United States Patent 11,492,591 (UNIVERSAL DONOR STEM CELLS AND RELATED METHODS) - sequence listing, part 2

SEQ ID NO: 28427 - DNA, 20 bp, Artificial
  CRISPR gRNA sequence
aatgttgatccaggctgtgt

SEQ ID NO: 28428 - DNA, 20 bp, Artificial
  CRISPR gRNA sequence
atccaggctgtgtgaccctg

SEQ ID NO: 28429 - DNA, 20 bp, Artificial
  CRISPR gRNA sequence
tgtgaccctgtgtgagctat

SEQ ID NO: 28430 - DNA, 20 bp, Artificial
  CRISPR gRNA sequence
tgtgagctatttgatcgcct

SEQ ID NO: 28431 - DNA, 20 bp, Artificial
  CRISPR gRNA sequence
tttgatcgcctagtgcctca

SEQ ID NO: 28432 - DNA, 20 bp, Artificial
  CRISPR gRNA sequence
gatcgcctagtgcctcagtt

SEQ ID NO: 28433 - DNA, 20 bp, Artificial
  CRISPR gRNA sequence
atcgcctagtgcctcagttt

SEQ ID NO: 28434 - DNA, 20 bp, Artificial
  CRISPR gRNA sequence
gtgcctcagtttccctatat

SEQ ID NO: 28435 - DNA, 20 bp, Artificial
  CRISPR gRNA sequence
agtttccctatatgtaaaat

SEQ ID NO: 28436 - DNA, 20 bp, Artificial
  CRISPR gRNA sequence
ccctatatgtaaaatggaga

SEQ ID NO: 28437 - DNA, 20 bp, Artificial
  CRISPR gRNA sequence
cctatatgtaaaatggagat

SEQ ID NO: 28438 - DNA, 20 bp, Artificial
  CRISPR gRNA sequence
tatgtaaaatggagataaga

SEQ ID NO: 28439 - DNA, 20 bp, Artificial
  CRISPR gRNA sequence
agagtcttgaggagtaaatg

SEQ ID NO: 28440 - DNA, 20 bp, Artificial
  CRISPR gRNA sequence
gaggagtaaatgagatctag

SEQ ID NO: 28441 - DNA, 20 bp, Artificial
  CRISPR gRNA sequence
aggagtaaatgagatctagg

SEQ ID NO: 28442 - DNA, 20 bp, Artificial
  CRISPR gRNA sequence
ggccgagggaagggcctagc

SEQ ID NO: 28443 - DNA, 20 bp, Artificial
  CRISPR gRNA sequence
gcatgcccctggcttataat

SEQ ID NO: 28444 - DNA, 20 bp, Artificial
  CRISPR gRNA sequence
gcttataataaatgctcaac

SEQ ID NO: 28445 - DNA, 20 bp, Artificial
  CRISPR gRNA sequence
ataataaatgctcaacaaat

SEQ ID NO: 28446 - DNA, 20 bp, Artificial
  CRISPR gRNA sequence
taataaatgctcaacaaatg

SEQ ID NO: 28447 - DNA, 20 bp, Artificial
  CRISPR gRNA sequence
aacaaatggttccttttgtt

SEQ ID NO: 28448 - DNA, 20 bp, Artificial
  CRISPR gRNA sequence
cttttgttattaaaatgcaa

SEQ ID NO: 28449 - DNA, 20 bp, Artificial
  CRISPR gRNA sequence
ttgttattaaaatgcaaagg

SEQ ID NO: 28450 - DNA, 20 bp, Artificial
  CRISPR gRNA sequence
tgttattaaaatgcaaaggc

SEQ ID NO: 28451 - DNA, 20 bp, Artificial
  CRISPR gRNA sequence
gttattaaaatgcaaaggca

SEQ ID NO: 28452 - DNA, 20 bp, Artificial
  CRISPR gRNA sequence
ttattaaaatgcaaaggcat

SEQ ID NO: 28453 - DNA, 20 bp, Artificial
  CRISPR gRNA sequence
ttaaaatgcaaaggcatatt

SEQ ID NO: 28454 - DNA, 20 bp, Artificial
  CRISPR gRNA sequence
aaatgcaaaggcatattagt

SEQ ID NO: 28455 - DNA, 20 bp, Artificial
  CRISPR gRNA sequence
gtcaaccacctggtttacca

SEQ ID NO: 28456 - DNA, 20 bp, Artificial
  CRISPR gRNA sequence
gtttaccactggcagtggtc

SEQ ID NO: 28457 - DNA, 20 bp, Artificial
  CRISPR gRNA sequence
accactggcagtggtcgtca

SEQ ID NO: 28458 - DNA, 20 bp, Artificial
  CRISPR gRNA sequence
ccactggcagtggtcgtcag

SEQ ID NO: 28459 - DNA, 20 bp, Artificial
  CRISPR gRNA sequence
gcagtggtcgtcagctggca

SEQ ID NO: 28460 - DNA, 20 bp, Artificial
  CRISPR gRNA sequence
gcatttcaggaccccttccc

SEQ ID NO: 28461 - DNA, 20 bp, Artificial
  CRISPR gRNA sequence
caggaccccttccccaggct

SEQ ID NO: 28462 - DNA, 20 bp, Artificial
  CRISPR gRNA sequence
aggaccccttccccaggctg

SEQ ID NO: 28463 - DNA, 20 bp, Artificial
  CRISPR gRNA sequence
ccccaggctgcggcgggaga

SEQ ID NO: 28464 - DNA, 20 bp, Artificial
  CRISPR gRNA sequence
cccaggctgcggcgggagaa

SEQ ID NO: 28465 - DNA, 20 bp, Artificial
  CRISPR gRNA sequence
cggcgggagaagggtatctg

SEQ ID NO: 28466 - DNA, 20 bp, Artificial
  CRISPR gRNA sequence
tggatgttgggaagagtaag

SEQ ID NO: 28467 - DNA, 20 bp, Artificial
  CRISPR gRNA sequence
ggaagagtaagaactggctc

SEQ ID NO: 28468 - DNA, 20 bp, Artificial
  CRISPR gRNA sequence
gctccctacttagagacaaa

SEQ ID NO: 28469 - DNA, 20 bp, Artificial
  CRISPR gRNA sequence
cctacttagagacaaaagct

SEQ ID NO: 28470 - DNA, 20 bp, Artificial
  CRISPR gRNA sequence
cttagagacaaaagctgggg

SEQ ID NO: 28471 - DNA, 20 bp, Artificial
  CRISPR gRNA sequence
agagacaaaagctggggagc

SEQ ID NO: 28472 - DNA, 20 bp, Artificial
  CRISPR gRNA sequence
gagacaaaagctggggagcc

SEQ ID NO: 28473 - DNA, 20 bp, Artificial
  CRISPR gRNA sequence
gggagccccaagatgggagc

SEQ ID NO: 28474 - DNA, 20 bp, Artificial
  CRISPR gRNA sequence
acctctttttcttttctttt

SEQ ID NO: 28475 - DNA, 20 bp, Artificial
  CRISPR gRNA sequence
cctctttttcttttcttttt

SEQ ID NO: 28476 - DNA, 20 bp, Artificial
  CRISPR gRNA sequence
tttttcttttctttttttgt

SEQ ID NO: 28477 - DNA, 20 bp, Artificial
  CRISPR gRNA sequence
tttcttttctttttttgttt

SEQ ID NO: 28478 - DNA, 20 bp, Artificial
  CRISPR gRNA sequence
ttcttttctttttttgtttt

SEQ ID NO: 28479 - DNA, 20 bp, Artificial
  CRISPR gRNA sequence
tcttttctttttttgttttt

SEQ ID NO: 28480 - DNA, 20 bp, Artificial
  CRISPR gRNA sequence
cttttctttttttgtttttt

SEQ ID NO: 28481 - DNA, 20 bp, Artificial
  CRISPR gRNA sequence
ttttctttttttgttttttt

SEQ ID NO: 28482 - DNA, 20 bp, Artificial
  CRISPR gRNA sequence
ttctttttttgttttttttc

SEQ ID NO: 28483 - DNA, 20 bp, Artificial
  CRISPR gRNA sequence
tctttttttgttttttttct

SEQ ID NO: 28484 - DNA, 20 bp, Artificial
  CRISPR gRNA sequence
ctttttttgttttttttctt

SEQ ID NO: 28485 - DNA, 20 bp, Artificial
  CRISPR gRNA sequence
tttttttgttttttttcttt

SEQ ID NO: 28486 - DNA, 20 bp, Artificial
  CRISPR gRNA sequence
tttttgttttttttcttttt

SEQ ID NO: 28487 - DNA, 20 bp, Artificial
  CRISPR gRNA sequence
ttttgttttttttctttttt

SEQ ID NO: 28488 - DNA, 20 bp, Artificial
  CRISPR gRNA sequence
tttgttttttttcttttttg

SEQ ID NO: 28489 - DNA, 20 bp, Artificial
  CRISPR gRNA sequence
ttgttttttttcttttttga

SEQ ID NO: 28490 - DNA, 20 bp, Artificial
  CRISPR gRNA sequence
tgttttttttcttttttgag

SEQ ID NO: 28491 - DNA, 20 bp, Artificial
  CRISPR gRNA sequence
gttttttttcttttttgaga

SEQ ID NO: 28492 - DNA, 20 bp, Artificial
  CRISPR gRNA sequence
ttttttttcttttttgagac

SEQ ID NO: 28493 - DNA, 20 bp, Artificial
  CRISPR gRNA sequence
tttttcttttttgagacagg

SEQ ID NO: 28494 - DNA, 20 bp, Artificial
  CRISPR gRNA sequence
ttttcttttttgagacaggg

SEQ ID NO: 28495 - DNA, 20 bp, Artificial
  CRISPR gRNA sequence
tttcttttttgagacagggt

SEQ ID NO: 28496 - DNA, 20 bp, Artificial
  CRISPR gRNA sequence
ttcttttttgagacagggtc

SEQ ID NO: 28497 - DNA, 20 bp, Artificial
  CRISPR gRNA sequence
tcttttttgagacagggtct

SEQ ID NO: 28498 - DNA, 20 bp, Artificial
  CRISPR gRNA sequence
cttttttgagacagggtctc

SEQ ID NO: 28499 - DNA, 20 bp, Artificial
  CRISPR gRNA sequence
ttttttgagacagggtctcg

SEQ ID NO: 28500 - DNA, 20 bp, Artificial
  CRISPR gRNA sequence
ttttgagacagggtctcgct

SEQ ID NO: 28501 - DNA, 20 bp, Artificial
  CRISPR gRNA sequence
tttgagacagggtctcgctc

SEQ ID NO: 28502 - DNA, 20 bp, Artificial
  CRISPR gRNA sequence
ttgagacagggtctcgctct

SEQ ID NO: 28503 - DNA, 20 bp, Artificial
  CRISPR gRNA sequence
tgagacagggtctcgctctt

SEQ ID NO: 28504 - DNA, 20 bp, Artificial
  CRISPR gRNA sequence
gagacagggtctcgctctta

SEQ ID NO: 28505 - DNA, 20 bp, Artificial
  CRISPR gRNA sequence
agacagggtctcgctcttac

SEQ ID NO: 28506 - DNA, 20 bp, Artificial
  CRISPR gRNA sequence
gctcttacccaggctggagt

SEQ ID NO: 28507 - DNA, 20 bp, Artificial
  CRISPR gRNA sequence
ttacccaggctggagtgcag

SEQ ID NO: 28508 - DNA, 20 bp, Artificial
  CRISPR gRNA sequence
acccaggctggagtgcagtg

SEQ ID NO: 28509 - DNA, 20 bp, Artificial
  CRISPR gRNA sequence
cccaggctggagtgcagtgg

SEQ ID NO: 28510 - DNA, 20 bp, Artificial
  CRISPR gRNA sequence
gagtgcagtggtgtgatcat

SEQ ID NO: 28511 - DNA, 20 bp, Artificial
  CRISPR gRNA sequence
actgcatcctccacctcctg

SEQ ID NO: 28512 - DNA, 20 bp, Artificial
  CRISPR gRNA sequence
catcctccacctcctgggct

SEQ ID NO: 28513 - DNA, 20 bp, Artificial
  CRISPR gRNA sequence
cacctcctgggctcaagcga

SEQ ID NO: 28514 - DNA, 20 bp, Artificial
  CRISPR gRNA sequence
ctgggctcaagcgatgcttc

SEQ ID NO: 28515 - DNA, 20 bp, Artificial
  CRISPR gRNA sequence
ggctcaagcgatgcttccac

SEQ ID NO: 28516 - DNA, 20 bp, Artificial
  CRISPR gRNA sequence
aagcgatgcttccacctcag

SEQ ID NO: 28517 - DNA, 20 bp, Artificial
  CRISPR gRNA sequence
ccacctcagcctcctaagaa

SEQ ID NO: 28518 - DNA, 20 bp, Artificial
  CRISPR gRNA sequence
cacctcagcctcctaagaag

SEQ ID NO: 28519 - DNA, 20 bp, Artificial
  CRISPR gRNA sequence
agcctcctaagaagctgaga

SEQ ID NO: 28520 - DNA, 20 bp, Artificial
  CRISPR gRNA sequence
ctaagaagctgagaccacag

SEQ ID NO: 28521 - DNA, 20 bp, Artificial
  CRISPR gRNA sequence
agaagctgagaccacaggac

SEQ ID NO: 28522 - DNA, 20 bp, Artificial
  CRISPR gRNA sequence
agaccacaggacacaccacc

SEQ ID NO: 28523 - DNA, 20 bp, Artificial
  CRISPR gRNA sequence
ggctaattattgtgtttttt

SEQ ID NO: 28524 - DNA, 20 bp, Artificial
  CRISPR gRNA sequence
gctaattattgtgttttttg

SEQ ID NO: 28525 - DNA, 20 bp, Artificial
  CRISPR gRNA sequence
attattgtgttttttgtaga

SEQ ID NO: 28526 - DNA, 20 bp, Artificial
  CRISPR gRNA sequence
ttgtgttttttgtagagact

SEQ ID NO: 28527 - DNA, 20 bp, Artificial
  CRISPR gRNA sequence
tgttttttgtagagactgag

SEQ ID NO: 28528 - DNA, 20 bp, Artificial
  CRISPR gRNA sequence
tttgtagagactgagtctca

SEQ ID NO: 28529 - DNA, 20 bp, Artificial
  CRISPR gRNA sequence
ttgtagagactgagtctcac

SEQ ID NO: 28530 - DNA, 20 bp, Artificial
  CRISPR gRNA sequence
tgtagagactgagtctcact

SEQ ID NO: 28531 - DNA, 20 bp, Artificial
  CRISPR gRNA sequence
gtagagactgagtctcacta

SEQ ID NO: 28532 - DNA, 20 bp, Artificial
  CRISPR gRNA sequence
tagagactgagtctcactat

SEQ ID NO: 28533 - DNA, 20 bp, Artificial
  CRISPR gRNA sequence
agtctcactatgttgcccaa

SEQ ID NO: 28534 - DNA, 20 bp, Artificial
  CRISPR gRNA sequence
actatgttgcccaagctggt

SEQ ID NO: 28535 - DNA, 20 bp, Artificial
  CRISPR gRNA sequence
tgttgcccaagctggtcttg

SEQ ID NO: 28536 - DNA, 20 bp, Artificial
  CRISPR gRNA sequence
cccaagctggtcttgaactc

SEQ ID NO: 28537 - DNA, 20 bp, Artificial
  CRISPR gRNA sequence
gtcttgaactcctgggctca

SEQ ID NO: 28538 - DNA, 20 bp, Artificial
  CRISPR gRNA sequence
gaactcctgggctcaagcag

SEQ ID NO: 28539 - DNA, 20 bp, Artificial
  CRISPR gRNA sequence
aactcctgggctcaagcagt

SEQ ID NO: 28540 - DNA, 20 bp, Artificial
  CRISPR gRNA sequence
ctgggctcaagcagtcctct

SEQ ID NO: 28541 - DNA, 20 bp, Artificial
  CRISPR gRNA sequence
ggctcaagcagtcctcttac

SEQ ID NO: 28542 - DNA, 20 bp, Artificial
  CRISPR gRNA sequence
aagcagtcctcttaccttgg

SEQ ID NO: 28543 - DNA, 20 bp, Artificial
  CRISPR gRNA sequence
ttaccttggcctcccaaaat

SEQ ID NO: 28544 - DNA, 20 bp, Artificial
  CRISPR gRNA sequence
accttggcctcccaaaatgc

SEQ ID NO: 28545 - DNA, 20 bp, Artificial
  CRISPR gRNA sequence
ccttggcctcccaaaatgct

SEQ ID NO: 28546 - DNA, 20 bp, Artificial
  CRISPR gRNA sequence
ggcctcccaaaatgctggaa

SEQ ID NO: 28547 - DNA, 20 bp, Artificial
  CRISPR gRNA sequence
gcctcccaaaatgctggaat

SEQ ID NO: 28548 - DNA, 20 bp, Artificial
  CRISPR gRNA sequence
ccaaaatgctggaattacag

SEQ ID NO: 28549 - DNA, 20 bp, Artificial
  CRISPR gRNA sequence
gaattacagacatgagccac

SEQ ID NO: 28550 - DNA, 20 bp, Artificial
  CRISPR gRNA sequence
cagacatgagccactgttcc

SEQ ID NO: 28551 - DNA, 20 bp, Artificial
  CRISPR gRNA sequence
ttcccagcctcaactggcct

SEQ ID NO: 28552 - DNA, 20 bp, Artificial
  CRISPR gRNA sequence
ccagcctcaactggcctctt

SEQ ID NO: 28553 - DNA, 20 bp, Artificial
  CRISPR gRNA sequence
aactggcctcttatgggggg

SEQ ID NO: 28554 - DNA, 20 bp, Artificial
  CRISPR gRNA sequence
gcctcttatggggggctatg

SEQ ID NO: 28555 - DNA, 20 bp, Artificial
  CRISPR gRNA sequence
ttatggggggctatgaaatc

SEQ ID NO: 28556 - DNA, 20 bp, Artificial
  CRISPR gRNA sequence
atggggggctatgaaatcta

SEQ ID NO: 28557 - DNA, 20 bp, Artificial
  CRISPR gRNA sequence
tggggggctatgaaatctac

SEQ ID NO: 28558 - DNA, 20 bp, Artificial
  CRISPR gRNA sequence
tgaaatctaccccaagcaga

SEQ ID NO: 28559 - DNA, 20 bp, Artificial
  CRISPR gRNA sequence
ccccaagcagaaaagattgg

SEQ ID NO: 28560 - DNA, 20 bp, Artificial
  CRISPR gRNA sequence
gggtcctacgtggaagggtt

SEQ ID NO: 28561 - DNA, 20 bp, Artificial
  CRISPR gRNA sequence
cgtggaagggttgcagggac

SEQ ID NO: 28562 - DNA, 20 bp, Artificial
  CRISPR gRNA sequence
cagggacctaagaggctggg

SEQ ID NO: 28563 - DNA, 20 bp, Artificial
  CRISPR gRNA sequence
agaggctggggtggaaggga

SEQ ID NO: 28564 - DNA, 20 bp, Artificial
  CRISPR gRNA sequence
gggtggaagggaagaggagg

SEQ ID NO: 28565 - DNA, 20 bp, Artificial
  CRISPR gRNA sequence
agacaggacctgacttctgt

SEQ ID NO: 28566 - DNA, 20 bp, Artificial
  CRISPR gRNA sequence
acttctgtgccttgtctctg

SEQ ID NO: 28567 - DNA, 20 bp, Artificial
  CRISPR gRNA sequence
ctgtgccttgtctctgcccc

SEQ ID NO: 28568 - DNA, 20 bp, Artificial
  CRISPR gRNA sequence
tgtgccttgtctctgcccca

SEQ ID NO: 28569 - DNA, 20 bp, Artificial
  CRISPR gRNA sequence
tgccttgtctctgccccacc

SEQ ID NO: 28570 - DNA, 20 bp, Artificial
  CRISPR gRNA sequence
gtctctgccccaccctgggg

SEQ ID NO: 28571 - DNA, 20 bp, Artificial
  CRISPR gRNA sequence
tctctgccccaccctggggc

SEQ ID NO: 28572 - DNA, 20 bp, Artificial
  CRISPR gRNA sequence
tgccccaccctggggctgaa

SEQ ID NO: 28573 - DNA, 20 bp, Artificial
  CRISPR gRNA sequence
ccccaccctggggctgaatg

SEQ ID NO: 28574 - DNA, 20 bp, Artificial
  CRISPR gRNA sequence
gggctgaatgaggggctgtg

SEQ ID NO: 28575 - DNA, 20 bp, Artificial
  CRISPR gRNA sequence
aatgaggggctgtgactgtg

SEQ ID NO: 28576 - DNA, 20 bp, Artificial
  CRISPR gRNA sequence
tgactgtgactggaggtctt

SEQ ID NO: 28577 - DNA, 20 bp, Artificial
  CRISPR gRNA sequence
tgactggaggtcttaccctt

SEQ ID NO: 28578 - DNA, 20 bp, Artificial
  CRISPR gRNA sequence
gaggtcttacccttgctctt

SEQ ID NO: 28579 - DNA, 20 bp, Artificial
  CRISPR gRNA sequence
acccttgctctttgcctcct

SEQ ID NO: 28580 - DNA, 20 bp, Artificial
  CRISPR gRNA sequence
cccttgctctttgcctccta

SEQ ID NO: 28581 - DNA, 20 bp, Artificial
  CRISPR gRNA sequence
gctctttgcctcctaggctg

SEQ ID NO: 28582 - DNA, 20 bp, Artificial
  CRISPR gRNA sequence
ctctttgcctcctaggctgg

SEQ ID NO: 28583 - DNA, 20 bp, Artificial
  CRISPR gRNA sequence
tttgcctcctaggctgggcc

SEQ ID NO: 28584 - DNA, 20 bp, Artificial
  CRISPR gRNA sequence
tgcctcctaggctgggccct

SEQ ID NO: 28585 - DNA, 20 bp, Artificial
  CRISPR gRNA sequence
gcctcctaggctgggccctg

SEQ ID NO: 28586 - DNA, 20 bp, Artificial
  CRISPR gRNA sequence
cctcctaggctgggccctgt

SEQ ID NO: 28587 - DNA, 20 bp, Artificial
  CRISPR gRNA sequence
ctaggctgggccctgtctca

SEQ ID NO: 28588 - DNA, 20 bp, Artificial
  CRISPR gRNA sequence
ggctgggccctgtctcaggc

SEQ ID NO: 28589 - DNA, 20 bp, Artificial
  CRISPR gRNA sequence
ggccctgtctcaggccccca

SEQ ID NO: 28590 - DNA, 20 bp, Artificial
  CRISPR gRNA sequence
tctcaggcccccaggctttc

SEQ ID NO: 28591 - DNA, 20 bp, Artificial
  CRISPR gRNA sequence
aggcccccaggctttcccca

SEQ ID NO: 28592 - DNA, 20 bp, Artificial
  CRISPR gRNA sequence
tccccaaactggtgcggatc

SEQ ID NO: 28593 - DNA, 20 bp, Artificial
  CRISPR gRNA sequence
ccccaaactggtgcggatcc

SEQ ID NO: 28594 - DNA, 20 bp, Artificial
  CRISPR gRNA sequence
cccaaactggtgcggatcct

SEQ ID NO: 28595 - DNA, 20 bp, Artificial
  CRISPR gRNA sequence
gtgcggatcctcacggcctt

SEQ ID NO: 28596 - DNA, 20 bp, Artificial
  CRISPR gRNA sequence
acggccttttcctccctgca

SEQ ID NO: 28597 - DNA, 20 bp, Artificial
  CRISPR gRNA sequence
ttcctccctgcagcatctgg

SEQ ID NO: 28598 - DNA, 20 bp, Artificial
  CRISPR gRNA sequence
tcctccctgcagcatctgga

SEQ ID NO: 28599 - DNA, 20 bp, Artificial
  CRISPR gRNA sequence
cctccctgcagcatctggag

SEQ ID NO: 28600 - DNA, 20 bp, Artificial
  CRISPR gRNA sequence
ctccctgcagcatctggagt

SEQ ID NO: 28601 - DNA, 20 bp, Artificial
  CRISPR gRNA sequence
cctgcagcatctggagtgag

SEQ ID NO: 28602 - DNA, 20 bp, Artificial
  CRISPR gRNA sequence
cagcatctggagtgagtata

SEQ ID NO: 28603 - DNA, 20 bp, Artificial
  CRISPR gRNA sequence
gagtgagtatagactctggg

SEQ ID NO: 28604 - DNA, 20 bp, Artificial
  CRISPR gRNA sequence
tgggaccccttcctctcaac

SEQ ID NO: 28605 - DNA, 20 bp, Artificial
  CRISPR gRNA sequence
ggaccccttcctctcaacat

SEQ ID NO: 28606 - DNA, 20 bp, Artificial
  CRISPR gRNA sequence
cctctcaacatctgggtgca

SEQ ID NO: 28607 - DNA, 20 bp, Artificial
  CRISPR gRNA sequence
ctctcaacatctgggtgcag

SEQ ID NO: 28608 - DNA, 20 bp, Artificial
  CRISPR gRNA sequence
tcaacatctgggtgcagtgc

SEQ ID NO: 28609 - DNA, 20 bp, Artificial
  CRISPR gRNA sequence
aacatctgggtgcagtgctg

SEQ ID NO: 28610 - DNA, 20 bp, Artificial
  CRISPR gRNA sequence
ggtgcagtgctgtgatcata

SEQ ID NO: 28611 - DNA, 20 bp, Artificial
  CRISPR gRNA sequence
tgatcatagctcactgcagc

SEQ ID NO: 28612 - DNA, 20 bp, Artificial
  CRISPR gRNA sequence
actgcagcctcgaattcctg

SEQ ID NO: 28613 - DNA, 20 bp, Artificial
  CRISPR gRNA sequence
cagcctcgaattcctggcct

SEQ ID NO: 28614 - DNA, 20 bp, Artificial
  CRISPR gRNA sequence
gaattcctggcctcaagtag

SEQ ID NO: 28615 - DNA, 20 bp, Artificial
  CRISPR gRNA sequence
ctggcctcaagtagtcctcc

SEQ ID NO: 28616 - DNA, 20 bp, Artificial
  CRISPR gRNA sequence
gcctcaagtagtcctcctgc

SEQ ID NO: 28617 - DNA, 20 bp, Artificial
  CRISPR gRNA sequence
aagtagtcctcctgcctcag

SEQ ID NO: 28618 - DNA, 20 bp, Artificial
  CRISPR gRNA sequence
ctgcctcagcctcctgagta

SEQ ID NO: 28619 - DNA, 20 bp, Artificial
  CRISPR gRNA sequence
cctcagcctcctgagtagct

SEQ ID NO: 28620 - DNA, 20 bp, Artificial
  CRISPR gRNA sequence
agcctcctgagtagctggga

SEQ ID NO: 28621 - DNA, 20 bp, Artificial
  CRISPR gRNA sequence
ctgagtagctgggaccacag

SEQ ID NO: 28622 - DNA, 20 bp, Artificial
  CRISPR gRNA sequence
agtagctgggaccacaggtg

SEQ ID NO: 28623 - DNA, 20 bp, Artificial
  CRISPR gRNA sequence
ggaccacaggtgcatgctac

SEQ ID NO: 28624 - DNA, 20 bp, Artificial
  CRISPR gRNA sequence
cagtgcccagcaacctctgg

SEQ ID NO: 28625 - DNA, 20 bp, Artificial
  CRISPR gRNA sequence
tgggttttgacaaccccaaa

SEQ ID NO: 28626 - DNA, 20 bp, Artificial
  CRISPR gRNA sequence
ggttttgacaaccccaaatc

SEQ ID NO: 28627 - DNA, 20 bp, Artificial
  CRISPR gRNA sequence
tgacaaccccaaatcctgcc

SEQ ID NO: 28628 - DNA, 20 bp, Artificial
  CRISPR gRNA sequence
gacaaccccaaatcctgccc

SEQ ID NO: 28629 - DNA, 20 bp, Artificial
  CRISPR gRNA sequence
acaaccccaaatcctgcccc

SEQ ID NO: 28630 - DNA, 20 bp, Artificial
  CRISPR gRNA sequence
cccccaaggcacctgcagaa

SEQ ID NO: 28631 - DNA, 20 bp, Artificial
  CRISPR gRNA sequence
cagaaagaaaagccctcact

SEQ ID NO: 28632 - DNA, 20 bp, Artificial
  CRISPR gRNA sequence
actttgtccctttttttctc

SEQ ID NO: 28633 - DNA, 20 bp, Artificial
  CRISPR gRNA sequence
tgtccctttttttctctctt

SEQ ID NO: 28634 - DNA, 20 bp, Artificial
  CRISPR gRNA sequence
gtccctttttttctctcttc

SEQ ID NO: 28635 - DNA, 20 bp, Artificial
  CRISPR gRNA sequence
tccctttttttctctcttcc

SEQ ID NO: 28636 - DNA, 20 bp, Artificial
  CRISPR gRNA sequence
tttttctctcttccgcctac

SEQ ID NO: 28637 - DNA, 20 bp, Artificial
  CRISPR gRNA sequence
ttttctctcttccgcctact

SEQ ID NO: 28638 - DNA, 20 bp, Artificial
  CRISPR gRNA sequence
tttctctcttccgcctactg

SEQ ID NO: 28639 - DNA, 20 bp, Artificial
  CRISPR gRNA sequence
ttctctcttccgcctactgc

SEQ ID NO: 28640 - DNA, 20 bp, Artificial
  CRISPR gRNA sequence
tctctcttccgcctactgca

SEQ ID NO: 28641 - DNA, 20 bp, Artificial
  CRISPR gRNA sequence
ctctcttccgcctactgcat

SEQ ID NO: 28642 - DNA, 20 bp, Artificial
  CRISPR gRNA sequence
tctcttccgcctactgcatc

SEQ ID NO: 28643 - DNA, 20 bp, Artificial
  CRISPR gRNA sequence
tcttccgcctactgcatcct

SEQ ID NO: 28644 - DNA, 20 bp, Artificial
  CRISPR gRNA sequence
ttccgcctactgcatcctca

SEQ ID NO: 28645 - DNA, 20 bp, Artificial
  CRISPR gRNA sequence
ccgcctactgcatcctcaat

SEQ ID NO: 28646 - DNA, 20 bp, Artificial
  CRISPR gRNA sequence
cgcctactgcatcctcaatg

SEQ ID NO: 28647 - DNA, 20 bp, Artificial
  CRISPR gRNA sequence
ctgcatcctcaatgtggctg

SEQ ID NO: 28648 - DNA, 20 bp, Artificial
  CRISPR gRNA sequence
catcctcaatgtggctggca

SEQ ID NO: 28649 - DNA, 20 bp, Artificial
  CRISPR gRNA sequence
aatgtggctggcacatgagt

SEQ ID NO: 28650 - DNA, 20 bp, Artificial
  CRISPR gRNA sequence
gcacatgagtgatgagatga

SEQ ID NO: 28651 - DNA, 20 bp, Artificial
  CRISPR gRNA sequence
tagatcctttcgtgaccttt

SEQ ID NO: 28652 - DNA, 20 bp, Artificial
  CRISPR gRNA sequence
tcgtgacctttgaaactcct

SEQ ID NO: 28653 - DNA, 20 bp, Artificial
  CRISPR gRNA sequence
cgtgacctttgaaactcctt

SEQ ID NO: 28654 - DNA, 20 bp, Artificial
  CRISPR gRNA sequence
gtgacctttgaaactccttt

SEQ ID NO: 28655 - DNA, 20 bp, Artificial
  CRISPR gRNA sequence
tgaaactcctttcctcacaa

SEQ ID NO: 28656 - DNA, 20 bp, Artificial
  CRISPR gRNA sequence
gaaactcctttcctcacaac

SEQ ID NO: 28657 - DNA, 20 bp, Artificial
  CRISPR gRNA sequence
aaactcctttcctcacaacc

SEQ ID NO: 28658 - DNA, 20 bp, Artificial
  CRISPR gRNA sequence
ctttcctcacaacctcattt

SEQ ID NO: 28659 - DNA, 20 bp, Artificial
  CRISPR gRNA sequence
tcctcacaacctcatttgct

SEQ ID NO: 28660 - DNA, 20 bp, Artificial
  CRISPR gRNA sequence
cctcacaacctcatttgctg

SEQ ID NO: 28661 - DNA, 20 bp, Artificial
  CRISPR gRNA sequence
ctcacaacctcatttgctgc

SEQ ID NO: 28662 - DNA, 20 bp, Artificial
  CRISPR gRNA sequence
acaacctcatttgctgctct

SEQ ID NO: 28663 - DNA, 20 bp, Artificial
  CRISPR gRNA sequence
atttgctgctctcagcaatt

SEQ ID NO: 28664 - DNA, 20 bp, Artificial
  CRISPR gRNA sequence
gctgctctcagcaattcagc

SEQ ID NO: 28665 - DNA, 20 bp, Artificial
  CRISPR gRNA sequence
ctgctctcagcaattcagct

SEQ ID NO: 28666 - DNA, 20 bp, Artificial
  CRISPR gRNA sequence
ctctcagcaattcagctggg

SEQ ID NO: 28667 - DNA, 20 bp, Artificial
  CRISPR gRNA sequence
tcagcaattcagctggggag

SEQ ID NO: 28668 - DNA, 20 bp, Artificial
  CRISPR gRNA sequence
agcaattcagctggggaggg

SEQ ID NO: 28669 - DNA, 20 bp, Artificial
  CRISPR gRNA sequence
agctggggagggattgggga

SEQ ID NO: 28670 - DNA, 20 bp, Artificial
  CRISPR gRNA sequence
gggagggattggggagcata

SEQ ID NO: 28671 - DNA, 20 bp, Artificial
  CRISPR gRNA sequence
gggagcatagtcctacttta

SEQ ID NO: 28672 - DNA, 20 bp, Artificial
  CRISPR gRNA sequence
ctttacagtggaggttaagg

SEQ ID NO: 28673 - DNA, 20 bp, Artificial
  CRISPR gRNA sequence
tacagtggaggttaaggaag

SEQ ID NO: 28674 - DNA, 20 bp, Artificial
  CRISPR gRNA sequence
acagtggaggttaaggaagt

SEQ ID NO: 28675 - DNA, 20 bp, Artificial
  CRISPR gRNA sequence
cagtggaggttaaggaagtt

SEQ ID NO: 28676 - DNA, 20 bp, Artificial
  CRISPR gRNA sequence
aggaagttgccaagcctcag

SEQ ID NO: 28677 - DNA, 20 bp, Artificial
  CRISPR gRNA sequence
ccaagcctcaggggcttagt

SEQ ID NO: 28678 - DNA, 20 bp, Artificial
  CRISPR gRNA sequence
aggggcttagttcctaagaa

SEQ ID NO: 28679 - DNA, 20 bp, Artificial
  CRISPR gRNA sequence
agttcctaagaagctaaaca

SEQ ID NO: 28680 - DNA, 20 bp, Artificial
  CRISPR gRNA sequence
gttcctaagaagctaaacag

SEQ ID NO: 28681 - DNA, 20 bp, Artificial
  CRISPR gRNA sequence
ctaagaagctaaacagggat

SEQ ID NO: 28682 - DNA, 20 bp, Artificial
  CRISPR gRNA sequence
agaagctaaacagggattca

SEQ ID NO: 28683 - DNA, 20 bp, Artificial
  CRISPR gRNA sequence
aacagggattcaagtccatc

SEQ ID NO: 28684 - DNA, 20 bp, Artificial
  CRISPR gRNA sequence
aagtccatcatgagttagac

SEQ ID NO: 28685 - DNA, 20 bp, Artificial
  CRISPR gRNA sequence
gactttgccctctggctgcc

SEQ ID NO: 28686 - DNA, 20 bp, Artificial
  CRISPR gRNA sequence
tgccctctggctgcctggtt

SEQ ID NO: 28687 - DNA, 20 bp, Artificial
  CRISPR gRNA sequence
gccctctggctgcctggttg

SEQ ID NO: 28688 - DNA, 20 bp, Artificial
  CRISPR gRNA sequence
ccctctggctgcctggttgg

SEQ ID NO: 28689 - DNA, 20 bp, Artificial
  CRISPR gRNA sequence
tggctgcctggttggagccc

SEQ ID NO: 28690 - DNA, 20 bp, Artificial
  CRISPR gRNA sequence
gctgcctggttggagccccc

SEQ ID NO: 28691 - DNA, 20 bp, Artificial
  CRISPR gRNA sequence
cctggttggagcccccaggt

SEQ ID NO: 28692 - DNA, 20 bp, Artificial
  CRISPR gRNA sequence
gttggagcccccaggtgatg

SEQ ID NO: 28693 - DNA, 20 bp, Artificial
  CRISPR gRNA sequence
gagcccccaggtgatgaagt

SEQ ID NO: 28694 - DNA, 20 bp, Artificial
  CRISPR gRNA sequence
gtctgaaaagctcaggaatg

SEQ ID NO: 28695 - DNA, 20 bp, Artificial
  CRISPR gRNA sequence
aaaagctcaggaatgtgccg

SEQ ID NO: 28696 - DNA, 20 bp, Artificial
  CRISPR gRNA sequence
aggaatgtgccggctgccta

SEQ ID NO: 28697 - DNA, 20 bp, Artificial
  CRISPR gRNA sequence
cctatggtgtattagagctg

SEQ ID NO: 28698 - DNA, 20 bp, Artificial
  CRISPR gRNA sequence
tggtgtattagagctggggg

SEQ ID NO: 28699 - DNA, 20 bp, Artificial
  CRISPR gRNA sequence
gagctggggggtgggaaggg

SEQ ID NO: 28700 - DNA, 20 bp, Artificial
  CRISPR gRNA sequence
gggggtgggaagggcaggtg

SEQ ID NO: 28701 - DNA, 20 bp, Artificial
  CRISPR gRNA sequence
aggaggccctcactgggatg

SEQ ID NO: 28702 - DNA, 20 bp, Artificial
  CRISPR gRNA sequence
actgggatgggaagggtcag

SEQ ID NO: 28703 - DNA, 20 bp, Artificial
  CRISPR gRNA sequence
ggatgggaagggtcagatgg

SEQ ID NO: 28704 - DNA, 20 bp, Artificial
  CRISPR gRNA sequence
gctgatggcccccatctgat

SEQ ID NO: 28705 - DNA, 20 bp, Artificial
  CRISPR gRNA sequence
atggcccccatctgattcca

SEQ ID NO: 28706 - DNA, 20 bp, Artificial
  CRISPR gRNA sequence
attccacctgcagcctggat

SEQ ID NO: 28707 - DNA, 20 bp, Artificial
  CRISPR gRNA sequence
cacctgcagcctggatgcgc

SEQ ID NO: 28708 - DNA, 20 bp, Artificial
  CRISPR gRNA sequence
cagcctggatgcgctgagtg

SEQ ID NO: 28709 - DNA, 20 bp, Artificial
  CRISPR gRNA sequence
gatgcgctgagtgagaacaa

SEQ ID NO: 28710 - DNA, 20 bp, Artificial
  CRISPR gRNA sequence
agtgagaacaagatcgggga

SEQ ID NO: 28711 - DNA, 20 bp, Artificial
  CRISPR gRNA sequence
gcagctctcagccaccttcc

SEQ ID NO: 28712 - DNA, 20 bp, Artificial
  CRISPR gRNA sequence
tcagccaccttcccccagct

SEQ ID NO: 28713 - DNA, 20 bp, Artificial
  CRISPR gRNA sequence
agccaccttcccccagctga

SEQ ID NO: 28714 - DNA, 20 bp, Artificial
  CRISPR gRNA sequence
cccccagctgaagtccttgg

SEQ ID NO: 28715 - DNA, 20 bp, Artificial
  CRISPR gRNA sequence
ccccagctgaagtccttgga

SEQ ID NO: 28716 - DNA, 20 bp, Artificial
  CRISPR gRNA sequence
aagtccttggaaaccctcaa

SEQ ID NO: 28717 - DNA, 20 bp, Artificial
  CRISPR gRNA sequence
ggaaaccctcaagtgagtga

SEQ ID NO: 28718 - DNA, 20 bp, Artificial
  CRISPR gRNA sequence
gaaaccctcaagtgagtgag

SEQ ID NO: 28719 - DNA, 20 bp, Artificial
  CRISPR gRNA sequence
aagtgagtgagctgggcctg

SEQ ID NO: 28720 - DNA, 20 bp, Artificial
  CRISPR gRNA sequence
ggcctgcccttcctgctgaa

SEQ ID NO: 28721 - DNA, 20 bp, Artificial
  CRISPR gRNA sequence
cccttcctgctgaatcgggc

SEQ ID NO: 28722 - DNA, 20 bp, Artificial
  CRISPR gRNA sequence
cctgctgaatcgggccccca

SEQ ID NO: 28723 - DNA, 20 bp, Artificial
  CRISPR gRNA sequence
ctgctgaatcgggcccccaa

SEQ ID NO: 28724 - DNA, 20 bp, Artificial
  CRISPR gRNA sequence
ctgaatcgggcccccaaagt

SEQ ID NO: 28725 - DNA, 20 bp, Artificial
  CRISPR gRNA sequence
aatcgggcccccaaagtccg

SEQ ID NO: 28726 - DNA, 20 bp, Artificial
  CRISPR gRNA sequence
actttttcaaaattaattta

SEQ ID NO: 28727 - DNA, 20 bp, Artificial
  CRISPR gRNA sequence
tttcaaaattaatttaaatt

SEQ ID NO: 28728 - DNA, 20 bp, Artificial
  CRISPR gRNA sequence
ttcaaaattaatttaaattt

SEQ ID NO: 28729 - DNA, 20 bp, Artificial
  CRISPR gRNA sequence
tcaaaattaatttaaatttg

SEQ ID NO: 28730 - DNA, 20 bp, Artificial
  CRISPR gRNA sequence
caaaattaatttaaatttgt

SEQ ID NO: 28731 - DNA, 20 bp, Artificial
  CRISPR gRNA sequence
aaaattaatttaaatttgtt

SEQ ID NO: 28732 - DNA, 20 bp, Artificial
  CRISPR gRNA sequence
atttaaatttgtttttttag

SEQ ID NO: 28733 - DNA, 20 bp, Artificial
  CRISPR gRNA sequence
aaatttgtttttttagacaa

SEQ ID NO: 28734 - DNA, 20 bp, Artificial
  CRISPR gRNA sequence
aatttgtttttttagacaag

SEQ ID NO: 28735 - DNA, 20 bp, Artificial
  CRISPR gRNA sequence
gtttttttagacaagggctc

SEQ ID NO: 28736 - DNA, 20 bp, Artificial
  CRISPR gRNA sequence
tttttttagacaagggctcg

SEQ ID NO: 28737 - DNA, 20 bp, Artificial
  CRISPR gRNA sequence
ttttagacaagggctcgctg

SEQ ID NO: 28738 - DNA, 20 bp, Artificial
  CRISPR gRNA sequence
tttagacaagggctcgctgt

SEQ ID NO: 28739 - DNA, 20 bp, Artificial
  CRISPR gRNA sequence
ttagacaagggctcgctgtg

SEQ ID NO: 28740 - DNA, 20 bp, Artificial
  CRISPR gRNA sequence
tagacaagggctcgctgtgt

SEQ ID NO: 28741 - DNA, 20 bp, Artificial
  CRISPR gRNA sequence
agacaagggctcgctgtgtc

SEQ ID NO: 28742 - DNA, 20 bp, Artificial
  CRISPR gRNA sequence
gacaagggctcgctgtgtca

SEQ ID NO: 28743 - DNA, 20 bp, Artificial
  CRISPR gRNA sequence
gctgtgtcacccaggctaga

SEQ ID NO: 28744 - DNA, 20 bp, Artificial
  CRISPR gRNA sequence
tgtcacccaggctagaatat

SEQ ID NO: 28745 - DNA, 20 bp, Artificial
  CRISPR gRNA sequence
gaatatagtgctatgatcat

SEQ ID NO: 28746 - DNA, 20 bp, Artificial
  CRISPR gRNA sequence
tgatcatacctctgcagcct

SEQ ID NO: 28747 - DNA, 20 bp, Artificial
  CRISPR gRNA sequence
tgcagccttgaactcctggc

SEQ ID NO: 28748 - DNA, 20 bp, Artificial
  CRISPR gRNA sequence
cagccttgaactcctggcct

SEQ ID NO: 28749 - DNA, 20 bp, Artificial
  CRISPR gRNA sequence
gaactcctggcctcaaggaa

SEQ ID NO: 28750 - DNA, 20 bp, Artificial
  CRISPR gRNA sequence
aactcctggcctcaaggaat

SEQ ID NO: 28751 - DNA, 20 bp, Artificial
  CRISPR gRNA sequence
ctggcctcaaggaatctcct

SEQ ID NO: 28752 - DNA, 20 bp, Artificial
  CRISPR gRNA sequence
gcctcaaggaatctcctcac

SEQ ID NO: 28753 - DNA, 20 bp, Artificial
  CRISPR gRNA sequence
aaggaatctcctcacctccg

SEQ ID NO: 28754 - DNA, 20 bp, Artificial
  CRISPR gRNA sequence
ctcacctccgcttcccaaag

SEQ ID NO: 28755 - DNA, 20 bp, Artificial
  CRISPR gRNA sequence
acctccgcttcccaaagtgc

SEQ ID NO: 28756 - DNA, 20 bp, Artificial
  CRISPR gRNA sequence
cgcttcccaaagtgctggga

SEQ ID NO: 28757 - DNA, 20 bp, Artificial
  CRISPR gRNA sequence
cccaaagtgctgggattata

SEQ ID NO: 28758 - DNA, 20 bp, Artificial
  CRISPR gRNA sequence
ccaaagtgctgggattatag

SEQ ID NO: 28759 - DNA, 20 bp, Artificial
  CRISPR gRNA sequence
ggattataggtgtgacttac

SEQ ID NO: 28760 - DNA, 20 bp, Artificial
  CRISPR gRNA sequence
taggtgtgacttaccatgcc

SEQ ID NO: 28761 - DNA, 20 bp, Artificial
  CRISPR gRNA sequence
accatgcccagccccagtgg

SEQ ID NO: 28762 - DNA, 20 bp, Artificial
  CRISPR gRNA sequence
ccatgcccagccccagtgga

SEQ ID NO: 28763 - DNA, 20 bp, Artificial
  CRISPR gRNA sequence
atccattcactcattcacct

SEQ ID NO: 28764 - DNA, 20 bp, Artificial
  CRISPR gRNA sequence
actcattcacctattcaatc

SEQ ID NO: 28765 - DNA, 20 bp, Artificial
  CRISPR gRNA sequence
attcacctattcaatcagcc

SEQ ID NO: 28766 - DNA, 20 bp, Artificial
  CRISPR gRNA sequence
acctattcaatcagccattc

SEQ ID NO: 28767 - DNA, 20 bp, Artificial
  CRISPR gRNA sequence
ttcaatcagccattcatcct

SEQ ID NO: 28768 - DNA, 20 bp, Artificial
  CRISPR gRNA sequence
aatcagccattcatccttcc

SEQ ID NO: 28769 - DNA, 20 bp, Artificial
  CRISPR gRNA sequence
atccttccattcaatgattc

SEQ ID NO: 28770 - DNA, 20 bp, Artificial
  CRISPR gRNA sequence
ccattcaatgattcatccat

SEQ ID NO: 28771 - DNA, 20 bp, Artificial
  CRISPR gRNA sequence
cattcaatgattcatccatt

SEQ ID NO: 28772 - DNA, 20 bp, Artificial
  CRISPR gRNA sequence
aatgattcatccattcactt

SEQ ID NO: 28773 - DNA, 20 bp, Artificial
  CRISPR gRNA sequence
atccattcacttatgcagtc

SEQ ID NO: 28774 - DNA, 20 bp, Artificial
  CRISPR gRNA sequence
acttatgcagtcatttcttt

SEQ ID NO: 28775 - DNA, 20 bp, Artificial
  CRISPR gRNA sequence
atgcagtcatttctttactc

SEQ ID NO: 28776 - DNA, 20 bp, Artificial
  CRISPR gRNA sequence
tgcagtcatttctttactcc

SEQ ID NO: 28777 - DNA, 20 bp, Artificial
  CRISPR gRNA sequence
ctttactccctcatccaacc

SEQ ID NO: 28778 - DNA, 20 bp, Artificial
  CRISPR gRNA sequence
tttactccctcatccaaccg

SEQ ID NO: 28779 - DNA, 20 bp, Artificial
  CRISPR gRNA sequence
tactccctcatccaaccgct

SEQ ID NO: 28780 - DNA, 20 bp, Artificial
  CRISPR gRNA sequence
actccctcatccaaccgctc

SEQ ID NO: 28781 - DNA, 20 bp, Artificial
  CRISPR gRNA sequence
ctccctcatccaaccgctca

SEQ ID NO: 28782 - DNA, 20 bp, Artificial
  CRISPR gRNA sequence
cctcatccaaccgctcactc

SEQ ID NO: 28783 - DNA, 20 bp, Artificial
  CRISPR gRNA sequence
atccaaccgctcactcaatc

SEQ ID NO: 28784 - DNA, 20 bp, Artificial
  CRISPR gRNA sequence
actcaatcatttctttactt

SEQ ID NO: 28785 - DNA, 20 bp, Artificial
  CRISPR gRNA sequence
aatcatttctttacttaccc

SEQ ID NO: 28786 - DNA, 20 bp, Artificial
  CRISPR gRNA sequence
ctttacttacccaaccattt

SEQ ID NO: 28787 - DNA, 20 bp, Artificial
  CRISPR gRNA sequence
tttacttacccaaccattta

SEQ ID NO: 28788 - DNA, 20 bp, Artificial
  CRISPR gRNA sequence
tacttacccaaccatttatt

SEQ ID NO: 28789 - DNA, 20 bp, Artificial
  CRISPR gRNA sequence
acttacccaaccatttatta

SEQ ID NO: 28790 - DNA, 20 bp, Artificial
  CRISPR gRNA sequence
cttacccaaccatttattaa

SEQ ID NO: 28791 - DNA, 20 bp, Artificial
  CRISPR gRNA sequence
acccaaccatttattaattt

SEQ ID NO: 28792 - DNA, 20 bp, Artificial
  CRISPR gRNA sequence
cccaaccatttattaattta

SEQ ID NO: 28793 - DNA, 20 bp, Artificial
  CRISPR gRNA sequence
attaatttaatcaacaaata

SEQ ID NO: 28794 - DNA, 20 bp, Artificial
  CRISPR gRNA sequence
ttaatttaatcaacaaatat

SEQ ID NO: 28795 - DNA, 20 bp, Artificial
  CRISPR gRNA sequence
atttaatcaacaaatattta

SEQ ID NO: 28796 - DNA, 20 bp, Artificial
  CRISPR gRNA sequence
aatcaacaaatatttaagga

SEQ ID NO: 28797 - DNA, 20 bp, Artificial
  CRISPR gRNA sequence
atcaacaaatatttaaggag

SEQ ID NO: 28798 - DNA, 20 bp, Artificial
  CRISPR gRNA sequence
aaggaggacctactatgtgc

SEQ ID NO: 28799 - DNA, 20 bp, Artificial
  CRISPR gRNA sequence
aggaggacctactatgtgca

SEQ ID NO: 28800 - DNA, 20 bp, Artificial
  CRISPR gRNA sequence
ctatgtgcaggcacctttct

SEQ ID NO: 28801 - DNA, 20 bp, Artificial
  CRISPR gRNA sequence
tgtgcaggcacctttctagg

SEQ ID NO: 28802 - DNA, 20 bp, Artificial
  CRISPR gRNA sequence
tctaggccctggagacccag

SEQ ID NO: 28803 - DNA, 20 bp, Artificial
  CRISPR gRNA sequence
ctaggccctggagacccagc

SEQ ID NO: 28804 - DNA, 20 bp, Artificial
  CRISPR gRNA sequence
taggccctggagacccagct

SEQ ID NO: 28805 - DNA, 20 bp, Artificial
  CRISPR gRNA sequence
ggccctggagacccagcttt

SEQ ID NO: 28806 - DNA, 20 bp, Artificial
  CRISPR gRNA sequence
gagacccagctttaaacaaa

SEQ ID NO: 28807 - DNA, 20 bp, Artificial
  CRISPR gRNA sequence
taaacaaaacaaataaatcc

SEQ ID NO: 28808 - DNA, 20 bp, Artificial
  CRISPR gRNA sequence
aaacaaaacaaataaatccc

SEQ ID NO: 28809 - DNA, 20 bp, Artificial
  CRISPR gRNA sequence
aacaaaacaaataaatcccc

SEQ ID NO: 28810 - DNA, 20 bp, Artificial
  CRISPR gRNA sequence
acctcaggaatcttaaattc

SEQ ID NO: 28811 - DNA, 20 bp, Artificial
  CRISPR gRNA sequence
aggaatcttaaattctagtg

SEQ ID NO: 28812 - DNA, 20 bp, Artificial
  CRISPR gRNA sequence
aaattctagtgaggagacac

SEQ ID NO: 28813 - DNA, 20 bp, Artificial
  CRISPR gRNA sequence
aattctagtgaggagacaca

SEQ ID NO: 28814 - DNA, 20 bp, Artificial
  CRISPR gRNA sequence
tagtgaggagacacaatgaa

SEQ ID NO: 28815 - DNA, 20 bp, Artificial
  CRISPR gRNA sequence
gtgaggagacacaatgaaca

SEQ ID NO: 28816 - DNA, 20 bp, Artificial
  CRISPR gRNA sequence
taaagtatacagtaatgaaa

SEQ ID NO: 28817 - DNA, 20 bp, Artificial
  CRISPR gRNA sequence
ggtgacagaaaattatactg

SEQ ID NO: 28818 - DNA, 20 bp, Artificial
  CRISPR gRNA sequence
gtgacagaaaattatactgg

SEQ ID NO: 28819 - DNA, 20 bp, Artificial
  CRISPR gRNA sequence
tactggggggtgaaatagga

SEQ ID NO: 28820 - DNA, 20 bp, Artificial
  CRISPR gRNA sequence
gggggtgaaataggagagat

SEQ ID NO: 28821 - DNA, 20 bp, Artificial
  CRISPR gRNA sequence
ggatttatcaataaagcatt

SEQ ID NO: 28822 - DNA, 20 bp, Artificial
  CRISPR gRNA sequence
atcaataaagcattattatc

SEQ ID NO: 28823 - DNA, 20 bp, Artificial
  CRISPR gRNA sequence
tcaataaagcattattatca

SEQ ID NO: 28824 - DNA, 20 bp, Artificial
  CRISPR gRNA sequence
ttatcaaaacagtaaaactt

SEQ ID NO: 28825 - DNA, 20 bp, Artificial
  CRISPR gRNA sequence
tcaaaacagtaaaacttttt

SEQ ID NO: 28826 - DNA, 20 bp, Artificial
  CRISPR gRNA sequence
tttaaaaactgttctgggct

SEQ ID NO: 28827 - DNA, 20 bp, Artificial
  CRISPR gRNA sequence
ttaaaaactgttctgggctc

SEQ ID NO: 28828 - DNA, 20 bp, Artificial
  CRISPR gRNA sequence
taaaaactgttctgggctct

SEQ ID NO: 28829 - DNA, 20 bp, Artificial
  CRISPR gRNA sequence
aaaaactgttctgggctctg

SEQ ID NO: 28830 - DNA, 20 bp, Artificial
  CRISPR gRNA sequence
aaaactgttctgggctctgg

SEQ ID NO: 28831 - DNA, 20 bp, Artificial
  CRISPR gRNA sequence
ttctgggctctgggaagttg

SEQ ID NO: 28832 - DNA, 20 bp, Artificial
  CRISPR gRNA sequence
tgggctctgggaagttggag

SEQ ID NO: 28833 - DNA, 20 bp, Artificial
  CRISPR gRNA sequence
ggctctgggaagttggagat

SEQ ID NO: 28834 - DNA, 20 bp, Artificial
  CRISPR gRNA sequence
tgggaagttggagatggata

SEQ ID NO: 28835 - DNA, 20 bp, Artificial
  CRISPR gRNA sequence
ggaagttggagatggataag

SEQ ID NO: 28836 - DNA, 20 bp, Artificial
  CRISPR gRNA sequence
gagatggataagatacagga

SEQ ID NO: 28837 - DNA, 20 bp, Artificial
  CRISPR gRNA sequence
tttttctttttttcagacaa

SEQ ID NO: 28838 - DNA, 20 bp, Artificial
  CRISPR gRNA sequence
ttttctttttttcagacaag

SEQ ID NO: 28839 - DNA, 20 bp, Artificial
  CRISPR gRNA sequence
tttctttttttcagacaagg

SEQ ID NO: 28840 - DNA, 20 bp, Artificial
  CRISPR gRNA sequence
ttctttttttcagacaaggt

SEQ ID NO: 28841 - DNA, 20 bp, Artificial
  CRISPR gRNA sequence
tctttttttcagacaaggtc

SEQ ID NO: 28842 - DNA, 20 bp, Artificial
  CRISPR gRNA sequence
ctttttttcagacaaggtct

SEQ ID NO: 28843 - DNA, 20 bp, Artificial
  CRISPR gRNA sequence
tttttttcagacaaggtctc

SEQ ID NO: 28844 - DNA, 20 bp, Artificial
  CRISPR gRNA sequence
tttttcagacaaggtctcgc

SEQ ID NO: 28845 - DNA, 20 bp, Artificial
  CRISPR gRNA sequence
ttttcagacaaggtctcgct

SEQ ID NO: 28846 - DNA, 20 bp, Artificial
  CRISPR gRNA sequence
tttcagacaaggtctcgctc

SEQ ID NO: 28847 - DNA, 20 bp, Artificial
  CRISPR gRNA sequence
ttcagacaaggtctcgctct

SEQ ID NO: 28848 - DNA, 20 bp, Artificial
  CRISPR gRNA sequence
tcagacaaggtctcgctctg

SEQ ID NO: 28849 - DNA, 20 bp, Artificial
  CRISPR gRNA sequence
cagacaaggtctcgctctgt

SEQ ID NO: 28850 - DNA, 20 bp, Artificial
  CRISPR gRNA sequence
agacaaggtctcgctctgtc

SEQ ID NO: 28851 - DNA, 20 bp, Artificial
  CRISPR gRNA sequence
gctctgtcacccagggtgga

SEQ ID NO: 28852 - DNA, 20 bp, Artificial
  CRISPR gRNA sequence
tgtcacccagggtggagtgc

SEQ ID NO: 28853 - DNA, 20 bp, Artificial
  CRISPR gRNA sequence
tcacccagggtggagtgcag

SEQ ID NO: 28854 - DNA, 20 bp, Artificial
  CRISPR gRNA sequence
actgcagcctcaatctccta

SEQ ID NO: 28855 - DNA, 20 bp, Artificial
  CRISPR gRNA sequence
cagcctcaatctcctaggct

SEQ ID NO: 28856 - DNA, 20 bp, Artificial
  CRISPR gRNA sequence
aatctcctaggctcaagcaa

SEQ ID NO: 28857 - DNA, 20 bp, Artificial
  CRISPR gRNA sequence
ctaggctcaagcaatcctcc

SEQ ID NO: 28858 - DNA, 20 bp, Artificial
  CRISPR gRNA sequence
ggctcaagcaatcctcccat

SEQ ID NO: 28859 - DNA, 20 bp, Artificial
  CRISPR gRNA sequence
aagcaatcctcccatctcaa

SEQ ID NO: 28860 - DNA, 20 bp, Artificial
  CRISPR gRNA sequence
ccatctcaaccttctgagta

SEQ ID NO: 28861 - DNA, 20 bp, Artificial
  CRISPR gRNA sequence
aaccttctgagtagctggga

SEQ ID NO: 28862 - DNA, 20 bp, Artificial
  CRISPR gRNA sequence
ctgagtagctgggacaggtg

SEQ ID NO: 28863 - DNA, 20 bp, Artificial
  CRISPR gRNA sequence
tgagtagctgggacaggtgc

SEQ ID NO: 28864 - DNA, 20 bp, Artificial
  CRISPR gRNA sequence
agtagctgggacaggtgcat

SEQ ID NO: 28865 - DNA, 20 bp, Artificial
  CRISPR gRNA sequence
ggacaggtgcatgccaccac

SEQ ID NO: 28866 - DNA, 20 bp, Artificial
  CRISPR gRNA sequence
atttttgtatttttttgtag

SEQ ID NO: 28867 - DNA, 20 bp, Artificial
  CRISPR gRNA sequence
ttgtatttttttgtagagac

SEQ ID NO: 28868 - DNA, 20 bp, Artificial
  CRISPR gRNA sequence
tgtatttttttgtagagacg

SEQ ID NO: 28869 - DNA, 20 bp, Artificial
  CRISPR gRNA sequence
gtatttttttgtagagacgt

SEQ ID NO: 28870 - DNA, 20 bp, Artificial
  CRISPR gRNA sequence
tatttttttgtagagacgtg

SEQ ID NO: 28871 - DNA, 20 bp, Artificial
  CRISPR gRNA sequence
ttttgtagagacgtggtttc

SEQ ID NO: 28872 - DNA, 20 bp, Artificial
  CRISPR gRNA sequence
tttgtagagacgtggtttca

SEQ ID NO: 28873 - DNA, 20 bp, Artificial
  CRISPR gRNA sequence
ttgtagagacgtggtttcac

SEQ ID NO: 28874 - DNA, 20 bp, Artificial
  CRISPR gRNA sequence
tgtagagacgtggtttcacc

SEQ ID NO: 28875 - DNA, 20 bp, Artificial
  CRISPR gRNA sequence
gtagagacgtggtttcacca

SEQ ID NO: 28876 - DNA, 20 bp, Artificial
  CRISPR gRNA sequence
tagagacgtggtttcaccac

SEQ ID NO: 28877 - DNA, 20 bp, Artificial
  CRISPR gRNA sequence
caccacgttgcccaggctgg

SEQ ID NO: 28878 - DNA, 20 bp, Artificial
  CRISPR gRNA sequence
accacgttgcccaggctggt

SEQ ID NO: 28879 - DNA, 20 bp, Artificial
  CRISPR gRNA sequence
cccaggctggtcttgaactt

SEQ ID NO: 28880 - DNA, 20 bp, Artificial
  CRISPR gRNA sequence
gtcttgaacttctgagctca

SEQ ID NO: 28881 - DNA, 20 bp, Artificial
  CRISPR gRNA sequence
gaacttctgagctcaagcca

SEQ ID NO: 28882 - DNA, 20 bp, Artificial
  CRISPR gRNA sequence
aacttctgagctcaagccat

SEQ ID NO: 28883 - DNA, 20 bp, Artificial
  CRISPR gRNA sequence
ctgagctcaagccatcctcc

SEQ ID NO: 28884 - DNA, 20 bp, Artificial
  CRISPR gRNA sequence
tgagctcaagccatcctcct

SEQ ID NO: 28885 - DNA, 20 bp, Artificial
  CRISPR gRNA sequence
agctcaagccatcctcctgc

SEQ ID NO: 28886 - DNA, 20 bp, Artificial
  CRISPR gRNA sequence
aagccatcctcctgcctctg

SEQ ID NO: 28887 - DNA, 20 bp, Artificial
  CRISPR gRNA sequence
ctgcctctgcctcccaaagt

SEQ ID NO: 28888 - DNA, 20 bp, Artificial
  CRISPR gRNA sequence
cctctgcctcccaaagtact

SEQ ID NO: 28889 - DNA, 20 bp, Artificial
  CRISPR gRNA sequence
tgcctcccaaagtactggga

SEQ ID NO: 28890 - DNA, 20 bp, Artificial
  CRISPR gRNA sequence
cctcccaaagtactgggatt

SEQ ID NO: 28891 - DNA, 20 bp, Artificial
  CRISPR gRNA sequence
ccaaagtactgggattacag

SEQ ID NO: 28892 - DNA, 20 bp, Artificial
  CRISPR gRNA sequence
ggattacaggcatgagtcac

SEQ ID NO: 28893 - DNA, 20 bp, Artificial
  CRISPR gRNA sequence
caggcatgagtcactgtgcc

SEQ ID NO: 28894 - DNA, 20 bp, Artificial
  CRISPR gRNA sequence
tgcctggttcaatgggattt

SEQ ID NO: 28895 - DNA, 20 bp, Artificial
  CRISPR gRNA sequence
gttcaatgggattttttttt

SEQ ID NO: 28896 - DNA, 20 bp, Artificial
  CRISPR gRNA sequence
aatgggattttttttttttt

SEQ ID NO: 28897 - DNA, 20 bp, Artificial
  CRISPR gRNA sequence
tttttttttttttttgacac

SEQ ID NO: 28898 - DNA, 20 bp, Artificial
  CRISPR gRNA sequence
ttttttttttttttgacacg

SEQ ID NO: 28899 - DNA, 20 bp, Artificial
  CRISPR gRNA sequence
tttttttttttttgacacgg

SEQ ID NO: 28900 - DNA, 20 bp, Artificial
  CRISPR gRNA sequence
ttttttttttttgacacgga

SEQ ID NO: 28901 - DNA, 20 bp, Artificial
  CRISPR gRNA sequence
tttttttttttgacacggag

SEQ ID NO: 28902 - DNA, 20 bp, Artificial
  CRISPR gRNA sequence
ttttttttttgacacggagt

SEQ ID NO: 28903 - DNA, 20 bp, Artificial
  CRISPR gRNA sequence
tttttttttgacacggagtc

SEQ ID NO: 28904 - DNA, 20 bp, Artificial
  CRISPR gRNA sequence
ttttttttgacacggagtct

SEQ ID NO: 28905 - DNA, 20 bp, Artificial
  CRISPR gRNA sequence
tttttttgacacggagtctc

SEQ ID NO: 28906 - DNA, 20 bp, Artificial
  CRISPR gRNA sequence
ttttttgacacggagtctcg

SEQ ID NO: 28907 - DNA, 20 bp, Artificial
  CRISPR gRNA sequence
tttttgacacggagtctcgc

SEQ ID NO: 28908 - DNA, 20 bp, Artificial
  CRISPR gRNA sequence
ttttgacacggagtctcgct

SEQ ID NO: 28909 - DNA, 20 bp, Artificial
  CRISPR gRNA sequence
tttgacacggagtctcgctc

SEQ ID NO: 28910 - DNA, 20 bp, Artificial
  CRISPR gRNA sequence
ttgacacggagtctcgctct

SEQ ID NO: 28911 - DNA, 20 bp, Artificial
  CRISPR gRNA sequence
tgacacggagtctcgctctg

SEQ ID NO: 28912 - DNA, 20 bp, Artificial
  CRISPR gRNA sequence
gacacggagtctcgctctgt

SEQ ID NO: 28913 - DNA, 20 bp, Artificial
  CRISPR gRNA sequence
acacggagtctcgctctgta

SEQ ID NO: 28914 - DNA, 20 bp, Artificial
  CRISPR gRNA sequence
gctctgtagcccaggctgga

SEQ ID NO: 28915 - DNA, 20 bp, Artificial
  CRISPR gRNA sequence
tgtagcccaggctggagtgc

SEQ ID NO: 28916 - DNA, 20 bp, Artificial
  CRISPR gRNA sequence
tagcccaggctggagtgcag

SEQ ID NO: 28917 - DNA, 20 bp, Artificial
  CRISPR gRNA sequence
gagtgcagtggtacgatcta

SEQ ID NO: 28918 - DNA, 20 bp, Artificial
  CRISPR gRNA sequence
tttattgcaaacttcacctc

SEQ ID NO: 28919 - DNA, 20 bp, Artificial
  CRISPR gRNA sequence
attgcaaacttcacctcctg

SEQ ID NO: 28920 - DNA, 20 bp, Artificial
  CRISPR gRNA sequence
ttgcaaacttcacctcctgg

SEQ ID NO: 28921 - DNA, 20 bp, Artificial
  CRISPR gRNA sequence
caaacttcacctcctgggtt

SEQ ID NO: 28922 - DNA, 20 bp, Artificial
  CRISPR gRNA sequence
cacctcctgggttcaagcaa

SEQ ID NO: 28923 - DNA, 20 bp, Artificial
  CRISPR gRNA sequence
acctcctgggttcaagcaat

SEQ ID NO: 28924 - DNA, 20 bp, Artificial
  CRISPR gRNA sequence
ctgggttcaagcaattctca

SEQ ID NO: 28925 - DNA, 20 bp, Artificial
  CRISPR gRNA sequence
ggttcaagcaattctcacac

SEQ ID NO: 28926 - DNA, 20 bp, Artificial
  CRISPR gRNA sequence
aagcaattctcacacctcag

SEQ ID NO: 28927 - DNA, 20 bp, Artificial
  CRISPR gRNA sequence
tcacacctcagcctcccaag

SEQ ID NO: 28928 - DNA, 20 bp, Artificial
  CRISPR gRNA sequence
acacctcagcctcccaagta

SEQ ID NO: 28929 - DNA, 20 bp, Artificial
  CRISPR gRNA sequence
agcctcccaagtagctggaa

SEQ ID NO: 28930 - DNA, 20 bp, Artificial
  CRISPR gRNA sequence
ccaagtagctggaattacag

SEQ ID NO: 28931 - DNA, 20 bp, Artificial
  CRISPR gRNA sequence
gaattacaggcatgcaccac

SEQ ID NO: 28932 - DNA, 20 bp, Artificial
  CRISPR gRNA sequence
caggcatgcaccactacacc

SEQ ID NO: 28933 - DNA, 20 bp, Artificial
  CRISPR gRNA sequence
cacccaactaatttttgtat

SEQ ID NO: 28934 - DNA, 20 bp, Artificial
  CRISPR gRNA sequence
atttttgtatttttagtaga

SEQ ID NO: 28935 - DNA, 20 bp, Artificial
  CRISPR gRNA sequence
ttgtatttttagtagagacg

SEQ ID NO: 28936 - DNA, 20 bp, Artificial
  CRISPR gRNA sequence
tgtatttttagtagagacgg

SEQ ID NO: 28937 - DNA, 20 bp, Artificial
  CRISPR gRNA sequence
gtatttttagtagagacggg

SEQ ID NO: 28938 - DNA, 20 bp, Artificial
  CRISPR gRNA sequence
tatttttagtagagacgggg

SEQ ID NO: 28939 - DNA, 20 bp, Artificial
  CRISPR gRNA sequence
ttagtagagacggggtttca

SEQ ID NO: 28940 - DNA, 20 bp, Artificial
  CRISPR gRNA sequence
tagtagagacggggtttcac

SEQ ID NO: 28941 - DNA, 20 bp, Artificial
  CRISPR gRNA sequence
agtagagacggggtttcacc

SEQ ID NO: 28942 - DNA, 20 bp, Artificial
  CRISPR gRNA sequence
gtagagacggggtttcacca

SEQ ID NO: 28943 - DNA, 20 bp, Artificial
  CRISPR gRNA sequence
caccaggttggccaggctgg

SEQ ID NO: 28944 - DNA, 20 bp, Artificial
  CRISPR gRNA sequence
accaggttggccaggctggt

SEQ ID NO: 28945 - DNA, 20 bp, Artificial
  CRISPR gRNA sequence
gccaggctggtcttgaactc

SEQ ID NO: 28946 - DNA, 20 bp, Artificial
  CRISPR gRNA sequence
gtcttgaactcctgacctca

SEQ ID NO: 28947 - DNA, 20 bp, Artificial
  CRISPR gRNA sequence
gaactcctgacctcaagtga

SEQ ID NO: 28948 - DNA, 20 bp, Artificial
  CRISPR gRNA sequence
aactcctgacctcaagtgat

SEQ ID NO: 28949 - DNA, 20 bp, Artificial
  CRISPR gRNA sequence
ctgacctcaagtgatccgcc

SEQ ID NO: 28950 - DNA, 20 bp, Artificial
  CRISPR gRNA sequence
acctcaagtgatccgcccac

SEQ ID NO: 28951 - DNA, 20 bp, Artificial
  CRISPR gRNA sequence
aagtgatccgcccacctcag

SEQ ID NO: 28952 - DNA, 20 bp, Artificial
  CRISPR gRNA sequence
agcctcccaaagtgctggga

SEQ ID NO: 28953 - DNA, 20 bp, Artificial
  CRISPR gRNA sequence
ccaaagtgctgggattaccg

SEQ ID NO: 28954 - DNA, 20 bp, Artificial
  CRISPR gRNA sequence
ggattaccggcatgagccac

SEQ ID NO: 28955 - DNA, 20 bp, Artificial
  CRISPR gRNA sequence
ccggcatgagccaccacgcc

SEQ ID NO: 28956 - DNA, 20 bp, Artificial
  CRISPR gRNA sequence
aacatgattttttactgaac

SEQ ID NO: 28957 - DNA, 20 bp, Artificial
  CRISPR gRNA sequence
tttactgaacctagaggata

SEQ ID NO: 28958 - DNA, 20 bp, Artificial
  CRISPR gRNA sequence
ttactgaacctagaggatat

SEQ ID NO: 28959 - DNA, 20 bp, Artificial
  CRISPR gRNA sequence
tactgaacctagaggatatc

SEQ ID NO: 28960 - DNA, 20 bp, Artificial
  CRISPR gRNA sequence
actgaacctagaggatatca

SEQ ID NO: 28961 - DNA, 20 bp, Artificial
  CRISPR gRNA sequence
ctgaacctagaggatatcaa

SEQ ID NO: 28962 - DNA, 20 bp, Artificial
  CRISPR gRNA sequence
aacctagaggatatcaaaat

SEQ ID NO: 28963 - DNA, 20 bp, Artificial
  CRISPR gRNA sequence
gaggatatcaaaatcttccc

SEQ ID NO: 28964 - DNA, 20 bp, Artificial
  CRISPR gRNA sequence
cccacactccccctcacaac

SEQ ID NO: 28965 - DNA, 20 bp, Artificial
  CRISPR gRNA sequence
ccacactccccctcacaacc

SEQ ID NO: 28966 - DNA, 20 bp, Artificial
  CRISPR gRNA sequence
cccctcacaaccaaggtctt

SEQ ID NO: 28967 - DNA, 20 bp, Artificial
  CRISPR gRNA sequence
acaaccaaggtcttaggatg

SEQ ID NO: 28968 - DNA, 20 bp, Artificial
  CRISPR gRNA sequence
aggatggccaaataatttac

SEQ ID NO: 28969 - DNA, 20 bp, Artificial
  CRISPR gRNA sequence
ggatggccaaataatttacc

SEQ ID NO: 28970 - DNA, 20 bp, Artificial
  CRISPR gRNA sequence
accggaatttacttagcaat

SEQ ID NO: 28971 - DNA, 20 bp, Artificial
  CRISPR gRNA sequence
ccggaatttacttagcaatt

SEQ ID NO: 28972 - DNA, 20 bp, Artificial
  CRISPR gRNA sequence
acttagcaatttccttaatt

SEQ ID NO: 28973 - DNA, 20 bp, Artificial
  CRISPR gRNA sequence
cttagcaatttccttaattg

SEQ ID NO: 28974 - DNA, 20 bp, Artificial
  CRISPR gRNA sequence
agcaatttccttaattgtag

SEQ ID NO: 28975 - DNA, 20 bp, Artificial
  CRISPR gRNA sequence
gcaatttccttaattgtagg

SEQ ID NO: 28976 - DNA, 20 bp, Artificial
  CRISPR gRNA sequence
ccttaattgtaggactgtgg

SEQ ID NO: 28977 - DNA, 20 bp, Artificial
  CRISPR gRNA sequence
cttaattgtaggactgtggg

SEQ ID NO: 28978 - DNA, 20 bp, Artificial
  CRISPR gRNA sequence
aattgtaggactgtgggact

SEQ ID NO: 28979 - DNA, 20 bp, Artificial
  CRISPR gRNA sequence
attgtaggactgtgggactt

SEQ ID NO: 28980 - DNA, 20 bp, Artificial
  CRISPR gRNA sequence
taggactgtgggacttctcc

SEQ ID NO: 28981 - DNA, 20 bp, Artificial
  CRISPR gRNA sequence
tgggacttctccagtaattt

SEQ ID NO: 28982 - DNA, 20 bp, Artificial
  CRISPR gRNA sequence
ctccagtaatttctagtgtc

SEQ ID NO: 28983 - DNA, 20 bp, Artificial
  CRISPR gRNA sequence
tccagtaatttctagtgtcc

SEQ ID NO: 28984 - DNA, 20 bp, Artificial
  CRISPR gRNA sequence
cagtaatttctagtgtccta

SEQ ID NO: 28985 - DNA, 20 bp, Artificial
  CRISPR gRNA sequence
ctagtgtcctaggtaacact

SEQ ID NO: 28986 - DNA, 20 bp, Artificial
  CRISPR gRNA sequence
tagtgtcctaggtaacactg

SEQ ID NO: 28987 - DNA, 20 bp, Artificial
  CRISPR gRNA sequence
gtgtcctaggtaacactgta

SEQ ID NO: 28988 - DNA, 20 bp, Artificial
  CRISPR gRNA sequence
ggtaacactgtaagctagat

SEQ ID NO: 28989 - DNA, 20 bp, Artificial
  CRISPR gRNA sequence
taagctagatttcttctcct

SEQ ID NO: 28990 - DNA, 20 bp, Artificial
  CRISPR gRNA sequence
gatttcttctccttagtcct

SEQ ID NO: 28991 - DNA, 20 bp, Artificial
  CRISPR gRNA sequence
cttctccttagtccttccgt

SEQ ID NO: 28992 - DNA, 20 bp, Artificial
  CRISPR gRNA sequence
ttctccttagtccttccgtc

SEQ ID NO: 28993 - DNA, 20 bp, Artificial
  CRISPR gRNA sequence
ctccttagtccttccgtccc

SEQ ID NO: 28994 - DNA, 20 bp, Artificial
  CRISPR gRNA sequence
tccttagtccttccgtcccc

SEQ ID NO: 28995 - DNA, 20 bp, Artificial
  CRISPR gRNA sequence
cttagtccttccgtccccct

SEQ ID NO: 28996 - DNA, 20 bp, Artificial
  CRISPR gRNA sequence
agtccttccgtccccctctt

SEQ ID NO: 28997 - DNA, 20 bp, Artificial
  CRISPR gRNA sequence
gtccttccgtccccctcttt

SEQ ID NO: 28998 - DNA, 20 bp, Artificial
  CRISPR gRNA sequence
ccgtccccctctttcttacc

SEQ ID NO: 28999 - DNA, 20 bp, Artificial
  CRISPR gRNA sequence
cgtccccctctttcttaccc

SEQ ID NO: 29000 - DNA, 20 bp, Artificial
  CRISPR gRNA sequence
tttcttacccgccaccccac

SEQ ID NO: 29001 - DNA, 20 bp, Artificial
  CRISPR gRNA sequence
tcttacccgccaccccactt

SEQ ID NO: 29002 - DNA, 20 bp, Artificial
  CRISPR gRNA sequence
cttacccgccaccccactta

SEQ ID NO: 29003 - DNA, 20 bp, Artificial
  CRISPR gRNA sequence
ttacccgccaccccacttaa

SEQ ID NO: 29004 - DNA, 20 bp, Artificial
  CRISPR gRNA sequence
acccgccaccccacttaagt

SEQ ID NO: 29005 - DNA, 20 bp, Artificial
  CRISPR gRNA sequence
cccgccaccccacttaagta

SEQ ID NO: 29006 - DNA, 20 bp, Artificial
  CRISPR gRNA sequence
aagtatttattgagcaccta

SEQ ID NO: 29007 - DNA, 20 bp, Artificial
  CRISPR gRNA sequence
agtatttattgagcacctac

SEQ ID NO: 29008 - DNA, 20 bp, Artificial
  CRISPR gRNA sequence
attgagcacctactatgtgc

SEQ ID NO: 29009 - DNA, 20 bp, Artificial
  CRISPR gRNA sequence
ttgagcacctactatgtgcc

SEQ ID NO: 29010 - DNA, 20 bp, Artificial
  CRISPR gRNA sequence
agcacctactatgtgcctgg

SEQ ID NO: 29011 - DNA, 20 bp, Artificial
  CRISPR gRNA sequence
ctatgtgcctggcagtgctc

SEQ ID NO: 29012 - DNA, 20 bp, Artificial
  CRISPR gRNA sequence
tgtgcctggcagtgctctag

SEQ ID NO: 29013 - DNA, 20 bp, Artificial
  CRISPR gRNA sequence
gcagtgctctaggcacaggg

SEQ ID NO: 29014 - DNA, 20 bp, Artificial
  CRISPR gRNA sequence
taggcacagggatacagtaa

SEQ ID NO: 29015 - DNA, 20 bp, Artificial
  CRISPR gRNA sequence
ggcacagggatacagtaatg

SEQ ID NO: 29016 - DNA, 20 bp, Artificial
  CRISPR gRNA sequence
ctccatgtgaagcccacaac

SEQ ID NO: 29017 - DNA, 20 bp, Artificial
  CRISPR gRNA sequence
catgtgaagcccacaacccg

SEQ ID NO: 29018 - DNA, 20 bp, Artificial
  CRISPR gRNA sequence
cacagccattaaacaaataa

SEQ ID NO: 29019 - DNA, 20 bp, Artificial
  CRISPR gRNA sequence
aacaaataatgccaacactt

SEQ ID NO: 29020 - DNA, 20 bp, Artificial
  CRISPR gRNA sequence
atttcattatagtgctgaaa

SEQ ID NO: 29021 - DNA, 20 bp, Artificial
  CRISPR gRNA sequence
tttcattatagtgctgaaaa

SEQ ID NO: 29022 - DNA, 20 bp, Artificial
  CRISPR gRNA sequence
cattatagtgctgaaaagtg

SEQ ID NO: 29023 - DNA, 20 bp, Artificial
  CRISPR gRNA sequence
attatagtgctgaaaagtgg

SEQ ID NO: 29024 - DNA, 20 bp, Artificial
  CRISPR gRNA sequence
tagtgctgaaaagtggcgca

SEQ ID NO: 29025 - DNA, 20 bp, Artificial
  CRISPR gRNA sequence
aaaagtggcgcagagggaaa

SEQ ID NO: 29026 - DNA, 20 bp, Artificial
  CRISPR gRNA sequence
taaagtcatgggacaggtgg

SEQ ID NO: 29027 - DNA, 20 bp, Artificial
  CRISPR gRNA sequence
tccctcccatccacctcctc

SEQ ID NO: 29028 - DNA, 20 bp, Artificial
  CRISPR gRNA sequence
cctcccatccacctcctcat

SEQ ID NO: 29029 - DNA, 20 bp, Artificial
  CRISPR gRNA sequence
ccatccacctcctcatccct

SEQ ID NO: 29030 - DNA, 20 bp, Artificial
  CRISPR gRNA sequence
ctcatccctgccctcccact

SEQ ID NO: 29031 - DNA, 20 bp, Artificial
  CRISPR gRNA sequence
atccctgccctcccacttgg

SEQ ID NO: 29032 - DNA, 20 bp, Artificial
  CRISPR gRNA sequence
ccctcccacttggccacagg

SEQ ID NO: 29033 - DNA, 20 bp, Artificial
  CRISPR gRNA sequence
ccacttggccacaggaccta

SEQ ID NO: 29034 - DNA, 20 bp, Artificial
  CRISPR gRNA sequence
ggccacaggacctaacagta

SEQ ID NO: 29035 - DNA, 20 bp, Artificial
  CRISPR gRNA sequence
gccacaggacctaacagtat

SEQ ID NO: 29036 - DNA, 20 bp, Artificial
  CRISPR gRNA sequence
acagtatcctcctatttacc

SEQ ID NO: 29037 - DNA, 20 bp, Artificial
  CRISPR gRNA sequence
ctatttaccgagaggtagct

SEQ ID NO: 29038 - DNA, 20 bp, Artificial
  CRISPR gRNA sequence
tttaccgagaggtagcttaa

SEQ ID NO: 29039 - DNA, 20 bp, Artificial
  CRISPR gRNA sequence
accgagaggtagcttaagtc

SEQ ID NO: 29040 - DNA, 20 bp, Artificial
  CRISPR gRNA sequence
ccgagaggtagcttaagtct

SEQ ID NO: 29041 - DNA, 20 bp, Artificial
  CRISPR gRNA sequence
aagtctgtcgacagcgccat

SEQ ID NO: 29042 - DNA, 20 bp, Artificial
  CRISPR gRNA sequence
agtctgtcgacagcgccatt

SEQ ID NO: 29043 - DNA, 20 bp, Artificial
  CRISPR gRNA sequence
tcgacagcgccattcacagc

SEQ ID NO: 29044 - DNA, 20 bp, Artificial
  CRISPR gRNA sequence
acagcctatgacccagaact

SEQ ID NO: 29045 - DNA, 20 bp, Artificial
  CRISPR gRNA sequence
tgacccagaactctccttga

SEQ ID NO: 29046 - DNA, 20 bp, Artificial
  CRISPR gRNA sequence
tccttgaggtcaaagtgagg

SEQ ID NO: 29047 - DNA, 20 bp, Artificial
  CRISPR gRNA sequence
cttgaggtcaaagtgaggca

SEQ ID NO: 29048 - DNA, 20 bp, Artificial
  CRISPR gRNA sequence
gaggtcaaagtgaggcatgc

SEQ ID NO: 29049 - DNA, 20 bp, Artificial
  CRISPR gRNA sequence
aggtcaaagtgaggcatgca

SEQ ID NO: 29050 - DNA, 20 bp, Artificial
  CRISPR gRNA sequence
ggtcctgagccctccccctc

SEQ ID NO: 29051 - DNA, 20 bp, Artificial
  CRISPR gRNA sequence
gtcctgagccctccccctca

SEQ ID NO: 29052 - DNA, 20 bp, Artificial
  CRISPR gRNA sequence
agccctccccctcactgtgt

SEQ ID NO: 29053 - DNA, 20 bp, Artificial
  CRISPR gRNA sequence
cccctcactgtgtccccgca

SEQ ID NO: 29054 - DNA, 20 bp, Artificial
  CRISPR gRNA sequence
actgtgtccccgcagtctgt

SEQ ID NO: 29055 - DNA, 20 bp, Artificial
  CRISPR gRNA sequence
tgtccccgcagtctgtccca

SEQ ID NO: 29056 - DNA, 20 bp, Artificial
  CRISPR gRNA sequence
tcccagaacaacatcactga

SEQ ID NO: 29057 - DNA, 20 bp, Artificial
  CRISPR gRNA sequence
acctgggtgcctacaaactc

SEQ ID NO: 29058 - DNA, 20 bp, Artificial
  CRISPR gRNA sequence
ggtgcctacaaactcgccga

SEQ ID NO: 29059 - DNA, 20 bp, Artificial
  CRISPR gRNA sequence
caaactcgccgaggccctgc

SEQ ID NO: 29060 - DNA, 20 bp, Artificial
  CRISPR gRNA sequence
gccgaggccctgccttcgct

SEQ ID NO: 29061 - DNA, 20 bp, Artificial
  CRISPR gRNA sequence
ccttcgctcgctgcatccct

SEQ ID NO: 29062 - DNA, 20 bp, Artificial
  CRISPR gRNA sequence
cgctcgctgcatccctgctc

SEQ ID NO: 29063 - DNA, 20 bp, Artificial
  CRISPR gRNA sequence
gctcgctgcatccctgctca

SEQ ID NO: 29064 - DNA, 20 bp, Artificial
  CRISPR gRNA sequence
gctgcatccctgctcaggct

SEQ ID NO: 29065 - DNA, 20 bp, Artificial
  CRISPR gRNA sequence
catccctgctcaggctaagg

SEQ ID NO: 29066 - DNA, 20 bp, Artificial
  CRISPR gRNA sequence
ctcaggctaaggtgagtggg

SEQ ID NO: 29067 - DNA, 20 bp, Artificial
  CRISPR gRNA sequence
aggctaaggtgagtggggcc

SEQ ID NO: 29068 - DNA, 20 bp, Artificial
  CRISPR gRNA sequence
aggtgagtggggccccggat

SEQ ID NO: 29069 - DNA, 20 bp, Artificial
  CRISPR gRNA sequence
agctggggggctgcagagcg

SEQ ID NO: 29070 - DNA, 20 bp, Artificial
  CRISPR gRNA sequence
gggggctgcagagcgcaggg

SEQ ID NO: 29071 - DNA, 20 bp, Artificial
  CRISPR gRNA sequence
cagagcgcagggaacccaca

SEQ ID NO: 29072 - DNA, 20 bp, Artificial
  CRISPR gRNA sequence
gctgcaggggacactgagac

SEQ ID NO: 29073 - DNA, 20 bp, Artificial
  CRISPR gRNA sequence
caggggacactgagacccta

SEQ ID NO: 29074 - DNA, 20 bp, Artificial
  CRISPR gRNA sequence
agaccctagaagcaatcacc

SEQ ID NO: 29075 - DNA, 20 bp, Artificial
  CRISPR gRNA sequence
gaagcaatcaccacagccct

SEQ ID NO: 29076 - DNA, 20 bp, Artificial
  CRISPR gRNA sequence
aacaaaaggattagcgggac

SEQ ID NO: 29077 - DNA, 20 bp, Artificial
  CRISPR gRNA sequence
gcgggacgtggtgaaagaaa

SEQ ID NO: 29078 - DNA, 20 bp, Artificial
  CRISPR gRNA sequence
tgagcaagtcagttattcat

SEQ ID NO: 29079 - DNA, 20 bp, Artificial
  CRISPR gRNA sequence
agcaagtcagttattcattc

SEQ ID NO: 29080 - DNA, 20 bp, Artificial
  CRISPR gRNA sequence
ttcattcctagccgctgttt

SEQ ID NO: 29081 - DNA, 20 bp, Artificial
  CRISPR gRNA sequence
attcctagccgctgttttct

SEQ ID NO: 29082 - DNA, 20 bp, Artificial
  CRISPR gRNA sequence
ctagccgctgttttcttacc

SEQ ID NO: 29083 - DNA, 20 bp, Artificial
  CRISPR gRNA sequence
gccgctgttttcttacctgg

SEQ ID NO: 29084 - DNA, 20 bp, Artificial
  CRISPR gRNA sequence
ttttcttacctggaaaatgg

SEQ ID NO: 29085 - DNA, 20 bp, Artificial
  CRISPR gRNA sequence
tcttacctggaaaatgggaa

SEQ ID NO: 29086 - DNA, 20 bp, Artificial
  CRISPR gRNA sequence
cttacctggaaaatgggaac

SEQ ID NO: 29087 - DNA, 20 bp, Artificial
  CRISPR gRNA sequence
ttacctggaaaatgggaacc

SEQ ID NO: 29088 - DNA, 20 bp, Artificial
  CRISPR gRNA sequence
acctggaaaatgggaaccat

SEQ ID NO: 29089 - DNA, 20 bp, Artificial
  CRISPR gRNA sequence
cctggaaaatgggaaccatc

SEQ ID NO: 29090 - DNA, 20 bp, Artificial
  CRISPR gRNA sequence
gaaaatgggaaccatcctaa

SEQ ID NO: 29091 - DNA, 20 bp, Artificial
  CRISPR gRNA sequence
atggtctatgtaagcacttg

SEQ ID NO: 29092 - DNA, 20 bp, Artificial
  CRISPR gRNA sequence
tgtaagcacttgtcacaatg

SEQ ID NO: 29093 - DNA, 20 bp, Artificial
  CRISPR gRNA sequence
gtcacaatgccaggttctgt

SEQ ID NO: 29094 - DNA, 20 bp, Artificial
  CRISPR gRNA sequence
tcacaatgccaggttctgtt

SEQ ID NO: 29095 - DNA, 20 bp, Artificial
  CRISPR gRNA sequence
tgttatgcaataaatattgc

SEQ ID NO: 29096 - DNA, 20 bp, Artificial
  CRISPR gRNA sequence
ttatgcaataaatattgctc

SEQ ID NO: 29097 - DNA, 20 bp, Artificial
  CRISPR gRNA sequence
tgcaataaatattgctcctt

SEQ ID NO: 29098 - DNA, 20 bp, Artificial
  CRISPR gRNA sequence
ctccttttcccccagggatg

SEQ ID NO: 29099 - DNA, 20 bp, Artificial
  CRISPR gRNA sequence
cttttcccccagggatggcg

SEQ ID NO: 29100 - DNA, 20 bp, Artificial
  CRISPR gRNA sequence
ttcccccagggatggcggga

SEQ ID NO: 29101 - DNA, 20 bp, Artificial
  CRISPR gRNA sequence
tcccccagggatggcgggac

SEQ ID NO: 29102 - DNA, 20 bp, Artificial
  CRISPR gRNA sequence
cccccagggatggcgggacc

SEQ ID NO: 29103 - DNA, 20 bp, Artificial
  CRISPR gRNA sequence
ccccagggatggcgggacca

SEQ ID NO: 29104 - DNA, 20 bp, Artificial
  CRISPR gRNA sequence
tttccggaacctaggggtgg

SEQ ID NO: 29105 - DNA, 20 bp, Artificial
  CRISPR gRNA sequence
ttccggaacctaggggtggt

SEQ ID NO: 29106 - DNA, 20 bp, Artificial
  CRISPR gRNA sequence
tccggaacctaggggtggtg

SEQ ID NO: 29107 - DNA, 20 bp, Artificial
  CRISPR gRNA sequence
ccggaacctaggggtggtgg

SEQ ID NO: 29108 - DNA, 20 bp, Artificial
  CRISPR gRNA sequence
cggaacctaggggtggtggc

SEQ ID NO: 29109 - DNA, 20 bp, Artificial
  CRISPR gRNA sequence
ggggtggtggcttctggaag

SEQ ID NO: 29110 - DNA, 20 bp, Artificial
  CRISPR gRNA sequence
ctggaaggctaaccacgtac

SEQ ID NO: 29111 - DNA, 20 bp, Artificial
  CRISPR gRNA sequence
tggaaggctaaccacgtacg

SEQ ID NO: 29112 - DNA, 20 bp, Artificial
  CRISPR gRNA sequence
gaaggctaaccacgtacgtc

SEQ ID NO: 29113 - DNA, 20 bp, Artificial
  CRISPR gRNA sequence
accacgtacgtcagcttttg

SEQ ID NO: 29114 - DNA, 20 bp, Artificial
  CRISPR gRNA sequence
ttgccggccttgtcacttac

SEQ ID NO: 29115 - DNA, 20 bp, Artificial
  CRISPR gRNA sequence
tgccggccttgtcacttaca

SEQ ID NO: 29116 - DNA, 20 bp, Artificial
  CRISPR gRNA sequence
gccggccttgtcacttacat

SEQ ID NO: 29117 - DNA, 20 bp, Artificial
  CRISPR gRNA sequence
ccggccttgtcacttacatg

SEQ ID NO: 29118 - DNA, 20 bp, Artificial
  CRISPR gRNA sequence
gtcacttacatgccggtcag

SEQ ID NO: 29119 - DNA, 20 bp, Artificial
  CRISPR gRNA sequence
tcacttacatgccggtcagt

SEQ ID NO: 29120 - DNA, 20 bp, Artificial
  CRISPR gRNA sequence
acatgccggtcagtgtttca

SEQ ID NO: 29121 - DNA, 20 bp, Artificial
  CRISPR gRNA sequence
catgccggtcagtgtttcac

SEQ ID NO: 29122 - DNA, 20 bp, Artificial
  CRISPR gRNA sequence
cactgccaccttctggtagg

SEQ ID NO: 29123 - DNA, 20 bp, Artificial
  CRISPR gRNA sequence
actgccaccttctggtaggc

SEQ ID NO: 29124 - DNA, 20 bp, Artificial
  CRISPR gRNA sequence
ccaccttctggtaggccttg

SEQ ID NO: 29125 - DNA, 20 bp, Artificial
  CRISPR gRNA sequence
ctggtaggccttggcatagc

SEQ ID NO: 29126 - DNA, 20 bp, Artificial
  CRISPR gRNA sequence
tggtaggccttggcatagca

SEQ ID NO: 29127 - DNA, 20 bp, Artificial
  CRISPR gRNA sequence
gtaggccttggcatagcacc

SEQ ID NO: 29128 - DNA, 20 bp, Artificial
  CRISPR gRNA sequence
ggcatagcacctcttgcttt

SEQ ID NO: 29129 - DNA, 20 bp, Artificial
  CRISPR gRNA sequence
gcatagcacctcttgctttt

SEQ ID NO: 29130 - DNA, 20 bp, Artificial
  CRISPR gRNA sequence
ttgcttttgagtgacttcca

SEQ ID NO: 29131 - DNA, 20 bp, Artificial
  CRISPR gRNA sequence
gcttttgagtgacttccatc

SEQ ID NO: 29132 - DNA, 20 bp, Artificial
  CRISPR gRNA sequence
cttttgagtgacttccatcc

SEQ ID NO: 29133 - DNA, 20 bp, Artificial
  CRISPR gRNA sequence
ttgagtgacttccatccagg

SEQ ID NO: 29134 - DNA, 20 bp, Artificial
  CRISPR gRNA sequence
tgagtgacttccatccaggc

SEQ ID NO: 29135 - DNA, 20 bp, Artificial
  CRISPR gRNA sequence
gagtgacttccatccaggcc

SEQ ID NO: 29136 - DNA, 20 bp, Artificial
  CRISPR gRNA sequence
agtgacttccatccaggccc

SEQ ID NO: 29137 - DNA, 20 bp, Artificial
  CRISPR gRNA sequence
ccatccaggccctggtgtgg

SEQ ID NO: 29138 - DNA, 20 bp, Artificial
  CRISPR gRNA sequence
catccaggccctggtgtggt

SEQ ID NO: 29139 - DNA, 20 bp, Artificial
  CRISPR gRNA sequence
gtgtggtcccagaggtaatg

SEQ ID NO: 29140 - DNA, 20 bp, Artificial
  CRISPR gRNA sequence
agcttggaccagagccccag

SEQ ID NO: 29141 - DNA, 20 bp, Artificial
  CRISPR gRNA sequence
ggaccagagccccagtcatc

SEQ ID NO: 29142 - DNA, 20 bp, Artificial
  CRISPR gRNA sequence
gaccagagccccagtcatcc

SEQ ID NO: 29143 - DNA, 20 bp, Artificial
  CRISPR gRNA sequence
agcattaccagctcttctta

SEQ ID NO: 29144 - DNA, 20 bp, Artificial
  CRISPR gRNA sequence
ccagctcttcttactcgcca

SEQ ID NO: 29145 - DNA, 20 bp, Artificial
  CRISPR gRNA sequence
ttcttactcgccagactgag

SEQ ID NO: 29146 - DNA, 20 bp, Artificial
  CRISPR gRNA sequence
cttactcgccagactgagag

SEQ ID NO: 29147 - DNA, 20 bp, Artificial
  CRISPR gRNA sequence
ttactcgccagactgagaga

SEQ ID NO: 29148 - DNA, 20 bp, Artificial
  CRISPR gRNA sequence
actcgccagactgagagaaa

SEQ ID NO: 29149 - DNA, 20 bp, Artificial
  CRISPR gRNA sequence
ctcgccagactgagagaaac

SEQ ID NO: 29150 - DNA, 20 bp, Artificial
  CRISPR gRNA sequence
gccagactgagagaaactgc

SEQ ID NO: 29151 - DNA, 20 bp, Artificial
  CRISPR gRNA sequence
agagaaactgctctcctctt

SEQ ID NO: 29152 - DNA, 20 bp, Artificial
  CRISPR gRNA sequence
ctctcctcttcgccagagct

SEQ ID NO: 29153 - DNA, 20 bp, Artificial
  CRISPR gRNA sequence
tcctcttcgccagagctctt

SEQ ID NO: 29154 - DNA, 20 bp, Artificial
  CRISPR gRNA sequence
ctcttcgccagagctcttca

SEQ ID NO: 29155 - DNA, 20 bp, Artificial
  CRISPR gRNA sequence
ttcgccagagctcttcactt

SEQ ID NO: 29156 - DNA, 20 bp, Artificial
  CRISPR gRNA sequence
cgccagagctcttcacttac

SEQ ID NO: 29157 - DNA, 20 bp, Artificial
  CRISPR gRNA sequence
gccagagctcttcacttact

SEQ ID NO: 29158 - DNA, 20 bp, Artificial
  CRISPR gRNA sequence
ttcacttactgaggacaacc

SEQ ID NO: 29159 - DNA, 20 bp, Artificial
  CRISPR gRNA sequence
cacttactgaggacaaccag

SEQ ID NO: 29160 - DNA, 20 bp, Artificial
  CRISPR gRNA sequence
acttactgaggacaaccaga

SEQ ID NO: 29161 - DNA, 20 bp, Artificial
  CRISPR gRNA sequence
actgaggacaaccagagtca

SEQ ID NO: 29162 - DNA, 20 bp, Artificial
  CRISPR gRNA sequence
ctgaggacaaccagagtcag

SEQ ID NO: 29163 - DNA, 20 bp, Artificial
  CRISPR gRNA sequence
aggacaaccagagtcagatt

SEQ ID NO: 29164 - DNA, 20 bp, Artificial
  CRISPR gRNA sequence
ccaggaaagatggcatttgg

SEQ ID NO: 29165 - DNA, 20 bp, Artificial
  CRISPR gRNA sequence
ggtcccttattatttattta

SEQ ID NO: 29166 - DNA, 20 bp, Artificial
  CRISPR gRNA sequence
gtcccttattatttatttat

SEQ ID NO: 29167 - DNA, 20 bp, Artificial
  CRISPR gRNA sequence
attatttatttatttttaat

SEQ ID NO: 29168 - DNA, 20 bp, Artificial
  CRISPR gRNA sequence
ttatttatttatttttaatt

SEQ ID NO: 29169 - DNA, 20 bp, Artificial
  CRISPR gRNA sequence
tttatttatttttaattttt

SEQ ID NO: 29170 - DNA, 20 bp, Artificial
  CRISPR gRNA sequence
atttatttttaattttttta

SEQ ID NO: 29171 - DNA, 20 bp, Artificial
  CRISPR gRNA sequence
tttatttttaatttttttaa

SEQ ID NO: 29172 - DNA, 20 bp, Artificial
  CRISPR gRNA sequence
atttttaatttttttaattt

SEQ ID NO: 29173 - DNA, 20 bp, Artificial
  CRISPR gRNA sequence
tttttaatttttttaatttc

SEQ ID NO: 29174 - DNA, 20 bp, Artificial
  CRISPR gRNA sequence
ttaatttttttaatttctgt

SEQ ID NO: 29175 - DNA, 20 bp, Artificial
  CRISPR gRNA sequence
taatttttttaatttctgtt

SEQ ID NO: 29176 - DNA, 20 bp, Artificial
  CRISPR gRNA sequence
aatttttttaatttctgttt

SEQ ID NO: 29177 - DNA, 20 bp, Artificial
  CRISPR gRNA sequence
atttttttaatttctgtttt

SEQ ID NO: 29178 - DNA, 20 bp, Artificial
  CRISPR gRNA sequence
ttttaatttctgtttttgag

SEQ ID NO: 29179 - DNA, 20 bp, Artificial
  CRISPR gRNA sequence
tttaatttctgtttttgaga

SEQ ID NO: 29180 - DNA, 20 bp, Artificial
  CRISPR gRNA sequence
ttaatttctgtttttgagat

SEQ ID NO: 29181 - DNA, 20 bp, Artificial
  CRISPR gRNA sequence
taatttctgtttttgagatg

SEQ ID NO: 29182 - DNA, 20 bp, Artificial
  CRISPR gRNA sequence
aatttctgtttttgagatgg

SEQ ID NO: 29183 - DNA, 20 bp, Artificial
  CRISPR gRNA sequence
atttctgtttttgagatgga

SEQ ID NO: 29184 - DNA, 20 bp, Artificial
  CRISPR gRNA sequence
ctgtttttgagatggagtct

SEQ ID NO: 29185 - DNA, 20 bp, Artificial
  CRISPR gRNA sequence
tgtttttgagatggagtctc

SEQ ID NO: 29186 - DNA, 20 bp, Artificial
  CRISPR gRNA sequence
tttttgagatggagtctcgc

SEQ ID NO: 29187 - DNA, 20 bp, Artificial
  CRISPR gRNA sequence
ttgagatggagtctcgctct

SEQ ID NO: 29188 - DNA, 20 bp, Artificial
  CRISPR gRNA sequence
tgagatggagtctcgctctg

SEQ ID NO: 29189 - DNA, 20 bp, Artificial
  CRISPR gRNA sequence
gagatggagtctcgctctgt

SEQ ID NO: 29190 - DNA, 20 bp, Artificial
  CRISPR gRNA sequence
agatggagtctcgctctgtc

SEQ ID NO: 29191 - DNA, 20 bp, Artificial
  CRISPR gRNA sequence
gctctgtcacccaggctgga

SEQ ID NO: 29192 - DNA, 20 bp, Artificial
  CRISPR gRNA sequence
tgtcacccaggctggagtga

SEQ ID NO: 29193 - DNA, 20 bp, Artificial
  CRISPR gRNA sequence
tcacccaggctggagtgaag

SEQ ID NO: 29194 - DNA, 20 bp, Artificial
  CRISPR gRNA sequence
gagtgaagtggtgtgatctc

SEQ ID NO: 29195 - DNA, 20 bp, Artificial
  CRISPR gRNA sequence
agctcactgcaacttctgcc

SEQ ID NO: 29196 - DNA, 20 bp, Artificial
  CRISPR gRNA sequence
actgcaacttctgccccccc

SEQ ID NO: 29197 - DNA, 20 bp, Artificial
  CRISPR gRNA sequence
caacttctgcccccccccag

SEQ ID NO: 29198 - DNA, 20 bp, Artificial
  CRISPR gRNA sequence
ctgcccccccccaggttcaa

SEQ ID NO: 29199 - DNA, 20 bp, Artificial
  CRISPR gRNA sequence
tgcccccccccaggttcaag

SEQ ID NO: 29200 - DNA, 20 bp, Artificial
  CRISPR gRNA sequence
cccccccccaggttcaagct

SEQ ID NO: 29201 - DNA, 20 bp, Artificial
  CRISPR gRNA sequence
aagctattcgcctgcctcag

SEQ ID NO: 29202 - DNA, 20 bp, Artificial
  CRISPR gRNA sequence
ttcgcctgcctcagtgctcc

SEQ ID NO: 29203 - DNA, 20 bp, Artificial
  CRISPR gRNA sequence
gcctgcctcagtgctccgag

SEQ ID NO: 29204 - DNA, 20 bp, Artificial
  CRISPR gRNA sequence
cctcagtgctccgagtagct

SEQ ID NO: 29205 - DNA, 20 bp, Artificial
  CRISPR gRNA sequence
agtgctccgagtagctggga

SEQ ID NO: 29206 - DNA, 20 bp, Artificial
  CRISPR gRNA sequence
cgagtagctgggattatagg

SEQ ID NO: 29207 - DNA, 20 bp, Artificial
  CRISPR gRNA sequence
ggattataggcgcccaccac

SEQ ID NO: 29208 - DNA, 20 bp, Artificial
  CRISPR gRNA sequence
taggcgcccaccaccacgtc

SEQ ID NO: 29209 - DNA, 20 bp, Artificial
  CRISPR gRNA sequence
gtttttatatttttagtaga

SEQ ID NO: 29210 - DNA, 20 bp, Artificial
  CRISPR gRNA sequence
ttatatttttagtagagaca

SEQ ID NO: 29211 - DNA, 20 bp, Artificial
  CRISPR gRNA sequence
tatatttttagtagagacag

SEQ ID NO: 29212 - DNA, 20 bp, Artificial
  CRISPR gRNA sequence
atatttttagtagagacagg

SEQ ID NO: 29213 - DNA, 20 bp, Artificial
  CRISPR gRNA sequence
tatttttagtagagacaggg

SEQ ID NO: 29214 - DNA, 20 bp, Artificial
  CRISPR gRNA sequence
ttagtagagacagggtttcg

SEQ ID NO: 29215 - DNA, 20 bp, Artificial
  CRISPR gRNA sequence
tagtagagacagggtttcgc

SEQ ID NO: 29216 - DNA, 20 bp, Artificial
  CRISPR gRNA sequence
agtagagacagggtttcgcc

SEQ ID NO: 29217 - DNA, 20 bp, Artificial
  CRISPR gRNA sequence
gtagagacagggtttcgcca

SEQ ID NO: 29218 - DNA, 20 bp, Artificial
  CRISPR gRNA sequence
cgccatgttggccaggctgg

SEQ ID NO: 29219 - DNA, 20 bp, Artificial
  CRISPR gRNA sequence
gccatgttggccaggctggt

SEQ ID NO: 29220 - DNA, 20 bp, Artificial
  CRISPR gRNA sequence
gccaggctggtctcaaactc

SEQ ID NO: 29221 - DNA, 20 bp, Artificial
  CRISPR gRNA sequence
gtctcaaactcctgatctca

SEQ ID NO: 29222 - DNA, 20 bp, Artificial
  CRISPR gRNA sequence
aaactcctgatctcaggtga

SEQ ID NO: 29223 - DNA, 20 bp, Artificial
  CRISPR gRNA sequence
ctgatctcaggtgatccacc

SEQ ID NO: 29224 - DNA, 20 bp, Artificial
  CRISPR gRNA sequence
atctcaggtgatccacctgc

SEQ ID NO: 29225 - DNA, 20 bp, Artificial
  CRISPR gRNA sequence
aggtgatccacctgcctcgg

SEQ ID NO: 29226 - DNA, 20 bp, Artificial
  CRISPR gRNA sequence
cctcggcctcccaaagtgag

SEQ ID NO: 29227 - DNA, 20 bp, Artificial
  CRISPR gRNA sequence
ggcctcccaaagtgagtact

SEQ ID NO: 29228 - DNA, 20 bp, Artificial
  CRISPR gRNA sequence
ccaaagtgagtactaggatt

SEQ ID NO: 29229 - DNA, 20 bp, Artificial
  CRISPR gRNA sequence
ggattacaggcgtgagccac

SEQ ID NO: 29230 - DNA, 20 bp, Artificial
  CRISPR gRNA sequence
caggcgtgagccaccatgcc

SEQ ID NO: 29231 - DNA, 20 bp, Artificial
  CRISPR gRNA sequence
atttatttatttatttattt

SEQ ID NO: 29232 - DNA, 20 bp, Artificial
  CRISPR gRNA sequence
tttatttatttatttattta

SEQ ID NO: 29233 - DNA, 20 bp, Artificial
  CRISPR gRNA sequence
atttatttatttatttattt

SEQ ID NO: 29234 - DNA, 20 bp, Artificial
  CRISPR gRNA sequence
tttatttatttatttattta

SEQ ID NO: 29235 - DNA, 20 bp, Artificial
  CRISPR gRNA sequence
atttatttatttatttattt

SEQ ID NO: 29236 - DNA, 20 bp, Artificial
  CRISPR gRNA sequence
tttatttatttatttatttg

SEQ ID NO: 29237 - DNA, 20 bp, Artificial
  CRISPR gRNA sequence
atttatttatttatttggag

SEQ ID NO: 29238 - DNA, 20 bp, Artificial
  CRISPR gRNA sequence
tttatttatttatttggaga

SEQ ID NO: 29239 - DNA, 20 bp, Artificial
  CRISPR gRNA sequence
atttatttatttggagatgg

SEQ ID NO: 29240 - DNA, 20 bp, Artificial
  CRISPR gRNA sequence
tttatttatttggagatggg

SEQ ID NO: 29241 - DNA, 20 bp, Artificial
  CRISPR gRNA sequence
atttatttggagatggggtc

SEQ ID NO: 29242 - DNA, 20 bp, Artificial
  CRISPR gRNA sequence
tttatttggagatggggtct

SEQ ID NO: 29243 - DNA, 20 bp, Artificial
  CRISPR gRNA sequence
atttggagatggggtctcac

SEQ ID NO: 29244 - DNA, 20 bp, Artificial
  CRISPR gRNA sequence
tttggagatggggtctcacc

SEQ ID NO: 29245 - DNA, 20 bp, Artificial
  CRISPR gRNA sequence
ggagatggggtctcacccag

SEQ ID NO: 29246 - DNA, 20 bp, Artificial
  CRISPR gRNA sequence
gagatggggtctcacccagg

SEQ ID NO: 29247 - DNA, 20 bp, Artificial
  CRISPR gRNA sequence
acccaggttgtagtgcaggg

SEQ ID NO: 29248 - DNA, 20 bp, Artificial
  CRISPR gRNA sequence
tagtgcaggggtgcaatgat

SEQ ID NO: 29249 - DNA, 20 bp, Artificial
  CRISPR gRNA sequence
actacagcctcgactacctg

SEQ ID NO: 29250 - DNA, 20 bp, Artificial
  CRISPR gRNA sequence
cagcctcgactacctggact

SEQ ID NO: 29251 - DNA, 20 bp, Artificial
  CRISPR gRNA sequence
gactacctggactgaagcga

SEQ ID NO: 29252 - DNA, 20 bp, Artificial
  CRISPR gRNA sequence
cctggactgaagcgaacctc

SEQ ID NO: 29253 - DNA, 20 bp, Artificial
  CRISPR gRNA sequence
gactgaagcgaacctcccac

SEQ ID NO: 29254 - DNA, 20 bp, Artificial
  CRISPR gRNA sequence
aagcgaacctcccacctcag

SEQ ID NO: 29255 - DNA, 20 bp, Artificial
  CRISPR gRNA sequence
ccacctcagccttccaagta

SEQ ID NO: 29256 - DNA, 20 bp, Artificial
  CRISPR gRNA sequence
agccttccaagtagctgggt

SEQ ID NO: 29257 - DNA, 20 bp, Artificial
  CRISPR gRNA sequence
ccaagtagctgggtcctata

SEQ ID NO: 29258 - DNA, 20 bp, Artificial
  CRISPR gRNA sequence
caagtagctgggtcctatac

SEQ ID NO: 29259 - DNA, 20 bp, Artificial
  CRISPR gRNA sequence
ggtcctataccctcctgagc

SEQ ID NO: 29260 - DNA, 20 bp, Artificial
  CRISPR gRNA sequence
taccctcctgagccttgtta

SEQ ID NO: 29261 - DNA, 20 bp, Artificial
  CRISPR gRNA sequence
ctgagccttgttaatttctt

SEQ ID NO: 29262 - DNA, 20 bp, Artificial
  CRISPR gRNA sequence
agccttgttaatttcttccc

SEQ ID NO: 29263 - DNA, 20 bp, Artificial
  CRISPR gRNA sequence
gttaatttcttcccagcatg

SEQ ID NO: 29264 - DNA, 20 bp, Artificial
  CRISPR gRNA sequence
ttaatttcttcccagcatga

SEQ ID NO: 29265 - DNA, 20 bp, Artificial
  CRISPR gRNA sequence
atttcttcccagcatgatca

SEQ ID NO: 29266 - DNA, 20 bp, Artificial
  CRISPR gRNA sequence
cttcccagcatgatcactgt

SEQ ID NO: 29267 - DNA, 20 bp, Artificial
  CRISPR gRNA sequence
ttcccagcatgatcactgtt

SEQ ID NO: 29268 - DNA, 20 bp, Artificial
  CRISPR gRNA sequence
cccagcatgatcactgtttt

SEQ ID NO: 29269 - DNA, 20 bp, Artificial
  CRISPR gRNA sequence
ccagcatgatcactgtttta

SEQ ID NO: 29270 - DNA, 20 bp, Artificial
  CRISPR gRNA sequence
ttttacaatattttatttat

SEQ ID NO: 29271 - DNA, 20 bp, Artificial
  CRISPR gRNA sequence
tacaatattttatttatgta

SEQ ID NO: 29272 - DNA, 20 bp, Artificial
  CRISPR gRNA sequence
acaatattttatttatgtag

SEQ ID NO: 29273 - DNA, 20 bp, Artificial
  CRISPR gRNA sequence
caatattttatttatgtagg

SEQ ID NO: 29274 - DNA, 20 bp, Artificial
  CRISPR gRNA sequence
tatttatgtaggtgcttact

SEQ ID NO: 29275 - DNA, 20 bp, Artificial
  CRISPR gRNA sequence
atttatgtaggtgcttactt

SEQ ID NO: 29276 - DNA, 20 bp, Artificial
  CRISPR gRNA sequence
tttatgtaggtgcttacttc

SEQ ID NO: 29277 - DNA, 20 bp, Artificial
  CRISPR gRNA sequence
atgtaggtgcttacttcttg

SEQ ID NO: 29278 - DNA, 20 bp, Artificial
  CRISPR gRNA sequence
tgtaggtgcttacttcttgc

SEQ ID NO: 29279 - DNA, 20 bp, Artificial
  CRISPR gRNA sequence
acttcttgctatgcaaagaa

SEQ ID NO: 29280 - DNA, 20 bp, Artificial
  CRISPR gRNA sequence
cttcttgctatgcaaagaaa

SEQ ID NO: 29281 - DNA, 20 bp, Artificial
  CRISPR gRNA sequence
cttgctatgcaaagaaactc

SEQ ID NO: 29282 - DNA, 20 bp, Artificial
  CRISPR gRNA sequence
ttgctatgcaaagaaactca

SEQ ID NO: 29283 - DNA, 20 bp, Artificial
  CRISPR gRNA sequence
gctatgcaaagaaactcaga

SEQ ID NO: 29284 - DNA, 20 bp, Artificial
  CRISPR gRNA sequence
ctatgcaaagaaactcagaa

SEQ ID NO: 29285 - DNA, 20 bp, Artificial
  CRISPR gRNA sequence
tgcaaagaaactcagaagca

SEQ ID NO: 29286 - DNA, 20 bp, Artificial
  CRISPR gRNA sequence
agaagcaaaaatagaatctg

SEQ ID NO: 29287 - DNA, 20 bp, Artificial
  CRISPR gRNA sequence
tctggttcataattgtgcta

SEQ ID NO: 29288 - DNA, 20 bp, Artificial
  CRISPR gRNA sequence
gttcataattgtgctaaaaa

SEQ ID NO: 29289 - DNA, 20 bp, Artificial
  CRISPR gRNA sequence
ataattgtgctaaaaactag

SEQ ID NO: 29290 - DNA, 20 bp, Artificial
  CRISPR gRNA sequence
tgctaaaaactagagataca

SEQ ID NO: 29291 - DNA, 20 bp, Artificial
  CRISPR gRNA sequence
aaaactagagatacaagtat

SEQ ID NO: 29292 - DNA, 20 bp, Artificial
  CRISPR gRNA sequence
gagatacaagtatgaactag

SEQ ID NO: 29293 - DNA, 20 bp, Artificial
  CRISPR gRNA sequence
gacagatgtcgttcttgctt

SEQ ID NO: 29294 - DNA, 20 bp, Artificial
  CRISPR gRNA sequence
ttgcttttgagtttctttgc

SEQ ID NO: 29295 - DNA, 20 bp, Artificial
  CRISPR gRNA sequence
gcttttgagtttctttgcgt

SEQ ID NO: 29296 - DNA, 20 bp, Artificial
  CRISPR gRNA sequence
cttttgagtttctttgcgta

SEQ ID NO: 29297 - DNA, 20 bp, Artificial
  CRISPR gRNA sequence
ttgagtttctttgcgtagta

SEQ ID NO: 29298 - DNA, 20 bp, Artificial
  CRISPR gRNA sequence
tgagtttctttgcgtagtag

SEQ ID NO: 29299 - DNA, 20 bp, Artificial
  CRISPR gRNA sequence
gagtttctttgcgtagtagg

SEQ ID NO: 29300 - DNA, 20 bp, Artificial
  CRISPR gRNA sequence
agtttctttgcgtagtagga

SEQ ID NO: 29301 - DNA, 20 bp, Artificial
  CRISPR gRNA sequence
ctttgcgtagtaggaattag

SEQ ID NO: 29302 - DNA, 20 bp, Artificial
  CRISPR gRNA sequence
tttgcgtagtaggaattagg

SEQ ID NO: 29303 - DNA, 20 bp, Artificial
  CRISPR gRNA sequence
tgcgtagtaggaattaggca

SEQ ID NO: 29304 - DNA, 20 bp, Artificial
  CRISPR gRNA sequence
gcgtagtaggaattaggcac

SEQ ID NO: 29305 - DNA, 20 bp, Artificial
  CRISPR gRNA sequence
cgtagtaggaattaggcaca

SEQ ID NO: 29306 - DNA, 20 bp, Artificial
  CRISPR gRNA sequence
ggcacatacataaataaaat

SEQ ID NO: 29307 - DNA, 20 bp, Artificial
  CRISPR gRNA sequence
taaaacagtgattcatgctg

SEQ ID NO: 29308 - DNA, 20 bp, Artificial
  CRISPR gRNA sequence
atgctgggaaggaaactaac

SEQ ID NO: 29309 - DNA, 20 bp, Artificial
  CRISPR gRNA sequence
ggaaggaaactaacaagccc

SEQ ID NO: 29310 - DNA, 20 bp, Artificial
  CRISPR gRNA sequence
acaagccccaggagggtaca

SEQ ID NO: 29311 - DNA, 20 bp, Artificial
  CRISPR gRNA sequence
ctggggagatgattcttccg

SEQ ID NO: 29312 - DNA, 20 bp, Artificial
  CRISPR gRNA sequence
tggggagatgattcttccgt

SEQ ID NO: 29313 - DNA, 20 bp, Artificial
  CRISPR gRNA sequence
gggagatgattcttccgtgg

SEQ ID NO: 29314 - DNA, 20 bp, Artificial
  CRISPR gRNA sequence
ttccgtgggaagctctaggg

SEQ ID NO: 29315 - DNA, 20 bp, Artificial
  CRISPR gRNA sequence
ccgtgggaagctctagggga

SEQ ID NO: 29316 - DNA, 20 bp, Artificial
  CRISPR gRNA sequence
cgtgggaagctctaggggaa

SEQ ID NO: 29317 - DNA, 20 bp, Artificial
  CRISPR gRNA sequence
taggggaaaaggactctagg

SEQ ID NO: 29318 - DNA, 20 bp, Artificial
  CRISPR gRNA sequence
ggggaaaaggactctaggaa

SEQ ID NO: 29319 - DNA, 20 bp, Artificial
  CRISPR gRNA sequence
taggaagaaagaacagcagg

SEQ ID NO: 29320 - DNA, 20 bp, Artificial
  CRISPR gRNA sequence
ggaagaaagaacagcaggtg

SEQ ID NO: 29321 - DNA, 20 bp, Artificial
  CRISPR gRNA sequence
agtgggaaaaggggctgtgt

SEQ ID NO: 29322 - DNA, 20 bp, Artificial
  CRISPR gRNA sequence
tgttttaagggtcagaaggg

SEQ ID NO: 29323 - DNA, 20 bp, Artificial
  CRISPR gRNA sequence
taagggtcagaagggccact

SEQ ID NO: 29324 - DNA, 20 bp, Artificial
  CRISPR gRNA sequence
aagggtcagaagggccactg

SEQ ID NO: 29325 - DNA, 20 bp, Artificial
  CRISPR gRNA sequence
agggtcagaagggccactgt

SEQ ID NO: 29326 - DNA, 20 bp, Artificial
  CRISPR gRNA sequence
tggctgtgtgtagtgaatga

SEQ ID NO: 29327 - DNA, 20 bp, Artificial
  CRISPR gRNA sequence
tgtgtagtgaatgagggaca

SEQ ID NO: 29328 - DNA, 20 bp, Artificial
  CRISPR gRNA sequence
ggcaatggtggaagtagggg

SEQ ID NO: 29329 - DNA, 20 bp, Artificial
  CRISPR gRNA sequence
gtgggtcacaagaggtattt

SEQ ID NO: 29330 - DNA, 20 bp, Artificial
  CRISPR gRNA sequence
tgggtcacaagaggtatttg

SEQ ID NO: 29331 - DNA, 20 bp, Artificial
  CRISPR gRNA sequence
gcagtttttcagtgtgaatg

SEQ ID NO: 29332 - DNA, 20 bp, Artificial
  CRISPR gRNA sequence
cagtttttcagtgtgaatgg

SEQ ID NO: 29333 - DNA, 20 bp, Artificial
  CRISPR gRNA sequence
ttcagtgtgaatggaaaagt

SEQ ID NO: 29334 - DNA, 20 bp, Artificial
  CRISPR gRNA sequence
tcagtgtgaatggaaaagta

SEQ ID NO: 29335 - DNA, 20 bp, Artificial
  CRISPR gRNA sequence
cagtgtgaatggaaaagtag

SEQ ID NO: 29336 - DNA, 20 bp, Artificial
  CRISPR gRNA sequence
agtgtgaatggaaaagtagg

SEQ ID NO: 29337 - DNA, 20 bp, Artificial
  CRISPR gRNA sequence
ggaaggcgacacttgatctg

SEQ ID NO: 29338 - DNA, 20 bp, Artificial
  CRISPR gRNA sequence
gatctgatttacacttttct

SEQ ID NO: 29339 - DNA, 20 bp, Artificial
  CRISPR gRNA sequence
atctgatttacacttttctt

SEQ ID NO: 29340 - DNA, 20 bp, Artificial
  CRISPR gRNA sequence
atttacacttttcttttttc

SEQ ID NO: 29341 - DNA, 20 bp, Artificial
  CRISPR gRNA sequence
acacttttcttttttctttt

SEQ ID NO: 29342 - DNA, 20 bp, Artificial
  CRISPR gRNA sequence
cacttttcttttttcttttc

SEQ ID NO: 29343 - DNA, 20 bp, Artificial
  CRISPR gRNA sequence
ttcttttttcttttcttttc

SEQ ID NO: 29344 - DNA, 20 bp, Artificial
  CRISPR gRNA sequence
tcttttttcttttcttttct

SEQ ID NO: 29345 - DNA, 20 bp, Artificial
  CRISPR gRNA sequence
cttttttcttttcttttctt

SEQ ID NO: 29346 - DNA, 20 bp, Artificial
  CRISPR gRNA sequence
ttttttcttttcttttcttt

SEQ ID NO: 29347 - DNA, 20 bp, Artificial
  CRISPR gRNA sequence
ttttcttttcttttcttttt

SEQ ID NO: 29348 - DNA, 20 bp, Artificial
  CRISPR gRNA sequence
tttcttttcttttctttttg

SEQ ID NO: 29349 - DNA, 20 bp, Artificial
  CRISPR gRNA sequence
ttcttttcttttctttttga

SEQ ID NO: 29350 - DNA, 20 bp, Artificial
  CRISPR gRNA sequence
tcttttcttttctttttgag

SEQ ID NO: 29351 - DNA, 20 bp, Artificial
  CRISPR gRNA sequence
cttttcttttctttttgaga

SEQ ID NO: 29352 - DNA, 20 bp, Artificial
  CRISPR gRNA sequence
ttttcttttctttttgagac

SEQ ID NO: 29353 - DNA, 20 bp, Artificial
  CRISPR gRNA sequence
ttcttttctttttgagacca

SEQ ID NO: 29354 - DNA, 20 bp, Artificial
  CRISPR gRNA sequence
tcttttctttttgagaccaa

SEQ ID NO: 29355 - DNA, 20 bp, Artificial
  CRISPR gRNA sequence
cttttctttttgagaccaag

SEQ ID NO: 29356 - DNA, 20 bp, Artificial
  CRISPR gRNA sequence
ttttctttttgagaccaagt

SEQ ID NO: 29357 - DNA, 20 bp, Artificial
  CRISPR gRNA sequence
ttctttttgagaccaagtct

SEQ ID NO: 29358 - DNA, 20 bp, Artificial
  CRISPR gRNA sequence
tctttttgagaccaagtctc

SEQ ID NO: 29359 - DNA, 20 bp, Artificial
  CRISPR gRNA sequence
ctttttgagaccaagtctca

SEQ ID NO: 29360 - DNA, 20 bp, Artificial
  CRISPR gRNA sequence
tttttgagaccaagtctcac

SEQ ID NO: 29361 - DNA, 20 bp, Artificial
  CRISPR gRNA sequence
tttgagaccaagtctcactt

SEQ ID NO: 29362 - DNA, 20 bp, Artificial
  CRISPR gRNA sequence
ttgagaccaagtctcacttt

SEQ ID NO: 29363 - DNA, 20 bp, Artificial
  CRISPR gRNA sequence
tgagaccaagtctcacttta

SEQ ID NO: 29364 - DNA, 20 bp, Artificial
  CRISPR gRNA sequence
gagaccaagtctcactttat

SEQ ID NO: 29365 - DNA, 20 bp, Artificial
  CRISPR gRNA sequence
agaccaagtctcactttatt

SEQ ID NO: 29366 - DNA, 20 bp, Artificial
  CRISPR gRNA sequence
actttattgcccaggctaag

SEQ ID NO: 29367 - DNA, 20 bp, Artificial
  CRISPR gRNA sequence
tattgcccaggctaaggtgc

SEQ ID NO: 29368 - DNA, 20 bp, Artificial
  CRISPR gRNA sequence
attgcccaggctaaggtgca

SEQ ID NO: 29369 - DNA, 20 bp, Artificial
  CRISPR gRNA sequence
ttgcccaggctaaggtgcag

SEQ ID NO: 29370 - DNA, 20 bp, Artificial
  CRISPR gRNA sequence
cccaggctaaggtgcagtgg

SEQ ID NO: 29371 - DNA, 20 bp, Artificial
  CRISPR gRNA sequence
aggtgcagtggcatgatctc

SEQ ID NO: 29372 - DNA, 20 bp, Artificial
  CRISPR gRNA sequence
agctcactgcaagcactgcc

SEQ ID NO: 29373 - DNA, 20 bp, Artificial
  CRISPR gRNA sequence
actgcaagcactgcctcctg

SEQ ID NO: 29374 - DNA, 20 bp, Artificial
  CRISPR gRNA sequence
caagcactgcctcctgggtt

SEQ ID NO: 29375 - DNA, 20 bp, Artificial
  CRISPR gRNA sequence
cctcctgggttcaagtgatt

SEQ ID NO: 29376 - DNA, 20 bp, Artificial
  CRISPR gRNA sequence
ctgggttcaagtgattctca

SEQ ID NO: 29377 - DNA, 20 bp, Artificial
  CRISPR gRNA sequence
ggttcaagtgattctcatgc

SEQ ID NO: 29378 - DNA, 20 bp, Artificial
  CRISPR gRNA sequence
aagtgattctcatgcctcag

SEQ ID NO: 29379 - DNA, 20 bp, Artificial
  CRISPR gRNA sequence
tcatgcctcagcctcccaag

SEQ ID NO: 29380 - DNA, 20 bp, Artificial
  CRISPR gRNA sequence
atgcctcagcctcccaagta

SEQ ID NO: 29381 - DNA, 20 bp, Artificial
  CRISPR gRNA sequence
agcctcccaagtagctggga

SEQ ID NO: 29382 - DNA, 20 bp, Artificial
  CRISPR gRNA sequence
ccaagtagctgggattacag

SEQ ID NO: 29383 - DNA, 20 bp, Artificial
  CRISPR gRNA sequence
ggattacagatgcccgccac

SEQ ID NO: 29384 - DNA, 20 bp, Artificial
  CRISPR gRNA sequence
cagatgcccgccaccacacc

SEQ ID NO: 29385 - DNA, 20 bp, Artificial
  CRISPR gRNA sequence
tttttgtgttttcagtagag

SEQ ID NO: 29386 - DNA, 20 bp, Artificial
  CRISPR gRNA sequence
ttgtgttttcagtagagaca

SEQ ID NO: 29387 - DNA, 20 bp, Artificial
  CRISPR gRNA sequence
tgtgttttcagtagagacag

SEQ ID NO: 29388 - DNA, 20 bp, Artificial
  CRISPR gRNA sequence
gtgttttcagtagagacagg

SEQ ID NO: 29389 - DNA, 20 bp, Artificial
  CRISPR gRNA sequence
tgttttcagtagagacaggg

SEQ ID NO: 29390 - DNA, 20 bp, Artificial
  CRISPR gRNA sequence
tcagtagagacagggcttcg

SEQ ID NO: 29391 - DNA, 20 bp, Artificial
  CRISPR gRNA sequence
cagtagagacagggcttcgc

SEQ ID NO: 29392 - DNA, 20 bp, Artificial
  CRISPR gRNA sequence
agtagagacagggcttcgcc

SEQ ID NO: 29393 - DNA, 20 bp, Artificial
  CRISPR gRNA sequence
cgccatgtggcccagactgg

SEQ ID NO: 29394 - DNA, 20 bp, Artificial
  CRISPR gRNA sequence
gccatgtggcccagactggt

SEQ ID NO: 29395 - DNA, 20 bp, Artificial
  CRISPR gRNA sequence
gtcttgaaatcctgggccca

SEQ ID NO: 29396 - DNA, 20 bp, Artificial
  CRISPR gRNA sequence
gaaatcctgggcccaagcga

SEQ ID NO: 29397 - DNA, 20 bp, Artificial
  CRISPR gRNA sequence
aaatcctgggcccaagcgat

SEQ ID NO: 29398 - DNA, 20 bp, Artificial
  CRISPR gRNA sequence
ggcccaagcgatccacccac

SEQ ID NO: 29399 - DNA, 20 bp, Artificial
  CRISPR gRNA sequence
agccttccaaagtgctggga

SEQ ID NO: 29400 - DNA, 20 bp, Artificial
  CRISPR gRNA sequence
ccaaagtgctgggattacgg

SEQ ID NO: 29401 - DNA, 20 bp, Artificial
  CRISPR gRNA sequence
caaagtgctgggattacggg

SEQ ID NO: 29402 - DNA, 20 bp, Artificial
  CRISPR gRNA sequence
ggattacgggtgtgagccac

SEQ ID NO: 29403 - DNA, 20 bp, Artificial
  CRISPR gRNA sequence
cgggtgtgagccaccatgcc

SEQ ID NO: 29404 - DNA, 20 bp, Artificial
  CRISPR gRNA sequence
atttaccctttaagaaacat

SEQ ID NO: 29405 - DNA, 20 bp, Artificial
  CRISPR gRNA sequence
accctttaagaaacatcata

SEQ ID NO: 29406 - DNA, 20 bp, Artificial
  CRISPR gRNA sequence
ccctttaagaaacatcatat

SEQ ID NO: 29407 - DNA, 20 bp, Artificial
  CRISPR gRNA sequence
taagaaacatcatatttcat

SEQ ID NO: 29408 - DNA, 20 bp, Artificial
  CRISPR gRNA sequence
aagaaacatcatatttcatg

SEQ ID NO: 29409 - DNA, 20 bp, Artificial
  CRISPR gRNA sequence
agaaacatcatatttcatgg

SEQ ID NO: 29410 - DNA, 20 bp, Artificial
  CRISPR gRNA sequence
catggaatctaagatgccat

SEQ ID NO: 29411 - DNA, 20 bp, Artificial
  CRISPR gRNA sequence
atggaatctaagatgccatc

SEQ ID NO: 29412 - DNA, 20 bp, Artificial
  CRISPR gRNA sequence
agatgccatccattgtaaga

SEQ ID NO: 29413 - DNA, 20 bp, Artificial
  CRISPR gRNA sequence
taagaccccaatatgaggcc

SEQ ID NO: 29414 - DNA, 20 bp, Artificial
  CRISPR gRNA sequence
tgacacgctattggttataa

SEQ ID NO: 29415 - DNA, 20 bp, Artificial
  CRISPR gRNA sequence
ttggttataagacacatcct

SEQ ID NO: 29416 - DNA, 20 bp, Artificial
  CRISPR gRNA sequence
gttataagacacatcctgat

SEQ ID NO: 29417 - DNA, 20 bp, Artificial
  CRISPR gRNA sequence
taagacacatcctgatctca

SEQ ID NO: 29418 - DNA, 20 bp, Artificial
  CRISPR gRNA sequence
atctcaatgatattcaaatg

SEQ ID NO: 29419 - DNA, 20 bp, Artificial
  CRISPR gRNA sequence
aatgatattcaaatggtgac

SEQ ID NO: 29420 - DNA, 20 bp, Artificial
  CRISPR gRNA sequence
aaatggtgacatatatgtct

SEQ ID NO: 29421 - DNA, 20 bp, Artificial
  CRISPR gRNA sequence
ggcatcgatgaaatatggtc

SEQ ID NO: 29422 - DNA, 20 bp, Artificial
  CRISPR gRNA sequence
gcatcgatgaaatatggtca

SEQ ID NO: 29423 - DNA, 20 bp, Artificial
  CRISPR gRNA sequence
ctctccctgtggggtggagg

SEQ ID NO: 29424 - DNA, 20 bp, Artificial
  CRISPR gRNA sequence
tccctgtggggtggaggaag

SEQ ID NO: 29425 - DNA, 20 bp, Artificial
  CRISPR gRNA sequence
cctgtggggtggaggaaggg

SEQ ID NO: 29426 - DNA, 20 bp, Artificial
  CRISPR gRNA sequence
tggggtggaggaagggtctc

SEQ ID NO: 29427 - DNA, 20 bp, Artificial
  CRISPR gRNA sequence
cagggttcagagattgcaaa

SEQ ID NO: 29428 - DNA, 20 bp, Artificial
  CRISPR gRNA sequence
agagattgcaaaacccccat

SEQ ID NO: 29429 - DNA, 20 bp, Artificial
  CRISPR gRNA sequence
caaaacccccatctagtttc

SEQ ID NO: 29430 - DNA, 20 bp, Artificial
  CRISPR gRNA sequence
gtttctgcactggtaccggc

SEQ ID NO: 29431 - DNA, 20 bp, Artificial
  CRISPR gRNA sequence
ctgcactggtaccggccgac

SEQ ID NO: 29432 - DNA, 20 bp, Artificial
  CRISPR gRNA sequence
tgcactggtaccggccgacc

SEQ ID NO: 29433 - DNA, 20 bp, Artificial
  CRISPR gRNA sequence
cactggtaccggccgacccg

SEQ ID NO: 29434 - DNA, 20 bp, Artificial
  CRISPR gRNA sequence
gtaccggccgacccgtgatg

SEQ ID NO: 29435 - DNA, 20 bp, Artificial
  CRISPR gRNA sequence
atttagcctgaatccacttg

SEQ ID NO: 29436 - DNA, 20 bp, Artificial
  CRISPR gRNA sequence
agcctgaatccacttggcag

SEQ ID NO: 29437 - DNA, 20 bp, Artificial
  CRISPR gRNA sequence
gcctgaatccacttggcagc

SEQ ID NO: 29438 - DNA, 20 bp, Artificial
  CRISPR gRNA sequence
aatccacttggcagcagtgt

SEQ ID NO: 29439 - DNA, 20 bp, Artificial
  CRISPR gRNA sequence
ggcagcagtgtaaacctgct

SEQ ID NO: 29440 - DNA, 20 bp, Artificial
  CRISPR gRNA sequence
gcagcagtgtaaacctgctg

SEQ ID NO: 29441 - DNA, 20 bp, Artificial
  CRISPR gRNA sequence
ctgcatttatttattttttt

SEQ ID NO: 29442 - DNA, 20 bp, Artificial
  CRISPR gRNA sequence
catttatttatttttttctt

SEQ ID NO: 29443 - DNA, 20 bp, Artificial
  CRISPR gRNA sequence
atttatttttttcttttttt

SEQ ID NO: 29444 - DNA, 20 bp, Artificial
  CRISPR gRNA sequence
tttatttttttctttttttt

SEQ ID NO: 29445 - DNA, 20 bp, Artificial
  CRISPR gRNA sequence
atttttttctttttttttcg

SEQ ID NO: 29446 - DNA, 20 bp, Artificial
  CRISPR gRNA sequence
tttttttctttttttttcga

SEQ ID NO: 29447 - DNA, 20 bp, Artificial
  CRISPR gRNA sequence
ttttctttttttttcgagac

SEQ ID NO: 29448 - DNA, 20 bp, Artificial
  CRISPR gRNA sequence
tttctttttttttcgagaca

SEQ ID NO: 29449 - DNA, 20 bp, Artificial
  CRISPR gRNA sequence
ttctttttttttcgagacag

SEQ ID NO: 29450 - DNA, 20 bp, Artificial
  CRISPR gRNA sequence
tctttttttttcgagacaga

SEQ ID NO: 29451 - DNA, 20 bp, Artificial
  CRISPR gRNA sequence
ctttttttttcgagacagag

SEQ ID NO: 29452 - DNA, 20 bp, Artificial
  CRISPR gRNA sequence
tttttttttcgagacagagt

SEQ ID NO: 29453 - DNA, 20 bp, Artificial
  CRISPR gRNA sequence
tttttttcgagacagagttt

SEQ ID NO: 29454 - DNA, 20 bp, Artificial
  CRISPR gRNA sequence
ttttttcgagacagagtttc

SEQ ID NO: 29455 - DNA, 20 bp, Artificial
  CRISPR gRNA sequence
tttttcgagacagagtttcg

SEQ ID NO: 29456 - DNA, 20 bp, Artificial
  CRISPR gRNA sequence
ttttcgagacagagtttcgc

SEQ ID NO: 29457 - DNA, 20 bp, Artificial
  CRISPR gRNA sequence
tttcgagacagagtttcgct

SEQ ID NO: 29458 - DNA, 20 bp, Artificial
  CRISPR gRNA sequence
ttcgagacagagtttcgctc

SEQ ID NO: 29459 - DNA, 20 bp, Artificial
  CRISPR gRNA sequence
tcgagacagagtttcgctct

SEQ ID NO: 29460 - DNA, 20 bp, Artificial
  CRISPR gRNA sequence
cgagacagagtttcgctctt

SEQ ID NO: 29461 - DNA, 20 bp, Artificial
  CRISPR gRNA sequence
gagacagagtttcgctcttg

SEQ ID NO: 29462 - DNA, 20 bp, Artificial
  CRISPR gRNA sequence
cgctcttgttgccaaggctg

SEQ ID NO: 29463 - DNA, 20 bp, Artificial
  CRISPR gRNA sequence
gctcttgttgccaaggctgg

SEQ ID NO: 29464 - DNA, 20 bp, Artificial
  CRISPR gRNA sequence
ttgttgccaaggctggagtg

SEQ ID NO: 29465 - DNA, 20 bp, Artificial
  CRISPR gRNA sequence
gttgccaaggctggagtgca

SEQ ID NO: 29466 - DNA, 20 bp, Artificial
  CRISPR gRNA sequence
ttgccaaggctggagtgcag

SEQ ID NO: 29467 - DNA, 20 bp, Artificial
  CRISPR gRNA sequence
ccaaggctggagtgcagtct

SEQ ID NO: 29468 - DNA, 20 bp, Artificial
  CRISPR gRNA sequence
gagtgcagtctcagttcact

SEQ ID NO: 29469 - DNA, 20 bp, Artificial
  CRISPR gRNA sequence
agttcactgcaactccgcct

SEQ ID NO: 29470 - DNA, 20 bp, Artificial
  CRISPR gRNA sequence
actgcaactccgcctcccga

SEQ ID NO: 29471 - DNA, 20 bp, Artificial
  CRISPR gRNA sequence
caactccgcctcccgagttc

SEQ ID NO: 29472 - DNA, 20 bp, Artificial
  CRISPR gRNA sequence
cgcctcccgagttcaagcaa

SEQ ID NO: 29473 - DNA, 20 bp, Artificial
  CRISPR gRNA sequence
ccgagttcaagcaattctcc

SEQ ID NO: 29474 - DNA, 20 bp, Artificial
  CRISPR gRNA sequence
aagcaattctcctgcctcag

SEQ ID NO: 29475 - DNA, 20 bp, Artificial
  CRISPR gRNA sequence
tcctgcctcagcctctcaag

SEQ ID NO: 29476 - DNA, 20 bp, Artificial
  CRISPR gRNA sequence
ctgcctcagcctctcaagta

SEQ ID NO: 29477 - DNA, 20 bp, Artificial
  CRISPR gRNA sequence
cctcagcctctcaagtagct

SEQ ID NO: 29478 - DNA, 20 bp, Artificial
  CRISPR gRNA sequence
agcctctcaagtagctggga

SEQ ID NO: 29479 - DNA, 20 bp, Artificial
  CRISPR gRNA sequence
tcaagtagctgggagtatag

SEQ ID NO: 29480 - DNA, 20 bp, Artificial
  CRISPR gRNA sequence
aagtagctgggagtataggc

SEQ ID NO: 29481 - DNA, 20 bp, Artificial
  CRISPR gRNA sequence
ggagtataggcatgtgccat

SEQ ID NO: 29482 - DNA, 20 bp, Artificial
  CRISPR gRNA sequence
attttgtatttttagtagag

SEQ ID NO: 29483 - DNA, 20 bp, Artificial
  CRISPR gRNA sequence
tgtatttttagtagagacgg

SEQ ID NO: 29484 - DNA, 20 bp, Artificial
  CRISPR gRNA sequence
gtatttttagtagagacggg

SEQ ID NO: 29485 - DNA, 20 bp, Artificial
  CRISPR gRNA sequence
tatttttagtagagacgggg

SEQ ID NO: 29486 - DNA, 20 bp, Artificial
  CRISPR gRNA sequence
ttagtagagacggggtttct

SEQ ID NO: 29487 - DNA, 20 bp, Artificial
  CRISPR gRNA sequence
tagtagagacggggtttctc

SEQ ID NO: 29488 - DNA, 20 bp, Artificial
  CRISPR gRNA sequence
agtagagacggggtttctcc

SEQ ID NO: 29489 - DNA, 20 bp, Artificial
  CRISPR gRNA sequence
gtagagacggggtttctcca

SEQ ID NO: 29490 - DNA, 20 bp, Artificial
  CRISPR gRNA sequence
ctccatgttggtcaggctgg

SEQ ID NO: 29491 - DNA, 20 bp, Artificial
  CRISPR gRNA sequence
tccatgttggtcaggctggt

SEQ ID NO: 29492 - DNA, 20 bp, Artificial
  CRISPR gRNA sequence
catgttggtcaggctggtct

SEQ ID NO: 29493 - DNA, 20 bp, Artificial
  CRISPR gRNA sequence
gtcaggctggtctcaaactc

SEQ ID NO: 29494 - DNA, 20 bp, Artificial
  CRISPR gRNA sequence
gtctcaaactcccgacctta

SEQ ID NO: 29495 - DNA, 20 bp, Artificial
  CRISPR gRNA sequence
aaactcccgaccttaggtga

SEQ ID NO: 29496 - DNA, 20 bp, Artificial
  CRISPR gRNA sequence
ccgaccttaggtgatccacc

SEQ ID NO: 29497 - DNA, 20 bp, Artificial
  CRISPR gRNA sequence
aggtgatccacccgcctcgg

SEQ ID NO: 29498 - DNA, 20 bp, Artificial
  CRISPR gRNA sequence
ggtgatccacccgcctcggc

SEQ ID NO: 29499 - DNA, 20 bp, Artificial
  CRISPR gRNA sequence
ggcctccaaagtgttaggat

SEQ ID NO: 29500 - DNA, 20 bp, Artificial
  CRISPR gRNA sequence
caaagtgttaggattacagg

SEQ ID NO: 29501 - DNA, 20 bp, Artificial
  CRISPR gRNA sequence
ggattacaggcgtgagccac

SEQ ID NO: 29502 - DNA, 20 bp, Artificial
  CRISPR gRNA sequence
caggcgtgagccactgcacc

SEQ ID NO: 29503 - DNA, 20 bp, Artificial
  CRISPR gRNA sequence
cacctgctgcttttatatgc

SEQ ID NO: 29504 - DNA, 20 bp, Artificial
  CRISPR gRNA sequence
ctgcttttatatgcagccct

SEQ ID NO: 29505 - DNA, 20 bp, Artificial
  CRISPR gRNA sequence
cttttatatgcagccctgca

SEQ ID NO: 29506 - DNA, 20 bp, Artificial
  CRISPR gRNA sequence
ttatatgcagccctgcaagg

SEQ ID NO: 29507 - DNA, 20 bp, Artificial
  CRISPR gRNA sequence
tatatgcagccctgcaaggg

SEQ ID NO: 29508 - DNA, 20 bp, Artificial
  CRISPR gRNA sequence
atatgcagccctgcaaggga

SEQ ID NO: 29509 - DNA, 20 bp, Artificial
  CRISPR gRNA sequence
tatgcagccctgcaagggag

SEQ ID NO: 29510 - DNA, 20 bp, Artificial
  CRISPR gRNA sequence
caagggagttctgaggctga

SEQ ID NO: 29511 - DNA, 20 bp, Artificial
  CRISPR gRNA sequence
tgaggctgaatcatggcaaa

SEQ ID NO: 29512 - DNA, 20 bp, Artificial
  CRISPR gRNA sequence
aggctgaatcatggcaaagt

SEQ ID NO: 29513 - DNA, 20 bp, Artificial
  CRISPR gRNA sequence
aatcatggcaaagtcatggc

SEQ ID NO: 29514 - DNA, 20 bp, Artificial
  CRISPR gRNA sequence
aaatcatacccgcagcagca

SEQ ID NO: 29515 - DNA, 20 bp, Artificial
  CRISPR gRNA sequence
acctgttaaaaggctgcttg

SEQ ID NO: 29516 - DNA, 20 bp, Artificial
  CRISPR gRNA sequence
ttaaaaggctgcttggtgtc

SEQ ID NO: 29517 - DNA, 20 bp, Artificial
  CRISPR gRNA sequence
aaaggctgcttggtgtcgag

SEQ ID NO: 29518 - DNA, 20 bp, Artificial
  CRISPR gRNA sequence
cttggtgtcgagtaaacagc

SEQ ID NO: 29519 - DNA, 20 bp, Artificial
  CRISPR gRNA sequence
ggtgtcgagtaaacagctga

SEQ ID NO: 29520 - DNA, 20 bp, Artificial
  CRISPR gRNA sequence
gtgtcgagtaaacagctgaa

SEQ ID NO: 29521 - DNA, 20 bp, Artificial
  CRISPR gRNA sequence
aagttggcatcagtgacact

SEQ ID NO: 29522 - DNA, 20 bp, Artificial
  CRISPR gRNA sequence
gcatcagtgacactcatcat

SEQ ID NO: 29523 - DNA, 20 bp, Artificial
  CRISPR gRNA sequence
atcatgctattttcactgct

SEQ ID NO: 29524 - DNA, 20 bp, Artificial
  CRISPR gRNA sequence
ttttcactgctactaatgct

SEQ ID NO: 29525 - DNA, 20 bp, Artificial
  CRISPR gRNA sequence
tcactgctactaatgctggt

SEQ ID NO: 29526 - DNA, 20 bp, Artificial
  CRISPR gRNA sequence
cactgctactaatgctggtt

SEQ ID NO: 29527 - DNA, 20 bp, Artificial
  CRISPR gRNA sequence
actgctactaatgctggttg

SEQ ID NO: 29528 - DNA, 20 bp, Artificial
  CRISPR gRNA sequence
ctactaatgctggttgtgaa

SEQ ID NO: 29529 - DNA, 20 bp, Artificial
  CRISPR gRNA sequence
ctaatgctggttgtgaatat

SEQ ID NO: 29530 - DNA, 20 bp, Artificial
  CRISPR gRNA sequence
atgctggttgtgaatatgct

SEQ ID NO: 29531 - DNA, 20 bp, Artificial
  CRISPR gRNA sequence
gttgtgaatatgctgcagaa

SEQ ID NO: 29532 - DNA, 20 bp, Artificial
  CRISPR gRNA sequence
tgaatatgctgcagaaactg

SEQ ID NO: 29533 - DNA, 20 bp, Artificial
  CRISPR gRNA sequence
cagaaactggagctggtcca

SEQ ID NO: 29534 - DNA, 20 bp, Artificial
  CRISPR gRNA sequence
gagctggtccagtgactggc

SEQ ID NO: 29535 - DNA, 20 bp, Artificial
  CRISPR gRNA sequence
gtccagtgactggctttttc

SEQ ID NO: 29536 - DNA, 20 bp, Artificial
  CRISPR gRNA sequence
gctttttctcttcctgcccc

SEQ ID NO: 29537 - DNA, 20 bp, Artificial
  CRISPR gRNA sequence
tttctcttcctgcccccagt

SEQ ID NO: 29538 - DNA, 20 bp, Artificial
  CRISPR gRNA sequence
ttctcttcctgcccccagtg

SEQ ID NO: 29539 - DNA, 20 bp, Artificial
  CRISPR gRNA sequence
tctcttcctgcccccagtgc

SEQ ID NO: 29540 - DNA, 20 bp, Artificial
  CRISPR gRNA sequence
ctcttcctgcccccagtgct

SEQ ID NO: 29541 - DNA, 20 bp, Artificial
  CRISPR gRNA sequence
tcttcctgcccccagtgctg

SEQ ID NO: 29542 - DNA, 20 bp, Artificial
  CRISPR gRNA sequence
ttcctgcccccagtgctggt

SEQ ID NO: 29543 - DNA, 20 bp, Artificial
  CRISPR gRNA sequence
cctgcccccagtgctggtca

SEQ ID NO: 29544 - DNA, 20 bp, Artificial
  CRISPR gRNA sequence
ctgcccccagtgctggtcac

SEQ ID NO: 29545 - DNA, 20 bp, Artificial
  CRISPR gRNA sequence
cccccagtgctggtcacacc

SEQ ID NO: 29546 - DNA, 20 bp, Artificial
  CRISPR gRNA sequence
gtcacaccctctatgttaac

SEQ ID NO: 29547 - DNA, 20 bp, Artificial
  CRISPR gRNA sequence
tatgttaactcatgcgaccc

SEQ ID NO: 29548 - DNA, 20 bp, Artificial
  CRISPR gRNA sequence
tgttaactcatgcgaccctc

SEQ ID NO: 29549 - DNA, 20 bp, Artificial
  CRISPR gRNA sequence
actcatgcgaccctcaccaa

SEQ ID NO: 29550 - DNA, 20 bp, Artificial
  CRISPR gRNA sequence
atgcgaccctcaccaatgtt

SEQ ID NO: 29551 - DNA, 20 bp, Artificial
  CRISPR gRNA sequence
accaatgttcctgtgatgta

SEQ ID NO: 29552 - DNA, 20 bp, Artificial
  CRISPR gRNA sequence
ctgtgatgtagtcagaacca

SEQ ID NO: 29553 - DNA, 20 bp, Artificial
  CRISPR gRNA sequence
tgatgtagtcagaaccatag

SEQ ID NO: 29554 - DNA, 20 bp, Artificial
  CRISPR gRNA sequence
acatttagttcattctaggc

SEQ ID NO: 29555 - DNA, 20 bp, Artificial
  CRISPR gRNA sequence
agttcattctaggcaccaag

SEQ ID NO: 29556 - DNA, 20 bp, Artificial
  CRISPR gRNA sequence
gttcattctaggcaccaagg

SEQ ID NO: 29557 - DNA, 20 bp, Artificial
  CRISPR gRNA sequence
attctaggcaccaaggcatg

SEQ ID NO: 29558 - DNA, 20 bp, Artificial
  CRISPR gRNA sequence
taggcaccaaggcatgttct

SEQ ID NO: 29559 - DNA, 20 bp, Artificial
  CRISPR gRNA sequence
ggcaccaaggcatgttctaa

SEQ ID NO: 29560 - DNA, 20 bp, Artificial
  CRISPR gRNA sequence
taaatgttatatcagcattg

SEQ ID NO: 29561 - DNA, 20 bp, Artificial
  CRISPR gRNA sequence
aatgttatatcagcattgat

SEQ ID NO: 29562 - DNA, 20 bp, Artificial
  CRISPR gRNA sequence
tatcagcattgattcattta

SEQ ID NO: 29563 - DNA, 20 bp, Artificial
  CRISPR gRNA sequence
attcatttactcctccccac

SEQ ID NO: 29564 - DNA, 20 bp, Artificial
  CRISPR gRNA sequence
atttactcctccccacaatg

SEQ ID NO: 29565 - DNA, 20 bp, Artificial
  CRISPR gRNA sequence
actcctccccacaatgactc

SEQ ID NO: 29566 - DNA, 20 bp, Artificial
  CRISPR gRNA sequence
ctcctccccacaatgactct

SEQ ID NO: 29567 - DNA, 20 bp, Artificial
  CRISPR gRNA sequence
ctccccacaatgactctatc

SEQ ID NO: 29568 - DNA, 20 bp, Artificial
  CRISPR gRNA sequence
cccacaatgactctatcatg

SEQ ID NO: 29569 - DNA, 20 bp, Artificial
  CRISPR gRNA sequence
tatcatgcccattttacaga

SEQ ID NO: 29570 - DNA, 20 bp, Artificial
  CRISPR gRNA sequence
tcatgcccattttacagatg

SEQ ID NO: 29571 - DNA, 20 bp, Artificial
  CRISPR gRNA sequence
tacagatgggcaaactgagt

SEQ ID NO: 29572 - DNA, 20 bp, Artificial
  CRISPR gRNA sequence
acagatgggcaaactgagtc

SEQ ID NO: 29573 - DNA, 20 bp, Artificial
  CRISPR gRNA sequence
cagatgggcaaactgagtct

SEQ ID NO: 29574 - DNA, 20 bp, Artificial
  CRISPR gRNA sequence
agtctcagaagagttgagta

SEQ ID NO: 29575 - DNA, 20 bp, Artificial
  CRISPR gRNA sequence
agaagagttgagtagcttgc

SEQ ID NO: 29576 - DNA, 20 bp, Artificial
  CRISPR gRNA sequence
agtagcttgcccaaggtcac

SEQ ID NO: 29577 - DNA, 20 bp, Artificial
  CRISPR gRNA sequence
gcccaaggtcacataggcag

SEQ ID NO: 29578 - DNA, 20 bp, Artificial
  CRISPR gRNA sequence
cccaaggtcacataggcagt

SEQ ID NO: 29579 - DNA, 20 bp, Artificial
  CRISPR gRNA sequence
ggatttgaacttgggaagtt

SEQ ID NO: 29580 - DNA, 20 bp, Artificial
  CRISPR gRNA sequence
gaacttgggaagttgttctg

SEQ ID NO: 29581 - DNA, 20 bp, Artificial
  CRISPR gRNA sequence
aacttgggaagttgttctga

SEQ ID NO: 29582 - DNA, 20 bp, Artificial
  CRISPR gRNA sequence
gggaagttgttctgacagtt

SEQ ID NO: 29583 - DNA, 20 bp, Artificial
  CRISPR gRNA sequence
ggaagttgttctgacagttt

SEQ ID NO: 29584 - DNA, 20 bp, Artificial
  CRISPR gRNA sequence
ttctgacagtttccacacag

SEQ ID NO: 29585 - DNA, 20 bp, Artificial
  CRISPR gRNA sequence
tgacagtttccacacagtaa

SEQ ID NO: 29586 - DNA, 20 bp, Artificial
  CRISPR gRNA sequence
acagtttccacacagtaagg

SEQ ID NO: 29587 - DNA, 20 bp, Artificial
  CRISPR gRNA sequence
ccacacagtaaggcaagaaa

SEQ ID NO: 29588 - DNA, 20 bp, Artificial
  CRISPR gRNA sequence
cacacagtaaggcaagaaat

SEQ ID NO: 29589 - DNA, 20 bp, Artificial
  CRISPR gRNA sequence
ccttttagtcctgctgtttt

SEQ ID NO: 29590 - DNA, 20 bp, Artificial
  CRISPR gRNA sequence
cttttagtcctgctgttttc

SEQ ID NO: 29591 - DNA, 20 bp, Artificial
  CRISPR gRNA sequence
ttagtcctgctgttttcctg

SEQ ID NO: 29592 - DNA, 20 bp, Artificial
  CRISPR gRNA sequence
tagtcctgctgttttcctgg

SEQ ID NO: 29593 - DNA, 20 bp, Artificial
  CRISPR gRNA sequence
agtcctgctgttttcctggg

SEQ ID NO: 29594 - DNA, 20 bp, Artificial
  CRISPR gRNA sequence
gtcctgctgttttcctgggc

SEQ ID NO: 29595 - DNA, 20 bp, Artificial
  CRISPR gRNA sequence
ctgttttcctgggctcactg

SEQ ID NO: 29596 - DNA, 20 bp, Artificial
  CRISPR gRNA sequence
ttttcctgggctcactgttt

SEQ ID NO: 29597 - DNA, 20 bp, Artificial
  CRISPR gRNA sequence
tcctgggctcactgtttgac

SEQ ID NO: 29598 - DNA, 20 bp, Artificial
  CRISPR gRNA sequence
cctgggctcactgtttgacc

SEQ ID NO: 29599 - DNA, 20 bp, Artificial
  CRISPR gRNA sequence
ctgggctcactgtttgacca

SEQ ID NO: 29600 - DNA, 20 bp, Artificial
  CRISPR gRNA sequence
ggctcactgtttgaccacag

SEQ ID NO: 29601 - DNA, 20 bp, Artificial
  CRISPR gRNA sequence
actgtttgaccacagagaag

SEQ ID NO: 29602 - DNA, 20 bp, Artificial
  CRISPR gRNA sequence
tttgaccacagagaagtggt

SEQ ID NO: 29603 - DNA, 20 bp, Artificial
  CRISPR gRNA sequence
gaccacagagaagtggtctc

SEQ ID NO: 29604 - DNA, 20 bp, Artificial
  CRISPR gRNA sequence
accacagagaagtggtctca

SEQ ID NO: 29605 - DNA, 20 bp, Artificial
  CRISPR gRNA sequence
aactctctgggtcttggttt

SEQ ID NO: 29606 - DNA, 20 bp, Artificial
  CRISPR gRNA sequence
tctgggtcttggtttgcctg

SEQ ID NO: 29607 - DNA, 20 bp, Artificial
  CRISPR gRNA sequence
tgggtcttggtttgcctgtc

SEQ ID NO: 29608 - DNA, 20 bp, Artificial
  CRISPR gRNA sequence
ggtcttggtttgcctgtctt

SEQ ID NO: 29609 - DNA, 20 bp, Artificial
  CRISPR gRNA sequence
ggtttgcctgtctttaaaat

SEQ ID NO: 29610 - DNA, 20 bp, Artificial
  CRISPR gRNA sequence
gtttgcctgtctttaaaatg

SEQ ID NO: 29611 - DNA, 20 bp, Artificial
  CRISPR gRNA sequence
gcctgtctttaaaatggggc

SEQ ID NO: 29612 - DNA, 20 bp, Artificial
  CRISPR gRNA sequence
cctgtctttaaaatggggca

SEQ ID NO: 29613 - DNA, 20 bp, Artificial
  CRISPR gRNA sequence
tctttaaaatggggcagtaa

SEQ ID NO: 29614 - DNA, 20 bp, Artificial
  CRISPR gRNA sequence
taaaatggggcagtaatccc

SEQ ID NO: 29615 - DNA, 20 bp, Artificial
  CRISPR gRNA sequence
aaaatggggcagtaatccca

SEQ ID NO: 29616 - DNA, 20 bp, Artificial
  CRISPR gRNA sequence
aaatggggcagtaatcccag

SEQ ID NO: 29617 - DNA, 20 bp, Artificial
  CRISPR gRNA sequence
ccacggggctgacctccagg

SEQ ID NO: 29618 - DNA, 20 bp, Artificial
  CRISPR gRNA sequence
acctccaggctgcaggggac

SEQ ID NO: 29619 - DNA, 20 bp, Artificial
  CRISPR gRNA sequence
caggctgcaggggacactga

SEQ ID NO: 29620 - DNA, 20 bp, Artificial
  CRISPR gRNA sequence
caggggacactgagatccta

SEQ ID NO: 29621 - DNA, 20 bp, Artificial
  CRISPR gRNA sequence
agatcctagaagcaatcacc

SEQ ID NO: 29622 - DNA, 20 bp, Artificial
  CRISPR gRNA sequence
gaagcaatcaccacagccct

SEQ ID NO: 29623 - DNA, 20 bp, Artificial
  CRISPR gRNA sequence
aacaagagaactagtgggac

SEQ ID NO: 29624 - DNA, 20 bp, Artificial
  CRISPR gRNA sequence
gtgggacctggggacagaaa

SEQ ID NO: 29625 - DNA, 20 bp, Artificial
  CRISPR gRNA sequence
gggacagaaactttgagcaa

SEQ ID NO: 29626 - DNA, 20 bp, Artificial
  CRISPR gRNA sequence
tgagcaagtcacttattcat

SEQ ID NO: 29627 - DNA, 20 bp, Artificial
  CRISPR gRNA sequence
gagcaagtcacttattcatt

SEQ ID NO: 29628 - DNA, 20 bp, Artificial
  CRISPR gRNA sequence
agcaagtcacttattcattc

SEQ ID NO: 29629 - DNA, 20 bp, Artificial
  CRISPR gRNA sequence
attcattcctagcctctatt

SEQ ID NO: 29630 - DNA, 20 bp, Artificial
  CRISPR gRNA sequence
ttcattcctagcctctattt

SEQ ID NO: 29631 - DNA, 20 bp, Artificial
  CRISPR gRNA sequence
attcctagcctctattttca

SEQ ID NO: 29632 - DNA, 20 bp, Artificial
  CRISPR gRNA sequence
ctagcctctattttcatatc

SEQ ID NO: 29633 - DNA, 20 bp, Artificial
  CRISPR gRNA sequence
gcctctattttcatatctag

SEQ ID NO: 29634 - DNA, 20 bp, Artificial
  CRISPR gRNA sequence
tattttcatatctagaaaat

SEQ ID NO: 29635 - DNA, 20 bp, Artificial
  CRISPR gRNA sequence
ttttcatatctagaaaatgg

SEQ ID NO: 29636 - DNA, 20 bp, Artificial
  CRISPR gRNA sequence
tcatatctagaaaatgggaa

SEQ ID NO: 29637 - DNA, 20 bp, Artificial
  CRISPR gRNA sequence
catatctagaaaatgggaac

SEQ ID NO: 29638 - DNA, 20 bp, Artificial
  CRISPR gRNA sequence
atatctagaaaatgggaacc

SEQ ID NO: 29639 - DNA, 20 bp, Artificial
  CRISPR gRNA sequence
gaaaatgggaaccatcccaa

SEQ ID NO: 29640 - DNA, 20 bp, Artificial
  CRISPR gRNA sequence
tgtaagtacttggcacaatg

SEQ ID NO: 29641 - DNA, 20 bp, Artificial
  CRISPR gRNA sequence
ggcacaatgccaggctctgt

SEQ ID NO: 29642 - DNA, 20 bp, Artificial
  CRISPR gRNA sequence
gcacaatgccaggctctgtt

SEQ ID NO: 29643 - DNA, 20 bp, Artificial
  CRISPR gRNA sequence
tgttgtgcaataaatattga

SEQ ID NO: 29644 - DNA, 20 bp, Artificial
  CRISPR gRNA sequence
ttgtgcaataaatattgatt

SEQ ID NO: 29645 - DNA, 20 bp, Artificial
  CRISPR gRNA sequence
tgcaataaatattgattcct

SEQ ID NO: 29646 - DNA, 20 bp, Artificial
  CRISPR gRNA sequence
attccttcccccagggatag

SEQ ID NO: 29647 - DNA, 20 bp, Artificial
  CRISPR gRNA sequence
cttcccccagggatagtggg

SEQ ID NO: 29648 - DNA, 20 bp, Artificial
  CRISPR gRNA sequence
cccccagggatagtgggacc

SEQ ID NO: 29649 - DNA, 20 bp, Artificial
  CRISPR gRNA sequence
ccccagggatagtgggacca

SEQ ID NO: 29650 - DNA, 20 bp, Artificial
  CRISPR gRNA sequence
tttctggaatctagggatgg

SEQ ID NO: 29651 - DNA, 20 bp, Artificial
  CRISPR gRNA sequence
ttctggaatctagggatggt

SEQ ID NO: 29652 - DNA, 20 bp, Artificial
  CRISPR gRNA sequence
tctggaatctagggatggtg

SEQ ID NO: 29653 - DNA, 20 bp, Artificial
  CRISPR gRNA sequence
ctggaatctagggatggtgg

SEQ ID NO: 29654 - DNA, 20 bp, Artificial
  CRISPR gRNA sequence
tggaatctagggatggtggc

SEQ ID NO: 29655 - DNA, 20 bp, Artificial
  CRISPR gRNA sequence
gaatctagggatggtggctt

SEQ ID NO: 29656 - DNA, 20 bp, Artificial
  CRISPR gRNA sequence
gggatggtggcttctggaag

SEQ ID NO: 29657 - DNA, 20 bp, Artificial
  CRISPR gRNA sequence
ctggaaggctgaccatgcac

SEQ ID NO: 29658 - DNA, 20 bp, Artificial
  CRISPR gRNA sequence
tggaaggctgaccatgcaca

SEQ ID NO: 29659 - DNA, 20 bp, Artificial
  CRISPR gRNA sequence
gaaggctgaccatgcacagg

SEQ ID NO: 29660 - DNA, 20 bp, Artificial
  CRISPR gRNA sequence
accatgcacaggcctccaat

SEQ ID NO: 29661 - DNA, 20 bp, Artificial
  CRISPR gRNA sequence
caatccctccccctggcctc

SEQ ID NO: 29662 - DNA, 20 bp, Artificial
  CRISPR gRNA sequence
cccctggcctctgtttccga

SEQ ID NO: 29663 - DNA, 20 bp, Artificial
  CRISPR gRNA sequence
gcctctgtttccgacagctt

SEQ ID NO: 29664 - DNA, 20 bp, Artificial
  CRISPR gRNA sequence
tgtttccgacagcttgtaca

SEQ ID NO: 29665 - DNA, 20 bp, Artificial
  CRISPR gRNA sequence
tttccgacagcttgtacaat

SEQ ID NO: 29666 - DNA, 20 bp, Artificial
  CRISPR gRNA sequence
ccgacagcttgtacaataac

SEQ ID NO: 29667 - DNA, 20 bp, Artificial
  CRISPR gRNA sequence
cgacagcttgtacaataact

SEQ ID NO: 29668 - DNA, 20 bp, Artificial
  CRISPR gRNA sequence
gtacaataactgcatctgcg

SEQ ID NO: 29669 - DNA, 20 bp, Artificial
  CRISPR gRNA sequence
tacaataactgcatctgcga

SEQ ID NO: 29670 - DNA, 20 bp, Artificial
  CRISPR gRNA sequence
catctgcgacgtgggagccg

SEQ ID NO: 29671 - DNA, 20 bp, Artificial
  CRISPR gRNA sequence
cgacgtgggagccgagagct

SEQ ID NO: 29672 - DNA, 20 bp, Artificial
  CRISPR gRNA sequence
ggctcgtgtgcttccggaca

SEQ ID NO: 29673 - DNA, 20 bp, Artificial
  CRISPR gRNA sequence
gctcgtgtgcttccggacat

SEQ ID NO: 29674 - DNA, 20 bp, Artificial
  CRISPR gRNA sequence
gtgtgcttccggacatggtg

SEQ ID NO: 29675 - DNA, 20 bp, Artificial
  CRISPR gRNA sequence
ccggacatggtgtccctccg

SEQ ID NO: 29676 - DNA, 20 bp, Artificial
  CRISPR gRNA sequence
cggacatggtgtccctccgg

SEQ ID NO: 29677 - DNA, 20 bp, Artificial
  CRISPR gRNA sequence
cgggtgatggagtgagtgtg

SEQ ID NO: 29678 - DNA, 20 bp, Artificial
  CRISPR gRNA sequence
ggcggtgggtggctcagccc

SEQ ID NO: 29679 - DNA, 20 bp, Artificial
  CRISPR gRNA sequence
agcccggggtgggagacact

SEQ ID NO: 29680 - DNA, 20 bp, Artificial
  CRISPR gRNA sequence
aagtctctccctggtgtcct

SEQ ID NO: 29681 - DNA, 20 bp, Artificial
  CRISPR gRNA sequence
tccctggtgtcctggaagag

SEQ ID NO: 29682 - DNA, 20 bp, Artificial
  CRISPR gRNA sequence
cctggtgtcctggaagagct

SEQ ID NO: 29683 - DNA, 20 bp, Artificial
  CRISPR gRNA sequence
gtgtcctggaagagctggat

SEQ ID NO: 29684 - DNA, 20 bp, Artificial
  CRISPR gRNA sequence
gaagagctggatgtgggggt

SEQ ID NO: 29685 - DNA, 20 bp, Artificial
  CRISPR gRNA sequence
gatgtgggggtggccttggt

SEQ ID NO: 29686 - DNA, 20 bp, Artificial
  CRISPR gRNA sequence
ggtctggagctggggagtcc

SEQ ID NO: 29687 - DNA, 20 bp, Artificial
  CRISPR gRNA sequence
gtctggagctggggagtccc

SEQ ID NO: 29688 - DNA, 20 bp, Artificial
  CRISPR gRNA sequence
gagctggggagtcccaaggg

SEQ ID NO: 29689 - DNA, 20 bp, Artificial
  CRISPR gRNA sequence
gggagtcccaagggccaggc

SEQ ID NO: 29690 - DNA, 20 bp, Artificial
  CRISPR gRNA sequence
ctcttgccagcgtccagtac

SEQ ID NO: 29691 - DNA, 20 bp, Artificial
  CRISPR gRNA sequence
tcttgccagcgtccagtaca

SEQ ID NO: 29692 - DNA, 20 bp, Artificial
  CRISPR gRNA sequence
ttgccagcgtccagtacaac

SEQ ID NO: 29693 - DNA, 20 bp, Artificial
  CRISPR gRNA sequence
gccagcgtccagtacaacaa

SEQ ID NO: 29694 - DNA, 20 bp, Artificial
  CRISPR gRNA sequence
ccagcgtccagtacaacaag

SEQ ID NO: 29695 - DNA, 20 bp, Artificial
  CRISPR gRNA sequence
acggctgccggggcccagca

SEQ ID NO: 29696 - DNA, 20 bp, Artificial
  CRISPR gRNA sequence
ccggggcccagcagctcgct

SEQ ID NO: 29697 - DNA, 20 bp, Artificial
  CRISPR gRNA sequence
gctgccagccttcggaggtg

SEQ ID NO: 29698 - DNA, 20 bp, Artificial
  CRISPR gRNA sequence
ccagccttcggaggtgtcct

SEQ ID NO: 29699 - DNA, 20 bp, Artificial
  CRISPR gRNA sequence
cggaggtgtcctcatgtgga

SEQ ID NO: 29700 - DNA, 20 bp, Artificial
  CRISPR gRNA sequence
ggaggtgtcctcatgtggag

SEQ ID NO: 29701 - DNA, 20 bp, Artificial
  CRISPR gRNA sequence
atgtggagacgctggcgtaa

SEQ ID NO: 29702 - DNA, 20 bp, Artificial
  CRISPR gRNA sequence
gcgtaagtccaggcaaccct

SEQ ID NO: 29703 - DNA, 20 bp, Artificial
  CRISPR gRNA sequence
gtgggtggagaacaactcac

SEQ ID NO: 29704 - DNA, 20 bp, Artificial
  CRISPR gRNA sequence
actccccaggcgtgtggccc

SEQ ID NO: 29705 - DNA, 20 bp, Artificial
  CRISPR gRNA sequence
cccaggcgtgtggcccagtg

SEQ ID NO: 29706 - DNA, 20 bp, Artificial
  CRISPR gRNA sequence
aaatcatgctcttcccttca

SEQ ID NO: 29707 - DNA, 20 bp, Artificial
  CRISPR gRNA sequence
ttcccttcaccaatctgcaa

SEQ ID NO: 29708 - DNA, 20 bp, Artificial
  CRISPR gRNA sequence
cccttcaccaatctgcaacc

SEQ ID NO: 29709 - DNA, 20 bp, Artificial
  CRISPR gRNA sequence
ccttcaccaatctgcaaccc

SEQ ID NO: 29710 - DNA, 20 bp, Artificial
  CRISPR gRNA sequence
caccaatctgcaaccctggg

SEQ ID NO: 29711 - DNA, 20 bp, Artificial
  CRISPR gRNA sequence
accaatctgcaaccctgggt

SEQ ID NO: 29712 - DNA, 20 bp, Artificial
  CRISPR gRNA sequence
caaccctgggtgagcagaca

SEQ ID NO: 29713 - DNA, 20 bp, Artificial
  CRISPR gRNA sequence
ggtgagcagacacttccccc

SEQ ID NO: 29714 - DNA, 20 bp, Artificial
  CRISPR gRNA sequence
ccccctctggcttcagcttc

SEQ ID NO: 29715 - DNA, 20 bp, Artificial
  CRISPR gRNA sequence
cccctctggcttcagcttct

SEQ ID NO: 29716 - DNA, 20 bp, Artificial
  CRISPR gRNA sequence
tggcttcagcttcttcatct

SEQ ID NO: 29717 - DNA, 20 bp, Artificial
  CRISPR gRNA sequence
gcttcagcttcttcatctgt

SEQ ID NO: 29718 - DNA, 20 bp, Artificial
  CRISPR gRNA sequence
cagcttcttcatctgtaaag

SEQ ID NO: 29719 - DNA, 20 bp, Artificial
  CRISPR gRNA sequence
agcttcttcatctgtaaagt

SEQ ID NO: 29720 - DNA, 20 bp, Artificial
  CRISPR gRNA sequence
cttcatctgtaaagtgggga

SEQ ID NO: 29721 - DNA, 20 bp, Artificial
  CRISPR gRNA sequence
ttcatctgtaaagtggggac

SEQ ID NO: 29722 - DNA, 20 bp, Artificial
  CRISPR gRNA sequence
catctgtaaagtggggacag

SEQ ID NO: 29723 - DNA, 20 bp, Artificial
  CRISPR gRNA sequence
atctgtaaagtggggacagt

SEQ ID NO: 29724 - DNA, 20 bp, Artificial
  CRISPR gRNA sequence
taaagtggggacagtaataa

SEQ ID NO: 29725 - DNA, 20 bp, Artificial
  CRISPR gRNA sequence
tgtgaggcttaaactaatca

SEQ ID NO: 29726 - DNA, 20 bp, Artificial
  CRISPR gRNA sequence
gtgaggcttaaactaatcaa

SEQ ID NO: 29727 - DNA, 20 bp, Artificial
  CRISPR gRNA sequence
tgaggcttaaactaatcaag

SEQ ID NO: 29728 - DNA, 20 bp, Artificial
  CRISPR gRNA sequence
aaactaatcaagccctacaa

SEQ ID NO: 29729 - DNA, 20 bp, Artificial
  CRISPR gRNA sequence
aactaatcaagccctacaaa

SEQ ID NO: 29730 - DNA, 20 bp, Artificial
  CRISPR gRNA sequence
atcaagccctacaaagctct

SEQ ID NO: 29731 - DNA, 20 bp, Artificial
  CRISPR gRNA sequence
caaagctcttataacaacag

SEQ ID NO: 29732 - DNA, 20 bp, Artificial
  CRISPR gRNA sequence
ttataacaacagtagctggc

SEQ ID NO: 29733 - DNA, 20 bp, Artificial
  CRISPR gRNA sequence
ataacaacagtagctggcac

SEQ ID NO: 29734 - DNA, 20 bp, Artificial
  CRISPR gRNA sequence
taacaacagtagctggcaca

SEQ ID NO: 29735 - DNA, 20 bp, Artificial
  CRISPR gRNA sequence
gcacacaaaaatgccaataa

SEQ ID NO: 29736 - DNA, 20 bp, Artificial
  CRISPR gRNA sequence
tattaggctgaaccatatga

SEQ ID NO: 29737 - DNA, 20 bp, Artificial
  CRISPR gRNA sequence
ggctgaaccatatgaaattg

SEQ ID NO: 29738 - DNA, 20 bp, Artificial
  CRISPR gRNA sequence
aaccatatgaaattgctgac

SEQ ID NO: 29739 - DNA, 20 bp, Artificial
  CRISPR gRNA sequence
ctgacatccacccatttttg

SEQ ID NO: 29740 - DNA, 20 bp, Artificial
  CRISPR gRNA sequence
acatccacccatttttgacc

SEQ ID NO: 29741 - DNA, 20 bp, Artificial
  CRISPR gRNA sequence
ttgacctgtaaaattggcaa

SEQ ID NO: 29742 - DNA, 20 bp, Artificial
  CRISPR gRNA sequence
tgacctgtaaaattggcaat

SEQ ID NO: 29743 - DNA, 20 bp, Artificial
  CRISPR gRNA sequence
gacctgtaaaattggcaatt

SEQ ID NO: 29744 - DNA, 20 bp, Artificial
  CRISPR gRNA sequence
acctgtaaaattggcaattt

SEQ ID NO: 29745 - DNA, 20 bp, Artificial
  CRISPR gRNA sequence
taaaattggcaatttcatat

SEQ ID NO: 29746 - DNA, 20 bp, Artificial
  CRISPR gRNA sequence
gcaatttcatatggttcagg

SEQ ID NO: 29747 - DNA, 20 bp, Artificial
  CRISPR gRNA sequence
catatggttcaggtttatct

SEQ ID NO: 29748 - DNA, 20 bp, Artificial
  CRISPR gRNA sequence
atatggttcaggtttatctt

SEQ ID NO: 29749 - DNA, 20 bp, Artificial
  CRISPR gRNA sequence
aggtttatcttttattaagt

SEQ ID NO: 29750 - DNA, 20 bp, Artificial
  CRISPR gRNA sequence
atcttttattaagtcaccat

SEQ ID NO: 29751 - DNA, 20 bp, Artificial
  CRISPR gRNA sequence
tcttttattaagtcaccatg

SEQ ID NO: 29752 - DNA, 20 bp, Artificial
  CRISPR gRNA sequence
ttattaagtcaccatgatgt

SEQ ID NO: 29753 - DNA, 20 bp, Artificial
  CRISPR gRNA sequence
tattaagtcaccatgatgtc

SEQ ID NO: 29754 - DNA, 20 bp, Artificial
  CRISPR gRNA sequence
attaagtcaccatgatgtcc

SEQ ID NO: 29755 - DNA, 20 bp, Artificial
  CRISPR gRNA sequence
ttaagtcaccatgatgtcca

SEQ ID NO: 29756 - DNA, 20 bp, Artificial
  CRISPR gRNA sequence
agtcaccatgatgtccaata

SEQ ID NO: 29757 - DNA, 20 bp, Artificial
  CRISPR gRNA sequence
gttactttatattctttcaa

SEQ ID NO: 29758 - DNA, 20 bp, Artificial
  CRISPR gRNA sequence
ctttatattctttcaaagca

SEQ ID NO: 29759 - DNA, 20 bp, Artificial
  CRISPR gRNA sequence
tatattctttcaaagcactt

SEQ ID NO: 29760 - DNA, 20 bp, Artificial
  CRISPR gRNA sequence
atattctttcaaagcacttt

SEQ ID NO: 29761 - DNA, 20 bp, Artificial
  CRISPR gRNA sequence
tattctttcaaagcactttt

SEQ ID NO: 29762 - DNA, 20 bp, Artificial
  CRISPR gRNA sequence
tttcaaagcacttttatctc

SEQ ID NO: 29763 - DNA, 20 bp, Artificial
  CRISPR gRNA sequence
tcaaagcacttttatctcca

SEQ ID NO: 29764 - DNA, 20 bp, Artificial
  CRISPR gRNA sequence
caaagcacttttatctccac

SEQ ID NO: 29765 - DNA, 20 bp, Artificial
  CRISPR gRNA sequence
aaagcacttttatctccaca

SEQ ID NO: 29766 - DNA, 20 bp, Artificial
  CRISPR gRNA sequence
ttatctccacaatcactcac

SEQ ID NO: 29767 - DNA, 20 bp, Artificial
  CRISPR gRNA sequence
tatctccacaatcactcacc

SEQ ID NO: 29768 - DNA, 20 bp, Artificial
  CRISPR gRNA sequence
atctccacaatcactcacct

SEQ ID NO: 29769 - DNA, 20 bp, Artificial
  CRISPR gRNA sequence
tctccacaatcactcacctc

SEQ ID NO: 29770 - DNA, 20 bp, Artificial
  CRISPR gRNA sequence
cacaatcactcacctcttct

SEQ ID NO: 29771 - DNA, 20 bp, Artificial
  CRISPR gRNA sequence
acctcttctaagacgcacag

SEQ ID NO: 29772 - DNA, 20 bp, Artificial
  CRISPR gRNA sequence
ttctaagacgcacagggtgg

SEQ ID NO: 29773 - DNA, 20 bp, Artificial
  CRISPR gRNA sequence
ctaagacgcacagggtgggt

SEQ ID NO: 29774 - DNA, 20 bp, Artificial
  CRISPR gRNA sequence
taagacgcacagggtgggtc

SEQ ID NO: 29775 - DNA, 20 bp, Artificial
  CRISPR gRNA sequence
agacgcacagggtgggtctt

SEQ ID NO: 29776 - DNA, 20 bp, Artificial
  CRISPR gRNA sequence
acaagacccattttacagat

SEQ ID NO: 29777 - DNA, 20 bp, Artificial
  CRISPR gRNA sequence
caagacccattttacagatg

SEQ ID NO: 29778 - DNA, 20 bp, Artificial
  CRISPR gRNA sequence
tacagatgaggaaaataaag

SEQ ID NO: 29779 - DNA, 20 bp, Artificial
  CRISPR gRNA sequence
acagatgaggaaaataaagc

SEQ ID NO: 29780 - DNA, 20 bp, Artificial
  CRISPR gRNA sequence
cagatgaggaaaataaagca

SEQ ID NO: 29781 - DNA, 20 bp, Artificial
  CRISPR gRNA sequence
actaacctttctggggtcac

SEQ ID NO: 29782 - DNA, 20 bp, Artificial
  CRISPR gRNA sequence
acctttctggggtcacacag

SEQ ID NO: 29783 - DNA, 20 bp, Artificial
  CRISPR gRNA sequence
tctggggtcacacagcaagt

SEQ ID NO: 29784 - DNA, 20 bp, Artificial
  CRISPR gRNA sequence
ctggggtcacacagcaagtc

SEQ ID NO: 29785 - DNA, 20 bp, Artificial
  CRISPR gRNA sequence
tggggtcacacagcaagtca

SEQ ID NO: 29786 - DNA, 20 bp, Artificial
  CRISPR gRNA sequence
gggtcacacagcaagtcagc

SEQ ID NO: 29787 - DNA, 20 bp, Artificial
  CRISPR gRNA sequence
cagaaccataaaggaatctc

SEQ ID NO: 29788 - DNA, 20 bp, Artificial
  CRISPR gRNA sequence
gggcctcctaggcttctcct

SEQ ID NO: 29789 - DNA, 20 bp, Artificial
  CRISPR gRNA sequence
ctaggcttctccttttcccc

SEQ ID NO: 29790 - DNA, 20 bp, Artificial
  CRISPR gRNA sequence
ggcttctccttttccccatg

SEQ ID NO: 29791 - DNA, 20 bp, Artificial
  CRISPR gRNA sequence
ctccttttccccatgaccca

SEQ ID NO: 29792 - DNA, 20 bp, Artificial
  CRISPR gRNA sequence
tccttttccccatgacccac

SEQ ID NO: 29793 - DNA, 20 bp, Artificial
  CRISPR gRNA sequence
cttttccccatgacccacac

SEQ ID NO: 29794 - DNA, 20 bp, Artificial
  CRISPR gRNA sequence
ttccccatgacccacaccgg

SEQ ID NO: 29795 - DNA, 20 bp, Artificial
  CRISPR gRNA sequence
tccccatgacccacaccggt

SEQ ID NO: 29796 - DNA, 20 bp, Artificial
  CRISPR gRNA sequence
ccccatgacccacaccggtc

SEQ ID NO: 29797 - DNA, 20 bp, Artificial
  CRISPR gRNA sequence
cccatgacccacaccggtcg

SEQ ID NO: 29798 - DNA, 20 bp, Artificial
  CRISPR gRNA sequence
gccaggggaaaagtccccaa

SEQ ID NO: 29799 - DNA, 20 bp, Artificial
  CRISPR gRNA sequence
ccaggggaaaagtccccaac

SEQ ID NO: 29800 - DNA, 20 bp, Artificial
  CRISPR gRNA sequence
taggctgggtggaaggaggg

SEQ ID NO: 29801 - DNA, 20 bp, Artificial
  CRISPR gRNA sequence
ggctgggtggaaggagggat

SEQ ID NO: 29802 - DNA, 20 bp, Artificial
  CRISPR gRNA sequence
ggtggaaggagggatttggg

SEQ ID NO: 29803 - DNA, 20 bp, Artificial
  CRISPR gRNA sequence
gggggcagctgtcactgggg

SEQ ID NO: 29804 - DNA, 20 bp, Artificial
  CRISPR gRNA sequence
ggggcagctgtcactggggc

SEQ ID NO: 29805 - DNA, 20 bp, Artificial
  CRISPR gRNA sequence
tcactggggccccaggccgc

SEQ ID NO: 29806 - DNA, 20 bp, Artificial
  CRISPR gRNA sequence
gggccccaggccgccctctc

SEQ ID NO: 29807 - DNA, 20 bp, Artificial
  CRISPR gRNA sequence
tctcctctaacctggctctg

SEQ ID NO: 29808 - DNA, 20 bp, Artificial
  CRISPR gRNA sequence
tcctctaacctggctctgag

SEQ ID NO: 29809 - DNA, 20 bp, Artificial
  CRISPR gRNA sequence
ctctaacctggctctgagtc

SEQ ID NO: 29810 - DNA, 20 bp, Artificial
  CRISPR gRNA sequence
taacctggctctgagtccca

SEQ ID NO: 29811 - DNA, 20 bp, Artificial
  CRISPR gRNA sequence
acctggctctgagtcccatc

SEQ ID NO: 29812 - DNA, 20 bp, Artificial
  CRISPR gRNA sequence
gctctgagtcccatcccccc

SEQ ID NO: 29813 - DNA, 20 bp, Artificial
  CRISPR gRNA sequence
tgagtcccatccccccttgc

SEQ ID NO: 29814 - DNA, 20 bp, Artificial
  CRISPR gRNA sequence
agtcccatccccccttgcag

SEQ ID NO: 29815 - DNA, 20 bp, Artificial
  CRISPR gRNA sequence
gcaggatgtggacgcccacc

SEQ ID NO: 29816 - DNA, 20 bp, Artificial
  CRISPR gRNA sequence
caggatgtggacgcccacca

SEQ ID NO: 29817 - DNA, 20 bp, Artificial
  CRISPR gRNA sequence
agtgtccaggaacacctgca

SEQ ID NO: 29818 - DNA, 20 bp, Artificial
  CRISPR gRNA sequence
caacaacaggattcacggat

SEQ ID NO: 29819 - DNA, 20 bp, Artificial
  CRISPR gRNA sequence
acggatcagcctgagatgat

SEQ ID NO: 29820 - DNA, 20 bp, Artificial
  CRISPR gRNA sequence
agatgatcccagctgtgctc

SEQ ID NO: 29821 - DNA, 20 bp, Artificial
  CRISPR gRNA sequence
tgctctggacagggtaacca

SEQ ID NO: 29822 - DNA, 20 bp, Artificial
  CRISPR gRNA sequence
tggacagggtaaccagggtg

SEQ ID NO: 29823 - DNA, 20 bp, Artificial
  CRISPR gRNA sequence
gacagggtaaccagggtggg

SEQ ID NO: 29824 - DNA, 20 bp, Artificial
  CRISPR gRNA sequence
gggaggggagagccgcagtg

SEQ ID NO: 29825 - DNA, 20 bp, Artificial
  CRISPR gRNA sequence
ggaggggagagccgcagtgg

SEQ ID NO: 29826 - DNA, 20 bp, Artificial
  CRISPR gRNA sequence
ggggcagtgtccttgtgaag

SEQ ID NO: 29827 - DNA, 20 bp, Artificial
  CRISPR gRNA sequence
gtgaaggtggcattcaaaaa

SEQ ID NO: 29828 - DNA, 20 bp, Artificial
  CRISPR gRNA sequence
tgaaggtggcattcaaaaaa

SEQ ID NO: 29829 - DNA, 20 bp, Artificial
  CRISPR gRNA sequence
tttgaatgccaccttcacaa

SEQ ID NO: 29830 - DNA, 20 bp, Artificial
  CRISPR gRNA sequence
ttgaatgccaccttcacaag

SEQ ID NO: 29831 - DNA, 20 bp, Artificial
  CRISPR gRNA sequence
tgaatgccaccttcacaagg

SEQ ID NO: 29832 - DNA, 20 bp, Artificial
  CRISPR gRNA sequence
gaatgccaccttcacaagga

SEQ ID NO: 29833 - DNA, 20 bp, Artificial
  CRISPR gRNA sequence
aatgccaccttcacaaggac

SEQ ID NO: 29834 - DNA, 20 bp, Artificial
  CRISPR gRNA sequence
cacaaggacactgcccccaa

SEQ ID NO: 29835 - DNA, 20 bp, Artificial
  CRISPR gRNA sequence
acaaggacactgcccccaac

SEQ ID NO: 29836 - DNA, 20 bp, Artificial
  CRISPR gRNA sequence
cccccaacccactgcggctc

SEQ ID NO: 29837 - DNA, 20 bp, Artificial
  CRISPR gRNA sequence
cggctctcccctcccaagcc

SEQ ID NO: 29838 - DNA, 20 bp, Artificial
  CRISPR gRNA sequence
tcccctcccaagcccaccct

SEQ ID NO: 29839 - DNA, 20 bp, Artificial
  CRISPR gRNA sequence
ccctcccaagcccaccctgg

SEQ ID NO: 29840 - DNA, 20 bp, Artificial
  CRISPR gRNA sequence
ccaagcccaccctggttacc

SEQ ID NO: 29841 - DNA, 20 bp, Artificial
  CRISPR gRNA sequence
gttaccctgtccagagcaca

SEQ ID NO: 29842 - DNA, 20 bp, Artificial
  CRISPR gRNA sequence
ccctgtccagagcacagctg

SEQ ID NO: 29843 - DNA, 20 bp, Artificial
  CRISPR gRNA sequence
tccagagcacagctgggatc

SEQ ID NO: 29844 - DNA, 20 bp, Artificial
  CRISPR gRNA sequence
ggatcatctcaggctgatcc

SEQ ID NO: 29845 - DNA, 20 bp, Artificial
  CRISPR gRNA sequence
aggctgatccgtgaatcctg

SEQ ID NO: 29846 - DNA, 20 bp, Artificial
  CRISPR gRNA sequence
atccgtgaatcctgttgttg

SEQ ID NO: 29847 - DNA, 20 bp, Artificial
  CRISPR gRNA sequence
ttgttgcaggtgttcctgga

SEQ ID NO: 29848 - DNA, 20 bp, Artificial
  CRISPR gRNA sequence
ttgcaggtgttcctggacac

SEQ ID NO: 29849 - DNA, 20 bp, Artificial
  CRISPR gRNA sequence
caggtgttcctggacactga

SEQ ID NO: 29850 - DNA, 20 bp, Artificial
  CRISPR gRNA sequence
ctggacactgaatgggatgg

SEQ ID NO: 29851 - DNA, 20 bp, Artificial
  CRISPR gRNA sequence
gacactgaatgggatggtgg

SEQ ID NO: 29852 - DNA, 20 bp, Artificial
  CRISPR gRNA sequence
aatgggatggtgggcgtcca

SEQ ID NO: 29853 - DNA, 20 bp, Artificial
  CRISPR gRNA sequence
caaggggggatgggactcag

SEQ ID NO: 29854 - DNA, 20 bp, Artificial
  CRISPR gRNA sequence
agagccaggttagaggagag

SEQ ID NO: 29855 - DNA, 20 bp, Artificial
  CRISPR gRNA sequence
gaggagagagggcggcctgg

SEQ ID NO: 29856 - DNA, 20 bp, Artificial
  CRISPR gRNA sequence
gggccccagtgacagctgcc

SEQ ID NO: 29857 - DNA, 20 bp, Artificial
  CRISPR gRNA sequence
cccccaaatccctccttcca

SEQ ID NO: 29858 - DNA, 20 bp, Artificial
  CRISPR gRNA sequence
cttccacccagcctagaacg

SEQ ID NO: 29859 - DNA, 20 bp, Artificial
  CRISPR gRNA sequence
ccacccagcctagaacgttg

SEQ ID NO: 29860 - DNA, 20 bp, Artificial
  CRISPR gRNA sequence
cacccagcctagaacgttgg

SEQ ID NO: 29861 - DNA, 20 bp, Artificial
  CRISPR gRNA sequence
gaacgttggggacttttccc

SEQ ID NO: 29862 - DNA, 20 bp, Artificial
  CRISPR gRNA sequence
gggacttttcccctggcaag

SEQ ID NO: 29863 - DNA, 20 bp, Artificial
  CRISPR gRNA sequence
ttcccctggcaagataccga

SEQ ID NO: 29864 - DNA, 20 bp, Artificial
  CRISPR gRNA sequence
tcccctggcaagataccgac

SEQ ID NO: 29865 - DNA, 20 bp, Artificial
  CRISPR gRNA sequence
cccctggcaagataccgacc

SEQ ID NO: 29866 - DNA, 20 bp, Artificial
  CRISPR gRNA sequence
ccctggcaagataccgaccg

SEQ ID NO: 29867 - DNA, 20 bp, Artificial
  CRISPR gRNA sequence
gcaagataccgaccggtgtg

SEQ ID NO: 29868 - DNA, 20 bp, Artificial
  CRISPR gRNA sequence
ggaggcccgagattccttta

SEQ ID NO: 29869 - DNA, 20 bp, Artificial
  CRISPR gRNA sequence
ctttatggttctgcagctga

SEQ ID NO: 29870 - DNA, 20 bp, Artificial
  CRISPR gRNA sequence
tatggttctgcagctgactt

SEQ ID NO: 29871 - DNA, 20 bp, Artificial
  CRISPR gRNA sequence
atggttctgcagctgacttg

SEQ ID NO: 29872 - DNA, 20 bp, Artificial
  CRISPR gRNA sequence
tggttctgcagctgacttgc

SEQ ID NO: 29873 - DNA, 20 bp, Artificial
  CRISPR gRNA sequence
tgcagctgacttgctgtgtg

SEQ ID NO: 29874 - DNA, 20 bp, Artificial
  CRISPR gRNA sequence
cagctgacttgctgtgtgac

SEQ ID NO: 29875 - DNA, 20 bp, Artificial
  CRISPR gRNA sequence
acttgctgtgtgaccccaga

SEQ ID NO: 29876 - DNA, 20 bp, Artificial
  CRISPR gRNA sequence
gctgtgtgaccccagaaagg

SEQ ID NO: 29877 - DNA, 20 bp, Artificial
  CRISPR gRNA sequence
ctgtgtgaccccagaaaggt

SEQ ID NO: 29878 - DNA, 20 bp, Artificial
  CRISPR gRNA sequence
tgtgaccccagaaaggttag

SEQ ID NO: 29879 - DNA, 20 bp, Artificial
  CRISPR gRNA sequence
gttaactgctctgtgcttta

SEQ ID NO: 29880 - DNA, 20 bp, Artificial
  CRISPR gRNA sequence
actgctctgtgctttatttt

SEQ ID NO: 29881 - DNA, 20 bp, Artificial
  CRISPR gRNA sequence
ctctgtgctttattttcctc

SEQ ID NO: 29882 - DNA, 20 bp, Artificial
  CRISPR gRNA sequence
tgtgctttattttcctcatc

SEQ ID NO: 29883 - DNA, 20 bp, Artificial
  CRISPR gRNA sequence
tgctttattttcctcatctg

SEQ ID NO: 29884 - DNA, 20 bp, Artificial
  CRISPR gRNA sequence
tattttcctcatctgtaaaa

SEQ ID NO: 29885 - DNA, 20 bp, Artificial
  CRISPR gRNA sequence
attttcctcatctgtaaaat

SEQ ID NO: 29886 - DNA, 20 bp, Artificial
  CRISPR gRNA sequence
ttttcctcatctgtaaaatg

SEQ ID NO: 29887 - DNA, 20 bp, Artificial
  CRISPR gRNA sequence
tcctcatctgtaaaatgggt

SEQ ID NO: 29888 - DNA, 20 bp, Artificial
  CRISPR gRNA sequence
cctcatctgtaaaatgggtc

SEQ ID NO: 29889 - DNA, 20 bp, Artificial
  CRISPR gRNA sequence
ctcatctgtaaaatgggtct

SEQ ID NO: 29890 - DNA, 20 bp, Artificial
  CRISPR gRNA sequence
atctgtaaaatgggtcttgt

SEQ ID NO: 29891 - DNA, 20 bp, Artificial
  CRISPR gRNA sequence
taaaatgggtcttgtaagac

SEQ ID NO: 29892 - DNA, 20 bp, Artificial
  CRISPR gRNA sequence
gtaagacccaccctgtgcgt

SEQ ID NO: 29893 - DNA, 20 bp, Artificial
  CRISPR gRNA sequence
taagacccaccctgtgcgtc

SEQ ID NO: 29894 - DNA, 20 bp, Artificial
  CRISPR gRNA sequence
tgcgtcttagaagaggtgag

SEQ ID NO: 29895 - DNA, 20 bp, Artificial
  CRISPR gRNA sequence
agaagaggtgagtgattgtg

SEQ ID NO: 29896 - DNA, 20 bp, Artificial
  CRISPR gRNA sequence
gaagaggtgagtgattgtgg

SEQ ID NO: 29897 - DNA, 20 bp, Artificial
  CRISPR gRNA sequence
tggagataaaagtgctttga

SEQ ID NO: 29898 - DNA, 20 bp, Artificial
  CRISPR gRNA sequence
tgaaagaatataaagtaacc

SEQ ID NO: 29899 - DNA, 20 bp, Artificial
  CRISPR gRNA sequence
gaaagaatataaagtaacca

SEQ ID NO: 29900 - DNA, 20 bp, Artificial
  CRISPR gRNA sequence
aaagaatataaagtaaccag

SEQ ID NO: 29901 - DNA, 20 bp, Artificial
  CRISPR gRNA sequence
gacatcatggtgacttaata

SEQ ID NO: 29902 - DNA, 20 bp, Artificial
  CRISPR gRNA sequence
aataaaagataaacctgaac

SEQ ID NO: 29903 - DNA, 20 bp, Artificial
  CRISPR gRNA sequence
ataaaagataaacctgaacc

SEQ ID NO: 29904 - DNA, 20 bp, Artificial
  CRISPR gRNA sequence
aaccatatgaaattgccaat

SEQ ID NO: 29905 - DNA, 20 bp, Artificial
  CRISPR gRNA sequence
ccaattttacaggtcaaaaa

SEQ ID NO: 29906 - DNA, 20 bp, Artificial
  CRISPR gRNA sequence
tacaggtcaaaaatgggtgg

SEQ ID NO: 29907 - DNA, 20 bp, Artificial
  CRISPR gRNA sequence
acaggtcaaaaatgggtgga

SEQ ID NO: 29908 - DNA, 20 bp, Artificial
  CRISPR gRNA sequence
caggtcaaaaatgggtggat

SEQ ID NO: 29909 - DNA, 20 bp, Artificial
  CRISPR gRNA sequence
catatggttcagcctaatat

SEQ ID NO: 29910 - DNA, 20 bp, Artificial
  CRISPR gRNA sequence
atatggttcagcctaatata

SEQ ID NO: 29911 - DNA, 20 bp, Artificial
  CRISPR gRNA sequence
agcctaatatagcatttatt

SEQ ID NO: 29912 - DNA, 20 bp, Artificial
  CRISPR gRNA sequence
atatagcatttattggcatt

SEQ ID NO: 29913 - DNA, 20 bp, Artificial
  CRISPR gRNA sequence
attggcatttttgtgtgcca

SEQ ID NO: 29914 - DNA, 20 bp, Artificial
  CRISPR gRNA sequence
ttggcatttttgtgtgccag

SEQ ID NO: 29915 - DNA, 20 bp, Artificial
  CRISPR gRNA sequence
gcatttttgtgtgccagcta

SEQ ID NO: 29916 - DNA, 20 bp, Artificial
  CRISPR gRNA sequence
ttgtgtgccagctactgttg

SEQ ID NO: 29917 - DNA, 20 bp, Artificial
  CRISPR gRNA sequence
tgtgtgccagctactgttgt

SEQ ID NO: 29918 - DNA, 20 bp, Artificial
  CRISPR gRNA sequence
gtgtgccagctactgttgtt

SEQ ID NO: 29919 - DNA, 20 bp, Artificial
  CRISPR gRNA sequence
tgtgccagctactgttgtta

SEQ ID NO: 29920 - DNA, 20 bp, Artificial
  CRISPR gRNA sequence
ctgttgttataagagctttg

SEQ ID NO: 29921 - DNA, 20 bp, Artificial
  CRISPR gRNA sequence
ttgttataagagctttgtag

SEQ ID NO: 29922 - DNA, 20 bp, Artificial
  CRISPR gRNA sequence
ttataagagctttgtagggc

SEQ ID NO: 29923 - DNA, 20 bp, Artificial
  CRISPR gRNA sequence
taagagctttgtagggcttg

SEQ ID NO: 29924 - DNA, 20 bp, Artificial
  CRISPR gRNA sequence
tgtagggcttgattagttta

SEQ ID NO: 29925 - DNA, 20 bp, Artificial
  CRISPR gRNA sequence
gtagggcttgattagtttaa

SEQ ID NO: 29926 - DNA, 20 bp, Artificial
  CRISPR gRNA sequence
tagggcttgattagtttaag

SEQ ID NO: 29927 - DNA, 20 bp, Artificial
  CRISPR gRNA sequence
gattagtttaagcctcacaa

SEQ ID NO: 29928 - DNA, 20 bp, Artificial
  CRISPR gRNA sequence
attagtttaagcctcacaaa

SEQ ID NO: 29929 - DNA, 20 bp, Artificial
  CRISPR gRNA sequence
gtttaagcctcacaaaacct

SEQ ID NO: 29930 - DNA, 20 bp, Artificial
  CRISPR gRNA sequence
aagcctcacaaaacctcttg

SEQ ID NO: 29931 - DNA, 20 bp, Artificial
  CRISPR gRNA sequence
agcctcacaaaacctcttgg

SEQ ID NO: 29932 - DNA, 20 bp, Artificial
  CRISPR gRNA sequence
acaaaacctcttgggtggat

SEQ ID NO: 29933 - DNA, 20 bp, Artificial
  CRISPR gRNA sequence
ttgggtggatattattactg

SEQ ID NO: 29934 - DNA, 20 bp, Artificial
  CRISPR gRNA sequence
gggtggatattattactgtc

SEQ ID NO: 29935 - DNA, 20 bp, Artificial
  CRISPR gRNA sequence
ggtggatattattactgtcc

SEQ ID NO: 29936 - DNA, 20 bp, Artificial
  CRISPR gRNA sequence
ttactgtccccactttacag

SEQ ID NO: 29937 - DNA, 20 bp, Artificial
  CRISPR gRNA sequence
ctgtccccactttacagatg

SEQ ID NO: 29938 - DNA, 20 bp, Artificial
  CRISPR gRNA sequence
tccccactttacagatgaag

SEQ ID NO: 29939 - DNA, 20 bp, Artificial
  CRISPR gRNA sequence
tacagatgaagaagctgaag

SEQ ID NO: 29940 - DNA, 20 bp, Artificial
  CRISPR gRNA sequence
acagatgaagaagctgaagc

SEQ ID NO: 29941 - DNA, 20 bp, Artificial
  CRISPR gRNA sequence
cagatgaagaagctgaagcc

SEQ ID NO: 29942 - DNA, 20 bp, Artificial
  CRISPR gRNA sequence
aagccagagggggaagtgtc

SEQ ID NO: 29943 - DNA, 20 bp, Artificial
  CRISPR gRNA sequence
ctcacccagggttgcagatt

SEQ ID NO: 29944 - DNA, 20 bp, Artificial
  CRISPR gRNA sequence
acccagggttgcagattggt

SEQ ID NO: 29945 - DNA, 20 bp, Artificial
  CRISPR gRNA sequence
cagattggtgaagggaagag

SEQ ID NO: 29946 - DNA, 20 bp, Artificial
  CRISPR gRNA sequence
gtgaagggaagagcatgatt

SEQ ID NO: 29947 - DNA, 20 bp, Artificial
  CRISPR gRNA sequence
gagctccggggtcacactgg

SEQ ID NO: 29948 - DNA, 20 bp, Artificial
  CRISPR gRNA sequence
agctccggggtcacactggg

SEQ ID NO: 29949 - DNA, 20 bp, Artificial
  CRISPR gRNA sequence
cggggtcacactgggccaca

SEQ ID NO: 29950 - DNA, 20 bp, Artificial
  CRISPR gRNA sequence
ggccacacgcctggggagtg

SEQ ID NO: 29951 - DNA, 20 bp, Artificial
  CRISPR gRNA sequence
gggagtgagttgttctccac

SEQ ID NO: 29952 - DNA, 20 bp, Artificial
  CRISPR gRNA sequence
ttctccacccaccagggttg

SEQ ID NO: 29953 - DNA, 20 bp, Artificial
  CRISPR gRNA sequence
tccacccaccagggttgcct

SEQ ID NO: 29954 - DNA, 20 bp, Artificial
  CRISPR gRNA sequence
cacccaccagggttgcctgg

SEQ ID NO: 29955 - DNA, 20 bp, Artificial
  CRISPR gRNA sequence
cctggacttacgccagcgtc

SEQ ID NO: 29956 - DNA, 20 bp, Artificial
  CRISPR gRNA sequence
gacttacgccagcgtctcca

SEQ ID NO: 29957 - DNA, 20 bp, Artificial
  CRISPR gRNA sequence
acgccagcgtctccacatga

SEQ ID NO: 29958 - DNA, 20 bp, Artificial
  CRISPR gRNA sequence
cgccagcgtctccacatgag

SEQ ID NO: 29959 - DNA, 20 bp, Artificial
  CRISPR gRNA sequence
cacatgaggacacctccgaa

SEQ ID NO: 29960 - DNA, 20 bp, Artificial
  CRISPR gRNA sequence
cgaaggctggcagcgagctg

SEQ ID NO: 29961 - DNA, 20 bp, Artificial
  CRISPR gRNA sequence
gcagcgagctgctgggcccc

SEQ ID NO: 29962 - DNA, 20 bp, Artificial
  CRISPR gRNA sequence
ctgggccccggcagccgtga

SEQ ID NO: 29963 - DNA, 20 bp, Artificial
  CRISPR gRNA sequence
ggccccggcagccgtgaact

SEQ ID NO: 29964 - DNA, 20 bp, Artificial
  CRISPR gRNA sequence
gttgtactggacgctggcaa

SEQ ID NO: 29965 - DNA, 20 bp, Artificial
  CRISPR gRNA sequence
ttgtactggacgctggcaag

SEQ ID NO: 29966 - DNA, 20 bp, Artificial
  CRISPR gRNA sequence
tactggacgctggcaagaga

SEQ ID NO: 29967 - DNA, 20 bp, Artificial
  CRISPR gRNA sequence
gacgctggcaagagaaactc

SEQ ID NO: 29968 - DNA, 20 bp, Artificial
  CRISPR gRNA sequence
gcaagagaaactcaccttgg

SEQ ID NO: 29969 - DNA, 20 bp, Artificial
  CRISPR gRNA sequence
accttggggcctggcccttg

SEQ ID NO: 29970 - DNA, 20 bp, Artificial
  CRISPR gRNA sequence
ggggcctggcccttgggact

SEQ ID NO: 29971 - DNA, 20 bp, Artificial
  CRISPR gRNA sequence
gggcctggcccttgggactc

SEQ ID NO: 29972 - DNA, 20 bp, Artificial
  CRISPR gRNA sequence
gcccttgggactccccagct

SEQ ID NO: 29973 - DNA, 20 bp, Artificial
  CRISPR gRNA sequence
gggactccccagctccagac

SEQ ID NO: 29974 - DNA, 20 bp, Artificial
  CRISPR gRNA sequence
ggactccccagctccagacc

SEQ ID NO: 29975 - DNA, 20 bp, Artificial
  CRISPR gRNA sequence
cccagctccagaccaaggcc

SEQ ID NO: 29976 - DNA, 20 bp, Artificial
  CRISPR gRNA sequence
cagaccaaggccacccccac

SEQ ID NO: 29977 - DNA, 20 bp, Artificial
  CRISPR gRNA sequence
ttccaggacaccagggagag

SEQ ID NO: 29978 - DNA, 20 bp, Artificial
  CRISPR gRNA sequence
ccaggacaccagggagagac

SEQ ID NO: 29979 - DNA, 20 bp, Artificial
  CRISPR gRNA sequence
caggacaccagggagagact

SEQ ID NO: 29980 - DNA, 20 bp, Artificial
  CRISPR gRNA sequence
cagtgtctcccaccccgggc

SEQ ID NO: 29981 - DNA, 20 bp, Artificial
  CRISPR gRNA sequence
agtgtctcccaccccgggct

SEQ ID NO: 29982 - DNA, 20 bp, Artificial
  CRISPR gRNA sequence
ccaccccgggctgagccacc

SEQ ID NO: 29983 - DNA, 20 bp, Artificial
  CRISPR gRNA sequence
agccacccaccgcccagact

SEQ ID NO: 29984 - DNA, 20 bp, Artificial
  CRISPR gRNA sequence
ccacactcactccatcaccc

SEQ ID NO: 29985 - DNA, 20 bp, Artificial
  CRISPR gRNA sequence
actccatcacccggagggac

SEQ ID NO: 29986 - DNA, 20 bp, Artificial
  CRISPR gRNA sequence
catcacccggagggacacca

SEQ ID NO: 29987 - DNA, 20 bp, Artificial
  CRISPR gRNA sequence
tcggctcccacgtcgcagat

SEQ ID NO: 29988 - DNA, 20 bp, Artificial
  CRISPR gRNA sequence
ggctcccacgtcgcagatgc

SEQ ID NO: 29989 - DNA, 20 bp, Artificial
  CRISPR gRNA sequence
ccacgtcgcagatgcagtta

SEQ ID NO: 29990 - DNA, 20 bp, Artificial
  CRISPR gRNA sequence
ttgtacaagctgtcggaaac

SEQ ID NO: 29991 - DNA, 20 bp, Artificial
  CRISPR gRNA sequence
tacaagctgtcggaaacaga

SEQ ID NO: 29992 - DNA, 20 bp, Artificial
  CRISPR gRNA sequence
tcggaaacagaggccagggg

SEQ ID NO: 29993 - DNA, 20 bp, Artificial
  CRISPR gRNA sequence
gaggcctgtgcatggtcagc

SEQ ID NO: 29994 - DNA, 20 bp, Artificial
  CRISPR gRNA sequence
tgcatggtcagccttccaga

SEQ ID NO: 29995 - DNA, 20 bp, Artificial
  CRISPR gRNA sequence
ccagaagccaccatccctag

SEQ ID NO: 29996 - DNA, 20 bp, Artificial
  CRISPR gRNA sequence
cagaagccaccatccctaga

SEQ ID NO: 29997 - DNA, 20 bp, Artificial
  CRISPR gRNA sequence
gattccagaaaaagcctggt

SEQ ID NO: 29998 - DNA, 20 bp, Artificial
  CRISPR gRNA sequence
cagaaaaagcctggtcccac

SEQ ID NO: 29999 - DNA, 20 bp, Artificial
  CRISPR gRNA sequence
gtcccactatccctggggga

SEQ ID NO: 30000 - DNA, 20 bp, Artificial
  CRISPR gRNA sequence
tccctgggggaaggaatcaa

SEQ ID NO: 30001 - DNA, 20 bp, Artificial
  CRISPR gRNA sequence
ggggaaggaatcaatattta

SEQ ID NO: 30002 - DNA, 20 bp, Artificial
  CRISPR gRNA sequence
attgcacaacagagcctggc

SEQ ID NO: 30003 - DNA, 20 bp, Artificial
  CRISPR gRNA sequence
ttgcacaacagagcctggca

SEQ ID NO: 30004 - DNA, 20 bp, Artificial
  CRISPR gRNA sequence
cacaacagagcctggcattg

SEQ ID NO: 30005 - DNA, 20 bp, Artificial
  CRISPR gRNA sequence
gcattgtgccaagtacttac

SEQ ID NO: 30006 - DNA, 20 bp, Artificial
  CRISPR gRNA sequence
tgccaagtacttacataggc

SEQ ID NO: 30007 - DNA, 20 bp, Artificial
  CRISPR gRNA sequence
acataggccattgggatggt

SEQ ID NO: 30008 - DNA, 20 bp, Artificial
  CRISPR gRNA sequence
cataggccattgggatggtt

SEQ ID NO: 30009 - DNA, 20 bp, Artificial
  CRISPR gRNA sequence
ggatggttcccattttctag

SEQ ID NO: 30010 - DNA, 20 bp, Artificial
  CRISPR gRNA sequence
ccattttctagatatgaaaa

SEQ ID NO: 30011 - DNA, 20 bp, Artificial
  CRISPR gRNA sequence
tctagatatgaaaatagagg

SEQ ID NO: 30012 - DNA, 20 bp, Artificial
  CRISPR gRNA sequence
ctagatatgaaaatagaggc

SEQ ID NO: 30013 - DNA, 20 bp, Artificial
  CRISPR gRNA sequence
tagatatgaaaatagaggct

SEQ ID NO: 30014 - DNA, 20 bp, Artificial
  CRISPR gRNA sequence
gatatgaaaatagaggctag

SEQ ID NO: 30015 - DNA, 20 bp, Artificial
  CRISPR gRNA sequence
ggaatgaataagtgacttgc

SEQ ID NO: 30016 - DNA, 20 bp, Artificial
  CRISPR gRNA sequence
gctcaaagtttctgtcccca

SEQ ID NO: 30017 - DNA, 20 bp, Artificial
  CRISPR gRNA sequence
ctcaaagtttctgtccccag

SEQ ID NO: 30018 - DNA, 20 bp, Artificial
  CRISPR gRNA sequence
aaagtttctgtccccaggtc

SEQ ID NO: 30019 - DNA, 20 bp, Artificial
  CRISPR gRNA sequence
ctgtccccaggtcccactag

SEQ ID NO: 30020 - DNA, 20 bp, Artificial
  CRISPR gRNA sequence
tgtccccaggtcccactagt

SEQ ID NO: 30021 - DNA, 20 bp, Artificial
  CRISPR gRNA sequence
tccccaggtcccactagttc

SEQ ID NO: 30022 - DNA, 20 bp, Artificial
  CRISPR gRNA sequence
gttctcttgttcagggctgt

SEQ ID NO: 30023 - DNA, 20 bp, Artificial
  CRISPR gRNA sequence
tcttgttcagggctgtggtg

SEQ ID NO: 30024 - DNA, 20 bp, Artificial
  CRISPR gRNA sequence
ttgttcagggctgtggtgat

SEQ ID NO: 30025 - DNA, 20 bp, Artificial
  CRISPR gRNA sequence
gttcagggctgtggtgattg

SEQ ID NO: 30026 - DNA, 20 bp, Artificial
  CRISPR gRNA sequence
ttcagggctgtggtgattgc

SEQ ID NO: 30027 - DNA, 20 bp, Artificial
  CRISPR gRNA sequence
agggctgtggtgattgcttc

SEQ ID NO: 30028 - DNA, 20 bp, Artificial
  CRISPR gRNA sequence
tggtgattgcttctaggatc

SEQ ID NO: 30029 - DNA, 20 bp, Artificial
  CRISPR gRNA sequence
cttctaggatctcagtgtcc

SEQ ID NO: 30030 - DNA, 20 bp, Artificial
  CRISPR gRNA sequence
ctaggatctcagtgtcccct

SEQ ID NO: 30031 - DNA, 20 bp, Artificial
  CRISPR gRNA sequence
taggatctcagtgtcccctg

SEQ ID NO: 30032 - DNA, 20 bp, Artificial
  CRISPR gRNA sequence
ggatctcagtgtcccctgca

SEQ ID NO: 30033 - DNA, 20 bp, Artificial
  CRISPR gRNA sequence
agtgtcccctgcagcctgga

SEQ ID NO: 30034 - DNA, 20 bp, Artificial
  CRISPR gRNA sequence
cagcctggaggtcagccccg

SEQ ID NO: 30035 - DNA, 20 bp, Artificial
  CRISPR gRNA sequence
gaggtcagccccgtgggagt

SEQ ID NO: 30036 - DNA, 20 bp, Artificial
  CRISPR gRNA sequence
ctgggattactgccccattt

SEQ ID NO: 30037 - DNA, 20 bp, Artificial
  CRISPR gRNA sequence
ggattactgccccattttaa

SEQ ID NO: 30038 - DNA, 20 bp, Artificial
  CRISPR gRNA sequence
ctgccccattttaaagacag

SEQ ID NO: 30039 - DNA, 20 bp, Artificial
  CRISPR gRNA sequence
ccccattttaaagacaggca

SEQ ID NO: 30040 - DNA, 20 bp, Artificial
  CRISPR gRNA sequence
taaagacaggcaaaccaaga

SEQ ID NO: 30041 - DNA, 20 bp, Artificial
  CRISPR gRNA sequence
aaagacaggcaaaccaagac

SEQ ID NO: 30042 - DNA, 20 bp, Artificial
  CRISPR gRNA sequence
aagacaggcaaaccaagacc

SEQ ID NO: 30043 - DNA, 20 bp, Artificial
  CRISPR gRNA sequence
agaccacttctctgtggtca

SEQ ID NO: 30044 - DNA, 20 bp, Artificial
  CRISPR gRNA sequence
ctctgtggtcaaacagtgag

SEQ ID NO: 30045 - DNA, 20 bp, Artificial
  CRISPR gRNA sequence
tctgtggtcaaacagtgagc

SEQ ID NO: 30046 - DNA, 20 bp, Artificial
  CRISPR gRNA sequence
tgtggtcaaacagtgagccc

SEQ ID NO: 30047 - DNA, 20 bp, Artificial
  CRISPR gRNA sequence
tggtcaaacagtgagcccag

SEQ ID NO: 30048 - DNA, 20 bp, Artificial
  CRISPR gRNA sequence
aaaggaagtcatttcttgcc

SEQ ID NO: 30049 - DNA, 20 bp, Artificial
  CRISPR gRNA sequence
cttgccttactgtgtggaaa

SEQ ID NO: 30050 - DNA, 20 bp, Artificial
  CRISPR gRNA sequence
ttgccttactgtgtggaaac

SEQ ID NO: 30051 - DNA, 20 bp, Artificial
  CRISPR gRNA sequence
gccttactgtgtggaaactg

SEQ ID NO: 30052 - DNA, 20 bp, Artificial
  CRISPR gRNA sequence
ccttactgtgtggaaactgt

SEQ ID NO: 30053 - DNA, 20 bp, Artificial
  CRISPR gRNA sequence
actgtgtggaaactgtcaga

SEQ ID NO: 30054 - DNA, 20 bp, Artificial
  CRISPR gRNA sequence
ctgtgtggaaactgtcagaa

SEQ ID NO: 30055 - DNA, 20 bp, Artificial
  CRISPR gRNA sequence
tgtggaaactgtcagaacaa

SEQ ID NO: 30056 - DNA, 20 bp, Artificial
  CRISPR gRNA sequence
tcagaacaacttcccaagtt

SEQ ID NO: 30057 - DNA, 20 bp, Artificial
  CRISPR gRNA sequence
cccaagttcaaatcccagct

SEQ ID NO: 30058 - DNA, 20 bp, Artificial
  CRISPR gRNA sequence
ccaagttcaaatcccagcta

SEQ ID NO: 30059 - DNA, 20 bp, Artificial
  CRISPR gRNA sequence
aaatcccagctatgcctctt

SEQ ID NO: 30060 - DNA, 20 bp, Artificial
  CRISPR gRNA sequence
tgcctcttactgcctatgtg

SEQ ID NO: 30061 - DNA, 20 bp, Artificial
  CRISPR gRNA sequence
ttactgcctatgtgaccttg

SEQ ID NO: 30062 - DNA, 20 bp, Artificial
  CRISPR gRNA sequence
actgcctatgtgaccttggg

SEQ ID NO: 30063 - DNA, 20 bp, Artificial
  CRISPR gRNA sequence
ctgcctatgtgaccttgggc

SEQ ID NO: 30064 - DNA, 20 bp, Artificial
  CRISPR gRNA sequence
cctatgtgaccttgggcaag

SEQ ID NO: 30065 - DNA, 20 bp, Artificial
  CRISPR gRNA sequence
tgtgaccttgggcaagctac

SEQ ID NO: 30066 - DNA, 20 bp, Artificial
  CRISPR gRNA sequence
gggcaagctactcaactctt

SEQ ID NO: 30067 - DNA, 20 bp, Artificial
  CRISPR gRNA sequence
ggcaagctactcaactcttc

SEQ ID NO: 30068 - DNA, 20 bp, Artificial
  CRISPR gRNA sequence
ctcaactcttctgagactca

SEQ ID NO: 30069 - DNA, 20 bp, Artificial
  CRISPR gRNA sequence
aactcttctgagactcagtt

SEQ ID NO: 30070 - DNA, 20 bp, Artificial
  CRISPR gRNA sequence
ttctgagactcagtttgccc

SEQ ID NO: 30071 - DNA, 20 bp, Artificial
  CRISPR gRNA sequence
ctgagactcagtttgcccat

SEQ ID NO: 30072 - DNA, 20 bp, Artificial
  CRISPR gRNA sequence
tgagactcagtttgcccatc

SEQ ID NO: 30073 - DNA, 20 bp, Artificial
  CRISPR gRNA sequence
agactcagtttgcccatctg

SEQ ID NO: 30074 - DNA, 20 bp, Artificial
  CRISPR gRNA sequence
agtttgcccatctgtaaaat

SEQ ID NO: 30075 - DNA, 20 bp, Artificial
  CRISPR gRNA sequence
gcccatctgtaaaatgggca

SEQ ID NO: 30076 - DNA, 20 bp, Artificial
  CRISPR gRNA sequence
cccatctgtaaaatgggcat

SEQ ID NO: 30077 - DNA, 20 bp, Artificial
  CRISPR gRNA sequence
taaaatgggcatgatagagt

SEQ ID NO: 30078 - DNA, 20 bp, Artificial
  CRISPR gRNA sequence
tggggaggagtaaatgaatc

SEQ ID NO: 30079 - DNA, 20 bp, Artificial
  CRISPR gRNA sequence
atataacatttagaacatgc

SEQ ID NO: 30080 - DNA, 20 bp, Artificial
  CRISPR gRNA sequence
agaacatgccttggtgccta

SEQ ID NO: 30081 - DNA, 20 bp, Artificial
  CRISPR gRNA sequence
gaacatgccttggtgcctag

SEQ ID NO: 30082 - DNA, 20 bp, Artificial
  CRISPR gRNA sequence
ggtgcctagaatgaactaaa

SEQ ID NO: 30083 - DNA, 20 bp, Artificial
  CRISPR gRNA sequence
gtgcctagaatgaactaaat

SEQ ID NO: 30084 - DNA, 20 bp, Artificial
  CRISPR gRNA sequence
gaatgaactaaatgttagct

SEQ ID NO: 30085 - DNA, 20 bp, Artificial
  CRISPR gRNA sequence
aatgttagctatggttctga

SEQ ID NO: 30086 - DNA, 20 bp, Artificial
  CRISPR gRNA sequence
gctatggttctgactacatc

SEQ ID NO: 30087 - DNA, 20 bp, Artificial
  CRISPR gRNA sequence
tggttctgactacatcacag

SEQ ID NO: 30088 - DNA, 20 bp, Artificial
  CRISPR gRNA sequence
tgactacatcacaggaacat

SEQ ID NO: 30089 - DNA, 20 bp, Artificial
  CRISPR gRNA sequence
actacatcacaggaacattg

SEQ ID NO: 30090 - DNA, 20 bp, Artificial
  CRISPR gRNA sequence
catcacaggaacattggtga

SEQ ID NO: 30091 - DNA, 20 bp, Artificial
  CRISPR gRNA sequence
gtgagggtcgcatgagttaa

SEQ ID NO: 30092 - DNA, 20 bp, Artificial
  CRISPR gRNA sequence
acatagagggtgtgaccagc

SEQ ID NO: 30093 - DNA, 20 bp, Artificial
  CRISPR gRNA sequence
ggggcaggaagagaaaaagc

SEQ ID NO: 30094 - DNA, 20 bp, Artificial
  CRISPR gRNA sequence
gaccagctccagtttctgca

SEQ ID NO: 30095 - DNA, 20 bp, Artificial
  CRISPR gRNA sequence
cagtttctgcagcatattca

SEQ ID NO: 30096 - DNA, 20 bp, Artificial
  CRISPR gRNA sequence
ctgcagcatattcacaacca

SEQ ID NO: 30097 - DNA, 20 bp, Artificial
  CRISPR gRNA sequence
tgcagcatattcacaaccag

SEQ ID NO: 30098 - DNA, 20 bp, Artificial
  CRISPR gRNA sequence
cagcatattcacaaccagca

SEQ ID NO: 30099 - DNA, 20 bp, Artificial
  CRISPR gRNA sequence
acaaccagcattagtagcag

SEQ ID NO: 30100 - DNA, 20 bp, Artificial
  CRISPR gRNA sequence
gtagcagtgaaaatagcatg

SEQ ID NO: 30101 - DNA, 20 bp, Artificial
  CRISPR gRNA sequence
atgccaacttcagctgttta

SEQ ID NO: 30102 - DNA, 20 bp, Artificial
  CRISPR gRNA sequence
cagctgtttactcgacacca

SEQ ID NO: 30103 - DNA, 20 bp, Artificial
  CRISPR gRNA sequence
agctgtttactcgacaccaa

SEQ ID NO: 30104 - DNA, 20 bp, Artificial
  CRISPR gRNA sequence
tttactcgacaccaagcagc

SEQ ID NO: 30105 - DNA, 20 bp, Artificial
  CRISPR gRNA sequence
actcgacaccaagcagcctt

SEQ ID NO: 30106 - DNA, 20 bp, Artificial
  CRISPR gRNA sequence
ctcgacaccaagcagccttt

SEQ ID NO: 30107 - DNA, 20 bp, Artificial
  CRISPR gRNA sequence
gacaccaagcagccttttaa

SEQ ID NO: 30108 - DNA, 20 bp, Artificial
  CRISPR gRNA sequence
ttaacaggtcaggtgctgct

SEQ ID NO: 30109 - DNA, 20 bp, Artificial
  CRISPR gRNA sequence
taacaggtcaggtgctgctg

SEQ ID NO: 30110 - DNA, 20 bp, Artificial
  CRISPR gRNA sequence
aacaggtcaggtgctgctgc

SEQ ID NO: 30111 - DNA, 20 bp, Artificial
  CRISPR gRNA sequence
acaggtcaggtgctgctgcg

SEQ ID NO: 30112 - DNA, 20 bp, Artificial
  CRISPR gRNA sequence
ctgcgggtatgatttcaggg

SEQ ID NO: 30113 - DNA, 20 bp, Artificial
  CRISPR gRNA sequence
cgggtatgatttcagggcca

SEQ ID NO: 30114 - DNA, 20 bp, Artificial
  CRISPR gRNA sequence
cagggccatgactttgccat

SEQ ID NO: 30115 - DNA, 20 bp, Artificial
  CRISPR gRNA sequence
agggccatgactttgccatg

SEQ ID NO: 30116 - DNA, 20 bp, Artificial
  CRISPR gRNA sequence
tgccatgattcagcctcaga

SEQ ID NO: 30117 - DNA, 20 bp, Artificial
  CRISPR gRNA sequence
gccatgattcagcctcagaa

SEQ ID NO: 30118 - DNA, 20 bp, Artificial
  CRISPR gRNA sequence
ccatgattcagcctcagaac

SEQ ID NO: 30119 - DNA, 20 bp, Artificial
  CRISPR gRNA sequence
agcctcagaactcccttgca

SEQ ID NO: 30120 - DNA, 20 bp, Artificial
  CRISPR gRNA sequence
agaactcccttgcagggctg

SEQ ID NO: 30121 - DNA, 20 bp, Artificial
  CRISPR gRNA sequence
ccttgcagggctgcatataa

SEQ ID NO: 30122 - DNA, 20 bp, Artificial
  CRISPR gRNA sequence
gcagggctgcatataaaagc

SEQ ID NO: 30123 - DNA, 20 bp, Artificial
  CRISPR gRNA sequence
cagggctgcatataaaagca

SEQ ID NO: 30124 - DNA, 20 bp, Artificial
  CRISPR gRNA sequence
catataaaagcagcaggtgc

SEQ ID NO: 30125 - DNA, 20 bp, Artificial
  CRISPR gRNA sequence
acgcctgtaatcctaacact

SEQ ID NO: 30126 - DNA, 20 bp, Artificial
  CRISPR gRNA sequence
taatcctaacactttggagg

SEQ ID NO: 30127 - DNA, 20 bp, Artificial
  CRISPR gRNA sequence
acactttggaggccgaggcg

SEQ ID NO: 30128 - DNA, 20 bp, Artificial
  CRISPR gRNA sequence
tggaggccgaggcgggtgga

SEQ ID NO: 30129 - DNA, 20 bp, Artificial
  CRISPR gRNA sequence
ggaggccgaggcgggtggat

SEQ ID NO: 30130 - DNA, 20 bp, Artificial
  CRISPR gRNA sequence
gaggccgaggcgggtggatc

SEQ ID NO: 30131 - DNA, 20 bp, Artificial
  CRISPR gRNA sequence
aggtcgggagtttgagacca

SEQ ID NO: 30132 - DNA, 20 bp, Artificial
  CRISPR gRNA sequence
gagaccagcctgaccaacat

SEQ ID NO: 30133 - DNA, 20 bp, Artificial
  CRISPR gRNA sequence
agaccagcctgaccaacatg

SEQ ID NO: 30134 - DNA, 20 bp, Artificial
  CRISPR gRNA sequence
accaacatggagaaaccccg

SEQ ID NO: 30135 - DNA, 20 bp, Artificial
  CRISPR gRNA sequence
tactaaaaatacaaaattag

SEQ ID NO: 30136 - DNA, 20 bp, Artificial
  CRISPR gRNA sequence
ctaaaaatacaaaattagcc

SEQ ID NO: 30137 - DNA, 20 bp, Artificial
  CRISPR gRNA sequence
aaaatacaaaattagccggg

SEQ ID NO: 30138 - DNA, 20 bp, Artificial
  CRISPR gRNA sequence
gccgggtgtgatggcacatg

SEQ ID NO: 30139 - DNA, 20 bp, Artificial
  CRISPR gRNA sequence
tactcccagctacttgagag

SEQ ID NO: 30140 - DNA, 20 bp, Artificial
  CRISPR gRNA sequence
ccagctacttgagaggctga

SEQ ID NO: 30141 - DNA, 20 bp, Artificial
  CRISPR gRNA sequence
cttgagaggctgaggcagga

SEQ ID NO: 30142 - DNA, 20 bp, Artificial
  CRISPR gRNA sequence
gagaggctgaggcaggagaa

SEQ ID NO: 30143 - DNA, 20 bp, Artificial
  CRISPR gRNA sequence
agaggctgaggcaggagaat

SEQ ID NO: 30144 - DNA, 20 bp, Artificial
  CRISPR gRNA sequence
aggcaggagaattgcttgaa

SEQ ID NO: 30145 - DNA, 20 bp, Artificial
  CRISPR gRNA sequence
cttgaactcgggaggcggag

SEQ ID NO: 30146 - DNA, 20 bp, Artificial
  CRISPR gRNA sequence
gaactcgggaggcggagttg

SEQ ID NO: 30147 - DNA, 20 bp, Artificial
  CRISPR gRNA sequence
aactcgggaggcggagttgc

SEQ ID NO: 30148 - DNA, 20 bp, Artificial
  CRISPR gRNA sequence
gggaggcggagttgcagtga

SEQ ID NO: 30149 - DNA, 20 bp, Artificial
  CRISPR gRNA sequence
cagtgaactgagactgcact

SEQ ID NO: 30150 - DNA, 20 bp, Artificial
  CRISPR gRNA sequence
agactgcactccagccttgg

SEQ ID NO: 30151 - DNA, 20 bp, Artificial
  CRISPR gRNA sequence
cactccagccttggcaacaa

SEQ ID NO: 30152 - DNA, 20 bp, Artificial
  CRISPR gRNA sequence
cagccttggcaacaagagcg

SEQ ID NO: 30153 - DNA, 20 bp, Artificial
  CRISPR gRNA sequence
ggcaacaagagcgaaactct

SEQ ID NO: 30154 - DNA, 20 bp, Artificial
  CRISPR gRNA sequence
gcaacaagagcgaaactctg

SEQ ID NO: 30155 - DNA, 20 bp, Artificial
  CRISPR gRNA sequence
tgtctcgaaaaaaaaagaaa

SEQ ID NO: 30156 - DNA, 20 bp, Artificial
  CRISPR gRNA sequence
tctcgaaaaaaaaagaaaaa

SEQ ID NO: 30157 - DNA, 20 bp, Artificial
  CRISPR gRNA sequence
gaaaaaaaaagaaaaaaata

SEQ ID NO: 30158 - DNA, 20 bp, Artificial
  CRISPR gRNA sequence
acactgctgccaagtggatt

SEQ ID NO: 30159 - DNA, 20 bp, Artificial
  CRISPR gRNA sequence
cactgctgccaagtggattc

SEQ ID NO: 30160 - DNA, 20 bp, Artificial
  CRISPR gRNA sequence
ctgccaagtggattcaggct

SEQ ID NO: 30161 - DNA, 20 bp, Artificial
  CRISPR gRNA sequence
ccaagtggattcaggctaaa

SEQ ID NO: 30162 - DNA, 20 bp, Artificial
  CRISPR gRNA sequence
aggctaaatcaactcacatc

SEQ ID NO: 30163 - DNA, 20 bp, Artificial
  CRISPR gRNA sequence
aatcaactcacatcacgggt

SEQ ID NO: 30164 - DNA, 20 bp, Artificial
  CRISPR gRNA sequence
acatcacgggtcggccggta

SEQ ID NO: 30165 - DNA, 20 bp, Artificial
  CRISPR gRNA sequence
gatgggggttttgcaatctc

SEQ ID NO: 30166 - DNA, 20 bp, Artificial
  CRISPR gRNA sequence
tgcaatctctgaaccctgga

SEQ ID NO: 30167 - DNA, 20 bp, Artificial
  CRISPR gRNA sequence
gcaatctctgaaccctggag

SEQ ID NO: 30168 - DNA, 20 bp, Artificial
  CRISPR gRNA sequence
caatctctgaaccctggaga

SEQ ID NO: 30169 - DNA, 20 bp, Artificial
  CRISPR gRNA sequence
tgaaccctggagacccttcc

SEQ ID NO: 30170 - DNA, 20 bp, Artificial
  CRISPR gRNA sequence
aaccctggagacccttcctc

SEQ ID NO: 30171 - DNA, 20 bp, Artificial
  CRISPR gRNA sequence
gagacccttcctccacccca

SEQ ID NO: 30172 - DNA, 20 bp, Artificial
  CRISPR gRNA sequence
cctccaccccacagggagag

SEQ ID NO: 30173 - DNA, 20 bp, Artificial
  CRISPR gRNA sequence
ctccaccccacagggagagt

SEQ ID NO: 30174 - DNA, 20 bp, Artificial
  CRISPR gRNA sequence
caccccacagggagagtaat

SEQ ID NO: 30175 - DNA, 20 bp, Artificial
  CRISPR gRNA sequence
accatatttcatcgatgcca

SEQ ID NO: 30176 - DNA, 20 bp, Artificial
  CRISPR gRNA sequence
catcgatgccaagacatata

SEQ ID NO: 30177 - DNA, 20 bp, Artificial
  CRISPR gRNA sequence
atcgatgccaagacatatat

SEQ ID NO: 30178 - DNA, 20 bp, Artificial
  CRISPR gRNA sequence
gaatatcattgagatcagga

SEQ ID NO: 30179 - DNA, 20 bp, Artificial
  CRISPR gRNA sequence
aatatcattgagatcaggat

SEQ ID NO: 30180 - DNA, 20 bp, Artificial
  CRISPR gRNA sequence
agatcaggatgtgtcttata

SEQ ID NO: 30181 - DNA, 20 bp, Artificial
  CRISPR gRNA sequence
ataaccaatagcgtgtcaca

SEQ ID NO: 30182 - DNA, 20 bp, Artificial
  CRISPR gRNA sequence
taaccaatagcgtgtcacag

SEQ ID NO: 30183 - DNA, 20 bp, Artificial
  CRISPR gRNA sequence
gcattttggcctcatattgg

SEQ ID NO: 30184 - DNA, 20 bp, Artificial
  CRISPR gRNA sequence
cattttggcctcatattggg

SEQ ID NO: 30185 - DNA, 20 bp, Artificial
  CRISPR gRNA sequence
tggcctcatattggggtctt

SEQ ID NO: 30186 - DNA, 20 bp, Artificial
  CRISPR gRNA sequence
ggcctcatattggggtctta

SEQ ID NO: 30187 - DNA, 20 bp, Artificial
  CRISPR gRNA sequence
gcctcatattggggtcttac

SEQ ID NO: 30188 - DNA, 20 bp, Artificial
  CRISPR gRNA sequence
atattggggtcttacaatgg

SEQ ID NO: 30189 - DNA, 20 bp, Artificial
  CRISPR gRNA sequence
gggtcttacaatggatggca

SEQ ID NO: 30190 - DNA, 20 bp, Artificial
  CRISPR gRNA sequence
acaatggatggcatcttaga

SEQ ID NO: 30191 - DNA, 20 bp, Artificial
  CRISPR gRNA sequence
caatggatggcatcttagat

SEQ ID NO: 30192 - DNA, 20 bp, Artificial
  CRISPR gRNA sequence
agattccatgaaatatgatg

SEQ ID NO: 30193 - DNA, 20 bp, Artificial
  CRISPR gRNA sequence
gattccatgaaatatgatgt

SEQ ID NO: 30194 - DNA, 20 bp, Artificial
  CRISPR gRNA sequence
catgaaatatgatgtttctt

SEQ ID NO: 30195 - DNA, 20 bp, Artificial
  CRISPR gRNA sequence
cttaaagggtaaatcaggct

SEQ ID NO: 30196 - DNA, 20 bp, Artificial
  CRISPR gRNA sequence
ttaaagggtaaatcaggctg

SEQ ID NO: 30197 - DNA, 20 bp, Artificial
  CRISPR gRNA sequence
aaagggtaaatcaggctggg

SEQ ID NO: 30198 - DNA, 20 bp, Artificial
  CRISPR gRNA sequence
aagggtaaatcaggctgggc

SEQ ID NO: 30199 - DNA, 20 bp, Artificial
  CRISPR gRNA sequence
ggcatggtggctcacacccg

SEQ ID NO: 30200 - DNA, 20 bp, Artificial
  CRISPR gRNA sequence
acacccgtaatcccagcact

SEQ ID NO: 30201 - DNA, 20 bp, Artificial
  CRISPR gRNA sequence
tggaaggctgaggtgggtgg

SEQ ID NO: 30202 - DNA, 20 bp, Artificial
  CRISPR gRNA sequence
ggaaggctgaggtgggtgga

SEQ ID NO: 30203 - DNA, 20 bp, Artificial
  CRISPR gRNA sequence
gaaggctgaggtgggtggat

SEQ ID NO: 30204 - DNA, 20 bp, Artificial
  CRISPR gRNA sequence
aggtgggtggatcgcttggg

SEQ ID NO: 30205 - DNA, 20 bp, Artificial
  CRISPR gRNA sequence
gggcccaggatttcaagacc

SEQ ID NO: 30206 - DNA, 20 bp, Artificial
  CRISPR gRNA sequence
ggcccaggatttcaagacca

SEQ ID NO: 30207 - DNA, 20 bp, Artificial
  CRISPR gRNA sequence
caagaccagtctgggccaca

SEQ ID NO: 30208 - DNA, 20 bp, Artificial
  CRISPR gRNA sequence
aagaccagtctgggccacat

SEQ ID NO: 30209 - DNA, 20 bp, Artificial
  CRISPR gRNA sequence
ggccacatggcgaagccctg

SEQ ID NO: 30210 - DNA, 20 bp, Artificial
  CRISPR gRNA sequence
tctctactgaaaacacaaaa

SEQ ID NO: 30211 - DNA, 20 bp, Artificial
  CRISPR gRNA sequence
tactgaaaacacaaaaatag

SEQ ID NO: 30212 - DNA, 20 bp, Artificial
  CRISPR gRNA sequence
ctgaaaacacaaaaatagcc

SEQ ID NO: 30213 - DNA, 20 bp, Artificial
  CRISPR gRNA sequence
aaaacacaaaaatagcctgg

SEQ ID NO: 30214 - DNA, 20 bp, Artificial
  CRISPR gRNA sequence
gtgtggtggcgggcatctgt

SEQ ID NO: 30215 - DNA, 20 bp, Artificial
  CRISPR gRNA sequence
taatcccagctacttgggag

SEQ ID NO: 30216 - DNA, 20 bp, Artificial
  CRISPR gRNA sequence
cttgggaggctgaggcatga

SEQ ID NO: 30217 - DNA, 20 bp, Artificial
  CRISPR gRNA sequence
gggaggctgaggcatgagaa

SEQ ID NO: 30218 - DNA, 20 bp, Artificial
  CRISPR gRNA sequence
ggaggctgaggcatgagaat

SEQ ID NO: 30219 - DNA, 20 bp, Artificial
  CRISPR gRNA sequence
aggcatgagaatcacttgaa

SEQ ID NO: 30220 - DNA, 20 bp, Artificial
  CRISPR gRNA sequence
gaacccaggaggcagtgctt

SEQ ID NO: 30221 - DNA, 20 bp, Artificial
  CRISPR gRNA sequence
aacccaggaggcagtgcttg

SEQ ID NO: 30222 - DNA, 20 bp, Artificial
  CRISPR gRNA sequence
gcagtgagctgagatcatgc

SEQ ID NO: 30223 - DNA, 20 bp, Artificial
  CRISPR gRNA sequence
cagtgagctgagatcatgcc

SEQ ID NO: 30224 - DNA, 20 bp, Artificial
  CRISPR gRNA sequence
agatcatgccactgcacctt

SEQ ID NO: 30225 - DNA, 20 bp, Artificial
  CRISPR gRNA sequence
caccttagcctgggcaataa

SEQ ID NO: 30226 - DNA, 20 bp, Artificial
  CRISPR gRNA sequence
agcctgggcaataaagtgag

SEQ ID NO: 30227 - DNA, 20 bp, Artificial
  CRISPR gRNA sequence
gcctgggcaataaagtgaga

SEQ ID NO: 30228 - DNA, 20 bp, Artificial
  CRISPR gRNA sequence
ggcaataaagtgagacttgg

SEQ ID NO: 30229 - DNA, 20 bp, Artificial
  CRISPR gRNA sequence
ggtctcaaaaagaaaagaaa

SEQ ID NO: 30230 - DNA, 20 bp, Artificial
  CRISPR gRNA sequence
gtctcaaaaagaaaagaaaa

SEQ ID NO: 30231 - DNA, 20 bp, Artificial
  CRISPR gRNA sequence
aaaaagaaaagaaaagaaaa

SEQ ID NO: 30232 - DNA, 20 bp, Artificial
  CRISPR gRNA sequence
cccaggcccacctacttttc

SEQ ID NO: 30233 - DNA, 20 bp, Artificial
  CRISPR gRNA sequence
ccaggcccacctacttttcc

SEQ ID NO: 30234 - DNA, 20 bp, Artificial
  CRISPR gRNA sequence
cttttccattcacactgaaa

SEQ ID NO: 30235 - DNA, 20 bp, Artificial
  CRISPR gRNA sequence
ttccattcacactgaaaaac

SEQ ID NO: 30236 - DNA, 20 bp, Artificial
  CRISPR gRNA sequence
tccattcacactgaaaaact

SEQ ID NO: 30237 - DNA, 20 bp, Artificial
  CRISPR gRNA sequence
ccattcacactgaaaaactg

SEQ ID NO: 30238 - DNA, 20 bp, Artificial
  CRISPR gRNA sequence
cattcacactgaaaaactgc

SEQ ID NO: 30239 - DNA, 20 bp, Artificial
  CRISPR gRNA sequence
acactgaaaaactgcaaata

SEQ ID NO: 30240 - DNA, 20 bp, Artificial
  CRISPR gRNA sequence
aaaaactgcaaatacctctt

SEQ ID NO: 30241 - DNA, 20 bp, Artificial
  CRISPR gRNA sequence
caaatacctcttgtgaccca

SEQ ID NO: 30242 - DNA, 20 bp, Artificial
  CRISPR gRNA sequence
ttgtgacccacaagggcctc

SEQ ID NO: 30243 - DNA, 20 bp, Artificial
  CRISPR gRNA sequence
gtgacccacaagggcctccc

SEQ ID NO: 30244 - DNA, 20 bp, Artificial
  CRISPR gRNA sequence
tgacccacaagggcctccct

SEQ ID NO: 30245 - DNA, 20 bp, Artificial
  CRISPR gRNA sequence
cctgtgtgatctggattccc

SEQ ID NO: 30246 - DNA, 20 bp, Artificial
  CRISPR gRNA sequence
tgtgatctggattcccctga

SEQ ID NO: 30247 - DNA, 20 bp, Artificial
  CRISPR gRNA sequence
gattcccctgacctccccta

SEQ ID NO: 30248 - DNA, 20 bp, Artificial
  CRISPR gRNA sequence
ccctgacctcccctacttcc

SEQ ID NO: 30249 - DNA, 20 bp, Artificial
  CRISPR gRNA sequence
acctcccctacttccaccat

SEQ ID NO: 30250 - DNA, 20 bp, Artificial
  CRISPR gRNA sequence
ccctacttccaccattgccc

SEQ ID NO: 30251 - DNA, 20 bp, Artificial
  CRISPR gRNA sequence
cttccaccattgcccagcct

SEQ ID NO: 30252 - DNA, 20 bp, Artificial
  CRISPR gRNA sequence
ccaccattgcccagcctctg

SEQ ID NO: 30253 - DNA, 20 bp, Artificial
  CRISPR gRNA sequence
caccattgcccagcctctgt

SEQ ID NO: 30254 - DNA, 20 bp, Artificial
  CRISPR gRNA sequence
cccagcctctgtccctcatt

SEQ ID NO: 30255 - DNA, 20 bp, Artificial
  CRISPR gRNA sequence
tgtccctcattcactacaca

SEQ ID NO: 30256 - DNA, 20 bp, Artificial
  CRISPR gRNA sequence
tccctcattcactacacaca

SEQ ID NO: 30257 - DNA, 20 bp, Artificial
  CRISPR gRNA sequence
attcactacacacagccaca

SEQ ID NO: 30258 - DNA, 20 bp, Artificial
  CRISPR gRNA sequence
actacacacagccacagtgg

SEQ ID NO: 30259 - DNA, 20 bp, Artificial
  CRISPR gRNA sequence
cacacagccacagtggccct

SEQ ID NO: 30260 - DNA, 20 bp, Artificial
  CRISPR gRNA sequence
ctgacccttaaaacacagcc

SEQ ID NO: 30261 - DNA, 20 bp, Artificial
  CRISPR gRNA sequence
tgacccttaaaacacagccc

SEQ ID NO: 30262 - DNA, 20 bp, Artificial
  CRISPR gRNA sequence
acccttaaaacacagcccct

SEQ ID NO: 30263 - DNA, 20 bp, Artificial
  CRISPR gRNA sequence
aaaacacagccccttttccc

SEQ ID NO: 30264 - DNA, 20 bp, Artificial
  CRISPR gRNA sequence
aaacacagccccttttccca

SEQ ID NO: 30265 - DNA, 20 bp, Artificial
  CRISPR gRNA sequence
ttcccacttagggcctttgc

SEQ ID NO: 30266 - DNA, 20 bp, Artificial
  CRISPR gRNA sequence
tcccacttagggcctttgca

SEQ ID NO: 30267 - DNA, 20 bp, Artificial
  CRISPR gRNA sequence
cccacttagggcctttgcac

SEQ ID NO: 30268 - DNA, 20 bp, Artificial
  CRISPR gRNA sequence
ccacttagggcctttgcacc

SEQ ID NO: 30269 - DNA, 20 bp, Artificial
  CRISPR gRNA sequence
agggcctttgcacctgctgt

SEQ ID NO: 30270 - DNA, 20 bp, Artificial
  CRISPR gRNA sequence
gggcctttgcacctgctgtt

SEQ ID NO: 30271 - DNA, 20 bp, Artificial
  CRISPR gRNA sequence
tgcacctgctgttctttctt

SEQ ID NO: 30272 - DNA, 20 bp, Artificial
  CRISPR gRNA sequence
gcacctgctgttctttcttc

SEQ ID NO: 30273 - DNA, 20 bp, Artificial
  CRISPR gRNA sequence
cacctgctgttctttcttcc

SEQ ID NO: 30274 - DNA, 20 bp, Artificial
  CRISPR gRNA sequence
ctgttctttcttcctagagt

SEQ ID NO: 30275 - DNA, 20 bp, Artificial
  CRISPR gRNA sequence
ttctttcttcctagagtcct

SEQ ID NO: 30276 - DNA, 20 bp, Artificial
  CRISPR gRNA sequence
tttcttcctagagtcctttt

SEQ ID NO: 30277 - DNA, 20 bp, Artificial
  CRISPR gRNA sequence
tcttcctagagtccttttcc

SEQ ID NO: 30278 - DNA, 20 bp, Artificial
  CRISPR gRNA sequence
cttcctagagtccttttccc

SEQ ID NO: 30279 - DNA, 20 bp, Artificial
  CRISPR gRNA sequence
ttcctagagtccttttcccc

SEQ ID NO: 30280 - DNA, 20 bp, Artificial
  CRISPR gRNA sequence
cctagagtccttttccccta

SEQ ID NO: 30281 - DNA, 20 bp, Artificial
  CRISPR gRNA sequence
ctagagtccttttcccctag

SEQ ID NO: 30282 - DNA, 20 bp, Artificial
  CRISPR gRNA sequence
gagtccttttcccctagagc

SEQ ID NO: 30283 - DNA, 20 bp, Artificial
  CRISPR gRNA sequence
ttcccctagagcttcccacg

SEQ ID NO: 30284 - DNA, 20 bp, Artificial
  CRISPR gRNA sequence
tcccctagagcttcccacgg

SEQ ID NO: 30285 - DNA, 20 bp, Artificial
  CRISPR gRNA sequence
cccctagagcttcccacgga

SEQ ID NO: 30286 - DNA, 20 bp, Artificial
  CRISPR gRNA sequence
ccctagagcttcccacggaa

SEQ ID NO: 30287 - DNA, 20 bp, Artificial
  CRISPR gRNA sequence
gagcttcccacggaagaatc

SEQ ID NO: 30288 - DNA, 20 bp, Artificial
  CRISPR gRNA sequence
cccacggaagaatcatctcc

SEQ ID NO: 30289 - DNA, 20 bp, Artificial
  CRISPR gRNA sequence
ccacggaagaatcatctccc

SEQ ID NO: 30290 - DNA, 20 bp, Artificial
  CRISPR gRNA sequence
cccagaagtcctgtaccctc

SEQ ID NO: 30291 - DNA, 20 bp, Artificial
  CRISPR gRNA sequence
taccctcctggggcttgtta

SEQ ID NO: 30292 - DNA, 20 bp, Artificial
  CRISPR gRNA sequence
ctggggcttgttagtttcct

SEQ ID NO: 30293 - DNA, 20 bp, Artificial
  CRISPR gRNA sequence
gggcttgttagtttccttcc

SEQ ID NO: 30294 - DNA, 20 bp, Artificial
  CRISPR gRNA sequence
gttagtttccttcccagcat

SEQ ID NO: 30295 - DNA, 20 bp, Artificial
  CRISPR gRNA sequence
ttagtttccttcccagcatg

SEQ ID NO: 30296 - DNA, 20 bp, Artificial
  CRISPR gRNA sequence
gtttccttcccagcatgaat

SEQ ID NO: 30297 - DNA, 20 bp, Artificial
  CRISPR gRNA sequence
ccttcccagcatgaatcact

SEQ ID NO: 30298 - DNA, 20 bp, Artificial
  CRISPR gRNA sequence
cttcccagcatgaatcactg

SEQ ID NO: 30299 - DNA, 20 bp, Artificial
  CRISPR gRNA sequence
cccagcatgaatcactgttt

SEQ ID NO: 30300 - DNA, 20 bp, Artificial
  CRISPR gRNA sequence
ccagcatgaatcactgtttt

SEQ ID NO: 30301 - DNA, 20 bp, Artificial
  CRISPR gRNA sequence
ttttacaatattttatttat

SEQ ID NO: 30302 - DNA, 20 bp, Artificial
  CRISPR gRNA sequence
tacaatattttatttatgta

SEQ ID NO: 30303 - DNA, 20 bp, Artificial
  CRISPR gRNA sequence
acaatattttatttatgtat

SEQ ID NO: 30304 - DNA, 20 bp, Artificial
  CRISPR gRNA sequence
caatattttatttatgtatg

SEQ ID NO: 30305 - DNA, 20 bp, Artificial
  CRISPR gRNA sequence
tatttatgtatgtgcctaat

SEQ ID NO: 30306 - DNA, 20 bp, Artificial
  CRISPR gRNA sequence
atttatgtatgtgcctaatt

SEQ ID NO: 30307 - DNA, 20 bp, Artificial
  CRISPR gRNA sequence
tttatgtatgtgcctaattc

SEQ ID NO: 30308 - DNA, 20 bp, Artificial
  CRISPR gRNA sequence
atgtatgtgcctaattccta

SEQ ID NO: 30309 - DNA, 20 bp, Artificial
  CRISPR gRNA sequence
tgtatgtgcctaattcctac

SEQ ID NO: 30310 - DNA, 20 bp, Artificial
  CRISPR gRNA sequence
attcctactacgcaaagaaa

SEQ ID NO: 30311 - DNA, 20 bp, Artificial
  CRISPR gRNA sequence
ctactacgcaaagaaactca

SEQ ID NO: 30312 - DNA, 20 bp, Artificial
  CRISPR gRNA sequence
ctacgcaaagaaactcaaaa

SEQ ID NO: 30313 - DNA, 20 bp, Artificial
  CRISPR gRNA sequence
cgcaaagaaactcaaaagca

SEQ ID NO: 30314 - DNA, 20 bp, Artificial
  CRISPR gRNA sequence
aaaagcaagaacgacatctg

SEQ ID NO: 30315 - DNA, 20 bp, Artificial
  CRISPR gRNA sequence
tctagttcatacttgtatct

SEQ ID NO: 30316 - DNA, 20 bp, Artificial
  CRISPR gRNA sequence
gttcatacttgtatctctag

SEQ ID NO: 30317 - DNA, 20 bp, Artificial
  CRISPR gRNA sequence
atacttgtatctctagtttt

SEQ ID NO: 30318 - DNA, 20 bp, Artificial
  CRISPR gRNA sequence
gtatctctagtttttagcac

SEQ ID NO: 30319 - DNA, 20 bp, Artificial
  CRISPR gRNA sequence
tatctctagtttttagcaca

SEQ ID NO: 30320 - DNA, 20 bp, Artificial
  CRISPR gRNA sequence
tagtttttagcacaattatg

SEQ ID NO: 30321 - DNA, 20 bp, Artificial
  CRISPR gRNA sequence
gtttttagcacaattatgaa

SEQ ID NO: 30322 - DNA, 20 bp, Artificial
  CRISPR gRNA sequence
ttagcacaattatgaaccag

SEQ ID NO: 30323 - DNA, 20 bp, Artificial
  CRISPR gRNA sequence
tagcacaattatgaaccaga

SEQ ID NO: 30324 - DNA, 20 bp, Artificial
  CRISPR gRNA sequence
agcacaattatgaaccagac

SEQ ID NO: 30325 - DNA, 20 bp, Artificial
  CRISPR gRNA sequence
gcacaattatgaaccagaca

SEQ ID NO: 30326 - DNA, 20 bp, Artificial
  CRISPR gRNA sequence
tgaaccagacagattctatt

SEQ ID NO: 30327 - DNA, 20 bp, Artificial
  CRISPR gRNA sequence
tatttttgcttctgagtttc

SEQ ID NO: 30328 - DNA, 20 bp, Artificial
  CRISPR gRNA sequence
tttttgcttctgagtttctt

SEQ ID NO: 30329 - DNA, 20 bp, Artificial
  CRISPR gRNA sequence
ttgcttctgagtttctttgc

SEQ ID NO: 30330 - DNA, 20 bp, Artificial
  CRISPR gRNA sequence
tgcttctgagtttctttgca

SEQ ID NO: 30331 - DNA, 20 bp, Artificial
  CRISPR gRNA sequence
gcttctgagtttctttgcat

SEQ ID NO: 30332 - DNA, 20 bp, Artificial
  CRISPR gRNA sequence
cttctgagtttctttgcata

SEQ ID NO: 30333 - DNA, 20 bp, Artificial
  CRISPR gRNA sequence
ctgagtttctttgcatagca

SEQ ID NO: 30334 - DNA, 20 bp, Artificial
  CRISPR gRNA sequence
tgagtttctttgcatagcaa

SEQ ID NO: 30335 - DNA, 20 bp, Artificial
  CRISPR gRNA sequence
agtttctttgcatagcaaga

SEQ ID NO: 30336 - DNA, 20 bp, Artificial
  CRISPR gRNA sequence
ctttgcatagcaagaagtaa

SEQ ID NO: 30337 - DNA, 20 bp, Artificial
  CRISPR gRNA sequence
tttgcatagcaagaagtaag

SEQ ID NO: 30338 - DNA, 20 bp, Artificial
  CRISPR gRNA sequence
tgcatagcaagaagtaagca

SEQ ID NO: 30339 - DNA, 20 bp, Artificial
  CRISPR gRNA sequence
gcatagcaagaagtaagcac

SEQ ID NO: 30340 - DNA, 20 bp, Artificial
  CRISPR gRNA sequence
catagcaagaagtaagcacc

SEQ ID NO: 30341 - DNA, 20 bp, Artificial
  CRISPR gRNA sequence
cataaataaaatattgtaaa

SEQ ID NO: 30342 - DNA, 20 bp, Artificial
  CRISPR gRNA sequence
taaaacagtgatcatgctgg

SEQ ID NO: 30343 - DNA, 20 bp, Artificial
  CRISPR gRNA sequence
ggaagaaattaacaaggctc

SEQ ID NO: 30344 - DNA, 20 bp, Artificial
  CRISPR gRNA sequence
acaaggctcaggagggtata

SEQ ID NO: 30345 - DNA, 20 bp, Artificial
  CRISPR gRNA sequence
aggagggtataggacccagc

SEQ ID NO: 30346 - DNA, 20 bp, Artificial
  CRISPR gRNA sequence
cttggaaggctgaggtggga

SEQ ID NO: 30347 - DNA, 20 bp, Artificial
  CRISPR gRNA sequence
ggaaggctgaggtgggaggt

SEQ ID NO: 30348 - DNA, 20 bp, Artificial
  CRISPR gRNA sequence
gaaggctgaggtgggaggtt

SEQ ID NO: 30349 - DNA, 20 bp, Artificial
  CRISPR gRNA sequence
aggtgggaggttcgcttcag

SEQ ID NO: 30350 - DNA, 20 bp, Artificial
  CRISPR gRNA sequence
gcttcagtccaggtagtcga

SEQ ID NO: 30351 - DNA, 20 bp, Artificial
  CRISPR gRNA sequence
cagtccaggtagtcgaggct

SEQ ID NO: 30352 - DNA, 20 bp, Artificial
  CRISPR gRNA sequence
agtccaggtagtcgaggctg

SEQ ID NO: 30353 - DNA, 20 bp, Artificial
  CRISPR gRNA sequence
tagtgagccatcattgcacc

SEQ ID NO: 30354 - DNA, 20 bp, Artificial
  CRISPR gRNA sequence
cacccctgcactacaacctg

SEQ ID NO: 30355 - DNA, 20 bp, Artificial
  CRISPR gRNA sequence
cactacaacctgggtgagac

SEQ ID NO: 30356 - DNA, 20 bp, Artificial
  CRISPR gRNA sequence
caacctgggtgagaccccat

SEQ ID NO: 30357 - DNA, 20 bp, Artificial
  CRISPR gRNA sequence
ggtgagaccccatctccaaa

SEQ ID NO: 30358 - DNA, 20 bp, Artificial
  CRISPR gRNA sequence
caaataaataaataaataaa

SEQ ID NO: 30359 - DNA, 20 bp, Artificial
  CRISPR gRNA sequence
gccgggcatggtggctcacg

SEQ ID NO: 30360 - DNA, 20 bp, Artificial
  CRISPR gRNA sequence
acgcctgtaatcctagtact

SEQ ID NO: 30361 - DNA, 20 bp, Artificial
  CRISPR gRNA sequence
taatcctagtactcactttg

SEQ ID NO: 30362 - DNA, 20 bp, Artificial
  CRISPR gRNA sequence
gtactcactttgggaggccg

SEQ ID NO: 30363 - DNA, 20 bp, Artificial
  CRISPR gRNA sequence
actttgggaggccgaggcag

SEQ ID NO: 30364 - DNA, 20 bp, Artificial
  CRISPR gRNA sequence
tgggaggccgaggcaggtgg

SEQ ID NO: 30365 - DNA, 20 bp, Artificial
  CRISPR gRNA sequence
gggaggccgaggcaggtgga

SEQ ID NO: 30366 - DNA, 20 bp, Artificial
  CRISPR gRNA sequence
ggaggccgaggcaggtggat

SEQ ID NO: 30367 - DNA, 20 bp, Artificial
  CRISPR gRNA sequence
agatcaggagtttgagacca

SEQ ID NO: 30368 - DNA, 20 bp, Artificial
  CRISPR gRNA sequence
gagaccagcctggccaacat

SEQ ID NO: 30369 - DNA, 20 bp, Artificial
  CRISPR gRNA sequence
agaccagcctggccaacatg

SEQ ID NO: 30370 - DNA, 20 bp, Artificial
  CRISPR gRNA sequence
gccaacatggcgaaaccctg

SEQ ID NO: 30371 - DNA, 20 bp, Artificial
  CRISPR gRNA sequence
tctctactaaaaatataaaa

SEQ ID NO: 30372 - DNA, 20 bp, Artificial
  CRISPR gRNA sequence
tactaaaaatataaaaacta

SEQ ID NO: 30373 - DNA, 20 bp, Artificial
  CRISPR gRNA sequence
ctaaaaatataaaaactagc

SEQ ID NO: 30374 - DNA, 20 bp, Artificial
  CRISPR gRNA sequence
aaaatataaaaactagctgg

SEQ ID NO: 30375 - DNA, 20 bp, Artificial
  CRISPR gRNA sequence
gctggacgtggtggtgggcg

SEQ ID NO: 30376 - DNA, 20 bp, Artificial
  CRISPR gRNA sequence
gacgtggtggtgggcgccta

SEQ ID NO: 30377 - DNA, 20 bp, Artificial
  CRISPR gRNA sequence
taatcccagctactcggagc

SEQ ID NO: 30378 - DNA, 20 bp, Artificial
  CRISPR gRNA sequence
ctcggagcactgaggcaggc

SEQ ID NO: 30379 - DNA, 20 bp, Artificial
  CRISPR gRNA sequence
ggagcactgaggcaggcgaa

SEQ ID NO: 30380 - DNA, 20 bp, Artificial
  CRISPR gRNA sequence
aggcaggcgaatagcttgaa

SEQ ID NO: 30381 - DNA, 20 bp, Artificial
  CRISPR gRNA sequence
gaacctgggggggggcagaa

SEQ ID NO: 30382 - DNA, 20 bp, Artificial
  CRISPR gRNA sequence
aacctgggggggggcagaag

SEQ ID NO: 30383 - DNA, 20 bp, Artificial
  CRISPR gRNA sequence
ggggggggcagaagttgcag

SEQ ID NO: 30384 - DNA, 20 bp, Artificial
  CRISPR gRNA sequence
cagtgagctgagatcacacc

SEQ ID NO: 30385 - DNA, 20 bp, Artificial
  CRISPR gRNA sequence
agatcacaccacttcactcc

SEQ ID NO: 30386 - DNA, 20 bp, Artificial
  CRISPR gRNA sequence
cactccagcctgggtgacag

SEQ ID NO: 30387 - DNA, 20 bp, Artificial
  CRISPR gRNA sequence
actccagcctgggtgacaga

SEQ ID NO: 30388 - DNA, 20 bp, Artificial
  CRISPR gRNA sequence
cagcctgggtgacagagcga

SEQ ID NO: 30389 - DNA, 20 bp, Artificial
  CRISPR gRNA sequence
ggtgacagagcgagactcca

SEQ ID NO: 30390 - DNA, 20 bp, Artificial
  CRISPR gRNA sequence
catctcaaaaacagaaatta

SEQ ID NO: 30391 - DNA, 20 bp, Artificial
  CRISPR gRNA sequence
aaaaacagaaattaaaaaaa

SEQ ID NO: 30392 - DNA, 20 bp, Artificial
  CRISPR gRNA sequence
aaaaaattaaaaataaataa

SEQ ID NO: 30393 - DNA, 20 bp, Artificial
  CRISPR gRNA sequence
aaaataaataaataataagg

SEQ ID NO: 30394 - DNA, 20 bp, Artificial
  CRISPR gRNA sequence
tcctgggaatctgactctgg

SEQ ID NO: 30395 - DNA, 20 bp, Artificial
  CRISPR gRNA sequence
cctgggaatctgactctggt

SEQ ID NO: 30396 - DNA, 20 bp, Artificial
  CRISPR gRNA sequence
ctgggaatctgactctggtt

SEQ ID NO: 30397 - DNA, 20 bp, Artificial
  CRISPR gRNA sequence
ggaatctgactctggttgtc

SEQ ID NO: 30398 - DNA, 20 bp, Artificial
  CRISPR gRNA sequence
actctggttgtcctcagtaa

SEQ ID NO: 30399 - DNA, 20 bp, Artificial
  CRISPR gRNA sequence
tggttgtcctcagtaagtga

SEQ ID NO: 30400 - DNA, 20 bp, Artificial
  CRISPR gRNA sequence
gttgtcctcagtaagtgaag

SEQ ID NO: 30401 - DNA, 20 bp, Artificial
  CRISPR gRNA sequence
tcctcagtaagtgaagagct

SEQ ID NO: 30402 - DNA, 20 bp, Artificial
  CRISPR gRNA sequence
agtaagtgaagagctctggc

SEQ ID NO: 30403 - DNA, 20 bp, Artificial
  CRISPR gRNA sequence
tggcgaagaggagagcagtt

SEQ ID NO: 30404 - DNA, 20 bp, Artificial
  CRISPR gRNA sequence
gcgaagaggagagcagtttc

SEQ ID NO: 30405 - DNA, 20 bp, Artificial
  CRISPR gRNA sequence
ctctcagtctggcgagtaag

SEQ ID NO: 30406 - DNA, 20 bp, Artificial
  CRISPR gRNA sequence
tctcagtctggcgagtaaga

SEQ ID NO: 30407 - DNA, 20 bp, Artificial
  CRISPR gRNA sequence
tcagtctggcgagtaagaag

SEQ ID NO: 30408 - DNA, 20 bp, Artificial
  CRISPR gRNA sequence
agtctggcgagtaagaagag

SEQ ID NO: 30409 - DNA, 20 bp, Artificial
  CRISPR gRNA sequence
gcgagtaagaagagctggta

SEQ ID NO: 30410 - DNA, 20 bp, Artificial
  CRISPR gRNA sequence
gtaatgctgagttggatgac

SEQ ID NO: 30411 - DNA, 20 bp, Artificial
  CRISPR gRNA sequence
agttggatgactggggctct

SEQ ID NO: 30412 - DNA, 20 bp, Artificial
  CRISPR gRNA sequence
gatgactggggctctggtcc

SEQ ID NO: 30413 - DNA, 20 bp, Artificial
  CRISPR gRNA sequence
gggctctggtccaagctcag

SEQ ID NO: 30414 - DNA, 20 bp, Artificial
  CRISPR gRNA sequence
tggtccaagctcagtccgct

SEQ ID NO: 30415 - DNA, 20 bp, Artificial
  CRISPR gRNA sequence
gtccaagctcagtccgctca

SEQ ID NO: 30416 - DNA, 20 bp, Artificial
  CRISPR gRNA sequence
agtccgctcattacctctgg

SEQ ID NO: 30417 - DNA, 20 bp, Artificial
  CRISPR gRNA sequence
attacctctgggaccacacc

SEQ ID NO: 30418 - DNA, 20 bp, Artificial
  CRISPR gRNA sequence
cctctgggaccacaccaggg

SEQ ID NO: 30419 - DNA, 20 bp, Artificial
  CRISPR gRNA sequence
tgggaccacaccagggcctg

SEQ ID NO: 30420 - DNA, 20 bp, Artificial
  CRISPR gRNA sequence
ggaccacaccagggcctgga

SEQ ID NO: 30421 - DNA, 20 bp, Artificial
  CRISPR gRNA sequence
gatggaagtcactcaaaagc

SEQ ID NO: 30422 - DNA, 20 bp, Artificial
  CRISPR gRNA sequence
aaaagcaagaggtgctatgc

SEQ ID NO: 30423 - DNA, 20 bp, Artificial
  CRISPR gRNA sequence
tgccaaggcctaccagaagg

SEQ ID NO: 30424 - DNA, 20 bp, Artificial
  CRISPR gRNA sequence
ccagaaggtggcagtgaaac

SEQ ID NO: 30425 - DNA, 20 bp, Artificial
  CRISPR gRNA sequence
accggcatgtaagtgacaag

SEQ ID NO: 30426 - DNA, 20 bp, Artificial
  CRISPR gRNA sequence
acgtacgtggttagccttcc

SEQ ID NO: 30427 - DNA, 20 bp, Artificial
  CRISPR gRNA sequence
gccttccagaagccaccacc

SEQ ID NO: 30428 - DNA, 20 bp, Artificial
  CRISPR gRNA sequence
ccagaagccaccacccctag

SEQ ID NO: 30429 - DNA, 20 bp, Artificial
  CRISPR gRNA sequence
cagaagccaccacccctagg

SEQ ID NO: 30430 - DNA, 20 bp, Artificial
  CRISPR gRNA sequence
ggttccggaaaaagcctggt

SEQ ID NO: 30431 - DNA, 20 bp, Artificial
  CRISPR gRNA sequence
cggaaaaagcctggtcccgc

SEQ ID NO: 30432 - DNA, 20 bp, Artificial
  CRISPR gRNA sequence
gtcccgccatccctggggga

SEQ ID NO: 30433 - DNA, 20 bp, Artificial
  CRISPR gRNA sequence
ggggaaaaggagcaatattt

SEQ ID NO: 30434 - DNA, 20 bp, Artificial
  CRISPR gRNA sequence
attgcataacagaacctggc

SEQ ID NO: 30435 - DNA, 20 bp, Artificial
  CRISPR gRNA sequence
ttgcataacagaacctggca

SEQ ID NO: 30436 - DNA, 20 bp, Artificial
  CRISPR gRNA sequence
cataacagaacctggcattg

SEQ ID NO: 30437 - DNA, 20 bp, Artificial
  CRISPR gRNA sequence
gcattgtgacaagtgcttac

SEQ ID NO: 30438 - DNA, 20 bp, Artificial
  CRISPR gRNA sequence
tgacaagtgcttacatagac

SEQ ID NO: 30439 - DNA, 20 bp, Artificial
  CRISPR gRNA sequence
acatagaccattaggatggt

SEQ ID NO: 30440 - DNA, 20 bp, Artificial
  CRISPR gRNA sequence
catagaccattaggatggtt

SEQ ID NO: 30441 - DNA, 20 bp, Artificial
  CRISPR gRNA sequence
ggatggttcccattttccag

SEQ ID NO: 30442 - DNA, 20 bp, Artificial
  CRISPR gRNA sequence
ccattttccaggtaagaaaa

SEQ ID NO: 30443 - DNA, 20 bp, Artificial
  CRISPR gRNA sequence
tccaggtaagaaaacagcgg

SEQ ID NO: 30444 - DNA, 20 bp, Artificial
  CRISPR gRNA sequence
ccaggtaagaaaacagcggc

SEQ ID NO: 30445 - DNA, 20 bp, Artificial
  CRISPR gRNA sequence
caggtaagaaaacagcggct

SEQ ID NO: 30446 - DNA, 20 bp, Artificial
  CRISPR gRNA sequence
ggaatgaataactgacttgc

SEQ ID NO: 30447 - DNA, 20 bp, Artificial
  CRISPR gRNA sequence
acttgctcagagtttctttc

SEQ ID NO: 30448 - DNA, 20 bp, Artificial
  CRISPR gRNA sequence
gctcagagtttctttcacca

SEQ ID NO: 30449 - DNA, 20 bp, Artificial
  CRISPR gRNA sequence
ctcagagtttctttcaccac

SEQ ID NO: 30450 - DNA, 20 bp, Artificial
  CRISPR gRNA sequence
agagtttctttcaccacgtc

SEQ ID NO: 30451 - DNA, 20 bp, Artificial
  CRISPR gRNA sequence
ctttcaccacgtcccgctaa

SEQ ID NO: 30452 - DNA, 20 bp, Artificial
  CRISPR gRNA sequence
tttcaccacgtcccgctaat

SEQ ID NO: 30453 - DNA, 20 bp, Artificial
  CRISPR gRNA sequence
tcaccacgtcccgctaatcc

SEQ ID NO: 30454 - DNA, 20 bp, Artificial
  CRISPR gRNA sequence
caccacgtcccgctaatcct

SEQ ID NO: 30455 - DNA, 20 bp, Artificial
  CRISPR gRNA sequence
accacgtcccgctaatcctt

SEQ ID NO: 30456 - DNA, 20 bp, Artificial
  CRISPR gRNA sequence
atccttttgttcagggctgt

SEQ ID NO: 30457 - DNA, 20 bp, Artificial
  CRISPR gRNA sequence
ttgttcagggctgtggtgat

SEQ ID NO: 30458 - DNA, 20 bp, Artificial
  CRISPR gRNA sequence
tgttcagggctgtggtgatt

SEQ ID NO: 30459 - DNA, 20 bp, Artificial
  CRISPR gRNA sequence
gttcagggctgtggtgattg

SEQ ID NO: 30460 - DNA, 20 bp, Artificial
  CRISPR gRNA sequence
ttcagggctgtggtgattgc

SEQ ID NO: 30461 - DNA, 20 bp, Artificial
  CRISPR gRNA sequence
agggctgtggtgattgcttc

SEQ ID NO: 30462 - DNA, 20 bp, Artificial
  CRISPR gRNA sequence
tggtgattgcttctagggtc

SEQ ID NO: 30463 - DNA, 20 bp, Artificial
  CRISPR gRNA sequence
cttctagggtctcagtgtcc

SEQ ID NO: 30464 - DNA, 20 bp, Artificial
  CRISPR gRNA sequence
ctagggtctcagtgtcccct

SEQ ID NO: 30465 - DNA, 20 bp, Artificial
  CRISPR gRNA sequence
tagggtctcagtgtcccctg

SEQ ID NO: 30466 - DNA, 20 bp, Artificial
  CRISPR gRNA sequence
gggtctcagtgtcccctgca

SEQ ID NO: 30467 - DNA, 20 bp, Artificial
  CRISPR gRNA sequence
agtgtcccctgcagccagca

SEQ ID NO: 30468 - DNA, 20 bp, Artificial
  CRISPR gRNA sequence
cagccagcacgatgtgggtt

SEQ ID NO: 30469 - DNA, 20 bp, Artificial
  CRISPR gRNA sequence
cctgcgctctgcagcccccc

SEQ ID NO: 30470 - DNA, 20 bp, Artificial
  CRISPR gRNA sequence
cgctctgcagccccccagct

SEQ ID NO: 30471 - DNA, 20 bp, Artificial
  CRISPR gRNA sequence
tgcagccccccagctcagca

SEQ ID NO: 30472 - DNA, 20 bp, Artificial
  CRISPR gRNA sequence
cagccccccagctcagcacc

SEQ ID NO: 30473 - DNA, 20 bp, Artificial
  CRISPR gRNA sequence
agcacctgaccggtatccgg

SEQ ID NO: 30474 - DNA, 20 bp, Artificial
  CRISPR gRNA sequence
accggtatccggggccccac

SEQ ID NO: 30475 - DNA, 20 bp, Artificial
  CRISPR gRNA sequence
accttagcctgagcagggat

SEQ ID NO: 30476 - DNA, 20 bp, Artificial
  CRISPR gRNA sequence
agcctgagcagggatgcagc

SEQ ID NO: 30477 - DNA, 20 bp, Artificial
  CRISPR gRNA sequence
gcctgagcagggatgcagcg

SEQ ID NO: 30478 - DNA, 20 bp, Artificial
  CRISPR gRNA sequence
agcagggatgcagcgagcga

SEQ ID NO: 30479 - DNA, 20 bp, Artificial
  CRISPR gRNA sequence
ggcgagtttgtaggcaccca

SEQ ID NO: 30480 - DNA, 20 bp, Artificial
  CRISPR gRNA sequence
gtaggcacccaggtcagtga

SEQ ID NO: 30481 - DNA, 20 bp, Artificial
  CRISPR gRNA sequence
taggcacccaggtcagtgat

SEQ ID NO: 30482 - DNA, 20 bp, Artificial
  CRISPR gRNA sequence
ttctgggacagactgcgggg

SEQ ID NO: 30483 - DNA, 20 bp, Artificial
  CRISPR gRNA sequence
tgggacagactgcggggaca

SEQ ID NO: 30484 - DNA, 20 bp, Artificial
  CRISPR gRNA sequence
ggacagactgcggggacaca

SEQ ID NO: 30485 - DNA, 20 bp, Artificial
  CRISPR gRNA sequence
cggggacacagtgaggggga

SEQ ID NO: 30486 - DNA, 20 bp, Artificial
  CRISPR gRNA sequence
aggaccaaacttgcatgcct

SEQ ID NO: 30487 - DNA, 20 bp, Artificial
  CRISPR gRNA sequence
gcatgcctcactttgacctc

SEQ ID NO: 30488 - DNA, 20 bp, Artificial
  CRISPR gRNA sequence
catgcctcactttgacctca

SEQ ID NO: 30489 - DNA, 20 bp, Artificial
  CRISPR gRNA sequence
actttgacctcaaggagagt

SEQ ID NO: 30490 - DNA, 20 bp, Artificial
  CRISPR gRNA sequence
tgacctcaaggagagttctg

SEQ ID NO: 30491 - DNA, 20 bp, Artificial
  CRISPR gRNA sequence
gacctcaaggagagttctgg

SEQ ID NO: 30492 - DNA, 20 bp, Artificial
  CRISPR gRNA sequence
acctcaaggagagttctggg

SEQ ID NO: 30493 - DNA, 20 bp, Artificial
  CRISPR gRNA sequence
aaggagagttctgggtcata

SEQ ID NO: 30494 - DNA, 20 bp, Artificial
  CRISPR gRNA sequence
tgggtcataggctgtgaatg

SEQ ID NO: 30495 - DNA, 20 bp, Artificial
  CRISPR gRNA sequence
ggtcataggctgtgaatggc

SEQ ID NO: 30496 - DNA, 20 bp, Artificial
  CRISPR gRNA sequence
tgaatggcgctgtcgacaga

SEQ ID NO: 30497 - DNA, 20 bp, Artificial
  CRISPR gRNA sequence
tcgacagacttaagctacct

SEQ ID NO: 30498 - DNA, 20 bp, Artificial
  CRISPR gRNA sequence
aagctacctctcggtaaata

SEQ ID NO: 30499 - DNA, 20 bp, Artificial
  CRISPR gRNA sequence
agctacctctcggtaaatag

SEQ ID NO: 30500 - DNA, 20 bp, Artificial
  CRISPR gRNA sequence
cctctcggtaaataggagga

SEQ ID NO: 30501 - DNA, 20 bp, Artificial
  CRISPR gRNA sequence
tcggtaaataggaggatact

SEQ ID NO: 30502 - DNA, 20 bp, Artificial
  CRISPR gRNA sequence
ggtaaataggaggatactgt

SEQ ID NO: 30503 - DNA, 20 bp, Artificial
  CRISPR gRNA sequence
ttaggtcctgtggccaagtg

SEQ ID NO: 30504 - DNA, 20 bp, Artificial
  CRISPR gRNA sequence
ggtcctgtggccaagtggga

SEQ ID NO: 30505 - DNA, 20 bp, Artificial
  CRISPR gRNA sequence
tggccaagtgggagggcagg

SEQ ID NO: 30506 - DNA, 20 bp, Artificial
  CRISPR gRNA sequence
ctgcccccacctgtcccatg

SEQ ID NO: 30507 - DNA, 20 bp, Artificial
  CRISPR gRNA sequence
cccccacctgtcccatgact

SEQ ID NO: 30508 - DNA, 20 bp, Artificial
  CRISPR gRNA sequence
tcccatgactttacaacatc

SEQ ID NO: 30509 - DNA, 20 bp, Artificial
  CRISPR gRNA sequence
tacaacatcccctcttttcc

SEQ ID NO: 30510 - DNA, 20 bp, Artificial
  CRISPR gRNA sequence
acaacatcccctcttttccc

SEQ ID NO: 30511 - DNA, 20 bp, Artificial
  CRISPR gRNA sequence
caacatcccctcttttccct

SEQ ID NO: 30512 - DNA, 20 bp, Artificial
  CRISPR gRNA sequence
ttttccctctgcgccacttt

SEQ ID NO: 30513 - DNA, 20 bp, Artificial
  CRISPR gRNA sequence
ttccctctgcgccacttttc

SEQ ID NO: 30514 - DNA, 20 bp, Artificial
  CRISPR gRNA sequence
tccctctgcgccacttttca

SEQ ID NO: 30515 - DNA, 20 bp, Artificial
  CRISPR gRNA sequence
ccctctgcgccacttttcag

SEQ ID NO: 30516 - DNA, 20 bp, Artificial
  CRISPR gRNA sequence
cctctgcgccacttttcagc

SEQ ID NO: 30517 - DNA, 20 bp, Artificial
  CRISPR gRNA sequence
tgcgccacttttcagcacta

SEQ ID NO: 30518 - DNA, 20 bp, Artificial
  CRISPR gRNA sequence
cgccacttttcagcactata

SEQ ID NO: 30519 - DNA, 20 bp, Artificial
  CRISPR gRNA sequence
ttcagcactataatgaaata

SEQ ID NO: 30520 - DNA, 20 bp, Artificial
  CRISPR gRNA sequence
tcagcactataatgaaataa

SEQ ID NO: 30521 - DNA, 20 bp, Artificial
  CRISPR gRNA sequence
cagcactataatgaaataag

SEQ ID NO: 30522 - DNA, 20 bp, Artificial
  CRISPR gRNA sequence
agcactataatgaaataagt

SEQ ID NO: 30523 - DNA, 20 bp, Artificial
  CRISPR gRNA sequence
taatgaaataagtgttggca

SEQ ID NO: 30524 - DNA, 20 bp, Artificial
  CRISPR gRNA sequence
gcattatttgtttaatggct

SEQ ID NO: 30525 - DNA, 20 bp, Artificial
  CRISPR gRNA sequence
tttgtttaatggctgtgtaa

SEQ ID NO: 30526 - DNA, 20 bp, Artificial
  CRISPR gRNA sequence
gtttaatggctgtgtaatcc

SEQ ID NO: 30527 - DNA, 20 bp, Artificial
  CRISPR gRNA sequence
tttaatggctgtgtaatcct

SEQ ID NO: 30528 - DNA, 20 bp, Artificial
  CRISPR gRNA sequence
aatggctgtgtaatcctttc

SEQ ID NO: 30529 - DNA, 20 bp, Artificial
  CRISPR gRNA sequence
atggctgtgtaatcctttct

SEQ ID NO: 30530 - DNA, 20 bp, Artificial
  CRISPR gRNA sequence
tgtaatcctttctgccgggt

SEQ ID NO: 30531 - DNA, 20 bp, Artificial
  CRISPR gRNA sequence
tctgccgggttgtgggcttc

SEQ ID NO: 30532 - DNA, 20 bp, Artificial
  CRISPR gRNA sequence
ctgccgggttgtgggcttca

SEQ ID NO: 30533 - DNA, 20 bp, Artificial
  CRISPR gRNA sequence
tgccgggttgtgggcttcac

SEQ ID NO: 30534 - DNA, 20 bp, Artificial
  CRISPR gRNA sequence
ccgggttgtgggcttcacat

SEQ ID NO: 30535 - DNA, 20 bp, Artificial
  CRISPR gRNA sequence
tgggcttcacatggagcagg

SEQ ID NO: 30536 - DNA, 20 bp, Artificial
  CRISPR gRNA sequence
cacatggagcagggctgtgt

SEQ ID NO: 30537 - DNA, 20 bp, Artificial
  CRISPR gRNA sequence
acatggagcagggctgtgtc

SEQ ID NO: 30538 - DNA, 20 bp, Artificial
  CRISPR gRNA sequence
tgtctgttttgctcattact

SEQ ID NO: 30539 - DNA, 20 bp, Artificial
  CRISPR gRNA sequence
ttttgctcattactgtatcc

SEQ ID NO: 30540 - DNA, 20 bp, Artificial
  CRISPR gRNA sequence
tgctcattactgtatccctg

SEQ ID NO: 30541 - DNA, 20 bp, Artificial
  CRISPR gRNA sequence
gctcattactgtatccctgt

SEQ ID NO: 30542 - DNA, 20 bp, Artificial
  CRISPR gRNA sequence
ctcattactgtatccctgtg

SEQ ID NO: 30543 - DNA, 20 bp, Artificial
  CRISPR gRNA sequence
attactgtatccctgtgcct

SEQ ID NO: 30544 - DNA, 20 bp, Artificial
  CRISPR gRNA sequence
ctgtatccctgtgcctagag

SEQ ID NO: 30545 - DNA, 20 bp, Artificial
  CRISPR gRNA sequence
tatccctgtgcctagagcac

SEQ ID NO: 30546 - DNA, 20 bp, Artificial
  CRISPR gRNA sequence
tgcctagagcactgccaggc

SEQ ID NO: 30547 - DNA, 20 bp, Artificial
  CRISPR gRNA sequence
gagcactgccaggcacatag

SEQ ID NO: 30548 - DNA, 20 bp, Artificial
  CRISPR gRNA sequence
ccaggcacatagtaggtgct

SEQ ID NO: 30549 - DNA, 20 bp, Artificial
  CRISPR gRNA sequence
aataaatacttaagtggggt

SEQ ID NO: 30550 - DNA, 20 bp, Artificial
  CRISPR gRNA sequence
aagtggggtggcgggtaaga

SEQ ID NO: 30551 - DNA, 20 bp, Artificial
  CRISPR gRNA sequence
agtggggtggcgggtaagaa

SEQ ID NO: 30552 - DNA, 20 bp, Artificial
  CRISPR gRNA sequence
aggagaagaaatctagctta

SEQ ID NO: 30553 - DNA, 20 bp, Artificial
  CRISPR gRNA sequence
gcttacagtgttacctagga

SEQ ID NO: 30554 - DNA, 20 bp, Artificial
  CRISPR gRNA sequence
acagtgttacctaggacact

SEQ ID NO: 30555 - DNA, 20 bp, Artificial
  CRISPR gRNA sequence
cagtgttacctaggacacta

SEQ ID NO: 30556 - DNA, 20 bp, Artificial
  CRISPR gRNA sequence
cctaggacactagaaattac

SEQ ID NO: 30557 - DNA, 20 bp, Artificial
  CRISPR gRNA sequence
ggacactagaaattactgga

SEQ ID NO: 30558 - DNA, 20 bp, Artificial
  CRISPR gRNA sequence
gaaattactggagaagtccc

SEQ ID NO: 30559 - DNA, 20 bp, Artificial
  CRISPR gRNA sequence
ctggagaagtcccacagtcc

SEQ ID NO: 30560 - DNA, 20 bp, Artificial
  CRISPR gRNA sequence
gagaagtcccacagtcctac

SEQ ID NO: 30561 - DNA, 20 bp, Artificial
  CRISPR gRNA sequence
caattaaggaaattgctaag

SEQ ID NO: 30562 - DNA, 20 bp, Artificial
  CRISPR gRNA sequence
aggaaattgctaagtaaatt

SEQ ID NO: 30563 - DNA, 20 bp, Artificial
  CRISPR gRNA sequence
ctaagtaaattccggtaaat

SEQ ID NO: 30564 - DNA, 20 bp, Artificial
  CRISPR gRNA sequence
agtaaattccggtaaattat

SEQ ID NO: 30565 - DNA, 20 bp, Artificial
  CRISPR gRNA sequence
cggtaaattatttggccatc

SEQ ID NO: 30566 - DNA, 20 bp, Artificial
  CRISPR gRNA sequence
tttggccatcctaagacctt

SEQ ID NO: 30567 - DNA, 20 bp, Artificial
  CRISPR gRNA sequence
ggccatcctaagaccttggt

SEQ ID NO: 30568 - DNA, 20 bp, Artificial
  CRISPR gRNA sequence
gccatcctaagaccttggtt

SEQ ID NO: 30569 - DNA, 20 bp, Artificial
  CRISPR gRNA sequence
agaccttggttgtgaggggg

SEQ ID NO: 30570 - DNA, 20 bp, Artificial
  CRISPR gRNA sequence
ggttgtgagggggagtgtgg

SEQ ID NO: 30571 - DNA, 20 bp, Artificial
  CRISPR gRNA sequence
gttgtgagggggagtgtggg

SEQ ID NO: 30572 - DNA, 20 bp, Artificial
  CRISPR gRNA sequence
tgagggggagtgtgggaaga

SEQ ID NO: 30573 - DNA, 20 bp, Artificial
  CRISPR gRNA sequence
tgatatcctctaggttcagt

SEQ ID NO: 30574 - DNA, 20 bp, Artificial
  CRISPR gRNA sequence
gatatcctctaggttcagta

SEQ ID NO: 30575 - DNA, 20 bp, Artificial
  CRISPR gRNA sequence
atatcctctaggttcagtaa

SEQ ID NO: 30576 - DNA, 20 bp, Artificial
  CRISPR gRNA sequence
taggttcagtaaaaaatcat

SEQ ID NO: 30577 - DNA, 20 bp, Artificial
  CRISPR gRNA sequence
ggttcagtaaaaaatcatgt

SEQ ID NO: 30578 - DNA, 20 bp, Artificial
  CRISPR gRNA sequence
agtaaaaaatcatgttgaac

SEQ ID NO: 30579 - DNA, 20 bp, Artificial
  CRISPR gRNA sequence
aactgggcgtggtggctcat

SEQ ID NO: 30580 - DNA, 20 bp, Artificial
  CRISPR gRNA sequence
ggcgtggtggctcatgccgg

SEQ ID NO: 30581 - DNA, 20 bp, Artificial
  CRISPR gRNA sequence
atgccggtaatcccagcact

SEQ ID NO: 30582 - DNA, 20 bp, Artificial
  CRISPR gRNA sequence
tgggaggctgaggtgggcgg

SEQ ID NO: 30583 - DNA, 20 bp, Artificial
  CRISPR gRNA sequence
gggaggctgaggtgggcgga

SEQ ID NO: 30584 - DNA, 20 bp, Artificial
  CRISPR gRNA sequence
ggaggctgaggtgggcggat

SEQ ID NO: 30585 - DNA, 20 bp, Artificial
  CRISPR gRNA sequence
aggtgggcggatcacttgag

SEQ ID NO: 30586 - DNA, 20 bp, Artificial
  CRISPR gRNA sequence
gaggtcaggagttcaagacc

SEQ ID NO: 30587 - DNA, 20 bp, Artificial
  CRISPR gRNA sequence
aggtcaggagttcaagacca

SEQ ID NO: 30588 - DNA, 20 bp, Artificial
  CRISPR gRNA sequence
aagaccagcctggccaacct

SEQ ID NO: 30589 - DNA, 20 bp, Artificial
  CRISPR gRNA sequence
gccaacctggtgaaaccccg

SEQ ID NO: 30590 - DNA, 20 bp, Artificial
  CRISPR gRNA sequence
gtgaaaccccgtctctacta

SEQ ID NO: 30591 - DNA, 20 bp, Artificial
  CRISPR gRNA sequence
tactaaaaatacaaaaatta

SEQ ID NO: 30592 - DNA, 20 bp, Artificial
  CRISPR gRNA sequence
ctaaaaatacaaaaattagt

SEQ ID NO: 30593 - DNA, 20 bp, Artificial
  CRISPR gRNA sequence
aaaatacaaaaattagttgg

SEQ ID NO: 30594 - DNA, 20 bp, Artificial
  CRISPR gRNA sequence
gttgggtgtagtggtgcatg

SEQ ID NO: 30595 - DNA, 20 bp, Artificial
  CRISPR gRNA sequence
ggtgtagtggtgcatgcctg

SEQ ID NO: 30596 - DNA, 20 bp, Artificial
  CRISPR gRNA sequence
taattccagctacttgggag

SEQ ID NO: 30597 - DNA, 20 bp, Artificial
  CRISPR gRNA sequence
cagctacttgggaggctgag

SEQ ID NO: 30598 - DNA, 20 bp, Artificial
  CRISPR gRNA sequence
cttgggaggctgaggtgtga

SEQ ID NO: 30599 - DNA, 20 bp, Artificial
  CRISPR gRNA sequence
gggaggctgaggtgtgagaa

SEQ ID NO: 30600 - DNA, 20 bp, Artificial
  CRISPR gRNA sequence
ggaggctgaggtgtgagaat

SEQ ID NO: 30601 - DNA, 20 bp, Artificial
  CRISPR gRNA sequence
aggtgtgagaattgcttgaa

SEQ ID NO: 30602 - DNA, 20 bp, Artificial
  CRISPR gRNA sequence
cttgaacccaggaggtgaag

SEQ ID NO: 30603 - DNA, 20 bp, Artificial
  CRISPR gRNA sequence
gaacccaggaggtgaagttt

SEQ ID NO: 30604 - DNA, 20 bp, Artificial
  CRISPR gRNA sequence
aacccaggaggtgaagtttg

SEQ ID NO: 30605 - DNA, 20 bp, Artificial
  CRISPR gRNA sequence
gcaataaatagatcgtacca

SEQ ID NO: 30606 - DNA, 20 bp, Artificial
  CRISPR gRNA sequence
caataaatagatcgtaccac

SEQ ID NO: 30607 - DNA, 20 bp, Artificial
  CRISPR gRNA sequence
cactccagcctgggctacag

SEQ ID NO: 30608 - DNA, 20 bp, Artificial
  CRISPR gRNA sequence
cagcctgggctacagagcga

SEQ ID NO: 30609 - DNA, 20 bp, Artificial
  CRISPR gRNA sequence
ggctacagagcgagactccg

SEQ ID NO: 30610 - DNA, 20 bp, Artificial
  CRISPR gRNA sequence
cagagcgagactccgtgtca

SEQ ID NO: 30611 - DNA, 20 bp, Artificial
  CRISPR gRNA sequence
cgtgtcaaaaaaaaaaaaaa

SEQ ID NO: 30612 - DNA, 20 bp, Artificial
  CRISPR gRNA sequence
aaccaggcacagtgactcat

SEQ ID NO: 30613 - DNA, 20 bp, Artificial
  CRISPR gRNA sequence
atgcctgtaatcccagtact

SEQ ID NO: 30614 - DNA, 20 bp, Artificial
  CRISPR gRNA sequence
taatcccagtactttgggag

SEQ ID NO: 30615 - DNA, 20 bp, Artificial
  CRISPR gRNA sequence
tgggaggcagaggcaggagg

SEQ ID NO: 30616 - DNA, 20 bp, Artificial
  CRISPR gRNA sequence
gggaggcagaggcaggagga

SEQ ID NO: 30617 - DNA, 20 bp, Artificial
  CRISPR gRNA sequence
ggaggcagaggcaggaggat

SEQ ID NO: 30618 - DNA, 20 bp, Artificial
  CRISPR gRNA sequence
gagctcagaagttcaagacc

SEQ ID NO: 30619 - DNA, 20 bp, Artificial
  CRISPR gRNA sequence
agctcagaagttcaagacca

SEQ ID NO: 30620 - DNA, 20 bp, Artificial
  CRISPR gRNA sequence
agaagttcaagaccagcctg

SEQ ID NO: 30621 - DNA, 20 bp, Artificial
  CRISPR gRNA sequence
aagaccagcctgggcaacgt

SEQ ID NO: 30622 - DNA, 20 bp, Artificial
  CRISPR gRNA sequence
ggcaacgtggtgaaaccacg

SEQ ID NO: 30623 - DNA, 20 bp, Artificial
  CRISPR gRNA sequence
tacaaaaaaatacaaaaatt

SEQ ID NO: 30624 - DNA, 20 bp, Artificial
  CRISPR gRNA sequence
caaaaaaatacaaaaattag

SEQ ID NO: 30625 - DNA, 20 bp, Artificial
  CRISPR gRNA sequence
gcgggacgtggtggcatgca

SEQ ID NO: 30626 - DNA, 20 bp, Artificial
  CRISPR gRNA sequence
tcccagctactcagaaggtt

SEQ ID NO: 30627 - DNA, 20 bp, Artificial
  CRISPR gRNA sequence
ctcagaaggttgagatggga

SEQ ID NO: 30628 - DNA, 20 bp, Artificial
  CRISPR gRNA sequence
agaaggttgagatgggagga

SEQ ID NO: 30629 - DNA, 20 bp, Artificial
  CRISPR gRNA sequence
agatgggaggattgcttgag

SEQ ID NO: 30630 - DNA, 20 bp, Artificial
  CRISPR gRNA sequence
cttgagcctaggagattgag

SEQ ID NO: 30631 - DNA, 20 bp, Artificial
  CRISPR gRNA sequence
gagcctaggagattgaggct

SEQ ID NO: 30632 - DNA, 20 bp, Artificial
  CRISPR gRNA sequence
agcctaggagattgaggctg

SEQ ID NO: 30633 - DNA, 20 bp, Artificial
  CRISPR gRNA sequence
ggagattgaggctgcagtga

SEQ ID NO: 30634 - DNA, 20 bp, Artificial
  CRISPR gRNA sequence
aggctgcagtgagccatgat

SEQ ID NO: 30635 - DNA, 20 bp, Artificial
  CRISPR gRNA sequence
cagtgagccatgattacacc

SEQ ID NO: 30636 - DNA, 20 bp, Artificial
  CRISPR gRNA sequence
caccactgcactccaccctg

SEQ ID NO: 30637 - DNA, 20 bp, Artificial
  CRISPR gRNA sequence
cactccaccctgggtgacag

SEQ ID NO: 30638 - DNA, 20 bp, Artificial
  CRISPR gRNA sequence
caccctgggtgacagagcga

SEQ ID NO: 30639 - DNA, 20 bp, Artificial
  CRISPR gRNA sequence
ggtgacagagcgagaccttg

SEQ ID NO: 30640 - DNA, 20 bp, Artificial
  CRISPR gRNA sequence
gtctgaaaaaaagaaaaaaa

SEQ ID NO: 30641 - DNA, 20 bp, Artificial
  CRISPR gRNA sequence
tctgaaaaaaagaaaaaaaa

SEQ ID NO: 30642 - DNA, 20 bp, Artificial
  CRISPR gRNA sequence
aaaaaaagaaaaaaaatcac

SEQ ID NO: 30643 - DNA, 20 bp, Artificial
  CRISPR gRNA sequence
atcctcctgtatcttatcca

SEQ ID NO: 30644 - DNA, 20 bp, Artificial
  CRISPR gRNA sequence
ctgtatcttatccatctcca

SEQ ID NO: 30645 - DNA, 20 bp, Artificial
  CRISPR gRNA sequence
tatcttatccatctccaact

SEQ ID NO: 30646 - DNA, 20 bp, Artificial
  CRISPR gRNA sequence
atccatctccaacttcccag

SEQ ID NO: 30647 - DNA, 20 bp, Artificial
  CRISPR gRNA sequence
tccatctccaacttcccaga

SEQ ID NO: 30648 - DNA, 20 bp, Artificial
  CRISPR gRNA sequence
caacttcccagagcccagaa

SEQ ID NO: 30649 - DNA, 20 bp, Artificial
  CRISPR gRNA sequence
cccagagcccagaacagttt

SEQ ID NO: 30650 - DNA, 20 bp, Artificial
  CRISPR gRNA sequence
ccagagcccagaacagtttt

SEQ ID NO: 30651 - DNA, 20 bp, Artificial
  CRISPR gRNA sequence
ttaaaaagttttactgtttt

SEQ ID NO: 30652 - DNA, 20 bp, Artificial
  CRISPR gRNA sequence
taaaaagttttactgttttg

SEQ ID NO: 30653 - DNA, 20 bp, Artificial
  CRISPR gRNA sequence
aaaaagttttactgttttga

SEQ ID NO: 30654 - DNA, 20 bp, Artificial
  CRISPR gRNA sequence
aaaagttttactgttttgat

SEQ ID NO: 30655 - DNA, 20 bp, Artificial
  CRISPR gRNA sequence
tactgttttgataataatgc

SEQ ID NO: 30656 - DNA, 20 bp, Artificial
  CRISPR gRNA sequence
actgttttgataataatgct

SEQ ID NO: 30657 - DNA, 20 bp, Artificial
  CRISPR gRNA sequence
ctgttttgataataatgctt

SEQ ID NO: 30658 - DNA, 20 bp, Artificial
  CRISPR gRNA sequence
ttttgataataatgctttat

SEQ ID NO: 30659 - DNA, 20 bp, Artificial
  CRISPR gRNA sequence
tgataataatgctttattga

SEQ ID NO: 30660 - DNA, 20 bp, Artificial
  CRISPR gRNA sequence
gataataatgctttattgat

SEQ ID NO: 30661 - DNA, 20 bp, Artificial
  CRISPR gRNA sequence
ataataatgctttattgata

SEQ ID NO: 30662 - DNA, 20 bp, Artificial
  CRISPR gRNA sequence
tattgataaatcctaatcta

SEQ ID NO: 30663 - DNA, 20 bp, Artificial
  CRISPR gRNA sequence
attgataaatcctaatctat

SEQ ID NO: 30664 - DNA, 20 bp, Artificial
  CRISPR gRNA sequence
ttgataaatcctaatctatc

SEQ ID NO: 30665 - DNA, 20 bp, Artificial
  CRISPR gRNA sequence
ataaatcctaatctatctct

SEQ ID NO: 30666 - DNA, 20 bp, Artificial
  CRISPR gRNA sequence
atctatctctcctatttcac

SEQ ID NO: 30667 - DNA, 20 bp, Artificial
  CRISPR gRNA sequence
tctctcctatttcacccccc

SEQ ID NO: 30668 - DNA, 20 bp, Artificial
  CRISPR gRNA sequence
tcctatttcaccccccagta

SEQ ID NO: 30669 - DNA, 20 bp, Artificial
  CRISPR gRNA sequence
ctatttcaccccccagtata

SEQ ID NO: 30670 - DNA, 20 bp, Artificial
  CRISPR gRNA sequence
tttcaccccccagtataatt

SEQ ID NO: 30671 - DNA, 20 bp, Artificial
  CRISPR gRNA sequence
caccccccagtataattttc

SEQ ID NO: 30672 - DNA, 20 bp, Artificial
  CRISPR gRNA sequence
accccccagtataattttct

SEQ ID NO: 30673 - DNA, 20 bp, Artificial
  CRISPR gRNA sequence
tctgtcaccaaacattattt

SEQ ID NO: 30674 - DNA, 20 bp, Artificial
  CRISPR gRNA sequence
ctgtcaccaaacattatttt

SEQ ID NO: 30675 - DNA, 20 bp, Artificial
  CRISPR gRNA sequence
tgtcaccaaacattattttc

SEQ ID NO: 30676 - DNA, 20 bp, Artificial
  CRISPR gRNA sequence
tcaccaaacattattttcat

SEQ ID NO: 30677 - DNA, 20 bp, Artificial
  CRISPR gRNA sequence
ttttcattactgtatacttt

SEQ ID NO: 30678 - DNA, 20 bp, Artificial
  CRISPR gRNA sequence
tcattactgtatactttata

SEQ ID NO: 30679 - DNA, 20 bp, Artificial
  CRISPR gRNA sequence
cattactgtatactttataa

SEQ ID NO: 30680 - DNA, 20 bp, Artificial
  CRISPR gRNA sequence
attactgtatactttataat

SEQ ID NO: 30681 - DNA, 20 bp, Artificial
  CRISPR gRNA sequence
ctgtatactttataattacc

SEQ ID NO: 30682 - DNA, 20 bp, Artificial
  CRISPR gRNA sequence
tatactttataattaccgac

SEQ ID NO: 30683 - DNA, 20 bp, Artificial
  CRISPR gRNA sequence
tataattaccgacttgttta

SEQ ID NO: 30684 - DNA, 20 bp, Artificial
  CRISPR gRNA sequence
ataattaccgacttgtttac

SEQ ID NO: 30685 - DNA, 20 bp, Artificial
  CRISPR gRNA sequence
taattaccgacttgtttact

SEQ ID NO: 30686 - DNA, 20 bp, Artificial
  CRISPR gRNA sequence
ccgacttgtttacttgttca

SEQ ID NO: 30687 - DNA, 20 bp, Artificial
  CRISPR gRNA sequence
gtttacttgttcattgtgtc

SEQ ID NO: 30688 - DNA, 20 bp, Artificial
  CRISPR gRNA sequence
tttacttgttcattgtgtct

SEQ ID NO: 30689 - DNA, 20 bp, Artificial
  CRISPR gRNA sequence
acttgttcattgtgtctcct

SEQ ID NO: 30690 - DNA, 20 bp, Artificial
  CRISPR gRNA sequence
cttgttcattgtgtctcctc

SEQ ID NO: 30691 - DNA, 20 bp, Artificial
  CRISPR gRNA sequence
gttcattgtgtctcctcact

SEQ ID NO: 30692 - DNA, 20 bp, Artificial
  CRISPR gRNA sequence
ttcattgtgtctcctcacta

SEQ ID NO: 30693 - DNA, 20 bp, Artificial
  CRISPR gRNA sequence
attgtgtctcctcactagaa

SEQ ID NO: 30694 - DNA, 20 bp, Artificial
  CRISPR gRNA sequence
tgtctcctcactagaattta

SEQ ID NO: 30695 - DNA, 20 bp, Artificial
  CRISPR gRNA sequence
ctcactagaatttaagattc

SEQ ID NO: 30696 - DNA, 20 bp, Artificial
  CRISPR gRNA sequence
actagaatttaagattcctg

SEQ ID NO: 30697 - DNA, 20 bp, Artificial
  CRISPR gRNA sequence
gaatttaagattcctgaggt

SEQ ID NO: 30698 - DNA, 20 bp, Artificial
  CRISPR gRNA sequence
aagattcctgaggtcagggg

SEQ ID NO: 30699 - DNA, 20 bp, Artificial
  CRISPR gRNA sequence
agattcctgaggtcagggga

SEQ ID NO: 30700 - DNA, 20 bp, Artificial
  CRISPR gRNA sequence
ctgaggtcaggggatttatt

SEQ ID NO: 30701 - DNA, 20 bp, Artificial
  CRISPR gRNA sequence
aggtcaggggatttatttgt

SEQ ID NO: 30702 - DNA, 20 bp, Artificial
  CRISPR gRNA sequence
atttgttttgtttaaagctg

SEQ ID NO: 30703 - DNA, 20 bp, Artificial
  CRISPR gRNA sequence
tttgttttgtttaaagctgg

SEQ ID NO: 30704 - DNA, 20 bp, Artificial
  CRISPR gRNA sequence
gttttgtttaaagctgggtc

SEQ ID NO: 30705 - DNA, 20 bp, Artificial
  CRISPR gRNA sequence
ttttgtttaaagctgggtct

SEQ ID NO: 30706 - DNA, 20 bp, Artificial
  CRISPR gRNA sequence
tgtttaaagctgggtctcca

SEQ ID NO: 30707 - DNA, 20 bp, Artificial
  CRISPR gRNA sequence
gtttaaagctgggtctccag

SEQ ID NO: 30708 - DNA, 20 bp, Artificial
  CRISPR gRNA sequence
tttaaagctgggtctccagg

SEQ ID NO: 30709 - DNA, 20 bp, Artificial
  CRISPR gRNA sequence
aaagctgggtctccagggcc

SEQ ID NO: 30710 - DNA, 20 bp, Artificial
  CRISPR gRNA sequence
aagctgggtctccagggcct

SEQ ID NO: 30711 - DNA, 20 bp, Artificial
  CRISPR gRNA sequence
ggtctccagggcctagaaag

SEQ ID NO: 30712 - DNA, 20 bp, Artificial
  CRISPR gRNA sequence
cagggcctagaaaggtgcct

SEQ ID NO: 30713 - DNA, 20 bp, Artificial
  CRISPR gRNA sequence
gaaaggtgcctgcacatagt

SEQ ID NO: 30714 - DNA, 20 bp, Artificial
  CRISPR gRNA sequence
cacatagtaggtcctcctta

SEQ ID NO: 30715 - DNA, 20 bp, Artificial
  CRISPR gRNA sequence
cttaaatatttgttgattaa

SEQ ID NO: 30716 - DNA, 20 bp, Artificial
  CRISPR gRNA sequence
aaatatttgttgattaaatt

SEQ ID NO: 30717 - DNA, 20 bp, Artificial
  CRISPR gRNA sequence
aatatttgttgattaaatta

SEQ ID NO: 30718 - DNA, 20 bp, Artificial
  CRISPR gRNA sequence
gttgattaaattaataaatg

SEQ ID NO: 30719 - DNA, 20 bp, Artificial
  CRISPR gRNA sequence
ttgattaaattaataaatgg

SEQ ID NO: 30720 - DNA, 20 bp, Artificial
  CRISPR gRNA sequence
attaaattaataaatggttg

SEQ ID NO: 30721 - DNA, 20 bp, Artificial
  CRISPR gRNA sequence
aattaataaatggttgggta

SEQ ID NO: 30722 - DNA, 20 bp, Artificial
  CRISPR gRNA sequence
ataaatggttgggtaagtaa

SEQ ID NO: 30723 - DNA, 20 bp, Artificial
  CRISPR gRNA sequence
ggtaagtaaagaaatgattg

SEQ ID NO: 30724 - DNA, 20 bp, Artificial
  CRISPR gRNA sequence
agtgagcggttggatgaggg

SEQ ID NO: 30725 - DNA, 20 bp, Artificial
  CRISPR gRNA sequence
gatgagggagtaaagaaatg

SEQ ID NO: 30726 - DNA, 20 bp, Artificial
  CRISPR gRNA sequence
cataagtgaatggatgaatc

SEQ ID NO: 30727 - DNA, 20 bp, Artificial
  CRISPR gRNA sequence
aatggaaggatgaatggctg

SEQ ID NO: 30728 - DNA, 20 bp, Artificial
  CRISPR gRNA sequence
attgaataggtgaatgagtg

SEQ ID NO: 30729 - DNA, 20 bp, Artificial
  CRISPR gRNA sequence
aataggtgaatgagtgaatg

SEQ ID NO: 30730 - DNA, 20 bp, Artificial
  CRISPR gRNA sequence
gggctgggcatggtaagtca

SEQ ID NO: 30731 - DNA, 20 bp, Artificial
  CRISPR gRNA sequence
ggcatggtaagtcacaccta

SEQ ID NO: 30732 - DNA, 20 bp, Artificial
  CRISPR gRNA sequence
taatcccagcactttgggaa

SEQ ID NO: 30733 - DNA, 20 bp, Artificial
  CRISPR gRNA sequence
tgggaagcggaggtgaggag

SEQ ID NO: 30734 - DNA, 20 bp, Artificial
  CRISPR gRNA sequence
gggaagcggaggtgaggaga

SEQ ID NO: 30735 - DNA, 20 bp, Artificial
  CRISPR gRNA sequence
ggaagcggaggtgaggagat

SEQ ID NO: 30736 - DNA, 20 bp, Artificial
  CRISPR gRNA sequence
cttgaggccaggagttcaag

SEQ ID NO: 30737 - DNA, 20 bp, Artificial
  CRISPR gRNA sequence
gaggccaggagttcaaggct

SEQ ID NO: 30738 - DNA, 20 bp, Artificial
  CRISPR gRNA sequence
aggccaggagttcaaggctg

SEQ ID NO: 30739 - DNA, 20 bp, Artificial
  CRISPR gRNA sequence
aaggctgcagaggtatgatc

SEQ ID NO: 30740 - DNA, 20 bp, Artificial
  CRISPR gRNA sequence
cagaggtatgatcatagcac

SEQ ID NO: 30741 - DNA, 20 bp, Artificial
  CRISPR gRNA sequence
tattctagcctgggtgacac

SEQ ID NO: 30742 - DNA, 20 bp, Artificial
  CRISPR gRNA sequence
tagcctgggtgacacagcga

SEQ ID NO: 30743 - DNA, 20 bp, Artificial
  CRISPR gRNA sequence
gcctgggtgacacagcgagc

SEQ ID NO: 30744 - DNA, 20 bp, Artificial
  CRISPR gRNA sequence
ggtgacacagcgagcccttg

SEQ ID NO: 30745 - DNA, 20 bp, Artificial
  CRISPR gRNA sequence
gtctaaaaaaacaaatttaa

SEQ ID NO: 30746 - DNA, 20 bp, Artificial
  CRISPR gRNA sequence
tctaaaaaaacaaatttaaa

SEQ ID NO: 30747 - DNA, 20 bp, Artificial
  CRISPR gRNA sequence
aaaaaacaaatttaaattaa

SEQ ID NO: 30748 - DNA, 20 bp, Artificial
  CRISPR gRNA sequence
aaattaattttgaaaaagtc

SEQ ID NO: 30749 - DNA, 20 bp, Artificial
  CRISPR gRNA sequence
aattaattttgaaaaagtca

SEQ ID NO: 30750 - DNA, 20 bp, Artificial
  CRISPR gRNA sequence
attttgaaaaagtcagccgg

SEQ ID NO: 30751 - DNA, 20 bp, Artificial
  CRISPR gRNA sequence
tgaaaaagtcagccggactt

SEQ ID NO: 30752 - DNA, 20 bp, Artificial
  CRISPR gRNA sequence
gaaaaagtcagccggacttt

SEQ ID NO: 30753 - DNA, 20 bp, Artificial
  CRISPR gRNA sequence
aaaaagtcagccggactttg

SEQ ID NO: 30754 - DNA, 20 bp, Artificial
  CRISPR gRNA sequence
tgggggcccgattcagcagg

SEQ ID NO: 30755 - DNA, 20 bp, Artificial
  CRISPR gRNA sequence
gggggcccgattcagcagga

SEQ ID NO: 30756 - DNA, 20 bp, Artificial
  CRISPR gRNA sequence
ggggcccgattcagcaggaa

SEQ ID NO: 30757 - DNA, 20 bp, Artificial
  CRISPR gRNA sequence
agcaggaagggcaggcccag

SEQ ID NO: 30758 - DNA, 20 bp, Artificial
  CRISPR gRNA sequence
actcacttgagggtttccaa

SEQ ID NO: 30759 - DNA, 20 bp, Artificial
  CRISPR gRNA sequence
acttgagggtttccaaggac

SEQ ID NO: 30760 - DNA, 20 bp, Artificial
  CRISPR gRNA sequence
gagggtttccaaggacttca

SEQ ID NO: 30761 - DNA, 20 bp, Artificial
  CRISPR gRNA sequence
agggtttccaaggacttcag

SEQ ID NO: 30762 - DNA, 20 bp, Artificial
  CRISPR gRNA sequence
ccaaggacttcagctggggg

SEQ ID NO: 30763 - DNA, 20 bp, Artificial
  CRISPR gRNA sequence
caaggacttcagctggggga

SEQ ID NO: 30764 - DNA, 20 bp, Artificial
  CRISPR gRNA sequence
cagctgggggaaggtggctg

SEQ ID NO: 30765 - DNA, 20 bp, Artificial
  CRISPR gRNA sequence
agctgggggaaggtggctga

SEQ ID NO: 30766 - DNA, 20 bp, Artificial
  CRISPR gRNA sequence
ggggaaggtggctgagagct

SEQ ID NO: 30767 - DNA, 20 bp, Artificial
  CRISPR gRNA sequence
agagctgcgagacaccctcg

SEQ ID NO: 30768 - DNA, 20 bp, Artificial
  CRISPR gRNA sequence
cgagacaccctcgtccccga

SEQ ID NO: 30769 - DNA, 20 bp, Artificial
  CRISPR gRNA sequence
gtccccgatcttgttctcac

SEQ ID NO: 30770 - DNA, 20 bp, Artificial
  CRISPR gRNA sequence
gttctcactcagcgcatcca

SEQ ID NO: 30771 - DNA, 20 bp, Artificial
  CRISPR gRNA sequence
ttctcactcagcgcatccag

SEQ ID NO: 30772 - DNA, 20 bp, Artificial
  CRISPR gRNA sequence
tcactcagcgcatccaggct

SEQ ID NO: 30773 - DNA, 20 bp, Artificial
  CRISPR gRNA sequence
actcagcgcatccaggctgc

SEQ ID NO: 30774 - DNA, 20 bp, Artificial
  CRISPR gRNA sequence
agcgcatccaggctgcaggt

SEQ ID NO: 30775 - DNA, 20 bp, Artificial
  CRISPR gRNA sequence
caggtggaatcagatggggg

SEQ ID NO: 30776 - DNA, 20 bp, Artificial
  CRISPR gRNA sequence
gcgtcctggggccatctgac

SEQ ID NO: 30777 - DNA, 20 bp, Artificial
  CRISPR gRNA sequence
gggccatctgacccttccca

SEQ ID NO: 30778 - DNA, 20 bp, Artificial
  CRISPR gRNA sequence
acccttcccatcccagtgag

SEQ ID NO: 30779 - DNA, 20 bp, Artificial
  CRISPR gRNA sequence
cccatcccagtgagggcctc

SEQ ID NO: 30780 - DNA, 20 bp, Artificial
  CRISPR gRNA sequence
ccatcccagtgagggcctcc

SEQ ID NO: 30781 - DNA, 20 bp, Artificial
  CRISPR gRNA sequence
ctcagccctggcacctgccc

SEQ ID NO: 30782 - DNA, 20 bp, Artificial
  CRISPR gRNA sequence
agccctggcacctgcccttc

SEQ ID NO: 30783 - DNA, 20 bp, Artificial
  CRISPR gRNA sequence
gcacctgcccttcccacccc

SEQ ID NO: 30784 - DNA, 20 bp, Artificial
  CRISPR gRNA sequence
cccttcccaccccccagctc

SEQ ID NO: 30785 - DNA, 20 bp, Artificial
  CRISPR gRNA sequence
cccaccccccagctctaata

SEQ ID NO: 30786 - DNA, 20 bp, Artificial
  CRISPR gRNA sequence
ccaccccccagctctaatac

SEQ ID NO: 30787 - DNA, 20 bp, Artificial
  CRISPR gRNA sequence
taatacaccataggcagccg

SEQ ID NO: 30788 - DNA, 20 bp, Artificial
  CRISPR gRNA sequence
atacaccataggcagccggc

SEQ ID NO: 30789 - DNA, 20 bp, Artificial
  CRISPR gRNA sequence
ctgagcttttcagacgagga

SEQ ID NO: 30790 - DNA, 20 bp, Artificial
  CRISPR gRNA sequence
agcttttcagacgaggactt

SEQ ID NO: 30791 - DNA, 20 bp, Artificial
  CRISPR gRNA sequence
ttcagacgaggacttcatca

SEQ ID NO: 30792 - DNA, 20 bp, Artificial
  CRISPR gRNA sequence
tcagacgaggacttcatcac

SEQ ID NO: 30793 - DNA, 20 bp, Artificial
  CRISPR gRNA sequence
cagacgaggacttcatcacc

SEQ ID NO: 30794 - DNA, 20 bp, Artificial
  CRISPR gRNA sequence
agacgaggacttcatcacct

SEQ ID NO: 30795 - DNA, 20 bp, Artificial
  CRISPR gRNA sequence
catcacctgggggctccaac

SEQ ID NO: 30796 - DNA, 20 bp, Artificial
  CRISPR gRNA sequence
atcacctgggggctccaacc

SEQ ID NO: 30797 - DNA, 20 bp, Artificial
  CRISPR gRNA sequence
ggggctccaaccaggcagcc

SEQ ID NO: 30798 - DNA, 20 bp, Artificial
  CRISPR gRNA sequence
caaccaggcagccagagggc

SEQ ID NO: 30799 - DNA, 20 bp, Artificial
  CRISPR gRNA sequence
actcatgatggacttgaatc

SEQ ID NO: 30800 - DNA, 20 bp, Artificial
  CRISPR gRNA sequence
atgatggacttgaatccctg

SEQ ID NO: 30801 - DNA, 20 bp, Artificial
  CRISPR gRNA sequence
gaatccctgtttagcttctt

SEQ ID NO: 30802 - DNA, 20 bp, Artificial
  CRISPR gRNA sequence
aatccctgtttagcttctta

SEQ ID NO: 30803 - DNA, 20 bp, Artificial
  CRISPR gRNA sequence
tttagcttcttaggaactaa

SEQ ID NO: 30804 - DNA, 20 bp, Artificial
  CRISPR gRNA sequence
agcttcttaggaactaagcc

SEQ ID NO: 30805 - DNA, 20 bp, Artificial
  CRISPR gRNA sequence
gcttcttaggaactaagccc

SEQ ID NO: 30806 - DNA, 20 bp, Artificial
  CRISPR gRNA sequence
cttaggaactaagcccctga

SEQ ID NO: 30807 - DNA, 20 bp, Artificial
  CRISPR gRNA sequence
ttaggaactaagcccctgag

SEQ ID NO: 30808 - DNA, 20 bp, Artificial
  CRISPR gRNA sequence
aggaactaagcccctgaggc

SEQ ID NO: 30809 - DNA, 20 bp, Artificial
  CRISPR gRNA sequence
ggaactaagcccctgaggct

SEQ ID NO: 30810 - DNA, 20 bp, Artificial
  CRISPR gRNA sequence
agcccctgaggcttggcaac

SEQ ID NO: 30811 - DNA, 20 bp, Artificial
  CRISPR gRNA sequence
aggcttggcaacttccttaa

SEQ ID NO: 30812 - DNA, 20 bp, Artificial
  CRISPR gRNA sequence
ggcaacttccttaacctcca

SEQ ID NO: 30813 - DNA, 20 bp, Artificial
  CRISPR gRNA sequence
gcaacttccttaacctccac

SEQ ID NO: 30814 - DNA, 20 bp, Artificial
  CRISPR gRNA sequence
ccttaacctccactgtaaag

SEQ ID NO: 30815 - DNA, 20 bp, Artificial
  CRISPR gRNA sequence
cttaacctccactgtaaagt

SEQ ID NO: 30816 - DNA, 20 bp, Artificial
  CRISPR gRNA sequence
aacctccactgtaaagtagg

SEQ ID NO: 30817 - DNA, 20 bp, Artificial
  CRISPR gRNA sequence
acctccactgtaaagtagga

SEQ ID NO: 30818 - DNA, 20 bp, Artificial
  CRISPR gRNA sequence
cactgtaaagtaggactatg

SEQ ID NO: 30819 - DNA, 20 bp, Artificial
  CRISPR gRNA sequence
taaagtaggactatgctccc

SEQ ID NO: 30820 - DNA, 20 bp, Artificial
  CRISPR gRNA sequence
tgctccccaatccctcccca

SEQ ID NO: 30821 - DNA, 20 bp, Artificial
  CRISPR gRNA sequence
cccaatccctccccagctga

SEQ ID NO: 30822 - DNA, 20 bp, Artificial
  CRISPR gRNA sequence
cccagctgaattgctgagag

SEQ ID NO: 30823 - DNA, 20 bp, Artificial
  CRISPR gRNA sequence
aattgctgagagcagcaaat

SEQ ID NO: 30824 - DNA, 20 bp, Artificial
  CRISPR gRNA sequence
ctgagagcagcaaatgaggt

SEQ ID NO: 30825 - DNA, 20 bp, Artificial
  CRISPR gRNA sequence
agagcagcaaatgaggttgt

SEQ ID NO: 30826 - DNA, 20 bp, Artificial
  CRISPR gRNA sequence
tgaggaaaggagtttcaaag

SEQ ID NO: 30827 - DNA, 20 bp, Artificial
  CRISPR gRNA sequence
caaaggtcacgaaaggatct

SEQ ID NO: 30828 - DNA, 20 bp, Artificial
  CRISPR gRNA sequence
aaaggtcacgaaaggatcta

SEQ ID NO: 30829 - DNA, 20 bp, Artificial
  CRISPR gRNA sequence
caactttttttgtcactggg

SEQ ID NO: 30830 - DNA, 20 bp, Artificial
  CRISPR gRNA sequence
tttttgtcactggggattcc

SEQ ID NO: 30831 - DNA, 20 bp, Artificial
  CRISPR gRNA sequence
ttttgtcactggggattccc

SEQ ID NO: 30832 - DNA, 20 bp, Artificial
  CRISPR gRNA sequence
tttgtcactggggattccca

SEQ ID NO: 30833 - DNA, 20 bp, Artificial
  CRISPR gRNA sequence
ttgtcactggggattcccat

SEQ ID NO: 30834 - DNA, 20 bp, Artificial
  CRISPR gRNA sequence
tgtcactggggattcccatc

SEQ ID NO: 30835 - DNA, 20 bp, Artificial
  CRISPR gRNA sequence
gtcactggggattcccatct

SEQ ID NO: 30836 - DNA, 20 bp, Artificial
  CRISPR gRNA sequence
tcactggggattcccatctg

SEQ ID NO: 30837 - DNA, 20 bp, Artificial
  CRISPR gRNA sequence
gggattcccatctgatgtgg

SEQ ID NO: 30838 - DNA, 20 bp, Artificial
  CRISPR gRNA sequence
ccatctgatgtggcgtcatc

SEQ ID NO: 30839 - DNA, 20 bp, Artificial
  CRISPR gRNA sequence
atgtggcgtcatctcatcac

SEQ ID NO: 30840 - DNA, 20 bp, Artificial
  CRISPR gRNA sequence
atcactcatgtgccagccac

SEQ ID NO: 30841 - DNA, 20 bp, Artificial
  CRISPR gRNA sequence
atgtgccagccacattgagg

SEQ ID NO: 30842 - DNA, 20 bp, Artificial
  CRISPR gRNA sequence
aggatgcagtaggcggaaga

SEQ ID NO: 30843 - DNA, 20 bp, Artificial
  CRISPR gRNA sequence
ttctttctgcaggtgccttg

SEQ ID NO: 30844 - DNA, 20 bp, Artificial
  CRISPR gRNA sequence
tctttctgcaggtgccttgg

SEQ ID NO: 30845 - DNA, 20 bp, Artificial
  CRISPR gRNA sequence
ctttctgcaggtgccttggg

SEQ ID NO: 30846 - DNA, 20 bp, Artificial
  CRISPR gRNA sequence
tttctgcaggtgccttgggg

SEQ ID NO: 30847 - DNA, 20 bp, Artificial
  CRISPR gRNA sequence
tctgcaggtgccttgggggc

SEQ ID NO: 30848 - DNA, 20 bp, Artificial
  CRISPR gRNA sequence
ctgcaggtgccttgggggca

SEQ ID NO: 30849 - DNA, 20 bp, Artificial
  CRISPR gRNA sequence
tgcaggtgccttgggggcag

SEQ ID NO: 30850 - DNA, 20 bp, Artificial
  CRISPR gRNA sequence
caggtgccttgggggcagga

SEQ ID NO: 30851 - DNA, 20 bp, Artificial
  CRISPR gRNA sequence
gggggcaggatttggggttg

SEQ ID NO: 30852 - DNA, 20 bp, Artificial
  CRISPR gRNA sequence
ggggcaggatttggggttgt

SEQ ID NO: 30853 - DNA, 20 bp, Artificial
  CRISPR gRNA sequence
ggggttgtcaaaacccagag

SEQ ID NO: 30854 - DNA, 20 bp, Artificial
  CRISPR gRNA sequence
gggttgtcaaaacccagagg

SEQ ID NO: 30855 - DNA, 20 bp, Artificial
  CRISPR gRNA sequence
tcaaaacccagaggttgctg

SEQ ID NO: 30856 - DNA, 20 bp, Artificial
  CRISPR gRNA sequence
ctgggcactgtagcatgcac

SEQ ID NO: 30857 - DNA, 20 bp, Artificial
  CRISPR gRNA sequence
ggcactgtagcatgcacctg

SEQ ID NO: 30858 - DNA, 20 bp, Artificial
  CRISPR gRNA sequence
tagcatgcacctgtggtccc

SEQ ID NO: 30859 - DNA, 20 bp, Artificial
  CRISPR gRNA sequence
tggtcccagctactcaggag

SEQ ID NO: 30860 - DNA, 20 bp, Artificial
  CRISPR gRNA sequence
ctcaggaggctgaggcagga

SEQ ID NO: 30861 - DNA, 20 bp, Artificial
  CRISPR gRNA sequence
aggaggctgaggcaggagga

SEQ ID NO: 30862 - DNA, 20 bp, Artificial
  CRISPR gRNA sequence
aggcaggaggactacttgag

SEQ ID NO: 30863 - DNA, 20 bp, Artificial
  CRISPR gRNA sequence
cttgaggccaggaattcgag

SEQ ID NO: 30864 - DNA, 20 bp, Artificial
  CRISPR gRNA sequence
gaggccaggaattcgaggct

SEQ ID NO: 30865 - DNA, 20 bp, Artificial
  CRISPR gRNA sequence
aggccaggaattcgaggctg

SEQ ID NO: 30866 - DNA, 20 bp, Artificial
  CRISPR gRNA sequence
gaggctgcagtgagctatga

SEQ ID NO: 30867 - DNA, 20 bp, Artificial
  CRISPR gRNA sequence
cagtgagctatgatcacagc

SEQ ID NO: 30868 - DNA, 20 bp, Artificial
  CRISPR gRNA sequence
tgatcacagcactgcaccca

SEQ ID NO: 30869 - DNA, 20 bp, Artificial
  CRISPR gRNA sequence
cacccagatgttgagaggaa

SEQ ID NO: 30870 - DNA, 20 bp, Artificial
  CRISPR gRNA sequence
agaggaaggggtcccagagt

SEQ ID NO: 30871 - DNA, 20 bp, Artificial
  CRISPR gRNA sequence
tactcactccagatgctgca

SEQ ID NO: 30872 - DNA, 20 bp, Artificial
  CRISPR gRNA sequence
actccagatgctgcagggag

SEQ ID NO: 30873 - DNA, 20 bp, Artificial
  CRISPR gRNA sequence
cagatgctgcagggaggaaa

SEQ ID NO: 30874 - DNA, 20 bp, Artificial
  CRISPR gRNA sequence
cagggaggaaaaggccgtga

SEQ ID NO: 30875 - DNA, 20 bp, Artificial
  CRISPR gRNA sequence
ggggaaagcctgggggcctg

SEQ ID NO: 30876 - DNA, 20 bp, Artificial
  CRISPR gRNA sequence
gggaaagcctgggggcctga

SEQ ID NO: 30877 - DNA, 20 bp, Artificial
  CRISPR gRNA sequence
ggggcctgagacagggccca

SEQ ID NO: 30878 - DNA, 20 bp, Artificial
  CRISPR gRNA sequence
agacagggcccagcctagga

SEQ ID NO: 30879 - DNA, 20 bp, Artificial
  CRISPR gRNA sequence
ggaggcaaagagcaagggta

SEQ ID NO: 30880 - DNA, 20 bp, Artificial
  CRISPR gRNA sequence
cagtcacagtcacagcccct

SEQ ID NO: 30881 - DNA, 20 bp, Artificial
  CRISPR gRNA sequence
attcagccccagggtggggc

SEQ ID NO: 30882 - DNA, 20 bp, Artificial
  CRISPR gRNA sequence
agccccagggtggggcagag

SEQ ID NO: 30883 - DNA, 20 bp, Artificial
  CRISPR gRNA sequence
tctgaggcccctcctcttcc

SEQ ID NO: 30884 - DNA, 20 bp, Artificial
  CRISPR gRNA sequence
aggcccctcctcttcccttc

SEQ ID NO: 30885 - DNA, 20 bp, Artificial
  CRISPR gRNA sequence
ctcttcccttccaccccagc

SEQ ID NO: 30886 - DNA, 20 bp, Artificial
  CRISPR gRNA sequence
ttcccttccaccccagcctc

SEQ ID NO: 30887 - DNA, 20 bp, Artificial
  CRISPR gRNA sequence
cccttccaccccagcctctt

SEQ ID NO: 30888 - DNA, 20 bp, Artificial
  CRISPR gRNA sequence
ccttccaccccagcctctta

SEQ ID NO: 30889 - DNA, 20 bp, Artificial
  CRISPR gRNA sequence
ccaccccagcctcttaggtc

SEQ ID NO: 30890 - DNA, 20 bp, Artificial
  CRISPR gRNA sequence
caccccagcctcttaggtcc

SEQ ID NO: 30891 - DNA, 20 bp, Artificial
  CRISPR gRNA sequence
ttaggtccctgcaacccttc

SEQ ID NO: 30892 - DNA, 20 bp, Artificial
  CRISPR gRNA sequence
aggtccctgcaacccttcca

SEQ ID NO: 30893 - DNA, 20 bp, Artificial
  CRISPR gRNA sequence
ggtccctgcaacccttccac

SEQ ID NO: 30894 - DNA, 20 bp, Artificial
  CRISPR gRNA sequence
caacccttccacgtaggacc

SEQ ID NO: 30895 - DNA, 20 bp, Artificial
  CRISPR gRNA sequence
ccacgtaggaccccaatctt

SEQ ID NO: 30896 - DNA, 20 bp, Artificial
  CRISPR gRNA sequence
cacgtaggaccccaatcttt

SEQ ID NO: 30897 - DNA, 20 bp, Artificial
  CRISPR gRNA sequence
ttctgcttggggtagatttc

SEQ ID NO: 30898 - DNA, 20 bp, Artificial
  CRISPR gRNA sequence
tctgcttggggtagatttca

SEQ ID NO: 30899 - DNA, 20 bp, Artificial
  CRISPR gRNA sequence
ctgcttggggtagatttcat

SEQ ID NO: 30900 - DNA, 20 bp, Artificial
  CRISPR gRNA sequence
tgcttggggtagatttcata

SEQ ID NO: 30901 - DNA, 20 bp, Artificial
  CRISPR gRNA sequence
cttggggtagatttcatagc

SEQ ID NO: 30902 - DNA, 20 bp, Artificial
  CRISPR gRNA sequence
ggggtagatttcatagcccc

SEQ ID NO: 30903 - DNA, 20 bp, Artificial
  CRISPR gRNA sequence
gggtagatttcatagccccc

SEQ ID NO: 30904 - DNA, 20 bp, Artificial
  CRISPR gRNA sequence
catagccccccataagaggc

SEQ ID NO: 30905 - DNA, 20 bp, Artificial
  CRISPR gRNA sequence
atagccccccataagaggcc

SEQ ID NO: 30906 - DNA, 20 bp, Artificial
  CRISPR gRNA sequence
aggctgggaacagtggctca

SEQ ID NO: 30907 - DNA, 20 bp, Artificial
  CRISPR gRNA sequence
ggaacagtggctcatgtctg

SEQ ID NO: 30908 - DNA, 20 bp, Artificial
  CRISPR gRNA sequence
atgtctgtaattccagcatt

SEQ ID NO: 30909 - DNA, 20 bp, Artificial
  CRISPR gRNA sequence
taattccagcattttgggag

SEQ ID NO: 30910 - DNA, 20 bp, Artificial
  CRISPR gRNA sequence
cagcattttgggaggccaag

SEQ ID NO: 30911 - DNA, 20 bp, Artificial
  CRISPR gRNA sequence
tgggaggccaaggtaagagg

SEQ ID NO: 30912 - DNA, 20 bp, Artificial
  CRISPR gRNA sequence
gggaggccaaggtaagagga

SEQ ID NO: 30913 - DNA, 20 bp, Artificial
  CRISPR gRNA sequence
ggaggccaaggtaagaggac

SEQ ID NO: 30914 - DNA, 20 bp, Artificial
  CRISPR gRNA sequence
cttgagcccaggagttcaag

SEQ ID NO: 30915 - DNA, 20 bp, Artificial
  CRISPR gRNA sequence
gagcccaggagttcaagacc

SEQ ID NO: 30916 - DNA, 20 bp, Artificial
  CRISPR gRNA sequence
agcccaggagttcaagacca

SEQ ID NO: 30917 - DNA, 20 bp, Artificial
  CRISPR gRNA sequence
aagaccagcttgggcaacat

SEQ ID NO: 30918 - DNA, 20 bp, Artificial
  CRISPR gRNA sequence
gggcaacatagtgagactca

SEQ ID NO: 30919 - DNA, 20 bp, Artificial
  CRISPR gRNA sequence
ggcaacatagtgagactcag

SEQ ID NO: 30920 - DNA, 20 bp, Artificial
  CRISPR gRNA sequence
agtctctacaaaaaacacaa

SEQ ID NO: 30921 - DNA, 20 bp, Artificial
  CRISPR gRNA sequence
tacaaaaaacacaataatta

SEQ ID NO: 30922 - DNA, 20 bp, Artificial
  CRISPR gRNA sequence
caaaaaacacaataattagc

SEQ ID NO: 30923 - DNA, 20 bp, Artificial
  CRISPR gRNA sequence
gccaagtgtggtggtgtgtc

SEQ ID NO: 30924 - DNA, 20 bp, Artificial
  CRISPR gRNA sequence
tggtctcagcttcttaggag

SEQ ID NO: 30925 - DNA, 20 bp, Artificial
  CRISPR gRNA sequence
agcttcttaggaggctgagg

SEQ ID NO: 30926 - DNA, 20 bp, Artificial
  CRISPR gRNA sequence
cttaggaggctgaggtggaa

SEQ ID NO: 30927 - DNA, 20 bp, Artificial
  CRISPR gRNA sequence
ttaggaggctgaggtggaag

SEQ ID NO: 30928 - DNA, 20 bp, Artificial
  CRISPR gRNA sequence
aggaggctgaggtggaagca

SEQ ID NO: 30929 - DNA, 20 bp, Artificial
  CRISPR gRNA sequence
ggaggctgaggtggaagcat

SEQ ID NO: 30930 - DNA, 20 bp, Artificial
  CRISPR gRNA sequence
aggtggaagcatcgcttgag

SEQ ID NO: 30931 - DNA, 20 bp, Artificial
  CRISPR gRNA sequence
gagcccaggaggtggaggat

SEQ ID NO: 30932 - DNA, 20 bp, Artificial
  CRISPR gRNA sequence
agcccaggaggtggaggatg

SEQ ID NO: 30933 - DNA, 20 bp, Artificial
  CRISPR gRNA sequence
cactccagcctgggtaagag

SEQ ID NO: 30934 - DNA, 20 bp, Artificial
  CRISPR gRNA sequence
cagcctgggtaagagcgaga

SEQ ID NO: 30935 - DNA, 20 bp, Artificial
  CRISPR gRNA sequence
ggtaagagcgagaccctgtc

SEQ ID NO: 30936 - DNA, 20 bp, Artificial
  CRISPR gRNA sequence
tctcaaaaaagaaaaaaaac

SEQ ID NO: 30937 - DNA, 20 bp, Artificial
  CRISPR gRNA sequence
aaaaaagaaaaaaaacaaaa

SEQ ID NO: 30938 - DNA, 20 bp, Artificial
  CRISPR gRNA sequence
ggctcccatcttggggctcc

SEQ ID NO: 30939 - DNA, 20 bp, Artificial
  CRISPR gRNA sequence
ccatcttggggctccccagc

SEQ ID NO: 30940 - DNA, 20 bp, Artificial
  CRISPR gRNA sequence
ggggctccccagcttttgtc

SEQ ID NO: 30941 - DNA, 20 bp, Artificial
  CRISPR gRNA sequence
gggctccccagcttttgtct

SEQ ID NO: 30942 - DNA, 20 bp, Artificial
  CRISPR gRNA sequence
cccagcttttgtctctaagt

SEQ ID NO: 30943 - DNA, 20 bp, Artificial
  CRISPR gRNA sequence
ttgtctctaagtagggagcc

SEQ ID NO: 30944 - DNA, 20 bp, Artificial
  CRISPR gRNA sequence
tgtctctaagtagggagcca

SEQ ID NO: 30945 - DNA, 20 bp, Artificial
  CRISPR gRNA sequence
gtctctaagtagggagccag

SEQ ID NO: 30946 - DNA, 20 bp, Artificial
  CRISPR gRNA sequence
tctctaagtagggagccagt

SEQ ID NO: 30947 - DNA, 20 bp, Artificial
  CRISPR gRNA sequence
taagtagggagccagttctt

SEQ ID NO: 30948 - DNA, 20 bp, Artificial
  CRISPR gRNA sequence
agtagggagccagttcttac

SEQ ID NO: 30949 - DNA, 20 bp, Artificial
  CRISPR gRNA sequence
ttactcttcccaacatccac

SEQ ID NO: 30950 - DNA, 20 bp, Artificial
  CRISPR gRNA sequence
actcttcccaacatccacag

SEQ ID NO: 30951 - DNA, 20 bp, Artificial
  CRISPR gRNA sequence
ctcttcccaacatccacaga

SEQ ID NO: 30952 - DNA, 20 bp, Artificial
  CRISPR gRNA sequence
ttcccaacatccacagatac

SEQ ID NO: 30953 - DNA, 20 bp, Artificial
  CRISPR gRNA sequence
cccaacatccacagataccc

SEQ ID NO: 30954 - DNA, 20 bp, Artificial
  CRISPR gRNA sequence
ccaacatccacagataccct

SEQ ID NO: 30955 - DNA, 20 bp, Artificial
  CRISPR gRNA sequence
ctcccgccgcagcctgggga

SEQ ID NO: 30956 - DNA, 20 bp, Artificial
  CRISPR gRNA sequence
tcccgccgcagcctggggaa

SEQ ID NO: 30957 - DNA, 20 bp, Artificial
  CRISPR gRNA sequence
ccgccgcagcctggggaagg

SEQ ID NO: 30958 - DNA, 20 bp, Artificial
  CRISPR gRNA sequence
gggaaggggtcctgaaatgc

SEQ ID NO: 30959 - DNA, 20 bp, Artificial
  CRISPR gRNA sequence
aaatgccagctgacgaccac

SEQ ID NO: 30960 - DNA, 20 bp, Artificial
  CRISPR gRNA sequence
acgaccactgccagtggtaa

SEQ ID NO: 30961 - DNA, 20 bp, Artificial
  CRISPR gRNA sequence
ccagtggtaaaccaggtggt

SEQ ID NO: 30962 - DNA, 20 bp, Artificial
  CRISPR gRNA sequence
actaatatgcctttgcattt

SEQ ID NO: 30963 - DNA, 20 bp, Artificial
  CRISPR gRNA sequence
atatgcctttgcattttaat

SEQ ID NO: 30964 - DNA, 20 bp, Artificial
  CRISPR gRNA sequence
tgcattttaataacaaaagg

SEQ ID NO: 30965 - DNA, 20 bp, Artificial
  CRISPR gRNA sequence
gcattttaataacaaaagga

SEQ ID NO: 30966 - DNA, 20 bp, Artificial
  CRISPR gRNA sequence
cattttaataacaaaaggaa

SEQ ID NO: 30967 - DNA, 20 bp, Artificial
  CRISPR gRNA sequence
taataacaaaaggaaccatt

SEQ ID NO: 30968 - DNA, 20 bp, Artificial
  CRISPR gRNA sequence
aataacaaaaggaaccattt

SEQ ID NO: 30969 - DNA, 20 bp, Artificial
  CRISPR gRNA sequence
ataacaaaaggaaccatttg

SEQ ID NO: 30970 - DNA, 20 bp, Artificial
  CRISPR gRNA sequence
gttgagcatttattataagc

SEQ ID NO: 30971 - DNA, 20 bp, Artificial
  CRISPR gRNA sequence
ttgagcatttattataagcc

SEQ ID NO: 30972 - DNA, 20 bp, Artificial
  CRISPR gRNA sequence
agcatttattataagccagg

SEQ ID NO: 30973 - DNA, 20 bp, Artificial
  CRISPR gRNA sequence
attataagccaggggcatgc

SEQ ID NO: 30974 - DNA, 20 bp, Artificial
  CRISPR gRNA sequence
ttataagccaggggcatgct

SEQ ID NO: 30975 - DNA, 20 bp, Artificial
  CRISPR gRNA sequence
taagccaggggcatgctagg

SEQ ID NO: 30976 - DNA, 20 bp, Artificial
  CRISPR gRNA sequence
ggcccttccctcggcctaga

SEQ ID NO: 30977 - DNA, 20 bp, Artificial
  CRISPR gRNA sequence
ccctcggcctagatctcatt

SEQ ID NO: 30978 - DNA, 20 bp, Artificial
  CRISPR gRNA sequence
cctcggcctagatctcattt

SEQ ID NO: 30979 - DNA, 20 bp, Artificial
  CRISPR gRNA sequence
ggcctagatctcatttactc

SEQ ID NO: 30980 - DNA, 20 bp, Artificial
  CRISPR gRNA sequence
gatctcatttactcctcaag

SEQ ID NO: 30981 - DNA, 20 bp, Artificial
  CRISPR gRNA sequence
atttactcctcaagactctg

SEQ ID NO: 30982 - DNA, 20 bp, Artificial
  CRISPR gRNA sequence
actcctcaagactctgagct

SEQ ID NO: 30983 - DNA, 20 bp, Artificial
  CRISPR gRNA sequence
ctcctcaagactctgagcta

SEQ ID NO: 30984 - DNA, 20 bp, Artificial
  CRISPR gRNA sequence
ctcaagactctgagctatgg

SEQ ID NO: 30985 - DNA, 20 bp, Artificial
  CRISPR gRNA sequence
aagactctgagctatgggct

SEQ ID NO: 30986 - DNA, 20 bp, Artificial
  CRISPR gRNA sequence
tgagctatgggctcttatct

SEQ ID NO: 30987 - DNA, 20 bp, Artificial
  CRISPR gRNA sequence
agctatgggctcttatctcc

SEQ ID NO: 30988 - DNA, 20 bp, Artificial
  CRISPR gRNA sequence
tgggctcttatctccatttt

SEQ ID NO: 30989 - DNA, 20 bp, Artificial
  CRISPR gRNA sequence
ttatctccattttacatata

SEQ ID NO: 30990 - DNA, 20 bp, Artificial
  CRISPR gRNA sequence
atctccattttacatatagg

SEQ ID NO: 30991 - DNA, 20 bp, Artificial
  CRISPR gRNA sequence
tctccattttacatataggg

SEQ ID NO: 30992 - DNA, 20 bp, Artificial
  CRISPR gRNA sequence
cattttacatatagggaaac

SEQ ID NO: 30993 - DNA, 20 bp, Artificial
  CRISPR gRNA sequence
tacatatagggaaactgagg

SEQ ID NO: 30994 - DNA, 20 bp, Artificial
  CRISPR gRNA sequence
acatatagggaaactgaggc

SEQ ID NO: 30995 - DNA, 20 bp, Artificial
  CRISPR gRNA sequence
catatagggaaactgaggca

SEQ ID NO: 30996 - DNA, 20 bp, Artificial
  CRISPR gRNA sequence
aggcactaggcgatcaaata

SEQ ID NO: 30997 - DNA, 20 bp, Artificial
  CRISPR gRNA sequence
ggcgatcaaatagctcacac

SEQ ID NO: 30998 - DNA, 20 bp, Artificial
  CRISPR gRNA sequence
acacagggtcacacagcctg

SEQ ID NO: 30999 - DNA, 20 bp, Artificial
  CRISPR gRNA sequence
gatcaacatttagagcagac

SEQ ID NO: 31000 - DNA, 20 bp, Artificial
  CRISPR gRNA sequence
agagcagacttcaaggggat

SEQ ID NO: 31001 - DNA, 20 bp, Artificial
  CRISPR gRNA sequence
gagcagacttcaaggggatg

SEQ ID NO: 31002 - DNA, 20 bp, Artificial
  CRISPR gRNA sequence
caaggggatgagaaaaataa

SEQ ID NO: 31003 - DNA, 20 bp, Artificial
  CRISPR gRNA sequence
aaggggatgagaaaaataag

SEQ ID NO: 31004 - DNA, 20 bp, Artificial
  CRISPR gRNA sequence
agtttaaaaatatggttaaa

SEQ ID NO: 31005 - DNA, 20 bp, Artificial
  CRISPR gRNA sequence
gtttaaaaatatggttaaat

SEQ ID NO: 31006 - DNA, 20 bp, Artificial
  CRISPR gRNA sequence
aaaaatatggttaaatgcat

SEQ ID NO: 31007 - DNA, 20 bp, Artificial
  CRISPR gRNA sequence
aaaatatggttaaatgcatt

SEQ ID NO: 31008 - DNA, 20 bp, Artificial
  CRISPR gRNA sequence
aatgcattccatataaagag

SEQ ID NO: 31009 - DNA, 20 bp, Artificial
  CRISPR gRNA sequence
catataaagagctgtctttt

SEQ ID NO: 31010 - DNA, 20 bp, Artificial
  CRISPR gRNA sequence
tcttttattctgcaattatg

SEQ ID NO: 31011 - DNA, 20 bp, Artificial
  CRISPR gRNA sequence
ttattctgcaattatgtcct

SEQ ID NO: 31012 - DNA, 20 bp, Artificial
  CRISPR gRNA sequence
tattctgcaattatgtcctt

SEQ ID NO: 31013 - DNA, 20 bp, Artificial
  CRISPR gRNA sequence
attctgcaattatgtccttt

SEQ ID NO: 31014 - DNA, 20 bp, Artificial
  CRISPR gRNA sequence
ttctgcaattatgtcctttg

SEQ ID NO: 31015 - DNA, 20 bp, Artificial
  CRISPR gRNA sequence
tgcaattatgtcctttgaac

SEQ ID NO: 31016 - DNA, 20 bp, Artificial
  CRISPR gRNA sequence
caattatgtcctttgaactt

SEQ ID NO: 31017 - DNA, 20 bp, Artificial
  CRISPR gRNA sequence
tgtcctttgaactttttcaa

SEQ ID NO: 31018 - DNA, 20 bp, Artificial
  CRISPR gRNA sequence
tgaactttttcaatattaga

SEQ ID NO: 31019 - DNA, 20 bp, Artificial
  CRISPR gRNA sequence
gaactttttcaatattagaa

SEQ ID NO: 31020 - DNA, 20 bp, Artificial
  CRISPR gRNA sequence
aactttttcaatattagaat

SEQ ID NO: 31021 - DNA, 20 bp, Artificial
  CRISPR gRNA sequence
tttcaatattagaatgatca

SEQ ID NO: 31022 - DNA, 20 bp, Artificial
  CRISPR gRNA sequence
ttcaatattagaatgatcat

SEQ ID NO: 31023 - DNA, 20 bp, Artificial
  CRISPR gRNA sequence
tcaatattagaatgatcatt

SEQ ID NO: 31024 - DNA, 20 bp, Artificial
  CRISPR gRNA sequence
caatattagaatgatcattc

SEQ ID NO: 31025 - DNA, 20 bp, Artificial
  CRISPR gRNA sequence
aatattagaatgatcattct

SEQ ID NO: 31026 - DNA, 20 bp, Artificial
  CRISPR gRNA sequence
gaatgatcattctttggtaa

SEQ ID NO: 31027 - DNA, 20 bp, Artificial
  CRISPR gRNA sequence
tttggtaaaattatggtgcc

SEQ ID NO: 31028 - DNA, 20 bp, Artificial
  CRISPR gRNA sequence
tggtaaaattatggtgccag

SEQ ID NO: 31029 - DNA, 20 bp, Artificial
  CRISPR gRNA sequence
ggtaaaattatggtgccagc

SEQ ID NO: 31030 - DNA, 20 bp, Artificial
  CRISPR gRNA sequence
gtaaaattatggtgccagca

SEQ ID NO: 31031 - DNA, 20 bp, Artificial
  CRISPR gRNA sequence
tggtgccagcagtgggtatt

SEQ ID NO: 31032 - DNA, 20 bp, Artificial
  CRISPR gRNA sequence
tgttgttatttgtttgtttg

SEQ ID NO: 31033 - DNA, 20 bp, Artificial
  CRISPR gRNA sequence
gttgttatttgtttgtttga

SEQ ID NO: 31034 - DNA, 20 bp, Artificial
  CRISPR gRNA sequence
ttgttatttgtttgtttgaa

SEQ ID NO: 31035 - DNA, 20 bp, Artificial
  CRISPR gRNA sequence
ttatttgtttgtttgaatga

SEQ ID NO: 31036 - DNA, 20 bp, Artificial
  CRISPR gRNA sequence
tttgtttgtttgaatgagca

SEQ ID NO: 31037 - DNA, 20 bp, Artificial
  CRISPR gRNA sequence
gtttgtttgaatgagcatcc

SEQ ID NO: 31038 - DNA, 20 bp, Artificial
  CRISPR gRNA sequence
tttgtttgaatgagcatcct

SEQ ID NO: 31039 - DNA, 20 bp, Artificial
  CRISPR gRNA sequence
gtttgaatgagcatccttga

SEQ ID NO: 31040 - DNA, 20 bp, Artificial
  CRISPR gRNA sequence
tttgaatgagcatccttgat

SEQ ID NO: 31041 - DNA, 20 bp, Artificial
  CRISPR gRNA sequence
gaatgagcatccttgataaa

SEQ ID NO: 31042 - DNA, 20 bp, Artificial
  CRISPR gRNA sequence
aatgagcatccttgataaac

SEQ ID NO: 31043 - DNA, 20 bp, Artificial
  CRISPR gRNA sequence
gataaacattaaaaaacagt

SEQ ID NO: 31044 - DNA, 20 bp, Artificial
  CRISPR gRNA sequence
ataaacattaaaaaacagta

SEQ ID NO: 31045 - DNA, 20 bp, Artificial
  CRISPR gRNA sequence
aaaaacagtaaccgcgcacg

SEQ ID NO: 31046 - DNA, 20 bp, Artificial
  CRISPR gRNA sequence
gaattcattccgaaatgttc

SEQ ID NO: 31047 - DNA, 20 bp, Artificial
  CRISPR gRNA sequence
attccgaaatgttctcggcc

SEQ ID NO: 31048 - DNA, 20 bp, Artificial
  CRISPR gRNA sequence
cgaaatgttctcggcctctg

SEQ ID NO: 31049 - DNA, 20 bp, Artificial
  CRISPR gRNA sequence
tcggcctctgaaatcctgaa

SEQ ID NO: 31050 - DNA, 20 bp, Artificial
  CRISPR gRNA sequence
ggcctctgaaatcctgaagt

SEQ ID NO: 31051 - DNA, 20 bp, Artificial
  CRISPR gRNA sequence
tgaaatcctgaagtctgaga

SEQ ID NO: 31052 - DNA, 20 bp, Artificial
  CRISPR gRNA sequence
aaatcctgaagtctgagaac

SEQ ID NO: 31053 - DNA, 20 bp, Artificial
  CRISPR gRNA sequence
aagtctgagaacactggcct

SEQ ID NO: 31054 - DNA, 20 bp, Artificial
  CRISPR gRNA sequence
agaacactggcctcagcaaa

SEQ ID NO: 31055 - DNA, 20 bp, Artificial
  CRISPR gRNA sequence
gcctcagcaaaaggccacag

SEQ ID NO: 31056 - DNA, 20 bp, Artificial
  CRISPR gRNA sequence
agcaaaaggccacaggatca

SEQ ID NO: 31057 - DNA, 20 bp, Artificial
  CRISPR gRNA sequence
gactccaggatctggcattt

SEQ ID NO: 31058 - DNA, 20 bp, Artificial
  CRISPR gRNA sequence
actccaggatctggcatttg

SEQ ID NO: 31059 - DNA, 20 bp, Artificial
  CRISPR gRNA sequence
caggatctggcatttggctc

SEQ ID NO: 31060 - DNA, 20 bp, Artificial
  CRISPR gRNA sequence
gcatttggctccctgctaaa

SEQ ID NO: 31061 - DNA, 20 bp, Artificial
  CRISPR gRNA sequence
ggctccctgctaaaggcctt

SEQ ID NO: 31062 - DNA, 20 bp, Artificial
  CRISPR gRNA sequence
gctccctgctaaaggccttg

SEQ ID NO: 31063 - DNA, 20 bp, Artificial
  CRISPR gRNA sequence
cctgctaaaggccttggcaa

SEQ ID NO: 31064 - DNA, 20 bp, Artificial
  CRISPR gRNA sequence
ctaaaggccttggcaaatcc

SEQ ID NO: 31065 - DNA, 20 bp, Artificial
  CRISPR gRNA sequence
aaggccttggcaaatccctt

SEQ ID NO: 31066 - DNA, 20 bp, Artificial
  CRISPR gRNA sequence
ggcaaatcccttcaccctta

SEQ ID NO: 31067 - DNA, 20 bp, Artificial
  CRISPR gRNA sequence
gcaaatcccttcacccttaa

SEQ ID NO: 31068 - DNA, 20 bp, Artificial
  CRISPR gRNA sequence
cacccttaagtcttgatctc

SEQ ID NO: 31069 - DNA, 20 bp, Artificial
  CRISPR gRNA sequence
acccttaagtcttgatctcc

SEQ ID NO: 31070 - DNA, 20 bp, Artificial
  CRISPR gRNA sequence
aagtcttgatctcctcaaat

SEQ ID NO: 31071 - DNA, 20 bp, Artificial
  CRISPR gRNA sequence
agtcttgatctcctcaaata

SEQ ID NO: 31072 - DNA, 20 bp, Artificial
  CRISPR gRNA sequence
gatctcctcaaatatttcac

SEQ ID NO: 31073 - DNA, 20 bp, Artificial
  CRISPR gRNA sequence
atctcctcaaatatttcacc

SEQ ID NO: 31074 - DNA, 20 bp, Artificial
  CRISPR gRNA sequence
ctcaaatatttcaccccaat

SEQ ID NO: 31075 - DNA, 20 bp, Artificial
  CRISPR gRNA sequence
aaatatttcaccccaatctt

SEQ ID NO: 31076 - DNA, 20 bp, Artificial
  CRISPR gRNA sequence
caccccaatcttatgggggt

SEQ ID NO: 31077 - DNA, 20 bp, Artificial
  CRISPR gRNA sequence
accccaatcttatgggggtt

SEQ ID NO: 31078 - DNA, 20 bp, Artificial
  CRISPR gRNA sequence
atgggggttcttggattaag

SEQ ID NO: 31079 - DNA, 20 bp, Artificial
  CRISPR gRNA sequence
tgggggttcttggattaagg

SEQ ID NO: 31080 - DNA, 20 bp, Artificial
  CRISPR gRNA sequence
ttggattaaggcattcgttg

SEQ ID NO: 31081 - DNA, 20 bp, Artificial
  CRISPR gRNA sequence
ggattaaggcattcgttgtt

SEQ ID NO: 31082 - DNA, 20 bp, Artificial
  CRISPR gRNA sequence
gattaaggcattcgttgtta

SEQ ID NO: 31083 - DNA, 20 bp, Artificial
  CRISPR gRNA sequence
aggcattcgttgttaaatat

SEQ ID NO: 31084 - DNA, 20 bp, Artificial
  CRISPR gRNA sequence
gttgttaaatattgaccgct

SEQ ID NO: 31085 - DNA, 20 bp, Artificial
  CRISPR gRNA sequence
ttaaatattgaccgcttgcc

SEQ ID NO: 31086 - DNA, 20 bp, Artificial
  CRISPR gRNA sequence
aatattgaccgcttgcctac

SEQ ID NO: 31087 - DNA, 20 bp, Artificial
  CRISPR gRNA sequence
accgcttgcctactatgtgc

SEQ ID NO: 31088 - DNA, 20 bp, Artificial
  CRISPR gRNA sequence
gcctactatgtgccaggccc

SEQ ID NO: 31089 - DNA, 20 bp, Artificial
  CRISPR gRNA sequence
cctactatgtgccaggccca

SEQ ID NO: 31090 - DNA, 20 bp, Artificial
  CRISPR gRNA sequence
ctatgtgccaggcccaggga

SEQ ID NO: 31091 - DNA, 20 bp, Artificial
  CRISPR gRNA sequence
tgtgccaggcccagggagga

SEQ ID NO: 31092 - DNA, 20 bp, Artificial
  CRISPR gRNA sequence
tgggccaaacagacgaaaat

SEQ ID NO: 31093 - DNA, 20 bp, Artificial
  CRISPR gRNA sequence
ccttctgggtgctgacattc

SEQ ID NO: 31094 - DNA, 20 bp, Artificial
  CRISPR gRNA sequence
ctgggtgctgacattccagg

SEQ ID NO: 31095 - DNA, 20 bp, Artificial
  CRISPR gRNA sequence
tgggtgctgacattccaggg

SEQ ID NO: 31096 - DNA, 20 bp, Artificial
  CRISPR gRNA sequence
ggtgctgacattccaggggg

SEQ ID NO: 31097 - DNA, 20 bp, Artificial
  CRISPR gRNA sequence
acattccaggggggaagata

SEQ ID NO: 31098 - DNA, 20 bp, Artificial
  CRISPR gRNA sequence
caggggggaagatagacaga

SEQ ID NO: 31099 - DNA, 20 bp, Artificial
  CRISPR gRNA sequence
atgtctgagacaatgaatca

SEQ ID NO: 31100 - DNA, 20 bp, Artificial
  CRISPR gRNA sequence
agacaatgaatcatatggaa

SEQ ID NO: 31101 - DNA, 20 bp, Artificial
  CRISPR gRNA sequence
tttttttaaccatgagggga

SEQ ID NO: 31102 - DNA, 20 bp, Artificial
  CRISPR gRNA sequence
ttttttaaccatgaggggaa

SEQ ID NO: 31103 - DNA, 20 bp, Artificial
  CRISPR gRNA sequence
tttttaaccatgaggggaat

SEQ ID NO: 31104 - DNA, 20 bp, Artificial
  CRISPR gRNA sequence
ttttaaccatgaggggaatg

SEQ ID NO: 31105 - DNA, 20 bp, Artificial
  CRISPR gRNA sequence
tttaaccatgaggggaatgg

SEQ ID NO: 31106 - DNA, 20 bp, Artificial
  CRISPR gRNA sequence
ttaaccatgaggggaatgga

SEQ ID NO: 31107 - DNA, 20 bp, Artificial
  CRISPR gRNA sequence
taaccatgaggggaatggag

SEQ ID NO: 31108 - DNA, 20 bp, Artificial
  CRISPR gRNA sequence
aaccatgaggggaatggagt

SEQ ID NO: 31109 - DNA, 20 bp, Artificial
  CRISPR gRNA sequence
accatgaggggaatggagtt

SEQ ID NO: 31110 - DNA, 20 bp, Artificial
  CRISPR gRNA sequence
tatttatttatttatttatt

SEQ ID NO: 31111 - DNA, 20 bp, Artificial
  CRISPR gRNA sequence
tttatttatttatttattta

SEQ ID NO: 31112 - DNA, 20 bp, Artificial
  CRISPR gRNA sequence
atttatttatttatttattt

SEQ ID NO: 31113 - DNA, 20 bp, Artificial
  CRISPR gRNA sequence
tttatttatttatttatttt

SEQ ID NO: 31114 - DNA, 20 bp, Artificial
  CRISPR gRNA sequence
atttatttatttatttttga

SEQ ID NO: 31115 - DNA, 20 bp, Artificial
  CRISPR gRNA sequence
tttatttatttatttttgag

SEQ ID NO: 31116 - DNA, 20 bp, Artificial
  CRISPR gRNA sequence
atttatttatttttgagatg

SEQ ID NO: 31117 - DNA, 20 bp, Artificial
  CRISPR gRNA sequence
tttatttatttttgagatgg

SEQ ID NO: 31118 - DNA, 20 bp, Artificial
  CRISPR gRNA sequence
atttatttttgagatggggt

SEQ ID NO: 31119 - DNA, 20 bp, Artificial
  CRISPR gRNA sequence
tttatttttgagatggggtc

SEQ ID NO: 31120 - DNA, 20 bp, Artificial
  CRISPR gRNA sequence
atttttgagatggggtctca

SEQ ID NO: 31121 - DNA, 20 bp, Artificial
  CRISPR gRNA sequence
tttttgagatggggtctcac

SEQ ID NO: 31122 - DNA, 20 bp, Artificial
  CRISPR gRNA sequence
ttgagatggggtctcactct

SEQ ID NO: 31123 - DNA, 20 bp, Artificial
  CRISPR gRNA sequence
tgagatggggtctcactctg

SEQ ID NO: 31124 - DNA, 20 bp, Artificial
  CRISPR gRNA sequence
gagatggggtctcactctgt

SEQ ID NO: 31125 - DNA, 20 bp, Artificial
  CRISPR gRNA sequence
agatggggtctcactctgtc

SEQ ID NO: 31126 - DNA, 20 bp, Artificial
  CRISPR gRNA sequence
actctgtcatccaagctgga

SEQ ID NO: 31127 - DNA, 20 bp, Artificial
  CRISPR gRNA sequence
tgtcatccaagctggactgc

SEQ ID NO: 31128 - DNA, 20 bp, Artificial
  CRISPR gRNA sequence
tcatccaagctggactgcag

SEQ ID NO: 31129 - DNA, 20 bp, Artificial
  CRISPR gRNA sequence
gactgcagtggcgtgatctc

SEQ ID NO: 31130 - DNA, 20 bp, Artificial
  CRISPR gRNA sequence
cagtggcgtgatctcagctc

SEQ ID NO: 31131 - DNA, 20 bp, Artificial
  CRISPR gRNA sequence
agctcaccgcaacctccgcc

SEQ ID NO: 31132 - DNA, 20 bp, Artificial
  CRISPR gRNA sequence
accgcaacctccgcctcccg

SEQ ID NO: 31133 - DNA, 20 bp, Artificial
  CRISPR gRNA sequence
cgcctcccggtttcaaatga

SEQ ID NO: 31134 - DNA, 20 bp, Artificial
  CRISPR gRNA sequence
ccggtttcaaatgattctcc

SEQ ID NO: 31135 - DNA, 20 bp, Artificial
  CRISPR gRNA sequence
caaatgattctcctgcctca

SEQ ID NO: 31136 - DNA, 20 bp, Artificial
  CRISPR gRNA sequence
aaatgattctcctgcctcag

SEQ ID NO: 31137 - DNA, 20 bp, Artificial
  CRISPR gRNA sequence
tcctgcctcagcctcccaag

SEQ ID NO: 31138 - DNA, 20 bp, Artificial
  CRISPR gRNA sequence
ctgcctcagcctcccaagta

SEQ ID NO: 31139 - DNA, 20 bp, Artificial
  CRISPR gRNA sequence
cctcagcctcccaagtagct

SEQ ID NO: 31140 - DNA, 20 bp, Artificial
  CRISPR gRNA sequence
agcctcccaagtagctgtga

SEQ ID NO: 31141 - DNA, 20 bp, Artificial
  CRISPR gRNA sequence
ccaagtagctgtgactacag

SEQ ID NO: 31142 - DNA, 20 bp, Artificial
  CRISPR gRNA sequence
tgactacaggcacctgccac

SEQ ID NO: 31143 - DNA, 20 bp, Artificial
  CRISPR gRNA sequence
caggcacctgccaccatgcc

SEQ ID NO: 31144 - DNA, 20 bp, Artificial
  CRISPR gRNA sequence
ccaccatgcccagctaattt

SEQ ID NO: 31145 - DNA, 20 bp, Artificial
  CRISPR gRNA sequence
atttgttttgtatatttagt

SEQ ID NO: 31146 - DNA, 20 bp, Artificial
  CRISPR gRNA sequence
gttttgtatatttagtagag

SEQ ID NO: 31147 - DNA, 20 bp, Artificial
  CRISPR gRNA sequence
ttttgtatatttagtagaga

SEQ ID NO: 31148 - DNA, 20 bp, Artificial
  CRISPR gRNA sequence
tgtatatttagtagagatgg

SEQ ID NO: 31149 - DNA, 20 bp, Artificial
  CRISPR gRNA sequence
gtatatttagtagagatggg

SEQ ID NO: 31150 - DNA, 20 bp, Artificial
  CRISPR gRNA sequence
tatatttagtagagatgggg

SEQ ID NO: 31151 - DNA, 20 bp, Artificial
  CRISPR gRNA sequence
agtagagatggggtttcact

SEQ ID NO: 31152 - DNA, 20 bp, Artificial
  CRISPR gRNA sequence
gtagagatggggtttcacta

SEQ ID NO: 31153 - DNA, 20 bp, Artificial
  CRISPR gRNA sequence
cactatgttggccaggctgg

SEQ ID NO: 31154 - DNA, 20 bp, Artificial
  CRISPR gRNA sequence
actatgttggccaggctggt

SEQ ID NO: 31155 - DNA, 20 bp, Artificial
  CRISPR gRNA sequence
tgttggccaggctggtctca

SEQ ID NO: 31156 - DNA, 20 bp, Artificial
  CRISPR gRNA sequence
gccaggctggtctcaaactc

SEQ ID NO: 31157 - DNA, 20 bp, Artificial
  CRISPR gRNA sequence
gtctcaaactcctggccttg

SEQ ID NO: 31158 - DNA, 20 bp, Artificial
  CRISPR gRNA sequence
aaactcctggccttgtgatc

SEQ ID NO: 31159 - DNA, 20 bp, Artificial
  CRISPR gRNA sequence
ctggccttgtgatccacctg

SEQ ID NO: 31160 - DNA, 20 bp, Artificial
  CRISPR gRNA sequence
gccttgtgatccacctgcct

SEQ ID NO: 31161 - DNA, 20 bp, Artificial
  CRISPR gRNA sequence
gtgatccacctgcctcggcc

SEQ ID NO: 31162 - DNA, 20 bp, Artificial
  CRISPR gRNA sequence
tgatccacctgcctcggcct

SEQ ID NO: 31163 - DNA, 20 bp, Artificial
  CRISPR gRNA sequence
cctcggcctcccaaagtgct

SEQ ID NO: 31164 - DNA, 20 bp, Artificial
  CRISPR gRNA sequence
ggcctcccaaagtgctggga

SEQ ID NO: 31165 - DNA, 20 bp, Artificial
  CRISPR gRNA sequence
ccaaagtgctgggattacag

SEQ ID NO: 31166 - DNA, 20 bp, Artificial
  CRISPR gRNA sequence
ggattacaggcataagccac

SEQ ID NO: 31167 - DNA, 20 bp, Artificial
  CRISPR gRNA sequence
caggcataagccactgcgcc

SEQ ID NO: 31168 - DNA, 20 bp, Artificial
  CRISPR gRNA sequence
cgcctggccagagttttatt

SEQ ID NO: 31169 - DNA, 20 bp, Artificial
  CRISPR gRNA sequence
gccagagttttatttttaac

SEQ ID NO: 31170 - DNA, 20 bp, Artificial
  CRISPR gRNA sequence
tatttttaactgtgagggtc

SEQ ID NO: 31171 - DNA, 20 bp, Artificial
  CRISPR gRNA sequence
atttttaactgtgagggtca

SEQ ID NO: 31172 - DNA, 20 bp, Artificial
  CRISPR gRNA sequence
tttttaactgtgagggtcag

SEQ ID NO: 31173 - DNA, 20 bp, Artificial
  CRISPR gRNA sequence
ttaactgtgagggtcagaaa

SEQ ID NO: 31174 - DNA, 20 bp, Artificial
  CRISPR gRNA sequence
taactgtgagggtcagaaaa

SEQ ID NO: 31175 - DNA, 20 bp, Artificial
  CRISPR gRNA sequence
aactgtgagggtcagaaaag

SEQ ID NO: 31176 - DNA, 20 bp, Artificial
  CRISPR gRNA sequence
actgtgagggtcagaaaaga

SEQ ID NO: 31177 - DNA, 20 bp, Artificial
  CRISPR gRNA sequence
tgagggtcagaaaagacctc

SEQ ID NO: 31178 - DNA, 20 bp, Artificial
  CRISPR gRNA sequence
actgaggccgggtgtggtgg

SEQ ID NO: 31179 - DNA, 20 bp, Artificial
  CRISPR gRNA sequence
aggccgggtgtggtggctca

SEQ ID NO: 31180 - DNA, 20 bp, Artificial
  CRISPR gRNA sequence
acgcctgtaatcccagcact

SEQ ID NO: 31181 - DNA, 20 bp, Artificial
  CRISPR gRNA sequence
taatcccagcactttgggag

SEQ ID NO: 31182 - DNA, 20 bp, Artificial
  CRISPR gRNA sequence
tgggaggccgaggtgggggg

SEQ ID NO: 31183 - DNA, 20 bp, Artificial
  CRISPR gRNA sequence
gggaggccgaggtgggggga

SEQ ID NO: 31184 - DNA, 20 bp, Artificial
  CRISPR gRNA sequence
ggaggccgaggtggggggat

SEQ ID NO: 31185 - DNA, 20 bp, Artificial
  CRISPR gRNA sequence
agaccatcctggctaacacg

SEQ ID NO: 31186 - DNA, 20 bp, Artificial
  CRISPR gRNA sequence
gctaacacggtgaaaccccg

SEQ ID NO: 31187 - DNA, 20 bp, Artificial
  CRISPR gRNA sequence
acacggtgaaaccccgtctc

SEQ ID NO: 31188 - DNA, 20 bp, Artificial
  CRISPR gRNA sequence
tactaaaaatacaaaaaatt

SEQ ID NO: 31189 - DNA, 20 bp, Artificial
  CRISPR gRNA sequence
ctaaaaatacaaaaaattag

SEQ ID NO: 31190 - DNA, 20 bp, Artificial
  CRISPR gRNA sequence
aaaatacaaaaaattagcca

SEQ ID NO: 31191 - DNA, 20 bp, Artificial
  CRISPR gRNA sequence
gccagatgtggtgacatgtg

SEQ ID NO: 31192 - DNA, 20 bp, Artificial
  CRISPR gRNA sequence
tagtcccagctactcgggag

SEQ ID NO: 31193 - DNA, 20 bp, Artificial
  CRISPR gRNA sequence
ctcgggaggctgaggcaaga

SEQ ID NO: 31194 - DNA, 20 bp, Artificial
  CRISPR gRNA sequence
gggaggctgaggcaagagaa

SEQ ID NO: 31195 - DNA, 20 bp, Artificial
  CRISPR gRNA sequence
aggcaagagaatcacttgga

SEQ ID NO: 31196 - DNA, 20 bp, Artificial
  CRISPR gRNA sequence
ggacttgggaggaggaggtt

SEQ ID NO: 31197 - DNA, 20 bp, Artificial
  CRISPR gRNA sequence
gacttgggaggaggaggttg

SEQ ID NO: 31198 - DNA, 20 bp, Artificial
  CRISPR gRNA sequence
gggaggaggaggttgcagtg

SEQ ID NO: 31199 - DNA, 20 bp, Artificial
  CRISPR gRNA sequence
ggaggaggaggttgcagtga

SEQ ID NO: 31200 - DNA, 20 bp, Artificial
  CRISPR gRNA sequence
cagtgagtcgagattgtgcc

SEQ ID NO: 31201 - DNA, 20 bp, Artificial
  CRISPR gRNA sequence
tgccactgcactccagcctg

SEQ ID NO: 31202 - DNA, 20 bp, Artificial
  CRISPR gRNA sequence
cactccagcctgggtgacag

SEQ ID NO: 31203 - DNA, 20 bp, Artificial
  CRISPR gRNA sequence
cagcctgggtgacagagcga

SEQ ID NO: 31204 - DNA, 20 bp, Artificial
  CRISPR gRNA sequence
ggtgacagagcgagactcca

SEQ ID NO: 31205 - DNA, 20 bp, Artificial
  CRISPR gRNA sequence
cacctcaaaaaaagaaaaag

SEQ ID NO: 31206 - DNA, 20 bp, Artificial
  CRISPR gRNA sequence
aaaaaaagaaaaagaaaaaa

SEQ ID NO: 31207 - DNA, 20 bp, Artificial
  CRISPR gRNA sequence
actgagtaaagaccagagga

SEQ ID NO: 31208 - DNA, 20 bp, Artificial
  CRISPR gRNA sequence
agtaaagaccagaggaggtg

SEQ ID NO: 31209 - DNA, 20 bp, Artificial
  CRISPR gRNA sequence
gggagaagtattccaggcag

SEQ ID NO: 31210 - DNA, 20 bp, Artificial
  CRISPR gRNA sequence
caggcagagggcacagccgg

SEQ ID NO: 31211 - DNA, 20 bp, Artificial
  CRISPR gRNA sequence
gaggcagaagcatgcctagg

SEQ ID NO: 31212 - DNA, 20 bp, Artificial
  CRISPR gRNA sequence
ggaggttgaaagccagcaag

SEQ ID NO: 31213 - DNA, 20 bp, Artificial
  CRISPR gRNA sequence
aaagccagcaaggaggccct

SEQ ID NO: 31214 - DNA, 20 bp, Artificial
  CRISPR gRNA sequence
tggctggaatggagagagca

SEQ ID NO: 31215 - DNA, 20 bp, Artificial
  CRISPR gRNA sequence
gaatggagagagcacccagc

SEQ ID NO: 31216 - DNA, 20 bp, Artificial
  CRISPR gRNA sequence
aactggggaaggactctgtg

SEQ ID NO: 31217 - DNA, 20 bp, Artificial
  CRISPR gRNA sequence
gggaaggactctgtgtacaa

SEQ ID NO: 31218 - DNA, 20 bp, Artificial
  CRISPR gRNA sequence
tgtgtacaaacgaagtccct

SEQ ID NO: 31219 - DNA, 20 bp, Artificial
  CRISPR gRNA sequence
tgtacaaacgaagtccctgt

SEQ ID NO: 31220 - DNA, 20 bp, Artificial
  CRISPR gRNA sequence
tagggttgtgagtggctaag

SEQ ID NO: 31221 - DNA, 20 bp, Artificial
  CRISPR gRNA sequence
tgagtggctaagaaccctga

SEQ ID NO: 31222 - DNA, 20 bp, Artificial
  CRISPR gRNA sequence
agaaccctgatttgacagac

SEQ ID NO: 31223 - DNA, 20 bp, Artificial
  CRISPR gRNA sequence
atttgacagacagatgaggt

SEQ ID NO: 31224 - DNA, 20 bp, Artificial
  CRISPR gRNA sequence
gacagacagatgaggtctac

SEQ ID NO: 31225 - DNA, 20 bp, Artificial
  CRISPR gRNA sequence
acagacagatgaggtctaca

SEQ ID NO: 31226 - DNA, 20 bp, Artificial
  CRISPR gRNA sequence
cagggtgcctgggcacagta

SEQ ID NO: 31227 - DNA, 20 bp, Artificial
  CRISPR gRNA sequence
ggcacagtagaagcctgaga

SEQ ID NO: 31228 - DNA, 20 bp, Artificial
  CRISPR gRNA sequence
agaaaatgccagaaatagtc

SEQ ID NO: 31229 - DNA, 20 bp, Artificial
  CRISPR gRNA sequence
ttccttccttccttccttcc

SEQ ID NO: 31230 - DNA, 20 bp, Artificial
  CRISPR gRNA sequence
tccttccttccttccttcct

SEQ ID NO: 31231 - DNA, 20 bp, Artificial
  CRISPR gRNA sequence
ccttccttccttccttcctc

SEQ ID NO: 31232 - DNA, 20 bp, Artificial
  CRISPR gRNA sequence
cttccttccttccttcctca

SEQ ID NO: 31233 - DNA, 20 bp, Artificial
  CRISPR gRNA sequence
ccttccttccttcctcagaa

SEQ ID NO: 31234 - DNA, 20 bp, Artificial
  CRISPR gRNA sequence
cttccttccttcctcagaac

SEQ ID NO: 31235 - DNA, 20 bp, Artificial
  CRISPR gRNA sequence
ccttccttcctcagaacctc

SEQ ID NO: 31236 - DNA, 20 bp, Artificial
  CRISPR gRNA sequence
cttccttcctcagaacctcc

SEQ ID NO: 31237 - DNA, 20 bp, Artificial
  CRISPR gRNA sequence
ccttcctcagaacctcctcg

SEQ ID NO: 31238 - DNA, 20 bp, Artificial
  CRISPR gRNA sequence
cttcctcagaacctcctcgg

SEQ ID NO: 31239 - DNA, 20 bp, Artificial
  CRISPR gRNA sequence
cctcagaacctcctcggggg

SEQ ID NO: 31240 - DNA, 20 bp, Artificial
  CRISPR gRNA sequence
ctcagaacctcctcgggggc

SEQ ID NO: 31241 - DNA, 20 bp, Artificial
  CRISPR gRNA sequence
agaacctcctcgggggcttc

SEQ ID NO: 31242 - DNA, 20 bp, Artificial
  CRISPR gRNA sequence
ctcgggggcttccggtctcc

SEQ ID NO: 31243 - DNA, 20 bp, Artificial
  CRISPR gRNA sequence
gggggcttccggtctccagg

SEQ ID NO: 31244 - DNA, 20 bp, Artificial
  CRISPR gRNA sequence
ccggtctccaggtggctgat

SEQ ID NO: 31245 - DNA, 20 bp, Artificial
  CRISPR gRNA sequence
cggtctccaggtggctgatc

SEQ ID NO: 31246 - DNA, 20 bp, Artificial
  CRISPR gRNA sequence
caggtggctgatcacccggc

SEQ ID NO: 31247 - DNA, 20 bp, Artificial
  CRISPR gRNA sequence
atcacccggctctaggctgt

SEQ ID NO: 31248 - DNA, 20 bp, Artificial
  CRISPR gRNA sequence
taggctgttccaccccatgg

SEQ ID NO: 31249 - DNA, 20 bp, Artificial
  CRISPR gRNA sequence
ggctgttccaccccatggcc

SEQ ID NO: 31250 - DNA, 20 bp, Artificial
  CRISPR gRNA sequence
ttccaccccatggccgctgt

SEQ ID NO: 31251 - DNA, 20 bp, Artificial
  CRISPR gRNA sequence
caccccatggccgctgttcc

SEQ ID NO: 31252 - DNA, 20 bp, Artificial
  CRISPR gRNA sequence
ttccccagagcgcagttccg

SEQ ID NO: 31253 - DNA, 20 bp, Artificial
  CRISPR gRNA sequence
cccagagcgcagttccgatc

SEQ ID NO: 31254 - DNA, 20 bp, Artificial
  CRISPR gRNA sequence
cgatcttgaactaggggctt

SEQ ID NO: 31255 - DNA, 20 bp, Artificial
  CRISPR gRNA sequence
gaactaggggctttttcagc

SEQ ID NO: 31256 - DNA, 20 bp, Artificial
  CRISPR gRNA sequence
aactaggggctttttcagct

SEQ ID NO: 31257 - DNA, 20 bp, Artificial
  CRISPR gRNA sequence
ggggctttttcagctgaaaa

SEQ ID NO: 31258 - DNA, 20 bp, Artificial
  CRISPR gRNA sequence
tttcagctgaaaataattta

SEQ ID NO: 31259 - DNA, 20 bp, Artificial
  CRISPR gRNA sequence
ttcagctgaaaataatttaa

SEQ ID NO: 31260 - DNA, 20 bp, Artificial
  CRISPR gRNA sequence
tcagctgaaaataatttaag

SEQ ID NO: 31261 - DNA, 20 bp, Artificial
  CRISPR gRNA sequence
cagctgaaaataatttaagg

SEQ ID NO: 31262 - DNA, 20 bp, Artificial
  CRISPR gRNA sequence
agctgaaaataatttaaggc

SEQ ID NO: 31263 - DNA, 20 bp, Artificial
  CRISPR gRNA sequence
aaaataatttaaggccagaa

SEQ ID NO: 31264 - DNA, 20 bp, Artificial
  CRISPR gRNA sequence
aaggccagaaagggccctca

SEQ ID NO: 31265 - DNA, 20 bp, Artificial
  CRISPR gRNA sequence
aggccagaaagggccctcag

SEQ ID NO: 31266 - DNA, 20 bp, Artificial
  CRISPR gRNA sequence
agttattgttttcagacatt

SEQ ID NO: 31267 - DNA, 20 bp, Artificial
  CRISPR gRNA sequence
ttgttttcagacatttcccc

SEQ ID NO: 31268 - DNA, 20 bp, Artificial
  CRISPR gRNA sequence
ttttcagacatttccccttt

SEQ ID NO: 31269 - DNA, 20 bp, Artificial
  CRISPR gRNA sequence
tcagacatttccccttttca

SEQ ID NO: 31270 - DNA, 20 bp, Artificial
  CRISPR gRNA sequence
cagacatttccccttttcag

SEQ ID NO: 31271 - DNA, 20 bp, Artificial
  CRISPR gRNA sequence
agacatttccccttttcagc

SEQ ID NO: 31272 - DNA, 20 bp, Artificial
  CRISPR gRNA sequence
ccccttttcagcatcatttt

SEQ ID NO: 31273 - DNA, 20 bp, Artificial
  CRISPR gRNA sequence
cccttttcagcatcattttt

SEQ ID NO: 31274 - DNA, 20 bp, Artificial
  CRISPR gRNA sequence
ttcagcatcatttttacctc

SEQ ID NO: 31275 - DNA, 20 bp, Artificial
  CRISPR gRNA sequence
tcagcatcatttttacctct

SEQ ID NO: 31276 - DNA, 20 bp, Artificial
  CRISPR gRNA sequence
cagcatcatttttacctctg

SEQ ID NO: 31277 - DNA, 20 bp, Artificial
  CRISPR gRNA sequence
agcatcatttttacctctgg

SEQ ID NO: 31278 - DNA, 20 bp, Artificial
  CRISPR gRNA sequence
ttacctctggacaaatttag

SEQ ID NO: 31279 - DNA, 20 bp, Artificial
  CRISPR gRNA sequence
tacctctggacaaatttagc

SEQ ID NO: 31280 - DNA, 20 bp, Artificial
  CRISPR gRNA sequence
acctctggacaaatttagca

SEQ ID NO: 31281 - DNA, 20 bp, Artificial
  CRISPR gRNA sequence
cctctggacaaatttagcac

SEQ ID NO: 31282 - DNA, 20 bp, Artificial
  CRISPR gRNA sequence
tggacaaatttagcaccttg

SEQ ID NO: 31283 - DNA, 20 bp, Artificial
  CRISPR gRNA sequence
gacaaatttagcaccttgtc

SEQ ID NO: 31284 - DNA, 20 bp, Artificial
  CRISPR gRNA sequence
agcaccttgtctctgttcaa

SEQ ID NO: 31285 - DNA, 20 bp, Artificial
  CRISPR gRNA sequence
gcaccttgtctctgttcaaa

SEQ ID NO: 31286 - DNA, 20 bp, Artificial
  CRISPR gRNA sequence
gtctctgttcaaaacaagag

SEQ ID NO: 31287 - DNA, 20 bp, Artificial
  CRISPR gRNA sequence
tctctgttcaaaacaagaga

SEQ ID NO: 31288 - DNA, 20 bp, Artificial
  CRISPR gRNA sequence
tgttcaaaacaagagacact

SEQ ID NO: 31289 - DNA, 20 bp, Artificial
  CRISPR gRNA sequence
ttcaaaacaagagacactgg

SEQ ID NO: 31290 - DNA, 20 bp, Artificial
  CRISPR gRNA sequence
aaaacaagagacactggctt

SEQ ID NO: 31291 - DNA, 20 bp, Artificial
  CRISPR gRNA sequence
gcttttttctggggcacagg

SEQ ID NO: 31292 - DNA, 20 bp, Artificial
  CRISPR gRNA sequence
ttttctggggcacaggggag

SEQ ID NO: 31293 - DNA, 20 bp, Artificial
  CRISPR gRNA sequence
tttctggggcacaggggagc

SEQ ID NO: 31294 - DNA, 20 bp, Artificial
  CRISPR gRNA sequence
ttctggggcacaggggagca

SEQ ID NO: 31295 - DNA, 20 bp, Artificial
  CRISPR gRNA sequence
tctggggcacaggggagcag

SEQ ID NO: 31296 - DNA, 20 bp, Artificial
  CRISPR gRNA sequence
ctggggcacaggggagcagt

SEQ ID NO: 31297 - DNA, 20 bp, Artificial
  CRISPR gRNA sequence
tggggcacaggggagcagtg

SEQ ID NO: 31298 - DNA, 20 bp, Artificial
  CRISPR gRNA sequence
gggcacaggggagcagtgat

SEQ ID NO: 31299 - DNA, 20 bp, Artificial
  CRISPR gRNA sequence
atagcttgtgggtgaccagc

SEQ ID NO: 31300 - DNA, 20 bp, Artificial
  CRISPR gRNA sequence
gtgggtgaccagctggggga

SEQ ID NO: 31301 - DNA, 20 bp, Artificial
  CRISPR gRNA sequence
tgggtgaccagctgggggac

SEQ ID NO: 31302 - DNA, 20 bp, Artificial
  CRISPR gRNA sequence
ggggaccacgggcaagtcac

SEQ ID NO: 31303 - DNA, 20 bp, Artificial
  CRISPR gRNA sequence
aacctcaccaggcctccgtc

SEQ ID NO: 31304 - DNA, 20 bp, Artificial
  CRISPR gRNA sequence
acctcaccaggcctccgtct

SEQ ID NO: 31305 - DNA, 20 bp, Artificial
  CRISPR gRNA sequence
accaggcctccgtctcctca

SEQ ID NO: 31306 - DNA, 20 bp, Artificial
  CRISPR gRNA sequence
cgtctcctcatctgtaaaat

SEQ ID NO: 31307 - DNA, 20 bp, Artificial
  CRISPR gRNA sequence
ctcatctgtaaaatggggaa

SEQ ID NO: 31308 - DNA, 20 bp, Artificial
  CRISPR gRNA sequence
atctgtaaaatggggaagat

SEQ ID NO: 31309 - DNA, 20 bp, Artificial
  CRISPR gRNA sequence
taaaatggggaagatgatga

SEQ ID NO: 31310 - DNA, 20 bp, Artificial
  CRISPR gRNA sequence
tctgtcttccacagtagctc

SEQ ID NO: 31311 - DNA, 20 bp, Artificial
  CRISPR gRNA sequence
tcttccacagtagctcttga

SEQ ID NO: 31312 - DNA, 20 bp, Artificial
  CRISPR gRNA sequence
ccacagtagctcttgagatt

SEQ ID NO: 31313 - DNA, 20 bp, Artificial
  CRISPR gRNA sequence
cacagtagctcttgagatta

SEQ ID NO: 31314 - DNA, 20 bp, Artificial
  CRISPR gRNA sequence
ttgagattaatgagattata

SEQ ID NO: 31315 - DNA, 20 bp, Artificial
  CRISPR gRNA sequence
gagattaatgagattatata

SEQ ID NO: 31316 - DNA, 20 bp, Artificial
  CRISPR gRNA sequence
agattaatgagattatatat

SEQ ID NO: 31317 - DNA, 20 bp, Artificial
  CRISPR gRNA sequence
atgagattatatataaaatg

SEQ ID NO: 31318 - DNA, 20 bp, Artificial
  CRISPR gRNA sequence
tatataaaatgcactgaatt

SEQ ID NO: 31319 - DNA, 20 bp, Artificial
  CRISPR gRNA sequence
aattataagctgggcatggt

SEQ ID NO: 31320 - DNA, 20 bp, Artificial
  CRISPR gRNA sequence
taagctgggcatggtggctt

SEQ ID NO: 31321 - DNA, 20 bp, Artificial
  CRISPR gRNA sequence
ggcatggtggcttacacctg

SEQ ID NO: 31322 - DNA, 20 bp, Artificial
  CRISPR gRNA sequence
acacctgtaatcccagcact

SEQ ID NO: 31323 - DNA, 20 bp, Artificial
  CRISPR gRNA sequence
cacctgtaatcccagcactt

SEQ ID NO: 31324 - DNA, 20 bp, Artificial
  CRISPR gRNA sequence
taatcccagcactttgggag

SEQ ID NO: 31325 - DNA, 20 bp, Artificial
  CRISPR gRNA sequence
tgggaggctgaggtgggagg

SEQ ID NO: 31326 - DNA, 20 bp, Artificial
  CRISPR gRNA sequence
gggaggctgaggtgggagga

SEQ ID NO: 31327 - DNA, 20 bp, Artificial
  CRISPR gRNA sequence
ggaggctgaggtgggaggaa

SEQ ID NO: 31328 - DNA, 20 bp, Artificial
  CRISPR gRNA sequence
aggtgggaggaacatctgag

SEQ ID NO: 31329 - DNA, 20 bp, Artificial
  CRISPR gRNA sequence
aggccaggagttcaagacca

SEQ ID NO: 31330 - DNA, 20 bp, Artificial
  CRISPR gRNA sequence
aagaccagcctggccaacat

SEQ ID NO: 31331 - DNA, 20 bp, Artificial
  CRISPR gRNA sequence
gccaacatggttaaagcccg

SEQ ID NO: 31332 - DNA, 20 bp, Artificial
  CRISPR gRNA sequence
aagcccgtctctactaaaaa

SEQ ID NO: 31333 - DNA, 20 bp, Artificial
  CRISPR gRNA sequence
tactaaaaatacaaaaatta

SEQ ID NO: 31334 - DNA, 20 bp, Artificial
  CRISPR gRNA sequence
ctaaaaatacaaaaattagc

SEQ ID NO: 31335 - DNA, 20 bp, Artificial
  CRISPR gRNA sequence
aaaatacaaaaattagccag

SEQ ID NO: 31336 - DNA, 20 bp, Artificial
  CRISPR gRNA sequence
gccaggtgtagtggtgtaca

SEQ ID NO: 31337 - DNA, 20 bp, Artificial
  CRISPR gRNA sequence
taatcccagctactcgggag

SEQ ID NO: 31338 - DNA, 20 bp, Artificial
  CRISPR gRNA sequence
ctcgggaggctgaggcagga

SEQ ID NO: 31339 - DNA, 20 bp, Artificial
  CRISPR gRNA sequence
gggaggctgaggcaggaaaa

SEQ ID NO: 31340 - DNA, 20 bp, Artificial
  CRISPR gRNA sequence
aggcaggaaaattgcttgaa

SEQ ID NO: 31341 - DNA, 20 bp, Artificial
  CRISPR gRNA sequence
cttgaaccgagaggtggaga

SEQ ID NO: 31342 - DNA, 20 bp, Artificial
  CRISPR gRNA sequence
gaaccgagaggtggagattg

SEQ ID NO: 31343 - DNA, 20 bp, Artificial
  CRISPR gRNA sequence
aaccgagaggtggagattgc

SEQ ID NO: 31344 - DNA, 20 bp, Artificial
  CRISPR gRNA sequence
cagtgagccaagatcatacc

SEQ ID NO: 31345 - DNA, 20 bp, Artificial
  CRISPR gRNA sequence
cattctagcctgggtgacag

SEQ ID NO: 31346 - DNA, 20 bp, Artificial
  CRISPR gRNA sequence
tagcctgggtgacagagcaa

SEQ ID NO: 31347 - DNA, 20 bp, Artificial
  CRISPR gRNA sequence
gcctgggtgacagagcaaga

SEQ ID NO: 31348 - DNA, 20 bp, Artificial
  CRISPR gRNA sequence
ggtgacagagcaagacccca

SEQ ID NO: 31349 - DNA, 20 bp, Artificial
  CRISPR gRNA sequence
caaaaaaaaacagcaccgaa

SEQ ID NO: 31350 - DNA, 20 bp, Artificial
  CRISPR gRNA sequence
cttcctaatcattagatgat

SEQ ID NO: 31351 - DNA, 20 bp, Artificial
  CRISPR gRNA sequence
cctaatcattagatgatcta

SEQ ID NO: 31352 - DNA, 20 bp, Artificial
  CRISPR gRNA sequence
ctaatcattagatgatctag

SEQ ID NO: 31353 - DNA, 20 bp, Artificial
  CRISPR gRNA sequence
atcattagatgatctagacc

SEQ ID NO: 31354 - DNA, 20 bp, Artificial
  CRISPR gRNA sequence
gatgatctagacccctacca

SEQ ID NO: 31355 - DNA, 20 bp, Artificial
  CRISPR gRNA sequence
gacccctaccaaggaacaaa

SEQ ID NO: 31356 - DNA, 20 bp, Artificial
  CRISPR gRNA sequence
ccaaggaacaaacattcatt

SEQ ID NO: 31357 - DNA, 20 bp, Artificial
  CRISPR gRNA sequence
atttagctttttctgtggaa

SEQ ID NO: 31358 - DNA, 20 bp, Artificial
  CRISPR gRNA sequence
agctttttctgtggaaggag

SEQ ID NO: 31359 - DNA, 20 bp, Artificial
  CRISPR gRNA sequence
gctttttctgtggaaggagc

SEQ ID NO: 31360 - DNA, 20 bp, Artificial
  CRISPR gRNA sequence
tttctgtggaaggagcttag

SEQ ID NO: 31361 - DNA, 20 bp, Artificial
  CRISPR gRNA sequence
ttctgtggaaggagcttagg

SEQ ID NO: 31362 - DNA, 20 bp, Artificial
  CRISPR gRNA sequence
tctgtggaaggagcttaggg

SEQ ID NO: 31363 - DNA, 20 bp, Artificial
  CRISPR gRNA sequence
ctgtggaaggagcttagggc

SEQ ID NO: 31364 - DNA, 20 bp, Artificial
  CRISPR gRNA sequence
tgtggaaggagcttagggcc

SEQ ID NO: 31365 - DNA, 20 bp, Artificial
  CRISPR gRNA sequence
tggaaggagcttagggccag

SEQ ID NO: 31366 - DNA, 20 bp, Artificial
  CRISPR gRNA sequence
agggccaggctgacctgacc

SEQ ID NO: 31367 - DNA, 20 bp, Artificial
  CRISPR gRNA sequence
gggccaggctgacctgacct

SEQ ID NO: 31368 - DNA, 20 bp, Artificial
  CRISPR gRNA sequence
acctgacctttatgactttg

SEQ ID NO: 31369 - DNA, 20 bp, Artificial
  CRISPR gRNA sequence
acctttatgactttggataa

SEQ ID NO: 31370 - DNA, 20 bp, Artificial
  CRISPR gRNA sequence
tatgactttggataaacaat

SEQ ID NO: 31371 - DNA, 20 bp, Artificial
  CRISPR gRNA sequence
atgactttggataaacaatt

SEQ ID NO: 31372 - DNA, 20 bp, Artificial
  CRISPR gRNA sequence
tgactttggataaacaattt

SEQ ID NO: 31373 - DNA, 20 bp, Artificial
  CRISPR gRNA sequence
tggataaacaatttaaagtc

SEQ ID NO: 31374 - DNA, 20 bp, Artificial
  CRISPR gRNA sequence
ggataaacaatttaaagtct

SEQ ID NO: 31375 - DNA, 20 bp, Artificial
  CRISPR gRNA sequence
gataaacaatttaaagtctc

SEQ ID NO: 31376 - DNA, 20 bp, Artificial
  CRISPR gRNA sequence
aaagtctcttgttctcagca

SEQ ID NO: 31377 - DNA, 20 bp, Artificial
  CRISPR gRNA sequence
aagtctcttgttctcagcat

SEQ ID NO: 31378 - DNA, 20 bp, Artificial
  CRISPR gRNA sequence
ttgttctcagcattgccatt

SEQ ID NO: 31379 - DNA, 20 bp, Artificial
  CRISPR gRNA sequence
gttctcagcattgccatttg

SEQ ID NO: 31380 - DNA, 20 bp, Artificial
  CRISPR gRNA sequence
ttctcagcattgccatttgt

SEQ ID NO: 31381 - DNA, 20 bp, Artificial
  CRISPR gRNA sequence
tcagcattgccatttgtaca

SEQ ID NO: 31382 - DNA, 20 bp, Artificial
  CRISPR gRNA sequence
agcattgccatttgtacaat

SEQ ID NO: 31383 - DNA, 20 bp, Artificial
  CRISPR gRNA sequence
ccatttgtacaatggggaga

SEQ ID NO: 31384 - DNA, 20 bp, Artificial
  CRISPR gRNA sequence
gtacaatggggagatgatga

SEQ ID NO: 31385 - DNA, 20 bp, Artificial
  CRISPR gRNA sequence
tacaatggggagatgatgac

SEQ ID NO: 31386 - DNA, 20 bp, Artificial
  CRISPR gRNA sequence
tagaggagggtggcctgaga

SEQ ID NO: 31387 - DNA, 20 bp, Artificial
  CRISPR gRNA sequence
agataattgagatggaaggt

SEQ ID NO: 31388 - DNA, 20 bp, Artificial
  CRISPR gRNA sequence
agatggaaggtgagctgcaa

SEQ ID NO: 31389 - DNA, 20 bp, Artificial
  CRISPR gRNA sequence
caaatttaaaagcctgttct

SEQ ID NO: 31390 - DNA, 20 bp, Artificial
  CRISPR gRNA sequence
aaaagcctgttctggccagg

SEQ ID NO: 31391 - DNA, 20 bp, Artificial
  CRISPR gRNA sequence
aaagcctgttctggccaggt

SEQ ID NO: 31392 - DNA, 20 bp, Artificial
  CRISPR gRNA sequence
ttctggccaggtgcgggagc

SEQ ID NO: 31393 - DNA, 20 bp, Artificial
  CRISPR gRNA sequence
tggccaggtgcgggagctcg

SEQ ID NO: 31394 - DNA, 20 bp, Artificial
  CRISPR gRNA sequence
gccaggtgcgggagctcgca

SEQ ID NO: 31395 - DNA, 20 bp, Artificial
  CRISPR gRNA sequence
gcacctgtaatcctagcact

SEQ ID NO: 31396 - DNA, 20 bp, Artificial
  CRISPR gRNA sequence
taatcctagcactttgggag

SEQ ID NO: 31397 - DNA, 20 bp, Artificial
  CRISPR gRNA sequence
gcactttgggaggctgaggt

SEQ ID NO: 31398 - DNA, 20 bp, Artificial
  CRISPR gRNA sequence
tgggaggctgaggtgggagg

SEQ ID NO: 31399 - DNA, 20 bp, Artificial
  CRISPR gRNA sequence
gggaggctgaggtgggagga

SEQ ID NO: 31400 - DNA, 20 bp, Artificial
  CRISPR gRNA sequence
ggaggctgaggtgggaggat

SEQ ID NO: 31401 - DNA, 20 bp, Artificial
  CRISPR gRNA sequence
aggtgggaggattgcttgag

SEQ ID NO: 31402 - DNA, 20 bp, Artificial
  CRISPR gRNA sequence
cttgagcccaggagctcgag

SEQ ID NO: 31403 - DNA, 20 bp, Artificial
  CRISPR gRNA sequence
gagcccaggagctcgagacc

SEQ ID NO: 31404 - DNA, 20 bp, Artificial
  CRISPR gRNA sequence
agcccaggagctcgagacca

SEQ ID NO: 31405 - DNA, 20 bp, Artificial
  CRISPR gRNA sequence
gagaccagactgggcaacat

SEQ ID NO: 31406 - DNA, 20 bp, Artificial
  CRISPR gRNA sequence
ggcaacatggtgaaatcctg

SEQ ID NO: 31407 - DNA, 20 bp, Artificial
  CRISPR gRNA sequence
tctctacaaaaaatacaaaa

SEQ ID NO: 31408 - DNA, 20 bp, Artificial
  CRISPR gRNA sequence
tacaaaaaatacaaaaatta

SEQ ID NO: 31409 - DNA, 20 bp, Artificial
  CRISPR gRNA sequence
caaaaaatacaaaaattagt

SEQ ID NO: 31410 - DNA, 20 bp, Artificial
  CRISPR gRNA sequence
gtcaggtggggcatgcctgt

SEQ ID NO: 31411 - DNA, 20 bp, Artificial
  CRISPR gRNA sequence
tagtcccagctactagggag

SEQ ID NO: 31412 - DNA, 20 bp, Artificial
  CRISPR gRNA sequence
ctagggaggctgaggtggga

SEQ ID NO: 31413 - DNA, 20 bp, Artificial
  CRISPR gRNA sequence
gggaggctgaggtgggagga

SEQ ID NO: 31414 - DNA, 20 bp, Artificial
  CRISPR gRNA sequence
aggtgggaggatcacttgag

SEQ ID NO: 31415 - DNA, 20 bp, Artificial
  CRISPR gRNA sequence
gagcctagggaggttgaggc

SEQ ID NO: 31416 - DNA, 20 bp, Artificial
  CRISPR gRNA sequence
agcctagggaggttgaggct

SEQ ID NO: 31417 - DNA, 20 bp, Artificial
  CRISPR gRNA sequence
gggaggttgaggctgtggtg

SEQ ID NO: 31418 - DNA, 20 bp, Artificial
  CRISPR gRNA sequence
aggctgtggtgagctgtgat

SEQ ID NO: 31419 - DNA, 20 bp, Artificial
  CRISPR gRNA sequence
tggtgagctgtgattgtgcc

SEQ ID NO: 31420 - DNA, 20 bp, Artificial
  CRISPR gRNA sequence
tgattgtgccactgaactcc

SEQ ID NO: 31421 - DNA, 20 bp, Artificial
  CRISPR gRNA sequence
tgccactgaactccagcctg

SEQ ID NO: 31422 - DNA, 20 bp, Artificial
  CRISPR gRNA sequence
aactccagcctgagggacag

SEQ ID NO: 31423 - DNA, 20 bp, Artificial
  CRISPR gRNA sequence
cagcctgagggacagagtaa

SEQ ID NO: 31424 - DNA, 20 bp, Artificial
  CRISPR gRNA sequence
agggacagagtaagactctg

SEQ ID NO: 31425 - DNA, 20 bp, Artificial
  CRISPR gRNA sequence
tgcctcaagaaagaaaagaa

SEQ ID NO: 31426 - DNA, 20 bp, Artificial
  CRISPR gRNA sequence
cctcaagaaagaaaagaaaa

SEQ ID NO: 31427 - DNA, 20 bp, Artificial
  CRISPR gRNA sequence
aagaaagaaaagaaaaggaa

SEQ ID NO: 31428 - DNA, 20 bp, Artificial
  CRISPR gRNA sequence
tattctgacagatctaaata

SEQ ID NO: 31429 - DNA, 20 bp, Artificial
  CRISPR gRNA sequence
tgacagatctaaatataata

SEQ ID NO: 31430 - DNA, 20 bp, Artificial
  CRISPR gRNA sequence
acagatctaaatataataat

SEQ ID NO: 31431 - DNA, 20 bp, Artificial
  CRISPR gRNA sequence
aatataataattattgtgct

SEQ ID NO: 31432 - DNA, 20 bp, Artificial
  CRISPR gRNA sequence
ttgtgctttcttggggccca

SEQ ID NO: 31433 - DNA, 20 bp, Artificial
  CRISPR gRNA sequence
tgctttcttggggcccatgt

SEQ ID NO: 31434 - DNA, 20 bp, Artificial
  CRISPR gRNA sequence
tcttggggcccatgtatggt

SEQ ID NO: 31435 - DNA, 20 bp, Artificial
  CRISPR gRNA sequence
cttggggcccatgtatggtg

SEQ ID NO: 31436 - DNA, 20 bp, Artificial
  CRISPR gRNA sequence
ttggggcccatgtatggtgg

SEQ ID NO: 31437 - DNA, 20 bp, Artificial
  CRISPR gRNA sequence
ggggcccatgtatggtgggc

SEQ ID NO: 31438 - DNA, 20 bp, Artificial
  CRISPR gRNA sequence
gggcccatgtatggtgggct

SEQ ID NO: 31439 - DNA, 20 bp, Artificial
  CRISPR gRNA sequence
cccctcctcagtgacccaga

SEQ ID NO: 31440 - DNA, 20 bp, Artificial
  CRISPR gRNA sequence
ctcagtgacccagacacaac

SEQ ID NO: 31441 - DNA, 20 bp, Artificial
  CRISPR gRNA sequence
agtgacccagacacaactgg

SEQ ID NO: 31442 - DNA, 20 bp, Artificial
  CRISPR gRNA sequence
gactccctagagccttgcct

SEQ ID NO: 31443 - DNA, 20 bp, Artificial
  CRISPR gRNA sequence
cctagagccttgcctaggtc

SEQ ID NO: 31444 - DNA, 20 bp, Artificial
  CRISPR gRNA sequence
gagccttgcctaggtctcca

SEQ ID NO: 31445 - DNA, 20 bp, Artificial
  CRISPR gRNA sequence
gcctaggtctccatttctgt

SEQ ID NO: 31446 - DNA, 20 bp, Artificial
  CRISPR gRNA sequence
cctaggtctccatttctgtc

SEQ ID NO: 31447 - DNA, 20 bp, Artificial
  CRISPR gRNA sequence
ggtctccatttctgtcaccc

SEQ ID NO: 31448 - DNA, 20 bp, Artificial
  CRISPR gRNA sequence
catttctgtcaccccagcaa

SEQ ID NO: 31449 - DNA, 20 bp, Artificial
  CRISPR gRNA sequence
ctgtcaccccagcaacactg

SEQ ID NO: 31450 - DNA, 20 bp, Artificial
  CRISPR gRNA sequence
tgtcaccccagcaacactgc

SEQ ID NO: 31451 - DNA, 20 bp, Artificial
  CRISPR gRNA sequence
tcaccccagcaacactgcct

SEQ ID NO: 31452 - DNA, 20 bp, Artificial
  CRISPR gRNA sequence
cctagggtgtggcccccagc

SEQ ID NO: 31453 - DNA, 20 bp, Artificial
  CRISPR gRNA sequence
gggtgtggcccccagccctg

SEQ ID NO: 31454 - DNA, 20 bp, Artificial
  CRISPR gRNA sequence
gccacacatagagcaaccaa

SEQ ID NO: 31455 - DNA, 20 bp, Artificial
  CRISPR gRNA sequence
tcccagtttgcctgggacta

SEQ ID NO: 31456 - DNA, 20 bp, Artificial
  CRISPR gRNA sequence
gcctgggactaaggggcttc

SEQ ID NO: 31457 - DNA, 20 bp, Artificial
  CRISPR gRNA sequence
cctgggactaaggggcttct

SEQ ID NO: 31458 - DNA, 20 bp, Artificial
  CRISPR gRNA sequence
ggactaaggggcttcttggg

SEQ ID NO: 31459 - DNA, 20 bp, Artificial
  CRISPR gRNA sequence
aggggcttcttgggatgcaa

SEQ ID NO: 31460 - DNA, 20 bp, Artificial
  CRISPR gRNA sequence
cttgggatgcaagactttca

SEQ ID NO: 31461 - DNA, 20 bp, Artificial
  CRISPR gRNA sequence
ttgggatgcaagactttcag

SEQ ID NO: 31462 - DNA, 20 bp, Artificial
  CRISPR gRNA sequence
gggatgcaagactttcagtt

SEQ ID NO: 31463 - DNA, 20 bp, Artificial
  CRISPR gRNA sequence
ggatgcaagactttcagttt

SEQ ID NO: 31464 - DNA, 20 bp, Artificial
  CRISPR gRNA sequence
tcagttttcaaaccaggata

SEQ ID NO: 31465 - DNA, 20 bp, Artificial
  CRISPR gRNA sequence
cagttttcaaaccaggatag

SEQ ID NO: 31466 - DNA, 20 bp, Artificial
  CRISPR gRNA sequence
agttttcaaaccaggatagt

SEQ ID NO: 31467 - DNA, 20 bp, Artificial
  CRISPR gRNA sequence
tcaaaccaggatagtcccag

SEQ ID NO: 31468 - DNA, 20 bp, Artificial
  CRISPR gRNA sequence
caaaccaggatagtcccagg

SEQ ID NO: 31469 - DNA, 20 bp, Artificial
  CRISPR gRNA sequence
aaaccaggatagtcccaggc

SEQ ID NO: 31470 - DNA, 20 bp, Artificial
  CRISPR gRNA sequence
ctttttcatcctagctgcac

SEQ ID NO: 31471 - DNA, 20 bp, Artificial
  CRISPR gRNA sequence
tttcatcctagctgcacatc

SEQ ID NO: 31472 - DNA, 20 bp, Artificial
  CRISPR gRNA sequence
ttcatcctagctgcacatca

SEQ ID NO: 31473 - DNA, 20 bp, Artificial
  CRISPR gRNA sequence
tcatcctagctgcacatcaa

SEQ ID NO: 31474 - DNA, 20 bp, Artificial
  CRISPR gRNA sequence
catcctagctgcacatcaaa

SEQ ID NO: 31475 - DNA, 20 bp, Artificial
  CRISPR gRNA sequence
atcctagctgcacatcaaaa

SEQ ID NO: 31476 - DNA, 20 bp, Artificial
  CRISPR gRNA sequence
gctgcacatcaaaagctcct

SEQ ID NO: 31477 - DNA, 20 bp, Artificial
  CRISPR gRNA sequence
cacatcaaaagctcctggga

SEQ ID NO: 31478 - DNA, 20 bp, Artificial
  CRISPR gRNA sequence
ctgggaatttcaaaatgggg

SEQ ID NO: 31479 - DNA, 20 bp, Artificial
  CRISPR gRNA sequence
ggaatttcaaaatgggggaa

SEQ ID NO: 31480 - DNA, 20 bp, Artificial
  CRISPR gRNA sequence
caaaatgggggaaagattct

SEQ ID NO: 31481 - DNA, 20 bp, Artificial
  CRISPR gRNA sequence
aaaatgggggaaagattctc

SEQ ID NO: 31482 - DNA, 20 bp, Artificial
  CRISPR gRNA sequence
tccctggggaggccatccct

SEQ ID NO: 31483 - DNA, 20 bp, Artificial
  CRISPR gRNA sequence
cctggggaggccatcccttg

SEQ ID NO: 31484 - DNA, 20 bp, Artificial
  CRISPR gRNA sequence
gggaggccatcccttggctg

SEQ ID NO: 31485 - DNA, 20 bp, Artificial
  CRISPR gRNA sequence
ggctgtggaagtaaacaagc

SEQ ID NO: 31486 - DNA, 20 bp, Artificial
  CRISPR gRNA sequence
gctgtggaagtaaacaagct

SEQ ID NO: 31487 - DNA, 20 bp, Artificial
  CRISPR gRNA sequence
tggaagtaaacaagctcagg

SEQ ID NO: 31488 - DNA, 20 bp, Artificial
  CRISPR gRNA sequence
aggcacaagggacgttgtgc

SEQ ID NO: 31489 - DNA, 20 bp, Artificial
  CRISPR gRNA sequence
tgcagttcctggccacagga

SEQ ID NO: 31490 - DNA, 20 bp, Artificial
  CRISPR gRNA sequence
ctggccacaggagggaaaag

SEQ ID NO: 31491 - DNA, 20 bp, Artificial
  CRISPR gRNA sequence
gccacaggagggaaaaggac

SEQ ID NO: 31492 - DNA, 20 bp, Artificial
  CRISPR gRNA sequence
catagtcatagtggcatcct

SEQ ID NO: 31493 - DNA, 20 bp, Artificial
  CRISPR gRNA sequence
ctatggaaggttggggacac

SEQ ID NO: 31494 - DNA, 20 bp, Artificial
  CRISPR gRNA sequence
tggaaggttggggacacatt

SEQ ID NO: 31495 - DNA, 20 bp, Artificial
  CRISPR gRNA sequence
gggacacattgggccttttc

SEQ ID NO: 31496 - DNA, 20 bp, Artificial
  CRISPR gRNA sequence
ggccttttctgatccctggc

SEQ ID NO: 31497 - DNA, 20 bp, Artificial
  CRISPR gRNA sequence
ttctgatccctggcgaaatt

SEQ ID NO: 31498 - DNA, 20 bp, Artificial
  CRISPR gRNA sequence
tctgatccctggcgaaatta

SEQ ID NO: 31499 - DNA, 20 bp, Artificial
  CRISPR gRNA sequence
ctgatccctggcgaaattac

SEQ ID NO: 31500 - DNA, 20 bp, Artificial
  CRISPR gRNA sequence
tgatccctggcgaaattaca

SEQ ID NO: 31501 - DNA, 20 bp, Artificial
  CRISPR gRNA sequence
atccctggcgaaattacaat

SEQ ID NO: 31502 - DNA, 20 bp, Artificial
  CRISPR gRNA sequence
gcgaaattacaattcctgga

SEQ ID NO: 31503 - DNA, 20 bp, Artificial
  CRISPR gRNA sequence
caattcctggaaagcctttc

SEQ ID NO: 31504 - DNA, 20 bp, Artificial
  CRISPR gRNA sequence
ctggaaagcctttcttactc

SEQ ID NO: 31505 - DNA, 20 bp, Artificial
  CRISPR gRNA sequence
gaaagcctttcttactcccc

SEQ ID NO: 31506 - DNA, 20 bp, Artificial
  CRISPR gRNA sequence
tcttactcccctctccccac

SEQ ID NO: 31507 - DNA, 20 bp, Artificial
  CRISPR gRNA sequence
cttactcccctctccccact

SEQ ID NO: 31508 - DNA, 20 bp, Artificial
  CRISPR gRNA sequence
ttactcccctctccccactc

SEQ ID NO: 31509 - DNA, 20 bp, Artificial
  CRISPR gRNA sequence
actcccctctccccactcag

SEQ ID NO: 31510 - DNA, 20 bp, Artificial
  CRISPR gRNA sequence
ctcccctctccccactcagc

SEQ ID NO: 31511 - DNA, 20 bp, Artificial
  CRISPR gRNA sequence
ccctctccccactcagctca

SEQ ID NO: 31512 - DNA, 20 bp, Artificial
  CRISPR gRNA sequence
tccccactcagctcattcct

SEQ ID NO: 31513 - DNA, 20 bp, Artificial
  CRISPR gRNA sequence
cccactcagctcattcctta

SEQ ID NO: 31514 - DNA, 20 bp, Artificial
  CRISPR gRNA sequence
agctcattccttatcctcac

SEQ ID NO: 31515 - DNA, 20 bp, Artificial
  CRISPR gRNA sequence
attccttatcctcactgaag

SEQ ID NO: 31516 - DNA, 20 bp, Artificial
  CRISPR gRNA sequence
cttatcctcactgaagcttc

SEQ ID NO: 31517 - DNA, 20 bp, Artificial
  CRISPR gRNA sequence
atcctcactgaagcttcagt

SEQ ID NO: 31518 - DNA, 20 bp, Artificial
  CRISPR gRNA sequence
tcctcactgaagcttcagtg

SEQ ID NO: 31519 - DNA, 20 bp, Artificial
  CRISPR gRNA sequence
actgaagcttcagtgcagat

SEQ ID NO: 31520 - DNA, 20 bp, Artificial
  CRISPR gRNA sequence
aagcttcagtgcagatatca

SEQ ID NO: 31521 - DNA, 20 bp, Artificial
  CRISPR gRNA sequence
cagtgcagatatcacctcct

SEQ ID NO: 31522 - DNA, 20 bp, Artificial
  CRISPR gRNA sequence
agtgcagatatcacctcctc

SEQ ID NO: 31523 - DNA, 20 bp, Artificial
  CRISPR gRNA sequence
ctccaggaagtccccctgac

SEQ ID NO: 31524 - DNA, 20 bp, Artificial
  CRISPR gRNA sequence
caggaagtccccctgacctc

SEQ ID NO: 31525 - DNA, 20 bp, Artificial
  CRISPR gRNA sequence
acctcctccagaggggagtt

SEQ ID NO: 31526 - DNA, 20 bp, Artificial
  CRISPR gRNA sequence
ctccagaggggagttgatta

SEQ ID NO: 31527 - DNA, 20 bp, Artificial
  CRISPR gRNA sequence
cagaggggagttgattagac

SEQ ID NO: 31528 - DNA, 20 bp, Artificial
  CRISPR gRNA sequence
attagactgtcagctcatga

SEQ ID NO: 31529 - DNA, 20 bp, Artificial
  CRISPR gRNA sequence
gactgtcagctcatgaggac

SEQ ID NO: 31530 - DNA, 20 bp, Artificial
  CRISPR gRNA sequence
tcagctcatgaggacagcag

SEQ ID NO: 31531 - DNA, 20 bp, Artificial
  CRISPR gRNA sequence
atgaggacagcagcctcagt

SEQ ID NO: 31532 - DNA, 20 bp, Artificial
  CRISPR gRNA sequence
agtcattcaagtgctcaata

SEQ ID NO: 31533 - DNA, 20 bp, Artificial
  CRISPR gRNA sequence
aagtgctcaatacctctgtt

SEQ ID NO: 31534 - DNA, 20 bp, Artificial
  CRISPR gRNA sequence
aatacctctgttgaatgagt

SEQ ID NO: 31535 - DNA, 20 bp, Artificial
  CRISPR gRNA sequence
tgttgaatgagtgatgggaa

SEQ ID NO: 31536 - DNA, 20 bp, Artificial
  CRISPR gRNA sequence
ttgaatgagtgatgggaatg

SEQ ID NO: 31537 - DNA, 20 bp, Artificial
  CRISPR gRNA sequence
aatgagtgatgggaatgacc

SEQ ID NO: 31538 - DNA, 20 bp, Artificial
  CRISPR gRNA sequence
accagcaaacgggtccatta

SEQ ID NO: 31539 - DNA, 20 bp, Artificial
  CRISPR gRNA sequence
gcttcaaatctgagaacctc

SEQ ID NO: 31540 - DNA, 20 bp, Artificial
  CRISPR gRNA sequence
caaatctgagaacctccagc

SEQ ID NO: 31541 - DNA, 20 bp, Artificial
  CRISPR gRNA sequence
aaatctgagaacctccagca

SEQ ID NO: 31542 - DNA, 20 bp, Artificial
  CRISPR gRNA sequence
agaacctccagcatttgccc

SEQ ID NO: 31543 - DNA, 20 bp, Artificial
  CRISPR gRNA sequence
cagcatttgcccacactggt

SEQ ID NO: 31544 - DNA, 20 bp, Artificial
  CRISPR gRNA sequence
gcccacactggtcactttcc

SEQ ID NO: 31545 - DNA, 20 bp, Artificial
  CRISPR gRNA sequence
cccacactggtcactttcca

SEQ ID NO: 31546 - DNA, 20 bp, Artificial
  CRISPR gRNA sequence
gtcactttccagctgctgga

SEQ ID NO: 31547 - DNA, 20 bp, Artificial
  CRISPR gRNA sequence
tccagctgctggaagctatt

SEQ ID NO: 31548 - DNA, 20 bp, Artificial
  CRISPR gRNA sequence
ccagctgctggaagctattt

SEQ ID NO: 31549 - DNA, 20 bp, Artificial
  CRISPR gRNA sequence
cagctgctggaagctatttc

SEQ ID NO: 31550 - DNA, 20 bp, Artificial
  CRISPR gRNA sequence
ctggaagctatttccaaagt

SEQ ID NO: 31551 - DNA, 20 bp, Artificial
  CRISPR gRNA sequence
gaagctatttccaaagtggt

SEQ ID NO: 31552 - DNA, 20 bp, Artificial
  CRISPR gRNA sequence
tttccaaagtggtgggcaag

SEQ ID NO: 31553 - DNA, 20 bp, Artificial
  CRISPR gRNA sequence
ccaaagtggtgggcaagagg

SEQ ID NO: 31554 - DNA, 20 bp, Artificial
  CRISPR gRNA sequence
caaagtggtgggcaagaggg

SEQ ID NO: 31555 - DNA, 20 bp, Artificial
  CRISPR gRNA sequence
tggagatctatctccattca

SEQ ID NO: 31556 - DNA, 20 bp, Artificial
  CRISPR gRNA sequence
gagatctatctccattcagg

SEQ ID NO: 31557 - DNA, 20 bp, Artificial
  CRISPR gRNA sequence
tctccattcaggtggtacaa

SEQ ID NO: 31558 - DNA, 20 bp, Artificial
  CRISPR gRNA sequence
cattcaggtggtacaagccc

SEQ ID NO: 31559 - DNA, 20 bp, Artificial
  CRISPR gRNA sequence
aggtggtacaagcccagcta

SEQ ID NO: 31560 - DNA, 20 bp, Artificial
  CRISPR gRNA sequence
atgctgcaggggaaaccttg

SEQ ID NO: 31561 - DNA, 20 bp, Artificial
  CRISPR gRNA sequence
caggggaaaccttgcgcaga

SEQ ID NO: 31562 - DNA, 20 bp, Artificial
  CRISPR gRNA sequence
gcgcagacccacaagacaat

SEQ ID NO: 31563 - DNA, 20 bp, Artificial
  CRISPR gRNA sequence
cgcagacccacaagacaatc

SEQ ID NO: 31564 - DNA, 20 bp, Artificial
  CRISPR gRNA sequence
tgcttacgcaaactccagtt

SEQ ID NO: 31565 - DNA, 20 bp, Artificial
  CRISPR gRNA sequence
gcttacgcaaactccagttt

SEQ ID NO: 31566 - DNA, 20 bp, Artificial
  CRISPR gRNA sequence
cttacgcaaactccagtttc

SEQ ID NO: 31567 - DNA, 20 bp, Artificial
  CRISPR gRNA sequence
acgcaaactccagtttcttt

SEQ ID NO: 31568 - DNA, 20 bp, Artificial
  CRISPR gRNA sequence
cgcaaactccagtttcttta

SEQ ID NO: 31569 - DNA, 20 bp, Artificial
  CRISPR gRNA sequence
cagtttctttaggtcccgaa

SEQ ID NO: 31570 - DNA, 20 bp, Artificial
  CRISPR gRNA sequence
ctttaggtcccgaacagcag

SEQ ID NO: 31571 - DNA, 20 bp, Artificial
  CRISPR gRNA sequence
tttaggtcccgaacagcagg

SEQ ID NO: 31572 - DNA, 20 bp, Artificial
  CRISPR gRNA sequence
taggtcccgaacagcaggga

SEQ ID NO: 31573 - DNA, 20 bp, Artificial
  CRISPR gRNA sequence
aggtcccgaacagcagggag

SEQ ID NO: 31574 - DNA, 20 bp, Artificial
  CRISPR gRNA sequence
ggtcccgaacagcagggagc

SEQ ID NO: 31575 - DNA, 20 bp, Artificial
  CRISPR gRNA sequence
cccagctgtgtcttccgagg

SEQ ID NO: 31576 - DNA, 20 bp, Artificial
  CRISPR gRNA sequence
tgtcttccgaggaacttctc

SEQ ID NO: 31577 - DNA, 20 bp, Artificial
  CRISPR gRNA sequence
ccgaggaacttctcgtcctg

SEQ ID NO: 31578 - DNA, 20 bp, Artificial
  CRISPR gRNA sequence
cgaggaacttctcgtcctgg

SEQ ID NO: 31579 - DNA, 20 bp, Artificial
  CRISPR gRNA sequence
ctcgtcctggagagaacagg

SEQ ID NO: 31580 - DNA, 20 bp, Artificial
  CRISPR gRNA sequence
tcgtcctggagagaacaggc

SEQ ID NO: 31581 - DNA, 20 bp, Artificial
  CRISPR gRNA sequence
gtcctggagagaacaggcaa

SEQ ID NO: 31582 - DNA, 20 bp, Artificial
  CRISPR gRNA sequence
gagagaacaggcaatgttag

SEQ ID NO: 31583 - DNA, 20 bp, Artificial
  CRISPR gRNA sequence
gggggagcaggcactgctgt

SEQ ID NO: 31584 - DNA, 20 bp, Artificial
  CRISPR gRNA sequence
ctgtcactgagcccttaccc

SEQ ID NO: 31585 - DNA, 20 bp, Artificial
  CRISPR gRNA sequence
tcactgagcccttacccatg

SEQ ID NO: 31586 - DNA, 20 bp, Artificial
  CRISPR gRNA sequence
agcccttacccatgggtccc

SEQ ID NO: 31587 - DNA, 20 bp, Artificial
  CRISPR gRNA sequence
acccatgggtcccatgatgg

SEQ ID NO: 31588 - DNA, 20 bp, Artificial
  CRISPR gRNA sequence
cccatgggtcccatgatggc

SEQ ID NO: 31589 - DNA, 20 bp, Artificial
  CRISPR gRNA sequence
ccccagtgccccaaattccc

SEQ ID NO: 31590 - DNA, 20 bp, Artificial
  CRISPR gRNA sequence
cccagggggattgctttcct

SEQ ID NO: 31591 - DNA, 20 bp, Artificial
  CRISPR gRNA sequence
ctttccttggggcaactgtt

SEQ ID NO: 31592 - DNA, 20 bp, Artificial
  CRISPR gRNA sequence
tccttggggcaactgttgtc

SEQ ID NO: 31593 - DNA, 20 bp, Artificial
  CRISPR gRNA sequence
ccttggggcaactgttgtcc

SEQ ID NO: 31594 - DNA, 20 bp, Artificial
  CRISPR gRNA sequence
cttggggcaactgttgtccc

SEQ ID NO: 31595 - DNA, 20 bp, Artificial
  CRISPR gRNA sequence
ggggcaactgttgtccccct

SEQ ID NO: 31596 - DNA, 20 bp, Artificial
  CRISPR gRNA sequence
gggcaactgttgtccccctc

SEQ ID NO: 31597 - DNA, 20 bp, Artificial
  CRISPR gRNA sequence
ttgtccccctcttaaaaaaa

SEQ ID NO: 31598 - DNA, 20 bp, Artificial
  CRISPR gRNA sequence
tccccctcttaaaaaaaaag

SEQ ID NO: 31599 - DNA, 20 bp, Artificial
  CRISPR gRNA sequence
ttaaaaaaaaagatctgtct

SEQ ID NO: 31600 - DNA, 20 bp, Artificial
  CRISPR gRNA sequence
aaaaaaaaagatctgtctgg

SEQ ID NO: 31601 - DNA, 20 bp, Artificial
  CRISPR gRNA sequence
aaaaaaaagatctgtctggg

SEQ ID NO: 31602 - DNA, 20 bp, Artificial
  CRISPR gRNA sequence
tctgggtgcggtgcctcgtg

SEQ ID NO: 31603 - DNA, 20 bp, Artificial
  CRISPR gRNA sequence
ggtgcggtgcctcgtgactg

SEQ ID NO: 31604 - DNA, 20 bp, Artificial
  CRISPR gRNA sequence
gtgactgtagtcccagcact

SEQ ID NO: 31605 - DNA, 20 bp, Artificial
  CRISPR gRNA sequence
tagtcccagcactttgggag

SEQ ID NO: 31606 - DNA, 20 bp, Artificial
  CRISPR gRNA sequence
tgggaggctgaggcaggagg

SEQ ID NO: 31607 - DNA, 20 bp, Artificial
  CRISPR gRNA sequence
gggaggctgaggcaggagga

SEQ ID NO: 31608 - DNA, 20 bp, Artificial
  CRISPR gRNA sequence
ggaggctgaggcaggaggat

SEQ ID NO: 31609 - DNA, 20 bp, Artificial
  CRISPR gRNA sequence
aggcaggaggattgcttgag

SEQ ID NO: 31610 - DNA, 20 bp, Artificial
  CRISPR gRNA sequence
cttgaggccaggagttcaag

SEQ ID NO: 31611 - DNA, 20 bp, Artificial
  CRISPR gRNA sequence
gaggccaggagttcaagacc

SEQ ID NO: 31612 - DNA, 20 bp, Artificial
  CRISPR gRNA sequence
aggccaggagttcaagacca

SEQ ID NO: 31613 - DNA, 20 bp, Artificial
  CRISPR gRNA sequence
aagaccagcctgggcaacat

SEQ ID NO: 31614 - DNA, 20 bp, Artificial
  CRISPR gRNA sequence
ggcaacatagcaagatccct

SEQ ID NO: 31615 - DNA, 20 bp, Artificial
  CRISPR gRNA sequence
tgtctacaaaaacttaaaaa

SEQ ID NO: 31616 - DNA, 20 bp, Artificial
  CRISPR gRNA sequence
caaaaacttaaaaaatcatc

SEQ ID NO: 31617 - DNA, 20 bp, Artificial
  CRISPR gRNA sequence
aaaaaatcatccggtgtgat

SEQ ID NO: 31618 - DNA, 20 bp, Artificial
  CRISPR gRNA sequence
aaaaatcatccggtgtgatg

SEQ ID NO: 31619 - DNA, 20 bp, Artificial
  CRISPR gRNA sequence
taatcccagctacttgggag

SEQ ID NO: 31620 - DNA, 20 bp, Artificial
  CRISPR gRNA sequence
cttgggaggctgaggcagga

SEQ ID NO: 31621 - DNA, 20 bp, Artificial
  CRISPR gRNA sequence
gggaggctgaggcaggagga

SEQ ID NO: 31622 - DNA, 20 bp, Artificial
  CRISPR gRNA sequence
ggaggctgaggcaggaggat

SEQ ID NO: 31623 - DNA, 20 bp, Artificial
  CRISPR gRNA sequence
aggcaggaggatcgcttgag

SEQ ID NO: 31624 - DNA, 20 bp, Artificial
  CRISPR gRNA sequence
gagctcaggagttccgaagc

SEQ ID NO: 31625 - DNA, 20 bp, Artificial
  CRISPR gRNA sequence
agctcaggagttccgaagct

SEQ ID NO: 31626 - DNA, 20 bp, Artificial
  CRISPR gRNA sequence
aggagttccgaagctacagt

SEQ ID NO: 31627 - DNA, 20 bp, Artificial
  CRISPR gRNA sequence
cgaagctacagtaagctatg

SEQ ID NO: 31628 - DNA, 20 bp, Artificial
  CRISPR gRNA sequence
cagtaagctatgatcgcact

SEQ ID NO: 31629 - DNA, 20 bp, Artificial
  CRISPR gRNA sequence
tgatcgcactactgtattct

SEQ ID NO: 31630 - DNA, 20 bp, Artificial
  CRISPR gRNA sequence
ctgtattctagcctggtaga

SEQ ID NO: 31631 - DNA, 20 bp, Artificial
  CRISPR gRNA sequence
tattctagcctggtagacac

SEQ ID NO: 31632 - DNA, 20 bp, Artificial
  CRISPR gRNA sequence
tagcctggtagacacagcga

SEQ ID NO: 31633 - DNA, 20 bp, Artificial
  CRISPR gRNA sequence
gcctggtagacacagcgaga

SEQ ID NO: 31634 - DNA, 20 bp, Artificial
  CRISPR gRNA sequence
gtagacacagcgagaccctg

SEQ ID NO: 31635 - DNA, 20 bp, Artificial
  CRISPR gRNA sequence
tctttaagaaataataaaaa

SEQ ID NO: 31636 - DNA, 20 bp, Artificial
  CRISPR gRNA sequence
taagaaataataaaaataaa

SEQ ID NO: 31637 - DNA, 20 bp, Artificial
  CRISPR gRNA sequence
aagaaataataaaaataaaa

SEQ ID NO: 31638 - DNA, 20 bp, Artificial
  CRISPR gRNA sequence
agaaataataaaaataaaaa

SEQ ID NO: 31639 - DNA, 20 bp, Artificial
  CRISPR gRNA sequence
aggactgtatctttcatgga

SEQ ID NO: 31640 - DNA, 20 bp, Artificial
  CRISPR gRNA sequence
tatctttcatggaaatgagc

SEQ ID NO: 31641 - DNA, 20 bp, Artificial
  CRISPR gRNA sequence
tcatggaaatgagcctcaga

SEQ ID NO: 31642 - DNA, 20 bp, Artificial
  CRISPR gRNA sequence
catggaaatgagcctcagat

SEQ ID NO: 31643 - DNA, 20 bp, Artificial
  CRISPR gRNA sequence
atggaaatgagcctcagatt

SEQ ID NO: 31644 - DNA, 20 bp, Artificial
  CRISPR gRNA sequence
agattaggcacttaccagta

SEQ ID NO: 31645 - DNA, 20 bp, Artificial
  CRISPR gRNA sequence
ggcacttaccagtacctatc

SEQ ID NO: 31646 - DNA, 20 bp, Artificial
  CRISPR gRNA sequence
accagtacctatcccagaca

SEQ ID NO: 31647 - DNA, 20 bp, Artificial
  CRISPR gRNA sequence
ccagtacctatcccagacag

SEQ ID NO: 31648 - DNA, 20 bp, Artificial
  CRISPR gRNA sequence
tcccagacagcacttaagag

SEQ ID NO: 31649 - DNA, 20 bp, Artificial
  CRISPR gRNA sequence
aagaggcgctcaaacaatgt

SEQ ID NO: 31650 - DNA, 20 bp, Artificial
  CRISPR gRNA sequence
agaggcgctcaaacaatgtg

SEQ ID NO: 31651 - DNA, 20 bp, Artificial
  CRISPR gRNA sequence
aaacaatgtgtgatgaagga

SEQ ID NO: 31652 - DNA, 20 bp, Artificial
  CRISPR gRNA sequence
acttgttctgtaatcaagtt

SEQ ID NO: 31653 - DNA, 20 bp, Artificial
  CRISPR gRNA sequence
gttctgtaatcaagttttgt

SEQ ID NO: 31654 - DNA, 20 bp, Artificial
  CRISPR gRNA sequence
ttctgtaatcaagttttgtc

SEQ ID NO: 31655 - DNA, 20 bp, Artificial
  CRISPR gRNA sequence
tgtaatcaagttttgtctgc

SEQ ID NO: 31656 - DNA, 20 bp, Artificial
  CRISPR gRNA sequence
taatcaagttttgtctgcct

SEQ ID NO: 31657 - DNA, 20 bp, Artificial
  CRISPR gRNA sequence
tgtctgccttctggacctta

SEQ ID NO: 31658 - DNA, 20 bp, Artificial
  CRISPR gRNA sequence
gtctgccttctggaccttag

SEQ ID NO: 31659 - DNA, 20 bp, Artificial
  CRISPR gRNA sequence
tctgccttctggaccttagc

SEQ ID NO: 31660 - DNA, 20 bp, Artificial
  CRISPR gRNA sequence
ccttctggaccttagctctg

SEQ ID NO: 31661 - DNA, 20 bp, Artificial
  CRISPR gRNA sequence
ctggaccttagctctgccgt

SEQ ID NO: 31662 - DNA, 20 bp, Artificial
  CRISPR gRNA sequence
tggaccttagctctgccgtc

SEQ ID NO: 31663 - DNA, 20 bp, Artificial
  CRISPR gRNA sequence
gaccttagctctgccgtcta

SEQ ID NO: 31664 - DNA, 20 bp, Artificial
  CRISPR gRNA sequence
agctctgccgtctataaatt

SEQ ID NO: 31665 - DNA, 20 bp, Artificial
  CRISPR gRNA sequence
gctctgccgtctataaattt

SEQ ID NO: 31666 - DNA, 20 bp, Artificial
  CRISPR gRNA sequence
tgccgtctataaatttggga

SEQ ID NO: 31667 - DNA, 20 bp, Artificial
  CRISPR gRNA sequence
ccgtctataaatttgggaca

SEQ ID NO: 31668 - DNA, 20 bp, Artificial
  CRISPR gRNA sequence
taaatttgggacaacagttg

SEQ ID NO: 31669 - DNA, 20 bp, Artificial
  CRISPR gRNA sequence
gggacaacagttgtcctaaa

SEQ ID NO: 31670 - DNA, 20 bp, Artificial
  CRISPR gRNA sequence
ggacaacagttgtcctaaat

SEQ ID NO: 31671 - DNA, 20 bp, Artificial
  CRISPR gRNA sequence
tcctaaatgcctcaaagggt

SEQ ID NO: 31672 - DNA, 20 bp, Artificial
  CRISPR gRNA sequence
aatgcctcaaagggtggcag

SEQ ID NO: 31673 - DNA, 20 bp, Artificial
  CRISPR gRNA sequence
aaagggtggcagtaggtgtc

SEQ ID NO: 31674 - DNA, 20 bp, Artificial
  CRISPR gRNA sequence
ctgttactaggtgcacaagg

SEQ ID NO: 31675 - DNA, 20 bp, Artificial
  CRISPR gRNA sequence
tgttactaggtgcacaaggc

SEQ ID NO: 31676 - DNA, 20 bp, Artificial
  CRISPR gRNA sequence
ttactaggtgcacaaggcat

SEQ ID NO: 31677 - DNA, 20 bp, Artificial
  CRISPR gRNA sequence
ctaggtgcacaaggcatcct

SEQ ID NO: 31678 - DNA, 20 bp, Artificial
  CRISPR gRNA sequence
ggtgcacaaggcatccttgt

SEQ ID NO: 31679 - DNA, 20 bp, Artificial
  CRISPR gRNA sequence
gttaactcctagaaggggag

SEQ ID NO: 31680 - DNA, 20 bp, Artificial
  CRISPR gRNA sequence
ttaactcctagaaggggaga

SEQ ID NO: 31681 - DNA, 20 bp, Artificial
  CRISPR gRNA sequence
actcctagaaggggagaggt

SEQ ID NO: 31682 - DNA, 20 bp, Artificial
  CRISPR gRNA sequence
ctagaaggggagaggttctc

SEQ ID NO: 31683 - DNA, 20 bp, Artificial
  CRISPR gRNA sequence
gaaggggagaggttctccat

SEQ ID NO: 31684 - DNA, 20 bp, Artificial
  CRISPR gRNA sequence
tccatggctttagctaagac

SEQ ID NO: 31685 - DNA, 20 bp, Artificial
  CRISPR gRNA sequence
catggctttagctaagactt

SEQ ID NO: 31686 - DNA, 20 bp, Artificial
  CRISPR gRNA sequence
tagctaagacttgggcacat

SEQ ID NO: 31687 - DNA, 20 bp, Artificial
  CRISPR gRNA sequence
agctaagacttgggcacatg

SEQ ID NO: 31688 - DNA, 20 bp, Artificial
  CRISPR gRNA sequence
gctaagacttgggcacatga

SEQ ID NO: 31689 - DNA, 20 bp, Artificial
  CRISPR gRNA sequence
agacttgggcacatgatggc

SEQ ID NO: 31690 - DNA, 20 bp, Artificial
  CRISPR gRNA sequence
gggcacatgatggcaggttt

SEQ ID NO: 31691 - DNA, 20 bp, Artificial
  CRISPR gRNA sequence
ggcacatgatggcaggtttt

SEQ ID NO: 31692 - DNA, 20 bp, Artificial
  CRISPR gRNA sequence
tgaatgcagcaaagttttca

SEQ ID NO: 31693 - DNA, 20 bp, Artificial
  CRISPR gRNA sequence
gaatgcagcaaagttttcaa

SEQ ID NO: 31694 - DNA, 20 bp, Artificial
  CRISPR gRNA sequence
aatgcagcaaagttttcaat

SEQ ID NO: 31695 - DNA, 20 bp, Artificial
  CRISPR gRNA sequence
tcaattctagaggctccgcc

SEQ ID NO: 31696 - DNA, 20 bp, Artificial
  CRISPR gRNA sequence
caattctagaggctccgcct

SEQ ID NO: 31697 - DNA, 20 bp, Artificial
  CRISPR gRNA sequence
aattctagaggctccgcctg

SEQ ID NO: 31698 - DNA, 20 bp, Artificial
  CRISPR gRNA sequence
tagaggctccgcctgggcag

SEQ ID NO: 31699 - DNA, 20 bp, Artificial
  CRISPR gRNA sequence
gaggctccgcctgggcagcg

SEQ ID NO: 31700 - DNA, 20 bp, Artificial
  CRISPR gRNA sequence
cgcctgggcagcgagtgcag

SEQ ID NO: 31701 - DNA, 20 bp, Artificial
  CRISPR gRNA sequence
ggcagcgagtgcagtgagag

SEQ ID NO: 31702 - DNA, 20 bp, Artificial
  CRISPR gRNA sequence
tggttagccattgcccagaa

SEQ ID NO: 31703 - DNA, 20 bp, Artificial
  CRISPR gRNA sequence
gttagccattgcccagaaag

SEQ ID NO: 31704 - DNA, 20 bp, Artificial
  CRISPR gRNA sequence
gccattgcccagaaagaggg

SEQ ID NO: 31705 - DNA, 20 bp, Artificial
  CRISPR gRNA sequence
cccagaaagagggcatgggg

SEQ ID NO: 31706 - DNA, 20 bp, Artificial
  CRISPR gRNA sequence
gaaatgcccatgacaaactt

SEQ ID NO: 31707 - DNA, 20 bp, Artificial
  CRISPR gRNA sequence
gagaatgggtcctacatgtc

SEQ ID NO: 31708 - DNA, 20 bp, Artificial
  CRISPR gRNA sequence
agaatgggtcctacatgtcc

SEQ ID NO: 31709 - DNA, 20 bp, Artificial
  CRISPR gRNA sequence
catgtcctcaacctgcatgg

SEQ ID NO: 31710 - DNA, 20 bp, Artificial
  CRISPR gRNA sequence
aacctgcatggcgtgaacca

SEQ ID NO: 31711 - DNA, 20 bp, Artificial
  CRISPR gRNA sequence
catggcgtgaaccacctccc

SEQ ID NO: 31712 - DNA, 20 bp, Artificial
  CRISPR gRNA sequence
ccatccgcctctcctctcac

SEQ ID NO: 31713 - DNA, 20 bp, Artificial
  CRISPR gRNA sequence
tcctctcacctctgagtctg

SEQ ID NO: 31714 - DNA, 20 bp, Artificial
  CRISPR gRNA sequence
ctctcacctctgagtctgca

SEQ ID NO: 31715 - DNA, 20 bp, Artificial
  CRISPR gRNA sequence
tcacctctgagtctgcacaa

SEQ ID NO: 31716 - DNA, 20 bp, Artificial
  CRISPR gRNA sequence
acctctgagtctgcacaagc

SEQ ID NO: 31717 - DNA, 20 bp, Artificial
  CRISPR gRNA sequence
tgagtctgcacaagctttcc

SEQ ID NO: 31718 - DNA, 20 bp, Artificial
  CRISPR gRNA sequence
agtctgcacaagctttccca

SEQ ID NO: 31719 - DNA, 20 bp, Artificial
  CRISPR gRNA sequence
cacaagctttcccaggtctt

SEQ ID NO: 31720 - DNA, 20 bp, Artificial
  CRISPR gRNA sequence
tcccaggtcttccacatcct

SEQ ID NO: 31721 - DNA, 20 bp, Artificial
  CRISPR gRNA sequence
cccaggtcttccacatcctt

SEQ ID NO: 31722 - DNA, 20 bp, Artificial
  CRISPR gRNA sequence
ccaggtcttccacatccttc

SEQ ID NO: 31723 - DNA, 20 bp, Artificial
  CRISPR gRNA sequence
ccacatccttcagggacttg

SEQ ID NO: 31724 - DNA, 20 bp, Artificial
  CRISPR gRNA sequence
cacatccttcagggacttgg

SEQ ID NO: 31725 - DNA, 20 bp, Artificial
  CRISPR gRNA sequence
cagggacttggctttgaaag

SEQ ID NO: 31726 - DNA, 20 bp, Artificial
  CRISPR gRNA sequence
agggacttggctttgaaagg

SEQ ID NO: 31727 - DNA, 20 bp, Artificial
  CRISPR gRNA sequence
ggctttgaaaggctcgatgg

SEQ ID NO: 31728 - DNA, 20 bp, Artificial
  CRISPR gRNA sequence
gctttgaaaggctcgatggt

SEQ ID NO: 31729 - DNA, 20 bp, Artificial
  CRISPR gRNA sequence
tgaaaggctcgatggtgaac

SEQ ID NO: 31730 - DNA, 20 bp, Artificial
  CRISPR gRNA sequence
gaaaggctcgatggtgaact

SEQ ID NO: 31731 - DNA, 20 bp, Artificial
  CRISPR gRNA sequence
aaaggctcgatggtgaactt

SEQ ID NO: 31732 - DNA, 20 bp, Artificial
  CRISPR gRNA sequence
gatggtgaacttctcctctg

SEQ ID NO: 31733 - DNA, 20 bp, Artificial
  CRISPR gRNA sequence
ctcctctgctgcctgaagta

SEQ ID NO: 31734 - DNA, 20 bp, Artificial
  CRISPR gRNA sequence
tcctctgctgcctgaagtag

SEQ ID NO: 31735 - DNA, 20 bp, Artificial
  CRISPR gRNA sequence
ctctgctgcctgaagtagct

SEQ ID NO: 31736 - DNA, 20 bp, Artificial
  CRISPR gRNA sequence
tgctgcctgaagtagcttgg

SEQ ID NO: 31737 - DNA, 20 bp, Artificial
  CRISPR gRNA sequence
ctgcctgaagtagcttggtc

SEQ ID NO: 31738 - DNA, 20 bp, Artificial
  CRISPR gRNA sequence
cctgaagtagcttggtctcc

SEQ ID NO: 31739 - DNA, 20 bp, Artificial
  CRISPR gRNA sequence
aagtagcttggtctccccat

SEQ ID NO: 31740 - DNA, 20 bp, Artificial
  CRISPR gRNA sequence
ggtctccccatgctgctgca

SEQ ID NO: 31741 - DNA, 20 bp, Artificial
  CRISPR gRNA sequence
gtctccccatgctgctgcag

SEQ ID NO: 31742 - DNA, 20 bp, Artificial
  CRISPR gRNA sequence
cccatgctgctgcagggact

SEQ ID NO: 31743 - DNA, 20 bp, Artificial
  CRISPR gRNA sequence
ctgcagggactcccacagcg

SEQ ID NO: 31744 - DNA, 20 bp, Artificial
  CRISPR gRNA sequence
cagggactcccacagcgcca

SEQ ID NO: 31745 - DNA, 20 bp, Artificial
  CRISPR gRNA sequence
ccacagcgccaccgtgtcgc

SEQ ID NO: 31746 - DNA, 20 bp, Artificial
  CRISPR gRNA sequence
aaggcagccctgtggaggga

SEQ ID NO: 31747 - DNA, 20 bp, Artificial
  CRISPR gRNA sequence
tggagggagggcctcagacc

SEQ ID NO: 31748 - DNA, 20 bp, Artificial
  CRISPR gRNA sequence
agacccaggcacggtgacca

SEQ ID NO: 31749 - DNA, 20 bp, Artificial
  CRISPR gRNA sequence
gaccttaatggaagggcagc

SEQ ID NO: 31750 - DNA, 20 bp, Artificial
  CRISPR gRNA sequence
aatggaagggcagctccatg

SEQ ID NO: 31751 - DNA, 20 bp, Artificial
  CRISPR gRNA sequence
atggaagggcagctccatga

SEQ ID NO: 31752 - DNA, 20 bp, Artificial
  CRISPR gRNA sequence
catgaagggtcctcctacct

SEQ ID NO: 31753 - DNA, 20 bp, Artificial
  CRISPR gRNA sequence
ctacctattaaaatactttc

SEQ ID NO: 31754 - DNA, 20 bp, Artificial
  CRISPR gRNA sequence
cctattaaaatactttcttt

SEQ ID NO: 31755 - DNA, 20 bp, Artificial
  CRISPR gRNA sequence
ttaaaatactttctttcctt

SEQ ID NO: 31756 - DNA, 20 bp, Artificial
  CRISPR gRNA sequence
aaatactttctttccttagc

SEQ ID NO: 31757 - DNA, 20 bp, Artificial
  CRISPR gRNA sequence
tctttccttagctcaacctc

SEQ ID NO: 31758 - DNA, 20 bp, Artificial
  CRISPR gRNA sequence
ctttccttagctcaacctct

SEQ ID NO: 31759 - DNA, 20 bp, Artificial
  CRISPR gRNA sequence
tttccttagctcaacctcta

SEQ ID NO: 31760 - DNA, 20 bp, Artificial
  CRISPR gRNA sequence
tccttagctcaacctctacc

SEQ ID NO: 31761 - DNA, 20 bp, Artificial
  CRISPR gRNA sequence
ccttagctcaacctctacct

SEQ ID NO: 31762 - DNA, 20 bp, Artificial
  CRISPR gRNA sequence
cttagctcaacctctacctt

SEQ ID NO: 31763 - DNA, 20 bp, Artificial
  CRISPR gRNA sequence
agctcaacctctacctttcc

SEQ ID NO: 31764 - DNA, 20 bp, Artificial
  CRISPR gRNA sequence
gctcaacctctacctttccc

SEQ ID NO: 31765 - DNA, 20 bp, Artificial
  CRISPR gRNA sequence
aacctctacctttcccagaa

SEQ ID NO: 31766 - DNA, 20 bp, Artificial
  CRISPR gRNA sequence
tacctttcccagaaagcctt

SEQ ID NO: 31767 - DNA, 20 bp, Artificial
  CRISPR gRNA sequence
cctttcccagaaagccttcc

SEQ ID NO: 31768 - DNA, 20 bp, Artificial
  CRISPR gRNA sequence
tcccagaaagccttccatga

SEQ ID NO: 31769 - DNA, 20 bp, Artificial
  CRISPR gRNA sequence
cccagaaagccttccatgac

SEQ ID NO: 31770 - DNA, 20 bp, Artificial
  CRISPR gRNA sequence
ccagaaagccttccatgacc

SEQ ID NO: 31771 - DNA, 20 bp, Artificial
  CRISPR gRNA sequence
ccatgaccactccagccttt

SEQ ID NO: 31772 - DNA, 20 bp, Artificial
  CRISPR gRNA sequence
catgaccactccagccttta

SEQ ID NO: 31773 - DNA, 20 bp, Artificial
  CRISPR gRNA sequence
cagcctttattgattcctac

SEQ ID NO: 31774 - DNA, 20 bp, Artificial
  CRISPR gRNA sequence
tattgattcctactttctca

SEQ ID NO: 31775 - DNA, 20 bp, Artificial
  CRISPR gRNA sequence
attgattcctactttctcac

SEQ ID NO: 31776 - DNA, 20 bp, Artificial
  CRISPR gRNA sequence
ttgattcctactttctcaca

SEQ ID NO: 31777 - DNA, 20 bp, Artificial
  CRISPR gRNA sequence
attcctactttctcacaact

SEQ ID NO: 31778 - DNA, 20 bp, Artificial
  CRISPR gRNA sequence
ctactttctcacaactcaca

SEQ ID NO: 31779 - DNA, 20 bp, Artificial
  CRISPR gRNA sequence
ctttctcacaactcacacag

SEQ ID NO: 31780 - DNA, 20 bp, Artificial
  CRISPR gRNA sequence
tctcacaactcacacagtgg

SEQ ID NO: 31781 - DNA, 20 bp, Artificial
  CRISPR gRNA sequence
ctcacaactcacacagtggt

SEQ ID NO: 31782 - DNA, 20 bp, Artificial
  CRISPR gRNA sequence
tcacaactcacacagtggtt

SEQ ID NO: 31783 - DNA, 20 bp, Artificial
  CRISPR gRNA sequence
acaactcacacagtggtttt

SEQ ID NO: 31784 - DNA, 20 bp, Artificial
  CRISPR gRNA sequence
acacagtggttttctttccc

SEQ ID NO: 31785 - DNA, 20 bp, Artificial
  CRISPR gRNA sequence
tctttccctttttgcttcgg

SEQ ID NO: 31786 - DNA, 20 bp, Artificial
  CRISPR gRNA sequence
ctttccctttttgcttcggc

SEQ ID NO: 31787 - DNA, 20 bp, Artificial
  CRISPR gRNA sequence
tttccctttttgcttcggct

SEQ ID NO: 31788 - DNA, 20 bp, Artificial
  CRISPR gRNA sequence
tccctttttgcttcggctac

SEQ ID NO: 31789 - DNA, 20 bp, Artificial
  CRISPR gRNA sequence
ccctttttgcttcggctacc

SEQ ID NO: 31790 - DNA, 20 bp, Artificial
  CRISPR gRNA sequence
cctttttgcttcggctacca

SEQ ID NO: 31791 - DNA, 20 bp, Artificial
  CRISPR gRNA sequence
tttgcttcggctaccaggaa

SEQ ID NO: 31792 - DNA, 20 bp, Artificial
  CRISPR gRNA sequence
ttgcttcggctaccaggaag

SEQ ID NO: 31793 - DNA, 20 bp, Artificial
  CRISPR gRNA sequence
tgcttcggctaccaggaagc

SEQ ID NO: 31794 - DNA, 20 bp, Artificial
  CRISPR gRNA sequence
gcttcggctaccaggaagct

SEQ ID NO: 31795 - DNA, 20 bp, Artificial
  CRISPR gRNA sequence
cttcggctaccaggaagctc

SEQ ID NO: 31796 - DNA, 20 bp, Artificial
  CRISPR gRNA sequence
cggctaccaggaagctcact

SEQ ID NO: 31797 - DNA, 20 bp, Artificial
  CRISPR gRNA sequence
ggctaccaggaagctcactg

SEQ ID NO: 31798 - DNA, 20 bp, Artificial
  CRISPR gRNA sequence
ccaggaagctcactgctaaa

SEQ ID NO: 31799 - DNA, 20 bp, Artificial
  CRISPR gRNA sequence
actgctaaattattggcaca

SEQ ID NO: 31800 - DNA, 20 bp, Artificial
  CRISPR gRNA sequence
ctaaattattggcacaatta

SEQ ID NO: 31801 - DNA, 20 bp, Artificial
  CRISPR gRNA sequence
aattattggcacaattatgt

SEQ ID NO: 31802 - DNA, 20 bp, Artificial
  CRISPR gRNA sequence
ttggcacaattatgtaggac

SEQ ID NO: 31803 - DNA, 20 bp, Artificial
  CRISPR gRNA sequence
gcacaattatgtaggacctt

SEQ ID NO: 31804 - DNA, 20 bp, Artificial
  CRISPR gRNA sequence
tgtaggaccttacagcttgg

SEQ ID NO: 31805 - DNA, 20 bp, Artificial
  CRISPR gRNA sequence
acagcttgggtaaagtatgt

SEQ ID NO: 31806 - DNA, 20 bp, Artificial
  CRISPR gRNA sequence
cagcttgggtaaagtatgtt

SEQ ID NO: 31807 - DNA, 20 bp, Artificial
  CRISPR gRNA sequence
gggtaaagtatgtttagggg

SEQ ID NO: 31808 - DNA, 20 bp, Artificial
  CRISPR gRNA sequence
ggtaaagtatgtttaggggg

SEQ ID NO: 31809 - DNA, 20 bp, Artificial
  CRISPR gRNA sequence
agggggaaatatggaagcaa

SEQ ID NO: 31810 - DNA, 20 bp, Artificial
  CRISPR gRNA sequence
gggggaaatatggaagcaat

SEQ ID NO: 31811 - DNA, 20 bp, Artificial
  CRISPR gRNA sequence
tggcgattaagctgaaatgc

SEQ ID NO: 31812 - DNA, 20 bp, Artificial
  CRISPR gRNA sequence
gcgattaagctgaaatgctc

SEQ ID NO: 31813 - DNA, 20 bp, Artificial
  CRISPR gRNA sequence
agctgaaatgctcaagcaga

SEQ ID NO: 31814 - DNA, 20 bp, Artificial
  CRISPR gRNA sequence
aaatgctcaagcagattgca

SEQ ID NO: 31815 - DNA, 20 bp, Artificial
  CRISPR gRNA sequence
aagcagattgcagaccgact

SEQ ID NO: 31816 - DNA, 20 bp, Artificial
  CRISPR gRNA sequence
cagaccgacttaatgaaacc

SEQ ID NO: 31817 - DNA, 20 bp, Artificial
  CRISPR gRNA sequence
aatgaaaccaaattaaggaa

SEQ ID NO: 31818 - DNA, 20 bp, Artificial
  CRISPR gRNA sequence
atgaaaccaaattaaggaat

SEQ ID NO: 31819 - DNA, 20 bp, Artificial
  CRISPR gRNA sequence
aggaatttagccttcatcct

SEQ ID NO: 31820 - DNA, 20 bp, Artificial
  CRISPR gRNA sequence
agccttcatcctgacagtgg

SEQ ID NO: 31821 - DNA, 20 bp, Artificial
  CRISPR gRNA sequence
gccttcatcctgacagtggt

SEQ ID NO: 31822 - DNA, 20 bp, Artificial
  CRISPR gRNA sequence
catcctgacagtggtggagt

SEQ ID NO: 31823 - DNA, 20 bp, Artificial
  CRISPR gRNA sequence
atcctgacagtggtggagtg

SEQ ID NO: 31824 - DNA, 20 bp, Artificial
  CRISPR gRNA sequence
acagtggtggagtgtccctg

SEQ ID NO: 31825 - DNA, 20 bp, Artificial
  CRISPR gRNA sequence
aaggattgtaagcagggatg

SEQ ID NO: 31826 - DNA, 20 bp, Artificial
  CRISPR gRNA sequence
taagcagggatgggatacaa

SEQ ID NO: 31827 - DNA, 20 bp, Artificial
  CRISPR gRNA sequence
aagttctgagaagattggtc

SEQ ID NO: 31828 - DNA, 20 bp, Artificial
  CRISPR gRNA sequence
tgagaagattggtctggttg

SEQ ID NO: 31829 - DNA, 20 bp, Artificial
  CRISPR gRNA sequence
agaagattggtctggttgct

SEQ ID NO: 31830 - DNA, 20 bp, Artificial
  CRISPR gRNA sequence
gtctggttgctgaatacaaa

SEQ ID NO: 31831 - DNA, 20 bp, Artificial
  CRISPR gRNA sequence
gttgctgaatacaaaatgga

SEQ ID NO: 31832 - DNA, 20 bp, Artificial
  CRISPR gRNA sequence
ctgaatacaaaatggagtgg

SEQ ID NO: 31833 - DNA, 20 bp, Artificial
  CRISPR gRNA sequence
aatacaaaatggagtggaag

SEQ ID NO: 31834 - DNA, 20 bp, Artificial
  CRISPR gRNA sequence
tactcttagcataagaaaac

SEQ ID NO: 31835 - DNA, 20 bp, Artificial
  CRISPR gRNA sequence
actcttagcataagaaaacg

SEQ ID NO: 31836 - DNA, 20 bp, Artificial
  CRISPR gRNA sequence
ctcttagcataagaaaacgg

SEQ ID NO: 31837 - DNA, 20 bp, Artificial
  CRISPR gRNA sequence
ttagcataagaaaacggtgg

SEQ ID NO: 31838 - DNA, 20 bp, Artificial
  CRISPR gRNA sequence
agcataagaaaacggtggcg

SEQ ID NO: 31839 - DNA, 20 bp, Artificial
  CRISPR gRNA sequence
gcataagaaaacggtggcgt

SEQ ID NO: 31840 - DNA, 20 bp, Artificial
  CRISPR gRNA sequence
agggggtggaaagaataaaa

SEQ ID NO: 31841 - DNA, 20 bp, Artificial
  CRISPR gRNA sequence
gagcccaggtcagtctcaga

SEQ ID NO: 31842 - DNA, 20 bp, Artificial
  CRISPR gRNA sequence
agcccaggtcagtctcagat

SEQ ID NO: 31843 - DNA, 20 bp, Artificial
  CRISPR gRNA sequence
agattctagacataccccag

SEQ ID NO: 31844 - DNA, 20 bp, Artificial
  CRISPR gRNA sequence
tagacataccccagtgactg

SEQ ID NO: 31845 - DNA, 20 bp, Artificial
  CRISPR gRNA sequence
gacataccccagtgactggc

SEQ ID NO: 31846 - DNA, 20 bp, Artificial
  CRISPR gRNA sequence
gcacatggcgggccttcaaa

SEQ ID NO: 31847 - DNA, 20 bp, Artificial
  CRISPR gRNA sequence
caaatattgactgggagaat

SEQ ID NO: 31848 - DNA, 20 bp, Artificial
  CRISPR gRNA sequence
aaatattgactgggagaatg

SEQ ID NO: 31849 - DNA, 20 bp, Artificial
  CRISPR gRNA sequence
actgggagaatgccattgcc

SEQ ID NO: 31850 - DNA, 20 bp, Artificial
  CRISPR gRNA sequence
ggagaatgccattgcctctc

SEQ ID NO: 31851 - DNA, 20 bp, Artificial
  CRISPR gRNA sequence
cctctcacttgctgtgtggc

SEQ ID NO: 31852 - DNA, 20 bp, Artificial
  CRISPR gRNA sequence
tcacttgctgtgtggcaagt

SEQ ID NO: 31853 - DNA, 20 bp, Artificial
  CRISPR gRNA sequence
acttgctgtgtggcaagtgg

SEQ ID NO: 31854 - DNA, 20 bp, Artificial
  CRISPR gRNA sequence
gctgtgtggcaagtggctgc

SEQ ID NO: 31855 - DNA, 20 bp, Artificial
  CRISPR gRNA sequence
ctgtgtggcaagtggctgcc

SEQ ID NO: 31856 - DNA, 20 bp, Artificial
  CRISPR gRNA sequence
tgtggcaagtggctgcccct

SEQ ID NO: 31857 - DNA, 20 bp, Artificial
  CRISPR gRNA sequence
cccctctctgagcctcaaca

SEQ ID NO: 31858 - DNA, 20 bp, Artificial
  CRISPR gRNA sequence
tctgagcctcaacatcctca

SEQ ID NO: 31859 - DNA, 20 bp, Artificial
  CRISPR gRNA sequence
tgagcctcaacatcctcatc

SEQ ID NO: 31860 - DNA, 20 bp, Artificial
  CRISPR gRNA sequence
agcctcaacatcctcatctt

SEQ ID NO: 31861 - DNA, 20 bp, Artificial
  CRISPR gRNA sequence
aacatcctcatcttaaaaat

SEQ ID NO: 31862 - DNA, 20 bp, Artificial
  CRISPR gRNA sequence
atcttaaaaatggagagaat

SEQ ID NO: 31863 - DNA, 20 bp, Artificial
  CRISPR gRNA sequence
aaaaatggagagaatccatt

SEQ ID NO: 31864 - DNA, 20 bp, Artificial
  CRISPR gRNA sequence
aaaatggagagaatccattc

SEQ ID NO: 31865 - DNA, 20 bp, Artificial
  CRISPR gRNA sequence
tgccccacccggctgctctg

SEQ ID NO: 31866 - DNA, 20 bp, Artificial
  CRISPR gRNA sequence
ccccacccggctgctctgca

SEQ ID NO: 31867 - DNA, 20 bp, Artificial
  CRISPR gRNA sequence
ctctgcatactaaaagagac

SEQ ID NO: 31868 - DNA, 20 bp, Artificial
  CRISPR gRNA sequence
tgcatactaaaagagacccc

SEQ ID NO: 31869 - DNA, 20 bp, Artificial
  CRISPR gRNA sequence
catactaaaagagaccccac

SEQ ID NO: 31870 - DNA, 20 bp, Artificial
  CRISPR gRNA sequence
aaagagaccccacagagcac

SEQ ID NO: 31871 - DNA, 20 bp, Artificial
  CRISPR gRNA sequence
ggcttggcaccaagaccgca

SEQ ID NO: 31872 - DNA, 20 bp, Artificial
  CRISPR gRNA sequence
ggcaccaagaccgcagttaa

SEQ ID NO: 31873 - DNA, 20 bp, Artificial
  CRISPR gRNA sequence
gcaccaagaccgcagttaat

SEQ ID NO: 31874 - DNA, 20 bp, Artificial
  CRISPR gRNA sequence
atgcccaacacaaggatgtc

SEQ ID NO: 31875 - DNA, 20 bp, Artificial
  CRISPR gRNA sequence
ttccccaagcccctcacccc

SEQ ID NO: 31876 - DNA, 20 bp, Artificial
  CRISPR gRNA sequence
ccccaagcccctcaccccac

SEQ ID NO: 31877 - DNA, 20 bp, Artificial
  CRISPR gRNA sequence
cccaagcccctcaccccacc

SEQ ID NO: 31878 - DNA, 20 bp, Artificial
  CRISPR gRNA sequence
accccacctgaaacgggtga

SEQ ID NO: 31879 - DNA, 20 bp, Artificial
  CRISPR gRNA sequence
aaacgggtgacacagctgag

SEQ ID NO: 31880 - DNA, 20 bp, Artificial
  CRISPR gRNA sequence
agtcccacgaggctccccaa

SEQ ID NO: 31881 - DNA, 20 bp, Artificial
  CRISPR gRNA sequence
cccaatccagaggggcaaat

SEQ ID NO: 31882 - DNA, 20 bp, Artificial
  CRISPR gRNA sequence
cggaggtccagggagaagtc

SEQ ID NO: 31883 - DNA, 20 bp, Artificial
  CRISPR gRNA sequence
ggcccgccgcctccaaggcc

SEQ ID NO: 31884 - DNA, 20 bp, Artificial
  CRISPR gRNA sequence
gcccgccgcctccaaggcct

SEQ ID NO: 31885 - DNA, 20 bp, Artificial
  CRISPR gRNA sequence
caaggccttgcccagtacat

SEQ ID NO: 31886 - DNA, 20 bp, Artificial
  CRISPR gRNA sequence
gcccagtacatgtgcatcag

SEQ ID NO: 31887 - DNA, 20 bp, Artificial
  CRISPR gRNA sequence
cccagtacatgtgcatcagg

SEQ ID NO: 31888 - DNA, 20 bp, Artificial
  CRISPR gRNA sequence
ctgtaccacgtgctgccaaa

SEQ ID NO: 31889 - DNA, 20 bp, Artificial
  CRISPR gRNA sequence
taccacgtgctgccaaattc

SEQ ID NO: 31890 - DNA, 20 bp, Artificial
  CRISPR gRNA sequence
ccaaattccagcctcctcgg

SEQ ID NO: 31891 - DNA, 20 bp, Artificial
  CRISPR gRNA sequence
cagcctcctcggcctcgtgg

SEQ ID NO: 31892 - DNA, 20 bp, Artificial
  CRISPR gRNA sequence
ctcggcctcgtgggcgcagt

SEQ ID NO: 31893 - DNA, 20 bp, Artificial
  CRISPR gRNA sequence
ggcctcgtgggcgcagtgca

SEQ ID NO: 31894 - DNA, 20 bp, Artificial
  CRISPR gRNA sequence
gtgggcgcagtgcagcagct

SEQ ID NO: 31895 - DNA, 20 bp, Artificial
  CRISPR gRNA sequence
cagcagctgccgcgcccgca

SEQ ID NO: 31896 - DNA, 20 bp, Artificial
  CRISPR gRNA sequence
ccgcgcccgcagtgtccccg

SEQ ID NO: 31897 - DNA, 20 bp, Artificial
  CRISPR gRNA sequence
cagccgcttcaggtacctcg

SEQ ID NO: 31898 - DNA, 20 bp, Artificial
  CRISPR gRNA sequence
caggtacctcgcaagcacct

SEQ ID NO: 31899 - DNA, 20 bp, Artificial
  CRISPR gRNA sequence
aggtacctcgcaagcacctt

SEQ ID NO: 31900 - DNA, 20 bp, Artificial
  CRISPR gRNA sequence
gcaagcaccttctgcttcct

SEQ ID NO: 31901 - DNA, 20 bp, Artificial
  CRISPR gRNA sequence
ctgcttcctgtccaccgagg

SEQ ID NO: 31902 - DNA, 20 bp, Artificial
  CRISPR gRNA sequence
tgcttcctgtccaccgaggc

SEQ ID NO: 31903 - DNA, 20 bp, Artificial
  CRISPR gRNA sequence
cttcctgtccaccgaggcag

SEQ ID NO: 31904 - DNA, 20 bp, Artificial
  CRISPR gRNA sequence
cctgtccaccgaggcagccg

SEQ ID NO: 31905 - DNA, 20 bp, Artificial
  CRISPR gRNA sequence
ctgtccaccgaggcagccgc

SEQ ID NO: 31906 - DNA, 20 bp, Artificial
  CRISPR gRNA sequence
tccaccgaggcagccgccga

SEQ ID NO: 31907 - DNA, 20 bp, Artificial
  CRISPR gRNA sequence
ccaggcagcgggcgggaggc

SEQ ID NO: 31908 - DNA, 20 bp, Artificial
  CRISPR gRNA sequence
gaagatcagcccagccagaa

SEQ ID NO: 31909 - DNA, 20 bp, Artificial
  CRISPR gRNA sequence
cagccagttgtcatagggcc

SEQ ID NO: 31910 - DNA, 20 bp, Artificial
  CRISPR gRNA sequence
tcatagggcctcttcttcct

SEQ ID NO: 31911 - DNA, 20 bp, Artificial
  CRISPR gRNA sequence
ttcttccttggggtcaatgc

SEQ ID NO: 31912 - DNA, 20 bp, Artificial
  CRISPR gRNA sequence
cttccttggggtcaatgcta

SEQ ID NO: 31913 - DNA, 20 bp, Artificial
  CRISPR gRNA sequence
ttccttggggtcaatgctag

SEQ ID NO: 31914 - DNA, 20 bp, Artificial
  CRISPR gRNA sequence
ccttggggtcaatgctaggt

SEQ ID NO: 31915 - DNA, 20 bp, Artificial
  CRISPR gRNA sequence
cttggggtcaatgctaggta

SEQ ID NO: 31916 - DNA, 20 bp, Artificial
  CRISPR gRNA sequence
ggggtcaatgctaggtactg

SEQ ID NO: 31917 - DNA, 20 bp, Artificial
  CRISPR gRNA sequence
gggtcaatgctaggtactgc

SEQ ID NO: 31918 - DNA, 20 bp, Artificial
  CRISPR gRNA sequence
ggtactgcgggagctccttg

SEQ ID NO: 31919 - DNA, 20 bp, Artificial
  CRISPR gRNA sequence
cgggagctccttgtccttga

SEQ ID NO: 31920 - DNA, 20 bp, Artificial
  CRISPR gRNA sequence
cttgtccttgatttcgccac

SEQ ID NO: 31921 - DNA, 20 bp, Artificial
  CRISPR gRNA sequence
gtccttgatttcgccactca

SEQ ID NO: 31922 - DNA, 20 bp, Artificial
  CRISPR gRNA sequence
tccttgatttcgccactcag

SEQ ID NO: 31923 - DNA, 20 bp, Artificial
  CRISPR gRNA sequence
gatttcgccactcagagcca

SEQ ID NO: 31924 - DNA, 20 bp, Artificial
  CRISPR gRNA sequence
atttcgccactcagagccag

SEQ ID NO: 31925 - DNA, 20 bp, Artificial
  CRISPR gRNA sequence
cgccactcagagccagccac

SEQ ID NO: 31926 - DNA, 20 bp, Artificial
  CRISPR gRNA sequence
gccactcagagccagccaca

SEQ ID NO: 31927 - DNA, 20 bp, Artificial
  CRISPR gRNA sequence
agagccagccacagggcccc

SEQ ID NO: 31928 - DNA, 20 bp, Artificial
  CRISPR gRNA sequence
caggaggaagctggggaagg

SEQ ID NO: 31929 - DNA, 20 bp, Artificial
  CRISPR gRNA sequence
gggaaggccagctcggactc

SEQ ID NO: 31930 - DNA, 20 bp, Artificial
  CRISPR gRNA sequence
ggactctgcggcccgcggtg

SEQ ID NO: 31931 - DNA, 20 bp, Artificial
  CRISPR gRNA sequence
tgcggcccgcggtgggtgtt

SEQ ID NO: 31932 - DNA, 20 bp, Artificial
  CRISPR gRNA sequence
cggcccgcggtgggtgttgg

SEQ ID NO: 31933 - DNA, 20 bp, Artificial
  CRISPR gRNA sequence
gactaagcctttggccatcg

SEQ ID NO: 31934 - DNA, 20 bp, Artificial
  CRISPR gRNA sequence
agcctttggccatcgcccag

SEQ ID NO: 31935 - DNA, 20 bp, Artificial
  CRISPR gRNA sequence
tggccatcgcccaggtcctc

SEQ ID NO: 31936 - DNA, 20 bp, Artificial
  CRISPR gRNA sequence
ggccatcgcccaggtcctca

SEQ ID NO: 31937 - DNA, 20 bp, Artificial
  CRISPR gRNA sequence
gccatcgcccaggtcctcac

SEQ ID NO: 31938 - DNA, 20 bp, Artificial
  CRISPR gRNA sequence
acgtctgcggatgggaactg

SEQ ID NO: 31939 - DNA, 20 bp, Artificial
  CRISPR gRNA sequence
cggatgggaactggtcctcc

SEQ ID NO: 31940 - DNA, 20 bp, Artificial
  CRISPR gRNA sequence
gtcctcctgtagggtacttt

SEQ ID NO: 31941 - DNA, 20 bp, Artificial
  CRISPR gRNA sequence
ctgtagggtactttgatgtc

SEQ ID NO: 31942 - DNA, 20 bp, Artificial
  CRISPR gRNA sequence
tagggtactttgatgtctgc

SEQ ID NO: 31943 - DNA, 20 bp, Artificial
  CRISPR gRNA sequence
tgatgtctgcggcccagctc

SEQ ID NO: 31944 - DNA, 20 bp, Artificial
  CRISPR gRNA sequence
gatgtctgcggcccagctcc

SEQ ID NO: 31945 - DNA, 20 bp, Artificial
  CRISPR gRNA sequence
atgtctgcggcccagctccc

SEQ ID NO: 31946 - DNA, 20 bp, Artificial
  CRISPR gRNA sequence
cggcccagctcccaggccag

SEQ ID NO: 31947 - DNA, 20 bp, Artificial
  CRISPR gRNA sequence
ccaggccagcttggccagct

SEQ ID NO: 31948 - DNA, 20 bp, Artificial
  CRISPR gRNA sequence
ggccagctctgccagggccc

SEQ ID NO: 31949 - DNA, 20 bp, Artificial
  CRISPR gRNA sequence
gccagctctgccagggcccc

SEQ ID NO: 31950 - DNA, 20 bp, Artificial
  CRISPR gRNA sequence
tgccagggccccgggggggc

SEQ ID NO: 31951 - DNA, 20 bp, Artificial
  CRISPR gRNA sequence
ccagggccccgggggggctg

SEQ ID NO: 31952 - DNA, 20 bp, Artificial
  CRISPR gRNA sequence
tcgagggctgcacggcccag

SEQ ID NO: 31953 - DNA, 20 bp, Artificial
  CRISPR gRNA sequence
cacggcccagcaggccgaca

SEQ ID NO: 31954 - DNA, 20 bp, Artificial
  CRISPR gRNA sequence
ggcgtcctccccaagctcca

SEQ ID NO: 31955 - DNA, 20 bp, Artificial
  CRISPR gRNA sequence
gcgtcctccccaagctccag

SEQ ID NO: 31956 - DNA, 20 bp, Artificial
  CRISPR gRNA sequence
cccaagctccagcagggcct

SEQ ID NO: 31957 - DNA, 20 bp, Artificial
  CRISPR gRNA sequence
cagcagggcctctgagagct

SEQ ID NO: 31958 - DNA, 20 bp, Artificial
  CRISPR gRNA sequence
tgagagctggcacactgccc

SEQ ID NO: 31959 - DNA, 20 bp, Artificial
  CRISPR gRNA sequence
agagctggcacactgcccgg

SEQ ID NO: 31960 - DNA, 20 bp, Artificial
  CRISPR gRNA sequence
gcacactgcccggcacaaag

SEQ ID NO: 31961 - DNA, 20 bp, Artificial
  CRISPR gRNA sequence
cccggcacaaagtagggctg

SEQ ID NO: 31962 - DNA, 20 bp, Artificial
  CRISPR gRNA sequence
tggctgtgactgagaagaag

SEQ ID NO: 31963 - DNA, 20 bp, Artificial
  CRISPR gRNA sequence
tgactgagaagaagtggccg

SEQ ID NO: 31964 - DNA, 20 bp, Artificial
  CRISPR gRNA sequence
agaagaagtggccggtcccg

SEQ ID NO: 31965 - DNA, 20 bp, Artificial
  CRISPR gRNA sequence
tgtcttggtgctctgtcatc

SEQ ID NO: 31966 - DNA, 20 bp, Artificial
  CRISPR gRNA sequence
tcttggtgctctgtcatccc

SEQ ID NO: 31967 - DNA, 20 bp, Artificial
  CRISPR gRNA sequence
ggtgctctgtcatccctgag

SEQ ID NO: 31968 - DNA, 20 bp, Artificial
  CRISPR gRNA sequence
gtgctctgtcatccctgagc

SEQ ID NO: 31969 - DNA, 20 bp, Artificial
  CRISPR gRNA sequence
tgtcatccctgagctctcaa

SEQ ID NO: 31970 - DNA, 20 bp, Artificial
  CRISPR gRNA sequence
tcatccctgagctctcaaag

SEQ ID NO: 31971 - DNA, 20 bp, Artificial
  CRISPR gRNA sequence
agctctcaaagtagcgcatc

SEQ ID NO: 31972 - DNA, 20 bp, Artificial
  CRISPR gRNA sequence
tcaaagtagcgcatcacgta

SEQ ID NO: 31973 - DNA, 20 bp, Artificial
  CRISPR gRNA sequence
aaagtagcgcatcacgtatg

SEQ ID NO: 31974 - DNA, 20 bp, Artificial
  CRISPR gRNA sequence
ggcctgctccatggagaagc

SEQ ID NO: 31975 - DNA, 20 bp, Artificial
  CRISPR gRNA sequence
ctccatggagaagccggaca

SEQ ID NO: 31976 - DNA, 20 bp, Artificial
  CRISPR gRNA sequence
catggagaagccggacagct

SEQ ID NO: 31977 - DNA, 20 bp, Artificial
  CRISPR gRNA sequence
aaatagggcgtcggccttgc

SEQ ID NO: 31978 - DNA, 20 bp, Artificial
  CRISPR gRNA sequence
gctcaggctctggaccaggc

SEQ ID NO: 31979 - DNA, 20 bp, Artificial
  CRISPR gRNA sequence
ctcaggctctggaccaggcg

SEQ ID NO: 31980 - DNA, 20 bp, Artificial
  CRISPR gRNA sequence
aggctctggaccaggcggcc

SEQ ID NO: 31981 - DNA, 20 bp, Artificial
  CRISPR gRNA sequence
tggaccaggcggccccgggg

SEQ ID NO: 31982 - DNA, 20 bp, Artificial
  CRISPR gRNA sequence
gaccaggcggccccggggcc

SEQ ID NO: 31983 - DNA, 20 bp, Artificial
  CRISPR gRNA sequence
tgaggaggagggtgcaacct

SEQ ID NO: 31984 - DNA, 20 bp, Artificial
  CRISPR gRNA sequence
ggagcagcttcttctggaaa

SEQ ID NO: 31985 - DNA, 20 bp, Artificial
  CRISPR gRNA sequence
cttctggaaaaggccggcca

SEQ ID NO: 31986 - DNA, 20 bp, Artificial
  CRISPR gRNA sequence
ttctggaaaaggccggccag

SEQ ID NO: 31987 - DNA, 20 bp, Artificial
  CRISPR gRNA sequence
ctggaaaaggccggccagca

SEQ ID NO: 31988 - DNA, 20 bp, Artificial
  CRISPR gRNA sequence
tggaaaaggccggccagcag

SEQ ID NO: 31989 - DNA, 20 bp, Artificial
  CRISPR gRNA sequence
gaaaaggccggccagcagcc

SEQ ID NO: 31990 - DNA, 20 bp, Artificial
  CRISPR gRNA sequence
cgccggtgccggtccgcacg

SEQ ID NO: 31991 - DNA, 20 bp, Artificial
  CRISPR gRNA sequence
tgcaggaagccatcttgcgc

SEQ ID NO: 31992 - DNA, 20 bp, Artificial
  CRISPR gRNA sequence
gcgcttccagctcctcgaag

SEQ ID NO: 31993 - DNA, 20 bp, Artificial
  CRISPR gRNA sequence
cgcttccagctcctcgaagc

SEQ ID NO: 31994 - DNA, 20 bp, Artificial
  CRISPR gRNA sequence
ccagctcctcgaagccgtct

SEQ ID NO: 31995 - DNA, 20 bp, Artificial
  CRISPR gRNA sequence
cagctcctcgaagccgtcta

SEQ ID NO: 31996 - DNA, 20 bp, Artificial
  CRISPR gRNA sequence
ctcgaagccgtctaggatga

SEQ ID NO: 31997 - DNA, 20 bp, Artificial
  CRISPR gRNA sequence
gaagccgtctaggatgagca

SEQ ID NO: 31998 - DNA, 20 bp, Artificial
  CRISPR gRNA sequence
ggatgagcagaacgcggtca

SEQ ID NO: 31999 - DNA, 20 bp, Artificial
  CRISPR gRNA sequence
ttcaagatgtggctgaaaac

SEQ ID NO: 32000 - DNA, 20 bp, Artificial
  CRISPR gRNA sequence
caagatgtggctgaaaacct

SEQ ID NO: 32001 - DNA, 20 bp, Artificial
  CRISPR gRNA sequence
aagatgtggctgaaaacctc

SEQ ID NO: 32002 - DNA, 20 bp, Artificial
  CRISPR gRNA sequence
aaaacctcatcggccgccac

SEQ ID NO: 32003 - DNA, 20 bp, Artificial
  CRISPR gRNA sequence
atcggccgccacgagtggct

SEQ ID NO: 32004 - DNA, 20 bp, Artificial
  CRISPR gRNA sequence
tgggcccagggagaagagca

SEQ ID NO: 32005 - DNA, 20 bp, Artificial
  CRISPR gRNA sequence
caggccataggcatcccccg

SEQ ID NO: 32006 - DNA, 20 bp, Artificial
  CRISPR gRNA sequence
aagcaatggcaggggacaga

SEQ ID NO: 32007 - DNA, 20 bp, Artificial
  CRISPR gRNA sequence
gggaagccggccacaagccc

SEQ ID NO: 32008 - DNA, 20 bp, Artificial
  CRISPR gRNA sequence
actgccccagcccaatagct

SEQ ID NO: 32009 - DNA, 20 bp, Artificial
  CRISPR gRNA sequence
ccccagcccaatagctcttg

SEQ ID NO: 32010 - DNA, 20 bp, Artificial
  CRISPR gRNA sequence
ttgccctgaccagctttgcc

SEQ ID NO: 32011 - DNA, 20 bp, Artificial
  CRISPR gRNA sequence
gccctgaccagctttgccca

SEQ ID NO: 32012 - DNA, 20 bp, Artificial
  CRISPR gRNA sequence
ccctgaccagctttgcccag

SEQ ID NO: 32013 - DNA, 20 bp, Artificial
  CRISPR gRNA sequence
accagctttgcccagcacag

SEQ ID NO: 32014 - DNA, 20 bp, Artificial
  CRISPR gRNA sequence
tgcccagcacagcaatcact

SEQ ID NO: 32015 - DNA, 20 bp, Artificial
  CRISPR gRNA sequence
gcccagcacagcaatcactc

SEQ ID NO: 32016 - DNA, 20 bp, Artificial
  CRISPR gRNA sequence
cccagcacagcaatcactcg

SEQ ID NO: 32017 - DNA, 20 bp, Artificial
  CRISPR gRNA sequence
gtgtctcacgcggccgccgg

SEQ ID NO: 32018 - DNA, 20 bp, Artificial
  CRISPR gRNA sequence
acgcggccgccggtgctcct

SEQ ID NO: 32019 - DNA, 20 bp, Artificial
  CRISPR gRNA sequence
cttggcagccaacagcacct

SEQ ID NO: 32020 - DNA, 20 bp, Artificial
  CRISPR gRNA sequence
ggcagccaacagcacctcag

SEQ ID NO: 32021 - DNA, 20 bp, Artificial
  CRISPR gRNA sequence
gcagccaacagcacctcagc

SEQ ID NO: 32022 - DNA, 20 bp, Artificial
  CRISPR gRNA sequence
agccaggcctccttgggcca

SEQ ID NO: 32023 - DNA, 20 bp, Artificial
  CRISPR gRNA sequence
cttgggccagctgccgttct

SEQ ID NO: 32024 - DNA, 20 bp, Artificial
  CRISPR gRNA sequence
gggccagctgccgttctgcc

SEQ ID NO: 32025 - DNA, 20 bp, Artificial
  CRISPR gRNA sequence
ggccagctgccgttctgccc

SEQ ID NO: 32026 - DNA, 20 bp, Artificial
  CRISPR gRNA sequence
ccgttctgcccagtccgggg

SEQ ID NO: 32027 - DNA, 20 bp, Artificial
  CRISPR gRNA sequence
tgcccagtccggggtggcca

SEQ ID NO: 32028 - DNA, 20 bp, Artificial
  CRISPR gRNA sequence
cccagtccggggtggccagt

SEQ ID NO: 32029 - DNA, 20 bp, Artificial
  CRISPR gRNA sequence
ccgctccaggctcttgctgc

SEQ ID NO: 32030 - DNA, 20 bp, Artificial
  CRISPR gRNA sequence
caggctcttgctgctgctcc

SEQ ID NO: 32031 - DNA, 20 bp, Artificial
  CRISPR gRNA sequence
ttgctgctgctcctctccag

SEQ ID NO: 32032 - DNA, 20 bp, Artificial
  CRISPR gRNA sequence
gctgctgctcctctccagcc

SEQ ID NO: 32033 - DNA, 20 bp, Artificial
  CRISPR gRNA sequence
ctgctgctcctctccagcct

SEQ ID NO: 32034 - DNA, 20 bp, Artificial
  CRISPR gRNA sequence
ctgctcctctccagcctggc

SEQ ID NO: 32035 - DNA, 20 bp, Artificial
  CRISPR gRNA sequence
ctcctctccagcctggcctg

SEQ ID NO: 32036 - DNA, 20 bp, Artificial
  CRISPR gRNA sequence
ctctccagcctggcctgcac

SEQ ID NO: 32037 - DNA, 20 bp, Artificial
  CRISPR gRNA sequence
tccagcctggcctgcaccag

SEQ ID NO: 32038 - DNA, 20 bp, Artificial
  CRISPR gRNA sequence
cagcctggcctgcaccagat

SEQ ID NO: 32039 - DNA, 20 bp, Artificial
  CRISPR gRNA sequence
gcctgcaccagatccacctc

SEQ ID NO: 32040 - DNA, 20 bp, Artificial
  CRISPR gRNA sequence
caccagatccacctccacta

SEQ ID NO: 32041 - DNA, 20 bp, Artificial
  CRISPR gRNA sequence
cactaggatgccatccgggc

SEQ ID NO: 32042 - DNA, 20 bp, Artificial
  CRISPR gRNA sequence
ggatgccatccgggcctgcg

SEQ ID NO: 32043 - DNA, 20 bp, Artificial
  CRISPR gRNA sequence
cgggctcggcaccatacgtg

SEQ ID NO: 32044 - DNA, 20 bp, Artificial
  CRISPR gRNA sequence
ggcaccatacgtgtcctgca

SEQ ID NO: 32045 - DNA, 20 bp, Artificial
  CRISPR gRNA sequence
cagtgagcggtagaactgct

SEQ ID NO: 32046 - DNA, 20 bp, Artificial
  CRISPR gRNA sequence
ctccaccggctctgcaaagg

SEQ ID NO: 32047 - DNA, 20 bp, Artificial
  CRISPR gRNA sequence
caccggctctgcaaaggcca

SEQ ID NO: 32048 - DNA, 20 bp, Artificial
  CRISPR gRNA sequence
tgcaaaggccaggggcgtgt

SEQ ID NO: 32049 - DNA, 20 bp, Artificial
  CRISPR gRNA sequence
caaaggccaggggcgtgtca

SEQ ID NO: 32050 - DNA, 20 bp, Artificial
  CRISPR gRNA sequence
ccaccatcatttacatctgt

SEQ ID NO: 32051 - DNA, 20 bp, Artificial
  CRISPR gRNA sequence
acatctgttccccacacagt

SEQ ID NO: 32052 - DNA, 20 bp, Artificial
  CRISPR gRNA sequence
catctgttccccacacagtt

SEQ ID NO: 32053 - DNA, 20 bp, Artificial
  CRISPR gRNA sequence
ttccccacacagtttttttg

SEQ ID NO: 32054 - DNA, 20 bp, Artificial
  CRISPR gRNA sequence
cccacacagtttttttgttt

SEQ ID NO: 32055 - DNA, 20 bp, Artificial
  CRISPR gRNA sequence
ttttgtttgtttgttttgtt

SEQ ID NO: 32056 - DNA, 20 bp, Artificial
  CRISPR gRNA sequence
tttgtttgtttgttttgttt

SEQ ID NO: 32057 - DNA, 20 bp, Artificial
  CRISPR gRNA sequence
ttgtttgtttgttttgtttt

SEQ ID NO: 32058 - DNA, 20 bp, Artificial
  CRISPR gRNA sequence
tgtttgtttgttttgttttg

SEQ ID NO: 32059 - DNA, 20 bp, Artificial
  CRISPR gRNA sequence
gtttgtttgttttgttttgt

SEQ ID NO: 32060 - DNA, 20 bp, Artificial
  CRISPR gRNA sequence
tttgtttgttttgttttgtt

SEQ ID NO: 32061 - DNA, 20 bp, Artificial
  CRISPR gRNA sequence
gtttgttttgttttgttttg

SEQ ID NO: 32062 - DNA, 20 bp, Artificial
  CRISPR gRNA sequence
tttgttttgttttgttttga

SEQ ID NO: 32063 - DNA, 20 bp, Artificial
  CRISPR gRNA sequence
gttttgttttgttttgagac

SEQ ID NO: 32064 - DNA, 20 bp, Artificial
  CRISPR gRNA sequence
ttttgttttgttttgagaca

SEQ ID NO: 32065 - DNA, 20 bp, Artificial
  CRISPR gRNA sequence
tgttttgttttgagacaggg

SEQ ID NO: 32066 - DNA, 20 bp, Artificial
  CRISPR gRNA sequence
gttttgttttgagacagggt

SEQ ID NO: 32067 - DNA, 20 bp, Artificial
  CRISPR gRNA sequence
ttttgttttgagacagggtc

SEQ ID NO: 32068 - DNA, 20 bp, Artificial
  CRISPR gRNA sequence
tgttttgagacagggtctgg

SEQ ID NO: 32069 - DNA, 20 bp, Artificial
  CRISPR gRNA sequence
gttttgagacagggtctggc

SEQ ID NO: 32070 - DNA, 20 bp, Artificial
  CRISPR gRNA sequence
ttttgagacagggtctggct

SEQ ID NO: 32071 - DNA, 20 bp, Artificial
  CRISPR gRNA sequence
tgagacagggtctggctttt

SEQ ID NO: 32072 - DNA, 20 bp, Artificial
  CRISPR gRNA sequence
gagacagggtctggcttttt

SEQ ID NO: 32073 - DNA, 20 bp, Artificial
  CRISPR gRNA sequence
agacagggtctggctttttt

SEQ ID NO: 32074 - DNA, 20 bp, Artificial
  CRISPR gRNA sequence
gcttttttgcccaggctgga

SEQ ID NO: 32075 - DNA, 20 bp, Artificial
  CRISPR gRNA sequence
ttttgcccaggctggaatgc

SEQ ID NO: 32076 - DNA, 20 bp, Artificial
  CRISPR gRNA sequence
tttgcccaggctggaatgca

SEQ ID NO: 32077 - DNA, 20 bp, Artificial
  CRISPR gRNA sequence
ttgcccaggctggaatgcag

SEQ ID NO: 32078 - DNA, 20 bp, Artificial
  CRISPR gRNA sequence
tgcccaggctggaatgcagt

SEQ ID NO: 32079 - DNA, 20 bp, Artificial
  CRISPR gRNA sequence
gcccaggctggaatgcagtg

SEQ ID NO: 32080 - DNA, 20 bp, Artificial
  CRISPR gRNA sequence
cccaggctggaatgcagtgg

SEQ ID NO: 32081 - DNA, 20 bp, Artificial
  CRISPR gRNA sequence
gaatgcagtggtgtgatcac

SEQ ID NO: 32082 - DNA, 20 bp, Artificial
  CRISPR gRNA sequence
gctgcaacctcaacctcctg

SEQ ID NO: 32083 - DNA, 20 bp, Artificial
  CRISPR gRNA sequence
caacctcaacctcctgggct

SEQ ID NO: 32084 - DNA, 20 bp, Artificial
  CRISPR gRNA sequence
aacctcctgggctcatgcga

SEQ ID NO: 32085 - DNA, 20 bp, Artificial
  CRISPR gRNA sequence
ctgggctcatgcgatcctcc

SEQ ID NO: 32086 - DNA, 20 bp, Artificial
  CRISPR gRNA sequence
ggctcatgcgatcctcctga

SEQ ID NO: 32087 - DNA, 20 bp, Artificial
  CRISPR gRNA sequence
atgcgatcctcctgactcca

SEQ ID NO: 32088 - DNA, 20 bp, Artificial
  CRISPR gRNA sequence
ctgactccacctcccaagta

SEQ ID NO: 32089 - DNA, 20 bp, Artificial
  CRISPR gRNA sequence
actccacctcccaagtagct

SEQ ID NO: 32090 - DNA, 20 bp, Artificial
  CRISPR gRNA sequence
cacctcccaagtagctggga

SEQ ID NO: 32091 - DNA, 20 bp, Artificial
  CRISPR gRNA sequence
ccaagtagctgggaccacag

SEQ ID NO: 32092 - DNA, 20 bp, Artificial
  CRISPR gRNA sequence
ggaccacagacatgtgacac

SEQ ID NO: 32093 - DNA, 20 bp, Artificial
  CRISPR gRNA sequence
tttgatttttttgtagagat

SEQ ID NO: 32094 - DNA, 20 bp, Artificial
  CRISPR gRNA sequence
ttgatttttttgtagagatg

SEQ ID NO: 32095 - DNA, 20 bp, Artificial
  CRISPR gRNA sequence
tgatttttttgtagagatgg

SEQ ID NO: 32096 - DNA, 20 bp, Artificial
  CRISPR gRNA sequence
gatttttttgtagagatggg

SEQ ID NO: 32097 - DNA, 20 bp, Artificial
  CRISPR gRNA sequence
atttttttgtagagatgggg

SEQ ID NO: 32098 - DNA, 20 bp, Artificial
  CRISPR gRNA sequence
ttttgtagagatggggtctc

SEQ ID NO: 32099 - DNA, 20 bp, Artificial
  CRISPR gRNA sequence
tttgtagagatggggtctca

SEQ ID NO: 32100 - DNA, 20 bp, Artificial
  CRISPR gRNA sequence
ttgtagagatggggtctcac

SEQ ID NO: 32101 - DNA, 20 bp, Artificial
  CRISPR gRNA sequence
tgtagagatggggtctcact

SEQ ID NO: 32102 - DNA, 20 bp, Artificial
  CRISPR gRNA sequence
gtagagatggggtctcacta

SEQ ID NO: 32103 - DNA, 20 bp, Artificial
  CRISPR gRNA sequence
tagagatggggtctcactat

SEQ ID NO: 32104 - DNA, 20 bp, Artificial
  CRISPR gRNA sequence
actatgtcgcccaggctggc

SEQ ID NO: 32105 - DNA, 20 bp, Artificial
  CRISPR gRNA sequence
tgtcgcccaggctggcgtgc

SEQ ID NO: 32106 - DNA, 20 bp, Artificial
  CRISPR gRNA sequence
gcgtgcaatggcacaatcat

SEQ ID NO: 32107 - DNA, 20 bp, Artificial
  CRISPR gRNA sequence
caacctcacaggctcaagca

SEQ ID NO: 32108 - DNA, 20 bp, Artificial
  CRISPR gRNA sequence
aacctcacaggctcaagcaa

SEQ ID NO: 32109 - DNA, 20 bp, Artificial
  CRISPR gRNA sequence
acaggctcaagcaatcctcc

SEQ ID NO: 32110 - DNA, 20 bp, Artificial
  CRISPR gRNA sequence
aagcaatcctcccacctcag

SEQ ID NO: 32111 - DNA, 20 bp, Artificial
  CRISPR gRNA sequence
ccacctcagcctcctgagta

SEQ ID NO: 32112 - DNA, 20 bp, Artificial
  CRISPR gRNA sequence
agcctcctgagtagctggga

SEQ ID NO: 32113 - DNA, 20 bp, Artificial
  CRISPR gRNA sequence
ctgagtagctgggactacag

SEQ ID NO: 32114 - DNA, 20 bp, Artificial
  CRISPR gRNA sequence
agtagctgggactacaggcg

SEQ ID NO: 32115 - DNA, 20 bp, Artificial
  CRISPR gRNA sequence
ggactacaggcgcccactgc

SEQ ID NO: 32116 - DNA, 20 bp, Artificial
  CRISPR gRNA sequence
caggcgcccactgccatgcc

SEQ ID NO: 32117 - DNA, 20 bp, Artificial
  CRISPR gRNA sequence
ccatgcctggctaatttttc

SEQ ID NO: 32118 - DNA, 20 bp, Artificial
  CRISPR gRNA sequence
gctaatttttcttttttgtt

SEQ ID NO: 32119 - DNA, 20 bp, Artificial
  CRISPR gRNA sequence
atttttcttttttgtttttt

SEQ ID NO: 32120 - DNA, 20 bp, Artificial
  CRISPR gRNA sequence
ttcttttttgtttttttgtg

SEQ ID NO: 32121 - DNA, 20 bp, Artificial
  CRISPR gRNA sequence
tcttttttgtttttttgtgg

SEQ ID NO: 32122 - DNA, 20 bp, Artificial
  CRISPR gRNA sequence
cttttttgtttttttgtgga

SEQ ID NO: 32123 - DNA, 20 bp, Artificial
  CRISPR gRNA sequence
ttttttgtttttttgtggag

SEQ ID NO: 32124 - DNA, 20 bp, Artificial
  CRISPR gRNA sequence
ttttgtttttttgtggagat

SEQ ID NO: 32125 - DNA, 20 bp, Artificial
  CRISPR gRNA sequence
tttgtttttttgtggagata

SEQ ID NO: 32126 - DNA, 20 bp, Artificial
  CRISPR gRNA sequence
ttgtttttttgtggagataa

SEQ ID NO: 32127 - DNA, 20 bp, Artificial
  CRISPR gRNA sequence
tgtttttttgtggagataag

SEQ ID NO: 32128 - DNA, 20 bp, Artificial
  CRISPR gRNA sequence
gtttttttgtggagataagt

SEQ ID NO: 32129 - DNA, 20 bp, Artificial
  CRISPR gRNA sequence
tttttttgtggagataagtt

SEQ ID NO: 32130 - DNA, 20 bp, Artificial
  CRISPR gRNA sequence
ttttgtggagataagttctc

SEQ ID NO: 32131 - DNA, 20 bp, Artificial
  CRISPR gRNA sequence
tttgtggagataagttctca

SEQ ID NO: 32132 - DNA, 20 bp, Artificial
  CRISPR gRNA sequence
ttgtggagataagttctcac

SEQ ID NO: 32133 - DNA, 20 bp, Artificial
  CRISPR gRNA sequence
tgtggagataagttctcact

SEQ ID NO: 32134 - DNA, 20 bp, Artificial
  CRISPR gRNA sequence
gtggagataagttctcacta

SEQ ID NO: 32135 - DNA, 20 bp, Artificial
  CRISPR gRNA sequence
tggagataagttctcactat

SEQ ID NO: 32136 - DNA, 20 bp, Artificial
  CRISPR gRNA sequence
tcactattttgcccaggctg

SEQ ID NO: 32137 - DNA, 20 bp, Artificial
  CRISPR gRNA sequence
actattttgcccaggctggt

SEQ ID NO: 32138 - DNA, 20 bp, Artificial
  CRISPR gRNA sequence
ttttgcccaggctggtcttg

SEQ ID NO: 32139 - DNA, 20 bp, Artificial
  CRISPR gRNA sequence
tgcccaggctggtcttgagc

SEQ ID NO: 32140 - DNA, 20 bp, Artificial
  CRISPR gRNA sequence
gcccaggctggtcttgagct

SEQ ID NO: 32141 - DNA, 20 bp, Artificial
  CRISPR gRNA sequence
cccaggctggtcttgagctc

SEQ ID NO: 32142 - DNA, 20 bp, Artificial
  CRISPR gRNA sequence
gtcttgagctcctgggctca

SEQ ID NO: 32143 - DNA, 20 bp, Artificial
  CRISPR gRNA sequence
gagctcctgggctcaagcaa

SEQ ID NO: 32144 - DNA, 20 bp, Artificial
  CRISPR gRNA sequence
agctcctgggctcaagcaat

SEQ ID NO: 32145 - DNA, 20 bp, Artificial
  CRISPR gRNA sequence
ctgggctcaagcaatcgttc

SEQ ID NO: 32146 - DNA, 20 bp, Artificial
  CRISPR gRNA sequence
ggctcaagcaatcgttccgc

SEQ ID NO: 32147 - DNA, 20 bp, Artificial
  CRISPR gRNA sequence
aagcaatcgttccgccttgg

SEQ ID NO: 32148 - DNA, 20 bp, Artificial
  CRISPR gRNA sequence
cgccttggcctcccaaagtg

SEQ ID NO: 32149 - DNA, 20 bp, Artificial
  CRISPR gRNA sequence
ggcctcccaaagtgctggga

SEQ ID NO: 32150 - DNA, 20 bp, Artificial
  CRISPR gRNA sequence
gcctcccaaagtgctgggat

SEQ ID NO: 32151 - DNA, 20 bp, Artificial
  CRISPR gRNA sequence
ccaaagtgctgggattacag

SEQ ID NO: 32152 - DNA, 20 bp, Artificial
  CRISPR gRNA sequence
ggattacaggtgtgagccac

SEQ ID NO: 32153 - DNA, 20 bp, Artificial
  CRISPR gRNA sequence
caggtgtgagccaccacatc

SEQ ID NO: 32154 - DNA, 20 bp, Artificial
  CRISPR gRNA sequence
gcccccatacagtcttcatc

SEQ ID NO: 32155 - DNA, 20 bp, Artificial
  CRISPR gRNA sequence
catcatttgcttcattcagt

SEQ ID NO: 32156 - DNA, 20 bp, Artificial
  CRISPR gRNA sequence
atcatttgcttcattcagtc

SEQ ID NO: 32157 - DNA, 20 bp, Artificial
  CRISPR gRNA sequence
gcttcattcagtcacccacc

SEQ ID NO: 32158 - DNA, 20 bp, Artificial
  CRISPR gRNA sequence
cttcattcagtcacccacca

SEQ ID NO: 32159 - DNA, 20 bp, Artificial
  CRISPR gRNA sequence
cattcagtcacccaccactc

SEQ ID NO: 32160 - DNA, 20 bp, Artificial
  CRISPR gRNA sequence
attcagtcacccaccactca

SEQ ID NO: 32161 - DNA, 20 bp, Artificial
  CRISPR gRNA sequence
agtcacccaccactcattca

SEQ ID NO: 32162 - DNA, 20 bp, Artificial
  CRISPR gRNA sequence
attcattagttcactcattt

SEQ ID NO: 32163 - DNA, 20 bp, Artificial
  CRISPR gRNA sequence
attagttcactcatttccac

SEQ ID NO: 32164 - DNA, 20 bp, Artificial
  CRISPR gRNA sequence
gttcactcatttccacaccc

SEQ ID NO: 32165 - DNA, 20 bp, Artificial
  CRISPR gRNA sequence
actcatttccacacccattc

SEQ ID NO: 32166 - DNA, 20 bp, Artificial
  CRISPR gRNA sequence
atttccacacccattccttc

SEQ ID NO: 32167 - DNA, 20 bp, Artificial
  CRISPR gRNA sequence
ccacacccattccttcactc

SEQ ID NO: 32168 - DNA, 20 bp, Artificial
  CRISPR gRNA sequence
cacacccattccttcactca

SEQ ID NO: 32169 - DNA, 20 bp, Artificial
  CRISPR gRNA sequence
cttcactcatcgtctctctt

SEQ ID NO: 32170 - DNA, 20 bp, Artificial
  CRISPR gRNA sequence
cactcatcgtctctcttgtt

SEQ ID NO: 32171 - DNA, 20 bp, Artificial
  CRISPR gRNA sequence
actcatcgtctctcttgttt

SEQ ID NO: 32172 - DNA, 20 bp, Artificial
  CRISPR gRNA sequence
atcgtctctcttgtttaagt

SEQ ID NO: 32173 - DNA, 20 bp, Artificial
  CRISPR gRNA sequence
tcttgtttaagtgtccactc

SEQ ID NO: 32174 - DNA, 20 bp, Artificial
  CRISPR gRNA sequence
ttgtttaagtgtccactcct

SEQ ID NO: 32175 - DNA, 20 bp, Artificial
  CRISPR gRNA sequence
gtttaagtgtccactccttt

SEQ ID NO: 32176 - DNA, 20 bp, Artificial
  CRISPR gRNA sequence
tttaagtgtccactcctttt

SEQ ID NO: 32177 - DNA, 20 bp, Artificial
  CRISPR gRNA sequence
aagtgtccactccttttaga

SEQ ID NO: 32178 - DNA, 20 bp, Artificial
  CRISPR gRNA sequence
agtgtccactccttttagac

SEQ ID NO: 32179 - DNA, 20 bp, Artificial
  CRISPR gRNA sequence
cttttagaccttttctctct

SEQ ID NO: 32180 - DNA, 20 bp, Artificial
  CRISPR gRNA sequence
ttagaccttttctctctttt

SEQ ID NO: 32181 - DNA, 20 bp, Artificial
  CRISPR gRNA sequence
tagaccttttctctcttttt

SEQ ID NO: 32182 - DNA, 20 bp, Artificial
  CRISPR gRNA sequence
agaccttttctctctttttt

SEQ ID NO: 32183 - DNA, 20 bp, Artificial
  CRISPR gRNA sequence
gaccttttctctcttttttt

SEQ ID NO: 32184 - DNA, 20 bp, Artificial
  CRISPR gRNA sequence
ttctctcttttttttttttg

SEQ ID NO: 32185 - DNA, 20 bp, Artificial
  CRISPR gRNA sequence
tctctcttttttttttttga

SEQ ID NO: 32186 - DNA, 20 bp, Artificial
  CRISPR gRNA sequence
ctctcttttttttttttgag

SEQ ID NO: 32187 - DNA, 20 bp, Artificial
  CRISPR gRNA sequence
tctcttttttttttttgaga

SEQ ID NO: 32188 - DNA, 20 bp, Artificial
  CRISPR gRNA sequence
tcttttttttttttgagatg

SEQ ID NO: 32189 - DNA, 20 bp, Artificial
  CRISPR gRNA sequence
ttttttttttttgagatgga

SEQ ID NO: 32190 - DNA, 20 bp, Artificial
  CRISPR gRNA sequence
ttttttttttgagatggatc

SEQ ID NO: 32191 - DNA, 20 bp, Artificial
  CRISPR gRNA sequence
tttttttttgagatggatcc

SEQ ID NO: 32192 - DNA, 20 bp, Artificial
  CRISPR gRNA sequence
ttttttttgagatggatcct

SEQ ID NO: 32193 - DNA, 20 bp, Artificial
  CRISPR gRNA sequence
tttttttgagatggatcctg

SEQ ID NO: 32194 - DNA, 20 bp, Artificial
  CRISPR gRNA sequence
ttttttgagatggatcctgc

SEQ ID NO: 32195 - DNA, 20 bp, Artificial
  CRISPR gRNA sequence
tttttgagatggatcctgcc

SEQ ID NO: 32196 - DNA, 20 bp, Artificial
  CRISPR gRNA sequence
ttttgagatggatcctgccc

SEQ ID NO: 32197 - DNA, 20 bp, Artificial
  CRISPR gRNA sequence
tttgagatggatcctgccct

SEQ ID NO: 32198 - DNA, 20 bp, Artificial
  CRISPR gRNA sequence
ttgagatggatcctgccctg

SEQ ID NO: 32199 - DNA, 20 bp, Artificial
  CRISPR gRNA sequence
tgagatggatcctgccctgt

SEQ ID NO: 32200 - DNA, 20 bp, Artificial
  CRISPR gRNA sequence
gagatggatcctgccctgtg

SEQ ID NO: 32201 - DNA, 20 bp, Artificial
  CRISPR gRNA sequence
agatggatcctgccctgtgc

SEQ ID NO: 32202 - DNA, 20 bp, Artificial
  CRISPR gRNA sequence
ccctgtgccccaggctggag

SEQ ID NO: 32203 - DNA, 20 bp, Artificial
  CRISPR gRNA sequence
tgccccaggctggagtgcac

SEQ ID NO: 32204 - DNA, 20 bp, Artificial
  CRISPR gRNA sequence
gagtgcactggcgcaatctc

SEQ ID NO: 32205 - DNA, 20 bp, Artificial
  CRISPR gRNA sequence
gcgcaatctcagctcacggc

SEQ ID NO: 32206 - DNA, 20 bp, Artificial
  CRISPR gRNA sequence
agctcacggcaacctccacc

SEQ ID NO: 32207 - DNA, 20 bp, Artificial
  CRISPR gRNA sequence
acggcaacctccacctcctg

SEQ ID NO: 32208 - DNA, 20 bp, Artificial
  CRISPR gRNA sequence
cacctcctgggtttaggcga

SEQ ID NO: 32209 - DNA, 20 bp, Artificial
  CRISPR gRNA sequence
ctgggtttaggcgattctcc

SEQ ID NO: 32210 - DNA, 20 bp, Artificial
  CRISPR gRNA sequence
ggtttaggcgattctcctgc

SEQ ID NO: 32211 - DNA, 20 bp, Artificial
  CRISPR gRNA sequence
aggcgattctcctgcctcgg

SEQ ID NO: 32212 - DNA, 20 bp, Artificial
  CRISPR gRNA sequence
ggcgattctcctgcctcggc

SEQ ID NO: 32213 - DNA, 20 bp, Artificial
  CRISPR gRNA sequence
tcctgcctcggcctgccaag

SEQ ID NO: 32214 - DNA, 20 bp, Artificial
  CRISPR gRNA sequence
ctgcctcggcctgccaagta

SEQ ID NO: 32215 - DNA, 20 bp, Artificial
  CRISPR gRNA sequence
cctcggcctgccaagtagct

SEQ ID NO: 32216 - DNA, 20 bp, Artificial
  CRISPR gRNA sequence
ggcctgccaagtagctggga

SEQ ID NO: 32217 - DNA, 20 bp, Artificial
  CRISPR gRNA sequence
ccaagtagctgggattacag

SEQ ID NO: 32218 - DNA, 20 bp, Artificial
  CRISPR gRNA sequence
ggattacaggcacccactac

SEQ ID NO: 32219 - DNA, 20 bp, Artificial
  CRISPR gRNA sequence
caggcacccactaccacgtc

SEQ ID NO: 32220 - DNA, 20 bp, Artificial
  CRISPR gRNA sequence
ccacgtctggctaatttttg

SEQ ID NO: 32221 - DNA, 20 bp, Artificial
  CRISPR gRNA sequence
gctaatttttgtatttttta

SEQ ID NO: 32222 - DNA, 20 bp, Artificial
  CRISPR gRNA sequence
atttttgtattttttaatgg

SEQ ID NO: 32223 - DNA, 20 bp, Artificial
  CRISPR gRNA sequence
ttgtattttttaatggagac

SEQ ID NO: 32224 - DNA, 20 bp, Artificial
  CRISPR gRNA sequence
tgtattttttaatggagacg

SEQ ID NO: 32225 - DNA, 20 bp, Artificial
  CRISPR gRNA sequence
gtattttttaatggagacgg

SEQ ID NO: 32226 - DNA, 20 bp, Artificial
  CRISPR gRNA sequence
tattttttaatggagacggg

SEQ ID NO: 32227 - DNA, 20 bp, Artificial
  CRISPR gRNA sequence
tttaatggagacggggtttc

SEQ ID NO: 32228 - DNA, 20 bp, Artificial
  CRISPR gRNA sequence
ttaatggagacggggtttca

SEQ ID NO: 32229 - DNA, 20 bp, Artificial
  CRISPR gRNA sequence
taatggagacggggtttcac

SEQ ID NO: 32230 - DNA, 20 bp, Artificial
  CRISPR gRNA sequence
aatggagacggggtttcact

SEQ ID NO: 32231 - DNA, 20 bp, Artificial
  CRISPR gRNA sequence
atggagacggggtttcacta

SEQ ID NO: 32232 - DNA, 20 bp, Artificial
  CRISPR gRNA sequence
cactatgttggccaggctgg

SEQ ID NO: 32233 - DNA, 20 bp, Artificial
  CRISPR gRNA sequence
actatgttggccaggctggt

SEQ ID NO: 32234 - DNA, 20 bp, Artificial
  CRISPR gRNA sequence
tgttggccaggctggtctcg

SEQ ID NO: 32235 - DNA, 20 bp, Artificial
  CRISPR gRNA sequence
gccaggctggtctcgaactc

SEQ ID NO: 32236 - DNA, 20 bp, Artificial
  CRISPR gRNA sequence
gtctcgaactcctgacctca

SEQ ID NO: 32237 - DNA, 20 bp, Artificial
  CRISPR gRNA sequence
gaactcctgacctcaggtga

SEQ ID NO: 32238 - DNA, 20 bp, Artificial
  CRISPR gRNA sequence
ctgacctcaggtgatccacc

SEQ ID NO: 32239 - DNA, 20 bp, Artificial
  CRISPR gRNA sequence
acctcaggtgatccacctgc

SEQ ID NO: 32240 - DNA, 20 bp, Artificial
  CRISPR gRNA sequence
aggtgatccacctgccttgg

SEQ ID NO: 32241 - DNA, 20 bp, Artificial
  CRISPR gRNA sequence
ccttggcctcccaaagtgct

SEQ ID NO: 32242 - DNA, 20 bp, Artificial
  CRISPR gRNA sequence
ggcctcccaaagtgctggga

SEQ ID NO: 32243 - DNA, 20 bp, Artificial
  CRISPR gRNA sequence
gcctcccaaagtgctgggat

SEQ ID NO: 32244 - DNA, 20 bp, Artificial
  CRISPR gRNA sequence
ccaaagtgctgggattacag

SEQ ID NO: 32245 - DNA, 20 bp, Artificial
  CRISPR gRNA sequence
ggattacaggcataaggcac

SEQ ID NO: 32246 - DNA, 20 bp, Artificial
  CRISPR gRNA sequence
caggcataaggcaccatgca

SEQ ID NO: 32247 - DNA, 20 bp, Artificial
  CRISPR gRNA sequence
ttctcattccttcatttact

SEQ ID NO: 32248 - DNA, 20 bp, Artificial
  CRISPR gRNA sequence
tctcattccttcatttactc

SEQ ID NO: 32249 - DNA, 20 bp, Artificial
  CRISPR gRNA sequence
ctcattccttcatttactca

SEQ ID NO: 32250 - DNA, 20 bp, Artificial
  CRISPR gRNA sequence
tcattccttcatttactcac

SEQ ID NO: 32251 - DNA, 20 bp, Artificial
  CRISPR gRNA sequence
attccttcatttactcacta

SEQ ID NO: 32252 - DNA, 20 bp, Artificial
  CRISPR gRNA sequence
cttcatttactcactaagct

SEQ ID NO: 32253 - DNA, 20 bp, Artificial
  CRISPR gRNA sequence
catttactcactaagctttt

SEQ ID NO: 32254 - DNA, 20 bp, Artificial
  CRISPR gRNA sequence
atttactcactaagcttttt

SEQ ID NO: 32255 - DNA, 20 bp, Artificial
  CRISPR gRNA sequence
actcactaagctttttcttc

SEQ ID NO: 32256 - DNA, 20 bp, Artificial
  CRISPR gRNA sequence
ctcactaagctttttcttcg

SEQ ID NO: 32257 - DNA, 20 bp, Artificial
  CRISPR gRNA sequence
actaagctttttcttcgctt

SEQ ID NO: 32258 - DNA, 20 bp, Artificial
  CRISPR gRNA sequence
agctttttcttcgcttgatc

SEQ ID NO: 32259 - DNA, 20 bp, Artificial
  CRISPR gRNA sequence
tttcttcgcttgatcactac

SEQ ID NO: 32260 - DNA, 20 bp, Artificial
  CRISPR gRNA sequence
ttcttcgcttgatcactact

SEQ ID NO: 32261 - DNA, 20 bp, Artificial
  CRISPR gRNA sequence
tcttcgcttgatcactactc

SEQ ID NO: 32262 - DNA, 20 bp, Artificial
  CRISPR gRNA sequence
cttcgcttgatcactactca

SEQ ID NO: 32263 - DNA, 20 bp, Artificial
  CRISPR gRNA sequence
ttcgcttgatcactactcac

SEQ ID NO: 32264 - DNA, 20 bp, Artificial
  CRISPR gRNA sequence
cgcttgatcactactcactc

SEQ ID NO: 32265 - DNA, 20 bp, Artificial
  CRISPR gRNA sequence
gcttgatcactactcactca

SEQ ID NO: 32266 - DNA, 20 bp, Artificial
  CRISPR gRNA sequence
gatcactactcactcaccat

SEQ ID NO: 32267 - DNA, 20 bp, Artificial
  CRISPR gRNA sequence
atcactactcactcaccatg

SEQ ID NO: 32268 - DNA, 20 bp, Artificial
  CRISPR gRNA sequence
ctcactcaccatggggaggt

SEQ ID NO: 32269 - DNA, 20 bp, Artificial
  CRISPR gRNA sequence
actcaccatggggaggtcat

SEQ ID NO: 32270 - DNA, 20 bp, Artificial
  CRISPR gRNA sequence
accatggggaggtcatggga

SEQ ID NO: 32271 - DNA, 20 bp, Artificial
  CRISPR gRNA sequence
agagttaagacagtggagcc

SEQ ID NO: 32272 - DNA, 20 bp, Artificial
  CRISPR gRNA sequence
agacagtggagcccacgtgt

SEQ ID NO: 32273 - DNA, 20 bp, Artificial
  CRISPR gRNA sequence
ggttcaaatcccggttctac

SEQ ID NO: 32274 - DNA, 20 bp, Artificial
  CRISPR gRNA sequence
aaatcccggttctaccactt

SEQ ID NO: 32275 - DNA, 20 bp, Artificial
  CRISPR gRNA sequence
taccacttgctggagcaatt

SEQ ID NO: 32276 - DNA, 20 bp, Artificial
  CRISPR gRNA sequence
ccacttgctggagcaattct

SEQ ID NO: 32277 - DNA, 20 bp, Artificial
  CRISPR gRNA sequence
gctggagcaattctgagcat

SEQ ID NO: 32278 - DNA, 20 bp, Artificial
  CRISPR gRNA sequence
ctggagcaattctgagcatg

SEQ ID NO: 32279 - DNA, 20 bp, Artificial
  CRISPR gRNA sequence
gagcaattctgagcatgcta

SEQ ID NO: 32280 - DNA, 20 bp, Artificial
  CRISPR gRNA sequence
tgagcatgctatacatccca

SEQ ID NO: 32281 - DNA, 20 bp, Artificial
  CRISPR gRNA sequence
agcatgctatacatcccacc

SEQ ID NO: 32282 - DNA, 20 bp, Artificial
  CRISPR gRNA sequence
tacatcccaccatgcctcag

SEQ ID NO: 32283 - DNA, 20 bp, Artificial
  CRISPR gRNA sequence
agtagcctcatctggaaaat

SEQ ID NO: 32284 - DNA, 20 bp, Artificial
  CRISPR gRNA sequence
atctggaaaatggggataat

SEQ ID NO: 32285 - DNA, 20 bp, Artificial
  CRISPR gRNA sequence
gaaaatggggataatattgg

SEQ ID NO: 32286 - DNA, 20 bp, Artificial
  CRISPR gRNA sequence
ggattgtgtgagatgttaat

SEQ ID NO: 32287 - DNA, 20 bp, Artificial
  CRISPR gRNA sequence
tgtgagatgttaatgattta

SEQ ID NO: 32288 - DNA, 20 bp, Artificial
  CRISPR gRNA sequence
atgatttagcatacctaaca

SEQ ID NO: 32289 - DNA, 20 bp, Artificial
  CRISPR gRNA sequence
agcatacctaacatgcttag

SEQ ID NO: 32290 - DNA, 20 bp, Artificial
  CRISPR gRNA sequence
gcatacctaacatgcttaga

SEQ ID NO: 32291 - DNA, 20 bp, Artificial
  CRISPR gRNA sequence
acatgcttagaccagtatgt

SEQ ID NO: 32292 - DNA, 20 bp, Artificial
  CRISPR gRNA sequence
agaccagtatgtgagagtaa

SEQ ID NO: 32293 - DNA, 20 bp, Artificial
  CRISPR gRNA sequence
gaccagtatgtgagagtaag

SEQ ID NO: 32294 - DNA, 20 bp, Artificial
  CRISPR gRNA sequence
agtaatttagtaattctctt

SEQ ID NO: 32295 - DNA, 20 bp, Artificial
  CRISPR gRNA sequence
gtaatttagtaattctctta

SEQ ID NO: 32296 - DNA, 20 bp, Artificial
  CRISPR gRNA sequence
agtaattctcttattcactg

SEQ ID NO: 32297 - DNA, 20 bp, Artificial
  CRISPR gRNA sequence
gtaattctcttattcactgg

SEQ ID NO: 32298 - DNA, 20 bp, Artificial
  CRISPR gRNA sequence
tcttattcactggtttattc

SEQ ID NO: 32299 - DNA, 20 bp, Artificial
  CRISPR gRNA sequence
ttattcactggtttattccc

SEQ ID NO: 32300 - DNA, 20 bp, Artificial
  CRISPR gRNA sequence
attcactggtttattcccac

SEQ ID NO: 32301 - DNA, 20 bp, Artificial
  CRISPR gRNA sequence
ttcactggtttattcccact

SEQ ID NO: 32302 - DNA, 20 bp, Artificial
  CRISPR gRNA sequence
actggtttattcccactttc

SEQ ID NO: 32303 - DNA, 20 bp, Artificial
  CRISPR gRNA sequence
gtttattcccactttccatt

SEQ ID NO: 32304 - DNA, 20 bp, Artificial
  CRISPR gRNA sequence
attcccactttccattgctc

SEQ ID NO: 32305 - DNA, 20 bp, Artificial
  CRISPR gRNA sequence
ttcccactttccattgctcc

SEQ ID NO: 32306 - DNA, 20 bp, Artificial
  CRISPR gRNA sequence
ccactttccattgctcccat

SEQ ID NO: 32307 - DNA, 20 bp, Artificial
  CRISPR gRNA sequence
tccattgctcccatcctcat

SEQ ID NO: 32308 - DNA, 20 bp, Artificial
  CRISPR gRNA sequence
ccattgctcccatcctcatc

SEQ ID NO: 32309 - DNA, 20 bp, Artificial
  CRISPR gRNA sequence
cattgctcccatcctcatca

SEQ ID NO: 32310 - DNA, 20 bp, Artificial
  CRISPR gRNA sequence
ctcccatcctcatcaacttc

SEQ ID NO: 32311 - DNA, 20 bp, Artificial
  CRISPR gRNA sequence
ccatcctcatcaacttctca

SEQ ID NO: 32312 - DNA, 20 bp, Artificial
  CRISPR gRNA sequence
atcaacttctcacttcatcc

SEQ ID NO: 32313 - DNA, 20 bp, Artificial
  CRISPR gRNA sequence
ctcacttcatccactcactc

SEQ ID NO: 32314 - DNA, 20 bp, Artificial
  CRISPR gRNA sequence
tcacttcatccactcactca

SEQ ID NO: 32315 - DNA, 20 bp, Artificial
  CRISPR gRNA sequence
acttcatccactcactcact

SEQ ID NO: 32316 - DNA, 20 bp, Artificial
  CRISPR gRNA sequence
catccactcactcacttcat

SEQ ID NO: 32317 - DNA, 20 bp, Artificial
  CRISPR gRNA sequence
atccactcactcacttcatc

SEQ ID NO: 32318 - DNA, 20 bp, Artificial
  CRISPR gRNA sequence
actcacttcatcattcgctt

SEQ ID NO: 32319 - DNA, 20 bp, Artificial
  CRISPR gRNA sequence
acttcatcattcgcttgccc

SEQ ID NO: 32320 - DNA, 20 bp, Artificial
  CRISPR gRNA sequence
catcattcgcttgcccctca

SEQ ID NO: 32321 - DNA, 20 bp, Artificial
  CRISPR gRNA sequence
atcattcgcttgcccctcat

SEQ ID NO: 32322 - DNA, 20 bp, Artificial
  CRISPR gRNA sequence
gcttgcccctcattcattct

SEQ ID NO: 32323 - DNA, 20 bp, Artificial
  CRISPR gRNA sequence
gcccctcattcattctctca

SEQ ID NO: 32324 - DNA, 20 bp, Artificial
  CRISPR gRNA sequence
cccctcattcattctctcag

SEQ ID NO: 32325 - DNA, 20 bp, Artificial
  CRISPR gRNA sequence
attcattctctcagcctgac

SEQ ID NO: 32326 - DNA, 20 bp, Artificial
  CRISPR gRNA sequence
attctctcagcctgacaatg

SEQ ID NO: 32327 - DNA, 20 bp, Artificial
  CRISPR gRNA sequence
tctcagcctgacaatgaagt

SEQ ID NO: 32328 - DNA, 20 bp, Artificial
  CRISPR gRNA sequence
tcagcctgacaatgaagtgt

SEQ ID NO: 32329 - DNA, 20 bp, Artificial
  CRISPR gRNA sequence
agcctgacaatgaagtgtta

SEQ ID NO: 32330 - DNA, 20 bp, Artificial
  CRISPR gRNA sequence
acaatgaagtgttaacaccc

SEQ ID NO: 32331 - DNA, 20 bp, Artificial
  CRISPR gRNA sequence
acacccagtgcaggcttatt

SEQ ID NO: 32332 - DNA, 20 bp, Artificial
  CRISPR gRNA sequence
attgaagggcaataaatatt

SEQ ID NO: 32333 - DNA, 20 bp, Artificial
  CRISPR gRNA sequence
ttgaagggcaataaatatta

SEQ ID NO: 32334 - DNA, 20 bp, Artificial
  CRISPR gRNA sequence
aagggcaataaatattattt

SEQ ID NO: 32335 - DNA, 20 bp, Artificial
  CRISPR gRNA sequence
tttgagggagtggtggagtg

SEQ ID NO: 32336 - DNA, 20 bp, Artificial
  CRISPR gRNA sequence
gagggagtggtggagtgaat

SEQ ID NO: 32337 - DNA, 20 bp, Artificial
  CRISPR gRNA sequence
agggagtggtggagtgaatg

SEQ ID NO: 32338 - DNA, 20 bp, Artificial
  CRISPR gRNA sequence
aataagtgtcaagtgaatga

SEQ ID NO: 32339 - DNA, 20 bp, Artificial
  CRISPR gRNA sequence
ccatctccaccacccagggc

SEQ ID NO: 32340 - DNA, 20 bp, Artificial
  CRISPR gRNA sequence
catctccaccacccagggca

SEQ ID NO: 32341 - DNA, 20 bp, Artificial
  CRISPR gRNA sequence
caccacccagggcagagaga

SEQ ID NO: 32342 - DNA, 20 bp, Artificial
  CRISPR gRNA sequence
accaggccattttggaagct

SEQ ID NO: 32343 - DNA, 20 bp, Artificial
  CRISPR gRNA sequence
tggaagcttgttggagacct

SEQ ID NO: 32344 - DNA, 20 bp, Artificial
  CRISPR gRNA sequence
ggaagcttgttggagacctc

SEQ ID NO: 32345 - DNA, 20 bp, Artificial
  CRISPR gRNA sequence
gaagcttgttggagacctct

SEQ ID NO: 32346 - DNA, 20 bp, Artificial
  CRISPR gRNA sequence
gttggagacctctccagctg

SEQ ID NO: 32347 - DNA, 20 bp, Artificial
  CRISPR gRNA sequence
ttggagacctctccagctgc

SEQ ID NO: 32348 - DNA, 20 bp, Artificial
  CRISPR gRNA sequence
gagacctctccagctgccgg

SEQ ID NO: 32349 - DNA, 20 bp, Artificial
  CRISPR gRNA sequence
tccagctgccgggcattggg

SEQ ID NO: 32350 - DNA, 20 bp, Artificial
  CRISPR gRNA sequence
cagctgccgggcattgggtg

SEQ ID NO: 32351 - DNA, 20 bp, Artificial
  CRISPR gRNA sequence
ccgggcattgggtgggggac

SEQ ID NO: 32352 - DNA, 20 bp, Artificial
  CRISPR gRNA sequence
ggtgggggacgtcttgtgct

SEQ ID NO: 32353 - DNA, 20 bp, Artificial
  CRISPR gRNA sequence
gtgctctggagatggagaag

SEQ ID NO: 32354 - DNA, 20 bp, Artificial
  CRISPR gRNA sequence
tgctctggagatggagaagc

SEQ ID NO: 32355 - DNA, 20 bp, Artificial
  CRISPR gRNA sequence
tggagatggagaagcaggtg

SEQ ID NO: 32356 - DNA, 20 bp, Artificial
  CRISPR gRNA sequence
gagatggagaagcaggtgcc

SEQ ID NO: 32357 - DNA, 20 bp, Artificial
  CRISPR gRNA sequence
agggtgagggttacccctgg

SEQ ID NO: 32358 - DNA, 20 bp, Artificial
  CRISPR gRNA sequence
gggtgagggttacccctggg

SEQ ID NO: 32359 - DNA, 20 bp, Artificial
  CRISPR gRNA sequence
cccctggggacccccctccc

SEQ ID NO: 32360 - DNA, 20 bp, Artificial
  CRISPR gRNA sequence
gggacccccctccctctggg

SEQ ID NO: 32361 - DNA, 20 bp, Artificial
  CRISPR gRNA sequence
cctctgggccacttagtcct

SEQ ID NO: 32362 - DNA, 20 bp, Artificial
  CRISPR gRNA sequence
tgggccacttagtccttaca

SEQ ID NO: 32363 - DNA, 20 bp, Artificial
  CRISPR gRNA sequence
ggccacttagtccttacagc

SEQ ID NO: 32364 - DNA, 20 bp, Artificial
  CRISPR gRNA sequence
agtccttacagccttcatgg

SEQ ID NO: 32365 - DNA, 20 bp, Artificial
  CRISPR gRNA sequence
gtccttacagccttcatggg

SEQ ID NO: 32366 - DNA, 20 bp, Artificial
  CRISPR gRNA sequence
acagccttcatgggctgagt

SEQ ID NO: 32367 - DNA, 20 bp, Artificial
  CRISPR gRNA sequence
cagccttcatgggctgagtt

SEQ ID NO: 32368 - DNA, 20 bp, Artificial
  CRISPR gRNA sequence
catgggctgagtttcccaag

SEQ ID NO: 32369 - DNA, 20 bp, Artificial
  CRISPR gRNA sequence
atgggctgagtttcccaaga

SEQ ID NO: 32370 - DNA, 20 bp, Artificial
  CRISPR gRNA sequence
agtttcccaagatggaggtt

SEQ ID NO: 32371 - DNA, 20 bp, Artificial
  CRISPR gRNA sequence
cccaagatggaggttataag

SEQ ID NO: 32372 - DNA, 20 bp, Artificial
  CRISPR gRNA sequence
ccaagatggaggttataaga

SEQ ID NO: 32373 - DNA, 20 bp, Artificial
  CRISPR gRNA sequence
taagatagcggcctgaggct

SEQ ID NO: 32374 - DNA, 20 bp, Artificial
  CRISPR gRNA sequence
aggctgtatctaactcaaat

SEQ ID NO: 32375 - DNA, 20 bp, Artificial
  CRISPR gRNA sequence
tatctaactcaaatatgtct

SEQ ID NO: 32376 - DNA, 20 bp, Artificial
  CRISPR gRNA sequence
actcaaatatgtctttcttt

SEQ ID NO: 32377 - DNA, 20 bp, Artificial
  CRISPR gRNA sequence
aaatatgtctttctttggcc

SEQ ID NO: 32378 - DNA, 20 bp, Artificial
  CRISPR gRNA sequence
tctttggccaactgtacttt

SEQ ID NO: 32379 - DNA, 20 bp, Artificial
  CRISPR gRNA sequence
ctttggccaactgtactttt

SEQ ID NO: 32380 - DNA, 20 bp, Artificial
  CRISPR gRNA sequence
tttggccaactgtactttta

SEQ ID NO: 32381 - DNA, 20 bp, Artificial
  CRISPR gRNA sequence
tggccaactgtacttttaaa

SEQ ID NO: 32382 - DNA, 20 bp, Artificial
  CRISPR gRNA sequence
ggccaactgtacttttaaaa

SEQ ID NO: 32383 - DNA, 20 bp, Artificial
  CRISPR gRNA sequence
gccaactgtacttttaaaaa

SEQ ID NO: 32384 - DNA, 20 bp, Artificial
  CRISPR gRNA sequence
tacttttaaaaatttcactc

SEQ ID NO: 32385 - DNA, 20 bp, Artificial
  CRISPR gRNA sequence
ttaaaaatttcactcatgtt

SEQ ID NO: 32386 - DNA, 20 bp, Artificial
  CRISPR gRNA sequence
taaaaatttcactcatgttt

SEQ ID NO: 32387 - DNA, 20 bp, Artificial
  CRISPR gRNA sequence
aaaaatttcactcatgttta

SEQ ID NO: 32388 - DNA, 20 bp, Artificial
  CRISPR gRNA sequence
aaaatttcactcatgtttaa

SEQ ID NO: 32389 - DNA, 20 bp, Artificial
  CRISPR gRNA sequence
cactcatgtttaaaaaagaa

SEQ ID NO: 32390 - DNA, 20 bp, Artificial
  CRISPR gRNA sequence
actcatgtttaaaaaagaaa

SEQ ID NO: 32391 - DNA, 20 bp, Artificial
  CRISPR gRNA sequence
atgtttaaaaaagaaaatcg

SEQ ID NO: 32392 - DNA, 20 bp, Artificial
  CRISPR gRNA sequence
aaaaaagaaaatcgcaatat

SEQ ID NO: 32393 - DNA, 20 bp, Artificial
  CRISPR gRNA sequence
aaaaagaaaatcgcaatatc

SEQ ID NO: 32394 - DNA, 20 bp, Artificial
  CRISPR gRNA sequence
ggtgcagtggctcacacctg

SEQ ID NO: 32395 - DNA, 20 bp, Artificial
  CRISPR gRNA sequence
acacctgtaatcccagcact

SEQ ID NO: 32396 - DNA, 20 bp, Artificial
  CRISPR gRNA sequence
taatcccagcactttgggag

SEQ ID NO: 32397 - DNA, 20 bp, Artificial
  CRISPR gRNA sequence
tgggaggtcgaggcaggtgg

SEQ ID NO: 32398 - DNA, 20 bp, Artificial
  CRISPR gRNA sequence
gggaggtcgaggcaggtgga

SEQ ID NO: 32399 - DNA, 20 bp, Artificial
  CRISPR gRNA sequence
ggaggtcgaggcaggtggat

SEQ ID NO: 32400 - DNA, 20 bp, Artificial
  CRISPR gRNA sequence
gagatcaggagttcgagacc

SEQ ID NO: 32401 - DNA, 20 bp, Artificial
  CRISPR gRNA sequence
agatcaggagttcgagacca

SEQ ID NO: 32402 - DNA, 20 bp, Artificial
  CRISPR gRNA sequence
gagaccagcctggccaacat

SEQ ID NO: 32403 - DNA, 20 bp, Artificial
  CRISPR gRNA sequence
gccaacatggttaaacttgt

SEQ ID NO: 32404 - DNA, 20 bp, Artificial
  CRISPR gRNA sequence
aacttgtctctactgaaatt

SEQ ID NO: 32405 - DNA, 20 bp, Artificial
  CRISPR gRNA sequence
gtctctactgaaattacaaa

SEQ ID NO: 32406 - DNA, 20 bp, Artificial
  CRISPR gRNA sequence
tctctactgaaattacaaaa

SEQ ID NO: 32407 - DNA, 20 bp, Artificial
  CRISPR gRNA sequence
tactgaaattacaaaaattg

SEQ ID NO: 32408 - DNA, 20 bp, Artificial
  CRISPR gRNA sequence
ctgaaattacaaaaattggc

SEQ ID NO: 32409 - DNA, 20 bp, Artificial
  CRISPR gRNA sequence
aaattacaaaaattggctgg

SEQ ID NO: 32410 - DNA, 20 bp, Artificial
  CRISPR gRNA sequence
caaaaattggctgggtgtga

SEQ ID NO: 32411 - DNA, 20 bp, Artificial
  CRISPR gRNA sequence
gctgggtgtgacggtgcaca

SEQ ID NO: 32412 - DNA, 20 bp, Artificial
  CRISPR gRNA sequence
ggtgtgacggtgcacacctg

SEQ ID NO: 32413 - DNA, 20 bp, Artificial
  CRISPR gRNA sequence
taattccagctgctccggag

SEQ ID NO: 32414 - DNA, 20 bp, Artificial
  CRISPR gRNA sequence
cagctgctccggaggctgag

SEQ ID NO: 32415 - DNA, 20 bp, Artificial
  CRISPR gRNA sequence
ctccggaggctgaggcagga

SEQ ID NO: 32416 - DNA, 20 bp, Artificial
  CRISPR gRNA sequence
cggaggctgaggcaggagaa

SEQ ID NO: 32417 - DNA, 20 bp, Artificial
  CRISPR gRNA sequence
aggcaggagaatcacttgaa

SEQ ID NO: 32418 - DNA, 20 bp, Artificial
  CRISPR gRNA sequence
gaacctgtagggcggaggtt

SEQ ID NO: 32419 - DNA, 20 bp, Artificial
  CRISPR gRNA sequence
aacctgtagggcggaggttg

SEQ ID NO: 32420 - DNA, 20 bp, Artificial
  CRISPR gRNA sequence
tagggcggaggttgcagtga

SEQ ID NO: 32421 - DNA, 20 bp, Artificial
  CRISPR gRNA sequence
cagtgatctgagatcgcacc

SEQ ID NO: 32422 - DNA, 20 bp, Artificial
  CRISPR gRNA sequence
agatcgcaccactgcactct

SEQ ID NO: 32423 - DNA, 20 bp, Artificial
  CRISPR gRNA sequence
cactctagcctgggcaacag

SEQ ID NO: 32424 - DNA, 20 bp, Artificial
  CRISPR gRNA sequence
tagcctgggcaacagagtga

SEQ ID NO: 32425 - DNA, 20 bp, Artificial
  CRISPR gRNA sequence
gcctgggcaacagagtgaga

SEQ ID NO: 32426 - DNA, 20 bp, Artificial
  CRISPR gRNA sequence
ggcaacagagtgagactcca

SEQ ID NO: 32427 - DNA, 20 bp, Artificial
  CRISPR gRNA sequence
catctcaacaataaataaat

SEQ ID NO: 32428 - DNA, 20 bp, Artificial
  CRISPR gRNA sequence
aacaataaataaataataaa

SEQ ID NO: 32429 - DNA, 20 bp, Artificial
  CRISPR gRNA sequence
aaaaatcacaatatctatgt

SEQ ID NO: 32430 - DNA, 20 bp, Artificial
  CRISPR gRNA sequence
tgtaaaaatcagggttttca

SEQ ID NO: 32431 - DNA, 20 bp, Artificial
  CRISPR gRNA sequence
tcaacttcaaaagatctgac

SEQ ID NO: 32432 - DNA, 20 bp, Artificial
  CRISPR gRNA sequence
caacttcaaaagatctgacc

SEQ ID NO: 32433 - DNA, 20 bp, Artificial
  CRISPR gRNA sequence
aacttcaaaagatctgacca

SEQ ID NO: 32434 - DNA, 20 bp, Artificial
  CRISPR gRNA sequence
caaaagatctgaccacattg

SEQ ID NO: 32435 - DNA, 20 bp, Artificial
  CRISPR gRNA sequence
aaaagatctgaccacattgt

SEQ ID NO: 32436 - DNA, 20 bp, Artificial
  CRISPR gRNA sequence
accacattgtctggcttttc

SEQ ID NO: 32437 - DNA, 20 bp, Artificial
  CRISPR gRNA sequence
tctggcttttctgctgggta

SEQ ID NO: 32438 - DNA, 20 bp, Artificial
  CRISPR gRNA sequence
gcttttctgctgggtaacaa

SEQ ID NO: 32439 - DNA, 20 bp, Artificial
  CRISPR gRNA sequence
ttctgctgggtaacaagcag

SEQ ID NO: 32440 - DNA, 20 bp, Artificial
  CRISPR gRNA sequence
tctgctgggtaacaagcagc

SEQ ID NO: 32441 - DNA, 20 bp, Artificial
  CRISPR gRNA sequence
ctgctgggtaacaagcagct

SEQ ID NO: 32442 - DNA, 20 bp, Artificial
  CRISPR gRNA sequence
tgctgggtaacaagcagctg

SEQ ID NO: 32443 - DNA, 20 bp, Artificial
  CRISPR gRNA sequence
ctgggtaacaagcagctgaa

SEQ ID NO: 32444 - DNA, 20 bp, Artificial
  CRISPR gRNA sequence
ggtaacaagcagctgaaggc

SEQ ID NO: 32445 - DNA, 20 bp, Artificial
  CRISPR gRNA sequence
aaggctgatggctgtatttg

SEQ ID NO: 32446 - DNA, 20 bp, Artificial
  CRISPR gRNA sequence
atggctgtatttggatggga

SEQ ID NO: 32447 - DNA, 20 bp, Artificial
  CRISPR gRNA sequence
tatttggatgggatgtggat

SEQ ID NO: 32448 - DNA, 20 bp, Artificial
  CRISPR gRNA sequence
ggatgggatgtggattctct

SEQ ID NO: 32449 - DNA, 20 bp, Artificial
  CRISPR gRNA sequence
gatgggatgtggattctcta

SEQ ID NO: 32450 - DNA, 20 bp, Artificial
  CRISPR gRNA sequence
tctagctgtccattccccca

SEQ ID NO: 32451 - DNA, 20 bp, Artificial
  CRISPR gRNA sequence
tagctgtccattcccccaca

SEQ ID NO: 32452 - DNA, 20 bp, Artificial
  CRISPR gRNA sequence
gctgtccattcccccacaac

SEQ ID NO: 32453 - DNA, 20 bp, Artificial
  CRISPR gRNA sequence
tccattcccccacaaccatg

SEQ ID NO: 32454 - DNA, 20 bp, Artificial
  CRISPR gRNA sequence
ccccacaaccatgcctccac

SEQ ID NO: 32455 - DNA, 20 bp, Artificial
  CRISPR gRNA sequence
cactccctggagaccctccc

SEQ ID NO: 32456 - DNA, 20 bp, Artificial
  CRISPR gRNA sequence
cctggagaccctccctgtcc

SEQ ID NO: 32457 - DNA, 20 bp, Artificial
  CRISPR gRNA sequence
gagaccctccctgtcccgac

SEQ ID NO: 32458 - DNA, 20 bp, Artificial
  CRISPR gRNA sequence
cctgtcccgactgaccccta

SEQ ID NO: 32459 - DNA, 20 bp, Artificial
  CRISPR gRNA sequence
tcccgactgacccctaaaca

SEQ ID NO: 32460 - DNA, 20 bp, Artificial
  CRISPR gRNA sequence
acccctaaacatgacctgtt

SEQ ID NO: 32461 - DNA, 20 bp, Artificial
  CRISPR gRNA sequence
aacatgacctgttgtcccta

SEQ ID NO: 32462 - DNA, 20 bp, Artificial
  CRISPR gRNA sequence
ttgtccctacaggcagcttt

SEQ ID NO: 32463 - DNA, 20 bp, Artificial
  CRISPR gRNA sequence
tccctacaggcagctttgct

SEQ ID NO: 32464 - DNA, 20 bp, Artificial
  CRISPR gRNA sequence
caggcagctttgcttgtgga

SEQ ID NO: 32465 - DNA, 20 bp, Artificial
  CRISPR gRNA sequence
tgcttgtggatcttatttga

SEQ ID NO: 32466 - DNA, 20 bp, Artificial
  CRISPR gRNA sequence
gcttgtggatcttatttgag

SEQ ID NO: 32467 - DNA, 20 bp, Artificial
  CRISPR gRNA sequence
cttgtggatcttatttgaga

SEQ ID NO: 32468 - DNA, 20 bp, Artificial
  CRISPR gRNA sequence
gtggatcttatttgagacaa

SEQ ID NO: 32469 - DNA, 20 bp, Artificial
  CRISPR gRNA sequence
tggatcttatttgagacaat

SEQ ID NO: 32470 - DNA, 20 bp, Artificial
  CRISPR gRNA sequence
atttgagacaattccttccc

SEQ ID NO: 32471 - DNA, 20 bp, Artificial
  CRISPR gRNA sequence
tttgagacaattccttcccc

SEQ ID NO: 32472 - DNA, 20 bp, Artificial
  CRISPR gRNA sequence
gagacaattccttccccagg

SEQ ID NO: 32473 - DNA, 20 bp, Artificial
  CRISPR gRNA sequence
agacaattccttccccaggg

SEQ ID NO: 32474 - DNA, 20 bp, Artificial
  CRISPR gRNA sequence
cttccccagggcctcgatcc

SEQ ID NO: 32475 - DNA, 20 bp, Artificial
  CRISPR gRNA sequence
ccccagggcctcgatcctgc

SEQ ID NO: 32476 - DNA, 20 bp, Artificial
  CRISPR gRNA sequence
cccagggcctcgatcctgct

SEQ ID NO: 32477 - DNA, 20 bp, Artificial
  CRISPR gRNA sequence
gatcctgcttctagtacctc

SEQ ID NO: 32478 - DNA, 20 bp, Artificial
  CRISPR gRNA sequence
cttctagtacctctcacagg

SEQ ID NO: 32479 - DNA, 20 bp, Artificial
  CRISPR gRNA sequence
ctagtacctctcacaggccc

SEQ ID NO: 32480 - DNA, 20 bp, Artificial
  CRISPR gRNA sequence
tagtacctctcacaggccct

SEQ ID NO: 32481 - DNA, 20 bp, Artificial
  CRISPR gRNA sequence
gtacctctcacaggccctaa

SEQ ID NO: 32482 - DNA, 20 bp, Artificial
  CRISPR gRNA sequence
tcacaggccctaagggtcct

SEQ ID NO: 32483 - DNA, 20 bp, Artificial
  CRISPR gRNA sequence
acaggccctaagggtcctta

SEQ ID NO: 32484 - DNA, 20 bp, Artificial
  CRISPR gRNA sequence
agggtccttacctgtcatgt

SEQ ID NO: 32485 - DNA, 20 bp, Artificial
  CRISPR gRNA sequence
acctgtcatgtttgctcggg

SEQ ID NO: 32486 - DNA, 20 bp, Artificial
  CRISPR gRNA sequence
cctgtcatgtttgctcggga

SEQ ID NO: 32487 - DNA, 20 bp, Artificial
  CRISPR gRNA sequence
tcatgtttgctcgggaggtc

SEQ ID NO: 32488 - DNA, 20 bp, Artificial
  CRISPR gRNA sequence
gctcgggaggtcagggcagg

SEQ ID NO: 32489 - DNA, 20 bp, Artificial
  CRISPR gRNA sequence
ctcgggaggtcagggcaggt

SEQ ID NO: 32490 - DNA, 20 bp, Artificial
  CRISPR gRNA sequence
gggaggtcagggcaggttca

SEQ ID NO: 32491 - DNA, 20 bp, Artificial
  CRISPR gRNA sequence
aggcatgctgggcaggtcag

SEQ ID NO: 32492 - DNA, 20 bp, Artificial
  CRISPR gRNA sequence
ggcaggtcagtggctgatgg

SEQ ID NO: 32493 - DNA, 20 bp, Artificial
  CRISPR gRNA sequence
atggagcgaaggggctggtg

SEQ ID NO: 32494 - DNA, 20 bp, Artificial
  CRISPR gRNA sequence
gtggagcctggccggtctgg

SEQ ID NO: 32495 - DNA, 20 bp, Artificial
  CRISPR gRNA sequence
gccggtctggagatgttggg

SEQ ID NO: 32496 - DNA, 20 bp, Artificial
  CRISPR gRNA sequence
gagatgttgggaggccgtgg

SEQ ID NO: 32497 - DNA, 20 bp, Artificial
  CRISPR gRNA sequence
ggaggccgtggacagtgaat

SEQ ID NO: 32498 - DNA, 20 bp, Artificial
  CRISPR gRNA sequence
ggagggggtacttggctggc

SEQ ID NO: 32499 - DNA, 20 bp, Artificial
  CRISPR gRNA sequence
ggctggcctggggcacctca

SEQ ID NO: 32500 - DNA, 20 bp, Artificial
  CRISPR gRNA sequence
gctggcctggggcacctcac

SEQ ID NO: 32501 - DNA, 20 bp, Artificial
  CRISPR gRNA sequence
gcctggggcacctcacctac

SEQ ID NO: 32502 - DNA, 20 bp, Artificial
  CRISPR gRNA sequence
gggcacctcacctacattgg

SEQ ID NO: 32503 - DNA, 20 bp, Artificial
  CRISPR gRNA sequence
acctacattgggggtggaga

SEQ ID NO: 32504 - DNA, 20 bp, Artificial
  CRISPR gRNA sequence
cattgggggtggagagtggt

SEQ ID NO: 32505 - DNA, 20 bp, Artificial
  CRISPR gRNA sequence
ggggtggagagtggtgtgag

SEQ ID NO: 32506 - DNA, 20 bp, Artificial
  CRISPR gRNA sequence
attccagaaatgcacttggg

SEQ ID NO: 32507 - DNA, 20 bp, Artificial
  CRISPR gRNA sequence
cagaaatgcacttgggtcac

SEQ ID NO: 32508 - DNA, 20 bp, Artificial
  CRISPR gRNA sequence
gggtcacccctactccaaac

SEQ ID NO: 32509 - DNA, 20 bp, Artificial
  CRISPR gRNA sequence
ggtcacccctactccaaact

SEQ ID NO: 32510 - DNA, 20 bp, Artificial
  CRISPR gRNA sequence
ctccaaactgggctgtggag

SEQ ID NO: 32511 - DNA, 20 bp, Artificial
  CRISPR gRNA sequence
caaactgggctgtggagctc

SEQ ID NO: 32512 - DNA, 20 bp, Artificial
  CRISPR gRNA sequence
ggctgtggagctcaggaagt

SEQ ID NO: 32513 - DNA, 20 bp, Artificial
  CRISPR gRNA sequence
tggagctcaggaagtctgga

SEQ ID NO: 32514 - DNA, 20 bp, Artificial
  CRISPR gRNA sequence
aggaagtctggagagaagag

SEQ ID NO: 32515 - DNA, 20 bp, Artificial
  CRISPR gRNA sequence
gagagaagagagtagaactt

SEQ ID NO: 32516 - DNA, 20 bp, Artificial
  CRISPR gRNA sequence
ccaaaggaagatatttcagg

SEQ ID NO: 32517 - DNA, 20 bp, Artificial
  CRISPR gRNA sequence
caaaggaagatatttcagga

SEQ ID NO: 32518 - DNA, 20 bp, Artificial
  CRISPR gRNA sequence
caggacagagctgaagaaag

SEQ ID NO: 32519 - DNA, 20 bp, Artificial
  CRISPR gRNA sequence
aggacagagctgaagaaaga

SEQ ID NO: 32520 - DNA, 20 bp, Artificial
  CRISPR gRNA sequence
aagaaagagctctggagtta

SEQ ID NO: 32521 - DNA, 20 bp, Artificial
  CRISPR gRNA sequence
tggagttacatctagctcct

SEQ ID NO: 32522 - DNA, 20 bp, Artificial
  CRISPR gRNA sequence
gagttacatctagctcctgg

SEQ ID NO: 32523 - DNA, 20 bp, Artificial
  CRISPR gRNA sequence
catctagctcctggaacctt

SEQ ID NO: 32524 - DNA, 20 bp, Artificial
  CRISPR gRNA sequence
gctcctggaaccttgctttt

SEQ ID NO: 32525 - DNA, 20 bp, Artificial
  CRISPR gRNA sequence
ctggaaccttgcttttccaa

SEQ ID NO: 32526 - DNA, 20 bp, Artificial
  CRISPR gRNA sequence
gaaccttgcttttccaatct

SEQ ID NO: 32527 - DNA, 20 bp, Artificial
  CRISPR gRNA sequence
gcttttccaatctgtgaaat

SEQ ID NO: 32528 - DNA, 20 bp, Artificial
  CRISPR gRNA sequence
cttttccaatctgtgaaatg

SEQ ID NO: 32529 - DNA, 20 bp, Artificial
  CRISPR gRNA sequence
ttccaatctgtgaaatgggt

SEQ ID NO: 32530 - DNA, 20 bp, Artificial
  CRISPR gRNA sequence
tccaatctgtgaaatgggtg

SEQ ID NO: 32531 - DNA, 20 bp, Artificial
  CRISPR gRNA sequence
ccaatctgtgaaatgggtgc

SEQ ID NO: 32532 - DNA, 20 bp, Artificial
  CRISPR gRNA sequence
caatctgtgaaatgggtgca

SEQ ID NO: 32533 - DNA, 20 bp, Artificial
  CRISPR gRNA sequence
tgaaatgggtgcaattagct

SEQ ID NO: 32534 - DNA, 20 bp, Artificial
  CRISPR gRNA sequence
gctcataaggaacttagggc

SEQ ID NO: 32535 - DNA, 20 bp, Artificial
  CRISPR gRNA sequence
ataaggaacttagggcaggt

SEQ ID NO: 32536 - DNA, 20 bp, Artificial
  CRISPR gRNA sequence
agggcaggtactactattgc

SEQ ID NO: 32537 - DNA, 20 bp, Artificial
  CRISPR gRNA sequence
gggcaggtactactattgca

SEQ ID NO: 32538 - DNA, 20 bp, Artificial
  CRISPR gRNA sequence
ctattgcactcttcctgctg

SEQ ID NO: 32539 - DNA, 20 bp, Artificial
  CRISPR gRNA sequence
ttgcactcttcctgctgtgt

SEQ ID NO: 32540 - DNA, 20 bp, Artificial
  CRISPR gRNA sequence
cactcttcctgctgtgtggt

SEQ ID NO: 32541 - DNA, 20 bp, Artificial
  CRISPR gRNA sequence
ttcctgctgtgtggtcagtg

SEQ ID NO: 32542 - DNA, 20 bp, Artificial
  CRISPR gRNA sequence
cctgctgtgtggtcagtgct

SEQ ID NO: 32543 - DNA, 20 bp, Artificial
  CRISPR gRNA sequence
ctgctgtgtggtcagtgctc

SEQ ID NO: 32544 - DNA, 20 bp, Artificial
  CRISPR gRNA sequence
ctgtgtggtcagtgctcatt

SEQ ID NO: 32545 - DNA, 20 bp, Artificial
  CRISPR gRNA sequence
tgtggtcagtgctcattttc

SEQ ID NO: 32546 - DNA, 20 bp, Artificial
  CRISPR gRNA sequence
attttcctagatatcaggaa

SEQ ID NO: 32547 - DNA, 20 bp, Artificial
  CRISPR gRNA sequence
tcctagatatcaggaactgc

SEQ ID NO: 32548 - DNA, 20 bp, Artificial
  CRISPR gRNA sequence
cctagatatcaggaactgct

SEQ ID NO: 32549 - DNA, 20 bp, Artificial
  CRISPR gRNA sequence
ctagatatcaggaactgctt

SEQ ID NO: 32550 - DNA, 20 bp, Artificial
  CRISPR gRNA sequence
gatatcaggaactgcttctc

SEQ ID NO: 32551 - DNA, 20 bp, Artificial
  CRISPR gRNA sequence
cttctctgcttctgagatac

SEQ ID NO: 32552 - DNA, 20 bp, Artificial
  CRISPR gRNA sequence
ctctgcttctgagataccag

SEQ ID NO: 32553 - DNA, 20 bp, Artificial
  CRISPR gRNA sequence
tctgcttctgagataccagt

SEQ ID NO: 32554 - DNA, 20 bp, Artificial
  CRISPR gRNA sequence
tgcttctgagataccagtgc

SEQ ID NO: 32555 - DNA, 20 bp, Artificial
  CRISPR gRNA sequence
cttctgagataccagtgcgt

SEQ ID NO: 32556 - DNA, 20 bp, Artificial
  CRISPR gRNA sequence
ctgagataccagtgcgttat

SEQ ID NO: 32557 - DNA, 20 bp, Artificial
  CRISPR gRNA sequence
tgagataccagtgcgttata

SEQ ID NO: 32558 - DNA, 20 bp, Artificial
  CRISPR gRNA sequence
agataccagtgcgttatact

SEQ ID NO: 32559 - DNA, 20 bp, Artificial
  CRISPR gRNA sequence
tactgaaactgtcttgcaac

SEQ ID NO: 32560 - DNA, 20 bp, Artificial
  CRISPR gRNA sequence
aaactgtcttgcaaccagga

SEQ ID NO: 32561 - DNA, 20 bp, Artificial
  CRISPR gRNA sequence
tcttgcaaccaggaatggat

SEQ ID NO: 32562 - DNA, 20 bp, Artificial
  CRISPR gRNA sequence
gcaaccaggaatggatgctc

SEQ ID NO: 32563 - DNA, 20 bp, Artificial
  CRISPR gRNA sequence
caaccaggaatggatgctct

SEQ ID NO: 32564 - DNA, 20 bp, Artificial
  CRISPR gRNA sequence
tggacttgagtggaagcatc

SEQ ID NO: 32565 - DNA, 20 bp, Artificial
  CRISPR gRNA sequence
gacttgagtggaagcatcct

SEQ ID NO: 32566 - DNA, 20 bp, Artificial
  CRISPR gRNA sequence
gagtggaagcatcctcctgg

SEQ ID NO: 32567 - DNA, 20 bp, Artificial
  CRISPR gRNA sequence
agtggaagcatcctcctggt

SEQ ID NO: 32568 - DNA, 20 bp, Artificial
  CRISPR gRNA sequence
ctggtctcatccctgacagc

SEQ ID NO: 32569 - DNA, 20 bp, Artificial
  CRISPR gRNA sequence
gtctcatccctgacagccca

SEQ ID NO: 32570 - DNA, 20 bp, Artificial
  CRISPR gRNA sequence
atccctgacagcccaaacac

SEQ ID NO: 32571 - DNA, 20 bp, Artificial
  CRISPR gRNA sequence
acagcccaaacacaccttcc

SEQ ID NO: 32572 - DNA, 20 bp, Artificial
  CRISPR gRNA sequence
ccctgagacaagtcacaacc

SEQ ID NO: 32573 - DNA, 20 bp, Artificial
  CRISPR gRNA sequence
cctgagacaagtcacaaccc

SEQ ID NO: 32574 - DNA, 20 bp, Artificial
  CRISPR gRNA sequence
agacaagtcacaacccctca

SEQ ID NO: 32575 - DNA, 20 bp, Artificial
  CRISPR gRNA sequence
agtgtggtgggtcagtaggg

SEQ ID NO: 32576 - DNA, 20 bp, Artificial
  CRISPR gRNA sequence
tactgattaggaaacaagac

SEQ ID NO: 32577 - DNA, 20 bp, Artificial
  CRISPR gRNA sequence
actgattaggaaacaagaca

SEQ ID NO: 32578 - DNA, 20 bp, Artificial
  CRISPR gRNA sequence
ctgattaggaaacaagacaa

SEQ ID NO: 32579 - DNA, 20 bp, Artificial
  CRISPR gRNA sequence
attaggaaacaagacaaatc

SEQ ID NO: 32580 - DNA, 20 bp, Artificial
  CRISPR gRNA sequence
ggaaacaagacaaatcagag

SEQ ID NO: 32581 - DNA, 20 bp, Artificial
  CRISPR gRNA sequence
tgcaaggatgcacaccaaac

SEQ ID NO: 32582 - DNA, 20 bp, Artificial
  CRISPR gRNA sequence
ttcacatcagtatactaaaa

SEQ ID NO: 32583 - DNA, 20 bp, Artificial
  CRISPR gRNA sequence
acatcagtatactaaaagag

SEQ ID NO: 32584 - DNA, 20 bp, Artificial
  CRISPR gRNA sequence
aaagagtgagagagacagtg

SEQ ID NO: 32585 - DNA, 20 bp, Artificial
  CRISPR gRNA sequence
ttgtaaacatcacttgtcat

SEQ ID NO: 32586 - DNA, 20 bp, Artificial
  CRISPR gRNA sequence
gtaaacatcacttgtcatta

SEQ ID NO: 32587 - DNA, 20 bp, Artificial
  CRISPR gRNA sequence
taaacatcacttgtcattag

SEQ ID NO: 32588 - DNA, 20 bp, Artificial
  CRISPR gRNA sequence
gtcattagcttattagtgag

SEQ ID NO: 32589 - DNA, 20 bp, Artificial
  CRISPR gRNA sequence
tcattagcttattagtgagc

SEQ ID NO: 32590 - DNA, 20 bp, Artificial
  CRISPR gRNA sequence
gcttattagtgagcatgtat

SEQ ID NO: 32591 - DNA, 20 bp, Artificial
  CRISPR gRNA sequence
attagtgagcatgtattgat

SEQ ID NO: 32592 - DNA, 20 bp, Artificial
  CRISPR gRNA sequence
ttagtgagcatgtattgatg

SEQ ID NO: 32593 - DNA, 20 bp, Artificial
  CRISPR gRNA sequence
gtgagcatgtattgatgttg

SEQ ID NO: 32594 - DNA, 20 bp, Artificial
  CRISPR gRNA sequence
atgttgcaatttaaaaacaa

SEQ ID NO: 32595 - DNA, 20 bp, Artificial
  CRISPR gRNA sequence
caatttaaaaacaaaaacat

SEQ ID NO: 32596 - DNA, 20 bp, Artificial
  CRISPR gRNA sequence
aaaaacaaaaacatttaaaa

SEQ ID NO: 32597 - DNA, 20 bp, Artificial
  CRISPR gRNA sequence
aaaacaaaaacatttaaaaa

SEQ ID NO: 32598 - DNA, 20 bp, Artificial
  CRISPR gRNA sequence
aaaaaaaataaggaaaaact

SEQ ID NO: 32599 - DNA, 20 bp, Artificial
  CRISPR gRNA sequence
aaaaaaataaggaaaaacta

SEQ ID NO: 32600 - DNA, 20 bp, Artificial
  CRISPR gRNA sequence
agggtcagaaggggaaagca

SEQ ID NO: 32601 - DNA, 20 bp, Artificial
  CRISPR gRNA sequence
ttggtcatgcacccagacca

SEQ ID NO: 32602 - DNA, 20 bp, Artificial
  CRISPR gRNA sequence
ggtcatgcacccagaccacc

SEQ ID NO: 32603 - DNA, 20 bp, Artificial
  CRISPR gRNA sequence
gtcatgcacccagaccacct

SEQ ID NO: 32604 - DNA, 20 bp, Artificial
  CRISPR gRNA sequence
aggaatctctgctcttctgc

SEQ ID NO: 32605 - DNA, 20 bp, Artificial
  CRISPR gRNA sequence
tgctcttctgctttgatttt

SEQ ID NO: 32606 - DNA, 20 bp, Artificial
  CRISPR gRNA sequence
ctcttctgctttgatttttg

SEQ ID NO: 32607 - DNA, 20 bp, Artificial
  CRISPR gRNA sequence
ttctgctttgatttttggga

SEQ ID NO: 32608 - DNA, 20 bp, Artificial
  CRISPR gRNA sequence
ctgctttgatttttgggaaa

SEQ ID NO: 32609 - DNA, 20 bp, Artificial
  CRISPR gRNA sequence
tgctttgatttttgggaaat

SEQ ID NO: 32610 - DNA, 20 bp, Artificial
  CRISPR gRNA sequence
ctttgatttttgggaaatag

SEQ ID NO: 32611 - DNA, 20 bp, Artificial
  CRISPR gRNA sequence
tgatttttgggaaataggga

SEQ ID NO: 32612 - DNA, 20 bp, Artificial
  CRISPR gRNA sequence
gatttttgggaaatagggac

SEQ ID NO: 32613 - DNA, 20 bp, Artificial
  CRISPR gRNA sequence
atttttgggaaatagggaca

SEQ ID NO: 32614 - DNA, 20 bp, Artificial
  CRISPR gRNA sequence
ttgggaaatagggacagaga

SEQ ID NO: 32615 - DNA, 20 bp, Artificial
  CRISPR gRNA sequence
tgggaaatagggacagagaa

SEQ ID NO: 32616 - DNA, 20 bp, Artificial
  CRISPR gRNA sequence
gggaaatagggacagagaaa

SEQ ID NO: 32617 - DNA, 20 bp, Artificial
  CRISPR gRNA sequence
ggaaatagggacagagaaag

SEQ ID NO: 32618 - DNA, 20 bp, Artificial
  CRISPR gRNA sequence
tgctggggagggaggatcat

SEQ ID NO: 32619 - DNA, 20 bp, Artificial
  CRISPR gRNA sequence
gggagggaggatcatgagaa

SEQ ID NO: 32620 - DNA, 20 bp, Artificial
  CRISPR gRNA sequence
gggcaccactgccaagtgca

SEQ ID NO: 32621 - DNA, 20 bp, Artificial
  CRISPR gRNA sequence
ccaagtgcatggagtatggg

SEQ ID NO: 32622 - DNA, 20 bp, Artificial
  CRISPR gRNA sequence
accatggtagatgaatatac

SEQ ID NO: 32623 - DNA, 20 bp, Artificial
  CRISPR gRNA sequence
gagacccctgttccagcctc

SEQ ID NO: 32624 - DNA, 20 bp, Artificial
  CRISPR gRNA sequence
ttccagcctcagagatttgc

SEQ ID NO: 32625 - DNA, 20 bp, Artificial
  CRISPR gRNA sequence
cagcctcagagatttgccag

SEQ ID NO: 32626 - DNA, 20 bp, Artificial
  CRISPR gRNA sequence
agagatttgccagagcccat

SEQ ID NO: 32627 - DNA, 20 bp, Artificial
  CRISPR gRNA sequence
gccagagcccatggggcaga

SEQ ID NO: 32628 - DNA, 20 bp, Artificial
  CRISPR gRNA sequence
ccagagcccatggggcagag

SEQ ID NO: 32629 - DNA, 20 bp, Artificial
  CRISPR gRNA sequence
gatgggtccctcagggagat

SEQ ID NO: 32630 - DNA, 20 bp, Artificial
  CRISPR gRNA sequence
agggagattcaggcagctca

SEQ ID NO: 32631 - DNA, 20 bp, Artificial
  CRISPR gRNA sequence
aggcagctcaacgaggaact

SEQ ID NO: 32632 - DNA, 20 bp, Artificial
  CRISPR gRNA sequence
aacgaggaactggagaaagg

SEQ ID NO: 32633 - DNA, 20 bp, Artificial
  CRISPR gRNA sequence
gagaaaggcactgcaagaga

SEQ ID NO: 32634 - DNA, 20 bp, Artificial
  CRISPR gRNA sequence
caagagacaaaggcagtgag

SEQ ID NO: 32635 - DNA, 20 bp, Artificial
  CRISPR gRNA sequence
gcatagcacctgtgtttgcg

SEQ ID NO: 32636 - DNA, 20 bp, Artificial
  CRISPR gRNA sequence
catagcacctgtgtttgcga

SEQ ID NO: 32637 - DNA, 20 bp, Artificial
  CRISPR gRNA sequence
tgtttgcgattctgcttttg

SEQ ID NO: 32638 - DNA, 20 bp, Artificial
  CRISPR gRNA sequence
gcgattctgcttttgcttat

SEQ ID NO: 32639 - DNA, 20 bp, Artificial
  CRISPR gRNA sequence
cgattctgcttttgcttatt

SEQ ID NO: 32640 - DNA, 20 bp, Artificial
  CRISPR gRNA sequence
tgcttttgcttatttgatta

SEQ ID NO: 32641 - DNA, 20 bp, Artificial
  CRISPR gRNA sequence
cttttgcttatttgattaat

SEQ ID NO: 32642 - DNA, 20 bp, Artificial
  CRISPR gRNA sequence
ttgcttatttgattaatgtc

SEQ ID NO: 32643 - DNA, 20 bp, Artificial
  CRISPR gRNA sequence
tgcttatttgattaatgtct

SEQ ID NO: 32644 - DNA, 20 bp, Artificial
  CRISPR gRNA sequence
gcttatttgattaatgtctg

SEQ ID NO: 32645 - DNA, 20 bp, Artificial
  CRISPR gRNA sequence
cttatttgattaatgtctga

SEQ ID NO: 32646 - DNA, 20 bp, Artificial
  CRISPR gRNA sequence
atttgattaatgtctgaccc

SEQ ID NO: 32647 - DNA, 20 bp, Artificial
  CRISPR gRNA sequence
tttgattaatgtctgacccc

SEQ ID NO: 32648 - DNA, 20 bp, Artificial
  CRISPR gRNA sequence
gattaatgtctgacccccct

SEQ ID NO: 32649 - DNA, 20 bp, Artificial
  CRISPR gRNA sequence
attaatgtctgaccccccta

SEQ ID NO: 32650 - DNA, 20 bp, Artificial
  CRISPR gRNA sequence
atgtctgacccccctaaagg

SEQ ID NO: 32651 - DNA, 20 bp, Artificial
  CRISPR gRNA sequence
acccccctaaagggccctaa

SEQ ID NO: 32652 - DNA, 20 bp, Artificial
  CRISPR gRNA sequence
aagggccctaatttccctaa

SEQ ID NO: 32653 - DNA, 20 bp, Artificial
  CRISPR gRNA sequence
atttccctaagagcagtagc

SEQ ID NO: 32654 - DNA, 20 bp, Artificial
  CRISPR gRNA sequence
ccctaagagcagtagctgtt

SEQ ID NO: 32655 - DNA, 20 bp, Artificial
  CRISPR gRNA sequence
cctaagagcagtagctgttt

SEQ ID NO: 32656 - DNA, 20 bp, Artificial
  CRISPR gRNA sequence
agagcagtagctgtttctgt

SEQ ID NO: 32657 - DNA, 20 bp, Artificial
  CRISPR gRNA sequence
tttctgtcctgccctgatgg

SEQ ID NO: 32658 - DNA, 20 bp, Artificial
  CRISPR gRNA sequence
ctgtcctgccctgatggaat

SEQ ID NO: 32659 - DNA, 20 bp, Artificial
  CRISPR gRNA sequence
tgtcctgccctgatggaatt

SEQ ID NO: 32660 - DNA, 20 bp, Artificial
  CRISPR gRNA sequence
tcctgccctgatggaattct

SEQ ID NO: 32661 - DNA, 20 bp, Artificial
  CRISPR gRNA sequence
ccctgatggaattcttagca

SEQ ID NO: 32662 - DNA, 20 bp, Artificial
  CRISPR gRNA sequence
atggaattcttagcacctag

SEQ ID NO: 32663 - DNA, 20 bp, Artificial
  CRISPR gRNA sequence
ttagcacctagcagagcagt

SEQ ID NO: 32664 - DNA, 20 bp, Artificial
  CRISPR gRNA sequence
agcacctagcagagcagttg

SEQ ID NO: 32665 - DNA, 20 bp, Artificial
  CRISPR gRNA sequence
gcacctagcagagcagttgg

SEQ ID NO: 32666 - DNA, 20 bp, Artificial
  CRISPR gRNA sequence
gcagagcagttggcacagag

SEQ ID NO: 32667 - DNA, 20 bp, Artificial
  CRISPR gRNA sequence
gcacagagaaggggctccat

SEQ ID NO: 32668 - DNA, 20 bp, Artificial
  CRISPR gRNA sequence
catgaagagctgatgaacga

SEQ ID NO: 32669 - DNA, 20 bp, Artificial
  CRISPR gRNA sequence
atgaacgaataaggctggca

SEQ ID NO: 32670 - DNA, 20 bp, Artificial
  CRISPR gRNA sequence
gcaggtgaatgctctaattg

SEQ ID NO: 32671 - DNA, 20 bp, Artificial
  CRISPR gRNA sequence
taattggtggagattccctc

SEQ ID NO: 32672 - DNA, 20 bp, Artificial
  CRISPR gRNA sequence
attggtggagattccctcct

SEQ ID NO: 32673 - DNA, 20 bp, Artificial
  CRISPR gRNA sequence
gtggagattccctcctgatg

SEQ ID NO: 32674 - DNA, 20 bp, Artificial
  CRISPR gRNA sequence
cctcctgatgctcgcacgga

SEQ ID NO: 32675 - DNA, 20 bp, Artificial
  CRISPR gRNA sequence
ctgatgctcgcacggatgtg

SEQ ID NO: 32676 - DNA, 20 bp, Artificial
  CRISPR gRNA sequence
atgctcgcacggatgtgttt

SEQ ID NO: 32677 - DNA, 20 bp, Artificial
  CRISPR gRNA sequence
gcacggatgtgtttccttct

SEQ ID NO: 32678 - DNA, 20 bp, Artificial
  CRISPR gRNA sequence
ccttctgaggcatgttctct

SEQ ID NO: 32679 - DNA, 20 bp, Artificial
  CRISPR gRNA sequence
cttctgaggcatgttctctg

SEQ ID NO: 32680 - DNA, 20 bp, Artificial
  CRISPR gRNA sequence
ctgaggcatgttctctgcca

SEQ ID NO: 32681 - DNA, 20 bp, Artificial
  CRISPR gRNA sequence
tgaggcatgttctctgccag

SEQ ID NO: 32682 - DNA, 20 bp, Artificial
  CRISPR gRNA sequence
aggcatgttctctgccaggg

SEQ ID NO: 32683 - DNA, 20 bp, Artificial
  CRISPR gRNA sequence
tctgccagggattgagctga

SEQ ID NO: 32684 - DNA, 20 bp, Artificial
  CRISPR gRNA sequence
tgccagggattgagctgacg

SEQ ID NO: 32685 - DNA, 20 bp, Artificial
  CRISPR gRNA sequence
ccagggattgagctgacggg

SEQ ID NO: 32686 - DNA, 20 bp, Artificial
  CRISPR gRNA sequence
agctgacgggggccccaagg

SEQ ID NO: 32687 - DNA, 20 bp, Artificial
  CRISPR gRNA sequence
acgggggccccaaggataaa

SEQ ID NO: 32688 - DNA, 20 bp, Artificial
  CRISPR gRNA sequence
gctggggcagaggtgagtga

SEQ ID NO: 32689 - DNA, 20 bp, Artificial
  CRISPR gRNA sequence
gggcagaggtgagtgacact

SEQ ID NO: 32690 - DNA, 20 bp, Artificial
  CRISPR gRNA sequence
atagggttggggagaggtga

SEQ ID NO: 32691 - DNA, 20 bp, Artificial
  CRISPR gRNA sequence
gggagaggtgaggtccagtt

SEQ ID NO: 32692 - DNA, 20 bp, Artificial
  CRISPR gRNA sequence
ctgacagtccctgccttagt

SEQ ID NO: 32693 - DNA, 20 bp, Artificial
  CRISPR gRNA sequence
acagtccctgccttagtgtc

SEQ ID NO: 32694 - DNA, 20 bp, Artificial
  CRISPR gRNA sequence
ccttagtgtcaactccttat

SEQ ID NO: 32695 - DNA, 20 bp, Artificial
  CRISPR gRNA sequence
agtgtcaactccttatccac

SEQ ID NO: 32696 - DNA, 20 bp, Artificial
  CRISPR gRNA sequence
gtgtcaactccttatccacc

SEQ ID NO: 32697 - DNA, 20 bp, Artificial
  CRISPR gRNA sequence
cttatccacctcccaagagg

SEQ ID NO: 32698 - DNA, 20 bp, Artificial
  CRISPR gRNA sequence
atccacctcccaagagggag

SEQ ID NO: 32699 - DNA, 20 bp, Artificial
  CRISPR gRNA sequence
tccacctcccaagagggaga

SEQ ID NO: 32700 - DNA, 20 bp, Artificial
  CRISPR gRNA sequence
ccaagagggagaaagcccac

SEQ ID NO: 32701 - DNA, 20 bp, Artificial
  CRISPR gRNA sequence
tctccaagccccctaacata

SEQ ID NO: 32702 - DNA, 20 bp, Artificial
  CRISPR gRNA sequence
tccaagccccctaacatact

SEQ ID NO: 32703 - DNA, 20 bp, Artificial
  CRISPR gRNA sequence
caagccccctaacatactgg

SEQ ID NO: 32704 - DNA, 20 bp, Artificial
  CRISPR gRNA sequence
acatactgggaatctggtcg

SEQ ID NO: 32705 - DNA, 20 bp, Artificial
  CRISPR gRNA sequence
ggaatctggtcggttttctc

SEQ ID NO: 32706 - DNA, 20 bp, Artificial
  CRISPR gRNA sequence
gtcggttttctccaggcgca

SEQ ID NO: 32707 - DNA, 20 bp, Artificial
  CRISPR gRNA sequence
tctccaggcgcatctggccg

SEQ ID NO: 32708 - DNA, 20 bp, Artificial
  CRISPR gRNA sequence
ctccaggcgcatctggccgg

SEQ ID NO: 32709 - DNA, 20 bp, Artificial
  CRISPR gRNA sequence
tccaggcgcatctggccgga

SEQ ID NO: 32710 - DNA, 20 bp, Artificial
  CRISPR gRNA sequence
caggcgcatctggccggagg

SEQ ID NO: 32711 - DNA, 20 bp, Artificial
  CRISPR gRNA sequence
gccggaggctggctcctggt

SEQ ID NO: 32712 - DNA, 20 bp, Artificial
  CRISPR gRNA sequence
gctcctggttgaacagcgca

SEQ ID NO: 32713 - DNA, 20 bp, Artificial
  CRISPR gRNA sequence
ctggttgaacagcgcaggca

SEQ ID NO: 32714 - DNA, 20 bp, Artificial
  CRISPR gRNA sequence
gttgaacagcgcaggcagtg

SEQ ID NO: 32715 - DNA, 20 bp, Artificial
  CRISPR gRNA sequence
aacagcgcaggcagtggcag

SEQ ID NO: 32716 - DNA, 20 bp, Artificial
  CRISPR gRNA sequence
actggtctcactaggagact

SEQ ID NO: 32717 - DNA, 20 bp, Artificial
  CRISPR gRNA sequence
gtctcactaggagactgcca

SEQ ID NO: 32718 - DNA, 20 bp, Artificial
  CRISPR gRNA sequence
actaggagactgccagtcac

SEQ ID NO: 32719 - DNA, 20 bp, Artificial
  CRISPR gRNA sequence
ggagactgccagtcaccaca

SEQ ID NO: 32720 - DNA, 20 bp, Artificial
  CRISPR gRNA sequence
ccagtcaccacagtgggggg

SEQ ID NO: 32721 - DNA, 20 bp, Artificial
  CRISPR gRNA sequence
agctgtgaggaagtgggctg

SEQ ID NO: 32722 - DNA, 20 bp, Artificial
  CRISPR gRNA sequence
tgaggaagtgggctgtgtta

SEQ ID NO: 32723 - DNA, 20 bp, Artificial
  CRISPR gRNA sequence
tgttagagactgggtgcttg

SEQ ID NO: 32724 - DNA, 20 bp, Artificial
  CRISPR gRNA sequence
gagactgggtgcttggaggg

SEQ ID NO: 32725 - DNA, 20 bp, Artificial
  CRISPR gRNA sequence
ggtgcttggaggggccttcc

SEQ ID NO: 32726 - DNA, 20 bp, Artificial
  CRISPR gRNA sequence
ggaggggccttcctgggatg

SEQ ID NO: 32727 - DNA, 20 bp, Artificial
  CRISPR gRNA sequence
gaggggccttcctgggatgg

SEQ ID NO: 32728 - DNA, 20 bp, Artificial
  CRISPR gRNA sequence
cctgggatggggagggccct

SEQ ID NO: 32729 - DNA, 20 bp, Artificial
  CRISPR gRNA sequence
ctgggatggggagggccctg

SEQ ID NO: 32730 - DNA, 20 bp, Artificial
  CRISPR gRNA sequence
ggatggggagggccctggag

SEQ ID NO: 32731 - DNA, 20 bp, Artificial
  CRISPR gRNA sequence
gagtggcatggatgtctctc

SEQ ID NO: 32732 - DNA, 20 bp, Artificial
  CRISPR gRNA sequence
tcctgacagaggaaatgctt

SEQ ID NO: 32733 - DNA, 20 bp, Artificial
  CRISPR gRNA sequence
ctgacagaggaaatgcttgt

SEQ ID NO: 32734 - DNA, 20 bp, Artificial
  CRISPR gRNA sequence
acagaggaaatgcttgtcat

SEQ ID NO: 32735 - DNA, 20 bp, Artificial
  CRISPR gRNA sequence
gtcatcttctcagccctggc

SEQ ID NO: 32736 - DNA, 20 bp, Artificial
  CRISPR gRNA sequence
tcatcttctcagccctggct

SEQ ID NO: 32737 - DNA, 20 bp, Artificial
  CRISPR gRNA sequence
ctcagccctggctgcagctg

SEQ ID NO: 32738 - DNA, 20 bp, Artificial
  CRISPR gRNA sequence
tcagccctggctgcagctgt

SEQ ID NO: 32739 - DNA, 20 bp, Artificial
  CRISPR gRNA sequence
agccctggctgcagctgtgt

SEQ ID NO: 32740 - DNA, 20 bp, Artificial
  CRISPR gRNA sequence
gctgcagctgtgttgatcag

SEQ ID NO: 32741 - DNA, 20 bp, Artificial
  CRISPR gRNA sequence
cagctgtgttgatcagcaac

SEQ ID NO: 32742 - DNA, 20 bp, Artificial
  CRISPR gRNA sequence
tgttgatcagcaactgctct

SEQ ID NO: 32743 - DNA, 20 bp, Artificial
  CRISPR gRNA sequence
atcagcaactgctctgtgcc

SEQ ID NO: 32744 - DNA, 20 bp, Artificial
  CRISPR gRNA sequence
ctctgtgccaggcagtcccc

SEQ ID NO: 32745 - DNA, 20 bp, Artificial
  CRISPR gRNA sequence
tgtgccaggcagtcccccag

SEQ ID NO: 32746 - DNA, 20 bp, Artificial
  CRISPR gRNA sequence
tgccaggcagtcccccagtc

SEQ ID NO: 32747 - DNA, 20 bp, Artificial
  CRISPR gRNA sequence
tccttgtgacttggctctga

SEQ ID NO: 32748 - DNA, 20 bp, Artificial
  CRISPR gRNA sequence
cttgtgacttggctctgaga

SEQ ID NO: 32749 - DNA, 20 bp, Artificial
  CRISPR gRNA sequence
gtgacttggctctgagagct

SEQ ID NO: 32750 - DNA, 20 bp, Artificial
  CRISPR gRNA sequence
tgacttggctctgagagcta

SEQ ID NO: 32751 - DNA, 20 bp, Artificial
  CRISPR gRNA sequence
ggctctgagagctatgctga

SEQ ID NO: 32752 - DNA, 20 bp, Artificial
  CRISPR gRNA sequence
gctctgagagctatgctgag

SEQ ID NO: 32753 - DNA, 20 bp, Artificial
  CRISPR gRNA sequence
tgagagctatgctgagcagg

SEQ ID NO: 32754 - DNA, 20 bp, Artificial
  CRISPR gRNA sequence
agagctatgctgagcaggac

SEQ ID NO: 32755 - DNA, 20 bp, Artificial
  CRISPR gRNA sequence
tgctgagcaggaccctaggg

SEQ ID NO: 32756 - DNA, 20 bp, Artificial
  CRISPR gRNA sequence
agcaggaccctagggcctcc

SEQ ID NO: 32757 - DNA, 20 bp, Artificial
  CRISPR gRNA sequence
gggcctccacacggagagct

SEQ ID NO: 32758 - DNA, 20 bp, Artificial
  CRISPR gRNA sequence
cacacggagagctggggcag

SEQ ID NO: 32759 - DNA, 20 bp, Artificial
  CRISPR gRNA sequence
gggcagaatagaacctatga

SEQ ID NO: 32760 - DNA, 20 bp, Artificial
  CRISPR gRNA sequence
tgaacaatctgttagctcca

SEQ ID NO: 32761 - DNA, 20 bp, Artificial
  CRISPR gRNA sequence
ttagctccaagcccctacca

SEQ ID NO: 32762 - DNA, 20 bp, Artificial
  CRISPR gRNA sequence
gctccaagcccctaccacct

SEQ ID NO: 32763 - DNA, 20 bp, Artificial
  CRISPR gRNA sequence
caagcccctaccaccttcca

SEQ ID NO: 32764 - DNA, 20 bp, Artificial
  CRISPR gRNA sequence
ccaccttccacaaacagtcg

SEQ ID NO: 32765 - DNA, 20 bp, Artificial
  CRISPR gRNA sequence
ccacaaacagtcgtgagccc

SEQ ID NO: 32766 - DNA, 20 bp, Artificial
  CRISPR gRNA sequence
cacaaacagtcgtgagcccc

SEQ ID NO: 32767 - DNA, 20 bp, Artificial
  CRISPR gRNA sequence
agaggactctaagggacccc

SEQ ID NO: 32768 - DNA, 20 bp, Artificial
  CRISPR gRNA sequence
gaggactctaagggacccca

SEQ ID NO: 32769 - DNA, 20 bp, Artificial
  CRISPR gRNA sequence
taagggaccccaagctctca

SEQ ID NO: 32770 - DNA, 20 bp, Artificial
  CRISPR gRNA sequence
agggaccccaagctctcagc

SEQ ID NO: 32771 - DNA, 20 bp, Artificial
  CRISPR gRNA sequence
tcagcctctacccaaagaag

SEQ ID NO: 32772 - DNA, 20 bp, Artificial
  CRISPR gRNA sequence
agcctctacccaaagaaggg

SEQ ID NO: 32773 - DNA, 20 bp, Artificial
  CRISPR gRNA sequence
tacccaaagaagggcagggg

SEQ ID NO: 32774 - DNA, 20 bp, Artificial
  CRISPR gRNA sequence
cccaaagaagggcaggggct

SEQ ID NO: 32775 - DNA, 20 bp, Artificial
  CRISPR gRNA sequence
caccatgcaccatccccatc

SEQ ID NO: 32776 - DNA, 20 bp, Artificial
  CRISPR gRNA sequence
gggccaggagttcaatctct

SEQ ID NO: 32777 - DNA, 20 bp, Artificial
  CRISPR gRNA sequence
ggccaggagttcaatctctt

SEQ ID NO: 32778 - DNA, 20 bp, Artificial
  CRISPR gRNA sequence
aatctcttccatcccctccc

SEQ ID NO: 32779 - DNA, 20 bp, Artificial
  CRISPR gRNA sequence
ttccatcccctccccaaggc

SEQ ID NO: 32780 - DNA, 20 bp, Artificial
  CRISPR gRNA sequence
ccatcccctccccaaggcat

SEQ ID NO: 32781 - DNA, 20 bp, Artificial
  CRISPR gRNA sequence
catcccctccccaaggcatc

SEQ ID NO: 32782 - DNA, 20 bp, Artificial
  CRISPR gRNA sequence
cccaaggcatccacccttcc

SEQ ID NO: 32783 - DNA, 20 bp, Artificial
  CRISPR gRNA sequence
cccaaccccagcccacctgc

SEQ ID NO: 32784 - DNA, 20 bp, Artificial
  CRISPR gRNA sequence
ccaaccccagcccacctgcc

SEQ ID NO: 32785 - DNA, 20 bp, Artificial
  CRISPR gRNA sequence
ccctgcacacctggcttcca

SEQ ID NO: 32786 - DNA, 20 bp, Artificial
  CRISPR gRNA sequence
cacacctggcttccagtgct

SEQ ID NO: 32787 - DNA, 20 bp, Artificial
  CRISPR gRNA sequence
gcttccagtgcttcaggtct

SEQ ID NO: 32788 - DNA, 20 bp, Artificial
  CRISPR gRNA sequence
ccagtgcttcaggtctgccg

SEQ ID NO: 32789 - DNA, 20 bp, Artificial
  CRISPR gRNA sequence
cagtgcttcaggtctgccgg

SEQ ID NO: 32790 - DNA, 20 bp, Artificial
  CRISPR gRNA sequence
caggtctgccggaagctcct

SEQ ID NO: 32791 - DNA, 20 bp, Artificial
  CRISPR gRNA sequence
aggtctgccggaagctcctc

SEQ ID NO: 32792 - DNA, 20 bp, Artificial
  CRISPR gRNA sequence
ccggaagctcctctgggaag

SEQ ID NO: 32793 - DNA, 20 bp, Artificial
  CRISPR gRNA sequence
ctctgggaaggctgcagaga

SEQ ID NO: 32794 - DNA, 20 bp, Artificial
  CRISPR gRNA sequence
tgggaaggctgcagagaaaa

SEQ ID NO: 32795 - DNA, 20 bp, Artificial
  CRISPR gRNA sequence
ggaaggctgcagagaaaaca

SEQ ID NO: 32796 - DNA, 20 bp, Artificial
  CRISPR gRNA sequence
cagagaaaacatgtgatcag

SEQ ID NO: 32797 - DNA, 20 bp, Artificial
  CRISPR gRNA sequence
ccccagggagaggatgtccc

SEQ ID NO: 32798 - DNA, 20 bp, Artificial
  CRISPR gRNA sequence
aggactctagcaggctatac

SEQ ID NO: 32799 - DNA, 20 bp, Artificial
  CRISPR gRNA sequence
tagcaggctatacggcctta

SEQ ID NO: 32800 - DNA, 20 bp, Artificial
  CRISPR gRNA sequence
gcaggctatacggccttaac

SEQ ID NO: 32801 - DNA, 20 bp, Artificial
  CRISPR gRNA sequence
tacggccttaacttcaaggc

SEQ ID NO: 32802 - DNA, 20 bp, Artificial
  CRISPR gRNA sequence
aacttcaaggctgggtagtg

SEQ ID NO: 32803 - DNA, 20 bp, Artificial
  CRISPR gRNA sequence
acttcaaggctgggtagtgg

SEQ ID NO: 32804 - DNA, 20 bp, Artificial
  CRISPR gRNA sequence
caaggctgggtagtggtctt

SEQ ID NO: 32805 - DNA, 20 bp, Artificial
  CRISPR gRNA sequence
aaggctgggtagtggtcttg

SEQ ID NO: 32806 - DNA, 20 bp, Artificial
  CRISPR gRNA sequence
ggtagtggtcttgggggtcc

SEQ ID NO: 32807 - DNA, 20 bp, Artificial
  CRISPR gRNA sequence
gggggtccattttcctcccc

SEQ ID NO: 32808 - DNA, 20 bp, Artificial
  CRISPR gRNA sequence
ggggtccattttcctcccct

SEQ ID NO: 32809 - DNA, 20 bp, Artificial
  CRISPR gRNA sequence
tcctcccctcgctctaacat

SEQ ID NO: 32810 - DNA, 20 bp, Artificial
  CRISPR gRNA sequence
cctcccctcgctctaacatt

SEQ ID NO: 32811 - DNA, 20 bp, Artificial
  CRISPR gRNA sequence
ctcccctcgctctaacattc

SEQ ID NO: 32812 - DNA, 20 bp, Artificial
  CRISPR gRNA sequence
ccctcgctctaacattccaa

SEQ ID NO: 32813 - DNA, 20 bp, Artificial
  CRISPR gRNA sequence
gctctaacattccaacccca

SEQ ID NO: 32814 - DNA, 20 bp, Artificial
  CRISPR gRNA sequence
taacattccaaccccagctc

SEQ ID NO: 32815 - DNA, 20 bp, Artificial
  CRISPR gRNA sequence
acattccaaccccagctcct

SEQ ID NO: 32816 - DNA, 20 bp, Artificial
  CRISPR gRNA sequence
caaccccagctccttggctt

SEQ ID NO: 32817 - DNA, 20 bp, Artificial
  CRISPR gRNA sequence
cttggcttgaacccaaaccc

SEQ ID NO: 32818 - DNA, 20 bp, Artificial
  CRISPR gRNA sequence
ggcttgaacccaaaccccat

SEQ ID NO: 32819 - DNA, 20 bp, Artificial
  CRISPR gRNA sequence
gcttgaacccaaaccccatc

SEQ ID NO: 32820 - DNA, 20 bp, Artificial
  CRISPR gRNA sequence
gaacccaaaccccatctcaa

SEQ ID NO: 32821 - DNA, 20 bp, Artificial
  CRISPR gRNA sequence
aacccaaaccccatctcaaa

SEQ ID NO: 32822 - DNA, 20 bp, Artificial
  CRISPR gRNA sequence
aaaccataccaggcagtgta

SEQ ID NO: 32823 - DNA, 20 bp, Artificial
  CRISPR gRNA sequence
gagccaaaaaacaaaacaaa

SEQ ID NO: 32824 - DNA, 20 bp, Artificial
  CRISPR gRNA sequence
agccaaaaaacaaaacaaaa

SEQ ID NO: 32825 - DNA, 20 bp, Artificial
  CRISPR gRNA sequence
cttttgaaccgcttcctagc

SEQ ID NO: 32826 - DNA, 20 bp, Artificial
  CRISPR gRNA sequence
ttgaaccgcttcctagctgt

SEQ ID NO: 32827 - DNA, 20 bp, Artificial
  CRISPR gRNA sequence
tgaaccgcttcctagctgtg

SEQ ID NO: 32828 - DNA, 20 bp, Artificial
  CRISPR gRNA sequence
gaaccgcttcctagctgtgt

SEQ ID NO: 32829 - DNA, 20 bp, Artificial
  CRISPR gRNA sequence
aaccgcttcctagctgtgtg

SEQ ID NO: 32830 - DNA, 20 bp, Artificial
  CRISPR gRNA sequence
cctagctgtgtgcctttgca

SEQ ID NO: 32831 - DNA, 20 bp, Artificial
  CRISPR gRNA sequence
ctagctgtgtgcctttgcaa

SEQ ID NO: 32832 - DNA, 20 bp, Artificial
  CRISPR gRNA sequence
gctgtgtgcctttgcaatgc

SEQ ID NO: 32833 - DNA, 20 bp, Artificial
  CRISPR gRNA sequence
tgtgcctttgcaatgcagct

SEQ ID NO: 32834 - DNA, 20 bp, Artificial
  CRISPR gRNA sequence
tgcaatgcagcttctctgaa

SEQ ID NO: 32835 - DNA, 20 bp, Artificial
  CRISPR gRNA sequence
gcaatgcagcttctctgaac

SEQ ID NO: 32836 - DNA, 20 bp, Artificial
  CRISPR gRNA sequence
caatgcagcttctctgaacc

SEQ ID NO: 32837 - DNA, 20 bp, Artificial
  CRISPR gRNA sequence
ctctgaacctttgatctcac

SEQ ID NO: 32838 - DNA, 20 bp, Artificial
  CRISPR gRNA sequence
tctgaacctttgatctcaca

SEQ ID NO: 32839 - DNA, 20 bp, Artificial
  CRISPR gRNA sequence
tgaacctttgatctcacatc

SEQ ID NO: 32840 - DNA, 20 bp, Artificial
  CRISPR gRNA sequence
aacctttgatctcacatcta

SEQ ID NO: 32841 - DNA, 20 bp, Artificial
  CRISPR gRNA sequence
tgatctcacatctatgaaat

SEQ ID NO: 32842 - DNA, 20 bp, Artificial
  CRISPR gRNA sequence
gatctcacatctatgaaatg

SEQ ID NO: 32843 - DNA, 20 bp, Artificial
  CRISPR gRNA sequence
atctcacatctatgaaatgg

SEQ ID NO: 32844 - DNA, 20 bp, Artificial
  CRISPR gRNA sequence
acatctatgaaatgggggtg

SEQ ID NO: 32845 - DNA, 20 bp, Artificial
  CRISPR gRNA sequence
tgaaatgggggtggtggttc

SEQ ID NO: 32846 - DNA, 20 bp, Artificial
  CRISPR gRNA sequence
ctacattgcaggagtatgcc

SEQ ID NO: 32847 - DNA, 20 bp, Artificial
  CRISPR gRNA sequence
cattgcaggagtatgccaga

SEQ ID NO: 32848 - DNA, 20 bp, Artificial
  CRISPR gRNA sequence
caggagtatgccagaaatca

SEQ ID NO: 32849 - DNA, 20 bp, Artificial
  CRISPR gRNA sequence
acagcaacagattaaaaacc

SEQ ID NO: 32850 - DNA, 20 bp, Artificial
  CRISPR gRNA sequence
aaaacccacgtgtcccttag

SEQ ID NO: 32851 - DNA, 20 bp, Artificial
  CRISPR gRNA sequence
agcaagggactgcttaaaca

SEQ ID NO: 32852 - DNA, 20 bp, Artificial
  CRISPR gRNA sequence
gcaagggactgcttaaacaa

SEQ ID NO: 32853 - DNA, 20 bp, Artificial
  CRISPR gRNA sequence
cttaaacaaattatggttca

SEQ ID NO: 32854 - DNA, 20 bp, Artificial
  CRISPR gRNA sequence
aaacaaattatggttcatct

SEQ ID NO: 32855 - DNA, 20 bp, Artificial
  CRISPR gRNA sequence
aacaaattatggttcatcta

SEQ ID NO: 32856 - DNA, 20 bp, Artificial
  CRISPR gRNA sequence
tggttcatctacccaacgaa

SEQ ID NO: 32857 - DNA, 20 bp, Artificial
  CRISPR gRNA sequence
atctacccaacgaaacactg

SEQ ID NO: 32858 - DNA, 20 bp, Artificial
  CRISPR gRNA sequence
cccaacgaaacactgcatgg

SEQ ID NO: 32859 - DNA, 20 bp, Artificial
  CRISPR gRNA sequence
catggccttaaaagaaagga

SEQ ID NO: 32860 - DNA, 20 bp, Artificial
  CRISPR gRNA sequence
aaaagaaaggatgctgaagt

SEQ ID NO: 32861 - DNA, 20 bp, Artificial
  CRISPR gRNA sequence
aaagaaaggatgctgaagta

SEQ ID NO: 32862 - DNA, 20 bp, Artificial
  CRISPR gRNA sequence
aagtacacgaggggagtgta

SEQ ID NO: 32863 - DNA, 20 bp, Artificial
  CRISPR gRNA sequence
caatttacatttgaaatgta

SEQ ID NO: 32864 - DNA, 20 bp, Artificial
  CRISPR gRNA sequence
acatttgaaatgtacattga

SEQ ID NO: 32865 - DNA, 20 bp, Artificial
  CRISPR gRNA sequence
catttgaaatgtacattgaa

SEQ ID NO: 32866 - DNA, 20 bp, Artificial
  CRISPR gRNA sequence
gaaatgtacattgaaatgta

SEQ ID NO: 32867 - DNA, 20 bp, Artificial
  CRISPR gRNA sequence
aaatgtacattgaaatgtac

SEQ ID NO: 32868 - DNA, 20 bp, Artificial
  CRISPR gRNA sequence
aaatgtaccaaaaatataat

SEQ ID NO: 32869 - DNA, 20 bp, Artificial
  CRISPR gRNA sequence
attgtagaatcaaaatggta

SEQ ID NO: 32870 - DNA, 20 bp, Artificial
  CRISPR gRNA sequence
tagaatcaaaatggtacatg

SEQ ID NO: 32871 - DNA, 20 bp, Artificial
  CRISPR gRNA sequence
catagtaccattctttcact

SEQ ID NO: 32872 - DNA, 20 bp, Artificial
  CRISPR gRNA sequence
atagtaccattctttcactt

SEQ ID NO: 32873 - DNA, 20 bp, Artificial
  CRISPR gRNA sequence
tttcacttttattgtatctt

SEQ ID NO: 32874 - DNA, 20 bp, Artificial
  CRISPR gRNA sequence
tcacttttattgtatcttga

SEQ ID NO: 32875 - DNA, 20 bp, Artificial
  CRISPR gRNA sequence
cacttttattgtatcttgaa

SEQ ID NO: 32876 - DNA, 20 bp, Artificial
  CRISPR gRNA sequence
acttttattgtatcttgaaa

SEQ ID NO: 32877 - DNA, 20 bp, Artificial
  CRISPR gRNA sequence
ttattgtatcttgaaaacat

SEQ ID NO: 32878 - DNA, 20 bp, Artificial
  CRISPR gRNA sequence
tattgtatcttgaaaacatt

SEQ ID NO: 32879 - DNA, 20 bp, Artificial
  CRISPR gRNA sequence
attgtatcttgaaaacattt

SEQ ID NO: 32880 - DNA, 20 bp, Artificial
  CRISPR gRNA sequence
ttgtatcttgaaaacatttt

SEQ ID NO: 32881 - DNA, 20 bp, Artificial
  CRISPR gRNA sequence
tatcttgaaaacattttttt

SEQ ID NO: 32882 - DNA, 20 bp, Artificial
  CRISPR gRNA sequence
gaaaacattttttttttttt

SEQ ID NO: 32883 - DNA, 20 bp, Artificial
  CRISPR gRNA sequence
aaaacatttttttttttttt

SEQ ID NO: 32884 - DNA, 20 bp, Artificial
  CRISPR gRNA sequence
ttttttttttttgaaacaga

SEQ ID NO: 32885 - DNA, 20 bp, Artificial
  CRISPR gRNA sequence
tttttttttttgaaacagag

SEQ ID NO: 32886 - DNA, 20 bp, Artificial
  CRISPR gRNA sequence
ttttttttttgaaacagagt

SEQ ID NO: 32887 - DNA, 20 bp, Artificial
  CRISPR gRNA sequence
tttttttttgaaacagagtc

SEQ ID NO: 32888 - DNA, 20 bp, Artificial
  CRISPR gRNA sequence
ttttttttgaaacagagtct

SEQ ID NO: 32889 - DNA, 20 bp, Artificial
  CRISPR gRNA sequence
tttttttgaaacagagtcta

SEQ ID NO: 32890 - DNA, 20 bp, Artificial
  CRISPR gRNA sequence
ttttttgaaacagagtctag

SEQ ID NO: 32891 - DNA, 20 bp, Artificial
  CRISPR gRNA sequence
tttttgaaacagagtctagc

SEQ ID NO: 32892 - DNA, 20 bp, Artificial
  CRISPR gRNA sequence
ttttgaaacagagtctagct

SEQ ID NO: 32893 - DNA, 20 bp, Artificial
  CRISPR gRNA sequence
tttgaaacagagtctagctc

SEQ ID NO: 32894 - DNA, 20 bp, Artificial
  CRISPR gRNA sequence
ttgaaacagagtctagctct

SEQ ID NO: 32895 - DNA, 20 bp, Artificial
  CRISPR gRNA sequence
tgaaacagagtctagctctg

SEQ ID NO: 32896 - DNA, 20 bp, Artificial
  CRISPR gRNA sequence
gaaacagagtctagctctgt

SEQ ID NO: 32897 - DNA, 20 bp, Artificial
  CRISPR gRNA sequence
aaacagagtctagctctgtt

SEQ ID NO: 32898 - DNA, 20 bp, Artificial
  CRISPR gRNA sequence
gctctgttgcccaggctgga

SEQ ID NO: 32899 - DNA, 20 bp, Artificial
  CRISPR gRNA sequence
tgttgcccaggctggagtgc

SEQ ID NO: 32900 - DNA, 20 bp, Artificial
  CRISPR gRNA sequence
ttgcccaggctggagtgcac

SEQ ID NO: 32901 - DNA, 20 bp, Artificial
  CRISPR gRNA sequence
cccaggctggagtgcactgg

SEQ ID NO: 32902 - DNA, 20 bp, Artificial
  CRISPR gRNA sequence
gagtgcactggcgcaatctt

SEQ ID NO: 32903 - DNA, 20 bp, Artificial
  CRISPR gRNA sequence
gcgcaatcttggctcactgc

SEQ ID NO: 32904 - DNA, 20 bp, Artificial
  CRISPR gRNA sequence
ggctcactgcaacctctgct

SEQ ID NO: 32905 - DNA, 20 bp, Artificial
  CRISPR gRNA sequence
gctcactgcaacctctgctt

SEQ ID NO: 32906 - DNA, 20 bp, Artificial
  CRISPR gRNA sequence
actgcaacctctgcttctta

SEQ ID NO: 32907 - DNA, 20 bp, Artificial
  CRISPR gRNA sequence
caacctctgcttcttaggtt

SEQ ID NO: 32908 - DNA, 20 bp, Artificial
  CRISPR gRNA sequence
tgcttcttaggttcaagcga

SEQ ID NO: 32909 - DNA, 20 bp, Artificial
  CRISPR gRNA sequence
cttcttaggttcaagcgatt

SEQ ID NO: 32910 - DNA, 20 bp, Artificial
  CRISPR gRNA sequence
cttaggttcaagcgattctc

SEQ ID NO: 32911 - DNA, 20 bp, Artificial
  CRISPR gRNA sequence
ttaggttcaagcgattctcc

SEQ ID NO: 32912 - DNA, 20 bp, Artificial
  CRISPR gRNA sequence
aggttcaagcgattctccca

SEQ ID NO: 32913 - DNA, 20 bp, Artificial
  CRISPR gRNA sequence
ggttcaagcgattctcccac

SEQ ID NO: 32914 - DNA, 20 bp, Artificial
  CRISPR gRNA sequence
aagcgattctcccaccctag

SEQ ID NO: 32915 - DNA, 20 bp, Artificial
  CRISPR gRNA sequence
tcccaccctagcctccctgg

SEQ ID NO: 32916 - DNA, 20 bp, Artificial
  CRISPR gRNA sequence
ccaccctagcctccctggta

SEQ ID NO: 32917 - DNA, 20 bp, Artificial
  CRISPR gRNA sequence
gcctccctggtagctgggat

SEQ ID NO: 32918 - DNA, 20 bp, Artificial
  CRISPR gRNA sequence
cctggtagctgggattacag

SEQ ID NO: 32919 - DNA, 20 bp, Artificial
  CRISPR gRNA sequence
gtagctgggattacaggtgt

SEQ ID NO: 32920 - DNA, 20 bp, Artificial
  CRISPR gRNA sequence
ggattacaggtgttcgccac

SEQ ID NO: 32921 - DNA, 20 bp, Artificial
  CRISPR gRNA sequence
caggtgttcgccaccacgcc

SEQ ID NO: 32922 - DNA, 20 bp, Artificial
  CRISPR gRNA sequence
gccaccacgcctggctaatt

SEQ ID NO: 32923 - DNA, 20 bp, Artificial
  CRISPR gRNA sequence
gctaatttttgtatttttag

SEQ ID NO: 32924 - DNA, 20 bp, Artificial
  CRISPR gRNA sequence
atttttgtatttttagtaga

SEQ ID NO: 32925 - DNA, 20 bp, Artificial
  CRISPR gRNA sequence
ttgtatttttagtagagatg

SEQ ID NO: 32926 - DNA, 20 bp, Artificial
  CRISPR gRNA sequence
tgtatttttagtagagatgg

SEQ ID NO: 32927 - DNA, 20 bp, Artificial
  CRISPR gRNA sequence
gtatttttagtagagatggg

SEQ ID NO: 32928 - DNA, 20 bp, Artificial
  CRISPR gRNA sequence
tatttttagtagagatgggg

SEQ ID NO: 32929 - DNA, 20 bp, Artificial
  CRISPR gRNA sequence
ttagtagagatggggtttca

SEQ ID NO: 32930 - DNA, 20 bp, Artificial
  CRISPR gRNA sequence
tagtagagatggggtttcac

SEQ ID NO: 32931 - DNA, 20 bp, Artificial
  CRISPR gRNA sequence
agtagagatggggtttcacc

SEQ ID NO: 32932 - DNA, 20 bp, Artificial
  CRISPR gRNA sequence
gtagagatggggtttcacca

SEQ ID NO: 32933 - DNA, 20 bp, Artificial
  CRISPR gRNA sequence
caccatgttggccaggctgg

SEQ ID NO: 32934 - DNA, 20 bp, Artificial
  CRISPR gRNA sequence
accatgttggccaggctggt

SEQ ID NO: 32935 - DNA, 20 bp, Artificial
  CRISPR gRNA sequence
gccaggctggtctcaaactc

SEQ ID NO: 32936 - DNA, 20 bp, Artificial
  CRISPR gRNA sequence
gtctcaaactcttgacctca

SEQ ID NO: 32937 - DNA, 20 bp, Artificial
  CRISPR gRNA sequence
aaactcttgacctcaggtga

SEQ ID NO: 32938 - DNA, 20 bp, Artificial
  CRISPR gRNA sequence
ttgacctcaggtgatctgcc

SEQ ID NO: 32939 - DNA, 20 bp, Artificial
  CRISPR gRNA sequence
gacctcaggtgatctgccag

SEQ ID NO: 32940 - DNA, 20 bp, Artificial
  CRISPR gRNA sequence
acctcaggtgatctgccagc

SEQ ID NO: 32941 - DNA, 20 bp, Artificial
  CRISPR gRNA sequence
aggtgatctgccagccttgg

SEQ ID NO: 32942 - DNA, 20 bp, Artificial
  CRISPR gRNA sequence
ccagccttggcctcccaaag

SEQ ID NO: 32943 - DNA, 20 bp, Artificial
  CRISPR gRNA sequence
ggcctcccaaagtgctggga

SEQ ID NO: 32944 - DNA, 20 bp, Artificial
  CRISPR gRNA sequence
gcctcccaaagtgctgggat

SEQ ID NO: 32945 - DNA, 20 bp, Artificial
  CRISPR gRNA sequence
ccaaagtgctgggattacag

SEQ ID NO: 32946 - DNA, 20 bp, Artificial
  CRISPR gRNA sequence
ggattacagatgtgagccac

SEQ ID NO: 32947 - DNA, 20 bp, Artificial
  CRISPR gRNA sequence
cagatgtgagccaccacgcc

SEQ ID NO: 32948 - DNA, 20 bp, Artificial
  CRISPR gRNA sequence
gccgaaaactttcacaataa

SEQ ID NO: 32949 - DNA, 20 bp, Artificial
  CRISPR gRNA sequence
tcacaataaaatcttggggg

SEQ ID NO: 32950 - DNA, 20 bp, Artificial
  CRISPR gRNA sequence
cacaataaaatcttgggggg

SEQ ID NO: 32951 - DNA, 20 bp, Artificial
  CRISPR gRNA sequence
acaataaaatcttgggggga

SEQ ID NO: 32952 - DNA, 20 bp, Artificial
  CRISPR gRNA sequence
ggggggaaatatttatcaaa

SEQ ID NO: 32953 - DNA, 20 bp, Artificial
  CRISPR gRNA sequence
gggggaaatatttatcaaat

SEQ ID NO: 32954 - DNA, 20 bp, Artificial
  CRISPR gRNA sequence
atcaaatgaaaacataaaga

SEQ ID NO: 32955 - DNA, 20 bp, Artificial
  CRISPR gRNA sequence
tcaaatgaaaacataaagaa

SEQ ID NO: 32956 - DNA, 20 bp, Artificial
  CRISPR gRNA sequence
ctgaagataggaccgtgtcc

SEQ ID NO: 32957 - DNA, 20 bp, Artificial
  CRISPR gRNA sequence
aagataggaccgtgtcctct

SEQ ID NO: 32958 - DNA, 20 bp, Artificial
  CRISPR gRNA sequence
tccctcaataatatggaacg

SEQ ID NO: 32959 - DNA, 20 bp, Artificial
  CRISPR gRNA sequence
cctcaataatatggaacgtg

SEQ ID NO: 32960 - DNA, 20 bp, Artificial
  CRISPR gRNA sequence
aataatatggaacgtgacct

SEQ ID NO: 32961 - DNA, 20 bp, Artificial
  CRISPR gRNA sequence
ccagacagggagtaatgaag

SEQ ID NO: 32962 - DNA, 20 bp, Artificial
  CRISPR gRNA sequence
gcatggaaaattaaagcaaa

SEQ ID NO: 32963 - DNA, 20 bp, Artificial
  CRISPR gRNA sequence
catggaaaattaaagcaaat

SEQ ID NO: 32964 - DNA, 20 bp, Artificial
  CRISPR gRNA sequence
aagcaaatacaggagctcgc

SEQ ID NO: 32965 - DNA, 20 bp, Artificial
  CRISPR gRNA sequence
gctttatttctgacaaggca

SEQ ID NO: 32966 - DNA, 20 bp, Artificial
  CRISPR gRNA sequence
tatttctgacaaggcaaaaa

SEQ ID NO: 32967 - DNA, 20 bp, Artificial
  CRISPR gRNA sequence
atttctgacaaggcaaaaag

SEQ ID NO: 32968 - DNA, 20 bp, Artificial
  CRISPR gRNA sequence
tttctgacaaggcaaaaagg

SEQ ID NO: 32969 - DNA, 20 bp, Artificial
  CRISPR gRNA sequence
ctgacaaggcaaaaaggaag

SEQ ID NO: 32970 - DNA, 20 bp, Artificial
  CRISPR gRNA sequence
tgacaaggcaaaaaggaagc

SEQ ID NO: 32971 - DNA, 20 bp, Artificial
  CRISPR gRNA sequence
acaaggcaaaaaggaagctg

SEQ ID NO: 32972 - DNA, 20 bp, Artificial
  CRISPR gRNA sequence
gtcacataggttgactaaga

SEQ ID NO: 32973 - DNA, 20 bp, Artificial
  CRISPR gRNA sequence
actaagataggagcaaaact

SEQ ID NO: 32974 - DNA, 20 bp, Artificial
  CRISPR gRNA sequence
agataggagcaaaactgagg

SEQ ID NO: 32975 - DNA, 20 bp, Artificial
  CRISPR gRNA sequence
agggactacagaacaggagt

SEQ ID NO: 32976 - DNA, 20 bp, Artificial
  CRISPR gRNA sequence
cagaacaggagtgggaggga

SEQ ID NO: 32977 - DNA, 20 bp, Artificial
  CRISPR gRNA sequence
ttttttcactgaatattctt

SEQ ID NO: 32978 - DNA, 20 bp, Artificial
  CRISPR gRNA sequence
tttttcactgaatattcttt

SEQ ID NO: 32979 - DNA, 20 bp, Artificial
  CRISPR gRNA sequence
ttttcactgaatattctttt

SEQ ID NO: 32980 - DNA, 20 bp, Artificial
  CRISPR gRNA sequence
tttcactgaatattcttttg

SEQ ID NO: 32981 - DNA, 20 bp, Artificial
  CRISPR gRNA sequence
ttcactgaatattcttttgg

SEQ ID NO: 32982 - DNA, 20 bp, Artificial
  CRISPR gRNA sequence
tcactgaatattcttttggt

SEQ ID NO: 32983 - DNA, 20 bp, Artificial
  CRISPR gRNA sequence
cactgaatattcttttggtt

SEQ ID NO: 32984 - DNA, 20 bp, Artificial
  CRISPR gRNA sequence
actgaatattcttttggttg

SEQ ID NO: 32985 - DNA, 20 bp, Artificial
  CRISPR gRNA sequence
aatattcttttggttgttgt

SEQ ID NO: 32986 - DNA, 20 bp, Artificial
  CRISPR gRNA sequence
ttttggttgttgttgtttga

SEQ ID NO: 32987 - DNA, 20 bp, Artificial
  CRISPR gRNA sequence
ttggttgttgttgtttgaga

SEQ ID NO: 32988 - DNA, 20 bp, Artificial
  CRISPR gRNA sequence
tggttgttgttgtttgagac

SEQ ID NO: 32989 - DNA, 20 bp, Artificial
  CRISPR gRNA sequence
ggttgttgttgtttgagaca

SEQ ID NO: 32990 - DNA, 20 bp, Artificial
  CRISPR gRNA sequence
gttgttgttgtttgagacag

SEQ ID NO: 32991 - DNA, 20 bp, Artificial
  CRISPR gRNA sequence
ttgttgtttgagacagagtc

SEQ ID NO: 32992 - DNA, 20 bp, Artificial
  CRISPR gRNA sequence
ttgtttgagacagagtctta

SEQ ID NO: 32993 - DNA, 20 bp, Artificial
  CRISPR gRNA sequence
tttgagacagagtcttactc

SEQ ID NO: 32994 - DNA, 20 bp, Artificial
  CRISPR gRNA sequence
gagacagagtcttactctgc

SEQ ID NO: 32995 - DNA, 20 bp, Artificial
  CRISPR gRNA sequence
agacagagtcttactctgcc

SEQ ID NO: 32996 - DNA, 20 bp, Artificial
  CRISPR gRNA sequence
actctgccacccaggctgga

SEQ ID NO: 32997 - DNA, 20 bp, Artificial
  CRISPR gRNA sequence
ctctgccacccaggctggag

SEQ ID NO: 32998 - DNA, 20 bp, Artificial
  CRISPR gRNA sequence
tgccacccaggctggagtgc

SEQ ID NO: 32999 - DNA, 20 bp, Artificial
  CRISPR gRNA sequence
ccacccaggctggagtgcag

SEQ ID NO: 33000 - DNA, 20 bp, Artificial
  CRISPR gRNA sequence
gagtgcagtggcgtgatctt

SEQ ID NO: 33001 - DNA, 20 bp, Artificial
  CRISPR gRNA sequence
agctcactgcaacctccacc

SEQ ID NO: 33002 - DNA, 20 bp, Artificial
  CRISPR gRNA sequence
gctcactgcaacctccacct

SEQ ID NO: 33003 - DNA, 20 bp, Artificial
  CRISPR gRNA sequence
actgcaacctccacctcctg

SEQ ID NO: 33004 - DNA, 20 bp, Artificial
  CRISPR gRNA sequence
caacctccacctcctgggtt

SEQ ID NO: 33005 - DNA, 20 bp, Artificial
  CRISPR gRNA sequence
cacctcctgggttcaagcga

SEQ ID NO: 33006 - DNA, 20 bp, Artificial
  CRISPR gRNA sequence
ctgggttcaagcgattctcc

SEQ ID NO: 33007 - DNA, 20 bp, Artificial
  CRISPR gRNA sequence
ggttcaagcgattctcctgc

SEQ ID NO: 33008 - DNA, 20 bp, Artificial
  CRISPR gRNA sequence
aagcgattctcctgcctcag

SEQ ID NO: 33009 - DNA, 20 bp, Artificial
  CRISPR gRNA sequence
tcctgcctcagcctcccgag

SEQ ID NO: 33010 - DNA, 20 bp, Artificial
  CRISPR gRNA sequence
ctgcctcagcctcccgagta

SEQ ID NO: 33011 - DNA, 20 bp, Artificial
  CRISPR gRNA sequence
cctcagcctcccgagtagct

SEQ ID NO: 33012 - DNA, 20 bp, Artificial
  CRISPR gRNA sequence
agcctcccgagtagctggga

SEQ ID NO: 33013 - DNA, 20 bp, Artificial
  CRISPR gRNA sequence
ccgagtagctgggattacag

SEQ ID NO: 33014 - DNA, 20 bp, Artificial
  CRISPR gRNA sequence
ggattacaggcgtgcaccac

SEQ ID NO: 33015 - DNA, 20 bp, Artificial
  CRISPR gRNA sequence
caggcgtgcaccaccacacc

SEQ ID NO: 33016 - DNA, 20 bp, Artificial
  CRISPR gRNA sequence
atttttgtattttttggtag

SEQ ID NO: 33017 - DNA, 20 bp, Artificial
  CRISPR gRNA sequence
ttgtattttttggtagagac

SEQ ID NO: 33018 - DNA, 20 bp, Artificial
  CRISPR gRNA sequence
tgtattttttggtagagacg

SEQ ID NO: 33019 - DNA, 20 bp, Artificial
  CRISPR gRNA sequence
gtattttttggtagagacgc

SEQ ID NO: 33020 - DNA, 20 bp, Artificial
  CRISPR gRNA sequence
tattttttggtagagacgcg

SEQ ID NO: 33021 - DNA, 20 bp, Artificial
  CRISPR gRNA sequence
tttggtagagacgcggtttc

SEQ ID NO: 33022 - DNA, 20 bp, Artificial
  CRISPR gRNA sequence
ttggtagagacgcggtttca

SEQ ID NO: 33023 - DNA, 20 bp, Artificial
  CRISPR gRNA sequence
tggtagagacgcggtttcac

SEQ ID NO: 33024 - DNA, 20 bp, Artificial
  CRISPR gRNA sequence
ggtagagacgcggtttcacc

SEQ ID NO: 33025 - DNA, 20 bp, Artificial
  CRISPR gRNA sequence
gtagagacgcggtttcacca

SEQ ID NO: 33026 - DNA, 20 bp, Artificial
  CRISPR gRNA sequence
caccatgttggccaggcagg

SEQ ID NO: 33027 - DNA, 20 bp, Artificial
  CRISPR gRNA sequence
accatgttggccaggcaggt

SEQ ID NO: 33028 - DNA, 20 bp, Artificial
  CRISPR gRNA sequence
gccaggcaggtatcaaactc

SEQ ID NO: 33029 - DNA, 20 bp, Artificial
  CRISPR gRNA sequence
ctgacctcaagtgatccgtc

SEQ ID NO: 33030 - DNA, 20 bp, Artificial
  CRISPR gRNA sequence
acctcaagtgatccgtcccc

SEQ ID NO: 33031 - DNA, 20 bp, Artificial
  CRISPR gRNA sequence
aagtgatccgtcccccttgg

SEQ ID NO: 33032 - DNA, 20 bp, Artificial
  CRISPR gRNA sequence
ggcctcccaaactgctggga

SEQ ID NO: 33033 - DNA, 20 bp, Artificial
  CRISPR gRNA sequence
gcctcccaaactgctgggat

SEQ ID NO: 33034 - DNA, 20 bp, Artificial
  CRISPR gRNA sequence
ccaaactgctgggattacag

SEQ ID NO: 33035 - DNA, 20 bp, Artificial
  CRISPR gRNA sequence
ctgggattacaggtgtgagc

SEQ ID NO: 33036 - DNA, 20 bp, Artificial
  CRISPR gRNA sequence
ggattacaggtgtgagccgc

SEQ ID NO: 33037 - DNA, 20 bp, Artificial
  CRISPR gRNA sequence
caggtgtgagccgctgcgcc

SEQ ID NO: 33038 - DNA, 20 bp, Artificial
  CRISPR gRNA sequence
cgcccagccttcactgaata

SEQ ID NO: 33039 - DNA, 20 bp, Artificial
  CRISPR gRNA sequence
cactgaatattctttgcact

SEQ ID NO: 33040 - DNA, 20 bp, Artificial
  CRISPR gRNA sequence
actgaatattctttgcactt

SEQ ID NO: 33041 - DNA, 20 bp, Artificial
  CRISPR gRNA sequence
aatattctttgcacttttaa

SEQ ID NO: 33042 - DNA, 20 bp, Artificial
  CRISPR gRNA sequence
tttgcacttttaaaatctca

SEQ ID NO: 33043 - DNA, 20 bp, Artificial
  CRISPR gRNA sequence
tgcacttttaaaatctcata

SEQ ID NO: 33044 - DNA, 20 bp, Artificial
  CRISPR gRNA sequence
gcacttttaaaatctcatac

SEQ ID NO: 33045 - DNA, 20 bp, Artificial
  CRISPR gRNA sequence
cacttttaaaatctcatacc

SEQ ID NO: 33046 - DNA, 20 bp, Artificial
  CRISPR gRNA sequence
ttaaaatctcataccctgtg

SEQ ID NO: 33047 - DNA, 20 bp, Artificial
  CRISPR gRNA sequence
taaaatctcataccctgtgt

SEQ ID NO: 33048 - DNA, 20 bp, Artificial
  CRISPR gRNA sequence
aaaatctcataccctgtgtg

SEQ ID NO: 33049 - DNA, 20 bp, Artificial
  CRISPR gRNA sequence
aaatctcataccctgtgtgc

SEQ ID NO: 33050 - DNA, 20 bp, Artificial
  CRISPR gRNA sequence
ataccctgtgtgcgattcac

SEQ ID NO: 33051 - DNA, 20 bp, Artificial
  CRISPR gRNA sequence
tgtgcgattcacctgtttaa

SEQ ID NO: 33052 - DNA, 20 bp, Artificial
  CRISPR gRNA sequence
acctgtttaagaactgaata

SEQ ID NO: 33053 - DNA, 20 bp, Artificial
  CRISPR gRNA sequence
tttaagaactgaataaatag

SEQ ID NO: 33054 - DNA, 20 bp, Artificial
  CRISPR gRNA sequence
aagaactgaataaatagata

SEQ ID NO: 33055 - DNA, 20 bp, Artificial
  CRISPR gRNA sequence
agaactgaataaatagatac

SEQ ID NO: 33056 - DNA, 20 bp, Artificial
  CRISPR gRNA sequence
aataaatagatacaggactt

SEQ ID NO: 33057 - DNA, 20 bp, Artificial
  CRISPR gRNA sequence
acacatggtcagacccataa

SEQ ID NO: 33058 - DNA, 20 bp, Artificial
  CRISPR gRNA sequence
cacatggtcagacccataat

SEQ ID NO: 33059 - DNA, 20 bp, Artificial
  CRISPR gRNA sequence
agttaactgttacacccatt

SEQ ID NO: 33060 - DNA, 20 bp, Artificial
  CRISPR gRNA sequence
actgttacacccattttaca

SEQ ID NO: 33061 - DNA, 20 bp, Artificial
  CRISPR gRNA sequence
ttacacccattttacagatg

SEQ ID NO: 33062 - DNA, 20 bp, Artificial
  CRISPR gRNA sequence
cacccattttacagatgttt

SEQ ID NO: 33063 - DNA, 20 bp, Artificial
  CRISPR gRNA sequence
tacagatgttttcattcaac

SEQ ID NO: 33064 - DNA, 20 bp, Artificial
  CRISPR gRNA sequence
acagatgttttcattcaaca

SEQ ID NO: 33065 - DNA, 20 bp, Artificial
  CRISPR gRNA sequence
cagatgttttcattcaacag

SEQ ID NO: 33066 - DNA, 20 bp, Artificial
  CRISPR gRNA sequence
tcattcaacagatatctact

SEQ ID NO: 33067 - DNA, 20 bp, Artificial
  CRISPR gRNA sequence
cattcaacagatatctactg

SEQ ID NO: 33068 - DNA, 20 bp, Artificial
  CRISPR gRNA sequence
attcaacagatatctactga

SEQ ID NO: 33069 - DNA, 20 bp, Artificial
  CRISPR gRNA sequence
aacagatatctactgaggtg

SEQ ID NO: 33070 - DNA, 20 bp, Artificial
  CRISPR gRNA sequence
ctgaggtgctactgcatacc

SEQ ID NO: 33071 - DNA, 20 bp, Artificial
  CRISPR gRNA sequence
aggtgctactgcataccagg

SEQ ID NO: 33072 - DNA, 20 bp, Artificial
  CRISPR gRNA sequence
ctgcataccaggcactgcac

SEQ ID NO: 33073 - DNA, 20 bp, Artificial
  CRISPR gRNA sequence
cataccaggcactgcactag

SEQ ID NO: 33074 - DNA, 20 bp, Artificial
  CRISPR gRNA sequence
cactagatgctggggaaaca

SEQ ID NO: 33075 - DNA, 20 bp, Artificial
  CRISPR gRNA sequence
gatgctggggaaacagtcac

SEQ ID NO: 33076 - DNA, 20 bp, Artificial
  CRISPR gRNA sequence
gggaaacagtcacgagcaag

SEQ ID NO: 33077 - DNA, 20 bp, Artificial
  CRISPR gRNA sequence
tcctcacagtgggagagcaa

SEQ ID NO: 33078 - DNA, 20 bp, Artificial
  CRISPR gRNA sequence
acagtgggagagcaaggcgt

SEQ ID NO: 33079 - DNA, 20 bp, Artificial
  CRISPR gRNA sequence
aactgcaaggaaaaagacac

SEQ ID NO: 33080 - DNA, 20 bp, Artificial
  CRISPR gRNA sequence
caaggaaaaagacacacaag

SEQ ID NO: 33081 - DNA, 20 bp, Artificial
  CRISPR gRNA sequence
agctaatctacatggaagga

SEQ ID NO: 33082 - DNA, 20 bp, Artificial
  CRISPR gRNA sequence
atctacatggaaggatggtc

SEQ ID NO: 33083 - DNA, 20 bp, Artificial
  CRISPR gRNA sequence
catggaaggatggtcagaga

SEQ ID NO: 33084 - DNA, 20 bp, Artificial
  CRISPR gRNA sequence
caggaagaggtgacagttta

SEQ ID NO: 33085 - DNA, 20 bp, Artificial
  CRISPR gRNA sequence
agccaacaccagaaagattc

SEQ ID NO: 33086 - DNA, 20 bp, Artificial
  CRISPR gRNA sequence
gccaacaccagaaagattca

SEQ ID NO: 33087 - DNA, 20 bp, Artificial
  CRISPR gRNA sequence
aaaggagtcagccatgggaa

SEQ ID NO: 33088 - DNA, 20 bp, Artificial
  CRISPR gRNA sequence
ggggaagggcattccagata

SEQ ID NO: 33089 - DNA, 20 bp, Artificial
  CRISPR gRNA sequence
cagatagagactatagcaac

SEQ ID NO: 33090 - DNA, 20 bp, Artificial
  CRISPR gRNA sequence
tagcaactgcaaaggccccg

SEQ ID NO: 33091 - DNA, 20 bp, Artificial
  CRISPR gRNA sequence
caaaggccccgaggcttgaa

SEQ ID NO: 33092 - DNA, 20 bp, Artificial
  CRISPR gRNA sequence
gaaagggcacatgggttata

SEQ ID NO: 33093 - DNA, 20 bp, Artificial
  CRISPR gRNA sequence
aaagggcacatgggttatag

SEQ ID NO: 33094 - DNA, 20 bp, Artificial
  CRISPR gRNA sequence
taggagtggagaagctggtg

SEQ ID NO: 33095 - DNA, 20 bp, Artificial
  CRISPR gRNA sequence
gtggtggctgaagtgtggtg

SEQ ID NO: 33096 - DNA, 20 bp, Artificial
  CRISPR gRNA sequence
aagtgtggtgtctcatagtg

SEQ ID NO: 33097 - DNA, 20 bp, Artificial
  CRISPR gRNA sequence
atagtgggtttggagaggga

SEQ ID NO: 33098 - DNA, 20 bp, Artificial
  CRISPR gRNA sequence
ggagagggaggaagggccat

SEQ ID NO: 33099 - DNA, 20 bp, Artificial
  CRISPR gRNA sequence
gagagggaggaagggccata

SEQ ID NO: 33100 - DNA, 20 bp, Artificial
  CRISPR gRNA sequence
gtggcatgtattttgtagcc

SEQ ID NO: 33101 - DNA, 20 bp, Artificial
  CRISPR gRNA sequence
tggcatgtattttgtagcca

SEQ ID NO: 33102 - DNA, 20 bp, Artificial
  CRISPR gRNA sequence
tgtagccattggagggttat

SEQ ID NO: 33103 - DNA, 20 bp, Artificial
  CRISPR gRNA sequence
gtagccattggagggttatc

SEQ ID NO: 33104 - DNA, 20 bp, Artificial
  CRISPR gRNA sequence
tagccattggagggttatca

SEQ ID NO: 33105 - DNA, 20 bp, Artificial
  CRISPR gRNA sequence
gagggttatcagggccatga

SEQ ID NO: 33106 - DNA, 20 bp, Artificial
  CRISPR gRNA sequence
tcagggccatgaaataatca

SEQ ID NO: 33107 - DNA, 20 bp, Artificial
  CRISPR gRNA sequence
taaggctcctgttggctttt

SEQ ID NO: 33108 - DNA, 20 bp, Artificial
  CRISPR gRNA sequence
aaggctcctgttggctttta

SEQ ID NO: 33109 - DNA, 20 bp, Artificial
  CRISPR gRNA sequence
aggctcctgttggcttttaa

SEQ ID NO: 33110 - DNA, 20 bp, Artificial
  CRISPR gRNA sequence
ctgttggcttttaaagggcc

SEQ ID NO: 33111 - DNA, 20 bp, Artificial
  CRISPR gRNA sequence
ttggcttttaaagggcctcc

SEQ ID NO: 33112 - DNA, 20 bp, Artificial
  CRISPR gRNA sequence
gcttttaaagggcctcccaa

SEQ ID NO: 33113 - DNA, 20 bp, Artificial
  CRISPR gRNA sequence
ttaaagggcctcccaaccag

SEQ ID NO: 33114 - DNA, 20 bp, Artificial
  CRISPR gRNA sequence
taaagggcctcccaaccaga

SEQ ID NO: 33115 - DNA, 20 bp, Artificial
  CRISPR gRNA sequence
aaagggcctcccaaccagac

SEQ ID NO: 33116 - DNA, 20 bp, Artificial
  CRISPR gRNA sequence
aagggcctcccaaccagaca

SEQ ID NO: 33117 - DNA, 20 bp, Artificial
  CRISPR gRNA sequence
ccaaccagacaggacttagc

SEQ ID NO: 33118 - DNA, 20 bp, Artificial
  CRISPR gRNA sequence
agcgagggaagcaagttgga

SEQ ID NO: 33119 - DNA, 20 bp, Artificial
  CRISPR gRNA sequence
gcgagggaagcaagttggac

SEQ ID NO: 33120 - DNA, 20 bp, Artificial
  CRISPR gRNA sequence
gacccacagcaggctttgga

SEQ ID NO: 33121 - DNA, 20 bp, Artificial
  CRISPR gRNA sequence
tggagtcaaggaaaggccag

SEQ ID NO: 33122 - DNA, 20 bp, Artificial
  CRISPR gRNA sequence
ggagtcaaggaaaggccagg

SEQ ID NO: 33123 - DNA, 20 bp, Artificial
  CRISPR gRNA sequence
gagtcaaggaaaggccaggt

SEQ ID NO: 33124 - DNA, 20 bp, Artificial
  CRISPR gRNA sequence
aagcaaggctaggttggatc

SEQ ID NO: 33125 - DNA, 20 bp, Artificial
  CRISPR gRNA sequence
ggttggatcagggaggggct

SEQ ID NO: 33126 - DNA, 20 bp, Artificial
  CRISPR gRNA sequence
gatcagggaggggctcactc

SEQ ID NO: 33127 - DNA, 20 bp, Artificial
  CRISPR gRNA sequence
actcacgtcttttctgactt

SEQ ID NO: 33128 - DNA, 20 bp, Artificial
  CRISPR gRNA sequence
acgtcttttctgacttttct

SEQ ID NO: 33129 - DNA, 20 bp, Artificial
  CRISPR gRNA sequence
ttctgacttttctgcccaac

SEQ ID NO: 33130 - DNA, 20 bp, Artificial
  CRISPR gRNA sequence
tctgacttttctgcccaact

SEQ ID NO: 33131 - DNA, 20 bp, Artificial
  CRISPR gRNA sequence
ctgacttttctgcccaactt

SEQ ID NO: 33132 - DNA, 20 bp, Artificial
  CRISPR gRNA sequence
tgacttttctgcccaacttc

SEQ ID NO: 33133 - DNA, 20 bp, Artificial
  CRISPR gRNA sequence
acttttctgcccaacttctg

SEQ ID NO: 33134 - DNA, 20 bp, Artificial
  CRISPR gRNA sequence
ttctgcccaacttctgctgg

SEQ ID NO: 33135 - DNA, 20 bp, Artificial
  CRISPR gRNA sequence
tctgcccaacttctgctggc

SEQ ID NO: 33136 - DNA, 20 bp, Artificial
  CRISPR gRNA sequence
ctgcccaacttctgctggca

SEQ ID NO: 33137 - DNA, 20 bp, Artificial
  CRISPR gRNA sequence
tgcccaacttctgctggcat

SEQ ID NO: 33138 - DNA, 20 bp, Artificial
  CRISPR gRNA sequence
cccaacttctgctggcatct

SEQ ID NO: 33139 - DNA, 20 bp, Artificial
  CRISPR gRNA sequence
ctgctggcatctccatactc

SEQ ID NO: 33140 - DNA, 20 bp, Artificial
  CRISPR gRNA sequence
tgctggcatctccatactct

SEQ ID NO: 33141 - DNA, 20 bp, Artificial
  CRISPR gRNA sequence
ctggcatctccatactctca

SEQ ID NO: 33142 - DNA, 20 bp, Artificial
  CRISPR gRNA sequence
gcatctccatactctcaccg

SEQ ID NO: 33143 - DNA, 20 bp, Artificial
  CRISPR gRNA sequence
catactctcaccgatcactt

SEQ ID NO: 33144 - DNA, 20 bp, Artificial
  CRISPR gRNA sequence
tcaccgatcacttcatctgg

SEQ ID NO: 33145 - DNA, 20 bp, Artificial
  CRISPR gRNA sequence
accgatcacttcatctggtc

SEQ ID NO: 33146 - DNA, 20 bp, Artificial
  CRISPR gRNA sequence
catctggtcctatgtgctct

SEQ ID NO: 33147 - DNA, 20 bp, Artificial
  CRISPR gRNA sequence
atctggtcctatgtgctcta

SEQ ID NO: 33148 - DNA, 20 bp, Artificial
  CRISPR gRNA sequence
gtcctatgtgctctactttg

SEQ ID NO: 33149 - DNA, 20 bp, Artificial
  CRISPR gRNA sequence
tgtgctctactttgagaaaa

SEQ ID NO: 33150 - DNA, 20 bp, Artificial
  CRISPR gRNA sequence
tactttgagaaaaaccagag

SEQ ID NO: 33151 - DNA, 20 bp, Artificial
  CRISPR gRNA sequence
ctttgagaaaaaccagagac

SEQ ID NO: 33152 - DNA, 20 bp, Artificial
  CRISPR gRNA sequence
tgagaaaaaccagagaccaa

SEQ ID NO: 33153 - DNA, 20 bp, Artificial
  CRISPR gRNA sequence
gagaaaaaccagagaccaac

SEQ ID NO: 33154 - DNA, 20 bp, Artificial
  CRISPR gRNA sequence
agaaaaaccagagaccaact

SEQ ID NO: 33155 - DNA, 20 bp, Artificial
  CRISPR gRNA sequence
acacaatcaatgaaagccca

SEQ ID NO: 33156 - DNA, 20 bp, Artificial
  CRISPR gRNA sequence
tattgtacccaccttgggga

SEQ ID NO: 33157 - DNA, 20 bp, Artificial
  CRISPR gRNA sequence
ttgtacccaccttggggaga

SEQ ID NO: 33158 - DNA, 20 bp, Artificial
  CRISPR gRNA sequence
tacccaccttggggagaggg

SEQ ID NO: 33159 - DNA, 20 bp, Artificial
  CRISPR gRNA sequence
ggggagaggggtctgactgc

SEQ ID NO: 33160 - DNA, 20 bp, Artificial
  CRISPR gRNA sequence
gggagaggggtctgactgcc

SEQ ID NO: 33161 - DNA, 20 bp, Artificial
  CRISPR gRNA sequence
actgcccatcaatgaatggt

SEQ ID NO: 33162 - DNA, 20 bp, Artificial
  CRISPR gRNA sequence
cccatcaatgaatggtcgtc

SEQ ID NO: 33163 - DNA, 20 bp, Artificial
  CRISPR gRNA sequence
gggcaccccccagggaacaa

SEQ ID NO: 33164 - DNA, 20 bp, Artificial
  CRISPR gRNA sequence
agccaagacctccccaccca

SEQ ID NO: 33165 - DNA, 20 bp, Artificial
  CRISPR gRNA sequence
cccacccaccacaaacttac

SEQ ID NO: 33166 - DNA, 20 bp, Artificial
  CRISPR gRNA sequence
actgaaaatgtccttgctca

SEQ ID NO: 33167 - DNA, 20 bp, Artificial
  CRISPR gRNA sequence
ctgaaaatgtccttgctcag

SEQ ID NO: 33168 - DNA, 20 bp, Artificial
  CRISPR gRNA sequence
aaaatgtccttgctcaggcc

SEQ ID NO: 33169 - DNA, 20 bp, Artificial
  CRISPR gRNA sequence
gctcaggccctccagctggg

SEQ ID NO: 33170 - DNA, 20 bp, Artificial
  CRISPR gRNA sequence
ctcaggccctccagctggga

SEQ ID NO: 33171 - DNA, 20 bp, Artificial
  CRISPR gRNA sequence
aggccctccagctgggagtc

SEQ ID NO: 33172 - DNA, 20 bp, Artificial
  CRISPR gRNA sequence
cagctgggagtcctggaaga

SEQ ID NO: 33173 - DNA, 20 bp, Artificial
  CRISPR gRNA sequence
ggagtcctggaagacatact

SEQ ID NO: 33174 - DNA, 20 bp, Artificial
  CRISPR gRNA sequence
gaagacatactggtccagtt

SEQ ID NO: 33175 - DNA, 20 bp, Artificial
  CRISPR gRNA sequence
gtccagttccgctgcccaga

SEQ ID NO: 33176 - DNA, 20 bp, Artificial
  CRISPR gRNA sequence
cgctgcccagacaaggaaaa

SEQ ID NO: 33177 - DNA, 20 bp, Artificial
  CRISPR gRNA sequence
cccagacaaggaaaagcgca

SEQ ID NO: 33178 - DNA, 20 bp, Artificial
  CRISPR gRNA sequence
actgaaggcccactgtgtgc

SEQ ID NO: 33179 - DNA, 20 bp, Artificial
  CRISPR gRNA sequence
aaggcccactgtgtgccagg

SEQ ID NO: 33180 - DNA, 20 bp, Artificial
  CRISPR gRNA sequence
tgtgccaggccttgggctgg

SEQ ID NO: 33181 - DNA, 20 bp, Artificial
  CRISPR gRNA sequence
gggctggggaacctctgggc

SEQ ID NO: 33182 - DNA, 20 bp, Artificial
  CRISPR gRNA sequence
ggctggggaacctctgggcc

SEQ ID NO: 33183 - DNA, 20 bp, Artificial
  CRISPR gRNA sequence
gggaacctctgggcctggca

SEQ ID NO: 33184 - DNA, 20 bp, Artificial
  CRISPR gRNA sequence
tgggcctggcacacagtggg

SEQ ID NO: 33185 - DNA, 20 bp, Artificial
  CRISPR gRNA sequence
ggcctggcacacagtgggga

SEQ ID NO: 33186 - DNA, 20 bp, Artificial
  CRISPR gRNA sequence
gcacacagtggggactcaag

SEQ ID NO: 33187 - DNA, 20 bp, Artificial
  CRISPR gRNA sequence
aagaaatgtttgttgaatga

SEQ ID NO: 33188 - DNA, 20 bp, Artificial
  CRISPR gRNA sequence
gttgaatgaatgaatgatca

SEQ ID NO: 33189 - DNA, 20 bp, Artificial
  CRISPR gRNA sequence
ttgaatgaatgaatgatcaa

SEQ ID NO: 33190 - DNA, 20 bp, Artificial
  CRISPR gRNA sequence
aatgaatgaatgatcaaaca

SEQ ID NO: 33191 - DNA, 20 bp, Artificial
  CRISPR gRNA sequence
acactccaggggcccttaat

SEQ ID NO: 33192 - DNA, 20 bp, Artificial
  CRISPR gRNA sequence
caggggcccttaatctaatc

SEQ ID NO: 33193 - DNA, 20 bp, Artificial
  CRISPR gRNA sequence
aatctaatcaaaaggatgag

SEQ ID NO: 33194 - DNA, 20 bp, Artificial
  CRISPR gRNA sequence
atctaatcaaaaggatgagg

SEQ ID NO: 33195 - DNA, 20 bp, Artificial
  CRISPR gRNA sequence
atcaaaaggatgaggtatgt

SEQ ID NO: 33196 - DNA, 20 bp, Artificial
  CRISPR gRNA sequence
atctactgctacaaagaaga

SEQ ID NO: 33197 - DNA, 20 bp, Artificial
  CRISPR gRNA sequence
tctactgctacaaagaagag

SEQ ID NO: 33198 - DNA, 20 bp, Artificial
  CRISPR gRNA sequence
ctgctacaaagaagagcaag

SEQ ID NO: 33199 - DNA, 20 bp, Artificial
  CRISPR gRNA sequence
ctacaaagaagagcaaggca

SEQ ID NO: 33200 - DNA, 20 bp, Artificial
  CRISPR gRNA sequence
caaagaagagcaaggcagaa

SEQ ID NO: 33201 - DNA, 20 bp, Artificial
  CRISPR gRNA sequence
ctgcaggatttgagttcaaa

SEQ ID NO: 33202 - DNA, 20 bp, Artificial
  CRISPR gRNA sequence
caggatttgagttcaaattc

SEQ ID NO: 33203 - DNA, 20 bp, Artificial
  CRISPR gRNA sequence
gagttcaaattccacctcta

SEQ ID NO: 33204 - DNA, 20 bp, Artificial
  CRISPR gRNA sequence
agttcaaattccacctctac

SEQ ID NO: 33205 - DNA, 20 bp, Artificial
  CRISPR gRNA sequence
aaattccacctctactttcc

SEQ ID NO: 33206 - DNA, 20 bp, Artificial
  CRISPR gRNA sequence
cacctctactttccactagc

SEQ ID NO: 33207 - DNA, 20 bp, Artificial
  CRISPR gRNA sequence
tactttccactagccctact

SEQ ID NO: 33208 - DNA, 20 bp, Artificial
  CRISPR gRNA sequence
ctttccactagccctactag

SEQ ID NO: 33209 - DNA, 20 bp, Artificial
  CRISPR gRNA sequence
tccactagccctactagctg

SEQ ID NO: 33210 - DNA, 20 bp, Artificial
  CRISPR gRNA sequence
ccactagccctactagctgt

SEQ ID NO: 33211 - DNA, 20 bp, Artificial
  CRISPR gRNA sequence
cactagccctactagctgtg

SEQ ID NO: 33212 - DNA, 20 bp, Artificial
  CRISPR gRNA sequence
gccctactagctgtgcaatc

SEQ ID NO: 33213 - DNA, 20 bp, Artificial
  CRISPR gRNA sequence
ctagctgtgcaatcttgggc

SEQ ID NO: 33214 - DNA, 20 bp, Artificial
  CRISPR gRNA sequence
gctgtgcaatcttgggctac

SEQ ID NO: 33215 - DNA, 20 bp, Artificial
  CRISPR gRNA sequence
tgcaatcttgggctacttat

SEQ ID NO: 33216 - DNA, 20 bp, Artificial
  CRISPR gRNA sequence
gggctacttatttaaccact

SEQ ID NO: 33217 - DNA, 20 bp, Artificial
  CRISPR gRNA sequence
ggctacttatttaaccactg

SEQ ID NO: 33218 - DNA, 20 bp, Artificial
  CRISPR gRNA sequence
cttatttaaccactgtgggc

SEQ ID NO: 33219 - DNA, 20 bp, Artificial
  CRISPR gRNA sequence
atttaaccactgtgggcctc

SEQ ID NO: 33220 - DNA, 20 bp, Artificial
  CRISPR gRNA sequence
tttaaccactgtgggcctcc

SEQ ID NO: 33221 - DNA, 20 bp, Artificial
  CRISPR gRNA sequence
aaccactgtgggcctccatt

SEQ ID NO: 33222 - DNA, 20 bp, Artificial
  CRISPR gRNA sequence
accactgtgggcctccattt

SEQ ID NO: 33223 - DNA, 20 bp, Artificial
  CRISPR gRNA sequence
tgggcctccattttctcatc

SEQ ID NO: 33224 - DNA, 20 bp, Artificial
  CRISPR gRNA sequence
cattttctcatctgtgtaag

SEQ ID NO: 33225 - DNA, 20 bp, Artificial
  CRISPR gRNA sequence
tctcatctgtgtaagatgaa

SEQ ID NO: 33226 - DNA, 20 bp, Artificial
  CRISPR gRNA sequence
ctcatctgtgtaagatgaat

SEQ ID NO: 33227 - DNA, 20 bp, Artificial
  CRISPR gRNA sequence
tcatctgtgtaagatgaata

SEQ ID NO: 33228 - DNA, 20 bp, Artificial
  CRISPR gRNA sequence
atctgtgtaagatgaataaa

SEQ ID NO: 33229 - DNA, 20 bp, Artificial
  CRISPR gRNA sequence
tgtaagatgaataaataatg

SEQ ID NO: 33230 - DNA, 20 bp, Artificial
  CRISPR gRNA sequence
ctacccaggaatcgatggtg

SEQ ID NO: 33231 - DNA, 20 bp, Artificial
  CRISPR gRNA sequence
cccaggaatcgatggtgata

SEQ ID NO: 33232 - DNA, 20 bp, Artificial
  CRISPR gRNA sequence
gaggttctacatctagagca

SEQ ID NO: 33233 - DNA, 20 bp, Artificial
  CRISPR gRNA sequence
tacatctagagcatccaaca

SEQ ID NO: 33234 - DNA, 20 bp, Artificial
  CRISPR gRNA sequence
catctagagcatccaacaca

SEQ ID NO: 33235 - DNA, 20 bp, Artificial
  CRISPR gRNA sequence
gagcatccaacacagtagct

SEQ ID NO: 33236 - DNA, 20 bp, Artificial
  CRISPR gRNA sequence
gtatacagtaggcactcagt

SEQ ID NO: 33237 - DNA, 20 bp, Artificial
  CRISPR gRNA sequence
agtaaatagtggtaactata

SEQ ID NO: 33238 - DNA, 20 bp, Artificial
  CRISPR gRNA sequence
tataaaggggtacatggctc

SEQ ID NO: 33239 - DNA, 20 bp, Artificial
  CRISPR gRNA sequence
agagcccttggaatataggc

SEQ ID NO: 33240 - DNA, 20 bp, Artificial
  CRISPR gRNA sequence
ggaatataggcaccatgaca

SEQ ID NO: 33241 - DNA, 20 bp, Artificial
  CRISPR gRNA sequence
gaatataggcaccatgacat

SEQ ID NO: 33242 - DNA, 20 bp, Artificial
  CRISPR gRNA sequence
cctggaggaagggatcctgg

SEQ ID NO: 33243 - DNA, 20 bp, Artificial
  CRISPR gRNA sequence
ctggaggaagggatcctgga

SEQ ID NO: 33244 - DNA, 20 bp, Artificial
  CRISPR gRNA sequence
gaggaagggatcctggaacc

SEQ ID NO: 33245 - DNA, 20 bp, Artificial
  CRISPR gRNA sequence
gaaccaggccttgaaagatg

SEQ ID NO: 33246 - DNA, 20 bp, Artificial
  CRISPR gRNA sequence
gaaagatgaggcagagtctg

SEQ ID NO: 33247 - DNA, 20 bp, Artificial
  CRISPR gRNA sequence
aaagatgaggcagagtctgg

SEQ ID NO: 33248 - DNA, 20 bp, Artificial
  CRISPR gRNA sequence
ggagaaggagaacagatagc

SEQ ID NO: 33249 - DNA, 20 bp, Artificial
  CRISPR gRNA sequence
tctgggtcacagtggcagag

SEQ ID NO: 33250 - DNA, 20 bp, Artificial
  CRISPR gRNA sequence
ctgggtcacagtggcagagt

SEQ ID NO: 33251 - DNA, 20 bp, Artificial
  CRISPR gRNA sequence
tgggtcacagtggcagagtg

SEQ ID NO: 33252 - DNA, 20 bp, Artificial
  CRISPR gRNA sequence
ggtcacagtggcagagtgag

SEQ ID NO: 33253 - DNA, 20 bp, Artificial
  CRISPR gRNA sequence
gttcagagtatgtttaggaa

SEQ ID NO: 33254 - DNA, 20 bp, Artificial
  CRISPR gRNA sequence
ttcagagtatgtttaggaaa

SEQ ID NO: 33255 - DNA, 20 bp, Artificial
  CRISPR gRNA sequence
agagtatgtttaggaaaccc

SEQ ID NO: 33256 - DNA, 20 bp, Artificial
  CRISPR gRNA sequence
aggaaaccctgagagatagg

SEQ ID NO: 33257 - DNA, 20 bp, Artificial
  CRISPR gRNA sequence
ggaaaccctgagagataggt

SEQ ID NO: 33258 - DNA, 20 bp, Artificial
  CRISPR gRNA sequence
agagataggtgacggtggta

SEQ ID NO: 33259 - DNA, 20 bp, Artificial
  CRISPR gRNA sequence
catgctggggaaagttagga

SEQ ID NO: 33260 - DNA, 20 bp, Artificial
  CRISPR gRNA sequence
atgctggggaaagttaggac

SEQ ID NO: 33261 - DNA, 20 bp, Artificial
  CRISPR gRNA sequence
gggaaagttaggacttgatt

SEQ ID NO: 33262 - DNA, 20 bp, Artificial
  CRISPR gRNA sequence
ggacttgattttataagcaa

SEQ ID NO: 33263 - DNA, 20 bp, Artificial
  CRISPR gRNA sequence
gattttataagcaatgggga

SEQ ID NO: 33264 - DNA, 20 bp, Artificial
  CRISPR gRNA sequence
attttataagcaatggggag

SEQ ID NO: 33265 - DNA, 20 bp, Artificial
  CRISPR gRNA sequence
tataagcaatggggagccat

SEQ ID NO: 33266 - DNA, 20 bp, Artificial
  CRISPR gRNA sequence
ataagcaatggggagccata

SEQ ID NO: 33267 - DNA, 20 bp, Artificial
  CRISPR gRNA sequence
taagcaatggggagccatag

SEQ ID NO: 33268 - DNA, 20 bp, Artificial
  CRISPR gRNA sequence
ctgagctgaggaatggaatg

SEQ ID NO: 33269 - DNA, 20 bp, Artificial
  CRISPR gRNA sequence
tgagctgaggaatggaatga

SEQ ID NO: 33270 - DNA, 20 bp, Artificial
  CRISPR gRNA sequence
agctgaggaatggaatgatg

SEQ ID NO: 33271 - DNA, 20 bp, Artificial
  CRISPR gRNA sequence
aggaatggaatgatggccat

SEQ ID NO: 33272 - DNA, 20 bp, Artificial
  CRISPR gRNA sequence
tggggtagtacctaacatct

SEQ ID NO: 33273 - DNA, 20 bp, Artificial
  CRISPR gRNA sequence
acatctactgaatgcttact

SEQ ID NO: 33274 - DNA, 20 bp, Artificial
  CRISPR gRNA sequence
ctgaatgcttactctgtgca

SEQ ID NO: 33275 - DNA, 20 bp, Artificial
  CRISPR gRNA sequence
aatgcttactctgtgcaaat

SEQ ID NO: 33276 - DNA, 20 bp, Artificial
  CRISPR gRNA sequence
actctgtgcaaattcctttt

SEQ ID NO: 33277 - DNA, 20 bp, Artificial
  CRISPR gRNA sequence
ctctgtgcaaattccttttc

SEQ ID NO: 33278 - DNA, 20 bp, Artificial
  CRISPR gRNA sequence
tgtgcaaattccttttctaa

SEQ ID NO: 33279 - DNA, 20 bp, Artificial
  CRISPR gRNA sequence
tgcaaattccttttctaaat

SEQ ID NO: 33280 - DNA, 20 bp, Artificial
  CRISPR gRNA sequence
cttttctaaatgctttacac

SEQ ID NO: 33281 - DNA, 20 bp, Artificial
  CRISPR gRNA sequence
ttctaaatgctttacacatt

SEQ ID NO: 33282 - DNA, 20 bp, Artificial
  CRISPR gRNA sequence
tctaaatgctttacacattg

SEQ ID NO: 33283 - DNA, 20 bp, Artificial
  CRISPR gRNA sequence
ctaaatgctttacacattgt

SEQ ID NO: 33284 - DNA, 20 bp, Artificial
  CRISPR gRNA sequence
taaatgctttacacattgta

SEQ ID NO: 33285 - DNA, 20 bp, Artificial
  CRISPR gRNA sequence
aatgctttacacattgtaac

SEQ ID NO: 33286 - DNA, 20 bp, Artificial
  CRISPR gRNA sequence
tacacattgtaacttattca

SEQ ID NO: 33287 - DNA, 20 bp, Artificial
  CRISPR gRNA sequence
acacattgtaacttattcag

SEQ ID NO: 33288 - DNA, 20 bp, Artificial
  CRISPR gRNA sequence
cacattgtaacttattcagt

SEQ ID NO: 33289 - DNA, 20 bp, Artificial
  CRISPR gRNA sequence
taacttattcagtcttacaa

SEQ ID NO: 33290 - DNA, 20 bp, Artificial
  CRISPR gRNA sequence
attcagtcttacaaccatcc

SEQ ID NO: 33291 - DNA, 20 bp, Artificial
  CRISPR gRNA sequence
ttcagtcttacaaccatccc

SEQ ID NO: 33292 - DNA, 20 bp, Artificial
  CRISPR gRNA sequence
agtcttacaaccatcccgtg

SEQ ID NO: 33293 - DNA, 20 bp, Artificial
  CRISPR gRNA sequence
acaaccatcccgtgatggtg

SEQ ID NO: 33294 - DNA, 20 bp, Artificial
  CRISPR gRNA sequence
caaccatcccgtgatggtgg

SEQ ID NO: 33295 - DNA, 20 bp, Artificial
  CRISPR gRNA sequence
ttatctccattttacacatt

SEQ ID NO: 33296 - DNA, 20 bp, Artificial
  CRISPR gRNA sequence
tctccattttacacatttag

SEQ ID NO: 33297 - DNA, 20 bp, Artificial
  CRISPR gRNA sequence
cattttacacatttagaagc

SEQ ID NO: 33298 - DNA, 20 bp, Artificial
  CRISPR gRNA sequence
tacacatttagaagctaagg

SEQ ID NO: 33299 - DNA, 20 bp, Artificial
  CRISPR gRNA sequence
acacatttagaagctaaggt

SEQ ID NO: 33300 - DNA, 20 bp, Artificial
  CRISPR gRNA sequence
cacatttagaagctaaggtc

SEQ ID NO: 33301 - DNA, 20 bp, Artificial
  CRISPR gRNA sequence
agaagctaaggtcatatttc

SEQ ID NO: 33302 - DNA, 20 bp, Artificial
  CRISPR gRNA sequence
gaagctaaggtcatatttca

SEQ ID NO: 33303 - DNA, 20 bp, Artificial
  CRISPR gRNA sequence
aggtcatatttcaggatgct

SEQ ID NO: 33304 - DNA, 20 bp, Artificial
  CRISPR gRNA sequence
caggatgctgcaaaagaata

SEQ ID NO: 33305 - DNA, 20 bp, Artificial
  CRISPR gRNA sequence
aggatgctgcaaaagaatac

SEQ ID NO: 33306 - DNA, 20 bp, Artificial
  CRISPR gRNA sequence
caaaagaatacttgcccagg

SEQ ID NO: 33307 - DNA, 20 bp, Artificial
  CRISPR gRNA sequence
gcccaggcctgggcttcacc

SEQ ID NO: 33308 - DNA, 20 bp, Artificial
  CRISPR gRNA sequence
cccaggcctgggcttcacct

SEQ ID NO: 33309 - DNA, 20 bp, Artificial
  CRISPR gRNA sequence
ggcttcaccttccagaagca

SEQ ID NO: 33310 - DNA, 20 bp, Artificial
  CRISPR gRNA sequence
caccttccagaagcagagag

SEQ ID NO: 33311 - DNA, 20 bp, Artificial
  CRISPR gRNA sequence
accttccagaagcagagaga

SEQ ID NO: 33312 - DNA, 20 bp, Artificial
  CRISPR gRNA sequence
ccagaagcagagagaaaacc

SEQ ID NO: 33313 - DNA, 20 bp, Artificial
  CRISPR gRNA sequence
cagaagcagagagaaaaccc

SEQ ID NO: 33314 - DNA, 20 bp, Artificial
  CRISPR gRNA sequence
gaggagcagacttgggtgaa

SEQ ID NO: 33315 - DNA, 20 bp, Artificial
  CRISPR gRNA sequence
aggagcagacttgggtgaag

SEQ ID NO: 33316 - DNA, 20 bp, Artificial
  CRISPR gRNA sequence
gggtgaagctgcctgttatg

SEQ ID NO: 33317 - DNA, 20 bp, Artificial
  CRISPR gRNA sequence
ggtgaagctgcctgttatga

SEQ ID NO: 33318 - DNA, 20 bp, Artificial
  CRISPR gRNA sequence
cctgttatgacgtgaatgtt

SEQ ID NO: 33319 - DNA, 20 bp, Artificial
  CRISPR gRNA sequence
ttatgacgtgaatgtttgtc

SEQ ID NO: 33320 - DNA, 20 bp, Artificial
  CRISPR gRNA sequence
tgacgtgaatgtttgtcttc

SEQ ID NO: 33321 - DNA, 20 bp, Artificial
  CRISPR gRNA sequence
gtcttctccaaaactcatgt

SEQ ID NO: 33322 - DNA, 20 bp, Artificial
  CRISPR gRNA sequence
tcttctccaaaactcatgta

SEQ ID NO: 33323 - DNA, 20 bp, Artificial
  CRISPR gRNA sequence
ctccaaaactcatgtataaa

SEQ ID NO: 33324 - DNA, 20 bp, Artificial
  CRISPR gRNA sequence
tccaaaactcatgtataaat

SEQ ID NO: 33325 - DNA, 20 bp, Artificial
  CRISPR gRNA sequence
caaaactcatgtataaatgt

SEQ ID NO: 33326 - DNA, 20 bp, Artificial
  CRISPR gRNA sequence
atgtataaatgtaatcccct

SEQ ID NO: 33327 - DNA, 20 bp, Artificial
  CRISPR gRNA sequence
tgtggcagtattgagaggtg

SEQ ID NO: 33328 - DNA, 20 bp, Artificial
  CRISPR gRNA sequence
agaggtggggcctttaagag

SEQ ID NO: 33329 - DNA, 20 bp, Artificial
  CRISPR gRNA sequence
taagaggtgactggggcttt

SEQ ID NO: 33330 - DNA, 20 bp, Artificial
  CRISPR gRNA sequence
aagaggtgactggggctttt

SEQ ID NO: 33331 - DNA, 20 bp, Artificial
  CRISPR gRNA sequence
agaggtgactggggcttttc

SEQ ID NO: 33332 - DNA, 20 bp, Artificial
  CRISPR gRNA sequence
gggcttttccttgatgaatg

SEQ ID NO: 33333 - DNA, 20 bp, Artificial
  CRISPR gRNA sequence
ttccttgatgaatgggttaa

SEQ ID NO: 33334 - DNA, 20 bp, Artificial
  CRISPR gRNA sequence
tccttgatgaatgggttaat

SEQ ID NO: 33335 - DNA, 20 bp, Artificial
  CRISPR gRNA sequence
ccttgatgaatgggttaatc

SEQ ID NO: 33336 - DNA, 20 bp, Artificial
  CRISPR gRNA sequence
cttgatgaatgggttaatcc

SEQ ID NO: 33337 - DNA, 20 bp, Artificial
  CRISPR gRNA sequence
gatgaatgggttaatccgtt

SEQ ID NO: 33338 - DNA, 20 bp, Artificial
  CRISPR gRNA sequence
atgaatgggttaatccgttc

SEQ ID NO: 33339 - DNA, 20 bp, Artificial
  CRISPR gRNA sequence
atccgttcatggattagtgg

SEQ ID NO: 33340 - DNA, 20 bp, Artificial
  CRISPR gRNA sequence
atggattagtggataaacag

SEQ ID NO: 33341 - DNA, 20 bp, Artificial
  CRISPR gRNA sequence
gtggataaacaggttaataa

SEQ ID NO: 33342 - DNA, 20 bp, Artificial
  CRISPR gRNA sequence
ataagttaatgggttgtcgt

SEQ ID NO: 33343 - DNA, 20 bp, Artificial
  CRISPR gRNA sequence
atgggttgtcgtgggagtaa

SEQ ID NO: 33344 - DNA, 20 bp, Artificial
  CRISPR gRNA sequence
tcgtgggagtaagactagtg

SEQ ID NO: 33345 - DNA, 20 bp, Artificial
  CRISPR gRNA sequence
gtggttttatgagaagagga

SEQ ID NO: 33346 - DNA, 20 bp, Artificial
  CRISPR gRNA sequence
tatgagaagaggaagagaga

SEQ ID NO: 33347 - DNA, 20 bp, Artificial
  CRISPR gRNA sequence
atgagaagaggaagagagac

SEQ ID NO: 33348 - DNA, 20 bp, Artificial
  CRISPR gRNA sequence
tgagaagaggaagagagact

SEQ ID NO: 33349 - DNA, 20 bp, Artificial
  CRISPR gRNA sequence
tcacaccgaaacctcttgcc

SEQ ID NO: 33350 - DNA, 20 bp, Artificial
  CRISPR gRNA sequence
ttgcctcgtgatgccccaca

SEQ ID NO: 33351 - DNA, 20 bp, Artificial
  CRISPR gRNA sequence
gcctcgtgatgccccacact

SEQ ID NO: 33352 - DNA, 20 bp, Artificial
  CRISPR gRNA sequence
cctcgtgatgccccacactg

SEQ ID NO: 33353 - DNA, 20 bp, Artificial
  CRISPR gRNA sequence
gtgatgccccacactgcctt

SEQ ID NO: 33354 - DNA, 20 bp, Artificial
  CRISPR gRNA sequence
ccttgggactctgcagagag

SEQ ID NO: 33355 - DNA, 20 bp, Artificial
  CRISPR gRNA sequence
gggactctgcagagagtcct

SEQ ID NO: 33356 - DNA, 20 bp, Artificial
  CRISPR gRNA sequence
ggactctgcagagagtcctc

SEQ ID NO: 33357 - DNA, 20 bp, Artificial
  CRISPR gRNA sequence
tgcagagagtcctcaccagt

SEQ ID NO: 33358 - DNA, 20 bp, Artificial
  CRISPR gRNA sequence
cagagagtcctcaccagtaa

SEQ ID NO: 33359 - DNA, 20 bp, Artificial
  CRISPR gRNA sequence
accagtaagaaggccctcac

SEQ ID NO: 33360 - DNA, 20 bp, Artificial
  CRISPR gRNA sequence
accagatgcagcccctaacc

SEQ ID NO: 33361 - DNA, 20 bp, Artificial
  CRISPR gRNA sequence
accttggacttctcagcctc

SEQ ID NO: 33362 - DNA, 20 bp, Artificial
  CRISPR gRNA sequence
ggacttctcagcctccataa

SEQ ID NO: 33363 - DNA, 20 bp, Artificial
  CRISPR gRNA sequence
gacttctcagcctccataac

SEQ ID NO: 33364 - DNA, 20 bp, Artificial
  CRISPR gRNA sequence
ctcagcctccataactgtaa

SEQ ID NO: 33365 - DNA, 20 bp, Artificial
  CRISPR gRNA sequence
tcagcctccataactgtaag

SEQ ID NO: 33366 - DNA, 20 bp, Artificial
  CRISPR gRNA sequence
agcctccataactgtaagaa

SEQ ID NO: 33367 - DNA, 20 bp, Artificial
  CRISPR gRNA sequence
cataactgtaagaaatattt

SEQ ID NO: 33368 - DNA, 20 bp, Artificial
  CRISPR gRNA sequence
taagaaatattttttttctt

SEQ ID NO: 33369 - DNA, 20 bp, Artificial
  CRISPR gRNA sequence
tttttctttataaattactc

SEQ ID NO: 33370 - DNA, 20 bp, Artificial
  CRISPR gRNA sequence
ttttctttataaattactca

SEQ ID NO: 33371 - DNA, 20 bp, Artificial
  CRISPR gRNA sequence
tttctttataaattactcag

SEQ ID NO: 33372 - DNA, 20 bp, Artificial
  CRISPR gRNA sequence
ttctttataaattactcagt

SEQ ID NO: 33373 - DNA, 20 bp, Artificial
  CRISPR gRNA sequence
tctttataaattactcagtg

SEQ ID NO: 33374 - DNA, 20 bp, Artificial
  CRISPR gRNA sequence
ctttataaattactcagtgt

SEQ ID NO: 33375 - DNA, 20 bp, Artificial
  CRISPR gRNA sequence
tttataaattactcagtgtc

SEQ ID NO: 33376 - DNA, 20 bp, Artificial
  CRISPR gRNA sequence
tataaattactcagtgtcag

SEQ ID NO: 33377 - DNA, 20 bp, Artificial
  CRISPR gRNA sequence
ataaattactcagtgtcagg

SEQ ID NO: 33378 - DNA, 20 bp, Artificial
  CRISPR gRNA sequence
taaattactcagtgtcaggt

SEQ ID NO: 33379 - DNA, 20 bp, Artificial
  CRISPR gRNA sequence
ctcagtgtcaggtatgttgt

SEQ ID NO: 33380 - DNA, 20 bp, Artificial
  CRISPR gRNA sequence
agtgtcaggtatgttgtttt

SEQ ID NO: 33381 - DNA, 20 bp, Artificial
  CRISPR gRNA sequence
ttttaagcaacaaaaaatgg

SEQ ID NO: 33382 - DNA, 20 bp, Artificial
  CRISPR gRNA sequence
taagcaacaaaaaatggact

SEQ ID NO: 33383 - DNA, 20 bp, Artificial
  CRISPR gRNA sequence
aagcaacaaaaaatggacta

SEQ ID NO: 33384 - DNA, 20 bp, Artificial
  CRISPR gRNA sequence
agcaacaaaaaatggactaa

SEQ ID NO: 33385 - DNA, 20 bp, Artificial
  CRISPR gRNA sequence
acgcactgcctcacctattt

SEQ ID NO: 33386 - DNA, 20 bp, Artificial
  CRISPR gRNA sequence
cctcacctatttgcttagac

SEQ ID NO: 33387 - DNA, 20 bp, Artificial
  CRISPR gRNA sequence
acctatttgcttagacagct

SEQ ID NO: 33388 - DNA, 20 bp, Artificial
  CRISPR gRNA sequence
tttgcttagacagctttcgc

SEQ ID NO: 33389 - DNA, 20 bp, Artificial
  CRISPR gRNA sequence
gcttagacagctttcgctgc

SEQ ID NO: 33390 - DNA, 20 bp, Artificial
  CRISPR gRNA sequence
cttagacagctttcgctgcc

SEQ ID NO: 33391 - DNA, 20 bp, Artificial
  CRISPR gRNA sequence
agacagctttcgctgcctgt

SEQ ID NO: 33392 - DNA, 20 bp, Artificial
  CRISPR gRNA sequence
gacagctttcgctgcctgtg

SEQ ID NO: 33393 - DNA, 20 bp, Artificial
  CRISPR gRNA sequence
tcgctgcctgtggagatgcc

SEQ ID NO: 33394 - DNA, 20 bp, Artificial
  CRISPR gRNA sequence
cgctgcctgtggagatgcca

SEQ ID NO: 33395 - DNA, 20 bp, Artificial
  CRISPR gRNA sequence
gctgcctgtggagatgccac

SEQ ID NO: 33396 - DNA, 20 bp, Artificial
  CRISPR gRNA sequence
cctgtggagatgccactaag

SEQ ID NO: 33397 - DNA, 20 bp, Artificial
  CRISPR gRNA sequence
tggagatgccactaaggggg

SEQ ID NO: 33398 - DNA, 20 bp, Artificial
  CRISPR gRNA sequence
aggggggagaaaaacaccca

SEQ ID NO: 33399 - DNA, 20 bp, Artificial
  CRISPR gRNA sequence
tgacatgcccaaatccttaa

SEQ ID NO: 33400 - DNA, 20 bp, Artificial
  CRISPR gRNA sequence
aatgactgcctccagttgtg

SEQ ID NO: 33401 - DNA, 20 bp, Artificial
  CRISPR gRNA sequence
atgactgcctccagttgtga

SEQ ID NO: 33402 - DNA, 20 bp, Artificial
  CRISPR gRNA sequence
cctccagttgtgaggaaatg

SEQ ID NO: 33403 - DNA, 20 bp, Artificial
  CRISPR gRNA sequence
cagttgtgaggaaatgtgaa

SEQ ID NO: 33404 - DNA, 20 bp, Artificial
  CRISPR gRNA sequence
tgaggaaatgtgaatgtcct

SEQ ID NO: 33405 - DNA, 20 bp, Artificial
  CRISPR gRNA sequence
agccccaatcacttctgctt

SEQ ID NO: 33406 - DNA, 20 bp, Artificial
  CRISPR gRNA sequence
ctgcttcccccatgtaaatc

SEQ ID NO: 33407 - DNA, 20 bp, Artificial
  CRISPR gRNA sequence
tgcttcccccatgtaaatcc

SEQ ID NO: 33408 - DNA, 20 bp, Artificial
  CRISPR gRNA sequence
cttcccccatgtaaatcccc

SEQ ID NO: 33409 - DNA, 20 bp, Artificial
  CRISPR gRNA sequence
cccccatgtaaatccccagg

SEQ ID NO: 33410 - DNA, 20 bp, Artificial
  CRISPR gRNA sequence
ccccatgtaaatccccagga

SEQ ID NO: 33411 - DNA, 20 bp, Artificial
  CRISPR gRNA sequence
tcagttctgtaatttctgaa

SEQ ID NO: 33412 - DNA, 20 bp, Artificial
  CRISPR gRNA sequence
agttctgtaatttctgaaac

SEQ ID NO: 33413 - DNA, 20 bp, Artificial
  CRISPR gRNA sequence
tgtaatttctgaaacatgaa

SEQ ID NO: 33414 - DNA, 20 bp, Artificial
  CRISPR gRNA sequence
taatttctgaaacatgaaca

SEQ ID NO: 33415 - DNA, 20 bp, Artificial
  CRISPR gRNA sequence
ctgaaacatgaacaattact

SEQ ID NO: 33416 - DNA, 20 bp, Artificial
  CRISPR gRNA sequence
tgaaacatgaacaattacta

SEQ ID NO: 33417 - DNA, 20 bp, Artificial
  CRISPR gRNA sequence
aaacatgaacaattactagt

SEQ ID NO: 33418 - DNA, 20 bp, Artificial
  CRISPR gRNA sequence
ctagtcccctccattttctt

SEQ ID NO: 33419 - DNA, 20 bp, Artificial
  CRISPR gRNA sequence
gtcccctccattttcttcct

SEQ ID NO: 33420 - DNA, 20 bp, Artificial
  CRISPR gRNA sequence
cattttcttccttggtatga

SEQ ID NO: 33421 - DNA, 20 bp, Artificial
  CRISPR gRNA sequence
tcttccttggtatgattttc

SEQ ID NO: 33422 - DNA, 20 bp, Artificial
  CRISPR gRNA sequence
cttccttggtatgattttca

SEQ ID NO: 33423 - DNA, 20 bp, Artificial
  CRISPR gRNA sequence
ttccttggtatgattttcaa

SEQ ID NO: 33424 - DNA, 20 bp, Artificial
  CRISPR gRNA sequence
ccttggtatgattttcaata

SEQ ID NO: 33425 - DNA, 20 bp, Artificial
  CRISPR gRNA sequence
cttggtatgattttcaatac

SEQ ID NO: 33426 - DNA, 20 bp, Artificial
  CRISPR gRNA sequence
ggtatgattttcaatacact

SEQ ID NO: 33427 - DNA, 20 bp, Artificial
  CRISPR gRNA sequence
gtatgattttcaatacactg

SEQ ID NO: 33428 - DNA, 20 bp, Artificial
  CRISPR gRNA sequence
tcaatacactgtgctctggg

SEQ ID NO: 33429 - DNA, 20 bp, Artificial
  CRISPR gRNA sequence
caatacactgtgctctgggg

SEQ ID NO: 33430 - DNA, 20 bp, Artificial
  CRISPR gRNA sequence
aatacactgtgctctgggga

SEQ ID NO: 33431 - DNA, 20 bp, Artificial
  CRISPR gRNA sequence
tgctctggggaaaaattggc

SEQ ID NO: 33432 - DNA, 20 bp, Artificial
  CRISPR gRNA sequence
tggggaaaaattggccacat

SEQ ID NO: 33433 - DNA, 20 bp, Artificial
  CRISPR gRNA sequence
gggaaaaattggccacattt

SEQ ID NO: 33434 - DNA, 20 bp, Artificial
  CRISPR gRNA sequence
gccacatttggatcaagcac

SEQ ID NO: 33435 - DNA, 20 bp, Artificial
  CRISPR gRNA sequence
ggatcaagcacagaactgct

SEQ ID NO: 33436 - DNA, 20 bp, Artificial
  CRISPR gRNA sequence
gatcaagcacagaactgctg

SEQ ID NO: 33437 - DNA, 20 bp, Artificial
  CRISPR gRNA sequence
ctgaatgctgctgttcctgg

SEQ ID NO: 33438 - DNA, 20 bp, Artificial
  CRISPR gRNA sequence
aatgctgctgttcctgggtt

SEQ ID NO: 33439 - DNA, 20 bp, Artificial
  CRISPR gRNA sequence
ctgttcctgggttggcagga

SEQ ID NO: 33440 - DNA, 20 bp, Artificial
  CRISPR gRNA sequence
ttcctgggttggcaggaaga

SEQ ID NO: 33441 - DNA, 20 bp, Artificial
  CRISPR gRNA sequence
ctgggttggcaggaagaaga

SEQ ID NO: 33442 - DNA, 20 bp, Artificial
  CRISPR gRNA sequence
ggttggcaggaagaagacca

SEQ ID NO: 33443 - DNA, 20 bp, Artificial
  CRISPR gRNA sequence
gcaggaagaagaccactaag

SEQ ID NO: 33444 - DNA, 20 bp, Artificial
  CRISPR gRNA sequence
agaagagttttgcaggttgt

SEQ ID NO: 33445 - DNA, 20 bp, Artificial
  CRISPR gRNA sequence
tgcaggttgttcactgcaca

SEQ ID NO: 33446 - DNA, 20 bp, Artificial
  CRISPR gRNA sequence
gcaggttgttcactgcacac

SEQ ID NO: 33447 - DNA, 20 bp, Artificial
  CRISPR gRNA sequence
caggttgttcactgcacaca

SEQ ID NO: 33448 - DNA, 20 bp, Artificial
  CRISPR gRNA sequence
ttcactgcacacaggtgccc

SEQ ID NO: 33449 - DNA, 20 bp, Artificial
  CRISPR gRNA sequence
actgcacacaggtgcccaag

SEQ ID NO: 33450 - DNA, 20 bp, Artificial
  CRISPR gRNA sequence
cacacaggtgcccaagccaa

SEQ ID NO: 33451 - DNA, 20 bp, Artificial
  CRISPR gRNA sequence
cggcttgcactttgctagcc

SEQ ID NO: 33452 - DNA, 20 bp, Artificial
  CRISPR gRNA sequence
gcactttgctagccaagcag

SEQ ID NO: 33453 - DNA, 20 bp, Artificial
  CRISPR gRNA sequence
cactttgctagccaagcagt

SEQ ID NO: 33454 - DNA, 20 bp, Artificial
  CRISPR gRNA sequence
tgctagccaagcagttactt

SEQ ID NO: 33455 - DNA, 20 bp, Artificial
  CRISPR gRNA sequence
gctagccaagcagttacttc

SEQ ID NO: 33456 - DNA, 20 bp, Artificial
  CRISPR gRNA sequence
ctagccaagcagttacttcc

SEQ ID NO: 33457 - DNA, 20 bp, Artificial
  CRISPR gRNA sequence
gccaagcagttacttcctgg

SEQ ID NO: 33458 - DNA, 20 bp, Artificial
  CRISPR gRNA sequence
cttcctggtaggggctgcat

SEQ ID NO: 33459 - DNA, 20 bp, Artificial
  CRISPR gRNA sequence
cctggtaggggctgcatcct

SEQ ID NO: 33460 - DNA, 20 bp, Artificial
  CRISPR gRNA sequence
ctggtaggggctgcatcctc

SEQ ID NO: 33461 - DNA, 20 bp, Artificial
  CRISPR gRNA sequence
gtaggggctgcatcctccag

SEQ ID NO: 33462 - DNA, 20 bp, Artificial
  CRISPR gRNA sequence
catcctccagaaaaaggcca

SEQ ID NO: 33463 - DNA, 20 bp, Artificial
  CRISPR gRNA sequence
cagaaaaaggccactttttt

SEQ ID NO: 33464 - DNA, 20 bp, Artificial
  CRISPR gRNA sequence
ttttctatttcaacataggc

SEQ ID NO: 33465 - DNA, 20 bp, Artificial
  CRISPR gRNA sequence
tttctatttcaacataggct

SEQ ID NO: 33466 - DNA, 20 bp, Artificial
  CRISPR gRNA sequence
ttctatttcaacataggctc

SEQ ID NO: 33467 - DNA, 20 bp, Artificial
  CRISPR gRNA sequence
tctatttcaacataggctct

SEQ ID NO: 33468 - DNA, 20 bp, Artificial
  CRISPR gRNA sequence
ctatttcaacataggctctg

SEQ ID NO: 33469 - DNA, 20 bp, Artificial
  CRISPR gRNA sequence
tatttcaacataggctctgt

SEQ ID NO: 33470 - DNA, 20 bp, Artificial
  CRISPR gRNA sequence
tttcaacataggctctgtat

SEQ ID NO: 33471 - DNA, 20 bp, Artificial
  CRISPR gRNA sequence
caacataggctctgtatgag

SEQ ID NO: 33472 - DNA, 20 bp, Artificial
  CRISPR gRNA sequence
aacataggctctgtatgagg

SEQ ID NO: 33473 - DNA, 20 bp, Artificial
  CRISPR gRNA sequence
tgtatgaggtggtggtgatg

SEQ ID NO: 33474 - DNA, 20 bp, Artificial
  CRISPR gRNA sequence
tatgaggtggtggtgatgct

SEQ ID NO: 33475 - DNA, 20 bp, Artificial
  CRISPR gRNA sequence
gtgagaagagattctctatc

SEQ ID NO: 33476 - DNA, 20 bp, Artificial
  CRISPR gRNA sequence
tctatcccacgtctctcccc

SEQ ID NO: 33477 - DNA, 20 bp, Artificial
  CRISPR gRNA sequence
tatcccacgtctctccccca

SEQ ID NO: 33478 - DNA, 20 bp, Artificial
  CRISPR gRNA sequence
tcccacgtctctcccccaaa

SEQ ID NO: 33479 - DNA, 20 bp, Artificial
  CRISPR gRNA sequence
tcccccaaaaaacaaaccac

SEQ ID NO: 33480 - DNA, 20 bp, Artificial
  CRISPR gRNA sequence
ccccaaaaaacaaaccacta

SEQ ID NO: 33481 - DNA, 20 bp, Artificial
  CRISPR gRNA sequence
gcagcaacaccaccaccacc

SEQ ID NO: 33482 - DNA, 20 bp, Artificial
  CRISPR gRNA sequence
tccccaagagtcctgccctt

SEQ ID NO: 33483 - DNA, 20 bp, Artificial
  CRISPR gRNA sequence
cccaagagtcctgcccttgt

SEQ ID NO: 33484 - DNA, 20 bp, Artificial
  CRISPR gRNA sequence
cccttgtctgaaagctgtag

SEQ ID NO: 33485 - DNA, 20 bp, Artificial
  CRISPR gRNA sequence
gtctgaaagctgtagctctt

SEQ ID NO: 33486 - DNA, 20 bp, Artificial
  CRISPR gRNA sequence
tctgaaagctgtagctcttc

SEQ ID NO: 33487 - DNA, 20 bp, Artificial
  CRISPR gRNA sequence
aaagctgtagctcttcttaa

SEQ ID NO: 33488 - DNA, 20 bp, Artificial
  CRISPR gRNA sequence
tagctcttcttaaggctaca

SEQ ID NO: 33489 - DNA, 20 bp, Artificial
  CRISPR gRNA sequence
ttcttaaggctacaaattag

SEQ ID NO: 33490 - DNA, 20 bp, Artificial
  CRISPR gRNA sequence
cttaaggctacaaattagct

SEQ ID NO: 33491 - DNA, 20 bp, Artificial
  CRISPR gRNA sequence
ttaaggctacaaattagctt

SEQ ID NO: 33492 - DNA, 20 bp, Artificial
  CRISPR gRNA sequence
aaggctacaaattagcttct

SEQ ID NO: 33493 - DNA, 20 bp, Artificial
  CRISPR gRNA sequence
aggctacaaattagcttctc

SEQ ID NO: 33494 - DNA, 20 bp, Artificial
  CRISPR gRNA sequence
caaattagcttctctgctta

SEQ ID NO: 33495 - DNA, 20 bp, Artificial
  CRISPR gRNA sequence
gcttctctgcttaagcctta

SEQ ID NO: 33496 - DNA, 20 bp, Artificial
  CRISPR gRNA sequence
ctctgcttaagccttagcaa

SEQ ID NO: 33497 - DNA, 20 bp, Artificial
  CRISPR gRNA sequence
tctgcttaagccttagcaaa

SEQ ID NO: 33498 - DNA, 20 bp, Artificial
  CRISPR gRNA sequence
tgcttaagccttagcaaatc

SEQ ID NO: 33499 - DNA, 20 bp, Artificial
  CRISPR gRNA sequence
cttaagccttagcaaatctt

SEQ ID NO: 33500 - DNA, 20 bp, Artificial
  CRISPR gRNA sequence
aagccttagcaaatcttcca

SEQ ID NO: 33501 - DNA, 20 bp, Artificial
  CRISPR gRNA sequence
agccttagcaaatcttccaa

SEQ ID NO: 33502 - DNA, 20 bp, Artificial
  CRISPR gRNA sequence
agcaaatcttccaaccccag

SEQ ID NO: 33503 - DNA, 20 bp, Artificial
  CRISPR gRNA sequence
gcaaatcttccaaccccaga

SEQ ID NO: 33504 - DNA, 20 bp, Artificial
  CRISPR gRNA sequence
ccaaccccagacactttctt

SEQ ID NO: 33505 - DNA, 20 bp, Artificial
  CRISPR gRNA sequence
caaccccagacactttcttt

SEQ ID NO: 33506 - DNA, 20 bp, Artificial
  CRISPR gRNA sequence
tctttttttgtggttaaaaa

SEQ ID NO: 33507 - DNA, 20 bp, Artificial
  CRISPR gRNA sequence
ctttttttgtggttaaaaat

SEQ ID NO: 33508 - DNA, 20 bp, Artificial
  CRISPR gRNA sequence
tttttttgtggttaaaaatg

SEQ ID NO: 33509 - DNA, 20 bp, Artificial
  CRISPR gRNA sequence
tttttgtggttaaaaatgga

SEQ ID NO: 33510 - DNA, 20 bp, Artificial
  CRISPR gRNA sequence
ttttgtggttaaaaatggag

SEQ ID NO: 33511 - DNA, 20 bp, Artificial
  CRISPR gRNA sequence
tttgtggttaaaaatggaga

SEQ ID NO: 33512 - DNA, 20 bp, Artificial
  CRISPR gRNA sequence
ttgtggttaaaaatggagac

SEQ ID NO: 33513 - DNA, 20 bp, Artificial
  CRISPR gRNA sequence
tgtggttaaaaatggagact

SEQ ID NO: 33514 - DNA, 20 bp, Artificial
  CRISPR gRNA sequence
gtggttaaaaatggagactt

SEQ ID NO: 33515 - DNA, 20 bp, Artificial
  CRISPR gRNA sequence
tggttaaaaatggagacttt

SEQ ID NO: 33516 - DNA, 20 bp, Artificial
  CRISPR gRNA sequence
aaaatggagactttgaaacg

SEQ ID NO: 33517 - DNA, 20 bp, Artificial
  CRISPR gRNA sequence
tgaaacgagaaagacctagg

SEQ ID NO: 33518 - DNA, 20 bp, Artificial
  CRISPR gRNA sequence
gaaacgagaaagacctaggt

SEQ ID NO: 33519 - DNA, 20 bp, Artificial
  CRISPR gRNA sequence
aaacgagaaagacctaggtt

SEQ ID NO: 33520 - DNA, 20 bp, Artificial
  CRISPR gRNA sequence
ggttagaatttcagatctgt

SEQ ID NO: 33521 - DNA, 20 bp, Artificial
  CRISPR gRNA sequence
gaatttcagatctgtacatt

SEQ ID NO: 33522 - DNA, 20 bp, Artificial
  CRISPR gRNA sequence
cagatctgtacattactatc

SEQ ID NO: 33523 - DNA, 20 bp, Artificial
  CRISPR gRNA sequence
agatctgtacattactatct

SEQ ID NO: 33524 - DNA, 20 bp, Artificial
  CRISPR gRNA sequence
tacattactatctctaatgc

SEQ ID NO: 33525 - DNA, 20 bp, Artificial
  CRISPR gRNA sequence
ctatctctaatgcaaacttg

SEQ ID NO: 33526 - DNA, 20 bp, Artificial
  CRISPR gRNA sequence
tctctaatgcaaacttgggt

SEQ ID NO: 33527 - DNA, 20 bp, Artificial
  CRISPR gRNA sequence
taatgcaaacttgggtaggt

SEQ ID NO: 33528 - DNA, 20 bp, Artificial
  CRISPR gRNA sequence
atgcaaacttgggtaggtcg

SEQ ID NO: 33529 - DNA, 20 bp, Artificial
  CRISPR gRNA sequence
gggtaggtcgtttcacctct

SEQ ID NO: 33530 - DNA, 20 bp, Artificial
  CRISPR gRNA sequence
ggtaggtcgtttcacctctc

SEQ ID NO: 33531 - DNA, 20 bp, Artificial
  CRISPR gRNA sequence
cacctctctaaacctcaatt

SEQ ID NO: 33532 - DNA, 20 bp, Artificial
  CRISPR gRNA sequence
acctctctaaacctcaattt

SEQ ID NO: 33533 - DNA, 20 bp, Artificial
  CRISPR gRNA sequence
tctaaacctcaatttcctca

SEQ ID NO: 33534 - DNA, 20 bp, Artificial
  CRISPR gRNA sequence
taaacctcaatttcctcatt

SEQ ID NO: 33535 - DNA, 20 bp, Artificial
  CRISPR gRNA sequence
aacctcaatttcctcatttg

SEQ ID NO: 33536 - DNA, 20 bp, Artificial
  CRISPR gRNA sequence
aatttcctcatttgtaaaag

SEQ ID NO: 33537 - DNA, 20 bp, Artificial
  CRISPR gRNA sequence
cctcatttgtaaaagacaga

SEQ ID NO: 33538 - DNA, 20 bp, Artificial
  CRISPR gRNA sequence
ctcatttgtaaaagacagaa

SEQ ID NO: 33539 - DNA, 20 bp, Artificial
  CRISPR gRNA sequence
atttgtaaaagacagaaact

SEQ ID NO: 33540 - DNA, 20 bp, Artificial
  CRISPR gRNA sequence
gtaaaagacagaaactaata

SEQ ID NO: 33541 - DNA, 20 bp, Artificial
  CRISPR gRNA sequence
taaaagacagaaactaataa

SEQ ID NO: 33542 - DNA, 20 bp, Artificial
  CRISPR gRNA sequence
ataatatgtatttcctttgt

SEQ ID NO: 33543 - DNA, 20 bp, Artificial
  CRISPR gRNA sequence
cctttgttgttgtaaggatt

SEQ ID NO: 33544 - DNA, 20 bp, Artificial
  CRISPR gRNA sequence
ctttgttgttgtaaggattc

SEQ ID NO: 33545 - DNA, 20 bp, Artificial
  CRISPR gRNA sequence
tgttgttgtaaggattccag

SEQ ID NO: 33546 - DNA, 20 bp, Artificial
  CRISPR gRNA sequence
gttgttgtaaggattccaga

SEQ ID NO: 33547 - DNA, 20 bp, Artificial
  CRISPR gRNA sequence
ttgttgtaaggattccagat

SEQ ID NO: 33548 - DNA, 20 bp, Artificial
  CRISPR gRNA sequence
ttgtaaggattccagatgat

SEQ ID NO: 33549 - DNA, 20 bp, Artificial
  CRISPR gRNA sequence
taaggattccagatgataat

SEQ ID NO: 33550 - DNA, 20 bp, Artificial
  CRISPR gRNA sequence
cagatgataatgtatggaca

SEQ ID NO: 33551 - DNA, 20 bp, Artificial
  CRISPR gRNA sequence
tgagtatccagtaaatgcta

SEQ ID NO: 33552 - DNA, 20 bp, Artificial
  CRISPR gRNA sequence
gttattacaaatactagagt

SEQ ID NO: 33553 - DNA, 20 bp, Artificial
  CRISPR gRNA sequence
ttacaaatactagagtagct

SEQ ID NO: 33554 - DNA, 20 bp, Artificial
  CRISPR gRNA sequence
caaatactagagtagcttgg

SEQ ID NO: 33555 - DNA, 20 bp, Artificial
  CRISPR gRNA sequence
gagtagcttggctaaggagc

SEQ ID NO: 33556 - DNA, 20 bp, Artificial
  CRISPR gRNA sequence
ggctaaggagctgggaggaa

SEQ ID NO: 33557 - DNA, 20 bp, Artificial
  CRISPR gRNA sequence
gctaaggagctgggaggaaa

SEQ ID NO: 33558 - DNA, 20 bp, Artificial
  CRISPR gRNA sequence
aggagctgggaggaaaaggg

SEQ ID NO: 33559 - DNA, 20 bp, Artificial
  CRISPR gRNA sequence
ggaggaaaagggaaaggggt

SEQ ID NO: 33560 - DNA, 20 bp, Artificial
  CRISPR gRNA sequence
tgtagaaaggatggacagaa

SEQ ID NO: 33561 - DNA, 20 bp, Artificial
  CRISPR gRNA sequence
gtagaaaggatggacagaag

SEQ ID NO: 33562 - DNA, 20 bp, Artificial
  CRISPR gRNA sequence
tagaaaggatggacagaaga

SEQ ID NO: 33563 - DNA, 20 bp, Artificial
  CRISPR gRNA sequence
tgttttcttggtggtcatta

SEQ ID NO: 33564 - DNA, 20 bp, Artificial
  CRISPR gRNA sequence
gttttcttggtggtcattag

SEQ ID NO: 33565 - DNA, 20 bp, Artificial
  CRISPR gRNA sequence
ttttcttggtggtcattagt

SEQ ID NO: 33566 - DNA, 20 bp, Artificial
  CRISPR gRNA sequence
tcttggtggtcattagtgaa

SEQ ID NO: 33567 - DNA, 20 bp, Artificial
  CRISPR gRNA sequence
cttggtggtcattagtgaag

SEQ ID NO: 33568 - DNA, 20 bp, Artificial
  CRISPR gRNA sequence
ttggtggtcattagtgaagg

SEQ ID NO: 33569 - DNA, 20 bp, Artificial
  CRISPR gRNA sequence
ggtggtcattagtgaagggg

SEQ ID NO: 33570 - DNA, 20 bp, Artificial
  CRISPR gRNA sequence
gtggtcattagtgaaggggc

SEQ ID NO: 33571 - DNA, 20 bp, Artificial
  CRISPR gRNA sequence
gtgaaggggcctatttcccc

SEQ ID NO: 33572 - DNA, 20 bp, Artificial
  CRISPR gRNA sequence
tttcccccactggcctccat

SEQ ID NO: 33573 - DNA, 20 bp, Artificial
  CRISPR gRNA sequence
cccccactggcctccatctc

SEQ ID NO: 33574 - DNA, 20 bp, Artificial
  CRISPR gRNA sequence
ccccactggcctccatctcc

SEQ ID NO: 33575 - DNA, 20 bp, Artificial
  CRISPR gRNA sequence
gcctccatctcccctctctt

SEQ ID NO: 33576 - DNA, 20 bp, Artificial
  CRISPR gRNA sequence
catctcccctctcttccctg

SEQ ID NO: 33577 - DNA, 20 bp, Artificial
  CRISPR gRNA sequence
ccctctcttccctggagtct

SEQ ID NO: 33578 - DNA, 20 bp, Artificial
  CRISPR gRNA sequence
tcttccctggagtctccgtt

SEQ ID NO: 33579 - DNA, 20 bp, Artificial
  CRISPR gRNA sequence
ttccctggagtctccgttcc

SEQ ID NO: 33580 - DNA, 20 bp, Artificial
  CRISPR gRNA sequence
ccctggagtctccgttcctc

SEQ ID NO: 33581 - DNA, 20 bp, Artificial
  CRISPR gRNA sequence
cctggagtctccgttcctcc

SEQ ID NO: 33582 - DNA, 20 bp, Artificial
  CRISPR gRNA sequence
gagtctccgttcctccagcc

SEQ ID NO: 33583 - DNA, 20 bp, Artificial
  CRISPR gRNA sequence
cgttcctccagccattgctc

SEQ ID NO: 33584 - DNA, 20 bp, Artificial
  CRISPR gRNA sequence
ctccagccattgctccgcat

SEQ ID NO: 33585 - DNA, 20 bp, Artificial
  CRISPR gRNA sequence
cagccattgctccgcatccc

SEQ ID NO: 33586 - DNA, 20 bp, Artificial
  CRISPR gRNA sequence
ctccgcatcccccttgcaat

SEQ ID NO: 33587 - DNA, 20 bp, Artificial
  CRISPR gRNA sequence
cgcatcccccttgcaatgat

SEQ ID NO: 33588 - DNA, 20 bp, Artificial
  CRISPR gRNA sequence
gcaatgatttctgtgggagg

SEQ ID NO: 33589 - DNA, 20 bp, Artificial
  CRISPR gRNA sequence
caatgatttctgtgggaggg

SEQ ID NO: 33590 - DNA, 20 bp, Artificial
  CRISPR gRNA sequence
ctgtgggaggggactgacgt

SEQ ID NO: 33591 - DNA, 20 bp, Artificial
  CRISPR gRNA sequence
tgtgggaggggactgacgtg

SEQ ID NO: 33592 - DNA, 20 bp, Artificial
  CRISPR gRNA sequence
tgggaggggactgacgtggc

SEQ ID NO: 33593 - DNA, 20 bp, Artificial
  CRISPR gRNA sequence
acgtggctcatgatgaatgg

SEQ ID NO: 33594 - DNA, 20 bp, Artificial
  CRISPR gRNA sequence
atgatgaatgggtgatattg

SEQ ID NO: 33595 - DNA, 20 bp, Artificial
  CRISPR gRNA sequence
acaagtggcagcaaagaact

SEQ ID NO: 33596 - DNA, 20 bp, Artificial
  CRISPR gRNA sequence
ttgcccttgattgtcctttt

SEQ ID NO: 33597 - DNA, 20 bp, Artificial
  CRISPR gRNA sequence
gcccttgattgtccttttct

SEQ ID NO: 33598 - DNA, 20 bp, Artificial
  CRISPR gRNA sequence
cccttgattgtccttttctg

SEQ ID NO: 33599 - DNA, 20 bp, Artificial
  CRISPR gRNA sequence
gattgtccttttctgggctc

SEQ ID NO: 33600 - DNA, 20 bp, Artificial
  CRISPR gRNA sequence
attgtccttttctgggctca

SEQ ID NO: 33601 - DNA, 20 bp, Artificial
  CRISPR gRNA sequence
tccttttctgggctcaggtg

SEQ ID NO: 33602 - DNA, 20 bp, Artificial
  CRISPR gRNA sequence
ttctgggctcaggtgcttcc

SEQ ID NO: 33603 - DNA, 20 bp, Artificial
  CRISPR gRNA sequence
tctgggctcaggtgcttcct

SEQ ID NO: 33604 - DNA, 20 bp, Artificial
  CRISPR gRNA sequence
ctgggctcaggtgcttcctc

SEQ ID NO: 33605 - DNA, 20 bp, Artificial
  CRISPR gRNA sequence
tgggctcaggtgcttcctca

SEQ ID NO: 33606 - DNA, 20 bp, Artificial
  CRISPR gRNA sequence
ggctcaggtgcttcctcacc

SEQ ID NO: 33607 - DNA, 20 bp, Artificial
  CRISPR gRNA sequence
aggtgcttcctcaccgatat

SEQ ID NO: 33608 - DNA, 20 bp, Artificial
  CRISPR gRNA sequence
cctcaccgatattggcataa

SEQ ID NO: 33609 - DNA, 20 bp, Artificial
  CRISPR gRNA sequence
ctcaccgatattggcataag

SEQ ID NO: 33610 - DNA, 20 bp, Artificial
  CRISPR gRNA sequence
accgatattggcataagcct

SEQ ID NO: 33611 - DNA, 20 bp, Artificial
  CRISPR gRNA sequence
gcataagcctccctggtctc

SEQ ID NO: 33612 - DNA, 20 bp, Artificial
  CRISPR gRNA sequence
cctggtctcttcatcacctt

SEQ ID NO: 33613 - DNA, 20 bp, Artificial
  CRISPR gRNA sequence
gtctcttcatcaccttccat

SEQ ID NO: 33614 - DNA, 20 bp, Artificial
  CRISPR gRNA sequence
ttcatcaccttccatgtcac

SEQ ID NO: 33615 - DNA, 20 bp, Artificial
  CRISPR gRNA sequence
catcaccttccatgtcacac

SEQ ID NO: 33616 - DNA, 20 bp, Artificial
  CRISPR gRNA sequence
atcaccttccatgtcacaca

SEQ ID NO: 33617 - DNA, 20 bp, Artificial
  CRISPR gRNA sequence
ccatgtcacacaacagcctg

SEQ ID NO: 33618 - DNA, 20 bp, Artificial
  CRISPR gRNA sequence
catgtcacacaacagcctgc

SEQ ID NO: 33619 - DNA, 20 bp, Artificial
  CRISPR gRNA sequence
ctgaactggtcgcagttgat

SEQ ID NO: 33620 - DNA, 20 bp, Artificial
  CRISPR gRNA sequence
aactggtcgcagttgatggt

SEQ ID NO: 33621 - DNA, 20 bp, Artificial
  CRISPR gRNA sequence
gtcgcagttgatggtgtctg

SEQ ID NO: 33622 - DNA, 20 bp, Artificial
  CRISPR gRNA sequence
atggtgtctgtgtcgggttc

SEQ ID NO: 33623 - DNA, 20 bp, Artificial
  CRISPR gRNA sequence
tgtcgggttctgggaggaaa

SEQ ID NO: 33624 - DNA, 20 bp, Artificial
  CRISPR gRNA sequence
tgggaggaaaagtcccttgg

SEQ ID NO: 33625 - DNA, 20 bp, Artificial
  CRISPR gRNA sequence
ggaggaaaagtcccttggat

SEQ ID NO: 33626 - DNA, 20 bp, Artificial
  CRISPR gRNA sequence
ggatgaagaaggaaatttct

SEQ ID NO: 33627 - DNA, 20 bp, Artificial
  CRISPR gRNA sequence
gatgaagaaggaaatttctg

SEQ ID NO: 33628 - DNA, 20 bp, Artificial
  CRISPR gRNA sequence
ctggaaagagggctggtggg

SEQ ID NO: 33629 - DNA, 20 bp, Artificial
  CRISPR gRNA sequence
tggaaagagggctggtgggg

SEQ ID NO: 33630 - DNA, 20 bp, Artificial
  CRISPR gRNA sequence
gaaagagggctggtggggaa

SEQ ID NO: 33631 - DNA, 20 bp, Artificial
  CRISPR gRNA sequence
gtggggaacgagggagaggc

SEQ ID NO: 33632 - DNA, 20 bp, Artificial
  CRISPR gRNA sequence
ggagatcatccccatctgca

SEQ ID NO: 33633 - DNA, 20 bp, Artificial
  CRISPR gRNA sequence
cagagagcgtcccacagacg

SEQ ID NO: 33634 - DNA, 20 bp, Artificial
  CRISPR gRNA sequence
tccgtggtgctgacgggagg

SEQ ID NO: 33635 - DNA, 20 bp, Artificial
  CRISPR gRNA sequence
acgggagggcagggaccaga

SEQ ID NO: 33636 - DNA, 20 bp, Artificial
  CRISPR gRNA sequence
cccctgattgccgtctctac

SEQ ID NO: 33637 - DNA, 20 bp, Artificial
  CRISPR gRNA sequence
ccctgattgccgtctctaca

SEQ ID NO: 33638 - DNA, 20 bp, Artificial
  CRISPR gRNA sequence
attgccgtctctacagcaag

SEQ ID NO: 33639 - DNA, 20 bp, Artificial
  CRISPR gRNA sequence
ccgtctctacagcaagctga

SEQ ID NO: 33640 - DNA, 20 bp, Artificial
  CRISPR gRNA sequence
tacagcaagctgaggggtgg

SEQ ID NO: 33641 - DNA, 20 bp, Artificial
  CRISPR gRNA sequence
cagcaagctgaggggtgggg

SEQ ID NO: 33642 - DNA, 20 bp, Artificial
  CRISPR gRNA sequence
aggggtgggggataccggaa

SEQ ID NO: 33643 - DNA, 20 bp, Artificial
  CRISPR gRNA sequence
agtagagctcaatctcttct

SEQ ID NO: 33644 - DNA, 20 bp, Artificial
  CRISPR gRNA sequence
aatctcttcttctccagcca

SEQ ID NO: 33645 - DNA, 20 bp, Artificial
  CRISPR gRNA sequence
ttcttctccagccaggtcca

SEQ ID NO: 33646 - DNA, 20 bp, Artificial
  CRISPR gRNA sequence
cttctccagccaggtccatc

SEQ ID NO: 33647 - DNA, 20 bp, Artificial
  CRISPR gRNA sequence
ttctccagccaggtccatct

SEQ ID NO: 33648 - DNA, 20 bp, Artificial
  CRISPR gRNA sequence
ctccagccaggtccatctgg

SEQ ID NO: 33649 - DNA, 20 bp, Artificial
  CRISPR gRNA sequence
tccagccaggtccatctggt

SEQ ID NO: 33650 - DNA, 20 bp, Artificial
  CRISPR gRNA sequence
cagccaggtccatctggtca

SEQ ID NO: 33651 - DNA, 20 bp, Artificial
  CRISPR gRNA sequence
gtcatagaagtggtagaggc

SEQ ID NO: 33652 - DNA, 20 bp, Artificial
  CRISPR gRNA sequence
ttaagaagctccaggtagcc

SEQ ID NO: 33653 - DNA, 20 bp, Artificial
  CRISPR gRNA sequence
agaagctccaggtagccacc

SEQ ID NO: 33654 - DNA, 20 bp, Artificial
  CRISPR gRNA sequence
caggtagccaccttctaggg

SEQ ID NO: 33655 - DNA, 20 bp, Artificial
  CRISPR gRNA sequence
ctaggggccccaactccatg

SEQ ID NO: 33656 - DNA, 20 bp, Artificial
  CRISPR gRNA sequence
taggggccccaactccatgg

SEQ ID NO: 33657 - DNA, 20 bp, Artificial
  CRISPR gRNA sequence
ggggccccaactccatggtg

SEQ ID NO: 33658 - DNA, 20 bp, Artificial
  CRISPR gRNA sequence
catggtggcacactgtgagc

SEQ ID NO: 33659 - DNA, 20 bp, Artificial
  CRISPR gRNA sequence
tgagctgcctgggagggaag

SEQ ID NO: 33660 - DNA, 20 bp, Artificial
  CRISPR gRNA sequence
cctgggagggaagacaatgc

SEQ ID NO: 33661 - DNA, 20 bp, Artificial
  CRISPR gRNA sequence
ggagggaagacaatgctcag

SEQ ID NO: 33662 - DNA, 20 bp, Artificial
  CRISPR gRNA sequence
agtcacctcacagggtgttg

SEQ ID NO: 33663 - DNA, 20 bp, Artificial
  CRISPR gRNA sequence
acagggtgttggaaagaggc

SEQ ID NO: 33664 - DNA, 20 bp, Artificial
  CRISPR gRNA sequence
gaaagaggcagaaaattgac

SEQ ID NO: 33665 - DNA, 20 bp, Artificial
  CRISPR gRNA sequence
acacctacaacaactcccag

SEQ ID NO: 33666 - DNA, 20 bp, Artificial
  CRISPR gRNA sequence
caacaactcccagctggtga

SEQ ID NO: 33667 - DNA, 20 bp, Artificial
  CRISPR gRNA sequence
ccagctggtgagggctgggg

SEQ ID NO: 33668 - DNA, 20 bp, Artificial
  CRISPR gRNA sequence
gtgagggctggggatgagag

SEQ ID NO: 33669 - DNA, 20 bp, Artificial
  CRISPR gRNA sequence
gggatgagaggagtgaataa

SEQ ID NO: 33670 - DNA, 20 bp, Artificial
  CRISPR gRNA sequence
attcagcacctcttatatgc

SEQ ID NO: 33671 - DNA, 20 bp, Artificial
  CRISPR gRNA sequence
agcacctcttatatgctcag

SEQ ID NO: 33672 - DNA, 20 bp, Artificial
  CRISPR gRNA sequence
ttatatgctcagcgtggtgg

SEQ ID NO: 33673 - DNA, 20 bp, Artificial
  CRISPR gRNA sequence
atatgctcagcgtggtggag

SEQ ID NO: 33674 - DNA, 20 bp, Artificial
  CRISPR gRNA sequence
tatgctcagcgtggtggaga

SEQ ID NO: 33675 - DNA, 20 bp, Artificial
  CRISPR gRNA sequence
agcgtggtggagagagcaag

SEQ ID NO: 33676 - DNA, 20 bp, Artificial
  CRISPR gRNA sequence
ccttcctccaaggaacttac

SEQ ID NO: 33677 - DNA, 20 bp, Artificial
  CRISPR gRNA sequence
cctccaaggaacttacaacc

SEQ ID NO: 33678 - DNA, 20 bp, Artificial
  CRISPR gRNA sequence
ctccaaggaacttacaacca

SEQ ID NO: 33679 - DNA, 20 bp, Artificial
  CRISPR gRNA sequence
caaggaacttacaaccatat

SEQ ID NO: 33680 - DNA, 20 bp, Artificial
  CRISPR gRNA sequence
acaaccatatgagaagatac

SEQ ID NO: 33681 - DNA, 20 bp, Artificial
  CRISPR gRNA sequence
caaccatatgagaagatacc

SEQ ID NO: 33682 - DNA, 20 bp, Artificial
  CRISPR gRNA sequence
gaaagtgtggattccatcaa

SEQ ID NO: 33683 - DNA, 20 bp, Artificial
  CRISPR gRNA sequence
catcaatctcacaccagaga

SEQ ID NO: 33684 - DNA, 20 bp, Artificial
  CRISPR gRNA sequence
acaccagagagtcaggagac

SEQ ID NO: 33685 - DNA, 20 bp, Artificial
  CRISPR gRNA sequence
ggcaatgccatgagtggtaa

SEQ ID NO: 33686 - DNA, 20 bp, Artificial
  CRISPR gRNA sequence
gcaatgccatgagtggtaac

SEQ ID NO: 33687 - DNA, 20 bp, Artificial
  CRISPR gRNA sequence
aggtttataaagcacctcct

SEQ ID NO: 33688 - DNA, 20 bp, Artificial
  CRISPR gRNA sequence
ataaagcacctcctatacgc

SEQ ID NO: 33689 - DNA, 20 bp, Artificial
  CRISPR gRNA sequence
taaagcacctcctatacgcc

SEQ ID NO: 33690 - DNA, 20 bp, Artificial
  CRISPR gRNA sequence
ctatacgccaggcacatgag

SEQ ID NO: 33691 - DNA, 20 bp, Artificial
  CRISPR gRNA sequence
tacgccaggcacatgagctg

SEQ ID NO: 33692 - DNA, 20 bp, Artificial
  CRISPR gRNA sequence
gcacatttaatactcatatc

SEQ ID NO: 33693 - DNA, 20 bp, Artificial
  CRISPR gRNA sequence
aatactcatatcagtaacca

SEQ ID NO: 33694 - DNA, 20 bp, Artificial
  CRISPR gRNA sequence
atactcatatcagtaaccat

SEQ ID NO: 33695 - DNA, 20 bp, Artificial
  CRISPR gRNA sequence
atatcagtaaccatgtaagg

SEQ ID NO: 33696 - DNA, 20 bp, Artificial
  CRISPR gRNA sequence
ttattatcctcactttgcat

SEQ ID NO: 33697 - DNA, 20 bp, Artificial
  CRISPR gRNA sequence
ttatcctcactttgcatatg

SEQ ID NO: 33698 - DNA, 20 bp, Artificial
  CRISPR gRNA sequence
tcctcactttgcatatgaga

SEQ ID NO: 33699 - DNA, 20 bp, Artificial
  CRISPR gRNA sequence
actttgcatatgagaaaact

SEQ ID NO: 33700 - DNA, 20 bp, Artificial
  CRISPR gRNA sequence
tgcatatgagaaaactgagg

SEQ ID NO: 33701 - DNA, 20 bp, Artificial
  CRISPR gRNA sequence
gcatatgagaaaactgaggc

SEQ ID NO: 33702 - DNA, 20 bp, Artificial
  CRISPR gRNA sequence
catatgagaaaactgaggct

SEQ ID NO: 33703 - DNA, 20 bp, Artificial
  CRISPR gRNA sequence
aggctcagagaggtgaagtg

SEQ ID NO: 33704 - DNA, 20 bp, Artificial
  CRISPR gRNA sequence
agagaggtgaagtgatttat

SEQ ID NO: 33705 - DNA, 20 bp, Artificial
  CRISPR gRNA sequence
atgtaaggaaacccatgtcc

SEQ ID NO: 33706 - DNA, 20 bp, Artificial
  CRISPR gRNA sequence
tgtaaggaaacccatgtcca

SEQ ID NO: 33707 - DNA, 20 bp, Artificial
  CRISPR gRNA sequence
gaacccagacagtctgactg

SEQ ID NO: 33708 - DNA, 20 bp, Artificial
  CRISPR gRNA sequence
aacccagacagtctgactga

SEQ ID NO: 33709 - DNA, 20 bp, Artificial
  CRISPR gRNA sequence
actgaagtcctgcatttaac

SEQ ID NO: 33710 - DNA, 20 bp, Artificial
  CRISPR gRNA sequence
aagtcctgcatttaaccaca

SEQ ID NO: 33711 - DNA, 20 bp, Artificial
  CRISPR gRNA sequence
catttaaccacaatgctcta

SEQ ID NO: 33712 - DNA, 20 bp, Artificial
  CRISPR gRNA sequence
aaccacaatgctctactgct

SEQ ID NO: 33713 - DNA, 20 bp, Artificial
  CRISPR gRNA sequence
accacaatgctctactgctt

SEQ ID NO: 33714 - DNA, 20 bp, Artificial
  CRISPR gRNA sequence
tactgctttgggtggacttg

SEQ ID NO: 33715 - DNA, 20 bp, Artificial
  CRISPR gRNA sequence
ctgctttgggtggacttgag

SEQ ID NO: 33716 - DNA, 20 bp, Artificial
  CRISPR gRNA sequence
ctttgggtggacttgagcaa

SEQ ID NO: 33717 - DNA, 20 bp, Artificial
  CRISPR gRNA sequence
tgggtggacttgagcaagtc

SEQ ID NO: 33718 - DNA, 20 bp, Artificial
  CRISPR gRNA sequence
gggtggacttgagcaagtct

SEQ ID NO: 33719 - DNA, 20 bp, Artificial
  CRISPR gRNA sequence
ggtggacttgagcaagtctc

SEQ ID NO: 33720 - DNA, 20 bp, Artificial
  CRISPR gRNA sequence
gagcaagtctctgctccttt

SEQ ID NO: 33721 - DNA, 20 bp, Artificial
  CRISPR gRNA sequence
agcaagtctctgctcctttc

SEQ ID NO: 33722 - DNA, 20 bp, Artificial
  CRISPR gRNA sequence
tgctcctttctgtgcctcag

SEQ ID NO: 33723 - DNA, 20 bp, Artificial
  CRISPR gRNA sequence
ctcctttctgtgcctcagtt

SEQ ID NO: 33724 - DNA, 20 bp, Artificial
  CRISPR gRNA sequence
ctttctgtgcctcagtttcc

SEQ ID NO: 33725 - DNA, 20 bp, Artificial
  CRISPR gRNA sequence
tctgtgcctcagtttcctaa

SEQ ID NO: 33726 - DNA, 20 bp, Artificial
  CRISPR gRNA sequence
ctgtgcctcagtttcctaat

SEQ ID NO: 33727 - DNA, 20 bp, Artificial
  CRISPR gRNA sequence
tgtgcctcagtttcctaata

SEQ ID NO: 33728 - DNA, 20 bp, Artificial
  CRISPR gRNA sequence
tgcctcagtttcctaatatg

SEQ ID NO: 33729 - DNA, 20 bp, Artificial
  CRISPR gRNA sequence
agtttcctaatatgtaaact

SEQ ID NO: 33730 - DNA, 20 bp, Artificial
  CRISPR gRNA sequence
cctaatatgtaaactgaagg

SEQ ID NO: 33731 - DNA, 20 bp, Artificial
  CRISPR gRNA sequence
ctaatatgtaaactgaagga

SEQ ID NO: 33732 - DNA, 20 bp, Artificial
  CRISPR gRNA sequence
atatgtaaactgaaggagtc

SEQ ID NO: 33733 - DNA, 20 bp, Artificial
  CRISPR gRNA sequence
aaggagtctgagcagattct

SEQ ID NO: 33734 - DNA, 20 bp, Artificial
  CRISPR gRNA sequence
agcagattctaagatttcct

SEQ ID NO: 33735 - DNA, 20 bp, Artificial
  CRISPR gRNA sequence
taagatttcctcatcatttg

SEQ ID NO: 33736 - DNA, 20 bp, Artificial
  CRISPR gRNA sequence
agatttcctcatcatttgtt

SEQ ID NO: 33737 - DNA, 20 bp, Artificial
  CRISPR gRNA sequence
cctcatcatttgttgaaggg

SEQ ID NO: 33738 - DNA, 20 bp, Artificial
  CRISPR gRNA sequence
ctcatcatttgttgaagggc

SEQ ID NO: 33739 - DNA, 20 bp, Artificial
  CRISPR gRNA sequence
atcatttgttgaagggcata

SEQ ID NO: 33740 - DNA, 20 bp, Artificial
  CRISPR gRNA sequence
gttgaagggcatattaaata

SEQ ID NO: 33741 - DNA, 20 bp, Artificial
  CRISPR gRNA sequence
ttgaagggcatattaaatac

SEQ ID NO: 33742 - DNA, 20 bp, Artificial
  CRISPR gRNA sequence
aagggcatattaaatacttt

SEQ ID NO: 33743 - DNA, 20 bp, Artificial
  CRISPR gRNA sequence
aatacttttaacactatttc

SEQ ID NO: 33744 - DNA, 20 bp, Artificial
  CRISPR gRNA sequence
ttaacactatttcatttaat

SEQ ID NO: 33745 - DNA, 20 bp, Artificial
  CRISPR gRNA sequence
taacactatttcatttaatc

SEQ ID NO: 33746 - DNA, 20 bp, Artificial
  CRISPR gRNA sequence
aacactatttcatttaatct

SEQ ID NO: 33747 - DNA, 20 bp, Artificial
  CRISPR gRNA sequence
acactatttcatttaatctt

SEQ ID NO: 33748 - DNA, 20 bp, Artificial
  CRISPR gRNA sequence
tttcatttaatctttaaaca

SEQ ID NO: 33749 - DNA, 20 bp, Artificial
  CRISPR gRNA sequence
catttaatctttaaacaatc

SEQ ID NO: 33750 - DNA, 20 bp, Artificial
  CRISPR gRNA sequence
atttaatctttaaacaatcc

SEQ ID NO: 33751 - DNA, 20 bp, Artificial
  CRISPR gRNA sequence
aatctttaaacaatcccaaa

SEQ ID NO: 33752 - DNA, 20 bp, Artificial
  CRISPR gRNA sequence
atctttaaacaatcccaaat

SEQ ID NO: 33753 - DNA, 20 bp, Artificial
  CRISPR gRNA sequence
taaacaatcccaaatgtgga

SEQ ID NO: 33754 - DNA, 20 bp, Artificial
  CRISPR gRNA sequence
aaacaatcccaaatgtggat

SEQ ID NO: 33755 - DNA, 20 bp, Artificial
  CRISPR gRNA sequence
aacaatcccaaatgtggata

SEQ ID NO: 33756 - DNA, 20 bp, Artificial
  CRISPR gRNA sequence
aaatatcctgacatgatcat

SEQ ID NO: 33757 - DNA, 20 bp, Artificial
  CRISPR gRNA sequence
acatgatcattataccttct

SEQ ID NO: 33758 - DNA, 20 bp, Artificial
  CRISPR gRNA sequence
taccttctatgcatgtaata

SEQ ID NO: 33759 - DNA, 20 bp, Artificial
  CRISPR gRNA sequence
ctatgcatgtaataaatatt

SEQ ID NO: 33760 - DNA, 20 bp, Artificial
  CRISPR gRNA sequence
tatgcatgtaataaatattc

SEQ ID NO: 33761 - DNA, 20 bp, Artificial
  CRISPR gRNA sequence
tgcatgtaataaatattcac

SEQ ID NO: 33762 - DNA, 20 bp, Artificial
  CRISPR gRNA sequence
acatataccccataaatatg

SEQ ID NO: 33763 - DNA, 20 bp, Artificial
  CRISPR gRNA sequence
tgtattaataaaacaaaaga

SEQ ID NO: 33764 - DNA, 20 bp, Artificial
  CRISPR gRNA sequence
ataaaacaaaagaaaacaag

SEQ ID NO: 33765 - DNA, 20 bp, Artificial
  CRISPR gRNA sequence
tacacgaatgttcacagaag

SEQ ID NO: 33766 - DNA, 20 bp, Artificial
  CRISPR gRNA sequence
acagaaggataattcaaaat

SEQ ID NO: 33767 - DNA, 20 bp, Artificial
  CRISPR gRNA sequence
aaaatagccaaaatataaaa

SEQ ID NO: 33768 - DNA, 20 bp, Artificial
  CRISPR gRNA sequence
cttatctatacaataaagta

SEQ ID NO: 33769 - DNA, 20 bp, Artificial
  CRISPR gRNA sequence
atctatacaataaagtattc

SEQ ID NO: 33770 - DNA, 20 bp, Artificial
  CRISPR gRNA sequence
tctatacaataaagtattcc

SEQ ID NO: 33771 - DNA, 20 bp, Artificial
  CRISPR gRNA sequence
tacaataaagtattccacca

SEQ ID NO: 33772 - DNA, 20 bp, Artificial
  CRISPR gRNA sequence
caccattaaagggagaaagc

SEQ ID NO: 33773 - DNA, 20 bp, Artificial
  CRISPR gRNA sequence
aagggagaaagcactgatac

SEQ ID NO: 33774 - DNA, 20 bp, Artificial
  CRISPR gRNA sequence
atacatgctggaacatggat

SEQ ID NO: 33775 - DNA, 20 bp, Artificial
  CRISPR gRNA sequence
gaacatggatgaaccttaaa

SEQ ID NO: 33776 - DNA, 20 bp, Artificial
  CRISPR gRNA sequence
aaaaaaaatgctaagtgaag

SEQ ID NO: 33777 - DNA, 20 bp, Artificial
  CRISPR gRNA sequence
aaaaaaatgctaagtgaaga

SEQ ID NO: 33778 - DNA, 20 bp, Artificial
  CRISPR gRNA sequence
agtgaagaagccggacacaa

SEQ ID NO: 33779 - DNA, 20 bp, Artificial
  CRISPR gRNA sequence
tatgattctatttatttgaa

SEQ ID NO: 33780 - DNA, 20 bp, Artificial
  CRISPR gRNA sequence
tatttatttgaaatgaccaa

SEQ ID NO: 33781 - DNA, 20 bp, Artificial
  CRISPR gRNA sequence
tttatttgaaatgaccaaaa

SEQ ID NO: 33782 - DNA, 20 bp, Artificial
  CRISPR gRNA sequence
atttgaaatgaccaaaacag

SEQ ID NO: 33783 - DNA, 20 bp, Artificial
  CRISPR gRNA sequence
tttgaaatgaccaaaacagg

SEQ ID NO: 33784 - DNA, 20 bp, Artificial
  CRISPR gRNA sequence
gaaatgaccaaaacaggcaa

SEQ ID NO: 33785 - DNA, 20 bp, Artificial
  CRISPR gRNA sequence
aaatgaccaaaacaggcaaa

SEQ ID NO: 33786 - DNA, 20 bp, Artificial
  CRISPR gRNA sequence
atgcctgaaatcccagcact

SEQ ID NO: 33787 - DNA, 20 bp, Artificial
  CRISPR gRNA sequence
aaatcccagcactttgggag

SEQ ID NO: 33788 - DNA, 20 bp, Artificial
  CRISPR gRNA sequence
tgggaggctgagacaggaga

SEQ ID NO: 33789 - DNA, 20 bp, Artificial
  CRISPR gRNA sequence
gggaggctgagacaggagaa

SEQ ID NO: 33790 - DNA, 20 bp, Artificial
  CRISPR gRNA sequence
ggaggctgagacaggagaat

SEQ ID NO: 33791 - DNA, 20 bp, Artificial
  CRISPR gRNA sequence
agacaggagaatcgcttgag

SEQ ID NO: 33792 - DNA, 20 bp, Artificial
  CRISPR gRNA sequence
gagcccaggtgttcaagacc

SEQ ID NO: 33793 - DNA, 20 bp, Artificial
  CRISPR gRNA sequence
agcccaggtgttcaagacca

SEQ ID NO: 33794 - DNA, 20 bp, Artificial
  CRISPR gRNA sequence
aagaccagcctgggcaacat

SEQ ID NO: 33795 - DNA, 20 bp, Artificial
  CRISPR gRNA sequence
ggcaacatagcaaaagccta

SEQ ID NO: 33796 - DNA, 20 bp, Artificial
  CRISPR gRNA sequence
tctctattaattttttttta

SEQ ID NO: 33797 - DNA, 20 bp, Artificial
  CRISPR gRNA sequence
tattaatttttttttaagaa

SEQ ID NO: 33798 - DNA, 20 bp, Artificial
  CRISPR gRNA sequence
ttaatttttttttaagaaag

SEQ ID NO: 33799 - DNA, 20 bp, Artificial
  CRISPR gRNA sequence
atttttttttaagaaagaaa

SEQ ID NO: 33800 - DNA, 20 bp, Artificial
  CRISPR gRNA sequence
ttttttaagaaagaaagcat

SEQ ID NO: 33801 - DNA, 20 bp, Artificial
  CRISPR gRNA sequence
tttttaagaaagaaagcata

SEQ ID NO: 33802 - DNA, 20 bp, Artificial
  CRISPR gRNA sequence
ttttaagaaagaaagcatat

SEQ ID NO: 33803 - DNA, 20 bp, Artificial
  CRISPR gRNA sequence
tttaagaaagaaagcatatt

SEQ ID NO: 33804 - DNA, 20 bp, Artificial
  CRISPR gRNA sequence
ttaagaaagaaagcatatta

SEQ ID NO: 33805 - DNA, 20 bp, Artificial
  CRISPR gRNA sequence
taagaaagaaagcatattag

SEQ ID NO: 33806 - DNA, 20 bp, Artificial
  CRISPR gRNA sequence
aagaaagaaagcatattagt

SEQ ID NO: 33807 - DNA, 20 bp, Artificial
  CRISPR gRNA sequence
agaaagaaagcatattagtg

SEQ ID NO: 33808 - DNA, 20 bp, Artificial
  CRISPR gRNA sequence
gtggttgcctagggcttggc

SEQ ID NO: 33809 - DNA, 20 bp, Artificial
  CRISPR gRNA sequence
cctagggcttggcagagagg

SEQ ID NO: 33810 - DNA, 20 bp, Artificial
  CRISPR gRNA sequence
gggcttggcagagagggatt

SEQ ID NO: 33811 - DNA, 20 bp, Artificial
  CRISPR gRNA sequence
ggcagagagggattttggaa

SEQ ID NO: 33812 - DNA, 20 bp, Artificial
  CRISPR gRNA sequence
gcagagagggattttggaag

SEQ ID NO: 33813 - DNA, 20 bp, Artificial
  CRISPR gRNA sequence
tggaaggaaatggggaacaa

SEQ ID NO: 33814 - DNA, 20 bp, Artificial
  CRISPR gRNA sequence
ggaaggaaatggggaacaac

SEQ ID NO: 33815 - DNA, 20 bp, Artificial
  CRISPR gRNA sequence
gaaggaaatggggaacaact

SEQ ID NO: 33816 - DNA, 20 bp, Artificial
  CRISPR gRNA sequence
ctgatgggtctggagtttct

SEQ ID NO: 33817 - DNA, 20 bp, Artificial
  CRISPR gRNA sequence
atgggtctggagtttcttta

SEQ ID NO: 33818 - DNA, 20 bp, Artificial
  CRISPR gRNA sequence
gagtttctttagggggtgat

SEQ ID NO: 33819 - DNA, 20 bp, Artificial
  CRISPR gRNA sequence
ctttagggggtgatgaaatg

SEQ ID NO: 33820 - DNA, 20 bp, Artificial
  CRISPR gRNA sequence
tttagggggtgatgaaatgt

SEQ ID NO: 33821 - DNA, 20 bp, Artificial
  CRISPR gRNA sequence
tagggggtgatgaaatgtgc

SEQ ID NO: 33822 - DNA, 20 bp, Artificial
  CRISPR gRNA sequence
agggggtgatgaaatgtgct

SEQ ID NO: 33823 - DNA, 20 bp, Artificial
  CRISPR gRNA sequence
gggggtgatgaaatgtgcta

SEQ ID NO: 33824 - DNA, 20 bp, Artificial
  CRISPR gRNA sequence
aaattgactgtggggatggg

SEQ ID NO: 33825 - DNA, 20 bp, Artificial
  CRISPR gRNA sequence
actgtggggatgggagatgg

SEQ ID NO: 33826 - DNA, 20 bp, Artificial
  CRISPR gRNA sequence
tggggatgggagatggtcac

SEQ ID NO: 33827 - DNA, 20 bp, Artificial
  CRISPR gRNA sequence
tctgagtattcccaaaagaa

SEQ ID NO: 33828 - DNA, 20 bp, Artificial
  CRISPR gRNA sequence
tgagtattcccaaaagaaca

SEQ ID NO: 33829 - DNA, 20 bp, Artificial
  CRISPR gRNA sequence
agtattcccaaaagaacact

SEQ ID NO: 33830 - DNA, 20 bp, Artificial
  CRISPR gRNA sequence
ccaaaagaacactgaactct

SEQ ID NO: 33831 - DNA, 20 bp, Artificial
  CRISPR gRNA sequence
aactctactttttttttttt

SEQ ID NO: 33832 - DNA, 20 bp, Artificial
  CRISPR gRNA sequence
tacttttttttttttttttt

SEQ ID NO: 33833 - DNA, 20 bp, Artificial
  CRISPR gRNA sequence
cttttttttttttttttttt

SEQ ID NO: 33834 - DNA, 20 bp, Artificial
  CRISPR gRNA sequence
tttttttttttttttttttt

SEQ ID NO: 33835 - DNA, 20 bp, Artificial
  CRISPR gRNA sequence
tttttttttttttttttttt

SEQ ID NO: 33836 - DNA, 20 bp, Artificial
  CRISPR gRNA sequence
tttttttttttttttttttt

SEQ ID NO: 33837 - DNA, 20 bp, Artificial
  CRISPR gRNA sequence
tttttttttttttttttttt

SEQ ID NO: 33838 - DNA, 20 bp, Artificial
  CRISPR gRNA sequence
tttttttttttttttttttt

SEQ ID NO: 33839 - DNA, 20 bp, Artificial
  CRISPR gRNA sequence
tttttttttttttttttttt

SEQ ID NO: 33840 - DNA, 20 bp, Artificial
  CRISPR gRNA sequence
tttttttttttttttttttt

SEQ ID NO: 33841 - DNA, 20 bp, Artificial
  CRISPR gRNA sequence
tttttttttttttttttttt

SEQ ID NO: 33842 - DNA, 20 bp, Artificial
  CRISPR gRNA sequence
tttttttttttttttttttt

SEQ ID NO: 33843 - DNA, 20 bp, Artificial
  CRISPR gRNA sequence
ttttttttttttttttttta

SEQ ID NO: 33844 - DNA, 20 bp, Artificial
  CRISPR gRNA sequence
ttttttttttttttttttaa

SEQ ID NO: 33845 - DNA, 20 bp, Artificial
  CRISPR gRNA sequence
tttttttttttttttttaag

SEQ ID NO: 33846 - DNA, 20 bp, Artificial
  CRISPR gRNA sequence
ttttttttttttttttaaga

SEQ ID NO: 33847 - DNA, 20 bp, Artificial
  CRISPR gRNA sequence
tttttttttttttttaagac

SEQ ID NO: 33848 - DNA, 20 bp, Artificial
  CRISPR gRNA sequence
ttttttttttttttaagacg

SEQ ID NO: 33849 - DNA, 20 bp, Artificial
  CRISPR gRNA sequence
tttttttttttttaagacgg

SEQ ID NO: 33850 - DNA, 20 bp, Artificial
  CRISPR gRNA sequence
ttttttttttttaagacgga

SEQ ID NO: 33851 - DNA, 20 bp, Artificial
  CRISPR gRNA sequence
tttttttttttaagacggag

SEQ ID NO: 33852 - DNA, 20 bp, Artificial
  CRISPR gRNA sequence
ttttttttttaagacggagt

SEQ ID NO: 33853 - DNA, 20 bp, Artificial
  CRISPR gRNA sequence
tttttttttaagacggagtc

SEQ ID NO: 33854 - DNA, 20 bp, Artificial
  CRISPR gRNA sequence
ttttttttaagacggagtct

SEQ ID NO: 33855 - DNA, 20 bp, Artificial
  CRISPR gRNA sequence
tttttttaagacggagtctc

SEQ ID NO: 33856 - DNA, 20 bp, Artificial
  CRISPR gRNA sequence
ttttttaagacggagtctct

SEQ ID NO: 33857 - DNA, 20 bp, Artificial
  CRISPR gRNA sequence
tttttaagacggagtctctg

SEQ ID NO: 33858 - DNA, 20 bp, Artificial
  CRISPR gRNA sequence
ttttaagacggagtctctgt

SEQ ID NO: 33859 - DNA, 20 bp, Artificial
  CRISPR gRNA sequence
tttaagacggagtctctgtc

SEQ ID NO: 33860 - DNA, 20 bp, Artificial
  CRISPR gRNA sequence
ttaagacggagtctctgtca

SEQ ID NO: 33861 - DNA, 20 bp, Artificial
  CRISPR gRNA sequence
taagacggagtctctgtcac

SEQ ID NO: 33862 - DNA, 20 bp, Artificial
  CRISPR gRNA sequence
aagacggagtctctgtcacc

SEQ ID NO: 33863 - DNA, 20 bp, Artificial
  CRISPR gRNA sequence
agacggagtctctgtcaccc

SEQ ID NO: 33864 - DNA, 20 bp, Artificial
  CRISPR gRNA sequence
tgtcacccaggctggagtgc

SEQ ID NO: 33865 - DNA, 20 bp, Artificial
  CRISPR gRNA sequence
tcacccaggctggagtgcag

SEQ ID NO: 33866 - DNA, 20 bp, Artificial
  CRISPR gRNA sequence
gagtgcaggggtgcaatctt

SEQ ID NO: 33867 - DNA, 20 bp, Artificial
  CRISPR gRNA sequence
ggctcactgcaacgtctgcc

SEQ ID NO: 33868 - DNA, 20 bp, Artificial
  CRISPR gRNA sequence
gctcactgcaacgtctgcct

SEQ ID NO: 33869 - DNA, 20 bp, Artificial
  CRISPR gRNA sequence
actgcaacgtctgcctccca

SEQ ID NO: 33870 - DNA, 20 bp, Artificial
  CRISPR gRNA sequence
caacgtctgcctcccaggtt

SEQ ID NO: 33871 - DNA, 20 bp, Artificial
  CRISPR gRNA sequence
cctcccaggttcaagccatt

SEQ ID NO: 33872 - DNA, 20 bp, Artificial
  CRISPR gRNA sequence
ccaggttcaagccattcttc

SEQ ID NO: 33873 - DNA, 20 bp, Artificial
  CRISPR gRNA sequence
aagccattcttctgcctcag

SEQ ID NO: 33874 - DNA, 20 bp, Artificial
  CRISPR gRNA sequence
ttctgcctcagcctcctgag

SEQ ID NO: 33875 - DNA, 20 bp, Artificial
  CRISPR gRNA sequence
ctgcctcagcctcctgagca

SEQ ID NO: 33876 - DNA, 20 bp, Artificial
  CRISPR gRNA sequence
tgcctcagcctcctgagcag

SEQ ID NO: 33877 - DNA, 20 bp, Artificial
  CRISPR gRNA sequence
cctcagcctcctgagcagct

SEQ ID NO: 33878 - DNA, 20 bp, Artificial
  CRISPR gRNA sequence
agcctcctgagcagctggga

SEQ ID NO: 33879 - DNA, 20 bp, Artificial
  CRISPR gRNA sequence
ctgagcagctgggattacag

SEQ ID NO: 33880 - DNA, 20 bp, Artificial
  CRISPR gRNA sequence
agcagctgggattacaggca

SEQ ID NO: 33881 - DNA, 20 bp, Artificial
  CRISPR gRNA sequence
ggattacaggcacccaccac

SEQ ID NO: 33882 - DNA, 20 bp, Artificial
  CRISPR gRNA sequence
caggcacccaccaccacacc

SEQ ID NO: 33883 - DNA, 20 bp, Artificial
  CRISPR gRNA sequence
atttttgcatttttagtaga

SEQ ID NO: 33884 - DNA, 20 bp, Artificial
  CRISPR gRNA sequence
ttgcatttttagtagagaca

SEQ ID NO: 33885 - DNA, 20 bp, Artificial
  CRISPR gRNA sequence
tgcatttttagtagagacag

SEQ ID NO: 33886 - DNA, 20 bp, Artificial
  CRISPR gRNA sequence
gcatttttagtagagacagt

SEQ ID NO: 33887 - DNA, 20 bp, Artificial
  CRISPR gRNA sequence
catttttagtagagacagtg

SEQ ID NO: 33888 - DNA, 20 bp, Artificial
  CRISPR gRNA sequence
ttagtagagacagtgtttca

SEQ ID NO: 33889 - DNA, 20 bp, Artificial
  CRISPR gRNA sequence
tagtagagacagtgtttcac

SEQ ID NO: 33890 - DNA, 20 bp, Artificial
  CRISPR gRNA sequence
agtagagacagtgtttcacc

SEQ ID NO: 33891 - DNA, 20 bp, Artificial
  CRISPR gRNA sequence
gtagagacagtgtttcacca

SEQ ID NO: 33892 - DNA, 20 bp, Artificial
  CRISPR gRNA sequence
caccattttggccaggctgt

SEQ ID NO: 33893 - DNA, 20 bp, Artificial
  CRISPR gRNA sequence
accattttggccaggctgtt

SEQ ID NO: 33894 - DNA, 20 bp, Artificial
  CRISPR gRNA sequence
tggccaggctgttctcaaac

SEQ ID NO: 33895 - DNA, 20 bp, Artificial
  CRISPR gRNA sequence
ggccaggctgttctcaaact

SEQ ID NO: 33896 - DNA, 20 bp, Artificial
  CRISPR gRNA sequence
gccaggctgttctcaaactc

SEQ ID NO: 33897 - DNA, 20 bp, Artificial
  CRISPR gRNA sequence
ttctcaaactcctgacctca

SEQ ID NO: 33898 - DNA, 20 bp, Artificial
  CRISPR gRNA sequence
tcaaactcctgacctcaagt

SEQ ID NO: 33899 - DNA, 20 bp, Artificial
  CRISPR gRNA sequence
aaactcctgacctcaagtga

SEQ ID NO: 33900 - DNA, 20 bp, Artificial
  CRISPR gRNA sequence
ctgacctcaagtgatccgcc

SEQ ID NO: 33901 - DNA, 20 bp, Artificial
  CRISPR gRNA sequence
acctcaagtgatccgcctgt

SEQ ID NO: 33902 - DNA, 20 bp, Artificial
  CRISPR gRNA sequence
aagtgatccgcctgtctcct

SEQ ID NO: 33903 - DNA, 20 bp, Artificial
  CRISPR gRNA sequence
tctcctcggcctcccaaagt

SEQ ID NO: 33904 - DNA, 20 bp, Artificial
  CRISPR gRNA sequence
ctcggcctcccaaagtgttg

SEQ ID NO: 33905 - DNA, 20 bp, Artificial
  CRISPR gRNA sequence
ggcctcccaaagtgttggga

SEQ ID NO: 33906 - DNA, 20 bp, Artificial
  CRISPR gRNA sequence
ccaaagtgttgggattacag

SEQ ID NO: 33907 - DNA, 20 bp, Artificial
  CRISPR gRNA sequence
ggattacaggcatgaactgt

SEQ ID NO: 33908 - DNA, 20 bp, Artificial
  CRISPR gRNA sequence
caggcatgaactgtactttt

SEQ ID NO: 33909 - DNA, 20 bp, Artificial
  CRISPR gRNA sequence
tactttttaagtgggcaaat

SEQ ID NO: 33910 - DNA, 20 bp, Artificial
  CRISPR gRNA sequence
tttaagtgggcaaattgtat

SEQ ID NO: 33911 - DNA, 20 bp, Artificial
  CRISPR gRNA sequence
ttaagtgggcaaattgtata

SEQ ID NO: 33912 - DNA, 20 bp, Artificial
  CRISPR gRNA sequence
taagtgggcaaattgtatat

SEQ ID NO: 33913 - DNA, 20 bp, Artificial
  CRISPR gRNA sequence
aagtgggcaaattgtatatg

SEQ ID NO: 33914 - DNA, 20 bp, Artificial
  CRISPR gRNA sequence
agtgggcaaattgtatatgt

SEQ ID NO: 33915 - DNA, 20 bp, Artificial
  CRISPR gRNA sequence
tatatgtgaattacatctca

SEQ ID NO: 33916 - DNA, 20 bp, Artificial
  CRISPR gRNA sequence
catctcaataaagctgttaa

SEQ ID NO: 33917 - DNA, 20 bp, Artificial
  CRISPR gRNA sequence
aataaagctgttaaaaccta

SEQ ID NO: 33918 - DNA, 20 bp, Artificial
  CRISPR gRNA sequence
ttaaaacctaggaagtaagc

SEQ ID NO: 33919 - DNA, 20 bp, Artificial
  CRISPR gRNA sequence
aaacctaggaagtaagcatt

SEQ ID NO: 33920 - DNA, 20 bp, Artificial
  CRISPR gRNA sequence
ggaagtaagcattattgtct

SEQ ID NO: 33921 - DNA, 20 bp, Artificial
  CRISPR gRNA sequence
ttgtctccattggcagatga

SEQ ID NO: 33922 - DNA, 20 bp, Artificial
  CRISPR gRNA sequence
tctccattggcagatgaaga

SEQ ID NO: 33923 - DNA, 20 bp, Artificial
  CRISPR gRNA sequence
cattggcagatgaagaactt

SEQ ID NO: 33924 - DNA, 20 bp, Artificial
  CRISPR gRNA sequence
gcagatgaagaacttgagac

SEQ ID NO: 33925 - DNA, 20 bp, Artificial
  CRISPR gRNA sequence
gagacccagagaagacaagc

SEQ ID NO: 33926 - DNA, 20 bp, Artificial
  CRISPR gRNA sequence
agacccagagaagacaagca

SEQ ID NO: 33927 - DNA, 20 bp, Artificial
  CRISPR gRNA sequence
cctcaagatcatgtagctct

SEQ ID NO: 33928 - DNA, 20 bp, Artificial
  CRISPR gRNA sequence
ctcaagatcatgtagctctt

SEQ ID NO: 33929 - DNA, 20 bp, Artificial
  CRISPR gRNA sequence
aagatcatgtagctcttgct

SEQ ID NO: 33930 - DNA, 20 bp, Artificial
  CRISPR gRNA sequence
ttgctggggaaagccaagct

SEQ ID NO: 33931 - DNA, 20 bp, Artificial
  CRISPR gRNA sequence
gctggggaaagccaagctga

SEQ ID NO: 33932 - DNA, 20 bp, Artificial
  CRISPR gRNA sequence
ctggggaaagccaagctgaa

SEQ ID NO: 33933 - DNA, 20 bp, Artificial
  CRISPR gRNA sequence
gggaaagccaagctgaaggc

SEQ ID NO: 33934 - DNA, 20 bp, Artificial
  CRISPR gRNA sequence
aaggctcatctgtgtggctc

SEQ ID NO: 33935 - DNA, 20 bp, Artificial
  CRISPR gRNA sequence
atctgtgtggctctaaggct

SEQ ID NO: 33936 - DNA, 20 bp, Artificial
  CRISPR gRNA sequence
tgtggctctaaggctcctgc

SEQ ID NO: 33937 - DNA, 20 bp, Artificial
  CRISPR gRNA sequence
taaggctcctgccaggatcc

SEQ ID NO: 33938 - DNA, 20 bp, Artificial
  CRISPR gRNA sequence
aggctcctgccaggatccgt

SEQ ID NO: 33939 - DNA, 20 bp, Artificial
  CRISPR gRNA sequence
ctgccaggatccgtggttca

SEQ ID NO: 33940 - DNA, 20 bp, Artificial
  CRISPR gRNA sequence
ccaggatccgtggttcaggt

SEQ ID NO: 33941 - DNA, 20 bp, Artificial
  CRISPR gRNA sequence
aggtccatgtttccatggta

SEQ ID NO: 33942 - DNA, 20 bp, Artificial
  CRISPR gRNA sequence
ccatggtatattcatttccc

SEQ ID NO: 33943 - DNA, 20 bp, Artificial
  CRISPR gRNA sequence
catggtatattcatttccca

SEQ ID NO: 33944 - DNA, 20 bp, Artificial
  CRISPR gRNA sequence
atttcccagggctgctgaaa

SEQ ID NO: 33945 - DNA, 20 bp, Artificial
  CRISPR gRNA sequence
cccagggctgctgaaacaag

SEQ ID NO: 33946 - DNA, 20 bp, Artificial
  CRISPR gRNA sequence
ccagggctgctgaaacaagg

SEQ ID NO: 33947 - DNA, 20 bp, Artificial
  CRISPR gRNA sequence
ctgaaacaaggtaccagcat

SEQ ID NO: 33948 - DNA, 20 bp, Artificial
  CRISPR gRNA sequence
aaacaaggtaccagcatcca

SEQ ID NO: 33949 - DNA, 20 bp, Artificial
  CRISPR gRNA sequence
agaacaacagcactttattc

SEQ ID NO: 33950 - DNA, 20 bp, Artificial
  CRISPR gRNA sequence
tattctctcatggttctgga

SEQ ID NO: 33951 - DNA, 20 bp, Artificial
  CRISPR gRNA sequence
attctctcatggttctggag

SEQ ID NO: 33952 - DNA, 20 bp, Artificial
  CRISPR gRNA sequence
ttctctcatggttctggagg

SEQ ID NO: 33953 - DNA, 20 bp, Artificial
  CRISPR gRNA sequence
tctcatggttctggaggcca

SEQ ID NO: 33954 - DNA, 20 bp, Artificial
  CRISPR gRNA sequence
tcatggttctggaggccaga

SEQ ID NO: 33955 - DNA, 20 bp, Artificial
  CRISPR gRNA sequence
atggttctggaggccagaag

SEQ ID NO: 33956 - DNA, 20 bp, Artificial
  CRISPR gRNA sequence
tggaggccagaagttgaagc

SEQ ID NO: 33957 - DNA, 20 bp, Artificial
  CRISPR gRNA sequence
gaggccagaagttgaagcca

SEQ ID NO: 33958 - DNA, 20 bp, Artificial
  CRISPR gRNA sequence
aagccaaggtgtcagcaggg

SEQ ID NO: 33959 - DNA, 20 bp, Artificial
  CRISPR gRNA sequence
cctctggaggctcgagggga

SEQ ID NO: 33960 - DNA, 20 bp, Artificial
  CRISPR gRNA sequence
tggaggctcgaggggagaat

SEQ ID NO: 33961 - DNA, 20 bp, Artificial
  CRISPR gRNA sequence
gaggctcgaggggagaatgc

SEQ ID NO: 33962 - DNA, 20 bp, Artificial
  CRISPR gRNA sequence
gaggggagaatgcttccttg

SEQ ID NO: 33963 - DNA, 20 bp, Artificial
  CRISPR gRNA sequence
ccttgcctcctctagctgct

SEQ ID NO: 33964 - DNA, 20 bp, Artificial
  CRISPR gRNA sequence
cttgcctcctctagctgctg

SEQ ID NO: 33965 - DNA, 20 bp, Artificial
  CRISPR gRNA sequence
gcctcctctagctgctggga

SEQ ID NO: 33966 - DNA, 20 bp, Artificial
  CRISPR gRNA sequence
cctcctctagctgctgggaa

SEQ ID NO: 33967 - DNA, 20 bp, Artificial
  CRISPR gRNA sequence
ctctagctgctgggaactac

SEQ ID NO: 33968 - DNA, 20 bp, Artificial
  CRISPR gRNA sequence
tagctgctgggaactactgg

SEQ ID NO: 33969 - DNA, 20 bp, Artificial
  CRISPR gRNA sequence
gctgctgggaactactggtg

SEQ ID NO: 33970 - DNA, 20 bp, Artificial
  CRISPR gRNA sequence
ctgggaactactggtgatcc

SEQ ID NO: 33971 - DNA, 20 bp, Artificial
  CRISPR gRNA sequence
ggaactactggtgatccttg

SEQ ID NO: 33972 - DNA, 20 bp, Artificial
  CRISPR gRNA sequence
ctggtgatccttgacttgtg

SEQ ID NO: 33973 - DNA, 20 bp, Artificial
  CRISPR gRNA sequence
gtgatccttgacttgtggtc

SEQ ID NO: 33974 - DNA, 20 bp, Artificial
  CRISPR gRNA sequence
gacttgtggtcttgtggctg

SEQ ID NO: 33975 - DNA, 20 bp, Artificial
  CRISPR gRNA sequence
acttgtggtcttgtggctgc

SEQ ID NO: 33976 - DNA, 20 bp, Artificial
  CRISPR gRNA sequence
gtggtcttgtggctgcatca

SEQ ID NO: 33977 - DNA, 20 bp, Artificial
  CRISPR gRNA sequence
tggtcttgtggctgcatcac

SEQ ID NO: 33978 - DNA, 20 bp, Artificial
  CRISPR gRNA sequence
gtggctgcatcactctaaac

SEQ ID NO: 33979 - DNA, 20 bp, Artificial
  CRISPR gRNA sequence
tggctgcatcactctaaact

SEQ ID NO: 33980 - DNA, 20 bp, Artificial
  CRISPR gRNA sequence
catcactctaaactcagctt

SEQ ID NO: 33981 - DNA, 20 bp, Artificial
  CRISPR gRNA sequence
taaactcagctttagtggcc

SEQ ID NO: 33982 - DNA, 20 bp, Artificial
  CRISPR gRNA sequence
aactcagctttagtggccac

SEQ ID NO: 33983 - DNA, 20 bp, Artificial
  CRISPR gRNA sequence
agctttagtggccacatcac

SEQ ID NO: 33984 - DNA, 20 bp, Artificial
  CRISPR gRNA sequence
tagtggccacatcacctact

SEQ ID NO: 33985 - DNA, 20 bp, Artificial
  CRISPR gRNA sequence
agtggccacatcacctactc

SEQ ID NO: 33986 - DNA, 20 bp, Artificial
  CRISPR gRNA sequence
gtggccacatcacctactcc

SEQ ID NO: 33987 - DNA, 20 bp, Artificial
  CRISPR gRNA sequence
ctcctcatgtagcaagtctc

SEQ ID NO: 33988 - DNA, 20 bp, Artificial
  CRISPR gRNA sequence
ctcatgtagcaagtctcttt

SEQ ID NO: 33989 - DNA, 20 bp, Artificial
  CRISPR gRNA sequence
atgtagcaagtctctttctc

SEQ ID NO: 33990 - DNA, 20 bp, Artificial
  CRISPR gRNA sequence
tttctcttataaagacactt

SEQ ID NO: 33991 - DNA, 20 bp, Artificial
  CRISPR gRNA sequence
tctcttataaagacacttgt

SEQ ID NO: 33992 - DNA, 20 bp, Artificial
  CRISPR gRNA sequence
ctcttataaagacacttgtc

SEQ ID NO: 33993 - DNA, 20 bp, Artificial
  CRISPR gRNA sequence
tcttataaagacacttgtca

SEQ ID NO: 33994 - DNA, 20 bp, Artificial
  CRISPR gRNA sequence
ttataaagacacttgtcatt

SEQ ID NO: 33995 - DNA, 20 bp, Artificial
  CRISPR gRNA sequence
ataaagacacttgtcattgg

SEQ ID NO: 33996 - DNA, 20 bp, Artificial
  CRISPR gRNA sequence
taaagacacttgtcattgga

SEQ ID NO: 33997 - DNA, 20 bp, Artificial
  CRISPR gRNA sequence
gtcattggatttaggaccca

SEQ ID NO: 33998 - DNA, 20 bp, Artificial
  CRISPR gRNA sequence
tcattggatttaggacccac

SEQ ID NO: 33999 - DNA, 20 bp, Artificial
  CRISPR gRNA sequence
gatttaggacccacctagat

SEQ ID NO: 34000 - DNA, 20 bp, Artificial
  CRISPR gRNA sequence
aggacccacctagataatcc

SEQ ID NO: 34001 - DNA, 20 bp, Artificial
  CRISPR gRNA sequence
ggacccacctagataatcca

SEQ ID NO: 34002 - DNA, 20 bp, Artificial
  CRISPR gRNA sequence
gataatccaggatgatgtca

SEQ ID NO: 34003 - DNA, 20 bp, Artificial
  CRISPR gRNA sequence
caagatctttaattcttttt

SEQ ID NO: 34004 - DNA, 20 bp, Artificial
  CRISPR gRNA sequence
aagatctttaattctttttt

SEQ ID NO: 34005 - DNA, 20 bp, Artificial
  CRISPR gRNA sequence
taattctttttttgccttct

SEQ ID NO: 34006 - DNA, 20 bp, Artificial
  CRISPR gRNA sequence
aattctttttttgccttctt

SEQ ID NO: 34007 - DNA, 20 bp, Artificial
  CRISPR gRNA sequence
attctttttttgccttcttt

SEQ ID NO: 34008 - DNA, 20 bp, Artificial
  CRISPR gRNA sequence
tttttttgccttcttttgag

SEQ ID NO: 34009 - DNA, 20 bp, Artificial
  CRISPR gRNA sequence
tttttgccttcttttgagac

SEQ ID NO: 34010 - DNA, 20 bp, Artificial
  CRISPR gRNA sequence
ttttgccttcttttgagaca

SEQ ID NO: 34011 - DNA, 20 bp, Artificial
  CRISPR gRNA sequence
tttgccttcttttgagacag

SEQ ID NO: 34012 - DNA, 20 bp, Artificial
  CRISPR gRNA sequence
ttgccttcttttgagacaga

SEQ ID NO: 34013 - DNA, 20 bp, Artificial
  CRISPR gRNA sequence
tgccttcttttgagacagag

SEQ ID NO: 34014 - DNA, 20 bp, Artificial
  CRISPR gRNA sequence
gccttcttttgagacagagg

SEQ ID NO: 34015 - DNA, 20 bp, Artificial
  CRISPR gRNA sequence
ccttcttttgagacagaggc

SEQ ID NO: 34016 - DNA, 20 bp, Artificial
  CRISPR gRNA sequence
cttttgagacagaggcttgc

SEQ ID NO: 34017 - DNA, 20 bp, Artificial
  CRISPR gRNA sequence
ttttgagacagaggcttgct

SEQ ID NO: 34018 - DNA, 20 bp, Artificial
  CRISPR gRNA sequence
ttgagacagaggcttgctct

SEQ ID NO: 34019 - DNA, 20 bp, Artificial
  CRISPR gRNA sequence
tgagacagaggcttgctctg

SEQ ID NO: 34020 - DNA, 20 bp, Artificial
  CRISPR gRNA sequence
gagacagaggcttgctctgt

SEQ ID NO: 34021 - DNA, 20 bp, Artificial
  CRISPR gRNA sequence
agacagaggcttgctctgtt

SEQ ID NO: 34022 - DNA, 20 bp, Artificial
  CRISPR gRNA sequence
gctctgttgcccaggctgga

SEQ ID NO: 34023 - DNA, 20 bp, Artificial
  CRISPR gRNA sequence
ctctgttgcccaggctggaa

SEQ ID NO: 34024 - DNA, 20 bp, Artificial
  CRISPR gRNA sequence
tgttgcccaggctggaatgc

SEQ ID NO: 34025 - DNA, 20 bp, Artificial
  CRISPR gRNA sequence
ttgcccaggctggaatgcag

SEQ ID NO: 34026 - DNA, 20 bp, Artificial
  CRISPR gRNA sequence
cccaggctggaatgcagtgg

SEQ ID NO: 34027 - DNA, 20 bp, Artificial
  CRISPR gRNA sequence
gaatgcagtggcgctgtatc

SEQ ID NO: 34028 - DNA, 20 bp, Artificial
  CRISPR gRNA sequence
tatcggctcactgcaacctc

SEQ ID NO: 34029 - DNA, 20 bp, Artificial
  CRISPR gRNA sequence
actgcaacctccacctccca

SEQ ID NO: 34030 - DNA, 20 bp, Artificial
  CRISPR gRNA sequence
caacctccacctcccagttc

SEQ ID NO: 34031 - DNA, 20 bp, Artificial
  CRISPR gRNA sequence
cacctcccagttcaagcgat

SEQ ID NO: 34032 - DNA, 20 bp, Artificial
  CRISPR gRNA sequence
ccagttcaagcgattctcct

SEQ ID NO: 34033 - DNA, 20 bp, Artificial
  CRISPR gRNA sequence
aagcgattctcctgccccag

SEQ ID NO: 34034 - DNA, 20 bp, Artificial
  CRISPR gRNA sequence
tcctgccccagtctcctgag

SEQ ID NO: 34035 - DNA, 20 bp, Artificial
  CRISPR gRNA sequence
ctgccccagtctcctgagta

SEQ ID NO: 34036 - DNA, 20 bp, Artificial
  CRISPR gRNA sequence
ccccagtctcctgagtagct

SEQ ID NO: 34037 - DNA, 20 bp, Artificial
  CRISPR gRNA sequence
ctgagtagctgggattacag

SEQ ID NO: 34038 - DNA, 20 bp, Artificial
  CRISPR gRNA sequence
agtagctgggattacaggtg

SEQ ID NO: 34039 - DNA, 20 bp, Artificial
  CRISPR gRNA sequence
ggattacaggtgctcaccac

SEQ ID NO: 34040 - DNA, 20 bp, Artificial
  CRISPR gRNA sequence
caggtgctcaccaccatgac

SEQ ID NO: 34041 - DNA, 20 bp, Artificial
  CRISPR gRNA sequence
accaccatgaccagctaatt

SEQ ID NO: 34042 - DNA, 20 bp, Artificial
  CRISPR gRNA sequence
atttttgtatttttagtaga

SEQ ID NO: 34043 - DNA, 20 bp, Artificial
  CRISPR gRNA sequence
ttgtatttttagtagaaatg

SEQ ID NO: 34044 - DNA, 20 bp, Artificial
  CRISPR gRNA sequence
tgtatttttagtagaaatgg

SEQ ID NO: 34045 - DNA, 20 bp, Artificial
  CRISPR gRNA sequence
gtatttttagtagaaatggg

SEQ ID NO: 34046 - DNA, 20 bp, Artificial
  CRISPR gRNA sequence
tatttttagtagaaatgggg

SEQ ID NO: 34047 - DNA, 20 bp, Artificial
  CRISPR gRNA sequence
ttagtagaaatggggttttg

SEQ ID NO: 34048 - DNA, 20 bp, Artificial
  CRISPR gRNA sequence
tagtagaaatggggttttgc

SEQ ID NO: 34049 - DNA, 20 bp, Artificial
  CRISPR gRNA sequence
agtagaaatggggttttgcc

SEQ ID NO: 34050 - DNA, 20 bp, Artificial
  CRISPR gRNA sequence
gtagaaatggggttttgcca

SEQ ID NO: 34051 - DNA, 20 bp, Artificial
  CRISPR gRNA sequence
tgccatgttggccacgctgg

SEQ ID NO: 34052 - DNA, 20 bp, Artificial
  CRISPR gRNA sequence
gccatgttggccacgctggt

SEQ ID NO: 34053 - DNA, 20 bp, Artificial
  CRISPR gRNA sequence
ccatgttggccacgctggtc

SEQ ID NO: 34054 - DNA, 20 bp, Artificial
  CRISPR gRNA sequence
gccacgctggtcttgaactc

SEQ ID NO: 34055 - DNA, 20 bp, Artificial
  CRISPR gRNA sequence
gtcttgaactcctgacctca

SEQ ID NO: 34056 - DNA, 20 bp, Artificial
  CRISPR gRNA sequence
gaactcctgacctcaggtga

SEQ ID NO: 34057 - DNA, 20 bp, Artificial
  CRISPR gRNA sequence
aactcctgacctcaggtgat

SEQ ID NO: 34058 - DNA, 20 bp, Artificial
  CRISPR gRNA sequence
ctgacctcaggtgatcctcc

SEQ ID NO: 34059 - DNA, 20 bp, Artificial
  CRISPR gRNA sequence
acctcaggtgatcctccaat

SEQ ID NO: 34060 - DNA, 20 bp, Artificial
  CRISPR gRNA sequence
aggtgatcctccaatctcag

SEQ ID NO: 34061 - DNA, 20 bp, Artificial
  CRISPR gRNA sequence
caatctcagcttcccaaagt

SEQ ID NO: 34062 - DNA, 20 bp, Artificial
  CRISPR gRNA sequence
agcttcccaaagtgctggga

SEQ ID NO: 34063 - DNA, 20 bp, Artificial
  CRISPR gRNA sequence
cccaaagtgctgggattaca

SEQ ID NO: 34064 - DNA, 20 bp, Artificial
  CRISPR gRNA sequence
ccaaagtgctgggattacag

SEQ ID NO: 34065 - DNA, 20 bp, Artificial
  CRISPR gRNA sequence
ggattacaggcatgagccac

SEQ ID NO: 34066 - DNA, 20 bp, Artificial
  CRISPR gRNA sequence
caggcatgagccactgcacc

SEQ ID NO: 34067 - DNA, 20 bp, Artificial
  CRISPR gRNA sequence
cacccagccccttaacttaa

SEQ ID NO: 34068 - DNA, 20 bp, Artificial
  CRISPR gRNA sequence
aacttaattctatctgcaaa

SEQ ID NO: 34069 - DNA, 20 bp, Artificial
  CRISPR gRNA sequence
acttaattctatctgcaaag

SEQ ID NO: 34070 - DNA, 20 bp, Artificial
  CRISPR gRNA sequence
aattctatctgcaaagaccc

SEQ ID NO: 34071 - DNA, 20 bp, Artificial
  CRISPR gRNA sequence
attctatctgcaaagaccct

SEQ ID NO: 34072 - DNA, 20 bp, Artificial
  CRISPR gRNA sequence
tatctgcaaagacccttttc

SEQ ID NO: 34073 - DNA, 20 bp, Artificial
  CRISPR gRNA sequence
tctgcaaagacccttttccc

SEQ ID NO: 34074 - DNA, 20 bp, Artificial
  CRISPR gRNA sequence
caaagacccttttcccaaat

SEQ ID NO: 34075 - DNA, 20 bp, Artificial
  CRISPR gRNA sequence
ttcccaaataaagtcacact

SEQ ID NO: 34076 - DNA, 20 bp, Artificial
  CRISPR gRNA sequence
tcccaaataaagtcacactg

SEQ ID NO: 34077 - DNA, 20 bp, Artificial
  CRISPR gRNA sequence
cccaaataaagtcacactga

SEQ ID NO: 34078 - DNA, 20 bp, Artificial
  CRISPR gRNA sequence
ccaaataaagtcacactgac

SEQ ID NO: 34079 - DNA, 20 bp, Artificial
  CRISPR gRNA sequence
acaggttccagggatttgac

SEQ ID NO: 34080 - DNA, 20 bp, Artificial
  CRISPR gRNA sequence
cagggatttgacatggacat

SEQ ID NO: 34081 - DNA, 20 bp, Artificial
  CRISPR gRNA sequence
gacatggacatatcttttgg

SEQ ID NO: 34082 - DNA, 20 bp, Artificial
  CRISPR gRNA sequence
acatggacatatcttttggg

SEQ ID NO: 34083 - DNA, 20 bp, Artificial
  CRISPR gRNA sequence
ttggggggccacctttcaac

SEQ ID NO: 34084 - DNA, 20 bp, Artificial
  CRISPR gRNA sequence
tggggggccacctttcaacc

SEQ ID NO: 34085 - DNA, 20 bp, Artificial
  CRISPR gRNA sequence
ggggggccacctttcaaccc

SEQ ID NO: 34086 - DNA, 20 bp, Artificial
  CRISPR gRNA sequence
gggggccacctttcaaccca

SEQ ID NO: 34087 - DNA, 20 bp, Artificial
  CRISPR gRNA sequence
tcaacccaccacacatgaca

SEQ ID NO: 34088 - DNA, 20 bp, Artificial
  CRISPR gRNA sequence
caacccaccacacatgacat

SEQ ID NO: 34089 - DNA, 20 bp, Artificial
  CRISPR gRNA sequence
aacccaccacacatgacatg

SEQ ID NO: 34090 - DNA, 20 bp, Artificial
  CRISPR gRNA sequence
gaaagaaacagagggagctt

SEQ ID NO: 34091 - DNA, 20 bp, Artificial
  CRISPR gRNA sequence
cctggaggaggtaagaggag

SEQ ID NO: 34092 - DNA, 20 bp, Artificial
  CRISPR gRNA sequence
ctggaggaggtaagaggaga

SEQ ID NO: 34093 - DNA, 20 bp, Artificial
  CRISPR gRNA sequence
gaggaggtaagaggagagct

SEQ ID NO: 34094 - DNA, 20 bp, Artificial
  CRISPR gRNA sequence
gccctgaagctggaagacca

SEQ ID NO: 34095 - DNA, 20 bp, Artificial
  CRISPR gRNA sequence
aagctggaagaccagaggga

SEQ ID NO: 34096 - DNA, 20 bp, Artificial
  CRISPR gRNA sequence
gaagaccagagggaggctcc

SEQ ID NO: 34097 - DNA, 20 bp, Artificial
  CRISPR gRNA sequence
ctactgccctgttctgggcc

SEQ ID NO: 34098 - DNA, 20 bp, Artificial
  CRISPR gRNA sequence
ctgccctgttctgggcccag

SEQ ID NO: 34099 - DNA, 20 bp, Artificial
  CRISPR gRNA sequence
ccctgttctgggcccagaag

SEQ ID NO: 34100 - DNA, 20 bp, Artificial
  CRISPR gRNA sequence
ttctgggcccagaagagaat

SEQ ID NO: 34101 - DNA, 20 bp, Artificial
  CRISPR gRNA sequence
tgggcccagaagagaataca

SEQ ID NO: 34102 - DNA, 20 bp, Artificial
  CRISPR gRNA sequence
ggcccagaagagaatacatt

SEQ ID NO: 34103 - DNA, 20 bp, Artificial
  CRISPR gRNA sequence
aagagtaagctcatgagaaa

SEQ ID NO: 34104 - DNA, 20 bp, Artificial
  CRISPR gRNA sequence
atgagaaaacacacactcaa

SEQ ID NO: 34105 - DNA, 20 bp, Artificial
  CRISPR gRNA sequence
aacttgccaccccattcctg

SEQ ID NO: 34106 - DNA, 20 bp, Artificial
  CRISPR gRNA sequence
gccaccccattcctgagact

SEQ ID NO: 34107 - DNA, 20 bp, Artificial
  CRISPR gRNA sequence
ccaccccattcctgagactc

SEQ ID NO: 34108 - DNA, 20 bp, Artificial
  CRISPR gRNA sequence
ctgagactcattttcttttt

SEQ ID NO: 34109 - DNA, 20 bp, Artificial
  CRISPR gRNA sequence
agactcattttctttttctt

SEQ ID NO: 34110 - DNA, 20 bp, Artificial
  CRISPR gRNA sequence
attttctttttctttttttt

SEQ ID NO: 34111 - DNA, 20 bp, Artificial
  CRISPR gRNA sequence
tctttttctttttttttttg

SEQ ID NO: 34112 - DNA, 20 bp, Artificial
  CRISPR gRNA sequence
ctttttctttttttttttga

SEQ ID NO: 34113 - DNA, 20 bp, Artificial
  CRISPR gRNA sequence
tttttctttttttttttgag

SEQ ID NO: 34114 - DNA, 20 bp, Artificial
  CRISPR gRNA sequence
tttctttttttttttgagac

SEQ ID NO: 34115 - DNA, 20 bp, Artificial
  CRISPR gRNA sequence
ttctttttttttttgagaca

SEQ ID NO: 34116 - DNA, 20 bp, Artificial
  CRISPR gRNA sequence
tctttttttttttgagacag

SEQ ID NO: 34117 - DNA, 20 bp, Artificial
  CRISPR gRNA sequence
ctttttttttttgagacaga

SEQ ID NO: 34118 - DNA, 20 bp, Artificial
  CRISPR gRNA sequence
tttttttttttgagacagag

SEQ ID NO: 34119 - DNA, 20 bp, Artificial
  CRISPR gRNA sequence
tttttttttgagacagagtc

SEQ ID NO: 34120 - DNA, 20 bp, Artificial
  CRISPR gRNA sequence
ttttttttgagacagagtct

SEQ ID NO: 34121 - DNA, 20 bp, Artificial
  CRISPR gRNA sequence
tttttttgagacagagtctc

SEQ ID NO: 34122 - DNA, 20 bp, Artificial
  CRISPR gRNA sequence
ttttttgagacagagtctca

SEQ ID NO: 34123 - DNA, 20 bp, Artificial
  CRISPR gRNA sequence
tttttgagacagagtctcac

SEQ ID NO: 34124 - DNA, 20 bp, Artificial
  CRISPR gRNA sequence
ttttgagacagagtctcact

SEQ ID NO: 34125 - DNA, 20 bp, Artificial
  CRISPR gRNA sequence
tttgagacagagtctcactc

SEQ ID NO: 34126 - DNA, 20 bp, Artificial
  CRISPR gRNA sequence
ttgagacagagtctcactct

SEQ ID NO: 34127 - DNA, 20 bp, Artificial
  CRISPR gRNA sequence
tgagacagagtctcactctg

SEQ ID NO: 34128 - DNA, 20 bp, Artificial
  CRISPR gRNA sequence
gagacagagtctcactctgt

SEQ ID NO: 34129 - DNA, 20 bp, Artificial
  CRISPR gRNA sequence
agacagagtctcactctgtc

SEQ ID NO: 34130 - DNA, 20 bp, Artificial
  CRISPR gRNA sequence
actctgtcgcccaggctgga

SEQ ID NO: 34131 - DNA, 20 bp, Artificial
  CRISPR gRNA sequence
tgtcgcccaggctggagtgc

SEQ ID NO: 34132 - DNA, 20 bp, Artificial
  CRISPR gRNA sequence
tcgcccaggctggagtgcag

SEQ ID NO: 34133 - DNA, 20 bp, Artificial
  CRISPR gRNA sequence
gagtgcagtggtgcaatctt

SEQ ID NO: 34134 - DNA, 20 bp, Artificial
  CRISPR gRNA sequence
ggctcactgcaacctctgcc

SEQ ID NO: 34135 - DNA, 20 bp, Artificial
  CRISPR gRNA sequence
gctcactgcaacctctgcct

SEQ ID NO: 34136 - DNA, 20 bp, Artificial
  CRISPR gRNA sequence
actgcaacctctgcctcccg

SEQ ID NO: 34137 - DNA, 20 bp, Artificial
  CRISPR gRNA sequence
caacctctgcctcccggatt

SEQ ID NO: 34138 - DNA, 20 bp, Artificial
  CRISPR gRNA sequence
tgcctcccggattcaagcaa

SEQ ID NO: 34139 - DNA, 20 bp, Artificial
  CRISPR gRNA sequence
cctcccggattcaagcaatt

SEQ ID NO: 34140 - DNA, 20 bp, Artificial
  CRISPR gRNA sequence
ccggattcaagcaattctcc

SEQ ID NO: 34141 - DNA, 20 bp, Artificial
  CRISPR gRNA sequence
aagcaattctcctgcttcaa

SEQ ID NO: 34142 - DNA, 20 bp, Artificial
  CRISPR gRNA sequence
tcctgcttcaacctcccaag

SEQ ID NO: 34143 - DNA, 20 bp, Artificial
  CRISPR gRNA sequence
ctgcttcaacctcccaagta

SEQ ID NO: 34144 - DNA, 20 bp, Artificial
  CRISPR gRNA sequence
cttcaacctcccaagtagct

SEQ ID NO: 34145 - DNA, 20 bp, Artificial
  CRISPR gRNA sequence
caacctcccaagtagctggc

SEQ ID NO: 34146 - DNA, 20 bp, Artificial
  CRISPR gRNA sequence
aacctcccaagtagctggca

SEQ ID NO: 34147 - DNA, 20 bp, Artificial
  CRISPR gRNA sequence
ccaagtagctggcattacag

SEQ ID NO: 34148 - DNA, 20 bp, Artificial
  CRISPR gRNA sequence
gcattacaggcacccgccac

SEQ ID NO: 34149 - DNA, 20 bp, Artificial
  CRISPR gRNA sequence
caggcacccgccaccatgcc

SEQ ID NO: 34150 - DNA, 20 bp, Artificial
  CRISPR gRNA sequence
gctaatttttttatttttag

SEQ ID NO: 34151 - DNA, 20 bp, Artificial
  CRISPR gRNA sequence
atttttttatttttagtaaa

SEQ ID NO: 34152 - DNA, 20 bp, Artificial
  CRISPR gRNA sequence
ttttatttttagtaaagatg

SEQ ID NO: 34153 - DNA, 20 bp, Artificial
  CRISPR gRNA sequence
tttatttttagtaaagatgg

SEQ ID NO: 34154 - DNA, 20 bp, Artificial
  CRISPR gRNA sequence
ttatttttagtaaagatggg

SEQ ID NO: 34155 - DNA, 20 bp, Artificial
  CRISPR gRNA sequence
tatttttagtaaagatgggg

SEQ ID NO: 34156 - DNA, 20 bp, Artificial
  CRISPR gRNA sequence
atttttagtaaagatggggt

SEQ ID NO: 34157 - DNA, 20 bp, Artificial
  CRISPR gRNA sequence
tttttagtaaagatggggtt

SEQ ID NO: 34158 - DNA, 20 bp, Artificial
  CRISPR gRNA sequence
ttagtaaagatggggtttca

SEQ ID NO: 34159 - DNA, 20 bp, Artificial
  CRISPR gRNA sequence
tagtaaagatggggtttcac

SEQ ID NO: 34160 - DNA, 20 bp, Artificial
  CRISPR gRNA sequence
agtaaagatggggtttcacc

SEQ ID NO: 34161 - DNA, 20 bp, Artificial
  CRISPR gRNA sequence
gtaaagatggggtttcacca

SEQ ID NO: 34162 - DNA, 20 bp, Artificial
  CRISPR gRNA sequence
caccatgttggtcaggctgg

SEQ ID NO: 34163 - DNA, 20 bp, Artificial
  CRISPR gRNA sequence
accatgttggtcaggctggt

SEQ ID NO: 34164 - DNA, 20 bp, Artificial
  CRISPR gRNA sequence
gtcaggctggtttcgaactc

SEQ ID NO: 34165 - DNA, 20 bp, Artificial
  CRISPR gRNA sequence
gtttcgaactcccgacctca

SEQ ID NO: 34166 - DNA, 20 bp, Artificial
  CRISPR gRNA sequence
cgaactcccgacctcaggtg

SEQ ID NO: 34167 - DNA, 20 bp, Artificial
  CRISPR gRNA sequence
gaactcccgacctcaggtga

SEQ ID NO: 34168 - DNA, 20 bp, Artificial
  CRISPR gRNA sequence
ccgacctcaggtgatccacc

SEQ ID NO: 34169 - DNA, 20 bp, Artificial
  CRISPR gRNA sequence
aggtgatccacccgccttgg

SEQ ID NO: 34170 - DNA, 20 bp, Artificial
  CRISPR gRNA sequence
ggcctcccaaagtgctggga

SEQ ID NO: 34171 - DNA, 20 bp, Artificial
  CRISPR gRNA sequence
gcctcccaaagtgctgggat

SEQ ID NO: 34172 - DNA, 20 bp, Artificial
  CRISPR gRNA sequence
ccaaagtgctgggattacag

SEQ ID NO: 34173 - DNA, 20 bp, Artificial
  CRISPR gRNA sequence
ggattacaggtgtgagccac

SEQ ID NO: 34174 - DNA, 20 bp, Artificial
  CRISPR gRNA sequence
caggtgtgagccaccacacc

SEQ ID NO: 34175 - DNA, 20 bp, Artificial
  CRISPR gRNA sequence
tctttcacgcatccacagct

SEQ ID NO: 34176 - DNA, 20 bp, Artificial
  CRISPR gRNA sequence
ctttcacgcatccacagctt

SEQ ID NO: 34177 - DNA, 20 bp, Artificial
  CRISPR gRNA sequence
tttcacgcatccacagcttt

SEQ ID NO: 34178 - DNA, 20 bp, Artificial
  CRISPR gRNA sequence
tcacgcatccacagctttca

SEQ ID NO: 34179 - DNA, 20 bp, Artificial
  CRISPR gRNA sequence
cacgcatccacagctttcac

SEQ ID NO: 34180 - DNA, 20 bp, Artificial
  CRISPR gRNA sequence
acgcatccacagctttcact

SEQ ID NO: 34181 - DNA, 20 bp, Artificial
  CRISPR gRNA sequence
tcactgcctggggagaggct

SEQ ID NO: 34182 - DNA, 20 bp, Artificial
  CRISPR gRNA sequence
cactgcctggggagaggctc

SEQ ID NO: 34183 - DNA, 20 bp, Artificial
  CRISPR gRNA sequence
actgcctggggagaggctca

SEQ ID NO: 34184 - DNA, 20 bp, Artificial
  CRISPR gRNA sequence
cctggggagaggctcagcac

SEQ ID NO: 34185 - DNA, 20 bp, Artificial
  CRISPR gRNA sequence
gggagaggctcagcacagac

SEQ ID NO: 34186 - DNA, 20 bp, Artificial
  CRISPR gRNA sequence
agcacagacccccggatgtc

SEQ ID NO: 34187 - DNA, 20 bp, Artificial
  CRISPR gRNA sequence
tccagtccaagctggggcac

SEQ ID NO: 34188 - DNA, 20 bp, Artificial
  CRISPR gRNA sequence
ccagtccaagctggggcact

SEQ ID NO: 34189 - DNA, 20 bp, Artificial
  CRISPR gRNA sequence
cagtccaagctggggcactg

SEQ ID NO: 34190 - DNA, 20 bp, Artificial
  CRISPR gRNA sequence
gggcactggctgggcccact

SEQ ID NO: 34191 - DNA, 20 bp, Artificial
  CRISPR gRNA sequence
gctgggcccacttgttcatg

SEQ ID NO: 34192 - DNA, 20 bp, Artificial
  CRISPR gRNA sequence
ggcccacttgttcatgacgg

SEQ ID NO: 34193 - DNA, 20 bp, Artificial
  CRISPR gRNA sequence
gttcatgacggttgagcggg

SEQ ID NO: 34194 - DNA, 20 bp, Artificial
  CRISPR gRNA sequence
ttcatgacggttgagcgggg

SEQ ID NO: 34195 - DNA, 20 bp, Artificial
  CRISPR gRNA sequence
atgacggttgagcgggggct

SEQ ID NO: 34196 - DNA, 20 bp, Artificial
  CRISPR gRNA sequence
agcgggggctgcaggaaccc

SEQ ID NO: 34197 - DNA, 20 bp, Artificial
  CRISPR gRNA sequence
caggaacccaaacataaccg

SEQ ID NO: 34198 - DNA, 20 bp, Artificial
  CRISPR gRNA sequence
gcagcgagatcccagccaac

SEQ ID NO: 34199 - DNA, 20 bp, Artificial
  CRISPR gRNA sequence
cagcgagatcccagccaacc

SEQ ID NO: 34200 - DNA, 20 bp, Artificial
  CRISPR gRNA sequence
gaggaagcagaactgaaaga

SEQ ID NO: 34201 - DNA, 20 bp, Artificial
  CRISPR gRNA sequence
aaagatggggccaccgccct

SEQ ID NO: 34202 - DNA, 20 bp, Artificial
  CRISPR gRNA sequence
ttcctggagcagggccaaag

SEQ ID NO: 34203 - DNA, 20 bp, Artificial
  CRISPR gRNA sequence
tcctggagcagggccaaagc

SEQ ID NO: 34204 - DNA, 20 bp, Artificial
  CRISPR gRNA sequence
cctggagcagggccaaagct

SEQ ID NO: 34205 - DNA, 20 bp, Artificial
  CRISPR gRNA sequence
ctggagcagggccaaagctg

SEQ ID NO: 34206 - DNA, 20 bp, Artificial
  CRISPR gRNA sequence
gagcagggccaaagctggga

SEQ ID NO: 34207 - DNA, 20 bp, Artificial
  CRISPR gRNA sequence
ggagatggttgggggtgaga

SEQ ID NO: 34208 - DNA, 20 bp, Artificial
  CRISPR gRNA sequence
ggggtgagatgctccacctc

SEQ ID NO: 34209 - DNA, 20 bp, Artificial
  CRISPR gRNA sequence
cacctctcccagccccttgg

SEQ ID NO: 34210 - DNA, 20 bp, Artificial
  CRISPR gRNA sequence
tcccagccccttggtcaggg

SEQ ID NO: 34211 - DNA, 20 bp, Artificial
  CRISPR gRNA sequence
ccagccccttggtcagggac

SEQ ID NO: 34212 - DNA, 20 bp, Artificial
  CRISPR gRNA sequence
ggtcagggacacaggcacaa

SEQ ID NO: 34213 - DNA, 20 bp, Artificial
  CRISPR gRNA sequence
gtcagggacacaggcacaaa

SEQ ID NO: 34214 - DNA, 20 bp, Artificial
  CRISPR gRNA sequence
ttctctcagagcagtgagaa

SEQ ID NO: 34215 - DNA, 20 bp, Artificial
  CRISPR gRNA sequence
tctcagagcagtgagaaaag

SEQ ID NO: 34216 - DNA, 20 bp, Artificial
  CRISPR gRNA sequence
tcagagcagtgagaaaagac

SEQ ID NO: 34217 - DNA, 20 bp, Artificial
  CRISPR gRNA sequence
agagcagtgagaaaagacac

SEQ ID NO: 34218 - DNA, 20 bp, Artificial
  CRISPR gRNA sequence
tgccccagctcctgcctgat

SEQ ID NO: 34219 - DNA, 20 bp, Artificial
  CRISPR gRNA sequence
gccccagctcctgcctgatg

SEQ ID NO: 34220 - DNA, 20 bp, Artificial
  CRISPR gRNA sequence
ccccagctcctgcctgatgc

SEQ ID NO: 34221 - DNA, 20 bp, Artificial
  CRISPR gRNA sequence
ctgcctgatgcccgcctccc

SEQ ID NO: 34222 - DNA, 20 bp, Artificial
  CRISPR gRNA sequence
cctgatgcccgcctcccatt

SEQ ID NO: 34223 - DNA, 20 bp, Artificial
  CRISPR gRNA sequence
atgcccgcctcccattccac

SEQ ID NO: 34224 - DNA, 20 bp, Artificial
  CRISPR gRNA sequence
ccattccacccatgctcttt

SEQ ID NO: 34225 - DNA, 20 bp, Artificial
  CRISPR gRNA sequence
cacccatgctctttattaag

SEQ ID NO: 34226 - DNA, 20 bp, Artificial
  CRISPR gRNA sequence
tttattaagaacctacattg

SEQ ID NO: 34227 - DNA, 20 bp, Artificial
  CRISPR gRNA sequence
tattaagaacctacattgca

SEQ ID NO: 34228 - DNA, 20 bp, Artificial
  CRISPR gRNA sequence
attaagaacctacattgcag

SEQ ID NO: 34229 - DNA, 20 bp, Artificial
  CRISPR gRNA sequence
ttaagaacctacattgcagc

SEQ ID NO: 34230 - DNA, 20 bp, Artificial
  CRISPR gRNA sequence
agaacctacattgcagcaat

SEQ ID NO: 34231 - DNA, 20 bp, Artificial
  CRISPR gRNA sequence
cattgcagcaatctgcctcc

SEQ ID NO: 34232 - DNA, 20 bp, Artificial
  CRISPR gRNA sequence
cagcaatctgcctcctcttt

SEQ ID NO: 34233 - DNA, 20 bp, Artificial
  CRISPR gRNA sequence
cctcctctttgaggcagtgt

SEQ ID NO: 34234 - DNA, 20 bp, Artificial
  CRISPR gRNA sequence
ctctttgaggcagtgtgatc

SEQ ID NO: 34235 - DNA, 20 bp, Artificial
  CRISPR gRNA sequence
tttgaggcagtgtgatctcg

SEQ ID NO: 34236 - DNA, 20 bp, Artificial
  CRISPR gRNA sequence
tgaggcagtgtgatctcgtg

SEQ ID NO: 34237 - DNA, 20 bp, Artificial
  CRISPR gRNA sequence
gaggcagtgtgatctcgtga

SEQ ID NO: 34238 - DNA, 20 bp, Artificial
  CRISPR gRNA sequence
aggcagtgtgatctcgtgac

SEQ ID NO: 34239 - DNA, 20 bp, Artificial
  CRISPR gRNA sequence
gtgacaagagctccagactg

SEQ ID NO: 34240 - DNA, 20 bp, Artificial
  CRISPR gRNA sequence
cagactgatcctagcaactc

SEQ ID NO: 34241 - DNA, 20 bp, Artificial
  CRISPR gRNA sequence
atcctagcaactccgtgaat

SEQ ID NO: 34242 - DNA, 20 bp, Artificial
  CRISPR gRNA sequence
gcaactccgtgaatgagttg

SEQ ID NO: 34243 - DNA, 20 bp, Artificial
  CRISPR gRNA sequence
cgtgaatgagttgtgtgact

SEQ ID NO: 34244 - DNA, 20 bp, Artificial
  CRISPR gRNA sequence
tgtgactttggactttgggc

SEQ ID NO: 34245 - DNA, 20 bp, Artificial
  CRISPR gRNA sequence
tggactttgggccatatcta

SEQ ID NO: 34246 - DNA, 20 bp, Artificial
  CRISPR gRNA sequence
ggactttgggccatatctat

SEQ ID NO: 34247 - DNA, 20 bp, Artificial
  CRISPR gRNA sequence
gactttgggccatatctata

SEQ ID NO: 34248 - DNA, 20 bp, Artificial
  CRISPR gRNA sequence
tgggccatatctataaaatg

SEQ ID NO: 34249 - DNA, 20 bp, Artificial
  CRISPR gRNA sequence
gggccatatctataaaatga

SEQ ID NO: 34250 - DNA, 20 bp, Artificial
  CRISPR gRNA sequence
ggccatatctataaaatgat

SEQ ID NO: 34251 - DNA, 20 bp, Artificial
  CRISPR gRNA sequence
taaaatgattccatatctat

SEQ ID NO: 34252 - DNA, 20 bp, Artificial
  CRISPR gRNA sequence
catatctataacatttctat

SEQ ID NO: 34253 - DNA, 20 bp, Artificial
  CRISPR gRNA sequence
taacatttctataagataat

SEQ ID NO: 34254 - DNA, 20 bp, Artificial
  CRISPR gRNA sequence
ctataagataattccatatc

SEQ ID NO: 34255 - DNA, 20 bp, Artificial
  CRISPR gRNA sequence
tataagataattccatatct

SEQ ID NO: 34256 - DNA, 20 bp, Artificial
  CRISPR gRNA sequence
taagataattccatatctat

SEQ ID NO: 34257 - DNA, 20 bp, Artificial
  CRISPR gRNA sequence
catatctataaaataataag

SEQ ID NO: 34258 - DNA, 20 bp, Artificial
  CRISPR gRNA sequence
taaaataataagttacccaa

SEQ ID NO: 34259 - DNA, 20 bp, Artificial
  CRISPR gRNA sequence
cccaaactcagttttctcac

SEQ ID NO: 34260 - DNA, 20 bp, Artificial
  CRISPR gRNA sequence
agttttctcacagggcattg

SEQ ID NO: 34261 - DNA, 20 bp, Artificial
  CRISPR gRNA sequence
tctcacagggcattgggtct

SEQ ID NO: 34262 - DNA, 20 bp, Artificial
  CRISPR gRNA sequence
ctcacagggcattgggtctg

SEQ ID NO: 34263 - DNA, 20 bp, Artificial
  CRISPR gRNA sequence
tcacagggcattgggtctgc

SEQ ID NO: 34264 - DNA, 20 bp, Artificial
  CRISPR gRNA sequence
acagggcattgggtctgcca

SEQ ID NO: 34265 - DNA, 20 bp, Artificial
  CRISPR gRNA sequence
ggtctgccagggaccttcaa

SEQ ID NO: 34266 - DNA, 20 bp, Artificial
  CRISPR gRNA sequence
ccagggaccttcaagcttga

SEQ ID NO: 34267 - DNA, 20 bp, Artificial
  CRISPR gRNA sequence
caagcttgacctctttcctt

SEQ ID NO: 34268 - DNA, 20 bp, Artificial
  CRISPR gRNA sequence
aagcttgacctctttccttc

SEQ ID NO: 34269 - DNA, 20 bp, Artificial
  CRISPR gRNA sequence
gacctctttccttcactctg

SEQ ID NO: 34270 - DNA, 20 bp, Artificial
  CRISPR gRNA sequence
acctctttccttcactctgc

SEQ ID NO: 34271 - DNA, 20 bp, Artificial
  CRISPR gRNA sequence
tttccttcactctgcagatg

SEQ ID NO: 34272 - DNA, 20 bp, Artificial
  CRISPR gRNA sequence
tccttcactctgcagatgac

SEQ ID NO: 34273 - DNA, 20 bp, Artificial
  CRISPR gRNA sequence
ccttcactctgcagatgaca

SEQ ID NO: 34274 - DNA, 20 bp, Artificial
  CRISPR gRNA sequence
cttcactctgcagatgacaa

SEQ ID NO: 34275 - DNA, 20 bp, Artificial
  CRISPR gRNA sequence
cactctgcagatgacaagac

SEQ ID NO: 34276 - DNA, 20 bp, Artificial
  CRISPR gRNA sequence
actctgcagatgacaagact

SEQ ID NO: 34277 - DNA, 20 bp, Artificial
  CRISPR gRNA sequence
tgcagatgacaagactgaga

SEQ ID NO: 34278 - DNA, 20 bp, Artificial
  CRISPR gRNA sequence
cagatgacaagactgagacc

SEQ ID NO: 34279 - DNA, 20 bp, Artificial
  CRISPR gRNA sequence
agaccccgggaaggacgtga

SEQ ID NO: 34280 - DNA, 20 bp, Artificial
  CRISPR gRNA sequence
gcacaagacctcatagcctg

SEQ ID NO: 34281 - DNA, 20 bp, Artificial
  CRISPR gRNA sequence
cacaagacctcatagcctgt

SEQ ID NO: 34282 - DNA, 20 bp, Artificial
  CRISPR gRNA sequence
atagcctgtcggtggctgcc

SEQ ID NO: 34283 - DNA, 20 bp, Artificial
  CRISPR gRNA sequence
tcggtggctgcccctgcccc

SEQ ID NO: 34284 - DNA, 20 bp, Artificial
  CRISPR gRNA sequence
cccctgccccttctccccca

SEQ ID NO: 34285 - DNA, 20 bp, Artificial
  CRISPR gRNA sequence
ccccttctcccccactcccc

SEQ ID NO: 34286 - DNA, 20 bp, Artificial
  CRISPR gRNA sequence
ctcccccactccccctgcca

SEQ ID NO: 34287 - DNA, 20 bp, Artificial
  CRISPR gRNA sequence
tcccccactccccctgccaa

SEQ ID NO: 34288 - DNA, 20 bp, Artificial
  CRISPR gRNA sequence
ccccactccccctgccaaga

SEQ ID NO: 34289 - DNA, 20 bp, Artificial
  CRISPR gRNA sequence
cccctgccaagactcccagg

SEQ ID NO: 34290 - DNA, 20 bp, Artificial
  CRISPR gRNA sequence
ccaagactcccaggctggtg

SEQ ID NO: 34291 - DNA, 20 bp, Artificial
  CRISPR gRNA sequence
ccaggctggtgctctttccc

SEQ ID NO: 34292 - DNA, 20 bp, Artificial
  CRISPR gRNA sequence
gtgctctttccccccagtca

SEQ ID NO: 34293 - DNA, 20 bp, Artificial
  CRISPR gRNA sequence
tttccccccagtcaaaatgt

SEQ ID NO: 34294 - DNA, 20 bp, Artificial
  CRISPR gRNA sequence
tccccccagtcaaaatgttc

SEQ ID NO: 34295 - DNA, 20 bp, Artificial
  CRISPR gRNA sequence
ccccccagtcaaaatgttcc

SEQ ID NO: 34296 - DNA, 20 bp, Artificial
  CRISPR gRNA sequence
cccccagtcaaaatgttccc

SEQ ID NO: 34297 - DNA, 20 bp, Artificial
  CRISPR gRNA sequence
ccaatgaaatgatcaccctt

SEQ ID NO: 34298 - DNA, 20 bp, Artificial
  CRISPR gRNA sequence
gtcctgtctgggctcaagca

SEQ ID NO: 34299 - DNA, 20 bp, Artificial
  CRISPR gRNA sequence
tcctgtctgggctcaagcat

SEQ ID NO: 34300 - DNA, 20 bp, Artificial
  CRISPR gRNA sequence
tctgggctcaagcatagaga

SEQ ID NO: 34301 - DNA, 20 bp, Artificial
  CRISPR gRNA sequence
ggctcaagcatagagacaca

SEQ ID NO: 34302 - DNA, 20 bp, Artificial
  CRISPR gRNA sequence
aagcatagagacacaggtgg

SEQ ID NO: 34303 - DNA, 20 bp, Artificial
  CRISPR gRNA sequence
gagacatttagcccaccccc

SEQ ID NO: 34304 - DNA, 20 bp, Artificial
  CRISPR gRNA sequence
agcccacccccacttattga

SEQ ID NO: 34305 - DNA, 20 bp, Artificial
  CRISPR gRNA sequence
gcccacccccacttattgat

SEQ ID NO: 34306 - DNA, 20 bp, Artificial
  CRISPR gRNA sequence
attgatgagctctgcttcaa

SEQ ID NO: 34307 - DNA, 20 bp, Artificial
  CRISPR gRNA sequence
ttgatgagctctgcttcaaa

SEQ ID NO: 34308 - DNA, 20 bp, Artificial
  CRISPR gRNA sequence
atgagctctgcttcaaactc

SEQ ID NO: 34309 - DNA, 20 bp, Artificial
  CRISPR gRNA sequence
tgcttcaaactctggatgac

SEQ ID NO: 34310 - DNA, 20 bp, Artificial
  CRISPR gRNA sequence
cttcaaactctggatgacac

SEQ ID NO: 34311 - DNA, 20 bp, Artificial
  CRISPR gRNA sequence
caaactctggatgacactgc

SEQ ID NO: 34312 - DNA, 20 bp, Artificial
  CRISPR gRNA sequence
aaactctggatgacactgct

SEQ ID NO: 34313 - DNA, 20 bp, Artificial
  CRISPR gRNA sequence
tggatgacactgctgtgtgg

SEQ ID NO: 34314 - DNA, 20 bp, Artificial
  CRISPR gRNA sequence
gatgacactgctgtgtggtt

SEQ ID NO: 34315 - DNA, 20 bp, Artificial
  CRISPR gRNA sequence
ctgtgtggttaagcacacag

SEQ ID NO: 34316 - DNA, 20 bp, Artificial
  CRISPR gRNA sequence
tgtggttaagcacacagtca

SEQ ID NO: 34317 - DNA, 20 bp, Artificial
  CRISPR gRNA sequence
agcacacagtcagagaaata

SEQ ID NO: 34318 - DNA, 20 bp, Artificial
  CRISPR gRNA sequence
agaagggaaagaaggcaagt

SEQ ID NO: 34319 - DNA, 20 bp, Artificial
  CRISPR gRNA sequence
tggcgtaaaatttaccaact

SEQ ID NO: 34320 - DNA, 20 bp, Artificial
  CRISPR gRNA sequence
ggcgtaaaatttaccaactt

SEQ ID NO: 34321 - DNA, 20 bp, Artificial
  CRISPR gRNA sequence
gcgtaaaatttaccaacttt

SEQ ID NO: 34322 - DNA, 20 bp, Artificial
  CRISPR gRNA sequence
accaactttgagactacccc

SEQ ID NO: 34323 - DNA, 20 bp, Artificial
  CRISPR gRNA sequence
ccaactttgagactacccct

SEQ ID NO: 34324 - DNA, 20 bp, Artificial
  CRISPR gRNA sequence
tgagactacccctacctacc

SEQ ID NO: 34325 - DNA, 20 bp, Artificial
  CRISPR gRNA sequence
gagactacccctacctacca

SEQ ID NO: 34326 - DNA, 20 bp, Artificial
  CRISPR gRNA sequence
agactacccctacctaccaa

SEQ ID NO: 34327 - DNA, 20 bp, Artificial
  CRISPR gRNA sequence
cccctacctaccaacacact

SEQ ID NO: 34328 - DNA, 20 bp, Artificial
  CRISPR gRNA sequence
cctaccaacacactgtaacc

SEQ ID NO: 34329 - DNA, 20 bp, Artificial
  CRISPR gRNA sequence
ccaacacactgtaacctggg

SEQ ID NO: 34330 - DNA, 20 bp, Artificial
  CRISPR gRNA sequence
taacctgggcaagttcattt

SEQ ID NO: 34331 - DNA, 20 bp, Artificial
  CRISPR gRNA sequence
ggcaagttcattttttaaac

SEQ ID NO: 34332 - DNA, 20 bp, Artificial
  CRISPR gRNA sequence
attttttaaaccacttggag

SEQ ID NO: 34333 - DNA, 20 bp, Artificial
  CRISPR gRNA sequence
tttaaaccacttggagcctc

SEQ ID NO: 34334 - DNA, 20 bp, Artificial
  CRISPR gRNA sequence
ttaaaccacttggagcctca

SEQ ID NO: 34335 - DNA, 20 bp, Artificial
  CRISPR gRNA sequence
taaaccacttggagcctcag

SEQ ID NO: 34336 - DNA, 20 bp, Artificial
  CRISPR gRNA sequence
aaaccacttggagcctcagt

SEQ ID NO: 34337 - DNA, 20 bp, Artificial
  CRISPR gRNA sequence
aaccacttggagcctcagtt

SEQ ID NO: 34338 - DNA, 20 bp, Artificial
  CRISPR gRNA sequence
ggagcctcagtttccatatc

SEQ ID NO: 34339 - DNA, 20 bp, Artificial
  CRISPR gRNA sequence
gagcctcagtttccatatct

SEQ ID NO: 34340 - DNA, 20 bp, Artificial
  CRISPR gRNA sequence
agtttccatatctataaaat

SEQ ID NO: 34341 - DNA, 20 bp, Artificial
  CRISPR gRNA sequence
ccatatctataaaatgcgaa

SEQ ID NO: 34342 - DNA, 20 bp, Artificial
  CRISPR gRNA sequence
catatctataaaatgcgaat

SEQ ID NO: 34343 - DNA, 20 bp, Artificial
  CRISPR gRNA sequence
taaaatgcgaataataattg

SEQ ID NO: 34344 - DNA, 20 bp, Artificial
  CRISPR gRNA sequence
gcaactcacaaggattaggg

SEQ ID NO: 34345 - DNA, 20 bp, Artificial
  CRISPR gRNA sequence
acaaggattaggggagttaa

SEQ ID NO: 34346 - DNA, 20 bp, Artificial
  CRISPR gRNA sequence
ggggagttaagtcacgcgga

SEQ ID NO: 34347 - DNA, 20 bp, Artificial
  CRISPR gRNA sequence
agtcacgcggagcccttagc

SEQ ID NO: 34348 - DNA, 20 bp, Artificial
  CRISPR gRNA sequence
agcaatgggactggcaatca

SEQ ID NO: 34349 - DNA, 20 bp, Artificial
  CRISPR gRNA sequence
gcaatgggactggcaatcag

SEQ ID NO: 34350 - DNA, 20 bp, Artificial
  CRISPR gRNA sequence
gcaatcagtaagtgctgaat

SEQ ID NO: 34351 - DNA, 20 bp, Artificial
  CRISPR gRNA sequence
aatgaacagaagtttaaggc

SEQ ID NO: 34352 - DNA, 20 bp, Artificial
  CRISPR gRNA sequence
aaggcagcacagcttctaca

SEQ ID NO: 34353 - DNA, 20 bp, Artificial
  CRISPR gRNA sequence
aggcagcacagcttctacat

SEQ ID NO: 34354 - DNA, 20 bp, Artificial
  CRISPR gRNA sequence
ctacatggtgagtataatat

SEQ ID NO: 34355 - DNA, 20 bp, Artificial
  CRISPR gRNA sequence
tacatggtgagtataatatg

SEQ ID NO: 34356 - DNA, 20 bp, Artificial
  CRISPR gRNA sequence
catggtgagtataatatgtg

SEQ ID NO: 34357 - DNA, 20 bp, Artificial
  CRISPR gRNA sequence
ttagtttgcttcttacgttt

SEQ ID NO: 34358 - DNA, 20 bp, Artificial
  CRISPR gRNA sequence
gtttgcttcttacgtttgtg

SEQ ID NO: 34359 - DNA, 20 bp, Artificial
  CRISPR gRNA sequence
gcttcttacgtttgtgagag

SEQ ID NO: 34360 - DNA, 20 bp, Artificial
  CRISPR gRNA sequence
cttcttacgtttgtgagagt

SEQ ID NO: 34361 - DNA, 20 bp, Artificial
  CRISPR gRNA sequence
cttacgtttgtgagagtgac

SEQ ID NO: 34362 - DNA, 20 bp, Artificial
  CRISPR gRNA sequence
ttacgtttgtgagagtgaca

SEQ ID NO: 34363 - DNA, 20 bp, Artificial
  CRISPR gRNA sequence
acgtttgtgagagtgacaaa

SEQ ID NO: 34364 - DNA, 20 bp, Artificial
  CRISPR gRNA sequence
cgtttgtgagagtgacaaag

SEQ ID NO: 34365 - DNA, 20 bp, Artificial
  CRISPR gRNA sequence
gtgagagtgacaaagggacc

SEQ ID NO: 34366 - DNA, 20 bp, Artificial
  CRISPR gRNA sequence
tgagagtgacaaagggaccc

SEQ ID NO: 34367 - DNA, 20 bp, Artificial
  CRISPR gRNA sequence
tcccttccatttcttccgag

SEQ ID NO: 34368 - DNA, 20 bp, Artificial
  CRISPR gRNA sequence
cccttccatttcttccgagg

SEQ ID NO: 34369 - DNA, 20 bp, Artificial
  CRISPR gRNA sequence
ccttccatttcttccgaggt

SEQ ID NO: 34370 - DNA, 20 bp, Artificial
  CRISPR gRNA sequence
ccatttcttccgaggtcaaa

SEQ ID NO: 34371 - DNA, 20 bp, Artificial
  CRISPR gRNA sequence
catttcttccgaggtcaaac

SEQ ID NO: 34372 - DNA, 20 bp, Artificial
  CRISPR gRNA sequence
cttccgaggtcaaactttgt

SEQ ID NO: 34373 - DNA, 20 bp, Artificial
  CRISPR gRNA sequence
ttccgaggtcaaactttgtg

SEQ ID NO: 34374 - DNA, 20 bp, Artificial
  CRISPR gRNA sequence
ccgaggtcaaactttgtgaa

SEQ ID NO: 34375 - DNA, 20 bp, Artificial
  CRISPR gRNA sequence
cgaggtcaaactttgtgaag

SEQ ID NO: 34376 - DNA, 20 bp, Artificial
  CRISPR gRNA sequence
tgtgaagccgagctttctgt

SEQ ID NO: 34377 - DNA, 20 bp, Artificial
  CRISPR gRNA sequence
gtgaagccgagctttctgtt

SEQ ID NO: 34378 - DNA, 20 bp, Artificial
  CRISPR gRNA sequence
tgaagccgagctttctgttc

SEQ ID NO: 34379 - DNA, 20 bp, Artificial
  CRISPR gRNA sequence
tctgttcttttgcataaggg

SEQ ID NO: 34380 - DNA, 20 bp, Artificial
  CRISPR gRNA sequence
ctgttcttttgcataagggg

SEQ ID NO: 34381 - DNA, 20 bp, Artificial
  CRISPR gRNA sequence
tgttcttttgcataagggga

SEQ ID NO: 34382 - DNA, 20 bp, Artificial
  CRISPR gRNA sequence
ttcttttgcataaggggacc

SEQ ID NO: 34383 - DNA, 20 bp, Artificial
  CRISPR gRNA sequence
ttttgcataaggggaccctg

SEQ ID NO: 34384 - DNA, 20 bp, Artificial
  CRISPR gRNA sequence
ttgcataaggggaccctgca

SEQ ID NO: 34385 - DNA, 20 bp, Artificial
  CRISPR gRNA sequence
tgcataaggggaccctgcag

SEQ ID NO: 34386 - DNA, 20 bp, Artificial
  CRISPR gRNA sequence
gcataaggggaccctgcaga

SEQ ID NO: 34387 - DNA, 20 bp, Artificial
  CRISPR gRNA sequence
cataaggggaccctgcagac

SEQ ID NO: 34388 - DNA, 20 bp, Artificial
  CRISPR gRNA sequence
cagacttcataggaacaaga

SEQ ID NO: 34389 - DNA, 20 bp, Artificial
  CRISPR gRNA sequence
cataggaacaagaagggccc

SEQ ID NO: 34390 - DNA, 20 bp, Artificial
  CRISPR gRNA sequence
ataggaacaagaagggcccc

SEQ ID NO: 34391 - DNA, 20 bp, Artificial
  CRISPR gRNA sequence
acatctgtagaaattccagc

SEQ ID NO: 34392 - DNA, 20 bp, Artificial
  CRISPR gRNA sequence
tagaaattccagcactttgg

SEQ ID NO: 34393 - DNA, 20 bp, Artificial
  CRISPR gRNA sequence
cagcactttgggagtccaag

SEQ ID NO: 34394 - DNA, 20 bp, Artificial
  CRISPR gRNA sequence
tgggagtccaaggcaggagt

SEQ ID NO: 34395 - DNA, 20 bp, Artificial
  CRISPR gRNA sequence
gggagtccaaggcaggagta

SEQ ID NO: 34396 - DNA, 20 bp, Artificial
  CRISPR gRNA sequence
ggagtccaaggcaggagtat

SEQ ID NO: 34397 - DNA, 20 bp, Artificial
  CRISPR gRNA sequence
agtccaggagtttgagacca

SEQ ID NO: 34398 - DNA, 20 bp, Artificial
  CRISPR gRNA sequence
gagaccagcctgggcaacat

SEQ ID NO: 34399 - DNA, 20 bp, Artificial
  CRISPR gRNA sequence
agaccagcctgggcaacatg

SEQ ID NO: 34400 - DNA, 20 bp, Artificial
  CRISPR gRNA sequence
ggcaacatggtgaagcccta

SEQ ID NO: 34401 - DNA, 20 bp, Artificial
  CRISPR gRNA sequence
tctctacaaataacacaaaa

SEQ ID NO: 34402 - DNA, 20 bp, Artificial
  CRISPR gRNA sequence
tacaaataacacaaaactta

SEQ ID NO: 34403 - DNA, 20 bp, Artificial
  CRISPR gRNA sequence
caaataacacaaaacttagc

SEQ ID NO: 34404 - DNA, 20 bp, Artificial
  CRISPR gRNA sequence
agctgggcgtggtgatgtgc

SEQ ID NO: 34405 - DNA, 20 bp, Artificial
  CRISPR gRNA sequence
gctgggcgtggtgatgtgca

SEQ ID NO: 34406 - DNA, 20 bp, Artificial
  CRISPR gRNA sequence
ggcgtggtgatgtgcatctg

SEQ ID NO: 34407 - DNA, 20 bp, Artificial
  CRISPR gRNA sequence
tagaaccagctactcaggag

SEQ ID NO: 34408 - DNA, 20 bp, Artificial
  CRISPR gRNA sequence
ctcaggaggctgaggtggga

SEQ ID NO: 34409 - DNA, 20 bp, Artificial
  CRISPR gRNA sequence
aggaggctgaggtgggagga

SEQ ID NO: 34410 - DNA, 20 bp, Artificial
  CRISPR gRNA sequence
aggtgggaggatagcttgag

SEQ ID NO: 34411 - DNA, 20 bp, Artificial
  CRISPR gRNA sequence
gagcctggggaggtgtcaag

SEQ ID NO: 34412 - DNA, 20 bp, Artificial
  CRISPR gRNA sequence
agcctggggaggtgtcaagg

SEQ ID NO: 34413 - DNA, 20 bp, Artificial
  CRISPR gRNA sequence
gggaggtgtcaaggctgcag

SEQ ID NO: 34414 - DNA, 20 bp, Artificial
  CRISPR gRNA sequence
cagtgaactgagattgcacc

SEQ ID NO: 34415 - DNA, 20 bp, Artificial
  CRISPR gRNA sequence
agattgcaccactgcactcc

SEQ ID NO: 34416 - DNA, 20 bp, Artificial
  CRISPR gRNA sequence
caccactgcactccagcctg

SEQ ID NO: 34417 - DNA, 20 bp, Artificial
  CRISPR gRNA sequence
cactccagcctgggtgatag

SEQ ID NO: 34418 - DNA, 20 bp, Artificial
  CRISPR gRNA sequence
cagcctgggtgatagagcca

SEQ ID NO: 34419 - DNA, 20 bp, Artificial
  CRISPR gRNA sequence
ggtgatagagccagactgtg

SEQ ID NO: 34420 - DNA, 20 bp, Artificial
  CRISPR gRNA sequence
tgtctcagaaaaaaaaaaaa

SEQ ID NO: 34421 - DNA, 20 bp, Artificial
  CRISPR gRNA sequence
agaaaaaaaaaaaaggcccc

SEQ ID NO: 34422 - DNA, 20 bp, Artificial
  CRISPR gRNA sequence
ggatggtctggccacgctcc

SEQ ID NO: 34423 - DNA, 20 bp, Artificial
  CRISPR gRNA sequence
gatggtctggccacgctccc

SEQ ID NO: 34424 - DNA, 20 bp, Artificial
  CRISPR gRNA sequence
gccacgctccccatcaccac

SEQ ID NO: 34425 - DNA, 20 bp, Artificial
  CRISPR gRNA sequence
cccatcaccaccactgagaa

SEQ ID NO: 34426 - DNA, 20 bp, Artificial
  CRISPR gRNA sequence
agaagttgcctgggcaaaaa

SEQ ID NO: 34427 - DNA, 20 bp, Artificial
  CRISPR gRNA sequence
cctgggcaaaaagtcaccag

SEQ ID NO: 34428 - DNA, 20 bp, Artificial
  CRISPR gRNA sequence
ggcaaaaagtcaccagaggg

SEQ ID NO: 34429 - DNA, 20 bp, Artificial
  CRISPR gRNA sequence
agatctgcgtcattggctca

SEQ ID NO: 34430 - DNA, 20 bp, Artificial
  CRISPR gRNA sequence
cgtcattggctcaacctgga

SEQ ID NO: 34431 - DNA, 20 bp, Artificial
  CRISPR gRNA sequence
gctcaacctggacaagaaga

SEQ ID NO: 34432 - DNA, 20 bp, Artificial
  CRISPR gRNA sequence
aacctggacaagaagaaacc

SEQ ID NO: 34433 - DNA, 20 bp, Artificial
  CRISPR gRNA sequence
gacaagaagaaaccccctcc

SEQ ID NO: 34434 - DNA, 20 bp, Artificial
  CRISPR gRNA sequence
ccagaagcccccaatacaca

SEQ ID NO: 34435 - DNA, 20 bp, Artificial
  CRISPR gRNA sequence
cagcgccccacttcctgctt

SEQ ID NO: 34436 - DNA, 20 bp, Artificial
  CRISPR gRNA sequence
agcgccccacttcctgcttc

SEQ ID NO: 34437 - DNA, 20 bp, Artificial
  CRISPR gRNA sequence
cctgcttccctaagactgaa

SEQ ID NO: 34438 - DNA, 20 bp, Artificial
  CRISPR gRNA sequence
ctgcttccctaagactgaag

SEQ ID NO: 34439 - DNA, 20 bp, Artificial
  CRISPR gRNA sequence
cttccctaagactgaagcct

SEQ ID NO: 34440 - DNA, 20 bp, Artificial
  CRISPR gRNA sequence
ccctaagactgaagcctgca

SEQ ID NO: 34441 - DNA, 20 bp, Artificial
  CRISPR gRNA sequence
cctaagactgaagcctgcac

SEQ ID NO: 34442 - DNA, 20 bp, Artificial
  CRISPR gRNA sequence
agactgaagcctgcacctta

SEQ ID NO: 34443 - DNA, 20 bp, Artificial
  CRISPR gRNA sequence
aagcctgcaccttaagcact

SEQ ID NO: 34444 - DNA, 20 bp, Artificial
  CRISPR gRNA sequence
caccttaagcacttcctctt

SEQ ID NO: 34445 - DNA, 20 bp, Artificial
  CRISPR gRNA sequence
aagcacttcctcttgggtga

SEQ ID NO: 34446 - DNA, 20 bp, Artificial
  CRISPR gRNA sequence
agcacttcctcttgggtgat

SEQ ID NO: 34447 - DNA, 20 bp, Artificial
  CRISPR gRNA sequence
cctcttgggtgatcaaggat

SEQ ID NO: 34448 - DNA, 20 bp, Artificial
  CRISPR gRNA sequence
ctcttgggtgatcaaggatt

SEQ ID NO: 34449 - DNA, 20 bp, Artificial
  CRISPR gRNA sequence
ttgggtgatcaaggatttgc

SEQ ID NO: 34450 - DNA, 20 bp, Artificial
  CRISPR gRNA sequence
gggtgatcaaggatttgcag

SEQ ID NO: 34451 - DNA, 20 bp, Artificial
  CRISPR gRNA sequence
ggtgatcaaggatttgcagc

SEQ ID NO: 34452 - DNA, 20 bp, Artificial
  CRISPR gRNA sequence
gcagctcacagtggacttct

SEQ ID NO: 34453 - DNA, 20 bp, Artificial
  CRISPR gRNA sequence
cagctcacagtggacttctg

SEQ ID NO: 34454 - DNA, 20 bp, Artificial
  CRISPR gRNA sequence
acagtggacttctgcctcca

SEQ ID NO: 34455 - DNA, 20 bp, Artificial
  CRISPR gRNA sequence
ctgcctccatcctccacacc

SEQ ID NO: 34456 - DNA, 20 bp, Artificial
  CRISPR gRNA sequence
tgcctccatcctccacacca

SEQ ID NO: 34457 - DNA, 20 bp, Artificial
  CRISPR gRNA sequence
cctccatcctccacaccatc

SEQ ID NO: 34458 - DNA, 20 bp, Artificial
  CRISPR gRNA sequence
catcctccacaccatctgag

SEQ ID NO: 34459 - DNA, 20 bp, Artificial
  CRISPR gRNA sequence
cacaccatctgagttcccaa

SEQ ID NO: 34460 - DNA, 20 bp, Artificial
  CRISPR gRNA sequence
agttcccaaaaagctctggg

SEQ ID NO: 34461 - DNA, 20 bp, Artificial
  CRISPR gRNA sequence
ccaaaaagctctggggaaaa

SEQ ID NO: 34462 - DNA, 20 bp, Artificial
  CRISPR gRNA sequence
tggggaaaaggcagggtaga

SEQ ID NO: 34463 - DNA, 20 bp, Artificial
  CRISPR gRNA sequence
gggaaaaggcagggtagagt

SEQ ID NO: 34464 - DNA, 20 bp, Artificial
  CRISPR gRNA sequence
tgcccatttgagcttagagg

SEQ ID NO: 34465 - DNA, 20 bp, Artificial
  CRISPR gRNA sequence
gagcttagaggaggttcaca

SEQ ID NO: 34466 - DNA, 20 bp, Artificial
  CRISPR gRNA sequence
agcttagaggaggttcacac

SEQ ID NO: 34467 - DNA, 20 bp, Artificial
  CRISPR gRNA sequence
agaggaggttcacacgcctc

SEQ ID NO: 34468 - DNA, 20 bp, Artificial
  CRISPR gRNA sequence
gaggaggttcacacgcctca

SEQ ID NO: 34469 - DNA, 20 bp, Artificial
  CRISPR gRNA sequence
acacgcctcagtgaaatggc

SEQ ID NO: 34470 - DNA, 20 bp, Artificial
  CRISPR gRNA sequence
agtgaaatggcttgtccaag

SEQ ID NO: 34471 - DNA, 20 bp, Artificial
  CRISPR gRNA sequence
gtccaaggtcatgtggttta

SEQ ID NO: 34472 - DNA, 20 bp, Artificial
  CRISPR gRNA sequence
tccaaggtcatgtggtttag

SEQ ID NO: 34473 - DNA, 20 bp, Artificial
  CRISPR gRNA sequence
aggagcttgcatctgaattc

SEQ ID NO: 34474 - DNA, 20 bp, Artificial
  CRISPR gRNA sequence
ggagcttgcatctgaattct

SEQ ID NO: 34475 - DNA, 20 bp, Artificial
  CRISPR gRNA sequence
gcatctgaattctggctgtg

SEQ ID NO: 34476 - DNA, 20 bp, Artificial
  CRISPR gRNA sequence
catctgaattctggctgtga

SEQ ID NO: 34477 - DNA, 20 bp, Artificial
  CRISPR gRNA sequence
aattctggctgtgatgcctt

SEQ ID NO: 34478 - DNA, 20 bp, Artificial
  CRISPR gRNA sequence
tggctgtgatgccttagcca

SEQ ID NO: 34479 - DNA, 20 bp, Artificial
  CRISPR gRNA sequence
gctgtgatgccttagccaag

SEQ ID NO: 34480 - DNA, 20 bp, Artificial
  CRISPR gRNA sequence
tgatgccttagccaagtcac

SEQ ID NO: 34481 - DNA, 20 bp, Artificial
  CRISPR gRNA sequence
agccaagtcacttgacctct

SEQ ID NO: 34482 - DNA, 20 bp, Artificial
  CRISPR gRNA sequence
gccaagtcacttgacctctc

SEQ ID NO: 34483 - DNA, 20 bp, Artificial
  CRISPR gRNA sequence
gacctctctgaacatcagtt

SEQ ID NO: 34484 - DNA, 20 bp, Artificial
  CRISPR gRNA sequence
acctctctgaacatcagttt

SEQ ID NO: 34485 - DNA, 20 bp, Artificial
  CRISPR gRNA sequence
tctgaacatcagttttccca

SEQ ID NO: 34486 - DNA, 20 bp, Artificial
  CRISPR gRNA sequence
tgaacatcagttttcccaat

SEQ ID NO: 34487 - DNA, 20 bp, Artificial
  CRISPR gRNA sequence
aacatcagttttcccaatat

SEQ ID NO: 34488 - DNA, 20 bp, Artificial
  CRISPR gRNA sequence
tcccaatattagttctggag

SEQ ID NO: 34489 - DNA, 20 bp, Artificial
  CRISPR gRNA sequence
cccaatattagttctggaga

SEQ ID NO: 34490 - DNA, 20 bp, Artificial
  CRISPR gRNA sequence
ccaatattagttctggagaa

SEQ ID NO: 34491 - DNA, 20 bp, Artificial
  CRISPR gRNA sequence
gttctggagaatgaagattg

SEQ ID NO: 34492 - DNA, 20 bp, Artificial
  CRISPR gRNA sequence
tggagaatgaagattgcctt

SEQ ID NO: 34493 - DNA, 20 bp, Artificial
  CRISPR gRNA sequence
gagaatgaagattgccttgc

SEQ ID NO: 34494 - DNA, 20 bp, Artificial
  CRISPR gRNA sequence
ccttgcagcccaccactgtg

SEQ ID NO: 34495 - DNA, 20 bp, Artificial
  CRISPR gRNA sequence
gcagcccaccactgtgggag

SEQ ID NO: 34496 - DNA, 20 bp, Artificial
  CRISPR gRNA sequence
cagcccaccactgtgggagg

SEQ ID NO: 34497 - DNA, 20 bp, Artificial
  CRISPR gRNA sequence
tgggaggccgaggcaggcag

SEQ ID NO: 34498 - DNA, 20 bp, Artificial
  CRISPR gRNA sequence
gaggtcaggagtttgagacc

SEQ ID NO: 34499 - DNA, 20 bp, Artificial
  CRISPR gRNA sequence
aggtcaggagtttgagacca

SEQ ID NO: 34500 - DNA, 20 bp, Artificial
  CRISPR gRNA sequence
gagaccagcccgggcaacat

SEQ ID NO: 34501 - DNA, 20 bp, Artificial
  CRISPR gRNA sequence
agaccagcccgggcaacatg

SEQ ID NO: 34502 - DNA, 20 bp, Artificial
  CRISPR gRNA sequence
tactaaaaatacaaaattag

SEQ ID NO: 34503 - DNA, 20 bp, Artificial
  CRISPR gRNA sequence
ctaaaaatacaaaattagcc

SEQ ID NO: 34504 - DNA, 20 bp, Artificial
  CRISPR gRNA sequence
aaaatacaaaattagccagg

SEQ ID NO: 34505 - DNA, 20 bp, Artificial
  CRISPR gRNA sequence
gccaggcatggtggcgtgct

SEQ ID NO: 34506 - DNA, 20 bp, Artificial
  CRISPR gRNA sequence
ctgtaatcccagctacttgg

SEQ ID NO: 34507 - DNA, 20 bp, Artificial
  CRISPR gRNA sequence
tgtaatcccagctacttggg

SEQ ID NO: 34508 - DNA, 20 bp, Artificial
  CRISPR gRNA sequence
taatcccagctacttgggag

SEQ ID NO: 34509 - DNA, 20 bp, Artificial
  CRISPR gRNA sequence
cttgggaggctgaggcagga

SEQ ID NO: 34510 - DNA, 20 bp, Artificial
  CRISPR gRNA sequence
gggaggctgaggcaggagaa

SEQ ID NO: 34511 - DNA, 20 bp, Artificial
  CRISPR gRNA sequence
ggaggctgaggcaggagaat

SEQ ID NO: 34512 - DNA, 20 bp, Artificial
  CRISPR gRNA sequence
aggcaggagaatcgcttgaa

SEQ ID NO: 34513 - DNA, 20 bp, Artificial
  CRISPR gRNA sequence
gaacctgggaggcagaggct

SEQ ID NO: 34514 - DNA, 20 bp, Artificial
  CRISPR gRNA sequence
aacctgggaggcagaggctg

SEQ ID NO: 34515 - DNA, 20 bp, Artificial
  CRISPR gRNA sequence
ggaggcagaggctgcagtga

SEQ ID NO: 34516 - DNA, 20 bp, Artificial
  CRISPR gRNA sequence
cagtgaaccaagactgcgcc

SEQ ID NO: 34517 - DNA, 20 bp, Artificial
  CRISPR gRNA sequence
cgccactgcactccagcctg

SEQ ID NO: 34518 - DNA, 20 bp, Artificial
  CRISPR gRNA sequence
cactccagcctgggcgacaa

SEQ ID NO: 34519 - DNA, 20 bp, Artificial
  CRISPR gRNA sequence
cagcctgggcgacaaagtga

SEQ ID NO: 34520 - DNA, 20 bp, Artificial
  CRISPR gRNA sequence
ggcgacaaagtgagatacca

SEQ ID NO: 34521 - DNA, 20 bp, Artificial
  CRISPR gRNA sequence
aaaaaaaaaacaaaaaacaa

SEQ ID NO: 34522 - DNA, 20 bp, Artificial
  CRISPR gRNA sequence
tcctgcaggatcatcagaag

SEQ ID NO: 34523 - DNA, 20 bp, Artificial
  CRISPR gRNA sequence
caggatcatcagaaggccaa

SEQ ID NO: 34524 - DNA, 20 bp, Artificial
  CRISPR gRNA sequence
tgtgtggggtgccagctatg

SEQ ID NO: 34525 - DNA, 20 bp, Artificial
  CRISPR gRNA sequence
tgtggggtgccagctatgtg

SEQ ID NO: 34526 - DNA, 20 bp, Artificial
  CRISPR gRNA sequence
tgtgggaagcctacagtcaa

SEQ ID NO: 34527 - DNA, 20 bp, Artificial
  CRISPR gRNA sequence
cagtcaaaggaagcccatta

SEQ ID NO: 34528 - DNA, 20 bp, Artificial
  CRISPR gRNA sequence
cattagagggtgtcaaagct

SEQ ID NO: 34529 - DNA, 20 bp, Artificial
  CRISPR gRNA sequence
gagggtgtcaaagctgaaat

SEQ ID NO: 34530 - DNA, 20 bp, Artificial
  CRISPR gRNA sequence
aaattcaggcccaagactct

SEQ ID NO: 34531 - DNA, 20 bp, Artificial
  CRISPR gRNA sequence
aggcccaagactctaggttt

SEQ ID NO: 34532 - DNA, 20 bp, Artificial
  CRISPR gRNA sequence
taggtttccccacaacgcca

SEQ ID NO: 34533 - DNA, 20 bp, Artificial
  CRISPR gRNA sequence
ggtttccccacaacgccaca

SEQ ID NO: 34534 - DNA, 20 bp, Artificial
  CRISPR gRNA sequence
ccccacaacgccacagctgc

SEQ ID NO: 34535 - DNA, 20 bp, Artificial
  CRISPR gRNA sequence
cccacaacgccacagctgcc

SEQ ID NO: 34536 - DNA, 20 bp, Artificial
  CRISPR gRNA sequence
cctcccagtcacaccaagat

SEQ ID NO: 34537 - DNA, 20 bp, Artificial
  CRISPR gRNA sequence
ccagtcacaccaagatctac

SEQ ID NO: 34538 - DNA, 20 bp, Artificial
  CRISPR gRNA sequence
cttgaatcttggcatgggac

SEQ ID NO: 34539 - DNA, 20 bp, Artificial
  CRISPR gRNA sequence
gaatcttggcatgggacctt

SEQ ID NO: 34540 - DNA, 20 bp, Artificial
  CRISPR gRNA sequence
aatcttggcatgggaccttc

SEQ ID NO: 34541 - DNA, 20 bp, Artificial
  CRISPR gRNA sequence
ggcatgggaccttcctctat

SEQ ID NO: 34542 - DNA, 20 bp, Artificial
  CRISPR gRNA sequence
gcatgggaccttcctctatc

SEQ ID NO: 34543 - DNA, 20 bp, Artificial
  CRISPR gRNA sequence
cctctatccccagagccaag

SEQ ID NO: 34544 - DNA, 20 bp, Artificial
  CRISPR gRNA sequence
ctctatccccagagccaagt

SEQ ID NO: 34545 - DNA, 20 bp, Artificial
  CRISPR gRNA sequence
tatccccagagccaagtttc

SEQ ID NO: 34546 - DNA, 20 bp, Artificial
  CRISPR gRNA sequence
tccccagagccaagtttcct

SEQ ID NO: 34547 - DNA, 20 bp, Artificial
  CRISPR gRNA sequence
cctatgtctatagatgctta

SEQ ID NO: 34548 - DNA, 20 bp, Artificial
  CRISPR gRNA sequence
ctatgtctatagatgcttag

SEQ ID NO: 34549 - DNA, 20 bp, Artificial
  CRISPR gRNA sequence
tgtctatagatgcttaggaa

SEQ ID NO: 34550 - DNA, 20 bp, Artificial
  CRISPR gRNA sequence
tagatgcttaggaagtgctt

SEQ ID NO: 34551 - DNA, 20 bp, Artificial
  CRISPR gRNA sequence
aggaagtgcttcaaaggccc

SEQ ID NO: 34552 - DNA, 20 bp, Artificial
  CRISPR gRNA sequence
ggaagtgcttcaaaggcccc

SEQ ID NO: 34553 - DNA, 20 bp, Artificial
  CRISPR gRNA sequence
caaaggccccttcattggac

SEQ ID NO: 34554 - DNA, 20 bp, Artificial
  CRISPR gRNA sequence
aaaggccccttcattggact

SEQ ID NO: 34555 - DNA, 20 bp, Artificial
  CRISPR gRNA sequence
cattggactgtttctccaaa

SEQ ID NO: 34556 - DNA, 20 bp, Artificial
  CRISPR gRNA sequence
attggactgtttctccaaac

SEQ ID NO: 34557 - DNA, 20 bp, Artificial
  CRISPR gRNA sequence
gactgtttctccaaaccaca

SEQ ID NO: 34558 - DNA, 20 bp, Artificial
  CRISPR gRNA sequence
tttctccaaaccacattgcc

SEQ ID NO: 34559 - DNA, 20 bp, Artificial
  CRISPR gRNA sequence
ctccaaaccacattgccaga

SEQ ID NO: 34560 - DNA, 20 bp, Artificial
  CRISPR gRNA sequence
tccaaaccacattgccagag

SEQ ID NO: 34561 - DNA, 20 bp, Artificial
  CRISPR gRNA sequence
caaaccacattgccagagcg

SEQ ID NO: 34562 - DNA, 20 bp, Artificial
  CRISPR gRNA sequence
ccagagcgggatggagggaa

SEQ ID NO: 34563 - DNA, 20 bp, Artificial
  CRISPR gRNA sequence
atcatcccgtggcaggagag

SEQ ID NO: 34564 - DNA, 20 bp, Artificial
  CRISPR gRNA sequence
cagctctccctgagggcagg

SEQ ID NO: 34565 - DNA, 20 bp, Artificial
  CRISPR gRNA sequence
agctctccctgagggcaggg

SEQ ID NO: 34566 - DNA, 20 bp, Artificial
  CRISPR gRNA sequence
tccctgagggcagggactgt

SEQ ID NO: 34567 - DNA, 20 bp, Artificial
  CRISPR gRNA sequence
cctgagggcagggactgtat

SEQ ID NO: 34568 - DNA, 20 bp, Artificial
  CRISPR gRNA sequence
agggcagggactgtatccct

SEQ ID NO: 34569 - DNA, 20 bp, Artificial
  CRISPR gRNA sequence
tatccctctagctcaccttc

SEQ ID NO: 34570 - DNA, 20 bp, Artificial
  CRISPR gRNA sequence
tagctcaccttctcccagct

SEQ ID NO: 34571 - DNA, 20 bp, Artificial
  CRISPR gRNA sequence
gctcaccttctcccagctct

SEQ ID NO: 34572 - DNA, 20 bp, Artificial
  CRISPR gRNA sequence
accttctcccagctctcagc

SEQ ID NO: 34573 - DNA, 20 bp, Artificial
  CRISPR gRNA sequence
ctcccagctctcagcatgtt

SEQ ID NO: 34574 - DNA, 20 bp, Artificial
  CRISPR gRNA sequence
tcccagctctcagcatgttt

SEQ ID NO: 34575 - DNA, 20 bp, Artificial
  CRISPR gRNA sequence
ccagctctcagcatgtttct

SEQ ID NO: 34576 - DNA, 20 bp, Artificial
  CRISPR gRNA sequence
tcagcatgtttctgcgcatg

SEQ ID NO: 34577 - DNA, 20 bp, Artificial
  CRISPR gRNA sequence
agcatgtttctgcgcatggc

SEQ ID NO: 34578 - DNA, 20 bp, Artificial
  CRISPR gRNA sequence
ctgcgcatggcagcctctct

SEQ ID NO: 34579 - DNA, 20 bp, Artificial
  CRISPR gRNA sequence
tgcgcatggcagcctctctt

SEQ ID NO: 34580 - DNA, 20 bp, Artificial
  CRISPR gRNA sequence
cgcatggcagcctctcttca

SEQ ID NO: 34581 - DNA, 20 bp, Artificial
  CRISPR gRNA sequence
tcttcatccgtggcaatgat

SEQ ID NO: 34582 - DNA, 20 bp, Artificial
  CRISPR gRNA sequence
ttcatccgtggcaatgatat

SEQ ID NO: 34583 - DNA, 20 bp, Artificial
  CRISPR gRNA sequence
catccgtggcaatgatatag

SEQ ID NO: 34584 - DNA, 20 bp, Artificial
  CRISPR gRNA sequence
atccgtggcaatgatataga

SEQ ID NO: 34585 - DNA, 20 bp, Artificial
  CRISPR gRNA sequence
gaattcacagtgtccagcaa

SEQ ID NO: 34586 - DNA, 20 bp, Artificial
  CRISPR gRNA sequence
acagtgtccagcaagtgcca

SEQ ID NO: 34587 - DNA, 20 bp, Artificial
  CRISPR gRNA sequence
gtaggcattaccccatttgg

SEQ ID NO: 34588 - DNA, 20 bp, Artificial
  CRISPR gRNA sequence
ccccatttggtctaacttac

SEQ ID NO: 34589 - DNA, 20 bp, Artificial
  CRISPR gRNA sequence
ggtctaacttacacatcagc

SEQ ID NO: 34590 - DNA, 20 bp, Artificial
  CRISPR gRNA sequence
gtctaacttacacatcagct

SEQ ID NO: 34591 - DNA, 20 bp, Artificial
  CRISPR gRNA sequence
acttacacatcagctatttg

SEQ ID NO: 34592 - DNA, 20 bp, Artificial
  CRISPR gRNA sequence
acacatcagctatttgtatt

SEQ ID NO: 34593 - DNA, 20 bp, Artificial
  CRISPR gRNA sequence
cacatcagctatttgtattc

SEQ ID NO: 34594 - DNA, 20 bp, Artificial
  CRISPR gRNA sequence
tttgtattcctgtttttcag

SEQ ID NO: 34595 - DNA, 20 bp, Artificial
  CRISPR gRNA sequence
gtattcctgtttttcagatg

SEQ ID NO: 34596 - DNA, 20 bp, Artificial
  CRISPR gRNA sequence
tattcctgtttttcagatga

SEQ ID NO: 34597 - DNA, 20 bp, Artificial
  CRISPR gRNA sequence
ctgtttttcagatgaagaga

SEQ ID NO: 34598 - DNA, 20 bp, Artificial
  CRISPR gRNA sequence
tttttcagatgaagagacag

SEQ ID NO: 34599 - DNA, 20 bp, Artificial
  CRISPR gRNA sequence
ttcagatgaagagacaggct

SEQ ID NO: 34600 - DNA, 20 bp, Artificial
  CRISPR gRNA sequence
tcagatgaagagacaggctc

SEQ ID NO: 34601 - DNA, 20 bp, Artificial
  CRISPR gRNA sequence
cagatgaagagacaggctca

SEQ ID NO: 34602 - DNA, 20 bp, Artificial
  CRISPR gRNA sequence
agatgaagagacaggctcag

SEQ ID NO: 34603 - DNA, 20 bp, Artificial
  CRISPR gRNA sequence
agagggattagtgggctgag

SEQ ID NO: 34604 - DNA, 20 bp, Artificial
  CRISPR gRNA sequence
gtgggctgagatttgaacca

SEQ ID NO: 34605 - DNA, 20 bp, Artificial
  CRISPR gRNA sequence
agatttgaaccaaactaccc

SEQ ID NO: 34606 - DNA, 20 bp, Artificial
  CRISPR gRNA sequence
gaaccaaactacccatctcc

SEQ ID NO: 34607 - DNA, 20 bp, Artificial
  CRISPR gRNA sequence
aaccaaactacccatctcca

SEQ ID NO: 34608 - DNA, 20 bp, Artificial
  CRISPR gRNA sequence
cccatctccaaagtctcagc

SEQ ID NO: 34609 - DNA, 20 bp, Artificial
  CRISPR gRNA sequence
caaagtctcagcccactcta

SEQ ID NO: 34610 - DNA, 20 bp, Artificial
  CRISPR gRNA sequence
agcccactctatagcctttt

SEQ ID NO: 34611 - DNA, 20 bp, Artificial
  CRISPR gRNA sequence
tatagcctttttgaattgct

SEQ ID NO: 34612 - DNA, 20 bp, Artificial
  CRISPR gRNA sequence
tagcctttttgaattgctgt

SEQ ID NO: 34613 - DNA, 20 bp, Artificial
  CRISPR gRNA sequence
tttgaattgctgttggcccc

SEQ ID NO: 34614 - DNA, 20 bp, Artificial
  CRISPR gRNA sequence
ttgaattgctgttggccccc

SEQ ID NO: 34615 - DNA, 20 bp, Artificial
  CRISPR gRNA sequence
tgaattgctgttggcccccc

SEQ ID NO: 34616 - DNA, 20 bp, Artificial
  CRISPR gRNA sequence
gaattgctgttggcccccca

SEQ ID NO: 34617 - DNA, 20 bp, Artificial
  CRISPR gRNA sequence
aattgctgttggccccccag

SEQ ID NO: 34618 - DNA, 20 bp, Artificial
  CRISPR gRNA sequence
ctgttggccccccagcaccc

SEQ ID NO: 34619 - DNA, 20 bp, Artificial
  CRISPR gRNA sequence
ttggccccccagcaccccgg

SEQ ID NO: 34620 - DNA, 20 bp, Artificial
  CRISPR gRNA sequence
gccccccagcaccccggcga

SEQ ID NO: 34621 - DNA, 20 bp, Artificial
  CRISPR gRNA sequence
ctccttttgaggagccatgt

SEQ ID NO: 34622 - DNA, 20 bp, Artificial
  CRISPR gRNA sequence
tccttttgaggagccatgtg

SEQ ID NO: 34623 - DNA, 20 bp, Artificial
  CRISPR gRNA sequence
cttttgaggagccatgtggg

SEQ ID NO: 34624 - DNA, 20 bp, Artificial
  CRISPR gRNA sequence
ttgaggagccatgtgggggc

SEQ ID NO: 34625 - DNA, 20 bp, Artificial
  CRISPR gRNA sequence
tgaggagccatgtgggggca

SEQ ID NO: 34626 - DNA, 20 bp, Artificial
  CRISPR gRNA sequence
gaggagccatgtgggggcag

SEQ ID NO: 34627 - DNA, 20 bp, Artificial
  CRISPR gRNA sequence
aggagccatgtgggggcagg

SEQ ID NO: 34628 - DNA, 20 bp, Artificial
  CRISPR gRNA sequence
tgtctttttggtaaatgggc

SEQ ID NO: 34629 - DNA, 20 bp, Artificial
  CRISPR gRNA sequence
tttggtaaatgggcagtatt

SEQ ID NO: 34630 - DNA, 20 bp, Artificial
  CRISPR gRNA sequence
ttggtaaatgggcagtattt

SEQ ID NO: 34631 - DNA, 20 bp, Artificial
  CRISPR gRNA sequence
tggtaaatgggcagtatttt

SEQ ID NO: 34632 - DNA, 20 bp, Artificial
  CRISPR gRNA sequence
ggtaaatgggcagtattttt

SEQ ID NO: 34633 - DNA, 20 bp, Artificial
  CRISPR gRNA sequence
gtaaatgggcagtattttta

SEQ ID NO: 34634 - DNA, 20 bp, Artificial
  CRISPR gRNA sequence
ttagaaggtcctctttgaaa

SEQ ID NO: 34635 - DNA, 20 bp, Artificial
  CRISPR gRNA sequence
tagaaggtcctctttgaaac

SEQ ID NO: 34636 - DNA, 20 bp, Artificial
  CRISPR gRNA sequence
agaaggtcctctttgaaact

SEQ ID NO: 34637 - DNA, 20 bp, Artificial
  CRISPR gRNA sequence
gaaggtcctctttgaaactg

SEQ ID NO: 34638 - DNA, 20 bp, Artificial
  CRISPR gRNA sequence
tttgaaactgtgcttccccc

SEQ ID NO: 34639 - DNA, 20 bp, Artificial
  CRISPR gRNA sequence
tgaaactgtgcttccccctg

SEQ ID NO: 34640 - DNA, 20 bp, Artificial
  CRISPR gRNA sequence
gaaactgtgcttccccctgg

SEQ ID NO: 34641 - DNA, 20 bp, Artificial
  CRISPR gRNA sequence
aaactgtgcttccccctggg

SEQ ID NO: 34642 - DNA, 20 bp, Artificial
  CRISPR gRNA sequence
tgcttccccctgggccacca

SEQ ID NO: 34643 - DNA, 20 bp, Artificial
  CRISPR gRNA sequence
ccccctgggccaccaccttc

SEQ ID NO: 34644 - DNA, 20 bp, Artificial
  CRISPR gRNA sequence
cccctgggccaccaccttcc

SEQ ID NO: 34645 - DNA, 20 bp, Artificial
  CRISPR gRNA sequence
ggccaccaccttccacatcc

SEQ ID NO: 34646 - DNA, 20 bp, Artificial
  CRISPR gRNA sequence
ccacatccaactcgagaaaa

SEQ ID NO: 34647 - DNA, 20 bp, Artificial
  CRISPR gRNA sequence
cacatccaactcgagaaaat

SEQ ID NO: 34648 - DNA, 20 bp, Artificial
  CRISPR gRNA sequence
gagaaaatattcctgatctt

SEQ ID NO: 34649 - DNA, 20 bp, Artificial
  CRISPR gRNA sequence
ctgatctttttgccatcaaa

SEQ ID NO: 34650 - DNA, 20 bp, Artificial
  CRISPR gRNA sequence
atctttttgccatcaaaagt

SEQ ID NO: 34651 - DNA, 20 bp, Artificial
  CRISPR gRNA sequence
tttgccatcaaaagtccttt

SEQ ID NO: 34652 - DNA, 20 bp, Artificial
  CRISPR gRNA sequence
ttgccatcaaaagtcctttt

SEQ ID NO: 34653 - DNA, 20 bp, Artificial
  CRISPR gRNA sequence
tgccatcaaaagtccttttt

SEQ ID NO: 34654 - DNA, 20 bp, Artificial
  CRISPR gRNA sequence
gccatcaaaagtcctttttg

SEQ ID NO: 34655 - DNA, 20 bp, Artificial
  CRISPR gRNA sequence
ccatcaaaagtcctttttgg

SEQ ID NO: 34656 - DNA, 20 bp, Artificial
  CRISPR gRNA sequence
tttggggtttattttcatcc

SEQ ID NO: 34657 - DNA, 20 bp, Artificial
  CRISPR gRNA sequence
ttggggtttattttcatccc

SEQ ID NO: 34658 - DNA, 20 bp, Artificial
  CRISPR gRNA sequence
tggggtttattttcatcccc

SEQ ID NO: 34659 - DNA, 20 bp, Artificial
  CRISPR gRNA sequence
ggggtttattttcatcccca

SEQ ID NO: 34660 - DNA, 20 bp, Artificial
  CRISPR gRNA sequence
gggtttattttcatccccac

SEQ ID NO: 34661 - DNA, 20 bp, Artificial
  CRISPR gRNA sequence
attttcatccccacttcaca

SEQ ID NO: 34662 - DNA, 20 bp, Artificial
  CRISPR gRNA sequence
ttttcatccccacttcacac

SEQ ID NO: 34663 - DNA, 20 bp, Artificial
  CRISPR gRNA sequence
tcatccccacttcacactgc

SEQ ID NO: 34664 - DNA, 20 bp, Artificial
  CRISPR gRNA sequence
catccccacttcacactgca

SEQ ID NO: 34665 - DNA, 20 bp, Artificial
  CRISPR gRNA sequence
atccccacttcacactgcat

SEQ ID NO: 34666 - DNA, 20 bp, Artificial
  CRISPR gRNA sequence
cacactgcatgcaggatttg

SEQ ID NO: 34667 - DNA, 20 bp, Artificial
  CRISPR gRNA sequence
acactgcatgcaggatttga

SEQ ID NO: 34668 - DNA, 20 bp, Artificial
  CRISPR gRNA sequence
catgcaggatttgaaaggct

SEQ ID NO: 34669 - DNA, 20 bp, Artificial
  CRISPR gRNA sequence
gaaaggctaagtgtagacac

SEQ ID NO: 34670 - DNA, 20 bp, Artificial
  CRISPR gRNA sequence
aaaggctaagtgtagacact

SEQ ID NO: 34671 - DNA, 20 bp, Artificial
  CRISPR gRNA sequence
agtgtagacactaaacaggt

SEQ ID NO: 34672 - DNA, 20 bp, Artificial
  CRISPR gRNA sequence
aacaggtgtctgaaataaca

SEQ ID NO: 34673 - DNA, 20 bp, Artificial
  CRISPR gRNA sequence
aaataacaattcacctctct

SEQ ID NO: 34674 - DNA, 20 bp, Artificial
  CRISPR gRNA sequence
acctctctctcccccgaggg

SEQ ID NO: 34675 - DNA, 20 bp, Artificial
  CRISPR gRNA sequence
tctctcccccgagggaaatc

SEQ ID NO: 34676 - DNA, 20 bp, Artificial
  CRISPR gRNA sequence
tctcccccgagggaaatcag

SEQ ID NO: 34677 - DNA, 20 bp, Artificial
  CRISPR gRNA sequence
tcccccgagggaaatcaggt

SEQ ID NO: 34678 - DNA, 20 bp, Artificial
  CRISPR gRNA sequence
ccccgagggaaatcaggtgt

SEQ ID NO: 34679 - DNA, 20 bp, Artificial
  CRISPR gRNA sequence
taactcagacttaaactatc

SEQ ID NO: 34680 - DNA, 20 bp, Artificial
  CRISPR gRNA sequence
actcagacttaaactatctg

SEQ ID NO: 34681 - DNA, 20 bp, Artificial
  CRISPR gRNA sequence
agacttaaactatctgaaga

SEQ ID NO: 34682 - DNA, 20 bp, Artificial
  CRISPR gRNA sequence
aaactatctgaagatcagtg

SEQ ID NO: 34683 - DNA, 20 bp, Artificial
  CRISPR gRNA sequence
aactatctgaagatcagtgc

SEQ ID NO: 34684 - DNA, 20 bp, Artificial
  CRISPR gRNA sequence
tctgaagatcagtgcatgca

SEQ ID NO: 34685 - DNA, 20 bp, Artificial
  CRISPR gRNA sequence
aagatcagtgcatgcatctc

SEQ ID NO: 34686 - DNA, 20 bp, Artificial
  CRISPR gRNA sequence
ttctgggaacagcataacgt

SEQ ID NO: 34687 - DNA, 20 bp, Artificial
  CRISPR gRNA sequence
ctgggaacagcataacgttc

SEQ ID NO: 34688 - DNA, 20 bp, Artificial
  CRISPR gRNA sequence
tgggaacagcataacgttcc

SEQ ID NO: 34689 - DNA, 20 bp, Artificial
  CRISPR gRNA sequence
ggaacagcataacgttccat

SEQ ID NO: 34690 - DNA, 20 bp, Artificial
  CRISPR gRNA sequence
catctcagctggtgggagat

SEQ ID NO: 34691 - DNA, 20 bp, Artificial
  CRISPR gRNA sequence
agctggtgggagatgaatgg

SEQ ID NO: 34692 - DNA, 20 bp, Artificial
  CRISPR gRNA sequence
gtgggagatgaatggagctc

SEQ ID NO: 34693 - DNA, 20 bp, Artificial
  CRISPR gRNA sequence
agatggtgagctttggggtg

SEQ ID NO: 34694 - DNA, 20 bp, Artificial
  CRISPR gRNA sequence
tggggtgaaatttcccaact

SEQ ID NO: 34695 - DNA, 20 bp, Artificial
  CRISPR gRNA sequence
ggggtgaaatttcccaactt

SEQ ID NO: 34696 - DNA, 20 bp, Artificial
  CRISPR gRNA sequence
gggtgaaatttcccaacttt

SEQ ID NO: 34697 - DNA, 20 bp, Artificial
  CRISPR gRNA sequence
cccaactttcaggttatccc

SEQ ID NO: 34698 - DNA, 20 bp, Artificial
  CRISPR gRNA sequence
ccaactttcaggttatccct

SEQ ID NO: 34699 - DNA, 20 bp, Artificial
  CRISPR gRNA sequence
tcaggttatccctacctacc

SEQ ID NO: 34700 - DNA, 20 bp, Artificial
  CRISPR gRNA sequence
caggttatccctacctacca

SEQ ID NO: 34701 - DNA, 20 bp, Artificial
  CRISPR gRNA sequence
aggttatccctacctaccaa

SEQ ID NO: 34702 - DNA, 20 bp, Artificial
  CRISPR gRNA sequence
tccctacctaccaacgcact

SEQ ID NO: 34703 - DNA, 20 bp, Artificial
  CRISPR gRNA sequence
cctaccaacgcactacaatc

SEQ ID NO: 34704 - DNA, 20 bp, Artificial
  CRISPR gRNA sequence
ccaacgcactacaatctggg

SEQ ID NO: 34705 - DNA, 20 bp, Artificial
  CRISPR gRNA sequence
caatctgggtaagttcattt

SEQ ID NO: 34706 - DNA, 20 bp, Artificial
  CRISPR gRNA sequence
ggtaagttcattttttaaac

SEQ ID NO: 34707 - DNA, 20 bp, Artificial
  CRISPR gRNA sequence
attttttaaaccacttggag

SEQ ID NO: 34708 - DNA, 20 bp, Artificial
  CRISPR gRNA sequence
tttaaaccacttggagcctc

SEQ ID NO: 34709 - DNA, 20 bp, Artificial
  CRISPR gRNA sequence
ttaaaccacttggagcctca

SEQ ID NO: 34710 - DNA, 20 bp, Artificial
  CRISPR gRNA sequence
taaaccacttggagcctcag

SEQ ID NO: 34711 - DNA, 20 bp, Artificial
  CRISPR gRNA sequence
aaaccacttggagcctcagt

SEQ ID NO: 34712 - DNA, 20 bp, Artificial
  CRISPR gRNA sequence
aaccacttggagcctcagtt

SEQ ID NO: 34713 - DNA, 20 bp, Artificial
  CRISPR gRNA sequence
ggagcctcagtttccttatc

SEQ ID NO: 34714 - DNA, 20 bp, Artificial
  CRISPR gRNA sequence
gagcctcagtttccttatct

SEQ ID NO: 34715 - DNA, 20 bp, Artificial
  CRISPR gRNA sequence
agtttccttatctgtaaagt

SEQ ID NO: 34716 - DNA, 20 bp, Artificial
  CRISPR gRNA sequence
ccttatctgtaaagtggggg

SEQ ID NO: 34717 - DNA, 20 bp, Artificial
  CRISPR gRNA sequence
cttatctgtaaagtggggga

SEQ ID NO: 34718 - DNA, 20 bp, Artificial
  CRISPR gRNA sequence
atctgtaaagtgggggataa

SEQ ID NO: 34719 - DNA, 20 bp, Artificial
  CRISPR gRNA sequence
tctgtaaagtgggggataat

SEQ ID NO: 34720 - DNA, 20 bp, Artificial
  CRISPR gRNA sequence
taaagtgggggataataatt

SEQ ID NO: 34721 - DNA, 20 bp, Artificial
  CRISPR gRNA sequence
gcaactcataggattagggg

SEQ ID NO: 34722 - DNA, 20 bp, Artificial
  CRISPR gRNA sequence
ataggattaggggagttaag

SEQ ID NO: 34723 - DNA, 20 bp, Artificial
  CRISPR gRNA sequence
ggggagttaagttgcatgga

SEQ ID NO: 34724 - DNA, 20 bp, Artificial
  CRISPR gRNA sequence
agttgcatggagcccttaga

SEQ ID NO: 34725 - DNA, 20 bp, Artificial
  CRISPR gRNA sequence
catggagcccttagaaaggg

SEQ ID NO: 34726 - DNA, 20 bp, Artificial
  CRISPR gRNA sequence
agaaaggggactggcgacca

SEQ ID NO: 34727 - DNA, 20 bp, Artificial
  CRISPR gRNA sequence
gaaaggggactggcgaccag

SEQ ID NO: 34728 - DNA, 20 bp, Artificial
  CRISPR gRNA sequence
gcgaccagtaagtgctcaat

SEQ ID NO: 34729 - DNA, 20 bp, Artificial
  CRISPR gRNA sequence
aatgaacagtagcttaaggc

SEQ ID NO: 34730 - DNA, 20 bp, Artificial
  CRISPR gRNA sequence
aaggcagcacaacttctgca

SEQ ID NO: 34731 - DNA, 20 bp, Artificial
  CRISPR gRNA sequence
aggcagcacaacttctgcat

SEQ ID NO: 34732 - DNA, 20 bp, Artificial
  CRISPR gRNA sequence
ctgcatggtgagtacaatat

SEQ ID NO: 34733 - DNA, 20 bp, Artificial
  CRISPR gRNA sequence
tgcatggtgagtacaatatg

SEQ ID NO: 34734 - DNA, 20 bp, Artificial
  CRISPR gRNA sequence
catggtgagtacaatatgcg

SEQ ID NO: 34735 - DNA, 20 bp, Artificial
  CRISPR gRNA sequence
ttattattaatgtgcttctt

SEQ ID NO: 34736 - DNA, 20 bp, Artificial
  CRISPR gRNA sequence
tattattaatgtgcttctta

SEQ ID NO: 34737 - DNA, 20 bp, Artificial
  CRISPR gRNA sequence
attattaatgtgcttcttac

SEQ ID NO: 34738 - DNA, 20 bp, Artificial
  CRISPR gRNA sequence
ttattaatgtgcttcttacc

SEQ ID NO: 34739 - DNA, 20 bp, Artificial
  CRISPR gRNA sequence
ttaatgtgcttcttacctct

SEQ ID NO: 34740 - DNA, 20 bp, Artificial
  CRISPR gRNA sequence
atgtgcttcttacctctgtg

SEQ ID NO: 34741 - DNA, 20 bp, Artificial
  CRISPR gRNA sequence
cttacctctgtgagagtgac

SEQ ID NO: 34742 - DNA, 20 bp, Artificial
  CRISPR gRNA sequence
ttacctctgtgagagtgacc

SEQ ID NO: 34743 - DNA, 20 bp, Artificial
  CRISPR gRNA sequence
acctctgtgagagtgaccag

SEQ ID NO: 34744 - DNA, 20 bp, Artificial
  CRISPR gRNA sequence
cctctgtgagagtgaccagg

SEQ ID NO: 34745 - DNA, 20 bp, Artificial
  CRISPR gRNA sequence
tgtgagagtgaccaggggag

SEQ ID NO: 34746 - DNA, 20 bp, Artificial
  CRISPR gRNA sequence
tgagagtgaccaggggagat

SEQ ID NO: 34747 - DNA, 20 bp, Artificial
  CRISPR gRNA sequence
ctctgtgtctggggctgtgc

SEQ ID NO: 34748 - DNA, 20 bp, Artificial
  CRISPR gRNA sequence
tctgtgtctggggctgtgct

SEQ ID NO: 34749 - DNA, 20 bp, Artificial
  CRISPR gRNA sequence
tgtgtctggggctgtgctag

SEQ ID NO: 34750 - DNA, 20 bp, Artificial
  CRISPR gRNA sequence
tgtctggggctgtgctagat

SEQ ID NO: 34751 - DNA, 20 bp, Artificial
  CRISPR gRNA sequence
gggctgtgctagatgccttg

SEQ ID NO: 34752 - DNA, 20 bp, Artificial
  CRISPR gRNA sequence
tgctagatgccttgcattta

SEQ ID NO: 34753 - DNA, 20 bp, Artificial
  CRISPR gRNA sequence
gatgccttgcatttactatt

SEQ ID NO: 34754 - DNA, 20 bp, Artificial
  CRISPR gRNA sequence
gcatttactattctgtttca

SEQ ID NO: 34755 - DNA, 20 bp, Artificial
  CRISPR gRNA sequence
catttactattctgtttcaa

SEQ ID NO: 34756 - DNA, 20 bp, Artificial
  CRISPR gRNA sequence
actattctgtttcaactgtt

SEQ ID NO: 34757 - DNA, 20 bp, Artificial
  CRISPR gRNA sequence
ctattctgtttcaactgtta

SEQ ID NO: 34758 - DNA, 20 bp, Artificial
  CRISPR gRNA sequence
ttctgtttcaactgttaacg

SEQ ID NO: 34759 - DNA, 20 bp, Artificial
  CRISPR gRNA sequence
tgtttcaactgttaacggca

SEQ ID NO: 34760 - DNA, 20 bp, Artificial
  CRISPR gRNA sequence
tttcaactgttaacggcaac

SEQ ID NO: 34761 - DNA, 20 bp, Artificial
  CRISPR gRNA sequence
caactgttaacggcaactct

SEQ ID NO: 34762 - DNA, 20 bp, Artificial
  CRISPR gRNA sequence
aactgttaacggcaactctg

SEQ ID NO: 34763 - DNA, 20 bp, Artificial
  CRISPR gRNA sequence
ttaacggcaactctgggaga

SEQ ID NO: 34764 - DNA, 20 bp, Artificial
  CRISPR gRNA sequence
acggcaactctgggagattg

SEQ ID NO: 34765 - DNA, 20 bp, Artificial
  CRISPR gRNA sequence
tgggagattgttgttattat

SEQ ID NO: 34766 - DNA, 20 bp, Artificial
  CRISPR gRNA sequence
ggagattgttgttattatag

SEQ ID NO: 34767 - DNA, 20 bp, Artificial
  CRISPR gRNA sequence
ttgttattatagccatttta

SEQ ID NO: 34768 - DNA, 20 bp, Artificial
  CRISPR gRNA sequence
ttattatagccattttacag

SEQ ID NO: 34769 - DNA, 20 bp, Artificial
  CRISPR gRNA sequence
ttatagccattttacagacg

SEQ ID NO: 34770 - DNA, 20 bp, Artificial
  CRISPR gRNA sequence
tagccattttacagacgcag

SEQ ID NO: 34771 - DNA, 20 bp, Artificial
  CRISPR gRNA sequence
tacagacgcaggcgctgaga

SEQ ID NO: 34772 - DNA, 20 bp, Artificial
  CRISPR gRNA sequence
acagacgcaggcgctgagat

SEQ ID NO: 34773 - DNA, 20 bp, Artificial
  CRISPR gRNA sequence
cagacgcaggcgctgagatt

SEQ ID NO: 34774 - DNA, 20 bp, Artificial
  CRISPR gRNA sequence
agattacgtccagttcatta

SEQ ID NO: 34775 - DNA, 20 bp, Artificial
  CRISPR gRNA sequence
cgtccagttcattagatgtt

SEQ ID NO: 34776 - DNA, 20 bp, Artificial
  CRISPR gRNA sequence
attagatgttttcttcccag

SEQ ID NO: 34777 - DNA, 20 bp, Artificial
  CRISPR gRNA sequence
gatgttttcttcccagaggc

SEQ ID NO: 34778 - DNA, 20 bp, Artificial
  CRISPR gRNA sequence
tcttcccagaggcggggagt

SEQ ID NO: 34779 - DNA, 20 bp, Artificial
  CRISPR gRNA sequence
cttcccagaggcggggagtc

SEQ ID NO: 34780 - DNA, 20 bp, Artificial
  CRISPR gRNA sequence
ttcccagaggcggggagtct

SEQ ID NO: 34781 - DNA, 20 bp, Artificial
  CRISPR gRNA sequence
cccagaggcggggagtctat

SEQ ID NO: 34782 - DNA, 20 bp, Artificial
  CRISPR gRNA sequence
ccagaggcggggagtctatc

SEQ ID NO: 34783 - DNA, 20 bp, Artificial
  CRISPR gRNA sequence
tctttgagggtctaaggagg

SEQ ID NO: 34784 - DNA, 20 bp, Artificial
  CRISPR gRNA sequence
tgagggtctaaggaggcact

SEQ ID NO: 34785 - DNA, 20 bp, Artificial
  CRISPR gRNA sequence
gagggtctaaggaggcactg

SEQ ID NO: 34786 - DNA, 20 bp, Artificial
  CRISPR gRNA sequence
agggtctaaggaggcactga

SEQ ID NO: 34787 - DNA, 20 bp, Artificial
  CRISPR gRNA sequence
aggaggcactgaaagggaga

SEQ ID NO: 34788 - DNA, 20 bp, Artificial
  CRISPR gRNA sequence
aaagggagaagaaggctctt

SEQ ID NO: 34789 - DNA, 20 bp, Artificial
  CRISPR gRNA sequence
ttttgctacccctaaaagcc

SEQ ID NO: 34790 - DNA, 20 bp, Artificial
  CRISPR gRNA sequence
ttgctacccctaaaagcctc

SEQ ID NO: 34791 - DNA, 20 bp, Artificial
  CRISPR gRNA sequence
tgctacccctaaaagcctcc

SEQ ID NO: 34792 - DNA, 20 bp, Artificial
  CRISPR gRNA sequence
gctacccctaaaagcctcca

SEQ ID NO: 34793 - DNA, 20 bp, Artificial
  CRISPR gRNA sequence
ctacccctaaaagcctccag

SEQ ID NO: 34794 - DNA, 20 bp, Artificial
  CRISPR gRNA sequence
cccctaaaagcctccagcac

SEQ ID NO: 34795 - DNA, 20 bp, Artificial
  CRISPR gRNA sequence
aaagcctccagcactgctct

SEQ ID NO: 34796 - DNA, 20 bp, Artificial
  CRISPR gRNA sequence
cagcactgctctgaactgtg

SEQ ID NO: 34797 - DNA, 20 bp, Artificial
  CRISPR gRNA sequence
ctctgaactgtgattaaaga

SEQ ID NO: 34798 - DNA, 20 bp, Artificial
  CRISPR gRNA sequence
tgaactgtgattaaagagca

SEQ ID NO: 34799 - DNA, 20 bp, Artificial
  CRISPR gRNA sequence
aactgtgattaaagagcatg

SEQ ID NO: 34800 - DNA, 20 bp, Artificial
  CRISPR gRNA sequence
tgattaaagagcatgagaag

SEQ ID NO: 34801 - DNA, 20 bp, Artificial
  CRISPR gRNA sequence
aagagcatgagaaggaggcc

SEQ ID NO: 34802 - DNA, 20 bp, Artificial
  CRISPR gRNA sequence
acgcctataatcctagcact

SEQ ID NO: 34803 - DNA, 20 bp, Artificial
  CRISPR gRNA sequence
taatcctagcactttgagag

SEQ ID NO: 34804 - DNA, 20 bp, Artificial
  CRISPR gRNA sequence
gcactttgagaggccgaggc

SEQ ID NO: 34805 - DNA, 20 bp, Artificial
  CRISPR gRNA sequence
tgagaggccgaggctggcgg

SEQ ID NO: 34806 - DNA, 20 bp, Artificial
  CRISPR gRNA sequence
gagaggccgaggctggcgga

SEQ ID NO: 34807 - DNA, 20 bp, Artificial
  CRISPR gRNA sequence
agaggccgaggctggcggat

SEQ ID NO: 34808 - DNA, 20 bp, Artificial
  CRISPR gRNA sequence
gcggattacttgaggtcagg

SEQ ID NO: 34809 - DNA, 20 bp, Artificial
  CRISPR gRNA sequence
cttgaggtcaggagttcaag

SEQ ID NO: 34810 - DNA, 20 bp, Artificial
  CRISPR gRNA sequence
gaggtcaggagttcaagacc

SEQ ID NO: 34811 - DNA, 20 bp, Artificial
  CRISPR gRNA sequence
aggtcaggagttcaagacca

SEQ ID NO: 34812 - DNA, 20 bp, Artificial
  CRISPR gRNA sequence
aagaccagcctgaccagcat

SEQ ID NO: 34813 - DNA, 20 bp, Artificial
  CRISPR gRNA sequence
accagcatggtgaaaccccg

SEQ ID NO: 34814 - DNA, 20 bp, Artificial
  CRISPR gRNA sequence
tgcaaaaatacaaaaatgag

SEQ ID NO: 34815 - DNA, 20 bp, Artificial
  CRISPR gRNA sequence
caaaaatacaaaaatgagct

SEQ ID NO: 34816 - DNA, 20 bp, Artificial
  CRISPR gRNA sequence
ggcgtggtggtgggtgccta

SEQ ID NO: 34817 - DNA, 20 bp, Artificial
  CRISPR gRNA sequence
taatcccagctacttgggag

SEQ ID NO: 34818 - DNA, 20 bp, Artificial
  CRISPR gRNA sequence
cttgggaggctgaggcagga

SEQ ID NO: 34819 - DNA, 20 bp, Artificial
  CRISPR gRNA sequence
gggaggctgaggcaggaaaa

SEQ ID NO: 34820 - DNA, 20 bp, Artificial
  CRISPR gRNA sequence
ggaggctgaggcaggaaaat

SEQ ID NO: 34821 - DNA, 20 bp, Artificial
  CRISPR gRNA sequence
aggcaggaaaattgcttgaa

SEQ ID NO: 34822 - DNA, 20 bp, Artificial
  CRISPR gRNA sequence
cttgaacctgggaggcggag

SEQ ID NO: 34823 - DNA, 20 bp, Artificial
  CRISPR gRNA sequence
gaacctgggaggcggaggtt

SEQ ID NO: 34824 - DNA, 20 bp, Artificial
  CRISPR gRNA sequence
aacctgggaggcggaggttg

SEQ ID NO: 34825 - DNA, 20 bp, Artificial
  CRISPR gRNA sequence
ggaggcggaggttgcagtga

SEQ ID NO: 34826 - DNA, 20 bp, Artificial
  CRISPR gRNA sequence
cagtgagccgagatcacgcc

SEQ ID NO: 34827 - DNA, 20 bp, Artificial
  CRISPR gRNA sequence
cactccagcctcggtgacag

SEQ ID NO: 34828 - DNA, 20 bp, Artificial
  CRISPR gRNA sequence
cagcctcggtgacagagcaa

SEQ ID NO: 34829 - DNA, 20 bp, Artificial
  CRISPR gRNA sequence
ggtgacagagcaagactctg

SEQ ID NO: 34830 - DNA, 20 bp, Artificial
  CRISPR gRNA sequence
tgtctcagacaaaaaaaaaa

SEQ ID NO: 34831 - DNA, 20 bp, Artificial
  CRISPR gRNA sequence
tctcagacaaaaaaaaaaaa

SEQ ID NO: 34832 - DNA, 20 bp, Artificial
  CRISPR gRNA sequence
agacaaaaaaaaaaaaagct

SEQ ID NO: 34833 - DNA, 20 bp, Artificial
  CRISPR gRNA sequence
gagaaggaatacttccctac

SEQ ID NO: 34834 - DNA, 20 bp, Artificial
  CRISPR gRNA sequence
agaaggaatacttccctact

SEQ ID NO: 34835 - DNA, 20 bp, Artificial
  CRISPR gRNA sequence
ccctactcttgaccatgaac

SEQ ID NO: 34836 - DNA, 20 bp, Artificial
  CRISPR gRNA sequence
cctactcttgaccatgaact

SEQ ID NO: 34837 - DNA, 20 bp, Artificial
  CRISPR gRNA sequence
ctcttgaccatgaacttctc

SEQ ID NO: 34838 - DNA, 20 bp, Artificial
  CRISPR gRNA sequence
ttgaccatgaacttctcctc

SEQ ID NO: 34839 - DNA, 20 bp, Artificial
  CRISPR gRNA sequence
gaccatgaacttctcctcct

SEQ ID NO: 34840 - DNA, 20 bp, Artificial
  CRISPR gRNA sequence
accatgaacttctcctcctg

SEQ ID NO: 34841 - DNA, 20 bp, Artificial
  CRISPR gRNA sequence
ctcctcctgaggaataatgg

SEQ ID NO: 34842 - DNA, 20 bp, Artificial
  CRISPR gRNA sequence
tcctcctgaggaataatggg

SEQ ID NO: 34843 - DNA, 20 bp, Artificial
  CRISPR gRNA sequence
ctcctgaggaataatgggaa

SEQ ID NO: 34844 - DNA, 20 bp, Artificial
  CRISPR gRNA sequence
ctgaggaataatgggaagac

SEQ ID NO: 34845 - DNA, 20 bp, Artificial
  CRISPR gRNA sequence
aggaataatgggaagacctc

SEQ ID NO: 34846 - DNA, 20 bp, Artificial
  CRISPR gRNA sequence
tgaactgtgtgcctagagac

SEQ ID NO: 34847 - DNA, 20 bp, Artificial
  CRISPR gRNA sequence
aactgtgtgcctagagacat

SEQ ID NO: 34848 - DNA, 20 bp, Artificial
  CRISPR gRNA sequence
tgtgcctagagacatggttt

SEQ ID NO: 34849 - DNA, 20 bp, Artificial
  CRISPR gRNA sequence
gagacatggtttgagtttct

SEQ ID NO: 34850 - DNA, 20 bp, Artificial
  CRISPR gRNA sequence
gagtttctgctctgcctttg

SEQ ID NO: 34851 - DNA, 20 bp, Artificial
  CRISPR gRNA sequence
agtttctgctctgcctttga

SEQ ID NO: 34852 - DNA, 20 bp, Artificial
  CRISPR gRNA sequence
ctgctctgcctttgatcctg

SEQ ID NO: 34853 - DNA, 20 bp, Artificial
  CRISPR gRNA sequence
tgctctgcctttgatcctga

SEQ ID NO: 34854 - DNA, 20 bp, Artificial
  CRISPR gRNA sequence
ctctgcctttgatcctgagt

SEQ ID NO: 34855 - DNA, 20 bp, Artificial
  CRISPR gRNA sequence
tgcctttgatcctgagtaca

SEQ ID NO: 34856 - DNA, 20 bp, Artificial
  CRISPR gRNA sequence
cctttgatcctgagtacatt

SEQ ID NO: 34857 - DNA, 20 bp, Artificial
  CRISPR gRNA sequence
tgatcctgagtacattacct

SEQ ID NO: 34858 - DNA, 20 bp, Artificial
  CRISPR gRNA sequence
gatcctgagtacattacctt

SEQ ID NO: 34859 - DNA, 20 bp, Artificial
  CRISPR gRNA sequence
atcctgagtacattacctta

SEQ ID NO: 34860 - DNA, 20 bp, Artificial
  CRISPR gRNA sequence
agtacattaccttagccctc

SEQ ID NO: 34861 - DNA, 20 bp, Artificial
  CRISPR gRNA sequence
ccttagccctctgagcctcc

SEQ ID NO: 34862 - DNA, 20 bp, Artificial
  CRISPR gRNA sequence
agccctctgagcctccgttt

SEQ ID NO: 34863 - DNA, 20 bp, Artificial
  CRISPR gRNA sequence
gccctctgagcctccgtttc

SEQ ID NO: 34864 - DNA, 20 bp, Artificial
  CRISPR gRNA sequence
tgagcctccgtttcaacgag

SEQ ID NO: 34865 - DNA, 20 bp, Artificial
  CRISPR gRNA sequence
agcctccgtttcaacgagtg

SEQ ID NO: 34866 - DNA, 20 bp, Artificial
  CRISPR gRNA sequence
cgtttcaacgagtgttggag

SEQ ID NO: 34867 - DNA, 20 bp, Artificial
  CRISPR gRNA sequence
caacgagtgttggagcccct

SEQ ID NO: 34868 - DNA, 20 bp, Artificial
  CRISPR gRNA sequence
aacgagtgttggagcccctt

SEQ ID NO: 34869 - DNA, 20 bp, Artificial
  CRISPR gRNA sequence
gagccccttcaattgagtct

SEQ ID NO: 34870 - DNA, 20 bp, Artificial
  CRISPR gRNA sequence
caattgagtctttttgagat

SEQ ID NO: 34871 - DNA, 20 bp, Artificial
  CRISPR gRNA sequence
aattgagtctttttgagatt

SEQ ID NO: 34872 - DNA, 20 bp, Artificial
  CRISPR gRNA sequence
agtctttttgagattctgat

SEQ ID NO: 34873 - DNA, 20 bp, Artificial
  CRISPR gRNA sequence
tttgagattctgattcctcg

SEQ ID NO: 34874 - DNA, 20 bp, Artificial
  CRISPR gRNA sequence
ttgagattctgattcctcgt

SEQ ID NO: 34875 - DNA, 20 bp, Artificial
  CRISPR gRNA sequence
tgagattctgattcctcgtt

SEQ ID NO: 34876 - DNA, 20 bp, Artificial
  CRISPR gRNA sequence
gagattctgattcctcgttg

SEQ ID NO: 34877 - DNA, 20 bp, Artificial
  CRISPR gRNA sequence
agattctgattcctcgttgc

SEQ ID NO: 34878 - DNA, 20 bp, Artificial
  CRISPR gRNA sequence
tgattcctcgttgcctggca

SEQ ID NO: 34879 - DNA, 20 bp, Artificial
  CRISPR gRNA sequence
attcctcgttgcctggcagt

SEQ ID NO: 34880 - DNA, 20 bp, Artificial
  CRISPR gRNA sequence
ctcgttgcctggcagtcttc

SEQ ID NO: 34881 - DNA, 20 bp, Artificial
  CRISPR gRNA sequence
gttgcctggcagtcttctcc

SEQ ID NO: 34882 - DNA, 20 bp, Artificial
  CRISPR gRNA sequence
cctggcagtcttctcctttt

SEQ ID NO: 34883 - DNA, 20 bp, Artificial
  CRISPR gRNA sequence
gcagtcttctccttttcctt

SEQ ID NO: 34884 - DNA, 20 bp, Artificial
  CRISPR gRNA sequence
ctccttttcctttcccccaa

SEQ ID NO: 34885 - DNA, 20 bp, Artificial
  CRISPR gRNA sequence
tccttttcctttcccccaag

SEQ ID NO: 34886 - DNA, 20 bp, Artificial
  CRISPR gRNA sequence
cttttcctttcccccaaggc

SEQ ID NO: 34887 - DNA, 20 bp, Artificial
  CRISPR gRNA sequence
ttcctttcccccaaggcccc

SEQ ID NO: 34888 - DNA, 20 bp, Artificial
  CRISPR gRNA sequence
tcctttcccccaaggccccc

SEQ ID NO: 34889 - DNA, 20 bp, Artificial
  CRISPR gRNA sequence
cctttcccccaaggcccccc

SEQ ID NO: 34890 - DNA, 20 bp, Artificial
  CRISPR gRNA sequence
ctttcccccaaggccccccc

SEQ ID NO: 34891 - DNA, 20 bp, Artificial
  CRISPR gRNA sequence
tcccccaaggccccccccaa

SEQ ID NO: 34892 - DNA, 20 bp, Artificial
  CRISPR gRNA sequence
cccccaaggccccccccaac

SEQ ID NO: 34893 - DNA, 20 bp, Artificial
  CRISPR gRNA sequence
ccccaaggccccccccaaca

SEQ ID NO: 34894 - DNA, 20 bp, Artificial
  CRISPR gRNA sequence
ctccccaacctcatgacaag

SEQ ID NO: 34895 - DNA, 20 bp, Artificial
  CRISPR gRNA sequence
cccaacctcatgacaagctg

SEQ ID NO: 34896 - DNA, 20 bp, Artificial
  CRISPR gRNA sequence
atgacaagctgcttccgggg

SEQ ID NO: 34897 - DNA, 20 bp, Artificial
  CRISPR gRNA sequence
cttccgggggccaaatggtg

SEQ ID NO: 34898 - DNA, 20 bp, Artificial
  CRISPR gRNA sequence
ccgggggccaaatggtgttg

SEQ ID NO: 34899 - DNA, 20 bp, Artificial
  CRISPR gRNA sequence
cgggggccaaatggtgttgg

SEQ ID NO: 34900 - DNA, 20 bp, Artificial
  CRISPR gRNA sequence
ggaagccaggggcctaggaa

SEQ ID NO: 34901 - DNA, 20 bp, Artificial
  CRISPR gRNA sequence
ggaatgcctatctaccatga

SEQ ID NO: 34902 - DNA, 20 bp, Artificial
  CRISPR gRNA sequence
tctaccatgaccagacccca

SEQ ID NO: 34903 - DNA, 20 bp, Artificial
  CRISPR gRNA sequence
ccatgaccagaccccaaaca

SEQ ID NO: 34904 - DNA, 20 bp, Artificial
  CRISPR gRNA sequence
ctttgtgggggtagtagctc

SEQ ID NO: 34905 - DNA, 20 bp, Artificial
  CRISPR gRNA sequence
tttgtgggggtagtagctca

SEQ ID NO: 34906 - DNA, 20 bp, Artificial
  CRISPR gRNA sequence
tgtgggggtagtagctcaaa

SEQ ID NO: 34907 - DNA, 20 bp, Artificial
  CRISPR gRNA sequence
gtgggggtagtagctcaaat

SEQ ID NO: 34908 - DNA, 20 bp, Artificial
  CRISPR gRNA sequence
tgggggtagtagctcaaatg

SEQ ID NO: 34909 - DNA, 20 bp, Artificial
  CRISPR gRNA sequence
aaatgagttccgcttttgct

SEQ ID NO: 34910 - DNA, 20 bp, Artificial
  CRISPR gRNA sequence
cgcttttgctcatgcaccct

SEQ ID NO: 34911 - DNA, 20 bp, Artificial
  CRISPR gRNA sequence
ttgctcatgcaccctgtagt

SEQ ID NO: 34912 - DNA, 20 bp, Artificial
  CRISPR gRNA sequence
tgctcatgcaccctgtagtc

SEQ ID NO: 34913 - DNA, 20 bp, Artificial
  CRISPR gRNA sequence
gctcatgcaccctgtagtcc

SEQ ID NO: 34914 - DNA, 20 bp, Artificial
  CRISPR gRNA sequence
ctcatgcaccctgtagtcct

SEQ ID NO: 34915 - DNA, 20 bp, Artificial
  CRISPR gRNA sequence
atgcaccctgtagtcctcca

SEQ ID NO: 34916 - DNA, 20 bp, Artificial
  CRISPR gRNA sequence
tagtcctccagataaactct

SEQ ID NO: 34917 - DNA, 20 bp, Artificial
  CRISPR gRNA sequence
cagataaactctaagaaaca

SEQ ID NO: 34918 - DNA, 20 bp, Artificial
  CRISPR gRNA sequence
taagaaacatctctcacttt

SEQ ID NO: 34919 - DNA, 20 bp, Artificial
  CRISPR gRNA sequence
agaaacatctctcacttttc

SEQ ID NO: 34920 - DNA, 20 bp, Artificial
  CRISPR gRNA sequence
tcacttttcccctctaaagc

SEQ ID NO: 34921 - DNA, 20 bp, Artificial
  CRISPR gRNA sequence
acttttcccctctaaagctg

SEQ ID NO: 34922 - DNA, 20 bp, Artificial
  CRISPR gRNA sequence
ttcccctctaaagctgtaaa

SEQ ID NO: 34923 - DNA, 20 bp, Artificial
  CRISPR gRNA sequence
tcccctctaaagctgtaaaa

SEQ ID NO: 34924 - DNA, 20 bp, Artificial
  CRISPR gRNA sequence
cccctctaaagctgtaaaac

SEQ ID NO: 34925 - DNA, 20 bp, Artificial
  CRISPR gRNA sequence
ccctctaaagctgtaaaaca

SEQ ID NO: 34926 - DNA, 20 bp, Artificial
  CRISPR gRNA sequence
taaagctgtaaaacaatgat

SEQ ID NO: 34927 - DNA, 20 bp, Artificial
  CRISPR gRNA sequence
aagctgtaaaacaatgattc

SEQ ID NO: 34928 - DNA, 20 bp, Artificial
  CRISPR gRNA sequence
taaaacaatgattcactgag

SEQ ID NO: 34929 - DNA, 20 bp, Artificial
  CRISPR gRNA sequence
actgagcaccccgtaagaaa

SEQ ID NO: 34930 - DNA, 20 bp, Artificial
  CRISPR gRNA sequence
agcaccccgtaagaaagtca

SEQ ID NO: 34931 - DNA, 20 bp, Artificial
  CRISPR gRNA sequence
agctcagttccttactggcc

SEQ ID NO: 34932 - DNA, 20 bp, Artificial
  CRISPR gRNA sequence
agttccttactggccccaaa

SEQ ID NO: 34933 - DNA, 20 bp, Artificial
  CRISPR gRNA sequence
cttactggccccaaagaggt

SEQ ID NO: 34934 - DNA, 20 bp, Artificial
  CRISPR gRNA sequence
actggccccaaagaggttta

SEQ ID NO: 34935 - DNA, 20 bp, Artificial
  CRISPR gRNA sequence
ctggccccaaagaggtttac

SEQ ID NO: 34936 - DNA, 20 bp, Artificial
  CRISPR gRNA sequence
gccccaaagaggtttaccac

SEQ ID NO: 34937 - DNA, 20 bp, Artificial
  CRISPR gRNA sequence
accacacagtccctgccaaa

SEQ ID NO: 34938 - DNA, 20 bp, Artificial
  CRISPR gRNA sequence
ccacacagtccctgccaaag

SEQ ID NO: 34939 - DNA, 20 bp, Artificial
  CRISPR gRNA sequence
ccaaagaggcttgcaatgta

SEQ ID NO: 34940 - DNA, 20 bp, Artificial
  CRISPR gRNA sequence
gcaatgtagacccagatgat

SEQ ID NO: 34941 - DNA, 20 bp, Artificial
  CRISPR gRNA sequence
caatgtagacccagatgata

SEQ ID NO: 34942 - DNA, 20 bp, Artificial
  CRISPR gRNA sequence
taggagagagacaaaacata

SEQ ID NO: 34943 - DNA, 20 bp, Artificial
  CRISPR gRNA sequence
aggagagagacaaaacataa

SEQ ID NO: 34944 - DNA, 20 bp, Artificial
  CRISPR gRNA sequence
ggagagagacaaaacataat

SEQ ID NO: 34945 - DNA, 20 bp, Artificial
  CRISPR gRNA sequence
agggtgcaggctctgggttc

SEQ ID NO: 34946 - DNA, 20 bp, Artificial
  CRISPR gRNA sequence
tgggttcaaatcttagttcc

SEQ ID NO: 34947 - DNA, 20 bp, Artificial
  CRISPR gRNA sequence
ggttcaaatcttagttccac

SEQ ID NO: 34948 - DNA, 20 bp, Artificial
  CRISPR gRNA sequence
aaatcttagttccacacttg

SEQ ID NO: 34949 - DNA, 20 bp, Artificial
  CRISPR gRNA sequence
agttccacacttgctgtgtg

SEQ ID NO: 34950 - DNA, 20 bp, Artificial
  CRISPR gRNA sequence
gttccacacttgctgtgtga

SEQ ID NO: 34951 - DNA, 20 bp, Artificial
  CRISPR gRNA sequence
cacacttgctgtgtgacttt

SEQ ID NO: 34952 - DNA, 20 bp, Artificial
  CRISPR gRNA sequence
gctgtgtgactttgcaaatg

SEQ ID NO: 34953 - DNA, 20 bp, Artificial
  CRISPR gRNA sequence
ctgtgtgactttgcaaatgt

SEQ ID NO: 34954 - DNA, 20 bp, Artificial
  CRISPR gRNA sequence
tgtgactttgcaaatgttac

SEQ ID NO: 34955 - DNA, 20 bp, Artificial
  CRISPR gRNA sequence
tgcaaatgttactcaacctc

SEQ ID NO: 34956 - DNA, 20 bp, Artificial
  CRISPR gRNA sequence
gcaaatgttactcaacctct

SEQ ID NO: 34957 - DNA, 20 bp, Artificial
  CRISPR gRNA sequence
caaatgttactcaacctctc

SEQ ID NO: 34958 - DNA, 20 bp, Artificial
  CRISPR gRNA sequence
ctcaacctctctgagtcaca

SEQ ID NO: 34959 - DNA, 20 bp, Artificial
  CRISPR gRNA sequence
aacctctctgagtcacagaa

SEQ ID NO: 34960 - DNA, 20 bp, Artificial
  CRISPR gRNA sequence
tctgagtcacagaatcgact

SEQ ID NO: 34961 - DNA, 20 bp, Artificial
  CRISPR gRNA sequence
tgagtcacagaatcgactgc

SEQ ID NO: 34962 - DNA, 20 bp, Artificial
  CRISPR gRNA sequence
agtcacagaatcgactgcat

SEQ ID NO: 34963 - DNA, 20 bp, Artificial
  CRISPR gRNA sequence
cattttgttggcacagtgct

SEQ ID NO: 34964 - DNA, 20 bp, Artificial
  CRISPR gRNA sequence
tgttggcacagtgcttatgt

SEQ ID NO: 34965 - DNA, 20 bp, Artificial
  CRISPR gRNA sequence
gttggcacagtgcttatgtc

SEQ ID NO: 34966 - DNA, 20 bp, Artificial
  CRISPR gRNA sequence
ttggcacagtgcttatgtca

SEQ ID NO: 34967 - DNA, 20 bp, Artificial
  CRISPR gRNA sequence
gcacagtgcttatgtcactg

SEQ ID NO: 34968 - DNA, 20 bp, Artificial
  CRISPR gRNA sequence
atgtcactgggttgttgtga

SEQ ID NO: 34969 - DNA, 20 bp, Artificial
  CRISPR gRNA sequence
tgtcactgggttgttgtgac

SEQ ID NO: 34970 - DNA, 20 bp, Artificial
  CRISPR gRNA sequence
ggttgttgtgacttacctaa

SEQ ID NO: 34971 - DNA, 20 bp, Artificial
  CRISPR gRNA sequence
ttgtgacttacctaaagtga

SEQ ID NO: 34972 - DNA, 20 bp, Artificial
  CRISPR gRNA sequence
tgacttacctaaagtgactt

SEQ ID NO: 34973 - DNA, 20 bp, Artificial
  CRISPR gRNA sequence
acctaaagtgacttagcgag

SEQ ID NO: 34974 - DNA, 20 bp, Artificial
  CRISPR gRNA sequence
cctaaagtgacttagcgagt

SEQ ID NO: 34975 - DNA, 20 bp, Artificial
  CRISPR gRNA sequence
aagtgacttagcgagtaagt

SEQ ID NO: 34976 - DNA, 20 bp, Artificial
  CRISPR gRNA sequence
agcgagtaagtggtactaag

SEQ ID NO: 34977 - DNA, 20 bp, Artificial
  CRISPR gRNA sequence
gcgagtaagtggtactaaga

SEQ ID NO: 34978 - DNA, 20 bp, Artificial
  CRISPR gRNA sequence
agatgtaaactccaaaaata

SEQ ID NO: 34979 - DNA, 20 bp, Artificial
  CRISPR gRNA sequence
caaaaataaaacagcaaagt

SEQ ID NO: 34980 - DNA, 20 bp, Artificial
  CRISPR gRNA sequence
gatactgtacaactggcaaa

SEQ ID NO: 34981 - DNA, 20 bp, Artificial
  CRISPR gRNA sequence
atactgtacaactggcaaaa

SEQ ID NO: 34982 - DNA, 20 bp, Artificial
  CRISPR gRNA sequence
tacaactggcaaaagttaga

SEQ ID NO: 34983 - DNA, 20 bp, Artificial
  CRISPR gRNA sequence
gcaaaagttagacatctggg

SEQ ID NO: 34984 - DNA, 20 bp, Artificial
  CRISPR gRNA sequence
gacatctgggaaatgccaag

SEQ ID NO: 34985 - DNA, 20 bp, Artificial
  CRISPR gRNA sequence
ggaaatgccaagtgttggtt

SEQ ID NO: 34986 - DNA, 20 bp, Artificial
  CRISPR gRNA sequence
gttacacgggtttgtgggaa

SEQ ID NO: 34987 - DNA, 20 bp, Artificial
  CRISPR gRNA sequence
cacgggtttgtgggaatgta

SEQ ID NO: 34988 - DNA, 20 bp, Artificial
  CRISPR gRNA sequence
gtgggaatgtagatggatgg

SEQ ID NO: 34989 - DNA, 20 bp, Artificial
  CRISPR gRNA sequence
tgggaatgtagatggatggg

SEQ ID NO: 34990 - DNA, 20 bp, Artificial
  CRISPR gRNA sequence
tggagaacgacctggcatca

SEQ ID NO: 34991 - DNA, 20 bp, Artificial
  CRISPR gRNA sequence
gagaacgacctggcatcatg

SEQ ID NO: 34992 - DNA, 20 bp, Artificial
  CRISPR gRNA sequence
gcatcatgtagaatatctaa

SEQ ID NO: 34993 - DNA, 20 bp, Artificial
  CRISPR gRNA sequence
aggatatgtagatcctacca

SEQ ID NO: 34994 - DNA, 20 bp, Artificial
  CRISPR gRNA sequence
ccacctggcaattcagctct

SEQ ID NO: 34995 - DNA, 20 bp, Artificial
  CRISPR gRNA sequence
gcaattcagctcttgggtct

SEQ ID NO: 34996 - DNA, 20 bp, Artificial
  CRISPR gRNA sequence
agctcttgggtctatatatc

SEQ ID NO: 34997 - DNA, 20 bp, Artificial
  CRISPR gRNA sequence
ttgggtctatatatcctgaa

SEQ ID NO: 34998 - DNA, 20 bp, Artificial
  CRISPR gRNA sequence
gggtctatatatcctgaaga

SEQ ID NO: 34999 - DNA, 20 bp, Artificial
  CRISPR gRNA sequence
ggtctatatatcctgaagaa

SEQ ID NO: 35000 - DNA, 20 bp, Artificial
  CRISPR gRNA sequence
tatatcctgaagaaatgttc

SEQ ID NO: 35001 - DNA, 20 bp, Artificial
  CRISPR gRNA sequence
aagaaatgttcccacaactc

SEQ ID NO: 35002 - DNA, 20 bp, Artificial
  CRISPR gRNA sequence
ccacaactccccaggagaac

SEQ ID NO: 35003 - DNA, 20 bp, Artificial
  CRISPR gRNA sequence
cccaggagaacccatctgag

SEQ ID NO: 35004 - DNA, 20 bp, Artificial
  CRISPR gRNA sequence
aggatggttactgctgtgtt

SEQ ID NO: 35005 - DNA, 20 bp, Artificial
  CRISPR gRNA sequence
ctgctgtgttatttgtggtg

SEQ ID NO: 35006 - DNA, 20 bp, Artificial
  CRISPR gRNA sequence
ctgtgttatttgtggtgaca

SEQ ID NO: 35007 - DNA, 20 bp, Artificial
  CRISPR gRNA sequence
tgttatttgtggtgacagag

SEQ ID NO: 35008 - DNA, 20 bp, Artificial
  CRISPR gRNA sequence
tttgtggtgacagagagttg

SEQ ID NO: 35009 - DNA, 20 bp, Artificial
  CRISPR gRNA sequence
gtggtgacagagagttggag

SEQ ID NO: 35010 - DNA, 20 bp, Artificial
  CRISPR gRNA sequence
tggtgacagagagttggagg

SEQ ID NO: 35011 - DNA, 20 bp, Artificial
  CRISPR gRNA sequence
gaggtcacctaggtgtccat

SEQ ID NO: 35012 - DNA, 20 bp, Artificial
  CRISPR gRNA sequence
ggtgtccatcactgggggtg

SEQ ID NO: 35013 - DNA, 20 bp, Artificial
  CRISPR gRNA sequence
ggggtgtggacaggtgaaaa

SEQ ID NO: 35014 - DNA, 20 bp, Artificial
  CRISPR gRNA sequence
cactccatagagaacaatgt

SEQ ID NO: 35015 - DNA, 20 bp, Artificial
  CRISPR gRNA sequence
catagagaacaatgtccgtg

SEQ ID NO: 35016 - DNA, 20 bp, Artificial
  CRISPR gRNA sequence
gaagcaaagatcaaatgcat

SEQ ID NO: 35017 - DNA, 20 bp, Artificial
  CRISPR gRNA sequence
aaaacatagtacagaatgca

SEQ ID NO: 35018 - DNA, 20 bp, Artificial
  CRISPR gRNA sequence
tggccaggcgtggtgactcg

SEQ ID NO: 35019 - DNA, 20 bp, Artificial
  CRISPR gRNA sequence
gcacctgtaattccagcact

SEQ ID NO: 35020 - DNA, 20 bp, Artificial
  CRISPR gRNA sequence
taattccagcactttgggag

SEQ ID NO: 35021 - DNA, 20 bp, Artificial
  CRISPR gRNA sequence
cagcactttgggaggccgag

SEQ ID NO: 35022 - DNA, 20 bp, Artificial
  CRISPR gRNA sequence
tgggaggccgaggcgggtgg

SEQ ID NO: 35023 - DNA, 20 bp, Artificial
  CRISPR gRNA sequence
gggaggccgaggcgggtgga

SEQ ID NO: 35024 - DNA, 20 bp, Artificial
  CRISPR gRNA sequence
ggaggccgaggcgggtggat

SEQ ID NO: 35025 - DNA, 20 bp, Artificial
  CRISPR gRNA sequence
aggtcaggagtttgagacca

SEQ ID NO: 35026 - DNA, 20 bp, Artificial
  CRISPR gRNA sequence
gagaccagcctggccaaggt

SEQ ID NO: 35027 - DNA, 20 bp, Artificial
  CRISPR gRNA sequence
agaccagcctggccaaggtg

SEQ ID NO: 35028 - DNA, 20 bp, Artificial
  CRISPR gRNA sequence
gccaaggtggtaaaacccca

SEQ ID NO: 35029 - DNA, 20 bp, Artificial
  CRISPR gRNA sequence
tactaaaaatagaaaactca

SEQ ID NO: 35030 - DNA, 20 bp, Artificial
  CRISPR gRNA sequence
ctaaaaatagaaaactcagc

SEQ ID NO: 35031 - DNA, 20 bp, Artificial
  CRISPR gRNA sequence
aaaatagaaaactcagcctg

SEQ ID NO: 35032 - DNA, 20 bp, Artificial
  CRISPR gRNA sequence
agcctgggtgacagagtgag

SEQ ID NO: 35033 - DNA, 20 bp, Artificial
  CRISPR gRNA sequence
ggtgacagagtgagactcca

SEQ ID NO: 35034 - DNA, 20 bp, Artificial
  CRISPR gRNA sequence
catctaaaaaaaaaaaaaaa

SEQ ID NO: 35035 - DNA, 20 bp, Artificial
  CRISPR gRNA sequence
aaaaaaaaaaaaaaaggcaa

SEQ ID NO: 35036 - DNA, 20 bp, Artificial
  CRISPR gRNA sequence
tataagagcacatacaaaca

SEQ ID NO: 35037 - DNA, 20 bp, Artificial
  CRISPR gRNA sequence
ataagagcacatacaaacag

SEQ ID NO: 35038 - DNA, 20 bp, Artificial
  CRISPR gRNA sequence
taagagcacatacaaacaga

SEQ ID NO: 35039 - DNA, 20 bp, Artificial
  CRISPR gRNA sequence
aaatgcattagaatgggcac

SEQ ID NO: 35040 - DNA, 20 bp, Artificial
  CRISPR gRNA sequence
gaatgggcacccagtatggg

SEQ ID NO: 35041 - DNA, 20 bp, Artificial
  CRISPR gRNA sequence
atgaagagaaaaccctcatg

SEQ ID NO: 35042 - DNA, 20 bp, Artificial
  CRISPR gRNA sequence
atgtgaaccaaagatcatag

SEQ ID NO: 35043 - DNA, 20 bp, Artificial
  CRISPR gRNA sequence
ggctgcactgggcagttaat

SEQ ID NO: 35044 - DNA, 20 bp, Artificial
  CRISPR gRNA sequence
cactgggcagttaatcgaag

SEQ ID NO: 35045 - DNA, 20 bp, Artificial
  CRISPR gRNA sequence
ggcagttaatcgaaggttta

SEQ ID NO: 35046 - DNA, 20 bp, Artificial
  CRISPR gRNA sequence
atcgaaggtttaaaggccca

SEQ ID NO: 35047 - DNA, 20 bp, Artificial
  CRISPR gRNA sequence
aaaggcccaggggttgaaaa

SEQ ID NO: 35048 - DNA, 20 bp, Artificial
  CRISPR gRNA sequence
aaggcccaggggttgaaaag

SEQ ID NO: 35049 - DNA, 20 bp, Artificial
  CRISPR gRNA sequence
aaaagaaaagaaacaaagga

SEQ ID NO: 35050 - DNA, 20 bp, Artificial
  CRISPR gRNA sequence
atggggtgaggttggtacct

SEQ ID NO: 35051 - DNA, 20 bp, Artificial
  CRISPR gRNA sequence
gtacctctatggctcaccaa

SEQ ID NO: 35052 - DNA, 20 bp, Artificial
  CRISPR gRNA sequence
tatggctcaccaacaatagg

SEQ ID NO: 35053 - DNA, 20 bp, Artificial
  CRISPR gRNA sequence
tggctcaccaacaatagggc

SEQ ID NO: 35054 - DNA, 20 bp, Artificial
  CRISPR gRNA sequence
accaacaatagggcctgcac

SEQ ID NO: 35055 - DNA, 20 bp, Artificial
  CRISPR gRNA sequence
cacagagcctggtacctata

SEQ ID NO: 35056 - DNA, 20 bp, Artificial
  CRISPR gRNA sequence
gtacctatagatgttcacaa

SEQ ID NO: 35057 - DNA, 20 bp, Artificial
  CRISPR gRNA sequence
tagatgttcacaaagaaaca

SEQ ID NO: 35058 - DNA, 20 bp, Artificial
  CRISPR gRNA sequence
acaaagaaacaaacctctgc

SEQ ID NO: 35059 - DNA, 20 bp, Artificial
  CRISPR gRNA sequence
tgctcttgccaccccacagg

SEQ ID NO: 35060 - DNA, 20 bp, Artificial
  CRISPR gRNA sequence
ctcttgccaccccacaggct

SEQ ID NO: 35061 - DNA, 20 bp, Artificial
  CRISPR gRNA sequence
ttgccaccccacaggctgtc

SEQ ID NO: 35062 - DNA, 20 bp, Artificial
  CRISPR gRNA sequence
gccaccccacaggctgtctg

SEQ ID NO: 35063 - DNA, 20 bp, Artificial
  CRISPR gRNA sequence
ccaccccacaggctgtctgg

SEQ ID NO: 35064 - DNA, 20 bp, Artificial
  CRISPR gRNA sequence
tctggtgatggcttgatttg

SEQ ID NO: 35065 - DNA, 20 bp, Artificial
  CRISPR gRNA sequence
gtgatggcttgatttgtgcc

SEQ ID NO: 35066 - DNA, 20 bp, Artificial
  CRISPR gRNA sequence
gatttgtgcccaagagccca

SEQ ID NO: 35067 - DNA, 20 bp, Artificial
  CRISPR gRNA sequence
atttgtgcccaagagcccag

SEQ ID NO: 35068 - DNA, 20 bp, Artificial
  CRISPR gRNA sequence
gtgcccaagagcccagggtc

SEQ ID NO: 35069 - DNA, 20 bp, Artificial
  CRISPR gRNA sequence
tgcccaagagcccagggtcc

SEQ ID NO: 35070 - DNA, 20 bp, Artificial
  CRISPR gRNA sequence
gggaagagataggaacatgc

SEQ ID NO: 35071 - DNA, 20 bp, Artificial
  CRISPR gRNA sequence
gacttggagcaggatggggg

SEQ ID NO: 35072 - DNA, 20 bp, Artificial
  CRISPR gRNA sequence
ggagcaggatgggggaggag

SEQ ID NO: 35073 - DNA, 20 bp, Artificial
  CRISPR gRNA sequence
gagcaggatgggggaggagc

SEQ ID NO: 35074 - DNA, 20 bp, Artificial
  CRISPR gRNA sequence
gatgtagaggaagaagcccc

SEQ ID NO: 35075 - DNA, 20 bp, Artificial
  CRISPR gRNA sequence
actctccagcctgctgtttg

SEQ ID NO: 35076 - DNA, 20 bp, Artificial
  CRISPR gRNA sequence
tccagcctgctgtttgcaaa

SEQ ID NO: 35077 - DNA, 20 bp, Artificial
  CRISPR gRNA sequence
cagcctgctgtttgcaaacc

SEQ ID NO: 35078 - DNA, 20 bp, Artificial
  CRISPR gRNA sequence
ctgtttgcaaaccaagtgta

SEQ ID NO: 35079 - DNA, 20 bp, Artificial
  CRISPR gRNA sequence
tttgcaaaccaagtgtagat

SEQ ID NO: 35080 - DNA, 20 bp, Artificial
  CRISPR gRNA sequence
gcaaaccaagtgtagatatc

SEQ ID NO: 35081 - DNA, 20 bp, Artificial
  CRISPR gRNA sequence
caaaccaagtgtagatatcc

SEQ ID NO: 35082 - DNA, 20 bp, Artificial
  CRISPR gRNA sequence
aagagaaactactggtctca

SEQ ID NO: 35083 - DNA, 20 bp, Artificial
  CRISPR gRNA sequence
agagaaactactggtctcac

SEQ ID NO: 35084 - DNA, 20 bp, Artificial
  CRISPR gRNA sequence
ctggtctcactcaagacttt

SEQ ID NO: 35085 - DNA, 20 bp, Artificial
  CRISPR gRNA sequence
gtctcactcaagactttcac

SEQ ID NO: 35086 - DNA, 20 bp, Artificial
  CRISPR gRNA sequence
actcaagactttcacttcct

SEQ ID NO: 35087 - DNA, 20 bp, Artificial
  CRISPR gRNA sequence
aagactttcacttcctggag

SEQ ID NO: 35088 - DNA, 20 bp, Artificial
  CRISPR gRNA sequence
tcacttcctggagtggcacg

SEQ ID NO: 35089 - DNA, 20 bp, Artificial
  CRISPR gRNA sequence
cacttcctggagtggcacga

SEQ ID NO: 35090 - DNA, 20 bp, Artificial
  CRISPR gRNA sequence
acttcctggagtggcacgag

SEQ ID NO: 35091 - DNA, 20 bp, Artificial
  CRISPR gRNA sequence
cctggagtggcacgaggagg

SEQ ID NO: 35092 - DNA, 20 bp, Artificial
  CRISPR gRNA sequence
ctggagtggcacgaggaggt

SEQ ID NO: 35093 - DNA, 20 bp, Artificial
  CRISPR gRNA sequence
gagtggcacgaggaggtcac

SEQ ID NO: 35094 - DNA, 20 bp, Artificial
  CRISPR gRNA sequence
aggcatgtagcaacactgca

SEQ ID NO: 35095 - DNA, 20 bp, Artificial
  CRISPR gRNA sequence
caatgctcaggggcttatgg

SEQ ID NO: 35096 - DNA, 20 bp, Artificial
  CRISPR gRNA sequence
aggggcttatgggcctggaa

SEQ ID NO: 35097 - DNA, 20 bp, Artificial
  CRISPR gRNA sequence
atgggcctggaaacagttgc

SEQ ID NO: 35098 - DNA, 20 bp, Artificial
  CRISPR gRNA sequence
tgggcctggaaacagttgca

SEQ ID NO: 35099 - DNA, 20 bp, Artificial
  CRISPR gRNA sequence
gaaacagttgcaggatctga

SEQ ID NO: 35100 - DNA, 20 bp, Artificial
  CRISPR gRNA sequence
caggatctgatcatttgtcc

SEQ ID NO: 35101 - DNA, 20 bp, Artificial
  CRISPR gRNA sequence
atcatttgtcctcaaggcag

SEQ ID NO: 35102 - DNA, 20 bp, Artificial
  CRISPR gRNA sequence
gtcctcaaggcagggagact

SEQ ID NO: 35103 - DNA, 20 bp, Artificial
  CRISPR gRNA sequence
tcctcaaggcagggagacta

SEQ ID NO: 35104 - DNA, 20 bp, Artificial
  CRISPR gRNA sequence
aaggcagggagactagaaga

SEQ ID NO: 35105 - DNA, 20 bp, Artificial
  CRISPR gRNA sequence
gaagacgtgcgtgcatgtgc

SEQ ID NO: 35106 - DNA, 20 bp, Artificial
  CRISPR gRNA sequence
catgcatgtgtgtgcatgtg

SEQ ID NO: 35107 - DNA, 20 bp, Artificial
  CRISPR gRNA sequence
cgtgtcaggagaggtctgga

SEQ ID NO: 35108 - DNA, 20 bp, Artificial
  CRISPR gRNA sequence
gtgtcaggagaggtctggag

SEQ ID NO: 35109 - DNA, 20 bp, Artificial
  CRISPR gRNA sequence
gagatattgctattggttgg

SEQ ID NO: 35110 - DNA, 20 bp, Artificial
  CRISPR gRNA sequence
ctattggttggctctaaatc

SEQ ID NO: 35111 - DNA, 20 bp, Artificial
  CRISPR gRNA sequence
ttggttggctctaaatcccc

SEQ ID NO: 35112 - DNA, 20 bp, Artificial
  CRISPR gRNA sequence
gttggctctaaatccccttt

SEQ ID NO: 35113 - DNA, 20 bp, Artificial
  CRISPR gRNA sequence
gctctaaatcccctttctga

SEQ ID NO: 35114 - DNA, 20 bp, Artificial
  CRISPR gRNA sequence
taaatcccctttctgacctg

SEQ ID NO: 35115 - DNA, 20 bp, Artificial
  CRISPR gRNA sequence
aatcccctttctgacctgca

SEQ ID NO: 35116 - DNA, 20 bp, Artificial
  CRISPR gRNA sequence
tctgacctgcaagctcctca

SEQ ID NO: 35117 - DNA, 20 bp, Artificial
  CRISPR gRNA sequence
ctgacctgcaagctcctcag

SEQ ID NO: 35118 - DNA, 20 bp, Artificial
  CRISPR gRNA sequence
tgacctgcaagctcctcagc

SEQ ID NO: 35119 - DNA, 20 bp, Artificial
  CRISPR gRNA sequence
acctgcaagctcctcagctg

SEQ ID NO: 35120 - DNA, 20 bp, Artificial
  CRISPR gRNA sequence
caagctcctcagctgtgcca

SEQ ID NO: 35121 - DNA, 20 bp, Artificial
  CRISPR gRNA sequence
ctcagctgtgccacaggggc

SEQ ID NO: 35122 - DNA, 20 bp, Artificial
  CRISPR gRNA sequence
agctgtgccacaggggcttg

SEQ ID NO: 35123 - DNA, 20 bp, Artificial
  CRISPR gRNA sequence
tgccacaggggcttggctgc

SEQ ID NO: 35124 - DNA, 20 bp, Artificial
  CRISPR gRNA sequence
ggctgcaaaatcaaaagttg

SEQ ID NO: 35125 - DNA, 20 bp, Artificial
  CRISPR gRNA sequence
gctgcaaaatcaaaagttga

SEQ ID NO: 35126 - DNA, 20 bp, Artificial
  CRISPR gRNA sequence
caaaatcaaaagttgaatcc

SEQ ID NO: 35127 - DNA, 20 bp, Artificial
  CRISPR gRNA sequence
aatccagtcgataggcctat

SEQ ID NO: 35128 - DNA, 20 bp, Artificial
  CRISPR gRNA sequence
tttgttttgtttcccaagcc

SEQ ID NO: 35129 - DNA, 20 bp, Artificial
  CRISPR gRNA sequence
gttttgtttcccaagccaat

SEQ ID NO: 35130 - DNA, 20 bp, Artificial
  CRISPR gRNA sequence
ttttgtttcccaagccaata

SEQ ID NO: 35131 - DNA, 20 bp, Artificial
  CRISPR gRNA sequence
tgtttcccaagccaatataa

SEQ ID NO: 35132 - DNA, 20 bp, Artificial
  CRISPR gRNA sequence
gtttcccaagccaatataag

SEQ ID NO: 35133 - DNA, 20 bp, Artificial
  CRISPR gRNA sequence
tttcccaagccaatataagt

SEQ ID NO: 35134 - DNA, 20 bp, Artificial
  CRISPR gRNA sequence
cccaagccaatataagtgtg

SEQ ID NO: 35135 - DNA, 20 bp, Artificial
  CRISPR gRNA sequence
ccaagccaatataagtgtgt

SEQ ID NO: 35136 - DNA, 20 bp, Artificial
  CRISPR gRNA sequence
aatcaccatcacaatgtctc

SEQ ID NO: 35137 - DNA, 20 bp, Artificial
  CRISPR gRNA sequence
tatatagagtacacacaatt

SEQ ID NO: 35138 - DNA, 20 bp, Artificial
  CRISPR gRNA sequence
tatagagtacacacaattgt

SEQ ID NO: 35139 - DNA, 20 bp, Artificial
  CRISPR gRNA sequence
ttaccagaggccccactact

SEQ ID NO: 35140 - DNA, 20 bp, Artificial
  CRISPR gRNA sequence
ccagaggccccactactccc

SEQ ID NO: 35141 - DNA, 20 bp, Artificial
  CRISPR gRNA sequence
ctccctattgccttctgcct

SEQ ID NO: 35142 - DNA, 20 bp, Artificial
  CRISPR gRNA sequence
cctattgccttctgcctgga

SEQ ID NO: 35143 - DNA, 20 bp, Artificial
  CRISPR gRNA sequence
ttgccttctgcctggacaca

SEQ ID NO: 35144 - DNA, 20 bp, Artificial
  CRISPR gRNA sequence
ccttctgcctggacacattt

SEQ ID NO: 35145 - DNA, 20 bp, Artificial
  CRISPR gRNA sequence
ctgcctggacacattttaca

SEQ ID NO: 35146 - DNA, 20 bp, Artificial
  CRISPR gRNA sequence
tgcctggacacattttacat

SEQ ID NO: 35147 - DNA, 20 bp, Artificial
  CRISPR gRNA sequence
cctggacacattttacatca

SEQ ID NO: 35148 - DNA, 20 bp, Artificial
  CRISPR gRNA sequence
gacacattttacatcattat

SEQ ID NO: 35149 - DNA, 20 bp, Artificial
  CRISPR gRNA sequence
tacatcattatggccccttt

SEQ ID NO: 35150 - DNA, 20 bp, Artificial
  CRISPR gRNA sequence
acatcattatggcccctttg

SEQ ID NO: 35151 - DNA, 20 bp, Artificial
  CRISPR gRNA sequence
catcattatggcccctttgg

SEQ ID NO: 35152 - DNA, 20 bp, Artificial
  CRISPR gRNA sequence
tggcccctttggtatttgga

SEQ ID NO: 35153 - DNA, 20 bp, Artificial
  CRISPR gRNA sequence
tggtatttggatttgccacc

SEQ ID NO: 35154 - DNA, 20 bp, Artificial
  CRISPR gRNA sequence
ggtatttggatttgccaccc

SEQ ID NO: 35155 - DNA, 20 bp, Artificial
  CRISPR gRNA sequence
gtatttggatttgccaccct

SEQ ID NO: 35156 - DNA, 20 bp, Artificial
  CRISPR gRNA sequence
ggatttgccacccttggctt

SEQ ID NO: 35157 - DNA, 20 bp, Artificial
  CRISPR gRNA sequence
gatttgccacccttggcttg

SEQ ID NO: 35158 - DNA, 20 bp, Artificial
  CRISPR gRNA sequence
gccacccttggcttggaggc

SEQ ID NO: 35159 - DNA, 20 bp, Artificial
  CRISPR gRNA sequence
ccacccttggcttggaggcc

SEQ ID NO: 35160 - DNA, 20 bp, Artificial
  CRISPR gRNA sequence
ggcttggaggcccttgcagg

SEQ ID NO: 35161 - DNA, 20 bp, Artificial
  CRISPR gRNA sequence
gcttggaggcccttgcaggt

SEQ ID NO: 35162 - DNA, 20 bp, Artificial
  CRISPR gRNA sequence
ggaggcccttgcaggtccca

SEQ ID NO: 35163 - DNA, 20 bp, Artificial
  CRISPR gRNA sequence
gaggcccttgcaggtcccaa

SEQ ID NO: 35164 - DNA, 20 bp, Artificial
  CRISPR gRNA sequence
gcaggtcccaagataatggc

SEQ ID NO: 35165 - DNA, 20 bp, Artificial
  CRISPR gRNA sequence
caggtcccaagataatggct

SEQ ID NO: 35166 - DNA, 20 bp, Artificial
  CRISPR gRNA sequence
gggagggatgggtgactggg

SEQ ID NO: 35167 - DNA, 20 bp, Artificial
  CRISPR gRNA sequence
ggagggatgggtgactgggg

SEQ ID NO: 35168 - DNA, 20 bp, Artificial
  CRISPR gRNA sequence
gggcagggagaggcaggatt

SEQ ID NO: 35169 - DNA, 20 bp, Artificial
  CRISPR gRNA sequence
aattatgtcctgtcctgcaa

SEQ ID NO: 35170 - DNA, 20 bp, Artificial
  CRISPR gRNA sequence
tgtcctgtcctgcaatggaa

SEQ ID NO: 35171 - DNA, 20 bp, Artificial
  CRISPR gRNA sequence
tcctgcaatggaattgaggt

SEQ ID NO: 35172 - DNA, 20 bp, Artificial
  CRISPR gRNA sequence
caatggaattgaggtgtaca

SEQ ID NO: 35173 - DNA, 20 bp, Artificial
  CRISPR gRNA sequence
aggtgtacagtagggtcttt

SEQ ID NO: 35174 - DNA, 20 bp, Artificial
  CRISPR gRNA sequence
tttctacagagggtcttgga

SEQ ID NO: 35175 - DNA, 20 bp, Artificial
  CRISPR gRNA sequence
ttctacagagggtcttggag

SEQ ID NO: 35176 - DNA, 20 bp, Artificial
  CRISPR gRNA sequence
tctacagagggtcttggagg

SEQ ID NO: 35177 - DNA, 20 bp, Artificial
  CRISPR gRNA sequence
ctacagagggtcttggaggg

SEQ ID NO: 35178 - DNA, 20 bp, Artificial
  CRISPR gRNA sequence
tacagagggtcttggagggg

SEQ ID NO: 35179 - DNA, 20 bp, Artificial
  CRISPR gRNA sequence
cagagggtcttggaggggac

SEQ ID NO: 35180 - DNA, 20 bp, Artificial
  CRISPR gRNA sequence
ggaggggactggccctgggt

SEQ ID NO: 35181 - DNA, 20 bp, Artificial
  CRISPR gRNA sequence
gaggggactggccctgggta

SEQ ID NO: 35182 - DNA, 20 bp, Artificial
  CRISPR gRNA sequence
gccctgggtacccaaacagg

SEQ ID NO: 35183 - DNA, 20 bp, Artificial
  CRISPR gRNA sequence
ggtacccaaacaggccagtt

SEQ ID NO: 35184 - DNA, 20 bp, Artificial
  CRISPR gRNA sequence
cacacagagaaggagcagga

SEQ ID NO: 35185 - DNA, 20 bp, Artificial
  CRISPR gRNA sequence
aagttgcagcatctggggtg

SEQ ID NO: 35186 - DNA, 20 bp, Artificial
  CRISPR gRNA sequence
cagcatctggggtgttgggt

SEQ ID NO: 35187 - DNA, 20 bp, Artificial
  CRISPR gRNA sequence
gggtgttgggtgcactttcc

SEQ ID NO: 35188 - DNA, 20 bp, Artificial
  CRISPR gRNA sequence
ggtgcactttcccagctctg

SEQ ID NO: 35189 - DNA, 20 bp, Artificial
  CRISPR gRNA sequence
tcccagctctgctgccagct

SEQ ID NO: 35190 - DNA, 20 bp, Artificial
  CRISPR gRNA sequence
cccagctctgctgccagctc

SEQ ID NO: 35191 - DNA, 20 bp, Artificial
  CRISPR gRNA sequence
ccagctctgctgccagctca

SEQ ID NO: 35192 - DNA, 20 bp, Artificial
  CRISPR gRNA sequence
tgctgccagctcagatggaa

SEQ ID NO: 35193 - DNA, 20 bp, Artificial
  CRISPR gRNA sequence
ctgccagctcagatggaaag

SEQ ID NO: 35194 - DNA, 20 bp, Artificial
  CRISPR gRNA sequence
ccagctcagatggaaaggtg

SEQ ID NO: 35195 - DNA, 20 bp, Artificial
  CRISPR gRNA sequence
agatggaaaggtgattaaga

SEQ ID NO: 35196 - DNA, 20 bp, Artificial
  CRISPR gRNA sequence
agaggtaagctgtctgagat

SEQ ID NO: 35197 - DNA, 20 bp, Artificial
  CRISPR gRNA sequence
tctgagatcacacctgtaat

SEQ ID NO: 35198 - DNA, 20 bp, Artificial
  CRISPR gRNA sequence
agatcacacctgtaatccca

SEQ ID NO: 35199 - DNA, 20 bp, Artificial
  CRISPR gRNA sequence
taatcccagcactttgggag

SEQ ID NO: 35200 - DNA, 20 bp, Artificial
  CRISPR gRNA sequence
tgggaggctgaggagggagg

SEQ ID NO: 35201 - DNA, 20 bp, Artificial
  CRISPR gRNA sequence
gggaggctgaggagggagga

SEQ ID NO: 35202 - DNA, 20 bp, Artificial
  CRISPR gRNA sequence
ggaggctgaggagggaggat

SEQ ID NO: 35203 - DNA, 20 bp, Artificial
  CRISPR gRNA sequence
aggagggaggatgacttgag

SEQ ID NO: 35204 - DNA, 20 bp, Artificial
  CRISPR gRNA sequence
gaggccaggagtttgagacc

SEQ ID NO: 35205 - DNA, 20 bp, Artificial
  CRISPR gRNA sequence
aggccaggagtttgagacca

SEQ ID NO: 35206 - DNA, 20 bp, Artificial
  CRISPR gRNA sequence
gagaccagcctgggcaacat

SEQ ID NO: 35207 - DNA, 20 bp, Artificial
  CRISPR gRNA sequence
agaccagcctgggcaacata

SEQ ID NO: 35208 - DNA, 20 bp, Artificial
  CRISPR gRNA sequence
ggcaacatagtgaaacccca

SEQ ID NO: 35209 - DNA, 20 bp, Artificial
  CRISPR gRNA sequence
ttcagaaataaaagatacaa

SEQ ID NO: 35210 - DNA, 20 bp, Artificial
  CRISPR gRNA sequence
cagaaataaaagatacaaaa

SEQ ID NO: 35211 - DNA, 20 bp, Artificial
  CRISPR gRNA sequence
agaaataaaagatacaaaaa

SEQ ID NO: 35212 - DNA, 20 bp, Artificial
  CRISPR gRNA sequence
gctgggtgtggtggagtgcc

SEQ ID NO: 35213 - DNA, 20 bp, Artificial
  CRISPR gRNA sequence
ggtgtggtggagtgcccttg

SEQ ID NO: 35214 - DNA, 20 bp, Artificial
  CRISPR gRNA sequence
gtagtctcggctacttggga

SEQ ID NO: 35215 - DNA, 20 bp, Artificial
  CRISPR gRNA sequence
tagtctcggctacttgggag

SEQ ID NO: 35216 - DNA, 20 bp, Artificial
  CRISPR gRNA sequence
ggctacttgggaggctgagg

SEQ ID NO: 35217 - DNA, 20 bp, Artificial
  CRISPR gRNA sequence
cttgggaggctgaggcagga

SEQ ID NO: 35218 - DNA, 20 bp, Artificial
  CRISPR gRNA sequence
gggaggctgaggcaggagga

SEQ ID NO: 35219 - DNA, 20 bp, Artificial
  CRISPR gRNA sequence
ggaggctgaggcaggaggat

SEQ ID NO: 35220 - DNA, 20 bp, Artificial
  CRISPR gRNA sequence
aggcaggaggatggcttgag

SEQ ID NO: 35221 - DNA, 20 bp, Artificial
  CRISPR gRNA sequence
gagctcaggagcttgaggct

SEQ ID NO: 35222 - DNA, 20 bp, Artificial
  CRISPR gRNA sequence
agctcaggagcttgaggctg

SEQ ID NO: 35223 - DNA, 20 bp, Artificial
  CRISPR gRNA sequence
aggagcttgaggctgcagtg

SEQ ID NO: 35224 - DNA, 20 bp, Artificial
  CRISPR gRNA sequence
gaggctgcagtgagcaatga

SEQ ID NO: 35225 - DNA, 20 bp, Artificial
  CRISPR gRNA sequence
aggctgcagtgagcaatgac

SEQ ID NO: 35226 - DNA, 20 bp, Artificial
  CRISPR gRNA sequence
cagtgagcaatgactgtgcc

SEQ ID NO: 35227 - DNA, 20 bp, Artificial
  CRISPR gRNA sequence
tgccactgcactccaacctg

SEQ ID NO: 35228 - DNA, 20 bp, Artificial
  CRISPR gRNA sequence
cactccaacctgggcaacag

SEQ ID NO: 35229 - DNA, 20 bp, Artificial
  CRISPR gRNA sequence
caacctgggcaacagagtga

SEQ ID NO: 35230 - DNA, 20 bp, Artificial
  CRISPR gRNA sequence
ggcaacagagtgagactttg

SEQ ID NO: 35231 - DNA, 20 bp, Artificial
  CRISPR gRNA sequence
tgtctcataaatgaaaggat

SEQ ID NO: 35232 - DNA, 20 bp, Artificial
  CRISPR gRNA sequence
gtctcataaatgaaaggatg

SEQ ID NO: 35233 - DNA, 20 bp, Artificial
  CRISPR gRNA sequence
tctcataaatgaaaggatga

SEQ ID NO: 35234 - DNA, 20 bp, Artificial
  CRISPR gRNA sequence
ataaatgaaaggatgaatga

SEQ ID NO: 35235 - DNA, 20 bp, Artificial
  CRISPR gRNA sequence
cctgggaactgtgggatgca

SEQ ID NO: 35236 - DNA, 20 bp, Artificial
  CRISPR gRNA sequence
ggaactgtgggatgcaaaga

SEQ ID NO: 35237 - DNA, 20 bp, Artificial
  CRISPR gRNA sequence
tgggatgcaaagagctgctc

SEQ ID NO: 35238 - DNA, 20 bp, Artificial
  CRISPR gRNA sequence
ctccctgctgacacctgcct

SEQ ID NO: 35239 - DNA, 20 bp, Artificial
  CRISPR gRNA sequence
cctgctgacacctgcctgct

SEQ ID NO: 35240 - DNA, 20 bp, Artificial
  CRISPR gRNA sequence
ctgacacctgcctgctgctc

SEQ ID NO: 35241 - DNA, 20 bp, Artificial
  CRISPR gRNA sequence
acacctgcctgctgctcctt

SEQ ID NO: 35242 - DNA, 20 bp, Artificial
  CRISPR gRNA sequence
cctgctgctcctttttgcca

SEQ ID NO: 35243 - DNA, 20 bp, Artificial
  CRISPR gRNA sequence
ctgctcctttttgccatccc

SEQ ID NO: 35244 - DNA, 20 bp, Artificial
  CRISPR gRNA sequence
ctcctttttgccatcccaat

SEQ ID NO: 35245 - DNA, 20 bp, Artificial
  CRISPR gRNA sequence
ctttttgccatcccaattcc

SEQ ID NO: 35246 - DNA, 20 bp, Artificial
  CRISPR gRNA sequence
tttgccatcccaattccagc

SEQ ID NO: 35247 - DNA, 20 bp, Artificial
  CRISPR gRNA sequence
ttgccatcccaattccagca

SEQ ID NO: 35248 - DNA, 20 bp, Artificial
  CRISPR gRNA sequence
tgccatcccaattccagcac

SEQ ID NO: 35249 - DNA, 20 bp, Artificial
  CRISPR gRNA sequence
gccatcccaattccagcacc

SEQ ID NO: 35250 - DNA, 20 bp, Artificial
  CRISPR gRNA sequence
ccatcccaattccagcaccg

SEQ ID NO: 35251 - DNA, 20 bp, Artificial
  CRISPR gRNA sequence
cagcaccgttgaatggattt

SEQ ID NO: 35252 - DNA, 20 bp, Artificial
  CRISPR gRNA sequence
aatggatttccattgcagct

SEQ ID NO: 35253 - DNA, 20 bp, Artificial
  CRISPR gRNA sequence
ccattgcagctccctgccct

SEQ ID NO: 35254 - DNA, 20 bp, Artificial
  CRISPR gRNA sequence
cattgcagctccctgccctt

SEQ ID NO: 35255 - DNA, 20 bp, Artificial
  CRISPR gRNA sequence
cagctccctgccctttgggt

SEQ ID NO: 35256 - DNA, 20 bp, Artificial
  CRISPR gRNA sequence
cctgccctttgggtttgaac

SEQ ID NO: 35257 - DNA, 20 bp, Artificial
  CRISPR gRNA sequence
ccctttgggtttgaaccaac

SEQ ID NO: 35258 - DNA, 20 bp, Artificial
  CRISPR gRNA sequence
tgggtttgaaccaaccagcc

SEQ ID NO: 35259 - DNA, 20 bp, Artificial
  CRISPR gRNA sequence
gggtttgaaccaaccagcct

SEQ ID NO: 35260 - DNA, 20 bp, Artificial
  CRISPR gRNA sequence
ggtttgaaccaaccagcctc

SEQ ID NO: 35261 - DNA, 20 bp, Artificial
  CRISPR gRNA sequence
gaaccaaccagcctctggca

SEQ ID NO: 35262 - DNA, 20 bp, Artificial
  CRISPR gRNA sequence
aaccaaccagcctctggcaa

SEQ ID NO: 35263 - DNA, 20 bp, Artificial
  CRISPR gRNA sequence
tggcaaacaaagtaacttca

SEQ ID NO: 35264 - DNA, 20 bp, Artificial
  CRISPR gRNA sequence
gcaaacaaagtaacttcaga

SEQ ID NO: 35265 - DNA, 20 bp, Artificial
  CRISPR gRNA sequence
cagagcaggaaagtggaaaa

SEQ ID NO: 35266 - DNA, 20 bp, Artificial
  CRISPR gRNA sequence
agagcaggaaagtggaaaac

SEQ ID NO: 35267 - DNA, 20 bp, Artificial
  CRISPR gRNA sequence
aaattggctgcaatccctag

SEQ ID NO: 35268 - DNA, 20 bp, Artificial
  CRISPR gRNA sequence
gctgcaatccctagccaaag

SEQ ID NO: 35269 - DNA, 20 bp, Artificial
  CRISPR gRNA sequence
caatccctagccaaagggct

SEQ ID NO: 35270 - DNA, 20 bp, Artificial
  CRISPR gRNA sequence
gccaaagggcttctcagcag

SEQ ID NO: 35271 - DNA, 20 bp, Artificial
  CRISPR gRNA sequence
ctcagcagttggaggcaggt

SEQ ID NO: 35272 - DNA, 20 bp, Artificial
  CRISPR gRNA sequence
tcagcagttggaggcaggtt

SEQ ID NO: 35273 - DNA, 20 bp, Artificial
  CRISPR gRNA sequence
agcagttggaggcaggttaa

SEQ ID NO: 35274 - DNA, 20 bp, Artificial
  CRISPR gRNA sequence
gaggcaggttaaagaaagaa

SEQ ID NO: 35275 - DNA, 20 bp, Artificial
  CRISPR gRNA sequence
aagaaagaaggacaagctca

SEQ ID NO: 35276 - DNA, 20 bp, Artificial
  CRISPR gRNA sequence
agtcacaagtgaaatgagtc

SEQ ID NO: 35277 - DNA, 20 bp, Artificial
  CRISPR gRNA sequence
tgtgatactataatgtcata

SEQ ID NO: 35278 - DNA, 20 bp, Artificial
  CRISPR gRNA sequence
taatgtcatatacattacat

SEQ ID NO: 35279 - DNA, 20 bp, Artificial
  CRISPR gRNA sequence
catcatgtatctgtccaaac

SEQ ID NO: 35280 - DNA, 20 bp, Artificial
  CRISPR gRNA sequence
tccaaacccacagaatgtac

SEQ ID NO: 35281 - DNA, 20 bp, Artificial
  CRISPR gRNA sequence
atgtaaacaaaccatggacc

SEQ ID NO: 35282 - DNA, 20 bp, Artificial
  CRISPR gRNA sequence
gggtaataatgatgcatcaa

SEQ ID NO: 35283 - DNA, 20 bp, Artificial
  CRISPR gRNA sequence
ggtaataatgatgcatcaat

SEQ ID NO: 35284 - DNA, 20 bp, Artificial
  CRISPR gRNA sequence
attgattataacaaatgtat

SEQ ID NO: 35285 - DNA, 20 bp, Artificial
  CRISPR gRNA sequence
attataacaaatgtatcagt

SEQ ID NO: 35286 - DNA, 20 bp, Artificial
  CRISPR gRNA sequence
taacaaatgtatcagtctgg

SEQ ID NO: 35287 - DNA, 20 bp, Artificial
  CRISPR gRNA sequence
gtgctgagtgttcatcatgg

SEQ ID NO: 35288 - DNA, 20 bp, Artificial
  CRISPR gRNA sequence
agtgttcatcatgggggagg

SEQ ID NO: 35289 - DNA, 20 bp, Artificial
  CRISPR gRNA sequence
atcatgggggaggctatgcc

SEQ ID NO: 35290 - DNA, 20 bp, Artificial
  CRISPR gRNA sequence
tgcctgtatgggaggacgga

SEQ ID NO: 35291 - DNA, 20 bp, Artificial
  CRISPR gRNA sequence
tatgggaggacggaggtaga

SEQ ID NO: 35292 - DNA, 20 bp, Artificial
  CRISPR gRNA sequence
gcttccttgctgtcccagct

SEQ ID NO: 35293 - DNA, 20 bp, Artificial
  CRISPR gRNA sequence
ccttgctgtcccagcttgag

SEQ ID NO: 35294 - DNA, 20 bp, Artificial
  CRISPR gRNA sequence
cttgctgtcccagcttgagt

SEQ ID NO: 35295 - DNA, 20 bp, Artificial
  CRISPR gRNA sequence
gctgtcccagcttgagtgct

SEQ ID NO: 35296 - DNA, 20 bp, Artificial
  CRISPR gRNA sequence
ctgtcccagcttgagtgctc

SEQ ID NO: 35297 - DNA, 20 bp, Artificial
  CRISPR gRNA sequence
tcccagcttgagtgctccct

SEQ ID NO: 35298 - DNA, 20 bp, Artificial
  CRISPR gRNA sequence
gagtgctccctatgggattg

SEQ ID NO: 35299 - DNA, 20 bp, Artificial
  CRISPR gRNA sequence
agtgctccctatgggattgg

SEQ ID NO: 35300 - DNA, 20 bp, Artificial
  CRISPR gRNA sequence
cctatgggattggctaagac

SEQ ID NO: 35301 - DNA, 20 bp, Artificial
  CRISPR gRNA sequence
tgggattggctaagacctct

SEQ ID NO: 35302 - DNA, 20 bp, Artificial
  CRISPR gRNA sequence
gctaagacctctgttgtgac

SEQ ID NO: 35303 - DNA, 20 bp, Artificial
  CRISPR gRNA sequence
agacctctgttgtgactgca

SEQ ID NO: 35304 - DNA, 20 bp, Artificial
  CRISPR gRNA sequence
tgttgtgactgcattgcacc

SEQ ID NO: 35305 - DNA, 20 bp, Artificial
  CRISPR gRNA sequence
ttgtgactgcattgcacctc

SEQ ID NO: 35306 - DNA, 20 bp, Artificial
  CRISPR gRNA sequence
tgactgcattgcacctcaac

SEQ ID NO: 35307 - DNA, 20 bp, Artificial
  CRISPR gRNA sequence
cattgcacctcaactcctgc

SEQ ID NO: 35308 - DNA, 20 bp, Artificial
  CRISPR gRNA sequence
cacctcaactcctgctgctt

SEQ ID NO: 35309 - DNA, 20 bp, Artificial
  CRISPR gRNA sequence
aactcctgctgcttcccaac

SEQ ID NO: 35310 - DNA, 20 bp, Artificial
  CRISPR gRNA sequence
ctgctgcttcccaaccctgc

SEQ ID NO: 35311 - DNA, 20 bp, Artificial
  CRISPR gRNA sequence
ctgcttcccaaccctgcttt

SEQ ID NO: 35312 - DNA, 20 bp, Artificial
  CRISPR gRNA sequence
cttcccaaccctgctttctt

SEQ ID NO: 35313 - DNA, 20 bp, Artificial
  CRISPR gRNA sequence
cccaaccctgctttcttccc

SEQ ID NO: 35314 - DNA, 20 bp, Artificial
  CRISPR gRNA sequence
ccaaccctgctttcttccct

SEQ ID NO: 35315 - DNA, 20 bp, Artificial
  CRISPR gRNA sequence
ctttcttcccttttccttcg

SEQ ID NO: 35316 - DNA, 20 bp, Artificial
  CRISPR gRNA sequence
tcttcccttttccttcgggt

SEQ ID NO: 35317 - DNA, 20 bp, Artificial
  CRISPR gRNA sequence
cttcccttttccttcgggtg

SEQ ID NO: 35318 - DNA, 20 bp, Artificial
  CRISPR gRNA sequence
ttcccttttccttcgggtgt

SEQ ID NO: 35319 - DNA, 20 bp, Artificial
  CRISPR gRNA sequence
cccttttccttcgggtgttc

SEQ ID NO: 35320 - DNA, 20 bp, Artificial
  CRISPR gRNA sequence
ccttttccttcgggtgttcc

SEQ ID NO: 35321 - DNA, 20 bp, Artificial
  CRISPR gRNA sequence
ttccttcgggtgttccctcc

SEQ ID NO: 35322 - DNA, 20 bp, Artificial
  CRISPR gRNA sequence
tccttcgggtgttccctcct

SEQ ID NO: 35323 - DNA, 20 bp, Artificial
  CRISPR gRNA sequence
ccttcgggtgttccctcctg

SEQ ID NO: 35324 - DNA, 20 bp, Artificial
  CRISPR gRNA sequence
cttcgggtgttccctcctgt

SEQ ID NO: 35325 - DNA, 20 bp, Artificial
  CRISPR gRNA sequence
cgggtgttccctcctgtgaa

SEQ ID NO: 35326 - DNA, 20 bp, Artificial
  CRISPR gRNA sequence
gggtgttccctcctgtgaat

SEQ ID NO: 35327 - DNA, 20 bp, Artificial
  CRISPR gRNA sequence
cctcctgtgaatgtccccag

SEQ ID NO: 35328 - DNA, 20 bp, Artificial
  CRISPR gRNA sequence
ctgtgaatgtccccagtaaa

SEQ ID NO: 35329 - DNA, 20 bp, Artificial
  CRISPR gRNA sequence
tgaatgtccccagtaaacct

SEQ ID NO: 35330 - DNA, 20 bp, Artificial
  CRISPR gRNA sequence
ctatatgcaaatctccatct

SEQ ID NO: 35331 - DNA, 20 bp, Artificial
  CRISPR gRNA sequence
tatgcaaatctccatctcct

SEQ ID NO: 35332 - DNA, 20 bp, Artificial
  CRISPR gRNA sequence
catctcctacttggcttccc

SEQ ID NO: 35333 - DNA, 20 bp, Artificial
  CRISPR gRNA sequence
ctacttggcttcccagacaa

SEQ ID NO: 35334 - DNA, 20 bp, Artificial
  CRISPR gRNA sequence
cttggcttcccagacaatct

SEQ ID NO: 35335 - DNA, 20 bp, Artificial
  CRISPR gRNA sequence
ggcttcccagacaatctgac

SEQ ID NO: 35336 - DNA, 20 bp, Artificial
  CRISPR gRNA sequence
gcttcccagacaatctgacc

SEQ ID NO: 35337 - DNA, 20 bp, Artificial
  CRISPR gRNA sequence
cccagacaatctgacctgag

SEQ ID NO: 35338 - DNA, 20 bp, Artificial
  CRISPR gRNA sequence
ccagacaatctgacctgaga

SEQ ID NO: 35339 - DNA, 20 bp, Artificial
  CRISPR gRNA sequence
acctgagacaacttacttct

SEQ ID NO: 35340 - DNA, 20 bp, Artificial
  CRISPR gRNA sequence
agacaacttacttctatttt

SEQ ID NO: 35341 - DNA, 20 bp, Artificial
  CRISPR gRNA sequence
acttctatttttcctccaag

SEQ ID NO: 35342 - DNA, 20 bp, Artificial
  CRISPR gRNA sequence
cttctatttttcctccaaga

SEQ ID NO: 35343 - DNA, 20 bp, Artificial
  CRISPR gRNA sequence
ctatttttcctccaagaggg

SEQ ID NO: 35344 - DNA, 20 bp, Artificial
  CRISPR gRNA sequence
tatttttcctccaagaggga

SEQ ID NO: 35345 - DNA, 20 bp, Artificial
  CRISPR gRNA sequence
tttttcctccaagagggacg

SEQ ID NO: 35346 - DNA, 20 bp, Artificial
  CRISPR gRNA sequence
ttcctccaagagggacgtgg

SEQ ID NO: 35347 - DNA, 20 bp, Artificial
  CRISPR gRNA sequence
tcctccaagagggacgtgga

SEQ ID NO: 35348 - DNA, 20 bp, Artificial
  CRISPR gRNA sequence
cctccaagagggacgtggaa

SEQ ID NO: 35349 - DNA, 20 bp, Artificial
  CRISPR gRNA sequence
ctccaagagggacgtggaaa

SEQ ID NO: 35350 - DNA, 20 bp, Artificial
  CRISPR gRNA sequence
caagagggacgtggaaatcc

SEQ ID NO: 35351 - DNA, 20 bp, Artificial
  CRISPR gRNA sequence
caggaccccacaaaagacac

SEQ ID NO: 35352 - DNA, 20 bp, Artificial
  CRISPR gRNA sequence
tgaaagttcaggcaagccac

SEQ ID NO: 35353 - DNA, 20 bp, Artificial
  CRISPR gRNA sequence
aaagttcaggcaagccacct

SEQ ID NO: 35354 - DNA, 20 bp, Artificial
  CRISPR gRNA sequence
aggcaagccacctatcttct

SEQ ID NO: 35355 - DNA, 20 bp, Artificial
  CRISPR gRNA sequence
tcttctctgggtcccgattg

SEQ ID NO: 35356 - DNA, 20 bp, Artificial
  CRISPR gRNA sequence
ctctgggtcccgattgagga

SEQ ID NO: 35357 - DNA, 20 bp, Artificial
  CRISPR gRNA sequence
tctgggtcccgattgaggac

SEQ ID NO: 35358 - DNA, 20 bp, Artificial
  CRISPR gRNA sequence
tgggtcccgattgaggacac

SEQ ID NO: 35359 - DNA, 20 bp, Artificial
  CRISPR gRNA sequence
ggtcccgattgaggacactg

SEQ ID NO: 35360 - DNA, 20 bp, Artificial
  CRISPR gRNA sequence
aggacactgacctcataaca

SEQ ID NO: 35361 - DNA, 20 bp, Artificial
  CRISPR gRNA sequence
acctcataacaacttggaaa

SEQ ID NO: 35362 - DNA, 20 bp, Artificial
  CRISPR gRNA sequence
ataacaacttggaaaatctt

SEQ ID NO: 35363 - DNA, 20 bp, Artificial
  CRISPR gRNA sequence
ggaaaatcttaaaactcgaa

SEQ ID NO: 35364 - DNA, 20 bp, Artificial
  CRISPR gRNA sequence
gaaaatcttaaaactcgaat

SEQ ID NO: 35365 - DNA, 20 bp, Artificial
  CRISPR gRNA sequence
aaaactcgaatgggccatca

SEQ ID NO: 35366 - DNA, 20 bp, Artificial
  CRISPR gRNA sequence
aaactcgaatgggccatcat

SEQ ID NO: 35367 - DNA, 20 bp, Artificial
  CRISPR gRNA sequence
gaatgggccatcatctccag

SEQ ID NO: 35368 - DNA, 20 bp, Artificial
  CRISPR gRNA sequence
cagcttgtgcatttgccagt

SEQ ID NO: 35369 - DNA, 20 bp, Artificial
  CRISPR gRNA sequence
gtgcatttgccagtaaaggg

SEQ ID NO: 35370 - DNA, 20 bp, Artificial
  CRISPR gRNA sequence
tgcatttgccagtaaagggt

SEQ ID NO: 35371 - DNA, 20 bp, Artificial
  CRISPR gRNA sequence
gccagtaaagggtaaagtta

SEQ ID NO: 35372 - DNA, 20 bp, Artificial
  CRISPR gRNA sequence
ccagtaaagggtaaagttat

SEQ ID NO: 35373 - DNA, 20 bp, Artificial
  CRISPR gRNA sequence
ttgtgggtgaggggcctggt

SEQ ID NO: 35374 - DNA, 20 bp, Artificial
  CRISPR gRNA sequence
tgggtgaggggcctggtggt

SEQ ID NO: 35375 - DNA, 20 bp, Artificial
  CRISPR gRNA sequence
gtggtcccaggatgagaatg

SEQ ID NO: 35376 - DNA, 20 bp, Artificial
  CRISPR gRNA sequence
tatgagctgcagccaggaga

SEQ ID NO: 35377 - DNA, 20 bp, Artificial
  CRISPR gRNA sequence
cagccaggagaccttcggtc

SEQ ID NO: 35378 - DNA, 20 bp, Artificial
  CRISPR gRNA sequence
cggtccctgtccagaatgca

SEQ ID NO: 35379 - DNA, 20 bp, Artificial
  CRISPR gRNA sequence
ggtccctgtccagaatgcag

SEQ ID NO: 35380 - DNA, 20 bp, Artificial
  CRISPR gRNA sequence
tccagaatgcagggttggga

SEQ ID NO: 35381 - DNA, 20 bp, Artificial
  CRISPR gRNA sequence
ggataagagttcccttcccc

SEQ ID NO: 35382 - DNA, 20 bp, Artificial
  CRISPR gRNA sequence
ccttccccgcttgcctggtc

SEQ ID NO: 35383 - DNA, 20 bp, Artificial
  CRISPR gRNA sequence
ccccgcttgcctggtctgtc

SEQ ID NO: 35384 - DNA, 20 bp, Artificial
  CRISPR gRNA sequence
cccgcttgcctggtctgtcc

SEQ ID NO: 35385 - DNA, 20 bp, Artificial
  CRISPR gRNA sequence
gcctggtctgtcccagctcc

SEQ ID NO: 35386 - DNA, 20 bp, Artificial
  CRISPR gRNA sequence
cctggtctgtcccagctcca

SEQ ID NO: 35387 - DNA, 20 bp, Artificial
  CRISPR gRNA sequence
gtctgtcccagctccagata

SEQ ID NO: 35388 - DNA, 20 bp, Artificial
  CRISPR gRNA sequence
tcccagctccagatagcctc

SEQ ID NO: 35389 - DNA, 20 bp, Artificial
  CRISPR gRNA sequence
cagatagcctcccttctgca

SEQ ID NO: 35390 - DNA, 20 bp, Artificial
  CRISPR gRNA sequence
ccttctgcatgccactccta

SEQ ID NO: 35391 - DNA, 20 bp, Artificial
  CRISPR gRNA sequence
ctgcatgccactcctaactg

SEQ ID NO: 35392 - DNA, 20 bp, Artificial
  CRISPR gRNA sequence
tgcatgccactcctaactgc

SEQ ID NO: 35393 - DNA, 20 bp, Artificial
  CRISPR gRNA sequence
catgccactcctaactgcag

SEQ ID NO: 35394 - DNA, 20 bp, Artificial
  CRISPR gRNA sequence
ctaactgcagtcaatgacct

SEQ ID NO: 35395 - DNA, 20 bp, Artificial
  CRISPR gRNA sequence
actgcagtcaatgacctgga

SEQ ID NO: 35396 - DNA, 20 bp, Artificial
  CRISPR gRNA sequence
cagtcaatgacctggaaagg

SEQ ID NO: 35397 - DNA, 20 bp, Artificial
  CRISPR gRNA sequence
gaaaggagtccaacaagttt

SEQ ID NO: 35398 - DNA, 20 bp, Artificial
  CRISPR gRNA sequence
ttcctggaagggaacctgac

SEQ ID NO: 35399 - DNA, 20 bp, Artificial
  CRISPR gRNA sequence
tcctggaagggaacctgacc

SEQ ID NO: 35400 - DNA, 20 bp, Artificial
  CRISPR gRNA sequence
cctggaagggaacctgaccc

SEQ ID NO: 35401 - DNA, 20 bp, Artificial
  CRISPR gRNA sequence
ctggaagggaacctgaccct

SEQ ID NO: 35402 - DNA, 20 bp, Artificial
  CRISPR gRNA sequence
gaagggaacctgaccctggt

SEQ ID NO: 35403 - DNA, 20 bp, Artificial
  CRISPR gRNA sequence
accctggtgctggggtaggg

SEQ ID NO: 35404 - DNA, 20 bp, Artificial
  CRISPR gRNA sequence
gtgctggggtagggggtgga

SEQ ID NO: 35405 - DNA, 20 bp, Artificial
  CRISPR gRNA sequence
gggtagggggtggagtgatg

SEQ ID NO: 35406 - DNA, 20 bp, Artificial
  CRISPR gRNA sequence
gtgactgcagttagcaaagc

SEQ ID NO: 35407 - DNA, 20 bp, Artificial
  CRISPR gRNA sequence
tgactgcagttagcaaagcc

SEQ ID NO: 35408 - DNA, 20 bp, Artificial
  CRISPR gRNA sequence
cagttagcaaagccaggccc

SEQ ID NO: 35409 - DNA, 20 bp, Artificial
  CRISPR gRNA sequence
gcaaagccaggccccacact

SEQ ID NO: 35410 - DNA, 20 bp, Artificial
  CRISPR gRNA sequence
cagtcctgacccatccggct

SEQ ID NO: 35411 - DNA, 20 bp, Artificial
  CRISPR gRNA sequence
acccatccggctctacttaa

SEQ ID NO: 35412 - DNA, 20 bp, Artificial
  CRISPR gRNA sequence
tacttaacacagtccccccg

SEQ ID NO: 35413 - DNA, 20 bp, Artificial
  CRISPR gRNA sequence
cttaacacagtccccccgcc

SEQ ID NO: 35414 - DNA, 20 bp, Artificial
  CRISPR gRNA sequence
aacacagtccccccgccagc

SEQ ID NO: 35415 - DNA, 20 bp, Artificial
  CRISPR gRNA sequence
acacagtccccccgccagca

SEQ ID NO: 35416 - DNA, 20 bp, Artificial
  CRISPR gRNA sequence
tgctgggtgctggagacccc

SEQ ID NO: 35417 - DNA, 20 bp, Artificial
  CRISPR gRNA sequence
ctgggtgctggagaccccaa

SEQ ID NO: 35418 - DNA, 20 bp, Artificial
  CRISPR gRNA sequence
ggtgctggagaccccaagat

SEQ ID NO: 35419 - DNA, 20 bp, Artificial
  CRISPR gRNA sequence
gagaccccaagatgaaccac

SEQ ID NO: 35420 - DNA, 20 bp, Artificial
  CRISPR gRNA sequence
cttgctgagatctgactacg

SEQ ID NO: 35421 - DNA, 20 bp, Artificial
  CRISPR gRNA sequence
gctgagatctgactacggag

SEQ ID NO: 35422 - DNA, 20 bp, Artificial
  CRISPR gRNA sequence
ctgagatctgactacggagt

SEQ ID NO: 35423 - DNA, 20 bp, Artificial
  CRISPR gRNA sequence
agatctgactacggagtcca

SEQ ID NO: 35424 - DNA, 20 bp, Artificial
  CRISPR gRNA sequence
actacggagtccagccatcg

SEQ ID NO: 35425 - DNA, 20 bp, Artificial
  CRISPR gRNA sequence
cggagtccagccatcggcag

SEQ ID NO: 35426 - DNA, 20 bp, Artificial
  CRISPR gRNA sequence
ggctgtgagtgagaattacc

SEQ ID NO: 35427 - DNA, 20 bp, Artificial
  CRISPR gRNA sequence
gctgtgagtgagaattacct

SEQ ID NO: 35428 - DNA, 20 bp, Artificial
  CRISPR gRNA sequence
tgagtgagaattacctggga

SEQ ID NO: 35429 - DNA, 20 bp, Artificial
  CRISPR gRNA sequence
cctgggaagggtgttaaaaa

SEQ ID NO: 35430 - DNA, 20 bp, Artificial
  CRISPR gRNA sequence
ggaagggtgttaaaaacaca

SEQ ID NO: 35431 - DNA, 20 bp, Artificial
  CRISPR gRNA sequence
aaaacacagcgtcctgggcc

SEQ ID NO: 35432 - DNA, 20 bp, Artificial
  CRISPR gRNA sequence
ggcctcacccccagtgattc

SEQ ID NO: 35433 - DNA, 20 bp, Artificial
  CRISPR gRNA sequence
acccccagtgattctattca

SEQ ID NO: 35434 - DNA, 20 bp, Artificial
  CRISPR gRNA sequence
tattcagggagtctgcagcc

SEQ ID NO: 35435 - DNA, 20 bp, Artificial
  CRISPR gRNA sequence
ttcagggagtctgcagccgg

SEQ ID NO: 35436 - DNA, 20 bp, Artificial
  CRISPR gRNA sequence
agggagtctgcagccgggcc

SEQ ID NO: 35437 - DNA, 20 bp, Artificial
  CRISPR gRNA sequence
cagccgggcccaggaatctg

SEQ ID NO: 35438 - DNA, 20 bp, Artificial
  CRISPR gRNA sequence
tattttctttcatttttttt

SEQ ID NO: 35439 - DNA, 20 bp, Artificial
  CRISPR gRNA sequence
tctttcattttttttgagac

SEQ ID NO: 35440 - DNA, 20 bp, Artificial
  CRISPR gRNA sequence
ctttcattttttttgagacg

SEQ ID NO: 35441 - DNA, 20 bp, Artificial
  CRISPR gRNA sequence
tttcattttttttgagacgg

SEQ ID NO: 35442 - DNA, 20 bp, Artificial
  CRISPR gRNA sequence
tcattttttttgagacggag

SEQ ID NO: 35443 - DNA, 20 bp, Artificial
  CRISPR gRNA sequence
cattttttttgagacggagt

SEQ ID NO: 35444 - DNA, 20 bp, Artificial
  CRISPR gRNA sequence
attttttttgagacggagtt

SEQ ID NO: 35445 - DNA, 20 bp, Artificial
  CRISPR gRNA sequence
tttttgagacggagtttcac

SEQ ID NO: 35446 - DNA, 20 bp, Artificial
  CRISPR gRNA sequence
ttttgagacggagtttcact

SEQ ID NO: 35447 - DNA, 20 bp, Artificial
  CRISPR gRNA sequence
tttgagacggagtttcactc

SEQ ID NO: 35448 - DNA, 20 bp, Artificial
  CRISPR gRNA sequence
ttgagacggagtttcactct

SEQ ID NO: 35449 - DNA, 20 bp, Artificial
  CRISPR gRNA sequence
tgagacggagtttcactctt

SEQ ID NO: 35450 - DNA, 20 bp, Artificial
  CRISPR gRNA sequence
gagacggagtttcactcttg

SEQ ID NO: 35451 - DNA, 20 bp, Artificial
  CRISPR gRNA sequence
agacggagtttcactcttgt

SEQ ID NO: 35452 - DNA, 20 bp, Artificial
  CRISPR gRNA sequence
cactcttgttgcccaggctg

SEQ ID NO: 35453 - DNA, 20 bp, Artificial
  CRISPR gRNA sequence
actcttgttgcccaggctgg

SEQ ID NO: 35454 - DNA, 20 bp, Artificial
  CRISPR gRNA sequence
ttgttgcccaggctggagtg

SEQ ID NO: 35455 - DNA, 20 bp, Artificial
  CRISPR gRNA sequence
gttgcccaggctggagtgca

SEQ ID NO: 35456 - DNA, 20 bp, Artificial
  CRISPR gRNA sequence
ttgcccaggctggagtgcaa

SEQ ID NO: 35457 - DNA, 20 bp, Artificial
  CRISPR gRNA sequence
cccaggctggagtgcaatgg

SEQ ID NO: 35458 - DNA, 20 bp, Artificial
  CRISPR gRNA sequence
gagtgcaatggtgtgatctc

SEQ ID NO: 35459 - DNA, 20 bp, Artificial
  CRISPR gRNA sequence
ggctcaccgcaatctccgcc

SEQ ID NO: 35460 - DNA, 20 bp, Artificial
  CRISPR gRNA sequence
accgcaatctccgcctcctg

SEQ ID NO: 35461 - DNA, 20 bp, Artificial
  CRISPR gRNA sequence
cgcctcctgggttcaggcga

SEQ ID NO: 35462 - DNA, 20 bp, Artificial
  CRISPR gRNA sequence
ctgggttcaggcgattctcc

SEQ ID NO: 35463 - DNA, 20 bp, Artificial
  CRISPR gRNA sequence
ggttcaggcgattctcctcc

SEQ ID NO: 35464 - DNA, 20 bp, Artificial
  CRISPR gRNA sequence
aggcgattctcctccaccag

SEQ ID NO: 35465 - DNA, 20 bp, Artificial
  CRISPR gRNA sequence
tcctccaccagcctaccgag

SEQ ID NO: 35466 - DNA, 20 bp, Artificial
  CRISPR gRNA sequence
ctccaccagcctaccgagta

SEQ ID NO: 35467 - DNA, 20 bp, Artificial
  CRISPR gRNA sequence
caccagcctaccgagtagct

SEQ ID NO: 35468 - DNA, 20 bp, Artificial
  CRISPR gRNA sequence
ccgagtagctgggattacag

SEQ ID NO: 35469 - DNA, 20 bp, Artificial
  CRISPR gRNA sequence
ggattacaggcatgcaccac

SEQ ID NO: 35470 - DNA, 20 bp, Artificial
  CRISPR gRNA sequence
caggcatgcaccactacacc

SEQ ID NO: 35471 - DNA, 20 bp, Artificial
  CRISPR gRNA sequence
cacccggctaattttgtatt

SEQ ID NO: 35472 - DNA, 20 bp, Artificial
  CRISPR gRNA sequence
attttgtatttttaggagag

SEQ ID NO: 35473 - DNA, 20 bp, Artificial
  CRISPR gRNA sequence
tgtatttttaggagagacgg

SEQ ID NO: 35474 - DNA, 20 bp, Artificial
  CRISPR gRNA sequence
gtatttttaggagagacggt

SEQ ID NO: 35475 - DNA, 20 bp, Artificial
  CRISPR gRNA sequence
tatttttaggagagacggtg

SEQ ID NO: 35476 - DNA, 20 bp, Artificial
  CRISPR gRNA sequence
ttaggagagacggtgtttca

SEQ ID NO: 35477 - DNA, 20 bp, Artificial
  CRISPR gRNA sequence
taggagagacggtgtttcac

SEQ ID NO: 35478 - DNA, 20 bp, Artificial
  CRISPR gRNA sequence
aggagagacggtgtttcacc

SEQ ID NO: 35479 - DNA, 20 bp, Artificial
  CRISPR gRNA sequence
ggagagacggtgtttcacca

SEQ ID NO: 35480 - DNA, 20 bp, Artificial
  CRISPR gRNA sequence
caccatgttgcccaggctgg

SEQ ID NO: 35481 - DNA, 20 bp, Artificial
  CRISPR gRNA sequence
accatgttgcccaggctggt

SEQ ID NO: 35482 - DNA, 20 bp, Artificial
  CRISPR gRNA sequence
cccaggctggtctcgaactc

SEQ ID NO: 35483 - DNA, 20 bp, Artificial
  CRISPR gRNA sequence
gtctcgaactcctgatccca

SEQ ID NO: 35484 - DNA, 20 bp, Artificial
  CRISPR gRNA sequence
gaactcctgatcccaggtga

SEQ ID NO: 35485 - DNA, 20 bp, Artificial
  CRISPR gRNA sequence
ctgatcccaggtgatccacc

SEQ ID NO: 35486 - DNA, 20 bp, Artificial
  CRISPR gRNA sequence
atcccaggtgatccaccggc

SEQ ID NO: 35487 - DNA, 20 bp, Artificial
  CRISPR gRNA sequence
agcctcccaaagtgctgggg

SEQ ID NO: 35488 - DNA, 20 bp, Artificial
  CRISPR gRNA sequence
ccaaagtgctggggttacag

SEQ ID NO: 35489 - DNA, 20 bp, Artificial
  CRISPR gRNA sequence
gggttacaggtgtgagccac

SEQ ID NO: 35490 - DNA, 20 bp, Artificial
  CRISPR gRNA sequence
caggtgtgagccaccatgcc

SEQ ID NO: 35491 - DNA, 20 bp, Artificial
  CRISPR gRNA sequence
gaatctgtattttcaaaaat

SEQ ID NO: 35492 - DNA, 20 bp, Artificial
  CRISPR gRNA sequence
tattttcaaaaatttatttt

SEQ ID NO: 35493 - DNA, 20 bp, Artificial
  CRISPR gRNA sequence
tcaaaaatttatttttatta

SEQ ID NO: 35494 - DNA, 20 bp, Artificial
  CRISPR gRNA sequence
caaaaatttatttttattaa

SEQ ID NO: 35495 - DNA, 20 bp, Artificial
  CRISPR gRNA sequence
aaaaatttatttttattaat

SEQ ID NO: 35496 - DNA, 20 bp, Artificial
  CRISPR gRNA sequence
atttttattaatttatatat

SEQ ID NO: 35497 - DNA, 20 bp, Artificial
  CRISPR gRNA sequence
tttttattaatttatatatt

SEQ ID NO: 35498 - DNA, 20 bp, Artificial
  CRISPR gRNA sequence
ttattaatttatatattttt

SEQ ID NO: 35499 - DNA, 20 bp, Artificial
  CRISPR gRNA sequence
tattaatttatatatttttt

SEQ ID NO: 35500 - DNA, 20 bp, Artificial
  CRISPR gRNA sequence
attaatttatatattttttt

SEQ ID NO: 35501 - DNA, 20 bp, Artificial
  CRISPR gRNA sequence
ttaatttatatatttttttc

SEQ ID NO: 35502 - DNA, 20 bp, Artificial
  CRISPR gRNA sequence
atttatatatttttttccta

SEQ ID NO: 35503 - DNA, 20 bp, Artificial
  CRISPR gRNA sequence
atatatttttttcctaaaaa

SEQ ID NO: 35504 - DNA, 20 bp, Artificial
  CRISPR gRNA sequence
tatatttttttcctaaaaaa

SEQ ID NO: 35505 - DNA, 20 bp, Artificial
  CRISPR gRNA sequence
ttttcctaaaaaaaggtctt

SEQ ID NO: 35506 - DNA, 20 bp, Artificial
  CRISPR gRNA sequence
tttcctaaaaaaaggtcttg

SEQ ID NO: 35507 - DNA, 20 bp, Artificial
  CRISPR gRNA sequence
ttcctaaaaaaaggtcttgc

SEQ ID NO: 35508 - DNA, 20 bp, Artificial
  CRISPR gRNA sequence
tcctaaaaaaaggtcttgct

SEQ ID NO: 35509 - DNA, 20 bp, Artificial
  CRISPR gRNA sequence
cctaaaaaaaggtcttgctc

SEQ ID NO: 35510 - DNA, 20 bp, Artificial
  CRISPR gRNA sequence
ctaaaaaaaggtcttgctct

SEQ ID NO: 35511 - DNA, 20 bp, Artificial
  CRISPR gRNA sequence
aaaaaaggtcttgctctgtt

SEQ ID NO: 35512 - DNA, 20 bp, Artificial
  CRISPR gRNA sequence
gctctgttgcccaggctggt

SEQ ID NO: 35513 - DNA, 20 bp, Artificial
  CRISPR gRNA sequence
ctctgttgcccaggctggtc

SEQ ID NO: 35514 - DNA, 20 bp, Artificial
  CRISPR gRNA sequence
tgttgcccaggctggtcttg

SEQ ID NO: 35515 - DNA, 20 bp, Artificial
  CRISPR gRNA sequence
ttgcccaggctggtcttgaa

SEQ ID NO: 35516 - DNA, 20 bp, Artificial
  CRISPR gRNA sequence
cccaggctggtcttgaactc

SEQ ID NO: 35517 - DNA, 20 bp, Artificial
  CRISPR gRNA sequence
gtcttgaactcctggtctca

SEQ ID NO: 35518 - DNA, 20 bp, Artificial
  CRISPR gRNA sequence
gaactcctggtctcaagcca

SEQ ID NO: 35519 - DNA, 20 bp, Artificial
  CRISPR gRNA sequence
aactcctggtctcaagccat

SEQ ID NO: 35520 - DNA, 20 bp, Artificial
  CRISPR gRNA sequence
ctggtctcaagccatcatcc

SEQ ID NO: 35521 - DNA, 20 bp, Artificial
  CRISPR gRNA sequence
gtctcaagccatcatcctgc

SEQ ID NO: 35522 - DNA, 20 bp, Artificial
  CRISPR gRNA sequence
aagccatcatcctgccttga

SEQ ID NO: 35523 - DNA, 20 bp, Artificial
  CRISPR gRNA sequence
ccttgacctcccaaggtgat

SEQ ID NO: 35524 - DNA, 20 bp, Artificial
  CRISPR gRNA sequence
gacctcccaaggtgatggaa

SEQ ID NO: 35525 - DNA, 20 bp, Artificial
  CRISPR gRNA sequence
acctcccaaggtgatggaat

SEQ ID NO: 35526 - DNA, 20 bp, Artificial
  CRISPR gRNA sequence
ccaaggtgatggaattacag

SEQ ID NO: 35527 - DNA, 20 bp, Artificial
  CRISPR gRNA sequence
caggcatgagccactgcacc

SEQ ID NO: 35528 - DNA, 20 bp, Artificial
  CRISPR gRNA sequence
caccaggcccctttcttaat

SEQ ID NO: 35529 - DNA, 20 bp, Artificial
  CRISPR gRNA sequence
tcttaattcttatatctttc

SEQ ID NO: 35530 - DNA, 20 bp, Artificial
  CRISPR gRNA sequence
cttaattcttatatctttcc

SEQ ID NO: 35531 - DNA, 20 bp, Artificial
  CRISPR gRNA sequence
ttaattcttatatctttcct

SEQ ID NO: 35532 - DNA, 20 bp, Artificial
  CRISPR gRNA sequence
aattcttatatctttccttc

SEQ ID NO: 35533 - DNA, 20 bp, Artificial
  CRISPR gRNA sequence
attcttatatctttccttcc

SEQ ID NO: 35534 - DNA, 20 bp, Artificial
  CRISPR gRNA sequence
ttatatctttccttcctgaa

SEQ ID NO: 35535 - DNA, 20 bp, Artificial
  CRISPR gRNA sequence
atatctttccttcctgaagt

SEQ ID NO: 35536 - DNA, 20 bp, Artificial
  CRISPR gRNA sequence
tatctttccttcctgaagtc

SEQ ID NO: 35537 - DNA, 20 bp, Artificial
  CRISPR gRNA sequence
tccttcctgaagtctttcag

SEQ ID NO: 35538 - DNA, 20 bp, Artificial
  CRISPR gRNA sequence
ccttcctgaagtctttcagc

SEQ ID NO: 35539 - DNA, 20 bp, Artificial
  CRISPR gRNA sequence
cttcctgaagtctttcagct

SEQ ID NO: 35540 - DNA, 20 bp, Artificial
  CRISPR gRNA sequence
cctgaagtctttcagctgcc

SEQ ID NO: 35541 - DNA, 20 bp, Artificial
  CRISPR gRNA sequence
ctgaagtctttcagctgccc

SEQ ID NO: 35542 - DNA, 20 bp, Artificial
  CRISPR gRNA sequence
aagtctttcagctgccctct

SEQ ID NO: 35543 - DNA, 20 bp, Artificial
  CRISPR gRNA sequence
tcagctgccctctgctgcca

SEQ ID NO: 35544 - DNA, 20 bp, Artificial
  CRISPR gRNA sequence
cagctgccctctgctgccat

SEQ ID NO: 35545 - DNA, 20 bp, Artificial
  CRISPR gRNA sequence
agctgccctctgctgccatg

SEQ ID NO: 35546 - DNA, 20 bp, Artificial
  CRISPR gRNA sequence
ccctctgctgccatgccctt

SEQ ID NO: 35547 - DNA, 20 bp, Artificial
  CRISPR gRNA sequence
tgctgccatgcccttggtct

SEQ ID NO: 35548 - DNA, 20 bp, Artificial
  CRISPR gRNA sequence
ctgccatgcccttggtctag

SEQ ID NO: 35549 - DNA, 20 bp, Artificial
  CRISPR gRNA sequence
ccatgcccttggtctagtag

SEQ ID NO: 35550 - DNA, 20 bp, Artificial
  CRISPR gRNA sequence
ggtctagtagtcaccagacc

SEQ ID NO: 35551 - DNA, 20 bp, Artificial
  CRISPR gRNA sequence
gtctagtagtcaccagaccc

SEQ ID NO: 35552 - DNA, 20 bp, Artificial
  CRISPR gRNA sequence
gtagtcaccagaccctcagc

SEQ ID NO: 35553 - DNA, 20 bp, Artificial
  CRISPR gRNA sequence
agcatagattttacaatagc

SEQ ID NO: 35554 - DNA, 20 bp, Artificial
  CRISPR gRNA sequence
tacaatagcttccaggtctt

SEQ ID NO: 35555 - DNA, 20 bp, Artificial
  CRISPR gRNA sequence
acaatagcttccaggtcttt

SEQ ID NO: 35556 - DNA, 20 bp, Artificial
  CRISPR gRNA sequence
caatagcttccaggtctttc

SEQ ID NO: 35557 - DNA, 20 bp, Artificial
  CRISPR gRNA sequence
ccaggtctttcctctcatcc

SEQ ID NO: 35558 - DNA, 20 bp, Artificial
  CRISPR gRNA sequence
caggtctttcctctcatccg

SEQ ID NO: 35559 - DNA, 20 bp, Artificial
  CRISPR gRNA sequence
tcctctcatccggtttccca

SEQ ID NO: 35560 - DNA, 20 bp, Artificial
  CRISPR gRNA sequence
cctctcatccggtttcccaa

SEQ ID NO: 35561 - DNA, 20 bp, Artificial
  CRISPR gRNA sequence
ctctcatccggtttcccaaa

SEQ ID NO: 35562 - DNA, 20 bp, Artificial
  CRISPR gRNA sequence
tcatccggtttcccaaactg

SEQ ID NO: 35563 - DNA, 20 bp, Artificial
  CRISPR gRNA sequence
atccggtttcccaaactgca

SEQ ID NO: 35564 - DNA, 20 bp, Artificial
  CRISPR gRNA sequence
cccaaactgcaggcattcgt

SEQ ID NO: 35565 - DNA, 20 bp, Artificial
  CRISPR gRNA sequence
ccaaactgcaggcattcgtc

SEQ ID NO: 35566 - DNA, 20 bp, Artificial
  CRISPR gRNA sequence
caggcattcgtcttccatct

SEQ ID NO: 35567 - DNA, 20 bp, Artificial
  CRISPR gRNA sequence
gtcttccatctttacaattt

SEQ ID NO: 35568 - DNA, 20 bp, Artificial
  CRISPR gRNA sequence
ccatctttacaatttttggg

SEQ ID NO: 35569 - DNA, 20 bp, Artificial
  CRISPR gRNA sequence
catctttacaatttttgggg

SEQ ID NO: 35570 - DNA, 20 bp, Artificial
  CRISPR gRNA sequence
tacaatttttggggtcatat

SEQ ID NO: 35571 - DNA, 20 bp, Artificial
  CRISPR gRNA sequence
acaatttttggggtcatatt

SEQ ID NO: 35572 - DNA, 20 bp, Artificial
  CRISPR gRNA sequence
caatttttggggtcatattg

SEQ ID NO: 35573 - DNA, 20 bp, Artificial
  CRISPR gRNA sequence
ttggggtcatattgacatat

SEQ ID NO: 35574 - DNA, 20 bp, Artificial
  CRISPR gRNA sequence
tggggtcatattgacatatc

SEQ ID NO: 35575 - DNA, 20 bp, Artificial
  CRISPR gRNA sequence
ggggtcatattgacatatca

SEQ ID NO: 35576 - DNA, 20 bp, Artificial
  CRISPR gRNA sequence
gggtcatattgacatatcac

SEQ ID NO: 35577 - DNA, 20 bp, Artificial
  CRISPR gRNA sequence
acatatcacctgttctacaa

SEQ ID NO: 35578 - DNA, 20 bp, Artificial
  CRISPR gRNA sequence
ttctacaatttaccttagta

SEQ ID NO: 35579 - DNA, 20 bp, Artificial
  CRISPR gRNA sequence
tacaatttaccttagtattt

SEQ ID NO: 35580 - DNA, 20 bp, Artificial
  CRISPR gRNA sequence
caatttaccttagtattttt

SEQ ID NO: 35581 - DNA, 20 bp, Artificial
  CRISPR gRNA sequence
accttagtatttttcttaaa

SEQ ID NO: 35582 - DNA, 20 bp, Artificial
  CRISPR gRNA sequence
ccttagtatttttcttaaat

SEQ ID NO: 35583 - DNA, 20 bp, Artificial
  CRISPR gRNA sequence
agtatttttcttaaattaac

SEQ ID NO: 35584 - DNA, 20 bp, Artificial
  CRISPR gRNA sequence
gtatttttcttaaattaact

SEQ ID NO: 35585 - DNA, 20 bp, Artificial
  CRISPR gRNA sequence
ttcttaaattaactttttaa

SEQ ID NO: 35586 - DNA, 20 bp, Artificial
  CRISPR gRNA sequence
tcttaaattaactttttaaa

SEQ ID NO: 35587 - DNA, 20 bp, Artificial
  CRISPR gRNA sequence
cttaaattaactttttaaag

SEQ ID NO: 35588 - DNA, 20 bp, Artificial
  CRISPR gRNA sequence
ttaaattaactttttaaaga

SEQ ID NO: 35589 - DNA, 20 bp, Artificial
  CRISPR gRNA sequence
aaattaactttttaaagaaa

SEQ ID NO: 35590 - DNA, 20 bp, Artificial
  CRISPR gRNA sequence
aattaactttttaaagaaac

SEQ ID NO: 35591 - DNA, 20 bp, Artificial
  CRISPR gRNA sequence
actttttaaagaaacttaaa

SEQ ID NO: 35592 - DNA, 20 bp, Artificial
  CRISPR gRNA sequence
tttaaagaaacttaaataga

SEQ ID NO: 35593 - DNA, 20 bp, Artificial
  CRISPR gRNA sequence
ttaaagaaacttaaatagac

SEQ ID NO: 35594 - DNA, 20 bp, Artificial
  CRISPR gRNA sequence
taaagaaacttaaatagacc

SEQ ID NO: 35595 - DNA, 20 bp, Artificial
  CRISPR gRNA sequence
aaagaaacttaaatagaccg

SEQ ID NO: 35596 - DNA, 20 bp, Artificial
  CRISPR gRNA sequence
aagaaacttaaatagaccga

SEQ ID NO: 35597 - DNA, 20 bp, Artificial
  CRISPR gRNA sequence
aaatagaccgattttaaaag

SEQ ID NO: 35598 - DNA, 20 bp, Artificial
  CRISPR gRNA sequence
aatagaccgattttaaaaga

SEQ ID NO: 35599 - DNA, 20 bp, Artificial
  CRISPR gRNA sequence
taaaagaaagctttctagag

SEQ ID NO: 35600 - DNA, 20 bp, Artificial
  CRISPR gRNA sequence
aaaagaaagctttctagagt

SEQ ID NO: 35601 - DNA, 20 bp, Artificial
  CRISPR gRNA sequence
aaagaaagctttctagagtt

SEQ ID NO: 35602 - DNA, 20 bp, Artificial
  CRISPR gRNA sequence
tctagagttgaaagcgggga

SEQ ID NO: 35603 - DNA, 20 bp, Artificial
  CRISPR gRNA sequence
ctagagttgaaagcggggag

SEQ ID NO: 35604 - DNA, 20 bp, Artificial
  CRISPR gRNA sequence
tagagttgaaagcggggagt

SEQ ID NO: 35605 - DNA, 20 bp, Artificial
  CRISPR gRNA sequence
gagttgaaagcggggagtca

SEQ ID NO: 35606 - DNA, 20 bp, Artificial
  CRISPR gRNA sequence
aaagcggggagtcagacaga

SEQ ID NO: 35607 - DNA, 20 bp, Artificial
  CRISPR gRNA sequence
gtccacccatgtacctagca

SEQ ID NO: 35608 - DNA, 20 bp, Artificial
  CRISPR gRNA sequence
tccacccatgtacctagcaa

SEQ ID NO: 35609 - DNA, 20 bp, Artificial
  CRISPR gRNA sequence
gcaagattattcacaatagt

SEQ ID NO: 35610 - DNA, 20 bp, Artificial
  CRISPR gRNA sequence
ttcacaatagtcaagaggta

SEQ ID NO: 35611 - DNA, 20 bp, Artificial
  CRISPR gRNA sequence
acaatagtcaagaggtagga

SEQ ID NO: 35612 - DNA, 20 bp, Artificial
  CRISPR gRNA sequence
tcaacaaatgaatggatgaa

SEQ ID NO: 35613 - DNA, 20 bp, Artificial
  CRISPR gRNA sequence
gaatactattccgccataga

SEQ ID NO: 35614 - DNA, 20 bp, Artificial
  CRISPR gRNA sequence
ttccgccatagaaaggaatt

SEQ ID NO: 35615 - DNA, 20 bp, Artificial
  CRISPR gRNA sequence
cgccatagaaaggaattaca

SEQ ID NO: 35616 - DNA, 20 bp, Artificial
  CRISPR gRNA sequence
cacatggcacgacatggatg

SEQ ID NO: 35617 - DNA, 20 bp, Artificial
  CRISPR gRNA sequence
gaagacattatgctaagtga

SEQ ID NO: 35618 - DNA, 20 bp, Artificial
  CRISPR gRNA sequence
tgctaagtgaaagaagccag

SEQ ID NO: 35619 - DNA, 20 bp, Artificial
  CRISPR gRNA sequence
agtgaaagaagccaggcaca

SEQ ID NO: 35620 - DNA, 20 bp, Artificial
  CRISPR gRNA sequence
tatttataggcggtgtctag

SEQ ID NO: 35621 - DNA, 20 bp, Artificial
  CRISPR gRNA sequence
tttataggcggtgtctagag

SEQ ID NO: 35622 - DNA, 20 bp, Artificial
  CRISPR gRNA sequence
ataggcggtgtctagagtag

SEQ ID NO: 35623 - DNA, 20 bp, Artificial
  CRISPR gRNA sequence
taggcggtgtctagagtagc

SEQ ID NO: 35624 - DNA, 20 bp, Artificial
  CRISPR gRNA sequence
gagtagcccaaaacatagag

SEQ ID NO: 35625 - DNA, 20 bp, Artificial
  CRISPR gRNA sequence
gagttaccacgagctgggtg

SEQ ID NO: 35626 - DNA, 20 bp, Artificial
  CRISPR gRNA sequence
ccacgagctgggtggaaggg

SEQ ID NO: 35627 - DNA, 20 bp, Artificial
  CRISPR gRNA sequence
ggtggaaggggcagtgggga

SEQ ID NO: 35628 - DNA, 20 bp, Artificial
  CRISPR gRNA sequence
ttgcttattgggtagagttt

SEQ ID NO: 35629 - DNA, 20 bp, Artificial
  CRISPR gRNA sequence
cttattgggtagagtttcag

SEQ ID NO: 35630 - DNA, 20 bp, Artificial
  CRISPR gRNA sequence
attgggtagagtttcagttt

SEQ ID NO: 35631 - DNA, 20 bp, Artificial
  CRISPR gRNA sequence
ttgggtagagtttcagtttg

SEQ ID NO: 35632 - DNA, 20 bp, Artificial
  CRISPR gRNA sequence
ggtagagtttcagtttggga

SEQ ID NO: 35633 - DNA, 20 bp, Artificial
  CRISPR gRNA sequence
cagtttgggaggatgaaaaa

SEQ ID NO: 35634 - DNA, 20 bp, Artificial
  CRISPR gRNA sequence
agtttgggaggatgaaaaag

SEQ ID NO: 35635 - DNA, 20 bp, Artificial
  CRISPR gRNA sequence
gggaggatgaaaaagttctg

SEQ ID NO: 35636 - DNA, 20 bp, Artificial
  CRISPR gRNA sequence
ggaggatgaaaaagttctgg

SEQ ID NO: 35637 - DNA, 20 bp, Artificial
  CRISPR gRNA sequence
tggagatggatggtagcgga

SEQ ID NO: 35638 - DNA, 20 bp, Artificial
  CRISPR gRNA sequence
gagatggatggtagcggagg

SEQ ID NO: 35639 - DNA, 20 bp, Artificial
  CRISPR gRNA sequence
cacaacagtttgaaatattt

SEQ ID NO: 35640 - DNA, 20 bp, Artificial
  CRISPR gRNA sequence
gaaatatttaatgccactga

SEQ ID NO: 35641 - DNA, 20 bp, Artificial
  CRISPR gRNA sequence
aaatatttaatgccactgaa

SEQ ID NO: 35642 - DNA, 20 bp, Artificial
  CRISPR gRNA sequence
aatgccactgaaatgtacat

SEQ ID NO: 35643 - DNA, 20 bp, Artificial
  CRISPR gRNA sequence
atgccactgaaatgtacatt

SEQ ID NO: 35644 - DNA, 20 bp, Artificial
  CRISPR gRNA sequence
aaatgtacatttgaaagtgg

SEQ ID NO: 35645 - DNA, 20 bp, Artificial
  CRISPR gRNA sequence
gaaagtggttaaaatggtaa

SEQ ID NO: 35646 - DNA, 20 bp, Artificial
  CRISPR gRNA sequence
aaagtggttaaaatggtaaa

SEQ ID NO: 35647 - DNA, 20 bp, Artificial
  CRISPR gRNA sequence
aaatggtaaattttatgtta

SEQ ID NO: 35648 - DNA, 20 bp, Artificial
  CRISPR gRNA sequence
tatgttatatgtattttacc

SEQ ID NO: 35649 - DNA, 20 bp, Artificial
  CRISPR gRNA sequence
atgttatatgtattttacca

SEQ ID NO: 35650 - DNA, 20 bp, Artificial
  CRISPR gRNA sequence
tgttatatgtattttaccat

SEQ ID NO: 35651 - DNA, 20 bp, Artificial
  CRISPR gRNA sequence
tatgtattttaccatgattt

SEQ ID NO: 35652 - DNA, 20 bp, Artificial
  CRISPR gRNA sequence
taccatgattttacaaaaag

SEQ ID NO: 35653 - DNA, 20 bp, Artificial
  CRISPR gRNA sequence
accatgattttacaaaaaga

SEQ ID NO: 35654 - DNA, 20 bp, Artificial
  CRISPR gRNA sequence
ccatgattttacaaaaagaa

SEQ ID NO: 35655 - DNA, 20 bp, Artificial
  CRISPR gRNA sequence
tacaaaaagaaaactttttt

SEQ ID NO: 35656 - DNA, 20 bp, Artificial
  CRISPR gRNA sequence
acaaaaagaaaacttttttt

SEQ ID NO: 35657 - DNA, 20 bp, Artificial
  CRISPR gRNA sequence
caaaaagaaaactttttttt

SEQ ID NO: 35658 - DNA, 20 bp, Artificial
  CRISPR gRNA sequence
ttttttccatgtataaacgg

SEQ ID NO: 35659 - DNA, 20 bp, Artificial
  CRISPR gRNA sequence
tttttccatgtataaacgga

SEQ ID NO: 35660 - DNA, 20 bp, Artificial
  CRISPR gRNA sequence
ttttccatgtataaacggaa

SEQ ID NO: 35661 - DNA, 20 bp, Artificial
  CRISPR gRNA sequence
tttccatgtataaacggaaa

SEQ ID NO: 35662 - DNA, 20 bp, Artificial
  CRISPR gRNA sequence
ttccatgtataaacggaaaa

SEQ ID NO: 35663 - DNA, 20 bp, Artificial
  CRISPR gRNA sequence
tccatgtataaacggaaaag

SEQ ID NO: 35664 - DNA, 20 bp, Artificial
  CRISPR gRNA sequence
ccatgtataaacggaaaagc

SEQ ID NO: 35665 - DNA, 20 bp, Artificial
  CRISPR gRNA sequence
catgtataaacggaaaagca

SEQ ID NO: 35666 - DNA, 20 bp, Artificial
  CRISPR gRNA sequence
gtggttgaaaaagaaacaat

SEQ ID NO: 35667 - DNA, 20 bp, Artificial
  CRISPR gRNA sequence
tggttgaaaaagaaacaatg

SEQ ID NO: 35668 - DNA, 20 bp, Artificial
  CRISPR gRNA sequence
aaaaagaaacaatgttacta

SEQ ID NO: 35669 - DNA, 20 bp, Artificial
  CRISPR gRNA sequence
ctaaaataatctcagcttct

SEQ ID NO: 35670 - DNA, 20 bp, Artificial
  CRISPR gRNA sequence
aaataatctcagcttcttta

SEQ ID NO: 35671 - DNA, 20 bp, Artificial
  CRISPR gRNA sequence
agcttctttaccactttgtt

SEQ ID NO: 35672 - DNA, 20 bp, Artificial
  CRISPR gRNA sequence
ctttaccactttgttaaaaa

SEQ ID NO: 35673 - DNA, 20 bp, Artificial
  CRISPR gRNA sequence
tttaccactttgttaaaaag

SEQ ID NO: 35674 - DNA, 20 bp, Artificial
  CRISPR gRNA sequence
taccactttgttaaaaagaa

SEQ ID NO: 35675 - DNA, 20 bp, Artificial
  CRISPR gRNA sequence
accactttgttaaaaagaaa

SEQ ID NO: 35676 - DNA, 20 bp, Artificial
  CRISPR gRNA sequence
ccactttgttaaaaagaaat

SEQ ID NO: 35677 - DNA, 20 bp, Artificial
  CRISPR gRNA sequence
tgttaaaaagaaatcttagc

SEQ ID NO: 35678 - DNA, 20 bp, Artificial
  CRISPR gRNA sequence
gttaaaaagaaatcttagca

SEQ ID NO: 35679 - DNA, 20 bp, Artificial
  CRISPR gRNA sequence
ttaaaaagaaatcttagcaa

SEQ ID NO: 35680 - DNA, 20 bp, Artificial
  CRISPR gRNA sequence
aaaagaaatcttagcaagca

SEQ ID NO: 35681 - DNA, 20 bp, Artificial
  CRISPR gRNA sequence
agcaagcattagggcactgt

SEQ ID NO: 35682 - DNA, 20 bp, Artificial
  CRISPR gRNA sequence
gcaagcattagggcactgtc

SEQ ID NO: 35683 - DNA, 20 bp, Artificial
  CRISPR gRNA sequence
gggcactgtcaaacatcagg

SEQ ID NO: 35684 - DNA, 20 bp, Artificial
  CRISPR gRNA sequence
tcaaacatcagggaaaatca

SEQ ID NO: 35685 - DNA, 20 bp, Artificial
  CRISPR gRNA sequence
tgtccttgatgtcagaagga

SEQ ID NO: 35686 - DNA, 20 bp, Artificial
  CRISPR gRNA sequence
gtccttgatgtcagaaggat

SEQ ID NO: 35687 - DNA, 20 bp, Artificial
  CRISPR gRNA sequence
tccttgatgtcagaaggatt

SEQ ID NO: 35688 - DNA, 20 bp, Artificial
  CRISPR gRNA sequence
gatgtcagaaggattgaagg

SEQ ID NO: 35689 - DNA, 20 bp, Artificial
  CRISPR gRNA sequence
atgtcagaaggattgaagga

SEQ ID NO: 35690 - DNA, 20 bp, Artificial
  CRISPR gRNA sequence
aaggaatctgaaaactatct

SEQ ID NO: 35691 - DNA, 20 bp, Artificial
  CRISPR gRNA sequence
aaaactatctatgtccttcc

SEQ ID NO: 35692 - DNA, 20 bp, Artificial
  CRISPR gRNA sequence
tctatgtccttcctatgaga

SEQ ID NO: 35693 - DNA, 20 bp, Artificial
  CRISPR gRNA sequence
tgtccttcctatgagaatcg

SEQ ID NO: 35694 - DNA, 20 bp, Artificial
  CRISPR gRNA sequence
cctatgagaatcggtggtaa

SEQ ID NO: 35695 - DNA, 20 bp, Artificial
  CRISPR gRNA sequence
ctatgagaatcggtggtaac

SEQ ID NO: 35696 - DNA, 20 bp, Artificial
  CRISPR gRNA sequence
tgagaatcggtggtaactaa

SEQ ID NO: 35697 - DNA, 20 bp, Artificial
  CRISPR gRNA sequence
atgcccctttctgaactgtc

SEQ ID NO: 35698 - DNA, 20 bp, Artificial
  CRISPR gRNA sequence
tctgaactgtcttttgactg

SEQ ID NO: 35699 - DNA, 20 bp, Artificial
  CRISPR gRNA sequence
ctgaactgtcttttgactgt

SEQ ID NO: 35700 - DNA, 20 bp, Artificial
  CRISPR gRNA sequence
tgaactgtcttttgactgtg

SEQ ID NO: 35701 - DNA, 20 bp, Artificial
  CRISPR gRNA sequence
aactgtcttttgactgtgtg

SEQ ID NO: 35702 - DNA, 20 bp, Artificial
  CRISPR gRNA sequence
tcttttgactgtgtgtgtct

SEQ ID NO: 35703 - DNA, 20 bp, Artificial
  CRISPR gRNA sequence
ttgactgtgtgtgtcttggt

SEQ ID NO: 35704 - DNA, 20 bp, Artificial
  CRISPR gRNA sequence
tgactgtgtgtgtcttggtc

SEQ ID NO: 35705 - DNA, 20 bp, Artificial
  CRISPR gRNA sequence
gactgtgtgtgtcttggtct

SEQ ID NO: 35706 - DNA, 20 bp, Artificial
  CRISPR gRNA sequence
actgtgtgtgtcttggtctt

SEQ ID NO: 35707 - DNA, 20 bp, Artificial
  CRISPR gRNA sequence
tgtgtgtcttggtctttgga

SEQ ID NO: 35708 - DNA, 20 bp, Artificial
  CRISPR gRNA sequence
ggtctttggaaacctcccat

SEQ ID NO: 35709 - DNA, 20 bp, Artificial
  CRISPR gRNA sequence
gtctttggaaacctcccatc

SEQ ID NO: 35710 - DNA, 20 bp, Artificial
  CRISPR gRNA sequence
tggaaacctcccatctgcct

SEQ ID NO: 35711 - DNA, 20 bp, Artificial
  CRISPR gRNA sequence
ggaaacctcccatctgccta

SEQ ID NO: 35712 - DNA, 20 bp, Artificial
  CRISPR gRNA sequence
gaaacctcccatctgcctat

SEQ ID NO: 35713 - DNA, 20 bp, Artificial
  CRISPR gRNA sequence
ccatctgcctatgctttcct

SEQ ID NO: 35714 - DNA, 20 bp, Artificial
  CRISPR gRNA sequence
cctatgctttcctctctgac

SEQ ID NO: 35715 - DNA, 20 bp, Artificial
  CRISPR gRNA sequence
tgctttcctctctgactttt

SEQ ID NO: 35716 - DNA, 20 bp, Artificial
  CRISPR gRNA sequence
tcctctctgacttttttctc

SEQ ID NO: 35717 - DNA, 20 bp, Artificial
  CRISPR gRNA sequence
cctctctgacttttttctct

SEQ ID NO: 35718 - DNA, 20 bp, Artificial
  CRISPR gRNA sequence
ctctctgacttttttctctc

SEQ ID NO: 35719 - DNA, 20 bp, Artificial
  CRISPR gRNA sequence
tctgacttttttctctctct

SEQ ID NO: 35720 - DNA, 20 bp, Artificial
  CRISPR gRNA sequence
tgacttttttctctctcttt

SEQ ID NO: 35721 - DNA, 20 bp, Artificial
  CRISPR gRNA sequence
acttttttctctctcttttt

SEQ ID NO: 35722 - DNA, 20 bp, Artificial
  CRISPR gRNA sequence
ttttctctctcttttttttt

SEQ ID NO: 35723 - DNA, 20 bp, Artificial
  CRISPR gRNA sequence
tttctctctctttttttttt

SEQ ID NO: 35724 - DNA, 20 bp, Artificial
  CRISPR gRNA sequence
ttctctctcttttttttttc

SEQ ID NO: 35725 - DNA, 20 bp, Artificial
  CRISPR gRNA sequence
tctctctcttttttttttcc

SEQ ID NO: 35726 - DNA, 20 bp, Artificial
  CRISPR gRNA sequence
ctctctcttttttttttcct

SEQ ID NO: 35727 - DNA, 20 bp, Artificial
  CRISPR gRNA sequence
tctctcttttttttttcctg

SEQ ID NO: 35728 - DNA, 20 bp, Artificial
  CRISPR gRNA sequence
tctcttttttttttcctgag

SEQ ID NO: 35729 - DNA, 20 bp, Artificial
  CRISPR gRNA sequence
tcttttttttttcctgagac

SEQ ID NO: 35730 - DNA, 20 bp, Artificial
  CRISPR gRNA sequence
ttttttttttcctgagacag

SEQ ID NO: 35731 - DNA, 20 bp, Artificial
  CRISPR gRNA sequence
ttttttttcctgagacagtc

SEQ ID NO: 35732 - DNA, 20 bp, Artificial
  CRISPR gRNA sequence
tttttttcctgagacagtct

SEQ ID NO: 35733 - DNA, 20 bp, Artificial
  CRISPR gRNA sequence
ttttttcctgagacagtctt

SEQ ID NO: 35734 - DNA, 20 bp, Artificial
  CRISPR gRNA sequence
tttttcctgagacagtcttg

SEQ ID NO: 35735 - DNA, 20 bp, Artificial
  CRISPR gRNA sequence
ttttcctgagacagtcttgc

SEQ ID NO: 35736 - DNA, 20 bp, Artificial
  CRISPR gRNA sequence
tttcctgagacagtcttgct

SEQ ID NO: 35737 - DNA, 20 bp, Artificial
  CRISPR gRNA sequence
ttcctgagacagtcttgctc

SEQ ID NO: 35738 - DNA, 20 bp, Artificial
  CRISPR gRNA sequence
tcctgagacagtcttgctct

SEQ ID NO: 35739 - DNA, 20 bp, Artificial
  CRISPR gRNA sequence
cctgagacagtcttgctctg

SEQ ID NO: 35740 - DNA, 20 bp, Artificial
  CRISPR gRNA sequence
ctgagacagtcttgctctgt

SEQ ID NO: 35741 - DNA, 20 bp, Artificial
  CRISPR gRNA sequence
agacagtcttgctctgttgc

SEQ ID NO: 35742 - DNA, 20 bp, Artificial
  CRISPR gRNA sequence
gctctgttgcccaggctggc

SEQ ID NO: 35743 - DNA, 20 bp, Artificial
  CRISPR gRNA sequence
ctctgttgcccaggctggcg

SEQ ID NO: 35744 - DNA, 20 bp, Artificial
  CRISPR gRNA sequence
tgttgcccaggctggcgtgc

SEQ ID NO: 35745 - DNA, 20 bp, Artificial
  CRISPR gRNA sequence
ttgcccaggctggcgtgcag

SEQ ID NO: 35746 - DNA, 20 bp, Artificial
  CRISPR gRNA sequence
cccaggctggcgtgcagtgg

SEQ ID NO: 35747 - DNA, 20 bp, Artificial
  CRISPR gRNA sequence
gcgtgcagtggtgcaatctc

SEQ ID NO: 35748 - DNA, 20 bp, Artificial
  CRISPR gRNA sequence
agctctcgggtaacctccac

SEQ ID NO: 35749 - DNA, 20 bp, Artificial
  CRISPR gRNA sequence
tcgggtaacctccacctctc

SEQ ID NO: 35750 - DNA, 20 bp, Artificial
  CRISPR gRNA sequence
gggtaacctccacctctcgg

SEQ ID NO: 35751 - DNA, 20 bp, Artificial
  CRISPR gRNA sequence
cacctctcgggtaaactccg

SEQ ID NO: 35752 - DNA, 20 bp, Artificial
  CRISPR gRNA sequence
tcgggtaaactccgcctctt

SEQ ID NO: 35753 - DNA, 20 bp, Artificial
  CRISPR gRNA sequence
gggtaaactccgcctcttgg

SEQ ID NO: 35754 - DNA, 20 bp, Artificial
  CRISPR gRNA sequence
cgcctcttgggttcaagtga

SEQ ID NO: 35755 - DNA, 20 bp, Artificial
  CRISPR gRNA sequence
ttgggttcaagtgattctcg

SEQ ID NO: 35756 - DNA, 20 bp, Artificial
  CRISPR gRNA sequence
gggttcaagtgattctcgtg

SEQ ID NO: 35757 - DNA, 20 bp, Artificial
  CRISPR gRNA sequence
ggttcaagtgattctcgtgc

SEQ ID NO: 35758 - DNA, 20 bp, Artificial
  CRISPR gRNA sequence
aagtgattctcgtgcctcag

SEQ ID NO: 35759 - DNA, 20 bp, Artificial
  CRISPR gRNA sequence
tcgtgcctcagcctcccaag

SEQ ID NO: 35760 - DNA, 20 bp, Artificial
  CRISPR gRNA sequence
gtgcctcagcctcccaagta

SEQ ID NO: 35761 - DNA, 20 bp, Artificial
  CRISPR gRNA sequence
agcctcccaagtagttgaga

SEQ ID NO: 35762 - DNA, 20 bp, Artificial
  CRISPR gRNA sequence
ccaagtagttgagattacag

SEQ ID NO: 35763 - DNA, 20 bp, Artificial
  CRISPR gRNA sequence
agattacaggtgtgcaccac

SEQ ID NO: 35764 - DNA, 20 bp, Artificial
  CRISPR gRNA sequence
caggtgtgcaccaccatgcc

SEQ ID NO: 35765 - DNA, 20 bp, Artificial
  CRISPR gRNA sequence
aaacacaaaaaagtgtttta

SEQ ID NO: 35766 - DNA, 20 bp, Artificial
  CRISPR gRNA sequence
tagtagagttggggtttctc

SEQ ID NO: 35767 - DNA, 20 bp, Artificial
  CRISPR gRNA sequence
agtagagttggggtttctcc

SEQ ID NO: 35768 - DNA, 20 bp, Artificial
  CRISPR gRNA sequence
gtagagttggggtttctcca

SEQ ID NO: 35769 - DNA, 20 bp, Artificial
  CRISPR gRNA sequence
gggtttctccaggttgccca

SEQ ID NO: 35770 - DNA, 20 bp, Artificial
  CRISPR gRNA sequence
ctccaggttgcccaggctgg

SEQ ID NO: 35771 - DNA, 20 bp, Artificial
  CRISPR gRNA sequence
tccaggttgcccaggctggt

SEQ ID NO: 35772 - DNA, 20 bp, Artificial
  CRISPR gRNA sequence
caggttgcccaggctggtct

SEQ ID NO: 35773 - DNA, 20 bp, Artificial
  CRISPR gRNA sequence
cccaggctggtcttgaactc

SEQ ID NO: 35774 - DNA, 20 bp, Artificial
  CRISPR gRNA sequence
gtcttgaactcctggcctca

SEQ ID NO: 35775 - DNA, 20 bp, Artificial
  CRISPR gRNA sequence
gaactcctggcctcaagcaa

SEQ ID NO: 35776 - DNA, 20 bp, Artificial
  CRISPR gRNA sequence
aactcctggcctcaagcaat

SEQ ID NO: 35777 - DNA, 20 bp, Artificial
  CRISPR gRNA sequence
ctggcctcaagcaatccacc

SEQ ID NO: 35778 - DNA, 20 bp, Artificial
  CRISPR gRNA sequence
gcctcaagcaatccacccgc

SEQ ID NO: 35779 - DNA, 20 bp, Artificial
  CRISPR gRNA sequence
aagcaatccacccgcctcgg

SEQ ID NO: 35780 - DNA, 20 bp, Artificial
  CRISPR gRNA sequence
ggcctcccaaagtgctagga

SEQ ID NO: 35781 - DNA, 20 bp, Artificial
  CRISPR gRNA sequence
ccaaagtgctaggattacag

SEQ ID NO: 35782 - DNA, 20 bp, Artificial
  CRISPR gRNA sequence
ggattacaggtgtgaaccac

SEQ ID NO: 35783 - DNA, 20 bp, Artificial
  CRISPR gRNA sequence
caggtgtgaaccactgctcc

SEQ ID NO: 35784 - DNA, 20 bp, Artificial
  CRISPR gRNA sequence
ctcccggcccctctctgatc

SEQ ID NO: 35785 - DNA, 20 bp, Artificial
  CRISPR gRNA sequence
ccggcccctctctgatcttt

SEQ ID NO: 35786 - DNA, 20 bp, Artificial
  CRISPR gRNA sequence
tctgatctttctaaacaatc

SEQ ID NO: 35787 - DNA, 20 bp, Artificial
  CRISPR gRNA sequence
tgatctttctaaacaatccc

SEQ ID NO: 35788 - DNA, 20 bp, Artificial
  CRISPR gRNA sequence
atctttctaaacaatccctt

SEQ ID NO: 35789 - DNA, 20 bp, Artificial
  CRISPR gRNA sequence
tctaaacaatccctttagga

SEQ ID NO: 35790 - DNA, 20 bp, Artificial
  CRISPR gRNA sequence
ctaaacaatccctttaggat

SEQ ID NO: 35791 - DNA, 20 bp, Artificial
  CRISPR gRNA sequence
taaacaatccctttaggatc

SEQ ID NO: 35792 - DNA, 20 bp, Artificial
  CRISPR gRNA sequence
aacaatccctttaggatcta

SEQ ID NO: 35793 - DNA, 20 bp, Artificial
  CRISPR gRNA sequence
taggatctataataattatt

SEQ ID NO: 35794 - DNA, 20 bp, Artificial
  CRISPR gRNA sequence
aggatctataataattattc

SEQ ID NO: 35795 - DNA, 20 bp, Artificial
  CRISPR gRNA sequence
ggatctataataattattcc

SEQ ID NO: 35796 - DNA, 20 bp, Artificial
  CRISPR gRNA sequence
taataattattcccaatgca

SEQ ID NO: 35797 - DNA, 20 bp, Artificial
  CRISPR gRNA sequence
ttcccaatgcatgaatattc

SEQ ID NO: 35798 - DNA, 20 bp, Artificial
  CRISPR gRNA sequence
ccaatgcatgaatattcttt

SEQ ID NO: 35799 - DNA, 20 bp, Artificial
  CRISPR gRNA sequence
tttggtggttttctaaagtg

SEQ ID NO: 35800 - DNA, 20 bp, Artificial
  CRISPR gRNA sequence
tggtggttttctaaagtgct

SEQ ID NO: 35801 - DNA, 20 bp, Artificial
  CRISPR gRNA sequence
ggtggttttctaaagtgctt

SEQ ID NO: 35802 - DNA, 20 bp, Artificial
  CRISPR gRNA sequence
gtggttttctaaagtgcttt

SEQ ID NO: 35803 - DNA, 20 bp, Artificial
  CRISPR gRNA sequence
tctaaagtgctttttctgta

SEQ ID NO: 35804 - DNA, 20 bp, Artificial
  CRISPR gRNA sequence
ctaaagtgctttttctgtac

SEQ ID NO: 35805 - DNA, 20 bp, Artificial
  CRISPR gRNA sequence
taaagtgctttttctgtaca

SEQ ID NO: 35806 - DNA, 20 bp, Artificial
  CRISPR gRNA sequence
aagtgctttttctgtacaca

SEQ ID NO: 35807 - DNA, 20 bp, Artificial
  CRISPR gRNA sequence
tttctgtacacatcagacat

SEQ ID NO: 35808 - DNA, 20 bp, Artificial
  CRISPR gRNA sequence
ttctgtacacatcagacatc

SEQ ID NO: 35809 - DNA, 20 bp, Artificial
  CRISPR gRNA sequence
tctgtacacatcagacatca

SEQ ID NO: 35810 - DNA, 20 bp, Artificial
  CRISPR gRNA sequence
ctgtacacatcagacatcat

SEQ ID NO: 35811 - DNA, 20 bp, Artificial
  CRISPR gRNA sequence
tgtacacatcagacatcatc

SEQ ID NO: 35812 - DNA, 20 bp, Artificial
  CRISPR gRNA sequence
tacacatcagacatcatcaa

SEQ ID NO: 35813 - DNA, 20 bp, Artificial
  CRISPR gRNA sequence
tcatgttttatccattttac

SEQ ID NO: 35814 - DNA, 20 bp, Artificial
  CRISPR gRNA sequence
atgttttatccattttacag

SEQ ID NO: 35815 - DNA, 20 bp, Artificial
  CRISPR gRNA sequence
tatccattttacagatgaac

SEQ ID NO: 35816 - DNA, 20 bp, Artificial
  CRISPR gRNA sequence
atccattttacagatgaacc

SEQ ID NO: 35817 - DNA, 20 bp, Artificial
  CRISPR gRNA sequence
tccattttacagatgaacct

SEQ ID NO: 35818 - DNA, 20 bp, Artificial
  CRISPR gRNA sequence
tacagatgaacctcagagag

SEQ ID NO: 35819 - DNA, 20 bp, Artificial
  CRISPR gRNA sequence
acagatgaacctcagagagg

SEQ ID NO: 35820 - DNA, 20 bp, Artificial
  CRISPR gRNA sequence
cagatgaacctcagagaggg

SEQ ID NO: 35821 - DNA, 20 bp, Artificial
  CRISPR gRNA sequence
agagaggggaagtcacttgt

SEQ ID NO: 35822 - DNA, 20 bp, Artificial
  CRISPR gRNA sequence
gtcagtgtgactcaaggcaa

SEQ ID NO: 35823 - DNA, 20 bp, Artificial
  CRISPR gRNA sequence
tcagtgtgactcaaggcaaa

SEQ ID NO: 35824 - DNA, 20 bp, Artificial
  CRISPR gRNA sequence
aaggcaaatctgaggctaag

SEQ ID NO: 35825 - DNA, 20 bp, Artificial
  CRISPR gRNA sequence
aggctaagtccagaagtttc

SEQ ID NO: 35826 - DNA, 20 bp, Artificial
  CRISPR gRNA sequence
agtccagaagtttcctacct

SEQ ID NO: 35827 - DNA, 20 bp, Artificial
  CRISPR gRNA sequence
cctacctccctccagccact

SEQ ID NO: 35828 - DNA, 20 bp, Artificial
  CRISPR gRNA sequence
ctacctccctccagccactt

SEQ ID NO: 35829 - DNA, 20 bp, Artificial
  CRISPR gRNA sequence
cctccctccagccacttccc

SEQ ID NO: 35830 - DNA, 20 bp, Artificial
  CRISPR gRNA sequence
cctccagccacttccctgat

SEQ ID NO: 35831 - DNA, 20 bp, Artificial
  CRISPR gRNA sequence
cagccacttccctgattgcc

SEQ ID NO: 35832 - DNA, 20 bp, Artificial
  CRISPR gRNA sequence
ccctgattgcctggaactaa

SEQ ID NO: 35833 - DNA, 20 bp, Artificial
  CRISPR gRNA sequence
cctgattgcctggaactaat

SEQ ID NO: 35834 - DNA, 20 bp, Artificial
  CRISPR gRNA sequence
attgcctggaactaatccag

SEQ ID NO: 35835 - DNA, 20 bp, Artificial
  CRISPR gRNA sequence
cctggaactaatccagagtt

SEQ ID NO: 35836 - DNA, 20 bp, Artificial
  CRISPR gRNA sequence
gaactaatccagagtttcct

SEQ ID NO: 35837 - DNA, 20 bp, Artificial
  CRISPR gRNA sequence
atccagagtttccttgggtt

SEQ ID NO: 35838 - DNA, 20 bp, Artificial
  CRISPR gRNA sequence
ccttgggttaatttctgatt

SEQ ID NO: 35839 - DNA, 20 bp, Artificial
  CRISPR gRNA sequence
cttgggttaatttctgattc

SEQ ID NO: 35840 - DNA, 20 bp, Artificial
  CRISPR gRNA sequence
gggttaatttctgattctgc

SEQ ID NO: 35841 - DNA, 20 bp, Artificial
  CRISPR gRNA sequence
ggttaatttctgattctgct

SEQ ID NO: 35842 - DNA, 20 bp, Artificial
  CRISPR gRNA sequence
atttctgattctgctcttct

SEQ ID NO: 35843 - DNA, 20 bp, Artificial
  CRISPR gRNA sequence
ctgattctgctcttctcaag

SEQ ID NO: 35844 - DNA, 20 bp, Artificial
  CRISPR gRNA sequence
tgattctgctcttctcaagg

SEQ ID NO: 35845 - DNA, 20 bp, Artificial
  CRISPR gRNA sequence
attctgctcttctcaaggta

SEQ ID NO: 35846 - DNA, 20 bp, Artificial
  CRISPR gRNA sequence
tgctcttctcaaggtatctg

SEQ ID NO: 35847 - DNA, 20 bp, Artificial
  CRISPR gRNA sequence
ctcttctcaaggtatctgag

SEQ ID NO: 35848 - DNA, 20 bp, Artificial
  CRISPR gRNA sequence
ttctcaaggtatctgaggct

SEQ ID NO: 35849 - DNA, 20 bp, Artificial
  CRISPR gRNA sequence
ctcaaggtatctgaggctgg

SEQ ID NO: 35850 - DNA, 20 bp, Artificial
  CRISPR gRNA sequence
tcaaggtatctgaggctggg

SEQ ID NO: 35851 - DNA, 20 bp, Artificial
  CRISPR gRNA sequence
aaggtatctgaggctgggtc

SEQ ID NO: 35852 - DNA, 20 bp, Artificial
  CRISPR gRNA sequence
aggctgggtcttaggacatg

SEQ ID NO: 35853 - DNA, 20 bp, Artificial
  CRISPR gRNA sequence
ggtcttaggacatgaaacca

SEQ ID NO: 35854 - DNA, 20 bp, Artificial
  CRISPR gRNA sequence
aggacatgaaaccaagcccc

SEQ ID NO: 35855 - DNA, 20 bp, Artificial
  CRISPR gRNA sequence
ggacatgaaaccaagcccca

SEQ ID NO: 35856 - DNA, 20 bp, Artificial
  CRISPR gRNA sequence
ggtatcaacaggtttctctc

SEQ ID NO: 35857 - DNA, 20 bp, Artificial
  CRISPR gRNA sequence
ctctctgactgcctgggacc

SEQ ID NO: 35858 - DNA, 20 bp, Artificial
  CRISPR gRNA sequence
tctctgactgcctgggacct

SEQ ID NO: 35859 - DNA, 20 bp, Artificial
  CRISPR gRNA sequence
tctgactgcctgggacctgc

SEQ ID NO: 35860 - DNA, 20 bp, Artificial
  CRISPR gRNA sequence
tgactgcctgggacctgccc

SEQ ID NO: 35861 - DNA, 20 bp, Artificial
  CRISPR gRNA sequence
actgcctgggacctgccctg

SEQ ID NO: 35862 - DNA, 20 bp, Artificial
  CRISPR gRNA sequence
cctgggacctgccctgcatt

SEQ ID NO: 35863 - DNA, 20 bp, Artificial
  CRISPR gRNA sequence
ggacctgccctgcatttgtg

SEQ ID NO: 35864 - DNA, 20 bp, Artificial
  CRISPR gRNA sequence
ccctgcatttgtggaggttc

SEQ ID NO: 35865 - DNA, 20 bp, Artificial
  CRISPR gRNA sequence
catttgtggaggttcacatc

SEQ ID NO: 35866 - DNA, 20 bp, Artificial
  CRISPR gRNA sequence
gtggaggttcacatctgctt

SEQ ID NO: 35867 - DNA, 20 bp, Artificial
  CRISPR gRNA sequence
tggaggttcacatctgcttg

SEQ ID NO: 35868 - DNA, 20 bp, Artificial
  CRISPR gRNA sequence
acatctgcttgctgcactgg

SEQ ID NO: 35869 - DNA, 20 bp, Artificial
  CRISPR gRNA sequence
cttgctgcactgggctgggc

SEQ ID NO: 35870 - DNA, 20 bp, Artificial
  CRISPR gRNA sequence
gctgcactgggctgggctct

SEQ ID NO: 35871 - DNA, 20 bp, Artificial
  CRISPR gRNA sequence
ctgcactgggctgggctctc

SEQ ID NO: 35872 - DNA, 20 bp, Artificial
  CRISPR gRNA sequence
cactgggctgggctctcagt

SEQ ID NO: 35873 - DNA, 20 bp, Artificial
  CRISPR gRNA sequence
ggctgggctctcagtagacc

SEQ ID NO: 35874 - DNA, 20 bp, Artificial
  CRISPR gRNA sequence
ggctctcagtagaccagggt

SEQ ID NO: 35875 - DNA, 20 bp, Artificial
  CRISPR gRNA sequence
tcagtagaccagggttcaaa

SEQ ID NO: 35876 - DNA, 20 bp, Artificial
  CRISPR gRNA sequence
agtagaccagggttcaaatc

SEQ ID NO: 35877 - DNA, 20 bp, Artificial
  CRISPR gRNA sequence
aaatcctgcgtctgcaaact

SEQ ID NO: 35878 - DNA, 20 bp, Artificial
  CRISPR gRNA sequence
cgtctgcaaactgcttgcta

SEQ ID NO: 35879 - DNA, 20 bp, Artificial
  CRISPR gRNA sequence
caaactgcttgctatgtggc

SEQ ID NO: 35880 - DNA, 20 bp, Artificial
  CRISPR gRNA sequence
cttgctatgtggcgttaagc

SEQ ID NO: 35881 - DNA, 20 bp, Artificial
  CRISPR gRNA sequence
gctatgtggcgttaagcaaa

SEQ ID NO: 35882 - DNA, 20 bp, Artificial
  CRISPR gRNA sequence
ctatgtggcgttaagcaaaa

SEQ ID NO: 35883 - DNA, 20 bp, Artificial
  CRISPR gRNA sequence
tgtggcgttaagcaaaacaa

SEQ ID NO: 35884 - DNA, 20 bp, Artificial
  CRISPR gRNA sequence
agcaaaacaaaacaaaacac

SEQ ID NO: 35885 - DNA, 20 bp, Artificial
  CRISPR gRNA sequence
ctggtactccttttctgata

SEQ ID NO: 35886 - DNA, 20 bp, Artificial
  CRISPR gRNA sequence
gtactccttttctgatagag

SEQ ID NO: 35887 - DNA, 20 bp, Artificial
  CRISPR gRNA sequence
cttttctgatagaggttttg

SEQ ID NO: 35888 - DNA, 20 bp, Artificial
  CRISPR gRNA sequence
ttctgatagaggttttgtaa

SEQ ID NO: 35889 - DNA, 20 bp, Artificial
  CRISPR gRNA sequence
tctgatagaggttttgtaac

SEQ ID NO: 35890 - DNA, 20 bp, Artificial
  CRISPR gRNA sequence
ctgatagaggttttgtaaca

SEQ ID NO: 35891 - DNA, 20 bp, Artificial
  CRISPR gRNA sequence
tgatagaggttttgtaacag

SEQ ID NO: 35892 - DNA, 20 bp, Artificial
  CRISPR gRNA sequence
atagaggttttgtaacaggg

SEQ ID NO: 35893 - DNA, 20 bp, Artificial
  CRISPR gRNA sequence
tgtaacagggagagagtaaa

SEQ ID NO: 35894 - DNA, 20 bp, Artificial
  CRISPR gRNA sequence
gtaacagggagagagtaaag

SEQ ID NO: 35895 - DNA, 20 bp, Artificial
  CRISPR gRNA sequence
taacagggagagagtaaaga

SEQ ID NO: 35896 - DNA, 20 bp, Artificial
  CRISPR gRNA sequence
ccagtgtctctgacttgagg

SEQ ID NO: 35897 - DNA, 20 bp, Artificial
  CRISPR gRNA sequence
tgacttgagggacttttgcc

SEQ ID NO: 35898 - DNA, 20 bp, Artificial
  CRISPR gRNA sequence
acttgagggacttttgcccc

SEQ ID NO: 35899 - DNA, 20 bp, Artificial
  CRISPR gRNA sequence
gagggacttttgccccacaa

SEQ ID NO: 35900 - DNA, 20 bp, Artificial
  CRISPR gRNA sequence
agggacttttgccccacaaa

SEQ ID NO: 35901 - DNA, 20 bp, Artificial
  CRISPR gRNA sequence
ttgccccacaaacgaacatt

SEQ ID NO: 35902 - DNA, 20 bp, Artificial
  CRISPR gRNA sequence
tgccccacaaacgaacattg

SEQ ID NO: 35903 - DNA, 20 bp, Artificial
  CRISPR gRNA sequence
gccccacaaacgaacattgg

SEQ ID NO: 35904 - DNA, 20 bp, Artificial
  CRISPR gRNA sequence
ccccacaaacgaacattgga

SEQ ID NO: 35905 - DNA, 20 bp, Artificial
  CRISPR gRNA sequence
gagtcacctgggatagatgg

SEQ ID NO: 35906 - DNA, 20 bp, Artificial
  CRISPR gRNA sequence
ggatagatggtttaacctgc

SEQ ID NO: 35907 - DNA, 20 bp, Artificial
  CRISPR gRNA sequence
aacctgcaggatctcagcct

SEQ ID NO: 35908 - DNA, 20 bp, Artificial
  CRISPR gRNA sequence
acctgcaggatctcagcctc

SEQ ID NO: 35909 - DNA, 20 bp, Artificial
  CRISPR gRNA sequence
caggatctcagcctcacccc

SEQ ID NO: 35910 - DNA, 20 bp, Artificial
  CRISPR gRNA sequence
agcctcaccccaggcctagc

SEQ ID NO: 35911 - DNA, 20 bp, Artificial
  CRISPR gRNA sequence
accccaggcctagccaaccg

SEQ ID NO: 35912 - DNA, 20 bp, Artificial
  CRISPR gRNA sequence
gccaaccgggcctgggggtg

SEQ ID NO: 35913 - DNA, 20 bp, Artificial
  CRISPR gRNA sequence
ggggtgagcccgggaaccta

SEQ ID NO: 35914 - DNA, 20 bp, Artificial
  CRISPR gRNA sequence
catcctgaacaggttgatca

SEQ ID NO: 35915 - DNA, 20 bp, Artificial
  CRISPR gRNA sequence
aacaggttgatcatcccagg

SEQ ID NO: 35916 - DNA, 20 bp, Artificial
  CRISPR gRNA sequence
atcatcccaggtgatgttca

SEQ ID NO: 35917 - DNA, 20 bp, Artificial
  CRISPR gRNA sequence
atgtgtggggagcctgggat

SEQ ID NO: 35918 - DNA, 20 bp, Artificial
  CRISPR gRNA sequence
ggattccccactcagtcatc

SEQ ID NO: 35919 - DNA, 20 bp, Artificial
  CRISPR gRNA sequence
cccactcagtcatctccaaa

SEQ ID NO: 35920 - DNA, 20 bp, Artificial
  CRISPR gRNA sequence
agtcatctccaaagaccctg

SEQ ID NO: 35921 - DNA, 20 bp, Artificial
  CRISPR gRNA sequence
caaagaccctgcctccaaac

SEQ ID NO: 35922 - DNA, 20 bp, Artificial
  CRISPR gRNA sequence
cctccaaacgctctgagatt

SEQ ID NO: 35923 - DNA, 20 bp, Artificial
  CRISPR gRNA sequence
caaacgctctgagattgttg

SEQ ID NO: 35924 - DNA, 20 bp, Artificial
  CRISPR gRNA sequence
tgagattgttggagaccagg

SEQ ID NO: 35925 - DNA, 20 bp, Artificial
  CRISPR gRNA sequence
agattgttggagaccaggtc

SEQ ID NO: 35926 - DNA, 20 bp, Artificial
  CRISPR gRNA sequence
ttggagaccaggtcatcccc

SEQ ID NO: 35927 - DNA, 20 bp, Artificial
  CRISPR gRNA sequence
gagaccaggtcatcccctaa

SEQ ID NO: 35928 - DNA, 20 bp, Artificial
  CRISPR gRNA sequence
agggagccgggggtttgcaa

SEQ ID NO: 35929 - DNA, 20 bp, Artificial
  CRISPR gRNA sequence
gcaaggtgatcatttgttgg

SEQ ID NO: 35930 - DNA, 20 bp, Artificial
  CRISPR gRNA sequence
caaggtgatcatttgttgga

SEQ ID NO: 35931 - DNA, 20 bp, Artificial
  CRISPR gRNA sequence
gttggagtcaagttcctttg

SEQ ID NO: 35932 - DNA, 20 bp, Artificial
  CRISPR gRNA sequence
ttggagtcaagttcctttgg

SEQ ID NO: 35933 - DNA, 20 bp, Artificial
  CRISPR gRNA sequence
gagtcaagttcctttggctc

SEQ ID NO: 35934 - DNA, 20 bp, Artificial
  CRISPR gRNA sequence
ctttggctcctctttctcca

SEQ ID NO: 35935 - DNA, 20 bp, Artificial
  CRISPR gRNA sequence
tggctcctctttctccaaga

SEQ ID NO: 35936 - DNA, 20 bp, Artificial
  CRISPR gRNA sequence
ggctcctctttctccaagag

SEQ ID NO: 35937 - DNA, 20 bp, Artificial
  CRISPR gRNA sequence
gctcctctttctccaagagg

SEQ ID NO: 35938 - DNA, 20 bp, Artificial
  CRISPR gRNA sequence
ctctttctccaagaggaaga

SEQ ID NO: 35939 - DNA, 20 bp, Artificial
  CRISPR gRNA sequence
tttctccaagaggaagaagt

SEQ ID NO: 35940 - DNA, 20 bp, Artificial
  CRISPR gRNA sequence
tctccaagaggaagaagtac

SEQ ID NO: 35941 - DNA, 20 bp, Artificial
  CRISPR gRNA sequence
ctccaagaggaagaagtacc

SEQ ID NO: 35942 - DNA, 20 bp, Artificial
  CRISPR gRNA sequence
tccaagaggaagaagtacct

SEQ ID NO: 35943 - DNA, 20 bp, Artificial
  CRISPR gRNA sequence
caagaggaagaagtacctgt

SEQ ID NO: 35944 - DNA, 20 bp, Artificial
  CRISPR gRNA sequence
tttccttaatctcactccgg

SEQ ID NO: 35945 - DNA, 20 bp, Artificial
  CRISPR gRNA sequence
ccttaatctcactccggaga

SEQ ID NO: 35946 - DNA, 20 bp, Artificial
  CRISPR gRNA sequence
cttaatctcactccggagaa

SEQ ID NO: 35947 - DNA, 20 bp, Artificial
  CRISPR gRNA sequence
aatctcactccggagaagta

SEQ ID NO: 35948 - DNA, 20 bp, Artificial
  CRISPR gRNA sequence
atctcactccggagaagtat

SEQ ID NO: 35949 - DNA, 20 bp, Artificial
  CRISPR gRNA sequence
actccggagaagtatttatt

SEQ ID NO: 35950 - DNA, 20 bp, Artificial
  CRISPR gRNA sequence
cggagaagtatttatttatt

SEQ ID NO: 35951 - DNA, 20 bp, Artificial
  CRISPR gRNA sequence
atttattttttctctggagt

SEQ ID NO: 35952 - DNA, 20 bp, Artificial
  CRISPR gRNA sequence
tttattttttctctggagtg

SEQ ID NO: 35953 - DNA, 20 bp, Artificial
  CRISPR gRNA sequence
attttttctctggagtgggg

SEQ ID NO: 35954 - DNA, 20 bp, Artificial
  CRISPR gRNA sequence
ttttttctctggagtgggga

SEQ ID NO: 35955 - DNA, 20 bp, Artificial
  CRISPR gRNA sequence
tttctctggagtggggagca

SEQ ID NO: 35956 - DNA, 20 bp, Artificial
  CRISPR gRNA sequence
ttctctggagtggggagcag

SEQ ID NO: 35957 - DNA, 20 bp, Artificial
  CRISPR gRNA sequence
tctctggagtggggagcaga

SEQ ID NO: 35958 - DNA, 20 bp, Artificial
  CRISPR gRNA sequence
ctctggagtggggagcagaa

SEQ ID NO: 35959 - DNA, 20 bp, Artificial
  CRISPR gRNA sequence
tctggagtggggagcagaaa

SEQ ID NO: 35960 - DNA, 20 bp, Artificial
  CRISPR gRNA sequence
tggagtggggagcagaaacg

SEQ ID NO: 35961 - DNA, 20 bp, Artificial
  CRISPR gRNA sequence
gagtggggagcagaaacgga

SEQ ID NO: 35962 - DNA, 20 bp, Artificial
  CRISPR gRNA sequence
cctgccaaagttagacactc

SEQ ID NO: 35963 - DNA, 20 bp, Artificial
  CRISPR gRNA sequence
ctgccaaagttagacactcc

SEQ ID NO: 35964 - DNA, 20 bp, Artificial
  CRISPR gRNA sequence
ccaaagttagacactccagg

SEQ ID NO: 35965 - DNA, 20 bp, Artificial
  CRISPR gRNA sequence
gacactccaggctgcggctg

SEQ ID NO: 35966 - DNA, 20 bp, Artificial
  CRISPR gRNA sequence
caggctgcggctggggaggg

SEQ ID NO: 35967 - DNA, 20 bp, Artificial
  CRISPR gRNA sequence
cggctggggagggagccatg

SEQ ID NO: 35968 - DNA, 20 bp, Artificial
  CRISPR gRNA sequence
gggagggagccatgccttga

SEQ ID NO: 35969 - DNA, 20 bp, Artificial
  CRISPR gRNA sequence
gaacttctaggcttttgcca

SEQ ID NO: 35970 - DNA, 20 bp, Artificial
  CRISPR gRNA sequence
aacttctaggcttttgccac

SEQ ID NO: 35971 - DNA, 20 bp, Artificial
  CRISPR gRNA sequence
ctaggcttttgccacctctc

SEQ ID NO: 35972 - DNA, 20 bp, Artificial
  CRISPR gRNA sequence
taggcttttgccacctctcc

SEQ ID NO: 35973 - DNA, 20 bp, Artificial
  CRISPR gRNA sequence
ggcttttgccacctctcctg

SEQ ID NO: 35974 - DNA, 20 bp, Artificial
  CRISPR gRNA sequence
ttgccacctctcctgtgcca

SEQ ID NO: 35975 - DNA, 20 bp, Artificial
  CRISPR gRNA sequence
tgccacctctcctgtgccac

SEQ ID NO: 35976 - DNA, 20 bp, Artificial
  CRISPR gRNA sequence
gccacctctcctgtgccacc

SEQ ID NO: 35977 - DNA, 20 bp, Artificial
  CRISPR gRNA sequence
ccacctctcctgtgccacct

SEQ ID NO: 35978 - DNA, 20 bp, Artificial
  CRISPR gRNA sequence
tcctgtgccacctagggtgg

SEQ ID NO: 35979 - DNA, 20 bp, Artificial
  CRISPR gRNA sequence
ctgtgccacctagggtggag

SEQ ID NO: 35980 - DNA, 20 bp, Artificial
  CRISPR gRNA sequence
tgccacctagggtggagagg

SEQ ID NO: 35981 - DNA, 20 bp, Artificial
  CRISPR gRNA sequence
gggtggagaggggctgtggg

SEQ ID NO: 35982 - DNA, 20 bp, Artificial
  CRISPR gRNA sequence
tgggactcaggaggaccgcg

SEQ ID NO: 35983 - DNA, 20 bp, Artificial
  CRISPR gRNA sequence
aggaggaccgcggcttttaa

SEQ ID NO: 35984 - DNA, 20 bp, Artificial
  CRISPR gRNA sequence
ttaagagttccagactaagc

SEQ ID NO: 35985 - DNA, 20 bp, Artificial
  CRISPR gRNA sequence
taagagttccagactaagct

SEQ ID NO: 35986 - DNA, 20 bp, Artificial
  CRISPR gRNA sequence
aagagttccagactaagcta

SEQ ID NO: 35987 - DNA, 20 bp, Artificial
  CRISPR gRNA sequence
agagttccagactaagctaa

SEQ ID NO: 35988 - DNA, 20 bp, Artificial
  CRISPR gRNA sequence
cagactaagctaagcatggt

SEQ ID NO: 35989 - DNA, 20 bp, Artificial
  CRISPR gRNA sequence
agctaagcatggtggctccg

SEQ ID NO: 35990 - DNA, 20 bp, Artificial
  CRISPR gRNA sequence
agcatggtggctccgattcc

SEQ ID NO: 35991 - DNA, 20 bp, Artificial
  CRISPR gRNA sequence
cgattccggctttcctggac

SEQ ID NO: 35992 - DNA, 20 bp, Artificial
  CRISPR gRNA sequence
cggctttcctggaccccagg

SEQ ID NO: 35993 - DNA, 20 bp, Artificial
  CRISPR gRNA sequence
tcctggaccccagggagatc

SEQ ID NO: 35994 - DNA, 20 bp, Artificial
  CRISPR gRNA sequence
cctggaccccagggagatcc

SEQ ID NO: 35995 - DNA, 20 bp, Artificial
  CRISPR gRNA sequence
ctggaccccagggagatcca

SEQ ID NO: 35996 - DNA, 20 bp, Artificial
  CRISPR gRNA sequence
gaccccagggagatccaatc

SEQ ID NO: 35997 - DNA, 20 bp, Artificial
  CRISPR gRNA sequence
ccactcccaccccggcattc

SEQ ID NO: 35998 - DNA, 20 bp, Artificial
  CRISPR gRNA sequence
ccaccccggcattcgcacgc

SEQ ID NO: 35999 - DNA, 20 bp, Artificial
  CRISPR gRNA sequence
gcacgctggctttccggggc

SEQ ID NO: 36000 - DNA, 20 bp, Artificial
  CRISPR gRNA sequence
gctttccggggcgctttagc

SEQ ID NO: 36001 - DNA, 20 bp, Artificial
  CRISPR gRNA sequence
tccggggcgctttagcctct

SEQ ID NO: 36002 - DNA, 20 bp, Artificial
  CRISPR gRNA sequence
ccggggcgctttagcctctc

SEQ ID NO: 36003 - DNA, 20 bp, Artificial
  CRISPR gRNA sequence
cggggcgctttagcctctct

SEQ ID NO: 36004 - DNA, 20 bp, Artificial
  CRISPR gRNA sequence
tagcctctctccttagaggg

SEQ ID NO: 36005 - DNA, 20 bp, Artificial
  CRISPR gRNA sequence
agcctctctccttagagggt

SEQ ID NO: 36006 - DNA, 20 bp, Artificial
  CRISPR gRNA sequence
gcctctctccttagagggtg

SEQ ID NO: 36007 - DNA, 20 bp, Artificial
  CRISPR gRNA sequence
tctccttagagggtgtgact

SEQ ID NO: 36008 - DNA, 20 bp, Artificial
  CRISPR gRNA sequence
tccttagagggtgtgactca

SEQ ID NO: 36009 - DNA, 20 bp, Artificial
  CRISPR gRNA sequence
cttagagggtgtgactcagg

SEQ ID NO: 36010 - DNA, 20 bp, Artificial
  CRISPR gRNA sequence
agagggtgtgactcagggcc

SEQ ID NO: 36011 - DNA, 20 bp, Artificial
  CRISPR gRNA sequence
gagggtgtgactcagggccc

SEQ ID NO: 36012 - DNA, 20 bp, Artificial
  CRISPR gRNA sequence
agggccccaaagcgaggtag

SEQ ID NO: 36013 - DNA, 20 bp, Artificial
  CRISPR gRNA sequence
agtccggggggatccctccc

SEQ ID NO: 36014 - DNA, 20 bp, Artificial
  CRISPR gRNA sequence
ccccacccctcccaacaaca

SEQ ID NO: 36015 - DNA, 20 bp, Artificial
  CRISPR gRNA sequence
ccaacaacacacaccttcgc

SEQ ID NO: 36016 - DNA, 20 bp, Artificial
  CRISPR gRNA sequence
cgccaagatgttcaacgaga

SEQ ID NO: 36017 - DNA, 20 bp, Artificial
  CRISPR gRNA sequence
gccaagatgttcaacgagag

SEQ ID NO: 36018 - DNA, 20 bp, Artificial
  CRISPR gRNA sequence
aacgagagttgaggacttat

SEQ ID NO: 36019 - DNA, 20 bp, Artificial
  CRISPR gRNA sequence
aggacttatcccatcctctg

SEQ ID NO: 36020 - DNA, 20 bp, Artificial
  CRISPR gRNA sequence
atcccatcctctggttaaag

SEQ ID NO: 36021 - DNA, 20 bp, Artificial
  CRISPR gRNA sequence
tcccatcctctggttaaagg

SEQ ID NO: 36022 - DNA, 20 bp, Artificial
  CRISPR gRNA sequence
tggttaaaggtttggctccc

SEQ ID NO: 36023 - DNA, 20 bp, Artificial
  CRISPR gRNA sequence
gttaaaggtttggctcccta

SEQ ID NO: 36024 - DNA, 20 bp, Artificial
  CRISPR gRNA sequence
aaggtttggctccctactgc

SEQ ID NO: 36025 - DNA, 20 bp, Artificial
  CRISPR gRNA sequence
ggctccctactgcctccctg

SEQ ID NO: 36026 - DNA, 20 bp, Artificial
  CRISPR gRNA sequence
gctccctactgcctccctga

SEQ ID NO: 36027 - DNA, 20 bp, Artificial
  CRISPR gRNA sequence
cctactgcctccctgagcag

SEQ ID NO: 36028 - DNA, 20 bp, Artificial
  CRISPR gRNA sequence
ctgcctccctgagcagggcc

SEQ ID NO: 36029 - DNA, 20 bp, Artificial
  CRISPR gRNA sequence
cctccctgagcagggccccc

SEQ ID NO: 36030 - DNA, 20 bp, Artificial
  CRISPR gRNA sequence
cctgagcagggccccccgcc

SEQ ID NO: 36031 - DNA, 20 bp, Artificial
  CRISPR gRNA sequence
agcagggccccccgcctgga

SEQ ID NO: 36032 - DNA, 20 bp, Artificial
  CRISPR gRNA sequence
gagagcccaatacccaagat

SEQ ID NO: 36033 - DNA, 20 bp, Artificial
  CRISPR gRNA sequence
cagagttagagatggaatat

SEQ ID NO: 36034 - DNA, 20 bp, Artificial
  CRISPR gRNA sequence
gagatggaatatgacccaac

SEQ ID NO: 36035 - DNA, 20 bp, Artificial
  CRISPR gRNA sequence
agggaacggcggccctggtc

SEQ ID NO: 36036 - DNA, 20 bp, Artificial
  CRISPR gRNA sequence
gtccaaagtctggcgtacaa

SEQ ID NO: 36037 - DNA, 20 bp, Artificial
  CRISPR gRNA sequence
gcgtacaagaagggcgcgca

SEQ ID NO: 36038 - DNA, 20 bp, Artificial
  CRISPR gRNA sequence
tgcaggatcccgggcgcgcg

SEQ ID NO: 36039 - DNA, 20 bp, Artificial
  CRISPR gRNA sequence
caggatcccgggcgcgcgga

SEQ ID NO: 36040 - DNA, 20 bp, Artificial
  CRISPR gRNA sequence
ctccgcgctcccagtctgcg

SEQ ID NO: 36041 - DNA, 20 bp, Artificial
  CRISPR gRNA sequence
cgcgctcccagtctgcgctc

SEQ ID NO: 36042 - DNA, 20 bp, Artificial
  CRISPR gRNA sequence
ccagtctgcgctccggcttc

SEQ ID NO: 36043 - DNA, 20 bp, Artificial
  CRISPR gRNA sequence
cgctccggcttctctgcaga

SEQ ID NO: 36044 - DNA, 20 bp, Artificial
  CRISPR gRNA sequence
cggcttctctgcagaagctg

SEQ ID NO: 36045 - DNA, 20 bp, Artificial
  CRISPR gRNA sequence
ctctgcagaagctgccgcca

SEQ ID NO: 36046 - DNA, 20 bp, Artificial
  CRISPR gRNA sequence
tctgcagaagctgccgccag

SEQ ID NO: 36047 - DNA, 20 bp, Artificial
  CRISPR gRNA sequence
tgcagaagctgccgccaggc

SEQ ID NO: 36048 - DNA, 20 bp, Artificial
  CRISPR gRNA sequence
cagaagctgccgccaggctt

SEQ ID NO: 36049 - DNA, 20 bp, Artificial
  CRISPR gRNA sequence
ccgccaggctttcctgccac

SEQ ID NO: 36050 - DNA, 20 bp, Artificial
  CRISPR gRNA sequence
tcctgccacccgcccacggc

SEQ ID NO: 36051 - DNA, 20 bp, Artificial
  CRISPR gRNA sequence
cctgccacccgcccacggcc

SEQ ID NO: 36052 - DNA, 20 bp, Artificial
  CRISPR gRNA sequence
ctgccacccgcccacggccc

SEQ ID NO: 36053 - DNA, 20 bp, Artificial
  CRISPR gRNA sequence
ccacccgcccacggccccgg

SEQ ID NO: 36054 - DNA, 20 bp, Artificial
  CRISPR gRNA sequence
tgggcacagcaagccaagct

SEQ ID NO: 36055 - DNA, 20 bp, Artificial
  CRISPR gRNA sequence
ggcacagcaagccaagctcc

SEQ ID NO: 36056 - DNA, 20 bp, Artificial
  CRISPR gRNA sequence
cgggttcccggctcctggtt

SEQ ID NO: 36057 - DNA, 20 bp, Artificial
  CRISPR gRNA sequence
ccggctcctggttcccgcgc

SEQ ID NO: 36058 - DNA, 20 bp, Artificial
  CRISPR gRNA sequence
ctggttcccgcgcagagtcg

SEQ ID NO: 36059 - DNA, 20 bp, Artificial
  CRISPR gRNA sequence
gttcccgcgcagagtcgttg

SEQ ID NO: 36060 - DNA, 20 bp, Artificial
  CRISPR gRNA sequence
ccgcgcagagtcgttgcggg

SEQ ID NO: 36061 - DNA, 20 bp, Artificial
  CRISPR gRNA sequence
cggggatgctggaaacgagg

SEQ ID NO: 36062 - DNA, 20 bp, Artificial
  CRISPR gRNA sequence
gaaacgaggtgtttcccggc

SEQ ID NO: 36063 - DNA, 20 bp, Artificial
  CRISPR gRNA sequence
cccggccctacattttgcat

SEQ ID NO: 36064 - DNA, 20 bp, Artificial
  CRISPR gRNA sequence
ccggccctacattttgcata

SEQ ID NO: 36065 - DNA, 20 bp, Artificial
  CRISPR gRNA sequence
cattttgcatattccatccc

SEQ ID NO: 36066 - DNA, 20 bp, Artificial
  CRISPR gRNA sequence
tgcatattccatccccccat

SEQ ID NO: 36067 - DNA, 20 bp, Artificial
  CRISPR gRNA sequence
gcatattccatccccccatc

SEQ ID NO: 36068 - DNA, 20 bp, Artificial
  CRISPR gRNA sequence
catattccatccccccatcc

SEQ ID NO: 36069 - DNA, 20 bp, Artificial
  CRISPR gRNA sequence
catccccccatcctcccaga

SEQ ID NO: 36070 - DNA, 20 bp, Artificial
  CRISPR gRNA sequence
ccagacttgctgtgtgacct

SEQ ID NO: 36071 - DNA, 20 bp, Artificial
  CRISPR gRNA sequence
gctgtgtgaccttgagcaag

SEQ ID NO: 36072 - DNA, 20 bp, Artificial
  CRISPR gRNA sequence
ctgtgtgaccttgagcaagt

SEQ ID NO: 36073 - DNA, 20 bp, Artificial
  CRISPR gRNA sequence
tgtgaccttgagcaagtagc

SEQ ID NO: 36074 - DNA, 20 bp, Artificial
  CRISPR gRNA sequence
gagcaagtagctgacagtct

SEQ ID NO: 36075 - DNA, 20 bp, Artificial
  CRISPR gRNA sequence
agcaagtagctgacagtctc

SEQ ID NO: 36076 - DNA, 20 bp, Artificial
  CRISPR gRNA sequence
acagtctcggagcctcgatt

SEQ ID NO: 36077 - DNA, 20 bp, Artificial
  CRISPR gRNA sequence
ggagcctcgattctcagccc

SEQ ID NO: 36078 - DNA, 20 bp, Artificial
  CRISPR gRNA sequence
gattctcagcccgaccttag

SEQ ID NO: 36079 - DNA, 20 bp, Artificial
  CRISPR gRNA sequence
tcagcccgaccttaggggtt

SEQ ID NO: 36080 - DNA, 20 bp, Artificial
  CRISPR gRNA sequence
agcccgaccttaggggttac

SEQ ID NO: 36081 - DNA, 20 bp, Artificial
  CRISPR gRNA sequence
aggggttacagaggagactt

SEQ ID NO: 36082 - DNA, 20 bp, Artificial
  CRISPR gRNA sequence
ggggttacagaggagacttt

SEQ ID NO: 36083 - DNA, 20 bp, Artificial
  CRISPR gRNA sequence
cagaggagactttggtcacc

SEQ ID NO: 36084 - DNA, 20 bp, Artificial
  CRISPR gRNA sequence
tggtcacctaccgctgttcc

SEQ ID NO: 36085 - DNA, 20 bp, Artificial
  CRISPR gRNA sequence
ggtcacctaccgctgttccc

SEQ ID NO: 36086 - DNA, 20 bp, Artificial
  CRISPR gRNA sequence
gtcacctaccgctgttcccc

SEQ ID NO: 36087 - DNA, 20 bp, Artificial
  CRISPR gRNA sequence
ccgctgttccccgggctccc

SEQ ID NO: 36088 - DNA, 20 bp, Artificial
  CRISPR gRNA sequence
ttccccgggctcccgcgcgc

SEQ ID NO: 36089 - DNA, 20 bp, Artificial
  CRISPR gRNA sequence
cccgggctcccgcgcgcgct

SEQ ID NO: 36090 - DNA, 20 bp, Artificial
  CRISPR gRNA sequence
ccgcgcgcgctgctggtggc

SEQ ID NO: 36091 - DNA, 20 bp, Artificial
  CRISPR gRNA sequence
ctggtggcctctccctcccg

SEQ ID NO: 36092 - DNA, 20 bp, Artificial
  CRISPR gRNA sequence
gtggcctctccctcccgcca

SEQ ID NO: 36093 - DNA, 20 bp, Artificial
  CRISPR gRNA sequence
tccctcccgccagctctggg

SEQ ID NO: 36094 - DNA, 20 bp, Artificial
  CRISPR gRNA sequence
cctcccgccagctctggggc

SEQ ID NO: 36095 - DNA, 20 bp, Artificial
  CRISPR gRNA sequence
ccgccagctctggggccgcg

SEQ ID NO: 36096 - DNA, 20 bp, Artificial
  CRISPR gRNA sequence
tggggccgcggcaagtctgt

SEQ ID NO: 36097 - DNA, 20 bp, Artificial
  CRISPR gRNA sequence
gggccgcggcaagtctgtgg

SEQ ID NO: 36098 - DNA, 20 bp, Artificial
  CRISPR gRNA sequence
tggcagctcgtccgctggtc

SEQ ID NO: 36099 - DNA, 20 bp, Artificial
  CRISPR gRNA sequence
gtccgctggtcatcctacct

SEQ ID NO: 36100 - DNA, 20 bp, Artificial
  CRISPR gRNA sequence
gtcatcctacctccccgcct

SEQ ID NO: 36101 - DNA, 20 bp, Artificial
  CRISPR gRNA sequence
cctccccgcctccccgcagt

SEQ ID NO: 36102 - DNA, 20 bp, Artificial
  CRISPR gRNA sequence
cccgcctccccgcagttctt

SEQ ID NO: 36103 - DNA, 20 bp, Artificial
  CRISPR gRNA sequence
cccgcagttctttttccctt

SEQ ID NO: 36104 - DNA, 20 bp, Artificial
  CRISPR gRNA sequence
tttttccctttcactttctt

SEQ ID NO: 36105 - DNA, 20 bp, Artificial
  CRISPR gRNA sequence
tttccctttcactttctttc

SEQ ID NO: 36106 - DNA, 20 bp, Artificial
  CRISPR gRNA sequence
ttccctttcactttctttct

SEQ ID NO: 36107 - DNA, 20 bp, Artificial
  CRISPR gRNA sequence
tccctttcactttctttctg

SEQ ID NO: 36108 - DNA, 20 bp, Artificial
  CRISPR gRNA sequence
ccctttcactttctttctgc

SEQ ID NO: 36109 - DNA, 20 bp, Artificial
  CRISPR gRNA sequence
cctttcactttctttctgca

SEQ ID NO: 36110 - DNA, 20 bp, Artificial
  CRISPR gRNA sequence
tcactttctttctgcagcgc

SEQ ID NO: 36111 - DNA, 20 bp, Artificial
  CRISPR gRNA sequence
cactttctttctgcagcgct

SEQ ID NO: 36112 - DNA, 20 bp, Artificial
  CRISPR gRNA sequence
actttctttctgcagcgctg

SEQ ID NO: 36113 - DNA, 20 bp, Artificial
  CRISPR gRNA sequence
tctttctgcagcgctgagct

SEQ ID NO: 36114 - DNA, 20 bp, Artificial
  CRISPR gRNA sequence
ctttctgcagcgctgagctc

SEQ ID NO: 36115 - DNA, 20 bp, Artificial
  CRISPR gRNA sequence
tttctgcagcgctgagctcg

SEQ ID NO: 36116 - DNA, 20 bp, Artificial
  CRISPR gRNA sequence
tctgcagcgctgagctcggg

SEQ ID NO: 36117 - DNA, 20 bp, Artificial
  CRISPR gRNA sequence
ctgcagcgctgagctcgggc

SEQ ID NO: 36118 - DNA, 20 bp, Artificial
  CRISPR gRNA sequence
tgcagcgctgagctcgggcc

SEQ ID NO: 36119 - DNA, 20 bp, Artificial
  CRISPR gRNA sequence
cagcgctgagctcgggccag

SEQ ID NO: 36120 - DNA, 20 bp, Artificial
  CRISPR gRNA sequence
agctcgggccaggctgtgga

SEQ ID NO: 36121 - DNA, 20 bp, Artificial
  CRISPR gRNA sequence
gggccaggctgtggagcaac

SEQ ID NO: 36122 - DNA, 20 bp, Artificial
  CRISPR gRNA sequence
tggagcaaccaagcacctac

SEQ ID NO: 36123 - DNA, 20 bp, Artificial
  CRISPR gRNA sequence
ctgtggccaccacgtgcttt

SEQ ID NO: 36124 - DNA, 20 bp, Artificial
  CRISPR gRNA sequence
tggccaccacgtgctttatc

SEQ ID NO: 36125 - DNA, 20 bp, Artificial
  CRISPR gRNA sequence
tatcagaagtggcatcccaa

SEQ ID NO: 36126 - DNA, 20 bp, Artificial
  CRISPR gRNA sequence
atcagaagtggcatcccaac

SEQ ID NO: 36127 - DNA, 20 bp, Artificial
  CRISPR gRNA sequence
tcagaagtggcatcccaact

SEQ ID NO: 36128 - DNA, 20 bp, Artificial
  CRISPR gRNA sequence
cctggggcatccaagaggtc

SEQ ID NO: 36129 - DNA, 20 bp, Artificial
  CRISPR gRNA sequence
gggcatccaagaggtccctg

SEQ ID NO: 36130 - DNA, 20 bp, Artificial
  CRISPR gRNA sequence
cctccagtcggttcctcaca

SEQ ID NO: 36131 - DNA, 20 bp, Artificial
  CRISPR gRNA sequence
cagtcggttcctcacagtgg

SEQ ID NO: 36132 - DNA, 20 bp, Artificial
  CRISPR gRNA sequence
ctcacagtggccagccccac

SEQ ID NO: 36133 - DNA, 20 bp, Artificial
  CRISPR gRNA sequence
acagtggccagccccacttc

SEQ ID NO: 36134 - DNA, 20 bp, Artificial
  CRISPR gRNA sequence
cggggagagtcccaggcccc

SEQ ID NO: 36135 - DNA, 20 bp, Artificial
  CRISPR gRNA sequence
ggggagagtcccaggccccg

SEQ ID NO: 36136 - DNA, 20 bp, Artificial
  CRISPR gRNA sequence
gggagccacttgggcaagtg

SEQ ID NO: 36137 - DNA, 20 bp, Artificial
  CRISPR gRNA sequence
gggcaagtgatctgcaagtc

SEQ ID NO: 36138 - DNA, 20 bp, Artificial
  CRISPR gRNA sequence
ggcaagtgatctgcaagtcc

SEQ ID NO: 36139 - DNA, 20 bp, Artificial
  CRISPR gRNA sequence
caagtcctgagttgcaggga

SEQ ID NO: 36140 - DNA, 20 bp, Artificial
  CRISPR gRNA sequence
agttgcagggagcttgtccc

SEQ ID NO: 36141 - DNA, 20 bp, Artificial
  CRISPR gRNA sequence
cagggagcttgtccccaccc

SEQ ID NO: 36142 - DNA, 20 bp, Artificial
  CRISPR gRNA sequence
gtccccacccctgggtgggt

SEQ ID NO: 36143 - DNA, 20 bp, Artificial
  CRISPR gRNA sequence
tccccacccctgggtgggtc

SEQ ID NO: 36144 - DNA, 20 bp, Artificial
  CRISPR gRNA sequence
ggtgggtctctgtttctctc

SEQ ID NO: 36145 - DNA, 20 bp, Artificial
  CRISPR gRNA sequence
tgtttctctccaactcagtc

SEQ ID NO: 36146 - DNA, 20 bp, Artificial
  CRISPR gRNA sequence
tttctctccaactcagtcca

SEQ ID NO: 36147 - DNA, 20 bp, Artificial
  CRISPR gRNA sequence
ctctccaactcagtccaacc

SEQ ID NO: 36148 - DNA, 20 bp, Artificial
  CRISPR gRNA sequence
tctccaactcagtccaaccg

SEQ ID NO: 36149 - DNA, 20 bp, Artificial
  CRISPR gRNA sequence
tccaactcagtccaaccgtg

SEQ ID NO: 36150 - DNA, 20 bp, Artificial
  CRISPR gRNA sequence
caactcagtccaaccgtgaa

SEQ ID NO: 36151 - DNA, 20 bp, Artificial
  CRISPR gRNA sequence
agtccaaccgtgaaagtggc

SEQ ID NO: 36152 - DNA, 20 bp, Artificial
  CRISPR gRNA sequence
cgagggcacatggcccctga

SEQ ID NO: 36153 - DNA, 20 bp, Artificial
  CRISPR gRNA sequence
agatgagctaactgagctat

SEQ ID NO: 36154 - DNA, 20 bp, Artificial
  CRISPR gRNA sequence
actgagctattcactcctct

SEQ ID NO: 36155 - DNA, 20 bp, Artificial
  CRISPR gRNA sequence
agctattcactcctctgatg

SEQ ID NO: 36156 - DNA, 20 bp, Artificial
  CRISPR gRNA sequence
ttcactcctctgatgctggc

SEQ ID NO: 36157 - DNA, 20 bp, Artificial
  CRISPR gRNA sequence
actcctctgatgctggccct

SEQ ID NO: 36158 - DNA, 20 bp, Artificial
  CRISPR gRNA sequence
ctctgatgctggccctaggg

SEQ ID NO: 36159 - DNA, 20 bp, Artificial
  CRISPR gRNA sequence
tgatgctggccctagggagg

SEQ ID NO: 36160 - DNA, 20 bp, Artificial
  CRISPR gRNA sequence
atgctggccctagggaggaa

SEQ ID NO: 36161 - DNA, 20 bp, Artificial
  CRISPR gRNA sequence
gccctagggaggaagagaaa

SEQ ID NO: 36162 - DNA, 20 bp, Artificial
  CRISPR gRNA sequence
gggaggaagagaaaatccct

SEQ ID NO: 36163 - DNA, 20 bp, Artificial
  CRISPR gRNA sequence
aggtaccttccatggatgga

SEQ ID NO: 36164 - DNA, 20 bp, Artificial
  CRISPR gRNA sequence
ccatggatggaaaacctgtg

SEQ ID NO: 36165 - DNA, 20 bp, Artificial
  CRISPR gRNA sequence
catggatggaaaacctgtgt

SEQ ID NO: 36166 - DNA, 20 bp, Artificial
  CRISPR gRNA sequence
tgttaccatgaccacacccc

SEQ ID NO: 36167 - DNA, 20 bp, Artificial
  CRISPR gRNA sequence
ccatgaccacacccccagcc

SEQ ID NO: 36168 - DNA, 20 bp, Artificial
  CRISPR gRNA sequence
ccggtccttttcagaggtct

SEQ ID NO: 36169 - DNA, 20 bp, Artificial
  CRISPR gRNA sequence
ttcagaggtcttggattcct

SEQ ID NO: 36170 - DNA, 20 bp, Artificial
  CRISPR gRNA sequence
tcagaggtcttggattcctg

SEQ ID NO: 36171 - DNA, 20 bp, Artificial
  CRISPR gRNA sequence
cagaggtcttggattcctgc

SEQ ID NO: 36172 - DNA, 20 bp, Artificial
  CRISPR gRNA sequence
agaggtcttggattcctgct

SEQ ID NO: 36173 - DNA, 20 bp, Artificial
  CRISPR gRNA sequence
ggattcctgctgggtcctcc

SEQ ID NO: 36174 - DNA, 20 bp, Artificial
  CRISPR gRNA sequence
gattcctgctgggtcctcca

SEQ ID NO: 36175 - DNA, 20 bp, Artificial
  CRISPR gRNA sequence
ctgctgggtcctccaaggca

SEQ ID NO: 36176 - DNA, 20 bp, Artificial
  CRISPR gRNA sequence
ctgggtcctccaaggcatga

SEQ ID NO: 36177 - DNA, 20 bp, Artificial
  CRISPR gRNA sequence
ggtcctccaaggcatgagac

SEQ ID NO: 36178 - DNA, 20 bp, Artificial
  CRISPR gRNA sequence
caaggcatgagactttgagg

SEQ ID NO: 36179 - DNA, 20 bp, Artificial
  CRISPR gRNA sequence
tgaggtggtcactttccctt

SEQ ID NO: 36180 - DNA, 20 bp, Artificial
  CRISPR gRNA sequence
gaggtggtcactttcccttt

SEQ ID NO: 36181 - DNA, 20 bp, Artificial
  CRISPR gRNA sequence
aggtggtcactttccctttt

SEQ ID NO: 36182 - DNA, 20 bp, Artificial
  CRISPR gRNA sequence
tcccttttcaggcctgaatt

SEQ ID NO: 36183 - DNA, 20 bp, Artificial
  CRISPR gRNA sequence
cccttttcaggcctgaattt

SEQ ID NO: 36184 - DNA, 20 bp, Artificial
  CRISPR gRNA sequence
ccttttcaggcctgaatttc

SEQ ID NO: 36185 - DNA, 20 bp, Artificial
  CRISPR gRNA sequence
ttcaggcctgaatttcctca

SEQ ID NO: 36186 - DNA, 20 bp, Artificial
  CRISPR gRNA sequence
tcaggcctgaatttcctcat

SEQ ID NO: 36187 - DNA, 20 bp, Artificial
  CRISPR gRNA sequence
caggcctgaatttcctcatc

SEQ ID NO: 36188 - DNA, 20 bp, Artificial
  CRISPR gRNA sequence
aggcctgaatttcctcatct

SEQ ID NO: 36189 - DNA, 20 bp, Artificial
  CRISPR gRNA sequence
aatttcctcatctggaattg

SEQ ID NO: 36190 - DNA, 20 bp, Artificial
  CRISPR gRNA sequence
cctcatctggaattgaggga

SEQ ID NO: 36191 - DNA, 20 bp, Artificial
  CRISPR gRNA sequence
ctcatctggaattgagggag

SEQ ID NO: 36192 - DNA, 20 bp, Artificial
  CRISPR gRNA sequence
atctggaattgagggagggg

SEQ ID NO: 36193 - DNA, 20 bp, Artificial
  CRISPR gRNA sequence
gaattgagggagggggcaag

SEQ ID NO: 36194 - DNA, 20 bp, Artificial
  CRISPR gRNA sequence
agggagggggcaaggttacc

SEQ ID NO: 36195 - DNA, 20 bp, Artificial
  CRISPR gRNA sequence
cctctgacttctccccctcc

SEQ ID NO: 36196 - DNA, 20 bp, Artificial
  CRISPR gRNA sequence
tgacttctccccctccaaca

SEQ ID NO: 36197 - DNA, 20 bp, Artificial
  CRISPR gRNA sequence
acttctccccctccaacact

SEQ ID NO: 36198 - DNA, 20 bp, Artificial
  CRISPR gRNA sequence
ctccccctccaacactttcc

SEQ ID NO: 36199 - DNA, 20 bp, Artificial
  CRISPR gRNA sequence
tccccctccaacactttccc

SEQ ID NO: 36200 - DNA, 20 bp, Artificial
  CRISPR gRNA sequence
cccctccaacactttcccgt

SEQ ID NO: 36201 - DNA, 20 bp, Artificial
  CRISPR gRNA sequence
caacactttcccgtagcaac

SEQ ID NO: 36202 - DNA, 20 bp, Artificial
  CRISPR gRNA sequence
tcccgtagcaacttaaggct

SEQ ID NO: 36203 - DNA, 20 bp, Artificial
  CRISPR gRNA sequence
cccgtagcaacttaaggctg

SEQ ID NO: 36204 - DNA, 20 bp, Artificial
  CRISPR gRNA sequence
ccgtagcaacttaaggctgc

SEQ ID NO: 36205 - DNA, 20 bp, Artificial
  CRISPR gRNA sequence
aaggctgcacccaaccacac

SEQ ID NO: 36206 - DNA, 20 bp, Artificial
  CRISPR gRNA sequence
aggctgcacccaaccacacc

SEQ ID NO: 36207 - DNA, 20 bp, Artificial
  CRISPR gRNA sequence
cacccaaccacaccggcaga

SEQ ID NO: 36208 - DNA, 20 bp, Artificial
  CRISPR gRNA sequence
tcatcagtctctgggttcaa

SEQ ID NO: 36209 - DNA, 20 bp, Artificial
  CRISPR gRNA sequence
tgggttcaaagcaaaccata

SEQ ID NO: 36210 - DNA, 20 bp, Artificial
  CRISPR gRNA sequence
ggttcaaagcaaaccataca

SEQ ID NO: 36211 - DNA, 20 bp, Artificial
  CRISPR gRNA sequence
aaagcaaaccatacatttca

SEQ ID NO: 36212 - DNA, 20 bp, Artificial
  CRISPR gRNA sequence
caggggagtctgagaaaagg

SEQ ID NO: 36213 - DNA, 20 bp, Artificial
  CRISPR gRNA sequence
aggggagtctgagaaaaggg

SEQ ID NO: 36214 - DNA, 20 bp, Artificial
  CRISPR gRNA sequence
agaaaagggataccacccct

SEQ ID NO: 36215 - DNA, 20 bp, Artificial
  CRISPR gRNA sequence
taaccatccaacaacagcaa

SEQ ID NO: 36216 - DNA, 20 bp, Artificial
  CRISPR gRNA sequence
aaccatccaacaacagcaat

SEQ ID NO: 36217 - DNA, 20 bp, Artificial
  CRISPR gRNA sequence
accatccaacaacagcaatg

SEQ ID NO: 36218 - DNA, 20 bp, Artificial
  CRISPR gRNA sequence
agctcctatgagctcaattc

SEQ ID NO: 36219 - DNA, 20 bp, Artificial
  CRISPR gRNA sequence
ctatgagctcaattccagtt

SEQ ID NO: 36220 - DNA, 20 bp, Artificial
  CRISPR gRNA sequence
tgagctcaattccagttcct

SEQ ID NO: 36221 - DNA, 20 bp, Artificial
  CRISPR gRNA sequence
aattccagttcctataaaat

SEQ ID NO: 36222 - DNA, 20 bp, Artificial
  CRISPR gRNA sequence
cagttcctataaaatattgg

SEQ ID NO: 36223 - DNA, 20 bp, Artificial
  CRISPR gRNA sequence
ctataaaatattggacactg

SEQ ID NO: 36224 - DNA, 20 bp, Artificial
  CRISPR gRNA sequence
taaaatattggacactgtgc

SEQ ID NO: 36225 - DNA, 20 bp, Artificial
  CRISPR gRNA sequence
gacactgtgctaggtccctc

SEQ ID NO: 36226 - DNA, 20 bp, Artificial
  CRISPR gRNA sequence
tgctaggtccctcatcatta

SEQ ID NO: 36227 - DNA, 20 bp, Artificial
  CRISPR gRNA sequence
ggtccctcatcattaccctt

SEQ ID NO: 36228 - DNA, 20 bp, Artificial
  CRISPR gRNA sequence
atcattaccctttcatacag

SEQ ID NO: 36229 - DNA, 20 bp, Artificial
  CRISPR gRNA sequence
ccctttcatacaggctttcc

SEQ ID NO: 36230 - DNA, 20 bp, Artificial
  CRISPR gRNA sequence
tcatacaggctttcccacag

SEQ ID NO: 36231 - DNA, 20 bp, Artificial
  CRISPR gRNA sequence
catacaggctttcccacagg

SEQ ID NO: 36232 - DNA, 20 bp, Artificial
  CRISPR gRNA sequence
atacaggctttcccacaggt

SEQ ID NO: 36233 - DNA, 20 bp, Artificial
  CRISPR gRNA sequence
tcccacaggtccattgtaca

SEQ ID NO: 36234 - DNA, 20 bp, Artificial
  CRISPR gRNA sequence
cccacaggtccattgtacac

SEQ ID NO: 36235 - DNA, 20 bp, Artificial
  CRISPR gRNA sequence
ccacaggtccattgtacact

SEQ ID NO: 36236 - DNA, 20 bp, Artificial
  CRISPR gRNA sequence
tacactccaggaaaattgac

SEQ ID NO: 36237 - DNA, 20 bp, Artificial
  CRISPR gRNA sequence
caggaaaattgactcgagaa

SEQ ID NO: 36238 - DNA, 20 bp, Artificial
  CRISPR gRNA sequence
actcgagaatgtaaacgact

SEQ ID NO: 36239 - DNA, 20 bp, Artificial
  CRISPR gRNA sequence
gagaatgtaaacgacttctt

SEQ ID NO: 36240 - DNA, 20 bp, Artificial
  CRISPR gRNA sequence
cttcaggggcacacccttcc

SEQ ID NO: 36241 - DNA, 20 bp, Artificial
  CRISPR gRNA sequence
ttcaggggcacacccttccc

SEQ ID NO: 36242 - DNA, 20 bp, Artificial
  CRISPR gRNA sequence
caggggcacacccttcccag

SEQ ID NO: 36243 - DNA, 20 bp, Artificial
  CRISPR gRNA sequence
aggggcacacccttcccagc

SEQ ID NO: 36244 - DNA, 20 bp, Artificial
  CRISPR gRNA sequence
cccagccaacggtgtagctg

SEQ ID NO: 36245 - DNA, 20 bp, Artificial
  CRISPR gRNA sequence
ccagccaacggtgtagctgc

SEQ ID NO: 36246 - DNA, 20 bp, Artificial
  CRISPR gRNA sequence
ccatgctgccttcagagccg

SEQ ID NO: 36247 - DNA, 20 bp, Artificial
  CRISPR gRNA sequence
ccttcagagccggtgccagg

SEQ ID NO: 36248 - DNA, 20 bp, Artificial
  CRISPR gRNA sequence
cagagccggtgccaggtgtc

SEQ ID NO: 36249 - DNA, 20 bp, Artificial
  CRISPR gRNA sequence
agagccggtgccaggtgtct

SEQ ID NO: 36250 - DNA, 20 bp, Artificial
  CRISPR gRNA sequence
cactgtgctcttcccaccat

SEQ ID NO: 36251 - DNA, 20 bp, Artificial
  CRISPR gRNA sequence
tgctcttcccaccatctgtt

SEQ ID NO: 36252 - DNA, 20 bp, Artificial
  CRISPR gRNA sequence
ttcccaccatctgttccccc

SEQ ID NO: 36253 - DNA, 20 bp, Artificial
  CRISPR gRNA sequence
cccaccatctgttcccccgt

SEQ ID NO: 36254 - DNA, 20 bp, Artificial
  CRISPR gRNA sequence
ccaccatctgttcccccgtc

SEQ ID NO: 36255 - DNA, 20 bp, Artificial
  CRISPR gRNA sequence
ttcccccgtcccctgaccct

SEQ ID NO: 36256 - DNA, 20 bp, Artificial
  CRISPR gRNA sequence
ccccgtcccctgaccctttt

SEQ ID NO: 36257 - DNA, 20 bp, Artificial
  CRISPR gRNA sequence
accctttttaaacaacacca

SEQ ID NO: 36258 - DNA, 20 bp, Artificial
  CRISPR gRNA sequence
tttaaacaacaccattagga

SEQ ID NO: 36259 - DNA, 20 bp, Artificial
  CRISPR gRNA sequence
ttaaacaacaccattaggaa

SEQ ID NO: 36260 - DNA, 20 bp, Artificial
  CRISPR gRNA sequence
taaacaacaccattaggaaa

SEQ ID NO: 36261 - DNA, 20 bp, Artificial
  CRISPR gRNA sequence
aaacaacaccattaggaaac

SEQ ID NO: 36262 - DNA, 20 bp, Artificial
  CRISPR gRNA sequence
aacaacaccattaggaaact

SEQ ID NO: 36263 - DNA, 20 bp, Artificial
  CRISPR gRNA sequence
ggaaactggggggagggcag

SEQ ID NO: 36264 - DNA, 20 bp, Artificial
  CRISPR gRNA sequence
gggggagggcagcatccgcc

SEQ ID NO: 36265 - DNA, 20 bp, Artificial
  CRISPR gRNA sequence
tccccagctgctgagggctc

SEQ ID NO: 36266 - DNA, 20 bp, Artificial
  CRISPR gRNA sequence
cccagctgctgagggctcaa

SEQ ID NO: 36267 - DNA, 20 bp, Artificial
  CRISPR gRNA sequence
ctgagggctcaacagctaca

SEQ ID NO: 36268 - DNA, 20 bp, Artificial
  CRISPR gRNA sequence
agggctcaacagctacacct

SEQ ID NO: 36269 - DNA, 20 bp, Artificial
  CRISPR gRNA sequence
aacagctacacctcaaggct

SEQ ID NO: 36270 - DNA, 20 bp, Artificial
  CRISPR gRNA sequence
cacctcaaggctgactccaa

SEQ ID NO: 36271 - DNA, 20 bp, Artificial
  CRISPR gRNA sequence
aaggctgactccaattttgg

SEQ ID NO: 36272 - DNA, 20 bp, Artificial
  CRISPR gRNA sequence
actccaattttggtttccct

SEQ ID NO: 36273 - DNA, 20 bp, Artificial
  CRISPR gRNA sequence
caattttggtttccctgctt

SEQ ID NO: 36274 - DNA, 20 bp, Artificial
  CRISPR gRNA sequence
tggtttccctgcttctctgg

SEQ ID NO: 36275 - DNA, 20 bp, Artificial
  CRISPR gRNA sequence
ggtttccctgcttctctggg

SEQ ID NO: 36276 - DNA, 20 bp, Artificial
  CRISPR gRNA sequence
gtttccctgcttctctgggt

SEQ ID NO: 36277 - DNA, 20 bp, Artificial
  CRISPR gRNA sequence
ccctgcttctctgggtatgg

SEQ ID NO: 36278 - DNA, 20 bp, Artificial
  CRISPR gRNA sequence
cctgcttctctgggtatgga

SEQ ID NO: 36279 - DNA, 20 bp, Artificial
  CRISPR gRNA sequence
cttctctgggtatggagtgg

SEQ ID NO: 36280 - DNA, 20 bp, Artificial
  CRISPR gRNA sequence
ctctgggtatggagtggagt

SEQ ID NO: 36281 - DNA, 20 bp, Artificial
  CRISPR gRNA sequence
tctgggtatggagtggagtc

SEQ ID NO: 36282 - DNA, 20 bp, Artificial
  CRISPR gRNA sequence
tgggtatggagtggagtctg

SEQ ID NO: 36283 - DNA, 20 bp, Artificial
  CRISPR gRNA sequence
ggtatggagtggagtctggc

SEQ ID NO: 36284 - DNA, 20 bp, Artificial
  CRISPR gRNA sequence
gcagaggtcccgtcctgcag

SEQ ID NO: 36285 - DNA, 20 bp, Artificial
  CRISPR gRNA sequence
cagaggcacccctcagtatt

SEQ ID NO: 36286 - DNA, 20 bp, Artificial
  CRISPR gRNA sequence
agtatttacccaaagggagg

SEQ ID NO: 36287 - DNA, 20 bp, Artificial
  CRISPR gRNA sequence
acccaaagggaggcgagaag

SEQ ID NO: 36288 - DNA, 20 bp, Artificial
  CRISPR gRNA sequence
cccaaagggaggcgagaaga

SEQ ID NO: 36289 - DNA, 20 bp, Artificial
  CRISPR gRNA sequence
gctgtgggccgagccaggcc

SEQ ID NO: 36290 - DNA, 20 bp, Artificial
  CRISPR gRNA sequence
ctgtgggccgagccaggcca

SEQ ID NO: 36291 - DNA, 20 bp, Artificial
  CRISPR gRNA sequence
tgggccgagccaggccagca

SEQ ID NO: 36292 - DNA, 20 bp, Artificial
  CRISPR gRNA sequence
agagttagtgacacactgcc

SEQ ID NO: 36293 - DNA, 20 bp, Artificial
  CRISPR gRNA sequence
gtgacacactgcccgaaagt

SEQ ID NO: 36294 - DNA, 20 bp, Artificial
  CRISPR gRNA sequence
cccgaaagtctgacttctag

SEQ ID NO: 36295 - DNA, 20 bp, Artificial
  CRISPR gRNA sequence
acttctagaacctttcggtg

SEQ ID NO: 36296 - DNA, 20 bp, Artificial
  CRISPR gRNA sequence
ctagaacctttcggtgctga

SEQ ID NO: 36297 - DNA, 20 bp, Artificial
  CRISPR gRNA sequence
tagaacctttcggtgctgat

SEQ ID NO: 36298 - DNA, 20 bp, Artificial
  CRISPR gRNA sequence
gaacctttcggtgctgatac

SEQ ID NO: 36299 - DNA, 20 bp, Artificial
  CRISPR gRNA sequence
tcggtgctgatacatggttc

SEQ ID NO: 36300 - DNA, 20 bp, Artificial
  CRISPR gRNA sequence
cggtgctgatacatggttca

SEQ ID NO: 36301 - DNA, 20 bp, Artificial
  CRISPR gRNA sequence
ggtgctgatacatggttcat

SEQ ID NO: 36302 - DNA, 20 bp, Artificial
  CRISPR gRNA sequence
atacatggttcatactccag

SEQ ID NO: 36303 - DNA, 20 bp, Artificial
  CRISPR gRNA sequence
atactccagacacctggctg

SEQ ID NO: 36304 - DNA, 20 bp, Artificial
  CRISPR gRNA sequence
cagacacctggctgacctga

SEQ ID NO: 36305 - DNA, 20 bp, Artificial
  CRISPR gRNA sequence
gctgacctgaagtctccctc

SEQ ID NO: 36306 - DNA, 20 bp, Artificial
  CRISPR gRNA sequence
acctgaagtctccctccggt

SEQ ID NO: 36307 - DNA, 20 bp, Artificial
  CRISPR gRNA sequence
aagtctccctccggtggaag

SEQ ID NO: 36308 - DNA, 20 bp, Artificial
  CRISPR gRNA sequence
cctccggtggaaggaaatag

SEQ ID NO: 36309 - DNA, 20 bp, Artificial
  CRISPR gRNA sequence
cggtggaaggaaatagacaa

SEQ ID NO: 36310 - DNA, 20 bp, Artificial
  CRISPR gRNA sequence
tttcacatcttccaatggcc

SEQ ID NO: 36311 - DNA, 20 bp, Artificial
  CRISPR gRNA sequence
tcacatcttccaatggcctg

SEQ ID NO: 36312 - DNA, 20 bp, Artificial
  CRISPR gRNA sequence
cacatcttccaatggcctgc

SEQ ID NO: 36313 - DNA, 20 bp, Artificial
  CRISPR gRNA sequence
acatcttccaatggcctgcc

SEQ ID NO: 36314 - DNA, 20 bp, Artificial
  CRISPR gRNA sequence
ccaatggcctgccccagcag

SEQ ID NO: 36315 - DNA, 20 bp, Artificial
  CRISPR gRNA sequence
caatggcctgccccagcagg

SEQ ID NO: 36316 - DNA, 20 bp, Artificial
  CRISPR gRNA sequence
ccccagcaggacacagactc

SEQ ID NO: 36317 - DNA, 20 bp, Artificial
  CRISPR gRNA sequence
ctgttcccatcctcaccccc

SEQ ID NO: 36318 - DNA, 20 bp, Artificial
  CRISPR gRNA sequence
ttcccatcctcacccccatc

SEQ ID NO: 36319 - DNA, 20 bp, Artificial
  CRISPR gRNA sequence
ccatcctcacccccatcccc

SEQ ID NO: 36320 - DNA, 20 bp, Artificial
  CRISPR gRNA sequence
acccccatccccaattcaga

SEQ ID NO: 36321 - DNA, 20 bp, Artificial
  CRISPR gRNA sequence
agaatggtttctctgtttat

SEQ ID NO: 36322 - DNA, 20 bp, Artificial
  CRISPR gRNA sequence
ctctgtttatctggaatggc

SEQ ID NO: 36323 - DNA, 20 bp, Artificial
  CRISPR gRNA sequence
tctgtttatctggaatggca

SEQ ID NO: 36324 - DNA, 20 bp, Artificial
  CRISPR gRNA sequence
tgtttatctggaatggcagg

SEQ ID NO: 36325 - DNA, 20 bp, Artificial
  CRISPR gRNA sequence
tttatctggaatggcaggac

SEQ ID NO: 36326 - DNA, 20 bp, Artificial
  CRISPR gRNA sequence
atctggaatggcaggaccag

SEQ ID NO: 36327 - DNA, 20 bp, Artificial
  CRISPR gRNA sequence
tctggaatggcaggaccagc

SEQ ID NO: 36328 - DNA, 20 bp, Artificial
  CRISPR gRNA sequence
gaatggcaggaccagctgag

SEQ ID NO: 36329 - DNA, 20 bp, Artificial
  CRISPR gRNA sequence
agactgcacgctaaattaag

SEQ ID NO: 36330 - DNA, 20 bp, Artificial
  CRISPR gRNA sequence
cacgctaaattaagatgctt

SEQ ID NO: 36331 - DNA, 20 bp, Artificial
  CRISPR gRNA sequence
aattaagatgctttcccggc

SEQ ID NO: 36332 - DNA, 20 bp, Artificial
  CRISPR gRNA sequence
agatgctttcccggcctttt

SEQ ID NO: 36333 - DNA, 20 bp, Artificial
  CRISPR gRNA sequence
tcccggcctttttaccttgg

SEQ ID NO: 36334 - DNA, 20 bp, Artificial
  CRISPR gRNA sequence
cccggcctttttaccttggg

SEQ ID NO: 36335 - DNA, 20 bp, Artificial
  CRISPR gRNA sequence
ccggcctttttaccttgggg

SEQ ID NO: 36336 - DNA, 20 bp, Artificial
  CRISPR gRNA sequence
tttaccttggggctctgaca

SEQ ID NO: 36337 - DNA, 20 bp, Artificial
  CRISPR gRNA sequence
ttaccttggggctctgacag

SEQ ID NO: 36338 - DNA, 20 bp, Artificial
  CRISPR gRNA sequence
taccttggggctctgacagg

SEQ ID NO: 36339 - DNA, 20 bp, Artificial
  CRISPR gRNA sequence
accttggggctctgacaggt

SEQ ID NO: 36340 - DNA, 20 bp, Artificial
  CRISPR gRNA sequence
ccttggggctctgacaggta

SEQ ID NO: 36341 - DNA, 20 bp, Artificial
  CRISPR gRNA sequence
ggggctctgacaggtaggac

SEQ ID NO: 36342 - DNA, 20 bp, Artificial
  CRISPR gRNA sequence
gggctctgacaggtaggacc

SEQ ID NO: 36343 - DNA, 20 bp, Artificial
  CRISPR gRNA sequence
tgacaggtaggacccagcag

SEQ ID NO: 36344 - DNA, 20 bp, Artificial
  CRISPR gRNA sequence
acaggtaggacccagcaggg

SEQ ID NO: 36345 - DNA, 20 bp, Artificial
  CRISPR gRNA sequence
tgtaggaatcccagccaggc

SEQ ID NO: 36346 - DNA, 20 bp, Artificial
  CRISPR gRNA sequence
ccggagtctggcagcccctc

SEQ ID NO: 36347 - DNA, 20 bp, Artificial
  CRISPR gRNA sequence
gcagcccctcctcgtgccct

SEQ ID NO: 36348 - DNA, 20 bp, Artificial
  CRISPR gRNA sequence
ctcgtgccctcagcttcccc

SEQ ID NO: 36349 - DNA, 20 bp, Artificial
  CRISPR gRNA sequence
gtgccctcagcttccccaag

SEQ ID NO: 36350 - DNA, 20 bp, Artificial
  CRISPR gRNA sequence
agcttccccaaggatgcctt

SEQ ID NO: 36351 - DNA, 20 bp, Artificial
  CRISPR gRNA sequence
ccccaaggatgccttcggat

SEQ ID NO: 36352 - DNA, 20 bp, Artificial
  CRISPR gRNA sequence
cccaaggatgccttcggatg

SEQ ID NO: 36353 - DNA, 20 bp, Artificial
  CRISPR gRNA sequence
tgtctccggcaggcaggggc

SEQ ID NO: 36354 - DNA, 20 bp, Artificial
  CRISPR gRNA sequence
gtctccggcaggcaggggca

SEQ ID NO: 36355 - DNA, 20 bp, Artificial
  CRISPR gRNA sequence
tctccggcaggcaggggcaa

SEQ ID NO: 36356 - DNA, 20 bp, Artificial
  CRISPR gRNA sequence
cggcaggcaggggcaagggc

SEQ ID NO: 36357 - DNA, 20 bp, Artificial
  CRISPR gRNA sequence
caggggcaagggctggtgcc

SEQ ID NO: 36358 - DNA, 20 bp, Artificial
  CRISPR gRNA sequence
aagggctggtgcctggttta

SEQ ID NO: 36359 - DNA, 20 bp, Artificial
  CRISPR gRNA sequence
ctggtttacagcattccttt

SEQ ID NO: 36360 - DNA, 20 bp, Artificial
  CRISPR gRNA sequence
ggtttacagcattccttttg

SEQ ID NO: 36361 - DNA, 20 bp, Artificial
  CRISPR gRNA sequence
acagcattccttttggagtc

SEQ ID NO: 36362 - DNA, 20 bp, Artificial
  CRISPR gRNA sequence
attccttttggagtctggaa

SEQ ID NO: 36363 - DNA, 20 bp, Artificial
  CRISPR gRNA sequence
ccttttggagtctggaatag

SEQ ID NO: 36364 - DNA, 20 bp, Artificial
  CRISPR gRNA sequence
cttttggagtctggaatagt

SEQ ID NO: 36365 - DNA, 20 bp, Artificial
  CRISPR gRNA sequence
ttttggagtctggaatagtg

SEQ ID NO: 36366 - DNA, 20 bp, Artificial
  CRISPR gRNA sequence
ctccctgtcttctctcccct

SEQ ID NO: 36367 - DNA, 20 bp, Artificial
  CRISPR gRNA sequence
tccctgtcttctctcccctt

SEQ ID NO: 36368 - DNA, 20 bp, Artificial
  CRISPR gRNA sequence
cctgtcttctctccccttag

SEQ ID NO: 36369 - DNA, 20 bp, Artificial
  CRISPR gRNA sequence
ccccttaggagtctgcacta

SEQ ID NO: 36370 - DNA, 20 bp, Artificial
  CRISPR gRNA sequence
atggaaacaacctgtcaatc

SEQ ID NO: 36371 - DNA, 20 bp, Artificial
  CRISPR gRNA sequence
acaacctgtcaatccagctc

SEQ ID NO: 36372 - DNA, 20 bp, Artificial
  CRISPR gRNA sequence
caacctgtcaatccagctca

SEQ ID NO: 36373 - DNA, 20 bp, Artificial
  CRISPR gRNA sequence
aatccagctcaaggcacaca

SEQ ID NO: 36374 - DNA, 20 bp, Artificial
  CRISPR gRNA sequence
agctcaaggcacacatagcc

SEQ ID NO: 36375 - DNA, 20 bp, Artificial
  CRISPR gRNA sequence
cacatagcccagacacccat

SEQ ID NO: 36376 - DNA, 20 bp, Artificial
  CRISPR gRNA sequence
cacccatgagaccctctccg

SEQ ID NO: 36377 - DNA, 20 bp, Artificial
  CRISPR gRNA sequence
acccatgagaccctctccgt

SEQ ID NO: 36378 - DNA, 20 bp, Artificial
  CRISPR gRNA sequence
cccatgagaccctctccgtg

SEQ ID NO: 36379 - DNA, 20 bp, Artificial
  CRISPR gRNA sequence
gaccctctccgtggggaccc

SEQ ID NO: 36380 - DNA, 20 bp, Artificial
  CRISPR gRNA sequence
ccctctccgtggggacccta

SEQ ID NO: 36381 - DNA, 20 bp, Artificial
  CRISPR gRNA sequence
ctagagcacctatcatgaac

SEQ ID NO: 36382 - DNA, 20 bp, Artificial
  CRISPR gRNA sequence
tagagcacctatcatgaacg

SEQ ID NO: 36383 - DNA, 20 bp, Artificial
  CRISPR gRNA sequence
gagcacctatcatgaacgag

SEQ ID NO: 36384 - DNA, 20 bp, Artificial
  CRISPR gRNA sequence
ctatcatgaacgaggagacc

SEQ ID NO: 36385 - DNA, 20 bp, Artificial
  CRISPR gRNA sequence
tcatgaacgaggagaccaag

SEQ ID NO: 36386 - DNA, 20 bp, Artificial
  CRISPR gRNA sequence
catgaacgaggagaccaagt

SEQ ID NO: 36387 - DNA, 20 bp, Artificial
  CRISPR gRNA sequence
gtcacttttctcctactgcc

SEQ ID NO: 36388 - DNA, 20 bp, Artificial
  CRISPR gRNA sequence
ttttctcctactgccaagac

SEQ ID NO: 36389 - DNA, 20 bp, Artificial
  CRISPR gRNA sequence
cctacccaaatctgccttac

SEQ ID NO: 36390 - DNA, 20 bp, Artificial
  CRISPR gRNA sequence
ctacccaaatctgccttact

SEQ ID NO: 36391 - DNA, 20 bp, Artificial
  CRISPR gRNA sequence
acctgcccttgaccatcatt

SEQ ID NO: 36392 - DNA, 20 bp, Artificial
  CRISPR gRNA sequence
ccttgaccatcattcagcat

SEQ ID NO: 36393 - DNA, 20 bp, Artificial
  CRISPR gRNA sequence
cagcatgagaatgtaatgat

SEQ ID NO: 36394 - DNA, 20 bp, Artificial
  CRISPR gRNA sequence
gagaatgtaatgatcagaca

SEQ ID NO: 36395 - DNA, 20 bp, Artificial
  CRISPR gRNA sequence
aatgatcagacacagaaaat

SEQ ID NO: 36396 - DNA, 20 bp, Artificial
  CRISPR gRNA sequence
atgatcagacacagaaaatc

SEQ ID NO: 36397 - DNA, 20 bp, Artificial
  CRISPR gRNA sequence
atcagacacagaaaatcagg

SEQ ID NO: 36398 - DNA, 20 bp, Artificial
  CRISPR gRNA sequence
cagacacagaaaatcaggaa

SEQ ID NO: 36399 - DNA, 20 bp, Artificial
  CRISPR gRNA sequence
agaaaatcaggaagagtttt

SEQ ID NO: 36400 - DNA, 20 bp, Artificial
  CRISPR gRNA sequence
aatcaggaagagttttgaga

SEQ ID NO: 36401 - DNA, 20 bp, Artificial
  CRISPR gRNA sequence
agcatctaatctacccattt

SEQ ID NO: 36402 - DNA, 20 bp, Artificial
  CRISPR gRNA sequence
catctaatctacccatttta

SEQ ID NO: 36403 - DNA, 20 bp, Artificial
  CRISPR gRNA sequence
taatctacccattttagaga

SEQ ID NO: 36404 - DNA, 20 bp, Artificial
  CRISPR gRNA sequence
attttagagatggtatgact

SEQ ID NO: 36405 - DNA, 20 bp, Artificial
  CRISPR gRNA sequence
ttttagagatggtatgactg

SEQ ID NO: 36406 - DNA, 20 bp, Artificial
  CRISPR gRNA sequence
tggtatgactgaggcttata

SEQ ID NO: 36407 - DNA, 20 bp, Artificial
  CRISPR gRNA sequence
ggtatgactgaggcttatat

SEQ ID NO: 36408 - DNA, 20 bp, Artificial
  CRISPR gRNA sequence
actgaggcttatataggaaa

SEQ ID NO: 36409 - DNA, 20 bp, Artificial
  CRISPR gRNA sequence
ctgaggcttatataggaaaa

SEQ ID NO: 36410 - DNA, 20 bp, Artificial
  CRISPR gRNA sequence
tataggaaaaaggcttgctc

SEQ ID NO: 36411 - DNA, 20 bp, Artificial
  CRISPR gRNA sequence
ataggaaaaaggcttgctca

SEQ ID NO: 36412 - DNA, 20 bp, Artificial
  CRISPR gRNA sequence
cttgctcaaggtcacactat

SEQ ID NO: 36413 - DNA, 20 bp, Artificial
  CRISPR gRNA sequence
aggtcacactatgagtgtat

SEQ ID NO: 36414 - DNA, 20 bp, Artificial
  CRISPR gRNA sequence
cacactatgagtgtatcagc

SEQ ID NO: 36415 - DNA, 20 bp, Artificial
  CRISPR gRNA sequence
acactatgagtgtatcagct

SEQ ID NO: 36416 - DNA, 20 bp, Artificial
  CRISPR gRNA sequence
tatgagtgtatcagctagga

SEQ ID NO: 36417 - DNA, 20 bp, Artificial
  CRISPR gRNA sequence
atgagtgtatcagctaggat

SEQ ID NO: 36418 - DNA, 20 bp, Artificial
  CRISPR gRNA sequence
gtgtatcagctaggataggc

SEQ ID NO: 36419 - DNA, 20 bp, Artificial
  CRISPR gRNA sequence
tgtatcagctaggataggcc

SEQ ID NO: 36420 - DNA, 20 bp, Artificial
  CRISPR gRNA sequence
ggataggccaggttacactg

SEQ ID NO: 36421 - DNA, 20 bp, Artificial
  CRISPR gRNA sequence
tgtagtacatgcaccctcca

SEQ ID NO: 36422 - DNA, 20 bp, Artificial
  CRISPR gRNA sequence
acatgcaccctccaaagtcc

SEQ ID NO: 36423 - DNA, 20 bp, Artificial
  CRISPR gRNA sequence
tccaaagtcccagtgactca

SEQ ID NO: 36424 - DNA, 20 bp, Artificial
  CRISPR gRNA sequence
ccagtgactcatggcaacaa

SEQ ID NO: 36425 - DNA, 20 bp, Artificial
  CRISPR gRNA sequence
ctcttgcttcctgtctcgtg

SEQ ID NO: 36426 - DNA, 20 bp, Artificial
  CRISPR gRNA sequence
cctgtctcgtgtggattgac

SEQ ID NO: 36427 - DNA, 20 bp, Artificial
  CRISPR gRNA sequence
ctgtctcgtgtggattgact

SEQ ID NO: 36428 - DNA, 20 bp, Artificial
  CRISPR gRNA sequence
atcatcctgtctcccacact

SEQ ID NO: 36429 - DNA, 20 bp, Artificial
  CRISPR gRNA sequence
tcatcctgtctcccacactc

SEQ ID NO: 36430 - DNA, 20 bp, Artificial
  CRISPR gRNA sequence
gtctcccacactcaggctaa

SEQ ID NO: 36431 - DNA, 20 bp, Artificial
  CRISPR gRNA sequence
tctcccacactcaggctaac

SEQ ID NO: 36432 - DNA, 20 bp, Artificial
  CRISPR gRNA sequence
ctcccacactcaggctaaca

SEQ ID NO: 36433 - DNA, 20 bp, Artificial
  CRISPR gRNA sequence
ccacactcaggctaacaggg

SEQ ID NO: 36434 - DNA, 20 bp, Artificial
  CRISPR gRNA sequence
gccatgatttgcaatatttc

SEQ ID NO: 36435 - DNA, 20 bp, Artificial
  CRISPR gRNA sequence
tttgcaatatttctggtccc

SEQ ID NO: 36436 - DNA, 20 bp, Artificial
  CRISPR gRNA sequence
tgcaatatttctggtccctg

SEQ ID NO: 36437 - DNA, 20 bp, Artificial
  CRISPR gRNA sequence
aatatttctggtccctggag

SEQ ID NO: 36438 - DNA, 20 bp, Artificial
  CRISPR gRNA sequence
tggtccctggagtagaaaaa

SEQ ID NO: 36439 - DNA, 20 bp, Artificial
  CRISPR gRNA sequence
ctggagtagaaaaaaagaaa

SEQ ID NO: 36440 - DNA, 20 bp, Artificial
  CRISPR gRNA sequence
aagtactgtcaattacacct

SEQ ID NO: 36441 - DNA, 20 bp, Artificial
  CRISPR gRNA sequence
cttggttcttaaaacaacta

SEQ ID NO: 36442 - DNA, 20 bp, Artificial
  CRISPR gRNA sequence
ttggttcttaaaacaactac

SEQ ID NO: 36443 - DNA, 20 bp, Artificial
  CRISPR gRNA sequence
aacaactacaggcatgacat

SEQ ID NO: 36444 - DNA, 20 bp, Artificial
  CRISPR gRNA sequence
ggcatgacatgagtcttttt

SEQ ID NO: 36445 - DNA, 20 bp, Artificial
  CRISPR gRNA sequence
ttagcatgtttcattgacca

SEQ ID NO: 36446 - DNA, 20 bp, Artificial
  CRISPR gRNA sequence
catgtttcattgaccaaagc

SEQ ID NO: 36447 - DNA, 20 bp, Artificial
  CRISPR gRNA sequence
attgaccaaagcaagtttca

SEQ ID NO: 36448 - DNA, 20 bp, Artificial
  CRISPR gRNA sequence
tcatggctgtgcccaatttc

SEQ ID NO: 36449 - DNA, 20 bp, Artificial
  CRISPR gRNA sequence
catggctgtgcccaatttca

SEQ ID NO: 36450 - DNA, 20 bp, Artificial
  CRISPR gRNA sequence
tggctgtgcccaatttcaag

SEQ ID NO: 36451 - DNA, 20 bp, Artificial
  CRISPR gRNA sequence
ggctgtgcccaatttcaagg

SEQ ID NO: 36452 - DNA, 20 bp, Artificial
  CRISPR gRNA sequence
tgtgcccaatttcaaggagg

SEQ ID NO: 36453 - DNA, 20 bp, Artificial
  CRISPR gRNA sequence
tgcccaatttcaaggaggca

SEQ ID NO: 36454 - DNA, 20 bp, Artificial
  CRISPR gRNA sequence
ccaatttcaaggaggcagag

SEQ ID NO: 36455 - DNA, 20 bp, Artificial
  CRISPR gRNA sequence
agagaagtgtaatcccacca

SEQ ID NO: 36456 - DNA, 20 bp, Artificial
  CRISPR gRNA sequence
gagaagtgtaatcccaccaa

SEQ ID NO: 36457 - DNA, 20 bp, Artificial
  CRISPR gRNA sequence
gtgtaatcccaccaaaggcc

SEQ ID NO: 36458 - DNA, 20 bp, Artificial
  CRISPR gRNA sequence
aatcccaccaaaggcctaga

SEQ ID NO: 36459 - DNA, 20 bp, Artificial
  CRISPR gRNA sequence
tcccaccaaaggcctagaaa

SEQ ID NO: 36460 - DNA, 20 bp, Artificial
  CRISPR gRNA sequence
cccaccaaaggcctagaaag

SEQ ID NO: 36461 - DNA, 20 bp, Artificial
  CRISPR gRNA sequence
caccaaaggcctagaaagag

SEQ ID NO: 36462 - DNA, 20 bp, Artificial
  CRISPR gRNA sequence
aaaggcctagaaagaggaga

SEQ ID NO: 36463 - DNA, 20 bp, Artificial
  CRISPR gRNA sequence
aggcctagaaagaggagaaa

SEQ ID NO: 36464 - DNA, 20 bp, Artificial
  CRISPR gRNA sequence
ggagaaagagtatctgtgaa

SEQ ID NO: 36465 - DNA, 20 bp, Artificial
  CRISPR gRNA sequence
aacagccctaatgcctacca

SEQ ID NO: 36466 - DNA, 20 bp, Artificial
  CRISPR gRNA sequence
cagccctaatgcctaccaca

SEQ ID NO: 36467 - DNA, 20 bp, Artificial
  CRISPR gRNA sequence
taatgcctaccacagagaat

SEQ ID NO: 36468 - DNA, 20 bp, Artificial
  CRISPR gRNA sequence
ctaccacagagaattagtaa

SEQ ID NO: 36469 - DNA, 20 bp, Artificial
  CRISPR gRNA sequence
accacagagaattagtaaca

SEQ ID NO: 36470 - DNA, 20 bp, Artificial
  CRISPR gRNA sequence
cagagaattagtaacagagc

SEQ ID NO: 36471 - DNA, 20 bp, Artificial
  CRISPR gRNA sequence
agagaattagtaacagagct

SEQ ID NO: 36472 - DNA, 20 bp, Artificial
  CRISPR gRNA sequence
ttagtaacagagctgggcca

SEQ ID NO: 36473 - DNA, 20 bp, Artificial
  CRISPR gRNA sequence
aaccatcgtcctctgtctcc

SEQ ID NO: 36474 - DNA, 20 bp, Artificial
  CRISPR gRNA sequence
gtctccaagattattcccca

SEQ ID NO: 36475 - DNA, 20 bp, Artificial
  CRISPR gRNA sequence
tgccatgtgctttttctcct

SEQ ID NO: 36476 - DNA, 20 bp, Artificial
  CRISPR gRNA sequence
gccatgtgctttttctcctg

SEQ ID NO: 36477 - DNA, 20 bp, Artificial
  CRISPR gRNA sequence
tgtgctttttctcctgagga

SEQ ID NO: 36478 - DNA, 20 bp, Artificial
  CRISPR gRNA sequence
ctttttctcctgaggatggt

SEQ ID NO: 36479 - DNA, 20 bp, Artificial
  CRISPR gRNA sequence
cctgaggatggttagcctta

SEQ ID NO: 36480 - DNA, 20 bp, Artificial
  CRISPR gRNA sequence
tgaggatggttagccttaaa

SEQ ID NO: 36481 - DNA, 20 bp, Artificial
  CRISPR gRNA sequence
agagatttgtgtcatatcct

SEQ ID NO: 36482 - DNA, 20 bp, Artificial
  CRISPR gRNA sequence
gagatttgtgtcatatccta

SEQ ID NO: 36483 - DNA, 20 bp, Artificial
  CRISPR gRNA sequence
agatttgtgtcatatcctaa

SEQ ID NO: 36484 - DNA, 20 bp, Artificial
  CRISPR gRNA sequence
gatttgtgtcatatcctaag

SEQ ID NO: 36485 - DNA, 20 bp, Artificial
  CRISPR gRNA sequence
tgtgtcatatcctaagggga

SEQ ID NO: 36486 - DNA, 20 bp, Artificial
  CRISPR gRNA sequence
aggggatagaacactaatga

SEQ ID NO: 36487 - DNA, 20 bp, Artificial
  CRISPR gRNA sequence
gaacactaatgatggaaaca

SEQ ID NO: 36488 - DNA, 20 bp, Artificial
  CRISPR gRNA sequence
aacactaatgatggaaacaa

SEQ ID NO: 36489 - DNA, 20 bp, Artificial
  CRISPR gRNA sequence
tggaaacaaaggtattgtgt

SEQ ID NO: 36490 - DNA, 20 bp, Artificial
  CRISPR gRNA sequence
acaaaggtattgtgttagac

SEQ ID NO: 36491 - DNA, 20 bp, Artificial
  CRISPR gRNA sequence
aggtattgtgttagactggc

SEQ ID NO: 36492 - DNA, 20 bp, Artificial
  CRISPR gRNA sequence
gtattgtgttagactggctg

SEQ ID NO: 36493 - DNA, 20 bp, Artificial
  CRISPR gRNA sequence
tattgtgttagactggctgg

SEQ ID NO: 36494 - DNA, 20 bp, Artificial
  CRISPR gRNA sequence
ttgtgttagactggctggag

SEQ ID NO: 36495 - DNA, 20 bp, Artificial
  CRISPR gRNA sequence
actggctggaggagaaattt

SEQ ID NO: 36496 - DNA, 20 bp, Artificial
  CRISPR gRNA sequence
ctggctggaggagaaatttg

SEQ ID NO: 36497 - DNA, 20 bp, Artificial
  CRISPR gRNA sequence
tggaggagaaatttgaggat

SEQ ID NO: 36498 - DNA, 20 bp, Artificial
  CRISPR gRNA sequence
ttgaggatgagaaacatcac

SEQ ID NO: 36499 - DNA, 20 bp, Artificial
  CRISPR gRNA sequence
tcaccagaaatcacaccatc

SEQ ID NO: 36500 - DNA, 20 bp, Artificial
  CRISPR gRNA sequence
caccagaaatcacaccatcc

SEQ ID NO: 36501 - DNA, 20 bp, Artificial
  CRISPR gRNA sequence
aggcactacttacttccatc

SEQ ID NO: 36502 - DNA, 20 bp, Artificial
  CRISPR gRNA sequence
catctggtgccatgctgccc

SEQ ID NO: 36503 - DNA, 20 bp, Artificial
  CRISPR gRNA sequence
tgccctggaccatttcttca

SEQ ID NO: 36504 - DNA, 20 bp, Artificial
  CRISPR gRNA sequence
gccctggaccatttcttcat

SEQ ID NO: 36505 - DNA, 20 bp, Artificial
  CRISPR gRNA sequence
ctggaccatttcttcatggg

SEQ ID NO: 36506 - DNA, 20 bp, Artificial
  CRISPR gRNA sequence
ccatttcttcatgggtagca

SEQ ID NO: 36507 - DNA, 20 bp, Artificial
  CRISPR gRNA sequence
ttcatgggtagcatggatgc

SEQ ID NO: 36508 - DNA, 20 bp, Artificial
  CRISPR gRNA sequence
agcatggatgctggacacca

SEQ ID NO: 36509 - DNA, 20 bp, Artificial
  CRISPR gRNA sequence
ggatgctggacaccatagcc

SEQ ID NO: 36510 - DNA, 20 bp, Artificial
  CRISPR gRNA sequence
ctggacaccatagcctggaa

SEQ ID NO: 36511 - DNA, 20 bp, Artificial
  CRISPR gRNA sequence
gacaccatagcctggaaaag

SEQ ID NO: 36512 - DNA, 20 bp, Artificial
  CRISPR gRNA sequence
ctggaaaagaagttatgccc

SEQ ID NO: 36513 - DNA, 20 bp, Artificial
  CRISPR gRNA sequence
tggaaaagaagttatgccct

SEQ ID NO: 36514 - DNA, 20 bp, Artificial
  CRISPR gRNA sequence
agaagttatgccctaggcta

SEQ ID NO: 36515 - DNA, 20 bp, Artificial
  CRISPR gRNA sequence
tatggccacatccttttgcc

SEQ ID NO: 36516 - DNA, 20 bp, Artificial
  CRISPR gRNA sequence
tgccgagatcacacaaaatc

SEQ ID NO: 36517 - DNA, 20 bp, Artificial
  CRISPR gRNA sequence
gccgagatcacacaaaatcc

SEQ ID NO: 36518 - DNA, 20 bp, Artificial
  CRISPR gRNA sequence
ccgagatcacacaaaatcca

SEQ ID NO: 36519 - DNA, 20 bp, Artificial
  CRISPR gRNA sequence
tcacacaaaatccagggact

SEQ ID NO: 36520 - DNA, 20 bp, Artificial
  CRISPR gRNA sequence
tccagggacttagccttgtc

SEQ ID NO: 36521 - DNA, 20 bp, Artificial
  CRISPR gRNA sequence
tagccttgtctggtgccatc

SEQ ID NO: 36522 - DNA, 20 bp, Artificial
  CRISPR gRNA sequence
agccttgtctggtgccatct

SEQ ID NO: 36523 - DNA, 20 bp, Artificial
  CRISPR gRNA sequence
ctggtgccatctaggcctcc

SEQ ID NO: 36524 - DNA, 20 bp, Artificial
  CRISPR gRNA sequence
tggtgccatctaggcctcca

SEQ ID NO: 36525 - DNA, 20 bp, Artificial
  CRISPR gRNA sequence
catctaggcctccaaggcct

SEQ ID NO: 36526 - DNA, 20 bp, Artificial
  CRISPR gRNA sequence
ccaaggccttggaaatttac

SEQ ID NO: 36527 - DNA, 20 bp, Artificial
  CRISPR gRNA sequence
gccttggaaatttactggcc

SEQ ID NO: 36528 - DNA, 20 bp, Artificial
  CRISPR gRNA sequence
ccttggaaatttactggcct

SEQ ID NO: 36529 - DNA, 20 bp, Artificial
  CRISPR gRNA sequence
ttggaaatttactggcctgg

SEQ ID NO: 36530 - DNA, 20 bp, Artificial
  CRISPR gRNA sequence
tggaaatttactggcctggg

SEQ ID NO: 36531 - DNA, 20 bp, Artificial
  CRISPR gRNA sequence
aatttactggcctgggaggc

SEQ ID NO: 36532 - DNA, 20 bp, Artificial
  CRISPR gRNA sequence
gcctgggaggcaagaaacct

SEQ ID NO: 36533 - DNA, 20 bp, Artificial
  CRISPR gRNA sequence
ttctcctcctgcctctgtca

SEQ ID NO: 36534 - DNA, 20 bp, Artificial
  CRISPR gRNA sequence
atggacttgctgtgtgactg

SEQ ID NO: 36535 - DNA, 20 bp, Artificial
  CRISPR gRNA sequence
tggacttgctgtgtgactgt

SEQ ID NO: 36536 - DNA, 20 bp, Artificial
  CRISPR gRNA sequence
gcacaccctttgcccttcct

SEQ ID NO: 36537 - DNA, 20 bp, Artificial
  CRISPR gRNA sequence
cctttgcccttccttggcca

SEQ ID NO: 36538 - DNA, 20 bp, Artificial
  CRISPR gRNA sequence
ccatggtctttccgtctgct

SEQ ID NO: 36539 - DNA, 20 bp, Artificial
  CRISPR gRNA sequence
tggtctttccgtctgcttag

SEQ ID NO: 36540 - DNA, 20 bp, Artificial
  CRISPR gRNA sequence
gtctttccgtctgcttagtg

SEQ ID NO: 36541 - DNA, 20 bp, Artificial
  CRISPR gRNA sequence
tctttccgtctgcttagtgg

SEQ ID NO: 36542 - DNA, 20 bp, Artificial
  CRISPR gRNA sequence
ttccgtctgcttagtggagg

SEQ ID NO: 36543 - DNA, 20 bp, Artificial
  CRISPR gRNA sequence
ggaggtggtgatccctgcct

SEQ ID NO: 36544 - DNA, 20 bp, Artificial
  CRISPR gRNA sequence
gaggtggtgatccctgcctg

SEQ ID NO: 36545 - DNA, 20 bp, Artificial
  CRISPR gRNA sequence
tgatccctgcctgaggatca

SEQ ID NO: 36546 - DNA, 20 bp, Artificial
  CRISPR gRNA sequence
ctgcctgaggatcatggtgt

SEQ ID NO: 36547 - DNA, 20 bp, Artificial
  CRISPR gRNA sequence
gagcatgtttcataaattct

SEQ ID NO: 36548 - DNA, 20 bp, Artificial
  CRISPR gRNA sequence
aattctaagactctctgcct

SEQ ID NO: 36549 - DNA, 20 bp, Artificial
  CRISPR gRNA sequence
ctaagactctctgcctgagt

SEQ ID NO: 36550 - DNA, 20 bp, Artificial
  CRISPR gRNA sequence
taagactctctgcctgagtg

SEQ ID NO: 36551 - DNA, 20 bp, Artificial
  CRISPR gRNA sequence
gagtgaggacctattgctat

SEQ ID NO: 36552 - DNA, 20 bp, Artificial
  CRISPR gRNA sequence
aggacctattgctattagcc

SEQ ID NO: 36553 - DNA, 20 bp, Artificial
  CRISPR gRNA sequence
ctattgctattagcccagtt

SEQ ID NO: 36554 - DNA, 20 bp, Artificial
  CRISPR gRNA sequence
tattgctattagcccagttg

SEQ ID NO: 36555 - DNA, 20 bp, Artificial
  CRISPR gRNA sequence
ttgctattagcccagttgag

SEQ ID NO: 36556 - DNA, 20 bp, Artificial
  CRISPR gRNA sequence
cccagttgaggagaaatgac

SEQ ID NO: 36557 - DNA, 20 bp, Artificial
  CRISPR gRNA sequence
agttgaggagaaatgaccag

SEQ ID NO: 36558 - DNA, 20 bp, Artificial
  CRISPR gRNA sequence
gttgaggagaaatgaccagt

SEQ ID NO: 36559 - DNA, 20 bp, Artificial
  CRISPR gRNA sequence
ttgaggagaaatgaccagtg

SEQ ID NO: 36560 - DNA, 20 bp, Artificial
  CRISPR gRNA sequence
gaaatgaccagtggggctga

SEQ ID NO: 36561 - DNA, 20 bp, Artificial
  CRISPR gRNA sequence
gtggggctgacagtacatcc

SEQ ID NO: 36562 - DNA, 20 bp, Artificial
  CRISPR gRNA sequence
gtatgtctctactgcatgcc

SEQ ID NO: 36563 - DNA, 20 bp, Artificial
  CRISPR gRNA sequence
tatgtctctactgcatgccc

SEQ ID NO: 36564 - DNA, 20 bp, Artificial
  CRISPR gRNA sequence
atgtctctactgcatgccca

SEQ ID NO: 36565 - DNA, 20 bp, Artificial
  CRISPR gRNA sequence
gtctctactgcatgcccagg

SEQ ID NO: 36566 - DNA, 20 bp, Artificial
  CRISPR gRNA sequence
tctactgcatgcccagggag

SEQ ID NO: 36567 - DNA, 20 bp, Artificial
  CRISPR gRNA sequence
ctgcatgcccagggagcagc

SEQ ID NO: 36568 - DNA, 20 bp, Artificial
  CRISPR gRNA sequence
tgcatgcccagggagcagct

SEQ ID NO: 36569 - DNA, 20 bp, Artificial
  CRISPR gRNA sequence
agcagctgggctctaaaccc

SEQ ID NO: 36570 - DNA, 20 bp, Artificial
  CRISPR gRNA sequence
gcagctgggctctaaacccc

SEQ ID NO: 36571 - DNA, 20 bp, Artificial
  CRISPR gRNA sequence
gctctaaaccccaggacgca

SEQ ID NO: 36572 - DNA, 20 bp, Artificial
  CRISPR gRNA sequence
aaccccaggacgcatagtac

SEQ ID NO: 36573 - DNA, 20 bp, Artificial
  CRISPR gRNA sequence
aggacgcatagtactggcct

SEQ ID NO: 36574 - DNA, 20 bp, Artificial
  CRISPR gRNA sequence
atagtactggcctcagcctc

SEQ ID NO: 36575 - DNA, 20 bp, Artificial
  CRISPR gRNA sequence
tagtactggcctcagcctct

SEQ ID NO: 36576 - DNA, 20 bp, Artificial
  CRISPR gRNA sequence
tggcctcagcctctgggaat

SEQ ID NO: 36577 - DNA, 20 bp, Artificial
  CRISPR gRNA sequence
ggcctcagcctctgggaatt

SEQ ID NO: 36578 - DNA, 20 bp, Artificial
  CRISPR gRNA sequence
ctcagcctctgggaattggg

SEQ ID NO: 36579 - DNA, 20 bp, Artificial
  CRISPR gRNA sequence
tcagcctctgggaattggga

SEQ ID NO: 36580 - DNA, 20 bp, Artificial
  CRISPR gRNA sequence
cctctgggaattgggaaggc

SEQ ID NO: 36581 - DNA, 20 bp, Artificial
  CRISPR gRNA sequence
gaattgggaaggctggcttc

SEQ ID NO: 36582 - DNA, 20 bp, Artificial
  CRISPR gRNA sequence
aattgggaaggctggcttct

SEQ ID NO: 36583 - DNA, 20 bp, Artificial
  CRISPR gRNA sequence
tgggaaggctggcttctggg

SEQ ID NO: 36584 - DNA, 20 bp, Artificial
  CRISPR gRNA sequence
ggtggacctcctactctttt

SEQ ID NO: 36585 - DNA, 20 bp, Artificial
  CRISPR gRNA sequence
tggacctcctactcttttca

SEQ ID NO: 36586 - DNA, 20 bp, Artificial
  CRISPR gRNA sequence
cctcctactcttttcagagt

SEQ ID NO: 36587 - DNA, 20 bp, Artificial
  CRISPR gRNA sequence
tcctactcttttcagagtta

SEQ ID NO: 36588 - DNA, 20 bp, Artificial
  CRISPR gRNA sequence
cctactcttttcagagttag

SEQ ID NO: 36589 - DNA, 20 bp, Artificial
  CRISPR gRNA sequence
actcttttcagagttagagg

SEQ ID NO: 36590 - DNA, 20 bp, Artificial
  CRISPR gRNA sequence
agagttagaggtggactctc

SEQ ID NO: 36591 - DNA, 20 bp, Artificial
  CRISPR gRNA sequence
agttagaggtggactctctg

SEQ ID NO: 36592 - DNA, 20 bp, Artificial
  CRISPR gRNA sequence
ggtggactctctggagttgt

SEQ ID NO: 36593 - DNA, 20 bp, Artificial
  CRISPR gRNA sequence
gtggactctctggagttgtg

SEQ ID NO: 36594 - DNA, 20 bp, Artificial
  CRISPR gRNA sequence
tggagttgtgaggataaaat

SEQ ID NO: 36595 - DNA, 20 bp, Artificial
  CRISPR gRNA sequence
ggagttgtgaggataaaata

SEQ ID NO: 36596 - DNA, 20 bp, Artificial
  CRISPR gRNA sequence
aggataaaataaggtatata

SEQ ID NO: 36597 - DNA, 20 bp, Artificial
  CRISPR gRNA sequence
aataaggtatataaagcact

SEQ ID NO: 36598 - DNA, 20 bp, Artificial
  CRISPR gRNA sequence
aggtatataaagcacttaga

SEQ ID NO: 36599 - DNA, 20 bp, Artificial
  CRISPR gRNA sequence
cttagacagtgcctaataca

SEQ ID NO: 36600 - DNA, 20 bp, Artificial
  CRISPR gRNA sequence
gacagtgcctaatacacagt

SEQ ID NO: 36601 - DNA, 20 bp, Artificial
  CRISPR gRNA sequence
atacacagtgagtgctttcc

SEQ ID NO: 36602 - DNA, 20 bp, Artificial
  CRISPR gRNA sequence
ttccaagtgtgtactgctat

SEQ ID NO: 36603 - DNA, 20 bp, Artificial
  CRISPR gRNA sequence
tccaagtgtgtactgctatg

SEQ ID NO: 36604 - DNA, 20 bp, Artificial
  CRISPR gRNA sequence
aagtgtgtactgctatgagg

SEQ ID NO: 36605 - DNA, 20 bp, Artificial
  CRISPR gRNA sequence
agtgtgtactgctatgagga

SEQ ID NO: 36606 - DNA, 20 bp, Artificial
  CRISPR gRNA sequence
tactgctatgaggaaggaca

SEQ ID NO: 36607 - DNA, 20 bp, Artificial
  CRISPR gRNA sequence
tatgaggaaggacatagtac

SEQ ID NO: 36608 - DNA, 20 bp, Artificial
  CRISPR gRNA sequence
aggaaggacatagtaccaga

SEQ ID NO: 36609 - DNA, 20 bp, Artificial
  CRISPR gRNA sequence
atagtaccagaaagtacatc

SEQ ID NO: 36610 - DNA, 20 bp, Artificial
  CRISPR gRNA sequence
aagtacatccggaaatgtga

SEQ ID NO: 36611 - DNA, 20 bp, Artificial
  CRISPR gRNA sequence
catccggaaatgtgatagca

SEQ ID NO: 36612 - DNA, 20 bp, Artificial
  CRISPR gRNA sequence
aatgtgatagcatagtccac

SEQ ID NO: 36613 - DNA, 20 bp, Artificial
  CRISPR gRNA sequence
tagcatagtccactagatga

SEQ ID NO: 36614 - DNA, 20 bp, Artificial
  CRISPR gRNA sequence
ctagatgatggaccaccatt

SEQ ID NO: 36615 - DNA, 20 bp, Artificial
  CRISPR gRNA sequence
atgatggaccaccatttagt

SEQ ID NO: 36616 - DNA, 20 bp, Artificial
  CRISPR gRNA sequence
gttggccaatccccaactgt

SEQ ID NO: 36617 - DNA, 20 bp, Artificial
  CRISPR gRNA sequence
atccccaactgttggacatt

SEQ ID NO: 36618 - DNA, 20 bp, Artificial
  CRISPR gRNA sequence
tccccaactgttggacattt

SEQ ID NO: 36619 - DNA, 20 bp, Artificial
  CRISPR gRNA sequence
aataattataaataatcttg

SEQ ID NO: 36620 - DNA, 20 bp, Artificial
  CRISPR gRNA sequence
attataaataatcttgcagt

SEQ ID NO: 36621 - DNA, 20 bp, Artificial
  CRISPR gRNA sequence
tacgttcatgatcgtttgcc

SEQ ID NO: 36622 - DNA, 20 bp, Artificial
  CRISPR gRNA sequence
acgttcatgatcgtttgcca

SEQ ID NO: 36623 - DNA, 20 bp, Artificial
  CRISPR gRNA sequence
tcatgatcgtttgccaaggt

SEQ ID NO: 36624 - DNA, 20 bp, Artificial
  CRISPR gRNA sequence
atgatcgtttgccaaggtta

SEQ ID NO: 36625 - DNA, 20 bp, Artificial
  CRISPR gRNA sequence
gtttgccaaggttagagtcc

SEQ ID NO: 36626 - DNA, 20 bp, Artificial
  CRISPR gRNA sequence
caaggttagagtcctagaaa

SEQ ID NO: 36627 - DNA, 20 bp, Artificial
  CRISPR gRNA sequence
gaaatggaattactgaatca

SEQ ID NO: 36628 - DNA, 20 bp, Artificial
  CRISPR gRNA sequence
aaatggaattactgaatcaa

SEQ ID NO: 36629 - DNA, 20 bp, Artificial
  CRISPR gRNA sequence
caaaggaactgcacattatt

SEQ ID NO: 36630 - DNA, 20 bp, Artificial
  CRISPR gRNA sequence
aaaggaactgcacattattt

SEQ ID NO: 36631 - DNA, 20 bp, Artificial
  CRISPR gRNA sequence
aaatgccccgtgccctctat

SEQ ID NO: 36632 - DNA, 20 bp, Artificial
  CRISPR gRNA sequence
gtgccctctattggtacttc

SEQ ID NO: 36633 - DNA, 20 bp, Artificial
  CRISPR gRNA sequence
ccctctattggtacttctag

SEQ ID NO: 36634 - DNA, 20 bp, Artificial
  CRISPR gRNA sequence
cctctattggtacttctaga

SEQ ID NO: 36635 - DNA, 20 bp, Artificial
  CRISPR gRNA sequence
tctattggtacttctagaag

SEQ ID NO: 36636 - DNA, 20 bp, Artificial
  CRISPR gRNA sequence
ctattggtacttctagaagg

SEQ ID NO: 36637 - DNA, 20 bp, Artificial
  CRISPR gRNA sequence
ttggtacttctagaaggagg

SEQ ID NO: 36638 - DNA, 20 bp, Artificial
  CRISPR gRNA sequence
cttctagaaggaggtggttt

SEQ ID NO: 36639 - DNA, 20 bp, Artificial
  CRISPR gRNA sequence
tctagaaggaggtggtttaa

SEQ ID NO: 36640 - DNA, 20 bp, Artificial
  CRISPR gRNA sequence
aggaggtggtttaagagttc

SEQ ID NO: 36641 - DNA, 20 bp, Artificial
  CRISPR gRNA sequence
gtggtttaagagttccagtt

SEQ ID NO: 36642 - DNA, 20 bp, Artificial
  CRISPR gRNA sequence
ttccagttcggccatcatga

SEQ ID NO: 36643 - DNA, 20 bp, Artificial
  CRISPR gRNA sequence
atggctcacacctgtaatcc

SEQ ID NO: 36644 - DNA, 20 bp, Artificial
  CRISPR gRNA sequence
cacctgtaatcccagcactt

SEQ ID NO: 36645 - DNA, 20 bp, Artificial
  CRISPR gRNA sequence
acctgtaatcccagcacttt

SEQ ID NO: 36646 - DNA, 20 bp, Artificial
  CRISPR gRNA sequence
ctgtaatcccagcactttgg

SEQ ID NO: 36647 - DNA, 20 bp, Artificial
  CRISPR gRNA sequence
tgtaatcccagcactttggg

SEQ ID NO: 36648 - DNA, 20 bp, Artificial
  CRISPR gRNA sequence
tcccagcactttgggaggcc

SEQ ID NO: 36649 - DNA, 20 bp, Artificial
  CRISPR gRNA sequence
cccagcactttgggaggccg

SEQ ID NO: 36650 - DNA, 20 bp, Artificial
  CRISPR gRNA sequence
agcactttgggaggccgagg

SEQ ID NO: 36651 - DNA, 20 bp, Artificial
  CRISPR gRNA sequence
gcactttgggaggccgaggt

SEQ ID NO: 36652 - DNA, 20 bp, Artificial
  CRISPR gRNA sequence
ctttgggaggccgaggtggg

SEQ ID NO: 36653 - DNA, 20 bp, Artificial
  CRISPR gRNA sequence
cgaggtgggcagatcaccct

SEQ ID NO: 36654 - DNA, 20 bp, Artificial
  CRISPR gRNA sequence
gaggtgggcagatcaccctg

SEQ ID NO: 36655 - DNA, 20 bp, Artificial
  CRISPR gRNA sequence
tgggcagatcaccctgaggt

SEQ ID NO: 36656 - DNA, 20 bp, Artificial
  CRISPR gRNA sequence
gggcagatcaccctgaggtc

SEQ ID NO: 36657 - DNA, 20 bp, Artificial
  CRISPR gRNA sequence
gcagatcaccctgaggtcag

SEQ ID NO: 36658 - DNA, 20 bp, Artificial
  CRISPR gRNA sequence
caccctgaggtcaggagttt

SEQ ID NO: 36659 - DNA, 20 bp, Artificial
  CRISPR gRNA sequence
tgaggtcaggagtttgagcc

SEQ ID NO: 36660 - DNA, 20 bp, Artificial
  CRISPR gRNA sequence
tcaggagtttgagcccagcc

SEQ ID NO: 36661 - DNA, 20 bp, Artificial
  CRISPR gRNA sequence
tgagcccagcctggccaaca

SEQ ID NO: 36662 - DNA, 20 bp, Artificial
  CRISPR gRNA sequence
gtactaaaaattacaaaaat

SEQ ID NO: 36663 - DNA, 20 bp, Artificial
  CRISPR gRNA sequence
taaaaattacaaaaattagc

SEQ ID NO: 36664 - DNA, 20 bp, Artificial
  CRISPR gRNA sequence
aaaaattacaaaaattagct

SEQ ID NO: 36665 - DNA, 20 bp, Artificial
  CRISPR gRNA sequence
caaaaattagctgggcattg

SEQ ID NO: 36666 - DNA, 20 bp, Artificial
  CRISPR gRNA sequence
gtggtgtgcacctgtaatcc

SEQ ID NO: 36667 - DNA, 20 bp, Artificial
  CRISPR gRNA sequence
cacctgtaatcccagctact

SEQ ID NO: 36668 - DNA, 20 bp, Artificial
  CRISPR gRNA sequence
acctgtaatcccagctactc

SEQ ID NO: 36669 - DNA, 20 bp, Artificial
  CRISPR gRNA sequence
ctgtaatcccagctactcgg

SEQ ID NO: 36670 - DNA, 20 bp, Artificial
  CRISPR gRNA sequence
tgtaatcccagctactcggg

SEQ ID NO: 36671 - DNA, 20 bp, Artificial
  CRISPR gRNA sequence
tcccagctactcgggaggct

SEQ ID NO: 36672 - DNA, 20 bp, Artificial
  CRISPR gRNA sequence
cccagctactcgggaggctg

SEQ ID NO: 36673 - DNA, 20 bp, Artificial
  CRISPR gRNA sequence
agctactcgggaggctgagg

SEQ ID NO: 36674 - DNA, 20 bp, Artificial
  CRISPR gRNA sequence
tactcgggaggctgaggcag

SEQ ID NO: 36675 - DNA, 20 bp, Artificial
  CRISPR gRNA sequence
gcagaagaatcgcttgaacc

SEQ ID NO: 36676 - DNA, 20 bp, Artificial
  CRISPR gRNA sequence
cagaagaatcgcttgaaccc

SEQ ID NO: 36677 - DNA, 20 bp, Artificial
  CRISPR gRNA sequence
gaagaatcgcttgaacccgg

SEQ ID NO: 36678 - DNA, 20 bp, Artificial
  CRISPR gRNA sequence
aagaatcgcttgaacccggg

SEQ ID NO: 36679 - DNA, 20 bp, Artificial
  CRISPR gRNA sequence
aatcgcttgaacccgggagg

SEQ ID NO: 36680 - DNA, 20 bp, Artificial
  CRISPR gRNA sequence
tcgcttgaacccgggaggcg

SEQ ID NO: 36681 - DNA, 20 bp, Artificial
  CRISPR gRNA sequence
cgcttgaacccgggaggcgg

SEQ ID NO: 36682 - DNA, 20 bp, Artificial
  CRISPR gRNA sequence
aacccgggaggcggaggctg

SEQ ID NO: 36683 - DNA, 20 bp, Artificial
  CRISPR gRNA sequence
cgggaggcggaggctgcagt

SEQ ID NO: 36684 - DNA, 20 bp, Artificial
  CRISPR gRNA sequence
ggcggaggctgcagtgagcc

SEQ ID NO: 36685 - DNA, 20 bp, Artificial
  CRISPR gRNA sequence
gagattgcaccattgcactc

SEQ ID NO: 36686 - DNA, 20 bp, Artificial
  CRISPR gRNA sequence
tgcaccattgcactccagcc

SEQ ID NO: 36687 - DNA, 20 bp, Artificial
  CRISPR gRNA sequence
gcaccattgcactccagcct

SEQ ID NO: 36688 - DNA, 20 bp, Artificial
  CRISPR gRNA sequence
ttgcactccagcctgggtga

SEQ ID NO: 36689 - DNA, 20 bp, Artificial
  CRISPR gRNA sequence
gcactccagcctgggtgaca

SEQ ID NO: 36690 - DNA, 20 bp, Artificial
  CRISPR gRNA sequence
tccagcctgggtgacagagc

SEQ ID NO: 36691 - DNA, 20 bp, Artificial
  CRISPR gRNA sequence
agactctgtctcaaaaaaaa

SEQ ID NO: 36692 - DNA, 20 bp, Artificial
  CRISPR gRNA sequence
actctgtctcaaaaaaaaaa

SEQ ID NO: 36693 - DNA, 20 bp, Artificial
  CRISPR gRNA sequence
tctcaaaaaaaaaagagttc

SEQ ID NO: 36694 - DNA, 20 bp, Artificial
  CRISPR gRNA sequence
aaaaaaaaagagttccagtt

SEQ ID NO: 36695 - DNA, 20 bp, Artificial
  CRISPR gRNA sequence
aaaaaagagttccagttcag

SEQ ID NO: 36696 - DNA, 20 bp, Artificial
  CRISPR gRNA sequence
aaaaagagttccagttcaga

SEQ ID NO: 36697 - DNA, 20 bp, Artificial
  CRISPR gRNA sequence
aaaagagttccagttcagaa

SEQ ID NO: 36698 - DNA, 20 bp, Artificial
  CRISPR gRNA sequence
agagttccagttcagaaggg

SEQ ID NO: 36699 - DNA, 20 bp, Artificial
  CRISPR gRNA sequence
tcagaagggaagaatttgct

SEQ ID NO: 36700 - DNA, 20 bp, Artificial
  CRISPR gRNA sequence
gggaagaatttgcttagcaa

SEQ ID NO: 36701 - DNA, 20 bp, Artificial
  CRISPR gRNA sequence
gaagaatttgcttagcaaaa

SEQ ID NO: 36702 - DNA, 20 bp, Artificial
  CRISPR gRNA sequence
aagaatttgcttagcaaaag

SEQ ID NO: 36703 - DNA, 20 bp, Artificial
  CRISPR gRNA sequence
ttgcttagcaaaagaggtga

SEQ ID NO: 36704 - DNA, 20 bp, Artificial
  CRISPR gRNA sequence
aaagaggtgatggtctgtgt

SEQ ID NO: 36705 - DNA, 20 bp, Artificial
  CRISPR gRNA sequence
aggtgatggtctgtgttagc

SEQ ID NO: 36706 - DNA, 20 bp, Artificial
  CRISPR gRNA sequence
ggtgatggtctgtgttagct

SEQ ID NO: 36707 - DNA, 20 bp, Artificial
  CRISPR gRNA sequence
tggtctgtgttagctaggat

SEQ ID NO: 36708 - DNA, 20 bp, Artificial
  CRISPR gRNA sequence
gtctgtgttagctaggatta

SEQ ID NO: 36709 - DNA, 20 bp, Artificial
  CRISPR gRNA sequence
ctaggattagagttcactgt

SEQ ID NO: 36710 - DNA, 20 bp, Artificial
  CRISPR gRNA sequence
ggattagagttcactgtgag

SEQ ID NO: 36711 - DNA, 20 bp, Artificial
  CRISPR gRNA sequence
ttagagttcactgtgagtag

SEQ ID NO: 36712 - DNA, 20 bp, Artificial
  CRISPR gRNA sequence
agttcactgtgagtagcaga

SEQ ID NO: 36713 - DNA, 20 bp, Artificial
  CRISPR gRNA sequence
tagcagaaagcactaaacaa

SEQ ID NO: 36714 - DNA, 20 bp, Artificial
  CRISPR gRNA sequence
cagaaagcactaaacaacag

SEQ ID NO: 36715 - DNA, 20 bp, Artificial
  CRISPR gRNA sequence
ctaaacaacagtggcttaac

SEQ ID NO: 36716 - DNA, 20 bp, Artificial
  CRISPR gRNA sequence
caacagtggcttaaccagaa

SEQ ID NO: 36717 - DNA, 20 bp, Artificial
  CRISPR gRNA sequence
cagtggcttaaccagaatgg

SEQ ID NO: 36718 - DNA, 20 bp, Artificial
  CRISPR gRNA sequence
tgtatttccctgccatgtaa

SEQ ID NO: 36719 - DNA, 20 bp, Artificial
  CRISPR gRNA sequence
atttccctgccatgtaacag

SEQ ID NO: 36720 - DNA, 20 bp, Artificial
  CRISPR gRNA sequence
tgccatgtaacagaagtcca

SEQ ID NO: 36721 - DNA, 20 bp, Artificial
  CRISPR gRNA sequence
atgtaacagaagtccaaagt

SEQ ID NO: 36722 - DNA, 20 bp, Artificial
  CRISPR gRNA sequence
aacagaagtccaaagtcagt

SEQ ID NO: 36723 - DNA, 20 bp, Artificial
  CRISPR gRNA sequence
aagtccaaagtcagtgagca

SEQ ID NO: 36724 - DNA, 20 bp, Artificial
  CRISPR gRNA sequence
agtccaaagtcagtgagcac

SEQ ID NO: 36725 - DNA, 20 bp, Artificial
  CRISPR gRNA sequence
gtccaaagtcagtgagcaca

SEQ ID NO: 36726 - DNA, 20 bp, Artificial
  CRISPR gRNA sequence
caaagtcagtgagcacaggg

SEQ ID NO: 36727 - DNA, 20 bp, Artificial
  CRISPR gRNA sequence
gtcagtgagcacagggcaga

SEQ ID NO: 36728 - DNA, 20 bp, Artificial
  CRISPR gRNA sequence
tcagtgagcacagggcagat

SEQ ID NO: 36729 - DNA, 20 bp, Artificial
  CRISPR gRNA sequence
gtgagcacagggcagatggg

SEQ ID NO: 36730 - DNA, 20 bp, Artificial
  CRISPR gRNA sequence
gctttaccttccaccttcct

SEQ ID NO: 36731 - DNA, 20 bp, Artificial
  CRISPR gRNA sequence
accttccaccttcctcagta

SEQ ID NO: 36732 - DNA, 20 bp, Artificial
  CRISPR gRNA sequence
ccttccaccttcctcagtat

SEQ ID NO: 36733 - DNA, 20 bp, Artificial
  CRISPR gRNA sequence
ttccacctcatgattcaata

SEQ ID NO: 36734 - DNA, 20 bp, Artificial
  CRISPR gRNA sequence
atgattcaatatggctgccc

SEQ ID NO: 36735 - DNA, 20 bp, Artificial
  CRISPR gRNA sequence
caatatggctgcccaagatc

SEQ ID NO: 36736 - DNA, 20 bp, Artificial
  CRISPR gRNA sequence
cagccatcccatcaacaatc

SEQ ID NO: 36737 - DNA, 20 bp, Artificial
  CRISPR gRNA sequence
cccatcaacaatccagacaa

SEQ ID NO: 36738 - DNA, 20 bp, Artificial
  CRISPR gRNA sequence
ccatcaacaatccagacaac

SEQ ID NO: 36739 - DNA, 20 bp, Artificial
  CRISPR gRNA sequence
tcaacaatccagacaacagg

SEQ ID NO: 36740 - DNA, 20 bp, Artificial
  CRISPR gRNA sequence
caacaatccagacaacagga

SEQ ID NO: 36741 - DNA, 20 bp, Artificial
  CRISPR gRNA sequence
acaatccagacaacaggaag

SEQ ID NO: 36742 - DNA, 20 bp, Artificial
  CRISPR gRNA sequence
ccagacaacaggaaggagca

SEQ ID NO: 36743 - DNA, 20 bp, Artificial
  CRISPR gRNA sequence
gacaacaggaaggagcaaag

SEQ ID NO: 36744 - DNA, 20 bp, Artificial
  CRISPR gRNA sequence
caggaaggagcaaagaagaa

SEQ ID NO: 36745 - DNA, 20 bp, Artificial
  CRISPR gRNA sequence
catttctacttacattccac

SEQ ID NO: 36746 - DNA, 20 bp, Artificial
  CRISPR gRNA sequence
attccactggccaaattaca

SEQ ID NO: 36747 - DNA, 20 bp, Artificial
  CRISPR gRNA sequence
acatggctacatataactgc

SEQ ID NO: 36748 - DNA, 20 bp, Artificial
  CRISPR gRNA sequence
catggctacatataactgca

SEQ ID NO: 36749 - DNA, 20 bp, Artificial
  CRISPR gRNA sequence
atggctacatataactgcaa

SEQ ID NO: 36750 - DNA, 20 bp, Artificial
  CRISPR gRNA sequence
ggctacatataactgcaagg

SEQ ID NO: 36751 - DNA, 20 bp, Artificial
  CRISPR gRNA sequence
catataactgcaagggagac

SEQ ID NO: 36752 - DNA, 20 bp, Artificial
  CRISPR gRNA sequence
atataactgcaagggagact

SEQ ID NO: 36753 - DNA, 20 bp, Artificial
  CRISPR gRNA sequence
tgggatataataatctattc

SEQ ID NO: 36754 - DNA, 20 bp, Artificial
  CRISPR gRNA sequence
aataatctattctagatgac

SEQ ID NO: 36755 - DNA, 20 bp, Artificial
  CRISPR gRNA sequence
taatctattctagatgacca

SEQ ID NO: 36756 - DNA, 20 bp, Artificial
  CRISPR gRNA sequence
ctagatgaccagagaatatt

SEQ ID NO: 36757 - DNA, 20 bp, Artificial
  CRISPR gRNA sequence
gatgaccagagaatatttag

SEQ ID NO: 36758 - DNA, 20 bp, Artificial
  CRISPR gRNA sequence
tatttagtagttctaatact

SEQ ID NO: 36759 - DNA, 20 bp, Artificial
  CRISPR gRNA sequence
atttagtagttctaatactg

SEQ ID NO: 36760 - DNA, 20 bp, Artificial
  CRISPR gRNA sequence
tagtagttctaatactgagg

SEQ ID NO: 36761 - DNA, 20 bp, Artificial
  CRISPR gRNA sequence
tagttctaatactgaggaag

SEQ ID NO: 36762 - DNA, 20 bp, Artificial
  CRISPR gRNA sequence
agttctaatactgaggaaga

SEQ ID NO: 36763 - DNA, 20 bp, Artificial
  CRISPR gRNA sequence
gttctaatactgaggaagaa

SEQ ID NO: 36764 - DNA, 20 bp, Artificial
  CRISPR gRNA sequence
ctaatactgaggaagaaggg

SEQ ID NO: 36765 - DNA, 20 bp, Artificial
  CRISPR gRNA sequence
actgaggaagaagggaagaa

SEQ ID NO: 36766 - DNA, 20 bp, Artificial
  CRISPR gRNA sequence
aagaagggaagaacagattt

SEQ ID NO: 36767 - DNA, 20 bp, Artificial
  CRISPR gRNA sequence
agaagggaagaacagatttt

SEQ ID NO: 36768 - DNA, 20 bp, Artificial
  CRISPR gRNA sequence
aagggaagaacagattttgg

SEQ ID NO: 36769 - DNA, 20 bp, Artificial
  CRISPR gRNA sequence
aacagattttgggagacaac

SEQ ID NO: 36770 - DNA, 20 bp, Artificial
  CRISPR gRNA sequence
caactagttgtctctgccat

SEQ ID NO: 36771 - DNA, 20 bp, Artificial
  CRISPR gRNA sequence
aactagttgtctctgccatg

SEQ ID NO: 36772 - DNA, 20 bp, Artificial
  CRISPR gRNA sequence
agttgtctctgccatgaggt

SEQ ID NO: 36773 - DNA, 20 bp, Artificial
  CRISPR gRNA sequence
tctctgccatgaggttagct

SEQ ID NO: 36774 - DNA, 20 bp, Artificial
  CRISPR gRNA sequence
ccatgaggttagctcagact

SEQ ID NO: 36775 - DNA, 20 bp, Artificial
  CRISPR gRNA sequence
atgaggttagctcagactga

SEQ ID NO: 36776 - DNA, 20 bp, Artificial
  CRISPR gRNA sequence
aggttagctcagactgagag

SEQ ID NO: 36777 - DNA, 20 bp, Artificial
  CRISPR gRNA sequence
cagactgagagcagcataaa

SEQ ID NO: 36778 - DNA, 20 bp, Artificial
  CRISPR gRNA sequence
agagcagcataaatggttca

SEQ ID NO: 36779 - DNA, 20 bp, Artificial
  CRISPR gRNA sequence
cataaatggttcatggaaat

SEQ ID NO: 36780 - DNA, 20 bp, Artificial
  CRISPR gRNA sequence
tggttcatggaaataagaat

SEQ ID NO: 36781 - DNA, 20 bp, Artificial
  CRISPR gRNA sequence
gaatgagtaatgcatcctca

SEQ ID NO: 36782 - DNA, 20 bp, Artificial
  CRISPR gRNA sequence
aatgagtaatgcatcctcac

SEQ ID NO: 36783 - DNA, 20 bp, Artificial
  CRISPR gRNA sequence
catcctcacgggactgtcca

SEQ ID NO: 36784 - DNA, 20 bp, Artificial
  CRISPR gRNA sequence
atcctcacgggactgtccac

SEQ ID NO: 36785 - DNA, 20 bp, Artificial
  CRISPR gRNA sequence
tcctcacgggactgtccaca

SEQ ID NO: 36786 - DNA, 20 bp, Artificial
  CRISPR gRNA sequence
cctcacgggactgtccacag

SEQ ID NO: 36787 - DNA, 20 bp, Artificial
  CRISPR gRNA sequence
actgtccacaggggatgaac

SEQ ID NO: 36788 - DNA, 20 bp, Artificial
  CRISPR gRNA sequence
ggggatgaacaagaccattc

SEQ ID NO: 36789 - DNA, 20 bp, Artificial
  CRISPR gRNA sequence
ggatgaacaagaccattcca

SEQ ID NO: 36790 - DNA, 20 bp, Artificial
  CRISPR gRNA sequence
atgaacaagaccattccaga

SEQ ID NO: 36791 - DNA, 20 bp, Artificial
  CRISPR gRNA sequence
acaagaccattccagagagc

SEQ ID NO: 36792 - DNA, 20 bp, Artificial
  CRISPR gRNA sequence
caagaccattccagagagcc

SEQ ID NO: 36793 - DNA, 20 bp, Artificial
  CRISPR gRNA sequence
aagaccattccagagagcca

SEQ ID NO: 36794 - DNA, 20 bp, Artificial
  CRISPR gRNA sequence
cattccagagagccagggtg

SEQ ID NO: 36795 - DNA, 20 bp, Artificial
  CRISPR gRNA sequence
attccagagagccagggtgc

SEQ ID NO: 36796 - DNA, 20 bp, Artificial
  CRISPR gRNA sequence
agccagggtgcaggcacaaa

SEQ ID NO: 36797 - DNA, 20 bp, Artificial
  CRISPR gRNA sequence
ccagggtgcaggcacaaatg

SEQ ID NO: 36798 - DNA, 20 bp, Artificial
  CRISPR gRNA sequence
gggtgcaggcacaaatggag

SEQ ID NO: 36799 - DNA, 20 bp, Artificial
  CRISPR gRNA sequence
ggtgcaggcacaaatggagt

SEQ ID NO: 36800 - DNA, 20 bp, Artificial
  CRISPR gRNA sequence
gtgcaggcacaaatggagta

SEQ ID NO: 36801 - DNA, 20 bp, Artificial
  CRISPR gRNA sequence
gcaggcacaaatggagtagg

SEQ ID NO: 36802 - DNA, 20 bp, Artificial
  CRISPR gRNA sequence
caggcacaaatggagtaggg

SEQ ID NO: 36803 - DNA, 20 bp, Artificial
  CRISPR gRNA sequence
aggcacaaatggagtaggga

SEQ ID NO: 36804 - DNA, 20 bp, Artificial
  CRISPR gRNA sequence
ggcacaaatggagtagggag

SEQ ID NO: 36805 - DNA, 20 bp, Artificial
  CRISPR gRNA sequence
gcacaaatggagtagggagg

SEQ ID NO: 36806 - DNA, 20 bp, Artificial
  CRISPR gRNA sequence
aatggagtagggagggggtg

SEQ ID NO: 36807 - DNA, 20 bp, Artificial
  CRISPR gRNA sequence
ggagtagggagggggtgcag

SEQ ID NO: 36808 - DNA, 20 bp, Artificial
  CRISPR gRNA sequence
gggagggggtgcagaagaaa

SEQ ID NO: 36809 - DNA, 20 bp, Artificial
  CRISPR gRNA sequence
agaagaaacagactgatctc

SEQ ID NO: 36810 - DNA, 20 bp, Artificial
  CRISPR gRNA sequence
aagaaacagactgatctctg

SEQ ID NO: 36811 - DNA, 20 bp, Artificial
  CRISPR gRNA sequence
tgatctctggagctgatccc

SEQ ID NO: 36812 - DNA, 20 bp, Artificial
  CRISPR gRNA sequence
gatctctggagctgatccct

SEQ ID NO: 36813 - DNA, 20 bp, Artificial
  CRISPR gRNA sequence
ctctggagctgatccctggg

SEQ ID NO: 36814 - DNA, 20 bp, Artificial
  CRISPR gRNA sequence
ctggagctgatccctgggca

SEQ ID NO: 36815 - DNA, 20 bp, Artificial
  CRISPR gRNA sequence
gatccctgggcagagacatc

SEQ ID NO: 36816 - DNA, 20 bp, Artificial
  CRISPR gRNA sequence
gcagagacatcaagactcca

SEQ ID NO: 36817 - DNA, 20 bp, Artificial
  CRISPR gRNA sequence
agagacatcaagactccatg

SEQ ID NO: 36818 - DNA, 20 bp, Artificial
  CRISPR gRNA sequence
agacatcaagactccatgga

SEQ ID NO: 36819 - DNA, 20 bp, Artificial
  CRISPR gRNA sequence
gacatcaagactccatggag

SEQ ID NO: 36820 - DNA, 20 bp, Artificial
  CRISPR gRNA sequence
tattttatgtcgctcaaatg

SEQ ID NO: 36821 - DNA, 20 bp, Artificial
  CRISPR gRNA sequence
attttatgtcgctcaaatgt

SEQ ID NO: 36822 - DNA, 20 bp, Artificial
  CRISPR gRNA sequence
ttttatgtcgctcaaatgta

SEQ ID NO: 36823 - DNA, 20 bp, Artificial
  CRISPR gRNA sequence
tgtcgctcaaatgtagggac

SEQ ID NO: 36824 - DNA, 20 bp, Artificial
  CRISPR gRNA sequence
tcttgactgcttgacttccc

SEQ ID NO: 36825 - DNA, 20 bp, Artificial
  CRISPR gRNA sequence
atcccccaactcaccttccc

SEQ ID NO: 36826 - DNA, 20 bp, Artificial
  CRISPR gRNA sequence
tccccagatcaccttccccc

SEQ ID NO: 36827 - DNA, 20 bp, Artificial
  CRISPR gRNA sequence
gtaccccactcacctgccct

SEQ ID NO: 36828 - DNA, 20 bp, Artificial
  CRISPR gRNA sequence
taccccactcacctgccctc

SEQ ID NO: 36829 - DNA, 20 bp, Artificial
  CRISPR gRNA sequence
tctccatctaatcttcctcc

SEQ ID NO: 36830 - DNA, 20 bp, Artificial
  CRISPR gRNA sequence
cccccaatttgcttgtcctc

SEQ ID NO: 36831 - DNA, 20 bp, Artificial
  CRISPR gRNA sequence
ttgcttgtcctccagctcac

SEQ ID NO: 36832 - DNA, 20 bp, Artificial
  CRISPR gRNA sequence
cctccagctcaccggttccc

SEQ ID NO: 36833 - DNA, 20 bp, Artificial
  CRISPR gRNA sequence
tccccagctcatcttccttc

SEQ ID NO: 36834 - DNA, 20 bp, Artificial
  CRISPR gRNA sequence
cttccagttcccctgtcccc

SEQ ID NO: 36835 - DNA, 20 bp, Artificial
  CRISPR gRNA sequence
ccagctcacctgcctgccct

SEQ ID NO: 36836 - DNA, 20 bp, Artificial
  CRISPR gRNA sequence
ccctcagttcacctgtcccc

SEQ ID NO: 36837 - DNA, 20 bp, Artificial
  CRISPR gRNA sequence
cccccagttcatcttcctcc

SEQ ID NO: 36838 - DNA, 20 bp, Artificial
  CRISPR gRNA sequence
ctcctagctcccctgtcccc

SEQ ID NO: 36839 - DNA, 20 bp, Artificial
  CRISPR gRNA sequence
cccctagctcacctgtgccc

SEQ ID NO: 36840 - DNA, 20 bp, Artificial
  CRISPR gRNA sequence
gccccagctcccctgtcccc

SEQ ID NO: 36841 - DNA, 20 bp, Artificial
  CRISPR gRNA sequence
cccccagttcccctgtcccc

SEQ ID NO: 36842 - DNA, 20 bp, Artificial
  CRISPR gRNA sequence
cccccagctcacctccccct

SEQ ID NO: 36843 - DNA, 20 bp, Artificial
  CRISPR gRNA sequence
ccctcagctctcctgtcccc

SEQ ID NO: 36844 - DNA, 20 bp, Artificial
  CRISPR gRNA sequence
tcccccagctcatctgcccc

SEQ ID NO: 36845 - DNA, 20 bp, Artificial
  CRISPR gRNA sequence
cccccagtttacctgtcccc

SEQ ID NO: 36846 - DNA, 20 bp, Artificial
  CRISPR gRNA sequence
cccctagctcacctcccccc

SEQ ID NO: 36847 - DNA, 20 bp, Artificial
  CRISPR gRNA sequence
cccccagtttacctgtcccc

SEQ ID NO: 36848 - DNA, 20 bp, Artificial
  CRISPR gRNA sequence
tcccccagctcacctccccc

SEQ ID NO: 36849 - DNA, 20 bp, Artificial
  CRISPR gRNA sequence
cccccagtttgcctgtcccc

SEQ ID NO: 36850 - DNA, 20 bp, Artificial
  CRISPR gRNA sequence
cccccagctcaactcccccc

SEQ ID NO: 36851 - DNA, 20 bp, Artificial
  CRISPR gRNA sequence
ccccaagttcccctgtccct

SEQ ID NO: 36852 - DNA, 20 bp, Artificial
  CRISPR gRNA sequence
tccctcagctcatctgcccc

SEQ ID NO: 36853 - DNA, 20 bp, Artificial
  CRISPR gRNA sequence
acctatcttccctgtccctc

SEQ ID NO: 36854 - DNA, 20 bp, Artificial
  CRISPR gRNA sequence
cctatcttccctgtccctcc

SEQ ID NO: 36855 - DNA, 20 bp, Artificial
  CRISPR gRNA sequence
ctatcttccctgtccctcca

SEQ ID NO: 36856 - DNA, 20 bp, Artificial
  CRISPR gRNA sequence
cttccctgtccctccagggc

SEQ ID NO: 36857 - DNA, 20 bp, Artificial
  CRISPR gRNA sequence
cctccagggctggctcctca

SEQ ID NO: 36858 - DNA, 20 bp, Artificial
  CRISPR gRNA sequence
tggctcctcatggaccccgt

SEQ ID NO: 36859 - DNA, 20 bp, Artificial
  CRISPR gRNA sequence
tcatggaccccgttggcctc

SEQ ID NO: 36860 - DNA, 20 bp, Artificial
  CRISPR gRNA sequence
gaccccgttggcctccagct

SEQ ID NO: 36861 - DNA, 20 bp, Artificial
  CRISPR gRNA sequence
ttggcctccagctcggcaac

SEQ ID NO: 36862 - DNA, 20 bp, Artificial
  CRISPR gRNA sequence
agctcggcaacaagaacctg

SEQ ID NO: 36863 - DNA, 20 bp, Artificial
  CRISPR gRNA sequence
ctcggcaacaagaacctgtg

SEQ ID NO: 36864 - DNA, 20 bp, Artificial
  CRISPR gRNA sequence
aacctgtggagctgtcttgt

SEQ ID NO: 36865 - DNA, 20 bp, Artificial
  CRISPR gRNA sequence
acctgtggagctgtcttgtg

SEQ ID NO: 36866 - DNA, 20 bp, Artificial
  CRISPR gRNA sequence
tcttgtgaggctgctcacca

SEQ ID NO: 36867 - DNA, 20 bp, Artificial
  CRISPR gRNA sequence
gaggctgctcaccaaagacc

SEQ ID NO: 36868 - DNA, 20 bp, Artificial
  CRISPR gRNA sequence
tgctcaccaaagacccagaa

SEQ ID NO: 36869 - DNA, 20 bp, Artificial
  CRISPR gRNA sequence
acccagaatggctgaacgcc

SEQ ID NO: 36870 - DNA, 20 bp, Artificial
  CRISPR gRNA sequence
aatggctgaacgccaagatg

SEQ ID NO: 36871 - DNA, 20 bp, Artificial
  CRISPR gRNA sequence
gaagttcttcctccccaaca

SEQ ID NO: 36872 - DNA, 20 bp, Artificial
  CRISPR gRNA sequence
cttcctccccaacacggacc

SEQ ID NO: 36873 - DNA, 20 bp, Artificial
  CRISPR gRNA sequence
cccaacacggacctggattc

SEQ ID NO: 36874 - DNA, 20 bp, Artificial
  CRISPR gRNA sequence
ccaacacggacctggattcc

SEQ ID NO: 36875 - DNA, 20 bp, Artificial
  CRISPR gRNA sequence
cggacctggattccaggaac

SEQ ID NO: 36876 - DNA, 20 bp, Artificial
  CRISPR gRNA sequence
ggattccaggaacgagacct

SEQ ID NO: 36877 - DNA, 20 bp, Artificial
  CRISPR gRNA sequence
acgagaccttggaccctgaa

SEQ ID NO: 36878 - DNA, 20 bp, Artificial
  CRISPR gRNA sequence
gagaccttggaccctgaaca

SEQ ID NO: 36879 - DNA, 20 bp, Artificial
  CRISPR gRNA sequence
gaccttggaccctgaacaga

SEQ ID NO: 36880 - DNA, 20 bp, Artificial
  CRISPR gRNA sequence
gagtcatcctgcaactcaac

SEQ ID NO: 36881 - DNA, 20 bp, Artificial
  CRISPR gRNA sequence
aactcaacaagctgcatgtc

SEQ ID NO: 36882 - DNA, 20 bp, Artificial
  CRISPR gRNA sequence
actcaacaagctgcatgtcc

SEQ ID NO: 36883 - DNA, 20 bp, Artificial
  CRISPR gRNA sequence
ctcaacaagctgcatgtcca

SEQ ID NO: 36884 - DNA, 20 bp, Artificial
  CRISPR gRNA sequence
caagctgcatgtccagggtt

SEQ ID NO: 36885 - DNA, 20 bp, Artificial
  CRISPR gRNA sequence
atgtccagggttcggacacc

SEQ ID NO: 36886 - DNA, 20 bp, Artificial
  CRISPR gRNA sequence
tccagggttcggacacctgg

SEQ ID NO: 36887 - DNA, 20 bp, Artificial
  CRISPR gRNA sequence
tcattcattgtgtgtgcatg

SEQ ID NO: 36888 - DNA, 20 bp, Artificial
  CRISPR gRNA sequence
tcattgtgtgtgcatgcagc

SEQ ID NO: 36889 - DNA, 20 bp, Artificial
  CRISPR gRNA sequence
attgtgtgtgcatgcagctg

SEQ ID NO: 36890 - DNA, 20 bp, Artificial
  CRISPR gRNA sequence
ttgtgtgtgcatgcagctgg

SEQ ID NO: 36891 - DNA, 20 bp, Artificial
  CRISPR gRNA sequence
catgcagctggaggtgcctc

SEQ ID NO: 36892 - DNA, 20 bp, Artificial
  CRISPR gRNA sequence
gctggaggtgcctctggacc

SEQ ID NO: 36893 - DNA, 20 bp, Artificial
  CRISPR gRNA sequence
tggaggtgcctctggacctg

SEQ ID NO: 36894 - DNA, 20 bp, Artificial
  CRISPR gRNA sequence
ggaggtgcctctggacctgg

SEQ ID NO: 36895 - DNA, 20 bp, Artificial
  CRISPR gRNA sequence
gacctggaggtgctgctgct

SEQ ID NO: 36896 - DNA, 20 bp, Artificial
  CRISPR gRNA sequence
gtgctgctgctgagtacttt

SEQ ID NO: 36897 - DNA, 20 bp, Artificial
  CRISPR gRNA sequence
agtacttttggctatgatga

SEQ ID NO: 36898 - DNA, 20 bp, Artificial
  CRISPR gRNA sequence
cttttggctatgatgatggt

SEQ ID NO: 36899 - DNA, 20 bp, Artificial
  CRISPR gRNA sequence
ttttggctatgatgatggta

SEQ ID NO: 36900 - DNA, 20 bp, Artificial
  CRISPR gRNA sequence
tttggctatgatgatggtaa

SEQ ID NO: 36901 - DNA, 20 bp, Artificial
  CRISPR gRNA sequence
ggctatgatgatggtaaggg

SEQ ID NO: 36902 - DNA, 20 bp, Artificial
  CRISPR gRNA sequence
gctatgatgatggtaagggc

SEQ ID NO: 36903 - DNA, 20 bp, Artificial
  CRISPR gRNA sequence
atgatggtaagggcaggtgt

SEQ ID NO: 36904 - DNA, 20 bp, Artificial
  CRISPR gRNA sequence
gatggtaagggcaggtgtga

SEQ ID NO: 36905 - DNA, 20 bp, Artificial
  CRISPR gRNA sequence
gggcaggtgtgagagacgca

SEQ ID NO: 36906 - DNA, 20 bp, Artificial
  CRISPR gRNA sequence
caggtgtgagagacgcaaag

SEQ ID NO: 36907 - DNA, 20 bp, Artificial
  CRISPR gRNA sequence
tgtgagagacgcaaagcagc

SEQ ID NO: 36908 - DNA, 20 bp, Artificial
  CRISPR gRNA sequence
gtgagagacgcaaagcagcc

SEQ ID NO: 36909 - DNA, 20 bp, Artificial
  CRISPR gRNA sequence
gagacgcaaagcagccgggc

SEQ ID NO: 36910 - DNA, 20 bp, Artificial
  CRISPR gRNA sequence
ccgggccagtacctgcgtca

SEQ ID NO: 36911 - DNA, 20 bp, Artificial
  CRISPR gRNA sequence
cgggccagtacctgcgtcat

SEQ ID NO: 36912 - DNA, 20 bp, Artificial
  CRISPR gRNA sequence
gggccagtacctgcgtcatg

SEQ ID NO: 36913 - DNA, 20 bp, Artificial
  CRISPR gRNA sequence
gccagtacctgcgtcatggg

SEQ ID NO: 36914 - DNA, 20 bp, Artificial
  CRISPR gRNA sequence
gtacctgcgtcatggggagc

SEQ ID NO: 36915 - DNA, 20 bp, Artificial
  CRISPR gRNA sequence
tacctgcgtcatggggagcc

SEQ ID NO: 36916 - DNA, 20 bp, Artificial
  CRISPR gRNA sequence
cctgcgtcatggggagccgg

SEQ ID NO: 36917 - DNA, 20 bp, Artificial
  CRISPR gRNA sequence
ctgcgtcatggggagccggg

SEQ ID NO: 36918 - DNA, 20 bp, Artificial
  CRISPR gRNA sequence
gcgtcatggggagccgggag

SEQ ID NO: 36919 - DNA, 20 bp, Artificial
  CRISPR gRNA sequence
atggggagccgggaggagcc

SEQ ID NO: 36920 - DNA, 20 bp, Artificial
  CRISPR gRNA sequence
tggggagccgggaggagccc

SEQ ID NO: 36921 - DNA, 20 bp, Artificial
  CRISPR gRNA sequence
ggggagccgggaggagccca

SEQ ID NO: 36922 - DNA, 20 bp, Artificial
  CRISPR gRNA sequence
aggagcccagggacccacct

SEQ ID NO: 36923 - DNA, 20 bp, Artificial
  CRISPR gRNA sequence
gcccagggacccacctaagt

SEQ ID NO: 36924 - DNA, 20 bp, Artificial
  CRISPR gRNA sequence
ccagggacccacctaagtca

SEQ ID NO: 36925 - DNA, 20 bp, Artificial
  CRISPR gRNA sequence
agggacccacctaagtcaga

SEQ ID NO: 36926 - DNA, 20 bp, Artificial
  CRISPR gRNA sequence
ggacccacctaagtcagaga

SEQ ID NO: 36927 - DNA, 20 bp, Artificial
  CRISPR gRNA sequence
gacccacctaagtcagagag

SEQ ID NO: 36928 - DNA, 20 bp, Artificial
  CRISPR gRNA sequence
acccacctaagtcagagaga

SEQ ID NO: 36929 - DNA, 20 bp, Artificial
  CRISPR gRNA sequence
cctaagtcagagagagggtg

SEQ ID NO: 36930 - DNA, 20 bp, Artificial
  CRISPR gRNA sequence
gtcagagagagggtgtagcc

SEQ ID NO: 36931 - DNA, 20 bp, Artificial
  CRISPR gRNA sequence
cgatctcaactctatatttc

SEQ ID NO: 36932 - DNA, 20 bp, Artificial
  CRISPR gRNA sequence
ctatatttctggacacttcc

SEQ ID NO: 36933 - DNA, 20 bp, Artificial
  CRISPR gRNA sequence
cctaatgcgcccaaatctgc

SEQ ID NO: 36934 - DNA, 20 bp, Artificial
  CRISPR gRNA sequence
ctaatgcgcccaaatctgct

SEQ ID NO: 36935 - DNA, 20 bp, Artificial
  CRISPR gRNA sequence
taatgcgcccaaatctgctg

SEQ ID NO: 36936 - DNA, 20 bp, Artificial
  CRISPR gRNA sequence
cgcccaaatctgctggggcc

SEQ ID NO: 36937 - DNA, 20 bp, Artificial
  CRISPR gRNA sequence
cccaaatctgctggggcctg

SEQ ID NO: 36938 - DNA, 20 bp, Artificial
  CRISPR gRNA sequence
ccaaatctgctggggcctgg

SEQ ID NO: 36939 - DNA, 20 bp, Artificial
  CRISPR gRNA sequence
ggaggacccctccttctacc

SEQ ID NO: 36940 - DNA, 20 bp, Artificial
  CRISPR gRNA sequence
ctcgaattgctcgaattgct

SEQ ID NO: 36941 - DNA, 20 bp, Artificial
  CRISPR gRNA sequence
aattgctgagtgactgcttc

SEQ ID NO: 36942 - DNA, 20 bp, Artificial
  CRISPR gRNA sequence
tccagccacaaaatcccaca

SEQ ID NO: 36943 - DNA, 20 bp, Artificial
  CRISPR gRNA sequence
ccacatagcccataatgccc

SEQ ID NO: 36944 - DNA, 20 bp, Artificial
  CRISPR gRNA sequence
acatagcccataatgcccga

SEQ ID NO: 36945 - DNA, 20 bp, Artificial
  CRISPR gRNA sequence
gagatttatttcttcttttt

SEQ ID NO: 36946 - DNA, 20 bp, Artificial
  CRISPR gRNA sequence
atttatttcttcttttttgg

SEQ ID NO: 36947 - DNA, 20 bp, Artificial
  CRISPR gRNA sequence
tttatttcttcttttttggc

SEQ ID NO: 36948 - DNA, 20 bp, Artificial
  CRISPR gRNA sequence
ttatttcttcttttttggcg

SEQ ID NO: 36949 - DNA, 20 bp, Artificial
  CRISPR gRNA sequence
tatttcttcttttttggcgg

SEQ ID NO: 36950 - DNA, 20 bp, Artificial
  CRISPR gRNA sequence
ttcttcttttttggcggggg

SEQ ID NO: 36951 - DNA, 20 bp, Artificial
  CRISPR gRNA sequence
tcttcttttttggcgggggt

SEQ ID NO: 36952 - DNA, 20 bp, Artificial
  CRISPR gRNA sequence
cttcttttttggcgggggtg

SEQ ID NO: 36953 - DNA, 20 bp, Artificial
  CRISPR gRNA sequence
ttcttttttggcgggggtgg

SEQ ID NO: 36954 - DNA, 20 bp, Artificial
  CRISPR gRNA sequence
tcttttttggcgggggtggg

SEQ ID NO: 36955 - DNA, 20 bp, Artificial
  CRISPR gRNA sequence
cttttttggcgggggtgggg

SEQ ID NO: 36956 - DNA, 20 bp, Artificial
  CRISPR gRNA sequence
ttgtttgttgttgctcttgt

SEQ ID NO: 36957 - DNA, 20 bp, Artificial
  CRISPR gRNA sequence
tgtttgttgttgctcttgtt

SEQ ID NO: 36958 - DNA, 20 bp, Artificial
  CRISPR gRNA sequence
tttgtttgttttttattttt

SEQ ID NO: 36959 - DNA, 20 bp, Artificial
  CRISPR gRNA sequence
ttgttttttatttttgagac

SEQ ID NO: 36960 - DNA, 20 bp, Artificial
  CRISPR gRNA sequence
tgttttttatttttgagaca

SEQ ID NO: 36961 - DNA, 20 bp, Artificial
  CRISPR gRNA sequence
caaggtcttgctctgttgcc

SEQ ID NO: 36962 - DNA, 20 bp, Artificial
  CRISPR gRNA sequence
aaggtcttgctctgttgcct

SEQ ID NO: 36963 - DNA, 20 bp, Artificial
  CRISPR gRNA sequence
tcttgctctgttgcctaggc

SEQ ID NO: 36964 - DNA, 20 bp, Artificial
  CRISPR gRNA sequence
ttgctctgttgcctaggctg

SEQ ID NO: 36965 - DNA, 20 bp, Artificial
  CRISPR gRNA sequence
ctgttgcctaggctggagtg

SEQ ID NO: 36966 - DNA, 20 bp, Artificial
  CRISPR gRNA sequence
ttgcctaggctggagtgcag

SEQ ID NO: 36967 - DNA, 20 bp, Artificial
  CRISPR gRNA sequence
ggagtgcagtggcacaatca

SEQ ID NO: 36968 - DNA, 20 bp, Artificial
  CRISPR gRNA sequence
ggcacaatcatagctcacta

SEQ ID NO: 36969 - DNA, 20 bp, Artificial
  CRISPR gRNA sequence
ctcactacagcatccaactc

SEQ ID NO: 36970 - DNA, 20 bp, Artificial
  CRISPR gRNA sequence
tcactacagcatccaactcc

SEQ ID NO: 36971 - DNA, 20 bp, Artificial
  CRISPR gRNA sequence
cagcatccaactccaggact

SEQ ID NO: 36972 - DNA, 20 bp, Artificial
  CRISPR gRNA sequence
agcatccaactccaggactc

SEQ ID NO: 36973 - DNA, 20 bp, Artificial
  CRISPR gRNA sequence
tcaggtgatccttcccactt

SEQ ID NO: 36974 - DNA, 20 bp, Artificial
  CRISPR gRNA sequence
ccttcccacttcagcctccc

SEQ ID NO: 36975 - DNA, 20 bp, Artificial
  CRISPR gRNA sequence
tcccacttcagcctcccaag

SEQ ID NO: 36976 - DNA, 20 bp, Artificial
  CRISPR gRNA sequence
cttcagcctcccaagtagct

SEQ ID NO: 36977 - DNA, 20 bp, Artificial
  CRISPR gRNA sequence
ctcccaagtagctgagacta

SEQ ID NO: 36978 - DNA, 20 bp, Artificial
  CRISPR gRNA sequence
ccaagtagctgagactacag

SEQ ID NO: 36979 - DNA, 20 bp, Artificial
  CRISPR gRNA sequence
ctgagactacagtagaacta

SEQ ID NO: 36980 - DNA, 20 bp, Artificial
  CRISPR gRNA sequence
tgagactacagtagaactat

SEQ ID NO: 36981 - DNA, 20 bp, Artificial
  CRISPR gRNA sequence
ataggtgcatgccaccacat

SEQ ID NO: 36982 - DNA, 20 bp, Artificial
  CRISPR gRNA sequence
taggtgcatgccaccacatt

SEQ ID NO: 36983 - DNA, 20 bp, Artificial
  CRISPR gRNA sequence
gctaatttttcattcttttg

SEQ ID NO: 36984 - DNA, 20 bp, Artificial
  CRISPR gRNA sequence
taatttttcattcttttgta

SEQ ID NO: 36985 - DNA, 20 bp, Artificial
  CRISPR gRNA sequence
ttttcattcttttgtagaga

SEQ ID NO: 36986 - DNA, 20 bp, Artificial
  CRISPR gRNA sequence
tttcattcttttgtagagac

SEQ ID NO: 36987 - DNA, 20 bp, Artificial
  CRISPR gRNA sequence
caggacatcactgtgttgcc

SEQ ID NO: 36988 - DNA, 20 bp, Artificial
  CRISPR gRNA sequence
aggacatcactgtgttgccc

SEQ ID NO: 36989 - DNA, 20 bp, Artificial
  CRISPR gRNA sequence
catcactgtgttgcccaggc

SEQ ID NO: 36990 - DNA, 20 bp, Artificial
  CRISPR gRNA sequence
ccaggctggtcttgaactcc

SEQ ID NO: 36991 - DNA, 20 bp, Artificial
  CRISPR gRNA sequence
ggtcttgaactcctggcctt

SEQ ID NO: 36992 - DNA, 20 bp, Artificial
  CRISPR gRNA sequence
cttaagtgatcctcctccct

SEQ ID NO: 36993 - DNA, 20 bp, Artificial
  CRISPR gRNA sequence
cctcctcccttggcctccca

SEQ ID NO: 36994 - DNA, 20 bp, Artificial
  CRISPR gRNA sequence
cccttggcctcccaaagtgc

SEQ ID NO: 36995 - DNA, 20 bp, Artificial
  CRISPR gRNA sequence
ccttggcctcccaaagtgct

SEQ ID NO: 36996 - DNA, 20 bp, Artificial
  CRISPR gRNA sequence
ctcccaaagtgctgggatta

SEQ ID NO: 36997 - DNA, 20 bp, Artificial
  CRISPR gRNA sequence
agtgctgggattatagatgt

SEQ ID NO: 36998 - DNA, 20 bp, Artificial
  CRISPR gRNA sequence
tagatgtgagccatcacacc

SEQ ID NO: 36999 - DNA, 20 bp, Artificial
  CRISPR gRNA sequence
tgtgagccatcacacctggc

SEQ ID NO: 37000 - DNA, 20 bp, Artificial
  CRISPR gRNA sequence
tgagccatcacacctggcta

SEQ ID NO: 37001 - DNA, 20 bp, Artificial
  CRISPR gRNA sequence
gagccatcacacctggctag

SEQ ID NO: 37002 - DNA, 20 bp, Artificial
  CRISPR gRNA sequence
tgtttgtttgttttgcaaca

SEQ ID NO: 37003 - DNA, 20 bp, Artificial
  CRISPR gRNA sequence
tgtttgttttgcaacatggt

SEQ ID NO: 37004 - DNA, 20 bp, Artificial
  CRISPR gRNA sequence
ttttgcaacatggtcagaaa

SEQ ID NO: 37005 - DNA, 20 bp, Artificial
  CRISPR gRNA sequence
aacatggtcagaaacagtga

SEQ ID NO: 37006 - DNA, 20 bp, Artificial
  CRISPR gRNA sequence
acatggtcagaaacagtgac

SEQ ID NO: 37007 - DNA, 20 bp, Artificial
  CRISPR gRNA sequence
catggtcagaaacagtgacg

SEQ ID NO: 37008 - DNA, 20 bp, Artificial
  CRISPR gRNA sequence
tggtcagaaacagtgacggg

SEQ ID NO: 37009 - DNA, 20 bp, Artificial
  CRISPR gRNA sequence
ttctgccctctactgatccg

SEQ ID NO: 37010 - DNA, 20 bp, Artificial
  CRISPR gRNA sequence
tctgccctctactgatccgt

SEQ ID NO: 37011 - DNA, 20 bp, Artificial
  CRISPR gRNA sequence
ctgccctctactgatccgtg

SEQ ID NO: 37012 - DNA, 20 bp, Artificial
  CRISPR gRNA sequence
actgatccgtggggatttct

SEQ ID NO: 37013 - DNA, 20 bp, Artificial
  CRISPR gRNA sequence
ctgatccgtggggatttctt

SEQ ID NO: 37014 - DNA, 20 bp, Artificial
  CRISPR gRNA sequence
ttgggcaccttctgtttgca

SEQ ID NO: 37015 - DNA, 20 bp, Artificial
  CRISPR gRNA sequence
ccttctgtttgcacagcact

SEQ ID NO: 37016 - DNA, 20 bp, Artificial
  CRISPR gRNA sequence
cttctgtttgcacagcactg

SEQ ID NO: 37017 - DNA, 20 bp, Artificial
  CRISPR gRNA sequence
ttctgtttgcacagcactga

SEQ ID NO: 37018 - DNA, 20 bp, Artificial
  CRISPR gRNA sequence
tctgtttgcacagcactgag

SEQ ID NO: 37019 - DNA, 20 bp, Artificial
  CRISPR gRNA sequence
cacagcactgaggggaaaca

SEQ ID NO: 37020 - DNA, 20 bp, Artificial
  CRISPR gRNA sequence
acagcactgaggggaaacac

SEQ ID NO: 37021 - DNA, 20 bp, Artificial
  CRISPR gRNA sequence
gaggggaaacacaggacatt

SEQ ID NO: 37022 - DNA, 20 bp, Artificial
  CRISPR gRNA sequence
aggggaaacacaggacattg

SEQ ID NO: 37023 - DNA, 20 bp, Artificial
  CRISPR gRNA sequence
ggggaaacacaggacattga

SEQ ID NO: 37024 - DNA, 20 bp, Artificial
  CRISPR gRNA sequence
gggaaacacaggacattgag

SEQ ID NO: 37025 - DNA, 20 bp, Artificial
  CRISPR gRNA sequence
cacaggacattgaggggcaa

SEQ ID NO: 37026 - DNA, 20 bp, Artificial
  CRISPR gRNA sequence
ttgaggggcaacagcgtttt

SEQ ID NO: 37027 - DNA, 20 bp, Artificial
  CRISPR gRNA sequence
gaggggcaacagcgtttttg

SEQ ID NO: 37028 - DNA, 20 bp, Artificial
  CRISPR gRNA sequence
ggggcaacagcgtttttgga

SEQ ID NO: 37029 - DNA, 20 bp, Artificial
  CRISPR gRNA sequence
cagcgtttttggagagaaaa

SEQ ID NO: 37030 - DNA, 20 bp, Artificial
  CRISPR gRNA sequence
agcgtttttggagagaaaat

SEQ ID NO: 37031 - DNA, 20 bp, Artificial
  CRISPR gRNA sequence
gagaaaatgggaactcactt

SEQ ID NO: 37032 - DNA, 20 bp, Artificial
  CRISPR gRNA sequence
tcacttaagaaccctacttc

SEQ ID NO: 37033 - DNA, 20 bp, Artificial
  CRISPR gRNA sequence
cacttaagaaccctacttca

SEQ ID NO: 37034 - DNA, 20 bp, Artificial
  CRISPR gRNA sequence
ttaagaaccctacttcaagg

SEQ ID NO: 37035 - DNA, 20 bp, Artificial
  CRISPR gRNA sequence
aagaaccctacttcaaggca

SEQ ID NO: 37036 - DNA, 20 bp, Artificial
  CRISPR gRNA sequence
ccctacttcaaggcagagtg

SEQ ID NO: 37037 - DNA, 20 bp, Artificial
  CRISPR gRNA sequence
cctacttcaaggcagagtgt

SEQ ID NO: 37038 - DNA, 20 bp, Artificial
  CRISPR gRNA sequence
aaggcagagtgtgggaattg

SEQ ID NO: 37039 - DNA, 20 bp, Artificial
  CRISPR gRNA sequence
aggcagagtgtgggaattgc

SEQ ID NO: 37040 - DNA, 20 bp, Artificial
  CRISPR gRNA sequence
ggcagagtgtgggaattgcg

SEQ ID NO: 37041 - DNA, 20 bp, Artificial
  CRISPR gRNA sequence
gcagagtgtgggaattgcgg

SEQ ID NO: 37042 - DNA, 20 bp, Artificial
  CRISPR gRNA sequence
cagagtgtgggaattgcggg

SEQ ID NO: 37043 - DNA, 20 bp, Artificial
  CRISPR gRNA sequence
agtgtgggaattgcgggggg

SEQ ID NO: 37044 - DNA, 20 bp, Artificial
  CRISPR gRNA sequence
gtgtgggaattgcggggggc

SEQ ID NO: 37045 - DNA, 20 bp, Artificial
  CRISPR gRNA sequence
tgtgggaattgcggggggcg

SEQ ID NO: 37046 - DNA, 20 bp, Artificial
  CRISPR gRNA sequence
gggaattgcggggggcgggg

SEQ ID NO: 37047 - DNA, 20 bp, Artificial
  CRISPR gRNA sequence
gcggcgcatgcacatatgtg

SEQ ID NO: 37048 - DNA, 20 bp, Artificial
  CRISPR gRNA sequence
cacatatgtgcagacatatg

SEQ ID NO: 37049 - DNA, 20 bp, Artificial
  CRISPR gRNA sequence
cagacatatgcagatacaca

SEQ ID NO: 37050 - DNA, 20 bp, Artificial
  CRISPR gRNA sequence
acacacagtgcatatacatg

SEQ ID NO: 37051 - DNA, 20 bp, Artificial
  CRISPR gRNA sequence
cacacagtgcatatacatgt

SEQ ID NO: 37052 - DNA, 20 bp, Artificial
  CRISPR gRNA sequence
acccatgtacacatgcatgc

SEQ ID NO: 37053 - DNA, 20 bp, Artificial
  CRISPR gRNA sequence
catatacacacatttctgcc

SEQ ID NO: 37054 - DNA, 20 bp, Artificial
  CRISPR gRNA sequence
tctgcccagcactgccttca

SEQ ID NO: 37055 - DNA, 20 bp, Artificial
  CRISPR gRNA sequence
ccaccacattttctccacaa

SEQ ID NO: 37056 - DNA, 20 bp, Artificial
  CRISPR gRNA sequence
tttctccacaacagataact

SEQ ID NO: 37057 - DNA, 20 bp, Artificial
  CRISPR gRNA sequence
agataactgagtgttccatt

SEQ ID NO: 37058 - DNA, 20 bp, Artificial
  CRISPR gRNA sequence
tccatttagttctcccttgc

SEQ ID NO: 37059 - DNA, 20 bp, Artificial
  CRISPR gRNA sequence
ccatttagttctcccttgct

SEQ ID NO: 37060 - DNA, 20 bp, Artificial
  CRISPR gRNA sequence
cttgctgggtatctccctgt

SEQ ID NO: 37061 - DNA, 20 bp, Artificial
  CRISPR gRNA sequence
tgggtatctccctgtgagat

SEQ ID NO: 37062 - DNA, 20 bp, Artificial
  CRISPR gRNA sequence
ctccctgtgagatgagccct

SEQ ID NO: 37063 - DNA, 20 bp, Artificial
  CRISPR gRNA sequence
ctgtgagatgagccctgagc

SEQ ID NO: 37064 - DNA, 20 bp, Artificial
  CRISPR gRNA sequence
tgtgagatgagccctgagcc

SEQ ID NO: 37065 - DNA, 20 bp, Artificial
  CRISPR gRNA sequence
atgagccctgagccaggcgc

SEQ ID NO: 37066 - DNA, 20 bp, Artificial
  CRISPR gRNA sequence
tgagccctgagccaggcgcc

SEQ ID NO: 37067 - DNA, 20 bp, Artificial
  CRISPR gRNA sequence
ccctgagccaggcgccaggc

SEQ ID NO: 37068 - DNA, 20 bp, Artificial
  CRISPR gRNA sequence
ctgagccaggcgccaggcca

SEQ ID NO: 37069 - DNA, 20 bp, Artificial
  CRISPR gRNA sequence
gccaggcgccaggccagagc

SEQ ID NO: 37070 - DNA, 20 bp, Artificial
  CRISPR gRNA sequence
gccaggccagagctggtccc

SEQ ID NO: 37071 - DNA, 20 bp, Artificial
  CRISPR gRNA sequence
tggtccccagcatccctcga

SEQ ID NO: 37072 - DNA, 20 bp, Artificial
  CRISPR gRNA sequence
ttatactctcccctctcttg

SEQ ID NO: 37073 - DNA, 20 bp, Artificial
  CRISPR gRNA sequence
tatactctcccctctcttgc

SEQ ID NO: 37074 - DNA, 20 bp, Artificial
  CRISPR gRNA sequence
atactctcccctctcttgca

SEQ ID NO: 37075 - DNA, 20 bp, Artificial
  CRISPR gRNA sequence
ccctctcttgcagggttcac

SEQ ID NO: 37076 - DNA, 20 bp, Artificial
  CRISPR gRNA sequence
ctcttgcagggttcaccagc

SEQ ID NO: 37077 - DNA, 20 bp, Artificial
  CRISPR gRNA sequence
tgcagggttcaccagccagc

SEQ ID NO: 37078 - DNA, 20 bp, Artificial
  CRISPR gRNA sequence
gcagggttcaccagccagct

SEQ ID NO: 37079 - DNA, 20 bp, Artificial
  CRISPR gRNA sequence
agggttcaccagccagctgg

SEQ ID NO: 37080 - DNA, 20 bp, Artificial
  CRISPR gRNA sequence
tcaccagccagctgggagct

SEQ ID NO: 37081 - DNA, 20 bp, Artificial
  CRISPR gRNA sequence
caccagccagctgggagctg

SEQ ID NO: 37082 - DNA, 20 bp, Artificial
  CRISPR gRNA sequence
accagccagctgggagctga

SEQ ID NO: 37083 - DNA, 20 bp, Artificial
  CRISPR gRNA sequence
ccagccagctgggagctgag

SEQ ID NO: 37084 - DNA, 20 bp, Artificial
  CRISPR gRNA sequence
cagctgggagctgaggggaa

SEQ ID NO: 37085 - DNA, 20 bp, Artificial
  CRISPR gRNA sequence
ggaaaagccaacctgaatct

SEQ ID NO: 37086 - DNA, 20 bp, Artificial
  CRISPR gRNA sequence
cctgaatctcagctccacca

SEQ ID NO: 37087 - DNA, 20 bp, Artificial
  CRISPR gRNA sequence
aatctcagctccaccatggt

SEQ ID NO: 37088 - DNA, 20 bp, Artificial
  CRISPR gRNA sequence
atctcagctccaccatggtg

SEQ ID NO: 37089 - DNA, 20 bp, Artificial
  CRISPR gRNA sequence
agctccaccatggtgaggac

SEQ ID NO: 37090 - DNA, 20 bp, Artificial
  CRISPR gRNA sequence
ctccaccatggtgaggactg

SEQ ID NO: 37091 - DNA, 20 bp, Artificial
  CRISPR gRNA sequence
accatggtgaggactggagt

SEQ ID NO: 37092 - DNA, 20 bp, Artificial
  CRISPR gRNA sequence
ccatggtgaggactggagtt

SEQ ID NO: 37093 - DNA, 20 bp, Artificial
  CRISPR gRNA sequence
catggtgaggactggagttg

SEQ ID NO: 37094 - DNA, 20 bp, Artificial
  CRISPR gRNA sequence
atggtgaggactggagttgg

SEQ ID NO: 37095 - DNA, 20 bp, Artificial
  CRISPR gRNA sequence
tggtgaggactggagttggg

SEQ ID NO: 37096 - DNA, 20 bp, Artificial
  CRISPR gRNA sequence
tgaggactggagttgggggg

SEQ ID NO: 37097 - DNA, 20 bp, Artificial
  CRISPR gRNA sequence
gaggactggagttggggggt

SEQ ID NO: 37098 - DNA, 20 bp, Artificial
  CRISPR gRNA sequence
gactggagttggggggtggg

SEQ ID NO: 37099 - DNA, 20 bp, Artificial
  CRISPR gRNA sequence
actggagttggggggtggga

SEQ ID NO: 37100 - DNA, 20 bp, Artificial
  CRISPR gRNA sequence
ctggagttggggggtgggaa

SEQ ID NO: 37101 - DNA, 20 bp, Artificial
  CRISPR gRNA sequence
tggagttggggggtgggaag

SEQ ID NO: 37102 - DNA, 20 bp, Artificial
  CRISPR gRNA sequence
ggagttggggggtgggaagg

SEQ ID NO: 37103 - DNA, 20 bp, Artificial
  CRISPR gRNA sequence
gttggggggtgggaaggggg

SEQ ID NO: 37104 - DNA, 20 bp, Artificial
  CRISPR gRNA sequence
gggggtgggaagggggtggt

SEQ ID NO: 37105 - DNA, 20 bp, Artificial
  CRISPR gRNA sequence
agggggtggtgagcactgtg

SEQ ID NO: 37106 - DNA, 20 bp, Artificial
  CRISPR gRNA sequence
actgtgaagtccccacttcc

SEQ ID NO: 37107 - DNA, 20 bp, Artificial
  CRISPR gRNA sequence
tgaagtccccacttccaagc

SEQ ID NO: 37108 - DNA, 20 bp, Artificial
  CRISPR gRNA sequence
aagtccccacttccaagctg

SEQ ID NO: 37109 - DNA, 20 bp, Artificial
  CRISPR gRNA sequence
agtccccacttccaagctgg

SEQ ID NO: 37110 - DNA, 20 bp, Artificial
  CRISPR gRNA sequence
tccccacttccaagctggag

SEQ ID NO: 37111 - DNA, 20 bp, Artificial
  CRISPR gRNA sequence
ccccacttccaagctggagg

SEQ ID NO: 37112 - DNA, 20 bp, Artificial
  CRISPR gRNA sequence
ttccaagctggaggaggctg

SEQ ID NO: 37113 - DNA, 20 bp, Artificial
  CRISPR gRNA sequence
ccaagctggaggaggctgtg

SEQ ID NO: 37114 - DNA, 20 bp, Artificial
  CRISPR gRNA sequence
caagctggaggaggctgtgg

SEQ ID NO: 37115 - DNA, 20 bp, Artificial
  CRISPR gRNA sequence
ggaggaggctgtggaggctg

SEQ ID NO: 37116 - DNA, 20 bp, Artificial
  CRISPR gRNA sequence
ggaggctgtggaggctgtgg

SEQ ID NO: 37117 - DNA, 20 bp, Artificial
  CRISPR gRNA sequence
gctgtggaggctgtggtggc

SEQ ID NO: 37118 - DNA, 20 bp, Artificial
  CRISPR gRNA sequence
gaggctgtggtggctggtca

SEQ ID NO: 37119 - DNA, 20 bp, Artificial
  CRISPR gRNA sequence
ctggtcacagccatttctca

SEQ ID NO: 37120 - DNA, 20 bp, Artificial
  CRISPR gRNA sequence
tggtcacagccatttctcat

SEQ ID NO: 37121 - DNA, 20 bp, Artificial
  CRISPR gRNA sequence
tctgtccctgacccatttgc

SEQ ID NO: 37122 - DNA, 20 bp, Artificial
  CRISPR gRNA sequence
gacccatttgcaagtgtgtc

SEQ ID NO: 37123 - DNA, 20 bp, Artificial
  CRISPR gRNA sequence
aagcccctaactgtgtctcc

SEQ ID NO: 37124 - DNA, 20 bp, Artificial
  CRISPR gRNA sequence
cccagccccacctcctcctg

SEQ ID NO: 37125 - DNA, 20 bp, Artificial
  CRISPR gRNA sequence
ctcctcctgcagtgactttc

SEQ ID NO: 37126 - DNA, 20 bp, Artificial
  CRISPR gRNA sequence
tcctcctgcagtgactttca

SEQ ID NO: 37127 - DNA, 20 bp, Artificial
  CRISPR gRNA sequence
tgcagtgactttcaaggctt

SEQ ID NO: 37128 - DNA, 20 bp, Artificial
  CRISPR gRNA sequence
ttgtcccgttaccaattcta

SEQ ID NO: 37129 - DNA, 20 bp, Artificial
  CRISPR gRNA sequence
tgtcccgttaccaattctaa

SEQ ID NO: 37130 - DNA, 20 bp, Artificial
  CRISPR gRNA sequence
gtcccgttaccaattctaaa

SEQ ID NO: 37131 - DNA, 20 bp, Artificial
  CRISPR gRNA sequence
caattctaaagggtctaacc

SEQ ID NO: 37132 - DNA, 20 bp, Artificial
  CRISPR gRNA sequence
gggtctaacctggaacccct

SEQ ID NO: 37133 - DNA, 20 bp, Artificial
  CRISPR gRNA sequence
ggtctaacctggaacccctc

SEQ ID NO: 37134 - DNA, 20 bp, Artificial
  CRISPR gRNA sequence
ctaacctggaacccctcagg

SEQ ID NO: 37135 - DNA, 20 bp, Artificial
  CRISPR gRNA sequence
actttcctgcccgcaacccg

SEQ ID NO: 37136 - DNA, 20 bp, Artificial
  CRISPR gRNA sequence
ctttcctgcccgcaacccgc

SEQ ID NO: 37137 - DNA, 20 bp, Artificial
  CRISPR gRNA sequence
tttcctgcccgcaacccgca

SEQ ID NO: 37138 - DNA, 20 bp, Artificial
  CRISPR gRNA sequence
acccgcagggcctcatctcc

SEQ ID NO: 37139 - DNA, 20 bp, Artificial
  CRISPR gRNA sequence
ggcctcatctcccagcccca

SEQ ID NO: 37140 - DNA, 20 bp, Artificial
  CRISPR gRNA sequence
atctcccagccccaaagtgt

SEQ ID NO: 37141 - DNA, 20 bp, Artificial
  CRISPR gRNA sequence
tctcccagccccaaagtgtc

SEQ ID NO: 37142 - DNA, 20 bp, Artificial
  CRISPR gRNA sequence
ccccaaagtgtcaggcttca

SEQ ID NO: 37143 - DNA, 20 bp, Artificial
  CRISPR gRNA sequence
cccaaagtgtcaggcttcat

SEQ ID NO: 37144 - DNA, 20 bp, Artificial
  CRISPR gRNA sequence
ccaaagtgtcaggcttcatg

SEQ ID NO: 37145 - DNA, 20 bp, Artificial
  CRISPR gRNA sequence
aagtgtcaggcttcatgggg

SEQ ID NO: 37146 - DNA, 20 bp, Artificial
  CRISPR gRNA sequence
ccctcccgacttgtacacct

SEQ ID NO: 37147 - DNA, 20 bp, Artificial
  CRISPR gRNA sequence
ttggacttgacactcaccca

SEQ ID NO: 37148 - DNA, 20 bp, Artificial
  CRISPR gRNA sequence
tcacccacagctgctgtctt

SEQ ID NO: 37149 - DNA, 20 bp, Artificial
  CRISPR gRNA sequence
cccacagctgctgtcttcag

SEQ ID NO: 37150 - DNA, 20 bp, Artificial
  CRISPR gRNA sequence
ccacagctgctgtcttcagc

SEQ ID NO: 37151 - DNA, 20 bp, Artificial
  CRISPR gRNA sequence
cacagctgctgtcttcagcg

SEQ ID NO: 37152 - DNA, 20 bp, Artificial
  CRISPR gRNA sequence
acagctgctgtcttcagcgg

SEQ ID NO: 37153 - DNA, 20 bp, Artificial
  CRISPR gRNA sequence
agctgctgtcttcagcgggg

SEQ ID NO: 37154 - DNA, 20 bp, Artificial
  CRISPR gRNA sequence
gtcttcagcgggggagcctt

SEQ ID NO: 37155 - DNA, 20 bp, Artificial
  CRISPR gRNA sequence
agcctttggctgattttctg

SEQ ID NO: 37156 - DNA, 20 bp, Artificial
  CRISPR gRNA sequence
gcctttggctgattttctga

SEQ ID NO: 37157 - DNA, 20 bp, Artificial
  CRISPR gRNA sequence
ctttggctgattttctgaag

SEQ ID NO: 37158 - DNA, 20 bp, Artificial
  CRISPR gRNA sequence
gctgattttctgaaggagct

SEQ ID NO: 37159 - DNA, 20 bp, Artificial
  CRISPR gRNA sequence
gattttctgaaggagctcgg

SEQ ID NO: 37160 - DNA, 20 bp, Artificial
  CRISPR gRNA sequence
attttctgaaggagctcgga

SEQ ID NO: 37161 - DNA, 20 bp, Artificial
  CRISPR gRNA sequence
ttttctgaaggagctcggaa

SEQ ID NO: 37162 - DNA, 20 bp, Artificial
  CRISPR gRNA sequence
ctgaaggagctcggaagggc

SEQ ID NO: 37163 - DNA, 20 bp, Artificial
  CRISPR gRNA sequence
aatgaccacctactgattcg

SEQ ID NO: 37164 - DNA, 20 bp, Artificial
  CRISPR gRNA sequence
atgaccacctactgattcgt

SEQ ID NO: 37165 - DNA, 20 bp, Artificial
  CRISPR gRNA sequence
cgtgggtcacactttcatct

SEQ ID NO: 37166 - DNA, 20 bp, Artificial
  CRISPR gRNA sequence
tctcagcaccttgatttcta

SEQ ID NO: 37167 - DNA, 20 bp, Artificial
  CRISPR gRNA sequence
cagcaccttgatttctacag

SEQ ID NO: 37168 - DNA, 20 bp, Artificial
  CRISPR gRNA sequence
actttacttatcgctgtgca

SEQ ID NO: 37169 - DNA, 20 bp, Artificial
  CRISPR gRNA sequence
ttacttatcgctgtgcatgg

SEQ ID NO: 37170 - DNA, 20 bp, Artificial
  CRISPR gRNA sequence
gtgcatggcagtaatgccaa

SEQ ID NO: 37171 - DNA, 20 bp, Artificial
  CRISPR gRNA sequence
gaaaacccaccctataacct

SEQ ID NO: 37172 - DNA, 20 bp, Artificial
  CRISPR gRNA sequence
accctataacctcagctccc

SEQ ID NO: 37173 - DNA, 20 bp, Artificial
  CRISPR gRNA sequence
ccagtgaatcaaaactgtcc

SEQ ID NO: 37174 - DNA, 20 bp, Artificial
  CRISPR gRNA sequence
atcaaaactgtccaagtccc

SEQ ID NO: 37175 - DNA, 20 bp, Artificial
  CRISPR gRNA sequence
tgtccaagtccctggtccaa

SEQ ID NO: 37176 - DNA, 20 bp, Artificial
  CRISPR gRNA sequence
gtccaagtccctggtccaat

SEQ ID NO: 37177 - DNA, 20 bp, Artificial
  CRISPR gRNA sequence
tccaataggcccgcatcact

SEQ ID NO: 37178 - DNA, 20 bp, Artificial
  CRISPR gRNA sequence
ataggcccgcatcactgagc

SEQ ID NO: 37179 - DNA, 20 bp, Artificial
  CRISPR gRNA sequence
gagctggcatcattatctca

SEQ ID NO: 37180 - DNA, 20 bp, Artificial
  CRISPR gRNA sequence
cattatctcatggctgtaac

SEQ ID NO: 37181 - DNA, 20 bp, Artificial
  CRISPR gRNA sequence
aaccagatctgattgatatt

SEQ ID NO: 37182 - DNA, 20 bp, Artificial
  CRISPR gRNA sequence
agatctgattgatatttggc

SEQ ID NO: 37183 - DNA, 20 bp, Artificial
  CRISPR gRNA sequence
ctgattgatatttggccagt

SEQ ID NO: 37184 - DNA, 20 bp, Artificial
  CRISPR gRNA sequence
cagtgagtccctttttaata

SEQ ID NO: 37185 - DNA, 20 bp, Artificial
  CRISPR gRNA sequence
agtgagtccctttttaatat

SEQ ID NO: 37186 - DNA, 20 bp, Artificial
  CRISPR gRNA sequence
tttttaatataggatttgtt

SEQ ID NO: 37187 - DNA, 20 bp, Artificial
  CRISPR gRNA sequence
taggatttgttaagatattg

SEQ ID NO: 37188 - DNA, 20 bp, Artificial
  CRISPR gRNA sequence
atattgaagtgctctcgaac

SEQ ID NO: 37189 - DNA, 20 bp, Artificial
  CRISPR gRNA sequence
aagtgctctcgaactggttc

SEQ ID NO: 37190 - DNA, 20 bp, Artificial
  CRISPR gRNA sequence
tcgaactggttccagcctcc

SEQ ID NO: 37191 - DNA, 20 bp, Artificial
  CRISPR gRNA sequence
actggttccagcctcctagc

SEQ ID NO: 37192 - DNA, 20 bp, Artificial
  CRISPR gRNA sequence
ttccagcctcctagctggac

SEQ ID NO: 37193 - DNA, 20 bp, Artificial
  CRISPR gRNA sequence
tccagcctcctagctggaca

SEQ ID NO: 37194 - DNA, 20 bp, Artificial
  CRISPR gRNA sequence
cagcctcctagctggacaag

SEQ ID NO: 37195 - DNA, 20 bp, Artificial
  CRISPR gRNA sequence
tcctagctggacaaggagcc

SEQ ID NO: 37196 - DNA, 20 bp, Artificial
  CRISPR gRNA sequence
cctagctggacaaggagccc

SEQ ID NO: 37197 - DNA, 20 bp, Artificial
  CRISPR gRNA sequence
ctagctggacaaggagccca

SEQ ID NO: 37198 - DNA, 20 bp, Artificial
  CRISPR gRNA sequence
aggagcccagggccctgctc

SEQ ID NO: 37199 - DNA, 20 bp, Artificial
  CRISPR gRNA sequence
ggagcccagggccctgctcc

SEQ ID NO: 37200 - DNA, 20 bp, Artificial
  CRISPR gRNA sequence
gagcccagggccctgctcca

SEQ ID NO: 37201 - DNA, 20 bp, Artificial
  CRISPR gRNA sequence
agcccagggccctgctccag

SEQ ID NO: 37202 - DNA, 20 bp, Artificial
  CRISPR gRNA sequence
gctccaggggctgttcctat

SEQ ID NO: 37203 - DNA, 20 bp, Artificial
  CRISPR gRNA sequence
ggctgttcctattggtcact

SEQ ID NO: 37204 - DNA, 20 bp, Artificial
  CRISPR gRNA sequence
ttcctattggtcacttagct

SEQ ID NO: 37205 - DNA, 20 bp, Artificial
  CRISPR gRNA sequence
ttggtcacttagcttagctg

SEQ ID NO: 37206 - DNA, 20 bp, Artificial
  CRISPR gRNA sequence
tggtcacttagcttagctgt

SEQ ID NO: 37207 - DNA, 20 bp, Artificial
  CRISPR gRNA sequence
gtcacttagcttagctgtag

SEQ ID NO: 37208 - DNA, 20 bp, Artificial
  CRISPR gRNA sequence
tcacttagcttagctgtagg

SEQ ID NO: 37209 - DNA, 20 bp, Artificial
  CRISPR gRNA sequence
acttcttaaaattctttcct

SEQ ID NO: 37210 - DNA, 20 bp, Artificial
  CRISPR gRNA sequence
tttctccctcccttcctttc

SEQ ID NO: 37211 - DNA, 20 bp, Artificial
  CRISPR gRNA sequence
ttctccctcccttcctttct

SEQ ID NO: 37212 - DNA, 20 bp, Artificial
  CRISPR gRNA sequence
cttcctttctcaaactcttc

SEQ ID NO: 37213 - DNA, 20 bp, Artificial
  CRISPR gRNA sequence
ctttctcaaactcttccaga

SEQ ID NO: 37214 - DNA, 20 bp, Artificial
  CRISPR gRNA sequence
tttctcaaactcttccagaa

SEQ ID NO: 37215 - DNA, 20 bp, Artificial
  CRISPR gRNA sequence
actcttccagaaaggcatta

SEQ ID NO: 37216 - DNA, 20 bp, Artificial
  CRISPR gRNA sequence
ttgttgaaaatccatacaat

SEQ ID NO: 37217 - DNA, 20 bp, Artificial
  CRISPR gRNA sequence
gaaaatccatacaatgagac

SEQ ID NO: 37218 - DNA, 20 bp, Artificial
  CRISPR gRNA sequence
catacaatgagacaagactc

SEQ ID NO: 37219 - DNA, 20 bp, Artificial
  CRISPR gRNA sequence
acaagactccagaaactatt

SEQ ID NO: 37220 - DNA, 20 bp, Artificial
  CRISPR gRNA sequence
caagactccagaaactatta

SEQ ID NO: 37221 - DNA, 20 bp, Artificial
  CRISPR gRNA sequence
aagactccagaaactattaa

SEQ ID NO: 37222 - DNA, 20 bp, Artificial
  CRISPR gRNA sequence
actccagaaactattaaggg

SEQ ID NO: 37223 - DNA, 20 bp, Artificial
  CRISPR gRNA sequence
cagaaactattaagggaagt

SEQ ID NO: 37224 - DNA, 20 bp, Artificial
  CRISPR gRNA sequence
agaaactattaagggaagtg

SEQ ID NO: 37225 - DNA, 20 bp, Artificial
  CRISPR gRNA sequence
ttaagggaagtgaggaaatg

SEQ ID NO: 37226 - DNA, 20 bp, Artificial
  CRISPR gRNA sequence
taagggaagtgaggaaatgt

SEQ ID NO: 37227 - DNA, 20 bp, Artificial
  CRISPR gRNA sequence
agtgaggaaatgtgggtgat

SEQ ID NO: 37228 - DNA, 20 bp, Artificial
  CRISPR gRNA sequence
aaatgtgggtgataagaaat

SEQ ID NO: 37229 - DNA, 20 bp, Artificial
  CRISPR gRNA sequence
aatgtgggtgataagaaatc

SEQ ID NO: 37230 - DNA, 20 bp, Artificial
  CRISPR gRNA sequence
tcgggatgataaaaccctaa

SEQ ID NO: 37231 - DNA, 20 bp, Artificial
  CRISPR gRNA sequence
gggatgataaaaccctaaca

SEQ ID NO: 37232 - DNA, 20 bp, Artificial
  CRISPR gRNA sequence
ggatgataaaaccctaacag

SEQ ID NO: 37233 - DNA, 20 bp, Artificial
  CRISPR gRNA sequence
atgataaaaccctaacagag

SEQ ID NO: 37234 - DNA, 20 bp, Artificial
  CRISPR gRNA sequence
tgataaaaccctaacagagg

SEQ ID NO: 37235 - DNA, 20 bp, Artificial
  CRISPR gRNA sequence
gataaaaccctaacagagga

SEQ ID NO: 37236 - DNA, 20 bp, Artificial
  CRISPR gRNA sequence
taaaaccctaacagaggagg

SEQ ID NO: 37237 - DNA, 20 bp, Artificial
  CRISPR gRNA sequence
aaaaccctaacagaggaggg

SEQ ID NO: 37238 - DNA, 20 bp, Artificial
  CRISPR gRNA sequence
ctaacagaggagggaggttg

SEQ ID NO: 37239 - DNA, 20 bp, Artificial
  CRISPR gRNA sequence
taacagaggagggaggttgc

SEQ ID NO: 37240 - DNA, 20 bp, Artificial
  CRISPR gRNA sequence
gaggagggaggttgcaggcc

SEQ ID NO: 37241 - DNA, 20 bp, Artificial
  CRISPR gRNA sequence
gcaggcctggccaaactcac

SEQ ID NO: 37242 - DNA, 20 bp, Artificial
  CRISPR gRNA sequence
caggcctggccaaactcact

SEQ ID NO: 37243 - DNA, 20 bp, Artificial
  CRISPR gRNA sequence
aacttcacttatatgaccac

SEQ ID NO: 37244 - DNA, 20 bp, Artificial
  CRISPR gRNA sequence
ttcacttatatgaccaccgg

SEQ ID NO: 37245 - DNA, 20 bp, Artificial
  CRISPR gRNA sequence
atgaccaccggcggcttcca

SEQ ID NO: 37246 - DNA, 20 bp, Artificial
  CRISPR gRNA sequence
gaccaccggcggcttccata

SEQ ID NO: 37247 - DNA, 20 bp, Artificial
  CRISPR gRNA sequence
ccggcggcttccatagagct

SEQ ID NO: 37248 - DNA, 20 bp, Artificial
  CRISPR gRNA sequence
agagcttggtccttccctga

SEQ ID NO: 37249 - DNA, 20 bp, Artificial
  CRISPR gRNA sequence
cttggtccttccctgatgga

SEQ ID NO: 37250 - DNA, 20 bp, Artificial
  CRISPR gRNA sequence
gtccttccctgatggacaga

SEQ ID NO: 37251 - DNA, 20 bp, Artificial
  CRISPR gRNA sequence
ctgatggacagatggccatt

SEQ ID NO: 37252 - DNA, 20 bp, Artificial
  CRISPR gRNA sequence
acagatggccatttagtgct

SEQ ID NO: 37253 - DNA, 20 bp, Artificial
  CRISPR gRNA sequence
agatggccatttagtgcttg

SEQ ID NO: 37254 - DNA, 20 bp, Artificial
  CRISPR gRNA sequence
gccatttagtgcttggagct

SEQ ID NO: 37255 - DNA, 20 bp, Artificial
  CRISPR gRNA sequence
tgcttggagctgagtgtttc

SEQ ID NO: 37256 - DNA, 20 bp, Artificial
  CRISPR gRNA sequence
gcttggagctgagtgtttct

SEQ ID NO: 37257 - DNA, 20 bp, Artificial
  CRISPR gRNA sequence
cttggagctgagtgtttctg

SEQ ID NO: 37258 - DNA, 20 bp, Artificial
  CRISPR gRNA sequence
ttggagctgagtgtttctgg

SEQ ID NO: 37259 - DNA, 20 bp, Artificial
  CRISPR gRNA sequence
tgagtgtttctgggggctgc

SEQ ID NO: 37260 - DNA, 20 bp, Artificial
  CRISPR gRNA sequence
ttctgggggctgctggctgt

SEQ ID NO: 37261 - DNA, 20 bp, Artificial
  CRISPR gRNA sequence
tggccctgcttcctgcatcc

SEQ ID NO: 37262 - DNA, 20 bp, Artificial
  CRISPR gRNA sequence
cttcctgcatcctggactgc

SEQ ID NO: 37263 - DNA, 20 bp, Artificial
  CRISPR gRNA sequence
atcctggactgcaagactgc

SEQ ID NO: 37264 - DNA, 20 bp, Artificial
  CRISPR gRNA sequence
tcctggactgcaagactgcc

SEQ ID NO: 37265 - DNA, 20 bp, Artificial
  CRISPR gRNA sequence
gactgcaagactgccaggcc

SEQ ID NO: 37266 - DNA, 20 bp, Artificial
  CRISPR gRNA sequence
ccagaacatccaccttccaa

SEQ ID NO: 37267 - DNA, 20 bp, Artificial
  CRISPR gRNA sequence
cagaacatccaccttccaat

SEQ ID NO: 37268 - DNA, 20 bp, Artificial
  CRISPR gRNA sequence
agaacatccaccttccaatg

SEQ ID NO: 37269 - DNA, 20 bp, Artificial
  CRISPR gRNA sequence
gaacatccaccttccaatgg

SEQ ID NO: 37270 - DNA, 20 bp, Artificial
  CRISPR gRNA sequence
caccttccaatgggggtgcc

SEQ ID NO: 37271 - DNA, 20 bp, Artificial
  CRISPR gRNA sequence
cttccaatgggggtgcctag

SEQ ID NO: 37272 - DNA, 20 bp, Artificial
  CRISPR gRNA sequence
ctagaagtccactctgcaaa

SEQ ID NO: 37273 - DNA, 20 bp, Artificial
  CRISPR gRNA sequence
gaagtccactctgcaaatag

SEQ ID NO: 37274 - DNA, 20 bp, Artificial
  CRISPR gRNA sequence
tccactctgcaaatagaagc

SEQ ID NO: 37275 - DNA, 20 bp, Artificial
  CRISPR gRNA sequence
aatagaagctggtgttgacc

SEQ ID NO: 37276 - DNA, 20 bp, Artificial
  CRISPR gRNA sequence
ctgcctgctgcctgcctttc

SEQ ID NO: 37277 - DNA, 20 bp, Artificial
  CRISPR gRNA sequence
gcctttccagtccctgcatg

SEQ ID NO: 37278 - DNA, 20 bp, Artificial
  CRISPR gRNA sequence
cctttccagtccctgcatgt

SEQ ID NO: 37279 - DNA, 20 bp, Artificial
  CRISPR gRNA sequence
tccctgcatgtgggtgtact

SEQ ID NO: 37280 - DNA, 20 bp, Artificial
  CRISPR gRNA sequence
ggctgcctgccacctgtctg

SEQ ID NO: 37281 - DNA, 20 bp, Artificial
  CRISPR gRNA sequence
cctgccacctgtctgtggac

SEQ ID NO: 37282 - DNA, 20 bp, Artificial
  CRISPR gRNA sequence
tgccacctgtctgtggactg

SEQ ID NO: 37283 - DNA, 20 bp, Artificial
  CRISPR gRNA sequence
ctgtggactggagttcccca

SEQ ID NO: 37284 - DNA, 20 bp, Artificial
  CRISPR gRNA sequence
tgtggactggagttccccaa

SEQ ID NO: 37285 - DNA, 20 bp, Artificial
  CRISPR gRNA sequence
ctggagttccccaaaggttc

SEQ ID NO: 37286 - DNA, 20 bp, Artificial
  CRISPR gRNA sequence
tggagttccccaaaggttct

SEQ ID NO: 37287 - DNA, 20 bp, Artificial
  CRISPR gRNA sequence
aaaggttctgggtaacccct

SEQ ID NO: 37288 - DNA, 20 bp, Artificial
  CRISPR gRNA sequence
ttctgggtaacccctcagcc

SEQ ID NO: 37289 - DNA, 20 bp, Artificial
  CRISPR gRNA sequence
aacccctcagcccagatccc

SEQ ID NO: 37290 - DNA, 20 bp, Artificial
  CRISPR gRNA sequence
caccccttcctttgcttttt

SEQ ID NO: 37291 - DNA, 20 bp, Artificial
  CRISPR gRNA sequence
accccttcctttgctttttc

SEQ ID NO: 37292 - DNA, 20 bp, Artificial
  CRISPR gRNA sequence
cctttgctttttcaggcctg

SEQ ID NO: 37293 - DNA, 20 bp, Artificial
  CRISPR gRNA sequence
caggcctgaagcgcccacat

SEQ ID NO: 37294 - DNA, 20 bp, Artificial
  CRISPR gRNA sequence
ggcctgaagcgcccacatca

SEQ ID NO: 37295 - DNA, 20 bp, Artificial
  CRISPR gRNA sequence
aagcgcccacatcagagctg

SEQ ID NO: 37296 - DNA, 20 bp, Artificial
  CRISPR gRNA sequence
agcgcccacatcagagctgt

SEQ ID NO: 37297 - DNA, 20 bp, Artificial
  CRISPR gRNA sequence
gctgtgggtcctcaccccgc

SEQ ID NO: 37298 - DNA, 20 bp, Artificial
  CRISPR gRNA sequence
gtgggtcctcaccccgccgg

SEQ ID NO: 37299 - DNA, 20 bp, Artificial
  CRISPR gRNA sequence
ggtcctcaccccgccggaag

SEQ ID NO: 37300 - DNA, 20 bp, Artificial
  CRISPR gRNA sequence
caccccgccggaagcagtgc

SEQ ID NO: 37301 - DNA, 20 bp, Artificial
  CRISPR gRNA sequence
cccgccggaagcagtgcaag

SEQ ID NO: 37302 - DNA, 20 bp, Artificial
  CRISPR gRNA sequence
gccggaagcagtgcaagaag

SEQ ID NO: 37303 - DNA, 20 bp, Artificial
  CRISPR gRNA sequence
ggaagcagtgcaagaagcag

SEQ ID NO: 37304 - DNA, 20 bp, Artificial
  CRISPR gRNA sequence
gcagtgcaagaagcagcagc

SEQ ID NO: 37305 - DNA, 20 bp, Artificial
  CRISPR gRNA sequence
cagtgcaagaagcagcagct

SEQ ID NO: 37306 - DNA, 20 bp, Artificial
  CRISPR gRNA sequence
tgcaagaagcagcagctagg

SEQ ID NO: 37307 - DNA, 20 bp, Artificial
  CRISPR gRNA sequence
gcaagaagcagcagctaggt

SEQ ID NO: 37308 - DNA, 20 bp, Artificial
  CRISPR gRNA sequence
agcagcagctaggtgggtac

SEQ ID NO: 37309 - DNA, 20 bp, Artificial
  CRISPR gRNA sequence
cagctaggtgggtaccagtg

SEQ ID NO: 37310 - DNA, 20 bp, Artificial
  CRISPR gRNA sequence
agctaggtgggtaccagtgt

SEQ ID NO: 37311 - DNA, 20 bp, Artificial
  CRISPR gRNA sequence
gctaggtgggtaccagtgtg

SEQ ID NO: 37312 - DNA, 20 bp, Artificial
  CRISPR gRNA sequence
taggtgggtaccagtgtggg

SEQ ID NO: 37313 - DNA, 20 bp, Artificial
  CRISPR gRNA sequence
aggtgggtaccagtgtgggg

SEQ ID NO: 37314 - DNA, 20 bp, Artificial
  CRISPR gRNA sequence
agtgtggggaggaacataaa

SEQ ID NO: 37315 - DNA, 20 bp, Artificial
  CRISPR gRNA sequence
tgtggggaggaacataaaca

SEQ ID NO: 37316 - DNA, 20 bp, Artificial
  CRISPR gRNA sequence
tggggaggaacataaacaga

SEQ ID NO: 37317 - DNA, 20 bp, Artificial
  CRISPR gRNA sequence
gaggaacataaacagagaga

SEQ ID NO: 37318 - DNA, 20 bp, Artificial
  CRISPR gRNA sequence
aggaacataaacagagagat

SEQ ID NO: 37319 - DNA, 20 bp, Artificial
  CRISPR gRNA sequence
ggaacataaacagagagatg

SEQ ID NO: 37320 - DNA, 20 bp, Artificial
  CRISPR gRNA sequence
aacagagagatggggttgcc

SEQ ID NO: 37321 - DNA, 20 bp, Artificial
  CRISPR gRNA sequence
acagagagatggggttgcct

SEQ ID NO: 37322 - DNA, 20 bp, Artificial
  CRISPR gRNA sequence
cagagagatggggttgcctg

SEQ ID NO: 37323 - DNA, 20 bp, Artificial
  CRISPR gRNA sequence
agagagatggggttgcctgg

SEQ ID NO: 37324 - DNA, 20 bp, Artificial
  CRISPR gRNA sequence
gatggggttgcctgggggcc

SEQ ID NO: 37325 - DNA, 20 bp, Artificial
  CRISPR gRNA sequence
gttgcctgggggccaagacc

SEQ ID NO: 37326 - DNA, 20 bp, Artificial
  CRISPR gRNA sequence
gggggccaagacccggaccc

SEQ ID NO: 37327 - DNA, 20 bp, Artificial
  CRISPR gRNA sequence
ggaccttgtcccctgccaat

SEQ ID NO: 37328 - DNA, 20 bp, Artificial
  CRISPR gRNA sequence
gtcccctgccaataagcctc

SEQ ID NO: 37329 - DNA, 20 bp, Artificial
  CRISPR gRNA sequence
cccctgccaataagcctcca

SEQ ID NO: 37330 - DNA, 20 bp, Artificial
  CRISPR gRNA sequence
ccctgccaataagcctccag

SEQ ID NO: 37331 - DNA, 20 bp, Artificial
  CRISPR gRNA sequence
ccaataagcctccagaggcc

SEQ ID NO: 37332 - DNA, 20 bp, Artificial
  CRISPR gRNA sequence
cccagtgactcttgtctcgc

SEQ ID NO: 37333 - DNA, 20 bp, Artificial
  CRISPR gRNA sequence
actcttgtctcgcaagtttc

SEQ ID NO: 37334 - DNA, 20 bp, Artificial
  CRISPR gRNA sequence
ctcttgtctcgcaagtttcc

SEQ ID NO: 37335 - DNA, 20 bp, Artificial
  CRISPR gRNA sequence
cttgtctcgcaagtttccag

SEQ ID NO: 37336 - DNA, 20 bp, Artificial
  CRISPR gRNA sequence
ctcgcaagtttccaggagaa

SEQ ID NO: 37337 - DNA, 20 bp, Artificial
  CRISPR gRNA sequence
tcgcaagtttccaggagaaa

SEQ ID NO: 37338 - DNA, 20 bp, Artificial
  CRISPR gRNA sequence
agtttccaggagaaaaggac

SEQ ID NO: 37339 - DNA, 20 bp, Artificial
  CRISPR gRNA sequence
tttccaggagaaaaggactg

SEQ ID NO: 37340 - DNA, 20 bp, Artificial
  CRISPR gRNA sequence
ttccaggagaaaaggactgg

SEQ ID NO: 37341 - DNA, 20 bp, Artificial
  CRISPR gRNA sequence
aaaggactggaggtcttgca

SEQ ID NO: 37342 - DNA, 20 bp, Artificial
  CRISPR gRNA sequence
aaggactggaggtcttgcac

SEQ ID NO: 37343 - DNA, 20 bp, Artificial
  CRISPR gRNA sequence
gactggaggtcttgcacagg

SEQ ID NO: 37344 - DNA, 20 bp, Artificial
  CRISPR gRNA sequence
ctggaggtcttgcacaggca

SEQ ID NO: 37345 - DNA, 20 bp, Artificial
  CRISPR gRNA sequence
tggaggtcttgcacaggcag

SEQ ID NO: 37346 - DNA, 20 bp, Artificial
  CRISPR gRNA sequence
gaggtcttgcacaggcagag

SEQ ID NO: 37347 - DNA, 20 bp, Artificial
  CRISPR gRNA sequence
ggtcttgcacaggcagagga

SEQ ID NO: 37348 - DNA, 20 bp, Artificial
  CRISPR gRNA sequence
gtcttgcacaggcagaggag

SEQ ID NO: 37349 - DNA, 20 bp, Artificial
  CRISPR gRNA sequence
gcacaggcagaggagaggcc

SEQ ID NO: 37350 - DNA, 20 bp, Artificial
  CRISPR gRNA sequence
cacaggcagaggagaggcct

SEQ ID NO: 37351 - DNA, 20 bp, Artificial
  CRISPR gRNA sequence
ggcagaggagaggcctgggc

SEQ ID NO: 37352 - DNA, 20 bp, Artificial
  CRISPR gRNA sequence
agaggagaggcctgggctgg

SEQ ID NO: 37353 - DNA, 20 bp, Artificial
  CRISPR gRNA sequence
agaggcctgggctggcagcg

SEQ ID NO: 37354 - DNA, 20 bp, Artificial
  CRISPR gRNA sequence
gaggcctgggctggcagcga

SEQ ID NO: 37355 - DNA, 20 bp, Artificial
  CRISPR gRNA sequence
aggcctgggctggcagcgaa

SEQ ID NO: 37356 - DNA, 20 bp, Artificial
  CRISPR gRNA sequence
ggcctgggctggcagcgaag

SEQ ID NO: 37357 - DNA, 20 bp, Artificial
  CRISPR gRNA sequence
gaaggggctccccacccatc

SEQ ID NO: 37358 - DNA, 20 bp, Artificial
  CRISPR gRNA sequence
tccccacccatctggctgca

SEQ ID NO: 37359 - DNA, 20 bp, Artificial
  CRISPR gRNA sequence
ccccacccatctggctgcat

SEQ ID NO: 37360 - DNA, 20 bp, Artificial
  CRISPR gRNA sequence
cccacccatctggctgcatg

SEQ ID NO: 37361 - DNA, 20 bp, Artificial
  CRISPR gRNA sequence
gctgcatggggacttctctg

SEQ ID NO: 37362 - DNA, 20 bp, Artificial
  CRISPR gRNA sequence
tgcatggggacttctctgaa

SEQ ID NO: 37363 - DNA, 20 bp, Artificial
  CRISPR gRNA sequence
gcatggggacttctctgaag

SEQ ID NO: 37364 - DNA, 20 bp, Artificial
  CRISPR gRNA sequence
catggggacttctctgaaga

SEQ ID NO: 37365 - DNA, 20 bp, Artificial
  CRISPR gRNA sequence
ctctgaagagggctccgctg

SEQ ID NO: 37366 - DNA, 20 bp, Artificial
  CRISPR gRNA sequence
tctgaagagggctccgctga

SEQ ID NO: 37367 - DNA, 20 bp, Artificial
  CRISPR gRNA sequence
tgaagagggctccgctgaag

SEQ ID NO: 37368 - DNA, 20 bp, Artificial
  CRISPR gRNA sequence
gagggctccgctgaaggagc

SEQ ID NO: 37369 - DNA, 20 bp, Artificial
  CRISPR gRNA sequence
ggctccgctgaaggagctgg

SEQ ID NO: 37370 - DNA, 20 bp, Artificial
  CRISPR gRNA sequence
aaggagctggaagcaccata

SEQ ID NO: 37371 - DNA, 20 bp, Artificial
  CRISPR gRNA sequence
aggagctggaagcaccatac

SEQ ID NO: 37372 - DNA, 20 bp, Artificial
  CRISPR gRNA sequence
tggaagcaccatacaggtct

SEQ ID NO: 37373 - DNA, 20 bp, Artificial
  CRISPR gRNA sequence
caggtctcagcttcgctgtc

SEQ ID NO: 37374 - DNA, 20 bp, Artificial
  CRISPR gRNA sequence
aggtctcagcttcgctgtcc

SEQ ID NO: 37375 - DNA, 20 bp, Artificial
  CRISPR gRNA sequence
cttcgctgtccaggcttttc

SEQ ID NO: 37376 - DNA, 20 bp, Artificial
  CRISPR gRNA sequence
ttcgctgtccaggcttttcc

SEQ ID NO: 37377 - DNA, 20 bp, Artificial
  CRISPR gRNA sequence
tcgctgtccaggcttttcca

SEQ ID NO: 37378 - DNA, 20 bp, Artificial
  CRISPR gRNA sequence
ccagggacaccctatgtcct

SEQ ID NO: 37379 - DNA, 20 bp, Artificial
  CRISPR gRNA sequence
accctatgtcctcagtgttg

SEQ ID NO: 37380 - DNA, 20 bp, Artificial
  CRISPR gRNA sequence
ccctatgtcctcagtgttga

SEQ ID NO: 37381 - DNA, 20 bp, Artificial
  CRISPR gRNA sequence
ctatgtcctcagtgttgaag

SEQ ID NO: 37382 - DNA, 20 bp, Artificial
  CRISPR gRNA sequence
cctcagtgttgaaggagacc

SEQ ID NO: 37383 - DNA, 20 bp, Artificial
  CRISPR gRNA sequence
ctcagtgttgaaggagaccc

SEQ ID NO: 37384 - DNA, 20 bp, Artificial
  CRISPR gRNA sequence
tcagtgttgaaggagaccca

SEQ ID NO: 37385 - DNA, 20 bp, Artificial
  CRISPR gRNA sequence
agtgttgaaggagacccagg

SEQ ID NO: 37386 - DNA, 20 bp, Artificial
  CRISPR gRNA sequence
gtgttgaaggagacccaggg

SEQ ID NO: 37387 - DNA, 20 bp, Artificial
  CRISPR gRNA sequence
gttgaaggagacccagggag

SEQ ID NO: 37388 - DNA, 20 bp, Artificial
  CRISPR gRNA sequence
aggagacccagggaggagac

SEQ ID NO: 37389 - DNA, 20 bp, Artificial
  CRISPR gRNA sequence
acccagggaggagaccagtt

SEQ ID NO: 37390 - DNA, 20 bp, Artificial
  CRISPR gRNA sequence
cccagggaggagaccagttt

SEQ ID NO: 37391 - DNA, 20 bp, Artificial
  CRISPR gRNA sequence
ccagggaggagaccagtttg

SEQ ID NO: 37392 - DNA, 20 bp, Artificial
  CRISPR gRNA sequence
cagggaggagaccagtttgg

SEQ ID NO: 37393 - DNA, 20 bp, Artificial
  CRISPR gRNA sequence
gaggagaccagtttgggggt

SEQ ID NO: 37394 - DNA, 20 bp, Artificial
  CRISPR gRNA sequence
gagaccagtttgggggtgag

SEQ ID NO: 37395 - DNA, 20 bp, Artificial
  CRISPR gRNA sequence
agaccagtttgggggtgagc

SEQ ID NO: 37396 - DNA, 20 bp, Artificial
  CRISPR gRNA sequence
gaccagtttgggggtgagca

SEQ ID NO: 37397 - DNA, 20 bp, Artificial
  CRISPR gRNA sequence
agtttgggggtgagcaggga

SEQ ID NO: 37398 - DNA, 20 bp, Artificial
  CRISPR gRNA sequence
gtttgggggtgagcagggat

SEQ ID NO: 37399 - DNA, 20 bp, Artificial
  CRISPR gRNA sequence
tttgggggtgagcagggatg

SEQ ID NO: 37400 - DNA, 20 bp, Artificial
  CRISPR gRNA sequence
tgggggtgagcagggatggg

SEQ ID NO: 37401 - DNA, 20 bp, Artificial
  CRISPR gRNA sequence
gggggtgagcagggatgggg

SEQ ID NO: 37402 - DNA, 20 bp, Artificial
  CRISPR gRNA sequence
ggggtgagcagggatgggga

SEQ ID NO: 37403 - DNA, 20 bp, Artificial
  CRISPR gRNA sequence
gggtgagcagggatggggag

SEQ ID NO: 37404 - DNA, 20 bp, Artificial
  CRISPR gRNA sequence
gagcagggatggggaggggt

SEQ ID NO: 37405 - DNA, 20 bp, Artificial
  CRISPR gRNA sequence
agcagggatggggaggggtg

SEQ ID NO: 37406 - DNA, 20 bp, Artificial
  CRISPR gRNA sequence
cagggatggggaggggtgag

SEQ ID NO: 37407 - DNA, 20 bp, Artificial
  CRISPR gRNA sequence
agggatggggaggggtgagg

SEQ ID NO: 37408 - DNA, 20 bp, Artificial
  CRISPR gRNA sequence
tggggaggggtgaggaggcc

SEQ ID NO: 37409 - DNA, 20 bp, Artificial
  CRISPR gRNA sequence
ggggaggggtgaggaggcct

SEQ ID NO: 37410 - DNA, 20 bp, Artificial
  CRISPR gRNA sequence
ggaggggtgaggaggcctgg

SEQ ID NO: 37411 - DNA, 20 bp, Artificial
  CRISPR gRNA sequence
gaggcctgggagaaaccttc

SEQ ID NO: 37412 - DNA, 20 bp, Artificial
  CRISPR gRNA sequence
cctgggagaaaccttcaaga

SEQ ID NO: 37413 - DNA, 20 bp, Artificial
  CRISPR gRNA sequence
tgggagaaaccttcaagaca

SEQ ID NO: 37414 - DNA, 20 bp, Artificial
  CRISPR gRNA sequence
gggagaaaccttcaagacag

SEQ ID NO: 37415 - DNA, 20 bp, Artificial
  CRISPR gRNA sequence
aaccttcaagacagaggccc

SEQ ID NO: 37416 - DNA, 20 bp, Artificial
  CRISPR gRNA sequence
accttcaagacagaggccct

SEQ ID NO: 37417 - DNA, 20 bp, Artificial
  CRISPR gRNA sequence
ccttcaagacagaggccctg

SEQ ID NO: 37418 - DNA, 20 bp, Artificial
  CRISPR gRNA sequence
cttcaagacagaggccctgg

SEQ ID NO: 37419 - DNA, 20 bp, Artificial
  CRISPR gRNA sequence
acagaggccctgggggccca

SEQ ID NO: 37420 - DNA, 20 bp, Artificial
  CRISPR gRNA sequence
cagaggccctgggggcccat

SEQ ID NO: 37421 - DNA, 20 bp, Artificial
  CRISPR gRNA sequence
agaggccctgggggcccatg

SEQ ID NO: 37422 - DNA, 20 bp, Artificial
  CRISPR gRNA sequence
aggccctgggggcccatggg

SEQ ID NO: 37423 - DNA, 20 bp, Artificial
  CRISPR gRNA sequence
tgggggcccatggggagaca

SEQ ID NO: 37424 - DNA, 20 bp, Artificial
  CRISPR gRNA sequence
ggggcccatggggagacatg

SEQ ID NO: 37425 - DNA, 20 bp, Artificial
  CRISPR gRNA sequence
tggggagacatggagctgct

SEQ ID NO: 37426 - DNA, 20 bp, Artificial
  CRISPR gRNA sequence
ggggagacatggagctgctt

SEQ ID NO: 37427 - DNA, 20 bp, Artificial
  CRISPR gRNA sequence
gggagacatggagctgctta

SEQ ID NO: 37428 - DNA, 20 bp, Artificial
  CRISPR gRNA sequence
agacatggagctgcttaggg

SEQ ID NO: 37429 - DNA, 20 bp, Artificial
  CRISPR gRNA sequence
gacatggagctgcttagggc

SEQ ID NO: 37430 - DNA, 20 bp, Artificial
  CRISPR gRNA sequence
tggagctgcttagggcaggc

SEQ ID NO: 37431 - DNA, 20 bp, Artificial
  CRISPR gRNA sequence
ggagctgcttagggcaggcc

SEQ ID NO: 37432 - DNA, 20 bp, Artificial
  CRISPR gRNA sequence
ctgcttagggcaggccaggc

SEQ ID NO: 37433 - DNA, 20 bp, Artificial
  CRISPR gRNA sequence
ttagggcaggccaggccagt

SEQ ID NO: 37434 - DNA, 20 bp, Artificial
  CRISPR gRNA sequence
agggcaggccaggccagtga

SEQ ID NO: 37435 - DNA, 20 bp, Artificial
  CRISPR gRNA sequence
gcaggccaggccagtgagag

SEQ ID NO: 37436 - DNA, 20 bp, Artificial
  CRISPR gRNA sequence
gccaggccagtgagagaaga

SEQ ID NO: 37437 - DNA, 20 bp, Artificial
  CRISPR gRNA sequence
ccaggccagtgagagaagaa

SEQ ID NO: 37438 - DNA, 20 bp, Artificial
  CRISPR gRNA sequence
caggccagtgagagaagaaa

SEQ ID NO: 37439 - DNA, 20 bp, Artificial
  CRISPR gRNA sequence
aggccagtgagagaagaaag

SEQ ID NO: 37440 - DNA, 20 bp, Artificial
  CRISPR gRNA sequence
ggacttctctcattcttgac

SEQ ID NO: 37441 - DNA, 20 bp, Artificial
  CRISPR gRNA sequence
tctcattcttgaccagttct

SEQ ID NO: 37442 - DNA, 20 bp, Artificial
  CRISPR gRNA sequence
ttcttgaccagttctcagaa

SEQ ID NO: 37443 - DNA, 20 bp, Artificial
  CRISPR gRNA sequence
gaatggtcctcgttctccac

SEQ ID NO: 37444 - DNA, 20 bp, Artificial
  CRISPR gRNA sequence
ccacgagttgtcccactaac

SEQ ID NO: 37445 - DNA, 20 bp, Artificial
  CRISPR gRNA sequence
acgagttgtcccactaacta

SEQ ID NO: 37446 - DNA, 20 bp, Artificial
  CRISPR gRNA sequence
gcccccactgctgccaacca

SEQ ID NO: 37447 - DNA, 20 bp, Artificial
  CRISPR gRNA sequence
ctgccaaccatggctataac

SEQ ID NO: 37448 - DNA, 20 bp, Artificial
  CRISPR gRNA sequence
gccaaccatggctataacca

SEQ ID NO: 37449 - DNA, 20 bp, Artificial
  CRISPR gRNA sequence
ccaaccatggctataaccag

SEQ ID NO: 37450 - DNA, 20 bp, Artificial
  CRISPR gRNA sequence
ggattcacatccgctcaaaa

SEQ ID NO: 37451 - DNA, 20 bp, Artificial
  CRISPR gRNA sequence
ctcaaaatagttcactacct

SEQ ID NO: 37452 - DNA, 20 bp, Artificial
  CRISPR gRNA sequence
actaccttggcctttcccca

SEQ ID NO: 37453 - DNA, 20 bp, Artificial
  CRISPR gRNA sequence
ctaccttggcctttccccat

SEQ ID NO: 37454 - DNA, 20 bp, Artificial
  CRISPR gRNA sequence
taccttggcctttccccata

SEQ ID NO: 37455 - DNA, 20 bp, Artificial
  CRISPR gRNA sequence
tccccatagggttcccccaa

SEQ ID NO: 37456 - DNA, 20 bp, Artificial
  CRISPR gRNA sequence
ccatagggttcccccaaaag

SEQ ID NO: 37457 - DNA, 20 bp, Artificial
  CRISPR gRNA sequence
ggttcccccaaaagcagccc

SEQ ID NO: 37458 - DNA, 20 bp, Artificial
  CRISPR gRNA sequence
agcagccccagccctttccc

SEQ ID NO: 37459 - DNA, 20 bp, Artificial
  CRISPR gRNA sequence
gcagccccagccctttccct

SEQ ID NO: 37460 - DNA, 20 bp, Artificial
  CRISPR gRNA sequence
gccctttccctgggtcacct

SEQ ID NO: 37461 - DNA, 20 bp, Artificial
  CRISPR gRNA sequence
cctgagacctctcaatgacc

SEQ ID NO: 37462 - DNA, 20 bp, Artificial
  CRISPR gRNA sequence
ctgagacctctcaatgaccc

SEQ ID NO: 37463 - DNA, 20 bp, Artificial
  CRISPR gRNA sequence
ctcaatgacccaggaattaa

SEQ ID NO: 37464 - DNA, 20 bp, Artificial
  CRISPR gRNA sequence
tcaatgacccaggaattaaa

SEQ ID NO: 37465 - DNA, 20 bp, Artificial
  CRISPR gRNA sequence
ggaattaaaaggttaacatc

SEQ ID NO: 37466 - DNA, 20 bp, Artificial
  CRISPR gRNA sequence
aaggttaacatctggcactg

SEQ ID NO: 37467 - DNA, 20 bp, Artificial
  CRISPR gRNA sequence
aggttaacatctggcactgt

SEQ ID NO: 37468 - DNA, 20 bp, Artificial
  CRISPR gRNA sequence
ggttaacatctggcactgta

SEQ ID NO: 37469 - DNA, 20 bp, Artificial
  CRISPR gRNA sequence
gttaacatctggcactgtag

SEQ ID NO: 37470 - DNA, 20 bp, Artificial
  CRISPR gRNA sequence
catctggcactgtaggggcc

SEQ ID NO: 37471 - DNA, 20 bp, Artificial
  CRISPR gRNA sequence
ctgtaggggcccagctccca

SEQ ID NO: 37472 - DNA, 20 bp, Artificial
  CRISPR gRNA sequence
ccagctcccacagttccgat

SEQ ID NO: 37473 - DNA, 20 bp, Artificial
  CRISPR gRNA sequence
cagttccgatcggtaatgcc

SEQ ID NO: 37474 - DNA, 20 bp, Artificial
  CRISPR gRNA sequence
agttccgatcggtaatgcct

SEQ ID NO: 37475 - DNA, 20 bp, Artificial
  CRISPR gRNA sequence
atcggtaatgcctaggccta

SEQ ID NO: 37476 - DNA, 20 bp, Artificial
  CRISPR gRNA sequence
tcggtaatgcctaggcctac

SEQ ID NO: 37477 - DNA, 20 bp, Artificial
  CRISPR gRNA sequence
tgcctaggcctacaggttgt

SEQ ID NO: 37478 - DNA, 20 bp, Artificial
  CRISPR gRNA sequence
aggttgttagtgctcacccc

SEQ ID NO: 37479 - DNA, 20 bp, Artificial
  CRISPR gRNA sequence
ggttgttagtgctcacccct

SEQ ID NO: 37480 - DNA, 20 bp, Artificial
  CRISPR gRNA sequence
gtgctcacccctgggcattg

SEQ ID NO: 37481 - DNA, 20 bp, Artificial
  CRISPR gRNA sequence
gcattgcagaactgaaatat

SEQ ID NO: 37482 - DNA, 20 bp, Artificial
  CRISPR gRNA sequence
cattgcagaactgaaatatt

SEQ ID NO: 37483 - DNA, 20 bp, Artificial
  CRISPR gRNA sequence
tgcagaactgaaatattggg

SEQ ID NO: 37484 - DNA, 20 bp, Artificial
  CRISPR gRNA sequence
cagaactgaaatattgggaa

SEQ ID NO: 37485 - DNA, 20 bp, Artificial
  CRISPR gRNA sequence
agaactgaaatattgggaag

SEQ ID NO: 37486 - DNA, 20 bp, Artificial
  CRISPR gRNA sequence
gaaatattgggaagaggcac

SEQ ID NO: 37487 - DNA, 20 bp, Artificial
  CRISPR gRNA sequence
aaatattgggaagaggcact

SEQ ID NO: 37488 - DNA, 20 bp, Artificial
  CRISPR gRNA sequence
aatattgggaagaggcactg

SEQ ID NO: 37489 - DNA, 20 bp, Artificial
  CRISPR gRNA sequence
gggaagaggcactggggatc

SEQ ID NO: 37490 - DNA, 20 bp, Artificial
  CRISPR gRNA sequence
cactggggatccagatatta

SEQ ID NO: 37491 - DNA, 20 bp, Artificial
  CRISPR gRNA sequence
ggggatccagatattacaga

SEQ ID NO: 37492 - DNA, 20 bp, Artificial
  CRISPR gRNA sequence
ggatccagatattacagaaa

SEQ ID NO: 37493 - DNA, 20 bp, Artificial
  CRISPR gRNA sequence
gatccagatattacagaaag

SEQ ID NO: 37494 - DNA, 20 bp, Artificial
  CRISPR gRNA sequence
cagaaagaggttgtttcaat

SEQ ID NO: 37495 - DNA, 20 bp, Artificial
  CRISPR gRNA sequence
tgtttcaataagatattgca

SEQ ID NO: 37496 - DNA, 20 bp, Artificial
  CRISPR gRNA sequence
ttcaataagatattgcaaag

SEQ ID NO: 37497 - DNA, 20 bp, Artificial
  CRISPR gRNA sequence
ataagatattgcaaagtagc

SEQ ID NO: 37498 - DNA, 20 bp, Artificial
  CRISPR gRNA sequence
taagatattgcaaagtagct

SEQ ID NO: 37499 - DNA, 20 bp, Artificial
  CRISPR gRNA sequence
tattgcaaagtagctgggcg

SEQ ID NO: 37500 - DNA, 20 bp, Artificial
  CRISPR gRNA sequence
tgcaaagtagctgggcgcgg

SEQ ID NO: 37501 - DNA, 20 bp, Artificial
  CRISPR gRNA sequence
gtggctcacacctgtaatcc

SEQ ID NO: 37502 - DNA, 20 bp, Artificial
  CRISPR gRNA sequence
cacctgtaatcccagcactt

SEQ ID NO: 37503 - DNA, 20 bp, Artificial
  CRISPR gRNA sequence
cctgtaatcccagcactttg

SEQ ID NO: 37504 - DNA, 20 bp, Artificial
  CRISPR gRNA sequence
ctgtaatcccagcactttgg

SEQ ID NO: 37505 - DNA, 20 bp, Artificial
  CRISPR gRNA sequence
tgtaatcccagcactttgga

SEQ ID NO: 37506 - DNA, 20 bp, Artificial
  CRISPR gRNA sequence
tcccagcactttggagggct

SEQ ID NO: 37507 - DNA, 20 bp, Artificial
  CRISPR gRNA sequence
cccagcactttggagggctg

SEQ ID NO: 37508 - DNA, 20 bp, Artificial
  CRISPR gRNA sequence
agcactttggagggctgagg

SEQ ID NO: 37509 - DNA, 20 bp, Artificial
  CRISPR gRNA sequence
gcactttggagggctgaggc

SEQ ID NO: 37510 - DNA, 20 bp, Artificial
  CRISPR gRNA sequence
ctttggagggctgaggcagg

SEQ ID NO: 37511 - DNA, 20 bp, Artificial
  CRISPR gRNA sequence
gagggctgaggcaggtggat

SEQ ID NO: 37512 - DNA, 20 bp, Artificial
  CRISPR gRNA sequence
ctgaggcaggtggatcagtt

SEQ ID NO: 37513 - DNA, 20 bp, Artificial
  CRISPR gRNA sequence
gcaggtggatcagttgagcc

SEQ ID NO: 37514 - DNA, 20 bp, Artificial
  CRISPR gRNA sequence
caggtggatcagttgagccc

SEQ ID NO: 37515 - DNA, 20 bp, Artificial
  CRISPR gRNA sequence
tgagcccaggaattcaatac

SEQ ID NO: 37516 - DNA, 20 bp, Artificial
  CRISPR gRNA sequence
ccaggaattcaatactagcc

SEQ ID NO: 37517 - DNA, 20 bp, Artificial
  CRISPR gRNA sequence
tctactaaaaatacaaaaat

SEQ ID NO: 37518 - DNA, 20 bp, Artificial
  CRISPR gRNA sequence
ctaaaaatacaaaaattagc

SEQ ID NO: 37519 - DNA, 20 bp, Artificial
  CRISPR gRNA sequence
taaaaatacaaaaattagct

SEQ ID NO: 37520 - DNA, 20 bp, Artificial
  CRISPR gRNA sequence
atacaaaaattagctgggtg

SEQ ID NO: 37521 - DNA, 20 bp, Artificial
  CRISPR gRNA sequence
caaaaattagctgggtgtgg

SEQ ID NO: 37522 - DNA, 20 bp, Artificial
  CRISPR gRNA sequence
ggtgtggtggtgtgcacctg

SEQ ID NO: 37523 - DNA, 20 bp, Artificial
  CRISPR gRNA sequence
gtggtgtgcacctgtagtcc

SEQ ID NO: 37524 - DNA, 20 bp, Artificial
  CRISPR gRNA sequence
cacctgtagtcccagctact

SEQ ID NO: 37525 - DNA, 20 bp, Artificial
  CRISPR gRNA sequence
acctgtagtcccagctactc

SEQ ID NO: 37526 - DNA, 20 bp, Artificial
  CRISPR gRNA sequence
ctgtagtcccagctactcag

SEQ ID NO: 37527 - DNA, 20 bp, Artificial
  CRISPR gRNA sequence
tgtagtcccagctactcagg

SEQ ID NO: 37528 - DNA, 20 bp, Artificial
  CRISPR gRNA sequence
tcccagctactcaggaggct

SEQ ID NO: 37529 - DNA, 20 bp, Artificial
  CRISPR gRNA sequence
cccagctactcaggaggctg

SEQ ID NO: 37530 - DNA, 20 bp, Artificial
  CRISPR gRNA sequence
agctactcaggaggctgagg

SEQ ID NO: 37531 - DNA, 20 bp, Artificial
  CRISPR gRNA sequence
gctactcaggaggctgaggc

SEQ ID NO: 37532 - DNA, 20 bp, Artificial
  CRISPR gRNA sequence
tactcaggaggctgaggcag

SEQ ID NO: 37533 - DNA, 20 bp, Artificial
  CRISPR gRNA sequence
actcaggaggctgaggcagg

SEQ ID NO: 37534 - DNA, 20 bp, Artificial
  CRISPR gRNA sequence
ctgaggcaggaggatcactt

SEQ ID NO: 37535 - DNA, 20 bp, Artificial
  CRISPR gRNA sequence
gcaggaggatcacttgagac

SEQ ID NO: 37536 - DNA, 20 bp, Artificial
  CRISPR gRNA sequence
caggaggatcacttgagacc

SEQ ID NO: 37537 - DNA, 20 bp, Artificial
  CRISPR gRNA sequence
ggaggatcacttgagaccag

SEQ ID NO: 37538 - DNA, 20 bp, Artificial
  CRISPR gRNA sequence
cacttgagaccaggagtttg

SEQ ID NO: 37539 - DNA, 20 bp, Artificial
  CRISPR gRNA sequence
agaccaggagtttgcggcta

SEQ ID NO: 37540 - DNA, 20 bp, Artificial
  CRISPR gRNA sequence
caggagtttgcggctacagt

SEQ ID NO: 37541 - DNA, 20 bp, Artificial
  CRISPR gRNA sequence
agtttgcggctacagtaagc

SEQ ID NO: 37542 - DNA, 20 bp, Artificial
  CRISPR gRNA sequence
gtttgcggctacagtaagct

SEQ ID NO: 37543 - DNA, 20 bp, Artificial
  CRISPR gRNA sequence
ctaggatcgtgccactgcac

SEQ ID NO: 37544 - DNA, 20 bp, Artificial
  CRISPR gRNA sequence
aggatcgtgccactgcactg

SEQ ID NO: 37545 - DNA, 20 bp, Artificial
  CRISPR gRNA sequence
cgtgccactgcactggagcc

SEQ ID NO: 37546 - DNA, 20 bp, Artificial
  CRISPR gRNA sequence
gtgccactgcactggagcct

SEQ ID NO: 37547 - DNA, 20 bp, Artificial
  CRISPR gRNA sequence
cactgcactggagcctgggc

SEQ ID NO: 37548 - DNA, 20 bp, Artificial
  CRISPR gRNA sequence
actggagcctgggcaagact

SEQ ID NO: 37549 - DNA, 20 bp, Artificial
  CRISPR gRNA sequence
caagactgagactctgtctc

SEQ ID NO: 37550 - DNA, 20 bp, Artificial
  CRISPR gRNA sequence
aagactgagactctgtctct

SEQ ID NO: 37551 - DNA, 20 bp, Artificial
  CRISPR gRNA sequence
agactctgtctctgggaaaa

SEQ ID NO: 37552 - DNA, 20 bp, Artificial
  CRISPR gRNA sequence
ctctgggaaaaaagaaaaaa

SEQ ID NO: 37553 - DNA, 20 bp, Artificial
  CRISPR gRNA sequence
ctgggaaaaaagaaaaaaaa

SEQ ID NO: 37554 - DNA, 20 bp, Artificial
  CRISPR gRNA sequence
gaaaaaaaagagatgttgca

SEQ ID NO: 37555 - DNA, 20 bp, Artificial
  CRISPR gRNA sequence
aaaaaaaagagatgttgcaa

SEQ ID NO: 37556 - DNA, 20 bp, Artificial
  CRISPR gRNA sequence
aaaaaagagatgttgcaaag

SEQ ID NO: 37557 - DNA, 20 bp, Artificial
  CRISPR gRNA sequence
aaaaagagatgttgcaaagg

SEQ ID NO: 37558 - DNA, 20 bp, Artificial
  CRISPR gRNA sequence
ttacaccacgtgtactattg

SEQ ID NO: 37559 - DNA, 20 bp, Artificial
  CRISPR gRNA sequence
ccacgtgtactattgcagaa

SEQ ID NO: 37560 - DNA, 20 bp, Artificial
  CRISPR gRNA sequence
gtgtactattgcagaatgga

SEQ ID NO: 37561 - DNA, 20 bp, Artificial
  CRISPR gRNA sequence
ttcccacctgcctgtttaaa

SEQ ID NO: 37562 - DNA, 20 bp, Artificial
  CRISPR gRNA sequence
ctgcctgtttaaatagctac

SEQ ID NO: 37563 - DNA, 20 bp, Artificial
  CRISPR gRNA sequence
gcctgtttaaatagctaccg

SEQ ID NO: 37564 - DNA, 20 bp, Artificial
  CRISPR gRNA sequence
ctgtttaaatagctaccgga

SEQ ID NO: 37565 - DNA, 20 bp, Artificial
  CRISPR gRNA sequence
ccggagagcctatgctccct

SEQ ID NO: 37566 - DNA, 20 bp, Artificial
  CRISPR gRNA sequence
cccttagaactgattccttc

SEQ ID NO: 37567 - DNA, 20 bp, Artificial
  CRISPR gRNA sequence
ttagaactgattccttctgg

SEQ ID NO: 37568 - DNA, 20 bp, Artificial
  CRISPR gRNA sequence
aactgattccttctggaagt

SEQ ID NO: 37569 - DNA, 20 bp, Artificial
  CRISPR gRNA sequence
actgattccttctggaagtt

SEQ ID NO: 37570 - DNA, 20 bp, Artificial
  CRISPR gRNA sequence
ctgattccttctggaagttg

SEQ ID NO: 37571 - DNA, 20 bp, Artificial
  CRISPR gRNA sequence
attccttctggaagttgggg

SEQ ID NO: 37572 - DNA, 20 bp, Artificial
  CRISPR gRNA sequence
ttctggaagttggggtggca

SEQ ID NO: 37573 - DNA, 20 bp, Artificial
  CRISPR gRNA sequence
gggtggcacagatcccccta

SEQ ID NO: 37574 - DNA, 20 bp, Artificial
  CRISPR gRNA sequence
ccccatcatacatacacatc

SEQ ID NO: 37575 - DNA, 20 bp, Artificial
  CRISPR gRNA sequence
cccatcatacatacacatct

SEQ ID NO: 37576 - DNA, 20 bp, Artificial
  CRISPR gRNA sequence
ccatcatacatacacatctg

SEQ ID NO: 37577 - DNA, 20 bp, Artificial
  CRISPR gRNA sequence
tacatacacatctggggcta

SEQ ID NO: 37578 - DNA, 20 bp, Artificial
  CRISPR gRNA sequence
acatacacatctggggctac

SEQ ID NO: 37579 - DNA, 20 bp, Artificial
  CRISPR gRNA sequence
ctggggctacaggctcccaa

SEQ ID NO: 37580 - DNA, 20 bp, Artificial
  CRISPR gRNA sequence
ggctcccaacagcccaatac

SEQ ID NO: 37581 - DNA, 20 bp, Artificial
  CRISPR gRNA sequence
gctcccaacagcccaatact

SEQ ID NO: 37582 - DNA, 20 bp, Artificial
  CRISPR gRNA sequence
ctcccaacagcccaatactg

SEQ ID NO: 37583 - DNA, 20 bp, Artificial
  CRISPR gRNA sequence
caacagcccaatactggggc

SEQ ID NO: 37584 - DNA, 20 bp, Artificial
  CRISPR gRNA sequence
cagcccaatactggggcaag

SEQ ID NO: 37585 - DNA, 20 bp, Artificial
  CRISPR gRNA sequence
atactggggcaagaagacat

SEQ ID NO: 37586 - DNA, 20 bp, Artificial
  CRISPR gRNA sequence
ctggggcaagaagacatgag

SEQ ID NO: 37587 - DNA, 20 bp, Artificial
  CRISPR gRNA sequence
ggggcaagaagacatgagca

SEQ ID NO: 37588 - DNA, 20 bp, Artificial
  CRISPR gRNA sequence
gggcaagaagacatgagcag

SEQ ID NO: 37589 - DNA, 20 bp, Artificial
  CRISPR gRNA sequence
ggcaagaagacatgagcaga

SEQ ID NO: 37590 - DNA, 20 bp, Artificial
  CRISPR gRNA sequence
agaagacatgagcagagggc

SEQ ID NO: 37591 - DNA, 20 bp, Artificial
  CRISPR gRNA sequence
gaagacatgagcagagggcc

SEQ ID NO: 37592 - DNA, 20 bp, Artificial
  CRISPR gRNA sequence
aagacatgagcagagggccg

SEQ ID NO: 37593 - DNA, 20 bp, Artificial
  CRISPR gRNA sequence
agacatgagcagagggccgg

SEQ ID NO: 37594 - DNA, 20 bp, Artificial
  CRISPR gRNA sequence
gacatgagcagagggccggg

SEQ ID NO: 37595 - DNA, 20 bp, Artificial
  CRISPR gRNA sequence
tgccatgtccctgccccttg

SEQ ID NO: 37596 - DNA, 20 bp, Artificial
  CRISPR gRNA sequence
ccatgtccctgccccttgca

SEQ ID NO: 37597 - DNA, 20 bp, Artificial
  CRISPR gRNA sequence
gtccctgccccttgcagagt

SEQ ID NO: 37598 - DNA, 20 bp, Artificial
  CRISPR gRNA sequence
tgccccttgcagagttggcc

SEQ ID NO: 37599 - DNA, 20 bp, Artificial
  CRISPR gRNA sequence
cccttgcagagttggccaag

SEQ ID NO: 37600 - DNA, 20 bp, Artificial
  CRISPR gRNA sequence
agttggccaagaagtacctg

SEQ ID NO: 37601 - DNA, 20 bp, Artificial
  CRISPR gRNA sequence
agaagtacctgcagctcctg

SEQ ID NO: 37602 - DNA, 20 bp, Artificial
  CRISPR gRNA sequence
agctcctgcggacctctgcc

SEQ ID NO: 37603 - DNA, 20 bp, Artificial
  CRISPR gRNA sequence
tcctgcggacctctgcccag

SEQ ID NO: 37604 - DNA, 20 bp, Artificial
  CRISPR gRNA sequence
acctctgcccagcagcgcta

SEQ ID NO: 37605 - DNA, 20 bp, Artificial
  CRISPR gRNA sequence
cctctgcccagcagcgctac

SEQ ID NO: 37606 - DNA, 20 bp, Artificial
  CRISPR gRNA sequence
tctgcccagcagcgctacag

SEQ ID NO: 37607 - DNA, 20 bp, Artificial
  CRISPR gRNA sequence
cgctacaggagccaaatccc

SEQ ID NO: 37608 - DNA, 20 bp, Artificial
  CRISPR gRNA sequence
gctacaggagccaaatccct

SEQ ID NO: 37609 - DNA, 20 bp, Artificial
  CRISPR gRNA sequence
caggagccaaatccctgggt

SEQ ID NO: 37610 - DNA, 20 bp, Artificial
  CRISPR gRNA sequence
aggagccaaatccctgggtc

SEQ ID NO: 37611 - DNA, 20 bp, Artificial
  CRISPR gRNA sequence
ggagccaaatccctgggtca

SEQ ID NO: 37612 - DNA, 20 bp, Artificial
  CRISPR gRNA sequence
gccaaatccctgggtcaggg

SEQ ID NO: 37613 - DNA, 20 bp, Artificial
  CRISPR gRNA sequence
ggcagccccacgccttccac

SEQ ID NO: 37614 - DNA, 20 bp, Artificial
  CRISPR gRNA sequence
gcagccccacgccttccacc

SEQ ID NO: 37615 - DNA, 20 bp, Artificial
  CRISPR gRNA sequence
atgtccctccaatcctgcgc

SEQ ID NO: 37616 - DNA, 20 bp, Artificial
  CRISPR gRNA sequence
tgtccctccaatcctgcgcc

SEQ ID NO: 37617 - DNA, 20 bp, Artificial
  CRISPR gRNA sequence
tccaatcctgcgccgggcca

SEQ ID NO: 37618 - DNA, 20 bp, Artificial
  CRISPR gRNA sequence
gcgccgggccacagcatcct

SEQ ID NO: 37619 - DNA, 20 bp, Artificial
  CRISPR gRNA sequence
cacagcatccttagacactc

SEQ ID NO: 37620 - DNA, 20 bp, Artificial
  CRISPR gRNA sequence
cagcatccttagacactccg

SEQ ID NO: 37621 - DNA, 20 bp, Artificial
  CRISPR gRNA sequence
agcatccttagacactccgg

SEQ ID NO: 37622 - DNA, 20 bp, Artificial
  CRISPR gRNA sequence
gcatccttagacactccgga

SEQ ID NO: 37623 - DNA, 20 bp, Artificial
  CRISPR gRNA sequence
catccttagacactccggag

SEQ ID NO: 37624 - DNA, 20 bp, Artificial
  CRISPR gRNA sequence
atccttagacactccggagg

SEQ ID NO: 37625 - DNA, 20 bp, Artificial
  CRISPR gRNA sequence
cactccggagggggccatta

SEQ ID NO: 37626 - DNA, 20 bp, Artificial
  CRISPR gRNA sequence
actccggagggggccattat

SEQ ID NO: 37627 - DNA, 20 bp, Artificial
  CRISPR gRNA sequence
ctccggagggggccattatg

SEQ ID NO: 37628 - DNA, 20 bp, Artificial
  CRISPR gRNA sequence
tccggagggggccattatgg

SEQ ID NO: 37629 - DNA, 20 bp, Artificial
  CRISPR gRNA sequence
gggccattatgggggacgtc

SEQ ID NO: 37630 - DNA, 20 bp, Artificial
  CRISPR gRNA sequence
ggccattatgggggacgtca

SEQ ID NO: 37631 - DNA, 20 bp, Artificial
  CRISPR gRNA sequence
cattatgggggacgtcaagg

SEQ ID NO: 37632 - DNA, 20 bp, Artificial
  CRISPR gRNA sequence
tatgggggacgtcaaggtgg

SEQ ID NO: 37633 - DNA, 20 bp, Artificial
  CRISPR gRNA sequence
ggggacgtcaaggtggaaga

SEQ ID NO: 37634 - DNA, 20 bp, Artificial
  CRISPR gRNA sequence
gtggaagatggtgctgacgt

SEQ ID NO: 37635 - DNA, 20 bp, Artificial
  CRISPR gRNA sequence
tggtgctgacgtgagcatct

SEQ ID NO: 37636 - DNA, 20 bp, Artificial
  CRISPR gRNA sequence
atctcggacctcttcaacac

SEQ ID NO: 37637 - DNA, 20 bp, Artificial
  CRISPR gRNA sequence
tctcggacctcttcaacacc

SEQ ID NO: 37638 - DNA, 20 bp, Artificial
  CRISPR gRNA sequence
ctcggacctcttcaacacca

SEQ ID NO: 37639 - DNA, 20 bp, Artificial
  CRISPR gRNA sequence
tcttcaacaccagggttaac

SEQ ID NO: 37640 - DNA, 20 bp, Artificial
  CRISPR gRNA sequence
cttcaacaccagggttaaca

SEQ ID NO: 37641 - DNA, 20 bp, Artificial
  CRISPR gRNA sequence
ttcaacaccagggttaacaa

SEQ ID NO: 37642 - DNA, 20 bp, Artificial
  CRISPR gRNA sequence
accagggttaacaagggccc

SEQ ID NO: 37643 - DNA, 20 bp, Artificial
  CRISPR gRNA sequence
ccagggttaacaagggcccg

SEQ ID NO: 37644 - DNA, 20 bp, Artificial
  CRISPR gRNA sequence
cagggttaacaagggcccga

SEQ ID NO: 37645 - DNA, 20 bp, Artificial
  CRISPR gRNA sequence
cccgagggtgaccgtgcttt

SEQ ID NO: 37646 - DNA, 20 bp, Artificial
  CRISPR gRNA sequence
ccgagggtgaccgtgctttt

SEQ ID NO: 37647 - DNA, 20 bp, Artificial
  CRISPR gRNA sequence
cgagggtgaccgtgcttttg

SEQ ID NO: 37648 - DNA, 20 bp, Artificial
  CRISPR gRNA sequence
gggtgaccgtgcttttgggg

SEQ ID NO: 37649 - DNA, 20 bp, Artificial
  CRISPR gRNA sequence
ggtgaccgtgcttttgggga

SEQ ID NO: 37650 - DNA, 20 bp, Artificial
  CRISPR gRNA sequence
accgtgcttttggggaaggc

SEQ ID NO: 37651 - DNA, 20 bp, Artificial
  CRISPR gRNA sequence
gcttttggggaaggctggca

SEQ ID NO: 37652 - DNA, 20 bp, Artificial
  CRISPR gRNA sequence
cttttggggaaggctggcat

SEQ ID NO: 37653 - DNA, 20 bp, Artificial
  CRISPR gRNA sequence
tggggaaggctggcatgggc

SEQ ID NO: 37654 - DNA, 20 bp, Artificial
  CRISPR gRNA sequence
tggcatgggcaagaccacgc

SEQ ID NO: 37655 - DNA, 20 bp, Artificial
  CRISPR gRNA sequence
gcaagaccacgctggcccac

SEQ ID NO: 37656 - DNA, 20 bp, Artificial
  CRISPR gRNA sequence
cgctggcccaccggctctgc

SEQ ID NO: 37657 - DNA, 20 bp, Artificial
  CRISPR gRNA sequence
tggcccaccggctctgccag

SEQ ID NO: 37658 - DNA, 20 bp, Artificial
  CRISPR gRNA sequence
cccaccggctctgccagaag

SEQ ID NO: 37659 - DNA, 20 bp, Artificial
  CRISPR gRNA sequence
ccaccggctctgccagaagt

SEQ ID NO: 37660 - DNA, 20 bp, Artificial
  CRISPR gRNA sequence
ccggctctgccagaagtggg

SEQ ID NO: 37661 - DNA, 20 bp, Artificial
  CRISPR gRNA sequence
ggctctgccagaagtgggca

SEQ ID NO: 37662 - DNA, 20 bp, Artificial
  CRISPR gRNA sequence
gctctgccagaagtgggcag

SEQ ID NO: 37663 - DNA, 20 bp, Artificial
  CRISPR gRNA sequence
ctctgccagaagtgggcaga

SEQ ID NO: 37664 - DNA, 20 bp, Artificial
  CRISPR gRNA sequence
agggccatctgaactgtttc

SEQ ID NO: 37665 - DNA, 20 bp, Artificial
  CRISPR gRNA sequence
gggccatctgaactgtttcc

SEQ ID NO: 37666 - DNA, 20 bp, Artificial
  CRISPR gRNA sequence
tgttcctttttgaattccgc

SEQ ID NO: 37667 - DNA, 20 bp, Artificial
  CRISPR gRNA sequence
cgccagctcaacttgatcac

SEQ ID NO: 37668 - DNA, 20 bp, Artificial
  CRISPR gRNA sequence
gccagctcaacttgatcacg

SEQ ID NO: 37669 - DNA, 20 bp, Artificial
  CRISPR gRNA sequence
cgaggttcctgacaccgtcc

SEQ ID NO: 37670 - DNA, 20 bp, Artificial
  CRISPR gRNA sequence
ctcctttttgatctgtacct

SEQ ID NO: 37671 - DNA, 20 bp, Artificial
  CRISPR gRNA sequence
tctgtacctgagccctgaat

SEQ ID NO: 37672 - DNA, 20 bp, Artificial
  CRISPR gRNA sequence
cggaccacgacactgtcttc

SEQ ID NO: 37673 - DNA, 20 bp, Artificial
  CRISPR gRNA sequence
cgacactgtcttccagtacc

SEQ ID NO: 37674 - DNA, 20 bp, Artificial
  CRISPR gRNA sequence
acactgtcttccagtacctg

SEQ ID NO: 37675 - DNA, 20 bp, Artificial
  CRISPR gRNA sequence
ctgtcttccagtacctggag

SEQ ID NO: 37676 - DNA, 20 bp, Artificial
  CRISPR gRNA sequence
cctggagaagaacgctgacc

SEQ ID NO: 37677 - DNA, 20 bp, Artificial
  CRISPR gRNA sequence
caagtcctgctgatctttga

SEQ ID NO: 37678 - DNA, 20 bp, Artificial
  CRISPR gRNA sequence
aagtcctgctgatctttgat

SEQ ID NO: 37679 - DNA, 20 bp, Artificial
  CRISPR gRNA sequence
cctgctgatctttgatgggc

SEQ ID NO: 37680 - DNA, 20 bp, Artificial
  CRISPR gRNA sequence
tgatctttgatgggctagat

SEQ ID NO: 37681 - DNA, 20 bp, Artificial
  CRISPR gRNA sequence
gatctttgatgggctagatg

SEQ ID NO: 37682 - DNA, 20 bp, Artificial
  CRISPR gRNA sequence
atgggctagatgaggccctc

SEQ ID NO: 37683 - DNA, 20 bp, Artificial
  CRISPR gRNA sequence
agatgaggccctccagccta

SEQ ID NO: 37684 - DNA, 20 bp, Artificial
  CRISPR gRNA sequence
gatgaggccctccagcctat

SEQ ID NO: 37685 - DNA, 20 bp, Artificial
  CRISPR gRNA sequence
ctccagcctatgggtcctga

SEQ ID NO: 37686 - DNA, 20 bp, Artificial
  CRISPR gRNA sequence
gcctatgggtcctgatggcc

SEQ ID NO: 37687 - DNA, 20 bp, Artificial
  CRISPR gRNA sequence
cctatgggtcctgatggccc

SEQ ID NO: 37688 - DNA, 20 bp, Artificial
  CRISPR gRNA sequence
gggtcctgatggcccaggcc

SEQ ID NO: 37689 - DNA, 20 bp, Artificial
  CRISPR gRNA sequence
cttttctcccatctctgcaa

SEQ ID NO: 37690 - DNA, 20 bp, Artificial
  CRISPR gRNA sequence
ttttctcccatctctgcaat

SEQ ID NO: 37691 - DNA, 20 bp, Artificial
  CRISPR gRNA sequence
tgcaatgggaccctcctgcc

SEQ ID NO: 37692 - DNA, 20 bp, Artificial
  CRISPR gRNA sequence
ggaccctcctgcctggctgc

SEQ ID NO: 37693 - DNA, 20 bp, Artificial
  CRISPR gRNA sequence
gaccctcctgcctggctgcc

SEQ ID NO: 37694 - DNA, 20 bp, Artificial
  CRISPR gRNA sequence
cctgcctggctgccgggtga

SEQ ID NO: 37695 - DNA, 20 bp, Artificial
  CRISPR gRNA sequence
ggtgatggctacctcccgtc

SEQ ID NO: 37696 - DNA, 20 bp, Artificial
  CRISPR gRNA sequence
gtgatggctacctcccgtcc

SEQ ID NO: 37697 - DNA, 20 bp, Artificial
  CRISPR gRNA sequence
tgatggctacctcccgtcca

SEQ ID NO: 37698 - DNA, 20 bp, Artificial
  CRISPR gRNA sequence
tggctacctcccgtccaggg

SEQ ID NO: 37699 - DNA, 20 bp, Artificial
  CRISPR gRNA sequence
gctgcctgcctgcctgcctg

SEQ ID NO: 37700 - DNA, 20 bp, Artificial
  CRISPR gRNA sequence
tgcctgcctgcctgcctgca

SEQ ID NO: 37701 - DNA, 20 bp, Artificial
  CRISPR gRNA sequence
gcctgcctgcctgcctgcag

SEQ ID NO: 37702 - DNA, 20 bp, Artificial
  CRISPR gRNA sequence
tgcctgcctgcctgcagagg

SEQ ID NO: 37703 - DNA, 20 bp, Artificial
  CRISPR gRNA sequence
cctgcctgcagaggcagcca

SEQ ID NO: 37704 - DNA, 20 bp, Artificial
  CRISPR gRNA sequence
ggcagccatggtccacatgt

SEQ ID NO: 37705 - DNA, 20 bp, Artificial
  CRISPR gRNA sequence
gcagccatggtccacatgtt

SEQ ID NO: 37706 - DNA, 20 bp, Artificial
  CRISPR gRNA sequence
gtccacatgttgggctttga

SEQ ID NO: 37707 - DNA, 20 bp, Artificial
  CRISPR gRNA sequence
tccacatgttgggctttgat

SEQ ID NO: 37708 - DNA, 20 bp, Artificial
  CRISPR gRNA sequence
tgttgggctttgatgggcca

SEQ ID NO: 37709 - DNA, 20 bp, Artificial
  CRISPR gRNA sequence
gttgggctttgatgggccac

SEQ ID NO: 37710 - DNA, 20 bp, Artificial
  CRISPR gRNA sequence
gggctttgatgggccacggg

SEQ ID NO: 37711 - DNA, 20 bp, Artificial
  CRISPR gRNA sequence
ctttgatgggccacgggtgg

SEQ ID NO: 37712 - DNA, 20 bp, Artificial
  CRISPR gRNA sequence
gaatatgtgaatcacttctt

SEQ ID NO: 37713 - DNA, 20 bp, Artificial
  CRISPR gRNA sequence
tgaatcacttcttcagcgcc

SEQ ID NO: 37714 - DNA, 20 bp, Artificial
  CRISPR gRNA sequence
tcttcagcgcccagccatcg

SEQ ID NO: 37715 - DNA, 20 bp, Artificial
  CRISPR gRNA sequence
cttcagcgcccagccatcgc

SEQ ID NO: 37716 - DNA, 20 bp, Artificial
  CRISPR gRNA sequence
tcagcgcccagccatcgcgg

SEQ ID NO: 37717 - DNA, 20 bp, Artificial
  CRISPR gRNA sequence
cagcgcccagccatcgcggg

SEQ ID NO: 37718 - DNA, 20 bp, Artificial
  CRISPR gRNA sequence
agcgcccagccatcgcggga

SEQ ID NO: 37719 - DNA, 20 bp, Artificial
  CRISPR gRNA sequence
gcgcccagccatcgcgggag

SEQ ID NO: 37720 - DNA, 20 bp, Artificial
  CRISPR gRNA sequence
cgcccagccatcgcgggagg

SEQ ID NO: 37721 - DNA, 20 bp, Artificial
  CRISPR gRNA sequence
gccatcgcgggagggggccc

SEQ ID NO: 37722 - DNA, 20 bp, Artificial
  CRISPR gRNA sequence
atcgcgggagggggccctgg

SEQ ID NO: 37723 - DNA, 20 bp, Artificial
  CRISPR gRNA sequence
cgcgggagggggccctggtg

SEQ ID NO: 37724 - DNA, 20 bp, Artificial
  CRISPR gRNA sequence
agggggccctggtggagtta

SEQ ID NO: 37725 - DNA, 20 bp, Artificial
  CRISPR gRNA sequence
ctggtggagttacagacaaa

SEQ ID NO: 37726 - DNA, 20 bp, Artificial
  CRISPR gRNA sequence
cagacaaatggacgtctccg

SEQ ID NO: 37727 - DNA, 20 bp, Artificial
  CRISPR gRNA sequence
acgtctccgaagcctgtgtg

SEQ ID NO: 37728 - DNA, 20 bp, Artificial
  CRISPR gRNA sequence
tgcggtgcccgcactgtgcc

SEQ ID NO: 37729 - DNA, 20 bp, Artificial
  CRISPR gRNA sequence
tctgcttcctgaccacgccc

SEQ ID NO: 37730 - DNA, 20 bp, Artificial
  CRISPR gRNA sequence
ctgcttcctgaccacgcccc

SEQ ID NO: 37731 - DNA, 20 bp, Artificial
  CRISPR gRNA sequence
ttcctgaccacgccccaggc

SEQ ID NO: 37732 - DNA, 20 bp, Artificial
  CRISPR gRNA sequence
ccacgccccaggccagtctg

SEQ ID NO: 37733 - DNA, 20 bp, Artificial
  CRISPR gRNA sequence
ccctcctgcccaacatgact

SEQ ID NO: 37734 - DNA, 20 bp, Artificial
  CRISPR gRNA sequence
acatgactcagctctatatg

SEQ ID NO: 37735 - DNA, 20 bp, Artificial
  CRISPR gRNA sequence
gactcagctctatatgcaga

SEQ ID NO: 37736 - DNA, 20 bp, Artificial
  CRISPR gRNA sequence
atgcagatggtgctcgccct

SEQ ID NO: 37737 - DNA, 20 bp, Artificial
  CRISPR gRNA sequence
gtgctcgccctcagcccccc

SEQ ID NO: 37738 - DNA, 20 bp, Artificial
  CRISPR gRNA sequence
tgctcgccctcagcccccct

SEQ ID NO: 37739 - DNA, 20 bp, Artificial
  CRISPR gRNA sequence
cttgcccacctcgtccctac

SEQ ID NO: 37740 - DNA, 20 bp, Artificial
  CRISPR gRNA sequence
cacctcgtccctactggacc

SEQ ID NO: 37741 - DNA, 20 bp, Artificial
  CRISPR gRNA sequence
acctcgtccctactggacct

SEQ ID NO: 37742 - DNA, 20 bp, Artificial
  CRISPR gRNA sequence
cctcgtccctactggacctg

SEQ ID NO: 37743 - DNA, 20 bp, Artificial
  CRISPR gRNA sequence
ctcgtccctactggacctgg

SEQ ID NO: 37744 - DNA, 20 bp, Artificial
  CRISPR gRNA sequence
cgtccctactggacctgggg

SEQ ID NO: 37745 - DNA, 20 bp, Artificial
  CRISPR gRNA sequence
gtccctactggacctggggg

SEQ ID NO: 37746 - DNA, 20 bp, Artificial
  CRISPR gRNA sequence
cctactggacctgggggagg

SEQ ID NO: 37747 - DNA, 20 bp, Artificial
  CRISPR gRNA sequence
gacctgggggaggtggccct

SEQ ID NO: 37748 - DNA, 20 bp, Artificial
  CRISPR gRNA sequence
acctgggggaggtggccctg

SEQ ID NO: 37749 - DNA, 20 bp, Artificial
  CRISPR gRNA sequence
cctgggggaggtggccctga

SEQ ID NO: 37750 - DNA, 20 bp, Artificial
  CRISPR gRNA sequence
ctgggggaggtggccctgag

SEQ ID NO: 37751 - DNA, 20 bp, Artificial
  CRISPR gRNA sequence
ggaggtggccctgaggggcc

SEQ ID NO: 37752 - DNA, 20 bp, Artificial
  CRISPR gRNA sequence
aggtggccctgaggggcctg

SEQ ID NO: 37753 - DNA, 20 bp, Artificial
  CRISPR gRNA sequence
ggccctgaggggcctggaga

SEQ ID NO: 37754 - DNA, 20 bp, Artificial
  CRISPR gRNA sequence
gccctgaggggcctggagac

SEQ ID NO: 37755 - DNA, 20 bp, Artificial
  CRISPR gRNA sequence
ccctgaggggcctggagaca

SEQ ID NO: 37756 - DNA, 20 bp, Artificial
  CRISPR gRNA sequence
tgaggggcctggagacaggg

SEQ ID NO: 37757 - DNA, 20 bp, Artificial
  CRISPR gRNA sequence
gaggggcctggagacaggga

SEQ ID NO: 37758 - DNA, 20 bp, Artificial
  CRISPR gRNA sequence
gaaggttatcttctatgcaa

SEQ ID NO: 37759 - DNA, 20 bp, Artificial
  CRISPR gRNA sequence
agatattgctccacccttga

SEQ ID NO: 37760 - DNA, 20 bp, Artificial
  CRISPR gRNA sequence
gctccacccttgatagcttt

SEQ ID NO: 37761 - DNA, 20 bp, Artificial
  CRISPR gRNA sequence
ctccacccttgatagctttt

SEQ ID NO: 37762 - DNA, 20 bp, Artificial
  CRISPR gRNA sequence
tccacccttgatagcttttg

SEQ ID NO: 37763 - DNA, 20 bp, Artificial
  CRISPR gRNA sequence
atagcttttggggccactca

SEQ ID NO: 37764 - DNA, 20 bp, Artificial
  CRISPR gRNA sequence
gacttccttctgcgtctgca

SEQ ID NO: 37765 - DNA, 20 bp, Artificial
  CRISPR gRNA sequence
acttccttctgcgtctgcac

SEQ ID NO: 37766 - DNA, 20 bp, Artificial
  CRISPR gRNA sequence
ttctgcgtctgcacaggccc

SEQ ID NO: 37767 - DNA, 20 bp, Artificial
  CRISPR gRNA sequence
tctgcgtctgcacaggccct

SEQ ID NO: 37768 - DNA, 20 bp, Artificial
  CRISPR gRNA sequence
tctgcacaggccctgggcac

SEQ ID NO: 37769 - DNA, 20 bp, Artificial
  CRISPR gRNA sequence
gcacaggccctgggcaccag

SEQ ID NO: 37770 - DNA, 20 bp, Artificial
  CRISPR gRNA sequence
aggccctgggcaccagcaga

SEQ ID NO: 37771 - DNA, 20 bp, Artificial
  CRISPR gRNA sequence
ggccctgggcaccagcagac

SEQ ID NO: 37772 - DNA, 20 bp, Artificial
  CRISPR gRNA sequence
ggctatgctttcacccacct

SEQ ID NO: 37773 - DNA, 20 bp, Artificial
  CRISPR gRNA sequence
ctttcacccacctcagcctg

SEQ ID NO: 37774 - DNA, 20 bp, Artificial
  CRISPR gRNA sequence
tttcacccacctcagcctgc

SEQ ID NO: 37775 - DNA, 20 bp, Artificial
  CRISPR gRNA sequence
tcacccacctcagcctgcag

SEQ ID NO: 37776 - DNA, 20 bp, Artificial
  CRISPR gRNA sequence
tcttgctgccctgcacctga

SEQ ID NO: 37777 - DNA, 20 bp, Artificial
  CRISPR gRNA sequence
gctgccctgcacctgatggc

SEQ ID NO: 37778 - DNA, 20 bp, Artificial
  CRISPR gRNA sequence
tgcacctgatggccagcccc

SEQ ID NO: 37779 - DNA, 20 bp, Artificial
  CRISPR gRNA sequence
gcacctgatggccagcccca

SEQ ID NO: 37780 - DNA, 20 bp, Artificial
  CRISPR gRNA sequence
ggccagccccaaggtgaaca

SEQ ID NO: 37781 - DNA, 20 bp, Artificial
  CRISPR gRNA sequence
tgaacaaagacacacttacc

SEQ ID NO: 37782 - DNA, 20 bp, Artificial
  CRISPR gRNA sequence
atgttaccctccattcccgc

SEQ ID NO: 37783 - DNA, 20 bp, Artificial
  CRISPR gRNA sequence
tgttaccctccattcccgct

SEQ ID NO: 37784 - DNA, 20 bp, Artificial
  CRISPR gRNA sequence
ccctccattcccgctgggta

SEQ ID NO: 37785 - DNA, 20 bp, Artificial
  CRISPR gRNA sequence
tccattcccgctgggtacag

SEQ ID NO: 37786 - DNA, 20 bp, Artificial
  CRISPR gRNA sequence
ccgctgggtacagcggacca

SEQ ID NO: 37787 - DNA, 20 bp, Artificial
  CRISPR gRNA sequence
tgggtacagcggaccaaagc

SEQ ID NO: 37788 - DNA, 20 bp, Artificial
  CRISPR gRNA sequence
acagcggaccaaagctagac

SEQ ID NO: 37789 - DNA, 20 bp, Artificial
  CRISPR gRNA sequence
cagcggaccaaagctagact

SEQ ID NO: 37790 - DNA, 20 bp, Artificial
  CRISPR gRNA sequence
caaagctagactgggcctct

SEQ ID NO: 37791 - DNA, 20 bp, Artificial
  CRISPR gRNA sequence
agaccacctccccaccttcc

SEQ ID NO: 37792 - DNA, 20 bp, Artificial
  CRISPR gRNA sequence
ccacctccccaccttcctgg

SEQ ID NO: 37793 - DNA, 20 bp, Artificial
  CRISPR gRNA sequence
cacctccccaccttcctggc

SEQ ID NO: 37794 - DNA, 20 bp, Artificial
  CRISPR gRNA sequence
ccccaccttcctggcgggcc

SEQ ID NO: 37795 - DNA, 20 bp, Artificial
  CRISPR gRNA sequence
tgcacctgccgccccttcct

SEQ ID NO: 37796 - DNA, 20 bp, Artificial
  CRISPR gRNA sequence
ccgccccttccttagccacc

SEQ ID NO: 37797 - DNA, 20 bp, Artificial
  CRISPR gRNA sequence
ccttccttagccacctggcg

SEQ ID NO: 37798 - DNA, 20 bp, Artificial
  CRISPR gRNA sequence
cttccttagccacctggcgc

SEQ ID NO: 37799 - DNA, 20 bp, Artificial
  CRISPR gRNA sequence
ttccttagccacctggcgca

SEQ ID NO: 37800 - DNA, 20 bp, Artificial
  CRISPR gRNA sequence
gccacctggcgcagggcaat

SEQ ID NO: 37801 - DNA, 20 bp, Artificial
  CRISPR gRNA sequence
ccacctggcgcagggcaatg

SEQ ID NO: 37802 - DNA, 20 bp, Artificial
  CRISPR gRNA sequence
gcagggcaatgaggactgtg

SEQ ID NO: 37803 - DNA, 20 bp, Artificial
  CRISPR gRNA sequence
cagggcaatgaggactgtgt

SEQ ID NO: 37804 - DNA, 20 bp, Artificial
  CRISPR gRNA sequence
atgaggactgtgtgggtgcc

SEQ ID NO: 37805 - DNA, 20 bp, Artificial
  CRISPR gRNA sequence
aggactgtgtgggtgccaag

SEQ ID NO: 37806 - DNA, 20 bp, Artificial
  CRISPR gRNA sequence
ggactgtgtgggtgccaagc

SEQ ID NO: 37807 - DNA, 20 bp, Artificial
  CRISPR gRNA sequence
gggtgccaagcaggctgctg

SEQ ID NO: 37808 - DNA, 20 bp, Artificial
  CRISPR gRNA sequence
ccaagcaggctgctgtagtg

SEQ ID NO: 37809 - DNA, 20 bp, Artificial
  CRISPR gRNA sequence
caagcaggctgctgtagtgc

SEQ ID NO: 37810 - DNA, 20 bp, Artificial
  CRISPR gRNA sequence
ctgctgtagtgcaggtgttg

SEQ ID NO: 37811 - DNA, 20 bp, Artificial
  CRISPR gRNA sequence
ctgtagtgcaggtgttgaag

SEQ ID NO: 37812 - DNA, 20 bp, Artificial
  CRISPR gRNA sequence
agtgcaggtgttgaagaagt

SEQ ID NO: 37813 - DNA, 20 bp, Artificial
  CRISPR gRNA sequence
tgaagaagttggccacccgc

SEQ ID NO: 37814 - DNA, 20 bp, Artificial
  CRISPR gRNA sequence
gttggccacccgcaagctca

SEQ ID NO: 37815 - DNA, 20 bp, Artificial
  CRISPR gRNA sequence
ttggccacccgcaagctcac

SEQ ID NO: 37816 - DNA, 20 bp, Artificial
  CRISPR gRNA sequence
tggccacccgcaagctcaca

SEQ ID NO: 37817 - DNA, 20 bp, Artificial
  CRISPR gRNA sequence
cccgcaagctcacagggcca

SEQ ID NO: 37818 - DNA, 20 bp, Artificial
  CRISPR gRNA sequence
ccgcaagctcacagggccaa

SEQ ID NO: 37819 - DNA, 20 bp, Artificial
  CRISPR gRNA sequence
gctcacagggccaaaggttg

SEQ ID NO: 37820 - DNA, 20 bp, Artificial
  CRISPR gRNA sequence
tcacagggccaaaggttgta

SEQ ID NO: 37821 - DNA, 20 bp, Artificial
  CRISPR gRNA sequence
tgtagagctgtgtcactgtg

SEQ ID NO: 37822 - DNA, 20 bp, Artificial
  CRISPR gRNA sequence
agctgtgtcactgtgtggat

SEQ ID NO: 37823 - DNA, 20 bp, Artificial
  CRISPR gRNA sequence
gtcactgtgtggatgagaca

SEQ ID NO: 37824 - DNA, 20 bp, Artificial
  CRISPR gRNA sequence
tcactgtgtggatgagacac

SEQ ID NO: 37825 - DNA, 20 bp, Artificial
  CRISPR gRNA sequence
actgtgtggatgagacacag

SEQ ID NO: 37826 - DNA, 20 bp, Artificial
  CRISPR gRNA sequence
tggatgagacacaggagcct

SEQ ID NO: 37827 - DNA, 20 bp, Artificial
  CRISPR gRNA sequence
tgagacacaggagcctgagc

SEQ ID NO: 37828 - DNA, 20 bp, Artificial
  CRISPR gRNA sequence
acacaggagcctgagctggc

SEQ ID NO: 37829 - DNA, 20 bp, Artificial
  CRISPR gRNA sequence
ctggccagtctcaccgcaca

SEQ ID NO: 37830 - DNA, 20 bp, Artificial
  CRISPR gRNA sequence
cccactgacctgcaccgacc

SEQ ID NO: 37831 - DNA, 20 bp, Artificial
  CRISPR gRNA sequence
ggccaccctgaccaacatcc

SEQ ID NO: 37832 - DNA, 20 bp, Artificial
  CRISPR gRNA sequence
ccaccctgaccaacatccta

SEQ ID NO: 37833 - DNA, 20 bp, Artificial
  CRISPR gRNA sequence
ctgaccaacatcctagagca

SEQ ID NO: 37834 - DNA, 20 bp, Artificial
  CRISPR gRNA sequence
tgaccaacatcctagagcac

SEQ ID NO: 37835 - DNA, 20 bp, Artificial
  CRISPR gRNA sequence
gaccaacatcctagagcaca

SEQ ID NO: 37836 - DNA, 20 bp, Artificial
  CRISPR gRNA sequence
ccaacatcctagagcacagg

SEQ ID NO: 37837 - DNA, 20 bp, Artificial
  CRISPR gRNA sequence
caacatcctagagcacaggg

SEQ ID NO: 37838 - DNA, 20 bp, Artificial
  CRISPR gRNA sequence
cagggaggcccccatccacc

SEQ ID NO: 37839 - DNA, 20 bp, Artificial
  CRISPR gRNA sequence
cccatccacctggattttga

SEQ ID NO: 37840 - DNA, 20 bp, Artificial
  CRISPR gRNA sequence
ggattttgatggctgtcccc

SEQ ID NO: 37841 - DNA, 20 bp, Artificial
  CRISPR gRNA sequence
attttgatggctgtcccctg

SEQ ID NO: 37842 - DNA, 20 bp, Artificial
  CRISPR gRNA sequence
ccctggagccccactgccct

SEQ ID NO: 37843 - DNA, 20 bp, Artificial
  CRISPR gRNA sequence
cctggagccccactgccctg

SEQ ID NO: 37844 - DNA, 20 bp, Artificial
  CRISPR gRNA sequence
gccccactgccctgaggctc

SEQ ID NO: 37845 - DNA, 20 bp, Artificial
  CRISPR gRNA sequence
ccactgccctgaggctctgg

SEQ ID NO: 37846 - DNA, 20 bp, Artificial
  CRISPR gRNA sequence
cactgccctgaggctctggt

SEQ ID NO: 37847 - DNA, 20 bp, Artificial
  CRISPR gRNA sequence
cctgaggctctggtaggctg

SEQ ID NO: 37848 - DNA, 20 bp, Artificial
  CRISPR gRNA sequence
ctgaggctctggtaggctgt

SEQ ID NO: 37849 - DNA, 20 bp, Artificial
  CRISPR gRNA sequence
aggctctggtaggctgtggg

SEQ ID NO: 37850 - DNA, 20 bp, Artificial
  CRISPR gRNA sequence
tctggtaggctgtgggcaga

SEQ ID NO: 37851 - DNA, 20 bp, Artificial
  CRISPR gRNA sequence
tggtaggctgtgggcagata

SEQ ID NO: 37852 - DNA, 20 bp, Artificial
  CRISPR gRNA sequence
tgtgggcagatagagaatct

SEQ ID NO: 37853 - DNA, 20 bp, Artificial
  CRISPR gRNA sequence
gtgggcagatagagaatctc

SEQ ID NO: 37854 - DNA, 20 bp, Artificial
  CRISPR gRNA sequence
gcagatagagaatctcaggt

SEQ ID NO: 37855 - DNA, 20 bp, Artificial
  CRISPR gRNA sequence
atagagaatctcaggtgagt

SEQ ID NO: 37856 - DNA, 20 bp, Artificial
  CRISPR gRNA sequence
agagaatctcaggtgagtaa

SEQ ID NO: 37857 - DNA, 20 bp, Artificial
  CRISPR gRNA sequence
gaatctcaggtgagtaagag

SEQ ID NO: 37858 - DNA, 20 bp, Artificial
  CRISPR gRNA sequence
atctcaggtgagtaagagtg

SEQ ID NO: 37859 - DNA, 20 bp, Artificial
  CRISPR gRNA sequence
tctcaggtgagtaagagtgg

SEQ ID NO: 37860 - DNA, 20 bp, Artificial
  CRISPR gRNA sequence
tcaggtgagtaagagtggag

SEQ ID NO: 37861 - DNA, 20 bp, Artificial
  CRISPR gRNA sequence
caggtgagtaagagtggagg

SEQ ID NO: 37862 - DNA, 20 bp, Artificial
  CRISPR gRNA sequence
gagtaagagtggaggaggac

SEQ ID NO: 37863 - DNA, 20 bp, Artificial
  CRISPR gRNA sequence
agtaagagtggaggaggacc

SEQ ID NO: 37864 - DNA, 20 bp, Artificial
  CRISPR gRNA sequence
gtaagagtggaggaggaccg

SEQ ID NO: 37865 - DNA, 20 bp, Artificial
  CRISPR gRNA sequence
aagagtggaggaggaccggg

SEQ ID NO: 37866 - DNA, 20 bp, Artificial
  CRISPR gRNA sequence
agagtggaggaggaccgggg

SEQ ID NO: 37867 - DNA, 20 bp, Artificial
  CRISPR gRNA sequence
gagtggaggaggaccgggga

SEQ ID NO: 37868 - DNA, 20 bp, Artificial
  CRISPR gRNA sequence
agtggaggaggaccggggag

SEQ ID NO: 37869 - DNA, 20 bp, Artificial
  CRISPR gRNA sequence
aggaggaccggggaggggat

SEQ ID NO: 37870 - DNA, 20 bp, Artificial
  CRISPR gRNA sequence
ggaggaccggggaggggatt

SEQ ID NO: 37871 - DNA, 20 bp, Artificial
  CRISPR gRNA sequence
cggggaggggattgggcttt

SEQ ID NO: 37872 - DNA, 20 bp, Artificial
  CRISPR gRNA sequence
ggggaggggattgggctttt

SEQ ID NO: 37873 - DNA, 20 bp, Artificial
  CRISPR gRNA sequence
gggaggggattgggcttttg

SEQ ID NO: 37874 - DNA, 20 bp, Artificial
  CRISPR gRNA sequence
ggaggggattgggcttttgg

SEQ ID NO: 37875 - DNA, 20 bp, Artificial
  CRISPR gRNA sequence
aggggattgggcttttgggg

SEQ ID NO: 37876 - DNA, 20 bp, Artificial
  CRISPR gRNA sequence
ggattgggcttttgggggag

SEQ ID NO: 37877 - DNA, 20 bp, Artificial
  CRISPR gRNA sequence
attgggcttttgggggagca

SEQ ID NO: 37878 - DNA, 20 bp, Artificial
  CRISPR gRNA sequence
ttgggcttttgggggagcag

SEQ ID NO: 37879 - DNA, 20 bp, Artificial
  CRISPR gRNA sequence
ttgggggagcagaggccaac

SEQ ID NO: 37880 - DNA, 20 bp, Artificial
  CRISPR gRNA sequence
ggagcagaggccaaccagtc

SEQ ID NO: 37881 - DNA, 20 bp, Artificial
  CRISPR gRNA sequence
cagtctagcaaacctctgcc

SEQ ID NO: 37882 - DNA, 20 bp, Artificial
  CRISPR gRNA sequence
gtctagcaaacctctgccaa

SEQ ID NO: 37883 - DNA, 20 bp, Artificial
  CRISPR gRNA sequence
tctagcaaacctctgccaag

SEQ ID NO: 37884 - DNA, 20 bp, Artificial
  CRISPR gRNA sequence
caaacctctgccaagaggac

SEQ ID NO: 37885 - DNA, 20 bp, Artificial
  CRISPR gRNA sequence
ctctgccaagaggactggat

SEQ ID NO: 37886 - DNA, 20 bp, Artificial
  CRISPR gRNA sequence
tggataagaatcttgaatat

SEQ ID NO: 37887 - DNA, 20 bp, Artificial
  CRISPR gRNA sequence
tcttgaatatcagaacataa

SEQ ID NO: 37888 - DNA, 20 bp, Artificial
  CRISPR gRNA sequence
aacataatggcctgcaatgc

SEQ ID NO: 37889 - DNA, 20 bp, Artificial
  CRISPR gRNA sequence
cataatggcctgcaatgcaa

SEQ ID NO: 37890 - DNA, 20 bp, Artificial
  CRISPR gRNA sequence
taatggcctgcaatgcaaga

SEQ ID NO: 37891 - DNA, 20 bp, Artificial
  CRISPR gRNA sequence
aatggcctgcaatgcaagag

SEQ ID NO: 37892 - DNA, 20 bp, Artificial
  CRISPR gRNA sequence
ggcctgcaatgcaagagagg

SEQ ID NO: 37893 - DNA, 20 bp, Artificial
  CRISPR gRNA sequence
gaggaagctccataccttga

SEQ ID NO: 37894 - DNA, 20 bp, Artificial
  CRISPR gRNA sequence
aggaagctccataccttgac

SEQ ID NO: 37895 - DNA, 20 bp, Artificial
  CRISPR gRNA sequence
ccataccttgacaggacctc

SEQ ID NO: 37896 - DNA, 20 bp, Artificial
  CRISPR gRNA sequence
ataccttgacaggacctctg

SEQ ID NO: 37897 - DNA, 20 bp, Artificial
  CRISPR gRNA sequence
caggacctctggagtccaaa

SEQ ID NO: 37898 - DNA, 20 bp, Artificial
  CRISPR gRNA sequence
atggatcctcctcttgtctg

SEQ ID NO: 37899 - DNA, 20 bp, Artificial
  CRISPR gRNA sequence
ctcctcttgtctgtggtttc

SEQ ID NO: 37900 - DNA, 20 bp, Artificial
  CRISPR gRNA sequence
gtctgtggtttctggactct

SEQ ID NO: 37901 - DNA, 20 bp, Artificial
  CRISPR gRNA sequence
ctcagtctctctgtcaatca

SEQ ID NO: 37902 - DNA, 20 bp, Artificial
  CRISPR gRNA sequence
tcagtctctctgtcaatcat

SEQ ID NO: 37903 - DNA, 20 bp, Artificial
  CRISPR gRNA sequence
tcaatcatgggctgaaacca

SEQ ID NO: 37904 - DNA, 20 bp, Artificial
  CRISPR gRNA sequence
atgggctgaaaccacagatc

SEQ ID NO: 37905 - DNA, 20 bp, Artificial
  CRISPR gRNA sequence
tgggctgaaaccacagatcc

SEQ ID NO: 37906 - DNA, 20 bp, Artificial
  CRISPR gRNA sequence
ccacagatccaggctgtcta

SEQ ID NO: 37907 - DNA, 20 bp, Artificial
  CRISPR gRNA sequence
acagatccaggctgtctata

SEQ ID NO: 37908 - DNA, 20 bp, Artificial
  CRISPR gRNA sequence
cagatccaggctgtctatag

SEQ ID NO: 37909 - DNA, 20 bp, Artificial
  CRISPR gRNA sequence
tccaggctgtctatagaggc

SEQ ID NO: 37910 - DNA, 20 bp, Artificial
  CRISPR gRNA sequence
aggctgtctatagaggctgg

SEQ ID NO: 37911 - DNA, 20 bp, Artificial
  CRISPR gRNA sequence
ctatagaggctggtggactt

SEQ ID NO: 37912 - DNA, 20 bp, Artificial
  CRISPR gRNA sequence
tatagaggctggtggacttt

SEQ ID NO: 37913 - DNA, 20 bp, Artificial
  CRISPR gRNA sequence
gaggctggtggactttgggc

SEQ ID NO: 37914 - DNA, 20 bp, Artificial
  CRISPR gRNA sequence
gtggactttgggcaagtata

SEQ ID NO: 37915 - DNA, 20 bp, Artificial
  CRISPR gRNA sequence
ggactttgggcaagtatatg

SEQ ID NO: 37916 - DNA, 20 bp, Artificial
  CRISPR gRNA sequence
gcacacacatgcacactgtc

SEQ ID NO: 37917 - DNA, 20 bp, Artificial
  CRISPR gRNA sequence
cacacacatgcacactgtct

SEQ ID NO: 37918 - DNA, 20 bp, Artificial
  CRISPR gRNA sequence
cacatgcacactgtctaggc

SEQ ID NO: 37919 - DNA, 20 bp, Artificial
  CRISPR gRNA sequence
catgcacactgtctaggcca

SEQ ID NO: 37920 - DNA, 20 bp, Artificial
  CRISPR gRNA sequence
ctaaaacgaatctgtaacaa

SEQ ID NO: 37921 - DNA, 20 bp, Artificial
  CRISPR gRNA sequence
gtaacaatagccaactcata

SEQ ID NO: 37922 - DNA, 20 bp, Artificial
  CRISPR gRNA sequence
ccaactcatatggtcattgc

SEQ ID NO: 37923 - DNA, 20 bp, Artificial
  CRISPR gRNA sequence
catatggtcattgcaagaat

SEQ ID NO: 37924 - DNA, 20 bp, Artificial
  CRISPR gRNA sequence
tggtcattgcaagaatgaga

SEQ ID NO: 37925 - DNA, 20 bp, Artificial
  CRISPR gRNA sequence
ggtcattgcaagaatgagat

SEQ ID NO: 37926 - DNA, 20 bp, Artificial
  CRISPR gRNA sequence
attgcaagaatgagatggga

SEQ ID NO: 37927 - DNA, 20 bp, Artificial
  CRISPR gRNA sequence
ggtgcatgaaaaacattttg

SEQ ID NO: 37928 - DNA, 20 bp, Artificial
  CRISPR gRNA sequence
atgaaaaacattttgtagca

SEQ ID NO: 37929 - DNA, 20 bp, Artificial
  CRISPR gRNA sequence
acattttgtagcacagtgcc

SEQ ID NO: 37930 - DNA, 20 bp, Artificial
  CRISPR gRNA sequence
ttgtagcacagtgcctagca

SEQ ID NO: 37931 - DNA, 20 bp, Artificial
  CRISPR gRNA sequence
gtagcacagtgcctagcaca

SEQ ID NO: 37932 - DNA, 20 bp, Artificial
  CRISPR gRNA sequence
acagtgcctagcacagagca

SEQ ID NO: 37933 - DNA, 20 bp, Artificial
  CRISPR gRNA sequence
cagtgcctagcacagagcaa

SEQ ID NO: 37934 - DNA, 20 bp, Artificial
  CRISPR gRNA sequence
cctagcacagagcaaaggct

SEQ ID NO: 37935 - DNA, 20 bp, Artificial
  CRISPR gRNA sequence
caaaggctcagtgtgcatat

SEQ ID NO: 37936 - DNA, 20 bp, Artificial
  CRISPR gRNA sequence
ggctcagtgtgcatattagc

SEQ ID NO: 37937 - DNA, 20 bp, Artificial
  CRISPR gRNA sequence
ctcagtgtgcatattagcta

SEQ ID NO: 37938 - DNA, 20 bp, Artificial
  CRISPR gRNA sequence
tgtgcatattagctagagaa

SEQ ID NO: 37939 - DNA, 20 bp, Artificial
  CRISPR gRNA sequence
gtgcatattagctagagaaa

SEQ ID NO: 37940 - DNA, 20 bp, Artificial
  CRISPR gRNA sequence
atattagctagagaaaaggc

SEQ ID NO: 37941 - DNA, 20 bp, Artificial
  CRISPR gRNA sequence
tattagctagagaaaaggct

SEQ ID NO: 37942 - DNA, 20 bp, Artificial
  CRISPR gRNA sequence
ctagagaaaaggctaggctg

SEQ ID NO: 37943 - DNA, 20 bp, Artificial
  CRISPR gRNA sequence
aaaaggctaggctgcagtaa

SEQ ID NO: 37944 - DNA, 20 bp, Artificial
  CRISPR gRNA sequence
aaggctaggctgcagtaaca

SEQ ID NO: 37945 - DNA, 20 bp, Artificial
  CRISPR gRNA sequence
agaaacctcctccccaaata

SEQ ID NO: 37946 - DNA, 20 bp, Artificial
  CRISPR gRNA sequence
aacctcctccccaaatacag

SEQ ID NO: 37947 - DNA, 20 bp, Artificial
  CRISPR gRNA sequence
acctcctccccaaatacagt

SEQ ID NO: 37948 - DNA, 20 bp, Artificial
  CRISPR gRNA sequence
atacagtaggttaaataatg

SEQ ID NO: 37949 - DNA, 20 bp, Artificial
  CRISPR gRNA sequence
agaattttatttctctctca

SEQ ID NO: 37950 - DNA, 20 bp, Artificial
  CRISPR gRNA sequence
attttatttctctctcatgg

SEQ ID NO: 37951 - DNA, 20 bp, Artificial
  CRISPR gRNA sequence
tttatttctctctcatggaa

SEQ ID NO: 37952 - DNA, 20 bp, Artificial
  CRISPR gRNA sequence
tttctctctcatggaagagt

SEQ ID NO: 37953 - DNA, 20 bp, Artificial
  CRISPR gRNA sequence
tctctctcatggaagagtca

SEQ ID NO: 37954 - DNA, 20 bp, Artificial
  CRISPR gRNA sequence
ctctctcatggaagagtcag

SEQ ID NO: 37955 - DNA, 20 bp, Artificial
  CRISPR gRNA sequence
tctcatggaagagtcagagg

SEQ ID NO: 37956 - DNA, 20 bp, Artificial
  CRISPR gRNA sequence
ctcatggaagagtcagaggt

SEQ ID NO: 37957 - DNA, 20 bp, Artificial
  CRISPR gRNA sequence
atggaagagtcagaggtagg

SEQ ID NO: 37958 - DNA, 20 bp, Artificial
  CRISPR gRNA sequence
agagtcagaggtaggtggtc

SEQ ID NO: 37959 - DNA, 20 bp, Artificial
  CRISPR gRNA sequence
gagtcagaggtaggtggtcc

SEQ ID NO: 37960 - DNA, 20 bp, Artificial
  CRISPR gRNA sequence
cagaggtaggtggtccaggt

SEQ ID NO: 37961 - DNA, 20 bp, Artificial
  CRISPR gRNA sequence
aggtaggtggtccaggtcag

SEQ ID NO: 37962 - DNA, 20 bp, Artificial
  CRISPR gRNA sequence
ggtggtccaggtcagtggaa

SEQ ID NO: 37963 - DNA, 20 bp, Artificial
  CRISPR gRNA sequence
tccaggtcagtggaatggct

SEQ ID NO: 37964 - DNA, 20 bp, Artificial
  CRISPR gRNA sequence
tggaatggctcagctccacg

SEQ ID NO: 37965 - DNA, 20 bp, Artificial
  CRISPR gRNA sequence
ctcagctccacgcagtcatg

SEQ ID NO: 37966 - DNA, 20 bp, Artificial
  CRISPR gRNA sequence
tcagctccacgcagtcatgc

SEQ ID NO: 37967 - DNA, 20 bp, Artificial
  CRISPR gRNA sequence
cacgcagtcatgcaggtacc

SEQ ID NO: 37968 - DNA, 20 bp, Artificial
  CRISPR gRNA sequence
acgcagtcatgcaggtaccc

SEQ ID NO: 37969 - DNA, 20 bp, Artificial
  CRISPR gRNA sequence
attttgctccattatcccct

SEQ ID NO: 37970 - DNA, 20 bp, Artificial
  CRISPR gRNA sequence
ttttgctccattatcccctt

SEQ ID NO: 37971 - DNA, 20 bp, Artificial
  CRISPR gRNA sequence
ccttgggaatcctatctgca

SEQ ID NO: 37972 - DNA, 20 bp, Artificial
  CRISPR gRNA sequence
gaatcctatctgcacagtca

SEQ ID NO: 37973 - DNA, 20 bp, Artificial
  CRISPR gRNA sequence
gcacagtcaaagctacgtca

SEQ ID NO: 37974 - DNA, 20 bp, Artificial
  CRISPR gRNA sequence
cacagtcaaagctacgtcat

SEQ ID NO: 37975 - DNA, 20 bp, Artificial
  CRISPR gRNA sequence
tcatgggtatatctgtgctc

SEQ ID NO: 37976 - DNA, 20 bp, Artificial
  CRISPR gRNA sequence
ggtatatctgtgctctggct

SEQ ID NO: 37977 - DNA, 20 bp, Artificial
  CRISPR gRNA sequence
gtatatctgtgctctggctt

SEQ ID NO: 37978 - DNA, 20 bp, Artificial
  CRISPR gRNA sequence
ctgtgctctggcttgggaac

SEQ ID NO: 37979 - DNA, 20 bp, Artificial
  CRISPR gRNA sequence
tgtgctctggcttgggaaca

SEQ ID NO: 37980 - DNA, 20 bp, Artificial
  CRISPR gRNA sequence
ctctggcttgggaacaagga

SEQ ID NO: 37981 - DNA, 20 bp, Artificial
  CRISPR gRNA sequence
ctggcttgggaacaaggaaa

SEQ ID NO: 37982 - DNA, 20 bp, Artificial
  CRISPR gRNA sequence
ttgggaacaaggaaagagca

SEQ ID NO: 37983 - DNA, 20 bp, Artificial
  CRISPR gRNA sequence
gggaacaaggaaagagcatg

SEQ ID NO: 37984 - DNA, 20 bp, Artificial
  CRISPR gRNA sequence
ggaacaaggaaagagcatgg

SEQ ID NO: 37985 - DNA, 20 bp, Artificial
  CRISPR gRNA sequence
aggaacatgtcaatgcatta

SEQ ID NO: 37986 - DNA, 20 bp, Artificial
  CRISPR gRNA sequence
catgtcaatgcattaaagtt

SEQ ID NO: 37987 - DNA, 20 bp, Artificial
  CRISPR gRNA sequence
ttaaagttcagtcctgaaac

SEQ ID NO: 37988 - DNA, 20 bp, Artificial
  CRISPR gRNA sequence
taaagttcagtcctgaaact

SEQ ID NO: 37989 - DNA, 20 bp, Artificial
  CRISPR gRNA sequence
cccttccactcacattccat

SEQ ID NO: 37990 - DNA, 20 bp, Artificial
  CRISPR gRNA sequence
tccactcacattccattggt

SEQ ID NO: 37991 - DNA, 20 bp, Artificial
  CRISPR gRNA sequence
acattccattggtgagaaca

SEQ ID NO: 37992 - DNA, 20 bp, Artificial
  CRISPR gRNA sequence
ttggtgagaacatagtcacc

SEQ ID NO: 37993 - DNA, 20 bp, Artificial
  CRISPR gRNA sequence
catagtcacctggccacact

SEQ ID NO: 37994 - DNA, 20 bp, Artificial
  CRISPR gRNA sequence
acctggccacactgagctgc

SEQ ID NO: 37995 - DNA, 20 bp, Artificial
  CRISPR gRNA sequence
cctggccacactgagctgca

SEQ ID NO: 37996 - DNA, 20 bp, Artificial
  CRISPR gRNA sequence
ctggccacactgagctgcaa

SEQ ID NO: 37997 - DNA, 20 bp, Artificial
  CRISPR gRNA sequence
ggccacactgagctgcaagg

SEQ ID NO: 37998 - DNA, 20 bp, Artificial
  CRISPR gRNA sequence
gccacactgagctgcaaggg

SEQ ID NO: 37999 - DNA, 20 bp, Artificial
  CRISPR gRNA sequence
cactgagctgcaagggaggc

SEQ ID NO: 38000 - DNA, 20 bp, Artificial
  CRISPR gRNA sequence
actgagctgcaagggaggct

SEQ ID NO: 38001 - DNA, 20 bp, Artificial
  CRISPR gRNA sequence
aggctgggaaatgtgatctc

SEQ ID NO: 38002 - DNA, 20 bp, Artificial
  CRISPR gRNA sequence
tgggaaatgtgatctctggc

SEQ ID NO: 38003 - DNA, 20 bp, Artificial
  CRISPR gRNA sequence
gggaaatgtgatctctggct

SEQ ID NO: 38004 - DNA, 20 bp, Artificial
  CRISPR gRNA sequence
ggaaaccatgttcctcatga

SEQ ID NO: 38005 - DNA, 20 bp, Artificial
  CRISPR gRNA sequence
tcatgatagctctattgctg

SEQ ID NO: 38006 - DNA, 20 bp, Artificial
  CRISPR gRNA sequence
tagctctattgctgtagatg

SEQ ID NO: 38007 - DNA, 20 bp, Artificial
  CRISPR gRNA sequence
ctctattgctgtagatgaag

SEQ ID NO: 38008 - DNA, 20 bp, Artificial
  CRISPR gRNA sequence
ctattgctgtagatgaagtg

SEQ ID NO: 38009 - DNA, 20 bp, Artificial
  CRISPR gRNA sequence
gctgtagatgaagtggagaa

SEQ ID NO: 38010 - DNA, 20 bp, Artificial
  CRISPR gRNA sequence
ctgtagatgaagtggagaat

SEQ ID NO: 38011 - DNA, 20 bp, Artificial
  CRISPR gRNA sequence
atgaagtggagaatgggctt

SEQ ID NO: 38012 - DNA, 20 bp, Artificial
  CRISPR gRNA sequence
aagtggagaatgggctttgg

SEQ ID NO: 38013 - DNA, 20 bp, Artificial
  CRISPR gRNA sequence
aatgggctttggtggacgat

SEQ ID NO: 38014 - DNA, 20 bp, Artificial
  CRISPR gRNA sequence
gggctttggtggacgattag

SEQ ID NO: 38015 - DNA, 20 bp, Artificial
  CRISPR gRNA sequence
tggtggacgattagaagtct

SEQ ID NO: 38016 - DNA, 20 bp, Artificial
  CRISPR gRNA sequence
cggccataatatgtatttgt

SEQ ID NO: 38017 - DNA, 20 bp, Artificial
  CRISPR gRNA sequence
tttgttagtactactgtatt

SEQ ID NO: 38018 - DNA, 20 bp, Artificial
  CRISPR gRNA sequence
gtattaagccccatctctct

SEQ ID NO: 38019 - DNA, 20 bp, Artificial
  CRISPR gRNA sequence
tattaagccccatctctctg

SEQ ID NO: 38020 - DNA, 20 bp, Artificial
  CRISPR gRNA sequence
attaagccccatctctctga

SEQ ID NO: 38021 - DNA, 20 bp, Artificial
  CRISPR gRNA sequence
ttaagccccatctctctgag

SEQ ID NO: 38022 - DNA, 20 bp, Artificial
  CRISPR gRNA sequence
gccccatctctctgagggga

SEQ ID NO: 38023 - DNA, 20 bp, Artificial
  CRISPR gRNA sequence
aggggatggcgatgacttct

SEQ ID NO: 38024 - DNA, 20 bp, Artificial
  CRISPR gRNA sequence
gatgacttctcagctctgcc

SEQ ID NO: 38025 - DNA, 20 bp, Artificial
  CRISPR gRNA sequence
tgacacttcgcttcttctta

SEQ ID NO: 38026 - DNA, 20 bp, Artificial
  CRISPR gRNA sequence
cacttcgcttcttcttatgg

SEQ ID NO: 38027 - DNA, 20 bp, Artificial
  CRISPR gRNA sequence
cttcttcttatggcagcttt

SEQ ID NO: 38028 - DNA, 20 bp, Artificial
  CRISPR gRNA sequence
tcttcttatggcagctttaa

SEQ ID NO: 38029 - DNA, 20 bp, Artificial
  CRISPR gRNA sequence
tcttatggcagctttaagag

SEQ ID NO: 38030 - DNA, 20 bp, Artificial
  CRISPR gRNA sequence
cttatggcagctttaagagc

SEQ ID NO: 38031 - DNA, 20 bp, Artificial
  CRISPR gRNA sequence
atggcagctttaagagcagg

SEQ ID NO: 38032 - DNA, 20 bp, Artificial
  CRISPR gRNA sequence
agctttaagagcaggaagtg

SEQ ID NO: 38033 - DNA, 20 bp, Artificial
  CRISPR gRNA sequence
gctttaagagcaggaagtgt

SEQ ID NO: 38034 - DNA, 20 bp, Artificial
  CRISPR gRNA sequence
ctttaagagcaggaagtgtg

SEQ ID NO: 38035 - DNA, 20 bp, Artificial
  CRISPR gRNA sequence
gaagtgtggggatgcctttg

SEQ ID NO: 38036 - DNA, 20 bp, Artificial
  CRISPR gRNA sequence
gtgtggggatgcctttgcag

SEQ ID NO: 38037 - DNA, 20 bp, Artificial
  CRISPR gRNA sequence
gcctttgcagaagccctctc

SEQ ID NO: 38038 - DNA, 20 bp, Artificial
  CRISPR gRNA sequence
cctttgcagaagccctctcc

SEQ ID NO: 38039 - DNA, 20 bp, Artificial
  CRISPR gRNA sequence
tttgcagaagccctctccag

SEQ ID NO: 38040 - DNA, 20 bp, Artificial
  CRISPR gRNA sequence
ctccaggagcttgccgacaa

SEQ ID NO: 38041 - DNA, 20 bp, Artificial
  CRISPR gRNA sequence
tccaggagcttgccgacaat

SEQ ID NO: 38042 - DNA, 20 bp, Artificial
  CRISPR gRNA sequence
ccaggagcttgccgacaatg

SEQ ID NO: 38043 - DNA, 20 bp, Artificial
  CRISPR gRNA sequence
aggagcttgccgacaatggg

SEQ ID NO: 38044 - DNA, 20 bp, Artificial
  CRISPR gRNA sequence
ggagcttgccgacaatgggg

SEQ ID NO: 38045 - DNA, 20 bp, Artificial
  CRISPR gRNA sequence
tgccgacaatggggaggctg

SEQ ID NO: 38046 - DNA, 20 bp, Artificial
  CRISPR gRNA sequence
aatggggaggctgcagatgc

SEQ ID NO: 38047 - DNA, 20 bp, Artificial
  CRISPR gRNA sequence
atggggaggctgcagatgct

SEQ ID NO: 38048 - DNA, 20 bp, Artificial
  CRISPR gRNA sequence
tggggaggctgcagatgctg

SEQ ID NO: 38049 - DNA, 20 bp, Artificial
  CRISPR gRNA sequence
gaggctgcagatgctggggt

SEQ ID NO: 38050 - DNA, 20 bp, Artificial
  CRISPR gRNA sequence
ctgcagatgctggggtgagc

SEQ ID NO: 38051 - DNA, 20 bp, Artificial
  CRISPR gRNA sequence
tgcagatgctggggtgagcc

SEQ ID NO: 38052 - DNA, 20 bp, Artificial
  CRISPR gRNA sequence
tgctggggtgagccaggcct

SEQ ID NO: 38053 - DNA, 20 bp, Artificial
  CRISPR gRNA sequence
ctggggtgagccaggccttg

SEQ ID NO: 38054 - DNA, 20 bp, Artificial
  CRISPR gRNA sequence
gtgagccaggccttggagct

SEQ ID NO: 38055 - DNA, 20 bp, Artificial
  CRISPR gRNA sequence
agccaggccttggagctgag

SEQ ID NO: 38056 - DNA, 20 bp, Artificial
  CRISPR gRNA sequence
gccaggccttggagctgaga

SEQ ID NO: 38057 - DNA, 20 bp, Artificial
  CRISPR gRNA sequence
ccaggccttggagctgagaa

SEQ ID NO: 38058 - DNA, 20 bp, Artificial
  CRISPR gRNA sequence
ttggagctgagaagggtctt

SEQ ID NO: 38059 - DNA, 20 bp, Artificial
  CRISPR gRNA sequence
agctgagaagggtcttcagc

SEQ ID NO: 38060 - DNA, 20 bp, Artificial
  CRISPR gRNA sequence
gctgagaagggtcttcagct

SEQ ID NO: 38061 - DNA, 20 bp, Artificial
  CRISPR gRNA sequence
ctgagaagggtcttcagctg

SEQ ID NO: 38062 - DNA, 20 bp, Artificial
  CRISPR gRNA sequence
ggtcttcagctggggatgcc

SEQ ID NO: 38063 - DNA, 20 bp, Artificial
  CRISPR gRNA sequence
ccctctccttaatcctacac

SEQ ID NO: 38064 - DNA, 20 bp, Artificial
  CRISPR gRNA sequence
cctctccttaatcctacaca

SEQ ID NO: 38065 - DNA, 20 bp, Artificial
  CRISPR gRNA sequence
ctccttaatcctacacaagg

SEQ ID NO: 38066 - DNA, 20 bp, Artificial
  CRISPR gRNA sequence
tcctacacaaggcagattcc

SEQ ID NO: 38067 - DNA, 20 bp, Artificial
  CRISPR gRNA sequence
caccatctttgcttactctg

SEQ ID NO: 38068 - DNA, 20 bp, Artificial
  CRISPR gRNA sequence
accatctttgcttactctgt

SEQ ID NO: 38069 - DNA, 20 bp, Artificial
  CRISPR gRNA sequence
tctttgcttactctgtaggt

SEQ ID NO: 38070 - DNA, 20 bp, Artificial
  CRISPR gRNA sequence
ttgcttactctgtaggttag

SEQ ID NO: 38071 - DNA, 20 bp, Artificial
  CRISPR gRNA sequence
tgcttactctgtaggttagc

SEQ ID NO: 38072 - DNA, 20 bp, Artificial
  CRISPR gRNA sequence
ttactctgtaggttagcagg

SEQ ID NO: 38073 - DNA, 20 bp, Artificial
  CRISPR gRNA sequence
aggaagtaaaatcactgccc

SEQ ID NO: 38074 - DNA, 20 bp, Artificial
  CRISPR gRNA sequence
ggaagtaaaatcactgcccg

SEQ ID NO: 38075 - DNA, 20 bp, Artificial
  CRISPR gRNA sequence
aaaatcactgcccgaggcat

SEQ ID NO: 38076 - DNA, 20 bp, Artificial
  CRISPR gRNA sequence
tgcccgaggcatcagccacc

SEQ ID NO: 38077 - DNA, 20 bp, Artificial
  CRISPR gRNA sequence
aggcatcagccacctggtga

SEQ ID NO: 38078 - DNA, 20 bp, Artificial
  CRISPR gRNA sequence
aagctttgcctctctgtcca

SEQ ID NO: 38079 - DNA, 20 bp, Artificial
  CRISPR gRNA sequence
gcctctctgtccacagctga

SEQ ID NO: 38080 - DNA, 20 bp, Artificial
  CRISPR gRNA sequence
tctctgtccacagctgaaag

SEQ ID NO: 38081 - DNA, 20 bp, Artificial
  CRISPR gRNA sequence
tgtccacagctgaaagaagt

SEQ ID NO: 38082 - DNA, 20 bp, Artificial
  CRISPR gRNA sequence
gtccacagctgaaagaagtc

SEQ ID NO: 38083 - DNA, 20 bp, Artificial
  CRISPR gRNA sequence
acagctgaaagaagtcaggt

SEQ ID NO: 38084 - DNA, 20 bp, Artificial
  CRISPR gRNA sequence
gaagtcaggtgagtgatctc

SEQ ID NO: 38085 - DNA, 20 bp, Artificial
  CRISPR gRNA sequence
aagtcaggtgagtgatctcc

SEQ ID NO: 38086 - DNA, 20 bp, Artificial
  CRISPR gRNA sequence
gtcaggtgagtgatctccag

SEQ ID NO: 38087 - DNA, 20 bp, Artificial
  CRISPR gRNA sequence
tcaggtgagtgatctccagg

SEQ ID NO: 38088 - DNA, 20 bp, Artificial
  CRISPR gRNA sequence
caggtgagtgatctccagga

SEQ ID NO: 38089 - DNA, 20 bp, Artificial
  CRISPR gRNA sequence
ctccaggagggctcactgac

SEQ ID NO: 38090 - DNA, 20 bp, Artificial
  CRISPR gRNA sequence
tccaggagggctcactgact

SEQ ID NO: 38091 - DNA, 20 bp, Artificial
  CRISPR gRNA sequence
ccaggagggctcactgactg

SEQ ID NO: 38092 - DNA, 20 bp, Artificial
  CRISPR gRNA sequence
aggagggctcactgactggg

SEQ ID NO: 38093 - DNA, 20 bp, Artificial
  CRISPR gRNA sequence
ggctcactgactggggagat

SEQ ID NO: 38094 - DNA, 20 bp, Artificial
  CRISPR gRNA sequence
tggggagatgagccactgcc

SEQ ID NO: 38095 - DNA, 20 bp, Artificial
  CRISPR gRNA sequence
ggggagatgagccactgccc

SEQ ID NO: 38096 - DNA, 20 bp, Artificial
  CRISPR gRNA sequence
atgagccactgcccaggtcc

SEQ ID NO: 38097 - DNA, 20 bp, Artificial
  CRISPR gRNA sequence
gagccactgcccaggtccca

SEQ ID NO: 38098 - DNA, 20 bp, Artificial
  CRISPR gRNA sequence
cccaggtcccagagtccccc

SEQ ID NO: 38099 - DNA, 20 bp, Artificial
  CRISPR gRNA sequence
ccaggtcccagagtccccct

SEQ ID NO: 38100 - DNA, 20 bp, Artificial
  CRISPR gRNA sequence
caggtcccagagtccccctg

SEQ ID NO: 38101 - DNA, 20 bp, Artificial
  CRISPR gRNA sequence
tggggcctgcatgttcctcc

SEQ ID NO: 38102 - DNA, 20 bp, Artificial
  CRISPR gRNA sequence
catgttcctccaagtctgac

SEQ ID NO: 38103 - DNA, 20 bp, Artificial
  CRISPR gRNA sequence
gttcctccaagtctgaccag

SEQ ID NO: 38104 - DNA, 20 bp, Artificial
  CRISPR gRNA sequence
aagtctgaccagtagttttt

SEQ ID NO: 38105 - DNA, 20 bp, Artificial
  CRISPR gRNA sequence
ctgaccagtagtttttcagt

SEQ ID NO: 38106 - DNA, 20 bp, Artificial
  CRISPR gRNA sequence
agtagtttttcagtgagacc

SEQ ID NO: 38107 - DNA, 20 bp, Artificial
  CRISPR gRNA sequence
tagtttttcagtgagaccca

SEQ ID NO: 38108 - DNA, 20 bp, Artificial
  CRISPR gRNA sequence
gtttttcagtgagacccaga

SEQ ID NO: 38109 - DNA, 20 bp, Artificial
  CRISPR gRNA sequence
tttttcagtgagacccagag

SEQ ID NO: 38110 - DNA, 20 bp, Artificial
  CRISPR gRNA sequence
ttttcagtgagacccagaga

SEQ ID NO: 38111 - DNA, 20 bp, Artificial
  CRISPR gRNA sequence
tcagtgagacccagagaggg

SEQ ID NO: 38112 - DNA, 20 bp, Artificial
  CRISPR gRNA sequence
cagtgagacccagagaggga

SEQ ID NO: 38113 - DNA, 20 bp, Artificial
  CRISPR gRNA sequence
gacccagagagggaaggcat

SEQ ID NO: 38114 - DNA, 20 bp, Artificial
  CRISPR gRNA sequence
gagagggaaggcatcagtcc

SEQ ID NO: 38115 - DNA, 20 bp, Artificial
  CRISPR gRNA sequence
aaggcatcagtccaagtact

SEQ ID NO: 38116 - DNA, 20 bp, Artificial
  CRISPR gRNA sequence
gcatcagtccaagtactcag

SEQ ID NO: 38117 - DNA, 20 bp, Artificial
  CRISPR gRNA sequence
catcagtccaagtactcagt

SEQ ID NO: 38118 - DNA, 20 bp, Artificial
  CRISPR gRNA sequence
atcagtccaagtactcagta

SEQ ID NO: 38119 - DNA, 20 bp, Artificial
  CRISPR gRNA sequence
tccaagtactcagtagggct

SEQ ID NO: 38120 - DNA, 20 bp, Artificial
  CRISPR gRNA sequence
gtagggctgagtccaaaccc

SEQ ID NO: 38121 - DNA, 20 bp, Artificial
  CRISPR gRNA sequence
tagggctgagtccaaaccca

SEQ ID NO: 38122 - DNA, 20 bp, Artificial
  CRISPR gRNA sequence
gagtccaaacccaaggctcc

SEQ ID NO: 38123 - DNA, 20 bp, Artificial
  CRISPR gRNA sequence
gtccaaacccaaggctccca

SEQ ID NO: 38124 - DNA, 20 bp, Artificial
  CRISPR gRNA sequence
cccaaggctcccagagtccc

SEQ ID NO: 38125 - DNA, 20 bp, Artificial
  CRISPR gRNA sequence
caaggctcccagagtcccca

SEQ ID NO: 38126 - DNA, 20 bp, Artificial
  CRISPR gRNA sequence
gctcccagagtccccagagc

SEQ ID NO: 38127 - DNA, 20 bp, Artificial
  CRISPR gRNA sequence
ctcccagagtccccagagca

SEQ ID NO: 38128 - DNA, 20 bp, Artificial
  CRISPR gRNA sequence
gcttccttcatctaatattt

SEQ ID NO: 38129 - DNA, 20 bp, Artificial
  CRISPR gRNA sequence
tctaatattttagactgtct

SEQ ID NO: 38130 - DNA, 20 bp, Artificial
  CRISPR gRNA sequence
taatattttagactgtcttg

SEQ ID NO: 38131 - DNA, 20 bp, Artificial
  CRISPR gRNA sequence
aatattttagactgtcttgg

SEQ ID NO: 38132 - DNA, 20 bp, Artificial
  CRISPR gRNA sequence
tattttagactgtcttggag

SEQ ID NO: 38133 - DNA, 20 bp, Artificial
  CRISPR gRNA sequence
agactgtcttggaggagcat

SEQ ID NO: 38134 - DNA, 20 bp, Artificial
  CRISPR gRNA sequence
cttggaggagcatgagtgtt

SEQ ID NO: 38135 - DNA, 20 bp, Artificial
  CRISPR gRNA sequence
ttggaggagcatgagtgtta

SEQ ID NO: 38136 - DNA, 20 bp, Artificial
  CRISPR gRNA sequence
cctccctctttctgaaatcc

SEQ ID NO: 38137 - DNA, 20 bp, Artificial
  CRISPR gRNA sequence
ctccctctttctgaaatccc

SEQ ID NO: 38138 - DNA, 20 bp, Artificial
  CRISPR gRNA sequence
ccctctttctgaaatcccag

SEQ ID NO: 38139 - DNA, 20 bp, Artificial
  CRISPR gRNA sequence
tctttctgaaatcccaggag

SEQ ID NO: 38140 - DNA, 20 bp, Artificial
  CRISPR gRNA sequence
ctttctgaaatcccaggaga

SEQ ID NO: 38141 - DNA, 20 bp, Artificial
  CRISPR gRNA sequence
tttctgaaatcccaggagaa

SEQ ID NO: 38142 - DNA, 20 bp, Artificial
  CRISPR gRNA sequence
tgaaatcccaggagaaggga

SEQ ID NO: 38143 - DNA, 20 bp, Artificial
  CRISPR gRNA sequence
aatcccaggagaagggatag

SEQ ID NO: 38144 - DNA, 20 bp, Artificial
  CRISPR gRNA sequence
ggagaagggatagcagtgcg

SEQ ID NO: 38145 - DNA, 20 bp, Artificial
  CRISPR gRNA sequence
gagaagggatagcagtgcgt

SEQ ID NO: 38146 - DNA, 20 bp, Artificial
  CRISPR gRNA sequence
aagggatagcagtgcgtagg

SEQ ID NO: 38147 - DNA, 20 bp, Artificial
  CRISPR gRNA sequence
agggatagcagtgcgtaggc

SEQ ID NO: 38148 - DNA, 20 bp, Artificial
  CRISPR gRNA sequence
agcagtgcgtaggcaggaat

SEQ ID NO: 38149 - DNA, 20 bp, Artificial
  CRISPR gRNA sequence
gcagtgcgtaggcaggaatc

SEQ ID NO: 38150 - DNA, 20 bp, Artificial
  CRISPR gRNA sequence
taggcaggaatcaggcactg

SEQ ID NO: 38151 - DNA, 20 bp, Artificial
  CRISPR gRNA sequence
aggcaggaatcaggcactgt

SEQ ID NO: 38152 - DNA, 20 bp, Artificial
  CRISPR gRNA sequence
tgggtacacataactacatg

SEQ ID NO: 38153 - DNA, 20 bp, Artificial
  CRISPR gRNA sequence
cacacatgtctacacttgca

SEQ ID NO: 38154 - DNA, 20 bp, Artificial
  CRISPR gRNA sequence
acatgtctacacttgcacag

SEQ ID NO: 38155 - DNA, 20 bp, Artificial
  CRISPR gRNA sequence
tacacttgcacagaagtaca

SEQ ID NO: 38156 - DNA, 20 bp, Artificial
  CRISPR gRNA sequence
acacttgcacagaagtacac

SEQ ID NO: 38157 - DNA, 20 bp, Artificial
  CRISPR gRNA sequence
agaagtacacaggcatatgc

SEQ ID NO: 38158 - DNA, 20 bp, Artificial
  CRISPR gRNA sequence
cacccacacatgcccactca

SEQ ID NO: 38159 - DNA, 20 bp, Artificial
  CRISPR gRNA sequence
acccacacatgcccactcat

SEQ ID NO: 38160 - DNA, 20 bp, Artificial
  CRISPR gRNA sequence
cataggtgtgcacatgtatg

SEQ ID NO: 38161 - DNA, 20 bp, Artificial
  CRISPR gRNA sequence
acatgtacacattttgatgc

SEQ ID NO: 38162 - DNA, 20 bp, Artificial
  CRISPR gRNA sequence
ccagcacactctaactaact

SEQ ID NO: 38163 - DNA, 20 bp, Artificial
  CRISPR gRNA sequence
atatactcctgccctgtgtc

SEQ ID NO: 38164 - DNA, 20 bp, Artificial
  CRISPR gRNA sequence
tatactcctgccctgtgtct

SEQ ID NO: 38165 - DNA, 20 bp, Artificial
  CRISPR gRNA sequence
cctgccctgtgtctgggact

SEQ ID NO: 38166 - DNA, 20 bp, Artificial
  CRISPR gRNA sequence
gtgtctgggactcagtacca

SEQ ID NO: 38167 - DNA, 20 bp, Artificial
  CRISPR gRNA sequence
tgtctgggactcagtaccat

SEQ ID NO: 38168 - DNA, 20 bp, Artificial
  CRISPR gRNA sequence
gtctgggactcagtaccatg

SEQ ID NO: 38169 - DNA, 20 bp, Artificial
  CRISPR gRNA sequence
ctgggactcagtaccatggg

SEQ ID NO: 38170 - DNA, 20 bp, Artificial
  CRISPR gRNA sequence
tgggactcagtaccatgggg

SEQ ID NO: 38171 - DNA, 20 bp, Artificial
  CRISPR gRNA sequence
ggactcagtaccatggggag

SEQ ID NO: 38172 - DNA, 20 bp, Artificial
  CRISPR gRNA sequence
ctcagtaccatggggaggag

SEQ ID NO: 38173 - DNA, 20 bp, Artificial
  CRISPR gRNA sequence
tcagtaccatggggaggagt

SEQ ID NO: 38174 - DNA, 20 bp, Artificial
  CRISPR gRNA sequence
accatggggaggagtgggac

SEQ ID NO: 38175 - DNA, 20 bp, Artificial
  CRISPR gRNA sequence
ggaccagtgaccctcctccc

SEQ ID NO: 38176 - DNA, 20 bp, Artificial
  CRISPR gRNA sequence
ccagtgaccctcctccctgg

SEQ ID NO: 38177 - DNA, 20 bp, Artificial
  CRISPR gRNA sequence
cctccctggcagaacgctgc

SEQ ID NO: 38178 - DNA, 20 bp, Artificial
  CRISPR gRNA sequence
cagaacgctgctagtttata

SEQ ID NO: 38179 - DNA, 20 bp, Artificial
  CRISPR gRNA sequence
tatggcacctttatgacatt

SEQ ID NO: 38180 - DNA, 20 bp, Artificial
  CRISPR gRNA sequence
tggcacctttatgacattta

SEQ ID NO: 38181 - DNA, 20 bp, Artificial
  CRISPR gRNA sequence
cacctttatgacatttagag

SEQ ID NO: 38182 - DNA, 20 bp, Artificial
  CRISPR gRNA sequence
acctttatgacatttagaga

SEQ ID NO: 38183 - DNA, 20 bp, Artificial
  CRISPR gRNA sequence
aaggcaccacttcatccaca

SEQ ID NO: 38184 - DNA, 20 bp, Artificial
  CRISPR gRNA sequence
ccacttcatccacacagatg

SEQ ID NO: 38185 - DNA, 20 bp, Artificial
  CRISPR gRNA sequence
cacagatgcagcctgtcact

SEQ ID NO: 38186 - DNA, 20 bp, Artificial
  CRISPR gRNA sequence
acagatgcagcctgtcacta

SEQ ID NO: 38187 - DNA, 20 bp, Artificial
  CRISPR gRNA sequence
tgcagcctgtcactaaggtt

SEQ ID NO: 38188 - DNA, 20 bp, Artificial
  CRISPR gRNA sequence
actaaggttcagcacttgtt

SEQ ID NO: 38189 - DNA, 20 bp, Artificial
  CRISPR gRNA sequence
acttgttgagtgaaaataat

SEQ ID NO: 38190 - DNA, 20 bp, Artificial
  CRISPR gRNA sequence
gttgagtgaaaataataagt

SEQ ID NO: 38191 - DNA, 20 bp, Artificial
  CRISPR gRNA sequence
gaaaataataagttggacca

SEQ ID NO: 38192 - DNA, 20 bp, Artificial
  CRISPR gRNA sequence
cacagtccctattgtcgtct

SEQ ID NO: 38193 - DNA, 20 bp, Artificial
  CRISPR gRNA sequence
gtccctattgtcgtctcggc

SEQ ID NO: 38194 - DNA, 20 bp, Artificial
  CRISPR gRNA sequence
tccctattgtcgtctcggct

SEQ ID NO: 38195 - DNA, 20 bp, Artificial
  CRISPR gRNA sequence
ggcatctgtgaaccgtgatt

SEQ ID NO: 38196 - DNA, 20 bp, Artificial
  CRISPR gRNA sequence
ctgtgaaccgtgattaagcc

SEQ ID NO: 38197 - DNA, 20 bp, Artificial
  CRISPR gRNA sequence
tgtgaaccgtgattaagcca

SEQ ID NO: 38198 - DNA, 20 bp, Artificial
  CRISPR gRNA sequence
accgtgattaagccaaggtt

SEQ ID NO: 38199 - DNA, 20 bp, Artificial
  CRISPR gRNA sequence
gtgattaagccaaggttcag

SEQ ID NO: 38200 - DNA, 20 bp, Artificial
  CRISPR gRNA sequence
ttgttgacatttttcttccc

SEQ ID NO: 38201 - DNA, 20 bp, Artificial
  CRISPR gRNA sequence
ttttcttccctggctattga

SEQ ID NO: 38202 - DNA, 20 bp, Artificial
  CRISPR gRNA sequence
cctcaactcatctgtctccc

SEQ ID NO: 38203 - DNA, 20 bp, Artificial
  CRISPR gRNA sequence
aactcatctgtctccccagc

SEQ ID NO: 38204 - DNA, 20 bp, Artificial
  CRISPR gRNA sequence
actcatctgtctccccagct

SEQ ID NO: 38205 - DNA, 20 bp, Artificial
  CRISPR gRNA sequence
tgtctccccagctaggaacc

SEQ ID NO: 38206 - DNA, 20 bp, Artificial
  CRISPR gRNA sequence
gtctccccagctaggaaccc

SEQ ID NO: 38207 - DNA, 20 bp, Artificial
  CRISPR gRNA sequence
ccccagctaggaacccaggc

SEQ ID NO: 38208 - DNA, 20 bp, Artificial
  CRISPR gRNA sequence
cccagctaggaacccaggca

SEQ ID NO: 38209 - DNA, 20 bp, Artificial
  CRISPR gRNA sequence
gctaggaacccaggcaaggc

SEQ ID NO: 38210 - DNA, 20 bp, Artificial
  CRISPR gRNA sequence
aggcaaggctggcttgtgaa

SEQ ID NO: 38211 - DNA, 20 bp, Artificial
  CRISPR gRNA sequence
ggcaaggctggcttgtgaac

SEQ ID NO: 38212 - DNA, 20 bp, Artificial
  CRISPR gRNA sequence
aaggctggcttgtgaacagg

SEQ ID NO: 38213 - DNA, 20 bp, Artificial
  CRISPR gRNA sequence
aggctggcttgtgaacaggt

SEQ ID NO: 38214 - DNA, 20 bp, Artificial
  CRISPR gRNA sequence
ggctggcttgtgaacaggtg

SEQ ID NO: 38215 - DNA, 20 bp, Artificial
  CRISPR gRNA sequence
ggcttgtgaacaggtgggga

SEQ ID NO: 38216 - DNA, 20 bp, Artificial
  CRISPR gRNA sequence
tgtgaacaggtggggaaagt

SEQ ID NO: 38217 - DNA, 20 bp, Artificial
  CRISPR gRNA sequence
gtgaacaggtggggaaagtg

SEQ ID NO: 38218 - DNA, 20 bp, Artificial
  CRISPR gRNA sequence
acaggtggggaaagtgaggt

SEQ ID NO: 38219 - DNA, 20 bp, Artificial
  CRISPR gRNA sequence
aggtggggaaagtgaggtca

SEQ ID NO: 38220 - DNA, 20 bp, Artificial
  CRISPR gRNA sequence
gtggggaaagtgaggtcaga

SEQ ID NO: 38221 - DNA, 20 bp, Artificial
  CRISPR gRNA sequence
tggggaaagtgaggtcagag

SEQ ID NO: 38222 - DNA, 20 bp, Artificial
  CRISPR gRNA sequence
aggtcagagaggaatgcgct

SEQ ID NO: 38223 - DNA, 20 bp, Artificial
  CRISPR gRNA sequence
agagaggaatgcgcttggct

SEQ ID NO: 38224 - DNA, 20 bp, Artificial
  CRISPR gRNA sequence
gagaggaatgcgcttggctc

SEQ ID NO: 38225 - DNA, 20 bp, Artificial
  CRISPR gRNA sequence
agaggaatgcgcttggctca

SEQ ID NO: 38226 - DNA, 20 bp, Artificial
  CRISPR gRNA sequence
atgcgcttggctcagggctc

SEQ ID NO: 38227 - DNA, 20 bp, Artificial
  CRISPR gRNA sequence
tgcgcttggctcagggctct

SEQ ID NO: 38228 - DNA, 20 bp, Artificial
  CRISPR gRNA sequence
cttggctcagggctctgggt

SEQ ID NO: 38229 - DNA, 20 bp, Artificial
  CRISPR gRNA sequence
gctcagggctctgggtgagt

SEQ ID NO: 38230 - DNA, 20 bp, Artificial
  CRISPR gRNA sequence
ctcagggctctgggtgagtc

SEQ ID NO: 38231 - DNA, 20 bp, Artificial
  CRISPR gRNA sequence
tcagggctctgggtgagtca

SEQ ID NO: 38232 - DNA, 20 bp, Artificial
  CRISPR gRNA sequence
ctctgggtgagtcagggcca

SEQ ID NO: 38233 - DNA, 20 bp, Artificial
  CRISPR gRNA sequence
ggtgagtcagggccacagcc

SEQ ID NO: 38234 - DNA, 20 bp, Artificial
  CRISPR gRNA sequence
gtgagtcagggccacagccg

SEQ ID NO: 38235 - DNA, 20 bp, Artificial
  CRISPR gRNA sequence
gtcagggccacagccgaggc

SEQ ID NO: 38236 - DNA, 20 bp, Artificial
  CRISPR gRNA sequence
agggccacagccgaggctgg

SEQ ID NO: 38237 - DNA, 20 bp, Artificial
  CRISPR gRNA sequence
gaggctggaagcgatgtctg

SEQ ID NO: 38238 - DNA, 20 bp, Artificial
  CRISPR gRNA sequence
aagcgatgtctgcagcgtcc

SEQ ID NO: 38239 - DNA, 20 bp, Artificial
  CRISPR gRNA sequence
atgtctgcagcgtcccagtc

SEQ ID NO: 38240 - DNA, 20 bp, Artificial
  CRISPR gRNA sequence
tctagactttactcattgcc

SEQ ID NO: 38241 - DNA, 20 bp, Artificial
  CRISPR gRNA sequence
ctagactttactcattgcct

SEQ ID NO: 38242 - DNA, 20 bp, Artificial
  CRISPR gRNA sequence
tagactttactcattgcctg

SEQ ID NO: 38243 - DNA, 20 bp, Artificial
  CRISPR gRNA sequence
agactttactcattgcctgg

SEQ ID NO: 38244 - DNA, 20 bp, Artificial
  CRISPR gRNA sequence
gactttactcattgcctggg

SEQ ID NO: 38245 - DNA, 20 bp, Artificial
  CRISPR gRNA sequence
attgcctggggggcctatcc

SEQ ID NO: 38246 - DNA, 20 bp, Artificial
  CRISPR gRNA sequence
ttgcctggggggcctatccc

SEQ ID NO: 38247 - DNA, 20 bp, Artificial
  CRISPR gRNA sequence
ggcctatcccaggcacatcc

SEQ ID NO: 38248 - DNA, 20 bp, Artificial
  CRISPR gRNA sequence
gcctatcccaggcacatccc

SEQ ID NO: 38249 - DNA, 20 bp, Artificial
  CRISPR gRNA sequence
cccaggcacatcccaggcat

SEQ ID NO: 38250 - DNA, 20 bp, Artificial
  CRISPR gRNA sequence
cacatcccaggcataagccc

SEQ ID NO: 38251 - DNA, 20 bp, Artificial
  CRISPR gRNA sequence
acatcccaggcataagccct

SEQ ID NO: 38252 - DNA, 20 bp, Artificial
  CRISPR gRNA sequence
atcccaggcataagccctgg

SEQ ID NO: 38253 - DNA, 20 bp, Artificial
  CRISPR gRNA sequence
ccaggcataagccctgggag

SEQ ID NO: 38254 - DNA, 20 bp, Artificial
  CRISPR gRNA sequence
caggcataagccctgggagc

SEQ ID NO: 38255 - DNA, 20 bp, Artificial
  CRISPR gRNA sequence
aggcataagccctgggagca

SEQ ID NO: 38256 - DNA, 20 bp, Artificial
  CRISPR gRNA sequence
aagccctgggagcagggtgc

SEQ ID NO: 38257 - DNA, 20 bp, Artificial
  CRISPR gRNA sequence
agccctgggagcagggtgct

SEQ ID NO: 38258 - DNA, 20 bp, Artificial
  CRISPR gRNA sequence
tctcctcattgtgcctcatg

SEQ ID NO: 38259 - DNA, 20 bp, Artificial
  CRISPR gRNA sequence
tcctcattgtgcctcatgaa

SEQ ID NO: 38260 - DNA, 20 bp, Artificial
  CRISPR gRNA sequence
cctcattgtgcctcatgaag

SEQ ID NO: 38261 - DNA, 20 bp, Artificial
  CRISPR gRNA sequence
gtgcctcatgaagaggccgt

SEQ ID NO: 38262 - DNA, 20 bp, Artificial
  CRISPR gRNA sequence
gaggccgtcagtctgtcttc

SEQ ID NO: 38263 - DNA, 20 bp, Artificial
  CRISPR gRNA sequence
gtctgtcttctagatccctt

SEQ ID NO: 38264 - DNA, 20 bp, Artificial
  CRISPR gRNA sequence
ttctagatcccttgagccgc

SEQ ID NO: 38265 - DNA, 20 bp, Artificial
  CRISPR gRNA sequence
tctagatcccttgagccgcc

SEQ ID NO: 38266 - DNA, 20 bp, Artificial
  CRISPR gRNA sequence
gccaggcaaaaacttcccca

SEQ ID NO: 38267 - DNA, 20 bp, Artificial
  CRISPR gRNA sequence
ccaggcaaaaacttccccat

SEQ ID NO: 38268 - DNA, 20 bp, Artificial
  CRISPR gRNA sequence
caaaaacttccccataggaa

SEQ ID NO: 38269 - DNA, 20 bp, Artificial
  CRISPR gRNA sequence
acttccccataggaacagaa

SEQ ID NO: 38270 - DNA, 20 bp, Artificial
  CRISPR gRNA sequence
ccataggaacagaatagacc

SEQ ID NO: 38271 - DNA, 20 bp, Artificial
  CRISPR gRNA sequence
aacagaatagacccagaatt

SEQ ID NO: 38272 - DNA, 20 bp, Artificial
  CRISPR gRNA sequence
acagaatagacccagaattg

SEQ ID NO: 38273 - DNA, 20 bp, Artificial
  CRISPR gRNA sequence
aatagacccagaattgaggc

SEQ ID NO: 38274 - DNA, 20 bp, Artificial
  CRISPR gRNA sequence
agacccagaattgaggccag

SEQ ID NO: 38275 - DNA, 20 bp, Artificial
  CRISPR gRNA sequence
acccagaattgaggccagca

SEQ ID NO: 38276 - DNA, 20 bp, Artificial
  CRISPR gRNA sequence
cccagaattgaggccagcag

SEQ ID NO: 38277 - DNA, 20 bp, Artificial
  CRISPR gRNA sequence
ccagaattgaggccagcaga

SEQ ID NO: 38278 - DNA, 20 bp, Artificial
  CRISPR gRNA sequence
cagcagagggtctttcctcc

SEQ ID NO: 38279 - DNA, 20 bp, Artificial
  CRISPR gRNA sequence
ttcctcctagccgtgcctgc

SEQ ID NO: 38280 - DNA, 20 bp, Artificial
  CRISPR gRNA sequence
tagccgtgcctgctggaatc

SEQ ID NO: 38281 - DNA, 20 bp, Artificial
  CRISPR gRNA sequence
cgtgcctgctggaatccggc

SEQ ID NO: 38282 - DNA, 20 bp, Artificial
  CRISPR gRNA sequence
gcctgctggaatccggcgag

SEQ ID NO: 38283 - DNA, 20 bp, Artificial
  CRISPR gRNA sequence
cctgctggaatccggcgagc

SEQ ID NO: 38284 - DNA, 20 bp, Artificial
  CRISPR gRNA sequence
gaatccggcgagcaggccat

SEQ ID NO: 38285 - DNA, 20 bp, Artificial
  CRISPR gRNA sequence
agcaggccatcagctctttc

SEQ ID NO: 38286 - DNA, 20 bp, Artificial
  CRISPR gRNA sequence
gcaggccatcagctctttct

SEQ ID NO: 38287 - DNA, 20 bp, Artificial
  CRISPR gRNA sequence
ctgtcttatgtctcccacat

SEQ ID NO: 38288 - DNA, 20 bp, Artificial
  CRISPR gRNA sequence
tgtcttatgtctcccacatg

SEQ ID NO: 38289 - DNA, 20 bp, Artificial
  CRISPR gRNA sequence
gtcttatgtctcccacatga

SEQ ID NO: 38290 - DNA, 20 bp, Artificial
  CRISPR gRNA sequence
ttatgtctcccacatgaggg

SEQ ID NO: 38291 - DNA, 20 bp, Artificial
  CRISPR gRNA sequence
ccatcctgtcacttgctaac

SEQ ID NO: 38292 - DNA, 20 bp, Artificial
  CRISPR gRNA sequence
catcctgtcacttgctaact

SEQ ID NO: 38293 - DNA, 20 bp, Artificial
  CRISPR gRNA sequence
atcctgtcacttgctaactg

SEQ ID NO: 38294 - DNA, 20 bp, Artificial
  CRISPR gRNA sequence
acttgctaactggggcttgc

SEQ ID NO: 38295 - DNA, 20 bp, Artificial
  CRISPR gRNA sequence
gcttgcaagtgccccaaccc

SEQ ID NO: 38296 - DNA, 20 bp, Artificial
  CRISPR gRNA sequence
cttgcaagtgccccaacccc

SEQ ID NO: 38297 - DNA, 20 bp, Artificial
  CRISPR gRNA sequence
ttgcaagtgccccaacccca

SEQ ID NO: 38298 - DNA, 20 bp, Artificial
  CRISPR gRNA sequence
agtgccccaaccccagggca

SEQ ID NO: 38299 - DNA, 20 bp, Artificial
  CRISPR gRNA sequence
gtgccccaaccccagggcaa

SEQ ID NO: 38300 - DNA, 20 bp, Artificial
  CRISPR gRNA sequence
tgccccaaccccagggcaaa

SEQ ID NO: 38301 - DNA, 20 bp, Artificial
  CRISPR gRNA sequence
caaccccagggcaaagggac

SEQ ID NO: 38302 - DNA, 20 bp, Artificial
  CRISPR gRNA sequence
aaccccagggcaaagggact

SEQ ID NO: 38303 - DNA, 20 bp, Artificial
  CRISPR gRNA sequence
agggcaaagggactgggcct

SEQ ID NO: 38304 - DNA, 20 bp, Artificial
  CRISPR gRNA sequence
actgggccttggtctcctcg

SEQ ID NO: 38305 - DNA, 20 bp, Artificial
  CRISPR gRNA sequence
cttggtctcctcgcagtttt

SEQ ID NO: 38306 - DNA, 20 bp, Artificial
  CRISPR gRNA sequence
ttggtctcctcgcagttttc

SEQ ID NO: 38307 - DNA, 20 bp, Artificial
  CRISPR gRNA sequence
ctcgcagttttcgggacaac

SEQ ID NO: 38308 - DNA, 20 bp, Artificial
  CRISPR gRNA sequence
agttttcgggacaaccagct

SEQ ID NO: 38309 - DNA, 20 bp, Artificial
  CRISPR gRNA sequence
gggacaaccagctcagtgac

SEQ ID NO: 38310 - DNA, 20 bp, Artificial
  CRISPR gRNA sequence
ggacaaccagctcagtgacc

SEQ ID NO: 38311 - DNA, 20 bp, Artificial
  CRISPR gRNA sequence
caaccagctcagtgaccagg

SEQ ID NO: 38312 - DNA, 20 bp, Artificial
  CRISPR gRNA sequence
ccaggtggtgctgaacattg

SEQ ID NO: 38313 - DNA, 20 bp, Artificial
  CRISPR gRNA sequence
aggtggtgctgaacattgtg

SEQ ID NO: 38314 - DNA, 20 bp, Artificial
  CRISPR gRNA sequence
ggtggtgctgaacattgtgg

SEQ ID NO: 38315 - DNA, 20 bp, Artificial
  CRISPR gRNA sequence
aggttctccctcacctacca

SEQ ID NO: 38316 - DNA, 20 bp, Artificial
  CRISPR gRNA sequence
tccctcacctaccacggctc

SEQ ID NO: 38317 - DNA, 20 bp, Artificial
  CRISPR gRNA sequence
ctcacctaccacggctccgg

SEQ ID NO: 38318 - DNA, 20 bp, Artificial
  CRISPR gRNA sequence
taccacggctccggaagctt

SEQ ID NO: 38319 - DNA, 20 bp, Artificial
  CRISPR gRNA sequence
acggctccggaagcttgagt

SEQ ID NO: 38320 - DNA, 20 bp, Artificial
  CRISPR gRNA sequence
tgatctttccactgcctctg

SEQ ID NO: 38321 - DNA, 20 bp, Artificial
  CRISPR gRNA sequence
tttccactgcctctgcagcc

SEQ ID NO: 38322 - DNA, 20 bp, Artificial
  CRISPR gRNA sequence
gattcaccccactcccttgc

SEQ ID NO: 38323 - DNA, 20 bp, Artificial
  CRISPR gRNA sequence
attcaccccactcccttgca

SEQ ID NO: 38324 - DNA, 20 bp, Artificial
  CRISPR gRNA sequence
accccactcccttgcaaggc

SEQ ID NO: 38325 - DNA, 20 bp, Artificial
  CRISPR gRNA sequence
ccccactcccttgcaaggca

SEQ ID NO: 38326 - DNA, 20 bp, Artificial
  CRISPR gRNA sequence
cactcccttgcaaggcaagg

SEQ ID NO: 38327 - DNA, 20 bp, Artificial
  CRISPR gRNA sequence
actcccttgcaaggcaagga

SEQ ID NO: 38328 - DNA, 20 bp, Artificial
  CRISPR gRNA sequence
cttgcaaggcaaggaaggtc

SEQ ID NO: 38329 - DNA, 20 bp, Artificial
  CRISPR gRNA sequence
ttgcaaggcaaggaaggtct

SEQ ID NO: 38330 - DNA, 20 bp, Artificial
  CRISPR gRNA sequence
tgcaaggcaaggaaggtctg

SEQ ID NO: 38331 - DNA, 20 bp, Artificial
  CRISPR gRNA sequence
caaggaaggtctggggcccc

SEQ ID NO: 38332 - DNA, 20 bp, Artificial
  CRISPR gRNA sequence
aaggaaggtctggggcccct

SEQ ID NO: 38333 - DNA, 20 bp, Artificial
  CRISPR gRNA sequence
aggaaggtctggggcccctg

SEQ ID NO: 38334 - DNA, 20 bp, Artificial
  CRISPR gRNA sequence
aaggtctggggcccctgggg

SEQ ID NO: 38335 - DNA, 20 bp, Artificial
  CRISPR gRNA sequence
aggtctggggcccctggggt

SEQ ID NO: 38336 - DNA, 20 bp, Artificial
  CRISPR gRNA sequence
ggtctggggcccctggggta

SEQ ID NO: 38337 - DNA, 20 bp, Artificial
  CRISPR gRNA sequence
gtctggggcccctggggtag

SEQ ID NO: 38338 - DNA, 20 bp, Artificial
  CRISPR gRNA sequence
acacctttgccacaatcttg

SEQ ID NO: 38339 - DNA, 20 bp, Artificial
  CRISPR gRNA sequence
ttgccacaatcttgcagcct

SEQ ID NO: 38340 - DNA, 20 bp, Artificial
  CRISPR gRNA sequence
ccacaatcttgcagcctgag

SEQ ID NO: 38341 - DNA, 20 bp, Artificial
  CRISPR gRNA sequence
tcttgcagcctgagcagcaa

SEQ ID NO: 38342 - DNA, 20 bp, Artificial
  CRISPR gRNA sequence
cgtgtcaaccctactctgct

SEQ ID NO: 38343 - DNA, 20 bp, Artificial
  CRISPR gRNA sequence
tcaaccctactctgcttggc

SEQ ID NO: 38344 - DNA, 20 bp, Artificial
  CRISPR gRNA sequence
caaccctactctgcttggca

SEQ ID NO: 38345 - DNA, 20 bp, Artificial
  CRISPR gRNA sequence
aaccctactctgcttggcaa

SEQ ID NO: 38346 - DNA, 20 bp, Artificial
  CRISPR gRNA sequence
cctactctgcttggcaaggg

SEQ ID NO: 38347 - DNA, 20 bp, Artificial
  CRISPR gRNA sequence
actctgcttggcaagggtgg

SEQ ID NO: 38348 - DNA, 20 bp, Artificial
  CRISPR gRNA sequence
gcagtcacgtgtcctaccgt

SEQ ID NO: 38349 - DNA, 20 bp, Artificial
  CRISPR gRNA sequence
cagtcacgtgtcctaccgtc

SEQ ID NO: 38350 - DNA, 20 bp, Artificial
  CRISPR gRNA sequence
gtcctaccgtcaggatgctt

SEQ ID NO: 38351 - DNA, 20 bp, Artificial
  CRISPR gRNA sequence
tcctaccgtcaggatgcttc

SEQ ID NO: 38352 - DNA, 20 bp, Artificial
  CRISPR gRNA sequence
accgtcaggatgcttcaggc

SEQ ID NO: 38353 - DNA, 20 bp, Artificial
  CRISPR gRNA sequence
ccgtcaggatgcttcaggcc

SEQ ID NO: 38354 - DNA, 20 bp, Artificial
  CRISPR gRNA sequence
caggatgcttcaggccaggt

SEQ ID NO: 38355 - DNA, 20 bp, Artificial
  CRISPR gRNA sequence
gatgcttcaggccaggtgag

SEQ ID NO: 38356 - DNA, 20 bp, Artificial
  CRISPR gRNA sequence
gcttcaggccaggtgagcag

SEQ ID NO: 38357 - DNA, 20 bp, Artificial
  CRISPR gRNA sequence
cttcaggccaggtgagcaga

SEQ ID NO: 38358 - DNA, 20 bp, Artificial
  CRISPR gRNA sequence
aggccaggtgagcagaagga

SEQ ID NO: 38359 - DNA, 20 bp, Artificial
  CRISPR gRNA sequence
ggccaggtgagcagaaggaa

SEQ ID NO: 38360 - DNA, 20 bp, Artificial
  CRISPR gRNA sequence
gccaggtgagcagaaggaaa

SEQ ID NO: 38361 - DNA, 20 bp, Artificial
  CRISPR gRNA sequence
gagcagaaggaaagggatct

SEQ ID NO: 38362 - DNA, 20 bp, Artificial
  CRISPR gRNA sequence
ggaaagggatcttggcctta

SEQ ID NO: 38363 - DNA, 20 bp, Artificial
  CRISPR gRNA sequence
gaaagggatcttggccttat

SEQ ID NO: 38364 - DNA, 20 bp, Artificial
  CRISPR gRNA sequence
atcttggccttatgggcctt

SEQ ID NO: 38365 - DNA, 20 bp, Artificial
  CRISPR gRNA sequence
ggccttatgggccttgagaa

SEQ ID NO: 38366 - DNA, 20 bp, Artificial
  CRISPR gRNA sequence
ccttatgggccttgagaaaa

SEQ ID NO: 38367 - DNA, 20 bp, Artificial
  CRISPR gRNA sequence
cttatgggccttgagaaaag

SEQ ID NO: 38368 - DNA, 20 bp, Artificial
  CRISPR gRNA sequence
tatgggccttgagaaaagag

SEQ ID NO: 38369 - DNA, 20 bp, Artificial
  CRISPR gRNA sequence
atgggccttgagaaaagagg

SEQ ID NO: 38370 - DNA, 20 bp, Artificial
  CRISPR gRNA sequence
tgggccttgagaaaagagga

SEQ ID NO: 38371 - DNA, 20 bp, Artificial
  CRISPR gRNA sequence
gggccttgagaaaagaggag

SEQ ID NO: 38372 - DNA, 20 bp, Artificial
  CRISPR gRNA sequence
cttgagaaaagaggagggga

SEQ ID NO: 38373 - DNA, 20 bp, Artificial
  CRISPR gRNA sequence
gagaaaagaggaggggaaag

SEQ ID NO: 38374 - DNA, 20 bp, Artificial
  CRISPR gRNA sequence
agaaaagaggaggggaaagt

SEQ ID NO: 38375 - DNA, 20 bp, Artificial
  CRISPR gRNA sequence
aagaggaggggaaagtggga

SEQ ID NO: 38376 - DNA, 20 bp, Artificial
  CRISPR gRNA sequence
agaggaggggaaagtgggat

SEQ ID NO: 38377 - DNA, 20 bp, Artificial
  CRISPR gRNA sequence
ggggaaagtgggatgggaaa

SEQ ID NO: 38378 - DNA, 20 bp, Artificial
  CRISPR gRNA sequence
ggaaagtgggatgggaaatg

SEQ ID NO: 38379 - DNA, 20 bp, Artificial
  CRISPR gRNA sequence
gaaagtgggatgggaaatgg

SEQ ID NO: 38380 - DNA, 20 bp, Artificial
  CRISPR gRNA sequence
aagtgggatgggaaatggag

SEQ ID NO: 38381 - DNA, 20 bp, Artificial
  CRISPR gRNA sequence
agtgggatgggaaatggagg

SEQ ID NO: 38382 - DNA, 20 bp, Artificial
  CRISPR gRNA sequence
tggaggaggcccctcgtctg

SEQ ID NO: 38383 - DNA, 20 bp, Artificial
  CRISPR gRNA sequence
ggaggaggcccctcgtctgc

SEQ ID NO: 38384 - DNA, 20 bp, Artificial
  CRISPR gRNA sequence
ataccctactgttttactca

SEQ ID NO: 38385 - DNA, 20 bp, Artificial
  CRISPR gRNA sequence
tttactcacagctttacctt

SEQ ID NO: 38386 - DNA, 20 bp, Artificial
  CRISPR gRNA sequence
acagctttaccttcagaacc

SEQ ID NO: 38387 - DNA, 20 bp, Artificial
  CRISPR gRNA sequence
tttaccttcagaacctagct

SEQ ID NO: 38388 - DNA, 20 bp, Artificial
  CRISPR gRNA sequence
ttaccttcagaacctagctc

SEQ ID NO: 38389 - DNA, 20 bp, Artificial
  CRISPR gRNA sequence
ttcagaacctagctcaggct

SEQ ID NO: 38390 - DNA, 20 bp, Artificial
  CRISPR gRNA sequence
cctagctcaggcttggcacc

SEQ ID NO: 38391 - DNA, 20 bp, Artificial
  CRISPR gRNA sequence
caggcttggcacctggtact

SEQ ID NO: 38392 - DNA, 20 bp, Artificial
  CRISPR gRNA sequence
cttggtatatattgaattaa

SEQ ID NO: 38393 - DNA, 20 bp, Artificial
  CRISPR gRNA sequence
gtatatattgaattaatgga

SEQ ID NO: 38394 - DNA, 20 bp, Artificial
  CRISPR gRNA sequence
tgaattaatggatggatgaa

SEQ ID NO: 38395 - DNA, 20 bp, Artificial
  CRISPR gRNA sequence
ttaatggatggatgaaaaga

SEQ ID NO: 38396 - DNA, 20 bp, Artificial
  CRISPR gRNA sequence
tggatgaaaagatggatgta

SEQ ID NO: 38397 - DNA, 20 bp, Artificial
  CRISPR gRNA sequence
tgaaaagatggatgtatgga

SEQ ID NO: 38398 - DNA, 20 bp, Artificial
  CRISPR gRNA sequence
aagatggatgtatggatgga

SEQ ID NO: 38399 - DNA, 20 bp, Artificial
  CRISPR gRNA sequence
tgtatggatggatggctgaa

SEQ ID NO: 38400 - DNA, 20 bp, Artificial
  CRISPR gRNA sequence
tggatggatggctgaaaaga

SEQ ID NO: 38401 - DNA, 20 bp, Artificial
  CRISPR gRNA sequence
tggatggctgaaaagatgga

SEQ ID NO: 38402 - DNA, 20 bp, Artificial
  CRISPR gRNA sequence
ggatggctgaaaagatggat

SEQ ID NO: 38403 - DNA, 20 bp, Artificial
  CRISPR gRNA sequence
tggctgaaaagatggatggg

SEQ ID NO: 38404 - DNA, 20 bp, Artificial
  CRISPR gRNA sequence
aagatggatgggtggatgaa

SEQ ID NO: 38405 - DNA, 20 bp, Artificial
  CRISPR gRNA sequence
tggatgggtggatgaaaaga

SEQ ID NO: 38406 - DNA, 20 bp, Artificial
  CRISPR gRNA sequence
tgggtggatgaaaagatgga

SEQ ID NO: 38407 - DNA, 20 bp, Artificial
  CRISPR gRNA sequence
tgaaaagatggatggatgaa

SEQ ID NO: 38408 - DNA, 20 bp, Artificial
  CRISPR gRNA sequence
aagatggatggatgaatgga

SEQ ID NO: 38409 - DNA, 20 bp, Artificial
  CRISPR gRNA sequence
tggatgaatggatggctgaa

SEQ ID NO: 38410 - DNA, 20 bp, Artificial
  CRISPR gRNA sequence
tgaatggatggctgaaaaga

SEQ ID NO: 38411 - DNA, 20 bp, Artificial
  CRISPR gRNA sequence
tggatggctgaaaagatgga

SEQ ID NO: 38412 - DNA, 20 bp, Artificial
  CRISPR gRNA sequence
ggatggctgaaaagatggat

SEQ ID NO: 38413 - DNA, 20 bp, Artificial
  CRISPR gRNA sequence
tggctgaaaagatggatggg

SEQ ID NO: 38414 - DNA, 20 bp, Artificial
  CRISPR gRNA sequence
aagatggatgggtggatgaa

SEQ ID NO: 38415 - DNA, 20 bp, Artificial
  CRISPR gRNA sequence
tggatgggtggatgaaaaga

SEQ ID NO: 38416 - DNA, 20 bp, Artificial
  CRISPR gRNA sequence
tgggtggatgaaaagatgga

SEQ ID NO: 38417 - DNA, 20 bp, Artificial
  CRISPR gRNA sequence
tggatgaaaagatggatgga

SEQ ID NO: 38418 - DNA, 20 bp, Artificial
  CRISPR gRNA sequence
tgaaaagatggatggatgga

SEQ ID NO: 38419 - DNA, 20 bp, Artificial
  CRISPR gRNA sequence
aagatggatggatggatgga

SEQ ID NO: 38420 - DNA, 20 bp, Artificial
  CRISPR gRNA sequence
tggatggatggatggatgga

SEQ ID NO: 38421 - DNA, 20 bp, Artificial
  CRISPR gRNA sequence
tggatggatggatggatgga

SEQ ID NO: 38422 - DNA, 20 bp, Artificial
  CRISPR gRNA sequence
tggatggatggatggctgaa

SEQ ID NO: 38423 - DNA, 20 bp, Artificial
  CRISPR gRNA sequence
tggatggatggctgaaaaga

SEQ ID NO: 38424 - DNA, 20 bp, Artificial
  CRISPR gRNA sequence
tggatggctgaaaagatgga

SEQ ID NO: 38425 - DNA, 20 bp, Artificial
  CRISPR gRNA sequence
ggatggctgaaaagatggat

SEQ ID NO: 38426 - DNA, 20 bp, Artificial
  CRISPR gRNA sequence
tggctgaaaagatggatggg

SEQ ID NO: 38427 - DNA, 20 bp, Artificial
  CRISPR gRNA sequence
aagatggatgggtggatgaa

SEQ ID NO: 38428 - DNA, 20 bp, Artificial
  CRISPR gRNA sequence
tggatgggtggatgaaaaga

SEQ ID NO: 38429 - DNA, 20 bp, Artificial
  CRISPR gRNA sequence
tgggtggatgaaaagatgga

SEQ ID NO: 38430 - DNA, 20 bp, Artificial
  CRISPR gRNA sequence
tggatgaaaagatggatgga

SEQ ID NO: 38431 - DNA, 20 bp, Artificial
  CRISPR gRNA sequence
tgaaaagatggatggatgga

SEQ ID NO: 38432 - DNA, 20 bp, Artificial
  CRISPR gRNA sequence
aagatggatggatggatgga

SEQ ID NO: 38433 - DNA, 20 bp, Artificial
  CRISPR gRNA sequence
tggatggatggatggatgga

SEQ ID NO: 38434 - DNA, 20 bp, Artificial
  CRISPR gRNA sequence
tggatggatggatggatgaa

SEQ ID NO: 38435 - DNA, 20 bp, Artificial
  CRISPR gRNA sequence
tggatggatggatgaaaaga

SEQ ID NO: 38436 - DNA, 20 bp, Artificial
  CRISPR gRNA sequence
tggatggatgaaaagatgga

SEQ ID NO: 38437 - DNA, 20 bp, Artificial
  CRISPR gRNA sequence
ggatggatgaaaagatggat

SEQ ID NO: 38438 - DNA, 20 bp, Artificial
  CRISPR gRNA sequence
tggatgaaaagatggatggg

SEQ ID NO: 38439 - DNA, 20 bp, Artificial
  CRISPR gRNA sequence
aagatggatgggtggatgaa

SEQ ID NO: 38440 - DNA, 20 bp, Artificial
  CRISPR gRNA sequence
tggatgggtggatgaaaaga

SEQ ID NO: 38441 - DNA, 20 bp, Artificial
  CRISPR gRNA sequence
tgggtggatgaaaagatgga

SEQ ID NO: 38442 - DNA, 20 bp, Artificial
  CRISPR gRNA sequence
tggatgaaaagatggatgga

SEQ ID NO: 38443 - DNA, 20 bp, Artificial
  CRISPR gRNA sequence
tgaaaagatggatggatgga

SEQ ID NO: 38444 - DNA, 20 bp, Artificial
  CRISPR gRNA sequence
aagatggatggatggatgga

SEQ ID NO: 38445 - DNA, 20 bp, Artificial
  CRISPR gRNA sequence
tggatggatggatggatgga

SEQ ID NO: 38446 - DNA, 20 bp, Artificial
  CRISPR gRNA sequence
tggatggatggatggatgga

SEQ ID NO: 38447 - DNA, 20 bp, Artificial
  CRISPR gRNA sequence
tggatggatggaaagattga

SEQ ID NO: 38448 - DNA, 20 bp, Artificial
  CRISPR gRNA sequence
ggatggatggaaagattgat

SEQ ID NO: 38449 - DNA, 20 bp, Artificial
  CRISPR gRNA sequence
tggatggaaagattgatggg

SEQ ID NO: 38450 - DNA, 20 bp, Artificial
  CRISPR gRNA sequence
aagattgatgggtggatgaa

SEQ ID NO: 38451 - DNA, 20 bp, Artificial
  CRISPR gRNA sequence
tgggtggatgaaaagatgaa

SEQ ID NO: 38452 - DNA, 20 bp, Artificial
  CRISPR gRNA sequence
tggatgaaaagatgaatgga

SEQ ID NO: 38453 - DNA, 20 bp, Artificial
  CRISPR gRNA sequence
tgaaaagatgaatggatgga

SEQ ID NO: 38454 - DNA, 20 bp, Artificial
  CRISPR gRNA sequence
aagatgaatggatggatgga

SEQ ID NO: 38455 - DNA, 20 bp, Artificial
  CRISPR gRNA sequence
tggatggatggatagatgaa

SEQ ID NO: 38456 - DNA, 20 bp, Artificial
  CRISPR gRNA sequence
tggatggatagatgaatgga

SEQ ID NO: 38457 - DNA, 20 bp, Artificial
  CRISPR gRNA sequence
tggatagatgaatggatgga

SEQ ID NO: 38458 - DNA, 20 bp, Artificial
  CRISPR gRNA sequence
tagatgaatggatggatgga

SEQ ID NO: 38459 - DNA, 20 bp, Artificial
  CRISPR gRNA sequence
tgaatggatggatggataga

SEQ ID NO: 38460 - DNA, 20 bp, Artificial
  CRISPR gRNA sequence
tggatggatggatagatggc

SEQ ID NO: 38461 - DNA, 20 bp, Artificial
  CRISPR gRNA sequence
tggatagatggctagctgaa

SEQ ID NO: 38462 - DNA, 20 bp, Artificial
  CRISPR gRNA sequence
tagatggctagctgaaaaga

SEQ ID NO: 38463 - DNA, 20 bp, Artificial
  CRISPR gRNA sequence
tggctagctgaaaagatgga

SEQ ID NO: 38464 - DNA, 20 bp, Artificial
  CRISPR gRNA sequence
ggctagctgaaaagatggat

SEQ ID NO: 38465 - DNA, 20 bp, Artificial
  CRISPR gRNA sequence
aagatggataggtgtgtgaa

SEQ ID NO: 38466 - DNA, 20 bp, Artificial
  CRISPR gRNA sequence
tggataggtgtgtgaaaaga

SEQ ID NO: 38467 - DNA, 20 bp, Artificial
  CRISPR gRNA sequence
taggtgtgtgaaaagatgga

SEQ ID NO: 38468 - DNA, 20 bp, Artificial
  CRISPR gRNA sequence
tgtgtgaaaagatggatgga

SEQ ID NO: 38469 - DNA, 20 bp, Artificial
  CRISPR gRNA sequence
tgaaaagatggatggatgga

SEQ ID NO: 38470 - DNA, 20 bp, Artificial
  CRISPR gRNA sequence
aagatggatggatggatgga

SEQ ID NO: 38471 - DNA, 20 bp, Artificial
  CRISPR gRNA sequence
tggatggatggatggatgga

SEQ ID NO: 38472 - DNA, 20 bp, Artificial
  CRISPR gRNA sequence
tggatggatggatggatgga

SEQ ID NO: 38473 - DNA, 20 bp, Artificial
  CRISPR gRNA sequence
tggatggatggatggatgga

SEQ ID NO: 38474 - DNA, 20 bp, Artificial
  CRISPR gRNA sequence
tggatggatggatggatgga

SEQ ID NO: 38475 - DNA, 20 bp, Artificial
  CRISPR gRNA sequence
tggatggatggatggatgga

SEQ ID NO: 38476 - DNA, 20 bp, Artificial
  CRISPR gRNA sequence
tggatggatggatggatgga

SEQ ID NO: 38477 - DNA, 20 bp, Artificial
  CRISPR gRNA sequence
tggatggatggatggatgga

SEQ ID NO: 38478 - DNA, 20 bp, Artificial
  CRISPR gRNA sequence
gatggatggatggatggatg

SEQ ID NO: 38479 - DNA, 20 bp, Artificial
  CRISPR gRNA sequence
atggatggatggatggatga

SEQ ID NO: 38480 - DNA, 20 bp, Artificial
  CRISPR gRNA sequence
ggatggatggatgaaggaat

SEQ ID NO: 38481 - DNA, 20 bp, Artificial
  CRISPR gRNA sequence
ggatgaaggaatgagtcaac

SEQ ID NO: 38482 - DNA, 20 bp, Artificial
  CRISPR gRNA sequence
aatgagtcaacaagtctacg

SEQ ID NO: 38483 - DNA, 20 bp, Artificial
  CRISPR gRNA sequence
gtcaacaagtctacgaagca

SEQ ID NO: 38484 - DNA, 20 bp, Artificial
  CRISPR gRNA sequence
tcaacaagtctacgaagcac

SEQ ID NO: 38485 - DNA, 20 bp, Artificial
  CRISPR gRNA sequence
aagtctacgaagcacaggca

SEQ ID NO: 38486 - DNA, 20 bp, Artificial
  CRISPR gRNA sequence
acgaagcacaggcatagcca

SEQ ID NO: 38487 - DNA, 20 bp, Artificial
  CRISPR gRNA sequence
cgaagcacaggcatagccaa

SEQ ID NO: 38488 - DNA, 20 bp, Artificial
  CRISPR gRNA sequence
ggcatagccaaaggaataat

SEQ ID NO: 38489 - DNA, 20 bp, Artificial
  CRISPR gRNA sequence
tagctgtgtgttgccctcca

SEQ ID NO: 38490 - DNA, 20 bp, Artificial
  CRISPR gRNA sequence
tccatggtgctgaaccaata

SEQ ID NO: 38491 - DNA, 20 bp, Artificial
  CRISPR gRNA sequence
tggtgctgaaccaatatagc

SEQ ID NO: 38492 - DNA, 20 bp, Artificial
  CRISPR gRNA sequence
aatatagccagttttgatca

SEQ ID NO: 38493 - DNA, 20 bp, Artificial
  CRISPR gRNA sequence
atatagccagttttgatcat

SEQ ID NO: 38494 - DNA, 20 bp, Artificial
  CRISPR gRNA sequence
tatagccagttttgatcatg

SEQ ID NO: 38495 - DNA, 20 bp, Artificial
  CRISPR gRNA sequence
agccagttttgatcatgggg

SEQ ID NO: 38496 - DNA, 20 bp, Artificial
  CRISPR gRNA sequence
gccagttttgatcatggggt

SEQ ID NO: 38497 - DNA, 20 bp, Artificial
  CRISPR gRNA sequence
gttttgatcatggggtaggt

SEQ ID NO: 38498 - DNA, 20 bp, Artificial
  CRISPR gRNA sequence
ttttgatcatggggtaggtt

SEQ ID NO: 38499 - DNA, 20 bp, Artificial
  CRISPR gRNA sequence
aatttctattaaaaaaaatt

SEQ ID NO: 38500 - DNA, 20 bp, Artificial
  CRISPR gRNA sequence
tctattaaaaaaaattcagc

SEQ ID NO: 38501 - DNA, 20 bp, Artificial
  CRISPR gRNA sequence
ctattaaaaaaaattcagcc

SEQ ID NO: 38502 - DNA, 20 bp, Artificial
  CRISPR gRNA sequence
aaaaaaaattcagccgggct

SEQ ID NO: 38503 - DNA, 20 bp, Artificial
  CRISPR gRNA sequence
aaaaattcagccgggctcag

SEQ ID NO: 38504 - DNA, 20 bp, Artificial
  CRISPR gRNA sequence
tgcctgtaattccaacactt

SEQ ID NO: 38505 - DNA, 20 bp, Artificial
  CRISPR gRNA sequence
ctgtaattccaacactttgg

SEQ ID NO: 38506 - DNA, 20 bp, Artificial
  CRISPR gRNA sequence
tgtaattccaacactttgga

SEQ ID NO: 38507 - DNA, 20 bp, Artificial
  CRISPR gRNA sequence
ttccaacactttggaaggcc

SEQ ID NO: 38508 - DNA, 20 bp, Artificial
  CRISPR gRNA sequence
tccaacactttggaaggcca

SEQ ID NO: 38509 - DNA, 20 bp, Artificial
  CRISPR gRNA sequence
acactttggaaggccaaggc

SEQ ID NO: 38510 - DNA, 20 bp, Artificial
  CRISPR gRNA sequence
actttggaaggccaaggcaa

SEQ ID NO: 38511 - DNA, 20 bp, Artificial
  CRISPR gRNA sequence
ctttggaaggccaaggcaag

SEQ ID NO: 38512 - DNA, 20 bp, Artificial
  CRISPR gRNA sequence
ccaaggcaagaggattactt

SEQ ID NO: 38513 - DNA, 20 bp, Artificial
  CRISPR gRNA sequence
gcaagaggattacttgagct

SEQ ID NO: 38514 - DNA, 20 bp, Artificial
  CRISPR gRNA sequence
caagaggattacttgagctc

SEQ ID NO: 38515 - DNA, 20 bp, Artificial
  CRISPR gRNA sequence
agaggattacttgagctcag

SEQ ID NO: 38516 - DNA, 20 bp, Artificial
  CRISPR gRNA sequence
ttacttgagctcaggagttc

SEQ ID NO: 38517 - DNA, 20 bp, Artificial
  CRISPR gRNA sequence
tcaggagttcgagaccaacc

SEQ ID NO: 38518 - DNA, 20 bp, Artificial
  CRISPR gRNA sequence
caggagttcgagaccaacct

SEQ ID NO: 38519 - DNA, 20 bp, Artificial
  CRISPR gRNA sequence
cgagaccaacctgggcaaca

SEQ ID NO: 38520 - DNA, 20 bp, Artificial
  CRISPR gRNA sequence
caaaaaatgaacaaaattaa

SEQ ID NO: 38521 - DNA, 20 bp, Artificial
  CRISPR gRNA sequence
aaaaaatgaacaaaattaat

SEQ ID NO: 38522 - DNA, 20 bp, Artificial
  CRISPR gRNA sequence
aaaaatgaacaaaattaatg

SEQ ID NO: 38523 - DNA, 20 bp, Artificial
  CRISPR gRNA sequence
tgaacaaaattaatggggca

SEQ ID NO: 38524 - DNA, 20 bp, Artificial
  CRISPR gRNA sequence
acaaaattaatggggcatgg

SEQ ID NO: 38525 - DNA, 20 bp, Artificial
  CRISPR gRNA sequence
ggcatggtggtgcatgcctg

SEQ ID NO: 38526 - DNA, 20 bp, Artificial
  CRISPR gRNA sequence
gtggtgcatgcctgtggttc

SEQ ID NO: 38527 - DNA, 20 bp, Artificial
  CRISPR gRNA sequence
tgcctgtggttccagctatt

SEQ ID NO: 38528 - DNA, 20 bp, Artificial
  CRISPR gRNA sequence
gcctgtggttccagctattt

SEQ ID NO: 38529 - DNA, 20 bp, Artificial
  CRISPR gRNA sequence
ctgtggttccagctatttgg

SEQ ID NO: 38530 - DNA, 20 bp, Artificial
  CRISPR gRNA sequence
tgtggttccagctatttggg

SEQ ID NO: 38531 - DNA, 20 bp, Artificial
  CRISPR gRNA sequence
ttccagctatttgggaggct

SEQ ID NO: 38532 - DNA, 20 bp, Artificial
  CRISPR gRNA sequence
tccagctatttgggaggctg

SEQ ID NO: 38533 - DNA, 20 bp, Artificial
  CRISPR gRNA sequence
agctatttgggaggctgagg

SEQ ID NO: 38534 - DNA, 20 bp, Artificial
  CRISPR gRNA sequence
gctatttgggaggctgaggt

SEQ ID NO: 38535 - DNA, 20 bp, Artificial
  CRISPR gRNA sequence
atttgggaggctgaggtggg

SEQ ID NO: 38536 - DNA, 20 bp, Artificial
  CRISPR gRNA sequence
ctgaggtgggaagattgctt

SEQ ID NO: 38537 - DNA, 20 bp, Artificial
  CRISPR gRNA sequence
tgggaagattgcttgagccg

SEQ ID NO: 38538 - DNA, 20 bp, Artificial
  CRISPR gRNA sequence
ggaagattgcttgagccgtg

SEQ ID NO: 38539 - DNA, 20 bp, Artificial
  CRISPR gRNA sequence
gaagattgcttgagccgtgg

SEQ ID NO: 38540 - DNA, 20 bp, Artificial
  CRISPR gRNA sequence
ttgcttgagccgtggaggtt

SEQ ID NO: 38541 - DNA, 20 bp, Artificial
  CRISPR gRNA sequence
tgcttgagccgtggaggttg

SEQ ID NO: 38542 - DNA, 20 bp, Artificial
  CRISPR gRNA sequence
agccgtggaggttgaggctg

SEQ ID NO: 38543 - DNA, 20 bp, Artificial
  CRISPR gRNA sequence
gtggaggttgaggctgcagt

SEQ ID NO: 38544 - DNA, 20 bp, Artificial
  CRISPR gRNA sequence
tggaggttgaggctgcagtg

SEQ ID NO: 38545 - DNA, 20 bp, Artificial
  CRISPR gRNA sequence
gtgaacacaccactgcactc

SEQ ID NO: 38546 - DNA, 20 bp, Artificial
  CRISPR gRNA sequence
acaccactgcactccagcct

SEQ ID NO: 38547 - DNA, 20 bp, Artificial
  CRISPR gRNA sequence
ccactgcactccagcctgag

SEQ ID NO: 38548 - DNA, 20 bp, Artificial
  CRISPR gRNA sequence
ctgcactccagcctgagtag

SEQ ID NO: 38549 - DNA, 20 bp, Artificial
  CRISPR gRNA sequence
gcactccagcctgagtagca

SEQ ID NO: 38550 - DNA, 20 bp, Artificial
  CRISPR gRNA sequence
tccagcctgagtagcagagt

SEQ ID NO: 38551 - DNA, 20 bp, Artificial
  CRISPR gRNA sequence
atctccatctcaaatttaaa

SEQ ID NO: 38552 - DNA, 20 bp, Artificial
  CRISPR gRNA sequence
ccatctcaaatttaaaaaga

SEQ ID NO: 38553 - DNA, 20 bp, Artificial
  CRISPR gRNA sequence
catctcaaatttaaaaagaa

SEQ ID NO: 38554 - DNA, 20 bp, Artificial
  CRISPR gRNA sequence
gactttttaaaacactcttg

SEQ ID NO: 38555 - DNA, 20 bp, Artificial
  CRISPR gRNA sequence
actttttaaaacactcttgc

SEQ ID NO: 38556 - DNA, 20 bp, Artificial
  CRISPR gRNA sequence
acactcttgcaggattcatc

SEQ ID NO: 38557 - DNA, 20 bp, Artificial
  CRISPR gRNA sequence
cttgcaggattcatcaagca

SEQ ID NO: 38558 - DNA, 20 bp, Artificial
  CRISPR gRNA sequence
tcatcaagcaaagacataat

SEQ ID NO: 38559 - DNA, 20 bp, Artificial
  CRISPR gRNA sequence
ctgatttaaaacacttttgc

SEQ ID NO: 38560 - DNA, 20 bp, Artificial
  CRISPR gRNA sequence
ttccctgtcaattgcaaaat

SEQ ID NO: 38561 - DNA, 20 bp, Artificial
  CRISPR gRNA sequence
attgcaaaatcagctttatc

SEQ ID NO: 38562 - DNA, 20 bp, Artificial
  CRISPR gRNA sequence
tatctggatgtttgaacatt

SEQ ID NO: 38563 - DNA, 20 bp, Artificial
  CRISPR gRNA sequence
atctggatgtttgaacattt

SEQ ID NO: 38564 - DNA, 20 bp, Artificial
  CRISPR gRNA sequence
tctggatgtttgaacatttg

SEQ ID NO: 38565 - DNA, 20 bp, Artificial
  CRISPR gRNA sequence
ggatgtttgaacatttgggg

SEQ ID NO: 38566 - DNA, 20 bp, Artificial
  CRISPR gRNA sequence
tttgaacatttggggcagaa

SEQ ID NO: 38567 - DNA, 20 bp, Artificial
  CRISPR gRNA sequence
ttgaacatttggggcagaaa

SEQ ID NO: 38568 - DNA, 20 bp, Artificial
  CRISPR gRNA sequence
tgaacatttggggcagaaaa

SEQ ID NO: 38569 - DNA, 20 bp, Artificial
  CRISPR gRNA sequence
ggcagaaaagggtgtgcctg

SEQ ID NO: 38570 - DNA, 20 bp, Artificial
  CRISPR gRNA sequence
agaaaagggtgtgcctgtgg

SEQ ID NO: 38571 - DNA, 20 bp, Artificial
  CRISPR gRNA sequence
gaaaagggtgtgcctgtggt

SEQ ID NO: 38572 - DNA, 20 bp, Artificial
  CRISPR gRNA sequence
gcctgtggtgggtgatgtgc

SEQ ID NO: 38573 - DNA, 20 bp, Artificial
  CRISPR gRNA sequence
gtgggtgatgtgctggtttc

SEQ ID NO: 38574 - DNA, 20 bp, Artificial
  CRISPR gRNA sequence
atgtgctggtttccagtctc

SEQ ID NO: 38575 - DNA, 20 bp, Artificial
  CRISPR gRNA sequence
tgtgctggtttccagtctct

SEQ ID NO: 38576 - DNA, 20 bp, Artificial
  CRISPR gRNA sequence
tttccagtctctgggtttca

SEQ ID NO: 38577 - DNA, 20 bp, Artificial
  CRISPR gRNA sequence
agtctctgggtttcatggct

SEQ ID NO: 38578 - DNA, 20 bp, Artificial
  CRISPR gRNA sequence
tggcttggtatctgatcctg

SEQ ID NO: 38579 - DNA, 20 bp, Artificial
  CRISPR gRNA sequence
ggcttggtatctgatcctgc

SEQ ID NO: 38580 - DNA, 20 bp, Artificial
  CRISPR gRNA sequence
gcttggtatctgatcctgca

SEQ ID NO: 38581 - DNA, 20 bp, Artificial
  CRISPR gRNA sequence
ttggtatctgatcctgcagg

SEQ ID NO: 38582 - DNA, 20 bp, Artificial
  CRISPR gRNA sequence
tggtatctgatcctgcaggg

SEQ ID NO: 38583 - DNA, 20 bp, Artificial
  CRISPR gRNA sequence
tatctgatcctgcagggagg

SEQ ID NO: 38584 - DNA, 20 bp, Artificial
  CRISPR gRNA sequence
cttccttctttccccgccca

SEQ ID NO: 38585 - DNA, 20 bp, Artificial
  CRISPR gRNA sequence
tccttctttccccgcccaca

SEQ ID NO: 38586 - DNA, 20 bp, Artificial
  CRISPR gRNA sequence
cccgcccacagagacaactg

SEQ ID NO: 38587 - DNA, 20 bp, Artificial
  CRISPR gRNA sequence
cgcccacagagacaactgca

SEQ ID NO: 38588 - DNA, 20 bp, Artificial
  CRISPR gRNA sequence
gagacaactgcagagctaca

SEQ ID NO: 38589 - DNA, 20 bp, Artificial
  CRISPR gRNA sequence
agacaactgcagagctacaa

SEQ ID NO: 38590 - DNA, 20 bp, Artificial
  CRISPR gRNA sequence
aactgcagagctacaaaggt

SEQ ID NO: 38591 - DNA, 20 bp, Artificial
  CRISPR gRNA sequence
tgcagagctacaaaggtaag

SEQ ID NO: 38592 - DNA, 20 bp, Artificial
  CRISPR gRNA sequence
agctacaaaggtaagaagcc

SEQ ID NO: 38593 - DNA, 20 bp, Artificial
  CRISPR gRNA sequence
ctacaaaggtaagaagccaa

SEQ ID NO: 38594 - DNA, 20 bp, Artificial
  CRISPR gRNA sequence
tacaaaggtaagaagccaag

SEQ ID NO: 38595 - DNA, 20 bp, Artificial
  CRISPR gRNA sequence
aaaggtaagaagccaagagg

SEQ ID NO: 38596 - DNA, 20 bp, Artificial
  CRISPR gRNA sequence
ggtaagaagccaagaggcgg

SEQ ID NO: 38597 - DNA, 20 bp, Artificial
  CRISPR gRNA sequence
gtaagaagccaagaggcggt

SEQ ID NO: 38598 - DNA, 20 bp, Artificial
  CRISPR gRNA sequence
aagccaagaggcggtgggcc

SEQ ID NO: 38599 - DNA, 20 bp, Artificial
  CRISPR gRNA sequence
agccaagaggcggtgggcct

SEQ ID NO: 38600 - DNA, 20 bp, Artificial
  CRISPR gRNA sequence
gccaagaggcggtgggcctg

SEQ ID NO: 38601 - DNA, 20 bp, Artificial
  CRISPR gRNA sequence
ggtgggcctggggccatcct

SEQ ID NO: 38602 - DNA, 20 bp, Artificial
  CRISPR gRNA sequence
gggcctggggccatccttag

SEQ ID NO: 38603 - DNA, 20 bp, Artificial
  CRISPR gRNA sequence
ggccatccttagaagcaact

SEQ ID NO: 38604 - DNA, 20 bp, Artificial
  CRISPR gRNA sequence
gccatccttagaagcaactt

SEQ ID NO: 38605 - DNA, 20 bp, Artificial
  CRISPR gRNA sequence
ccttagaagcaacttgggct

SEQ ID NO: 38606 - DNA, 20 bp, Artificial
  CRISPR gRNA sequence
cttagaagcaacttgggctc

SEQ ID NO: 38607 - DNA, 20 bp, Artificial
  CRISPR gRNA sequence
agaagcaacttgggctcagg

SEQ ID NO: 38608 - DNA, 20 bp, Artificial
  CRISPR gRNA sequence
caacttgggctcaggcagtt

SEQ ID NO: 38609 - DNA, 20 bp, Artificial
  CRISPR gRNA sequence
aacttgggctcaggcagttg

SEQ ID NO: 38610 - DNA, 20 bp, Artificial
  CRISPR gRNA sequence
acttgggctcaggcagttga

SEQ ID NO: 38611 - DNA, 20 bp, Artificial
  CRISPR gRNA sequence
cttgggctcaggcagttgag

SEQ ID NO: 38612 - DNA, 20 bp, Artificial
  CRISPR gRNA sequence
ggctcaggcagttgagggga

SEQ ID NO: 38613 - DNA, 20 bp, Artificial
  CRISPR gRNA sequence
gctcaggcagttgaggggaa

SEQ ID NO: 38614 - DNA, 20 bp, Artificial
  CRISPR gRNA sequence
agttgaggggaaaggtgacc

SEQ ID NO: 38615 - DNA, 20 bp, Artificial
  CRISPR gRNA sequence
ttgaggggaaaggtgaccaa

SEQ ID NO: 38616 - DNA, 20 bp, Artificial
  CRISPR gRNA sequence
gggaaaggtgaccaagagac

SEQ ID NO: 38617 - DNA, 20 bp, Artificial
  CRISPR gRNA sequence
ggaaaggtgaccaagagact

SEQ ID NO: 38618 - DNA, 20 bp, Artificial
  CRISPR gRNA sequence
aaggtgaccaagagactagg

SEQ ID NO: 38619 - DNA, 20 bp, Artificial
  CRISPR gRNA sequence
ggtgaccaagagactaggaa

SEQ ID NO: 38620 - DNA, 20 bp, Artificial
  CRISPR gRNA sequence
accaagagactaggaagagc

SEQ ID NO: 38621 - DNA, 20 bp, Artificial
  CRISPR gRNA sequence
ccaagagactaggaagagct

SEQ ID NO: 38622 - DNA, 20 bp, Artificial
  CRISPR gRNA sequence
caagagactaggaagagctg

SEQ ID NO: 38623 - DNA, 20 bp, Artificial
  CRISPR gRNA sequence
gactaggaagagctggggta

SEQ ID NO: 38624 - DNA, 20 bp, Artificial
  CRISPR gRNA sequence
actaggaagagctggggtat

SEQ ID NO: 38625 - DNA, 20 bp, Artificial
  CRISPR gRNA sequence
cttcctgctactgctgcact

SEQ ID NO: 38626 - DNA, 20 bp, Artificial
  CRISPR gRNA sequence
ttcctgctactgctgcactg

SEQ ID NO: 38627 - DNA, 20 bp, Artificial
  CRISPR gRNA sequence
ctgaggaatgaattactgct

SEQ ID NO: 38628 - DNA, 20 bp, Artificial
  CRISPR gRNA sequence
tgaggaatgaattactgctt

SEQ ID NO: 38629 - DNA, 20 bp, Artificial
  CRISPR gRNA sequence
gaatgaattactgcttaggt

SEQ ID NO: 38630 - DNA, 20 bp, Artificial
  CRISPR gRNA sequence
aattactgcttaggttggca

SEQ ID NO: 38631 - DNA, 20 bp, Artificial
  CRISPR gRNA sequence
attactgcttaggttggcaa

SEQ ID NO: 38632 - DNA, 20 bp, Artificial
  CRISPR gRNA sequence
caaaggattttaacttcctc

SEQ ID NO: 38633 - DNA, 20 bp, Artificial
  CRISPR gRNA sequence
ttaacttcctctagcgtgtc

SEQ ID NO: 38634 - DNA, 20 bp, Artificial
  CRISPR gRNA sequence
tagcgtgtccagaccacatc

SEQ ID NO: 38635 - DNA, 20 bp, Artificial
  CRISPR gRNA sequence
cagaccacatctggtccctg

SEQ ID NO: 38636 - DNA, 20 bp, Artificial
  CRISPR gRNA sequence
accacatctggtccctgtgg

SEQ ID NO: 38637 - DNA, 20 bp, Artificial
  CRISPR gRNA sequence
ccacatctggtccctgtgga

SEQ ID NO: 38638 - DNA, 20 bp, Artificial
  CRISPR gRNA sequence
catctggtccctgtggaagg

SEQ ID NO: 38639 - DNA, 20 bp, Artificial
  CRISPR gRNA sequence
cctgtggaaggaagcatccc

SEQ ID NO: 38640 - DNA, 20 bp, Artificial
  CRISPR gRNA sequence
gtggaaggaagcatccccag

SEQ ID NO: 38641 - DNA, 20 bp, Artificial
  CRISPR gRNA sequence
ggaagcatccccagaagact

SEQ ID NO: 38642 - DNA, 20 bp, Artificial
  CRISPR gRNA sequence
aagcatccccagaagactca

SEQ ID NO: 38643 - DNA, 20 bp, Artificial
  CRISPR gRNA sequence
agcatccccagaagactcag

SEQ ID NO: 38644 - DNA, 20 bp, Artificial
  CRISPR gRNA sequence
atccccagaagactcagagg

SEQ ID NO: 38645 - DNA, 20 bp, Artificial
  CRISPR gRNA sequence
tccccagaagactcagagga

SEQ ID NO: 38646 - DNA, 20 bp, Artificial
  CRISPR gRNA sequence
ctcagaggaaggcaaaccct

SEQ ID NO: 38647 - DNA, 20 bp, Artificial
  CRISPR gRNA sequence
tcagaggaaggcaaaccctt

SEQ ID NO: 38648 - DNA, 20 bp, Artificial
  CRISPR gRNA sequence
cagaggaaggcaaacccttg

SEQ ID NO: 38649 - DNA, 20 bp, Artificial
  CRISPR gRNA sequence
gaggaaggcaaacccttggg

SEQ ID NO: 38650 - DNA, 20 bp, Artificial
  CRISPR gRNA sequence
aaacccttggggagaacata

SEQ ID NO: 38651 - DNA, 20 bp, Artificial
  CRISPR gRNA sequence
ggagaacataaagatactgt

SEQ ID NO: 38652 - DNA, 20 bp, Artificial
  CRISPR gRNA sequence
acataaagatactgttagac

SEQ ID NO: 38653 - DNA, 20 bp, Artificial
  CRISPR gRNA sequence
tactgttagactggcattac

SEQ ID NO: 38654 - DNA, 20 bp, Artificial
  CRISPR gRNA sequence
gttagactggcattactaga

SEQ ID NO: 38655 - DNA, 20 bp, Artificial
  CRISPR gRNA sequence
ttactagatggtgaaaactc

SEQ ID NO: 38656 - DNA, 20 bp, Artificial
  CRISPR gRNA sequence
agatggtgaaaactctggaa

SEQ ID NO: 38657 - DNA, 20 bp, Artificial
  CRISPR gRNA sequence
aaagcccttacaactgaaaa

SEQ ID NO: 38658 - DNA, 20 bp, Artificial
  CRISPR gRNA sequence
cccttacaactgaaaaaaga

SEQ ID NO: 38659 - DNA, 20 bp, Artificial
  CRISPR gRNA sequence
ccttacaactgaaaaaagac

SEQ ID NO: 38660 - DNA, 20 bp, Artificial
  CRISPR gRNA sequence
cttacaactgaaaaaagaca

SEQ ID NO: 38661 - DNA, 20 bp, Artificial
  CRISPR gRNA sequence
tacaactgaaaaaagacagg

SEQ ID NO: 38662 - DNA, 20 bp, Artificial
  CRISPR gRNA sequence
acaactgaaaaaagacaggg

SEQ ID NO: 38663 - DNA, 20 bp, Artificial
  CRISPR gRNA sequence
caactgaaaaaagacaggga

SEQ ID NO: 38664 - DNA, 20 bp, Artificial
  CRISPR gRNA sequence
aaagacagggagggcaatta

SEQ ID NO: 38665 - DNA, 20 bp, Artificial
  CRISPR gRNA sequence
caattatggtacctacatct

SEQ ID NO: 38666 - DNA, 20 bp, Artificial
  CRISPR gRNA sequence
aattatggtacctacatctt

SEQ ID NO: 38667 - DNA, 20 bp, Artificial
  CRISPR gRNA sequence
attatggtacctacatctta

SEQ ID NO: 38668 - DNA, 20 bp, Artificial
  CRISPR gRNA sequence
ctacatcttagggttgttct

SEQ ID NO: 38669 - DNA, 20 bp, Artificial
  CRISPR gRNA sequence
ggttgttctgagaattaaat

SEQ ID NO: 38670 - DNA, 20 bp, Artificial
  CRISPR gRNA sequence
ttaaatgagttactacactt

SEQ ID NO: 38671 - DNA, 20 bp, Artificial
  CRISPR gRNA sequence
taaatgagttactacactta

SEQ ID NO: 38672 - DNA, 20 bp, Artificial
  CRISPR gRNA sequence
aatgagttactacacttaag

SEQ ID NO: 38673 - DNA, 20 bp, Artificial
  CRISPR gRNA sequence
gttactacacttaaggagtt

SEQ ID NO: 38674 - DNA, 20 bp, Artificial
  CRISPR gRNA sequence
tactacacttaaggagttta

SEQ ID NO: 38675 - DNA, 20 bp, Artificial
  CRISPR gRNA sequence
taaggagtttagagcactgt

SEQ ID NO: 38676 - DNA, 20 bp, Artificial
  CRISPR gRNA sequence
tttagagcactgttggcatg

SEQ ID NO: 38677 - DNA, 20 bp, Artificial
  CRISPR gRNA sequence
agagcactgttggcatgcag

SEQ ID NO: 38678 - DNA, 20 bp, Artificial
  CRISPR gRNA sequence
gagcactgttggcatgcagt

SEQ ID NO: 38679 - DNA, 20 bp, Artificial
  CRISPR gRNA sequence
cactgttggcatgcagtggg

SEQ ID NO: 38680 - DNA, 20 bp, Artificial
  CRISPR gRNA sequence
tgcagtgggcagtcaaatgc

SEQ ID NO: 38681 - DNA, 20 bp, Artificial
  CRISPR gRNA sequence
cagtcaaatgctggctattc

SEQ ID NO: 38682 - DNA, 20 bp, Artificial
  CRISPR gRNA sequence
ctggctattccagctgtgca

SEQ ID NO: 38683 - DNA, 20 bp, Artificial
  CRISPR gRNA sequence
ttccagctgtgcatggattc

SEQ ID NO: 38684 - DNA, 20 bp, Artificial
  CRISPR gRNA sequence
gctgtgcatggattccagct

SEQ ID NO: 38685 - DNA, 20 bp, Artificial
  CRISPR gRNA sequence
tgcatggattccagcttggc

SEQ ID NO: 38686 - DNA, 20 bp, Artificial
  CRISPR gRNA sequence
gattccagcttggccagtct

SEQ ID NO: 38687 - DNA, 20 bp, Artificial
  CRISPR gRNA sequence
ccagcttggccagtcttgga

SEQ ID NO: 38688 - DNA, 20 bp, Artificial
  CRISPR gRNA sequence
cagcttggccagtcttggat

SEQ ID NO: 38689 - DNA, 20 bp, Artificial
  CRISPR gRNA sequence
tggccagtcttggatgggct

SEQ ID NO: 38690 - DNA, 20 bp, Artificial
  CRISPR gRNA sequence
agtcttggatgggctgagaa

SEQ ID NO: 38691 - DNA, 20 bp, Artificial
  CRISPR gRNA sequence
gtcttggatgggctgagaaa

SEQ ID NO: 38692 - DNA, 20 bp, Artificial
  CRISPR gRNA sequence
tcttggatgggctgagaaaa

SEQ ID NO: 38693 - DNA, 20 bp, Artificial
  CRISPR gRNA sequence
ttggatgggctgagaaaagg

SEQ ID NO: 38694 - DNA, 20 bp, Artificial
  CRISPR gRNA sequence
agggagctgcttttccctaa

SEQ ID NO: 38695 - DNA, 20 bp, Artificial
  CRISPR gRNA sequence
tctaccacactttgctctcc

SEQ ID NO: 38696 - DNA, 20 bp, Artificial
  CRISPR gRNA sequence
cacactttgctctcctggct

SEQ ID NO: 38697 - DNA, 20 bp, Artificial
  CRISPR gRNA sequence
ttgctctcctggctaagact

SEQ ID NO: 38698 - DNA, 20 bp, Artificial
  CRISPR gRNA sequence
gctctcctggctaagactca

SEQ ID NO: 38699 - DNA, 20 bp, Artificial
  CRISPR gRNA sequence
tcctggctaagactcagaga

SEQ ID NO: 38700 - DNA, 20 bp, Artificial
  CRISPR gRNA sequence
acagatgtatgtatgcccct

SEQ ID NO: 38701 - DNA, 20 bp, Artificial
  CRISPR gRNA sequence
agcaatctctttcccttctc

SEQ ID NO: 38702 - DNA, 20 bp, Artificial
  CRISPR gRNA sequence
tccttgcttgtataatgacc

SEQ ID NO: 38703 - DNA, 20 bp, Artificial
  CRISPR gRNA sequence
ttgcttgtataatgacctgg

SEQ ID NO: 38704 - DNA, 20 bp, Artificial
  CRISPR gRNA sequence
tgtataatgacctggtagtg

SEQ ID NO: 38705 - DNA, 20 bp, Artificial
  CRISPR gRNA sequence
gtataatgacctggtagtgt

SEQ ID NO: 38706 - DNA, 20 bp, Artificial
  CRISPR gRNA sequence
tagtgtaggaccaatgttgc

SEQ ID NO: 38707 - DNA, 20 bp, Artificial
  CRISPR gRNA sequence
agtgtaggaccaatgttgct

SEQ ID NO: 38708 - DNA, 20 bp, Artificial
  CRISPR gRNA sequence
aggaccaatgttgctgggtg

SEQ ID NO: 38709 - DNA, 20 bp, Artificial
  CRISPR gRNA sequence
accaatgttgctgggtgcgg

SEQ ID NO: 38710 - DNA, 20 bp, Artificial
  CRISPR gRNA sequence
gtggctcatgcctgtaatcc

SEQ ID NO: 38711 - DNA, 20 bp, Artificial
  CRISPR gRNA sequence
tgcctgtaatcctagcactt

SEQ ID NO: 38712 - DNA, 20 bp, Artificial
  CRISPR gRNA sequence
tcctagcactttggaacgcc

SEQ ID NO: 38713 - DNA, 20 bp, Artificial
  CRISPR gRNA sequence
cactttggaacgccaagcac

SEQ ID NO: 38714 - DNA, 20 bp, Artificial
  CRISPR gRNA sequence
gcacgagaatctcttgattc

SEQ ID NO: 38715 - DNA, 20 bp, Artificial
  CRISPR gRNA sequence
cacgagaatctcttgattcc

SEQ ID NO: 38716 - DNA, 20 bp, Artificial
  CRISPR gRNA sequence
tctcttgattccaggtgttc

SEQ ID NO: 38717 - DNA, 20 bp, Artificial
  CRISPR gRNA sequence
tgattccaggtgttcaagac

SEQ ID NO: 38718 - DNA, 20 bp, Artificial
  CRISPR gRNA sequence
ccaggtgttcaagaccagcc

SEQ ID NO: 38719 - DNA, 20 bp, Artificial
  CRISPR gRNA sequence
caggtgttcaagaccagcct

SEQ ID NO: 38720 - DNA, 20 bp, Artificial
  CRISPR gRNA sequence
caagaccagcctgggcaaca

SEQ ID NO: 38721 - DNA, 20 bp, Artificial
  CRISPR gRNA sequence
accagcctgggcaacatagc

SEQ ID NO: 38722 - DNA, 20 bp, Artificial
  CRISPR gRNA sequence
gaccccatctctaaaaaaaa

SEQ ID NO: 38723 - DNA, 20 bp, Artificial
  CRISPR gRNA sequence
accccatctctaaaaaaaaa

SEQ ID NO: 38724 - DNA, 20 bp, Artificial
  CRISPR gRNA sequence
ccatctctaaaaaaaaaagg

SEQ ID NO: 38725 - DNA, 20 bp, Artificial
  CRISPR gRNA sequence
catctctaaaaaaaaaaggc

SEQ ID NO: 38726 - DNA, 20 bp, Artificial
  CRISPR gRNA sequence
ctaaaaaaaaaaggcaggcg

SEQ ID NO: 38727 - DNA, 20 bp, Artificial
  CRISPR gRNA sequence
aaaaaaaaaggcaggcgtgg

SEQ ID NO: 38728 - DNA, 20 bp, Artificial
  CRISPR gRNA sequence
ggcgtggtggtgcacacctg

SEQ ID NO: 38729 - DNA, 20 bp, Artificial
  CRISPR gRNA sequence
gtggtgcacacctgtagtcc

SEQ ID NO: 38730 - DNA, 20 bp, Artificial
  CRISPR gRNA sequence
acctgtagtcccagctactc

SEQ ID NO: 38731 - DNA, 20 bp, Artificial
  CRISPR gRNA sequence
gctactcaagatgctgacgt

SEQ ID NO: 38732 - DNA, 20 bp, Artificial
  CRISPR gRNA sequence
ctactcaagatgctgacgtt

SEQ ID NO: 38733 - DNA, 20 bp, Artificial
  CRISPR gRNA sequence
actcaagatgctgacgttgg

SEQ ID NO: 38734 - DNA, 20 bp, Artificial
  CRISPR gRNA sequence
ctcaagatgctgacgttggg

SEQ ID NO: 38735 - DNA, 20 bp, Artificial
  CRISPR gRNA sequence
tgacgttgggaggatcgctt

SEQ ID NO: 38736 - DNA, 20 bp, Artificial
  CRISPR gRNA sequence
ttgggaggatcgcttgagcc

SEQ ID NO: 38737 - DNA, 20 bp, Artificial
  CRISPR gRNA sequence
tgggaggatcgcttgagcct

SEQ ID NO: 38738 - DNA, 20 bp, Artificial
  CRISPR gRNA sequence
ggaggatcgcttgagcctgg

SEQ ID NO: 38739 - DNA, 20 bp, Artificial
  CRISPR gRNA sequence
tcgcttgagcctgggagctt

SEQ ID NO: 38740 - DNA, 20 bp, Artificial
  CRISPR gRNA sequence
atgatcacaccactgtactc

SEQ ID NO: 38741 - DNA, 20 bp, Artificial
  CRISPR gRNA sequence
cacaccactgtactccagcc

SEQ ID NO: 38742 - DNA, 20 bp, Artificial
  CRISPR gRNA sequence
acaccactgtactccagcct

SEQ ID NO: 38743 - DNA, 20 bp, Artificial
  CRISPR gRNA sequence
ctgtactccagcctgggtga

SEQ ID NO: 38744 - DNA, 20 bp, Artificial
  CRISPR gRNA sequence
gtactccagcctgggtgaca

SEQ ID NO: 38745 - DNA, 20 bp, Artificial
  CRISPR gRNA sequence
actccagcctgggtgacaga

SEQ ID NO: 38746 - DNA, 20 bp, Artificial
  CRISPR gRNA sequence
ctccagcctgggtgacagag

SEQ ID NO: 38747 - DNA, 20 bp, Artificial
  CRISPR gRNA sequence
tccagcctgggtgacagaga

SEQ ID NO: 38748 - DNA, 20 bp, Artificial
  CRISPR gRNA sequence
tgtctcaaaaaatgacccac

SEQ ID NO: 38749 - DNA, 20 bp, Artificial
  CRISPR gRNA sequence
gtctcaaaaaatgacccact

SEQ ID NO: 38750 - DNA, 20 bp, Artificial
  CRISPR gRNA sequence
aaaaaatgacccactaggac

SEQ ID NO: 38751 - DNA, 20 bp, Artificial
  CRISPR gRNA sequence
cttttccctctaactgctta

SEQ ID NO: 38752 - DNA, 20 bp, Artificial
  CRISPR gRNA sequence
ctgcttaaagctgtgatgct

SEQ ID NO: 38753 - DNA, 20 bp, Artificial
  CRISPR gRNA sequence
cttaaagctgtgatgctcag

SEQ ID NO: 38754 - DNA, 20 bp, Artificial
  CRISPR gRNA sequence
ttaaagctgtgatgctcagt

SEQ ID NO: 38755 - DNA, 20 bp, Artificial
  CRISPR gRNA sequence
agctgtgatgctcagtagga

SEQ ID NO: 38756 - DNA, 20 bp, Artificial
  CRISPR gRNA sequence
atgctcagtaggatagccac

SEQ ID NO: 38757 - DNA, 20 bp, Artificial
  CRISPR gRNA sequence
ggatagccactagccccata

SEQ ID NO: 38758 - DNA, 20 bp, Artificial
  CRISPR gRNA sequence
aatttaaataaattaaaatt

SEQ ID NO: 38759 - DNA, 20 bp, Artificial
  CRISPR gRNA sequence
attaagtaaaatgaaatttt

SEQ ID NO: 38760 - DNA, 20 bp, Artificial
  CRISPR gRNA sequence
aaatgaaattttcagttcat

SEQ ID NO: 38761 - DNA, 20 bp, Artificial
  CRISPR gRNA sequence
tttcagttcattagtcacat

SEQ ID NO: 38762 - DNA, 20 bp, Artificial
  CRISPR gRNA sequence
ttagctatatttcaactgct

SEQ ID NO: 38763 - DNA, 20 bp, Artificial
  CRISPR gRNA sequence
gctatatttcaactgctcag

SEQ ID NO: 38764 - DNA, 20 bp, Artificial
  CRISPR gRNA sequence
tttcaactgctcagtggcca

SEQ ID NO: 38765 - DNA, 20 bp, Artificial
  CRISPR gRNA sequence
ttcaactgctcagtggccat

SEQ ID NO: 38766 - DNA, 20 bp, Artificial
  CRISPR gRNA sequence
aactgctcagtggccatagg

SEQ ID NO: 38767 - DNA, 20 bp, Artificial
  CRISPR gRNA sequence
gctcagtggccataggtggc

SEQ ID NO: 38768 - DNA, 20 bp, Artificial
  CRISPR gRNA sequence
cagtggccataggtggctag

SEQ ID NO: 38769 - DNA, 20 bp, Artificial
  CRISPR gRNA sequence
taggtggctagtggctccca

SEQ ID NO: 38770 - DNA, 20 bp, Artificial
  CRISPR gRNA sequence
tggctagtggctcccatagc

SEQ ID NO: 38771 - DNA, 20 bp, Artificial
  CRISPR gRNA sequence
ctagtggctcccatagcaag

SEQ ID NO: 38772 - DNA, 20 bp, Artificial
  CRISPR gRNA sequence
ggctcccatagcaagtggta

SEQ ID NO: 38773 - DNA, 20 bp, Artificial
  CRISPR gRNA sequence
atagcaagtggtacagatgc

SEQ ID NO: 38774 - DNA, 20 bp, Artificial
  CRISPR gRNA sequence
tagcaagtggtacagatgcc

SEQ ID NO: 38775 - DNA, 20 bp, Artificial
  CRISPR gRNA sequence
ccaggacatttccatcattg

SEQ ID NO: 38776 - DNA, 20 bp, Artificial
  CRISPR gRNA sequence
gacatttccatcattgcaga

SEQ ID NO: 38777 - DNA, 20 bp, Artificial
  CRISPR gRNA sequence
ttgcagaaagttctattaaa

SEQ ID NO: 38778 - DNA, 20 bp, Artificial
  CRISPR gRNA sequence
tgcagaaagttctattaaac

SEQ ID NO: 38779 - DNA, 20 bp, Artificial
  CRISPR gRNA sequence
gaaagttctattaaacaggc

SEQ ID NO: 38780 - DNA, 20 bp, Artificial
  CRISPR gRNA sequence
ttctattaaacaggctggca

SEQ ID NO: 38781 - DNA, 20 bp, Artificial
  CRISPR gRNA sequence
tattaaacaggctggcatgg

SEQ ID NO: 38782 - DNA, 20 bp, Artificial
  CRISPR gRNA sequence
gtggctcatgtctgtaaccc

SEQ ID NO: 38783 - DNA, 20 bp, Artificial
  CRISPR gRNA sequence
gtctgtaaccccagcacttt

SEQ ID NO: 38784 - DNA, 20 bp, Artificial
  CRISPR gRNA sequence
ctgtaaccccagcactttga

SEQ ID NO: 38785 - DNA, 20 bp, Artificial
  CRISPR gRNA sequence
tgtaaccccagcactttgag

SEQ ID NO: 38786 - DNA, 20 bp, Artificial
  CRISPR gRNA sequence
ccccagcactttgagaggct

SEQ ID NO: 38787 - DNA, 20 bp, Artificial
  CRISPR gRNA sequence
cccagcactttgagaggctg

SEQ ID NO: 38788 - DNA, 20 bp, Artificial
  CRISPR gRNA sequence
ccagcactttgagaggctga

SEQ ID NO: 38789 - DNA, 20 bp, Artificial
  CRISPR gRNA sequence
cagcactttgagaggctgag

SEQ ID NO: 38790 - DNA, 20 bp, Artificial
  CRISPR gRNA sequence
agcactttgagaggctgagg

SEQ ID NO: 38791 - DNA, 20 bp, Artificial
  CRISPR gRNA sequence
actttgagaggctgaggggg

SEQ ID NO: 38792 - DNA, 20 bp, Artificial
  CRISPR gRNA sequence
ctttgagaggctgagggggc

SEQ ID NO: 38793 - DNA, 20 bp, Artificial
  CRISPR gRNA sequence
tgagggggcaggatcgcttg

SEQ ID NO: 38794 - DNA, 20 bp, Artificial
  CRISPR gRNA sequence
ggggcaggatcgcttgaagc

SEQ ID NO: 38795 - DNA, 20 bp, Artificial
  CRISPR gRNA sequence
gggcaggatcgcttgaagct

SEQ ID NO: 38796 - DNA, 20 bp, Artificial
  CRISPR gRNA sequence
gcaggatcgcttgaagctag

SEQ ID NO: 38797 - DNA, 20 bp, Artificial
  CRISPR gRNA sequence
tcgcttgaagctaggagttc

SEQ ID NO: 38798 - DNA, 20 bp, Artificial
  CRISPR gRNA sequence
tgaagctaggagttcaagac

SEQ ID NO: 38799 - DNA, 20 bp, Artificial
  CRISPR gRNA sequence
ctaggagttcaagaccagcc

SEQ ID NO: 38800 - DNA, 20 bp, Artificial
  CRISPR gRNA sequence
taggagttcaagaccagcct

SEQ ID NO: 38801 - DNA, 20 bp, Artificial
  CRISPR gRNA sequence
caagaccagcctgggcaaca

SEQ ID NO: 38802 - DNA, 20 bp, Artificial
  CRISPR gRNA sequence
accagcctgggcaacaaagt

SEQ ID NO: 38803 - DNA, 20 bp, Artificial
  CRISPR gRNA sequence
ctacaaaaaaaaaaaaaaaa

SEQ ID NO: 38804 - DNA, 20 bp, Artificial
  CRISPR gRNA sequence
aaaaaaaaaaaaaaaatagc

SEQ ID NO: 38805 - DNA, 20 bp, Artificial
  CRISPR gRNA sequence
aaaaaaaaaaaaaaatagct

SEQ ID NO: 38806 - DNA, 20 bp, Artificial
  CRISPR gRNA sequence
aaaaaaaaaatagctgggca

SEQ ID NO: 38807 - DNA, 20 bp, Artificial
  CRISPR gRNA sequence
ggcatggtgattcactccta

SEQ ID NO: 38808 - DNA, 20 bp, Artificial
  CRISPR gRNA sequence
gtgattcactcctatagtac

SEQ ID NO: 38809 - DNA, 20 bp, Artificial
  CRISPR gRNA sequence
ctcctatagtaccagttact

SEQ ID NO: 38810 - DNA, 20 bp, Artificial
  CRISPR gRNA sequence
tcctatagtaccagttactc

SEQ ID NO: 38811 - DNA, 20 bp, Artificial
  CRISPR gRNA sequence
tatagtaccagttactcagg

SEQ ID NO: 38812 - DNA, 20 bp, Artificial
  CRISPR gRNA sequence
taccagttactcaggaagcc

SEQ ID NO: 38813 - DNA, 20 bp, Artificial
  CRISPR gRNA sequence
accagttactcaggaagcca

SEQ ID NO: 38814 - DNA, 20 bp, Artificial
  CRISPR gRNA sequence
agttactcaggaagccaagg

SEQ ID NO: 38815 - DNA, 20 bp, Artificial
  CRISPR gRNA sequence
gttactcaggaagccaaggt

SEQ ID NO: 38816 - DNA, 20 bp, Artificial
  CRISPR gRNA sequence
tactcaggaagccaaggtgg

SEQ ID NO: 38817 - DNA, 20 bp, Artificial
  CRISPR gRNA sequence
actcaggaagccaaggtggg

SEQ ID NO: 38818 - DNA, 20 bp, Artificial
  CRISPR gRNA sequence
ccaaggtgggaggatcactt

SEQ ID NO: 38819 - DNA, 20 bp, Artificial
  CRISPR gRNA sequence
gtgggaggatcacttgagcc

SEQ ID NO: 38820 - DNA, 20 bp, Artificial
  CRISPR gRNA sequence
tgggaggatcacttgagccc

SEQ ID NO: 38821 - DNA, 20 bp, Artificial
  CRISPR gRNA sequence
ggaggatcacttgagcccag

SEQ ID NO: 38822 - DNA, 20 bp, Artificial
  CRISPR gRNA sequence
tcacttgagcccaggagttt

SEQ ID NO: 38823 - DNA, 20 bp, Artificial
  CRISPR gRNA sequence
cacttgagcccaggagtttg

SEQ ID NO: 38824 - DNA, 20 bp, Artificial
  CRISPR gRNA sequence
agcccaggagtttgaggctg

SEQ ID NO: 38825 - DNA, 20 bp, Artificial
  CRISPR gRNA sequence
agtttgaggctgcagtgaac

SEQ ID NO: 38826 - DNA, 20 bp, Artificial
  CRISPR gRNA sequence
gtttgaggctgcagtgaact

SEQ ID NO: 38827 - DNA, 20 bp, Artificial
  CRISPR gRNA sequence
gaggctgcagtgaactggga

SEQ ID NO: 38828 - DNA, 20 bp, Artificial
  CRISPR gRNA sequence
ggctgcagtgaactgggata

SEQ ID NO: 38829 - DNA, 20 bp, Artificial
  CRISPR gRNA sequence
gggatagagccactgcactc

SEQ ID NO: 38830 - DNA, 20 bp, Artificial
  CRISPR gRNA sequence
agagccactgcactccagct

SEQ ID NO: 38831 - DNA, 20 bp, Artificial
  CRISPR gRNA sequence
gagccactgcactccagctt

SEQ ID NO: 38832 - DNA, 20 bp, Artificial
  CRISPR gRNA sequence
agccactgcactccagcttg

SEQ ID NO: 38833 - DNA, 20 bp, Artificial
  CRISPR gRNA sequence
tgcactccagcttggggact

SEQ ID NO: 38834 - DNA, 20 bp, Artificial
  CRISPR gRNA sequence
actccagcttggggactgag

SEQ ID NO: 38835 - DNA, 20 bp, Artificial
  CRISPR gRNA sequence
ctccagcttggggactgagt

SEQ ID NO: 38836 - DNA, 20 bp, Artificial
  CRISPR gRNA sequence
tgtctctaaaaaaaaaaaaa

SEQ ID NO: 38837 - DNA, 20 bp, Artificial
  CRISPR gRNA sequence
tctaaaaaaaaaaaaatggt

SEQ ID NO: 38838 - DNA, 20 bp, Artificial
  CRISPR gRNA sequence
atggttagcaccaatccaaa

SEQ ID NO: 38839 - DNA, 20 bp, Artificial
  CRISPR gRNA sequence
tccaaaaagtctgtgaaacc

SEQ ID NO: 38840 - DNA, 20 bp, Artificial
  CRISPR gRNA sequence
aaacctggctcatgatgtcc

SEQ ID NO: 38841 - DNA, 20 bp, Artificial
  CRISPR gRNA sequence
tgcatcccctaacgctccct

SEQ ID NO: 38842 - DNA, 20 bp, Artificial
  CRISPR gRNA sequence
cccctaacgctccctcagcc

SEQ ID NO: 38843 - DNA, 20 bp, Artificial
  CRISPR gRNA sequence
ctaacgctccctcagcccag

SEQ ID NO: 38844 - DNA, 20 bp, Artificial
  CRISPR gRNA sequence
taacgctccctcagcccagt

SEQ ID NO: 38845 - DNA, 20 bp, Artificial
  CRISPR gRNA sequence
acgctccctcagcccagtgg

SEQ ID NO: 38846 - DNA, 20 bp, Artificial
  CRISPR gRNA sequence
gctccctcagcccagtggga

SEQ ID NO: 38847 - DNA, 20 bp, Artificial
  CRISPR gRNA sequence
tccctcagcccagtgggaga

SEQ ID NO: 38848 - DNA, 20 bp, Artificial
  CRISPR gRNA sequence
gcccagtgggagagagtctg

SEQ ID NO: 38849 - DNA, 20 bp, Artificial
  CRISPR gRNA sequence
agagagtctgtggtttacca

SEQ ID NO: 38850 - DNA, 20 bp, Artificial
  CRISPR gRNA sequence
gtctgtggtttaccatagcc

SEQ ID NO: 38851 - DNA, 20 bp, Artificial
  CRISPR gRNA sequence
tagcctggactcactgcata

SEQ ID NO: 38852 - DNA, 20 bp, Artificial
  CRISPR gRNA sequence
gctcctcgccttctgaacca

SEQ ID NO: 38853 - DNA, 20 bp, Artificial
  CRISPR gRNA sequence
ctcgccttctgaaccacaga

SEQ ID NO: 38854 - DNA, 20 bp, Artificial
  CRISPR gRNA sequence
acagacagcacatccacaaa

SEQ ID NO: 38855 - DNA, 20 bp, Artificial
  CRISPR gRNA sequence
agacagcacatccacaaatg

SEQ ID NO: 38856 - DNA, 20 bp, Artificial
  CRISPR gRNA sequence
gaccatcacatcatcgacaa

SEQ ID NO: 38857 - DNA, 20 bp, Artificial
  CRISPR gRNA sequence
catcacatcatcgacaatag

SEQ ID NO: 38858 - DNA, 20 bp, Artificial
  CRISPR gRNA sequence
cttcgattttacacctatgc

SEQ ID NO: 38859 - DNA, 20 bp, Artificial
  CRISPR gRNA sequence
ttcgattttacacctatgct

SEQ ID NO: 38860 - DNA, 20 bp, Artificial
  CRISPR gRNA sequence
ttacacctatgctgggtact

SEQ ID NO: 38861 - DNA, 20 bp, Artificial
  CRISPR gRNA sequence
cattgtctcattcaatcctt

SEQ ID NO: 38862 - DNA, 20 bp, Artificial
  CRISPR gRNA sequence
attgtctcattcaatccttc

SEQ ID NO: 38863 - DNA, 20 bp, Artificial
  CRISPR gRNA sequence
tccttcaggtacctatgtgc

SEQ ID NO: 38864 - DNA, 20 bp, Artificial
  CRISPR gRNA sequence
ctagatgttgtcatccgttt

SEQ ID NO: 38865 - DNA, 20 bp, Artificial
  CRISPR gRNA sequence
tgttgtcatccgttttagaa

SEQ ID NO: 38866 - DNA, 20 bp, Artificial
  CRISPR gRNA sequence
ttgtcatccgttttagaaaa

SEQ ID NO: 38867 - DNA, 20 bp, Artificial
  CRISPR gRNA sequence
atccgttttagaaaagagaa

SEQ ID NO: 38868 - DNA, 20 bp, Artificial
  CRISPR gRNA sequence
tccgttttagaaaagagaaa

SEQ ID NO: 38869 - DNA, 20 bp, Artificial
  CRISPR gRNA sequence
ccgttttagaaaagagaaaa

SEQ ID NO: 38870 - DNA, 20 bp, Artificial
  CRISPR gRNA sequence
gttttagaaaagagaaaagg

SEQ ID NO: 38871 - DNA, 20 bp, Artificial
  CRISPR gRNA sequence
agagaaaagggagccgactg

SEQ ID NO: 38872 - DNA, 20 bp, Artificial
  CRISPR gRNA sequence
ccgactgcagtgatttgccc

SEQ ID NO: 38873 - DNA, 20 bp, Artificial
  CRISPR gRNA sequence
cgactgcagtgatttgccca

SEQ ID NO: 38874 - DNA, 20 bp, Artificial
  CRISPR gRNA sequence
gtgatttgcccaaggccaca

SEQ ID NO: 38875 - DNA, 20 bp, Artificial
  CRISPR gRNA sequence
caaggccacatggctataca

SEQ ID NO: 38876 - DNA, 20 bp, Artificial
  CRISPR gRNA sequence
ggccacatggctatacatgg

SEQ ID NO: 38877 - DNA, 20 bp, Artificial
  CRISPR gRNA sequence
ccacatggctatacatggca

SEQ ID NO: 38878 - DNA, 20 bp, Artificial
  CRISPR gRNA sequence
gcagagccaaaatttgaata

SEQ ID NO: 38879 - DNA, 20 bp, Artificial
  CRISPR gRNA sequence
cagagccaaaatttgaataa

SEQ ID NO: 38880 - DNA, 20 bp, Artificial
  CRISPR gRNA sequence
gctctgctgaatcacatctt

SEQ ID NO: 38881 - DNA, 20 bp, Artificial
  CRISPR gRNA sequence
atcacatcttgagcatctgc

SEQ ID NO: 38882 - DNA, 20 bp, Artificial
  CRISPR gRNA sequence
acatcttgagcatctgcaag

SEQ ID NO: 38883 - DNA, 20 bp, Artificial
  CRISPR gRNA sequence
cctttgttaccgactcactt

SEQ ID NO: 38884 - DNA, 20 bp, Artificial
  CRISPR gRNA sequence
ctttgttaccgactcacttt

SEQ ID NO: 38885 - DNA, 20 bp, Artificial
  CRISPR gRNA sequence
actcactttgggttgtgctt

SEQ ID NO: 38886 - DNA, 20 bp, Artificial
  CRISPR gRNA sequence
ctcactttgggttgtgcttc

SEQ ID NO: 38887 - DNA, 20 bp, Artificial
  CRISPR gRNA sequence
tcactttgggttgtgcttca

SEQ ID NO: 38888 - DNA, 20 bp, Artificial
  CRISPR gRNA sequence
gggttgtgcttcagggtctt

SEQ ID NO: 38889 - DNA, 20 bp, Artificial
  CRISPR gRNA sequence
gcttcagggtcttcagcctc

SEQ ID NO: 38890 - DNA, 20 bp, Artificial
  CRISPR gRNA sequence
tcagggtcttcagcctctag

SEQ ID NO: 38891 - DNA, 20 bp, Artificial
  CRISPR gRNA sequence
gtcttcagcctctagaagcc

SEQ ID NO: 38892 - DNA, 20 bp, Artificial
  CRISPR gRNA sequence
tcttcagcctctagaagcca

SEQ ID NO: 38893 - DNA, 20 bp, Artificial
  CRISPR gRNA sequence
cagcctctagaagccaagga

SEQ ID NO: 38894 - DNA, 20 bp, Artificial
  CRISPR gRNA sequence
gcctctagaagccaaggaaa

SEQ ID NO: 38895 - DNA, 20 bp, Artificial
  CRISPR gRNA sequence
cctctagaagccaaggaaag

SEQ ID NO: 38896 - DNA, 20 bp, Artificial
  CRISPR gRNA sequence
aggaaagaggcttgatccac

SEQ ID NO: 38897 - DNA, 20 bp, Artificial
  CRISPR gRNA sequence
ggaaagaggcttgatccacc

SEQ ID NO: 38898 - DNA, 20 bp, Artificial
  CRISPR gRNA sequence
aggcttgatccaccaggccc

SEQ ID NO: 38899 - DNA, 20 bp, Artificial
  CRISPR gRNA sequence
ccaccaggccctagatgcct

SEQ ID NO: 38900 - DNA, 20 bp, Artificial
  CRISPR gRNA sequence
aggccctagatgcctgagcc

SEQ ID NO: 38901 - DNA, 20 bp, Artificial
  CRISPR gRNA sequence
ggccctagatgcctgagccc

SEQ ID NO: 38902 - DNA, 20 bp, Artificial
  CRISPR gRNA sequence
aatgcttgatttgttcttgc

SEQ ID NO: 38903 - DNA, 20 bp, Artificial
  CRISPR gRNA sequence
tgcttgatttgttcttgcca

SEQ ID NO: 38904 - DNA, 20 bp, Artificial
  CRISPR gRNA sequence
atttgttcttgccagagctc

SEQ ID NO: 38905 - DNA, 20 bp, Artificial
  CRISPR gRNA sequence
ttgccagagctccagacctg

SEQ ID NO: 38906 - DNA, 20 bp, Artificial
  CRISPR gRNA sequence
tgccagagctccagacctgc

SEQ ID NO: 38907 - DNA, 20 bp, Artificial
  CRISPR gRNA sequence
agagctccagacctgcagga

SEQ ID NO: 38908 - DNA, 20 bp, Artificial
  CRISPR gRNA sequence
ccagacctgcaggaaagtga

SEQ ID NO: 38909 - DNA, 20 bp, Artificial
  CRISPR gRNA sequence
acctgcaggaaagtgacggc

SEQ ID NO: 38910 - DNA, 20 bp, Artificial
  CRISPR gRNA sequence
ctgcaggaaagtgacggcca

SEQ ID NO: 38911 - DNA, 20 bp, Artificial
  CRISPR gRNA sequence
tgcaggaaagtgacggccag

SEQ ID NO: 38912 - DNA, 20 bp, Artificial
  CRISPR gRNA sequence
ggaaagtgacggccagagga

SEQ ID NO: 38913 - DNA, 20 bp, Artificial
  CRISPR gRNA sequence
gaaagtgacggccagaggaa

SEQ ID NO: 38914 - DNA, 20 bp, Artificial
  CRISPR gRNA sequence
aaagtgacggccagaggaaa

SEQ ID NO: 38915 - DNA, 20 bp, Artificial
  CRISPR gRNA sequence
aagtgacggccagaggaaag

SEQ ID NO: 38916 - DNA, 20 bp, Artificial
  CRISPR gRNA sequence
acggccagaggaaaggggct

SEQ ID NO: 38917 - DNA, 20 bp, Artificial
  CRISPR gRNA sequence
ggccagaggaaaggggctca

SEQ ID NO: 38918 - DNA, 20 bp, Artificial
  CRISPR gRNA sequence
cagaggaaaggggctcagag

SEQ ID NO: 38919 - DNA, 20 bp, Artificial
  CRISPR gRNA sequence
aggaaaggggctcagagcag

SEQ ID NO: 38920 - DNA, 20 bp, Artificial
  CRISPR gRNA sequence
cagagcagaagcttgacgct

SEQ ID NO: 38921 - DNA, 20 bp, Artificial
  CRISPR gRNA sequence
agagcagaagcttgacgctc

SEQ ID NO: 38922 - DNA, 20 bp, Artificial
  CRISPR gRNA sequence
agcttgacgctcaggtacct

SEQ ID NO: 38923 - DNA, 20 bp, Artificial
  CRISPR gRNA sequence
cttgacgctcaggtaccttg

SEQ ID NO: 38924 - DNA, 20 bp, Artificial
  CRISPR gRNA sequence
ttgacgctcaggtaccttgg

SEQ ID NO: 38925 - DNA, 20 bp, Artificial
  CRISPR gRNA sequence
tgacgctcaggtaccttgga

SEQ ID NO: 38926 - DNA, 20 bp, Artificial
  CRISPR gRNA sequence
cttggagggatctattgcct

SEQ ID NO: 38927 - DNA, 20 bp, Artificial
  CRISPR gRNA sequence
ttggagggatctattgcctt

SEQ ID NO: 38928 - DNA, 20 bp, Artificial
  CRISPR gRNA sequence
ggagggatctattgccttag

SEQ ID NO: 38929 - DNA, 20 bp, Artificial
  CRISPR gRNA sequence
agggatctattgccttagga

SEQ ID NO: 38930 - DNA, 20 bp, Artificial
  CRISPR gRNA sequence
gggatctattgccttaggag

SEQ ID NO: 38931 - DNA, 20 bp, Artificial
  CRISPR gRNA sequence
ggatctattgccttaggaga

SEQ ID NO: 38932 - DNA, 20 bp, Artificial
  CRISPR gRNA sequence
cttaggagagggatatgata

SEQ ID NO: 38933 - DNA, 20 bp, Artificial
  CRISPR gRNA sequence
ttaggagagggatatgatat

SEQ ID NO: 38934 - DNA, 20 bp, Artificial
  CRISPR gRNA sequence
taggagagggatatgatatg

SEQ ID NO: 38935 - DNA, 20 bp, Artificial
  CRISPR gRNA sequence
aggagagggatatgatatgg

SEQ ID NO: 38936 - DNA, 20 bp, Artificial
  CRISPR gRNA sequence
gagggatatgatatggggga

SEQ ID NO: 38937 - DNA, 20 bp, Artificial
  CRISPR gRNA sequence
tatgatatgggggaaagtcc

SEQ ID NO: 38938 - DNA, 20 bp, Artificial
  CRISPR gRNA sequence
atgatatgggggaaagtccg

SEQ ID NO: 38939 - DNA, 20 bp, Artificial
  CRISPR gRNA sequence
tatgggggaaagtccgaggc

SEQ ID NO: 38940 - DNA, 20 bp, Artificial
  CRISPR gRNA sequence
atgggggaaagtccgaggca

SEQ ID NO: 38941 - DNA, 20 bp, Artificial
  CRISPR gRNA sequence
tgggggaaagtccgaggcaa

SEQ ID NO: 38942 - DNA, 20 bp, Artificial
  CRISPR gRNA sequence
ggggaaagtccgaggcaagg

SEQ ID NO: 38943 - DNA, 20 bp, Artificial
  CRISPR gRNA sequence
ggaaagtccgaggcaaggga

SEQ ID NO: 38944 - DNA, 20 bp, Artificial
  CRISPR gRNA sequence
aagtccgaggcaagggagag

SEQ ID NO: 38945 - DNA, 20 bp, Artificial
  CRISPR gRNA sequence
agtccgaggcaagggagagc

SEQ ID NO: 38946 - DNA, 20 bp, Artificial
  CRISPR gRNA sequence
gtccgaggcaagggagagca

SEQ ID NO: 38947 - DNA, 20 bp, Artificial
  CRISPR gRNA sequence
tccgaggcaagggagagcag

SEQ ID NO: 38948 - DNA, 20 bp, Artificial
  CRISPR gRNA sequence
gaggcaagggagagcagggg

SEQ ID NO: 38949 - DNA, 20 bp, Artificial
  CRISPR gRNA sequence
aggcaagggagagcaggggc

SEQ ID NO: 38950 - DNA, 20 bp, Artificial
  CRISPR gRNA sequence
ggcaagggagagcaggggca

SEQ ID NO: 38951 - DNA, 20 bp, Artificial
  CRISPR gRNA sequence
caagggagagcaggggcagg

SEQ ID NO: 38952 - DNA, 20 bp, Artificial
  CRISPR gRNA sequence
aagggagagcaggggcaggg

SEQ ID NO: 38953 - DNA, 20 bp, Artificial
  CRISPR gRNA sequence
gagcaggggcagggaggata

SEQ ID NO: 38954 - DNA, 20 bp, Artificial
  CRISPR gRNA sequence
agcaggggcagggaggataa

SEQ ID NO: 38955 - DNA, 20 bp, Artificial
  CRISPR gRNA sequence
gcaggggcagggaggataaa

SEQ ID NO: 38956 - DNA, 20 bp, Artificial
  CRISPR gRNA sequence
ggcagggaggataaagggaa

SEQ ID NO: 38957 - DNA, 20 bp, Artificial
  CRISPR gRNA sequence
agggaggataaagggaaaag

SEQ ID NO: 38958 - DNA, 20 bp, Artificial
  CRISPR gRNA sequence
ggataaagggaaaagcagat

SEQ ID NO: 38959 - DNA, 20 bp, Artificial
  CRISPR gRNA sequence
gataaagggaaaagcagatg

SEQ ID NO: 38960 - DNA, 20 bp, Artificial
  CRISPR gRNA sequence
ataaagggaaaagcagatga

SEQ ID NO: 38961 - DNA, 20 bp, Artificial
  CRISPR gRNA sequence
agggaaaagcagatgaggga

SEQ ID NO: 38962 - DNA, 20 bp, Artificial
  CRISPR gRNA sequence
gggaaaagcagatgagggac

SEQ ID NO: 38963 - DNA, 20 bp, Artificial
  CRISPR gRNA sequence
ggaaaagcagatgagggaca

SEQ ID NO: 38964 - DNA, 20 bp, Artificial
  CRISPR gRNA sequence
aagcagatgagggacaggga

SEQ ID NO: 38965 - DNA, 20 bp, Artificial
  CRISPR gRNA sequence
agcagatgagggacagggaa

SEQ ID NO: 38966 - DNA, 20 bp, Artificial
  CRISPR gRNA sequence
atgagggacagggaaaggat

SEQ ID NO: 38967 - DNA, 20 bp, Artificial
  CRISPR gRNA sequence
gggacagggaaaggattagc

SEQ ID NO: 38968 - DNA, 20 bp, Artificial
  CRISPR gRNA sequence
ggacagggaaaggattagcc

SEQ ID NO: 38969 - DNA, 20 bp, Artificial
  CRISPR gRNA sequence
gggaaaggattagccgggtg

SEQ ID NO: 38970 - DNA, 20 bp, Artificial
  CRISPR gRNA sequence
gccgggtgtggtgcccatcc

SEQ ID NO: 38971 - DNA, 20 bp, Artificial
  CRISPR gRNA sequence
ggtgtggtgcccatcctgga

SEQ ID NO: 38972 - DNA, 20 bp, Artificial
  CRISPR gRNA sequence
ccatcctggatagcccatcc

SEQ ID NO: 38973 - DNA, 20 bp, Artificial
  CRISPR gRNA sequence
tagcccatcctggcttgaat

SEQ ID NO: 38974 - DNA, 20 bp, Artificial
  CRISPR gRNA sequence
agcccatcctggcttgaata

SEQ ID NO: 38975 - DNA, 20 bp, Artificial
  CRISPR gRNA sequence
cccatcctggcttgaataag

SEQ ID NO: 38976 - DNA, 20 bp, Artificial
  CRISPR gRNA sequence
agcatctgtcataataacaa

SEQ ID NO: 38977 - DNA, 20 bp, Artificial
  CRISPR gRNA sequence
taacaatagctgcaacttaa

SEQ ID NO: 38978 - DNA, 20 bp, Artificial
  CRISPR gRNA sequence
tagctgcaacttaatggaac

SEQ ID NO: 38979 - DNA, 20 bp, Artificial
  CRISPR gRNA sequence
ggaaccggctatctatatgc

SEQ ID NO: 38980 - DNA, 20 bp, Artificial
  CRISPR gRNA sequence
gaaccggctatctatatgcc

SEQ ID NO: 38981 - DNA, 20 bp, Artificial
  CRISPR gRNA sequence
ctatatgccgggcattgcac

SEQ ID NO: 38982 - DNA, 20 bp, Artificial
  CRISPR gRNA sequence
ttacctcactgtaattcctt

SEQ ID NO: 38983 - DNA, 20 bp, Artificial
  CRISPR gRNA sequence
attcctttagaatctctgtg

SEQ ID NO: 38984 - DNA, 20 bp, Artificial
  CRISPR gRNA sequence
acacattattattccccttt

SEQ ID NO: 38985 - DNA, 20 bp, Artificial
  CRISPR gRNA sequence
cacattattattcccctttg

SEQ ID NO: 38986 - DNA, 20 bp, Artificial
  CRISPR gRNA sequence
acattattattcccctttga

SEQ ID NO: 38987 - DNA, 20 bp, Artificial
  CRISPR gRNA sequence
attattattcccctttgagg

SEQ ID NO: 38988 - DNA, 20 bp, Artificial
  CRISPR gRNA sequence
ttattattcccctttgaggg

SEQ ID NO: 38989 - DNA, 20 bp, Artificial
  CRISPR gRNA sequence
attattcccctttgagggag

SEQ ID NO: 38990 - DNA, 20 bp, Artificial
  CRISPR gRNA sequence
ttattcccctttgagggagg

SEQ ID NO: 38991 - DNA, 20 bp, Artificial
  CRISPR gRNA sequence
ctttgagggaggaggaaact

SEQ ID NO: 38992 - DNA, 20 bp, Artificial
  CRISPR gRNA sequence
gggaggaggaaactgagtct

SEQ ID NO: 38993 - DNA, 20 bp, Artificial
  CRISPR gRNA sequence
ggaggaaactgagtctcaga

SEQ ID NO: 38994 - DNA, 20 bp, Artificial
  CRISPR gRNA sequence
gaggaaactgagtctcagac

SEQ ID NO: 38995 - DNA, 20 bp, Artificial
  CRISPR gRNA sequence
aactgagtctcagacaggtt

SEQ ID NO: 38996 - DNA, 20 bp, Artificial
  CRISPR gRNA sequence
acaggttaagtcccttgctc

SEQ ID NO: 38997 - DNA, 20 bp, Artificial
  CRISPR gRNA sequence
gtcccttgctcaagatcacc

SEQ ID NO: 38998 - DNA, 20 bp, Artificial
  CRISPR gRNA sequence
ctcaagatcacccagctact

SEQ ID NO: 38999 - DNA, 20 bp, Artificial
  CRISPR gRNA sequence
caagatcacccagctactaa

SEQ ID NO: 39000 - DNA, 20 bp, Artificial
  CRISPR gRNA sequence
aagatcacccagctactaag

SEQ ID NO: 39001 - DNA, 20 bp, Artificial
  CRISPR gRNA sequence
cacccagctactaagaggtg

SEQ ID NO: 39002 - DNA, 20 bp, Artificial
  CRISPR gRNA sequence
cagctactaagaggtgtggc

SEQ ID NO: 39003 - DNA, 20 bp, Artificial
  CRISPR gRNA sequence
agctactaagaggtgtggct

SEQ ID NO: 39004 - DNA, 20 bp, Artificial
  CRISPR gRNA sequence
ctaagaggtgtggctaggat

SEQ ID NO: 39005 - DNA, 20 bp, Artificial
  CRISPR gRNA sequence
ggtgtggctaggattagacc

SEQ ID NO: 39006 - DNA, 20 bp, Artificial
  CRISPR gRNA sequence
gtgtggctaggattagaccc

SEQ ID NO: 39007 - DNA, 20 bp, Artificial
  CRISPR gRNA sequence
taggattagacccaggtctg

SEQ ID NO: 39008 - DNA, 20 bp, Artificial
  CRISPR gRNA sequence
aggattagacccaggtctgt

SEQ ID NO: 39009 - DNA, 20 bp, Artificial
  CRISPR gRNA sequence
tgtgggccccctgactcccc

SEQ ID NO: 39010 - DNA, 20 bp, Artificial
  CRISPR gRNA sequence
ccccctgactcccccagcat

SEQ ID NO: 39011 - DNA, 20 bp, Artificial
  CRISPR gRNA sequence
cctgactcccccagcattgg

SEQ ID NO: 39012 - DNA, 20 bp, Artificial
  CRISPR gRNA sequence
actcccccagcattggaagc

SEQ ID NO: 39013 - DNA, 20 bp, Artificial
  CRISPR gRNA sequence
tcccccagcattggaagctg

SEQ ID NO: 39014 - DNA, 20 bp, Artificial
  CRISPR gRNA sequence
cccccagcattggaagctgg

SEQ ID NO: 39015 - DNA, 20 bp, Artificial
  CRISPR gRNA sequence
ccccagcattggaagctgga

SEQ ID NO: 39016 - DNA, 20 bp, Artificial
  CRISPR gRNA sequence
cccagcattggaagctggag

SEQ ID NO: 39017 - DNA, 20 bp, Artificial
  CRISPR gRNA sequence
attggaagctggaggggcca

SEQ ID NO: 39018 - DNA, 20 bp, Artificial
  CRISPR gRNA sequence
tggaagctggaggggccatg

SEQ ID NO: 39019 - DNA, 20 bp, Artificial
  CRISPR gRNA sequence
aagctggaggggccatggag

SEQ ID NO: 39020 - DNA, 20 bp, Artificial
  CRISPR gRNA sequence
agctggaggggccatggagt

SEQ ID NO: 39021 - DNA, 20 bp, Artificial
  CRISPR gRNA sequence
gctggaggggccatggagta

SEQ ID NO: 39022 - DNA, 20 bp, Artificial
  CRISPR gRNA sequence
ctggaggggccatggagtag

SEQ ID NO: 39023 - DNA, 20 bp, Artificial
  CRISPR gRNA sequence
gagtaggggctgtttgccct

SEQ ID NO: 39024 - DNA, 20 bp, Artificial
  CRISPR gRNA sequence
tctgtcccccactcctaccc

SEQ ID NO: 39025 - DNA, 20 bp, Artificial
  CRISPR gRNA sequence
ctgtcccccactcctaccca

SEQ ID NO: 39026 - DNA, 20 bp, Artificial
  CRISPR gRNA sequence
cccactcctacccaaggctg

SEQ ID NO: 39027 - DNA, 20 bp, Artificial
  CRISPR gRNA sequence
actcctacccaaggctgcag

SEQ ID NO: 39028 - DNA, 20 bp, Artificial
  CRISPR gRNA sequence
acccaaggctgcagaagtgt

SEQ ID NO: 39029 - DNA, 20 bp, Artificial
  CRISPR gRNA sequence
ggctgcagaagtgtcagctc

SEQ ID NO: 39030 - DNA, 20 bp, Artificial
  CRISPR gRNA sequence
gctgcagaagtgtcagctcc

SEQ ID NO: 39031 - DNA, 20 bp, Artificial
  CRISPR gRNA sequence
tcagctccaggtccacgatg

SEQ ID NO: 39032 - DNA, 20 bp, Artificial
  CRISPR gRNA sequence
agctccaggtccacgatgcg

SEQ ID NO: 39033 - DNA, 20 bp, Artificial
  CRISPR gRNA sequence
gctccaggtccacgatgcgg

SEQ ID NO: 39034 - DNA, 20 bp, Artificial
  CRISPR gRNA sequence
ccacgatgcggaggccctca

SEQ ID NO: 39035 - DNA, 20 bp, Artificial
  CRISPR gRNA sequence
aggccctcatagccctgctc

SEQ ID NO: 39036 - DNA, 20 bp, Artificial
  CRISPR gRNA sequence
ggccctcatagccctgctcc

SEQ ID NO: 39037 - DNA, 20 bp, Artificial
  CRISPR gRNA sequence
cctcatagccctgctccagg

SEQ ID NO: 39038 - DNA, 20 bp, Artificial
  CRISPR gRNA sequence
ctcatagccctgctccagga

SEQ ID NO: 39039 - DNA, 20 bp, Artificial
  CRISPR gRNA sequence
gctccaggaaggccctcacc

SEQ ID NO: 39040 - DNA, 20 bp, Artificial
  CRISPR gRNA sequence
tccaggaaggccctcacctg

SEQ ID NO: 39041 - DNA, 20 bp, Artificial
  CRISPR gRNA sequence
ccaggaaggccctcacctgg

SEQ ID NO: 39042 - DNA, 20 bp, Artificial
  CRISPR gRNA sequence
ggaaggccctcacctggagg

SEQ ID NO: 39043 - DNA, 20 bp, Artificial
  CRISPR gRNA sequence
aggccctcacctggaggaag

SEQ ID NO: 39044 - DNA, 20 bp, Artificial
  CRISPR gRNA sequence
gccctcacctggaggaagtg

SEQ ID NO: 39045 - DNA, 20 bp, Artificial
  CRISPR gRNA sequence
tcacctggaggaagtggagt

SEQ ID NO: 39046 - DNA, 20 bp, Artificial
  CRISPR gRNA sequence
aggaagtggagtgagtatca

SEQ ID NO: 39047 - DNA, 20 bp, Artificial
  CRISPR gRNA sequence
ggaagtggagtgagtatcac

SEQ ID NO: 39048 - DNA, 20 bp, Artificial
  CRISPR gRNA sequence
agtggagtgagtatcacggg

SEQ ID NO: 39049 - DNA, 20 bp, Artificial
  CRISPR gRNA sequence
gtgagtatcacgggaagccc

SEQ ID NO: 39050 - DNA, 20 bp, Artificial
  CRISPR gRNA sequence
tatcacgggaagccctggcg

SEQ ID NO: 39051 - DNA, 20 bp, Artificial
  CRISPR gRNA sequence
atcacgggaagccctggcgt

SEQ ID NO: 39052 - DNA, 20 bp, Artificial
  CRISPR gRNA sequence
cacgggaagccctggcgtag

SEQ ID NO: 39053 - DNA, 20 bp, Artificial
  CRISPR gRNA sequence
ggaagccctggcgtaggagc

SEQ ID NO: 39054 - DNA, 20 bp, Artificial
  CRISPR gRNA sequence
gaagccctggcgtaggagcc

SEQ ID NO: 39055 - DNA, 20 bp, Artificial
  CRISPR gRNA sequence
ccctggcgtaggagccagga

SEQ ID NO: 39056 - DNA, 20 bp, Artificial
  CRISPR gRNA sequence
cctggcgtaggagccaggaa

SEQ ID NO: 39057 - DNA, 20 bp, Artificial
  CRISPR gRNA sequence
tggcgtaggagccaggaaag

SEQ ID NO: 39058 - DNA, 20 bp, Artificial
  CRISPR gRNA sequence
ggcgtaggagccaggaaagg

SEQ ID NO: 39059 - DNA, 20 bp, Artificial
  CRISPR gRNA sequence
taggagccaggaaaggaggt

SEQ ID NO: 39060 - DNA, 20 bp, Artificial
  CRISPR gRNA sequence
ggagccaggaaaggaggttg

SEQ ID NO: 39061 - DNA, 20 bp, Artificial
  CRISPR gRNA sequence
agccaggaaaggaggttgga

SEQ ID NO: 39062 - DNA, 20 bp, Artificial
  CRISPR gRNA sequence
gccaggaaaggaggttggag

SEQ ID NO: 39063 - DNA, 20 bp, Artificial
  CRISPR gRNA sequence
ccaggaaaggaggttggaga

SEQ ID NO: 39064 - DNA, 20 bp, Artificial
  CRISPR gRNA sequence
ggaaaggaggttggagaggg

SEQ ID NO: 39065 - DNA, 20 bp, Artificial
  CRISPR gRNA sequence
gaaaggaggttggagagggt

SEQ ID NO: 39066 - DNA, 20 bp, Artificial
  CRISPR gRNA sequence
aggaggttggagagggtggg

SEQ ID NO: 39067 - DNA, 20 bp, Artificial
  CRISPR gRNA sequence
ggaggttggagagggtgggc

SEQ ID NO: 39068 - DNA, 20 bp, Artificial
  CRISPR gRNA sequence
gaggttggagagggtgggca

SEQ ID NO: 39069 - DNA, 20 bp, Artificial
  CRISPR gRNA sequence
ggtgggcagggcctcgcctt

SEQ ID NO: 39070 - DNA, 20 bp, Artificial
  CRISPR gRNA sequence
gtgggcagggcctcgccttt

SEQ ID NO: 39071 - DNA, 20 bp, Artificial
  CRISPR gRNA sequence
ggcagggcctcgcctttggg

SEQ ID NO: 39072 - DNA, 20 bp, Artificial
  CRISPR gRNA sequence
gcagggcctcgcctttgggt

SEQ ID NO: 39073 - DNA, 20 bp, Artificial
  CRISPR gRNA sequence
gggcctcgcctttgggtggg

SEQ ID NO: 39074 - DNA, 20 bp, Artificial
  CRISPR gRNA sequence
tcgcctttgggtgggtggtg

SEQ ID NO: 39075 - DNA, 20 bp, Artificial
  CRISPR gRNA sequence
cgcctttgggtgggtggtgt

SEQ ID NO: 39076 - DNA, 20 bp, Artificial
  CRISPR gRNA sequence
gcctttgggtgggtggtgtg

SEQ ID NO: 39077 - DNA, 20 bp, Artificial
  CRISPR gRNA sequence
cctttgggtgggtggtgtgg

SEQ ID NO: 39078 - DNA, 20 bp, Artificial
  CRISPR gRNA sequence
tttgggtgggtggtgtgggg

SEQ ID NO: 39079 - DNA, 20 bp, Artificial
  CRISPR gRNA sequence
ttgggtgggtggtgtggggg

SEQ ID NO: 39080 - DNA, 20 bp, Artificial
  CRISPR gRNA sequence
tgggtgggtggtgtggggga

SEQ ID NO: 39081 - DNA, 20 bp, Artificial
  CRISPR gRNA sequence
gggtgggtggtgtgggggag

SEQ ID NO: 39082 - DNA, 20 bp, Artificial
  CRISPR gRNA sequence
gaggggcatgctgcctcatg

SEQ ID NO: 39083 - DNA, 20 bp, Artificial
  CRISPR gRNA sequence
atgctgcctcatgaagaatt

SEQ ID NO: 39084 - DNA, 20 bp, Artificial
  CRISPR gRNA sequence
tgctgcctcatgaagaattt

SEQ ID NO: 39085 - DNA, 20 bp, Artificial
  CRISPR gRNA sequence
gctgcctcatgaagaatttg

SEQ ID NO: 39086 - DNA, 20 bp, Artificial
  CRISPR gRNA sequence
ctgcctcatgaagaatttgg

SEQ ID NO: 39087 - DNA, 20 bp, Artificial
  CRISPR gRNA sequence
catgaagaatttgggggaat

SEQ ID NO: 39088 - DNA, 20 bp, Artificial
  CRISPR gRNA sequence
ggggaatcagatcattgtaa

SEQ ID NO: 39089 - DNA, 20 bp, Artificial
  CRISPR gRNA sequence
ttgtaacagctgctactatt

SEQ ID NO: 39090 - DNA, 20 bp, Artificial
  CRISPR gRNA sequence
ctactattcagcacttgtcc

SEQ ID NO: 39091 - DNA, 20 bp, Artificial
  CRISPR gRNA sequence
tactattcagcacttgtccc

SEQ ID NO: 39092 - DNA, 20 bp, Artificial
  CRISPR gRNA sequence
attcagcacttgtcccgggt

SEQ ID NO: 39093 - DNA, 20 bp, Artificial
  CRISPR gRNA sequence
ttcagcacttgtcccgggtc

SEQ ID NO: 39094 - DNA, 20 bp, Artificial
  CRISPR gRNA sequence
tcccgggtcaggtgctgtgc

SEQ ID NO: 39095 - DNA, 20 bp, Artificial
  CRISPR gRNA sequence
cccgggtcaggtgctgtgct

SEQ ID NO: 39096 - DNA, 20 bp, Artificial
  CRISPR gRNA sequence
ccgggtcaggtgctgtgcta

SEQ ID NO: 39097 - DNA, 20 bp, Artificial
  CRISPR gRNA sequence
tcctcacatctctgtgatgt

SEQ ID NO: 39098 - DNA, 20 bp, Artificial
  CRISPR gRNA sequence
ctgttactgtcctcatttta

SEQ ID NO: 39099 - DNA, 20 bp, Artificial
  CRISPR gRNA sequence
gttactgtcctcattttata

SEQ ID NO: 39100 - DNA, 20 bp, Artificial
  CRISPR gRNA sequence
ttactgtcctcattttatag

SEQ ID NO: 39101 - DNA, 20 bp, Artificial
  CRISPR gRNA sequence
actgtcctcattttatagag

SEQ ID NO: 39102 - DNA, 20 bp, Artificial
  CRISPR gRNA sequence
ctgtcctcattttatagagg

SEQ ID NO: 39103 - DNA, 20 bp, Artificial
  CRISPR gRNA sequence
tcctcattttatagaggagg

SEQ ID NO: 39104 - DNA, 20 bp, Artificial
  CRISPR gRNA sequence
attttatagaggaggaagtt

SEQ ID NO: 39105 - DNA, 20 bp, Artificial
  CRISPR gRNA sequence
tagaggaggaagttaagctg

SEQ ID NO: 39106 - DNA, 20 bp, Artificial
  CRISPR gRNA sequence
ggaggaagttaagctgcaga

SEQ ID NO: 39107 - DNA, 20 bp, Artificial
  CRISPR gRNA sequence
gcagaaagataaacttgctc

SEQ ID NO: 39108 - DNA, 20 bp, Artificial
  CRISPR gRNA sequence
cagaaagataaacttgctca

SEQ ID NO: 39109 - DNA, 20 bp, Artificial
  CRISPR gRNA sequence
taaacttgctcaaggccaca

SEQ ID NO: 39110 - DNA, 20 bp, Artificial
  CRISPR gRNA sequence
aaacttgctcaaggccacac

SEQ ID NO: 39111 - DNA, 20 bp, Artificial
  CRISPR gRNA sequence
cttgctcaaggccacacagg

SEQ ID NO: 39112 - DNA, 20 bp, Artificial
  CRISPR gRNA sequence
ttgctcaaggccacacaggt

SEQ ID NO: 39113 - DNA, 20 bp, Artificial
  CRISPR gRNA sequence
ctcaaggccacacaggtagg

SEQ ID NO: 39114 - DNA, 20 bp, Artificial
  CRISPR gRNA sequence
caaggccacacaggtaggaa

SEQ ID NO: 39115 - DNA, 20 bp, Artificial
  CRISPR gRNA sequence
ccacacaggtaggaagagtc

SEQ ID NO: 39116 - DNA, 20 bp, Artificial
  CRISPR gRNA sequence
cacacaggtaggaagagtct

SEQ ID NO: 39117 - DNA, 20 bp, Artificial
  CRISPR gRNA sequence
caggtaggaagagtctaggc

SEQ ID NO: 39118 - DNA, 20 bp, Artificial
  CRISPR gRNA sequence
aggtaggaagagtctaggct

SEQ ID NO: 39119 - DNA, 20 bp, Artificial
  CRISPR gRNA sequence
ggtaggaagagtctaggcta

SEQ ID NO: 39120 - DNA, 20 bp, Artificial
  CRISPR gRNA sequence
aagagtctaggctagggttc

SEQ ID NO: 39121 - DNA, 20 bp, Artificial
  CRISPR gRNA sequence
tctaggctagggttcaagcc

SEQ ID NO: 39122 - DNA, 20 bp, Artificial
  CRISPR gRNA sequence
ggctagggttcaagcccaga

SEQ ID NO: 39123 - DNA, 20 bp, Artificial
  CRISPR gRNA sequence
gggttcaagcccagacagtc

SEQ ID NO: 39124 - DNA, 20 bp, Artificial
  CRISPR gRNA sequence
agcccagacagtctggctcg

SEQ ID NO: 39125 - DNA, 20 bp, Artificial
  CRISPR gRNA sequence
ccactgctacctctcttgct

SEQ ID NO: 39126 - DNA, 20 bp, Artificial
  CRISPR gRNA sequence
ctctcttgctgagatctgcc

SEQ ID NO: 39127 - DNA, 20 bp, Artificial
  CRISPR gRNA sequence
tcttgctgagatctgccaag

SEQ ID NO: 39128 - DNA, 20 bp, Artificial
  CRISPR gRNA sequence
agtagaaaccccaccacacc

SEQ ID NO: 39129 - DNA, 20 bp, Artificial
  CRISPR gRNA sequence
gtagaaaccccaccacacct

SEQ ID NO: 39130 - DNA, 20 bp, Artificial
  CRISPR gRNA sequence
tgggtctgccttccaaacca

SEQ ID NO: 39131 - DNA, 20 bp, Artificial
  CRISPR gRNA sequence
ccttccaaaccacagtccct

SEQ ID NO: 39132 - DNA, 20 bp, Artificial
  CRISPR gRNA sequence
cttccaaaccacagtccctc

SEQ ID NO: 39133 - DNA, 20 bp, Artificial
  CRISPR gRNA sequence
ttccaaaccacagtccctca

SEQ ID NO: 39134 - DNA, 20 bp, Artificial
  CRISPR gRNA sequence
cacccccttcatccttctcc

SEQ ID NO: 39135 - DNA, 20 bp, Artificial
  CRISPR gRNA sequence
cccccttcatccttctccca

SEQ ID NO: 39136 - DNA, 20 bp, Artificial
  CRISPR gRNA sequence
ccttcatccttctcccagag

SEQ ID NO: 39137 - DNA, 20 bp, Artificial
  CRISPR gRNA sequence
ttcatccttctcccagagta

SEQ ID NO: 39138 - DNA, 20 bp, Artificial
  CRISPR gRNA sequence
atccttctcccagagtagag

SEQ ID NO: 39139 - DNA, 20 bp, Artificial
  CRISPR gRNA sequence
tccttctcccagagtagagt

SEQ ID NO: 39140 - DNA, 20 bp, Artificial
  CRISPR gRNA sequence
gtgggataaccttctctttt

SEQ ID NO: 39141 - DNA, 20 bp, Artificial
  CRISPR gRNA sequence
tgggataaccttctcttttc

SEQ ID NO: 39142 - DNA, 20 bp, Artificial
  CRISPR gRNA sequence
ataaccttctcttttcggga

SEQ ID NO: 39143 - DNA, 20 bp, Artificial
  CRISPR gRNA sequence
aaccttctcttttcgggatg

SEQ ID NO: 39144 - DNA, 20 bp, Artificial
  CRISPR gRNA sequence
tcgggatggagaaattccca

SEQ ID NO: 39145 - DNA, 20 bp, Artificial
  CRISPR gRNA sequence
ggagaaattcccatggcgtc

SEQ ID NO: 39146 - DNA, 20 bp, Artificial
  CRISPR gRNA sequence
ttcccatggcgtccagcccc

SEQ ID NO: 39147 - DNA, 20 bp, Artificial
  CRISPR gRNA sequence
tggcgtccagcccctggctg

SEQ ID NO: 39148 - DNA, 20 bp, Artificial
  CRISPR gRNA sequence
agcccctggctgaagccaat

SEQ ID NO: 39149 - DNA, 20 bp, Artificial
  CRISPR gRNA sequence
cccctggctgaagccaataa

SEQ ID NO: 39150 - DNA, 20 bp, Artificial
  CRISPR gRNA sequence
ctggctgaagccaataagag

SEQ ID NO: 39151 - DNA, 20 bp, Artificial
  CRISPR gRNA sequence
aagccaataagagtagtgct

SEQ ID NO: 39152 - DNA, 20 bp, Artificial
  CRISPR gRNA sequence
agccaataagagtagtgctt

SEQ ID NO: 39153 - DNA, 20 bp, Artificial
  CRISPR gRNA sequence
gccaataagagtagtgcttg

SEQ ID NO: 39154 - DNA, 20 bp, Artificial
  CRISPR gRNA sequence
ataagagtagtgcttgggga

SEQ ID NO: 39155 - DNA, 20 bp, Artificial
  CRISPR gRNA sequence
gagtagtgcttggggatgga

SEQ ID NO: 39156 - DNA, 20 bp, Artificial
  CRISPR gRNA sequence
gtagtgcttggggatggacg

SEQ ID NO: 39157 - DNA, 20 bp, Artificial
  CRISPR gRNA sequence
tagtgcttggggatggacgg

SEQ ID NO: 39158 - DNA, 20 bp, Artificial
  CRISPR gRNA sequence
cggaggctctgtcacgaccc

SEQ ID NO: 39159 - DNA, 20 bp, Artificial
  CRISPR gRNA sequence
ggaggctctgtcacgaccct

SEQ ID NO: 39160 - DNA, 20 bp, Artificial
  CRISPR gRNA sequence
aggctctgtcacgaccctag

SEQ ID NO: 39161 - DNA, 20 bp, Artificial
  CRISPR gRNA sequence
ggctctgtcacgaccctagg

SEQ ID NO: 39162 - DNA, 20 bp, Artificial
  CRISPR gRNA sequence
gctctgtcacgaccctagga

SEQ ID NO: 39163 - DNA, 20 bp, Artificial
  CRISPR gRNA sequence
ctctgtcacgaccctaggag

SEQ ID NO: 39164 - DNA, 20 bp, Artificial
  CRISPR gRNA sequence
ccctaggaggggcgcccctc

SEQ ID NO: 39165 - DNA, 20 bp, Artificial
  CRISPR gRNA sequence
cctaggaggggcgcccctcc

SEQ ID NO: 39166 - DNA, 20 bp, Artificial
  CRISPR gRNA sequence
cgcccctccaggaaacctcc

SEQ ID NO: 39167 - DNA, 20 bp, Artificial
  CRISPR gRNA sequence
gaaacctccaagtgaacatg

SEQ ID NO: 39168 - DNA, 20 bp, Artificial
  CRISPR gRNA sequence
aaacctccaagtgaacatga

SEQ ID NO: 39169 - DNA, 20 bp, Artificial
  CRISPR gRNA sequence
cctccaagtgaacatgaagg

SEQ ID NO: 39170 - DNA, 20 bp, Artificial
  CRISPR gRNA sequence
gtgaacatgaaggcagatga

SEQ ID NO: 39171 - DNA, 20 bp, Artificial
  CRISPR gRNA sequence
gaaggcagatgatggaacgc

SEQ ID NO: 39172 - DNA, 20 bp, Artificial
  CRISPR gRNA sequence
aaggcagatgatggaacgcc

SEQ ID NO: 39173 - DNA, 20 bp, Artificial
  CRISPR gRNA sequence
tggaacgccaggatgtgttc

SEQ ID NO: 39174 - DNA, 20 bp, Artificial
  CRISPR gRNA sequence
ggaacgccaggatgtgttct

SEQ ID NO: 39175 - DNA, 20 bp, Artificial
  CRISPR gRNA sequence
gccaggatgtgttctgggtc

SEQ ID NO: 39176 - DNA, 20 bp, Artificial
  CRISPR gRNA sequence
aggatgtgttctgggtcgag

SEQ ID NO: 39177 - DNA, 20 bp, Artificial
  CRISPR gRNA sequence
tgggtcgagtggccccacct

SEQ ID NO: 39178 - DNA, 20 bp, Artificial
  CRISPR gRNA sequence
gggtcgagtggccccacctc

SEQ ID NO: 39179 - DNA, 20 bp, Artificial
  CRISPR gRNA sequence
ggtcgagtggccccacctca

SEQ ID NO: 39180 - DNA, 20 bp, Artificial
  CRISPR gRNA sequence
gagtggccccacctcagggt

SEQ ID NO: 39181 - DNA, 20 bp, Artificial
  CRISPR gRNA sequence
ggccccacctcagggtaaga

SEQ ID NO: 39182 - DNA, 20 bp, Artificial
  CRISPR gRNA sequence
ccacctcagggtaagacgga

SEQ ID NO: 39183 - DNA, 20 bp, Artificial
  CRISPR gRNA sequence
cacctcagggtaagacggat

SEQ ID NO: 39184 - DNA, 20 bp, Artificial
  CRISPR gRNA sequence
acctcagggtaagacggata

SEQ ID NO: 39185 - DNA, 20 bp, Artificial
  CRISPR gRNA sequence
cctcagggtaagacggatag

SEQ ID NO: 39186 - DNA, 20 bp, Artificial
  CRISPR gRNA sequence
agggtaagacggataggggt

SEQ ID NO: 39187 - DNA, 20 bp, Artificial
  CRISPR gRNA sequence
gggtaagacggataggggtg

SEQ ID NO: 39188 - DNA, 20 bp, Artificial
  CRISPR gRNA sequence
ggtaagacggataggggtga

SEQ ID NO: 39189 - DNA, 20 bp, Artificial
  CRISPR gRNA sequence
gataggggtgagggttgtcg

SEQ ID NO: 39190 - DNA, 20 bp, Artificial
  CRISPR gRNA sequence
tggtgatcacctcttgatcc

SEQ ID NO: 39191 - DNA, 20 bp, Artificial
  CRISPR gRNA sequence
gatcctggacctcgtcccat

SEQ ID NO: 39192 - DNA, 20 bp, Artificial
  CRISPR gRNA sequence
atcctggacctcgtcccatt

SEQ ID NO: 39193 - DNA, 20 bp, Artificial
  CRISPR gRNA sequence
cctggacctcgtcccattgg

SEQ ID NO: 39194 - DNA, 20 bp, Artificial
  CRISPR gRNA sequence
cctcgtcccattgggagaac

SEQ ID NO: 39195 - DNA, 20 bp, Artificial
  CRISPR gRNA sequence
ctcgtcccattgggagaacc

SEQ ID NO: 39196 - DNA, 20 bp, Artificial
  CRISPR gRNA sequence
tcccattgggagaaccagga

SEQ ID NO: 39197 - DNA, 20 bp, Artificial
  CRISPR gRNA sequence
tgggagaaccaggacagaat

SEQ ID NO: 39198 - DNA, 20 bp, Artificial
  CRISPR gRNA sequence
gagaaccaggacagaattag

SEQ ID NO: 39199 - DNA, 20 bp, Artificial
  CRISPR gRNA sequence
agaaccaggacagaattaga

SEQ ID NO: 39200 - DNA, 20 bp, Artificial
  CRISPR gRNA sequence
accaggacagaattagaagg

SEQ ID NO: 39201 - DNA, 20 bp, Artificial
  CRISPR gRNA sequence
ttagaaggtggttttttaac

SEQ ID NO: 39202 - DNA, 20 bp, Artificial
  CRISPR gRNA sequence
cacacttctacctgcctcac

SEQ ID NO: 39203 - DNA, 20 bp, Artificial
  CRISPR gRNA sequence
ctacctgcctcaccagcact

SEQ ID NO: 39204 - DNA, 20 bp, Artificial
  CRISPR gRNA sequence
cactgagcatgcccctcccc

SEQ ID NO: 39205 - DNA, 20 bp, Artificial
  CRISPR gRNA sequence
tccccgagtgccatcacctg

SEQ ID NO: 39206 - DNA, 20 bp, Artificial
  CRISPR gRNA sequence
ccgagtgccatcacctgcag

SEQ ID NO: 39207 - DNA, 20 bp, Artificial
  CRISPR gRNA sequence
agtgccatcacctgcagaag

SEQ ID NO: 39208 - DNA, 20 bp, Artificial
  CRISPR gRNA sequence
aagcagccccatcacccgcc

SEQ ID NO: 39209 - DNA, 20 bp, Artificial
  CRISPR gRNA sequence
ccatcacccgcctggttacg

SEQ ID NO: 39210 - DNA, 20 bp, Artificial
  CRISPR gRNA sequence
ctggttacgcagccacctcc

SEQ ID NO: 39211 - DNA, 20 bp, Artificial
  CRISPR gRNA sequence
ccttgcccttctcccacatt

SEQ ID NO: 39212 - DNA, 20 bp, Artificial
  CRISPR gRNA sequence
tctcccacatttagtccctc

SEQ ID NO: 39213 - DNA, 20 bp, Artificial
  CRISPR gRNA sequence
ccacatttagtccctccaga

SEQ ID NO: 39214 - DNA, 20 bp, Artificial
  CRISPR gRNA sequence
gtccctccagatggacctac

SEQ ID NO: 39215 - DNA, 20 bp, Artificial
  CRISPR gRNA sequence
cctccagatggacctactgg

SEQ ID NO: 39216 - DNA, 20 bp, Artificial
  CRISPR gRNA sequence
cctcttttcctccacctttc

SEQ ID NO: 39217 - DNA, 20 bp, Artificial
  CRISPR gRNA sequence
acccaccctcatctcttacc

SEQ ID NO: 39218 - DNA, 20 bp, Artificial
  CRISPR gRNA sequence
cctcgccttgccttccttgc

SEQ ID NO: 39219 - DNA, 20 bp, Artificial
  CRISPR gRNA sequence
tggcttccctgctttcaccc

SEQ ID NO: 39220 - DNA, 20 bp, Artificial
  CRISPR gRNA sequence
tcaccctggccacttccacc

SEQ ID NO: 39221 - DNA, 20 bp, Artificial
  CRISPR gRNA sequence
ccctggccacttccacctgg

SEQ ID NO: 39222 - DNA, 20 bp, Artificial
  CRISPR gRNA sequence
ctggccacttccacctggca

SEQ ID NO: 39223 - DNA, 20 bp, Artificial
  CRISPR gRNA sequence
ggccacttccacctggcaga

SEQ ID NO: 39224 - DNA, 20 bp, Artificial
  CRISPR gRNA sequence
cacttccacctggcagagag

SEQ ID NO: 39225 - DNA, 20 bp, Artificial
  CRISPR gRNA sequence
cttcactccttcccactgct

SEQ ID NO: 39226 - DNA, 20 bp, Artificial
  CRISPR gRNA sequence
ttcactccttcccactgctc

SEQ ID NO: 39227 - DNA, 20 bp, Artificial
  CRISPR gRNA sequence
aaacccacattctaaactcc

SEQ ID NO: 39228 - DNA, 20 bp, Artificial
  CRISPR gRNA sequence
aacccacattctaaactccc

SEQ ID NO: 39229 - DNA, 20 bp, Artificial
  CRISPR gRNA sequence
ccacattctaaactcccagg

SEQ ID NO: 39230 - DNA, 20 bp, Artificial
  CRISPR gRNA sequence
ttctaaactcccaggtggtc

SEQ ID NO: 39231 - DNA, 20 bp, Artificial
  CRISPR gRNA sequence
gtggtccagaaccctgcccc

SEQ ID NO: 39232 - DNA, 20 bp, Artificial
  CRISPR gRNA sequence
cttccactcaatctccaatc

SEQ ID NO: 39233 - DNA, 20 bp, Artificial
  CRISPR gRNA sequence
aatctccaatccagacacac

SEQ ID NO: 39234 - DNA, 20 bp, Artificial
  CRISPR gRNA sequence
cagacacactggctctcttt

SEQ ID NO: 39235 - DNA, 20 bp, Artificial
  CRISPR gRNA sequence
agacacactggctctctttc

SEQ ID NO: 39236 - DNA, 20 bp, Artificial
  CRISPR gRNA sequence
tcctcatatgtgttatgcca

SEQ ID NO: 39237 - DNA, 20 bp, Artificial
  CRISPR gRNA sequence
cctcatatgtgttatgccac

SEQ ID NO: 39238 - DNA, 20 bp, Artificial
  CRISPR gRNA sequence
ctcatatgtgttatgccaca

SEQ ID NO: 39239 - DNA, 20 bp, Artificial
  CRISPR gRNA sequence
gaatgtactgcttctaccac

SEQ ID NO: 39240 - DNA, 20 bp, Artificial
  CRISPR gRNA sequence
aatgtactgcttctaccacc

SEQ ID NO: 39241 - DNA, 20 bp, Artificial
  CRISPR gRNA sequence
ccttttacctactgaactcc

SEQ ID NO: 39242 - DNA, 20 bp, Artificial
  CRISPR gRNA sequence
tactgaactcccagttattt

SEQ ID NO: 39243 - DNA, 20 bp, Artificial
  CRISPR gRNA sequence
gaactcccagttatttcagc

SEQ ID NO: 39244 - DNA, 20 bp, Artificial
  CRISPR gRNA sequence
ctcccagttatttcagcaag

SEQ ID NO: 39245 - DNA, 20 bp, Artificial
  CRISPR gRNA sequence
gttatttcagcaagtagctt

SEQ ID NO: 39246 - DNA, 20 bp, Artificial
  CRISPR gRNA sequence
aagtagcttaagcaacaaat

SEQ ID NO: 39247 - DNA, 20 bp, Artificial
  CRISPR gRNA sequence
aataagccatccccgactcc

SEQ ID NO: 39248 - DNA, 20 bp, Artificial
  CRISPR gRNA sequence
gccatccccgactcccagac

SEQ ID NO: 39249 - DNA, 20 bp, Artificial
  CRISPR gRNA sequence
ccatccccgactcccagact

SEQ ID NO: 39250 - DNA, 20 bp, Artificial
  CRISPR gRNA sequence
ccccgactcccagactaggt

SEQ ID NO: 39251 - DNA, 20 bp, Artificial
  CRISPR gRNA sequence
cagatgcccccataatcatg

SEQ ID NO: 39252 - DNA, 20 bp, Artificial
  CRISPR gRNA sequence
atcatgaagtttatcacaaa

SEQ ID NO: 39253 - DNA, 20 bp, Artificial
  CRISPR gRNA sequence
aaaagcaattatgtaacttg

SEQ ID NO: 39254 - DNA, 20 bp, Artificial
  CRISPR gRNA sequence
attatgtaacttgcagcata

SEQ ID NO: 39255 - DNA, 20 bp, Artificial
  CRISPR gRNA sequence
ttatgtaacttgcagcataa

SEQ ID NO: 39256 - DNA, 20 bp, Artificial
  CRISPR gRNA sequence
tgtaacttgcagcataaagg

SEQ ID NO: 39257 - DNA, 20 bp, Artificial
  CRISPR gRNA sequence
taacttgcagcataaaggaa

SEQ ID NO: 39258 - DNA, 20 bp, Artificial
  CRISPR gRNA sequence
tgcagcataaaggaagagtt

SEQ ID NO: 39259 - DNA, 20 bp, Artificial
  CRISPR gRNA sequence
gcagcataaaggaagagttg

SEQ ID NO: 39260 - DNA, 20 bp, Artificial
  CRISPR gRNA sequence
cagcataaaggaagagttga

SEQ ID NO: 39261 - DNA, 20 bp, Artificial
  CRISPR gRNA sequence
cataaaggaagagttgaggg

SEQ ID NO: 39262 - DNA, 20 bp, Artificial
  CRISPR gRNA sequence
ataaaggaagagttgagggt

SEQ ID NO: 39263 - DNA, 20 bp, Artificial
  CRISPR gRNA sequence
taaaggaagagttgagggtg

SEQ ID NO: 39264 - DNA, 20 bp, Artificial
  CRISPR gRNA sequence
gagttgagggtggggccttg

SEQ ID NO: 39265 - DNA, 20 bp, Artificial
  CRISPR gRNA sequence
agttgagggtggggccttga

SEQ ID NO: 39266 - DNA, 20 bp, Artificial
  CRISPR gRNA sequence
tgagggtggggccttgaagg

SEQ ID NO: 39267 - DNA, 20 bp, Artificial
  CRISPR gRNA sequence
gagggtggggccttgaaggc

SEQ ID NO: 39268 - DNA, 20 bp, Artificial
  CRISPR gRNA sequence
ggccttgaaggcaggctgcc

SEQ ID NO: 39269 - DNA, 20 bp, Artificial
  CRISPR gRNA sequence
gccttgaaggcaggctgcct

SEQ ID NO: 39270 - DNA, 20 bp, Artificial
  CRISPR gRNA sequence
aggctgcctgggttcaaatc

SEQ ID NO: 39271 - DNA, 20 bp, Artificial
  CRISPR gRNA sequence
ggctgcctgggttcaaatcc

SEQ ID NO: 39272 - DNA, 20 bp, Artificial
  CRISPR gRNA sequence
tcaaatccaggttctccctc

SEQ ID NO: 39273 - DNA, 20 bp, Artificial
  CRISPR gRNA sequence
atccaggttctccctcgagc

SEQ ID NO: 39274 - DNA, 20 bp, Artificial
  CRISPR gRNA sequence
cacttaaccactctgcactt

SEQ ID NO: 39275 - DNA, 20 bp, Artificial
  CRISPR gRNA sequence
ctgcacttgagtttactcat

SEQ ID NO: 39276 - DNA, 20 bp, Artificial
  CRISPR gRNA sequence
acttgagtttactcatcagt

SEQ ID NO: 39277 - DNA, 20 bp, Artificial
  CRISPR gRNA sequence
cttgagtttactcatcagta

SEQ ID NO: 39278 - DNA, 20 bp, Artificial
  CRISPR gRNA sequence
agtttactcatcagtaaggt

SEQ ID NO: 39279 - DNA, 20 bp, Artificial
  CRISPR gRNA sequence
gtttactcatcagtaaggtg

SEQ ID NO: 39280 - DNA, 20 bp, Artificial
  CRISPR gRNA sequence
cagtaaggtgaggataatta

SEQ ID NO: 39281 - DNA, 20 bp, Artificial
  CRISPR gRNA sequence
aattacagtgcccacgtcat

SEQ ID NO: 39282 - DNA, 20 bp, Artificial
  CRISPR gRNA sequence
gcccacgtcatcggcactat

SEQ ID NO: 39283 - DNA, 20 bp, Artificial
  CRISPR gRNA sequence
cccacgtcatcggcactatg

SEQ ID NO: 39284 - DNA, 20 bp, Artificial
  CRISPR gRNA sequence
tcggcactatgaggatgaaa

SEQ ID NO: 39285 - DNA, 20 bp, Artificial
  CRISPR gRNA sequence
cggcactatgaggatgaaat

SEQ ID NO: 39286 - DNA, 20 bp, Artificial
  CRISPR gRNA sequence
atgaggatgaaataggccaa

SEQ ID NO: 39287 - DNA, 20 bp, Artificial
  CRISPR gRNA sequence
atgaaataggccaatagtca

SEQ ID NO: 39288 - DNA, 20 bp, Artificial
  CRISPR gRNA sequence
aaataggccaatagtcatag

SEQ ID NO: 39289 - DNA, 20 bp, Artificial
  CRISPR gRNA sequence
ccaatagtcatagaagaacc

SEQ ID NO: 39290 - DNA, 20 bp, Artificial
  CRISPR gRNA sequence
caatagtcatagaagaacct

SEQ ID NO: 39291 - DNA, 20 bp, Artificial
  CRISPR gRNA sequence
agaagaacctaggatgttgc

SEQ ID NO: 39292 - DNA, 20 bp, Artificial
  CRISPR gRNA sequence
gaagaacctaggatgttgcc

SEQ ID NO: 39293 - DNA, 20 bp, Artificial
  CRISPR gRNA sequence
ctaggatgttgccaggcatg

SEQ ID NO: 39294 - DNA, 20 bp, Artificial
  CRISPR gRNA sequence
atgttgccaggcatgtggta

SEQ ID NO: 39295 - DNA, 20 bp, Artificial
  CRISPR gRNA sequence
gttgccaggcatgtggtatg

SEQ ID NO: 39296 - DNA, 20 bp, Artificial
  CRISPR gRNA sequence
ggtatggagtctgtcgattt

SEQ ID NO: 39297 - DNA, 20 bp, Artificial
  CRISPR gRNA sequence
tgtcgatttcagttattatc

SEQ ID NO: 39298 - DNA, 20 bp, Artificial
  CRISPR gRNA sequence
gtcgatttcagttattatca

SEQ ID NO: 39299 - DNA, 20 bp, Artificial
  CRISPR gRNA sequence
tattatcaaggttcattcct

SEQ ID NO: 39300 - DNA, 20 bp, Artificial
  CRISPR gRNA sequence
ttatcaaggttcattcctga

SEQ ID NO: 39301 - DNA, 20 bp, Artificial
  CRISPR gRNA sequence
tgagagtgacactttgacta

SEQ ID NO: 39302 - DNA, 20 bp, Artificial
  CRISPR gRNA sequence
agtgacactttgactaaagt

SEQ ID NO: 39303 - DNA, 20 bp, Artificial
  CRISPR gRNA sequence
cactttgactaaagttagca

SEQ ID NO: 39304 - DNA, 20 bp, Artificial
  CRISPR gRNA sequence
actttgactaaagttagcaa

SEQ ID NO: 39305 - DNA, 20 bp, Artificial
  CRISPR gRNA sequence
tttgactaaagttagcaaag

SEQ ID NO: 39306 - DNA, 20 bp, Artificial
  CRISPR gRNA sequence
ttgactaaagttagcaaagg

SEQ ID NO: 39307 - DNA, 20 bp, Artificial
  CRISPR gRNA sequence
gactaaagttagcaaaggag

SEQ ID NO: 39308 - DNA, 20 bp, Artificial
  CRISPR gRNA sequence
aaagttagcaaaggaggagt

SEQ ID NO: 39309 - DNA, 20 bp, Artificial
  CRISPR gRNA sequence
agcaaaggaggagtaagtga

SEQ ID NO: 39310 - DNA, 20 bp, Artificial
  CRISPR gRNA sequence
gcaaaggaggagtaagtgat

SEQ ID NO: 39311 - DNA, 20 bp, Artificial
  CRISPR gRNA sequence
caaaggaggagtaagtgatg

SEQ ID NO: 39312 - DNA, 20 bp, Artificial
  CRISPR gRNA sequence
aggagtaagtgatggggatt

SEQ ID NO: 39313 - DNA, 20 bp, Artificial
  CRISPR gRNA sequence
ggagtaagtgatggggattg

SEQ ID NO: 39314 - DNA, 20 bp, Artificial
  CRISPR gRNA sequence
gagtaagtgatggggattga

SEQ ID NO: 39315 - DNA, 20 bp, Artificial
  CRISPR gRNA sequence
gtaagtgatggggattgagg

SEQ ID NO: 39316 - DNA, 20 bp, Artificial
  CRISPR gRNA sequence
taagtgatggggattgaggg

SEQ ID NO: 39317 - DNA, 20 bp, Artificial
  CRISPR gRNA sequence
tggggattgagggaggactc

SEQ ID NO: 39318 - DNA, 20 bp, Artificial
  CRISPR gRNA sequence
aggactccagccccacaata

SEQ ID NO: 39319 - DNA, 20 bp, Artificial
  CRISPR gRNA sequence
agccccacaatacagtgcat

SEQ ID NO: 39320 - DNA, 20 bp, Artificial
  CRISPR gRNA sequence
gccccacaatacagtgcatt

SEQ ID NO: 39321 - DNA, 20 bp, Artificial
  CRISPR gRNA sequence
gtgcattgggccccccgtct

SEQ ID NO: 39322 - DNA, 20 bp, Artificial
  CRISPR gRNA sequence
ggccccccgtctcagcctct

SEQ ID NO: 39323 - DNA, 20 bp, Artificial
  CRISPR gRNA sequence
gccccccgtctcagcctctc

SEQ ID NO: 39324 - DNA, 20 bp, Artificial
  CRISPR gRNA sequence
ccccccgtctcagcctctca

SEQ ID NO: 39325 - DNA, 20 bp, Artificial
  CRISPR gRNA sequence
gtctcagcctctcagggaac

SEQ ID NO: 39326 - DNA, 20 bp, Artificial
  CRISPR gRNA sequence
cagcctctcagggaaccagc

SEQ ID NO: 39327 - DNA, 20 bp, Artificial
  CRISPR gRNA sequence
cctctcagggaaccagctgg

SEQ ID NO: 39328 - DNA, 20 bp, Artificial
  CRISPR gRNA sequence
agggaaccagctggaagatg

SEQ ID NO: 39329 - DNA, 20 bp, Artificial
  CRISPR gRNA sequence
gggaaccagctggaagatga

SEQ ID NO: 39330 - DNA, 20 bp, Artificial
  CRISPR gRNA sequence
agctggaagatgaaggctgt

SEQ ID NO: 39331 - DNA, 20 bp, Artificial
  CRISPR gRNA sequence
agatgaaggctgtcggctga

SEQ ID NO: 39332 - DNA, 20 bp, Artificial
  CRISPR gRNA sequence
tgaaggctgtcggctgatgg

SEQ ID NO: 39333 - DNA, 20 bp, Artificial
  CRISPR gRNA sequence
aaggctgtcggctgatggca

SEQ ID NO: 39334 - DNA, 20 bp, Artificial
  CRISPR gRNA sequence
aggctgtcggctgatggcag

SEQ ID NO: 39335 - DNA, 20 bp, Artificial
  CRISPR gRNA sequence
tgatggcagaggctgcatcc

SEQ ID NO: 39336 - DNA, 20 bp, Artificial
  CRISPR gRNA sequence
gcatcccagctgcacatcgc

SEQ ID NO: 39337 - DNA, 20 bp, Artificial
  CRISPR gRNA sequence
catcccagctgcacatcgcc

SEQ ID NO: 39338 - DNA, 20 bp, Artificial
  CRISPR gRNA sequence
cccagctgcacatcgccagg

SEQ ID NO: 39339 - DNA, 20 bp, Artificial
  CRISPR gRNA sequence
gctgcacatcgccaggaagc

SEQ ID NO: 39340 - DNA, 20 bp, Artificial
  CRISPR gRNA sequence
tgcacatcgccaggaagctg

SEQ ID NO: 39341 - DNA, 20 bp, Artificial
  CRISPR gRNA sequence
catcgccaggaagctggagt

SEQ ID NO: 39342 - DNA, 20 bp, Artificial
  CRISPR gRNA sequence
tgagttgtccaccccaccgc

SEQ ID NO: 39343 - DNA, 20 bp, Artificial
  CRISPR gRNA sequence
gagttgtccaccccaccgct

SEQ ID NO: 39344 - DNA, 20 bp, Artificial
  CRISPR gRNA sequence
tccaccccaccgctgggtac

SEQ ID NO: 39345 - DNA, 20 bp, Artificial
  CRISPR gRNA sequence
ccaccccaccgctgggtacc

SEQ ID NO: 39346 - DNA, 20 bp, Artificial
  CRISPR gRNA sequence
caccccaccgctgggtacca

SEQ ID NO: 39347 - DNA, 20 bp, Artificial
  CRISPR gRNA sequence
cccaccgctgggtaccaggg

SEQ ID NO: 39348 - DNA, 20 bp, Artificial
  CRISPR gRNA sequence
ccaccgctgggtaccaggga

SEQ ID NO: 39349 - DNA, 20 bp, Artificial
  CRISPR gRNA sequence
gggtaccagggaaggccctg

SEQ ID NO: 39350 - DNA, 20 bp, Artificial
  CRISPR gRNA sequence
gtaccagggaaggccctgta

SEQ ID NO: 39351 - DNA, 20 bp, Artificial
  CRISPR gRNA sequence
gggaaggccctgtagagccc

SEQ ID NO: 39352 - DNA, 20 bp, Artificial
  CRISPR gRNA sequence
ggaaggccctgtagagcccc

SEQ ID NO: 39353 - DNA, 20 bp, Artificial
  CRISPR gRNA sequence
aaggccctgtagagccccag

SEQ ID NO: 39354 - DNA, 20 bp, Artificial
  CRISPR gRNA sequence
aggccctgtagagccccagg

SEQ ID NO: 39355 - DNA, 20 bp, Artificial
  CRISPR gRNA sequence
gaggtccccgtgttcgtaat

SEQ ID NO: 39356 - DNA, 20 bp, Artificial
  CRISPR gRNA sequence
gtccccgtgttcgtaatcag

SEQ ID NO: 39357 - DNA, 20 bp, Artificial
  CRISPR gRNA sequence
ccgtgttcgtaatcagcagt

SEQ ID NO: 39358 - DNA, 20 bp, Artificial
  CRISPR gRNA sequence
cgtgttcgtaatcagcagta

SEQ ID NO: 39359 - DNA, 20 bp, Artificial
  CRISPR gRNA sequence
gtgttcgtaatcagcagtaa

SEQ ID NO: 39360 - DNA, 20 bp, Artificial
  CRISPR gRNA sequence
cccctgcttcctcccaactc

SEQ ID NO: 39361 - DNA, 20 bp, Artificial
  CRISPR gRNA sequence
gcttcctcccaactccagca

SEQ ID NO: 39362 - DNA, 20 bp, Artificial
  CRISPR gRNA sequence
ctcccaactccagcaaagtc

SEQ ID NO: 39363 - DNA, 20 bp, Artificial
  CRISPR gRNA sequence
caactccagcaaagtcaaga

SEQ ID NO: 39364 - DNA, 20 bp, Artificial
  CRISPR gRNA sequence
ccatgccttgccttcacctc

SEQ ID NO: 39365 - DNA, 20 bp, Artificial
  CRISPR gRNA sequence
cttgccttcacctccggcat

SEQ ID NO: 39366 - DNA, 20 bp, Artificial
  CRISPR gRNA sequence
tccggcatgagccactgtct

SEQ ID NO: 39367 - DNA, 20 bp, Artificial
  CRISPR gRNA sequence
actgtcttagtccaatcatc

SEQ ID NO: 39368 - DNA, 20 bp, Artificial
  CRISPR gRNA sequence
aaaatgcgttcattatacat

SEQ ID NO: 39369 - DNA, 20 bp, Artificial
  CRISPR gRNA sequence
atgcgttcattatacatcag

SEQ ID NO: 39370 - DNA, 20 bp, Artificial
  CRISPR gRNA sequence
tgcattccaattcatctttg

SEQ ID NO: 39371 - DNA, 20 bp, Artificial
  CRISPR gRNA sequence
attcatctttgtagctgccc

SEQ ID NO: 39372 - DNA, 20 bp, Artificial
  CRISPR gRNA sequence
tcatctttgtagctgccctg

SEQ ID NO: 39373 - DNA, 20 bp, Artificial
  CRISPR gRNA sequence
tttgtagctgccctggagca

SEQ ID NO: 39374 - DNA, 20 bp, Artificial
  CRISPR gRNA sequence
gtagctgccctggagcacgg

SEQ ID NO: 39375 - DNA, 20 bp, Artificial
  CRISPR gRNA sequence
tagctgccctggagcacggt

SEQ ID NO: 39376 - DNA, 20 bp, Artificial
  CRISPR gRNA sequence
agctgccctggagcacggtg

SEQ ID NO: 39377 - DNA, 20 bp, Artificial
  CRISPR gRNA sequence
tgccctggagcacggtgggg

SEQ ID NO: 39378 - DNA, 20 bp, Artificial
  CRISPR gRNA sequence
gccctggagcacggtggggt

SEQ ID NO: 39379 - DNA, 20 bp, Artificial
  CRISPR gRNA sequence
ccctggagcacggtggggtg

SEQ ID NO: 39380 - DNA, 20 bp, Artificial
  CRISPR gRNA sequence
ggtggggtggggtgttgcac

SEQ ID NO: 39381 - DNA, 20 bp, Artificial
  CRISPR gRNA sequence
gtggggtggggtgttgcact

SEQ ID NO: 39382 - DNA, 20 bp, Artificial
  CRISPR gRNA sequence
tggggtggggtgttgcactg

SEQ ID NO: 39383 - DNA, 20 bp, Artificial
  CRISPR gRNA sequence
gggtggggtgttgcactggg

SEQ ID NO: 39384 - DNA, 20 bp, Artificial
  CRISPR gRNA sequence
ggtggggtgttgcactgggg

SEQ ID NO: 39385 - DNA, 20 bp, Artificial
  CRISPR gRNA sequence
gtgttgcactggggaggtgt

SEQ ID NO: 39386 - DNA, 20 bp, Artificial
  CRISPR gRNA sequence
tgttgcactggggaggtgtc

SEQ ID NO: 39387 - DNA, 20 bp, Artificial
  CRISPR gRNA sequence
gttgcactggggaggtgtca

SEQ ID NO: 39388 - DNA, 20 bp, Artificial
  CRISPR gRNA sequence
gcactggggaggtgtcaggg

SEQ ID NO: 39389 - DNA, 20 bp, Artificial
  CRISPR gRNA sequence
cactggggaggtgtcagggt

SEQ ID NO: 39390 - DNA, 20 bp, Artificial
  CRISPR gRNA sequence
tggggaggtgtcagggtggg

SEQ ID NO: 39391 - DNA, 20 bp, Artificial
  CRISPR gRNA sequence
ggggaggtgtcagggtgggt

SEQ ID NO: 39392 - DNA, 20 bp, Artificial
  CRISPR gRNA sequence
gtgggtgggatgttgcactg

SEQ ID NO: 39393 - DNA, 20 bp, Artificial
  CRISPR gRNA sequence
gggtgggatgttgcactgtg

SEQ ID NO: 39394 - DNA, 20 bp, Artificial
  CRISPR gRNA sequence
ggtgggatgttgcactgtgg

SEQ ID NO: 39395 - DNA, 20 bp, Artificial
  CRISPR gRNA sequence
gcactgtggaggtgtcatgc

SEQ ID NO: 39396 - DNA, 20 bp, Artificial
  CRISPR gRNA sequence
cactgtggaggtgtcatgct

SEQ ID NO: 39397 - DNA, 20 bp, Artificial
  CRISPR gRNA sequence
actgtggaggtgtcatgctg

SEQ ID NO: 39398 - DNA, 20 bp, Artificial
  CRISPR gRNA sequence
gaggtgtcatgctggggtgc

SEQ ID NO: 39399 - DNA, 20 bp, Artificial
  CRISPR gRNA sequence
aggtgtcatgctggggtgct

SEQ ID NO: 39400 - DNA, 20 bp, Artificial
  CRISPR gRNA sequence
ggtgtcatgctggggtgcta

SEQ ID NO: 39401 - DNA, 20 bp, Artificial
  CRISPR gRNA sequence
gtcatgctggggtgctaggg

SEQ ID NO: 39402 - DNA, 20 bp, Artificial
  CRISPR gRNA sequence
tcatgctggggtgctagggt

SEQ ID NO: 39403 - DNA, 20 bp, Artificial
  CRISPR gRNA sequence
catgctggggtgctagggta

SEQ ID NO: 39404 - DNA, 20 bp, Artificial
  CRISPR gRNA sequence
tgctggggtgctagggtagg

SEQ ID NO: 39405 - DNA, 20 bp, Artificial
  CRISPR gRNA sequence
tggggtgctagggtagggag

SEQ ID NO: 39406 - DNA, 20 bp, Artificial
  CRISPR gRNA sequence
tagggagtggtgtgttcctg

SEQ ID NO: 39407 - DNA, 20 bp, Artificial
  CRISPR gRNA sequence
agggagtggtgtgttcctgt

SEQ ID NO: 39408 - DNA, 20 bp, Artificial
  CRISPR gRNA sequence
gggagtggtgtgttcctgtg

SEQ ID NO: 39409 - DNA, 20 bp, Artificial
  CRISPR gRNA sequence
ttcctgtggggatacactgt

SEQ ID NO: 39410 - DNA, 20 bp, Artificial
  CRISPR gRNA sequence
tcctgtggggatacactgtt

SEQ ID NO: 39411 - DNA, 20 bp, Artificial
  CRISPR gRNA sequence
cctgtggggatacactgttg

SEQ ID NO: 39412 - DNA, 20 bp, Artificial
  CRISPR gRNA sequence
tggggatacactgttggggt

SEQ ID NO: 39413 - DNA, 20 bp, Artificial
  CRISPR gRNA sequence
ggggatacactgttggggtg

SEQ ID NO: 39414 - DNA, 20 bp, Artificial
  CRISPR gRNA sequence
gggatacactgttggggtga

SEQ ID NO: 39415 - DNA, 20 bp, Artificial
  CRISPR gRNA sequence
ggatacactgttggggtgag

SEQ ID NO: 39416 - DNA, 20 bp, Artificial
  CRISPR gRNA sequence
tacactgttggggtgagggg

SEQ ID NO: 39417 - DNA, 20 bp, Artificial
  CRISPR gRNA sequence
ctgttggggtgaggggtggt

SEQ ID NO: 39418 - DNA, 20 bp, Artificial
  CRISPR gRNA sequence
tggggtgaggggtggtgaga

SEQ ID NO: 39419 - DNA, 20 bp, Artificial
  CRISPR gRNA sequence
gtgaggggtggtgagatgga

SEQ ID NO: 39420 - DNA, 20 bp, Artificial
  CRISPR gRNA sequence
tgaggggtggtgagatggaa

SEQ ID NO: 39421 - DNA, 20 bp, Artificial
  CRISPR gRNA sequence
ggggtggtgagatggaaagg

SEQ ID NO: 39422 - DNA, 20 bp, Artificial
  CRISPR gRNA sequence
gggtggtgagatggaaaggt

SEQ ID NO: 39423 - DNA, 20 bp, Artificial
  CRISPR gRNA sequence
gagatggaaaggtaggctat

SEQ ID NO: 39424 - DNA, 20 bp, Artificial
  CRISPR gRNA sequence
agatggaaaggtaggctatt

SEQ ID NO: 39425 - DNA, 20 bp, Artificial
  CRISPR gRNA sequence
aaggtaggctattaggctgc

SEQ ID NO: 39426 - DNA, 20 bp, Artificial
  CRISPR gRNA sequence
aggtaggctattaggctgct

SEQ ID NO: 39427 - DNA, 20 bp, Artificial
  CRISPR gRNA sequence
ttaggctgctgggtgtgctg

SEQ ID NO: 39428 - DNA, 20 bp, Artificial
  CRISPR gRNA sequence
gggtgtgctgtggtgttgca

SEQ ID NO: 39429 - DNA, 20 bp, Artificial
  CRISPR gRNA sequence
ggtgtgctgtggtgttgcat

SEQ ID NO: 39430 - DNA, 20 bp, Artificial
  CRISPR gRNA sequence
gtgtgctgtggtgttgcatg

SEQ ID NO: 39431 - DNA, 20 bp, Artificial
  CRISPR gRNA sequence
gctgtggtgttgcatggggt

SEQ ID NO: 39432 - DNA, 20 bp, Artificial
  CRISPR gRNA sequence
ctgtggtgttgcatggggtg

SEQ ID NO: 39433 - DNA, 20 bp, Artificial
  CRISPR gRNA sequence
tgtggtgttgcatggggtga

SEQ ID NO: 39434 - DNA, 20 bp, Artificial
  CRISPR gRNA sequence
catggggtgagggtgatgtt

SEQ ID NO: 39435 - DNA, 20 bp, Artificial
  CRISPR gRNA sequence
atggggtgagggtgatgttt

SEQ ID NO: 39436 - DNA, 20 bp, Artificial
  CRISPR gRNA sequence
gggtgagggtgatgtttggg

SEQ ID NO: 39437 - DNA, 20 bp, Artificial
  CRISPR gRNA sequence
ggtgagggtgatgtttgggt

SEQ ID NO: 39438 - DNA, 20 bp, Artificial
  CRISPR gRNA sequence
gtgagggtgatgtttgggtg

SEQ ID NO: 39439 - DNA, 20 bp, Artificial
  CRISPR gRNA sequence
tgagggtgatgtttgggtgg

SEQ ID NO: 39440 - DNA, 20 bp, Artificial
  CRISPR gRNA sequence
atgtttgggtgggggtgtct

SEQ ID NO: 39441 - DNA, 20 bp, Artificial
  CRISPR gRNA sequence
tgtttgggtgggggtgtctt

SEQ ID NO: 39442 - DNA, 20 bp, Artificial
  CRISPR gRNA sequence
gtttgggtgggggtgtcttg

SEQ ID NO: 39443 - DNA, 20 bp, Artificial
  CRISPR gRNA sequence
tttgggtgggggtgtcttgg

SEQ ID NO: 39444 - DNA, 20 bp, Artificial
  CRISPR gRNA sequence
tgggggtgtcttgggggtct

SEQ ID NO: 39445 - DNA, 20 bp, Artificial
  CRISPR gRNA sequence
gggggtgtcttgggggtctt

SEQ ID NO: 39446 - DNA, 20 bp, Artificial
  CRISPR gRNA sequence
gtcttgggggtcttaggatc

SEQ ID NO: 39447 - DNA, 20 bp, Artificial
  CRISPR gRNA sequence
gggggtcttaggatcaagtg

SEQ ID NO: 39448 - DNA, 20 bp, Artificial
  CRISPR gRNA sequence
ggggtcttaggatcaagtgt

SEQ ID NO: 39449 - DNA, 20 bp, Artificial
  CRISPR gRNA sequence
tcttaggatcaagtgtgggt

SEQ ID NO: 39450 - DNA, 20 bp, Artificial
  CRISPR gRNA sequence
cttaggatcaagtgtgggtc

SEQ ID NO: 39451 - DNA, 20 bp, Artificial
  CRISPR gRNA sequence
gatcaagtgtgggtcgggtt

SEQ ID NO: 39452 - DNA, 20 bp, Artificial
  CRISPR gRNA sequence
atcaagtgtgggtcgggttt

SEQ ID NO: 39453 - DNA, 20 bp, Artificial
  CRISPR gRNA sequence
tcaagtgtgggtcgggtttg

SEQ ID NO: 39454 - DNA, 20 bp, Artificial
  CRISPR gRNA sequence
aagtgtgggtcgggtttggg

SEQ ID NO: 39455 - DNA, 20 bp, Artificial
  CRISPR gRNA sequence
ggtcgggtttggggagtgtt

SEQ ID NO: 39456 - DNA, 20 bp, Artificial
  CRISPR gRNA sequence
ggtttggggagtgttgagat

SEQ ID NO: 39457 - DNA, 20 bp, Artificial
  CRISPR gRNA sequence
gtttggggagtgttgagatt

SEQ ID NO: 39458 - DNA, 20 bp, Artificial
  CRISPR gRNA sequence
tggggagtgttgagattggg

SEQ ID NO: 39459 - DNA, 20 bp, Artificial
  CRISPR gRNA sequence
ggagtgttgagattgggtag

SEQ ID NO: 39460 - DNA, 20 bp, Artificial
  CRISPR gRNA sequence
gtgttgagattgggtagcag

SEQ ID NO: 39461 - DNA, 20 bp, Artificial
  CRISPR gRNA sequence
gagattgggtagcagtggtt

SEQ ID NO: 39462 - DNA, 20 bp, Artificial
  CRISPR gRNA sequence
agattgggtagcagtggttt

SEQ ID NO: 39463 - DNA, 20 bp, Artificial
  CRISPR gRNA sequence
gattgggtagcagtggtttg

SEQ ID NO: 39464 - DNA, 20 bp, Artificial
  CRISPR gRNA sequence
gtagcagtggtttggggcct

SEQ ID NO: 39465 - DNA, 20 bp, Artificial
  CRISPR gRNA sequence
gtggtttggggcctcagctt

SEQ ID NO: 39466 - DNA, 20 bp, Artificial
  CRISPR gRNA sequence
tcaatcttcgctctgtcact

SEQ ID NO: 39467 - DNA, 20 bp, Artificial
  CRISPR gRNA sequence
atcttcgctctgtcacttag

SEQ ID NO: 39468 - DNA, 20 bp, Artificial
  CRISPR gRNA sequence
acttagtagcattgtgaacc

SEQ ID NO: 39469 - DNA, 20 bp, Artificial
  CRISPR gRNA sequence
cttagtagcattgtgaacct

SEQ ID NO: 39470 - DNA, 20 bp, Artificial
  CRISPR gRNA sequence
gtagcattgtgaacctggga

SEQ ID NO: 39471 - DNA, 20 bp, Artificial
  CRISPR gRNA sequence
ggaaagtaattgaatgtctc

SEQ ID NO: 39472 - DNA, 20 bp, Artificial
  CRISPR gRNA sequence
gaaagtaattgaatgtctct

SEQ ID NO: 39473 - DNA, 20 bp, Artificial
  CRISPR gRNA sequence
aattgaatgtctctgggcct

SEQ ID NO: 39474 - DNA, 20 bp, Artificial
  CRISPR gRNA sequence
tcggtttcccctctgtaaaa

SEQ ID NO: 39475 - DNA, 20 bp, Artificial
  CRISPR gRNA sequence
cggtttcccctctgtaaaat

SEQ ID NO: 39476 - DNA, 20 bp, Artificial
  CRISPR gRNA sequence
catgaaaccatatatgtaca

SEQ ID NO: 39477 - DNA, 20 bp, Artificial
  CRISPR gRNA sequence
tatgtacaaagccttttgta

SEQ ID NO: 39478 - DNA, 20 bp, Artificial
  CRISPR gRNA sequence
tgtacaaagccttttgtaca

SEQ ID NO: 39479 - DNA, 20 bp, Artificial
  CRISPR gRNA sequence
aaagccttttgtacagagtc

SEQ ID NO: 39480 - DNA, 20 bp, Artificial
  CRISPR gRNA sequence
cttttgtacagagtctggta

SEQ ID NO: 39481 - DNA, 20 bp, Artificial
  CRISPR gRNA sequence
tgtacagagtctggtatagt

SEQ ID NO: 39482 - DNA, 20 bp, Artificial
  CRISPR gRNA sequence
gtacagagtctggtatagtc

SEQ ID NO: 39483 - DNA, 20 bp, Artificial
  CRISPR gRNA sequence
tacagagtctggtatagtca

SEQ ID NO: 39484 - DNA, 20 bp, Artificial
  CRISPR gRNA sequence
agtctggtatagtcagggct

SEQ ID NO: 39485 - DNA, 20 bp, Artificial
  CRISPR gRNA sequence
tatagtcagggctcagaaaa

SEQ ID NO: 39486 - DNA, 20 bp, Artificial
  CRISPR gRNA sequence
agtcagggctcagaaaatgg

SEQ ID NO: 39487 - DNA, 20 bp, Artificial
  CRISPR gRNA sequence
agaaaatggtggttatttta

SEQ ID NO: 39488 - DNA, 20 bp, Artificial
  CRISPR gRNA sequence
atggtggttattttacagat

SEQ ID NO: 39489 - DNA, 20 bp, Artificial
  CRISPR gRNA sequence
tattttacagatgagaaaac

SEQ ID NO: 39490 - DNA, 20 bp, Artificial
  CRISPR gRNA sequence
attttacagatgagaaaact

SEQ ID NO: 39491 - DNA, 20 bp, Artificial
  CRISPR gRNA sequence
ttttacagatgagaaaactg

SEQ ID NO: 39492 - DNA, 20 bp, Artificial
  CRISPR gRNA sequence
tttacagatgagaaaactgg

SEQ ID NO: 39493 - DNA, 20 bp, Artificial
  CRISPR gRNA sequence
cagatgagaaaactgggggt

SEQ ID NO: 39494 - DNA, 20 bp, Artificial
  CRISPR gRNA sequence
gatgagaaaactgggggtca

SEQ ID NO: 39495 - DNA, 20 bp, Artificial
  CRISPR gRNA sequence
tgagaaaactgggggtcaga

SEQ ID NO: 39496 - DNA, 20 bp, Artificial
  CRISPR gRNA sequence
gagaaaactgggggtcagag

SEQ ID NO: 39497 - DNA, 20 bp, Artificial
  CRISPR gRNA sequence
gtcagagaggtgaaaacact

SEQ ID NO: 39498 - DNA, 20 bp, Artificial
  CRISPR gRNA sequence
aacactgagttcttgctgtc

SEQ ID NO: 39499 - DNA, 20 bp, Artificial
  CRISPR gRNA sequence
ctgagttcttgctgtcaagc

SEQ ID NO: 39500 - DNA, 20 bp, Artificial
  CRISPR gRNA sequence
ggacaactttattttccaaa

SEQ ID NO: 39501 - DNA, 20 bp, Artificial
  CRISPR gRNA sequence
gacaactttattttccaaat

SEQ ID NO: 39502 - DNA, 20 bp, Artificial
  CRISPR gRNA sequence
actttattttccaaatggga

SEQ ID NO: 39503 - DNA, 20 bp, Artificial
  CRISPR gRNA sequence
ctttattttccaaatgggat

SEQ ID NO: 39504 - DNA, 20 bp, Artificial
  CRISPR gRNA sequence
tttattttccaaatgggatg

SEQ ID NO: 39505 - DNA, 20 bp, Artificial
  CRISPR gRNA sequence
ttattttccaaatgggatgg

SEQ ID NO: 39506 - DNA, 20 bp, Artificial
  CRISPR gRNA sequence
tgggggtgtcatgcattttt

SEQ ID NO: 39507 - DNA, 20 bp, Artificial
  CRISPR gRNA sequence
tttggcttactcacacgcac

SEQ ID NO: 39508 - DNA, 20 bp, Artificial
  CRISPR gRNA sequence
cacacgcaccagaatccttt

SEQ ID NO: 39509 - DNA, 20 bp, Artificial
  CRISPR gRNA sequence
cagaatcctttgagatcccc

SEQ ID NO: 39510 - DNA, 20 bp, Artificial
  CRISPR gRNA sequence
atcctttgagatcccctggc

SEQ ID NO: 39511 - DNA, 20 bp, Artificial
  CRISPR gRNA sequence
tcctttgagatcccctggca

SEQ ID NO: 39512 - DNA, 20 bp, Artificial
  CRISPR gRNA sequence
cctttgagatcccctggcaa

SEQ ID NO: 39513 - DNA, 20 bp, Artificial
  CRISPR gRNA sequence
agatcccctggcaagggacc

SEQ ID NO: 39514 - DNA, 20 bp, Artificial
  CRISPR gRNA sequence
gatcccctggcaagggacct

SEQ ID NO: 39515 - DNA, 20 bp, Artificial
  CRISPR gRNA sequence
ggcaagggacctaggacatc

SEQ ID NO: 39516 - DNA, 20 bp, Artificial
  CRISPR gRNA sequence
gcaagggacctaggacatcc

SEQ ID NO: 39517 - DNA, 20 bp, Artificial
  CRISPR gRNA sequence
aagggacctaggacatccag

SEQ ID NO: 39518 - DNA, 20 bp, Artificial
  CRISPR gRNA sequence
cctaggacatccaggagtga

SEQ ID NO: 39519 - DNA, 20 bp, Artificial
  CRISPR gRNA sequence
ggacatccaggagtgacagc

SEQ ID NO: 39520 - DNA, 20 bp, Artificial
  CRISPR gRNA sequence
atccaggagtgacagccagc

SEQ ID NO: 39521 - DNA, 20 bp, Artificial
  CRISPR gRNA sequence
gtgacagccagcaagctgct

SEQ ID NO: 39522 - DNA, 20 bp, Artificial
  CRISPR gRNA sequence
gccagcaagctgctgagcca

SEQ ID NO: 39523 - DNA, 20 bp, Artificial
  CRISPR gRNA sequence
ccagcaagctgctgagccac

SEQ ID NO: 39524 - DNA, 20 bp, Artificial
  CRISPR gRNA sequence
cagcaagctgctgagccaca

SEQ ID NO: 39525 - DNA, 20 bp, Artificial
  CRISPR gRNA sequence
gcaagctgctgagccacagg

SEQ ID NO: 39526 - DNA, 20 bp, Artificial
  CRISPR gRNA sequence
caagctgctgagccacaggg

SEQ ID NO: 39527 - DNA, 20 bp, Artificial
  CRISPR gRNA sequence
aagctgctgagccacaggga

SEQ ID NO: 39528 - DNA, 20 bp, Artificial
  CRISPR gRNA sequence
agctgctgagccacagggag

SEQ ID NO: 39529 - DNA, 20 bp, Artificial
  CRISPR gRNA sequence
gctgagccacagggaggggc

SEQ ID NO: 39530 - DNA, 20 bp, Artificial
  CRISPR gRNA sequence
tgagccacagggaggggcta

SEQ ID NO: 39531 - DNA, 20 bp, Artificial
  CRISPR gRNA sequence
ccacagggaggggctagagc

SEQ ID NO: 39532 - DNA, 20 bp, Artificial
  CRISPR gRNA sequence
agggaggggctagagctggc

SEQ ID NO: 39533 - DNA, 20 bp, Artificial
  CRISPR gRNA sequence
gggaggggctagagctggct

SEQ ID NO: 39534 - DNA, 20 bp, Artificial
  CRISPR gRNA sequence
ggaggggctagagctggctg

SEQ ID NO: 39535 - DNA, 20 bp, Artificial
  CRISPR gRNA sequence
gggctagagctggctggggc

SEQ ID NO: 39536 - DNA, 20 bp, Artificial
  CRISPR gRNA sequence
ggctagagctggctggggct

SEQ ID NO: 39537 - DNA, 20 bp, Artificial
  CRISPR gRNA sequence
ctggctggggctgggtacct

SEQ ID NO: 39538 - DNA, 20 bp, Artificial
  CRISPR gRNA sequence
gtacctcagccacatgccaa

SEQ ID NO: 39539 - DNA, 20 bp, Artificial
  CRISPR gRNA sequence
ctgccttctcctgctctcca

SEQ ID NO: 39540 - DNA, 20 bp, Artificial
  CRISPR gRNA sequence
tctcctgctctccacagcct

SEQ ID NO: 39541 - DNA, 20 bp, Artificial
  CRISPR gRNA sequence
ctccacagcctcagtaacaa

SEQ ID NO: 39542 - DNA, 20 bp, Artificial
  CRISPR gRNA sequence
tccacagcctcagtaacaac

SEQ ID NO: 39543 - DNA, 20 bp, Artificial
  CRISPR gRNA sequence
cagtaacaacgggctttctg

SEQ ID NO: 39544 - DNA, 20 bp, Artificial
  CRISPR gRNA sequence
aacaacgggctttctgtggc

SEQ ID NO: 39545 - DNA, 20 bp, Artificial
  CRISPR gRNA sequence
acaacgggctttctgtggcc

SEQ ID NO: 39546 - DNA, 20 bp, Artificial
  CRISPR gRNA sequence
caacgggctttctgtggccg

SEQ ID NO: 39547 - DNA, 20 bp, Artificial
  CRISPR gRNA sequence
gccggggtgcattgtgtgct

SEQ ID NO: 39548 - DNA, 20 bp, Artificial
  CRISPR gRNA sequence
ccggggtgcattgtgtgctg

SEQ ID NO: 39549 - DNA, 20 bp, Artificial
  CRISPR gRNA sequence
cggggtgcattgtgtgctga

SEQ ID NO: 39550 - DNA, 20 bp, Artificial
  CRISPR gRNA sequence
cattgtgtgctgagggccgt

SEQ ID NO: 39551 - DNA, 20 bp, Artificial
  CRISPR gRNA sequence
tgagggccgtgagtgcgtgc

SEQ ID NO: 39552 - DNA, 20 bp, Artificial
  CRISPR gRNA sequence
cgtgagtgcgtgctggaccc

SEQ ID NO: 39553 - DNA, 20 bp, Artificial
  CRISPR gRNA sequence
gagtgcgtgctggaccctgg

SEQ ID NO: 39554 - DNA, 20 bp, Artificial
  CRISPR gRNA sequence
gtgcgtgctggaccctggca

SEQ ID NO: 39555 - DNA, 20 bp, Artificial
  CRISPR gRNA sequence
accctggcagagctgcacat

SEQ ID NO: 39556 - DNA, 20 bp, Artificial
  CRISPR gRNA sequence
ccctggcagagctgcacatc

SEQ ID NO: 39557 - DNA, 20 bp, Artificial
  CRISPR gRNA sequence
tggcagagctgcacatcagg

SEQ ID NO: 39558 - DNA, 20 bp, Artificial
  CRISPR gRNA sequence
ggcagagctgcacatcaggt

SEQ ID NO: 39559 - DNA, 20 bp, Artificial
  CRISPR gRNA sequence
cagagctgcacatcaggtgg

SEQ ID NO: 39560 - DNA, 20 bp, Artificial
  CRISPR gRNA sequence
acatcaggtgggagctccct

SEQ ID NO: 39561 - DNA, 20 bp, Artificial
  CRISPR gRNA sequence
gtgggagctccctcagacca

SEQ ID NO: 39562 - DNA, 20 bp, Artificial
  CRISPR gRNA sequence
cccccatcatgctctctctg

SEQ ID NO: 39563 - DNA, 20 bp, Artificial
  CRISPR gRNA sequence
catgctctctctgaagccct

SEQ ID NO: 39564 - DNA, 20 bp, Artificial
  CRISPR gRNA sequence
gaagcccttggaattccttc

SEQ ID NO: 39565 - DNA, 20 bp, Artificial
  CRISPR gRNA sequence
aagcccttggaattccttct

SEQ ID NO: 39566 - DNA, 20 bp, Artificial
  CRISPR gRNA sequence
cttggaattccttctgggcc

SEQ ID NO: 39567 - DNA, 20 bp, Artificial
  CRISPR gRNA sequence
ttggaattccttctgggccc

SEQ ID NO: 39568 - DNA, 20 bp, Artificial
  CRISPR gRNA sequence
ttccttctgggcccaggcct

SEQ ID NO: 39569 - DNA, 20 bp, Artificial
  CRISPR gRNA sequence
tccttctgggcccaggcctt

SEQ ID NO: 39570 - DNA, 20 bp, Artificial
  CRISPR gRNA sequence
tctgggcccaggccttggga

SEQ ID NO: 39571 - DNA, 20 bp, Artificial
  CRISPR gRNA sequence
ctgggcccaggccttgggac

SEQ ID NO: 39572 - DNA, 20 bp, Artificial
  CRISPR gRNA sequence
ggcccaggccttgggacggg

SEQ ID NO: 39573 - DNA, 20 bp, Artificial
  CRISPR gRNA sequence
ccaggccttgggacgggcag

SEQ ID NO: 39574 - DNA, 20 bp, Artificial
  CRISPR gRNA sequence
gatgctgctgctgtcccacc

SEQ ID NO: 39575 - DNA, 20 bp, Artificial
  CRISPR gRNA sequence
gtcccacccagaccccgtta

SEQ ID NO: 39576 - DNA, 20 bp, Artificial
  CRISPR gRNA sequence
cacccagaccccgttacagc

SEQ ID NO: 39577 - DNA, 20 bp, Artificial
  CRISPR gRNA sequence
acagccggcacccctcttcc

SEQ ID NO: 39578 - DNA, 20 bp, Artificial
  CRISPR gRNA sequence
acccctcttcctagctgctg

SEQ ID NO: 39579 - DNA, 20 bp, Artificial
  CRISPR gRNA sequence
cttcctagctgctgtggata

SEQ ID NO: 39580 - DNA, 20 bp, Artificial
  CRISPR gRNA sequence
ttcctagctgctgtggatat

SEQ ID NO: 39581 - DNA, 20 bp, Artificial
  CRISPR gRNA sequence
ctgtggatataggctgctca

SEQ ID NO: 39582 - DNA, 20 bp, Artificial
  CRISPR gRNA sequence
ctgctcatggtttatacctc

SEQ ID NO: 39583 - DNA, 20 bp, Artificial
  CRISPR gRNA sequence
gctcatggtttatacctctg

SEQ ID NO: 39584 - DNA, 20 bp, Artificial
  CRISPR gRNA sequence
tacctctggagaactaccct

SEQ ID NO: 39585 - DNA, 20 bp, Artificial
  CRISPR gRNA sequence
gagaactacccttggctgat

SEQ ID NO: 39586 - DNA, 20 bp, Artificial
  CRISPR gRNA sequence
tacccttggctgataagaac

SEQ ID NO: 39587 - DNA, 20 bp, Artificial
  CRISPR gRNA sequence
cccttggctgataagaacca

SEQ ID NO: 39588 - DNA, 20 bp, Artificial
  CRISPR gRNA sequence
tgataagaaccagagacgcc

SEQ ID NO: 39589 - DNA, 20 bp, Artificial
  CRISPR gRNA sequence
taagaaccagagacgcctgg

SEQ ID NO: 39590 - DNA, 20 bp, Artificial
  CRISPR gRNA sequence
aagaaccagagacgcctggc

SEQ ID NO: 39591 - DNA, 20 bp, Artificial
  CRISPR gRNA sequence
agaaccagagacgcctggca

SEQ ID NO: 39592 - DNA, 20 bp, Artificial
  CRISPR gRNA sequence
acccccactttcccctaacc

SEQ ID NO: 39593 - DNA, 20 bp, Artificial
  CRISPR gRNA sequence
ccccactttcccctaaccta

SEQ ID NO: 39594 - DNA, 20 bp, Artificial
  CRISPR gRNA sequence
cactttcccctaacctagag

SEQ ID NO: 39595 - DNA, 20 bp, Artificial
  CRISPR gRNA sequence
taacctagagtggccaatga

SEQ ID NO: 39596 - DNA, 20 bp, Artificial
  CRISPR gRNA sequence
acctagagtggccaatgaca

SEQ ID NO: 39597 - DNA, 20 bp, Artificial
  CRISPR gRNA sequence
cctagagtggccaatgacag

SEQ ID NO: 39598 - DNA, 20 bp, Artificial
  CRISPR gRNA sequence
agagtggccaatgacagagg

SEQ ID NO: 39599 - DNA, 20 bp, Artificial
  CRISPR gRNA sequence
agtggccaatgacagaggca

SEQ ID NO: 39600 - DNA, 20 bp, Artificial
  CRISPR gRNA sequence
gtggccaatgacagaggcag

SEQ ID NO: 39601 - DNA, 20 bp, Artificial
  CRISPR gRNA sequence
tggccaatgacagaggcaga

SEQ ID NO: 39602 - DNA, 20 bp, Artificial
  CRISPR gRNA sequence
aggcagagggcacaactctc

SEQ ID NO: 39603 - DNA, 20 bp, Artificial
  CRISPR gRNA sequence
actctccagcccaaactctc

SEQ ID NO: 39604 - DNA, 20 bp, Artificial
  CRISPR gRNA sequence
ctccagcccaaactctccag

SEQ ID NO: 39605 - DNA, 20 bp, Artificial
  CRISPR gRNA sequence
tccagcccaaactctccagt

SEQ ID NO: 39606 - DNA, 20 bp, Artificial
  CRISPR gRNA sequence
ccaaactctccagtgggaca

SEQ ID NO: 39607 - DNA, 20 bp, Artificial
  CRISPR gRNA sequence
tccagtgggacaaagctccc

SEQ ID NO: 39608 - DNA, 20 bp, Artificial
  CRISPR gRNA sequence
ccagtgggacaaagctccct

SEQ ID NO: 39609 - DNA, 20 bp, Artificial
  CRISPR gRNA sequence
agtgggacaaagctccctgg

SEQ ID NO: 39610 - DNA, 20 bp, Artificial
  CRISPR gRNA sequence
gacaaagctccctgggagac

SEQ ID NO: 39611 - DNA, 20 bp, Artificial
  CRISPR gRNA sequence
acaaagctccctgggagact

SEQ ID NO: 39612 - DNA, 20 bp, Artificial
  CRISPR gRNA sequence
gctccctgggagactaggcc

SEQ ID NO: 39613 - DNA, 20 bp, Artificial
  CRISPR gRNA sequence
ctccctgggagactaggcca

SEQ ID NO: 39614 - DNA, 20 bp, Artificial
  CRISPR gRNA sequence
ggccaaggacttgctccgtt

SEQ ID NO: 39615 - DNA, 20 bp, Artificial
  CRISPR gRNA sequence
ttgctccgtttggcttccct

SEQ ID NO: 39616 - DNA, 20 bp, Artificial
  CRISPR gRNA sequence
agtcccttactgtttctcct

SEQ ID NO: 39617 - DNA, 20 bp, Artificial
  CRISPR gRNA sequence
tcccttactgtttctcctga

SEQ ID NO: 39618 - DNA, 20 bp, Artificial
  CRISPR gRNA sequence
cttactgtttctcctgagag

SEQ ID NO: 39619 - DNA, 20 bp, Artificial
  CRISPR gRNA sequence
ttctcctgagagcagaccgt

SEQ ID NO: 39620 - DNA, 20 bp, Artificial
  CRISPR gRNA sequence
tcatgatgtgcgcaactgac

SEQ ID NO: 39621 - DNA, 20 bp, Artificial
  CRISPR gRNA sequence
gcgaccccctaccccactca

SEQ ID NO: 39622 - DNA, 20 bp, Artificial
  CRISPR gRNA sequence
ccctaccccactcacagacc

SEQ ID NO: 39623 - DNA, 20 bp, Artificial
  CRISPR gRNA sequence
cctaccccactcacagaccc

SEQ ID NO: 39624 - DNA, 20 bp, Artificial
  CRISPR gRNA sequence
acagacccaggctctgccac

SEQ ID NO: 39625 - DNA, 20 bp, Artificial
  CRISPR gRNA sequence
cagacccaggctctgccact

SEQ ID NO: 39626 - DNA, 20 bp, Artificial
  CRISPR gRNA sequence
agacccaggctctgccacta

SEQ ID NO: 39627 - DNA, 20 bp, Artificial
  CRISPR gRNA sequence
gaacccaatcctatttctgt

SEQ ID NO: 39628 - DNA, 20 bp, Artificial
  CRISPR gRNA sequence
tttctgtaagtctcgccgtt

SEQ ID NO: 39629 - DNA, 20 bp, Artificial
  CRISPR gRNA sequence
gtaagtctcgccgttgagta

SEQ ID NO: 39630 - DNA, 20 bp, Artificial
  CRISPR gRNA sequence
taagtctcgccgttgagtat

SEQ ID NO: 39631 - DNA, 20 bp, Artificial
  CRISPR gRNA sequence
aagtctcgccgttgagtatg

SEQ ID NO: 39632 - DNA, 20 bp, Artificial
  CRISPR gRNA sequence
gtctcgccgttgagtatggg

SEQ ID NO: 39633 - DNA, 20 bp, Artificial
  CRISPR gRNA sequence
tctcgccgttgagtatgggg

SEQ ID NO: 39634 - DNA, 20 bp, Artificial
  CRISPR gRNA sequence
gccgttgagtatggggaggt

SEQ ID NO: 39635 - DNA, 20 bp, Artificial
  CRISPR gRNA sequence
ccgttgagtatggggaggtg

SEQ ID NO: 39636 - DNA, 20 bp, Artificial
  CRISPR gRNA sequence
tgagtatggggaggtgagga

SEQ ID NO: 39637 - DNA, 20 bp, Artificial
  CRISPR gRNA sequence
gatgatgattaatgtcaact

SEQ ID NO: 39638 - DNA, 20 bp, Artificial
  CRISPR gRNA sequence
atgtcaactcagttcccact

SEQ ID NO: 39639 - DNA, 20 bp, Artificial
  CRISPR gRNA sequence
gtcaactcagttcccactcg

SEQ ID NO: 39640 - DNA, 20 bp, Artificial
  CRISPR gRNA sequence
tcaactcagttcccactcgg

SEQ ID NO: 39641 - DNA, 20 bp, Artificial
  CRISPR gRNA sequence
ctcagttcccactcggagga

SEQ ID NO: 39642 - DNA, 20 bp, Artificial
  CRISPR gRNA sequence
ggaaagcctcattctcaacc

SEQ ID NO: 39643 - DNA, 20 bp, Artificial
  CRISPR gRNA sequence
aagcctcattctcaacccag

SEQ ID NO: 39644 - DNA, 20 bp, Artificial
  CRISPR gRNA sequence
agcctcattctcaacccagt

SEQ ID NO: 39645 - DNA, 20 bp, Artificial
  CRISPR gRNA sequence
gcctcattctcaacccagta

SEQ ID NO: 39646 - DNA, 20 bp, Artificial
  CRISPR gRNA sequence
tcattctcaacccagtaggg

SEQ ID NO: 39647 - DNA, 20 bp, Artificial
  CRISPR gRNA sequence
ccctgctttaaacacccctc

SEQ ID NO: 39648 - DNA, 20 bp, Artificial
  CRISPR gRNA sequence
cctgctttaaacacccctca

SEQ ID NO: 39649 - DNA, 20 bp, Artificial
  CRISPR gRNA sequence
ctgctttaaacacccctcaa

SEQ ID NO: 39650 - DNA, 20 bp, Artificial
  CRISPR gRNA sequence
gctttaaacacccctcaagg

SEQ ID NO: 39651 - DNA, 20 bp, Artificial
  CRISPR gRNA sequence
ctttaaacacccctcaaggg

SEQ ID NO: 39652 - DNA, 20 bp, Artificial
  CRISPR gRNA sequence
ttaaacacccctcaagggag

SEQ ID NO: 39653 - DNA, 20 bp, Artificial
  CRISPR gRNA sequence
aaacacccctcaagggagga

SEQ ID NO: 39654 - DNA, 20 bp, Artificial
  CRISPR gRNA sequence
aacacccctcaagggaggag

SEQ ID NO: 39655 - DNA, 20 bp, Artificial
  CRISPR gRNA sequence
acacccctcaagggaggaga

SEQ ID NO: 39656 - DNA, 20 bp, Artificial
  CRISPR gRNA sequence
agggaaaccgattcacccaa

SEQ ID NO: 39657 - DNA, 20 bp, Artificial
  CRISPR gRNA sequence
gggaaaccgattcacccaaa

SEQ ID NO: 39658 - DNA, 20 bp, Artificial
  CRISPR gRNA sequence
aaaccgattcacccaaaagg

SEQ ID NO: 39659 - DNA, 20 bp, Artificial
  CRISPR gRNA sequence
gattcacccaaaaggtagat

SEQ ID NO: 39660 - DNA, 20 bp, Artificial
  CRISPR gRNA sequence
attcacccaaaaggtagatt

SEQ ID NO: 39661 - DNA, 20 bp, Artificial
  CRISPR gRNA sequence
ttcacccaaaaggtagatta

SEQ ID NO: 39662 - DNA, 20 bp, Artificial
  CRISPR gRNA sequence
tcacccaaaaggtagattag

SEQ ID NO: 39663 - DNA, 20 bp, Artificial
  CRISPR gRNA sequence
aaaggtagattaggggacct

SEQ ID NO: 39664 - DNA, 20 bp, Artificial
  CRISPR gRNA sequence
ctgtatatgatgattcaata

SEQ ID NO: 39665 - DNA, 20 bp, Artificial
  CRISPR gRNA sequence
tgtatatgatgattcaataa

SEQ ID NO: 39666 - DNA, 20 bp, Artificial
  CRISPR gRNA sequence
gtatatgatgattcaataaa

SEQ ID NO: 39667 - DNA, 20 bp, Artificial
  CRISPR gRNA sequence
atgattcaataaagggtccc

SEQ ID NO: 39668 - DNA, 20 bp, Artificial
  CRISPR gRNA sequence
aagggtccctagtgcattcc

SEQ ID NO: 39669 - DNA, 20 bp, Artificial
  CRISPR gRNA sequence
agcgatgccctgttcacttc

SEQ ID NO: 39670 - DNA, 20 bp, Artificial
  CRISPR gRNA sequence
gcgatgccctgttcacttcc

SEQ ID NO: 39671 - DNA, 20 bp, Artificial
  CRISPR gRNA sequence
cacgattgtgcaaacacatt

SEQ ID NO: 39672 - DNA, 20 bp, Artificial
  CRISPR gRNA sequence
tgtgcaaacacatttagctg

SEQ ID NO: 39673 - DNA, 20 bp, Artificial
  CRISPR gRNA sequence
gtgcaaacacatttagctgt

SEQ ID NO: 39674 - DNA, 20 bp, Artificial
  CRISPR gRNA sequence
tgcaaacacatttagctgta

SEQ ID NO: 39675 - DNA, 20 bp, Artificial
  CRISPR gRNA sequence
agctgtagggatgttcacct

SEQ ID NO: 39676 - DNA, 20 bp, Artificial
  CRISPR gRNA sequence
agggatgttcacctcagtat

SEQ ID NO: 39677 - DNA, 20 bp, Artificial
  CRISPR gRNA sequence
cacctcagtattggttataa

SEQ ID NO: 39678 - DNA, 20 bp, Artificial
  CRISPR gRNA sequence
acctcagtattggttataat

SEQ ID NO: 39679 - DNA, 20 bp, Artificial
  CRISPR gRNA sequence
tggttataataggaaaaaaa

SEQ ID NO: 39680 - DNA, 20 bp, Artificial
  CRISPR gRNA sequence
aataggaaaaaaaaagaaaa

SEQ ID NO: 39681 - DNA, 20 bp, Artificial
  CRISPR gRNA sequence
ggaaaaaaaaagaaaatagc

SEQ ID NO: 39682 - DNA, 20 bp, Artificial
  CRISPR gRNA sequence
aatagctggaatgtttaacc

SEQ ID NO: 39683 - DNA, 20 bp, Artificial
  CRISPR gRNA sequence
atagctggaatgtttaaccg

SEQ ID NO: 39684 - DNA, 20 bp, Artificial
  CRISPR gRNA sequence
tagctggaatgtttaaccga

SEQ ID NO: 39685 - DNA, 20 bp, Artificial
  CRISPR gRNA sequence
aatgtttaaccgagggatat

SEQ ID NO: 39686 - DNA, 20 bp, Artificial
  CRISPR gRNA sequence
tttaaccgagggatattagt

SEQ ID NO: 39687 - DNA, 20 bp, Artificial
  CRISPR gRNA sequence
cgagggatattagttagact

SEQ ID NO: 39688 - DNA, 20 bp, Artificial
  CRISPR gRNA sequence
tagttagactaagttacttc

SEQ ID NO: 39689 - DNA, 20 bp, Artificial
  CRISPR gRNA sequence
gttagactaagttacttcca

SEQ ID NO: 39690 - DNA, 20 bp, Artificial
  CRISPR gRNA sequence
tagactaagttacttccaga

SEQ ID NO: 39691 - DNA, 20 bp, Artificial
  CRISPR gRNA sequence
agttacttccagagagaact

SEQ ID NO: 39692 - DNA, 20 bp, Artificial
  CRISPR gRNA sequence
tacttccagagagaactcag

SEQ ID NO: 39693 - DNA, 20 bp, Artificial
  CRISPR gRNA sequence
gagagaactcagtggaacca

SEQ ID NO: 39694 - DNA, 20 bp, Artificial
  CRISPR gRNA sequence
tagaaaaaaaaatgataata

SEQ ID NO: 39695 - DNA, 20 bp, Artificial
  CRISPR gRNA sequence
agaaaaaaaaatgataatat

SEQ ID NO: 39696 - DNA, 20 bp, Artificial
  CRISPR gRNA sequence
aaaaaatgataatataggtg

SEQ ID NO: 39697 - DNA, 20 bp, Artificial
  CRISPR gRNA sequence
atataggtgcagtttcaata

SEQ ID NO: 39698 - DNA, 20 bp, Artificial
  CRISPR gRNA sequence
ataggtgcagtttcaatatg

SEQ ID NO: 39699 - DNA, 20 bp, Artificial
  CRISPR gRNA sequence
taggtgcagtttcaatatgg

SEQ ID NO: 39700 - DNA, 20 bp, Artificial
  CRISPR gRNA sequence
aggtgcagtttcaatatgga

SEQ ID NO: 39701 - DNA, 20 bp, Artificial
  CRISPR gRNA sequence
ggtgcagtttcaatatggag

SEQ ID NO: 39702 - DNA, 20 bp, Artificial
  CRISPR gRNA sequence
gtttcaatatggaggggtga

SEQ ID NO: 39703 - DNA, 20 bp, Artificial
  CRISPR gRNA sequence
tttcaatatggaggggtgac

SEQ ID NO: 39704 - DNA, 20 bp, Artificial
  CRISPR gRNA sequence
ttcaatatggaggggtgacg

SEQ ID NO: 39705 - DNA, 20 bp, Artificial
  CRISPR gRNA sequence
caatatggaggggtgacggg

SEQ ID NO: 39706 - DNA, 20 bp, Artificial
  CRISPR gRNA sequence
aggggtgacggggagttatt

SEQ ID NO: 39707 - DNA, 20 bp, Artificial
  CRISPR gRNA sequence
ggagttattaagtaaacata

SEQ ID NO: 39708 - DNA, 20 bp, Artificial
  CRISPR gRNA sequence
taaacataaagaaatttctt

SEQ ID NO: 39709 - DNA, 20 bp, Artificial
  CRISPR gRNA sequence
aacataaagaaatttcttta

SEQ ID NO: 39710 - DNA, 20 bp, Artificial
  CRISPR gRNA sequence
taaagaaatttctttagaga

SEQ ID NO: 39711 - DNA, 20 bp, Artificial
  CRISPR gRNA sequence
aaagaaatttctttagagac

SEQ ID NO: 39712 - DNA, 20 bp, Artificial
  CRISPR gRNA sequence
caggatcttgctctgttacc

SEQ ID NO: 39713 - DNA, 20 bp, Artificial
  CRISPR gRNA sequence
aggatcttgctctgttacca

SEQ ID NO: 39714 - DNA, 20 bp, Artificial
  CRISPR gRNA sequence
tcttgctctgttaccaaggc

SEQ ID NO: 39715 - DNA, 20 bp, Artificial
  CRISPR gRNA sequence
ttgctctgttaccaaggctg

SEQ ID NO: 39716 - DNA, 20 bp, Artificial
  CRISPR gRNA sequence
ctgttaccaaggctggagta

SEQ ID NO: 39717 - DNA, 20 bp, Artificial
  CRISPR gRNA sequence
ggagtacagtgacacaatca

SEQ ID NO: 39718 - DNA, 20 bp, Artificial
  CRISPR gRNA sequence
tcactgtaacctccaaatcc

SEQ ID NO: 39719 - DNA, 20 bp, Artificial
  CRISPR gRNA sequence
cactgtaacctccaaatcct

SEQ ID NO: 39720 - DNA, 20 bp, Artificial
  CRISPR gRNA sequence
taacctccaaatcctgggct

SEQ ID NO: 39721 - DNA, 20 bp, Artificial
  CRISPR gRNA sequence
gctcagcaatccatctctct

SEQ ID NO: 39722 - DNA, 20 bp, Artificial
  CRISPR gRNA sequence
ccatctctcttagtctccca

SEQ ID NO: 39723 - DNA, 20 bp, Artificial
  CRISPR gRNA sequence
ctcttagtctcccaaagtgc

SEQ ID NO: 39724 - DNA, 20 bp, Artificial
  CRISPR gRNA sequence
tcttagtctcccaaagtgct

SEQ ID NO: 39725 - DNA, 20 bp, Artificial
  CRISPR gRNA sequence
ctcccaaagtgctgggatta

SEQ ID NO: 39726 - DNA, 20 bp, Artificial
  CRISPR gRNA sequence
agtgctgggattacagtcat

SEQ ID NO: 39727 - DNA, 20 bp, Artificial
  CRISPR gRNA sequence
cagtcatgagtcactatgcc

SEQ ID NO: 39728 - DNA, 20 bp, Artificial
  CRISPR gRNA sequence
ctggcaattttttttatttt

SEQ ID NO: 39729 - DNA, 20 bp, Artificial
  CRISPR gRNA sequence
gcaattttttttatttttag

SEQ ID NO: 39730 - DNA, 20 bp, Artificial
  CRISPR gRNA sequence
aattttttttatttttagta

SEQ ID NO: 39731 - DNA, 20 bp, Artificial
  CRISPR gRNA sequence
ttttttttatttttagtaga

SEQ ID NO: 39732 - DNA, 20 bp, Artificial
  CRISPR gRNA sequence
ttttttatttttagtagaga

SEQ ID NO: 39733 - DNA, 20 bp, Artificial
  CRISPR gRNA sequence
tttttatttttagtagagag

SEQ ID NO: 39734 - DNA, 20 bp, Artificial
  CRISPR gRNA sequence
ttttatttttagtagagaga

SEQ ID NO: 39735 - DNA, 20 bp, Artificial
  CRISPR gRNA sequence
gagggtcttgctatattgac

SEQ ID NO: 39736 - DNA, 20 bp, Artificial
  CRISPR gRNA sequence
agggtcttgctatattgacc

SEQ ID NO: 39737 - DNA, 20 bp, Artificial
  CRISPR gRNA sequence
caggctgttctcaaactccc

SEQ ID NO: 39738 - DNA, 20 bp, Artificial
  CRISPR gRNA sequence
ctcatgtgatcctcctgccc

SEQ ID NO: 39739 - DNA, 20 bp, Artificial
  CRISPR gRNA sequence
cctcctgccctggcctccca

SEQ ID NO: 39740 - DNA, 20 bp, Artificial
  CRISPR gRNA sequence
tcctgccctggcctcccaaa

SEQ ID NO: 39741 - DNA, 20 bp, Artificial
  CRISPR gRNA sequence
gccctggcctcccaaagagc

SEQ ID NO: 39742 - DNA, 20 bp, Artificial
  CRISPR gRNA sequence
ccctggcctcccaaagagca

SEQ ID NO: 39743 - DNA, 20 bp, Artificial
  CRISPR gRNA sequence
ctcccaaagagcaaggatta

SEQ ID NO: 39744 - DNA, 20 bp, Artificial
  CRISPR gRNA sequence
tcccaaagagcaaggattat

SEQ ID NO: 39745 - DNA, 20 bp, Artificial
  CRISPR gRNA sequence
ataggtatgaaccactgcac

SEQ ID NO: 39746 - DNA, 20 bp, Artificial
  CRISPR gRNA sequence
taggtatgaaccactgcacc

SEQ ID NO: 39747 - DNA, 20 bp, Artificial
  CRISPR gRNA sequence
attttaactcattatcttaa

SEQ ID NO: 39748 - DNA, 20 bp, Artificial
  CRISPR gRNA sequence
attatcttaaaagattataa

SEQ ID NO: 39749 - DNA, 20 bp, Artificial
  CRISPR gRNA sequence
gattataaaagattataata

SEQ ID NO: 39750 - DNA, 20 bp, Artificial
  CRISPR gRNA sequence
agattataataaagcttttc

SEQ ID NO: 39751 - DNA, 20 bp, Artificial
  CRISPR gRNA sequence
aagcttttcaagatatgcaa

SEQ ID NO: 39752 - DNA, 20 bp, Artificial
  CRISPR gRNA sequence
cttttcaagatatgcaatgg

SEQ ID NO: 39753 - DNA, 20 bp, Artificial
  CRISPR gRNA sequence
tcaagatatgcaatggcaga

SEQ ID NO: 39754 - DNA, 20 bp, Artificial
  CRISPR gRNA sequence
atatgcaatggcagaaagaa

SEQ ID NO: 39755 - DNA, 20 bp, Artificial
  CRISPR gRNA sequence
gcagaaagaatggtataatc

SEQ ID NO: 39756 - DNA, 20 bp, Artificial
  CRISPR gRNA sequence
cagaaagaatggtataatct

SEQ ID NO: 39757 - DNA, 20 bp, Artificial
  CRISPR gRNA sequence
aagaatggtataatctgggc

SEQ ID NO: 39758 - DNA, 20 bp, Artificial
  CRISPR gRNA sequence
agaatggtataatctgggcc

SEQ ID NO: 39759 - DNA, 20 bp, Artificial
  CRISPR gRNA sequence
ataatctgggccaggtgctg

SEQ ID NO: 39760 - DNA, 20 bp, Artificial
  CRISPR gRNA sequence
tgtggctcatgctgtaaacc

SEQ ID NO: 39761 - DNA, 20 bp, Artificial
  CRISPR gRNA sequence
atgctgtaaacccagcactt

SEQ ID NO: 39762 - DNA, 20 bp, Artificial
  CRISPR gRNA sequence
tgctgtaaacccagcacttt

SEQ ID NO: 39763 - DNA, 20 bp, Artificial
  CRISPR gRNA sequence
ctgtaaacccagcactttgg

SEQ ID NO: 39764 - DNA, 20 bp, Artificial
  CRISPR gRNA sequence
tgtaaacccagcactttggg

SEQ ID NO: 39765 - DNA, 20 bp, Artificial
  CRISPR gRNA sequence
acccagcactttgggaggct

SEQ ID NO: 39766 - DNA, 20 bp, Artificial
  CRISPR gRNA sequence
cccagcactttgggaggctg

SEQ ID NO: 39767 - DNA, 20 bp, Artificial
  CRISPR gRNA sequence
agcactttgggaggctgagg

SEQ ID NO: 39768 - DNA, 20 bp, Artificial
  CRISPR gRNA sequence
gcactttgggaggctgaggc

SEQ ID NO: 39769 - DNA, 20 bp, Artificial
  CRISPR gRNA sequence
cactttgggaggctgaggca

SEQ ID NO: 39770 - DNA, 20 bp, Artificial
  CRISPR gRNA sequence
actttgggaggctgaggcag

SEQ ID NO: 39771 - DNA, 20 bp, Artificial
  CRISPR gRNA sequence
ctttgggaggctgaggcagg

SEQ ID NO: 39772 - DNA, 20 bp, Artificial
  CRISPR gRNA sequence
ctgaggcagggggatcacct

SEQ ID NO: 39773 - DNA, 20 bp, Artificial
  CRISPR gRNA sequence
tgaggcagggggatcacctg

SEQ ID NO: 39774 - DNA, 20 bp, Artificial
  CRISPR gRNA sequence
gcagggggatcacctgaggt

SEQ ID NO: 39775 - DNA, 20 bp, Artificial
  CRISPR gRNA sequence
cagggggatcacctgaggtc

SEQ ID NO: 39776 - DNA, 20 bp, Artificial
  CRISPR gRNA sequence
gggggatcacctgaggtcag

SEQ ID NO: 39777 - DNA, 20 bp, Artificial
  CRISPR gRNA sequence
tcacctgaggtcaggagttc

SEQ ID NO: 39778 - DNA, 20 bp, Artificial
  CRISPR gRNA sequence
tgaggtcaggagttcaagac

SEQ ID NO: 39779 - DNA, 20 bp, Artificial
  CRISPR gRNA sequence
tcaggagttcaagaccagcc

SEQ ID NO: 39780 - DNA, 20 bp, Artificial
  CRISPR gRNA sequence
ttcaagaccagcctggccaa

SEQ ID NO: 39781 - DNA, 20 bp, Artificial
  CRISPR gRNA sequence
tcaagaccagcctggccaat

SEQ ID NO: 39782 - DNA, 20 bp, Artificial
  CRISPR gRNA sequence
tctactaaaaatacaaaaac

SEQ ID NO: 39783 - DNA, 20 bp, Artificial
  CRISPR gRNA sequence
ctaaaaatacaaaaactagc

SEQ ID NO: 39784 - DNA, 20 bp, Artificial
  CRISPR gRNA sequence
taaaaatacaaaaactagct

SEQ ID NO: 39785 - DNA, 20 bp, Artificial
  CRISPR gRNA sequence
atacaaaaactagctgggca

SEQ ID NO: 39786 - DNA, 20 bp, Artificial
  CRISPR gRNA sequence
caaaaactagctgggcatgg

SEQ ID NO: 39787 - DNA, 20 bp, Artificial
  CRISPR gRNA sequence
gtggcgtgcacctgtaattc

SEQ ID NO: 39788 - DNA, 20 bp, Artificial
  CRISPR gRNA sequence
cacctgtaattccagctact

SEQ ID NO: 39789 - DNA, 20 bp, Artificial
  CRISPR gRNA sequence
acctgtaattccagctactc

SEQ ID NO: 39790 - DNA, 20 bp, Artificial
  CRISPR gRNA sequence
ctgtaattccagctactcag

SEQ ID NO: 39791 - DNA, 20 bp, Artificial
  CRISPR gRNA sequence
tgtaattccagctactcagg

SEQ ID NO: 39792 - DNA, 20 bp, Artificial
  CRISPR gRNA sequence
ttccagctactcaggaggct

SEQ ID NO: 39793 - DNA, 20 bp, Artificial
  CRISPR gRNA sequence
tccagctactcaggaggctg

SEQ ID NO: 39794 - DNA, 20 bp, Artificial
  CRISPR gRNA sequence
agctactcaggaggctgagg

SEQ ID NO: 39795 - DNA, 20 bp, Artificial
  CRISPR gRNA sequence
gctactcaggaggctgaggc

SEQ ID NO: 39796 - DNA, 20 bp, Artificial
  CRISPR gRNA sequence
tactcaggaggctgaggcag

SEQ ID NO: 39797 - DNA, 20 bp, Artificial
  CRISPR gRNA sequence
ggctgaggcaggagaatcgc

SEQ ID NO: 39798 - DNA, 20 bp, Artificial
  CRISPR gRNA sequence
gcaggagaatcgctggaacc

SEQ ID NO: 39799 - DNA, 20 bp, Artificial
  CRISPR gRNA sequence
caggagaatcgctggaacct

SEQ ID NO: 39800 - DNA, 20 bp, Artificial
  CRISPR gRNA sequence
ggagaatcgctggaacctgg

SEQ ID NO: 39801 - DNA, 20 bp, Artificial
  CRISPR gRNA sequence
gagaatcgctggaacctggg

SEQ ID NO: 39802 - DNA, 20 bp, Artificial
  CRISPR gRNA sequence
aatcgctggaacctgggagg

SEQ ID NO: 39803 - DNA, 20 bp, Artificial
  CRISPR gRNA sequence
tcgctggaacctgggaggcg

SEQ ID NO: 39804 - DNA, 20 bp, Artificial
  CRISPR gRNA sequence
cgctggaacctgggaggcgg

SEQ ID NO: 39805 - DNA, 20 bp, Artificial
  CRISPR gRNA sequence
aacctgggaggcggaggttg

SEQ ID NO: 39806 - DNA, 20 bp, Artificial
  CRISPR gRNA sequence
tgggaggcggaggttgcagt

SEQ ID NO: 39807 - DNA, 20 bp, Artificial
  CRISPR gRNA sequence
ggcggaggttgcagtgagcc

SEQ ID NO: 39808 - DNA, 20 bp, Artificial
  CRISPR gRNA sequence
gagatcatgccactgcactc

SEQ ID NO: 39809 - DNA, 20 bp, Artificial
  CRISPR gRNA sequence
catgccactgcactccagcc

SEQ ID NO: 39810 - DNA, 20 bp, Artificial
  CRISPR gRNA sequence
atgccactgcactccagcct

SEQ ID NO: 39811 - DNA, 20 bp, Artificial
  CRISPR gRNA sequence
gccactgcactccagcctgg

SEQ ID NO: 39812 - DNA, 20 bp, Artificial
  CRISPR gRNA sequence
ctgcactccagcctgggaga

SEQ ID NO: 39813 - DNA, 20 bp, Artificial
  CRISPR gRNA sequence
gcactccagcctgggagaca

SEQ ID NO: 39814 - DNA, 20 bp, Artificial
  CRISPR gRNA sequence
tccagcctgggagacagagc

SEQ ID NO: 39815 - DNA, 20 bp, Artificial
  CRISPR gRNA sequence
attaaaaaaaaaaaaaaaaa

SEQ ID NO: 39816 - DNA, 20 bp, Artificial
  CRISPR gRNA sequence
taaaaaaaaaaaaaaaaaaa

SEQ ID NO: 39817 - DNA, 20 bp, Artificial
  CRISPR gRNA sequence
aaaaaaaaaaaaaaaaaaga

SEQ ID NO: 39818 - DNA, 20 bp, Artificial
  CRISPR gRNA sequence
aaaaaaaaaaaaaaaagaga

SEQ ID NO: 39819 - DNA, 20 bp, Artificial
  CRISPR gRNA sequence
aaaaaaaaaaagagagagca

SEQ ID NO: 39820 - DNA, 20 bp, Artificial
  CRISPR gRNA sequence
tgttcccatcaataatgatc

SEQ ID NO: 39821 - DNA, 20 bp, Artificial
  CRISPR gRNA sequence
ttatttgtcatccctgcttc

SEQ ID NO: 39822 - DNA, 20 bp, Artificial
  CRISPR gRNA sequence
ttaaaaaactaatgtttaaa

SEQ ID NO: 39823 - DNA, 20 bp, Artificial
  CRISPR gRNA sequence
aaaaaactaatgtttaaaaa

SEQ ID NO: 39824 - DNA, 20 bp, Artificial
  CRISPR gRNA sequence
atgtttaaaaagagaatcta

SEQ ID NO: 39825 - DNA, 20 bp, Artificial
  CRISPR gRNA sequence
taaaacaaaaattattgcac

SEQ ID NO: 39826 - DNA, 20 bp, Artificial
  CRISPR gRNA sequence
aaaattattgcactagaaaa

SEQ ID NO: 39827 - DNA, 20 bp, Artificial
  CRISPR gRNA sequence
attattgcactagaaaatgg

SEQ ID NO: 39828 - DNA, 20 bp, Artificial
  CRISPR gRNA sequence
ttattgcactagaaaatgga

SEQ ID NO: 39829 - DNA, 20 bp, Artificial
  CRISPR gRNA sequence
actagaaaatggaaggtttg

SEQ ID NO: 39830 - DNA, 20 bp, Artificial
  CRISPR gRNA sequence
ctagaaaatggaaggtttga

SEQ ID NO: 39831 - DNA, 20 bp, Artificial
  CRISPR gRNA sequence
ggtttgaaggactcactcca

SEQ ID NO: 39832 - DNA, 20 bp, Artificial
  CRISPR gRNA sequence
gtttgaaggactcactccaa

SEQ ID NO: 39833 - DNA, 20 bp, Artificial
  CRISPR gRNA sequence
ggactcactccaaaggttac

SEQ ID NO: 39834 - DNA, 20 bp, Artificial
  CRISPR gRNA sequence
gactcactccaaaggttacc

SEQ ID NO: 39835 - DNA, 20 bp, Artificial
  CRISPR gRNA sequence
actcactccaaaggttacca

SEQ ID NO: 39836 - DNA, 20 bp, Artificial
  CRISPR gRNA sequence
ctcactccaaaggttaccag

SEQ ID NO: 39837 - DNA, 20 bp, Artificial
  CRISPR gRNA sequence
gggtaatccacacatacttt

SEQ ID NO: 39838 - DNA, 20 bp, Artificial
  CRISPR gRNA sequence
atccacacatactttgagca

SEQ ID NO: 39839 - DNA, 20 bp, Artificial
  CRISPR gRNA sequence
acacatactttgagcacaga

SEQ ID NO: 39840 - DNA, 20 bp, Artificial
  CRISPR gRNA sequence
agcacagacagaacactgac

SEQ ID NO: 39841 - DNA, 20 bp, Artificial
  CRISPR gRNA sequence
acagacagaacactgactag

SEQ ID NO: 39842 - DNA, 20 bp, Artificial
  CRISPR gRNA sequence
agacagaacactgactagca

SEQ ID NO: 39843 - DNA, 20 bp, Artificial
  CRISPR gRNA sequence
acagaacactgactagcaga

SEQ ID NO: 39844 - DNA, 20 bp, Artificial
  CRISPR gRNA sequence
agaacactgactagcagaga

SEQ ID NO: 39845 - DNA, 20 bp, Artificial
  CRISPR gRNA sequence
gaacactgactagcagagag

SEQ ID NO: 39846 - DNA, 20 bp, Artificial
  CRISPR gRNA sequence
aacactgactagcagagaga

SEQ ID NO: 39847 - DNA, 20 bp, Artificial
  CRISPR gRNA sequence
acactgactagcagagagag

SEQ ID NO: 39848 - DNA, 20 bp, Artificial
  CRISPR gRNA sequence
actagcagagagaggggttt

SEQ ID NO: 39849 - DNA, 20 bp, Artificial
  CRISPR gRNA sequence
cagagagaggggtttcagtc

SEQ ID NO: 39850 - DNA, 20 bp, Artificial
  CRISPR gRNA sequence
agagagaggggtttcagtct

SEQ ID NO: 39851 - DNA, 20 bp, Artificial
  CRISPR gRNA sequence
gagagaggggtttcagtctg

SEQ ID NO: 39852 - DNA, 20 bp, Artificial
  CRISPR gRNA sequence
gggtttcagtctggggctaa

SEQ ID NO: 39853 - DNA, 20 bp, Artificial
  CRISPR gRNA sequence
gtttcagtctggggctaaaa

SEQ ID NO: 39854 - DNA, 20 bp, Artificial
  CRISPR gRNA sequence
ttcagtctggggctaaaaga

SEQ ID NO: 39855 - DNA, 20 bp, Artificial
  CRISPR gRNA sequence
tggggctaaaagagagaaca

SEQ ID NO: 39856 - DNA, 20 bp, Artificial
  CRISPR gRNA sequence
cacagaatttgttttctttt

SEQ ID NO: 39857 - DNA, 20 bp, Artificial
  CRISPR gRNA sequence
tgttttcttttaagacttgc

SEQ ID NO: 39858 - DNA, 20 bp, Artificial
  CRISPR gRNA sequence
gttttcttttaagacttgcc

SEQ ID NO: 39859 - DNA, 20 bp, Artificial
  CRISPR gRNA sequence
ttttaagacttgccaggaaa

SEQ ID NO: 39860 - DNA, 20 bp, Artificial
  CRISPR gRNA sequence
tttaagacttgccaggaaat

SEQ ID NO: 39861 - DNA, 20 bp, Artificial
  CRISPR gRNA sequence
ttaagacttgccaggaaatg

SEQ ID NO: 39862 - DNA, 20 bp, Artificial
  CRISPR gRNA sequence
gccaggaaatggggcttact

SEQ ID NO: 39863 - DNA, 20 bp, Artificial
  CRISPR gRNA sequence
ccaggaaatggggcttactt

SEQ ID NO: 39864 - DNA, 20 bp, Artificial
  CRISPR gRNA sequence
aatggggcttacttaggcaa

SEQ ID NO: 39865 - DNA, 20 bp, Artificial
  CRISPR gRNA sequence
atacatttgtgaaatatctg

SEQ ID NO: 39866 - DNA, 20 bp, Artificial
  CRISPR gRNA sequence
catttgtgaaatatctgtgg

SEQ ID NO: 39867 - DNA, 20 bp, Artificial
  CRISPR gRNA sequence
tgtgaaatatctgtggtaga

SEQ ID NO: 39868 - DNA, 20 bp, Artificial
  CRISPR gRNA sequence
tatctgtggtagaaagattt

SEQ ID NO: 39869 - DNA, 20 bp, Artificial
  CRISPR gRNA sequence
gaaagatttcagccctccaa

SEQ ID NO: 39870 - DNA, 20 bp, Artificial
  CRISPR gRNA sequence
atttcagccctccaaaagct

SEQ ID NO: 39871 - DNA, 20 bp, Artificial
  CRISPR gRNA sequence
ttcagccctccaaaagctca

SEQ ID NO: 39872 - DNA, 20 bp, Artificial
  CRISPR gRNA sequence
tcagccctccaaaagctcag

SEQ ID NO: 39873 - DNA, 20 bp, Artificial
  CRISPR gRNA sequence
gccctccaaaagctcagagg

SEQ ID NO: 39874 - DNA, 20 bp, Artificial
  CRISPR gRNA sequence
tccaaaagctcagaggaagt

SEQ ID NO: 39875 - DNA, 20 bp, Artificial
  CRISPR gRNA sequence
caaaagctcagaggaagtca

SEQ ID NO: 39876 - DNA, 20 bp, Artificial
  CRISPR gRNA sequence
aaaagctcagaggaagtcag

SEQ ID NO: 39877 - DNA, 20 bp, Artificial
  CRISPR gRNA sequence
aaagctcagaggaagtcaga

SEQ ID NO: 39878 - DNA, 20 bp, Artificial
  CRISPR gRNA sequence
aagctcagaggaagtcagag

SEQ ID NO: 39879 - DNA, 20 bp, Artificial
  CRISPR gRNA sequence
gctcagaggaagtcagaggg

SEQ ID NO: 39880 - DNA, 20 bp, Artificial
  CRISPR gRNA sequence
agaggaagtcagaggggagt

SEQ ID NO: 39881 - DNA, 20 bp, Artificial
  CRISPR gRNA sequence
aggaagtcagaggggagtca

SEQ ID NO: 39882 - DNA, 20 bp, Artificial
  CRISPR gRNA sequence
ggaagtcagaggggagtcag

SEQ ID NO: 39883 - DNA, 20 bp, Artificial
  CRISPR gRNA sequence
agtcagaggggagtcagagg

SEQ ID NO: 39884 - DNA, 20 bp, Artificial
  CRISPR gRNA sequence
cagaggggagtcagaggaag

SEQ ID NO: 39885 - DNA, 20 bp, Artificial
  CRISPR gRNA sequence
ggagtcagaggaagtggctg

SEQ ID NO: 39886 - DNA, 20 bp, Artificial
  CRISPR gRNA sequence
tcagaggaagtggctgcagc

SEQ ID NO: 39887 - DNA, 20 bp, Artificial
  CRISPR gRNA sequence
agaggaagtggctgcagctg

SEQ ID NO: 39888 - DNA, 20 bp, Artificial
  CRISPR gRNA sequence
gaggaagtggctgcagctgg

SEQ ID NO: 39889 - DNA, 20 bp, Artificial
  CRISPR gRNA sequence
gaagtggctgcagctggagg

SEQ ID NO: 39890 - DNA, 20 bp, Artificial
  CRISPR gRNA sequence
aagtggctgcagctggaggc

SEQ ID NO: 39891 - DNA, 20 bp, Artificial
  CRISPR gRNA sequence
agtggctgcagctggaggca

SEQ ID NO: 39892 - DNA, 20 bp, Artificial
  CRISPR gRNA sequence
gtggctgcagctggaggcag

SEQ ID NO: 39893 - DNA, 20 bp, Artificial
  CRISPR gRNA sequence
tggctgcagctggaggcagg

SEQ ID NO: 39894 - DNA, 20 bp, Artificial
  CRISPR gRNA sequence
tgcagctggaggcaggggga

SEQ ID NO: 39895 - DNA, 20 bp, Artificial
  CRISPR gRNA sequence
gaggcagggggatggaactt

SEQ ID NO: 39896 - DNA, 20 bp, Artificial
  CRISPR gRNA sequence
ggcagggggatggaacttga

SEQ ID NO: 39897 - DNA, 20 bp, Artificial
  CRISPR gRNA sequence
gcagggggatggaacttgag

SEQ ID NO: 39898 - DNA, 20 bp, Artificial
  CRISPR gRNA sequence
tggaacttgagaggtcctcc

SEQ ID NO: 39899 - DNA, 20 bp, Artificial
  CRISPR gRNA sequence
ggaacttgagaggtcctccc

SEQ ID NO: 39900 - DNA, 20 bp, Artificial
  CRISPR gRNA sequence
cttgagaggtcctcccgggc

SEQ ID NO: 39901 - DNA, 20 bp, Artificial
  CRISPR gRNA sequence
ttgagaggtcctcccgggcc

SEQ ID NO: 39902 - DNA, 20 bp, Artificial
  CRISPR gRNA sequence
tgagaggtcctcccgggcca

SEQ ID NO: 39903 - DNA, 20 bp, Artificial
  CRISPR gRNA sequence
gagaggtcctcccgggccag

SEQ ID NO: 39904 - DNA, 20 bp, Artificial
  CRISPR gRNA sequence
cctcccgggccaggggtaaa

SEQ ID NO: 39905 - DNA, 20 bp, Artificial
  CRISPR gRNA sequence
gggccaggggtaaaaagtga

SEQ ID NO: 39906 - DNA, 20 bp, Artificial
  CRISPR gRNA sequence
ggccaggggtaaaaagtgac

SEQ ID NO: 39907 - DNA, 20 bp, Artificial
  CRISPR gRNA sequence
aggggtaaaaagtgacaggc

SEQ ID NO: 39908 - DNA, 20 bp, Artificial
  CRISPR gRNA sequence
ggggtaaaaagtgacaggcc

SEQ ID NO: 39909 - DNA, 20 bp, Artificial
  CRISPR gRNA sequence
aaaaagtgacaggccgggca

SEQ ID NO: 39910 - DNA, 20 bp, Artificial
  CRISPR gRNA sequence
aagtgacaggccgggcacgg

SEQ ID NO: 39911 - DNA, 20 bp, Artificial
  CRISPR gRNA sequence
gtggctcacacctatcatcc

SEQ ID NO: 39912 - DNA, 20 bp, Artificial
  CRISPR gRNA sequence
cacctatcatcccagcactt

SEQ ID NO: 39913 - DNA, 20 bp, Artificial
  CRISPR gRNA sequence
acctatcatcccagcacttt

SEQ ID NO: 39914 - DNA, 20 bp, Artificial
  CRISPR gRNA sequence
tatcatcccagcactttggg

SEQ ID NO: 39915 - DNA, 20 bp, Artificial
  CRISPR gRNA sequence
tcccagcactttgggaagca

SEQ ID NO: 39916 - DNA, 20 bp, Artificial
  CRISPR gRNA sequence
cccagcactttgggaagcaa

SEQ ID NO: 39917 - DNA, 20 bp, Artificial
  CRISPR gRNA sequence
agcactttgggaagcaaagg

SEQ ID NO: 39918 - DNA, 20 bp, Artificial
  CRISPR gRNA sequence
gcactttgggaagcaaaggt

SEQ ID NO: 39919 - DNA, 20 bp, Artificial
  CRISPR gRNA sequence
actttgggaagcaaaggtgg

SEQ ID NO: 39920 - DNA, 20 bp, Artificial
  CRISPR gRNA sequence
ctttgggaagcaaaggtggg

SEQ ID NO: 39921 - DNA, 20 bp, Artificial
  CRISPR gRNA sequence
caaaggtgggaggatcacct

SEQ ID NO: 39922 - DNA, 20 bp, Artificial
  CRISPR gRNA sequence
gtgggaggatcacctgagcc

SEQ ID NO: 39923 - DNA, 20 bp, Artificial
  CRISPR gRNA sequence
ggaggatcacctgagcccag

SEQ ID NO: 39924 - DNA, 20 bp, Artificial
  CRISPR gRNA sequence
tcacctgagcccagaagttc

SEQ ID NO: 39925 - DNA, 20 bp, Artificial
  CRISPR gRNA sequence
tgagcccagaagttcgagac

SEQ ID NO: 39926 - DNA, 20 bp, Artificial
  CRISPR gRNA sequence
agcccagaagttcgagacca

SEQ ID NO: 39927 - DNA, 20 bp, Artificial
  CRISPR gRNA sequence
ccagaagttcgagaccagag

SEQ ID NO: 39928 - DNA, 20 bp, Artificial
  CRISPR gRNA sequence
cgagaccagagtagacaaca

SEQ ID NO: 39929 - DNA, 20 bp, Artificial
  CRISPR gRNA sequence
tacatacttttttttttaat

SEQ ID NO: 39930 - DNA, 20 bp, Artificial
  CRISPR gRNA sequence
tacttttttttttaattagc

SEQ ID NO: 39931 - DNA, 20 bp, Artificial
  CRISPR gRNA sequence
acttttttttttaattagct

SEQ ID NO: 39932 - DNA, 20 bp, Artificial
  CRISPR gRNA sequence
ttttaattagctgggcctga

SEQ ID NO: 39933 - DNA, 20 bp, Artificial
  CRISPR gRNA sequence
ttagctgggcctgatggcac

SEQ ID NO: 39934 - DNA, 20 bp, Artificial
  CRISPR gRNA sequence
atggcacaagcctgtaatcc

SEQ ID NO: 39935 - DNA, 20 bp, Artificial
  CRISPR gRNA sequence
agcctgtaatcccagctact

SEQ ID NO: 39936 - DNA, 20 bp, Artificial
  CRISPR gRNA sequence
gcctgtaatcccagctactc

SEQ ID NO: 39937 - DNA, 20 bp, Artificial
  CRISPR gRNA sequence
ctgtaatcccagctactcag

SEQ ID NO: 39938 - DNA, 20 bp, Artificial
  CRISPR gRNA sequence
tgtaatcccagctactcagg

SEQ ID NO: 39939 - DNA, 20 bp, Artificial
  CRISPR gRNA sequence
cccagctactcaggaggctg

SEQ ID NO: 39940 - DNA, 20 bp, Artificial
  CRISPR gRNA sequence
agctactcaggaggctgaag

SEQ ID NO: 39941 - DNA, 20 bp, Artificial
  CRISPR gRNA sequence
gctactcaggaggctgaagt

SEQ ID NO: 39942 - DNA, 20 bp, Artificial
  CRISPR gRNA sequence
tactcaggaggctgaagtgg

SEQ ID NO: 39943 - DNA, 20 bp, Artificial
  CRISPR gRNA sequence
actcaggaggctgaagtggg

SEQ ID NO: 39944 - DNA, 20 bp, Artificial
  CRISPR gRNA sequence
ctgaagtgggaggattgctt

SEQ ID NO: 39945 - DNA, 20 bp, Artificial
  CRISPR gRNA sequence
gtgggaggattgcttgagcc

SEQ ID NO: 39946 - DNA, 20 bp, Artificial
  CRISPR gRNA sequence
tgggaggattgcttgagccc

SEQ ID NO: 39947 - DNA, 20 bp, Artificial
  CRISPR gRNA sequence
ggaggattgcttgagcccag

SEQ ID NO: 39948 - DNA, 20 bp, Artificial
  CRISPR gRNA sequence
gaggattgcttgagcccagg

SEQ ID NO: 39949 - DNA, 20 bp, Artificial
  CRISPR gRNA sequence
gattgcttgagcccaggagg

SEQ ID NO: 39950 - DNA, 20 bp, Artificial
  CRISPR gRNA sequence
ttgcttgagcccaggaggtg

SEQ ID NO: 39951 - DNA, 20 bp, Artificial
  CRISPR gRNA sequence
tgcttgagcccaggaggtgg

SEQ ID NO: 39952 - DNA, 20 bp, Artificial
  CRISPR gRNA sequence
agcccaggaggtggaggctt

SEQ ID NO: 39953 - DNA, 20 bp, Artificial
  CRISPR gRNA sequence
caggaggtggaggcttcagt

SEQ ID NO: 39954 - DNA, 20 bp, Artificial
  CRISPR gRNA sequence
atgattgcaccactgcacac

SEQ ID NO: 39955 - DNA, 20 bp, Artificial
  CRISPR gRNA sequence
tgcaccactgcacaccagct

SEQ ID NO: 39956 - DNA, 20 bp, Artificial
  CRISPR gRNA sequence
gcaccactgcacaccagctt

SEQ ID NO: 39957 - DNA, 20 bp, Artificial
  CRISPR gRNA sequence
ctgcacaccagcttgggcaa

SEQ ID NO: 39958 - DNA, 20 bp, Artificial
  CRISPR gRNA sequence
accagcttgggcaacagact

SEQ ID NO: 39959 - DNA, 20 bp, Artificial
  CRISPR gRNA sequence
gactgagaccttctctcaaa

SEQ ID NO: 39960 - DNA, 20 bp, Artificial
  CRISPR gRNA sequence
gaccttctctcaaaaagaaa

SEQ ID NO: 39961 - DNA, 20 bp, Artificial
  CRISPR gRNA sequence
ctctcaaaaagaaatagtaa

SEQ ID NO: 39962 - DNA, 20 bp, Artificial
  CRISPR gRNA sequence
tctcaaaaagaaatagtaac

SEQ ID NO: 39963 - DNA, 20 bp, Artificial
  CRISPR gRNA sequence
ctcaaaaagaaatagtaaca

SEQ ID NO: 39964 - DNA, 20 bp, Artificial
  CRISPR gRNA sequence
caaaaagaaatagtaacagg

SEQ ID NO: 39965 - DNA, 20 bp, Artificial
  CRISPR gRNA sequence
tcacccctcttttgtcttca

SEQ ID NO: 39966 - DNA, 20 bp, Artificial
  CRISPR gRNA sequence
tcttttgtcttcacagcctg

SEQ ID NO: 39967 - DNA, 20 bp, Artificial
  CRISPR gRNA sequence
ctgtgatcttcatgtttgcc

SEQ ID NO: 39968 - DNA, 20 bp, Artificial
  CRISPR gRNA sequence
tgtgatcttcatgtttgccc

SEQ ID NO: 39969 - DNA, 20 bp, Artificial
  CRISPR gRNA sequence
tgatcttcatgtttgcccag

SEQ ID NO: 39970 - DNA, 20 bp, Artificial
  CRISPR gRNA sequence
cttcatgtttgcccaggagc

SEQ ID NO: 39971 - DNA, 20 bp, Artificial
  CRISPR gRNA sequence
tcatgtttgcccaggagcca

SEQ ID NO: 39972 - DNA, 20 bp, Artificial
  CRISPR gRNA sequence
catgtttgcccaggagccag

SEQ ID NO: 39973 - DNA, 20 bp, Artificial
  CRISPR gRNA sequence
tgtttgcccaggagccagag

SEQ ID NO: 39974 - DNA, 20 bp, Artificial
  CRISPR gRNA sequence
ttgcccaggagccagaggag

SEQ ID NO: 39975 - DNA, 20 bp, Artificial
  CRISPR gRNA sequence
cccaggagccagaggagcag

SEQ ID NO: 39976 - DNA, 20 bp, Artificial
  CRISPR gRNA sequence
ccaggagccagaggagcaga

SEQ ID NO: 39977 - DNA, 20 bp, Artificial
  CRISPR gRNA sequence
caggagccagaggagcagaa

SEQ ID NO: 39978 - DNA, 20 bp, Artificial
  CRISPR gRNA sequence
aggagccagaggagcagaag

SEQ ID NO: 39979 - DNA, 20 bp, Artificial
  CRISPR gRNA sequence
cagaggagcagaaggggccc

SEQ ID NO: 39980 - DNA, 20 bp, Artificial
  CRISPR gRNA sequence
agaggagcagaaggggcccc

SEQ ID NO: 39981 - DNA, 20 bp, Artificial
  CRISPR gRNA sequence
aggagcagaaggggccccag

SEQ ID NO: 39982 - DNA, 20 bp, Artificial
  CRISPR gRNA sequence
gagcagaaggggccccagga

SEQ ID NO: 39983 - DNA, 20 bp, Artificial
  CRISPR gRNA sequence
agcagaaggggccccaggag

SEQ ID NO: 39984 - DNA, 20 bp, Artificial
  CRISPR gRNA sequence
agaaggggccccaggagagg

SEQ ID NO: 39985 - DNA, 20 bp, Artificial
  CRISPR gRNA sequence
gaaggggccccaggagaggt

SEQ ID NO: 39986 - DNA, 20 bp, Artificial
  CRISPR gRNA sequence
aaggggccccaggagaggta

SEQ ID NO: 39987 - DNA, 20 bp, Artificial
  CRISPR gRNA sequence
tttcaccccaactccatgct

SEQ ID NO: 39988 - DNA, 20 bp, Artificial
  CRISPR gRNA sequence
accccaactccatgctcagt

SEQ ID NO: 39989 - DNA, 20 bp, Artificial
  CRISPR gRNA sequence
ccccaactccatgctcagtc

SEQ ID NO: 39990 - DNA, 20 bp, Artificial
  CRISPR gRNA sequence
cccaactccatgctcagtca

SEQ ID NO: 39991 - DNA, 20 bp, Artificial
  CRISPR gRNA sequence
attcccctctctaccctcca

SEQ ID NO: 39992 - DNA, 20 bp, Artificial
  CRISPR gRNA sequence
ccctctctaccctccacagc

SEQ ID NO: 39993 - DNA, 20 bp, Artificial
  CRISPR gRNA sequence
cctctctaccctccacagct

SEQ ID NO: 39994 - DNA, 20 bp, Artificial
  CRISPR gRNA sequence
ctctaccctccacagctggg

SEQ ID NO: 39995 - DNA, 20 bp, Artificial
  CRISPR gRNA sequence
cctccacagctgggcagtgc

SEQ ID NO: 39996 - DNA, 20 bp, Artificial
  CRISPR gRNA sequence
cacagctgggcagtgccagt

SEQ ID NO: 39997 - DNA, 20 bp, Artificial
  CRISPR gRNA sequence
agtgccagtcagtcaactgc

SEQ ID NO: 39998 - DNA, 20 bp, Artificial
  CRISPR gRNA sequence
gtgccagtcagtcaactgcc

SEQ ID NO: 39999 - DNA, 20 bp, Artificial
  CRISPR gRNA sequence
tgccagtcagtcaactgcca

SEQ ID NO: 40000 - DNA, 20 bp, Artificial
  CRISPR gRNA sequence
agtcaactgccagggtgacc

SEQ ID NO: 40001 - DNA, 20 bp, Artificial
  CRISPR gRNA sequence
gggtgacctggacaaattca

SEQ ID NO: 40002 - DNA, 20 bp, Artificial
  CRISPR gRNA sequence
tgacctggacaaattcacgg

SEQ ID NO: 40003 - DNA, 20 bp, Artificial
  CRISPR gRNA sequence
acctggacaaattcacggaa

SEQ ID NO: 40004 - DNA, 20 bp, Artificial
  CRISPR gRNA sequence
tggacaaattcacggaagag

SEQ ID NO: 40005 - DNA, 20 bp, Artificial
  CRISPR gRNA sequence
ggacaaattcacggaagagc

SEQ ID NO: 40006 - DNA, 20 bp, Artificial
  CRISPR gRNA sequence
caaattcacggaagagcggg

SEQ ID NO: 40007 - DNA, 20 bp, Artificial
  CRISPR gRNA sequence
ttcacggaagagcgggaagt

SEQ ID NO: 40008 - DNA, 20 bp, Artificial
  CRISPR gRNA sequence
acggaagagcgggaagtgag

SEQ ID NO: 40009 - DNA, 20 bp, Artificial
  CRISPR gRNA sequence
cggaagagcgggaagtgagc

SEQ ID NO: 40010 - DNA, 20 bp, Artificial
  CRISPR gRNA sequence
gagcgggaagtgagcaggct

SEQ ID NO: 40011 - DNA, 20 bp, Artificial
  CRISPR gRNA sequence
ggaagtgagcaggcttggca

SEQ ID NO: 40012 - DNA, 20 bp, Artificial
  CRISPR gRNA sequence
gaagtgagcaggcttggcaa

SEQ ID NO: 40013 - DNA, 20 bp, Artificial
  CRISPR gRNA sequence
agcaggcttggcaaaggatg

SEQ ID NO: 40014 - DNA, 20 bp, Artificial
  CRISPR gRNA sequence
tggcaaaggatgcagcccca

SEQ ID NO: 40015 - DNA, 20 bp, Artificial
  CRISPR gRNA sequence
ggcaaaggatgcagccccaa

SEQ ID NO: 40016 - DNA, 20 bp, Artificial
  CRISPR gRNA sequence
gcaaaggatgcagccccaaa

SEQ ID NO: 40017 - DNA, 20 bp, Artificial
  CRISPR gRNA sequence
caaaggatgcagccccaaag

SEQ ID NO: 40018 - DNA, 20 bp, Artificial
  CRISPR gRNA sequence
aaaggatgcagccccaaagg

SEQ ID NO: 40019 - DNA, 20 bp, Artificial
  CRISPR gRNA sequence
aggatgcagccccaaagggg

SEQ ID NO: 40020 - DNA, 20 bp, Artificial
  CRISPR gRNA sequence
ggatgcagccccaaaggggg

SEQ ID NO: 40021 - DNA, 20 bp, Artificial
  CRISPR gRNA sequence
gatgcagccccaaaggggga

SEQ ID NO: 40022 - DNA, 20 bp, Artificial
  CRISPR gRNA sequence
aaagggggagggtccaaatc

SEQ ID NO: 40023 - DNA, 20 bp, Artificial
  CRISPR gRNA sequence
cagaccacctccgcctctca

SEQ ID NO: 40024 - DNA, 20 bp, Artificial
  CRISPR gRNA sequence
ccgcctctcatggtgcctga

SEQ ID NO: 40025 - DNA, 20 bp, Artificial
  CRISPR gRNA sequence
cgcctctcatggtgcctgaa

SEQ ID NO: 40026 - DNA, 20 bp, Artificial
  CRISPR gRNA sequence
cctctcatggtgcctgaaag

SEQ ID NO: 40027 - DNA, 20 bp, Artificial
  CRISPR gRNA sequence
atggtgcctgaaaggagccc

SEQ ID NO: 40028 - DNA, 20 bp, Artificial
  CRISPR gRNA sequence
ctgaaaggagccccagtgtg

SEQ ID NO: 40029 - DNA, 20 bp, Artificial
  CRISPR gRNA sequence
tgaaaggagccccagtgtgt

SEQ ID NO: 40030 - DNA, 20 bp, Artificial
  CRISPR gRNA sequence
gagccccagtgtgtaggata

SEQ ID NO: 40031 - DNA, 20 bp, Artificial
  CRISPR gRNA sequence
cccagtgtgtaggatataga

SEQ ID NO: 40032 - DNA, 20 bp, Artificial
  CRISPR gRNA sequence
agtgtgtaggatatagacag

SEQ ID NO: 40033 - DNA, 20 bp, Artificial
  CRISPR gRNA sequence
gtgtgtaggatatagacagc

SEQ ID NO: 40034 - DNA, 20 bp, Artificial
  CRISPR gRNA sequence
gtaggatatagacagcaggc

SEQ ID NO: 40035 - DNA, 20 bp, Artificial
  CRISPR gRNA sequence
taggatatagacagcaggcc

SEQ ID NO: 40036 - DNA, 20 bp, Artificial
  CRISPR gRNA sequence
aggatatagacagcaggcca

SEQ ID NO: 40037 - DNA, 20 bp, Artificial
  CRISPR gRNA sequence
atatagacagcaggccaggg

SEQ ID NO: 40038 - DNA, 20 bp, Artificial
  CRISPR gRNA sequence
tatagacagcaggccagggc

SEQ ID NO: 40039 - DNA, 20 bp, Artificial
  CRISPR gRNA sequence
tagacagcaggccagggcag

SEQ ID NO: 40040 - DNA, 20 bp, Artificial
  CRISPR gRNA sequence
cagcaggccagggcaggagt

SEQ ID NO: 40041 - DNA, 20 bp, Artificial
  CRISPR gRNA sequence
agcaggccagggcaggagtt

SEQ ID NO: 40042 - DNA, 20 bp, Artificial
  CRISPR gRNA sequence
aggccagggcaggagttggg

SEQ ID NO: 40043 - DNA, 20 bp, Artificial
  CRISPR gRNA sequence
cagggcaggagttgggtagc

SEQ ID NO: 40044 - DNA, 20 bp, Artificial
  CRISPR gRNA sequence
gggcaggagttgggtagcca

SEQ ID NO: 40045 - DNA, 20 bp, Artificial
  CRISPR gRNA sequence
ggcaggagttgggtagccag

SEQ ID NO: 40046 - DNA, 20 bp, Artificial
  CRISPR gRNA sequence
gcaggagttgggtagccaga

SEQ ID NO: 40047 - DNA, 20 bp, Artificial
  CRISPR gRNA sequence
caggagttgggtagccagag

SEQ ID NO: 40048 - DNA, 20 bp, Artificial
  CRISPR gRNA sequence
aggagttgggtagccagagg

SEQ ID NO: 40049 - DNA, 20 bp, Artificial
  CRISPR gRNA sequence
gggtagccagagggggattc

SEQ ID NO: 40050 - DNA, 20 bp, Artificial
  CRISPR gRNA sequence
ggtagccagagggggattcc

SEQ ID NO: 40051 - DNA, 20 bp, Artificial
  CRISPR gRNA sequence
tagccagagggggattccgg

SEQ ID NO: 40052 - DNA, 20 bp, Artificial
  CRISPR gRNA sequence
agagggggattccgggagac

SEQ ID NO: 40053 - DNA, 20 bp, Artificial
  CRISPR gRNA sequence
agggggattccgggagacta

SEQ ID NO: 40054 - DNA, 20 bp, Artificial
  CRISPR gRNA sequence
tccgggagactagagccctc

SEQ ID NO: 40055 - DNA, 20 bp, Artificial
  CRISPR gRNA sequence
agagccctccagcttaaacc

SEQ ID NO: 40056 - DNA, 20 bp, Artificial
  CRISPR gRNA sequence
gagccctccagcttaaaccc

SEQ ID NO: 40057 - DNA, 20 bp, Artificial
  CRISPR gRNA sequence
agccctccagcttaaaccca

SEQ ID NO: 40058 - DNA, 20 bp, Artificial
  CRISPR gRNA sequence
gccctccagcttaaacccag

SEQ ID NO: 40059 - DNA, 20 bp, Artificial
  CRISPR gRNA sequence
cttaaacccaggggattgcc

SEQ ID NO: 40060 - DNA, 20 bp, Artificial
  CRISPR gRNA sequence
ccaggggattgcctggcctg

SEQ ID NO: 40061 - DNA, 20 bp, Artificial
  CRISPR gRNA sequence
gattgcctggcctgtagctc

SEQ ID NO: 40062 - DNA, 20 bp, Artificial
  CRISPR gRNA sequence
ctggcctgtagctctggtcc

SEQ ID NO: 40063 - DNA, 20 bp, Artificial
  CRISPR gRNA sequence
cctgtagctctggtcctggt

SEQ ID NO: 40064 - DNA, 20 bp, Artificial
  CRISPR gRNA sequence
cttctgtatccctttcacac

SEQ ID NO: 40065 - DNA, 20 bp, Artificial
  CRISPR gRNA sequence
ttctgtatccctttcacaca

SEQ ID NO: 40066 - DNA, 20 bp, Artificial
  CRISPR gRNA sequence
cctttcacacaaggacccat

SEQ ID NO: 40067 - DNA, 20 bp, Artificial
  CRISPR gRNA sequence
ctttcacacaaggacccatt

SEQ ID NO: 40068 - DNA, 20 bp, Artificial
  CRISPR gRNA sequence
tttcacacaaggacccatta

SEQ ID NO: 40069 - DNA, 20 bp, Artificial
  CRISPR gRNA sequence
acaaggacccattagggtcc

SEQ ID NO: 40070 - DNA, 20 bp, Artificial
  CRISPR gRNA sequence
attagggtcctggattgccc

SEQ ID NO: 40071 - DNA, 20 bp, Artificial
  CRISPR gRNA sequence
ggtcctggattgccccagcc

SEQ ID NO: 40072 - DNA, 20 bp, Artificial
  CRISPR gRNA sequence
gattgccccagcctagcgca

SEQ ID NO: 40073 - DNA, 20 bp, Artificial
  CRISPR gRNA sequence
attgccccagcctagcgcat

SEQ ID NO: 40074 - DNA, 20 bp, Artificial
  CRISPR gRNA sequence
gccccagcctagcgcatggg

SEQ ID NO: 40075 - DNA, 20 bp, Artificial
  CRISPR gRNA sequence
cccagcctagcgcatgggta

SEQ ID NO: 40076 - DNA, 20 bp, Artificial
  CRISPR gRNA sequence
ctagcgcatgggtagagact

SEQ ID NO: 40077 - DNA, 20 bp, Artificial
  CRISPR gRNA sequence
gagactcagctctttgctcc

SEQ ID NO: 40078 - DNA, 20 bp, Artificial
  CRISPR gRNA sequence
gactcagctctttgctcccg

SEQ ID NO: 40079 - DNA, 20 bp, Artificial
  CRISPR gRNA sequence
cccacccacaatctcttctg

SEQ ID NO: 40080 - DNA, 20 bp, Artificial
  CRISPR gRNA sequence
cacccacaatctcttctgta

SEQ ID NO: 40081 - DNA, 20 bp, Artificial
  CRISPR gRNA sequence
acaatctcttctgtagagtc

SEQ ID NO: 40082 - DNA, 20 bp, Artificial
  CRISPR gRNA sequence
ctgtagagtctggactactg

SEQ ID NO: 40083 - DNA, 20 bp, Artificial
  CRISPR gRNA sequence
tgtagagtctggactactga

SEQ ID NO: 40084 - DNA, 20 bp, Artificial
  CRISPR gRNA sequence
gactactgaaggctcgattc

SEQ ID NO: 40085 - DNA, 20 bp, Artificial
  CRISPR gRNA sequence
actgaaggctcgattccagc

SEQ ID NO: 40086 - DNA, 20 bp, Artificial
  CRISPR gRNA sequence
ctgaaggctcgattccagct

SEQ ID NO: 40087 - DNA, 20 bp, Artificial
  CRISPR gRNA sequence
tgaaggctcgattccagctg

SEQ ID NO: 40088 - DNA, 20 bp, Artificial
  CRISPR gRNA sequence
agctggggctgacatctctg

SEQ ID NO: 40089 - DNA, 20 bp, Artificial
  CRISPR gRNA sequence
gggctgacatctctgaagca

SEQ ID NO: 40090 - DNA, 20 bp, Artificial
  CRISPR gRNA sequence
gacatctctgaagcacagat

SEQ ID NO: 40091 - DNA, 20 bp, Artificial
  CRISPR gRNA sequence
acatctctgaagcacagatg

SEQ ID NO: 40092 - DNA, 20 bp, Artificial
  CRISPR gRNA sequence
atctctgaagcacagatgag

SEQ ID NO: 40093 - DNA, 20 bp, Artificial
  CRISPR gRNA sequence
tctctgaagcacagatgagg

SEQ ID NO: 40094 - DNA, 20 bp, Artificial
  CRISPR gRNA sequence
tctgaagcacagatgaggag

SEQ ID NO: 40095 - DNA, 20 bp, Artificial
  CRISPR gRNA sequence
ctgaagcacagatgaggagg

SEQ ID NO: 40096 - DNA, 20 bp, Artificial
  CRISPR gRNA sequence
gcacagatgaggaggaggat

SEQ ID NO: 40097 - DNA, 20 bp, Artificial
  CRISPR gRNA sequence
gaggatgagattaatgataa

SEQ ID NO: 40098 - DNA, 20 bp, Artificial
  CRISPR gRNA sequence
gatgagattaatgataatag

SEQ ID NO: 40099 - DNA, 20 bp, Artificial
  CRISPR gRNA sequence
gattaatgataatagcagtc

SEQ ID NO: 40100 - DNA, 20 bp, Artificial
  CRISPR gRNA sequence
attaatgataatagcagtca

SEQ ID NO: 40101 - DNA, 20 bp, Artificial
  CRISPR gRNA sequence
aatagcagtcaaggtcaatt

SEQ ID NO: 40102 - DNA, 20 bp, Artificial
  CRISPR gRNA sequence
gtacttgccatgtatgcacc

SEQ ID NO: 40103 - DNA, 20 bp, Artificial
  CRISPR gRNA sequence
tatgcaccaagcaccaaact

SEQ ID NO: 40104 - DNA, 20 bp, Artificial
  CRISPR gRNA sequence
atgcaccaagcaccaaacta

SEQ ID NO: 40105 - DNA, 20 bp, Artificial
  CRISPR gRNA sequence
caccaagcaccaaactaagg

SEQ ID NO: 40106 - DNA, 20 bp, Artificial
  CRISPR gRNA sequence
aaactaaggcagttcacata

SEQ ID NO: 40107 - DNA, 20 bp, Artificial
  CRISPR gRNA sequence
ttcacatacagtctcccatt

SEQ ID NO: 40108 - DNA, 20 bp, Artificial
  CRISPR gRNA sequence
cacatacagtctcccattga

SEQ ID NO: 40109 - DNA, 20 bp, Artificial
  CRISPR gRNA sequence
acatacagtctcccattgag

SEQ ID NO: 40110 - DNA, 20 bp, Artificial
  CRISPR gRNA sequence
ttgagaggctgtgatttgtc

SEQ ID NO: 40111 - DNA, 20 bp, Artificial
  CRISPR gRNA sequence
tgagaggctgtgatttgtcc

SEQ ID NO: 40112 - DNA, 20 bp, Artificial
  CRISPR gRNA sequence
gagaggctgtgatttgtcca

SEQ ID NO: 40113 - DNA, 20 bp, Artificial
  CRISPR gRNA sequence
tttgtccagggtcacacaac

SEQ ID NO: 40114 - DNA, 20 bp, Artificial
  CRISPR gRNA sequence
ttgtccagggtcacacaacc

SEQ ID NO: 40115 - DNA, 20 bp, Artificial
  CRISPR gRNA sequence
tccagggtcacacaaccagg

SEQ ID NO: 40116 - DNA, 20 bp, Artificial
  CRISPR gRNA sequence
agggtcacacaaccaggaag

SEQ ID NO: 40117 - DNA, 20 bp, Artificial
  CRISPR gRNA sequence
ggtcacacaaccaggaagtg

SEQ ID NO: 40118 - DNA, 20 bp, Artificial
  CRISPR gRNA sequence
cacacaaccaggaagtggag

SEQ ID NO: 40119 - DNA, 20 bp, Artificial
  CRISPR gRNA sequence
aggaagtggagaagccaaat

SEQ ID NO: 40120 - DNA, 20 bp, Artificial
  CRISPR gRNA sequence
ggagaagccaaattggcacc

SEQ ID NO: 40121 - DNA, 20 bp, Artificial
  CRISPR gRNA sequence
gagaagccaaattggcacca

SEQ ID NO: 40122 - DNA, 20 bp, Artificial
  CRISPR gRNA sequence
caccaaggtctgattgactc

SEQ ID NO: 40123 - DNA, 20 bp, Artificial
  CRISPR gRNA sequence
accaaggtctgattgactct

SEQ ID NO: 40124 - DNA, 20 bp, Artificial
  CRISPR gRNA sequence
aaggtctgattgactctagg

SEQ ID NO: 40125 - DNA, 20 bp, Artificial
  CRISPR gRNA sequence
ggtctgattgactctaggtg

SEQ ID NO: 40126 - DNA, 20 bp, Artificial
  CRISPR gRNA sequence
gtctgattgactctaggtgg

SEQ ID NO: 40127 - DNA, 20 bp, Artificial
  CRISPR gRNA sequence
gattgactctaggtggagga

SEQ ID NO: 40128 - DNA, 20 bp, Artificial
  CRISPR gRNA sequence
attgactctaggtggaggat

SEQ ID NO: 40129 - DNA, 20 bp, Artificial
  CRISPR gRNA sequence
ttgactctaggtggaggata

SEQ ID NO: 40130 - DNA, 20 bp, Artificial
  CRISPR gRNA sequence
aggtggaggatagggctcga

SEQ ID NO: 40131 - DNA, 20 bp, Artificial
  CRISPR gRNA sequence
tggaggatagggctcgatgg

SEQ ID NO: 40132 - DNA, 20 bp, Artificial
  CRISPR gRNA sequence
aggatagggctcgatggtgg

SEQ ID NO: 40133 - DNA, 20 bp, Artificial
  CRISPR gRNA sequence
ggatagggctcgatggtgga

SEQ ID NO: 40134 - DNA, 20 bp, Artificial
  CRISPR gRNA sequence
agggctcgatggtggaaggc

SEQ ID NO: 40135 - DNA, 20 bp, Artificial
  CRISPR gRNA sequence
gggctcgatggtggaaggcc

SEQ ID NO: 40136 - DNA, 20 bp, Artificial
  CRISPR gRNA sequence
cgatggtggaaggccaggct

SEQ ID NO: 40137 - DNA, 20 bp, Artificial
  CRISPR gRNA sequence
gatggtggaaggccaggctg

SEQ ID NO: 40138 - DNA, 20 bp, Artificial
  CRISPR gRNA sequence
gtggaaggccaggctgagga

SEQ ID NO: 40139 - DNA, 20 bp, Artificial
  CRISPR gRNA sequence
gccaggctgaggatggattc

SEQ ID NO: 40140 - DNA, 20 bp, Artificial
  CRISPR gRNA sequence
caggctgaggatggattctg

SEQ ID NO: 40141 - DNA, 20 bp, Artificial
  CRISPR gRNA sequence
ctgaggatggattctggaga

SEQ ID NO: 40142 - DNA, 20 bp, Artificial
  CRISPR gRNA sequence
aggatggattctggagatgg

SEQ ID NO: 40143 - DNA, 20 bp, Artificial
  CRISPR gRNA sequence
gattctggagatggcggaca

SEQ ID NO: 40144 - DNA, 20 bp, Artificial
  CRISPR gRNA sequence
tggcggacatggcctttgct

SEQ ID NO: 40145 - DNA, 20 bp, Artificial
  CRISPR gRNA sequence
gacatggcctttgctcagcc

SEQ ID NO: 40146 - DNA, 20 bp, Artificial
  CRISPR gRNA sequence
gcctttgctcagcctggcct

SEQ ID NO: 40147 - DNA, 20 bp, Artificial
  CRISPR gRNA sequence
tggccttggtgatgtccctc

SEQ ID NO: 40148 - DNA, 20 bp, Artificial
  CRISPR gRNA sequence
ggccttggtgatgtccctcc

SEQ ID NO: 40149 - DNA, 20 bp, Artificial
  CRISPR gRNA sequence
gccttggtgatgtccctcca

SEQ ID NO: 40150 - DNA, 20 bp, Artificial
  CRISPR gRNA sequence
tccagggctgcatttcttga

SEQ ID NO: 40151 - DNA, 20 bp, Artificial
  CRISPR gRNA sequence
ttcttgacagcctcatgctc

SEQ ID NO: 40152 - DNA, 20 bp, Artificial
  CRISPR gRNA sequence
tcatgctccagatgccctct

SEQ ID NO: 40153 - DNA, 20 bp, Artificial
  CRISPR gRNA sequence
atgccctctgagctgcctct

SEQ ID NO: 40154 - DNA, 20 bp, Artificial
  CRISPR gRNA sequence
gagctgcctctgagctcccg

SEQ ID NO: 40155 - DNA, 20 bp, Artificial
  CRISPR gRNA sequence
agctgcctctgagctcccga

SEQ ID NO: 40156 - DNA, 20 bp, Artificial
  CRISPR gRNA sequence
cctctgagctcccgaaggat

SEQ ID NO: 40157 - DNA, 20 bp, Artificial
  CRISPR gRNA sequence
ctctgagctcccgaaggatg

SEQ ID NO: 40158 - DNA, 20 bp, Artificial
  CRISPR gRNA sequence
agctcccgaaggatgaggta

SEQ ID NO: 40159 - DNA, 20 bp, Artificial
  CRISPR gRNA sequence
cgaaggatgaggtacagtga

SEQ ID NO: 40160 - DNA, 20 bp, Artificial
  CRISPR gRNA sequence
tgaggtacagtgatggcctc

SEQ ID NO: 40161 - DNA, 20 bp, Artificial
  CRISPR gRNA sequence
tccagccctgtgtgtgattc

SEQ ID NO: 40162 - DNA, 20 bp, Artificial
  CRISPR gRNA sequence
gccccctcccttcccctgct

SEQ ID NO: 40163 - DNA, 20 bp, Artificial
  CRISPR gRNA sequence
cccctcccttcccctgctca

SEQ ID NO: 40164 - DNA, 20 bp, Artificial
  CRISPR gRNA sequence
cctgctcccaaacctgtgcc

SEQ ID NO: 40165 - DNA, 20 bp, Artificial
  CRISPR gRNA sequence
ctgctcccaaacctgtgccc

SEQ ID NO: 40166 - DNA, 20 bp, Artificial
  CRISPR gRNA sequence
caggccccacatgctccctg

SEQ ID NO: 40167 - DNA, 20 bp, Artificial
  CRISPR gRNA sequence
aggccccacatgctccctga

SEQ ID NO: 40168 - DNA, 20 bp, Artificial
  CRISPR gRNA sequence
gacacctgacctgctgtgtc

SEQ ID NO: 40169 - DNA, 20 bp, Artificial
  CRISPR gRNA sequence
acacctgacctgctgtgtcc

SEQ ID NO: 40170 - DNA, 20 bp, Artificial
  CRISPR gRNA sequence
cacctgacctgctgtgtcca

SEQ ID NO: 40171 - DNA, 20 bp, Artificial
  CRISPR gRNA sequence
acctgacctgctgtgtccag

SEQ ID NO: 40172 - DNA, 20 bp, Artificial
  CRISPR gRNA sequence
cctgctgtgtccaggggtca

SEQ ID NO: 40173 - DNA, 20 bp, Artificial
  CRISPR gRNA sequence
tgtgtccaggggtcatggcc

SEQ ID NO: 40174 - DNA, 20 bp, Artificial
  CRISPR gRNA sequence
tacctcctacctcccctgcc

SEQ ID NO: 40175 - DNA, 20 bp, Artificial
  CRISPR gRNA sequence
ctcccctgcccagcccaccc

SEQ ID NO: 40176 - DNA, 20 bp, Artificial
  CRISPR gRNA sequence
cctgcccagcccaccccaga

SEQ ID NO: 40177 - DNA, 20 bp, Artificial
  CRISPR gRNA sequence
ctgcccagcccaccccagac

SEQ ID NO: 40178 - DNA, 20 bp, Artificial
  CRISPR gRNA sequence
tgcccagcccaccccagaca

SEQ ID NO: 40179 - DNA, 20 bp, Artificial
  CRISPR gRNA sequence
ccaccccagacagggctcac

SEQ ID NO: 40180 - DNA, 20 bp, Artificial
  CRISPR gRNA sequence
caccccagacagggctcaca

SEQ ID NO: 40181 - DNA, 20 bp, Artificial
  CRISPR gRNA sequence
cccagacagggctcacaagg

SEQ ID NO: 40182 - DNA, 20 bp, Artificial
  CRISPR gRNA sequence
gccccgtcaaccaccttccc

SEQ ID NO: 40183 - DNA, 20 bp, Artificial
  CRISPR gRNA sequence
gtcaaccaccttcccaagcc

SEQ ID NO: 40184 - DNA, 20 bp, Artificial
  CRISPR gRNA sequence
tcaaccaccttcccaagccc

SEQ ID NO: 40185 - DNA, 20 bp, Artificial
  CRISPR gRNA sequence
aaccaccttcccaagcccag

SEQ ID NO: 40186 - DNA, 20 bp, Artificial
  CRISPR gRNA sequence
ccaggagaccccactcccct

SEQ ID NO: 40187 - DNA, 20 bp, Artificial
  CRISPR gRNA sequence
ccccttagctccctgacccc

SEQ ID NO: 40188 - DNA, 20 bp, Artificial
  CRISPR gRNA sequence
cttagctccctgacccccag

SEQ ID NO: 40189 - DNA, 20 bp, Artificial
  CRISPR gRNA sequence
ctccctgacccccagcagct

SEQ ID NO: 40190 - DNA, 20 bp, Artificial
  CRISPR gRNA sequence
tccctgacccccagcagctg

SEQ ID NO: 40191 - DNA, 20 bp, Artificial
  CRISPR gRNA sequence
ccctgacccccagcagctga

SEQ ID NO: 40192 - DNA, 20 bp, Artificial
  CRISPR gRNA sequence
cctgacccccagcagctgag

SEQ ID NO: 40193 - DNA, 20 bp, Artificial
  CRISPR gRNA sequence
ccccagcagctgaggggttg

SEQ ID NO: 40194 - DNA, 20 bp, Artificial
  CRISPR gRNA sequence
ccagcagctgaggggttgtg

SEQ ID NO: 40195 - DNA, 20 bp, Artificial
  CRISPR gRNA sequence
ggggttgtggagactctgaa

SEQ ID NO: 40196 - DNA, 20 bp, Artificial
  CRISPR gRNA sequence
ggttgtggagactctgaaaa

SEQ ID NO: 40197 - DNA, 20 bp, Artificial
  CRISPR gRNA sequence
gttgtggagactctgaaaag

SEQ ID NO: 40198 - DNA, 20 bp, Artificial
  CRISPR gRNA sequence
ggagactctgaaaagaggtg

SEQ ID NO: 40199 - DNA, 20 bp, Artificial
  CRISPR gRNA sequence
gagactctgaaaagaggtga

SEQ ID NO: 40200 - DNA, 20 bp, Artificial
  CRISPR gRNA sequence
agactctgaaaagaggtgaa

SEQ ID NO: 40201 - DNA, 20 bp, Artificial
  CRISPR gRNA sequence
gactctgaaaagaggtgaag

SEQ ID NO: 40202 - DNA, 20 bp, Artificial
  CRISPR gRNA sequence
ctctgaaaagaggtgaaggg

SEQ ID NO: 40203 - DNA, 20 bp, Artificial
  CRISPR gRNA sequence
aaagaggtgaaggggagcac

SEQ ID NO: 40204 - DNA, 20 bp, Artificial
  CRISPR gRNA sequence
aagaggtgaaggggagcact

SEQ ID NO: 40205 - DNA, 20 bp, Artificial
  CRISPR gRNA sequence
ggctccttctgtcatgatcc

SEQ ID NO: 40206 - DNA, 20 bp, Artificial
  CRISPR gRNA sequence
tctgtcatgatcctggtgcc

SEQ ID NO: 40207 - DNA, 20 bp, Artificial
  CRISPR gRNA sequence
ctgtcatgatcctggtgcct

SEQ ID NO: 40208 - DNA, 20 bp, Artificial
  CRISPR gRNA sequence
atgatcctggtgcctgggcc

SEQ ID NO: 40209 - DNA, 20 bp, Artificial
  CRISPR gRNA sequence
tgatcctggtgcctgggcct

SEQ ID NO: 40210 - DNA, 20 bp, Artificial
  CRISPR gRNA sequence
gatcctggtgcctgggcctg

SEQ ID NO: 40211 - DNA, 20 bp, Artificial
  CRISPR gRNA sequence
atcctggtgcctgggcctgg

SEQ ID NO: 40212 - DNA, 20 bp, Artificial
  CRISPR gRNA sequence
ctgggcctgggggctcccat

SEQ ID NO: 40213 - DNA, 20 bp, Artificial
  CRISPR gRNA sequence
actcttccccccttctctct

SEQ ID NO: 40214 - DNA, 20 bp, Artificial
  CRISPR gRNA sequence
atcgtgtatttctgttttat

SEQ ID NO: 40215 - DNA, 20 bp, Artificial
  CRISPR gRNA sequence
agtttatttaactgttattt

SEQ ID NO: 40216 - DNA, 20 bp, Artificial
  CRISPR gRNA sequence
ctgatctgctctctctctct

SEQ ID NO: 40217 - DNA, 20 bp, Artificial
  CRISPR gRNA sequence
tgatctgctctctctctctg

SEQ ID NO: 40218 - DNA, 20 bp, Artificial
  CRISPR gRNA sequence
tctctgaggtctctgtgcct

SEQ ID NO: 40219 - DNA, 20 bp, Artificial
  CRISPR gRNA sequence
tgcctatatgtgacatcctg

SEQ ID NO: 40220 - DNA, 20 bp, Artificial
  CRISPR gRNA sequence
gcctatatgtgacatcctgt

SEQ ID NO: 40221 - DNA, 20 bp, Artificial
  CRISPR gRNA sequence
cctgtgggtgtcgtgtgtgt

SEQ ID NO: 40222 - DNA, 20 bp, Artificial
  CRISPR gRNA sequence
tccctctttgtccgtctgtc

SEQ ID NO: 40223 - DNA, 20 bp, Artificial
  CRISPR gRNA sequence
ccctctttgtccgtctgtct

SEQ ID NO: 40224 - DNA, 20 bp, Artificial
  CRISPR gRNA sequence
ttgtccgtctgtctaggtgc

SEQ ID NO: 40225 - DNA, 20 bp, Artificial
  CRISPR gRNA sequence
tctaggtgccagatacatcc

SEQ ID NO: 40226 - DNA, 20 bp, Artificial
  CRISPR gRNA sequence
cccagtccctcctctcctgc

SEQ ID NO: 40227 - DNA, 20 bp, Artificial
  CRISPR gRNA sequence
tcattctctgcctctgtgtc

SEQ ID NO: 40228 - DNA, 20 bp, Artificial
  CRISPR gRNA sequence
cattctctgcctctgtgtct

SEQ ID NO: 40229 - DNA, 20 bp, Artificial
  CRISPR gRNA sequence
attctctgcctctgtgtctg

SEQ ID NO: 40230 - DNA, 20 bp, Artificial
  CRISPR gRNA sequence
ttctctgcctctgtgtctgg

SEQ ID NO: 40231 - DNA, 20 bp, Artificial
  CRISPR gRNA sequence
tctctgcctctgtgtctggg

SEQ ID NO: 40232 - DNA, 20 bp, Artificial
  CRISPR gRNA sequence
ctgcctctgtgtctgggggg

SEQ ID NO: 40233 - DNA, 20 bp, Artificial
  CRISPR gRNA sequence
tgcctctgtgtctggggggt

SEQ ID NO: 40234 - DNA, 20 bp, Artificial
  CRISPR gRNA sequence
tctgtgtctggggggtggga

SEQ ID NO: 40235 - DNA, 20 bp, Artificial
  CRISPR gRNA sequence
gtgtctggggggtgggaaag

SEQ ID NO: 40236 - DNA, 20 bp, Artificial
  CRISPR gRNA sequence
ggctccttcccgcctctgtt

SEQ ID NO: 40237 - DNA, 20 bp, Artificial
  CRISPR gRNA sequence
tccttcccgcctctgttcag

SEQ ID NO: 40238 - DNA, 20 bp, Artificial
  CRISPR gRNA sequence
ccttcccgcctctgttcagt

SEQ ID NO: 40239 - DNA, 20 bp, Artificial
  CRISPR gRNA sequence
cttcccgcctctgttcagtg

SEQ ID NO: 40240 - DNA, 20 bp, Artificial
  CRISPR gRNA sequence
cctctgttcagtggggcatg

SEQ ID NO: 40241 - DNA, 20 bp, Artificial
  CRISPR gRNA sequence
cagcactgtgtttttgtccc

SEQ ID NO: 40242 - DNA, 20 bp, Artificial
  CRISPR gRNA sequence
agcactgtgtttttgtccct

SEQ ID NO: 40243 - DNA, 20 bp, Artificial
  CRISPR gRNA sequence
actgtgtttttgtccctggg

SEQ ID NO: 40244 - DNA, 20 bp, Artificial
  CRISPR gRNA sequence
ctgtgtttttgtccctgggc

SEQ ID NO: 40245 - DNA, 20 bp, Artificial
  CRISPR gRNA sequence
ctgggcaggctgacacattg

SEQ ID NO: 40246 - DNA, 20 bp, Artificial
  CRISPR gRNA sequence
gctgacacattgtggcctcc

SEQ ID NO: 40247 - DNA, 20 bp, Artificial
  CRISPR gRNA sequence
cacattgtggcctccaagaa

SEQ ID NO: 40248 - DNA, 20 bp, Artificial
  CRISPR gRNA sequence
tggcctccaagaaaagcacc

SEQ ID NO: 40249 - DNA, 20 bp, Artificial
  CRISPR gRNA sequence
gcctccaagaaaagcaccta

SEQ ID NO: 40250 - DNA, 20 bp, Artificial
  CRISPR gRNA sequence
tccaagaaaagcacctagag

SEQ ID NO: 40251 - DNA, 20 bp, Artificial
  CRISPR gRNA sequence
agcacctagagcagctctgc

SEQ ID NO: 40252 - DNA, 20 bp, Artificial
  CRISPR gRNA sequence
gcacctagagcagctctgca

SEQ ID NO: 40253 - DNA, 20 bp, Artificial
  CRISPR gRNA sequence
agagcagctctgcaaggctc

SEQ ID NO: 40254 - DNA, 20 bp, Artificial
  CRISPR gRNA sequence
gagcagctctgcaaggctct

SEQ ID NO: 40255 - DNA, 20 bp, Artificial
  CRISPR gRNA sequence
gcagctctgcaaggctctgg

SEQ ID NO: 40256 - DNA, 20 bp, Artificial
  CRISPR gRNA sequence
cagctctgcaaggctctggg

SEQ ID NO: 40257 - DNA, 20 bp, Artificial
  CRISPR gRNA sequence
ctctgcaaggctctgggagg

SEQ ID NO: 40258 - DNA, 20 bp, Artificial
  CRISPR gRNA sequence
ctgggaggaagctgccacct

SEQ ID NO: 40259 - DNA, 20 bp, Artificial
  CRISPR gRNA sequence
acctcggtcacctccacctc

SEQ ID NO: 40260 - DNA, 20 bp, Artificial
  CRISPR gRNA sequence
cggtcacctccacctcgagt

SEQ ID NO: 40261 - DNA, 20 bp, Artificial
  CRISPR gRNA sequence
tcacctccacctcgagtgag

SEQ ID NO: 40262 - DNA, 20 bp, Artificial
  CRISPR gRNA sequence
cgagtgagtggtttgtgtgt

SEQ ID NO: 40263 - DNA, 20 bp, Artificial
  CRISPR gRNA sequence
gtgagtggtttgtgtgttgg

SEQ ID NO: 40264 - DNA, 20 bp, Artificial
  CRISPR gRNA sequence
tgagtggtttgtgtgttgga

SEQ ID NO: 40265 - DNA, 20 bp, Artificial
  CRISPR gRNA sequence
gtggtttgtgtgttggaagg

SEQ ID NO: 40266 - DNA, 20 bp, Artificial
  CRISPR gRNA sequence
tggtttgtgtgttggaaggt

SEQ ID NO: 40267 - DNA, 20 bp, Artificial
  CRISPR gRNA sequence
tttgtgtgttggaaggtggg

SEQ ID NO: 40268 - DNA, 20 bp, Artificial
  CRISPR gRNA sequence
ttgtgtgttggaaggtgggt

SEQ ID NO: 40269 - DNA, 20 bp, Artificial
  CRISPR gRNA sequence
tgtgttggaaggtgggtggg

SEQ ID NO: 40270 - DNA, 20 bp, Artificial
  CRISPR gRNA sequence
gtgttggaaggtgggtgggt

SEQ ID NO: 40271 - DNA, 20 bp, Artificial
  CRISPR gRNA sequence
tgttggaaggtgggtgggtg

SEQ ID NO: 40272 - DNA, 20 bp, Artificial
  CRISPR gRNA sequence
tgggtgggtggggccaatta

SEQ ID NO: 40273 - DNA, 20 bp, Artificial
  CRISPR gRNA sequence
tgggtggggccaattacagt

SEQ ID NO: 40274 - DNA, 20 bp, Artificial
  CRISPR gRNA sequence
tggggccaattacagtgagt

SEQ ID NO: 40275 - DNA, 20 bp, Artificial
  CRISPR gRNA sequence
caattacagtgagttagtgt

SEQ ID NO: 40276 - DNA, 20 bp, Artificial
  CRISPR gRNA sequence
agtgagttagtgttggtgtt

SEQ ID NO: 40277 - DNA, 20 bp, Artificial
  CRISPR gRNA sequence
gtgagttagtgttggtgttt

SEQ ID NO: 40278 - DNA, 20 bp, Artificial
  CRISPR gRNA sequence
ttagtgttggtgtttgggtt

SEQ ID NO: 40279 - DNA, 20 bp, Artificial
  CRISPR gRNA sequence
ggtgtttgggtttggttttt

SEQ ID NO: 40280 - DNA, 20 bp, Artificial
  CRISPR gRNA sequence
tgggtttggtttttaagatt

SEQ ID NO: 40281 - DNA, 20 bp, Artificial
  CRISPR gRNA sequence
caactgttctttccctgctg

SEQ ID NO: 40282 - DNA, 20 bp, Artificial
  CRISPR gRNA sequence
tgttctttccctgctgaagt

SEQ ID NO: 40283 - DNA, 20 bp, Artificial
  CRISPR gRNA sequence
tgctgaagtcagaaacccct

SEQ ID NO: 40284 - DNA, 20 bp, Artificial
  CRISPR gRNA sequence
ctgaagtcagaaaccccttg

SEQ ID NO: 40285 - DNA, 20 bp, Artificial
  CRISPR gRNA sequence
cagaaaccccttggagaatc

SEQ ID NO: 40286 - DNA, 20 bp, Artificial
  CRISPR gRNA sequence
ccccttggagaatctggtga

SEQ ID NO: 40287 - DNA, 20 bp, Artificial
  CRISPR gRNA sequence
aagttgtgactcttcctccc

SEQ ID NO: 40288 - DNA, 20 bp, Artificial
  CRISPR gRNA sequence
tgactcttcctcccaagata

SEQ ID NO: 40289 - DNA, 20 bp, Artificial
  CRISPR gRNA sequence
tcccccatgtctgacacgct

SEQ ID NO: 40290 - DNA, 20 bp, Artificial
  CRISPR gRNA sequence
ccccatgtctgacacgctcg

SEQ ID NO: 40291 - DNA, 20 bp, Artificial
  CRISPR gRNA sequence
cccatgtctgacacgctcgg

SEQ ID NO: 40292 - DNA, 20 bp, Artificial
  CRISPR gRNA sequence
cacgctcggaggctcacccc

SEQ ID NO: 40293 - DNA, 20 bp, Artificial
  CRISPR gRNA sequence
gaggctcacccctggtccct

SEQ ID NO: 40294 - DNA, 20 bp, Artificial
  CRISPR gRNA sequence
ggctcacccctggtccctca

SEQ ID NO: 40295 - DNA, 20 bp, Artificial
  CRISPR gRNA sequence
gctcacccctggtccctcag

SEQ ID NO: 40296 - DNA, 20 bp, Artificial
  CRISPR gRNA sequence
cctcagaggtccacgaacct

SEQ ID NO: 40297 - DNA, 20 bp, Artificial
  CRISPR gRNA sequence
aggtccacgaacctcagaat

SEQ ID NO: 40298 - DNA, 20 bp, Artificial
  CRISPR gRNA sequence
cgaacctcagaataagaacc

SEQ ID NO: 40299 - DNA, 20 bp, Artificial
  CRISPR gRNA sequence
gaacctcagaataagaacct

SEQ ID NO: 40300 - DNA, 20 bp, Artificial
  CRISPR gRNA sequence
aacctcagaataagaacctg

SEQ ID NO: 40301 - DNA, 20 bp, Artificial
  CRISPR gRNA sequence
acctcagaataagaacctgg

SEQ ID NO: 40302 - DNA, 20 bp, Artificial
  CRISPR gRNA sequence
ctcagaataagaacctgggg

SEQ ID NO: 40303 - DNA, 20 bp, Artificial
  CRISPR gRNA sequence
taagaacctgggggagaccc

SEQ ID NO: 40304 - DNA, 20 bp, Artificial
  CRISPR gRNA sequence
gagaccccagctgcccgtgc

SEQ ID NO: 40305 - DNA, 20 bp, Artificial
  CRISPR gRNA sequence
ctgcccgtgccagatctgct

SEQ ID NO: 40306 - DNA, 20 bp, Artificial
  CRISPR gRNA sequence
gtgccagatctgctgagatc

SEQ ID NO: 40307 - DNA, 20 bp, Artificial
  CRISPR gRNA sequence
agatctgctgagatctggcc

SEQ ID NO: 40308 - DNA, 20 bp, Artificial
  CRISPR gRNA sequence
tctgctgagatctggcctgg

SEQ ID NO: 40309 - DNA, 20 bp, Artificial
  CRISPR gRNA sequence
tgagatctggcctggcagcc

SEQ ID NO: 40310 - DNA, 20 bp, Artificial
  CRISPR gRNA sequence
gagatctggcctggcagccc

SEQ ID NO: 40311 - DNA, 20 bp, Artificial
  CRISPR gRNA sequence
agatctggcctggcagccca

SEQ ID NO: 40312 - DNA, 20 bp, Artificial
  CRISPR gRNA sequence
tggcagcccagggctgtgtc

SEQ ID NO: 40313 - DNA, 20 bp, Artificial
  CRISPR gRNA sequence
cccagggctgtgtccagttt

SEQ ID NO: 40314 - DNA, 20 bp, Artificial
  CRISPR gRNA sequence
ccagggctgtgtccagtttc

SEQ ID NO: 40315 - DNA, 20 bp, Artificial
  CRISPR gRNA sequence
gggctgtgtccagtttcagg

SEQ ID NO: 40316 - DNA, 20 bp, Artificial
  CRISPR gRNA sequence
gtgtccagtttcaggaagtt

SEQ ID NO: 40317 - DNA, 20 bp, Artificial
  CRISPR gRNA sequence
gtttcaggaagttgagtaac

SEQ ID NO: 40318 - DNA, 20 bp, Artificial
  CRISPR gRNA sequence
gaagttgagtaactggaatg

SEQ ID NO: 40319 - DNA, 20 bp, Artificial
  CRISPR gRNA sequence
aagttgagtaactggaatgc

SEQ ID NO: 40320 - DNA, 20 bp, Artificial
  CRISPR gRNA sequence
agttgagtaactggaatgca

SEQ ID NO: 40321 - DNA, 20 bp, Artificial
  CRISPR gRNA sequence
gaatgcagggaccatgctgc

SEQ ID NO: 40322 - DNA, 20 bp, Artificial
  CRISPR gRNA sequence
ccctcccttctccccacccc

SEQ ID NO: 40323 - DNA, 20 bp, Artificial
  CRISPR gRNA sequence
tctccccacccccagcttct

SEQ ID NO: 40324 - DNA, 20 bp, Artificial
  CRISPR gRNA sequence
ctccccacccccagcttctc

SEQ ID NO: 40325 - DNA, 20 bp, Artificial
  CRISPR gRNA sequence
cagcttctcaggcaatgctc

SEQ ID NO: 40326 - DNA, 20 bp, Artificial
  CRISPR gRNA sequence
agcttctcaggcaatgctct

SEQ ID NO: 40327 - DNA, 20 bp, Artificial
  CRISPR gRNA sequence
gcttctcaggcaatgctctg

SEQ ID NO: 40328 - DNA, 20 bp, Artificial
  CRISPR gRNA sequence
cttctcaggcaatgctctgg

SEQ ID NO: 40329 - DNA, 20 bp, Artificial
  CRISPR gRNA sequence
aggcaatgctctgggggatg

SEQ ID NO: 40330 - DNA, 20 bp, Artificial
  CRISPR gRNA sequence
ggcaatgctctgggggatga

SEQ ID NO: 40331 - DNA, 20 bp, Artificial
  CRISPR gRNA sequence
tgctctgggggatgaaggtg

SEQ ID NO: 40332 - DNA, 20 bp, Artificial
  CRISPR gRNA sequence
tgggggatgaaggtgcagcc

SEQ ID NO: 40333 - DNA, 20 bp, Artificial
  CRISPR gRNA sequence
ggatgaaggtgcagcccggc

SEQ ID NO: 40334 - DNA, 20 bp, Artificial
  CRISPR gRNA sequence
aaggtgcagcccggctggct

SEQ ID NO: 40335 - DNA, 20 bp, Artificial
  CRISPR gRNA sequence
ccggctggctcagctgctcc

SEQ ID NO: 40336 - DNA, 20 bp, Artificial
  CRISPR gRNA sequence
cggctggctcagctgctccc

SEQ ID NO: 40337 - DNA, 20 bp, Artificial
  CRISPR gRNA sequence
ggctggctcagctgctccca

SEQ ID NO: 40338 - DNA, 20 bp, Artificial
  CRISPR gRNA sequence
ggctcagctgctcccagggc

SEQ ID NO: 40339 - DNA, 20 bp, Artificial
  CRISPR gRNA sequence
gctcagctgctcccagggct

SEQ ID NO: 40340 - DNA, 20 bp, Artificial
  CRISPR gRNA sequence
tcagctgctcccagggctgg

SEQ ID NO: 40341 - DNA, 20 bp, Artificial
  CRISPR gRNA sequence
tcccagggctgggagctctg

SEQ ID NO: 40342 - DNA, 20 bp, Artificial
  CRISPR gRNA sequence
tgggagctctgcagtccttg

SEQ ID NO: 40343 - DNA, 20 bp, Artificial
  CRISPR gRNA sequence
agctctgcagtccttgaagt

SEQ ID NO: 40344 - DNA, 20 bp, Artificial
  CRISPR gRNA sequence
tctgcagtccttgaagtgag

SEQ ID NO: 40345 - DNA, 20 bp, Artificial
  CRISPR gRNA sequence
ccttgaagtgagtagcccgc

SEQ ID NO: 40346 - DNA, 20 bp, Artificial
  CRISPR gRNA sequence
cttgaagtgagtagcccgct

SEQ ID NO: 40347 - DNA, 20 bp, Artificial
  CRISPR gRNA sequence
gaagtgagtagcccgctagg

SEQ ID NO: 40348 - DNA, 20 bp, Artificial
  CRISPR gRNA sequence
agtgagtagcccgctaggca

SEQ ID NO: 40349 - DNA, 20 bp, Artificial
  CRISPR gRNA sequence
gcccgctaggcagagcctct

SEQ ID NO: 40350 - DNA, 20 bp, Artificial
  CRISPR gRNA sequence
cccgctaggcagagcctctg

SEQ ID NO: 40351 - DNA, 20 bp, Artificial
  CRISPR gRNA sequence
ctaggcagagcctctgaggc

SEQ ID NO: 40352 - DNA, 20 bp, Artificial
  CRISPR gRNA sequence
taggcagagcctctgaggct

SEQ ID NO: 40353 - DNA, 20 bp, Artificial
  CRISPR gRNA sequence
aggcagagcctctgaggctg

SEQ ID NO: 40354 - DNA, 20 bp, Artificial
  CRISPR gRNA sequence
cagagcctctgaggctgggg

SEQ ID NO: 40355 - DNA, 20 bp, Artificial
  CRISPR gRNA sequence
agagcctctgaggctggggc

SEQ ID NO: 40356 - DNA, 20 bp, Artificial
  CRISPR gRNA sequence
gagcctctgaggctggggca

SEQ ID NO: 40357 - DNA, 20 bp, Artificial
  CRISPR gRNA sequence
agcctctgaggctggggcag

SEQ ID NO: 40358 - DNA, 20 bp, Artificial
  CRISPR gRNA sequence
gcctctgaggctggggcagg

SEQ ID NO: 40359 - DNA, 20 bp, Artificial
  CRISPR gRNA sequence
cctctgaggctggggcaggg

SEQ ID NO: 40360 - DNA, 20 bp, Artificial
  CRISPR gRNA sequence
ctctgaggctggggcagggg

SEQ ID NO: 40361 - DNA, 20 bp, Artificial
  CRISPR gRNA sequence
ctgaggctggggcagggggg

SEQ ID NO: 40362 - DNA, 20 bp, Artificial
  CRISPR gRNA sequence
tgtcccatccccctctttcc

SEQ ID NO: 40363 - DNA, 20 bp, Artificial
  CRISPR gRNA sequence
gtcccatccccctctttcct

SEQ ID NO: 40364 - DNA, 20 bp, Artificial
  CRISPR gRNA sequence
tcccatccccctctttcctg

SEQ ID NO: 40365 - DNA, 20 bp, Artificial
  CRISPR gRNA sequence
tctttcctggggttattgta

SEQ ID NO: 40366 - DNA, 20 bp, Artificial
  CRISPR gRNA sequence
ggttattgtaaagattaaat

SEQ ID NO: 40367 - DNA, 20 bp, Artificial
  CRISPR gRNA sequence
aattgcccctaatacaatgt

SEQ ID NO: 40368 - DNA, 20 bp, Artificial
  CRISPR gRNA sequence
cctaatacaatgtaagttct

SEQ ID NO: 40369 - DNA, 20 bp, Artificial
  CRISPR gRNA sequence
tacaatgtaagttctcggtg

SEQ ID NO: 40370 - DNA, 20 bp, Artificial
  CRISPR gRNA sequence
acaatgtaagttctcggtga

SEQ ID NO: 40371 - DNA, 20 bp, Artificial
  CRISPR gRNA sequence
tgtaagttctcggtgaaggc

SEQ ID NO: 40372 - DNA, 20 bp, Artificial
  CRISPR gRNA sequence
tctcggtgaaggctagctaa

SEQ ID NO: 40373 - DNA, 20 bp, Artificial
  CRISPR gRNA sequence
gctaatagatgattcttact

SEQ ID NO: 40374 - DNA, 20 bp, Artificial
  CRISPR gRNA sequence
taatagatgattcttactca

SEQ ID NO: 40375 - DNA, 20 bp, Artificial
  CRISPR gRNA sequence
atagatgattcttactcaga

SEQ ID NO: 40376 - DNA, 20 bp, Artificial
  CRISPR gRNA sequence
aataatcccacttctgattc

SEQ ID NO: 40377 - DNA, 20 bp, Artificial
  CRISPR gRNA sequence
ataatcccacttctgattca

SEQ ID NO: 40378 - DNA, 20 bp, Artificial
  CRISPR gRNA sequence
ctgattcaaggtttcacttc

SEQ ID NO: 40379 - DNA, 20 bp, Artificial
  CRISPR gRNA sequence
cctgtctccgcatctctgaa

SEQ ID NO: 40380 - DNA, 20 bp, Artificial
  CRISPR gRNA sequence
ctgtctccgcatctctgaac

SEQ ID NO: 40381 - DNA, 20 bp, Artificial
  CRISPR gRNA sequence
gcatctctgaacaggcttct

SEQ ID NO: 40382 - DNA, 20 bp, Artificial
  CRISPR gRNA sequence
catctctgaacaggcttctg

SEQ ID NO: 40383 - DNA, 20 bp, Artificial
  CRISPR gRNA sequence
acaggcttctgaggccaccc

SEQ ID NO: 40384 - DNA, 20 bp, Artificial
  CRISPR gRNA sequence
caggcttctgaggccaccct

SEQ ID NO: 40385 - DNA, 20 bp, Artificial
  CRISPR gRNA sequence
aggcttctgaggccaccctg

SEQ ID NO: 40386 - DNA, 20 bp, Artificial
  CRISPR gRNA sequence
gcttctgaggccaccctggg

SEQ ID NO: 40387 - DNA, 20 bp, Artificial
  CRISPR gRNA sequence
cttctgaggccaccctgggg

SEQ ID NO: 40388 - DNA, 20 bp, Artificial
  CRISPR gRNA sequence
ttctgaggccaccctgggga

SEQ ID NO: 40389 - DNA, 20 bp, Artificial
  CRISPR gRNA sequence
tgaggccaccctggggaggg

SEQ ID NO: 40390 - DNA, 20 bp, Artificial
  CRISPR gRNA sequence
gaggccaccctggggagggc

SEQ ID NO: 40391 - DNA, 20 bp, Artificial
  CRISPR gRNA sequence
caccctggggagggcaggtg

SEQ ID NO: 40392 - DNA, 20 bp, Artificial
  CRISPR gRNA sequence
accctggggagggcaggtgt

SEQ ID NO: 40393 - DNA, 20 bp, Artificial
  CRISPR gRNA sequence
ggagggcaggtgtgggtgcg

SEQ ID NO: 40394 - DNA, 20 bp, Artificial
  CRISPR gRNA sequence
tgggtgcgaagtatgactaa

SEQ ID NO: 40395 - DNA, 20 bp, Artificial
  CRISPR gRNA sequence
tgcgaagtatgactaacggc

SEQ ID NO: 40396 - DNA, 20 bp, Artificial
  CRISPR gRNA sequence
gaagtatgactaacggctgg

SEQ ID NO: 40397 - DNA, 20 bp, Artificial
  CRISPR gRNA sequence
acggctggcagttgttattc

SEQ ID NO: 40398 - DNA, 20 bp, Artificial
  CRISPR gRNA sequence
ggcagttgttattctggccc

SEQ ID NO: 40399 - DNA, 20 bp, Artificial
  CRISPR gRNA sequence
gcagttgttattctggccct

SEQ ID NO: 40400 - DNA, 20 bp, Artificial
  CRISPR gRNA sequence
cagttgttattctggccctg

SEQ ID NO: 40401 - DNA, 20 bp, Artificial
  CRISPR gRNA sequence
ttattctggccctggggtgc

SEQ ID NO: 40402 - DNA, 20 bp, Artificial
  CRISPR gRNA sequence
tattctggccctggggtgcc

SEQ ID NO: 40403 - DNA, 20 bp, Artificial
  CRISPR gRNA sequence
ttctggccctggggtgccgg

SEQ ID NO: 40404 - DNA, 20 bp, Artificial
  CRISPR gRNA sequence
tctggccctggggtgccggg

SEQ ID NO: 40405 - DNA, 20 bp, Artificial
  CRISPR gRNA sequence
ctggccctggggtgccggga

SEQ ID NO: 40406 - DNA, 20 bp, Artificial
  CRISPR gRNA sequence
tggccctggggtgccgggag

SEQ ID NO: 40407 - DNA, 20 bp, Artificial
  CRISPR gRNA sequence
cctggggtgccgggaggggc

SEQ ID NO: 40408 - DNA, 20 bp, Artificial
  CRISPR gRNA sequence
ctggggtgccgggaggggct

SEQ ID NO: 40409 - DNA, 20 bp, Artificial
  CRISPR gRNA sequence
tggggtgccgggaggggctg

SEQ ID NO: 40410 - DNA, 20 bp, Artificial
  CRISPR gRNA sequence
ccgggaggggctggggctgt

SEQ ID NO: 40411 - DNA, 20 bp, Artificial
  CRISPR gRNA sequence
gaggggctggggctgttagc

SEQ ID NO: 40412 - DNA, 20 bp, Artificial
  CRISPR gRNA sequence
aggggctggggctgttagct

SEQ ID NO: 40413 - DNA, 20 bp, Artificial
  CRISPR gRNA sequence
ggggctggggctgttagctg

SEQ ID NO: 40414 - DNA, 20 bp, Artificial
  CRISPR gRNA sequence
tggggctgttagctggggta

SEQ ID NO: 40415 - DNA, 20 bp, Artificial
  CRISPR gRNA sequence
gctgttagctggggtatggt

SEQ ID NO: 40416 - DNA, 20 bp, Artificial
  CRISPR gRNA sequence
ctgttagctggggtatggtc

SEQ ID NO: 40417 - DNA, 20 bp, Artificial
  CRISPR gRNA sequence
tgttagctggggtatggtca

SEQ ID NO: 40418 - DNA, 20 bp, Artificial
  CRISPR gRNA sequence
tagctggggtatggtcaggg

SEQ ID NO: 40419 - DNA, 20 bp, Artificial
  CRISPR gRNA sequence
tggggtatggtcagggtaga

SEQ ID NO: 40420 - DNA, 20 bp, Artificial
  CRISPR gRNA sequence
ggggtatggtcagggtagac

SEQ ID NO: 40421 - DNA, 20 bp, Artificial
  CRISPR gRNA sequence
gggtatggtcagggtagaca

SEQ ID NO: 40422 - DNA, 20 bp, Artificial
  CRISPR gRNA sequence
gtatggtcagggtagacagg

SEQ ID NO: 40423 - DNA, 20 bp, Artificial
  CRISPR gRNA sequence
tatggtcagggtagacaggg

SEQ ID NO: 40424 - DNA, 20 bp, Artificial
  CRISPR gRNA sequence
atggtcagggtagacaggga

SEQ ID NO: 40425 - DNA, 20 bp, Artificial
  CRISPR gRNA sequence
tagacagggagggtttgtac

SEQ ID NO: 40426 - DNA, 20 bp, Artificial
  CRISPR gRNA sequence
gacagggagggtttgtacca

SEQ ID NO: 40427 - DNA, 20 bp, Artificial
  CRISPR gRNA sequence
cagggagggtttgtaccaga

SEQ ID NO: 40428 - DNA, 20 bp, Artificial
  CRISPR gRNA sequence
agggagggtttgtaccagag

SEQ ID NO: 40429 - DNA, 20 bp, Artificial
  CRISPR gRNA sequence
ttgtaccagagaggacactc

SEQ ID NO: 40430 - DNA, 20 bp, Artificial
  CRISPR gRNA sequence
taccagagaggacactcaag

SEQ ID NO: 40431 - DNA, 20 bp, Artificial
  CRISPR gRNA sequence
accagagaggacactcaagc

SEQ ID NO: 40432 - DNA, 20 bp, Artificial
  CRISPR gRNA sequence
ccagagaggacactcaagca

SEQ ID NO: 40433 - DNA, 20 bp, Artificial
  CRISPR gRNA sequence
ggacactcaagcagggtgcc

SEQ ID NO: 40434 - DNA, 20 bp, Artificial
  CRISPR gRNA sequence
gacactcaagcagggtgccc

SEQ ID NO: 40435 - DNA, 20 bp, Artificial
  CRISPR gRNA sequence
acactcaagcagggtgccca

SEQ ID NO: 40436 - DNA, 20 bp, Artificial
  CRISPR gRNA sequence
gcagggtgcccagggctgcc

SEQ ID NO: 40437 - DNA, 20 bp, Artificial
  CRISPR gRNA sequence
cagggtgcccagggctgcca

SEQ ID NO: 40438 - DNA, 20 bp, Artificial
  CRISPR gRNA sequence
cagggctgccaaggatccct

SEQ ID NO: 40439 - DNA, 20 bp, Artificial
  CRISPR gRNA sequence
gccaaggatccctgagtacc

SEQ ID NO: 40440 - DNA, 20 bp, Artificial
  CRISPR gRNA sequence
aaggatccctgagtacctgg

SEQ ID NO: 40441 - DNA, 20 bp, Artificial
  CRISPR gRNA sequence
ggatccctgagtacctggca

SEQ ID NO: 40442 - DNA, 20 bp, Artificial
  CRISPR gRNA sequence
atccctgagtacctggcaga

SEQ ID NO: 40443 - DNA, 20 bp, Artificial
  CRISPR gRNA sequence
agtacctggcagagagtgtg

SEQ ID NO: 40444 - DNA, 20 bp, Artificial
  CRISPR gRNA sequence
gtacctggcagagagtgtgt

SEQ ID NO: 40445 - DNA, 20 bp, Artificial
  CRISPR gRNA sequence
acctggcagagagtgtgtag

SEQ ID NO: 40446 - DNA, 20 bp, Artificial
  CRISPR gRNA sequence
cctggcagagagtgtgtagg

SEQ ID NO: 40447 - DNA, 20 bp, Artificial
  CRISPR gRNA sequence
gtgtgtaggaggaatcccca

SEQ ID NO: 40448 - DNA, 20 bp, Artificial
  CRISPR gRNA sequence
tccccaaagtttgcctgcaa

SEQ ID NO: 40449 - DNA, 20 bp, Artificial
  CRISPR gRNA sequence
aaagtttgcctgcaatggac

SEQ ID NO: 40450 - DNA, 20 bp, Artificial
  CRISPR gRNA sequence
agtttgcctgcaatggacca

SEQ ID NO: 40451 - DNA, 20 bp, Artificial
  CRISPR gRNA sequence
tcttgatccctaaatgccct

SEQ ID NO: 40452 - DNA, 20 bp, Artificial
  CRISPR gRNA sequence
ctaaatgcccttggtgcttt

SEQ ID NO: 40453 - DNA, 20 bp, Artificial
  CRISPR gRNA sequence
cttggtgcttttggctcaca

SEQ ID NO: 40454 - DNA, 20 bp, Artificial
  CRISPR gRNA sequence
cacaaagcaccccctcctcc

SEQ ID NO: 40455 - DNA, 20 bp, Artificial
  CRISPR gRNA sequence
acaaagcaccccctcctccc

SEQ ID NO: 40456 - DNA, 20 bp, Artificial
  CRISPR gRNA sequence
cccctcctcccaggcacttc

SEQ ID NO: 40457 - DNA, 20 bp, Artificial
  CRISPR gRNA sequence
ccctcctcccaggcacttct

SEQ ID NO: 40458 - DNA, 20 bp, Artificial
  CRISPR gRNA sequence
tcccaggcacttctgggcca

SEQ ID NO: 40459 - DNA, 20 bp, Artificial
  CRISPR gRNA sequence
aggcacttctgggccaaagc

SEQ ID NO: 40460 - DNA, 20 bp, Artificial
  CRISPR gRNA sequence
gcacttctgggccaaagcca

SEQ ID NO: 40461 - DNA, 20 bp, Artificial
  CRISPR gRNA sequence
cacttctgggccaaagccag

SEQ ID NO: 40462 - DNA, 20 bp, Artificial
  CRISPR gRNA sequence
cttctgggccaaagccagag

SEQ ID NO: 40463 - DNA, 20 bp, Artificial
  CRISPR gRNA sequence
gggccaaagccagaggagcc

SEQ ID NO: 40464 - DNA, 20 bp, Artificial
  CRISPR gRNA sequence
ggccaaagccagaggagccc

SEQ ID NO: 40465 - DNA, 20 bp, Artificial
  CRISPR gRNA sequence
gccaaagccagaggagccca

SEQ ID NO: 40466 - DNA, 20 bp, Artificial
  CRISPR gRNA sequence
ccaaagccagaggagcccag

SEQ ID NO: 40467 - DNA, 20 bp, Artificial
  CRISPR gRNA sequence
aaagccagaggagcccaggg

SEQ ID NO: 40468 - DNA, 20 bp, Artificial
  CRISPR gRNA sequence
agccagaggagcccagggga

SEQ ID NO: 40469 - DNA, 20 bp, Artificial
  CRISPR gRNA sequence
gccagaggagcccaggggag

SEQ ID NO: 40470 - DNA, 20 bp, Artificial
  CRISPR gRNA sequence
ggagcccaggggagaggtca

SEQ ID NO: 40471 - DNA, 20 bp, Artificial
  CRISPR gRNA sequence
gagcccaggggagaggtcac

SEQ ID NO: 40472 - DNA, 20 bp, Artificial
  CRISPR gRNA sequence
aggtcacaggtcctatattc

SEQ ID NO: 40473 - DNA, 20 bp, Artificial
  CRISPR gRNA sequence
ggtcacaggtcctatattcc

SEQ ID NO: 40474 - DNA, 20 bp, Artificial
  CRISPR gRNA sequence
cacgctttgctgtgtgattc

SEQ ID NO: 40475 - DNA, 20 bp, Artificial
  CRISPR gRNA sequence
acgctttgctgtgtgattct

SEQ ID NO: 40476 - DNA, 20 bp, Artificial
  CRISPR gRNA sequence
tttgctgtgtgattctgggc

SEQ ID NO: 40477 - DNA, 20 bp, Artificial
  CRISPR gRNA sequence
gcaagttacatcccctctcc

SEQ ID NO: 40478 - DNA, 20 bp, Artificial
  CRISPR gRNA sequence
acatcccctctccgagtccc

SEQ ID NO: 40479 - DNA, 20 bp, Artificial
  CRISPR gRNA sequence
ctctccgagtccctggttcc

SEQ ID NO: 40480 - DNA, 20 bp, Artificial
  CRISPR gRNA sequence
ccgagtccctggttcccagt

SEQ ID NO: 40481 - DNA, 20 bp, Artificial
  CRISPR gRNA sequence
gtcggtaaatacataaattg

SEQ ID NO: 40482 - DNA, 20 bp, Artificial
  CRISPR gRNA sequence
tcggtaaatacataaattgc

SEQ ID NO: 40483 - DNA, 20 bp, Artificial
  CRISPR gRNA sequence
aaatacataaattgcaggcg

SEQ ID NO: 40484 - DNA, 20 bp, Artificial
  CRISPR gRNA sequence
attgcaggcgtggcctctgt

SEQ ID NO: 40485 - DNA, 20 bp, Artificial
  CRISPR gRNA sequence
gcaggcgtggcctctgttgg

SEQ ID NO: 40486 - DNA, 20 bp, Artificial
  CRISPR gRNA sequence
gtggctacgatctctgaaat

SEQ ID NO: 40487 - DNA, 20 bp, Artificial
  CRISPR gRNA sequence
acgatctctgaaatgagtgc

SEQ ID NO: 40488 - DNA, 20 bp, Artificial
  CRISPR gRNA sequence
cgatctctgaaatgagtgct

SEQ ID NO: 40489 - DNA, 20 bp, Artificial
  CRISPR gRNA sequence
gatctctgaaatgagtgctg

SEQ ID NO: 40490 - DNA, 20 bp, Artificial
  CRISPR gRNA sequence
tgaaatgagtgctggggcct

SEQ ID NO: 40491 - DNA, 20 bp, Artificial
  CRISPR gRNA sequence
gaaatgagtgctggggccta

SEQ ID NO: 40492 - DNA, 20 bp, Artificial
  CRISPR gRNA sequence
accctgtttttgtgcaatgc

SEQ ID NO: 40493 - DNA, 20 bp, Artificial
  CRISPR gRNA sequence
ccctgtttttgtgcaatgct

SEQ ID NO: 40494 - DNA, 20 bp, Artificial
  CRISPR gRNA sequence
tgtttttgtgcaatgctggg

SEQ ID NO: 40495 - DNA, 20 bp, Artificial
  CRISPR gRNA sequence
gtttttgtgcaatgctggga

SEQ ID NO: 40496 - DNA, 20 bp, Artificial
  CRISPR gRNA sequence
tttgtgcaatgctgggaagg

SEQ ID NO: 40497 - DNA, 20 bp, Artificial
  CRISPR gRNA sequence
ttgtgcaatgctgggaagga

SEQ ID NO: 40498 - DNA, 20 bp, Artificial
  CRISPR gRNA sequence
tgtgcaatgctgggaaggaa

SEQ ID NO: 40499 - DNA, 20 bp, Artificial
  CRISPR gRNA sequence
tgcaatgctgggaaggaagg

SEQ ID NO: 40500 - DNA, 20 bp, Artificial
  CRISPR gRNA sequence
gggaaggaagggagttgcct

SEQ ID NO: 40501 - DNA, 20 bp, Artificial
  CRISPR gRNA sequence
gagttgccttggttcctgtt

SEQ ID NO: 40502 - DNA, 20 bp, Artificial
  CRISPR gRNA sequence
agttgccttggttcctgttc

SEQ ID NO: 40503 - DNA, 20 bp, Artificial
  CRISPR gRNA sequence
gttgccttggttcctgttca

SEQ ID NO: 40504 - DNA, 20 bp, Artificial
  CRISPR gRNA sequence
tcctgttcagggcctgcacc

SEQ ID NO: 40505 - DNA, 20 bp, Artificial
  CRISPR gRNA sequence
cctgttcagggcctgcacct

SEQ ID NO: 40506 - DNA, 20 bp, Artificial
  CRISPR gRNA sequence
gttcagggcctgcacctggg

SEQ ID NO: 40507 - DNA, 20 bp, Artificial
  CRISPR gRNA sequence
ttcagggcctgcacctggga

SEQ ID NO: 40508 - DNA, 20 bp, Artificial
  CRISPR gRNA sequence
agggcctgcacctgggaagg

SEQ ID NO: 40509 - DNA, 20 bp, Artificial
  CRISPR gRNA sequence
gggcctgcacctgggaagga

SEQ ID NO: 40510 - DNA, 20 bp, Artificial
  CRISPR gRNA sequence
cctgcacctgggaaggaagg

SEQ ID NO: 40511 - DNA, 20 bp, Artificial
  CRISPR gRNA sequence
ctgcacctgggaaggaagga

SEQ ID NO: 40512 - DNA, 20 bp, Artificial
  CRISPR gRNA sequence
gaaggaaggtctaaccattg

SEQ ID NO: 40513 - DNA, 20 bp, Artificial
  CRISPR gRNA sequence
aaggaaggtctaaccattgc

SEQ ID NO: 40514 - DNA, 20 bp, Artificial
  CRISPR gRNA sequence
cattgcaggcaaattacatg

SEQ ID NO: 40515 - DNA, 20 bp, Artificial
  CRISPR gRNA sequence
caggcaaattacatgaagac

SEQ ID NO: 40516 - DNA, 20 bp, Artificial
  CRISPR gRNA sequence
ggcaaattacatgaagactg

SEQ ID NO: 40517 - DNA, 20 bp, Artificial
  CRISPR gRNA sequence
gcaaattacatgaagactgg

SEQ ID NO: 40518 - DNA, 20 bp, Artificial
  CRISPR gRNA sequence
tacatgaagactggaggttt

SEQ ID NO: 40519 - DNA, 20 bp, Artificial
  CRISPR gRNA sequence
tcctcatgtgaccttcttat

SEQ ID NO: 40520 - DNA, 20 bp, Artificial
  CRISPR gRNA sequence
atgtgaccttcttattagtg

SEQ ID NO: 40521 - DNA, 20 bp, Artificial
  CRISPR gRNA sequence
attagtgtggactcgtgacc

SEQ ID NO: 40522 - DNA, 20 bp, Artificial
  CRISPR gRNA sequence
gactcgtgacctggtgctgt

SEQ ID NO: 40523 - DNA, 20 bp, Artificial
  CRISPR gRNA sequence
actcgtgacctggtgctgtg

SEQ ID NO: 40524 - DNA, 20 bp, Artificial
  CRISPR gRNA sequence
ctcgtgacctggtgctgtga

SEQ ID NO: 40525 - DNA, 20 bp, Artificial
  CRISPR gRNA sequence
agggtccacactcgccctac

SEQ ID NO: 40526 - DNA, 20 bp, Artificial
  CRISPR gRNA sequence
tcgccctaccagtgtccccg

SEQ ID NO: 40527 - DNA, 20 bp, Artificial
  CRISPR gRNA sequence
cgccctaccagtgtccccgt

SEQ ID NO: 40528 - DNA, 20 bp, Artificial
  CRISPR gRNA sequence
ccctaccagtgtccccgtgg

SEQ ID NO: 40529 - DNA, 20 bp, Artificial
  CRISPR gRNA sequence
cctaccagtgtccccgtggg

SEQ ID NO: 40530 - DNA, 20 bp, Artificial
  CRISPR gRNA sequence
ctaccagtgtccccgtggga

SEQ ID NO: 40531 - DNA, 20 bp, Artificial
  CRISPR gRNA sequence
taccagtgtccccgtgggag

SEQ ID NO: 40532 - DNA, 20 bp, Artificial
  CRISPR gRNA sequence
ccagtgtccccgtgggaggg

SEQ ID NO: 40533 - DNA, 20 bp, Artificial
  CRISPR gRNA sequence
gtccccgtgggaggggagtg

SEQ ID NO: 40534 - DNA, 20 bp, Artificial
  CRISPR gRNA sequence
gaggggagtgtagcattaaa

SEQ ID NO: 40535 - DNA, 20 bp, Artificial
  CRISPR gRNA sequence
gtgtagcattaaatagtaaa

SEQ ID NO: 40536 - DNA, 20 bp, Artificial
  CRISPR gRNA sequence
agtaaatagaaaacaataac

SEQ ID NO: 40537 - DNA, 20 bp, Artificial
  CRISPR gRNA sequence
agaaaacaataacaagttga

SEQ ID NO: 40538 - DNA, 20 bp, Artificial
  CRISPR gRNA sequence
gaaaacaataacaagttgac

SEQ ID NO: 40539 - DNA, 20 bp, Artificial
  CRISPR gRNA sequence
aaacaataacaagttgacag

SEQ ID NO: 40540 - DNA, 20 bp, Artificial
  CRISPR gRNA sequence
aagttgacaggagaccctga

SEQ ID NO: 40541 - DNA, 20 bp, Artificial
  CRISPR gRNA sequence
tgacaggagaccctgaaaga

SEQ ID NO: 40542 - DNA, 20 bp, Artificial
  CRISPR gRNA sequence
gacaggagaccctgaaagaa

SEQ ID NO: 40543 - DNA, 20 bp, Artificial
  CRISPR gRNA sequence
caggagaccctgaaagaaag

SEQ ID NO: 40544 - DNA, 20 bp, Artificial
  CRISPR gRNA sequence
tttgttcctgctttctgcac

SEQ ID NO: 40545 - DNA, 20 bp, Artificial
  CRISPR gRNA sequence
tgttcctgctttctgcacaa

SEQ ID NO: 40546 - DNA, 20 bp, Artificial
  CRISPR gRNA sequence
cctgcattttcattttgtcc

SEQ ID NO: 40547 - DNA, 20 bp, Artificial
  CRISPR gRNA sequence
ctgcattttcattttgtcct

SEQ ID NO: 40548 - DNA, 20 bp, Artificial
  CRISPR gRNA sequence
gggtaccacccctcccttat

SEQ ID NO: 40549 - DNA, 20 bp, Artificial
  CRISPR gRNA sequence
ggtaccacccctcccttatc

SEQ ID NO: 40550 - DNA, 20 bp, Artificial
  CRISPR gRNA sequence
accacccctcccttatcagg

SEQ ID NO: 40551 - DNA, 20 bp, Artificial
  CRISPR gRNA sequence
cacccctcccttatcaggtg

SEQ ID NO: 40552 - DNA, 20 bp, Artificial
  CRISPR gRNA sequence
ctcccttatcaggtggagaa

SEQ ID NO: 40553 - DNA, 20 bp, Artificial
  CRISPR gRNA sequence
tcccttatcaggtggagaaa

SEQ ID NO: 40554 - DNA, 20 bp, Artificial
  CRISPR gRNA sequence
ccttatcaggtggagaaaag

SEQ ID NO: 40555 - DNA, 20 bp, Artificial
  CRISPR gRNA sequence
cttatcaggtggagaaaagg

SEQ ID NO: 40556 - DNA, 20 bp, Artificial
  CRISPR gRNA sequence
caggtggagaaaaggaggcc

SEQ ID NO: 40557 - DNA, 20 bp, Artificial
  CRISPR gRNA sequence
gagaaaaggaggcccagctc

SEQ ID NO: 40558 - DNA, 20 bp, Artificial
  CRISPR gRNA sequence
aaaggaggcccagctccagc

SEQ ID NO: 40559 - DNA, 20 bp, Artificial
  CRISPR gRNA sequence
gaggcccagctccagccaga

SEQ ID NO: 40560 - DNA, 20 bp, Artificial
  CRISPR gRNA sequence
tccagccagaaagcactcct

SEQ ID NO: 40561 - DNA, 20 bp, Artificial
  CRISPR gRNA sequence
agcactcctcagatccatca

SEQ ID NO: 40562 - DNA, 20 bp, Artificial
  CRISPR gRNA sequence
cctcagatccatcacagacc

SEQ ID NO: 40563 - DNA, 20 bp, Artificial
  CRISPR gRNA sequence
ctcagatccatcacagaccg

SEQ ID NO: 40564 - DNA, 20 bp, Artificial
  CRISPR gRNA sequence
tcagatccatcacagaccga

SEQ ID NO: 40565 - DNA, 20 bp, Artificial
  CRISPR gRNA sequence
tcacagaccgagggacccac

SEQ ID NO: 40566 - DNA, 20 bp, Artificial
  CRISPR gRNA sequence
cacagaccgagggacccact

SEQ ID NO: 40567 - DNA, 20 bp, Artificial
  CRISPR gRNA sequence
gacccactgggtgcccatct

SEQ ID NO: 40568 - DNA, 20 bp, Artificial
  CRISPR gRNA sequence
accaacatgtctcataacct

SEQ ID NO: 40569 - DNA, 20 bp, Artificial
  CRISPR gRNA sequence
ccaacatgtctcataacctt

SEQ ID NO: 40570 - DNA, 20 bp, Artificial
  CRISPR gRNA sequence
catgtctcataaccttgggc

SEQ ID NO: 40571 - DNA, 20 bp, Artificial
  CRISPR gRNA sequence
ggctagaccttgattctctc

SEQ ID NO: 40572 - DNA, 20 bp, Artificial
  CRISPR gRNA sequence
gctagaccttgattctctct

SEQ ID NO: 40573 - DNA, 20 bp, Artificial
  CRISPR gRNA sequence
tgtttccccatctccaccat

SEQ ID NO: 40574 - DNA, 20 bp, Artificial
  CRISPR gRNA sequence
gtttccccatctccaccatg

SEQ ID NO: 40575 - DNA, 20 bp, Artificial
  CRISPR gRNA sequence
tctccaccatgaggacttgc

SEQ ID NO: 40576 - DNA, 20 bp, Artificial
  CRISPR gRNA sequence
ctccaccatgaggacttgca

SEQ ID NO: 40577 - DNA, 20 bp, Artificial
  CRISPR gRNA sequence
tccaccatgaggacttgcaa

SEQ ID NO: 40578 - DNA, 20 bp, Artificial
  CRISPR gRNA sequence
ccaccatgaggacttgcaag

SEQ ID NO: 40579 - DNA, 20 bp, Artificial
  CRISPR gRNA sequence
ggggtgctctctgaccatct

SEQ ID NO: 40580 - DNA, 20 bp, Artificial
  CRISPR gRNA sequence
gggtgctctctgaccatctt

SEQ ID NO: 40581 - DNA, 20 bp, Artificial
  CRISPR gRNA sequence
ctctctgaccatcttgggtt

SEQ ID NO: 40582 - DNA, 20 bp, Artificial
  CRISPR gRNA sequence
tctgaccatcttgggttcag

SEQ ID NO: 40583 - DNA, 20 bp, Artificial
  CRISPR gRNA sequence
ctgaccatcttgggttcagt

SEQ ID NO: 40584 - DNA, 20 bp, Artificial
  CRISPR gRNA sequence
gttcagtgggttccgtcatc

SEQ ID NO: 40585 - DNA, 20 bp, Artificial
  CRISPR gRNA sequence
tgggttccgtcatctggaac

SEQ ID NO: 40586 - DNA, 20 bp, Artificial
  CRISPR gRNA sequence
gggttccgtcatctggaacc

SEQ ID NO: 40587 - DNA, 20 bp, Artificial
  CRISPR gRNA sequence
ggttccgtcatctggaacca

SEQ ID NO: 40588 - DNA, 20 bp, Artificial
  CRISPR gRNA sequence
cgccctgtgccctgaccaca

SEQ ID NO: 40589 - DNA, 20 bp, Artificial
  CRISPR gRNA sequence
ccctgtgccctgaccacaaa

SEQ ID NO: 40590 - DNA, 20 bp, Artificial
  CRISPR gRNA sequence
cctgtgccctgaccacaaag

SEQ ID NO: 40591 - DNA, 20 bp, Artificial
  CRISPR gRNA sequence
gaccacaaagaggatgtgtt

SEQ ID NO: 40592 - DNA, 20 bp, Artificial
  CRISPR gRNA sequence
accacaaagaggatgtgttt

SEQ ID NO: 40593 - DNA, 20 bp, Artificial
  CRISPR gRNA sequence
agaggatgtgtttgggtcct

SEQ ID NO: 40594 - DNA, 20 bp, Artificial
  CRISPR gRNA sequence
tgtgccacccctgtgatctc

SEQ ID NO: 40595 - DNA, 20 bp, Artificial
  CRISPR gRNA sequence
acccctgtgatctccagcct

SEQ ID NO: 40596 - DNA, 20 bp, Artificial
  CRISPR gRNA sequence
ctgtgatctccagcctcagt

SEQ ID NO: 40597 - DNA, 20 bp, Artificial
  CRISPR gRNA sequence
atctccagcctcagtgagaa

SEQ ID NO: 40598 - DNA, 20 bp, Artificial
  CRISPR gRNA sequence
cagtgagaacggtttgtccc

SEQ ID NO: 40599 - DNA, 20 bp, Artificial
  CRISPR gRNA sequence
tttgtccctggatgccgtgt

SEQ ID NO: 40600 - DNA, 20 bp, Artificial
  CRISPR gRNA sequence
ttgtccctggatgccgtgtt

SEQ ID NO: 40601 - DNA, 20 bp, Artificial
  CRISPR gRNA sequence
cctggatgccgtgttgggtt

SEQ ID NO: 40602 - DNA, 20 bp, Artificial
  CRISPR gRNA sequence
atgccgtgttgggtttggtt

SEQ ID NO: 40603 - DNA, 20 bp, Artificial
  CRISPR gRNA sequence
ttcggtgcttctccactctg

SEQ ID NO: 40604 - DNA, 20 bp, Artificial
  CRISPR gRNA sequence
ggtgcttctccactctgcag

SEQ ID NO: 40605 - DNA, 20 bp, Artificial
  CRISPR gRNA sequence
tctgcagtggctcttccgct

SEQ ID NO: 40606 - DNA, 20 bp, Artificial
  CRISPR gRNA sequence
tggctcttccgcttggacat

SEQ ID NO: 40607 - DNA, 20 bp, Artificial
  CRISPR gRNA sequence
ggctcttccgcttggacatc

SEQ ID NO: 40608 - DNA, 20 bp, Artificial
  CRISPR gRNA sequence
cttccgcttggacatcaggt

SEQ ID NO: 40609 - DNA, 20 bp, Artificial
  CRISPR gRNA sequence
tgagcgtgcctctccgcccc

SEQ ID NO: 40610 - DNA, 20 bp, Artificial
  CRISPR gRNA sequence
tgcccctgtcccccatccca

SEQ ID NO: 40611 - DNA, 20 bp, Artificial
  CRISPR gRNA sequence
gcccctgtcccccatcccac

SEQ ID NO: 40612 - DNA, 20 bp, Artificial
  CRISPR gRNA sequence
acaggtcatctgctcccacg

SEQ ID NO: 40613 - DNA, 20 bp, Artificial
  CRISPR gRNA sequence
caggtcatctgctcccacgt

SEQ ID NO: 40614 - DNA, 20 bp, Artificial
  CRISPR gRNA sequence
cacgtgggccccttgtccac

SEQ ID NO: 40615 - DNA, 20 bp, Artificial
  CRISPR gRNA sequence
tcatgccaacctgtcatcct

SEQ ID NO: 40616 - DNA, 20 bp, Artificial
  CRISPR gRNA sequence
acctgtcatcctcagcacct

SEQ ID NO: 40617 - DNA, 20 bp, Artificial
  CRISPR gRNA sequence
cctgtcatcctcagcacctt

SEQ ID NO: 40618 - DNA, 20 bp, Artificial
  CRISPR gRNA sequence
gtcatcctcagcaccttggg

SEQ ID NO: 40619 - DNA, 20 bp, Artificial
  CRISPR gRNA sequence
ctcagcaccttgggcagtac

SEQ ID NO: 40620 - DNA, 20 bp, Artificial
  CRISPR gRNA sequence
cttgggcagtaccagatctg

SEQ ID NO: 40621 - DNA, 20 bp, Artificial
  CRISPR gRNA sequence
tgggcagtaccagatctgca

SEQ ID NO: 40622 - DNA, 20 bp, Artificial
  CRISPR gRNA sequence
cagatctgcagagcatgtga

SEQ ID NO: 40623 - DNA, 20 bp, Artificial
  CRISPR gRNA sequence
agatctgcagagcatgtgat

SEQ ID NO: 40624 - DNA, 20 bp, Artificial
  CRISPR gRNA sequence
gaatgatcaaatgaatgaat

SEQ ID NO: 40625 - DNA, 20 bp, Artificial
  CRISPR gRNA sequence
atcaaatgaatgaataagta

SEQ ID NO: 40626 - DNA, 20 bp, Artificial
  CRISPR gRNA sequence
aatgaataagtatggcctca

SEQ ID NO: 40627 - DNA, 20 bp, Artificial
  CRISPR gRNA sequence
aatttctccaaattcaccat

SEQ ID NO: 40628 - DNA, 20 bp, Artificial
  CRISPR gRNA sequence
tttctccaaattcaccatta

SEQ ID NO: 40629 - DNA, 20 bp, Artificial
  CRISPR gRNA sequence
tctccaaattcaccattaga

SEQ ID NO: 40630 - DNA, 20 bp, Artificial
  CRISPR gRNA sequence
actctgcctcactcgttctt

SEQ ID NO: 40631 - DNA, 20 bp, Artificial
  CRISPR gRNA sequence
tgcctcactcgttctttgga

SEQ ID NO: 40632 - DNA, 20 bp, Artificial
  CRISPR gRNA sequence
ctcgttctttggatagtcct

SEQ ID NO: 40633 - DNA, 20 bp, Artificial
  CRISPR gRNA sequence
cgttctttggatagtcctta

SEQ ID NO: 40634 - DNA, 20 bp, Artificial
  CRISPR gRNA sequence
tccttagagatttttttttt

SEQ ID NO: 40635 - DNA, 20 bp, Artificial
  CRISPR gRNA sequence
ccttagagattttttttttt

SEQ ID NO: 40636 - DNA, 20 bp, Artificial
  CRISPR gRNA sequence
ttttttaattattatacttt

SEQ ID NO: 40637 - DNA, 20 bp, Artificial
  CRISPR gRNA sequence
aattattatactttaagttc

SEQ ID NO: 40638 - DNA, 20 bp, Artificial
  CRISPR gRNA sequence
attattatactttaagttct

SEQ ID NO: 40639 - DNA, 20 bp, Artificial
  CRISPR gRNA sequence
ttattatactttaagttcta

SEQ ID NO: 40640 - DNA, 20 bp, Artificial
  CRISPR gRNA sequence
gggtacatgtgcacaacata

SEQ ID NO: 40641 - DNA, 20 bp, Artificial
  CRISPR gRNA sequence
ggtacatgtgcacaacatac

SEQ ID NO: 40642 - DNA, 20 bp, Artificial
  CRISPR gRNA sequence
tatgtatacatgtgccatgt

SEQ ID NO: 40643 - DNA, 20 bp, Artificial
  CRISPR gRNA sequence
tgtgccatgttggtatgctg

SEQ ID NO: 40644 - DNA, 20 bp, Artificial
  CRISPR gRNA sequence
tgccatgttggtatgctgca

SEQ ID NO: 40645 - DNA, 20 bp, Artificial
  CRISPR gRNA sequence
ggtatgctgcagagactttt

SEQ ID NO: 40646 - DNA, 20 bp, Artificial
  CRISPR gRNA sequence
gcagagacttttaagaaaac

SEQ ID NO: 40647 - DNA, 20 bp, Artificial
  CRISPR gRNA sequence
cagagacttttaagaaaact

SEQ ID NO: 40648 - DNA, 20 bp, Artificial
  CRISPR gRNA sequence
agagacttttaagaaaactg

SEQ ID NO: 40649 - DNA, 20 bp, Artificial
  CRISPR gRNA sequence
gagacttttaagaaaactgg

SEQ ID NO: 40650 - DNA, 20 bp, Artificial
  CRISPR gRNA sequence
cttttaagaaaactgggggc

SEQ ID NO: 40651 - DNA, 20 bp, Artificial
  CRISPR gRNA sequence
ttttaagaaaactgggggcc

SEQ ID NO: 40652 - DNA, 20 bp, Artificial
  CRISPR gRNA sequence
agaaaactgggggccaggcg

SEQ ID NO: 40653 - DNA, 20 bp, Artificial
  CRISPR gRNA sequence
aaactgggggccaggcgcgg

SEQ ID NO: 40654 - DNA, 20 bp, Artificial
  CRISPR gRNA sequence
gtggctcacgcctgtaatcc

SEQ ID NO: 40655 - DNA, 20 bp, Artificial
  CRISPR gRNA sequence
cgcctgtaatcccagcattt

SEQ ID NO: 40656 - DNA, 20 bp, Artificial
  CRISPR gRNA sequence
gcctgtaatcccagcatttt

SEQ ID NO: 40657 - DNA, 20 bp, Artificial
  CRISPR gRNA sequence
ctgtaatcccagcattttgg

SEQ ID NO: 40658 - DNA, 20 bp, Artificial
  CRISPR gRNA sequence
tgtaatcccagcattttggg

SEQ ID NO: 40659 - DNA, 20 bp, Artificial
  CRISPR gRNA sequence
tcccagcattttgggaggcc

SEQ ID NO: 40660 - DNA, 20 bp, Artificial
  CRISPR gRNA sequence
cccagcattttgggaggcca

SEQ ID NO: 40661 - DNA, 20 bp, Artificial
  CRISPR gRNA sequence
agcattttgggaggccaagg

SEQ ID NO: 40662 - DNA, 20 bp, Artificial
  CRISPR gRNA sequence
gcattttgggaggccaaggt

SEQ ID NO: 40663 - DNA, 20 bp, Artificial
  CRISPR gRNA sequence
ttttgggaggccaaggtggg

SEQ ID NO: 40664 - DNA, 20 bp, Artificial
  CRISPR gRNA sequence
ccaaggtgggcggatcacgt

SEQ ID NO: 40665 - DNA, 20 bp, Artificial
  CRISPR gRNA sequence
caaggtgggcggatcacgtg

SEQ ID NO: 40666 - DNA, 20 bp, Artificial
  CRISPR gRNA sequence
gtgggcggatcacgtgaggt

SEQ ID NO: 40667 - DNA, 20 bp, Artificial
  CRISPR gRNA sequence
tgggcggatcacgtgaggtc

SEQ ID NO: 40668 - DNA, 20 bp, Artificial
  CRISPR gRNA sequence
ggcggatcacgtgaggtcag

SEQ ID NO: 40669 - DNA, 20 bp, Artificial
  CRISPR gRNA sequence
tcacgtgaggtcaggagttt

SEQ ID NO: 40670 - DNA, 20 bp, Artificial
  CRISPR gRNA sequence
tgaggtcaggagtttgagaa

SEQ ID NO: 40671 - DNA, 20 bp, Artificial
  CRISPR gRNA sequence
tcaggagtttgagaacagcc

SEQ ID NO: 40672 - DNA, 20 bp, Artificial
  CRISPR gRNA sequence
tttgagaacagcctggccaa

SEQ ID NO: 40673 - DNA, 20 bp, Artificial
  CRISPR gRNA sequence
ttgagaacagcctggccaac

SEQ ID NO: 40674 - DNA, 20 bp, Artificial
  CRISPR gRNA sequence
tgagaacagcctggccaaca

SEQ ID NO: 40675 - DNA, 20 bp, Artificial
  CRISPR gRNA sequence
aataccaaaaaaaaaaaaaa

SEQ ID NO: 40676 - DNA, 20 bp, Artificial
  CRISPR gRNA sequence
aaaaaaaaaaaaaaagtatc

SEQ ID NO: 40677 - DNA, 20 bp, Artificial
  CRISPR gRNA sequence
aaaaaaaaaaaaaagtatct

SEQ ID NO: 40678 - DNA, 20 bp, Artificial
  CRISPR gRNA sequence
aaaaaaaaagtatctgggcg

SEQ ID NO: 40679 - DNA, 20 bp, Artificial
  CRISPR gRNA sequence
aagtatctgggcgtggttgt

SEQ ID NO: 40680 - DNA, 20 bp, Artificial
  CRISPR gRNA sequence
ggcgtggttgtgagcccttg

SEQ ID NO: 40681 - DNA, 20 bp, Artificial
  CRISPR gRNA sequence
gttgtgagcccttgtagtgc

SEQ ID NO: 40682 - DNA, 20 bp, Artificial
  CRISPR gRNA sequence
cccttgtagtgccagccgct

SEQ ID NO: 40683 - DNA, 20 bp, Artificial
  CRISPR gRNA sequence
ccttgtagtgccagccgctc

SEQ ID NO: 40684 - DNA, 20 bp, Artificial
  CRISPR gRNA sequence
ttgtagtgccagccgctcag

SEQ ID NO: 40685 - DNA, 20 bp, Artificial
  CRISPR gRNA sequence
agtgccagccgctcaggagt

SEQ ID NO: 40686 - DNA, 20 bp, Artificial
  CRISPR gRNA sequence
gtgccagccgctcaggagtc

SEQ ID NO: 40687 - DNA, 20 bp, Artificial
  CRISPR gRNA sequence
gccagccgctcaggagtcag

SEQ ID NO: 40688 - DNA, 20 bp, Artificial
  CRISPR gRNA sequence
tcaggagaatcacttgaacc

SEQ ID NO: 40689 - DNA, 20 bp, Artificial
  CRISPR gRNA sequence
caggagaatcacttgaaccc

SEQ ID NO: 40690 - DNA, 20 bp, Artificial
  CRISPR gRNA sequence
ggagaatcacttgaacccag

SEQ ID NO: 40691 - DNA, 20 bp, Artificial
  CRISPR gRNA sequence
gagaatcacttgaacccagg

SEQ ID NO: 40692 - DNA, 20 bp, Artificial
  CRISPR gRNA sequence
tcacttgaacccaggaggcg

SEQ ID NO: 40693 - DNA, 20 bp, Artificial
  CRISPR gRNA sequence
cacttgaacccaggaggcga

SEQ ID NO: 40694 - DNA, 20 bp, Artificial
  CRISPR gRNA sequence
aacccaggaggcgaaggttg

SEQ ID NO: 40695 - DNA, 20 bp, Artificial
  CRISPR gRNA sequence
caggaggcgaaggttgcagt

SEQ ID NO: 40696 - DNA, 20 bp, Artificial
  CRISPR gRNA sequence
ggcgaaggttgcagtgagct

SEQ ID NO: 40697 - DNA, 20 bp, Artificial
  CRISPR gRNA sequence
gagatcgtgccactgcactc

SEQ ID NO: 40698 - DNA, 20 bp, Artificial
  CRISPR gRNA sequence
cgtgccactgcactccagcc

SEQ ID NO: 40699 - DNA, 20 bp, Artificial
  CRISPR gRNA sequence
gtgccactgcactccagcct

SEQ ID NO: 40700 - DNA, 20 bp, Artificial
  CRISPR gRNA sequence
ctgcactccagcctgggcga

SEQ ID NO: 40701 - DNA, 20 bp, Artificial
  CRISPR gRNA sequence
gcactccagcctgggcgaca

SEQ ID NO: 40702 - DNA, 20 bp, Artificial
  CRISPR gRNA sequence
tccagcctgggcgacagagt

SEQ ID NO: 40703 - DNA, 20 bp, Artificial
  CRISPR gRNA sequence
gactccatctcaaaaaaaaa

SEQ ID NO: 40704 - DNA, 20 bp, Artificial
  CRISPR gRNA sequence
catctcaaaaaaaaaaagaa

SEQ ID NO: 40705 - DNA, 20 bp, Artificial
  CRISPR gRNA sequence
caaaaaaaaaaagaaaagaa

SEQ ID NO: 40706 - DNA, 20 bp, Artificial
  CRISPR gRNA sequence
aaaagaaaagaaaagaaaac

SEQ ID NO: 40707 - DNA, 20 bp, Artificial
  CRISPR gRNA sequence
aaagaaaagaaaagaaaact

SEQ ID NO: 40708 - DNA, 20 bp, Artificial
  CRISPR gRNA sequence
agaaaagaaaagaaaactgg

SEQ ID NO: 40709 - DNA, 20 bp, Artificial
  CRISPR gRNA sequence
aaagaaaactgggagcttcc

SEQ ID NO: 40710 - DNA, 20 bp, Artificial
  CRISPR gRNA sequence
gggagcttcctagttgccac

SEQ ID NO: 40711 - DNA, 20 bp, Artificial
  CRISPR gRNA sequence
ggagcttcctagttgccact

SEQ ID NO: 40712 - DNA, 20 bp, Artificial
  CRISPR gRNA sequence
gagcttcctagttgccactg

SEQ ID NO: 40713 - DNA, 20 bp, Artificial
  CRISPR gRNA sequence
cctagttgccactggggact

SEQ ID NO: 40714 - DNA, 20 bp, Artificial
  CRISPR gRNA sequence
ctagttgccactggggactc

SEQ ID NO: 40715 - DNA, 20 bp, Artificial
  CRISPR gRNA sequence
tagttgccactggggactca

SEQ ID NO: 40716 - DNA, 20 bp, Artificial
  CRISPR gRNA sequence
tcagggacctgtcttaattg

SEQ ID NO: 40717 - DNA, 20 bp, Artificial
  CRISPR gRNA sequence
cagggacctgtcttaattgt

SEQ ID NO: 40718 - DNA, 20 bp, Artificial
  CRISPR gRNA sequence
gggacctgtcttaattgtgg

SEQ ID NO: 40719 - DNA, 20 bp, Artificial
  CRISPR gRNA sequence
tcttaattgtgggagctgat

SEQ ID NO: 40720 - DNA, 20 bp, Artificial
  CRISPR gRNA sequence
gggagctgatgagaatataa

SEQ ID NO: 40721 - DNA, 20 bp, Artificial
  CRISPR gRNA sequence
ggagctgatgagaatataaa

SEQ ID NO: 40722 - DNA, 20 bp, Artificial
  CRISPR gRNA sequence
gagctgatgagaatataaaa

SEQ ID NO: 40723 - DNA, 20 bp, Artificial
  CRISPR gRNA sequence
agctgatgagaatataaaag

SEQ ID NO: 40724 - DNA, 20 bp, Artificial
  CRISPR gRNA sequence
ctgatgagaatataaaaggg

SEQ ID NO: 40725 - DNA, 20 bp, Artificial
  CRISPR gRNA sequence
tgatgagaatataaaagggg

SEQ ID NO: 40726 - DNA, 20 bp, Artificial
  CRISPR gRNA sequence
gaatataaaaggggaggcac

SEQ ID NO: 40727 - DNA, 20 bp, Artificial
  CRISPR gRNA sequence
ataaaaggggaggcaccagc

SEQ ID NO: 40728 - DNA, 20 bp, Artificial
  CRISPR gRNA sequence
aggggaggcaccagccagcc

SEQ ID NO: 40729 - DNA, 20 bp, Artificial
  CRISPR gRNA sequence
accagccagccaagccaccc

SEQ ID NO: 40730 - DNA, 20 bp, Artificial
  CRISPR gRNA sequence
ccagccagccaagccacccc

SEQ ID NO: 40731 - DNA, 20 bp, Artificial
  CRISPR gRNA sequence
gccaagccaccccaggcact

SEQ ID NO: 40732 - DNA, 20 bp, Artificial
  CRISPR gRNA sequence
ccaagccaccccaggcactc

SEQ ID NO: 40733 - DNA, 20 bp, Artificial
  CRISPR gRNA sequence
caagccaccccaggcactca

SEQ ID NO: 40734 - DNA, 20 bp, Artificial
  CRISPR gRNA sequence
ggcaccgcatccatgatttt

SEQ ID NO: 40735 - DNA, 20 bp, Artificial
  CRISPR gRNA sequence
gcaccgcatccatgattttc

SEQ ID NO: 40736 - DNA, 20 bp, Artificial
  CRISPR gRNA sequence
caccgcatccatgattttca

SEQ ID NO: 40737 - DNA, 20 bp, Artificial
  CRISPR gRNA sequence
accgcatccatgattttcag

SEQ ID NO: 40738 - DNA, 20 bp, Artificial
  CRISPR gRNA sequence
cgcatccatgattttcaggg

SEQ ID NO: 40739 - DNA, 20 bp, Artificial
  CRISPR gRNA sequence
gcatccatgattttcagggg

SEQ ID NO: 40740 - DNA, 20 bp, Artificial
  CRISPR gRNA sequence
tgcttccctttcccttccct

SEQ ID NO: 40741 - DNA, 20 bp, Artificial
  CRISPR gRNA sequence
gcttccctttcccttcccta

SEQ ID NO: 40742 - DNA, 20 bp, Artificial
  CRISPR gRNA sequence
tcccttccctaaggaccccc

SEQ ID NO: 40743 - DNA, 20 bp, Artificial
  CRISPR gRNA sequence
tccctaaggacccccaagaa

SEQ ID NO: 40744 - DNA, 20 bp, Artificial
  CRISPR gRNA sequence
ccctaaggacccccaagaat

SEQ ID NO: 40745 - DNA, 20 bp, Artificial
  CRISPR gRNA sequence
ctaaggacccccaagaatgg

SEQ ID NO: 40746 - DNA, 20 bp, Artificial
  CRISPR gRNA sequence
taaggacccccaagaatggg

SEQ ID NO: 40747 - DNA, 20 bp, Artificial
  CRISPR gRNA sequence
cccaagaatgggaggtgcca

SEQ ID NO: 40748 - DNA, 20 bp, Artificial
  CRISPR gRNA sequence
aagaatgggaggtgccacag

SEQ ID NO: 40749 - DNA, 20 bp, Artificial
  CRISPR gRNA sequence
atgggaggtgccacagcaga

SEQ ID NO: 40750 - DNA, 20 bp, Artificial
  CRISPR gRNA sequence
aggtgccacagcagatggac

SEQ ID NO: 40751 - DNA, 20 bp, Artificial
  CRISPR gRNA sequence
ggtgccacagcagatggacc

SEQ ID NO: 40752 - DNA, 20 bp, Artificial
  CRISPR gRNA sequence
cacagcagatggaccaggct

SEQ ID NO: 40753 - DNA, 20 bp, Artificial
  CRISPR gRNA sequence
ctcagttacttaactgctgc

SEQ ID NO: 40754 - DNA, 20 bp, Artificial
  CRISPR gRNA sequence
ttacttaactgctgcgagct

SEQ ID NO: 40755 - DNA, 20 bp, Artificial
  CRISPR gRNA sequence
acttaactgctgcgagctca

SEQ ID NO: 40756 - DNA, 20 bp, Artificial
  CRISPR gRNA sequence
taactgctgcgagctcagag

SEQ ID NO: 40757 - DNA, 20 bp, Artificial
  CRISPR gRNA sequence
aactgctgcgagctcagagc

SEQ ID NO: 40758 - DNA, 20 bp, Artificial
  CRISPR gRNA sequence
tgcgagctcagagcaggtcc

SEQ ID NO: 40759 - DNA, 20 bp, Artificial
  CRISPR gRNA sequence
cgagctcagagcaggtccca

SEQ ID NO: 40760 - DNA, 20 bp, Artificial
  CRISPR gRNA sequence
agcaggtcccagagcctctc

SEQ ID NO: 40761 - DNA, 20 bp, Artificial
  CRISPR gRNA sequence
gcaggtcccagagcctctcc

SEQ ID NO: 40762 - DNA, 20 bp, Artificial
  CRISPR gRNA sequence
cccagagcctctccaggcct

SEQ ID NO: 40763 - DNA, 20 bp, Artificial
  CRISPR gRNA sequence
cagtttcctcatctgtaaaa

SEQ ID NO: 40764 - DNA, 20 bp, Artificial
  CRISPR gRNA sequence
gtttcctcatctgtaaaatg

SEQ ID NO: 40765 - DNA, 20 bp, Artificial
  CRISPR gRNA sequence
ctcatctgtaaaatggagat

SEQ ID NO: 40766 - DNA, 20 bp, Artificial
  CRISPR gRNA sequence
atggagataagaataattac

SEQ ID NO: 40767 - DNA, 20 bp, Artificial
  CRISPR gRNA sequence
gataagaataattactggcc

SEQ ID NO: 40768 - DNA, 20 bp, Artificial
  CRISPR gRNA sequence
gaataattactggcctggca

SEQ ID NO: 40769 - DNA, 20 bp, Artificial
  CRISPR gRNA sequence
taattactggcctggcacag

SEQ ID NO: 40770 - DNA, 20 bp, Artificial
  CRISPR gRNA sequence
ctggcctggcacagtggctc

SEQ ID NO: 40771 - DNA, 20 bp, Artificial
  CRISPR gRNA sequence
gtggctcaagcctgtaatcc

SEQ ID NO: 40772 - DNA, 20 bp, Artificial
  CRISPR gRNA sequence
agcctgtaatcccagcactt

SEQ ID NO: 40773 - DNA, 20 bp, Artificial
  CRISPR gRNA sequence
gcctgtaatcccagcacttt

SEQ ID NO: 40774 - DNA, 20 bp, Artificial
  CRISPR gRNA sequence
ctgtaatcccagcactttgg

SEQ ID NO: 40775 - DNA, 20 bp, Artificial
  CRISPR gRNA sequence
tgtaatcccagcactttggg

SEQ ID NO: 40776 - DNA, 20 bp, Artificial
  CRISPR gRNA sequence
tcccagcactttgggaggcc

SEQ ID NO: 40777 - DNA, 20 bp, Artificial
  CRISPR gRNA sequence
agcactttgggaggccaaga

SEQ ID NO: 40778 - DNA, 20 bp, Artificial
  CRISPR gRNA sequence
gcactttgggaggccaagac

SEQ ID NO: 40779 - DNA, 20 bp, Artificial
  CRISPR gRNA sequence
actttgggaggccaagacag

SEQ ID NO: 40780 - DNA, 20 bp, Artificial
  CRISPR gRNA sequence
ctttgggaggccaagacagg

SEQ ID NO: 40781 - DNA, 20 bp, Artificial
  CRISPR gRNA sequence
ttgggaggccaagacaggag

SEQ ID NO: 40782 - DNA, 20 bp, Artificial
  CRISPR gRNA sequence
tgggaggccaagacaggagg

SEQ ID NO: 40783 - DNA, 20 bp, Artificial
  CRISPR gRNA sequence
ggaggccaagacaggaggag

SEQ ID NO: 40784 - DNA, 20 bp, Artificial
  CRISPR gRNA sequence
gaggccaagacaggaggagg

SEQ ID NO: 40785 - DNA, 20 bp, Artificial
  CRISPR gRNA sequence
caggaggaggaggatcacct

SEQ ID NO: 40786 - DNA, 20 bp, Artificial
  CRISPR gRNA sequence
ggaggaggatcacctgagcc

SEQ ID NO: 40787 - DNA, 20 bp, Artificial
  CRISPR gRNA sequence
gaggaggatcacctgagcct

SEQ ID NO: 40788 - DNA, 20 bp, Artificial
  CRISPR gRNA sequence
ggaggatcacctgagcctag

SEQ ID NO: 40789 - DNA, 20 bp, Artificial
  CRISPR gRNA sequence
tcacctgagcctaggagttt

SEQ ID NO: 40790 - DNA, 20 bp, Artificial
  CRISPR gRNA sequence
tgagcctaggagtttgagac

SEQ ID NO: 40791 - DNA, 20 bp, Artificial
  CRISPR gRNA sequence
ctaggagtttgagaccagcc

SEQ ID NO: 40792 - DNA, 20 bp, Artificial
  CRISPR gRNA sequence
tgagaccagcctggacaaca

SEQ ID NO: 40793 - DNA, 20 bp, Artificial
  CRISPR gRNA sequence
accagcctggacaacatggt

SEQ ID NO: 40794 - DNA, 20 bp, Artificial
  CRISPR gRNA sequence
gtgagacccccccatctcta

SEQ ID NO: 40795 - DNA, 20 bp, Artificial
  CRISPR gRNA sequence
tctacagaaactttaaaaat

SEQ ID NO: 40796 - DNA, 20 bp, Artificial
  CRISPR gRNA sequence
agaaactttaaaaattagcc

SEQ ID NO: 40797 - DNA, 20 bp, Artificial
  CRISPR gRNA sequence
taaaaattagccaagcgtga

SEQ ID NO: 40798 - DNA, 20 bp, Artificial
  CRISPR gRNA sequence
cgtgatggcatgcacctact

SEQ ID NO: 40799 - DNA, 20 bp, Artificial
  CRISPR gRNA sequence
gtgatggcatgcacctactt

SEQ ID NO: 40800 - DNA, 20 bp, Artificial
  CRISPR gRNA sequence
gatggcatgcacctacttgg

SEQ ID NO: 40801 - DNA, 20 bp, Artificial
  CRISPR gRNA sequence
atggcatgcacctacttggg

SEQ ID NO: 40802 - DNA, 20 bp, Artificial
  CRISPR gRNA sequence
atgcacctacttgggaggct

SEQ ID NO: 40803 - DNA, 20 bp, Artificial
  CRISPR gRNA sequence
tgcacctacttgggaggctg

SEQ ID NO: 40804 - DNA, 20 bp, Artificial
  CRISPR gRNA sequence
acctacttgggaggctgagg

SEQ ID NO: 40805 - DNA, 20 bp, Artificial
  CRISPR gRNA sequence
cctacttgggaggctgaggt

SEQ ID NO: 40806 - DNA, 20 bp, Artificial
  CRISPR gRNA sequence
tacttgggaggctgaggtgg

SEQ ID NO: 40807 - DNA, 20 bp, Artificial
  CRISPR gRNA sequence
acttgggaggctgaggtggg

SEQ ID NO: 40808 - DNA, 20 bp, Artificial
  CRISPR gRNA sequence
gctgaggtgggaggattgct

SEQ ID NO: 40809 - DNA, 20 bp, Artificial
  CRISPR gRNA sequence
gtgggaggattgcttagact

SEQ ID NO: 40810 - DNA, 20 bp, Artificial
  CRISPR gRNA sequence
tgggaggattgcttagactc

SEQ ID NO: 40811 - DNA, 20 bp, Artificial
  CRISPR gRNA sequence
ggaggattgcttagactcag

SEQ ID NO: 40812 - DNA, 20 bp, Artificial
  CRISPR gRNA sequence
ttgcttagactcaggagatc

SEQ ID NO: 40813 - DNA, 20 bp, Artificial
  CRISPR gRNA sequence
tgcttagactcaggagatcg

SEQ ID NO: 40814 - DNA, 20 bp, Artificial
  CRISPR gRNA sequence
gactcaggagatcgaggcta

SEQ ID NO: 40815 - DNA, 20 bp, Artificial
  CRISPR gRNA sequence
caggagatcgaggctacagt

SEQ ID NO: 40816 - DNA, 20 bp, Artificial
  CRISPR gRNA sequence
gtgatcacaccattgcactc

SEQ ID NO: 40817 - DNA, 20 bp, Artificial
  CRISPR gRNA sequence
cacaccattgcactccagcc

SEQ ID NO: 40818 - DNA, 20 bp, Artificial
  CRISPR gRNA sequence
acaccattgcactccagcct

SEQ ID NO: 40819 - DNA, 20 bp, Artificial
  CRISPR gRNA sequence
ttgcactccagcctgggcaa

SEQ ID NO: 40820 - DNA, 20 bp, Artificial
  CRISPR gRNA sequence
gcactccagcctgggcaaca

SEQ ID NO: 40821 - DNA, 20 bp, Artificial
  CRISPR gRNA sequence
tccagcctgggcaacagagc

SEQ ID NO: 40822 - DNA, 20 bp, Artificial
  CRISPR gRNA sequence
cagagcaagactctgtctca

SEQ ID NO: 40823 - DNA, 20 bp, Artificial
  CRISPR gRNA sequence
tctcaaagaaaaaaaaatgt

SEQ ID NO: 40824 - DNA, 20 bp, Artificial
  CRISPR gRNA sequence
ctcaaagaaaaaaaaatgtc

SEQ ID NO: 40825 - DNA, 20 bp, Artificial
  CRISPR gRNA sequence
aaaaaaaatgtcaggcacaa

SEQ ID NO: 40826 - DNA, 20 bp, Artificial
  CRISPR gRNA sequence
atggctcacatctgtaattc

SEQ ID NO: 40827 - DNA, 20 bp, Artificial
  CRISPR gRNA sequence
catctgtaattccagcactt

SEQ ID NO: 40828 - DNA, 20 bp, Artificial
  CRISPR gRNA sequence
atctgtaattccagcacttt

SEQ ID NO: 40829 - DNA, 20 bp, Artificial
  CRISPR gRNA sequence
ctgtaattccagcactttgg

SEQ ID NO: 40830 - DNA, 20 bp, Artificial
  CRISPR gRNA sequence
tgtaattccagcactttggg

SEQ ID NO: 40831 - DNA, 20 bp, Artificial
  CRISPR gRNA sequence
ttccagcactttgggaggct

SEQ ID NO: 40832 - DNA, 20 bp, Artificial
  CRISPR gRNA sequence
tccagcactttgggaggcta

SEQ ID NO: 40833 - DNA, 20 bp, Artificial
  CRISPR gRNA sequence
agcactttgggaggctaagg

SEQ ID NO: 40834 - DNA, 20 bp, Artificial
  CRISPR gRNA sequence
gcactttgggaggctaaggc

SEQ ID NO: 40835 - DNA, 20 bp, Artificial
  CRISPR gRNA sequence
actttgggaggctaaggcag

SEQ ID NO: 40836 - DNA, 20 bp, Artificial
  CRISPR gRNA sequence
ctttgggaggctaaggcagg

SEQ ID NO: 40837 - DNA, 20 bp, Artificial
  CRISPR gRNA sequence
ctaaggcaggaggatcgttt

SEQ ID NO: 40838 - DNA, 20 bp, Artificial
  CRISPR gRNA sequence
caggaggatcgtttgagcca

SEQ ID NO: 40839 - DNA, 20 bp, Artificial
  CRISPR gRNA sequence
ggaggatcgtttgagccatg

SEQ ID NO: 40840 - DNA, 20 bp, Artificial
  CRISPR gRNA sequence
tcgtttgagccatggagttt

SEQ ID NO: 40841 - DNA, 20 bp, Artificial
  CRISPR gRNA sequence
tgagccatggagtttgagac

SEQ ID NO: 40842 - DNA, 20 bp, Artificial
  CRISPR gRNA sequence
tgagaccagcctgctcaaca

SEQ ID NO: 40843 - DNA, 20 bp, Artificial
  CRISPR gRNA sequence
tctacaaaaaatacaaaaat

SEQ ID NO: 40844 - DNA, 20 bp, Artificial
  CRISPR gRNA sequence
caaaaaatacaaaaattaga

SEQ ID NO: 40845 - DNA, 20 bp, Artificial
  CRISPR gRNA sequence
atacaaaaattagacagtca

SEQ ID NO: 40846 - DNA, 20 bp, Artificial
  CRISPR gRNA sequence
caaaaattagacagtcatgg

SEQ ID NO: 40847 - DNA, 20 bp, Artificial
  CRISPR gRNA sequence
aaaaattagacagtcatggt

SEQ ID NO: 40848 - DNA, 20 bp, Artificial
  CRISPR gRNA sequence
aaaattagacagtcatggtg

SEQ ID NO: 40849 - DNA, 20 bp, Artificial
  CRISPR gRNA sequence
gtcatggtggggcgttcctg

SEQ ID NO: 40850 - DNA, 20 bp, Artificial
  CRISPR gRNA sequence
gtggggcgttcctgtagtcc

SEQ ID NO: 40851 - DNA, 20 bp, Artificial
  CRISPR gRNA sequence
ttcctgtagtcccagctact

SEQ ID NO: 40852 - DNA, 20 bp, Artificial
  CRISPR gRNA sequence
tcctgtagtcccagctactt

SEQ ID NO: 40853 - DNA, 20 bp, Artificial
  CRISPR gRNA sequence
ctgtagtcccagctacttgg

SEQ ID NO: 40854 - DNA, 20 bp, Artificial
  CRISPR gRNA sequence
tgtagtcccagctacttggg

SEQ ID NO: 40855 - DNA, 20 bp, Artificial
  CRISPR gRNA sequence
tcccagctacttgggaggct

SEQ ID NO: 40856 - DNA, 20 bp, Artificial
  CRISPR gRNA sequence
cccagctacttgggaggctg

SEQ ID NO: 40857 - DNA, 20 bp, Artificial
  CRISPR gRNA sequence
agctacttgggaggctgagg

SEQ ID NO: 40858 - DNA, 20 bp, Artificial
  CRISPR gRNA sequence
tacttgggaggctgaggcag

SEQ ID NO: 40859 - DNA, 20 bp, Artificial
  CRISPR gRNA sequence
acttgggaggctgaggcagt

SEQ ID NO: 40860 - DNA, 20 bp, Artificial
  CRISPR gRNA sequence
ggaggctgaggcagtaggat

SEQ ID NO: 40861 - DNA, 20 bp, Artificial
  CRISPR gRNA sequence
ctgaggcagtaggatcagtt

SEQ ID NO: 40862 - DNA, 20 bp, Artificial
  CRISPR gRNA sequence
gcagtaggatcagttgagcc

SEQ ID NO: 40863 - DNA, 20 bp, Artificial
  CRISPR gRNA sequence
cagtaggatcagttgagccc

SEQ ID NO: 40864 - DNA, 20 bp, Artificial
  CRISPR gRNA sequence
agtaggatcagttgagcccg

SEQ ID NO: 40865 - DNA, 20 bp, Artificial
  CRISPR gRNA sequence
aggatcagttgagcccgggg

SEQ ID NO: 40866 - DNA, 20 bp, Artificial
  CRISPR gRNA sequence
ggatcagttgagcccgggga

SEQ ID NO: 40867 - DNA, 20 bp, Artificial
  CRISPR gRNA sequence
agttgagcccggggaaggtt

SEQ ID NO: 40868 - DNA, 20 bp, Artificial
  CRISPR gRNA sequence
gttgagcccggggaaggttg

SEQ ID NO: 40869 - DNA, 20 bp, Artificial
  CRISPR gRNA sequence
cccggggaaggttgaggctg

SEQ ID NO: 40870 - DNA, 20 bp, Artificial
  CRISPR gRNA sequence
gggaaggttgaggctgcagt

SEQ ID NO: 40871 - DNA, 20 bp, Artificial
  CRISPR gRNA sequence
atgactgcaccactgcacac

SEQ ID NO: 40872 - DNA, 20 bp, Artificial
  CRISPR gRNA sequence
tgcaccactgcacaccagcc

SEQ ID NO: 40873 - DNA, 20 bp, Artificial
  CRISPR gRNA sequence
gcaccactgcacaccagcct

SEQ ID NO: 40874 - DNA, 20 bp, Artificial
  CRISPR gRNA sequence
ctgcacaccagcctgggcga

SEQ ID NO: 40875 - DNA, 20 bp, Artificial
  CRISPR gRNA sequence
gcacaccagcctgggcgaca

SEQ ID NO: 40876 - DNA, 20 bp, Artificial
  CRISPR gRNA sequence
accagcctgggcgacagagc

SEQ ID NO: 40877 - DNA, 20 bp, Artificial
  CRISPR gRNA sequence
ctttcttcgaaacaacaaca

SEQ ID NO: 40878 - DNA, 20 bp, Artificial
  CRISPR gRNA sequence
tcttcgaaacaacaacaaag

SEQ ID NO: 40879 - DNA, 20 bp, Artificial
  CRISPR gRNA sequence
cttacctcattgtttattgt

SEQ ID NO: 40880 - DNA, 20 bp, Artificial
  CRISPR gRNA sequence
gtttattgtgagaatcaaat

SEQ ID NO: 40881 - DNA, 20 bp, Artificial
  CRISPR gRNA sequence
aatcaaatgagaaatgtcga

SEQ ID NO: 40882 - DNA, 20 bp, Artificial
  CRISPR gRNA sequence
taatctattccttgtttgct

SEQ ID NO: 40883 - DNA, 20 bp, Artificial
  CRISPR gRNA sequence
ctattccttgtttgctaaga

SEQ ID NO: 40884 - DNA, 20 bp, Artificial
  CRISPR gRNA sequence
ttccttgtttgctaagaaag

SEQ ID NO: 40885 - DNA, 20 bp, Artificial
  CRISPR gRNA sequence
tccttgtttgctaagaaagc

SEQ ID NO: 40886 - DNA, 20 bp, Artificial
  CRISPR gRNA sequence
gctaagaaagcaggccaccc

SEQ ID NO: 40887 - DNA, 20 bp, Artificial
  CRISPR gRNA sequence
ctaagaaagcaggccacccc

SEQ ID NO: 40888 - DNA, 20 bp, Artificial
  CRISPR gRNA sequence
caggccctccttgccctgac

SEQ ID NO: 40889 - DNA, 20 bp, Artificial
  CRISPR gRNA sequence
cctccttgccctgaccagtc

SEQ ID NO: 40890 - DNA, 20 bp, Artificial
  CRISPR gRNA sequence
ctccttgccctgaccagtct

SEQ ID NO: 40891 - DNA, 20 bp, Artificial
  CRISPR gRNA sequence
gtctgggttcttgccactgc

SEQ ID NO: 40892 - DNA, 20 bp, Artificial
  CRISPR gRNA sequence
tctgggttcttgccactgcc

SEQ ID NO: 40893 - DNA, 20 bp, Artificial
  CRISPR gRNA sequence
ctgggttcttgccactgcca

SEQ ID NO: 40894 - DNA, 20 bp, Artificial
  CRISPR gRNA sequence
ggttcttgccactgccaggg

SEQ ID NO: 40895 - DNA, 20 bp, Artificial
  CRISPR gRNA sequence
cttgccactgccagggaagt

SEQ ID NO: 40896 - DNA, 20 bp, Artificial
  CRISPR gRNA sequence
tgctgcttcctctctgcttc

SEQ ID NO: 40897 - DNA, 20 bp, Artificial
  CRISPR gRNA sequence
ctctctgcttccagctttga

SEQ ID NO: 40898 - DNA, 20 bp, Artificial
  CRISPR gRNA sequence
gaaagccaacacatcctcct

SEQ ID NO: 40899 - DNA, 20 bp, Artificial
  CRISPR gRNA sequence
aagccaacacatcctcctga

SEQ ID NO: 40900 - DNA, 20 bp, Artificial
  CRISPR gRNA sequence
agccaacacatcctcctgag

SEQ ID NO: 40901 - DNA, 20 bp, Artificial
  CRISPR gRNA sequence
gccaacacatcctcctgaga

SEQ ID NO: 40902 - DNA, 20 bp, Artificial
  CRISPR gRNA sequence
ccaacacatcctcctgagag

SEQ ID NO: 40903 - DNA, 20 bp, Artificial
  CRISPR gRNA sequence
acatcctcctgagaggggac

SEQ ID NO: 40904 - DNA, 20 bp, Artificial
  CRISPR gRNA sequence
ctcctgagaggggacaagac

SEQ ID NO: 40905 - DNA, 20 bp, Artificial
  CRISPR gRNA sequence
ctgagaggggacaagacaag

SEQ ID NO: 40906 - DNA, 20 bp, Artificial
  CRISPR gRNA sequence
tgagaggggacaagacaagc

SEQ ID NO: 40907 - DNA, 20 bp, Artificial
  CRISPR gRNA sequence
aggggacaagacaagcaggt

SEQ ID NO: 40908 - DNA, 20 bp, Artificial
  CRISPR gRNA sequence
ggggacaagacaagcaggtg

SEQ ID NO: 40909 - DNA, 20 bp, Artificial
  CRISPR gRNA sequence
ggacaagacaagcaggtgag

SEQ ID NO: 40910 - DNA, 20 bp, Artificial
  CRISPR gRNA sequence
gacaagacaagcaggtgagg

SEQ ID NO: 40911 - DNA, 20 bp, Artificial
  CRISPR gRNA sequence
acaagacaagcaggtgagga

SEQ ID NO: 40912 - DNA, 20 bp, Artificial
  CRISPR gRNA sequence
gcaggtgaggagggaacgct

SEQ ID NO: 40913 - DNA, 20 bp, Artificial
  CRISPR gRNA sequence
caggtgaggagggaacgctc

SEQ ID NO: 40914 - DNA, 20 bp, Artificial
  CRISPR gRNA sequence
aggtgaggagggaacgctcg

SEQ ID NO: 40915 - DNA, 20 bp, Artificial
  CRISPR gRNA sequence
tgaggagggaacgctcgggg

SEQ ID NO: 40916 - DNA, 20 bp, Artificial
  CRISPR gRNA sequence
gaggagggaacgctcggggt

SEQ ID NO: 40917 - DNA, 20 bp, Artificial
  CRISPR gRNA sequence
aggagggaacgctcggggtg

SEQ ID NO: 40918 - DNA, 20 bp, Artificial
  CRISPR gRNA sequence
ggagggaacgctcggggtgg

SEQ ID NO: 40919 - DNA, 20 bp, Artificial
  CRISPR gRNA sequence
agggaacgctcggggtgggg

SEQ ID NO: 40920 - DNA, 20 bp, Artificial
  CRISPR gRNA sequence
gggggagtcccctcccgctc

SEQ ID NO: 40921 - DNA, 20 bp, Artificial
  CRISPR gRNA sequence
ccgctctggtccccgtctgt

SEQ ID NO: 40922 - DNA, 20 bp, Artificial
  CRISPR gRNA sequence
gctctggtccccgtctgttg

SEQ ID NO: 40923 - DNA, 20 bp, Artificial
  CRISPR gRNA sequence
ctctggtccccgtctgttgg

SEQ ID NO: 40924 - DNA, 20 bp, Artificial
  CRISPR gRNA sequence
gttggaggtccccccacccc

SEQ ID NO: 40925 - DNA, 20 bp, Artificial
  CRISPR gRNA sequence
ccagacccatgctgaccact

SEQ ID NO: 40926 - DNA, 20 bp, Artificial
  CRISPR gRNA sequence
catgctgaccactcagctct

SEQ ID NO: 40927 - DNA, 20 bp, Artificial
  CRISPR gRNA sequence
agctctcagttaaaccaccc

SEQ ID NO: 40928 - DNA, 20 bp, Artificial
  CRISPR gRNA sequence
tcagttaaaccacccaagtc

SEQ ID NO: 40929 - DNA, 20 bp, Artificial
  CRISPR gRNA sequence
accacccaagtccggcacac

SEQ ID NO: 40930 - DNA, 20 bp, Artificial
  CRISPR gRNA sequence
ccacccaagtccggcacact

SEQ ID NO: 40931 - DNA, 20 bp, Artificial
  CRISPR gRNA sequence
actaggtttaatcaccactt

SEQ ID NO: 40932 - DNA, 20 bp, Artificial
  CRISPR gRNA sequence
ccgccccccccataaattgt

SEQ ID NO: 40933 - DNA, 20 bp, Artificial
  CRISPR gRNA sequence
caactgccctgttttcccct

SEQ ID NO: 40934 - DNA, 20 bp, Artificial
  CRISPR gRNA sequence
ctgccctgttttccccttgg

SEQ ID NO: 40935 - DNA, 20 bp, Artificial
  CRISPR gRNA sequence
tgccctgttttccccttgga

SEQ ID NO: 40936 - DNA, 20 bp, Artificial
  CRISPR gRNA sequence
ccctgttttccccttggaag

SEQ ID NO: 40937 - DNA, 20 bp, Artificial
  CRISPR gRNA sequence
cctgttttccccttggaagg

SEQ ID NO: 40938 - DNA, 20 bp, Artificial
  CRISPR gRNA sequence
ccccttggaaggaggcaatg

SEQ ID NO: 40939 - DNA, 20 bp, Artificial
  CRISPR gRNA sequence
ttggaaggaggcaatgcaga

SEQ ID NO: 40940 - DNA, 20 bp, Artificial
  CRISPR gRNA sequence
tggaaggaggcaatgcagat

SEQ ID NO: 40941 - DNA, 20 bp, Artificial
  CRISPR gRNA sequence
gaaggaggcaatgcagatgg

SEQ ID NO: 40942 - DNA, 20 bp, Artificial
  CRISPR gRNA sequence
aaggaggcaatgcagatggg

SEQ ID NO: 40943 - DNA, 20 bp, Artificial
  CRISPR gRNA sequence
gaggcaatgcagatgggagg

SEQ ID NO: 40944 - DNA, 20 bp, Artificial
  CRISPR gRNA sequence
aggcaatgcagatgggagga

SEQ ID NO: 40945 - DNA, 20 bp, Artificial
  CRISPR gRNA sequence
ggcaatgcagatgggaggaa

SEQ ID NO: 40946 - DNA, 20 bp, Artificial
  CRISPR gRNA sequence
caatgcagatgggaggaagg

SEQ ID NO: 40947 - DNA, 20 bp, Artificial
  CRISPR gRNA sequence
aatgcagatgggaggaaggg

SEQ ID NO: 40948 - DNA, 20 bp, Artificial
  CRISPR gRNA sequence
atgcagatgggaggaaggga

SEQ ID NO: 40949 - DNA, 20 bp, Artificial
  CRISPR gRNA sequence
atgggaggaagggagggata

SEQ ID NO: 40950 - DNA, 20 bp, Artificial
  CRISPR gRNA sequence
gaggaagggagggatatggt

SEQ ID NO: 40951 - DNA, 20 bp, Artificial
  CRISPR gRNA sequence
aggaagggagggatatggtt

SEQ ID NO: 40952 - DNA, 20 bp, Artificial
  CRISPR gRNA sequence
gaagggagggatatggttgg

SEQ ID NO: 40953 - DNA, 20 bp, Artificial
  CRISPR gRNA sequence
agggagggatatggttggga

SEQ ID NO: 40954 - DNA, 20 bp, Artificial
  CRISPR gRNA sequence
gggagggatatggttgggag

SEQ ID NO: 40955 - DNA, 20 bp, Artificial
  CRISPR gRNA sequence
gatatggttgggagaggtcc

SEQ ID NO: 40956 - DNA, 20 bp, Artificial
  CRISPR gRNA sequence
tatggttgggagaggtccca

SEQ ID NO: 40957 - DNA, 20 bp, Artificial
  CRISPR gRNA sequence
ggttgggagaggtcccagag

SEQ ID NO: 40958 - DNA, 20 bp, Artificial
  CRISPR gRNA sequence
gttgggagaggtcccagagc

SEQ ID NO: 40959 - DNA, 20 bp, Artificial
  CRISPR gRNA sequence
ttgggagaggtcccagagca

SEQ ID NO: 40960 - DNA, 20 bp, Artificial
  CRISPR gRNA sequence
ggagaggtcccagagcaggg

SEQ ID NO: 40961 - DNA, 20 bp, Artificial
  CRISPR gRNA sequence
gagaggtcccagagcagggc

SEQ ID NO: 40962 - DNA, 20 bp, Artificial
  CRISPR gRNA sequence
cagagcagggcaggtgcccg

SEQ ID NO: 40963 - DNA, 20 bp, Artificial
  CRISPR gRNA sequence
gcccgcagattgctgctgtg

SEQ ID NO: 40964 - DNA, 20 bp, Artificial
  CRISPR gRNA sequence
cccgcagattgctgctgtgt

SEQ ID NO: 40965 - DNA, 20 bp, Artificial
  CRISPR gRNA sequence
cgcagattgctgctgtgtgg

SEQ ID NO: 40966 - DNA, 20 bp, Artificial
  CRISPR gRNA sequence
gcagattgctgctgtgtggg

SEQ ID NO: 40967 - DNA, 20 bp, Artificial
  CRISPR gRNA sequence
agattgctgctgtgtgggag

SEQ ID NO: 40968 - DNA, 20 bp, Artificial
  CRISPR gRNA sequence
tgctgctgtgtgggaggaga

SEQ ID NO: 40969 - DNA, 20 bp, Artificial
  CRISPR gRNA sequence
gctgctgtgtgggaggagac

SEQ ID NO: 40970 - DNA, 20 bp, Artificial
  CRISPR gRNA sequence
tgctgtgtgggaggagacag

SEQ ID NO: 40971 - DNA, 20 bp, Artificial
  CRISPR gRNA sequence
acatttgtgcttctgcgttt

SEQ ID NO: 40972 - DNA, 20 bp, Artificial
  CRISPR gRNA sequence
catttgtgcttctgcgtttc

SEQ ID NO: 40973 - DNA, 20 bp, Artificial
  CRISPR gRNA sequence
atttgtgcttctgcgtttcg

SEQ ID NO: 40974 - DNA, 20 bp, Artificial
  CRISPR gRNA sequence
ctgcgtttcggggaattttg

SEQ ID NO: 40975 - DNA, 20 bp, Artificial
  CRISPR gRNA sequence
cactgccctttcacgctctg

SEQ ID NO: 40976 - DNA, 20 bp, Artificial
  CRISPR gRNA sequence
actgccctttcacgctctga

SEQ ID NO: 40977 - DNA, 20 bp, Artificial
  CRISPR gRNA sequence
gccctttcacgctctgaagg

SEQ ID NO: 40978 - DNA, 20 bp, Artificial
  CRISPR gRNA sequence
ccctttcacgctctgaaggc

SEQ ID NO: 40979 - DNA, 20 bp, Artificial
  CRISPR gRNA sequence
cctttcacgctctgaaggca

SEQ ID NO: 40980 - DNA, 20 bp, Artificial
  CRISPR gRNA sequence
ctttcacgctctgaaggcag

SEQ ID NO: 40981 - DNA, 20 bp, Artificial
  CRISPR gRNA sequence
cgctctgaaggcaggggccg

SEQ ID NO: 40982 - DNA, 20 bp, Artificial
  CRISPR gRNA sequence
gctctgaaggcaggggccgt

SEQ ID NO: 40983 - DNA, 20 bp, Artificial
  CRISPR gRNA sequence
aaacattttccccgtcttcg

SEQ ID NO: 40984 - DNA, 20 bp, Artificial
  CRISPR gRNA sequence
tcgcagtaaacaaccaatac

SEQ ID NO: 40985 - DNA, 20 bp, Artificial
  CRISPR gRNA sequence
gtaaacaaccaatactagtt

SEQ ID NO: 40986 - DNA, 20 bp, Artificial
  CRISPR gRNA sequence
ttagctcttcatgatgttcc

SEQ ID NO: 40987 - DNA, 20 bp, Artificial
  CRISPR gRNA sequence
tgatgttcccggctgccctc

SEQ ID NO: 40988 - DNA, 20 bp, Artificial
  CRISPR gRNA sequence
tgttcccggctgccctctag

SEQ ID NO: 40989 - DNA, 20 bp, Artificial
  CRISPR gRNA sequence
gttcccggctgccctctagt

SEQ ID NO: 40990 - DNA, 20 bp, Artificial
  CRISPR gRNA sequence
cggctgccctctagtgggac

SEQ ID NO: 40991 - DNA, 20 bp, Artificial
  CRISPR gRNA sequence
ggctgccctctagtgggacc

SEQ ID NO: 40992 - DNA, 20 bp, Artificial
  CRISPR gRNA sequence
tctagtgggaccaggcctct

SEQ ID NO: 40993 - DNA, 20 bp, Artificial
  CRISPR gRNA sequence
ccaggcctcttggcctcact

SEQ ID NO: 40994 - DNA, 20 bp, Artificial
  CRISPR gRNA sequence
caggcctcttggcctcactt

SEQ ID NO: 40995 - DNA, 20 bp, Artificial
  CRISPR gRNA sequence
ggcctcttggcctcacttgg

SEQ ID NO: 40996 - DNA, 20 bp, Artificial
  CRISPR gRNA sequence
ctcttggcctcacttgggag

SEQ ID NO: 40997 - DNA, 20 bp, Artificial
  CRISPR gRNA sequence
ttggcctcacttgggagcag

SEQ ID NO: 40998 - DNA, 20 bp, Artificial
  CRISPR gRNA sequence
gcctcacttgggagcagtgg

SEQ ID NO: 40999 - DNA, 20 bp, Artificial
  CRISPR gRNA sequence
tcacttgggagcagtggcag

SEQ ID NO: 41000 - DNA, 20 bp, Artificial
  CRISPR gRNA sequence
ttgggagcagtggcagcgga

SEQ ID NO: 41001 - DNA, 20 bp, Artificial
  CRISPR gRNA sequence
tgggagcagtggcagcggac

SEQ ID NO: 41002 - DNA, 20 bp, Artificial
  CRISPR gRNA sequence
gggagcagtggcagcggaca

SEQ ID NO: 41003 - DNA, 20 bp, Artificial
  CRISPR gRNA sequence
agcagtggcagcggacaggg

SEQ ID NO: 41004 - DNA, 20 bp, Artificial
  CRISPR gRNA sequence
gcagtggcagcggacagggt

SEQ ID NO: 41005 - DNA, 20 bp, Artificial
  CRISPR gRNA sequence
ggacagggtgggcccatgtg

SEQ ID NO: 41006 - DNA, 20 bp, Artificial
  CRISPR gRNA sequence
agggtgggcccatgtgcagc

SEQ ID NO: 41007 - DNA, 20 bp, Artificial
  CRISPR gRNA sequence
tgggcccatgtgcagctggc

SEQ ID NO: 41008 - DNA, 20 bp, Artificial
  CRISPR gRNA sequence
gggcccatgtgcagctggct

SEQ ID NO: 41009 - DNA, 20 bp, Artificial
  CRISPR gRNA sequence
cccatgtgcagctggctggg

SEQ ID NO: 41010 - DNA, 20 bp, Artificial
  CRISPR gRNA sequence
catgtgcagctggctgggtg

SEQ ID NO: 41011 - DNA, 20 bp, Artificial
  CRISPR gRNA sequence
tgtgcagctggctgggtgga

SEQ ID NO: 41012 - DNA, 20 bp, Artificial
  CRISPR gRNA sequence
tgcagctggctgggtggaga

SEQ ID NO: 41013 - DNA, 20 bp, Artificial
  CRISPR gRNA sequence
tggctgggtggagagagtca

SEQ ID NO: 41014 - DNA, 20 bp, Artificial
  CRISPR gRNA sequence
tgggtggagagagtcacagc

SEQ ID NO: 41015 - DNA, 20 bp, Artificial
  CRISPR gRNA sequence
agagtcacagctagtgtgtc

SEQ ID NO: 41016 - DNA, 20 bp, Artificial
  CRISPR gRNA sequence
cacagctagtgtgtcaagaa

SEQ ID NO: 41017 - DNA, 20 bp, Artificial
  CRISPR gRNA sequence
acagctagtgtgtcaagaaa

SEQ ID NO: 41018 - DNA, 20 bp, Artificial
  CRISPR gRNA sequence
caagaaaaggcactgccgta

SEQ ID NO: 41019 - DNA, 20 bp, Artificial
  CRISPR gRNA sequence
aaaaggcactgccgtacaga

SEQ ID NO: 41020 - DNA, 20 bp, Artificial
  CRISPR gRNA sequence
aaaggcactgccgtacagat

SEQ ID NO: 41021 - DNA, 20 bp, Artificial
  CRISPR gRNA sequence
ctgccgtacagatgggctgt

SEQ ID NO: 41022 - DNA, 20 bp, Artificial
  CRISPR gRNA sequence
tgccgtacagatgggctgtc

SEQ ID NO: 41023 - DNA, 20 bp, Artificial
  CRISPR gRNA sequence
ccgtacagatgggctgtcag

SEQ ID NO: 41024 - DNA, 20 bp, Artificial
  CRISPR gRNA sequence
acagatgggctgtcaggagt

SEQ ID NO: 41025 - DNA, 20 bp, Artificial
  CRISPR gRNA sequence
cagatgggctgtcaggagtc

SEQ ID NO: 41026 - DNA, 20 bp, Artificial
  CRISPR gRNA sequence
agatgggctgtcaggagtca

SEQ ID NO: 41027 - DNA, 20 bp, Artificial
  CRISPR gRNA sequence
gatgggctgtcaggagtcag

SEQ ID NO: 41028 - DNA, 20 bp, Artificial
  CRISPR gRNA sequence
gggctgtcaggagtcagggg

SEQ ID NO: 41029 - DNA, 20 bp, Artificial
  CRISPR gRNA sequence
tcaggagtcaggggtggctc

SEQ ID NO: 41030 - DNA, 20 bp, Artificial
  CRISPR gRNA sequence
agtcaggggtggctcaagcc

SEQ ID NO: 41031 - DNA, 20 bp, Artificial
  CRISPR gRNA sequence
gtcaggggtggctcaagcct

SEQ ID NO: 41032 - DNA, 20 bp, Artificial
  CRISPR gRNA sequence
aggggtggctcaagcctggg

SEQ ID NO: 41033 - DNA, 20 bp, Artificial
  CRISPR gRNA sequence
gcctgggtggtcttgcttcc

SEQ ID NO: 41034 - DNA, 20 bp, Artificial
  CRISPR gRNA sequence
cctgggtggtcttgcttccc

SEQ ID NO: 41035 - DNA, 20 bp, Artificial
  CRISPR gRNA sequence
ggtggtcttgcttcccagga

SEQ ID NO: 41036 - DNA, 20 bp, Artificial
  CRISPR gRNA sequence
gtggtcttgcttcccaggat

SEQ ID NO: 41037 - DNA, 20 bp, Artificial
  CRISPR gRNA sequence
caggataggatctctgtttc

SEQ ID NO: 41038 - DNA, 20 bp, Artificial
  CRISPR gRNA sequence
aggataggatctctgtttct

SEQ ID NO: 41039 - DNA, 20 bp, Artificial
  CRISPR gRNA sequence
ggataggatctctgtttctg

SEQ ID NO: 41040 - DNA, 20 bp, Artificial
  CRISPR gRNA sequence
ctctgtttctggggaacccc

SEQ ID NO: 41041 - DNA, 20 bp, Artificial
  CRISPR gRNA sequence
tctgtttctggggaaccccc

SEQ ID NO: 41042 - DNA, 20 bp, Artificial
  CRISPR gRNA sequence
tggggaacccccgggttctt

SEQ ID NO: 41043 - DNA, 20 bp, Artificial
  CRISPR gRNA sequence
ggggaacccccgggttcttg

SEQ ID NO: 41044 - DNA, 20 bp, Artificial
  CRISPR gRNA sequence
ccccgggttcttgaggccca

SEQ ID NO: 41045 - DNA, 20 bp, Artificial
  CRISPR gRNA sequence
aggcccaaagaactgacgta

SEQ ID NO: 41046 - DNA, 20 bp, Artificial
  CRISPR gRNA sequence
ggcccaaagaactgacgtac

SEQ ID NO: 41047 - DNA, 20 bp, Artificial
  CRISPR gRNA sequence
gcccaaagaactgacgtaca

SEQ ID NO: 41048 - DNA, 20 bp, Artificial
  CRISPR gRNA sequence
ccaaagaactgacgtacagg

SEQ ID NO: 41049 - DNA, 20 bp, Artificial
  CRISPR gRNA sequence
caaagaactgacgtacaggg

SEQ ID NO: 41050 - DNA, 20 bp, Artificial
  CRISPR gRNA sequence
agaactgacgtacagggagg

SEQ ID NO: 41051 - DNA, 20 bp, Artificial
  CRISPR gRNA sequence
actgacgtacagggaggcag

SEQ ID NO: 41052 - DNA, 20 bp, Artificial
  CRISPR gRNA sequence
ggcagaagtcatgtgatgcc

SEQ ID NO: 41053 - DNA, 20 bp, Artificial
  CRISPR gRNA sequence
agaagtcatgtgatgccaag

SEQ ID NO: 41054 - DNA, 20 bp, Artificial
  CRISPR gRNA sequence
agtcatgtgatgccaagcag

SEQ ID NO: 41055 - DNA, 20 bp, Artificial
  CRISPR gRNA sequence
atgtgatgccaagcagtggt

SEQ ID NO: 41056 - DNA, 20 bp, Artificial
  CRISPR gRNA sequence
gtgatgccaagcagtggtca

SEQ ID NO: 41057 - DNA, 20 bp, Artificial
  CRISPR gRNA sequence
gatgccaagcagtggtcaga

SEQ ID NO: 41058 - DNA, 20 bp, Artificial
  CRISPR gRNA sequence
atgccaagcagtggtcagag

SEQ ID NO: 41059 - DNA, 20 bp, Artificial
  CRISPR gRNA sequence
tggtcagagaggctctgtct

SEQ ID NO: 41060 - DNA, 20 bp, Artificial
  CRISPR gRNA sequence
ggtcagagaggctctgtctt

SEQ ID NO: 41061 - DNA, 20 bp, Artificial
  CRISPR gRNA sequence
ggtcctcctgcctgctcacc

SEQ ID NO: 41062 - DNA, 20 bp, Artificial
  CRISPR gRNA sequence
ctcctgcctgctcacctgga

SEQ ID NO: 41063 - DNA, 20 bp, Artificial
  CRISPR gRNA sequence
tcctgcctgctcacctggac

SEQ ID NO: 41064 - DNA, 20 bp, Artificial
  CRISPR gRNA sequence
ctgctcacctggacaggaac

SEQ ID NO: 41065 - DNA, 20 bp, Artificial
  CRISPR gRNA sequence
cctggacaggaacaagctgc

SEQ ID NO: 41066 - DNA, 20 bp, Artificial
  CRISPR gRNA sequence
agctgctggcttttctaact

SEQ ID NO: 41067 - DNA, 20 bp, Artificial
  CRISPR gRNA sequence
gctgctggcttttctaactc

SEQ ID NO: 41068 - DNA, 20 bp, Artificial
  CRISPR gRNA sequence
aactcaggcttcccttccct

SEQ ID NO: 41069 - DNA, 20 bp, Artificial
  CRISPR gRNA sequence
ggcttcccttccctgagcct

SEQ ID NO: 41070 - DNA, 20 bp, Artificial
  CRISPR gRNA sequence
agtttccccatctgaacaat

SEQ ID NO: 41071 - DNA, 20 bp, Artificial
  CRISPR gRNA sequence
gtttccccatctgaacaatg

SEQ ID NO: 41072 - DNA, 20 bp, Artificial
  CRISPR gRNA sequence
tttccccatctgaacaatga

SEQ ID NO: 41073 - DNA, 20 bp, Artificial
  CRISPR gRNA sequence
catctgaacaatgagggact

SEQ ID NO: 41074 - DNA, 20 bp, Artificial
  CRISPR gRNA sequence
tgaacaatgagggactgagc

SEQ ID NO: 41075 - DNA, 20 bp, Artificial
  CRISPR gRNA sequence
gaacaatgagggactgagct

SEQ ID NO: 41076 - DNA, 20 bp, Artificial
  CRISPR gRNA sequence
tgagggactgagctaggatc

SEQ ID NO: 41077 - DNA, 20 bp, Artificial
  CRISPR gRNA sequence
ctagtgactgcattgtctct

SEQ ID NO: 41078 - DNA, 20 bp, Artificial
  CRISPR gRNA sequence
attgtctctgagatgccttc

SEQ ID NO: 41079 - DNA, 20 bp, Artificial
  CRISPR gRNA sequence
ccttccagccctgactttcc

SEQ ID NO: 41080 - DNA, 20 bp, Artificial
  CRISPR gRNA sequence
cagccctgactttccaagtc

SEQ ID NO: 41081 - DNA, 20 bp, Artificial
  CRISPR gRNA sequence
agccctgactttccaagtct

SEQ ID NO: 41082 - DNA, 20 bp, Artificial
  CRISPR gRNA sequence
ccctgactttccaagtctgg

SEQ ID NO: 41083 - DNA, 20 bp, Artificial
  CRISPR gRNA sequence
ccaagtctgggagtccaatg

SEQ ID NO: 41084 - DNA, 20 bp, Artificial
  CRISPR gRNA sequence
caagtctgggagtccaatgt

SEQ ID NO: 41085 - DNA, 20 bp, Artificial
  CRISPR gRNA sequence
tttctaaacgatccccctcc

SEQ ID NO: 41086 - DNA, 20 bp, Artificial
  CRISPR gRNA sequence
ttctaaacgatccccctcct

SEQ ID NO: 41087 - DNA, 20 bp, Artificial
  CRISPR gRNA sequence
tctaaacgatccccctccta

SEQ ID NO: 41088 - DNA, 20 bp, Artificial
  CRISPR gRNA sequence
ctaaacgatccccctcctag

SEQ ID NO: 41089 - DNA, 20 bp, Artificial
  CRISPR gRNA sequence
atccccctcctaggggtata

SEQ ID NO: 41090 - DNA, 20 bp, Artificial
  CRISPR gRNA sequence
tccccctcctaggggtatat

SEQ ID NO: 41091 - DNA, 20 bp, Artificial
  CRISPR gRNA sequence
cctcctaggggtatatgggc

SEQ ID NO: 41092 - DNA, 20 bp, Artificial
  CRISPR gRNA sequence
ctcctaggggtatatgggct

SEQ ID NO: 41093 - DNA, 20 bp, Artificial
  CRISPR gRNA sequence
taggggtatatgggctgggc

SEQ ID NO: 41094 - DNA, 20 bp, Artificial
  CRISPR gRNA sequence
aggggtatatgggctgggct

SEQ ID NO: 41095 - DNA, 20 bp, Artificial
  CRISPR gRNA sequence
gggtatatgggctgggctgg

SEQ ID NO: 41096 - DNA, 20 bp, Artificial
  CRISPR gRNA sequence
atgggctgggctgggagtcc

SEQ ID NO: 41097 - DNA, 20 bp, Artificial
  CRISPR gRNA sequence
tgggctgggctgggagtccg

SEQ ID NO: 41098 - DNA, 20 bp, Artificial
  CRISPR gRNA sequence
gggctgggctgggagtccga

SEQ ID NO: 41099 - DNA, 20 bp, Artificial
  CRISPR gRNA sequence
ggctgggctgggagtccgag

SEQ ID NO: 41100 - DNA, 20 bp, Artificial
  CRISPR gRNA sequence
gctgggctgggagtccgagg

SEQ ID NO: 41101 - DNA, 20 bp, Artificial
  CRISPR gRNA sequence
tttctaaatgatccccctcc

SEQ ID NO: 41102 - DNA, 20 bp, Artificial
  CRISPR gRNA sequence
ttctaaatgatccccctcct

SEQ ID NO: 41103 - DNA, 20 bp, Artificial
  CRISPR gRNA sequence
tctaaatgatccccctccta

SEQ ID NO: 41104 - DNA, 20 bp, Artificial
  CRISPR gRNA sequence
atccccctcctagggatatg

SEQ ID NO: 41105 - DNA, 20 bp, Artificial
  CRISPR gRNA sequence
tccccctcctagggatatgt

SEQ ID NO: 41106 - DNA, 20 bp, Artificial
  CRISPR gRNA sequence
cctagggatatgtgggccac

SEQ ID NO: 41107 - DNA, 20 bp, Artificial
  CRISPR gRNA sequence
gtgggccactggatctttgc

SEQ ID NO: 41108 - DNA, 20 bp, Artificial
  CRISPR gRNA sequence
tggatctttgccagacttcc

SEQ ID NO: 41109 - DNA, 20 bp, Artificial
  CRISPR gRNA sequence
tttgccagacttcccagctg

SEQ ID NO: 41110 - DNA, 20 bp, Artificial
  CRISPR gRNA sequence
cagacttcccagctgcagcc

SEQ ID NO: 41111 - DNA, 20 bp, Artificial
  CRISPR gRNA sequence
cccagctgcagccaagttct

SEQ ID NO: 41112 - DNA, 20 bp, Artificial
  CRISPR gRNA sequence
ccagctgcagccaagttctt

SEQ ID NO: 41113 - DNA, 20 bp, Artificial
  CRISPR gRNA sequence
cagctgcagccaagttctta

SEQ ID NO: 41114 - DNA, 20 bp, Artificial
  CRISPR gRNA sequence
ccaagttcttagggttccgt

SEQ ID NO: 41115 - DNA, 20 bp, Artificial
  CRISPR gRNA sequence
ttccgtcagcgctgcatccc

SEQ ID NO: 41116 - DNA, 20 bp, Artificial
  CRISPR gRNA sequence
tccgtcagcgctgcatcccc

SEQ ID NO: 41117 - DNA, 20 bp, Artificial
  CRISPR gRNA sequence
cgtcagcgctgcatccccag

SEQ ID NO: 41118 - DNA, 20 bp, Artificial
  CRISPR gRNA sequence
gctgcatccccaggagcctc

SEQ ID NO: 41119 - DNA, 20 bp, Artificial
  CRISPR gRNA sequence
aggagcctctggtactgtcc

SEQ ID NO: 41120 - DNA, 20 bp, Artificial
  CRISPR gRNA sequence
ctgtcccagcccttcttgtt

SEQ ID NO: 41121 - DNA, 20 bp, Artificial
  CRISPR gRNA sequence
tgtcccagcccttcttgttt

SEQ ID NO: 41122 - DNA, 20 bp, Artificial
  CRISPR gRNA sequence
gtcccagcccttcttgtttg

SEQ ID NO: 41123 - DNA, 20 bp, Artificial
  CRISPR gRNA sequence
tcccagcccttcttgtttgg

SEQ ID NO: 41124 - DNA, 20 bp, Artificial
  CRISPR gRNA sequence
ttgtttgggggtaaccataa

SEQ ID NO: 41125 - DNA, 20 bp, Artificial
  CRISPR gRNA sequence
tgtttgggggtaaccataat

SEQ ID NO: 41126 - DNA, 20 bp, Artificial
  CRISPR gRNA sequence
gtttgggggtaaccataata

SEQ ID NO: 41127 - DNA, 20 bp, Artificial
  CRISPR gRNA sequence
ggggtaaccataatagggat

SEQ ID NO: 41128 - DNA, 20 bp, Artificial
  CRISPR gRNA sequence
gggtaaccataatagggatg

SEQ ID NO: 41129 - DNA, 20 bp, Artificial
  CRISPR gRNA sequence
ccataatagggatgaggcgt

SEQ ID NO: 41130 - DNA, 20 bp, Artificial
  CRISPR gRNA sequence
ataatagggatgaggcgtca

SEQ ID NO: 41131 - DNA, 20 bp, Artificial
  CRISPR gRNA sequence
taatagggatgaggcgtcag

SEQ ID NO: 41132 - DNA, 20 bp, Artificial
  CRISPR gRNA sequence
aatagggatgaggcgtcaga

SEQ ID NO: 41133 - DNA, 20 bp, Artificial
  CRISPR gRNA sequence
atagggatgaggcgtcagag

SEQ ID NO: 41134 - DNA, 20 bp, Artificial
  CRISPR gRNA sequence
tagggatgaggcgtcagagg

SEQ ID NO: 41135 - DNA, 20 bp, Artificial
  CRISPR gRNA sequence
ggatgaggcgtcagaggggg

SEQ ID NO: 41136 - DNA, 20 bp, Artificial
  CRISPR gRNA sequence
atgaggcgtcagagggggca

SEQ ID NO: 41137 - DNA, 20 bp, Artificial
  CRISPR gRNA sequence
ggcgtcagagggggcagagc

SEQ ID NO: 41138 - DNA, 20 bp, Artificial
  CRISPR gRNA sequence
gtcagagggggcagagctgg

SEQ ID NO: 41139 - DNA, 20 bp, Artificial
  CRISPR gRNA sequence
tcagagggggcagagctggc

SEQ ID NO: 41140 - DNA, 20 bp, Artificial
  CRISPR gRNA sequence
cagagggggcagagctggca

SEQ ID NO: 41141 - DNA, 20 bp, Artificial
  CRISPR gRNA sequence
agagggggcagagctggcag

SEQ ID NO: 41142 - DNA, 20 bp, Artificial
  CRISPR gRNA sequence
gagggggcagagctggcagg

SEQ ID NO: 41143 - DNA, 20 bp, Artificial
  CRISPR gRNA sequence
gggcagagctggcagggggc

SEQ ID NO: 41144 - DNA, 20 bp, Artificial
  CRISPR gRNA sequence
ggcagagctggcagggggct

SEQ ID NO: 41145 - DNA, 20 bp, Artificial
  CRISPR gRNA sequence
gcagagctggcagggggcta

SEQ ID NO: 41146 - DNA, 20 bp, Artificial
  CRISPR gRNA sequence
agctggcagggggctagggc

SEQ ID NO: 41147 - DNA, 20 bp, Artificial
  CRISPR gRNA sequence
gctggcagggggctagggct

SEQ ID NO: 41148 - DNA, 20 bp, Artificial
  CRISPR gRNA sequence
ctggcagggggctagggctg

SEQ ID NO: 41149 - DNA, 20 bp, Artificial
  CRISPR gRNA sequence
agggggctagggctggggat

SEQ ID NO: 41150 - DNA, 20 bp, Artificial
  CRISPR gRNA sequence
gggggctagggctggggatt

SEQ ID NO: 41151 - DNA, 20 bp, Artificial
  CRISPR gRNA sequence
gctagggctggggattggga

SEQ ID NO: 41152 - DNA, 20 bp, Artificial
  CRISPR gRNA sequence
tagggctggggattgggata

SEQ ID NO: 41153 - DNA, 20 bp, Artificial
  CRISPR gRNA sequence
agggctggggattgggatag

SEQ ID NO: 41154 - DNA, 20 bp, Artificial
  CRISPR gRNA sequence
gggctggggattgggataga

SEQ ID NO: 41155 - DNA, 20 bp, Artificial
  CRISPR gRNA sequence
ctggggattgggatagaggg

SEQ ID NO: 41156 - DNA, 20 bp, Artificial
  CRISPR gRNA sequence
ggggattgggatagagggaa

SEQ ID NO: 41157 - DNA, 20 bp, Artificial
  CRISPR gRNA sequence
ggattgggatagagggaaga

SEQ ID NO: 41158 - DNA, 20 bp, Artificial
  CRISPR gRNA sequence
gattgggatagagggaagag

SEQ ID NO: 41159 - DNA, 20 bp, Artificial
  CRISPR gRNA sequence
attgggatagagggaagaga

SEQ ID NO: 41160 - DNA, 20 bp, Artificial
  CRISPR gRNA sequence
tgggatagagggaagagagg

SEQ ID NO: 41161 - DNA, 20 bp, Artificial
  CRISPR gRNA sequence
agagggaagagagggagttt

SEQ ID NO: 41162 - DNA, 20 bp, Artificial
  CRISPR gRNA sequence
agggaagagagggagtttaa

SEQ ID NO: 41163 - DNA, 20 bp, Artificial
  CRISPR gRNA sequence
agagagggagtttaagagaa

SEQ ID NO: 41164 - DNA, 20 bp, Artificial
  CRISPR gRNA sequence
gagagggagtttaagagaaa

SEQ ID NO: 41165 - DNA, 20 bp, Artificial
  CRISPR gRNA sequence
ggagtttaagagaaaaggaa

SEQ ID NO: 41166 - DNA, 20 bp, Artificial
  CRISPR gRNA sequence
tttaagagaaaaggaaaaga

SEQ ID NO: 41167 - DNA, 20 bp, Artificial
  CRISPR gRNA sequence
taagagaaaaggaaaagaaa

SEQ ID NO: 41168 - DNA, 20 bp, Artificial
  CRISPR gRNA sequence
aagagaaaaggaaaagaaag

SEQ ID NO: 41169 - DNA, 20 bp, Artificial
  CRISPR gRNA sequence
aaaaggaaaagaaagaggcg

SEQ ID NO: 41170 - DNA, 20 bp, Artificial
  CRISPR gRNA sequence
aaaggaaaagaaagaggcgt

SEQ ID NO: 41171 - DNA, 20 bp, Artificial
  CRISPR gRNA sequence
aaagaaagaggcgtgggtgt

SEQ ID NO: 41172 - DNA, 20 bp, Artificial
  CRISPR gRNA sequence
aagaaagaggcgtgggtgtg

SEQ ID NO: 41173 - DNA, 20 bp, Artificial
  CRISPR gRNA sequence
agaaagaggcgtgggtgtga

SEQ ID NO: 41174 - DNA, 20 bp, Artificial
  CRISPR gRNA sequence
gaaagaggcgtgggtgtgag

SEQ ID NO: 41175 - DNA, 20 bp, Artificial
  CRISPR gRNA sequence
ggcgtgggtgtgaggggtgc

SEQ ID NO: 41176 - DNA, 20 bp, Artificial
  CRISPR gRNA sequence
gcgtgggtgtgaggggtgct

SEQ ID NO: 41177 - DNA, 20 bp, Artificial
  CRISPR gRNA sequence
gtgggtgtgaggggtgctgg

SEQ ID NO: 41178 - DNA, 20 bp, Artificial
  CRISPR gRNA sequence
gtgtgaggggtgctgggagt

SEQ ID NO: 41179 - DNA, 20 bp, Artificial
  CRISPR gRNA sequence
tgtgaggggtgctgggagtt

SEQ ID NO: 41180 - DNA, 20 bp, Artificial
  CRISPR gRNA sequence
gtgaggggtgctgggagttg

SEQ ID NO: 41181 - DNA, 20 bp, Artificial
  CRISPR gRNA sequence
gaggggtgctgggagttggg

SEQ ID NO: 41182 - DNA, 20 bp, Artificial
  CRISPR gRNA sequence
tgctgggagttggggagctc

SEQ ID NO: 41183 - DNA, 20 bp, Artificial
  CRISPR gRNA sequence
tggggagctctggcccctga

SEQ ID NO: 41184 - DNA, 20 bp, Artificial
  CRISPR gRNA sequence
ggggagctctggcccctgac

SEQ ID NO: 41185 - DNA, 20 bp, Artificial
  CRISPR gRNA sequence
gagctctggcccctgacggg

SEQ ID NO: 41186 - DNA, 20 bp, Artificial
  CRISPR gRNA sequence
ctggcccctgacgggcagct

SEQ ID NO: 41187 - DNA, 20 bp, Artificial
  CRISPR gRNA sequence
cccctgacgggcagctcagc

SEQ ID NO: 41188 - DNA, 20 bp, Artificial
  CRISPR gRNA sequence
cccatgccccgcattctcct

SEQ ID NO: 41189 - DNA, 20 bp, Artificial
  CRISPR gRNA sequence
catgccccgcattctccttg

SEQ ID NO: 41190 - DNA, 20 bp, Artificial
  CRISPR gRNA sequence
tgccccgcattctccttgga

SEQ ID NO: 41191 - DNA, 20 bp, Artificial
  CRISPR gRNA sequence
cccgcattctccttggagag

SEQ ID NO: 41192 - DNA, 20 bp, Artificial
  CRISPR gRNA sequence
gaagattccacatttctgtg

SEQ ID NO: 41193 - DNA, 20 bp, Artificial
  CRISPR gRNA sequence
ccacatttctgtgaagcaaa

SEQ ID NO: 41194 - DNA, 20 bp, Artificial
  CRISPR gRNA sequence
acatttctgtgaagcaaaca

SEQ ID NO: 41195 - DNA, 20 bp, Artificial
  CRISPR gRNA sequence
tttctgtgaagcaaacagag

SEQ ID NO: 41196 - DNA, 20 bp, Artificial
  CRISPR gRNA sequence
gtgaagcaaacagagcagct

SEQ ID NO: 41197 - DNA, 20 bp, Artificial
  CRISPR gRNA sequence
cagctcagccactccctgcc

SEQ ID NO: 41198 - DNA, 20 bp, Artificial
  CRISPR gRNA sequence
agctcagccactccctgcct

SEQ ID NO: 41199 - DNA, 20 bp, Artificial
  CRISPR gRNA sequence
gctcagccactccctgcctg

SEQ ID NO: 41200 - DNA, 20 bp, Artificial
  CRISPR gRNA sequence
cctggggtctccatctgctc

SEQ ID NO: 41201 - DNA, 20 bp, Artificial
  CRISPR gRNA sequence
ctggggtctccatctgctct

SEQ ID NO: 41202 - DNA, 20 bp, Artificial
  CRISPR gRNA sequence
tggggtctccatctgctctg

SEQ ID NO: 41203 - DNA, 20 bp, Artificial
  CRISPR gRNA sequence
ggggtctccatctgctctgg

SEQ ID NO: 41204 - DNA, 20 bp, Artificial
  CRISPR gRNA sequence
tctgggggacacccactttc

SEQ ID NO: 41205 - DNA, 20 bp, Artificial
  CRISPR gRNA sequence
ggggacacccactttccaga

SEQ ID NO: 41206 - DNA, 20 bp, Artificial
  CRISPR gRNA sequence
acacccactttccagaaaga

SEQ ID NO: 41207 - DNA, 20 bp, Artificial
  CRISPR gRNA sequence
cacccactttccagaaagaa

SEQ ID NO: 41208 - DNA, 20 bp, Artificial
  CRISPR gRNA sequence
acccactttccagaaagaaa

SEQ ID NO: 41209 - DNA, 20 bp, Artificial
  CRISPR gRNA sequence
cccactttccagaaagaaag

SEQ ID NO: 41210 - DNA, 20 bp, Artificial
  CRISPR gRNA sequence
ctttccagaaagaaaggggt

SEQ ID NO: 41211 - DNA, 20 bp, Artificial
  CRISPR gRNA sequence
ctaatacactccccatctgc

SEQ ID NO: 41212 - DNA, 20 bp, Artificial
  CRISPR gRNA sequence
ccatctgcaagctctgccat

SEQ ID NO: 41213 - DNA, 20 bp, Artificial
  CRISPR gRNA sequence
atctgcaagctctgccatga

SEQ ID NO: 41214 - DNA, 20 bp, Artificial
  CRISPR gRNA sequence
tctgcaagctctgccatgag

SEQ ID NO: 41215 - DNA, 20 bp, Artificial
  CRISPR gRNA sequence
gctctgccatgagaggctgt

SEQ ID NO: 41216 - DNA, 20 bp, Artificial
  CRISPR gRNA sequence
gaggctgtgagaccctgact

SEQ ID NO: 41217 - DNA, 20 bp, Artificial
  CRISPR gRNA sequence
gacttggccccacctctctc

SEQ ID NO: 41218 - DNA, 20 bp, Artificial
  CRISPR gRNA sequence
acttggccccacctctctct

SEQ ID NO: 41219 - DNA, 20 bp, Artificial
  CRISPR gRNA sequence
cccacctctctctaggcctc

SEQ ID NO: 41220 - DNA, 20 bp, Artificial
  CRISPR gRNA sequence
ccacctctctctaggcctcc

SEQ ID NO: 41221 - DNA, 20 bp, Artificial
  CRISPR gRNA sequence
cacctctctctaggcctcca

SEQ ID NO: 41222 - DNA, 20 bp, Artificial
  CRISPR gRNA sequence
ctctctctaggcctccaggg

SEQ ID NO: 41223 - DNA, 20 bp, Artificial
  CRISPR gRNA sequence
tctctaggcctccagggaag

SEQ ID NO: 41224 - DNA, 20 bp, Artificial
  CRISPR gRNA sequence
tctaggcctccagggaagtg

SEQ ID NO: 41225 - DNA, 20 bp, Artificial
  CRISPR gRNA sequence
ctaggcctccagggaagtgg

SEQ ID NO: 41226 - DNA, 20 bp, Artificial
  CRISPR gRNA sequence
gcctccagggaagtggaggc

SEQ ID NO: 41227 - DNA, 20 bp, Artificial
  CRISPR gRNA sequence
ccagggaagtggaggcaagt

SEQ ID NO: 41228 - DNA, 20 bp, Artificial
  CRISPR gRNA sequence
cagggaagtggaggcaagtg

SEQ ID NO: 41229 - DNA, 20 bp, Artificial
  CRISPR gRNA sequence
agtggaggcaagtgaggccc

SEQ ID NO: 41230 - DNA, 20 bp, Artificial
  CRISPR gRNA sequence
gtggaggcaagtgaggccct

SEQ ID NO: 41231 - DNA, 20 bp, Artificial
  CRISPR gRNA sequence
gaggcaagtgaggccctggg

SEQ ID NO: 41232 - DNA, 20 bp, Artificial
  CRISPR gRNA sequence
aggcaagtgaggccctggga

SEQ ID NO: 41233 - DNA, 20 bp, Artificial
  CRISPR gRNA sequence
ggacatttcaatttcactgt

SEQ ID NO: 41234 - DNA, 20 bp, Artificial
  CRISPR gRNA sequence
ttcaatttcactgttagccc

SEQ ID NO: 41235 - DNA, 20 bp, Artificial
  CRISPR gRNA sequence
tcaatttcactgttagcccc

SEQ ID NO: 41236 - DNA, 20 bp, Artificial
  CRISPR gRNA sequence
caatttcactgttagcccca

SEQ ID NO: 41237 - DNA, 20 bp, Artificial
  CRISPR gRNA sequence
cactgttagccccagggcaa

SEQ ID NO: 41238 - DNA, 20 bp, Artificial
  CRISPR gRNA sequence
actgttagccccagggcaat

SEQ ID NO: 41239 - DNA, 20 bp, Artificial
  CRISPR gRNA sequence
ctgttagccccagggcaatg

SEQ ID NO: 41240 - DNA, 20 bp, Artificial
  CRISPR gRNA sequence
gttagccccagggcaatggg

SEQ ID NO: 41241 - DNA, 20 bp, Artificial
  CRISPR gRNA sequence
cccagggcaatggggagcca

SEQ ID NO: 41242 - DNA, 20 bp, Artificial
  CRISPR gRNA sequence
ccagggcaatggggagccac

SEQ ID NO: 41243 - DNA, 20 bp, Artificial
  CRISPR gRNA sequence
cagggcaatggggagccacg

SEQ ID NO: 41244 - DNA, 20 bp, Artificial
  CRISPR gRNA sequence
agggcaatggggagccacgg

SEQ ID NO: 41245 - DNA, 20 bp, Artificial
  CRISPR gRNA sequence
atggggagccacgggggtaa

SEQ ID NO: 41246 - DNA, 20 bp, Artificial
  CRISPR gRNA sequence
tggggagccacgggggtaac

SEQ ID NO: 41247 - DNA, 20 bp, Artificial
  CRISPR gRNA sequence
ggggagccacgggggtaaca

SEQ ID NO: 41248 - DNA, 20 bp, Artificial
  CRISPR gRNA sequence
ggagccacgggggtaacagg

SEQ ID NO: 41249 - DNA, 20 bp, Artificial
  CRISPR gRNA sequence
agccacgggggtaacaggga

SEQ ID NO: 41250 - DNA, 20 bp, Artificial
  CRISPR gRNA sequence
gccacgggggtaacagggag

SEQ ID NO: 41251 - DNA, 20 bp, Artificial
  CRISPR gRNA sequence
gggggtaacagggagaggcc

SEQ ID NO: 41252 - DNA, 20 bp, Artificial
  CRISPR gRNA sequence
gtaacagggagaggcctggt

SEQ ID NO: 41253 - DNA, 20 bp, Artificial
  CRISPR gRNA sequence
gagaggcctggtcagatgtg

SEQ ID NO: 41254 - DNA, 20 bp, Artificial
  CRISPR gRNA sequence
gatgtgcagtgttaaaatgt

SEQ ID NO: 41255 - DNA, 20 bp, Artificial
  CRISPR gRNA sequence
gttaaaatgtgagacacttg

SEQ ID NO: 41256 - DNA, 20 bp, Artificial
  CRISPR gRNA sequence
ttaaaatgtgagacacttgt

SEQ ID NO: 41257 - DNA, 20 bp, Artificial
  CRISPR gRNA sequence
taaaatgtgagacacttgtg

SEQ ID NO: 41258 - DNA, 20 bp, Artificial
  CRISPR gRNA sequence
aatgtgagacacttgtgggg

SEQ ID NO: 41259 - DNA, 20 bp, Artificial
  CRISPR gRNA sequence
tgtgagacacttgtggggca

SEQ ID NO: 41260 - DNA, 20 bp, Artificial
  CRISPR gRNA sequence
tgagacacttgtggggcaga

SEQ ID NO: 41261 - DNA, 20 bp, Artificial
  CRISPR gRNA sequence
gagacacttgtggggcagag

SEQ ID NO: 41262 - DNA, 20 bp, Artificial
  CRISPR gRNA sequence
agacacttgtggggcagaga

SEQ ID NO: 41263 - DNA, 20 bp, Artificial
  CRISPR gRNA sequence
tgtggggcagagagggatta

SEQ ID NO: 41264 - DNA, 20 bp, Artificial
  CRISPR gRNA sequence
gtggggcagagagggattaa

SEQ ID NO: 41265 - DNA, 20 bp, Artificial
  CRISPR gRNA sequence
tggggcagagagggattaaa

SEQ ID NO: 41266 - DNA, 20 bp, Artificial
  CRISPR gRNA sequence
gggcagagagggattaaagg

SEQ ID NO: 41267 - DNA, 20 bp, Artificial
  CRISPR gRNA sequence
ggcagagagggattaaaggg

SEQ ID NO: 41268 - DNA, 20 bp, Artificial
  CRISPR gRNA sequence
gagagggattaaagggaggc

SEQ ID NO: 41269 - DNA, 20 bp, Artificial
  CRISPR gRNA sequence
gagggattaaagggaggcaa

SEQ ID NO: 41270 - DNA, 20 bp, Artificial
  CRISPR gRNA sequence
ggattaaagggaggcaagag

SEQ ID NO: 41271 - DNA, 20 bp, Artificial
  CRISPR gRNA sequence
ttaaagggaggcaagagtgg

SEQ ID NO: 41272 - DNA, 20 bp, Artificial
  CRISPR gRNA sequence
gggaggcaagagtggaagcc

SEQ ID NO: 41273 - DNA, 20 bp, Artificial
  CRISPR gRNA sequence
gaggcaagagtggaagccca

SEQ ID NO: 41274 - DNA, 20 bp, Artificial
  CRISPR gRNA sequence
aggcaagagtggaagcccag

SEQ ID NO: 41275 - DNA, 20 bp, Artificial
  CRISPR gRNA sequence
ggcaagagtggaagcccaga

SEQ ID NO: 41276 - DNA, 20 bp, Artificial
  CRISPR gRNA sequence
gaagcccagagggtgttaaa

SEQ ID NO: 41277 - DNA, 20 bp, Artificial
  CRISPR gRNA sequence
ccagagggtgttaaatggtc

SEQ ID NO: 41278 - DNA, 20 bp, Artificial
  CRISPR gRNA sequence
cagagggtgttaaatggtca

SEQ ID NO: 41279 - DNA, 20 bp, Artificial
  CRISPR gRNA sequence
gggtgttaaatggtcaaggt

SEQ ID NO: 41280 - DNA, 20 bp, Artificial
  CRISPR gRNA sequence
gttaaatggtcaaggtgagt

SEQ ID NO: 41281 - DNA, 20 bp, Artificial
  CRISPR gRNA sequence
ttaaatggtcaaggtgagtg

SEQ ID NO: 41282 - DNA, 20 bp, Artificial
  CRISPR gRNA sequence
atggtcaaggtgagtgagga

SEQ ID NO: 41283 - DNA, 20 bp, Artificial
  CRISPR gRNA sequence
gtcaaggtgagtgaggatgg

SEQ ID NO: 41284 - DNA, 20 bp, Artificial
  CRISPR gRNA sequence
ggtgagtgaggatggtggcc

SEQ ID NO: 41285 - DNA, 20 bp, Artificial
  CRISPR gRNA sequence
gtgagtgaggatggtggcct

SEQ ID NO: 41286 - DNA, 20 bp, Artificial
  CRISPR gRNA sequence
gaggatggtggcctgggctc

SEQ ID NO: 41287 - DNA, 20 bp, Artificial
  CRISPR gRNA sequence
ggatggtggcctgggctctg

SEQ ID NO: 41288 - DNA, 20 bp, Artificial
  CRISPR gRNA sequence
gatggtggcctgggctctgg

SEQ ID NO: 41289 - DNA, 20 bp, Artificial
  CRISPR gRNA sequence
atggtggcctgggctctgga

SEQ ID NO: 41290 - DNA, 20 bp, Artificial
  CRISPR gRNA sequence
tggtggcctgggctctggag

SEQ ID NO: 41291 - DNA, 20 bp, Artificial
  CRISPR gRNA sequence
ggtggcctgggctctggagg

SEQ ID NO: 41292 - DNA, 20 bp, Artificial
  CRISPR gRNA sequence
ggcctgggctctggaggggg

SEQ ID NO: 41293 - DNA, 20 bp, Artificial
  CRISPR gRNA sequence
ctgggctctggagggggcgg

SEQ ID NO: 41294 - DNA, 20 bp, Artificial
  CRISPR gRNA sequence
tgggctctggagggggcggt

SEQ ID NO: 41295 - DNA, 20 bp, Artificial
  CRISPR gRNA sequence
gggctctggagggggcggtg

SEQ ID NO: 41296 - DNA, 20 bp, Artificial
  CRISPR gRNA sequence
gctctggagggggcggtggg

SEQ ID NO: 41297 - DNA, 20 bp, Artificial
  CRISPR gRNA sequence
ctctggagggggcggtgggg

SEQ ID NO: 41298 - DNA, 20 bp, Artificial
  CRISPR gRNA sequence
agggggcggtggggaggact

SEQ ID NO: 41299 - DNA, 20 bp, Artificial
  CRISPR gRNA sequence
ggggcggtggggaggacttg

SEQ ID NO: 41300 - DNA, 20 bp, Artificial
  CRISPR gRNA sequence
ggcggtggggaggacttgga

SEQ ID NO: 41301 - DNA, 20 bp, Artificial
  CRISPR gRNA sequence
ggacttggagagtcactgac

SEQ ID NO: 41302 - DNA, 20 bp, Artificial
  CRISPR gRNA sequence
gacttggagagtcactgaca

SEQ ID NO: 41303 - DNA, 20 bp, Artificial
  CRISPR gRNA sequence
acttggagagtcactgacaa

SEQ ID NO: 41304 - DNA, 20 bp, Artificial
  CRISPR gRNA sequence
tggagagtcactgacaaggg

SEQ ID NO: 41305 - DNA, 20 bp, Artificial
  CRISPR gRNA sequence
gagtcactgacaagggcagc

SEQ ID NO: 41306 - DNA, 20 bp, Artificial
  CRISPR gRNA sequence
agtcactgacaagggcagct

SEQ ID NO: 41307 - DNA, 20 bp, Artificial
  CRISPR gRNA sequence
gacaagggcagctgggaact

SEQ ID NO: 41308 - DNA, 20 bp, Artificial
  CRISPR gRNA sequence
acaagggcagctgggaactc

SEQ ID NO: 41309 - DNA, 20 bp, Artificial
  CRISPR gRNA sequence
caagggcagctgggaactca

SEQ ID NO: 41310 - DNA, 20 bp, Artificial
  CRISPR gRNA sequence
gggtcctgcactgtcactgt

SEQ ID NO: 41311 - DNA, 20 bp, Artificial
  CRISPR gRNA sequence
ggtcctgcactgtcactgtc

SEQ ID NO: 41312 - DNA, 20 bp, Artificial
  CRISPR gRNA sequence
gtcctgcactgtcactgtca

SEQ ID NO: 41313 - DNA, 20 bp, Artificial
  CRISPR gRNA sequence
ctgcactgtcactgtcaggg

SEQ ID NO: 41314 - DNA, 20 bp, Artificial
  CRISPR gRNA sequence
tgcactgtcactgtcagggc

SEQ ID NO: 41315 - DNA, 20 bp, Artificial
  CRISPR gRNA sequence
cactgtcactgtcagggcag

SEQ ID NO: 41316 - DNA, 20 bp, Artificial
  CRISPR gRNA sequence
actgtcactgtcagggcagg

SEQ ID NO: 41317 - DNA, 20 bp, Artificial
  CRISPR gRNA sequence
cactgtcagggcaggaggat

SEQ ID NO: 41318 - DNA, 20 bp, Artificial
  CRISPR gRNA sequence
actgtcagggcaggaggatt

SEQ ID NO: 41319 - DNA, 20 bp, Artificial
  CRISPR gRNA sequence
ctgtcagggcaggaggattg

SEQ ID NO: 41320 - DNA, 20 bp, Artificial
  CRISPR gRNA sequence
tgtcagggcaggaggattgg

SEQ ID NO: 41321 - DNA, 20 bp, Artificial
  CRISPR gRNA sequence
ggcaggaggattgggggctg

SEQ ID NO: 41322 - DNA, 20 bp, Artificial
  CRISPR gRNA sequence
gcaggaggattgggggctgc

SEQ ID NO: 41323 - DNA, 20 bp, Artificial
  CRISPR gRNA sequence
caggaggattgggggctgca

SEQ ID NO: 41324 - DNA, 20 bp, Artificial
  CRISPR gRNA sequence
aggaggattgggggctgcag

SEQ ID NO: 41325 - DNA, 20 bp, Artificial
  CRISPR gRNA sequence
gaggattgggggctgcaggg

SEQ ID NO: 41326 - DNA, 20 bp, Artificial
  CRISPR gRNA sequence
gggggctgcaggggagactc

SEQ ID NO: 41327 - DNA, 20 bp, Artificial
  CRISPR gRNA sequence
gggctgcaggggagactcga

SEQ ID NO: 41328 - DNA, 20 bp, Artificial
  CRISPR gRNA sequence
ggctgcaggggagactcgag

SEQ ID NO: 41329 - DNA, 20 bp, Artificial
  CRISPR gRNA sequence
gctgcaggggagactcgaga

SEQ ID NO: 41330 - DNA, 20 bp, Artificial
  CRISPR gRNA sequence
gcaggggagactcgagaggg

SEQ ID NO: 41331 - DNA, 20 bp, Artificial
  CRISPR gRNA sequence
gggagactcgagagggaagc

SEQ ID NO: 41332 - DNA, 20 bp, Artificial
  CRISPR gRNA sequence
agagggaagcgagtgcccca

SEQ ID NO: 41333 - DNA, 20 bp, Artificial
  CRISPR gRNA sequence
gagggaagcgagtgccccac

SEQ ID NO: 41334 - DNA, 20 bp, Artificial
  CRISPR gRNA sequence
agggaagcgagtgccccaca

SEQ ID NO: 41335 - DNA, 20 bp, Artificial
  CRISPR gRNA sequence
gggaagcgagtgccccacag

SEQ ID NO: 41336 - DNA, 20 bp, Artificial
  CRISPR gRNA sequence
aagcgagtgccccacagggg

SEQ ID NO: 41337 - DNA, 20 bp, Artificial
  CRISPR gRNA sequence
agcgagtgccccacagggga

SEQ ID NO: 41338 - DNA, 20 bp, Artificial
  CRISPR gRNA sequence
gcgagtgccccacaggggaa

SEQ ID NO: 41339 - DNA, 20 bp, Artificial
  CRISPR gRNA sequence
cgagtgccccacaggggaag

SEQ ID NO: 41340 - DNA, 20 bp, Artificial
  CRISPR gRNA sequence
cccacaggggaaggggcctg

SEQ ID NO: 41341 - DNA, 20 bp, Artificial
  CRISPR gRNA sequence
ggggcctgtggcctcccact

SEQ ID NO: 41342 - DNA, 20 bp, Artificial
  CRISPR gRNA sequence
ggcctgtggcctcccactta

SEQ ID NO: 41343 - DNA, 20 bp, Artificial
  CRISPR gRNA sequence
tgtggcctcccacttagagt

SEQ ID NO: 41344 - DNA, 20 bp, Artificial
  CRISPR gRNA sequence
gtggcctcccacttagagtg

SEQ ID NO: 41345 - DNA, 20 bp, Artificial
  CRISPR gRNA sequence
tggcctcccacttagagtga

SEQ ID NO: 41346 - DNA, 20 bp, Artificial
  CRISPR gRNA sequence
ccacttagagtgagggatgc

SEQ ID NO: 41347 - DNA, 20 bp, Artificial
  CRISPR gRNA sequence
cacttagagtgagggatgct

SEQ ID NO: 41348 - DNA, 20 bp, Artificial
  CRISPR gRNA sequence
cttagagtgagggatgctgg

SEQ ID NO: 41349 - DNA, 20 bp, Artificial
  CRISPR gRNA sequence
agagtgagggatgctgggag

SEQ ID NO: 41350 - DNA, 20 bp, Artificial
  CRISPR gRNA sequence
gagtgagggatgctgggaga

SEQ ID NO: 41351 - DNA, 20 bp, Artificial
  CRISPR gRNA sequence
gagggatgctgggagaagga

SEQ ID NO: 41352 - DNA, 20 bp, Artificial
  CRISPR gRNA sequence
gggatgctgggagaaggata

SEQ ID NO: 41353 - DNA, 20 bp, Artificial
  CRISPR gRNA sequence
tgggagaaggatagagcccc

SEQ ID NO: 41354 - DNA, 20 bp, Artificial
  CRISPR gRNA sequence
gggagaaggatagagcccct

SEQ ID NO: 41355 - DNA, 20 bp, Artificial
  CRISPR gRNA sequence
ggagaaggatagagcccctg

SEQ ID NO: 41356 - DNA, 20 bp, Artificial
  CRISPR gRNA sequence
aaggatagagcccctggggc

SEQ ID NO: 41357 - DNA, 20 bp, Artificial
  CRISPR gRNA sequence
atagagcccctggggctagc

SEQ ID NO: 41358 - DNA, 20 bp, Artificial
  CRISPR gRNA sequence
tagagcccctggggctagcc

SEQ ID NO: 41359 - DNA, 20 bp, Artificial
  CRISPR gRNA sequence
agagcccctggggctagcca

SEQ ID NO: 41360 - DNA, 20 bp, Artificial
  CRISPR gRNA sequence
ctggggctagccagggaccc

SEQ ID NO: 41361 - DNA, 20 bp, Artificial
  CRISPR gRNA sequence
tggggctagccagggaccct

SEQ ID NO: 41362 - DNA, 20 bp, Artificial
  CRISPR gRNA sequence
ccctgcccattgcccctttg

SEQ ID NO: 41363 - DNA, 20 bp, Artificial
  CRISPR gRNA sequence
ccattgcccctttgcagcct

SEQ ID NO: 41364 - DNA, 20 bp, Artificial
  CRISPR gRNA sequence
tgcccctttgcagcctcagt

SEQ ID NO: 41365 - DNA, 20 bp, Artificial
  CRISPR gRNA sequence
cagcctcagtgagtgtcctc

SEQ ID NO: 41366 - DNA, 20 bp, Artificial
  CRISPR gRNA sequence
gcctcagtgagtgtcctctg

SEQ ID NO: 41367 - DNA, 20 bp, Artificial
  CRISPR gRNA sequence
gagtgtcctctggagccccc

SEQ ID NO: 41368 - DNA, 20 bp, Artificial
  CRISPR gRNA sequence
cccgcctctgtgccactctg

SEQ ID NO: 41369 - DNA, 20 bp, Artificial
  CRISPR gRNA sequence
ccgcctctgtgccactctga

SEQ ID NO: 41370 - DNA, 20 bp, Artificial
  CRISPR gRNA sequence
tgccactctgaaggactgcc

SEQ ID NO: 41371 - DNA, 20 bp, Artificial
  CRISPR gRNA sequence
gccactctgaaggactgccc

SEQ ID NO: 41372 - DNA, 20 bp, Artificial
  CRISPR gRNA sequence
gaaggactgcccgggacccc

SEQ ID NO: 41373 - DNA, 20 bp, Artificial
  CRISPR gRNA sequence
gcccgggacccctggaactg

SEQ ID NO: 41374 - DNA, 20 bp, Artificial
  CRISPR gRNA sequence
gggacccctggaactgcagt

SEQ ID NO: 41375 - DNA, 20 bp, Artificial
  CRISPR gRNA sequence
ctggaactgcagtaagtaac

SEQ ID NO: 41376 - DNA, 20 bp, Artificial
  CRISPR gRNA sequence
tggaactgcagtaagtaacg

SEQ ID NO: 41377 - DNA, 20 bp, Artificial
  CRISPR gRNA sequence
tgcagtaagtaacgaggaca

SEQ ID NO: 41378 - DNA, 20 bp, Artificial
  CRISPR gRNA sequence
aagtaacgaggacacagccc

SEQ ID NO: 41379 - DNA, 20 bp, Artificial
  CRISPR gRNA sequence
gtaacgaggacacagcccca

SEQ ID NO: 41380 - DNA, 20 bp, Artificial
  CRISPR gRNA sequence
taacgaggacacagccccag

SEQ ID NO: 41381 - DNA, 20 bp, Artificial
  CRISPR gRNA sequence
aacgaggacacagccccaga

SEQ ID NO: 41382 - DNA, 20 bp, Artificial
  CRISPR gRNA sequence
cagccccagagggcaccatg

SEQ ID NO: 41383 - DNA, 20 bp, Artificial
  CRISPR gRNA sequence
agccccagagggcaccatgt

SEQ ID NO: 41384 - DNA, 20 bp, Artificial
  CRISPR gRNA sequence
gccccagagggcaccatgtg

SEQ ID NO: 41385 - DNA, 20 bp, Artificial
  CRISPR gRNA sequence
gcaccatgtggggatctgcc

SEQ ID NO: 41386 - DNA, 20 bp, Artificial
  CRISPR gRNA sequence
tggggatctgcccagtgacc

SEQ ID NO: 41387 - DNA, 20 bp, Artificial
  CRISPR gRNA sequence
ggggatctgcccagtgacct

SEQ ID NO: 41388 - DNA, 20 bp, Artificial
  CRISPR gRNA sequence
ggatctgcccagtgacctgg

SEQ ID NO: 41389 - DNA, 20 bp, Artificial
  CRISPR gRNA sequence
gatctgcccagtgacctggg

SEQ ID NO: 41390 - DNA, 20 bp, Artificial
  CRISPR gRNA sequence
atctgcccagtgacctggga

SEQ ID NO: 41391 - DNA, 20 bp, Artificial
  CRISPR gRNA sequence
tctgcccagtgacctgggag

SEQ ID NO: 41392 - DNA, 20 bp, Artificial
  CRISPR gRNA sequence
ctgcccagtgacctgggagg

SEQ ID NO: 41393 - DNA, 20 bp, Artificial
  CRISPR gRNA sequence
tgacctgggagggggcttct

SEQ ID NO: 41394 - DNA, 20 bp, Artificial
  CRISPR gRNA sequence
ctgggagggggcttcttggt

SEQ ID NO: 41395 - DNA, 20 bp, Artificial
  CRISPR gRNA sequence
ggagggggcttcttggttag

SEQ ID NO: 41396 - DNA, 20 bp, Artificial
  CRISPR gRNA sequence
ggggcttcttggttagaaga

SEQ ID NO: 41397 - DNA, 20 bp, Artificial
  CRISPR gRNA sequence
gggcttcttggttagaagac

SEQ ID NO: 41398 - DNA, 20 bp, Artificial
  CRISPR gRNA sequence
ttcttggttagaagacaggt

SEQ ID NO: 41399 - DNA, 20 bp, Artificial
  CRISPR gRNA sequence
ctttctcgatttcttcccac

SEQ ID NO: 41400 - DNA, 20 bp, Artificial
  CRISPR gRNA sequence
tcccaccagccctgccccat

SEQ ID NO: 41401 - DNA, 20 bp, Artificial
  CRISPR gRNA sequence
ccaccagccctgccccatga

SEQ ID NO: 41402 - DNA, 20 bp, Artificial
  CRISPR gRNA sequence
cctgccccatgagagtcccc

SEQ ID NO: 41403 - DNA, 20 bp, Artificial
  CRISPR gRNA sequence
catgagagtcccctggcctt

SEQ ID NO: 41404 - DNA, 20 bp, Artificial
  CRISPR gRNA sequence
gagagtcccctggcctttgg

SEQ ID NO: 41405 - DNA, 20 bp, Artificial
  CRISPR gRNA sequence
cctggcctttggtagaaact

SEQ ID NO: 41406 - DNA, 20 bp, Artificial
  CRISPR gRNA sequence
gtagaaacttggctgtctct

SEQ ID NO: 41407 - DNA, 20 bp, Artificial
  CRISPR gRNA sequence
gaaacttggctgtctctcgg

SEQ ID NO: 41408 - DNA, 20 bp, Artificial
  CRISPR gRNA sequence
ggctgtctctcggcagcccc

SEQ ID NO: 41409 - DNA, 20 bp, Artificial
  CRISPR gRNA sequence
ctctcggcagcccccagcct

SEQ ID NO: 41410 - DNA, 20 bp, Artificial
  CRISPR gRNA sequence
tctcggcagcccccagcctt

SEQ ID NO: 41411 - DNA, 20 bp, Artificial
  CRISPR gRNA sequence
cggcagcccccagccttagg

SEQ ID NO: 41412 - DNA, 20 bp, Artificial
  CRISPR gRNA sequence
aggcagcgcatgtctcccac

SEQ ID NO: 41413 - DNA, 20 bp, Artificial
  CRISPR gRNA sequence
ggcagcgcatgtctcccact

SEQ ID NO: 41414 - DNA, 20 bp, Artificial
  CRISPR gRNA sequence
cagcgcatgtctcccactgg

SEQ ID NO: 41415 - DNA, 20 bp, Artificial
  CRISPR gRNA sequence
cccactgggagatgctgtgc

SEQ ID NO: 41416 - DNA, 20 bp, Artificial
  CRISPR gRNA sequence
tgggagatgctgtgctggac

SEQ ID NO: 41417 - DNA, 20 bp, Artificial
  CRISPR gRNA sequence
gggagatgctgtgctggact

SEQ ID NO: 41418 - DNA, 20 bp, Artificial
  CRISPR gRNA sequence
ggagatgctgtgctggactg

SEQ ID NO: 41419 - DNA, 20 bp, Artificial
  CRISPR gRNA sequence
gatgctgtgctggactgggg

SEQ ID NO: 41420 - DNA, 20 bp, Artificial
  CRISPR gRNA sequence
cctgcaccatccactcaact

SEQ ID NO: 41421 - DNA, 20 bp, Artificial
  CRISPR gRNA sequence
ctgcaccatccactcaactc

SEQ ID NO: 41422 - DNA, 20 bp, Artificial
  CRISPR gRNA sequence
tgcaccatccactcaactca

SEQ ID NO: 41423 - DNA, 20 bp, Artificial
  CRISPR gRNA sequence
tccactcaactcagggcacc

SEQ ID NO: 41424 - DNA, 20 bp, Artificial
  CRISPR gRNA sequence
ccactcaactcagggcacct

SEQ ID NO: 41425 - DNA, 20 bp, Artificial
  CRISPR gRNA sequence
actcaactcagggcacctgg

SEQ ID NO: 41426 - DNA, 20 bp, Artificial
  CRISPR gRNA sequence
tccacctccaaccccacccc

SEQ ID NO: 41427 - DNA, 20 bp, Artificial
  CRISPR gRNA sequence
cacctccaaccccacccctg

SEQ ID NO: 41428 - DNA, 20 bp, Artificial
  CRISPR gRNA sequence
ccccacccctggagcctcac

SEQ ID NO: 41429 - DNA, 20 bp, Artificial
  CRISPR gRNA sequence
cccacccctggagcctcacc

SEQ ID NO: 41430 - DNA, 20 bp, Artificial
  CRISPR gRNA sequence
ccacccctggagcctcacca

SEQ ID NO: 41431 - DNA, 20 bp, Artificial
  CRISPR gRNA sequence
cccacttgaacctgcctgca

SEQ ID NO: 41432 - DNA, 20 bp, Artificial
  CRISPR gRNA sequence
cttgaacctgcctgcatggc

SEQ ID NO: 41433 - DNA, 20 bp, Artificial
  CRISPR gRNA sequence
tgaacctgcctgcatggctg

SEQ ID NO: 41434 - DNA, 20 bp, Artificial
  CRISPR gRNA sequence
ctgcctgcatggctggagcg

SEQ ID NO: 41435 - DNA, 20 bp, Artificial
  CRISPR gRNA sequence
ctggagcgtagcacttctga

SEQ ID NO: 41436 - DNA, 20 bp, Artificial
  CRISPR gRNA sequence
acttctgaaagcccttcctc

SEQ ID NO: 41437 - DNA, 20 bp, Artificial
  CRISPR gRNA sequence
cttctgaaagcccttcctca

SEQ ID NO: 41438 - DNA, 20 bp, Artificial
  CRISPR gRNA sequence
caaggcacccccactctcct

SEQ ID NO: 41439 - DNA, 20 bp, Artificial
  CRISPR gRNA sequence
aaggcacccccactctcctt

SEQ ID NO: 41440 - DNA, 20 bp, Artificial
  CRISPR gRNA sequence
aggcacccccactctccttg

SEQ ID NO: 41441 - DNA, 20 bp, Artificial
  CRISPR gRNA sequence
ggttaccacctcactcgccc

SEQ ID NO: 41442 - DNA, 20 bp, Artificial
  CRISPR gRNA sequence
ctcactcgccccagaacatc

SEQ ID NO: 41443 - DNA, 20 bp, Artificial
  CRISPR gRNA sequence
tcactcgccccagaacatct

SEQ ID NO: 41444 - DNA, 20 bp, Artificial
  CRISPR gRNA sequence
agaacatctgggtctgtaac

SEQ ID NO: 41445 - DNA, 20 bp, Artificial
  CRISPR gRNA sequence
aacatctgggtctgtaacca

SEQ ID NO: 41446 - DNA, 20 bp, Artificial
  CRISPR gRNA sequence
ctgggtctgtaaccagagac

SEQ ID NO: 41447 - DNA, 20 bp, Artificial
  CRISPR gRNA sequence
ctgtaaccagagactggacc

SEQ ID NO: 41448 - DNA, 20 bp, Artificial
  CRISPR gRNA sequence
ccagagactggacctggaat

SEQ ID NO: 41449 - DNA, 20 bp, Artificial
  CRISPR gRNA sequence
cagagactggacctggaatc

SEQ ID NO: 41450 - DNA, 20 bp, Artificial
  CRISPR gRNA sequence
ggacctggaatcaggactct

SEQ ID NO: 41451 - DNA, 20 bp, Artificial
  CRISPR gRNA sequence
aatcaggactcttggctcaa

SEQ ID NO: 41452 - DNA, 20 bp, Artificial
  CRISPR gRNA sequence
atcaggactcttggctcaaa

SEQ ID NO: 41453 - DNA, 20 bp, Artificial
  CRISPR gRNA sequence
tcaggactcttggctcaaaa

SEQ ID NO: 41454 - DNA, 20 bp, Artificial
  CRISPR gRNA sequence
tcaaaagggatttaactccc

SEQ ID NO: 41455 - DNA, 20 bp, Artificial
  CRISPR gRNA sequence
caaaagggatttaactcccc

SEQ ID NO: 41456 - DNA, 20 bp, Artificial
  CRISPR gRNA sequence
ggatttaactccccgggcct

SEQ ID NO: 41457 - DNA, 20 bp, Artificial
  CRISPR gRNA sequence
cctcagcttcttcatctgca

SEQ ID NO: 41458 - DNA, 20 bp, Artificial
  CRISPR gRNA sequence
cagcttcttcatctgcacag

SEQ ID NO: 41459 - DNA, 20 bp, Artificial
  CRISPR gRNA sequence
ttcttcatctgcacagtgga

SEQ ID NO: 41460 - DNA, 20 bp, Artificial
  CRISPR gRNA sequence
tcatctgcacagtggatggt

SEQ ID NO: 41461 - DNA, 20 bp, Artificial
  CRISPR gRNA sequence
ctttccttttattgtcattg

SEQ ID NO: 41462 - DNA, 20 bp, Artificial
  CRISPR gRNA sequence
tcattgtggtgattctatta

SEQ ID NO: 41463 - DNA, 20 bp, Artificial
  CRISPR gRNA sequence
atagtaattaccttaaaata

SEQ ID NO: 41464 - DNA, 20 bp, Artificial
  CRISPR gRNA sequence
accttaaaataaagaaatcc

SEQ ID NO: 41465 - DNA, 20 bp, Artificial
  CRISPR gRNA sequence
tccatgttgtcatgtgtcca

SEQ ID NO: 41466 - DNA, 20 bp, Artificial
  CRISPR gRNA sequence
ccatgttgtcatgtgtccac

SEQ ID NO: 41467 - DNA, 20 bp, Artificial
  CRISPR gRNA sequence
tccttgcctatttgcatatt

SEQ ID NO: 41468 - DNA, 20 bp, Artificial
  CRISPR gRNA sequence
attcagtttctacctgtttg

SEQ ID NO: 41469 - DNA, 20 bp, Artificial
  CRISPR gRNA sequence
acctgtttgcagtcataaac

SEQ ID NO: 41470 - DNA, 20 bp, Artificial
  CRISPR gRNA sequence
tttcatgcactgtgttttca

SEQ ID NO: 41471 - DNA, 20 bp, Artificial
  CRISPR gRNA sequence
ctgtgttttccattttgctt

SEQ ID NO: 41472 - DNA, 20 bp, Artificial
  CRISPR gRNA sequence
cagtcttttttcttgctttc

SEQ ID NO: 41473 - DNA, 20 bp, Artificial
  CRISPR gRNA sequence
ccccatctcaaatgcccttc

SEQ ID NO: 41474 - DNA, 20 bp, Artificial
  CRISPR gRNA sequence
gcccttccagcccttccaac

SEQ ID NO: 41475 - DNA, 20 bp, Artificial
  CRISPR gRNA sequence
gcccttccaaccagataatc

SEQ ID NO: 41476 - DNA, 20 bp, Artificial
  CRISPR gRNA sequence
gataatccggtttgaccccc

SEQ ID NO: 41477 - DNA, 20 bp, Artificial
  CRISPR gRNA sequence
taatccggtttgaccccctg

SEQ ID NO: 41478 - DNA, 20 bp, Artificial
  CRISPR gRNA sequence
cggtttgaccccctggagtg

SEQ ID NO: 41479 - DNA, 20 bp, Artificial
  CRISPR gRNA sequence
ggccttcccatgtccttctc

SEQ ID NO: 41480 - DNA, 20 bp, Artificial
  CRISPR gRNA sequence
gccttcccatgtccttctcc

SEQ ID NO: 41481 - DNA, 20 bp, Artificial
  CRISPR gRNA sequence
tataaccacaaaaccattat

SEQ ID NO: 41482 - DNA, 20 bp, Artificial
  CRISPR gRNA sequence
ctacactattttttttttct

SEQ ID NO: 41483 - DNA, 20 bp, Artificial
  CRISPR gRNA sequence
actattttttttttctgaga

SEQ ID NO: 41484 - DNA, 20 bp, Artificial
  CRISPR gRNA sequence
tattttttttttctgagaca

SEQ ID NO: 41485 - DNA, 20 bp, Artificial
  CRISPR gRNA sequence
agagttttgctcttgttgcc

SEQ ID NO: 41486 - DNA, 20 bp, Artificial
  CRISPR gRNA sequence
gagttttgctcttgttgccc

SEQ ID NO: 41487 - DNA, 20 bp, Artificial
  CRISPR gRNA sequence
tttgctcttgttgcccaggc

SEQ ID NO: 41488 - DNA, 20 bp, Artificial
  CRISPR gRNA sequence
tgctcttgttgcccaggctg

SEQ ID NO: 41489 - DNA, 20 bp, Artificial
  CRISPR gRNA sequence
ttgcccaggctggagtgcaa

SEQ ID NO: 41490 - DNA, 20 bp, Artificial
  CRISPR gRNA sequence
ggagtgcaatggcgtgatct

SEQ ID NO: 41491 - DNA, 20 bp, Artificial
  CRISPR gRNA sequence
ttgctgccacctctgcctcc

SEQ ID NO: 41492 - DNA, 20 bp, Artificial
  CRISPR gRNA sequence
tgctgccacctctgcctcct

SEQ ID NO: 41493 - DNA, 20 bp, Artificial
  CRISPR gRNA sequence
cacctctgcctcctgggttc

SEQ ID NO: 41494 - DNA, 20 bp, Artificial
  CRISPR gRNA sequence
ttcaagcaattctcctgcct

SEQ ID NO: 41495 - DNA, 20 bp, Artificial
  CRISPR gRNA sequence
ttctcctgcctcagcctcct

SEQ ID NO: 41496 - DNA, 20 bp, Artificial
  CRISPR gRNA sequence
tcctgcctcagcctcctgag

SEQ ID NO: 41497 - DNA, 20 bp, Artificial
  CRISPR gRNA sequence
gcctcagcctcctgagtagc

SEQ ID NO: 41498 - DNA, 20 bp, Artificial
  CRISPR gRNA sequence
cctcagcctcctgagtagct

SEQ ID NO: 41499 - DNA, 20 bp, Artificial
  CRISPR gRNA sequence
ctcctgagtagctgggatta

SEQ ID NO: 41500 - DNA, 20 bp, Artificial
  CRISPR gRNA sequence
tcctgagtagctgggattac

SEQ ID NO: 41501 - DNA, 20 bp, Artificial
  CRISPR gRNA sequence
caggcgcccgccatcatgcc

SEQ ID NO: 41502 - DNA, 20 bp, Artificial
  CRISPR gRNA sequence
ctggctaatttttgtatttt

SEQ ID NO: 41503 - DNA, 20 bp, Artificial
  CRISPR gRNA sequence
gctaatttttgtatttttag

SEQ ID NO: 41504 - DNA, 20 bp, Artificial
  CRISPR gRNA sequence
taatttttgtatttttagta

SEQ ID NO: 41505 - DNA, 20 bp, Artificial
  CRISPR gRNA sequence
aatttttgtatttttagtag

SEQ ID NO: 41506 - DNA, 20 bp, Artificial
  CRISPR gRNA sequence
ttttgtatttttagtagagg

SEQ ID NO: 41507 - DNA, 20 bp, Artificial
  CRISPR gRNA sequence
tttgtatttttagtagaggc

SEQ ID NO: 41508 - DNA, 20 bp, Artificial
  CRISPR gRNA sequence
ttgtatttttagtagaggca

SEQ ID NO: 41509 - DNA, 20 bp, Artificial
  CRISPR gRNA sequence
gaggcagggtttcaccatgt

SEQ ID NO: 41510 - DNA, 20 bp, Artificial
  CRISPR gRNA sequence
cagggtttcaccatgttggc

SEQ ID NO: 41511 - DNA, 20 bp, Artificial
  CRISPR gRNA sequence
agggtttcaccatgttggcc

SEQ ID NO: 41512 - DNA, 20 bp, Artificial
  CRISPR gRNA sequence
tttcaccatgttggccaggc

SEQ ID NO: 41513 - DNA, 20 bp, Artificial
  CRISPR gRNA sequence
ggtctcgaactcctgacctc

SEQ ID NO: 41514 - DNA, 20 bp, Artificial
  CRISPR gRNA sequence
ctcaagtgatccaccttcct

SEQ ID NO: 41515 - DNA, 20 bp, Artificial
  CRISPR gRNA sequence
ccaccttcctcagcctccca

SEQ ID NO: 41516 - DNA, 20 bp, Artificial
  CRISPR gRNA sequence
tcctcagcctcccaaagtgt

SEQ ID NO: 41517 - DNA, 20 bp, Artificial
  CRISPR gRNA sequence
cctcagcctcccaaagtgtt

SEQ ID NO: 41518 - DNA, 20 bp, Artificial
  CRISPR gRNA sequence
ctcccaaagtgttgggatta

SEQ ID NO: 41519 - DNA, 20 bp, Artificial
  CRISPR gRNA sequence
tcccaaagtgttgggattac

SEQ ID NO: 41520 - DNA, 20 bp, Artificial
  CRISPR gRNA sequence
agtgttgggattacaggctt

SEQ ID NO: 41521 - DNA, 20 bp, Artificial
  CRISPR gRNA sequence
caggcttgagccactgcacc

SEQ ID NO: 41522 - DNA, 20 bp, Artificial
  CRISPR gRNA sequence
ttgagccactgcacctggcc

SEQ ID NO: 41523 - DNA, 20 bp, Artificial
  CRISPR gRNA sequence
gcccagacctaccctattaa

SEQ ID NO: 41524 - DNA, 20 bp, Artificial
  CRISPR gRNA sequence
ctattaatggcaattcctta

SEQ ID NO: 41525 - DNA, 20 bp, Artificial
  CRISPR gRNA sequence
aattccttaaagtcaaccaa

SEQ ID NO: 41526 - DNA, 20 bp, Artificial
  CRISPR gRNA sequence
ccttaaagtcaaccaatggt

SEQ ID NO: 41527 - DNA, 20 bp, Artificial
  CRISPR gRNA sequence
taaagtcaaccaatggtcag

SEQ ID NO: 41528 - DNA, 20 bp, Artificial
  CRISPR gRNA sequence
ttgtctcttacctgttttca

SEQ ID NO: 41529 - DNA, 20 bp, Artificial
  CRISPR gRNA sequence
gtctcttacctgttttcaca

SEQ ID NO: 41530 - DNA, 20 bp, Artificial
  CRISPR gRNA sequence
cttttaatactaaattgcca

SEQ ID NO: 41531 - DNA, 20 bp, Artificial
  CRISPR gRNA sequence
aatactaaattgccacagta

SEQ ID NO: 41532 - DNA, 20 bp, Artificial
  CRISPR gRNA sequence
atactaaattgccacagtac

SEQ ID NO: 41533 - DNA, 20 bp, Artificial
  CRISPR gRNA sequence
aaattgccacagtacgggac

SEQ ID NO: 41534 - DNA, 20 bp, Artificial
  CRISPR gRNA sequence
cacagtacgggacgagctgc

SEQ ID NO: 41535 - DNA, 20 bp, Artificial
  CRISPR gRNA sequence
gttactccaccacacccttc

SEQ ID NO: 41536 - DNA, 20 bp, Artificial
  CRISPR gRNA sequence
tactccaccacacccttcta

SEQ ID NO: 41537 - DNA, 20 bp, Artificial
  CRISPR gRNA sequence
caccacacccttctagagtc

SEQ ID NO: 41538 - DNA, 20 bp, Artificial
  CRISPR gRNA sequence
acccttctagagtctagatc

SEQ ID NO: 41539 - DNA, 20 bp, Artificial
  CRISPR gRNA sequence
cccttctagagtctagatca

SEQ ID NO: 41540 - DNA, 20 bp, Artificial
  CRISPR gRNA sequence
ccttctagagtctagatcaa

SEQ ID NO: 41541 - DNA, 20 bp, Artificial
  CRISPR gRNA sequence
atcaagggtgtccaatcttt

SEQ ID NO: 41542 - DNA, 20 bp, Artificial
  CRISPR gRNA sequence
gtccaatcttttggcttccc

SEQ ID NO: 41543 - DNA, 20 bp, Artificial
  CRISPR gRNA sequence
tccaatcttttggcttccct

SEQ ID NO: 41544 - DNA, 20 bp, Artificial
  CRISPR gRNA sequence
ttggcttccctgggccacat

SEQ ID NO: 41545 - DNA, 20 bp, Artificial
  CRISPR gRNA sequence
gcttccctgggccacattgg

SEQ ID NO: 41546 - DNA, 20 bp, Artificial
  CRISPR gRNA sequence
tccctgggccacattggaag

SEQ ID NO: 41547 - DNA, 20 bp, Artificial
  CRISPR gRNA sequence
ggccacattggaagaagaaa

SEQ ID NO: 41548 - DNA, 20 bp, Artificial
  CRISPR gRNA sequence
aagaagaaaaagaattgtct

SEQ ID NO: 41549 - DNA, 20 bp, Artificial
  CRISPR gRNA sequence
agaagaaaaagaattgtctt

SEQ ID NO: 41550 - DNA, 20 bp, Artificial
  CRISPR gRNA sequence
cacataaaatacactaacac

SEQ ID NO: 41551 - DNA, 20 bp, Artificial
  CRISPR gRNA sequence
aaatacactaacactagcga

SEQ ID NO: 41552 - DNA, 20 bp, Artificial
  CRISPR gRNA sequence
aaaaaaaaaacaaaactcca

SEQ ID NO: 41553 - DNA, 20 bp, Artificial
  CRISPR gRNA sequence
aactccaaagaaaaatctca

SEQ ID NO: 41554 - DNA, 20 bp, Artificial
  CRISPR gRNA sequence
gaaaaatctcatagtgtttt

SEQ ID NO: 41555 - DNA, 20 bp, Artificial
  CRISPR gRNA sequence
aatctcatagtgttttaaga

SEQ ID NO: 41556 - DNA, 20 bp, Artificial
  CRISPR gRNA sequence
gaaagtttacgaatttttgt

SEQ ID NO: 41557 - DNA, 20 bp, Artificial
  CRISPR gRNA sequence
aaagtttacgaatttttgtt

SEQ ID NO: 41558 - DNA, 20 bp, Artificial
  CRISPR gRNA sequence
tttttgttaggccgtattca

SEQ ID NO: 41559 - DNA, 20 bp, Artificial
  CRISPR gRNA sequence
ggccgtattcaaagccatcc

SEQ ID NO: 41560 - DNA, 20 bp, Artificial
  CRISPR gRNA sequence
gccgtattcaaagccatcct

SEQ ID NO: 41561 - DNA, 20 bp, Artificial
  CRISPR gRNA sequence
aagccatcctaggctgcatg

SEQ ID NO: 41562 - DNA, 20 bp, Artificial
  CRISPR gRNA sequence
ccatcctaggctgcatgcag

SEQ ID NO: 41563 - DNA, 20 bp, Artificial
  CRISPR gRNA sequence
catcctaggctgcatgcagc

SEQ ID NO: 41564 - DNA, 20 bp, Artificial
  CRISPR gRNA sequence
gctgcatgcagcaggccatg

SEQ ID NO: 41565 - DNA, 20 bp, Artificial
  CRISPR gRNA sequence
atgcagcaggccatgtggct

SEQ ID NO: 41566 - DNA, 20 bp, Artificial
  CRISPR gRNA sequence
gccatgtggcttggacaact

SEQ ID NO: 41567 - DNA, 20 bp, Artificial
  CRISPR gRNA sequence
gtggcttggacaacttggtc

SEQ ID NO: 41568 - DNA, 20 bp, Artificial
  CRISPR gRNA sequence
attgaaatccaaactgcttc

SEQ ID NO: 41569 - DNA, 20 bp, Artificial
  CRISPR gRNA sequence
ttgaaatccaaactgcttct

SEQ ID NO: 41570 - DNA, 20 bp, Artificial
  CRISPR gRNA sequence
gtgttgtgttttgttttgtg

SEQ ID NO: 41571 - DNA, 20 bp, Artificial
  CRISPR gRNA sequence
ttttgttttgtgtagcactg

SEQ ID NO: 41572 - DNA, 20 bp, Artificial
  CRISPR gRNA sequence
gttttgtgtagcactgcagt

SEQ ID NO: 41573 - DNA, 20 bp, Artificial
  CRISPR gRNA sequence
actgcagtcagtgctacaaa

SEQ ID NO: 41574 - DNA, 20 bp, Artificial
  CRISPR gRNA sequence
tcttacgtgatttgactgtt

SEQ ID NO: 41575 - DNA, 20 bp, Artificial
  CRISPR gRNA sequence
acctattgtataccatgcac

SEQ ID NO: 41576 - DNA, 20 bp, Artificial
  CRISPR gRNA sequence
cctattgtataccatgcact

SEQ ID NO: 41577 - DNA, 20 bp, Artificial
  CRISPR gRNA sequence
ttgtataccatgcactgggc

SEQ ID NO: 41578 - DNA, 20 bp, Artificial
  CRISPR gRNA sequence
ccatgcactgggccagatcc

SEQ ID NO: 41579 - DNA, 20 bp, Artificial
  CRISPR gRNA sequence
catgcactgggccagatcct

SEQ ID NO: 41580 - DNA, 20 bp, Artificial
  CRISPR gRNA sequence
gggccagatcctgggaacac

SEQ ID NO: 41581 - DNA, 20 bp, Artificial
  CRISPR gRNA sequence
ggccagatcctgggaacaca

SEQ ID NO: 41582 - DNA, 20 bp, Artificial
  CRISPR gRNA sequence
ccagatcctgggaacacaag

SEQ ID NO: 41583 - DNA, 20 bp, Artificial
  CRISPR gRNA sequence
tcctgggaacacaaggagac

SEQ ID NO: 41584 - DNA, 20 bp, Artificial
  CRISPR gRNA sequence
cctgggaacacaaggagact

SEQ ID NO: 41585 - DNA, 20 bp, Artificial
  CRISPR gRNA sequence
aacacaaggagactgggatg

SEQ ID NO: 41586 - DNA, 20 bp, Artificial
  CRISPR gRNA sequence
acacaaggagactgggatgc

SEQ ID NO: 41587 - DNA, 20 bp, Artificial
  CRISPR gRNA sequence
gactgggatgcgggctctgc

SEQ ID NO: 41588 - DNA, 20 bp, Artificial
  CRISPR gRNA sequence
ggatgcgggctctgctggcc

SEQ ID NO: 41589 - DNA, 20 bp, Artificial
  CRISPR gRNA sequence
gatgcgggctctgctggcca

SEQ ID NO: 41590 - DNA, 20 bp, Artificial
  CRISPR gRNA sequence
tggccaaggcaaatcatctg

SEQ ID NO: 41591 - DNA, 20 bp, Artificial
  CRISPR gRNA sequence
gccaaggcaaatcatctgca

SEQ ID NO: 41592 - DNA, 20 bp, Artificial
  CRISPR gRNA sequence
ccaaggcaaatcatctgcag

SEQ ID NO: 41593 - DNA, 20 bp, Artificial
  CRISPR gRNA sequence
aggcaaatcatctgcagagg

SEQ ID NO: 41594 - DNA, 20 bp, Artificial
  CRISPR gRNA sequence
cagaggaagcttaatataaa

SEQ ID NO: 41595 - DNA, 20 bp, Artificial
  CRISPR gRNA sequence
gcttaatataaaaagcccac

SEQ ID NO: 41596 - DNA, 20 bp, Artificial
  CRISPR gRNA sequence
taatataaaaagcccactgg

SEQ ID NO: 41597 - DNA, 20 bp, Artificial
  CRISPR gRNA sequence
taaaaagcccactggcggcc

SEQ ID NO: 41598 - DNA, 20 bp, Artificial
  CRISPR gRNA sequence
agcccactggcggcccggca

SEQ ID NO: 41599 - DNA, 20 bp, Artificial
  CRISPR gRNA sequence
gtgactcacgcctataatcc

SEQ ID NO: 41600 - DNA, 20 bp, Artificial
  CRISPR gRNA sequence
cgcctataatcccagcactt

SEQ ID NO: 41601 - DNA, 20 bp, Artificial
  CRISPR gRNA sequence
gcctataatcccagcacttt

SEQ ID NO: 41602 - DNA, 20 bp, Artificial
  CRISPR gRNA sequence
ctataatcccagcactttgg

SEQ ID NO: 41603 - DNA, 20 bp, Artificial
  CRISPR gRNA sequence
tataatcccagcactttggg

SEQ ID NO: 41604 - DNA, 20 bp, Artificial
  CRISPR gRNA sequence
tcccagcactttgggaggcc

SEQ ID NO: 41605 - DNA, 20 bp, Artificial
  CRISPR gRNA sequence
cccagcactttgggaggccg

SEQ ID NO: 41606 - DNA, 20 bp, Artificial
  CRISPR gRNA sequence
agcactttgggaggccgagg

SEQ ID NO: 41607 - DNA, 20 bp, Artificial
  CRISPR gRNA sequence
ctttgggaggccgaggtggc

SEQ ID NO: 41608 - DNA, 20 bp, Artificial
  CRISPR gRNA sequence
ggccgaggtggctggatcat

SEQ ID NO: 41609 - DNA, 20 bp, Artificial
  CRISPR gRNA sequence
gccgaggtggctggatcatg

SEQ ID NO: 41610 - DNA, 20 bp, Artificial
  CRISPR gRNA sequence
aggtggctggatcatgaggt

SEQ ID NO: 41611 - DNA, 20 bp, Artificial
  CRISPR gRNA sequence
ggtggctggatcatgaggtc

SEQ ID NO: 41612 - DNA, 20 bp, Artificial
  CRISPR gRNA sequence
tggctggatcatgaggtcag

SEQ ID NO: 41613 - DNA, 20 bp, Artificial
  CRISPR gRNA sequence
gatcatgaggtcaggagttc

SEQ ID NO: 41614 - DNA, 20 bp, Artificial
  CRISPR gRNA sequence
tgaggtcaggagttcgagac

SEQ ID NO: 41615 - DNA, 20 bp, Artificial
  CRISPR gRNA sequence
tcaggagttcgagactagcc

SEQ ID NO: 41616 - DNA, 20 bp, Artificial
  CRISPR gRNA sequence
cgagactagcctggccaaca

SEQ ID NO: 41617 - DNA, 20 bp, Artificial
  CRISPR gRNA sequence
tctactaaaaatacaaaaat

SEQ ID NO: 41618 - DNA, 20 bp, Artificial
  CRISPR gRNA sequence
ctaaaaatacaaaaattagc

SEQ ID NO: 41619 - DNA, 20 bp, Artificial
  CRISPR gRNA sequence
taaaaatacaaaaattagcc

SEQ ID NO: 41620 - DNA, 20 bp, Artificial
  CRISPR gRNA sequence
atacaaaaattagccaggca

SEQ ID NO: 41621 - DNA, 20 bp, Artificial
  CRISPR gRNA sequence
caaaaattagccaggcatgg

SEQ ID NO: 41622 - DNA, 20 bp, Artificial
  CRISPR gRNA sequence
gtggtgcacccctgtaatcc

SEQ ID NO: 41623 - DNA, 20 bp, Artificial
  CRISPR gRNA sequence
ccctgtaatcccagctactc

SEQ ID NO: 41624 - DNA, 20 bp, Artificial
  CRISPR gRNA sequence
ctgtaatcccagctactctg

SEQ ID NO: 41625 - DNA, 20 bp, Artificial
  CRISPR gRNA sequence
tgtaatcccagctactctgg

SEQ ID NO: 41626 - DNA, 20 bp, Artificial
  CRISPR gRNA sequence
aatcccagctactctggagg

SEQ ID NO: 41627 - DNA, 20 bp, Artificial
  CRISPR gRNA sequence
atcccagctactctggaggc

SEQ ID NO: 41628 - DNA, 20 bp, Artificial
  CRISPR gRNA sequence
ccagctactctggaggcagg

SEQ ID NO: 41629 - DNA, 20 bp, Artificial
  CRISPR gRNA sequence
cagctactctggaggcaggc

SEQ ID NO: 41630 - DNA, 20 bp, Artificial
  CRISPR gRNA sequence
gctactctggaggcaggcag

SEQ ID NO: 41631 - DNA, 20 bp, Artificial
  CRISPR gRNA sequence
gcaggagacttgcttgaacc

SEQ ID NO: 41632 - DNA, 20 bp, Artificial
  CRISPR gRNA sequence
caggagacttgcttgaaccc

SEQ ID NO: 41633 - DNA, 20 bp, Artificial
  CRISPR gRNA sequence
ggagacttgcttgaacccgg

SEQ ID NO: 41634 - DNA, 20 bp, Artificial
  CRISPR gRNA sequence
gagacttgcttgaacccggg

SEQ ID NO: 41635 - DNA, 20 bp, Artificial
  CRISPR gRNA sequence
acttgcttgaacccgggagg

SEQ ID NO: 41636 - DNA, 20 bp, Artificial
  CRISPR gRNA sequence
ttgcttgaacccgggaggca

SEQ ID NO: 41637 - DNA, 20 bp, Artificial
  CRISPR gRNA sequence
aacccgggaggcagagattg

SEQ ID NO: 41638 - DNA, 20 bp, Artificial
  CRISPR gRNA sequence
cgggaggcagagattgtggt

SEQ ID NO: 41639 - DNA, 20 bp, Artificial
  CRISPR gRNA sequence
ggcagagattgtggtgagcc

SEQ ID NO: 41640 - DNA, 20 bp, Artificial
  CRISPR gRNA sequence
aagactgcgccactgtcctc

SEQ ID NO: 41641 - DNA, 20 bp, Artificial
  CRISPR gRNA sequence
tgcgccactgtcctccagcc

SEQ ID NO: 41642 - DNA, 20 bp, Artificial
  CRISPR gRNA sequence
gcgccactgtcctccagcct

SEQ ID NO: 41643 - DNA, 20 bp, Artificial
  CRISPR gRNA sequence
ctgtcctccagcctgggcaa

SEQ ID NO: 41644 - DNA, 20 bp, Artificial
  CRISPR gRNA sequence
gtcctccagcctgggcaaca

SEQ ID NO: 41645 - DNA, 20 bp, Artificial
  CRISPR gRNA sequence
tccagcctgggcaacagagc

SEQ ID NO: 41646 - DNA, 20 bp, Artificial
  CRISPR gRNA sequence
aataaataaataaataaata

SEQ ID NO: 41647 - DNA, 20 bp, Artificial
  CRISPR gRNA sequence
aataaataaataaagcccac

SEQ ID NO: 41648 - DNA, 20 bp, Artificial
  CRISPR gRNA sequence
aaataaataaagcccactgg

SEQ ID NO: 41649 - DNA, 20 bp, Artificial
  CRISPR gRNA sequence
ataaagcccactggcagcac

SEQ ID NO: 41650 - DNA, 20 bp, Artificial
  CRISPR gRNA sequence
taaagcccactggcagcact

SEQ ID NO: 41651 - DNA, 20 bp, Artificial
  CRISPR gRNA sequence
agcccactggcagcactggg

SEQ ID NO: 41652 - DNA, 20 bp, Artificial
  CRISPR gRNA sequence
ctggcagcactgggcggtct

SEQ ID NO: 41653 - DNA, 20 bp, Artificial
  CRISPR gRNA sequence
agcactgggcggtctgagca

SEQ ID NO: 41654 - DNA, 20 bp, Artificial
  CRISPR gRNA sequence
gcactgggcggtctgagcac

SEQ ID NO: 41655 - DNA, 20 bp, Artificial
  CRISPR gRNA sequence
ctgggcggtctgagcacagg

SEQ ID NO: 41656 - DNA, 20 bp, Artificial
  CRISPR gRNA sequence
tgggcggtctgagcacaggt

SEQ ID NO: 41657 - DNA, 20 bp, Artificial
  CRISPR gRNA sequence
ggcggtctgagcacaggtgg

SEQ ID NO: 41658 - DNA, 20 bp, Artificial
  CRISPR gRNA sequence
ctgagcacaggtgggagttt

SEQ ID NO: 41659 - DNA, 20 bp, Artificial
  CRISPR gRNA sequence
tgagcacaggtgggagtttc

SEQ ID NO: 41660 - DNA, 20 bp, Artificial
  CRISPR gRNA sequence
aggtccccctccattacctg

SEQ ID NO: 41661 - DNA, 20 bp, Artificial
  CRISPR gRNA sequence
ccccctccattacctgtggt

SEQ ID NO: 41662 - DNA, 20 bp, Artificial
  CRISPR gRNA sequence
cccctccattacctgtggtt

SEQ ID NO: 41663 - DNA, 20 bp, Artificial
  CRISPR gRNA sequence
ccctccattacctgtggttg

SEQ ID NO: 41664 - DNA, 20 bp, Artificial
  CRISPR gRNA sequence
ccattacctgtggttgggga

SEQ ID NO: 41665 - DNA, 20 bp, Artificial
  CRISPR gRNA sequence
tgtggttggggaaagtgcaa

SEQ ID NO: 41666 - DNA, 20 bp, Artificial
  CRISPR gRNA sequence
aagtgcaatagtgaatatga

SEQ ID NO: 41667 - DNA, 20 bp, Artificial
  CRISPR gRNA sequence
tgaaagcactttgtcaactg

SEQ ID NO: 41668 - DNA, 20 bp, Artificial
  CRISPR gRNA sequence
aaagcactttgtcaactgta

SEQ ID NO: 41669 - DNA, 20 bp, Artificial
  CRISPR gRNA sequence
tagagtactgtgatcacttg

SEQ ID NO: 41670 - DNA, 20 bp, Artificial
  CRISPR gRNA sequence
agagtactgtgatcacttgc

SEQ ID NO: 41671 - DNA, 20 bp, Artificial
  CRISPR gRNA sequence
tgcaggattattgctataaa

SEQ ID NO: 41672 - DNA, 20 bp, Artificial
  CRISPR gRNA sequence
tattgctataaatagtcatc

SEQ ID NO: 41673 - DNA, 20 bp, Artificial
  CRISPR gRNA sequence
attgctataaatagtcatca

SEQ ID NO: 41674 - DNA, 20 bp, Artificial
  CRISPR gRNA sequence
catcaaggtactcaatgctg

SEQ ID NO: 41675 - DNA, 20 bp, Artificial
  CRISPR gRNA sequence
aggtactcaatgctgaagtc

SEQ ID NO: 41676 - DNA, 20 bp, Artificial
  CRISPR gRNA sequence
gctgaagtccagtgattccc

SEQ ID NO: 41677 - DNA, 20 bp, Artificial
  CRISPR gRNA sequence
ctgaagtccagtgattcccc

SEQ ID NO: 41678 - DNA, 20 bp, Artificial
  CRISPR gRNA sequence
tgaagtccagtgattccccg

SEQ ID NO: 41679 - DNA, 20 bp, Artificial
  CRISPR gRNA sequence
gtgattccccggggttccac

SEQ ID NO: 41680 - DNA, 20 bp, Artificial
  CRISPR gRNA sequence
tgattccccggggttccacc

SEQ ID NO: 41681 - DNA, 20 bp, Artificial
  CRISPR gRNA sequence
gattccccggggttccaccg

SEQ ID NO: 41682 - DNA, 20 bp, Artificial
  CRISPR gRNA sequence
tccccggggttccaccgggg

SEQ ID NO: 41683 - DNA, 20 bp, Artificial
  CRISPR gRNA sequence
cggggttccaccggggaagc

SEQ ID NO: 41684 - DNA, 20 bp, Artificial
  CRISPR gRNA sequence
ggggttccaccggggaagcc

SEQ ID NO: 41685 - DNA, 20 bp, Artificial
  CRISPR gRNA sequence
gggttccaccggggaagcca

SEQ ID NO: 41686 - DNA, 20 bp, Artificial
  CRISPR gRNA sequence
ttccaccggggaagccaggg

SEQ ID NO: 41687 - DNA, 20 bp, Artificial
  CRISPR gRNA sequence
accggggaagccagggaaga

SEQ ID NO: 41688 - DNA, 20 bp, Artificial
  CRISPR gRNA sequence
aagccagggaagatagattg

SEQ ID NO: 41689 - DNA, 20 bp, Artificial
  CRISPR gRNA sequence
agccagggaagatagattgt

SEQ ID NO: 41690 - DNA, 20 bp, Artificial
  CRISPR gRNA sequence
gccagggaagatagattgtg

SEQ ID NO: 41691 - DNA, 20 bp, Artificial
  CRISPR gRNA sequence
catcccccctccctgaattc

SEQ ID NO: 41692 - DNA, 20 bp, Artificial
  CRISPR gRNA sequence
ctccctgaattcaagcactg

SEQ ID NO: 41693 - DNA, 20 bp, Artificial
  CRISPR gRNA sequence
tccctgaattcaagcactgc

SEQ ID NO: 41694 - DNA, 20 bp, Artificial
  CRISPR gRNA sequence
ctactttgcctgtgtacaca

SEQ ID NO: 41695 - DNA, 20 bp, Artificial
  CRISPR gRNA sequence
tactttgcctgtgtacacat

SEQ ID NO: 41696 - DNA, 20 bp, Artificial
  CRISPR gRNA sequence
gtacacatgggcataccatg

SEQ ID NO: 41697 - DNA, 20 bp, Artificial
  CRISPR gRNA sequence
tacacatgggcataccatgt

SEQ ID NO: 41698 - DNA, 20 bp, Artificial
  CRISPR gRNA sequence
tgggcataccatgtgggatg

SEQ ID NO: 41699 - DNA, 20 bp, Artificial
  CRISPR gRNA sequence
ataccatgtgggatgtggta

SEQ ID NO: 41700 - DNA, 20 bp, Artificial
  CRISPR gRNA sequence
accatgtgggatgtggtaaa

SEQ ID NO: 41701 - DNA, 20 bp, Artificial
  CRISPR gRNA sequence
gtgggatgtggtaaagagta

SEQ ID NO: 41702 - DNA, 20 bp, Artificial
  CRISPR gRNA sequence
attgctttaaaaaaaaaaaa

SEQ ID NO: 41703 - DNA, 20 bp, Artificial
  CRISPR gRNA sequence
ttgctttaaaaaaaaaaaaa

SEQ ID NO: 41704 - DNA, 20 bp, Artificial
  CRISPR gRNA sequence
gctttaaaaaaaaaaaaaag

SEQ ID NO: 41705 - DNA, 20 bp, Artificial
  CRISPR gRNA sequence
ctttaaaaaaaaaaaaaagg

SEQ ID NO: 41706 - DNA, 20 bp, Artificial
  CRISPR gRNA sequence
tttaaaaaaaaaaaaaagga

SEQ ID NO: 41707 - DNA, 20 bp, Artificial
  CRISPR gRNA sequence
taatcacctcctttgccaac

SEQ ID NO: 41708 - DNA, 20 bp, Artificial
  CRISPR gRNA sequence
atcacctcctttgccaacca

SEQ ID NO: 41709 - DNA, 20 bp, Artificial
  CRISPR gRNA sequence
cctttgccaaccagagccca

SEQ ID NO: 41710 - DNA, 20 bp, Artificial
  CRISPR gRNA sequence
accagagcccatggtgtatt

SEQ ID NO: 41711 - DNA, 20 bp, Artificial
  CRISPR gRNA sequence
ccagagcccatggtgtattt

SEQ ID NO: 41712 - DNA, 20 bp, Artificial
  CRISPR gRNA sequence
cagagcccatggtgtatttg

SEQ ID NO: 41713 - DNA, 20 bp, Artificial
  CRISPR gRNA sequence
agagcccatggtgtatttgg

SEQ ID NO: 41714 - DNA, 20 bp, Artificial
  CRISPR gRNA sequence
ccatggtgtatttgggggtc

SEQ ID NO: 41715 - DNA, 20 bp, Artificial
  CRISPR gRNA sequence
tggtgtatttgggggtctgg

SEQ ID NO: 41716 - DNA, 20 bp, Artificial
  CRISPR gRNA sequence
ggtgtatttgggggtctggt

SEQ ID NO: 41717 - DNA, 20 bp, Artificial
  CRISPR gRNA sequence
gggtctggtgggacaccata

SEQ ID NO: 41718 - DNA, 20 bp, Artificial
  CRISPR gRNA sequence
ggtctggtgggacaccatac

SEQ ID NO: 41719 - DNA, 20 bp, Artificial
  CRISPR gRNA sequence
caccatacgggatgtgtttc

SEQ ID NO: 41720 - DNA, 20 bp, Artificial
  CRISPR gRNA sequence
atacgggatgtgtttctgga

SEQ ID NO: 41721 - DNA, 20 bp, Artificial
  CRISPR gRNA sequence
tggaaagaccaccctcaata

SEQ ID NO: 41722 - DNA, 20 bp, Artificial
  CRISPR gRNA sequence
ggaaagaccaccctcaataa

SEQ ID NO: 41723 - DNA, 20 bp, Artificial
  CRISPR gRNA sequence
accaccctcaataaaggccc

SEQ ID NO: 41724 - DNA, 20 bp, Artificial
  CRISPR gRNA sequence
ccccagtcctgactgtgcct

SEQ ID NO: 41725 - DNA, 20 bp, Artificial
  CRISPR gRNA sequence
cccagtcctgactgtgcctc

SEQ ID NO: 41726 - DNA, 20 bp, Artificial
  CRISPR gRNA sequence
ccagtcctgactgtgcctca

SEQ ID NO: 41727 - DNA, 20 bp, Artificial
  CRISPR gRNA sequence
cagtcctgactgtgcctcag

SEQ ID NO: 41728 - DNA, 20 bp, Artificial
  CRISPR gRNA sequence
gtgcctcaggggcccatgcc

SEQ ID NO: 41729 - DNA, 20 bp, Artificial
  CRISPR gRNA sequence
aggggcccatgcccagtccc

SEQ ID NO: 41730 - DNA, 20 bp, Artificial
  CRISPR gRNA sequence
ggggcccatgcccagtccct

SEQ ID NO: 41731 - DNA, 20 bp, Artificial
  CRISPR gRNA sequence
gggcccatgcccagtccctg

SEQ ID NO: 41732 - DNA, 20 bp, Artificial
  CRISPR gRNA sequence
cccatgcccagtccctgggg

SEQ ID NO: 41733 - DNA, 20 bp, Artificial
  CRISPR gRNA sequence
tgcccagtccctggggcaga

SEQ ID NO: 41734 - DNA, 20 bp, Artificial
  CRISPR gRNA sequence
gcccagtccctggggcagaa

SEQ ID NO: 41735 - DNA, 20 bp, Artificial
  CRISPR gRNA sequence
cccagtccctggggcagaaa

SEQ ID NO: 41736 - DNA, 20 bp, Artificial
  CRISPR gRNA sequence
agtccctggggcagaaaggg

SEQ ID NO: 41737 - DNA, 20 bp, Artificial
  CRISPR gRNA sequence
tccctggggcagaaagggta

SEQ ID NO: 41738 - DNA, 20 bp, Artificial
  CRISPR gRNA sequence
tggggcagaaagggtagagt

SEQ ID NO: 41739 - DNA, 20 bp, Artificial
  CRISPR gRNA sequence
ggggcagaaagggtagagtt

SEQ ID NO: 41740 - DNA, 20 bp, Artificial
  CRISPR gRNA sequence
aaagggtagagttgggcctc

SEQ ID NO: 41741 - DNA, 20 bp, Artificial
  CRISPR gRNA sequence
gtagagttgggcctccagcc

SEQ ID NO: 41742 - DNA, 20 bp, Artificial
  CRISPR gRNA sequence
tagagttgggcctccagcct

SEQ ID NO: 41743 - DNA, 20 bp, Artificial
  CRISPR gRNA sequence
tgggcctccagcctgggccc

SEQ ID NO: 41744 - DNA, 20 bp, Artificial
  CRISPR gRNA sequence
gcctccagcctgggccctgg

SEQ ID NO: 41745 - DNA, 20 bp, Artificial
  CRISPR gRNA sequence
ctccagcctgggccctggca

SEQ ID NO: 41746 - DNA, 20 bp, Artificial
  CRISPR gRNA sequence
tccagcctgggccctggcag

SEQ ID NO: 41747 - DNA, 20 bp, Artificial
  CRISPR gRNA sequence
cctggcagaggctccaacat

SEQ ID NO: 41748 - DNA, 20 bp, Artificial
  CRISPR gRNA sequence
ctggcagaggctccaacatg

SEQ ID NO: 41749 - DNA, 20 bp, Artificial
  CRISPR gRNA sequence
tcccgccctaccctgccccc

SEQ ID NO: 41750 - DNA, 20 bp, Artificial
  CRISPR gRNA sequence
accctgccccccagctcact

SEQ ID NO: 41751 - DNA, 20 bp, Artificial
  CRISPR gRNA sequence
tgccccccagctcactgagc

SEQ ID NO: 41752 - DNA, 20 bp, Artificial
  CRISPR gRNA sequence
gctcactgagccagttgatg

SEQ ID NO: 41753 - DNA, 20 bp, Artificial
  CRISPR gRNA sequence
ctcactgagccagttgatgt

SEQ ID NO: 41754 - DNA, 20 bp, Artificial
  CRISPR gRNA sequence
tcactgagccagttgatgta

SEQ ID NO: 41755 - DNA, 20 bp, Artificial
  CRISPR gRNA sequence
ctccatgcctcccctccaaa

SEQ ID NO: 41756 - DNA, 20 bp, Artificial
  CRISPR gRNA sequence
atgcctcccctccaaacagc

SEQ ID NO: 41757 - DNA, 20 bp, Artificial
  CRISPR gRNA sequence
gcctcccctccaaacagcca

SEQ ID NO: 41758 - DNA, 20 bp, Artificial
  CRISPR gRNA sequence
cctcccctccaaacagccag

SEQ ID NO: 41759 - DNA, 20 bp, Artificial
  CRISPR gRNA sequence
tcccctccaaacagccagag

SEQ ID NO: 41760 - DNA, 20 bp, Artificial
  CRISPR gRNA sequence
ctccaaacagccagaggaga

SEQ ID NO: 41761 - DNA, 20 bp, Artificial
  CRISPR gRNA sequence
caaacagccagaggagaaag

SEQ ID NO: 41762 - DNA, 20 bp, Artificial
  CRISPR gRNA sequence
acagccagaggagaaagcag

SEQ ID NO: 41763 - DNA, 20 bp, Artificial
  CRISPR gRNA sequence
agccagaggagaaagcagca

SEQ ID NO: 41764 - DNA, 20 bp, Artificial
  CRISPR gRNA sequence
agaggagaaagcagcagaga

SEQ ID NO: 41765 - DNA, 20 bp, Artificial
  CRISPR gRNA sequence
gaggagaaagcagcagagat

SEQ ID NO: 41766 - DNA, 20 bp, Artificial
  CRISPR gRNA sequence
agaaagcagcagagatgggc

SEQ ID NO: 41767 - DNA, 20 bp, Artificial
  CRISPR gRNA sequence
gaaagcagcagagatgggcc

SEQ ID NO: 41768 - DNA, 20 bp, Artificial
  CRISPR gRNA sequence
gcagagatgggccaggccct

SEQ ID NO: 41769 - DNA, 20 bp, Artificial
  CRISPR gRNA sequence
agagatgggccaggcccttg

SEQ ID NO: 41770 - DNA, 20 bp, Artificial
  CRISPR gRNA sequence
gagatgggccaggcccttgg

SEQ ID NO: 41771 - DNA, 20 bp, Artificial
  CRISPR gRNA sequence
ggccaggcccttggaggccc

SEQ ID NO: 41772 - DNA, 20 bp, Artificial
  CRISPR gRNA sequence
ccaggcccttggaggccccg

SEQ ID NO: 41773 - DNA, 20 bp, Artificial
  CRISPR gRNA sequence
aggcccttggaggccccgga

SEQ ID NO: 41774 - DNA, 20 bp, Artificial
  CRISPR gRNA sequence
ggcccttggaggccccggag

SEQ ID NO: 41775 - DNA, 20 bp, Artificial
  CRISPR gRNA sequence
gcccttggaggccccggaga

SEQ ID NO: 41776 - DNA, 20 bp, Artificial
  CRISPR gRNA sequence
cccttggaggccccggagag

SEQ ID NO: 41777 - DNA, 20 bp, Artificial
  CRISPR gRNA sequence
cttggaggccccggagaggg

SEQ ID NO: 41778 - DNA, 20 bp, Artificial
  CRISPR gRNA sequence
tggaggccccggagagggga

SEQ ID NO: 41779 - DNA, 20 bp, Artificial
  CRISPR gRNA sequence
ggaggccccggagaggggag

SEQ ID NO: 41780 - DNA, 20 bp, Artificial
  CRISPR gRNA sequence
gaggccccggagaggggaga

SEQ ID NO: 41781 - DNA, 20 bp, Artificial
  CRISPR gRNA sequence
gccccggagaggggagaggg

SEQ ID NO: 41782 - DNA, 20 bp, Artificial
  CRISPR gRNA sequence
agaggggagagggcagcctg

SEQ ID NO: 41783 - DNA, 20 bp, Artificial
  CRISPR gRNA sequence
aggggagagggcagcctgca

SEQ ID NO: 41784 - DNA, 20 bp, Artificial
  CRISPR gRNA sequence
ggggagagggcagcctgcag

SEQ ID NO: 41785 - DNA, 20 bp, Artificial
  CRISPR gRNA sequence
agggcagcctgcagaggatg

SEQ ID NO: 41786 - DNA, 20 bp, Artificial
  CRISPR gRNA sequence
gggcagcctgcagaggatga

SEQ ID NO: 41787 - DNA, 20 bp, Artificial
  CRISPR gRNA sequence
gcctgcagaggatgaaggaa

SEQ ID NO: 41788 - DNA, 20 bp, Artificial
  CRISPR gRNA sequence
gcagaggatgaaggaacaga

SEQ ID NO: 41789 - DNA, 20 bp, Artificial
  CRISPR gRNA sequence
agaggatgaaggaacagaaa

SEQ ID NO: 41790 - DNA, 20 bp, Artificial
  CRISPR gRNA sequence
aggatgaaggaacagaaaga

SEQ ID NO: 41791 - DNA, 20 bp, Artificial
  CRISPR gRNA sequence
ggatgaaggaacagaaagag

SEQ ID NO: 41792 - DNA, 20 bp, Artificial
  CRISPR gRNA sequence
tgaaggaacagaaagagagg

SEQ ID NO: 41793 - DNA, 20 bp, Artificial
  CRISPR gRNA sequence
gaaggaacagaaagagagga

SEQ ID NO: 41794 - DNA, 20 bp, Artificial
  CRISPR gRNA sequence
aaggaacagaaagagaggaa

SEQ ID NO: 41795 - DNA, 20 bp, Artificial
  CRISPR gRNA sequence
aggaacagaaagagaggaag

SEQ ID NO: 41796 - DNA, 20 bp, Artificial
  CRISPR gRNA sequence
ggaacagaaagagaggaagg

SEQ ID NO: 41797 - DNA, 20 bp, Artificial
  CRISPR gRNA sequence
aacagaaagagaggaagggg

SEQ ID NO: 41798 - DNA, 20 bp, Artificial
  CRISPR gRNA sequence
acagaaagagaggaaggggg

SEQ ID NO: 41799 - DNA, 20 bp, Artificial
  CRISPR gRNA sequence
gaaagagaggaagggggagg

SEQ ID NO: 41800 - DNA, 20 bp, Artificial
  CRISPR gRNA sequence
aagagaggaagggggaggtg

SEQ ID NO: 41801 - DNA, 20 bp, Artificial
  CRISPR gRNA sequence
agaggaagggggaggtggag

SEQ ID NO: 41802 - DNA, 20 bp, Artificial
  CRISPR gRNA sequence
gaggaagggggaggtggaga

SEQ ID NO: 41803 - DNA, 20 bp, Artificial
  CRISPR gRNA sequence
gaagggggaggtggagaagg

SEQ ID NO: 41804 - DNA, 20 bp, Artificial
  CRISPR gRNA sequence
gggggaggtggagaaggcag

SEQ ID NO: 41805 - DNA, 20 bp, Artificial
  CRISPR gRNA sequence
ggggaggtggagaaggcaga

SEQ ID NO: 41806 - DNA, 20 bp, Artificial
  CRISPR gRNA sequence
ggaggtggagaaggcagaag

SEQ ID NO: 41807 - DNA, 20 bp, Artificial
  CRISPR gRNA sequence
gagaaggcagaaggagaaca

SEQ ID NO: 41808 - DNA, 20 bp, Artificial
  CRISPR gRNA sequence
aaggcagaaggagaacatag

SEQ ID NO: 41809 - DNA, 20 bp, Artificial
  CRISPR gRNA sequence
ggcagaaggagaacatagta

SEQ ID NO: 41810 - DNA, 20 bp, Artificial
  CRISPR gRNA sequence
gcagaaggagaacatagtag

SEQ ID NO: 41811 - DNA, 20 bp, Artificial
  CRISPR gRNA sequence
gagaacatagtagaggtctg

SEQ ID NO: 41812 - DNA, 20 bp, Artificial
  CRISPR gRNA sequence
agaacatagtagaggtctgc

SEQ ID NO: 41813 - DNA, 20 bp, Artificial
  CRISPR gRNA sequence
gaacatagtagaggtctgcg

SEQ ID NO: 41814 - DNA, 20 bp, Artificial
  CRISPR gRNA sequence
aacatagtagaggtctgcgg

SEQ ID NO: 41815 - DNA, 20 bp, Artificial
  CRISPR gRNA sequence
tagtagaggtctgcgggggt

SEQ ID NO: 41816 - DNA, 20 bp, Artificial
  CRISPR gRNA sequence
agtagaggtctgcgggggtt

SEQ ID NO: 41817 - DNA, 20 bp, Artificial
  CRISPR gRNA sequence
agaggtctgcgggggttggg

SEQ ID NO: 41818 - DNA, 20 bp, Artificial
  CRISPR gRNA sequence
ggtctgcgggggttgggaag

SEQ ID NO: 41819 - DNA, 20 bp, Artificial
  CRISPR gRNA sequence
cgggggttgggaagtggctc

SEQ ID NO: 41820 - DNA, 20 bp, Artificial
  CRISPR gRNA sequence
gggggttgggaagtggctcc

SEQ ID NO: 41821 - DNA, 20 bp, Artificial
  CRISPR gRNA sequence
ggaagtggctccaggccccc

SEQ ID NO: 41822 - DNA, 20 bp, Artificial
  CRISPR gRNA sequence
gaagtggctccaggcccccc

SEQ ID NO: 41823 - DNA, 20 bp, Artificial
  CRISPR gRNA sequence
gtggctccaggccccccagg

SEQ ID NO: 41824 - DNA, 20 bp, Artificial
  CRISPR gRNA sequence
tggctccaggccccccagga

SEQ ID NO: 41825 - DNA, 20 bp, Artificial
  CRISPR gRNA sequence
ggctccaggccccccaggaa

SEQ ID NO: 41826 - DNA, 20 bp, Artificial
  CRISPR gRNA sequence
gctccaggccccccaggaag

SEQ ID NO: 41827 - DNA, 20 bp, Artificial
  CRISPR gRNA sequence
ggccccccaggaaggggctg

SEQ ID NO: 41828 - DNA, 20 bp, Artificial
  CRISPR gRNA sequence
gccccccaggaaggggctgt

SEQ ID NO: 41829 - DNA, 20 bp, Artificial
  CRISPR gRNA sequence
aaggggctgtaggtaaaccc

SEQ ID NO: 41830 - DNA, 20 bp, Artificial
  CRISPR gRNA sequence
aggggctgtaggtaaacccc

SEQ ID NO: 41831 - DNA, 20 bp, Artificial
  CRISPR gRNA sequence
ggggctgtaggtaaacccca

SEQ ID NO: 41832 - DNA, 20 bp, Artificial
  CRISPR gRNA sequence
taggtaaaccccagggaact

SEQ ID NO: 41833 - DNA, 20 bp, Artificial
  CRISPR gRNA sequence
cccagggaactcagtgtctt

SEQ ID NO: 41834 - DNA, 20 bp, Artificial
  CRISPR gRNA sequence
ctcagtgtcttgagttgtcc

SEQ ID NO: 41835 - DNA, 20 bp, Artificial
  CRISPR gRNA sequence
agttgtcctggtcctccatc

SEQ ID NO: 41836 - DNA, 20 bp, Artificial
  CRISPR gRNA sequence
ttgtcctggtcctccatcta

SEQ ID NO: 41837 - DNA, 20 bp, Artificial
  CRISPR gRNA sequence
tcctggtcctccatctagag

SEQ ID NO: 41838 - DNA, 20 bp, Artificial
  CRISPR gRNA sequence
ctggtcctccatctagagca

SEQ ID NO: 41839 - DNA, 20 bp, Artificial
  CRISPR gRNA sequence
tcctccatctagagcagaga

SEQ ID NO: 41840 - DNA, 20 bp, Artificial
  CRISPR gRNA sequence
ccatctagagcagagacagc

SEQ ID NO: 41841 - DNA, 20 bp, Artificial
  CRISPR gRNA sequence
catctagagcagagacagca

SEQ ID NO: 41842 - DNA, 20 bp, Artificial
  CRISPR gRNA sequence
ctagagcagagacagcaagg

SEQ ID NO: 41843 - DNA, 20 bp, Artificial
  CRISPR gRNA sequence
tagagcagagacagcaaggc

SEQ ID NO: 41844 - DNA, 20 bp, Artificial
  CRISPR gRNA sequence
gagacagcaaggcaggtatc

SEQ ID NO: 41845 - DNA, 20 bp, Artificial
  CRISPR gRNA sequence
gacagcaaggcaggtatctg

SEQ ID NO: 41846 - DNA, 20 bp, Artificial
  CRISPR gRNA sequence
ggagtttctcctaaatgcac

SEQ ID NO: 41847 - DNA, 20 bp, Artificial
  CRISPR gRNA sequence
gagtttctcctaaatgcact

SEQ ID NO: 41848 - DNA, 20 bp, Artificial
  CRISPR gRNA sequence
cgaattatctgaacaatgat

SEQ ID NO: 41849 - DNA, 20 bp, Artificial
  CRISPR gRNA sequence
ttatctgaacaatgatgagc

SEQ ID NO: 41850 - DNA, 20 bp, Artificial
  CRISPR gRNA sequence
ctgaacaatgatgagctggt

SEQ ID NO: 41851 - DNA, 20 bp, Artificial
  CRISPR gRNA sequence
caatgatgagctggttggtc

SEQ ID NO: 41852 - DNA, 20 bp, Artificial
  CRISPR gRNA sequence
gctggttggtctggtgttaa

SEQ ID NO: 41853 - DNA, 20 bp, Artificial
  CRISPR gRNA sequence
ctggttggtctggtgttaat

SEQ ID NO: 41854 - DNA, 20 bp, Artificial
  CRISPR gRNA sequence
gtctggtgttaatgggcaac

SEQ ID NO: 41855 - DNA, 20 bp, Artificial
  CRISPR gRNA sequence
ctggtgttaatgggcaacta

SEQ ID NO: 41856 - DNA, 20 bp, Artificial
  CRISPR gRNA sequence
taatgggcaactagagaccc

SEQ ID NO: 41857 - DNA, 20 bp, Artificial
  CRISPR gRNA sequence
gggcaactagagacccaagc

SEQ ID NO: 41858 - DNA, 20 bp, Artificial
  CRISPR gRNA sequence
cactgtcatatccactcctc

SEQ ID NO: 41859 - DNA, 20 bp, Artificial
  CRISPR gRNA sequence
actgtcatatccactcctct

SEQ ID NO: 41860 - DNA, 20 bp, Artificial
  CRISPR gRNA sequence
catatccactcctctgggtt

SEQ ID NO: 41861 - DNA, 20 bp, Artificial
  CRISPR gRNA sequence
atatccactcctctgggtta

SEQ ID NO: 41862 - DNA, 20 bp, Artificial
  CRISPR gRNA sequence
tccactcctctgggttaagg

SEQ ID NO: 41863 - DNA, 20 bp, Artificial
  CRISPR gRNA sequence
cttttcttttttattttttt

SEQ ID NO: 41864 - DNA, 20 bp, Artificial
  CRISPR gRNA sequence
tcttttttatttttttgaga

SEQ ID NO: 41865 - DNA, 20 bp, Artificial
  CRISPR gRNA sequence
ttttttatttttttgagata

SEQ ID NO: 41866 - DNA, 20 bp, Artificial
  CRISPR gRNA sequence
tagagactcgctctgtcacc

SEQ ID NO: 41867 - DNA, 20 bp, Artificial
  CRISPR gRNA sequence
agagactcgctctgtcaccc

SEQ ID NO: 41868 - DNA, 20 bp, Artificial
  CRISPR gRNA sequence
actcgctctgtcacccaggc

SEQ ID NO: 41869 - DNA, 20 bp, Artificial
  CRISPR gRNA sequence
tcgctctgtcacccaggctg

SEQ ID NO: 41870 - DNA, 20 bp, Artificial
  CRISPR gRNA sequence
ctgtcacccaggctggagtg

SEQ ID NO: 41871 - DNA, 20 bp, Artificial
  CRISPR gRNA sequence
tcacccaggctggagtgcag

SEQ ID NO: 41872 - DNA, 20 bp, Artificial
  CRISPR gRNA sequence
ggagtgcagtggtacgatct

SEQ ID NO: 41873 - DNA, 20 bp, Artificial
  CRISPR gRNA sequence
tcactgcaacctctgcctcc

SEQ ID NO: 41874 - DNA, 20 bp, Artificial
  CRISPR gRNA sequence
cactgcaacctctgcctccc

SEQ ID NO: 41875 - DNA, 20 bp, Artificial
  CRISPR gRNA sequence
aacctctgcctcccaggttc

SEQ ID NO: 41876 - DNA, 20 bp, Artificial
  CRISPR gRNA sequence
ttcaagtgattcccatgcct

SEQ ID NO: 41877 - DNA, 20 bp, Artificial
  CRISPR gRNA sequence
ttcccatgcctcagcctcct

SEQ ID NO: 41878 - DNA, 20 bp, Artificial
  CRISPR gRNA sequence
ccatgcctcagcctcctgag

SEQ ID NO: 41879 - DNA, 20 bp, Artificial
  CRISPR gRNA sequence
ctcctgagtagctattacta

SEQ ID NO: 41880 - DNA, 20 bp, Artificial
  CRISPR gRNA sequence
tcctgagtagctattactac

SEQ ID NO: 41881 - DNA, 20 bp, Artificial
  CRISPR gRNA sequence
caggtgtgcaccaccacgcc

SEQ ID NO: 41882 - DNA, 20 bp, Artificial
  CRISPR gRNA sequence
aatttttttttcgttttttg

SEQ ID NO: 41883 - DNA, 20 bp, Artificial
  CRISPR gRNA sequence
ttttttttcgttttttgtag

SEQ ID NO: 41884 - DNA, 20 bp, Artificial
  CRISPR gRNA sequence
ttttttcgttttttgtagta

SEQ ID NO: 41885 - DNA, 20 bp, Artificial
  CRISPR gRNA sequence
tttttcgttttttgtagtag

SEQ ID NO: 41886 - DNA, 20 bp, Artificial
  CRISPR gRNA sequence
ttcgttttttgtagtagagg

SEQ ID NO: 41887 - DNA, 20 bp, Artificial
  CRISPR gRNA sequence
tggaatttcaccatgttgcc

SEQ ID NO: 41888 - DNA, 20 bp, Artificial
  CRISPR gRNA sequence
ggaatttcaccatgttgccc

SEQ ID NO: 41889 - DNA, 20 bp, Artificial
  CRISPR gRNA sequence
tttcaccatgttgcccaggc

SEQ ID NO: 41890 - DNA, 20 bp, Artificial
  CRISPR gRNA sequence
catgttgcccaggctggtcc

SEQ ID NO: 41891 - DNA, 20 bp, Artificial
  CRISPR gRNA sequence
tggtcccagactcctgacct

SEQ ID NO: 41892 - DNA, 20 bp, Artificial
  CRISPR gRNA sequence
ctcagatgatccacccacct

SEQ ID NO: 41893 - DNA, 20 bp, Artificial
  CRISPR gRNA sequence
ccacccacctcagcctccca

SEQ ID NO: 41894 - DNA, 20 bp, Artificial
  CRISPR gRNA sequence
ctcccaaagtgctgcgatta

SEQ ID NO: 41895 - DNA, 20 bp, Artificial
  CRISPR gRNA sequence
tcccaaagtgctgcgattac

SEQ ID NO: 41896 - DNA, 20 bp, Artificial
  CRISPR gRNA sequence
agtgctgcgattacaggcat

SEQ ID NO: 41897 - DNA, 20 bp, Artificial
  CRISPR gRNA sequence
caggcatgagccaccatgcc

SEQ ID NO: 41898 - DNA, 20 bp, Artificial
  CRISPR gRNA sequence
ttcttaacaaacatgttttg

SEQ ID NO: 41899 - DNA, 20 bp, Artificial
  CRISPR gRNA sequence
ttgcggaacactaaccttca

SEQ ID NO: 41900 - DNA, 20 bp, Artificial
  CRISPR gRNA sequence
cccttaaaaattaattctgc

SEQ ID NO: 41901 - DNA, 20 bp, Artificial
  CRISPR gRNA sequence
attaattctgctagtccatt

SEQ ID NO: 41902 - DNA, 20 bp, Artificial
  CRISPR gRNA sequence
ttctgctagtccatttagtt

SEQ ID NO: 41903 - DNA, 20 bp, Artificial
  CRISPR gRNA sequence
tctgctagtccatttagttt

SEQ ID NO: 41904 - DNA, 20 bp, Artificial
  CRISPR gRNA sequence
ctgctagtccatttagtttg

SEQ ID NO: 41905 - DNA, 20 bp, Artificial
  CRISPR gRNA sequence
agtccatttagtttggggaa

SEQ ID NO: 41906 - DNA, 20 bp, Artificial
  CRISPR gRNA sequence
gtttggggaaaagtctgctg

SEQ ID NO: 41907 - DNA, 20 bp, Artificial
  CRISPR gRNA sequence
aaaagtctgctgtagctcct

SEQ ID NO: 41908 - DNA, 20 bp, Artificial
  CRISPR gRNA sequence
ccttggaaattcataatgca

SEQ ID NO: 41909 - DNA, 20 bp, Artificial
  CRISPR gRNA sequence
tggaaattcataatgcacag

SEQ ID NO: 41910 - DNA, 20 bp, Artificial
  CRISPR gRNA sequence
taatgcacagcagcctatcg

SEQ ID NO: 41911 - DNA, 20 bp, Artificial
  CRISPR gRNA sequence
acagcagcctatcgcagcct

SEQ ID NO: 41912 - DNA, 20 bp, Artificial
  CRISPR gRNA sequence
agcagcctatcgcagcctca

SEQ ID NO: 41913 - DNA, 20 bp, Artificial
  CRISPR gRNA sequence
agcctatcgcagcctcagag

SEQ ID NO: 41914 - DNA, 20 bp, Artificial
  CRISPR gRNA sequence
gcagcctcagagaagccctg

SEQ ID NO: 41915 - DNA, 20 bp, Artificial
  CRISPR gRNA sequence
gcaaacaaaaccatttaatt

SEQ ID NO: 41916 - DNA, 20 bp, Artificial
  CRISPR gRNA sequence
cccgtatttcccaaacttaa

SEQ ID NO: 41917 - DNA, 20 bp, Artificial
  CRISPR gRNA sequence
aaaagaccttcctcttcttc

SEQ ID NO: 41918 - DNA, 20 bp, Artificial
  CRISPR gRNA sequence
ttcctcttcttccagcctca

SEQ ID NO: 41919 - DNA, 20 bp, Artificial
  CRISPR gRNA sequence
ccagcctcacggataaccca

SEQ ID NO: 41920 - DNA, 20 bp, Artificial
  CRISPR gRNA sequence
tcacggataacccatggacc

SEQ ID NO: 41921 - DNA, 20 bp, Artificial
  CRISPR gRNA sequence
ataacccatggacccagtgc

SEQ ID NO: 41922 - DNA, 20 bp, Artificial
  CRISPR gRNA sequence
taacccatggacccagtgct

SEQ ID NO: 41923 - DNA, 20 bp, Artificial
  CRISPR gRNA sequence
acccatggacccagtgctgg

SEQ ID NO: 41924 - DNA, 20 bp, Artificial
  CRISPR gRNA sequence
cccatggacccagtgctggg

SEQ ID NO: 41925 - DNA, 20 bp, Artificial
  CRISPR gRNA sequence
ccatggacccagtgctggga

SEQ ID NO: 41926 - DNA, 20 bp, Artificial
  CRISPR gRNA sequence
agtgctgggagggaatgttt

SEQ ID NO: 41927 - DNA, 20 bp, Artificial
  CRISPR gRNA sequence
gtgctgggagggaatgtttc

SEQ ID NO: 41928 - DNA, 20 bp, Artificial
  CRISPR gRNA sequence
gggaatgtttcaggtgaccc

SEQ ID NO: 41929 - DNA, 20 bp, Artificial
  CRISPR gRNA sequence
atgtttcaggtgaccctggt

SEQ ID NO: 41930 - DNA, 20 bp, Artificial
  CRISPR gRNA sequence
tgtttcaggtgaccctggtt

SEQ ID NO: 41931 - DNA, 20 bp, Artificial
  CRISPR gRNA sequence
ccctggttaggtcccatctc

SEQ ID NO: 41932 - DNA, 20 bp, Artificial
  CRISPR gRNA sequence
tggttaggtcccatctccag

SEQ ID NO: 41933 - DNA, 20 bp, Artificial
  CRISPR gRNA sequence
ggttaggtcccatctccaga

SEQ ID NO: 41934 - DNA, 20 bp, Artificial
  CRISPR gRNA sequence
gtcccatctccagaaggctc

SEQ ID NO: 41935 - DNA, 20 bp, Artificial
  CRISPR gRNA sequence
ctccagaaggctctggctat

SEQ ID NO: 41936 - DNA, 20 bp, Artificial
  CRISPR gRNA sequence
tccagaaggctctggctatg

SEQ ID NO: 41937 - DNA, 20 bp, Artificial
  CRISPR gRNA sequence
ggccgtgctccctgctttcc

SEQ ID NO: 41938 - DNA, 20 bp, Artificial
  CRISPR gRNA sequence
cgtgctccctgctttcctgg

SEQ ID NO: 41939 - DNA, 20 bp, Artificial
  CRISPR gRNA sequence
gtgctccctgctttcctgga

SEQ ID NO: 41940 - DNA, 20 bp, Artificial
  CRISPR gRNA sequence
catccacctgctttgtttca

SEQ ID NO: 41941 - DNA, 20 bp, Artificial
  CRISPR gRNA sequence
tgtttcacagattgtcctgt

SEQ ID NO: 41942 - DNA, 20 bp, Artificial
  CRISPR gRNA sequence
agattgtcctgtgagttcct

SEQ ID NO: 41943 - DNA, 20 bp, Artificial
  CRISPR gRNA sequence
cctgtgagttcctgagtgac

SEQ ID NO: 41944 - DNA, 20 bp, Artificial
  CRISPR gRNA sequence
tgtgagttcctgagtgacca

SEQ ID NO: 41945 - DNA, 20 bp, Artificial
  CRISPR gRNA sequence
gttcctgagtgaccagagcc

SEQ ID NO: 41946 - DNA, 20 bp, Artificial
  CRISPR gRNA sequence
tcctgagtgaccagagcctg

SEQ ID NO: 41947 - DNA, 20 bp, Artificial
  CRISPR gRNA sequence
ccagagcctggagactctac

SEQ ID NO: 41948 - DNA, 20 bp, Artificial
  CRISPR gRNA sequence
actgcttacctcaactccct

SEQ ID NO: 41949 - DNA, 20 bp, Artificial
  CRISPR gRNA sequence
ttacctcaactccctcagct

SEQ ID NO: 41950 - DNA, 20 bp, Artificial
  CRISPR gRNA sequence
tccctcagctgagcctgctg

SEQ ID NO: 41951 - DNA, 20 bp, Artificial
  CRISPR gRNA sequence
tcagctgagcctgctgcagt

SEQ ID NO: 41952 - DNA, 20 bp, Artificial
  CRISPR gRNA sequence
tgagcctgctgcagtaagac

SEQ ID NO: 41953 - DNA, 20 bp, Artificial
  CRISPR gRNA sequence
agcctgctgcagtaagacga

SEQ ID NO: 41954 - DNA, 20 bp, Artificial
  CRISPR gRNA sequence
cgagagtttttcctatttcc

SEQ ID NO: 41955 - DNA, 20 bp, Artificial
  CRISPR gRNA sequence
ttccttgtgctcgtgtttct

SEQ ID NO: 41956 - DNA, 20 bp, Artificial
  CRISPR gRNA sequence
tccttgtgctcgtgtttcta

SEQ ID NO: 41957 - DNA, 20 bp, Artificial
  CRISPR gRNA sequence
gtgtttctaaggctcctcca

SEQ ID NO: 41958 - DNA, 20 bp, Artificial
  CRISPR gRNA sequence
tctaaggctcctccatggca

SEQ ID NO: 41959 - DNA, 20 bp, Artificial
  CRISPR gRNA sequence
tacccgctccattctttcct

SEQ ID NO: 41960 - DNA, 20 bp, Artificial
  CRISPR gRNA sequence
acccgctccattctttcctt

SEQ ID NO: 41961 - DNA, 20 bp, Artificial
  CRISPR gRNA sequence
ggttgttttatcattttacc

SEQ ID NO: 41962 - DNA, 20 bp, Artificial
  CRISPR gRNA sequence
atcattttacctggcacaac

SEQ ID NO: 41963 - DNA, 20 bp, Artificial
  CRISPR gRNA sequence
tcattttacctggcacaact

SEQ ID NO: 41964 - DNA, 20 bp, Artificial
  CRISPR gRNA sequence
cattttacctggcacaactg

SEQ ID NO: 41965 - DNA, 20 bp, Artificial
  CRISPR gRNA sequence
tggggactccaatctgcttc

SEQ ID NO: 41966 - DNA, 20 bp, Artificial
  CRISPR gRNA sequence
ccctaatactttgtcaacct

SEQ ID NO: 41967 - DNA, 20 bp, Artificial
  CRISPR gRNA sequence
cctaatactttgtcaacctc

SEQ ID NO: 41968 - DNA, 20 bp, Artificial
  CRISPR gRNA sequence
ctaatactttgtcaacctca

SEQ ID NO: 41969 - DNA, 20 bp, Artificial
  CRISPR gRNA sequence
taatactttgtcaacctcag

SEQ ID NO: 41970 - DNA, 20 bp, Artificial
  CRISPR gRNA sequence
aatactttgtcaacctcagg

SEQ ID NO: 41971 - DNA, 20 bp, Artificial
  CRISPR gRNA sequence
cgtttgcctcctctgcgtct

SEQ ID NO: 41972 - DNA, 20 bp, Artificial
  CRISPR gRNA sequence
cagtttcctcatctgacaaa

SEQ ID NO: 41973 - DNA, 20 bp, Artificial
  CRISPR gRNA sequence
agtttcctcatctgacaaat

SEQ ID NO: 41974 - DNA, 20 bp, Artificial
  CRISPR gRNA sequence
atattccccgcccattcccc

SEQ ID NO: 41975 - DNA, 20 bp, Artificial
  CRISPR gRNA sequence
attccccgcccattccccca

SEQ ID NO: 41976 - DNA, 20 bp, Artificial
  CRISPR gRNA sequence
cccgcccattcccccagagt

SEQ ID NO: 41977 - DNA, 20 bp, Artificial
  CRISPR gRNA sequence
ccgcccattcccccagagtt

SEQ ID NO: 41978 - DNA, 20 bp, Artificial
  CRISPR gRNA sequence
cccagagttgggactcaaat

SEQ ID NO: 41979 - DNA, 20 bp, Artificial
  CRISPR gRNA sequence
agttattctaaaatcacctt

SEQ ID NO: 41980 - DNA, 20 bp, Artificial
  CRISPR gRNA sequence
tctaaaatcaccttaagaaa

SEQ ID NO: 41981 - DNA, 20 bp, Artificial
  CRISPR gRNA sequence
aaaatcaccttaagaaatgg

SEQ ID NO: 41982 - DNA, 20 bp, Artificial
  CRISPR gRNA sequence
atggaagatctgtgacaaat

SEQ ID NO: 41983 - DNA, 20 bp, Artificial
  CRISPR gRNA sequence
gtccaacttctccccaccca

SEQ ID NO: 41984 - DNA, 20 bp, Artificial
  CRISPR gRNA sequence
ccaacttctccccacccacg

SEQ ID NO: 41985 - DNA, 20 bp, Artificial
  CRISPR gRNA sequence
caacttctccccacccacgg

SEQ ID NO: 41986 - DNA, 20 bp, Artificial
  CRISPR gRNA sequence
aacttctccccacccacgga

SEQ ID NO: 41987 - DNA, 20 bp, Artificial
  CRISPR gRNA sequence
cacggagggtcacccactcg

SEQ ID NO: 41988 - DNA, 20 bp, Artificial
  CRISPR gRNA sequence
gagggtcacccactcgtaga

SEQ ID NO: 41989 - DNA, 20 bp, Artificial
  CRISPR gRNA sequence
agggtcacccactcgtagaa

SEQ ID NO: 41990 - DNA, 20 bp, Artificial
  CRISPR gRNA sequence
gggtcacccactcgtagaaa

SEQ ID NO: 41991 - DNA, 20 bp, Artificial
  CRISPR gRNA sequence
ggtcacccactcgtagaaag

SEQ ID NO: 41992 - DNA, 20 bp, Artificial
  CRISPR gRNA sequence
actcgtagaaaggggctgta

SEQ ID NO: 41993 - DNA, 20 bp, Artificial
  CRISPR gRNA sequence
agaaaggggctgtacagatg

SEQ ID NO: 41994 - DNA, 20 bp, Artificial
  CRISPR gRNA sequence
gaaaggggctgtacagatgt

SEQ ID NO: 41995 - DNA, 20 bp, Artificial
  CRISPR gRNA sequence
ttatcacatgctgcttttta

SEQ ID NO: 41996 - DNA, 20 bp, Artificial
  CRISPR gRNA sequence
tatcacatgctgctttttaa

SEQ ID NO: 41997 - DNA, 20 bp, Artificial
  CRISPR gRNA sequence
gtcaccgtcaaactcgcaaa

SEQ ID NO: 41998 - DNA, 20 bp, Artificial
  CRISPR gRNA sequence
tcaccgtcaaactcgcaaaa

SEQ ID NO: 41999 - DNA, 20 bp, Artificial
  CRISPR gRNA sequence
caccgtcaaactcgcaaaaa

SEQ ID NO: 42000 - DNA, 20 bp, Artificial
  CRISPR gRNA sequence
aactcgcaaaaagggaattt

SEQ ID NO: 42001 - DNA, 20 bp, Artificial
  CRISPR gRNA sequence
tcgcaaaaagggaatttaag

SEQ ID NO: 42002 - DNA, 20 bp, Artificial
  CRISPR gRNA sequence
atttaagcagaattccccca

SEQ ID NO: 42003 - DNA, 20 bp, Artificial
  CRISPR gRNA sequence
ttaaaactattttctaattt

SEQ ID NO: 42004 - DNA, 20 bp, Artificial
  CRISPR gRNA sequence
actattttctaatttcagct

SEQ ID NO: 42005 - DNA, 20 bp, Artificial
  CRISPR gRNA sequence
tttctaatttcagctcagac

SEQ ID NO: 42006 - DNA, 20 bp, Artificial
  CRISPR gRNA sequence
taatttcagctcagactggt

SEQ ID NO: 42007 - DNA, 20 bp, Artificial
  CRISPR gRNA sequence
cagactggttagaattttaa

SEQ ID NO: 42008 - DNA, 20 bp, Artificial
  CRISPR gRNA sequence
gttagaattttaaaagtatt

SEQ ID NO: 42009 - DNA, 20 bp, Artificial
  CRISPR gRNA sequence
ttagaattttaaaagtattt

SEQ ID NO: 42010 - DNA, 20 bp, Artificial
  CRISPR gRNA sequence
aaaagtatttaggccatgtg

SEQ ID NO: 42011 - DNA, 20 bp, Artificial
  CRISPR gRNA sequence
agtatttaggccatgtgtgg

SEQ ID NO: 42012 - DNA, 20 bp, Artificial
  CRISPR gRNA sequence
gtggctcatgcctgtaatcc

SEQ ID NO: 42013 - DNA, 20 bp, Artificial
  CRISPR gRNA sequence
tgcctgtaatcccggcactt

SEQ ID NO: 42014 - DNA, 20 bp, Artificial
  CRISPR gRNA sequence
gcctgtaatcccggcacttt

SEQ ID NO: 42015 - DNA, 20 bp, Artificial
  CRISPR gRNA sequence
ctgtaatcccggcactttgg

SEQ ID NO: 42016 - DNA, 20 bp, Artificial
  CRISPR gRNA sequence
tgtaatcccggcactttggg

SEQ ID NO: 42017 - DNA, 20 bp, Artificial
  CRISPR gRNA sequence
tcccggcactttgggaggcc

SEQ ID NO: 42018 - DNA, 20 bp, Artificial
  CRISPR gRNA sequence
cccggcactttgggaggccg

SEQ ID NO: 42019 - DNA, 20 bp, Artificial
  CRISPR gRNA sequence
ggcactttgggaggccgagg

SEQ ID NO: 42020 - DNA, 20 bp, Artificial
  CRISPR gRNA sequence
gcactttgggaggccgaggc

SEQ ID NO: 42021 - DNA, 20 bp, Artificial
  CRISPR gRNA sequence
ctttgggaggccgaggcggg

SEQ ID NO: 42022 - DNA, 20 bp, Artificial
  CRISPR gRNA sequence
ccgaggcgggcagatcacct

SEQ ID NO: 42023 - DNA, 20 bp, Artificial
  CRISPR gRNA sequence
cgaggcgggcagatcacctg

SEQ ID NO: 42024 - DNA, 20 bp, Artificial
  CRISPR gRNA sequence
gcgggcagatcacctgaggt

SEQ ID NO: 42025 - DNA, 20 bp, Artificial
  CRISPR gRNA sequence
cgggcagatcacctgaggtc

SEQ ID NO: 42026 - DNA, 20 bp, Artificial
  CRISPR gRNA sequence
ggcagatcacctgaggtcag

SEQ ID NO: 42027 - DNA, 20 bp, Artificial
  CRISPR gRNA sequence
tcacctgaggtcaggagttt

SEQ ID NO: 42028 - DNA, 20 bp, Artificial
  CRISPR gRNA sequence
tgaggtcaggagtttgagac

SEQ ID NO: 42029 - DNA, 20 bp, Artificial
  CRISPR gRNA sequence
tcaggagtttgagaccagcc

SEQ ID NO: 42030 - DNA, 20 bp, Artificial
  CRISPR gRNA sequence
tgagaccagcctggccaatg

SEQ ID NO: 42031 - DNA, 20 bp, Artificial
  CRISPR gRNA sequence
tctactaaaaatacaaaaat

SEQ ID NO: 42032 - DNA, 20 bp, Artificial
  CRISPR gRNA sequence
taaaaatacaaaaattagcc

SEQ ID NO: 42033 - DNA, 20 bp, Artificial
  CRISPR gRNA sequence
atacaaaaattagcccggtg

SEQ ID NO: 42034 - DNA, 20 bp, Artificial
  CRISPR gRNA sequence
caaaaattagcccggtgtgg

SEQ ID NO: 42035 - DNA, 20 bp, Artificial
  CRISPR gRNA sequence
aaattagcccggtgtggtgg

SEQ ID NO: 42036 - DNA, 20 bp, Artificial
  CRISPR gRNA sequence
aattagcccggtgtggtggt

SEQ ID NO: 42037 - DNA, 20 bp, Artificial
  CRISPR gRNA sequence
gtggtgggtgcctgtaattc

SEQ ID NO: 42038 - DNA, 20 bp, Artificial
  CRISPR gRNA sequence
tgcctgtaattccagctact

SEQ ID NO: 42039 - DNA, 20 bp, Artificial
  CRISPR gRNA sequence
gcctgtaattccagctactt

SEQ ID NO: 42040 - DNA, 20 bp, Artificial
  CRISPR gRNA sequence
ctgtaattccagctacttgg

SEQ ID NO: 42041 - DNA, 20 bp, Artificial
  CRISPR gRNA sequence
tgtaattccagctacttggg

SEQ ID NO: 42042 - DNA, 20 bp, Artificial
  CRISPR gRNA sequence
ttccagctacttgggaggct

SEQ ID NO: 42043 - DNA, 20 bp, Artificial
  CRISPR gRNA sequence
tccagctacttgggaggctg

SEQ ID NO: 42044 - DNA, 20 bp, Artificial
  CRISPR gRNA sequence
agctacttgggaggctgagg

SEQ ID NO: 42045 - DNA, 20 bp, Artificial
  CRISPR gRNA sequence
gctacttgggaggctgaggc

SEQ ID NO: 42046 - DNA, 20 bp, Artificial
  CRISPR gRNA sequence
tacttgggaggctgaggcag

SEQ ID NO: 42047 - DNA, 20 bp, Artificial
  CRISPR gRNA sequence
gcaggagaattgcttgaact

SEQ ID NO: 42048 - DNA, 20 bp, Artificial
  CRISPR gRNA sequence
caggagaattgcttgaactt

SEQ ID NO: 42049 - DNA, 20 bp, Artificial
  CRISPR gRNA sequence
ggagaattgcttgaacttgg

SEQ ID NO: 42050 - DNA, 20 bp, Artificial
  CRISPR gRNA sequence
gagaattgcttgaacttggg

SEQ ID NO: 42051 - DNA, 20 bp, Artificial
  CRISPR gRNA sequence
aattgcttgaacttgggagg

SEQ ID NO: 42052 - DNA, 20 bp, Artificial
  CRISPR gRNA sequence
ttgcttgaacttgggaggcg

SEQ ID NO: 42053 - DNA, 20 bp, Artificial
  CRISPR gRNA sequence
tgcttgaacttgggaggcgg

SEQ ID NO: 42054 - DNA, 20 bp, Artificial
  CRISPR gRNA sequence
aacttgggaggcggaggttg

SEQ ID NO: 42055 - DNA, 20 bp, Artificial
  CRISPR gRNA sequence
tgggaggcggaggttgcagt

SEQ ID NO: 42056 - DNA, 20 bp, Artificial
  CRISPR gRNA sequence
ggcggaggttgcagtgagcc

SEQ ID NO: 42057 - DNA, 20 bp, Artificial
  CRISPR gRNA sequence
gagatcgcgccattgcactc

SEQ ID NO: 42058 - DNA, 20 bp, Artificial
  CRISPR gRNA sequence
cgcgccattgcactccagct

SEQ ID NO: 42059 - DNA, 20 bp, Artificial
  CRISPR gRNA sequence
gcgccattgcactccagctt

SEQ ID NO: 42060 - DNA, 20 bp, Artificial
  CRISPR gRNA sequence
tgcactccagcttgggcgac

SEQ ID NO: 42061 - DNA, 20 bp, Artificial
  CRISPR gRNA sequence
cactccagcttgggcgacaa

SEQ ID NO: 42062 - DNA, 20 bp, Artificial
  CRISPR gRNA sequence
acaagagtgaaactccatct

SEQ ID NO: 42063 - DNA, 20 bp, Artificial
  CRISPR gRNA sequence
ctccatctcagaaaaaaaaa

SEQ ID NO: 42064 - DNA, 20 bp, Artificial
  CRISPR gRNA sequence
cagaaaaaaaaaaagaaaaa

SEQ ID NO: 42065 - DNA, 20 bp, Artificial
  CRISPR gRNA sequence
aaaaaaaagaaaaaaagaaa

SEQ ID NO: 42066 - DNA, 20 bp, Artificial
  CRISPR gRNA sequence
aaaagaaaaaaagaaaaaga

SEQ ID NO: 42067 - DNA, 20 bp, Artificial
  CRISPR gRNA sequence
aaaagaaaaagaaagaattt

SEQ ID NO: 42068 - DNA, 20 bp, Artificial
  CRISPR gRNA sequence
agaaaaagaaagaattttag

SEQ ID NO: 42069 - DNA, 20 bp, Artificial
  CRISPR gRNA sequence
gaaaaagaaagaattttaga

SEQ ID NO: 42070 - DNA, 20 bp, Artificial
  CRISPR gRNA sequence
ttagaaggatttactttaaa

SEQ ID NO: 42071 - DNA, 20 bp, Artificial
  CRISPR gRNA sequence
atttactttaaacagtcttc

SEQ ID NO: 42072 - DNA, 20 bp, Artificial
  CRISPR gRNA sequence
tactttaaacagtcttctag

SEQ ID NO: 42073 - DNA, 20 bp, Artificial
  CRISPR gRNA sequence
tttaaacagtcttctagtgg

SEQ ID NO: 42074 - DNA, 20 bp, Artificial
  CRISPR gRNA sequence
ttaaacagtcttctagtggt

SEQ ID NO: 42075 - DNA, 20 bp, Artificial
  CRISPR gRNA sequence
aaacagtcttctagtggtgg

SEQ ID NO: 42076 - DNA, 20 bp, Artificial
  CRISPR gRNA sequence
aacagtcttctagtggtggg

SEQ ID NO: 42077 - DNA, 20 bp, Artificial
  CRISPR gRNA sequence
agtcttctagtggtgggagg

SEQ ID NO: 42078 - DNA, 20 bp, Artificial
  CRISPR gRNA sequence
gtcttctagtggtgggaggc

SEQ ID NO: 42079 - DNA, 20 bp, Artificial
  CRISPR gRNA sequence
tcttctagtggtgggaggcg

SEQ ID NO: 42080 - DNA, 20 bp, Artificial
  CRISPR gRNA sequence
tctagtggtgggaggcgggg

SEQ ID NO: 42081 - DNA, 20 bp, Artificial
  CRISPR gRNA sequence
ctagtggtgggaggcggggt

SEQ ID NO: 42082 - DNA, 20 bp, Artificial
  CRISPR gRNA sequence
gtggtgggaggcggggtggg

SEQ ID NO: 42083 - DNA, 20 bp, Artificial
  CRISPR gRNA sequence
gtgggaggcggggtgggaag

SEQ ID NO: 42084 - DNA, 20 bp, Artificial
  CRISPR gRNA sequence
ggcggggtgggaagcagctg

SEQ ID NO: 42085 - DNA, 20 bp, Artificial
  CRISPR gRNA sequence
ggtgggaagcagctgcagct

SEQ ID NO: 42086 - DNA, 20 bp, Artificial
  CRISPR gRNA sequence
gcagctaagatgaaaaaata

SEQ ID NO: 42087 - DNA, 20 bp, Artificial
  CRISPR gRNA sequence
gctaagatgaaaaaatacag

SEQ ID NO: 42088 - DNA, 20 bp, Artificial
  CRISPR gRNA sequence
ctaagatgaaaaaatacagc

SEQ ID NO: 42089 - DNA, 20 bp, Artificial
  CRISPR gRNA sequence
gatgaaaaaatacagcagga

SEQ ID NO: 42090 - DNA, 20 bp, Artificial
  CRISPR gRNA sequence
aatcataatgttaataacat

SEQ ID NO: 42091 - DNA, 20 bp, Artificial
  CRISPR gRNA sequence
atgttaataacatcggtgca

SEQ ID NO: 42092 - DNA, 20 bp, Artificial
  CRISPR gRNA sequence
tgttaataacatcggtgcaa

SEQ ID NO: 42093 - DNA, 20 bp, Artificial
  CRISPR gRNA sequence
aataacatcggtgcaaaggc

SEQ ID NO: 42094 - DNA, 20 bp, Artificial
  CRISPR gRNA sequence
ataacatcggtgcaaaggct

SEQ ID NO: 42095 - DNA, 20 bp, Artificial
  CRISPR gRNA sequence
taacatcggtgcaaaggctg

SEQ ID NO: 42096 - DNA, 20 bp, Artificial
  CRISPR gRNA sequence
gtgcaaaggctggggctctc

SEQ ID NO: 42097 - DNA, 20 bp, Artificial
  CRISPR gRNA sequence
tgcaaaggctggggctctct

SEQ ID NO: 42098 - DNA, 20 bp, Artificial
  CRISPR gRNA sequence
tggggctctctgggatgtct

SEQ ID NO: 42099 - DNA, 20 bp, Artificial
  CRISPR gRNA sequence
gctctctgggatgtctaaga

SEQ ID NO: 42100 - DNA, 20 bp, Artificial
  CRISPR gRNA sequence
aagatggctcgcatcacctc

SEQ ID NO: 42101 - DNA, 20 bp, Artificial
  CRISPR gRNA sequence
agatggctcgcatcacctcc

SEQ ID NO: 42102 - DNA, 20 bp, Artificial
  CRISPR gRNA sequence
tccaggatctcgcttatgct

SEQ ID NO: 42103 - DNA, 20 bp, Artificial
  CRISPR gRNA sequence
ccaggatctcgcttatgctt

SEQ ID NO: 42104 - DNA, 20 bp, Artificial
  CRISPR gRNA sequence
gcttatgcttgggttttatc

SEQ ID NO: 42105 - DNA, 20 bp, Artificial
  CRISPR gRNA sequence
cttatgcttgggttttatct

SEQ ID NO: 42106 - DNA, 20 bp, Artificial
  CRISPR gRNA sequence
tatgcttgggttttatctgg

SEQ ID NO: 42107 - DNA, 20 bp, Artificial
  CRISPR gRNA sequence
atgcttgggttttatctggg

SEQ ID NO: 42108 - DNA, 20 bp, Artificial
  CRISPR gRNA sequence
tgcttgggttttatctggga

SEQ ID NO: 42109 - DNA, 20 bp, Artificial
  CRISPR gRNA sequence
cttgggttttatctgggagg

SEQ ID NO: 42110 - DNA, 20 bp, Artificial
  CRISPR gRNA sequence
ttgggttttatctgggaggg

SEQ ID NO: 42111 - DNA, 20 bp, Artificial
  CRISPR gRNA sequence
tgggttttatctgggaggga

SEQ ID NO: 42112 - DNA, 20 bp, Artificial
  CRISPR gRNA sequence
ggttttatctgggagggagg

SEQ ID NO: 42113 - DNA, 20 bp, Artificial
  CRISPR gRNA sequence
gttttatctgggagggaggg

SEQ ID NO: 42114 - DNA, 20 bp, Artificial
  CRISPR gRNA sequence
tttatctgggagggagggag

SEQ ID NO: 42115 - DNA, 20 bp, Artificial
  CRISPR gRNA sequence
gaggagacgtgacaacattc

SEQ ID NO: 42116 - DNA, 20 bp, Artificial
  CRISPR gRNA sequence
aggagacgtgacaacattcc

SEQ ID NO: 42117 - DNA, 20 bp, Artificial
  CRISPR gRNA sequence
ggagacgtgacaacattcca

SEQ ID NO: 42118 - DNA, 20 bp, Artificial
  CRISPR gRNA sequence
gagacgtgacaacattccag

SEQ ID NO: 42119 - DNA, 20 bp, Artificial
  CRISPR gRNA sequence
cgtgacaacattccaggggc

SEQ ID NO: 42120 - DNA, 20 bp, Artificial
  CRISPR gRNA sequence
caacattccaggggcaagta

SEQ ID NO: 42121 - DNA, 20 bp, Artificial
  CRISPR gRNA sequence
ttccaggggcaagtacagcc

SEQ ID NO: 42122 - DNA, 20 bp, Artificial
  CRISPR gRNA sequence
ggcaagtacagcccagctca

SEQ ID NO: 42123 - DNA, 20 bp, Artificial
  CRISPR gRNA sequence
gcccagctcacagcacccca

SEQ ID NO: 42124 - DNA, 20 bp, Artificial
  CRISPR gRNA sequence
caccccatggcaccctgtaa

SEQ ID NO: 42125 - DNA, 20 bp, Artificial
  CRISPR gRNA sequence
tgtaatagtcccaccctgcc

SEQ ID NO: 42126 - DNA, 20 bp, Artificial
  CRISPR gRNA sequence
taatagtcccaccctgcccg

SEQ ID NO: 42127 - DNA, 20 bp, Artificial
  CRISPR gRNA sequence
ccaccctgcccggagataat

SEQ ID NO: 42128 - DNA, 20 bp, Artificial
  CRISPR gRNA sequence
cctgcccggagataatgagt

SEQ ID NO: 42129 - DNA, 20 bp, Artificial
  CRISPR gRNA sequence
cccggagataatgagtcaga

SEQ ID NO: 42130 - DNA, 20 bp, Artificial
  CRISPR gRNA sequence
ccggagataatgagtcagaa

SEQ ID NO: 42131 - DNA, 20 bp, Artificial
  CRISPR gRNA sequence
tgagtcagaaaggactcctt

SEQ ID NO: 42132 - DNA, 20 bp, Artificial
  CRISPR gRNA sequence
aaggactcctttggacataa

SEQ ID NO: 42133 - DNA, 20 bp, Artificial
  CRISPR gRNA sequence
aggactcctttggacataaa

SEQ ID NO: 42134 - DNA, 20 bp, Artificial
  CRISPR gRNA sequence
actcctttggacataaaagg

SEQ ID NO: 42135 - DNA, 20 bp, Artificial
  CRISPR gRNA sequence
cctttggacataaaaggtgg

SEQ ID NO: 42136 - DNA, 20 bp, Artificial
  CRISPR gRNA sequence
ctttggacataaaaggtggc

SEQ ID NO: 42137 - DNA, 20 bp, Artificial
  CRISPR gRNA sequence
ggtggcaggttaaaattgaa

SEQ ID NO: 42138 - DNA, 20 bp, Artificial
  CRISPR gRNA sequence
gtggcaggttaaaattgaac

SEQ ID NO: 42139 - DNA, 20 bp, Artificial
  CRISPR gRNA sequence
caggttaaaattgaacaggt

SEQ ID NO: 42140 - DNA, 20 bp, Artificial
  CRISPR gRNA sequence
attgaacaggttggaaacct

SEQ ID NO: 42141 - DNA, 20 bp, Artificial
  CRISPR gRNA sequence
acaggttggaaacctcagac

SEQ ID NO: 42142 - DNA, 20 bp, Artificial
  CRISPR gRNA sequence
aggttggaaacctcagaccg

SEQ ID NO: 42143 - DNA, 20 bp, Artificial
  CRISPR gRNA sequence
gttggaaacctcagaccgga

SEQ ID NO: 42144 - DNA, 20 bp, Artificial
  CRISPR gRNA sequence
ttggaaacctcagaccggag

SEQ ID NO: 42145 - DNA, 20 bp, Artificial
  CRISPR gRNA sequence
ttctctttgcctaaatcaca

SEQ ID NO: 42146 - DNA, 20 bp, Artificial
  CRISPR gRNA sequence
cctgactcctcgtccgcctt

SEQ ID NO: 42147 - DNA, 20 bp, Artificial
  CRISPR gRNA sequence
tgactcctcgtccgcctttg

SEQ ID NO: 42148 - DNA, 20 bp, Artificial
  CRISPR gRNA sequence
ctcctcgtccgcctttggag

SEQ ID NO: 42149 - DNA, 20 bp, Artificial
  CRISPR gRNA sequence
cgtccgcctttggagtggcg

SEQ ID NO: 42150 - DNA, 20 bp, Artificial
  CRISPR gRNA sequence
cgcctttggagtggcgtggc

SEQ ID NO: 42151 - DNA, 20 bp, Artificial
  CRISPR gRNA sequence
tggccagcctgaccccttgc

SEQ ID NO: 42152 - DNA, 20 bp, Artificial
  CRISPR gRNA sequence
ggccagcctgaccccttgcc

SEQ ID NO: 42153 - DNA, 20 bp, Artificial
  CRISPR gRNA sequence
gccagcctgaccccttgcca

SEQ ID NO: 42154 - DNA, 20 bp, Artificial
  CRISPR gRNA sequence
ttgccagggtttaaactttg

SEQ ID NO: 42155 - DNA, 20 bp, Artificial
  CRISPR gRNA sequence
actttgtagtactcaacgtg

SEQ ID NO: 42156 - DNA, 20 bp, Artificial
  CRISPR gRNA sequence
tactcaacgtgtagtgcttg

SEQ ID NO: 42157 - DNA, 20 bp, Artificial
  CRISPR gRNA sequence
tagtgcttgtggccctactg

SEQ ID NO: 42158 - DNA, 20 bp, Artificial
  CRISPR gRNA sequence
agtgcttgtggccctactgt

SEQ ID NO: 42159 - DNA, 20 bp, Artificial
  CRISPR gRNA sequence
cttgtggccctactgtgggc

SEQ ID NO: 42160 - DNA, 20 bp, Artificial
  CRISPR gRNA sequence
ttgtggccctactgtgggcc

SEQ ID NO: 42161 - DNA, 20 bp, Artificial
  CRISPR gRNA sequence
ccaggcattgtgtgacgaca

SEQ ID NO: 42162 - DNA, 20 bp, Artificial
  CRISPR gRNA sequence
ggcattgtgtgacgacacag

SEQ ID NO: 42163 - DNA, 20 bp, Artificial
  CRISPR gRNA sequence
gtgtgacgacacagcagaaa

SEQ ID NO: 42164 - DNA, 20 bp, Artificial
  CRISPR gRNA sequence
tgaccatgtccttatcttct

SEQ ID NO: 42165 - DNA, 20 bp, Artificial
  CRISPR gRNA sequence
accatgtccttatcttcttg

SEQ ID NO: 42166 - DNA, 20 bp, Artificial
  CRISPR gRNA sequence
tcttggagctcctcttacaa

SEQ ID NO: 42167 - DNA, 20 bp, Artificial
  CRISPR gRNA sequence
tggagctcctcttacaatag

SEQ ID NO: 42168 - DNA, 20 bp, Artificial
  CRISPR gRNA sequence
ggagctcctcttacaatagt

SEQ ID NO: 42169 - DNA, 20 bp, Artificial
  CRISPR gRNA sequence
agctcctcttacaatagtgg

SEQ ID NO: 42170 - DNA, 20 bp, Artificial
  CRISPR gRNA sequence
aatagtgggagctgaaaaat

SEQ ID NO: 42171 - DNA, 20 bp, Artificial
  CRISPR gRNA sequence
tgggagctgaaaaataagta

SEQ ID NO: 42172 - DNA, 20 bp, Artificial
  CRISPR gRNA sequence
taagtaaagtaaaatcaaat

SEQ ID NO: 42173 - DNA, 20 bp, Artificial
  CRISPR gRNA sequence
aaaatcaaataagatgaact

SEQ ID NO: 42174 - DNA, 20 bp, Artificial
  CRISPR gRNA sequence
tcaaataagatgaacttagc

SEQ ID NO: 42175 - DNA, 20 bp, Artificial
  CRISPR gRNA sequence
agatgaacttagccagtgat

SEQ ID NO: 42176 - DNA, 20 bp, Artificial
  CRISPR gRNA sequence
atgaacttagccagtgataa

SEQ ID NO: 42177 - DNA, 20 bp, Artificial
  CRISPR gRNA sequence
cagtgataagagaattttct

SEQ ID NO: 42178 - DNA, 20 bp, Artificial
  CRISPR gRNA sequence
agtgataagagaattttctc

SEQ ID NO: 42179 - DNA, 20 bp, Artificial
  CRISPR gRNA sequence
aagagaattttctcgggatg

SEQ ID NO: 42180 - DNA, 20 bp, Artificial
  CRISPR gRNA sequence
aattttctcgggatgtggtg

SEQ ID NO: 42181 - DNA, 20 bp, Artificial
  CRISPR gRNA sequence
ttttctcgggatgtggtgaa

SEQ ID NO: 42182 - DNA, 20 bp, Artificial
  CRISPR gRNA sequence
tctcgggatgtggtgaagag

SEQ ID NO: 42183 - DNA, 20 bp, Artificial
  CRISPR gRNA sequence
gggatgtggtgaagagtggc

SEQ ID NO: 42184 - DNA, 20 bp, Artificial
  CRISPR gRNA sequence
gatgtggtgaagagtggctg

SEQ ID NO: 42185 - DNA, 20 bp, Artificial
  CRISPR gRNA sequence
tgtggtgaagagtggctgga

SEQ ID NO: 42186 - DNA, 20 bp, Artificial
  CRISPR gRNA sequence
gtggtgaagagtggctggag

SEQ ID NO: 42187 - DNA, 20 bp, Artificial
  CRISPR gRNA sequence
gagtggctggagaggtgatt

SEQ ID NO: 42188 - DNA, 20 bp, Artificial
  CRISPR gRNA sequence
ctggagaggtgatttagatg

SEQ ID NO: 42189 - DNA, 20 bp, Artificial
  CRISPR gRNA sequence
gagaggtgatttagatgtgg

SEQ ID NO: 42190 - DNA, 20 bp, Artificial
  CRISPR gRNA sequence
aggtgatttagatgtggcag

SEQ ID NO: 42191 - DNA, 20 bp, Artificial
  CRISPR gRNA sequence
ttagatgtggcagaagccat

SEQ ID NO: 42192 - DNA, 20 bp, Artificial
  CRISPR gRNA sequence
tagatgtggcagaagccatc

SEQ ID NO: 42193 - DNA, 20 bp, Artificial
  CRISPR gRNA sequence
agatgtggcagaagccatca

SEQ ID NO: 42194 - DNA, 20 bp, Artificial
  CRISPR gRNA sequence
agccatcagggaacatctct

SEQ ID NO: 42195 - DNA, 20 bp, Artificial
  CRISPR gRNA sequence
gccatcagggaacatctctg

SEQ ID NO: 42196 - DNA, 20 bp, Artificial
  CRISPR gRNA sequence
catcagggaacatctctgag

SEQ ID NO: 42197 - DNA, 20 bp, Artificial
  CRISPR gRNA sequence
atcagggaacatctctgagg

SEQ ID NO: 42198 - DNA, 20 bp, Artificial
  CRISPR gRNA sequence
tcagggaacatctctgagga

SEQ ID NO: 42199 - DNA, 20 bp, Artificial
  CRISPR gRNA sequence
catctctgaggagggatgct

SEQ ID NO: 42200 - DNA, 20 bp, Artificial
  CRISPR gRNA sequence
tctgaggagggatgctgagc

SEQ ID NO: 42201 - DNA, 20 bp, Artificial
  CRISPR gRNA sequence
ctgaggagggatgctgagct

SEQ ID NO: 42202 - DNA, 20 bp, Artificial
  CRISPR gRNA sequence
ggatgctgagctgggaccta

SEQ ID NO: 42203 - DNA, 20 bp, Artificial
  CRISPR gRNA sequence
gatgctgagctgggacctaa

SEQ ID NO: 42204 - DNA, 20 bp, Artificial
  CRISPR gRNA sequence
gctgagctgggacctaaagg

SEQ ID NO: 42205 - DNA, 20 bp, Artificial
  CRISPR gRNA sequence
tgagctgggacctaaaggaa

SEQ ID NO: 42206 - DNA, 20 bp, Artificial
  CRISPR gRNA sequence
agctgggacctaaaggaaga

SEQ ID NO: 42207 - DNA, 20 bp, Artificial
  CRISPR gRNA sequence
ctgggacctaaaggaagaga

SEQ ID NO: 42208 - DNA, 20 bp, Artificial
  CRISPR gRNA sequence
gggacctaaaggaagagaga

SEQ ID NO: 42209 - DNA, 20 bp, Artificial
  CRISPR gRNA sequence
gagagagagctcgccttgtg

SEQ ID NO: 42210 - DNA, 20 bp, Artificial
  CRISPR gRNA sequence
gagagagctcgccttgtgaa

SEQ ID NO: 42211 - DNA, 20 bp, Artificial
  CRISPR gRNA sequence
agagctcgccttgtgaagag

SEQ ID NO: 42212 - DNA, 20 bp, Artificial
  CRISPR gRNA sequence
gagctcgccttgtgaagagc

SEQ ID NO: 42213 - DNA, 20 bp, Artificial
  CRISPR gRNA sequence
agctcgccttgtgaagagca

SEQ ID NO: 42214 - DNA, 20 bp, Artificial
  CRISPR gRNA sequence
aagagcagggaactgcattc

SEQ ID NO: 42215 - DNA, 20 bp, Artificial
  CRISPR gRNA sequence
agagcagggaactgcattcc

SEQ ID NO: 42216 - DNA, 20 bp, Artificial
  CRISPR gRNA sequence
gcagggaactgcattccagg

SEQ ID NO: 42217 - DNA, 20 bp, Artificial
  CRISPR gRNA sequence
agggaactgcattccaggca

SEQ ID NO: 42218 - DNA, 20 bp, Artificial
  CRISPR gRNA sequence
gggaactgcattccaggcag

SEQ ID NO: 42219 - DNA, 20 bp, Artificial
  CRISPR gRNA sequence
ggaactgcattccaggcaga

SEQ ID NO: 42220 - DNA, 20 bp, Artificial
  CRISPR gRNA sequence
tgcattccaggcagagggaa

SEQ ID NO: 42221 - DNA, 20 bp, Artificial
  CRISPR gRNA sequence
gcagagggaacggcatgtgt

SEQ ID NO: 42222 - DNA, 20 bp, Artificial
  CRISPR gRNA sequence
cagagggaacggcatgtgtg

SEQ ID NO: 42223 - DNA, 20 bp, Artificial
  CRISPR gRNA sequence
aacggcatgtgtgaggccct

SEQ ID NO: 42224 - DNA, 20 bp, Artificial
  CRISPR gRNA sequence
acggcatgtgtgaggccctg

SEQ ID NO: 42225 - DNA, 20 bp, Artificial
  CRISPR gRNA sequence
tgaggccctgaggcatgatt

SEQ ID NO: 42226 - DNA, 20 bp, Artificial
  CRISPR gRNA sequence
ccctgaggcatgattaagct

SEQ ID NO: 42227 - DNA, 20 bp, Artificial
  CRISPR gRNA sequence
tgaggcatgattaagcttgg

SEQ ID NO: 42228 - DNA, 20 bp, Artificial
  CRISPR gRNA sequence
gaggcatgattaagcttggt

SEQ ID NO: 42229 - DNA, 20 bp, Artificial
  CRISPR gRNA sequence
tgattaagcttggtgggctc

SEQ ID NO: 42230 - DNA, 20 bp, Artificial
  CRISPR gRNA sequence
gattaagcttggtgggctcc

SEQ ID NO: 42231 - DNA, 20 bp, Artificial
  CRISPR gRNA sequence
agcttggtgggctccaggaa

SEQ ID NO: 42232 - DNA, 20 bp, Artificial
  CRISPR gRNA sequence
ggtgggctccaggaacagcg

SEQ ID NO: 42233 - DNA, 20 bp, Artificial
  CRISPR gRNA sequence
tccaggaacagcgcggaacc

SEQ ID NO: 42234 - DNA, 20 bp, Artificial
  CRISPR gRNA sequence
ggaacagcgcggaaccgaga

SEQ ID NO: 42235 - DNA, 20 bp, Artificial
  CRISPR gRNA sequence
cagcgcggaaccgagacagc

SEQ ID NO: 42236 - DNA, 20 bp, Artificial
  CRISPR gRNA sequence
gcgcggaaccgagacagcca

SEQ ID NO: 42237 - DNA, 20 bp, Artificial
  CRISPR gRNA sequence
gaaccgagacagccagagca

SEQ ID NO: 42238 - DNA, 20 bp, Artificial
  CRISPR gRNA sequence
gacagccagagcacagtgac

SEQ ID NO: 42239 - DNA, 20 bp, Artificial
  CRISPR gRNA sequence
agccagagcacagtgactgg

SEQ ID NO: 42240 - DNA, 20 bp, Artificial
  CRISPR gRNA sequence
gccagagcacagtgactggc

SEQ ID NO: 42241 - DNA, 20 bp, Artificial
  CRISPR gRNA sequence
ccagagcacagtgactggca

SEQ ID NO: 42242 - DNA, 20 bp, Artificial
  CRISPR gRNA sequence
agcacagtgactggcaggga

SEQ ID NO: 42243 - DNA, 20 bp, Artificial
  CRISPR gRNA sequence
gtgactggcagggacagtcc

SEQ ID NO: 42244 - DNA, 20 bp, Artificial
  CRISPR gRNA sequence
tgactggcagggacagtcct

SEQ ID NO: 42245 - DNA, 20 bp, Artificial
  CRISPR gRNA sequence
actggcagggacagtcctag

SEQ ID NO: 42246 - DNA, 20 bp, Artificial
  CRISPR gRNA sequence
tggcagggacagtcctagga

SEQ ID NO: 42247 - DNA, 20 bp, Artificial
  CRISPR gRNA sequence
ggcagggacagtcctaggag

SEQ ID NO: 42248 - DNA, 20 bp, Artificial
  CRISPR gRNA sequence
cagggacagtcctaggagag

SEQ ID NO: 42249 - DNA, 20 bp, Artificial
  CRISPR gRNA sequence
agggacagtcctaggagagg

SEQ ID NO: 42250 - DNA, 20 bp, Artificial
  CRISPR gRNA sequence
gacagtcctaggagaggagg

SEQ ID NO: 42251 - DNA, 20 bp, Artificial
  CRISPR gRNA sequence
cagtcctaggagaggaggaa

SEQ ID NO: 42252 - DNA, 20 bp, Artificial
  CRISPR gRNA sequence
gtcctaggagaggaggaaga

SEQ ID NO: 42253 - DNA, 20 bp, Artificial
  CRISPR gRNA sequence
cctaggagaggaggaagaga

SEQ ID NO: 42254 - DNA, 20 bp, Artificial
  CRISPR gRNA sequence
ggagaggaggaagagagaga

SEQ ID NO: 42255 - DNA, 20 bp, Artificial
  CRISPR gRNA sequence
gagaggaggaagagagagat

SEQ ID NO: 42256 - DNA, 20 bp, Artificial
  CRISPR gRNA sequence
gaggaagagagagatgggct

SEQ ID NO: 42257 - DNA, 20 bp, Artificial
  CRISPR gRNA sequence
aggaagagagagatgggctc

SEQ ID NO: 42258 - DNA, 20 bp, Artificial
  CRISPR gRNA sequence
agagagagatgggctcgggt

SEQ ID NO: 42259 - DNA, 20 bp, Artificial
  CRISPR gRNA sequence
gagagagatgggctcgggtt

SEQ ID NO: 42260 - DNA, 20 bp, Artificial
  CRISPR gRNA sequence
tgggctcgggttgggttgca

SEQ ID NO: 42261 - DNA, 20 bp, Artificial
  CRISPR gRNA sequence
gggctcgggttgggttgcat

SEQ ID NO: 42262 - DNA, 20 bp, Artificial
  CRISPR gRNA sequence
ggctcgggttgggttgcatg

SEQ ID NO: 42263 - DNA, 20 bp, Artificial
  CRISPR gRNA sequence
gggttgggttgcatggggcc

SEQ ID NO: 42264 - DNA, 20 bp, Artificial
  CRISPR gRNA sequence
tgcatggggcctggcaccca

SEQ ID NO: 42265 - DNA, 20 bp, Artificial
  CRISPR gRNA sequence
gcatggggcctggcacccat

SEQ ID NO: 42266 - DNA, 20 bp, Artificial
  CRISPR gRNA sequence
catggggcctggcacccatg

SEQ ID NO: 42267 - DNA, 20 bp, Artificial
  CRISPR gRNA sequence
tggggcctggcacccatggg

SEQ ID NO: 42268 - DNA, 20 bp, Artificial
  CRISPR gRNA sequence
gggcctggcacccatgggga

SEQ ID NO: 42269 - DNA, 20 bp, Artificial
  CRISPR gRNA sequence
tggcacccatggggagagtt

SEQ ID NO: 42270 - DNA, 20 bp, Artificial
  CRISPR gRNA sequence
agagtttagacttttgttcc

SEQ ID NO: 42271 - DNA, 20 bp, Artificial
  CRISPR gRNA sequence
gagtttagacttttgttcct

SEQ ID NO: 42272 - DNA, 20 bp, Artificial
  CRISPR gRNA sequence
ttttgttcctgggaacatga

SEQ ID NO: 42273 - DNA, 20 bp, Artificial
  CRISPR gRNA sequence
tttgttcctgggaacatgaa

SEQ ID NO: 42274 - DNA, 20 bp, Artificial
  CRISPR gRNA sequence
ttgttcctgggaacatgaaa

SEQ ID NO: 42275 - DNA, 20 bp, Artificial
  CRISPR gRNA sequence
gttcctgggaacatgaaagg

SEQ ID NO: 42276 - DNA, 20 bp, Artificial
  CRISPR gRNA sequence
tcctgggaacatgaaaggga

SEQ ID NO: 42277 - DNA, 20 bp, Artificial
  CRISPR gRNA sequence
cctgggaacatgaaagggag

SEQ ID NO: 42278 - DNA, 20 bp, Artificial
  CRISPR gRNA sequence
tgaaagggagaggaataatt

SEQ ID NO: 42279 - DNA, 20 bp, Artificial
  CRISPR gRNA sequence
gaaagggagaggaataattt

SEQ ID NO: 42280 - DNA, 20 bp, Artificial
  CRISPR gRNA sequence
ttttctttctttcttttttg

SEQ ID NO: 42281 - DNA, 20 bp, Artificial
  CRISPR gRNA sequence
tttctttctttcttttttgt

SEQ ID NO: 42282 - DNA, 20 bp, Artificial
  CRISPR gRNA sequence
ttctttctttcttttttgtg

SEQ ID NO: 42283 - DNA, 20 bp, Artificial
  CRISPR gRNA sequence
tctttctttcttttttgtgg

SEQ ID NO: 42284 - DNA, 20 bp, Artificial
  CRISPR gRNA sequence
tttctttcttttttgtgggg

SEQ ID NO: 42285 - DNA, 20 bp, Artificial
  CRISPR gRNA sequence
ttctttcttttttgtggggg

SEQ ID NO: 42286 - DNA, 20 bp, Artificial
  CRISPR gRNA sequence
tctttcttttttgtggggga

SEQ ID NO: 42287 - DNA, 20 bp, Artificial
  CRISPR gRNA sequence
gagggtctcgctctgtcaca

SEQ ID NO: 42288 - DNA, 20 bp, Artificial
  CRISPR gRNA sequence
agggtctcgctctgtcacac

SEQ ID NO: 42289 - DNA, 20 bp, Artificial
  CRISPR gRNA sequence
tctcgctctgtcacacaggc

SEQ ID NO: 42290 - DNA, 20 bp, Artificial
  CRISPR gRNA sequence
tcgctctgtcacacaggctg

SEQ ID NO: 42291 - DNA, 20 bp, Artificial
  CRISPR gRNA sequence
tcacacaggctggagtgcaa

SEQ ID NO: 42292 - DNA, 20 bp, Artificial
  CRISPR gRNA sequence
ggagtgcaatggcgcaatct

SEQ ID NO: 42293 - DNA, 20 bp, Artificial
  CRISPR gRNA sequence
tcactgcaacctccgcctcc

SEQ ID NO: 42294 - DNA, 20 bp, Artificial
  CRISPR gRNA sequence
cactgcaacctccgcctccc

SEQ ID NO: 42295 - DNA, 20 bp, Artificial
  CRISPR gRNA sequence
caacctccgcctcccaggtt

SEQ ID NO: 42296 - DNA, 20 bp, Artificial
  CRISPR gRNA sequence
aacctccgcctcccaggttc

SEQ ID NO: 42297 - DNA, 20 bp, Artificial
  CRISPR gRNA sequence
ttcaggcaattcttgtgcct

SEQ ID NO: 42298 - DNA, 20 bp, Artificial
  CRISPR gRNA sequence
ttcttgtgcctcagcctccc

SEQ ID NO: 42299 - DNA, 20 bp, Artificial
  CRISPR gRNA sequence
ttgtgcctcagcctcccaag

SEQ ID NO: 42300 - DNA, 20 bp, Artificial
  CRISPR gRNA sequence
gcctcagcctcccaagtagc

SEQ ID NO: 42301 - DNA, 20 bp, Artificial
  CRISPR gRNA sequence
cctcagcctcccaagtagct

SEQ ID NO: 42302 - DNA, 20 bp, Artificial
  CRISPR gRNA sequence
ctcccaagtagctgggatta

SEQ ID NO: 42303 - DNA, 20 bp, Artificial
  CRISPR gRNA sequence
tcccaagtagctgggattac

SEQ ID NO: 42304 - DNA, 20 bp, Artificial
  CRISPR gRNA sequence
caggcgtgcaccatcatgcc

SEQ ID NO: 42305 - DNA, 20 bp, Artificial
  CRISPR gRNA sequence
ccagctaatttttgtatttt

SEQ ID NO: 42306 - DNA, 20 bp, Artificial
  CRISPR gRNA sequence
gctaatttttgtatttttag

SEQ ID NO: 42307 - DNA, 20 bp, Artificial
  CRISPR gRNA sequence
taatttttgtatttttagta

SEQ ID NO: 42308 - DNA, 20 bp, Artificial
  CRISPR gRNA sequence
ttttgtatttttagtagaga

SEQ ID NO: 42309 - DNA, 20 bp, Artificial
  CRISPR gRNA sequence
ttgtatttttagtagagaca

SEQ ID NO: 42310 - DNA, 20 bp, Artificial
  CRISPR gRNA sequence
tttaaccatgttgaccatgc

SEQ ID NO: 42311 - DNA, 20 bp, Artificial
  CRISPR gRNA sequence
ggtctcaaactcccgacctc

SEQ ID NO: 42312 - DNA, 20 bp, Artificial
  CRISPR gRNA sequence
ctcaagtgatccgcccgcct

SEQ ID NO: 42313 - DNA, 20 bp, Artificial
  CRISPR gRNA sequence
ccgcccgcctcggcttccca

SEQ ID NO: 42314 - DNA, 20 bp, Artificial
  CRISPR gRNA sequence
cctcggcttcccaaagtact

SEQ ID NO: 42315 - DNA, 20 bp, Artificial
  CRISPR gRNA sequence
ttcccaaagtactgagatta

SEQ ID NO: 42316 - DNA, 20 bp, Artificial
  CRISPR gRNA sequence
tcccaaagtactgagattac

SEQ ID NO: 42317 - DNA, 20 bp, Artificial
  CRISPR gRNA sequence
caaagtactgagattacagg

SEQ ID NO: 42318 - DNA, 20 bp, Artificial
  CRISPR gRNA sequence
aaagtactgagattacaggc

SEQ ID NO: 42319 - DNA, 20 bp, Artificial
  CRISPR gRNA sequence
agtactgagattacaggcag

SEQ ID NO: 42320 - DNA, 20 bp, Artificial
  CRISPR gRNA sequence
cactgcacccgttcctcatt

SEQ ID NO: 42321 - DNA, 20 bp, Artificial
  CRISPR gRNA sequence
actgcacccgttcctcattt

SEQ ID NO: 42322 - DNA, 20 bp, Artificial
  CRISPR gRNA sequence
ttcctcatttgggttttcaa

SEQ ID NO: 42323 - DNA, 20 bp, Artificial
  CRISPR gRNA sequence
catttgggttttcaaaagtt

SEQ ID NO: 42324 - DNA, 20 bp, Artificial
  CRISPR gRNA sequence
ggttttcaaaagttcagact

SEQ ID NO: 42325 - DNA, 20 bp, Artificial
  CRISPR gRNA sequence
caaaagttcagactgagtgc

SEQ ID NO: 42326 - DNA, 20 bp, Artificial
  CRISPR gRNA sequence
aaaagttcagactgagtgct

SEQ ID NO: 42327 - DNA, 20 bp, Artificial
  CRISPR gRNA sequence
agttcagactgagtgctggg

SEQ ID NO: 42328 - DNA, 20 bp, Artificial
  CRISPR gRNA sequence
ttcagactgagtgctgggta

SEQ ID NO: 42329 - DNA, 20 bp, Artificial
  CRISPR gRNA sequence
actgagtgctgggtagagaa

SEQ ID NO: 42330 - DNA, 20 bp, Artificial
  CRISPR gRNA sequence
gtgctgggtagagaatggat

SEQ ID NO: 42331 - DNA, 20 bp, Artificial
  CRISPR gRNA sequence
tgctgggtagagaatggatt

SEQ ID NO: 42332 - DNA, 20 bp, Artificial
  CRISPR gRNA sequence
ctgggtagagaatggattgg

SEQ ID NO: 42333 - DNA, 20 bp, Artificial
  CRISPR gRNA sequence
gagaatggattgggagatac

SEQ ID NO: 42334 - DNA, 20 bp, Artificial
  CRISPR gRNA sequence
aatggattgggagatacgag

SEQ ID NO: 42335 - DNA, 20 bp, Artificial
  CRISPR gRNA sequence
tgggagatacgagtggaaat

SEQ ID NO: 42336 - DNA, 20 bp, Artificial
  CRISPR gRNA sequence
ggagatacgagtggaaatga

SEQ ID NO: 42337 - DNA, 20 bp, Artificial
  CRISPR gRNA sequence
gatacgagtggaaatgagag

SEQ ID NO: 42338 - DNA, 20 bp, Artificial
  CRISPR gRNA sequence
atacgagtggaaatgagagt

SEQ ID NO: 42339 - DNA, 20 bp, Artificial
  CRISPR gRNA sequence
cgagtggaaatgagagtggg

SEQ ID NO: 42340 - DNA, 20 bp, Artificial
  CRISPR gRNA sequence
agtggaaatgagagtgggaa

SEQ ID NO: 42341 - DNA, 20 bp, Artificial
  CRISPR gRNA sequence
agagtgggaagagatgtgtg

SEQ ID NO: 42342 - DNA, 20 bp, Artificial
  CRISPR gRNA sequence
gtgggaagagatgtgtgcag

SEQ ID NO: 42343 - DNA, 20 bp, Artificial
  CRISPR gRNA sequence
tgggaagagatgtgtgcagc

SEQ ID NO: 42344 - DNA, 20 bp, Artificial
  CRISPR gRNA sequence
gggaagagatgtgtgcagca

SEQ ID NO: 42345 - DNA, 20 bp, Artificial
  CRISPR gRNA sequence
gagatgtgtgcagcagggtg

SEQ ID NO: 42346 - DNA, 20 bp, Artificial
  CRISPR gRNA sequence
agatgtgtgcagcagggtga

SEQ ID NO: 42347 - DNA, 20 bp, Artificial
  CRISPR gRNA sequence
gatgtgtgcagcagggtgaa

SEQ ID NO: 42348 - DNA, 20 bp, Artificial
  CRISPR gRNA sequence
tgcagcagggtgaagggtgc

SEQ ID NO: 42349 - DNA, 20 bp, Artificial
  CRISPR gRNA sequence
gcagcagggtgaagggtgct

SEQ ID NO: 42350 - DNA, 20 bp, Artificial
  CRISPR gRNA sequence
cagcagggtgaagggtgctg

SEQ ID NO: 42351 - DNA, 20 bp, Artificial
  CRISPR gRNA sequence
agcagggtgaagggtgctgg

SEQ ID NO: 42352 - DNA, 20 bp, Artificial
  CRISPR gRNA sequence
tgctgggggctgatcactgc

SEQ ID NO: 42353 - DNA, 20 bp, Artificial
  CRISPR gRNA sequence
gctgggggctgatcactgct

SEQ ID NO: 42354 - DNA, 20 bp, Artificial
  CRISPR gRNA sequence
ctgggggctgatcactgctg

SEQ ID NO: 42355 - DNA, 20 bp, Artificial
  CRISPR gRNA sequence
ggggctgatcactgctgggg

SEQ ID NO: 42356 - DNA, 20 bp, Artificial
  CRISPR gRNA sequence
gggctgatcactgctggggt

SEQ ID NO: 42357 - DNA, 20 bp, Artificial
  CRISPR gRNA sequence
tgatcactgctggggtggga

SEQ ID NO: 42358 - DNA, 20 bp, Artificial
  CRISPR gRNA sequence
tcactgctggggtgggatag

SEQ ID NO: 42359 - DNA, 20 bp, Artificial
  CRISPR gRNA sequence
tgctggggtgggatagaagt

SEQ ID NO: 42360 - DNA, 20 bp, Artificial
  CRISPR gRNA sequence
tggggtgggatagaagttgg

SEQ ID NO: 42361 - DNA, 20 bp, Artificial
  CRISPR gRNA sequence
gggatagaagttggtagact

SEQ ID NO: 42362 - DNA, 20 bp, Artificial
  CRISPR gRNA sequence
ggatagaagttggtagactc

SEQ ID NO: 42363 - DNA, 20 bp, Artificial
  CRISPR gRNA sequence
gatagaagttggtagactca

SEQ ID NO: 42364 - DNA, 20 bp, Artificial
  CRISPR gRNA sequence
agaagttggtagactcaggg

SEQ ID NO: 42365 - DNA, 20 bp, Artificial
  CRISPR gRNA sequence
gtagactcagggtggatctt

SEQ ID NO: 42366 - DNA, 20 bp, Artificial
  CRISPR gRNA sequence
agactcagggtggatcttga

SEQ ID NO: 42367 - DNA, 20 bp, Artificial
  CRISPR gRNA sequence
ctcagggtggatcttgagag

SEQ ID NO: 42368 - DNA, 20 bp, Artificial
  CRISPR gRNA sequence
gatcttgagagtggaattta

SEQ ID NO: 42369 - DNA, 20 bp, Artificial
  CRISPR gRNA sequence
tgagagtggaatttacagac

SEQ ID NO: 42370 - DNA, 20 bp, Artificial
  CRISPR gRNA sequence
ggaatttacagacaagctga

SEQ ID NO: 42371 - DNA, 20 bp, Artificial
  CRISPR gRNA sequence
gaatttacagacaagctgat

SEQ ID NO: 42372 - DNA, 20 bp, Artificial
  CRISPR gRNA sequence
aatttacagacaagctgata

SEQ ID NO: 42373 - DNA, 20 bp, Artificial
  CRISPR gRNA sequence
atttacagacaagctgatag

SEQ ID NO: 42374 - DNA, 20 bp, Artificial
  CRISPR gRNA sequence
tttacagacaagctgatagg

SEQ ID NO: 42375 - DNA, 20 bp, Artificial
  CRISPR gRNA sequence
caagctgatagggggattac

SEQ ID NO: 42376 - DNA, 20 bp, Artificial
  CRISPR gRNA sequence
tgatagggggattactggat

SEQ ID NO: 42377 - DNA, 20 bp, Artificial
  CRISPR gRNA sequence
gatagggggattactggatg

SEQ ID NO: 42378 - DNA, 20 bp, Artificial
  CRISPR gRNA sequence
ggattactggatgaggcaaa

SEQ ID NO: 42379 - DNA, 20 bp, Artificial
  CRISPR gRNA sequence
attactggatgaggcaaatg

SEQ ID NO: 42380 - DNA, 20 bp, Artificial
  CRISPR gRNA sequence
ttactggatgaggcaaatgg

SEQ ID NO: 42381 - DNA, 20 bp, Artificial
  CRISPR gRNA sequence
atgaggcaaatggaggtgct

SEQ ID NO: 42382 - DNA, 20 bp, Artificial
  CRISPR gRNA sequence
tgaggcaaatggaggtgctg

SEQ ID NO: 42383 - DNA, 20 bp, Artificial
  CRISPR gRNA sequence
gaggtgctgaggctgcctct

SEQ ID NO: 42384 - DNA, 20 bp, Artificial
  CRISPR gRNA sequence
aggtgctgaggctgcctctg

SEQ ID NO: 42385 - DNA, 20 bp, Artificial
  CRISPR gRNA sequence
ggtgctgaggctgcctctga

SEQ ID NO: 42386 - DNA, 20 bp, Artificial
  CRISPR gRNA sequence
gctgaggctgcctctgaggg

SEQ ID NO: 42387 - DNA, 20 bp, Artificial
  CRISPR gRNA sequence
tgaggctgcctctgagggca

SEQ ID NO: 42388 - DNA, 20 bp, Artificial
  CRISPR gRNA sequence
ggctgcctctgagggcagag

SEQ ID NO: 42389 - DNA, 20 bp, Artificial
  CRISPR gRNA sequence
ggacccatctcactttctct

SEQ ID NO: 42390 - DNA, 20 bp, Artificial
  CRISPR gRNA sequence
gacccatctcactttctcta

SEQ ID NO: 42391 - DNA, 20 bp, Artificial
  CRISPR gRNA sequence
ccatctcactttctctaagg

SEQ ID NO: 42392 - DNA, 20 bp, Artificial
  CRISPR gRNA sequence
tctcactttctctaaggcag

SEQ ID NO: 42393 - DNA, 20 bp, Artificial
  CRISPR gRNA sequence
ctaaggcagtggtttccaac

SEQ ID NO: 42394 - DNA, 20 bp, Artificial
  CRISPR gRNA sequence
taaggcagtggtttccaact

SEQ ID NO: 42395 - DNA, 20 bp, Artificial
  CRISPR gRNA sequence
aaggcagtggtttccaactg

SEQ ID NO: 42396 - DNA, 20 bp, Artificial
  CRISPR gRNA sequence
aggcagtggtttccaactgg

SEQ ID NO: 42397 - DNA, 20 bp, Artificial
  CRISPR gRNA sequence
ctgggggtgattttcaccct

SEQ ID NO: 42398 - DNA, 20 bp, Artificial
  CRISPR gRNA sequence
tgggggtgattttcaccctt

SEQ ID NO: 42399 - DNA, 20 bp, Artificial
  CRISPR gRNA sequence
ggggtgattttcacccttgg

SEQ ID NO: 42400 - DNA, 20 bp, Artificial
  CRISPR gRNA sequence
tttcacccttgggagtcatt

SEQ ID NO: 42401 - DNA, 20 bp, Artificial
  CRISPR gRNA sequence
gggagtcatttggaaatatc

SEQ ID NO: 42402 - DNA, 20 bp, Artificial
  CRISPR gRNA sequence
gagtcatttggaaatatctg

SEQ ID NO: 42403 - DNA, 20 bp, Artificial
  CRISPR gRNA sequence
gaaatatctggagatatttt

SEQ ID NO: 42404 - DNA, 20 bp, Artificial
  CRISPR gRNA sequence
atatctggagatatttttgg

SEQ ID NO: 42405 - DNA, 20 bp, Artificial
  CRISPR gRNA sequence
atttttggtggtcatgactg

SEQ ID NO: 42406 - DNA, 20 bp, Artificial
  CRISPR gRNA sequence
tttttggtggtcatgactgc

SEQ ID NO: 42407 - DNA, 20 bp, Artificial
  CRISPR gRNA sequence
tggtggtcatgactgcgggt

SEQ ID NO: 42408 - DNA, 20 bp, Artificial
  CRISPR gRNA sequence
ggtggtcatgactgcgggtg

SEQ ID NO: 42409 - DNA, 20 bp, Artificial
  CRISPR gRNA sequence
gtggtcatgactgcgggtga

SEQ ID NO: 42410 - DNA, 20 bp, Artificial
  CRISPR gRNA sequence
tggtcatgactgcgggtgag

SEQ ID NO: 42411 - DNA, 20 bp, Artificial
  CRISPR gRNA sequence
cgggtgaggggtgctgctac

SEQ ID NO: 42412 - DNA, 20 bp, Artificial
  CRISPR gRNA sequence
tgctactggcatcgaatgaa

SEQ ID NO: 42413 - DNA, 20 bp, Artificial
  CRISPR gRNA sequence
ctactggcatcgaatgaata

SEQ ID NO: 42414 - DNA, 20 bp, Artificial
  CRISPR gRNA sequence
gcatcgaatgaatagagatc

SEQ ID NO: 42415 - DNA, 20 bp, Artificial
  CRISPR gRNA sequence
catcgaatgaatagagatct

SEQ ID NO: 42416 - DNA, 20 bp, Artificial
  CRISPR gRNA sequence
ggatgctgctgaacatccta

SEQ ID NO: 42417 - DNA, 20 bp, Artificial
  CRISPR gRNA sequence
gatgctgctgaacatcctat

SEQ ID NO: 42418 - DNA, 20 bp, Artificial
  CRISPR gRNA sequence
atgctgctgaacatcctata

SEQ ID NO: 42419 - DNA, 20 bp, Artificial
  CRISPR gRNA sequence
gctgaacatcctatagggca

SEQ ID NO: 42420 - DNA, 20 bp, Artificial
  CRISPR gRNA sequence
ctgaacatcctatagggcac

SEQ ID NO: 42421 - DNA, 20 bp, Artificial
  CRISPR gRNA sequence
gaacatcctatagggcacag

SEQ ID NO: 42422 - DNA, 20 bp, Artificial
  CRISPR gRNA sequence
acatcctatagggcacagga

SEQ ID NO: 42423 - DNA, 20 bp, Artificial
  CRISPR gRNA sequence
gcacaggagagcccacaaca

SEQ ID NO: 42424 - DNA, 20 bp, Artificial
  CRISPR gRNA sequence
agcccacaacaaagaattat

SEQ ID NO: 42425 - DNA, 20 bp, Artificial
  CRISPR gRNA sequence
tattggacctcacatctcaa

SEQ ID NO: 42426 - DNA, 20 bp, Artificial
  CRISPR gRNA sequence
cctcacatctcaatagtgct

SEQ ID NO: 42427 - DNA, 20 bp, Artificial
  CRISPR gRNA sequence
ctcacatctcaatagtgcta

SEQ ID NO: 42428 - DNA, 20 bp, Artificial
  CRISPR gRNA sequence
aggtttaaaaactgtgtctg

SEQ ID NO: 42429 - DNA, 20 bp, Artificial
  CRISPR gRNA sequence
ggtttaaaaactgtgtctga

SEQ ID NO: 42430 - DNA, 20 bp, Artificial
  CRISPR gRNA sequence
gtttaaaaactgtgtctgaa

SEQ ID NO: 42431 - DNA, 20 bp, Artificial
  CRISPR gRNA sequence
aactgtgtctgaagggcctg

SEQ ID NO: 42432 - DNA, 20 bp, Artificial
  CRISPR gRNA sequence
tgaagcttcccactctctgt

SEQ ID NO: 42433 - DNA, 20 bp, Artificial
  CRISPR gRNA sequence
gcttcccactctctgtgagc

SEQ ID NO: 42434 - DNA, 20 bp, Artificial
  CRISPR gRNA sequence
cttcccactctctgtgagca

SEQ ID NO: 42435 - DNA, 20 bp, Artificial
  CRISPR gRNA sequence
gcctgtgaaatctgtgcttg

SEQ ID NO: 42436 - DNA, 20 bp, Artificial
  CRISPR gRNA sequence
cctgtgaaatctgtgcttgc

SEQ ID NO: 42437 - DNA, 20 bp, Artificial
  CRISPR gRNA sequence
gtgcttgcaggtaaaaacaa

SEQ ID NO: 42438 - DNA, 20 bp, Artificial
  CRISPR gRNA sequence
aaaaacaatagtaataataa

SEQ ID NO: 42439 - DNA, 20 bp, Artificial
  CRISPR gRNA sequence
acaatagtaataataacagc

SEQ ID NO: 42440 - DNA, 20 bp, Artificial
  CRISPR gRNA sequence
agtaataataacagcaagca

SEQ ID NO: 42441 - DNA, 20 bp, Artificial
  CRISPR gRNA sequence
gtaataataacagcaagcac

SEQ ID NO: 42442 - DNA, 20 bp, Artificial
  CRISPR gRNA sequence
gcaagcacaggtcccatgcc

SEQ ID NO: 42443 - DNA, 20 bp, Artificial
  CRISPR gRNA sequence
agcacaggtcccatgcccgg

SEQ ID NO: 42444 - DNA, 20 bp, Artificial
  CRISPR gRNA sequence
attaaatcctcatatacctc

SEQ ID NO: 42445 - DNA, 20 bp, Artificial
  CRISPR gRNA sequence
taaatcctcatatacctcga

SEQ ID NO: 42446 - DNA, 20 bp, Artificial
  CRISPR gRNA sequence
cctcgagagtcatacatgac

SEQ ID NO: 42447 - DNA, 20 bp, Artificial
  CRISPR gRNA sequence
acatgacgagtcttgatttc

SEQ ID NO: 42448 - DNA, 20 bp, Artificial
  CRISPR gRNA sequence
acgagtcttgatttccagat

SEQ ID NO: 42449 - DNA, 20 bp, Artificial
  CRISPR gRNA sequence
cgagtcttgatttccagata

SEQ ID NO: 42450 - DNA, 20 bp, Artificial
  CRISPR gRNA sequence
atttccagataaggaaactg

SEQ ID NO: 42451 - DNA, 20 bp, Artificial
  CRISPR gRNA sequence
cagataaggaaactgaagct

SEQ ID NO: 42452 - DNA, 20 bp, Artificial
  CRISPR gRNA sequence
gataaggaaactgaagctca

SEQ ID NO: 42453 - DNA, 20 bp, Artificial
  CRISPR gRNA sequence
taaggaaactgaagctcaga

SEQ ID NO: 42454 - DNA, 20 bp, Artificial
  CRISPR gRNA sequence
aaggaaactgaagctcagag

SEQ ID NO: 42455 - DNA, 20 bp, Artificial
  CRISPR gRNA sequence
aactgaagctcagagaggtg

SEQ ID NO: 42456 - DNA, 20 bp, Artificial
  CRISPR gRNA sequence
agaggtgaagtcacttctcc

SEQ ID NO: 42457 - DNA, 20 bp, Artificial
  CRISPR gRNA sequence
gaggtgaagtcacttctcca

SEQ ID NO: 42458 - DNA, 20 bp, Artificial
  CRISPR gRNA sequence
gtcacttctccaaggtcaca

SEQ ID NO: 42459 - DNA, 20 bp, Artificial
  CRISPR gRNA sequence
tccaaggtcacacagccaat

SEQ ID NO: 42460 - DNA, 20 bp, Artificial
  CRISPR gRNA sequence
aaggtcacacagccaataag

SEQ ID NO: 42461 - DNA, 20 bp, Artificial
  CRISPR gRNA sequence
acacagccaataagcagaac

SEQ ID NO: 42462 - DNA, 20 bp, Artificial
  CRISPR gRNA sequence
cacagccaataagcagaact

SEQ ID NO: 42463 - DNA, 20 bp, Artificial
  CRISPR gRNA sequence
atccaaatctgcctgtccct

SEQ ID NO: 42464 - DNA, 20 bp, Artificial
  CRISPR gRNA sequence
tgcttccctattgccttgct

SEQ ID NO: 42465 - DNA, 20 bp, Artificial
  CRISPR gRNA sequence
ctattgccttgctgagctgc

SEQ ID NO: 42466 - DNA, 20 bp, Artificial
  CRISPR gRNA sequence
ccctccctttccttaccctc

SEQ ID NO: 42467 - DNA, 20 bp, Artificial
  CRISPR gRNA sequence
cctccctttccttaccctcc

SEQ ID NO: 42468 - DNA, 20 bp, Artificial
  CRISPR gRNA sequence
cctttccttaccctccaggc

SEQ ID NO: 42469 - DNA, 20 bp, Artificial
  CRISPR gRNA sequence
tccttaccctccaggctagc

SEQ ID NO: 42470 - DNA, 20 bp, Artificial
  CRISPR gRNA sequence
ccttaccctccaggctagcc

SEQ ID NO: 42471 - DNA, 20 bp, Artificial
  CRISPR gRNA sequence
tccttgtccactcatcttgc

SEQ ID NO: 42472 - DNA, 20 bp, Artificial
  CRISPR gRNA sequence
gatctaccccctttcctttt

SEQ ID NO: 42473 - DNA, 20 bp, Artificial
  CRISPR gRNA sequence
atctaccccctttccttttc

SEQ ID NO: 42474 - DNA, 20 bp, Artificial
  CRISPR gRNA sequence
ccccctttccttttcaggct

SEQ ID NO: 42475 - DNA, 20 bp, Artificial
  CRISPR gRNA sequence
ctttccttttcaggctgagc

SEQ ID NO: 42476 - DNA, 20 bp, Artificial
  CRISPR gRNA sequence
ccttttcaggctgagccaga

SEQ ID NO: 42477 - DNA, 20 bp, Artificial
  CRISPR gRNA sequence
cttttcaggctgagccagac

SEQ ID NO: 42478 - DNA, 20 bp, Artificial
  CRISPR gRNA sequence
cagacgggactgtccccgaa

SEQ ID NO: 42479 - DNA, 20 bp, Artificial
  CRISPR gRNA sequence
cccgaaaagccccttcctgc

SEQ ID NO: 42480 - DNA, 20 bp, Artificial
  CRISPR gRNA sequence
ttcctgctggccaacacctt

SEQ ID NO: 42481 - DNA, 20 bp, Artificial
  CRISPR gRNA sequence
acaccttaagcctgtgtcca

SEQ ID NO: 42482 - DNA, 20 bp, Artificial
  CRISPR gRNA sequence
caccttaagcctgtgtccac

SEQ ID NO: 42483 - DNA, 20 bp, Artificial
  CRISPR gRNA sequence
gcctgtgtccacgggttaaa

SEQ ID NO: 42484 - DNA, 20 bp, Artificial
  CRISPR gRNA sequence
cctgtgtccacgggttaaaa

SEQ ID NO: 42485 - DNA, 20 bp, Artificial
  CRISPR gRNA sequence
gtgtccacgggttaaaaagg

SEQ ID NO: 42486 - DNA, 20 bp, Artificial
  CRISPR gRNA sequence
cgggttaaaaaggtggatct

SEQ ID NO: 42487 - DNA, 20 bp, Artificial
  CRISPR gRNA sequence
gggttaaaaaggtggatctc

SEQ ID NO: 42488 - DNA, 20 bp, Artificial
  CRISPR gRNA sequence
ttaaaaaggtggatctcagg

SEQ ID NO: 42489 - DNA, 20 bp, Artificial
  CRISPR gRNA sequence
taaaaaggtggatctcaggt

SEQ ID NO: 42490 - DNA, 20 bp, Artificial
  CRISPR gRNA sequence
atctcaggtgggcattcccc

SEQ ID NO: 42491 - DNA, 20 bp, Artificial
  CRISPR gRNA sequence
tctcaggtgggcattcccct

SEQ ID NO: 42492 - DNA, 20 bp, Artificial
  CRISPR gRNA sequence
aggtgggcattcccctggga

SEQ ID NO: 42493 - DNA, 20 bp, Artificial
  CRISPR gRNA sequence
gggcattcccctgggacagc

SEQ ID NO: 42494 - DNA, 20 bp, Artificial
  CRISPR gRNA sequence
ggcattcccctgggacagcc

SEQ ID NO: 42495 - DNA, 20 bp, Artificial
  CRISPR gRNA sequence
gacagccaggactcgtcctg

SEQ ID NO: 42496 - DNA, 20 bp, Artificial
  CRISPR gRNA sequence
acagccaggactcgtcctga

SEQ ID NO: 42497 - DNA, 20 bp, Artificial
  CRISPR gRNA sequence
cagccaggactcgtcctgaa

SEQ ID NO: 42498 - DNA, 20 bp, Artificial
  CRISPR gRNA sequence
tcgtcctgaagggttgtgcc

SEQ ID NO: 42499 - DNA, 20 bp, Artificial
  CRISPR gRNA sequence
gtcctgaagggttgtgcctg

SEQ ID NO: 42500 - DNA, 20 bp, Artificial
  CRISPR gRNA sequence
gaagggttgtgcctggagtc

SEQ ID NO: 42501 - DNA, 20 bp, Artificial
  CRISPR gRNA sequence
gggttgtgcctggagtctgg

SEQ ID NO: 42502 - DNA, 20 bp, Artificial
  CRISPR gRNA sequence
ggttgtgcctggagtctggt

SEQ ID NO: 42503 - DNA, 20 bp, Artificial
  CRISPR gRNA sequence
gcctggagtctggtgggtat

SEQ ID NO: 42504 - DNA, 20 bp, Artificial
  CRISPR gRNA sequence
cctggagtctggtgggtatg

SEQ ID NO: 42505 - DNA, 20 bp, Artificial
  CRISPR gRNA sequence
ctggagtctggtgggtatga

SEQ ID NO: 42506 - DNA, 20 bp, Artificial
  CRISPR gRNA sequence
tggagtctggtgggtatgag

SEQ ID NO: 42507 - DNA, 20 bp, Artificial
  CRISPR gRNA sequence
ggagtctggtgggtatgagg

SEQ ID NO: 42508 - DNA, 20 bp, Artificial
  CRISPR gRNA sequence
gtctggtgggtatgaggggg

SEQ ID NO: 42509 - DNA, 20 bp, Artificial
  CRISPR gRNA sequence
tctggtgggtatgagggggt

SEQ ID NO: 42510 - DNA, 20 bp, Artificial
  CRISPR gRNA sequence
gggtatgagggggtaggatg

SEQ ID NO: 42511 - DNA, 20 bp, Artificial
  CRISPR gRNA sequence
atgagggggtaggatgaaga

SEQ ID NO: 42512 - DNA, 20 bp, Artificial
  CRISPR gRNA sequence
agggggtaggatgaagacag

SEQ ID NO: 42513 - DNA, 20 bp, Artificial
  CRISPR gRNA sequence
gggggtaggatgaagacagt

SEQ ID NO: 42514 - DNA, 20 bp, Artificial
  CRISPR gRNA sequence
tgaagacagtaggacccaac

SEQ ID NO: 42515 - DNA, 20 bp, Artificial
  CRISPR gRNA sequence
aagacagtaggacccaacta

SEQ ID NO: 42516 - DNA, 20 bp, Artificial
  CRISPR gRNA sequence
agacagtaggacccaactag

SEQ ID NO: 42517 - DNA, 20 bp, Artificial
  CRISPR gRNA sequence
agtaggacccaactagaggc

SEQ ID NO: 42518 - DNA, 20 bp, Artificial
  CRISPR gRNA sequence
gtaggacccaactagaggct

SEQ ID NO: 42519 - DNA, 20 bp, Artificial
  CRISPR gRNA sequence
ccaactagaggctgggcttc

SEQ ID NO: 42520 - DNA, 20 bp, Artificial
  CRISPR gRNA sequence
aactagaggctgggcttccg

SEQ ID NO: 42521 - DNA, 20 bp, Artificial
  CRISPR gRNA sequence
actagaggctgggcttccgg

SEQ ID NO: 42522 - DNA, 20 bp, Artificial
  CRISPR gRNA sequence
tagaggctgggcttccggag

SEQ ID NO: 42523 - DNA, 20 bp, Artificial
  CRISPR gRNA sequence
agaggctgggcttccggagg

SEQ ID NO: 42524 - DNA, 20 bp, Artificial
  CRISPR gRNA sequence
gaggctgggcttccggagga

SEQ ID NO: 42525 - DNA, 20 bp, Artificial
  CRISPR gRNA sequence
aggctgggcttccggaggag

SEQ ID NO: 42526 - DNA, 20 bp, Artificial
  CRISPR gRNA sequence
ggcttccggaggaggggtgc

SEQ ID NO: 42527 - DNA, 20 bp, Artificial
  CRISPR gRNA sequence
gaggaggggtgctggccccg

SEQ ID NO: 42528 - DNA, 20 bp, Artificial
  CRISPR gRNA sequence
aggaggggtgctggccccgt

SEQ ID NO: 42529 - DNA, 20 bp, Artificial
  CRISPR gRNA sequence
ggaggggtgctggccccgtg

SEQ ID NO: 42530 - DNA, 20 bp, Artificial
  CRISPR gRNA sequence
gaggggtgctggccccgtgg

SEQ ID NO: 42531 - DNA, 20 bp, Artificial
  CRISPR gRNA sequence
tggccccgtgggggcatcct

SEQ ID NO: 42532 - DNA, 20 bp, Artificial
  CRISPR gRNA sequence
ggccccgtgggggcatcctg

SEQ ID NO: 42533 - DNA, 20 bp, Artificial
  CRISPR gRNA sequence
gtgggggcatcctgaggctg

SEQ ID NO: 42534 - DNA, 20 bp, Artificial
  CRISPR gRNA sequence
gcatcctgaggctgtggcca

SEQ ID NO: 42535 - DNA, 20 bp, Artificial
  CRISPR gRNA sequence
gtggccacagctgtctgacc

SEQ ID NO: 42536 - DNA, 20 bp, Artificial
  CRISPR gRNA sequence
tggccacagctgtctgaccc

SEQ ID NO: 42537 - DNA, 20 bp, Artificial
  CRISPR gRNA sequence
gacccaggtcctgtctgatc

SEQ ID NO: 42538 - DNA, 20 bp, Artificial
  CRISPR gRNA sequence
acccaggtcctgtctgatcc

SEQ ID NO: 42539 - DNA, 20 bp, Artificial
  CRISPR gRNA sequence
caccatgcaactttgcactt

SEQ ID NO: 42540 - DNA, 20 bp, Artificial
  CRISPR gRNA sequence
ctttgcacttcagatccaac

SEQ ID NO: 42541 - DNA, 20 bp, Artificial
  CRISPR gRNA sequence
tttgcacttcagatccaacg

SEQ ID NO: 42542 - DNA, 20 bp, Artificial
  CRISPR gRNA sequence
tgcacttcagatccaacgag

SEQ ID NO: 42543 - DNA, 20 bp, Artificial
  CRISPR gRNA sequence
gcacttcagatccaacgagg

SEQ ID NO: 42544 - DNA, 20 bp, Artificial
  CRISPR gRNA sequence
acttcagatccaacgaggag

SEQ ID NO: 42545 - DNA, 20 bp, Artificial
  CRISPR gRNA sequence
cttcagatccaacgaggagg

SEQ ID NO: 42546 - DNA, 20 bp, Artificial
  CRISPR gRNA sequence
cagatccaacgaggaggagg

SEQ ID NO: 42547 - DNA, 20 bp, Artificial
  CRISPR gRNA sequence
agatccaacgaggaggagga

SEQ ID NO: 42548 - DNA, 20 bp, Artificial
  CRISPR gRNA sequence
gaggaggaaggcgtgtgctg

SEQ ID NO: 42549 - DNA, 20 bp, Artificial
  CRISPR gRNA sequence
aggaggaaggcgtgtgctgt

SEQ ID NO: 42550 - DNA, 20 bp, Artificial
  CRISPR gRNA sequence
ggaaggcgtgtgctgtgggt

SEQ ID NO: 42551 - DNA, 20 bp, Artificial
  CRISPR gRNA sequence
aagcccccttgaaccatgcc

SEQ ID NO: 42552 - DNA, 20 bp, Artificial
  CRISPR gRNA sequence
agcccccttgaaccatgcct

SEQ ID NO: 42553 - DNA, 20 bp, Artificial
  CRISPR gRNA sequence
ccccttgaaccatgcctagg

SEQ ID NO: 42554 - DNA, 20 bp, Artificial
  CRISPR gRNA sequence
ttgaaccatgcctaggcagc

SEQ ID NO: 42555 - DNA, 20 bp, Artificial
  CRISPR gRNA sequence
cctaggcagctagttgatgt

SEQ ID NO: 42556 - DNA, 20 bp, Artificial
  CRISPR gRNA sequence
ctaggcagctagttgatgtt

SEQ ID NO: 42557 - DNA, 20 bp, Artificial
  CRISPR gRNA sequence
taggcagctagttgatgttg

SEQ ID NO: 42558 - DNA, 20 bp, Artificial
  CRISPR gRNA sequence
agctagttgatgttggggac

SEQ ID NO: 42559 - DNA, 20 bp, Artificial
  CRISPR gRNA sequence
tagttgatgttggggaccag

SEQ ID NO: 42560 - DNA, 20 bp, Artificial
  CRISPR gRNA sequence
ggaccagtagatctgcctcc

SEQ ID NO: 42561 - DNA, 20 bp, Artificial
  CRISPR gRNA sequence
gaccagtagatctgcctcct

SEQ ID NO: 42562 - DNA, 20 bp, Artificial
  CRISPR gRNA sequence
cagtagatctgcctcctggg

SEQ ID NO: 42563 - DNA, 20 bp, Artificial
  CRISPR gRNA sequence
agatctgcctcctgggtggc

SEQ ID NO: 42564 - DNA, 20 bp, Artificial
  CRISPR gRNA sequence
atctgcctcctgggtggcca

SEQ ID NO: 42565 - DNA, 20 bp, Artificial
  CRISPR gRNA sequence
tgcctcctgggtggccagag

SEQ ID NO: 42566 - DNA, 20 bp, Artificial
  CRISPR gRNA sequence
tgggtggccagagcagtatg

SEQ ID NO: 42567 - DNA, 20 bp, Artificial
  CRISPR gRNA sequence
cctaccacaaaacattcccc

SEQ ID NO: 42568 - DNA, 20 bp, Artificial
  CRISPR gRNA sequence
attcccctggaacaaccctg

SEQ ID NO: 42569 - DNA, 20 bp, Artificial
  CRISPR gRNA sequence
tcccctggaacaaccctgca

SEQ ID NO: 42570 - DNA, 20 bp, Artificial
  CRISPR gRNA sequence
cccctggaacaaccctgcag

SEQ ID NO: 42571 - DNA, 20 bp, Artificial
  CRISPR gRNA sequence
ccctggaacaaccctgcaga

SEQ ID NO: 42572 - DNA, 20 bp, Artificial
  CRISPR gRNA sequence
gcagagggacttgtttcacc

SEQ ID NO: 42573 - DNA, 20 bp, Artificial
  CRISPR gRNA sequence
gacttgtttcacccagcatg

SEQ ID NO: 42574 - DNA, 20 bp, Artificial
  CRISPR gRNA sequence
tcacccagcatgaagaaaca

SEQ ID NO: 42575 - DNA, 20 bp, Artificial
  CRISPR gRNA sequence
cacccagcatgaagaaacac

SEQ ID NO: 42576 - DNA, 20 bp, Artificial
  CRISPR gRNA sequence
agcatgaagaaacacaggtc

SEQ ID NO: 42577 - DNA, 20 bp, Artificial
  CRISPR gRNA sequence
gcatgaagaaacacaggtcc

SEQ ID NO: 42578 - DNA, 20 bp, Artificial
  CRISPR gRNA sequence
tgaagaaacacaggtccggg

SEQ ID NO: 42579 - DNA, 20 bp, Artificial
  CRISPR gRNA sequence
gaagaaacacaggtccgggt

SEQ ID NO: 42580 - DNA, 20 bp, Artificial
  CRISPR gRNA sequence
ggtccgggtgggatctactg

SEQ ID NO: 42581 - DNA, 20 bp, Artificial
  CRISPR gRNA sequence
gtccgggtgggatctactgt

SEQ ID NO: 42582 - DNA, 20 bp, Artificial
  CRISPR gRNA sequence
tccgggtgggatctactgtg

SEQ ID NO: 42583 - DNA, 20 bp, Artificial
  CRISPR gRNA sequence
ccgggtgggatctactgtgg

SEQ ID NO: 42584 - DNA, 20 bp, Artificial
  CRISPR gRNA sequence
ggtgggatctactgtggggg

SEQ ID NO: 42585 - DNA, 20 bp, Artificial
  CRISPR gRNA sequence
gtgggatctactgtgggggt

SEQ ID NO: 42586 - DNA, 20 bp, Artificial
  CRISPR gRNA sequence
gggatctactgtgggggtgg

SEQ ID NO: 42587 - DNA, 20 bp, Artificial
  CRISPR gRNA sequence
atctactgtgggggtgggag

SEQ ID NO: 42588 - DNA, 20 bp, Artificial
  CRISPR gRNA sequence
tactgtgggggtgggagcag

SEQ ID NO: 42589 - DNA, 20 bp, Artificial
  CRISPR gRNA sequence
ggggtgggagcagtggattc

SEQ ID NO: 42590 - DNA, 20 bp, Artificial
  CRISPR gRNA sequence
cagtggattctggacacttc

SEQ ID NO: 42591 - DNA, 20 bp, Artificial
  CRISPR gRNA sequence
gtggattctggacacttcca

SEQ ID NO: 42592 - DNA, 20 bp, Artificial
  CRISPR gRNA sequence
tggattctggacacttccag

SEQ ID NO: 42593 - DNA, 20 bp, Artificial
  CRISPR gRNA sequence
ggattctggacacttccaga

SEQ ID NO: 42594 - DNA, 20 bp, Artificial
  CRISPR gRNA sequence
tggacacttccagagggtcc

SEQ ID NO: 42595 - DNA, 20 bp, Artificial
  CRISPR gRNA sequence
cttccagagggtccaagctt

SEQ ID NO: 42596 - DNA, 20 bp, Artificial
  CRISPR gRNA sequence
ccagagggtccaagcttgag

SEQ ID NO: 42597 - DNA, 20 bp, Artificial
  CRISPR gRNA sequence
agagggtccaagcttgagtg

SEQ ID NO: 42598 - DNA, 20 bp, Artificial
  CRISPR gRNA sequence
agcttgagtggagacccacc

SEQ ID NO: 42599 - DNA, 20 bp, Artificial
  CRISPR gRNA sequence
cttgagtggagacccacctg

SEQ ID NO: 42600 - DNA, 20 bp, Artificial
  CRISPR gRNA sequence
gtggagacccacctggagcc

SEQ ID NO: 42601 - DNA, 20 bp, Artificial
  CRISPR gRNA sequence
ggagacccacctggagccca

SEQ ID NO: 42602 - DNA, 20 bp, Artificial
  CRISPR gRNA sequence
gagacccacctggagcccag

SEQ ID NO: 42603 - DNA, 20 bp, Artificial
  CRISPR gRNA sequence
ggagcccagaggctgtgccc

SEQ ID NO: 42604 - DNA, 20 bp, Artificial
  CRISPR gRNA sequence
gagcccagaggctgtgccct

SEQ ID NO: 42605 - DNA, 20 bp, Artificial
  CRISPR gRNA sequence
ccagaggctgtgccctgggc

SEQ ID NO: 42606 - DNA, 20 bp, Artificial
  CRISPR gRNA sequence
aggctgtgccctgggctagc

SEQ ID NO: 42607 - DNA, 20 bp, Artificial
  CRISPR gRNA sequence
ggctgtgccctgggctagcc

SEQ ID NO: 42608 - DNA, 20 bp, Artificial
  CRISPR gRNA sequence
gtgccctgggctagccaggc

SEQ ID NO: 42609 - DNA, 20 bp, Artificial
  CRISPR gRNA sequence
gccctgggctagccaggccg

SEQ ID NO: 42610 - DNA, 20 bp, Artificial
  CRISPR gRNA sequence
ccctgggctagccaggccgg

SEQ ID NO: 42611 - DNA, 20 bp, Artificial
  CRISPR gRNA sequence
cctgggctagccaggccgga

SEQ ID NO: 42612 - DNA, 20 bp, Artificial
  CRISPR gRNA sequence
ctgggctagccaggccggag

SEQ ID NO: 42613 - DNA, 20 bp, Artificial
  CRISPR gRNA sequence
tgggctagccaggccggagg

SEQ ID NO: 42614 - DNA, 20 bp, Artificial
  CRISPR gRNA sequence
agccaggccggagggggtct

SEQ ID NO: 42615 - DNA, 20 bp, Artificial
  CRISPR gRNA sequence
caggccggagggggtctcag

SEQ ID NO: 42616 - DNA, 20 bp, Artificial
  CRISPR gRNA sequence
ttgtcccctttacctccgtc

SEQ ID NO: 42617 - DNA, 20 bp, Artificial
  CRISPR gRNA sequence
tcccctttacctccgtccag

SEQ ID NO: 42618 - DNA, 20 bp, Artificial
  CRISPR gRNA sequence
cccctttacctccgtccagc

SEQ ID NO: 42619 - DNA, 20 bp, Artificial
  CRISPR gRNA sequence
acctccgtccagcaggttca

SEQ ID NO: 42620 - DNA, 20 bp, Artificial
  CRISPR gRNA sequence
cctccgtccagcaggttcac

SEQ ID NO: 42621 - DNA, 20 bp, Artificial
  CRISPR gRNA sequence
tccagcaggttcacaggctg

SEQ ID NO: 42622 - DNA, 20 bp, Artificial
  CRISPR gRNA sequence
aggttcacaggctgcagcct

SEQ ID NO: 42623 - DNA, 20 bp, Artificial
  CRISPR gRNA sequence
tcacaggctgcagcctcagc

SEQ ID NO: 42624 - DNA, 20 bp, Artificial
  CRISPR gRNA sequence
cacaggctgcagcctcagcc

SEQ ID NO: 42625 - DNA, 20 bp, Artificial
  CRISPR gRNA sequence
caggctgcagcctcagccag

SEQ ID NO: 42626 - DNA, 20 bp, Artificial
  CRISPR gRNA sequence
cagcctcagccaggagcacg

SEQ ID NO: 42627 - DNA, 20 bp, Artificial
  CRISPR gRNA sequence
gcctcagccaggagcacgta

SEQ ID NO: 42628 - DNA, 20 bp, Artificial
  CRISPR gRNA sequence
agcacgtagagtcactctgc

SEQ ID NO: 42629 - DNA, 20 bp, Artificial
  CRISPR gRNA sequence
gagtcactctgctggttgct

SEQ ID NO: 42630 - DNA, 20 bp, Artificial
  CRISPR gRNA sequence
cactctgctggttgctgagc

SEQ ID NO: 42631 - DNA, 20 bp, Artificial
  CRISPR gRNA sequence
ctggttgctgagcaagtgta

SEQ ID NO: 42632 - DNA, 20 bp, Artificial
  CRISPR gRNA sequence
ctgagcaagtgtaaagacct

SEQ ID NO: 42633 - DNA, 20 bp, Artificial
  CRISPR gRNA sequence
gcaagtgtaaagacctcagc

SEQ ID NO: 42634 - DNA, 20 bp, Artificial
  CRISPR gRNA sequence
caagtgtaaagacctcagcc

SEQ ID NO: 42635 - DNA, 20 bp, Artificial
  CRISPR gRNA sequence
gtgtaaagacctcagccagg

SEQ ID NO: 42636 - DNA, 20 bp, Artificial
  CRISPR gRNA sequence
gtaaagacctcagccaggtg

SEQ ID NO: 42637 - DNA, 20 bp, Artificial
  CRISPR gRNA sequence
agacctcagccaggtggagt

SEQ ID NO: 42638 - DNA, 20 bp, Artificial
  CRISPR gRNA sequence
tcagccaggtggagtaagtt

SEQ ID NO: 42639 - DNA, 20 bp, Artificial
  CRISPR gRNA sequence
cagccaggtggagtaagttg

SEQ ID NO: 42640 - DNA, 20 bp, Artificial
  CRISPR gRNA sequence
agccaggtggagtaagttga

SEQ ID NO: 42641 - DNA, 20 bp, Artificial
  CRISPR gRNA sequence
ccaggtggagtaagttgagg

SEQ ID NO: 42642 - DNA, 20 bp, Artificial
  CRISPR gRNA sequence
caggtggagtaagttgaggg

SEQ ID NO: 42643 - DNA, 20 bp, Artificial
  CRISPR gRNA sequence
ggtggagtaagttgagggag

SEQ ID NO: 42644 - DNA, 20 bp, Artificial
  CRISPR gRNA sequence
gtggagtaagttgagggagg

SEQ ID NO: 42645 - DNA, 20 bp, Artificial
  CRISPR gRNA sequence
ggagtaagttgagggaggag

SEQ ID NO: 42646 - DNA, 20 bp, Artificial
  CRISPR gRNA sequence
gagtaagttgagggaggagg

SEQ ID NO: 42647 - DNA, 20 bp, Artificial
  CRISPR gRNA sequence
taagttgagggaggaggagg

SEQ ID NO: 42648 - DNA, 20 bp, Artificial
  CRISPR gRNA sequence
aagttgagggaggaggagga

SEQ ID NO: 42649 - DNA, 20 bp, Artificial
  CRISPR gRNA sequence
gttgagggaggaggaggaag

SEQ ID NO: 42650 - DNA, 20 bp, Artificial
  CRISPR gRNA sequence
tgagggaggaggaggaagga

SEQ ID NO: 42651 - DNA, 20 bp, Artificial
  CRISPR gRNA sequence
gagggaggaggaggaaggag

SEQ ID NO: 42652 - DNA, 20 bp, Artificial
  CRISPR gRNA sequence
gggaggaggaggaaggagag

SEQ ID NO: 42653 - DNA, 20 bp, Artificial
  CRISPR gRNA sequence
gaggaggaaggagaggagca

SEQ ID NO: 42654 - DNA, 20 bp, Artificial
  CRISPR gRNA sequence
aggagcatggacgcatgcct

SEQ ID NO: 42655 - DNA, 20 bp, Artificial
  CRISPR gRNA sequence
ggagcatggacgcatgcctg

SEQ ID NO: 42656 - DNA, 20 bp, Artificial
  CRISPR gRNA sequence
gagcatggacgcatgcctga

SEQ ID NO: 42657 - DNA, 20 bp, Artificial
  CRISPR gRNA sequence
agcatggacgcatgcctgag

SEQ ID NO: 42658 - DNA, 20 bp, Artificial
  CRISPR gRNA sequence
cgcatgcctgaggggcactg

SEQ ID NO: 42659 - DNA, 20 bp, Artificial
  CRISPR gRNA sequence
gcatgcctgaggggcactga

SEQ ID NO: 42660 - DNA, 20 bp, Artificial
  CRISPR gRNA sequence
catgcctgaggggcactgaa

SEQ ID NO: 42661 - DNA, 20 bp, Artificial
  CRISPR gRNA sequence
atgcctgaggggcactgaag

SEQ ID NO: 42662 - DNA, 20 bp, Artificial
  CRISPR gRNA sequence
tgcctgaggggcactgaagg

SEQ ID NO: 42663 - DNA, 20 bp, Artificial
  CRISPR gRNA sequence
aggggcactgaagggggtat

SEQ ID NO: 42664 - DNA, 20 bp, Artificial
  CRISPR gRNA sequence
ggggcactgaagggggtatg

SEQ ID NO: 42665 - DNA, 20 bp, Artificial
  CRISPR gRNA sequence
gggcactgaagggggtatga

SEQ ID NO: 42666 - DNA, 20 bp, Artificial
  CRISPR gRNA sequence
gtgtgcctgcctacacctct

SEQ ID NO: 42667 - DNA, 20 bp, Artificial
  CRISPR gRNA sequence
tgtgcctgcctacacctctc

SEQ ID NO: 42668 - DNA, 20 bp, Artificial
  CRISPR gRNA sequence
ctgcctacacctctcaggac

SEQ ID NO: 42669 - DNA, 20 bp, Artificial
  CRISPR gRNA sequence
cacctctcaggaccagctgt

SEQ ID NO: 42670 - DNA, 20 bp, Artificial
  CRISPR gRNA sequence
acctctcaggaccagctgtc

SEQ ID NO: 42671 - DNA, 20 bp, Artificial
  CRISPR gRNA sequence
cctctcaggaccagctgtca

SEQ ID NO: 42672 - DNA, 20 bp, Artificial
  CRISPR gRNA sequence
gaccagctgtcagggatgcc

SEQ ID NO: 42673 - DNA, 20 bp, Artificial
  CRISPR gRNA sequence
accagctgtcagggatgcct

SEQ ID NO: 42674 - DNA, 20 bp, Artificial
  CRISPR gRNA sequence
atgcctgggtcacataccca

SEQ ID NO: 42675 - DNA, 20 bp, Artificial
  CRISPR gRNA sequence
tcccgcccccactctcgcca

SEQ ID NO: 42676 - DNA, 20 bp, Artificial
  CRISPR gRNA sequence
cgcccccactctcgccatgg

SEQ ID NO: 42677 - DNA, 20 bp, Artificial
  CRISPR gRNA sequence
cccccactctcgccatggtg

SEQ ID NO: 42678 - DNA, 20 bp, Artificial
  CRISPR gRNA sequence
cactctcgccatggtggagc

SEQ ID NO: 42679 - DNA, 20 bp, Artificial
  CRISPR gRNA sequence
ccatggtggagctagttcca

SEQ ID NO: 42680 - DNA, 20 bp, Artificial
  CRISPR gRNA sequence
ccatggtgtgccctctgact

SEQ ID NO: 42681 - DNA, 20 bp, Artificial
  CRISPR gRNA sequence
catggtgtgccctctgactt

SEQ ID NO: 42682 - DNA, 20 bp, Artificial
  CRISPR gRNA sequence
ggtgtgccctctgacttggg

SEQ ID NO: 42683 - DNA, 20 bp, Artificial
  CRISPR gRNA sequence
cctctgacttgggcagccct

SEQ ID NO: 42684 - DNA, 20 bp, Artificial
  CRISPR gRNA sequence
cttgggcagccctcagcctc

SEQ ID NO: 42685 - DNA, 20 bp, Artificial
  CRISPR gRNA sequence
cctcagcctcaagtatgtgc

SEQ ID NO: 42686 - DNA, 20 bp, Artificial
  CRISPR gRNA sequence
caagtatgtgcaagctctgc

SEQ ID NO: 42687 - DNA, 20 bp, Artificial
  CRISPR gRNA sequence
gtatgtgcaagctctgctgg

SEQ ID NO: 42688 - DNA, 20 bp, Artificial
  CRISPR gRNA sequence
gtgcaagctctgctggcaga

SEQ ID NO: 42689 - DNA, 20 bp, Artificial
  CRISPR gRNA sequence
tgcaagctctgctggcagat

SEQ ID NO: 42690 - DNA, 20 bp, Artificial
  CRISPR gRNA sequence
gcaagctctgctggcagatg

SEQ ID NO: 42691 - DNA, 20 bp, Artificial
  CRISPR gRNA sequence
caagctctgctggcagatgg

SEQ ID NO: 42692 - DNA, 20 bp, Artificial
  CRISPR gRNA sequence
ggcagatgggggctaaaacg

SEQ ID NO: 42693 - DNA, 20 bp, Artificial
  CRISPR gRNA sequence
gcagatgggggctaaaacgc

SEQ ID NO: 42694 - DNA, 20 bp, Artificial
  CRISPR gRNA sequence
taaaacgcaggattcattgt

SEQ ID NO: 42695 - DNA, 20 bp, Artificial
  CRISPR gRNA sequence
cgcaggattcattgttggcc

SEQ ID NO: 42696 - DNA, 20 bp, Artificial
  CRISPR gRNA sequence
aggattcattgttggcccag

SEQ ID NO: 42697 - DNA, 20 bp, Artificial
  CRISPR gRNA sequence
ggattcattgttggcccagc

SEQ ID NO: 42698 - DNA, 20 bp, Artificial
  CRISPR gRNA sequence
ttcattgttggcccagcagg

SEQ ID NO: 42699 - DNA, 20 bp, Artificial
  CRISPR gRNA sequence
ttggcccagcaggtggttaa

SEQ ID NO: 42700 - DNA, 20 bp, Artificial
  CRISPR gRNA sequence
cagcaggtggttaaaagtac

SEQ ID NO: 42701 - DNA, 20 bp, Artificial
  CRISPR gRNA sequence
agtaccggatgactctgcct

SEQ ID NO: 42702 - DNA, 20 bp, Artificial
  CRISPR gRNA sequence
gtaccggatgactctgcctg

SEQ ID NO: 42703 - DNA, 20 bp, Artificial
  CRISPR gRNA sequence
accggatgactctgcctgag

SEQ ID NO: 42704 - DNA, 20 bp, Artificial
  CRISPR gRNA sequence
ccggatgactctgcctgagg

SEQ ID NO: 42705 - DNA, 20 bp, Artificial
  CRISPR gRNA sequence
cggatgactctgcctgagga

SEQ ID NO: 42706 - DNA, 20 bp, Artificial
  CRISPR gRNA sequence
actctgcctgaggagggacg

SEQ ID NO: 42707 - DNA, 20 bp, Artificial
  CRISPR gRNA sequence
tctgcctgaggagggacgca

SEQ ID NO: 42708 - DNA, 20 bp, Artificial
  CRISPR gRNA sequence
cctgaggagggacgcagagc

SEQ ID NO: 42709 - DNA, 20 bp, Artificial
  CRISPR gRNA sequence
aggagggacgcagagccagc

SEQ ID NO: 42710 - DNA, 20 bp, Artificial
  CRISPR gRNA sequence
ggagggacgcagagccagcc

SEQ ID NO: 42711 - DNA, 20 bp, Artificial
  CRISPR gRNA sequence
gagggacgcagagccagcca

SEQ ID NO: 42712 - DNA, 20 bp, Artificial
  CRISPR gRNA sequence
ggacgcagagccagccaggg

SEQ ID NO: 42713 - DNA, 20 bp, Artificial
  CRISPR gRNA sequence
gacgcagagccagccagggt

SEQ ID NO: 42714 - DNA, 20 bp, Artificial
  CRISPR gRNA sequence
acgcagagccagccagggtg

SEQ ID NO: 42715 - DNA, 20 bp, Artificial
  CRISPR gRNA sequence
ccagccagggtggggtcttg

SEQ ID NO: 42716 - DNA, 20 bp, Artificial
  CRISPR gRNA sequence
ttgcagtctcttgtattgtt

SEQ ID NO: 42717 - DNA, 20 bp, Artificial
  CRISPR gRNA sequence
tctcttgtattgttgagatg

SEQ ID NO: 42718 - DNA, 20 bp, Artificial
  CRISPR gRNA sequence
gttgagatgtggtatctgcg

SEQ ID NO: 42719 - DNA, 20 bp, Artificial
  CRISPR gRNA sequence
ggtatctgcgtggcctgtct

SEQ ID NO: 42720 - DNA, 20 bp, Artificial
  CRISPR gRNA sequence
gcctgtcttggatattcaaa

SEQ ID NO: 42721 - DNA, 20 bp, Artificial
  CRISPR gRNA sequence
gtcttggatattcaaatagt

SEQ ID NO: 42722 - DNA, 20 bp, Artificial
  CRISPR gRNA sequence
tcaaatagtcagcccctgca

SEQ ID NO: 42723 - DNA, 20 bp, Artificial
  CRISPR gRNA sequence
caaatagtcagcccctgcat

SEQ ID NO: 42724 - DNA, 20 bp, Artificial
  CRISPR gRNA sequence
atagtcagcccctgcatggg

SEQ ID NO: 42725 - DNA, 20 bp, Artificial
  CRISPR gRNA sequence
ctgcatgggtggaataataa

SEQ ID NO: 42726 - DNA, 20 bp, Artificial
  CRISPR gRNA sequence
ggtggaataataatagctaa

SEQ ID NO: 42727 - DNA, 20 bp, Artificial
  CRISPR gRNA sequence
aataatagctaacagctact

SEQ ID NO: 42728 - DNA, 20 bp, Artificial
  CRISPR gRNA sequence
agcactttctccactgttct

SEQ ID NO: 42729 - DNA, 20 bp, Artificial
  CRISPR gRNA sequence
ttttatgtttcccatatccc

SEQ ID NO: 42730 - DNA, 20 bp, Artificial
  CRISPR gRNA sequence
tttcccatatccctggatac

SEQ ID NO: 42731 - DNA, 20 bp, Artificial
  CRISPR gRNA sequence
ctagtattgttctcatttta

SEQ ID NO: 42732 - DNA, 20 bp, Artificial
  CRISPR gRNA sequence
attgttctcattttacagat

SEQ ID NO: 42733 - DNA, 20 bp, Artificial
  CRISPR gRNA sequence
ttgttctcattttacagatg

SEQ ID NO: 42734 - DNA, 20 bp, Artificial
  CRISPR gRNA sequence
tgttctcattttacagatga

SEQ ID NO: 42735 - DNA, 20 bp, Artificial
  CRISPR gRNA sequence
attttacagatgagggaact

SEQ ID NO: 42736 - DNA, 20 bp, Artificial
  CRISPR gRNA sequence
cagatgagggaactgagaca

SEQ ID NO: 42737 - DNA, 20 bp, Artificial
  CRISPR gRNA sequence
gatgagggaactgagacaca

SEQ ID NO: 42738 - DNA, 20 bp, Artificial
  CRISPR gRNA sequence
atgagggaactgagacacag

SEQ ID NO: 42739 - DNA, 20 bp, Artificial
  CRISPR gRNA sequence
tgagggaactgagacacaga

SEQ ID NO: 42740 - DNA, 20 bp, Artificial
  CRISPR gRNA sequence
aactgagacacagagggtgt

SEQ ID NO: 42741 - DNA, 20 bp, Artificial
  CRISPR gRNA sequence
gagggtgtaagaacttgccc

SEQ ID NO: 42742 - DNA, 20 bp, Artificial
  CRISPR gRNA sequence
agggtgtaagaacttgccca

SEQ ID NO: 42743 - DNA, 20 bp, Artificial
  CRISPR gRNA sequence
agaacttgcccaaggtcaca

SEQ ID NO: 42744 - DNA, 20 bp, Artificial
  CRISPR gRNA sequence
cttgcccaaggtcacacagc

SEQ ID NO: 42745 - DNA, 20 bp, Artificial
  CRISPR gRNA sequence
gtcacacagctagtaaaatg

SEQ ID NO: 42746 - DNA, 20 bp, Artificial
  CRISPR gRNA sequence
cacacagctagtaaaatgca

SEQ ID NO: 42747 - DNA, 20 bp, Artificial
  CRISPR gRNA sequence
taaaatgcagagtccctgct

SEQ ID NO: 42748 - DNA, 20 bp, Artificial
  CRISPR gRNA sequence
gagtccctgctcagacgcat

SEQ ID NO: 42749 - DNA, 20 bp, Artificial
  CRISPR gRNA sequence
agtccctgctcagacgcatt

SEQ ID NO: 42750 - DNA, 20 bp, Artificial
  CRISPR gRNA sequence
gctcagacgcattgggaatc

SEQ ID NO: 42751 - DNA, 20 bp, Artificial
  CRISPR gRNA sequence
gacgcattgggaatccagcc

SEQ ID NO: 42752 - DNA, 20 bp, Artificial
  CRISPR gRNA sequence
acgcattgggaatccagcct

SEQ ID NO: 42753 - DNA, 20 bp, Artificial
  CRISPR gRNA sequence
ttgggaatccagcctaggac

SEQ ID NO: 42754 - DNA, 20 bp, Artificial
  CRISPR gRNA sequence
ggaatccagcctaggaccag

SEQ ID NO: 42755 - DNA, 20 bp, Artificial
  CRISPR gRNA sequence
gaatccagcctaggaccagt

SEQ ID NO: 42756 - DNA, 20 bp, Artificial
  CRISPR gRNA sequence
agcctaggaccagtgggaaa

SEQ ID NO: 42757 - DNA, 20 bp, Artificial
  CRISPR gRNA sequence
cctaggaccagtgggaaata

SEQ ID NO: 42758 - DNA, 20 bp, Artificial
  CRISPR gRNA sequence
taggaccagtgggaaataga

SEQ ID NO: 42759 - DNA, 20 bp, Artificial
  CRISPR gRNA sequence
ggaccagtgggaaatagaga

SEQ ID NO: 42760 - DNA, 20 bp, Artificial
  CRISPR gRNA sequence
ccagtgggaaatagagagag

SEQ ID NO: 42761 - DNA, 20 bp, Artificial
  CRISPR gRNA sequence
ttttcatttctgttgtgatg

SEQ ID NO: 42762 - DNA, 20 bp, Artificial
  CRISPR gRNA sequence
tcatttctgttgtgatgtgg

SEQ ID NO: 42763 - DNA, 20 bp, Artificial
  CRISPR gRNA sequence
atttctgttgtgatgtggca

SEQ ID NO: 42764 - DNA, 20 bp, Artificial
  CRISPR gRNA sequence
tctgttgtgatgtggcagag

SEQ ID NO: 42765 - DNA, 20 bp, Artificial
  CRISPR gRNA sequence
aaatgtgactgataaaatca

SEQ ID NO: 42766 - DNA, 20 bp, Artificial
  CRISPR gRNA sequence
catggatttctttttttttt

SEQ ID NO: 42767 - DNA, 20 bp, Artificial
  CRISPR gRNA sequence
tttcttttttttttaagacc

SEQ ID NO: 42768 - DNA, 20 bp, Artificial
  CRISPR gRNA sequence
ttcttttttttttaagacct

SEQ ID NO: 42769 - DNA, 20 bp, Artificial
  CRISPR gRNA sequence
tcttttttttttaagacctg

SEQ ID NO: 42770 - DNA, 20 bp, Artificial
  CRISPR gRNA sequence
tggggtctcactctgttgcc

SEQ ID NO: 42771 - DNA, 20 bp, Artificial
  CRISPR gRNA sequence
ggggtctcactctgttgccc

SEQ ID NO: 42772 - DNA, 20 bp, Artificial
  CRISPR gRNA sequence
tctcactctgttgcccaggc

SEQ ID NO: 42773 - DNA, 20 bp, Artificial
  CRISPR gRNA sequence
tcactctgttgcccaggctg

SEQ ID NO: 42774 - DNA, 20 bp, Artificial
  CRISPR gRNA sequence
ctgttgcccaggctggagtg

SEQ ID NO: 42775 - DNA, 20 bp, Artificial
  CRISPR gRNA sequence
ttgcccaggctggagtgcag

SEQ ID NO: 42776 - DNA, 20 bp, Artificial
  CRISPR gRNA sequence
ggagtgcagtggtgcaatga

SEQ ID NO: 42777 - DNA, 20 bp, Artificial
  CRISPR gRNA sequence
gagtgcagtggtgcaatgat

SEQ ID NO: 42778 - DNA, 20 bp, Artificial
  CRISPR gRNA sequence
ggtgcaatgataggtcactg

SEQ ID NO: 42779 - DNA, 20 bp, Artificial
  CRISPR gRNA sequence
tcactgcagcctccaactcc

SEQ ID NO: 42780 - DNA, 20 bp, Artificial
  CRISPR gRNA sequence
cactgcagcctccaactcct

SEQ ID NO: 42781 - DNA, 20 bp, Artificial
  CRISPR gRNA sequence
agcctccaactcctgggctc

SEQ ID NO: 42782 - DNA, 20 bp, Artificial
  CRISPR gRNA sequence
ctcaagcgatcctcccacct

SEQ ID NO: 42783 - DNA, 20 bp, Artificial
  CRISPR gRNA sequence
gatcctcccacctcagcctc

SEQ ID NO: 42784 - DNA, 20 bp, Artificial
  CRISPR gRNA sequence
tcctcccacctcagcctctg

SEQ ID NO: 42785 - DNA, 20 bp, Artificial
  CRISPR gRNA sequence
tcccacctcagcctctggag

SEQ ID NO: 42786 - DNA, 20 bp, Artificial
  CRISPR gRNA sequence
acctcagcctctggagtagc

SEQ ID NO: 42787 - DNA, 20 bp, Artificial
  CRISPR gRNA sequence
cctcagcctctggagtagct

SEQ ID NO: 42788 - DNA, 20 bp, Artificial
  CRISPR gRNA sequence
ctctggagtagctgggacta

SEQ ID NO: 42789 - DNA, 20 bp, Artificial
  CRISPR gRNA sequence
tctggagtagctgggactac

SEQ ID NO: 42790 - DNA, 20 bp, Artificial
  CRISPR gRNA sequence
caggcacacaccaacatgcc

SEQ ID NO: 42791 - DNA, 20 bp, Artificial
  CRISPR gRNA sequence
acaccaacatgcctggctaa

SEQ ID NO: 42792 - DNA, 20 bp, Artificial
  CRISPR gRNA sequence
aacatgcctggctaatagtt

SEQ ID NO: 42793 - DNA, 20 bp, Artificial
  CRISPR gRNA sequence
ggctaatagtttagttttgt

SEQ ID NO: 42794 - DNA, 20 bp, Artificial
  CRISPR gRNA sequence
ctaatagtttagttttgtaa

SEQ ID NO: 42795 - DNA, 20 bp, Artificial
  CRISPR gRNA sequence
gtttagttttgtaagagatg

SEQ ID NO: 42796 - DNA, 20 bp, Artificial
  CRISPR gRNA sequence
tgaagtctcaccatgttccc

SEQ ID NO: 42797 - DNA, 20 bp, Artificial
  CRISPR gRNA sequence
gaagtctcaccatgttcccc

SEQ ID NO: 42798 - DNA, 20 bp, Artificial
  CRISPR gRNA sequence
tctcaccatgttccccaggt

SEQ ID NO: 42799 - DNA, 20 bp, Artificial
  CRISPR gRNA sequence
caggttggtctcaaacttct

SEQ ID NO: 42800 - DNA, 20 bp, Artificial
  CRISPR gRNA sequence
tggtctcaaacttctgagct

SEQ ID NO: 42801 - DNA, 20 bp, Artificial
  CRISPR gRNA sequence
ggtctcaaacttctgagctc

SEQ ID NO: 42802 - DNA, 20 bp, Artificial
  CRISPR gRNA sequence
ttctgagctcaggtgatcct

SEQ ID NO: 42803 - DNA, 20 bp, Artificial
  CRISPR gRNA sequence
tcaggtgatcctcagcctcc

SEQ ID NO: 42804 - DNA, 20 bp, Artificial
  CRISPR gRNA sequence
caggtgatcctcagcctccc

SEQ ID NO: 42805 - DNA, 20 bp, Artificial
  CRISPR gRNA sequence
cctcagcctcccaggttgct

SEQ ID NO: 42806 - DNA, 20 bp, Artificial
  CRISPR gRNA sequence
ctcccaggttgctgagatta

SEQ ID NO: 42807 - DNA, 20 bp, Artificial
  CRISPR gRNA sequence
tcccaggttgctgagattac

SEQ ID NO: 42808 - DNA, 20 bp, Artificial
  CRISPR gRNA sequence
gttgctgagattacaggcat

SEQ ID NO: 42809 - DNA, 20 bp, Artificial
  CRISPR gRNA sequence
caggcatgagccgctgtgct

SEQ ID NO: 42810 - DNA, 20 bp, Artificial
  CRISPR gRNA sequence
tgcttggaatgtattttaaa

SEQ ID NO: 42811 - DNA, 20 bp, Artificial
  CRISPR gRNA sequence
tattttaaacagatatgaat

SEQ ID NO: 42812 - DNA, 20 bp, Artificial
  CRISPR gRNA sequence
tgaataagaaatatgtcttt

SEQ ID NO: 42813 - DNA, 20 bp, Artificial
  CRISPR gRNA sequence
gagttttttgtttttcatta

SEQ ID NO: 42814 - DNA, 20 bp, Artificial
  CRISPR gRNA sequence
gttttttgtttttcattata

SEQ ID NO: 42815 - DNA, 20 bp, Artificial
  CRISPR gRNA sequence
ttttttgtttttcattatag

SEQ ID NO: 42816 - DNA, 20 bp, Artificial
  CRISPR gRNA sequence
tttttgtttttcattataga

SEQ ID NO: 42817 - DNA, 20 bp, Artificial
  CRISPR gRNA sequence
tttctttctttctttttttt

SEQ ID NO: 42818 - DNA, 20 bp, Artificial
  CRISPR gRNA sequence
tttctttctttttttttaga

SEQ ID NO: 42819 - DNA, 20 bp, Artificial
  CRISPR gRNA sequence
tctttctttttttttagatg

SEQ ID NO: 42820 - DNA, 20 bp, Artificial
  CRISPR gRNA sequence
tggagtctttctctgctgcc

SEQ ID NO: 42821 - DNA, 20 bp, Artificial
  CRISPR gRNA sequence
ggagtctttctctgctgccc

SEQ ID NO: 42822 - DNA, 20 bp, Artificial
  CRISPR gRNA sequence
tctttctctgctgcccaggc

SEQ ID NO: 42823 - DNA, 20 bp, Artificial
  CRISPR gRNA sequence
ctgctgcccaggctggaatg

SEQ ID NO: 42824 - DNA, 20 bp, Artificial
  CRISPR gRNA sequence
ctgcccaggctggaatgcag

SEQ ID NO: 42825 - DNA, 20 bp, Artificial
  CRISPR gRNA sequence
ggaatgcagtggcgcaattt

SEQ ID NO: 42826 - DNA, 20 bp, Artificial
  CRISPR gRNA sequence
tcactgcaacttccgcctcc

SEQ ID NO: 42827 - DNA, 20 bp, Artificial
  CRISPR gRNA sequence
cactgcaacttccgcctccc

SEQ ID NO: 42828 - DNA, 20 bp, Artificial
  CRISPR gRNA sequence
aacttccgcctcccaggttc

SEQ ID NO: 42829 - DNA, 20 bp, Artificial
  CRISPR gRNA sequence
ttcaagcaattctcctgcct

SEQ ID NO: 42830 - DNA, 20 bp, Artificial
  CRISPR gRNA sequence
ttctcctgcctcagcctccc

SEQ ID NO: 42831 - DNA, 20 bp, Artificial
  CRISPR gRNA sequence
tctcctgcctcagcctccca

SEQ ID NO: 42832 - DNA, 20 bp, Artificial
  CRISPR gRNA sequence
tcctgcctcagcctcccaag

SEQ ID NO: 42833 - DNA, 20 bp, Artificial
  CRISPR gRNA sequence
cctcagcctcccaaggagct

SEQ ID NO: 42834 - DNA, 20 bp, Artificial
  CRISPR gRNA sequence
ctcccaaggagctgagatta

SEQ ID NO: 42835 - DNA, 20 bp, Artificial
  CRISPR gRNA sequence
tcccaaggagctgagattac

SEQ ID NO: 42836 - DNA, 20 bp, Artificial
  CRISPR gRNA sequence
ggagctgagattacaggcat

SEQ ID NO: 42837 - DNA, 20 bp, Artificial
  CRISPR gRNA sequence
caggcatgagccaccatgcc

SEQ ID NO: 42838 - DNA, 20 bp, Artificial
  CRISPR gRNA sequence
ccaccatgcctggctaattt

SEQ ID NO: 42839 - DNA, 20 bp, Artificial
  CRISPR gRNA sequence
ctggctaattttggtatttt

SEQ ID NO: 42840 - DNA, 20 bp, Artificial
  CRISPR gRNA sequence
gctaattttggtatttttag

SEQ ID NO: 42841 - DNA, 20 bp, Artificial
  CRISPR gRNA sequence
taattttggtatttttagta

SEQ ID NO: 42842 - DNA, 20 bp, Artificial
  CRISPR gRNA sequence
tttggtatttttagtagaga

SEQ ID NO: 42843 - DNA, 20 bp, Artificial
  CRISPR gRNA sequence
ttggtatttttagtagagac

SEQ ID NO: 42844 - DNA, 20 bp, Artificial
  CRISPR gRNA sequence
tggtatttttagtagagacg

SEQ ID NO: 42845 - DNA, 20 bp, Artificial
  CRISPR gRNA sequence
gagacggggtttcaccatgt

SEQ ID NO: 42846 - DNA, 20 bp, Artificial
  CRISPR gRNA sequence
cggggtttcaccatgttggc

SEQ ID NO: 42847 - DNA, 20 bp, Artificial
  CRISPR gRNA sequence
ggggtttcaccatgttggcc

SEQ ID NO: 42848 - DNA, 20 bp, Artificial
  CRISPR gRNA sequence
tttcaccatgttggccaggc

SEQ ID NO: 42849 - DNA, 20 bp, Artificial
  CRISPR gRNA sequence
tggtcttgaactcctgacct

SEQ ID NO: 42850 - DNA, 20 bp, Artificial
  CRISPR gRNA sequence
ggtcttgaactcctgacctc

SEQ ID NO: 42851 - DNA, 20 bp, Artificial
  CRISPR gRNA sequence
ccgcctgcctcgccctccca

SEQ ID NO: 42852 - DNA, 20 bp, Artificial
  CRISPR gRNA sequence
gcctcgccctcccaaagtgc

SEQ ID NO: 42853 - DNA, 20 bp, Artificial
  CRISPR gRNA sequence
cctcgccctcccaaagtgct

SEQ ID NO: 42854 - DNA, 20 bp, Artificial
  CRISPR gRNA sequence
ctcccaaagtgctgggatta

SEQ ID NO: 42855 - DNA, 20 bp, Artificial
  CRISPR gRNA sequence
agtgctgggattacagcctt

SEQ ID NO: 42856 - DNA, 20 bp, Artificial
  CRISPR gRNA sequence
cagccttgagccaccgcacc

SEQ ID NO: 42857 - DNA, 20 bp, Artificial
  CRISPR gRNA sequence
agccaatttttcttatttta

SEQ ID NO: 42858 - DNA, 20 bp, Artificial
  CRISPR gRNA sequence
attttaaagactattttatt

SEQ ID NO: 42859 - DNA, 20 bp, Artificial
  CRISPR gRNA sequence
ttaaagactattttattaag

SEQ ID NO: 42860 - DNA, 20 bp, Artificial
  CRISPR gRNA sequence
attttattaagtggcttcat

SEQ ID NO: 42861 - DNA, 20 bp, Artificial
  CRISPR gRNA sequence
tattaagtggcttcataaga

SEQ ID NO: 42862 - DNA, 20 bp, Artificial
  CRISPR gRNA sequence
aatttttaaatgacgtttct

SEQ ID NO: 42863 - DNA, 20 bp, Artificial
  CRISPR gRNA sequence
atttttaaatgacgtttctc

SEQ ID NO: 42864 - DNA, 20 bp, Artificial
  CRISPR gRNA sequence
taaatgacgtttctcaggaa

SEQ ID NO: 42865 - DNA, 20 bp, Artificial
  CRISPR gRNA sequence
aacaaacatcaaaaatgtca

SEQ ID NO: 42866 - DNA, 20 bp, Artificial
  CRISPR gRNA sequence
catcaaaaatgtcacagacc

SEQ ID NO: 42867 - DNA, 20 bp, Artificial
  CRISPR gRNA sequence
atcaaaaatgtcacagacct

SEQ ID NO: 42868 - DNA, 20 bp, Artificial
  CRISPR gRNA sequence
caaaaatgtcacagacctag

SEQ ID NO: 42869 - DNA, 20 bp, Artificial
  CRISPR gRNA sequence
aaaaatgtcacagacctagg

SEQ ID NO: 42870 - DNA, 20 bp, Artificial
  CRISPR gRNA sequence
cacagacctaggaggaaaat

SEQ ID NO: 42871 - DNA, 20 bp, Artificial
  CRISPR gRNA sequence
aggaggaaaatcagatgttc

SEQ ID NO: 42872 - DNA, 20 bp, Artificial
  CRISPR gRNA sequence
ggaggaaaatcagatgttcc

SEQ ID NO: 42873 - DNA, 20 bp, Artificial
  CRISPR gRNA sequence
tcagatgttccgggacacac

SEQ ID NO: 42874 - DNA, 20 bp, Artificial
  CRISPR gRNA sequence
ttatattatttctgaaactg

SEQ ID NO: 42875 - DNA, 20 bp, Artificial
  CRISPR gRNA sequence
tctgaaactgtagttaaaac

SEQ ID NO: 42876 - DNA, 20 bp, Artificial
  CRISPR gRNA sequence
aaactgtagttaaaactagc

SEQ ID NO: 42877 - DNA, 20 bp, Artificial
  CRISPR gRNA sequence
aactgtagttaaaactagct

SEQ ID NO: 42878 - DNA, 20 bp, Artificial
  CRISPR gRNA sequence
tagttaaaactagctgggcg

SEQ ID NO: 42879 - DNA, 20 bp, Artificial
  CRISPR gRNA sequence
ttaaaactagctgggcgtgg

SEQ ID NO: 42880 - DNA, 20 bp, Artificial
  CRISPR gRNA sequence
gtggctcacgcctgtaatcc

SEQ ID NO: 42881 - DNA, 20 bp, Artificial
  CRISPR gRNA sequence
cgcctgtaatcccagcactt

SEQ ID NO: 42882 - DNA, 20 bp, Artificial
  CRISPR gRNA sequence
gcctgtaatcccagcacttt

SEQ ID NO: 42883 - DNA, 20 bp, Artificial
  CRISPR gRNA sequence
ctgtaatcccagcactttgg

SEQ ID NO: 42884 - DNA, 20 bp, Artificial
  CRISPR gRNA sequence
tgtaatcccagcactttggg

SEQ ID NO: 42885 - DNA, 20 bp, Artificial
  CRISPR gRNA sequence
cccagcactttgggaggcca

SEQ ID NO: 42886 - DNA, 20 bp, Artificial
  CRISPR gRNA sequence
agcactttgggaggccaaag

SEQ ID NO: 42887 - DNA, 20 bp, Artificial
  CRISPR gRNA sequence
gcactttgggaggccaaagc

SEQ ID NO: 42888 - DNA, 20 bp, Artificial
  CRISPR gRNA sequence
ctttgggaggccaaagcggg

SEQ ID NO: 42889 - DNA, 20 bp, Artificial
  CRISPR gRNA sequence
ccaaagcgggtggatcacct

SEQ ID NO: 42890 - DNA, 20 bp, Artificial
  CRISPR gRNA sequence
caaagcgggtggatcacctg

SEQ ID NO: 42891 - DNA, 20 bp, Artificial
  CRISPR gRNA sequence
gcgggtggatcacctgaggt

SEQ ID NO: 42892 - DNA, 20 bp, Artificial
  CRISPR gRNA sequence
cgggtggatcacctgaggtc

SEQ ID NO: 42893 - DNA, 20 bp, Artificial
  CRISPR gRNA sequence
ggtggatcacctgaggtcag

SEQ ID NO: 42894 - DNA, 20 bp, Artificial
  CRISPR gRNA sequence
tcacctgaggtcaggagttt

SEQ ID NO: 42895 - DNA, 20 bp, Artificial
  CRISPR gRNA sequence
tgaggtcaggagtttgagac

SEQ ID NO: 42896 - DNA, 20 bp, Artificial
  CRISPR gRNA sequence
tgagaccagcctgatcaaca

SEQ ID NO: 42897 - DNA, 20 bp, Artificial
  CRISPR gRNA sequence
actaaaaatacaaaaataat

SEQ ID NO: 42898 - DNA, 20 bp, Artificial
  CRISPR gRNA sequence
aaaatacaaaaataattagc

SEQ ID NO: 42899 - DNA, 20 bp, Artificial
  CRISPR gRNA sequence
aaatacaaaaataattagcc

SEQ ID NO: 42900 - DNA, 20 bp, Artificial
  CRISPR gRNA sequence
caaaaataattagccaggca

SEQ ID NO: 42901 - DNA, 20 bp, Artificial
  CRISPR gRNA sequence
aaataattagccaggcatag

SEQ ID NO: 42902 - DNA, 20 bp, Artificial
  CRISPR gRNA sequence
gtggcacatgcctgtaatcc

SEQ ID NO: 42903 - DNA, 20 bp, Artificial
  CRISPR gRNA sequence
tgcctgtaatcccagctact

SEQ ID NO: 42904 - DNA, 20 bp, Artificial
  CRISPR gRNA sequence
gcctgtaatcccagctactt

SEQ ID NO: 42905 - DNA, 20 bp, Artificial
  CRISPR gRNA sequence
ctgtaatcccagctacttgg

SEQ ID NO: 42906 - DNA, 20 bp, Artificial
  CRISPR gRNA sequence
tgtaatcccagctacttggg

SEQ ID NO: 42907 - DNA, 20 bp, Artificial
  CRISPR gRNA sequence
tcccagctacttgggaggct

SEQ ID NO: 42908 - DNA, 20 bp, Artificial
  CRISPR gRNA sequence
cccagctacttgggaggctg

SEQ ID NO: 42909 - DNA, 20 bp, Artificial
  CRISPR gRNA sequence
agctacttgggaggctgagg

SEQ ID NO: 42910 - DNA, 20 bp, Artificial
  CRISPR gRNA sequence
gctacttgggaggctgaggc

SEQ ID NO: 42911 - DNA, 20 bp, Artificial
  CRISPR gRNA sequence
tacttgggaggctgaggcag

SEQ ID NO: 42912 - DNA, 20 bp, Artificial
  CRISPR gRNA sequence
gcaggagaatctcttgaacc

SEQ ID NO: 42913 - DNA, 20 bp, Artificial
  CRISPR gRNA sequence
caggagaatctcttgaacct

SEQ ID NO: 42914 - DNA, 20 bp, Artificial
  CRISPR gRNA sequence
ggagaatctcttgaacctgg

SEQ ID NO: 42915 - DNA, 20 bp, Artificial
  CRISPR gRNA sequence
aatctcttgaacctgggaga

SEQ ID NO: 42916 - DNA, 20 bp, Artificial
  CRISPR gRNA sequence
tctcttgaacctgggagaca

SEQ ID NO: 42917 - DNA, 20 bp, Artificial
  CRISPR gRNA sequence
ctcttgaacctgggagacag

SEQ ID NO: 42918 - DNA, 20 bp, Artificial
  CRISPR gRNA sequence
aacctgggagacagaggtcg

SEQ ID NO: 42919 - DNA, 20 bp, Artificial
  CRISPR gRNA sequence
tgggagacagaggtcgcagt

SEQ ID NO: 42920 - DNA, 20 bp, Artificial
  CRISPR gRNA sequence
gacagaggtcgcagtgagcc

SEQ ID NO: 42921 - DNA, 20 bp, Artificial
  CRISPR gRNA sequence
aagatcgtgccattgcactc

SEQ ID NO: 42922 - DNA, 20 bp, Artificial
  CRISPR gRNA sequence
cgtgccattgcactccagcc

SEQ ID NO: 42923 - DNA, 20 bp, Artificial
  CRISPR gRNA sequence
gtgccattgcactccagcct

SEQ ID NO: 42924 - DNA, 20 bp, Artificial
  CRISPR gRNA sequence
ttgcactccagcctgggcaa

SEQ ID NO: 42925 - DNA, 20 bp, Artificial
  CRISPR gRNA sequence
gcactccagcctgggcaaca

SEQ ID NO: 42926 - DNA, 20 bp, Artificial
  CRISPR gRNA sequence
tccagcctgggcaacagagc

SEQ ID NO: 42927 - DNA, 20 bp, Artificial
  CRISPR gRNA sequence
taaataaataaataaaacca

SEQ ID NO: 42928 - DNA, 20 bp, Artificial
  CRISPR gRNA sequence
aaccacagaatgctgcaatg

SEQ ID NO: 42929 - DNA, 20 bp, Artificial
  CRISPR gRNA sequence
accacagaatgctgcaatga

SEQ ID NO: 42930 - DNA, 20 bp, Artificial
  CRISPR gRNA sequence
ccacagaatgctgcaatgaa

SEQ ID NO: 42931 - DNA, 20 bp, Artificial
  CRISPR gRNA sequence
cagaatgctgcaatgaaggg

SEQ ID NO: 42932 - DNA, 20 bp, Artificial
  CRISPR gRNA sequence
atgctgcaatgaagggaagt

SEQ ID NO: 42933 - DNA, 20 bp, Artificial
  CRISPR gRNA sequence
tgaagggaagtaagaaactt

SEQ ID NO: 42934 - DNA, 20 bp, Artificial
  CRISPR gRNA sequence
gaagggaagtaagaaacttc

SEQ ID NO: 42935 - DNA, 20 bp, Artificial
  CRISPR gRNA sequence
ggaagtaagaaacttcaggt

SEQ ID NO: 42936 - DNA, 20 bp, Artificial
  CRISPR gRNA sequence
gaagtaagaaacttcaggtg

SEQ ID NO: 42937 - DNA, 20 bp, Artificial
  CRISPR gRNA sequence
caatattgatattgcattcc

SEQ ID NO: 42938 - DNA, 20 bp, Artificial
  CRISPR gRNA sequence
atattgcattcccagattaa

SEQ ID NO: 42939 - DNA, 20 bp, Artificial
  CRISPR gRNA sequence
ttgcattcccagattaaaag

SEQ ID NO: 42940 - DNA, 20 bp, Artificial
  CRISPR gRNA sequence
agattaaaagaagaaatcta

SEQ ID NO: 42941 - DNA, 20 bp, Artificial
  CRISPR gRNA sequence
gattaaaagaagaaatctat

SEQ ID NO: 42942 - DNA, 20 bp, Artificial
  CRISPR gRNA sequence
ttcctctcattcaaaaactg

SEQ ID NO: 42943 - DNA, 20 bp, Artificial
  CRISPR gRNA sequence
ctgtggatcccaaatgatgc

SEQ ID NO: 42944 - DNA, 20 bp, Artificial
  CRISPR gRNA sequence
gatcccaaatgatgccggcc

SEQ ID NO: 42945 - DNA, 20 bp, Artificial
  CRISPR gRNA sequence
atcccaaatgatgccggcca

SEQ ID NO: 42946 - DNA, 20 bp, Artificial
  CRISPR gRNA sequence
tcccaaatgatgccggccaa

SEQ ID NO: 42947 - DNA, 20 bp, Artificial
  CRISPR gRNA sequence
aatgatgccggccaagggcg

SEQ ID NO: 42948 - DNA, 20 bp, Artificial
  CRISPR gRNA sequence
tgccggccaagggcgtggtg

SEQ ID NO: 42949 - DNA, 20 bp, Artificial
  CRISPR gRNA sequence
gccggccaagggcgtggtga

SEQ ID NO: 42950 - DNA, 20 bp, Artificial
  CRISPR gRNA sequence
agggcgtggtgaaggcaaat

SEQ ID NO: 42951 - DNA, 20 bp, Artificial
  CRISPR gRNA sequence
ggtttttctttaacccttga

SEQ ID NO: 42952 - DNA, 20 bp, Artificial
  CRISPR gRNA sequence
tttaacccttgaaagcctgc

SEQ ID NO: 42953 - DNA, 20 bp, Artificial
  CRISPR gRNA sequence
taacccttgaaagcctgctg

SEQ ID NO: 42954 - DNA, 20 bp, Artificial
  CRISPR gRNA sequence
aacccttgaaagcctgctgg

SEQ ID NO: 42955 - DNA, 20 bp, Artificial
  CRISPR gRNA sequence
aaagcctgctggaggcacct

SEQ ID NO: 42956 - DNA, 20 bp, Artificial
  CRISPR gRNA sequence
gctggaggcacctgagctat

SEQ ID NO: 42957 - DNA, 20 bp, Artificial
  CRISPR gRNA sequence
ggaggcacctgagctatgag

SEQ ID NO: 42958 - DNA, 20 bp, Artificial
  CRISPR gRNA sequence
ctatgagtggtcacccgata

SEQ ID NO: 42959 - DNA, 20 bp, Artificial
  CRISPR gRNA sequence
tgagtggtcacccgatatgg

SEQ ID NO: 42960 - DNA, 20 bp, Artificial
  CRISPR gRNA sequence
agtggtcacccgatatggaa

SEQ ID NO: 42961 - DNA, 20 bp, Artificial
  CRISPR gRNA sequence
gtggtcacccgatatggaag

SEQ ID NO: 42962 - DNA, 20 bp, Artificial
  CRISPR gRNA sequence
acccgatatggaagaggacc

SEQ ID NO: 42963 - DNA, 20 bp, Artificial
  CRISPR gRNA sequence
ccgatatggaagaggaccaa

SEQ ID NO: 42964 - DNA, 20 bp, Artificial
  CRISPR gRNA sequence
cgatatggaagaggaccaag

SEQ ID NO: 42965 - DNA, 20 bp, Artificial
  CRISPR gRNA sequence
atggaagaggaccaagagga

SEQ ID NO: 42966 - DNA, 20 bp, Artificial
  CRISPR gRNA sequence
tggaagaggaccaagaggat

SEQ ID NO: 42967 - DNA, 20 bp, Artificial
  CRISPR gRNA sequence
ccaagaggatgggtttactg

SEQ ID NO: 42968 - DNA, 20 bp, Artificial
  CRISPR gRNA sequence
ggatgggtttactgtggtgc

SEQ ID NO: 42969 - DNA, 20 bp, Artificial
  CRISPR gRNA sequence
gatgggtttactgtggtgct

SEQ ID NO: 42970 - DNA, 20 bp, Artificial
  CRISPR gRNA sequence
atgggtttactgtggtgctg

SEQ ID NO: 42971 - DNA, 20 bp, Artificial
  CRISPR gRNA sequence
gggtttactgtggtgctggg

SEQ ID NO: 42972 - DNA, 20 bp, Artificial
  CRISPR gRNA sequence
ggtttactgtggtgctgggg

SEQ ID NO: 42973 - DNA, 20 bp, Artificial
  CRISPR gRNA sequence
gtttactgtggtgctgggga

SEQ ID NO: 42974 - DNA, 20 bp, Artificial
  CRISPR gRNA sequence
tttactgtggtgctggggag

SEQ ID NO: 42975 - DNA, 20 bp, Artificial
  CRISPR gRNA sequence
ctgtggtgctggggagggga

SEQ ID NO: 42976 - DNA, 20 bp, Artificial
  CRISPR gRNA sequence
tggtgctggggaggggatag

SEQ ID NO: 42977 - DNA, 20 bp, Artificial
  CRISPR gRNA sequence
tgctggggaggggatagtag

SEQ ID NO: 42978 - DNA, 20 bp, Artificial
  CRISPR gRNA sequence
ctggggaggggatagtagca

SEQ ID NO: 42979 - DNA, 20 bp, Artificial
  CRISPR gRNA sequence
ggggatagtagcagagaacg

SEQ ID NO: 42980 - DNA, 20 bp, Artificial
  CRISPR gRNA sequence
gggatagtagcagagaacgt

SEQ ID NO: 42981 - DNA, 20 bp, Artificial
  CRISPR gRNA sequence
gatagtagcagagaacgtag

SEQ ID NO: 42982 - DNA, 20 bp, Artificial
  CRISPR gRNA sequence
gcagagaacgtaggagttgc

SEQ ID NO: 42983 - DNA, 20 bp, Artificial
  CRISPR gRNA sequence
gtaggagttgctggtcattc

SEQ ID NO: 42984 - DNA, 20 bp, Artificial
  CRISPR gRNA sequence
ggagttgctggtcattctag

SEQ ID NO: 42985 - DNA, 20 bp, Artificial
  CRISPR gRNA sequence
gctggtcattctagtggtga

SEQ ID NO: 42986 - DNA, 20 bp, Artificial
  CRISPR gRNA sequence
ggtcattctagtggtgatgg

SEQ ID NO: 42987 - DNA, 20 bp, Artificial
  CRISPR gRNA sequence
gtcattctagtggtgatgga

SEQ ID NO: 42988 - DNA, 20 bp, Artificial
  CRISPR gRNA sequence
tcattctagtggtgatggaa

SEQ ID NO: 42989 - DNA, 20 bp, Artificial
  CRISPR gRNA sequence
tctagtggtgatggaaggga

SEQ ID NO: 42990 - DNA, 20 bp, Artificial
  CRISPR gRNA sequence
ggtgatggaagggatggtga

SEQ ID NO: 42991 - DNA, 20 bp, Artificial
  CRISPR gRNA sequence
gatggaagggatggtgatgg

SEQ ID NO: 42992 - DNA, 20 bp, Artificial
  CRISPR gRNA sequence
agggatggtgatggtggtac

SEQ ID NO: 42993 - DNA, 20 bp, Artificial
  CRISPR gRNA sequence
gggatggtgatggtggtact

SEQ ID NO: 42994 - DNA, 20 bp, Artificial
  CRISPR gRNA sequence
ggtgatggtggtactgggct

SEQ ID NO: 42995 - DNA, 20 bp, Artificial
  CRISPR gRNA sequence
gatggtggtactgggcttgg

SEQ ID NO: 42996 - DNA, 20 bp, Artificial
  CRISPR gRNA sequence
tggtactgggcttggtggtg

SEQ ID NO: 42997 - DNA, 20 bp, Artificial
  CRISPR gRNA sequence
ggcttggtggtgtagaattg

SEQ ID NO: 42998 - DNA, 20 bp, Artificial
  CRISPR gRNA sequence
tagaattgtggtgataatga

SEQ ID NO: 42999 - DNA, 20 bp, Artificial
  CRISPR gRNA sequence
aattgtggtgataatgaaag

SEQ ID NO: 43000 - DNA, 20 bp, Artificial
  CRISPR gRNA sequence
tgtggtgataatgaaagtgg

SEQ ID NO: 43001 - DNA, 20 bp, Artificial
  CRISPR gRNA sequence
ggtgataatgaaagtggtgg

SEQ ID NO: 43002 - DNA, 20 bp, Artificial
  CRISPR gRNA sequence
aatgaaagtggtggtggtga

SEQ ID NO: 43003 - DNA, 20 bp, Artificial
  CRISPR gRNA sequence
gaaagtggtggtggtgatgg

SEQ ID NO: 43004 - DNA, 20 bp, Artificial
  CRISPR gRNA sequence
ggtggtgatggtggtaatac

SEQ ID NO: 43005 - DNA, 20 bp, Artificial
  CRISPR gRNA sequence
ggtgatggtggtaatactgg

SEQ ID NO: 43006 - DNA, 20 bp, Artificial
  CRISPR gRNA sequence
gatggtggtaatactggtgg

SEQ ID NO: 43007 - DNA, 20 bp, Artificial
  CRISPR gRNA sequence
aatactggtggtggtgacat

SEQ ID NO: 43008 - DNA, 20 bp, Artificial
  CRISPR gRNA sequence
actggtggtggtgacattgg

SEQ ID NO: 43009 - DNA, 20 bp, Artificial
  CRISPR gRNA sequence
ggtggtggtgacattggtgg

SEQ ID NO: 43010 - DNA, 20 bp, Artificial
  CRISPR gRNA sequence
ggtggtgacattggtggtgg

SEQ ID NO: 43011 - DNA, 20 bp, Artificial
  CRISPR gRNA sequence
gacattggtggtggtggtga

SEQ ID NO: 43012 - DNA, 20 bp, Artificial
  CRISPR gRNA sequence
attggtggtggtggtgatgg

SEQ ID NO: 43013 - DNA, 20 bp, Artificial
  CRISPR gRNA sequence
ggtggtgatggtggtgatac

SEQ ID NO: 43014 - DNA, 20 bp, Artificial
  CRISPR gRNA sequence
gatggtggtgatactggtga

SEQ ID NO: 43015 - DNA, 20 bp, Artificial
  CRISPR gRNA sequence
ggtggtgatactggtgatgg

SEQ ID NO: 43016 - DNA, 20 bp, Artificial
  CRISPR gRNA sequence
gatactggtgatggtggtga

SEQ ID NO: 43017 - DNA, 20 bp, Artificial
  CRISPR gRNA sequence
actggtgatggtggtgatgg

SEQ ID NO: 43018 - DNA, 20 bp, Artificial
  CRISPR gRNA sequence
ggtgatggtggtgatggtgg

SEQ ID NO: 43019 - DNA, 20 bp, Artificial
  CRISPR gRNA sequence
ggtggtgatggtggtggcgc

SEQ ID NO: 43020 - DNA, 20 bp, Artificial
  CRISPR gRNA sequence
tggcgctggtgaccctgaca

SEQ ID NO: 43021 - DNA, 20 bp, Artificial
  CRISPR gRNA sequence
ggcgctggtgaccctgacat

SEQ ID NO: 43022 - DNA, 20 bp, Artificial
  CRISPR gRNA sequence
gcgctggtgaccctgacatg

SEQ ID NO: 43023 - DNA, 20 bp, Artificial
  CRISPR gRNA sequence
ggtgaccctgacatggggtc

SEQ ID NO: 43024 - DNA, 20 bp, Artificial
  CRISPR gRNA sequence
gaccctgacatggggtccag

SEQ ID NO: 43025 - DNA, 20 bp, Artificial
  CRISPR gRNA sequence
cctgacatggggtccagtag

SEQ ID NO: 43026 - DNA, 20 bp, Artificial
  CRISPR gRNA sequence
atggggtccagtagcagtga

SEQ ID NO: 43027 - DNA, 20 bp, Artificial
  CRISPR gRNA sequence
gggtccagtagcagtgacag

SEQ ID NO: 43028 - DNA, 20 bp, Artificial
  CRISPR gRNA sequence
agtagcagtgacagtggatg

SEQ ID NO: 43029 - DNA, 20 bp, Artificial
  CRISPR gRNA sequence
gtagcagtgacagtggatgc

SEQ ID NO: 43030 - DNA, 20 bp, Artificial
  CRISPR gRNA sequence
tgacagtggatgcaggctcc

SEQ ID NO: 43031 - DNA, 20 bp, Artificial
  CRISPR gRNA sequence
gatgcaggctcctggtgact

SEQ ID NO: 43032 - DNA, 20 bp, Artificial
  CRISPR gRNA sequence
atgcaggctcctggtgactg

SEQ ID NO: 43033 - DNA, 20 bp, Artificial
  CRISPR gRNA sequence
gcaggctcctggtgactgag

SEQ ID NO: 43034 - DNA, 20 bp, Artificial
  CRISPR gRNA sequence
ctggtgactgaggagcatct

SEQ ID NO: 43035 - DNA, 20 bp, Artificial
  CRISPR gRNA sequence
tggtgactgaggagcatctc

SEQ ID NO: 43036 - DNA, 20 bp, Artificial
  CRISPR gRNA sequence
actgaggagcatctcaggct

SEQ ID NO: 43037 - DNA, 20 bp, Artificial
  CRISPR gRNA sequence
ctgaggagcatctcaggctg

SEQ ID NO: 43038 - DNA, 20 bp, Artificial
  CRISPR gRNA sequence
gaggagcatctcaggctgag

SEQ ID NO: 43039 - DNA, 20 bp, Artificial
  CRISPR gRNA sequence
aggagcatctcaggctgagg

SEQ ID NO: 43040 - DNA, 20 bp, Artificial
  CRISPR gRNA sequence
ccactgctccttacccccta

SEQ ID NO: 43041 - DNA, 20 bp, Artificial
  CRISPR gRNA sequence
ccttaccccctacagtctct

SEQ ID NO: 43042 - DNA, 20 bp, Artificial
  CRISPR gRNA sequence
cagtctctcagcaaacctgc

SEQ ID NO: 43043 - DNA, 20 bp, Artificial
  CRISPR gRNA sequence
agtctctcagcaaacctgct

SEQ ID NO: 43044 - DNA, 20 bp, Artificial
  CRISPR gRNA sequence
tcagcaaacctgctgggcga

SEQ ID NO: 43045 - DNA, 20 bp, Artificial
  CRISPR gRNA sequence
gcaaacctgctgggcgacag

SEQ ID NO: 43046 - DNA, 20 bp, Artificial
  CRISPR gRNA sequence
ctgctgggcgacagcggact

SEQ ID NO: 43047 - DNA, 20 bp, Artificial
  CRISPR gRNA sequence
cagcggactcagatgccttc

SEQ ID NO: 43048 - DNA, 20 bp, Artificial
  CRISPR gRNA sequence
gccttctggaatgtctgccg

SEQ ID NO: 43049 - DNA, 20 bp, Artificial
  CRISPR gRNA sequence
ccttctggaatgtctgccgc

SEQ ID NO: 43050 - DNA, 20 bp, Artificial
  CRISPR gRNA sequence
ctgccgcaggtgcccatctc

SEQ ID NO: 43051 - DNA, 20 bp, Artificial
  CRISPR gRNA sequence
tgcccatctccggtttgctt

SEQ ID NO: 43052 - DNA, 20 bp, Artificial
  CRISPR gRNA sequence
catctccggtttgcttgagt

SEQ ID NO: 43053 - DNA, 20 bp, Artificial
  CRISPR gRNA sequence
ctccggtttgcttgagtaag

SEQ ID NO: 43054 - DNA, 20 bp, Artificial
  CRISPR gRNA sequence
ggtttgcttgagtaagtgga

SEQ ID NO: 43055 - DNA, 20 bp, Artificial
  CRISPR gRNA sequence
ttgcttgagtaagtggaaag

SEQ ID NO: 43056 - DNA, 20 bp, Artificial
  CRISPR gRNA sequence
agtaagtggaaagcagcata

SEQ ID NO: 43057 - DNA, 20 bp, Artificial
  CRISPR gRNA sequence
gtaagtggaaagcagcataa

SEQ ID NO: 43058 - DNA, 20 bp, Artificial
  CRISPR gRNA sequence
gtggaaagcagcataaagga

SEQ ID NO: 43059 - DNA, 20 bp, Artificial
  CRISPR gRNA sequence
aaagcagcataaaggacaga

SEQ ID NO: 43060 - DNA, 20 bp, Artificial
  CRISPR gRNA sequence
cagcataaaggacagatagc

SEQ ID NO: 43061 - DNA, 20 bp, Artificial
  CRISPR gRNA sequence
agcataaaggacagatagca

SEQ ID NO: 43062 - DNA, 20 bp, Artificial
  CRISPR gRNA sequence
cataaaggacagatagcaag

SEQ ID NO: 43063 - DNA, 20 bp, Artificial
  CRISPR gRNA sequence
ataaaggacagatagcaagg

SEQ ID NO: 43064 - DNA, 20 bp, Artificial
  CRISPR gRNA sequence
aaggacagatagcaaggagg

SEQ ID NO: 43065 - DNA, 20 bp, Artificial
  CRISPR gRNA sequence
aggacagatagcaaggagga

SEQ ID NO: 43066 - DNA, 20 bp, Artificial
  CRISPR gRNA sequence
agcaaggaggaaggctcccc

SEQ ID NO: 43067 - DNA, 20 bp, Artificial
  CRISPR gRNA sequence
gcaaggaggaaggctcccct

SEQ ID NO: 43068 - DNA, 20 bp, Artificial
  CRISPR gRNA sequence
ggaaggctcccctaggccaa

SEQ ID NO: 43069 - DNA, 20 bp, Artificial
  CRISPR gRNA sequence
cccctaggccaaaagcatga

SEQ ID NO: 43070 - DNA, 20 bp, Artificial
  CRISPR gRNA sequence
ccctaggccaaaagcatgat

SEQ ID NO: 43071 - DNA, 20 bp, Artificial
  CRISPR gRNA sequence
cctaggccaaaagcatgatg

SEQ ID NO: 43072 - DNA, 20 bp, Artificial
  CRISPR gRNA sequence
ctaggccaaaagcatgatgg

SEQ ID NO: 43073 - DNA, 20 bp, Artificial
  CRISPR gRNA sequence
gcatgatgggggctccttct

SEQ ID NO: 43074 - DNA, 20 bp, Artificial
  CRISPR gRNA sequence
catgatgggggctccttctg

SEQ ID NO: 43075 - DNA, 20 bp, Artificial
  CRISPR gRNA sequence
atgatgggggctccttctga

SEQ ID NO: 43076 - DNA, 20 bp, Artificial
  CRISPR gRNA sequence
ctccttctgagggcatcccc

SEQ ID NO: 43077 - DNA, 20 bp, Artificial
  CRISPR gRNA sequence
ccttctgagggcatccccca

SEQ ID NO: 43078 - DNA, 20 bp, Artificial
  CRISPR gRNA sequence
gagggcatcccccagagcac

SEQ ID NO: 43079 - DNA, 20 bp, Artificial
  CRISPR gRNA sequence
gggcatcccccagagcacca

SEQ ID NO: 43080 - DNA, 20 bp, Artificial
  CRISPR gRNA sequence
ggcatcccccagagcaccag

SEQ ID NO: 43081 - DNA, 20 bp, Artificial
  CRISPR gRNA sequence
cccccagagcaccagaggac

SEQ ID NO: 43082 - DNA, 20 bp, Artificial
  CRISPR gRNA sequence
ccccagagcaccagaggaca

SEQ ID NO: 43083 - DNA, 20 bp, Artificial
  CRISPR gRNA sequence
gcaccagaggacaaggactg

SEQ ID NO: 43084 - DNA, 20 bp, Artificial
  CRISPR gRNA sequence
accagaggacaaggactgtg

SEQ ID NO: 43085 - DNA, 20 bp, Artificial
  CRISPR gRNA sequence
ccagaggacaaggactgtgg

SEQ ID NO: 43086 - DNA, 20 bp, Artificial
  CRISPR gRNA sequence
cagaggacaaggactgtgga

SEQ ID NO: 43087 - DNA, 20 bp, Artificial
  CRISPR gRNA sequence
ggacaaggactgtggagggc

SEQ ID NO: 43088 - DNA, 20 bp, Artificial
  CRISPR gRNA sequence
gacaaggactgtggagggca

SEQ ID NO: 43089 - DNA, 20 bp, Artificial
  CRISPR gRNA sequence
acaaggactgtggagggcaa

SEQ ID NO: 43090 - DNA, 20 bp, Artificial
  CRISPR gRNA sequence
caaggactgtggagggcaag

SEQ ID NO: 43091 - DNA, 20 bp, Artificial
  CRISPR gRNA sequence
ttcccttgccttcactcccc

SEQ ID NO: 43092 - DNA, 20 bp, Artificial
  CRISPR gRNA sequence
tgccttcactcccctggcct

SEQ ID NO: 43093 - DNA, 20 bp, Artificial
  CRISPR gRNA sequence
gccttcactcccctggcctt

SEQ ID NO: 43094 - DNA, 20 bp, Artificial
  CRISPR gRNA sequence
tctgtccctcacacccacca

SEQ ID NO: 43095 - DNA, 20 bp, Artificial
  CRISPR gRNA sequence
ctgtccctcacacccaccat

SEQ ID NO: 43096 - DNA, 20 bp, Artificial
  CRISPR gRNA sequence
tccctcacacccaccatggg

SEQ ID NO: 43097 - DNA, 20 bp, Artificial
  CRISPR gRNA sequence
agatcctccaccaaacaccc

SEQ ID NO: 43098 - DNA, 20 bp, Artificial
  CRISPR gRNA sequence
atcctccaccaaacacccaa

SEQ ID NO: 43099 - DNA, 20 bp, Artificial
  CRISPR gRNA sequence
cctccaccaaacacccaaga

SEQ ID NO: 43100 - DNA, 20 bp, Artificial
  CRISPR gRNA sequence
ctccaccaaacacccaagag

SEQ ID NO: 43101 - DNA, 20 bp, Artificial
  CRISPR gRNA sequence
ccaagagaggctgtgattcg

SEQ ID NO: 43102 - DNA, 20 bp, Artificial
  CRISPR gRNA sequence
agagaggctgtgattcgtgg

SEQ ID NO: 43103 - DNA, 20 bp, Artificial
  CRISPR gRNA sequence
gagaggctgtgattcgtggc

SEQ ID NO: 43104 - DNA, 20 bp, Artificial
  CRISPR gRNA sequence
agaggctgtgattcgtggca

SEQ ID NO: 43105 - DNA, 20 bp, Artificial
  CRISPR gRNA sequence
ggcagggtgacacaccccta

SEQ ID NO: 43106 - DNA, 20 bp, Artificial
  CRISPR gRNA sequence
cccctacagccaaactgacc

SEQ ID NO: 43107 - DNA, 20 bp, Artificial
  CRISPR gRNA sequence
ccctacagccaaactgacct

SEQ ID NO: 43108 - DNA, 20 bp, Artificial
  CRISPR gRNA sequence
cctacagccaaactgacctg

SEQ ID NO: 43109 - DNA, 20 bp, Artificial
  CRISPR gRNA sequence
cagccaaactgacctgggga

SEQ ID NO: 43110 - DNA, 20 bp, Artificial
  CRISPR gRNA sequence
agccaaactgacctggggac

SEQ ID NO: 43111 - DNA, 20 bp, Artificial
  CRISPR gRNA sequence
gccaaactgacctggggaca

SEQ ID NO: 43112 - DNA, 20 bp, Artificial
  CRISPR gRNA sequence
aaactgacctggggacaggg

SEQ ID NO: 43113 - DNA, 20 bp, Artificial
  CRISPR gRNA sequence
agcaacattccatccccaac

SEQ ID NO: 43114 - DNA, 20 bp, Artificial
  CRISPR gRNA sequence
ccatccccaaccagctgatg

SEQ ID NO: 43115 - DNA, 20 bp, Artificial
  CRISPR gRNA sequence
catccccaaccagctgatgc

SEQ ID NO: 43116 - DNA, 20 bp, Artificial
  CRISPR gRNA sequence
aaccagctgatgcgggattg

SEQ ID NO: 43117 - DNA, 20 bp, Artificial
  CRISPR gRNA sequence
gatgcgggattgcagctgcc

SEQ ID NO: 43118 - DNA, 20 bp, Artificial
  CRISPR gRNA sequence
gattgcagctgcctggctcc

SEQ ID NO: 43119 - DNA, 20 bp, Artificial
  CRISPR gRNA sequence
aattcttctgacccaatctg

SEQ ID NO: 43120 - DNA, 20 bp, Artificial
  CRISPR gRNA sequence
caatctgtggaacataaatg

SEQ ID NO: 43121 - DNA, 20 bp, Artificial
  CRISPR gRNA sequence
atctgtggaacataaatgtg

SEQ ID NO: 43122 - DNA, 20 bp, Artificial
  CRISPR gRNA sequence
taaatgtggagatgtccctg

SEQ ID NO: 43123 - DNA, 20 bp, Artificial
  CRISPR gRNA sequence
atgtggagatgtccctgtgg

SEQ ID NO: 43124 - DNA, 20 bp, Artificial
  CRISPR gRNA sequence
tgtggagatgtccctgtggc

SEQ ID NO: 43125 - DNA, 20 bp, Artificial
  CRISPR gRNA sequence
gagatgtccctgtggcaggc

SEQ ID NO: 43126 - DNA, 20 bp, Artificial
  CRISPR gRNA sequence
agatgtccctgtggcaggca

SEQ ID NO: 43127 - DNA, 20 bp, Artificial
  CRISPR gRNA sequence
gatgtccctgtggcaggcaa

SEQ ID NO: 43128 - DNA, 20 bp, Artificial
  CRISPR gRNA sequence
atgtccctgtggcaggcaag

SEQ ID NO: 43129 - DNA, 20 bp, Artificial
  CRISPR gRNA sequence
ctgtggcaggcaaggggcct

SEQ ID NO: 43130 - DNA, 20 bp, Artificial
  CRISPR gRNA sequence
tgtggcaggcaaggggcctt

SEQ ID NO: 43131 - DNA, 20 bp, Artificial
  CRISPR gRNA sequence
ggcaggcaaggggccttagg

SEQ ID NO: 43132 - DNA, 20 bp, Artificial
  CRISPR gRNA sequence
gccttaggaagtcatccaca

SEQ ID NO: 43133 - DNA, 20 bp, Artificial
  CRISPR gRNA sequence
ccatctctcccgtgacctgc

SEQ ID NO: 43134 - DNA, 20 bp, Artificial
  CRISPR gRNA sequence
atctctcccgtgacctgctg

SEQ ID NO: 43135 - DNA, 20 bp, Artificial
  CRISPR gRNA sequence
cccgtgacctgctggagtga

SEQ ID NO: 43136 - DNA, 20 bp, Artificial
  CRISPR gRNA sequence
tgacctgctggagtgacagc

SEQ ID NO: 43137 - DNA, 20 bp, Artificial
  CRISPR gRNA sequence
gctggagtgacagccagctc

SEQ ID NO: 43138 - DNA, 20 bp, Artificial
  CRISPR gRNA sequence
ctggagtgacagccagctcc

SEQ ID NO: 43139 - DNA, 20 bp, Artificial
  CRISPR gRNA sequence
tccaggacaccacttgttgc

SEQ ID NO: 43140 - DNA, 20 bp, Artificial
  CRISPR gRNA sequence
ccaggacaccacttgttgct

SEQ ID NO: 43141 - DNA, 20 bp, Artificial
  CRISPR gRNA sequence
ccacttgttgctaggcaact

SEQ ID NO: 43142 - DNA, 20 bp, Artificial
  CRISPR gRNA sequence
aggcaactgagcttcgtgct

SEQ ID NO: 43143 - DNA, 20 bp, Artificial
  CRISPR gRNA sequence
ggcaactgagcttcgtgctc

SEQ ID NO: 43144 - DNA, 20 bp, Artificial
  CRISPR gRNA sequence
caactgagcttcgtgctcgg

SEQ ID NO: 43145 - DNA, 20 bp, Artificial
  CRISPR gRNA sequence
tcgggagtccttgacccatg

SEQ ID NO: 43146 - DNA, 20 bp, Artificial
  CRISPR gRNA sequence
cgggagtccttgacccatgc

SEQ ID NO: 43147 - DNA, 20 bp, Artificial
  CRISPR gRNA sequence
gggagtccttgacccatgcg

SEQ ID NO: 43148 - DNA, 20 bp, Artificial
  CRISPR gRNA sequence
gtccttgacccatgcggggc

SEQ ID NO: 43149 - DNA, 20 bp, Artificial
  CRISPR gRNA sequence
ccttgacccatgcggggcta

SEQ ID NO: 43150 - DNA, 20 bp, Artificial
  CRISPR gRNA sequence
ccatgcggggctagagctgc

SEQ ID NO: 43151 - DNA, 20 bp, Artificial
  CRISPR gRNA sequence
cggggctagagctgccagcc

SEQ ID NO: 43152 - DNA, 20 bp, Artificial
  CRISPR gRNA sequence
agctgccagcctggccttgc

SEQ ID NO: 43153 - DNA, 20 bp, Artificial
  CRISPR gRNA sequence
agcctggccttgccagtgcc

SEQ ID NO: 43154 - DNA, 20 bp, Artificial
  CRISPR gRNA sequence
ccttgccagtgcccagaccc

SEQ ID NO: 43155 - DNA, 20 bp, Artificial
  CRISPR gRNA sequence
agtgcccagaccccagacca

SEQ ID NO: 43156 - DNA, 20 bp, Artificial
  CRISPR gRNA sequence
gtgcccagaccccagaccac

SEQ ID NO: 43157 - DNA, 20 bp, Artificial
  CRISPR gRNA sequence
tgcccagaccccagaccaca

SEQ ID NO: 43158 - DNA, 20 bp, Artificial
  CRISPR gRNA sequence
gcccagaccccagaccacag

SEQ ID NO: 43159 - DNA, 20 bp, Artificial
  CRISPR gRNA sequence
cagaccccagaccacagggg

SEQ ID NO: 43160 - DNA, 20 bp, Artificial
  CRISPR gRNA sequence
accccagaccacaggggcag

SEQ ID NO: 43161 - DNA, 20 bp, Artificial
  CRISPR gRNA sequence
ccccagaccacaggggcagc

SEQ ID NO: 43162 - DNA, 20 bp, Artificial
  CRISPR gRNA sequence
cagaccacaggggcagcggg

SEQ ID NO: 43163 - DNA, 20 bp, Artificial
  CRISPR gRNA sequence
agaccacaggggcagcgggc

SEQ ID NO: 43164 - DNA, 20 bp, Artificial
  CRISPR gRNA sequence
gaccacaggggcagcgggca

SEQ ID NO: 43165 - DNA, 20 bp, Artificial
  CRISPR gRNA sequence
acaggggcagcgggcagggt

SEQ ID NO: 43166 - DNA, 20 bp, Artificial
  CRISPR gRNA sequence
ggcagcgggcagggtgagtg

SEQ ID NO: 43167 - DNA, 20 bp, Artificial
  CRISPR gRNA sequence
gcagggtgagtgcagcgctc

SEQ ID NO: 43168 - DNA, 20 bp, Artificial
  CRISPR gRNA sequence
cagggtgagtgcagcgctca

SEQ ID NO: 43169 - DNA, 20 bp, Artificial
  CRISPR gRNA sequence
gagtgcagcgctcaaggact

SEQ ID NO: 43170 - DNA, 20 bp, Artificial
  CRISPR gRNA sequence
agtgcagcgctcaaggactc

SEQ ID NO: 43171 - DNA, 20 bp, Artificial
  CRISPR gRNA sequence
gtgcagcgctcaaggactca

SEQ ID NO: 43172 - DNA, 20 bp, Artificial
  CRISPR gRNA sequence
gcgctcaaggactcagggtc

SEQ ID NO: 43173 - DNA, 20 bp, Artificial
  CRISPR gRNA sequence
aaggactcagggtctggtgc

SEQ ID NO: 43174 - DNA, 20 bp, Artificial
  CRISPR gRNA sequence
tggtgccagttctgcctgtg

SEQ ID NO: 43175 - DNA, 20 bp, Artificial
  CRISPR gRNA sequence
ggtgccagttctgcctgtgt

SEQ ID NO: 43176 - DNA, 20 bp, Artificial
  CRISPR gRNA sequence
gtgccagttctgcctgtgtg

SEQ ID NO: 43177 - DNA, 20 bp, Artificial
  CRISPR gRNA sequence
cagttctgcctgtgtgggga

SEQ ID NO: 43178 - DNA, 20 bp, Artificial
  CRISPR gRNA sequence
gtgtggggatggtatccttc

SEQ ID NO: 43179 - DNA, 20 bp, Artificial
  CRISPR gRNA sequence
tgtggggatggtatccttct

SEQ ID NO: 43180 - DNA, 20 bp, Artificial
  CRISPR gRNA sequence
gatggtatccttctgggcct

SEQ ID NO: 43181 - DNA, 20 bp, Artificial
  CRISPR gRNA sequence
tgggcctcagtgtgtccatc

SEQ ID NO: 43182 - DNA, 20 bp, Artificial
  CRISPR gRNA sequence
ggcctcagtgtgtccatctg

SEQ ID NO: 43183 - DNA, 20 bp, Artificial
  CRISPR gRNA sequence
cagtgtgtccatctggagaa

SEQ ID NO: 43184 - DNA, 20 bp, Artificial
  CRISPR gRNA sequence
ccatctggagaatagatgct

SEQ ID NO: 43185 - DNA, 20 bp, Artificial
  CRISPR gRNA sequence
ggagaatagatgcttagaca

SEQ ID NO: 43186 - DNA, 20 bp, Artificial
  CRISPR gRNA sequence
agaatagatgcttagacatg

SEQ ID NO: 43187 - DNA, 20 bp, Artificial
  CRISPR gRNA sequence
gaatagatgcttagacatgg

SEQ ID NO: 43188 - DNA, 20 bp, Artificial
  CRISPR gRNA sequence
gacatggaggcttctcttct

SEQ ID NO: 43189 - DNA, 20 bp, Artificial
  CRISPR gRNA sequence
gcttctcttcttggaaatga

SEQ ID NO: 43190 - DNA, 20 bp, Artificial
  CRISPR gRNA sequence
ctcttcttggaaatgacagc

SEQ ID NO: 43191 - DNA, 20 bp, Artificial
  CRISPR gRNA sequence
ttcttggaaatgacagctgg

SEQ ID NO: 43192 - DNA, 20 bp, Artificial
  CRISPR gRNA sequence
tcttggaaatgacagctgga

SEQ ID NO: 43193 - DNA, 20 bp, Artificial
  CRISPR gRNA sequence
cttggaaatgacagctggaa

SEQ ID NO: 43194 - DNA, 20 bp, Artificial
  CRISPR gRNA sequence
tggaaatgacagctggaagg

SEQ ID NO: 43195 - DNA, 20 bp, Artificial
  CRISPR gRNA sequence
aatgacagctggaagggaga

SEQ ID NO: 43196 - DNA, 20 bp, Artificial
  CRISPR gRNA sequence
tgacagctggaagggagatg

SEQ ID NO: 43197 - DNA, 20 bp, Artificial
  CRISPR gRNA sequence
gacagctggaagggagatgg

SEQ ID NO: 43198 - DNA, 20 bp, Artificial
  CRISPR gRNA sequence
acagctggaagggagatgga

SEQ ID NO: 43199 - DNA, 20 bp, Artificial
  CRISPR gRNA sequence
cagctggaagggagatggag

SEQ ID NO: 43200 - DNA, 20 bp, Artificial
  CRISPR gRNA sequence
agctggaagggagatggagg

SEQ ID NO: 43201 - DNA, 20 bp, Artificial
  CRISPR gRNA sequence
ggaagggagatggagggggc

SEQ ID NO: 43202 - DNA, 20 bp, Artificial
  CRISPR gRNA sequence
gaagggagatggagggggct

SEQ ID NO: 43203 - DNA, 20 bp, Artificial
  CRISPR gRNA sequence
gggagatggagggggctggg

SEQ ID NO: 43204 - DNA, 20 bp, Artificial
  CRISPR gRNA sequence
ggagatggagggggctgggc

SEQ ID NO: 43205 - DNA, 20 bp, Artificial
  CRISPR gRNA sequence
gagatggagggggctgggca

SEQ ID NO: 43206 - DNA, 20 bp, Artificial
  CRISPR gRNA sequence
agggggctgggcagggctcc

SEQ ID NO: 43207 - DNA, 20 bp, Artificial
  CRISPR gRNA sequence
gggggctgggcagggctcca

SEQ ID NO: 43208 - DNA, 20 bp, Artificial
  CRISPR gRNA sequence
gggctgggcagggctccaag

SEQ ID NO: 43209 - DNA, 20 bp, Artificial
  CRISPR gRNA sequence
ggctgggcagggctccaagg

SEQ ID NO: 43210 - DNA, 20 bp, Artificial
  CRISPR gRNA sequence
tctcatctccatttcccttc

SEQ ID NO: 43211 - DNA, 20 bp, Artificial
  CRISPR gRNA sequence
ctccatttcccttctagtct

SEQ ID NO: 43212 - DNA, 20 bp, Artificial
  CRISPR gRNA sequence
ccttctagtctgagtcacaa

SEQ ID NO: 43213 - DNA, 20 bp, Artificial
  CRISPR gRNA sequence
tgagtcacaacagcatttct

SEQ ID NO: 43214 - DNA, 20 bp, Artificial
  CRISPR gRNA sequence
gagtcacaacagcatttctc

SEQ ID NO: 43215 - DNA, 20 bp, Artificial
  CRISPR gRNA sequence
cacaacagcatttctcagga

SEQ ID NO: 43216 - DNA, 20 bp, Artificial
  CRISPR gRNA sequence
ggaaagtgccctgtacctgc

SEQ ID NO: 43217 - DNA, 20 bp, Artificial
  CRISPR gRNA sequence
aaagtgccctgtacctgctg

SEQ ID NO: 43218 - DNA, 20 bp, Artificial
  CRISPR gRNA sequence
tgccctcctgcccacgtgtc

SEQ ID NO: 43219 - DNA, 20 bp, Artificial
  CRISPR gRNA sequence
gccctcctgcccacgtgtcc

SEQ ID NO: 43220 - DNA, 20 bp, Artificial
  CRISPR gRNA sequence
cctcctgcccacgtgtccgg

SEQ ID NO: 43221 - DNA, 20 bp, Artificial
  CRISPR gRNA sequence
ctcctgcccacgtgtccggg

SEQ ID NO: 43222 - DNA, 20 bp, Artificial
  CRISPR gRNA sequence
cccacgtgtccgggaggcct

SEQ ID NO: 43223 - DNA, 20 bp, Artificial
  CRISPR gRNA sequence
gtgtccgggaggcctcagtg

SEQ ID NO: 43224 - DNA, 20 bp, Artificial
  CRISPR gRNA sequence
ccgggaggcctcagtgaagt

SEQ ID NO: 43225 - DNA, 20 bp, Artificial
  CRISPR gRNA sequence
cgggaggcctcagtgaagta

SEQ ID NO: 43226 - DNA, 20 bp, Artificial
  CRISPR gRNA sequence
gggaggcctcagtgaagtaa

SEQ ID NO: 43227 - DNA, 20 bp, Artificial
  CRISPR gRNA sequence
ggaggcctcagtgaagtaag

SEQ ID NO: 43228 - DNA, 20 bp, Artificial
  CRISPR gRNA sequence
tcagtgaagtaaggggatgt

SEQ ID NO: 43229 - DNA, 20 bp, Artificial
  CRISPR gRNA sequence
aggggatgttggtccccgaa

SEQ ID NO: 43230 - DNA, 20 bp, Artificial
  CRISPR gRNA sequence
cccgaaaagcccctttctgc

SEQ ID NO: 43231 - DNA, 20 bp, Artificial
  CRISPR gRNA sequence
agcccctttctgctggccaa

SEQ ID NO: 43232 - DNA, 20 bp, Artificial
  CRISPR gRNA sequence
gcccctttctgctggccaac

SEQ ID NO: 43233 - DNA, 20 bp, Artificial
  CRISPR gRNA sequence
tgctggccaacaggtgcccc

SEQ ID NO: 43234 - DNA, 20 bp, Artificial
  CRISPR gRNA sequence
caggtgcccctggctgatga

SEQ ID NO: 43235 - DNA, 20 bp, Artificial
  CRISPR gRNA sequence
aggtgcccctggctgatgat

SEQ ID NO: 43236 - DNA, 20 bp, Artificial
  CRISPR gRNA sequence
gtgcccctggctgatgatgg

SEQ ID NO: 43237 - DNA, 20 bp, Artificial
  CRISPR gRNA sequence
cccctggctgatgatgggag

SEQ ID NO: 43238 - DNA, 20 bp, Artificial
  CRISPR gRNA sequence
tggctgatgatgggagaagc

SEQ ID NO: 43239 - DNA, 20 bp, Artificial
  CRISPR gRNA sequence
ggctgatgatgggagaagca

SEQ ID NO: 43240 - DNA, 20 bp, Artificial
  CRISPR gRNA sequence
agcaaggcacccacactttg

SEQ ID NO: 43241 - DNA, 20 bp, Artificial
  CRISPR gRNA sequence
acactttgtggccttccatc

SEQ ID NO: 43242 - DNA, 20 bp, Artificial
  CRISPR gRNA sequence
cactttgtggccttccatct

SEQ ID NO: 43243 - DNA, 20 bp, Artificial
  CRISPR gRNA sequence
tttgtggccttccatctggg

SEQ ID NO: 43244 - DNA, 20 bp, Artificial
  CRISPR gRNA sequence
ggccttccatctgggtggct

SEQ ID NO: 43245 - DNA, 20 bp, Artificial
  CRISPR gRNA sequence
ccttccatctgggtggcttg

SEQ ID NO: 43246 - DNA, 20 bp, Artificial
  CRISPR gRNA sequence
ctctgcctttctctgaatct

SEQ ID NO: 43247 - DNA, 20 bp, Artificial
  CRISPR gRNA sequence
tctgcctttctctgaatctc

SEQ ID NO: 43248 - DNA, 20 bp, Artificial
  CRISPR gRNA sequence
ctgcctttctctgaatctca

SEQ ID NO: 43249 - DNA, 20 bp, Artificial
  CRISPR gRNA sequence
ctctgaatctcagggtttcc

SEQ ID NO: 43250 - DNA, 20 bp, Artificial
  CRISPR gRNA sequence
tctgaatctcagggtttcct

SEQ ID NO: 43251 - DNA, 20 bp, Artificial
  CRISPR gRNA sequence
atctcagggtttcctgggca

SEQ ID NO: 43252 - DNA, 20 bp, Artificial
  CRISPR gRNA sequence
tctcagggtttcctgggcat

SEQ ID NO: 43253 - DNA, 20 bp, Artificial
  CRISPR gRNA sequence
aatttctatcccctgatgcc

SEQ ID NO: 43254 - DNA, 20 bp, Artificial
  CRISPR gRNA sequence
atttctatcccctgatgccc

SEQ ID NO: 43255 - DNA, 20 bp, Artificial
  CRISPR gRNA sequence
cccctgatgcccgggtgcca

SEQ ID NO: 43256 - DNA, 20 bp, Artificial
  CRISPR gRNA sequence
ccctgatgcccgggtgccat

SEQ ID NO: 43257 - DNA, 20 bp, Artificial
  CRISPR gRNA sequence
cctgatgcccgggtgccatg

SEQ ID NO: 43258 - DNA, 20 bp, Artificial
  CRISPR gRNA sequence
cccgggtgccatggggacca

SEQ ID NO: 43259 - DNA, 20 bp, Artificial
  CRISPR gRNA sequence
cgggtgccatggggaccatg

SEQ ID NO: 43260 - DNA, 20 bp, Artificial
  CRISPR gRNA sequence
gggtgccatggggaccatgg

SEQ ID NO: 43261 - DNA, 20 bp, Artificial
  CRISPR gRNA sequence
catggggaccatggaggcca

SEQ ID NO: 43262 - DNA, 20 bp, Artificial
  CRISPR gRNA sequence
atggggaccatggaggccat

SEQ ID NO: 43263 - DNA, 20 bp, Artificial
  CRISPR gRNA sequence
tggggaccatggaggccatg

SEQ ID NO: 43264 - DNA, 20 bp, Artificial
  CRISPR gRNA sequence
ggaccatggaggccatgggg

SEQ ID NO: 43265 - DNA, 20 bp, Artificial
  CRISPR gRNA sequence
gaccatggaggccatggggt

SEQ ID NO: 43266 - DNA, 20 bp, Artificial
  CRISPR gRNA sequence
catggaggccatggggtggg

SEQ ID NO: 43267 - DNA, 20 bp, Artificial
  CRISPR gRNA sequence
atggaggccatggggtggga

SEQ ID NO: 43268 - DNA, 20 bp, Artificial
  CRISPR gRNA sequence
aggccatggggtgggaaggc

SEQ ID NO: 43269 - DNA, 20 bp, Artificial
  CRISPR gRNA sequence
ggccatggggtgggaaggcc

SEQ ID NO: 43270 - DNA, 20 bp, Artificial
  CRISPR gRNA sequence
gccaggtattgccatgctca

SEQ ID NO: 43271 - DNA, 20 bp, Artificial
  CRISPR gRNA sequence
tattgccatgctcacagaat

SEQ ID NO: 43272 - DNA, 20 bp, Artificial
  CRISPR gRNA sequence
ccatgctcacagaatgagtt

SEQ ID NO: 43273 - DNA, 20 bp, Artificial
  CRISPR gRNA sequence
catgctcacagaatgagttt

SEQ ID NO: 43274 - DNA, 20 bp, Artificial
  CRISPR gRNA sequence
atgctcacagaatgagtttg

SEQ ID NO: 43275 - DNA, 20 bp, Artificial
  CRISPR gRNA sequence
tgctcacagaatgagtttgg

SEQ ID NO: 43276 - DNA, 20 bp, Artificial
  CRISPR gRNA sequence
atgagtttgggggtctcctc

SEQ ID NO: 43277 - DNA, 20 bp, Artificial
  CRISPR gRNA sequence
tgggggtctcctctggttct

SEQ ID NO: 43278 - DNA, 20 bp, Artificial
  CRISPR gRNA sequence
gggggtctcctctggttctg

SEQ ID NO: 43279 - DNA, 20 bp, Artificial
  CRISPR gRNA sequence
tccatcctcccttgtccttg

SEQ ID NO: 43280 - DNA, 20 bp, Artificial
  CRISPR gRNA sequence
ccatcctcccttgtccttgt

SEQ ID NO: 43281 - DNA, 20 bp, Artificial
  CRISPR gRNA sequence
ctcccttgtccttgtgggtg

SEQ ID NO: 43282 - DNA, 20 bp, Artificial
  CRISPR gRNA sequence
gcttccctctctgtgccctg

SEQ ID NO: 43283 - DNA, 20 bp, Artificial
  CRISPR gRNA sequence
cttccctctctgtgccctgt

SEQ ID NO: 43284 - DNA, 20 bp, Artificial
  CRISPR gRNA sequence
tctgtgccctgtgggtgccc

SEQ ID NO: 43285 - DNA, 20 bp, Artificial
  CRISPR gRNA sequence
ctgtgccctgtgggtgccct

SEQ ID NO: 43286 - DNA, 20 bp, Artificial
  CRISPR gRNA sequence
ctgtgggtgccctaggtgcc

SEQ ID NO: 43287 - DNA, 20 bp, Artificial
  CRISPR gRNA sequence
tgtgggtgccctaggtgcct

SEQ ID NO: 43288 - DNA, 20 bp, Artificial
  CRISPR gRNA sequence
gggtgccctaggtgcctagg

SEQ ID NO: 43289 - DNA, 20 bp, Artificial
  CRISPR gRNA sequence
gccctaggtgcctaggaagc

SEQ ID NO: 43290 - DNA, 20 bp, Artificial
  CRISPR gRNA sequence
gcctaggaagctggcatgtc

SEQ ID NO: 43291 - DNA, 20 bp, Artificial
  CRISPR gRNA sequence
cctaggaagctggcatgtct

SEQ ID NO: 43292 - DNA, 20 bp, Artificial
  CRISPR gRNA sequence
gtctgggcaccgtgcttccc

SEQ ID NO: 43293 - DNA, 20 bp, Artificial
  CRISPR gRNA sequence
tctgggcaccgtgcttcccc

SEQ ID NO: 43294 - DNA, 20 bp, Artificial
  CRISPR gRNA sequence
tccccaggcccttctctctg

SEQ ID NO: 43295 - DNA, 20 bp, Artificial
  CRISPR gRNA sequence
aggcccttctctctgcagcc

SEQ ID NO: 43296 - DNA, 20 bp, Artificial
  CRISPR gRNA sequence
ggcccttctctctgcagcct

SEQ ID NO: 43297 - DNA, 20 bp, Artificial
  CRISPR gRNA sequence
ctctctgcagcctgggctct

SEQ ID NO: 43298 - DNA, 20 bp, Artificial
  CRISPR gRNA sequence
tctgcagcctgggctctgag

SEQ ID NO: 43299 - DNA, 20 bp, Artificial
  CRISPR gRNA sequence
tgcagcctgggctctgagca

SEQ ID NO: 43300 - DNA, 20 bp, Artificial
  CRISPR gRNA sequence
tgggctctgagcagagcttc

SEQ ID NO: 43301 - DNA, 20 bp, Artificial
  CRISPR gRNA sequence
agcttccggattcacttctc

SEQ ID NO: 43302 - DNA, 20 bp, Artificial
  CRISPR gRNA sequence
cttccggattcacttctcca

SEQ ID NO: 43303 - DNA, 20 bp, Artificial
  CRISPR gRNA sequence
tccggattcacttctccaga

SEQ ID NO: 43304 - DNA, 20 bp, Artificial
  CRISPR gRNA sequence
ccggattcacttctccagag

SEQ ID NO: 43305 - DNA, 20 bp, Artificial
  CRISPR gRNA sequence
ttcacttctccagagaggac

SEQ ID NO: 43306 - DNA, 20 bp, Artificial
  CRISPR gRNA sequence
tcacttctccagagaggacc

SEQ ID NO: 43307 - DNA, 20 bp, Artificial
  CRISPR gRNA sequence
ttctccagagaggaccaggc

SEQ ID NO: 43308 - DNA, 20 bp, Artificial
  CRISPR gRNA sequence
tctccagagaggaccaggct

SEQ ID NO: 43309 - DNA, 20 bp, Artificial
  CRISPR gRNA sequence
ccagagaggaccaggctggg

SEQ ID NO: 43310 - DNA, 20 bp, Artificial
  CRISPR gRNA sequence
gaccaggctgggaagacact

SEQ ID NO: 43311 - DNA, 20 bp, Artificial
  CRISPR gRNA sequence
accaggctgggaagacactc

SEQ ID NO: 43312 - DNA, 20 bp, Artificial
  CRISPR gRNA sequence
agacactcaggtaatccctg

SEQ ID NO: 43313 - DNA, 20 bp, Artificial
  CRISPR gRNA sequence
gacactcaggtaatccctgc

SEQ ID NO: 43314 - DNA, 20 bp, Artificial
  CRISPR gRNA sequence
acactcaggtaatccctgca

SEQ ID NO: 43315 - DNA, 20 bp, Artificial
  CRISPR gRNA sequence
aggtaatccctgcagggtga

SEQ ID NO: 43316 - DNA, 20 bp, Artificial
  CRISPR gRNA sequence
ggtaatccctgcagggtgat

SEQ ID NO: 43317 - DNA, 20 bp, Artificial
  CRISPR gRNA sequence
atccctgcagggtgatggga

SEQ ID NO: 43318 - DNA, 20 bp, Artificial
  CRISPR gRNA sequence
tccctgcagggtgatgggac

SEQ ID NO: 43319 - DNA, 20 bp, Artificial
  CRISPR gRNA sequence
ccctgcagggtgatgggaca

SEQ ID NO: 43320 - DNA, 20 bp, Artificial
  CRISPR gRNA sequence
cctgcagggtgatgggacag

SEQ ID NO: 43321 - DNA, 20 bp, Artificial
  CRISPR gRNA sequence
cagggtgatgggacagggga

SEQ ID NO: 43322 - DNA, 20 bp, Artificial
  CRISPR gRNA sequence
gggtgatgggacaggggaca

SEQ ID NO: 43323 - DNA, 20 bp, Artificial
  CRISPR gRNA sequence
gtgatgggacaggggacaga

SEQ ID NO: 43324 - DNA, 20 bp, Artificial
  CRISPR gRNA sequence
tgatgggacaggggacagag

SEQ ID NO: 43325 - DNA, 20 bp, Artificial
  CRISPR gRNA sequence
gatgggacaggggacagaga

SEQ ID NO: 43326 - DNA, 20 bp, Artificial
  CRISPR gRNA sequence
atgggacaggggacagagag

SEQ ID NO: 43327 - DNA, 20 bp, Artificial
  CRISPR gRNA sequence
gggacaggggacagagaggg

SEQ ID NO: 43328 - DNA, 20 bp, Artificial
  CRISPR gRNA sequence
gacaggggacagagagggga

SEQ ID NO: 43329 - DNA, 20 bp, Artificial
  CRISPR gRNA sequence
acaggggacagagaggggag

SEQ ID NO: 43330 - DNA, 20 bp, Artificial
  CRISPR gRNA sequence
aggggacagagaggggagag

SEQ ID NO: 43331 - DNA, 20 bp, Artificial
  CRISPR gRNA sequence
ggggacagagaggggagagg

SEQ ID NO: 43332 - DNA, 20 bp, Artificial
  CRISPR gRNA sequence
gggagaggaggctgacccta

SEQ ID NO: 43333 - DNA, 20 bp, Artificial
  CRISPR gRNA sequence
agaggaggctgaccctatgg

SEQ ID NO: 43334 - DNA, 20 bp, Artificial
  CRISPR gRNA sequence
tgaccctatggcggcctcca

SEQ ID NO: 43335 - DNA, 20 bp, Artificial
  CRISPR gRNA sequence
ctccatggccccctcttccc

SEQ ID NO: 43336 - DNA, 20 bp, Artificial
  CRISPR gRNA sequence
tccatggccccctcttccct

SEQ ID NO: 43337 - DNA, 20 bp, Artificial
  CRISPR gRNA sequence
ccctgggccctctcctcctt

SEQ ID NO: 43338 - DNA, 20 bp, Artificial
  CRISPR gRNA sequence
ctgggccctctcctccttta

SEQ ID NO: 43339 - DNA, 20 bp, Artificial
  CRISPR gRNA sequence
gggccctctcctcctttaga

SEQ ID NO: 43340 - DNA, 20 bp, Artificial
  CRISPR gRNA sequence
ccctctcctcctttagagag

SEQ ID NO: 43341 - DNA, 20 bp, Artificial
  CRISPR gRNA sequence
ctcctttagagagcagcttc

SEQ ID NO: 43342 - DNA, 20 bp, Artificial
  CRISPR gRNA sequence
gcagcttcaagctcactgcc

SEQ ID NO: 43343 - DNA, 20 bp, Artificial
  CRISPR gRNA sequence
cagcttcaagctcactgcct

SEQ ID NO: 43344 - DNA, 20 bp, Artificial
  CRISPR gRNA sequence
actgcctgggtctgttcctc

SEQ ID NO: 43345 - DNA, 20 bp, Artificial
  CRISPR gRNA sequence
cagatctgcccccgatgccc

SEQ ID NO: 43346 - DNA, 20 bp, Artificial
  CRISPR gRNA sequence
ccccgatgccctggtaactc

SEQ ID NO: 43347 - DNA, 20 bp, Artificial
  CRISPR gRNA sequence
tgccctggtaactccagtct

SEQ ID NO: 43348 - DNA, 20 bp, Artificial
  CRISPR gRNA sequence
ctggtaactccagtctcagc

SEQ ID NO: 43349 - DNA, 20 bp, Artificial
  CRISPR gRNA sequence
tggtaactccagtctcagcc

SEQ ID NO: 43350 - DNA, 20 bp, Artificial
  CRISPR gRNA sequence
ggtaactccagtctcagcca

SEQ ID NO: 43351 - DNA, 20 bp, Artificial
  CRISPR gRNA sequence
tccagtctcagccagggcct

SEQ ID NO: 43352 - DNA, 20 bp, Artificial
  CRISPR gRNA sequence
ggcattgaacttgtgcctct

SEQ ID NO: 43353 - DNA, 20 bp, Artificial
  CRISPR gRNA sequence
gcctcttagcccaccatcct

SEQ ID NO: 43354 - DNA, 20 bp, Artificial
  CRISPR gRNA sequence
ccaccatcctaagcccaact

SEQ ID NO: 43355 - DNA, 20 bp, Artificial
  CRISPR gRNA sequence
tccttgccatgtcctgacta

SEQ ID NO: 43356 - DNA, 20 bp, Artificial
  CRISPR gRNA sequence
ccttgccatgtcctgactac

SEQ ID NO: 43357 - DNA, 20 bp, Artificial
  CRISPR gRNA sequence
atgtcctgactacaggcctt

SEQ ID NO: 43358 - DNA, 20 bp, Artificial
  CRISPR gRNA sequence
tgtcctgactacaggccttg

SEQ ID NO: 43359 - DNA, 20 bp, Artificial
  CRISPR gRNA sequence
ctacaggccttgaggcttct

SEQ ID NO: 43360 - DNA, 20 bp, Artificial
  CRISPR gRNA sequence
cttgaggcttctgagtgtca

SEQ ID NO: 43361 - DNA, 20 bp, Artificial
  CRISPR gRNA sequence
gcttctgagtgtcacggtta

SEQ ID NO: 43362 - DNA, 20 bp, Artificial
  CRISPR gRNA sequence
tgtcacggttaaagattttg

SEQ ID NO: 43363 - DNA, 20 bp, Artificial
  CRISPR gRNA sequence
atccctgatctgccacttac

SEQ ID NO: 43364 - DNA, 20 bp, Artificial
  CRISPR gRNA sequence
tctgccacttaccagctatg

SEQ ID NO: 43365 - DNA, 20 bp, Artificial
  CRISPR gRNA sequence
acttaccagctatgtggccc

SEQ ID NO: 43366 - DNA, 20 bp, Artificial
  CRISPR gRNA sequence
ccagctatgtggccctggac

SEQ ID NO: 43367 - DNA, 20 bp, Artificial
  CRISPR gRNA sequence
gtggccctggacaagtaaaa

SEQ ID NO: 43368 - DNA, 20 bp, Artificial
  CRISPR gRNA sequence
tggccctggacaagtaaaat

SEQ ID NO: 43369 - DNA, 20 bp, Artificial
  CRISPR gRNA sequence
ggccctggacaagtaaaatg

SEQ ID NO: 43370 - DNA, 20 bp, Artificial
  CRISPR gRNA sequence
taataacacaacctacccct

SEQ ID NO: 43371 - DNA, 20 bp, Artificial
  CRISPR gRNA sequence
aataacacaacctacccctt

SEQ ID NO: 43372 - DNA, 20 bp, Artificial
  CRISPR gRNA sequence
ataacacaacctacccctta

SEQ ID NO: 43373 - DNA, 20 bp, Artificial
  CRISPR gRNA sequence
ctaccccttagggttattgt

SEQ ID NO: 43374 - DNA, 20 bp, Artificial
  CRISPR gRNA sequence
taccccttagggttattgtg

SEQ ID NO: 43375 - DNA, 20 bp, Artificial
  CRISPR gRNA sequence
ggttattgtgaggattaaat

SEQ ID NO: 43376 - DNA, 20 bp, Artificial
  CRISPR gRNA sequence
tgaggattaaatgagttaat

SEQ ID NO: 43377 - DNA, 20 bp, Artificial
  CRISPR gRNA sequence
taaatgagttaataagtata

SEQ ID NO: 43378 - DNA, 20 bp, Artificial
  CRISPR gRNA sequence
agttaataagtataaagtgc

SEQ ID NO: 43379 - DNA, 20 bp, Artificial
  CRISPR gRNA sequence
gttaataagtataaagtgcc

SEQ ID NO: 43380 - DNA, 20 bp, Artificial
  CRISPR gRNA sequence
taagtataaagtgccaggaa

SEQ ID NO: 43381 - DNA, 20 bp, Artificial
  CRISPR gRNA sequence
aagtataaagtgccaggaaa

SEQ ID NO: 43382 - DNA, 20 bp, Artificial
  CRISPR gRNA sequence
taaagtgccaggaaaaggtc

SEQ ID NO: 43383 - DNA, 20 bp, Artificial
  CRISPR gRNA sequence
ccaggaaaaggtctggctca

SEQ ID NO: 43384 - DNA, 20 bp, Artificial
  CRISPR gRNA sequence
caggaaaaggtctggctcat

SEQ ID NO: 43385 - DNA, 20 bp, Artificial
  CRISPR gRNA sequence
ggaaaaggtctggctcatgg

SEQ ID NO: 43386 - DNA, 20 bp, Artificial
  CRISPR gRNA sequence
ctggctcatgggagtgctgt

SEQ ID NO: 43387 - DNA, 20 bp, Artificial
  CRISPR gRNA sequence
gctcatgggagtgctgtcag

SEQ ID NO: 43388 - DNA, 20 bp, Artificial
  CRISPR gRNA sequence
attatcattatcattacccc

SEQ ID NO: 43389 - DNA, 20 bp, Artificial
  CRISPR gRNA sequence
atcattatcattacccctgg

SEQ ID NO: 43390 - DNA, 20 bp, Artificial
  CRISPR gRNA sequence
gtagccctgactcactgcca

SEQ ID NO: 43391 - DNA, 20 bp, Artificial
  CRISPR gRNA sequence
ccctgactcactgccacggc

SEQ ID NO: 43392 - DNA, 20 bp, Artificial
  CRISPR gRNA sequence
ttcctttacatgtcttactt

SEQ ID NO: 43393 - DNA, 20 bp, Artificial
  CRISPR gRNA sequence
tgtcttacttcagctgtgaa

SEQ ID NO: 43394 - DNA, 20 bp, Artificial
  CRISPR gRNA sequence
gtcttacttcagctgtgaac

SEQ ID NO: 43395 - DNA, 20 bp, Artificial
  CRISPR gRNA sequence
tcttacttcagctgtgaaca

SEQ ID NO: 43396 - DNA, 20 bp, Artificial
  CRISPR gRNA sequence
aactgatccctgcatcttat

SEQ ID NO: 43397 - DNA, 20 bp, Artificial
  CRISPR gRNA sequence
actgatccctgcatcttatc

SEQ ID NO: 43398 - DNA, 20 bp, Artificial
  CRISPR gRNA sequence
cctcccctccattcactcca

SEQ ID NO: 43399 - DNA, 20 bp, Artificial
  CRISPR gRNA sequence
tccattcactccacagcccc

SEQ ID NO: 43400 - DNA, 20 bp, Artificial
  CRISPR gRNA sequence
cattcactccacagccccca

SEQ ID NO: 43401 - DNA, 20 bp, Artificial
  CRISPR gRNA sequence
attcactccacagcccccag

SEQ ID NO: 43402 - DNA, 20 bp, Artificial
  CRISPR gRNA sequence
ttcactccacagcccccaga

SEQ ID NO: 43403 - DNA, 20 bp, Artificial
  CRISPR gRNA sequence
tcttcacaacacacatctga

SEQ ID NO: 43404 - DNA, 20 bp, Artificial
  CRISPR gRNA sequence
ctctgctactctgtgcccct

SEQ ID NO: 43405 - DNA, 20 bp, Artificial
  CRISPR gRNA sequence
tgctactctgtgcccctcag

SEQ ID NO: 43406 - DNA, 20 bp, Artificial
  CRISPR gRNA sequence
cagtggctccccattaaccc

SEQ ID NO: 43407 - DNA, 20 bp, Artificial
  CRISPR gRNA sequence
agtggctccccattaacccc

SEQ ID NO: 43408 - DNA, 20 bp, Artificial
  CRISPR gRNA sequence
gtggctccccattaacccca

SEQ ID NO: 43409 - DNA, 20 bp, Artificial
  CRISPR gRNA sequence
tccccattaaccccagggtg

SEQ ID NO: 43410 - DNA, 20 bp, Artificial
  CRISPR gRNA sequence
taaccccagggtgaagttca

SEQ ID NO: 43411 - DNA, 20 bp, Artificial
  CRISPR gRNA sequence
agggtgaagttcaaagtccc

SEQ ID NO: 43412 - DNA, 20 bp, Artificial
  CRISPR gRNA sequence
ccctagcatcttctccctca

SEQ ID NO: 43413 - DNA, 20 bp, Artificial
  CRISPR gRNA sequence
acacaccaacccatatacca

SEQ ID NO: 43414 - DNA, 20 bp, Artificial
  CRISPR gRNA sequence
ccatataccacagatacacc

SEQ ID NO: 43415 - DNA, 20 bp, Artificial
  CRISPR gRNA sequence
gcacacccaaacacaccaca

SEQ ID NO: 43416 - DNA, 20 bp, Artificial
  CRISPR gRNA sequence
caaacacaccacacagcacg

SEQ ID NO: 43417 - DNA, 20 bp, Artificial
  CRISPR gRNA sequence
cacaacacacgcacaccaca

SEQ ID NO: 43418 - DNA, 20 bp, Artificial
  CRISPR gRNA sequence
aaaccccccacatacatacc

SEQ ID NO: 43419 - DNA, 20 bp, Artificial
  CRISPR gRNA sequence
tacctggcacattacaaata

SEQ ID NO: 43420 - DNA, 20 bp, Artificial
  CRISPR gRNA sequence
acaacacacacacacacaca

SEQ ID NO: 43421 - DNA, 20 bp, Artificial
  CRISPR gRNA sequence
acacacacacacacacagtt

SEQ ID NO: 43422 - DNA, 20 bp, Artificial
  CRISPR gRNA sequence
taaccttcactatttgctcc

SEQ ID NO: 43423 - DNA, 20 bp, Artificial
  CRISPR gRNA sequence
tcactatttgctcctagatc

SEQ ID NO: 43424 - DNA, 20 bp, Artificial
  CRISPR gRNA sequence
cctagatcaagccctgcctg

SEQ ID NO: 43425 - DNA, 20 bp, Artificial
  CRISPR gRNA sequence
gcctctgctcacaccgcact

SEQ ID NO: 43426 - DNA, 20 bp, Artificial
  CRISPR gRNA sequence
ttctcttccttgccttttct

SEQ ID NO: 43427 - DNA, 20 bp, Artificial
  CRISPR gRNA sequence
tctcccaatcctttaacacc

SEQ ID NO: 43428 - DNA, 20 bp, Artificial
  CRISPR gRNA sequence
ttaacacccagctcaaacat

SEQ ID NO: 43429 - DNA, 20 bp, Artificial
  CRISPR gRNA sequence
gctcaaacatcagcccctcc

SEQ ID NO: 43430 - DNA, 20 bp, Artificial
  CRISPR gRNA sequence
caaacatcagcccctcctgg

SEQ ID NO: 43431 - DNA, 20 bp, Artificial
  CRISPR gRNA sequence
agcccctcctggaagtatcc

SEQ ID NO: 43432 - DNA, 20 bp, Artificial
  CRISPR gRNA sequence
ccctcctggaagtatcccag

SEQ ID NO: 43433 - DNA, 20 bp, Artificial
  CRISPR gRNA sequence
tcccagcagccctgcctcat

SEQ ID NO: 43434 - DNA, 20 bp, Artificial
  CRISPR gRNA sequence
ccagcagccctgcctcatca

SEQ ID NO: 43435 - DNA, 20 bp, Artificial
  CRISPR gRNA sequence
tcatcagagtgaactgcccc

SEQ ID NO: 43436 - DNA, 20 bp, Artificial
  CRISPR gRNA sequence
catcagagtgaactgccccg

SEQ ID NO: 43437 - DNA, 20 bp, Artificial
  CRISPR gRNA sequence
tgaactgccccgaggttcac

SEQ ID NO: 43438 - DNA, 20 bp, Artificial
  CRISPR gRNA sequence
gaactgccccgaggttcact

SEQ ID NO: 43439 - DNA, 20 bp, Artificial
  CRISPR gRNA sequence
gttcactgggccctttcact

SEQ ID NO: 43440 - DNA, 20 bp, Artificial
  CRISPR gRNA sequence
actgggccctttcacttggc

SEQ ID NO: 43441 - DNA, 20 bp, Artificial
  CRISPR gRNA sequence
ctgggccctttcacttggct

SEQ ID NO: 43442 - DNA, 20 bp, Artificial
  CRISPR gRNA sequence
acttggctgggcccgtctgc

SEQ ID NO: 43443 - DNA, 20 bp, Artificial
  CRISPR gRNA sequence
gggcccgtctgctggccacc

SEQ ID NO: 43444 - DNA, 20 bp, Artificial
  CRISPR gRNA sequence
ggcccgtctgctggccaccc

SEQ ID NO: 43445 - DNA, 20 bp, Artificial
  CRISPR gRNA sequence
gcccgtctgctggccaccca

SEQ ID NO: 43446 - DNA, 20 bp, Artificial
  CRISPR gRNA sequence
tctgctggccacccagggct

SEQ ID NO: 43447 - DNA, 20 bp, Artificial
  CRISPR gRNA sequence
ccacccagggctgagatgcc

SEQ ID NO: 43448 - DNA, 20 bp, Artificial
  CRISPR gRNA sequence
ccagggctgagatgcctgga

SEQ ID NO: 43449 - DNA, 20 bp, Artificial
  CRISPR gRNA sequence
gggctgagatgcctggacag

SEQ ID NO: 43450 - DNA, 20 bp, Artificial
  CRISPR gRNA sequence
gctgagatgcctggacagca

SEQ ID NO: 43451 - DNA, 20 bp, Artificial
  CRISPR gRNA sequence
gcctggacagcagagcccca

SEQ ID NO: 43452 - DNA, 20 bp, Artificial
  CRISPR gRNA sequence
ctggacagcagagccccacg

SEQ ID NO: 43453 - DNA, 20 bp, Artificial
  CRISPR gRNA sequence
cagagccccacggagaatcc

SEQ ID NO: 43454 - DNA, 20 bp, Artificial
  CRISPR gRNA sequence
agagccccacggagaatccc

SEQ ID NO: 43455 - DNA, 20 bp, Artificial
  CRISPR gRNA sequence
cccaggcacacctccctccc

SEQ ID NO: 43456 - DNA, 20 bp, Artificial
  CRISPR gRNA sequence
ccaggcacacctccctcccc

SEQ ID NO: 43457 - DNA, 20 bp, Artificial
  CRISPR gRNA sequence
caggcacacctccctcccca

SEQ ID NO: 43458 - DNA, 20 bp, Artificial
  CRISPR gRNA sequence
ggcacacctccctccccagg

SEQ ID NO: 43459 - DNA, 20 bp, Artificial
  CRISPR gRNA sequence
acctccctccccagggagct

SEQ ID NO: 43460 - DNA, 20 bp, Artificial
  CRISPR gRNA sequence
ccctccccagggagctcagc

SEQ ID NO: 43461 - DNA, 20 bp, Artificial
  CRISPR gRNA sequence
ccagggagctcagccagtgc

SEQ ID NO: 43462 - DNA, 20 bp, Artificial
  CRISPR gRNA sequence
gagctcagccagtgctggtc

SEQ ID NO: 43463 - DNA, 20 bp, Artificial
  CRISPR gRNA sequence
agctcagccagtgctggtcc

SEQ ID NO: 43464 - DNA, 20 bp, Artificial
  CRISPR gRNA sequence
ctcagccagtgctggtccgg

SEQ ID NO: 43465 - DNA, 20 bp, Artificial
  CRISPR gRNA sequence
cagccagtgctggtccggga

SEQ ID NO: 43466 - DNA, 20 bp, Artificial
  CRISPR gRNA sequence
cagtgctggtccgggagagt

SEQ ID NO: 43467 - DNA, 20 bp, Artificial
  CRISPR gRNA sequence
agtgctggtccgggagagta

SEQ ID NO: 43468 - DNA, 20 bp, Artificial
  CRISPR gRNA sequence
gctggtccgggagagtaagg

SEQ ID NO: 43469 - DNA, 20 bp, Artificial
  CRISPR gRNA sequence
ggtccgggagagtaaggcag

SEQ ID NO: 43470 - DNA, 20 bp, Artificial
  CRISPR gRNA sequence
gggagagtaaggcagtggtt

SEQ ID NO: 43471 - DNA, 20 bp, Artificial
  CRISPR gRNA sequence
gagagtaaggcagtggttaa

SEQ ID NO: 43472 - DNA, 20 bp, Artificial
  CRISPR gRNA sequence
taaggcagtggttaagagct

SEQ ID NO: 43473 - DNA, 20 bp, Artificial
  CRISPR gRNA sequence
aaggcagtggttaagagctt

SEQ ID NO: 43474 - DNA, 20 bp, Artificial
  CRISPR gRNA sequence
aggcagtggttaagagcttg

SEQ ID NO: 43475 - DNA, 20 bp, Artificial
  CRISPR gRNA sequence
ggttaagagcttggggtctg

SEQ ID NO: 43476 - DNA, 20 bp, Artificial
  CRISPR gRNA sequence
aagagcttggggtctgcagt

SEQ ID NO: 43477 - DNA, 20 bp, Artificial
  CRISPR gRNA sequence
ggtctgcagtcagactgacc

SEQ ID NO: 43478 - DNA, 20 bp, Artificial
  CRISPR gRNA sequence
tgcagtcagactgacctgga

SEQ ID NO: 43479 - DNA, 20 bp, Artificial
  CRISPR gRNA sequence
agactgacctggatggaaac

SEQ ID NO: 43480 - DNA, 20 bp, Artificial
  CRISPR gRNA sequence
tcttatctgctgtgtgtcct

SEQ ID NO: 43481 - DNA, 20 bp, Artificial
  CRISPR gRNA sequence
cttatctgctgtgtgtcctt

SEQ ID NO: 43482 - DNA, 20 bp, Artificial
  CRISPR gRNA sequence
tctgctgtgtgtccttgggt

SEQ ID NO: 43483 - DNA, 20 bp, Artificial
  CRISPR gRNA sequence
ctgtgtgtccttgggttagt

SEQ ID NO: 43484 - DNA, 20 bp, Artificial
  CRISPR gRNA sequence
tcagtttccccacctctaat

SEQ ID NO: 43485 - DNA, 20 bp, Artificial
  CRISPR gRNA sequence
ccacctctaattggtgctat

SEQ ID NO: 43486 - DNA, 20 bp, Artificial
  CRISPR gRNA sequence
aattggtgctatgagaatta

SEQ ID NO: 43487 - DNA, 20 bp, Artificial
  CRISPR gRNA sequence
attggtgctatgagaattaa

SEQ ID NO: 43488 - DNA, 20 bp, Artificial
  CRISPR gRNA sequence
tggtgctatgagaattaaag

SEQ ID NO: 43489 - DNA, 20 bp, Artificial
  CRISPR gRNA sequence
gagaattaaaggagaccctg

SEQ ID NO: 43490 - DNA, 20 bp, Artificial
  CRISPR gRNA sequence
agaattaaaggagaccctgc

SEQ ID NO: 43491 - DNA, 20 bp, Artificial
  CRISPR gRNA sequence
ttaaaggagaccctgcgggt

SEQ ID NO: 43492 - DNA, 20 bp, Artificial
  CRISPR gRNA sequence
taaaggagaccctgcgggta

SEQ ID NO: 43493 - DNA, 20 bp, Artificial
  CRISPR gRNA sequence
aggagaccctgcgggtaagg

SEQ ID NO: 43494 - DNA, 20 bp, Artificial
  CRISPR gRNA sequence
ggagaccctgcgggtaaggc

SEQ ID NO: 43495 - DNA, 20 bp, Artificial
  CRISPR gRNA sequence
gaccctgcgggtaaggcagg

SEQ ID NO: 43496 - DNA, 20 bp, Artificial
  CRISPR gRNA sequence
ggcaggaagtcccatgcacc

SEQ ID NO: 43497 - DNA, 20 bp, Artificial
  CRISPR gRNA sequence
caggaagtcccatgcaccca

SEQ ID NO: 43498 - DNA, 20 bp, Artificial
  CRISPR gRNA sequence
aggaagtcccatgcacccag

SEQ ID NO: 43499 - DNA, 20 bp, Artificial
  CRISPR gRNA sequence
agtcccatgcacccagaggc

SEQ ID NO: 43500 - DNA, 20 bp, Artificial
  CRISPR gRNA sequence
catgcacccagaggctggca

SEQ ID NO: 43501 - DNA, 20 bp, Artificial
  CRISPR gRNA sequence
ggctggcacagtgcctgacc

SEQ ID NO: 43502 - DNA, 20 bp, Artificial
  CRISPR gRNA sequence
ctggcacagtgcctgaccta

SEQ ID NO: 43503 - DNA, 20 bp, Artificial
  CRISPR gRNA sequence
cacagtgcctgacctagagt

SEQ ID NO: 43504 - DNA, 20 bp, Artificial
  CRISPR gRNA sequence
ttactcctaatactttctta

SEQ ID NO: 43505 - DNA, 20 bp, Artificial
  CRISPR gRNA sequence
tactcctaatactttcttac

SEQ ID NO: 43506 - DNA, 20 bp, Artificial
  CRISPR gRNA sequence
actcctaatactttcttaca

SEQ ID NO: 43507 - DNA, 20 bp, Artificial
  CRISPR gRNA sequence
ctcctaatactttcttacag

SEQ ID NO: 43508 - DNA, 20 bp, Artificial
  CRISPR gRNA sequence
tcctaatactttcttacagg

SEQ ID NO: 43509 - DNA, 20 bp, Artificial
  CRISPR gRNA sequence
atactttcttacagggggtg

SEQ ID NO: 43510 - DNA, 20 bp, Artificial
  CRISPR gRNA sequence
tactttcttacagggggtgt

SEQ ID NO: 43511 - DNA, 20 bp, Artificial
  CRISPR gRNA sequence
ctttcttacagggggtgtgg

SEQ ID NO: 43512 - DNA, 20 bp, Artificial
  CRISPR gRNA sequence
tttcttacagggggtgtggg

SEQ ID NO: 43513 - DNA, 20 bp, Artificial
  CRISPR gRNA sequence
gtgtgggaggttcctcccca

SEQ ID NO: 43514 - DNA, 20 bp, Artificial
  CRISPR gRNA sequence
gtgggaggttcctccccaaa

SEQ ID NO: 43515 - DNA, 20 bp, Artificial
  CRISPR gRNA sequence
gaggttcctccccaaagaga

SEQ ID NO: 43516 - DNA, 20 bp, Artificial
  CRISPR gRNA sequence
aggttcctccccaaagagac

SEQ ID NO: 43517 - DNA, 20 bp, Artificial
  CRISPR gRNA sequence
ttcctccccaaagagacagg

SEQ ID NO: 43518 - DNA, 20 bp, Artificial
  CRISPR gRNA sequence
ccaaagagacaggaagctcc

SEQ ID NO: 43519 - DNA, 20 bp, Artificial
  CRISPR gRNA sequence
aaagagacaggaagctccca

SEQ ID NO: 43520 - DNA, 20 bp, Artificial
  CRISPR gRNA sequence
gagacaggaagctcccagag

SEQ ID NO: 43521 - DNA, 20 bp, Artificial
  CRISPR gRNA sequence
agacaggaagctcccagagc

SEQ ID NO: 43522 - DNA, 20 bp, Artificial
  CRISPR gRNA sequence
acaggaagctcccagagcag

SEQ ID NO: 43523 - DNA, 20 bp, Artificial
  CRISPR gRNA sequence
cagagcaggagctgcatatt

SEQ ID NO: 43524 - DNA, 20 bp, Artificial
  CRISPR gRNA sequence
gagctgcatatttggcctct

SEQ ID NO: 43525 - DNA, 20 bp, Artificial
  CRISPR gRNA sequence
agctgcatatttggcctctc

SEQ ID NO: 43526 - DNA, 20 bp, Artificial
  CRISPR gRNA sequence
tggcctctcaggccctgctc

SEQ ID NO: 43527 - DNA, 20 bp, Artificial
  CRISPR gRNA sequence
ggcctctcaggccctgctcc

SEQ ID NO: 43528 - DNA, 20 bp, Artificial
  CRISPR gRNA sequence
ctgctccaggcctttgccct

SEQ ID NO: 43529 - DNA, 20 bp, Artificial
  CRISPR gRNA sequence
gctccaggcctttgccctca

SEQ ID NO: 43530 - DNA, 20 bp, Artificial
  CRISPR gRNA sequence
ctccaggcctttgccctcag

SEQ ID NO: 43531 - DNA, 20 bp, Artificial
  CRISPR gRNA sequence
caggcctttgccctcagagg

SEQ ID NO: 43532 - DNA, 20 bp, Artificial
  CRISPR gRNA sequence
aggcctttgccctcagaggt

SEQ ID NO: 43533 - DNA, 20 bp, Artificial
  CRISPR gRNA sequence
gaggtgggatgctcccccaa

SEQ ID NO: 43534 - DNA, 20 bp, Artificial
  CRISPR gRNA sequence
aggtgggatgctcccccaat

SEQ ID NO: 43535 - DNA, 20 bp, Artificial
  CRISPR gRNA sequence
atgctcccccaataggccct

SEQ ID NO: 43536 - DNA, 20 bp, Artificial
  CRISPR gRNA sequence
tgctcccccaataggccctc

SEQ ID NO: 43537 - DNA, 20 bp, Artificial
  CRISPR gRNA sequence
gctcccccaataggccctca

SEQ ID NO: 43538 - DNA, 20 bp, Artificial
  CRISPR gRNA sequence
tcccccaataggccctcagg

SEQ ID NO: 43539 - DNA, 20 bp, Artificial
  CRISPR gRNA sequence
cccccaataggccctcaggg

SEQ ID NO: 43540 - DNA, 20 bp, Artificial
  CRISPR gRNA sequence
aataggccctcagggaggct

SEQ ID NO: 43541 - DNA, 20 bp, Artificial
  CRISPR gRNA sequence
ccctcagggaggctgagatg

SEQ ID NO: 43542 - DNA, 20 bp, Artificial
  CRISPR gRNA sequence
agggaggctgagatgaagct

SEQ ID NO: 43543 - DNA, 20 bp, Artificial
  CRISPR gRNA sequence
gaggctgagatgaagctgag

SEQ ID NO: 43544 - DNA, 20 bp, Artificial
  CRISPR gRNA sequence
gctgagatgaagctgagcag

SEQ ID NO: 43545 - DNA, 20 bp, Artificial
  CRISPR gRNA sequence
aagctgagcagcagtgccca

SEQ ID NO: 43546 - DNA, 20 bp, Artificial
  CRISPR gRNA sequence
agctgagcagcagtgcccac

SEQ ID NO: 43547 - DNA, 20 bp, Artificial
  CRISPR gRNA sequence
cagtgcccacaggcctcacc

SEQ ID NO: 43548 - DNA, 20 bp, Artificial
  CRISPR gRNA sequence
agtgcccacaggcctcaccc

SEQ ID NO: 43549 - DNA, 20 bp, Artificial
  CRISPR gRNA sequence
gcctcacccaggctctgccc

SEQ ID NO: 43550 - DNA, 20 bp, Artificial
  CRISPR gRNA sequence
ctgccctggctttctgccct

SEQ ID NO: 43551 - DNA, 20 bp, Artificial
  CRISPR gRNA sequence
tgccctggctttctgccctc

SEQ ID NO: 43552 - DNA, 20 bp, Artificial
  CRISPR gRNA sequence
tggctttctgccctcaggct

SEQ ID NO: 43553 - DNA, 20 bp, Artificial
  CRISPR gRNA sequence
tttctgccctcaggctaagt

SEQ ID NO: 43554 - DNA, 20 bp, Artificial
  CRISPR gRNA sequence
gccctcaggctaagtgagtg

SEQ ID NO: 43555 - DNA, 20 bp, Artificial
  CRISPR gRNA sequence
ggctaagtgagtgcagcttc

SEQ ID NO: 43556 - DNA, 20 bp, Artificial
  CRISPR gRNA sequence
aagtgagtgcagcttccggc

SEQ ID NO: 43557 - DNA, 20 bp, Artificial
  CRISPR gRNA sequence
gtgagtgcagcttccggcca

SEQ ID NO: 43558 - DNA, 20 bp, Artificial
  CRISPR gRNA sequence
ttccggccagagcacgtgtc

SEQ ID NO: 43559 - DNA, 20 bp, Artificial
  CRISPR gRNA sequence
tccggccagagcacgtgtcc

SEQ ID NO: 43560 - DNA, 20 bp, Artificial
  CRISPR gRNA sequence
gccagagcacgtgtccaggc

SEQ ID NO: 43561 - DNA, 20 bp, Artificial
  CRISPR gRNA sequence
cacgtgtccaggctggccac

SEQ ID NO: 43562 - DNA, 20 bp, Artificial
  CRISPR gRNA sequence
tccaggctggccaccggctt

SEQ ID NO: 43563 - DNA, 20 bp, Artificial
  CRISPR gRNA sequence
ggctggccaccggcttgagc

SEQ ID NO: 43564 - DNA, 20 bp, Artificial
  CRISPR gRNA sequence
ccggcttgagcaagtccctg

SEQ ID NO: 43565 - DNA, 20 bp, Artificial
  CRISPR gRNA sequence
gagcaagtccctgcagctga

SEQ ID NO: 43566 - DNA, 20 bp, Artificial
  CRISPR gRNA sequence
gcaagtccctgcagctgacg

SEQ ID NO: 43567 - DNA, 20 bp, Artificial
  CRISPR gRNA sequence
gcagctgacggagctcacgt

SEQ ID NO: 43568 - DNA, 20 bp, Artificial
  CRISPR gRNA sequence
gctcacgtgagtgacccacc

SEQ ID NO: 43569 - DNA, 20 bp, Artificial
  CRISPR gRNA sequence
gagtgacccacccagcccgt

SEQ ID NO: 43570 - DNA, 20 bp, Artificial
  CRISPR gRNA sequence
agtgacccacccagcccgtg

SEQ ID NO: 43571 - DNA, 20 bp, Artificial
  CRISPR gRNA sequence
acccacccagcccgtgagga

SEQ ID NO: 43572 - DNA, 20 bp, Artificial
  CRISPR gRNA sequence
cacccagcccgtgaggacag

SEQ ID NO: 43573 - DNA, 20 bp, Artificial
  CRISPR gRNA sequence
cccagcccgtgaggacagca

SEQ ID NO: 43574 - DNA, 20 bp, Artificial
  CRISPR gRNA sequence
ccagcccgtgaggacagcag

SEQ ID NO: 43575 - DNA, 20 bp, Artificial
  CRISPR gRNA sequence
cagcccgtgaggacagcaga

SEQ ID NO: 43576 - DNA, 20 bp, Artificial
  CRISPR gRNA sequence
agcccgtgaggacagcagag

SEQ ID NO: 43577 - DNA, 20 bp, Artificial
  CRISPR gRNA sequence
ccgtgaggacagcagagggg

SEQ ID NO: 43578 - DNA, 20 bp, Artificial
  CRISPR gRNA sequence
cgtgaggacagcagaggggt

SEQ ID NO: 43579 - DNA, 20 bp, Artificial
  CRISPR gRNA sequence
gtgaggacagcagaggggtg

SEQ ID NO: 43580 - DNA, 20 bp, Artificial
  CRISPR gRNA sequence
tgaggacagcagaggggtgg

SEQ ID NO: 43581 - DNA, 20 bp, Artificial
  CRISPR gRNA sequence
gaggggtgggggcaccctgc

SEQ ID NO: 43582 - DNA, 20 bp, Artificial
  CRISPR gRNA sequence
ggggtgggggcaccctgcca

SEQ ID NO: 43583 - DNA, 20 bp, Artificial
  CRISPR gRNA sequence
gcaccctgccagagccacct

SEQ ID NO: 43584 - DNA, 20 bp, Artificial
  CRISPR gRNA sequence
cagtgactgacctctgtctc

SEQ ID NO: 43585 - DNA, 20 bp, Artificial
  CRISPR gRNA sequence
agtgactgacctctgtctcc

SEQ ID NO: 43586 - DNA, 20 bp, Artificial
  CRISPR gRNA sequence
cctctgtctccaggctgacc

SEQ ID NO: 43587 - DNA, 20 bp, Artificial
  CRISPR gRNA sequence
caggctgacccagtgctgcc

SEQ ID NO: 43588 - DNA, 20 bp, Artificial
  CRISPR gRNA sequence
aggctgacccagtgctgcct

SEQ ID NO: 43589 - DNA, 20 bp, Artificial
  CRISPR gRNA sequence
tgacccagtgctgcctgggc

SEQ ID NO: 43590 - DNA, 20 bp, Artificial
  CRISPR gRNA sequence
cccagtgctgcctgggccag

SEQ ID NO: 43591 - DNA, 20 bp, Artificial
  CRISPR gRNA sequence
agtgctgcctgggccagaag

SEQ ID NO: 43592 - DNA, 20 bp, Artificial
  CRISPR gRNA sequence
ctgcctgggccagaagcagc

SEQ ID NO: 43593 - DNA, 20 bp, Artificial
  CRISPR gRNA sequence
aagcagctggccatcctcct

SEQ ID NO: 43594 - DNA, 20 bp, Artificial
  CRISPR gRNA sequence
gctggccatcctcctgagct

SEQ ID NO: 43595 - DNA, 20 bp, Artificial
  CRISPR gRNA sequence
ggccatcctcctgagcttgg

SEQ ID NO: 43596 - DNA, 20 bp, Artificial
  CRISPR gRNA sequence
gccatcctcctgagcttggt

SEQ ID NO: 43597 - DNA, 20 bp, Artificial
  CRISPR gRNA sequence
ccatcctcctgagcttggtg

SEQ ID NO: 43598 - DNA, 20 bp, Artificial
  CRISPR gRNA sequence
gagcttggtggggcgacccg

SEQ ID NO: 43599 - DNA, 20 bp, Artificial
  CRISPR gRNA sequence
agcttggtggggcgacccgc

SEQ ID NO: 43600 - DNA, 20 bp, Artificial
  CRISPR gRNA sequence
gcttggtggggcgacccgca

SEQ ID NO: 43601 - DNA, 20 bp, Artificial
  CRISPR gRNA sequence
gggcgacccgcagggctgtt

SEQ ID NO: 43602 - DNA, 20 bp, Artificial
  CRISPR gRNA sequence
cccgcagggctgttcagcct

SEQ ID NO: 43603 - DNA, 20 bp, Artificial
  CRISPR gRNA sequence
ccgcagggctgttcagcctc

SEQ ID NO: 43604 - DNA, 20 bp, Artificial
  CRISPR gRNA sequence
acctcctcccccgctgcctc

SEQ ID NO: 43605 - DNA, 20 bp, Artificial
  CRISPR gRNA sequence
cctcctcccccgctgcctcc

SEQ ID NO: 43606 - DNA, 20 bp, Artificial
  CRISPR gRNA sequence
tcctcccccgctgcctccgg

SEQ ID NO: 43607 - DNA, 20 bp, Artificial
  CRISPR gRNA sequence
cctcccccgctgcctccggg

SEQ ID NO: 43608 - DNA, 20 bp, Artificial
  CRISPR gRNA sequence
ctcccccgctgcctccggga

SEQ ID NO: 43609 - DNA, 20 bp, Artificial
  CRISPR gRNA sequence
tcccccgctgcctccgggag

SEQ ID NO: 43610 - DNA, 20 bp, Artificial
  CRISPR gRNA sequence
gctgcctccgggaggggcca

SEQ ID NO: 43611 - DNA, 20 bp, Artificial
  CRISPR gRNA sequence
gggaggggccatggcatgaa

SEQ ID NO: 43612 - DNA, 20 bp, Artificial
  CRISPR gRNA sequence
ggaggggccatggcatgaat

SEQ ID NO: 43613 - DNA, 20 bp, Artificial
  CRISPR gRNA sequence
aggggccatggcatgaatgg

SEQ ID NO: 43614 - DNA, 20 bp, Artificial
  CRISPR gRNA sequence
ggccatggcatgaatgggag

SEQ ID NO: 43615 - DNA, 20 bp, Artificial
  CRISPR gRNA sequence
gccatggcatgaatgggagc

SEQ ID NO: 43616 - DNA, 20 bp, Artificial
  CRISPR gRNA sequence
ccatggcatgaatgggagca

SEQ ID NO: 43617 - DNA, 20 bp, Artificial
  CRISPR gRNA sequence
catggcatgaatgggagcag

SEQ ID NO: 43618 - DNA, 20 bp, Artificial
  CRISPR gRNA sequence
ggcatgaatgggagcagggg

SEQ ID NO: 43619 - DNA, 20 bp, Artificial
  CRISPR gRNA sequence
gcatgaatgggagcaggggt

SEQ ID NO: 43620 - DNA, 20 bp, Artificial
  CRISPR gRNA sequence
atgggagcaggggtgggcac

SEQ ID NO: 43621 - DNA, 20 bp, Artificial
  CRISPR gRNA sequence
gggagcaggggtgggcactg

SEQ ID NO: 43622 - DNA, 20 bp, Artificial
  CRISPR gRNA sequence
gcaggggtgggcactggagt

SEQ ID NO: 43623 - DNA, 20 bp, Artificial
  CRISPR gRNA sequence
aggggtgggcactggagtaa

SEQ ID NO: 43624 - DNA, 20 bp, Artificial
  CRISPR gRNA sequence
ggggtgggcactggagtaag

SEQ ID NO: 43625 - DNA, 20 bp, Artificial
  CRISPR gRNA sequence
gcactggagtaagaggcccc

SEQ ID NO: 43626 - DNA, 20 bp, Artificial
  CRISPR gRNA sequence
cactggagtaagaggccccc

SEQ ID NO: 43627 - DNA, 20 bp, Artificial
  CRISPR gRNA sequence
gtaagaggcccccaggatca

SEQ ID NO: 43628 - DNA, 20 bp, Artificial
  CRISPR gRNA sequence
ggcccccaggatcatggccc

SEQ ID NO: 43629 - DNA, 20 bp, Artificial
  CRISPR gRNA sequence
gtacccacaaccctgccatc

SEQ ID NO: 43630 - DNA, 20 bp, Artificial
  CRISPR gRNA sequence
aaccctgccatctggaccct

SEQ ID NO: 43631 - DNA, 20 bp, Artificial
  CRISPR gRNA sequence
caaaccctgtccatctgtcc

SEQ ID NO: 43632 - DNA, 20 bp, Artificial
  CRISPR gRNA sequence
aaccctgtccatctgtccca

SEQ ID NO: 43633 - DNA, 20 bp, Artificial
  CRISPR gRNA sequence
atctgtcccagagactccac

SEQ ID NO: 43634 - DNA, 20 bp, Artificial
  CRISPR gRNA sequence
tctgtcccagagactccaca

SEQ ID NO: 43635 - DNA, 20 bp, Artificial
  CRISPR gRNA sequence
cagagactccacaaggcaca

SEQ ID NO: 43636 - DNA, 20 bp, Artificial
  CRISPR gRNA sequence
gagactccacaaggcacaca

SEQ ID NO: 43637 - DNA, 20 bp, Artificial
  CRISPR gRNA sequence
gaaactgtccttccccacac

SEQ ID NO: 43638 - DNA, 20 bp, Artificial
  CRISPR gRNA sequence
aactgtccttccccacactg

SEQ ID NO: 43639 - DNA, 20 bp, Artificial
  CRISPR gRNA sequence
actgtccttccccacactgg

SEQ ID NO: 43640 - DNA, 20 bp, Artificial
  CRISPR gRNA sequence
cacactggaggcctgtgctt

SEQ ID NO: 43641 - DNA, 20 bp, Artificial
  CRISPR gRNA sequence
acactggaggcctgtgcttt

SEQ ID NO: 43642 - DNA, 20 bp, Artificial
  CRISPR gRNA sequence
aggcctgtgctttgggattt

SEQ ID NO: 43643 - DNA, 20 bp, Artificial
  CRISPR gRNA sequence
gctttgggatttaagaaaaa

SEQ ID NO: 43644 - DNA, 20 bp, Artificial
  CRISPR gRNA sequence
tgggatttaagaaaaaaaga

SEQ ID NO: 43645 - DNA, 20 bp, Artificial
  CRISPR gRNA sequence
atttaagaaaaaaagaaaga

SEQ ID NO: 43646 - DNA, 20 bp, Artificial
  CRISPR gRNA sequence
aagaaaaaaagaaagaaaga

SEQ ID NO: 43647 - DNA, 20 bp, Artificial
  CRISPR gRNA sequence
aaaaaagaaagaaagaaaga

SEQ ID NO: 43648 - DNA, 20 bp, Artificial
  CRISPR gRNA sequence
aaagaaagaaagaaagaaag

SEQ ID NO: 43649 - DNA, 20 bp, Artificial
  CRISPR gRNA sequence
aagaaagaaagaaagaaaga

SEQ ID NO: 43650 - DNA, 20 bp, Artificial
  CRISPR gRNA sequence
gaaagaaagaaagaaggttt

SEQ ID NO: 43651 - DNA, 20 bp, Artificial
  CRISPR gRNA sequence
aagaaagaaagaaggtttca

SEQ ID NO: 43652 - DNA, 20 bp, Artificial
  CRISPR gRNA sequence
agaaagaaagaaggtttcag

SEQ ID NO: 43653 - DNA, 20 bp, Artificial
  CRISPR gRNA sequence
gtttcagaggatactgaact

SEQ ID NO: 43654 - DNA, 20 bp, Artificial
  CRISPR gRNA sequence
tttcagaggatactgaactg

SEQ ID NO: 43655 - DNA, 20 bp, Artificial
  CRISPR gRNA sequence
gacaaaaataaactgaaacg

SEQ ID NO: 43656 - DNA, 20 bp, Artificial
  CRISPR gRNA sequence
tatgatcattttaaaacact

SEQ ID NO: 43657 - DNA, 20 bp, Artificial
  CRISPR gRNA sequence
cattttaaaacactcagaaa

SEQ ID NO: 43658 - DNA, 20 bp, Artificial
  CRISPR gRNA sequence
tttaaaacactcagaaaaag

SEQ ID NO: 43659 - DNA, 20 bp, Artificial
  CRISPR gRNA sequence
ctcagaaaaagaagataccg

SEQ ID NO: 43660 - DNA, 20 bp, Artificial
  CRISPR gRNA sequence
agaaaaagaagataccgaag

SEQ ID NO: 43661 - DNA, 20 bp, Artificial
  CRISPR gRNA sequence
aaagaagataccgaagtaga

SEQ ID NO: 43662 - DNA, 20 bp, Artificial
  CRISPR gRNA sequence
ttttttaaaactcctattcc

SEQ ID NO: 43663 - DNA, 20 bp, Artificial
  CRISPR gRNA sequence
aaactcctattcccagaacc

SEQ ID NO: 43664 - DNA, 20 bp, Artificial
  CRISPR gRNA sequence
aactcctattcccagaacct

SEQ ID NO: 43665 - DNA, 20 bp, Artificial
  CRISPR gRNA sequence
ttcccagaacctaggtttga

SEQ ID NO: 43666 - DNA, 20 bp, Artificial
  CRISPR gRNA sequence
ttctatttttatttttattt

SEQ ID NO: 43667 - DNA, 20 bp, Artificial
  CRISPR gRNA sequence
ttttatttttatttcagctg

SEQ ID NO: 43668 - DNA, 20 bp, Artificial
  CRISPR gRNA sequence
tatttttatttcagctgaag

SEQ ID NO: 43669 - DNA, 20 bp, Artificial
  CRISPR gRNA sequence
atttcagctgaagcggtttc

SEQ ID NO: 43670 - DNA, 20 bp, Artificial
  CRISPR gRNA sequence
cagctgaagcggtttcaagt

SEQ ID NO: 43671 - DNA, 20 bp, Artificial
  CRISPR gRNA sequence
aagcggtttcaagtaagtta

SEQ ID NO: 43672 - DNA, 20 bp, Artificial
  CRISPR gRNA sequence
ctcctaaatatttcaccgtg

SEQ ID NO: 43673 - DNA, 20 bp, Artificial
  CRISPR gRNA sequence
accgtgaagctccaaaaaat

SEQ ID NO: 43674 - DNA, 20 bp, Artificial
  CRISPR gRNA sequence
ccgtgaagctccaaaaaata

SEQ ID NO: 43675 - DNA, 20 bp, Artificial
  CRISPR gRNA sequence
aaaaataaggacattttttt

SEQ ID NO: 43676 - DNA, 20 bp, Artificial
  CRISPR gRNA sequence
gacatttttttcagtaatca

SEQ ID NO: 43677 - DNA, 20 bp, Artificial
  CRISPR gRNA sequence
ttcagtaatcacagttccat

SEQ ID NO: 43678 - DNA, 20 bp, Artificial
  CRISPR gRNA sequence
tcagtaatcacagttccatc

SEQ ID NO: 43679 - DNA, 20 bp, Artificial
  CRISPR gRNA sequence
acagttccatcaggacacct

SEQ ID NO: 43680 - DNA, 20 bp, Artificial
  CRISPR gRNA sequence
atcaggacacctaagaaact

SEQ ID NO: 43681 - DNA, 20 bp, Artificial
  CRISPR gRNA sequence
ggacacctaagaaactcagt

SEQ ID NO: 43682 - DNA, 20 bp, Artificial
  CRISPR gRNA sequence
aaactcagttagcgattcct

SEQ ID NO: 43683 - DNA, 20 bp, Artificial
  CRISPR gRNA sequence
agttagcgattccttagtgt

SEQ ID NO: 43684 - DNA, 20 bp, Artificial
  CRISPR gRNA sequence
gttagcgattccttagtgtc

SEQ ID NO: 43685 - DNA, 20 bp, Artificial
  CRISPR gRNA sequence
ccttagtgtcgggtactacc

SEQ ID NO: 43686 - DNA, 20 bp, Artificial
  CRISPR gRNA sequence
aaaatgtccccattgtcccc

SEQ ID NO: 43687 - DNA, 20 bp, Artificial
  CRISPR gRNA sequence
gtccccattgtcccccagat

SEQ ID NO: 43688 - DNA, 20 bp, Artificial
  CRISPR gRNA sequence
ccattgtcccccagataaga

SEQ ID NO: 43689 - DNA, 20 bp, Artificial
  CRISPR gRNA sequence
tgtcccccagataagacagc

SEQ ID NO: 43690 - DNA, 20 bp, Artificial
  CRISPR gRNA sequence
cagataagacagctggcttt

SEQ ID NO: 43691 - DNA, 20 bp, Artificial
  CRISPR gRNA sequence
agataagacagctggctttt

SEQ ID NO: 43692 - DNA, 20 bp, Artificial
  CRISPR gRNA sequence
gacagctggcttttgggatc

SEQ ID NO: 43693 - DNA, 20 bp, Artificial
  CRISPR gRNA sequence
acagctggcttttgggatcc

SEQ ID NO: 43694 - DNA, 20 bp, Artificial
  CRISPR gRNA sequence
gatccaggatctgtcacatc

SEQ ID NO: 43695 - DNA, 20 bp, Artificial
  CRISPR gRNA sequence
acatctggtctgcatttgca

SEQ ID NO: 43696 - DNA, 20 bp, Artificial
  CRISPR gRNA sequence
catctggtctgcatttgcac

SEQ ID NO: 43697 - DNA, 20 bp, Artificial
  CRISPR gRNA sequence
tggtctgcatttgcacggga

SEQ ID NO: 43698 - DNA, 20 bp, Artificial
  CRISPR gRNA sequence
gcatttgcacgggatggcga

SEQ ID NO: 43699 - DNA, 20 bp, Artificial
  CRISPR gRNA sequence
cttctgactcttctaacctg

SEQ ID NO: 43700 - DNA, 20 bp, Artificial
  CRISPR gRNA sequence
ctgcccccatcccctcacca

SEQ ID NO: 43701 - DNA, 20 bp, Artificial
  CRISPR gRNA sequence
cacagctttctgtttcatgt

SEQ ID NO: 43702 - DNA, 20 bp, Artificial
  CRISPR gRNA sequence
tcagtgtctgttgacaaaat

SEQ ID NO: 43703 - DNA, 20 bp, Artificial
  CRISPR gRNA sequence
atcagcaactgtgtgtactg

SEQ ID NO: 43704 - DNA, 20 bp, Artificial
  CRISPR gRNA sequence
gactgtcctgctcctgactc

SEQ ID NO: 43705 - DNA, 20 bp, Artificial
  CRISPR gRNA sequence
tgtcctgctcctgactctgg

SEQ ID NO: 43706 - DNA, 20 bp, Artificial
  CRISPR gRNA sequence
gtggctttctcatgatgtca

SEQ ID NO: 43707 - DNA, 20 bp, Artificial
  CRISPR gRNA sequence
tcctctaaccccgactttcc

SEQ ID NO: 43708 - DNA, 20 bp, Artificial
  CRISPR gRNA sequence
accccgactttcctggaaac

SEQ ID NO: 43709 - DNA, 20 bp, Artificial
  CRISPR gRNA sequence
ctttcctggaaactggacgt

SEQ ID NO: 43710 - DNA, 20 bp, Artificial
  CRISPR gRNA sequence
gaaactggacgttagatcaa

SEQ ID NO: 43711 - DNA, 20 bp, Artificial
  CRISPR gRNA sequence
aaactggacgttagatcaaa

SEQ ID NO: 43712 - DNA, 20 bp, Artificial
  CRISPR gRNA sequence
tcaaaaggctccatgacatt

SEQ ID NO: 43713 - DNA, 20 bp, Artificial
  CRISPR gRNA sequence
caaaaaacttacgtcaccga

SEQ ID NO: 43714 - DNA, 20 bp, Artificial
  CRISPR gRNA sequence
aaaaacttacgtcaccgaca

SEQ ID NO: 43715 - DNA, 20 bp, Artificial
  CRISPR gRNA sequence
gagctgtgcacttctcattg

SEQ ID NO: 43716 - DNA, 20 bp, Artificial
  CRISPR gRNA sequence
ttctcattgcagcctgtgac

SEQ ID NO: 43717 - DNA, 20 bp, Artificial
  CRISPR gRNA sequence
tctcattgcagcctgtgaca

SEQ ID NO: 43718 - DNA, 20 bp, Artificial
  CRISPR gRNA sequence
cagcctgtgacaaggcacct

SEQ ID NO: 43719 - DNA, 20 bp, Artificial
  CRISPR gRNA sequence
ttgccatcttaatcatttct

SEQ ID NO: 43720 - DNA, 20 bp, Artificial
  CRISPR gRNA sequence
tcatttctaagtgtaccatt

SEQ ID NO: 43721 - DNA, 20 bp, Artificial
  CRISPR gRNA sequence
catttctaagtgtaccattc

SEQ ID NO: 43722 - DNA, 20 bp, Artificial
  CRISPR gRNA sequence
tttctaagtgtaccattcag

SEQ ID NO: 43723 - DNA, 20 bp, Artificial
  CRISPR gRNA sequence
gtgtaccattcaggagtgtt

SEQ ID NO: 43724 - DNA, 20 bp, Artificial
  CRISPR gRNA sequence
agtacatccacttttttgta

SEQ ID NO: 43725 - DNA, 20 bp, Artificial
  CRISPR gRNA sequence
ttttttgtacggccaatctc

SEQ ID NO: 43726 - DNA, 20 bp, Artificial
  CRISPR gRNA sequence
accccatttcccccctaccc

SEQ ID NO: 43727 - DNA, 20 bp, Artificial
  CRISPR gRNA sequence
ttcccccctaccccagcccc

SEQ ID NO: 43728 - DNA, 20 bp, Artificial
  CRISPR gRNA sequence
tgctttctgtctctatgaat

SEQ ID NO: 43729 - DNA, 20 bp, Artificial
  CRISPR gRNA sequence
atgaattggactgctctaaa

SEQ ID NO: 43730 - DNA, 20 bp, Artificial
  CRISPR gRNA sequence
ctgctctaaatagtttatat

SEQ ID NO: 43731 - DNA, 20 bp, Artificial
  CRISPR gRNA sequence
ctctaaatagtttatatgag

SEQ ID NO: 43732 - DNA, 20 bp, Artificial
  CRISPR gRNA sequence
ctaaatagtttatatgagtg

SEQ ID NO: 43733 - DNA, 20 bp, Artificial
  CRISPR gRNA sequence
tgtatttgtctttttgtgac

SEQ ID NO: 43734 - DNA, 20 bp, Artificial
  CRISPR gRNA sequence
ttgtgactggctcatttcat

SEQ ID NO: 43735 - DNA, 20 bp, Artificial
  CRISPR gRNA sequence
tgtgactggctcatttcatt

SEQ ID NO: 43736 - DNA, 20 bp, Artificial
  CRISPR gRNA sequence
tcattgggcataatgtcctc

SEQ ID NO: 43737 - DNA, 20 bp, Artificial
  CRISPR gRNA sequence
cctctggttcattcatgttg

SEQ ID NO: 43738 - DNA, 20 bp, Artificial
  CRISPR gRNA sequence
tgcagcgtgtgtcactgtgt

SEQ ID NO: 43739 - DNA, 20 bp, Artificial
  CRISPR gRNA sequence
tttttttttttttttttttt

SEQ ID NO: 43740 - DNA, 20 bp, Artificial
  CRISPR gRNA sequence
ttttttttttttttttgaga

SEQ ID NO: 43741 - DNA, 20 bp, Artificial
  CRISPR gRNA sequence
ttttttttttttttgagaca

SEQ ID NO: 43742 - DNA, 20 bp, Artificial
  CRISPR gRNA sequence
agagtctcactcttgtcacc

SEQ ID NO: 43743 - DNA, 20 bp, Artificial
  CRISPR gRNA sequence
gagtctcactcttgtcacct

SEQ ID NO: 43744 - DNA, 20 bp, Artificial
  CRISPR gRNA sequence
ctcactcttgtcacctgggc

SEQ ID NO: 43745 - DNA, 20 bp, Artificial
  CRISPR gRNA sequence
cactcttgtcacctgggctg

SEQ ID NO: 43746 - DNA, 20 bp, Artificial
  CRISPR gRNA sequence
tcacctgggctggagtgcac

SEQ ID NO: 43747 - DNA, 20 bp, Artificial
  CRISPR gRNA sequence
ggagtgcactggctcgatct

SEQ ID NO: 43748 - DNA, 20 bp, Artificial
  CRISPR gRNA sequence
tcactgcaccctccacctct

SEQ ID NO: 43749 - DNA, 20 bp, Artificial
  CRISPR gRNA sequence
cactgcaccctccacctctt

SEQ ID NO: 43750 - DNA, 20 bp, Artificial
  CRISPR gRNA sequence
accctccacctcttgggttc

SEQ ID NO: 43751 - DNA, 20 bp, Artificial
  CRISPR gRNA sequence
ttcaagcgattctcctgcct

SEQ ID NO: 43752 - DNA, 20 bp, Artificial
  CRISPR gRNA sequence
gattctcctgcctcagcctc

SEQ ID NO: 43753 - DNA, 20 bp, Artificial
  CRISPR gRNA sequence
ttctcctgcctcagcctccg

SEQ ID NO: 43754 - DNA, 20 bp, Artificial
  CRISPR gRNA sequence
tcctgcctcagcctccggag

SEQ ID NO: 43755 - DNA, 20 bp, Artificial
  CRISPR gRNA sequence
gcctcagcctccggagtagc

SEQ ID NO: 43756 - DNA, 20 bp, Artificial
  CRISPR gRNA sequence
cctcagcctccggagtagct

SEQ ID NO: 43757 - DNA, 20 bp, Artificial
  CRISPR gRNA sequence
ctccggagtagctgggatta

SEQ ID NO: 43758 - DNA, 20 bp, Artificial
  CRISPR gRNA sequence
tccggagtagctgggattac

SEQ ID NO: 43759 - DNA, 20 bp, Artificial
  CRISPR gRNA sequence
caggcgcccgccaccacacc

SEQ ID NO: 43760 - DNA, 20 bp, Artificial
  CRISPR gRNA sequence
aatttttttttgtatttttg

SEQ ID NO: 43761 - DNA, 20 bp, Artificial
  CRISPR gRNA sequence
tttttttttgtatttttgta

SEQ ID NO: 43762 - DNA, 20 bp, Artificial
  CRISPR gRNA sequence
tttttgtatttttgtagaga

SEQ ID NO: 43763 - DNA, 20 bp, Artificial
  CRISPR gRNA sequence
ttttgtatttttgtagagac

SEQ ID NO: 43764 - DNA, 20 bp, Artificial
  CRISPR gRNA sequence
tttgtatttttgtagagaca

SEQ ID NO: 43765 - DNA, 20 bp, Artificial
  CRISPR gRNA sequence
gagacagggtttcaccatgt

SEQ ID NO: 43766 - DNA, 20 bp, Artificial
  CRISPR gRNA sequence
cagggtttcaccatgttggc

SEQ ID NO: 43767 - DNA, 20 bp, Artificial
  CRISPR gRNA sequence
agggtttcaccatgttggcg

SEQ ID NO: 43768 - DNA, 20 bp, Artificial
  CRISPR gRNA sequence
tttcaccatgttggcgaggc

SEQ ID NO: 43769 - DNA, 20 bp, Artificial
  CRISPR gRNA sequence
tggtctcgaactcctgacct

SEQ ID NO: 43770 - DNA, 20 bp, Artificial
  CRISPR gRNA sequence
ctcagatgatctgcccgttt

SEQ ID NO: 43771 - DNA, 20 bp, Artificial
  CRISPR gRNA sequence
ctgcccgtttcggccttcca

SEQ ID NO: 43772 - DNA, 20 bp, Artificial
  CRISPR gRNA sequence
gtttcggccttccaaagtgc

SEQ ID NO: 43773 - DNA, 20 bp, Artificial
  CRISPR gRNA sequence
tttcggccttccaaagtgct

SEQ ID NO: 43774 - DNA, 20 bp, Artificial
  CRISPR gRNA sequence
cttccaaagtgctgggatta

SEQ ID NO: 43775 - DNA, 20 bp, Artificial
  CRISPR gRNA sequence
ttccaaagtgctgggattac

SEQ ID NO: 43776 - DNA, 20 bp, Artificial
  CRISPR gRNA sequence
agtgctgggattacaggcat

SEQ ID NO: 43777 - DNA, 20 bp, Artificial
  CRISPR gRNA sequence
caggcatgagccaccacacc

SEQ ID NO: 43778 - DNA, 20 bp, Artificial
  CRISPR gRNA sequence
acccagccctttcctttttt

SEQ ID NO: 43779 - DNA, 20 bp, Artificial
  CRISPR gRNA sequence
cccagccctttcctttttta

SEQ ID NO: 43780 - DNA, 20 bp, Artificial
  CRISPR gRNA sequence
ctgcataatattccattgtg

SEQ ID NO: 43781 - DNA, 20 bp, Artificial
  CRISPR gRNA sequence
ataatattccattgtgtgga

SEQ ID NO: 43782 - DNA, 20 bp, Artificial
  CRISPR gRNA sequence
cttatccatcaattgacact

SEQ ID NO: 43783 - DNA, 20 bp, Artificial
  CRISPR gRNA sequence
ttatccatcaattgacactt

SEQ ID NO: 43784 - DNA, 20 bp, Artificial
  CRISPR gRNA sequence
gacacttgggttgtccattc

SEQ ID NO: 43785 - DNA, 20 bp, Artificial
  CRISPR gRNA sequence
ccattcaagtgcccaattga

SEQ ID NO: 43786 - DNA, 20 bp, Artificial
  CRISPR gRNA sequence
ttattttatttcaaaaacaa

SEQ ID NO: 43787 - DNA, 20 bp, Artificial
  CRISPR gRNA sequence
attttatttcaaaaacaata

SEQ ID NO: 43788 - DNA, 20 bp, Artificial
  CRISPR gRNA sequence
atttcaaaaacaatagagat

SEQ ID NO: 43789 - DNA, 20 bp, Artificial
  CRISPR gRNA sequence
tttcaaaaacaatagagatg

SEQ ID NO: 43790 - DNA, 20 bp, Artificial
  CRISPR gRNA sequence
tgaggtctcactgttttgcc

SEQ ID NO: 43791 - DNA, 20 bp, Artificial
  CRISPR gRNA sequence
gaggtctcactgttttgccc

SEQ ID NO: 43792 - DNA, 20 bp, Artificial
  CRISPR gRNA sequence
caggatgatcttgatctcct

SEQ ID NO: 43793 - DNA, 20 bp, Artificial
  CRISPR gRNA sequence
gatcttgatctcctgagctc

SEQ ID NO: 43794 - DNA, 20 bp, Artificial
  CRISPR gRNA sequence
ctcaagtgatcctcccacct

SEQ ID NO: 43795 - DNA, 20 bp, Artificial
  CRISPR gRNA sequence
cctcccacctcagcctccca

SEQ ID NO: 43796 - DNA, 20 bp, Artificial
  CRISPR gRNA sequence
acctcagcctcccaaagtgc

SEQ ID NO: 43797 - DNA, 20 bp, Artificial
  CRISPR gRNA sequence
cctcagcctcccaaagtgct

SEQ ID NO: 43798 - DNA, 20 bp, Artificial
  CRISPR gRNA sequence
cctcccaaagtgctaggcgt

SEQ ID NO: 43799 - DNA, 20 bp, Artificial
  CRISPR gRNA sequence
taggcgtgagccaccatgcc

SEQ ID NO: 43800 - DNA, 20 bp, Artificial
  CRISPR gRNA sequence
cgtgagccaccatgcccagc

SEQ ID NO: 43801 - DNA, 20 bp, Artificial
  CRISPR gRNA sequence
agccaccatgcccagccaga

SEQ ID NO: 43802 - DNA, 20 bp, Artificial
  CRISPR gRNA sequence
catgcccagccagaaagtcc

SEQ ID NO: 43803 - DNA, 20 bp, Artificial
  CRISPR gRNA sequence
gtcccagctttcaattattt

SEQ ID NO: 43804 - DNA, 20 bp, Artificial
  CRISPR gRNA sequence
aattattttggttatatatc

SEQ ID NO: 43805 - DNA, 20 bp, Artificial
  CRISPR gRNA sequence
ggttatatatccagaattgc

SEQ ID NO: 43806 - DNA, 20 bp, Artificial
  CRISPR gRNA sequence
ttatatatccagaattgcta

SEQ ID NO: 43807 - DNA, 20 bp, Artificial
  CRISPR gRNA sequence
caaaataacttttttttttt

SEQ ID NO: 43808 - DNA, 20 bp, Artificial
  CRISPR gRNA sequence
ataactttttttttttgaga

SEQ ID NO: 43809 - DNA, 20 bp, Artificial
  CRISPR gRNA sequence
aactttttttttttgagacg

SEQ ID NO: 43810 - DNA, 20 bp, Artificial
  CRISPR gRNA sequence
cggagtctcgctctgttgcc

SEQ ID NO: 43811 - DNA, 20 bp, Artificial
  CRISPR gRNA sequence
ggagtctcgctctgttgccc

SEQ ID NO: 43812 - DNA, 20 bp, Artificial
  CRISPR gRNA sequence
tctcgctctgttgcccaggt

SEQ ID NO: 43813 - DNA, 20 bp, Artificial
  CRISPR gRNA sequence
tcgctctgttgcccaggttg

SEQ ID NO: 43814 - DNA, 20 bp, Artificial
  CRISPR gRNA sequence
ctgttgcccaggttggagtg

SEQ ID NO: 43815 - DNA, 20 bp, Artificial
  CRISPR gRNA sequence
ttgcccaggttggagtgcag

SEQ ID NO: 43816 - DNA, 20 bp, Artificial
  CRISPR gRNA sequence
ggagtgcagtggtgcgatct

SEQ ID NO: 43817 - DNA, 20 bp, Artificial
  CRISPR gRNA sequence
gtgcgatctcggctcactgc

SEQ ID NO: 43818 - DNA, 20 bp, Artificial
  CRISPR gRNA sequence
tcactgcaagctccgcctcc

SEQ ID NO: 43819 - DNA, 20 bp, Artificial
  CRISPR gRNA sequence
cactgcaagctccgcctcct

SEQ ID NO: 43820 - DNA, 20 bp, Artificial
  CRISPR gRNA sequence
ttcacgccattctcctgcct

SEQ ID NO: 43821 - DNA, 20 bp, Artificial
  CRISPR gRNA sequence
cattctcctgcctcagcctc

SEQ ID NO: 43822 - DNA, 20 bp, Artificial
  CRISPR gRNA sequence
ttctcctgcctcagcctcca

SEQ ID NO: 43823 - DNA, 20 bp, Artificial
  CRISPR gRNA sequence
tcctgcctcagcctccagag

SEQ ID NO: 43824 - DNA, 20 bp, Artificial
  CRISPR gRNA sequence
gcctcagcctccagagtagc

SEQ ID NO: 43825 - DNA, 20 bp, Artificial
  CRISPR gRNA sequence
cctcagcctccagagtagct

SEQ ID NO: 43826 - DNA, 20 bp, Artificial
  CRISPR gRNA sequence
ctccagagtagctgggacta

SEQ ID NO: 43827 - DNA, 20 bp, Artificial
  CRISPR gRNA sequence
tccagagtagctgggactac

SEQ ID NO: 43828 - DNA, 20 bp, Artificial
  CRISPR gRNA sequence
tgactaatgttttgtatttt

SEQ ID NO: 43829 - DNA, 20 bp, Artificial
  CRISPR gRNA sequence
ctaatgttttgtatttttag

SEQ ID NO: 43830 - DNA, 20 bp, Artificial
  CRISPR gRNA sequence
aatgttttgtatttttagta

SEQ ID NO: 43831 - DNA, 20 bp, Artificial
  CRISPR gRNA sequence
ttttgtatttttagtagaga

SEQ ID NO: 43832 - DNA, 20 bp, Artificial
  CRISPR gRNA sequence
tttgtatttttagtagagac

SEQ ID NO: 43833 - DNA, 20 bp, Artificial
  CRISPR gRNA sequence
ttgtatttttagtagagacg

SEQ ID NO: 43834 - DNA, 20 bp, Artificial
  CRISPR gRNA sequence
gagacggggtttcaccatgt

SEQ ID NO: 43835 - DNA, 20 bp, Artificial
  CRISPR gRNA sequence
cggggtttcaccatgttagc

SEQ ID NO: 43836 - DNA, 20 bp, Artificial
  CRISPR gRNA sequence
ggggtttcaccatgttagcc

SEQ ID NO: 43837 - DNA, 20 bp, Artificial
  CRISPR gRNA sequence
tttcaccatgttagccagga

SEQ ID NO: 43838 - DNA, 20 bp, Artificial
  CRISPR gRNA sequence
acctcgtgatccccccacct

SEQ ID NO: 43839 - DNA, 20 bp, Artificial
  CRISPR gRNA sequence
ccccccacctcagcctccca

SEQ ID NO: 43840 - DNA, 20 bp, Artificial
  CRISPR gRNA sequence
acctcagcctcccaaagtgc

SEQ ID NO: 43841 - DNA, 20 bp, Artificial
  CRISPR gRNA sequence
cctcagcctcccaaagtgct

SEQ ID NO: 43842 - DNA, 20 bp, Artificial
  CRISPR gRNA sequence
ctcccaaagtgctgggatta

SEQ ID NO: 43843 - DNA, 20 bp, Artificial
  CRISPR gRNA sequence
tcccaaagtgctgggattac

SEQ ID NO: 43844 - DNA, 20 bp, Artificial
  CRISPR gRNA sequence
agtgctgggattacaggtgt

SEQ ID NO: 43845 - DNA, 20 bp, Artificial
  CRISPR gRNA sequence
caggtgtgagccactgcacc

SEQ ID NO: 43846 - DNA, 20 bp, Artificial
  CRISPR gRNA sequence
ttttcaaataaaacttttct

SEQ ID NO: 43847 - DNA, 20 bp, Artificial
  CRISPR gRNA sequence
tcttagtctaaaaataatat

SEQ ID NO: 43848 - DNA, 20 bp, Artificial
  CRISPR gRNA sequence
agtctaaaaataatattggt

SEQ ID NO: 43849 - DNA, 20 bp, Artificial
  CRISPR gRNA sequence
gtctaaaaataatattggtt

SEQ ID NO: 43850 - DNA, 20 bp, Artificial
  CRISPR gRNA sequence
tctaaaaataatattggttg

SEQ ID NO: 43851 - DNA, 20 bp, Artificial
  CRISPR gRNA sequence
ctaaaaataatattggttgg

SEQ ID NO: 43852 - DNA, 20 bp, Artificial
  CRISPR gRNA sequence
aaaataatattggttggggg

SEQ ID NO: 43853 - DNA, 20 bp, Artificial
  CRISPR gRNA sequence
ataatattggttgggggaag

SEQ ID NO: 43854 - DNA, 20 bp, Artificial
  CRISPR gRNA sequence
cgcctgtaatcccaacactt

SEQ ID NO: 43855 - DNA, 20 bp, Artificial
  CRISPR gRNA sequence
gcctgtaatcccaacacttt

SEQ ID NO: 43856 - DNA, 20 bp, Artificial
  CRISPR gRNA sequence
ctgtaatcccaacactttgg

SEQ ID NO: 43857 - DNA, 20 bp, Artificial
  CRISPR gRNA sequence
tgtaatcccaacactttggg

SEQ ID NO: 43858 - DNA, 20 bp, Artificial
  CRISPR gRNA sequence
tcccaacactttgggaggct

SEQ ID NO: 43859 - DNA, 20 bp, Artificial
  CRISPR gRNA sequence
cccaacactttgggaggctg

SEQ ID NO: 43860 - DNA, 20 bp, Artificial
  CRISPR gRNA sequence
aacactttgggaggctgagg

SEQ ID NO: 43861 - DNA, 20 bp, Artificial
  CRISPR gRNA sequence
acactttgggaggctgaggt

SEQ ID NO: 43862 - DNA, 20 bp, Artificial
  CRISPR gRNA sequence
ctttgggaggctgaggtggg

SEQ ID NO: 43863 - DNA, 20 bp, Artificial
  CRISPR gRNA sequence
ctgaggtgggcagattgttt

SEQ ID NO: 43864 - DNA, 20 bp, Artificial
  CRISPR gRNA sequence
gtgggcagattgtttgagct

SEQ ID NO: 43865 - DNA, 20 bp, Artificial
  CRISPR gRNA sequence
tgggcagattgtttgagctc

SEQ ID NO: 43866 - DNA, 20 bp, Artificial
  CRISPR gRNA sequence
ttgtttgagctcaggcgttc

SEQ ID NO: 43867 - DNA, 20 bp, Artificial
  CRISPR gRNA sequence
tgagctcaggcgttcaagac

SEQ ID NO: 43868 - DNA, 20 bp, Artificial
  CRISPR gRNA sequence
tcaggcgttcaagaccagcc

SEQ ID NO: 43869 - DNA, 20 bp, Artificial
  CRISPR gRNA sequence
caagaccagcctggacaaca

SEQ ID NO: 43870 - DNA, 20 bp, Artificial
  CRISPR gRNA sequence
ttaatcattgttgaaatgtg

SEQ ID NO: 43871 - DNA, 20 bp, Artificial
  CRISPR gRNA sequence
gttgaaatgtgcagaaaatc

SEQ ID NO: 43872 - DNA, 20 bp, Artificial
  CRISPR gRNA sequence
agaaaatccagaaatacata

SEQ ID NO: 43873 - DNA, 20 bp, Artificial
  CRISPR gRNA sequence
ccagaaatacataaagaaaa

SEQ ID NO: 43874 - DNA, 20 bp, Artificial
  CRISPR gRNA sequence
aaaatagtgctttaaaaatt

SEQ ID NO: 43875 - DNA, 20 bp, Artificial
  CRISPR gRNA sequence
aaaaattcagcataacttta

SEQ ID NO: 43876 - DNA, 20 bp, Artificial
  CRISPR gRNA sequence
aattcagcataactttaaag

SEQ ID NO: 43877 - DNA, 20 bp, Artificial
  CRISPR gRNA sequence
aaattaatgcacatgcattg

SEQ ID NO: 43878 - DNA, 20 bp, Artificial
  CRISPR gRNA sequence
taatgcacatgcattgtaga

SEQ ID NO: 43879 - DNA, 20 bp, Artificial
  CRISPR gRNA sequence
cacatgcattgtagaaagtt

SEQ ID NO: 43880 - DNA, 20 bp, Artificial
  CRISPR gRNA sequence
tgtagaaagtttagaaaata

SEQ ID NO: 43881 - DNA, 20 bp, Artificial
  CRISPR gRNA sequence
ttagaaaatatagaaaatta

SEQ ID NO: 43882 - DNA, 20 bp, Artificial
  CRISPR gRNA sequence
gaaaatatagaaaattaaag

SEQ ID NO: 43883 - DNA, 20 bp, Artificial
  CRISPR gRNA sequence
ataaaataaaaatcactcat

SEQ ID NO: 43884 - DNA, 20 bp, Artificial
  CRISPR gRNA sequence
ctttttttgaaatgcaaaat

SEQ ID NO: 43885 - DNA, 20 bp, Artificial
  CRISPR gRNA sequence
tttttttgaaatgcaaaatt

SEQ ID NO: 43886 - DNA, 20 bp, Artificial
  CRISPR gRNA sequence
ttgggatcatgttttatata

SEQ ID NO: 43887 - DNA, 20 bp, Artificial
  CRISPR gRNA sequence
atcatgttttatatacagtt

SEQ ID NO: 43888 - DNA, 20 bp, Artificial
  CRISPR gRNA sequence
tttcttaaatctaaaaatat

SEQ ID NO: 43889 - DNA, 20 bp, Artificial
  CRISPR gRNA sequence
cttaaatctaaaaatatcag

SEQ ID NO: 43890 - DNA, 20 bp, Artificial
  CRISPR gRNA sequence
atctaaaaatatcagtggcc

SEQ ID NO: 43891 - DNA, 20 bp, Artificial
  CRISPR gRNA sequence
aaaatatcagtggcccagtg

SEQ ID NO: 43892 - DNA, 20 bp, Artificial
  CRISPR gRNA sequence
atatcagtggcccagtgcag

SEQ ID NO: 43893 - DNA, 20 bp, Artificial
  CRISPR gRNA sequence
gtggctcacgcctgtaatcc

SEQ ID NO: 43894 - DNA, 20 bp, Artificial
  CRISPR gRNA sequence
cgcctgtaatcccagcactt

SEQ ID NO: 43895 - DNA, 20 bp, Artificial
  CRISPR gRNA sequence
gcctgtaatcccagcacttt

SEQ ID NO: 43896 - DNA, 20 bp, Artificial
  CRISPR gRNA sequence
ctgtaatcccagcactttgg

SEQ ID NO: 43897 - DNA, 20 bp, Artificial
  CRISPR gRNA sequence
tgtaatcccagcactttggg

SEQ ID NO: 43898 - DNA, 20 bp, Artificial
  CRISPR gRNA sequence
tcccagcactttgggaggcc

SEQ ID NO: 43899 - DNA, 20 bp, Artificial
  CRISPR gRNA sequence
cccagcactttgggaggccg

SEQ ID NO: 43900 - DNA, 20 bp, Artificial
  CRISPR gRNA sequence
agcactttgggaggccgagg

SEQ ID NO: 43901 - DNA, 20 bp, Artificial
  CRISPR gRNA sequence
gcactttgggaggccgaggc

SEQ ID NO: 43902 - DNA, 20 bp, Artificial
  CRISPR gRNA sequence
ctttgggaggccgaggcagg

SEQ ID NO: 43903 - DNA, 20 bp, Artificial
  CRISPR gRNA sequence
ccgaggcaggtggatcactt

SEQ ID NO: 43904 - DNA, 20 bp, Artificial
  CRISPR gRNA sequence
cgaggcaggtggatcacttg

SEQ ID NO: 43905 - DNA, 20 bp, Artificial
  CRISPR gRNA sequence
gcaggtggatcacttgaggt

SEQ ID NO: 43906 - DNA, 20 bp, Artificial
  CRISPR gRNA sequence
caggtggatcacttgaggtc

SEQ ID NO: 43907 - DNA, 20 bp, Artificial
  CRISPR gRNA sequence
ggtggatcacttgaggtcag

SEQ ID NO: 43908 - DNA, 20 bp, Artificial
  CRISPR gRNA sequence
tcacttgaggtcaggagttc

SEQ ID NO: 43909 - DNA, 20 bp, Artificial
  CRISPR gRNA sequence
tgaggtcaggagttcaagac

SEQ ID NO: 43910 - DNA, 20 bp, Artificial
  CRISPR gRNA sequence
caagaccagcctgaccaaca

SEQ ID NO: 43911 - DNA, 20 bp, Artificial
  CRISPR gRNA sequence
tctactaaaaatacaaaaat

SEQ ID NO: 43912 - DNA, 20 bp, Artificial
  CRISPR gRNA sequence
ctaaaaatacaaaaattagc

SEQ ID NO: 43913 - DNA, 20 bp, Artificial
  CRISPR gRNA sequence
taaaaatacaaaaattagcc

SEQ ID NO: 43914 - DNA, 20 bp, Artificial
  CRISPR gRNA sequence
atacaaaaattagccaggcg

SEQ ID NO: 43915 - DNA, 20 bp, Artificial
  CRISPR gRNA sequence
caaaaattagccaggcgtgg

SEQ ID NO: 43916 - DNA, 20 bp, Artificial
  CRISPR gRNA sequence
gtggcgcatgcctgtaatcc

SEQ ID NO: 43917 - DNA, 20 bp, Artificial
  CRISPR gRNA sequence
tgcctgtaatcccagctact

SEQ ID NO: 43918 - DNA, 20 bp, Artificial
  CRISPR gRNA sequence
gcctgtaatcccagctactt

SEQ ID NO: 43919 - DNA, 20 bp, Artificial
  CRISPR gRNA sequence
ctgtaatcccagctacttgg

SEQ ID NO: 43920 - DNA, 20 bp, Artificial
  CRISPR gRNA sequence
tgtaatcccagctacttggg

SEQ ID NO: 43921 - DNA, 20 bp, Artificial
  CRISPR gRNA sequence
tcccagctacttgggaggct

SEQ ID NO: 43922 - DNA, 20 bp, Artificial
  CRISPR gRNA sequence
cccagctacttgggaggctg

SEQ ID NO: 43923 - DNA, 20 bp, Artificial
  CRISPR gRNA sequence
agctacttgggaggctgagg

SEQ ID NO: 43924 - DNA, 20 bp, Artificial
  CRISPR gRNA sequence
gctacttgggaggctgaggc

SEQ ID NO: 43925 - DNA, 20 bp, Artificial
  CRISPR gRNA sequence
tacttgggaggctgaggcag

SEQ ID NO: 43926 - DNA, 20 bp, Artificial
  CRISPR gRNA sequence
gcaggagaatcgcttgaacc

SEQ ID NO: 43927 - DNA, 20 bp, Artificial
  CRISPR gRNA sequence
caggagaatcgcttgaaccc

SEQ ID NO: 43928 - DNA, 20 bp, Artificial
  CRISPR gRNA sequence
ggagaatcgcttgaacccag

SEQ ID NO: 43929 - DNA, 20 bp, Artificial
  CRISPR gRNA sequence
gagaatcgcttgaacccagg

SEQ ID NO: 43930 - DNA, 20 bp, Artificial
  CRISPR gRNA sequence
aatcgcttgaacccaggagg

SEQ ID NO: 43931 - DNA, 20 bp, Artificial
  CRISPR gRNA sequence
tcgcttgaacccaggaggca

SEQ ID NO: 43932 - DNA, 20 bp, Artificial
  CRISPR gRNA sequence
cgcttgaacccaggaggcag

SEQ ID NO: 43933 - DNA, 20 bp, Artificial
  CRISPR gRNA sequence
aacccaggaggcagaggttg

SEQ ID NO: 43934 - DNA, 20 bp, Artificial
  CRISPR gRNA sequence
ggcagaggttgcagtgatct

SEQ ID NO: 43935 - DNA, 20 bp, Artificial
  CRISPR gRNA sequence
gagatcatgccattgcactc

SEQ ID NO: 43936 - DNA, 20 bp, Artificial
  CRISPR gRNA sequence
catgccattgcactccagtc

SEQ ID NO: 43937 - DNA, 20 bp, Artificial
  CRISPR gRNA sequence
atgccattgcactccagtct

SEQ ID NO: 43938 - DNA, 20 bp, Artificial
  CRISPR gRNA sequence
tgcactccagtctgggcaac

SEQ ID NO: 43939 - DNA, 20 bp, Artificial
  CRISPR gRNA sequence
cactccagtctgggcaacaa

SEQ ID NO: 43940 - DNA, 20 bp, Artificial
  CRISPR gRNA sequence
ctctgtctcaaaaataaaat

SEQ ID NO: 43941 - DNA, 20 bp, Artificial
  CRISPR gRNA sequence
tctcaaaaataaaataagat

SEQ ID NO: 43942 - DNA, 20 bp, Artificial
  CRISPR gRNA sequence
aaaaaataatattttctgtt

SEQ ID NO: 43943 - DNA, 20 bp, Artificial
  CRISPR gRNA sequence
tgtttggattgtcacaacaa

SEQ ID NO: 43944 - DNA, 20 bp, Artificial
  CRISPR gRNA sequence
attgtcacaacaatagttgt

SEQ ID NO: 43945 - DNA, 20 bp, Artificial
  CRISPR gRNA sequence
acaacaatagttgttggaat

SEQ ID NO: 43946 - DNA, 20 bp, Artificial
  CRISPR gRNA sequence
caacaatagttgttggaata

SEQ ID NO: 43947 - DNA, 20 bp, Artificial
  CRISPR gRNA sequence
aacaatagttgttggaataa

SEQ ID NO: 43948 - DNA, 20 bp, Artificial
  CRISPR gRNA sequence
gtgatgttaatttccttttt

SEQ ID NO: 43949 - DNA, 20 bp, Artificial
  CRISPR gRNA sequence
tgcctacttgtataatttta

SEQ ID NO: 43950 - DNA, 20 bp, Artificial
  CRISPR gRNA sequence
taattttatagttttaaaat

SEQ ID NO: 43951 - DNA, 20 bp, Artificial
  CRISPR gRNA sequence
atgagcaaaaaaaactcaaa

SEQ ID NO: 43952 - DNA, 20 bp, Artificial
  CRISPR gRNA sequence
aaaaaaactcaaaaagcctc

SEQ ID NO: 43953 - DNA, 20 bp, Artificial
  CRISPR gRNA sequence
aaaaaactcaaaaagcctct

SEQ ID NO: 43954 - DNA, 20 bp, Artificial
  CRISPR gRNA sequence
cccccttgacactcctcccc

SEQ ID NO: 43955 - DNA, 20 bp, Artificial
  CRISPR gRNA sequence
tgattgtctgctgctcacct

SEQ ID NO: 43956 - DNA, 20 bp, Artificial
  CRISPR gRNA sequence
gattgtctgctgctcacctt

SEQ ID NO: 43957 - DNA, 20 bp, Artificial
  CRISPR gRNA sequence
attgtctgctgctcaccttg

SEQ ID NO: 43958 - DNA, 20 bp, Artificial
  CRISPR gRNA sequence
ttgtctgctgctcaccttgg

SEQ ID NO: 43959 - DNA, 20 bp, Artificial
  CRISPR gRNA sequence
tgtctgctgctcaccttggg

SEQ ID NO: 43960 - DNA, 20 bp, Artificial
  CRISPR gRNA sequence
gtctgctgctcaccttgggg

SEQ ID NO: 43961 - DNA, 20 bp, Artificial
  CRISPR gRNA sequence
atctgtgtccccttctgtga

SEQ ID NO: 43962 - DNA, 20 bp, Artificial
  CRISPR gRNA sequence
tctgtgtccccttctgtgac

SEQ ID NO: 43963 - DNA, 20 bp, Artificial
  CRISPR gRNA sequence
ctgtgtccccttctgtgaca

SEQ ID NO: 43964 - DNA, 20 bp, Artificial
  CRISPR gRNA sequence
tccccttctgtgacagggtg

SEQ ID NO: 43965 - DNA, 20 bp, Artificial
  CRISPR gRNA sequence
ccccttctgtgacagggtgc

SEQ ID NO: 43966 - DNA, 20 bp, Artificial
  CRISPR gRNA sequence
ccttctgtgacagggtgcag

SEQ ID NO: 43967 - DNA, 20 bp, Artificial
  CRISPR gRNA sequence
gtgacagggtgcaggagccg

SEQ ID NO: 43968 - DNA, 20 bp, Artificial
  CRISPR gRNA sequence
tgacagggtgcaggagccgt

SEQ ID NO: 43969 - DNA, 20 bp, Artificial
  CRISPR gRNA sequence
cagggtgcaggagccgtggg

SEQ ID NO: 43970 - DNA, 20 bp, Artificial
  CRISPR gRNA sequence
gtgcaggagccgtgggcgga

SEQ ID NO: 43971 - DNA, 20 bp, Artificial
  CRISPR gRNA sequence
gcaggagccgtgggcggaca

SEQ ID NO: 43972 - DNA, 20 bp, Artificial
  CRISPR gRNA sequence
gagccgtgggcggacagagc

SEQ ID NO: 43973 - DNA, 20 bp, Artificial
  CRISPR gRNA sequence
agccgtgggcggacagagcc

SEQ ID NO: 43974 - DNA, 20 bp, Artificial
  CRISPR gRNA sequence
gccgtgggcggacagagcca

SEQ ID NO: 43975 - DNA, 20 bp, Artificial
  CRISPR gRNA sequence
agccagggttctctccctgt

SEQ ID NO: 43976 - DNA, 20 bp, Artificial
  CRISPR gRNA sequence
cagggttctctccctgttag

SEQ ID NO: 43977 - DNA, 20 bp, Artificial
  CRISPR gRNA sequence
ccctgttagaagtctgcgcc

SEQ ID NO: 43978 - DNA, 20 bp, Artificial
  CRISPR gRNA sequence
cctgttagaagtctgcgccc

SEQ ID NO: 43979 - DNA, 20 bp, Artificial
  CRISPR gRNA sequence
agaagtctgcgcccaggcct

SEQ ID NO: 43980 - DNA, 20 bp, Artificial
  CRISPR gRNA sequence
gaagtctgcgcccaggcctc

SEQ ID NO: 43981 - DNA, 20 bp, Artificial
  CRISPR gRNA sequence
gtctgcgcccaggcctcagg

SEQ ID NO: 43982 - DNA, 20 bp, Artificial
  CRISPR gRNA sequence
tcaggcagtgtcactgaaat

SEQ ID NO: 43983 - DNA, 20 bp, Artificial
  CRISPR gRNA sequence
caggcagtgtcactgaaatc

SEQ ID NO: 43984 - DNA, 20 bp, Artificial
  CRISPR gRNA sequence
cagtgtcactgaaatcaggt

SEQ ID NO: 43985 - DNA, 20 bp, Artificial
  CRISPR gRNA sequence
tcactgaaatcaggtgagtc

SEQ ID NO: 43986 - DNA, 20 bp, Artificial
  CRISPR gRNA sequence
actgaaatcaggtgagtcca

SEQ ID NO: 43987 - DNA, 20 bp, Artificial
  CRISPR gRNA sequence
gaaatcaggtgagtccagag

SEQ ID NO: 43988 - DNA, 20 bp, Artificial
  CRISPR gRNA sequence
aatcaggtgagtccagagaa

SEQ ID NO: 43989 - DNA, 20 bp, Artificial
  CRISPR gRNA sequence
atcaggtgagtccagagaag

SEQ ID NO: 43990 - DNA, 20 bp, Artificial
  CRISPR gRNA sequence
gtccagagaagaggcccctt

SEQ ID NO: 43991 - DNA, 20 bp, Artificial
  CRISPR gRNA sequence
tggaattcttcatctttcat

SEQ ID NO: 43992 - DNA, 20 bp, Artificial
  CRISPR gRNA sequence
tcttcatctttcataagcat

SEQ ID NO: 43993 - DNA, 20 bp, Artificial
  CRISPR gRNA sequence
cttcatctttcataagcatt

SEQ ID NO: 43994 - DNA, 20 bp, Artificial
  CRISPR gRNA sequence
cttgaccttccctcatcctg

SEQ ID NO: 43995 - DNA, 20 bp, Artificial
  CRISPR gRNA sequence
ttgaccttccctcatcctgt

SEQ ID NO: 43996 - DNA, 20 bp, Artificial
  CRISPR gRNA sequence
tgaccttccctcatcctgtg

SEQ ID NO: 43997 - DNA, 20 bp, Artificial
  CRISPR gRNA sequence
tccctcatcctgtggggtaa

SEQ ID NO: 43998 - DNA, 20 bp, Artificial
  CRISPR gRNA sequence
tggggtaatagctgtgtcac

SEQ ID NO: 43999 - DNA, 20 bp, Artificial
  CRISPR gRNA sequence
gtaatagctgtgtcaccagc

SEQ ID NO: 44000 - DNA, 20 bp, Artificial
  CRISPR gRNA sequence
cagctagttttccatgtccc

SEQ ID NO: 44001 - DNA, 20 bp, Artificial
  CRISPR gRNA sequence
agctagttttccatgtcccc

SEQ ID NO: 44002 - DNA, 20 bp, Artificial
  CRISPR gRNA sequence
gctagttttccatgtcccca

SEQ ID NO: 44003 - DNA, 20 bp, Artificial
  CRISPR gRNA sequence
agttttccatgtccccaggg

SEQ ID NO: 44004 - DNA, 20 bp, Artificial
  CRISPR gRNA sequence
tttccatgtccccagggtag

SEQ ID NO: 44005 - DNA, 20 bp, Artificial
  CRISPR gRNA sequence
ttccatgtccccagggtagc

SEQ ID NO: 44006 - DNA, 20 bp, Artificial
  CRISPR gRNA sequence
ccatgtccccagggtagcag

SEQ ID NO: 44007 - DNA, 20 bp, Artificial
  CRISPR gRNA sequence
cccagggtagcaggagctcc

SEQ ID NO: 44008 - DNA, 20 bp, Artificial
  CRISPR gRNA sequence
ccagggtagcaggagctcct

SEQ ID NO: 44009 - DNA, 20 bp, Artificial
  CRISPR gRNA sequence
cagggtagcaggagctcctg

SEQ ID NO: 44010 - DNA, 20 bp, Artificial
  CRISPR gRNA sequence
ggagctcctggggcatatgt

SEQ ID NO: 44011 - DNA, 20 bp, Artificial
  CRISPR gRNA sequence
gagctcctggggcatatgtg

SEQ ID NO: 44012 - DNA, 20 bp, Artificial
  CRISPR gRNA sequence
agctcctggggcatatgtga

SEQ ID NO: 44013 - DNA, 20 bp, Artificial
  CRISPR gRNA sequence
gctcctggggcatatgtgag

SEQ ID NO: 44014 - DNA, 20 bp, Artificial
  CRISPR gRNA sequence
gtgaggggctacacatttgt

SEQ ID NO: 44015 - DNA, 20 bp, Artificial
  CRISPR gRNA sequence
tgaggggctacacatttgtt

SEQ ID NO: 44016 - DNA, 20 bp, Artificial
  CRISPR gRNA sequence
ggctacacatttgttgggac

SEQ ID NO: 44017 - DNA, 20 bp, Artificial
  CRISPR gRNA sequence
cacatttgttgggactagtg

SEQ ID NO: 44018 - DNA, 20 bp, Artificial
  CRISPR gRNA sequence
atttgttgggactagtgcag

SEQ ID NO: 44019 - DNA, 20 bp, Artificial
  CRISPR gRNA sequence
ttgggactagtgcagtagtc

SEQ ID NO: 44020 - DNA, 20 bp, Artificial
  CRISPR gRNA sequence
ctagtgcagtagtcaagcca

SEQ ID NO: 44021 - DNA, 20 bp, Artificial
  CRISPR gRNA sequence
cagtagtcaagccacagtgt

SEQ ID NO: 44022 - DNA, 20 bp, Artificial
  CRISPR gRNA sequence
gtagtcaagccacagtgtca

SEQ ID NO: 44023 - DNA, 20 bp, Artificial
  CRISPR gRNA sequence
tagtcaagccacagtgtcag

SEQ ID NO: 44024 - DNA, 20 bp, Artificial
  CRISPR gRNA sequence
tcaagccacagtgtcagagg

SEQ ID NO: 44025 - DNA, 20 bp, Artificial
  CRISPR gRNA sequence
gtgtcagaggaagacatccc

SEQ ID NO: 44026 - DNA, 20 bp, Artificial
  CRISPR gRNA sequence
acatccccagaatcaaaaca

SEQ ID NO: 44027 - DNA, 20 bp, Artificial
  CRISPR gRNA sequence
catccccagaatcaaaacaa

SEQ ID NO: 44028 - DNA, 20 bp, Artificial
  CRISPR gRNA sequence
atccccagaatcaaaacaaa

SEQ ID NO: 44029 - DNA, 20 bp, Artificial
  CRISPR gRNA sequence
gaatcaaaacaaagggctat

SEQ ID NO: 44030 - DNA, 20 bp, Artificial
  CRISPR gRNA sequence
aaacaaagggctattggatc

SEQ ID NO: 44031 - DNA, 20 bp, Artificial
  CRISPR gRNA sequence
aacaaagggctattggatcc

SEQ ID NO: 44032 - DNA, 20 bp, Artificial
  CRISPR gRNA sequence
aaagggctattggatccagg

SEQ ID NO: 44033 - DNA, 20 bp, Artificial
  CRISPR gRNA sequence
ctattggatccaggcagaca

SEQ ID NO: 44034 - DNA, 20 bp, Artificial
  CRISPR gRNA sequence
tggatccaggcagacatggc

SEQ ID NO: 44035 - DNA, 20 bp, Artificial
  CRISPR gRNA sequence
ggatccaggcagacatggct

SEQ ID NO: 44036 - DNA, 20 bp, Artificial
  CRISPR gRNA sequence
atccaggcagacatggctgg

SEQ ID NO: 44037 - DNA, 20 bp, Artificial
  CRISPR gRNA sequence
acatggctgggagtccacgc

SEQ ID NO: 44038 - DNA, 20 bp, Artificial
  CRISPR gRNA sequence
gggagtccacgctggttgct

SEQ ID NO: 44039 - DNA, 20 bp, Artificial
  CRISPR gRNA sequence
agtccacgctggttgcttgg

SEQ ID NO: 44040 - DNA, 20 bp, Artificial
  CRISPR gRNA sequence
ccacgctggttgcttggaag

SEQ ID NO: 44041 - DNA, 20 bp, Artificial
  CRISPR gRNA sequence
gttgcttggaagtggccccc

SEQ ID NO: 44042 - DNA, 20 bp, Artificial
  CRISPR gRNA sequence
tggaagtggccccccagatg

SEQ ID NO: 44043 - DNA, 20 bp, Artificial
  CRISPR gRNA sequence
agatgcagtaacacacatta

SEQ ID NO: 44044 - DNA, 20 bp, Artificial
  CRISPR gRNA sequence
acacattatggctcttcaac

SEQ ID NO: 44045 - DNA, 20 bp, Artificial
  CRISPR gRNA sequence
agaaataacacaatgacaca

SEQ ID NO: 44046 - DNA, 20 bp, Artificial
  CRISPR gRNA sequence
aaataacacaatgacacaca

SEQ ID NO: 44047 - DNA, 20 bp, Artificial
  CRISPR gRNA sequence
taacacaatgacacacagag

SEQ ID NO: 44048 - DNA, 20 bp, Artificial
  CRISPR gRNA sequence
atgacacacagagtagctta

SEQ ID NO: 44049 - DNA, 20 bp, Artificial
  CRISPR gRNA sequence
acacagagtagcttatagca

SEQ ID NO: 44050 - DNA, 20 bp, Artificial
  CRISPR gRNA sequence
cacagagtagcttatagcaa

SEQ ID NO: 44051 - DNA, 20 bp, Artificial
  CRISPR gRNA sequence
gtagcttatagcaaaggttt

SEQ ID NO: 44052 - DNA, 20 bp, Artificial
  CRISPR gRNA sequence
aaaggttttagcatcccact

SEQ ID NO: 44053 - DNA, 20 bp, Artificial
  CRISPR gRNA sequence
gcatcccactcagctatgtt

SEQ ID NO: 44054 - DNA, 20 bp, Artificial
  CRISPR gRNA sequence
gctatgttcagatcccaact

SEQ ID NO: 44055 - DNA, 20 bp, Artificial
  CRISPR gRNA sequence
atcccaactcagtcacttac

SEQ ID NO: 44056 - DNA, 20 bp, Artificial
  CRISPR gRNA sequence
caactcagtcacttactggt

SEQ ID NO: 44057 - DNA, 20 bp, Artificial
  CRISPR gRNA sequence
actcagtcacttactggttg

SEQ ID NO: 44058 - DNA, 20 bp, Artificial
  CRISPR gRNA sequence
cctcaacctcctgctcttaa

SEQ ID NO: 44059 - DNA, 20 bp, Artificial
  CRISPR gRNA sequence
tcaacctcctgctcttaaaa

SEQ ID NO: 44060 - DNA, 20 bp, Artificial
  CRISPR gRNA sequence
ctcttaaaagagtctaatta

SEQ ID NO: 44061 - DNA, 20 bp, Artificial
  CRISPR gRNA sequence
agtctaattacggccctttg

SEQ ID NO: 44062 - DNA, 20 bp, Artificial
  CRISPR gRNA sequence
gtctaattacggccctttgc

SEQ ID NO: 44063 - DNA, 20 bp, Artificial
  CRISPR gRNA sequence
tctaattacggccctttgca

SEQ ID NO: 44064 - DNA, 20 bp, Artificial
  CRISPR gRNA sequence
attacggccctttgcagggc

SEQ ID NO: 44065 - DNA, 20 bp, Artificial
  CRISPR gRNA sequence
ttacggccctttgcagggct

SEQ ID NO: 44066 - DNA, 20 bp, Artificial
  CRISPR gRNA sequence
acggccctttgcagggctgg

SEQ ID NO: 44067 - DNA, 20 bp, Artificial
  CRISPR gRNA sequence
cggccctttgcagggctggg

SEQ ID NO: 44068 - DNA, 20 bp, Artificial
  CRISPR gRNA sequence
tgcagggctgggaggattac

SEQ ID NO: 44069 - DNA, 20 bp, Artificial
  CRISPR gRNA sequence
gctgggaggattacaagaac

SEQ ID NO: 44070 - DNA, 20 bp, Artificial
  CRISPR gRNA sequence
tgggaggattacaagaactg

SEQ ID NO: 44071 - DNA, 20 bp, Artificial
  CRISPR gRNA sequence
tacaagaactggagcctgta

SEQ ID NO: 44072 - DNA, 20 bp, Artificial
  CRISPR gRNA sequence
gatgtctgctgtactgtcac

SEQ ID NO: 44073 - DNA, 20 bp, Artificial
  CRISPR gRNA sequence
ctgtactgtcaccagccaca

SEQ ID NO: 44074 - DNA, 20 bp, Artificial
  CRISPR gRNA sequence
tgcttcttccttctctcctc

SEQ ID NO: 44075 - DNA, 20 bp, Artificial
  CRISPR gRNA sequence
gcttcttccttctctcctcc

SEQ ID NO: 44076 - DNA, 20 bp, Artificial
  CRISPR gRNA sequence
ttcttccttctctcctccag

SEQ ID NO: 44077 - DNA, 20 bp, Artificial
  CRISPR gRNA sequence
tccttctctcctccaggagt

SEQ ID NO: 44078 - DNA, 20 bp, Artificial
  CRISPR gRNA sequence
tctctcctccaggagtgagc

SEQ ID NO: 44079 - DNA, 20 bp, Artificial
  CRISPR gRNA sequence
ctctcctccaggagtgagca

SEQ ID NO: 44080 - DNA, 20 bp, Artificial
  CRISPR gRNA sequence
tctcctccaggagtgagcaa

SEQ ID NO: 44081 - DNA, 20 bp, Artificial
  CRISPR gRNA sequence
ctcctccaggagtgagcaag

SEQ ID NO: 44082 - DNA, 20 bp, Artificial
  CRISPR gRNA sequence
gagtgagcaaggggatgctc

SEQ ID NO: 44083 - DNA, 20 bp, Artificial
  CRISPR gRNA sequence
agtgagcaaggggatgctct

SEQ ID NO: 44084 - DNA, 20 bp, Artificial
  CRISPR gRNA sequence
gtgagcaaggggatgctctg

SEQ ID NO: 44085 - DNA, 20 bp, Artificial
  CRISPR gRNA sequence
ggggactttataatctccca

SEQ ID NO: 44086 - DNA, 20 bp, Artificial
  CRISPR gRNA sequence
tcccatagccctctccccat

SEQ ID NO: 44087 - DNA, 20 bp, Artificial
  CRISPR gRNA sequence
accccatgaacataacattc

SEQ ID NO: 44088 - DNA, 20 bp, Artificial
  CRISPR gRNA sequence
atgaacataacattcaagtg

SEQ ID NO: 44089 - DNA, 20 bp, Artificial
  CRISPR gRNA sequence
tgaacataacattcaagtga

SEQ ID NO: 44090 - DNA, 20 bp, Artificial
  CRISPR gRNA sequence
acataacattcaagtgaagg

SEQ ID NO: 44091 - DNA, 20 bp, Artificial
  CRISPR gRNA sequence
aacattcaagtgaaggcagt

SEQ ID NO: 44092 - DNA, 20 bp, Artificial
  CRISPR gRNA sequence
tcaagtgaaggcagtgagct

SEQ ID NO: 44093 - DNA, 20 bp, Artificial
  CRISPR gRNA sequence
aagtgaaggcagtgagctta

SEQ ID NO: 44094 - DNA, 20 bp, Artificial
  CRISPR gRNA sequence
gtgagcttagagcgcaaatg

SEQ ID NO: 44095 - DNA, 20 bp, Artificial
  CRISPR gRNA sequence
tagagcgcaaatgcagactc

SEQ ID NO: 44096 - DNA, 20 bp, Artificial
  CRISPR gRNA sequence
cccacccttccaccacactg

SEQ ID NO: 44097 - DNA, 20 bp, Artificial
  CRISPR gRNA sequence
tggtccttgtgcccctccct

SEQ ID NO: 44098 - DNA, 20 bp, Artificial
  CRISPR gRNA sequence
gcccctccctcagaaaattc

SEQ ID NO: 44099 - DNA, 20 bp, Artificial
  CRISPR gRNA sequence
gaaaattctggaactgccct

SEQ ID NO: 44100 - DNA, 20 bp, Artificial
  CRISPR gRNA sequence
ctgcccttggatccctctaa

SEQ ID NO: 44101 - DNA, 20 bp, Artificial
  CRISPR gRNA sequence
cctctaatggctttctgtca

SEQ ID NO: 44102 - DNA, 20 bp, Artificial
  CRISPR gRNA sequence
gctttctgtcatggtctgaa

SEQ ID NO: 44103 - DNA, 20 bp, Artificial
  CRISPR gRNA sequence
ctttctgtcatggtctgaaa

SEQ ID NO: 44104 - DNA, 20 bp, Artificial
  CRISPR gRNA sequence
attaactttaaattgttgaa

SEQ ID NO: 44105 - DNA, 20 bp, Artificial
  CRISPR gRNA sequence
ttaactttaaattgttgaaa

SEQ ID NO: 44106 - DNA, 20 bp, Artificial
  CRISPR gRNA sequence
taactttaaattgttgaaaa

SEQ ID NO: 44107 - DNA, 20 bp, Artificial
  CRISPR gRNA sequence
tttaaattgttgaaaagggc

SEQ ID NO: 44108 - DNA, 20 bp, Artificial
  CRISPR gRNA sequence
ttaaattgttgaaaagggcc

SEQ ID NO: 44109 - DNA, 20 bp, Artificial
  CRISPR gRNA sequence
ttgttgaaaagggccaggcg

SEQ ID NO: 44110 - DNA, 20 bp, Artificial
  CRISPR gRNA sequence
ttgaaaagggccaggcgcgg

SEQ ID NO: 44111 - DNA, 20 bp, Artificial
  CRISPR gRNA sequence
gtggctcacgcctgtaaccc

SEQ ID NO: 44112 - DNA, 20 bp, Artificial
  CRISPR gRNA sequence
cgcctgtaaccccagcactt

SEQ ID NO: 44113 - DNA, 20 bp, Artificial
  CRISPR gRNA sequence
gcctgtaaccccagcacttt

SEQ ID NO: 44114 - DNA, 20 bp, Artificial
  CRISPR gRNA sequence
ctgtaaccccagcactttgg

SEQ ID NO: 44115 - DNA, 20 bp, Artificial
  CRISPR gRNA sequence
tgtaaccccagcactttggg

SEQ ID NO: 44116 - DNA, 20 bp, Artificial
  CRISPR gRNA sequence
ccccagcactttgggaggcc

SEQ ID NO: 44117 - DNA, 20 bp, Artificial
  CRISPR gRNA sequence
cccagcactttgggaggccg

SEQ ID NO: 44118 - DNA, 20 bp, Artificial
  CRISPR gRNA sequence
agcactttgggaggccgagg

SEQ ID NO: 44119 - DNA, 20 bp, Artificial
  CRISPR gRNA sequence
gcactttgggaggccgaggc

SEQ ID NO: 44120 - DNA, 20 bp, Artificial
  CRISPR gRNA sequence
actttgggaggccgaggcag

SEQ ID NO: 44121 - DNA, 20 bp, Artificial
  CRISPR gRNA sequence
ctttgggaggccgaggcagg

SEQ ID NO: 44122 - DNA, 20 bp, Artificial
  CRISPR gRNA sequence
ccgaggcaggaggatcactg

SEQ ID NO: 44123 - DNA, 20 bp, Artificial
  CRISPR gRNA sequence
gcaggaggatcactgaagcc

SEQ ID NO: 44124 - DNA, 20 bp, Artificial
  CRISPR gRNA sequence
aggaggatcactgaagccca

SEQ ID NO: 44125 - DNA, 20 bp, Artificial
  CRISPR gRNA sequence
atcactgaagcccagagttc

SEQ ID NO: 44126 - DNA, 20 bp, Artificial
  CRISPR gRNA sequence
tcactgaagcccagagttca

SEQ ID NO: 44127 - DNA, 20 bp, Artificial
  CRISPR gRNA sequence
aagcccagagttcaaggctg

SEQ ID NO: 44128 - DNA, 20 bp, Artificial
  CRISPR gRNA sequence
ccagagttcaaggctgcagt

SEQ ID NO: 44129 - DNA, 20 bp, Artificial
  CRISPR gRNA sequence
tcgtgcccaccactgcactt

SEQ ID NO: 44130 - DNA, 20 bp, Artificial
  CRISPR gRNA sequence
cccaccactgcacttcagcc

SEQ ID NO: 44131 - DNA, 20 bp, Artificial
  CRISPR gRNA sequence
ccaccactgcacttcagcct

SEQ ID NO: 44132 - DNA, 20 bp, Artificial
  CRISPR gRNA sequence
ctgcacttcagcctgggcta

SEQ ID NO: 44133 - DNA, 20 bp, Artificial
  CRISPR gRNA sequence
gcacttcagcctgggctaca

SEQ ID NO: 44134 - DNA, 20 bp, Artificial
  CRISPR gRNA sequence
ttcagcctgggctacagagc

SEQ ID NO: 44135 - DNA, 20 bp, Artificial
  CRISPR gRNA sequence
tctctttaaaaaaaaaaaaa

SEQ ID NO: 44136 - DNA, 20 bp, Artificial
  CRISPR gRNA sequence
tttaaaaaaaaaaaaaaaga

SEQ ID NO: 44137 - DNA, 20 bp, Artificial
  CRISPR gRNA sequence
taaaaaaaaaaaaaaagaaa

SEQ ID NO: 44138 - DNA, 20 bp, Artificial
  CRISPR gRNA sequence
gaaagagaaaaattgttgaa

SEQ ID NO: 44139 - DNA, 20 bp, Artificial
  CRISPR gRNA sequence
aaagagaaaaattgttgaaa

SEQ ID NO: 44140 - DNA, 20 bp, Artificial
  CRISPR gRNA sequence
attgttgaaaaggcactact

SEQ ID NO: 44141 - DNA, 20 bp, Artificial
  CRISPR gRNA sequence
ttgttgaaaaggcactactt

SEQ ID NO: 44142 - DNA, 20 bp, Artificial
  CRISPR gRNA sequence
tgttgaaaaggcactacttg

SEQ ID NO: 44143 - DNA, 20 bp, Artificial
  CRISPR gRNA sequence
ggggtattgtgtgtgactca

SEQ ID NO: 44144 - DNA, 20 bp, Artificial
  CRISPR gRNA sequence
gtattgtgtgtgactcacgg

SEQ ID NO: 44145 - DNA, 20 bp, Artificial
  CRISPR gRNA sequence
tcacggaagcacctactttc

SEQ ID NO: 44146 - DNA, 20 bp, Artificial
  CRISPR gRNA sequence
agcacctactttccagtcct

SEQ ID NO: 44147 - DNA, 20 bp, Artificial
  CRISPR gRNA sequence
cctactttccagtcctaagc

SEQ ID NO: 44148 - DNA, 20 bp, Artificial
  CRISPR gRNA sequence
tccagtcctaagctggtccc

SEQ ID NO: 44149 - DNA, 20 bp, Artificial
  CRISPR gRNA sequence
agtcctaagctggtccctgg

SEQ ID NO: 44150 - DNA, 20 bp, Artificial
  CRISPR gRNA sequence
gtcctaagctggtccctggc

SEQ ID NO: 44151 - DNA, 20 bp, Artificial
  CRISPR gRNA sequence
tcctaagctggtccctggca

SEQ ID NO: 44152 - DNA, 20 bp, Artificial
  CRISPR gRNA sequence
cctaagctggtccctggcag

SEQ ID NO: 44153 - DNA, 20 bp, Artificial
  CRISPR gRNA sequence
taagctggtccctggcaggg

SEQ ID NO: 44154 - DNA, 20 bp, Artificial
  CRISPR gRNA sequence
gctggtccctggcaggggag

SEQ ID NO: 44155 - DNA, 20 bp, Artificial
  CRISPR gRNA sequence
ctggtccctggcaggggaga

SEQ ID NO: 44156 - DNA, 20 bp, Artificial
  CRISPR gRNA sequence
tggtccctggcaggggagaa

SEQ ID NO: 44157 - DNA, 20 bp, Artificial
  CRISPR gRNA sequence
ggtccctggcaggggagaag

SEQ ID NO: 44158 - DNA, 20 bp, Artificial
  CRISPR gRNA sequence
tggcaggggagaaggggacc

SEQ ID NO: 44159 - DNA, 20 bp, Artificial
  CRISPR gRNA sequence
ggcaggggagaaggggaccc

SEQ ID NO: 44160 - DNA, 20 bp, Artificial
  CRISPR gRNA sequence
gggagaaggggacccaggca

SEQ ID NO: 44161 - DNA, 20 bp, Artificial
  CRISPR gRNA sequence
gaaggggacccaggcaaagt

SEQ ID NO: 44162 - DNA, 20 bp, Artificial
  CRISPR gRNA sequence
aggggacccaggcaaagtga

SEQ ID NO: 44163 - DNA, 20 bp, Artificial
  CRISPR gRNA sequence
acccaggcaaagtgagagtt

SEQ ID NO: 44164 - DNA, 20 bp, Artificial
  CRISPR gRNA sequence
ccaggcaaagtgagagttca

SEQ ID NO: 44165 - DNA, 20 bp, Artificial
  CRISPR gRNA sequence
gcaaagtgagagttcagagt

SEQ ID NO: 44166 - DNA, 20 bp, Artificial
  CRISPR gRNA sequence
aaagtgagagttcagagttg

SEQ ID NO: 44167 - DNA, 20 bp, Artificial
  CRISPR gRNA sequence
tgagagttcagagttggagc

SEQ ID NO: 44168 - DNA, 20 bp, Artificial
  CRISPR gRNA sequence
gagagttcagagttggagcc

SEQ ID NO: 44169 - DNA, 20 bp, Artificial
  CRISPR gRNA sequence
agttcagagttggagccggg

SEQ ID NO: 44170 - DNA, 20 bp, Artificial
  CRISPR gRNA sequence
agagttggagccgggcagcc

SEQ ID NO: 44171 - DNA, 20 bp, Artificial
  CRISPR gRNA sequence
gagttggagccgggcagccc

SEQ ID NO: 44172 - DNA, 20 bp, Artificial
  CRISPR gRNA sequence
gagccgggcagcccaggtgc

SEQ ID NO: 44173 - DNA, 20 bp, Artificial
  CRISPR gRNA sequence
cgggcagcccaggtgccagc

SEQ ID NO: 44174 - DNA, 20 bp, Artificial
  CRISPR gRNA sequence
gggcagcccaggtgccagct

SEQ ID NO: 44175 - DNA, 20 bp, Artificial
  CRISPR gRNA sequence
caggtgccagctaggccctc

SEQ ID NO: 44176 - DNA, 20 bp, Artificial
  CRISPR gRNA sequence
aggtgccagctaggccctcc

SEQ ID NO: 44177 - DNA, 20 bp, Artificial
  CRISPR gRNA sequence
ggtgccagctaggccctccg

SEQ ID NO: 44178 - DNA, 20 bp, Artificial
  CRISPR gRNA sequence
gccagctaggccctccgggg

SEQ ID NO: 44179 - DNA, 20 bp, Artificial
  CRISPR gRNA sequence
ccagctaggccctccgggga

SEQ ID NO: 44180 - DNA, 20 bp, Artificial
  CRISPR gRNA sequence
aaggctgcccgacctcacgt

SEQ ID NO: 44181 - DNA, 20 bp, Artificial
  CRISPR gRNA sequence
gttggttactgctcactcct

SEQ ID NO: 44182 - DNA, 20 bp, Artificial
  CRISPR gRNA sequence
gctcactcctcagcatctcc

SEQ ID NO: 44183 - DNA, 20 bp, Artificial
  CRISPR gRNA sequence
tcctcagcatctccgagacc

SEQ ID NO: 44184 - DNA, 20 bp, Artificial
  CRISPR gRNA sequence
tcagcatctccgagacccag

SEQ ID NO: 44185 - DNA, 20 bp, Artificial
  CRISPR gRNA sequence
gcatctccgagacccagcag

SEQ ID NO: 44186 - DNA, 20 bp, Artificial
  CRISPR gRNA sequence
cccagcagcagctctgtgtc

SEQ ID NO: 44187 - DNA, 20 bp, Artificial
  CRISPR gRNA sequence
gcagcagctctgtgtccagc

SEQ ID NO: 44188 - DNA, 20 bp, Artificial
  CRISPR gRNA sequence
tccagctggaatttcctcgc

SEQ ID NO: 44189 - DNA, 20 bp, Artificial
  CRISPR gRNA sequence
ccagctggaatttcctcgcc

SEQ ID NO: 44190 - DNA, 20 bp, Artificial
  CRISPR gRNA sequence
gctggaatttcctcgccagg

SEQ ID NO: 44191 - DNA, 20 bp, Artificial
  CRISPR gRNA sequence
tggaatttcctcgccaggaa

SEQ ID NO: 44192 - DNA, 20 bp, Artificial
  CRISPR gRNA sequence
tcctcgccaggaagagaatc

SEQ ID NO: 44193 - DNA, 20 bp, Artificial
  CRISPR gRNA sequence
tcgccaggaagagaatccag

SEQ ID NO: 44194 - DNA, 20 bp, Artificial
  CRISPR gRNA sequence
ggaagagaatccagaagctg

SEQ ID NO: 44195 - DNA, 20 bp, Artificial
  CRISPR gRNA sequence
aatccagaagctgtggcact

SEQ ID NO: 44196 - DNA, 20 bp, Artificial
  CRISPR gRNA sequence
atccagaagctgtggcactc

SEQ ID NO: 44197 - DNA, 20 bp, Artificial
  CRISPR gRNA sequence
cagaagctgtggcactcagg

SEQ ID NO: 44198 - DNA, 20 bp, Artificial
  CRISPR gRNA sequence
agaagctgtggcactcaggt

SEQ ID NO: 44199 - DNA, 20 bp, Artificial
  CRISPR gRNA sequence
tgtggcactcaggtgggacc

SEQ ID NO: 44200 - DNA, 20 bp, Artificial
  CRISPR gRNA sequence
actcaggtgggacccagcac

SEQ ID NO: 44201 - DNA, 20 bp, Artificial
  CRISPR gRNA sequence
ctcaggtgggacccagcacc

SEQ ID NO: 44202 - DNA, 20 bp, Artificial
  CRISPR gRNA sequence
tcaggtgggacccagcacca

SEQ ID NO: 44203 - DNA, 20 bp, Artificial
  CRISPR gRNA sequence
gacccagcaccagggacccc

SEQ ID NO: 44204 - DNA, 20 bp, Artificial
  CRISPR gRNA sequence
acccagcaccagggacccca

SEQ ID NO: 44205 - DNA, 20 bp, Artificial
  CRISPR gRNA sequence
cagcaccagggaccccaagg

SEQ ID NO: 44206 - DNA, 20 bp, Artificial
  CRISPR gRNA sequence
agcaccagggaccccaaggc

SEQ ID NO: 44207 - DNA, 20 bp, Artificial
  CRISPR gRNA sequence
gcaccagggaccccaaggca

SEQ ID NO: 44208 - DNA, 20 bp, Artificial
  CRISPR gRNA sequence
caccagggaccccaaggcag

SEQ ID NO: 44209 - DNA, 20 bp, Artificial
  CRISPR gRNA sequence
agggaccccaaggcaggggc

SEQ ID NO: 44210 - DNA, 20 bp, Artificial
  CRISPR gRNA sequence
cccaaggcaggggctggtgt

SEQ ID NO: 44211 - DNA, 20 bp, Artificial
  CRISPR gRNA sequence
ccaaggcaggggctggtgtt

SEQ ID NO: 44212 - DNA, 20 bp, Artificial
  CRISPR gRNA sequence
caaggcaggggctggtgttg

SEQ ID NO: 44213 - DNA, 20 bp, Artificial
  CRISPR gRNA sequence
aggcaggggctggtgttggg

SEQ ID NO: 44214 - DNA, 20 bp, Artificial
  CRISPR gRNA sequence
ggcaggggctggtgttgggg

SEQ ID NO: 44215 - DNA, 20 bp, Artificial
  CRISPR gRNA sequence
gcaggggctggtgttgggga

SEQ ID NO: 44216 - DNA, 20 bp, Artificial
  CRISPR gRNA sequence
caggggctggtgttggggag

SEQ ID NO: 44217 - DNA, 20 bp, Artificial
  CRISPR gRNA sequence
aggggctggtgttggggagg

SEQ ID NO: 44218 - DNA, 20 bp, Artificial
  CRISPR gRNA sequence
ggctggtgttggggaggggg

SEQ ID NO: 44219 - DNA, 20 bp, Artificial
  CRISPR gRNA sequence
gctggtgttggggagggggc

SEQ ID NO: 44220 - DNA, 20 bp, Artificial
  CRISPR gRNA sequence
ctggtgttggggagggggca

SEQ ID NO: 44221 - DNA, 20 bp, Artificial
  CRISPR gRNA sequence
ccaatattcaccaccctgcc

SEQ ID NO: 44222 - DNA, 20 bp, Artificial
  CRISPR gRNA sequence
aatattcaccaccctgccca

SEQ ID NO: 44223 - DNA, 20 bp, Artificial
  CRISPR gRNA sequence
accaccctgcccagagacct

SEQ ID NO: 44224 - DNA, 20 bp, Artificial
  CRISPR gRNA sequence
ccaccctgcccagagacctt

SEQ ID NO: 44225 - DNA, 20 bp, Artificial
  CRISPR gRNA sequence
caccctgcccagagacctta

SEQ ID NO: 44226 - DNA, 20 bp, Artificial
  CRISPR gRNA sequence
accctgcccagagaccttag

SEQ ID NO: 44227 - DNA, 20 bp, Artificial
  CRISPR gRNA sequence
ccagagaccttaggggttcg

SEQ ID NO: 44228 - DNA, 20 bp, Artificial
  CRISPR gRNA sequence
aggggttcgaagtctttaca

SEQ ID NO: 44229 - DNA, 20 bp, Artificial
  CRISPR gRNA sequence
ggggttcgaagtctttacac

SEQ ID NO: 44230 - DNA, 20 bp, Artificial
  CRISPR gRNA sequence
cgaagtctttacacaggcta

SEQ ID NO: 44231 - DNA, 20 bp, Artificial
  CRISPR gRNA sequence
aagtctttacacaggctaca

SEQ ID NO: 44232 - DNA, 20 bp, Artificial
  CRISPR gRNA sequence
agtctttacacaggctacag

SEQ ID NO: 44233 - DNA, 20 bp, Artificial
  CRISPR gRNA sequence
ggtctgaccaacccacttct

SEQ ID NO: 44234 - DNA, 20 bp, Artificial
  CRISPR gRNA sequence
gtctgaccaacccacttctg

SEQ ID NO: 44235 - DNA, 20 bp, Artificial
  CRISPR gRNA sequence
aacccacttctgaggcgttt

SEQ ID NO: 44236 - DNA, 20 bp, Artificial
  CRISPR gRNA sequence
gaggcgtttcagccccactc

SEQ ID NO: 44237 - DNA, 20 bp, Artificial
  CRISPR gRNA sequence
aggcgtttcagccccactcc

SEQ ID NO: 44238 - DNA, 20 bp, Artificial
  CRISPR gRNA sequence
ttcagccccactccaggccc

SEQ ID NO: 44239 - DNA, 20 bp, Artificial
  CRISPR gRNA sequence
cccactccaggccccagtct

SEQ ID NO: 44240 - DNA, 20 bp, Artificial
  CRISPR gRNA sequence
ccaggccccagtctcagctc

SEQ ID NO: 44241 - DNA, 20 bp, Artificial
  CRISPR gRNA sequence
cagtcacccccatgaacttt

SEQ ID NO: 44242 - DNA, 20 bp, Artificial
  CRISPR gRNA sequence
tccccgaacaccatcttgct

SEQ ID NO: 44243 - DNA, 20 bp, Artificial
  CRISPR gRNA sequence
acaccatcttgcttagacct

SEQ ID NO: 44244 - DNA, 20 bp, Artificial
  CRISPR gRNA sequence
caccatcttgcttagacctt

SEQ ID NO: 44245 - DNA, 20 bp, Artificial
  CRISPR gRNA sequence
accatcttgcttagacctta

SEQ ID NO: 44246 - DNA, 20 bp, Artificial
  CRISPR gRNA sequence
tagaccttagggcatttgca

SEQ ID NO: 44247 - DNA, 20 bp, Artificial
  CRISPR gRNA sequence
agaccttagggcatttgcac

SEQ ID NO: 44248 - DNA, 20 bp, Artificial
  CRISPR gRNA sequence
cacaggctgtgctctctgcc

SEQ ID NO: 44249 - DNA, 20 bp, Artificial
  CRISPR gRNA sequence
cctaactcctcctcatccct

SEQ ID NO: 44250 - DNA, 20 bp, Artificial
  CRISPR gRNA sequence
ctaactcctcctcatccctc

SEQ ID NO: 44251 - DNA, 20 bp, Artificial
  CRISPR gRNA sequence
cctcctcatccctcaggtct

SEQ ID NO: 44252 - DNA, 20 bp, Artificial
  CRISPR gRNA sequence
cagcttaaatgccaccacct

SEQ ID NO: 44253 - DNA, 20 bp, Artificial
  CRISPR gRNA sequence
agcttaaatgccaccacctc

SEQ ID NO: 44254 - DNA, 20 bp, Artificial
  CRISPR gRNA sequence
gcttaaatgccaccacctca

SEQ ID NO: 44255 - DNA, 20 bp, Artificial
  CRISPR gRNA sequence
ttaaatgccaccacctcagg

SEQ ID NO: 44256 - DNA, 20 bp, Artificial
  CRISPR gRNA sequence
taaatgccaccacctcaggg

SEQ ID NO: 44257 - DNA, 20 bp, Artificial
  CRISPR gRNA sequence
accacctcagggaggccccc

SEQ ID NO: 44258 - DNA, 20 bp, Artificial
  CRISPR gRNA sequence
agggaggccccctggacccc

SEQ ID NO: 44259 - DNA, 20 bp, Artificial
  CRISPR gRNA sequence
gggaggccccctggacccca

SEQ ID NO: 44260 - DNA, 20 bp, Artificial
  CRISPR gRNA sequence
gccccctggaccccaaggct

SEQ ID NO: 44261 - DNA, 20 bp, Artificial
  CRISPR gRNA sequence
acttccattatccactctta

SEQ ID NO: 44262 - DNA, 20 bp, Artificial
  CRISPR gRNA sequence
tatccactcttatagatccc

SEQ ID NO: 44263 - DNA, 20 bp, Artificial
  CRISPR gRNA sequence
cttatagatccctggattca

SEQ ID NO: 44264 - DNA, 20 bp, Artificial
  CRISPR gRNA sequence
acagcacctctaaatccata

SEQ ID NO: 44265 - DNA, 20 bp, Artificial
  CRISPR gRNA sequence
acctctaaatccatatggca

SEQ ID NO: 44266 - DNA, 20 bp, Artificial
  CRISPR gRNA sequence
taaatccatatggcacagtt

SEQ ID NO: 44267 - DNA, 20 bp, Artificial
  CRISPR gRNA sequence
aaatccatatggcacagttt

SEQ ID NO: 44268 - DNA, 20 bp, Artificial
  CRISPR gRNA sequence
aattaaaatgtcaccctttt

SEQ ID NO: 44269 - DNA, 20 bp, Artificial
  CRISPR gRNA sequence
taaaatgtcacccttttgag

SEQ ID NO: 44270 - DNA, 20 bp, Artificial
  CRISPR gRNA sequence
gtcacccttttgagtggatg

SEQ ID NO: 44271 - DNA, 20 bp, Artificial
  CRISPR gRNA sequence
agccctgcatgtgtacattc

SEQ ID NO: 44272 - DNA, 20 bp, Artificial
  CRISPR gRNA sequence
gccctgcatgtgtacattct

SEQ ID NO: 44273 - DNA, 20 bp, Artificial
  CRISPR gRNA sequence
catgtgtacattctgggaaa

SEQ ID NO: 44274 - DNA, 20 bp, Artificial
  CRISPR gRNA sequence
tgtgtacattctgggaaata

SEQ ID NO: 44275 - DNA, 20 bp, Artificial
  CRISPR gRNA sequence
acattctgggaaatagagca

SEQ ID NO: 44276 - DNA, 20 bp, Artificial
  CRISPR gRNA sequence
ttctgggaaatagagcatgg

SEQ ID NO: 44277 - DNA, 20 bp, Artificial
  CRISPR gRNA sequence
tctgggaaatagagcatggt

SEQ ID NO: 44278 - DNA, 20 bp, Artificial
  CRISPR gRNA sequence
aatagagcatggtaggatct

SEQ ID NO: 44279 - DNA, 20 bp, Artificial
  CRISPR gRNA sequence
tcagcctcacctcacctcct

SEQ ID NO: 44280 - DNA, 20 bp, Artificial
  CRISPR gRNA sequence
ctcggctgtgtgtccttgtg

SEQ ID NO: 44281 - DNA, 20 bp, Artificial
  CRISPR gRNA sequence
aacaacctgcacaaccatac

SEQ ID NO: 44282 - DNA, 20 bp, Artificial
  CRISPR gRNA sequence
accataccagctgccccatc

SEQ ID NO: 44283 - DNA, 20 bp, Artificial
  CRISPR gRNA sequence
ccatctggactcctgcttcc

SEQ ID NO: 44284 - DNA, 20 bp, Artificial
  CRISPR gRNA sequence
tgcttcctagcacttctcat

SEQ ID NO: 44285 - DNA, 20 bp, Artificial
  CRISPR gRNA sequence
tagcacttctcataagtgaa

SEQ ID NO: 44286 - DNA, 20 bp, Artificial
  CRISPR gRNA sequence
cataagtgaatagcaaactg

SEQ ID NO: 44287 - DNA, 20 bp, Artificial
  CRISPR gRNA sequence
ataagtgaatagcaaactgt

SEQ ID NO: 44288 - DNA, 20 bp, Artificial
  CRISPR gRNA sequence
actgtaggacttcatttgat

SEQ ID NO: 44289 - DNA, 20 bp, Artificial
  CRISPR gRNA sequence
tttatttacccctacaccat

SEQ ID NO: 44290 - DNA, 20 bp, Artificial
  CRISPR gRNA sequence
cctacaccataagctccttg

SEQ ID NO: 44291 - DNA, 20 bp, Artificial
  CRISPR gRNA sequence
ctacaccataagctccttgc

SEQ ID NO: 44292 - DNA, 20 bp, Artificial
  CRISPR gRNA sequence
caccataagctccttgcagg

SEQ ID NO: 44293 - DNA, 20 bp, Artificial
  CRISPR gRNA sequence
agatactgaatcccacatac

SEQ ID NO: 44294 - DNA, 20 bp, Artificial
  CRISPR gRNA sequence
ctgaatcccacatactggac

SEQ ID NO: 44295 - DNA, 20 bp, Artificial
  CRISPR gRNA sequence
gtcgtctccctgtctgtgtc

SEQ ID NO: 44296 - DNA, 20 bp, Artificial
  CRISPR gRNA sequence
tcgtctccctgtctgtgtcc

SEQ ID NO: 44297 - DNA, 20 bp, Artificial
  CRISPR gRNA sequence
ctccctgtctgtgtccaggt

SEQ ID NO: 44298 - DNA, 20 bp, Artificial
  CRISPR gRNA sequence
aggttggctcactgtgacct

SEQ ID NO: 44299 - DNA, 20 bp, Artificial
  CRISPR gRNA sequence
gttggctcactgtgaccttg

SEQ ID NO: 44300 - DNA, 20 bp, Artificial
  CRISPR gRNA sequence
tgtgaccttggagcccacca

SEQ ID NO: 44301 - DNA, 20 bp, Artificial
  CRISPR gRNA sequence
gcccaccacagccttcttgt

SEQ ID NO: 44302 - DNA, 20 bp, Artificial
  CRISPR gRNA sequence
cccaccacagccttcttgtc

SEQ ID NO: 44303 - DNA, 20 bp, Artificial
  CRISPR gRNA sequence
accacagccttcttgtcggg

SEQ ID NO: 44304 - DNA, 20 bp, Artificial
  CRISPR gRNA sequence
ccttcttgtcgggcagctga

SEQ ID NO: 44305 - DNA, 20 bp, Artificial
  CRISPR gRNA sequence
ttcttgtcgggcagctgatg

SEQ ID NO: 44306 - DNA, 20 bp, Artificial
  CRISPR gRNA sequence
cagctgatggagacatgtgc

SEQ ID NO: 44307 - DNA, 20 bp, Artificial
  CRISPR gRNA sequence
agctgatggagacatgtgcc

SEQ ID NO: 44308 - DNA, 20 bp, Artificial
  CRISPR gRNA sequence
tggagacatgtgccaggctg

SEQ ID NO: 44309 - DNA, 20 bp, Artificial
  CRISPR gRNA sequence
agacatgtgccaggctgcag

SEQ ID NO: 44310 - DNA, 20 bp, Artificial
  CRISPR gRNA sequence
tgtgccaggctgcagcagct

SEQ ID NO: 44311 - DNA, 20 bp, Artificial
  CRISPR gRNA sequence
gtgccaggctgcagcagctc

SEQ ID NO: 44312 - DNA, 20 bp, Artificial
  CRISPR gRNA sequence
caggctgcagcagctcaggt

SEQ ID NO: 44313 - DNA, 20 bp, Artificial
  CRISPR gRNA sequence
cagcagctcaggtcagcgcc

SEQ ID NO: 44314 - DNA, 20 bp, Artificial
  CRISPR gRNA sequence
cagcgcctggaaactctgtg

SEQ ID NO: 44315 - DNA, 20 bp, Artificial
  CRISPR gRNA sequence
agcgcctggaaactctgtgt

SEQ ID NO: 44316 - DNA, 20 bp, Artificial
  CRISPR gRNA sequence
gcgcctggaaactctgtgtg

SEQ ID NO: 44317 - DNA, 20 bp, Artificial
  CRISPR gRNA sequence
gaaactctgtgtggggccct

SEQ ID NO: 44318 - DNA, 20 bp, Artificial
  CRISPR gRNA sequence
gtgtggggccctgagttctc

SEQ ID NO: 44319 - DNA, 20 bp, Artificial
  CRISPR gRNA sequence
ctgagttctctggttgaccc

SEQ ID NO: 44320 - DNA, 20 bp, Artificial
  CRISPR gRNA sequence
gttgaccctggtacctactc

SEQ ID NO: 44321 - DNA, 20 bp, Artificial
  CRISPR gRNA sequence
ttgaccctggtacctactcc

SEQ ID NO: 44322 - DNA, 20 bp, Artificial
  CRISPR gRNA sequence
ctccaggccatgtgtgaccc

SEQ ID NO: 44323 - DNA, 20 bp, Artificial
  CRISPR gRNA sequence
ggcattctcacttccttgtg

SEQ ID NO: 44324 - DNA, 20 bp, Artificial
  CRISPR gRNA sequence
gcattctcacttccttgtgc

SEQ ID NO: 44325 - DNA, 20 bp, Artificial
  CRISPR gRNA sequence
attctcacttccttgtgcag

SEQ ID NO: 44326 - DNA, 20 bp, Artificial
  CRISPR gRNA sequence
gtgcaggagaaaatcacact

SEQ ID NO: 44327 - DNA, 20 bp, Artificial
  CRISPR gRNA sequence
aggagaaaatcacacttggc

SEQ ID NO: 44328 - DNA, 20 bp, Artificial
  CRISPR gRNA sequence
agaaaatcacacttggccag

SEQ ID NO: 44329 - DNA, 20 bp, Artificial
  CRISPR gRNA sequence
aaaatcacacttggccagtg

SEQ ID NO: 44330 - DNA, 20 bp, Artificial
  CRISPR gRNA sequence
aaatcacacttggccagtgg

SEQ ID NO: 44331 - DNA, 20 bp, Artificial
  CRISPR gRNA sequence
aatcacacttggccagtgga

SEQ ID NO: 44332 - DNA, 20 bp, Artificial
  CRISPR gRNA sequence
atcacacttggccagtggag

SEQ ID NO: 44333 - DNA, 20 bp, Artificial
  CRISPR gRNA sequence
cacacttggccagtggaggg

SEQ ID NO: 44334 - DNA, 20 bp, Artificial
  CRISPR gRNA sequence
acacttggccagtggagggg

SEQ ID NO: 44335 - DNA, 20 bp, Artificial
  CRISPR gRNA sequence
cacttggccagtggagggga

SEQ ID NO: 44336 - DNA, 20 bp, Artificial
  CRISPR gRNA sequence
cttggccagtggaggggagg

SEQ ID NO: 44337 - DNA, 20 bp, Artificial
  CRISPR gRNA sequence
tggccagtggaggggaggga

SEQ ID NO: 44338 - DNA, 20 bp, Artificial
  CRISPR gRNA sequence
gtggaggggagggagagccc

SEQ ID NO: 44339 - DNA, 20 bp, Artificial
  CRISPR gRNA sequence
tggaggggagggagagcccc

SEQ ID NO: 44340 - DNA, 20 bp, Artificial
  CRISPR gRNA sequence
ggaggggagggagagcccca

SEQ ID NO: 44341 - DNA, 20 bp, Artificial
  CRISPR gRNA sequence
ggggagggagagccccaggg

SEQ ID NO: 44342 - DNA, 20 bp, Artificial
  CRISPR gRNA sequence
gggagagccccagggtggct

SEQ ID NO: 44343 - DNA, 20 bp, Artificial
  CRISPR gRNA sequence
ggagagccccagggtggctc

SEQ ID NO: 44344 - DNA, 20 bp, Artificial
  CRISPR gRNA sequence
gagagccccagggtggctca

SEQ ID NO: 44345 - DNA, 20 bp, Artificial
  CRISPR gRNA sequence
agagccccagggtggctcag

SEQ ID NO: 44346 - DNA, 20 bp, Artificial
  CRISPR gRNA sequence
agccccagggtggctcaggg

SEQ ID NO: 44347 - DNA, 20 bp, Artificial
  CRISPR gRNA sequence
gggtggctcaggggagctct

SEQ ID NO: 44348 - DNA, 20 bp, Artificial
  CRISPR gRNA sequence
ggtggctcaggggagctctt

SEQ ID NO: 44349 - DNA, 20 bp, Artificial
  CRISPR gRNA sequence
ggctcaggggagctcttggg

SEQ ID NO: 44350 - DNA, 20 bp, Artificial
  CRISPR gRNA sequence
ggtggccccttctcctctct

SEQ ID NO: 44351 - DNA, 20 bp, Artificial
  CRISPR gRNA sequence
cctctcttggcacccccttc

SEQ ID NO: 44352 - DNA, 20 bp, Artificial
  CRISPR gRNA sequence
ttctggatgtgatgacctct

SEQ ID NO: 44353 - DNA, 20 bp, Artificial
  CRISPR gRNA sequence
tctggatgtgatgacctctg

SEQ ID NO: 44354 - DNA, 20 bp, Artificial
  CRISPR gRNA sequence
gatgacctctgaggtgtgtc

SEQ ID NO: 44355 - DNA, 20 bp, Artificial
  CRISPR gRNA sequence
gtgtccagcctgaaatcctc

SEQ ID NO: 44356 - DNA, 20 bp, Artificial
  CRISPR gRNA sequence
gaaatcctctagaatatcct

SEQ ID NO: 44357 - DNA, 20 bp, Artificial
  CRISPR gRNA sequence
agaatatccttggacctttt

SEQ ID NO: 44358 - DNA, 20 bp, Artificial
  CRISPR gRNA sequence
tggaccttttcagcttgtct

SEQ ID NO: 44359 - DNA, 20 bp, Artificial
  CRISPR gRNA sequence
ggaccttttcagcttgtctc

SEQ ID NO: 44360 - DNA, 20 bp, Artificial
  CRISPR gRNA sequence
tgtctcaggttaacctctgt

SEQ ID NO: 44361 - DNA, 20 bp, Artificial
  CRISPR gRNA sequence
gtctcaggttaacctctgtg

SEQ ID NO: 44362 - DNA, 20 bp, Artificial
  CRISPR gRNA sequence
ctctgtgaggacgatgatgc

SEQ ID NO: 44363 - DNA, 20 bp, Artificial
  CRISPR gRNA sequence
atgccagttccctgctgctg

SEQ ID NO: 44364 - DNA, 20 bp, Artificial
  CRISPR gRNA sequence
gccagttccctgctgctgca

SEQ ID NO: 44365 - DNA, 20 bp, Artificial
  CRISPR gRNA sequence
gcctcctgctgtccctctct

SEQ ID NO: 44366 - DNA, 20 bp, Artificial
  CRISPR gRNA sequence
tgctgtccctctctgagctg

SEQ ID NO: 44367 - DNA, 20 bp, Artificial
  CRISPR gRNA sequence
tctctgagctgaagacattt

SEQ ID NO: 44368 - DNA, 20 bp, Artificial
  CRISPR gRNA sequence
gctgaagacatttcggtatg

SEQ ID NO: 44369 - DNA, 20 bp, Artificial
  CRISPR gRNA sequence
agacatttcggtatgtagac

SEQ ID NO: 44370 - DNA, 20 bp, Artificial
  CRISPR gRNA sequence
atgtagacaagacattcact

SEQ ID NO: 44371 - DNA, 20 bp, Artificial
  CRISPR gRNA sequence
cattcactcagtcccctttg

SEQ ID NO: 44372 - DNA, 20 bp, Artificial
  CRISPR gRNA sequence
ctgacacctcccgttattcc

SEQ ID NO: 44373 - DNA, 20 bp, Artificial
  CRISPR gRNA sequence
cctcccgttattcccagccc

SEQ ID NO: 44374 - DNA, 20 bp, Artificial
  CRISPR gRNA sequence
ctcccgttattcccagccct

SEQ ID NO: 44375 - DNA, 20 bp, Artificial
  CRISPR gRNA sequence
gttattcccagccctgggct

SEQ ID NO: 44376 - DNA, 20 bp, Artificial
  CRISPR gRNA sequence
tattcccagccctgggctca

SEQ ID NO: 44377 - DNA, 20 bp, Artificial
  CRISPR gRNA sequence
attcccagccctgggctcag

SEQ ID NO: 44378 - DNA, 20 bp, Artificial
  CRISPR gRNA sequence
ttactctgtgtcttactctg

SEQ ID NO: 44379 - DNA, 20 bp, Artificial
  CRISPR gRNA sequence
tactctgtggacacaaacca

SEQ ID NO: 44380 - DNA, 20 bp, Artificial
  CRISPR gRNA sequence
actctgtggacacaaaccac

SEQ ID NO: 44381 - DNA, 20 bp, Artificial
  CRISPR gRNA sequence
ctgtggacacaaaccacagg

SEQ ID NO: 44382 - DNA, 20 bp, Artificial
  CRISPR gRNA sequence
acacaaaccacaggtggccc

SEQ ID NO: 44383 - DNA, 20 bp, Artificial
  CRISPR gRNA sequence
acaaaccacaggtggccctg

SEQ ID NO: 44384 - DNA, 20 bp, Artificial
  CRISPR gRNA sequence
gtggccctggagatgatttt

SEQ ID NO: 44385 - DNA, 20 bp, Artificial
  CRISPR gRNA sequence
tggccctggagatgattttt

SEQ ID NO: 44386 - DNA, 20 bp, Artificial
  CRISPR gRNA sequence
ggccctggagatgattttta

SEQ ID NO: 44387 - DNA, 20 bp, Artificial
  CRISPR gRNA sequence
gccctggagatgatttttag

SEQ ID NO: 44388 - DNA, 20 bp, Artificial
  CRISPR gRNA sequence
agatgatttttaggggtacc

SEQ ID NO: 44389 - DNA, 20 bp, Artificial
  CRISPR gRNA sequence
cctagtcgtaaacatgacct

SEQ ID NO: 44390 - DNA, 20 bp, Artificial
  CRISPR gRNA sequence
ctagtcgtaaacatgacctt

SEQ ID NO: 44391 - DNA, 20 bp, Artificial
  CRISPR gRNA sequence
aacatgaccttaggaacatt

SEQ ID NO: 44392 - DNA, 20 bp, Artificial
  CRISPR gRNA sequence
cttaggaacattgagccaca

SEQ ID NO: 44393 - DNA, 20 bp, Artificial
  CRISPR gRNA sequence
ggaacattgagccacatggc

SEQ ID NO: 44394 - DNA, 20 bp, Artificial
  CRISPR gRNA sequence
cattgagccacatggcaaga

SEQ ID NO: 44395 - DNA, 20 bp, Artificial
  CRISPR gRNA sequence
aataactgcgaactaacaca

SEQ ID NO: 44396 - DNA, 20 bp, Artificial
  CRISPR gRNA sequence
gcgaactaacacaaagtttc

SEQ ID NO: 44397 - DNA, 20 bp, Artificial
  CRISPR gRNA sequence
aactaacacaaagtttcaag

SEQ ID NO: 44398 - DNA, 20 bp, Artificial
  CRISPR gRNA sequence
cacaaagtttcaagaagact

SEQ ID NO: 44399 - DNA, 20 bp, Artificial
  CRISPR gRNA sequence
catttacccaaattcaccct

SEQ ID NO: 44400 - DNA, 20 bp, Artificial
  CRISPR gRNA sequence
tttacccaaattcaccctta

SEQ ID NO: 44401 - DNA, 20 bp, Artificial
  CRISPR gRNA sequence
cccaaattcacccttagagc

SEQ ID NO: 44402 - DNA, 20 bp, Artificial
  CRISPR gRNA sequence
ccaaattcacccttagagct

SEQ ID NO: 44403 - DNA, 20 bp, Artificial
  CRISPR gRNA sequence
ttcacccttagagctgggcg

SEQ ID NO: 44404 - DNA, 20 bp, Artificial
  CRISPR gRNA sequence
acccttagagctgggcgtgg

SEQ ID NO: 44405 - DNA, 20 bp, Artificial
  CRISPR gRNA sequence
gtggctcatgtctgtaatcc

SEQ ID NO: 44406 - DNA, 20 bp, Artificial
  CRISPR gRNA sequence
tgtctgtaatcctagcactt

SEQ ID NO: 44407 - DNA, 20 bp, Artificial
  CRISPR gRNA sequence
gtctgtaatcctagcacttt

SEQ ID NO: 44408 - DNA, 20 bp, Artificial
  CRISPR gRNA sequence
ctgtaatcctagcactttgg

SEQ ID NO: 44409 - DNA, 20 bp, Artificial
  CRISPR gRNA sequence
tgtaatcctagcactttggg

SEQ ID NO: 44410 - DNA, 20 bp, Artificial
  CRISPR gRNA sequence
tcctagcactttgggaggcc

SEQ ID NO: 44411 - DNA, 20 bp, Artificial
  CRISPR gRNA sequence
cctagcactttgggaggccg

SEQ ID NO: 44412 - DNA, 20 bp, Artificial
  CRISPR gRNA sequence
agcactttgggaggccgagg

SEQ ID NO: 44413 - DNA, 20 bp, Artificial
  CRISPR gRNA sequence
gcactttgggaggccgaggc

SEQ ID NO: 44414 - DNA, 20 bp, Artificial
  CRISPR gRNA sequence
ctttgggaggccgaggcagg

SEQ ID NO: 44415 - DNA, 20 bp, Artificial
  CRISPR gRNA sequence
ccgaggcaggtggattgcct

SEQ ID NO: 44416 - DNA, 20 bp, Artificial
  CRISPR gRNA sequence
gcaggtggattgcctgagct

SEQ ID NO: 44417 - DNA, 20 bp, Artificial
  CRISPR gRNA sequence
caggtggattgcctgagctc

SEQ ID NO: 44418 - DNA, 20 bp, Artificial
  CRISPR gRNA sequence
ttgcctgagctcaggaattc

SEQ ID NO: 44419 - DNA, 20 bp, Artificial
  CRISPR gRNA sequence
tcaggaattcgagaccaccc

SEQ ID NO: 44420 - DNA, 20 bp, Artificial
  CRISPR gRNA sequence
cgagaccaccctggacaaca

SEQ ID NO: 44421 - DNA, 20 bp, Artificial
  CRISPR gRNA sequence
ctactaaaatacaaaaaaat

SEQ ID NO: 44422 - DNA, 20 bp, Artificial
  CRISPR gRNA sequence
taaaatacaaaaaaattagc

SEQ ID NO: 44423 - DNA, 20 bp, Artificial
  CRISPR gRNA sequence
aaaatacaaaaaaattagct

SEQ ID NO: 44424 - DNA, 20 bp, Artificial
  CRISPR gRNA sequence
acaaaaaaattagctgggca

SEQ ID NO: 44425 - DNA, 20 bp, Artificial
  CRISPR gRNA sequence
aaaaaattagctgggcatgg

SEQ ID NO: 44426 - DNA, 20 bp, Artificial
  CRISPR gRNA sequence
gtggtgcatgcctgtaatcc

SEQ ID NO: 44427 - DNA, 20 bp, Artificial
  CRISPR gRNA sequence
tgcctgtaatcccagctaat

SEQ ID NO: 44428 - DNA, 20 bp, Artificial
  CRISPR gRNA sequence
gcctgtaatcccagctaatt

SEQ ID NO: 44429 - DNA, 20 bp, Artificial
  CRISPR gRNA sequence
ctgtaatcccagctaattgg

SEQ ID NO: 44430 - DNA, 20 bp, Artificial
  CRISPR gRNA sequence
tgtaatcccagctaattggg

SEQ ID NO: 44431 - DNA, 20 bp, Artificial
  CRISPR gRNA sequence
tcccagctaattgggaggct

SEQ ID NO: 44432 - DNA, 20 bp, Artificial
  CRISPR gRNA sequence
cccagctaattgggaggctg

SEQ ID NO: 44433 - DNA, 20 bp, Artificial
  CRISPR gRNA sequence
taattgggaggctgaggcac

SEQ ID NO: 44434 - DNA, 20 bp, Artificial
  CRISPR gRNA sequence
gcacaagaattgcttgaacc

SEQ ID NO: 44435 - DNA, 20 bp, Artificial
  CRISPR gRNA sequence
cacaagaattgcttgaaccc

SEQ ID NO: 44436 - DNA, 20 bp, Artificial
  CRISPR gRNA sequence
caagaattgcttgaacccgg

SEQ ID NO: 44437 - DNA, 20 bp, Artificial
  CRISPR gRNA sequence
aagaattgcttgaacccggg

SEQ ID NO: 44438 - DNA, 20 bp, Artificial
  CRISPR gRNA sequence
ttgcttgaacccgggaggct

SEQ ID NO: 44439 - DNA, 20 bp, Artificial
  CRISPR gRNA sequence
tgcttgaacccgggaggctg

SEQ ID NO: 44440 - DNA, 20 bp, Artificial
  CRISPR gRNA sequence
aacccgggaggctgaggtta

SEQ ID NO: 44441 - DNA, 20 bp, Artificial
  CRISPR gRNA sequence
cgggaggctgaggttacagt

SEQ ID NO: 44442 - DNA, 20 bp, Artificial
  CRISPR gRNA sequence
ggctgaggttacagtgagcc

SEQ ID NO: 44443 - DNA, 20 bp, Artificial
  CRISPR gRNA sequence
aagattgtgccactgcactc

SEQ ID NO: 44444 - DNA, 20 bp, Artificial
  CRISPR gRNA sequence
tgtgccactgcactctagcc

SEQ ID NO: 44445 - DNA, 20 bp, Artificial
  CRISPR gRNA sequence
gtgccactgcactctagcct

SEQ ID NO: 44446 - DNA, 20 bp, Artificial
  CRISPR gRNA sequence
ctgcactctagcctaggtga

SEQ ID NO: 44447 - DNA, 20 bp, Artificial
  CRISPR gRNA sequence
gcactctagcctaggtgaca

SEQ ID NO: 44448 - DNA, 20 bp, Artificial
  CRISPR gRNA sequence
tctagcctaggtgacagagc

SEQ ID NO: 44449 - DNA, 20 bp, Artificial
  CRISPR gRNA sequence
ctagcctaggtgacagagcg

SEQ ID NO: 44450 - DNA, 20 bp, Artificial
  CRISPR gRNA sequence
ctaggtgacagagcgaggct

SEQ ID NO: 44451 - DNA, 20 bp, Artificial
  CRISPR gRNA sequence
ggtttccgaaaaaaaaaaaa

SEQ ID NO: 44452 - DNA, 20 bp, Artificial
  CRISPR gRNA sequence
ctctccttttctgaaccatt

SEQ ID NO: 44453 - DNA, 20 bp, Artificial
  CRISPR gRNA sequence
tccttttctgaaccatttag

SEQ ID NO: 44454 - DNA, 20 bp, Artificial
  CRISPR gRNA sequence
tttctgaaccatttagaagt

SEQ ID NO: 44455 - DNA, 20 bp, Artificial
  CRISPR gRNA sequence
ccctttacccgttaacattt

SEQ ID NO: 44456 - DNA, 20 bp, Artificial
  CRISPR gRNA sequence
taacatttcagcgaatttgc

SEQ ID NO: 44457 - DNA, 20 bp, Artificial
  CRISPR gRNA sequence
tcagcgaatttgctagaaat

SEQ ID NO: 44458 - DNA, 20 bp, Artificial
  CRISPR gRNA sequence
cagcgaatttgctagaaata

SEQ ID NO: 44459 - DNA, 20 bp, Artificial
  CRISPR gRNA sequence
ggacattctcttccataatc

SEQ ID NO: 44460 - DNA, 20 bp, Artificial
  CRISPR gRNA sequence
tccagtaaaattataaaatc

SEQ ID NO: 44461 - DNA, 20 bp, Artificial
  CRISPR gRNA sequence
ccagtaaaattataaaatcc

SEQ ID NO: 44462 - DNA, 20 bp, Artificial
  CRISPR gRNA sequence
cactactattatctcaacta

SEQ ID NO: 44463 - DNA, 20 bp, Artificial
  CRISPR gRNA sequence
agtttatactccaatctcac

SEQ ID NO: 44464 - DNA, 20 bp, Artificial
  CRISPR gRNA sequence
tgcttattgcatttttttcc

SEQ ID NO: 44465 - DNA, 20 bp, Artificial
  CRISPR gRNA sequence
ttgcatttttttcccagttg

SEQ ID NO: 44466 - DNA, 20 bp, Artificial
  CRISPR gRNA sequence
tcccagttgtggatccaatc

SEQ ID NO: 44467 - DNA, 20 bp, Artificial
  CRISPR gRNA sequence
cccagttgtggatccaatcc

SEQ ID NO: 44468 - DNA, 20 bp, Artificial
  CRISPR gRNA sequence
ccaggatcacacgtctcatt

SEQ ID NO: 44469 - DNA, 20 bp, Artificial
  CRISPR gRNA sequence
ctcatttagtgtcatctctt

SEQ ID NO: 44470 - DNA, 20 bp, Artificial
  CRISPR gRNA sequence
ctttagtgtctccttcaatc

SEQ ID NO: 44471 - DNA, 20 bp, Artificial
  CRISPR gRNA sequence
ttcaatctggaacacgtcct

SEQ ID NO: 44472 - DNA, 20 bp, Artificial
  CRISPR gRNA sequence
tggcccttctttgtctttca

SEQ ID NO: 44473 - DNA, 20 bp, Artificial
  CRISPR gRNA sequence
agcattgtctctgacattta

SEQ ID NO: 44474 - DNA, 20 bp, Artificial
  CRISPR gRNA sequence
gcattgtctctgacatttac

SEQ ID NO: 44475 - DNA, 20 bp, Artificial
  CRISPR gRNA sequence
tgtctctgacatttacaggc

SEQ ID NO: 44476 - DNA, 20 bp, Artificial
  CRISPR gRNA sequence
tttacaggccagttatttta

SEQ ID NO: 44477 - DNA, 20 bp, Artificial
  CRISPR gRNA sequence
ttatagaatgtccttccact

SEQ ID NO: 44478 - DNA, 20 bp, Artificial
  CRISPR gRNA sequence
tatagaatgtccttccactt

SEQ ID NO: 44479 - DNA, 20 bp, Artificial
  CRISPR gRNA sequence
gtccaatgtttcctcatgtt

SEQ ID NO: 44480 - DNA, 20 bp, Artificial
  CRISPR gRNA sequence
ccaatgtttcctcatgttta

SEQ ID NO: 44481 - DNA, 20 bp, Artificial
  CRISPR gRNA sequence
tgtttcctcatgtttagagt

SEQ ID NO: 44482 - DNA, 20 bp, Artificial
  CRISPR gRNA sequence
tttcctcatgtttagagtta

SEQ ID NO: 44483 - DNA, 20 bp, Artificial
  CRISPR gRNA sequence
tagagttagagtctgccctt

SEQ ID NO: 44484 - DNA, 20 bp, Artificial
  CRISPR gRNA sequence
agagttagagtctgcccttt

SEQ ID NO: 44485 - DNA, 20 bp, Artificial
  CRISPR gRNA sequence
gttagagtctgccctttggg

SEQ ID NO: 44486 - DNA, 20 bp, Artificial
  CRISPR gRNA sequence
ttagagtctgccctttgggc

SEQ ID NO: 44487 - DNA, 20 bp, Artificial
  CRISPR gRNA sequence
ctttgggcaggaatatcaca

SEQ ID NO: 44488 - DNA, 20 bp, Artificial
  CRISPR gRNA sequence
tttgggcaggaatatcacac

SEQ ID NO: 44489 - DNA, 20 bp, Artificial
  CRISPR gRNA sequence
tgtgttatcgtgccttccat

SEQ ID NO: 44490 - DNA, 20 bp, Artificial
  CRISPR gRNA sequence
gtgttatcgtgccttccatc

SEQ ID NO: 44491 - DNA, 20 bp, Artificial
  CRISPR gRNA sequence
tgttatcgtgccttccatcg

SEQ ID NO: 44492 - DNA, 20 bp, Artificial
  CRISPR gRNA sequence
catcggggcacatgatgtgt

SEQ ID NO: 44493 - DNA, 20 bp, Artificial
  CRISPR gRNA sequence
tcggggcacatgatgtgtca

SEQ ID NO: 44494 - DNA, 20 bp, Artificial
  CRISPR gRNA sequence
acatgatgtgtcagagtcct

SEQ ID NO: 44495 - DNA, 20 bp, Artificial
  CRISPR gRNA sequence
catgatgtgtcagagtcctc

SEQ ID NO: 44496 - DNA, 20 bp, Artificial
  CRISPR gRNA sequence
atgtgtcagagtcctcgggc

SEQ ID NO: 44497 - DNA, 20 bp, Artificial
  CRISPR gRNA sequence
ttaactgtgatcacctgtga

SEQ ID NO: 44498 - DNA, 20 bp, Artificial
  CRISPR gRNA sequence
actgtgatcacctgtgacag

SEQ ID NO: 44499 - DNA, 20 bp, Artificial
  CRISPR gRNA sequence
cctgtgacagtggtgtctgc

SEQ ID NO: 44500 - DNA, 20 bp, Artificial
  CRISPR gRNA sequence
ctgtgacagtggtgtctgcc

SEQ ID NO: 44501 - DNA, 20 bp, Artificial
  CRISPR gRNA sequence
ctttccctttgtaatcaaca

SEQ ID NO: 44502 - DNA, 20 bp, Artificial
  CRISPR gRNA sequence
tgtaatcaacatagattatg

SEQ ID NO: 44503 - DNA, 20 bp, Artificial
  CRISPR gRNA sequence
gtaatcaacatagattatgt

SEQ ID NO: 44504 - DNA, 20 bp, Artificial
  CRISPR gRNA sequence
taatcaacatagattatgtg

SEQ ID NO: 44505 - DNA, 20 bp, Artificial
  CRISPR gRNA sequence
atcaacatagattatgtggg

SEQ ID NO: 44506 - DNA, 20 bp, Artificial
  CRISPR gRNA sequence
attatgtggggagatacttt

SEQ ID NO: 44507 - DNA, 20 bp, Artificial
  CRISPR gRNA sequence
atactttaagattatgtatt

SEQ ID NO: 44508 - DNA, 20 bp, Artificial
  CRISPR gRNA sequence
agtcttcctcaaactctcat

SEQ ID NO: 44509 - DNA, 20 bp, Artificial
  CRISPR gRNA sequence
aaactctcattggcaaattt

SEQ ID NO: 44510 - DNA, 20 bp, Artificial
  CRISPR gRNA sequence
ctctcattggcaaattttag

SEQ ID NO: 44511 - DNA, 20 bp, Artificial
  CRISPR gRNA sequence
tcttacttaaatcgatgaat

SEQ ID NO: 44512 - DNA, 20 bp, Artificial
  CRISPR gRNA sequence
aaatcgatgaatcagcatga

SEQ ID NO: 44513 - DNA, 20 bp, Artificial
  CRISPR gRNA sequence
agcatgacagttgcaaaatg

SEQ ID NO: 44514 - DNA, 20 bp, Artificial
  CRISPR gRNA sequence
tccatctaactgattacacc

SEQ ID NO: 44515 - DNA, 20 bp, Artificial
  CRISPR gRNA sequence
atctaactgattacaccaag

SEQ ID NO: 44516 - DNA, 20 bp, Artificial
  CRISPR gRNA sequence
ttacaccaagaagaaactct

SEQ ID NO: 44517 - DNA, 20 bp, Artificial
  CRISPR gRNA sequence
tacaccaagaagaaactctt

SEQ ID NO: 44518 - DNA, 20 bp, Artificial
  CRISPR gRNA sequence
ccaagaagaaactcttgggc

SEQ ID NO: 44519 - DNA, 20 bp, Artificial
  CRISPR gRNA sequence
caagaagaaactcttgggct

SEQ ID NO: 44520 - DNA, 20 bp, Artificial
  CRISPR gRNA sequence
agaaactcttgggctgggaa

SEQ ID NO: 44521 - DNA, 20 bp, Artificial
  CRISPR gRNA sequence
aactcttgggctgggaacag

SEQ ID NO: 44522 - DNA, 20 bp, Artificial
  CRISPR gRNA sequence
tgggctgggaacagtggctc

SEQ ID NO: 44523 - DNA, 20 bp, Artificial
  CRISPR gRNA sequence
gtggctcaagcttgtaatcc

SEQ ID NO: 44524 - DNA, 20 bp, Artificial
  CRISPR gRNA sequence
agcttgtaatcccagcactc

SEQ ID NO: 44525 - DNA, 20 bp, Artificial
  CRISPR gRNA sequence
gcttgtaatcccagcactct

SEQ ID NO: 44526 - DNA, 20 bp, Artificial
  CRISPR gRNA sequence
ttgtaatcccagcactctgg

SEQ ID NO: 44527 - DNA, 20 bp, Artificial
  CRISPR gRNA sequence
tgtaatcccagcactctggg

SEQ ID NO: 44528 - DNA, 20 bp, Artificial
  CRISPR gRNA sequence
tcccagcactctgggaggcc

SEQ ID NO: 44529 - DNA, 20 bp, Artificial
  CRISPR gRNA sequence
cccagcactctgggaggccg

SEQ ID NO: 44530 - DNA, 20 bp, Artificial
  CRISPR gRNA sequence
cagcactctgggaggccgag

SEQ ID NO: 44531 - DNA, 20 bp, Artificial
  CRISPR gRNA sequence
agcactctgggaggccgagg

SEQ ID NO: 44532 - DNA, 20 bp, Artificial
  CRISPR gRNA sequence
ccgaggaggaaaaatcgctt

SEQ ID NO: 44533 - DNA, 20 bp, Artificial
  CRISPR gRNA sequence
gaggaaaaatcgcttgagcc

SEQ ID NO: 44534 - DNA, 20 bp, Artificial
  CRISPR gRNA sequence
aggaaaaatcgcttgagccc

SEQ ID NO: 44535 - DNA, 20 bp, Artificial
  CRISPR gRNA sequence
gaaaaatcgcttgagcccgg

SEQ ID NO: 44536 - DNA, 20 bp, Artificial
  CRISPR gRNA sequence
tgagcccgggagttcgacac

SEQ ID NO: 44537 - DNA, 20 bp, Artificial
  CRISPR gRNA sequence
cgggagttcgacaccagcct

SEQ ID NO: 44538 - DNA, 20 bp, Artificial
  CRISPR gRNA sequence
cgacaccagcctgagcaaca

SEQ ID NO: 44539 - DNA, 20 bp, Artificial
  CRISPR gRNA sequence
accagcctgagcaacatagc

SEQ ID NO: 44540 - DNA, 20 bp, Artificial
  CRISPR gRNA sequence
aaataaaataaatgtttaaa

SEQ ID NO: 44541 - DNA, 20 bp, Artificial
  CRISPR gRNA sequence
aataaaataaatgtttaaaa

SEQ ID NO: 44542 - DNA, 20 bp, Artificial
  CRISPR gRNA sequence
aaaataaatgtttaaaaagg

SEQ ID NO: 44543 - DNA, 20 bp, Artificial
  CRISPR gRNA sequence
ttaaaaaggaagaaactctt

SEQ ID NO: 44544 - DNA, 20 bp, Artificial
  CRISPR gRNA sequence
taaaaaggaagaaactcttt

SEQ ID NO: 44545 - DNA, 20 bp, Artificial
  CRISPR gRNA sequence
aaggaagaaactctttagga

SEQ ID NO: 44546 - DNA, 20 bp, Artificial
  CRISPR gRNA sequence
ggaagaaactctttaggaca

SEQ ID NO: 44547 - DNA, 20 bp, Artificial
  CRISPR gRNA sequence
aagaaactctttaggacaga

SEQ ID NO: 44548 - DNA, 20 bp, Artificial
  CRISPR gRNA sequence
agagatctttgacacttctt

SEQ ID NO: 44549 - DNA, 20 bp, Artificial
  CRISPR gRNA sequence
cttcttcagtatttgcttta

SEQ ID NO: 44550 - DNA, 20 bp, Artificial
  CRISPR gRNA sequence
cagtatttgctttaaagatg

SEQ ID NO: 44551 - DNA, 20 bp, Artificial
  CRISPR gRNA sequence
gtatttgctttaaagatgca

SEQ ID NO: 44552 - DNA, 20 bp, Artificial
  CRISPR gRNA sequence
gcagagtttgtaataaacaa

SEQ ID NO: 44553 - DNA, 20 bp, Artificial
  CRISPR gRNA sequence
ttgtaataaacaacagtaac

SEQ ID NO: 44554 - DNA, 20 bp, Artificial
  CRISPR gRNA sequence
aacagtaactagctaaacta

SEQ ID NO: 44555 - DNA, 20 bp, Artificial
  CRISPR gRNA sequence
actacagtgatacctaatcc

SEQ ID NO: 44556 - DNA, 20 bp, Artificial
  CRISPR gRNA sequence
gtgatacctaatcctggctt

SEQ ID NO: 44557 - DNA, 20 bp, Artificial
  CRISPR gRNA sequence
taatcctggcttaagttgtg

SEQ ID NO: 44558 - DNA, 20 bp, Artificial
  CRISPR gRNA sequence
agttgctacctgaatgactg

SEQ ID NO: 44559 - DNA, 20 bp, Artificial
  CRISPR gRNA sequence
ctacctgaatgactgcggtt

SEQ ID NO: 44560 - DNA, 20 bp, Artificial
  CRISPR gRNA sequence
tacctgaatgactgcggttt

SEQ ID NO: 44561 - DNA, 20 bp, Artificial
  CRISPR gRNA sequence
cggtttaggaaatactgaac

SEQ ID NO: 44562 - DNA, 20 bp, Artificial
  CRISPR gRNA sequence
tagtccatgcttctgcttcc

SEQ ID NO: 44563 - DNA, 20 bp, Artificial
  CRISPR gRNA sequence
gcttctgcttccaagctctg

SEQ ID NO: 44564 - DNA, 20 bp, Artificial
  CRISPR gRNA sequence
tctgcttccaagctctgtgg

SEQ ID NO: 44565 - DNA, 20 bp, Artificial
  CRISPR gRNA sequence
aagctctgtggtggcttaat

SEQ ID NO: 44566 - DNA, 20 bp, Artificial
  CRISPR gRNA sequence
gtggtggcttaatgagttca

SEQ ID NO: 44567 - DNA, 20 bp, Artificial
  CRISPR gRNA sequence
gtggcttaatgagttcatgg

SEQ ID NO: 44568 - DNA, 20 bp, Artificial
  CRISPR gRNA sequence
gcttaatgagttcatggtgg

SEQ ID NO: 44569 - DNA, 20 bp, Artificial
  CRISPR gRNA sequence
ttaatgagttcatggtggaa

SEQ ID NO: 44570 - DNA, 20 bp, Artificial
  CRISPR gRNA sequence
catggtggaagagatttacg

SEQ ID NO: 44571 - DNA, 20 bp, Artificial
  CRISPR gRNA sequence
atggtggaagagatttacga

SEQ ID NO: 44572 - DNA, 20 bp, Artificial
  CRISPR gRNA sequence
tggtggaagagatttacgaa

SEQ ID NO: 44573 - DNA, 20 bp, Artificial
  CRISPR gRNA sequence
tggaagagatttacgaaggg

SEQ ID NO: 44574 - DNA, 20 bp, Artificial
  CRISPR gRNA sequence
ggaagagatttacgaaggga

SEQ ID NO: 44575 - DNA, 20 bp, Artificial
  CRISPR gRNA sequence
aagagatttacgaagggaag

SEQ ID NO: 44576 - DNA, 20 bp, Artificial
  CRISPR gRNA sequence
agagatttacgaagggaagg

SEQ ID NO: 44577 - DNA, 20 bp, Artificial
  CRISPR gRNA sequence
acatccttgccctctgccac

SEQ ID NO: 44578 - DNA, 20 bp, Artificial
  CRISPR gRNA sequence
tgccctctgccaccagcatt

SEQ ID NO: 44579 - DNA, 20 bp, Artificial
  CRISPR gRNA sequence
ccctctgccaccagcattca

SEQ ID NO: 44580 - DNA, 20 bp, Artificial
  CRISPR gRNA sequence
caccagcattcagagctccc

SEQ ID NO: 44581 - DNA, 20 bp, Artificial
  CRISPR gRNA sequence
cattcagagctcccaagacc

SEQ ID NO: 44582 - DNA, 20 bp, Artificial
  CRISPR gRNA sequence
attcagagctcccaagaccc

SEQ ID NO: 44583 - DNA, 20 bp, Artificial
  CRISPR gRNA sequence
ttcagagctcccaagaccca

SEQ ID NO: 44584 - DNA, 20 bp, Artificial
  CRISPR gRNA sequence
agagctcccaagacccaggg

SEQ ID NO: 44585 - DNA, 20 bp, Artificial
  CRISPR gRNA sequence
tgttgccctttgacccccac

SEQ ID NO: 44586 - DNA, 20 bp, Artificial
  CRISPR gRNA sequence
gttgccctttgacccccacc

SEQ ID NO: 44587 - DNA, 20 bp, Artificial
  CRISPR gRNA sequence
acccccaccaggctgacctc

SEQ ID NO: 44588 - DNA, 20 bp, Artificial
  CRISPR gRNA sequence
aggctgacctccagctgtgt

SEQ ID NO: 44589 - DNA, 20 bp, Artificial
  CRISPR gRNA sequence
cctccagctgtgtgagcacc

SEQ ID NO: 44590 - DNA, 20 bp, Artificial
  CRISPR gRNA sequence
ctccagctgtgtgagcaccg

SEQ ID NO: 44591 - DNA, 20 bp, Artificial
  CRISPR gRNA sequence
tccagctgtgtgagcaccga

SEQ ID NO: 44592 - DNA, 20 bp, Artificial
  CRISPR gRNA sequence
caccgagggcctcgcccacc

SEQ ID NO: 44593 - DNA, 20 bp, Artificial
  CRISPR gRNA sequence
ggcctcgcccacctggcatc

SEQ ID NO: 44594 - DNA, 20 bp, Artificial
  CRISPR gRNA sequence
cgcccacctggcatctggtc

SEQ ID NO: 44595 - DNA, 20 bp, Artificial
  CRISPR gRNA sequence
gcccacctggcatctggtct

SEQ ID NO: 44596 - DNA, 20 bp, Artificial
  CRISPR gRNA sequence
tctgggccactgccaccact

SEQ ID NO: 44597 - DNA, 20 bp, Artificial
  CRISPR gRNA sequence
tgggccactgccaccacttg

SEQ ID NO: 44598 - DNA, 20 bp, Artificial
  CRISPR gRNA sequence
gggccactgccaccacttgg

SEQ ID NO: 44599 - DNA, 20 bp, Artificial
  CRISPR gRNA sequence
gccactgccaccacttggag

SEQ ID NO: 44600 - DNA, 20 bp, Artificial
  CRISPR gRNA sequence
ctgccaccacttggaggagc

SEQ ID NO: 44601 - DNA, 20 bp, Artificial
  CRISPR gRNA sequence
gccaccacttggaggagctg

SEQ ID NO: 44602 - DNA, 20 bp, Artificial
  CRISPR gRNA sequence
ccacttggaggagctggagt

SEQ ID NO: 44603 - DNA, 20 bp, Artificial
  CRISPR gRNA sequence
ggaggagctggagtgagttg

SEQ ID NO: 44604 - DNA, 20 bp, Artificial
  CRISPR gRNA sequence
aggagctggagtgagttgca

SEQ ID NO: 44605 - DNA, 20 bp, Artificial
  CRISPR gRNA sequence
agctggagtgagttgcagag

SEQ ID NO: 44606 - DNA, 20 bp, Artificial
  CRISPR gRNA sequence
ctggagtgagttgcagagtg

SEQ ID NO: 44607 - DNA, 20 bp, Artificial
  CRISPR gRNA sequence
tggagtgagttgcagagtgg

SEQ ID NO: 44608 - DNA, 20 bp, Artificial
  CRISPR gRNA sequence
ggagtgagttgcagagtgga

SEQ ID NO: 44609 - DNA, 20 bp, Artificial
  CRISPR gRNA sequence
gagttgcagagtggagggat

SEQ ID NO: 44610 - DNA, 20 bp, Artificial
  CRISPR gRNA sequence
agttgcagagtggagggatt

SEQ ID NO: 44611 - DNA, 20 bp, Artificial
  CRISPR gRNA sequence
gttgcagagtggagggattg

SEQ ID NO: 44612 - DNA, 20 bp, Artificial
  CRISPR gRNA sequence
agagtggagggattggggac

SEQ ID NO: 44613 - DNA, 20 bp, Artificial
  CRISPR gRNA sequence
gtggagggattggggacaag

SEQ ID NO: 44614 - DNA, 20 bp, Artificial
  CRISPR gRNA sequence
gggattggggacaagtggcc

SEQ ID NO: 44615 - DNA, 20 bp, Artificial
  CRISPR gRNA sequence
tggggacaagtggcccagct

SEQ ID NO: 44616 - DNA, 20 bp, Artificial
  CRISPR gRNA sequence
ggggacaagtggcccagctg

SEQ ID NO: 44617 - DNA, 20 bp, Artificial
  CRISPR gRNA sequence
gggacaagtggcccagctga

SEQ ID NO: 44618 - DNA, 20 bp, Artificial
  CRISPR gRNA sequence
caagtggcccagctgagggt

SEQ ID NO: 44619 - DNA, 20 bp, Artificial
  CRISPR gRNA sequence
aagtggcccagctgagggtg

SEQ ID NO: 44620 - DNA, 20 bp, Artificial
  CRISPR gRNA sequence
agtggcccagctgagggtga

SEQ ID NO: 44621 - DNA, 20 bp, Artificial
  CRISPR gRNA sequence
gtggcccagctgagggtgag

SEQ ID NO: 44622 - DNA, 20 bp, Artificial
  CRISPR gRNA sequence
gcccagctgagggtgagggg

SEQ ID NO: 44623 - DNA, 20 bp, Artificial
  CRISPR gRNA sequence
ccagctgagggtgaggggtg

SEQ ID NO: 44624 - DNA, 20 bp, Artificial
  CRISPR gRNA sequence
gctgagggtgaggggtggag

SEQ ID NO: 44625 - DNA, 20 bp, Artificial
  CRISPR gRNA sequence
tgagggtgaggggtggagaa

SEQ ID NO: 44626 - DNA, 20 bp, Artificial
  CRISPR gRNA sequence
agggtgaggggtggagaaga

SEQ ID NO: 44627 - DNA, 20 bp, Artificial
  CRISPR gRNA sequence
gtgaggggtggagaagagag

SEQ ID NO: 44628 - DNA, 20 bp, Artificial
  CRISPR gRNA sequence
tgaggggtggagaagagagc

SEQ ID NO: 44629 - DNA, 20 bp, Artificial
  CRISPR gRNA sequence
gaggggtggagaagagagca

SEQ ID NO: 44630 - DNA, 20 bp, Artificial
  CRISPR gRNA sequence
ggagaagagagcagggcgtt

SEQ ID NO: 44631 - DNA, 20 bp, Artificial
  CRISPR gRNA sequence
gagaagagagcagggcgttt

SEQ ID NO: 44632 - DNA, 20 bp, Artificial
  CRISPR gRNA sequence
gaagagagcagggcgtttgg

SEQ ID NO: 44633 - DNA, 20 bp, Artificial
  CRISPR gRNA sequence
aagagagcagggcgtttggg

SEQ ID NO: 44634 - DNA, 20 bp, Artificial
  CRISPR gRNA sequence
agagagcagggcgtttggga

SEQ ID NO: 44635 - DNA, 20 bp, Artificial
  CRISPR gRNA sequence
gagcagggcgtttgggaggg

SEQ ID NO: 44636 - DNA, 20 bp, Artificial
  CRISPR gRNA sequence
agcagggcgtttgggagggc

SEQ ID NO: 44637 - DNA, 20 bp, Artificial
  CRISPR gRNA sequence
cgtttgggagggcaggcaat

SEQ ID NO: 44638 - DNA, 20 bp, Artificial
  CRISPR gRNA sequence
caatgacccttcccctgatg

SEQ ID NO: 44639 - DNA, 20 bp, Artificial
  CRISPR gRNA sequence
acccttcccctgatgaagtg

SEQ ID NO: 44640 - DNA, 20 bp, Artificial
  CRISPR gRNA sequence
cttcccctgatgaagtgcag

SEQ ID NO: 44641 - DNA, 20 bp, Artificial
  CRISPR gRNA sequence
ctgatgaagtgcagcagttc

SEQ ID NO: 44642 - DNA, 20 bp, Artificial
  CRISPR gRNA sequence
tgatgaagtgcagcagttct

SEQ ID NO: 44643 - DNA, 20 bp, Artificial
  CRISPR gRNA sequence
aagtgcagcagttctgggtg

SEQ ID NO: 44644 - DNA, 20 bp, Artificial
  CRISPR gRNA sequence
cagcagttctgggtgtggcc

SEQ ID NO: 44645 - DNA, 20 bp, Artificial
  CRISPR gRNA sequence
agcagttctgggtgtggcct

SEQ ID NO: 44646 - DNA, 20 bp, Artificial
  CRISPR gRNA sequence
gcagttctgggtgtggcctg

SEQ ID NO: 44647 - DNA, 20 bp, Artificial
  CRISPR gRNA sequence
gttctgggtgtggcctgggg

SEQ ID NO: 44648 - DNA, 20 bp, Artificial
  CRISPR gRNA sequence
ttctgggtgtggcctgggga

SEQ ID NO: 44649 - DNA, 20 bp, Artificial
  CRISPR gRNA sequence
tgggtgtggcctggggaagg

SEQ ID NO: 44650 - DNA, 20 bp, Artificial
  CRISPR gRNA sequence
ggtgtggcctggggaaggaa

SEQ ID NO: 44651 - DNA, 20 bp, Artificial
  CRISPR gRNA sequence
ctggggaaggaagagcacca

SEQ ID NO: 44652 - DNA, 20 bp, Artificial
  CRISPR gRNA sequence
aaggaagagcaccacagttt

SEQ ID NO: 44653 - DNA, 20 bp, Artificial
  CRISPR gRNA sequence
tgaatttcgccactgactca

SEQ ID NO: 44654 - DNA, 20 bp, Artificial
  CRISPR gRNA sequence
aatttcgccactgactcaca

SEQ ID NO: 44655 - DNA, 20 bp, Artificial
  CRISPR gRNA sequence
atttcgccactgactcacag

SEQ ID NO: 44656 - DNA, 20 bp, Artificial
  CRISPR gRNA sequence
tttcgccactgactcacaga

SEQ ID NO: 44657 - DNA, 20 bp, Artificial
  CRISPR gRNA sequence
ttcgccactgactcacagag

SEQ ID NO: 44658 - DNA, 20 bp, Artificial
  CRISPR gRNA sequence
actgactcacagaggggctg

SEQ ID NO: 44659 - DNA, 20 bp, Artificial
  CRISPR gRNA sequence
ctgactcacagaggggctgt

SEQ ID NO: 44660 - DNA, 20 bp, Artificial
  CRISPR gRNA sequence
tcacagaggggctgtgggca

SEQ ID NO: 44661 - DNA, 20 bp, Artificial
  CRISPR gRNA sequence
tgggcatggctgttccactc

SEQ ID NO: 44662 - DNA, 20 bp, Artificial
  CRISPR gRNA sequence
gggcatggctgttccactct

SEQ ID NO: 44663 - DNA, 20 bp, Artificial
  CRISPR gRNA sequence
gattgccttatctatgaaaa

SEQ ID NO: 44664 - DNA, 20 bp, Artificial
  CRISPR gRNA sequence
attgccttatctatgaaaat

SEQ ID NO: 44665 - DNA, 20 bp, Artificial
  CRISPR gRNA sequence
ttgccttatctatgaaaatg

SEQ ID NO: 44666 - DNA, 20 bp, Artificial
  CRISPR gRNA sequence
tctatgaaaatggggctcat

SEQ ID NO: 44667 - DNA, 20 bp, Artificial
  CRISPR gRNA sequence
gctcatgagccttgctctgc

SEQ ID NO: 44668 - DNA, 20 bp, Artificial
  CRISPR gRNA sequence
ctcatgagccttgctctgct

SEQ ID NO: 44669 - DNA, 20 bp, Artificial
  CRISPR gRNA sequence
tgagccttgctctgctgggc

SEQ ID NO: 44670 - DNA, 20 bp, Artificial
  CRISPR gRNA sequence
ttgctctgctgggctggctg

SEQ ID NO: 44671 - DNA, 20 bp, Artificial
  CRISPR gRNA sequence
tgctctgctgggctggctgt

SEQ ID NO: 44672 - DNA, 20 bp, Artificial
  CRISPR gRNA sequence
ctctgctgggctggctgtgg

SEQ ID NO: 44673 - DNA, 20 bp, Artificial
  CRISPR gRNA sequence
gctgggctggctgtgggagt

SEQ ID NO: 44674 - DNA, 20 bp, Artificial
  CRISPR gRNA sequence
ctgggctggctgtgggagtc

SEQ ID NO: 44675 - DNA, 20 bp, Artificial
  CRISPR gRNA sequence
tggctgtgggagtcaggcta

SEQ ID NO: 44676 - DNA, 20 bp, Artificial
  CRISPR gRNA sequence
gctgtgggagtcaggctacg

SEQ ID NO: 44677 - DNA, 20 bp, Artificial
  CRISPR gRNA sequence
tgtgggagtcaggctacgga

SEQ ID NO: 44678 - DNA, 20 bp, Artificial
  CRISPR gRNA sequence
gtgggagtcaggctacggag

SEQ ID NO: 44679 - DNA, 20 bp, Artificial
  CRISPR gRNA sequence
tgggagtcaggctacggaga

SEQ ID NO: 44680 - DNA, 20 bp, Artificial
  CRISPR gRNA sequence
tcaggctacggagagggctg

SEQ ID NO: 44681 - DNA, 20 bp, Artificial
  CRISPR gRNA sequence
tacggagagggctgaagaac

SEQ ID NO: 44682 - DNA, 20 bp, Artificial
  CRISPR gRNA sequence
cggagagggctgaagaacaa

SEQ ID NO: 44683 - DNA, 20 bp, Artificial
  CRISPR gRNA sequence
ggagagggctgaagaacaag

SEQ ID NO: 44684 - DNA, 20 bp, Artificial
  CRISPR gRNA sequence
gagagggctgaagaacaaga

SEQ ID NO: 44685 - DNA, 20 bp, Artificial
  CRISPR gRNA sequence
tgtgtgtgtgtgtgtgtccc

SEQ ID NO: 44686 - DNA, 20 bp, Artificial
  CRISPR gRNA sequence
tgtgtgtgtccctagtcccc

SEQ ID NO: 44687 - DNA, 20 bp, Artificial
  CRISPR gRNA sequence
gtcccccagcttcctctctg

SEQ ID NO: 44688 - DNA, 20 bp, Artificial
  CRISPR gRNA sequence
tcctctctgcagccttcatc

SEQ ID NO: 44689 - DNA, 20 bp, Artificial
  CRISPR gRNA sequence
cctctctgcagccttcatcc

SEQ ID NO: 44690 - DNA, 20 bp, Artificial
  CRISPR gRNA sequence
ctctctgcagccttcatcca

SEQ ID NO: 44691 - DNA, 20 bp, Artificial
  CRISPR gRNA sequence
tgcagccttcatccagggca

SEQ ID NO: 44692 - DNA, 20 bp, Artificial
  CRISPR gRNA sequence
tcatccagggcatagtttct

SEQ ID NO: 44693 - DNA, 20 bp, Artificial
  CRISPR gRNA sequence
ccagggcatagtttctcagc

SEQ ID NO: 44694 - DNA, 20 bp, Artificial
  CRISPR gRNA sequence
cagggcatagtttctcagct

SEQ ID NO: 44695 - DNA, 20 bp, Artificial
  CRISPR gRNA sequence
gcatagtttctcagctgggc

SEQ ID NO: 44696 - DNA, 20 bp, Artificial
  CRISPR gRNA sequence
ctgtgactatcatgcctacc

SEQ ID NO: 44697 - DNA, 20 bp, Artificial
  CRISPR gRNA sequence
gtgactatcatgcctaccca

SEQ ID NO: 44698 - DNA, 20 bp, Artificial
  CRISPR gRNA sequence
atcatgcctacccagagcct

SEQ ID NO: 44699 - DNA, 20 bp, Artificial
  CRISPR gRNA sequence
cctacccagagcctgagccc

SEQ ID NO: 44700 - DNA, 20 bp, Artificial
  CRISPR gRNA sequence
tacccagagcctgagccctg

SEQ ID NO: 44701 - DNA, 20 bp, Artificial
  CRISPR gRNA sequence
cagagcctgagccctggagc

SEQ ID NO: 44702 - DNA, 20 bp, Artificial
  CRISPR gRNA sequence
agagcctgagccctggagct

SEQ ID NO: 44703 - DNA, 20 bp, Artificial
  CRISPR gRNA sequence
gagcctgagccctggagcta

SEQ ID NO: 44704 - DNA, 20 bp, Artificial
  CRISPR gRNA sequence
cctggagctagggataccca

SEQ ID NO: 44705 - DNA, 20 bp, Artificial
  CRISPR gRNA sequence
ctggagctagggatacccat

SEQ ID NO: 44706 - DNA, 20 bp, Artificial
  CRISPR gRNA sequence
tggagctagggatacccatg

SEQ ID NO: 44707 - DNA, 20 bp, Artificial
  CRISPR gRNA sequence
agggatacccatggggaacc

SEQ ID NO: 44708 - DNA, 20 bp, Artificial
  CRISPR gRNA sequence
atacccatggggaacctgga

SEQ ID NO: 44709 - DNA, 20 bp, Artificial
  CRISPR gRNA sequence
ccatggggaacctggacagc

SEQ ID NO: 44710 - DNA, 20 bp, Artificial
  CRISPR gRNA sequence
catggggaacctggacagcg

SEQ ID NO: 44711 - DNA, 20 bp, Artificial
  CRISPR gRNA sequence
atggggaacctggacagcga

SEQ ID NO: 44712 - DNA, 20 bp, Artificial
  CRISPR gRNA sequence
gggaacctggacagcgaggg

SEQ ID NO: 44713 - DNA, 20 bp, Artificial
  CRISPR gRNA sequence
cctggacagcgagggtggcc

SEQ ID NO: 44714 - DNA, 20 bp, Artificial
  CRISPR gRNA sequence
ctggacagcgagggtggccc

SEQ ID NO: 44715 - DNA, 20 bp, Artificial
  CRISPR gRNA sequence
tggacagcgagggtggccca

SEQ ID NO: 44716 - DNA, 20 bp, Artificial
  CRISPR gRNA sequence
cgagggtggcccagggcatg

SEQ ID NO: 44717 - DNA, 20 bp, Artificial
  CRISPR gRNA sequence
tggcccagggcatgcagatg

SEQ ID NO: 44718 - DNA, 20 bp, Artificial
  CRISPR gRNA sequence
gcccagggcatgcagatgca

SEQ ID NO: 44719 - DNA, 20 bp, Artificial
  CRISPR gRNA sequence
agggcatgcagatgcagagt

SEQ ID NO: 44720 - DNA, 20 bp, Artificial
  CRISPR gRNA sequence
cagatgcagagttggcctcc

SEQ ID NO: 44721 - DNA, 20 bp, Artificial
  CRISPR gRNA sequence
agatgcagagttggcctccc

SEQ ID NO: 44722 - DNA, 20 bp, Artificial
  CRISPR gRNA sequence
gatgcagagttggcctccca

SEQ ID NO: 44723 - DNA, 20 bp, Artificial
  CRISPR gRNA sequence
atgcagagttggcctcccag

SEQ ID NO: 44724 - DNA, 20 bp, Artificial
  CRISPR gRNA sequence
agagttggcctcccagggga

SEQ ID NO: 44725 - DNA, 20 bp, Artificial
  CRISPR gRNA sequence
agttggcctcccaggggaca

SEQ ID NO: 44726 - DNA, 20 bp, Artificial
  CRISPR gRNA sequence
tggcctcccaggggacagag

SEQ ID NO: 44727 - DNA, 20 bp, Artificial
  CRISPR gRNA sequence
ggcctcccaggggacagagc

SEQ ID NO: 44728 - DNA, 20 bp, Artificial
  CRISPR gRNA sequence
cctcccaggggacagagcag

SEQ ID NO: 44729 - DNA, 20 bp, Artificial
  CRISPR gRNA sequence
tcccaggggacagagcagga

SEQ ID NO: 44730 - DNA, 20 bp, Artificial
  CRISPR gRNA sequence
cccaggggacagagcaggag

SEQ ID NO: 44731 - DNA, 20 bp, Artificial
  CRISPR gRNA sequence
ccaggggacagagcaggaga

SEQ ID NO: 44732 - DNA, 20 bp, Artificial
  CRISPR gRNA sequence
caggggacagagcaggagag

SEQ ID NO: 44733 - DNA, 20 bp, Artificial
  CRISPR gRNA sequence
ggggacagagcaggagaggg

SEQ ID NO: 44734 - DNA, 20 bp, Artificial
  CRISPR gRNA sequence
gagcaggagaggggagctga

SEQ ID NO: 44735 - DNA, 20 bp, Artificial
  CRISPR gRNA sequence
agcaggagaggggagctgac

SEQ ID NO: 44736 - DNA, 20 bp, Artificial
  CRISPR gRNA sequence
ggagaggggagctgacagga

SEQ ID NO: 44737 - DNA, 20 bp, Artificial
  CRISPR gRNA sequence
ggggagctgacaggacagct

SEQ ID NO: 44738 - DNA, 20 bp, Artificial
  CRISPR gRNA sequence
ctgacaggacagctcagctc

SEQ ID NO: 44739 - DNA, 20 bp, Artificial
  CRISPR gRNA sequence
tgacaggacagctcagctcc

SEQ ID NO: 44740 - DNA, 20 bp, Artificial
  CRISPR gRNA sequence
gacaggacagctcagctcca

SEQ ID NO: 44741 - DNA, 20 bp, Artificial
  CRISPR gRNA sequence
ggacagctcagctccagggc

SEQ ID NO: 44742 - DNA, 20 bp, Artificial
  CRISPR gRNA sequence
gacagctcagctccagggct

SEQ ID NO: 44743 - DNA, 20 bp, Artificial
  CRISPR gRNA sequence
agctcagctccagggctggg

SEQ ID NO: 44744 - DNA, 20 bp, Artificial
  CRISPR gRNA sequence
gctcagctccagggctgggc

SEQ ID NO: 44745 - DNA, 20 bp, Artificial
  CRISPR gRNA sequence
cgctaacccttgcctctgcc

SEQ ID NO: 44746 - DNA, 20 bp, Artificial
  CRISPR gRNA sequence
tgcctctgcctggtcttctg

SEQ ID NO: 44747 - DNA, 20 bp, Artificial
  CRISPR gRNA sequence
tgtctaacaatcaatttgat

SEQ ID NO: 44748 - DNA, 20 bp, Artificial
  CRISPR gRNA sequence
gtctaacaatcaatttgatg

SEQ ID NO: 44749 - DNA, 20 bp, Artificial
  CRISPR gRNA sequence
ctaacaatcaatttgatgag

SEQ ID NO: 44750 - DNA, 20 bp, Artificial
  CRISPR gRNA sequence
taacaatcaatttgatgagg

SEQ ID NO: 44751 - DNA, 20 bp, Artificial
  CRISPR gRNA sequence
aacaatcaatttgatgagga

SEQ ID NO: 44752 - DNA, 20 bp, Artificial
  CRISPR gRNA sequence
aatttgatgaggagggcacc

SEQ ID NO: 44753 - DNA, 20 bp, Artificial
  CRISPR gRNA sequence
atttgatgaggagggcacca

SEQ ID NO: 44754 - DNA, 20 bp, Artificial
  CRISPR gRNA sequence
gagggcaccaaggcgctgat

SEQ ID NO: 44755 - DNA, 20 bp, Artificial
  CRISPR gRNA sequence
agggcaccaaggcgctgatg

SEQ ID NO: 44756 - DNA, 20 bp, Artificial
  CRISPR gRNA sequence
gggcaccaaggcgctgatga

SEQ ID NO: 44757 - DNA, 20 bp, Artificial
  CRISPR gRNA sequence
aggcgctgatgagggccctt

SEQ ID NO: 44758 - DNA, 20 bp, Artificial
  CRISPR gRNA sequence
ggcgctgatgagggcccttg

SEQ ID NO: 44759 - DNA, 20 bp, Artificial
  CRISPR gRNA sequence
gcgctgatgagggcccttga

SEQ ID NO: 44760 - DNA, 20 bp, Artificial
  CRISPR gRNA sequence
cgctgatgagggcccttgag

SEQ ID NO: 44761 - DNA, 20 bp, Artificial
  CRISPR gRNA sequence
tgagggcccttgaggggaaa

SEQ ID NO: 44762 - DNA, 20 bp, Artificial
  CRISPR gRNA sequence
ttgaggggaaatggatgcta

SEQ ID NO: 44763 - DNA, 20 bp, Artificial
  CRISPR gRNA sequence
gaggggaaatggatgctaaa

SEQ ID NO: 44764 - DNA, 20 bp, Artificial
  CRISPR gRNA sequence
aggggaaatggatgctaaag

SEQ ID NO: 44765 - DNA, 20 bp, Artificial
  CRISPR gRNA sequence
gaaatggatgctaaagaggc

SEQ ID NO: 44766 - DNA, 20 bp, Artificial
  CRISPR gRNA sequence
aatggatgctaaagaggctg

SEQ ID NO: 44767 - DNA, 20 bp, Artificial
  CRISPR gRNA sequence
gatgctaaagaggctggagt

SEQ ID NO: 44768 - DNA, 20 bp, Artificial
  CRISPR gRNA sequence
gctaaagaggctggagtaag

SEQ ID NO: 44769 - DNA, 20 bp, Artificial
  CRISPR gRNA sequence
gaggctggagtaagtagtga

SEQ ID NO: 44770 - DNA, 20 bp, Artificial
  CRISPR gRNA sequence
gctggagtaagtagtgatgg

SEQ ID NO: 44771 - DNA, 20 bp, Artificial
  CRISPR gRNA sequence
gtaagtagtgatggtggttg

SEQ ID NO: 44772 - DNA, 20 bp, Artificial
  CRISPR gRNA sequence
taagtagtgatggtggttgt

SEQ ID NO: 44773 - DNA, 20 bp, Artificial
  CRISPR gRNA sequence
tagtgatggtggttgtgggt

SEQ ID NO: 44774 - DNA, 20 bp, Artificial
  CRISPR gRNA sequence
gatggtggttgtgggtgagt

SEQ ID NO: 44775 - DNA, 20 bp, Artificial
  CRISPR gRNA sequence
ggtggttgtgggtgagtgag

SEQ ID NO: 44776 - DNA, 20 bp, Artificial
  CRISPR gRNA sequence
ggttgtgggtgagtgagtgg

SEQ ID NO: 44777 - DNA, 20 bp, Artificial
  CRISPR gRNA sequence
gttgtgggtgagtgagtggt

SEQ ID NO: 44778 - DNA, 20 bp, Artificial
  CRISPR gRNA sequence
ttgtgggtgagtgagtggtg

SEQ ID NO: 44779 - DNA, 20 bp, Artificial
  CRISPR gRNA sequence
tgtgggtgagtgagtggtgg

SEQ ID NO: 44780 - DNA, 20 bp, Artificial
  CRISPR gRNA sequence
gggtgagtgagtggtggggg

SEQ ID NO: 44781 - DNA, 20 bp, Artificial
  CRISPR gRNA sequence
tgagtggtgggggtggttaa

SEQ ID NO: 44782 - DNA, 20 bp, Artificial
  CRISPR gRNA sequence
tggtgggggtggttaatgga

SEQ ID NO: 44783 - DNA, 20 bp, Artificial
  CRISPR gRNA sequence
tgggggtggttaatggatgg

SEQ ID NO: 44784 - DNA, 20 bp, Artificial
  CRISPR gRNA sequence
gggtggttaatggatggtgg

SEQ ID NO: 44785 - DNA, 20 bp, Artificial
  CRISPR gRNA sequence
tggttaatggatggtggaag

SEQ ID NO: 44786 - DNA, 20 bp, Artificial
  CRISPR gRNA sequence
ggttaatggatggtggaagt

SEQ ID NO: 44787 - DNA, 20 bp, Artificial
  CRISPR gRNA sequence
aatggatggtggaagtgggt

SEQ ID NO: 44788 - DNA, 20 bp, Artificial
  CRISPR gRNA sequence
ggatggtggaagtgggtgag

SEQ ID NO: 44789 - DNA, 20 bp, Artificial
  CRISPR gRNA sequence
tggtggaagtgggtgagtgg

SEQ ID NO: 44790 - DNA, 20 bp, Artificial
  CRISPR gRNA sequence
ggtggaagtgggtgagtggt

SEQ ID NO: 44791 - DNA, 20 bp, Artificial
  CRISPR gRNA sequence
gtggaagtgggtgagtggtg

SEQ ID NO: 44792 - DNA, 20 bp, Artificial
  CRISPR gRNA sequence
aagtgggtgagtggtggggt

SEQ ID NO: 44793 - DNA, 20 bp, Artificial
  CRISPR gRNA sequence
tgagtggtggggttggttaa

SEQ ID NO: 44794 - DNA, 20 bp, Artificial
  CRISPR gRNA sequence
tggtggggttggttaatgga

SEQ ID NO: 44795 - DNA, 20 bp, Artificial
  CRISPR gRNA sequence
tggggttggttaatggatgg

SEQ ID NO: 44796 - DNA, 20 bp, Artificial
  CRISPR gRNA sequence
ggttggttaatggatggtgg

SEQ ID NO: 44797 - DNA, 20 bp, Artificial
  CRISPR gRNA sequence
tggttaatggatggtggaag

SEQ ID NO: 44798 - DNA, 20 bp, Artificial
  CRISPR gRNA sequence
ggttaatggatggtggaagt

SEQ ID NO: 44799 - DNA, 20 bp, Artificial
  CRISPR gRNA sequence
aatggatggtggaagtgggt

SEQ ID NO: 44800 - DNA, 20 bp, Artificial
  CRISPR gRNA sequence
ggatggtggaagtgggtgag

SEQ ID NO: 44801 - DNA, 20 bp, Artificial
  CRISPR gRNA sequence
tggtggaagtgggtgagtgg

SEQ ID NO: 44802 - DNA, 20 bp, Artificial
  CRISPR gRNA sequence
ggtggaagtgggtgagtggt

SEQ ID NO: 44803 - DNA, 20 bp, Artificial
  CRISPR gRNA sequence
gtggaagtgggtgagtggtg

SEQ ID NO: 44804 - DNA, 20 bp, Artificial
  CRISPR gRNA sequence
aagtgggtgagtggtggggt

SEQ ID NO: 44805 - DNA, 20 bp, Artificial
  CRISPR gRNA sequence
tgagtggtggggttggttaa

SEQ ID NO: 44806 - DNA, 20 bp, Artificial
  CRISPR gRNA sequence
gagtggtggggttggttaat

SEQ ID NO: 44807 - DNA, 20 bp, Artificial
  CRISPR gRNA sequence
agtggtggggttggttaatg

SEQ ID NO: 44808 - DNA, 20 bp, Artificial
  CRISPR gRNA sequence
tggggttggttaatggggaa

SEQ ID NO: 44809 - DNA, 20 bp, Artificial
  CRISPR gRNA sequence
ggggttggttaatggggaat

SEQ ID NO: 44810 - DNA, 20 bp, Artificial
  CRISPR gRNA sequence
gggttggttaatggggaatg

SEQ ID NO: 44811 - DNA, 20 bp, Artificial
  CRISPR gRNA sequence
tggttaatggggaatggggt

SEQ ID NO: 44812 - DNA, 20 bp, Artificial
  CRISPR gRNA sequence
taatggggaatggggtgagt

SEQ ID NO: 44813 - DNA, 20 bp, Artificial
  CRISPR gRNA sequence
tggggaatggggtgagtgag

SEQ ID NO: 44814 - DNA, 20 bp, Artificial
  CRISPR gRNA sequence
ggaatggggtgagtgagtgg

SEQ ID NO: 44815 - DNA, 20 bp, Artificial
  CRISPR gRNA sequence
gaatggggtgagtgagtggt

SEQ ID NO: 44816 - DNA, 20 bp, Artificial
  CRISPR gRNA sequence
atggggtgagtgagtggtgg

SEQ ID NO: 44817 - DNA, 20 bp, Artificial
  CRISPR gRNA sequence
gggtgagtgagtggtgggag

SEQ ID NO: 44818 - DNA, 20 bp, Artificial
  CRISPR gRNA sequence
tgagtggtgggagtggttaa

SEQ ID NO: 44819 - DNA, 20 bp, Artificial
  CRISPR gRNA sequence
gagtggtgggagtggttaat

SEQ ID NO: 44820 - DNA, 20 bp, Artificial
  CRISPR gRNA sequence
agtggtgggagtggttaatg

SEQ ID NO: 44821 - DNA, 20 bp, Artificial
  CRISPR gRNA sequence
tgggagtggttaatggggaa

SEQ ID NO: 44822 - DNA, 20 bp, Artificial
  CRISPR gRNA sequence
gggagtggttaatggggaat

SEQ ID NO: 44823 - DNA, 20 bp, Artificial
  CRISPR gRNA sequence
tggttaatggggaatgggct

SEQ ID NO: 44824 - DNA, 20 bp, Artificial
  CRISPR gRNA sequence
taatggggaatgggctgagt

SEQ ID NO: 44825 - DNA, 20 bp, Artificial
  CRISPR gRNA sequence
tggggaatgggctgagtgag

SEQ ID NO: 44826 - DNA, 20 bp, Artificial
  CRISPR gRNA sequence
ggaatgggctgagtgagtgg

SEQ ID NO: 44827 - DNA, 20 bp, Artificial
  CRISPR gRNA sequence
gaatgggctgagtgagtggt

SEQ ID NO: 44828 - DNA, 20 bp, Artificial
  CRISPR gRNA sequence
atgggctgagtgagtggtgg

SEQ ID NO: 44829 - DNA, 20 bp, Artificial
  CRISPR gRNA sequence
ggctgagtgagtggtgggag

SEQ ID NO: 44830 - DNA, 20 bp, Artificial
  CRISPR gRNA sequence
tgagtggtgggagtggttaa

SEQ ID NO: 44831 - DNA, 20 bp, Artificial
  CRISPR gRNA sequence
gagtggtgggagtggttaat

SEQ ID NO: 44832 - DNA, 20 bp, Artificial
  CRISPR gRNA sequence
agtggtgggagtggttaatg

SEQ ID NO: 44833 - DNA, 20 bp, Artificial
  CRISPR gRNA sequence
tgggagtggttaatggggaa

SEQ ID NO: 44834 - DNA, 20 bp, Artificial
  CRISPR gRNA sequence
gggagtggttaatggggaat

SEQ ID NO: 44835 - DNA, 20 bp, Artificial
  CRISPR gRNA sequence
ggagtggttaatggggaatg

SEQ ID NO: 44836 - DNA, 20 bp, Artificial
  CRISPR gRNA sequence
tggttaatggggaatggggt

SEQ ID NO: 44837 - DNA, 20 bp, Artificial
  CRISPR gRNA sequence
taatggggaatggggtgagt

SEQ ID NO: 44838 - DNA, 20 bp, Artificial
  CRISPR gRNA sequence
tggggaatggggtgagtgag

SEQ ID NO: 44839 - DNA, 20 bp, Artificial
  CRISPR gRNA sequence
atggggtgagtgagtggtga

SEQ ID NO: 44840 - DNA, 20 bp, Artificial
  CRISPR gRNA sequence
gggtgagtgagtggtgatgg

SEQ ID NO: 44841 - DNA, 20 bp, Artificial
  CRISPR gRNA sequence
tgagtggtgatggtggttaa

SEQ ID NO: 44842 - DNA, 20 bp, Artificial
  CRISPR gRNA sequence
gagtggtgatggtggttaat

SEQ ID NO: 44843 - DNA, 20 bp, Artificial
  CRISPR gRNA sequence
agtggtgatggtggttaatg

SEQ ID NO: 44844 - DNA, 20 bp, Artificial
  CRISPR gRNA sequence
ggtgatggtggttaatgggg

SEQ ID NO: 44845 - DNA, 20 bp, Artificial
  CRISPR gRNA sequence
gtgatggtggttaatgggga

SEQ ID NO: 44846 - DNA, 20 bp, Artificial
  CRISPR gRNA sequence
tgatggtggttaatggggaa

SEQ ID NO: 44847 - DNA, 20 bp, Artificial
  CRISPR gRNA sequence
tggttaatggggaagggtgt

SEQ ID NO: 44848 - DNA, 20 bp, Artificial
  CRISPR gRNA sequence
gttaatggggaagggtgtga

SEQ ID NO: 44849 - DNA, 20 bp, Artificial
  CRISPR gRNA sequence
aatggggaagggtgtgagag

SEQ ID NO: 44850 - DNA, 20 bp, Artificial
  CRISPR gRNA sequence
gaagggtgtgagagtggtga

SEQ ID NO: 44851 - DNA, 20 bp, Artificial
  CRISPR gRNA sequence
gggtgtgagagtggtgatgg

SEQ ID NO: 44852 - DNA, 20 bp, Artificial
  CRISPR gRNA sequence
agagtggtgatggtggttaa

SEQ ID NO: 44853 - DNA, 20 bp, Artificial
  CRISPR gRNA sequence
gagtggtgatggtggttaat

SEQ ID NO: 44854 - DNA, 20 bp, Artificial
  CRISPR gRNA sequence
agtggtgatggtggttaatg

SEQ ID NO: 44855 - DNA, 20 bp, Artificial
  CRISPR gRNA sequence
ggtgatggtggttaatgggg

SEQ ID NO: 44856 - DNA, 20 bp, Artificial
  CRISPR gRNA sequence
gtgatggtggttaatgggga

SEQ ID NO: 44857 - DNA, 20 bp, Artificial
  CRISPR gRNA sequence
tgatggtggttaatggggaa

SEQ ID NO: 44858 - DNA, 20 bp, Artificial
  CRISPR gRNA sequence
gatggtggttaatggggaag

SEQ ID NO: 44859 - DNA, 20 bp, Artificial
  CRISPR gRNA sequence
atggtggttaatggggaagg

SEQ ID NO: 44860 - DNA, 20 bp, Artificial
  CRISPR gRNA sequence
tggttaatggggaagggggt

SEQ ID NO: 44861 - DNA, 20 bp, Artificial
  CRISPR gRNA sequence
taatggggaagggggtgagt

SEQ ID NO: 44862 - DNA, 20 bp, Artificial
  CRISPR gRNA sequence
tggggaagggggtgagtgag

SEQ ID NO: 44863 - DNA, 20 bp, Artificial
  CRISPR gRNA sequence
agggggtgagtgagtggtga

SEQ ID NO: 44864 - DNA, 20 bp, Artificial
  CRISPR gRNA sequence
gggtgagtgagtggtgatgg

SEQ ID NO: 44865 - DNA, 20 bp, Artificial
  CRISPR gRNA sequence
tgagtggtgatggtggttaa

SEQ ID NO: 44866 - DNA, 20 bp, Artificial
  CRISPR gRNA sequence
gagtggtgatggtggttaat

SEQ ID NO: 44867 - DNA, 20 bp, Artificial
  CRISPR gRNA sequence
agtggtgatggtggttaatg

SEQ ID NO: 44868 - DNA, 20 bp, Artificial
  CRISPR gRNA sequence
ggtgatggtggttaatgggg

SEQ ID NO: 44869 - DNA, 20 bp, Artificial
  CRISPR gRNA sequence
ggttaatggggaagtgttgt

SEQ ID NO: 44870 - DNA, 20 bp, Artificial
  CRISPR gRNA sequence
aatggggaagtgttgtgagt

SEQ ID NO: 44871 - DNA, 20 bp, Artificial
  CRISPR gRNA sequence
gtgttgtgagtgagttgtgt

SEQ ID NO: 44872 - DNA, 20 bp, Artificial
  CRISPR gRNA sequence
ttgtgagtgagttgtgttgg

SEQ ID NO: 44873 - DNA, 20 bp, Artificial
  CRISPR gRNA sequence
tgagttgtgttggtggttaa

SEQ ID NO: 44874 - DNA, 20 bp, Artificial
  CRISPR gRNA sequence
gagttgtgttggtggttaat

SEQ ID NO: 44875 - DNA, 20 bp, Artificial
  CRISPR gRNA sequence
agttgtgttggtggttaatg

SEQ ID NO: 44876 - DNA, 20 bp, Artificial
  CRISPR gRNA sequence
tgtgttggtggttaatgggg

SEQ ID NO: 44877 - DNA, 20 bp, Artificial
  CRISPR gRNA sequence
gtgttggtggttaatgggga

SEQ ID NO: 44878 - DNA, 20 bp, Artificial
  CRISPR gRNA sequence
gttggtggttaatggggaag

SEQ ID NO: 44879 - DNA, 20 bp, Artificial
  CRISPR gRNA sequence
tggttaatggggaaggagat

SEQ ID NO: 44880 - DNA, 20 bp, Artificial
  CRISPR gRNA sequence
taatggggaaggagatgagt

SEQ ID NO: 44881 - DNA, 20 bp, Artificial
  CRISPR gRNA sequence
tggggaaggagatgagtgag

SEQ ID NO: 44882 - DNA, 20 bp, Artificial
  CRISPR gRNA sequence
aggagatgagtgagtggtgt

SEQ ID NO: 44883 - DNA, 20 bp, Artificial
  CRISPR gRNA sequence
agatgagtgagtggtgttgg

SEQ ID NO: 44884 - DNA, 20 bp, Artificial
  CRISPR gRNA sequence
tgagtggtgttggtggttaa

SEQ ID NO: 44885 - DNA, 20 bp, Artificial
  CRISPR gRNA sequence
gagtggtgttggtggttaat

SEQ ID NO: 44886 - DNA, 20 bp, Artificial
  CRISPR gRNA sequence
agtggtgttggtggttaatg

SEQ ID NO: 44887 - DNA, 20 bp, Artificial
  CRISPR gRNA sequence
ggtgttggtggttaatgggg

SEQ ID NO: 44888 - DNA, 20 bp, Artificial
  CRISPR gRNA sequence
gtgttggtggttaatgggga

SEQ ID NO: 44889 - DNA, 20 bp, Artificial
  CRISPR gRNA sequence
tgttggtggttaatggggaa

SEQ ID NO: 44890 - DNA, 20 bp, Artificial
  CRISPR gRNA sequence
ggttaatggggaagggttgt

SEQ ID NO: 44891 - DNA, 20 bp, Artificial
  CRISPR gRNA sequence
aatggggaagggttgtgagt

SEQ ID NO: 44892 - DNA, 20 bp, Artificial
  CRISPR gRNA sequence
ggggaagggttgtgagtgag

SEQ ID NO: 44893 - DNA, 20 bp, Artificial
  CRISPR gRNA sequence
gaagggttgtgagtgagtgg

SEQ ID NO: 44894 - DNA, 20 bp, Artificial
  CRISPR gRNA sequence
ttgtgagtgagtggtggcgt

SEQ ID NO: 44895 - DNA, 20 bp, Artificial
  CRISPR gRNA sequence
tgagtggtggcgttggttaa

SEQ ID NO: 44896 - DNA, 20 bp, Artificial
  CRISPR gRNA sequence
gagtggtggcgttggttaat

SEQ ID NO: 44897 - DNA, 20 bp, Artificial
  CRISPR gRNA sequence
agtggtggcgttggttaatg

SEQ ID NO: 44898 - DNA, 20 bp, Artificial
  CRISPR gRNA sequence
ggtggcgttggttaatgggg

SEQ ID NO: 44899 - DNA, 20 bp, Artificial
  CRISPR gRNA sequence
gtggcgttggttaatgggga

SEQ ID NO: 44900 - DNA, 20 bp, Artificial
  CRISPR gRNA sequence
tggcgttggttaatggggaa

SEQ ID NO: 44901 - DNA, 20 bp, Artificial
  CRISPR gRNA sequence
ggcgttggttaatggggaag

SEQ ID NO: 44902 - DNA, 20 bp, Artificial
  CRISPR gRNA sequence
gcgttggttaatggggaagg

SEQ ID NO: 44903 - DNA, 20 bp, Artificial
  CRISPR gRNA sequence
tggttaatggggaagggggt

SEQ ID NO: 44904 - DNA, 20 bp, Artificial
  CRISPR gRNA sequence
taatggggaagggggtgagt

SEQ ID NO: 44905 - DNA, 20 bp, Artificial
  CRISPR gRNA sequence
tggggaagggggtgagtgag

SEQ ID NO: 44906 - DNA, 20 bp, Artificial
  CRISPR gRNA sequence
agggggtgagtgagtggtga

SEQ ID NO: 44907 - DNA, 20 bp, Artificial
  CRISPR gRNA sequence
gggtgagtgagtggtgatgg

SEQ ID NO: 44908 - DNA, 20 bp, Artificial
  CRISPR gRNA sequence
tgagtggtgatggtggttaa

SEQ ID NO: 44909 - DNA, 20 bp, Artificial
  CRISPR gRNA sequence
gagtggtgatggtggttaat

SEQ ID NO: 44910 - DNA, 20 bp, Artificial
  CRISPR gRNA sequence
agtggtgatggtggttaatg

SEQ ID NO: 44911 - DNA, 20 bp, Artificial
  CRISPR gRNA sequence
ggtgatggtggttaatgggg

SEQ ID NO: 44912 - DNA, 20 bp, Artificial
  CRISPR gRNA sequence
tgatggtggttaatggggaa

SEQ ID NO: 44913 - DNA, 20 bp, Artificial
  CRISPR gRNA sequence
ggttaatggggaagagttgt

SEQ ID NO: 44914 - DNA, 20 bp, Artificial
  CRISPR gRNA sequence
aatggggaagagttgtgagt

SEQ ID NO: 44915 - DNA, 20 bp, Artificial
  CRISPR gRNA sequence
ggggaagagttgtgagtgag

SEQ ID NO: 44916 - DNA, 20 bp, Artificial
  CRISPR gRNA sequence
gagttgtgagtgagtggtgt

SEQ ID NO: 44917 - DNA, 20 bp, Artificial
  CRISPR gRNA sequence
ttgtgagtgagtggtgttgg

SEQ ID NO: 44918 - DNA, 20 bp, Artificial
  CRISPR gRNA sequence
tgagtggtgttggtggttaa

SEQ ID NO: 44919 - DNA, 20 bp, Artificial
  CRISPR gRNA sequence
gagtggtgttggtggttaat

SEQ ID NO: 44920 - DNA, 20 bp, Artificial
  CRISPR gRNA sequence
agtggtgttggtggttaatg

SEQ ID NO: 44921 - DNA, 20 bp, Artificial
  CRISPR gRNA sequence
ggtgttggtggttaatgggg

SEQ ID NO: 44922 - DNA, 20 bp, Artificial
  CRISPR gRNA sequence
gtgttggtggttaatgggga

SEQ ID NO: 44923 - DNA, 20 bp, Artificial
  CRISPR gRNA sequence
tgttggtggttaatggggaa

SEQ ID NO: 44924 - DNA, 20 bp, Artificial
  CRISPR gRNA sequence
gttggtggttaatggggaag

SEQ ID NO: 44925 - DNA, 20 bp, Artificial
  CRISPR gRNA sequence
ttggtggttaatggggaagg

SEQ ID NO: 44926 - DNA, 20 bp, Artificial
  CRISPR gRNA sequence
tggttaatggggaagggggt

SEQ ID NO: 44927 - DNA, 20 bp, Artificial
  CRISPR gRNA sequence
taatggggaagggggtgagt

SEQ ID NO: 44928 - DNA, 20 bp, Artificial
  CRISPR gRNA sequence
tggggaagggggtgagtgag

SEQ ID NO: 44929 - DNA, 20 bp, Artificial
  CRISPR gRNA sequence
ggaagggggtgagtgagtgg

SEQ ID NO: 44930 - DNA, 20 bp, Artificial
  CRISPR gRNA sequence
gaagggggtgagtgagtggt

SEQ ID NO: 44931 - DNA, 20 bp, Artificial
  CRISPR gRNA sequence
aagggggtgagtgagtggtg

SEQ ID NO: 44932 - DNA, 20 bp, Artificial
  CRISPR gRNA sequence
gggtgagtgagtggtggggt

SEQ ID NO: 44933 - DNA, 20 bp, Artificial
  CRISPR gRNA sequence
tgagtggtggggttggttaa

SEQ ID NO: 44934 - DNA, 20 bp, Artificial
  CRISPR gRNA sequence
gagtggtggggttggttaat

SEQ ID NO: 44935 - DNA, 20 bp, Artificial
  CRISPR gRNA sequence
agtggtggggttggttaatg

SEQ ID NO: 44936 - DNA, 20 bp, Artificial
  CRISPR gRNA sequence
ggtggggttggttaatgggg

SEQ ID NO: 44937 - DNA, 20 bp, Artificial
  CRISPR gRNA sequence
ggttaatggggaagtgttgt

SEQ ID NO: 44938 - DNA, 20 bp, Artificial
  CRISPR gRNA sequence
aatggggaagtgttgtgagt

SEQ ID NO: 44939 - DNA, 20 bp, Artificial
  CRISPR gRNA sequence
ggggaagtgttgtgagtgag

SEQ ID NO: 44940 - DNA, 20 bp, Artificial
  CRISPR gRNA sequence
gtgttgtgagtgagtggtga

SEQ ID NO: 44941 - DNA, 20 bp, Artificial
  CRISPR gRNA sequence
tgagtggtgatggtgattaa

SEQ ID NO: 44942 - DNA, 20 bp, Artificial
  CRISPR gRNA sequence
gagtggtgatggtgattaat

SEQ ID NO: 44943 - DNA, 20 bp, Artificial
  CRISPR gRNA sequence
agtggtgatggtgattaatg

SEQ ID NO: 44944 - DNA, 20 bp, Artificial
  CRISPR gRNA sequence
ggtgatggtgattaatgggg

SEQ ID NO: 44945 - DNA, 20 bp, Artificial
  CRISPR gRNA sequence
gtgatggtgattaatgggga

SEQ ID NO: 44946 - DNA, 20 bp, Artificial
  CRISPR gRNA sequence
tgatggtgattaatggggaa

SEQ ID NO: 44947 - DNA, 20 bp, Artificial
  CRISPR gRNA sequence
gattaatggggaagggttgt

SEQ ID NO: 44948 - DNA, 20 bp, Artificial
  CRISPR gRNA sequence
aatggggaagggttgtgagt

SEQ ID NO: 44949 - DNA, 20 bp, Artificial
  CRISPR gRNA sequence
ggggaagggttgtgagtgag

SEQ ID NO: 44950 - DNA, 20 bp, Artificial
  CRISPR gRNA sequence
gggttgtgagtgagtggcgt

SEQ ID NO: 44951 - DNA, 20 bp, Artificial
  CRISPR gRNA sequence
ttgtgagtgagtggcgttgg

SEQ ID NO: 44952 - DNA, 20 bp, Artificial
  CRISPR gRNA sequence
tgagtggcgttggtggttaa

SEQ ID NO: 44953 - DNA, 20 bp, Artificial
  CRISPR gRNA sequence
gagtggcgttggtggttaat

SEQ ID NO: 44954 - DNA, 20 bp, Artificial
  CRISPR gRNA sequence
agtggcgttggtggttaatg

SEQ ID NO: 44955 - DNA, 20 bp, Artificial
  CRISPR gRNA sequence
ggcgttggtggttaatgggg

SEQ ID NO: 44956 - DNA, 20 bp, Artificial
  CRISPR gRNA sequence
gcgttggtggttaatgggga

SEQ ID NO: 44957 - DNA, 20 bp, Artificial
  CRISPR gRNA sequence
cgttggtggttaatggggaa

SEQ ID NO: 44958 - DNA, 20 bp, Artificial
  CRISPR gRNA sequence
ttggtggttaatggggaagg

SEQ ID NO: 44959 - DNA, 20 bp, Artificial
  CRISPR gRNA sequence
tggtggttaatggggaaggg

SEQ ID NO: 44960 - DNA, 20 bp, Artificial
  CRISPR gRNA sequence
ggtggttaatggggaaggga

SEQ ID NO: 44961 - DNA, 20 bp, Artificial
  CRISPR gRNA sequence
tggttaatggggaagggagg

SEQ ID NO: 44962 - DNA, 20 bp, Artificial
  CRISPR gRNA sequence
taatggggaagggagggagt

SEQ ID NO: 44963 - DNA, 20 bp, Artificial
  CRISPR gRNA sequence
agggagggagtgagtgatga

SEQ ID NO: 44964 - DNA, 20 bp, Artificial
  CRISPR gRNA sequence
gagggagtgagtgatgatgg

SEQ ID NO: 44965 - DNA, 20 bp, Artificial
  CRISPR gRNA sequence
tgagtgatgatggtggttaa

SEQ ID NO: 44966 - DNA, 20 bp, Artificial
  CRISPR gRNA sequence
gagtgatgatggtggttaat

SEQ ID NO: 44967 - DNA, 20 bp, Artificial
  CRISPR gRNA sequence
agtgatgatggtggttaatg

SEQ ID NO: 44968 - DNA, 20 bp, Artificial
  CRISPR gRNA sequence
gatgatggtggttaatgggg

SEQ ID NO: 44969 - DNA, 20 bp, Artificial
  CRISPR gRNA sequence
atgatggtggttaatgggga

SEQ ID NO: 44970 - DNA, 20 bp, Artificial
  CRISPR gRNA sequence
tgatggtggttaatggggaa

SEQ ID NO: 44971 - DNA, 20 bp, Artificial
  CRISPR gRNA sequence
ggttaatggggaagggttgt

SEQ ID NO: 44972 - DNA, 20 bp, Artificial
  CRISPR gRNA sequence
aatggggaagggttgtgagt

SEQ ID NO: 44973 - DNA, 20 bp, Artificial
  CRISPR gRNA sequence
gaagggttgtgagtgagttg

SEQ ID NO: 44974 - DNA, 20 bp, Artificial
  CRISPR gRNA sequence
aagggttgtgagtgagttgt

SEQ ID NO: 44975 - DNA, 20 bp, Artificial
  CRISPR gRNA sequence
agggttgtgagtgagttgtg

SEQ ID NO: 44976 - DNA, 20 bp, Artificial
  CRISPR gRNA sequence
ttgtgagtgagttgtggggt

SEQ ID NO: 44977 - DNA, 20 bp, Artificial
  CRISPR gRNA sequence
tgagttgtggggttggttaa

SEQ ID NO: 44978 - DNA, 20 bp, Artificial
  CRISPR gRNA sequence
gagttgtggggttggttaat

SEQ ID NO: 44979 - DNA, 20 bp, Artificial
  CRISPR gRNA sequence
agttgtggggttggttaatg

SEQ ID NO: 44980 - DNA, 20 bp, Artificial
  CRISPR gRNA sequence
tgtggggttggttaatgggg

SEQ ID NO: 44981 - DNA, 20 bp, Artificial
  CRISPR gRNA sequence
ggttaatggggaagcgttgt

SEQ ID NO: 44982 - DNA, 20 bp, Artificial
  CRISPR gRNA sequence
aatggggaagcgttgtgagt

SEQ ID NO: 44983 - DNA, 20 bp, Artificial
  CRISPR gRNA sequence
ggggaagcgttgtgagtgag

SEQ ID NO: 44984 - DNA, 20 bp, Artificial
  CRISPR gRNA sequence
gcgttgtgagtgagtggtga

SEQ ID NO: 44985 - DNA, 20 bp, Artificial
  CRISPR gRNA sequence
tgtgagtgagtggtgatggt

SEQ ID NO: 44986 - DNA, 20 bp, Artificial
  CRISPR gRNA sequence
gagtggtgatggttggttaa

SEQ ID NO: 44987 - DNA, 20 bp, Artificial
  CRISPR gRNA sequence
agtggtgatggttggttaat

SEQ ID NO: 44988 - DNA, 20 bp, Artificial
  CRISPR gRNA sequence
gtggtgatggttggttaatg

SEQ ID NO: 44989 - DNA, 20 bp, Artificial
  CRISPR gRNA sequence
gtgatggttggttaatgggg

SEQ ID NO: 44990 - DNA, 20 bp, Artificial
  CRISPR gRNA sequence
tgatggttggttaatgggga

SEQ ID NO: 44991 - DNA, 20 bp, Artificial
  CRISPR gRNA sequence
gatggttggttaatggggaa

SEQ ID NO: 44992 - DNA, 20 bp, Artificial
  CRISPR gRNA sequence
ggttaatggggaagggttgt

SEQ ID NO: 44993 - DNA, 20 bp, Artificial
  CRISPR gRNA sequence
aatggggaagggttgtgagt

SEQ ID NO: 44994 - DNA, 20 bp, Artificial
  CRISPR gRNA sequence
ggggaagggttgtgagtgag

SEQ ID NO: 44995 - DNA, 20 bp, Artificial
  CRISPR gRNA sequence
gggttgtgagtgagtggtga

SEQ ID NO: 44996 - DNA, 20 bp, Artificial
  CRISPR gRNA sequence
ttgtgagtgagtggtgatgg

SEQ ID NO: 44997 - DNA, 20 bp, Artificial
  CRISPR gRNA sequence
tgagtggtgatggtggttaa

SEQ ID NO: 44998 - DNA, 20 bp, Artificial
  CRISPR gRNA sequence
gagtggtgatggtggttaat

SEQ ID NO: 44999 - DNA, 20 bp, Artificial
  CRISPR gRNA sequence
agtggtgatggtggttaatg

SEQ ID NO: 45000 - DNA, 20 bp, Artificial
  CRISPR gRNA sequence
ggtgatggtggttaatgggg

SEQ ID NO: 45001 - DNA, 20 bp, Artificial
  CRISPR gRNA sequence
gtgatggtggttaatgggga

SEQ ID NO: 45002 - DNA, 20 bp, Artificial
  CRISPR gRNA sequence
tgatggtggttaatggggaa

SEQ ID NO: 45003 - DNA, 20 bp, Artificial
  CRISPR gRNA sequence
gatggtggttaatggggaag

SEQ ID NO: 45004 - DNA, 20 bp, Artificial
  CRISPR gRNA sequence
atggtggttaatggggaagg

SEQ ID NO: 45005 - DNA, 20 bp, Artificial
  CRISPR gRNA sequence
tggttaatggggaagggggt

SEQ ID NO: 45006 - DNA, 20 bp, Artificial
  CRISPR gRNA sequence
taatggggaagggggtgagt

SEQ ID NO: 45007 - DNA, 20 bp, Artificial
  CRISPR gRNA sequence
tggggaagggggtgagtgag

SEQ ID NO: 45008 - DNA, 20 bp, Artificial
  CRISPR gRNA sequence
agggggtgagtgagtggtgt

SEQ ID NO: 45009 - DNA, 20 bp, Artificial
  CRISPR gRNA sequence
gggtgagtgagtggtgttgg

SEQ ID NO: 45010 - DNA, 20 bp, Artificial
  CRISPR gRNA sequence
tgagtggtgttggtggttaa

SEQ ID NO: 45011 - DNA, 20 bp, Artificial
  CRISPR gRNA sequence
gagtggtgttggtggttaat

SEQ ID NO: 45012 - DNA, 20 bp, Artificial
  CRISPR gRNA sequence
agtggtgttggtggttaatg

SEQ ID NO: 45013 - DNA, 20 bp, Artificial
  CRISPR gRNA sequence
ggtgttggtggttaatgggg

SEQ ID NO: 45014 - DNA, 20 bp, Artificial
  CRISPR gRNA sequence
ggttaatggggaagtgttgt

SEQ ID NO: 45015 - DNA, 20 bp, Artificial
  CRISPR gRNA sequence
aatggggaagtgttgtgagt

SEQ ID NO: 45016 - DNA, 20 bp, Artificial
  CRISPR gRNA sequence
ggggaagtgttgtgagtgag

SEQ ID NO: 45017 - DNA, 20 bp, Artificial
  CRISPR gRNA sequence
gtgttgtgagtgagtggtga

SEQ ID NO: 45018 - DNA, 20 bp, Artificial
  CRISPR gRNA sequence
ttgtgagtgagtggtgatgg

SEQ ID NO: 45019 - DNA, 20 bp, Artificial
  CRISPR gRNA sequence
tgagtggtgatggtggttaa

SEQ ID NO: 45020 - DNA, 20 bp, Artificial
  CRISPR gRNA sequence
gagtggtgatggtggttaat

SEQ ID NO: 45021 - DNA, 20 bp, Artificial
  CRISPR gRNA sequence
agtggtgatggtggttaatg

SEQ ID NO: 45022 - DNA, 20 bp, Artificial
  CRISPR gRNA sequence
ggtgatggtggttaatgggg

SEQ ID NO: 45023 - DNA, 20 bp, Artificial
  CRISPR gRNA sequence
gtgatggtggttaatgggga

SEQ ID NO: 45024 - DNA, 20 bp, Artificial
  CRISPR gRNA sequence
tgatggtggttaatggggaa

SEQ ID NO: 45025 - DNA, 20 bp, Artificial
  CRISPR gRNA sequence
ggttaatggggaagggttgt

SEQ ID NO: 45026 - DNA, 20 bp, Artificial
  CRISPR gRNA sequence
aatggggaagggttgtgagt

SEQ ID NO: 45027 - DNA, 20 bp, Artificial
  CRISPR gRNA sequence
ggggaagggttgtgagtgag

SEQ ID NO: 45028 - DNA, 20 bp, Artificial
  CRISPR gRNA sequence
gggttgtgagtgagtggtgt

SEQ ID NO: 45029 - DNA, 20 bp, Artificial
  CRISPR gRNA sequence
ttgtgagtgagtggtgttgg

SEQ ID NO: 45030 - DNA, 20 bp, Artificial
  CRISPR gRNA sequence
tgagtggtgttggtggttaa

SEQ ID NO: 45031 - DNA, 20 bp, Artificial
  CRISPR gRNA sequence
gagtggtgttggtggttaat

SEQ ID NO: 45032 - DNA, 20 bp, Artificial
  CRISPR gRNA sequence
agtggtgttggtggttaatg

SEQ ID NO: 45033 - DNA, 20 bp, Artificial
  CRISPR gRNA sequence
ggtgttggtggttaatgggg

SEQ ID NO: 45034 - DNA, 20 bp, Artificial
  CRISPR gRNA sequence
gtgttggtggttaatgggga

SEQ ID NO: 45035 - DNA, 20 bp, Artificial
  CRISPR gRNA sequence
tgttggtggttaatggggaa

SEQ ID NO: 45036 - DNA, 20 bp, Artificial
  CRISPR gRNA sequence
gttggtggttaatggggaag

SEQ ID NO: 45037 - DNA, 20 bp, Artificial
  CRISPR gRNA sequence
ttggtggttaatggggaagg

SEQ ID NO: 45038 - DNA, 20 bp, Artificial
  CRISPR gRNA sequence
tggttaatggggaagggggt

SEQ ID NO: 45039 - DNA, 20 bp, Artificial
  CRISPR gRNA sequence
taatggggaagggggtgagt

SEQ ID NO: 45040 - DNA, 20 bp, Artificial
  CRISPR gRNA sequence
agggggtgagtgagcgatga

SEQ ID NO: 45041 - DNA, 20 bp, Artificial
  CRISPR gRNA sequence
gggtgagtgagcgatgatgg

SEQ ID NO: 45042 - DNA, 20 bp, Artificial
  CRISPR gRNA sequence
tgagcgatgatggtggttaa

SEQ ID NO: 45043 - DNA, 20 bp, Artificial
  CRISPR gRNA sequence
gagcgatgatggtggttaat

SEQ ID NO: 45044 - DNA, 20 bp, Artificial
  CRISPR gRNA sequence
agcgatgatggtggttaatg

SEQ ID NO: 45045 - DNA, 20 bp, Artificial
  CRISPR gRNA sequence
gatgatggtggttaatgggg

SEQ ID NO: 45046 - DNA, 20 bp, Artificial
  CRISPR gRNA sequence
atgatggtggttaatgggga

SEQ ID NO: 45047 - DNA, 20 bp, Artificial
  CRISPR gRNA sequence
tgatggtggttaatggggaa

SEQ ID NO: 45048 - DNA, 20 bp, Artificial
  CRISPR gRNA sequence
ggttaatggggaagggttgt

SEQ ID NO: 45049 - DNA, 20 bp, Artificial
  CRISPR gRNA sequence
aatggggaagggttgtgagt

SEQ ID NO: 45050 - DNA, 20 bp, Artificial
  CRISPR gRNA sequence
ggggaagggttgtgagtgag

SEQ ID NO: 45051 - DNA, 20 bp, Artificial
  CRISPR gRNA sequence
gaagggttgtgagtgagtgg

SEQ ID NO: 45052 - DNA, 20 bp, Artificial
  CRISPR gRNA sequence
aagggttgtgagtgagtggt

SEQ ID NO: 45053 - DNA, 20 bp, Artificial
  CRISPR gRNA sequence
agggttgtgagtgagtggtg

SEQ ID NO: 45054 - DNA, 20 bp, Artificial
  CRISPR gRNA sequence
ttgtgagtgagtggtggggt

SEQ ID NO: 45055 - DNA, 20 bp, Artificial
  CRISPR gRNA sequence
tgagtggtggggttggttaa

SEQ ID NO: 45056 - DNA, 20 bp, Artificial
  CRISPR gRNA sequence
gagtggtggggttggttaac

SEQ ID NO: 45057 - DNA, 20 bp, Artificial
  CRISPR gRNA sequence
agtggtggggttggttaacg

SEQ ID NO: 45058 - DNA, 20 bp, Artificial
  CRISPR gRNA sequence
ggtggggttggttaacgggg

SEQ ID NO: 45059 - DNA, 20 bp, Artificial
  CRISPR gRNA sequence
gtggggttggttaacgggga

SEQ ID NO: 45060 - DNA, 20 bp, Artificial
  CRISPR gRNA sequence
tggggttggttaacggggaa

SEQ ID NO: 45061 - DNA, 20 bp, Artificial
  CRISPR gRNA sequence
ggggttggttaacggggaag

SEQ ID NO: 45062 - DNA, 20 bp, Artificial
  CRISPR gRNA sequence
gggttggttaacggggaagg

SEQ ID NO: 45063 - DNA, 20 bp, Artificial
  CRISPR gRNA sequence
tggttaacggggaagggggt

SEQ ID NO: 45064 - DNA, 20 bp, Artificial
  CRISPR gRNA sequence
taacggggaagggggtgagt

SEQ ID NO: 45065 - DNA, 20 bp, Artificial
  CRISPR gRNA sequence
cggggaagggggtgagtgag

SEQ ID NO: 45066 - DNA, 20 bp, Artificial
  CRISPR gRNA sequence
ggaagggggtgagtgagtgg

SEQ ID NO: 45067 - DNA, 20 bp, Artificial
  CRISPR gRNA sequence
agggggtgagtgagtggtgg

SEQ ID NO: 45068 - DNA, 20 bp, Artificial
  CRISPR gRNA sequence
gggtgagtgagtggtggtgg

SEQ ID NO: 45069 - DNA, 20 bp, Artificial
  CRISPR gRNA sequence
tgagtggtggtggtggttaa

SEQ ID NO: 45070 - DNA, 20 bp, Artificial
  CRISPR gRNA sequence
gagtggtggtggtggttaat

SEQ ID NO: 45071 - DNA, 20 bp, Artificial
  CRISPR gRNA sequence
agtggtggtggtggttaatg

SEQ ID NO: 45072 - DNA, 20 bp, Artificial
  CRISPR gRNA sequence
ggtggtggtggttaatgggg

SEQ ID NO: 45073 - DNA, 20 bp, Artificial
  CRISPR gRNA sequence
gtggtggtggttaatgggga

SEQ ID NO: 45074 - DNA, 20 bp, Artificial
  CRISPR gRNA sequence
tggtggtggttaatggggaa

SEQ ID NO: 45075 - DNA, 20 bp, Artificial
  CRISPR gRNA sequence
ggtggtggttaatggggaag

SEQ ID NO: 45076 - DNA, 20 bp, Artificial
  CRISPR gRNA sequence
gtggtggttaatggggaagg

SEQ ID NO: 45077 - DNA, 20 bp, Artificial
  CRISPR gRNA sequence
tggttaatggggaagggggt

SEQ ID NO: 45078 - DNA, 20 bp, Artificial
  CRISPR gRNA sequence
taatggggaagggggtgagt

SEQ ID NO: 45079 - DNA, 20 bp, Artificial
  CRISPR gRNA sequence
tggggaagggggtgagtgag

SEQ ID NO: 45080 - DNA, 20 bp, Artificial
  CRISPR gRNA sequence
agggggtgagtgagtggtgt

SEQ ID NO: 45081 - DNA, 20 bp, Artificial
  CRISPR gRNA sequence
gggtgagtgagtggtgttgg

SEQ ID NO: 45082 - DNA, 20 bp, Artificial
  CRISPR gRNA sequence
tgagtggtgttggtggttaa

SEQ ID NO: 45083 - DNA, 20 bp, Artificial
  CRISPR gRNA sequence
gagtggtgttggtggttaat

SEQ ID NO: 45084 - DNA, 20 bp, Artificial
  CRISPR gRNA sequence
agtggtgttggtggttaatg

SEQ ID NO: 45085 - DNA, 20 bp, Artificial
  CRISPR gRNA sequence
ggtgttggtggttaatgggg

SEQ ID NO: 45086 - DNA, 20 bp, Artificial
  CRISPR gRNA sequence
gtgttggtggttaatgggga

SEQ ID NO: 45087 - DNA, 20 bp, Artificial
  CRISPR gRNA sequence
tgttggtggttaatggggaa

SEQ ID NO: 45088 - DNA, 20 bp, Artificial
  CRISPR gRNA sequence
gttggtggttaatggggaag

SEQ ID NO: 45089 - DNA, 20 bp, Artificial
  CRISPR gRNA sequence
ttggtggttaatggggaagg

SEQ ID NO: 45090 - DNA, 20 bp, Artificial
  CRISPR gRNA sequence
gtggttaatggggaaggggg

SEQ ID NO: 45091 - DNA, 20 bp, Artificial
  CRISPR gRNA sequence
tggttaatggggaagggggt

SEQ ID NO: 45092 - DNA, 20 bp, Artificial
  CRISPR gRNA sequence
taatggggaagggggtgggt

SEQ ID NO: 45093 - DNA, 20 bp, Artificial
  CRISPR gRNA sequence
tggggaagggggtgggtgag

SEQ ID NO: 45094 - DNA, 20 bp, Artificial
  CRISPR gRNA sequence
agggggtgggtgagtggtga

SEQ ID NO: 45095 - DNA, 20 bp, Artificial
  CRISPR gRNA sequence
gggtgggtgagtggtgatgg

SEQ ID NO: 45096 - DNA, 20 bp, Artificial
  CRISPR gRNA sequence
tgagtggtgatggtggttaa

SEQ ID NO: 45097 - DNA, 20 bp, Artificial
  CRISPR gRNA sequence
gagtggtgatggtggttaat

SEQ ID NO: 45098 - DNA, 20 bp, Artificial
  CRISPR gRNA sequence
tggtgatggtggttaatggg

SEQ ID NO: 45099 - DNA, 20 bp, Artificial
  CRISPR gRNA sequence
ggtgatggtggttaatggga

SEQ ID NO: 45100 - DNA, 20 bp, Artificial
  CRISPR gRNA sequence
gtgatggtggttaatgggaa

SEQ ID NO: 45101 - DNA, 20 bp, Artificial
  CRISPR gRNA sequence
gatggtggttaatgggaagg

SEQ ID NO: 45102 - DNA, 20 bp, Artificial
  CRISPR gRNA sequence
gtggttaatgggaagggagt

SEQ ID NO: 45103 - DNA, 20 bp, Artificial
  CRISPR gRNA sequence
gttaatgggaagggagtgag

SEQ ID NO: 45104 - DNA, 20 bp, Artificial
  CRISPR gRNA sequence
gggaagggagtgagtggtga

SEQ ID NO: 45105 - DNA, 20 bp, Artificial
  CRISPR gRNA sequence
aagggagtgagtggtgatgg

SEQ ID NO: 45106 - DNA, 20 bp, Artificial
  CRISPR gRNA sequence
tgagtggtgatggtggttaa

SEQ ID NO: 45107 - DNA, 20 bp, Artificial
  CRISPR gRNA sequence
gagtggtgatggtggttaat

SEQ ID NO: 45108 - DNA, 20 bp, Artificial
  CRISPR gRNA sequence
agtggtgatggtggttaatg

SEQ ID NO: 45109 - DNA, 20 bp, Artificial
  CRISPR gRNA sequence
ggtgatggtggttaatgggg

SEQ ID NO: 45110 - DNA, 20 bp, Artificial
  CRISPR gRNA sequence
gtgatggtggttaatgggga

SEQ ID NO: 45111 - DNA, 20 bp, Artificial
  CRISPR gRNA sequence
tgatggtggttaatggggaa

SEQ ID NO: 45112 - DNA, 20 bp, Artificial
  CRISPR gRNA sequence
ggttaatggggaagggttgt

SEQ ID NO: 45113 - DNA, 20 bp, Artificial
  CRISPR gRNA sequence
aatggggaagggttgtgagt

SEQ ID NO: 45114 - DNA, 20 bp, Artificial
  CRISPR gRNA sequence
ggggaagggttgtgagtgag

SEQ ID NO: 45115 - DNA, 20 bp, Artificial
  CRISPR gRNA sequence
gggttgtgagtgagtggtga

SEQ ID NO: 45116 - DNA, 20 bp, Artificial
  CRISPR gRNA sequence
ttgtgagtgagtggtgatgg

SEQ ID NO: 45117 - DNA, 20 bp, Artificial
  CRISPR gRNA sequence
tgagtggtgatggtggttaa

SEQ ID NO: 45118 - DNA, 20 bp, Artificial
  CRISPR gRNA sequence
gagtggtgatggtggttaat

SEQ ID NO: 45119 - DNA, 20 bp, Artificial
  CRISPR gRNA sequence
agtggtgatggtggttaatg

SEQ ID NO: 45120 - DNA, 20 bp, Artificial
  CRISPR gRNA sequence
ggtgatggtggttaatgggg

SEQ ID NO: 45121 - DNA, 20 bp, Artificial
  CRISPR gRNA sequence
gtgatggtggttaatgggga

SEQ ID NO: 45122 - DNA, 20 bp, Artificial
  CRISPR gRNA sequence
tgatggtggttaatggggaa

SEQ ID NO: 45123 - DNA, 20 bp, Artificial
  CRISPR gRNA sequence
gatggtggttaatggggaag

SEQ ID NO: 45124 - DNA, 20 bp, Artificial
  CRISPR gRNA sequence
atggtggttaatggggaagg

SEQ ID NO: 45125 - DNA, 20 bp, Artificial
  CRISPR gRNA sequence
tggttaatggggaagggggt

SEQ ID NO: 45126 - DNA, 20 bp, Artificial
  CRISPR gRNA sequence
taatggggaagggggtgagt

SEQ ID NO: 45127 - DNA, 20 bp, Artificial
  CRISPR gRNA sequence
aatggggaagggggtgagta

SEQ ID NO: 45128 - DNA, 20 bp, Artificial
  CRISPR gRNA sequence
atggggaagggggtgagtaa

SEQ ID NO: 45129 - DNA, 20 bp, Artificial
  CRISPR gRNA sequence
tggggaagggggtgagtaag

SEQ ID NO: 45130 - DNA, 20 bp, Artificial
  CRISPR gRNA sequence
ggaagggggtgagtaagggg

SEQ ID NO: 45131 - DNA, 20 bp, Artificial
  CRISPR gRNA sequence
gaagggggtgagtaaggggt

SEQ ID NO: 45132 - DNA, 20 bp, Artificial
  CRISPR gRNA sequence
aagggggtgagtaaggggtg

SEQ ID NO: 45133 - DNA, 20 bp, Artificial
  CRISPR gRNA sequence
agggggtgagtaaggggtgg

SEQ ID NO: 45134 - DNA, 20 bp, Artificial
  CRISPR gRNA sequence
gggtgagtaaggggtggggg

SEQ ID NO: 45135 - DNA, 20 bp, Artificial
  CRISPR gRNA sequence
taaggggtgggggtggttaa

SEQ ID NO: 45136 - DNA, 20 bp, Artificial
  CRISPR gRNA sequence
aaggggtgggggtggttaat

SEQ ID NO: 45137 - DNA, 20 bp, Artificial
  CRISPR gRNA sequence
aggggtgggggtggttaata

SEQ ID NO: 45138 - DNA, 20 bp, Artificial
  CRISPR gRNA sequence
ggtgggggtggttaataggg

SEQ ID NO: 45139 - DNA, 20 bp, Artificial
  CRISPR gRNA sequence
tgggggtggttaatagggaa

SEQ ID NO: 45140 - DNA, 20 bp, Artificial
  CRISPR gRNA sequence
ggttaatagggaagagttgt

SEQ ID NO: 45141 - DNA, 20 bp, Artificial
  CRISPR gRNA sequence
aatagggaagagttgtgagt

SEQ ID NO: 45142 - DNA, 20 bp, Artificial
  CRISPR gRNA sequence
agggaagagttgtgagtgag

SEQ ID NO: 45143 - DNA, 20 bp, Artificial
  CRISPR gRNA sequence
gaagagttgtgagtgagtgg

SEQ ID NO: 45144 - DNA, 20 bp, Artificial
  CRISPR gRNA sequence
aagagttgtgagtgagtggt

SEQ ID NO: 45145 - DNA, 20 bp, Artificial
  CRISPR gRNA sequence
agagttgtgagtgagtggtg

SEQ ID NO: 45146 - DNA, 20 bp, Artificial
  CRISPR gRNA sequence
ttgtgagtgagtggtggggt

SEQ ID NO: 45147 - DNA, 20 bp, Artificial
  CRISPR gRNA sequence
tgagtggtggggttggttaa

SEQ ID NO: 45148 - DNA, 20 bp, Artificial
  CRISPR gRNA sequence
gagtggtggggttggttaat

SEQ ID NO: 45149 - DNA, 20 bp, Artificial
  CRISPR gRNA sequence
agtggtggggttggttaatg

SEQ ID NO: 45150 - DNA, 20 bp, Artificial
  CRISPR gRNA sequence
ggtggggttggttaatgggg

SEQ ID NO: 45151 - DNA, 20 bp, Artificial
  CRISPR gRNA sequence
gtggggttggttaatgggga

SEQ ID NO: 45152 - DNA, 20 bp, Artificial
  CRISPR gRNA sequence
tggggttggttaatggggaa

SEQ ID NO: 45153 - DNA, 20 bp, Artificial
  CRISPR gRNA sequence
ggggttggttaatggggaag

SEQ ID NO: 45154 - DNA, 20 bp, Artificial
  CRISPR gRNA sequence
gggttggttaatggggaagg

SEQ ID NO: 45155 - DNA, 20 bp, Artificial
  CRISPR gRNA sequence
tggttaatggggaagggggt

SEQ ID NO: 45156 - DNA, 20 bp, Artificial
  CRISPR gRNA sequence
taatggggaagggggtgagt

SEQ ID NO: 45157 - DNA, 20 bp, Artificial
  CRISPR gRNA sequence
aatggggaagggggtgagtg

SEQ ID NO: 45158 - DNA, 20 bp, Artificial
  CRISPR gRNA sequence
atggggaagggggtgagtga

SEQ ID NO: 45159 - DNA, 20 bp, Artificial
  CRISPR gRNA sequence
agggggtgagtgagggatga

SEQ ID NO: 45160 - DNA, 20 bp, Artificial
  CRISPR gRNA sequence
gggtgagtgagggatgacag

SEQ ID NO: 45161 - DNA, 20 bp, Artificial
  CRISPR gRNA sequence
tgagggatgacagtggttaa

SEQ ID NO: 45162 - DNA, 20 bp, Artificial
  CRISPR gRNA sequence
gagggatgacagtggttaat

SEQ ID NO: 45163 - DNA, 20 bp, Artificial
  CRISPR gRNA sequence
agggatgacagtggttaatg

SEQ ID NO: 45164 - DNA, 20 bp, Artificial
  CRISPR gRNA sequence
atgacagtggttaatgggga

SEQ ID NO: 45165 - DNA, 20 bp, Artificial
  CRISPR gRNA sequence
tgacagtggttaatggggaa

SEQ ID NO: 45166 - DNA, 20 bp, Artificial
  CRISPR gRNA sequence
acagtggttaatggggaaag

SEQ ID NO: 45167 - DNA, 20 bp, Artificial
  CRISPR gRNA sequence
tggttaatggggaaaggagt

SEQ ID NO: 45168 - DNA, 20 bp, Artificial
  CRISPR gRNA sequence
taatggggaaaggagtgagt

SEQ ID NO: 45169 - DNA, 20 bp, Artificial
  CRISPR gRNA sequence
aatggggaaaggagtgagtg

SEQ ID NO: 45170 - DNA, 20 bp, Artificial
  CRISPR gRNA sequence
atggggaaaggagtgagtga

SEQ ID NO: 45171 - DNA, 20 bp, Artificial
  CRISPR gRNA sequence
tggggaaaggagtgagtgag

SEQ ID NO: 45172 - DNA, 20 bp, Artificial
  CRISPR gRNA sequence
aaggagtgagtgaggggtga

SEQ ID NO: 45173 - DNA, 20 bp, Artificial
  CRISPR gRNA sequence
gagtgaggggtgatggtgct

SEQ ID NO: 45174 - DNA, 20 bp, Artificial
  CRISPR gRNA sequence
tgatggtgcttagtgctgca

SEQ ID NO: 45175 - DNA, 20 bp, Artificial
  CRISPR gRNA sequence
ggtgcttagtgctgcatggt

SEQ ID NO: 45176 - DNA, 20 bp, Artificial
  CRISPR gRNA sequence
cttagtgctgcatggtcagt

SEQ ID NO: 45177 - DNA, 20 bp, Artificial
  CRISPR gRNA sequence
agtgctgcatggtcagtgag

SEQ ID NO: 45178 - DNA, 20 bp, Artificial
  CRISPR gRNA sequence
tggtcagtgagtagcatgcc

SEQ ID NO: 45179 - DNA, 20 bp, Artificial
  CRISPR gRNA sequence
ggtcagtgagtagcatgcct

SEQ ID NO: 45180 - DNA, 20 bp, Artificial
  CRISPR gRNA sequence
aacacaaaccgccatgtttc

SEQ ID NO: 45181 - DNA, 20 bp, Artificial
  CRISPR gRNA sequence
caaaccgccatgtttctgga

SEQ ID NO: 45182 - DNA, 20 bp, Artificial
  CRISPR gRNA sequence
gccatgtttctggatggacc

SEQ ID NO: 45183 - DNA, 20 bp, Artificial
  CRISPR gRNA sequence
ccatgtttctggatggaccc

SEQ ID NO: 45184 - DNA, 20 bp, Artificial
  CRISPR gRNA sequence
gtttctggatggacccaggt

SEQ ID NO: 45185 - DNA, 20 bp, Artificial
  CRISPR gRNA sequence
tgaccttttactttctattc

SEQ ID NO: 45186 - DNA, 20 bp, Artificial
  CRISPR gRNA sequence
ttactttctattctggatct

SEQ ID NO: 45187 - DNA, 20 bp, Artificial
  CRISPR gRNA sequence
tctattctggatctcagtgc

SEQ ID NO: 45188 - DNA, 20 bp, Artificial
  CRISPR gRNA sequence
ttctggatctcagtgccagc

SEQ ID NO: 45189 - DNA, 20 bp, Artificial
  CRISPR gRNA sequence
ctcagtgccagcaagaacct

SEQ ID NO: 45190 - DNA, 20 bp, Artificial
  CRISPR gRNA sequence
gccagcaagaaccttggtca

SEQ ID NO: 45191 - DNA, 20 bp, Artificial
  CRISPR gRNA sequence
ccagcaagaaccttggtcat

SEQ ID NO: 45192 - DNA, 20 bp, Artificial
  CRISPR gRNA sequence
agaaccttggtcataggaaa

SEQ ID NO: 45193 - DNA, 20 bp, Artificial
  CRISPR gRNA sequence
gaaacagaatacacaactca

SEQ ID NO: 45194 - DNA, 20 bp, Artificial
  CRISPR gRNA sequence
tacacaactcaaagcaatcc

SEQ ID NO: 45195 - DNA, 20 bp, Artificial
  CRISPR gRNA sequence
caactcaaagcaatccaaga

SEQ ID NO: 45196 - DNA, 20 bp, Artificial
  CRISPR gRNA sequence
aatccaagacagaaatatat

SEQ ID NO: 45197 - DNA, 20 bp, Artificial
  CRISPR gRNA sequence
aaatatattggcttatgtca

SEQ ID NO: 45198 - DNA, 20 bp, Artificial
  CRISPR gRNA sequence
cttatgtcatggaaaattac

SEQ ID NO: 45199 - DNA, 20 bp, Artificial
  CRISPR gRNA sequence
ttatgtcatggaaaattacg

SEQ ID NO: 45200 - DNA, 20 bp, Artificial
  CRISPR gRNA sequence
aattacgaggccaatgactt

SEQ ID NO: 45201 - DNA, 20 bp, Artificial
  CRISPR gRNA sequence
attacgaggccaatgacttc

SEQ ID NO: 45202 - DNA, 20 bp, Artificial
  CRISPR gRNA sequence
gaggccaatgacttcaggca

SEQ ID NO: 45203 - DNA, 20 bp, Artificial
  CRISPR gRNA sequence
ccaatgacttcaggcacagc

SEQ ID NO: 45204 - DNA, 20 bp, Artificial
  CRISPR gRNA sequence
acttcaggcacagctggatc

SEQ ID NO: 45205 - DNA, 20 bp, Artificial
  CRISPR gRNA sequence
cttcaggcacagctggatcc

SEQ ID NO: 45206 - DNA, 20 bp, Artificial
  CRISPR gRNA sequence
ttcaggcacagctggatcca

SEQ ID NO: 45207 - DNA, 20 bp, Artificial
  CRISPR gRNA sequence
tcaggcacagctggatccag

SEQ ID NO: 45208 - DNA, 20 bp, Artificial
  CRISPR gRNA sequence
tccaggggttctatatttgt

SEQ ID NO: 45209 - DNA, 20 bp, Artificial
  CRISPR gRNA sequence
ccaggggttctatatttgtc

SEQ ID NO: 45210 - DNA, 20 bp, Artificial
  CRISPR gRNA sequence
ctctctcacacacttcactc

SEQ ID NO: 45211 - DNA, 20 bp, Artificial
  CRISPR gRNA sequence
tactctttctctgtccacct

SEQ ID NO: 45212 - DNA, 20 bp, Artificial
  CRISPR gRNA sequence
gtccaccttggcttccttct

SEQ ID NO: 45213 - DNA, 20 bp, Artificial
  CRISPR gRNA sequence
tccaccttggcttccttctc

SEQ ID NO: 45214 - DNA, 20 bp, Artificial
  CRISPR gRNA sequence
accttggcttccttctcagg

SEQ ID NO: 45215 - DNA, 20 bp, Artificial
  CRISPR gRNA sequence
ccttggcttccttctcaggc

SEQ ID NO: 45216 - DNA, 20 bp, Artificial
  CRISPR gRNA sequence
gcaggccatccctgcacctg

SEQ ID NO: 45217 - DNA, 20 bp, Artificial
  CRISPR gRNA sequence
caggccatccctgcacctgc

SEQ ID NO: 45218 - DNA, 20 bp, Artificial
  CRISPR gRNA sequence
cctgcaggcttactttctct

SEQ ID NO: 45219 - DNA, 20 bp, Artificial
  CRISPR gRNA sequence
aggcttactttctctcagct

SEQ ID NO: 45220 - DNA, 20 bp, Artificial
  CRISPR gRNA sequence
cttactttctctcagcttag

SEQ ID NO: 45221 - DNA, 20 bp, Artificial
  CRISPR gRNA sequence
ctttctctcagcttagtgga

SEQ ID NO: 45222 - DNA, 20 bp, Artificial
  CRISPR gRNA sequence
tttctctcagcttagtggaa

SEQ ID NO: 45223 - DNA, 20 bp, Artificial
  CRISPR gRNA sequence
ttctctcagcttagtggaaa

SEQ ID NO: 45224 - DNA, 20 bp, Artificial
  CRISPR gRNA sequence
ctctcagcttagtggaaagg

SEQ ID NO: 45225 - DNA, 20 bp, Artificial
  CRISPR gRNA sequence
agggagtaccattctctctg

SEQ ID NO: 45226 - DNA, 20 bp, Artificial
  CRISPR gRNA sequence
tctctctgtggttacaacaa

SEQ ID NO: 45227 - DNA, 20 bp, Artificial
  CRISPR gRNA sequence
ctctctgtggttacaacaaa

SEQ ID NO: 45228 - DNA, 20 bp, Artificial
  CRISPR gRNA sequence
gtggttacaacaaaaggtcc

SEQ ID NO: 45229 - DNA, 20 bp, Artificial
  CRISPR gRNA sequence
acaacaaaaggtcctagact

SEQ ID NO: 45230 - DNA, 20 bp, Artificial
  CRISPR gRNA sequence
ggtcctagactgagtctcac

SEQ ID NO: 45231 - DNA, 20 bp, Artificial
  CRISPR gRNA sequence
tagactgagtctcactggac

SEQ ID NO: 45232 - DNA, 20 bp, Artificial
  CRISPR gRNA sequence
gagtctcactggactagctt

SEQ ID NO: 45233 - DNA, 20 bp, Artificial
  CRISPR gRNA sequence
gagtcacctgccccacccta

SEQ ID NO: 45234 - DNA, 20 bp, Artificial
  CRISPR gRNA sequence
ccaccctaaagcaatcactg

SEQ ID NO: 45235 - DNA, 20 bp, Artificial
  CRISPR gRNA sequence
aaagcaatcactgtggctgt

SEQ ID NO: 45236 - DNA, 20 bp, Artificial
  CRISPR gRNA sequence
gcacaaaatattctcctcac

SEQ ID NO: 45237 - DNA, 20 bp, Artificial
  CRISPR gRNA sequence
aaaatattctcctcactggc

SEQ ID NO: 45238 - DNA, 20 bp, Artificial
  CRISPR gRNA sequence
ttctcctcactggccagacc

SEQ ID NO: 45239 - DNA, 20 bp, Artificial
  CRISPR gRNA sequence
tctcctcactggccagacct

SEQ ID NO: 45240 - DNA, 20 bp, Artificial
  CRISPR gRNA sequence
cgcatgcacaccctatcttc

SEQ ID NO: 45241 - DNA, 20 bp, Artificial
  CRISPR gRNA sequence
cacaccctatcttctggact

SEQ ID NO: 45242 - DNA, 20 bp, Artificial
  CRISPR gRNA sequence
caccctatcttctggactta

SEQ ID NO: 45243 - DNA, 20 bp, Artificial
  CRISPR gRNA sequence
accctatcttctggacttag

SEQ ID NO: 45244 - DNA, 20 bp, Artificial
  CRISPR gRNA sequence
ccctatcttctggacttaga

SEQ ID NO: 45245 - DNA, 20 bp, Artificial
  CRISPR gRNA sequence
cctatcttctggacttagag

SEQ ID NO: 45246 - DNA, 20 bp, Artificial
  CRISPR gRNA sequence
atcttctggacttagagggg

SEQ ID NO: 45247 - DNA, 20 bp, Artificial
  CRISPR gRNA sequence
gacttagaggggtggtattt

SEQ ID NO: 45248 - DNA, 20 bp, Artificial
  CRISPR gRNA sequence
acttagaggggtggtatttc

SEQ ID NO: 45249 - DNA, 20 bp, Artificial
  CRISPR gRNA sequence
ggggtggtatttcaggatgt

SEQ ID NO: 45250 - DNA, 20 bp, Artificial
  CRISPR gRNA sequence
gtatttcaggatgtgagtaa

SEQ ID NO: 45251 - DNA, 20 bp, Artificial
  CRISPR gRNA sequence
tttcaggatgtgagtaacag

SEQ ID NO: 45252 - DNA, 20 bp, Artificial
  CRISPR gRNA sequence
tcaggatgtgagtaacagaa

SEQ ID NO: 45253 - DNA, 20 bp, Artificial
  CRISPR gRNA sequence
caggatgtgagtaacagaag

SEQ ID NO: 45254 - DNA, 20 bp, Artificial
  CRISPR gRNA sequence
atgtgagtaacagaagagga

SEQ ID NO: 45255 - DNA, 20 bp, Artificial
  CRISPR gRNA sequence
acagaagaggaaagaaactc

SEQ ID NO: 45256 - DNA, 20 bp, Artificial
  CRISPR gRNA sequence
cagaagaggaaagaaactct

SEQ ID NO: 45257 - DNA, 20 bp, Artificial
  CRISPR gRNA sequence
aagaggaaagaaactctggg

SEQ ID NO: 45258 - DNA, 20 bp, Artificial
  CRISPR gRNA sequence
tctgggcagaaaaaaatcta

SEQ ID NO: 45259 - DNA, 20 bp, Artificial
  CRISPR gRNA sequence
atgtccactacatttgtcta

SEQ ID NO: 45260 - DNA, 20 bp, Artificial
  CRISPR gRNA sequence
tttgtctacagttgtttcct

SEQ ID NO: 45261 - DNA, 20 bp, Artificial
  CRISPR gRNA sequence
acagttgtttccttggtaac

SEQ ID NO: 45262 - DNA, 20 bp, Artificial
  CRISPR gRNA sequence
gttgtttccttggtaactgg

SEQ ID NO: 45263 - DNA, 20 bp, Artificial
  CRISPR gRNA sequence
ctactctcccccataatttg

SEQ ID NO: 45264 - DNA, 20 bp, Artificial
  CRISPR gRNA sequence
atttgaagtcatcaaattct

SEQ ID NO: 45265 - DNA, 20 bp, Artificial
  CRISPR gRNA sequence
catcaaattcttagaaatgc

SEQ ID NO: 45266 - DNA, 20 bp, Artificial
  CRISPR gRNA sequence
attcttagaaatgccagaaa

SEQ ID NO: 45267 - DNA, 20 bp, Artificial
  CRISPR gRNA sequence
agaaatgccagaaacagcct

SEQ ID NO: 45268 - DNA, 20 bp, Artificial
  CRISPR gRNA sequence
cagaaacagcctcagtctaa

SEQ ID NO: 45269 - DNA, 20 bp, Artificial
  CRISPR gRNA sequence
aacagcctcagtctaaaaga

SEQ ID NO: 45270 - DNA, 20 bp, Artificial
  CRISPR gRNA sequence
acagcctcagtctaaaagac

SEQ ID NO: 45271 - DNA, 20 bp, Artificial
  CRISPR gRNA sequence
agacaggtccccgtcctgca

SEQ ID NO: 45272 - DNA, 20 bp, Artificial
  CRISPR gRNA sequence
gtcctgcacagattcctgtt

SEQ ID NO: 45273 - DNA, 20 bp, Artificial
  CRISPR gRNA sequence
tgcacagattcctgtttaga

SEQ ID NO: 45274 - DNA, 20 bp, Artificial
  CRISPR gRNA sequence
attcctgtttagacagtatc

SEQ ID NO: 45275 - DNA, 20 bp, Artificial
  CRISPR gRNA sequence
ctgtttagacagtatctgga

SEQ ID NO: 45276 - DNA, 20 bp, Artificial
  CRISPR gRNA sequence
tatctggacagaaaatttaa

SEQ ID NO: 45277 - DNA, 20 bp, Artificial
  CRISPR gRNA sequence
actttttctgatgaccaaaa

SEQ ID NO: 45278 - DNA, 20 bp, Artificial
  CRISPR gRNA sequence
ccaaaaaagttccatctttc

SEQ ID NO: 45279 - DNA, 20 bp, Artificial
  CRISPR gRNA sequence
acaaataacatgaaatgccc

SEQ ID NO: 45280 - DNA, 20 bp, Artificial
  CRISPR gRNA sequence
caaataacatgaaatgcccc

SEQ ID NO: 45281 - DNA, 20 bp, Artificial
  CRISPR gRNA sequence
aaataacatgaaatgccccg

SEQ ID NO: 45282 - DNA, 20 bp, Artificial
  CRISPR gRNA sequence
ccccggggatgacaccccct

SEQ ID NO: 45283 - DNA, 20 bp, Artificial
  CRISPR gRNA sequence
ctgagaaaacttctgttgaa

SEQ ID NO: 45284 - DNA, 20 bp, Artificial
  CRISPR gRNA sequence
acggtttgtgaatttttctc

SEQ ID NO: 45285 - DNA, 20 bp, Artificial
  CRISPR gRNA sequence
ttctacatatgttttgaatt

SEQ ID NO: 45286 - DNA, 20 bp, Artificial
  CRISPR gRNA sequence
atgttttgaattcagcttga

SEQ ID NO: 45287 - DNA, 20 bp, Artificial
  CRISPR gRNA sequence
ttttgaattcagcttgaaag

SEQ ID NO: 45288 - DNA, 20 bp, Artificial
  CRISPR gRNA sequence
ttgtccctctttgcttgtcc

SEQ ID NO: 45289 - DNA, 20 bp, Artificial
  CRISPR gRNA sequence
tgtccctctttgcttgtcct

SEQ ID NO: 45290 - DNA, 20 bp, Artificial
  CRISPR gRNA sequence
gtccctctttgcttgtcctg

SEQ ID NO: 45291 - DNA, 20 bp, Artificial
  CRISPR gRNA sequence
ccctctttgcttgtcctggg

SEQ ID NO: 45292 - DNA, 20 bp, Artificial
  CRISPR gRNA sequence
ctctttgcttgtcctgggga

SEQ ID NO: 45293 - DNA, 20 bp, Artificial
  CRISPR gRNA sequence
tctttgcttgtcctggggag

SEQ ID NO: 45294 - DNA, 20 bp, Artificial
  CRISPR gRNA sequence
gcttgtcctggggagaggat

SEQ ID NO: 45295 - DNA, 20 bp, Artificial
  CRISPR gRNA sequence
cttgtcctggggagaggatc

SEQ ID NO: 45296 - DNA, 20 bp, Artificial
  CRISPR gRNA sequence
ctggggagaggatcaggtaa

SEQ ID NO: 45297 - DNA, 20 bp, Artificial
  CRISPR gRNA sequence
tggggagaggatcaggtaaa

SEQ ID NO: 45298 - DNA, 20 bp, Artificial
  CRISPR gRNA sequence
gggagaggatcaggtaaaag

SEQ ID NO: 45299 - DNA, 20 bp, Artificial
  CRISPR gRNA sequence
agaggatcaggtaaaaggag

SEQ ID NO: 45300 - DNA, 20 bp, Artificial
  CRISPR gRNA sequence
aggatcaggtaaaaggagaa

SEQ ID NO: 45301 - DNA, 20 bp, Artificial
  CRISPR gRNA sequence
ggatcaggtaaaaggagaag

SEQ ID NO: 45302 - DNA, 20 bp, Artificial
  CRISPR gRNA sequence
gatcaggtaaaaggagaaga

SEQ ID NO: 45303 - DNA, 20 bp, Artificial
  CRISPR gRNA sequence
taaaaggagaagagggatta

SEQ ID NO: 45304 - DNA, 20 bp, Artificial
  CRISPR gRNA sequence
aaaggagaagagggattaca

SEQ ID NO: 45305 - DNA, 20 bp, Artificial
  CRISPR gRNA sequence
attacagagacctttgacca

SEQ ID NO: 45306 - DNA, 20 bp, Artificial
  CRISPR gRNA sequence
ttacagagacctttgaccac

SEQ ID NO: 45307 - DNA, 20 bp, Artificial
  CRISPR gRNA sequence
tacagagacctttgaccaca

SEQ ID NO: 45308 - DNA, 20 bp, Artificial
  CRISPR gRNA sequence
gggccctcctgtcgtctcac

SEQ ID NO: 45309 - DNA, 20 bp, Artificial
  CRISPR gRNA sequence
ctgtccatgtacctgcatct

SEQ ID NO: 45310 - DNA, 20 bp, Artificial
  CRISPR gRNA sequence
catgtacctgcatctcggct

SEQ ID NO: 45311 - DNA, 20 bp, Artificial
  CRISPR gRNA sequence
tgcatctcggctcagccttc

SEQ ID NO: 45312 - DNA, 20 bp, Artificial
  CRISPR gRNA sequence
atctcggctcagccttctgg

SEQ ID NO: 45313 - DNA, 20 bp, Artificial
  CRISPR gRNA sequence
gccttctggaagcttttatt

SEQ ID NO: 45314 - DNA, 20 bp, Artificial
  CRISPR gRNA sequence
ccttctggaagcttttattt

SEQ ID NO: 45315 - DNA, 20 bp, Artificial
  CRISPR gRNA sequence
cttctggaagcttttattta

SEQ ID NO: 45316 - DNA, 20 bp, Artificial
  CRISPR gRNA sequence
ttctggaagcttttatttag

SEQ ID NO: 45317 - DNA, 20 bp, Artificial
  CRISPR gRNA sequence
gaagcttttatttaggggat

SEQ ID NO: 45318 - DNA, 20 bp, Artificial
  CRISPR gRNA sequence
agcttttatttaggggattg

SEQ ID NO: 45319 - DNA, 20 bp, Artificial
  CRISPR gRNA sequence
gcttttatttaggggattgg

SEQ ID NO: 45320 - DNA, 20 bp, Artificial
  CRISPR gRNA sequence
tatttaggggattggaggcc

SEQ ID NO: 45321 - DNA, 20 bp, Artificial
  CRISPR gRNA sequence
taggggattggaggcccagt

SEQ ID NO: 45322 - DNA, 20 bp, Artificial
  CRISPR gRNA sequence
aggggattggaggcccagtg

SEQ ID NO: 45323 - DNA, 20 bp, Artificial
  CRISPR gRNA sequence
ggcccagtgaggtcattcat

SEQ ID NO: 45324 - DNA, 20 bp, Artificial
  CRISPR gRNA sequence
gcattcgacaaatatgtact

SEQ ID NO: 45325 - DNA, 20 bp, Artificial
  CRISPR gRNA sequence
tcgacaaatatgtactgagc

SEQ ID NO: 45326 - DNA, 20 bp, Artificial
  CRISPR gRNA sequence
cgacaaatatgtactgagct

SEQ ID NO: 45327 - DNA, 20 bp, Artificial
  CRISPR gRNA sequence
tatgtactgagctgggcacc

SEQ ID NO: 45328 - DNA, 20 bp, Artificial
  CRISPR gRNA sequence
atgtactgagctgggcacct

SEQ ID NO: 45329 - DNA, 20 bp, Artificial
  CRISPR gRNA sequence
actgagctgggcacctgggc

SEQ ID NO: 45330 - DNA, 20 bp, Artificial
  CRISPR gRNA sequence
ctgagctgggcacctgggcc

SEQ ID NO: 45331 - DNA, 20 bp, Artificial
  CRISPR gRNA sequence
tgagctgggcacctgggccg

SEQ ID NO: 45332 - DNA, 20 bp, Artificial
  CRISPR gRNA sequence
ctgggcacctgggccgggga

SEQ ID NO: 45333 - DNA, 20 bp, Artificial
  CRISPR gRNA sequence
tgggcacctgggccggggac

SEQ ID NO: 45334 - DNA, 20 bp, Artificial
  CRISPR gRNA sequence
cacctgggccggggacagga

SEQ ID NO: 45335 - DNA, 20 bp, Artificial
  CRISPR gRNA sequence
gacagattcatccatgcccc

SEQ ID NO: 45336 - DNA, 20 bp, Artificial
  CRISPR gRNA sequence
acagattcatccatgcccct

SEQ ID NO: 45337 - DNA, 20 bp, Artificial
  CRISPR gRNA sequence
cagattcatccatgcccctg

SEQ ID NO: 45338 - DNA, 20 bp, Artificial
  CRISPR gRNA sequence
agattcatccatgcccctgg

SEQ ID NO: 45339 - DNA, 20 bp, Artificial
  CRISPR gRNA sequence
ttttcttcctcctgatttcc

SEQ ID NO: 45340 - DNA, 20 bp, Artificial
  CRISPR gRNA sequence
tttcttcctcctgatttccc

SEQ ID NO: 45341 - DNA, 20 bp, Artificial
  CRISPR gRNA sequence
ctccttacctcctgctgcct

SEQ ID NO: 45342 - DNA, 20 bp, Artificial
  CRISPR gRNA sequence
tagttgccctatctgtaaac

SEQ ID NO: 45343 - DNA, 20 bp, Artificial
  CRISPR gRNA sequence
agttgccctatctgtaaact

SEQ ID NO: 45344 - DNA, 20 bp, Artificial
  CRISPR gRNA sequence
cataatatcttccctgtccg

SEQ ID NO: 45345 - DNA, 20 bp, Artificial
  CRISPR gRNA sequence
ataatatcttccctgtccga

SEQ ID NO: 45346 - DNA, 20 bp, Artificial
  CRISPR gRNA sequence
atatcttccctgtccgaagg

SEQ ID NO: 45347 - DNA, 20 bp, Artificial
  CRISPR gRNA sequence
tatcttccctgtccgaagga

SEQ ID NO: 45348 - DNA, 20 bp, Artificial
  CRISPR gRNA sequence
atcttccctgtccgaaggaa

SEQ ID NO: 45349 - DNA, 20 bp, Artificial
  CRISPR gRNA sequence
tcttccctgtccgaaggaag

SEQ ID NO: 45350 - DNA, 20 bp, Artificial
  CRISPR gRNA sequence
ccctgtccgaaggaagggga

SEQ ID NO: 45351 - DNA, 20 bp, Artificial
  CRISPR gRNA sequence
gaaggaaggggatggatcgt

SEQ ID NO: 45352 - DNA, 20 bp, Artificial
  CRISPR gRNA sequence
ggggatggatcgtcagtgcc

SEQ ID NO: 45353 - DNA, 20 bp, Artificial
  CRISPR gRNA sequence
ggatggatcgtcagtgcccg

SEQ ID NO: 45354 - DNA, 20 bp, Artificial
  CRISPR gRNA sequence
gatggatcgtcagtgcccgg

SEQ ID NO: 45355 - DNA, 20 bp, Artificial
  CRISPR gRNA sequence
ccggaggtctcttcccatct

SEQ ID NO: 45356 - DNA, 20 bp, Artificial
  CRISPR gRNA sequence
atctcagatctgtcatttcc

SEQ ID NO: 45357 - DNA, 20 bp, Artificial
  CRISPR gRNA sequence
tttccaagtgtaactcccca

SEQ ID NO: 45358 - DNA, 20 bp, Artificial
  CRISPR gRNA sequence
ttccaagtgtaactccccac

SEQ ID NO: 45359 - DNA, 20 bp, Artificial
  CRISPR gRNA sequence
caagtgtaactccccacagg

SEQ ID NO: 45360 - DNA, 20 bp, Artificial
  CRISPR gRNA sequence
caggcagttaccctcaaatc

SEQ ID NO: 45361 - DNA, 20 bp, Artificial
  CRISPR gRNA sequence
cagttaccctcaaatccagt

SEQ ID NO: 45362 - DNA, 20 bp, Artificial
  CRISPR gRNA sequence
caaatccagtcagcttcttc

SEQ ID NO: 45363 - DNA, 20 bp, Artificial
  CRISPR gRNA sequence
ttccagctgtatacctgtga

SEQ ID NO: 45364 - DNA, 20 bp, Artificial
  CRISPR gRNA sequence
ccagctgtatacctgtgatg

SEQ ID NO: 45365 - DNA, 20 bp, Artificial
  CRISPR gRNA sequence
gctgtatacctgtgatggag

SEQ ID NO: 45366 - DNA, 20 bp, Artificial
  CRISPR gRNA sequence
ctgtatacctgtgatggagt

SEQ ID NO: 45367 - DNA, 20 bp, Artificial
  CRISPR gRNA sequence
tatacctgtgatggagtggg

SEQ ID NO: 45368 - DNA, 20 bp, Artificial
  CRISPR gRNA sequence
atacctgtgatggagtgggt

SEQ ID NO: 45369 - DNA, 20 bp, Artificial
  CRISPR gRNA sequence
acctgtgatggagtgggtag

SEQ ID NO: 45370 - DNA, 20 bp, Artificial
  CRISPR gRNA sequence
tgatggagtgggtaggagca

SEQ ID NO: 45371 - DNA, 20 bp, Artificial
  CRISPR gRNA sequence
gtgggtaggagcatggaccc

SEQ ID NO: 45372 - DNA, 20 bp, Artificial
  CRISPR gRNA sequence
gtaggagcatggaccctagt

SEQ ID NO: 45373 - DNA, 20 bp, Artificial
  CRISPR gRNA sequence
taggagcatggaccctagtt

SEQ ID NO: 45374 - DNA, 20 bp, Artificial
  CRISPR gRNA sequence
ggagcatggaccctagttag

SEQ ID NO: 45375 - DNA, 20 bp, Artificial
  CRISPR gRNA sequence
tagttaggagcctcactgcc

SEQ ID NO: 45376 - DNA, 20 bp, Artificial
  CRISPR gRNA sequence
agttaggagcctcactgcct

SEQ ID NO: 45377 - DNA, 20 bp, Artificial
  CRISPR gRNA sequence
tcactgcctgggttcaactc

SEQ ID NO: 45378 - DNA, 20 bp, Artificial
  CRISPR gRNA sequence
cactgcctgggttcaactct

SEQ ID NO: 45379 - DNA, 20 bp, Artificial
  CRISPR gRNA sequence
tgcctgggttcaactctggg

SEQ ID NO: 45380 - DNA, 20 bp, Artificial
  CRISPR gRNA sequence
gcctgggttcaactctgggt

SEQ ID NO: 45381 - DNA, 20 bp, Artificial
  CRISPR gRNA sequence
cctgggttcaactctgggtg

SEQ ID NO: 45382 - DNA, 20 bp, Artificial
  CRISPR gRNA sequence
ggtggggtaactgacacttc

SEQ ID NO: 45383 - DNA, 20 bp, Artificial
  CRISPR gRNA sequence
actgacacttccagtttgct

SEQ ID NO: 45384 - DNA, 20 bp, Artificial
  CRISPR gRNA sequence
tgacacttccagtttgcttg

SEQ ID NO: 45385 - DNA, 20 bp, Artificial
  CRISPR gRNA sequence
gcttggagctttccccattt

SEQ ID NO: 45386 - DNA, 20 bp, Artificial
  CRISPR gRNA sequence
tttccccattttggcaccca

SEQ ID NO: 45387 - DNA, 20 bp, Artificial
  CRISPR gRNA sequence
ggcacccaaagtcccacatc

SEQ ID NO: 45388 - DNA, 20 bp, Artificial
  CRISPR gRNA sequence
gcacccaaagtcccacatcc

SEQ ID NO: 45389 - DNA, 20 bp, Artificial
  CRISPR gRNA sequence
aggaaaaactcttctgttct

SEQ ID NO: 45390 - DNA, 20 bp, Artificial
  CRISPR gRNA sequence
tcttctgttctgagccaacc

SEQ ID NO: 45391 - DNA, 20 bp, Artificial
  CRISPR gRNA sequence
ctgttctgagccaaccaaga

SEQ ID NO: 45392 - DNA, 20 bp, Artificial
  CRISPR gRNA sequence
attttattatttatttattt

SEQ ID NO: 45393 - DNA, 20 bp, Artificial
  CRISPR gRNA sequence
ttatttatttatttgagacc

SEQ ID NO: 45394 - DNA, 20 bp, Artificial
  CRISPR gRNA sequence
cccagtctctctccgttgcc

SEQ ID NO: 45395 - DNA, 20 bp, Artificial
  CRISPR gRNA sequence
ccagtctctctccgttgccc

SEQ ID NO: 45396 - DNA, 20 bp, Artificial
  CRISPR gRNA sequence
tctctctccgttgcccaggc

SEQ ID NO: 45397 - DNA, 20 bp, Artificial
  CRISPR gRNA sequence
tctctccgttgcccaggctg

SEQ ID NO: 45398 - DNA, 20 bp, Artificial
  CRISPR gRNA sequence
ccgttgcccaggctggagtg

SEQ ID NO: 45399 - DNA, 20 bp, Artificial
  CRISPR gRNA sequence
ttgcccaggctggagtgcag

SEQ ID NO: 45400 - DNA, 20 bp, Artificial
  CRISPR gRNA sequence
caggctggagtgcagtggca

SEQ ID NO: 45401 - DNA, 20 bp, Artificial
  CRISPR gRNA sequence
ggagtgcagtggcacagtct

SEQ ID NO: 45402 - DNA, 20 bp, Artificial
  CRISPR gRNA sequence
tcactgcaacctccgcctcc

SEQ ID NO: 45403 - DNA, 20 bp, Artificial
  CRISPR gRNA sequence
cactgcaacctccgcctccc

SEQ ID NO: 45404 - DNA, 20 bp, Artificial
  CRISPR gRNA sequence
aacctccgcctcccgggttc

SEQ ID NO: 45405 - DNA, 20 bp, Artificial
  CRISPR gRNA sequence
ttcaagcaaccctcctgcct

SEQ ID NO: 45406 - DNA, 20 bp, Artificial
  CRISPR gRNA sequence
ccctcctgcctcagcctccc

SEQ ID NO: 45407 - DNA, 20 bp, Artificial
  CRISPR gRNA sequence
tcctgcctcagcctcccaag

SEQ ID NO: 45408 - DNA, 20 bp, Artificial
  CRISPR gRNA sequence
gcctcagcctcccaagtagc

SEQ ID NO: 45409 - DNA, 20 bp, Artificial
  CRISPR gRNA sequence
ctcccaagtagctggcatta

SEQ ID NO: 45410 - DNA, 20 bp, Artificial
  CRISPR gRNA sequence
tcccaagtagctggcattac

SEQ ID NO: 45411 - DNA, 20 bp, Artificial
  CRISPR gRNA sequence
gcattacaggcacatgccac

SEQ ID NO: 45412 - DNA, 20 bp, Artificial
  CRISPR gRNA sequence
cattacaggcacatgccacc

SEQ ID NO: 45413 - DNA, 20 bp, Artificial
  CRISPR gRNA sequence
caggcacatgccaccaggcc

SEQ ID NO: 45414 - DNA, 20 bp, Artificial
  CRISPR gRNA sequence
ccagctaatttttctatttt

SEQ ID NO: 45415 - DNA, 20 bp, Artificial
  CRISPR gRNA sequence
gctaatttttctatttttag

SEQ ID NO: 45416 - DNA, 20 bp, Artificial
  CRISPR gRNA sequence
taatttttctatttttagtg

SEQ ID NO: 45417 - DNA, 20 bp, Artificial
  CRISPR gRNA sequence
ttttctatttttagtggaga

SEQ ID NO: 45418 - DNA, 20 bp, Artificial
  CRISPR gRNA sequence
tttctatttttagtggagat

SEQ ID NO: 45419 - DNA, 20 bp, Artificial
  CRISPR gRNA sequence
ttctatttttagtggagatg

SEQ ID NO: 45420 - DNA, 20 bp, Artificial
  CRISPR gRNA sequence
gagatggggtttcactttgt

SEQ ID NO: 45421 - DNA, 20 bp, Artificial
  CRISPR gRNA sequence
tggggtttcactttgttggc

SEQ ID NO: 45422 - DNA, 20 bp, Artificial
  CRISPR gRNA sequence
ggggtttcactttgttggcc

SEQ ID NO: 45423 - DNA, 20 bp, Artificial
  CRISPR gRNA sequence
tttcactttgttggccaggc

SEQ ID NO: 45424 - DNA, 20 bp, Artificial
  CRISPR gRNA sequence
tggtctcgaactcctgacct

SEQ ID NO: 45425 - DNA, 20 bp, Artificial
  CRISPR gRNA sequence
ggtctcgaactcctgacctc

SEQ ID NO: 45426 - DNA, 20 bp, Artificial
  CRISPR gRNA sequence
ctcaggtgattcacccgcct

SEQ ID NO: 45427 - DNA, 20 bp, Artificial
  CRISPR gRNA sequence
tcacccgccttggcctcaca

SEQ ID NO: 45428 - DNA, 20 bp, Artificial
  CRISPR gRNA sequence
gccttggcctcacaaagtcc

SEQ ID NO: 45429 - DNA, 20 bp, Artificial
  CRISPR gRNA sequence
ccttggcctcacaaagtcct

SEQ ID NO: 45430 - DNA, 20 bp, Artificial
  CRISPR gRNA sequence
ctcacaaagtcctgggatta

SEQ ID NO: 45431 - DNA, 20 bp, Artificial
  CRISPR gRNA sequence
tcacaaagtcctgggattac

SEQ ID NO: 45432 - DNA, 20 bp, Artificial
  CRISPR gRNA sequence
agtcctgggattacaggcat

SEQ ID NO: 45433 - DNA, 20 bp, Artificial
  CRISPR gRNA sequence
caggcatgagccattgcgcc

SEQ ID NO: 45434 - DNA, 20 bp, Artificial
  CRISPR gRNA sequence
catgagccattgcgcccagc

SEQ ID NO: 45435 - DNA, 20 bp, Artificial
  CRISPR gRNA sequence
cttaatgtgtgaactcgtgc

SEQ ID NO: 45436 - DNA, 20 bp, Artificial
  CRISPR gRNA sequence
gtgaactcgtgccagtccct

SEQ ID NO: 45437 - DNA, 20 bp, Artificial
  CRISPR gRNA sequence
ccctcagcctctctgttctt

SEQ ID NO: 45438 - DNA, 20 bp, Artificial
  CRISPR gRNA sequence
ggcctcctcatcttaacttt

SEQ ID NO: 45439 - DNA, 20 bp, Artificial
  CRISPR gRNA sequence
gcctcctcatcttaactttg

SEQ ID NO: 45440 - DNA, 20 bp, Artificial
  CRISPR gRNA sequence
ctcatcttaactttgaggat

SEQ ID NO: 45441 - DNA, 20 bp, Artificial
  CRISPR gRNA sequence
catcttaactttgaggataa

SEQ ID NO: 45442 - DNA, 20 bp, Artificial
  CRISPR gRNA sequence
aagagcaatctcccctgcta

SEQ ID NO: 45443 - DNA, 20 bp, Artificial
  CRISPR gRNA sequence
tcccctgctacggttgttgt

SEQ ID NO: 45444 - DNA, 20 bp, Artificial
  CRISPR gRNA sequence
ggttgttgtgagtattaaat

SEQ ID NO: 45445 - DNA, 20 bp, Artificial
  CRISPR gRNA sequence
aaatgagataatatgtgtta

SEQ ID NO: 45446 - DNA, 20 bp, Artificial
  CRISPR gRNA sequence
gataatatgtgttacagtct

SEQ ID NO: 45447 - DNA, 20 bp, Artificial
  CRISPR gRNA sequence
taatatgtgttacagtctta

SEQ ID NO: 45448 - DNA, 20 bp, Artificial
  CRISPR gRNA sequence
tgtgttacagtcttagagtc

SEQ ID NO: 45449 - DNA, 20 bp, Artificial
  CRISPR gRNA sequence
ttacagtcttagagtctggt

SEQ ID NO: 45450 - DNA, 20 bp, Artificial
  CRISPR gRNA sequence
acagtcttagagtctggtca

SEQ ID NO: 45451 - DNA, 20 bp, Artificial
  CRISPR gRNA sequence
ggtcagagttcacactctac

SEQ ID NO: 45452 - DNA, 20 bp, Artificial
  CRISPR gRNA sequence
agttcacactctacaagtgc

SEQ ID NO: 45453 - DNA, 20 bp, Artificial
  CRISPR gRNA sequence
tgttattctcctctcctgcc

SEQ ID NO: 45454 - DNA, 20 bp, Artificial
  CRISPR gRNA sequence
gttattctcctctcctgcct

SEQ ID NO: 45455 - DNA, 20 bp, Artificial
  CRISPR gRNA sequence
ttctcctctcctgcctaggc

SEQ ID NO: 45456 - DNA, 20 bp, Artificial
  CRISPR gRNA sequence
tctcctctcctgcctaggct

SEQ ID NO: 45457 - DNA, 20 bp, Artificial
  CRISPR gRNA sequence
ctcctctcctgcctaggctg

SEQ ID NO: 45458 - DNA, 20 bp, Artificial
  CRISPR gRNA sequence
tcctctcctgcctaggctgg

SEQ ID NO: 45459 - DNA, 20 bp, Artificial
  CRISPR gRNA sequence
ctgcctaggctgggggcctc

SEQ ID NO: 45460 - DNA, 20 bp, Artificial
  CRISPR gRNA sequence
cctaggctgggggcctctag

SEQ ID NO: 45461 - DNA, 20 bp, Artificial
  CRISPR gRNA sequence
cctctagaagtacaatcgcc

SEQ ID NO: 45462 - DNA, 20 bp, Artificial
  CRISPR gRNA sequence
ctctagaagtacaatcgcct

SEQ ID NO: 45463 - DNA, 20 bp, Artificial
  CRISPR gRNA sequence
acaatcgcctgggtcacata

SEQ ID NO: 45464 - DNA, 20 bp, Artificial
  CRISPR gRNA sequence
tcgcctgggtcacatatggt

SEQ ID NO: 45465 - DNA, 20 bp, Artificial
  CRISPR gRNA sequence
cgcctgggtcacatatggtt

SEQ ID NO: 45466 - DNA, 20 bp, Artificial
  CRISPR gRNA sequence
gcctgggtcacatatggttg

SEQ ID NO: 45467 - DNA, 20 bp, Artificial
  CRISPR gRNA sequence
ggtcacatatggttggggct

SEQ ID NO: 45468 - DNA, 20 bp, Artificial
  CRISPR gRNA sequence
gtcacatatggttggggctc

SEQ ID NO: 45469 - DNA, 20 bp, Artificial
  CRISPR gRNA sequence
atatggttggggctcaggaa

SEQ ID NO: 45470 - DNA, 20 bp, Artificial
  CRISPR gRNA sequence
tatggttggggctcaggaat

SEQ ID NO: 45471 - DNA, 20 bp, Artificial
  CRISPR gRNA sequence
tggttggggctcaggaatgg

SEQ ID NO: 45472 - DNA, 20 bp, Artificial
  CRISPR gRNA sequence
gctcaggaatgggagttcta

SEQ ID NO: 45473 - DNA, 20 bp, Artificial
  CRISPR gRNA sequence
aatgggagttctatagtttt

SEQ ID NO: 45474 - DNA, 20 bp, Artificial
  CRISPR gRNA sequence
agtttttggttctgttcctg

SEQ ID NO: 45475 - DNA, 20 bp, Artificial
  CRISPR gRNA sequence
ttttggttctgttcctgaag

SEQ ID NO: 45476 - DNA, 20 bp, Artificial
  CRISPR gRNA sequence
gccactttgtgtatgacctt

SEQ ID NO: 45477 - DNA, 20 bp, Artificial
  CRISPR gRNA sequence
ctttgtgtatgaccttaagc

SEQ ID NO: 45478 - DNA, 20 bp, Artificial
  CRISPR gRNA sequence
ttctctaactctctgaacct

SEQ ID NO: 45479 - DNA, 20 bp, Artificial
  CRISPR gRNA sequence
ggtgttcctcacctgtaaaa

SEQ ID NO: 45480 - DNA, 20 bp, Artificial
  CRISPR gRNA sequence
gtgttcctcacctgtaaaat

SEQ ID NO: 45481 - DNA, 20 bp, Artificial
  CRISPR gRNA sequence
tgttcctcacctgtaaaatg

SEQ ID NO: 45482 - DNA, 20 bp, Artificial
  CRISPR gRNA sequence
cgataataaacccacctttc

SEQ ID NO: 45483 - DNA, 20 bp, Artificial
  CRISPR gRNA sequence
aataaacccacctttccaga

SEQ ID NO: 45484 - DNA, 20 bp, Artificial
  CRISPR gRNA sequence
ccacctttccagatggcccc

SEQ ID NO: 45485 - DNA, 20 bp, Artificial
  CRISPR gRNA sequence
tccagatggccccaagccct

SEQ ID NO: 45486 - DNA, 20 bp, Artificial
  CRISPR gRNA sequence
atggccccaagccctgagtt

SEQ ID NO: 45487 - DNA, 20 bp, Artificial
  CRISPR gRNA sequence
atgtgtgaccgccattatta

SEQ ID NO: 45488 - DNA, 20 bp, Artificial
  CRISPR gRNA sequence
ccgccattattacggatcat

SEQ ID NO: 45489 - DNA, 20 bp, Artificial
  CRISPR gRNA sequence
ttattacggatcattagtct

SEQ ID NO: 45490 - DNA, 20 bp, Artificial
  CRISPR gRNA sequence
atcattagtcttggtccatg

SEQ ID NO: 45491 - DNA, 20 bp, Artificial
  CRISPR gRNA sequence
tagtcttggtccatgtggtt

SEQ ID NO: 45492 - DNA, 20 bp, Artificial
  CRISPR gRNA sequence
ggtccatgtggttcagaaca

SEQ ID NO: 45493 - DNA, 20 bp, Artificial
  CRISPR gRNA sequence
aactgctgcctgcctgacct

SEQ ID NO: 45494 - DNA, 20 bp, Artificial
  CRISPR gRNA sequence
cctgacctcagtaattcatg

SEQ ID NO: 45495 - DNA, 20 bp, Artificial
  CRISPR gRNA sequence
tgacctcagtaattcatgca

SEQ ID NO: 45496 - DNA, 20 bp, Artificial
  CRISPR gRNA sequence
cagtaattcatgcagagaaa

SEQ ID NO: 45497 - DNA, 20 bp, Artificial
  CRISPR gRNA sequence
tcatgcagagaaacagcatt

SEQ ID NO: 45498 - DNA, 20 bp, Artificial
  CRISPR gRNA sequence
gaaacagcatttggacctcc

SEQ ID NO: 45499 - DNA, 20 bp, Artificial
  CRISPR gRNA sequence
agcatttggacctcccagta

SEQ ID NO: 45500 - DNA, 20 bp, Artificial
  CRISPR gRNA sequence
tcccagtacagttcattttg

SEQ ID NO: 45501 - DNA, 20 bp, Artificial
  CRISPR gRNA sequence
tgtagaatttttacactgtg

SEQ ID NO: 45502 - DNA, 20 bp, Artificial
  CRISPR gRNA sequence
tttttacactgtgtggatat

SEQ ID NO: 45503 - DNA, 20 bp, Artificial
  CRISPR gRNA sequence
ttacactgtgtggatataag

SEQ ID NO: 45504 - DNA, 20 bp, Artificial
  CRISPR gRNA sequence
gtggatataagtggctgtct

SEQ ID NO: 45505 - DNA, 20 bp, Artificial
  CRISPR gRNA sequence
ggatataagtggctgtcttg

SEQ ID NO: 45506 - DNA, 20 bp, Artificial
  CRISPR gRNA sequence
gatataagtggctgtcttgg

SEQ ID NO: 45507 - DNA, 20 bp, Artificial
  CRISPR gRNA sequence
gtggctgtcttggaggtccc

SEQ ID NO: 45508 - DNA, 20 bp, Artificial
  CRISPR gRNA sequence
tggctgtcttggaggtccct

SEQ ID NO: 45509 - DNA, 20 bp, Artificial
  CRISPR gRNA sequence
tggaggtccctaggcttgct

SEQ ID NO: 45510 - DNA, 20 bp, Artificial
  CRISPR gRNA sequence
gtccctaggcttgctaagca

SEQ ID NO: 45511 - DNA, 20 bp, Artificial
  CRISPR gRNA sequence
ccctaggcttgctaagcaca

SEQ ID NO: 45512 - DNA, 20 bp, Artificial
  CRISPR gRNA sequence
cctaggcttgctaagcacag

SEQ ID NO: 45513 - DNA, 20 bp, Artificial
  CRISPR gRNA sequence
cttgctaagcacagaggcct

SEQ ID NO: 45514 - DNA, 20 bp, Artificial
  CRISPR gRNA sequence
gcacagaggcctcagacccc

SEQ ID NO: 45515 - DNA, 20 bp, Artificial
  CRISPR gRNA sequence
gaggcctcagacccccagac

SEQ ID NO: 45516 - DNA, 20 bp, Artificial
  CRISPR gRNA sequence
cctcagacccccagactgga

SEQ ID NO: 45517 - DNA, 20 bp, Artificial
  CRISPR gRNA sequence
actggacagtgccccacccc

SEQ ID NO: 45518 - DNA, 20 bp, Artificial
  CRISPR gRNA sequence
gtgccccacccccagatgtc

SEQ ID NO: 45519 - DNA, 20 bp, Artificial
  CRISPR gRNA sequence
ccccagatgtcaagttcacc

SEQ ID NO: 45520 - DNA, 20 bp, Artificial
  CRISPR gRNA sequence
tcacctggcctcctcttctc

SEQ ID NO: 45521 - DNA, 20 bp, Artificial
  CRISPR gRNA sequence
ggcctcctcttctccagcct

SEQ ID NO: 45522 - DNA, 20 bp, Artificial
  CRISPR gRNA sequence
ctcagtcaccttctgctgaa

SEQ ID NO: 45523 - DNA, 20 bp, Artificial
  CRISPR gRNA sequence
tctgctgaacagctccacct

SEQ ID NO: 45524 - DNA, 20 bp, Artificial
  CRISPR gRNA sequence
accttggccttgcttactca

SEQ ID NO: 45525 - DNA, 20 bp, Artificial
  CRISPR gRNA sequence
gccttgcttactcacagact

SEQ ID NO: 45526 - DNA, 20 bp, Artificial
  CRISPR gRNA sequence
tgcttactcacagactaagc

SEQ ID NO: 45527 - DNA, 20 bp, Artificial
  CRISPR gRNA sequence
taagccagatgacctgcctg

SEQ ID NO: 45528 - DNA, 20 bp, Artificial
  CRISPR gRNA sequence
agccagatgacctgcctgca

SEQ ID NO: 45529 - DNA, 20 bp, Artificial
  CRISPR gRNA sequence
atgacctgcctgcagagcct

SEQ ID NO: 45530 - DNA, 20 bp, Artificial
  CRISPR gRNA sequence
tgacctgcctgcagagcctc

SEQ ID NO: 45531 - DNA, 20 bp, Artificial
  CRISPR gRNA sequence
ctgcctgcagagcctcaggt

SEQ ID NO: 45532 - DNA, 20 bp, Artificial
  CRISPR gRNA sequence
agagcctcaggtgagtgacc

SEQ ID NO: 45533 - DNA, 20 bp, Artificial
  CRISPR gRNA sequence
gcctcaggtgagtgaccgag

SEQ ID NO: 45534 - DNA, 20 bp, Artificial
  CRISPR gRNA sequence
tgagtgaccgagcggcccca

SEQ ID NO: 45535 - DNA, 20 bp, Artificial
  CRISPR gRNA sequence
gagtgaccgagcggccccat

SEQ ID NO: 45536 - DNA, 20 bp, Artificial
  CRISPR gRNA sequence
ccgagcggccccatgggaat

SEQ ID NO: 45537 - DNA, 20 bp, Artificial
  CRISPR gRNA sequence
agcggccccatgggaatgag

SEQ ID NO: 45538 - DNA, 20 bp, Artificial
  CRISPR gRNA sequence
gcggccccatgggaatgagt

SEQ ID NO: 45539 - DNA, 20 bp, Artificial
  CRISPR gRNA sequence
gccccatgggaatgagtggg

SEQ ID NO: 45540 - DNA, 20 bp, Artificial
  CRISPR gRNA sequence
gggaagaaacacttcccact

SEQ ID NO: 45541 - DNA, 20 bp, Artificial
  CRISPR gRNA sequence
agaaacacttcccactcagt

SEQ ID NO: 45542 - DNA, 20 bp, Artificial
  CRISPR gRNA sequence
gaaacacttcccactcagtt

SEQ ID NO: 45543 - DNA, 20 bp, Artificial
  CRISPR gRNA sequence
cactcagttgggaccacatc

SEQ ID NO: 45544 - DNA, 20 bp, Artificial
  CRISPR gRNA sequence
actcagttgggaccacatcc

SEQ ID NO: 45545 - DNA, 20 bp, Artificial
  CRISPR gRNA sequence
ctcagttgggaccacatcca

SEQ ID NO: 45546 - DNA, 20 bp, Artificial
  CRISPR gRNA sequence
agttgggaccacatccaggg

SEQ ID NO: 45547 - DNA, 20 bp, Artificial
  CRISPR gRNA sequence
accacatccagggaagcact

SEQ ID NO: 45548 - DNA, 20 bp, Artificial
  CRISPR gRNA sequence
ccacatccagggaagcactg

SEQ ID NO: 45549 - DNA, 20 bp, Artificial
  CRISPR gRNA sequence
gaagcactgaggccacctcc

SEQ ID NO: 45550 - DNA, 20 bp, Artificial
  CRISPR gRNA sequence
aagcactgaggccacctccc

SEQ ID NO: 45551 - DNA, 20 bp, Artificial
  CRISPR gRNA sequence
agcactgaggccacctccca

SEQ ID NO: 45552 - DNA, 20 bp, Artificial
  CRISPR gRNA sequence
gcactgaggccacctcccag

SEQ ID NO: 45553 - DNA, 20 bp, Artificial
  CRISPR gRNA sequence
acctcccaggggatcctttg

SEQ ID NO: 45554 - DNA, 20 bp, Artificial
  CRISPR gRNA sequence
gatcctttgcggatccctcc

SEQ ID NO: 45555 - DNA, 20 bp, Artificial
  CRISPR gRNA sequence
atcctttgcggatccctccc

SEQ ID NO: 45556 - DNA, 20 bp, Artificial
  CRISPR gRNA sequence
ggcccatccctgtgccctcc

SEQ ID NO: 45557 - DNA, 20 bp, Artificial
  CRISPR gRNA sequence
gcccatccctgtgccctccc

SEQ ID NO: 45558 - DNA, 20 bp, Artificial
  CRISPR gRNA sequence
catccctgtgccctcccagg

SEQ ID NO: 45559 - DNA, 20 bp, Artificial
  CRISPR gRNA sequence
atccctgtgccctcccaggt

SEQ ID NO: 45560 - DNA, 20 bp, Artificial
  CRISPR gRNA sequence
ctcttgccttctaatgccat

SEQ ID NO: 45561 - DNA, 20 bp, Artificial
  CRISPR gRNA sequence
taatgccatcagcttcctcc

SEQ ID NO: 45562 - DNA, 20 bp, Artificial
  CRISPR gRNA sequence
cagcttcctcctggttacaa

SEQ ID NO: 45563 - DNA, 20 bp, Artificial
  CRISPR gRNA sequence
cttcctcctggttacaaaag

SEQ ID NO: 45564 - DNA, 20 bp, Artificial
  CRISPR gRNA sequence
ctggttacaaaagtggccta

SEQ ID NO: 45565 - DNA, 20 bp, Artificial
  CRISPR gRNA sequence
tggttacaaaagtggcctaa

SEQ ID NO: 45566 - DNA, 20 bp, Artificial
  CRISPR gRNA sequence
ggttacaaaagtggcctaaa

SEQ ID NO: 45567 - DNA, 20 bp, Artificial
  CRISPR gRNA sequence
caaaagtggcctaaagggct

SEQ ID NO: 45568 - DNA, 20 bp, Artificial
  CRISPR gRNA sequence
aaaagtggcctaaagggctt

SEQ ID NO: 45569 - DNA, 20 bp, Artificial
  CRISPR gRNA sequence
aagggcttaggcccacgtcg

SEQ ID NO: 45570 - DNA, 20 bp, Artificial
  CRISPR gRNA sequence
cacgtcgtagaacaaccctt

SEQ ID NO: 45571 - DNA, 20 bp, Artificial
  CRISPR gRNA sequence
acgtcgtagaacaacccttg

SEQ ID NO: 45572 - DNA, 20 bp, Artificial
  CRISPR gRNA sequence
caacccttgaggcacacaca

SEQ ID NO: 45573 - DNA, 20 bp, Artificial
  CRISPR gRNA sequence
ggcacacacacagttcaccc

SEQ ID NO: 45574 - DNA, 20 bp, Artificial
  CRISPR gRNA sequence
gcacacacacagttcaccct

SEQ ID NO: 45575 - DNA, 20 bp, Artificial
  CRISPR gRNA sequence
aaatgctcattctgattccc

SEQ ID NO: 45576 - DNA, 20 bp, Artificial
  CRISPR gRNA sequence
aatgctcattctgattcccc

SEQ ID NO: 45577 - DNA, 20 bp, Artificial
  CRISPR gRNA sequence
tcattctgattccccaggtc

SEQ ID NO: 45578 - DNA, 20 bp, Artificial
  CRISPR gRNA sequence
cccaggtctggaattctgcc

SEQ ID NO: 45579 - DNA, 20 bp, Artificial
  CRISPR gRNA sequence
tttttttttttttttttttt

SEQ ID NO: 45580 - DNA, 20 bp, Artificial
  CRISPR gRNA sequence
ttttttttttttttttgagt

SEQ ID NO: 45581 - DNA, 20 bp, Artificial
  CRISPR gRNA sequence
tttttttttttttttgagtt

SEQ ID NO: 45582 - DNA, 20 bp, Artificial
  CRISPR gRNA sequence
ttttttttttttttgagttg

SEQ ID NO: 45583 - DNA, 20 bp, Artificial
  CRISPR gRNA sequence
tgagttggggcctcactgtg

SEQ ID NO: 45584 - DNA, 20 bp, Artificial
  CRISPR gRNA sequence
tggggcctcactgtgtggcc

SEQ ID NO: 45585 - DNA, 20 bp, Artificial
  CRISPR gRNA sequence
ggggcctcactgtgtggccc

SEQ ID NO: 45586 - DNA, 20 bp, Artificial
  CRISPR gRNA sequence
cctcactgtgtggcccaggc

SEQ ID NO: 45587 - DNA, 20 bp, Artificial
  CRISPR gRNA sequence
tcactgtgtggcccaggctg

SEQ ID NO: 45588 - DNA, 20 bp, Artificial
  CRISPR gRNA sequence
gtgtggcccaggctggagtg

SEQ ID NO: 45589 - DNA, 20 bp, Artificial
  CRISPR gRNA sequence
tggcccaggctggagtgcag

SEQ ID NO: 45590 - DNA, 20 bp, Artificial
  CRISPR gRNA sequence
tggagtgcagtggcaatgca

SEQ ID NO: 45591 - DNA, 20 bp, Artificial
  CRISPR gRNA sequence
ggagtgcagtggcaatgcac

SEQ ID NO: 45592 - DNA, 20 bp, Artificial
  CRISPR gRNA sequence
ggtgcaatcgtgttgcactg

SEQ ID NO: 45593 - DNA, 20 bp, Artificial
  CRISPR gRNA sequence
gcactgcagcctcaaactcc

SEQ ID NO: 45594 - DNA, 20 bp, Artificial
  CRISPR gRNA sequence
cactgcagcctcaaactcct

SEQ ID NO: 45595 - DNA, 20 bp, Artificial
  CRISPR gRNA sequence
tcctcctgcctcaccctcct

SEQ ID NO: 45596 - DNA, 20 bp, Artificial
  CRISPR gRNA sequence
tcctgcctcaccctcctaag

SEQ ID NO: 45597 - DNA, 20 bp, Artificial
  CRISPR gRNA sequence
gcctcaccctcctaagcagc

SEQ ID NO: 45598 - DNA, 20 bp, Artificial
  CRISPR gRNA sequence
cctcaccctcctaagcagct

SEQ ID NO: 45599 - DNA, 20 bp, Artificial
  CRISPR gRNA sequence
ctcctaagcagctgggacta

SEQ ID NO: 45600 - DNA, 20 bp, Artificial
  CRISPR gRNA sequence
tcctaagcagctgggactac

SEQ ID NO: 45601 - DNA, 20 bp, Artificial
  CRISPR gRNA sequence
gcagctgggactacaggcct

SEQ ID NO: 45602 - DNA, 20 bp, Artificial
  CRISPR gRNA sequence
cagctgggactacaggccta

SEQ ID NO: 45603 - DNA, 20 bp, Artificial
  CRISPR gRNA sequence
taaggcgttgcacccaaact

SEQ ID NO: 45604 - DNA, 20 bp, Artificial
  CRISPR gRNA sequence
ttttttgtttgtttgttttt

SEQ ID NO: 45605 - DNA, 20 bp, Artificial
  CRISPR gRNA sequence
ttgtttgtttgtttttgaga

SEQ ID NO: 45606 - DNA, 20 bp, Artificial
  CRISPR gRNA sequence
gtttgtttgtttttgagaca

SEQ ID NO: 45607 - DNA, 20 bp, Artificial
  CRISPR gRNA sequence
agagtttcgctcttgttgcc

SEQ ID NO: 45608 - DNA, 20 bp, Artificial
  CRISPR gRNA sequence
gagtttcgctcttgttgccc

SEQ ID NO: 45609 - DNA, 20 bp, Artificial
  CRISPR gRNA sequence
ttcgctcttgttgcccaggc

SEQ ID NO: 45610 - DNA, 20 bp, Artificial
  CRISPR gRNA sequence
cgctcttgttgcccaggctg

SEQ ID NO: 45611 - DNA, 20 bp, Artificial
  CRISPR gRNA sequence
ttgcccaggctggagtgcaa

SEQ ID NO: 45612 - DNA, 20 bp, Artificial
  CRISPR gRNA sequence
ggagtgcaatggcacaatct

SEQ ID NO: 45613 - DNA, 20 bp, Artificial
  CRISPR gRNA sequence
tcactgcaacctccgcctcc

SEQ ID NO: 45614 - DNA, 20 bp, Artificial
  CRISPR gRNA sequence
cactgcaacctccgcctccc

SEQ ID NO: 45615 - DNA, 20 bp, Artificial
  CRISPR gRNA sequence
aacctccgcctcccgggttc

SEQ ID NO: 45616 - DNA, 20 bp, Artificial
  CRISPR gRNA sequence
ttcaagcgattctcctgcct

SEQ ID NO: 45617 - DNA, 20 bp, Artificial
  CRISPR gRNA sequence
ttctcctgcctcagcctccc

SEQ ID NO: 45618 - DNA, 20 bp, Artificial
  CRISPR gRNA sequence
tcctgcctcagcctcccgag

SEQ ID NO: 45619 - DNA, 20 bp, Artificial
  CRISPR gRNA sequence
gcctcagcctcccgagtagc

SEQ ID NO: 45620 - DNA, 20 bp, Artificial
  CRISPR gRNA sequence
cctcagcctcccgagtagcc

SEQ ID NO: 45621 - DNA, 20 bp, Artificial
  CRISPR gRNA sequence
ctcccgagtagccgggatta

SEQ ID NO: 45622 - DNA, 20 bp, Artificial
  CRISPR gRNA sequence
tcccgagtagccgggattat

SEQ ID NO: 45623 - DNA, 20 bp, Artificial
  CRISPR gRNA sequence
taggcatgtgccaccacgcc

SEQ ID NO: 45624 - DNA, 20 bp, Artificial
  CRISPR gRNA sequence
ccggctaatttttgtatttt

SEQ ID NO: 45625 - DNA, 20 bp, Artificial
  CRISPR gRNA sequence
gctaatttttgtatttttgg

SEQ ID NO: 45626 - DNA, 20 bp, Artificial
  CRISPR gRNA sequence
taatttttgtatttttggta

SEQ ID NO: 45627 - DNA, 20 bp, Artificial
  CRISPR gRNA sequence
ttttgtatttttggtagaga

SEQ ID NO: 45628 - DNA, 20 bp, Artificial
  CRISPR gRNA sequence
gagacagtgtttctccatgt

SEQ ID NO: 45629 - DNA, 20 bp, Artificial
  CRISPR gRNA sequence
cagtgtttctccatgttggt

SEQ ID NO: 45630 - DNA, 20 bp, Artificial
  CRISPR gRNA sequence
agtgtttctccatgttggtc

SEQ ID NO: 45631 - DNA, 20 bp, Artificial
  CRISPR gRNA sequence
tttctccatgttggtcaggc

SEQ ID NO: 45632 - DNA, 20 bp, Artificial
  CRISPR gRNA sequence
tggtcttgaacgtccaacct

SEQ ID NO: 45633 - DNA, 20 bp, Artificial
  CRISPR gRNA sequence
ggtcttgaacgtccaacctc

SEQ ID NO: 45634 - DNA, 20 bp, Artificial
  CRISPR gRNA sequence
ctcaggtgatctgcccacct

SEQ ID NO: 45635 - DNA, 20 bp, Artificial
  CRISPR gRNA sequence
ctgcccacctcggcctccca

SEQ ID NO: 45636 - DNA, 20 bp, Artificial
  CRISPR gRNA sequence
acctcggcctcccaaagtgc

SEQ ID NO: 45637 - DNA, 20 bp, Artificial
  CRISPR gRNA sequence
cctcggcctcccaaagtgct

SEQ ID NO: 45638 - DNA, 20 bp, Artificial
  CRISPR gRNA sequence
ctcccaaagtgctgggatta

SEQ ID NO: 45639 - DNA, 20 bp, Artificial
  CRISPR gRNA sequence
tcccaaagtgctgggattac

SEQ ID NO: 45640 - DNA, 20 bp, Artificial
  CRISPR gRNA sequence
agtgctgggattacaggcgt

SEQ ID NO: 45641 - DNA, 20 bp, Artificial
  CRISPR gRNA sequence
caggcgtgagccaccacgcc

SEQ ID NO: 45642 - DNA, 20 bp, Artificial
  CRISPR gRNA sequence
tgagccaccacgcctggctt

SEQ ID NO: 45643 - DNA, 20 bp, Artificial
  CRISPR gRNA sequence
cagactctgcattttctaac

SEQ ID NO: 45644 - DNA, 20 bp, Artificial
  CRISPR gRNA sequence
tgcattttctaacaagcttc

SEQ ID NO: 45645 - DNA, 20 bp, Artificial
  CRISPR gRNA sequence
gcattttctaacaagcttcc

SEQ ID NO: 45646 - DNA, 20 bp, Artificial
  CRISPR gRNA sequence
ttttctaacaagcttccggg

SEQ ID NO: 45647 - DNA, 20 bp, Artificial
  CRISPR gRNA sequence
cttccgggtggtatcaattc

SEQ ID NO: 45648 - DNA, 20 bp, Artificial
  CRISPR gRNA sequence
ttccgggtggtatcaattct

SEQ ID NO: 45649 - DNA, 20 bp, Artificial
  CRISPR gRNA sequence
tccgggtggtatcaattctg

SEQ ID NO: 45650 - DNA, 20 bp, Artificial
  CRISPR gRNA sequence
ccgggtggtatcaattctgg

SEQ ID NO: 45651 - DNA, 20 bp, Artificial
  CRISPR gRNA sequence
ggtatcaattctgggggcca

SEQ ID NO: 45652 - DNA, 20 bp, Artificial
  CRISPR gRNA sequence
tcaattctgggggccacggt

SEQ ID NO: 45653 - DNA, 20 bp, Artificial
  CRISPR gRNA sequence
ggggccacggtcagcacttt

SEQ ID NO: 45654 - DNA, 20 bp, Artificial
  CRISPR gRNA sequence
gccacggtcagcactttgag

SEQ ID NO: 45655 - DNA, 20 bp, Artificial
  CRISPR gRNA sequence
ggtcagcactttgagtagtg

SEQ ID NO: 45656 - DNA, 20 bp, Artificial
  CRISPR gRNA sequence
gtcagcactttgagtagtgt

SEQ ID NO: 45657 - DNA, 20 bp, Artificial
  CRISPR gRNA sequence
cactttgagtagtgtgggtc

SEQ ID NO: 45658 - DNA, 20 bp, Artificial
  CRISPR gRNA sequence
gagtagtgtgggtctagact

SEQ ID NO: 45659 - DNA, 20 bp, Artificial
  CRISPR gRNA sequence
agtgtgggtctagactcaga

SEQ ID NO: 45660 - DNA, 20 bp, Artificial
  CRISPR gRNA sequence
gtgtgggtctagactcagat

SEQ ID NO: 45661 - DNA, 20 bp, Artificial
  CRISPR gRNA sequence
tgtgggtctagactcagatg

SEQ ID NO: 45662 - DNA, 20 bp, Artificial
  CRISPR gRNA sequence
gggtctagactcagatgggg

SEQ ID NO: 45663 - DNA, 20 bp, Artificial
  CRISPR gRNA sequence
gtgatttcactccctgctgc

SEQ ID NO: 45664 - DNA, 20 bp, Artificial
  CRISPR gRNA sequence
tgatttcactccctgctgct

SEQ ID NO: 45665 - DNA, 20 bp, Artificial
  CRISPR gRNA sequence
ttgtgactaaaaacaaatcc

SEQ ID NO: 45666 - DNA, 20 bp, Artificial
  CRISPR gRNA sequence
tgactaaaaacaaatccaag

SEQ ID NO: 45667 - DNA, 20 bp, Artificial
  CRISPR gRNA sequence
caaatccaagcagtgacaca

SEQ ID NO: 45668 - DNA, 20 bp, Artificial
  CRISPR gRNA sequence
gcattgctttgtttatatcc

SEQ ID NO: 45669 - DNA, 20 bp, Artificial
  CRISPR gRNA sequence
acacctcctaccccctacct

SEQ ID NO: 45670 - DNA, 20 bp, Artificial
  CRISPR gRNA sequence
cacctcctaccccctacctc

SEQ ID NO: 45671 - DNA, 20 bp, Artificial
  CRISPR gRNA sequence
ctcctaccccctacctcggg

SEQ ID NO: 45672 - DNA, 20 bp, Artificial
  CRISPR gRNA sequence
cctaccccctacctcgggca

SEQ ID NO: 45673 - DNA, 20 bp, Artificial
  CRISPR gRNA sequence
accccctacctcgggcagag

SEQ ID NO: 45674 - DNA, 20 bp, Artificial
  CRISPR gRNA sequence
cccctacctcgggcagagca

SEQ ID NO: 45675 - DNA, 20 bp, Artificial
  CRISPR gRNA sequence
ctacctcgggcagagcagag

SEQ ID NO: 45676 - DNA, 20 bp, Artificial
  CRISPR gRNA sequence
tacctcgggcagagcagagt

SEQ ID NO: 45677 - DNA, 20 bp, Artificial
  CRISPR gRNA sequence
ctcgggcagagcagagtagg

SEQ ID NO: 45678 - DNA, 20 bp, Artificial
  CRISPR gRNA sequence
tcgggcagagcagagtaggt

SEQ ID NO: 45679 - DNA, 20 bp, Artificial
  CRISPR gRNA sequence
gagcagagtaggtaggaaat

SEQ ID NO: 45680 - DNA, 20 bp, Artificial
  CRISPR gRNA sequence
agcagagtaggtaggaaatg

SEQ ID NO: 45681 - DNA, 20 bp, Artificial
  CRISPR gRNA sequence
gagtaggtaggaaatgaggt

SEQ ID NO: 45682 - DNA, 20 bp, Artificial
  CRISPR gRNA sequence
gtaggtaggaaatgaggtta

SEQ ID NO: 45683 - DNA, 20 bp, Artificial
  CRISPR gRNA sequence
aggtaggaaatgaggttaga

SEQ ID NO: 45684 - DNA, 20 bp, Artificial
  CRISPR gRNA sequence
gaaatgaggttagagagttc

SEQ ID NO: 45685 - DNA, 20 bp, Artificial
  CRISPR gRNA sequence
aaatgaggttagagagttcc

SEQ ID NO: 45686 - DNA, 20 bp, Artificial
  CRISPR gRNA sequence
atgaggttagagagttccag

SEQ ID NO: 45687 - DNA, 20 bp, Artificial
  CRISPR gRNA sequence
tgaggttagagagttccagg

SEQ ID NO: 45688 - DNA, 20 bp, Artificial
  CRISPR gRNA sequence
tccaggaggttatatcatat

SEQ ID NO: 45689 - DNA, 20 bp, Artificial
  CRISPR gRNA sequence
acccaaaattaatttactga

SEQ ID NO: 45690 - DNA, 20 bp, Artificial
  CRISPR gRNA sequence
cccaaaattaatttactgaa

SEQ ID NO: 45691 - DNA, 20 bp, Artificial
  CRISPR gRNA sequence
tactgaaaggtgatccatta

SEQ ID NO: 45692 - DNA, 20 bp, Artificial
  CRISPR gRNA sequence
ctattttatttttatttttt

SEQ ID NO: 45693 - DNA, 20 bp, Artificial
  CRISPR gRNA sequence
tatttttattttttgagaca

SEQ ID NO: 45694 - DNA, 20 bp, Artificial
  CRISPR gRNA sequence
cacagtctcactctgtcgcc

SEQ ID NO: 45695 - DNA, 20 bp, Artificial
  CRISPR gRNA sequence
acagtctcactctgtcgccc

SEQ ID NO: 45696 - DNA, 20 bp, Artificial
  CRISPR gRNA sequence
tctcactctgtcgcccaggc

SEQ ID NO: 45697 - DNA, 20 bp, Artificial
  CRISPR gRNA sequence
tcactctgtcgcccaggctg

SEQ ID NO: 45698 - DNA, 20 bp, Artificial
  CRISPR gRNA sequence
ctgtcgcccaggctggagtg

SEQ ID NO: 45699 - DNA, 20 bp, Artificial
  CRISPR gRNA sequence
tcgcccaggctggagtgcag

SEQ ID NO: 45700 - DNA, 20 bp, Artificial
  CRISPR gRNA sequence
tcactgcaacctctgcctcc

SEQ ID NO: 45701 - DNA, 20 bp, Artificial
  CRISPR gRNA sequence
cactgcaacctctgcctcct

SEQ ID NO: 45702 - DNA, 20 bp, Artificial
  CRISPR gRNA sequence
aacctctgcctcctgggttc

SEQ ID NO: 45703 - DNA, 20 bp, Artificial
  CRISPR gRNA sequence
ctcctgggttcaagcgattc

SEQ ID NO: 45704 - DNA, 20 bp, Artificial
  CRISPR gRNA sequence
ttcaagcgattctggtgcct

SEQ ID NO: 45705 - DNA, 20 bp, Artificial
  CRISPR gRNA sequence
ttctggtgcctcagccgccc

SEQ ID NO: 45706 - DNA, 20 bp, Artificial
  CRISPR gRNA sequence
tggtgcctcagccgcccaag

SEQ ID NO: 45707 - DNA, 20 bp, Artificial
  CRISPR gRNA sequence
gcctcagccgcccaagtagc

SEQ ID NO: 45708 - DNA, 20 bp, Artificial
  CRISPR gRNA sequence
cctcagccgcccaagtagct

SEQ ID NO: 45709 - DNA, 20 bp, Artificial
  CRISPR gRNA sequence
cgcccaagtagctgggatta

SEQ ID NO: 45710 - DNA, 20 bp, Artificial
  CRISPR gRNA sequence
gcccaagtagctgggattac

SEQ ID NO: 45711 - DNA, 20 bp, Artificial
  CRISPR gRNA sequence
caggtatgcaccaccacgcc

SEQ ID NO: 45712 - DNA, 20 bp, Artificial
  CRISPR gRNA sequence
agataatttttgtatatttt

SEQ ID NO: 45713 - DNA, 20 bp, Artificial
  CRISPR gRNA sequence
ttgtatatttttagtacaaa

SEQ ID NO: 45714 - DNA, 20 bp, Artificial
  CRISPR gRNA sequence
tgtatatttttagtacaaat

SEQ ID NO: 45715 - DNA, 20 bp, Artificial
  CRISPR gRNA sequence
gtatatttttagtacaaatg

SEQ ID NO: 45716 - DNA, 20 bp, Artificial
  CRISPR gRNA sequence
caaatggggtttcaccatgt

SEQ ID NO: 45717 - DNA, 20 bp, Artificial
  CRISPR gRNA sequence
tggggtttcaccatgttggc

SEQ ID NO: 45718 - DNA, 20 bp, Artificial
  CRISPR gRNA sequence
ggggtttcaccatgttggcc

SEQ ID NO: 45719 - DNA, 20 bp, Artificial
  CRISPR gRNA sequence
tttcaccatgttggccgggc

SEQ ID NO: 45720 - DNA, 20 bp, Artificial
  CRISPR gRNA sequence
cctcaaatgatccacctgcc

SEQ ID NO: 45721 - DNA, 20 bp, Artificial
  CRISPR gRNA sequence
tccacctgcctagactccga

SEQ ID NO: 45722 - DNA, 20 bp, Artificial
  CRISPR gRNA sequence
tgcctagactccgaaagtgc

SEQ ID NO: 45723 - DNA, 20 bp, Artificial
  CRISPR gRNA sequence
gcctagactccgaaagtgct

SEQ ID NO: 45724 - DNA, 20 bp, Artificial
  CRISPR gRNA sequence
ctccgaaagtgctgggaata

SEQ ID NO: 45725 - DNA, 20 bp, Artificial
  CRISPR gRNA sequence
tccgaaagtgctgggaatac

SEQ ID NO: 45726 - DNA, 20 bp, Artificial
  CRISPR gRNA sequence
caggtgtgaaccactgctcc

SEQ ID NO: 45727 - DNA, 20 bp, Artificial
  CRISPR gRNA sequence
aaatttaatttgcaaaataa

SEQ ID NO: 45728 - DNA, 20 bp, Artificial
  CRISPR gRNA sequence
ttaatttgcaaaataaaaga

SEQ ID NO: 45729 - DNA, 20 bp, Artificial
  CRISPR gRNA sequence
catgcaaacaaatacttccc

SEQ ID NO: 45730 - DNA, 20 bp, Artificial
  CRISPR gRNA sequence
atgcaaacaaatacttccca

SEQ ID NO: 45731 - DNA, 20 bp, Artificial
  CRISPR gRNA sequence
tgcaaacaaatacttcccaa

SEQ ID NO: 45732 - DNA, 20 bp, Artificial
  CRISPR gRNA sequence
gcaaacaaatacttcccaag

SEQ ID NO: 45733 - DNA, 20 bp, Artificial
  CRISPR gRNA sequence
caaatacttcccaaggggct

SEQ ID NO: 45734 - DNA, 20 bp, Artificial
  CRISPR gRNA sequence
ggggctaagaccatttgcct

SEQ ID NO: 45735 - DNA, 20 bp, Artificial
  CRISPR gRNA sequence
atttattgttttttcctacc

SEQ ID NO: 45736 - DNA, 20 bp, Artificial
  CRISPR gRNA sequence
tttattgttttttcctaccc

SEQ ID NO: 45737 - DNA, 20 bp, Artificial
  CRISPR gRNA sequence
attgttttttcctacccagg

SEQ ID NO: 45738 - DNA, 20 bp, Artificial
  CRISPR gRNA sequence
tgttttttcctacccaggca

SEQ ID NO: 45739 - DNA, 20 bp, Artificial
  CRISPR gRNA sequence
ttttcctacccaggcagagc

SEQ ID NO: 45740 - DNA, 20 bp, Artificial
  CRISPR gRNA sequence
tttcctacccaggcagagca

SEQ ID NO: 45741 - DNA, 20 bp, Artificial
  CRISPR gRNA sequence
ctacccaggcagagcaaggt

SEQ ID NO: 45742 - DNA, 20 bp, Artificial
  CRISPR gRNA sequence
tacccaggcagagcaaggtc

SEQ ID NO: 45743 - DNA, 20 bp, Artificial
  CRISPR gRNA sequence
acccaggcagagcaaggtca

SEQ ID NO: 45744 - DNA, 20 bp, Artificial
  CRISPR gRNA sequence
ggcagagcaaggtcagggct

SEQ ID NO: 45745 - DNA, 20 bp, Artificial
  CRISPR gRNA sequence
agcaaggtcagggctcagta

SEQ ID NO: 45746 - DNA, 20 bp, Artificial
  CRISPR gRNA sequence
gctcagtaaagacaataccc

SEQ ID NO: 45747 - DNA, 20 bp, Artificial
  CRISPR gRNA sequence
ctcagtaaagacaataccct

SEQ ID NO: 45748 - DNA, 20 bp, Artificial
  CRISPR gRNA sequence
aaagacaataccctgggttt

SEQ ID NO: 45749 - DNA, 20 bp, Artificial
  CRISPR gRNA sequence
aagacaataccctgggttta

SEQ ID NO: 45750 - DNA, 20 bp, Artificial
  CRISPR gRNA sequence
ggaaaaacctaccatttgca

SEQ ID NO: 45751 - DNA, 20 bp, Artificial
  CRISPR gRNA sequence
aacctaccatttgcatggat

SEQ ID NO: 45752 - DNA, 20 bp, Artificial
  CRISPR gRNA sequence
atgagaacacatatgcccct

SEQ ID NO: 45753 - DNA, 20 bp, Artificial
  CRISPR gRNA sequence
gagaactgatctgcgtgaat

SEQ ID NO: 45754 - DNA, 20 bp, Artificial
  CRISPR gRNA sequence
gaactgatctgcgtgaatca

SEQ ID NO: 45755 - DNA, 20 bp, Artificial
  CRISPR gRNA sequence
aatcagagaatcccacgtga

SEQ ID NO: 45756 - DNA, 20 bp, Artificial
  CRISPR gRNA sequence
cagagaatcccacgtgaaag

SEQ ID NO: 45757 - DNA, 20 bp, Artificial
  CRISPR gRNA sequence
tcccacgtgaaagtggcatt

SEQ ID NO: 45758 - DNA, 20 bp, Artificial
  CRISPR gRNA sequence
acgtgaaagtggcattcagc

SEQ ID NO: 45759 - DNA, 20 bp, Artificial
  CRISPR gRNA sequence
cgtgaaagtggcattcagcc

SEQ ID NO: 45760 - DNA, 20 bp, Artificial
  CRISPR gRNA sequence
aaagtggcattcagccgggc

SEQ ID NO: 45761 - DNA, 20 bp, Artificial
  CRISPR gRNA sequence
ggcattcagccgggccagcc

SEQ ID NO: 45762 - DNA, 20 bp, Artificial
  CRISPR gRNA sequence
cattcagccgggccagcccg

SEQ ID NO: 45763 - DNA, 20 bp, Artificial
  CRISPR gRNA sequence
cagcccggagatccctgaca

SEQ ID NO: 45764 - DNA, 20 bp, Artificial
  CRISPR gRNA sequence
gcccggagatccctgacaca

SEQ ID NO: 45765 - DNA, 20 bp, Artificial
  CRISPR gRNA sequence
cccggagatccctgacacag

SEQ ID NO: 45766 - DNA, 20 bp, Artificial
  CRISPR gRNA sequence
agatccctgacacagaggct

SEQ ID NO: 45767 - DNA, 20 bp, Artificial
  CRISPR gRNA sequence
gatccctgacacagaggctg

SEQ ID NO: 45768 - DNA, 20 bp, Artificial
  CRISPR gRNA sequence
ctgacacagaggctgaggtg

SEQ ID NO: 45769 - DNA, 20 bp, Artificial
  CRISPR gRNA sequence
acagaggctgaggtgaagct

SEQ ID NO: 45770 - DNA, 20 bp, Artificial
  CRISPR gRNA sequence
ggctgaggtgaagcttggca

SEQ ID NO: 45771 - DNA, 20 bp, Artificial
  CRISPR gRNA sequence
tgaagcttggcaaagaaatg

SEQ ID NO: 45772 - DNA, 20 bp, Artificial
  CRISPR gRNA sequence
aagcttggcaaagaaatgta

SEQ ID NO: 45773 - DNA, 20 bp, Artificial
  CRISPR gRNA sequence
agaaatgtagagactcctcc

SEQ ID NO: 45774 - DNA, 20 bp, Artificial
  CRISPR gRNA sequence
gaaatgtagagactcctcct

SEQ ID NO: 45775 - DNA, 20 bp, Artificial
  CRISPR gRNA sequence
tgtagagactcctcctgggc

SEQ ID NO: 45776 - DNA, 20 bp, Artificial
  CRISPR gRNA sequence
gtagagactcctcctgggcc

SEQ ID NO: 45777 - DNA, 20 bp, Artificial
  CRISPR gRNA sequence
tagagactcctcctgggcca

SEQ ID NO: 45778 - DNA, 20 bp, Artificial
  CRISPR gRNA sequence
agagactcctcctgggccag

SEQ ID NO: 45779 - DNA, 20 bp, Artificial
  CRISPR gRNA sequence
tcctcctgggccaggggctc

SEQ ID NO: 45780 - DNA, 20 bp, Artificial
  CRISPR gRNA sequence
gctctggatttgtttccacc

SEQ ID NO: 45781 - DNA, 20 bp, Artificial
  CRISPR gRNA sequence
tttgtttccacccagcctgc

SEQ ID NO: 45782 - DNA, 20 bp, Artificial
  CRISPR gRNA sequence
cacccagcctgcaagtccct

SEQ ID NO: 45783 - DNA, 20 bp, Artificial
  CRISPR gRNA sequence
cctgcaagtccctaagtctc

SEQ ID NO: 45784 - DNA, 20 bp, Artificial
  CRISPR gRNA sequence
caagtccctaagtctctggc

SEQ ID NO: 45785 - DNA, 20 bp, Artificial
  CRISPR gRNA sequence
cctaagtctctggccagtca

SEQ ID NO: 45786 - DNA, 20 bp, Artificial
  CRISPR gRNA sequence
ggccagtcacagctcactgc

SEQ ID NO: 45787 - DNA, 20 bp, Artificial
  CRISPR gRNA sequence
acagctcactgctggctctc

SEQ ID NO: 45788 - DNA, 20 bp, Artificial
  CRISPR gRNA sequence
ggctctcaagttttctcacc

SEQ ID NO: 45789 - DNA, 20 bp, Artificial
  CRISPR gRNA sequence
aagttttctcacctggacac

SEQ ID NO: 45790 - DNA, 20 bp, Artificial
  CRISPR gRNA sequence
agttttctcacctggacact

SEQ ID NO: 45791 - DNA, 20 bp, Artificial
  CRISPR gRNA sequence
gttttctcacctggacactg

SEQ ID NO: 45792 - DNA, 20 bp, Artificial
  CRISPR gRNA sequence
tccccacctgccatgacccc

SEQ ID NO: 45793 - DNA, 20 bp, Artificial
  CRISPR gRNA sequence
ccacctgccatgacccccag

SEQ ID NO: 45794 - DNA, 20 bp, Artificial
  CRISPR gRNA sequence
acccccagaagttttgctac

SEQ ID NO: 45795 - DNA, 20 bp, Artificial
  CRISPR gRNA sequence
gctaccagcatatgaattcc

SEQ ID NO: 45796 - DNA, 20 bp, Artificial
  CRISPR gRNA sequence
ctaccagcatatgaattcct

SEQ ID NO: 45797 - DNA, 20 bp, Artificial
  CRISPR gRNA sequence
atatgaattcctgggcgtgt

SEQ ID NO: 45798 - DNA, 20 bp, Artificial
  CRISPR gRNA sequence
tatgaattcctgggcgtgta

SEQ ID NO: 45799 - DNA, 20 bp, Artificial
  CRISPR gRNA sequence
gtgtaaggctttgcaaactg

SEQ ID NO: 45800 - DNA, 20 bp, Artificial
  CRISPR gRNA sequence
gtaaggctttgcaaactgta

SEQ ID NO: 45801 - DNA, 20 bp, Artificial
  CRISPR gRNA sequence
tttgcaaactgtagagttct

SEQ ID NO: 45802 - DNA, 20 bp, Artificial
  CRISPR gRNA sequence
aaactgtagagttcttagca

SEQ ID NO: 45803 - DNA, 20 bp, Artificial
  CRISPR gRNA sequence
ttcttagcacagcacctgca

SEQ ID NO: 45804 - DNA, 20 bp, Artificial
  CRISPR gRNA sequence
tcttagcacagcacctgcaa

SEQ ID NO: 45805 - DNA, 20 bp, Artificial
  CRISPR gRNA sequence
cagcacctgcaaaggccttt

SEQ ID NO: 45806 - DNA, 20 bp, Artificial
  CRISPR gRNA sequence
aaaggcctttaagctcctga

SEQ ID NO: 45807 - DNA, 20 bp, Artificial
  CRISPR gRNA sequence
ttaagctcctgaaagcctct

SEQ ID NO: 45808 - DNA, 20 bp, Artificial
  CRISPR gRNA sequence
tggtctattccctgcttttc

SEQ ID NO: 45809 - DNA, 20 bp, Artificial
  CRISPR gRNA sequence
ccctgcttttccagactgaa

SEQ ID NO: 45810 - DNA, 20 bp, Artificial
  CRISPR gRNA sequence
cctgcttttccagactgaac

SEQ ID NO: 45811 - DNA, 20 bp, Artificial
  CRISPR gRNA sequence
ttttccagactgaacaggaa

SEQ ID NO: 45812 - DNA, 20 bp, Artificial
  CRISPR gRNA sequence
agactgaacaggaacagtat

SEQ ID NO: 45813 - DNA, 20 bp, Artificial
  CRISPR gRNA sequence
aggaacagtatcggtgatgt

SEQ ID NO: 45814 - DNA, 20 bp, Artificial
  CRISPR gRNA sequence
tcggttgctgccacctttct

SEQ ID NO: 45815 - DNA, 20 bp, Artificial
  CRISPR gRNA sequence
cggttgctgccacctttctg

SEQ ID NO: 45816 - DNA, 20 bp, Artificial
  CRISPR gRNA sequence
tgccacctttctgaggctct

SEQ ID NO: 45817 - DNA, 20 bp, Artificial
  CRISPR gRNA sequence
gccacctttctgaggctctc

SEQ ID NO: 45818 - DNA, 20 bp, Artificial
  CRISPR gRNA sequence
ccacctttctgaggctctca

SEQ ID NO: 45819 - DNA, 20 bp, Artificial
  CRISPR gRNA sequence
gaggctctcagggctgccac

SEQ ID NO: 45820 - DNA, 20 bp, Artificial
  CRISPR gRNA sequence
tctcagggctgccaccagcc

SEQ ID NO: 45821 - DNA, 20 bp, Artificial
  CRISPR gRNA sequence
tcagggctgccaccagccta

SEQ ID NO: 45822 - DNA, 20 bp, Artificial
  CRISPR gRNA sequence
cagggctgccaccagcctag

SEQ ID NO: 45823 - DNA, 20 bp, Artificial
  CRISPR gRNA sequence
gggctgccaccagcctagag

SEQ ID NO: 45824 - DNA, 20 bp, Artificial
  CRISPR gRNA sequence
tgccaccagcctagaggagc

SEQ ID NO: 45825 - DNA, 20 bp, Artificial
  CRISPR gRNA sequence
ccaccagcctagaggagctg

SEQ ID NO: 45826 - DNA, 20 bp, Artificial
  CRISPR gRNA sequence
cagcctagaggagctggagt

SEQ ID NO: 45827 - DNA, 20 bp, Artificial
  CRISPR gRNA sequence
tgagttgcccattctgcccc

SEQ ID NO: 45828 - DNA, 20 bp, Artificial
  CRISPR gRNA sequence
gcccattctgcccccagacc

SEQ ID NO: 45829 - DNA, 20 bp, Artificial
  CRISPR gRNA sequence
cccattctgcccccagaccc

SEQ ID NO: 45830 - DNA, 20 bp, Artificial
  CRISPR gRNA sequence
ccccagacccaggacaattt

SEQ ID NO: 45831 - DNA, 20 bp, Artificial
  CRISPR gRNA sequence
agacccaggacaattttggc

SEQ ID NO: 45832 - DNA, 20 bp, Artificial
  CRISPR gRNA sequence
gacccaggacaattttggcc

SEQ ID NO: 45833 - DNA, 20 bp, Artificial
  CRISPR gRNA sequence
caggacaattttggccggga

SEQ ID NO: 45834 - DNA, 20 bp, Artificial
  CRISPR gRNA sequence
ttttggccgggaaagatgac

SEQ ID NO: 45835 - DNA, 20 bp, Artificial
  CRISPR gRNA sequence
tttggccgggaaagatgaca

SEQ ID NO: 45836 - DNA, 20 bp, Artificial
  CRISPR gRNA sequence
ttggccgggaaagatgacaa

SEQ ID NO: 45837 - DNA, 20 bp, Artificial
  CRISPR gRNA sequence
ccgggaaagatgacaagggc

SEQ ID NO: 45838 - DNA, 20 bp, Artificial
  CRISPR gRNA sequence
cgggaaagatgacaagggca

SEQ ID NO: 45839 - DNA, 20 bp, Artificial
  CRISPR gRNA sequence
gggaaagatgacaagggcaa

SEQ ID NO: 45840 - DNA, 20 bp, Artificial
  CRISPR gRNA sequence
ggaaagatgacaagggcaag

SEQ ID NO: 45841 - DNA, 20 bp, Artificial
  CRISPR gRNA sequence
acaagggcaaggggctacct

SEQ ID NO: 45842 - DNA, 20 bp, Artificial
  CRISPR gRNA sequence
tctacactgtgtaaacaacc

SEQ ID NO: 45843 - DNA, 20 bp, Artificial
  CRISPR gRNA sequence
ctacactgtgtaaacaacct

SEQ ID NO: 45844 - DNA, 20 bp, Artificial
  CRISPR gRNA sequence
tacactgtgtaaacaacctg

SEQ ID NO: 45845 - DNA, 20 bp, Artificial
  CRISPR gRNA sequence
tgtgtaaacaacctggggcc

SEQ ID NO: 45846 - DNA, 20 bp, Artificial
  CRISPR gRNA sequence
gtaaacaacctggggcctag

SEQ ID NO: 45847 - DNA, 20 bp, Artificial
  CRISPR gRNA sequence
caacctggggcctagaagct

SEQ ID NO: 45848 - DNA, 20 bp, Artificial
  CRISPR gRNA sequence
aacctggggcctagaagctt

SEQ ID NO: 45849 - DNA, 20 bp, Artificial
  CRISPR gRNA sequence
acctggggcctagaagcttg

SEQ ID NO: 45850 - DNA, 20 bp, Artificial
  CRISPR gRNA sequence
cctggggcctagaagcttgg

SEQ ID NO: 45851 - DNA, 20 bp, Artificial
  CRISPR gRNA sequence
ctagaagcttgggggaccca

SEQ ID NO: 45852 - DNA, 20 bp, Artificial
  CRISPR gRNA sequence
aagcttgggggacccaaaga

SEQ ID NO: 45853 - DNA, 20 bp, Artificial
  CRISPR gRNA sequence
agcttgggggacccaaagac

SEQ ID NO: 45854 - DNA, 20 bp, Artificial
  CRISPR gRNA sequence
gggacccaaagacaggatgt

SEQ ID NO: 45855 - DNA, 20 bp, Artificial
  CRISPR gRNA sequence
gacccaaagacaggatgtaa

SEQ ID NO: 45856 - DNA, 20 bp, Artificial
  CRISPR gRNA sequence
ggatgtaagagtgtcaattg

SEQ ID NO: 45857 - DNA, 20 bp, Artificial
  CRISPR gRNA sequence
gtaagagtgtcaattgtagc

SEQ ID NO: 45858 - DNA, 20 bp, Artificial
  CRISPR gRNA sequence
aagagtgtcaattgtagcaa

SEQ ID NO: 45859 - DNA, 20 bp, Artificial
  CRISPR gRNA sequence
agagtgtcaattgtagcaag

SEQ ID NO: 45860 - DNA, 20 bp, Artificial
  CRISPR gRNA sequence
gagtgtcaattgtagcaaga

SEQ ID NO: 45861 - DNA, 20 bp, Artificial
  CRISPR gRNA sequence
caattgtagcaagagggatt

SEQ ID NO: 45862 - DNA, 20 bp, Artificial
  CRISPR gRNA sequence
aattgtagcaagagggattt

SEQ ID NO: 45863 - DNA, 20 bp, Artificial
  CRISPR gRNA sequence
gtagcaagagggatttaggt

SEQ ID NO: 45864 - DNA, 20 bp, Artificial
  CRISPR gRNA sequence
gagggatttaggtcagacaa

SEQ ID NO: 45865 - DNA, 20 bp, Artificial
  CRISPR gRNA sequence
agggatttaggtcagacaat

SEQ ID NO: 45866 - DNA, 20 bp, Artificial
  CRISPR gRNA sequence
gggatttaggtcagacaatg

SEQ ID NO: 45867 - DNA, 20 bp, Artificial
  CRISPR gRNA sequence
gatttaggtcagacaatggg

SEQ ID NO: 45868 - DNA, 20 bp, Artificial
  CRISPR gRNA sequence
aatggggagaacatcctaaa

SEQ ID NO: 45869 - DNA, 20 bp, Artificial
  CRISPR gRNA sequence
ggggagaacatcctaaacag

SEQ ID NO: 45870 - DNA, 20 bp, Artificial
  CRISPR gRNA sequence
gaacatcctaaacagaagcc

SEQ ID NO: 45871 - DNA, 20 bp, Artificial
  CRISPR gRNA sequence
aacatcctaaacagaagcca

SEQ ID NO: 45872 - DNA, 20 bp, Artificial
  CRISPR gRNA sequence
acatcctaaacagaagccaa

SEQ ID NO: 45873 - DNA, 20 bp, Artificial
  CRISPR gRNA sequence
cctaaacagaagccaagggt

SEQ ID NO: 45874 - DNA, 20 bp, Artificial
  CRISPR gRNA sequence
ctaaacagaagccaagggtt

SEQ ID NO: 45875 - DNA, 20 bp, Artificial
  CRISPR gRNA sequence
aaacagaagccaagggttag

SEQ ID NO: 45876 - DNA, 20 bp, Artificial
  CRISPR gRNA sequence
ttaggagctgtcactcaaca

SEQ ID NO: 45877 - DNA, 20 bp, Artificial
  CRISPR gRNA sequence
taggagctgtcactcaacat

SEQ ID NO: 45878 - DNA, 20 bp, Artificial
  CRISPR gRNA sequence
aggagctgtcactcaacatg

SEQ ID NO: 45879 - DNA, 20 bp, Artificial
  CRISPR gRNA sequence
tgtcactcaacatggggtga

SEQ ID NO: 45880 - DNA, 20 bp, Artificial
  CRISPR gRNA sequence
gtcactcaacatggggtgat

SEQ ID NO: 45881 - DNA, 20 bp, Artificial
  CRISPR gRNA sequence
tcactcaacatggggtgatg

SEQ ID NO: 45882 - DNA, 20 bp, Artificial
  CRISPR gRNA sequence
ggtgatggggctctctgtgt

SEQ ID NO: 45883 - DNA, 20 bp, Artificial
  CRISPR gRNA sequence
tggggctctctgtgtgagtc

SEQ ID NO: 45884 - DNA, 20 bp, Artificial
  CRISPR gRNA sequence
ggggctctctgtgtgagtcg

SEQ ID NO: 45885 - DNA, 20 bp, Artificial
  CRISPR gRNA sequence
gtgtgagtcgaggcccttcc

SEQ ID NO: 45886 - DNA, 20 bp, Artificial
  CRISPR gRNA sequence
tgtgagtcgaggcccttcct

SEQ ID NO: 45887 - DNA, 20 bp, Artificial
  CRISPR gRNA sequence
cgaggcccttcctgggactt

SEQ ID NO: 45888 - DNA, 20 bp, Artificial
  CRISPR gRNA sequence
tcagcctccccttctttttc

SEQ ID NO: 45889 - DNA, 20 bp, Artificial
  CRISPR gRNA sequence
cagcctccccttctttttct

SEQ ID NO: 45890 - DNA, 20 bp, Artificial
  CRISPR gRNA sequence
gcctccccttctttttctgg

SEQ ID NO: 45891 - DNA, 20 bp, Artificial
  CRISPR gRNA sequence
tccccttctttttctgggag

SEQ ID NO: 45892 - DNA, 20 bp, Artificial
  CRISPR gRNA sequence
ccccttctttttctgggagt

SEQ ID NO: 45893 - DNA, 20 bp, Artificial
  CRISPR gRNA sequence
cccttctttttctgggagtg

SEQ ID NO: 45894 - DNA, 20 bp, Artificial
  CRISPR gRNA sequence
ctttttctgggagtggggtg

SEQ ID NO: 45895 - DNA, 20 bp, Artificial
  CRISPR gRNA sequence
tctgggagtggggtgtggac

SEQ ID NO: 45896 - DNA, 20 bp, Artificial
  CRISPR gRNA sequence
gagtggggtgtggacaagat

SEQ ID NO: 45897 - DNA, 20 bp, Artificial
  CRISPR gRNA sequence
ggggtgtggacaagatgaga

SEQ ID NO: 45898 - DNA, 20 bp, Artificial
  CRISPR gRNA sequence
gtgtggacaagatgagacgg

SEQ ID NO: 45899 - DNA, 20 bp, Artificial
  CRISPR gRNA sequence
tggacaagatgagacggcag

SEQ ID NO: 45900 - DNA, 20 bp, Artificial
  CRISPR gRNA sequence
ggacaagatgagacggcaga

SEQ ID NO: 45901 - DNA, 20 bp, Artificial
  CRISPR gRNA sequence
gagacggcagaaggctgatg

SEQ ID NO: 45902 - DNA, 20 bp, Artificial
  CRISPR gRNA sequence
atgaagctgttttctccccc

SEQ ID NO: 45903 - DNA, 20 bp, Artificial
  CRISPR gRNA sequence
ctgttttctcccccaagctt

SEQ ID NO: 45904 - DNA, 20 bp, Artificial
  CRISPR gRNA sequence
ccccaagcttgagccacaac

SEQ ID NO: 45905 - DNA, 20 bp, Artificial
  CRISPR gRNA sequence
agcttgagccacaaccagat

SEQ ID NO: 45906 - DNA, 20 bp, Artificial
  CRISPR gRNA sequence
cttgagccacaaccagattg

SEQ ID NO: 45907 - DNA, 20 bp, Artificial
  CRISPR gRNA sequence
cacaaccagattggagacgc

SEQ ID NO: 45908 - DNA, 20 bp, Artificial
  CRISPR gRNA sequence
agattggagacgctggtgtc

SEQ ID NO: 45909 - DNA, 20 bp, Artificial
  CRISPR gRNA sequence
agacgctggtgtccagcact

SEQ ID NO: 45910 - DNA, 20 bp, Artificial
  CRISPR gRNA sequence
cacttagctaccatcctgcc

SEQ ID NO: 45911 - DNA, 20 bp, Artificial
  CRISPR gRNA sequence
acttagctaccatcctgcct

SEQ ID NO: 45912 - DNA, 20 bp, Artificial
  CRISPR gRNA sequence
taccatcctgcctgggctgc

SEQ ID NO: 45913 - DNA, 20 bp, Artificial
  CRISPR gRNA sequence
ccatcctgcctgggctgcca

SEQ ID NO: 45914 - DNA, 20 bp, Artificial
  CRISPR gRNA sequence
ctgcctgggctgccagagct

SEQ ID NO: 45915 - DNA, 20 bp, Artificial
  CRISPR gRNA sequence
tgcctgggctgccagagctc

SEQ ID NO: 45916 - DNA, 20 bp, Artificial
  CRISPR gRNA sequence
ctgggctgccagagctcagg

SEQ ID NO: 45917 - DNA, 20 bp, Artificial
  CRISPR gRNA sequence
gctgccagagctcaggaaga

SEQ ID NO: 45918 - DNA, 20 bp, Artificial
  CRISPR gRNA sequence
tgccagagctcaggaagata

SEQ ID NO: 45919 - DNA, 20 bp, Artificial
  CRISPR gRNA sequence
agagctcaggaagatagagt

SEQ ID NO: 45920 - DNA, 20 bp, Artificial
  CRISPR gRNA sequence
gctcaggaagatagagtgag

SEQ ID NO: 45921 - DNA, 20 bp, Artificial
  CRISPR gRNA sequence
aggaagatagagtgagtagc

SEQ ID NO: 45922 - DNA, 20 bp, Artificial
  CRISPR gRNA sequence
agagtgagtagccagcccta

SEQ ID NO: 45923 - DNA, 20 bp, Artificial
  CRISPR gRNA sequence
agtgagtagccagccctaca

SEQ ID NO: 45924 - DNA, 20 bp, Artificial
  CRISPR gRNA sequence
gtgagtagccagccctacag

SEQ ID NO: 45925 - DNA, 20 bp, Artificial
  CRISPR gRNA sequence
gagtagccagccctacagag

SEQ ID NO: 45926 - DNA, 20 bp, Artificial
  CRISPR gRNA sequence
agtagccagccctacagagg

SEQ ID NO: 45927 - DNA, 20 bp, Artificial
  CRISPR gRNA sequence
gtagccagccctacagagga

SEQ ID NO: 45928 - DNA, 20 bp, Artificial
  CRISPR gRNA sequence
agccctacagaggagggcca

SEQ ID NO: 45929 - DNA, 20 bp, Artificial
  CRISPR gRNA sequence
gccctacagaggagggccac

SEQ ID NO: 45930 - DNA, 20 bp, Artificial
  CRISPR gRNA sequence
ccctacagaggagggccaca

SEQ ID NO: 45931 - DNA, 20 bp, Artificial
  CRISPR gRNA sequence
cctacagaggagggccacag

SEQ ID NO: 45932 - DNA, 20 bp, Artificial
  CRISPR gRNA sequence
gggccacaggggtcacacga

SEQ ID NO: 45933 - DNA, 20 bp, Artificial
  CRISPR gRNA sequence
caggggtcacacgatggtcc

SEQ ID NO: 45934 - DNA, 20 bp, Artificial
  CRISPR gRNA sequence
aggggtcacacgatggtcct

SEQ ID NO: 45935 - DNA, 20 bp, Artificial
  CRISPR gRNA sequence
gggtcacacgatggtcctag

SEQ ID NO: 45936 - DNA, 20 bp, Artificial
  CRISPR gRNA sequence
acgatggtcctaggagatac

SEQ ID NO: 45937 - DNA, 20 bp, Artificial
  CRISPR gRNA sequence
tcctaggagatactggcccc

SEQ ID NO: 45938 - DNA, 20 bp, Artificial
  CRISPR gRNA sequence
ggagatactggcccctagct

SEQ ID NO: 45939 - DNA, 20 bp, Artificial
  CRISPR gRNA sequence
gagatactggcccctagctg

SEQ ID NO: 45940 - DNA, 20 bp, Artificial
  CRISPR gRNA sequence
tactggcccctagctgaggc

SEQ ID NO: 45941 - DNA, 20 bp, Artificial
  CRISPR gRNA sequence
gcccctagctgaggccagca

SEQ ID NO: 45942 - DNA, 20 bp, Artificial
  CRISPR gRNA sequence
aatctcccctgcgccaacct

SEQ ID NO: 45943 - DNA, 20 bp, Artificial
  CRISPR gRNA sequence
cctgcgccaacctcagtgtc

SEQ ID NO: 45944 - DNA, 20 bp, Artificial
  CRISPR gRNA sequence
ctgcgccaacctcagtgtcc

SEQ ID NO: 45945 - DNA, 20 bp, Artificial
  CRISPR gRNA sequence
cgccaacctcagtgtccagg

SEQ ID NO: 45946 - DNA, 20 bp, Artificial
  CRISPR gRNA sequence
caacctcagtgtccaggcag

SEQ ID NO: 45947 - DNA, 20 bp, Artificial
  CRISPR gRNA sequence
aacctcagtgtccaggcagt

SEQ ID NO: 45948 - DNA, 20 bp, Artificial
  CRISPR gRNA sequence
acctcagtgtccaggcagtg

SEQ ID NO: 45949 - DNA, 20 bp, Artificial
  CRISPR gRNA sequence
agtgtccaggcagtggggct

SEQ ID NO: 45950 - DNA, 20 bp, Artificial
  CRISPR gRNA sequence
agtggggctcggtgacctcc

SEQ ID NO: 45951 - DNA, 20 bp, Artificial
  CRISPR gRNA sequence
tgacctcctggccctcactg

SEQ ID NO: 45952 - DNA, 20 bp, Artificial
  CRISPR gRNA sequence
gacctcctggccctcactgc

SEQ ID NO: 45953 - DNA, 20 bp, Artificial
  CRISPR gRNA sequence
ggccctcactgcgggacctt

SEQ ID NO: 45954 - DNA, 20 bp, Artificial
  CRISPR gRNA sequence
tgcgggaccttaagccaccc

SEQ ID NO: 45955 - DNA, 20 bp, Artificial
  CRISPR gRNA sequence
ccccagcccctgctcttctc

SEQ ID NO: 45956 - DNA, 20 bp, Artificial
  CRISPR gRNA sequence
cccagcccctgctcttctct

SEQ ID NO: 45957 - DNA, 20 bp, Artificial
  CRISPR gRNA sequence
ggcctttctgcctcattgtc

SEQ ID NO: 45958 - DNA, 20 bp, Artificial
  CRISPR gRNA sequence
gcctttctgcctcattgtct

SEQ ID NO: 45959 - DNA, 20 bp, Artificial
  CRISPR gRNA sequence
tttctgcctcattgtctggg

SEQ ID NO: 45960 - DNA, 20 bp, Artificial
  CRISPR gRNA sequence
ttctgcctcattgtctgggt

SEQ ID NO: 45961 - DNA, 20 bp, Artificial
  CRISPR gRNA sequence
tcattgtctgggtaggtgtg

SEQ ID NO: 45962 - DNA, 20 bp, Artificial
  CRISPR gRNA sequence
tctgggtaggtgtgtggtgt

SEQ ID NO: 45963 - DNA, 20 bp, Artificial
  CRISPR gRNA sequence
ctgggtaggtgtgtggtgtc

SEQ ID NO: 45964 - DNA, 20 bp, Artificial
  CRISPR gRNA sequence
tgggtaggtgtgtggtgtcg

SEQ ID NO: 45965 - DNA, 20 bp, Artificial
  CRISPR gRNA sequence
gggtaggtgtgtggtgtcgg

SEQ ID NO: 45966 - DNA, 20 bp, Artificial
  CRISPR gRNA sequence
ggtaggtgtgtggtgtcggg

SEQ ID NO: 45967 - DNA, 20 bp, Artificial
  CRISPR gRNA sequence
ggtgtcggggggttgtctct

SEQ ID NO: 45968 - DNA, 20 bp, Artificial
  CRISPR gRNA sequence
gtgtcggggggttgtctctt

SEQ ID NO: 45969 - DNA, 20 bp, Artificial
  CRISPR gRNA sequence
gttgtctcttaggccccctg

SEQ ID NO: 45970 - DNA, 20 bp, Artificial
  CRISPR gRNA sequence
gtctcttaggccccctgaag

SEQ ID NO: 45971 - DNA, 20 bp, Artificial
  CRISPR gRNA sequence
tctcttaggccccctgaagc

SEQ ID NO: 45972 - DNA, 20 bp, Artificial
  CRISPR gRNA sequence
ctcttaggccccctgaagca

SEQ ID NO: 45973 - DNA, 20 bp, Artificial
  CRISPR gRNA sequence
tcttaggccccctgaagcag

SEQ ID NO: 45974 - DNA, 20 bp, Artificial
  CRISPR gRNA sequence
taggccccctgaagcagggg

SEQ ID NO: 45975 - DNA, 20 bp, Artificial
  CRISPR gRNA sequence
gccccctgaagcaggggtgg

SEQ ID NO: 45976 - DNA, 20 bp, Artificial
  CRISPR gRNA sequence
tgaagcaggggtggcagacc

SEQ ID NO: 45977 - DNA, 20 bp, Artificial
  CRISPR gRNA sequence
agcaggggtggcagacccag

SEQ ID NO: 45978 - DNA, 20 bp, Artificial
  CRISPR gRNA sequence
ggcagacccagcagatgtgc

SEQ ID NO: 45979 - DNA, 20 bp, Artificial
  CRISPR gRNA sequence
gcagacccagcagatgtgct

SEQ ID NO: 45980 - DNA, 20 bp, Artificial
  CRISPR gRNA sequence
cagacccagcagatgtgctg

SEQ ID NO: 45981 - DNA, 20 bp, Artificial
  CRISPR gRNA sequence
cagcagatgtgctggggtgt

SEQ ID NO: 45982 - DNA, 20 bp, Artificial
  CRISPR gRNA sequence
agcagatgtgctggggtgtc

SEQ ID NO: 45983 - DNA, 20 bp, Artificial
  CRISPR gRNA sequence
gcagatgtgctggggtgtcg

SEQ ID NO: 45984 - DNA, 20 bp, Artificial
  CRISPR gRNA sequence
agatgtgctggggtgtcggg

SEQ ID NO: 45985 - DNA, 20 bp, Artificial
  CRISPR gRNA sequence
atgtgctggggtgtcgggga

SEQ ID NO: 45986 - DNA, 20 bp, Artificial
  CRISPR gRNA sequence
tgtgctggggtgtcggggag

SEQ ID NO: 45987 - DNA, 20 bp, Artificial
  CRISPR gRNA sequence
gtgctggggtgtcggggaga

SEQ ID NO: 45988 - DNA, 20 bp, Artificial
  CRISPR gRNA sequence
tgctggggtgtcggggagag

SEQ ID NO: 45989 - DNA, 20 bp, Artificial
  CRISPR gRNA sequence
gctggggtgtcggggagagg

SEQ ID NO: 45990 - DNA, 20 bp, Artificial
  CRISPR gRNA sequence
gtgtcggggagagggggcat

SEQ ID NO: 45991 - DNA, 20 bp, Artificial
  CRISPR gRNA sequence
gtcggggagagggggcatca

SEQ ID NO: 45992 - DNA, 20 bp, Artificial
  CRISPR gRNA sequence
tcggggagagggggcatcag

SEQ ID NO: 45993 - DNA, 20 bp, Artificial
  CRISPR gRNA sequence
gggggcatcagaggacctga

SEQ ID NO: 45994 - DNA, 20 bp, Artificial
  CRISPR gRNA sequence
tgatggctgcccccctccca

SEQ ID NO: 45995 - DNA, 20 bp, Artificial
  CRISPR gRNA sequence
gcccccctcccacagcctct

SEQ ID NO: 45996 - DNA, 20 bp, Artificial
  CRISPR gRNA sequence
cccccctcccacagcctctc

SEQ ID NO: 45997 - DNA, 20 bp, Artificial
  CRISPR gRNA sequence
ccccctcccacagcctctca

SEQ ID NO: 45998 - DNA, 20 bp, Artificial
  CRISPR gRNA sequence
tcccacagcctctcagggaa

SEQ ID NO: 45999 - DNA, 20 bp, Artificial
  CRISPR gRNA sequence
agcctctcagggaatagcat

SEQ ID NO: 46000 - DNA, 20 bp, Artificial
  CRISPR gRNA sequence
ctcagggaatagcatcagct

SEQ ID NO: 46001 - DNA, 20 bp, Artificial
  CRISPR gRNA sequence
gggaatagcatcagctcagc

SEQ ID NO: 46002 - DNA, 20 bp, Artificial
  CRISPR gRNA sequence
ggaatagcatcagctcagcc

SEQ ID NO: 46003 - DNA, 20 bp, Artificial
  CRISPR gRNA sequence
gaatagcatcagctcagccg

SEQ ID NO: 46004 - DNA, 20 bp, Artificial
  CRISPR gRNA sequence
aatagcatcagctcagccgg

SEQ ID NO: 46005 - DNA, 20 bp, Artificial
  CRISPR gRNA sequence
tagcatcagctcagccgggg

SEQ ID NO: 46006 - DNA, 20 bp, Artificial
  CRISPR gRNA sequence
tcagctcagccgggggagtg

SEQ ID NO: 46007 - DNA, 20 bp, Artificial
  CRISPR gRNA sequence
ctcagccgggggagtgcagt

SEQ ID NO: 46008 - DNA, 20 bp, Artificial
  CRISPR gRNA sequence
agccgggggagtgcagttgg

SEQ ID NO: 46009 - DNA, 20 bp, Artificial
  CRISPR gRNA sequence
ccgggggagtgcagttggca

SEQ ID NO: 46010 - DNA, 20 bp, Artificial
  CRISPR gRNA sequence
gcagagtctctcgttctttg

SEQ ID NO: 46011 - DNA, 20 bp, Artificial
  CRISPR gRNA sequence
cagagtctctcgttctttgc

SEQ ID NO: 46012 - DNA, 20 bp, Artificial
  CRISPR gRNA sequence
tctcgttctttgcaggcgcc

SEQ ID NO: 46013 - DNA, 20 bp, Artificial
  CRISPR gRNA sequence
tcgttctttgcaggcgcctg

SEQ ID NO: 46014 - DNA, 20 bp, Artificial
  CRISPR gRNA sequence
cgttctttgcaggcgcctgg

SEQ ID NO: 46015 - DNA, 20 bp, Artificial
  CRISPR gRNA sequence
ttctttgcaggcgcctggag

SEQ ID NO: 46016 - DNA, 20 bp, Artificial
  CRISPR gRNA sequence
gcgcctggaggagttgatgt

SEQ ID NO: 46017 - DNA, 20 bp, Artificial
  CRISPR gRNA sequence
agttgatgtgagtgtctgcc

SEQ ID NO: 46018 - DNA, 20 bp, Artificial
  CRISPR gRNA sequence
gttgatgtgagtgtctgccc

SEQ ID NO: 46019 - DNA, 20 bp, Artificial
  CRISPR gRNA sequence
gatgtgagtgtctgcccagg

SEQ ID NO: 46020 - DNA, 20 bp, Artificial
  CRISPR gRNA sequence
cctctgccctctgtgccccc

SEQ ID NO: 46021 - DNA, 20 bp, Artificial
  CRISPR gRNA sequence
ctctgccctctgtgcccccc

SEQ ID NO: 46022 - DNA, 20 bp, Artificial
  CRISPR gRNA sequence
ctgtgccccccaggtccacc

SEQ ID NO: 46023 - DNA, 20 bp, Artificial
  CRISPR gRNA sequence
ccacctggcctcctctcccg

SEQ ID NO: 46024 - DNA, 20 bp, Artificial
  CRISPR gRNA sequence
cctggcctcctctcccgcag

SEQ ID NO: 46025 - DNA, 20 bp, Artificial
  CRISPR gRNA sequence
ctggcctcctctcccgcagt

SEQ ID NO: 46026 - DNA, 20 bp, Artificial
  CRISPR gRNA sequence
ctcctctcccgcagtgggca

SEQ ID NO: 46027 - DNA, 20 bp, Artificial
  CRISPR gRNA sequence
tcctctcccgcagtgggcac

SEQ ID NO: 46028 - DNA, 20 bp, Artificial
  CRISPR gRNA sequence
cctctcccgcagtgggcaca

SEQ ID NO: 46029 - DNA, 20 bp, Artificial
  CRISPR gRNA sequence
ctcccgcagtgggcacaggg

SEQ ID NO: 46030 - DNA, 20 bp, Artificial
  CRISPR gRNA sequence
tcccgcagtgggcacagggc

SEQ ID NO: 46031 - DNA, 20 bp, Artificial
  CRISPR gRNA sequence
cccgcagtgggcacagggca

SEQ ID NO: 46032 - DNA, 20 bp, Artificial
  CRISPR gRNA sequence
gcagtgggcacagggcaggg

SEQ ID NO: 46033 - DNA, 20 bp, Artificial
  CRISPR gRNA sequence
cagtgggcacagggcagggc

SEQ ID NO: 46034 - DNA, 20 bp, Artificial
  CRISPR gRNA sequence
agtgggcacagggcagggcg

SEQ ID NO: 46035 - DNA, 20 bp, Artificial
  CRISPR gRNA sequence
gtgggcacagggcagggcgg

SEQ ID NO: 46036 - DNA, 20 bp, Artificial
  CRISPR gRNA sequence
cagggcagggcgggggtccc

SEQ ID NO: 46037 - DNA, 20 bp, Artificial
  CRISPR gRNA sequence
ggcagggcgggggtcccgag

SEQ ID NO: 46038 - DNA, 20 bp, Artificial
  CRISPR gRNA sequence
gcagggcgggggtcccgagt

SEQ ID NO: 46039 - DNA, 20 bp, Artificial
  CRISPR gRNA sequence
gggcgggggtcccgagtggg

SEQ ID NO: 46040 - DNA, 20 bp, Artificial
  CRISPR gRNA sequence
ggcgggggtcccgagtgggc

SEQ ID NO: 46041 - DNA, 20 bp, Artificial
  CRISPR gRNA sequence
gggtcccgagtgggcaggcc

SEQ ID NO: 46042 - DNA, 20 bp, Artificial
  CRISPR gRNA sequence
tgctcattcctctcctcttc

SEQ ID NO: 46043 - DNA, 20 bp, Artificial
  CRISPR gRNA sequence
gctcattcctctcctcttcc

SEQ ID NO: 46044 - DNA, 20 bp, Artificial
  CRISPR gRNA sequence
ttcctctcctcttccaggct

SEQ ID NO: 46045 - DNA, 20 bp, Artificial
  CRISPR gRNA sequence
caggcttggctgcaatgccc

SEQ ID NO: 46046 - DNA, 20 bp, Artificial
  CRISPR gRNA sequence
aggcttggctgcaatgccct

SEQ ID NO: 46047 - DNA, 20 bp, Artificial
  CRISPR gRNA sequence
ggcttggctgcaatgccctg

SEQ ID NO: 46048 - DNA, 20 bp, Artificial
  CRISPR gRNA sequence
gcttggctgcaatgccctgg

SEQ ID NO: 46049 - DNA, 20 bp, Artificial
  CRISPR gRNA sequence
caatgccctgggggatccca

SEQ ID NO: 46050 - DNA, 20 bp, Artificial
  CRISPR gRNA sequence
cctgggggatcccacagccc

SEQ ID NO: 46051 - DNA, 20 bp, Artificial
  CRISPR gRNA sequence
ctgggggatcccacagccct

SEQ ID NO: 46052 - DNA, 20 bp, Artificial
  CRISPR gRNA sequence
tgggggatcccacagccctg

SEQ ID NO: 46053 - DNA, 20 bp, Artificial
  CRISPR gRNA sequence
ggatcccacagccctggggc

SEQ ID NO: 46054 - DNA, 20 bp, Artificial
  CRISPR gRNA sequence
ccacagccctggggctggct

SEQ ID NO: 46055 - DNA, 20 bp, Artificial
  CRISPR gRNA sequence
cacagccctggggctggctc

SEQ ID NO: 46056 - DNA, 20 bp, Artificial
  CRISPR gRNA sequence
cagccctggggctggctcag

SEQ ID NO: 46057 - DNA, 20 bp, Artificial
  CRISPR gRNA sequence
ggctggctcaggagctgccc

SEQ ID NO: 46058 - DNA, 20 bp, Artificial
  CRISPR gRNA sequence
caggagctgccccagcacct

SEQ ID NO: 46059 - DNA, 20 bp, Artificial
  CRISPR gRNA sequence
aggagctgccccagcacctg

SEQ ID NO: 46060 - DNA, 20 bp, Artificial
  CRISPR gRNA sequence
ggagctgccccagcacctga

SEQ ID NO: 46061 - DNA, 20 bp, Artificial
  CRISPR gRNA sequence
cccagcacctgagggtccta

SEQ ID NO: 46062 - DNA, 20 bp, Artificial
  CRISPR gRNA sequence
gcacctgagggtcctacagt

SEQ ID NO: 46063 - DNA, 20 bp, Artificial
  CRISPR gRNA sequence
cctgagggtcctacagtgag

SEQ ID NO: 46064 - DNA, 20 bp, Artificial
  CRISPR gRNA sequence
ggccccctgcccataccatg

SEQ ID NO: 46065 - DNA, 20 bp, Artificial
  CRISPR gRNA sequence
gccccctgcccataccatgc

SEQ ID NO: 46066 - DNA, 20 bp, Artificial
  CRISPR gRNA sequence
ccccctgcccataccatgca

SEQ ID NO: 46067 - DNA, 20 bp, Artificial
  CRISPR gRNA sequence
ctgcccataccatgcagggc

SEQ ID NO: 46068 - DNA, 20 bp, Artificial
  CRISPR gRNA sequence
cccataccatgcagggctgg

SEQ ID NO: 46069 - DNA, 20 bp, Artificial
  CRISPR gRNA sequence
ccataccatgcagggctggt

SEQ ID NO: 46070 - DNA, 20 bp, Artificial
  CRISPR gRNA sequence
cataccatgcagggctggtg

SEQ ID NO: 46071 - DNA, 20 bp, Artificial
  CRISPR gRNA sequence
taccatgcagggctggtggg

SEQ ID NO: 46072 - DNA, 20 bp, Artificial
  CRISPR gRNA sequence
accatgcagggctggtgggg

SEQ ID NO: 46073 - DNA, 20 bp, Artificial
  CRISPR gRNA sequence
catgcagggctggtggggag

SEQ ID NO: 46074 - DNA, 20 bp, Artificial
  CRISPR gRNA sequence
atgcagggctggtggggagg

SEQ ID NO: 46075 - DNA, 20 bp, Artificial
  CRISPR gRNA sequence
tgcagggctggtggggagga

SEQ ID NO: 46076 - DNA, 20 bp, Artificial
  CRISPR gRNA sequence
ctggtggggaggagggtcct

SEQ ID NO: 46077 - DNA, 20 bp, Artificial
  CRISPR gRNA sequence
tggtggggaggagggtcctc

SEQ ID NO: 46078 - DNA, 20 bp, Artificial
  CRISPR gRNA sequence
gtggggaggagggtcctcgg

SEQ ID NO: 46079 - DNA, 20 bp, Artificial
  CRISPR gRNA sequence
gggaggagggtcctcgggag

SEQ ID NO: 46080 - DNA, 20 bp, Artificial
  CRISPR gRNA sequence
aggagggtcctcgggagcag

SEQ ID NO: 46081 - DNA, 20 bp, Artificial
  CRISPR gRNA sequence
ggagggtcctcgggagcagt

SEQ ID NO: 46082 - DNA, 20 bp, Artificial
  CRISPR gRNA sequence
gagggtcctcgggagcagtg

SEQ ID NO: 46083 - DNA, 20 bp, Artificial
  CRISPR gRNA sequence
agggtcctcgggagcagtgg

SEQ ID NO: 46084 - DNA, 20 bp, Artificial
  CRISPR gRNA sequence
gggtcctcgggagcagtggg

SEQ ID NO: 46085 - DNA, 20 bp, Artificial
  CRISPR gRNA sequence
ggtcctcgggagcagtgggg

SEQ ID NO: 46086 - DNA, 20 bp, Artificial
  CRISPR gRNA sequence
tcgggagcagtgggggggtc

SEQ ID NO: 46087 - DNA, 20 bp, Artificial
  CRISPR gRNA sequence
cgggagcagtgggggggtcc

SEQ ID NO: 46088 - DNA, 20 bp, Artificial
  CRISPR gRNA sequence
gggggggtccaggcccccat

SEQ ID NO: 46089 - DNA, 20 bp, Artificial
  CRISPR gRNA sequence
ggtccaggcccccatcagtt

SEQ ID NO: 46090 - DNA, 20 bp, Artificial
  CRISPR gRNA sequence
cagttgagctgccctgcccc

SEQ ID NO: 46091 - DNA, 20 bp, Artificial
  CRISPR gRNA sequence
gagctgccctgccccaagtc

SEQ ID NO: 46092 - DNA, 20 bp, Artificial
  CRISPR gRNA sequence
gccctgccccaagtcaagct

SEQ ID NO: 46093 - DNA, 20 bp, Artificial
  CRISPR gRNA sequence
ttccctgcctctgatgtctg

SEQ ID NO: 46094 - DNA, 20 bp, Artificial
  CRISPR gRNA sequence
ctgcctctgatgtctgcagc

SEQ ID NO: 46095 - DNA, 20 bp, Artificial
  CRISPR gRNA sequence
gatgtctgcagcaagaaaat

SEQ ID NO: 46096 - DNA, 20 bp, Artificial
  CRISPR gRNA sequence
atgtctgcagcaagaaaatc

SEQ ID NO: 46097 - DNA, 20 bp, Artificial
  CRISPR gRNA sequence
gtctgcagcaagaaaatcag

SEQ ID NO: 46098 - DNA, 20 bp, Artificial
  CRISPR gRNA sequence
tctgcagcaagaaaatcagg

SEQ ID NO: 46099 - DNA, 20 bp, Artificial
  CRISPR gRNA sequence
agcaagaaaatcaggaggcc

SEQ ID NO: 46100 - DNA, 20 bp, Artificial
  CRISPR gRNA sequence
gaaaatcaggaggcccagcc

SEQ ID NO: 46101 - DNA, 20 bp, Artificial
  CRISPR gRNA sequence
caggaggcccagcctagtcc

SEQ ID NO: 46102 - DNA, 20 bp, Artificial
  CRISPR gRNA sequence
cctagtcctggctctgccac

SEQ ID NO: 46103 - DNA, 20 bp, Artificial
  CRISPR gRNA sequence
cactggcccctgcctgacct

SEQ ID NO: 46104 - DNA, 20 bp, Artificial
  CRISPR gRNA sequence
gccaaacccctgccccttct

SEQ ID NO: 46105 - DNA, 20 bp, Artificial
  CRISPR gRNA sequence
cccctgccccttctcagcct

SEQ ID NO: 46106 - DNA, 20 bp, Artificial
  CRISPR gRNA sequence
ctcagtttcttcacatgcaa

SEQ ID NO: 46107 - DNA, 20 bp, Artificial
  CRISPR gRNA sequence
agtttcttcacatgcaaaag

SEQ ID NO: 46108 - DNA, 20 bp, Artificial
  CRISPR gRNA sequence
caaaagaagtacaatgatcc

SEQ ID NO: 46109 - DNA, 20 bp, Artificial
  CRISPR gRNA sequence
cccagttcattgtgccctgt

SEQ ID NO: 46110 - DNA, 20 bp, Artificial
  CRISPR gRNA sequence
agttcattgtgccctgtgag

SEQ ID NO: 46111 - DNA, 20 bp, Artificial
  CRISPR gRNA sequence
gttcattgtgccctgtgagc

SEQ ID NO: 46112 - DNA, 20 bp, Artificial
  CRISPR gRNA sequence
tgccctgtgagcgggtccct

SEQ ID NO: 46113 - DNA, 20 bp, Artificial
  CRISPR gRNA sequence
gccctgtgagcgggtccctg

SEQ ID NO: 46114 - DNA, 20 bp, Artificial
  CRISPR gRNA sequence
ccctgtgagcgggtccctga

SEQ ID NO: 46115 - DNA, 20 bp, Artificial
  CRISPR gRNA sequence
gcgggtccctgagggcgaat

SEQ ID NO: 46116 - DNA, 20 bp, Artificial
  CRISPR gRNA sequence
tgagggcgaatgagaaatcc

SEQ ID NO: 46117 - DNA, 20 bp, Artificial
  CRISPR gRNA sequence
gggcgaatgagaaatcctgg

SEQ ID NO: 46118 - DNA, 20 bp, Artificial
  CRISPR gRNA sequence
gcgaatgagaaatcctggca

SEQ ID NO: 46119 - DNA, 20 bp, Artificial
  CRISPR gRNA sequence
cgaatgagaaatcctggcag

SEQ ID NO: 46120 - DNA, 20 bp, Artificial
  CRISPR gRNA sequence
gaatgagaaatcctggcaga

SEQ ID NO: 46121 - DNA, 20 bp, Artificial
  CRISPR gRNA sequence
aatcctggcagagggcttcg

SEQ ID NO: 46122 - DNA, 20 bp, Artificial
  CRISPR gRNA sequence
atcctggcagagggcttcgc

SEQ ID NO: 46123 - DNA, 20 bp, Artificial
  CRISPR gRNA sequence
cctggcagagggcttcgcag

SEQ ID NO: 46124 - DNA, 20 bp, Artificial
  CRISPR gRNA sequence
cagagggcttcgcaggagca

SEQ ID NO: 46125 - DNA, 20 bp, Artificial
  CRISPR gRNA sequence
gagcacggtgccaatcaacg

SEQ ID NO: 46126 - DNA, 20 bp, Artificial
  CRISPR gRNA sequence
ggtgccaatcaacgtggcct

SEQ ID NO: 46127 - DNA, 20 bp, Artificial
  CRISPR gRNA sequence
cttcacaaatgacctcattg

SEQ ID NO: 46128 - DNA, 20 bp, Artificial
  CRISPR gRNA sequence
atgacctcattgcagcccca

SEQ ID NO: 46129 - DNA, 20 bp, Artificial
  CRISPR gRNA sequence
acctcattgcagccccatgg

SEQ ID NO: 46130 - DNA, 20 bp, Artificial
  CRISPR gRNA sequence
tgcagccccatggcagcccc

SEQ ID NO: 46131 - DNA, 20 bp, Artificial
  CRISPR gRNA sequence
cagccccatggcagccccca

SEQ ID NO: 46132 - DNA, 20 bp, Artificial
  CRISPR gRNA sequence
catggcagcccccagagtcc

SEQ ID NO: 46133 - DNA, 20 bp, Artificial
  CRISPR gRNA sequence
tggcagcccccagagtccca

SEQ ID NO: 46134 - DNA, 20 bp, Artificial
  CRISPR gRNA sequence
cccccagagtcccagagtgc

SEQ ID NO: 46135 - DNA, 20 bp, Artificial
  CRISPR gRNA sequence
ccccagagtcccagagtgct

SEQ ID NO: 46136 - DNA, 20 bp, Artificial
  CRISPR gRNA sequence
tttttttttttttttttttt

SEQ ID NO: 46137 - DNA, 20 bp, Artificial
  CRISPR gRNA sequence
tttttttttttttttttaga

SEQ ID NO: 46138 - DNA, 20 bp, Artificial
  CRISPR gRNA sequence
tttttttttttttttagatg

SEQ ID NO: 46139 - DNA, 20 bp, Artificial
  CRISPR gRNA sequence
tggagtctctctctgtcacc

SEQ ID NO: 46140 - DNA, 20 bp, Artificial
  CRISPR gRNA sequence
ggagtctctctctgtcaccc

SEQ ID NO: 46141 - DNA, 20 bp, Artificial
  CRISPR gRNA sequence
tctctctctgtcacccaggc

SEQ ID NO: 46142 - DNA, 20 bp, Artificial
  CRISPR gRNA sequence
tctctctgtcacccaggctg

SEQ ID NO: 46143 - DNA, 20 bp, Artificial
  CRISPR gRNA sequence
ctgtcacccaggctggagtg

SEQ ID NO: 46144 - DNA, 20 bp, Artificial
  CRISPR gRNA sequence
tcacccaggctggagtgcag

SEQ ID NO: 46145 - DNA, 20 bp, Artificial
  CRISPR gRNA sequence
ggagtgcagtggtgcaacct

SEQ ID NO: 46146 - DNA, 20 bp, Artificial
  CRISPR gRNA sequence
tcactgcaacctccacctcc

SEQ ID NO: 46147 - DNA, 20 bp, Artificial
  CRISPR gRNA sequence
cactgcaacctccacctccc

SEQ ID NO: 46148 - DNA, 20 bp, Artificial
  CRISPR gRNA sequence
aacctccacctcccgggttc

SEQ ID NO: 46149 - DNA, 20 bp, Artificial
  CRISPR gRNA sequence
ttcaagcaattcttgtgcct

SEQ ID NO: 46150 - DNA, 20 bp, Artificial
  CRISPR gRNA sequence
aattcttgtgcctcagctac

SEQ ID NO: 46151 - DNA, 20 bp, Artificial
  CRISPR gRNA sequence
ttcttgtgcctcagctacca

SEQ ID NO: 46152 - DNA, 20 bp, Artificial
  CRISPR gRNA sequence
ttgtgcctcagctaccagag

SEQ ID NO: 46153 - DNA, 20 bp, Artificial
  CRISPR gRNA sequence
gcctcagctaccagagtagc

SEQ ID NO: 46154 - DNA, 20 bp, Artificial
  CRISPR gRNA sequence
cctcagctaccagagtagct

SEQ ID NO: 46155 - DNA, 20 bp, Artificial
  CRISPR gRNA sequence
accagagtagctgggattac

SEQ ID NO: 46156 - DNA, 20 bp, Artificial
  CRISPR gRNA sequence
acgagcatgcccaccatgcc

SEQ ID NO: 46157 - DNA, 20 bp, Artificial
  CRISPR gRNA sequence
ccagctaatttttgtatttt

SEQ ID NO: 46158 - DNA, 20 bp, Artificial
  CRISPR gRNA sequence
gctaatttttgtatttttag

SEQ ID NO: 46159 - DNA, 20 bp, Artificial
  CRISPR gRNA sequence
taatttttgtatttttagta

SEQ ID NO: 46160 - DNA, 20 bp, Artificial
  CRISPR gRNA sequence
ttttgtatttttagtagaga

SEQ ID NO: 46161 - DNA, 20 bp, Artificial
  CRISPR gRNA sequence
cggcatttcaccatattgcc

SEQ ID NO: 46162 - DNA, 20 bp, Artificial
  CRISPR gRNA sequence
ggcatttcaccatattgccc

SEQ ID NO: 46163 - DNA, 20 bp, Artificial
  CRISPR gRNA sequence
tttcaccatattgcccaggc

SEQ ID NO: 46164 - DNA, 20 bp, Artificial
  CRISPR gRNA sequence
catattgcccaggctggtct

SEQ ID NO: 46165 - DNA, 20 bp, Artificial
  CRISPR gRNA sequence
ccaggctggtcttggactcc

SEQ ID NO: 46166 - DNA, 20 bp, Artificial
  CRISPR gRNA sequence
ggtcttggactcctggcctc

SEQ ID NO: 46167 - DNA, 20 bp, Artificial
  CRISPR gRNA sequence
ctcaagtgatccacccacct

SEQ ID NO: 46168 - DNA, 20 bp, Artificial
  CRISPR gRNA sequence
ccacccacctcagcctccaa

SEQ ID NO: 46169 - DNA, 20 bp, Artificial
  CRISPR gRNA sequence
acctcagcctccaaaagtgc

SEQ ID NO: 46170 - DNA, 20 bp, Artificial
  CRISPR gRNA sequence
cctcagcctccaaaagtgct

SEQ ID NO: 46171 - DNA, 20 bp, Artificial
  CRISPR gRNA sequence
ctccaaaagtgctgggatta

SEQ ID NO: 46172 - DNA, 20 bp, Artificial
  CRISPR gRNA sequence
tccaaaagtgctgggattac

SEQ ID NO: 46173 - DNA, 20 bp, Artificial
  CRISPR gRNA sequence
agtgctgggattacaggcgt

SEQ ID NO: 46174 - DNA, 20 bp, Artificial
  CRISPR gRNA sequence
attacaggcgtgagccacca

SEQ ID NO: 46175 - DNA, 20 bp, Artificial
  CRISPR gRNA sequence
caggcgtgagccaccatggc

SEQ ID NO: 46176 - DNA, 20 bp, Artificial
  CRISPR gRNA sequence
cgtgagccaccatggctggc

SEQ ID NO: 46177 - DNA, 20 bp, Artificial
  CRISPR gRNA sequence
ccaccatggctggctggtgc

SEQ ID NO: 46178 - DNA, 20 bp, Artificial
  CRISPR gRNA sequence
caccatggctggctggtgct

SEQ ID NO: 46179 - DNA, 20 bp, Artificial
  CRISPR gRNA sequence
cttttatgtgctcccttttc

SEQ ID NO: 46180 - DNA, 20 bp, Artificial
  CRISPR gRNA sequence
ttttatgtgctcccttttcc

SEQ ID NO: 46181 - DNA, 20 bp, Artificial
  CRISPR gRNA sequence
atgtgctcccttttccaggc

SEQ ID NO: 46182 - DNA, 20 bp, Artificial
  CRISPR gRNA sequence
tgtgctcccttttccaggca

SEQ ID NO: 46183 - DNA, 20 bp, Artificial
  CRISPR gRNA sequence
gtgctcccttttccaggcaa

SEQ ID NO: 46184 - DNA, 20 bp, Artificial
  CRISPR gRNA sequence
cttttccaggcaagggaatg

SEQ ID NO: 46185 - DNA, 20 bp, Artificial
  CRISPR gRNA sequence
ttttccaggcaagggaatga

SEQ ID NO: 46186 - DNA, 20 bp, Artificial
  CRISPR gRNA sequence
ccaggcaagggaatgaaggc

SEQ ID NO: 46187 - DNA, 20 bp, Artificial
  CRISPR gRNA sequence
caggcaagggaatgaaggcc

SEQ ID NO: 46188 - DNA, 20 bp, Artificial
  CRISPR gRNA sequence
ggcaagggaatgaaggccag

SEQ ID NO: 46189 - DNA, 20 bp, Artificial
  CRISPR gRNA sequence
caagggaatgaaggccagga

SEQ ID NO: 46190 - DNA, 20 bp, Artificial
  CRISPR gRNA sequence
aagggaatgaaggccaggag

SEQ ID NO: 46191 - DNA, 20 bp, Artificial
  CRISPR gRNA sequence
aatgaaggccaggagaggtg

SEQ ID NO: 46192 - DNA, 20 bp, Artificial
  CRISPR gRNA sequence
tgaaggccaggagaggtgtg

SEQ ID NO: 46193 - DNA, 20 bp, Artificial
  CRISPR gRNA sequence
attttccttactcatacacg

SEQ ID NO: 46194 - DNA, 20 bp, Artificial
  CRISPR gRNA sequence
ttttccttactcatacacga

SEQ ID NO: 46195 - DNA, 20 bp, Artificial
  CRISPR gRNA sequence
ttactcatacacgaaggacc

SEQ ID NO: 46196 - DNA, 20 bp, Artificial
  CRISPR gRNA sequence
tactcatacacgaaggaccc

SEQ ID NO: 46197 - DNA, 20 bp, Artificial
  CRISPR gRNA sequence
aaggacccaggtgttgaatt

SEQ ID NO: 46198 - DNA, 20 bp, Artificial
  CRISPR gRNA sequence
aggacccaggtgttgaattt

SEQ ID NO: 46199 - DNA, 20 bp, Artificial
  CRISPR gRNA sequence
aggtgttgaatttgggatct

SEQ ID NO: 46200 - DNA, 20 bp, Artificial
  CRISPR gRNA sequence
atttgggatctcagacccca

SEQ ID NO: 46201 - DNA, 20 bp, Artificial
  CRISPR gRNA sequence
gggatctcagaccccaaagc

SEQ ID NO: 46202 - DNA, 20 bp, Artificial
  CRISPR gRNA sequence
ggatctcagaccccaaagcc

SEQ ID NO: 46203 - DNA, 20 bp, Artificial
  CRISPR gRNA sequence
gatctcagaccccaaagcca

SEQ ID NO: 46204 - DNA, 20 bp, Artificial
  CRISPR gRNA sequence
cagggtccttgatacctacc

SEQ ID NO: 46205 - DNA, 20 bp, Artificial
  CRISPR gRNA sequence
agggtccttgatacctaccc

SEQ ID NO: 46206 - DNA, 20 bp, Artificial
  CRISPR gRNA sequence
atacctacccaggtcctgtg

SEQ ID NO: 46207 - DNA, 20 bp, Artificial
  CRISPR gRNA sequence
ctacccaggtcctgtgtgga

SEQ ID NO: 46208 - DNA, 20 bp, Artificial
  CRISPR gRNA sequence
tacccaggtcctgtgtggat

SEQ ID NO: 46209 - DNA, 20 bp, Artificial
  CRISPR gRNA sequence
acccaggtcctgtgtggatg

SEQ ID NO: 46210 - DNA, 20 bp, Artificial
  CRISPR gRNA sequence
gtcctgtgtggatggggaat

SEQ ID NO: 46211 - DNA, 20 bp, Artificial
  CRISPR gRNA sequence
tgtgtggatggggaattagc

SEQ ID NO: 46212 - DNA, 20 bp, Artificial
  CRISPR gRNA sequence
tgtggatggggaattagcca

SEQ ID NO: 46213 - DNA, 20 bp, Artificial
  CRISPR gRNA sequence
aattagccagagactgtcta

SEQ ID NO: 46214 - DNA, 20 bp, Artificial
  CRISPR gRNA sequence
attagccagagactgtctac

SEQ ID NO: 46215 - DNA, 20 bp, Artificial
  CRISPR gRNA sequence
gccagagactgtctacgggc

SEQ ID NO: 46216 - DNA, 20 bp, Artificial
  CRISPR gRNA sequence
ctgtctacgggctggcactg

SEQ ID NO: 46217 - DNA, 20 bp, Artificial
  CRISPR gRNA sequence
acgggctggcactgcagcct

SEQ ID NO: 46218 - DNA, 20 bp, Artificial
  CRISPR gRNA sequence
ctggcactgcagcctgagac

SEQ ID NO: 46219 - DNA, 20 bp, Artificial
  CRISPR gRNA sequence
tggcactgcagcctgagaca

SEQ ID NO: 46220 - DNA, 20 bp, Artificial
  CRISPR gRNA sequence
ctgcagcctgagacaaggct

SEQ ID NO: 46221 - DNA, 20 bp, Artificial
  CRISPR gRNA sequence
tgcagcctgagacaaggctg

SEQ ID NO: 46222 - DNA, 20 bp, Artificial
  CRISPR gRNA sequence
gcagcctgagacaaggctga

SEQ ID NO: 46223 - DNA, 20 bp, Artificial
  CRISPR gRNA sequence
gcctgagacaaggctgaggg

SEQ ID NO: 46224 - DNA, 20 bp, Artificial
  CRISPR gRNA sequence
cctgagacaaggctgagggt

SEQ ID NO: 46225 - DNA, 20 bp, Artificial
  CRISPR gRNA sequence
ctgagacaaggctgagggtg

SEQ ID NO: 46226 - DNA, 20 bp, Artificial
  CRISPR gRNA sequence
caaggctgagggtggggctc

SEQ ID NO: 46227 - DNA, 20 bp, Artificial
  CRISPR gRNA sequence
gggtggggctctggaaacgc

SEQ ID NO: 46228 - DNA, 20 bp, Artificial
  CRISPR gRNA sequence
ctctggaaacgccagtccct

SEQ ID NO: 46229 - DNA, 20 bp, Artificial
  CRISPR gRNA sequence
tctggaaacgccagtccctc

SEQ ID NO: 46230 - DNA, 20 bp, Artificial
  CRISPR gRNA sequence
ctcaccctctcctctttccc

SEQ ID NO: 46231 - DNA, 20 bp, Artificial
  CRISPR gRNA sequence
tctttccccagcctaccatt

SEQ ID NO: 46232 - DNA, 20 bp, Artificial
  CRISPR gRNA sequence
cagcctaccattcagccatc

SEQ ID NO: 46233 - DNA, 20 bp, Artificial
  CRISPR gRNA sequence
agcctaccattcagccatct

SEQ ID NO: 46234 - DNA, 20 bp, Artificial
  CRISPR gRNA sequence
accattcagccatctgggcc

SEQ ID NO: 46235 - DNA, 20 bp, Artificial
  CRISPR gRNA sequence
ccattcagccatctgggccc

SEQ ID NO: 46236 - DNA, 20 bp, Artificial
  CRISPR gRNA sequence
ttcagccatctgggcccagg

SEQ ID NO: 46237 - DNA, 20 bp, Artificial
  CRISPR gRNA sequence
tcagccatctgggcccaggt

SEQ ID NO: 46238 - DNA, 20 bp, Artificial
  CRISPR gRNA sequence
cagccatctgggcccaggtg

SEQ ID NO: 46239 - DNA, 20 bp, Artificial
  CRISPR gRNA sequence
ctgggcccaggtggggccct

SEQ ID NO: 46240 - DNA, 20 bp, Artificial
  CRISPR gRNA sequence
cccaggtggggccctgagcc

SEQ ID NO: 46241 - DNA, 20 bp, Artificial
  CRISPR gRNA sequence
gtggggccctgagcctggcc

SEQ ID NO: 46242 - DNA, 20 bp, Artificial
  CRISPR gRNA sequence
tggggccctgagcctggccc

SEQ ID NO: 46243 - DNA, 20 bp, Artificial
  CRISPR gRNA sequence
cctgagcctggcccaggccc

SEQ ID NO: 46244 - DNA, 20 bp, Artificial
  CRISPR gRNA sequence
agcctggcccaggccctgga

SEQ ID NO: 46245 - DNA, 20 bp, Artificial
  CRISPR gRNA sequence
cctggatggatccccccatt

SEQ ID NO: 46246 - DNA, 20 bp, Artificial
  CRISPR gRNA sequence
ggatggatccccccatttgg

SEQ ID NO: 46247 - DNA, 20 bp, Artificial
  CRISPR gRNA sequence
atggatccccccatttggaa

SEQ ID NO: 46248 - DNA, 20 bp, Artificial
  CRISPR gRNA sequence
tccccccatttggaagagat

SEQ ID NO: 46249 - DNA, 20 bp, Artificial
  CRISPR gRNA sequence
ccccccatttggaagagatc

SEQ ID NO: 46250 - DNA, 20 bp, Artificial
  CRISPR gRNA sequence
ccatttggaagagatcaggt

SEQ ID NO: 46251 - DNA, 20 bp, Artificial
  CRISPR gRNA sequence
tttggaagagatcaggtaag

SEQ ID NO: 46252 - DNA, 20 bp, Artificial
  CRISPR gRNA sequence
ttggaagagatcaggtaagt

SEQ ID NO: 46253 - DNA, 20 bp, Artificial
  CRISPR gRNA sequence
tggaagagatcaggtaagta

SEQ ID NO: 46254 - DNA, 20 bp, Artificial
  CRISPR gRNA sequence
ggaagagatcaggtaagtag

SEQ ID NO: 46255 - DNA, 20 bp, Artificial
  CRISPR gRNA sequence
tcaggtaagtaggggctgcc

SEQ ID NO: 46256 - DNA, 20 bp, Artificial
  CRISPR gRNA sequence
taagtaggggctgcccagcc

SEQ ID NO: 46257 - DNA, 20 bp, Artificial
  CRISPR gRNA sequence
aagtaggggctgcccagccc

SEQ ID NO: 46258 - DNA, 20 bp, Artificial
  CRISPR gRNA sequence
ggggctgcccagcccaggca

SEQ ID NO: 46259 - DNA, 20 bp, Artificial
  CRISPR gRNA sequence
gggctgcccagcccaggcac

SEQ ID NO: 46260 - DNA, 20 bp, Artificial
  CRISPR gRNA sequence
ggctgcccagcccaggcacg

SEQ ID NO: 46261 - DNA, 20 bp, Artificial
  CRISPR gRNA sequence
gcccagcccaggcacgggga

SEQ ID NO: 46262 - DNA, 20 bp, Artificial
  CRISPR gRNA sequence
cccaggcacggggacagtcc

SEQ ID NO: 46263 - DNA, 20 bp, Artificial
  CRISPR gRNA sequence
ccaggcacggggacagtcct

SEQ ID NO: 46264 - DNA, 20 bp, Artificial
  CRISPR gRNA sequence
ggcacggggacagtcctggg

SEQ ID NO: 46265 - DNA, 20 bp, Artificial
  CRISPR gRNA sequence
gcacggggacagtcctgggc

SEQ ID NO: 46266 - DNA, 20 bp, Artificial
  CRISPR gRNA sequence
gggacagtcctgggcgggtc

SEQ ID NO: 46267 - DNA, 20 bp, Artificial
  CRISPR gRNA sequence
ggacagtcctgggcgggtct

SEQ ID NO: 46268 - DNA, 20 bp, Artificial
  CRISPR gRNA sequence
gacagtcctgggcgggtctg

SEQ ID NO: 46269 - DNA, 20 bp, Artificial
  CRISPR gRNA sequence
acagtcctgggcgggtctgg

SEQ ID NO: 46270 - DNA, 20 bp, Artificial
  CRISPR gRNA sequence
gggtctgggggttcctctca

SEQ ID NO: 46271 - DNA, 20 bp, Artificial
  CRISPR gRNA sequence
ggtctgggggttcctctcac

SEQ ID NO: 46272 - DNA, 20 bp, Artificial
  CRISPR gRNA sequence
caggtatctcccctaccctg

SEQ ID NO: 46273 - DNA, 20 bp, Artificial
  CRISPR gRNA sequence
atctcccctaccctgcagct

SEQ ID NO: 46274 - DNA, 20 bp, Artificial
  CRISPR gRNA sequence
tcccctaccctgcagcttgg

SEQ ID NO: 46275 - DNA, 20 bp, Artificial
  CRISPR gRNA sequence
cagcttggcggaaaacaacc

SEQ ID NO: 46276 - DNA, 20 bp, Artificial
  CRISPR gRNA sequence
ttggcggaaaacaacctggc

SEQ ID NO: 46277 - DNA, 20 bp, Artificial
  CRISPR gRNA sequence
ggcggaaaacaacctggctg

SEQ ID NO: 46278 - DNA, 20 bp, Artificial
  CRISPR gRNA sequence
gcggaaaacaacctggctgg

SEQ ID NO: 46279 - DNA, 20 bp, Artificial
  CRISPR gRNA sequence
cggaaaacaacctggctgga

SEQ ID NO: 46280 - DNA, 20 bp, Artificial
  CRISPR gRNA sequence
ggaaaacaacctggctggag

SEQ ID NO: 46281 - DNA, 20 bp, Artificial
  CRISPR gRNA sequence
aggggtcctgcgtttctgta

SEQ ID NO: 46282 - DNA, 20 bp, Artificial
  CRISPR gRNA sequence
gggtcctgcgtttctgtatg

SEQ ID NO: 46283 - DNA, 20 bp, Artificial
  CRISPR gRNA sequence
tgtatggagctcccgctgct

SEQ ID NO: 46284 - DNA, 20 bp, Artificial
  CRISPR gRNA sequence
tggagctcccgctgctcaga

SEQ ID NO: 46285 - DNA, 20 bp, Artificial
  CRISPR gRNA sequence
gctcccgctgctcagacaga

SEQ ID NO: 46286 - DNA, 20 bp, Artificial
  CRISPR gRNA sequence
tcccgctgctcagacagata

SEQ ID NO: 46287 - DNA, 20 bp, Artificial
  CRISPR gRNA sequence
gctgctcagacagatagagt

SEQ ID NO: 46288 - DNA, 20 bp, Artificial
  CRISPR gRNA sequence
gctcagacagatagagtaag

SEQ ID NO: 46289 - DNA, 20 bp, Artificial
  CRISPR gRNA sequence
agtagcctcccctgcctgcc

SEQ ID NO: 46290 - DNA, 20 bp, Artificial
  CRISPR gRNA sequence
gtagcctcccctgcctgcct

SEQ ID NO: 46291 - DNA, 20 bp, Artificial
  CRISPR gRNA sequence
tagcctcccctgcctgccta

SEQ ID NO: 46292 - DNA, 20 bp, Artificial
  CRISPR gRNA sequence
agcctcccctgcctgcctag

SEQ ID NO: 46293 - DNA, 20 bp, Artificial
  CRISPR gRNA sequence
cccctgcctgcctaggggac

SEQ ID NO: 46294 - DNA, 20 bp, Artificial
  CRISPR gRNA sequence
ctgcctgcctaggggaccag

SEQ ID NO: 46295 - DNA, 20 bp, Artificial
  CRISPR gRNA sequence
cctgcctaggggaccagtgg

SEQ ID NO: 46296 - DNA, 20 bp, Artificial
  CRISPR gRNA sequence
ctgcctaggggaccagtggc

SEQ ID NO: 46297 - DNA, 20 bp, Artificial
  CRISPR gRNA sequence
taggggaccagtggcaggct

SEQ ID NO: 46298 - DNA, 20 bp, Artificial
  CRISPR gRNA sequence
aggggaccagtggcaggctg

SEQ ID NO: 46299 - DNA, 20 bp, Artificial
  CRISPR gRNA sequence
ggggaccagtggcaggctga

SEQ ID NO: 46300 - DNA, 20 bp, Artificial
  CRISPR gRNA sequence
gaccagtggcaggctgaggg

SEQ ID NO: 46301 - DNA, 20 bp, Artificial
  CRISPR gRNA sequence
agggcagcccttctctgact

SEQ ID NO: 46302 - DNA, 20 bp, Artificial
  CRISPR gRNA sequence
ctctgactgagcctaacacc

SEQ ID NO: 46303 - DNA, 20 bp, Artificial
  CRISPR gRNA sequence
tctgactgagcctaacacct

SEQ ID NO: 46304 - DNA, 20 bp, Artificial
  CRISPR gRNA sequence
ctgactgagcctaacacctg

SEQ ID NO: 46305 - DNA, 20 bp, Artificial
  CRISPR gRNA sequence
gactgagcctaacacctggg

SEQ ID NO: 46306 - DNA, 20 bp, Artificial
  CRISPR gRNA sequence
actgagcctaacacctgggg

SEQ ID NO: 46307 - DNA, 20 bp, Artificial
  CRISPR gRNA sequence
aacacctggggaggcctttg

SEQ ID NO: 46308 - DNA, 20 bp, Artificial
  CRISPR gRNA sequence
tggggaggcctttgaagtga

SEQ ID NO: 46309 - DNA, 20 bp, Artificial
  CRISPR gRNA sequence
ggaggcctttgaagtgatag

SEQ ID NO: 46310 - DNA, 20 bp, Artificial
  CRISPR gRNA sequence
ctttgaagtgatagaagccc

SEQ ID NO: 46311 - DNA, 20 bp, Artificial
  CRISPR gRNA sequence
tttgaagtgatagaagcccc

SEQ ID NO: 46312 - DNA, 20 bp, Artificial
  CRISPR gRNA sequence
ttgaagtgatagaagcccca

SEQ ID NO: 46313 - DNA, 20 bp, Artificial
  CRISPR gRNA sequence
agtgatagaagccccaggga

SEQ ID NO: 46314 - DNA, 20 bp, Artificial
  CRISPR gRNA sequence
gatagaagccccagggatgg

SEQ ID NO: 46315 - DNA, 20 bp, Artificial
  CRISPR gRNA sequence
atagaagccccagggatggt

SEQ ID NO: 46316 - DNA, 20 bp, Artificial
  CRISPR gRNA sequence
tagaagccccagggatggtg

SEQ ID NO: 46317 - DNA, 20 bp, Artificial
  CRISPR gRNA sequence
agaagccccagggatggtgg

SEQ ID NO: 46318 - DNA, 20 bp, Artificial
  CRISPR gRNA sequence
ccccagggatggtgggggcc

SEQ ID NO: 46319 - DNA, 20 bp, Artificial
  CRISPR gRNA sequence
ggatggtgggggcctggctc

SEQ ID NO: 46320 - DNA, 20 bp, Artificial
  CRISPR gRNA sequence
ggtgggggcctggctcaaga

SEQ ID NO: 46321 - DNA, 20 bp, Artificial
  CRISPR gRNA sequence
gtgggggcctggctcaagaa

SEQ ID NO: 46322 - DNA, 20 bp, Artificial
  CRISPR gRNA sequence
ggggcctggctcaagaaagg

SEQ ID NO: 46323 - DNA, 20 bp, Artificial
  CRISPR gRNA sequence
gaagtctttcctaaaacgcc

SEQ ID NO: 46324 - DNA, 20 bp, Artificial
  CRISPR gRNA sequence
ctaaaacgcctagcttaccc

SEQ ID NO: 46325 - DNA, 20 bp, Artificial
  CRISPR gRNA sequence
gcctagcttaccccagaccc

SEQ ID NO: 46326 - DNA, 20 bp, Artificial
  CRISPR gRNA sequence
tagcttaccccagaccctgg

SEQ ID NO: 46327 - DNA, 20 bp, Artificial
  CRISPR gRNA sequence
accccagaccctggtggctc

SEQ ID NO: 46328 - DNA, 20 bp, Artificial
  CRISPR gRNA sequence
cccagaccctggtggctctg

SEQ ID NO: 46329 - DNA, 20 bp, Artificial
  CRISPR gRNA sequence
ccagaccctggtggctctgg

SEQ ID NO: 46330 - DNA, 20 bp, Artificial
  CRISPR gRNA sequence
gaccctggtggctctggagg

SEQ ID NO: 46331 - DNA, 20 bp, Artificial
  CRISPR gRNA sequence
accctggtggctctggaggc

SEQ ID NO: 46332 - DNA, 20 bp, Artificial
  CRISPR gRNA sequence
gctctggaggcaggacctgc

SEQ ID NO: 46333 - DNA, 20 bp, Artificial
  CRISPR gRNA sequence
cccatgcccttctccatccc

SEQ ID NO: 46334 - DNA, 20 bp, Artificial
  CRISPR gRNA sequence
gcccttctccatccccagcc

SEQ ID NO: 46335 - DNA, 20 bp, Artificial
  CRISPR gRNA sequence
tccccagcctggtttcctgt

SEQ ID NO: 46336 - DNA, 20 bp, Artificial
  CRISPR gRNA sequence
tttcctgtaagattgacaac

SEQ ID NO: 46337 - DNA, 20 bp, Artificial
  CRISPR gRNA sequence
agattgacaaccagactgcc

SEQ ID NO: 46338 - DNA, 20 bp, Artificial
  CRISPR gRNA sequence
actgccaagctcctcacctc

SEQ ID NO: 46339 - DNA, 20 bp, Artificial
  CRISPR gRNA sequence
ctcctcacctccagcttcac

SEQ ID NO: 46340 - DNA, 20 bp, Artificial
  CRISPR gRNA sequence
cttcacgagctgccctgccc

SEQ ID NO: 46341 - DNA, 20 bp, Artificial
  CRISPR gRNA sequence
cacgagctgccctgccctgg

SEQ ID NO: 46342 - DNA, 20 bp, Artificial
  CRISPR gRNA sequence
tgccctggaagtaatcttgt

SEQ ID NO: 46343 - DNA, 20 bp, Artificial
  CRISPR gRNA sequence
gaagtaatcttgtgagtgat

SEQ ID NO: 46344 - DNA, 20 bp, Artificial
  CRISPR gRNA sequence
gtaatcttgtgagtgattgg

SEQ ID NO: 46345 - DNA, 20 bp, Artificial
  CRISPR gRNA sequence
aatcttgtgagtgattggaa

SEQ ID NO: 46346 - DNA, 20 bp, Artificial
  CRISPR gRNA sequence
tgagtgattggaagagccct

SEQ ID NO: 46347 - DNA, 20 bp, Artificial
  CRISPR gRNA sequence
tgattggaagagccctgagc

SEQ ID NO: 46348 - DNA, 20 bp, Artificial
  CRISPR gRNA sequence
tggaagagccctgagctggc

SEQ ID NO: 46349 - DNA, 20 bp, Artificial
  CRISPR gRNA sequence
ggaagagccctgagctggct

SEQ ID NO: 46350 - DNA, 20 bp, Artificial
  CRISPR gRNA sequence
agccctgagctggctgggaa

SEQ ID NO: 46351 - DNA, 20 bp, Artificial
  CRISPR gRNA sequence
gccctgagctggctgggaaa

SEQ ID NO: 46352 - DNA, 20 bp, Artificial
  CRISPR gRNA sequence
gagctggctgggaaaaggaa

SEQ ID NO: 46353 - DNA, 20 bp, Artificial
  CRISPR gRNA sequence
tggctgggaaaaggaaaagt

SEQ ID NO: 46354 - DNA, 20 bp, Artificial
  CRISPR gRNA sequence
ggctgggaaaaggaaaagtc

SEQ ID NO: 46355 - DNA, 20 bp, Artificial
  CRISPR gRNA sequence
ctgggaaaaggaaaagtcgg

SEQ ID NO: 46356 - DNA, 20 bp, Artificial
  CRISPR gRNA sequence
tgggaaaaggaaaagtcggg

SEQ ID NO: 46357 - DNA, 20 bp, Artificial
  CRISPR gRNA sequence
gggaaaaggaaaagtcggga

SEQ ID NO: 46358 - DNA, 20 bp, Artificial
  CRISPR gRNA sequence
ggaaaaggaaaagtcgggag

SEQ ID NO: 46359 - DNA, 20 bp, Artificial
  CRISPR gRNA sequence
aaggaaaagtcgggaggggt

SEQ ID NO: 46360 - DNA, 20 bp, Artificial
  CRISPR gRNA sequence
aggaaaagtcgggaggggtc

SEQ ID NO: 46361 - DNA, 20 bp, Artificial
  CRISPR gRNA sequence
ggaaaagtcgggaggggtcg

SEQ ID NO: 46362 - DNA, 20 bp, Artificial
  CRISPR gRNA sequence
gaaaagtcgggaggggtcgg

SEQ ID NO: 46363 - DNA, 20 bp, Artificial
  CRISPR gRNA sequence
aaagtcgggaggggtcgggg

SEQ ID NO: 46364 - DNA, 20 bp, Artificial
  CRISPR gRNA sequence
tcgggaggggtcgggggagt

SEQ ID NO: 46365 - DNA, 20 bp, Artificial
  CRISPR gRNA sequence
ggggtcgggggagttggctc

SEQ ID NO: 46366 - DNA, 20 bp, Artificial
  CRISPR gRNA sequence
gttggctccagcctgctgtg

SEQ ID NO: 46367 - DNA, 20 bp, Artificial
  CRISPR gRNA sequence
ctccagcctgctgtgtggcc

SEQ ID NO: 46368 - DNA, 20 bp, Artificial
  CRISPR gRNA sequence
ccagcctgctgtgtggcctg

SEQ ID NO: 46369 - DNA, 20 bp, Artificial
  CRISPR gRNA sequence
ggagctgctcccatcctctc

SEQ ID NO: 46370 - DNA, 20 bp, Artificial
  CRISPR gRNA sequence
ctgctcccatcctctctggc

SEQ ID NO: 46371 - DNA, 20 bp, Artificial
  CRISPR gRNA sequence
ccagtcctcccatttgtaaa

SEQ ID NO: 46372 - DNA, 20 bp, Artificial
  CRISPR gRNA sequence
cagtcctcccatttgtaaat

SEQ ID NO: 46373 - DNA, 20 bp, Artificial
  CRISPR gRNA sequence
agtcctcccatttgtaaatg

SEQ ID NO: 46374 - DNA, 20 bp, Artificial
  CRISPR gRNA sequence
cctcccatttgtaaatgggg

SEQ ID NO: 46375 - DNA, 20 bp, Artificial
  CRISPR gRNA sequence
tggggaagatcatccttact

SEQ ID NO: 46376 - DNA, 20 bp, Artificial
  CRISPR gRNA sequence
cttactcagacatcctctca

SEQ ID NO: 46377 - DNA, 20 bp, Artificial
  CRISPR gRNA sequence
tcaaagacattttaacactt

SEQ ID NO: 46378 - DNA, 20 bp, Artificial
  CRISPR gRNA sequence
acattttaacacttgagctg

SEQ ID NO: 46379 - DNA, 20 bp, Artificial
  CRISPR gRNA sequence
cattttaacacttgagctgc

SEQ ID NO: 46380 - DNA, 20 bp, Artificial
  CRISPR gRNA sequence
acttgagctgcaggtaatgt

SEQ ID NO: 46381 - DNA, 20 bp, Artificial
  CRISPR gRNA sequence
cttgagctgcaggtaatgtt

SEQ ID NO: 46382 - DNA, 20 bp, Artificial
  CRISPR gRNA sequence
gcaggtaatgttgggtaaaa

SEQ ID NO: 46383 - DNA, 20 bp, Artificial
  CRISPR gRNA sequence
tctgcctttttccccatttg

SEQ ID NO: 46384 - DNA, 20 bp, Artificial
  CRISPR gRNA sequence
ctttttccccatttgtagat

SEQ ID NO: 46385 - DNA, 20 bp, Artificial
  CRISPR gRNA sequence
tttccccatttgtagattgg

SEQ ID NO: 46386 - DNA, 20 bp, Artificial
  CRISPR gRNA sequence
ttccccatttgtagattggt

SEQ ID NO: 46387 - DNA, 20 bp, Artificial
  CRISPR gRNA sequence
ccccatttgtagattggtgg

SEQ ID NO: 46388 - DNA, 20 bp, Artificial
  CRISPR gRNA sequence
cccatttgtagattggtggg

SEQ ID NO: 46389 - DNA, 20 bp, Artificial
  CRISPR gRNA sequence
ccatttgtagattggtggga

SEQ ID NO: 46390 - DNA, 20 bp, Artificial
  CRISPR gRNA sequence
catttgtagattggtgggag

SEQ ID NO: 46391 - DNA, 20 bp, Artificial
  CRISPR gRNA sequence
tttgtagattggtgggaggg

SEQ ID NO: 46392 - DNA, 20 bp, Artificial
  CRISPR gRNA sequence
ttgtagattggtgggagggg

SEQ ID NO: 46393 - DNA, 20 bp, Artificial
  CRISPR gRNA sequence
tagattggtgggaggggagg

SEQ ID NO: 46394 - DNA, 20 bp, Artificial
  CRISPR gRNA sequence
tggtgggaggggaggtggac

SEQ ID NO: 46395 - DNA, 20 bp, Artificial
  CRISPR gRNA sequence
gggaggggaggtggaccaga

SEQ ID NO: 46396 - DNA, 20 bp, Artificial
  CRISPR gRNA sequence
ggtggaccagatggtcttta

SEQ ID NO: 46397 - DNA, 20 bp, Artificial
  CRISPR gRNA sequence
gtggaccagatggtctttaa

SEQ ID NO: 46398 - DNA, 20 bp, Artificial
  CRISPR gRNA sequence
agatggtctttaaaggtttt

SEQ ID NO: 46399 - DNA, 20 bp, Artificial
  CRISPR gRNA sequence
ttttggtccaaccttccttt

SEQ ID NO: 46400 - DNA, 20 bp, Artificial
  CRISPR gRNA sequence
tttggtccaaccttcctttt

SEQ ID NO: 46401 - DNA, 20 bp, Artificial
  CRISPR gRNA sequence
tggtccaaccttccttttgg

SEQ ID NO: 46402 - DNA, 20 bp, Artificial
  CRISPR gRNA sequence
ggtccaaccttccttttggg

SEQ ID NO: 46403 - DNA, 20 bp, Artificial
  CRISPR gRNA sequence
ccttccttttgggaggcaac

SEQ ID NO: 46404 - DNA, 20 bp, Artificial
  CRISPR gRNA sequence
ccttttgggaggcaactgga

SEQ ID NO: 46405 - DNA, 20 bp, Artificial
  CRISPR gRNA sequence
aaacctccatttatgaacca

SEQ ID NO: 46406 - DNA, 20 bp, Artificial
  CRISPR gRNA sequence
ctccatttatgaaccacagt

SEQ ID NO: 46407 - DNA, 20 bp, Artificial
  CRISPR gRNA sequence
catttatgaaccacagttgg

SEQ ID NO: 46408 - DNA, 20 bp, Artificial
  CRISPR gRNA sequence
tgaaccacagttggtagaaa

SEQ ID NO: 46409 - DNA, 20 bp, Artificial
  CRISPR gRNA sequence
accacagttggtagaaacag

SEQ ID NO: 46410 - DNA, 20 bp, Artificial
  CRISPR gRNA sequence
gttggtagaaacagtggcta

SEQ ID NO: 46411 - DNA, 20 bp, Artificial
  CRISPR gRNA sequence
gtagaaacagtggctaaagc

SEQ ID NO: 46412 - DNA, 20 bp, Artificial
  CRISPR gRNA sequence
tagaaacagtggctaaagcc

SEQ ID NO: 46413 - DNA, 20 bp, Artificial
  CRISPR gRNA sequence
gaaacagtggctaaagccag

SEQ ID NO: 46414 - DNA, 20 bp, Artificial
  CRISPR gRNA sequence
cagtggctaaagccaggaga

SEQ ID NO: 46415 - DNA, 20 bp, Artificial
  CRISPR gRNA sequence
agccaggagaaagccacccc

SEQ ID NO: 46416 - DNA, 20 bp, Artificial
  CRISPR gRNA sequence
aaagccacccccagacctgc

SEQ ID NO: 46417 - DNA, 20 bp, Artificial
  CRISPR gRNA sequence
ccacccccagacctgctggc

SEQ ID NO: 46418 - DNA, 20 bp, Artificial
  CRISPR gRNA sequence
acctgctggctggccgtgct

SEQ ID NO: 46419 - DNA, 20 bp, Artificial
  CRISPR gRNA sequence
ggccgtgcttggctgtctct

SEQ ID NO: 46420 - DNA, 20 bp, Artificial
  CRISPR gRNA sequence
cttggctgtctcttagcaat

SEQ ID NO: 46421 - DNA, 20 bp, Artificial
  CRISPR gRNA sequence
tcttagcaatcagaatcccc

SEQ ID NO: 46422 - DNA, 20 bp, Artificial
  CRISPR gRNA sequence
aatcagaatcccccagacct

SEQ ID NO: 46423 - DNA, 20 bp, Artificial
  CRISPR gRNA sequence
atcagaatcccccagacctt

SEQ ID NO: 46424 - DNA, 20 bp, Artificial
  CRISPR gRNA sequence
tcagaatcccccagaccttg

SEQ ID NO: 46425 - DNA, 20 bp, Artificial
  CRISPR gRNA sequence
ccccagaccttggggctttg

SEQ ID NO: 46426 - DNA, 20 bp, Artificial
  CRISPR gRNA sequence
gctttgcagtgctgcctcat

SEQ ID NO: 46427 - DNA, 20 bp, Artificial
  CRISPR gRNA sequence
gtgctgcctcatgagtaaac

SEQ ID NO: 46428 - DNA, 20 bp, Artificial
  CRISPR gRNA sequence
tcatgagtaaactagaattc

SEQ ID NO: 46429 - DNA, 20 bp, Artificial
  CRISPR gRNA sequence
catgagtaaactagaattct

SEQ ID NO: 46430 - DNA, 20 bp, Artificial
  CRISPR gRNA sequence
gtaaactagaattctaggac

SEQ ID NO: 46431 - DNA, 20 bp, Artificial
  CRISPR gRNA sequence
ctagaattctaggactagcc

SEQ ID NO: 46432 - DNA, 20 bp, Artificial
  CRISPR gRNA sequence
tagaattctaggactagcct

SEQ ID NO: 46433 - DNA, 20 bp, Artificial
  CRISPR gRNA sequence
ctagcctgggaccctaacca

SEQ ID NO: 46434 - DNA, 20 bp, Artificial
  CRISPR gRNA sequence
ctgggaccctaaccatggta

SEQ ID NO: 46435 - DNA, 20 bp, Artificial
  CRISPR gRNA sequence
gggaccctaaccatggtatg

SEQ ID NO: 46436 - DNA, 20 bp, Artificial
  CRISPR gRNA sequence
ggaccctaaccatggtatgg

SEQ ID NO: 46437 - DNA, 20 bp, Artificial
  CRISPR gRNA sequence
taaccatggtatggaggaca

SEQ ID NO: 46438 - DNA, 20 bp, Artificial
  CRISPR gRNA sequence
gaggacaaagctgtttccta

SEQ ID NO: 46439 - DNA, 20 bp, Artificial
  CRISPR gRNA sequence
caaagctgtttcctaaagaa

SEQ ID NO: 46440 - DNA, 20 bp, Artificial
  CRISPR gRNA sequence
aaagctgtttcctaaagaac

SEQ ID NO: 46441 - DNA, 20 bp, Artificial
  CRISPR gRNA sequence
tttcctaaagaacaggacac

SEQ ID NO: 46442 - DNA, 20 bp, Artificial
  CRISPR gRNA sequence
aacaggacacaagtgattac

SEQ ID NO: 46443 - DNA, 20 bp, Artificial
  CRISPR gRNA sequence
aggacacaagtgattacgag

SEQ ID NO: 46444 - DNA, 20 bp, Artificial
  CRISPR gRNA sequence
aagtgattacgagaagattt

SEQ ID NO: 46445 - DNA, 20 bp, Artificial
  CRISPR gRNA sequence
agattttagtttgcatccta

SEQ ID NO: 46446 - DNA, 20 bp, Artificial
  CRISPR gRNA sequence
gattttagtttgcatcctaa

SEQ ID NO: 46447 - DNA, 20 bp, Artificial
  CRISPR gRNA sequence
taacccttctcattacacca

SEQ ID NO: 46448 - DNA, 20 bp, Artificial
  CRISPR gRNA sequence
ttctcattacaccaaagcga

SEQ ID NO: 46449 - DNA, 20 bp, Artificial
  CRISPR gRNA sequence
ttacaccaaagcgaaagtct

SEQ ID NO: 46450 - DNA, 20 bp, Artificial
  CRISPR gRNA sequence
ccaaagcgaaagtctcagat

SEQ ID NO: 46451 - DNA, 20 bp, Artificial
  CRISPR gRNA sequence
aagcgaaagtctcagatcag

SEQ ID NO: 46452 - DNA, 20 bp, Artificial
  CRISPR gRNA sequence
tcatctttaacacctaacac

SEQ ID NO: 46453 - DNA, 20 bp, Artificial
  CRISPR gRNA sequence
gattctccctttttaaccaa

SEQ ID NO: 46454 - DNA, 20 bp, Artificial
  CRISPR gRNA sequence
attctccctttttaaccaaa

SEQ ID NO: 46455 - DNA, 20 bp, Artificial
  CRISPR gRNA sequence
ttctccctttttaaccaaaa

SEQ ID NO: 46456 - DNA, 20 bp, Artificial
  CRISPR gRNA sequence
gggttaaaaacccaacatct

SEQ ID NO: 46457 - DNA, 20 bp, Artificial
  CRISPR gRNA sequence
ggttaaaaacccaacatctt

SEQ ID NO: 46458 - DNA, 20 bp, Artificial
  CRISPR gRNA sequence
taaaaacccaacatcttagg

SEQ ID NO: 46459 - DNA, 20 bp, Artificial
  CRISPR gRNA sequence
aaaaacccaacatcttagga

SEQ ID NO: 46460 - DNA, 20 bp, Artificial
  CRISPR gRNA sequence
aaaacccaacatcttaggaa

SEQ ID NO: 46461 - DNA, 20 bp, Artificial
  CRISPR gRNA sequence
ggaagggcatatgttccaac

SEQ ID NO: 46462 - DNA, 20 bp, Artificial
  CRISPR gRNA sequence
agggcatatgttccaactag

SEQ ID NO: 46463 - DNA, 20 bp, Artificial
  CRISPR gRNA sequence
ttttgtaactaccttctata

SEQ ID NO: 46464 - DNA, 20 bp, Artificial
  CRISPR gRNA sequence
ttgtaactaccttctatatg

SEQ ID NO: 46465 - DNA, 20 bp, Artificial
  CRISPR gRNA sequence
ctatatggagtctgtaacac

SEQ ID NO: 46466 - DNA, 20 bp, Artificial
  CRISPR gRNA sequence
taacacaagttttccattga

SEQ ID NO: 46467 - DNA, 20 bp, Artificial
  CRISPR gRNA sequence
cacaagttttccattgatag

SEQ ID NO: 46468 - DNA, 20 bp, Artificial
  CRISPR gRNA sequence
tccattgatagtagcaataa

SEQ ID NO: 46469 - DNA, 20 bp, Artificial
  CRISPR gRNA sequence
agcaataaaagtttcctttc

SEQ ID NO: 46470 - DNA, 20 bp, Artificial
  CRISPR gRNA sequence
tttttttttttttttttttt

SEQ ID NO: 46471 - DNA, 20 bp, Artificial
  CRISPR gRNA sequence
ttttttttttttttttgaga

SEQ ID NO: 46472 - DNA, 20 bp, Artificial
  CRISPR gRNA sequence
ttttttttttttttgagatg

SEQ ID NO: 46473 - DNA, 20 bp, Artificial
  CRISPR gRNA sequence
tggagtctccctctgttacc

SEQ ID NO: 46474 - DNA, 20 bp, Artificial
  CRISPR gRNA sequence
ggagtctccctctgttaccc

SEQ ID NO: 46475 - DNA, 20 bp, Artificial
  CRISPR gRNA sequence
tctccctctgttacccaggc

SEQ ID NO: 46476 - DNA, 20 bp, Artificial
  CRISPR gRNA sequence
tccctctgttacccaggctg

SEQ ID NO: 46477 - DNA, 20 bp, Artificial
  CRISPR gRNA sequence
ctgttacccaggctggagtg

SEQ ID NO: 46478 - DNA, 20 bp, Artificial
  CRISPR gRNA sequence
ttacccaggctggagtgcag

SEQ ID NO: 46479 - DNA, 20 bp, Artificial
  CRISPR gRNA sequence
ggagtgcagtggtgcaatct

SEQ ID NO: 46480 - DNA, 20 bp, Artificial
  CRISPR gRNA sequence
tcactgcaacctccacctgc

SEQ ID NO: 46481 - DNA, 20 bp, Artificial
  CRISPR gRNA sequence
cactgcaacctccacctgcc

SEQ ID NO: 46482 - DNA, 20 bp, Artificial
  CRISPR gRNA sequence
aacctccacctgccgggttc

SEQ ID NO: 46483 - DNA, 20 bp, Artificial
  CRISPR gRNA sequence
cctccacctgccgggttcaa

SEQ ID NO: 46484 - DNA, 20 bp, Artificial
  CRISPR gRNA sequence
ttcaagagattctcctgcct

SEQ ID NO: 46485 - DNA, 20 bp, Artificial
  CRISPR gRNA sequence
ttctcctgcctcagcctcct

SEQ ID NO: 46486 - DNA, 20 bp, Artificial
  CRISPR gRNA sequence
tcctgcctcagcctcctgag

SEQ ID NO: 46487 - DNA, 20 bp, Artificial
  CRISPR gRNA sequence
gcctcagcctcctgagtagc

SEQ ID NO: 46488 - DNA, 20 bp, Artificial
  CRISPR gRNA sequence
cctcagcctcctgagtagct

SEQ ID NO: 46489 - DNA, 20 bp, Artificial
  CRISPR gRNA sequence
tcctgagtagctgggattac

SEQ ID NO: 46490 - DNA, 20 bp, Artificial
  CRISPR gRNA sequence
caagtgcccaccaccacacc

SEQ ID NO: 46491 - DNA, 20 bp, Artificial
  CRISPR gRNA sequence
ccagctaatttttgtatttt

SEQ ID NO: 46492 - DNA, 20 bp, Artificial
  CRISPR gRNA sequence
gctaatttttgtatttttag

SEQ ID NO: 46493 - DNA, 20 bp, Artificial
  CRISPR gRNA sequence
taatttttgtatttttagta

SEQ ID NO: 46494 - DNA, 20 bp, Artificial
  CRISPR gRNA sequence
ttttgtatttttagtagaga

SEQ ID NO: 46495 - DNA, 20 bp, Artificial
  CRISPR gRNA sequence
tttgtatttttagtagagac

SEQ ID NO: 46496 - DNA, 20 bp, Artificial
  CRISPR gRNA sequence
gagacaggatttcaccatgt

SEQ ID NO: 46497 - DNA, 20 bp, Artificial
  CRISPR gRNA sequence
caggatttcaccatgttggt

SEQ ID NO: 46498 - DNA, 20 bp, Artificial
  CRISPR gRNA sequence
aggatttcaccatgttggtt

SEQ ID NO: 46499 - DNA, 20 bp, Artificial
  CRISPR gRNA sequence
tcgtctcaaacacctgacct

SEQ ID NO: 46500 - DNA, 20 bp, Artificial
  CRISPR gRNA sequence
cacctgaccttggcctccca

SEQ ID NO: 46501 - DNA, 20 bp, Artificial
  CRISPR gRNA sequence
accttggcctcccaaagtgc

SEQ ID NO: 46502 - DNA, 20 bp, Artificial
  CRISPR gRNA sequence
ccttggcctcccaaagtgct

SEQ ID NO: 46503 - DNA, 20 bp, Artificial
  CRISPR gRNA sequence
ctcccaaagtgctgggatta

SEQ ID NO: 46504 - DNA, 20 bp, Artificial
  CRISPR gRNA sequence
tcccaaagtgctgggattac

SEQ ID NO: 46505 - DNA, 20 bp, Artificial
  CRISPR gRNA sequence
agtgctgggattacaggcgt

SEQ ID NO: 46506 - DNA, 20 bp, Artificial
  CRISPR gRNA sequence
caggcgtgagcaaccacgcc

SEQ ID NO: 46507 - DNA, 20 bp, Artificial
  CRISPR gRNA sequence
gtgagcaaccacgcccagcc

SEQ ID NO: 46508 - DNA, 20 bp, Artificial
  CRISPR gRNA sequence
cagccaagattaatttttta

SEQ ID NO: 46509 - DNA, 20 bp, Artificial
  CRISPR gRNA sequence
caagattaattttttaaagt

SEQ ID NO: 46510 - DNA, 20 bp, Artificial
  CRISPR gRNA sequence
aattttttaaagtaagaaaa

SEQ ID NO: 46511 - DNA, 20 bp, Artificial
  CRISPR gRNA sequence
ttttttaaagtaagaaaaaa

SEQ ID NO: 46512 - DNA, 20 bp, Artificial
  CRISPR gRNA sequence
tttttaaagtaagaaaaaag

SEQ ID NO: 46513 - DNA, 20 bp, Artificial
  CRISPR gRNA sequence
ttttaaagtaagaaaaaaga

SEQ ID NO: 46514 - DNA, 20 bp, Artificial
  CRISPR gRNA sequence
tttaaagtaagaaaaaagag

SEQ ID NO: 46515 - DNA, 20 bp, Artificial
  CRISPR gRNA sequence
ttaaagtaagaaaaaagagg

SEQ ID NO: 46516 - DNA, 20 bp, Artificial
  CRISPR gRNA sequence
aaaaagagggggccaattta

SEQ ID NO: 46517 - DNA, 20 bp, Artificial
  CRISPR gRNA sequence
aatatgatgcatcttaaata

SEQ ID NO: 46518 - DNA, 20 bp, Artificial
  CRISPR gRNA sequence
atatgatgcatcttaaatac

SEQ ID NO: 46519 - DNA, 20 bp, Artificial
  CRISPR gRNA sequence
atgatgcatcttaaatacag

SEQ ID NO: 46520 - DNA, 20 bp, Artificial
  CRISPR gRNA sequence
tgatgcatcttaaatacagg

SEQ ID NO: 46521 - DNA, 20 bp, Artificial
  CRISPR gRNA sequence
atacaggaggtacatgtatg

SEQ ID NO: 46522 - DNA, 20 bp, Artificial
  CRISPR gRNA sequence
gtacatgtatgtggcaaaaa

SEQ ID NO: 46523 - DNA, 20 bp, Artificial
  CRISPR gRNA sequence
acgtcatgattcaaacttga

SEQ ID NO: 46524 - DNA, 20 bp, Artificial
  CRISPR gRNA sequence
cgtcatgattcaaacttgac

SEQ ID NO: 46525 - DNA, 20 bp, Artificial
  CRISPR gRNA sequence
gtcatgattcaaacttgacg

SEQ ID NO: 46526 - DNA, 20 bp, Artificial
  CRISPR gRNA sequence
catgattcaaacttgacggg

SEQ ID NO: 46527 - DNA, 20 bp, Artificial
  CRISPR gRNA sequence
atgattcaaacttgacgggg

SEQ ID NO: 46528 - DNA, 20 bp, Artificial
  CRISPR gRNA sequence
tgattcaaacttgacgggga

SEQ ID NO: 46529 - DNA, 20 bp, Artificial
  CRISPR gRNA sequence
gattcaaacttgacggggag

SEQ ID NO: 46530 - DNA, 20 bp, Artificial
  CRISPR gRNA sequence
ttcaaacttgacggggaggg

SEQ ID NO: 46531 - DNA, 20 bp, Artificial
  CRISPR gRNA sequence
aaacttgacggggaggggag

SEQ ID NO: 46532 - DNA, 20 bp, Artificial
  CRISPR gRNA sequence
aacttgacggggaggggagc

SEQ ID NO: 46533 - DNA, 20 bp, Artificial
  CRISPR gRNA sequence
acttgacggggaggggagca

SEQ ID NO: 46534 - DNA, 20 bp, Artificial
  CRISPR gRNA sequence
ttgacggggaggggagcagg

SEQ ID NO: 46535 - DNA, 20 bp, Artificial
  CRISPR gRNA sequence
tgacggggaggggagcaggg

SEQ ID NO: 46536 - DNA, 20 bp, Artificial
  CRISPR gRNA sequence
cggggaggggagcagggagg

SEQ ID NO: 46537 - DNA, 20 bp, Artificial
  CRISPR gRNA sequence
ggggaggggagcagggagga

SEQ ID NO: 46538 - DNA, 20 bp, Artificial
  CRISPR gRNA sequence
aacctgcaccctgacgtctt

SEQ ID NO: 46539 - DNA, 20 bp, Artificial
  CRISPR gRNA sequence
acctgcaccctgacgtcttc

SEQ ID NO: 46540 - DNA, 20 bp, Artificial
  CRISPR gRNA sequence
cctgcaccctgacgtcttca

SEQ ID NO: 46541 - DNA, 20 bp, Artificial
  CRISPR gRNA sequence
ctgcaccctgacgtcttcag

SEQ ID NO: 46542 - DNA, 20 bp, Artificial
  CRISPR gRNA sequence
gcaccctgacgtcttcaggg

SEQ ID NO: 46543 - DNA, 20 bp, Artificial
  CRISPR gRNA sequence
caccctgacgtcttcagggg

SEQ ID NO: 46544 - DNA, 20 bp, Artificial
  CRISPR gRNA sequence
gtcttcaggggaggacacac

SEQ ID NO: 46545 - DNA, 20 bp, Artificial
  CRISPR gRNA sequence
aggacacacaagcaccctat

SEQ ID NO: 46546 - DNA, 20 bp, Artificial
  CRISPR gRNA sequence
ggacacacaagcaccctatc

SEQ ID NO: 46547 - DNA, 20 bp, Artificial
  CRISPR gRNA sequence
cacacaagcaccctatcagg

SEQ ID NO: 46548 - DNA, 20 bp, Artificial
  CRISPR gRNA sequence
aaaacccttgcccccacgac

SEQ ID NO: 46549 - DNA, 20 bp, Artificial
  CRISPR gRNA sequence
tgctctcctgccgctgactt

SEQ ID NO: 46550 - DNA, 20 bp, Artificial
  CRISPR gRNA sequence
gctctcctgccgctgacttt

SEQ ID NO: 46551 - DNA, 20 bp, Artificial
  CRISPR gRNA sequence
actttgggacccctaccctg

SEQ ID NO: 46552 - DNA, 20 bp, Artificial
  CRISPR gRNA sequence
ctttgggacccctaccctgc

SEQ ID NO: 46553 - DNA, 20 bp, Artificial
  CRISPR gRNA sequence
ccctaccctgcaggctgtcc

SEQ ID NO: 46554 - DNA, 20 bp, Artificial
  CRISPR gRNA sequence
aggctgtcctggaatctcct

SEQ ID NO: 46555 - DNA, 20 bp, Artificial
  CRISPR gRNA sequence
ggctgtcctggaatctcctc

SEQ ID NO: 46556 - DNA, 20 bp, Artificial
  CRISPR gRNA sequence
gctgtcctggaatctcctcg

SEQ ID NO: 46557 - DNA, 20 bp, Artificial
  CRISPR gRNA sequence
cctggaatctcctcggggat

SEQ ID NO: 46558 - DNA, 20 bp, Artificial
  CRISPR gRNA sequence
ctggaatctcctcggggatg

SEQ ID NO: 46559 - DNA, 20 bp, Artificial
  CRISPR gRNA sequence
gaatctcctcggggatgagg

SEQ ID NO: 46560 - DNA, 20 bp, Artificial
  CRISPR gRNA sequence
tcggggatgaggcagctgcc

SEQ ID NO: 46561 - DNA, 20 bp, Artificial
  CRISPR gRNA sequence
ggatgaggcagctgccgagc

SEQ ID NO: 46562 - DNA, 20 bp, Artificial
  CRISPR gRNA sequence
aggcagctgccgagctggcc

SEQ ID NO: 46563 - DNA, 20 bp, Artificial
  CRISPR gRNA sequence
ggcagctgccgagctggccc

SEQ ID NO: 46564 - DNA, 20 bp, Artificial
  CRISPR gRNA sequence
agctggcccaggtgctgccg

SEQ ID NO: 46565 - DNA, 20 bp, Artificial
  CRISPR gRNA sequence
ggcccaggtgctgccgcaga

SEQ ID NO: 46566 - DNA, 20 bp, Artificial
  CRISPR gRNA sequence
gcccaggtgctgccgcagat

SEQ ID NO: 46567 - DNA, 20 bp, Artificial
  CRISPR gRNA sequence
aggtgctgccgcagatgggc

SEQ ID NO: 46568 - DNA, 20 bp, Artificial
  CRISPR gRNA sequence
tgccgcagatgggccggctg

SEQ ID NO: 46569 - DNA, 20 bp, Artificial
  CRISPR gRNA sequence
ccgcagatgggccggctgaa

SEQ ID NO: 46570 - DNA, 20 bp, Artificial
  CRISPR gRNA sequence
gcagatgggccggctgaaga

SEQ ID NO: 46571 - DNA, 20 bp, Artificial
  CRISPR gRNA sequence
gatgggccggctgaagagag

SEQ ID NO: 46572 - DNA, 20 bp, Artificial
  CRISPR gRNA sequence
tgggccggctgaagagagtg

SEQ ID NO: 46573 - DNA, 20 bp, Artificial
  CRISPR gRNA sequence
ggctgaagagagtggagtat

SEQ ID NO: 46574 - DNA, 20 bp, Artificial
  CRISPR gRNA sequence
gctgaagagagtggagtatg

SEQ ID NO: 46575 - DNA, 20 bp, Artificial
  CRISPR gRNA sequence
ctgaagagagtggagtatga

SEQ ID NO: 46576 - DNA, 20 bp, Artificial
  CRISPR gRNA sequence
tgaagagagtggagtatgag

SEQ ID NO: 46577 - DNA, 20 bp, Artificial
  CRISPR gRNA sequence
gagagtggagtatgaggggc

SEQ ID NO: 46578 - DNA, 20 bp, Artificial
  CRISPR gRNA sequence
agagtggagtatgaggggcc

SEQ ID NO: 46579 - DNA, 20 bp, Artificial
  CRISPR gRNA sequence
gagtggagtatgaggggccg

SEQ ID NO: 46580 - DNA, 20 bp, Artificial
  CRISPR gRNA sequence
agtggagtatgaggggccgg

SEQ ID NO: 46581 - DNA, 20 bp, Artificial
  CRISPR gRNA sequence
tggagtatgaggggccgggg

SEQ ID NO: 46582 - DNA, 20 bp, Artificial
  CRISPR gRNA sequence
ggagtatgaggggccggggg

SEQ ID NO: 46583 - DNA, 20 bp, Artificial
  CRISPR gRNA sequence
atgaggggccgggggaggaa

SEQ ID NO: 46584 - DNA, 20 bp, Artificial
  CRISPR gRNA sequence
tgaggggccgggggaggaat

SEQ ID NO: 46585 - DNA, 20 bp, Artificial
  CRISPR gRNA sequence
gggccgggggaggaatggga

SEQ ID NO: 46586 - DNA, 20 bp, Artificial
  CRISPR gRNA sequence
ggccgggggaggaatgggac

SEQ ID NO: 46587 - DNA, 20 bp, Artificial
  CRISPR gRNA sequence
gggaggaatgggacgggcta

SEQ ID NO: 46588 - DNA, 20 bp, Artificial
  CRISPR gRNA sequence
ggaggaatgggacgggctaa

SEQ ID NO: 46589 - DNA, 20 bp, Artificial
  CRISPR gRNA sequence
gaggaatgggacgggctaaa

SEQ ID NO: 46590 - DNA, 20 bp, Artificial
  CRISPR gRNA sequence
aggaatgggacgggctaaag

SEQ ID NO: 46591 - DNA, 20 bp, Artificial
  CRISPR gRNA sequence
ggaatgggacgggctaaagg

SEQ ID NO: 46592 - DNA, 20 bp, Artificial
  CRISPR gRNA sequence
ctaaagggggacctacatcc

SEQ ID NO: 46593 - DNA, 20 bp, Artificial
  CRISPR gRNA sequence
taaagggggacctacatccc

SEQ ID NO: 46594 - DNA, 20 bp, Artificial
  CRISPR gRNA sequence
acctacatcccgggaacacc

SEQ ID NO: 46595 - DNA, 20 bp, Artificial
  CRISPR gRNA sequence
ctacatcccgggaacaccaa

SEQ ID NO: 46596 - DNA, 20 bp, Artificial
  CRISPR gRNA sequence
tacatcccgggaacaccaag

SEQ ID NO: 46597 - DNA, 20 bp, Artificial
  CRISPR gRNA sequence
cgggaacaccaagaggccac

SEQ ID NO: 46598 - DNA, 20 bp, Artificial
  CRISPR gRNA sequence
gggaacaccaagaggccact

SEQ ID NO: 46599 - DNA, 20 bp, Artificial
  CRISPR gRNA sequence
acaccaagaggccactgggt

SEQ ID NO: 46600 - DNA, 20 bp, Artificial
  CRISPR gRNA sequence
tgggtcagtcccctgcctcc

SEQ ID NO: 46601 - DNA, 20 bp, Artificial
  CRISPR gRNA sequence
tcagtcccctgcctcccaga

SEQ ID NO: 46602 - DNA, 20 bp, Artificial
  CRISPR gRNA sequence
ctcccagaaagcccttcctt

SEQ ID NO: 46603 - DNA, 20 bp, Artificial
  CRISPR gRNA sequence
cttccttgagttgcacactc

SEQ ID NO: 46604 - DNA, 20 bp, Artificial
  CRISPR gRNA sequence
tgcacactctggcctgttcc

SEQ ID NO: 46605 - DNA, 20 bp, Artificial
  CRISPR gRNA sequence
ggcctgttccaagcccctgc

SEQ ID NO: 46606 - DNA, 20 bp, Artificial
  CRISPR gRNA sequence
gcctgttccaagcccctgcc

SEQ ID NO: 46607 - DNA, 20 bp, Artificial
  CRISPR gRNA sequence
ttccaagcccctgccaggct

SEQ ID NO: 46608 - DNA, 20 bp, Artificial
  CRISPR gRNA sequence
ctgccaggcttagttccccc

SEQ ID NO: 46609 - DNA, 20 bp, Artificial
  CRISPR gRNA sequence
tgccaggcttagttccccct

SEQ ID NO: 46610 - DNA, 20 bp, Artificial
  CRISPR gRNA sequence
gcttagttccccctgggttc

SEQ ID NO: 46611 - DNA, 20 bp, Artificial
  CRISPR gRNA sequence
tccccctgggttctagcctt

SEQ ID NO: 46612 - DNA, 20 bp, Artificial
  CRISPR gRNA sequence
cttcctgctgcacctgccac

SEQ ID NO: 46613 - DNA, 20 bp, Artificial
  CRISPR gRNA sequence
accagtcccctgttgtcttt

SEQ ID NO: 46614 - DNA, 20 bp, Artificial
  CRISPR gRNA sequence
ccagtcccctgttgtctttt

SEQ ID NO: 46615 - DNA, 20 bp, Artificial
  CRISPR gRNA sequence
tgttgtcttttgggttccct

SEQ ID NO: 46616 - DNA, 20 bp, Artificial
  CRISPR gRNA sequence
tgtcttttgggttccctgag

SEQ ID NO: 46617 - DNA, 20 bp, Artificial
  CRISPR gRNA sequence
gtcttttgggttccctgaga

SEQ ID NO: 46618 - DNA, 20 bp, Artificial
  CRISPR gRNA sequence
ttttgggttccctgagaagg

SEQ ID NO: 46619 - DNA, 20 bp, Artificial
  CRISPR gRNA sequence
ggttccctgagaaggtagtg

SEQ ID NO: 46620 - DNA, 20 bp, Artificial
  CRISPR gRNA sequence
gttccctgagaaggtagtgt

SEQ ID NO: 46621 - DNA, 20 bp, Artificial
  CRISPR gRNA sequence
tccctgagaaggtagtgtgg

SEQ ID NO: 46622 - DNA, 20 bp, Artificial
  CRISPR gRNA sequence
gagactgtgtcccctgacct

SEQ ID NO: 46623 - DNA, 20 bp, Artificial
  CRISPR gRNA sequence
gtgtcccctgaccttggcct

SEQ ID NO: 46624 - DNA, 20 bp, Artificial
  CRISPR gRNA sequence
tgtcccctgaccttggcctg

SEQ ID NO: 46625 - DNA, 20 bp, Artificial
  CRISPR gRNA sequence
cccctgaccttggcctgagg

SEQ ID NO: 46626 - DNA, 20 bp, Artificial
  CRISPR gRNA sequence
ccctgaccttggcctgagga

SEQ ID NO: 46627 - DNA, 20 bp, Artificial
  CRISPR gRNA sequence
cctgaccttggcctgaggaa

SEQ ID NO: 46628 - DNA, 20 bp, Artificial
  CRISPR gRNA sequence
cttggcctgaggaagggacc

SEQ ID NO: 46629 - DNA, 20 bp, Artificial
  CRISPR gRNA sequence
ttggcctgaggaagggacct

SEQ ID NO: 46630 - DNA, 20 bp, Artificial
  CRISPR gRNA sequence
aactctcacacccattctca

SEQ ID NO: 46631 - DNA, 20 bp, Artificial
  CRISPR gRNA sequence
ccctcccctcactgtccact

SEQ ID NO: 46632 - DNA, 20 bp, Artificial
  CRISPR gRNA sequence
tcccctcactgtccactgag

SEQ ID NO: 46633 - DNA, 20 bp, Artificial
  CRISPR gRNA sequence
tcactgtccactgagaagcc

SEQ ID NO: 46634 - DNA, 20 bp, Artificial
  CRISPR gRNA sequence
actgtccactgagaagcctg

SEQ ID NO: 46635 - DNA, 20 bp, Artificial
  CRISPR gRNA sequence
gtccactgagaagcctggag

SEQ ID NO: 46636 - DNA, 20 bp, Artificial
  CRISPR gRNA sequence
tgagaagcctggagaagaat

SEQ ID NO: 46637 - DNA, 20 bp, Artificial
  CRISPR gRNA sequence
cctggagaagaatcagatca

SEQ ID NO: 46638 - DNA, 20 bp, Artificial
  CRISPR gRNA sequence
gaagaatcagatcacagctt

SEQ ID NO: 46639 - DNA, 20 bp, Artificial
  CRISPR gRNA sequence
aagaatcagatcacagcttt

SEQ ID NO: 46640 - DNA, 20 bp, Artificial
  CRISPR gRNA sequence
agaatcagatcacagctttg

SEQ ID NO: 46641 - DNA, 20 bp, Artificial
  CRISPR gRNA sequence
gaatcagatcacagctttgg

SEQ ID NO: 46642 - DNA, 20 bp, Artificial
  CRISPR gRNA sequence
agatcacagctttgggggcc

SEQ ID NO: 46643 - DNA, 20 bp, Artificial
  CRISPR gRNA sequence
agctttgggggcctggctcc

SEQ ID NO: 46644 - DNA, 20 bp, Artificial
  CRISPR gRNA sequence
gggggcctggctcctggctg

SEQ ID NO: 46645 - DNA, 20 bp, Artificial
  CRISPR gRNA sequence
ggggcctggctcctggctga

SEQ ID NO: 46646 - DNA, 20 bp, Artificial
  CRISPR gRNA sequence
ctggctcctggctgaaggac

SEQ ID NO: 46647 - DNA, 20 bp, Artificial
  CRISPR gRNA sequence
tcctggctgaaggactggcc

SEQ ID NO: 46648 - DNA, 20 bp, Artificial
  CRISPR gRNA sequence
cctggctgaaggactggccc

SEQ ID NO: 46649 - DNA, 20 bp, Artificial
  CRISPR gRNA sequence
ctggctgaaggactggccca

SEQ ID NO: 46650 - DNA, 20 bp, Artificial
  CRISPR gRNA sequence
tggctgaaggactggcccag

SEQ ID NO: 46651 - DNA, 20 bp, Artificial
  CRISPR gRNA sequence
gaaggactggcccaggggtc

SEQ ID NO: 46652 - DNA, 20 bp, Artificial
  CRISPR gRNA sequence
ggcccaggggtctagcatcc

SEQ ID NO: 46653 - DNA, 20 bp, Artificial
  CRISPR gRNA sequence
ggtctagcatccaagtcatc

SEQ ID NO: 46654 - DNA, 20 bp, Artificial
  CRISPR gRNA sequence
gcatccaagtcatccggtaa

SEQ ID NO: 46655 - DNA, 20 bp, Artificial
  CRISPR gRNA sequence
atccaagtcatccggtaaca

SEQ ID NO: 46656 - DNA, 20 bp, Artificial
  CRISPR gRNA sequence
tccaagtcatccggtaacag

SEQ ID NO: 46657 - DNA, 20 bp, Artificial
  CRISPR gRNA sequence
catccggtaacagaggcctg

SEQ ID NO: 46658 - DNA, 20 bp, Artificial
  CRISPR gRNA sequence
atccggtaacagaggcctgc

SEQ ID NO: 46659 - DNA, 20 bp, Artificial
  CRISPR gRNA sequence
tccggtaacagaggcctgca

SEQ ID NO: 46660 - DNA, 20 bp, Artificial
  CRISPR gRNA sequence
ccggtaacagaggcctgcag

SEQ ID NO: 46661 - DNA, 20 bp, Artificial
  CRISPR gRNA sequence
gtaacagaggcctgcagggg

SEQ ID NO: 46662 - DNA, 20 bp, Artificial
  CRISPR gRNA sequence
taacagaggcctgcaggggc

SEQ ID NO: 46663 - DNA, 20 bp, Artificial
  CRISPR gRNA sequence
aacagaggcctgcaggggca

SEQ ID NO: 46664 - DNA, 20 bp, Artificial
  CRISPR gRNA sequence
gaggcctgcaggggcaggga

SEQ ID NO: 46665 - DNA, 20 bp, Artificial
  CRISPR gRNA sequence
gcctgcaggggcagggatgg

SEQ ID NO: 46666 - DNA, 20 bp, Artificial
  CRISPR gRNA sequence
cctgcaggggcagggatggt

SEQ ID NO: 46667 - DNA, 20 bp, Artificial
  CRISPR gRNA sequence
gcaggggcagggatggtggg

SEQ ID NO: 46668 - DNA, 20 bp, Artificial
  CRISPR gRNA sequence
caggggcagggatggtgggt

SEQ ID NO: 46669 - DNA, 20 bp, Artificial
  CRISPR gRNA sequence
ggggcagggatggtgggtgg

SEQ ID NO: 46670 - DNA, 20 bp, Artificial
  CRISPR gRNA sequence
gggcagggatggtgggtggg

SEQ ID NO: 46671 - DNA, 20 bp, Artificial
  CRISPR gRNA sequence
tgggaggctacaccaacccc

SEQ ID NO: 46672 - DNA, 20 bp, Artificial
  CRISPR gRNA sequence
acaccaacccccagatctaa

SEQ ID NO: 46673 - DNA, 20 bp, Artificial
  CRISPR gRNA sequence
caccaacccccagatctaat

SEQ ID NO: 46674 - DNA, 20 bp, Artificial
  CRISPR gRNA sequence
ccagatctaatgggactccc

SEQ ID NO: 46675 - DNA, 20 bp, Artificial
  CRISPR gRNA sequence
agatctaatgggactccctg

SEQ ID NO: 46676 - DNA, 20 bp, Artificial
  CRISPR gRNA sequence
gatctaatgggactccctgg

SEQ ID NO: 46677 - DNA, 20 bp, Artificial
  CRISPR gRNA sequence
tctaatgggactccctggag

SEQ ID NO: 46678 - DNA, 20 bp, Artificial
  CRISPR gRNA sequence
ctaatgggactccctggagg

SEQ ID NO: 46679 - DNA, 20 bp, Artificial
  CRISPR gRNA sequence
atgggactccctggaggagg

SEQ ID NO: 46680 - DNA, 20 bp, Artificial
  CRISPR gRNA sequence
ggactccctggaggaggcgg

SEQ ID NO: 46681 - DNA, 20 bp, Artificial
  CRISPR gRNA sequence
gactccctggaggaggcggc

SEQ ID NO: 46682 - DNA, 20 bp, Artificial
  CRISPR gRNA sequence
actccctggaggaggcggca

SEQ ID NO: 46683 - DNA, 20 bp, Artificial
  CRISPR gRNA sequence
ctggaggaggcggcagggcc

SEQ ID NO: 46684 - DNA, 20 bp, Artificial
  CRISPR gRNA sequence
tggaggaggcggcagggcct

SEQ ID NO: 46685 - DNA, 20 bp, Artificial
  CRISPR gRNA sequence
ggaggcggcagggcctgggc

SEQ ID NO: 46686 - DNA, 20 bp, Artificial
  CRISPR gRNA sequence
gaggcggcagggcctgggct

SEQ ID NO: 46687 - DNA, 20 bp, Artificial
  CRISPR gRNA sequence
aggcggcagggcctgggctg

SEQ ID NO: 46688 - DNA, 20 bp, Artificial
  CRISPR gRNA sequence
gcctgggctggggattatca

SEQ ID NO: 46689 - DNA, 20 bp, Artificial
  CRISPR gRNA sequence
cctgggctggggattatcaa

SEQ ID NO: 46690 - DNA, 20 bp, Artificial
  CRISPR gRNA sequence
tgggctggggattatcaaag

SEQ ID NO: 46691 - DNA, 20 bp, Artificial
  CRISPR gRNA sequence
ggggattatcaaaggagact

SEQ ID NO: 46692 - DNA, 20 bp, Artificial
  CRISPR gRNA sequence
gagacttggaccactccacc

SEQ ID NO: 46693 - DNA, 20 bp, Artificial
  CRISPR gRNA sequence
ggaccactccaccaagaatt

SEQ ID NO: 46694 - DNA, 20 bp, Artificial
  CRISPR gRNA sequence
ccactccaccaagaatttgg

SEQ ID NO: 46695 - DNA, 20 bp, Artificial
  CRISPR gRNA sequence
tccaccaagaatttggcagc

SEQ ID NO: 46696 - DNA, 20 bp, Artificial
  CRISPR gRNA sequence
accaagaatttggcagcaag

SEQ ID NO: 46697 - DNA, 20 bp, Artificial
  CRISPR gRNA sequence
aatttggcagcaagcagact

SEQ ID NO: 46698 - DNA, 20 bp, Artificial
  CRISPR gRNA sequence
agcagacttggatcaaaccc

SEQ ID NO: 46699 - DNA, 20 bp, Artificial
  CRISPR gRNA sequence
ttgccaactgtgtaactttg

SEQ ID NO: 46700 - DNA, 20 bp, Artificial
  CRISPR gRNA sequence
caattttctcatctgtgaaa

SEQ ID NO: 46701 - DNA, 20 bp, Artificial
  CRISPR gRNA sequence
aattttctcatctgtgaaat

SEQ ID NO: 46702 - DNA, 20 bp, Artificial
  CRISPR gRNA sequence
attttctcatctgtgaaatg

SEQ ID NO: 46703 - DNA, 20 bp, Artificial
  CRISPR gRNA sequence
ctgtgaaatggggatactga

SEQ ID NO: 46704 - DNA, 20 bp, Artificial
  CRISPR gRNA sequence
gatactgatagtatctacct

SEQ ID NO: 46705 - DNA, 20 bp, Artificial
  CRISPR gRNA sequence
tactgatagtatctacctca

SEQ ID NO: 46706 - DNA, 20 bp, Artificial
  CRISPR gRNA sequence
ctgatagtatctacctcaga

SEQ ID NO: 46707 - DNA, 20 bp, Artificial
  CRISPR gRNA sequence
atctacctcagagagttgtg

SEQ ID NO: 46708 - DNA, 20 bp, Artificial
  CRISPR gRNA sequence
gagagttgtgaagactaaat

SEQ ID NO: 46709 - DNA, 20 bp, Artificial
  CRISPR gRNA sequence
gaagactaaatgagcatata

SEQ ID NO: 46710 - DNA, 20 bp, Artificial
  CRISPR gRNA sequence
aaagcactgaacccaatgcc

SEQ ID NO: 46711 - DNA, 20 bp, Artificial
  CRISPR gRNA sequence
tgaacccaatgcctggcaca

SEQ ID NO: 46712 - DNA, 20 bp, Artificial
  CRISPR gRNA sequence
cccaatgcctggcacatagt

SEQ ID NO: 46713 - DNA, 20 bp, Artificial
  CRISPR gRNA sequence
cacatagtaagcacttaaaa

SEQ ID NO: 46714 - DNA, 20 bp, Artificial
  CRISPR gRNA sequence
atagtaagcacttaaaatgg

SEQ ID NO: 46715 - DNA, 20 bp, Artificial
  CRISPR gRNA sequence
cttaaaatggcagctataat

SEQ ID NO: 46716 - DNA, 20 bp, Artificial
  CRISPR gRNA sequence
taaaatggcagctataatca

SEQ ID NO: 46717 - DNA, 20 bp, Artificial
  CRISPR gRNA sequence
ataatcagagccatcacata

SEQ ID NO: 46718 - DNA, 20 bp, Artificial
  CRISPR gRNA sequence
agccatcacatacagttgta

SEQ ID NO: 46719 - DNA, 20 bp, Artificial
  CRISPR gRNA sequence
gccatcacatacagttgtat

SEQ ID NO: 46720 - DNA, 20 bp, Artificial
  CRISPR gRNA sequence
gtataggttgtgcactgcac

SEQ ID NO: 46721 - DNA, 20 bp, Artificial
  CRISPR gRNA sequence
tataggttgtgcactgcaca

SEQ ID NO: 46722 - DNA, 20 bp, Artificial
  CRISPR gRNA sequence
ataggttgtgcactgcacaa

SEQ ID NO: 46723 - DNA, 20 bp, Artificial
  CRISPR gRNA sequence
tgcacaagggcattaaacct

SEQ ID NO: 46724 - DNA, 20 bp, Artificial
  CRISPR gRNA sequence
gcacaagggcattaaaccta

SEQ ID NO: 46725 - DNA, 20 bp, Artificial
  CRISPR gRNA sequence
cacaagggcattaaacctaa

SEQ ID NO: 46726 - DNA, 20 bp, Artificial
  CRISPR gRNA sequence
acaagggcattaaacctaag

SEQ ID NO: 46727 - DNA, 20 bp, Artificial
  CRISPR gRNA sequence
cattcacattgtcaacctgc

SEQ ID NO: 46728 - DNA, 20 bp, Artificial
  CRISPR gRNA sequence
ttgtcaacctgctagatttc

SEQ ID NO: 46729 - DNA, 20 bp, Artificial
  CRISPR gRNA sequence
tcaacctgctagatttctag

SEQ ID NO: 46730 - DNA, 20 bp, Artificial
  CRISPR gRNA sequence
ctgctagatttctagcagat

SEQ ID NO: 46731 - DNA, 20 bp, Artificial
  CRISPR gRNA sequence
gctagatttctagcagatga

SEQ ID NO: 46732 - DNA, 20 bp, Artificial
  CRISPR gRNA sequence
atttctagcagatgagagta

SEQ ID NO: 46733 - DNA, 20 bp, Artificial
  CRISPR gRNA sequence
atcatatattatgacaattt

SEQ ID NO: 46734 - DNA, 20 bp, Artificial
  CRISPR gRNA sequence
tatattatgacaatttcaga

SEQ ID NO: 46735 - DNA, 20 bp, Artificial
  CRISPR gRNA sequence
ttatgacaatttcagacaga

SEQ ID NO: 46736 - DNA, 20 bp, Artificial
  CRISPR gRNA sequence
tgacaatttcagacagatgg

SEQ ID NO: 46737 - DNA, 20 bp, Artificial
  CRISPR gRNA sequence
gatggaagtaaaacatcttg

SEQ ID NO: 46738 - DNA, 20 bp, Artificial
  CRISPR gRNA sequence
gaagtaaaacatcttgaaga

SEQ ID NO: 46739 - DNA, 20 bp, Artificial
  CRISPR gRNA sequence
agtaaaacatcttgaagaaa

SEQ ID NO: 46740 - DNA, 20 bp, Artificial
  CRISPR gRNA sequence
gtaaaacatcttgaagaaag

SEQ ID NO: 46741 - DNA, 20 bp, Artificial
  CRISPR gRNA sequence
taaaacatcttgaagaaaga

SEQ ID NO: 46742 - DNA, 20 bp, Artificial
  CRISPR gRNA sequence
tttgcacaaatgtgtcatat

SEQ ID NO: 46743 - DNA, 20 bp, Artificial
  CRISPR gRNA sequence
acaaatgtgtcatatgagtg

SEQ ID NO: 46744 - DNA, 20 bp, Artificial
  CRISPR gRNA sequence
gtgtcatatgagtgtggcct

SEQ ID NO: 46745 - DNA, 20 bp, Artificial
  CRISPR gRNA sequence
catatgagtgtggccttagc

SEQ ID NO: 46746 - DNA, 20 bp, Artificial
  CRISPR gRNA sequence
tagctggcatcactatctcc

SEQ ID NO: 46747 - DNA, 20 bp, Artificial
  CRISPR gRNA sequence
agctggcatcactatctccc

SEQ ID NO: 46748 - DNA, 20 bp, Artificial
  CRISPR gRNA sequence
gctggcatcactatctccca

SEQ ID NO: 46749 - DNA, 20 bp, Artificial
  CRISPR gRNA sequence
tggcatcactatctcccagg

SEQ ID NO: 46750 - DNA, 20 bp, Artificial
  CRISPR gRNA sequence
ggcatcactatctcccaggg

SEQ ID NO: 46751 - DNA, 20 bp, Artificial
  CRISPR gRNA sequence
atcactatctcccagggagg

SEQ ID NO: 46752 - DNA, 20 bp, Artificial
  CRISPR gRNA sequence
tcactatctcccagggagga

SEQ ID NO: 46753 - DNA, 20 bp, Artificial
  CRISPR gRNA sequence
atctcccagggaggaaggtt

SEQ ID NO: 46754 - DNA, 20 bp, Artificial
  CRISPR gRNA sequence
cccagggaggaaggttgagt

SEQ ID NO: 46755 - DNA, 20 bp, Artificial
  CRISPR gRNA sequence
cagggaggaaggttgagttg

SEQ ID NO: 46756 - DNA, 20 bp, Artificial
  CRISPR gRNA sequence
agggaggaaggttgagttgg

SEQ ID NO: 46757 - DNA, 20 bp, Artificial
  CRISPR gRNA sequence
gaaggttgagttggaggact

SEQ ID NO: 46758 - DNA, 20 bp, Artificial
  CRISPR gRNA sequence
aaggttgagttggaggactc

SEQ ID NO: 46759 - DNA, 20 bp, Artificial
  CRISPR gRNA sequence
ggttgagttggaggactcag

SEQ ID NO: 46760 - DNA, 20 bp, Artificial
  CRISPR gRNA sequence
gttgagttggaggactcagg

SEQ ID NO: 46761 - DNA, 20 bp, Artificial
  CRISPR gRNA sequence
gagttggaggactcaggagg

SEQ ID NO: 46762 - DNA, 20 bp, Artificial
  CRISPR gRNA sequence
agttggaggactcaggaggc

SEQ ID NO: 46763 - DNA, 20 bp, Artificial
  CRISPR gRNA sequence
gaggactcaggaggcaggtg

SEQ ID NO: 46764 - DNA, 20 bp, Artificial
  CRISPR gRNA sequence
aggactcaggaggcaggtgt

SEQ ID NO: 46765 - DNA, 20 bp, Artificial
  CRISPR gRNA sequence
ggactcaggaggcaggtgtg

SEQ ID NO: 46766 - DNA, 20 bp, Artificial
  CRISPR gRNA sequence
tgtggggtacaccctctccc

SEQ ID NO: 46767 - DNA, 20 bp, Artificial
  CRISPR gRNA sequence
gtggggtacaccctctccct

SEQ ID NO: 46768 - DNA, 20 bp, Artificial
  CRISPR gRNA sequence
ggtacaccctctccctaggt

SEQ ID NO: 46769 - DNA, 20 bp, Artificial
  CRISPR gRNA sequence
tctccctaggtcagctatgc

SEQ ID NO: 46770 - DNA, 20 bp, Artificial
  CRISPR gRNA sequence
ggtctaacacctgcctctgc

SEQ ID NO: 46771 - DNA, 20 bp, Artificial
  CRISPR gRNA sequence
gtctaacacctgcctctgcc

SEQ ID NO: 46772 - DNA, 20 bp, Artificial
  CRISPR gRNA sequence
ctgcctctgccaggtaactc

SEQ ID NO: 46773 - DNA, 20 bp, Artificial
  CRISPR gRNA sequence
tgcctctgccaggtaactct

SEQ ID NO: 46774 - DNA, 20 bp, Artificial
  CRISPR gRNA sequence
ctgccaggtaactctaggca

SEQ ID NO: 46775 - DNA, 20 bp, Artificial
  CRISPR gRNA sequence
taggcacagctctacctttt

SEQ ID NO: 46776 - DNA, 20 bp, Artificial
  CRISPR gRNA sequence
aggcacagctctaccttttt

SEQ ID NO: 46777 - DNA, 20 bp, Artificial
  CRISPR gRNA sequence
agctctacctttttgggcct

SEQ ID NO: 46778 - DNA, 20 bp, Artificial
  CRISPR gRNA sequence
ggcctcagcctcccaatctg

SEQ ID NO: 46779 - DNA, 20 bp, Artificial
  CRISPR gRNA sequence
ctcccaatctgcagatacga

SEQ ID NO: 46780 - DNA, 20 bp, Artificial
  CRISPR gRNA sequence
caatctgcagatacgacaga

SEQ ID NO: 46781 - DNA, 20 bp, Artificial
  CRISPR gRNA sequence
tgcagatacgacagatggca

SEQ ID NO: 46782 - DNA, 20 bp, Artificial
  CRISPR gRNA sequence
gatacgacagatggcaaaga

SEQ ID NO: 46783 - DNA, 20 bp, Artificial
  CRISPR gRNA sequence
atacgacagatggcaaagat

SEQ ID NO: 46784 - DNA, 20 bp, Artificial
  CRISPR gRNA sequence
acgacagatggcaaagatgg

SEQ ID NO: 46785 - DNA, 20 bp, Artificial
  CRISPR gRNA sequence
cgacagatggcaaagatggg

SEQ ID NO: 46786 - DNA, 20 bp, Artificial
  CRISPR gRNA sequence
gcaaagatgggaggatgaat

SEQ ID NO: 46787 - DNA, 20 bp, Artificial
  CRISPR gRNA sequence
gtgcctatatctgtgcccca

SEQ ID NO: 46788 - DNA, 20 bp, Artificial
  CRISPR gRNA sequence
tatctgtgccccacagcctc

SEQ ID NO: 46789 - DNA, 20 bp, Artificial
  CRISPR gRNA sequence
taaccccattccctgcgaca

SEQ ID NO: 46790 - DNA, 20 bp, Artificial
  CRISPR gRNA sequence
ccattccctgcgacatggcc

SEQ ID NO: 46791 - DNA, 20 bp, Artificial
  CRISPR gRNA sequence
gcgacatggcccagcacctg

SEQ ID NO: 46792 - DNA, 20 bp, Artificial
  CRISPR gRNA sequence
gacatggcccagcacctgaa

SEQ ID NO: 46793 - DNA, 20 bp, Artificial
  CRISPR gRNA sequence
tggcccagcacctgaagagc

SEQ ID NO: 46794 - DNA, 20 bp, Artificial
  CRISPR gRNA sequence
ggcccagcacctgaagagcc

SEQ ID NO: 46795 - DNA, 20 bp, Artificial
  CRISPR gRNA sequence
cccagcacctgaagagccag

SEQ ID NO: 46796 - DNA, 20 bp, Artificial
  CRISPR gRNA sequence
cacctgaagagccaggagcc

SEQ ID NO: 46797 - DNA, 20 bp, Artificial
  CRISPR gRNA sequence
acctgaagagccaggagccc

SEQ ID NO: 46798 - DNA, 20 bp, Artificial
  CRISPR gRNA sequence
gaagagccaggagcccaggc

SEQ ID NO: 46799 - DNA, 20 bp, Artificial
  CRISPR gRNA sequence
actttgccttctttgacaac

SEQ ID NO: 46800 - DNA, 20 bp, Artificial
  CRISPR gRNA sequence
ccttctttgacaaccagccc

SEQ ID NO: 46801 - DNA, 20 bp, Artificial
  CRISPR gRNA sequence
cttctttgacaaccagcccc

SEQ ID NO: 46802 - DNA, 20 bp, Artificial
  CRISPR gRNA sequence
acaaccagccccaggcccct

SEQ ID NO: 46803 - DNA, 20 bp, Artificial
  CRISPR gRNA sequence
caaccagccccaggcccctt

SEQ ID NO: 46804 - DNA, 20 bp, Artificial
  CRISPR gRNA sequence
aaccagccccaggccccttg

SEQ ID NO: 46805 - DNA, 20 bp, Artificial
  CRISPR gRNA sequence
aggccccttggggtacttga

SEQ ID NO: 46806 - DNA, 20 bp, Artificial
  CRISPR gRNA sequence
gggtacttgatggccccctc

SEQ ID NO: 46807 - DNA, 20 bp, Artificial
  CRISPR gRNA sequence
gatggccccctcaagacctt

SEQ ID NO: 46808 - DNA, 20 bp, Artificial
  CRISPR gRNA sequence
ccctcaagacctttggaatc

SEQ ID NO: 46809 - DNA, 20 bp, Artificial
  CRISPR gRNA sequence
aagacctttggaatccagcc

SEQ ID NO: 46810 - DNA, 20 bp, Artificial
  CRISPR gRNA sequence
atgatccacctttcgcccac

SEQ ID NO: 46811 - DNA, 20 bp, Artificial
  CRISPR gRNA sequence
tgatccacctttcgcccact

SEQ ID NO: 46812 - DNA, 20 bp, Artificial
  CRISPR gRNA sequence
gcccactgggataattgact

SEQ ID NO: 46813 - DNA, 20 bp, Artificial
  CRISPR gRNA sequence
cccactgggataattgactc

SEQ ID NO: 46814 - DNA, 20 bp, Artificial
  CRISPR gRNA sequence
ctgggataattgactcagga

SEQ ID NO: 46815 - DNA, 20 bp, Artificial
  CRISPR gRNA sequence
ggataattgactcaggaaag

SEQ ID NO: 46816 - DNA, 20 bp, Artificial
  CRISPR gRNA sequence
ataattgactcaggaaagaa

SEQ ID NO: 46817 - DNA, 20 bp, Artificial
  CRISPR gRNA sequence
gactcaggaaagaagagcct

SEQ ID NO: 46818 - DNA, 20 bp, Artificial
  CRISPR gRNA sequence
tcaggaaagaagagcctcgg

SEQ ID NO: 46819 - DNA, 20 bp, Artificial
  CRISPR gRNA sequence
caggaaagaagagcctcggc

SEQ ID NO: 46820 - DNA, 20 bp, Artificial
  CRISPR gRNA sequence
aggaaagaagagcctcggca

SEQ ID NO: 46821 - DNA, 20 bp, Artificial
  CRISPR gRNA sequence
agggcgctctgcactccacc

SEQ ID NO: 46822 - DNA, 20 bp, Artificial
  CRISPR gRNA sequence
gggcgctctgcactccaccc

SEQ ID NO: 46823 - DNA, 20 bp, Artificial
  CRISPR gRNA sequence
gcgctctgcactccacccag

SEQ ID NO: 46824 - DNA, 20 bp, Artificial
  CRISPR gRNA sequence
cgctctgcactccacccagg

SEQ ID NO: 46825 - DNA, 20 bp, Artificial
  CRISPR gRNA sequence
tctgcactccacccaggagg

SEQ ID NO: 46826 - DNA, 20 bp, Artificial
  CRISPR gRNA sequence
ctgcactccacccaggagga

SEQ ID NO: 46827 - DNA, 20 bp, Artificial
  CRISPR gRNA sequence
aggatacgtgtgtcctgctg

SEQ ID NO: 46828 - DNA, 20 bp, Artificial
  CRISPR gRNA sequence
gtgtgtcctgctgcagtcct

SEQ ID NO: 46829 - DNA, 20 bp, Artificial
  CRISPR gRNA sequence
tgtgtcctgctgcagtcctc

SEQ ID NO: 46830 - DNA, 20 bp, Artificial
  CRISPR gRNA sequence
gtgtcctgctgcagtcctca

SEQ ID NO: 46831 - DNA, 20 bp, Artificial
  CRISPR gRNA sequence
gtcctgctgcagtcctcagg

SEQ ID NO: 46832 - DNA, 20 bp, Artificial
  CRISPR gRNA sequence
gtcctcagggagaacttttt

SEQ ID NO: 46833 - DNA, 20 bp, Artificial
  CRISPR gRNA sequence
tcctcagggagaactttttt

SEQ ID NO: 46834 - DNA, 20 bp, Artificial
  CRISPR gRNA sequence
gggagaacttttttgggaac

SEQ ID NO: 46835 - DNA, 20 bp, Artificial
  CRISPR gRNA sequence
ggagaacttttttgggaacc

SEQ ID NO: 46836 - DNA, 20 bp, Artificial
  CRISPR gRNA sequence
agaacttttttgggaaccag

SEQ ID NO: 46837 - DNA, 20 bp, Artificial
  CRISPR gRNA sequence
cttttttgggaaccaggagc

SEQ ID NO: 46838 - DNA, 20 bp, Artificial
  CRISPR gRNA sequence
ttttttgggaaccaggagct

SEQ ID NO: 46839 - DNA, 20 bp, Artificial
  CRISPR gRNA sequence
tgggaaccaggagctgggtc

SEQ ID NO: 46840 - DNA, 20 bp, Artificial
  CRISPR gRNA sequence
ccaggagctgggtctggaca

SEQ ID NO: 46841 - DNA, 20 bp, Artificial
  CRISPR gRNA sequence
caggagctgggtctggacaa

SEQ ID NO: 46842 - DNA, 20 bp, Artificial
  CRISPR gRNA sequence
ggagctgggtctggacaaag

SEQ ID NO: 46843 - DNA, 20 bp, Artificial
  CRISPR gRNA sequence
aaggagtaccctgcattacg

SEQ ID NO: 46844 - DNA, 20 bp, Artificial
  CRISPR gRNA sequence
aggagtaccctgcattacgt

SEQ ID NO: 46845 - DNA, 20 bp, Artificial
  CRISPR gRNA sequence
gtgggatatgtgtgatcaat

SEQ ID NO: 46846 - DNA, 20 bp, Artificial
  CRISPR gRNA sequence
tgggatatgtgtgatcaatt

SEQ ID NO: 46847 - DNA, 20 bp, Artificial
  CRISPR gRNA sequence
gggatatgtgtgatcaattg

SEQ ID NO: 46848 - DNA, 20 bp, Artificial
  CRISPR gRNA sequence
ggggacatgcgacacacaat

SEQ ID NO: 46849 - DNA, 20 bp, Artificial
  CRISPR gRNA sequence
gggacatgcgacacacaatg

SEQ ID NO: 46850 - DNA, 20 bp, Artificial
  CRISPR gRNA sequence
ggacatgcgacacacaatga

SEQ ID NO: 46851 - DNA, 20 bp, Artificial
  CRISPR gRNA sequence
atgacaatgcatgacacgta

SEQ ID NO: 46852 - DNA, 20 bp, Artificial
  CRISPR gRNA sequence
atgacacgtacggttatatg

SEQ ID NO: 46853 - DNA, 20 bp, Artificial
  CRISPR gRNA sequence
acacgtacggttatatgtgg

SEQ ID NO: 46854 - DNA, 20 bp, Artificial
  CRISPR gRNA sequence
cagtgtgaccccttgacatg

SEQ ID NO: 46855 - DNA, 20 bp, Artificial
  CRISPR gRNA sequence
tgacatgtggcgttacatga

SEQ ID NO: 46856 - DNA, 20 bp, Artificial
  CRISPR gRNA sequence
atgtggcgttacatgaaagt

SEQ ID NO: 46857 - DNA, 20 bp, Artificial
  CRISPR gRNA sequence
gcgttacatgaaagtcagtg

SEQ ID NO: 46858 - DNA, 20 bp, Artificial
  CRISPR gRNA sequence
tcagtgtggcacgtgttctg

SEQ ID NO: 46859 - DNA, 20 bp, Artificial
  CRISPR gRNA sequence
gtggcacgtgttctgtggca

SEQ ID NO: 46860 - DNA, 20 bp, Artificial
  CRISPR gRNA sequence
tggcacgtgttctgtggcat

SEQ ID NO: 46861 - DNA, 20 bp, Artificial
  CRISPR gRNA sequence
gtgttctgtggcatgggtgc

SEQ ID NO: 46862 - DNA, 20 bp, Artificial
  CRISPR gRNA sequence
ggcatgggtgctggcatccc

SEQ ID NO: 46863 - DNA, 20 bp, Artificial
  CRISPR gRNA sequence
atgggtgctggcatcccaag

SEQ ID NO: 46864 - DNA, 20 bp, Artificial
  CRISPR gRNA sequence
ggtgctggcatcccaagtag

SEQ ID NO: 46865 - DNA, 20 bp, Artificial
  CRISPR gRNA sequence
gtgctggcatcccaagtagc

SEQ ID NO: 46866 - DNA, 20 bp, Artificial
  CRISPR gRNA sequence
gtagcaggatacatgattgt

SEQ ID NO: 46867 - DNA, 20 bp, Artificial
  CRISPR gRNA sequence
catgacaaatgtccatgtca

SEQ ID NO: 46868 - DNA, 20 bp, Artificial
  CRISPR gRNA sequence
atgacaaatgtccatgtcac

SEQ ID NO: 46869 - DNA, 20 bp, Artificial
  CRISPR gRNA sequence
tgtccatgtcacaggactca

SEQ ID NO: 46870 - DNA, 20 bp, Artificial
  CRISPR gRNA sequence
catgtcacaggactcatggc

SEQ ID NO: 46871 - DNA, 20 bp, Artificial
  CRISPR gRNA sequence
tcacaggactcatggctggc

SEQ ID NO: 46872 - DNA, 20 bp, Artificial
  CRISPR gRNA sequence
catggctggccagatgacct

SEQ ID NO: 46873 - DNA, 20 bp, Artificial
  CRISPR gRNA sequence
atggctggccagatgacctc

SEQ ID NO: 46874 - DNA, 20 bp, Artificial
  CRISPR gRNA sequence
ctggccagatgacctcaggc

SEQ ID NO: 46875 - DNA, 20 bp, Artificial
  CRISPR gRNA sequence
agatgacctcaggctggccc

SEQ ID NO: 46876 - DNA, 20 bp, Artificial
  CRISPR gRNA sequence
atctaatttattaattttta

SEQ ID NO: 46877 - DNA, 20 bp, Artificial
  CRISPR gRNA sequence
ttaaagcaaatacatattta

SEQ ID NO: 46878 - DNA, 20 bp, Artificial
  CRISPR gRNA sequence
atatttatagattgtgtgta

SEQ ID NO: 46879 - DNA, 20 bp, Artificial
  CRISPR gRNA sequence
atttatagattgtgtgtatg

SEQ ID NO: 46880 - DNA, 20 bp, Artificial
  CRISPR gRNA sequence
tatagattgtgtgtatggag

SEQ ID NO: 46881 - DNA, 20 bp, Artificial
  CRISPR gRNA sequence
attgtgtgtatggagcagct

SEQ ID NO: 46882 - DNA, 20 bp, Artificial
  CRISPR gRNA sequence
tgtgtatggagcagctaagt

SEQ ID NO: 46883 - DNA, 20 bp, Artificial
  CRISPR gRNA sequence
gtgtatggagcagctaagtc

SEQ ID NO: 46884 - DNA, 20 bp, Artificial
  CRISPR gRNA sequence
tggagcagctaagtcaggaa

SEQ ID NO: 46885 - DNA, 20 bp, Artificial
  CRISPR gRNA sequence
tcaggaaaagtcttccgccc

SEQ ID NO: 46886 - DNA, 20 bp, Artificial
  CRISPR gRNA sequence
gaaaagtcttccgcccgagc

SEQ ID NO: 46887 - DNA, 20 bp, Artificial
  CRISPR gRNA sequence
aaaagtcttccgcccgagct

SEQ ID NO: 46888 - DNA, 20 bp, Artificial
  CRISPR gRNA sequence
aagtcttccgcccgagctgg

SEQ ID NO: 46889 - DNA, 20 bp, Artificial
  CRISPR gRNA sequence
agtcttccgcccgagctggg

SEQ ID NO: 46890 - DNA, 20 bp, Artificial
  CRISPR gRNA sequence
gtcttccgcccgagctggga

SEQ ID NO: 46891 - DNA, 20 bp, Artificial
  CRISPR gRNA sequence
tcttccgcccgagctgggag

SEQ ID NO: 46892 - DNA, 20 bp, Artificial
  CRISPR gRNA sequence
ttccgcccgagctgggaggg

SEQ ID NO: 46893 - DNA, 20 bp, Artificial
  CRISPR gRNA sequence
ccgcccgagctgggagggga

SEQ ID NO: 46894 - DNA, 20 bp, Artificial
  CRISPR gRNA sequence
gagagtgtccatgcactgac

SEQ ID NO: 46895 - DNA, 20 bp, Artificial
  CRISPR gRNA sequence
tgtccatgcactgaccagtc

SEQ ID NO: 46896 - DNA, 20 bp, Artificial
  CRISPR gRNA sequence
gtccatgcactgaccagtcc

SEQ ID NO: 46897 - DNA, 20 bp, Artificial
  CRISPR gRNA sequence
tccatgcactgaccagtcca

SEQ ID NO: 46898 - DNA, 20 bp, Artificial
  CRISPR gRNA sequence
ccatgcactgaccagtccag

SEQ ID NO: 46899 - DNA, 20 bp, Artificial
  CRISPR gRNA sequence
actgaccagtccaggggctc

SEQ ID NO: 46900 - DNA, 20 bp, Artificial
  CRISPR gRNA sequence
ctgaccagtccaggggctca

SEQ ID NO: 46901 - DNA, 20 bp, Artificial
  CRISPR gRNA sequence
tgaccagtccaggggctcaa

SEQ ID NO: 46902 - DNA, 20 bp, Artificial
  CRISPR gRNA sequence
cagtccaggggctcaagggc

SEQ ID NO: 46903 - DNA, 20 bp, Artificial
  CRISPR gRNA sequence
agtccaggggctcaagggcc

SEQ ID NO: 46904 - DNA, 20 bp, Artificial
  CRISPR gRNA sequence
gtccaggggctcaagggcca

SEQ ID NO: 46905 - DNA, 20 bp, Artificial
  CRISPR gRNA sequence
gggctcaagggccagggctc

SEQ ID NO: 46906 - DNA, 20 bp, Artificial
  CRISPR gRNA sequence
aagggccagggctctggaac

SEQ ID NO: 46907 - DNA, 20 bp, Artificial
  CRISPR gRNA sequence
gccagggctctggaacaagc

SEQ ID NO: 46908 - DNA, 20 bp, Artificial
  CRISPR gRNA sequence
ccagggctctggaacaagcc

SEQ ID NO: 46909 - DNA, 20 bp, Artificial
  CRISPR gRNA sequence
cagggctctggaacaagcca

SEQ ID NO: 46910 - DNA, 20 bp, Artificial
  CRISPR gRNA sequence
tctggaacaagccagggact

SEQ ID NO: 46911 - DNA, 20 bp, Artificial
  CRISPR gRNA sequence
aagccagggactcagccatt

SEQ ID NO: 46912 - DNA, 20 bp, Artificial
  CRISPR gRNA sequence
tcccctcctgcctcaatcct

SEQ ID NO: 46913 - DNA, 20 bp, Artificial
  CRISPR gRNA sequence
ctcctcccttacttacatac

SEQ ID NO: 46914 - DNA, 20 bp, Artificial
  CRISPR gRNA sequence
ttacttacatactagcttcc

SEQ ID NO: 46915 - DNA, 20 bp, Artificial
  CRISPR gRNA sequence
tacttacatactagcttcca

SEQ ID NO: 46916 - DNA, 20 bp, Artificial
  CRISPR gRNA sequence
tacatactagcttccaagga

SEQ ID NO: 46917 - DNA, 20 bp, Artificial
  CRISPR gRNA sequence
acatactagcttccaaggac

SEQ ID NO: 46918 - DNA, 20 bp, Artificial
  CRISPR gRNA sequence
tactagcttccaaggacagg

SEQ ID NO: 46919 - DNA, 20 bp, Artificial
  CRISPR gRNA sequence
ctagcttccaaggacaggtg

SEQ ID NO: 46920 - DNA, 20 bp, Artificial
  CRISPR gRNA sequence
tagcttccaaggacaggtgg

SEQ ID NO: 46921 - DNA, 20 bp, Artificial
  CRISPR gRNA sequence
cttccaaggacaggtggagg

SEQ ID NO: 46922 - DNA, 20 bp, Artificial
  CRISPR gRNA sequence
ttccaaggacaggtggaggt

SEQ ID NO: 46923 - DNA, 20 bp, Artificial
  CRISPR gRNA sequence
tccaaggacaggtggaggta

SEQ ID NO: 46924 - DNA, 20 bp, Artificial
  CRISPR gRNA sequence
aggacaggtggaggtagggc

SEQ ID NO: 46925 - DNA, 20 bp, Artificial
  CRISPR gRNA sequence
aggtggaggtagggccagcc

SEQ ID NO: 46926 - DNA, 20 bp, Artificial
  CRISPR gRNA sequence
tggaggtagggccagcctgg

SEQ ID NO: 46927 - DNA, 20 bp, Artificial
  CRISPR gRNA sequence
ggaggtagggccagcctggc

SEQ ID NO: 46928 - DNA, 20 bp, Artificial
  CRISPR gRNA sequence
aggtagggccagcctggcgg

SEQ ID NO: 46929 - DNA, 20 bp, Artificial
  CRISPR gRNA sequence
tagggccagcctggcgggag

SEQ ID NO: 46930 - DNA, 20 bp, Artificial
  CRISPR gRNA sequence
gggccagcctggcgggagtg

SEQ ID NO: 46931 - DNA, 20 bp, Artificial
  CRISPR gRNA sequence
ccagcctggcgggagtggag

SEQ ID NO: 46932 - DNA, 20 bp, Artificial
  CRISPR gRNA sequence
ctggcgggagtggagaagcc

SEQ ID NO: 46933 - DNA, 20 bp, Artificial
  CRISPR gRNA sequence
aagcccagtctgtcctatgt

SEQ ID NO: 46934 - DNA, 20 bp, Artificial
  CRISPR gRNA sequence
agcccagtctgtcctatgta

SEQ ID NO: 46935 - DNA, 20 bp, Artificial
  CRISPR gRNA sequence
gcccagtctgtcctatgtaa

SEQ ID NO: 46936 - DNA, 20 bp, Artificial
  CRISPR gRNA sequence
tctgtcctatgtaagggaca

SEQ ID NO: 46937 - DNA, 20 bp, Artificial
  CRISPR gRNA sequence
tcctatgtaagggacaaagc

SEQ ID NO: 46938 - DNA, 20 bp, Artificial
  CRISPR gRNA sequence
cctatgtaagggacaaagcc

SEQ ID NO: 46939 - DNA, 20 bp, Artificial
  CRISPR gRNA sequence
agggacaaagccaggtctaa

SEQ ID NO: 46940 - DNA, 20 bp, Artificial
  CRISPR gRNA sequence
aaagccaggtctaatggtac

SEQ ID NO: 46941 - DNA, 20 bp, Artificial
  CRISPR gRNA sequence
aagccaggtctaatggtact

SEQ ID NO: 46942 - DNA, 20 bp, Artificial
  CRISPR gRNA sequence
ccaggtctaatggtactggg

SEQ ID NO: 46943 - DNA, 20 bp, Artificial
  CRISPR gRNA sequence
caggtctaatggtactgggt

SEQ ID NO: 46944 - DNA, 20 bp, Artificial
  CRISPR gRNA sequence
aggtctaatggtactgggta

SEQ ID NO: 46945 - DNA, 20 bp, Artificial
  CRISPR gRNA sequence
ggtctaatggtactgggtag

SEQ ID NO: 46946 - DNA, 20 bp, Artificial
  CRISPR gRNA sequence
gtctaatggtactgggtagg

SEQ ID NO: 46947 - DNA, 20 bp, Artificial
  CRISPR gRNA sequence
actgggtagggggcactgcc

SEQ ID NO: 46948 - DNA, 20 bp, Artificial
  CRISPR gRNA sequence
gggggcactgccaagacaat

SEQ ID NO: 46949 - DNA, 20 bp, Artificial
  CRISPR gRNA sequence
gcactgccaagacaataagc

SEQ ID NO: 46950 - DNA, 20 bp, Artificial
  CRISPR gRNA sequence
cactgccaagacaataagct

SEQ ID NO: 46951 - DNA, 20 bp, Artificial
  CRISPR gRNA sequence
aagacaataagctaggctac

SEQ ID NO: 46952 - DNA, 20 bp, Artificial
  CRISPR gRNA sequence
agacaataagctaggctact

SEQ ID NO: 46953 - DNA, 20 bp, Artificial
  CRISPR gRNA sequence
ataagctaggctactgggtc

SEQ ID NO: 46954 - DNA, 20 bp, Artificial
  CRISPR gRNA sequence
actgggtccagctactactt

SEQ ID NO: 46955 - DNA, 20 bp, Artificial
  CRISPR gRNA sequence
gggtccagctactactttgg

SEQ ID NO: 46956 - DNA, 20 bp, Artificial
  CRISPR gRNA sequence
ggtccagctactactttggt

SEQ ID NO: 46957 - DNA, 20 bp, Artificial
  CRISPR gRNA sequence
gctactactttggtgggatt

SEQ ID NO: 46958 - DNA, 20 bp, Artificial
  CRISPR gRNA sequence
ctactactttggtgggattc

SEQ ID NO: 46959 - DNA, 20 bp, Artificial
  CRISPR gRNA sequence
tactttggtgggattcaggt

SEQ ID NO: 46960 - DNA, 20 bp, Artificial
  CRISPR gRNA sequence
catgcacttcacatgttacc

SEQ ID NO: 46961 - DNA, 20 bp, Artificial
  CRISPR gRNA sequence
ccagtgttcttgttacttcc

SEQ ID NO: 46962 - DNA, 20 bp, Artificial
  CRISPR gRNA sequence
cagtgttcttgttacttcca

SEQ ID NO: 46963 - DNA, 20 bp, Artificial
  CRISPR gRNA sequence
gtgttcttgttacttccaag

SEQ ID NO: 46964 - DNA, 20 bp, Artificial
  CRISPR gRNA sequence
tgttacttccaaggagaacc

SEQ ID NO: 46965 - DNA, 20 bp, Artificial
  CRISPR gRNA sequence
cttccaaggagaaccaagaa

SEQ ID NO: 46966 - DNA, 20 bp, Artificial
  CRISPR gRNA sequence
gaatggctctgtcacactcg

SEQ ID NO: 46967 - DNA, 20 bp, Artificial
  CRISPR gRNA sequence
ggctctgtcacactcgaagc

SEQ ID NO: 46968 - DNA, 20 bp, Artificial
  CRISPR gRNA sequence
gctctgtcacactcgaagcc

SEQ ID NO: 46969 - DNA, 20 bp, Artificial
  CRISPR gRNA sequence
ggcttgatcaataaacacaa

SEQ ID NO: 46970 - DNA, 20 bp, Artificial
  CRISPR gRNA sequence
acacaatggtattccacgtc

SEQ ID NO: 46971 - DNA, 20 bp, Artificial
  CRISPR gRNA sequence
tgtttcctcttaccccactg

SEQ ID NO: 46972 - DNA, 20 bp, Artificial
  CRISPR gRNA sequence
tcctcttaccccactgaagt

SEQ ID NO: 46973 - DNA, 20 bp, Artificial
  CRISPR gRNA sequence
ctcttaccccactgaagtca

SEQ ID NO: 46974 - DNA, 20 bp, Artificial
  CRISPR gRNA sequence
tcttaccccactgaagtcag

SEQ ID NO: 46975 - DNA, 20 bp, Artificial
  CRISPR gRNA sequence
taccccactgaagtcagagg

SEQ ID NO: 46976 - DNA, 20 bp, Artificial
  CRISPR gRNA sequence
ggtggttcaccccctgccgt

SEQ ID NO: 46977 - DNA, 20 bp, Artificial
  CRISPR gRNA sequence
gtggttcaccccctgccgta

SEQ ID NO: 46978 - DNA, 20 bp, Artificial
  CRISPR gRNA sequence
tcaccccctgccgtaaggac

SEQ ID NO: 46979 - DNA, 20 bp, Artificial
  CRISPR gRNA sequence
cccctgccgtaaggactgga

SEQ ID NO: 46980 - DNA, 20 bp, Artificial
  CRISPR gRNA sequence
ctgccgtaaggactggacag

SEQ ID NO: 46981 - DNA, 20 bp, Artificial
  CRISPR gRNA sequence
ctggacagcagcgcaaacaa

SEQ ID NO: 46982 - DNA, 20 bp, Artificial
  CRISPR gRNA sequence
ggacagcagcgcaaacaaca

SEQ ID NO: 46983 - DNA, 20 bp, Artificial
  CRISPR gRNA sequence
acagcagcgcaaacaacaga

SEQ ID NO: 46984 - DNA, 20 bp, Artificial
  CRISPR gRNA sequence
cagcagcgcaaacaacagag

SEQ ID NO: 46985 - DNA, 20 bp, Artificial
  CRISPR gRNA sequence
ctgttgtttgcgctgctgtc

SEQ ID NO: 46986 - DNA, 20 bp, Artificial
  CRISPR gRNA sequence
gcgctgctgtccagtcctta

SEQ ID NO: 46987 - DNA, 20 bp, Artificial
  CRISPR gRNA sequence
ctgctgtccagtccttacgg

SEQ ID NO: 46988 - DNA, 20 bp, Artificial
  CRISPR gRNA sequence
tgctgtccagtccttacggc

SEQ ID NO: 46989 - DNA, 20 bp, Artificial
  CRISPR gRNA sequence
gctgtccagtccttacggca

SEQ ID NO: 46990 - DNA, 20 bp, Artificial
  CRISPR gRNA sequence
ctgtccagtccttacggcag

SEQ ID NO: 46991 - DNA, 20 bp, Artificial
  CRISPR gRNA sequence
tgtccagtccttacggcagg

SEQ ID NO: 46992 - DNA, 20 bp, Artificial
  CRISPR gRNA sequence
gggtgaaccacctctgactt

SEQ ID NO: 46993 - DNA, 20 bp, Artificial
  CRISPR gRNA sequence
tgaaccacctctgacttcag

SEQ ID NO: 46994 - DNA, 20 bp, Artificial
  CRISPR gRNA sequence
gaaccacctctgacttcagt

SEQ ID NO: 46995 - DNA, 20 bp, Artificial
  CRISPR gRNA sequence
aaccacctctgacttcagtg

SEQ ID NO: 46996 - DNA, 20 bp, Artificial
  CRISPR gRNA sequence
acctctgacttcagtggggt

SEQ ID NO: 46997 - DNA, 20 bp, Artificial
  CRISPR gRNA sequence
ctctgacttcagtggggtaa

SEQ ID NO: 46998 - DNA, 20 bp, Artificial
  CRISPR gRNA sequence
tctgacttcagtggggtaag

SEQ ID NO: 46999 - DNA, 20 bp, Artificial
  CRISPR gRNA sequence
agtggggtaagaggaaacat

SEQ ID NO: 47000 - DNA, 20 bp, Artificial
  CRISPR gRNA sequence
aggaaacattggattcacgc

SEQ ID NO: 47001 - DNA, 20 bp, Artificial
  CRISPR gRNA sequence
cattggattcacgctagacg

SEQ ID NO: 47002 - DNA, 20 bp, Artificial
  CRISPR gRNA sequence
taccattgtgtttattgatc

SEQ ID NO: 47003 - DNA, 20 bp, Artificial
  CRISPR gRNA sequence
ttgtgtttattgatcaagcc

SEQ ID NO: 47004 - DNA, 20 bp, Artificial
  CRISPR gRNA sequence
tattgatcaagcctggcttc

SEQ ID NO: 47005 - DNA, 20 bp, Artificial
  CRISPR gRNA sequence
aagcctggcttcgagtgtga

SEQ ID NO: 47006 - DNA, 20 bp, Artificial
  CRISPR gRNA sequence
gcctggcttcgagtgtgaca

SEQ ID NO: 47007 - DNA, 20 bp, Artificial
  CRISPR gRNA sequence
gagtgtgacagagccattct

SEQ ID NO: 47008 - DNA, 20 bp, Artificial
  CRISPR gRNA sequence
gagccattcttggttctcct

SEQ ID NO: 47009 - DNA, 20 bp, Artificial
  CRISPR gRNA sequence
ccattcttggttctccttgg

SEQ ID NO: 47010 - DNA, 20 bp, Artificial
  CRISPR gRNA sequence
tggttctccttggaagtaac

SEQ ID NO: 47011 - DNA, 20 bp, Artificial
  CRISPR gRNA sequence
cttggaagtaacaagaacac

SEQ ID NO: 47012 - DNA, 20 bp, Artificial
  CRISPR gRNA sequence
ttggaagtaacaagaacact

SEQ ID NO: 47013 - DNA, 20 bp, Artificial
  CRISPR gRNA sequence
agaacactgggtaacatgtg

SEQ ID NO: 47014 - DNA, 20 bp, Artificial
  CRISPR gRNA sequence
tgggtaacatgtgaagtgca

SEQ ID NO: 47015 - DNA, 20 bp, Artificial
  CRISPR gRNA sequence
ggtaacatgtgaagtgcatg

SEQ ID NO: 47016 - DNA, 20 bp, Artificial
  CRISPR gRNA sequence
gactcacctgaatcccacca

SEQ ID NO: 47017 - DNA, 20 bp, Artificial
  CRISPR gRNA sequence
tcacctgaatcccaccaaag

SEQ ID NO: 47018 - DNA, 20 bp, Artificial
  CRISPR gRNA sequence
cctgaatcccaccaaagtag

SEQ ID NO: 47019 - DNA, 20 bp, Artificial
  CRISPR gRNA sequence
aatcccaccaaagtagtagc

SEQ ID NO: 47020 - DNA, 20 bp, Artificial
  CRISPR gRNA sequence
accaaagtagtagctggacc

SEQ ID NO: 47021 - DNA, 20 bp, Artificial
  CRISPR gRNA sequence
aaagtagtagctggacccag

SEQ ID NO: 47022 - DNA, 20 bp, Artificial
  CRISPR gRNA sequence
agtagctggacccagtagcc

SEQ ID NO: 47023 - DNA, 20 bp, Artificial
  CRISPR gRNA sequence
agtagcctagcttattgtct

SEQ ID NO: 47024 - DNA, 20 bp, Artificial
  CRISPR gRNA sequence
agcctagcttattgtcttgg

SEQ ID NO: 47025 - DNA, 20 bp, Artificial
  CRISPR gRNA sequence
tcttggcagtgccccctacc

SEQ ID NO: 47026 - DNA, 20 bp, Artificial
  CRISPR gRNA sequence
tgccccctacccagtaccat

SEQ ID NO: 47027 - DNA, 20 bp, Artificial
  CRISPR gRNA sequence
ctacccagtaccattagacc

SEQ ID NO: 47028 - DNA, 20 bp, Artificial
  CRISPR gRNA sequence
acctggctttgtcccttaca

SEQ ID NO: 47029 - DNA, 20 bp, Artificial
  CRISPR gRNA sequence
cctggctttgtcccttacat

SEQ ID NO: 47030 - DNA, 20 bp, Artificial
  CRISPR gRNA sequence
gctttgtcccttacatagga

SEQ ID NO: 47031 - DNA, 20 bp, Artificial
  CRISPR gRNA sequence
gtcccttacataggacagac

SEQ ID NO: 47032 - DNA, 20 bp, Artificial
  CRISPR gRNA sequence
tcccttacataggacagact

SEQ ID NO: 47033 - DNA, 20 bp, Artificial
  CRISPR gRNA sequence
ctgggcttctccactcccgc

SEQ ID NO: 47034 - DNA, 20 bp, Artificial
  CRISPR gRNA sequence
tgggcttctccactcccgcc

SEQ ID NO: 47035 - DNA, 20 bp, Artificial
  CRISPR gRNA sequence
cttctccactcccgccaggc

SEQ ID NO: 47036 - DNA, 20 bp, Artificial
  CRISPR gRNA sequence
gccctacctccacctgtcct

SEQ ID NO: 47037 - DNA, 20 bp, Artificial
  CRISPR gRNA sequence
ctacctccacctgtccttgg

SEQ ID NO: 47038 - DNA, 20 bp, Artificial
  CRISPR gRNA sequence
ctccacctgtccttggaagc

SEQ ID NO: 47039 - DNA, 20 bp, Artificial
  CRISPR gRNA sequence
gtccttggaagctagtatgt

SEQ ID NO: 47040 - DNA, 20 bp, Artificial
  CRISPR gRNA sequence
ttggaagctagtatgtaagt

SEQ ID NO: 47041 - DNA, 20 bp, Artificial
  CRISPR gRNA sequence
tggaagctagtatgtaagta

SEQ ID NO: 47042 - DNA, 20 bp, Artificial
  CRISPR gRNA sequence
ggaagctagtatgtaagtaa

SEQ ID NO: 47043 - DNA, 20 bp, Artificial
  CRISPR gRNA sequence
aagctagtatgtaagtaagg

SEQ ID NO: 47044 - DNA, 20 bp, Artificial
  CRISPR gRNA sequence
agctagtatgtaagtaaggg

SEQ ID NO: 47045 - DNA, 20 bp, Artificial
  CRISPR gRNA sequence
ctagtatgtaagtaagggag

SEQ ID NO: 47046 - DNA, 20 bp, Artificial
  CRISPR gRNA sequence
taagtaagggaggagtcatc

SEQ ID NO: 47047 - DNA, 20 bp, Artificial
  CRISPR gRNA sequence
gggaggagtcatcaagttta

SEQ ID NO: 47048 - DNA, 20 bp, Artificial
  CRISPR gRNA sequence
ggagtcatcaagtttataga

SEQ ID NO: 47049 - DNA, 20 bp, Artificial
  CRISPR gRNA sequence
gagtcatcaagtttatagat

SEQ ID NO: 47050 - DNA, 20 bp, Artificial
  CRISPR gRNA sequence
tcatcaagtttatagatggg

SEQ ID NO: 47051 - DNA, 20 bp, Artificial
  CRISPR gRNA sequence
catcaagtttatagatgggt

SEQ ID NO: 47052 - DNA, 20 bp, Artificial
  CRISPR gRNA sequence
agtttatagatgggtaggct

SEQ ID NO: 47053 - DNA, 20 bp, Artificial
  CRISPR gRNA sequence
gtttatagatgggtaggctg

SEQ ID NO: 47054 - DNA, 20 bp, Artificial
  CRISPR gRNA sequence
agatgggtaggctgaggatt

SEQ ID NO: 47055 - DNA, 20 bp, Artificial
  CRISPR gRNA sequence
gatgggtaggctgaggattg

SEQ ID NO: 47056 - DNA, 20 bp, Artificial
  CRISPR gRNA sequence
gggtaggctgaggattgagg

SEQ ID NO: 47057 - DNA, 20 bp, Artificial
  CRISPR gRNA sequence
ggtaggctgaggattgaggc

SEQ ID NO: 47058 - DNA, 20 bp, Artificial
  CRISPR gRNA sequence
taggctgaggattgaggcag

SEQ ID NO: 47059 - DNA, 20 bp, Artificial
  CRISPR gRNA sequence
aggctgaggattgaggcagg

SEQ ID NO: 47060 - DNA, 20 bp, Artificial
  CRISPR gRNA sequence
ggctgaggattgaggcagga

SEQ ID NO: 47061 - DNA, 20 bp, Artificial
  CRISPR gRNA sequence
gctgaggattgaggcaggag

SEQ ID NO: 47062 - DNA, 20 bp, Artificial
  CRISPR gRNA sequence
tgaggcaggaggggacttaa

SEQ ID NO: 47063 - DNA, 20 bp, Artificial
  CRISPR gRNA sequence
caggaggggacttaatggct

SEQ ID NO: 47064 - DNA, 20 bp, Artificial
  CRISPR gRNA sequence
ggacttaatggctgagtccc

SEQ ID NO: 47065 - DNA, 20 bp, Artificial
  CRISPR gRNA sequence
gctgagtccctggcttgttc

SEQ ID NO: 47066 - DNA, 20 bp, Artificial
  CRISPR gRNA sequence
tgagtccctggcttgttcca

SEQ ID NO: 47067 - DNA, 20 bp, Artificial
  CRISPR gRNA sequence
cctggcttgttccagagccc

SEQ ID NO: 47068 - DNA, 20 bp, Artificial
  CRISPR gRNA sequence
gttccagagccctggccctt

SEQ ID NO: 47069 - DNA, 20 bp, Artificial
  CRISPR gRNA sequence
agccctggcccttgagcccc

SEQ ID NO: 47070 - DNA, 20 bp, Artificial
  CRISPR gRNA sequence
tggcccttgagcccctggac

SEQ ID NO: 47071 - DNA, 20 bp, Artificial
  CRISPR gRNA sequence
ccttgagcccctggactggt

SEQ ID NO: 47072 - DNA, 20 bp, Artificial
  CRISPR gRNA sequence
cccctggactggtcagtgca

SEQ ID NO: 47073 - DNA, 20 bp, Artificial
  CRISPR gRNA sequence
gcatggacactctcccctcc

SEQ ID NO: 47074 - DNA, 20 bp, Artificial
  CRISPR gRNA sequence
gacactctcccctcccagct

SEQ ID NO: 47075 - DNA, 20 bp, Artificial
  CRISPR gRNA sequence
acactctcccctcccagctc

SEQ ID NO: 47076 - DNA, 20 bp, Artificial
  CRISPR gRNA sequence
ctctcccctcccagctcggg

SEQ ID NO: 47077 - DNA, 20 bp, Artificial
  CRISPR gRNA sequence
tcccctcccagctcgggcgg

SEQ ID NO: 47078 - DNA, 20 bp, Artificial
  CRISPR gRNA sequence
gcggaagacttttcctgact

SEQ ID NO: 47079 - DNA, 20 bp, Artificial
  CRISPR gRNA sequence
tgctttaaaaattaataaat

SEQ ID NO: 47080 - DNA, 20 bp, Artificial
  CRISPR gRNA sequence
aaaattaataaattagatct

SEQ ID NO: 47081 - DNA, 20 bp, Artificial
  CRISPR gRNA sequence
aaattaataaattagatctt

SEQ ID NO: 47082 - DNA, 20 bp, Artificial
  CRISPR gRNA sequence
taataaattagatcttgggc

SEQ ID NO: 47083 - DNA, 20 bp, Artificial
  CRISPR gRNA sequence
attagatcttgggccagcct

SEQ ID NO: 47084 - DNA, 20 bp, Artificial
  CRISPR gRNA sequence
ttagatcttgggccagcctg

SEQ ID NO: 47085 - DNA, 20 bp, Artificial
  CRISPR gRNA sequence
tgggccagcctgaggtcatc

SEQ ID NO: 47086 - DNA, 20 bp, Artificial
  CRISPR gRNA sequence
ccagcctgaggtcatctggc

SEQ ID NO: 47087 - DNA, 20 bp, Artificial
  CRISPR gRNA sequence
gaggtcatctggccagccat

SEQ ID NO: 47088 - DNA, 20 bp, Artificial
  CRISPR gRNA sequence
cagccatgagtcctgtgaca

SEQ ID NO: 47089 - DNA, 20 bp, Artificial
  CRISPR gRNA sequence
catttgtcatgtgtcatata

SEQ ID NO: 47090 - DNA, 20 bp, Artificial
  CRISPR gRNA sequence
caatcatgtatcctgctact

SEQ ID NO: 47091 - DNA, 20 bp, Artificial
  CRISPR gRNA sequence
aatcatgtatcctgctactt

SEQ ID NO: 47092 - DNA, 20 bp, Artificial
  CRISPR gRNA sequence
tatcctgctacttgggatgc

SEQ ID NO: 47093 - DNA, 20 bp, Artificial
  CRISPR gRNA sequence
ggatgccagcacccatgcca

SEQ ID NO: 47094 - DNA, 20 bp, Artificial
  CRISPR gRNA sequence
ttcatgtaacgccacatgtc

SEQ ID NO: 47095 - DNA, 20 bp, Artificial
  CRISPR gRNA sequence
tcatgtaacgccacatgtca

SEQ ID NO: 47096 - DNA, 20 bp, Artificial
  CRISPR gRNA sequence
catgtaacgccacatgtcaa

SEQ ID NO: 47097 - DNA, 20 bp, Artificial
  CRISPR gRNA sequence
atgtaacgccacatgtcaag

SEQ ID NO: 47098 - DNA, 20 bp, Artificial
  CRISPR gRNA sequence
cacacatatcccacgtaatg

SEQ ID NO: 47099 - DNA, 20 bp, Artificial
  CRISPR gRNA sequence
acacatatcccacgtaatgc

SEQ ID NO: 47100 - DNA, 20 bp, Artificial
  CRISPR gRNA sequence
cacatatcccacgtaatgca

SEQ ID NO: 47101 - DNA, 20 bp, Artificial
  CRISPR gRNA sequence
atgcagggtactcctttgtc

SEQ ID NO: 47102 - DNA, 20 bp, Artificial
  CRISPR gRNA sequence
ggtactcctttgtccagacc

SEQ ID NO: 47103 - DNA, 20 bp, Artificial
  CRISPR gRNA sequence
ctttgtccagacccagctcc

SEQ ID NO: 47104 - DNA, 20 bp, Artificial
  CRISPR gRNA sequence
ccagctcctggttcccaaaa

SEQ ID NO: 47105 - DNA, 20 bp, Artificial
  CRISPR gRNA sequence
ttcccaaaaaagttctccct

SEQ ID NO: 47106 - DNA, 20 bp, Artificial
  CRISPR gRNA sequence
tcccaaaaaagttctccctg

SEQ ID NO: 47107 - DNA, 20 bp, Artificial
  CRISPR gRNA sequence
aaagttctccctgaggactg

SEQ ID NO: 47108 - DNA, 20 bp, Artificial
  CRISPR gRNA sequence
gttctccctgaggactgcag

SEQ ID NO: 47109 - DNA, 20 bp, Artificial
  CRISPR gRNA sequence
ttctccctgaggactgcagc

SEQ ID NO: 47110 - DNA, 20 bp, Artificial
  CRISPR gRNA sequence
gacacacgtatccttcctcc

SEQ ID NO: 47111 - DNA, 20 bp, Artificial
  CRISPR gRNA sequence
acacacgtatccttcctcct

SEQ ID NO: 47112 - DNA, 20 bp, Artificial
  CRISPR gRNA sequence
cacgtatccttcctcctggg

SEQ ID NO: 47113 - DNA, 20 bp, Artificial
  CRISPR gRNA sequence
cgtatccttcctcctgggtg

SEQ ID NO: 47114 - DNA, 20 bp, Artificial
  CRISPR gRNA sequence
ccttcctcctgggtggagtg

SEQ ID NO: 47115 - DNA, 20 bp, Artificial
  CRISPR gRNA sequence
ttcctcctgggtggagtgca

SEQ ID NO: 47116 - DNA, 20 bp, Artificial
  CRISPR gRNA sequence
ggagtgcagagcgccctgcc

SEQ ID NO: 47117 - DNA, 20 bp, Artificial
  CRISPR gRNA sequence
gagtgcagagcgccctgccg

SEQ ID NO: 47118 - DNA, 20 bp, Artificial
  CRISPR gRNA sequence
tgccgaggctcttctttcct

SEQ ID NO: 47119 - DNA, 20 bp, Artificial
  CRISPR gRNA sequence
ctttcctgagtcaattatcc

SEQ ID NO: 47120 - DNA, 20 bp, Artificial
  CRISPR gRNA sequence
tcctgagtcaattatcccag

SEQ ID NO: 47121 - DNA, 20 bp, Artificial
  CRISPR gRNA sequence
cctgagtcaattatcccagt

SEQ ID NO: 47122 - DNA, 20 bp, Artificial
  CRISPR gRNA sequence
tcaattatcccagtgggcga

SEQ ID NO: 47123 - DNA, 20 bp, Artificial
  CRISPR gRNA sequence
caattatcccagtgggcgaa

SEQ ID NO: 47124 - DNA, 20 bp, Artificial
  CRISPR gRNA sequence
ttatcccagtgggcgaaagg

SEQ ID NO: 47125 - DNA, 20 bp, Artificial
  CRISPR gRNA sequence
tgggcgaaaggtggatcatt

SEQ ID NO: 47126 - DNA, 20 bp, Artificial
  CRISPR gRNA sequence
gggcgaaaggtggatcattt

SEQ ID NO: 47127 - DNA, 20 bp, Artificial
  CRISPR gRNA sequence
gatcatttgggtgcatcact

SEQ ID NO: 47128 - DNA, 20 bp, Artificial
  CRISPR gRNA sequence
atttgggtgcatcacttggc

SEQ ID NO: 47129 - DNA, 20 bp, Artificial
  CRISPR gRNA sequence
catcacttggctggattcca

SEQ ID NO: 47130 - DNA, 20 bp, Artificial
  CRISPR gRNA sequence
atcacttggctggattccaa

SEQ ID NO: 47131 - DNA, 20 bp, Artificial
  CRISPR gRNA sequence
ggctggattccaaaggtctt

SEQ ID NO: 47132 - DNA, 20 bp, Artificial
  CRISPR gRNA sequence
gctggattccaaaggtcttg

SEQ ID NO: 47133 - DNA, 20 bp, Artificial
  CRISPR gRNA sequence
ctggattccaaaggtcttga

SEQ ID NO: 47134 - DNA, 20 bp, Artificial
  CRISPR gRNA sequence
tggattccaaaggtcttgag

SEQ ID NO: 47135 - DNA, 20 bp, Artificial
  CRISPR gRNA sequence
ggattccaaaggtcttgagg

SEQ ID NO: 47136 - DNA, 20 bp, Artificial
  CRISPR gRNA sequence
aaggtcttgagggggccatc

SEQ ID NO: 47137 - DNA, 20 bp, Artificial
  CRISPR gRNA sequence
agggggccatcaagtacccc

SEQ ID NO: 47138 - DNA, 20 bp, Artificial
  CRISPR gRNA sequence
gggggccatcaagtacccca

SEQ ID NO: 47139 - DNA, 20 bp, Artificial
  CRISPR gRNA sequence
ggggccatcaagtaccccaa

SEQ ID NO: 47140 - DNA, 20 bp, Artificial
  CRISPR gRNA sequence
gggccatcaagtaccccaag

SEQ ID NO: 47141 - DNA, 20 bp, Artificial
  CRISPR gRNA sequence
atcaagtaccccaaggggcc

SEQ ID NO: 47142 - DNA, 20 bp, Artificial
  CRISPR gRNA sequence
tcaagtaccccaaggggcct

SEQ ID NO: 47143 - DNA, 20 bp, Artificial
  CRISPR gRNA sequence
caagtaccccaaggggcctg

SEQ ID NO: 47144 - DNA, 20 bp, Artificial
  CRISPR gRNA sequence
taccccaaggggcctggggc

SEQ ID NO: 47145 - DNA, 20 bp, Artificial
  CRISPR gRNA sequence
gggcctggggctggttgtca

SEQ ID NO: 47146 - DNA, 20 bp, Artificial
  CRISPR gRNA sequence
cctggggctggttgtcaaag

SEQ ID NO: 47147 - DNA, 20 bp, Artificial
  CRISPR gRNA sequence
ctggggctggttgtcaaaga

SEQ ID NO: 47148 - DNA, 20 bp, Artificial
  CRISPR gRNA sequence
gctggttgtcaaagaaggca

SEQ ID NO: 47149 - DNA, 20 bp, Artificial
  CRISPR gRNA sequence
ttgtcaaagaaggcaaagtc

SEQ ID NO: 47150 - DNA, 20 bp, Artificial
  CRISPR gRNA sequence
aaagaaggcaaagtccagcc

SEQ ID NO: 47151 - DNA, 20 bp, Artificial
  CRISPR gRNA sequence
aagaaggcaaagtccagcct

SEQ ID NO: 47152 - DNA, 20 bp, Artificial
  CRISPR gRNA sequence
caaagtccagcctgggctcc

SEQ ID NO: 47153 - DNA, 20 bp, Artificial
  CRISPR gRNA sequence
agcctgggctcctggctctt

SEQ ID NO: 47154 - DNA, 20 bp, Artificial
  CRISPR gRNA sequence
gcctgggctcctggctcttc

SEQ ID NO: 47155 - DNA, 20 bp, Artificial
  CRISPR gRNA sequence
gctcctggctcttcaggtgc

SEQ ID NO: 47156 - DNA, 20 bp, Artificial
  CRISPR gRNA sequence
ctcctggctcttcaggtgct

SEQ ID NO: 47157 - DNA, 20 bp, Artificial
  CRISPR gRNA sequence
tcaggtgctgggccatgtcg

SEQ ID NO: 47158 - DNA, 20 bp, Artificial
  CRISPR gRNA sequence
caggtgctgggccatgtcgc

SEQ ID NO: 47159 - DNA, 20 bp, Artificial
  CRISPR gRNA sequence
aggtgctgggccatgtcgca

SEQ ID NO: 47160 - DNA, 20 bp, Artificial
  CRISPR gRNA sequence
ctgggccatgtcgcagggaa

SEQ ID NO: 47161 - DNA, 20 bp, Artificial
  CRISPR gRNA sequence
tgggccatgtcgcagggaat

SEQ ID NO: 47162 - DNA, 20 bp, Artificial
  CRISPR gRNA sequence
gggccatgtcgcagggaatg

SEQ ID NO: 47163 - DNA, 20 bp, Artificial
  CRISPR gRNA sequence
cgcagggaatggggttattc

SEQ ID NO: 47164 - DNA, 20 bp, Artificial
  CRISPR gRNA sequence
cagggaatggggttattcca

SEQ ID NO: 47165 - DNA, 20 bp, Artificial
  CRISPR gRNA sequence
agggaatggggttattccag

SEQ ID NO: 47166 - DNA, 20 bp, Artificial
  CRISPR gRNA sequence
tggggttattccagaggctg

SEQ ID NO: 47167 - DNA, 20 bp, Artificial
  CRISPR gRNA sequence
ggggttattccagaggctgt

SEQ ID NO: 47168 - DNA, 20 bp, Artificial
  CRISPR gRNA sequence
gggttattccagaggctgtg

SEQ ID NO: 47169 - DNA, 20 bp, Artificial
  CRISPR gRNA sequence
attccagaggctgtggggca

SEQ ID NO: 47170 - DNA, 20 bp, Artificial
  CRISPR gRNA sequence
gaggctgtggggcacagata

SEQ ID NO: 47171 - DNA, 20 bp, Artificial
  CRISPR gRNA sequence
aggctgtggggcacagatat

SEQ ID NO: 47172 - DNA, 20 bp, Artificial
  CRISPR gRNA sequence
tttgccatctgtcgtatctg

SEQ ID NO: 47173 - DNA, 20 bp, Artificial
  CRISPR gRNA sequence
catctgtcgtatctgcagat

SEQ ID NO: 47174 - DNA, 20 bp, Artificial
  CRISPR gRNA sequence
atctgtcgtatctgcagatt

SEQ ID NO: 47175 - DNA, 20 bp, Artificial
  CRISPR gRNA sequence
ctgtcgtatctgcagattgg

SEQ ID NO: 47176 - DNA, 20 bp, Artificial
  CRISPR gRNA sequence
tgtcgtatctgcagattggg

SEQ ID NO: 47177 - DNA, 20 bp, Artificial
  CRISPR gRNA sequence
tatctgcagattgggaggct

SEQ ID NO: 47178 - DNA, 20 bp, Artificial
  CRISPR gRNA sequence
atctgcagattgggaggctg

SEQ ID NO: 47179 - DNA, 20 bp, Artificial
  CRISPR gRNA sequence
ttgggaggctgaggcccaaa

SEQ ID NO: 47180 - DNA, 20 bp, Artificial
  CRISPR gRNA sequence
tgggaggctgaggcccaaaa

SEQ ID NO: 47181 - DNA, 20 bp, Artificial
  CRISPR gRNA sequence
gaggctgaggcccaaaaagg

SEQ ID NO: 47182 - DNA, 20 bp, Artificial
  CRISPR gRNA sequence
ggctgaggcccaaaaaggta

SEQ ID NO: 47183 - DNA, 20 bp, Artificial
  CRISPR gRNA sequence
caaaaaggtagagctgtgcc

SEQ ID NO: 47184 - DNA, 20 bp, Artificial
  CRISPR gRNA sequence
aaaaggtagagctgtgccta

SEQ ID NO: 47185 - DNA, 20 bp, Artificial
  CRISPR gRNA sequence
gagctgtgcctagagttacc

SEQ ID NO: 47186 - DNA, 20 bp, Artificial
  CRISPR gRNA sequence
ctgtgcctagagttacctgg

SEQ ID NO: 47187 - DNA, 20 bp, Artificial
  CRISPR gRNA sequence
gtgcctagagttacctggca

SEQ ID NO: 47188 - DNA, 20 bp, Artificial
  CRISPR gRNA sequence
tgcctagagttacctggcag

SEQ ID NO: 47189 - DNA, 20 bp, Artificial
  CRISPR gRNA sequence
ctagagttacctggcagagg

SEQ ID NO: 47190 - DNA, 20 bp, Artificial
  CRISPR gRNA sequence
tagagttacctggcagaggc

SEQ ID NO: 47191 - DNA, 20 bp, Artificial
  CRISPR gRNA sequence
tacctggcagaggcaggtgt

SEQ ID NO: 47192 - DNA, 20 bp, Artificial
  CRISPR gRNA sequence
ggcagaggcaggtgttagac

SEQ ID NO: 47193 - DNA, 20 bp, Artificial
  CRISPR gRNA sequence
aggcaggtgttagaccagca

SEQ ID NO: 47194 - DNA, 20 bp, Artificial
  CRISPR gRNA sequence
ttagaccagcatagctgacc

SEQ ID NO: 47195 - DNA, 20 bp, Artificial
  CRISPR gRNA sequence
tagaccagcatagctgacct

SEQ ID NO: 47196 - DNA, 20 bp, Artificial
  CRISPR gRNA sequence
agaccagcatagctgaccta

SEQ ID NO: 47197 - DNA, 20 bp, Artificial
  CRISPR gRNA sequence
accagcatagctgacctagg

SEQ ID NO: 47198 - DNA, 20 bp, Artificial
  CRISPR gRNA sequence
cagcatagctgacctaggga

SEQ ID NO: 47199 - DNA, 20 bp, Artificial
  CRISPR gRNA sequence
agcatagctgacctagggag

SEQ ID NO: 47200 - DNA, 20 bp, Artificial
  CRISPR gRNA sequence
gcatagctgacctagggaga

SEQ ID NO: 47201 - DNA, 20 bp, Artificial
  CRISPR gRNA sequence
gtaccccacacctgcctcct

SEQ ID NO: 47202 - DNA, 20 bp, Artificial
  CRISPR gRNA sequence
tccaactcaaccttcctccc

SEQ ID NO: 47203 - DNA, 20 bp, Artificial
  CRISPR gRNA sequence
ccaactcaaccttcctccct

SEQ ID NO: 47204 - DNA, 20 bp, Artificial
  CRISPR gRNA sequence
aactcaaccttcctccctgg

SEQ ID NO: 47205 - DNA, 20 bp, Artificial
  CRISPR gRNA sequence
caaccttcctccctgggaga

SEQ ID NO: 47206 - DNA, 20 bp, Artificial
  CRISPR gRNA sequence
tccctgggagatagtgatgc

SEQ ID NO: 47207 - DNA, 20 bp, Artificial
  CRISPR gRNA sequence
gggagatagtgatgccagct

SEQ ID NO: 47208 - DNA, 20 bp, Artificial
  CRISPR gRNA sequence
ggagatagtgatgccagcta

SEQ ID NO: 47209 - DNA, 20 bp, Artificial
  CRISPR gRNA sequence
tatgacacatttgtgcaaat

SEQ ID NO: 47210 - DNA, 20 bp, Artificial
  CRISPR gRNA sequence
atgacacatttgtgcaaata

SEQ ID NO: 47211 - DNA, 20 bp, Artificial
  CRISPR gRNA sequence
acatttgtgcaaataaggaa

SEQ ID NO: 47212 - DNA, 20 bp, Artificial
  CRISPR gRNA sequence
ggaaaagaccctctttcttc

SEQ ID NO: 47213 - DNA, 20 bp, Artificial
  CRISPR gRNA sequence
attgtcataatatatgattt

SEQ ID NO: 47214 - DNA, 20 bp, Artificial
  CRISPR gRNA sequence
gtcataatatatgattttgg

SEQ ID NO: 47215 - DNA, 20 bp, Artificial
  CRISPR gRNA sequence
atatatgattttggtagaac

SEQ ID NO: 47216 - DNA, 20 bp, Artificial
  CRISPR gRNA sequence
tatatgattttggtagaaca

SEQ ID NO: 47217 - DNA, 20 bp, Artificial
  CRISPR gRNA sequence
ggtactttactctcatctgc

SEQ ID NO: 47218 - DNA, 20 bp, Artificial
  CRISPR gRNA sequence
actctcatctgctagaaatc

SEQ ID NO: 47219 - DNA, 20 bp, Artificial
  CRISPR gRNA sequence
ctcatctgctagaaatctag

SEQ ID NO: 47220 - DNA, 20 bp, Artificial
  CRISPR gRNA sequence
tcatctgctagaaatctagc

SEQ ID NO: 47221 - DNA, 20 bp, Artificial
  CRISPR gRNA sequence
tagcaggttgacaatgtgaa

SEQ ID NO: 47222 - DNA, 20 bp, Artificial
  CRISPR gRNA sequence
acaatgtgaatggtgcccct

SEQ ID NO: 47223 - DNA, 20 bp, Artificial
  CRISPR gRNA sequence
caatgtgaatggtgcccctt

SEQ ID NO: 47224 - DNA, 20 bp, Artificial
  CRISPR gRNA sequence
ttaggtttaatgcccttgtg

SEQ ID NO: 47225 - DNA, 20 bp, Artificial
  CRISPR gRNA sequence
acctatacaactgtatgtga

SEQ ID NO: 47226 - DNA, 20 bp, Artificial
  CRISPR gRNA sequence
gtatgtgatggctctgatta

SEQ ID NO: 47227 - DNA, 20 bp, Artificial
  CRISPR gRNA sequence
ctgattatagctgccatttt

SEQ ID NO: 47228 - DNA, 20 bp, Artificial
  CRISPR gRNA sequence
tttaagtgcttactatgtgc

SEQ ID NO: 47229 - DNA, 20 bp, Artificial
  CRISPR gRNA sequence
ttaagtgcttactatgtgcc

SEQ ID NO: 47230 - DNA, 20 bp, Artificial
  CRISPR gRNA sequence
gcttactatgtgccaggcat

SEQ ID NO: 47231 - DNA, 20 bp, Artificial
  CRISPR gRNA sequence
cttactatgtgccaggcatt

SEQ ID NO: 47232 - DNA, 20 bp, Artificial
  CRISPR gRNA sequence
tatgtgccaggcattgggtt

SEQ ID NO: 47233 - DNA, 20 bp, Artificial
  CRISPR gRNA sequence
cagtgctttatatgctcatt

SEQ ID NO: 47234 - DNA, 20 bp, Artificial
  CRISPR gRNA sequence
tttagtcttcacaactctct

SEQ ID NO: 47235 - DNA, 20 bp, Artificial
  CRISPR gRNA sequence
ttagtcttcacaactctctg

SEQ ID NO: 47236 - DNA, 20 bp, Artificial
  CRISPR gRNA sequence
gtcttcacaactctctgagg

SEQ ID NO: 47237 - DNA, 20 bp, Artificial
  CRISPR gRNA sequence
ctctctgaggtagatactat

SEQ ID NO: 47238 - DNA, 20 bp, Artificial
  CRISPR gRNA sequence
ctatcagtatccccatttca

SEQ ID NO: 47239 - DNA, 20 bp, Artificial
  CRISPR gRNA sequence
agtatccccatttcacagat

SEQ ID NO: 47240 - DNA, 20 bp, Artificial
  CRISPR gRNA sequence
catttcacagatgagaaaat

SEQ ID NO: 47241 - DNA, 20 bp, Artificial
  CRISPR gRNA sequence
atttcacagatgagaaaatt

SEQ ID NO: 47242 - DNA, 20 bp, Artificial
  CRISPR gRNA sequence
tttcacagatgagaaaattg

SEQ ID NO: 47243 - DNA, 20 bp, Artificial
  CRISPR gRNA sequence
cagatgagaaaattggggtt

SEQ ID NO: 47244 - DNA, 20 bp, Artificial
  CRISPR gRNA sequence
gatgagaaaattggggttca

SEQ ID NO: 47245 - DNA, 20 bp, Artificial
  CRISPR gRNA sequence
tgagaaaattggggttcaga

SEQ ID NO: 47246 - DNA, 20 bp, Artificial
  CRISPR gRNA sequence
gagaaaattggggttcagag

SEQ ID NO: 47247 - DNA, 20 bp, Artificial
  CRISPR gRNA sequence
aattggggttcagagaggtt

SEQ ID NO: 47248 - DNA, 20 bp, Artificial
  CRISPR gRNA sequence
ggttcagagaggttgagtta

SEQ ID NO: 47249 - DNA, 20 bp, Artificial
  CRISPR gRNA sequence
gaggttgagttatggctaca

SEQ ID NO: 47250 - DNA, 20 bp, Artificial
  CRISPR gRNA sequence
gttatggctacaaagttaca

SEQ ID NO: 47251 - DNA, 20 bp, Artificial
  CRISPR gRNA sequence
tggctacaaagttacacagt

SEQ ID NO: 47252 - DNA, 20 bp, Artificial
  CRISPR gRNA sequence
tacaaagttacacagttggc

SEQ ID NO: 47253 - DNA, 20 bp, Artificial
  CRISPR gRNA sequence
aaagttacacagttggcaag

SEQ ID NO: 47254 - DNA, 20 bp, Artificial
  CRISPR gRNA sequence
gttacacagttggcaagtgg

SEQ ID NO: 47255 - DNA, 20 bp, Artificial
  CRISPR gRNA sequence
tacacagttggcaagtggca

SEQ ID NO: 47256 - DNA, 20 bp, Artificial
  CRISPR gRNA sequence
cagttggcaagtggcagagc

SEQ ID NO: 47257 - DNA, 20 bp, Artificial
  CRISPR gRNA sequence
agttggcaagtggcagagct

SEQ ID NO: 47258 - DNA, 20 bp, Artificial
  CRISPR gRNA sequence
gttggcaagtggcagagctg

SEQ ID NO: 47259 - DNA, 20 bp, Artificial
  CRISPR gRNA sequence
gcagagctggggtttgatcc

SEQ ID NO: 47260 - DNA, 20 bp, Artificial
  CRISPR gRNA sequence
tctgcttgctgccaaattct

SEQ ID NO: 47261 - DNA, 20 bp, Artificial
  CRISPR gRNA sequence
gcttgctgccaaattcttgg

SEQ ID NO: 47262 - DNA, 20 bp, Artificial
  CRISPR gRNA sequence
ttgctgccaaattcttggtg

SEQ ID NO: 47263 - DNA, 20 bp, Artificial
  CRISPR gRNA sequence
ctgccaaattcttggtggag

SEQ ID NO: 47264 - DNA, 20 bp, Artificial
  CRISPR gRNA sequence
aattcttggtggagtggtcc

SEQ ID NO: 47265 - DNA, 20 bp, Artificial
  CRISPR gRNA sequence
aagtctcctttgataatccc

SEQ ID NO: 47266 - DNA, 20 bp, Artificial
  CRISPR gRNA sequence
tcctttgataatccccagcc

SEQ ID NO: 47267 - DNA, 20 bp, Artificial
  CRISPR gRNA sequence
cctttgataatccccagccc

SEQ ID NO: 47268 - DNA, 20 bp, Artificial
  CRISPR gRNA sequence
ccaggccctgccgcctcctc

SEQ ID NO: 47269 - DNA, 20 bp, Artificial
  CRISPR gRNA sequence
caggccctgccgcctcctcc

SEQ ID NO: 47270 - DNA, 20 bp, Artificial
  CRISPR gRNA sequence
aggccctgccgcctcctcca

SEQ ID NO: 47271 - DNA, 20 bp, Artificial
  CRISPR gRNA sequence
gccctgccgcctcctccagg

SEQ ID NO: 47272 - DNA, 20 bp, Artificial
  CRISPR gRNA sequence
cctcctccagggagtcccat

SEQ ID NO: 47273 - DNA, 20 bp, Artificial
  CRISPR gRNA sequence
ccagggagtcccattagatc

SEQ ID NO: 47274 - DNA, 20 bp, Artificial
  CRISPR gRNA sequence
cagggagtcccattagatct

SEQ ID NO: 47275 - DNA, 20 bp, Artificial
  CRISPR gRNA sequence
agggagtcccattagatctg

SEQ ID NO: 47276 - DNA, 20 bp, Artificial
  CRISPR gRNA sequence
gggagtcccattagatctgg

SEQ ID NO: 47277 - DNA, 20 bp, Artificial
  CRISPR gRNA sequence
gtcccattagatctgggggt

SEQ ID NO: 47278 - DNA, 20 bp, Artificial
  CRISPR gRNA sequence
attagatctgggggttggtg

SEQ ID NO: 47279 - DNA, 20 bp, Artificial
  CRISPR gRNA sequence
acccaccatccctgcccctg

SEQ ID NO: 47280 - DNA, 20 bp, Artificial
  CRISPR gRNA sequence
cccaccatccctgcccctgc

SEQ ID NO: 47281 - DNA, 20 bp, Artificial
  CRISPR gRNA sequence
cccctgcaggcctctgttac

SEQ ID NO: 47282 - DNA, 20 bp, Artificial
  CRISPR gRNA sequence
gcctctgttaccggatgact

SEQ ID NO: 47283 - DNA, 20 bp, Artificial
  CRISPR gRNA sequence
ttaccggatgacttggatgc

SEQ ID NO: 47284 - DNA, 20 bp, Artificial
  CRISPR gRNA sequence
tgacttggatgctagacccc

SEQ ID NO: 47285 - DNA, 20 bp, Artificial
  CRISPR gRNA sequence
gacttggatgctagacccct

SEQ ID NO: 47286 - DNA, 20 bp, Artificial
  CRISPR gRNA sequence
tggatgctagacccctgggc

SEQ ID NO: 47287 - DNA, 20 bp, Artificial
  CRISPR gRNA sequence
agacccctgggccagtcctt

SEQ ID NO: 47288 - DNA, 20 bp, Artificial
  CRISPR gRNA sequence
ccctgggccagtccttcagc

SEQ ID NO: 47289 - DNA, 20 bp, Artificial
  CRISPR gRNA sequence
cctgggccagtccttcagcc

SEQ ID NO: 47290 - DNA, 20 bp, Artificial
  CRISPR gRNA sequence
tgggccagtccttcagccag

SEQ ID NO: 47291 - DNA, 20 bp, Artificial
  CRISPR gRNA sequence
ccagtccttcagccaggagc

SEQ ID NO: 47292 - DNA, 20 bp, Artificial
  CRISPR gRNA sequence
cagtccttcagccaggagcc

SEQ ID NO: 47293 - DNA, 20 bp, Artificial
  CRISPR gRNA sequence
agccaggagccaggccccca

SEQ ID NO: 47294 - DNA, 20 bp, Artificial
  CRISPR gRNA sequence
gctgtgatctgattcttctc

SEQ ID NO: 47295 - DNA, 20 bp, Artificial
  CRISPR gRNA sequence
ctgtgatctgattcttctcc

SEQ ID NO: 47296 - DNA, 20 bp, Artificial
  CRISPR gRNA sequence
tgattcttctccaggcttct

SEQ ID NO: 47297 - DNA, 20 bp, Artificial
  CRISPR gRNA sequence
ttcttctccaggcttctcag

SEQ ID NO: 47298 - DNA, 20 bp, Artificial
  CRISPR gRNA sequence
tctccaggcttctcagtgga

SEQ ID NO: 47299 - DNA, 20 bp, Artificial
  CRISPR gRNA sequence
caggcttctcagtggacagt

SEQ ID NO: 47300 - DNA, 20 bp, Artificial
  CRISPR gRNA sequence
aggcttctcagtggacagtg

SEQ ID NO: 47301 - DNA, 20 bp, Artificial
  CRISPR gRNA sequence
ggcttctcagtggacagtga

SEQ ID NO: 47302 - DNA, 20 bp, Artificial
  CRISPR gRNA sequence
gcttctcagtggacagtgag

SEQ ID NO: 47303 - DNA, 20 bp, Artificial
  CRISPR gRNA sequence
ttctcagtggacagtgaggg

SEQ ID NO: 47304 - DNA, 20 bp, Artificial
  CRISPR gRNA sequence
tctcagtggacagtgagggg

SEQ ID NO: 47305 - DNA, 20 bp, Artificial
  CRISPR gRNA sequence
ctcagtggacagtgagggga

SEQ ID NO: 47306 - DNA, 20 bp, Artificial
  CRISPR gRNA sequence
tcagtggacagtgaggggag

SEQ ID NO: 47307 - DNA, 20 bp, Artificial
  CRISPR gRNA sequence
tggacagtgaggggagggga

SEQ ID NO: 47308 - DNA, 20 bp, Artificial
  CRISPR gRNA sequence
gacagtgaggggaggggaaa

SEQ ID NO: 47309 - DNA, 20 bp, Artificial
  CRISPR gRNA sequence
ggggaggggaaagagaaaca

SEQ ID NO: 47310 - DNA, 20 bp, Artificial
  CRISPR gRNA sequence
ggaaagagaaacacggccat

SEQ ID NO: 47311 - DNA, 20 bp, Artificial
  CRISPR gRNA sequence
gagaaacacggccatgagaa

SEQ ID NO: 47312 - DNA, 20 bp, Artificial
  CRISPR gRNA sequence
agaaacacggccatgagaat

SEQ ID NO: 47313 - DNA, 20 bp, Artificial
  CRISPR gRNA sequence
acggccatgagaatgggtgt

SEQ ID NO: 47314 - DNA, 20 bp, Artificial
  CRISPR gRNA sequence
ggccatgagaatgggtgtga

SEQ ID NO: 47315 - DNA, 20 bp, Artificial
  CRISPR gRNA sequence
gaatgggtgtgagagtttcc

SEQ ID NO: 47316 - DNA, 20 bp, Artificial
  CRISPR gRNA sequence
aatgggtgtgagagtttcct

SEQ ID NO: 47317 - DNA, 20 bp, Artificial
  CRISPR gRNA sequence
agtttcctaggtcccttcct

SEQ ID NO: 47318 - DNA, 20 bp, Artificial
  CRISPR gRNA sequence
gtttcctaggtcccttcctc

SEQ ID NO: 47319 - DNA, 20 bp, Artificial
  CRISPR gRNA sequence
ctaggtcccttcctcaggcc

SEQ ID NO: 47320 - DNA, 20 bp, Artificial
  CRISPR gRNA sequence
taggtcccttcctcaggcca

SEQ ID NO: 47321 - DNA, 20 bp, Artificial
  CRISPR gRNA sequence
tcccttcctcaggccaaggt

SEQ ID NO: 47322 - DNA, 20 bp, Artificial
  CRISPR gRNA sequence
cccttcctcaggccaaggtc

SEQ ID NO: 47323 - DNA, 20 bp, Artificial
  CRISPR gRNA sequence
ccttcctcaggccaaggtca

SEQ ID NO: 47324 - DNA, 20 bp, Artificial
  CRISPR gRNA sequence
cttcctcaggccaaggtcag

SEQ ID NO: 47325 - DNA, 20 bp, Artificial
  CRISPR gRNA sequence
caggccaaggtcaggggaca

SEQ ID NO: 47326 - DNA, 20 bp, Artificial
  CRISPR gRNA sequence
agtctcccacactaccttct

SEQ ID NO: 47327 - DNA, 20 bp, Artificial
  CRISPR gRNA sequence
gtctcccacactaccttctc

SEQ ID NO: 47328 - DNA, 20 bp, Artificial
  CRISPR gRNA sequence
tctcccacactaccttctca

SEQ ID NO: 47329 - DNA, 20 bp, Artificial
  CRISPR gRNA sequence
taccttctcagggaacccaa

SEQ ID NO: 47330 - DNA, 20 bp, Artificial
  CRISPR gRNA sequence
tcagggaacccaaaagacaa

SEQ ID NO: 47331 - DNA, 20 bp, Artificial
  CRISPR gRNA sequence
cagggaacccaaaagacaac

SEQ ID NO: 47332 - DNA, 20 bp, Artificial
  CRISPR gRNA sequence
agggaacccaaaagacaaca

SEQ ID NO: 47333 - DNA, 20 bp, Artificial
  CRISPR gRNA sequence
gggaacccaaaagacaacag

SEQ ID NO: 47334 - DNA, 20 bp, Artificial
  CRISPR gRNA sequence
cccaaaagacaacaggggac

SEQ ID NO: 47335 - DNA, 20 bp, Artificial
  CRISPR gRNA sequence
aaaagacaacaggggactgg

SEQ ID NO: 47336 - DNA, 20 bp, Artificial
  CRISPR gRNA sequence
agacaacaggggactggtgg

SEQ ID NO: 47337 - DNA, 20 bp, Artificial
  CRISPR gRNA sequence
gacaacaggggactggtggc

SEQ ID NO: 47338 - DNA, 20 bp, Artificial
  CRISPR gRNA sequence
caggggactggtggcaggtg

SEQ ID NO: 47339 - DNA, 20 bp, Artificial
  CRISPR gRNA sequence
gggactggtggcaggtgcag

SEQ ID NO: 47340 - DNA, 20 bp, Artificial
  CRISPR gRNA sequence
ggactggtggcaggtgcagc

SEQ ID NO: 47341 - DNA, 20 bp, Artificial
  CRISPR gRNA sequence
ctggtggcaggtgcagcagg

SEQ ID NO: 47342 - DNA, 20 bp, Artificial
  CRISPR gRNA sequence
tggtggcaggtgcagcagga

SEQ ID NO: 47343 - DNA, 20 bp, Artificial
  CRISPR gRNA sequence
caggtgcagcaggaaggctg

SEQ ID NO: 47344 - DNA, 20 bp, Artificial
  CRISPR gRNA sequence
aggtgcagcaggaaggctga

SEQ ID NO: 47345 - DNA, 20 bp, Artificial
  CRISPR gRNA sequence
gcagcaggaaggctgaaggc

SEQ ID NO: 47346 - DNA, 20 bp, Artificial
  CRISPR gRNA sequence
gaaggctgaaggctagaacc

SEQ ID NO: 47347 - DNA, 20 bp, Artificial
  CRISPR gRNA sequence
aaggctgaaggctagaaccc

SEQ ID NO: 47348 - DNA, 20 bp, Artificial
  CRISPR gRNA sequence
aggctgaaggctagaaccca

SEQ ID NO: 47349 - DNA, 20 bp, Artificial
  CRISPR gRNA sequence
ggctgaaggctagaacccag

SEQ ID NO: 47350 - DNA, 20 bp, Artificial
  CRISPR gRNA sequence
gctgaaggctagaacccagg

SEQ ID NO: 47351 - DNA, 20 bp, Artificial
  CRISPR gRNA sequence
gctagaacccagggggaact

SEQ ID NO: 47352 - DNA, 20 bp, Artificial
  CRISPR gRNA sequence
aacccagggggaactaagcc

SEQ ID NO: 47353 - DNA, 20 bp, Artificial
  CRISPR gRNA sequence
ccagggggaactaagcctgg

SEQ ID NO: 47354 - DNA, 20 bp, Artificial
  CRISPR gRNA sequence
cagggggaactaagcctggc

SEQ ID NO: 47355 - DNA, 20 bp, Artificial
  CRISPR gRNA sequence
agggggaactaagcctggca

SEQ ID NO: 47356 - DNA, 20 bp, Artificial
  CRISPR gRNA sequence
gggggaactaagcctggcag

SEQ ID NO: 47357 - DNA, 20 bp, Artificial
  CRISPR gRNA sequence
aactaagcctggcaggggct

SEQ ID NO: 47358 - DNA, 20 bp, Artificial
  CRISPR gRNA sequence
agcctggcaggggcttggaa

SEQ ID NO: 47359 - DNA, 20 bp, Artificial
  CRISPR gRNA sequence
gcctggcaggggcttggaac

SEQ ID NO: 47360 - DNA, 20 bp, Artificial
  CRISPR gRNA sequence
ggcaggggcttggaacaggc

SEQ ID NO: 47361 - DNA, 20 bp, Artificial
  CRISPR gRNA sequence
caggggcttggaacaggcca

SEQ ID NO: 47362 - DNA, 20 bp, Artificial
  CRISPR gRNA sequence
caggccagagtgtgcaactc

SEQ ID NO: 47363 - DNA, 20 bp, Artificial
  CRISPR gRNA sequence
aggccagagtgtgcaactca

SEQ ID NO: 47364 - DNA, 20 bp, Artificial
  CRISPR gRNA sequence
ccagagtgtgcaactcaagg

SEQ ID NO: 47365 - DNA, 20 bp, Artificial
  CRISPR gRNA sequence
cagagtgtgcaactcaagga

SEQ ID NO: 47366 - DNA, 20 bp, Artificial
  CRISPR gRNA sequence
agagtgtgcaactcaaggaa

SEQ ID NO: 47367 - DNA, 20 bp, Artificial
  CRISPR gRNA sequence
caactcaaggaagggctttc

SEQ ID NO: 47368 - DNA, 20 bp, Artificial
  CRISPR gRNA sequence
aactcaaggaagggctttct

SEQ ID NO: 47369 - DNA, 20 bp, Artificial
  CRISPR gRNA sequence
ctcaaggaagggctttctgg

SEQ ID NO: 47370 - DNA, 20 bp, Artificial
  CRISPR gRNA sequence
tcaaggaagggctttctggg

SEQ ID NO: 47371 - DNA, 20 bp, Artificial
  CRISPR gRNA sequence
aggaagggctttctgggagg

SEQ ID NO: 47372 - DNA, 20 bp, Artificial
  CRISPR gRNA sequence
ggaagggctttctgggaggc

SEQ ID NO: 47373 - DNA, 20 bp, Artificial
  CRISPR gRNA sequence
gaagggctttctgggaggca

SEQ ID NO: 47374 - DNA, 20 bp, Artificial
  CRISPR gRNA sequence
aagggctttctgggaggcag

SEQ ID NO: 47375 - DNA, 20 bp, Artificial
  CRISPR gRNA sequence
tgggaggcaggggactgacc

SEQ ID NO: 47376 - DNA, 20 bp, Artificial
  CRISPR gRNA sequence
gaggcaggggactgacccag

SEQ ID NO: 47377 - DNA, 20 bp, Artificial
  CRISPR gRNA sequence
ggactgacccagtggcctct

SEQ ID NO: 47378 - DNA, 20 bp, Artificial
  CRISPR gRNA sequence
cagtggcctcttggtgttcc

SEQ ID NO: 47379 - DNA, 20 bp, Artificial
  CRISPR gRNA sequence
agtggcctcttggtgttccc

SEQ ID NO: 47380 - DNA, 20 bp, Artificial
  CRISPR gRNA sequence
ctcttggtgttcccgggatg

SEQ ID NO: 47381 - DNA, 20 bp, Artificial
  CRISPR gRNA sequence
tcttggtgttcccgggatgt

SEQ ID NO: 47382 - DNA, 20 bp, Artificial
  CRISPR gRNA sequence
ccgggatgtaggtccccctt

SEQ ID NO: 47383 - DNA, 20 bp, Artificial
  CRISPR gRNA sequence
agcccgtcccattcctcccc

SEQ ID NO: 47384 - DNA, 20 bp, Artificial
  CRISPR gRNA sequence
ccctcatactccactctctt

SEQ ID NO: 47385 - DNA, 20 bp, Artificial
  CRISPR gRNA sequence
catactccactctcttcagc

SEQ ID NO: 47386 - DNA, 20 bp, Artificial
  CRISPR gRNA sequence
ctcttcagccggcccatctg

SEQ ID NO: 47387 - DNA, 20 bp, Artificial
  CRISPR gRNA sequence
ttcagccggcccatctgcgg

SEQ ID NO: 47388 - DNA, 20 bp, Artificial
  CRISPR gRNA sequence
ggcccatctgcggcagcacc

SEQ ID NO: 47389 - DNA, 20 bp, Artificial
  CRISPR gRNA sequence
gcccatctgcggcagcacct

SEQ ID NO: 47390 - DNA, 20 bp, Artificial
  CRISPR gRNA sequence
atctgcggcagcacctgggc

SEQ ID NO: 47391 - DNA, 20 bp, Artificial
  CRISPR gRNA sequence
cggcagcacctgggccagct

SEQ ID NO: 47392 - DNA, 20 bp, Artificial
  CRISPR gRNA sequence
cagcacctgggccagctcgg

SEQ ID NO: 47393 - DNA, 20 bp, Artificial
  CRISPR gRNA sequence
tcggcagctgcctcatcccc

SEQ ID NO: 47394 - DNA, 20 bp, Artificial
  CRISPR gRNA sequence
cggcagctgcctcatccccg

SEQ ID NO: 47395 - DNA, 20 bp, Artificial
  CRISPR gRNA sequence
gcagctgcctcatccccgag

SEQ ID NO: 47396 - DNA, 20 bp, Artificial
  CRISPR gRNA sequence
cctcatccccgaggagattc

SEQ ID NO: 47397 - DNA, 20 bp, Artificial
  CRISPR gRNA sequence
ctcatccccgaggagattcc

SEQ ID NO: 47398 - DNA, 20 bp, Artificial
  CRISPR gRNA sequence
tccccgaggagattccagga

SEQ ID NO: 47399 - DNA, 20 bp, Artificial
  CRISPR gRNA sequence
ggagattccaggacagcctg

SEQ ID NO: 47400 - DNA, 20 bp, Artificial
  CRISPR gRNA sequence
gagattccaggacagcctgc

SEQ ID NO: 47401 - DNA, 20 bp, Artificial
  CRISPR gRNA sequence
agattccaggacagcctgca

SEQ ID NO: 47402 - DNA, 20 bp, Artificial
  CRISPR gRNA sequence
ttccaggacagcctgcaggg

SEQ ID NO: 47403 - DNA, 20 bp, Artificial
  CRISPR gRNA sequence
tccaggacagcctgcagggt

SEQ ID NO: 47404 - DNA, 20 bp, Artificial
  CRISPR gRNA sequence
ccaggacagcctgcagggta

SEQ ID NO: 47405 - DNA, 20 bp, Artificial
  CRISPR gRNA sequence
caggacagcctgcagggtag

SEQ ID NO: 47406 - DNA, 20 bp, Artificial
  CRISPR gRNA sequence
cctgcagggtaggggtccca

SEQ ID NO: 47407 - DNA, 20 bp, Artificial
  CRISPR gRNA sequence
cagggtaggggtcccaaagt

SEQ ID NO: 47408 - DNA, 20 bp, Artificial
  CRISPR gRNA sequence
ggtaggggtcccaaagtcag

SEQ ID NO: 47409 - DNA, 20 bp, Artificial
  CRISPR gRNA sequence
aggggtcccaaagtcagcgg

SEQ ID NO: 47410 - DNA, 20 bp, Artificial
  CRISPR gRNA sequence
ggggtcccaaagtcagcggc

SEQ ID NO: 47411 - DNA, 20 bp, Artificial
  CRISPR gRNA sequence
ggtcccaaagtcagcggcag

SEQ ID NO: 47412 - DNA, 20 bp, Artificial
  CRISPR gRNA sequence
tcccaaagtcagcggcagga

SEQ ID NO: 47413 - DNA, 20 bp, Artificial
  CRISPR gRNA sequence
aaagtcagcggcaggagagc

SEQ ID NO: 47414 - DNA, 20 bp, Artificial
  CRISPR gRNA sequence
aagtcagcggcaggagagca

SEQ ID NO: 47415 - DNA, 20 bp, Artificial
  CRISPR gRNA sequence
gtcagcggcaggagagcaag

SEQ ID NO: 47416 - DNA, 20 bp, Artificial
  CRISPR gRNA sequence
tcagcggcaggagagcaagg

SEQ ID NO: 47417 - DNA, 20 bp, Artificial
  CRISPR gRNA sequence
ggcaggagagcaaggaggtc

SEQ ID NO: 47418 - DNA, 20 bp, Artificial
  CRISPR gRNA sequence
gcaggagagcaaggaggtcg

SEQ ID NO: 47419 - DNA, 20 bp, Artificial
  CRISPR gRNA sequence
caggagagcaaggaggtcga

SEQ ID NO: 47420 - DNA, 20 bp, Artificial
  CRISPR gRNA sequence
aggagagcaaggaggtcgag

SEQ ID NO: 47421 - DNA, 20 bp, Artificial
  CRISPR gRNA sequence
agagcaaggaggtcgagggg

SEQ ID NO: 47422 - DNA, 20 bp, Artificial
  CRISPR gRNA sequence
agcaaggaggtcgaggggtg

SEQ ID NO: 47423 - DNA, 20 bp, Artificial
  CRISPR gRNA sequence
ggaggtcgaggggtggagac

SEQ ID NO: 47424 - DNA, 20 bp, Artificial
  CRISPR gRNA sequence
gaggtcgaggggtggagaca

SEQ ID NO: 47425 - DNA, 20 bp, Artificial
  CRISPR gRNA sequence
gtcgaggggtggagacaagg

SEQ ID NO: 47426 - DNA, 20 bp, Artificial
  CRISPR gRNA sequence
ggtggagacaaggcagtgaa

SEQ ID NO: 47427 - DNA, 20 bp, Artificial
  CRISPR gRNA sequence
gtggagacaaggcagtgaat

SEQ ID NO: 47428 - DNA, 20 bp, Artificial
  CRISPR gRNA sequence
tggagacaaggcagtgaatg

SEQ ID NO: 47429 - DNA, 20 bp, Artificial
  CRISPR gRNA sequence
gacaaggcagtgaatgggga

SEQ ID NO: 47430 - DNA, 20 bp, Artificial
  CRISPR gRNA sequence
aaggcagtgaatggggaaag

SEQ ID NO: 47431 - DNA, 20 bp, Artificial
  CRISPR gRNA sequence
aggcagtgaatggggaaagc

SEQ ID NO: 47432 - DNA, 20 bp, Artificial
  CRISPR gRNA sequence
ggcagtgaatggggaaagca

SEQ ID NO: 47433 - DNA, 20 bp, Artificial
  CRISPR gRNA sequence
gaatggggaaagcagggtgc

SEQ ID NO: 47434 - DNA, 20 bp, Artificial
  CRISPR gRNA sequence
ggaaagcagggtgccagtcg

SEQ ID NO: 47435 - DNA, 20 bp, Artificial
  CRISPR gRNA sequence
gaaagcagggtgccagtcgt

SEQ ID NO: 47436 - DNA, 20 bp, Artificial
  CRISPR gRNA sequence
aaagcagggtgccagtcgtg

SEQ ID NO: 47437 - DNA, 20 bp, Artificial
  CRISPR gRNA sequence
aagcagggtgccagtcgtgg

SEQ ID NO: 47438 - DNA, 20 bp, Artificial
  CRISPR gRNA sequence
agggtgccagtcgtgggggc

SEQ ID NO: 47439 - DNA, 20 bp, Artificial
  CRISPR gRNA sequence
gggtgccagtcgtgggggca

SEQ ID NO: 47440 - DNA, 20 bp, Artificial
  CRISPR gRNA sequence
ggtgccagtcgtgggggcaa

SEQ ID NO: 47441 - DNA, 20 bp, Artificial
  CRISPR gRNA sequence
tcgtgggggcaagggttttc

SEQ ID NO: 47442 - DNA, 20 bp, Artificial
  CRISPR gRNA sequence
gtgggggcaagggttttcaa

SEQ ID NO: 47443 - DNA, 20 bp, Artificial
  CRISPR gRNA sequence
gggggcaagggttttcaaga

SEQ ID NO: 47444 - DNA, 20 bp, Artificial
  CRISPR gRNA sequence
ggggcaagggttttcaagag

SEQ ID NO: 47445 - DNA, 20 bp, Artificial
  CRISPR gRNA sequence
tttcaagagaggccacctga

SEQ ID NO: 47446 - DNA, 20 bp, Artificial
  CRISPR gRNA sequence
ttcaagagaggccacctgat

SEQ ID NO: 47447 - DNA, 20 bp, Artificial
  CRISPR gRNA sequence
tcaagagaggccacctgata

SEQ ID NO: 47448 - DNA, 20 bp, Artificial
  CRISPR gRNA sequence
tgcttgtgtgtcctcccctg

SEQ ID NO: 47449 - DNA, 20 bp, Artificial
  CRISPR gRNA sequence
gtgtcctcccctgaagacgt

SEQ ID NO: 47450 - DNA, 20 bp, Artificial
  CRISPR gRNA sequence
tgtcctcccctgaagacgtc

SEQ ID NO: 47451 - DNA, 20 bp, Artificial
  CRISPR gRNA sequence
gtcctcccctgaagacgtca

SEQ ID NO: 47452 - DNA, 20 bp, Artificial
  CRISPR gRNA sequence
cccctgaagacgtcagggtg

SEQ ID NO: 47453 - DNA, 20 bp, Artificial
  CRISPR gRNA sequence
ccctgaagacgtcagggtgc

SEQ ID NO: 47454 - DNA, 20 bp, Artificial
  CRISPR gRNA sequence
tccctgctcccctccccgtc

SEQ ID NO: 47455 - DNA, 20 bp, Artificial
  CRISPR gRNA sequence
tgaatcatgacgttgttcac

SEQ ID NO: 47456 - DNA, 20 bp, Artificial
  CRISPR gRNA sequence
tacatgtacctcctgtattt

SEQ ID NO: 47457 - DNA, 20 bp, Artificial
  CRISPR gRNA sequence
catcatatttttctttaaat

SEQ ID NO: 47458 - DNA, 20 bp, Artificial
  CRISPR gRNA sequence
ttactttaaaaaattaatct

SEQ ID NO: 47459 - DNA, 20 bp, Artificial
  CRISPR gRNA sequence
tttaaaaaattaatcttggc

SEQ ID NO: 47460 - DNA, 20 bp, Artificial
  CRISPR gRNA sequence
ttaaaaaattaatcttggct

SEQ ID NO: 47461 - DNA, 20 bp, Artificial
  CRISPR gRNA sequence
aaattaatcttggctgggcg

SEQ ID NO: 47462 - DNA, 20 bp, Artificial
  CRISPR gRNA sequence
gttgctcacgcctgtaatcc

SEQ ID NO: 47463 - DNA, 20 bp, Artificial
  CRISPR gRNA sequence
cgcctgtaatcccagcactt

SEQ ID NO: 47464 - DNA, 20 bp, Artificial
  CRISPR gRNA sequence
gcctgtaatcccagcacttt

SEQ ID NO: 47465 - DNA, 20 bp, Artificial
  CRISPR gRNA sequence
ctgtaatcccagcactttgg

SEQ ID NO: 47466 - DNA, 20 bp, Artificial
  CRISPR gRNA sequence
tgtaatcccagcactttggg

SEQ ID NO: 47467 - DNA, 20 bp, Artificial
  CRISPR gRNA sequence
tcccagcactttgggaggcc

SEQ ID NO: 47468 - DNA, 20 bp, Artificial
  CRISPR gRNA sequence
cccagcactttgggaggcca

SEQ ID NO: 47469 - DNA, 20 bp, Artificial
  CRISPR gRNA sequence
gcactttgggaggccaaggt

SEQ ID NO: 47470 - DNA, 20 bp, Artificial
  CRISPR gRNA sequence
cactttgggaggccaaggtc

SEQ ID NO: 47471 - DNA, 20 bp, Artificial
  CRISPR gRNA sequence
gaggccaaggtcaggtgttt

SEQ ID NO: 47472 - DNA, 20 bp, Artificial
  CRISPR gRNA sequence
caaggtcaggtgtttgagac

SEQ ID NO: 47473 - DNA, 20 bp, Artificial
  CRISPR gRNA sequence
tgagacgagcctaaccaaca

SEQ ID NO: 47474 - DNA, 20 bp, Artificial
  CRISPR gRNA sequence
tctactaaaaatacaaaaat

SEQ ID NO: 47475 - DNA, 20 bp, Artificial
  CRISPR gRNA sequence
ctaaaaatacaaaaattagc

SEQ ID NO: 47476 - DNA, 20 bp, Artificial
  CRISPR gRNA sequence
taaaaatacaaaaattagct

SEQ ID NO: 47477 - DNA, 20 bp, Artificial
  CRISPR gRNA sequence
atacaaaaattagctgggtg

SEQ ID NO: 47478 - DNA, 20 bp, Artificial
  CRISPR gRNA sequence
caaaaattagctgggtgtgg

SEQ ID NO: 47479 - DNA, 20 bp, Artificial
  CRISPR gRNA sequence
aaattagctgggtgtggtgg

SEQ ID NO: 47480 - DNA, 20 bp, Artificial
  CRISPR gRNA sequence
aattagctgggtgtggtggt

SEQ ID NO: 47481 - DNA, 20 bp, Artificial
  CRISPR gRNA sequence
gtggtgggcacttgtaatcc

SEQ ID NO: 47482 - DNA, 20 bp, Artificial
  CRISPR gRNA sequence
cacttgtaatcccagctact

SEQ ID NO: 47483 - DNA, 20 bp, Artificial
  CRISPR gRNA sequence
acttgtaatcccagctactc

SEQ ID NO: 47484 - DNA, 20 bp, Artificial
  CRISPR gRNA sequence
ttgtaatcccagctactcag

SEQ ID NO: 47485 - DNA, 20 bp, Artificial
  CRISPR gRNA sequence
tgtaatcccagctactcagg

SEQ ID NO: 47486 - DNA, 20 bp, Artificial
  CRISPR gRNA sequence
tcccagctactcaggaggct

SEQ ID NO: 47487 - DNA, 20 bp, Artificial
  CRISPR gRNA sequence
cccagctactcaggaggctg

SEQ ID NO: 47488 - DNA, 20 bp, Artificial
  CRISPR gRNA sequence
agctactcaggaggctgagg

SEQ ID NO: 47489 - DNA, 20 bp, Artificial
  CRISPR gRNA sequence
gctactcaggaggctgaggc

SEQ ID NO: 47490 - DNA, 20 bp, Artificial
  CRISPR gRNA sequence
tactcaggaggctgaggcag

SEQ ID NO: 47491 - DNA, 20 bp, Artificial
  CRISPR gRNA sequence
gcaggagaatctcttgaacc

SEQ ID NO: 47492 - DNA, 20 bp, Artificial
  CRISPR gRNA sequence
ggagaatctcttgaacccgg

SEQ ID NO: 47493 - DNA, 20 bp, Artificial
  CRISPR gRNA sequence
gagaatctcttgaacccggc

SEQ ID NO: 47494 - DNA, 20 bp, Artificial
  CRISPR gRNA sequence
aatctcttgaacccggcagg

SEQ ID NO: 47495 - DNA, 20 bp, Artificial
  CRISPR gRNA sequence
tctcttgaacccggcaggtg

SEQ ID NO: 47496 - DNA, 20 bp, Artificial
  CRISPR gRNA sequence
ctcttgaacccggcaggtgg

SEQ ID NO: 47497 - DNA, 20 bp, Artificial
  CRISPR gRNA sequence
aacccggcaggtggaggttg

SEQ ID NO: 47498 - DNA, 20 bp, Artificial
  CRISPR gRNA sequence
cggcaggtggaggttgcagt

SEQ ID NO: 47499 - DNA, 20 bp, Artificial
  CRISPR gRNA sequence
ggtggaggttgcagtgagcc

SEQ ID NO: 47500 - DNA, 20 bp, Artificial
  CRISPR gRNA sequence
gagattgcaccactgcactc

SEQ ID NO: 47501 - DNA, 20 bp, Artificial
  CRISPR gRNA sequence
tgcaccactgcactccagcc

SEQ ID NO: 47502 - DNA, 20 bp, Artificial
  CRISPR gRNA sequence
gcaccactgcactccagcct

SEQ ID NO: 47503 - DNA, 20 bp, Artificial
  CRISPR gRNA sequence
ctgcactccagcctgggtaa

SEQ ID NO: 47504 - DNA, 20 bp, Artificial
  CRISPR gRNA sequence
gcactccagcctgggtaaca

SEQ ID NO: 47505 - DNA, 20 bp, Artificial
  CRISPR gRNA sequence
cactccagcctgggtaacag

SEQ ID NO: 47506 - DNA, 20 bp, Artificial
  CRISPR gRNA sequence
actccagcctgggtaacaga

SEQ ID NO: 47507 - DNA, 20 bp, Artificial
  CRISPR gRNA sequence
tccagcctgggtaacagagg

SEQ ID NO: 47508 - DNA, 20 bp, Artificial
  CRISPR gRNA sequence
aaaaaaaaaaaaaatcttga

SEQ ID NO: 47509 - DNA, 20 bp, Artificial
  CRISPR gRNA sequence
aaaaaaaaaaaaatcttgaa

SEQ ID NO: 47510 - DNA, 20 bp, Artificial
  CRISPR gRNA sequence
acttttattgctactatcaa

SEQ ID NO: 47511 - DNA, 20 bp, Artificial
  CRISPR gRNA sequence
tcaatggaaaacttgtgtta

SEQ ID NO: 47512 - DNA, 20 bp, Artificial
  CRISPR gRNA sequence
cttgtgttacagactccata

SEQ ID NO: 47513 - DNA, 20 bp, Artificial
  CRISPR gRNA sequence
gtgttacagactccatatag

SEQ ID NO: 47514 - DNA, 20 bp, Artificial
  CRISPR gRNA sequence
tgttacagactccatataga

SEQ ID NO: 47515 - DNA, 20 bp, Artificial
  CRISPR gRNA sequence
tacagactccatatagaagg

SEQ ID NO: 47516 - DNA, 20 bp, Artificial
  CRISPR gRNA sequence
ggtagttacaaaaataaata

SEQ ID NO: 47517 - DNA, 20 bp, Artificial
  CRISPR gRNA sequence
aataaatatagtacaaacaa

SEQ ID NO: 47518 - DNA, 20 bp, Artificial
  CRISPR gRNA sequence
caaacaatggtattaacttc

SEQ ID NO: 47519 - DNA, 20 bp, Artificial
  CRISPR gRNA sequence
caatggtattaacttctagt

SEQ ID NO: 47520 - DNA, 20 bp, Artificial
  CRISPR gRNA sequence
ttggaacatatgcccttcct

SEQ ID NO: 47521 - DNA, 20 bp, Artificial
  CRISPR gRNA sequence
atatgcccttcctaagatgt

SEQ ID NO: 47522 - DNA, 20 bp, Artificial
  CRISPR gRNA sequence
tatgcccttcctaagatgtt

SEQ ID NO: 47523 - DNA, 20 bp, Artificial
  CRISPR gRNA sequence
tgttgggtttttaacccttt

SEQ ID NO: 47524 - DNA, 20 bp, Artificial
  CRISPR gRNA sequence
ttttaacccttttggttaaa

SEQ ID NO: 47525 - DNA, 20 bp, Artificial
  CRISPR gRNA sequence
tttaacccttttggttaaaa

SEQ ID NO: 47526 - DNA, 20 bp, Artificial
  CRISPR gRNA sequence
ttaacccttttggttaaaaa

SEQ ID NO: 47527 - DNA, 20 bp, Artificial
  CRISPR gRNA sequence
aacccttttggttaaaaagg

SEQ ID NO: 47528 - DNA, 20 bp, Artificial
  CRISPR gRNA sequence
ttggttaaaaagggagaatc

SEQ ID NO: 47529 - DNA, 20 bp, Artificial
  CRISPR gRNA sequence
aaaaagggagaatccagtgt

SEQ ID NO: 47530 - DNA, 20 bp, Artificial
  CRISPR gRNA sequence
aaaagggagaatccagtgtt

SEQ ID NO: 47531 - DNA, 20 bp, Artificial
  CRISPR gRNA sequence
gaatccagtgttaggtgtta

SEQ ID NO: 47532 - DNA, 20 bp, Artificial
  CRISPR gRNA sequence
agatgaattaccactgatct

SEQ ID NO: 47533 - DNA, 20 bp, Artificial
  CRISPR gRNA sequence
ctgatctgagactttcgctt

SEQ ID NO: 47534 - DNA, 20 bp, Artificial
  CRISPR gRNA sequence
gactttcgctttggtgtaat

SEQ ID NO: 47535 - DNA, 20 bp, Artificial
  CRISPR gRNA sequence
tttcgctttggtgtaatgag

SEQ ID NO: 47536 - DNA, 20 bp, Artificial
  CRISPR gRNA sequence
ttcgctttggtgtaatgaga

SEQ ID NO: 47537 - DNA, 20 bp, Artificial
  CRISPR gRNA sequence
tcgctttggtgtaatgagaa

SEQ ID NO: 47538 - DNA, 20 bp, Artificial
  CRISPR gRNA sequence
ttggtgtaatgagaagggtt

SEQ ID NO: 47539 - DNA, 20 bp, Artificial
  CRISPR gRNA sequence
atgagaagggttaagacctt

SEQ ID NO: 47540 - DNA, 20 bp, Artificial
  CRISPR gRNA sequence
tgagaagggttaagaccttt

SEQ ID NO: 47541 - DNA, 20 bp, Artificial
  CRISPR gRNA sequence
atcacttgtgtcctgttctt

SEQ ID NO: 47542 - DNA, 20 bp, Artificial
  CRISPR gRNA sequence
tcacttgtgtcctgttcttt

SEQ ID NO: 47543 - DNA, 20 bp, Artificial
  CRISPR gRNA sequence
gtgtcctgttctttaggaaa

SEQ ID NO: 47544 - DNA, 20 bp, Artificial
  CRISPR gRNA sequence
cagctttgtcctccatacca

SEQ ID NO: 47545 - DNA, 20 bp, Artificial
  CRISPR gRNA sequence
tttgtcctccataccatggt

SEQ ID NO: 47546 - DNA, 20 bp, Artificial
  CRISPR gRNA sequence
ttgtcctccataccatggtt

SEQ ID NO: 47547 - DNA, 20 bp, Artificial
  CRISPR gRNA sequence
tgtcctccataccatggtta

SEQ ID NO: 47548 - DNA, 20 bp, Artificial
  CRISPR gRNA sequence
ccataccatggttagggtcc

SEQ ID NO: 47549 - DNA, 20 bp, Artificial
  CRISPR gRNA sequence
cataccatggttagggtccc

SEQ ID NO: 47550 - DNA, 20 bp, Artificial
  CRISPR gRNA sequence
ccatggttagggtcccaggc

SEQ ID NO: 47551 - DNA, 20 bp, Artificial
  CRISPR gRNA sequence
ttagggtcccaggctagtcc

SEQ ID NO: 47552 - DNA, 20 bp, Artificial
  CRISPR gRNA sequence
ccaggctagtcctagaattc

SEQ ID NO: 47553 - DNA, 20 bp, Artificial
  CRISPR gRNA sequence
tagaattctagtttactcat

SEQ ID NO: 47554 - DNA, 20 bp, Artificial
  CRISPR gRNA sequence
agaattctagtttactcatg

SEQ ID NO: 47555 - DNA, 20 bp, Artificial
  CRISPR gRNA sequence
attctagtttactcatgagg

SEQ ID NO: 47556 - DNA, 20 bp, Artificial
  CRISPR gRNA sequence
actcatgaggcagcactgca

SEQ ID NO: 47557 - DNA, 20 bp, Artificial
  CRISPR gRNA sequence
aggcagcactgcaaagcccc

SEQ ID NO: 47558 - DNA, 20 bp, Artificial
  CRISPR gRNA sequence
ggcagcactgcaaagcccca

SEQ ID NO: 47559 - DNA, 20 bp, Artificial
  CRISPR gRNA sequence
cactgcaaagccccaaggtc

SEQ ID NO: 47560 - DNA, 20 bp, Artificial
  CRISPR gRNA sequence
actgcaaagccccaaggtct

SEQ ID NO: 47561 - DNA, 20 bp, Artificial
  CRISPR gRNA sequence
ctgcaaagccccaaggtctg

SEQ ID NO: 47562 - DNA, 20 bp, Artificial
  CRISPR gRNA sequence
tgcaaagccccaaggtctgg

SEQ ID NO: 47563 - DNA, 20 bp, Artificial
  CRISPR gRNA sequence
tctgggggattctgattgct

SEQ ID NO: 47564 - DNA, 20 bp, Artificial
  CRISPR gRNA sequence
tgggggattctgattgctaa

SEQ ID NO: 47565 - DNA, 20 bp, Artificial
  CRISPR gRNA sequence
ggattctgattgctaagaga

SEQ ID NO: 47566 - DNA, 20 bp, Artificial
  CRISPR gRNA sequence
ctgattgctaagagacagcc

SEQ ID NO: 47567 - DNA, 20 bp, Artificial
  CRISPR gRNA sequence
tgctaagagacagccaagca

SEQ ID NO: 47568 - DNA, 20 bp, Artificial
  CRISPR gRNA sequence
aagagacagccaagcacggc

SEQ ID NO: 47569 - DNA, 20 bp, Artificial
  CRISPR gRNA sequence
gacagccaagcacggccagc

SEQ ID NO: 47570 - DNA, 20 bp, Artificial
  CRISPR gRNA sequence
agccaagcacggccagccag

SEQ ID NO: 47571 - DNA, 20 bp, Artificial
  CRISPR gRNA sequence
gccaagcacggccagccagc

SEQ ID NO: 47572 - DNA, 20 bp, Artificial
  CRISPR gRNA sequence
gcacggccagccagcaggtc

SEQ ID NO: 47573 - DNA, 20 bp, Artificial
  CRISPR gRNA sequence
cacggccagccagcaggtct

SEQ ID NO: 47574 - DNA, 20 bp, Artificial
  CRISPR gRNA sequence
acggccagccagcaggtctg

SEQ ID NO: 47575 - DNA, 20 bp, Artificial
  CRISPR gRNA sequence
cggccagccagcaggtctgg

SEQ ID NO: 47576 - DNA, 20 bp, Artificial
  CRISPR gRNA sequence
ccagccagcaggtctggggg

SEQ ID NO: 47577 - DNA, 20 bp, Artificial
  CRISPR gRNA sequence
gtctgggggtggctttctcc

SEQ ID NO: 47578 - DNA, 20 bp, Artificial
  CRISPR gRNA sequence
gggtggctttctcctggctt

SEQ ID NO: 47579 - DNA, 20 bp, Artificial
  CRISPR gRNA sequence
gccactgtttctaccaactg

SEQ ID NO: 47580 - DNA, 20 bp, Artificial
  CRISPR gRNA sequence
taccaactgtggttcataaa

SEQ ID NO: 47581 - DNA, 20 bp, Artificial
  CRISPR gRNA sequence
ccaactgtggttcataaatg

SEQ ID NO: 47582 - DNA, 20 bp, Artificial
  CRISPR gRNA sequence
caactgtggttcataaatgg

SEQ ID NO: 47583 - DNA, 20 bp, Artificial
  CRISPR gRNA sequence
tcataaatggaggtttcatc

SEQ ID NO: 47584 - DNA, 20 bp, Artificial
  CRISPR gRNA sequence
taaatggaggtttcatcaag

SEQ ID NO: 47585 - DNA, 20 bp, Artificial
  CRISPR gRNA sequence
aaatggaggtttcatcaagc

SEQ ID NO: 47586 - DNA, 20 bp, Artificial
  CRISPR gRNA sequence
ggaggtttcatcaagcaggc

SEQ ID NO: 47587 - DNA, 20 bp, Artificial
  CRISPR gRNA sequence
gaggtttcatcaagcaggca

SEQ ID NO: 47588 - DNA, 20 bp, Artificial
  CRISPR gRNA sequence
gtttcatcaagcaggcaagg

SEQ ID NO: 47589 - DNA, 20 bp, Artificial
  CRISPR gRNA sequence
agcaggcaaggtggtctatc

SEQ ID NO: 47590 - DNA, 20 bp, Artificial
  CRISPR gRNA sequence
tctatccagttgcctcccaa

SEQ ID NO: 47591 - DNA, 20 bp, Artificial
  CRISPR gRNA sequence
ctatccagttgcctcccaaa

SEQ ID NO: 47592 - DNA, 20 bp, Artificial
  CRISPR gRNA sequence
tccagttgcctcccaaaagg

SEQ ID NO: 47593 - DNA, 20 bp, Artificial
  CRISPR gRNA sequence
ccagttgcctcccaaaagga

SEQ ID NO: 47594 - DNA, 20 bp, Artificial
  CRISPR gRNA sequence
ttgcctcccaaaaggaaggt

SEQ ID NO: 47595 - DNA, 20 bp, Artificial
  CRISPR gRNA sequence
ggttggaccaaaaaccttta

SEQ ID NO: 47596 - DNA, 20 bp, Artificial
  CRISPR gRNA sequence
aaaaacctttaaagaccatc

SEQ ID NO: 47597 - DNA, 20 bp, Artificial
  CRISPR gRNA sequence
ccctcccaccaatctacaaa

SEQ ID NO: 47598 - DNA, 20 bp, Artificial
  CRISPR gRNA sequence
cctcccaccaatctacaaat

SEQ ID NO: 47599 - DNA, 20 bp, Artificial
  CRISPR gRNA sequence
ctcccaccaatctacaaatg

SEQ ID NO: 47600 - DNA, 20 bp, Artificial
  CRISPR gRNA sequence
ccaatctacaaatggggaaa

SEQ ID NO: 47601 - DNA, 20 bp, Artificial
  CRISPR gRNA sequence
caatctacaaatggggaaaa

SEQ ID NO: 47602 - DNA, 20 bp, Artificial
  CRISPR gRNA sequence
tctacaaatggggaaaaagg

SEQ ID NO: 47603 - DNA, 20 bp, Artificial
  CRISPR gRNA sequence
acaaatggggaaaaaggcag

SEQ ID NO: 47604 - DNA, 20 bp, Artificial
  CRISPR gRNA sequence
aatggggaaaaaggcagaag

SEQ ID NO: 47605 - DNA, 20 bp, Artificial
  CRISPR gRNA sequence
atggggaaaaaggcagaaga

SEQ ID NO: 47606 - DNA, 20 bp, Artificial
  CRISPR gRNA sequence
gttttacccaacattacctg

SEQ ID NO: 47607 - DNA, 20 bp, Artificial
  CRISPR gRNA sequence
cccaacattacctgcagctc

SEQ ID NO: 47608 - DNA, 20 bp, Artificial
  CRISPR gRNA sequence
tcaagtgttaaaatgtcttt

SEQ ID NO: 47609 - DNA, 20 bp, Artificial
  CRISPR gRNA sequence
aagtgttaaaatgtctttga

SEQ ID NO: 47610 - DNA, 20 bp, Artificial
  CRISPR gRNA sequence
agtgttaaaatgtctttgag

SEQ ID NO: 47611 - DNA, 20 bp, Artificial
  CRISPR gRNA sequence
atgtctttgagaggatgtct

SEQ ID NO: 47612 - DNA, 20 bp, Artificial
  CRISPR gRNA sequence
ctttgagaggatgtctgagt

SEQ ID NO: 47613 - DNA, 20 bp, Artificial
  CRISPR gRNA sequence
tttgagaggatgtctgagta

SEQ ID NO: 47614 - DNA, 20 bp, Artificial
  CRISPR gRNA sequence
tgatcttccccatttacaaa

SEQ ID NO: 47615 - DNA, 20 bp, Artificial
  CRISPR gRNA sequence
gatcttccccatttacaaat

SEQ ID NO: 47616 - DNA, 20 bp, Artificial
  CRISPR gRNA sequence
tcttccccatttacaaatgg

SEQ ID NO: 47617 - DNA, 20 bp, Artificial
  CRISPR gRNA sequence
cttccccatttacaaatggg

SEQ ID NO: 47618 - DNA, 20 bp, Artificial
  CRISPR gRNA sequence
ccatttacaaatgggaggac

SEQ ID NO: 47619 - DNA, 20 bp, Artificial
  CRISPR gRNA sequence
ttacaaatgggaggactggc

SEQ ID NO: 47620 - DNA, 20 bp, Artificial
  CRISPR gRNA sequence
acaaatgggaggactggcca

SEQ ID NO: 47621 - DNA, 20 bp, Artificial
  CRISPR gRNA sequence
aaatgggaggactggccaga

SEQ ID NO: 47622 - DNA, 20 bp, Artificial
  CRISPR gRNA sequence
aatgggaggactggccagag

SEQ ID NO: 47623 - DNA, 20 bp, Artificial
  CRISPR gRNA sequence
ggaggactggccagagagga

SEQ ID NO: 47624 - DNA, 20 bp, Artificial
  CRISPR gRNA sequence
gaggactggccagagaggat

SEQ ID NO: 47625 - DNA, 20 bp, Artificial
  CRISPR gRNA sequence
ggactggccagagaggatgg

SEQ ID NO: 47626 - DNA, 20 bp, Artificial
  CRISPR gRNA sequence
ctggccagagaggatgggag

SEQ ID NO: 47627 - DNA, 20 bp, Artificial
  CRISPR gRNA sequence
agagaggatgggagcagctc

SEQ ID NO: 47628 - DNA, 20 bp, Artificial
  CRISPR gRNA sequence
gagaggatgggagcagctcc

SEQ ID NO: 47629 - DNA, 20 bp, Artificial
  CRISPR gRNA sequence
gggagcagctccaggccaca

SEQ ID NO: 47630 - DNA, 20 bp, Artificial
  CRISPR gRNA sequence
agcagctccaggccacacag

SEQ ID NO: 47631 - DNA, 20 bp, Artificial
  CRISPR gRNA sequence
gcagctccaggccacacagc

SEQ ID NO: 47632 - DNA, 20 bp, Artificial
  CRISPR gRNA sequence
ctccaggccacacagcaggc

SEQ ID NO: 47633 - DNA, 20 bp, Artificial
  CRISPR gRNA sequence
ccaggccacacagcaggctg

SEQ ID NO: 47634 - DNA, 20 bp, Artificial
  CRISPR gRNA sequence
ctcccgacttttccttttcc

SEQ ID NO: 47635 - DNA, 20 bp, Artificial
  CRISPR gRNA sequence
cgacttttccttttcccagc

SEQ ID NO: 47636 - DNA, 20 bp, Artificial
  CRISPR gRNA sequence
tttccttttcccagccagct

SEQ ID NO: 47637 - DNA, 20 bp, Artificial
  CRISPR gRNA sequence
ttccttttcccagccagctc

SEQ ID NO: 47638 - DNA, 20 bp, Artificial
  CRISPR gRNA sequence
tccttttcccagccagctca

SEQ ID NO: 47639 - DNA, 20 bp, Artificial
  CRISPR gRNA sequence
gggctcttccaatcactcac

SEQ ID NO: 47640 - DNA, 20 bp, Artificial
  CRISPR gRNA sequence
atcactcacaagattacttc

SEQ ID NO: 47641 - DNA, 20 bp, Artificial
  CRISPR gRNA sequence
tcactcacaagattacttcc

SEQ ID NO: 47642 - DNA, 20 bp, Artificial
  CRISPR gRNA sequence
cactcacaagattacttcca

SEQ ID NO: 47643 - DNA, 20 bp, Artificial
  CRISPR gRNA sequence
tcacaagattacttccaggg

SEQ ID NO: 47644 - DNA, 20 bp, Artificial
  CRISPR gRNA sequence
cacaagattacttccagggc

SEQ ID NO: 47645 - DNA, 20 bp, Artificial
  CRISPR gRNA sequence
acaagattacttccagggca

SEQ ID NO: 47646 - DNA, 20 bp, Artificial
  CRISPR gRNA sequence
agattacttccagggcaggg

SEQ ID NO: 47647 - DNA, 20 bp, Artificial
  CRISPR gRNA sequence
ccagggcagggcagctcgtg

SEQ ID NO: 47648 - DNA, 20 bp, Artificial
  CRISPR gRNA sequence
ggcagggcagctcgtgaagc

SEQ ID NO: 47649 - DNA, 20 bp, Artificial
  CRISPR gRNA sequence
cagggcagctcgtgaagctg

SEQ ID NO: 47650 - DNA, 20 bp, Artificial
  CRISPR gRNA sequence
agggcagctcgtgaagctgg

SEQ ID NO: 47651 - DNA, 20 bp, Artificial
  CRISPR gRNA sequence
cagctcgtgaagctggaggt

SEQ ID NO: 47652 - DNA, 20 bp, Artificial
  CRISPR gRNA sequence
agctcgtgaagctggaggtg

SEQ ID NO: 47653 - DNA, 20 bp, Artificial
  CRISPR gRNA sequence
ctcgtgaagctggaggtgag

SEQ ID NO: 47654 - DNA, 20 bp, Artificial
  CRISPR gRNA sequence
gaagctggaggtgaggagct

SEQ ID NO: 47655 - DNA, 20 bp, Artificial
  CRISPR gRNA sequence
gctggaggtgaggagcttgg

SEQ ID NO: 47656 - DNA, 20 bp, Artificial
  CRISPR gRNA sequence
aggtgaggagcttggcagtc

SEQ ID NO: 47657 - DNA, 20 bp, Artificial
  CRISPR gRNA sequence
cagtctggttgtcaatctta

SEQ ID NO: 47658 - DNA, 20 bp, Artificial
  CRISPR gRNA sequence
agtctggttgtcaatcttac

SEQ ID NO: 47659 - DNA, 20 bp, Artificial
  CRISPR gRNA sequence
ttgtcaatcttacaggaaac

SEQ ID NO: 47660 - DNA, 20 bp, Artificial
  CRISPR gRNA sequence
tgtcaatcttacaggaaacc

SEQ ID NO: 47661 - DNA, 20 bp, Artificial
  CRISPR gRNA sequence
aatcttacaggaaaccaggc

SEQ ID NO: 47662 - DNA, 20 bp, Artificial
  CRISPR gRNA sequence
atcttacaggaaaccaggct

SEQ ID NO: 47663 - DNA, 20 bp, Artificial
  CRISPR gRNA sequence
tcttacaggaaaccaggctg

SEQ ID NO: 47664 - DNA, 20 bp, Artificial
  CRISPR gRNA sequence
acaggaaaccaggctgggga

SEQ ID NO: 47665 - DNA, 20 bp, Artificial
  CRISPR gRNA sequence
aggaaaccaggctggggatg

SEQ ID NO: 47666 - DNA, 20 bp, Artificial
  CRISPR gRNA sequence
aaaccaggctggggatggag

SEQ ID NO: 47667 - DNA, 20 bp, Artificial
  CRISPR gRNA sequence
aaccaggctggggatggaga

SEQ ID NO: 47668 - DNA, 20 bp, Artificial
  CRISPR gRNA sequence
accaggctggggatggagaa

SEQ ID NO: 47669 - DNA, 20 bp, Artificial
  CRISPR gRNA sequence
gctggggatggagaagggca

SEQ ID NO: 47670 - DNA, 20 bp, Artificial
  CRISPR gRNA sequence
ctggggatggagaagggcat

SEQ ID NO: 47671 - DNA, 20 bp, Artificial
  CRISPR gRNA sequence
ggatggagaagggcatggga

SEQ ID NO: 47672 - DNA, 20 bp, Artificial
  CRISPR gRNA sequence
gatggagaagggcatgggat

SEQ ID NO: 47673 - DNA, 20 bp, Artificial
  CRISPR gRNA sequence
gagaagggcatgggatggga

SEQ ID NO: 47674 - DNA, 20 bp, Artificial
  CRISPR gRNA sequence
agaagggcatgggatgggat

SEQ ID NO: 47675 - DNA, 20 bp, Artificial
  CRISPR gRNA sequence
gaagggcatgggatgggatg

SEQ ID NO: 47676 - DNA, 20 bp, Artificial
  CRISPR gRNA sequence
aagggcatgggatgggatgg

SEQ ID NO: 47677 - DNA, 20 bp, Artificial
  CRISPR gRNA sequence
ggatgggatgggggttgttt

SEQ ID NO: 47678 - DNA, 20 bp, Artificial
  CRISPR gRNA sequence
gggatgggggttgtttgagt

SEQ ID NO: 47679 - DNA, 20 bp, Artificial
  CRISPR gRNA sequence
ggatgggggttgtttgagtc

SEQ ID NO: 47680 - DNA, 20 bp, Artificial
  CRISPR gRNA sequence
gatgggggttgtttgagtca

SEQ ID NO: 47681 - DNA, 20 bp, Artificial
  CRISPR gRNA sequence
atgggggttgtttgagtcag

SEQ ID NO: 47682 - DNA, 20 bp, Artificial
  CRISPR gRNA sequence
gttgtttgagtcaggggatc

SEQ ID NO: 47683 - DNA, 20 bp, Artificial
  CRISPR gRNA sequence
gtttgagtcaggggatctag

SEQ ID NO: 47684 - DNA, 20 bp, Artificial
  CRISPR gRNA sequence
tttgagtcaggggatctagc

SEQ ID NO: 47685 - DNA, 20 bp, Artificial
  CRISPR gRNA sequence
gatctagcaggtcctgcctc

SEQ ID NO: 47686 - DNA, 20 bp, Artificial
  CRISPR gRNA sequence
tctagcaggtcctgcctcca

SEQ ID NO: 47687 - DNA, 20 bp, Artificial
  CRISPR gRNA sequence
ggtcctgcctccagagccac

SEQ ID NO: 47688 - DNA, 20 bp, Artificial
  CRISPR gRNA sequence
gtcctgcctccagagccacc

SEQ ID NO: 47689 - DNA, 20 bp, Artificial
  CRISPR gRNA sequence
tcctgcctccagagccacca

SEQ ID NO: 47690 - DNA, 20 bp, Artificial
  CRISPR gRNA sequence
cctccagagccaccagggtc

SEQ ID NO: 47691 - DNA, 20 bp, Artificial
  CRISPR gRNA sequence
ctccagagccaccagggtct

SEQ ID NO: 47692 - DNA, 20 bp, Artificial
  CRISPR gRNA sequence
tccagagccaccagggtctg

SEQ ID NO: 47693 - DNA, 20 bp, Artificial
  CRISPR gRNA sequence
gagccaccagggtctggggt

SEQ ID NO: 47694 - DNA, 20 bp, Artificial
  CRISPR gRNA sequence
caccagggtctggggtaagc

SEQ ID NO: 47695 - DNA, 20 bp, Artificial
  CRISPR gRNA sequence
accagggtctggggtaagct

SEQ ID NO: 47696 - DNA, 20 bp, Artificial
  CRISPR gRNA sequence
ctggggtaagctaggcgttt

SEQ ID NO: 47697 - DNA, 20 bp, Artificial
  CRISPR gRNA sequence
tggggtaagctaggcgtttt

SEQ ID NO: 47698 - DNA, 20 bp, Artificial
  CRISPR gRNA sequence
gtaagctaggcgttttagga

SEQ ID NO: 47699 - DNA, 20 bp, Artificial
  CRISPR gRNA sequence
taggaaagacttcctttctt

SEQ ID NO: 47700 - DNA, 20 bp, Artificial
  CRISPR gRNA sequence
aaagacttcctttcttgagc

SEQ ID NO: 47701 - DNA, 20 bp, Artificial
  CRISPR gRNA sequence
aagacttcctttcttgagcc

SEQ ID NO: 47702 - DNA, 20 bp, Artificial
  CRISPR gRNA sequence
agccaggcccccaccatccc

SEQ ID NO: 47703 - DNA, 20 bp, Artificial
  CRISPR gRNA sequence
gccaggcccccaccatccct

SEQ ID NO: 47704 - DNA, 20 bp, Artificial
  CRISPR gRNA sequence
ccaggcccccaccatccctg

SEQ ID NO: 47705 - DNA, 20 bp, Artificial
  CRISPR gRNA sequence
ctggggcttctatcacttca

SEQ ID NO: 47706 - DNA, 20 bp, Artificial
  CRISPR gRNA sequence
tggggcttctatcacttcaa

SEQ ID NO: 47707 - DNA, 20 bp, Artificial
  CRISPR gRNA sequence
tatcacttcaaaggcctccc

SEQ ID NO: 47708 - DNA, 20 bp, Artificial
  CRISPR gRNA sequence
atcacttcaaaggcctcccc

SEQ ID NO: 47709 - DNA, 20 bp, Artificial
  CRISPR gRNA sequence
tcaaaggcctccccaggtgt

SEQ ID NO: 47710 - DNA, 20 bp, Artificial
  CRISPR gRNA sequence
caaaggcctccccaggtgtt

SEQ ID NO: 47711 - DNA, 20 bp, Artificial
  CRISPR gRNA sequence
gcctccccaggtgttaggct

SEQ ID NO: 47712 - DNA, 20 bp, Artificial
  CRISPR gRNA sequence
ccccaggtgttaggctcagt

SEQ ID NO: 47713 - DNA, 20 bp, Artificial
  CRISPR gRNA sequence
ccaggtgttaggctcagtca

SEQ ID NO: 47714 - DNA, 20 bp, Artificial
  CRISPR gRNA sequence
ggtgttaggctcagtcagag

SEQ ID NO: 47715 - DNA, 20 bp, Artificial
  CRISPR gRNA sequence
gtgttaggctcagtcagaga

SEQ ID NO: 47716 - DNA, 20 bp, Artificial
  CRISPR gRNA sequence
tgttaggctcagtcagagaa

SEQ ID NO: 47717 - DNA, 20 bp, Artificial
  CRISPR gRNA sequence
agtcagagaagggctgccct

SEQ ID NO: 47718 - DNA, 20 bp, Artificial
  CRISPR gRNA sequence
ggctgccctcagcctgccac

SEQ ID NO: 47719 - DNA, 20 bp, Artificial
  CRISPR gRNA sequence
tcagcctgccactggtcccc

SEQ ID NO: 47720 - DNA, 20 bp, Artificial
  CRISPR gRNA sequence
cagcctgccactggtcccct

SEQ ID NO: 47721 - DNA, 20 bp, Artificial
  CRISPR gRNA sequence
cctgccactggtcccctagg

SEQ ID NO: 47722 - DNA, 20 bp, Artificial
  CRISPR gRNA sequence
ctgccactggtcccctaggc

SEQ ID NO: 47723 - DNA, 20 bp, Artificial
  CRISPR gRNA sequence
ccactggtcccctaggcagg

SEQ ID NO: 47724 - DNA, 20 bp, Artificial
  CRISPR gRNA sequence
cactggtcccctaggcaggc

SEQ ID NO: 47725 - DNA, 20 bp, Artificial
  CRISPR gRNA sequence
actggtcccctaggcaggca

SEQ ID NO: 47726 - DNA, 20 bp, Artificial
  CRISPR gRNA sequence
ctggtcccctaggcaggcag

SEQ ID NO: 47727 - DNA, 20 bp, Artificial
  CRISPR gRNA sequence
ggtcccctaggcaggcaggg

SEQ ID NO: 47728 - DNA, 20 bp, Artificial
  CRISPR gRNA sequence
gtcccctaggcaggcagggg

SEQ ID NO: 47729 - DNA, 20 bp, Artificial
  CRISPR gRNA sequence
gctacttactctatctgtct

SEQ ID NO: 47730 - DNA, 20 bp, Artificial
  CRISPR gRNA sequence
acttactctatctgtctgag

SEQ ID NO: 47731 - DNA, 20 bp, Artificial
  CRISPR gRNA sequence
tactctatctgtctgagcag

SEQ ID NO: 47732 - DNA, 20 bp, Artificial
  CRISPR gRNA sequence
actctatctgtctgagcagc

SEQ ID NO: 47733 - DNA, 20 bp, Artificial
  CRISPR gRNA sequence
tctatctgtctgagcagcgg

SEQ ID NO: 47734 - DNA, 20 bp, Artificial
  CRISPR gRNA sequence
tgagcagcgggagctccata

SEQ ID NO: 47735 - DNA, 20 bp, Artificial
  CRISPR gRNA sequence
gggagctccatacagaaacg

SEQ ID NO: 47736 - DNA, 20 bp, Artificial
  CRISPR gRNA sequence
ggagctccatacagaaacgc

SEQ ID NO: 47737 - DNA, 20 bp, Artificial
  CRISPR gRNA sequence
acagaaacgcaggacccctc

SEQ ID NO: 47738 - DNA, 20 bp, Artificial
  CRISPR gRNA sequence
aaacgcaggacccctccagc

SEQ ID NO: 47739 - DNA, 20 bp, Artificial
  CRISPR gRNA sequence
aacgcaggacccctccagcc

SEQ ID NO: 47740 - DNA, 20 bp, Artificial
  CRISPR gRNA sequence
cagccaggttgttttccgcc

SEQ ID NO: 47741 - DNA, 20 bp, Artificial
  CRISPR gRNA sequence
ggttgttttccgccaagctg

SEQ ID NO: 47742 - DNA, 20 bp, Artificial
  CRISPR gRNA sequence
gttgttttccgccaagctgc

SEQ ID NO: 47743 - DNA, 20 bp, Artificial
  CRISPR gRNA sequence
ttgttttccgccaagctgca

SEQ ID NO: 47744 - DNA, 20 bp, Artificial
  CRISPR gRNA sequence
ttttccgccaagctgcaggg

SEQ ID NO: 47745 - DNA, 20 bp, Artificial
  CRISPR gRNA sequence
tttccgccaagctgcagggt

SEQ ID NO: 47746 - DNA, 20 bp, Artificial
  CRISPR gRNA sequence
ttccgccaagctgcagggta

SEQ ID NO: 47747 - DNA, 20 bp, Artificial
  CRISPR gRNA sequence
tccgccaagctgcagggtag

SEQ ID NO: 47748 - DNA, 20 bp, Artificial
  CRISPR gRNA sequence
cgccaagctgcagggtaggg

SEQ ID NO: 47749 - DNA, 20 bp, Artificial
  CRISPR gRNA sequence
agggtaggggagatacctgt

SEQ ID NO: 47750 - DNA, 20 bp, Artificial
  CRISPR gRNA sequence
ggtaggggagatacctgtga

SEQ ID NO: 47751 - DNA, 20 bp, Artificial
  CRISPR gRNA sequence
gtaggggagatacctgtgag

SEQ ID NO: 47752 - DNA, 20 bp, Artificial
  CRISPR gRNA sequence
atacctgtgagaggaacccc

SEQ ID NO: 47753 - DNA, 20 bp, Artificial
  CRISPR gRNA sequence
gaggaacccccagacccgcc

SEQ ID NO: 47754 - DNA, 20 bp, Artificial
  CRISPR gRNA sequence
aggaacccccagacccgccc

SEQ ID NO: 47755 - DNA, 20 bp, Artificial
  CRISPR gRNA sequence
cccaggactgtccccgtgcc

SEQ ID NO: 47756 - DNA, 20 bp, Artificial
  CRISPR gRNA sequence
ccaggactgtccccgtgcct

SEQ ID NO: 47757 - DNA, 20 bp, Artificial
  CRISPR gRNA sequence
gactgtccccgtgcctgggc

SEQ ID NO: 47758 - DNA, 20 bp, Artificial
  CRISPR gRNA sequence
actgtccccgtgcctgggct

SEQ ID NO: 47759 - DNA, 20 bp, Artificial
  CRISPR gRNA sequence
gtccccgtgcctgggctggg

SEQ ID NO: 47760 - DNA, 20 bp, Artificial
  CRISPR gRNA sequence
cttacctgatctcttccaaa

SEQ ID NO: 47761 - DNA, 20 bp, Artificial
  CRISPR gRNA sequence
ttacctgatctcttccaaat

SEQ ID NO: 47762 - DNA, 20 bp, Artificial
  CRISPR gRNA sequence
tacctgatctcttccaaatg

SEQ ID NO: 47763 - DNA, 20 bp, Artificial
  CRISPR gRNA sequence
acctgatctcttccaaatgg

SEQ ID NO: 47764 - DNA, 20 bp, Artificial
  CRISPR gRNA sequence
cctgatctcttccaaatggg

SEQ ID NO: 47765 - DNA, 20 bp, Artificial
  CRISPR gRNA sequence
tccaaatggggggatccatc

SEQ ID NO: 47766 - DNA, 20 bp, Artificial
  CRISPR gRNA sequence
ccaaatggggggatccatcc

SEQ ID NO: 47767 - DNA, 20 bp, Artificial
  CRISPR gRNA sequence
caaatggggggatccatcca

SEQ ID NO: 47768 - DNA, 20 bp, Artificial
  CRISPR gRNA sequence
ggggggatccatccagggcc

SEQ ID NO: 47769 - DNA, 20 bp, Artificial
  CRISPR gRNA sequence
gggggatccatccagggcct

SEQ ID NO: 47770 - DNA, 20 bp, Artificial
  CRISPR gRNA sequence
gatccatccagggcctgggc

SEQ ID NO: 47771 - DNA, 20 bp, Artificial
  CRISPR gRNA sequence
atccatccagggcctgggcc

SEQ ID NO: 47772 - DNA, 20 bp, Artificial
  CRISPR gRNA sequence
tccagggcctgggccaggct

SEQ ID NO: 47773 - DNA, 20 bp, Artificial
  CRISPR gRNA sequence
ccagggcctgggccaggctc

SEQ ID NO: 47774 - DNA, 20 bp, Artificial
  CRISPR gRNA sequence
cagggcctgggccaggctca

SEQ ID NO: 47775 - DNA, 20 bp, Artificial
  CRISPR gRNA sequence
gccaggctcagggccccacc

SEQ ID NO: 47776 - DNA, 20 bp, Artificial
  CRISPR gRNA sequence
ccaggctcagggccccacct

SEQ ID NO: 47777 - DNA, 20 bp, Artificial
  CRISPR gRNA sequence
ctcagggccccacctgggcc

SEQ ID NO: 47778 - DNA, 20 bp, Artificial
  CRISPR gRNA sequence
gggccccacctgggcccaga

SEQ ID NO: 47779 - DNA, 20 bp, Artificial
  CRISPR gRNA sequence
cctgggcccagatggctgaa

SEQ ID NO: 47780 - DNA, 20 bp, Artificial
  CRISPR gRNA sequence
gggcccagatggctgaatgg

SEQ ID NO: 47781 - DNA, 20 bp, Artificial
  CRISPR gRNA sequence
ggcccagatggctgaatggt

SEQ ID NO: 47782 - DNA, 20 bp, Artificial
  CRISPR gRNA sequence
cagatggctgaatggtaggc

SEQ ID NO: 47783 - DNA, 20 bp, Artificial
  CRISPR gRNA sequence
agatggctgaatggtaggct

SEQ ID NO: 47784 - DNA, 20 bp, Artificial
  CRISPR gRNA sequence
gatggctgaatggtaggctg

SEQ ID NO: 47785 - DNA, 20 bp, Artificial
  CRISPR gRNA sequence
gctgaatggtaggctgggga

SEQ ID NO: 47786 - DNA, 20 bp, Artificial
  CRISPR gRNA sequence
tgaatggtaggctggggaaa

SEQ ID NO: 47787 - DNA, 20 bp, Artificial
  CRISPR gRNA sequence
gaatggtaggctggggaaag

SEQ ID NO: 47788 - DNA, 20 bp, Artificial
  CRISPR gRNA sequence
atggtaggctggggaaagag

SEQ ID NO: 47789 - DNA, 20 bp, Artificial
  CRISPR gRNA sequence
ggtaggctggggaaagagga

SEQ ID NO: 47790 - DNA, 20 bp, Artificial
  CRISPR gRNA sequence
gtaggctggggaaagaggag

SEQ ID NO: 47791 - DNA, 20 bp, Artificial
  CRISPR gRNA sequence
taggctggggaaagaggaga

SEQ ID NO: 47792 - DNA, 20 bp, Artificial
  CRISPR gRNA sequence
ctggggaaagaggagagggt

SEQ ID NO: 47793 - DNA, 20 bp, Artificial
  CRISPR gRNA sequence
ggggaaagaggagagggtga

SEQ ID NO: 47794 - DNA, 20 bp, Artificial
  CRISPR gRNA sequence
gggaaagaggagagggtgag

SEQ ID NO: 47795 - DNA, 20 bp, Artificial
  CRISPR gRNA sequence
gaaagaggagagggtgagag

SEQ ID NO: 47796 - DNA, 20 bp, Artificial
  CRISPR gRNA sequence
ggagagggtgagaggagcct

SEQ ID NO: 47797 - DNA, 20 bp, Artificial
  CRISPR gRNA sequence
gagagggtgagaggagcctg

SEQ ID NO: 47798 - DNA, 20 bp, Artificial
  CRISPR gRNA sequence
agagggtgagaggagcctga

SEQ ID NO: 47799 - DNA, 20 bp, Artificial
  CRISPR gRNA sequence
gtgagaggagcctgagggac

SEQ ID NO: 47800 - DNA, 20 bp, Artificial
  CRISPR gRNA sequence
gcctgagggactggcgtttc

SEQ ID NO: 47801 - DNA, 20 bp, Artificial
  CRISPR gRNA sequence
ctgagggactggcgtttcca

SEQ ID NO: 47802 - DNA, 20 bp, Artificial
  CRISPR gRNA sequence
cgtttccagagccccaccct

SEQ ID NO: 47803 - DNA, 20 bp, Artificial
  CRISPR gRNA sequence
ccccaccctcagccttgtct

SEQ ID NO: 47804 - DNA, 20 bp, Artificial
  CRISPR gRNA sequence
cccaccctcagccttgtctc

SEQ ID NO: 47805 - DNA, 20 bp, Artificial
  CRISPR gRNA sequence
ctcagccttgtctcaggctg

SEQ ID NO: 47806 - DNA, 20 bp, Artificial
  CRISPR gRNA sequence
cttgtctcaggctgcagtgc

SEQ ID NO: 47807 - DNA, 20 bp, Artificial
  CRISPR gRNA sequence
caggctgcagtgccagcccg

SEQ ID NO: 47808 - DNA, 20 bp, Artificial
  CRISPR gRNA sequence
ctgcagtgccagcccgtaga

SEQ ID NO: 47809 - DNA, 20 bp, Artificial
  CRISPR gRNA sequence
gccagcccgtagacagtctc

SEQ ID NO: 47810 - DNA, 20 bp, Artificial
  CRISPR gRNA sequence
tggctaattccccatccaca

SEQ ID NO: 47811 - DNA, 20 bp, Artificial
  CRISPR gRNA sequence
ggctaattccccatccacac

SEQ ID NO: 47812 - DNA, 20 bp, Artificial
  CRISPR gRNA sequence
ttccccatccacacaggacc

SEQ ID NO: 47813 - DNA, 20 bp, Artificial
  CRISPR gRNA sequence
tccccatccacacaggacct

SEQ ID NO: 47814 - DNA, 20 bp, Artificial
  CRISPR gRNA sequence
ccatccacacaggacctggg

SEQ ID NO: 47815 - DNA, 20 bp, Artificial
  CRISPR gRNA sequence
catccacacaggacctgggt

SEQ ID NO: 47816 - DNA, 20 bp, Artificial
  CRISPR gRNA sequence
acaggacctgggtaggtatc

SEQ ID NO: 47817 - DNA, 20 bp, Artificial
  CRISPR gRNA sequence
caggacctgggtaggtatca

SEQ ID NO: 47818 - DNA, 20 bp, Artificial
  CRISPR gRNA sequence
tgggtaggtatcaaggaccc

SEQ ID NO: 47819 - DNA, 20 bp, Artificial
  CRISPR gRNA sequence
ggtatcaaggaccctggctt

SEQ ID NO: 47820 - DNA, 20 bp, Artificial
  CRISPR gRNA sequence
gtatcaaggaccctggcttt

SEQ ID NO: 47821 - DNA, 20 bp, Artificial
  CRISPR gRNA sequence
tatcaaggaccctggctttg

SEQ ID NO: 47822 - DNA, 20 bp, Artificial
  CRISPR gRNA sequence
ggaccctggctttggggtct

SEQ ID NO: 47823 - DNA, 20 bp, Artificial
  CRISPR gRNA sequence
gagatcccaaattcaacacc

SEQ ID NO: 47824 - DNA, 20 bp, Artificial
  CRISPR gRNA sequence
agatcccaaattcaacacct

SEQ ID NO: 47825 - DNA, 20 bp, Artificial
  CRISPR gRNA sequence
cacctgggtccttcgtgtat

SEQ ID NO: 47826 - DNA, 20 bp, Artificial
  CRISPR gRNA sequence
tgggtccttcgtgtatgagt

SEQ ID NO: 47827 - DNA, 20 bp, Artificial
  CRISPR gRNA sequence
gggtccttcgtgtatgagta

SEQ ID NO: 47828 - DNA, 20 bp, Artificial
  CRISPR gRNA sequence
aaaattctccacacctctcc

SEQ ID NO: 47829 - DNA, 20 bp, Artificial
  CRISPR gRNA sequence
ctggccttcattcccttgcc

SEQ ID NO: 47830 - DNA, 20 bp, Artificial
  CRISPR gRNA sequence
cttcattcccttgcctggaa

SEQ ID NO: 47831 - DNA, 20 bp, Artificial
  CRISPR gRNA sequence
ttcattcccttgcctggaaa

SEQ ID NO: 47832 - DNA, 20 bp, Artificial
  CRISPR gRNA sequence
tcattcccttgcctggaaaa

SEQ ID NO: 47833 - DNA, 20 bp, Artificial
  CRISPR gRNA sequence
attcccttgcctggaaaagg

SEQ ID NO: 47834 - DNA, 20 bp, Artificial
  CRISPR gRNA sequence
ctggaaaagggagcacataa

SEQ ID NO: 47835 - DNA, 20 bp, Artificial
  CRISPR gRNA sequence
aagggagcacataaaagtcc

SEQ ID NO: 47836 - DNA, 20 bp, Artificial
  CRISPR gRNA sequence
gcacataaaagtcccagcac

SEQ ID NO: 47837 - DNA, 20 bp, Artificial
  CRISPR gRNA sequence
ataaaagtcccagcaccagc

SEQ ID NO: 47838 - DNA, 20 bp, Artificial
  CRISPR gRNA sequence
gtcccagcaccagccagcca

SEQ ID NO: 47839 - DNA, 20 bp, Artificial
  CRISPR gRNA sequence
ccagcaccagccagccatgg

SEQ ID NO: 47840 - DNA, 20 bp, Artificial
  CRISPR gRNA sequence
gtggctcacgcctgtaatcc

SEQ ID NO: 47841 - DNA, 20 bp, Artificial
  CRISPR gRNA sequence
gcctgtaatcccagcacttt

SEQ ID NO: 47842 - DNA, 20 bp, Artificial
  CRISPR gRNA sequence
ctgtaatcccagcacttttg

SEQ ID NO: 47843 - DNA, 20 bp, Artificial
  CRISPR gRNA sequence
tgtaatcccagcacttttgg

SEQ ID NO: 47844 - DNA, 20 bp, Artificial
  CRISPR gRNA sequence
tcccagcacttttggaggct

SEQ ID NO: 47845 - DNA, 20 bp, Artificial
  CRISPR gRNA sequence
cccagcacttttggaggctg

SEQ ID NO: 47846 - DNA, 20 bp, Artificial
  CRISPR gRNA sequence
agcacttttggaggctgagg

SEQ ID NO: 47847 - DNA, 20 bp, Artificial
  CRISPR gRNA sequence
gcacttttggaggctgaggt

SEQ ID NO: 47848 - DNA, 20 bp, Artificial
  CRISPR gRNA sequence
cttttggaggctgaggtggg

SEQ ID NO: 47849 - DNA, 20 bp, Artificial
  CRISPR gRNA sequence
ctgaggtgggtggatcactt

SEQ ID NO: 47850 - DNA, 20 bp, Artificial
  CRISPR gRNA sequence
tgaggtgggtggatcacttg

SEQ ID NO: 47851 - DNA, 20 bp, Artificial
  CRISPR gRNA sequence
gtgggtggatcacttgaggc

SEQ ID NO: 47852 - DNA, 20 bp, Artificial
  CRISPR gRNA sequence
tgggtggatcacttgaggcc

SEQ ID NO: 47853 - DNA, 20 bp, Artificial
  CRISPR gRNA sequence
ggtggatcacttgaggccag

SEQ ID NO: 47854 - DNA, 20 bp, Artificial
  CRISPR gRNA sequence
tcacttgaggccaggagtcc

SEQ ID NO: 47855 - DNA, 20 bp, Artificial
  CRISPR gRNA sequence
tgaggccaggagtccaagac

SEQ ID NO: 47856 - DNA, 20 bp, Artificial
  CRISPR gRNA sequence
ccaggagtccaagaccagcc

SEQ ID NO: 47857 - DNA, 20 bp, Artificial
  CRISPR gRNA sequence
caggagtccaagaccagcct

SEQ ID NO: 47858 - DNA, 20 bp, Artificial
  CRISPR gRNA sequence
caagaccagcctgggcaata

SEQ ID NO: 47859 - DNA, 20 bp, Artificial
  CRISPR gRNA sequence
tctactaaaaatacaaaaat

SEQ ID NO: 47860 - DNA, 20 bp, Artificial
  CRISPR gRNA sequence
ctaaaaatacaaaaattagc

SEQ ID NO: 47861 - DNA, 20 bp, Artificial
  CRISPR gRNA sequence
taaaaatacaaaaattagct

SEQ ID NO: 47862 - DNA, 20 bp, Artificial
  CRISPR gRNA sequence
atacaaaaattagctgggca

SEQ ID NO: 47863 - DNA, 20 bp, Artificial
  CRISPR gRNA sequence
caaaaattagctgggcatgg

SEQ ID NO: 47864 - DNA, 20 bp, Artificial
  CRISPR gRNA sequence
aaaaattagctgggcatggt

SEQ ID NO: 47865 - DNA, 20 bp, Artificial
  CRISPR gRNA sequence
ggtgggcatgctcgtaatcc

SEQ ID NO: 47866 - DNA, 20 bp, Artificial
  CRISPR gRNA sequence
gctcgtaatcccagctactc

SEQ ID NO: 47867 - DNA, 20 bp, Artificial
  CRISPR gRNA sequence
cgtaatcccagctactctgg

SEQ ID NO: 47868 - DNA, 20 bp, Artificial
  CRISPR gRNA sequence
tcccagctactctggtagct

SEQ ID NO: 47869 - DNA, 20 bp, Artificial
  CRISPR gRNA sequence
cccagctactctggtagctg

SEQ ID NO: 47870 - DNA, 20 bp, Artificial
  CRISPR gRNA sequence
tactctggtagctgaggcac

SEQ ID NO: 47871 - DNA, 20 bp, Artificial
  CRISPR gRNA sequence
gcacaagaattgcttgaacc

SEQ ID NO: 47872 - DNA, 20 bp, Artificial
  CRISPR gRNA sequence
cacaagaattgcttgaaccc

SEQ ID NO: 47873 - DNA, 20 bp, Artificial
  CRISPR gRNA sequence
caagaattgcttgaacccgg

SEQ ID NO: 47874 - DNA, 20 bp, Artificial
  CRISPR gRNA sequence
aagaattgcttgaacccggg

SEQ ID NO: 47875 - DNA, 20 bp, Artificial
  CRISPR gRNA sequence
aattgcttgaacccgggagg

SEQ ID NO: 47876 - DNA, 20 bp, Artificial
  CRISPR gRNA sequence
ttgcttgaacccgggaggtg

SEQ ID NO: 47877 - DNA, 20 bp, Artificial
  CRISPR gRNA sequence
tgcttgaacccgggaggtgg

SEQ ID NO: 47878 - DNA, 20 bp, Artificial
  CRISPR gRNA sequence
aacccgggaggtggaggttg

SEQ ID NO: 47879 - DNA, 20 bp, Artificial
  CRISPR gRNA sequence
cgggaggtggaggttgcagt

SEQ ID NO: 47880 - DNA, 20 bp, Artificial
  CRISPR gRNA sequence
ggtggaggttgcagtgagcc

SEQ ID NO: 47881 - DNA, 20 bp, Artificial
  CRISPR gRNA sequence
gtggaggttgcagtgagccg

SEQ ID NO: 47882 - DNA, 20 bp, Artificial
  CRISPR gRNA sequence
gaggttgcaccactgcactc

SEQ ID NO: 47883 - DNA, 20 bp, Artificial
  CRISPR gRNA sequence
tgcaccactgcactccagcc

SEQ ID NO: 47884 - DNA, 20 bp, Artificial
  CRISPR gRNA sequence
gcaccactgcactccagcct

SEQ ID NO: 47885 - DNA, 20 bp, Artificial
  CRISPR gRNA sequence
ctgcactccagcctgggtga

SEQ ID NO: 47886 - DNA, 20 bp, Artificial
  CRISPR gRNA sequence
gcactccagcctgggtgaca

SEQ ID NO: 47887 - DNA, 20 bp, Artificial
  CRISPR gRNA sequence
actccagcctgggtgacaga

SEQ ID NO: 47888 - DNA, 20 bp, Artificial
  CRISPR gRNA sequence
tccagcctgggtgacagaga

SEQ ID NO: 47889 - DNA, 20 bp, Artificial
  CRISPR gRNA sequence
aaaaaaaaaaaaaaaaaaac

SEQ ID NO: 47890 - DNA, 20 bp, Artificial
  CRISPR gRNA sequence
aaaaaaaaaaaaaaaaaaca

SEQ ID NO: 47891 - DNA, 20 bp, Artificial
  CRISPR gRNA sequence
aaaaaaaaaaaacaaggtcc

SEQ ID NO: 47892 - DNA, 20 bp, Artificial
  CRISPR gRNA sequence
aaaacaaggtcccagcactc

SEQ ID NO: 47893 - DNA, 20 bp, Artificial
  CRISPR gRNA sequence
aaacaaggtcccagcactct

SEQ ID NO: 47894 - DNA, 20 bp, Artificial
  CRISPR gRNA sequence
gtcccagcactctgggactc

SEQ ID NO: 47895 - DNA, 20 bp, Artificial
  CRISPR gRNA sequence
tcccagcactctgggactct

SEQ ID NO: 47896 - DNA, 20 bp, Artificial
  CRISPR gRNA sequence
cccagcactctgggactctg

SEQ ID NO: 47897 - DNA, 20 bp, Artificial
  CRISPR gRNA sequence
ccagcactctgggactctgg

SEQ ID NO: 47898 - DNA, 20 bp, Artificial
  CRISPR gRNA sequence
tgggactctgggggctgcca

SEQ ID NO: 47899 - DNA, 20 bp, Artificial
  CRISPR gRNA sequence
gggactctgggggctgccat

SEQ ID NO: 47900 - DNA, 20 bp, Artificial
  CRISPR gRNA sequence
ggactctgggggctgccatg

SEQ ID NO: 47901 - DNA, 20 bp, Artificial
  CRISPR gRNA sequence
ggctgccatggggctgcaat

SEQ ID NO: 47902 - DNA, 20 bp, Artificial
  CRISPR gRNA sequence
gctgccatggggctgcaatg

SEQ ID NO: 47903 - DNA, 20 bp, Artificial
  CRISPR gRNA sequence
ctgcaatgaggtcatttgtg

SEQ ID NO: 47904 - DNA, 20 bp, Artificial
  CRISPR gRNA sequence
gaggtcatttgtgaagtgct

SEQ ID NO: 47905 - DNA, 20 bp, Artificial
  CRISPR gRNA sequence
aggtcatttgtgaagtgctg

SEQ ID NO: 47906 - DNA, 20 bp, Artificial
  CRISPR gRNA sequence
agtgctgaggccacgttgat

SEQ ID NO: 47907 - DNA, 20 bp, Artificial
  CRISPR gRNA sequence
attggcaccgtgctcctgcg

SEQ ID NO: 47908 - DNA, 20 bp, Artificial
  CRISPR gRNA sequence
gctcctgcgaagccctctgc

SEQ ID NO: 47909 - DNA, 20 bp, Artificial
  CRISPR gRNA sequence
ctcctgcgaagccctctgcc

SEQ ID NO: 47910 - DNA, 20 bp, Artificial
  CRISPR gRNA sequence
caggatttctcattcgccct

SEQ ID NO: 47911 - DNA, 20 bp, Artificial
  CRISPR gRNA sequence
aggatttctcattcgccctc

SEQ ID NO: 47912 - DNA, 20 bp, Artificial
  CRISPR gRNA sequence
ggatttctcattcgccctca

SEQ ID NO: 47913 - DNA, 20 bp, Artificial
  CRISPR gRNA sequence
cgccctcagggacccgctca

SEQ ID NO: 47914 - DNA, 20 bp, Artificial
  CRISPR gRNA sequence
gccctcagggacccgctcac

SEQ ID NO: 47915 - DNA, 20 bp, Artificial
  CRISPR gRNA sequence
ccctcagggacccgctcaca

SEQ ID NO: 47916 - DNA, 20 bp, Artificial
  CRISPR gRNA sequence
gctcacagggcacaatgaac

SEQ ID NO: 47917 - DNA, 20 bp, Artificial
  CRISPR gRNA sequence
ctcacagggcacaatgaact

SEQ ID NO: 47918 - DNA, 20 bp, Artificial
  CRISPR gRNA sequence
ttgtacttcttttgcatgtg

SEQ ID NO: 47919 - DNA, 20 bp, Artificial
  CRISPR gRNA sequence
cttttgcatgtgaagaaact

SEQ ID NO: 47920 - DNA, 20 bp, Artificial
  CRISPR gRNA sequence
ttttgcatgtgaagaaactg

SEQ ID NO: 47921 - DNA, 20 bp, Artificial
  CRISPR gRNA sequence
catgtgaagaaactgaggct

SEQ ID NO: 47922 - DNA, 20 bp, Artificial
  CRISPR gRNA sequence
gtgaagaaactgaggctgag

SEQ ID NO: 47923 - DNA, 20 bp, Artificial
  CRISPR gRNA sequence
tgaagaaactgaggctgaga

SEQ ID NO: 47924 - DNA, 20 bp, Artificial
  CRISPR gRNA sequence
gaagaaactgaggctgagaa

SEQ ID NO: 47925 - DNA, 20 bp, Artificial
  CRISPR gRNA sequence
aagaaactgaggctgagaag

SEQ ID NO: 47926 - DNA, 20 bp, Artificial
  CRISPR gRNA sequence
aaactgaggctgagaagggg

SEQ ID NO: 47927 - DNA, 20 bp, Artificial
  CRISPR gRNA sequence
aactgaggctgagaaggggc

SEQ ID NO: 47928 - DNA, 20 bp, Artificial
  CRISPR gRNA sequence
actgaggctgagaaggggca

SEQ ID NO: 47929 - DNA, 20 bp, Artificial
  CRISPR gRNA sequence
ctgaggctgagaaggggcag

SEQ ID NO: 47930 - DNA, 20 bp, Artificial
  CRISPR gRNA sequence
gctgagaaggggcaggggtt

SEQ ID NO: 47931 - DNA, 20 bp, Artificial
  CRISPR gRNA sequence
gaaggggcaggggtttggcc

SEQ ID NO: 47932 - DNA, 20 bp, Artificial
  CRISPR gRNA sequence
aaggggcaggggtttggcca

SEQ ID NO: 47933 - DNA, 20 bp, Artificial
  CRISPR gRNA sequence
ggcaggggtttggccaaggt

SEQ ID NO: 47934 - DNA, 20 bp, Artificial
  CRISPR gRNA sequence
gcaggggtttggccaaggtc

SEQ ID NO: 47935 - DNA, 20 bp, Artificial
  CRISPR gRNA sequence
ggggtttggccaaggtcagg

SEQ ID NO: 47936 - DNA, 20 bp, Artificial
  CRISPR gRNA sequence
gggtttggccaaggtcaggc

SEQ ID NO: 47937 - DNA, 20 bp, Artificial
  CRISPR gRNA sequence
ggtttggccaaggtcaggca

SEQ ID NO: 47938 - DNA, 20 bp, Artificial
  CRISPR gRNA sequence
gtttggccaaggtcaggcag

SEQ ID NO: 47939 - DNA, 20 bp, Artificial
  CRISPR gRNA sequence
ggccaaggtcaggcaggggc

SEQ ID NO: 47940 - DNA, 20 bp, Artificial
  CRISPR gRNA sequence
caaggtcaggcaggggccag

SEQ ID NO: 47941 - DNA, 20 bp, Artificial
  CRISPR gRNA sequence
ggtcaggcaggggccagtgg

SEQ ID NO: 47942 - DNA, 20 bp, Artificial
  CRISPR gRNA sequence
tcaggcaggggccagtggca

SEQ ID NO: 47943 - DNA, 20 bp, Artificial
  CRISPR gRNA sequence
gcaggggccagtggcagagc

SEQ ID NO: 47944 - DNA, 20 bp, Artificial
  CRISPR gRNA sequence
caggggccagtggcagagcc

SEQ ID NO: 47945 - DNA, 20 bp, Artificial
  CRISPR gRNA sequence
gccagtggcagagccaggac

SEQ ID NO: 47946 - DNA, 20 bp, Artificial
  CRISPR gRNA sequence
ccagtggcagagccaggact

SEQ ID NO: 47947 - DNA, 20 bp, Artificial
  CRISPR gRNA sequence
tggcagagccaggactaggc

SEQ ID NO: 47948 - DNA, 20 bp, Artificial
  CRISPR gRNA sequence
ggcagagccaggactaggct

SEQ ID NO: 47949 - DNA, 20 bp, Artificial
  CRISPR gRNA sequence
gcctcctgattttcttgctg

SEQ ID NO: 47950 - DNA, 20 bp, Artificial
  CRISPR gRNA sequence
gattttcttgctgcagacat

SEQ ID NO: 47951 - DNA, 20 bp, Artificial
  CRISPR gRNA sequence
ttttcttgctgcagacatca

SEQ ID NO: 47952 - DNA, 20 bp, Artificial
  CRISPR gRNA sequence
tttcttgctgcagacatcag

SEQ ID NO: 47953 - DNA, 20 bp, Artificial
  CRISPR gRNA sequence
cttgctgcagacatcagagg

SEQ ID NO: 47954 - DNA, 20 bp, Artificial
  CRISPR gRNA sequence
ttgctgcagacatcagaggc

SEQ ID NO: 47955 - DNA, 20 bp, Artificial
  CRISPR gRNA sequence
tgctgcagacatcagaggca

SEQ ID NO: 47956 - DNA, 20 bp, Artificial
  CRISPR gRNA sequence
tgcagacatcagaggcaggg

SEQ ID NO: 47957 - DNA, 20 bp, Artificial
  CRISPR gRNA sequence
gcagacatcagaggcaggga

SEQ ID NO: 47958 - DNA, 20 bp, Artificial
  CRISPR gRNA sequence
catcagaggcagggaaggaa

SEQ ID NO: 47959 - DNA, 20 bp, Artificial
  CRISPR gRNA sequence
atcagaggcagggaaggaac

SEQ ID NO: 47960 - DNA, 20 bp, Artificial
  CRISPR gRNA sequence
agaggcagggaaggaacagg

SEQ ID NO: 47961 - DNA, 20 bp, Artificial
  CRISPR gRNA sequence
gaggcagggaaggaacaggc

SEQ ID NO: 47962 - DNA, 20 bp, Artificial
  CRISPR gRNA sequence
ggcagggaaggaacaggcag

SEQ ID NO: 47963 - DNA, 20 bp, Artificial
  CRISPR gRNA sequence
cagggaaggaacaggcagga

SEQ ID NO: 47964 - DNA, 20 bp, Artificial
  CRISPR gRNA sequence
ggaaggaacaggcaggagag

SEQ ID NO: 47965 - DNA, 20 bp, Artificial
  CRISPR gRNA sequence
gaaggaacaggcaggagagt

SEQ ID NO: 47966 - DNA, 20 bp, Artificial
  CRISPR gRNA sequence
caggagagtgggtatatgcc

SEQ ID NO: 47967 - DNA, 20 bp, Artificial
  CRISPR gRNA sequence
ggtatatgccaagcttgact

SEQ ID NO: 47968 - DNA, 20 bp, Artificial
  CRISPR gRNA sequence
gtatatgccaagcttgactt

SEQ ID NO: 47969 - DNA, 20 bp, Artificial
  CRISPR gRNA sequence
tatatgccaagcttgacttg

SEQ ID NO: 47970 - DNA, 20 bp, Artificial
  CRISPR gRNA sequence
atgccaagcttgacttgggg

SEQ ID NO: 47971 - DNA, 20 bp, Artificial
  CRISPR gRNA sequence
tgccaagcttgacttggggc

SEQ ID NO: 47972 - DNA, 20 bp, Artificial
  CRISPR gRNA sequence
gccaagcttgacttggggca

SEQ ID NO: 47973 - DNA, 20 bp, Artificial
  CRISPR gRNA sequence
aagcttgacttggggcaggg

SEQ ID NO: 47974 - DNA, 20 bp, Artificial
  CRISPR gRNA sequence
gggcagggcagctcaactga

SEQ ID NO: 47975 - DNA, 20 bp, Artificial
  CRISPR gRNA sequence
ggcagggcagctcaactgat

SEQ ID NO: 47976 - DNA, 20 bp, Artificial
  CRISPR gRNA sequence
gcagggcagctcaactgatg

SEQ ID NO: 47977 - DNA, 20 bp, Artificial
  CRISPR gRNA sequence
cagggcagctcaactgatgg

SEQ ID NO: 47978 - DNA, 20 bp, Artificial
  CRISPR gRNA sequence
cagctcaactgatgggggcc

SEQ ID NO: 47979 - DNA, 20 bp, Artificial
  CRISPR gRNA sequence
tggacccccccactgctccc

SEQ ID NO: 47980 - DNA, 20 bp, Artificial
  CRISPR gRNA sequence
ggacccccccactgctcccg

SEQ ID NO: 47981 - DNA, 20 bp, Artificial
  CRISPR gRNA sequence
ccgaggaccctcctccccac

SEQ ID NO: 47982 - DNA, 20 bp, Artificial
  CRISPR gRNA sequence
tcctccccaccagccctgca

SEQ ID NO: 47983 - DNA, 20 bp, Artificial
  CRISPR gRNA sequence
cccaccagccctgcatggta

SEQ ID NO: 47984 - DNA, 20 bp, Artificial
  CRISPR gRNA sequence
ccaccagccctgcatggtat

SEQ ID NO: 47985 - DNA, 20 bp, Artificial
  CRISPR gRNA sequence
ccagccctgcatggtatggg

SEQ ID NO: 47986 - DNA, 20 bp, Artificial
  CRISPR gRNA sequence
cagccctgcatggtatgggc

SEQ ID NO: 47987 - DNA, 20 bp, Artificial
  CRISPR gRNA sequence
agccctgcatggtatgggca

SEQ ID NO: 47988 - DNA, 20 bp, Artificial
  CRISPR gRNA sequence
gccctgcatggtatgggcag

SEQ ID NO: 47989 - DNA, 20 bp, Artificial
  CRISPR gRNA sequence
ccctgcatggtatgggcagg

SEQ ID NO: 47990 - DNA, 20 bp, Artificial
  CRISPR gRNA sequence
gggcagggggccactcactg

SEQ ID NO: 47991 - DNA, 20 bp, Artificial
  CRISPR gRNA sequence
ggcagggggccactcactgt

SEQ ID NO: 47992 - DNA, 20 bp, Artificial
  CRISPR gRNA sequence
gccactcactgtaggaccct

SEQ ID NO: 47993 - DNA, 20 bp, Artificial
  CRISPR gRNA sequence
ccactcactgtaggaccctc

SEQ ID NO: 47994 - DNA, 20 bp, Artificial
  CRISPR gRNA sequence
actgtaggaccctcaggtgc

SEQ ID NO: 47995 - DNA, 20 bp, Artificial
  CRISPR gRNA sequence
ctgtaggaccctcaggtgct

SEQ ID NO: 47996 - DNA, 20 bp, Artificial
  CRISPR gRNA sequence
tgtaggaccctcaggtgctg

SEQ ID NO: 47997 - DNA, 20 bp, Artificial
  CRISPR gRNA sequence
aggaccctcaggtgctgggg

SEQ ID NO: 47998 - DNA, 20 bp, Artificial
  CRISPR gRNA sequence
caggtgctggggcagctcct

SEQ ID NO: 47999 - DNA, 20 bp, Artificial
  CRISPR gRNA sequence
tgctggggcagctcctgagc

SEQ ID NO: 48000 - DNA, 20 bp, Artificial
  CRISPR gRNA sequence
ggcagctcctgagccagccc

SEQ ID NO: 48001 - DNA, 20 bp, Artificial
  CRISPR gRNA sequence
gcagctcctgagccagcccc

SEQ ID NO: 48002 - DNA, 20 bp, Artificial
  CRISPR gRNA sequence
cagctcctgagccagcccca

SEQ ID NO: 48003 - DNA, 20 bp, Artificial
  CRISPR gRNA sequence
ctgagccagccccagggctg

SEQ ID NO: 48004 - DNA, 20 bp, Artificial
  CRISPR gRNA sequence
tgagccagccccagggctgt

SEQ ID NO: 48005 - DNA, 20 bp, Artificial
  CRISPR gRNA sequence
cccagggctgtgggatcccc

SEQ ID NO: 48006 - DNA, 20 bp, Artificial
  CRISPR gRNA sequence
ccagggctgtgggatccccc

SEQ ID NO: 48007 - DNA, 20 bp, Artificial
  CRISPR gRNA sequence
cagggctgtgggatccccca

SEQ ID NO: 48008 - DNA, 20 bp, Artificial
  CRISPR gRNA sequence
tgggatcccccagggcattg

SEQ ID NO: 48009 - DNA, 20 bp, Artificial
  CRISPR gRNA sequence
tcccccagggcattgcagcc

SEQ ID NO: 48010 - DNA, 20 bp, Artificial
  CRISPR gRNA sequence
cagggcattgcagccaagcc

SEQ ID NO: 48011 - DNA, 20 bp, Artificial
  CRISPR gRNA sequence
ggcattgcagccaagcctgg

SEQ ID NO: 48012 - DNA, 20 bp, Artificial
  CRISPR gRNA sequence
cattgcagccaagcctggaa

SEQ ID NO: 48013 - DNA, 20 bp, Artificial
  CRISPR gRNA sequence
attgcagccaagcctggaag

SEQ ID NO: 48014 - DNA, 20 bp, Artificial
  CRISPR gRNA sequence
tgcagccaagcctggaagag

SEQ ID NO: 48015 - DNA, 20 bp, Artificial
  CRISPR gRNA sequence
cagccaagcctggaagagga

SEQ ID NO: 48016 - DNA, 20 bp, Artificial
  CRISPR gRNA sequence
agccaagcctggaagaggag

SEQ ID NO: 48017 - DNA, 20 bp, Artificial
  CRISPR gRNA sequence
gcctggaagaggagaggaat

SEQ ID NO: 48018 - DNA, 20 bp, Artificial
  CRISPR gRNA sequence
agaggagaggaatgagcatt

SEQ ID NO: 48019 - DNA, 20 bp, Artificial
  CRISPR gRNA sequence
gaggaatgagcattgagtac

SEQ ID NO: 48020 - DNA, 20 bp, Artificial
  CRISPR gRNA sequence
aggaatgagcattgagtact

SEQ ID NO: 48021 - DNA, 20 bp, Artificial
  CRISPR gRNA sequence
gagtactgggcctgcccact

SEQ ID NO: 48022 - DNA, 20 bp, Artificial
  CRISPR gRNA sequence
agtactgggcctgcccactc

SEQ ID NO: 48023 - DNA, 20 bp, Artificial
  CRISPR gRNA sequence
gccctgccctgtgcccactg

SEQ ID NO: 48024 - DNA, 20 bp, Artificial
  CRISPR gRNA sequence
ccctgccctgtgcccactgc

SEQ ID NO: 48025 - DNA, 20 bp, Artificial
  CRISPR gRNA sequence
ctgccctgtgcccactgcgg

SEQ ID NO: 48026 - DNA, 20 bp, Artificial
  CRISPR gRNA sequence
gccctgtgcccactgcggga

SEQ ID NO: 48027 - DNA, 20 bp, Artificial
  CRISPR gRNA sequence
ccctgtgcccactgcgggag

SEQ ID NO: 48028 - DNA, 20 bp, Artificial
  CRISPR gRNA sequence
ctgtgcccactgcgggagag

SEQ ID NO: 48029 - DNA, 20 bp, Artificial
  CRISPR gRNA sequence
tgtgcccactgcgggagagg

SEQ ID NO: 48030 - DNA, 20 bp, Artificial
  CRISPR gRNA sequence
cccactgcgggagaggaggc

SEQ ID NO: 48031 - DNA, 20 bp, Artificial
  CRISPR gRNA sequence
ccactgcgggagaggaggcc

SEQ ID NO: 48032 - DNA, 20 bp, Artificial
  CRISPR gRNA sequence
ctgcgggagaggaggccagg

SEQ ID NO: 48033 - DNA, 20 bp, Artificial
  CRISPR gRNA sequence
gagaggaggccaggtggacc

SEQ ID NO: 48034 - DNA, 20 bp, Artificial
  CRISPR gRNA sequence
agaggaggccaggtggacct

SEQ ID NO: 48035 - DNA, 20 bp, Artificial
  CRISPR gRNA sequence
gaggaggccaggtggacctg

SEQ ID NO: 48036 - DNA, 20 bp, Artificial
  CRISPR gRNA sequence
aggaggccaggtggacctgg

SEQ ID NO: 48037 - DNA, 20 bp, Artificial
  CRISPR gRNA sequence
ggaggccaggtggacctggg

SEQ ID NO: 48038 - DNA, 20 bp, Artificial
  CRISPR gRNA sequence
ccaggtggacctggggggca

SEQ ID NO: 48039 - DNA, 20 bp, Artificial
  CRISPR gRNA sequence
aggtggacctggggggcaca

SEQ ID NO: 48040 - DNA, 20 bp, Artificial
  CRISPR gRNA sequence
ggtggacctggggggcacag

SEQ ID NO: 48041 - DNA, 20 bp, Artificial
  CRISPR gRNA sequence
gtggacctggggggcacaga

SEQ ID NO: 48042 - DNA, 20 bp, Artificial
  CRISPR gRNA sequence
gacctggggggcacagaggg

SEQ ID NO: 48043 - DNA, 20 bp, Artificial
  CRISPR gRNA sequence
cctggggggcacagagggca

SEQ ID NO: 48044 - DNA, 20 bp, Artificial
  CRISPR gRNA sequence
ctggggggcacagagggcag

SEQ ID NO: 48045 - DNA, 20 bp, Artificial
  CRISPR gRNA sequence
cacagagggcagaggccacc

SEQ ID NO: 48046 - DNA, 20 bp, Artificial
  CRISPR gRNA sequence
acagagggcagaggccacct

SEQ ID NO: 48047 - DNA, 20 bp, Artificial
  CRISPR gRNA sequence
gagggcagaggccacctggg

SEQ ID NO: 48048 - DNA, 20 bp, Artificial
  CRISPR gRNA sequence
gacactcacatcaactcctc

SEQ ID NO: 48049 - DNA, 20 bp, Artificial
  CRISPR gRNA sequence
acactcacatcaactcctcc

SEQ ID NO: 48050 - DNA, 20 bp, Artificial
  CRISPR gRNA sequence
aactcctccaggcgcctgca

SEQ ID NO: 48051 - DNA, 20 bp, Artificial
  CRISPR gRNA sequence
tccaggcgcctgcaaagaac

SEQ ID NO: 48052 - DNA, 20 bp, Artificial
  CRISPR gRNA sequence
caggcgcctgcaaagaacga

SEQ ID NO: 48053 - DNA, 20 bp, Artificial
  CRISPR gRNA sequence
ctctgccaactgcactcccc

SEQ ID NO: 48054 - DNA, 20 bp, Artificial
  CRISPR gRNA sequence
ccaactgcactcccccggct

SEQ ID NO: 48055 - DNA, 20 bp, Artificial
  CRISPR gRNA sequence
ctgagctgatgctattccct

SEQ ID NO: 48056 - DNA, 20 bp, Artificial
  CRISPR gRNA sequence
gagctgatgctattccctga

SEQ ID NO: 48057 - DNA, 20 bp, Artificial
  CRISPR gRNA sequence
agctgatgctattccctgag

SEQ ID NO: 48058 - DNA, 20 bp, Artificial
  CRISPR gRNA sequence
tgctattccctgagaggctg

SEQ ID NO: 48059 - DNA, 20 bp, Artificial
  CRISPR gRNA sequence
gctattccctgagaggctgt

SEQ ID NO: 48060 - DNA, 20 bp, Artificial
  CRISPR gRNA sequence
tattccctgagaggctgtgg

SEQ ID NO: 48061 - DNA, 20 bp, Artificial
  CRISPR gRNA sequence
attccctgagaggctgtggg

SEQ ID NO: 48062 - DNA, 20 bp, Artificial
  CRISPR gRNA sequence
ttccctgagaggctgtggga

SEQ ID NO: 48063 - DNA, 20 bp, Artificial
  CRISPR gRNA sequence
tccctgagaggctgtgggag

SEQ ID NO: 48064 - DNA, 20 bp, Artificial
  CRISPR gRNA sequence
ccctgagaggctgtgggagg

SEQ ID NO: 48065 - DNA, 20 bp, Artificial
  CRISPR gRNA sequence
cctgagaggctgtgggaggg

SEQ ID NO: 48066 - DNA, 20 bp, Artificial
  CRISPR gRNA sequence
gagaggctgtgggagggggg

SEQ ID NO: 48067 - DNA, 20 bp, Artificial
  CRISPR gRNA sequence
tgtgggaggggggcagccat

SEQ ID NO: 48068 - DNA, 20 bp, Artificial
  CRISPR gRNA sequence
gtgggaggggggcagccatc

SEQ ID NO: 48069 - DNA, 20 bp, Artificial
  CRISPR gRNA sequence
gccccctctccccgacaccc

SEQ ID NO: 48070 - DNA, 20 bp, Artificial
  CRISPR gRNA sequence
cgacaccccagcacatctgc

SEQ ID NO: 48071 - DNA, 20 bp, Artificial
  CRISPR gRNA sequence
gacaccccagcacatctgct

SEQ ID NO: 48072 - DNA, 20 bp, Artificial
  CRISPR gRNA sequence
tgggtctgccacccctgctt

SEQ ID NO: 48073 - DNA, 20 bp, Artificial
  CRISPR gRNA sequence
gggtctgccacccctgcttc

SEQ ID NO: 48074 - DNA, 20 bp, Artificial
  CRISPR gRNA sequence
ggtctgccacccctgcttca

SEQ ID NO: 48075 - DNA, 20 bp, Artificial
  CRISPR gRNA sequence
gtctgccacccctgcttcag

SEQ ID NO: 48076 - DNA, 20 bp, Artificial
  CRISPR gRNA sequence
tctgccacccctgcttcagg

SEQ ID NO: 48077 - DNA, 20 bp, Artificial
  CRISPR gRNA sequence
acccctgcttcagggggcct

SEQ ID NO: 48078 - DNA, 20 bp, Artificial
  CRISPR gRNA sequence
ccctgcttcagggggcctaa

SEQ ID NO: 48079 - DNA, 20 bp, Artificial
  CRISPR gRNA sequence
cccgacaccacacacctacc

SEQ ID NO: 48080 - DNA, 20 bp, Artificial
  CRISPR gRNA sequence
cacacacctacccagacaat

SEQ ID NO: 48081 - DNA, 20 bp, Artificial
  CRISPR gRNA sequence
acacacctacccagacaatg

SEQ ID NO: 48082 - DNA, 20 bp, Artificial
  CRISPR gRNA sequence
cacctacccagacaatgagg

SEQ ID NO: 48083 - DNA, 20 bp, Artificial
  CRISPR gRNA sequence
tacccagacaatgaggcaga

SEQ ID NO: 48084 - DNA, 20 bp, Artificial
  CRISPR gRNA sequence
acccagacaatgaggcagaa

SEQ ID NO: 48085 - DNA, 20 bp, Artificial
  CRISPR gRNA sequence
gacaatgaggcagaaaggcc

SEQ ID NO: 48086 - DNA, 20 bp, Artificial
  CRISPR gRNA sequence
caatgaggcagaaaggccca

SEQ ID NO: 48087 - DNA, 20 bp, Artificial
  CRISPR gRNA sequence
tgaggcagaaaggcccagag

SEQ ID NO: 48088 - DNA, 20 bp, Artificial
  CRISPR gRNA sequence
aggcagaaaggcccagagaa

SEQ ID NO: 48089 - DNA, 20 bp, Artificial
  CRISPR gRNA sequence
cagaaaggcccagagaagag

SEQ ID NO: 48090 - DNA, 20 bp, Artificial
  CRISPR gRNA sequence
agaaaggcccagagaagagc

SEQ ID NO: 48091 - DNA, 20 bp, Artificial
  CRISPR gRNA sequence
gaaaggcccagagaagagca

SEQ ID NO: 48092 - DNA, 20 bp, Artificial
  CRISPR gRNA sequence
aaaggcccagagaagagcag

SEQ ID NO: 48093 - DNA, 20 bp, Artificial
  CRISPR gRNA sequence
gcccagagaagagcaggggc

SEQ ID NO: 48094 - DNA, 20 bp, Artificial
  CRISPR gRNA sequence
cccagagaagagcaggggct

SEQ ID NO: 48095 - DNA, 20 bp, Artificial
  CRISPR gRNA sequence
ccagagaagagcaggggctg

SEQ ID NO: 48096 - DNA, 20 bp, Artificial
  CRISPR gRNA sequence
gagaagagcaggggctgggg

SEQ ID NO: 48097 - DNA, 20 bp, Artificial
  CRISPR gRNA sequence
agcaggggctggggtggctt

SEQ ID NO: 48098 - DNA, 20 bp, Artificial
  CRISPR gRNA sequence
gcaggggctggggtggctta

SEQ ID NO: 48099 - DNA, 20 bp, Artificial
  CRISPR gRNA sequence
tggggtggcttaaggtcccg

SEQ ID NO: 48100 - DNA, 20 bp, Artificial
  CRISPR gRNA sequence
gtggcttaaggtcccgcagt

SEQ ID NO: 48101 - DNA, 20 bp, Artificial
  CRISPR gRNA sequence
tggcttaaggtcccgcagtg

SEQ ID NO: 48102 - DNA, 20 bp, Artificial
  CRISPR gRNA sequence
ggcttaaggtcccgcagtga

SEQ ID NO: 48103 - DNA, 20 bp, Artificial
  CRISPR gRNA sequence
taaggtcccgcagtgagggc

SEQ ID NO: 48104 - DNA, 20 bp, Artificial
  CRISPR gRNA sequence
aaggtcccgcagtgagggcc

SEQ ID NO: 48105 - DNA, 20 bp, Artificial
  CRISPR gRNA sequence
ggtcccgcagtgagggccag

SEQ ID NO: 48106 - DNA, 20 bp, Artificial
  CRISPR gRNA sequence
gtcccgcagtgagggccagg

SEQ ID NO: 48107 - DNA, 20 bp, Artificial
  CRISPR gRNA sequence
gtgagggccaggaggtcacc

SEQ ID NO: 48108 - DNA, 20 bp, Artificial
  CRISPR gRNA sequence
ggtcaccgagccccactgcc

SEQ ID NO: 48109 - DNA, 20 bp, Artificial
  CRISPR gRNA sequence
agccccactgcctggacact

SEQ ID NO: 48110 - DNA, 20 bp, Artificial
  CRISPR gRNA sequence
gccccactgcctggacactg

SEQ ID NO: 48111 - DNA, 20 bp, Artificial
  CRISPR gRNA sequence
cactgcctggacactgaggt

SEQ ID NO: 48112 - DNA, 20 bp, Artificial
  CRISPR gRNA sequence
cctggacactgaggttggcg

SEQ ID NO: 48113 - DNA, 20 bp, Artificial
  CRISPR gRNA sequence
ctggacactgaggttggcgc

SEQ ID NO: 48114 - DNA, 20 bp, Artificial
  CRISPR gRNA sequence
tggacactgaggttggcgca

SEQ ID NO: 48115 - DNA, 20 bp, Artificial
  CRISPR gRNA sequence
ggacactgaggttggcgcag

SEQ ID NO: 48116 - DNA, 20 bp, Artificial
  CRISPR gRNA sequence
acactgaggttggcgcaggg

SEQ ID NO: 48117 - DNA, 20 bp, Artificial
  CRISPR gRNA sequence
caggggagattttaccatgc

SEQ ID NO: 48118 - DNA, 20 bp, Artificial
  CRISPR gRNA sequence
agattttaccatgctggcct

SEQ ID NO: 48119 - DNA, 20 bp, Artificial
  CRISPR gRNA sequence
tttaccatgctggcctcagc

SEQ ID NO: 48120 - DNA, 20 bp, Artificial
  CRISPR gRNA sequence
ttaccatgctggcctcagct

SEQ ID NO: 48121 - DNA, 20 bp, Artificial
  CRISPR gRNA sequence
taccatgctggcctcagcta

SEQ ID NO: 48122 - DNA, 20 bp, Artificial
  CRISPR gRNA sequence
accatgctggcctcagctag

SEQ ID NO: 48123 - DNA, 20 bp, Artificial
  CRISPR gRNA sequence
tgctggcctcagctaggggc

SEQ ID NO: 48124 - DNA, 20 bp, Artificial
  CRISPR gRNA sequence
agctaggggccagtatctcc

SEQ ID NO: 48125 - DNA, 20 bp, Artificial
  CRISPR gRNA sequence
gctaggggccagtatctcct

SEQ ID NO: 48126 - DNA, 20 bp, Artificial
  CRISPR gRNA sequence
ggaccatcgtgtgacccctg

SEQ ID NO: 48127 - DNA, 20 bp, Artificial
  CRISPR gRNA sequence
acccctgtggccctcctctg

SEQ ID NO: 48128 - DNA, 20 bp, Artificial
  CRISPR gRNA sequence
cccctgtggccctcctctgt

SEQ ID NO: 48129 - DNA, 20 bp, Artificial
  CRISPR gRNA sequence
ccctgtggccctcctctgta

SEQ ID NO: 48130 - DNA, 20 bp, Artificial
  CRISPR gRNA sequence
gtggccctcctctgtagggc

SEQ ID NO: 48131 - DNA, 20 bp, Artificial
  CRISPR gRNA sequence
gctactcactctatcttcct

SEQ ID NO: 48132 - DNA, 20 bp, Artificial
  CRISPR gRNA sequence
cactctatcttcctgagctc

SEQ ID NO: 48133 - DNA, 20 bp, Artificial
  CRISPR gRNA sequence
tctatcttcctgagctctgg

SEQ ID NO: 48134 - DNA, 20 bp, Artificial
  CRISPR gRNA sequence
cttcctgagctctggcagcc

SEQ ID NO: 48135 - DNA, 20 bp, Artificial
  CRISPR gRNA sequence
ttcctgagctctggcagccc

SEQ ID NO: 48136 - DNA, 20 bp, Artificial
  CRISPR gRNA sequence
ctgagctctggcagcccagg

SEQ ID NO: 48137 - DNA, 20 bp, Artificial
  CRISPR gRNA sequence
tgagctctggcagcccaggc

SEQ ID NO: 48138 - DNA, 20 bp, Artificial
  CRISPR gRNA sequence
ctctggcagcccaggcagga

SEQ ID NO: 48139 - DNA, 20 bp, Artificial
  CRISPR gRNA sequence
tggcagcccaggcaggatgg

SEQ ID NO: 48140 - DNA, 20 bp, Artificial
  CRISPR gRNA sequence
gcccaggcaggatggtagct

SEQ ID NO: 48141 - DNA, 20 bp, Artificial
  CRISPR gRNA sequence
gcaggatggtagctaagtgc

SEQ ID NO: 48142 - DNA, 20 bp, Artificial
  CRISPR gRNA sequence
ggtagctaagtgctggacac

SEQ ID NO: 48143 - DNA, 20 bp, Artificial
  CRISPR gRNA sequence
ggacaccagcgtctccaatc

SEQ ID NO: 48144 - DNA, 20 bp, Artificial
  CRISPR gRNA sequence
cagcgtctccaatctggttg

SEQ ID NO: 48145 - DNA, 20 bp, Artificial
  CRISPR gRNA sequence
ctccaatctggttgtggctc

SEQ ID NO: 48146 - DNA, 20 bp, Artificial
  CRISPR gRNA sequence
atctggttgtggctcaagct

SEQ ID NO: 48147 - DNA, 20 bp, Artificial
  CRISPR gRNA sequence
tctggttgtggctcaagctt

SEQ ID NO: 48148 - DNA, 20 bp, Artificial
  CRISPR gRNA sequence
ctggttgtggctcaagcttg

SEQ ID NO: 48149 - DNA, 20 bp, Artificial
  CRISPR gRNA sequence
tggttgtggctcaagcttgg

SEQ ID NO: 48150 - DNA, 20 bp, Artificial
  CRISPR gRNA sequence
gttgtggctcaagcttgggg

SEQ ID NO: 48151 - DNA, 20 bp, Artificial
  CRISPR gRNA sequence
ctcaagcttgggggagaaaa

SEQ ID NO: 48152 - DNA, 20 bp, Artificial
  CRISPR gRNA sequence
gggggagaaaacagcttcat

SEQ ID NO: 48153 - DNA, 20 bp, Artificial
  CRISPR gRNA sequence
tcttgtccacaccccactcc

SEQ ID NO: 48154 - DNA, 20 bp, Artificial
  CRISPR gRNA sequence
ccacaccccactcccagaaa

SEQ ID NO: 48155 - DNA, 20 bp, Artificial
  CRISPR gRNA sequence
caccccactcccagaaaaag

SEQ ID NO: 48156 - DNA, 20 bp, Artificial
  CRISPR gRNA sequence
accccactcccagaaaaaga

SEQ ID NO: 48157 - DNA, 20 bp, Artificial
  CRISPR gRNA sequence
ccccactcccagaaaaagaa

SEQ ID NO: 48158 - DNA, 20 bp, Artificial
  CRISPR gRNA sequence
cccactcccagaaaaagaag

SEQ ID NO: 48159 - DNA, 20 bp, Artificial
  CRISPR gRNA sequence
cactcccagaaaaagaaggg

SEQ ID NO: 48160 - DNA, 20 bp, Artificial
  CRISPR gRNA sequence
actcccagaaaaagaagggg

SEQ ID NO: 48161 - DNA, 20 bp, Artificial
  CRISPR gRNA sequence
agaaaaagaaggggaggctg

SEQ ID NO: 48162 - DNA, 20 bp, Artificial
  CRISPR gRNA sequence
agaaggggaggctgaagtcc

SEQ ID NO: 48163 - DNA, 20 bp, Artificial
  CRISPR gRNA sequence
gaaggggaggctgaagtccc

SEQ ID NO: 48164 - DNA, 20 bp, Artificial
  CRISPR gRNA sequence
ggggaggctgaagtcccagg

SEQ ID NO: 48165 - DNA, 20 bp, Artificial
  CRISPR gRNA sequence
gggaggctgaagtcccagga

SEQ ID NO: 48166 - DNA, 20 bp, Artificial
  CRISPR gRNA sequence
ggaggctgaagtcccaggaa

SEQ ID NO: 48167 - DNA, 20 bp, Artificial
  CRISPR gRNA sequence
aggaagggcctcgactcaca

SEQ ID NO: 48168 - DNA, 20 bp, Artificial
  CRISPR gRNA sequence
gaagggcctcgactcacaca

SEQ ID NO: 48169 - DNA, 20 bp, Artificial
  CRISPR gRNA sequence
agggcctcgactcacacaga

SEQ ID NO: 48170 - DNA, 20 bp, Artificial
  CRISPR gRNA sequence
gagccccatcaccccatgtt

SEQ ID NO: 48171 - DNA, 20 bp, Artificial
  CRISPR gRNA sequence
catcaccccatgttgagtga

SEQ ID NO: 48172 - DNA, 20 bp, Artificial
  CRISPR gRNA sequence
gagtgacagctcctaaccct

SEQ ID NO: 48173 - DNA, 20 bp, Artificial
  CRISPR gRNA sequence
cctaacccttggcttctgtt

SEQ ID NO: 48174 - DNA, 20 bp, Artificial
  CRISPR gRNA sequence
ctaacccttggcttctgttt

SEQ ID NO: 48175 - DNA, 20 bp, Artificial
  CRISPR gRNA sequence
acactcttacatcctgtctt

SEQ ID NO: 48176 - DNA, 20 bp, Artificial
  CRISPR gRNA sequence
cactcttacatcctgtcttt

SEQ ID NO: 48177 - DNA, 20 bp, Artificial
  CRISPR gRNA sequence
atcctgtctttgggtccccc

SEQ ID NO: 48178 - DNA, 20 bp, Artificial
  CRISPR gRNA sequence
ctttgggtcccccaagcttc

SEQ ID NO: 48179 - DNA, 20 bp, Artificial
  CRISPR gRNA sequence
tttgggtcccccaagcttct

SEQ ID NO: 48180 - DNA, 20 bp, Artificial
  CRISPR gRNA sequence
tcccccaagcttctaggccc

SEQ ID NO: 48181 - DNA, 20 bp, Artificial
  CRISPR gRNA sequence
cccccaagcttctaggcccc

SEQ ID NO: 48182 - DNA, 20 bp, Artificial
  CRISPR gRNA sequence
taggccccaggttgtttaca

SEQ ID NO: 48183 - DNA, 20 bp, Artificial
  CRISPR gRNA sequence
cccaggttgtttacacagtg

SEQ ID NO: 48184 - DNA, 20 bp, Artificial
  CRISPR gRNA sequence
aggttgtttacacagtgtag

SEQ ID NO: 48185 - DNA, 20 bp, Artificial
  CRISPR gRNA sequence
ttgtttacacagtgtagaag

SEQ ID NO: 48186 - DNA, 20 bp, Artificial
  CRISPR gRNA sequence
tgtttacacagtgtagaagt

SEQ ID NO: 48187 - DNA, 20 bp, Artificial
  CRISPR gRNA sequence
acacagtgtagaagtgggtg

SEQ ID NO: 48188 - DNA, 20 bp, Artificial
  CRISPR gRNA sequence
cacagtgtagaagtgggtga

SEQ ID NO: 48189 - DNA, 20 bp, Artificial
  CRISPR gRNA sequence
cagtgtagaagtgggtgaag

SEQ ID NO: 48190 - DNA, 20 bp, Artificial
  CRISPR gRNA sequence
tagaagtgggtgaaggagat

SEQ ID NO: 48191 - DNA, 20 bp, Artificial
  CRISPR gRNA sequence
tgggtgaaggagatgagatg

SEQ ID NO: 48192 - DNA, 20 bp, Artificial
  CRISPR gRNA sequence
gtgaaggagatgagatgaag

SEQ ID NO: 48193 - DNA, 20 bp, Artificial
  CRISPR gRNA sequence
ggagatgagatgaagaagca

SEQ ID NO: 48194 - DNA, 20 bp, Artificial
  CRISPR gRNA sequence
gagatgagatgaagaagcaa

SEQ ID NO: 48195 - DNA, 20 bp, Artificial
  CRISPR gRNA sequence
agatgagatgaagaagcaaa

SEQ ID NO: 48196 - DNA, 20 bp, Artificial
  CRISPR gRNA sequence
gaagaagcaaagggcgtgct

SEQ ID NO: 48197 - DNA, 20 bp, Artificial
  CRISPR gRNA sequence
aagaagcaaagggcgtgctc

SEQ ID NO: 48198 - DNA, 20 bp, Artificial
  CRISPR gRNA sequence
aagcaaagggcgtgctcagg

SEQ ID NO: 48199 - DNA, 20 bp, Artificial
  CRISPR gRNA sequence
cttgcccttgtcatctttcc

SEQ ID NO: 48200 - DNA, 20 bp, Artificial
  CRISPR gRNA sequence
tttcccggccaaaattgtcc

SEQ ID NO: 48201 - DNA, 20 bp, Artificial
  CRISPR gRNA sequence
ttcccggccaaaattgtcct

SEQ ID NO: 48202 - DNA, 20 bp, Artificial
  CRISPR gRNA sequence
ggccaaaattgtcctgggtc

SEQ ID NO: 48203 - DNA, 20 bp, Artificial
  CRISPR gRNA sequence
gccaaaattgtcctgggtct

SEQ ID NO: 48204 - DNA, 20 bp, Artificial
  CRISPR gRNA sequence
ccaaaattgtcctgggtctg

SEQ ID NO: 48205 - DNA, 20 bp, Artificial
  CRISPR gRNA sequence
caaaattgtcctgggtctgg

SEQ ID NO: 48206 - DNA, 20 bp, Artificial
  CRISPR gRNA sequence
aattgtcctgggtctggggg

SEQ ID NO: 48207 - DNA, 20 bp, Artificial
  CRISPR gRNA sequence
tcctgggtctgggggcagaa

SEQ ID NO: 48208 - DNA, 20 bp, Artificial
  CRISPR gRNA sequence
cctgggtctgggggcagaat

SEQ ID NO: 48209 - DNA, 20 bp, Artificial
  CRISPR gRNA sequence
gcagaatgggcaactcactc

SEQ ID NO: 48210 - DNA, 20 bp, Artificial
  CRISPR gRNA sequence
gcaactcactccagctcctc

SEQ ID NO: 48211 - DNA, 20 bp, Artificial
  CRISPR gRNA sequence
caactcactccagctcctct

SEQ ID NO: 48212 - DNA, 20 bp, Artificial
  CRISPR gRNA sequence
tcactccagctcctctaggc

SEQ ID NO: 48213 - DNA, 20 bp, Artificial
  CRISPR gRNA sequence
ctccagctcctctaggctgg

SEQ ID NO: 48214 - DNA, 20 bp, Artificial
  CRISPR gRNA sequence
cagctcctctaggctggtgg

SEQ ID NO: 48215 - DNA, 20 bp, Artificial
  CRISPR gRNA sequence
tctaggctggtggcagccct

SEQ ID NO: 48216 - DNA, 20 bp, Artificial
  CRISPR gRNA sequence
taggctggtggcagccctga

SEQ ID NO: 48217 - DNA, 20 bp, Artificial
  CRISPR gRNA sequence
ggtggcagccctgagagcct

SEQ ID NO: 48218 - DNA, 20 bp, Artificial
  CRISPR gRNA sequence
gcagccctgagagcctcaga

SEQ ID NO: 48219 - DNA, 20 bp, Artificial
  CRISPR gRNA sequence
cagccctgagagcctcagaa

SEQ ID NO: 48220 - DNA, 20 bp, Artificial
  CRISPR gRNA sequence
ccctgagagcctcagaaagg

SEQ ID NO: 48221 - DNA, 20 bp, Artificial
  CRISPR gRNA sequence
tgagagcctcagaaaggtgg

SEQ ID NO: 48222 - DNA, 20 bp, Artificial
  CRISPR gRNA sequence
tcaccgatactgttcctgtt

SEQ ID NO: 48223 - DNA, 20 bp, Artificial
  CRISPR gRNA sequence
gatactgttcctgttcagtc

SEQ ID NO: 48224 - DNA, 20 bp, Artificial
  CRISPR gRNA sequence
tgttcctgttcagtctggaa

SEQ ID NO: 48225 - DNA, 20 bp, Artificial
  CRISPR gRNA sequence
tcctgttcagtctggaaaag

SEQ ID NO: 48226 - DNA, 20 bp, Artificial
  CRISPR gRNA sequence
cctgttcagtctggaaaagc

SEQ ID NO: 48227 - DNA, 20 bp, Artificial
  CRISPR gRNA sequence
ctgttcagtctggaaaagca

SEQ ID NO: 48228 - DNA, 20 bp, Artificial
  CRISPR gRNA sequence
cagtctggaaaagcagggaa

SEQ ID NO: 48229 - DNA, 20 bp, Artificial
  CRISPR gRNA sequence
ggaaaagcagggaatagacc

SEQ ID NO: 48230 - DNA, 20 bp, Artificial
  CRISPR gRNA sequence
aaaagcagggaatagaccaa

SEQ ID NO: 48231 - DNA, 20 bp, Artificial
  CRISPR gRNA sequence
aaagcagggaatagaccaag

SEQ ID NO: 48232 - DNA, 20 bp, Artificial
  CRISPR gRNA sequence
ggaatagaccaagaggcttt

SEQ ID NO: 48233 - DNA, 20 bp, Artificial
  CRISPR gRNA sequence
gaatagaccaagaggctttc

SEQ ID NO: 48234 - DNA, 20 bp, Artificial
  CRISPR gRNA sequence
atagaccaagaggctttcag

SEQ ID NO: 48235 - DNA, 20 bp, Artificial
  CRISPR gRNA sequence
aagaggctttcaggagctta

SEQ ID NO: 48236 - DNA, 20 bp, Artificial
  CRISPR gRNA sequence
agaggctttcaggagcttaa

SEQ ID NO: 48237 - DNA, 20 bp, Artificial
  CRISPR gRNA sequence
caggagcttaaaggcctttg

SEQ ID NO: 48238 - DNA, 20 bp, Artificial
  CRISPR gRNA sequence
aggagcttaaaggcctttgc

SEQ ID NO: 48239 - DNA, 20 bp, Artificial
  CRISPR gRNA sequence
gcctttgcaggtgctgtgct

SEQ ID NO: 48240 - DNA, 20 bp, Artificial
  CRISPR gRNA sequence
gtgctgtgctaagaactcta

SEQ ID NO: 48241 - DNA, 20 bp, Artificial
  CRISPR gRNA sequence
taagaactctacagtttgca

SEQ ID NO: 48242 - DNA, 20 bp, Artificial
  CRISPR gRNA sequence
tttgcaaagccttacacgcc

SEQ ID NO: 48243 - DNA, 20 bp, Artificial
  CRISPR gRNA sequence
ttgcaaagccttacacgccc

SEQ ID NO: 48244 - DNA, 20 bp, Artificial
  CRISPR gRNA sequence
acgcccaggaattcatatgc

SEQ ID NO: 48245 - DNA, 20 bp, Artificial
  CRISPR gRNA sequence
cccaggaattcatatgctgg

SEQ ID NO: 48246 - DNA, 20 bp, Artificial
  CRISPR gRNA sequence
tatgctggtagcaaaacttc

SEQ ID NO: 48247 - DNA, 20 bp, Artificial
  CRISPR gRNA sequence
atgctggtagcaaaacttct

SEQ ID NO: 48248 - DNA, 20 bp, Artificial
  CRISPR gRNA sequence
tgctggtagcaaaacttctg

SEQ ID NO: 48249 - DNA, 20 bp, Artificial
  CRISPR gRNA sequence
gctggtagcaaaacttctgg

SEQ ID NO: 48250 - DNA, 20 bp, Artificial
  CRISPR gRNA sequence
agcaaaacttctgggggtca

SEQ ID NO: 48251 - DNA, 20 bp, Artificial
  CRISPR gRNA sequence
aaaacttctgggggtcatgg

SEQ ID NO: 48252 - DNA, 20 bp, Artificial
  CRISPR gRNA sequence
aaacttctgggggtcatggc

SEQ ID NO: 48253 - DNA, 20 bp, Artificial
  CRISPR gRNA sequence
cttctgggggtcatggcagg

SEQ ID NO: 48254 - DNA, 20 bp, Artificial
  CRISPR gRNA sequence
ttctgggggtcatggcaggt

SEQ ID NO: 48255 - DNA, 20 bp, Artificial
  CRISPR gRNA sequence
tctgggggtcatggcaggtg

SEQ ID NO: 48256 - DNA, 20 bp, Artificial
  CRISPR gRNA sequence
tgggggtcatggcaggtggg

SEQ ID NO: 48257 - DNA, 20 bp, Artificial
  CRISPR gRNA sequence
gggtcatggcaggtggggag

SEQ ID NO: 48258 - DNA, 20 bp, Artificial
  CRISPR gRNA sequence
catggcaggtggggagtggt

SEQ ID NO: 48259 - DNA, 20 bp, Artificial
  CRISPR gRNA sequence
gcaggtggggagtggtgagc

SEQ ID NO: 48260 - DNA, 20 bp, Artificial
  CRISPR gRNA sequence
caggtggggagtggtgagca

SEQ ID NO: 48261 - DNA, 20 bp, Artificial
  CRISPR gRNA sequence
gtggggagtggtgagcaagg

SEQ ID NO: 48262 - DNA, 20 bp, Artificial
  CRISPR gRNA sequence
tggggagtggtgagcaaggt

SEQ ID NO: 48263 - DNA, 20 bp, Artificial
  CRISPR gRNA sequence
aaggtgggaattattgtccc

SEQ ID NO: 48264 - DNA, 20 bp, Artificial
  CRISPR gRNA sequence
gaattattgtccccagtgtc

SEQ ID NO: 48265 - DNA, 20 bp, Artificial
  CRISPR gRNA sequence
aattattgtccccagtgtcc

SEQ ID NO: 48266 - DNA, 20 bp, Artificial
  CRISPR gRNA sequence
attgtccccagtgtccaggt

SEQ ID NO: 48267 - DNA, 20 bp, Artificial
  CRISPR gRNA sequence
gtgtccaggtgagaaaactt

SEQ ID NO: 48268 - DNA, 20 bp, Artificial
  CRISPR gRNA sequence
gtccaggtgagaaaacttga

SEQ ID NO: 48269 - DNA, 20 bp, Artificial
  CRISPR gRNA sequence
aggtgagaaaacttgagagc

SEQ ID NO: 48270 - DNA, 20 bp, Artificial
  CRISPR gRNA sequence
tgagaaaacttgagagccag

SEQ ID NO: 48271 - DNA, 20 bp, Artificial
  CRISPR gRNA sequence
aaaacttgagagccagcagt

SEQ ID NO: 48272 - DNA, 20 bp, Artificial
  CRISPR gRNA sequence
agccagcagtgagctgtgac

SEQ ID NO: 48273 - DNA, 20 bp, Artificial
  CRISPR gRNA sequence
agcagtgagctgtgactggc

SEQ ID NO: 48274 - DNA, 20 bp, Artificial
  CRISPR gRNA sequence
cagtgagctgtgactggcca

SEQ ID NO: 48275 - DNA, 20 bp, Artificial
  CRISPR gRNA sequence
gctgtgactggccagagact

SEQ ID NO: 48276 - DNA, 20 bp, Artificial
  CRISPR gRNA sequence
ctgtgactggccagagactt

SEQ ID NO: 48277 - DNA, 20 bp, Artificial
  CRISPR gRNA sequence
tgtgactggccagagactta

SEQ ID NO: 48278 - DNA, 20 bp, Artificial
  CRISPR gRNA sequence
gccagagacttagggacttg

SEQ ID NO: 48279 - DNA, 20 bp, Artificial
  CRISPR gRNA sequence
ccagagacttagggacttgc

SEQ ID NO: 48280 - DNA, 20 bp, Artificial
  CRISPR gRNA sequence
agacttagggacttgcaggc

SEQ ID NO: 48281 - DNA, 20 bp, Artificial
  CRISPR gRNA sequence
gacttagggacttgcaggct

SEQ ID NO: 48282 - DNA, 20 bp, Artificial
  CRISPR gRNA sequence
ttagggacttgcaggctggg

SEQ ID NO: 48283 - DNA, 20 bp, Artificial
  CRISPR gRNA sequence
aggctgggtggaaacaaatc

SEQ ID NO: 48284 - DNA, 20 bp, Artificial
  CRISPR gRNA sequence
gctgggtggaaacaaatcca

SEQ ID NO: 48285 - DNA, 20 bp, Artificial
  CRISPR gRNA sequence
ggaaacaaatccagagcccc

SEQ ID NO: 48286 - DNA, 20 bp, Artificial
  CRISPR gRNA sequence
caaatccagagcccctggcc

SEQ ID NO: 48287 - DNA, 20 bp, Artificial
  CRISPR gRNA sequence
aaatccagagcccctggccc

SEQ ID NO: 48288 - DNA, 20 bp, Artificial
  CRISPR gRNA sequence
atccagagcccctggcccag

SEQ ID NO: 48289 - DNA, 20 bp, Artificial
  CRISPR gRNA sequence
tccagagcccctggcccagg

SEQ ID NO: 48290 - DNA, 20 bp, Artificial
  CRISPR gRNA sequence
cagagcccctggcccaggag

SEQ ID NO: 48291 - DNA, 20 bp, Artificial
  CRISPR gRNA sequence
agtctctacatttctttgcc

SEQ ID NO: 48292 - DNA, 20 bp, Artificial
  CRISPR gRNA sequence
ttctttgccaagcttcacct

SEQ ID NO: 48293 - DNA, 20 bp, Artificial
  CRISPR gRNA sequence
cttcacctcagcctctgtgt

SEQ ID NO: 48294 - DNA, 20 bp, Artificial
  CRISPR gRNA sequence
ttcacctcagcctctgtgtc

SEQ ID NO: 48295 - DNA, 20 bp, Artificial
  CRISPR gRNA sequence
tcacctcagcctctgtgtca

SEQ ID NO: 48296 - DNA, 20 bp, Artificial
  CRISPR gRNA sequence
gcctctgtgtcagggatctc

SEQ ID NO: 48297 - DNA, 20 bp, Artificial
  CRISPR gRNA sequence
cctctgtgtcagggatctcc

SEQ ID NO: 48298 - DNA, 20 bp, Artificial
  CRISPR gRNA sequence
tgtgtcagggatctccgggc

SEQ ID NO: 48299 - DNA, 20 bp, Artificial
  CRISPR gRNA sequence
cagggatctccgggctggcc

SEQ ID NO: 48300 - DNA, 20 bp, Artificial
  CRISPR gRNA sequence
ggctgaatgccactttcacg

SEQ ID NO: 48301 - DNA, 20 bp, Artificial
  CRISPR gRNA sequence
gctgaatgccactttcacgt

SEQ ID NO: 48302 - DNA, 20 bp, Artificial
  CRISPR gRNA sequence
gtgggattctctgattcacg

SEQ ID NO: 48303 - DNA, 20 bp, Artificial
  CRISPR gRNA sequence
attctctgattcacgcagat

SEQ ID NO: 48304 - DNA, 20 bp, Artificial
  CRISPR gRNA sequence
gattcacgcagatcagttct

SEQ ID NO: 48305 - DNA, 20 bp, Artificial
  CRISPR gRNA sequence
attcacgcagatcagttctc

SEQ ID NO: 48306 - DNA, 20 bp, Artificial
  CRISPR gRNA sequence
ttcacgcagatcagttctca

SEQ ID NO: 48307 - DNA, 20 bp, Artificial
  CRISPR gRNA sequence
tcacgcagatcagttctcag

SEQ ID NO: 48308 - DNA, 20 bp, Artificial
  CRISPR gRNA sequence
tgtgttctcatccatgcaaa

SEQ ID NO: 48309 - DNA, 20 bp, Artificial
  CRISPR gRNA sequence
gttctcatccatgcaaatgg

SEQ ID NO: 48310 - DNA, 20 bp, Artificial
  CRISPR gRNA sequence
ttctcatccatgcaaatggt

SEQ ID NO: 48311 - DNA, 20 bp, Artificial
  CRISPR gRNA sequence
ggtaggtttttccttaaacc

SEQ ID NO: 48312 - DNA, 20 bp, Artificial
  CRISPR gRNA sequence
gtaggtttttccttaaaccc

SEQ ID NO: 48313 - DNA, 20 bp, Artificial
  CRISPR gRNA sequence
taggtttttccttaaaccca

SEQ ID NO: 48314 - DNA, 20 bp, Artificial
  CRISPR gRNA sequence
cccagggtattgtctttact

SEQ ID NO: 48315 - DNA, 20 bp, Artificial
  CRISPR gRNA sequence
agccctgaccttgctctgcc

SEQ ID NO: 48316 - DNA, 20 bp, Artificial
  CRISPR gRNA sequence
gccctgaccttgctctgcct

SEQ ID NO: 48317 - DNA, 20 bp, Artificial
  CRISPR gRNA sequence
ctgaccttgctctgcctggg

SEQ ID NO: 48318 - DNA, 20 bp, Artificial
  CRISPR gRNA sequence
tgaccttgctctgcctgggt

SEQ ID NO: 48319 - DNA, 20 bp, Artificial
  CRISPR gRNA sequence
gggtaggaaaaaacaataaa

SEQ ID NO: 48320 - DNA, 20 bp, Artificial
  CRISPR gRNA sequence
ggaaaaaacaataaatagct

SEQ ID NO: 48321 - DNA, 20 bp, Artificial
  CRISPR gRNA sequence
gaaaaaacaataaatagctg

SEQ ID NO: 48322 - DNA, 20 bp, Artificial
  CRISPR gRNA sequence
caataaatagctgaggcaaa

SEQ ID NO: 48323 - DNA, 20 bp, Artificial
  CRISPR gRNA sequence
atagctgaggcaaatggtct

SEQ ID NO: 48324 - DNA, 20 bp, Artificial
  CRISPR gRNA sequence
ggcaaatggtcttagcccct

SEQ ID NO: 48325 - DNA, 20 bp, Artificial
  CRISPR gRNA sequence
gcaaatggtcttagcccctt

SEQ ID NO: 48326 - DNA, 20 bp, Artificial
  CRISPR gRNA sequence
aatggtcttagccccttggg

SEQ ID NO: 48327 - DNA, 20 bp, Artificial
  CRISPR gRNA sequence
ttttgcaaattaaattttaa

SEQ ID NO: 48328 - DNA, 20 bp, Artificial
  CRISPR gRNA sequence
tttgcaaattaaattttaat

SEQ ID NO: 48329 - DNA, 20 bp, Artificial
  CRISPR gRNA sequence
ttgcaaattaaattttaatg

SEQ ID NO: 48330 - DNA, 20 bp, Artificial
  CRISPR gRNA sequence
aaattaaattttaatggggc

SEQ ID NO: 48331 - DNA, 20 bp, Artificial
  CRISPR gRNA sequence
aattaaattttaatggggct

SEQ ID NO: 48332 - DNA, 20 bp, Artificial
  CRISPR gRNA sequence
ttaaattttaatggggctgg

SEQ ID NO: 48333 - DNA, 20 bp, Artificial
  CRISPR gRNA sequence
aattttaatggggctgggag

SEQ ID NO: 48334 - DNA, 20 bp, Artificial
  CRISPR gRNA sequence
tttaatggggctgggagcag

SEQ ID NO: 48335 - DNA, 20 bp, Artificial
  CRISPR gRNA sequence
gtggttcacacctgtattcc

SEQ ID NO: 48336 - DNA, 20 bp, Artificial
  CRISPR gRNA sequence
acctgtattcccagcacttt

SEQ ID NO: 48337 - DNA, 20 bp, Artificial
  CRISPR gRNA sequence
ctgtattcccagcactttcg

SEQ ID NO: 48338 - DNA, 20 bp, Artificial
  CRISPR gRNA sequence
ttcccagcactttcggagtc

SEQ ID NO: 48339 - DNA, 20 bp, Artificial
  CRISPR gRNA sequence
tcccagcactttcggagtct

SEQ ID NO: 48340 - DNA, 20 bp, Artificial
  CRISPR gRNA sequence
cagcactttcggagtctagg

SEQ ID NO: 48341 - DNA, 20 bp, Artificial
  CRISPR gRNA sequence
agcactttcggagtctaggc

SEQ ID NO: 48342 - DNA, 20 bp, Artificial
  CRISPR gRNA sequence
actttcggagtctaggcagg

SEQ ID NO: 48343 - DNA, 20 bp, Artificial
  CRISPR gRNA sequence
tctaggcaggtggatcattt

SEQ ID NO: 48344 - DNA, 20 bp, Artificial
  CRISPR gRNA sequence
ctaggcaggtggatcatttg

SEQ ID NO: 48345 - DNA, 20 bp, Artificial
  CRISPR gRNA sequence
gcaggtggatcatttgaggt

SEQ ID NO: 48346 - DNA, 20 bp, Artificial
  CRISPR gRNA sequence
caggtggatcatttgaggtc

SEQ ID NO: 48347 - DNA, 20 bp, Artificial
  CRISPR gRNA sequence
aggtggatcatttgaggtca

SEQ ID NO: 48348 - DNA, 20 bp, Artificial
  CRISPR gRNA sequence
ggtggatcatttgaggtcag

SEQ ID NO: 48349 - DNA, 20 bp, Artificial
  CRISPR gRNA sequence
tcatttgaggtcaggggttc

SEQ ID NO: 48350 - DNA, 20 bp, Artificial
  CRISPR gRNA sequence
tgaggtcaggggttcgagac

SEQ ID NO: 48351 - DNA, 20 bp, Artificial
  CRISPR gRNA sequence
tcaggggttcgagaccagcc

SEQ ID NO: 48352 - DNA, 20 bp, Artificial
  CRISPR gRNA sequence
cgagaccagcccggccaaca

SEQ ID NO: 48353 - DNA, 20 bp, Artificial
  CRISPR gRNA sequence
aaaaatatacaaaaattatc

SEQ ID NO: 48354 - DNA, 20 bp, Artificial
  CRISPR gRNA sequence
aaaatatacaaaaattatct

SEQ ID NO: 48355 - DNA, 20 bp, Artificial
  CRISPR gRNA sequence
atacaaaaattatctgggcg

SEQ ID NO: 48356 - DNA, 20 bp, Artificial
  CRISPR gRNA sequence
caaaaattatctgggcgtgg

SEQ ID NO: 48357 - DNA, 20 bp, Artificial
  CRISPR gRNA sequence
gtggtgcatacctgtaatcc

SEQ ID NO: 48358 - DNA, 20 bp, Artificial
  CRISPR gRNA sequence
tacctgtaatcccagctact

SEQ ID NO: 48359 - DNA, 20 bp, Artificial
  CRISPR gRNA sequence
acctgtaatcccagctactt

SEQ ID NO: 48360 - DNA, 20 bp, Artificial
  CRISPR gRNA sequence
tgtaatcccagctacttggg

SEQ ID NO: 48361 - DNA, 20 bp, Artificial
  CRISPR gRNA sequence
tcccagctacttgggcggct

SEQ ID NO: 48362 - DNA, 20 bp, Artificial
  CRISPR gRNA sequence
cccagctacttgggcggctg

SEQ ID NO: 48363 - DNA, 20 bp, Artificial
  CRISPR gRNA sequence
tacttgggcggctgaggcac

SEQ ID NO: 48364 - DNA, 20 bp, Artificial
  CRISPR gRNA sequence
gcaccagaatcgcttgaacc

SEQ ID NO: 48365 - DNA, 20 bp, Artificial
  CRISPR gRNA sequence
caccagaatcgcttgaaccc

SEQ ID NO: 48366 - DNA, 20 bp, Artificial
  CRISPR gRNA sequence
ccagaatcgcttgaacccag

SEQ ID NO: 48367 - DNA, 20 bp, Artificial
  CRISPR gRNA sequence
cagaatcgcttgaacccagg

SEQ ID NO: 48368 - DNA, 20 bp, Artificial
  CRISPR gRNA sequence
aatcgcttgaacccaggagg

SEQ ID NO: 48369 - DNA, 20 bp, Artificial
  CRISPR gRNA sequence
tcgcttgaacccaggaggca

SEQ ID NO: 48370 - DNA, 20 bp, Artificial
  CRISPR gRNA sequence
cgcttgaacccaggaggcag

SEQ ID NO: 48371 - DNA, 20 bp, Artificial
  CRISPR gRNA sequence
aacccaggaggcagaggttg

SEQ ID NO: 48372 - DNA, 20 bp, Artificial
  CRISPR gRNA sequence
aggaggcagaggttgcagtg

SEQ ID NO: 48373 - DNA, 20 bp, Artificial
  CRISPR gRNA sequence
ggcagaggttgcagtgaagt

SEQ ID NO: 48374 - DNA, 20 bp, Artificial
  CRISPR gRNA sequence
gagatcatgccactgcactc

SEQ ID NO: 48375 - DNA, 20 bp, Artificial
  CRISPR gRNA sequence
catgccactgcactccagcc

SEQ ID NO: 48376 - DNA, 20 bp, Artificial
  CRISPR gRNA sequence
atgccactgcactccagcct

SEQ ID NO: 48377 - DNA, 20 bp, Artificial
  CRISPR gRNA sequence
ctgcactccagcctgggcga

SEQ ID NO: 48378 - DNA, 20 bp, Artificial
  CRISPR gRNA sequence
gcactccagcctgggcgaca

SEQ ID NO: 48379 - DNA, 20 bp, Artificial
  CRISPR gRNA sequence
tccagcctgggcgacagagt

SEQ ID NO: 48380 - DNA, 20 bp, Artificial
  CRISPR gRNA sequence
ctcaaaaaataaaaataaaa

SEQ ID NO: 48381 - DNA, 20 bp, Artificial
  CRISPR gRNA sequence
aataaataaatacactttaa

SEQ ID NO: 48382 - DNA, 20 bp, Artificial
  CRISPR gRNA sequence
cactttaatggatcaccttt

SEQ ID NO: 48383 - DNA, 20 bp, Artificial
  CRISPR gRNA sequence
acctttcagtaaattaattt

SEQ ID NO: 48384 - DNA, 20 bp, Artificial
  CRISPR gRNA sequence
cctttcagtaaattaatttt

SEQ ID NO: 48385 - DNA, 20 bp, Artificial
  CRISPR gRNA sequence
taaattaattttgggtgaaa

SEQ ID NO: 48386 - DNA, 20 bp, Artificial
  CRISPR gRNA sequence
tccaatatgatataacctcc

SEQ ID NO: 48387 - DNA, 20 bp, Artificial
  CRISPR gRNA sequence
ctacctactctgctctgccc

SEQ ID NO: 48388 - DNA, 20 bp, Artificial
  CRISPR gRNA sequence
tacctactctgctctgcccg

SEQ ID NO: 48389 - DNA, 20 bp, Artificial
  CRISPR gRNA sequence
ctactctgctctgcccgagg

SEQ ID NO: 48390 - DNA, 20 bp, Artificial
  CRISPR gRNA sequence
tactctgctctgcccgaggt

SEQ ID NO: 48391 - DNA, 20 bp, Artificial
  CRISPR gRNA sequence
actctgctctgcccgaggta

SEQ ID NO: 48392 - DNA, 20 bp, Artificial
  CRISPR gRNA sequence
ctctgctctgcccgaggtag

SEQ ID NO: 48393 - DNA, 20 bp, Artificial
  CRISPR gRNA sequence
tctgctctgcccgaggtagg

SEQ ID NO: 48394 - DNA, 20 bp, Artificial
  CRISPR gRNA sequence
gctctgcccgaggtaggggg

SEQ ID NO: 48395 - DNA, 20 bp, Artificial
  CRISPR gRNA sequence
ctctgcccgaggtagggggt

SEQ ID NO: 48396 - DNA, 20 bp, Artificial
  CRISPR gRNA sequence
ctgcccgaggtagggggtag

SEQ ID NO: 48397 - DNA, 20 bp, Artificial
  CRISPR gRNA sequence
tgcccgaggtagggggtagg

SEQ ID NO: 48398 - DNA, 20 bp, Artificial
  CRISPR gRNA sequence
tagggggtaggaggtgtact

SEQ ID NO: 48399 - DNA, 20 bp, Artificial
  CRISPR gRNA sequence
ggtgtacttggatataaaca

SEQ ID NO: 48400 - DNA, 20 bp, Artificial
  CRISPR gRNA sequence
caatgctttgtgtcactgct

SEQ ID NO: 48401 - DNA, 20 bp, Artificial
  CRISPR gRNA sequence
tcactgcttggatttgtttt

SEQ ID NO: 48402 - DNA, 20 bp, Artificial
  CRISPR gRNA sequence
ttggatttgtttttagtcac

SEQ ID NO: 48403 - DNA, 20 bp, Artificial
  CRISPR gRNA sequence
gttttgaaaaatcacattga

SEQ ID NO: 48404 - DNA, 20 bp, Artificial
  CRISPR gRNA sequence
tgaaaaatcacattgaaagt

SEQ ID NO: 48405 - DNA, 20 bp, Artificial
  CRISPR gRNA sequence
agtgtcatgtttatttatcc

SEQ ID NO: 48406 - DNA, 20 bp, Artificial
  CRISPR gRNA sequence
gtcatgtttatttatcctag

SEQ ID NO: 48407 - DNA, 20 bp, Artificial
  CRISPR gRNA sequence
atgtttatttatcctagcag

SEQ ID NO: 48408 - DNA, 20 bp, Artificial
  CRISPR gRNA sequence
tgtttatttatcctagcagc

SEQ ID NO: 48409 - DNA, 20 bp, Artificial
  CRISPR gRNA sequence
gtttatttatcctagcagca

SEQ ID NO: 48410 - DNA, 20 bp, Artificial
  CRISPR gRNA sequence
ttatttatcctagcagcagg

SEQ ID NO: 48411 - DNA, 20 bp, Artificial
  CRISPR gRNA sequence
cagcagggagtgaaatcaca

SEQ ID NO: 48412 - DNA, 20 bp, Artificial
  CRISPR gRNA sequence
agcagggagtgaaatcacaa

SEQ ID NO: 48413 - DNA, 20 bp, Artificial
  CRISPR gRNA sequence
gcagggagtgaaatcacaaa

SEQ ID NO: 48414 - DNA, 20 bp, Artificial
  CRISPR gRNA sequence
agggagtgaaatcacaaagg

SEQ ID NO: 48415 - DNA, 20 bp, Artificial
  CRISPR gRNA sequence
gtgaaatcacaaagggagtg

SEQ ID NO: 48416 - DNA, 20 bp, Artificial
  CRISPR gRNA sequence
tgaaatcacaaagggagtgt

SEQ ID NO: 48417 - DNA, 20 bp, Artificial
  CRISPR gRNA sequence
aatcacaaagggagtgtagg

SEQ ID NO: 48418 - DNA, 20 bp, Artificial
  CRISPR gRNA sequence
atcacaaagggagtgtagga

SEQ ID NO: 48419 - DNA, 20 bp, Artificial
  CRISPR gRNA sequence
gtaggaaggccaccccatct

SEQ ID NO: 48420 - DNA, 20 bp, Artificial
  CRISPR gRNA sequence
aaggccaccccatctgagtc

SEQ ID NO: 48421 - DNA, 20 bp, Artificial
  CRISPR gRNA sequence
gtctagacccacactactca

SEQ ID NO: 48422 - DNA, 20 bp, Artificial
  CRISPR gRNA sequence
actactcaaagtgctgaccg

SEQ ID NO: 48423 - DNA, 20 bp, Artificial
  CRISPR gRNA sequence
aaagtgctgaccgtggcccc

SEQ ID NO: 48424 - DNA, 20 bp, Artificial
  CRISPR gRNA sequence
cccccagaattgataccacc

SEQ ID NO: 48425 - DNA, 20 bp, Artificial
  CRISPR gRNA sequence
ccagaattgataccacccgg

SEQ ID NO: 48426 - DNA, 20 bp, Artificial
  CRISPR gRNA sequence
gataccacccggaagcttgt

SEQ ID NO: 48427 - DNA, 20 bp, Artificial
  CRISPR gRNA sequence
cggaagcttgttagaaaatg

SEQ ID NO: 48428 - DNA, 20 bp, Artificial
  CRISPR gRNA sequence
gaagcttgttagaaaatgca

SEQ ID NO: 48429 - DNA, 20 bp, Artificial
  CRISPR gRNA sequence
gttagaaaatgcagagtctg

SEQ ID NO: 48430 - DNA, 20 bp, Artificial
  CRISPR gRNA sequence
gaaaatgcagagtctgaagc

SEQ ID NO: 48431 - DNA, 20 bp, Artificial
  CRISPR gRNA sequence
aaaatgcagagtctgaagcc

SEQ ID NO: 48432 - DNA, 20 bp, Artificial
  CRISPR gRNA sequence
gcagagtctgaagccaggcg

SEQ ID NO: 48433 - DNA, 20 bp, Artificial
  CRISPR gRNA sequence
gagtctgaagccaggcgtgg

SEQ ID NO: 48434 - DNA, 20 bp, Artificial
  CRISPR gRNA sequence
gtggctcacgcctgtaatcc

SEQ ID NO: 48435 - DNA, 20 bp, Artificial
  CRISPR gRNA sequence
cgcctgtaatcccagcactt

SEQ ID NO: 48436 - DNA, 20 bp, Artificial
  CRISPR gRNA sequence
gcctgtaatcccagcacttt

SEQ ID NO: 48437 - DNA, 20 bp, Artificial
  CRISPR gRNA sequence
ctgtaatcccagcactttgg

SEQ ID NO: 48438 - DNA, 20 bp, Artificial
  CRISPR gRNA sequence
tgtaatcccagcactttggg

SEQ ID NO: 48439 - DNA, 20 bp, Artificial
  CRISPR gRNA sequence
tcccagcactttgggaggcc

SEQ ID NO: 48440 - DNA, 20 bp, Artificial
  CRISPR gRNA sequence
cccagcactttgggaggccg

SEQ ID NO: 48441 - DNA, 20 bp, Artificial
  CRISPR gRNA sequence
agcactttgggaggccgagg

SEQ ID NO: 48442 - DNA, 20 bp, Artificial
  CRISPR gRNA sequence
gcactttgggaggccgaggt

SEQ ID NO: 48443 - DNA, 20 bp, Artificial
  CRISPR gRNA sequence
ctttgggaggccgaggtggg

SEQ ID NO: 48444 - DNA, 20 bp, Artificial
  CRISPR gRNA sequence
ccgaggtgggcagatcacct

SEQ ID NO: 48445 - DNA, 20 bp, Artificial
  CRISPR gRNA sequence
cgaggtgggcagatcacctg

SEQ ID NO: 48446 - DNA, 20 bp, Artificial
  CRISPR gRNA sequence
gtgggcagatcacctgaggt

SEQ ID NO: 48447 - DNA, 20 bp, Artificial
  CRISPR gRNA sequence
tcacctgaggttggacgttc

SEQ ID NO: 48448 - DNA, 20 bp, Artificial
  CRISPR gRNA sequence
tgaggttggacgttcaagac

SEQ ID NO: 48449 - DNA, 20 bp, Artificial
  CRISPR gRNA sequence
caagaccagcctgaccaaca

SEQ ID NO: 48450 - DNA, 20 bp, Artificial
  CRISPR gRNA sequence
agaccagcctgaccaacatg

SEQ ID NO: 48451 - DNA, 20 bp, Artificial
  CRISPR gRNA sequence
tctaccaaaaatacaaaaat

SEQ ID NO: 48452 - DNA, 20 bp, Artificial
  CRISPR gRNA sequence
ccaaaaatacaaaaattagc

SEQ ID NO: 48453 - DNA, 20 bp, Artificial
  CRISPR gRNA sequence
caaaaatacaaaaattagcc

SEQ ID NO: 48454 - DNA, 20 bp, Artificial
  CRISPR gRNA sequence
atacaaaaattagccgggcg

SEQ ID NO: 48455 - DNA, 20 bp, Artificial
  CRISPR gRNA sequence
caaaaattagccgggcgtgg

SEQ ID NO: 48456 - DNA, 20 bp, Artificial
  CRISPR gRNA sequence
gtggcacatgcctataatcc

SEQ ID NO: 48457 - DNA, 20 bp, Artificial
  CRISPR gRNA sequence
tgcctataatcccggctact

SEQ ID NO: 48458 - DNA, 20 bp, Artificial
  CRISPR gRNA sequence
gcctataatcccggctactc

SEQ ID NO: 48459 - DNA, 20 bp, Artificial
  CRISPR gRNA sequence
ctataatcccggctactcgg

SEQ ID NO: 48460 - DNA, 20 bp, Artificial
  CRISPR gRNA sequence
tataatcccggctactcggg

SEQ ID NO: 48461 - DNA, 20 bp, Artificial
  CRISPR gRNA sequence
tcccggctactcgggaggct

SEQ ID NO: 48462 - DNA, 20 bp, Artificial
  CRISPR gRNA sequence
cccggctactcgggaggctg

SEQ ID NO: 48463 - DNA, 20 bp, Artificial
  CRISPR gRNA sequence
ggctactcgggaggctgagg

SEQ ID NO: 48464 - DNA, 20 bp, Artificial
  CRISPR gRNA sequence
gctactcgggaggctgaggc

SEQ ID NO: 48465 - DNA, 20 bp, Artificial
  CRISPR gRNA sequence
tactcgggaggctgaggcag

SEQ ID NO: 48466 - DNA, 20 bp, Artificial
  CRISPR gRNA sequence
gcaggagaatcgcttgaacc

SEQ ID NO: 48467 - DNA, 20 bp, Artificial
  CRISPR gRNA sequence
caggagaatcgcttgaaccc

SEQ ID NO: 48468 - DNA, 20 bp, Artificial
  CRISPR gRNA sequence
ggagaatcgcttgaacccgg

SEQ ID NO: 48469 - DNA, 20 bp, Artificial
  CRISPR gRNA sequence
gagaatcgcttgaacccggg

SEQ ID NO: 48470 - DNA, 20 bp, Artificial
  CRISPR gRNA sequence
aatcgcttgaacccgggagg

SEQ ID NO: 48471 - DNA, 20 bp, Artificial
  CRISPR gRNA sequence
tcgcttgaacccgggaggcg

SEQ ID NO: 48472 - DNA, 20 bp, Artificial
  CRISPR gRNA sequence
cgcttgaacccgggaggcgg

SEQ ID NO: 48473 - DNA, 20 bp, Artificial
  CRISPR gRNA sequence
aacccgggaggcggaggttg

SEQ ID NO: 48474 - DNA, 20 bp, Artificial
  CRISPR gRNA sequence
cgggaggcggaggttgcagt

SEQ ID NO: 48475 - DNA, 20 bp, Artificial
  CRISPR gRNA sequence
ggcggaggttgcagtgagct

SEQ ID NO: 48476 - DNA, 20 bp, Artificial
  CRISPR gRNA sequence
gagattgtgccattgcactc

SEQ ID NO: 48477 - DNA, 20 bp, Artificial
  CRISPR gRNA sequence
tgtgccattgcactccagcc

SEQ ID NO: 48478 - DNA, 20 bp, Artificial
  CRISPR gRNA sequence
gtgccattgcactccagcct

SEQ ID NO: 48479 - DNA, 20 bp, Artificial
  CRISPR gRNA sequence
tgcactccagcctgggcaac

SEQ ID NO: 48480 - DNA, 20 bp, Artificial
  CRISPR gRNA sequence
cactccagcctgggcaacaa

SEQ ID NO: 48481 - DNA, 20 bp, Artificial
  CRISPR gRNA sequence
caaaaacaaacaaacaaaaa

SEQ ID NO: 48482 - DNA, 20 bp, Artificial
  CRISPR gRNA sequence
caaacaaaaaaagaaatgct

SEQ ID NO: 48483 - DNA, 20 bp, Artificial
  CRISPR gRNA sequence
aaaaaaagaaatgctaagtt

SEQ ID NO: 48484 - DNA, 20 bp, Artificial
  CRISPR gRNA sequence
aaaaaagaaatgctaagttt

SEQ ID NO: 48485 - DNA, 20 bp, Artificial
  CRISPR gRNA sequence
taagtttgggtgcaacgcct

SEQ ID NO: 48486 - DNA, 20 bp, Artificial
  CRISPR gRNA sequence
aagtttgggtgcaacgcctt

SEQ ID NO: 48487 - DNA, 20 bp, Artificial
  CRISPR gRNA sequence
ggtgcaacgccttaggcctg

SEQ ID NO: 48488 - DNA, 20 bp, Artificial
  CRISPR gRNA sequence
acgccttaggcctgtagtcc

SEQ ID NO: 48489 - DNA, 20 bp, Artificial
  CRISPR gRNA sequence
ggcctgtagtcccagctgct

SEQ ID NO: 48490 - DNA, 20 bp, Artificial
  CRISPR gRNA sequence
gcctgtagtcccagctgctt

SEQ ID NO: 48491 - DNA, 20 bp, Artificial
  CRISPR gRNA sequence
ctgtagtcccagctgcttag

SEQ ID NO: 48492 - DNA, 20 bp, Artificial
  CRISPR gRNA sequence
tgtagtcccagctgcttagg

SEQ ID NO: 48493 - DNA, 20 bp, Artificial
  CRISPR gRNA sequence
gtagtcccagctgcttagga

SEQ ID NO: 48494 - DNA, 20 bp, Artificial
  CRISPR gRNA sequence
tcccagctgcttaggagggt

SEQ ID NO: 48495 - DNA, 20 bp, Artificial
  CRISPR gRNA sequence
cccagctgcttaggagggtg

SEQ ID NO: 48496 - DNA, 20 bp, Artificial
  CRISPR gRNA sequence
agctgcttaggagggtgagg

SEQ ID NO: 48497 - DNA, 20 bp, Artificial
  CRISPR gRNA sequence
gctgcttaggagggtgaggc

SEQ ID NO: 48498 - DNA, 20 bp, Artificial
  CRISPR gRNA sequence
tgcttaggagggtgaggcag

SEQ ID NO: 48499 - DNA, 20 bp, Artificial
  CRISPR gRNA sequence
gcttaggagggtgaggcagg

SEQ ID NO: 48500 - DNA, 20 bp, Artificial
  CRISPR gRNA sequence
gcaggaggatcacgttcgcc

SEQ ID NO: 48501 - DNA, 20 bp, Artificial
  CRISPR gRNA sequence
caggaggatcacgttcgccc

SEQ ID NO: 48502 - DNA, 20 bp, Artificial
  CRISPR gRNA sequence
ggaggatcacgttcgcccag

SEQ ID NO: 48503 - DNA, 20 bp, Artificial
  CRISPR gRNA sequence
tcacgttcgcccaggagttt

SEQ ID NO: 48504 - DNA, 20 bp, Artificial
  CRISPR gRNA sequence
cacgttcgcccaggagtttg

SEQ ID NO: 48505 - DNA, 20 bp, Artificial
  CRISPR gRNA sequence
cgcccaggagtttgaggctg

SEQ ID NO: 48506 - DNA, 20 bp, Artificial
  CRISPR gRNA sequence
tgtgcattgccactgcactc

SEQ ID NO: 48507 - DNA, 20 bp, Artificial
  CRISPR gRNA sequence
attgccactgcactccagcc

SEQ ID NO: 48508 - DNA, 20 bp, Artificial
  CRISPR gRNA sequence
ttgccactgcactccagcct

SEQ ID NO: 48509 - DNA, 20 bp, Artificial
  CRISPR gRNA sequence
gcactccagcctgggccaca

SEQ ID NO: 48510 - DNA, 20 bp, Artificial
  CRISPR gRNA sequence
tccagcctgggccacacagt

SEQ ID NO: 48511 - DNA, 20 bp, Artificial
  CRISPR gRNA sequence
ccagcctgggccacacagtg

SEQ ID NO: 48512 - DNA, 20 bp, Artificial
  CRISPR gRNA sequence
aaaaaaaaaaaaaaaaaaaa

SEQ ID NO: 48513 - DNA, 20 bp, Artificial
  CRISPR gRNA sequence
aaaaaaaaaaaaaaaaagca

SEQ ID NO: 48514 - DNA, 20 bp, Artificial
  CRISPR gRNA sequence
aaaaaaaaaaaagcacagtc

SEQ ID NO: 48515 - DNA, 20 bp, Artificial
  CRISPR gRNA sequence
aaaaaaaaaaagcacagtct

SEQ ID NO: 48516 - DNA, 20 bp, Artificial
  CRISPR gRNA sequence
aaaaaaaagcacagtctagg

SEQ ID NO: 48517 - DNA, 20 bp, Artificial
  CRISPR gRNA sequence
gcacagtctaggcagaattc

SEQ ID NO: 48518 - DNA, 20 bp, Artificial
  CRISPR gRNA sequence
tctaggcagaattccagacc

SEQ ID NO: 48519 - DNA, 20 bp, Artificial
  CRISPR gRNA sequence
ctaggcagaattccagacct

SEQ ID NO: 48520 - DNA, 20 bp, Artificial
  CRISPR gRNA sequence
taggcagaattccagacctg

SEQ ID NO: 48521 - DNA, 20 bp, Artificial
  CRISPR gRNA sequence
gaattccagacctggggaat

SEQ ID NO: 48522 - DNA, 20 bp, Artificial
  CRISPR gRNA sequence
cagacctggggaatcagaat

SEQ ID NO: 48523 - DNA, 20 bp, Artificial
  CRISPR gRNA sequence
atcagaatgagcattttaac

SEQ ID NO: 48524 - DNA, 20 bp, Artificial
  CRISPR gRNA sequence
cagaatgagcattttaacaa

SEQ ID NO: 48525 - DNA, 20 bp, Artificial
  CRISPR gRNA sequence
tgagcattttaacaagagcc

SEQ ID NO: 48526 - DNA, 20 bp, Artificial
  CRISPR gRNA sequence
gagcattttaacaagagccc

SEQ ID NO: 48527 - DNA, 20 bp, Artificial
  CRISPR gRNA sequence
agcattttaacaagagccca

SEQ ID NO: 48528 - DNA, 20 bp, Artificial
  CRISPR gRNA sequence
gtgaactgtgtgtgtgcctc

SEQ ID NO: 48529 - DNA, 20 bp, Artificial
  CRISPR gRNA sequence
tgaactgtgtgtgtgcctca

SEQ ID NO: 48530 - DNA, 20 bp, Artificial
  CRISPR gRNA sequence
gaactgtgtgtgtgcctcaa

SEQ ID NO: 48531 - DNA, 20 bp, Artificial
  CRISPR gRNA sequence
tcaagggttgttctacgacg

SEQ ID NO: 48532 - DNA, 20 bp, Artificial
  CRISPR gRNA sequence
caagggttgttctacgacgt

SEQ ID NO: 48533 - DNA, 20 bp, Artificial
  CRISPR gRNA sequence
ttgttctacgacgtgggcct

SEQ ID NO: 48534 - DNA, 20 bp, Artificial
  CRISPR gRNA sequence
cgacgtgggcctaagccctt

SEQ ID NO: 48535 - DNA, 20 bp, Artificial
  CRISPR gRNA sequence
gacgtgggcctaagcccttt

SEQ ID NO: 48536 - DNA, 20 bp, Artificial
  CRISPR gRNA sequence
ctttaggccacttttgtaac

SEQ ID NO: 48537 - DNA, 20 bp, Artificial
  CRISPR gRNA sequence
tttaggccacttttgtaacc

SEQ ID NO: 48538 - DNA, 20 bp, Artificial
  CRISPR gRNA sequence
taggccacttttgtaaccag

SEQ ID NO: 48539 - DNA, 20 bp, Artificial
  CRISPR gRNA sequence
aggccacttttgtaaccagg

SEQ ID NO: 48540 - DNA, 20 bp, Artificial
  CRISPR gRNA sequence
ccacttttgtaaccaggagg

SEQ ID NO: 48541 - DNA, 20 bp, Artificial
  CRISPR gRNA sequence
tgtaaccaggaggaagctga

SEQ ID NO: 48542 - DNA, 20 bp, Artificial
  CRISPR gRNA sequence
caggaggaagctgatggcat

SEQ ID NO: 48543 - DNA, 20 bp, Artificial
  CRISPR gRNA sequence
gaggaagctgatggcattag

SEQ ID NO: 48544 - DNA, 20 bp, Artificial
  CRISPR gRNA sequence
aggaagctgatggcattaga

SEQ ID NO: 48545 - DNA, 20 bp, Artificial
  CRISPR gRNA sequence
agctgatggcattagaaggc

SEQ ID NO: 48546 - DNA, 20 bp, Artificial
  CRISPR gRNA sequence
ctgatggcattagaaggcaa

SEQ ID NO: 48547 - DNA, 20 bp, Artificial
  CRISPR gRNA sequence
atggcattagaaggcaagag

SEQ ID NO: 48548 - DNA, 20 bp, Artificial
  CRISPR gRNA sequence
gcattagaaggcaagagcag

SEQ ID NO: 48549 - DNA, 20 bp, Artificial
  CRISPR gRNA sequence
cattagaaggcaagagcagt

SEQ ID NO: 48550 - DNA, 20 bp, Artificial
  CRISPR gRNA sequence
aagagcagtgggcacccacc

SEQ ID NO: 48551 - DNA, 20 bp, Artificial
  CRISPR gRNA sequence
agagcagtgggcacccacct

SEQ ID NO: 48552 - DNA, 20 bp, Artificial
  CRISPR gRNA sequence
agcagtgggcacccacctgg

SEQ ID NO: 48553 - DNA, 20 bp, Artificial
  CRISPR gRNA sequence
gcagtgggcacccacctggg

SEQ ID NO: 48554 - DNA, 20 bp, Artificial
  CRISPR gRNA sequence
cagtgggcacccacctggga

SEQ ID NO: 48555 - DNA, 20 bp, Artificial
  CRISPR gRNA sequence
ggcacccacctgggagggca

SEQ ID NO: 48556 - DNA, 20 bp, Artificial
  CRISPR gRNA sequence
gcacccacctgggagggcac

SEQ ID NO: 48557 - DNA, 20 bp, Artificial
  CRISPR gRNA sequence
cacccacctgggagggcaca

SEQ ID NO: 48558 - DNA, 20 bp, Artificial
  CRISPR gRNA sequence
cacctgggagggcacaggga

SEQ ID NO: 48559 - DNA, 20 bp, Artificial
  CRISPR gRNA sequence
acctgggagggcacagggat

SEQ ID NO: 48560 - DNA, 20 bp, Artificial
  CRISPR gRNA sequence
ggagggcacagggatgggcc

SEQ ID NO: 48561 - DNA, 20 bp, Artificial
  CRISPR gRNA sequence
gagggcacagggatgggcct

SEQ ID NO: 48562 - DNA, 20 bp, Artificial
  CRISPR gRNA sequence
gggcacagggatgggcctgg

SEQ ID NO: 48563 - DNA, 20 bp, Artificial
  CRISPR gRNA sequence
ggcacagggatgggcctggg

SEQ ID NO: 48564 - DNA, 20 bp, Artificial
  CRISPR gRNA sequence
gcacagggatgggcctggga

SEQ ID NO: 48565 - DNA, 20 bp, Artificial
  CRISPR gRNA sequence
gggcctgggagggatccgca

SEQ ID NO: 48566 - DNA, 20 bp, Artificial
  CRISPR gRNA sequence
ggcctgggagggatccgcaa

SEQ ID NO: 48567 - DNA, 20 bp, Artificial
  CRISPR gRNA sequence
gggatccgcaaaggatcccc

SEQ ID NO: 48568 - DNA, 20 bp, Artificial
  CRISPR gRNA sequence
ggatccgcaaaggatcccct

SEQ ID NO: 48569 - DNA, 20 bp, Artificial
  CRISPR gRNA sequence
atccgcaaaggatcccctgg

SEQ ID NO: 48570 - DNA, 20 bp, Artificial
  CRISPR gRNA sequence
tccgcaaaggatcccctggg

SEQ ID NO: 48571 - DNA, 20 bp, Artificial
  CRISPR gRNA sequence
gcaaaggatcccctgggagg

SEQ ID NO: 48572 - DNA, 20 bp, Artificial
  CRISPR gRNA sequence
gatcccctgggaggtggcct

SEQ ID NO: 48573 - DNA, 20 bp, Artificial
  CRISPR gRNA sequence
aggtggcctcagtgcttccc

SEQ ID NO: 48574 - DNA, 20 bp, Artificial
  CRISPR gRNA sequence
cctcagtgcttccctggatg

SEQ ID NO: 48575 - DNA, 20 bp, Artificial
  CRISPR gRNA sequence
ccctggatgtggtcccaact

SEQ ID NO: 48576 - DNA, 20 bp, Artificial
  CRISPR gRNA sequence
tggatgtggtcccaactgag

SEQ ID NO: 48577 - DNA, 20 bp, Artificial
  CRISPR gRNA sequence
ggatgtggtcccaactgagt

SEQ ID NO: 48578 - DNA, 20 bp, Artificial
  CRISPR gRNA sequence
tgtggtcccaactgagtggg

SEQ ID NO: 48579 - DNA, 20 bp, Artificial
  CRISPR gRNA sequence
tttcttcccactcattccca

SEQ ID NO: 48580 - DNA, 20 bp, Artificial
  CRISPR gRNA sequence
ttcttcccactcattcccat

SEQ ID NO: 48581 - DNA, 20 bp, Artificial
  CRISPR gRNA sequence
tcttcccactcattcccatg

SEQ ID NO: 48582 - DNA, 20 bp, Artificial
  CRISPR gRNA sequence
ctcattcccatggggccgct

SEQ ID NO: 48583 - DNA, 20 bp, Artificial
  CRISPR gRNA sequence
ggccgctcggtcactcacct

SEQ ID NO: 48584 - DNA, 20 bp, Artificial
  CRISPR gRNA sequence
gccgctcggtcactcacctg

SEQ ID NO: 48585 - DNA, 20 bp, Artificial
  CRISPR gRNA sequence
gtcactcacctgaggctctg

SEQ ID NO: 48586 - DNA, 20 bp, Artificial
  CRISPR gRNA sequence
tcactcacctgaggctctgc

SEQ ID NO: 48587 - DNA, 20 bp, Artificial
  CRISPR gRNA sequence
ctcacctgaggctctgcagg

SEQ ID NO: 48588 - DNA, 20 bp, Artificial
  CRISPR gRNA sequence
tcacctgaggctctgcaggc

SEQ ID NO: 48589 - DNA, 20 bp, Artificial
  CRISPR gRNA sequence
ggctctgcaggcaggtcatc

SEQ ID NO: 48590 - DNA, 20 bp, Artificial
  CRISPR gRNA sequence
tgcaggcaggtcatctggct

SEQ ID NO: 48591 - DNA, 20 bp, Artificial
  CRISPR gRNA sequence
ggtcatctggcttagtctgt

SEQ ID NO: 48592 - DNA, 20 bp, Artificial
  CRISPR gRNA sequence
atctggcttagtctgtgagt

SEQ ID NO: 48593 - DNA, 20 bp, Artificial
  CRISPR gRNA sequence
ggcttagtctgtgagtaagc

SEQ ID NO: 48594 - DNA, 20 bp, Artificial
  CRISPR gRNA sequence
gcttagtctgtgagtaagca

SEQ ID NO: 48595 - DNA, 20 bp, Artificial
  CRISPR gRNA sequence
gtctgtgagtaagcaaggcc

SEQ ID NO: 48596 - DNA, 20 bp, Artificial
  CRISPR gRNA sequence
tctgtgagtaagcaaggcca

SEQ ID NO: 48597 - DNA, 20 bp, Artificial
  CRISPR gRNA sequence
gtgagtaagcaaggccaagg

SEQ ID NO: 48598 - DNA, 20 bp, Artificial
  CRISPR gRNA sequence
gagtaagcaaggccaaggtg

SEQ ID NO: 48599 - DNA, 20 bp, Artificial
  CRISPR gRNA sequence
aaggccaaggtggagctgtt

SEQ ID NO: 48600 - DNA, 20 bp, Artificial
  CRISPR gRNA sequence
gccaaggtggagctgttcag

SEQ ID NO: 48601 - DNA, 20 bp, Artificial
  CRISPR gRNA sequence
aaggtggagctgttcagcag

SEQ ID NO: 48602 - DNA, 20 bp, Artificial
  CRISPR gRNA sequence
aggtggagctgttcagcaga

SEQ ID NO: 48603 - DNA, 20 bp, Artificial
  CRISPR gRNA sequence
ctgttcagcagaaggtgact

SEQ ID NO: 48604 - DNA, 20 bp, Artificial
  CRISPR gRNA sequence
tgttcagcagaaggtgactg

SEQ ID NO: 48605 - DNA, 20 bp, Artificial
  CRISPR gRNA sequence
cagcagaaggtgactgaggc

SEQ ID NO: 48606 - DNA, 20 bp, Artificial
  CRISPR gRNA sequence
gcagaaggtgactgaggctg

SEQ ID NO: 48607 - DNA, 20 bp, Artificial
  CRISPR gRNA sequence
gaaggtgactgaggctggag

SEQ ID NO: 48608 - DNA, 20 bp, Artificial
  CRISPR gRNA sequence
aggtgactgaggctggagaa

SEQ ID NO: 48609 - DNA, 20 bp, Artificial
  CRISPR gRNA sequence
ggtgactgaggctggagaag

SEQ ID NO: 48610 - DNA, 20 bp, Artificial
  CRISPR gRNA sequence
tgactgaggctggagaagag

SEQ ID NO: 48611 - DNA, 20 bp, Artificial
  CRISPR gRNA sequence
gactgaggctggagaagagg

SEQ ID NO: 48612 - DNA, 20 bp, Artificial
  CRISPR gRNA sequence
gaggctggagaagaggaggc

SEQ ID NO: 48613 - DNA, 20 bp, Artificial
  CRISPR gRNA sequence
aggctggagaagaggaggcc

SEQ ID NO: 48614 - DNA, 20 bp, Artificial
  CRISPR gRNA sequence
ggccaggtgaacttgacatc

SEQ ID NO: 48615 - DNA, 20 bp, Artificial
  CRISPR gRNA sequence
gccaggtgaacttgacatct

SEQ ID NO: 48616 - DNA, 20 bp, Artificial
  CRISPR gRNA sequence
ccaggtgaacttgacatctg

SEQ ID NO: 48617 - DNA, 20 bp, Artificial
  CRISPR gRNA sequence
caggtgaacttgacatctgg

SEQ ID NO: 48618 - DNA, 20 bp, Artificial
  CRISPR gRNA sequence
gtgaacttgacatctggggg

SEQ ID NO: 48619 - DNA, 20 bp, Artificial
  CRISPR gRNA sequence
tgaacttgacatctgggggt

SEQ ID NO: 48620 - DNA, 20 bp, Artificial
  CRISPR gRNA sequence
gaacttgacatctgggggtg

SEQ ID NO: 48621 - DNA, 20 bp, Artificial
  CRISPR gRNA sequence
tctgggggtggggcactgtc

SEQ ID NO: 48622 - DNA, 20 bp, Artificial
  CRISPR gRNA sequence
gggtggggcactgtccagtc

SEQ ID NO: 48623 - DNA, 20 bp, Artificial
  CRISPR gRNA sequence
ggtggggcactgtccagtct

SEQ ID NO: 48624 - DNA, 20 bp, Artificial
  CRISPR gRNA sequence
gtggggcactgtccagtctg

SEQ ID NO: 48625 - DNA, 20 bp, Artificial
  CRISPR gRNA sequence
tggggcactgtccagtctgg

SEQ ID NO: 48626 - DNA, 20 bp, Artificial
  CRISPR gRNA sequence
actgtccagtctgggggtct

SEQ ID NO: 48627 - DNA, 20 bp, Artificial
  CRISPR gRNA sequence
ctgtccagtctgggggtctg

SEQ ID NO: 48628 - DNA, 20 bp, Artificial
  CRISPR gRNA sequence
gggtctgaggcctctgtgct

SEQ ID NO: 48629 - DNA, 20 bp, Artificial
  CRISPR gRNA sequence
ctgaggcctctgtgcttagc

SEQ ID NO: 48630 - DNA, 20 bp, Artificial
  CRISPR gRNA sequence
gcctctgtgcttagcaagcc

SEQ ID NO: 48631 - DNA, 20 bp, Artificial
  CRISPR gRNA sequence
cctctgtgcttagcaagcct

SEQ ID NO: 48632 - DNA, 20 bp, Artificial
  CRISPR gRNA sequence
ctctgtgcttagcaagccta

SEQ ID NO: 48633 - DNA, 20 bp, Artificial
  CRISPR gRNA sequence
tagcaagcctagggacctcc

SEQ ID NO: 48634 - DNA, 20 bp, Artificial
  CRISPR gRNA sequence
aagcctagggacctccaaga

SEQ ID NO: 48635 - DNA, 20 bp, Artificial
  CRISPR gRNA sequence
gacagccacttatatccaca

SEQ ID NO: 48636 - DNA, 20 bp, Artificial
  CRISPR gRNA sequence
ttctacaaaatgaactgtac

SEQ ID NO: 48637 - DNA, 20 bp, Artificial
  CRISPR gRNA sequence
tctacaaaatgaactgtact

SEQ ID NO: 48638 - DNA, 20 bp, Artificial
  CRISPR gRNA sequence
tacaaaatgaactgtactgg

SEQ ID NO: 48639 - DNA, 20 bp, Artificial
  CRISPR gRNA sequence
acaaaatgaactgtactggg

SEQ ID NO: 48640 - DNA, 20 bp, Artificial
  CRISPR gRNA sequence
gtttctctgcatgaattact

SEQ ID NO: 48641 - DNA, 20 bp, Artificial
  CRISPR gRNA sequence
tttctctgcatgaattactg

SEQ ID NO: 48642 - DNA, 20 bp, Artificial
  CRISPR gRNA sequence
tctgcatgaattactgaggt

SEQ ID NO: 48643 - DNA, 20 bp, Artificial
  CRISPR gRNA sequence
ctgcatgaattactgaggtc

SEQ ID NO: 48644 - DNA, 20 bp, Artificial
  CRISPR gRNA sequence
catgaattactgaggtcagg

SEQ ID NO: 48645 - DNA, 20 bp, Artificial
  CRISPR gRNA sequence
atgaattactgaggtcaggc

SEQ ID NO: 48646 - DNA, 20 bp, Artificial
  CRISPR gRNA sequence
aattactgaggtcaggcagg

SEQ ID NO: 48647 - DNA, 20 bp, Artificial
  CRISPR gRNA sequence
tactgaggtcaggcaggcag

SEQ ID NO: 48648 - DNA, 20 bp, Artificial
  CRISPR gRNA sequence
gttctatgttctgaaccaca

SEQ ID NO: 48649 - DNA, 20 bp, Artificial
  CRISPR gRNA sequence
tgttctgaaccacatggacc

SEQ ID NO: 48650 - DNA, 20 bp, Artificial
  CRISPR gRNA sequence
agactaatgatccgtaataa

SEQ ID NO: 48651 - DNA, 20 bp, Artificial
  CRISPR gRNA sequence
ctaatgatccgtaataatgg

SEQ ID NO: 48652 - DNA, 20 bp, Artificial
  CRISPR gRNA sequence
cacacattgatcataaaatg

SEQ ID NO: 48653 - DNA, 20 bp, Artificial
  CRISPR gRNA sequence
acacattgatcataaaatgt

SEQ ID NO: 48654 - DNA, 20 bp, Artificial
  CRISPR gRNA sequence
cataaaatgtgggccaaact

SEQ ID NO: 48655 - DNA, 20 bp, Artificial
  CRISPR gRNA sequence
ataaaatgtgggccaaactc

SEQ ID NO: 48656 - DNA, 20 bp, Artificial
  CRISPR gRNA sequence
taaaatgtgggccaaactca

SEQ ID NO: 48657 - DNA, 20 bp, Artificial
  CRISPR gRNA sequence
tgtgggccaaactcagggct

SEQ ID NO: 48658 - DNA, 20 bp, Artificial
  CRISPR gRNA sequence
gtgggccaaactcagggctt

SEQ ID NO: 48659 - DNA, 20 bp, Artificial
  CRISPR gRNA sequence
tgggccaaactcagggcttg

SEQ ID NO: 48660 - DNA, 20 bp, Artificial
  CRISPR gRNA sequence
actcagggcttggggccatc

SEQ ID NO: 48661 - DNA, 20 bp, Artificial
  CRISPR gRNA sequence
agggcttggggccatctgga

SEQ ID NO: 48662 - DNA, 20 bp, Artificial
  CRISPR gRNA sequence
gggcttggggccatctggaa

SEQ ID NO: 48663 - DNA, 20 bp, Artificial
  CRISPR gRNA sequence
cttggggccatctggaaagg

SEQ ID NO: 48664 - DNA, 20 bp, Artificial
  CRISPR gRNA sequence
ttggggccatctggaaaggt

SEQ ID NO: 48665 - DNA, 20 bp, Artificial
  CRISPR gRNA sequence
ttattatcgtccccatttta

SEQ ID NO: 48666 - DNA, 20 bp, Artificial
  CRISPR gRNA sequence
tattatcgtccccattttac

SEQ ID NO: 48667 - DNA, 20 bp, Artificial
  CRISPR gRNA sequence
atcgtccccattttacaggt

SEQ ID NO: 48668 - DNA, 20 bp, Artificial
  CRISPR gRNA sequence
tcgtccccattttacaggtg

SEQ ID NO: 48669 - DNA, 20 bp, Artificial
  CRISPR gRNA sequence
ttttacaggtgaggaacacc

SEQ ID NO: 48670 - DNA, 20 bp, Artificial
  CRISPR gRNA sequence
tttacaggtgaggaacacca

SEQ ID NO: 48671 - DNA, 20 bp, Artificial
  CRISPR gRNA sequence
aggtgaggaacaccaaggtt

SEQ ID NO: 48672 - DNA, 20 bp, Artificial
  CRISPR gRNA sequence
gtgaggaacaccaaggttca

SEQ ID NO: 48673 - DNA, 20 bp, Artificial
  CRISPR gRNA sequence
gaggaacaccaaggttcaga

SEQ ID NO: 48674 - DNA, 20 bp, Artificial
  CRISPR gRNA sequence
aacaccaaggttcagagagt

SEQ ID NO: 48675 - DNA, 20 bp, Artificial
  CRISPR gRNA sequence
caccaaggttcagagagtta

SEQ ID NO: 48676 - DNA, 20 bp, Artificial
  CRISPR gRNA sequence
gagagttagagaacttgctt

SEQ ID NO: 48677 - DNA, 20 bp, Artificial
  CRISPR gRNA sequence
agagttagagaacttgctta

SEQ ID NO: 48678 - DNA, 20 bp, Artificial
  CRISPR gRNA sequence
cttgcttaaggtcatacaca

SEQ ID NO: 48679 - DNA, 20 bp, Artificial
  CRISPR gRNA sequence
gcttaaggtcatacacaaag

SEQ ID NO: 48680 - DNA, 20 bp, Artificial
  CRISPR gRNA sequence
catacacaaagtggctgctt

SEQ ID NO: 48681 - DNA, 20 bp, Artificial
  CRISPR gRNA sequence
atacacaaagtggctgcttc

SEQ ID NO: 48682 - DNA, 20 bp, Artificial
  CRISPR gRNA sequence
caaagtggctgcttcaggaa

SEQ ID NO: 48683 - DNA, 20 bp, Artificial
  CRISPR gRNA sequence
aggaacagaaccaaaaacta

SEQ ID NO: 48684 - DNA, 20 bp, Artificial
  CRISPR gRNA sequence
actatagaactcccattcct

SEQ ID NO: 48685 - DNA, 20 bp, Artificial
  CRISPR gRNA sequence
agccccaaccatatgtgacc

SEQ ID NO: 48686 - DNA, 20 bp, Artificial
  CRISPR gRNA sequence
gccccaaccatatgtgaccc

SEQ ID NO: 48687 - DNA, 20 bp, Artificial
  CRISPR gRNA sequence
gacccaggcgattgtacttc

SEQ ID NO: 48688 - DNA, 20 bp, Artificial
  CRISPR gRNA sequence
cccaggcgattgtacttcta

SEQ ID NO: 48689 - DNA, 20 bp, Artificial
  CRISPR gRNA sequence
ccaggcgattgtacttctag

SEQ ID NO: 48690 - DNA, 20 bp, Artificial
  CRISPR gRNA sequence
attgtacttctagaggcccc

SEQ ID NO: 48691 - DNA, 20 bp, Artificial
  CRISPR gRNA sequence
acttctagaggcccccagcc

SEQ ID NO: 48692 - DNA, 20 bp, Artificial
  CRISPR gRNA sequence
cttctagaggcccccagcct

SEQ ID NO: 48693 - DNA, 20 bp, Artificial
  CRISPR gRNA sequence
ctagaggcccccagcctagg

SEQ ID NO: 48694 - DNA, 20 bp, Artificial
  CRISPR gRNA sequence
tagaggcccccagcctaggc

SEQ ID NO: 48695 - DNA, 20 bp, Artificial
  CRISPR gRNA sequence
gaggcccccagcctaggcag

SEQ ID NO: 48696 - DNA, 20 bp, Artificial
  CRISPR gRNA sequence
ggcccccagcctaggcagga

SEQ ID NO: 48697 - DNA, 20 bp, Artificial
  CRISPR gRNA sequence
gcccccagcctaggcaggag

SEQ ID NO: 48698 - DNA, 20 bp, Artificial
  CRISPR gRNA sequence
ccccagcctaggcaggagag

SEQ ID NO: 48699 - DNA, 20 bp, Artificial
  CRISPR gRNA sequence
gcaggagaggagaataacaa

SEQ ID NO: 48700 - DNA, 20 bp, Artificial
  CRISPR gRNA sequence
gagaggagaataacaatagc

SEQ ID NO: 48701 - DNA, 20 bp, Artificial
  CRISPR gRNA sequence
ataacaatagctagcacttg

SEQ ID NO: 48702 - DNA, 20 bp, Artificial
  CRISPR gRNA sequence
aacaatagctagcacttgta

SEQ ID NO: 48703 - DNA, 20 bp, Artificial
  CRISPR gRNA sequence
tgtagagtgtgaactctgac

SEQ ID NO: 48704 - DNA, 20 bp, Artificial
  CRISPR gRNA sequence
gtgaactctgaccagactct

SEQ ID NO: 48705 - DNA, 20 bp, Artificial
  CRISPR gRNA sequence
tttaatactcacaacaaccg

SEQ ID NO: 48706 - DNA, 20 bp, Artificial
  CRISPR gRNA sequence
aatactcacaacaaccgtag

SEQ ID NO: 48707 - DNA, 20 bp, Artificial
  CRISPR gRNA sequence
atactcacaacaaccgtagc

SEQ ID NO: 48708 - DNA, 20 bp, Artificial
  CRISPR gRNA sequence
tactcacaacaaccgtagca

SEQ ID NO: 48709 - DNA, 20 bp, Artificial
  CRISPR gRNA sequence
actcacaacaaccgtagcag

SEQ ID NO: 48710 - DNA, 20 bp, Artificial
  CRISPR gRNA sequence
tcacaacaaccgtagcaggg

SEQ ID NO: 48711 - DNA, 20 bp, Artificial
  CRISPR gRNA sequence
ggagattgctcttatcctca

SEQ ID NO: 48712 - DNA, 20 bp, Artificial
  CRISPR gRNA sequence
ttgctcttatcctcaaagtt

SEQ ID NO: 48713 - DNA, 20 bp, Artificial
  CRISPR gRNA sequence
cttatcctcaaagttaagat

SEQ ID NO: 48714 - DNA, 20 bp, Artificial
  CRISPR gRNA sequence
ttatcctcaaagttaagatg

SEQ ID NO: 48715 - DNA, 20 bp, Artificial
  CRISPR gRNA sequence
atcctcaaagttaagatgag

SEQ ID NO: 48716 - DNA, 20 bp, Artificial
  CRISPR gRNA sequence
tcctcaaagttaagatgagg

SEQ ID NO: 48717 - DNA, 20 bp, Artificial
  CRISPR gRNA sequence
aagttaagatgaggaggcca

SEQ ID NO: 48718 - DNA, 20 bp, Artificial
  CRISPR gRNA sequence
aagatgaggaggccaaagaa

SEQ ID NO: 48719 - DNA, 20 bp, Artificial
  CRISPR gRNA sequence
gatgaggaggccaaagaaca

SEQ ID NO: 48720 - DNA, 20 bp, Artificial
  CRISPR gRNA sequence
tgaggaggccaaagaacaga

SEQ ID NO: 48721 - DNA, 20 bp, Artificial
  CRISPR gRNA sequence
gaggaggccaaagaacagag

SEQ ID NO: 48722 - DNA, 20 bp, Artificial
  CRISPR gRNA sequence
ggccaaagaacagagaggct

SEQ ID NO: 48723 - DNA, 20 bp, Artificial
  CRISPR gRNA sequence
gccaaagaacagagaggctg

SEQ ID NO: 48724 - DNA, 20 bp, Artificial
  CRISPR gRNA sequence
ccaaagaacagagaggctga

SEQ ID NO: 48725 - DNA, 20 bp, Artificial
  CRISPR gRNA sequence
gaacagagaggctgagggac

SEQ ID NO: 48726 - DNA, 20 bp, Artificial
  CRISPR gRNA sequence
agaggctgagggactggcac

SEQ ID NO: 48727 - DNA, 20 bp, Artificial
  CRISPR gRNA sequence
ctggcacgagttcacacatt

SEQ ID NO: 48728 - DNA, 20 bp, Artificial
  CRISPR gRNA sequence
cgagttcacacattaagaaa

SEQ ID NO: 48729 - DNA, 20 bp, Artificial
  CRISPR gRNA sequence
cacacattaagaaacagaac

SEQ ID NO: 48730 - DNA, 20 bp, Artificial
  CRISPR gRNA sequence
cattaagaaacagaactggc

SEQ ID NO: 48731 - DNA, 20 bp, Artificial
  CRISPR gRNA sequence
attaagaaacagaactggct

SEQ ID NO: 48732 - DNA, 20 bp, Artificial
  CRISPR gRNA sequence
acagaactggctgggcgcaa

SEQ ID NO: 48733 - DNA, 20 bp, Artificial
  CRISPR gRNA sequence
atggctcatgcctgtaatcc

SEQ ID NO: 48734 - DNA, 20 bp, Artificial
  CRISPR gRNA sequence
tggctcatgcctgtaatccc

SEQ ID NO: 48735 - DNA, 20 bp, Artificial
  CRISPR gRNA sequence
ctgtaatcccaggactttgt

SEQ ID NO: 48736 - DNA, 20 bp, Artificial
  CRISPR gRNA sequence
tgtaatcccaggactttgtg

SEQ ID NO: 48737 - DNA, 20 bp, Artificial
  CRISPR gRNA sequence
tcccaggactttgtgaggcc

SEQ ID NO: 48738 - DNA, 20 bp, Artificial
  CRISPR gRNA sequence
cccaggactttgtgaggcca

SEQ ID NO: 48739 - DNA, 20 bp, Artificial
  CRISPR gRNA sequence
aggactttgtgaggccaagg

SEQ ID NO: 48740 - DNA, 20 bp, Artificial
  CRISPR gRNA sequence
ggactttgtgaggccaaggc

SEQ ID NO: 48741 - DNA, 20 bp, Artificial
  CRISPR gRNA sequence
ccaaggcgggtgaatcacct

SEQ ID NO: 48742 - DNA, 20 bp, Artificial
  CRISPR gRNA sequence
caaggcgggtgaatcacctg

SEQ ID NO: 48743 - DNA, 20 bp, Artificial
  CRISPR gRNA sequence
gcgggtgaatcacctgaggt

SEQ ID NO: 48744 - DNA, 20 bp, Artificial
  CRISPR gRNA sequence
cgggtgaatcacctgaggtc

SEQ ID NO: 48745 - DNA, 20 bp, Artificial
  CRISPR gRNA sequence
ggtgaatcacctgaggtcag

SEQ ID NO: 48746 - DNA, 20 bp, Artificial
  CRISPR gRNA sequence
tcacctgaggtcaggagttc

SEQ ID NO: 48747 - DNA, 20 bp, Artificial
  CRISPR gRNA sequence
tgaggtcaggagttcgagac

SEQ ID NO: 48748 - DNA, 20 bp, Artificial
  CRISPR gRNA sequence
tcaggagttcgagaccagcc

SEQ ID NO: 48749 - DNA, 20 bp, Artificial
  CRISPR gRNA sequence
cgagaccagcctggccaaca

SEQ ID NO: 48750 - DNA, 20 bp, Artificial
  CRISPR gRNA sequence
aaccccatctccactaaaaa

SEQ ID NO: 48751 - DNA, 20 bp, Artificial
  CRISPR gRNA sequence
tccactaaaaatagaaaaat

SEQ ID NO: 48752 - DNA, 20 bp, Artificial
  CRISPR gRNA sequence
ctaaaaatagaaaaattagc

SEQ ID NO: 48753 - DNA, 20 bp, Artificial
  CRISPR gRNA sequence
taaaaatagaaaaattagct

SEQ ID NO: 48754 - DNA, 20 bp, Artificial
  CRISPR gRNA sequence
atagaaaaattagctgggcc

SEQ ID NO: 48755 - DNA, 20 bp, Artificial
  CRISPR gRNA sequence
gaaaaattagctgggcctgg

SEQ ID NO: 48756 - DNA, 20 bp, Artificial
  CRISPR gRNA sequence
gtggcatgtgcctgtaatgc

SEQ ID NO: 48757 - DNA, 20 bp, Artificial
  CRISPR gRNA sequence
tgcctgtaatgccagctact

SEQ ID NO: 48758 - DNA, 20 bp, Artificial
  CRISPR gRNA sequence
gcctgtaatgccagctactt

SEQ ID NO: 48759 - DNA, 20 bp, Artificial
  CRISPR gRNA sequence
ctgtaatgccagctacttgg

SEQ ID NO: 48760 - DNA, 20 bp, Artificial
  CRISPR gRNA sequence
tgtaatgccagctacttggg

SEQ ID NO: 48761 - DNA, 20 bp, Artificial
  CRISPR gRNA sequence
tgccagctacttgggaggct

SEQ ID NO: 48762 - DNA, 20 bp, Artificial
  CRISPR gRNA sequence
gccagctacttgggaggctg

SEQ ID NO: 48763 - DNA, 20 bp, Artificial
  CRISPR gRNA sequence
agctacttgggaggctgagg

SEQ ID NO: 48764 - DNA, 20 bp, Artificial
  CRISPR gRNA sequence
gctacttgggaggctgaggc

SEQ ID NO: 48765 - DNA, 20 bp, Artificial
  CRISPR gRNA sequence
tacttgggaggctgaggcag

SEQ ID NO: 48766 - DNA, 20 bp, Artificial
  CRISPR gRNA sequence
acttgggaggctgaggcagg

SEQ ID NO: 48767 - DNA, 20 bp, Artificial
  CRISPR gRNA sequence
cttgggaggctgaggcagga

SEQ ID NO: 48768 - DNA, 20 bp, Artificial
  CRISPR gRNA sequence
gcaggagggttgcttgaacc

SEQ ID NO: 48769 - DNA, 20 bp, Artificial
  CRISPR gRNA sequence
caggagggttgcttgaaccc

SEQ ID NO: 48770 - DNA, 20 bp, Artificial
  CRISPR gRNA sequence
ggagggttgcttgaacccgg

SEQ ID NO: 48771 - DNA, 20 bp, Artificial
  CRISPR gRNA sequence
gagggttgcttgaacccggg

SEQ ID NO: 48772 - DNA, 20 bp, Artificial
  CRISPR gRNA sequence
ggttgcttgaacccgggagg

SEQ ID NO: 48773 - DNA, 20 bp, Artificial
  CRISPR gRNA sequence
ttgcttgaacccgggaggcg

SEQ ID NO: 48774 - DNA, 20 bp, Artificial
  CRISPR gRNA sequence
tgcttgaacccgggaggcgg

SEQ ID NO: 48775 - DNA, 20 bp, Artificial
  CRISPR gRNA sequence
aacccgggaggcggaggttg

SEQ ID NO: 48776 - DNA, 20 bp, Artificial
  CRISPR gRNA sequence
cgggaggcggaggttgcagt

SEQ ID NO: 48777 - DNA, 20 bp, Artificial
  CRISPR gRNA sequence
ggcggaggttgcagtgagcc

SEQ ID NO: 48778 - DNA, 20 bp, Artificial
  CRISPR gRNA sequence
aagactgtgccactgcactc

SEQ ID NO: 48779 - DNA, 20 bp, Artificial
  CRISPR gRNA sequence
tgtgccactgcactccagcc

SEQ ID NO: 48780 - DNA, 20 bp, Artificial
  CRISPR gRNA sequence
gtgccactgcactccagcct

SEQ ID NO: 48781 - DNA, 20 bp, Artificial
  CRISPR gRNA sequence
ctgcactccagcctgggcaa

SEQ ID NO: 48782 - DNA, 20 bp, Artificial
  CRISPR gRNA sequence
gcactccagcctgggcaacg

SEQ ID NO: 48783 - DNA, 20 bp, Artificial
  CRISPR gRNA sequence
actccagcctgggcaacgga

SEQ ID NO: 48784 - DNA, 20 bp, Artificial
  CRISPR gRNA sequence
tccagcctgggcaacggaga

SEQ ID NO: 48785 - DNA, 20 bp, Artificial
  CRISPR gRNA sequence
cctgggcaacggagagagac

SEQ ID NO: 48786 - DNA, 20 bp, Artificial
  CRISPR gRNA sequence
ctgggcaacggagagagact

SEQ ID NO: 48787 - DNA, 20 bp, Artificial
  CRISPR gRNA sequence
aaataaataaataataaaat

SEQ ID NO: 48788 - DNA, 20 bp, Artificial
  CRISPR gRNA sequence
ataaataaataataaaataa

SEQ ID NO: 48789 - DNA, 20 bp, Artificial
  CRISPR gRNA sequence
taaataaataataaaataag

SEQ ID NO: 48790 - DNA, 20 bp, Artificial
  CRISPR gRNA sequence
ataaataataaaataagagg

SEQ ID NO: 48791 - DNA, 20 bp, Artificial
  CRISPR gRNA sequence
aataataaaataagaggcag

SEQ ID NO: 48792 - DNA, 20 bp, Artificial
  CRISPR gRNA sequence
aaaataagaggcagaagcaa

SEQ ID NO: 48793 - DNA, 20 bp, Artificial
  CRISPR gRNA sequence
taagaggcagaagcaaaaga

SEQ ID NO: 48794 - DNA, 20 bp, Artificial
  CRISPR gRNA sequence
caaaagatggtcaactgtct

SEQ ID NO: 48795 - DNA, 20 bp, Artificial
  CRISPR gRNA sequence
agatggtcaactgtcttggt

SEQ ID NO: 48796 - DNA, 20 bp, Artificial
  CRISPR gRNA sequence
gtcaactgtcttggttggct

SEQ ID NO: 48797 - DNA, 20 bp, Artificial
  CRISPR gRNA sequence
ctgtcttggttggctcagaa

SEQ ID NO: 48798 - DNA, 20 bp, Artificial
  CRISPR gRNA sequence
tcttggttggctcagaacag

SEQ ID NO: 48799 - DNA, 20 bp, Artificial
  CRISPR gRNA sequence
ttggttggctcagaacagaa

SEQ ID NO: 48800 - DNA, 20 bp, Artificial
  CRISPR gRNA sequence
cagaacagaagagtttttcc

SEQ ID NO: 48801 - DNA, 20 bp, Artificial
  CRISPR gRNA sequence
agaagagtttttcctggatg

SEQ ID NO: 48802 - DNA, 20 bp, Artificial
  CRISPR gRNA sequence
gaagagtttttcctggatgt

SEQ ID NO: 48803 - DNA, 20 bp, Artificial
  CRISPR gRNA sequence
ttttcctggatgtgggactt

SEQ ID NO: 48804 - DNA, 20 bp, Artificial
  CRISPR gRNA sequence
tttcctggatgtgggacttt

SEQ ID NO: 48805 - DNA, 20 bp, Artificial
  CRISPR gRNA sequence
tgggactttgggtgccaaaa

SEQ ID NO: 48806 - DNA, 20 bp, Artificial
  CRISPR gRNA sequence
gggactttgggtgccaaaat

SEQ ID NO: 48807 - DNA, 20 bp, Artificial
  CRISPR gRNA sequence
ggactttgggtgccaaaatg

SEQ ID NO: 48808 - DNA, 20 bp, Artificial
  CRISPR gRNA sequence
tttgggtgccaaaatgggga

SEQ ID NO: 48809 - DNA, 20 bp, Artificial
  CRISPR gRNA sequence
gccaaaatggggaaagctcc

SEQ ID NO: 48810 - DNA, 20 bp, Artificial
  CRISPR gRNA sequence
ggggaaagctccaagcaaac

SEQ ID NO: 48811 - DNA, 20 bp, Artificial
  CRISPR gRNA sequence
gaaagctccaagcaaactgg

SEQ ID NO: 48812 - DNA, 20 bp, Artificial
  CRISPR gRNA sequence
tccaagcaaactggaagtgt

SEQ ID NO: 48813 - DNA, 20 bp, Artificial
  CRISPR gRNA sequence
gaagtgtcagttaccccacc

SEQ ID NO: 48814 - DNA, 20 bp, Artificial
  CRISPR gRNA sequence
agtgtcagttaccccaccca

SEQ ID NO: 48815 - DNA, 20 bp, Artificial
  CRISPR gRNA sequence
accccacccagagttgaacc

SEQ ID NO: 48816 - DNA, 20 bp, Artificial
  CRISPR gRNA sequence
ccccacccagagttgaaccc

SEQ ID NO: 48817 - DNA, 20 bp, Artificial
  CRISPR gRNA sequence
cacccagagttgaacccagg

SEQ ID NO: 48818 - DNA, 20 bp, Artificial
  CRISPR gRNA sequence
cagagttgaacccaggcagt

SEQ ID NO: 48819 - DNA, 20 bp, Artificial
  CRISPR gRNA sequence
agagttgaacccaggcagtg

SEQ ID NO: 48820 - DNA, 20 bp, Artificial
  CRISPR gRNA sequence
caggcagtgaggctcctaac

SEQ ID NO: 48821 - DNA, 20 bp, Artificial
  CRISPR gRNA sequence
aggcagtgaggctcctaact

SEQ ID NO: 48822 - DNA, 20 bp, Artificial
  CRISPR gRNA sequence
ggcagtgaggctcctaacta

SEQ ID NO: 48823 - DNA, 20 bp, Artificial
  CRISPR gRNA sequence
tgctcctacccactccatca

SEQ ID NO: 48824 - DNA, 20 bp, Artificial
  CRISPR gRNA sequence
gctcctacccactccatcac

SEQ ID NO: 48825 - DNA, 20 bp, Artificial
  CRISPR gRNA sequence
cccactccatcacaggtata

SEQ ID NO: 48826 - DNA, 20 bp, Artificial
  CRISPR gRNA sequence
ctccatcacaggtatacagc

SEQ ID NO: 48827 - DNA, 20 bp, Artificial
  CRISPR gRNA sequence
catcacaggtatacagctgg

SEQ ID NO: 48828 - DNA, 20 bp, Artificial
  CRISPR gRNA sequence
cacaggtatacagctggaag

SEQ ID NO: 48829 - DNA, 20 bp, Artificial
  CRISPR gRNA sequence
tacagctggaagaagctgac

SEQ ID NO: 48830 - DNA, 20 bp, Artificial
  CRISPR gRNA sequence
ggaagaagctgactggattt

SEQ ID NO: 48831 - DNA, 20 bp, Artificial
  CRISPR gRNA sequence
gaagaagctgactggatttg

SEQ ID NO: 48832 - DNA, 20 bp, Artificial
  CRISPR gRNA sequence
aagaagctgactggatttga

SEQ ID NO: 48833 - DNA, 20 bp, Artificial
  CRISPR gRNA sequence
gatttgagggtaactgcctg

SEQ ID NO: 48834 - DNA, 20 bp, Artificial
  CRISPR gRNA sequence
atttgagggtaactgcctgt

SEQ ID NO: 48835 - DNA, 20 bp, Artificial
  CRISPR gRNA sequence
tttgagggtaactgcctgtg

SEQ ID NO: 48836 - DNA, 20 bp, Artificial
  CRISPR gRNA sequence
tgagggtaactgcctgtggg

SEQ ID NO: 48837 - DNA, 20 bp, Artificial
  CRISPR gRNA sequence
tgcctgtggggagttacact

SEQ ID NO: 48838 - DNA, 20 bp, Artificial
  CRISPR gRNA sequence
ggagttacacttggaaatga

SEQ ID NO: 48839 - DNA, 20 bp, Artificial
  CRISPR gRNA sequence
cacttggaaatgacagatct

SEQ ID NO: 48840 - DNA, 20 bp, Artificial
  CRISPR gRNA sequence
tggaaatgacagatctgaga

SEQ ID NO: 48841 - DNA, 20 bp, Artificial
  CRISPR gRNA sequence
ggaaatgacagatctgagat

SEQ ID NO: 48842 - DNA, 20 bp, Artificial
  CRISPR gRNA sequence
aatgacagatctgagatggg

SEQ ID NO: 48843 - DNA, 20 bp, Artificial
  CRISPR gRNA sequence
tgacagatctgagatgggaa

SEQ ID NO: 48844 - DNA, 20 bp, Artificial
  CRISPR gRNA sequence
ctgagatgggaagagacctc

SEQ ID NO: 48845 - DNA, 20 bp, Artificial
  CRISPR gRNA sequence
tgagatgggaagagacctcc

SEQ ID NO: 48846 - DNA, 20 bp, Artificial
  CRISPR gRNA sequence
gacgatccatccccttcctt

SEQ ID NO: 48847 - DNA, 20 bp, Artificial
  CRISPR gRNA sequence
atccatccccttccttcgga

SEQ ID NO: 48848 - DNA, 20 bp, Artificial
  CRISPR gRNA sequence
tccatccccttccttcggac

SEQ ID NO: 48849 - DNA, 20 bp, Artificial
  CRISPR gRNA sequence
ccatccccttccttcggaca

SEQ ID NO: 48850 - DNA, 20 bp, Artificial
  CRISPR gRNA sequence
tccccttccttcggacaggg

SEQ ID NO: 48851 - DNA, 20 bp, Artificial
  CRISPR gRNA sequence
gacagggaagatattatgcc

SEQ ID NO: 48852 - DNA, 20 bp, Artificial
  CRISPR gRNA sequence
aagatattatgcccagttta

SEQ ID NO: 48853 - DNA, 20 bp, Artificial
  CRISPR gRNA sequence
tattatgcccagtttacaga

SEQ ID NO: 48854 - DNA, 20 bp, Artificial
  CRISPR gRNA sequence
attatgcccagtttacagat

SEQ ID NO: 48855 - DNA, 20 bp, Artificial
  CRISPR gRNA sequence
ttatgcccagtttacagata

SEQ ID NO: 48856 - DNA, 20 bp, Artificial
  CRISPR gRNA sequence
agtttacagatagggcaact

SEQ ID NO: 48857 - DNA, 20 bp, Artificial
  CRISPR gRNA sequence
gtttacagatagggcaacta

SEQ ID NO: 48858 - DNA, 20 bp, Artificial
  CRISPR gRNA sequence
tacagatagggcaactaagg

SEQ ID NO: 48859 - DNA, 20 bp, Artificial
  CRISPR gRNA sequence
agatagggcaactaaggcag

SEQ ID NO: 48860 - DNA, 20 bp, Artificial
  CRISPR gRNA sequence
gatagggcaactaaggcagc

SEQ ID NO: 48861 - DNA, 20 bp, Artificial
  CRISPR gRNA sequence
tagggcaactaaggcagcag

SEQ ID NO: 48862 - DNA, 20 bp, Artificial
  CRISPR gRNA sequence
agggcaactaaggcagcagg

SEQ ID NO: 48863 - DNA, 20 bp, Artificial
  CRISPR gRNA sequence
caactaaggcagcaggaggt

SEQ ID NO: 48864 - DNA, 20 bp, Artificial
  CRISPR gRNA sequence
aactaaggcagcaggaggta

SEQ ID NO: 48865 - DNA, 20 bp, Artificial
  CRISPR gRNA sequence
ctaaggcagcaggaggtaag

SEQ ID NO: 48866 - DNA, 20 bp, Artificial
  CRISPR gRNA sequence
aggcagcaggaggtaaggag

SEQ ID NO: 48867 - DNA, 20 bp, Artificial
  CRISPR gRNA sequence
aggaggtaaggagcagcaca

SEQ ID NO: 48868 - DNA, 20 bp, Artificial
  CRISPR gRNA sequence
aaggagcagcacatggtgcc

SEQ ID NO: 48869 - DNA, 20 bp, Artificial
  CRISPR gRNA sequence
aggagcagcacatggtgcct

SEQ ID NO: 48870 - DNA, 20 bp, Artificial
  CRISPR gRNA sequence
gcacatggtgcctgggaaat

SEQ ID NO: 48871 - DNA, 20 bp, Artificial
  CRISPR gRNA sequence
cacatggtgcctgggaaatc

SEQ ID NO: 48872 - DNA, 20 bp, Artificial
  CRISPR gRNA sequence
catggtgcctgggaaatcag

SEQ ID NO: 48873 - DNA, 20 bp, Artificial
  CRISPR gRNA sequence
atggtgcctgggaaatcagg

SEQ ID NO: 48874 - DNA, 20 bp, Artificial
  CRISPR gRNA sequence
gtgcctgggaaatcaggagg

SEQ ID NO: 48875 - DNA, 20 bp, Artificial
  CRISPR gRNA sequence
gggaaatcaggaggaagaaa

SEQ ID NO: 48876 - DNA, 20 bp, Artificial
  CRISPR gRNA sequence
ggaaatcaggaggaagaaaa

SEQ ID NO: 48877 - DNA, 20 bp, Artificial
  CRISPR gRNA sequence
aggaggaagaaaaaggcccc

SEQ ID NO: 48878 - DNA, 20 bp, Artificial
  CRISPR gRNA sequence
ggaggaagaaaaaggccccc

SEQ ID NO: 48879 - DNA, 20 bp, Artificial
  CRISPR gRNA sequence
gaggaagaaaaaggccccca

SEQ ID NO: 48880 - DNA, 20 bp, Artificial
  CRISPR gRNA sequence
aggaagaaaaaggcccccag

SEQ ID NO: 48881 - DNA, 20 bp, Artificial
  CRISPR gRNA sequence
gaaaaaggcccccaggggca

SEQ ID NO: 48882 - DNA, 20 bp, Artificial
  CRISPR gRNA sequence
ggatgaatctgtcctgtccc

SEQ ID NO: 48883 - DNA, 20 bp, Artificial
  CRISPR gRNA sequence
aatctgtcctgtccccggcc

SEQ ID NO: 48884 - DNA, 20 bp, Artificial
  CRISPR gRNA sequence
atctgtcctgtccccggccc

SEQ ID NO: 48885 - DNA, 20 bp, Artificial
  CRISPR gRNA sequence
ctgtccccggcccaggtgcc

SEQ ID NO: 48886 - DNA, 20 bp, Artificial
  CRISPR gRNA sequence
cccggcccaggtgcccagct

SEQ ID NO: 48887 - DNA, 20 bp, Artificial
  CRISPR gRNA sequence
tatttgtcgaatgcatgaat

SEQ ID NO: 48888 - DNA, 20 bp, Artificial
  CRISPR gRNA sequence
gagccaatgaatgacctcac

SEQ ID NO: 48889 - DNA, 20 bp, Artificial
  CRISPR gRNA sequence
agccaatgaatgacctcact

SEQ ID NO: 48890 - DNA, 20 bp, Artificial
  CRISPR gRNA sequence
gcctccaatcccctaaataa

SEQ ID NO: 48891 - DNA, 20 bp, Artificial
  CRISPR gRNA sequence
atcccctaaataaaagcttc

SEQ ID NO: 48892 - DNA, 20 bp, Artificial
  CRISPR gRNA sequence
ccctaaataaaagcttccag

SEQ ID NO: 48893 - DNA, 20 bp, Artificial
  CRISPR gRNA sequence
cctaaataaaagcttccaga

SEQ ID NO: 48894 - DNA, 20 bp, Artificial
  CRISPR gRNA sequence
ataaaagcttccagaaggct

SEQ ID NO: 48895 - DNA, 20 bp, Artificial
  CRISPR gRNA sequence
agcttccagaaggctgagcc

SEQ ID NO: 48896 - DNA, 20 bp, Artificial
  CRISPR gRNA sequence
cagaaggctgagccgagatg

SEQ ID NO: 48897 - DNA, 20 bp, Artificial
  CRISPR gRNA sequence
agaaggctgagccgagatgc

SEQ ID NO: 48898 - DNA, 20 bp, Artificial
  CRISPR gRNA sequence
tgagccgagatgcaggtaca

SEQ ID NO: 48899 - DNA, 20 bp, Artificial
  CRISPR gRNA sequence
ccgagatgcaggtacatgga

SEQ ID NO: 48900 - DNA, 20 bp, Artificial
  CRISPR gRNA sequence
agatgcaggtacatggacag

SEQ ID NO: 48901 - DNA, 20 bp, Artificial
  CRISPR gRNA sequence
gatgcaggtacatggacagt

SEQ ID NO: 48902 - DNA, 20 bp, Artificial
  CRISPR gRNA sequence
aggtacatggacagtgggca

SEQ ID NO: 48903 - DNA, 20 bp, Artificial
  CRISPR gRNA sequence
atggacagtgggcaaagaaa

SEQ ID NO: 48904 - DNA, 20 bp, Artificial
  CRISPR gRNA sequence
cagtgggcaaagaaacagac

SEQ ID NO: 48905 - DNA, 20 bp, Artificial
  CRISPR gRNA sequence
gggcaaagaaacagaccagt

SEQ ID NO: 48906 - DNA, 20 bp, Artificial
  CRISPR gRNA sequence
gaaacagaccagtgagacga

SEQ ID NO: 48907 - DNA, 20 bp, Artificial
  CRISPR gRNA sequence
aaacagaccagtgagacgac

SEQ ID NO: 48908 - DNA, 20 bp, Artificial
  CRISPR gRNA sequence
acagaccagtgagacgacag

SEQ ID NO: 48909 - DNA, 20 bp, Artificial
  CRISPR gRNA sequence
cagaccagtgagacgacagg

SEQ ID NO: 48910 - DNA, 20 bp, Artificial
  CRISPR gRNA sequence
agaccagtgagacgacagga

SEQ ID NO: 48911 - DNA, 20 bp, Artificial
  CRISPR gRNA sequence
gagacgacaggagggccctg

SEQ ID NO: 48912 - DNA, 20 bp, Artificial
  CRISPR gRNA sequence
acaggagggccctgtggtca

SEQ ID NO: 48913 - DNA, 20 bp, Artificial
  CRISPR gRNA sequence
caggagggccctgtggtcaa

SEQ ID NO: 48914 - DNA, 20 bp, Artificial
  CRISPR gRNA sequence
cttttacctgatcctctccc

SEQ ID NO: 48915 - DNA, 20 bp, Artificial
  CRISPR gRNA sequence
ttttacctgatcctctcccc

SEQ ID NO: 48916 - DNA, 20 bp, Artificial
  CRISPR gRNA sequence
cctgatcctctccccaggac

SEQ ID NO: 48917 - DNA, 20 bp, Artificial
  CRISPR gRNA sequence
tcctctccccaggacaagca

SEQ ID NO: 48918 - DNA, 20 bp, Artificial
  CRISPR gRNA sequence
ctctccccaggacaagcaaa

SEQ ID NO: 48919 - DNA, 20 bp, Artificial
  CRISPR gRNA sequence
tctccccaggacaagcaaag

SEQ ID NO: 48920 - DNA, 20 bp, Artificial
  CRISPR gRNA sequence
ctccccaggacaagcaaaga

SEQ ID NO: 48921 - DNA, 20 bp, Artificial
  CRISPR gRNA sequence
caggacaagcaaagagggac

SEQ ID NO: 48922 - DNA, 20 bp, Artificial
  CRISPR gRNA sequence
gacaagcaaagagggacaag

SEQ ID NO: 48923 - DNA, 20 bp, Artificial
  CRISPR gRNA sequence
aagcaaagagggacaagcgg

SEQ ID NO: 48924 - DNA, 20 bp, Artificial
  CRISPR gRNA sequence
agcggaagaatttcaatgtt

SEQ ID NO: 48925 - DNA, 20 bp, Artificial
  CRISPR gRNA sequence
gcggaagaatttcaatgtta

SEQ ID NO: 48926 - DNA, 20 bp, Artificial
  CRISPR gRNA sequence
cggaagaatttcaatgttaa

SEQ ID NO: 48927 - DNA, 20 bp, Artificial
  CRISPR gRNA sequence
ggaagaatttcaatgttaag

SEQ ID NO: 48928 - DNA, 20 bp, Artificial
  CRISPR gRNA sequence
tttcaatgttaaggggcaaa

SEQ ID NO: 48929 - DNA, 20 bp, Artificial
  CRISPR gRNA sequence
gttaaggggcaaaaagtcaa

SEQ ID NO: 48930 - DNA, 20 bp, Artificial
  CRISPR gRNA sequence
ttaaggggcaaaaagtcaaa

SEQ ID NO: 48931 - DNA, 20 bp, Artificial
  CRISPR gRNA sequence
aaagtcaaaaggctactttc

SEQ ID NO: 48932 - DNA, 20 bp, Artificial
  CRISPR gRNA sequence
agctgaattcaaaacatatg

SEQ ID NO: 48933 - DNA, 20 bp, Artificial
  CRISPR gRNA sequence
catatgtagaaaaaaaaatc

SEQ ID NO: 48934 - DNA, 20 bp, Artificial
  CRISPR gRNA sequence
tatgtagaaaaaaaaatctg

SEQ ID NO: 48935 - DNA, 20 bp, Artificial
  CRISPR gRNA sequence
aaaattcacaaaccgttcaa

SEQ ID NO: 48936 - DNA, 20 bp, Artificial
  CRISPR gRNA sequence
attcacaaaccgttcaacag

SEQ ID NO: 48937 - DNA, 20 bp, Artificial
  CRISPR gRNA sequence
ccgttcaacagaagttttct

SEQ ID NO: 48938 - DNA, 20 bp, Artificial
  CRISPR gRNA sequence
cgttcaacagaagttttctc

SEQ ID NO: 48939 - DNA, 20 bp, Artificial
  CRISPR gRNA sequence
gttcaacagaagttttctca

SEQ ID NO: 48940 - DNA, 20 bp, Artificial
  CRISPR gRNA sequence
ttcaacagaagttttctcag

SEQ ID NO: 48941 - DNA, 20 bp, Artificial
  CRISPR gRNA sequence
tcaacagaagttttctcagg

SEQ ID NO: 48942 - DNA, 20 bp, Artificial
  CRISPR gRNA sequence
ttctcagggggtgtcatccc

SEQ ID NO: 48943 - DNA, 20 bp, Artificial
  CRISPR gRNA sequence
tctcagggggtgtcatcccc

SEQ ID NO: 48944 - DNA, 20 bp, Artificial
  CRISPR gRNA sequence
ctcagggggtgtcatccccg

SEQ ID NO: 48945 - DNA, 20 bp, Artificial
  CRISPR gRNA sequence
tgttatttgttacatatttc

SEQ ID NO: 48946 - DNA, 20 bp, Artificial
  CRISPR gRNA sequence
atttgttacatatttctaga

SEQ ID NO: 48947 - DNA, 20 bp, Artificial
  CRISPR gRNA sequence
gttacatatttctagaaaga

SEQ ID NO: 48948 - DNA, 20 bp, Artificial
  CRISPR gRNA sequence
ctagaaagatggaacttttt

SEQ ID NO: 48949 - DNA, 20 bp, Artificial
  CRISPR gRNA sequence
gatggaacttttttggtcat

SEQ ID NO: 48950 - DNA, 20 bp, Artificial
  CRISPR gRNA sequence
acttttttggtcatcagaaa

SEQ ID NO: 48951 - DNA, 20 bp, Artificial
  CRISPR gRNA sequence
tttggtcatcagaaaaagtt

SEQ ID NO: 48952 - DNA, 20 bp, Artificial
  CRISPR gRNA sequence
tggtcatcagaaaaagttaa

SEQ ID NO: 48953 - DNA, 20 bp, Artificial
  CRISPR gRNA sequence
agaaaaagttaagagatgaa

SEQ ID NO: 48954 - DNA, 20 bp, Artificial
  CRISPR gRNA sequence
aaaagttaagagatgaaaag

SEQ ID NO: 48955 - DNA, 20 bp, Artificial
  CRISPR gRNA sequence
agttaagagatgaaaagcag

SEQ ID NO: 48956 - DNA, 20 bp, Artificial
  CRISPR gRNA sequence
attctgttaaattttctgtc

SEQ ID NO: 48957 - DNA, 20 bp, Artificial
  CRISPR gRNA sequence
ctgtccagatactgtctaaa

SEQ ID NO: 48958 - DNA, 20 bp, Artificial
  CRISPR gRNA sequence
tgtccagatactgtctaaac

SEQ ID NO: 48959 - DNA, 20 bp, Artificial
  CRISPR gRNA sequence
tgtctaaacaggaatctgtg

SEQ ID NO: 48960 - DNA, 20 bp, Artificial
  CRISPR gRNA sequence
gtctaaacaggaatctgtgc

SEQ ID NO: 48961 - DNA, 20 bp, Artificial
  CRISPR gRNA sequence
aaacaggaatctgtgcagga

SEQ ID NO: 48962 - DNA, 20 bp, Artificial
  CRISPR gRNA sequence
aacaggaatctgtgcaggac

SEQ ID NO: 48963 - DNA, 20 bp, Artificial
  CRISPR gRNA sequence
acaggaatctgtgcaggacg

SEQ ID NO: 48964 - DNA, 20 bp, Artificial
  CRISPR gRNA sequence
caggacggggacctgtcttt

SEQ ID NO: 48965 - DNA, 20 bp, Artificial
  CRISPR gRNA sequence
ggggacctgtcttttagact

SEQ ID NO: 48966 - DNA, 20 bp, Artificial
  CRISPR gRNA sequence
gggacctgtcttttagactg

SEQ ID NO: 48967 - DNA, 20 bp, Artificial
  CRISPR gRNA sequence
ttttagactgaggctgtttc

SEQ ID NO: 48968 - DNA, 20 bp, Artificial
  CRISPR gRNA sequence
aggctgtttctggcatttct

SEQ ID NO: 48969 - DNA, 20 bp, Artificial
  CRISPR gRNA sequence
aatttgatgacttcaaatta

SEQ ID NO: 48970 - DNA, 20 bp, Artificial
  CRISPR gRNA sequence
atttgatgacttcaaattat

SEQ ID NO: 48971 - DNA, 20 bp, Artificial
  CRISPR gRNA sequence
tttgatgacttcaaattatg

SEQ ID NO: 48972 - DNA, 20 bp, Artificial
  CRISPR gRNA sequence
ttgatgacttcaaattatgg

SEQ ID NO: 48973 - DNA, 20 bp, Artificial
  CRISPR gRNA sequence
gatgacttcaaattatgggg

SEQ ID NO: 48974 - DNA, 20 bp, Artificial
  CRISPR gRNA sequence
tgacttcaaattatggggga

SEQ ID NO: 48975 - DNA, 20 bp, Artificial
  CRISPR gRNA sequence
cttcaaattatgggggagag

SEQ ID NO: 48976 - DNA, 20 bp, Artificial
  CRISPR gRNA sequence
attatgggggagagtagtaa

SEQ ID NO: 48977 - DNA, 20 bp, Artificial
  CRISPR gRNA sequence
gggagagtagtaaaagctgc

SEQ ID NO: 48978 - DNA, 20 bp, Artificial
  CRISPR gRNA sequence
agtaaaagctgccagttacc

SEQ ID NO: 48979 - DNA, 20 bp, Artificial
  CRISPR gRNA sequence
gtaaaagctgccagttacca

SEQ ID NO: 48980 - DNA, 20 bp, Artificial
  CRISPR gRNA sequence
agttaccaaggaaacaactg

SEQ ID NO: 48981 - DNA, 20 bp, Artificial
  CRISPR gRNA sequence
gaaacaactgtagacaaatg

SEQ ID NO: 48982 - DNA, 20 bp, Artificial
  CRISPR gRNA sequence
acaactgtagacaaatgtag

SEQ ID NO: 48983 - DNA, 20 bp, Artificial
  CRISPR gRNA sequence
acaaatgtagtggacatctg

SEQ ID NO: 48984 - DNA, 20 bp, Artificial
  CRISPR gRNA sequence
tctgtagatttttttctgcc

SEQ ID NO: 48985 - DNA, 20 bp, Artificial
  CRISPR gRNA sequence
tgtagatttttttctgccca

SEQ ID NO: 48986 - DNA, 20 bp, Artificial
  CRISPR gRNA sequence
tcctgaaataccacccctct

SEQ ID NO: 48987 - DNA, 20 bp, Artificial
  CRISPR gRNA sequence
aaataccacccctctaagtc

SEQ ID NO: 48988 - DNA, 20 bp, Artificial
  CRISPR gRNA sequence
taccacccctctaagtccag

SEQ ID NO: 48989 - DNA, 20 bp, Artificial
  CRISPR gRNA sequence
acccctctaagtccagaaga

SEQ ID NO: 48990 - DNA, 20 bp, Artificial
  CRISPR gRNA sequence
cccctctaagtccagaagat

SEQ ID NO: 48991 - DNA, 20 bp, Artificial
  CRISPR gRNA sequence
ccctctaagtccagaagata

SEQ ID NO: 48992 - DNA, 20 bp, Artificial
  CRISPR gRNA sequence
agatagggtgtgcatgcgcc

SEQ ID NO: 48993 - DNA, 20 bp, Artificial
  CRISPR gRNA sequence
gatagggtgtgcatgcgccc

SEQ ID NO: 48994 - DNA, 20 bp, Artificial
  CRISPR gRNA sequence
ggtgtgcatgcgcccaggtc

SEQ ID NO: 48995 - DNA, 20 bp, Artificial
  CRISPR gRNA sequence
tgcatgcgcccaggtctggc

SEQ ID NO: 48996 - DNA, 20 bp, Artificial
  CRISPR gRNA sequence
tgcgcccaggtctggccagt

SEQ ID NO: 48997 - DNA, 20 bp, Artificial
  CRISPR gRNA sequence
gcgcccaggtctggccagtg

SEQ ID NO: 48998 - DNA, 20 bp, Artificial
  CRISPR gRNA sequence
gcccaggtctggccagtgag

SEQ ID NO: 48999 - DNA, 20 bp, Artificial
  CRISPR gRNA sequence
aggagaatattttgtgctca

SEQ ID NO: 49000 - DNA, 20 bp, Artificial
  CRISPR gRNA sequence
atattttgtgctcacagcca

SEQ ID NO: 49001 - DNA, 20 bp, Artificial
  CRISPR gRNA sequence
cacagccacagtgattgctt

SEQ ID NO: 49002 - DNA, 20 bp, Artificial
  CRISPR gRNA sequence
acagccacagtgattgcttt

SEQ ID NO: 49003 - DNA, 20 bp, Artificial
  CRISPR gRNA sequence
cagccacagtgattgcttta

SEQ ID NO: 49004 - DNA, 20 bp, Artificial
  CRISPR gRNA sequence
ccacagtgattgctttaggg

SEQ ID NO: 49005 - DNA, 20 bp, Artificial
  CRISPR gRNA sequence
cacagtgattgctttagggt

SEQ ID NO: 49006 - DNA, 20 bp, Artificial
  CRISPR gRNA sequence
acagtgattgctttagggtg

SEQ ID NO: 49007 - DNA, 20 bp, Artificial
  CRISPR gRNA sequence
gtgattgctttagggtgggg

SEQ ID NO: 49008 - DNA, 20 bp, Artificial
  CRISPR gRNA sequence
tgattgctttagggtggggc

SEQ ID NO: 49009 - DNA, 20 bp, Artificial
  CRISPR gRNA sequence
tagggtggggcaggtgactc

SEQ ID NO: 49010 - DNA, 20 bp, Artificial
  CRISPR gRNA sequence
gtggggcaggtgactcaagc

SEQ ID NO: 49011 - DNA, 20 bp, Artificial
  CRISPR gRNA sequence
gcaggtgactcaagctagtc

SEQ ID NO: 49012 - DNA, 20 bp, Artificial
  CRISPR gRNA sequence
gtgactcaagctagtccagt

SEQ ID NO: 49013 - DNA, 20 bp, Artificial
  CRISPR gRNA sequence
caagctagtccagtgagact

SEQ ID NO: 49014 - DNA, 20 bp, Artificial
  CRISPR gRNA sequence
tagtccagtgagactcagtc

SEQ ID NO: 49015 - DNA, 20 bp, Artificial
  CRISPR gRNA sequence
agtccagtgagactcagtct

SEQ ID NO: 49016 - DNA, 20 bp, Artificial
  CRISPR gRNA sequence
aggaccttttgttgtaacca

SEQ ID NO: 49017 - DNA, 20 bp, Artificial
  CRISPR gRNA sequence
gaccttttgttgtaaccaca

SEQ ID NO: 49018 - DNA, 20 bp, Artificial
  CRISPR gRNA sequence
ccttttgttgtaaccacaga

SEQ ID NO: 49019 - DNA, 20 bp, Artificial
  CRISPR gRNA sequence
tgttgtaaccacagagagaa

SEQ ID NO: 49020 - DNA, 20 bp, Artificial
  CRISPR gRNA sequence
aatggtactccctttccact

SEQ ID NO: 49021 - DNA, 20 bp, Artificial
  CRISPR gRNA sequence
tactccctttccactaagct

SEQ ID NO: 49022 - DNA, 20 bp, Artificial
  CRISPR gRNA sequence
ctccctttccactaagctga

SEQ ID NO: 49023 - DNA, 20 bp, Artificial
  CRISPR gRNA sequence
ctttccactaagctgagaga

SEQ ID NO: 49024 - DNA, 20 bp, Artificial
  CRISPR gRNA sequence
ccactaagctgagagaaagt

SEQ ID NO: 49025 - DNA, 20 bp, Artificial
  CRISPR gRNA sequence
gctgagagaaagtaagcctg

SEQ ID NO: 49026 - DNA, 20 bp, Artificial
  CRISPR gRNA sequence
ctgagagaaagtaagcctgc

SEQ ID NO: 49027 - DNA, 20 bp, Artificial
  CRISPR gRNA sequence
agaaagtaagcctgcaggtg

SEQ ID NO: 49028 - DNA, 20 bp, Artificial
  CRISPR gRNA sequence
gaaagtaagcctgcaggtgc

SEQ ID NO: 49029 - DNA, 20 bp, Artificial
  CRISPR gRNA sequence
aaagtaagcctgcaggtgca

SEQ ID NO: 49030 - DNA, 20 bp, Artificial
  CRISPR gRNA sequence
taagcctgcaggtgcaggga

SEQ ID NO: 49031 - DNA, 20 bp, Artificial
  CRISPR gRNA sequence
ggtgcagggatggcctgcct

SEQ ID NO: 49032 - DNA, 20 bp, Artificial
  CRISPR gRNA sequence
gcagggatggcctgcctgag

SEQ ID NO: 49033 - DNA, 20 bp, Artificial
  CRISPR gRNA sequence
cagggatggcctgcctgaga

SEQ ID NO: 49034 - DNA, 20 bp, Artificial
  CRISPR gRNA sequence
ggatggcctgcctgagaagg

SEQ ID NO: 49035 - DNA, 20 bp, Artificial
  CRISPR gRNA sequence
gcctgcctgagaaggaagcc

SEQ ID NO: 49036 - DNA, 20 bp, Artificial
  CRISPR gRNA sequence
cctgcctgagaaggaagcca

SEQ ID NO: 49037 - DNA, 20 bp, Artificial
  CRISPR gRNA sequence
gcctgagaaggaagccaagg

SEQ ID NO: 49038 - DNA, 20 bp, Artificial
  CRISPR gRNA sequence
gagaaggaagccaaggtgga

SEQ ID NO: 49039 - DNA, 20 bp, Artificial
  CRISPR gRNA sequence
gaaggaagccaaggtggaca

SEQ ID NO: 49040 - DNA, 20 bp, Artificial
  CRISPR gRNA sequence
gaagccaaggtggacagaga

SEQ ID NO: 49041 - DNA, 20 bp, Artificial
  CRISPR gRNA sequence
agccaaggtggacagagaaa

SEQ ID NO: 49042 - DNA, 20 bp, Artificial
  CRISPR gRNA sequence
aaggtggacagagaaagagt

SEQ ID NO: 49043 - DNA, 20 bp, Artificial
  CRISPR gRNA sequence
aggtggacagagaaagagta

SEQ ID NO: 49044 - DNA, 20 bp, Artificial
  CRISPR gRNA sequence
ggtggacagagaaagagtaa

SEQ ID NO: 49045 - DNA, 20 bp, Artificial
  CRISPR gRNA sequence
gacagagaaagagtaagggc

SEQ ID NO: 49046 - DNA, 20 bp, Artificial
  CRISPR gRNA sequence
cagagaaagagtaagggcca

SEQ ID NO: 49047 - DNA, 20 bp, Artificial
  CRISPR gRNA sequence
aaagagtaagggccagagtg

SEQ ID NO: 49048 - DNA, 20 bp, Artificial
  CRISPR gRNA sequence
agggccagagtgaagtgtgt

SEQ ID NO: 49049 - DNA, 20 bp, Artificial
  CRISPR gRNA sequence
ggccagagtgaagtgtgtga

SEQ ID NO: 49050 - DNA, 20 bp, Artificial
  CRISPR gRNA sequence
ccagagtgaagtgtgtgaga

SEQ ID NO: 49051 - DNA, 20 bp, Artificial
  CRISPR gRNA sequence
gagtgaagtgtgtgagagag

SEQ ID NO: 49052 - DNA, 20 bp, Artificial
  CRISPR gRNA sequence
agagagaagcctgacaaata

SEQ ID NO: 49053 - DNA, 20 bp, Artificial
  CRISPR gRNA sequence
cctgacaaatatagaacccc

SEQ ID NO: 49054 - DNA, 20 bp, Artificial
  CRISPR gRNA sequence
aaatatagaacccctggatc

SEQ ID NO: 49055 - DNA, 20 bp, Artificial
  CRISPR gRNA sequence
cctggatccagctgtgcctg

SEQ ID NO: 49056 - DNA, 20 bp, Artificial
  CRISPR gRNA sequence
ccagctgtgcctgaagtcat

SEQ ID NO: 49057 - DNA, 20 bp, Artificial
  CRISPR gRNA sequence
ctcgtaattttccatgacat

SEQ ID NO: 49058 - DNA, 20 bp, Artificial
  CRISPR gRNA sequence
aagccaatatatttctgtct

SEQ ID NO: 49059 - DNA, 20 bp, Artificial
  CRISPR gRNA sequence
tttctgtcttggattgcttt

SEQ ID NO: 49060 - DNA, 20 bp, Artificial
  CRISPR gRNA sequence
gtattctgtttcctatgacc

SEQ ID NO: 49061 - DNA, 20 bp, Artificial
  CRISPR gRNA sequence
tattctgtttcctatgacca

SEQ ID NO: 49062 - DNA, 20 bp, Artificial
  CRISPR gRNA sequence
cctatgaccaaggttcttgc

SEQ ID NO: 49063 - DNA, 20 bp, Artificial
  CRISPR gRNA sequence
ccaaggttcttgctggcact

SEQ ID NO: 49064 - DNA, 20 bp, Artificial
  CRISPR gRNA sequence
ttcttgctggcactgagatc

SEQ ID NO: 49065 - DNA, 20 bp, Artificial
  CRISPR gRNA sequence
gctggcactgagatccagaa

SEQ ID NO: 49066 - DNA, 20 bp, Artificial
  CRISPR gRNA sequence
gcactgagatccagaataga

SEQ ID NO: 49067 - DNA, 20 bp, Artificial
  CRISPR gRNA sequence
agatccagaatagaaagtaa

SEQ ID NO: 49068 - DNA, 20 bp, Artificial
  CRISPR gRNA sequence
gatccagaatagaaagtaaa

SEQ ID NO: 49069 - DNA, 20 bp, Artificial
  CRISPR gRNA sequence
tagaaagtaaaaggtcatgt

SEQ ID NO: 49070 - DNA, 20 bp, Artificial
  CRISPR gRNA sequence
agaaagtaaaaggtcatgta

SEQ ID NO: 49071 - DNA, 20 bp, Artificial
  CRISPR gRNA sequence
gaaagtaaaaggtcatgtaa

SEQ ID NO: 49072 - DNA, 20 bp, Artificial
  CRISPR gRNA sequence
aaaggtcatgtaagggcatt

SEQ ID NO: 49073 - DNA, 20 bp, Artificial
  CRISPR gRNA sequence
gtaagggcattcagctcacc

SEQ ID NO: 49074 - DNA, 20 bp, Artificial
  CRISPR gRNA sequence
taagggcattcagctcacct

SEQ ID NO: 49075 - DNA, 20 bp, Artificial
  CRISPR gRNA sequence
tcagctcacctgggtccatc

SEQ ID NO: 49076 - DNA, 20 bp, Artificial
  CRISPR gRNA sequence
cctgggtccatccagaaaca

SEQ ID NO: 49077 - DNA, 20 bp, Artificial
  CRISPR gRNA sequence
gggtccatccagaaacatgg

SEQ ID NO: 49078 - DNA, 20 bp, Artificial
  CRISPR gRNA sequence
ttgtgttcacaaaacatgca

SEQ ID NO: 49079 - DNA, 20 bp, Artificial
  CRISPR gRNA sequence
tgtgttcacaaaacatgcaa

SEQ ID NO: 49080 - DNA, 20 bp, Artificial
  CRISPR gRNA sequence
acaaaacatgcaaaggttcc

SEQ ID NO: 49081 - DNA, 20 bp, Artificial
  CRISPR gRNA sequence
caaaacatgcaaaggttcct

SEQ ID NO: 49082 - DNA, 20 bp, Artificial
  CRISPR gRNA sequence
catgctactcactgaccatg

SEQ ID NO: 49083 - DNA, 20 bp, Artificial
  CRISPR gRNA sequence
ctcactgaccatgcagcact

SEQ ID NO: 49084 - DNA, 20 bp, Artificial
  CRISPR gRNA sequence
aaccactcccaccactcact

SEQ ID NO: 49085 - DNA, 20 bp, Artificial
  CRISPR gRNA sequence
accaccatcactacttactc

SEQ ID NO: 49086 - DNA, 20 bp, Artificial
  CRISPR gRNA sequence
actacttactccagcctctt

SEQ ID NO: 49087 - DNA, 20 bp, Artificial
  CRISPR gRNA sequence
tttagcatccatttcccctc

SEQ ID NO: 49088 - DNA, 20 bp, Artificial
  CRISPR gRNA sequence
ttagcatccatttcccctca

SEQ ID NO: 49089 - DNA, 20 bp, Artificial
  CRISPR gRNA sequence
tagcatccatttcccctcaa

SEQ ID NO: 49090 - DNA, 20 bp, Artificial
  CRISPR gRNA sequence
ttcccctcaagggccctcat

SEQ ID NO: 49091 - DNA, 20 bp, Artificial
  CRISPR gRNA sequence
aagggccctcatcagcgcct

SEQ ID NO: 49092 - DNA, 20 bp, Artificial
  CRISPR gRNA sequence
ctcctcatcaaattgattgt

SEQ ID NO: 49093 - DNA, 20 bp, Artificial
  CRISPR gRNA sequence
catcaaattgattgttagac

SEQ ID NO: 49094 - DNA, 20 bp, Artificial
  CRISPR gRNA sequence
attgattgttagacaagctg

SEQ ID NO: 49095 - DNA, 20 bp, Artificial
  CRISPR gRNA sequence
gattgttagacaagctgcag

SEQ ID NO: 49096 - DNA, 20 bp, Artificial
  CRISPR gRNA sequence
ttagacaagctgcagaagac

SEQ ID NO: 49097 - DNA, 20 bp, Artificial
  CRISPR gRNA sequence
tagacaagctgcagaagacc

SEQ ID NO: 49098 - DNA, 20 bp, Artificial
  CRISPR gRNA sequence
acaagctgcagaagaccagg

SEQ ID NO: 49099 - DNA, 20 bp, Artificial
  CRISPR gRNA sequence
aagctgcagaagaccaggca

SEQ ID NO: 49100 - DNA, 20 bp, Artificial
  CRISPR gRNA sequence
agctgcagaagaccaggcag

SEQ ID NO: 49101 - DNA, 20 bp, Artificial
  CRISPR gRNA sequence
gcagaagaccaggcagaggc

SEQ ID NO: 49102 - DNA, 20 bp, Artificial
  CRISPR gRNA sequence
cagaagaccaggcagaggca

SEQ ID NO: 49103 - DNA, 20 bp, Artificial
  CRISPR gRNA sequence
agaagaccaggcagaggcaa

SEQ ID NO: 49104 - DNA, 20 bp, Artificial
  CRISPR gRNA sequence
gaccaggcagaggcaagggt

SEQ ID NO: 49105 - DNA, 20 bp, Artificial
  CRISPR gRNA sequence
ggcagaggcaagggttagcg

SEQ ID NO: 49106 - DNA, 20 bp, Artificial
  CRISPR gRNA sequence
aagggttagcgcagcctgcc

SEQ ID NO: 49107 - DNA, 20 bp, Artificial
  CRISPR gRNA sequence
tagcgcagcctgcccagccc

SEQ ID NO: 49108 - DNA, 20 bp, Artificial
  CRISPR gRNA sequence
gcgcagcctgcccagccctg

SEQ ID NO: 49109 - DNA, 20 bp, Artificial
  CRISPR gRNA sequence
gcctgcccagccctggagct

SEQ ID NO: 49110 - DNA, 20 bp, Artificial
  CRISPR gRNA sequence
ctggagctgagctgtcctgt

SEQ ID NO: 49111 - DNA, 20 bp, Artificial
  CRISPR gRNA sequence
ccctctcctgctctgtcccc

SEQ ID NO: 49112 - DNA, 20 bp, Artificial
  CRISPR gRNA sequence
cctctcctgctctgtcccct

SEQ ID NO: 49113 - DNA, 20 bp, Artificial
  CRISPR gRNA sequence
tctcctgctctgtcccctgg

SEQ ID NO: 49114 - DNA, 20 bp, Artificial
  CRISPR gRNA sequence
ctcctgctctgtcccctggg

SEQ ID NO: 49115 - DNA, 20 bp, Artificial
  CRISPR gRNA sequence
aactctgcatctgcatgccc

SEQ ID NO: 49116 - DNA, 20 bp, Artificial
  CRISPR gRNA sequence
actctgcatctgcatgccct

SEQ ID NO: 49117 - DNA, 20 bp, Artificial
  CRISPR gRNA sequence
cctgggccaccctcgctgtc

SEQ ID NO: 49118 - DNA, 20 bp, Artificial
  CRISPR gRNA sequence
ctgggccaccctcgctgtcc

SEQ ID NO: 49119 - DNA, 20 bp, Artificial
  CRISPR gRNA sequence
ctcgctgtccaggttcccca

SEQ ID NO: 49120 - DNA, 20 bp, Artificial
  CRISPR gRNA sequence
tcgctgtccaggttccccat

SEQ ID NO: 49121 - DNA, 20 bp, Artificial
  CRISPR gRNA sequence
aggttccccatgggtatccc

SEQ ID NO: 49122 - DNA, 20 bp, Artificial
  CRISPR gRNA sequence
cccatgggtatccctagctc

SEQ ID NO: 49123 - DNA, 20 bp, Artificial
  CRISPR gRNA sequence
ccatgggtatccctagctcc

SEQ ID NO: 49124 - DNA, 20 bp, Artificial
  CRISPR gRNA sequence
catgggtatccctagctcca

SEQ ID NO: 49125 - DNA, 20 bp, Artificial
  CRISPR gRNA sequence
gtatccctagctccagggct

SEQ ID NO: 49126 - DNA, 20 bp, Artificial
  CRISPR gRNA sequence
tatccctagctccagggctc

SEQ ID NO: 49127 - DNA, 20 bp, Artificial
  CRISPR gRNA sequence
tagctccagggctcaggctc

SEQ ID NO: 49128 - DNA, 20 bp, Artificial
  CRISPR gRNA sequence
agctccagggctcaggctct

SEQ ID NO: 49129 - DNA, 20 bp, Artificial
  CRISPR gRNA sequence
tccagggctcaggctctggg

SEQ ID NO: 49130 - DNA, 20 bp, Artificial
  CRISPR gRNA sequence
ccagggctcaggctctgggt

SEQ ID NO: 49131 - DNA, 20 bp, Artificial
  CRISPR gRNA sequence
caggctctgggtaggcatga

SEQ ID NO: 49132 - DNA, 20 bp, Artificial
  CRISPR gRNA sequence
ctgggtaggcatgatagtca

SEQ ID NO: 49133 - DNA, 20 bp, Artificial
  CRISPR gRNA sequence
gtaggcatgatagtcacagc

SEQ ID NO: 49134 - DNA, 20 bp, Artificial
  CRISPR gRNA sequence
catgatagtcacagctggcc

SEQ ID NO: 49135 - DNA, 20 bp, Artificial
  CRISPR gRNA sequence
tagtcacagctggcccagct

SEQ ID NO: 49136 - DNA, 20 bp, Artificial
  CRISPR gRNA sequence
ccagctgagaaactatgccc

SEQ ID NO: 49137 - DNA, 20 bp, Artificial
  CRISPR gRNA sequence
gagaaactatgccctggatg

SEQ ID NO: 49138 - DNA, 20 bp, Artificial
  CRISPR gRNA sequence
agaaactatgccctggatga

SEQ ID NO: 49139 - DNA, 20 bp, Artificial
  CRISPR gRNA sequence
tatgccctggatgaaggctg

SEQ ID NO: 49140 - DNA, 20 bp, Artificial
  CRISPR gRNA sequence
tgccctggatgaaggctgca

SEQ ID NO: 49141 - DNA, 20 bp, Artificial
  CRISPR gRNA sequence
ccctggatgaaggctgcaga

SEQ ID NO: 49142 - DNA, 20 bp, Artificial
  CRISPR gRNA sequence
cctggatgaaggctgcagag

SEQ ID NO: 49143 - DNA, 20 bp, Artificial
  CRISPR gRNA sequence
ggatgaaggctgcagagagg

SEQ ID NO: 49144 - DNA, 20 bp, Artificial
  CRISPR gRNA sequence
gaaggctgcagagaggaagc

SEQ ID NO: 49145 - DNA, 20 bp, Artificial
  CRISPR gRNA sequence
aaggctgcagagaggaagct

SEQ ID NO: 49146 - DNA, 20 bp, Artificial
  CRISPR gRNA sequence
aggctgcagagaggaagctg

SEQ ID NO: 49147 - DNA, 20 bp, Artificial
  CRISPR gRNA sequence
ggctgcagagaggaagctgg

SEQ ID NO: 49148 - DNA, 20 bp, Artificial
  CRISPR gRNA sequence
cagagaggaagctgggggac

SEQ ID NO: 49149 - DNA, 20 bp, Artificial
  CRISPR gRNA sequence
agagaggaagctgggggact

SEQ ID NO: 49150 - DNA, 20 bp, Artificial
  CRISPR gRNA sequence
gagaggaagctgggggacta

SEQ ID NO: 49151 - DNA, 20 bp, Artificial
  CRISPR gRNA sequence
acacacaccctcttgttctt

SEQ ID NO: 49152 - DNA, 20 bp, Artificial
  CRISPR gRNA sequence
ttgttcttcagccctctccg

SEQ ID NO: 49153 - DNA, 20 bp, Artificial
  CRISPR gRNA sequence
tctccgtagcctgactccca

SEQ ID NO: 49154 - DNA, 20 bp, Artificial
  CRISPR gRNA sequence
cgtagcctgactcccacagc

SEQ ID NO: 49155 - DNA, 20 bp, Artificial
  CRISPR gRNA sequence
cctgactcccacagccagcc

SEQ ID NO: 49156 - DNA, 20 bp, Artificial
  CRISPR gRNA sequence
gactcccacagccagcccag

SEQ ID NO: 49157 - DNA, 20 bp, Artificial
  CRISPR gRNA sequence
ctcccacagccagcccagca

SEQ ID NO: 49158 - DNA, 20 bp, Artificial
  CRISPR gRNA sequence
cacagccagcccagcagagc

SEQ ID NO: 49159 - DNA, 20 bp, Artificial
  CRISPR gRNA sequence
acagccagcccagcagagca

SEQ ID NO: 49160 - DNA, 20 bp, Artificial
  CRISPR gRNA sequence
cccagcagagcaaggctcat

SEQ ID NO: 49161 - DNA, 20 bp, Artificial
  CRISPR gRNA sequence
gctcatgagccccattttca

SEQ ID NO: 49162 - DNA, 20 bp, Artificial
  CRISPR gRNA sequence
tgagccccattttcatagat

SEQ ID NO: 49163 - DNA, 20 bp, Artificial
  CRISPR gRNA sequence
gagccccattttcatagata

SEQ ID NO: 49164 - DNA, 20 bp, Artificial
  CRISPR gRNA sequence
tttcatagataaggcaatca

SEQ ID NO: 49165 - DNA, 20 bp, Artificial
  CRISPR gRNA sequence
tagataaggcaatcaaagcc

SEQ ID NO: 49166 - DNA, 20 bp, Artificial
  CRISPR gRNA sequence
gataaggcaatcaaagccca

SEQ ID NO: 49167 - DNA, 20 bp, Artificial
  CRISPR gRNA sequence
aaggcaatcaaagcccagag

SEQ ID NO: 49168 - DNA, 20 bp, Artificial
  CRISPR gRNA sequence
aatcaaagcccagagtggaa

SEQ ID NO: 49169 - DNA, 20 bp, Artificial
  CRISPR gRNA sequence
gagtggaacagccatgccca

SEQ ID NO: 49170 - DNA, 20 bp, Artificial
  CRISPR gRNA sequence
catgcccacagcccctctgt

SEQ ID NO: 49171 - DNA, 20 bp, Artificial
  CRISPR gRNA sequence
cccacagcccctctgtgagt

SEQ ID NO: 49172 - DNA, 20 bp, Artificial
  CRISPR gRNA sequence
acagcccctctgtgagtcag

SEQ ID NO: 49173 - DNA, 20 bp, Artificial
  CRISPR gRNA sequence
tgtgagtcagtggcgaaatt

SEQ ID NO: 49174 - DNA, 20 bp, Artificial
  CRISPR gRNA sequence
cgaaattcagaccaaaactg

SEQ ID NO: 49175 - DNA, 20 bp, Artificial
  CRISPR gRNA sequence
ctgtggtgctcttccttccc

SEQ ID NO: 49176 - DNA, 20 bp, Artificial
  CRISPR gRNA sequence
tgtggtgctcttccttcccc

SEQ ID NO: 49177 - DNA, 20 bp, Artificial
  CRISPR gRNA sequence
ttccttccccaggccacacc

SEQ ID NO: 49178 - DNA, 20 bp, Artificial
  CRISPR gRNA sequence
ccagaactgctgcacttcat

SEQ ID NO: 49179 - DNA, 20 bp, Artificial
  CRISPR gRNA sequence
cagaactgctgcacttcatc

SEQ ID NO: 49180 - DNA, 20 bp, Artificial
  CRISPR gRNA sequence
agaactgctgcacttcatca

SEQ ID NO: 49181 - DNA, 20 bp, Artificial
  CRISPR gRNA sequence
gaactgctgcacttcatcag

SEQ ID NO: 49182 - DNA, 20 bp, Artificial
  CRISPR gRNA sequence
ctgctgcacttcatcagggg

SEQ ID NO: 49183 - DNA, 20 bp, Artificial
  CRISPR gRNA sequence
tgctgcacttcatcagggga

SEQ ID NO: 49184 - DNA, 20 bp, Artificial
  CRISPR gRNA sequence
gctgcacttcatcaggggaa

SEQ ID NO: 49185 - DNA, 20 bp, Artificial
  CRISPR gRNA sequence
ttcatcaggggaagggtcat

SEQ ID NO: 49186 - DNA, 20 bp, Artificial
  CRISPR gRNA sequence
aggggaagggtcattggttg

SEQ ID NO: 49187 - DNA, 20 bp, Artificial
  CRISPR gRNA sequence
tcttctccacccctcaccct

SEQ ID NO: 49188 - DNA, 20 bp, Artificial
  CRISPR gRNA sequence
ctccacccctcaccctcagc

SEQ ID NO: 49189 - DNA, 20 bp, Artificial
  CRISPR gRNA sequence
tccacccctcaccctcagct

SEQ ID NO: 49190 - DNA, 20 bp, Artificial
  CRISPR gRNA sequence
ctccactctgcaactcactc

SEQ ID NO: 49191 - DNA, 20 bp, Artificial
  CRISPR gRNA sequence
caactcactccagctcctcc

SEQ ID NO: 49192 - DNA, 20 bp, Artificial
  CRISPR gRNA sequence
ctcactccagctcctccaag

SEQ ID NO: 49193 - DNA, 20 bp, Artificial
  CRISPR gRNA sequence
actccagctcctccaagtgg

SEQ ID NO: 49194 - DNA, 20 bp, Artificial
  CRISPR gRNA sequence
ccagctcctccaagtggtgg

SEQ ID NO: 49195 - DNA, 20 bp, Artificial
  CRISPR gRNA sequence
gctcctccaagtggtggcag

SEQ ID NO: 49196 - DNA, 20 bp, Artificial
  CRISPR gRNA sequence
tccaagtggtggcagtggcc

SEQ ID NO: 49197 - DNA, 20 bp, Artificial
  CRISPR gRNA sequence
gtggtggcagtggcccagac

SEQ ID NO: 49198 - DNA, 20 bp, Artificial
  CRISPR gRNA sequence
cagtggcccagaccagatgc

SEQ ID NO: 49199 - DNA, 20 bp, Artificial
  CRISPR gRNA sequence
agtggcccagaccagatgcc

SEQ ID NO: 49200 - DNA, 20 bp, Artificial
  CRISPR gRNA sequence
ggcccagaccagatgccagg

SEQ ID NO: 49201 - DNA, 20 bp, Artificial
  CRISPR gRNA sequence
gcccagaccagatgccaggt

SEQ ID NO: 49202 - DNA, 20 bp, Artificial
  CRISPR gRNA sequence
agaccagatgccaggtgggc

SEQ ID NO: 49203 - DNA, 20 bp, Artificial
  CRISPR gRNA sequence
gaccagatgccaggtgggcg

SEQ ID NO: 49204 - DNA, 20 bp, Artificial
  CRISPR gRNA sequence
tgccaggtgggcgaggccct

SEQ ID NO: 49205 - DNA, 20 bp, Artificial
  CRISPR gRNA sequence
cgaggccctcggtgctcaca

SEQ ID NO: 49206 - DNA, 20 bp, Artificial
  CRISPR gRNA sequence
gccctcggtgctcacacagc

SEQ ID NO: 49207 - DNA, 20 bp, Artificial
  CRISPR gRNA sequence
cctcggtgctcacacagctg

SEQ ID NO: 49208 - DNA, 20 bp, Artificial
  CRISPR gRNA sequence
ctcggtgctcacacagctgg

SEQ ID NO: 49209 - DNA, 20 bp, Artificial
  CRISPR gRNA sequence
gtgctcacacagctggaggt

SEQ ID NO: 49210 - DNA, 20 bp, Artificial
  CRISPR gRNA sequence
cacacagctggaggtcagcc

SEQ ID NO: 49211 - DNA, 20 bp, Artificial
  CRISPR gRNA sequence
acagctggaggtcagcctgg

SEQ ID NO: 49212 - DNA, 20 bp, Artificial
  CRISPR gRNA sequence
cagctggaggtcagcctggt

SEQ ID NO: 49213 - DNA, 20 bp, Artificial
  CRISPR gRNA sequence
agctggaggtcagcctggtg

SEQ ID NO: 49214 - DNA, 20 bp, Artificial
  CRISPR gRNA sequence
gctggaggtcagcctggtgg

SEQ ID NO: 49215 - DNA, 20 bp, Artificial
  CRISPR gRNA sequence
ggtcagcctggtgggggtca

SEQ ID NO: 49216 - DNA, 20 bp, Artificial
  CRISPR gRNA sequence
gtcagcctggtgggggtcaa

SEQ ID NO: 49217 - DNA, 20 bp, Artificial
  CRISPR gRNA sequence
tcagcctggtgggggtcaaa

SEQ ID NO: 49218 - DNA, 20 bp, Artificial
  CRISPR gRNA sequence
tggtgggggtcaaagggcaa

SEQ ID NO: 49219 - DNA, 20 bp, Artificial
  CRISPR gRNA sequence
ggtgggggtcaaagggcaac

SEQ ID NO: 49220 - DNA, 20 bp, Artificial
  CRISPR gRNA sequence
ggggtcaaagggcaacaggt

SEQ ID NO: 49221 - DNA, 20 bp, Artificial
  CRISPR gRNA sequence
gggtcaaagggcaacaggtc

SEQ ID NO: 49222 - DNA, 20 bp, Artificial
  CRISPR gRNA sequence
tcaaagggcaacaggtcagg

SEQ ID NO: 49223 - DNA, 20 bp, Artificial
  CRISPR gRNA sequence
caaagggcaacaggtcaggc

SEQ ID NO: 49224 - DNA, 20 bp, Artificial
  CRISPR gRNA sequence
aagggcaacaggtcaggcag

SEQ ID NO: 49225 - DNA, 20 bp, Artificial
  CRISPR gRNA sequence
aggtcaggcaggagccgccc

SEQ ID NO: 49226 - DNA, 20 bp, Artificial
  CRISPR gRNA sequence
ggtcaggcaggagccgccct

SEQ ID NO: 49227 - DNA, 20 bp, Artificial
  CRISPR gRNA sequence
gcaggagccgccctgggtct

SEQ ID NO: 49228 - DNA, 20 bp, Artificial
  CRISPR gRNA sequence
caggagccgccctgggtctt

SEQ ID NO: 49229 - DNA, 20 bp, Artificial
  CRISPR gRNA sequence
ggagccgccctgggtcttgg

SEQ ID NO: 49230 - DNA, 20 bp, Artificial
  CRISPR gRNA sequence
gtcttgggagctctgaatgc

SEQ ID NO: 49231 - DNA, 20 bp, Artificial
  CRISPR gRNA sequence
ttgggagctctgaatgctgg

SEQ ID NO: 49232 - DNA, 20 bp, Artificial
  CRISPR gRNA sequence
ggagctctgaatgctggtgg

SEQ ID NO: 49233 - DNA, 20 bp, Artificial
  CRISPR gRNA sequence
agctctgaatgctggtggca

SEQ ID NO: 49234 - DNA, 20 bp, Artificial
  CRISPR gRNA sequence
gctctgaatgctggtggcag

SEQ ID NO: 49235 - DNA, 20 bp, Artificial
  CRISPR gRNA sequence
ctctgaatgctggtggcaga

SEQ ID NO: 49236 - DNA, 20 bp, Artificial
  CRISPR gRNA sequence
gaatgctggtggcagagggc

SEQ ID NO: 49237 - DNA, 20 bp, Artificial
  CRISPR gRNA sequence
aatgctggtggcagagggca

SEQ ID NO: 49238 - DNA, 20 bp, Artificial
  CRISPR gRNA sequence
ggtggcagagggcaaggatg

SEQ ID NO: 49239 - DNA, 20 bp, Artificial
  CRISPR gRNA sequence
gtggcagagggcaaggatgt

SEQ ID NO: 49240 - DNA, 20 bp, Artificial
  CRISPR gRNA sequence
tggcagagggcaaggatgtg

SEQ ID NO: 49241 - DNA, 20 bp, Artificial
  CRISPR gRNA sequence
cagagggcaaggatgtgggg

SEQ ID NO: 49242 - DNA, 20 bp, Artificial
  CRISPR gRNA sequence
agagggcaaggatgtggggt

SEQ ID NO: 49243 - DNA, 20 bp, Artificial
  CRISPR gRNA sequence
gagggcaaggatgtggggta

SEQ ID NO: 49244 - DNA, 20 bp, Artificial
  CRISPR gRNA sequence
aaggatgtggggtagggatg

SEQ ID NO: 49245 - DNA, 20 bp, Artificial
  CRISPR gRNA sequence
gatgtggggtagggatgtgg

SEQ ID NO: 49246 - DNA, 20 bp, Artificial
  CRISPR gRNA sequence
atgtggggtagggatgtggc

SEQ ID NO: 49247 - DNA, 20 bp, Artificial
  CRISPR gRNA sequence
agggatgtggcgggcaatgt

SEQ ID NO: 49248 - DNA, 20 bp, Artificial
  CRISPR gRNA sequence
gggatgtggcgggcaatgtg

SEQ ID NO: 49249 - DNA, 20 bp, Artificial
  CRISPR gRNA sequence
gatgtggcgggcaatgtgag

SEQ ID NO: 49250 - DNA, 20 bp, Artificial
  CRISPR gRNA sequence
tcttccaccatgaactcatt

SEQ ID NO: 49251 - DNA, 20 bp, Artificial
  CRISPR gRNA sequence
atgaactcattaagccacca

SEQ ID NO: 49252 - DNA, 20 bp, Artificial
  CRISPR gRNA sequence
gaactcattaagccaccaca

SEQ ID NO: 49253 - DNA, 20 bp, Artificial
  CRISPR gRNA sequence
cattaagccaccacagagct

SEQ ID NO: 49254 - DNA, 20 bp, Artificial
  CRISPR gRNA sequence
taagccaccacagagcttgg

SEQ ID NO: 49255 - DNA, 20 bp, Artificial
  CRISPR gRNA sequence
gccaccacagagcttggaag

SEQ ID NO: 49256 - DNA, 20 bp, Artificial
  CRISPR gRNA sequence
accacagagcttggaagcag

SEQ ID NO: 49257 - DNA, 20 bp, Artificial
  CRISPR gRNA sequence
agagcttggaagcagaagca

SEQ ID NO: 49258 - DNA, 20 bp, Artificial
  CRISPR gRNA sequence
ttggaagcagaagcatggac

SEQ ID NO: 49259 - DNA, 20 bp, Artificial
  CRISPR gRNA sequence
agcagaagcatggactagtt

SEQ ID NO: 49260 - DNA, 20 bp, Artificial
  CRISPR gRNA sequence
gttcagtatttcctaaaccg

SEQ ID NO: 49261 - DNA, 20 bp, Artificial
  CRISPR gRNA sequence
tttcctaaaccgcagtcatt

SEQ ID NO: 49262 - DNA, 20 bp, Artificial
  CRISPR gRNA sequence
ttcctaaaccgcagtcattc

SEQ ID NO: 49263 - DNA, 20 bp, Artificial
  CRISPR gRNA sequence
ctaaaccgcagtcattcagg

SEQ ID NO: 49264 - DNA, 20 bp, Artificial
  CRISPR gRNA sequence
aggtagcaacttcacaactt

SEQ ID NO: 49265 - DNA, 20 bp, Artificial
  CRISPR gRNA sequence
agcaacttcacaacttaagc

SEQ ID NO: 49266 - DNA, 20 bp, Artificial
  CRISPR gRNA sequence
gcaacttcacaacttaagcc

SEQ ID NO: 49267 - DNA, 20 bp, Artificial
  CRISPR gRNA sequence
ttcacaacttaagccaggat

SEQ ID NO: 49268 - DNA, 20 bp, Artificial
  CRISPR gRNA sequence
tcacaacttaagccaggatt

SEQ ID NO: 49269 - DNA, 20 bp, Artificial
  CRISPR gRNA sequence
gccaggattaggtatcactg

SEQ ID NO: 49270 - DNA, 20 bp, Artificial
  CRISPR gRNA sequence
gattaggtatcactgtagtt

SEQ ID NO: 49271 - DNA, 20 bp, Artificial
  CRISPR gRNA sequence
aggtatcactgtagtttagc

SEQ ID NO: 49272 - DNA, 20 bp, Artificial
  CRISPR gRNA sequence
ttacaaactctgcatcttta

SEQ ID NO: 49273 - DNA, 20 bp, Artificial
  CRISPR gRNA sequence
catctttaaagcaaatactg

SEQ ID NO: 49274 - DNA, 20 bp, Artificial
  CRISPR gRNA sequence
ctttaaagcaaatactgaag

SEQ ID NO: 49275 - DNA, 20 bp, Artificial
  CRISPR gRNA sequence
caaatactgaagaagtgtca

SEQ ID NO: 49276 - DNA, 20 bp, Artificial
  CRISPR gRNA sequence
tcaaagatctctctgtccta

SEQ ID NO: 49277 - DNA, 20 bp, Artificial
  CRISPR gRNA sequence
aaagatctctctgtcctaaa

SEQ ID NO: 49278 - DNA, 20 bp, Artificial
  CRISPR gRNA sequence
ttttatttatttattttttg

SEQ ID NO: 49279 - DNA, 20 bp, Artificial
  CRISPR gRNA sequence
ttatttatttattttttgta

SEQ ID NO: 49280 - DNA, 20 bp, Artificial
  CRISPR gRNA sequence
ttatttattttttgtagaga

SEQ ID NO: 49281 - DNA, 20 bp, Artificial
  CRISPR gRNA sequence
tatttattttttgtagagat

SEQ ID NO: 49282 - DNA, 20 bp, Artificial
  CRISPR gRNA sequence
atttattttttgtagagatg

SEQ ID NO: 49283 - DNA, 20 bp, Artificial
  CRISPR gRNA sequence
tttattttttgtagagatgg

SEQ ID NO: 49284 - DNA, 20 bp, Artificial
  CRISPR gRNA sequence
attttttgtagagatggggg

SEQ ID NO: 49285 - DNA, 20 bp, Artificial
  CRISPR gRNA sequence
ggtggtctcgctatgttgct

SEQ ID NO: 49286 - DNA, 20 bp, Artificial
  CRISPR gRNA sequence
gtggtctcgctatgttgctc

SEQ ID NO: 49287 - DNA, 20 bp, Artificial
  CRISPR gRNA sequence
tctcgctatgttgctcaggc

SEQ ID NO: 49288 - DNA, 20 bp, Artificial
  CRISPR gRNA sequence
tcaggctggtgtcgaactcc

SEQ ID NO: 49289 - DNA, 20 bp, Artificial
  CRISPR gRNA sequence
caggctggtgtcgaactccc

SEQ ID NO: 49290 - DNA, 20 bp, Artificial
  CRISPR gRNA sequence
ggtgtcgaactcccgggctc

SEQ ID NO: 49291 - DNA, 20 bp, Artificial
  CRISPR gRNA sequence
ctcaagcgatttttcctcct

SEQ ID NO: 49292 - DNA, 20 bp, Artificial
  CRISPR gRNA sequence
atttttcctcctcggcctcc

SEQ ID NO: 49293 - DNA, 20 bp, Artificial
  CRISPR gRNA sequence
ttttcctcctcggcctccca

SEQ ID NO: 49294 - DNA, 20 bp, Artificial
  CRISPR gRNA sequence
tcctcggcctcccagagtgc

SEQ ID NO: 49295 - DNA, 20 bp, Artificial
  CRISPR gRNA sequence
cctcggcctcccagagtgct

SEQ ID NO: 49296 - DNA, 20 bp, Artificial
  CRISPR gRNA sequence
tcccagagtgctgggattac

SEQ ID NO: 49297 - DNA, 20 bp, Artificial
  CRISPR gRNA sequence
agtgctgggattacaagctt

SEQ ID NO: 49298 - DNA, 20 bp, Artificial
  CRISPR gRNA sequence
caagcttgagccactgttcc

SEQ ID NO: 49299 - DNA, 20 bp, Artificial
  CRISPR gRNA sequence
tgagccactgttcccagccc

SEQ ID NO: 49300 - DNA, 20 bp, Artificial
  CRISPR gRNA sequence
agccactgttcccagcccaa

SEQ ID NO: 49301 - DNA, 20 bp, Artificial
  CRISPR gRNA sequence
ccagcccaagagtttcttct

SEQ ID NO: 49302 - DNA, 20 bp, Artificial
  CRISPR gRNA sequence
gagtttcttcttggtgtaat

SEQ ID NO: 49303 - DNA, 20 bp, Artificial
  CRISPR gRNA sequence
ttcttcttggtgtaatcagt

SEQ ID NO: 49304 - DNA, 20 bp, Artificial
  CRISPR gRNA sequence
tcttggtgtaatcagttaga

SEQ ID NO: 49305 - DNA, 20 bp, Artificial
  CRISPR gRNA sequence
ttagatggaaataaaatgta

SEQ ID NO: 49306 - DNA, 20 bp, Artificial
  CRISPR gRNA sequence
atggaaataaaatgtaaagt

SEQ ID NO: 49307 - DNA, 20 bp, Artificial
  CRISPR gRNA sequence
tggaaataaaatgtaaagtt

SEQ ID NO: 49308 - DNA, 20 bp, Artificial
  CRISPR gRNA sequence
aataaaatgtaaagttagga

SEQ ID NO: 49309 - DNA, 20 bp, Artificial
  CRISPR gRNA sequence
tcatgctgattcatcgattt

SEQ ID NO: 49310 - DNA, 20 bp, Artificial
  CRISPR gRNA sequence
gctgattcatcgatttaagt

SEQ ID NO: 49311 - DNA, 20 bp, Artificial
  CRISPR gRNA sequence
atttaagtaagatttattaa

SEQ ID NO: 49312 - DNA, 20 bp, Artificial
  CRISPR gRNA sequence
ggctgctaaaatttgccaat

SEQ ID NO: 49313 - DNA, 20 bp, Artificial
  CRISPR gRNA sequence
ctgctaaaatttgccaatga

SEQ ID NO: 49314 - DNA, 20 bp, Artificial
  CRISPR gRNA sequence
aaatttgccaatgagagttt

SEQ ID NO: 49315 - DNA, 20 bp, Artificial
  CRISPR gRNA sequence
aatttgccaatgagagtttg

SEQ ID NO: 49316 - DNA, 20 bp, Artificial
  CRISPR gRNA sequence
ttgccaatgagagtttgagg

SEQ ID NO: 49317 - DNA, 20 bp, Artificial
  CRISPR gRNA sequence
agacttaatacataatctta

SEQ ID NO: 49318 - DNA, 20 bp, Artificial
  CRISPR gRNA sequence
cataatctatgttgattaca

SEQ ID NO: 49319 - DNA, 20 bp, Artificial
  CRISPR gRNA sequence
ataatctatgttgattacaa

SEQ ID NO: 49320 - DNA, 20 bp, Artificial
  CRISPR gRNA sequence
taatctatgttgattacaaa

SEQ ID NO: 49321 - DNA, 20 bp, Artificial
  CRISPR gRNA sequence
ctatgttgattacaaaggga

SEQ ID NO: 49322 - DNA, 20 bp, Artificial
  CRISPR gRNA sequence
gttgattacaaagggaaagt

SEQ ID NO: 49323 - DNA, 20 bp, Artificial
  CRISPR gRNA sequence
gggaaagttagtaaatttgc

SEQ ID NO: 49324 - DNA, 20 bp, Artificial
  CRISPR gRNA sequence
aaagttagtaaatttgcaag

SEQ ID NO: 49325 - DNA, 20 bp, Artificial
  CRISPR gRNA sequence
agttagtaaatttgcaagtg

SEQ ID NO: 49326 - DNA, 20 bp, Artificial
  CRISPR gRNA sequence
ttagtaaatttgcaagtgga

SEQ ID NO: 49327 - DNA, 20 bp, Artificial
  CRISPR gRNA sequence
aatttgcaagtggagagacc

SEQ ID NO: 49328 - DNA, 20 bp, Artificial
  CRISPR gRNA sequence
ttgcaagtggagagacctgg

SEQ ID NO: 49329 - DNA, 20 bp, Artificial
  CRISPR gRNA sequence
cctggcagacaccactgtca

SEQ ID NO: 49330 - DNA, 20 bp, Artificial
  CRISPR gRNA sequence
ctggcagacaccactgtcac

SEQ ID NO: 49331 - DNA, 20 bp, Artificial
  CRISPR gRNA sequence
accactgtcacaggtgatca

SEQ ID NO: 49332 - DNA, 20 bp, Artificial
  CRISPR gRNA sequence
gtgatcacagttaacatcac

SEQ ID NO: 49333 - DNA, 20 bp, Artificial
  CRISPR gRNA sequence
acagttaacatcactagccc

SEQ ID NO: 49334 - DNA, 20 bp, Artificial
  CRISPR gRNA sequence
cagttaacatcactagcccg

SEQ ID NO: 49335 - DNA, 20 bp, Artificial
  CRISPR gRNA sequence
tgacacatcatgtgccccga

SEQ ID NO: 49336 - DNA, 20 bp, Artificial
  CRISPR gRNA sequence
cacatcatgtgccccgatgg

SEQ ID NO: 49337 - DNA, 20 bp, Artificial
  CRISPR gRNA sequence
acatcatgtgccccgatgga

SEQ ID NO: 49338 - DNA, 20 bp, Artificial
  CRISPR gRNA sequence
cgatggaaggcacgataaca

SEQ ID NO: 49339 - DNA, 20 bp, Artificial
  CRISPR gRNA sequence
ctgtgtgatattcctgccca

SEQ ID NO: 49340 - DNA, 20 bp, Artificial
  CRISPR gRNA sequence
tgtgtgatattcctgcccaa

SEQ ID NO: 49341 - DNA, 20 bp, Artificial
  CRISPR gRNA sequence
gtgtgatattcctgcccaaa

SEQ ID NO: 49342 - DNA, 20 bp, Artificial
  CRISPR gRNA sequence
tgatattcctgcccaaaggg

SEQ ID NO: 49343 - DNA, 20 bp, Artificial
  CRISPR gRNA sequence
cagactctaactctaaacat

SEQ ID NO: 49344 - DNA, 20 bp, Artificial
  CRISPR gRNA sequence
agactctaactctaaacatg

SEQ ID NO: 49345 - DNA, 20 bp, Artificial
  CRISPR gRNA sequence
ctctaaacatgaggaaacat

SEQ ID NO: 49346 - DNA, 20 bp, Artificial
  CRISPR gRNA sequence
aggaaacattggacaaaccc

SEQ ID NO: 49347 - DNA, 20 bp, Artificial
  CRISPR gRNA sequence
aaacattggacaaacccaag

SEQ ID NO: 49348 - DNA, 20 bp, Artificial
  CRISPR gRNA sequence
cattggacaaacccaagtgg

SEQ ID NO: 49349 - DNA, 20 bp, Artificial
  CRISPR gRNA sequence
attggacaaacccaagtgga

SEQ ID NO: 49350 - DNA, 20 bp, Artificial
  CRISPR gRNA sequence
aggacattctataaaataac

SEQ ID NO: 49351 - DNA, 20 bp, Artificial
  CRISPR gRNA sequence
aataactggcctgtaaatgt

SEQ ID NO: 49352 - DNA, 20 bp, Artificial
  CRISPR gRNA sequence
taactggcctgtaaatgtca

SEQ ID NO: 49353 - DNA, 20 bp, Artificial
  CRISPR gRNA sequence
tgtcagagacaatgctatga

SEQ ID NO: 49354 - DNA, 20 bp, Artificial
  CRISPR gRNA sequence
agacaatgctatgaaagaca

SEQ ID NO: 49355 - DNA, 20 bp, Artificial
  CRISPR gRNA sequence
caatgctatgaaagacaaag

SEQ ID NO: 49356 - DNA, 20 bp, Artificial
  CRISPR gRNA sequence
aatgctatgaaagacaaaga

SEQ ID NO: 49357 - DNA, 20 bp, Artificial
  CRISPR gRNA sequence
atgctatgaaagacaaagaa

SEQ ID NO: 49358 - DNA, 20 bp, Artificial
  CRISPR gRNA sequence
atgaaagacaaagaagggcc

SEQ ID NO: 49359 - DNA, 20 bp, Artificial
  CRISPR gRNA sequence
tgaaagacaaagaagggcca

SEQ ID NO: 49360 - DNA, 20 bp, Artificial
  CRISPR gRNA sequence
gaagggccaaggacgtgttc

SEQ ID NO: 49361 - DNA, 20 bp, Artificial
  CRISPR gRNA sequence
caaggacgtgttccagattg

SEQ ID NO: 49362 - DNA, 20 bp, Artificial
  CRISPR gRNA sequence
aaggacgtgttccagattga

SEQ ID NO: 49363 - DNA, 20 bp, Artificial
  CRISPR gRNA sequence
ggacgtgttccagattgaag

SEQ ID NO: 49364 - DNA, 20 bp, Artificial
  CRISPR gRNA sequence
ccagattgaaggagacacta

SEQ ID NO: 49365 - DNA, 20 bp, Artificial
  CRISPR gRNA sequence
agattgaaggagacactaaa

SEQ ID NO: 49366 - DNA, 20 bp, Artificial
  CRISPR gRNA sequence
ctaaagagatgacactaaat

SEQ ID NO: 49367 - DNA, 20 bp, Artificial
  CRISPR gRNA sequence
ctaaatgagacgtgtgatcc

SEQ ID NO: 49368 - DNA, 20 bp, Artificial
  CRISPR gRNA sequence
tgagacgtgtgatcctggat

SEQ ID NO: 49369 - DNA, 20 bp, Artificial
  CRISPR gRNA sequence
tcctggattggatccacaac

SEQ ID NO: 49370 - DNA, 20 bp, Artificial
  CRISPR gRNA sequence
cctggattggatccacaact

SEQ ID NO: 49371 - DNA, 20 bp, Artificial
  CRISPR gRNA sequence
aactgggaaaaaaatgcaat

SEQ ID NO: 49372 - DNA, 20 bp, Artificial
  CRISPR gRNA sequence
aatgcaataagcaacattat

SEQ ID NO: 49373 - DNA, 20 bp, Artificial
  CRISPR gRNA sequence
atgcaataagcaacattatt

SEQ ID NO: 49374 - DNA, 20 bp, Artificial
  CRISPR gRNA sequence
gcaataagcaacattattgg

SEQ ID NO: 49375 - DNA, 20 bp, Artificial
  CRISPR gRNA sequence
agcaacattattgggagaac

SEQ ID NO: 49376 - DNA, 20 bp, Artificial
  CRISPR gRNA sequence
acattattgggagaactggt

SEQ ID NO: 49377 - DNA, 20 bp, Artificial
  CRISPR gRNA sequence
attgggagaactggtgagat

SEQ ID NO: 49378 - DNA, 20 bp, Artificial
  CRISPR gRNA sequence
tgggagaactggtgagattg

SEQ ID NO: 49379 - DNA, 20 bp, Artificial
  CRISPR gRNA sequence
tgagattggagtataaactg

SEQ ID NO: 49380 - DNA, 20 bp, Artificial
  CRISPR gRNA sequence
ttggagtataaactgtagtt

SEQ ID NO: 49381 - DNA, 20 bp, Artificial
  CRISPR gRNA sequence
ataaactgtagttgagataa

SEQ ID NO: 49382 - DNA, 20 bp, Artificial
  CRISPR gRNA sequence
aactgtagttgagataatag

SEQ ID NO: 49383 - DNA, 20 bp, Artificial
  CRISPR gRNA sequence
tgtatcaatgtcacatttcc

SEQ ID NO: 49384 - DNA, 20 bp, Artificial
  CRISPR gRNA sequence
cctggattttataattttac

SEQ ID NO: 49385 - DNA, 20 bp, Artificial
  CRISPR gRNA sequence
tttataattttactggatta

SEQ ID NO: 49386 - DNA, 20 bp, Artificial
  CRISPR gRNA sequence
ataattttactggattatgg

SEQ ID NO: 49387 - DNA, 20 bp, Artificial
  CRISPR gRNA sequence
aattttactggattatggaa

SEQ ID NO: 49388 - DNA, 20 bp, Artificial
  CRISPR gRNA sequence
gaagagaatgtccttatttc

SEQ ID NO: 49389 - DNA, 20 bp, Artificial
  CRISPR gRNA sequence
caaattcgctgaaatgttaa

SEQ ID NO: 49390 - DNA, 20 bp, Artificial
  CRISPR gRNA sequence
aaattcgctgaaatgttaac

SEQ ID NO: 49391 - DNA, 20 bp, Artificial
  CRISPR gRNA sequence
cgctgaaatgttaacgggta

SEQ ID NO: 49392 - DNA, 20 bp, Artificial
  CRISPR gRNA sequence
gctgaaatgttaacgggtaa

SEQ ID NO: 49393 - DNA, 20 bp, Artificial
  CRISPR gRNA sequence
ctgaaatgttaacgggtaaa

SEQ ID NO: 49394 - DNA, 20 bp, Artificial
  CRISPR gRNA sequence
gattacaacttacttctaaa

SEQ ID NO: 49395 - DNA, 20 bp, Artificial
  CRISPR gRNA sequence
caacttacttctaaatggtt

SEQ ID NO: 49396 - DNA, 20 bp, Artificial
  CRISPR gRNA sequence
tacttctaaatggttcagaa

SEQ ID NO: 49397 - DNA, 20 bp, Artificial
  CRISPR gRNA sequence
acttctaaatggttcagaaa

SEQ ID NO: 49398 - DNA, 20 bp, Artificial
  CRISPR gRNA sequence
ttctaaatggttcagaaaag

SEQ ID NO: 49399 - DNA, 20 bp, Artificial
  CRISPR gRNA sequence
ctaaatggttcagaaaagga

SEQ ID NO: 49400 - DNA, 20 bp, Artificial
  CRISPR gRNA sequence
aaatggttcagaaaaggaga

SEQ ID NO: 49401 - DNA, 20 bp, Artificial
  CRISPR gRNA sequence
aatggttcagaaaaggagag

SEQ ID NO: 49402 - DNA, 20 bp, Artificial
  CRISPR gRNA sequence
atggttcagaaaaggagaga

SEQ ID NO: 49403 - DNA, 20 bp, Artificial
  CRISPR gRNA sequence
ggttcagaaaaggagagagg

SEQ ID NO: 49404 - DNA, 20 bp, Artificial
  CRISPR gRNA sequence
ttcagaaaaggagagaggga

SEQ ID NO: 49405 - DNA, 20 bp, Artificial
  CRISPR gRNA sequence
cagaaaaggagagagggaga

SEQ ID NO: 49406 - DNA, 20 bp, Artificial
  CRISPR gRNA sequence
aggagagagggagagagtga

SEQ ID NO: 49407 - DNA, 20 bp, Artificial
  CRISPR gRNA sequence
agagggagagagtgaaagaa

SEQ ID NO: 49408 - DNA, 20 bp, Artificial
  CRISPR gRNA sequence
gagggagagagtgaaagaaa

SEQ ID NO: 49409 - DNA, 20 bp, Artificial
  CRISPR gRNA sequence
agggagagagtgaaagaaaa

SEQ ID NO: 49410 - DNA, 20 bp, Artificial
  CRISPR gRNA sequence
ggagagagtgaaagaaaagg

SEQ ID NO: 49411 - DNA, 20 bp, Artificial
  CRISPR gRNA sequence
gagagagtgaaagaaaaggg

SEQ ID NO: 49412 - DNA, 20 bp, Artificial
  CRISPR gRNA sequence
agagtgaaagaaaagggagg

SEQ ID NO: 49413 - DNA, 20 bp, Artificial
  CRISPR gRNA sequence
gagtgaaagaaaagggaggt

SEQ ID NO: 49414 - DNA, 20 bp, Artificial
  CRISPR gRNA sequence
gaaagaaaagggaggtggga

SEQ ID NO: 49415 - DNA, 20 bp, Artificial
  CRISPR gRNA sequence
agaaaagggaggtgggaaag

SEQ ID NO: 49416 - DNA, 20 bp, Artificial
  CRISPR gRNA sequence
gaaaagggaggtgggaaaga

SEQ ID NO: 49417 - DNA, 20 bp, Artificial
  CRISPR gRNA sequence
aaagggaggtgggaaagaag

SEQ ID NO: 49418 - DNA, 20 bp, Artificial
  CRISPR gRNA sequence
aagggaggtgggaaagaagg

SEQ ID NO: 49419 - DNA, 20 bp, Artificial
  CRISPR gRNA sequence
agggaggtgggaaagaagga

SEQ ID NO: 49420 - DNA, 20 bp, Artificial
  CRISPR gRNA sequence
ggaggtgggaaagaaggagg

SEQ ID NO: 49421 - DNA, 20 bp, Artificial
  CRISPR gRNA sequence
gaggtgggaaagaaggaggg

SEQ ID NO: 49422 - DNA, 20 bp, Artificial
  CRISPR gRNA sequence
aggtgggaaagaaggaggga

SEQ ID NO: 49423 - DNA, 20 bp, Artificial
  CRISPR gRNA sequence
tgggaaagaaggagggaggg

SEQ ID NO: 49424 - DNA, 20 bp, Artificial
  CRISPR gRNA sequence
gaaggagggagggaagaaat

SEQ ID NO: 49425 - DNA, 20 bp, Artificial
  CRISPR gRNA sequence
agggaagaaatgagcaaatg

SEQ ID NO: 49426 - DNA, 20 bp, Artificial
  CRISPR gRNA sequence
gaaatgagcaaatgtggaaa

SEQ ID NO: 49427 - DNA, 20 bp, Artificial
  CRISPR gRNA sequence
gagcaaatgtggaaaaagat

SEQ ID NO: 49428 - DNA, 20 bp, Artificial
  CRISPR gRNA sequence
aatgtggaaaaagattggca

SEQ ID NO: 49429 - DNA, 20 bp, Artificial
  CRISPR gRNA sequence
atgtggaaaaagattggcaa

SEQ ID NO: 49430 - DNA, 20 bp, Artificial
  CRISPR gRNA sequence
tgtggaaaaagattggcaaa

SEQ ID NO: 49431 - DNA, 20 bp, Artificial
  CRISPR gRNA sequence
ttgttctttttttttttttt

SEQ ID NO: 49432 - DNA, 20 bp, Artificial
  CRISPR gRNA sequence
ttttttttttttcggaaacc

SEQ ID NO: 49433 - DNA, 20 bp, Artificial
  CRISPR gRNA sequence
ccgagcctcgctctgtcacc

SEQ ID NO: 49434 - DNA, 20 bp, Artificial
  CRISPR gRNA sequence
cgagcctcgctctgtcacct

SEQ ID NO: 49435 - DNA, 20 bp, Artificial
  CRISPR gRNA sequence
cctcgctctgtcacctaggc

SEQ ID NO: 49436 - DNA, 20 bp, Artificial
  CRISPR gRNA sequence
tcgctctgtcacctaggcta

SEQ ID NO: 49437 - DNA, 20 bp, Artificial
  CRISPR gRNA sequence
ctgtcacctaggctagagtg

SEQ ID NO: 49438 - DNA, 20 bp, Artificial
  CRISPR gRNA sequence
tcacctaggctagagtgcag

SEQ ID NO: 49439 - DNA, 20 bp, Artificial
  CRISPR gRNA sequence
agagtgcagtggcacaatct

SEQ ID NO: 49440 - DNA, 20 bp, Artificial
  CRISPR gRNA sequence
atcttggctcactgtaacct

SEQ ID NO: 49441 - DNA, 20 bp, Artificial
  CRISPR gRNA sequence
tcactgtaacctcagcctcc

SEQ ID NO: 49442 - DNA, 20 bp, Artificial
  CRISPR gRNA sequence
cactgtaacctcagcctccc

SEQ ID NO: 49443 - DNA, 20 bp, Artificial
  CRISPR gRNA sequence
aacctcagcctcccgggttc

SEQ ID NO: 49444 - DNA, 20 bp, Artificial
  CRISPR gRNA sequence
ttcaagcaattcttgtgcct

SEQ ID NO: 49445 - DNA, 20 bp, Artificial
  CRISPR gRNA sequence
ttgtgcctcagcctcccaat

SEQ ID NO: 49446 - DNA, 20 bp, Artificial
  CRISPR gRNA sequence
gcctcagcctcccaattagc

SEQ ID NO: 49447 - DNA, 20 bp, Artificial
  CRISPR gRNA sequence
cctcagcctcccaattagct

SEQ ID NO: 49448 - DNA, 20 bp, Artificial
  CRISPR gRNA sequence
ctcccaattagctgggatta

SEQ ID NO: 49449 - DNA, 20 bp, Artificial
  CRISPR gRNA sequence
tcccaattagctgggattac

SEQ ID NO: 49450 - DNA, 20 bp, Artificial
  CRISPR gRNA sequence
caggcatgcaccaccatgcc

SEQ ID NO: 49451 - DNA, 20 bp, Artificial
  CRISPR gRNA sequence
cagctaatttttttgtattt

SEQ ID NO: 49452 - DNA, 20 bp, Artificial
  CRISPR gRNA sequence
ctaatttttttgtattttag

SEQ ID NO: 49453 - DNA, 20 bp, Artificial
  CRISPR gRNA sequence
aatttttttgtattttagta

SEQ ID NO: 49454 - DNA, 20 bp, Artificial
  CRISPR gRNA sequence
tttttgtattttagtagaga

SEQ ID NO: 49455 - DNA, 20 bp, Artificial
  CRISPR gRNA sequence
ttttgtattttagtagagac

SEQ ID NO: 49456 - DNA, 20 bp, Artificial
  CRISPR gRNA sequence
tttgtattttagtagagacg

SEQ ID NO: 49457 - DNA, 20 bp, Artificial
  CRISPR gRNA sequence
cggggtttcaccgtgttgtc

SEQ ID NO: 49458 - DNA, 20 bp, Artificial
  CRISPR gRNA sequence
ggggtttcaccgtgttgtcc

SEQ ID NO: 49459 - DNA, 20 bp, Artificial
  CRISPR gRNA sequence
gggtttcaccgtgttgtcca

SEQ ID NO: 49460 - DNA, 20 bp, Artificial
  CRISPR gRNA sequence
tttcaccgtgttgtccaggg

SEQ ID NO: 49461 - DNA, 20 bp, Artificial
  CRISPR gRNA sequence
cagggtggtctcgaattcct

SEQ ID NO: 49462 - DNA, 20 bp, Artificial
  CRISPR gRNA sequence
tggtctcgaattcctgagct

SEQ ID NO: 49463 - DNA, 20 bp, Artificial
  CRISPR gRNA sequence
ggtctcgaattcctgagctc

SEQ ID NO: 49464 - DNA, 20 bp, Artificial
  CRISPR gRNA sequence
ctcaggcaatccacctgcct

SEQ ID NO: 49465 - DNA, 20 bp, Artificial
  CRISPR gRNA sequence
ccacctgcctcggcctccca

SEQ ID NO: 49466 - DNA, 20 bp, Artificial
  CRISPR gRNA sequence
gcctcggcctcccaaagtgc

SEQ ID NO: 49467 - DNA, 20 bp, Artificial
  CRISPR gRNA sequence
cctcggcctcccaaagtgct

SEQ ID NO: 49468 - DNA, 20 bp, Artificial
  CRISPR gRNA sequence
ctcccaaagtgctaggatta

SEQ ID NO: 49469 - DNA, 20 bp, Artificial
  CRISPR gRNA sequence
agtgctaggattacagacat

SEQ ID NO: 49470 - DNA, 20 bp, Artificial
  CRISPR gRNA sequence
cagacatgagccaccacgcc

SEQ ID NO: 49471 - DNA, 20 bp, Artificial
  CRISPR gRNA sequence
gagccaccacgcccagctct

SEQ ID NO: 49472 - DNA, 20 bp, Artificial
  CRISPR gRNA sequence
agccaccacgcccagctcta

SEQ ID NO: 49473 - DNA, 20 bp, Artificial
  CRISPR gRNA sequence
gccaccacgcccagctctaa

SEQ ID NO: 49474 - DNA, 20 bp, Artificial
  CRISPR gRNA sequence
cccagctctaagggtgaatt

SEQ ID NO: 49475 - DNA, 20 bp, Artificial
  CRISPR gRNA sequence
ccagctctaagggtgaattt

SEQ ID NO: 49476 - DNA, 20 bp, Artificial
  CRISPR gRNA sequence
taagggtgaatttgggtaaa

SEQ ID NO: 49477 - DNA, 20 bp, Artificial
  CRISPR gRNA sequence
gaatttgggtaaatggcaca

SEQ ID NO: 49478 - DNA, 20 bp, Artificial
  CRISPR gRNA sequence
tttgggtaaatggcacacag

SEQ ID NO: 49479 - DNA, 20 bp, Artificial
  CRISPR gRNA sequence
aaatggcacacagcagttct

SEQ ID NO: 49480 - DNA, 20 bp, Artificial
  CRISPR gRNA sequence
gtcttcttgaaactttgtgt

SEQ ID NO: 49481 - DNA, 20 bp, Artificial
  CRISPR gRNA sequence
tgaaactttgtgttagttcg

SEQ ID NO: 49482 - DNA, 20 bp, Artificial
  CRISPR gRNA sequence
ttagttcgcagttattttaa

SEQ ID NO: 49483 - DNA, 20 bp, Artificial
  CRISPR gRNA sequence
ttttaaaagaaaaacaatga

SEQ ID NO: 49484 - DNA, 20 bp, Artificial
  CRISPR gRNA sequence
ttaaaagaaaaacaatgaaa

SEQ ID NO: 49485 - DNA, 20 bp, Artificial
  CRISPR gRNA sequence
aacaatgaaagagtgttaaa

SEQ ID NO: 49486 - DNA, 20 bp, Artificial
  CRISPR gRNA sequence
acaatgaaagagtgttaaaa

SEQ ID NO: 49487 - DNA, 20 bp, Artificial
  CRISPR gRNA sequence
caatgaaagagtgttaaaaa

SEQ ID NO: 49488 - DNA, 20 bp, Artificial
  CRISPR gRNA sequence
ggaacaactttcttgccatg

SEQ ID NO: 49489 - DNA, 20 bp, Artificial
  CRISPR gRNA sequence
ccatgtggctcaatgttcct

SEQ ID NO: 49490 - DNA, 20 bp, Artificial
  CRISPR gRNA sequence
catgtggctcaatgttccta

SEQ ID NO: 49491 - DNA, 20 bp, Artificial
  CRISPR gRNA sequence
cctaaggtcatgtttacgac

SEQ ID NO: 49492 - DNA, 20 bp, Artificial
  CRISPR gRNA sequence
ctaaggtcatgtttacgact

SEQ ID NO: 49493 - DNA, 20 bp, Artificial
  CRISPR gRNA sequence
gtacccctaaaaatcatctc

SEQ ID NO: 49494 - DNA, 20 bp, Artificial
  CRISPR gRNA sequence
tacccctaaaaatcatctcc

SEQ ID NO: 49495 - DNA, 20 bp, Artificial
  CRISPR gRNA sequence
acccctaaaaatcatctcca

SEQ ID NO: 49496 - DNA, 20 bp, Artificial
  CRISPR gRNA sequence
atcatctccagggccacctg

SEQ ID NO: 49497 - DNA, 20 bp, Artificial
  CRISPR gRNA sequence
ccacctgtggtttgtgtcca

SEQ ID NO: 49498 - DNA, 20 bp, Artificial
  CRISPR gRNA sequence
acctgtggtttgtgtccaca

SEQ ID NO: 49499 - DNA, 20 bp, Artificial
  CRISPR gRNA sequence
gtggtttgtgtccacagagt

SEQ ID NO: 49500 - DNA, 20 bp, Artificial
  CRISPR gRNA sequence
tgtgtccacagagtaagaca

SEQ ID NO: 49501 - DNA, 20 bp, Artificial
  CRISPR gRNA sequence
tgtccacagagtaagacaca

SEQ ID NO: 49502 - DNA, 20 bp, Artificial
  CRISPR gRNA sequence
cacagagtaagacacagagt

SEQ ID NO: 49503 - DNA, 20 bp, Artificial
  CRISPR gRNA sequence
cagagtaagacacagagtaa

SEQ ID NO: 49504 - DNA, 20 bp, Artificial
  CRISPR gRNA sequence
acacagagtaagagtcctct

SEQ ID NO: 49505 - DNA, 20 bp, Artificial
  CRISPR gRNA sequence
gagtaagagtcctctgagcc

SEQ ID NO: 49506 - DNA, 20 bp, Artificial
  CRISPR gRNA sequence
agtaagagtcctctgagccc

SEQ ID NO: 49507 - DNA, 20 bp, Artificial
  CRISPR gRNA sequence
gtaagagtcctctgagccca

SEQ ID NO: 49508 - DNA, 20 bp, Artificial
  CRISPR gRNA sequence
gagtcctctgagcccagggc

SEQ ID NO: 49509 - DNA, 20 bp, Artificial
  CRISPR gRNA sequence
agtcctctgagcccagggct

SEQ ID NO: 49510 - DNA, 20 bp, Artificial
  CRISPR gRNA sequence
gagcccagggctgggaataa

SEQ ID NO: 49511 - DNA, 20 bp, Artificial
  CRISPR gRNA sequence
agcccagggctgggaataac

SEQ ID NO: 49512 - DNA, 20 bp, Artificial
  CRISPR gRNA sequence
cccagggctgggaataacgg

SEQ ID NO: 49513 - DNA, 20 bp, Artificial
  CRISPR gRNA sequence
ccagggctgggaataacggg

SEQ ID NO: 49514 - DNA, 20 bp, Artificial
  CRISPR gRNA sequence
ctgggaataacgggaggtgt

SEQ ID NO: 49515 - DNA, 20 bp, Artificial
  CRISPR gRNA sequence
tgggaataacgggaggtgtc

SEQ ID NO: 49516 - DNA, 20 bp, Artificial
  CRISPR gRNA sequence
gggaataacgggaggtgtca

SEQ ID NO: 49517 - DNA, 20 bp, Artificial
  CRISPR gRNA sequence
aataacgggaggtgtcaggg

SEQ ID NO: 49518 - DNA, 20 bp, Artificial
  CRISPR gRNA sequence
ataacgggaggtgtcagggc

SEQ ID NO: 49519 - DNA, 20 bp, Artificial
  CRISPR gRNA sequence
taacgggaggtgtcagggca

SEQ ID NO: 49520 - DNA, 20 bp, Artificial
  CRISPR gRNA sequence
cgggaggtgtcagggcaggg

SEQ ID NO: 49521 - DNA, 20 bp, Artificial
  CRISPR gRNA sequence
ggaggtgtcagggcagggca

SEQ ID NO: 49522 - DNA, 20 bp, Artificial
  CRISPR gRNA sequence
cagggcagggcagagctgca

SEQ ID NO: 49523 - DNA, 20 bp, Artificial
  CRISPR gRNA sequence
agggcagggcagagctgcaa

SEQ ID NO: 49524 - DNA, 20 bp, Artificial
  CRISPR gRNA sequence
gggcagggcagagctgcaaa

SEQ ID NO: 49525 - DNA, 20 bp, Artificial
  CRISPR gRNA sequence
ggcagggcagagctgcaaag

SEQ ID NO: 49526 - DNA, 20 bp, Artificial
  CRISPR gRNA sequence
gcagagctgcaaaggggact

SEQ ID NO: 49527 - DNA, 20 bp, Artificial
  CRISPR gRNA sequence
tctacataccgaaatgtctt

SEQ ID NO: 49528 - DNA, 20 bp, Artificial
  CRISPR gRNA sequence
ataccgaaatgtcttcagct

SEQ ID NO: 49529 - DNA, 20 bp, Artificial
  CRISPR gRNA sequence
accgaaatgtcttcagctca

SEQ ID NO: 49530 - DNA, 20 bp, Artificial
  CRISPR gRNA sequence
cgaaatgtcttcagctcaga

SEQ ID NO: 49531 - DNA, 20 bp, Artificial
  CRISPR gRNA sequence
gaaatgtcttcagctcagag

SEQ ID NO: 49532 - DNA, 20 bp, Artificial
  CRISPR gRNA sequence
aaatgtcttcagctcagaga

SEQ ID NO: 49533 - DNA, 20 bp, Artificial
  CRISPR gRNA sequence
gtcttcagctcagagaggga

SEQ ID NO: 49534 - DNA, 20 bp, Artificial
  CRISPR gRNA sequence
ttcagctcagagagggacag

SEQ ID NO: 49535 - DNA, 20 bp, Artificial
  CRISPR gRNA sequence
tcagctcagagagggacagc

SEQ ID NO: 49536 - DNA, 20 bp, Artificial
  CRISPR gRNA sequence
agctcagagagggacagcag

SEQ ID NO: 49537 - DNA, 20 bp, Artificial
  CRISPR gRNA sequence
gctcagagagggacagcagg

SEQ ID NO: 49538 - DNA, 20 bp, Artificial
  CRISPR gRNA sequence
agggacagcaggaggctctg

SEQ ID NO: 49539 - DNA, 20 bp, Artificial
  CRISPR gRNA sequence
gacagcaggaggctctgcag

SEQ ID NO: 49540 - DNA, 20 bp, Artificial
  CRISPR gRNA sequence
agcaggaggctctgcagcag

SEQ ID NO: 49541 - DNA, 20 bp, Artificial
  CRISPR gRNA sequence
gcaggaggctctgcagcagc

SEQ ID NO: 49542 - DNA, 20 bp, Artificial
  CRISPR gRNA sequence
caggaggctctgcagcagca

SEQ ID NO: 49543 - DNA, 20 bp, Artificial
  CRISPR gRNA sequence
gctctgcagcagcagggaac

SEQ ID NO: 49544 - DNA, 20 bp, Artificial
  CRISPR gRNA sequence
aactggcatcatcgtcctca

SEQ ID NO: 49545 - DNA, 20 bp, Artificial
  CRISPR gRNA sequence
ctggcatcatcgtcctcaca

SEQ ID NO: 49546 - DNA, 20 bp, Artificial
  CRISPR gRNA sequence
tggcatcatcgtcctcacag

SEQ ID NO: 49547 - DNA, 20 bp, Artificial
  CRISPR gRNA sequence
gtcctcacagaggttaacct

SEQ ID NO: 49548 - DNA, 20 bp, Artificial
  CRISPR gRNA sequence
cacagaggttaacctgagac

SEQ ID NO: 49549 - DNA, 20 bp, Artificial
  CRISPR gRNA sequence
ttaacctgagacaagctgaa

SEQ ID NO: 49550 - DNA, 20 bp, Artificial
  CRISPR gRNA sequence
taacctgagacaagctgaaa

SEQ ID NO: 49551 - DNA, 20 bp, Artificial
  CRISPR gRNA sequence
gagacaagctgaaaaggtcc

SEQ ID NO: 49552 - DNA, 20 bp, Artificial
  CRISPR gRNA sequence
agacaagctgaaaaggtcca

SEQ ID NO: 49553 - DNA, 20 bp, Artificial
  CRISPR gRNA sequence
gaaaaggtccaaggatattc

SEQ ID NO: 49554 - DNA, 20 bp, Artificial
  CRISPR gRNA sequence
aaaggtccaaggatattcta

SEQ ID NO: 49555 - DNA, 20 bp, Artificial
  CRISPR gRNA sequence
aaggtccaaggatattctag

SEQ ID NO: 49556 - DNA, 20 bp, Artificial
  CRISPR gRNA sequence
aaggatattctagaggattt

SEQ ID NO: 49557 - DNA, 20 bp, Artificial
  CRISPR gRNA sequence
aggatattctagaggatttc

SEQ ID NO: 49558 - DNA, 20 bp, Artificial
  CRISPR gRNA sequence
tattctagaggatttcaggc

SEQ ID NO: 49559 - DNA, 20 bp, Artificial
  CRISPR gRNA sequence
atttcaggctggacacacct

SEQ ID NO: 49560 - DNA, 20 bp, Artificial
  CRISPR gRNA sequence
ttcaggctggacacacctca

SEQ ID NO: 49561 - DNA, 20 bp, Artificial
  CRISPR gRNA sequence
tcaggctggacacacctcag

SEQ ID NO: 49562 - DNA, 20 bp, Artificial
  CRISPR gRNA sequence
acctcagaggtcatcacatc

SEQ ID NO: 49563 - DNA, 20 bp, Artificial
  CRISPR gRNA sequence
tcagaggtcatcacatccag

SEQ ID NO: 49564 - DNA, 20 bp, Artificial
  CRISPR gRNA sequence
cagaggtcatcacatccaga

SEQ ID NO: 49565 - DNA, 20 bp, Artificial
  CRISPR gRNA sequence
agaggtcatcacatccagaa

SEQ ID NO: 49566 - DNA, 20 bp, Artificial
  CRISPR gRNA sequence
gaggtcatcacatccagaag

SEQ ID NO: 49567 - DNA, 20 bp, Artificial
  CRISPR gRNA sequence
aggtcatcacatccagaagg

SEQ ID NO: 49568 - DNA, 20 bp, Artificial
  CRISPR gRNA sequence
cacatccagaagggggtgcc

SEQ ID NO: 49569 - DNA, 20 bp, Artificial
  CRISPR gRNA sequence
catccagaagggggtgccaa

SEQ ID NO: 49570 - DNA, 20 bp, Artificial
  CRISPR gRNA sequence
tccagaagggggtgccaaga

SEQ ID NO: 49571 - DNA, 20 bp, Artificial
  CRISPR gRNA sequence
ccagaagggggtgccaagag

SEQ ID NO: 49572 - DNA, 20 bp, Artificial
  CRISPR gRNA sequence
agaagggggtgccaagagag

SEQ ID NO: 49573 - DNA, 20 bp, Artificial
  CRISPR gRNA sequence
agggggtgccaagagaggag

SEQ ID NO: 49574 - DNA, 20 bp, Artificial
  CRISPR gRNA sequence
gggggtgccaagagaggaga

SEQ ID NO: 49575 - DNA, 20 bp, Artificial
  CRISPR gRNA sequence
ggggtgccaagagaggagaa

SEQ ID NO: 49576 - DNA, 20 bp, Artificial
  CRISPR gRNA sequence
gggtgccaagagaggagaag

SEQ ID NO: 49577 - DNA, 20 bp, Artificial
  CRISPR gRNA sequence
gagaggagaaggggccaccc

SEQ ID NO: 49578 - DNA, 20 bp, Artificial
  CRISPR gRNA sequence
gaggagaaggggccacccaa

SEQ ID NO: 49579 - DNA, 20 bp, Artificial
  CRISPR gRNA sequence
ggccacccaagagctcccct

SEQ ID NO: 49580 - DNA, 20 bp, Artificial
  CRISPR gRNA sequence
agagctcccctgagccaccc

SEQ ID NO: 49581 - DNA, 20 bp, Artificial
  CRISPR gRNA sequence
gagctcccctgagccaccct

SEQ ID NO: 49582 - DNA, 20 bp, Artificial
  CRISPR gRNA sequence
agctcccctgagccaccctg

SEQ ID NO: 49583 - DNA, 20 bp, Artificial
  CRISPR gRNA sequence
gggctctccctcccctccac

SEQ ID NO: 49584 - DNA, 20 bp, Artificial
  CRISPR gRNA sequence
ctccctcccctccactggcc

SEQ ID NO: 49585 - DNA, 20 bp, Artificial
  CRISPR gRNA sequence
agtgtgattttctcctgcac

SEQ ID NO: 49586 - DNA, 20 bp, Artificial
  CRISPR gRNA sequence
gtgtgattttctcctgcaca

SEQ ID NO: 49587 - DNA, 20 bp, Artificial
  CRISPR gRNA sequence
tgattttctcctgcacaagg

SEQ ID NO: 49588 - DNA, 20 bp, Artificial
  CRISPR gRNA sequence
tttctcctgcacaaggaagt

SEQ ID NO: 49589 - DNA, 20 bp, Artificial
  CRISPR gRNA sequence
gcacaaggaagtgagaatgc

SEQ ID NO: 49590 - DNA, 20 bp, Artificial
  CRISPR gRNA sequence
cacaaggaagtgagaatgcc

SEQ ID NO: 49591 - DNA, 20 bp, Artificial
  CRISPR gRNA sequence
acaaggaagtgagaatgcca

SEQ ID NO: 49592 - DNA, 20 bp, Artificial
  CRISPR gRNA sequence
gagaatgccagggtcacaca

SEQ ID NO: 49593 - DNA, 20 bp, Artificial
  CRISPR gRNA sequence
tgccagggtcacacatggcc

SEQ ID NO: 49594 - DNA, 20 bp, Artificial
  CRISPR gRNA sequence
ccagggtcacacatggcctg

SEQ ID NO: 49595 - DNA, 20 bp, Artificial
  CRISPR gRNA sequence
gggtcacacatggcctggag

SEQ ID NO: 49596 - DNA, 20 bp, Artificial
  CRISPR gRNA sequence
ggtcacacatggcctggagt

SEQ ID NO: 49597 - DNA, 20 bp, Artificial
  CRISPR gRNA sequence
acatggcctggagtaggtac

SEQ ID NO: 49598 - DNA, 20 bp, Artificial
  CRISPR gRNA sequence
catggcctggagtaggtacc

SEQ ID NO: 49599 - DNA, 20 bp, Artificial
  CRISPR gRNA sequence
atggcctggagtaggtacca

SEQ ID NO: 49600 - DNA, 20 bp, Artificial
  CRISPR gRNA sequence
gagtaggtaccagggtcaac

SEQ ID NO: 49601 - DNA, 20 bp, Artificial
  CRISPR gRNA sequence
gtaggtaccagggtcaacca

SEQ ID NO: 49602 - DNA, 20 bp, Artificial
  CRISPR gRNA sequence
ccagggtcaaccagagaact

SEQ ID NO: 49603 - DNA, 20 bp, Artificial
  CRISPR gRNA sequence
cagggtcaaccagagaactc

SEQ ID NO: 49604 - DNA, 20 bp, Artificial
  CRISPR gRNA sequence
agggtcaaccagagaactca

SEQ ID NO: 49605 - DNA, 20 bp, Artificial
  CRISPR gRNA sequence
agagaactcagggccccaca

SEQ ID NO: 49606 - DNA, 20 bp, Artificial
  CRISPR gRNA sequence
agaactcagggccccacaca

SEQ ID NO: 49607 - DNA, 20 bp, Artificial
  CRISPR gRNA sequence
agggccccacacagagtttc

SEQ ID NO: 49608 - DNA, 20 bp, Artificial
  CRISPR gRNA sequence
gggccccacacagagtttcc

SEQ ID NO: 49609 - DNA, 20 bp, Artificial
  CRISPR gRNA sequence
gagtttccaggcgctgacct

SEQ ID NO: 49610 - DNA, 20 bp, Artificial
  CRISPR gRNA sequence
ggcgctgacctgagctgctg

SEQ ID NO: 49611 - DNA, 20 bp, Artificial
  CRISPR gRNA sequence
tgacctgagctgctgcagcc

SEQ ID NO: 49612 - DNA, 20 bp, Artificial
  CRISPR gRNA sequence
agcctggcacatgtctccat

SEQ ID NO: 49613 - DNA, 20 bp, Artificial
  CRISPR gRNA sequence
gtctccatcagctgcccgac

SEQ ID NO: 49614 - DNA, 20 bp, Artificial
  CRISPR gRNA sequence
tccatcagctgcccgacaag

SEQ ID NO: 49615 - DNA, 20 bp, Artificial
  CRISPR gRNA sequence
ccatcagctgcccgacaaga

SEQ ID NO: 49616 - DNA, 20 bp, Artificial
  CRISPR gRNA sequence
gctgcccgacaagaaggctg

SEQ ID NO: 49617 - DNA, 20 bp, Artificial
  CRISPR gRNA sequence
gcccgacaagaaggctgtgg

SEQ ID NO: 49618 - DNA, 20 bp, Artificial
  CRISPR gRNA sequence
cccgacaagaaggctgtggt

SEQ ID NO: 49619 - DNA, 20 bp, Artificial
  CRISPR gRNA sequence
agaaggctgtggtgggctcc

SEQ ID NO: 49620 - DNA, 20 bp, Artificial
  CRISPR gRNA sequence
gaaggctgtggtgggctcca

SEQ ID NO: 49621 - DNA, 20 bp, Artificial
  CRISPR gRNA sequence
tgtggtgggctccaaggtca

SEQ ID NO: 49622 - DNA, 20 bp, Artificial
  CRISPR gRNA sequence
gtgggctccaaggtcacagt

SEQ ID NO: 49623 - DNA, 20 bp, Artificial
  CRISPR gRNA sequence
aaggtcacagtgagccaacc

SEQ ID NO: 49624 - DNA, 20 bp, Artificial
  CRISPR gRNA sequence
acagtgagccaacctggaca

SEQ ID NO: 49625 - DNA, 20 bp, Artificial
  CRISPR gRNA sequence
tgagccaacctggacacaga

SEQ ID NO: 49626 - DNA, 20 bp, Artificial
  CRISPR gRNA sequence
gagccaacctggacacagac

SEQ ID NO: 49627 - DNA, 20 bp, Artificial
  CRISPR gRNA sequence
agccaacctggacacagaca

SEQ ID NO: 49628 - DNA, 20 bp, Artificial
  CRISPR gRNA sequence
ccaacctggacacagacagg

SEQ ID NO: 49629 - DNA, 20 bp, Artificial
  CRISPR gRNA sequence
ggacacagacagggagacga

SEQ ID NO: 49630 - DNA, 20 bp, Artificial
  CRISPR gRNA sequence
agacagggagacgacagttt

SEQ ID NO: 49631 - DNA, 20 bp, Artificial
  CRISPR gRNA sequence
gacgacagttttggaacatc

SEQ ID NO: 49632 - DNA, 20 bp, Artificial
  CRISPR gRNA sequence
cagttttggaacatctagtc

SEQ ID NO: 49633 - DNA, 20 bp, Artificial
  CRISPR gRNA sequence
ggaacatctagtccagtatg

SEQ ID NO: 49634 - DNA, 20 bp, Artificial
  CRISPR gRNA sequence
gaacatctagtccagtatgt

SEQ ID NO: 49635 - DNA, 20 bp, Artificial
  CRISPR gRNA sequence
ctagtccagtatgtgggatt

SEQ ID NO: 49636 - DNA, 20 bp, Artificial
  CRISPR gRNA sequence
gggattcagtatctgcctgc

SEQ ID NO: 49637 - DNA, 20 bp, Artificial
  CRISPR gRNA sequence
ggattcagtatctgcctgca

SEQ ID NO: 49638 - DNA, 20 bp, Artificial
  CRISPR gRNA sequence
attcagtatctgcctgcaag

SEQ ID NO: 49639 - DNA, 20 bp, Artificial
  CRISPR gRNA sequence
atctgcctgcaaggagctta

SEQ ID NO: 49640 - DNA, 20 bp, Artificial
  CRISPR gRNA sequence
cctgcaaggagcttatggtg

SEQ ID NO: 49641 - DNA, 20 bp, Artificial
  CRISPR gRNA sequence
ctgcaaggagcttatggtgt

SEQ ID NO: 49642 - DNA, 20 bp, Artificial
  CRISPR gRNA sequence
tgcaaggagcttatggtgta

SEQ ID NO: 49643 - DNA, 20 bp, Artificial
  CRISPR gRNA sequence
gcaaggagcttatggtgtag

SEQ ID NO: 49644 - DNA, 20 bp, Artificial
  CRISPR gRNA sequence
aaataaatgctgatcaaatg

SEQ ID NO: 49645 - DNA, 20 bp, Artificial
  CRISPR gRNA sequence
gctgatcaaatgaagtccta

SEQ ID NO: 49646 - DNA, 20 bp, Artificial
  CRISPR gRNA sequence
acagtttgctattcacttat

SEQ ID NO: 49647 - DNA, 20 bp, Artificial
  CRISPR gRNA sequence
gtttgctattcacttatgag

SEQ ID NO: 49648 - DNA, 20 bp, Artificial
  CRISPR gRNA sequence
tattcacttatgagaagtgc

SEQ ID NO: 49649 - DNA, 20 bp, Artificial
  CRISPR gRNA sequence
attcacttatgagaagtgct

SEQ ID NO: 49650 - DNA, 20 bp, Artificial
  CRISPR gRNA sequence
cacttatgagaagtgctagg

SEQ ID NO: 49651 - DNA, 20 bp, Artificial
  CRISPR gRNA sequence
ttatgagaagtgctaggaag

SEQ ID NO: 49652 - DNA, 20 bp, Artificial
  CRISPR gRNA sequence
tatgagaagtgctaggaagc

SEQ ID NO: 49653 - DNA, 20 bp, Artificial
  CRISPR gRNA sequence
tgagaagtgctaggaagcag

SEQ ID NO: 49654 - DNA, 20 bp, Artificial
  CRISPR gRNA sequence
agtgctaggaagcaggagtc

SEQ ID NO: 49655 - DNA, 20 bp, Artificial
  CRISPR gRNA sequence
ctaggaagcaggagtccaga

SEQ ID NO: 49656 - DNA, 20 bp, Artificial
  CRISPR gRNA sequence
taggaagcaggagtccagat

SEQ ID NO: 49657 - DNA, 20 bp, Artificial
  CRISPR gRNA sequence
aggaagcaggagtccagatg

SEQ ID NO: 49658 - DNA, 20 bp, Artificial
  CRISPR gRNA sequence
aagcaggagtccagatgggg

SEQ ID NO: 49659 - DNA, 20 bp, Artificial
  CRISPR gRNA sequence
aggagtccagatggggcagc

SEQ ID NO: 49660 - DNA, 20 bp, Artificial
  CRISPR gRNA sequence
tccagatggggcagctggta

SEQ ID NO: 49661 - DNA, 20 bp, Artificial
  CRISPR gRNA sequence
gggcagctggtatggttgtg

SEQ ID NO: 49662 - DNA, 20 bp, Artificial
  CRISPR gRNA sequence
ggcagctggtatggttgtgc

SEQ ID NO: 49663 - DNA, 20 bp, Artificial
  CRISPR gRNA sequence
gtgcaggttgttcaccgcac

SEQ ID NO: 49664 - DNA, 20 bp, Artificial
  CRISPR gRNA sequence
tgcaggttgttcaccgcaca

SEQ ID NO: 49665 - DNA, 20 bp, Artificial
  CRISPR gRNA sequence
gttcaccgcacaaggacaca

SEQ ID NO: 49666 - DNA, 20 bp, Artificial
  CRISPR gRNA sequence
ccgcacaaggacacacagcc

SEQ ID NO: 49667 - DNA, 20 bp, Artificial
  CRISPR gRNA sequence
cgcacaaggacacacagccg

SEQ ID NO: 49668 - DNA, 20 bp, Artificial
  CRISPR gRNA sequence
cacaaggacacacagccgag

SEQ ID NO: 49669 - DNA, 20 bp, Artificial
  CRISPR gRNA sequence
acaaggacacacagccgagg

SEQ ID NO: 49670 - DNA, 20 bp, Artificial
  CRISPR gRNA sequence
ggacacacagccgaggaggt

SEQ ID NO: 49671 - DNA, 20 bp, Artificial
  CRISPR gRNA sequence
gacacacagccgaggaggtg

SEQ ID NO: 49672 - DNA, 20 bp, Artificial
  CRISPR gRNA sequence
cacagccgaggaggtgaggt

SEQ ID NO: 49673 - DNA, 20 bp, Artificial
  CRISPR gRNA sequence
acagccgaggaggtgaggtg

SEQ ID NO: 49674 - DNA, 20 bp, Artificial
  CRISPR gRNA sequence
cgaggaggtgaggtgaggct

SEQ ID NO: 49675 - DNA, 20 bp, Artificial
  CRISPR gRNA sequence
tcctaccatgctctatttcc

SEQ ID NO: 49676 - DNA, 20 bp, Artificial
  CRISPR gRNA sequence
tttcccagaatgtacacatg

SEQ ID NO: 49677 - DNA, 20 bp, Artificial
  CRISPR gRNA sequence
ttcccagaatgtacacatgc

SEQ ID NO: 49678 - DNA, 20 bp, Artificial
  CRISPR gRNA sequence
tcccagaatgtacacatgca

SEQ ID NO: 49679 - DNA, 20 bp, Artificial
  CRISPR gRNA sequence
gcagggctgcatccactcaa

SEQ ID NO: 49680 - DNA, 20 bp, Artificial
  CRISPR gRNA sequence
cagggctgcatccactcaaa

SEQ ID NO: 49681 - DNA, 20 bp, Artificial
  CRISPR gRNA sequence
agggctgcatccactcaaaa

SEQ ID NO: 49682 - DNA, 20 bp, Artificial
  CRISPR gRNA sequence
atttcccaaactgtgccata

SEQ ID NO: 49683 - DNA, 20 bp, Artificial
  CRISPR gRNA sequence
caaactgtgccatatggatt

SEQ ID NO: 49684 - DNA, 20 bp, Artificial
  CRISPR gRNA sequence
aactgtgccatatggattta

SEQ ID NO: 49685 - DNA, 20 bp, Artificial
  CRISPR gRNA sequence
actgtgccatatggatttag

SEQ ID NO: 49686 - DNA, 20 bp, Artificial
  CRISPR gRNA sequence
atttagaggtgctgtgaatc

SEQ ID NO: 49687 - DNA, 20 bp, Artificial
  CRISPR gRNA sequence
tttagaggtgctgtgaatcc

SEQ ID NO: 49688 - DNA, 20 bp, Artificial
  CRISPR gRNA sequence
ttagaggtgctgtgaatcca

SEQ ID NO: 49689 - DNA, 20 bp, Artificial
  CRISPR gRNA sequence
ctgtgaatccagggatctat

SEQ ID NO: 49690 - DNA, 20 bp, Artificial
  CRISPR gRNA sequence
gtgaatccagggatctataa

SEQ ID NO: 49691 - DNA, 20 bp, Artificial
  CRISPR gRNA sequence
aatccagggatctataagag

SEQ ID NO: 49692 - DNA, 20 bp, Artificial
  CRISPR gRNA sequence
ggatctataagagtggataa

SEQ ID NO: 49693 - DNA, 20 bp, Artificial
  CRISPR gRNA sequence
tctataagagtggataatgg

SEQ ID NO: 49694 - DNA, 20 bp, Artificial
  CRISPR gRNA sequence
gataatggaagtgtttgact

SEQ ID NO: 49695 - DNA, 20 bp, Artificial
  CRISPR gRNA sequence
ggaagtgtttgactaagcct

SEQ ID NO: 49696 - DNA, 20 bp, Artificial
  CRISPR gRNA sequence
gaagtgtttgactaagcctt

SEQ ID NO: 49697 - DNA, 20 bp, Artificial
  CRISPR gRNA sequence
aagtgtttgactaagccttg

SEQ ID NO: 49698 - DNA, 20 bp, Artificial
  CRISPR gRNA sequence
tttgactaagccttggggtc

SEQ ID NO: 49699 - DNA, 20 bp, Artificial
  CRISPR gRNA sequence
ttgactaagccttggggtcc

SEQ ID NO: 49700 - DNA, 20 bp, Artificial
  CRISPR gRNA sequence
tgactaagccttggggtcca

SEQ ID NO: 49701 - DNA, 20 bp, Artificial
  CRISPR gRNA sequence
gactaagccttggggtccag

SEQ ID NO: 49702 - DNA, 20 bp, Artificial
  CRISPR gRNA sequence
actaagccttggggtccagg

SEQ ID NO: 49703 - DNA, 20 bp, Artificial
  CRISPR gRNA sequence
ggggtccagggggcctccct

SEQ ID NO: 49704 - DNA, 20 bp, Artificial
  CRISPR gRNA sequence
gggtccagggggcctccctg

SEQ ID NO: 49705 - DNA, 20 bp, Artificial
  CRISPR gRNA sequence
tccagggggcctccctgagg

SEQ ID NO: 49706 - DNA, 20 bp, Artificial
  CRISPR gRNA sequence
agggggcctccctgaggtgg

SEQ ID NO: 49707 - DNA, 20 bp, Artificial
  CRISPR gRNA sequence
tccctgaggtggtggcattt

SEQ ID NO: 49708 - DNA, 20 bp, Artificial
  CRISPR gRNA sequence
gaggtggtggcatttaagct

SEQ ID NO: 49709 - DNA, 20 bp, Artificial
  CRISPR gRNA sequence
tggcatttaagctgagacct

SEQ ID NO: 49710 - DNA, 20 bp, Artificial
  CRISPR gRNA sequence
ggcatttaagctgagacctg

SEQ ID NO: 49711 - DNA, 20 bp, Artificial
  CRISPR gRNA sequence
gcatttaagctgagacctga

SEQ ID NO: 49712 - DNA, 20 bp, Artificial
  CRISPR gRNA sequence
taagctgagacctgagggat

SEQ ID NO: 49713 - DNA, 20 bp, Artificial
  CRISPR gRNA sequence
aagctgagacctgagggatg

SEQ ID NO: 49714 - DNA, 20 bp, Artificial
  CRISPR gRNA sequence
gctgagacctgagggatgag

SEQ ID NO: 49715 - DNA, 20 bp, Artificial
  CRISPR gRNA sequence
ctgagacctgagggatgagg

SEQ ID NO: 49716 - DNA, 20 bp, Artificial
  CRISPR gRNA sequence
gagacctgagggatgaggag

SEQ ID NO: 49717 - DNA, 20 bp, Artificial
  CRISPR gRNA sequence
cctgagggatgaggaggagt

SEQ ID NO: 49718 - DNA, 20 bp, Artificial
  CRISPR gRNA sequence
ctgagggatgaggaggagtt

SEQ ID NO: 49719 - DNA, 20 bp, Artificial
  CRISPR gRNA sequence
agggatgaggaggagttagg

SEQ ID NO: 49720 - DNA, 20 bp, Artificial
  CRISPR gRNA sequence
gggatgaggaggagttaggc

SEQ ID NO: 49721 - DNA, 20 bp, Artificial
  CRISPR gRNA sequence
gaggaggagttaggcaggtg

SEQ ID NO: 49722 - DNA, 20 bp, Artificial
  CRISPR gRNA sequence
gaggagttaggcaggtgaag

SEQ ID NO: 49723 - DNA, 20 bp, Artificial
  CRISPR gRNA sequence
aggagttaggcaggtgaagc

SEQ ID NO: 49724 - DNA, 20 bp, Artificial
  CRISPR gRNA sequence
agttaggcaggtgaagcagg

SEQ ID NO: 49725 - DNA, 20 bp, Artificial
  CRISPR gRNA sequence
gttaggcaggtgaagcaggt

SEQ ID NO: 49726 - DNA, 20 bp, Artificial
  CRISPR gRNA sequence
aggtgaagcaggtaggcgtg

SEQ ID NO: 49727 - DNA, 20 bp, Artificial
  CRISPR gRNA sequence
gtgaagcaggtaggcgtgaa

SEQ ID NO: 49728 - DNA, 20 bp, Artificial
  CRISPR gRNA sequence
taggcgtgaagagaacattc

SEQ ID NO: 49729 - DNA, 20 bp, Artificial
  CRISPR gRNA sequence
aggcgtgaagagaacattct

SEQ ID NO: 49730 - DNA, 20 bp, Artificial
  CRISPR gRNA sequence
cgtgaagagaacattctggg

SEQ ID NO: 49731 - DNA, 20 bp, Artificial
  CRISPR gRNA sequence
tgaagagaacattctgggca

SEQ ID NO: 49732 - DNA, 20 bp, Artificial
  CRISPR gRNA sequence
aagagaacattctgggcaga

SEQ ID NO: 49733 - DNA, 20 bp, Artificial
  CRISPR gRNA sequence
aacattctgggcagagagca

SEQ ID NO: 49734 - DNA, 20 bp, Artificial
  CRISPR gRNA sequence
acagcctgtgcaaatgccct

SEQ ID NO: 49735 - DNA, 20 bp, Artificial
  CRISPR gRNA sequence
cagcctgtgcaaatgcccta

SEQ ID NO: 49736 - DNA, 20 bp, Artificial
  CRISPR gRNA sequence
gtgcaaatgccctaaggtct

SEQ ID NO: 49737 - DNA, 20 bp, Artificial
  CRISPR gRNA sequence
aaatgccctaaggtctaagc

SEQ ID NO: 49738 - DNA, 20 bp, Artificial
  CRISPR gRNA sequence
gccctaaggtctaagcaaga

SEQ ID NO: 49739 - DNA, 20 bp, Artificial
  CRISPR gRNA sequence
ggtctaagcaagatggtgtt

SEQ ID NO: 49740 - DNA, 20 bp, Artificial
  CRISPR gRNA sequence
gtctaagcaagatggtgttc

SEQ ID NO: 49741 - DNA, 20 bp, Artificial
  CRISPR gRNA sequence
tctaagcaagatggtgttcg

SEQ ID NO: 49742 - DNA, 20 bp, Artificial
  CRISPR gRNA sequence
gatggtgttcggggaactga

SEQ ID NO: 49743 - DNA, 20 bp, Artificial
  CRISPR gRNA sequence
ttcggggaactgaaagttca

SEQ ID NO: 49744 - DNA, 20 bp, Artificial
  CRISPR gRNA sequence
tcggggaactgaaagttcat

SEQ ID NO: 49745 - DNA, 20 bp, Artificial
  CRISPR gRNA sequence
cggggaactgaaagttcatg

SEQ ID NO: 49746 - DNA, 20 bp, Artificial
  CRISPR gRNA sequence
ggggaactgaaagttcatgg

SEQ ID NO: 49747 - DNA, 20 bp, Artificial
  CRISPR gRNA sequence
tgaaagttcatgggggtgac

SEQ ID NO: 49748 - DNA, 20 bp, Artificial
  CRISPR gRNA sequence
aaagttcatgggggtgactg

SEQ ID NO: 49749 - DNA, 20 bp, Artificial
  CRISPR gRNA sequence
tcatgggggtgactggagct

SEQ ID NO: 49750 - DNA, 20 bp, Artificial
  CRISPR gRNA sequence
ggggtgactggagctgagac

SEQ ID NO: 49751 - DNA, 20 bp, Artificial
  CRISPR gRNA sequence
gggtgactggagctgagact

SEQ ID NO: 49752 - DNA, 20 bp, Artificial
  CRISPR gRNA sequence
ggtgactggagctgagactg

SEQ ID NO: 49753 - DNA, 20 bp, Artificial
  CRISPR gRNA sequence
ctggagctgagactggggcc

SEQ ID NO: 49754 - DNA, 20 bp, Artificial
  CRISPR gRNA sequence
ggagctgagactggggcctg

SEQ ID NO: 49755 - DNA, 20 bp, Artificial
  CRISPR gRNA sequence
gctgagactggggcctggag

SEQ ID NO: 49756 - DNA, 20 bp, Artificial
  CRISPR gRNA sequence
ctgagactggggcctggagt

SEQ ID NO: 49757 - DNA, 20 bp, Artificial
  CRISPR gRNA sequence
tgagactggggcctggagtg

SEQ ID NO: 49758 - DNA, 20 bp, Artificial
  CRISPR gRNA sequence
ggagtggggctgaaacgcct

SEQ ID NO: 49759 - DNA, 20 bp, Artificial
  CRISPR gRNA sequence
gtggggctgaaacgcctcag

SEQ ID NO: 49760 - DNA, 20 bp, Artificial
  CRISPR gRNA sequence
gggctgaaacgcctcagaag

SEQ ID NO: 49761 - DNA, 20 bp, Artificial
  CRISPR gRNA sequence
ggctgaaacgcctcagaagt

SEQ ID NO: 49762 - DNA, 20 bp, Artificial
  CRISPR gRNA sequence
gaaacgcctcagaagtgggt

SEQ ID NO: 49763 - DNA, 20 bp, Artificial
  CRISPR gRNA sequence
cgcctcagaagtgggttggt

SEQ ID NO: 49764 - DNA, 20 bp, Artificial
  CRISPR gRNA sequence
gtgggttggtcagacctctg

SEQ ID NO: 49765 - DNA, 20 bp, Artificial
  CRISPR gRNA sequence
agacctctgtagcctgtgta

SEQ ID NO: 49766 - DNA, 20 bp, Artificial
  CRISPR gRNA sequence
tgtaaagacttcgaacccct

SEQ ID NO: 49767 - DNA, 20 bp, Artificial
  CRISPR gRNA sequence
gtaaagacttcgaaccccta

SEQ ID NO: 49768 - DNA, 20 bp, Artificial
  CRISPR gRNA sequence
cttcgaacccctaaggtctc

SEQ ID NO: 49769 - DNA, 20 bp, Artificial
  CRISPR gRNA sequence
ttcgaacccctaaggtctct

SEQ ID NO: 49770 - DNA, 20 bp, Artificial
  CRISPR gRNA sequence
gaacccctaaggtctctggg

SEQ ID NO: 49771 - DNA, 20 bp, Artificial
  CRISPR gRNA sequence
aacccctaaggtctctgggc

SEQ ID NO: 49772 - DNA, 20 bp, Artificial
  CRISPR gRNA sequence
acccctaaggtctctgggca

SEQ ID NO: 49773 - DNA, 20 bp, Artificial
  CRISPR gRNA sequence
cctaaggtctctgggcaggg

SEQ ID NO: 49774 - DNA, 20 bp, Artificial
  CRISPR gRNA sequence
ctgggcagggtggtgaatat

SEQ ID NO: 49775 - DNA, 20 bp, Artificial
  CRISPR gRNA sequence
gcagggtggtgaatattggt

SEQ ID NO: 49776 - DNA, 20 bp, Artificial
  CRISPR gRNA sequence
gggtggtgaatattggtcag

SEQ ID NO: 49777 - DNA, 20 bp, Artificial
  CRISPR gRNA sequence
tggtgaatattggtcagaag

SEQ ID NO: 49778 - DNA, 20 bp, Artificial
  CRISPR gRNA sequence
ccctgccccctccccaacac

SEQ ID NO: 49779 - DNA, 20 bp, Artificial
  CRISPR gRNA sequence
cccaacaccagcccctgcct

SEQ ID NO: 49780 - DNA, 20 bp, Artificial
  CRISPR gRNA sequence
ccaacaccagcccctgcctt

SEQ ID NO: 49781 - DNA, 20 bp, Artificial
  CRISPR gRNA sequence
caacaccagcccctgccttg

SEQ ID NO: 49782 - DNA, 20 bp, Artificial
  CRISPR gRNA sequence
agcccctgccttggggtccc

SEQ ID NO: 49783 - DNA, 20 bp, Artificial
  CRISPR gRNA sequence
tgccttggggtccctggtgc

SEQ ID NO: 49784 - DNA, 20 bp, Artificial
  CRISPR gRNA sequence
gccttggggtccctggtgct

SEQ ID NO: 49785 - DNA, 20 bp, Artificial
  CRISPR gRNA sequence
cctggtgctgggtcccacct

SEQ ID NO: 49786 - DNA, 20 bp, Artificial
  CRISPR gRNA sequence
tgggtcccacctgagtgcca

SEQ ID NO: 49787 - DNA, 20 bp, Artificial
  CRISPR gRNA sequence
cacctgagtgccacagcttc

SEQ ID NO: 49788 - DNA, 20 bp, Artificial
  CRISPR gRNA sequence
cagcttctggattctcttcc

SEQ ID NO: 49789 - DNA, 20 bp, Artificial
  CRISPR gRNA sequence
ttctggattctcttcctggc

SEQ ID NO: 49790 - DNA, 20 bp, Artificial
  CRISPR gRNA sequence
tctggattctcttcctggcg

SEQ ID NO: 49791 - DNA, 20 bp, Artificial
  CRISPR gRNA sequence
tcttcctggcgaggaaattc

SEQ ID NO: 49792 - DNA, 20 bp, Artificial
  CRISPR gRNA sequence
cctggcgaggaaattccagc

SEQ ID NO: 49793 - DNA, 20 bp, Artificial
  CRISPR gRNA sequence
gaggaaattccagctggaca

SEQ ID NO: 49794 - DNA, 20 bp, Artificial
  CRISPR gRNA sequence
ggaaattccagctggacaca

SEQ ID NO: 49795 - DNA, 20 bp, Artificial
  CRISPR gRNA sequence
gctggacacagagctgctgc

SEQ ID NO: 49796 - DNA, 20 bp, Artificial
  CRISPR gRNA sequence
ctggacacagagctgctgct

SEQ ID NO: 49797 - DNA, 20 bp, Artificial
  CRISPR gRNA sequence
acagagctgctgctgggtct

SEQ ID NO: 49798 - DNA, 20 bp, Artificial
  CRISPR gRNA sequence
agagctgctgctgggtctcg

SEQ ID NO: 49799 - DNA, 20 bp, Artificial
  CRISPR gRNA sequence
tgctgggtctcggagatgct

SEQ ID NO: 49800 - DNA, 20 bp, Artificial
  CRISPR gRNA sequence
gctgggtctcggagatgctg

SEQ ID NO: 49801 - DNA, 20 bp, Artificial
  CRISPR gRNA sequence
tgggtctcggagatgctgag

SEQ ID NO: 49802 - DNA, 20 bp, Artificial
  CRISPR gRNA sequence
tctcggagatgctgaggagt

SEQ ID NO: 49803 - DNA, 20 bp, Artificial
  CRISPR gRNA sequence
cggagatgctgaggagtgag

SEQ ID NO: 49804 - DNA, 20 bp, Artificial
  CRISPR gRNA sequence
gagtgagcagtaaccaacgt

SEQ ID NO: 49805 - DNA, 20 bp, Artificial
  CRISPR gRNA sequence
agtgagcagtaaccaacgtg

SEQ ID NO: 49806 - DNA, 20 bp, Artificial
  CRISPR gRNA sequence
agcagtaaccaacgtgaggt

SEQ ID NO: 49807 - DNA, 20 bp, Artificial
  CRISPR gRNA sequence
gcagtaaccaacgtgaggtc

SEQ ID NO: 49808 - DNA, 20 bp, Artificial
  CRISPR gRNA sequence
gtaaccaacgtgaggtcggg

SEQ ID NO: 49809 - DNA, 20 bp, Artificial
  CRISPR gRNA sequence
tgaggtcgggcagccttccc

SEQ ID NO: 49810 - DNA, 20 bp, Artificial
  CRISPR gRNA sequence
aggtcgggcagccttccccg

SEQ ID NO: 49811 - DNA, 20 bp, Artificial
  CRISPR gRNA sequence
ggtcgggcagccttccccgg

SEQ ID NO: 49812 - DNA, 20 bp, Artificial
  CRISPR gRNA sequence
gtcgggcagccttccccgga

SEQ ID NO: 49813 - DNA, 20 bp, Artificial
  CRISPR gRNA sequence
gcagccttccccggagggcc

SEQ ID NO: 49814 - DNA, 20 bp, Artificial
  CRISPR gRNA sequence
ccttccccggagggcctagc

SEQ ID NO: 49815 - DNA, 20 bp, Artificial
  CRISPR gRNA sequence
cggagggcctagctggcacc

SEQ ID NO: 49816 - DNA, 20 bp, Artificial
  CRISPR gRNA sequence
ggagggcctagctggcacct

SEQ ID NO: 49817 - DNA, 20 bp, Artificial
  CRISPR gRNA sequence
tagctggcacctgggctgcc

SEQ ID NO: 49818 - DNA, 20 bp, Artificial
  CRISPR gRNA sequence
ctctgaactctcactttgcc

SEQ ID NO: 49819 - DNA, 20 bp, Artificial
  CRISPR gRNA sequence
tctgaactctcactttgcct

SEQ ID NO: 49820 - DNA, 20 bp, Artificial
  CRISPR gRNA sequence
tgggtccccttctcccctgc

SEQ ID NO: 49821 - DNA, 20 bp, Artificial
  CRISPR gRNA sequence
gggtccccttctcccctgcc

SEQ ID NO: 49822 - DNA, 20 bp, Artificial
  CRISPR gRNA sequence
ggtccccttctcccctgcca

SEQ ID NO: 49823 - DNA, 20 bp, Artificial
  CRISPR gRNA sequence
ccttctcccctgccagggac

SEQ ID NO: 49824 - DNA, 20 bp, Artificial
  CRISPR gRNA sequence
tcccctgccagggaccagct

SEQ ID NO: 49825 - DNA, 20 bp, Artificial
  CRISPR gRNA sequence
cccctgccagggaccagctt

SEQ ID NO: 49826 - DNA, 20 bp, Artificial
  CRISPR gRNA sequence
gccagggaccagcttaggac

SEQ ID NO: 49827 - DNA, 20 bp, Artificial
  CRISPR gRNA sequence
gggaccagcttaggactgga

SEQ ID NO: 49828 - DNA, 20 bp, Artificial
  CRISPR gRNA sequence
accagcttaggactggaaag

SEQ ID NO: 49829 - DNA, 20 bp, Artificial
  CRISPR gRNA sequence
ccagcttaggactggaaagt

SEQ ID NO: 49830 - DNA, 20 bp, Artificial
  CRISPR gRNA sequence
tggaaagtaggtgcttccgt

SEQ ID NO: 49831 - DNA, 20 bp, Artificial
  CRISPR gRNA sequence
tgagtcacacacaatacccc

SEQ ID NO: 49832 - DNA, 20 bp, Artificial
  CRISPR gRNA sequence
gtcacacacaataccccaag

SEQ ID NO: 49833 - DNA, 20 bp, Artificial
  CRISPR gRNA sequence
tttcttttttttttttttta

SEQ ID NO: 49834 - DNA, 20 bp, Artificial
  CRISPR gRNA sequence
tctttttttttttttttaaa

SEQ ID NO: 49835 - DNA, 20 bp, Artificial
  CRISPR gRNA sequence
tttttttttttttaaagaga

SEQ ID NO: 49836 - DNA, 20 bp, Artificial
  CRISPR gRNA sequence
ttttttttttttaaagagac

SEQ ID NO: 49837 - DNA, 20 bp, Artificial
  CRISPR gRNA sequence
tttttttttttaaagagaca

SEQ ID NO: 49838 - DNA, 20 bp, Artificial
  CRISPR gRNA sequence
agagacagggtcttgctctg

SEQ ID NO: 49839 - DNA, 20 bp, Artificial
  CRISPR gRNA sequence
cagggtcttgctctgtagcc

SEQ ID NO: 49840 - DNA, 20 bp, Artificial
  CRISPR gRNA sequence
agggtcttgctctgtagccc

SEQ ID NO: 49841 - DNA, 20 bp, Artificial
  CRISPR gRNA sequence
ttgctctgtagcccaggctg

SEQ ID NO: 49842 - DNA, 20 bp, Artificial
  CRISPR gRNA sequence
ctgtagcccaggctgaagtg

SEQ ID NO: 49843 - DNA, 20 bp, Artificial
  CRISPR gRNA sequence
tagcccaggctgaagtgcag

SEQ ID NO: 49844 - DNA, 20 bp, Artificial
  CRISPR gRNA sequence
cccaggctgaagtgcagtgg

SEQ ID NO: 49845 - DNA, 20 bp, Artificial
  CRISPR gRNA sequence
ccaggctgaagtgcagtggt

SEQ ID NO: 49846 - DNA, 20 bp, Artificial
  CRISPR gRNA sequence
tgcagtggtgggcacgatca

SEQ ID NO: 49847 - DNA, 20 bp, Artificial
  CRISPR gRNA sequence
ggcacgatcatagctcactg

SEQ ID NO: 49848 - DNA, 20 bp, Artificial
  CRISPR gRNA sequence
ctcactgcagccttgaactc

SEQ ID NO: 49849 - DNA, 20 bp, Artificial
  CRISPR gRNA sequence
tcactgcagccttgaactct

SEQ ID NO: 49850 - DNA, 20 bp, Artificial
  CRISPR gRNA sequence
cagccttgaactctgggctt

SEQ ID NO: 49851 - DNA, 20 bp, Artificial
  CRISPR gRNA sequence
cttcagtgatcctcctgcct

SEQ ID NO: 49852 - DNA, 20 bp, Artificial
  CRISPR gRNA sequence
cctcctgcctcggcctccca

SEQ ID NO: 49853 - DNA, 20 bp, Artificial
  CRISPR gRNA sequence
gcctcggcctcccaaagtgc

SEQ ID NO: 49854 - DNA, 20 bp, Artificial
  CRISPR gRNA sequence
cctcggcctcccaaagtgct

SEQ ID NO: 49855 - DNA, 20 bp, Artificial
  CRISPR gRNA sequence
ctcggcctcccaaagtgctg

SEQ ID NO: 49856 - DNA, 20 bp, Artificial
  CRISPR gRNA sequence
ctcccaaagtgctggggtta

SEQ ID NO: 49857 - DNA, 20 bp, Artificial
  CRISPR gRNA sequence
tcccaaagtgctggggttac

SEQ ID NO: 49858 - DNA, 20 bp, Artificial
  CRISPR gRNA sequence
agtgctggggttacaggcgt

SEQ ID NO: 49859 - DNA, 20 bp, Artificial
  CRISPR gRNA sequence
caggcgtgagccaccgcgcc

SEQ ID NO: 49860 - DNA, 20 bp, Artificial
  CRISPR gRNA sequence
tggcccttttcaacaattta

SEQ ID NO: 49861 - DNA, 20 bp, Artificial
  CRISPR gRNA sequence
ttcaacaatttaaagttaat

SEQ ID NO: 49862 - DNA, 20 bp, Artificial
  CRISPR gRNA sequence
tttaaagttaataagttgat

SEQ ID NO: 49863 - DNA, 20 bp, Artificial
  CRISPR gRNA sequence
aataagttgataagcctttt

SEQ ID NO: 49864 - DNA, 20 bp, Artificial
  CRISPR gRNA sequence
taagccttttcagaccatga

SEQ ID NO: 49865 - DNA, 20 bp, Artificial
  CRISPR gRNA sequence
ccttttcagaccatgacaga

SEQ ID NO: 49866 - DNA, 20 bp, Artificial
  CRISPR gRNA sequence
agaccatgacagaaagccat

SEQ ID NO: 49867 - DNA, 20 bp, Artificial
  CRISPR gRNA sequence
accatgacagaaagccatta

SEQ ID NO: 49868 - DNA, 20 bp, Artificial
  CRISPR gRNA sequence
ccatgacagaaagccattag

SEQ ID NO: 49869 - DNA, 20 bp, Artificial
  CRISPR gRNA sequence
catgacagaaagccattaga

SEQ ID NO: 49870 - DNA, 20 bp, Artificial
  CRISPR gRNA sequence
gaaagccattagagggatcc

SEQ ID NO: 49871 - DNA, 20 bp, Artificial
  CRISPR gRNA sequence
aaagccattagagggatcca

SEQ ID NO: 49872 - DNA, 20 bp, Artificial
  CRISPR gRNA sequence
aagccattagagggatccaa

SEQ ID NO: 49873 - DNA, 20 bp, Artificial
  CRISPR gRNA sequence
ccattagagggatccaaggg

SEQ ID NO: 49874 - DNA, 20 bp, Artificial
  CRISPR gRNA sequence
gagggatccaagggcagttc

SEQ ID NO: 49875 - DNA, 20 bp, Artificial
  CRISPR gRNA sequence
gggcagttccagaattttct

SEQ ID NO: 49876 - DNA, 20 bp, Artificial
  CRISPR gRNA sequence
ggcagttccagaattttctg

SEQ ID NO: 49877 - DNA, 20 bp, Artificial
  CRISPR gRNA sequence
gcagttccagaattttctga

SEQ ID NO: 49878 - DNA, 20 bp, Artificial
  CRISPR gRNA sequence
agttccagaattttctgagg

SEQ ID NO: 49879 - DNA, 20 bp, Artificial
  CRISPR gRNA sequence
gttccagaattttctgaggg

SEQ ID NO: 49880 - DNA, 20 bp, Artificial
  CRISPR gRNA sequence
ttccagaattttctgaggga

SEQ ID NO: 49881 - DNA, 20 bp, Artificial
  CRISPR gRNA sequence
tccagaattttctgagggag

SEQ ID NO: 49882 - DNA, 20 bp, Artificial
  CRISPR gRNA sequence
attttctgagggaggggcac

SEQ ID NO: 49883 - DNA, 20 bp, Artificial
  CRISPR gRNA sequence
ttttctgagggaggggcaca

SEQ ID NO: 49884 - DNA, 20 bp, Artificial
  CRISPR gRNA sequence
agggaggggcacaaggacca

SEQ ID NO: 49885 - DNA, 20 bp, Artificial
  CRISPR gRNA sequence
ggggcacaaggaccacagtg

SEQ ID NO: 49886 - DNA, 20 bp, Artificial
  CRISPR gRNA sequence
gcacaaggaccacagtgtgg

SEQ ID NO: 49887 - DNA, 20 bp, Artificial
  CRISPR gRNA sequence
caaggaccacagtgtggtgg

SEQ ID NO: 49888 - DNA, 20 bp, Artificial
  CRISPR gRNA sequence
aaggaccacagtgtggtgga

SEQ ID NO: 49889 - DNA, 20 bp, Artificial
  CRISPR gRNA sequence
aggaccacagtgtggtggaa

SEQ ID NO: 49890 - DNA, 20 bp, Artificial
  CRISPR gRNA sequence
accacagtgtggtggaaggg

SEQ ID NO: 49891 - DNA, 20 bp, Artificial
  CRISPR gRNA sequence
ccacagtgtggtggaagggt

SEQ ID NO: 49892 - DNA, 20 bp, Artificial
  CRISPR gRNA sequence
cacagtgtggtggaagggtg

SEQ ID NO: 49893 - DNA, 20 bp, Artificial
  CRISPR gRNA sequence
agtgtggtggaagggtgggg

SEQ ID NO: 49894 - DNA, 20 bp, Artificial
  CRISPR gRNA sequence
gtgtggtggaagggtggggt

SEQ ID NO: 49895 - DNA, 20 bp, Artificial
  CRISPR gRNA sequence
tgtggtggaagggtggggta

SEQ ID NO: 49896 - DNA, 20 bp, Artificial
  CRISPR gRNA sequence
gtggtggaagggtggggtag

SEQ ID NO: 49897 - DNA, 20 bp, Artificial
  CRISPR gRNA sequence
ggtggggtaggggatgtgtc

SEQ ID NO: 49898 - DNA, 20 bp, Artificial
  CRISPR gRNA sequence
tggggtaggggatgtgtctg

SEQ ID NO: 49899 - DNA, 20 bp, Artificial
  CRISPR gRNA sequence
ggagtctgcatttgcgctct

SEQ ID NO: 49900 - DNA, 20 bp, Artificial
  CRISPR gRNA sequence
tcacttgaatgttatgttca

SEQ ID NO: 49901 - DNA, 20 bp, Artificial
  CRISPR gRNA sequence
cacttgaatgttatgttcat

SEQ ID NO: 49902 - DNA, 20 bp, Artificial
  CRISPR gRNA sequence
acttgaatgttatgttcatg

SEQ ID NO: 49903 - DNA, 20 bp, Artificial
  CRISPR gRNA sequence
ttatgttcatggggtgctta

SEQ ID NO: 49904 - DNA, 20 bp, Artificial
  CRISPR gRNA sequence
tatgttcatggggtgcttat

SEQ ID NO: 49905 - DNA, 20 bp, Artificial
  CRISPR gRNA sequence
atgttcatggggtgcttatg

SEQ ID NO: 49906 - DNA, 20 bp, Artificial
  CRISPR gRNA sequence
gttcatggggtgcttatggg

SEQ ID NO: 49907 - DNA, 20 bp, Artificial
  CRISPR gRNA sequence
tcatggggtgcttatgggga

SEQ ID NO: 49908 - DNA, 20 bp, Artificial
  CRISPR gRNA sequence
catggggtgcttatggggag

SEQ ID NO: 49909 - DNA, 20 bp, Artificial
  CRISPR gRNA sequence
atggggtgcttatggggaga

SEQ ID NO: 49910 - DNA, 20 bp, Artificial
  CRISPR gRNA sequence
tgcttatggggagagggcta

SEQ ID NO: 49911 - DNA, 20 bp, Artificial
  CRISPR gRNA sequence
gcttatggggagagggctat

SEQ ID NO: 49912 - DNA, 20 bp, Artificial
  CRISPR gRNA sequence
ttatggggagagggctatgg

SEQ ID NO: 49913 - DNA, 20 bp, Artificial
  CRISPR gRNA sequence
gagggctatgggagattata

SEQ ID NO: 49914 - DNA, 20 bp, Artificial
  CRISPR gRNA sequence
atgggagattataaagtccc

SEQ ID NO: 49915 - DNA, 20 bp, Artificial
  CRISPR gRNA sequence
gggagattataaagtcccca

SEQ ID NO: 49916 - DNA, 20 bp, Artificial
  CRISPR gRNA sequence
agcatccccttgctcactcc

SEQ ID NO: 49917 - DNA, 20 bp, Artificial
  CRISPR gRNA sequence
catccccttgctcactcctg

SEQ ID NO: 49918 - DNA, 20 bp, Artificial
  CRISPR gRNA sequence
atccccttgctcactcctgg

SEQ ID NO: 49919 - DNA, 20 bp, Artificial
  CRISPR gRNA sequence
ccccttgctcactcctggag

SEQ ID NO: 49920 - DNA, 20 bp, Artificial
  CRISPR gRNA sequence
ccttgctcactcctggagga

SEQ ID NO: 49921 - DNA, 20 bp, Artificial
  CRISPR gRNA sequence
tgctcactcctggaggagag

SEQ ID NO: 49922 - DNA, 20 bp, Artificial
  CRISPR gRNA sequence
gctcactcctggaggagaga

SEQ ID NO: 49923 - DNA, 20 bp, Artificial
  CRISPR gRNA sequence
cactcctggaggagagaagg

SEQ ID NO: 49924 - DNA, 20 bp, Artificial
  CRISPR gRNA sequence
tcctggaggagagaaggaag

SEQ ID NO: 49925 - DNA, 20 bp, Artificial
  CRISPR gRNA sequence
tggaggagagaaggaagaag

SEQ ID NO: 49926 - DNA, 20 bp, Artificial
  CRISPR gRNA sequence
ggaggagagaaggaagaagc

SEQ ID NO: 49927 - DNA, 20 bp, Artificial
  CRISPR gRNA sequence
gaggagagaaggaagaagca

SEQ ID NO: 49928 - DNA, 20 bp, Artificial
  CRISPR gRNA sequence
gagagaaggaagaagcaggg

SEQ ID NO: 49929 - DNA, 20 bp, Artificial
  CRISPR gRNA sequence
agagaaggaagaagcagggc

SEQ ID NO: 49930 - DNA, 20 bp, Artificial
  CRISPR gRNA sequence
aagaagcagggcaggctgtg

SEQ ID NO: 49931 - DNA, 20 bp, Artificial
  CRISPR gRNA sequence
agcagggcaggctgtgtggc

SEQ ID NO: 49932 - DNA, 20 bp, Artificial
  CRISPR gRNA sequence
gcaggctgtgtggctggtga

SEQ ID NO: 49933 - DNA, 20 bp, Artificial
  CRISPR gRNA sequence
ctgtgtggctggtgacagta

SEQ ID NO: 49934 - DNA, 20 bp, Artificial
  CRISPR gRNA sequence
tgtggctggtgacagtacag

SEQ ID NO: 49935 - DNA, 20 bp, Artificial
  CRISPR gRNA sequence
cagtacagcagacatcttta

SEQ ID NO: 49936 - DNA, 20 bp, Artificial
  CRISPR gRNA sequence
agtacagcagacatctttac

SEQ ID NO: 49937 - DNA, 20 bp, Artificial
  CRISPR gRNA sequence
gcagacatctttacaggctc

SEQ ID NO: 49938 - DNA, 20 bp, Artificial
  CRISPR gRNA sequence
tccagttcttgtaatcctcc

SEQ ID NO: 49939 - DNA, 20 bp, Artificial
  CRISPR gRNA sequence
gtaatcctcccagccctgca

SEQ ID NO: 49940 - DNA, 20 bp, Artificial
  CRISPR gRNA sequence
taatcctcccagccctgcaa

SEQ ID NO: 49941 - DNA, 20 bp, Artificial
  CRISPR gRNA sequence
aatcctcccagccctgcaaa

SEQ ID NO: 49942 - DNA, 20 bp, Artificial
  CRISPR gRNA sequence
gccctgcaaagggccgtaat

SEQ ID NO: 49943 - DNA, 20 bp, Artificial
  CRISPR gRNA sequence
ggccgtaattagactctttt

SEQ ID NO: 49944 - DNA, 20 bp, Artificial
  CRISPR gRNA sequence
ccgtaattagactcttttaa

SEQ ID NO: 49945 - DNA, 20 bp, Artificial
  CRISPR gRNA sequence
taattagactcttttaagag

SEQ ID NO: 49946 - DNA, 20 bp, Artificial
  CRISPR gRNA sequence
aattagactcttttaagagc

SEQ ID NO: 49947 - DNA, 20 bp, Artificial
  CRISPR gRNA sequence
ttagactcttttaagagcag

SEQ ID NO: 49948 - DNA, 20 bp, Artificial
  CRISPR gRNA sequence
tagactcttttaagagcagg

SEQ ID NO: 49949 - DNA, 20 bp, Artificial
  CRISPR gRNA sequence
tcttttaagagcaggaggtt

SEQ ID NO: 49950 - DNA, 20 bp, Artificial
  CRISPR gRNA sequence
cttttaagagcaggaggttg

SEQ ID NO: 49951 - DNA, 20 bp, Artificial
  CRISPR gRNA sequence
taagagcaggaggttgaggt

SEQ ID NO: 49952 - DNA, 20 bp, Artificial
  CRISPR gRNA sequence
agagcaggaggttgaggtca

SEQ ID NO: 49953 - DNA, 20 bp, Artificial
  CRISPR gRNA sequence
agcaggaggttgaggtcaga

SEQ ID NO: 49954 - DNA, 20 bp, Artificial
  CRISPR gRNA sequence
aggttgaggtcagagagaca

SEQ ID NO: 49955 - DNA, 20 bp, Artificial
  CRISPR gRNA sequence
aggtcagagagacacagtaa

SEQ ID NO: 49956 - DNA, 20 bp, Artificial
  CRISPR gRNA sequence
ggtcagagagacacagtaat

SEQ ID NO: 49957 - DNA, 20 bp, Artificial
  CRISPR gRNA sequence
acacagtaatgggctccaac

SEQ ID NO: 49958 - DNA, 20 bp, Artificial
  CRISPR gRNA sequence
agtaatgggctccaaccagt

SEQ ID NO: 49959 - DNA, 20 bp, Artificial
  CRISPR gRNA sequence
gctccaaccagtaagtgact

SEQ ID NO: 49960 - DNA, 20 bp, Artificial
  CRISPR gRNA sequence
caaccagtaagtgactgagt

SEQ ID NO: 49961 - DNA, 20 bp, Artificial
  CRISPR gRNA sequence
aaccagtaagtgactgagtt

SEQ ID NO: 49962 - DNA, 20 bp, Artificial
  CRISPR gRNA sequence
actgagttgggatctgaaca

SEQ ID NO: 49963 - DNA, 20 bp, Artificial
  CRISPR gRNA sequence
gttgggatctgaacatagct

SEQ ID NO: 49964 - DNA, 20 bp, Artificial
  CRISPR gRNA sequence
gggatctgaacatagctgag

SEQ ID NO: 49965 - DNA, 20 bp, Artificial
  CRISPR gRNA sequence
ggatctgaacatagctgagt

SEQ ID NO: 49966 - DNA, 20 bp, Artificial
  CRISPR gRNA sequence
gatgctaaaacctttgctat

SEQ ID NO: 49967 - DNA, 20 bp, Artificial
  CRISPR gRNA sequence
gtgtgtcattgtgttatttc

SEQ ID NO: 49968 - DNA, 20 bp, Artificial
  CRISPR gRNA sequence
cattgtgttatttctggttg

SEQ ID NO: 49969 - DNA, 20 bp, Artificial
  CRISPR gRNA sequence
ttgtgttatttctggttgaa

SEQ ID NO: 49970 - DNA, 20 bp, Artificial
  CRISPR gRNA sequence
ataatgtgtgttactgcatc

SEQ ID NO: 49971 - DNA, 20 bp, Artificial
  CRISPR gRNA sequence
taatgtgtgttactgcatct

SEQ ID NO: 49972 - DNA, 20 bp, Artificial
  CRISPR gRNA sequence
aatgtgtgttactgcatctg

SEQ ID NO: 49973 - DNA, 20 bp, Artificial
  CRISPR gRNA sequence
atgtgtgttactgcatctgg

SEQ ID NO: 49974 - DNA, 20 bp, Artificial
  CRISPR gRNA sequence
tgtgtgttactgcatctggg

SEQ ID NO: 49975 - DNA, 20 bp, Artificial
  CRISPR gRNA sequence
gcatctggggggccacttcc

SEQ ID NO: 49976 - DNA, 20 bp, Artificial
  CRISPR gRNA sequence
gggggccacttccaagcaac

SEQ ID NO: 49977 - DNA, 20 bp, Artificial
  CRISPR gRNA sequence
ccacttccaagcaaccagcg

SEQ ID NO: 49978 - DNA, 20 bp, Artificial
  CRISPR gRNA sequence
aagcaaccagcgtggactcc

SEQ ID NO: 49979 - DNA, 20 bp, Artificial
  CRISPR gRNA sequence
gactcccagccatgtctgcc

SEQ ID NO: 49980 - DNA, 20 bp, Artificial
  CRISPR gRNA sequence
ccatgtctgcctggatccaa

SEQ ID NO: 49981 - DNA, 20 bp, Artificial
  CRISPR gRNA sequence
atagccctttgttttgattc

SEQ ID NO: 49982 - DNA, 20 bp, Artificial
  CRISPR gRNA sequence
tagccctttgttttgattct

SEQ ID NO: 49983 - DNA, 20 bp, Artificial
  CRISPR gRNA sequence
agccctttgttttgattctg

SEQ ID NO: 49984 - DNA, 20 bp, Artificial
  CRISPR gRNA sequence
gatgtcttcctctgacactg

SEQ ID NO: 49985 - DNA, 20 bp, Artificial
  CRISPR gRNA sequence
ctgtggcttgactactgcac

SEQ ID NO: 49986 - DNA, 20 bp, Artificial
  CRISPR gRNA sequence
cactagtcccaacaaatgtg

SEQ ID NO: 49987 - DNA, 20 bp, Artificial
  CRISPR gRNA sequence
gtagcccctcacatatgccc

SEQ ID NO: 49988 - DNA, 20 bp, Artificial
  CRISPR gRNA sequence
tagcccctcacatatgcccc

SEQ ID NO: 49989 - DNA, 20 bp, Artificial
  CRISPR gRNA sequence
gcccctcacatatgccccag

SEQ ID NO: 49990 - DNA, 20 bp, Artificial
  CRISPR gRNA sequence
cccaggagctcctgctaccc

SEQ ID NO: 49991 - DNA, 20 bp, Artificial
  CRISPR gRNA sequence
ccaggagctcctgctaccct

SEQ ID NO: 49992 - DNA, 20 bp, Artificial
  CRISPR gRNA sequence
caggagctcctgctaccctg

SEQ ID NO: 49993 - DNA, 20 bp, Artificial
  CRISPR gRNA sequence
ctcctgctaccctggggaca

SEQ ID NO: 49994 - DNA, 20 bp, Artificial
  CRISPR gRNA sequence
accctggggacatggaaaac

SEQ ID NO: 49995 - DNA, 20 bp, Artificial
  CRISPR gRNA sequence
tggggacatggaaaactagc

SEQ ID NO: 49996 - DNA, 20 bp, Artificial
  CRISPR gRNA sequence
tggaaaactagctggtgaca

SEQ ID NO: 49997 - DNA, 20 bp, Artificial
  CRISPR gRNA sequence
gtgacacagctattacccca

SEQ ID NO: 49998 - DNA, 20 bp, Artificial
  CRISPR gRNA sequence
tgacacagctattaccccac

SEQ ID NO: 49999 - DNA, 20 bp, Artificial
  CRISPR gRNA sequence
cagctattaccccacaggat

SEQ ID NO: 50000 - DNA, 20 bp, Artificial
  CRISPR gRNA sequence
agctattaccccacaggatg

SEQ ID NO: 50001 - DNA, 20 bp, Artificial
  CRISPR gRNA sequence
gctattaccccacaggatga

SEQ ID NO: 50002 - DNA, 20 bp, Artificial
  CRISPR gRNA sequence
attaccccacaggatgaggg

SEQ ID NO: 50003 - DNA, 20 bp, Artificial
  CRISPR gRNA sequence
ttaccccacaggatgaggga

SEQ ID NO: 50004 - DNA, 20 bp, Artificial
  CRISPR gRNA sequence
ccacaggatgagggaaggtc

SEQ ID NO: 50005 - DNA, 20 bp, Artificial
  CRISPR gRNA sequence
cacaggatgagggaaggtca

SEQ ID NO: 50006 - DNA, 20 bp, Artificial
  CRISPR gRNA sequence
gatgagggaaggtcaaggaa

SEQ ID NO: 50007 - DNA, 20 bp, Artificial
  CRISPR gRNA sequence
aaaagtcccaatgcttatga

SEQ ID NO: 50008 - DNA, 20 bp, Artificial
  CRISPR gRNA sequence
cccaatgcttatgaaagatg

SEQ ID NO: 50009 - DNA, 20 bp, Artificial
  CRISPR gRNA sequence
atgaaagatgaagaattcca

SEQ ID NO: 50010 - DNA, 20 bp, Artificial
  CRISPR gRNA sequence
tgaaagatgaagaattccaa

SEQ ID NO: 50011 - DNA, 20 bp, Artificial
  CRISPR gRNA sequence
gaaagatgaagaattccaaa

SEQ ID NO: 50012 - DNA, 20 bp, Artificial
  CRISPR gRNA sequence
aaagatgaagaattccaaag

SEQ ID NO: 50013 - DNA, 20 bp, Artificial
  CRISPR gRNA sequence
ttccaaaggggcctcttctc

SEQ ID NO: 50014 - DNA, 20 bp, Artificial
  CRISPR gRNA sequence
tctctggactcacctgattt

SEQ ID NO: 50015 - DNA, 20 bp, Artificial
  CRISPR gRNA sequence
tgatttcagtgacactgcct

SEQ ID NO: 50016 - DNA, 20 bp, Artificial
  CRISPR gRNA sequence
gatttcagtgacactgcctg

SEQ ID NO: 50017 - DNA, 20 bp, Artificial
  CRISPR gRNA sequence
cagtgacactgcctgaggcc

SEQ ID NO: 50018 - DNA, 20 bp, Artificial
  CRISPR gRNA sequence
agtgacactgcctgaggcct

SEQ ID NO: 50019 - DNA, 20 bp, Artificial
  CRISPR gRNA sequence
cactgcctgaggcctgggcg

SEQ ID NO: 50020 - DNA, 20 bp, Artificial
  CRISPR gRNA sequence
gcctgggcgcagacttctaa

SEQ ID NO: 50021 - DNA, 20 bp, Artificial
  CRISPR gRNA sequence
cctgggcgcagacttctaac

SEQ ID NO: 50022 - DNA, 20 bp, Artificial
  CRISPR gRNA sequence
ctgggcgcagacttctaaca

SEQ ID NO: 50023 - DNA, 20 bp, Artificial
  CRISPR gRNA sequence
gggcgcagacttctaacagg

SEQ ID NO: 50024 - DNA, 20 bp, Artificial
  CRISPR gRNA sequence
gcgcagacttctaacaggga

SEQ ID NO: 50025 - DNA, 20 bp, Artificial
  CRISPR gRNA sequence
ttctaacagggagagaaccc

SEQ ID NO: 50026 - DNA, 20 bp, Artificial
  CRISPR gRNA sequence
accctggctctgtccgccca

SEQ ID NO: 50027 - DNA, 20 bp, Artificial
  CRISPR gRNA sequence
acggctcctgcaccctgtca

SEQ ID NO: 50028 - DNA, 20 bp, Artificial
  CRISPR gRNA sequence
gctcctgcaccctgtcacag

SEQ ID NO: 50029 - DNA, 20 bp, Artificial
  CRISPR gRNA sequence
ctcctgcaccctgtcacaga

SEQ ID NO: 50030 - DNA, 20 bp, Artificial
  CRISPR gRNA sequence
tcctgcaccctgtcacagaa

SEQ ID NO: 50031 - DNA, 20 bp, Artificial
  CRISPR gRNA sequence
cctgcaccctgtcacagaag

SEQ ID NO: 50032 - DNA, 20 bp, Artificial
  CRISPR gRNA sequence
ccctgtcacagaaggggaca

SEQ ID NO: 50033 - DNA, 20 bp, Artificial
  CRISPR gRNA sequence
tcacagaaggggacacagat

SEQ ID NO: 50034 - DNA, 20 bp, Artificial
  CRISPR gRNA sequence
cacagaaggggacacagata

SEQ ID NO: 50035 - DNA, 20 bp, Artificial
  CRISPR gRNA sequence
gacacagataaggccccccc

SEQ ID NO: 50036 - DNA, 20 bp, Artificial
  CRISPR gRNA sequence
acacagataaggccccccca

SEQ ID NO: 50037 - DNA, 20 bp, Artificial
  CRISPR gRNA sequence
agataaggcccccccaaggt

SEQ ID NO: 50038 - DNA, 20 bp, Artificial
  CRISPR gRNA sequence
taaggcccccccaaggtgag

SEQ ID NO: 50039 - DNA, 20 bp, Artificial
  CRISPR gRNA sequence
ggcccccccaaggtgagcag

SEQ ID NO: 50040 - DNA, 20 bp, Artificial
  CRISPR gRNA sequence
caaggtgagcagcagacaat

SEQ ID NO: 50041 - DNA, 20 bp, Artificial
  CRISPR gRNA sequence
cagacaatcagcacacatga

SEQ ID NO: 50042 - DNA, 20 bp, Artificial
  CRISPR gRNA sequence
agacaatcagcacacatgac

SEQ ID NO: 50043 - DNA, 20 bp, Artificial
  CRISPR gRNA sequence
gacaatcagcacacatgacg

SEQ ID NO: 50044 - DNA, 20 bp, Artificial
  CRISPR gRNA sequence
atcagcacacatgacggggc

SEQ ID NO: 50045 - DNA, 20 bp, Artificial
  CRISPR gRNA sequence
tcagcacacatgacggggcc

SEQ ID NO: 50046 - DNA, 20 bp, Artificial
  CRISPR gRNA sequence
cagcacacatgacggggccg

SEQ ID NO: 50047 - DNA, 20 bp, Artificial
  CRISPR gRNA sequence
agcacacatgacggggccgg

SEQ ID NO: 50048 - DNA, 20 bp, Artificial
  CRISPR gRNA sequence
cacacatgacggggccgggg

SEQ ID NO: 50049 - DNA, 20 bp, Artificial
  CRISPR gRNA sequence
acacatgacggggccggggg

SEQ ID NO: 50050 - DNA, 20 bp, Artificial
  CRISPR gRNA sequence
acatgacggggccgggggag

SEQ ID NO: 50051 - DNA, 20 bp, Artificial
  CRISPR gRNA sequence
ggggccgggggaggagtgtc

SEQ ID NO: 50052 - DNA, 20 bp, Artificial
  CRISPR gRNA sequence
gggccgggggaggagtgtca

SEQ ID NO: 50053 - DNA, 20 bp, Artificial
  CRISPR gRNA sequence
ggccgggggaggagtgtcaa

SEQ ID NO: 50054 - DNA, 20 bp, Artificial
  CRISPR gRNA sequence
gccgggggaggagtgtcaag

SEQ ID NO: 50055 - DNA, 20 bp, Artificial
  CRISPR gRNA sequence
ccgggggaggagtgtcaagg

SEQ ID NO: 50056 - DNA, 20 bp, Artificial
  CRISPR gRNA sequence
cgggggaggagtgtcaaggg

SEQ ID NO: 50057 - DNA, 20 bp, Artificial
  CRISPR gRNA sequence
gggggaggagtgtcaagggg

SEQ ID NO: 50058 - DNA, 20 bp, Artificial
  CRISPR gRNA sequence
ggagtgtcaagggggggacc

SEQ ID NO: 50059 - DNA, 20 bp, Artificial
  CRISPR gRNA sequence
agtgtcaagggggggaccta

SEQ ID NO: 50060 - DNA, 20 bp, Artificial
  CRISPR gRNA sequence
gtgtcaagggggggacctag

SEQ ID NO: 50061 - DNA, 20 bp, Artificial
  CRISPR gRNA sequence
gggggacctagaggcttttt

SEQ ID NO: 50062 - DNA, 20 bp, Artificial
  CRISPR gRNA sequence
ttaaaactataaaattatac

SEQ ID NO: 50063 - DNA, 20 bp, Artificial
  CRISPR gRNA sequence
aaactataaaattatacaag

SEQ ID NO: 50064 - DNA, 20 bp, Artificial
  CRISPR gRNA sequence
aactataaaattatacaagt

SEQ ID NO: 50065 - DNA, 20 bp, Artificial
  CRISPR gRNA sequence
aagtaggcatcaatctaaaa

SEQ ID NO: 50066 - DNA, 20 bp, Artificial
  CRISPR gRNA sequence
agtaggcatcaatctaaaaa

SEQ ID NO: 50067 - DNA, 20 bp, Artificial
  CRISPR gRNA sequence
tattgttgtgacaatccaaa

SEQ ID NO: 50068 - DNA, 20 bp, Artificial
  CRISPR gRNA sequence
tcttatcttattttattttt

SEQ ID NO: 50069 - DNA, 20 bp, Artificial
  CRISPR gRNA sequence
atcttattttatttttgaga

SEQ ID NO: 50070 - DNA, 20 bp, Artificial
  CRISPR gRNA sequence
cttattttatttttgagaca

SEQ ID NO: 50071 - DNA, 20 bp, Artificial
  CRISPR gRNA sequence
agagttttgctcttgttgcc

SEQ ID NO: 50072 - DNA, 20 bp, Artificial
  CRISPR gRNA sequence
tttgctcttgttgcccagac

SEQ ID NO: 50073 - DNA, 20 bp, Artificial
  CRISPR gRNA sequence
tgctcttgttgcccagactg

SEQ ID NO: 50074 - DNA, 20 bp, Artificial
  CRISPR gRNA sequence
ttgcccagactggagtgcaa

SEQ ID NO: 50075 - DNA, 20 bp, Artificial
  CRISPR gRNA sequence
ggagtgcaatggcatgatct

SEQ ID NO: 50076 - DNA, 20 bp, Artificial
  CRISPR gRNA sequence
tcactgcaacctctgcctcc

SEQ ID NO: 50077 - DNA, 20 bp, Artificial
  CRISPR gRNA sequence
cactgcaacctctgcctcct

SEQ ID NO: 50078 - DNA, 20 bp, Artificial
  CRISPR gRNA sequence
aacctctgcctcctgggttc

SEQ ID NO: 50079 - DNA, 20 bp, Artificial
  CRISPR gRNA sequence
ttcaagcgattctcctgcct

SEQ ID NO: 50080 - DNA, 20 bp, Artificial
  CRISPR gRNA sequence
ttctcctgcctcagcctccc

SEQ ID NO: 50081 - DNA, 20 bp, Artificial
  CRISPR gRNA sequence
tcctgcctcagcctcccaag

SEQ ID NO: 50082 - DNA, 20 bp, Artificial
  CRISPR gRNA sequence
gcctcagcctcccaagtagc

SEQ ID NO: 50083 - DNA, 20 bp, Artificial
  CRISPR gRNA sequence
cctcagcctcccaagtagct

SEQ ID NO: 50084 - DNA, 20 bp, Artificial
  CRISPR gRNA sequence
ctcccaagtagctgggatta

SEQ ID NO: 50085 - DNA, 20 bp, Artificial
  CRISPR gRNA sequence
tcccaagtagctgggattac

SEQ ID NO: 50086 - DNA, 20 bp, Artificial
  CRISPR gRNA sequence
caggcatgcgccaccacgcc

SEQ ID NO: 50087 - DNA, 20 bp, Artificial
  CRISPR gRNA sequence
ctggctaatttttgtatttt

SEQ ID NO: 50088 - DNA, 20 bp, Artificial
  CRISPR gRNA sequence
gctaatttttgtatttttag

SEQ ID NO: 50089 - DNA, 20 bp, Artificial
  CRISPR gRNA sequence
taatttttgtatttttagta

SEQ ID NO: 50090 - DNA, 20 bp, Artificial
  CRISPR gRNA sequence
ttttgtatttttagtagaga

SEQ ID NO: 50091 - DNA, 20 bp, Artificial
  CRISPR gRNA sequence
tttgtatttttagtagagat

SEQ ID NO: 50092 - DNA, 20 bp, Artificial
  CRISPR gRNA sequence
ttgtatttttagtagagatg

SEQ ID NO: 50093 - DNA, 20 bp, Artificial
  CRISPR gRNA sequence
gagatggggtttcaccatgt

SEQ ID NO: 50094 - DNA, 20 bp, Artificial
  CRISPR gRNA sequence
tggggtttcaccatgttggt

SEQ ID NO: 50095 - DNA, 20 bp, Artificial
  CRISPR gRNA sequence
ggggtttcaccatgttggtc

SEQ ID NO: 50096 - DNA, 20 bp, Artificial
  CRISPR gRNA sequence
tttcaccatgttggtcaggc

SEQ ID NO: 50097 - DNA, 20 bp, Artificial
  CRISPR gRNA sequence
ggtcttgaactcctgacctc

SEQ ID NO: 50098 - DNA, 20 bp, Artificial
  CRISPR gRNA sequence
ctcaagtgatccacctgcct

SEQ ID NO: 50099 - DNA, 20 bp, Artificial
  CRISPR gRNA sequence
ccacctgcctcggcctccca

SEQ ID NO: 50100 - DNA, 20 bp, Artificial
  CRISPR gRNA sequence
gcctcggcctcccaaagtgc

SEQ ID NO: 50101 - DNA, 20 bp, Artificial
  CRISPR gRNA sequence
cctcggcctcccaaagtgct

SEQ ID NO: 50102 - DNA, 20 bp, Artificial
  CRISPR gRNA sequence
ctcccaaagtgctgggatta

SEQ ID NO: 50103 - DNA, 20 bp, Artificial
  CRISPR gRNA sequence
tcccaaagtgctgggattac

SEQ ID NO: 50104 - DNA, 20 bp, Artificial
  CRISPR gRNA sequence
agtgctgggattacaggcgt

SEQ ID NO: 50105 - DNA, 20 bp, Artificial
  CRISPR gRNA sequence
acaggcgtgagccactgcac

SEQ ID NO: 50106 - DNA, 20 bp, Artificial
  CRISPR gRNA sequence
caggcgtgagccactgcact

SEQ ID NO: 50107 - DNA, 20 bp, Artificial
  CRISPR gRNA sequence
cactgggccactgatatttt

SEQ ID NO: 50108 - DNA, 20 bp, Artificial
  CRISPR gRNA sequence
ccactgatatttttagattt

SEQ ID NO: 50109 - DNA, 20 bp, Artificial
  CRISPR gRNA sequence
gatatttttagatttaagaa

SEQ ID NO: 50110 - DNA, 20 bp, Artificial
  CRISPR gRNA sequence
tcacataatgttacatcaca

SEQ ID NO: 50111 - DNA, 20 bp, Artificial
  CRISPR gRNA sequence
cacataatgttacatcacaa

SEQ ID NO: 50112 - DNA, 20 bp, Artificial
  CRISPR gRNA sequence
taatgttacatcacaaaggt

SEQ ID NO: 50113 - DNA, 20 bp, Artificial
  CRISPR gRNA sequence
aatgttacatcacaaaggta

SEQ ID NO: 50114 - DNA, 20 bp, Artificial
  CRISPR gRNA sequence
ccaattttgcatttcaaaaa

SEQ ID NO: 50115 - DNA, 20 bp, Artificial
  CRISPR gRNA sequence
caattttgcatttcaaaaaa

SEQ ID NO: 50116 - DNA, 20 bp, Artificial
  CRISPR gRNA sequence
tttgcatttcaaaaaaagga

SEQ ID NO: 50117 - DNA, 20 bp, Artificial
  CRISPR gRNA sequence
ttcaaaaaaaggaaagtatt

SEQ ID NO: 50118 - DNA, 20 bp, Artificial
  CRISPR gRNA sequence
caaaaaaaggaaagtatttg

SEQ ID NO: 50119 - DNA, 20 bp, Artificial
  CRISPR gRNA sequence
ggaaagtatttggagaaaaa

SEQ ID NO: 50120 - DNA, 20 bp, Artificial
  CRISPR gRNA sequence
gtatttggagaaaaaaagtg

SEQ ID NO: 50121 - DNA, 20 bp, Artificial
  CRISPR gRNA sequence
ttggagaaaaaaagtgtgga

SEQ ID NO: 50122 - DNA, 20 bp, Artificial
  CRISPR gRNA sequence
aaaaaaagtgtggaaagaaa

SEQ ID NO: 50123 - DNA, 20 bp, Artificial
  CRISPR gRNA sequence
aaaaaagtgtggaaagaaac

SEQ ID NO: 50124 - DNA, 20 bp, Artificial
  CRISPR gRNA sequence
aaaaagtgtggaaagaaaca

SEQ ID NO: 50125 - DNA, 20 bp, Artificial
  CRISPR gRNA sequence
aaagtgtggaaagaaacagg

SEQ ID NO: 50126 - DNA, 20 bp, Artificial
  CRISPR gRNA sequence
agtgtggaaagaaacaggga

SEQ ID NO: 50127 - DNA, 20 bp, Artificial
  CRISPR gRNA sequence
tgtggaaagaaacagggaga

SEQ ID NO: 50128 - DNA, 20 bp, Artificial
  CRISPR gRNA sequence
gaaacagggagagagatgtg

SEQ ID NO: 50129 - DNA, 20 bp, Artificial
  CRISPR gRNA sequence
agagagatgtgtggaaaaca

SEQ ID NO: 50130 - DNA, 20 bp, Artificial
  CRISPR gRNA sequence
gagagatgtgtggaaaacat

SEQ ID NO: 50131 - DNA, 20 bp, Artificial
  CRISPR gRNA sequence
gaaaatatattaaatgttca

SEQ ID NO: 50132 - DNA, 20 bp, Artificial
  CRISPR gRNA sequence
aatatattaaatgttcatgg

SEQ ID NO: 50133 - DNA, 20 bp, Artificial
  CRISPR gRNA sequence
aatgttcatggtggttgttt

SEQ ID NO: 50134 - DNA, 20 bp, Artificial
  CRISPR gRNA sequence
atggtggttgtttaagatga

SEQ ID NO: 50135 - DNA, 20 bp, Artificial
  CRISPR gRNA sequence
taagatgatagaattctcat

SEQ ID NO: 50136 - DNA, 20 bp, Artificial
  CRISPR gRNA sequence
atgcatgtgcattaatttga

SEQ ID NO: 50137 - DNA, 20 bp, Artificial
  CRISPR gRNA sequence
catgtgcattaatttgaaag

SEQ ID NO: 50138 - DNA, 20 bp, Artificial
  CRISPR gRNA sequence
atgtgcattaatttgaaagt

SEQ ID NO: 50139 - DNA, 20 bp, Artificial
  CRISPR gRNA sequence
ttaatttgaaagtaggaaaa

SEQ ID NO: 50140 - DNA, 20 bp, Artificial
  CRISPR gRNA sequence
aatttgaaagtaggaaaaaa

SEQ ID NO: 50141 - DNA, 20 bp, Artificial
  CRISPR gRNA sequence
aagtaggaaaaaagagaatt

SEQ ID NO: 50142 - DNA, 20 bp, Artificial
  CRISPR gRNA sequence
agtcaaatattactgcttta

SEQ ID NO: 50143 - DNA, 20 bp, Artificial
  CRISPR gRNA sequence
aaagttatgctgaattttta

SEQ ID NO: 50144 - DNA, 20 bp, Artificial
  CRISPR gRNA sequence
ctattttctttatgtatttc

SEQ ID NO: 50145 - DNA, 20 bp, Artificial
  CRISPR gRNA sequence
ttttttatttttattttttg

SEQ ID NO: 50146 - DNA, 20 bp, Artificial
  CRISPR gRNA sequence
atttttattttttgtagata

SEQ ID NO: 50147 - DNA, 20 bp, Artificial
  CRISPR gRNA sequence
tttttattttttgtagatat

SEQ ID NO: 50148 - DNA, 20 bp, Artificial
  CRISPR gRNA sequence
ttttattttttgtagatatg

SEQ ID NO: 50149 - DNA, 20 bp, Artificial
  CRISPR gRNA sequence
tggggttttgccatgttgtc

SEQ ID NO: 50150 - DNA, 20 bp, Artificial
  CRISPR gRNA sequence
ggggttttgccatgttgtcc

SEQ ID NO: 50151 - DNA, 20 bp, Artificial
  CRISPR gRNA sequence
ttttgccatgttgtccaggc

SEQ ID NO: 50152 - DNA, 20 bp, Artificial
  CRISPR gRNA sequence
caggctggtcttgaacgcct

SEQ ID NO: 50153 - DNA, 20 bp, Artificial
  CRISPR gRNA sequence
ctcaaacaatctgcccacct

SEQ ID NO: 50154 - DNA, 20 bp, Artificial
  CRISPR gRNA sequence
ctgcccacctcagcctccca

SEQ ID NO: 50155 - DNA, 20 bp, Artificial
  CRISPR gRNA sequence
acctcagcctcccaaagtgt

SEQ ID NO: 50156 - DNA, 20 bp, Artificial
  CRISPR gRNA sequence
cctcagcctcccaaagtgtt

SEQ ID NO: 50157 - DNA, 20 bp, Artificial
  CRISPR gRNA sequence
ctcccaaagtgttgggatta

SEQ ID NO: 50158 - DNA, 20 bp, Artificial
  CRISPR gRNA sequence
tcccaaagtgttgggattac

SEQ ID NO: 50159 - DNA, 20 bp, Artificial
  CRISPR gRNA sequence
cccccaaccaatattatttt

SEQ ID NO: 50160 - DNA, 20 bp, Artificial
  CRISPR gRNA sequence
accaatattatttttagact

SEQ ID NO: 50161 - DNA, 20 bp, Artificial
  CRISPR gRNA sequence
tattatttttagactaagaa

SEQ ID NO: 50162 - DNA, 20 bp, Artificial
  CRISPR gRNA sequence
tttatttgaaaatgttattt

SEQ ID NO: 50163 - DNA, 20 bp, Artificial
  CRISPR gRNA sequence
tttgaaaatgttattttggc

SEQ ID NO: 50164 - DNA, 20 bp, Artificial
  CRISPR gRNA sequence
ttgaaaatgttattttggct

SEQ ID NO: 50165 - DNA, 20 bp, Artificial
  CRISPR gRNA sequence
aatgttattttggctgggtg

SEQ ID NO: 50166 - DNA, 20 bp, Artificial
  CRISPR gRNA sequence
gttattttggctgggtgcag

SEQ ID NO: 50167 - DNA, 20 bp, Artificial
  CRISPR gRNA sequence
gtggctcacacctgtaatcc

SEQ ID NO: 50168 - DNA, 20 bp, Artificial
  CRISPR gRNA sequence
cacctgtaatcccagcactt

SEQ ID NO: 50169 - DNA, 20 bp, Artificial
  CRISPR gRNA sequence
acctgtaatcccagcacttt

SEQ ID NO: 50170 - DNA, 20 bp, Artificial
  CRISPR gRNA sequence
ctgtaatcccagcactttgg

SEQ ID NO: 50171 - DNA, 20 bp, Artificial
  CRISPR gRNA sequence
tgtaatcccagcactttggg

SEQ ID NO: 50172 - DNA, 20 bp, Artificial
  CRISPR gRNA sequence
tcccagcactttgggaggct

SEQ ID NO: 50173 - DNA, 20 bp, Artificial
  CRISPR gRNA sequence
cccagcactttgggaggctg

SEQ ID NO: 50174 - DNA, 20 bp, Artificial
  CRISPR gRNA sequence
agcactttgggaggctgagg

SEQ ID NO: 50175 - DNA, 20 bp, Artificial
  CRISPR gRNA sequence
gcactttgggaggctgaggt

SEQ ID NO: 50176 - DNA, 20 bp, Artificial
  CRISPR gRNA sequence
cactttgggaggctgaggtg

SEQ ID NO: 50177 - DNA, 20 bp, Artificial
  CRISPR gRNA sequence
actttgggaggctgaggtgg

SEQ ID NO: 50178 - DNA, 20 bp, Artificial
  CRISPR gRNA sequence
ctttgggaggctgaggtggg

SEQ ID NO: 50179 - DNA, 20 bp, Artificial
  CRISPR gRNA sequence
ggctgaggtggggggatcac

SEQ ID NO: 50180 - DNA, 20 bp, Artificial
  CRISPR gRNA sequence
gctgaggtggggggatcacg

SEQ ID NO: 50181 - DNA, 20 bp, Artificial
  CRISPR gRNA sequence
aggtggggggatcacgaggt

SEQ ID NO: 50182 - DNA, 20 bp, Artificial
  CRISPR gRNA sequence
ggtggggggatcacgaggtc

SEQ ID NO: 50183 - DNA, 20 bp, Artificial
  CRISPR gRNA sequence
tggggggatcacgaggtcag

SEQ ID NO: 50184 - DNA, 20 bp, Artificial
  CRISPR gRNA sequence
gatcacgaggtcaggagatc

SEQ ID NO: 50185 - DNA, 20 bp, Artificial
  CRISPR gRNA sequence
tcaggagatcgagaccatcc

SEQ ID NO: 50186 - DNA, 20 bp, Artificial
  CRISPR gRNA sequence
cgagaccatcctggctaaca

SEQ ID NO: 50187 - DNA, 20 bp, Artificial
  CRISPR gRNA sequence
ctactaaaaatacaaaacat

SEQ ID NO: 50188 - DNA, 20 bp, Artificial
  CRISPR gRNA sequence
taaaaatacaaaacattagt

SEQ ID NO: 50189 - DNA, 20 bp, Artificial
  CRISPR gRNA sequence
aaaaatacaaaacattagtc

SEQ ID NO: 50190 - DNA, 20 bp, Artificial
  CRISPR gRNA sequence
tacaaaacattagtcaggcg

SEQ ID NO: 50191 - DNA, 20 bp, Artificial
  CRISPR gRNA sequence
aaaacattagtcaggcgtgg

SEQ ID NO: 50192 - DNA, 20 bp, Artificial
  CRISPR gRNA sequence
acattagtcaggcgtggtgg

SEQ ID NO: 50193 - DNA, 20 bp, Artificial
  CRISPR gRNA sequence
cattagtcaggcgtggtggc

SEQ ID NO: 50194 - DNA, 20 bp, Artificial
  CRISPR gRNA sequence
ggcgtggtggcgggcacctg

SEQ ID NO: 50195 - DNA, 20 bp, Artificial
  CRISPR gRNA sequence
gtggcgggcacctgtagtcc

SEQ ID NO: 50196 - DNA, 20 bp, Artificial
  CRISPR gRNA sequence
acctgtagtcccagctactc

SEQ ID NO: 50197 - DNA, 20 bp, Artificial
  CRISPR gRNA sequence
ctgtagtcccagctactctg

SEQ ID NO: 50198 - DNA, 20 bp, Artificial
  CRISPR gRNA sequence
tgtagtcccagctactctgg

SEQ ID NO: 50199 - DNA, 20 bp, Artificial
  CRISPR gRNA sequence
tcccagctactctggaggct

SEQ ID NO: 50200 - DNA, 20 bp, Artificial
  CRISPR gRNA sequence
cccagctactctggaggctg

SEQ ID NO: 50201 - DNA, 20 bp, Artificial
  CRISPR gRNA sequence
agctactctggaggctgagg

SEQ ID NO: 50202 - DNA, 20 bp, Artificial
  CRISPR gRNA sequence
gctactctggaggctgaggc

SEQ ID NO: 50203 - DNA, 20 bp, Artificial
  CRISPR gRNA sequence
tactctggaggctgaggcag

SEQ ID NO: 50204 - DNA, 20 bp, Artificial
  CRISPR gRNA sequence
tggaggctgaggcaggagaa

SEQ ID NO: 50205 - DNA, 20 bp, Artificial
  CRISPR gRNA sequence
gcaggagaatggcgtgaacc

SEQ ID NO: 50206 - DNA, 20 bp, Artificial
  CRISPR gRNA sequence
caggagaatggcgtgaaccc

SEQ ID NO: 50207 - DNA, 20 bp, Artificial
  CRISPR gRNA sequence
ggagaatggcgtgaacccag

SEQ ID NO: 50208 - DNA, 20 bp, Artificial
  CRISPR gRNA sequence
gagaatggcgtgaacccagg

SEQ ID NO: 50209 - DNA, 20 bp, Artificial
  CRISPR gRNA sequence
aatggcgtgaacccaggagg

SEQ ID NO: 50210 - DNA, 20 bp, Artificial
  CRISPR gRNA sequence
tggcgtgaacccaggaggcg

SEQ ID NO: 50211 - DNA, 20 bp, Artificial
  CRISPR gRNA sequence
aacccaggaggcggagcttg

SEQ ID NO: 50212 - DNA, 20 bp, Artificial
  CRISPR gRNA sequence
caggaggcggagcttgcagt

SEQ ID NO: 50213 - DNA, 20 bp, Artificial
  CRISPR gRNA sequence
ggcggagcttgcagtgagcc

SEQ ID NO: 50214 - DNA, 20 bp, Artificial
  CRISPR gRNA sequence
cgcaccactgcactccaacc

SEQ ID NO: 50215 - DNA, 20 bp, Artificial
  CRISPR gRNA sequence
gcaccactgcactccaacct

SEQ ID NO: 50216 - DNA, 20 bp, Artificial
  CRISPR gRNA sequence
ctgcactccaacctgggcaa

SEQ ID NO: 50217 - DNA, 20 bp, Artificial
  CRISPR gRNA sequence
gcactccaacctgggcaaca

SEQ ID NO: 50218 - DNA, 20 bp, Artificial
  CRISPR gRNA sequence
tccaacctgggcaacagagc

SEQ ID NO: 50219 - DNA, 20 bp, Artificial
  CRISPR gRNA sequence
gactccgtctcaaaaaaaaa

SEQ ID NO: 50220 - DNA, 20 bp, Artificial
  CRISPR gRNA sequence
tcaaaaaaaaaaagttattt

SEQ ID NO: 50221 - DNA, 20 bp, Artificial
  CRISPR gRNA sequence
caaaaaaaaaaagttatttt

SEQ ID NO: 50222 - DNA, 20 bp, Artificial
  CRISPR gRNA sequence
aaaagttattttgggtgctc

SEQ ID NO: 50223 - DNA, 20 bp, Artificial
  CRISPR gRNA sequence
tttgggtgctctagcaattc

SEQ ID NO: 50224 - DNA, 20 bp, Artificial
  CRISPR gRNA sequence
tatataaccaaaataattga

SEQ ID NO: 50225 - DNA, 20 bp, Artificial
  CRISPR gRNA sequence
taaccaaaataattgaaagc

SEQ ID NO: 50226 - DNA, 20 bp, Artificial
  CRISPR gRNA sequence
aaccaaaataattgaaagct

SEQ ID NO: 50227 - DNA, 20 bp, Artificial
  CRISPR gRNA sequence
aattgaaagctgggactttc

SEQ ID NO: 50228 - DNA, 20 bp, Artificial
  CRISPR gRNA sequence
gaaagctgggactttctggc

SEQ ID NO: 50229 - DNA, 20 bp, Artificial
  CRISPR gRNA sequence
aaagctgggactttctggct

SEQ ID NO: 50230 - DNA, 20 bp, Artificial
  CRISPR gRNA sequence
tgggactttctggctgggca

SEQ ID NO: 50231 - DNA, 20 bp, Artificial
  CRISPR gRNA sequence
gactttctggctgggcatgg

SEQ ID NO: 50232 - DNA, 20 bp, Artificial
  CRISPR gRNA sequence
tgggcatggtggctcacgcc

SEQ ID NO: 50233 - DNA, 20 bp, Artificial
  CRISPR gRNA sequence
gtggctcacgcctagcactt

SEQ ID NO: 50234 - DNA, 20 bp, Artificial
  CRISPR gRNA sequence
tggctcacgcctagcacttt

SEQ ID NO: 50235 - DNA, 20 bp, Artificial
  CRISPR gRNA sequence
gctcacgcctagcactttgg

SEQ ID NO: 50236 - DNA, 20 bp, Artificial
  CRISPR gRNA sequence
ctcacgcctagcactttggg

SEQ ID NO: 50237 - DNA, 20 bp, Artificial
  CRISPR gRNA sequence
gcctagcactttgggaggct

SEQ ID NO: 50238 - DNA, 20 bp, Artificial
  CRISPR gRNA sequence
cctagcactttgggaggctg

SEQ ID NO: 50239 - DNA, 20 bp, Artificial
  CRISPR gRNA sequence
agcactttgggaggctgagg

SEQ ID NO: 50240 - DNA, 20 bp, Artificial
  CRISPR gRNA sequence
gcactttgggaggctgaggt

SEQ ID NO: 50241 - DNA, 20 bp, Artificial
  CRISPR gRNA sequence
actttgggaggctgaggtgg

SEQ ID NO: 50242 - DNA, 20 bp, Artificial
  CRISPR gRNA sequence
ctttgggaggctgaggtggg

SEQ ID NO: 50243 - DNA, 20 bp, Artificial
  CRISPR gRNA sequence
ctgaggtgggaggatcactt

SEQ ID NO: 50244 - DNA, 20 bp, Artificial
  CRISPR gRNA sequence
gtgggaggatcacttgagct

SEQ ID NO: 50245 - DNA, 20 bp, Artificial
  CRISPR gRNA sequence
tgggaggatcacttgagctc

SEQ ID NO: 50246 - DNA, 20 bp, Artificial
  CRISPR gRNA sequence
ggaggatcacttgagctcag

SEQ ID NO: 50247 - DNA, 20 bp, Artificial
  CRISPR gRNA sequence
tcacttgagctcaggagatc

SEQ ID NO: 50248 - DNA, 20 bp, Artificial
  CRISPR gRNA sequence
tcaggagatcaagatcatcc

SEQ ID NO: 50249 - DNA, 20 bp, Artificial
  CRISPR gRNA sequence
caggagatcaagatcatcct

SEQ ID NO: 50250 - DNA, 20 bp, Artificial
  CRISPR gRNA sequence
caagatcatcctgggcaaaa

SEQ ID NO: 50251 - DNA, 20 bp, Artificial
  CRISPR gRNA sequence
atcatcctgggcaaaacagt

SEQ ID NO: 50252 - DNA, 20 bp, Artificial
  CRISPR gRNA sequence
aataaaataatatttaaaaa

SEQ ID NO: 50253 - DNA, 20 bp, Artificial
  CRISPR gRNA sequence
aaataatatttaaaaaaaga

SEQ ID NO: 50254 - DNA, 20 bp, Artificial
  CRISPR gRNA sequence
taatatttaaaaaaagaaag

SEQ ID NO: 50255 - DNA, 20 bp, Artificial
  CRISPR gRNA sequence
aatatttaaaaaaagaaagc

SEQ ID NO: 50256 - DNA, 20 bp, Artificial
  CRISPR gRNA sequence
atatttaaaaaaagaaagca

SEQ ID NO: 50257 - DNA, 20 bp, Artificial
  CRISPR gRNA sequence
agaaagcagggactgtcaat

SEQ ID NO: 50258 - DNA, 20 bp, Artificial
  CRISPR gRNA sequence
gaaagcagggactgtcaatt

SEQ ID NO: 50259 - DNA, 20 bp, Artificial
  CRISPR gRNA sequence
ctgtcaattgggcacttgaa

SEQ ID NO: 50260 - DNA, 20 bp, Artificial
  CRISPR gRNA sequence
ggcacttgaatggacaaccc

SEQ ID NO: 50261 - DNA, 20 bp, Artificial
  CRISPR gRNA sequence
acaacccaagtgtcaattga

SEQ ID NO: 50262 - DNA, 20 bp, Artificial
  CRISPR gRNA sequence
ccaagtgtcaattgatggat

SEQ ID NO: 50263 - DNA, 20 bp, Artificial
  CRISPR gRNA sequence
agtgtcaattgatggataag

SEQ ID NO: 50264 - DNA, 20 bp, Artificial
  CRISPR gRNA sequence
ataagtggatacacaaaatg

SEQ ID NO: 50265 - DNA, 20 bp, Artificial
  CRISPR gRNA sequence
aatgtggtccatccacacaa

SEQ ID NO: 50266 - DNA, 20 bp, Artificial
  CRISPR gRNA sequence
ccacacaatggaatattatg

SEQ ID NO: 50267 - DNA, 20 bp, Artificial
  CRISPR gRNA sequence
aatattatgcagccttaaaa

SEQ ID NO: 50268 - DNA, 20 bp, Artificial
  CRISPR gRNA sequence
atattatgcagccttaaaaa

SEQ ID NO: 50269 - DNA, 20 bp, Artificial
  CRISPR gRNA sequence
tatgcagccttaaaaaagga

SEQ ID NO: 50270 - DNA, 20 bp, Artificial
  CRISPR gRNA sequence
atgcagccttaaaaaaggaa

SEQ ID NO: 50271 - DNA, 20 bp, Artificial
  CRISPR gRNA sequence
tgcagccttaaaaaaggaaa

SEQ ID NO: 50272 - DNA, 20 bp, Artificial
  CRISPR gRNA sequence
gccttaaaaaaggaaagggc

SEQ ID NO: 50273 - DNA, 20 bp, Artificial
  CRISPR gRNA sequence
ccttaaaaaaggaaagggct

SEQ ID NO: 50274 - DNA, 20 bp, Artificial
  CRISPR gRNA sequence
aaaaaggaaagggctgggtg

SEQ ID NO: 50275 - DNA, 20 bp, Artificial
  CRISPR gRNA sequence
aaggaaagggctgggtgtgg

SEQ ID NO: 50276 - DNA, 20 bp, Artificial
  CRISPR gRNA sequence
gtggctcatgcctgtaatcc

SEQ ID NO: 50277 - DNA, 20 bp, Artificial
  CRISPR gRNA sequence
tgcctgtaatcccagcactt

SEQ ID NO: 50278 - DNA, 20 bp, Artificial
  CRISPR gRNA sequence
ctgtaatcccagcactttgg

SEQ ID NO: 50279 - DNA, 20 bp, Artificial
  CRISPR gRNA sequence
tgtaatcccagcactttgga

SEQ ID NO: 50280 - DNA, 20 bp, Artificial
  CRISPR gRNA sequence
agcactttggaaggccgaaa

SEQ ID NO: 50281 - DNA, 20 bp, Artificial
  CRISPR gRNA sequence
gcactttggaaggccgaaac

SEQ ID NO: 50282 - DNA, 20 bp, Artificial
  CRISPR gRNA sequence
ctttggaaggccgaaacggg

SEQ ID NO: 50283 - DNA, 20 bp, Artificial
  CRISPR gRNA sequence
ccgaaacgggcagatcatct

SEQ ID NO: 50284 - DNA, 20 bp, Artificial
  CRISPR gRNA sequence
cgaaacgggcagatcatctg

SEQ ID NO: 50285 - DNA, 20 bp, Artificial
  CRISPR gRNA sequence
acgggcagatcatctgaggt

SEQ ID NO: 50286 - DNA, 20 bp, Artificial
  CRISPR gRNA sequence
cgggcagatcatctgaggtc

SEQ ID NO: 50287 - DNA, 20 bp, Artificial
  CRISPR gRNA sequence
ggcagatcatctgaggtcag

SEQ ID NO: 50288 - DNA, 20 bp, Artificial
  CRISPR gRNA sequence
tcatctgaggtcaggagttc

SEQ ID NO: 50289 - DNA, 20 bp, Artificial
  CRISPR gRNA sequence
tgaggtcaggagttcgagac

SEQ ID NO: 50290 - DNA, 20 bp, Artificial
  CRISPR gRNA sequence
cgagaccagcctcgccaaca

SEQ ID NO: 50291 - DNA, 20 bp, Artificial
  CRISPR gRNA sequence
acaaaaatacaaaaaaaaat

SEQ ID NO: 50292 - DNA, 20 bp, Artificial
  CRISPR gRNA sequence
aaatacaaaaaaaaattagc

SEQ ID NO: 50293 - DNA, 20 bp, Artificial
  CRISPR gRNA sequence
aatacaaaaaaaaattagct

SEQ ID NO: 50294 - DNA, 20 bp, Artificial
  CRISPR gRNA sequence
aaaaaaaaattagctgggtg

SEQ ID NO: 50295 - DNA, 20 bp, Artificial
  CRISPR gRNA sequence
aaaaaattagctgggtgtgg

SEQ ID NO: 50296 - DNA, 20 bp, Artificial
  CRISPR gRNA sequence
aaattagctgggtgtggtgg

SEQ ID NO: 50297 - DNA, 20 bp, Artificial
  CRISPR gRNA sequence
aattagctgggtgtggtggc

SEQ ID NO: 50298 - DNA, 20 bp, Artificial
  CRISPR gRNA sequence
gtggcgggcgcctgtaatcc

SEQ ID NO: 50299 - DNA, 20 bp, Artificial
  CRISPR gRNA sequence
gcctgtaatcccagctactc

SEQ ID NO: 50300 - DNA, 20 bp, Artificial
  CRISPR gRNA sequence
ctgtaatcccagctactccg

SEQ ID NO: 50301 - DNA, 20 bp, Artificial
  CRISPR gRNA sequence
tgtaatcccagctactccgg

SEQ ID NO: 50302 - DNA, 20 bp, Artificial
  CRISPR gRNA sequence
tcccagctactccggaggct

SEQ ID NO: 50303 - DNA, 20 bp, Artificial
  CRISPR gRNA sequence
cccagctactccggaggctg

SEQ ID NO: 50304 - DNA, 20 bp, Artificial
  CRISPR gRNA sequence
agctactccggaggctgagg

SEQ ID NO: 50305 - DNA, 20 bp, Artificial
  CRISPR gRNA sequence
gctactccggaggctgaggc

SEQ ID NO: 50306 - DNA, 20 bp, Artificial
  CRISPR gRNA sequence
tactccggaggctgaggcag

SEQ ID NO: 50307 - DNA, 20 bp, Artificial
  CRISPR gRNA sequence
caggagaatcgcttgaaccc

SEQ ID NO: 50308 - DNA, 20 bp, Artificial
  CRISPR gRNA sequence
ggagaatcgcttgaacccaa

SEQ ID NO: 50309 - DNA, 20 bp, Artificial
  CRISPR gRNA sequence
gagaatcgcttgaacccaag

SEQ ID NO: 50310 - DNA, 20 bp, Artificial
  CRISPR gRNA sequence
aatcgcttgaacccaagagg

SEQ ID NO: 50311 - DNA, 20 bp, Artificial
  CRISPR gRNA sequence
tcgcttgaacccaagaggtg

SEQ ID NO: 50312 - DNA, 20 bp, Artificial
  CRISPR gRNA sequence
cgcttgaacccaagaggtgg

SEQ ID NO: 50313 - DNA, 20 bp, Artificial
  CRISPR gRNA sequence
gcttgaacccaagaggtgga

SEQ ID NO: 50314 - DNA, 20 bp, Artificial
  CRISPR gRNA sequence
aacccaagaggtggagggtg

SEQ ID NO: 50315 - DNA, 20 bp, Artificial
  CRISPR gRNA sequence
caagaggtggagggtgcagt

SEQ ID NO: 50316 - DNA, 20 bp, Artificial
  CRISPR gRNA sequence
ggtggagggtgcagtgagct

SEQ ID NO: 50317 - DNA, 20 bp, Artificial
  CRISPR gRNA sequence
gggtgcagtgagctgagatc

SEQ ID NO: 50318 - DNA, 20 bp, Artificial
  CRISPR gRNA sequence
gcagtgagctgagatcgagc

SEQ ID NO: 50319 - DNA, 20 bp, Artificial
  CRISPR gRNA sequence
gagatcgagccagtgcactc

SEQ ID NO: 50320 - DNA, 20 bp, Artificial
  CRISPR gRNA sequence
cgagccagtgcactccagcc

SEQ ID NO: 50321 - DNA, 20 bp, Artificial
  CRISPR gRNA sequence
gagccagtgcactccagccc

SEQ ID NO: 50322 - DNA, 20 bp, Artificial
  CRISPR gRNA sequence
tgcactccagcccaggtgac

SEQ ID NO: 50323 - DNA, 20 bp, Artificial
  CRISPR gRNA sequence
cactccagcccaggtgacaa

SEQ ID NO: 50324 - DNA, 20 bp, Artificial
  CRISPR gRNA sequence
ccagcccaggtgacaagagt

SEQ ID NO: 50325 - DNA, 20 bp, Artificial
  CRISPR gRNA sequence
aaaaaaaaaaaaaaaaaaaa

SEQ ID NO: 50326 - DNA, 20 bp, Artificial
  CRISPR gRNA sequence
aaaaaaaaaaaaaaaaaaaa

SEQ ID NO: 50327 - DNA, 20 bp, Artificial
  CRISPR gRNA sequence
aaaaaaaaaaaaaaaaaagg

SEQ ID NO: 50328 - DNA, 20 bp, Artificial
  CRISPR gRNA sequence
aaaaaaaaaaaaaaaaagga

SEQ ID NO: 50329 - DNA, 20 bp, Artificial
  CRISPR gRNA sequence
aaaaaaaaaaaaaggaagga

SEQ ID NO: 50330 - DNA, 20 bp, Artificial
  CRISPR gRNA sequence
aaaggaaggaaagtctgaca

SEQ ID NO: 50331 - DNA, 20 bp, Artificial
  CRISPR gRNA sequence
acgctgcaacatgaatgaac

SEQ ID NO: 50332 - DNA, 20 bp, Artificial
  CRISPR gRNA sequence
gctgcaacatgaatgaacca

SEQ ID NO: 50333 - DNA, 20 bp, Artificial
  CRISPR gRNA sequence
ctgcaacatgaatgaaccag

SEQ ID NO: 50334 - DNA, 20 bp, Artificial
  CRISPR gRNA sequence
gacattatgcccaatgaaat

SEQ ID NO: 50335 - DNA, 20 bp, Artificial
  CRISPR gRNA sequence
ttatgcccaatgaaatgagc

SEQ ID NO: 50336 - DNA, 20 bp, Artificial
  CRISPR gRNA sequence
tgaaatgagccagtcacaaa

SEQ ID NO: 50337 - DNA, 20 bp, Artificial
  CRISPR gRNA sequence
cagtcacaaaaagacaaata

SEQ ID NO: 50338 - DNA, 20 bp, Artificial
  CRISPR gRNA sequence
ctccactcatataaactatt

SEQ ID NO: 50339 - DNA, 20 bp, Artificial
  CRISPR gRNA sequence
ccactcatataaactattta

SEQ ID NO: 50340 - DNA, 20 bp, Artificial
  CRISPR gRNA sequence
ctcatataaactatttagag

SEQ ID NO: 50341 - DNA, 20 bp, Artificial
  CRISPR gRNA sequence
atttagagcagtccaattca

SEQ ID NO: 50342 - DNA, 20 bp, Artificial
  CRISPR gRNA sequence
ttagagcagtccaattcata

SEQ ID NO: 50343 - DNA, 20 bp, Artificial
  CRISPR gRNA sequence
agcagtccaattcatagaga

SEQ ID NO: 50344 - DNA, 20 bp, Artificial
  CRISPR gRNA sequence
gtccaattcatagagacaga

SEQ ID NO: 50345 - DNA, 20 bp, Artificial
  CRISPR gRNA sequence
caattcatagagacagaaag

SEQ ID NO: 50346 - DNA, 20 bp, Artificial
  CRISPR gRNA sequence
catagagacagaaagcagaa

SEQ ID NO: 50347 - DNA, 20 bp, Artificial
  CRISPR gRNA sequence
agagacagaaagcagaatgg

SEQ ID NO: 50348 - DNA, 20 bp, Artificial
  CRISPR gRNA sequence
gaaagcagaatggtggttgc

SEQ ID NO: 50349 - DNA, 20 bp, Artificial
  CRISPR gRNA sequence
aaagcagaatggtggttgcc

SEQ ID NO: 50350 - DNA, 20 bp, Artificial
  CRISPR gRNA sequence
aagcagaatggtggttgcca

SEQ ID NO: 50351 - DNA, 20 bp, Artificial
  CRISPR gRNA sequence
agcagaatggtggttgccag

SEQ ID NO: 50352 - DNA, 20 bp, Artificial
  CRISPR gRNA sequence
gaatggtggttgccaggggc

SEQ ID NO: 50353 - DNA, 20 bp, Artificial
  CRISPR gRNA sequence
aatggtggttgccaggggct

SEQ ID NO: 50354 - DNA, 20 bp, Artificial
  CRISPR gRNA sequence
atggtggttgccaggggctg

SEQ ID NO: 50355 - DNA, 20 bp, Artificial
  CRISPR gRNA sequence
gtggttgccaggggctgggg

SEQ ID NO: 50356 - DNA, 20 bp, Artificial
  CRISPR gRNA sequence
tggttgccaggggctggggt

SEQ ID NO: 50357 - DNA, 20 bp, Artificial
  CRISPR gRNA sequence
ggttgccaggggctggggta

SEQ ID NO: 50358 - DNA, 20 bp, Artificial
  CRISPR gRNA sequence
gttgccaggggctggggtag

SEQ ID NO: 50359 - DNA, 20 bp, Artificial
  CRISPR gRNA sequence
ttgccaggggctggggtagg

SEQ ID NO: 50360 - DNA, 20 bp, Artificial
  CRISPR gRNA sequence
tgccaggggctggggtaggg

SEQ ID NO: 50361 - DNA, 20 bp, Artificial
  CRISPR gRNA sequence
gggctggggtaggggggaaa

SEQ ID NO: 50362 - DNA, 20 bp, Artificial
  CRISPR gRNA sequence
ggctggggtaggggggaaat

SEQ ID NO: 50363 - DNA, 20 bp, Artificial
  CRISPR gRNA sequence
gctggggtaggggggaaatg

SEQ ID NO: 50364 - DNA, 20 bp, Artificial
  CRISPR gRNA sequence
ggaaatggggtgttgtttaa

SEQ ID NO: 50365 - DNA, 20 bp, Artificial
  CRISPR gRNA sequence
gaaatggggtgttgtttaat

SEQ ID NO: 50366 - DNA, 20 bp, Artificial
  CRISPR gRNA sequence
aaatggggtgttgtttaatg

SEQ ID NO: 50367 - DNA, 20 bp, Artificial
  CRISPR gRNA sequence
ggggtgttgtttaatgggga

SEQ ID NO: 50368 - DNA, 20 bp, Artificial
  CRISPR gRNA sequence
ggtgttgtttaatggggata

SEQ ID NO: 50369 - DNA, 20 bp, Artificial
  CRISPR gRNA sequence
gtttaatggggatagagatt

SEQ ID NO: 50370 - DNA, 20 bp, Artificial
  CRISPR gRNA sequence
ggatagagattcagttttgc

SEQ ID NO: 50371 - DNA, 20 bp, Artificial
  CRISPR gRNA sequence
atagagattcagttttgcaa

SEQ ID NO: 50372 - DNA, 20 bp, Artificial
  CRISPR gRNA sequence
tagagattcagttttgcaag

SEQ ID NO: 50373 - DNA, 20 bp, Artificial
  CRISPR gRNA sequence
attcagttttgcaagaggaa

SEQ ID NO: 50374 - DNA, 20 bp, Artificial
  CRISPR gRNA sequence
tcagttttgcaagaggaaaa

SEQ ID NO: 50375 - DNA, 20 bp, Artificial
  CRISPR gRNA sequence
ttgcaagaggaaaagagttc

SEQ ID NO: 50376 - DNA, 20 bp, Artificial
  CRISPR gRNA sequence
gcaagaggaaaagagttccg

SEQ ID NO: 50377 - DNA, 20 bp, Artificial
  CRISPR gRNA sequence
aggaaaagagttccggagat

SEQ ID NO: 50378 - DNA, 20 bp, Artificial
  CRISPR gRNA sequence
cggagattggccgtacaaaa

SEQ ID NO: 50379 - DNA, 20 bp, Artificial
  CRISPR gRNA sequence
agattggccgtacaaaaaag

SEQ ID NO: 50380 - DNA, 20 bp, Artificial
  CRISPR gRNA sequence
atgtacttaacactcctgaa

SEQ ID NO: 50381 - DNA, 20 bp, Artificial
  CRISPR gRNA sequence
acactcctgaatggtacact

SEQ ID NO: 50382 - DNA, 20 bp, Artificial
  CRISPR gRNA sequence
tggtacacttagaaatgatt

SEQ ID NO: 50383 - DNA, 20 bp, Artificial
  CRISPR gRNA sequence
acacttagaaatgattaaga

SEQ ID NO: 50384 - DNA, 20 bp, Artificial
  CRISPR gRNA sequence
gtattttataataattttta

SEQ ID NO: 50385 - DNA, 20 bp, Artificial
  CRISPR gRNA sequence
tattttataataatttttac

SEQ ID NO: 50386 - DNA, 20 bp, Artificial
  CRISPR gRNA sequence
ataatttttacaggttattt

SEQ ID NO: 50387 - DNA, 20 bp, Artificial
  CRISPR gRNA sequence
taatttttacaggttatttt

SEQ ID NO: 50388 - DNA, 20 bp, Artificial
  CRISPR gRNA sequence
aatttttacaggttattttg

SEQ ID NO: 50389 - DNA, 20 bp, Artificial
  CRISPR gRNA sequence
ttacaggttattttggggaa

SEQ ID NO: 50390 - DNA, 20 bp, Artificial
  CRISPR gRNA sequence
aggttattttggggaacagt

SEQ ID NO: 50391 - DNA, 20 bp, Artificial
  CRISPR gRNA sequence
tttggggaacagtcagttct

SEQ ID NO: 50392 - DNA, 20 bp, Artificial
  CRISPR gRNA sequence
ttggggaacagtcagttctt

SEQ ID NO: 50393 - DNA, 20 bp, Artificial
  CRISPR gRNA sequence
agttcttaggtgccttgtca

SEQ ID NO: 50394 - DNA, 20 bp, Artificial
  CRISPR gRNA sequence
gttcttaggtgccttgtcac

SEQ ID NO: 50395 - DNA, 20 bp, Artificial
  CRISPR gRNA sequence
gccttgtcacaggctgcaat

SEQ ID NO: 50396 - DNA, 20 bp, Artificial
  CRISPR gRNA sequence
ttgtcacaggctgcaatgag

SEQ ID NO: 50397 - DNA, 20 bp, Artificial
  CRISPR gRNA sequence
aggctgcaatgagaagtgca

SEQ ID NO: 50398 - DNA, 20 bp, Artificial
  CRISPR gRNA sequence
tgagaagtgcacagctctgt

SEQ ID NO: 50399 - DNA, 20 bp, Artificial
  CRISPR gRNA sequence
cacagctctgtcggtgacgt

SEQ ID NO: 50400 - DNA, 20 bp, Artificial
  CRISPR gRNA sequence
tgtcggtgacgtaagttttt

SEQ ID NO: 50401 - DNA, 20 bp, Artificial
  CRISPR gRNA sequence
gtcggtgacgtaagtttttt

SEQ ID NO: 50402 - DNA, 20 bp, Artificial
  CRISPR gRNA sequence
aaacatgaaactgaatgtca

SEQ ID NO: 50403 - DNA, 20 bp, Artificial
  CRISPR gRNA sequence
acatgaaactgaatgtcatg

SEQ ID NO: 50404 - DNA, 20 bp, Artificial
  CRISPR gRNA sequence
gagccttttgatctaacgtc

SEQ ID NO: 50405 - DNA, 20 bp, Artificial
  CRISPR gRNA sequence
ttgatctaacgtccagtttc

SEQ ID NO: 50406 - DNA, 20 bp, Artificial
  CRISPR gRNA sequence
tgatctaacgtccagtttcc

SEQ ID NO: 50407 - DNA, 20 bp, Artificial
  CRISPR gRNA sequence
ctaacgtccagtttccagga

SEQ ID NO: 50408 - DNA, 20 bp, Artificial
  CRISPR gRNA sequence
cgtccagtttccaggaaagt

SEQ ID NO: 50409 - DNA, 20 bp, Artificial
  CRISPR gRNA sequence
gtccagtttccaggaaagtc

SEQ ID NO: 50410 - DNA, 20 bp, Artificial
  CRISPR gRNA sequence
tccagtttccaggaaagtcg

SEQ ID NO: 50411 - DNA, 20 bp, Artificial
  CRISPR gRNA sequence
gtttccaggaaagtcggggt

SEQ ID NO: 50412 - DNA, 20 bp, Artificial
  CRISPR gRNA sequence
ttccaggaaagtcggggtta

SEQ ID NO: 50413 - DNA, 20 bp, Artificial
  CRISPR gRNA sequence
tccaggaaagtcggggttag

SEQ ID NO: 50414 - DNA, 20 bp, Artificial
  CRISPR gRNA sequence
aacacgtgccatgacatcat

SEQ ID NO: 50415 - DNA, 20 bp, Artificial
  CRISPR gRNA sequence
cgtgccatgacatcatgaga

SEQ ID NO: 50416 - DNA, 20 bp, Artificial
  CRISPR gRNA sequence
tgacatcatgagaaagccac

SEQ ID NO: 50417 - DNA, 20 bp, Artificial
  CRISPR gRNA sequence
acatcatgagaaagccacca

SEQ ID NO: 50418 - DNA, 20 bp, Artificial
  CRISPR gRNA sequence
catgagaaagccaccagagt

SEQ ID NO: 50419 - DNA, 20 bp, Artificial
  CRISPR gRNA sequence
atgagaaagccaccagagtc

SEQ ID NO: 50420 - DNA, 20 bp, Artificial
  CRISPR gRNA sequence
gagaaagccaccagagtcag

SEQ ID NO: 50421 - DNA, 20 bp, Artificial
  CRISPR gRNA sequence
aaagccaccagagtcaggag

SEQ ID NO: 50422 - DNA, 20 bp, Artificial
  CRISPR gRNA sequence
aagccaccagagtcaggagc

SEQ ID NO: 50423 - DNA, 20 bp, Artificial
  CRISPR gRNA sequence
caccagagtcaggagcagga

SEQ ID NO: 50424 - DNA, 20 bp, Artificial
  CRISPR gRNA sequence
gtcaggagcaggacagtctg

SEQ ID NO: 50425 - DNA, 20 bp, Artificial
  CRISPR gRNA sequence
aggacagtctgcagtacaca

SEQ ID NO: 50426 - DNA, 20 bp, Artificial
  CRISPR gRNA sequence
acagttgctgattttgtcaa

SEQ ID NO: 50427 - DNA, 20 bp, Artificial
  CRISPR gRNA sequence
caacagacactgacatgaaa

SEQ ID NO: 50428 - DNA, 20 bp, Artificial
  CRISPR gRNA sequence
agacactgacatgaaacaga

SEQ ID NO: 50429 - DNA, 20 bp, Artificial
  CRISPR gRNA sequence
tgacatgaaacagaaagctg

SEQ ID NO: 50430 - DNA, 20 bp, Artificial
  CRISPR gRNA sequence
atgaaacagaaagctgtggt

SEQ ID NO: 50431 - DNA, 20 bp, Artificial
  CRISPR gRNA sequence
tgaaacagaaagctgtggtg

SEQ ID NO: 50432 - DNA, 20 bp, Artificial
  CRISPR gRNA sequence
gaaacagaaagctgtggtga

SEQ ID NO: 50433 - DNA, 20 bp, Artificial
  CRISPR gRNA sequence
aaacagaaagctgtggtgag

SEQ ID NO: 50434 - DNA, 20 bp, Artificial
  CRISPR gRNA sequence
agaaagctgtggtgagggga

SEQ ID NO: 50435 - DNA, 20 bp, Artificial
  CRISPR gRNA sequence
gaaagctgtggtgaggggat

SEQ ID NO: 50436 - DNA, 20 bp, Artificial
  CRISPR gRNA sequence
aaagctgtggtgaggggatg

SEQ ID NO: 50437 - DNA, 20 bp, Artificial
  CRISPR gRNA sequence
aagctgtggtgaggggatgg

SEQ ID NO: 50438 - DNA, 20 bp, Artificial
  CRISPR gRNA sequence
ctgtggtgaggggatggggg

SEQ ID NO: 50439 - DNA, 20 bp, Artificial
  CRISPR gRNA sequence
ggatgggggcagtgatgccg

SEQ ID NO: 50440 - DNA, 20 bp, Artificial
  CRISPR gRNA sequence
gatgggggcagtgatgccgc

SEQ ID NO: 50441 - DNA, 20 bp, Artificial
  CRISPR gRNA sequence
ggggcagtgatgccgcaggt

SEQ ID NO: 50442 - DNA, 20 bp, Artificial
  CRISPR gRNA sequence
gcagtgatgccgcaggttag

SEQ ID NO: 50443 - DNA, 20 bp, Artificial
  CRISPR gRNA sequence
agtgatgccgcaggttagaa

SEQ ID NO: 50444 - DNA, 20 bp, Artificial
  CRISPR gRNA sequence
atgccgcaggttagaagagt

SEQ ID NO: 50445 - DNA, 20 bp, Artificial
  CRISPR gRNA sequence
ccgcaggttagaagagtcag

SEQ ID NO: 50446 - DNA, 20 bp, Artificial
  CRISPR gRNA sequence
atcgccatcccgtgcaaatg

SEQ ID NO: 50447 - DNA, 20 bp, Artificial
  CRISPR gRNA sequence
catcccgtgcaaatgcagac

SEQ ID NO: 50448 - DNA, 20 bp, Artificial
  CRISPR gRNA sequence
caaatgcagaccagatgtga

SEQ ID NO: 50449 - DNA, 20 bp, Artificial
  CRISPR gRNA sequence
agaccagatgtgacagatcc

SEQ ID NO: 50450 - DNA, 20 bp, Artificial
  CRISPR gRNA sequence
tgacagatcctggatcccaa

SEQ ID NO: 50451 - DNA, 20 bp, Artificial
  CRISPR gRNA sequence
agatcctggatcccaaaagc

SEQ ID NO: 50452 - DNA, 20 bp, Artificial
  CRISPR gRNA sequence
caaaagccagctgtcttatc

SEQ ID NO: 50453 - DNA, 20 bp, Artificial
  CRISPR gRNA sequence
aaaagccagctgtcttatct

SEQ ID NO: 50454 - DNA, 20 bp, Artificial
  CRISPR gRNA sequence
aaagccagctgtcttatctg

SEQ ID NO: 50455 - DNA, 20 bp, Artificial
  CRISPR gRNA sequence
aagccagctgtcttatctgg

SEQ ID NO: 50456 - DNA, 20 bp, Artificial
  CRISPR gRNA sequence
ctgtcttatctgggggacaa

SEQ ID NO: 50457 - DNA, 20 bp, Artificial
  CRISPR gRNA sequence
tgtcttatctgggggacaat

SEQ ID NO: 50458 - DNA, 20 bp, Artificial
  CRISPR gRNA sequence
gtcttatctgggggacaatg

SEQ ID NO: 50459 - DNA, 20 bp, Artificial
  CRISPR gRNA sequence
gggggacaatggggacattt

SEQ ID NO: 50460 - DNA, 20 bp, Artificial
  CRISPR gRNA sequence
acaatggggacattttagat

SEQ ID NO: 50461 - DNA, 20 bp, Artificial
  CRISPR gRNA sequence
ggggacattttagattagac

SEQ ID NO: 50462 - DNA, 20 bp, Artificial
  CRISPR gRNA sequence
gggacattttagattagact

SEQ ID NO: 50463 - DNA, 20 bp, Artificial
  CRISPR gRNA sequence
acattttagattagactagg

SEQ ID NO: 50464 - DNA, 20 bp, Artificial
  CRISPR gRNA sequence
actaggtagtacccgacact

SEQ ID NO: 50465 - DNA, 20 bp, Artificial
  CRISPR gRNA sequence
ctaggtagtacccgacacta

SEQ ID NO: 50466 - DNA, 20 bp, Artificial
  CRISPR gRNA sequence
acactaaggaatcgctaact

SEQ ID NO: 50467 - DNA, 20 bp, Artificial
  CRISPR gRNA sequence
gaatcgctaactgagtttct

SEQ ID NO: 50468 - DNA, 20 bp, Artificial
  CRISPR gRNA sequence
aatcgctaactgagtttctt

SEQ ID NO: 50469 - DNA, 20 bp, Artificial
  CRISPR gRNA sequence
gagtttcttaggtgtcctga

SEQ ID NO: 50470 - DNA, 20 bp, Artificial
  CRISPR gRNA sequence
aaaaaaatgtccttattttt

SEQ ID NO: 50471 - DNA, 20 bp, Artificial
  CRISPR gRNA sequence
aaaaatgtccttattttttg

SEQ ID NO: 50472 - DNA, 20 bp, Artificial
  CRISPR gRNA sequence
ccttattttttggagcttca

SEQ ID NO: 50473 - DNA, 20 bp, Artificial
  CRISPR gRNA sequence
gagcttcacggtgaaatatt

SEQ ID NO: 50474 - DNA, 20 bp, Artificial
  CRISPR gRNA sequence
agcttcacggtgaaatattt

SEQ ID NO: 50475 - DNA, 20 bp, Artificial
  CRISPR gRNA sequence
cttcacggtgaaatatttag

SEQ ID NO: 50476 - DNA, 20 bp, Artificial
  CRISPR gRNA sequence
ggtgaaatatttaggagtga

SEQ ID NO: 50477 - DNA, 20 bp, Artificial
  CRISPR gRNA sequence
atttaggagtgatggattat

SEQ ID NO: 50478 - DNA, 20 bp, Artificial
  CRISPR gRNA sequence
tttaggagtgatggattatg

SEQ ID NO: 50479 - DNA, 20 bp, Artificial
  CRISPR gRNA sequence
taacttacttgaaaccgctt

SEQ ID NO: 50480 - DNA, 20 bp, Artificial
  CRISPR gRNA sequence
agctgaaataaaaataaaaa

SEQ ID NO: 50481 - DNA, 20 bp, Artificial
  CRISPR gRNA sequence
tgaaataaaaataaaaatag

SEQ ID NO: 50482 - DNA, 20 bp, Artificial
  CRISPR gRNA sequence
aatagaagcaaatataaaaa

SEQ ID NO: 50483 - DNA, 20 bp, Artificial
  CRISPR gRNA sequence
gtatgaacaactgtcaaacc

SEQ ID NO: 50484 - DNA, 20 bp, Artificial
  CRISPR gRNA sequence
tatgaacaactgtcaaacct

SEQ ID NO: 50485 - DNA, 20 bp, Artificial
  CRISPR gRNA sequence
caactgtcaaacctaggttc

SEQ ID NO: 50486 - DNA, 20 bp, Artificial
  CRISPR gRNA sequence
aactgtcaaacctaggttct

SEQ ID NO: 50487 - DNA, 20 bp, Artificial
  CRISPR gRNA sequence
tcaaacctaggttctgggaa

SEQ ID NO: 50488 - DNA, 20 bp, Artificial
  CRISPR gRNA sequence
caaacctaggttctgggaat

SEQ ID NO: 50489 - DNA, 20 bp, Artificial
  CRISPR gRNA sequence
aacctaggttctgggaatag

SEQ ID NO: 50490 - DNA, 20 bp, Artificial
  CRISPR gRNA sequence
aaaaattattctttctactt

SEQ ID NO: 50491 - DNA, 20 bp, Artificial
  CRISPR gRNA sequence
cttcggtatcttctttttct

SEQ ID NO: 50492 - DNA, 20 bp, Artificial
  CRISPR gRNA sequence
tgagtgttttaaaatgatca

SEQ ID NO: 50493 - DNA, 20 bp, Artificial
  CRISPR gRNA sequence
tttaaaatgatcatagtgaa

SEQ ID NO: 50494 - DNA, 20 bp, Artificial
  CRISPR gRNA sequence
aaatgatcatagtgaacaga

SEQ ID NO: 50495 - DNA, 20 bp, Artificial
  CRISPR gRNA sequence
atcatagtgaacagacagac

SEQ ID NO: 50496 - DNA, 20 bp, Artificial
  CRISPR gRNA sequence
gacagacaagaacttcgttt

SEQ ID NO: 50497 - DNA, 20 bp, Artificial
  CRISPR gRNA sequence
tttcagtttatttttgtcct

SEQ ID NO: 50498 - DNA, 20 bp, Artificial
  CRISPR gRNA sequence
gtttatttttgtcctcagtt

SEQ ID NO: 50499 - DNA, 20 bp, Artificial
  CRISPR gRNA sequence
tctttttttcttaaatccca

SEQ ID NO: 50500 - DNA, 20 bp, Artificial
  CRISPR gRNA sequence
ttttcttaaatcccaaagca

SEQ ID NO: 50501 - DNA, 20 bp, Artificial
  CRISPR gRNA sequence
tttcttaaatcccaaagcac

SEQ ID NO: 50502 - DNA, 20 bp, Artificial
  CRISPR gRNA sequence
aatcccaaagcacaggcctc

SEQ ID NO: 50503 - DNA, 20 bp, Artificial
  CRISPR gRNA sequence
caaagcacaggcctccagtg

SEQ ID NO: 50504 - DNA, 20 bp, Artificial
  CRISPR gRNA sequence
aaagcacaggcctccagtgt

SEQ ID NO: 50505 - DNA, 20 bp, Artificial
  CRISPR gRNA sequence
aagcacaggcctccagtgtg

SEQ ID NO: 50506 - DNA, 20 bp, Artificial
  CRISPR gRNA sequence
cacaggcctccagtgtgggg

SEQ ID NO: 50507 - DNA, 20 bp, Artificial
  CRISPR gRNA sequence
acaggcctccagtgtgggga

SEQ ID NO: 50508 - DNA, 20 bp, Artificial
  CRISPR gRNA sequence
gcctccagtgtggggaagga

SEQ ID NO: 50509 - DNA, 20 bp, Artificial
  CRISPR gRNA sequence
cagtttctctgtgtgccttg

SEQ ID NO: 50510 - DNA, 20 bp, Artificial
  CRISPR gRNA sequence
gtttctctgtgtgccttgtg

SEQ ID NO: 50511 - DNA, 20 bp, Artificial
  CRISPR gRNA sequence
tgtgtgccttgtggagtctc

SEQ ID NO: 50512 - DNA, 20 bp, Artificial
  CRISPR gRNA sequence
gtgtgccttgtggagtctct

SEQ ID NO: 50513 - DNA, 20 bp, Artificial
  CRISPR gRNA sequence
gccttgtggagtctctggga

SEQ ID NO: 50514 - DNA, 20 bp, Artificial
  CRISPR gRNA sequence
tgtggagtctctgggacaga

SEQ ID NO: 50515 - DNA, 20 bp, Artificial
  CRISPR gRNA sequence
gagtctctgggacagatgga

SEQ ID NO: 50516 - DNA, 20 bp, Artificial
  CRISPR gRNA sequence
agtctctgggacagatggac

SEQ ID NO: 50517 - DNA, 20 bp, Artificial
  CRISPR gRNA sequence
gtctctgggacagatggaca

SEQ ID NO: 50518 - DNA, 20 bp, Artificial
  CRISPR gRNA sequence
acagatggacagggtttgct

SEQ ID NO: 50519 - DNA, 20 bp, Artificial
  CRISPR gRNA sequence
cagatggacagggtttgctc

SEQ ID NO: 50520 - DNA, 20 bp, Artificial
  CRISPR gRNA sequence
agatggacagggtttgctca

SEQ ID NO: 50521 - DNA, 20 bp, Artificial
  CRISPR gRNA sequence
gacagggtttgctcagggtc

SEQ ID NO: 50522 - DNA, 20 bp, Artificial
  CRISPR gRNA sequence
gggtttgctcagggtccaga

SEQ ID NO: 50523 - DNA, 20 bp, Artificial
  CRISPR gRNA sequence
tttgctcagggtccagatgg

SEQ ID NO: 50524 - DNA, 20 bp, Artificial
  CRISPR gRNA sequence
ttgctcagggtccagatggc

SEQ ID NO: 50525 - DNA, 20 bp, Artificial
  CRISPR gRNA sequence
tgctcagggtccagatggca

SEQ ID NO: 50526 - DNA, 20 bp, Artificial
  CRISPR gRNA sequence
gggtccagatggcagggttg

SEQ ID NO: 50527 - DNA, 20 bp, Artificial
  CRISPR gRNA sequence
ggtccagatggcagggttgt

SEQ ID NO: 50528 - DNA, 20 bp, Artificial
  CRISPR gRNA sequence
agatggcagggttgtgggta

SEQ ID NO: 50529 - DNA, 20 bp, Artificial
  CRISPR gRNA sequence
gatggcagggttgtgggtac

SEQ ID NO: 50530 - DNA, 20 bp, Artificial
  CRISPR gRNA sequence
ttgtgggtacaggaaatgac

SEQ ID NO: 50531 - DNA, 20 bp, Artificial
  CRISPR gRNA sequence
tgtgggtacaggaaatgact

SEQ ID NO: 50532 - DNA, 20 bp, Artificial
  CRISPR gRNA sequence
gtgggtacaggaaatgactg

SEQ ID NO: 50533 - DNA, 20 bp, Artificial
  CRISPR gRNA sequence
aatgactggggccatgatcc

SEQ ID NO: 50534 - DNA, 20 bp, Artificial
  CRISPR gRNA sequence
atgactggggccatgatcct

SEQ ID NO: 50535 - DNA, 20 bp, Artificial
  CRISPR gRNA sequence
tgactggggccatgatcctg

SEQ ID NO: 50536 - DNA, 20 bp, Artificial
  CRISPR gRNA sequence
gactggggccatgatcctgg

SEQ ID NO: 50537 - DNA, 20 bp, Artificial
  CRISPR gRNA sequence
atcctgggggcctcttactc

SEQ ID NO: 50538 - DNA, 20 bp, Artificial
  CRISPR gRNA sequence
ccctgctcccattcatgcca

SEQ ID NO: 50539 - DNA, 20 bp, Artificial
  CRISPR gRNA sequence
attcatgccatggcccctcc

SEQ ID NO: 50540 - DNA, 20 bp, Artificial
  CRISPR gRNA sequence
tcatgccatggcccctcccg

SEQ ID NO: 50541 - DNA, 20 bp, Artificial
  CRISPR gRNA sequence
catgccatggcccctcccgg

SEQ ID NO: 50542 - DNA, 20 bp, Artificial
  CRISPR gRNA sequence
gccatggcccctcccggagg

SEQ ID NO: 50543 - DNA, 20 bp, Artificial
  CRISPR gRNA sequence
atggcccctcccggaggcag

SEQ ID NO: 50544 - DNA, 20 bp, Artificial
  CRISPR gRNA sequence
tggcccctcccggaggcagc

SEQ ID NO: 50545 - DNA, 20 bp, Artificial
  CRISPR gRNA sequence
ggcccctcccggaggcagcg

SEQ ID NO: 50546 - DNA, 20 bp, Artificial
  CRISPR gRNA sequence
gcccctcccggaggcagcgg

SEQ ID NO: 50547 - DNA, 20 bp, Artificial
  CRISPR gRNA sequence
ccctcccggaggcagcgggg

SEQ ID NO: 50548 - DNA, 20 bp, Artificial
  CRISPR gRNA sequence
cctcccggaggcagcggggg

SEQ ID NO: 50549 - DNA, 20 bp, Artificial
  CRISPR gRNA sequence
tcccggaggcagcgggggag

SEQ ID NO: 50550 - DNA, 20 bp, Artificial
  CRISPR gRNA sequence
cccggaggcagcgggggagg

SEQ ID NO: 50551 - DNA, 20 bp, Artificial
  CRISPR gRNA sequence
cagcgggggaggaggtacct

SEQ ID NO: 50552 - DNA, 20 bp, Artificial
  CRISPR gRNA sequence
agcgggggaggaggtacctg

SEQ ID NO: 50553 - DNA, 20 bp, Artificial
  CRISPR gRNA sequence
aggaggtacctgaggctgaa

SEQ ID NO: 50554 - DNA, 20 bp, Artificial
  CRISPR gRNA sequence
cctgaggctgaacagccctg

SEQ ID NO: 50555 - DNA, 20 bp, Artificial
  CRISPR gRNA sequence
ctgaggctgaacagccctgc

SEQ ID NO: 50556 - DNA, 20 bp, Artificial
  CRISPR gRNA sequence
gccctgcgggtcgccccacc

SEQ ID NO: 50557 - DNA, 20 bp, Artificial
  CRISPR gRNA sequence
gcgggtcgccccaccaagct

SEQ ID NO: 50558 - DNA, 20 bp, Artificial
  CRISPR gRNA sequence
cgggtcgccccaccaagctc

SEQ ID NO: 50559 - DNA, 20 bp, Artificial
  CRISPR gRNA sequence
ggtcgccccaccaagctcag

SEQ ID NO: 50560 - DNA, 20 bp, Artificial
  CRISPR gRNA sequence
gtcgccccaccaagctcagg

SEQ ID NO: 50561 - DNA, 20 bp, Artificial
  CRISPR gRNA sequence
ccccaccaagctcaggagga

SEQ ID NO: 50562 - DNA, 20 bp, Artificial
  CRISPR gRNA sequence
accaagctcaggaggatggc

SEQ ID NO: 50563 - DNA, 20 bp, Artificial
  CRISPR gRNA sequence
ggaggatggccagctgcttc

SEQ ID NO: 50564 - DNA, 20 bp, Artificial
  CRISPR gRNA sequence
atggccagctgcttctggcc

SEQ ID NO: 50565 - DNA, 20 bp, Artificial
  CRISPR gRNA sequence
tggccagctgcttctggccc

SEQ ID NO: 50566 - DNA, 20 bp, Artificial
  CRISPR gRNA sequence
ccagctgcttctggcccagg

SEQ ID NO: 50567 - DNA, 20 bp, Artificial
  CRISPR gRNA sequence
gcttctggcccaggcagcac

SEQ ID NO: 50568 - DNA, 20 bp, Artificial
  CRISPR gRNA sequence
cttctggcccaggcagcact

SEQ ID NO: 50569 - DNA, 20 bp, Artificial
  CRISPR gRNA sequence
tggcccaggcagcactgggt

SEQ ID NO: 50570 - DNA, 20 bp, Artificial
  CRISPR gRNA sequence
caggcagcactgggtcagcc

SEQ ID NO: 50571 - DNA, 20 bp, Artificial
  CRISPR gRNA sequence
ggcagcactgggtcagcctg

SEQ ID NO: 50572 - DNA, 20 bp, Artificial
  CRISPR gRNA sequence
gcactgggtcagcctggaga

SEQ ID NO: 50573 - DNA, 20 bp, Artificial
  CRISPR gRNA sequence
actgggtcagcctggagaca

SEQ ID NO: 50574 - DNA, 20 bp, Artificial
  CRISPR gRNA sequence
ctgggtcagcctggagacag

SEQ ID NO: 50575 - DNA, 20 bp, Artificial
  CRISPR gRNA sequence
gtcagcctggagacagaggt

SEQ ID NO: 50576 - DNA, 20 bp, Artificial
  CRISPR gRNA sequence
ggagacagaggtcagtcact

SEQ ID NO: 50577 - DNA, 20 bp, Artificial
  CRISPR gRNA sequence
gagacagaggtcagtcactg

SEQ ID NO: 50578 - DNA, 20 bp, Artificial
  CRISPR gRNA sequence
acagaggtcagtcactgagg

SEQ ID NO: 50579 - DNA, 20 bp, Artificial
  CRISPR gRNA sequence
gtcagtcactgaggtggctc

SEQ ID NO: 50580 - DNA, 20 bp, Artificial
  CRISPR gRNA sequence
agtcactgaggtggctctgg

SEQ ID NO: 50581 - DNA, 20 bp, Artificial
  CRISPR gRNA sequence
gtcactgaggtggctctggc

SEQ ID NO: 50582 - DNA, 20 bp, Artificial
  CRISPR gRNA sequence
tcactgaggtggctctggca

SEQ ID NO: 50583 - DNA, 20 bp, Artificial
  CRISPR gRNA sequence
ccacccctctgctgtcctca

SEQ ID NO: 50584 - DNA, 20 bp, Artificial
  CRISPR gRNA sequence
cacccctctgctgtcctcac

SEQ ID NO: 50585 - DNA, 20 bp, Artificial
  CRISPR gRNA sequence
cctctgctgtcctcacgggc

SEQ ID NO: 50586 - DNA, 20 bp, Artificial
  CRISPR gRNA sequence
ctctgctgtcctcacgggct

SEQ ID NO: 50587 - DNA, 20 bp, Artificial
  CRISPR gRNA sequence
tgctgtcctcacgggctggg

SEQ ID NO: 50588 - DNA, 20 bp, Artificial
  CRISPR gRNA sequence
gctgtcctcacgggctgggt

SEQ ID NO: 50589 - DNA, 20 bp, Artificial
  CRISPR gRNA sequence
gctgggtgggtcactcacgt

SEQ ID NO: 50590 - DNA, 20 bp, Artificial
  CRISPR gRNA sequence
gtcactcacgtgagctccgt

SEQ ID NO: 50591 - DNA, 20 bp, Artificial
  CRISPR gRNA sequence
cacgtgagctccgtcagctg

SEQ ID NO: 50592 - DNA, 20 bp, Artificial
  CRISPR gRNA sequence
acgtgagctccgtcagctgc

SEQ ID NO: 50593 - DNA, 20 bp, Artificial
  CRISPR gRNA sequence
cgtgagctccgtcagctgca

SEQ ID NO: 50594 - DNA, 20 bp, Artificial
  CRISPR gRNA sequence
tcagctgcagggacttgctc

SEQ ID NO: 50595 - DNA, 20 bp, Artificial
  CRISPR gRNA sequence
ctgcagggacttgctcaagc

SEQ ID NO: 50596 - DNA, 20 bp, Artificial
  CRISPR gRNA sequence
cagggacttgctcaagccgg

SEQ ID NO: 50597 - DNA, 20 bp, Artificial
  CRISPR gRNA sequence
gacttgctcaagccggtggc

SEQ ID NO: 50598 - DNA, 20 bp, Artificial
  CRISPR gRNA sequence
gctcaagccggtggccagcc

SEQ ID NO: 50599 - DNA, 20 bp, Artificial
  CRISPR gRNA sequence
gccagcctggacacgtgctc

SEQ ID NO: 50600 - DNA, 20 bp, Artificial
  CRISPR gRNA sequence
gcctggacacgtgctctggc

SEQ ID NO: 50601 - DNA, 20 bp, Artificial
  CRISPR gRNA sequence
tggacacgtgctctggccgg

SEQ ID NO: 50602 - DNA, 20 bp, Artificial
  CRISPR gRNA sequence
ggccggaagctgcactcact

SEQ ID NO: 50603 - DNA, 20 bp, Artificial
  CRISPR gRNA sequence
aagctgcactcacttagcct

SEQ ID NO: 50604 - DNA, 20 bp, Artificial
  CRISPR gRNA sequence
agctgcactcacttagcctg

SEQ ID NO: 50605 - DNA, 20 bp, Artificial
  CRISPR gRNA sequence
gctgcactcacttagcctga

SEQ ID NO: 50606 - DNA, 20 bp, Artificial
  CRISPR gRNA sequence
gcactcacttagcctgaggg

SEQ ID NO: 50607 - DNA, 20 bp, Artificial
  CRISPR gRNA sequence
tcacttagcctgagggcaga

SEQ ID NO: 50608 - DNA, 20 bp, Artificial
  CRISPR gRNA sequence
ttagcctgagggcagaaagc

SEQ ID NO: 50609 - DNA, 20 bp, Artificial
  CRISPR gRNA sequence
tagcctgagggcagaaagcc

SEQ ID NO: 50610 - DNA, 20 bp, Artificial
  CRISPR gRNA sequence
agcctgagggcagaaagcca

SEQ ID NO: 50611 - DNA, 20 bp, Artificial
  CRISPR gRNA sequence
ctgagggcagaaagccaggg

SEQ ID NO: 50612 - DNA, 20 bp, Artificial
  CRISPR gRNA sequence
gagggcagaaagccagggca

SEQ ID NO: 50613 - DNA, 20 bp, Artificial
  CRISPR gRNA sequence
cagaaagccagggcagagcc

SEQ ID NO: 50614 - DNA, 20 bp, Artificial
  CRISPR gRNA sequence
agaaagccagggcagagcct

SEQ ID NO: 50615 - DNA, 20 bp, Artificial
  CRISPR gRNA sequence
agccagggcagagcctgggt

SEQ ID NO: 50616 - DNA, 20 bp, Artificial
  CRISPR gRNA sequence
gccagggcagagcctgggtg

SEQ ID NO: 50617 - DNA, 20 bp, Artificial
  CRISPR gRNA sequence
cagagcctgggtgaggcctg

SEQ ID NO: 50618 - DNA, 20 bp, Artificial
  CRISPR gRNA sequence
agagcctgggtgaggcctgt

SEQ ID NO: 50619 - DNA, 20 bp, Artificial
  CRISPR gRNA sequence
ggcctgtgggcactgctgct

SEQ ID NO: 50620 - DNA, 20 bp, Artificial
  CRISPR gRNA sequence
actgctgctcagcttcatct

SEQ ID NO: 50621 - DNA, 20 bp, Artificial
  CRISPR gRNA sequence
agcttcatctcagcctccct

SEQ ID NO: 50622 - DNA, 20 bp, Artificial
  CRISPR gRNA sequence
gcttcatctcagcctccctg

SEQ ID NO: 50623 - DNA, 20 bp, Artificial
  CRISPR gRNA sequence
cttcatctcagcctccctga

SEQ ID NO: 50624 - DNA, 20 bp, Artificial
  CRISPR gRNA sequence
cagcctccctgagggcctat

SEQ ID NO: 50625 - DNA, 20 bp, Artificial
  CRISPR gRNA sequence
agcctccctgagggcctatt

SEQ ID NO: 50626 - DNA, 20 bp, Artificial
  CRISPR gRNA sequence
gcctccctgagggcctattg

SEQ ID NO: 50627 - DNA, 20 bp, Artificial
  CRISPR gRNA sequence
cctccctgagggcctattgg

SEQ ID NO: 50628 - DNA, 20 bp, Artificial
  CRISPR gRNA sequence
tccctgagggcctattgggg

SEQ ID NO: 50629 - DNA, 20 bp, Artificial
  CRISPR gRNA sequence
tgggggagcatcccacctct

SEQ ID NO: 50630 - DNA, 20 bp, Artificial
  CRISPR gRNA sequence
gggggagcatcccacctctg

SEQ ID NO: 50631 - DNA, 20 bp, Artificial
  CRISPR gRNA sequence
ggggagcatcccacctctga

SEQ ID NO: 50632 - DNA, 20 bp, Artificial
  CRISPR gRNA sequence
gcatcccacctctgagggca

SEQ ID NO: 50633 - DNA, 20 bp, Artificial
  CRISPR gRNA sequence
catcccacctctgagggcaa

SEQ ID NO: 50634 - DNA, 20 bp, Artificial
  CRISPR gRNA sequence
cacctctgagggcaaaggcc

SEQ ID NO: 50635 - DNA, 20 bp, Artificial
  CRISPR gRNA sequence
cctctgagggcaaaggcctg

SEQ ID NO: 50636 - DNA, 20 bp, Artificial
  CRISPR gRNA sequence
ctgagggcaaaggcctggag

SEQ ID NO: 50637 - DNA, 20 bp, Artificial
  CRISPR gRNA sequence
tgagggcaaaggcctggagc

SEQ ID NO: 50638 - DNA, 20 bp, Artificial
  CRISPR gRNA sequence
gagggcaaaggcctggagca

SEQ ID NO: 50639 - DNA, 20 bp, Artificial
  CRISPR gRNA sequence
aaaggcctggagcagggcct

SEQ ID NO: 50640 - DNA, 20 bp, Artificial
  CRISPR gRNA sequence
aggcctggagcagggcctga

SEQ ID NO: 50641 - DNA, 20 bp, Artificial
  CRISPR gRNA sequence
ggcctggagcagggcctgag

SEQ ID NO: 50642 - DNA, 20 bp, Artificial
  CRISPR gRNA sequence
ggcctgagaggccaaatatg

SEQ ID NO: 50643 - DNA, 20 bp, Artificial
  CRISPR gRNA sequence
caaatatgcagctcctgctc

SEQ ID NO: 50644 - DNA, 20 bp, Artificial
  CRISPR gRNA sequence
aaatatgcagctcctgctct

SEQ ID NO: 50645 - DNA, 20 bp, Artificial
  CRISPR gRNA sequence
atatgcagctcctgctctgg

SEQ ID NO: 50646 - DNA, 20 bp, Artificial
  CRISPR gRNA sequence
ctgggagcttcctgtctctt

SEQ ID NO: 50647 - DNA, 20 bp, Artificial
  CRISPR gRNA sequence
tgggagcttcctgtctcttt

SEQ ID NO: 50648 - DNA, 20 bp, Artificial
  CRISPR gRNA sequence
gggagcttcctgtctctttg

SEQ ID NO: 50649 - DNA, 20 bp, Artificial
  CRISPR gRNA sequence
gagcttcctgtctctttggg

SEQ ID NO: 50650 - DNA, 20 bp, Artificial
  CRISPR gRNA sequence
agcttcctgtctctttgggg

SEQ ID NO: 50651 - DNA, 20 bp, Artificial
  CRISPR gRNA sequence
gaacctcccacaccccctgt

SEQ ID NO: 50652 - DNA, 20 bp, Artificial
  CRISPR gRNA sequence
ctcccacaccccctgtaaga

SEQ ID NO: 50653 - DNA, 20 bp, Artificial
  CRISPR gRNA sequence
caccccctgtaagaaagtat

SEQ ID NO: 50654 - DNA, 20 bp, Artificial
  CRISPR gRNA sequence
accccctgtaagaaagtatt

SEQ ID NO: 50655 - DNA, 20 bp, Artificial
  CRISPR gRNA sequence
cccctgtaagaaagtattag

SEQ ID NO: 50656 - DNA, 20 bp, Artificial
  CRISPR gRNA sequence
tgtaagaaagtattaggagt

SEQ ID NO: 50657 - DNA, 20 bp, Artificial
  CRISPR gRNA sequence
agtattaggagtaagttatt

SEQ ID NO: 50658 - DNA, 20 bp, Artificial
  CRISPR gRNA sequence
gtattaggagtaagttattt

SEQ ID NO: 50659 - DNA, 20 bp, Artificial
  CRISPR gRNA sequence
tattaggagtaagttattta

SEQ ID NO: 50660 - DNA, 20 bp, Artificial
  CRISPR gRNA sequence
ttaggagtaagttatttagg

SEQ ID NO: 50661 - DNA, 20 bp, Artificial
  CRISPR gRNA sequence
taggagtaagttatttaggg

SEQ ID NO: 50662 - DNA, 20 bp, Artificial
  CRISPR gRNA sequence
ttatttagggaggctgactc

SEQ ID NO: 50663 - DNA, 20 bp, Artificial
  CRISPR gRNA sequence
tatttagggaggctgactct

SEQ ID NO: 50664 - DNA, 20 bp, Artificial
  CRISPR gRNA sequence
tagggaggctgactctaggt

SEQ ID NO: 50665 - DNA, 20 bp, Artificial
  CRISPR gRNA sequence
agggaggctgactctaggtc

SEQ ID NO: 50666 - DNA, 20 bp, Artificial
  CRISPR gRNA sequence
ctctaggtcaggcactgtgc

SEQ ID NO: 50667 - DNA, 20 bp, Artificial
  CRISPR gRNA sequence
tcaggcactgtgccagcctc

SEQ ID NO: 50668 - DNA, 20 bp, Artificial
  CRISPR gRNA sequence
caggcactgtgccagcctct

SEQ ID NO: 50669 - DNA, 20 bp, Artificial
  CRISPR gRNA sequence
tgtgccagcctctgggtgca

SEQ ID NO: 50670 - DNA, 20 bp, Artificial
  CRISPR gRNA sequence
gtgccagcctctgggtgcat

SEQ ID NO: 50671 - DNA, 20 bp, Artificial
  CRISPR gRNA sequence
gggacttcctgccttacccg

SEQ ID NO: 50672 - DNA, 20 bp, Artificial
  CRISPR gRNA sequence
ggacttcctgccttacccgc

SEQ ID NO: 50673 - DNA, 20 bp, Artificial
  CRISPR gRNA sequence
gacttcctgccttacccgca

SEQ ID NO: 50674 - DNA, 20 bp, Artificial
  CRISPR gRNA sequence
agggtctcctttaattctca

SEQ ID NO: 50675 - DNA, 20 bp, Artificial
  CRISPR gRNA sequence
ttaattctcatagcaccaat

SEQ ID NO: 50676 - DNA, 20 bp, Artificial
  CRISPR gRNA sequence
aattctcatagcaccaatta

SEQ ID NO: 50677 - DNA, 20 bp, Artificial
  CRISPR gRNA sequence
attctcatagcaccaattag

SEQ ID NO: 50678 - DNA, 20 bp, Artificial
  CRISPR gRNA sequence
ctcatagcaccaattagagg

SEQ ID NO: 50679 - DNA, 20 bp, Artificial
  CRISPR gRNA sequence
tcatagcaccaattagaggt

SEQ ID NO: 50680 - DNA, 20 bp, Artificial
  CRISPR gRNA sequence
catagcaccaattagaggtg

SEQ ID NO: 50681 - DNA, 20 bp, Artificial
  CRISPR gRNA sequence
gtggggaaactgactaaccc

SEQ ID NO: 50682 - DNA, 20 bp, Artificial
  CRISPR gRNA sequence
tggggaaactgactaaccca

SEQ ID NO: 50683 - DNA, 20 bp, Artificial
  CRISPR gRNA sequence
ctgactaacccaaggacaca

SEQ ID NO: 50684 - DNA, 20 bp, Artificial
  CRISPR gRNA sequence
actaacccaaggacacacag

SEQ ID NO: 50685 - DNA, 20 bp, Artificial
  CRISPR gRNA sequence
cccaaggacacacagcagat

SEQ ID NO: 50686 - DNA, 20 bp, Artificial
  CRISPR gRNA sequence
aggacacacagcagataaga

SEQ ID NO: 50687 - DNA, 20 bp, Artificial
  CRISPR gRNA sequence
acacacagcagataagaaag

SEQ ID NO: 50688 - DNA, 20 bp, Artificial
  CRISPR gRNA sequence
cacacagcagataagaaaga

SEQ ID NO: 50689 - DNA, 20 bp, Artificial
  CRISPR gRNA sequence
acacagcagataagaaagaa

SEQ ID NO: 50690 - DNA, 20 bp, Artificial
  CRISPR gRNA sequence
cagcagataagaaagaaggg

SEQ ID NO: 50691 - DNA, 20 bp, Artificial
  CRISPR gRNA sequence
taagaaagaagggcagaatc

SEQ ID NO: 50692 - DNA, 20 bp, Artificial
  CRISPR gRNA sequence
ggcagaatctggtttccatc

SEQ ID NO: 50693 - DNA, 20 bp, Artificial
  CRISPR gRNA sequence
gcagaatctggtttccatcc

SEQ ID NO: 50694 - DNA, 20 bp, Artificial
  CRISPR gRNA sequence
aatctggtttccatccaggt

SEQ ID NO: 50695 - DNA, 20 bp, Artificial
  CRISPR gRNA sequence
catccaggtcagtctgactg

SEQ ID NO: 50696 - DNA, 20 bp, Artificial
  CRISPR gRNA sequence
tcagtctgactgcagacccc

SEQ ID NO: 50697 - DNA, 20 bp, Artificial
  CRISPR gRNA sequence
taaccactgccttactctcc

SEQ ID NO: 50698 - DNA, 20 bp, Artificial
  CRISPR gRNA sequence
actgccttactctcccggac

SEQ ID NO: 50699 - DNA, 20 bp, Artificial
  CRISPR gRNA sequence
ttactctcccggaccagcac

SEQ ID NO: 50700 - DNA, 20 bp, Artificial
  CRISPR gRNA sequence
ctcccggaccagcactggct

SEQ ID NO: 50701 - DNA, 20 bp, Artificial
  CRISPR gRNA sequence
ccagcactggctgagctccc

SEQ ID NO: 50702 - DNA, 20 bp, Artificial
  CRISPR gRNA sequence
cagcactggctgagctccct

SEQ ID NO: 50703 - DNA, 20 bp, Artificial
  CRISPR gRNA sequence
agcactggctgagctccctg

SEQ ID NO: 50704 - DNA, 20 bp, Artificial
  CRISPR gRNA sequence
cactggctgagctccctggg

SEQ ID NO: 50705 - DNA, 20 bp, Artificial
  CRISPR gRNA sequence
actggctgagctccctgggg

SEQ ID NO: 50706 - DNA, 20 bp, Artificial
  CRISPR gRNA sequence
ctggctgagctccctgggga

SEQ ID NO: 50707 - DNA, 20 bp, Artificial
  CRISPR gRNA sequence
ggctgagctccctggggagg

SEQ ID NO: 50708 - DNA, 20 bp, Artificial
  CRISPR gRNA sequence
gctgagctccctggggaggg

SEQ ID NO: 50709 - DNA, 20 bp, Artificial
  CRISPR gRNA sequence
cctggggagggaggtgtgcc

SEQ ID NO: 50710 - DNA, 20 bp, Artificial
  CRISPR gRNA sequence
ctggggagggaggtgtgcct

SEQ ID NO: 50711 - DNA, 20 bp, Artificial
  CRISPR gRNA sequence
ggtgtgcctgggattctccg

SEQ ID NO: 50712 - DNA, 20 bp, Artificial
  CRISPR gRNA sequence
gtgtgcctgggattctccgt

SEQ ID NO: 50713 - DNA, 20 bp, Artificial
  CRISPR gRNA sequence
tgtgcctgggattctccgtg

SEQ ID NO: 50714 - DNA, 20 bp, Artificial
  CRISPR gRNA sequence
ctccgtggggctctgctgtc

SEQ ID NO: 50715 - DNA, 20 bp, Artificial
  CRISPR gRNA sequence
tccgtggggctctgctgtcc

SEQ ID NO: 50716 - DNA, 20 bp, Artificial
  CRISPR gRNA sequence
gctctgctgtccaggcatct

SEQ ID NO: 50717 - DNA, 20 bp, Artificial
  CRISPR gRNA sequence
ctgtccaggcatctcagccc

SEQ ID NO: 50718 - DNA, 20 bp, Artificial
  CRISPR gRNA sequence
tgtccaggcatctcagccct

SEQ ID NO: 50719 - DNA, 20 bp, Artificial
  CRISPR gRNA sequence
ccaggcatctcagccctggg

SEQ ID NO: 50720 - DNA, 20 bp, Artificial
  CRISPR gRNA sequence
gcatctcagccctgggtggc

SEQ ID NO: 50721 - DNA, 20 bp, Artificial
  CRISPR gRNA sequence
tctcagccctgggtggccag

SEQ ID NO: 50722 - DNA, 20 bp, Artificial
  CRISPR gRNA sequence
agccctgggtggccagcaga

SEQ ID NO: 50723 - DNA, 20 bp, Artificial
  CRISPR gRNA sequence
gccctgggtggccagcagac

SEQ ID NO: 50724 - DNA, 20 bp, Artificial
  CRISPR gRNA sequence
gggtggccagcagacgggcc

SEQ ID NO: 50725 - DNA, 20 bp, Artificial
  CRISPR gRNA sequence
gccagcagacgggcccagcc

SEQ ID NO: 50726 - DNA, 20 bp, Artificial
  CRISPR gRNA sequence
agacgggcccagccaagtga

SEQ ID NO: 50727 - DNA, 20 bp, Artificial
  CRISPR gRNA sequence
gacgggcccagccaagtgaa

SEQ ID NO: 50728 - DNA, 20 bp, Artificial
  CRISPR gRNA sequence
acgggcccagccaagtgaaa

SEQ ID NO: 50729 - DNA, 20 bp, Artificial
  CRISPR gRNA sequence
cccagccaagtgaaagggcc

SEQ ID NO: 50730 - DNA, 20 bp, Artificial
  CRISPR gRNA sequence
tgaaagggcccagtgaacct

SEQ ID NO: 50731 - DNA, 20 bp, Artificial
  CRISPR gRNA sequence
gaaagggcccagtgaacctc

SEQ ID NO: 50732 - DNA, 20 bp, Artificial
  CRISPR gRNA sequence
aaagggcccagtgaacctcg

SEQ ID NO: 50733 - DNA, 20 bp, Artificial
  CRISPR gRNA sequence
gggcccagtgaacctcgggg

SEQ ID NO: 50734 - DNA, 20 bp, Artificial
  CRISPR gRNA sequence
tcggggcagttcactctgat

SEQ ID NO: 50735 - DNA, 20 bp, Artificial
  CRISPR gRNA sequence
cggggcagttcactctgatg

SEQ ID NO: 50736 - DNA, 20 bp, Artificial
  CRISPR gRNA sequence
ggcagttcactctgatgagg

SEQ ID NO: 50737 - DNA, 20 bp, Artificial
  CRISPR gRNA sequence
gcagttcactctgatgaggc

SEQ ID NO: 50738 - DNA, 20 bp, Artificial
  CRISPR gRNA sequence
cagttcactctgatgaggca

SEQ ID NO: 50739 - DNA, 20 bp, Artificial
  CRISPR gRNA sequence
ctctgatgaggcagggctgc

SEQ ID NO: 50740 - DNA, 20 bp, Artificial
  CRISPR gRNA sequence
tctgatgaggcagggctgct

SEQ ID NO: 50741 - DNA, 20 bp, Artificial
  CRISPR gRNA sequence
cagggctgctgggatacttc

SEQ ID NO: 50742 - DNA, 20 bp, Artificial
  CRISPR gRNA sequence
agggctgctgggatacttcc

SEQ ID NO: 50743 - DNA, 20 bp, Artificial
  CRISPR gRNA sequence
ggctgctgggatacttccag

SEQ ID NO: 50744 - DNA, 20 bp, Artificial
  CRISPR gRNA sequence
gctgctgggatacttccagg

SEQ ID NO: 50745 - DNA, 20 bp, Artificial
  CRISPR gRNA sequence
ctgctgggatacttccagga

SEQ ID NO: 50746 - DNA, 20 bp, Artificial
  CRISPR gRNA sequence
tgctgggatacttccaggag

SEQ ID NO: 50747 - DNA, 20 bp, Artificial
  CRISPR gRNA sequence
tccaggaggggctgatgttt

SEQ ID NO: 50748 - DNA, 20 bp, Artificial
  CRISPR gRNA sequence
ggaggggctgatgtttgagc

SEQ ID NO: 50749 - DNA, 20 bp, Artificial
  CRISPR gRNA sequence
gaggggctgatgtttgagct

SEQ ID NO: 50750 - DNA, 20 bp, Artificial
  CRISPR gRNA sequence
gatgtttgagctgggtgtta

SEQ ID NO: 50751 - DNA, 20 bp, Artificial
  CRISPR gRNA sequence
atgtttgagctgggtgttaa

SEQ ID NO: 50752 - DNA, 20 bp, Artificial
  CRISPR gRNA sequence
tgagctgggtgttaaaggat

SEQ ID NO: 50753 - DNA, 20 bp, Artificial
  CRISPR gRNA sequence
gagctgggtgttaaaggatt

SEQ ID NO: 50754 - DNA, 20 bp, Artificial
  CRISPR gRNA sequence
gctgggtgttaaaggattgg

SEQ ID NO: 50755 - DNA, 20 bp, Artificial
  CRISPR gRNA sequence
ggattgggagaattttatct

SEQ ID NO: 50756 - DNA, 20 bp, Artificial
  CRISPR gRNA sequence
gggagaattttatctcagaa

SEQ ID NO: 50757 - DNA, 20 bp, Artificial
  CRISPR gRNA sequence
ggagaattttatctcagaaa

SEQ ID NO: 50758 - DNA, 20 bp, Artificial
  CRISPR gRNA sequence
aattttatctcagaaaaggc

SEQ ID NO: 50759 - DNA, 20 bp, Artificial
  CRISPR gRNA sequence
attttatctcagaaaaggca

SEQ ID NO: 50760 - DNA, 20 bp, Artificial
  CRISPR gRNA sequence
ttatctcagaaaaggcaagg

SEQ ID NO: 50761 - DNA, 20 bp, Artificial
  CRISPR gRNA sequence
atctcagaaaaggcaaggaa

SEQ ID NO: 50762 - DNA, 20 bp, Artificial
  CRISPR gRNA sequence
aaggcaaggaagagaatgtt

SEQ ID NO: 50763 - DNA, 20 bp, Artificial
  CRISPR gRNA sequence
aaggaagagaatgttgagct

SEQ ID NO: 50764 - DNA, 20 bp, Artificial
  CRISPR gRNA sequence
agagaatgttgagctgagtg

SEQ ID NO: 50765 - DNA, 20 bp, Artificial
  CRISPR gRNA sequence
tgttgagctgagtgcggtgt

SEQ ID NO: 50766 - DNA, 20 bp, Artificial
  CRISPR gRNA sequence
tgagctgagtgcggtgtgag

SEQ ID NO: 50767 - DNA, 20 bp, Artificial
  CRISPR gRNA sequence
agctgagtgcggtgtgagca

SEQ ID NO: 50768 - DNA, 20 bp, Artificial
  CRISPR gRNA sequence
gctgagtgcggtgtgagcag

SEQ ID NO: 50769 - DNA, 20 bp, Artificial
  CRISPR gRNA sequence
gagtgcggtgtgagcagagg

SEQ ID NO: 50770 - DNA, 20 bp, Artificial
  CRISPR gRNA sequence
gtgcggtgtgagcagaggca

SEQ ID NO: 50771 - DNA, 20 bp, Artificial
  CRISPR gRNA sequence
gagcagaggcagagaatctt

SEQ ID NO: 50772 - DNA, 20 bp, Artificial
  CRISPR gRNA sequence
agcagaggcagagaatcttc

SEQ ID NO: 50773 - DNA, 20 bp, Artificial
  CRISPR gRNA sequence
agaggcagagaatcttcagg

SEQ ID NO: 50774 - DNA, 20 bp, Artificial
  CRISPR gRNA sequence
gaggcagagaatcttcaggc

SEQ ID NO: 50775 - DNA, 20 bp, Artificial
  CRISPR gRNA sequence
aggcagagaatcttcaggca

SEQ ID NO: 50776 - DNA, 20 bp, Artificial
  CRISPR gRNA sequence
tcttcaggcagggcttgatc

SEQ ID NO: 50777 - DNA, 20 bp, Artificial
  CRISPR gRNA sequence
cttcaggcagggcttgatct

SEQ ID NO: 50778 - DNA, 20 bp, Artificial
  CRISPR gRNA sequence
tcaggcagggcttgatctag

SEQ ID NO: 50779 - DNA, 20 bp, Artificial
  CRISPR gRNA sequence
gggcttgatctaggagcaaa

SEQ ID NO: 50780 - DNA, 20 bp, Artificial
  CRISPR gRNA sequence
tgatctaggagcaaatagtg

SEQ ID NO: 50781 - DNA, 20 bp, Artificial
  CRISPR gRNA sequence
gatctaggagcaaatagtga

SEQ ID NO: 50782 - DNA, 20 bp, Artificial
  CRISPR gRNA sequence
ggagcaaatagtgaaggtta

SEQ ID NO: 50783 - DNA, 20 bp, Artificial
  CRISPR gRNA sequence
gtgtgtgtgtgttgtgtatg

SEQ ID NO: 50784 - DNA, 20 bp, Artificial
  CRISPR gRNA sequence
tgttgtgtatgtggtatttg

SEQ ID NO: 50785 - DNA, 20 bp, Artificial
  CRISPR gRNA sequence
gttgtgtatgtggtatttgt

SEQ ID NO: 50786 - DNA, 20 bp, Artificial
  CRISPR gRNA sequence
tggtatttgtaggtattatg

SEQ ID NO: 50787 - DNA, 20 bp, Artificial
  CRISPR gRNA sequence
gtgctgtatttgtaatgtgc

SEQ ID NO: 50788 - DNA, 20 bp, Artificial
  CRISPR gRNA sequence
tgctgtatttgtaatgtgcc

SEQ ID NO: 50789 - DNA, 20 bp, Artificial
  CRISPR gRNA sequence
taatgtgccaggtatgtatg

SEQ ID NO: 50790 - DNA, 20 bp, Artificial
  CRISPR gRNA sequence
aatgtgccaggtatgtatgt

SEQ ID NO: 50791 - DNA, 20 bp, Artificial
  CRISPR gRNA sequence
atgtgccaggtatgtatgtg

SEQ ID NO: 50792 - DNA, 20 bp, Artificial
  CRISPR gRNA sequence
tgtgccaggtatgtatgtgg

SEQ ID NO: 50793 - DNA, 20 bp, Artificial
  CRISPR gRNA sequence
gtgccaggtatgtatgtggg

SEQ ID NO: 50794 - DNA, 20 bp, Artificial
  CRISPR gRNA sequence
atgtggggggtttgtttttg

SEQ ID NO: 50795 - DNA, 20 bp, Artificial
  CRISPR gRNA sequence
tgtggggggtttgtttttgt

SEQ ID NO: 50796 - DNA, 20 bp, Artificial
  CRISPR gRNA sequence
gtggggggtttgtttttgtg

SEQ ID NO: 50797 - DNA, 20 bp, Artificial
  CRISPR gRNA sequence
tgtggggtgtgtgtattgtg

SEQ ID NO: 50798 - DNA, 20 bp, Artificial
  CRISPR gRNA sequence
tgtgtattgtgtggtgtgtg

SEQ ID NO: 50799 - DNA, 20 bp, Artificial
  CRISPR gRNA sequence
gtggtgtatgtgtgtgtatg

SEQ ID NO: 50800 - DNA, 20 bp, Artificial
  CRISPR gRNA sequence
gtgtgtatgtggtatgtgta

SEQ ID NO: 50801 - DNA, 20 bp, Artificial
  CRISPR gRNA sequence
tgtggtatgtgtatggtatg

SEQ ID NO: 50802 - DNA, 20 bp, Artificial
  CRISPR gRNA sequence
tgtgtgttgtgtgtgctgtg

SEQ ID NO: 50803 - DNA, 20 bp, Artificial
  CRISPR gRNA sequence
tgtgtgtgctgcgtgctgtg

SEQ ID NO: 50804 - DNA, 20 bp, Artificial
  CRISPR gRNA sequence
tgcgtgctgtgtggtgtgtt

SEQ ID NO: 50805 - DNA, 20 bp, Artificial
  CRISPR gRNA sequence
gcgtgctgtgtggtgtgttt

SEQ ID NO: 50806 - DNA, 20 bp, Artificial
  CRISPR gRNA sequence
gtggtgtgtttgggtgtgct

SEQ ID NO: 50807 - DNA, 20 bp, Artificial
  CRISPR gRNA sequence
gggtgtgcttggtgtatctg

SEQ ID NO: 50808 - DNA, 20 bp, Artificial
  CRISPR gRNA sequence
cttggtgtatctgtggtata

SEQ ID NO: 50809 - DNA, 20 bp, Artificial
  CRISPR gRNA sequence
ttggtgtatctgtggtatat

SEQ ID NO: 50810 - DNA, 20 bp, Artificial
  CRISPR gRNA sequence
tgtatctgtggtatatgggt

SEQ ID NO: 50811 - DNA, 20 bp, Artificial
  CRISPR gRNA sequence
gtggtatatgggttggtgtg

SEQ ID NO: 50812 - DNA, 20 bp, Artificial
  CRISPR gRNA sequence
tggtatatgggttggtgtgt

SEQ ID NO: 50813 - DNA, 20 bp, Artificial
  CRISPR gRNA sequence
ggtatatgggttggtgtgta

SEQ ID NO: 50814 - DNA, 20 bp, Artificial
  CRISPR gRNA sequence
tggtgtgtagggcgtgtgtg

SEQ ID NO: 50815 - DNA, 20 bp, Artificial
  CRISPR gRNA sequence
tgtagggcgtgtgtgtggtg

SEQ ID NO: 50816 - DNA, 20 bp, Artificial
  CRISPR gRNA sequence
gtagggcgtgtgtgtggtgt

SEQ ID NO: 50817 - DNA, 20 bp, Artificial
  CRISPR gRNA sequence
tagggcgtgtgtgtggtgtg

SEQ ID NO: 50818 - DNA, 20 bp, Artificial
  CRISPR gRNA sequence
agggcgtgtgtgtggtgtgg

SEQ ID NO: 50819 - DNA, 20 bp, Artificial
  CRISPR gRNA sequence
ggcgtgtgtgtggtgtgggg

SEQ ID NO: 50820 - DNA, 20 bp, Artificial
  CRISPR gRNA sequence
gcgtgtgtgtggtgtggggg

SEQ ID NO: 50821 - DNA, 20 bp, Artificial
  CRISPR gRNA sequence
tgtgtgtggtgtgggggagg

SEQ ID NO: 50822 - DNA, 20 bp, Artificial
  CRISPR gRNA sequence
gtgtgtggtgtgggggaggt

SEQ ID NO: 50823 - DNA, 20 bp, Artificial
  CRISPR gRNA sequence
tgtggtgtgggggaggtggg

SEQ ID NO: 50824 - DNA, 20 bp, Artificial
  CRISPR gRNA sequence
gtggtgtgggggaggtggga

SEQ ID NO: 50825 - DNA, 20 bp, Artificial
  CRISPR gRNA sequence
gggggaggtgggaaggaaca

SEQ ID NO: 50826 - DNA, 20 bp, Artificial
  CRISPR gRNA sequence
ggaggtgggaaggaacatgg

SEQ ID NO: 50827 - DNA, 20 bp, Artificial
  CRISPR gRNA sequence
ggtgggaaggaacatggtgg

SEQ ID NO: 50828 - DNA, 20 bp, Artificial
  CRISPR gRNA sequence
gtgggaaggaacatggtgga

SEQ ID NO: 50829 - DNA, 20 bp, Artificial
  CRISPR gRNA sequence
aggaacatggtggaaggtga

SEQ ID NO: 50830 - DNA, 20 bp, Artificial
  CRISPR gRNA sequence
acatggtggaaggtgacagt

SEQ ID NO: 50831 - DNA, 20 bp, Artificial
  CRISPR gRNA sequence
gtggaaggtgacagttggat

SEQ ID NO: 50832 - DNA, 20 bp, Artificial
  CRISPR gRNA sequence
tgacagttggatcagactgt

SEQ ID NO: 50833 - DNA, 20 bp, Artificial
  CRISPR gRNA sequence
gacagttggatcagactgtg

SEQ ID NO: 50834 - DNA, 20 bp, Artificial
  CRISPR gRNA sequence
acagttggatcagactgtga

SEQ ID NO: 50835 - DNA, 20 bp, Artificial
  CRISPR gRNA sequence
agttggatcagactgtgagg

SEQ ID NO: 50836 - DNA, 20 bp, Artificial
  CRISPR gRNA sequence
tggatcagactgtgagggag

SEQ ID NO: 50837 - DNA, 20 bp, Artificial
  CRISPR gRNA sequence
gactgtgagggagaagatgc

SEQ ID NO: 50838 - DNA, 20 bp, Artificial
  CRISPR gRNA sequence
actgtgagggagaagatgct

SEQ ID NO: 50839 - DNA, 20 bp, Artificial
  CRISPR gRNA sequence
ctgtgagggagaagatgcta

SEQ ID NO: 50840 - DNA, 20 bp, Artificial
  CRISPR gRNA sequence
agggactttgaacttcaccc

SEQ ID NO: 50841 - DNA, 20 bp, Artificial
  CRISPR gRNA sequence
gggactttgaacttcaccct

SEQ ID NO: 50842 - DNA, 20 bp, Artificial
  CRISPR gRNA sequence
ggactttgaacttcaccctg

SEQ ID NO: 50843 - DNA, 20 bp, Artificial
  CRISPR gRNA sequence
gaacttcaccctggggttaa

SEQ ID NO: 50844 - DNA, 20 bp, Artificial
  CRISPR gRNA sequence
aacttcaccctggggttaat

SEQ ID NO: 50845 - DNA, 20 bp, Artificial
  CRISPR gRNA sequence
acttcaccctggggttaatg

SEQ ID NO: 50846 - DNA, 20 bp, Artificial
  CRISPR gRNA sequence
ttcaccctggggttaatggg

SEQ ID NO: 50847 - DNA, 20 bp, Artificial
  CRISPR gRNA sequence
ggggttaatggggagccact

SEQ ID NO: 50848 - DNA, 20 bp, Artificial
  CRISPR gRNA sequence
gggttaatggggagccactg

SEQ ID NO: 50849 - DNA, 20 bp, Artificial
  CRISPR gRNA sequence
ggttaatggggagccactga

SEQ ID NO: 50850 - DNA, 20 bp, Artificial
  CRISPR gRNA sequence
gttaatggggagccactgag

SEQ ID NO: 50851 - DNA, 20 bp, Artificial
  CRISPR gRNA sequence
tggggagccactgaggggca

SEQ ID NO: 50852 - DNA, 20 bp, Artificial
  CRISPR gRNA sequence
gggagccactgaggggcaca

SEQ ID NO: 50853 - DNA, 20 bp, Artificial
  CRISPR gRNA sequence
agccactgaggggcacagag

SEQ ID NO: 50854 - DNA, 20 bp, Artificial
  CRISPR gRNA sequence
cactgaggggcacagagtag

SEQ ID NO: 50855 - DNA, 20 bp, Artificial
  CRISPR gRNA sequence
ctgaggggcacagagtagca

SEQ ID NO: 50856 - DNA, 20 bp, Artificial
  CRISPR gRNA sequence
tgaggggcacagagtagcag

SEQ ID NO: 50857 - DNA, 20 bp, Artificial
  CRISPR gRNA sequence
gaggggcacagagtagcaga

SEQ ID NO: 50858 - DNA, 20 bp, Artificial
  CRISPR gRNA sequence
aggggcacagagtagcagag

SEQ ID NO: 50859 - DNA, 20 bp, Artificial
  CRISPR gRNA sequence
gagtagcagaggggcactgt

SEQ ID NO: 50860 - DNA, 20 bp, Artificial
  CRISPR gRNA sequence
actgtcagatgtgtgttgtg

SEQ ID NO: 50861 - DNA, 20 bp, Artificial
  CRISPR gRNA sequence
gtgtgttgtgaagatccctc

SEQ ID NO: 50862 - DNA, 20 bp, Artificial
  CRISPR gRNA sequence
tgtgttgtgaagatccctct

SEQ ID NO: 50863 - DNA, 20 bp, Artificial
  CRISPR gRNA sequence
gtgttgtgaagatccctctg

SEQ ID NO: 50864 - DNA, 20 bp, Artificial
  CRISPR gRNA sequence
tgttgtgaagatccctctgg

SEQ ID NO: 50865 - DNA, 20 bp, Artificial
  CRISPR gRNA sequence
gaagatccctctgggggctg

SEQ ID NO: 50866 - DNA, 20 bp, Artificial
  CRISPR gRNA sequence
agatccctctgggggctgtg

SEQ ID NO: 50867 - DNA, 20 bp, Artificial
  CRISPR gRNA sequence
tctgggggctgtggagtgaa

SEQ ID NO: 50868 - DNA, 20 bp, Artificial
  CRISPR gRNA sequence
tgggggctgtggagtgaatg

SEQ ID NO: 50869 - DNA, 20 bp, Artificial
  CRISPR gRNA sequence
gggggctgtggagtgaatgg

SEQ ID NO: 50870 - DNA, 20 bp, Artificial
  CRISPR gRNA sequence
ggggctgtggagtgaatgga

SEQ ID NO: 50871 - DNA, 20 bp, Artificial
  CRISPR gRNA sequence
gggctgtggagtgaatggag

SEQ ID NO: 50872 - DNA, 20 bp, Artificial
  CRISPR gRNA sequence
gctgtggagtgaatggaggg

SEQ ID NO: 50873 - DNA, 20 bp, Artificial
  CRISPR gRNA sequence
ctgtggagtgaatggagggg

SEQ ID NO: 50874 - DNA, 20 bp, Artificial
  CRISPR gRNA sequence
gtggagtgaatggaggggag

SEQ ID NO: 50875 - DNA, 20 bp, Artificial
  CRISPR gRNA sequence
tggagtgaatggaggggagg

SEQ ID NO: 50876 - DNA, 20 bp, Artificial
  CRISPR gRNA sequence
tggaggggaggaggcctgat

SEQ ID NO: 50877 - DNA, 20 bp, Artificial
  CRISPR gRNA sequence
ggaggaggcctgataagatg

SEQ ID NO: 50878 - DNA, 20 bp, Artificial
  CRISPR gRNA sequence
gaggaggcctgataagatgc

SEQ ID NO: 50879 - DNA, 20 bp, Artificial
  CRISPR gRNA sequence
aggaggcctgataagatgca

SEQ ID NO: 50880 - DNA, 20 bp, Artificial
  CRISPR gRNA sequence
gcctgataagatgcagggat

SEQ ID NO: 50881 - DNA, 20 bp, Artificial
  CRISPR gRNA sequence
ataagatgcagggatcagtt

SEQ ID NO: 50882 - DNA, 20 bp, Artificial
  CRISPR gRNA sequence
aagatgcagggatcagtttg

SEQ ID NO: 50883 - DNA, 20 bp, Artificial
  CRISPR gRNA sequence
agatgcagggatcagtttgg

SEQ ID NO: 50884 - DNA, 20 bp, Artificial
  CRISPR gRNA sequence
cagtttggaggccctgttca

SEQ ID NO: 50885 - DNA, 20 bp, Artificial
  CRISPR gRNA sequence
ggaggccctgttcacagctg

SEQ ID NO: 50886 - DNA, 20 bp, Artificial
  CRISPR gRNA sequence
gccctgttcacagctgaagt

SEQ ID NO: 50887 - DNA, 20 bp, Artificial
  CRISPR gRNA sequence
cagctgaagtaagacatgta

SEQ ID NO: 50888 - DNA, 20 bp, Artificial
  CRISPR gRNA sequence
agctgaagtaagacatgtaa

SEQ ID NO: 50889 - DNA, 20 bp, Artificial
  CRISPR gRNA sequence
agtaagacatgtaaaggaac

SEQ ID NO: 50890 - DNA, 20 bp, Artificial
  CRISPR gRNA sequence
acatgtaaaggaactggccg

SEQ ID NO: 50891 - DNA, 20 bp, Artificial
  CRISPR gRNA sequence
tgtaaaggaactggccgtgg

SEQ ID NO: 50892 - DNA, 20 bp, Artificial
  CRISPR gRNA sequence
aaggaactggccgtggcagt

SEQ ID NO: 50893 - DNA, 20 bp, Artificial
  CRISPR gRNA sequence
aactggccgtggcagtgagt

SEQ ID NO: 50894 - DNA, 20 bp, Artificial
  CRISPR gRNA sequence
actggccgtggcagtgagtc

SEQ ID NO: 50895 - DNA, 20 bp, Artificial
  CRISPR gRNA sequence
ctggccgtggcagtgagtca

SEQ ID NO: 50896 - DNA, 20 bp, Artificial
  CRISPR gRNA sequence
tggcagtgagtcagggctac

SEQ ID NO: 50897 - DNA, 20 bp, Artificial
  CRISPR gRNA sequence
ggcagtgagtcagggctacc

SEQ ID NO: 50898 - DNA, 20 bp, Artificial
  CRISPR gRNA sequence
gcagtgagtcagggctacca

SEQ ID NO: 50899 - DNA, 20 bp, Artificial
  CRISPR gRNA sequence
cagtgagtcagggctaccag

SEQ ID NO: 50900 - DNA, 20 bp, Artificial
  CRISPR gRNA sequence
aataataataataataataa

SEQ ID NO: 50901 - DNA, 20 bp, Artificial
  CRISPR gRNA sequence
acagttacaataactgctga

SEQ ID NO: 50902 - DNA, 20 bp, Artificial
  CRISPR gRNA sequence
actgctgacagcactcccat

SEQ ID NO: 50903 - DNA, 20 bp, Artificial
  CRISPR gRNA sequence
ctgacagcactcccatgagc

SEQ ID NO: 50904 - DNA, 20 bp, Artificial
  CRISPR gRNA sequence
ccatgagccagaccttttcc

SEQ ID NO: 50905 - DNA, 20 bp, Artificial
  CRISPR gRNA sequence
ttaatcctcacaataaccct

SEQ ID NO: 50906 - DNA, 20 bp, Artificial
  CRISPR gRNA sequence
taatcctcacaataacccta

SEQ ID NO: 50907 - DNA, 20 bp, Artificial
  CRISPR gRNA sequence
aatcctcacaataaccctaa

SEQ ID NO: 50908 - DNA, 20 bp, Artificial
  CRISPR gRNA sequence
atcctcacaataaccctaag

SEQ ID NO: 50909 - DNA, 20 bp, Artificial
  CRISPR gRNA sequence
ctcacaataaccctaagggg

SEQ ID NO: 50910 - DNA, 20 bp, Artificial
  CRISPR gRNA sequence
tcacaataaccctaaggggt

SEQ ID NO: 50911 - DNA, 20 bp, Artificial
  CRISPR gRNA sequence
ttatccccattttacttgtc

SEQ ID NO: 50912 - DNA, 20 bp, Artificial
  CRISPR gRNA sequence
tatccccattttacttgtcc

SEQ ID NO: 50913 - DNA, 20 bp, Artificial
  CRISPR gRNA sequence
atccccattttacttgtcca

SEQ ID NO: 50914 - DNA, 20 bp, Artificial
  CRISPR gRNA sequence
tttacttgtccagggccaca

SEQ ID NO: 50915 - DNA, 20 bp, Artificial
  CRISPR gRNA sequence
cttgtccagggccacatagc

SEQ ID NO: 50916 - DNA, 20 bp, Artificial
  CRISPR gRNA sequence
tccagggccacatagctggt

SEQ ID NO: 50917 - DNA, 20 bp, Artificial
  CRISPR gRNA sequence
agggccacatagctggtaag

SEQ ID NO: 50918 - DNA, 20 bp, Artificial
  CRISPR gRNA sequence
gccacatagctggtaagtgg

SEQ ID NO: 50919 - DNA, 20 bp, Artificial
  CRISPR gRNA sequence
atagctggtaagtggcagat

SEQ ID NO: 50920 - DNA, 20 bp, Artificial
  CRISPR gRNA sequence
tagctggtaagtggcagatc

SEQ ID NO: 50921 - DNA, 20 bp, Artificial
  CRISPR gRNA sequence
agctggtaagtggcagatca

SEQ ID NO: 50922 - DNA, 20 bp, Artificial
  CRISPR gRNA sequence
gcagatcagggatttatttt

SEQ ID NO: 50923 - DNA, 20 bp, Artificial
  CRISPR gRNA sequence
atcagggatttattttcagt

SEQ ID NO: 50924 - DNA, 20 bp, Artificial
  CRISPR gRNA sequence
aaatctttaaccgtgacact

SEQ ID NO: 50925 - DNA, 20 bp, Artificial
  CRISPR gRNA sequence
tctttaaccgtgacactcag

SEQ ID NO: 50926 - DNA, 20 bp, Artificial
  CRISPR gRNA sequence
ccgtgacactcagaagcctc

SEQ ID NO: 50927 - DNA, 20 bp, Artificial
  CRISPR gRNA sequence
cgtgacactcagaagcctca

SEQ ID NO: 50928 - DNA, 20 bp, Artificial
  CRISPR gRNA sequence
ctcagaagcctcaaggcctg

SEQ ID NO: 50929 - DNA, 20 bp, Artificial
  CRISPR gRNA sequence
gaagcctcaaggcctgtagt

SEQ ID NO: 50930 - DNA, 20 bp, Artificial
  CRISPR gRNA sequence
aagcctcaaggcctgtagtc

SEQ ID NO: 50931 - DNA, 20 bp, Artificial
  CRISPR gRNA sequence
caaggcctgtagtcaggaca

SEQ ID NO: 50932 - DNA, 20 bp, Artificial
  CRISPR gRNA sequence
gcctgtagtcaggacatggc

SEQ ID NO: 50933 - DNA, 20 bp, Artificial
  CRISPR gRNA sequence
cctgtagtcaggacatggca

SEQ ID NO: 50934 - DNA, 20 bp, Artificial
  CRISPR gRNA sequence
gtagtcaggacatggcaagg

SEQ ID NO: 50935 - DNA, 20 bp, Artificial
  CRISPR gRNA sequence
agtcaggacatggcaaggaa

SEQ ID NO: 50936 - DNA, 20 bp, Artificial
  CRISPR gRNA sequence
catggcaaggaagagaatgt

SEQ ID NO: 50937 - DNA, 20 bp, Artificial
  CRISPR gRNA sequence
atggcaaggaagagaatgtt

SEQ ID NO: 50938 - DNA, 20 bp, Artificial
  CRISPR gRNA sequence
aaggaagagaatgttgggct

SEQ ID NO: 50939 - DNA, 20 bp, Artificial
  CRISPR gRNA sequence
aagagaatgttgggctgagt

SEQ ID NO: 50940 - DNA, 20 bp, Artificial
  CRISPR gRNA sequence
agagaatgttgggctgagtt

SEQ ID NO: 50941 - DNA, 20 bp, Artificial
  CRISPR gRNA sequence
atgttgggctgagttgggct

SEQ ID NO: 50942 - DNA, 20 bp, Artificial
  CRISPR gRNA sequence
tgttgggctgagttgggctt

SEQ ID NO: 50943 - DNA, 20 bp, Artificial
  CRISPR gRNA sequence
gggctgagttgggcttagga

SEQ ID NO: 50944 - DNA, 20 bp, Artificial
  CRISPR gRNA sequence
ctgagttgggcttaggatgg

SEQ ID NO: 50945 - DNA, 20 bp, Artificial
  CRISPR gRNA sequence
tgagttgggcttaggatggt

SEQ ID NO: 50946 - DNA, 20 bp, Artificial
  CRISPR gRNA sequence
tgggcttaggatggtgggct

SEQ ID NO: 50947 - DNA, 20 bp, Artificial
  CRISPR gRNA sequence
ggcttaggatggtgggctaa

SEQ ID NO: 50948 - DNA, 20 bp, Artificial
  CRISPR gRNA sequence
gcttaggatggtgggctaag

SEQ ID NO: 50949 - DNA, 20 bp, Artificial
  CRISPR gRNA sequence
gatggtgggctaagaggcac

SEQ ID NO: 50950 - DNA, 20 bp, Artificial
  CRISPR gRNA sequence
agaggcacaagttcaatgcc

SEQ ID NO: 50951 - DNA, 20 bp, Artificial
  CRISPR gRNA sequence
gaggcacaagttcaatgcca

SEQ ID NO: 50952 - DNA, 20 bp, Artificial
  CRISPR gRNA sequence
caagttcaatgccaaggccc

SEQ ID NO: 50953 - DNA, 20 bp, Artificial
  CRISPR gRNA sequence
tcaatgccaaggccctggct

SEQ ID NO: 50954 - DNA, 20 bp, Artificial
  CRISPR gRNA sequence
gccaaggccctggctgagac

SEQ ID NO: 50955 - DNA, 20 bp, Artificial
  CRISPR gRNA sequence
caaggccctggctgagactg

SEQ ID NO: 50956 - DNA, 20 bp, Artificial
  CRISPR gRNA sequence
ctggctgagactggagttac

SEQ ID NO: 50957 - DNA, 20 bp, Artificial
  CRISPR gRNA sequence
tggctgagactggagttacc

SEQ ID NO: 50958 - DNA, 20 bp, Artificial
  CRISPR gRNA sequence
ggctgagactggagttacca

SEQ ID NO: 50959 - DNA, 20 bp, Artificial
  CRISPR gRNA sequence
gactggagttaccagggcat

SEQ ID NO: 50960 - DNA, 20 bp, Artificial
  CRISPR gRNA sequence
actggagttaccagggcatc

SEQ ID NO: 50961 - DNA, 20 bp, Artificial
  CRISPR gRNA sequence
ctggagttaccagggcatcg

SEQ ID NO: 50962 - DNA, 20 bp, Artificial
  CRISPR gRNA sequence
tggagttaccagggcatcgg

SEQ ID NO: 50963 - DNA, 20 bp, Artificial
  CRISPR gRNA sequence
agttaccagggcatcggggg

SEQ ID NO: 50964 - DNA, 20 bp, Artificial
  CRISPR gRNA sequence
cagggcatcgggggcagatc

SEQ ID NO: 50965 - DNA, 20 bp, Artificial
  CRISPR gRNA sequence
gggcatcgggggcagatctg

SEQ ID NO: 50966 - DNA, 20 bp, Artificial
  CRISPR gRNA sequence
ggcatcgggggcagatctgg

SEQ ID NO: 50967 - DNA, 20 bp, Artificial
  CRISPR gRNA sequence
cgggggcagatctggaggaa

SEQ ID NO: 50968 - DNA, 20 bp, Artificial
  CRISPR gRNA sequence
cagatctggaggaacagacc

SEQ ID NO: 50969 - DNA, 20 bp, Artificial
  CRISPR gRNA sequence
agatctggaggaacagaccc

SEQ ID NO: 50970 - DNA, 20 bp, Artificial
  CRISPR gRNA sequence
tctggaggaacagacccagg

SEQ ID NO: 50971 - DNA, 20 bp, Artificial
  CRISPR gRNA sequence
gaggaacagacccaggcagt

SEQ ID NO: 50972 - DNA, 20 bp, Artificial
  CRISPR gRNA sequence
agacccaggcagtgagcttg

SEQ ID NO: 50973 - DNA, 20 bp, Artificial
  CRISPR gRNA sequence
gagcttgaagctgctctcta

SEQ ID NO: 50974 - DNA, 20 bp, Artificial
  CRISPR gRNA sequence
agcttgaagctgctctctaa

SEQ ID NO: 50975 - DNA, 20 bp, Artificial
  CRISPR gRNA sequence
cttgaagctgctctctaaag

SEQ ID NO: 50976 - DNA, 20 bp, Artificial
  CRISPR gRNA sequence
ttgaagctgctctctaaagg

SEQ ID NO: 50977 - DNA, 20 bp, Artificial
  CRISPR gRNA sequence
gaagctgctctctaaaggag

SEQ ID NO: 50978 - DNA, 20 bp, Artificial
  CRISPR gRNA sequence
agctgctctctaaaggagga

SEQ ID NO: 50979 - DNA, 20 bp, Artificial
  CRISPR gRNA sequence
gctgctctctaaaggaggag

SEQ ID NO: 50980 - DNA, 20 bp, Artificial
  CRISPR gRNA sequence
ctgctctctaaaggaggaga

SEQ ID NO: 50981 - DNA, 20 bp, Artificial
  CRISPR gRNA sequence
ctctaaaggaggagagggcc

SEQ ID NO: 50982 - DNA, 20 bp, Artificial
  CRISPR gRNA sequence
tctaaaggaggagagggccc

SEQ ID NO: 50983 - DNA, 20 bp, Artificial
  CRISPR gRNA sequence
ctaaaggaggagagggccca

SEQ ID NO: 50984 - DNA, 20 bp, Artificial
  CRISPR gRNA sequence
aaggaggagagggcccaggg

SEQ ID NO: 50985 - DNA, 20 bp, Artificial
  CRISPR gRNA sequence
ggaggagagggcccagggaa

SEQ ID NO: 50986 - DNA, 20 bp, Artificial
  CRISPR gRNA sequence
gaggagagggcccagggaag

SEQ ID NO: 50987 - DNA, 20 bp, Artificial
  CRISPR gRNA sequence
aggagagggcccagggaaga

SEQ ID NO: 50988 - DNA, 20 bp, Artificial
  CRISPR gRNA sequence
ggagagggcccagggaagag

SEQ ID NO: 50989 - DNA, 20 bp, Artificial
  CRISPR gRNA sequence
gagagggcccagggaagagg

SEQ ID NO: 50990 - DNA, 20 bp, Artificial
  CRISPR gRNA sequence
gcccagggaagagggggcca

SEQ ID NO: 50991 - DNA, 20 bp, Artificial
  CRISPR gRNA sequence
ccagggaagagggggccatg

SEQ ID NO: 50992 - DNA, 20 bp, Artificial
  CRISPR gRNA sequence
cagggaagagggggccatgg

SEQ ID NO: 50993 - DNA, 20 bp, Artificial
  CRISPR gRNA sequence
gggggccatggaggccgcca

SEQ ID NO: 50994 - DNA, 20 bp, Artificial
  CRISPR gRNA sequence
ggggccatggaggccgccat

SEQ ID NO: 50995 - DNA, 20 bp, Artificial
  CRISPR gRNA sequence
gggccatggaggccgccata

SEQ ID NO: 50996 - DNA, 20 bp, Artificial
  CRISPR gRNA sequence
catggaggccgccatagggt

SEQ ID NO: 50997 - DNA, 20 bp, Artificial
  CRISPR gRNA sequence
tcccctgtcccatcaccctg

SEQ ID NO: 50998 - DNA, 20 bp, Artificial
  CRISPR gRNA sequence
cccctgtcccatcaccctgc

SEQ ID NO: 50999 - DNA, 20 bp, Artificial
  CRISPR gRNA sequence
ccctgtcccatcaccctgca

SEQ ID NO: 51000 - DNA, 20 bp, Artificial
  CRISPR gRNA sequence
tcaccctgcagggattacct

SEQ ID NO: 51001 - DNA, 20 bp, Artificial
  CRISPR gRNA sequence
ggattacctgagtgtcttcc

SEQ ID NO: 51002 - DNA, 20 bp, Artificial
  CRISPR gRNA sequence
acctgagtgtcttcccagcc

SEQ ID NO: 51003 - DNA, 20 bp, Artificial
  CRISPR gRNA sequence
cttcccagcctggtcctctc

SEQ ID NO: 51004 - DNA, 20 bp, Artificial
  CRISPR gRNA sequence
tcccagcctggtcctctctg

SEQ ID NO: 51005 - DNA, 20 bp, Artificial
  CRISPR gRNA sequence
cagcctggtcctctctggag

SEQ ID NO: 51006 - DNA, 20 bp, Artificial
  CRISPR gRNA sequence
cctctctggagaagtgaatc

SEQ ID NO: 51007 - DNA, 20 bp, Artificial
  CRISPR gRNA sequence
ctctggagaagtgaatccgg

SEQ ID NO: 51008 - DNA, 20 bp, Artificial
  CRISPR gRNA sequence
gtgaatccggaagctctgct

SEQ ID NO: 51009 - DNA, 20 bp, Artificial
  CRISPR gRNA sequence
gaatccggaagctctgctca

SEQ ID NO: 51010 - DNA, 20 bp, Artificial
  CRISPR gRNA sequence
cggaagctctgctcagagcc

SEQ ID NO: 51011 - DNA, 20 bp, Artificial
  CRISPR gRNA sequence
ggaagctctgctcagagccc

SEQ ID NO: 51012 - DNA, 20 bp, Artificial
  CRISPR gRNA sequence
tctgctcagagcccaggctg

SEQ ID NO: 51013 - DNA, 20 bp, Artificial
  CRISPR gRNA sequence
tgctcagagcccaggctgca

SEQ ID NO: 51014 - DNA, 20 bp, Artificial
  CRISPR gRNA sequence
ctcagagcccaggctgcaga

SEQ ID NO: 51015 - DNA, 20 bp, Artificial
  CRISPR gRNA sequence
agagcccaggctgcagagag

SEQ ID NO: 51016 - DNA, 20 bp, Artificial
  CRISPR gRNA sequence
gagcccaggctgcagagaga

SEQ ID NO: 51017 - DNA, 20 bp, Artificial
  CRISPR gRNA sequence
agcccaggctgcagagagaa

SEQ ID NO: 51018 - DNA, 20 bp, Artificial
  CRISPR gRNA sequence
aggctgcagagagaagggcc

SEQ ID NO: 51019 - DNA, 20 bp, Artificial
  CRISPR gRNA sequence
ggctgcagagagaagggcct

SEQ ID NO: 51020 - DNA, 20 bp, Artificial
  CRISPR gRNA sequence
gctgcagagagaagggcctg

SEQ ID NO: 51021 - DNA, 20 bp, Artificial
  CRISPR gRNA sequence
gcagagagaagggcctgggg

SEQ ID NO: 51022 - DNA, 20 bp, Artificial
  CRISPR gRNA sequence
gagaagggcctggggaagca

SEQ ID NO: 51023 - DNA, 20 bp, Artificial
  CRISPR gRNA sequence
gcctggggaagcacggtgcc

SEQ ID NO: 51024 - DNA, 20 bp, Artificial
  CRISPR gRNA sequence
agcacggtgcccagacatgc

SEQ ID NO: 51025 - DNA, 20 bp, Artificial
  CRISPR gRNA sequence
gcccagacatgccagcttcc

SEQ ID NO: 51026 - DNA, 20 bp, Artificial
  CRISPR gRNA sequence
cccagacatgccagcttcct

SEQ ID NO: 51027 - DNA, 20 bp, Artificial
  CRISPR gRNA sequence
atgccagcttcctaggcacc

SEQ ID NO: 51028 - DNA, 20 bp, Artificial
  CRISPR gRNA sequence
tgccagcttcctaggcacct

SEQ ID NO: 51029 - DNA, 20 bp, Artificial
  CRISPR gRNA sequence
gccagcttcctaggcaccta

SEQ ID NO: 51030 - DNA, 20 bp, Artificial
  CRISPR gRNA sequence
ctaggcacctagggcaccca

SEQ ID NO: 51031 - DNA, 20 bp, Artificial
  CRISPR gRNA sequence
taggcacctagggcacccac

SEQ ID NO: 51032 - DNA, 20 bp, Artificial
  CRISPR gRNA sequence
aggcacctagggcacccaca

SEQ ID NO: 51033 - DNA, 20 bp, Artificial
  CRISPR gRNA sequence
cctagggcacccacagggca

SEQ ID NO: 51034 - DNA, 20 bp, Artificial
  CRISPR gRNA sequence
tagggcacccacagggcaca

SEQ ID NO: 51035 - DNA, 20 bp, Artificial
  CRISPR gRNA sequence
gggcacccacagggcacaga

SEQ ID NO: 51036 - DNA, 20 bp, Artificial
  CRISPR gRNA sequence
ggcacccacagggcacagag

SEQ ID NO: 51037 - DNA, 20 bp, Artificial
  CRISPR gRNA sequence
gcacccacagggcacagaga

SEQ ID NO: 51038 - DNA, 20 bp, Artificial
  CRISPR gRNA sequence
cccacagggcacagagaggg

SEQ ID NO: 51039 - DNA, 20 bp, Artificial
  CRISPR gRNA sequence
acagggcacagagagggaag

SEQ ID NO: 51040 - DNA, 20 bp, Artificial
  CRISPR gRNA sequence
cagggcacagagagggaagc

SEQ ID NO: 51041 - DNA, 20 bp, Artificial
  CRISPR gRNA sequence
agggcacagagagggaagcg

SEQ ID NO: 51042 - DNA, 20 bp, Artificial
  CRISPR gRNA sequence
ggaagcggggctgcacccac

SEQ ID NO: 51043 - DNA, 20 bp, Artificial
  CRISPR gRNA sequence
gaagcggggctgcacccaca

SEQ ID NO: 51044 - DNA, 20 bp, Artificial
  CRISPR gRNA sequence
ggggctgcacccacaaggac

SEQ ID NO: 51045 - DNA, 20 bp, Artificial
  CRISPR gRNA sequence
gggctgcacccacaaggaca

SEQ ID NO: 51046 - DNA, 20 bp, Artificial
  CRISPR gRNA sequence
ggctgcacccacaaggacaa

SEQ ID NO: 51047 - DNA, 20 bp, Artificial
  CRISPR gRNA sequence
ctgcacccacaaggacaagg

SEQ ID NO: 51048 - DNA, 20 bp, Artificial
  CRISPR gRNA sequence
tgcacccacaaggacaaggg

SEQ ID NO: 51049 - DNA, 20 bp, Artificial
  CRISPR gRNA sequence
cccacaaggacaagggagga

SEQ ID NO: 51050 - DNA, 20 bp, Artificial
  CRISPR gRNA sequence
cacaaggacaagggaggatg

SEQ ID NO: 51051 - DNA, 20 bp, Artificial
  CRISPR gRNA sequence
acaaggacaagggaggatgg

SEQ ID NO: 51052 - DNA, 20 bp, Artificial
  CRISPR gRNA sequence
acaagggaggatggaggcct

SEQ ID NO: 51053 - DNA, 20 bp, Artificial
  CRISPR gRNA sequence
gaggatggaggcctcagaac

SEQ ID NO: 51054 - DNA, 20 bp, Artificial
  CRISPR gRNA sequence
ggatggaggcctcagaacca

SEQ ID NO: 51055 - DNA, 20 bp, Artificial
  CRISPR gRNA sequence
gatggaggcctcagaaccag

SEQ ID NO: 51056 - DNA, 20 bp, Artificial
  CRISPR gRNA sequence
tggaggcctcagaaccagag

SEQ ID NO: 51057 - DNA, 20 bp, Artificial
  CRISPR gRNA sequence
gacccccaaactcattctgt

SEQ ID NO: 51058 - DNA, 20 bp, Artificial
  CRISPR gRNA sequence
ccaaactcattctgtgagca

SEQ ID NO: 51059 - DNA, 20 bp, Artificial
  CRISPR gRNA sequence
tctgtgagcatggcaatacc

SEQ ID NO: 51060 - DNA, 20 bp, Artificial
  CRISPR gRNA sequence
tacctggccttcccacccca

SEQ ID NO: 51061 - DNA, 20 bp, Artificial
  CRISPR gRNA sequence
ttcccaccccatggcctcca

SEQ ID NO: 51062 - DNA, 20 bp, Artificial
  CRISPR gRNA sequence
catggcctccatggtcccca

SEQ ID NO: 51063 - DNA, 20 bp, Artificial
  CRISPR gRNA sequence
tccatggtccccatggcacc

SEQ ID NO: 51064 - DNA, 20 bp, Artificial
  CRISPR gRNA sequence
ccatggtccccatggcaccc

SEQ ID NO: 51065 - DNA, 20 bp, Artificial
  CRISPR gRNA sequence
tccccatggcacccgggcat

SEQ ID NO: 51066 - DNA, 20 bp, Artificial
  CRISPR gRNA sequence
ccccatggcacccgggcatc

SEQ ID NO: 51067 - DNA, 20 bp, Artificial
  CRISPR gRNA sequence
cccatggcacccgggcatca

SEQ ID NO: 51068 - DNA, 20 bp, Artificial
  CRISPR gRNA sequence
ccatggcacccgggcatcag

SEQ ID NO: 51069 - DNA, 20 bp, Artificial
  CRISPR gRNA sequence
ggcacccgggcatcagggga

SEQ ID NO: 51070 - DNA, 20 bp, Artificial
  CRISPR gRNA sequence
agaaattatgatcccatgcc

SEQ ID NO: 51071 - DNA, 20 bp, Artificial
  CRISPR gRNA sequence
gaaattatgatcccatgccc

SEQ ID NO: 51072 - DNA, 20 bp, Artificial
  CRISPR gRNA sequence
tcccatgcccaggaaaccct

SEQ ID NO: 51073 - DNA, 20 bp, Artificial
  CRISPR gRNA sequence
gcccaggaaaccctgagatt

SEQ ID NO: 51074 - DNA, 20 bp, Artificial
  CRISPR gRNA sequence
ccaggaaaccctgagattca

SEQ ID NO: 51075 - DNA, 20 bp, Artificial
  CRISPR gRNA sequence
gaaaccctgagattcagaga

SEQ ID NO: 51076 - DNA, 20 bp, Artificial
  CRISPR gRNA sequence
aaaccctgagattcagagaa

SEQ ID NO: 51077 - DNA, 20 bp, Artificial
  CRISPR gRNA sequence
ccctgagattcagagaaagg

SEQ ID NO: 51078 - DNA, 20 bp, Artificial
  CRISPR gRNA sequence
ctgagattcagagaaaggca

SEQ ID NO: 51079 - DNA, 20 bp, Artificial
  CRISPR gRNA sequence
tgagattcagagaaaggcag

SEQ ID NO: 51080 - DNA, 20 bp, Artificial
  CRISPR gRNA sequence
agaaaggcagaggttgctcc

SEQ ID NO: 51081 - DNA, 20 bp, Artificial
  CRISPR gRNA sequence
agaggttgctccaagccacc

SEQ ID NO: 51082 - DNA, 20 bp, Artificial
  CRISPR gRNA sequence
gttgctccaagccacccaga

SEQ ID NO: 51083 - DNA, 20 bp, Artificial
  CRISPR gRNA sequence
gctccaagccacccagatgg

SEQ ID NO: 51084 - DNA, 20 bp, Artificial
  CRISPR gRNA sequence
ctccaagccacccagatgga

SEQ ID NO: 51085 - DNA, 20 bp, Artificial
  CRISPR gRNA sequence
cacccagatggaaggccaca

SEQ ID NO: 51086 - DNA, 20 bp, Artificial
  CRISPR gRNA sequence
agatggaaggccacaaagtg

SEQ ID NO: 51087 - DNA, 20 bp, Artificial
  CRISPR gRNA sequence
gatggaaggccacaaagtgt

SEQ ID NO: 51088 - DNA, 20 bp, Artificial
  CRISPR gRNA sequence
tgccttgcttctcccatcat

SEQ ID NO: 51089 - DNA, 20 bp, Artificial
  CRISPR gRNA sequence
ttgcttctcccatcatcagc

SEQ ID NO: 51090 - DNA, 20 bp, Artificial
  CRISPR gRNA sequence
tgcttctcccatcatcagcc

SEQ ID NO: 51091 - DNA, 20 bp, Artificial
  CRISPR gRNA sequence
gcttctcccatcatcagcca

SEQ ID NO: 51092 - DNA, 20 bp, Artificial
  CRISPR gRNA sequence
cttctcccatcatcagccag

SEQ ID NO: 51093 - DNA, 20 bp, Artificial
  CRISPR gRNA sequence
catcagccaggggcacctgt

SEQ ID NO: 51094 - DNA, 20 bp, Artificial
  CRISPR gRNA sequence
agccaggggcacctgttggc

SEQ ID NO: 51095 - DNA, 20 bp, Artificial
  CRISPR gRNA sequence
caggggcacctgttggccag

SEQ ID NO: 51096 - DNA, 20 bp, Artificial
  CRISPR gRNA sequence
ggcacctgttggccagcaga

SEQ ID NO: 51097 - DNA, 20 bp, Artificial
  CRISPR gRNA sequence
gcacctgttggccagcagaa

SEQ ID NO: 51098 - DNA, 20 bp, Artificial
  CRISPR gRNA sequence
cacctgttggccagcagaaa

SEQ ID NO: 51099 - DNA, 20 bp, Artificial
  CRISPR gRNA sequence
acctgttggccagcagaaag

SEQ ID NO: 51100 - DNA, 20 bp, Artificial
  CRISPR gRNA sequence
gccagcagaaaggggctttt

SEQ ID NO: 51101 - DNA, 20 bp, Artificial
  CRISPR gRNA sequence
ccagcagaaaggggcttttc

SEQ ID NO: 51102 - DNA, 20 bp, Artificial
  CRISPR gRNA sequence
cagcagaaaggggcttttcg

SEQ ID NO: 51103 - DNA, 20 bp, Artificial
  CRISPR gRNA sequence
caacatccccttacttcact

SEQ ID NO: 51104 - DNA, 20 bp, Artificial
  CRISPR gRNA sequence
aacatccccttacttcactg

SEQ ID NO: 51105 - DNA, 20 bp, Artificial
  CRISPR gRNA sequence
cttacttcactgaggcctcc

SEQ ID NO: 51106 - DNA, 20 bp, Artificial
  CRISPR gRNA sequence
actgaggcctcccggacacg

SEQ ID NO: 51107 - DNA, 20 bp, Artificial
  CRISPR gRNA sequence
ctgaggcctcccggacacgt

SEQ ID NO: 51108 - DNA, 20 bp, Artificial
  CRISPR gRNA sequence
aggcctcccggacacgtggg

SEQ ID NO: 51109 - DNA, 20 bp, Artificial
  CRISPR gRNA sequence
ggcctcccggacacgtgggc

SEQ ID NO: 51110 - DNA, 20 bp, Artificial
  CRISPR gRNA sequence
cctcccggacacgtgggcag

SEQ ID NO: 51111 - DNA, 20 bp, Artificial
  CRISPR gRNA sequence
ctcccggacacgtgggcagg

SEQ ID NO: 51112 - DNA, 20 bp, Artificial
  CRISPR gRNA sequence
tcccggacacgtgggcagga

SEQ ID NO: 51113 - DNA, 20 bp, Artificial
  CRISPR gRNA sequence
cggacacgtgggcaggaggg

SEQ ID NO: 51114 - DNA, 20 bp, Artificial
  CRISPR gRNA sequence
gggcaggagggcagtgtctc

SEQ ID NO: 51115 - DNA, 20 bp, Artificial
  CRISPR gRNA sequence
caggagggcagtgtctccag

SEQ ID NO: 51116 - DNA, 20 bp, Artificial
  CRISPR gRNA sequence
aggagggcagtgtctccagc

SEQ ID NO: 51117 - DNA, 20 bp, Artificial
  CRISPR gRNA sequence
ggcagtgtctccagcaggta

SEQ ID NO: 51118 - DNA, 20 bp, Artificial
  CRISPR gRNA sequence
gcagtgtctccagcaggtac

SEQ ID NO: 51119 - DNA, 20 bp, Artificial
  CRISPR gRNA sequence
cagtgtctccagcaggtaca

SEQ ID NO: 51120 - DNA, 20 bp, Artificial
  CRISPR gRNA sequence
caggtacagggcactttcct

SEQ ID NO: 51121 - DNA, 20 bp, Artificial
  CRISPR gRNA sequence
tgagaaatgctgttgtgact

SEQ ID NO: 51122 - DNA, 20 bp, Artificial
  CRISPR gRNA sequence
aatgctgttgtgactcagac

SEQ ID NO: 51123 - DNA, 20 bp, Artificial
  CRISPR gRNA sequence
gctgttgtgactcagactag

SEQ ID NO: 51124 - DNA, 20 bp, Artificial
  CRISPR gRNA sequence
ctgttgtgactcagactaga

SEQ ID NO: 51125 - DNA, 20 bp, Artificial
  CRISPR gRNA sequence
tgttgtgactcagactagaa

SEQ ID NO: 51126 - DNA, 20 bp, Artificial
  CRISPR gRNA sequence
gactcagactagaagggaaa

SEQ ID NO: 51127 - DNA, 20 bp, Artificial
  CRISPR gRNA sequence
ctcagactagaagggaaatg

SEQ ID NO: 51128 - DNA, 20 bp, Artificial
  CRISPR gRNA sequence
actagaagggaaatggagat

SEQ ID NO: 51129 - DNA, 20 bp, Artificial
  CRISPR gRNA sequence
aagggaaatggagatgagaa

SEQ ID NO: 51130 - DNA, 20 bp, Artificial
  CRISPR gRNA sequence
agggaaatggagatgagaat

SEQ ID NO: 51131 - DNA, 20 bp, Artificial
  CRISPR gRNA sequence
ggaaatggagatgagaatgg

SEQ ID NO: 51132 - DNA, 20 bp, Artificial
  CRISPR gRNA sequence
atggagatgagaatgggagt

SEQ ID NO: 51133 - DNA, 20 bp, Artificial
  CRISPR gRNA sequence
tggagatgagaatgggagtg

SEQ ID NO: 51134 - DNA, 20 bp, Artificial
  CRISPR gRNA sequence
ggagatgagaatgggagtga

SEQ ID NO: 51135 - DNA, 20 bp, Artificial
  CRISPR gRNA sequence
gatgagaatgggagtgaggg

SEQ ID NO: 51136 - DNA, 20 bp, Artificial
  CRISPR gRNA sequence
atgagaatgggagtgagggc

SEQ ID NO: 51137 - DNA, 20 bp, Artificial
  CRISPR gRNA sequence
gagtgagggcaggacctcct

SEQ ID NO: 51138 - DNA, 20 bp, Artificial
  CRISPR gRNA sequence
gtgagggcaggacctccttg

SEQ ID NO: 51139 - DNA, 20 bp, Artificial
  CRISPR gRNA sequence
gacctccttggagccctgcc

SEQ ID NO: 51140 - DNA, 20 bp, Artificial
  CRISPR gRNA sequence
agccccctccatctcccttc

SEQ ID NO: 51141 - DNA, 20 bp, Artificial
  CRISPR gRNA sequence
cccttccagctgtcatttcc

SEQ ID NO: 51142 - DNA, 20 bp, Artificial
  CRISPR gRNA sequence
ttccagctgtcatttccaag

SEQ ID NO: 51143 - DNA, 20 bp, Artificial
  CRISPR gRNA sequence
ccagctgtcatttccaagaa

SEQ ID NO: 51144 - DNA, 20 bp, Artificial
  CRISPR gRNA sequence
gctgtcatttccaagaagag

SEQ ID NO: 51145 - DNA, 20 bp, Artificial
  CRISPR gRNA sequence
gaagagaagcctccatgtct

SEQ ID NO: 51146 - DNA, 20 bp, Artificial
  CRISPR gRNA sequence
atgtctaagcatctattctc

SEQ ID NO: 51147 - DNA, 20 bp, Artificial
  CRISPR gRNA sequence
ctaagcatctattctccaga

SEQ ID NO: 51148 - DNA, 20 bp, Artificial
  CRISPR gRNA sequence
attctccagatggacacact

SEQ ID NO: 51149 - DNA, 20 bp, Artificial
  CRISPR gRNA sequence
ttctccagatggacacactg

SEQ ID NO: 51150 - DNA, 20 bp, Artificial
  CRISPR gRNA sequence
cagatggacacactgaggcc

SEQ ID NO: 51151 - DNA, 20 bp, Artificial
  CRISPR gRNA sequence
atggacacactgaggcccag

SEQ ID NO: 51152 - DNA, 20 bp, Artificial
  CRISPR gRNA sequence
tggacacactgaggcccaga

SEQ ID NO: 51153 - DNA, 20 bp, Artificial
  CRISPR gRNA sequence
agaaggataccatccccaca

SEQ ID NO: 51154 - DNA, 20 bp, Artificial
  CRISPR gRNA sequence
gaaggataccatccccacac

SEQ ID NO: 51155 - DNA, 20 bp, Artificial
  CRISPR gRNA sequence
ggataccatccccacacagg

SEQ ID NO: 51156 - DNA, 20 bp, Artificial
  CRISPR gRNA sequence
catccccacacaggcagaac

SEQ ID NO: 51157 - DNA, 20 bp, Artificial
  CRISPR gRNA sequence
cacacaggcagaactggcac

SEQ ID NO: 51158 - DNA, 20 bp, Artificial
  CRISPR gRNA sequence
cagaactggcaccagaccct

SEQ ID NO: 51159 - DNA, 20 bp, Artificial
  CRISPR gRNA sequence
gcaccagaccctgagtcctt

SEQ ID NO: 51160 - DNA, 20 bp, Artificial
  CRISPR gRNA sequence
caccctgcccgctgcccctg

SEQ ID NO: 51161 - DNA, 20 bp, Artificial
  CRISPR gRNA sequence
tgcccgctgcccctgtggtc

SEQ ID NO: 51162 - DNA, 20 bp, Artificial
  CRISPR gRNA sequence
gcccgctgcccctgtggtct

SEQ ID NO: 51163 - DNA, 20 bp, Artificial
  CRISPR gRNA sequence
cccgctgcccctgtggtctg

SEQ ID NO: 51164 - DNA, 20 bp, Artificial
  CRISPR gRNA sequence
tgcccctgtggtctggggtc

SEQ ID NO: 51165 - DNA, 20 bp, Artificial
  CRISPR gRNA sequence
gcccctgtggtctggggtct

SEQ ID NO: 51166 - DNA, 20 bp, Artificial
  CRISPR gRNA sequence
gtggtctggggtctgggcac

SEQ ID NO: 51167 - DNA, 20 bp, Artificial
  CRISPR gRNA sequence
tctggggtctgggcactggc

SEQ ID NO: 51168 - DNA, 20 bp, Artificial
  CRISPR gRNA sequence
ctggggtctgggcactggca

SEQ ID NO: 51169 - DNA, 20 bp, Artificial
  CRISPR gRNA sequence
ggtctgggcactggcaaggc

SEQ ID NO: 51170 - DNA, 20 bp, Artificial
  CRISPR gRNA sequence
gtctgggcactggcaaggcc

SEQ ID NO: 51171 - DNA, 20 bp, Artificial
  CRISPR gRNA sequence
gggcactggcaaggccaggc

SEQ ID NO: 51172 - DNA, 20 bp, Artificial
  CRISPR gRNA sequence
cactggcaaggccaggctgg

SEQ ID NO: 51173 - DNA, 20 bp, Artificial
  CRISPR gRNA sequence
caaggccaggctggcagctc

SEQ ID NO: 51174 - DNA, 20 bp, Artificial
  CRISPR gRNA sequence
ctggcagctctagccccgca

SEQ ID NO: 51175 - DNA, 20 bp, Artificial
  CRISPR gRNA sequence
tggcagctctagccccgcat

SEQ ID NO: 51176 - DNA, 20 bp, Artificial
  CRISPR gRNA sequence
gctctagccccgcatgggtc

SEQ ID NO: 51177 - DNA, 20 bp, Artificial
  CRISPR gRNA sequence
ctctagccccgcatgggtca

SEQ ID NO: 51178 - DNA, 20 bp, Artificial
  CRISPR gRNA sequence
cgcatgggtcaaggactccc

SEQ ID NO: 51179 - DNA, 20 bp, Artificial
  CRISPR gRNA sequence
gtcaaggactcccgagcacg

SEQ ID NO: 51180 - DNA, 20 bp, Artificial
  CRISPR gRNA sequence
ggactcccgagcacgaagct

SEQ ID NO: 51181 - DNA, 20 bp, Artificial
  CRISPR gRNA sequence
gagcacgaagctcagttgcc

SEQ ID NO: 51182 - DNA, 20 bp, Artificial
  CRISPR gRNA sequence
aagctcagttgcctagcaac

SEQ ID NO: 51183 - DNA, 20 bp, Artificial
  CRISPR gRNA sequence
ctcagttgcctagcaacaag

SEQ ID NO: 51184 - DNA, 20 bp, Artificial
  CRISPR gRNA sequence
cctagcaacaagtggtgtcc

SEQ ID NO: 51185 - DNA, 20 bp, Artificial
  CRISPR gRNA sequence
tagcaacaagtggtgtcctg

SEQ ID NO: 51186 - DNA, 20 bp, Artificial
  CRISPR gRNA sequence
aacaagtggtgtcctggagc

SEQ ID NO: 51187 - DNA, 20 bp, Artificial
  CRISPR gRNA sequence
cctggagctggctgtcactc

SEQ ID NO: 51188 - DNA, 20 bp, Artificial
  CRISPR gRNA sequence
ggagctggctgtcactccag

SEQ ID NO: 51189 - DNA, 20 bp, Artificial
  CRISPR gRNA sequence
gagctggctgtcactccagc

SEQ ID NO: 51190 - DNA, 20 bp, Artificial
  CRISPR gRNA sequence
gctgtcactccagcaggtca

SEQ ID NO: 51191 - DNA, 20 bp, Artificial
  CRISPR gRNA sequence
ctgtcactccagcaggtcac

SEQ ID NO: 51192 - DNA, 20 bp, Artificial
  CRISPR gRNA sequence
gtcactccagcaggtcacgg

SEQ ID NO: 51193 - DNA, 20 bp, Artificial
  CRISPR gRNA sequence
cactccagcaggtcacggga

SEQ ID NO: 51194 - DNA, 20 bp, Artificial
  CRISPR gRNA sequence
ccagcaggtcacgggagaga

SEQ ID NO: 51195 - DNA, 20 bp, Artificial
  CRISPR gRNA sequence
cagcaggtcacgggagagat

SEQ ID NO: 51196 - DNA, 20 bp, Artificial
  CRISPR gRNA sequence
agcaggtcacgggagagatg

SEQ ID NO: 51197 - DNA, 20 bp, Artificial
  CRISPR gRNA sequence
ggagagatggggcaaccatg

SEQ ID NO: 51198 - DNA, 20 bp, Artificial
  CRISPR gRNA sequence
aaccatgtggatgacttcct

SEQ ID NO: 51199 - DNA, 20 bp, Artificial
  CRISPR gRNA sequence
accatgtggatgacttccta

SEQ ID NO: 51200 - DNA, 20 bp, Artificial
  CRISPR gRNA sequence
ctaaggccccttgcctgcca

SEQ ID NO: 51201 - DNA, 20 bp, Artificial
  CRISPR gRNA sequence
taaggccccttgcctgccac

SEQ ID NO: 51202 - DNA, 20 bp, Artificial
  CRISPR gRNA sequence
aaggccccttgcctgccaca

SEQ ID NO: 51203 - DNA, 20 bp, Artificial
  CRISPR gRNA sequence
atctccacatttatgttcca

SEQ ID NO: 51204 - DNA, 20 bp, Artificial
  CRISPR gRNA sequence
cacatttatgttccacagat

SEQ ID NO: 51205 - DNA, 20 bp, Artificial
  CRISPR gRNA sequence
acatttatgttccacagatt

SEQ ID NO: 51206 - DNA, 20 bp, Artificial
  CRISPR gRNA sequence
ttatgttccacagattgggt

SEQ ID NO: 51207 - DNA, 20 bp, Artificial
  CRISPR gRNA sequence
tgttccacagattgggtcag

SEQ ID NO: 51208 - DNA, 20 bp, Artificial
  CRISPR gRNA sequence
agattgggtcagaagaattt

SEQ ID NO: 51209 - DNA, 20 bp, Artificial
  CRISPR gRNA sequence
gattgggtcagaagaatttc

SEQ ID NO: 51210 - DNA, 20 bp, Artificial
  CRISPR gRNA sequence
attgggtcagaagaatttca

SEQ ID NO: 51211 - DNA, 20 bp, Artificial
  CRISPR gRNA sequence
ggtcagaagaatttcaggga

SEQ ID NO: 51212 - DNA, 20 bp, Artificial
  CRISPR gRNA sequence
gtcagaagaatttcagggac

SEQ ID NO: 51213 - DNA, 20 bp, Artificial
  CRISPR gRNA sequence
gaagaatttcagggacggga

SEQ ID NO: 51214 - DNA, 20 bp, Artificial
  CRISPR gRNA sequence
atttcagggacgggatggac

SEQ ID NO: 51215 - DNA, 20 bp, Artificial
  CRISPR gRNA sequence
tttcagggacgggatggacc

SEQ ID NO: 51216 - DNA, 20 bp, Artificial
  CRISPR gRNA sequence
tcagggacgggatggaccag

SEQ ID NO: 51217 - DNA, 20 bp, Artificial
  CRISPR gRNA sequence
ggacgggatggaccaggagc

SEQ ID NO: 51218 - DNA, 20 bp, Artificial
  CRISPR gRNA sequence
gacgggatggaccaggagcc

SEQ ID NO: 51219 - DNA, 20 bp, Artificial
  CRISPR gRNA sequence
gggatggaccaggagccagg

SEQ ID NO: 51220 - DNA, 20 bp, Artificial
  CRISPR gRNA sequence
aggcagctgcaatcccgcat

SEQ ID NO: 51221 - DNA, 20 bp, Artificial
  CRISPR gRNA sequence
agctgcaatcccgcatcagc

SEQ ID NO: 51222 - DNA, 20 bp, Artificial
  CRISPR gRNA sequence
gcaatcccgcatcagctggt

SEQ ID NO: 51223 - DNA, 20 bp, Artificial
  CRISPR gRNA sequence
caatcccgcatcagctggtt

SEQ ID NO: 51224 - DNA, 20 bp, Artificial
  CRISPR gRNA sequence
aatcccgcatcagctggttg

SEQ ID NO: 51225 - DNA, 20 bp, Artificial
  CRISPR gRNA sequence
ccgcatcagctggttgggga

SEQ ID NO: 51226 - DNA, 20 bp, Artificial
  CRISPR gRNA sequence
gaatgttgcttccctgtccc

SEQ ID NO: 51227 - DNA, 20 bp, Artificial
  CRISPR gRNA sequence
aatgttgcttccctgtcccc

SEQ ID NO: 51228 - DNA, 20 bp, Artificial
  CRISPR gRNA sequence
ttgcttccctgtccccaggt

SEQ ID NO: 51229 - DNA, 20 bp, Artificial
  CRISPR gRNA sequence
tccctgtccccaggtcagtt

SEQ ID NO: 51230 - DNA, 20 bp, Artificial
  CRISPR gRNA sequence
tccccaggtcagtttggctg

SEQ ID NO: 51231 - DNA, 20 bp, Artificial
  CRISPR gRNA sequence
ccccaggtcagtttggctgt

SEQ ID NO: 51232 - DNA, 20 bp, Artificial
  CRISPR gRNA sequence
cccaggtcagtttggctgta

SEQ ID NO: 51233 - DNA, 20 bp, Artificial
  CRISPR gRNA sequence
ccaggtcagtttggctgtag

SEQ ID NO: 51234 - DNA, 20 bp, Artificial
  CRISPR gRNA sequence
tgtcaccctgccacgaatca

SEQ ID NO: 51235 - DNA, 20 bp, Artificial
  CRISPR gRNA sequence
ccacgaatcacagcctctct

SEQ ID NO: 51236 - DNA, 20 bp, Artificial
  CRISPR gRNA sequence
cacgaatcacagcctctctt

SEQ ID NO: 51237 - DNA, 20 bp, Artificial
  CRISPR gRNA sequence
cacagcctctcttgggtgtt

SEQ ID NO: 51238 - DNA, 20 bp, Artificial
  CRISPR gRNA sequence
agcctctcttgggtgtttgg

SEQ ID NO: 51239 - DNA, 20 bp, Artificial
  CRISPR gRNA sequence
cctctcttgggtgtttggtg

SEQ ID NO: 51240 - DNA, 20 bp, Artificial
  CRISPR gRNA sequence
ctctcttgggtgtttggtgg

SEQ ID NO: 51241 - DNA, 20 bp, Artificial
  CRISPR gRNA sequence
tttggtggaggatctgccca

SEQ ID NO: 51242 - DNA, 20 bp, Artificial
  CRISPR gRNA sequence
ggtggaggatctgcccatgg

SEQ ID NO: 51243 - DNA, 20 bp, Artificial
  CRISPR gRNA sequence
gtggaggatctgcccatggt

SEQ ID NO: 51244 - DNA, 20 bp, Artificial
  CRISPR gRNA sequence
gatctgcccatggtgggtgt

SEQ ID NO: 51245 - DNA, 20 bp, Artificial
  CRISPR gRNA sequence
atctgcccatggtgggtgtg

SEQ ID NO: 51246 - DNA, 20 bp, Artificial
  CRISPR gRNA sequence
tctgcccatggtgggtgtga

SEQ ID NO: 51247 - DNA, 20 bp, Artificial
  CRISPR gRNA sequence
cccatggtgggtgtgaggga

SEQ ID NO: 51248 - DNA, 20 bp, Artificial
  CRISPR gRNA sequence
catggtgggtgtgagggaca

SEQ ID NO: 51249 - DNA, 20 bp, Artificial
  CRISPR gRNA sequence
atggtgggtgtgagggacag

SEQ ID NO: 51250 - DNA, 20 bp, Artificial
  CRISPR gRNA sequence
tgggtgtgagggacagagga

SEQ ID NO: 51251 - DNA, 20 bp, Artificial
  CRISPR gRNA sequence
gggtgtgagggacagaggaa

SEQ ID NO: 51252 - DNA, 20 bp, Artificial
  CRISPR gRNA sequence
agggacagaggaaaggaccc

SEQ ID NO: 51253 - DNA, 20 bp, Artificial
  CRISPR gRNA sequence
gggacagaggaaaggaccca

SEQ ID NO: 51254 - DNA, 20 bp, Artificial
  CRISPR gRNA sequence
cagaggaaaggacccaaggc

SEQ ID NO: 51255 - DNA, 20 bp, Artificial
  CRISPR gRNA sequence
agaggaaaggacccaaggcc

SEQ ID NO: 51256 - DNA, 20 bp, Artificial
  CRISPR gRNA sequence
gaggaaaggacccaaggcca

SEQ ID NO: 51257 - DNA, 20 bp, Artificial
  CRISPR gRNA sequence
aggaaaggacccaaggccag

SEQ ID NO: 51258 - DNA, 20 bp, Artificial
  CRISPR gRNA sequence
gaaaggacccaaggccaggg

SEQ ID NO: 51259 - DNA, 20 bp, Artificial
  CRISPR gRNA sequence
gacccaaggccaggggagtg

SEQ ID NO: 51260 - DNA, 20 bp, Artificial
  CRISPR gRNA sequence
acccaaggccaggggagtga

SEQ ID NO: 51261 - DNA, 20 bp, Artificial
  CRISPR gRNA sequence
aaggccaggggagtgaaggc

SEQ ID NO: 51262 - DNA, 20 bp, Artificial
  CRISPR gRNA sequence
aggccaggggagtgaaggca

SEQ ID NO: 51263 - DNA, 20 bp, Artificial
  CRISPR gRNA sequence
ggccaggggagtgaaggcaa

SEQ ID NO: 51264 - DNA, 20 bp, Artificial
  CRISPR gRNA sequence
caggggagtgaaggcaaggg

SEQ ID NO: 51265 - DNA, 20 bp, Artificial
  CRISPR gRNA sequence
gaattgccccttgccctcca

SEQ ID NO: 51266 - DNA, 20 bp, Artificial
  CRISPR gRNA sequence
cctccacagtccttgtcctc

SEQ ID NO: 51267 - DNA, 20 bp, Artificial
  CRISPR gRNA sequence
gtccttgtcctctggtgctc

SEQ ID NO: 51268 - DNA, 20 bp, Artificial
  CRISPR gRNA sequence
tccttgtcctctggtgctct

SEQ ID NO: 51269 - DNA, 20 bp, Artificial
  CRISPR gRNA sequence
ccttgtcctctggtgctctg

SEQ ID NO: 51270 - DNA, 20 bp, Artificial
  CRISPR gRNA sequence
cttgtcctctggtgctctgg

SEQ ID NO: 51271 - DNA, 20 bp, Artificial
  CRISPR gRNA sequence
ggtgctctgggggatgccct

SEQ ID NO: 51272 - DNA, 20 bp, Artificial
  CRISPR gRNA sequence
gctctgggggatgccctcag

SEQ ID NO: 51273 - DNA, 20 bp, Artificial
  CRISPR gRNA sequence
ctctgggggatgccctcaga

SEQ ID NO: 51274 - DNA, 20 bp, Artificial
  CRISPR gRNA sequence
ctgggggatgccctcagaag

SEQ ID NO: 51275 - DNA, 20 bp, Artificial
  CRISPR gRNA sequence
aggagcccccatcatgcttt

SEQ ID NO: 51276 - DNA, 20 bp, Artificial
  CRISPR gRNA sequence
cccccatcatgcttttggcc

SEQ ID NO: 51277 - DNA, 20 bp, Artificial
  CRISPR gRNA sequence
ccccatcatgcttttggcct

SEQ ID NO: 51278 - DNA, 20 bp, Artificial
  CRISPR gRNA sequence
cccatcatgcttttggccta

SEQ ID NO: 51279 - DNA, 20 bp, Artificial
  CRISPR gRNA sequence
ccatcatgcttttggcctag

SEQ ID NO: 51280 - DNA, 20 bp, Artificial
  CRISPR gRNA sequence
atcatgcttttggcctaggg

SEQ ID NO: 51281 - DNA, 20 bp, Artificial
  CRISPR gRNA sequence
atgctgctttccacttactc

SEQ ID NO: 51282 - DNA, 20 bp, Artificial
  CRISPR gRNA sequence
ttccacttactcaagcaaac

SEQ ID NO: 51283 - DNA, 20 bp, Artificial
  CRISPR gRNA sequence
ccacttactcaagcaaaccg

SEQ ID NO: 51284 - DNA, 20 bp, Artificial
  CRISPR gRNA sequence
ttactcaagcaaaccggaga

SEQ ID NO: 51285 - DNA, 20 bp, Artificial
  CRISPR gRNA sequence
tactcaagcaaaccggagat

SEQ ID NO: 51286 - DNA, 20 bp, Artificial
  CRISPR gRNA sequence
aaaccggagatgggcacctg

SEQ ID NO: 51287 - DNA, 20 bp, Artificial
  CRISPR gRNA sequence
ccggagatgggcacctgcgg

SEQ ID NO: 51288 - DNA, 20 bp, Artificial
  CRISPR gRNA sequence
ggcacctgcggcagacattc

SEQ ID NO: 51289 - DNA, 20 bp, Artificial
  CRISPR gRNA sequence
acctgcggcagacattccag

SEQ ID NO: 51290 - DNA, 20 bp, Artificial
  CRISPR gRNA sequence
cctgcggcagacattccaga

SEQ ID NO: 51291 - DNA, 20 bp, Artificial
  CRISPR gRNA sequence
agacattccagaaggcatct

SEQ ID NO: 51292 - DNA, 20 bp, Artificial
  CRISPR gRNA sequence
catctgagtccgctgtcgcc

SEQ ID NO: 51293 - DNA, 20 bp, Artificial
  CRISPR gRNA sequence
ctgagtccgctgtcgcccag

SEQ ID NO: 51294 - DNA, 20 bp, Artificial
  CRISPR gRNA sequence
tgagtccgctgtcgcccagc

SEQ ID NO: 51295 - DNA, 20 bp, Artificial
  CRISPR gRNA sequence
tgtcgcccagcaggtttgct

SEQ ID NO: 51296 - DNA, 20 bp, Artificial
  CRISPR gRNA sequence
tcgcccagcaggtttgctga

SEQ ID NO: 51297 - DNA, 20 bp, Artificial
  CRISPR gRNA sequence
gcaggtttgctgagagactg

SEQ ID NO: 51298 - DNA, 20 bp, Artificial
  CRISPR gRNA sequence
caggtttgctgagagactgt

SEQ ID NO: 51299 - DNA, 20 bp, Artificial
  CRISPR gRNA sequence
aggtttgctgagagactgta

SEQ ID NO: 51300 - DNA, 20 bp, Artificial
  CRISPR gRNA sequence
ggtttgctgagagactgtag

SEQ ID NO: 51301 - DNA, 20 bp, Artificial
  CRISPR gRNA sequence
gtttgctgagagactgtagg

SEQ ID NO: 51302 - DNA, 20 bp, Artificial
  CRISPR gRNA sequence
gctgagagactgtagggggt

SEQ ID NO: 51303 - DNA, 20 bp, Artificial
  CRISPR gRNA sequence
ctgagagactgtagggggta

SEQ ID NO: 51304 - DNA, 20 bp, Artificial
  CRISPR gRNA sequence
gagagactgtagggggtaag

SEQ ID NO: 51305 - DNA, 20 bp, Artificial
  CRISPR gRNA sequence
agactgtagggggtaaggag

SEQ ID NO: 51306 - DNA, 20 bp, Artificial
  CRISPR gRNA sequence
ctgtagggggtaaggagcag

SEQ ID NO: 51307 - DNA, 20 bp, Artificial
  CRISPR gRNA sequence
tagggggtaaggagcagtgg

SEQ ID NO: 51308 - DNA, 20 bp, Artificial
  CRISPR gRNA sequence
agggggtaaggagcagtggc

SEQ ID NO: 51309 - DNA, 20 bp, Artificial
  CRISPR gRNA sequence
gggggtaaggagcagtggcg

SEQ ID NO: 51310 - DNA, 20 bp, Artificial
  CRISPR gRNA sequence
taaggagcagtggcggggat

SEQ ID NO: 51311 - DNA, 20 bp, Artificial
  CRISPR gRNA sequence
aggagcagtggcggggatca

SEQ ID NO: 51312 - DNA, 20 bp, Artificial
  CRISPR gRNA sequence
ggagcagtggcggggatcag

SEQ ID NO: 51313 - DNA, 20 bp, Artificial
  CRISPR gRNA sequence
ggggatcagaggtgcctcct

SEQ ID NO: 51314 - DNA, 20 bp, Artificial
  CRISPR gRNA sequence
cagaggtgcctcctcagcct

SEQ ID NO: 51315 - DNA, 20 bp, Artificial
  CRISPR gRNA sequence
cctcagcctgagatgctcct

SEQ ID NO: 51316 - DNA, 20 bp, Artificial
  CRISPR gRNA sequence
ctgagatgctcctcagtcac

SEQ ID NO: 51317 - DNA, 20 bp, Artificial
  CRISPR gRNA sequence
tgagatgctcctcagtcacc

SEQ ID NO: 51318 - DNA, 20 bp, Artificial
  CRISPR gRNA sequence
agatgctcctcagtcaccag

SEQ ID NO: 51319 - DNA, 20 bp, Artificial
  CRISPR gRNA sequence
gcatccactgtcactgctac

SEQ ID NO: 51320 - DNA, 20 bp, Artificial
  CRISPR gRNA sequence
actgctactggaccccatgt

SEQ ID NO: 51321 - DNA, 20 bp, Artificial
  CRISPR gRNA sequence
ctgctactggaccccatgtc

SEQ ID NO: 51322 - DNA, 20 bp, Artificial
  CRISPR gRNA sequence
tgctactggaccccatgtca

SEQ ID NO: 51323 - DNA, 20 bp, Artificial
  CRISPR gRNA sequence
ggaccccatgtcagggtcac

SEQ ID NO: 51324 - DNA, 20 bp, Artificial
  CRISPR gRNA sequence
accaccatcaccaccatcac

SEQ ID NO: 51325 - DNA, 20 bp, Artificial
  CRISPR gRNA sequence
accaccaatgtcaccaccac

SEQ ID NO: 51326 - DNA, 20 bp, Artificial
  CRISPR gRNA sequence
caccacaattctacaccacc

SEQ ID NO: 51327 - DNA, 20 bp, Artificial
  CRISPR gRNA sequence
caattctacaccaccaagcc

SEQ ID NO: 51328 - DNA, 20 bp, Artificial
  CRISPR gRNA sequence
accatcccttccatcaccac

SEQ ID NO: 51329 - DNA, 20 bp, Artificial
  CRISPR gRNA sequence
tccatcaccactagaatgac

SEQ ID NO: 51330 - DNA, 20 bp, Artificial
  CRISPR gRNA sequence
ctctgctactatcccctccc

SEQ ID NO: 51331 - DNA, 20 bp, Artificial
  CRISPR gRNA sequence
ctatcccctccccagcacca

SEQ ID NO: 51332 - DNA, 20 bp, Artificial
  CRISPR gRNA sequence
ccacagtaaacccatcctct

SEQ ID NO: 51333 - DNA, 20 bp, Artificial
  CRISPR gRNA sequence
ctcttggtcctcttccatat

SEQ ID NO: 51334 - DNA, 20 bp, Artificial
  CRISPR gRNA sequence
tcttggtcctcttccatatc

SEQ ID NO: 51335 - DNA, 20 bp, Artificial
  CRISPR gRNA sequence
ccatatcgggtgaccactca

SEQ ID NO: 51336 - DNA, 20 bp, Artificial
  CRISPR gRNA sequence
tcgggtgaccactcatagct

SEQ ID NO: 51337 - DNA, 20 bp, Artificial
  CRISPR gRNA sequence
cgggtgaccactcatagctc

SEQ ID NO: 51338 - DNA, 20 bp, Artificial
  CRISPR gRNA sequence
actcatagctcaggtgcctc

SEQ ID NO: 51339 - DNA, 20 bp, Artificial
  CRISPR gRNA sequence
catagctcaggtgcctccag

SEQ ID NO: 51340 - DNA, 20 bp, Artificial
  CRISPR gRNA sequence
atagctcaggtgcctccagc

SEQ ID NO: 51341 - DNA, 20 bp, Artificial
  CRISPR gRNA sequence
ggtgcctccagcaggctttc

SEQ ID NO: 51342 - DNA, 20 bp, Artificial
  CRISPR gRNA sequence
gtgcctccagcaggctttca

SEQ ID NO: 51343 - DNA, 20 bp, Artificial
  CRISPR gRNA sequence
tgcctccagcaggctttcaa

SEQ ID NO: 51344 - DNA, 20 bp, Artificial
  CRISPR gRNA sequence
cagcaggctttcaagggtta

SEQ ID NO: 51345 - DNA, 20 bp, Artificial
  CRISPR gRNA sequence
atttgccttcaccacgccct

SEQ ID NO: 51346 - DNA, 20 bp, Artificial
  CRISPR gRNA sequence
gccttcaccacgcccttggc

SEQ ID NO: 51347 - DNA, 20 bp, Artificial
  CRISPR gRNA sequence
cgcccttggccggcatcatt

SEQ ID NO: 51348 - DNA, 20 bp, Artificial
  CRISPR gRNA sequence
gcccttggccggcatcattt

SEQ ID NO: 51349 - DNA, 20 bp, Artificial
  CRISPR gRNA sequence
ccggcatcatttgggatcca

SEQ ID NO: 51350 - DNA, 20 bp, Artificial
  CRISPR gRNA sequence
gggatccacagtttttgaat

SEQ ID NO: 51351 - DNA, 20 bp, Artificial
  CRISPR gRNA sequence
gatccacagtttttgaatga

SEQ ID NO: 51352 - DNA, 20 bp, Artificial
  CRISPR gRNA sequence
atccacagtttttgaatgag

SEQ ID NO: 51353 - DNA, 20 bp, Artificial
  CRISPR gRNA sequence
tttttgaatgagaggaaatt

SEQ ID NO: 51354 - DNA, 20 bp, Artificial
  CRISPR gRNA sequence
ttttgaatgagaggaaattc

SEQ ID NO: 51355 - DNA, 20 bp, Artificial
  CRISPR gRNA sequence
tcaggaaaaaaaaatgtttg

SEQ ID NO: 51356 - DNA, 20 bp, Artificial
  CRISPR gRNA sequence
caggaaaaaaaaatgtttgc

SEQ ID NO: 51357 - DNA, 20 bp, Artificial
  CRISPR gRNA sequence
tgcaggatgcattaaaccca

SEQ ID NO: 51358 - DNA, 20 bp, Artificial
  CRISPR gRNA sequence
atagatttcttcttttaatc

SEQ ID NO: 51359 - DNA, 20 bp, Artificial
  CRISPR gRNA sequence
tagatttcttcttttaatct

SEQ ID NO: 51360 - DNA, 20 bp, Artificial
  CRISPR gRNA sequence
tgggaatgcaatatcaatat

SEQ ID NO: 51361 - DNA, 20 bp, Artificial
  CRISPR gRNA sequence
aatattggaaacctcacctg

SEQ ID NO: 51362 - DNA, 20 bp, Artificial
  CRISPR gRNA sequence
tttcttacttcccttcattg

SEQ ID NO: 51363 - DNA, 20 bp, Artificial
  CRISPR gRNA sequence
cccttcattgcagcattctg

SEQ ID NO: 51364 - DNA, 20 bp, Artificial
  CRISPR gRNA sequence
tttatttatttatttatttt

SEQ ID NO: 51365 - DNA, 20 bp, Artificial
  CRISPR gRNA sequence
tttatttatttattttgaga

SEQ ID NO: 51366 - DNA, 20 bp, Artificial
  CRISPR gRNA sequence
tatttatttattttgagatg

SEQ ID NO: 51367 - DNA, 20 bp, Artificial
  CRISPR gRNA sequence
tggagtcttgctctgttgcc

SEQ ID NO: 51368 - DNA, 20 bp, Artificial
  CRISPR gRNA sequence
ggagtcttgctctgttgccc

SEQ ID NO: 51369 - DNA, 20 bp, Artificial
  CRISPR gRNA sequence
tcttgctctgttgcccaggc

SEQ ID NO: 51370 - DNA, 20 bp, Artificial
  CRISPR gRNA sequence
ttgctctgttgcccaggctg

SEQ ID NO: 51371 - DNA, 20 bp, Artificial
  CRISPR gRNA sequence
ttgcccaggctggagtgcaa

SEQ ID NO: 51372 - DNA, 20 bp, Artificial
  CRISPR gRNA sequence
ggagtgcaatggcacgatct

SEQ ID NO: 51373 - DNA, 20 bp, Artificial
  CRISPR gRNA sequence
tcactgcgacctctgtctcc

SEQ ID NO: 51374 - DNA, 20 bp, Artificial
  CRISPR gRNA sequence
cactgcgacctctgtctccc

SEQ ID NO: 51375 - DNA, 20 bp, Artificial
  CRISPR gRNA sequence
gacctctgtctcccaggttc

SEQ ID NO: 51376 - DNA, 20 bp, Artificial
  CRISPR gRNA sequence
cctctgtctcccaggttcaa

SEQ ID NO: 51377 - DNA, 20 bp, Artificial
  CRISPR gRNA sequence
ttcaagagattctcctgcct

SEQ ID NO: 51378 - DNA, 20 bp, Artificial
  CRISPR gRNA sequence
ttctcctgcctcagcctccc

SEQ ID NO: 51379 - DNA, 20 bp, Artificial
  CRISPR gRNA sequence
tcctgcctcagcctcccaag

SEQ ID NO: 51380 - DNA, 20 bp, Artificial
  CRISPR gRNA sequence
gcctcagcctcccaagtagc

SEQ ID NO: 51381 - DNA, 20 bp, Artificial
  CRISPR gRNA sequence
cctcagcctcccaagtagct

SEQ ID NO: 51382 - DNA, 20 bp, Artificial
  CRISPR gRNA sequence
ctcccaagtagctgggatta

SEQ ID NO: 51383 - DNA, 20 bp, Artificial
  CRISPR gRNA sequence
tcccaagtagctgggattac

SEQ ID NO: 51384 - DNA, 20 bp, Artificial
  CRISPR gRNA sequence
caggcatgtgccactatgcc

SEQ ID NO: 51385 - DNA, 20 bp, Artificial
  CRISPR gRNA sequence
gctaattatttttgtatttt

SEQ ID NO: 51386 - DNA, 20 bp, Artificial
  CRISPR gRNA sequence
aattatttttgtatttttag

SEQ ID NO: 51387 - DNA, 20 bp, Artificial
  CRISPR gRNA sequence
ttatttttgtatttttagta

SEQ ID NO: 51388 - DNA, 20 bp, Artificial
  CRISPR gRNA sequence
ttttgtatttttagtagaga

SEQ ID NO: 51389 - DNA, 20 bp, Artificial
  CRISPR gRNA sequence
tttgtatttttagtagagac

SEQ ID NO: 51390 - DNA, 20 bp, Artificial
  CRISPR gRNA sequence
cgggttttcaccatgttgat

SEQ ID NO: 51391 - DNA, 20 bp, Artificial
  CRISPR gRNA sequence
gggttttcaccatgttgatc

SEQ ID NO: 51392 - DNA, 20 bp, Artificial
  CRISPR gRNA sequence
tttcaccatgttgatcaggc

SEQ ID NO: 51393 - DNA, 20 bp, Artificial
  CRISPR gRNA sequence
tggtctcaaactcctgacct

SEQ ID NO: 51394 - DNA, 20 bp, Artificial
  CRISPR gRNA sequence
ggtctcaaactcctgacctc

SEQ ID NO: 51395 - DNA, 20 bp, Artificial
  CRISPR gRNA sequence
ctcaggtgatccacccgctt

SEQ ID NO: 51396 - DNA, 20 bp, Artificial
  CRISPR gRNA sequence
ccacccgctttggcctccca

SEQ ID NO: 51397 - DNA, 20 bp, Artificial
  CRISPR gRNA sequence
gctttggcctcccaaagtgc

SEQ ID NO: 51398 - DNA, 20 bp, Artificial
  CRISPR gRNA sequence
ctttggcctcccaaagtgct

SEQ ID NO: 51399 - DNA, 20 bp, Artificial
  CRISPR gRNA sequence
ctcccaaagtgctgggatta

SEQ ID NO: 51400 - DNA, 20 bp, Artificial
  CRISPR gRNA sequence
tcccaaagtgctgggattac

SEQ ID NO: 51401 - DNA, 20 bp, Artificial
  CRISPR gRNA sequence
agtgctgggattacaggcgt

SEQ ID NO: 51402 - DNA, 20 bp, Artificial
  CRISPR gRNA sequence
caggcgtgagccaccacgcc

SEQ ID NO: 51403 - DNA, 20 bp, Artificial
  CRISPR gRNA sequence
cgtgagccaccacgcccagc

SEQ ID NO: 51404 - DNA, 20 bp, Artificial
  CRISPR gRNA sequence
cgcccagctagttttaacta

SEQ ID NO: 51405 - DNA, 20 bp, Artificial
  CRISPR gRNA sequence
gctagttttaactacagttt

SEQ ID NO: 51406 - DNA, 20 bp, Artificial
  CRISPR gRNA sequence
agtttcagaaataatataac

SEQ ID NO: 51407 - DNA, 20 bp, Artificial
  CRISPR gRNA sequence
ataatataaccagtgtgtcc

SEQ ID NO: 51408 - DNA, 20 bp, Artificial
  CRISPR gRNA sequence
ggaacatctgattttcctcc

SEQ ID NO: 51409 - DNA, 20 bp, Artificial
  CRISPR gRNA sequence
gaacatctgattttcctcct

SEQ ID NO: 51410 - DNA, 20 bp, Artificial
  CRISPR gRNA sequence
tgttaatttcatcttttcct

SEQ ID NO: 51411 - DNA, 20 bp, Artificial
  CRISPR gRNA sequence
gagaaacgtcatttaaaaat

SEQ ID NO: 51412 - DNA, 20 bp, Artificial
  CRISPR gRNA sequence
aaaaattggtctgtcttatg

SEQ ID NO: 51413 - DNA, 20 bp, Artificial
  CRISPR gRNA sequence
tatgaagccacttaataaaa

SEQ ID NO: 51414 - DNA, 20 bp, Artificial
  CRISPR gRNA sequence
aataaaatagtctttaaaat

SEQ ID NO: 51415 - DNA, 20 bp, Artificial
  CRISPR gRNA sequence
gtctttaaaataagaaaaat

SEQ ID NO: 51416 - DNA, 20 bp, Artificial
  CRISPR gRNA sequence
ttaaaataagaaaaattggc

SEQ ID NO: 51417 - DNA, 20 bp, Artificial
  CRISPR gRNA sequence
taaaataagaaaaattggct

SEQ ID NO: 51418 - DNA, 20 bp, Artificial
  CRISPR gRNA sequence
taagaaaaattggctgggtg

SEQ ID NO: 51419 - DNA, 20 bp, Artificial
  CRISPR gRNA sequence
gaaaaattggctgggtgcgg

SEQ ID NO: 51420 - DNA, 20 bp, Artificial
  CRISPR gRNA sequence
ttggctgggtgcggtggctc

SEQ ID NO: 51421 - DNA, 20 bp, Artificial
  CRISPR gRNA sequence
tggctgggtgcggtggctca

SEQ ID NO: 51422 - DNA, 20 bp, Artificial
  CRISPR gRNA sequence
gtggctcaaggctgtaatcc

SEQ ID NO: 51423 - DNA, 20 bp, Artificial
  CRISPR gRNA sequence
aggctgtaatcccagcactt

SEQ ID NO: 51424 - DNA, 20 bp, Artificial
  CRISPR gRNA sequence
ggctgtaatcccagcacttt

SEQ ID NO: 51425 - DNA, 20 bp, Artificial
  CRISPR gRNA sequence
ctgtaatcccagcactttgg

SEQ ID NO: 51426 - DNA, 20 bp, Artificial
  CRISPR gRNA sequence
tgtaatcccagcactttggg

SEQ ID NO: 51427 - DNA, 20 bp, Artificial
  CRISPR gRNA sequence
gtaatcccagcactttggga

SEQ ID NO: 51428 - DNA, 20 bp, Artificial
  CRISPR gRNA sequence
tcccagcactttgggagggc

SEQ ID NO: 51429 - DNA, 20 bp, Artificial
  CRISPR gRNA sequence
cccagcactttgggagggcg

SEQ ID NO: 51430 - DNA, 20 bp, Artificial
  CRISPR gRNA sequence
agcactttgggagggcgagg

SEQ ID NO: 51431 - DNA, 20 bp, Artificial
  CRISPR gRNA sequence
gcactttgggagggcgaggc

SEQ ID NO: 51432 - DNA, 20 bp, Artificial
  CRISPR gRNA sequence
ctttgggagggcgaggcagg

SEQ ID NO: 51433 - DNA, 20 bp, Artificial
  CRISPR gRNA sequence
gcgaggcaggcggatcgcct

SEQ ID NO: 51434 - DNA, 20 bp, Artificial
  CRISPR gRNA sequence
cgaggcaggcggatcgcctg

SEQ ID NO: 51435 - DNA, 20 bp, Artificial
  CRISPR gRNA sequence
gcaggcggatcgcctgaggt

SEQ ID NO: 51436 - DNA, 20 bp, Artificial
  CRISPR gRNA sequence
caggcggatcgcctgaggtc

SEQ ID NO: 51437 - DNA, 20 bp, Artificial
  CRISPR gRNA sequence
ggcggatcgcctgaggtcag

SEQ ID NO: 51438 - DNA, 20 bp, Artificial
  CRISPR gRNA sequence
tcgcctgaggtcaggagttc

SEQ ID NO: 51439 - DNA, 20 bp, Artificial
  CRISPR gRNA sequence
tgaggtcaggagttcaagac

SEQ ID NO: 51440 - DNA, 20 bp, Artificial
  CRISPR gRNA sequence
tcaggagttcaagaccagcc

SEQ ID NO: 51441 - DNA, 20 bp, Artificial
  CRISPR gRNA sequence
caagaccagcctggccaaca

SEQ ID NO: 51442 - DNA, 20 bp, Artificial
  CRISPR gRNA sequence
tctactaaaaataccaaaat

SEQ ID NO: 51443 - DNA, 20 bp, Artificial
  CRISPR gRNA sequence
ctaaaaataccaaaattagc

SEQ ID NO: 51444 - DNA, 20 bp, Artificial
  CRISPR gRNA sequence
taaaaataccaaaattagcc

SEQ ID NO: 51445 - DNA, 20 bp, Artificial
  CRISPR gRNA sequence
ataccaaaattagccaggca

SEQ ID NO: 51446 - DNA, 20 bp, Artificial
  CRISPR gRNA sequence
ccaaaattagccaggcatgg

SEQ ID NO: 51447 - DNA, 20 bp, Artificial
  CRISPR gRNA sequence
gtggctcatgcctgtaatct

SEQ ID NO: 51448 - DNA, 20 bp, Artificial
  CRISPR gRNA sequence
tgcctgtaatctcagctcct

SEQ ID NO: 51449 - DNA, 20 bp, Artificial
  CRISPR gRNA sequence
gcctgtaatctcagctcctt

SEQ ID NO: 51450 - DNA, 20 bp, Artificial
  CRISPR gRNA sequence
ctgtaatctcagctccttgg

SEQ ID NO: 51451 - DNA, 20 bp, Artificial
  CRISPR gRNA sequence
tgtaatctcagctccttggg

SEQ ID NO: 51452 - DNA, 20 bp, Artificial
  CRISPR gRNA sequence
tctcagctccttgggaggct

SEQ ID NO: 51453 - DNA, 20 bp, Artificial
  CRISPR gRNA sequence
ctcagctccttgggaggctg

SEQ ID NO: 51454 - DNA, 20 bp, Artificial
  CRISPR gRNA sequence
agctccttgggaggctgagg

SEQ ID NO: 51455 - DNA, 20 bp, Artificial
  CRISPR gRNA sequence
gctccttgggaggctgaggc

SEQ ID NO: 51456 - DNA, 20 bp, Artificial
  CRISPR gRNA sequence
tccttgggaggctgaggcag

SEQ ID NO: 51457 - DNA, 20 bp, Artificial
  CRISPR gRNA sequence
gcaggagaattgcttgaacc

SEQ ID NO: 51458 - DNA, 20 bp, Artificial
  CRISPR gRNA sequence
caggagaattgcttgaacct

SEQ ID NO: 51459 - DNA, 20 bp, Artificial
  CRISPR gRNA sequence
ggagaattgcttgaacctgg

SEQ ID NO: 51460 - DNA, 20 bp, Artificial
  CRISPR gRNA sequence
gagaattgcttgaacctggg

SEQ ID NO: 51461 - DNA, 20 bp, Artificial
  CRISPR gRNA sequence
aattgcttgaacctgggagg

SEQ ID NO: 51462 - DNA, 20 bp, Artificial
  CRISPR gRNA sequence
tgcttgaacctgggaggcgg

SEQ ID NO: 51463 - DNA, 20 bp, Artificial
  CRISPR gRNA sequence
aacctgggaggcggaagttg

SEQ ID NO: 51464 - DNA, 20 bp, Artificial
  CRISPR gRNA sequence
tgggaggcggaagttgcagt

SEQ ID NO: 51465 - DNA, 20 bp, Artificial
  CRISPR gRNA sequence
gaaattgcgccactgcattc

SEQ ID NO: 51466 - DNA, 20 bp, Artificial
  CRISPR gRNA sequence
tgcgccactgcattccagcc

SEQ ID NO: 51467 - DNA, 20 bp, Artificial
  CRISPR gRNA sequence
gcgccactgcattccagcct

SEQ ID NO: 51468 - DNA, 20 bp, Artificial
  CRISPR gRNA sequence
ccactgcattccagcctggg

SEQ ID NO: 51469 - DNA, 20 bp, Artificial
  CRISPR gRNA sequence
ctgcattccagcctgggcag

SEQ ID NO: 51470 - DNA, 20 bp, Artificial
  CRISPR gRNA sequence
gcattccagcctgggcagca

SEQ ID NO: 51471 - DNA, 20 bp, Artificial
  CRISPR gRNA sequence
tccagcctgggcagcagaga

SEQ ID NO: 51472 - DNA, 20 bp, Artificial
  CRISPR gRNA sequence
aaagactccatctaaaaaaa

SEQ ID NO: 51473 - DNA, 20 bp, Artificial
  CRISPR gRNA sequence
actccatctaaaaaaaaaga

SEQ ID NO: 51474 - DNA, 20 bp, Artificial
  CRISPR gRNA sequence
catctaaaaaaaaagaaaga

SEQ ID NO: 51475 - DNA, 20 bp, Artificial
  CRISPR gRNA sequence
aaaaaaaaagaaagaaagaa

SEQ ID NO: 51476 - DNA, 20 bp, Artificial
  CRISPR gRNA sequence
aatgaaaaacaaaaaactca

SEQ ID NO: 51477 - DNA, 20 bp, Artificial
  CRISPR gRNA sequence
atctgtttaaaatacattcc

SEQ ID NO: 51478 - DNA, 20 bp, Artificial
  CRISPR gRNA sequence
tttaaaatacattccaagca

SEQ ID NO: 51479 - DNA, 20 bp, Artificial
  CRISPR gRNA sequence
aaaatacattccaagcacag

SEQ ID NO: 51480 - DNA, 20 bp, Artificial
  CRISPR gRNA sequence
gcggctcatgcctgtaatct

SEQ ID NO: 51481 - DNA, 20 bp, Artificial
  CRISPR gRNA sequence
tgcctgtaatctcagcaacc

SEQ ID NO: 51482 - DNA, 20 bp, Artificial
  CRISPR gRNA sequence
gcctgtaatctcagcaacct

SEQ ID NO: 51483 - DNA, 20 bp, Artificial
  CRISPR gRNA sequence
ctgtaatctcagcaacctgg

SEQ ID NO: 51484 - DNA, 20 bp, Artificial
  CRISPR gRNA sequence
tgtaatctcagcaacctggg

SEQ ID NO: 51485 - DNA, 20 bp, Artificial
  CRISPR gRNA sequence
tctcagcaacctgggaggct

SEQ ID NO: 51486 - DNA, 20 bp, Artificial
  CRISPR gRNA sequence
ctcagcaacctgggaggctg

SEQ ID NO: 51487 - DNA, 20 bp, Artificial
  CRISPR gRNA sequence
tgggaggctgaggatcacct

SEQ ID NO: 51488 - DNA, 20 bp, Artificial
  CRISPR gRNA sequence
ggctgaggatcacctgagct

SEQ ID NO: 51489 - DNA, 20 bp, Artificial
  CRISPR gRNA sequence
tgaggatcacctgagctcag

SEQ ID NO: 51490 - DNA, 20 bp, Artificial
  CRISPR gRNA sequence
tcacctgagctcagaagttt

SEQ ID NO: 51491 - DNA, 20 bp, Artificial
  CRISPR gRNA sequence
tcagaagtttgagaccaacc

SEQ ID NO: 51492 - DNA, 20 bp, Artificial
  CRISPR gRNA sequence
cagaagtttgagaccaacct

SEQ ID NO: 51493 - DNA, 20 bp, Artificial
  CRISPR gRNA sequence
agaagtttgagaccaacctg

SEQ ID NO: 51494 - DNA, 20 bp, Artificial
  CRISPR gRNA sequence
tgagaccaacctggggaaca

SEQ ID NO: 51495 - DNA, 20 bp, Artificial
  CRISPR gRNA sequence
accaacctggggaacatggt

SEQ ID NO: 51496 - DNA, 20 bp, Artificial
  CRISPR gRNA sequence
ctcttacaaaactaaactat

SEQ ID NO: 51497 - DNA, 20 bp, Artificial
  CRISPR gRNA sequence
tacaaaactaaactattagc

SEQ ID NO: 51498 - DNA, 20 bp, Artificial
  CRISPR gRNA sequence
acaaaactaaactattagcc

SEQ ID NO: 51499 - DNA, 20 bp, Artificial
  CRISPR gRNA sequence
aaactattagccaggcatgt

SEQ ID NO: 51500 - DNA, 20 bp, Artificial
  CRISPR gRNA sequence
ggcatgttggtgtgtgcctg

SEQ ID NO: 51501 - DNA, 20 bp, Artificial
  CRISPR gRNA sequence
ttggtgtgtgcctgtagtcc

SEQ ID NO: 51502 - DNA, 20 bp, Artificial
  CRISPR gRNA sequence
gcctgtagtcccagctactc

SEQ ID NO: 51503 - DNA, 20 bp, Artificial
  CRISPR gRNA sequence
ctgtagtcccagctactcca

SEQ ID NO: 51504 - DNA, 20 bp, Artificial
  CRISPR gRNA sequence
tgtagtcccagctactccag

SEQ ID NO: 51505 - DNA, 20 bp, Artificial
  CRISPR gRNA sequence
tcccagctactccagaggct

SEQ ID NO: 51506 - DNA, 20 bp, Artificial
  CRISPR gRNA sequence
cccagctactccagaggctg

SEQ ID NO: 51507 - DNA, 20 bp, Artificial
  CRISPR gRNA sequence
agctactccagaggctgagg

SEQ ID NO: 51508 - DNA, 20 bp, Artificial
  CRISPR gRNA sequence
gctactccagaggctgaggt

SEQ ID NO: 51509 - DNA, 20 bp, Artificial
  CRISPR gRNA sequence
tactccagaggctgaggtgg

SEQ ID NO: 51510 - DNA, 20 bp, Artificial
  CRISPR gRNA sequence
actccagaggctgaggtggg

SEQ ID NO: 51511 - DNA, 20 bp, Artificial
  CRISPR gRNA sequence
ctgaggtgggaggatcgctt

SEQ ID NO: 51512 - DNA, 20 bp, Artificial
  CRISPR gRNA sequence
gtgggaggatcgcttgagcc

SEQ ID NO: 51513 - DNA, 20 bp, Artificial
  CRISPR gRNA sequence
tgggaggatcgcttgagccc

SEQ ID NO: 51514 - DNA, 20 bp, Artificial
  CRISPR gRNA sequence
ggaggatcgcttgagcccag

SEQ ID NO: 51515 - DNA, 20 bp, Artificial
  CRISPR gRNA sequence
gatcgcttgagcccaggagt

SEQ ID NO: 51516 - DNA, 20 bp, Artificial
  CRISPR gRNA sequence
tcgcttgagcccaggagttg

SEQ ID NO: 51517 - DNA, 20 bp, Artificial
  CRISPR gRNA sequence
cgcttgagcccaggagttgg

SEQ ID NO: 51518 - DNA, 20 bp, Artificial
  CRISPR gRNA sequence
agcccaggagttggaggctg

SEQ ID NO: 51519 - DNA, 20 bp, Artificial
  CRISPR gRNA sequence
atcattgcaccactgcactc

SEQ ID NO: 51520 - DNA, 20 bp, Artificial
  CRISPR gRNA sequence
tgcaccactgcactccagcc

SEQ ID NO: 51521 - DNA, 20 bp, Artificial
  CRISPR gRNA sequence
gcaccactgcactccagcct

SEQ ID NO: 51522 - DNA, 20 bp, Artificial
  CRISPR gRNA sequence
ctgcactccagcctgggcaa

SEQ ID NO: 51523 - DNA, 20 bp, Artificial
  CRISPR gRNA sequence
gcactccagcctgggcaaca

SEQ ID NO: 51524 - DNA, 20 bp, Artificial
  CRISPR gRNA sequence
tccagcctgggcaacagagt

SEQ ID NO: 51525 - DNA, 20 bp, Artificial
  CRISPR gRNA sequence
tgggcaacagagtgagaccc

SEQ ID NO: 51526 - DNA, 20 bp, Artificial
  CRISPR gRNA sequence
gggcaacagagtgagacccc

SEQ ID NO: 51527 - DNA, 20 bp, Artificial
  CRISPR gRNA sequence
accccaggtcttaaaaaaaa

SEQ ID NO: 51528 - DNA, 20 bp, Artificial
  CRISPR gRNA sequence
aaagaaatccatgattttat

SEQ ID NO: 51529 - DNA, 20 bp, Artificial
  CRISPR gRNA sequence
tcttctctgccacatcacaa

SEQ ID NO: 51530 - DNA, 20 bp, Artificial
  CRISPR gRNA sequence
caacagaaatgaaaattgtg

SEQ ID NO: 51531 - DNA, 20 bp, Artificial
  CRISPR gRNA sequence
tgaaaattgtgtggcatttt

SEQ ID NO: 51532 - DNA, 20 bp, Artificial
  CRISPR gRNA sequence
aaattgtgtggcatttttgg

SEQ ID NO: 51533 - DNA, 20 bp, Artificial
  CRISPR gRNA sequence
ctgctctctctatttcccac

SEQ ID NO: 51534 - DNA, 20 bp, Artificial
  CRISPR gRNA sequence
tctctatttcccactggtcc

SEQ ID NO: 51535 - DNA, 20 bp, Artificial
  CRISPR gRNA sequence
ctctatttcccactggtcct

SEQ ID NO: 51536 - DNA, 20 bp, Artificial
  CRISPR gRNA sequence
atttcccactggtcctaggc

SEQ ID NO: 51537 - DNA, 20 bp, Artificial
  CRISPR gRNA sequence
gctggattcccaatgcgtct

SEQ ID NO: 51538 - DNA, 20 bp, Artificial
  CRISPR gRNA sequence
ggattcccaatgcgtctgag

SEQ ID NO: 51539 - DNA, 20 bp, Artificial
  CRISPR gRNA sequence
gattcccaatgcgtctgagc

SEQ ID NO: 51540 - DNA, 20 bp, Artificial
  CRISPR gRNA sequence
attcccaatgcgtctgagca

SEQ ID NO: 51541 - DNA, 20 bp, Artificial
  CRISPR gRNA sequence
gcagggactctgcattttac

SEQ ID NO: 51542 - DNA, 20 bp, Artificial
  CRISPR gRNA sequence
ttttactagctgtgtgacct

SEQ ID NO: 51543 - DNA, 20 bp, Artificial
  CRISPR gRNA sequence
tttactagctgtgtgacctt

SEQ ID NO: 51544 - DNA, 20 bp, Artificial
  CRISPR gRNA sequence
ctagctgtgtgaccttgggc

SEQ ID NO: 51545 - DNA, 20 bp, Artificial
  CRISPR gRNA sequence
ttcttacaccctctgtgtct

SEQ ID NO: 51546 - DNA, 20 bp, Artificial
  CRISPR gRNA sequence
agttccctcatctgtaaaat

SEQ ID NO: 51547 - DNA, 20 bp, Artificial
  CRISPR gRNA sequence
ctgtaaaatgagaacaatac

SEQ ID NO: 51548 - DNA, 20 bp, Artificial
  CRISPR gRNA sequence
atgagaacaatactagtatc

SEQ ID NO: 51549 - DNA, 20 bp, Artificial
  CRISPR gRNA sequence
tgagaacaatactagtatcc

SEQ ID NO: 51550 - DNA, 20 bp, Artificial
  CRISPR gRNA sequence
gagaacaatactagtatcca

SEQ ID NO: 51551 - DNA, 20 bp, Artificial
  CRISPR gRNA sequence
aatactagtatccagggata

SEQ ID NO: 51552 - DNA, 20 bp, Artificial
  CRISPR gRNA sequence
atactagtatccagggatat

SEQ ID NO: 51553 - DNA, 20 bp, Artificial
  CRISPR gRNA sequence
agggatatgggaaacataaa

SEQ ID NO: 51554 - DNA, 20 bp, Artificial
  CRISPR gRNA sequence
aaacataaaaagaacatgtc

SEQ ID NO: 51555 - DNA, 20 bp, Artificial
  CRISPR gRNA sequence
aaaagaacatgtcaagcact

SEQ ID NO: 51556 - DNA, 20 bp, Artificial
  CRISPR gRNA sequence
aacatgtcaagcacttagaa

SEQ ID NO: 51557 - DNA, 20 bp, Artificial
  CRISPR gRNA sequence
atgtcaagcacttagaacag

SEQ ID NO: 51558 - DNA, 20 bp, Artificial
  CRISPR gRNA sequence
gtcaagcacttagaacagtg

SEQ ID NO: 51559 - DNA, 20 bp, Artificial
  CRISPR gRNA sequence
agcacttagaacagtggaga

SEQ ID NO: 51560 - DNA, 20 bp, Artificial
  CRISPR gRNA sequence
agaacagtggagaaagtgct

SEQ ID NO: 51561 - DNA, 20 bp, Artificial
  CRISPR gRNA sequence
acagtggagaaagtgctcag

SEQ ID NO: 51562 - DNA, 20 bp, Artificial
  CRISPR gRNA sequence
agaaagtgctcagtagctgt

SEQ ID NO: 51563 - DNA, 20 bp, Artificial
  CRISPR gRNA sequence
ctattattattccacccatg

SEQ ID NO: 51564 - DNA, 20 bp, Artificial
  CRISPR gRNA sequence
tattattattccacccatgc

SEQ ID NO: 51565 - DNA, 20 bp, Artificial
  CRISPR gRNA sequence
attattattccacccatgca

SEQ ID NO: 51566 - DNA, 20 bp, Artificial
  CRISPR gRNA sequence
ttattattccacccatgcag

SEQ ID NO: 51567 - DNA, 20 bp, Artificial
  CRISPR gRNA sequence
ggctgactatttgaatatcc

SEQ ID NO: 51568 - DNA, 20 bp, Artificial
  CRISPR gRNA sequence
gactatttgaatatccaaga

SEQ ID NO: 51569 - DNA, 20 bp, Artificial
  CRISPR gRNA sequence
actatttgaatatccaagac

SEQ ID NO: 51570 - DNA, 20 bp, Artificial
  CRISPR gRNA sequence
aatatccaagacaggccacg

SEQ ID NO: 51571 - DNA, 20 bp, Artificial
  CRISPR gRNA sequence
ataccacatctcaacaatac

SEQ ID NO: 51572 - DNA, 20 bp, Artificial
  CRISPR gRNA sequence
accacatctcaacaatacaa

SEQ ID NO: 51573 - DNA, 20 bp, Artificial
  CRISPR gRNA sequence
tcaacaatacaagagactgc

SEQ ID NO: 51574 - DNA, 20 bp, Artificial
  CRISPR gRNA sequence
gagactgcaagaccccaccc

SEQ ID NO: 51575 - DNA, 20 bp, Artificial
  CRISPR gRNA sequence
ctgcaagaccccaccctggc

SEQ ID NO: 51576 - DNA, 20 bp, Artificial
  CRISPR gRNA sequence
gctggctctgcgtccctcct

SEQ ID NO: 51577 - DNA, 20 bp, Artificial
  CRISPR gRNA sequence
ctggctctgcgtccctcctc

SEQ ID NO: 51578 - DNA, 20 bp, Artificial
  CRISPR gRNA sequence
gctctgcgtccctcctcagg

SEQ ID NO: 51579 - DNA, 20 bp, Artificial
  CRISPR gRNA sequence
tctgcgtccctcctcaggca

SEQ ID NO: 51580 - DNA, 20 bp, Artificial
  CRISPR gRNA sequence
cctcctcaggcagagtcatc

SEQ ID NO: 51581 - DNA, 20 bp, Artificial
  CRISPR gRNA sequence
cggtacttttaaccacctgc

SEQ ID NO: 51582 - DNA, 20 bp, Artificial
  CRISPR gRNA sequence
ggtacttttaaccacctgct

SEQ ID NO: 51583 - DNA, 20 bp, Artificial
  CRISPR gRNA sequence
caacaatgaatcctgcgttt

SEQ ID NO: 51584 - DNA, 20 bp, Artificial
  CRISPR gRNA sequence
gcgttttagcccccatctgc

SEQ ID NO: 51585 - DNA, 20 bp, Artificial
  CRISPR gRNA sequence
ttttagcccccatctgccag

SEQ ID NO: 51586 - DNA, 20 bp, Artificial
  CRISPR gRNA sequence
ttagcccccatctgccagca

SEQ ID NO: 51587 - DNA, 20 bp, Artificial
  CRISPR gRNA sequence
agcagagcttgcacatactt

SEQ ID NO: 51588 - DNA, 20 bp, Artificial
  CRISPR gRNA sequence
gcagagcttgcacatacttg

SEQ ID NO: 51589 - DNA, 20 bp, Artificial
  CRISPR gRNA sequence
gcttgcacatacttgaggct

SEQ ID NO: 51590 - DNA, 20 bp, Artificial
  CRISPR gRNA sequence
cttgcacatacttgaggctg

SEQ ID NO: 51591 - DNA, 20 bp, Artificial
  CRISPR gRNA sequence
ttgcacatacttgaggctga

SEQ ID NO: 51592 - DNA, 20 bp, Artificial
  CRISPR gRNA sequence
cttgaggctgagggctgccc

SEQ ID NO: 51593 - DNA, 20 bp, Artificial
  CRISPR gRNA sequence
aggctgagggctgcccaagt

SEQ ID NO: 51594 - DNA, 20 bp, Artificial
  CRISPR gRNA sequence
gctgagggctgcccaagtca

SEQ ID NO: 51595 - DNA, 20 bp, Artificial
  CRISPR gRNA sequence
ctgagggctgcccaagtcag

SEQ ID NO: 51596 - DNA, 20 bp, Artificial
  CRISPR gRNA sequence
tgagggctgcccaagtcaga

SEQ ID NO: 51597 - DNA, 20 bp, Artificial
  CRISPR gRNA sequence
ccaagtcagagggcacacca

SEQ ID NO: 51598 - DNA, 20 bp, Artificial
  CRISPR gRNA sequence
cagagggcacaccatggaac

SEQ ID NO: 51599 - DNA, 20 bp, Artificial
  CRISPR gRNA sequence
ccatggaactagctccacca

SEQ ID NO: 51600 - DNA, 20 bp, Artificial
  CRISPR gRNA sequence
ggaactagctccaccatggc

SEQ ID NO: 51601 - DNA, 20 bp, Artificial
  CRISPR gRNA sequence
aactagctccaccatggcga

SEQ ID NO: 51602 - DNA, 20 bp, Artificial
  CRISPR gRNA sequence
tagctccaccatggcgagag

SEQ ID NO: 51603 - DNA, 20 bp, Artificial
  CRISPR gRNA sequence
agctccaccatggcgagagt

SEQ ID NO: 51604 - DNA, 20 bp, Artificial
  CRISPR gRNA sequence
gctccaccatggcgagagtg

SEQ ID NO: 51605 - DNA, 20 bp, Artificial
  CRISPR gRNA sequence
ctccaccatggcgagagtgg

SEQ ID NO: 51606 - DNA, 20 bp, Artificial
  CRISPR gRNA sequence
caccatggcgagagtggggg

SEQ ID NO: 51607 - DNA, 20 bp, Artificial
  CRISPR gRNA sequence
accatggcgagagtgggggc

SEQ ID NO: 51608 - DNA, 20 bp, Artificial
  CRISPR gRNA sequence
catggcgagagtgggggcgg

SEQ ID NO: 51609 - DNA, 20 bp, Artificial
  CRISPR gRNA sequence
tggcgagagtgggggcggga

SEQ ID NO: 51610 - DNA, 20 bp, Artificial
  CRISPR gRNA sequence
gcgagagtgggggcgggaga

SEQ ID NO: 51611 - DNA, 20 bp, Artificial
  CRISPR gRNA sequence
cgggagagagaaaattgatt

SEQ ID NO: 51612 - DNA, 20 bp, Artificial
  CRISPR gRNA sequence
gggagagagaaaattgattc

SEQ ID NO: 51613 - DNA, 20 bp, Artificial
  CRISPR gRNA sequence
ggagagagaaaattgattca

SEQ ID NO: 51614 - DNA, 20 bp, Artificial
  CRISPR gRNA sequence
gagagaaaattgattcaggg

SEQ ID NO: 51615 - DNA, 20 bp, Artificial
  CRISPR gRNA sequence
aaattgattcagggaagctt

SEQ ID NO: 51616 - DNA, 20 bp, Artificial
  CRISPR gRNA sequence
aattgattcagggaagcttt

SEQ ID NO: 51617 - DNA, 20 bp, Artificial
  CRISPR gRNA sequence
gaagctttgggtatgtgacc

SEQ ID NO: 51618 - DNA, 20 bp, Artificial
  CRISPR gRNA sequence
aagctttgggtatgtgaccc

SEQ ID NO: 51619 - DNA, 20 bp, Artificial
  CRISPR gRNA sequence
tgtgacccaggcatccctga

SEQ ID NO: 51620 - DNA, 20 bp, Artificial
  CRISPR gRNA sequence
acccaggcatccctgacagc

SEQ ID NO: 51621 - DNA, 20 bp, Artificial
  CRISPR gRNA sequence
catccctgacagctggtcct

SEQ ID NO: 51622 - DNA, 20 bp, Artificial
  CRISPR gRNA sequence
tccctgacagctggtcctga

SEQ ID NO: 51623 - DNA, 20 bp, Artificial
  CRISPR gRNA sequence
ccctgacagctggtcctgag

SEQ ID NO: 51624 - DNA, 20 bp, Artificial
  CRISPR gRNA sequence
acagctggtcctgagaggtg

SEQ ID NO: 51625 - DNA, 20 bp, Artificial
  CRISPR gRNA sequence
cagctggtcctgagaggtgt

SEQ ID NO: 51626 - DNA, 20 bp, Artificial
  CRISPR gRNA sequence
ctggtcctgagaggtgtagg

SEQ ID NO: 51627 - DNA, 20 bp, Artificial
  CRISPR gRNA sequence
tggtcctgagaggtgtaggc

SEQ ID NO: 51628 - DNA, 20 bp, Artificial
  CRISPR gRNA sequence
aggtgtaggcaggcacacat

SEQ ID NO: 51629 - DNA, 20 bp, Artificial
  CRISPR gRNA sequence
catgagtgtatgtgcacaca

SEQ ID NO: 51630 - DNA, 20 bp, Artificial
  CRISPR gRNA sequence
acggaccctcataccccctt

SEQ ID NO: 51631 - DNA, 20 bp, Artificial
  CRISPR gRNA sequence
atacccccttcagtgcccct

SEQ ID NO: 51632 - DNA, 20 bp, Artificial
  CRISPR gRNA sequence
tacccccttcagtgcccctc

SEQ ID NO: 51633 - DNA, 20 bp, Artificial
  CRISPR gRNA sequence
ctccctcaacttactccacc

SEQ ID NO: 51634 - DNA, 20 bp, Artificial
  CRISPR gRNA sequence
tcaacttactccacctggct

SEQ ID NO: 51635 - DNA, 20 bp, Artificial
  CRISPR gRNA sequence
caacttactccacctggctg

SEQ ID NO: 51636 - DNA, 20 bp, Artificial
  CRISPR gRNA sequence
ctgaggtctttacacttgct

SEQ ID NO: 51637 - DNA, 20 bp, Artificial
  CRISPR gRNA sequence
ctttacacttgctcagcaac

SEQ ID NO: 51638 - DNA, 20 bp, Artificial
  CRISPR gRNA sequence
tacacttgctcagcaaccag

SEQ ID NO: 51639 - DNA, 20 bp, Artificial
  CRISPR gRNA sequence
cacttgctcagcaaccagca

SEQ ID NO: 51640 - DNA, 20 bp, Artificial
  CRISPR gRNA sequence
agagtgactctacgtgctcc

SEQ ID NO: 51641 - DNA, 20 bp, Artificial
  CRISPR gRNA sequence
gactctacgtgctcctggct

SEQ ID NO: 51642 - DNA, 20 bp, Artificial
  CRISPR gRNA sequence
actctacgtgctcctggctg

SEQ ID NO: 51643 - DNA, 20 bp, Artificial
  CRISPR gRNA sequence
cgtgctcctggctgaggctg

SEQ ID NO: 51644 - DNA, 20 bp, Artificial
  CRISPR gRNA sequence
gctgcagcctgtgaacctgc

SEQ ID NO: 51645 - DNA, 20 bp, Artificial
  CRISPR gRNA sequence
cagcctgtgaacctgctgga

SEQ ID NO: 51646 - DNA, 20 bp, Artificial
  CRISPR gRNA sequence
gcctgtgaacctgctggacg

SEQ ID NO: 51647 - DNA, 20 bp, Artificial
  CRISPR gRNA sequence
cctgtgaacctgctggacgg

SEQ ID NO: 51648 - DNA, 20 bp, Artificial
  CRISPR gRNA sequence
gaacctgctggacggaggta

SEQ ID NO: 51649 - DNA, 20 bp, Artificial
  CRISPR gRNA sequence
aacctgctggacggaggtaa

SEQ ID NO: 51650 - DNA, 20 bp, Artificial
  CRISPR gRNA sequence
acctgctggacggaggtaaa

SEQ ID NO: 51651 - DNA, 20 bp, Artificial
  CRISPR gRNA sequence
cctgctggacggaggtaaag

SEQ ID NO: 51652 - DNA, 20 bp, Artificial
  CRISPR gRNA sequence
tggacggaggtaaaggggac

SEQ ID NO: 51653 - DNA, 20 bp, Artificial
  CRISPR gRNA sequence
acggaggtaaaggggacaag

SEQ ID NO: 51654 - DNA, 20 bp, Artificial
  CRISPR gRNA sequence
cggaggtaaaggggacaagc

SEQ ID NO: 51655 - DNA, 20 bp, Artificial
  CRISPR gRNA sequence
ggaggtaaaggggacaagca

SEQ ID NO: 51656 - DNA, 20 bp, Artificial
  CRISPR gRNA sequence
gaggtaaaggggacaagcag

SEQ ID NO: 51657 - DNA, 20 bp, Artificial
  CRISPR gRNA sequence
taaaggggacaagcagggga

SEQ ID NO: 51658 - DNA, 20 bp, Artificial
  CRISPR gRNA sequence
aaaggggacaagcaggggat

SEQ ID NO: 51659 - DNA, 20 bp, Artificial
  CRISPR gRNA sequence
aaggggacaagcaggggatg

SEQ ID NO: 51660 - DNA, 20 bp, Artificial
  CRISPR gRNA sequence
caagcaggggatggggcgtt

SEQ ID NO: 51661 - DNA, 20 bp, Artificial
  CRISPR gRNA sequence
ggatggggcgtttggccact

SEQ ID NO: 51662 - DNA, 20 bp, Artificial
  CRISPR gRNA sequence
ttggccactgagaccccctc

SEQ ID NO: 51663 - DNA, 20 bp, Artificial
  CRISPR gRNA sequence
cactgagaccccctccggcc

SEQ ID NO: 51664 - DNA, 20 bp, Artificial
  CRISPR gRNA sequence
gagaccccctccggcctggc

SEQ ID NO: 51665 - DNA, 20 bp, Artificial
  CRISPR gRNA sequence
cccctccggcctggctagcc

SEQ ID NO: 51666 - DNA, 20 bp, Artificial
  CRISPR gRNA sequence
ccctccggcctggctagccc

SEQ ID NO: 51667 - DNA, 20 bp, Artificial
  CRISPR gRNA sequence
cctccggcctggctagccca

SEQ ID NO: 51668 - DNA, 20 bp, Artificial
  CRISPR gRNA sequence
ggcctggctagcccagggca

SEQ ID NO: 51669 - DNA, 20 bp, Artificial
  CRISPR gRNA sequence
ctagcccagggcacagcctc

SEQ ID NO: 51670 - DNA, 20 bp, Artificial
  CRISPR gRNA sequence
tagcccagggcacagcctct

SEQ ID NO: 51671 - DNA, 20 bp, Artificial
  CRISPR gRNA sequence
agggcacagcctctgggctc

SEQ ID NO: 51672 - DNA, 20 bp, Artificial
  CRISPR gRNA sequence
gggcacagcctctgggctcc

SEQ ID NO: 51673 - DNA, 20 bp, Artificial
  CRISPR gRNA sequence
cacagcctctgggctccagg

SEQ ID NO: 51674 - DNA, 20 bp, Artificial
  CRISPR gRNA sequence
acagcctctgggctccaggt

SEQ ID NO: 51675 - DNA, 20 bp, Artificial
  CRISPR gRNA sequence
ctccaggtgggtctccactc

SEQ ID NO: 51676 - DNA, 20 bp, Artificial
  CRISPR gRNA sequence
ggtgggtctccactcaagct

SEQ ID NO: 51677 - DNA, 20 bp, Artificial
  CRISPR gRNA sequence
ccactcaagcttggaccctc

SEQ ID NO: 51678 - DNA, 20 bp, Artificial
  CRISPR gRNA sequence
ctcaagcttggaccctctgg

SEQ ID NO: 51679 - DNA, 20 bp, Artificial
  CRISPR gRNA sequence
ttggaccctctggaagtgtc

SEQ ID NO: 51680 - DNA, 20 bp, Artificial
  CRISPR gRNA sequence
atccactgctcccaccccca

SEQ ID NO: 51681 - DNA, 20 bp, Artificial
  CRISPR gRNA sequence
cactgctcccacccccacag

SEQ ID NO: 51682 - DNA, 20 bp, Artificial
  CRISPR gRNA sequence
cccccacagtagatcccacc

SEQ ID NO: 51683 - DNA, 20 bp, Artificial
  CRISPR gRNA sequence
ggacctgtgtttcttcatgc

SEQ ID NO: 51684 - DNA, 20 bp, Artificial
  CRISPR gRNA sequence
gacctgtgtttcttcatgct

SEQ ID NO: 51685 - DNA, 20 bp, Artificial
  CRISPR gRNA sequence
ttcttcatgctgggtgaaac

SEQ ID NO: 51686 - DNA, 20 bp, Artificial
  CRISPR gRNA sequence
gggtgaaacaagtccctctg

SEQ ID NO: 51687 - DNA, 20 bp, Artificial
  CRISPR gRNA sequence
ggtgaaacaagtccctctgc

SEQ ID NO: 51688 - DNA, 20 bp, Artificial
  CRISPR gRNA sequence
gtgaaacaagtccctctgca

SEQ ID NO: 51689 - DNA, 20 bp, Artificial
  CRISPR gRNA sequence
gtccctctgcagggttgttc

SEQ ID NO: 51690 - DNA, 20 bp, Artificial
  CRISPR gRNA sequence
tccctctgcagggttgttcc

SEQ ID NO: 51691 - DNA, 20 bp, Artificial
  CRISPR gRNA sequence
ccctctgcagggttgttcca

SEQ ID NO: 51692 - DNA, 20 bp, Artificial
  CRISPR gRNA sequence
cctctgcagggttgttccag

SEQ ID NO: 51693 - DNA, 20 bp, Artificial
  CRISPR gRNA sequence
tgttccaggggaatgttttg

SEQ ID NO: 51694 - DNA, 20 bp, Artificial
  CRISPR gRNA sequence
tccaggggaatgttttgtgg

SEQ ID NO: 51695 - DNA, 20 bp, Artificial
  CRISPR gRNA sequence
ccaggggaatgttttgtggt

SEQ ID NO: 51696 - DNA, 20 bp, Artificial
  CRISPR gRNA sequence
ggggaatgttttgtggtagg

SEQ ID NO: 51697 - DNA, 20 bp, Artificial
  CRISPR gRNA sequence
aggcagtctgcatactgctc

SEQ ID NO: 51698 - DNA, 20 bp, Artificial
  CRISPR gRNA sequence
tgcatactgctctggccacc

SEQ ID NO: 51699 - DNA, 20 bp, Artificial
  CRISPR gRNA sequence
gcatactgctctggccaccc

SEQ ID NO: 51700 - DNA, 20 bp, Artificial
  CRISPR gRNA sequence
atactgctctggccacccag

SEQ ID NO: 51701 - DNA, 20 bp, Artificial
  CRISPR gRNA sequence
tactgctctggccacccagg

SEQ ID NO: 51702 - DNA, 20 bp, Artificial
  CRISPR gRNA sequence
tgctctggccacccaggagg

SEQ ID NO: 51703 - DNA, 20 bp, Artificial
  CRISPR gRNA sequence
cacccaggaggcagatctac

SEQ ID NO: 51704 - DNA, 20 bp, Artificial
  CRISPR gRNA sequence
tactggtccccaacatcaac

SEQ ID NO: 51705 - DNA, 20 bp, Artificial
  CRISPR gRNA sequence
cccaacatcaactagctgcc

SEQ ID NO: 51706 - DNA, 20 bp, Artificial
  CRISPR gRNA sequence
ccaacatcaactagctgcct

SEQ ID NO: 51707 - DNA, 20 bp, Artificial
  CRISPR gRNA sequence
atcaactagctgcctaggca

SEQ ID NO: 51708 - DNA, 20 bp, Artificial
  CRISPR gRNA sequence
tagctgcctaggcatggttc

SEQ ID NO: 51709 - DNA, 20 bp, Artificial
  CRISPR gRNA sequence
agctgcctaggcatggttca

SEQ ID NO: 51710 - DNA, 20 bp, Artificial
  CRISPR gRNA sequence
gctgcctaggcatggttcaa

SEQ ID NO: 51711 - DNA, 20 bp, Artificial
  CRISPR gRNA sequence
ctgcctaggcatggttcaag

SEQ ID NO: 51712 - DNA, 20 bp, Artificial
  CRISPR gRNA sequence
tgcctaggcatggttcaagg

SEQ ID NO: 51713 - DNA, 20 bp, Artificial
  CRISPR gRNA sequence
ggttcaagggggcttaccca

SEQ ID NO: 51714 - DNA, 20 bp, Artificial
  CRISPR gRNA sequence
cacgccttcctcctcctcgt

SEQ ID NO: 51715 - DNA, 20 bp, Artificial
  CRISPR gRNA sequence
cctcctcctcgttggatctg

SEQ ID NO: 51716 - DNA, 20 bp, Artificial
  CRISPR gRNA sequence
ctcgttggatctgaagtgca

SEQ ID NO: 51717 - DNA, 20 bp, Artificial
  CRISPR gRNA sequence
atctgaagtgcaaagttgca

SEQ ID NO: 51718 - DNA, 20 bp, Artificial
  CRISPR gRNA sequence
aagtgcaaagttgcatggtg

SEQ ID NO: 51719 - DNA, 20 bp, Artificial
  CRISPR gRNA sequence
agtgcaaagttgcatggtgc

SEQ ID NO: 51720 - DNA, 20 bp, Artificial
  CRISPR gRNA sequence
gtgcaaagttgcatggtgca

SEQ ID NO: 51721 - DNA, 20 bp, Artificial
  CRISPR gRNA sequence
agttgcatggtgcagggacc

SEQ ID NO: 51722 - DNA, 20 bp, Artificial
  CRISPR gRNA sequence
catggtgcagggacctggat

SEQ ID NO: 51723 - DNA, 20 bp, Artificial
  CRISPR gRNA sequence
gtgcagggacctggatcaga

SEQ ID NO: 51724 - DNA, 20 bp, Artificial
  CRISPR gRNA sequence
tgcagggacctggatcagac

SEQ ID NO: 51725 - DNA, 20 bp, Artificial
  CRISPR gRNA sequence
gacctggatcagacaggacc

SEQ ID NO: 51726 - DNA, 20 bp, Artificial
  CRISPR gRNA sequence
acctggatcagacaggacct

SEQ ID NO: 51727 - DNA, 20 bp, Artificial
  CRISPR gRNA sequence
ggatcagacaggacctgggt

SEQ ID NO: 51728 - DNA, 20 bp, Artificial
  CRISPR gRNA sequence
cagacaggacctgggtcaga

SEQ ID NO: 51729 - DNA, 20 bp, Artificial
  CRISPR gRNA sequence
ggacctgggtcagacagctg

SEQ ID NO: 51730 - DNA, 20 bp, Artificial
  CRISPR gRNA sequence
gggtcagacagctgtggcca

SEQ ID NO: 51731 - DNA, 20 bp, Artificial
  CRISPR gRNA sequence
gacagctgtggccacagcct

SEQ ID NO: 51732 - DNA, 20 bp, Artificial
  CRISPR gRNA sequence
acagctgtggccacagcctc

SEQ ID NO: 51733 - DNA, 20 bp, Artificial
  CRISPR gRNA sequence
acagcctcaggatgccccca

SEQ ID NO: 51734 - DNA, 20 bp, Artificial
  CRISPR gRNA sequence
cagcctcaggatgcccccac

SEQ ID NO: 51735 - DNA, 20 bp, Artificial
  CRISPR gRNA sequence
agcctcaggatgcccccacg

SEQ ID NO: 51736 - DNA, 20 bp, Artificial
  CRISPR gRNA sequence
tcaggatgcccccacggggc

SEQ ID NO: 51737 - DNA, 20 bp, Artificial
  CRISPR gRNA sequence
cggggccagcacccctcctc

SEQ ID NO: 51738 - DNA, 20 bp, Artificial
  CRISPR gRNA sequence
ggccagcacccctcctccgg

SEQ ID NO: 51739 - DNA, 20 bp, Artificial
  CRISPR gRNA sequence
gcacccctcctccggaagcc

SEQ ID NO: 51740 - DNA, 20 bp, Artificial
  CRISPR gRNA sequence
tcctccggaagcccagcctc

SEQ ID NO: 51741 - DNA, 20 bp, Artificial
  CRISPR gRNA sequence
ccggaagcccagcctctagt

SEQ ID NO: 51742 - DNA, 20 bp, Artificial
  CRISPR gRNA sequence
cggaagcccagcctctagtt

SEQ ID NO: 51743 - DNA, 20 bp, Artificial
  CRISPR gRNA sequence
tcctaccccctcatacccac

SEQ ID NO: 51744 - DNA, 20 bp, Artificial
  CRISPR gRNA sequence
ccctcatacccaccagactc

SEQ ID NO: 51745 - DNA, 20 bp, Artificial
  CRISPR gRNA sequence
cctcatacccaccagactcc

SEQ ID NO: 51746 - DNA, 20 bp, Artificial
  CRISPR gRNA sequence
agactccaggcacaaccctt

SEQ ID NO: 51747 - DNA, 20 bp, Artificial
  CRISPR gRNA sequence
gactccaggcacaacccttc

SEQ ID NO: 51748 - DNA, 20 bp, Artificial
  CRISPR gRNA sequence
caggcacaacccttcaggac

SEQ ID NO: 51749 - DNA, 20 bp, Artificial
  CRISPR gRNA sequence
caacccttcaggacgagtcc

SEQ ID NO: 51750 - DNA, 20 bp, Artificial
  CRISPR gRNA sequence
aggacgagtcctggctgtcc

SEQ ID NO: 51751 - DNA, 20 bp, Artificial
  CRISPR gRNA sequence
ggacgagtcctggctgtccc

SEQ ID NO: 51752 - DNA, 20 bp, Artificial
  CRISPR gRNA sequence
gacgagtcctggctgtccca

SEQ ID NO: 51753 - DNA, 20 bp, Artificial
  CRISPR gRNA sequence
acgagtcctggctgtcccag

SEQ ID NO: 51754 - DNA, 20 bp, Artificial
  CRISPR gRNA sequence
tcccaggggaatgcccacct

SEQ ID NO: 51755 - DNA, 20 bp, Artificial
  CRISPR gRNA sequence
agatccacctttttaacccg

SEQ ID NO: 51756 - DNA, 20 bp, Artificial
  CRISPR gRNA sequence
acctttttaacccgtggaca

SEQ ID NO: 51757 - DNA, 20 bp, Artificial
  CRISPR gRNA sequence
cctttttaacccgtggacac

SEQ ID NO: 51758 - DNA, 20 bp, Artificial
  CRISPR gRNA sequence
taacccgtggacacaggctt

SEQ ID NO: 51759 - DNA, 20 bp, Artificial
  CRISPR gRNA sequence
aacccgtggacacaggctta

SEQ ID NO: 51760 - DNA, 20 bp, Artificial
  CRISPR gRNA sequence
tggacacaggcttaaggtgt

SEQ ID NO: 51761 - DNA, 20 bp, Artificial
  CRISPR gRNA sequence
cacaggcttaaggtgttggc

SEQ ID NO: 51762 - DNA, 20 bp, Artificial
  CRISPR gRNA sequence
aggcttaaggtgttggccag

SEQ ID NO: 51763 - DNA, 20 bp, Artificial
  CRISPR gRNA sequence
ggcttaaggtgttggccagc

SEQ ID NO: 51764 - DNA, 20 bp, Artificial
  CRISPR gRNA sequence
ttaaggtgttggccagcagg

SEQ ID NO: 51765 - DNA, 20 bp, Artificial
  CRISPR gRNA sequence
taaggtgttggccagcagga

SEQ ID NO: 51766 - DNA, 20 bp, Artificial
  CRISPR gRNA sequence
aaggtgttggccagcaggaa

SEQ ID NO: 51767 - DNA, 20 bp, Artificial
  CRISPR gRNA sequence
aggtgttggccagcaggaag

SEQ ID NO: 51768 - DNA, 20 bp, Artificial
  CRISPR gRNA sequence
gccagcaggaaggggctttt

SEQ ID NO: 51769 - DNA, 20 bp, Artificial
  CRISPR gRNA sequence
ccagcaggaaggggcttttc

SEQ ID NO: 51770 - DNA, 20 bp, Artificial
  CRISPR gRNA sequence
cagcaggaaggggcttttcg

SEQ ID NO: 51771 - DNA, 20 bp, Artificial
  CRISPR gRNA sequence
aggaaggggcttttcgggga

SEQ ID NO: 51772 - DNA, 20 bp, Artificial
  CRISPR gRNA sequence
ttttcggggacagtcccgtc

SEQ ID NO: 51773 - DNA, 20 bp, Artificial
  CRISPR gRNA sequence
ggggacagtcccgtctggct

SEQ ID NO: 51774 - DNA, 20 bp, Artificial
  CRISPR gRNA sequence
cccgtctggctcagcctgaa

SEQ ID NO: 51775 - DNA, 20 bp, Artificial
  CRISPR gRNA sequence
ccgtctggctcagcctgaaa

SEQ ID NO: 51776 - DNA, 20 bp, Artificial
  CRISPR gRNA sequence
ctggctcagcctgaaaagga

SEQ ID NO: 51777 - DNA, 20 bp, Artificial
  CRISPR gRNA sequence
tggctcagcctgaaaaggaa

SEQ ID NO: 51778 - DNA, 20 bp, Artificial
  CRISPR gRNA sequence
ggctcagcctgaaaaggaaa

SEQ ID NO: 51779 - DNA, 20 bp, Artificial
  CRISPR gRNA sequence
gctcagcctgaaaaggaaag

SEQ ID NO: 51780 - DNA, 20 bp, Artificial
  CRISPR gRNA sequence
ctcagcctgaaaaggaaagg

SEQ ID NO: 51781 - DNA, 20 bp, Artificial
  CRISPR gRNA sequence
agcctgaaaaggaaaggggg

SEQ ID NO: 51782 - DNA, 20 bp, Artificial
  CRISPR gRNA sequence
aaaaggaaagggggtagatc

SEQ ID NO: 51783 - DNA, 20 bp, Artificial
  CRISPR gRNA sequence
ggaaagggggtagatccggc

SEQ ID NO: 51784 - DNA, 20 bp, Artificial
  CRISPR gRNA sequence
gggggtagatccggcaagat

SEQ ID NO: 51785 - DNA, 20 bp, Artificial
  CRISPR gRNA sequence
ggtagatccggcaagatgag

SEQ ID NO: 51786 - DNA, 20 bp, Artificial
  CRISPR gRNA sequence
atccggcaagatgagtggac

SEQ ID NO: 51787 - DNA, 20 bp, Artificial
  CRISPR gRNA sequence
tccggcaagatgagtggaca

SEQ ID NO: 51788 - DNA, 20 bp, Artificial
  CRISPR gRNA sequence
agatgagtggacaaggaacc

SEQ ID NO: 51789 - DNA, 20 bp, Artificial
  CRISPR gRNA sequence
gagtggacaaggaacctggc

SEQ ID NO: 51790 - DNA, 20 bp, Artificial
  CRISPR gRNA sequence
gacaaggaacctggctagcc

SEQ ID NO: 51791 - DNA, 20 bp, Artificial
  CRISPR gRNA sequence
caaggaacctggctagcctg

SEQ ID NO: 51792 - DNA, 20 bp, Artificial
  CRISPR gRNA sequence
aaggaacctggctagcctgg

SEQ ID NO: 51793 - DNA, 20 bp, Artificial
  CRISPR gRNA sequence
aggaacctggctagcctgga

SEQ ID NO: 51794 - DNA, 20 bp, Artificial
  CRISPR gRNA sequence
acctggctagcctggagggt

SEQ ID NO: 51795 - DNA, 20 bp, Artificial
  CRISPR gRNA sequence
cctggctagcctggagggta

SEQ ID NO: 51796 - DNA, 20 bp, Artificial
  CRISPR gRNA sequence
gctagcctggagggtaagga

SEQ ID NO: 51797 - DNA, 20 bp, Artificial
  CRISPR gRNA sequence
ctagcctggagggtaaggaa

SEQ ID NO: 51798 - DNA, 20 bp, Artificial
  CRISPR gRNA sequence
tagcctggagggtaaggaaa

SEQ ID NO: 51799 - DNA, 20 bp, Artificial
  CRISPR gRNA sequence
gcctggagggtaaggaaagg

SEQ ID NO: 51800 - DNA, 20 bp, Artificial
  CRISPR gRNA sequence
cctggagggtaaggaaaggg

SEQ ID NO: 51801 - DNA, 20 bp, Artificial
  CRISPR gRNA sequence
ctggagggtaaggaaaggga

SEQ ID NO: 51802 - DNA, 20 bp, Artificial
  CRISPR gRNA sequence
gagggtaaggaaagggaggg

SEQ ID NO: 51803 - DNA, 20 bp, Artificial
  CRISPR gRNA sequence
agggtaaggaaagggagggt

SEQ ID NO: 51804 - DNA, 20 bp, Artificial
  CRISPR gRNA sequence
gggtaaggaaagggagggtg

SEQ ID NO: 51805 - DNA, 20 bp, Artificial
  CRISPR gRNA sequence
gtaaggaaagggagggtggg

SEQ ID NO: 51806 - DNA, 20 bp, Artificial
  CRISPR gRNA sequence
taaggaaagggagggtgggg

SEQ ID NO: 51807 - DNA, 20 bp, Artificial
  CRISPR gRNA sequence
aaggaaagggagggtgggga

SEQ ID NO: 51808 - DNA, 20 bp, Artificial
  CRISPR gRNA sequence
aaagggagggtggggagggc

SEQ ID NO: 51809 - DNA, 20 bp, Artificial
  CRISPR gRNA sequence
gggagggtggggagggctag

SEQ ID NO: 51810 - DNA, 20 bp, Artificial
  CRISPR gRNA sequence
ggtggggagggctagcagct

SEQ ID NO: 51811 - DNA, 20 bp, Artificial
  CRISPR gRNA sequence
gggagggctagcagctcagc

SEQ ID NO: 51812 - DNA, 20 bp, Artificial
  CRISPR gRNA sequence
ggagggctagcagctcagca

SEQ ID NO: 51813 - DNA, 20 bp, Artificial
  CRISPR gRNA sequence
ctagcagctcagcaaggcaa

SEQ ID NO: 51814 - DNA, 20 bp, Artificial
  CRISPR gRNA sequence
tagcagctcagcaaggcaat

SEQ ID NO: 51815 - DNA, 20 bp, Artificial
  CRISPR gRNA sequence
agcagctcagcaaggcaata

SEQ ID NO: 51816 - DNA, 20 bp, Artificial
  CRISPR gRNA sequence
agctcagcaaggcaataggg

SEQ ID NO: 51817 - DNA, 20 bp, Artificial
  CRISPR gRNA sequence
tcagcaaggcaatagggaag

SEQ ID NO: 51818 - DNA, 20 bp, Artificial
  CRISPR gRNA sequence
cagcaaggcaatagggaagc

SEQ ID NO: 51819 - DNA, 20 bp, Artificial
  CRISPR gRNA sequence
caaggcaatagggaagcagg

SEQ ID NO: 51820 - DNA, 20 bp, Artificial
  CRISPR gRNA sequence
aaggcaatagggaagcaggc

SEQ ID NO: 51821 - DNA, 20 bp, Artificial
  CRISPR gRNA sequence
aggcaatagggaagcaggca

SEQ ID NO: 51822 - DNA, 20 bp, Artificial
  CRISPR gRNA sequence
ggcaatagggaagcaggcag

SEQ ID NO: 51823 - DNA, 20 bp, Artificial
  CRISPR gRNA sequence
agggaagcaggcaggggatc

SEQ ID NO: 51824 - DNA, 20 bp, Artificial
  CRISPR gRNA sequence
ggaagcaggcaggggatcaa

SEQ ID NO: 51825 - DNA, 20 bp, Artificial
  CRISPR gRNA sequence
gaagcaggcaggggatcaag

SEQ ID NO: 51826 - DNA, 20 bp, Artificial
  CRISPR gRNA sequence
aggggatcaagaggcacaaa

SEQ ID NO: 51827 - DNA, 20 bp, Artificial
  CRISPR gRNA sequence
ggggatcaagaggcacaaat

SEQ ID NO: 51828 - DNA, 20 bp, Artificial
  CRISPR gRNA sequence
gggatcaagaggcacaaata

SEQ ID NO: 51829 - DNA, 20 bp, Artificial
  CRISPR gRNA sequence
caagaggcacaaatagggct

SEQ ID NO: 51830 - DNA, 20 bp, Artificial
  CRISPR gRNA sequence
aagaggcacaaatagggctg

SEQ ID NO: 51831 - DNA, 20 bp, Artificial
  CRISPR gRNA sequence
agaggcacaaatagggctga

SEQ ID NO: 51832 - DNA, 20 bp, Artificial
  CRISPR gRNA sequence
gcacaaatagggctgaggga

SEQ ID NO: 51833 - DNA, 20 bp, Artificial
  CRISPR gRNA sequence
cacaaatagggctgagggac

SEQ ID NO: 51834 - DNA, 20 bp, Artificial
  CRISPR gRNA sequence
aaatagggctgagggacagg

SEQ ID NO: 51835 - DNA, 20 bp, Artificial
  CRISPR gRNA sequence
ggctgagggacaggcagatt

SEQ ID NO: 51836 - DNA, 20 bp, Artificial
  CRISPR gRNA sequence
ggacaggcagatttggattt

SEQ ID NO: 51837 - DNA, 20 bp, Artificial
  CRISPR gRNA sequence
gcagatttggatttgagtcc

SEQ ID NO: 51838 - DNA, 20 bp, Artificial
  CRISPR gRNA sequence
tgagtcccagttctgcttat

SEQ ID NO: 51839 - DNA, 20 bp, Artificial
  CRISPR gRNA sequence
gcttattggctgtgtgacct

SEQ ID NO: 51840 - DNA, 20 bp, Artificial
  CRISPR gRNA sequence
ttattggctgtgtgaccttg

SEQ ID NO: 51841 - DNA, 20 bp, Artificial
  CRISPR gRNA sequence
ttggctgtgtgaccttggag

SEQ ID NO: 51842 - DNA, 20 bp, Artificial
  CRISPR gRNA sequence
agaagtgacttcacctctct

SEQ ID NO: 51843 - DNA, 20 bp, Artificial
  CRISPR gRNA sequence
gacttcacctctctgagctt

SEQ ID NO: 51844 - DNA, 20 bp, Artificial
  CRISPR gRNA sequence
tgagcttcagtttccttatc

SEQ ID NO: 51845 - DNA, 20 bp, Artificial
  CRISPR gRNA sequence
agtttccttatctggaaatc

SEQ ID NO: 51846 - DNA, 20 bp, Artificial
  CRISPR gRNA sequence
actcgtcatgtatgactctc

SEQ ID NO: 51847 - DNA, 20 bp, Artificial
  CRISPR gRNA sequence
ctcgtcatgtatgactctcg

SEQ ID NO: 51848 - DNA, 20 bp, Artificial
  CRISPR gRNA sequence
gtatgactctcgaggtatat

SEQ ID NO: 51849 - DNA, 20 bp, Artificial
  CRISPR gRNA sequence
tatgactctcgaggtatatg

SEQ ID NO: 51850 - DNA, 20 bp, Artificial
  CRISPR gRNA sequence
gaggatttaattacatcatg

SEQ ID NO: 51851 - DNA, 20 bp, Artificial
  CRISPR gRNA sequence
aggatttaattacatcatgc

SEQ ID NO: 51852 - DNA, 20 bp, Artificial
  CRISPR gRNA sequence
acatcatgcaggtgcactgc

SEQ ID NO: 51853 - DNA, 20 bp, Artificial
  CRISPR gRNA sequence
catcatgcaggtgcactgcc

SEQ ID NO: 51854 - DNA, 20 bp, Artificial
  CRISPR gRNA sequence
tgcaggtgcactgccgggca

SEQ ID NO: 51855 - DNA, 20 bp, Artificial
  CRISPR gRNA sequence
gcaggtgcactgccgggcat

SEQ ID NO: 51856 - DNA, 20 bp, Artificial
  CRISPR gRNA sequence
ttactattgtttttacctgc

SEQ ID NO: 51857 - DNA, 20 bp, Artificial
  CRISPR gRNA sequence
attgtttttacctgcaagca

SEQ ID NO: 51858 - DNA, 20 bp, Artificial
  CRISPR gRNA sequence
acctgcaagcacagatttca

SEQ ID NO: 51859 - DNA, 20 bp, Artificial
  CRISPR gRNA sequence
cctgcaagcacagatttcac

SEQ ID NO: 51860 - DNA, 20 bp, Artificial
  CRISPR gRNA sequence
caagcacagatttcacaggc

SEQ ID NO: 51861 - DNA, 20 bp, Artificial
  CRISPR gRNA sequence
cacaggcgagtccttgctca

SEQ ID NO: 51862 - DNA, 20 bp, Artificial
  CRISPR gRNA sequence
caggcgagtccttgctcaca

SEQ ID NO: 51863 - DNA, 20 bp, Artificial
  CRISPR gRNA sequence
ggcgagtccttgctcacaga

SEQ ID NO: 51864 - DNA, 20 bp, Artificial
  CRISPR gRNA sequence
gagtccttgctcacagagag

SEQ ID NO: 51865 - DNA, 20 bp, Artificial
  CRISPR gRNA sequence
agtccttgctcacagagagt

SEQ ID NO: 51866 - DNA, 20 bp, Artificial
  CRISPR gRNA sequence
ccttgctcacagagagtggg

SEQ ID NO: 51867 - DNA, 20 bp, Artificial
  CRISPR gRNA sequence
tcacagagagtgggaagctt

SEQ ID NO: 51868 - DNA, 20 bp, Artificial
  CRISPR gRNA sequence
cacagagagtgggaagcttc

SEQ ID NO: 51869 - DNA, 20 bp, Artificial
  CRISPR gRNA sequence
gtgggaagcttcaggccctt

SEQ ID NO: 51870 - DNA, 20 bp, Artificial
  CRISPR gRNA sequence
agcttcaggcccttcagaca

SEQ ID NO: 51871 - DNA, 20 bp, Artificial
  CRISPR gRNA sequence
cagacacagtttttaaacct

SEQ ID NO: 51872 - DNA, 20 bp, Artificial
  CRISPR gRNA sequence
ttttaaaccttagcactatt

SEQ ID NO: 51873 - DNA, 20 bp, Artificial
  CRISPR gRNA sequence
ccttagcactattgagatgt

SEQ ID NO: 51874 - DNA, 20 bp, Artificial
  CRISPR gRNA sequence
cttagcactattgagatgtg

SEQ ID NO: 51875 - DNA, 20 bp, Artificial
  CRISPR gRNA sequence
ggtccaataattctttgttg

SEQ ID NO: 51876 - DNA, 20 bp, Artificial
  CRISPR gRNA sequence
gtccaataattctttgttgt

SEQ ID NO: 51877 - DNA, 20 bp, Artificial
  CRISPR gRNA sequence
gtgggctctcctgtgcccta

SEQ ID NO: 51878 - DNA, 20 bp, Artificial
  CRISPR gRNA sequence
tgggctctcctgtgccctat

SEQ ID NO: 51879 - DNA, 20 bp, Artificial
  CRISPR gRNA sequence
cctgtgccctataggatgtt

SEQ ID NO: 51880 - DNA, 20 bp, Artificial
  CRISPR gRNA sequence
gtgccctataggatgttcag

SEQ ID NO: 51881 - DNA, 20 bp, Artificial
  CRISPR gRNA sequence
taggatgttcagcagcatcc

SEQ ID NO: 51882 - DNA, 20 bp, Artificial
  CRISPR gRNA sequence
gatctctattcattcgatgc

SEQ ID NO: 51883 - DNA, 20 bp, Artificial
  CRISPR gRNA sequence
ctctattcattcgatgccag

SEQ ID NO: 51884 - DNA, 20 bp, Artificial
  CRISPR gRNA sequence
tattcattcgatgccagtag

SEQ ID NO: 51885 - DNA, 20 bp, Artificial
  CRISPR gRNA sequence
gtagcagcacccctcacccg

SEQ ID NO: 51886 - DNA, 20 bp, Artificial
  CRISPR gRNA sequence
atgaccaccaaaaatatctc

SEQ ID NO: 51887 - DNA, 20 bp, Artificial
  CRISPR gRNA sequence
gatatttccaaatgactccc

SEQ ID NO: 51888 - DNA, 20 bp, Artificial
  CRISPR gRNA sequence
atatttccaaatgactccca

SEQ ID NO: 51889 - DNA, 20 bp, Artificial
  CRISPR gRNA sequence
tatttccaaatgactcccaa

SEQ ID NO: 51890 - DNA, 20 bp, Artificial
  CRISPR gRNA sequence
ccaagggtgaaaatcacccc

SEQ ID NO: 51891 - DNA, 20 bp, Artificial
  CRISPR gRNA sequence
gggtgaaaatcacccccagt

SEQ ID NO: 51892 - DNA, 20 bp, Artificial
  CRISPR gRNA sequence
ccagttggaaaccactgcct

SEQ ID NO: 51893 - DNA, 20 bp, Artificial
  CRISPR gRNA sequence
agttggaaaccactgcctta

SEQ ID NO: 51894 - DNA, 20 bp, Artificial
  CRISPR gRNA sequence
ggaaaccactgccttagaga

SEQ ID NO: 51895 - DNA, 20 bp, Artificial
  CRISPR gRNA sequence
accactgccttagagaaagt

SEQ ID NO: 51896 - DNA, 20 bp, Artificial
  CRISPR gRNA sequence
ctgccttagagaaagtgaga

SEQ ID NO: 51897 - DNA, 20 bp, Artificial
  CRISPR gRNA sequence
tgccttagagaaagtgagat

SEQ ID NO: 51898 - DNA, 20 bp, Artificial
  CRISPR gRNA sequence
agatgggtccactctgccct

SEQ ID NO: 51899 - DNA, 20 bp, Artificial
  CRISPR gRNA sequence
atgggtccactctgccctca

SEQ ID NO: 51900 - DNA, 20 bp, Artificial
  CRISPR gRNA sequence
tgggtccactctgccctcag

SEQ ID NO: 51901 - DNA, 20 bp, Artificial
  CRISPR gRNA sequence
gtccactctgccctcagagg

SEQ ID NO: 51902 - DNA, 20 bp, Artificial
  CRISPR gRNA sequence
tctgccctcagaggcagcct

SEQ ID NO: 51903 - DNA, 20 bp, Artificial
  CRISPR gRNA sequence
gcacctccatttgcctcatc

SEQ ID NO: 51904 - DNA, 20 bp, Artificial
  CRISPR gRNA sequence
tcatccagtaatccccctat

SEQ ID NO: 51905 - DNA, 20 bp, Artificial
  CRISPR gRNA sequence
tgtctgtaaattccactctc

SEQ ID NO: 51906 - DNA, 20 bp, Artificial
  CRISPR gRNA sequence
ccactctcaagatccaccct

SEQ ID NO: 51907 - DNA, 20 bp, Artificial
  CRISPR gRNA sequence
taccaacttctatcccaccc

SEQ ID NO: 51908 - DNA, 20 bp, Artificial
  CRISPR gRNA sequence
caacttctatcccaccccag

SEQ ID NO: 51909 - DNA, 20 bp, Artificial
  CRISPR gRNA sequence
tatcccaccccagcagtgat

SEQ ID NO: 51910 - DNA, 20 bp, Artificial
  CRISPR gRNA sequence
ccccagcagtgatcagcccc

SEQ ID NO: 51911 - DNA, 20 bp, Artificial
  CRISPR gRNA sequence
ctcccaatccattctctacc

SEQ ID NO: 51912 - DNA, 20 bp, Artificial
  CRISPR gRNA sequence
tccattctctacccagcact

SEQ ID NO: 51913 - DNA, 20 bp, Artificial
  CRISPR gRNA sequence
gaacttttgaaaacccaaat

SEQ ID NO: 51914 - DNA, 20 bp, Artificial
  CRISPR gRNA sequence
aacttttgaaaacccaaatg

SEQ ID NO: 51915 - DNA, 20 bp, Artificial
  CRISPR gRNA sequence
ttgaaaacccaaatgaggaa

SEQ ID NO: 51916 - DNA, 20 bp, Artificial
  CRISPR gRNA sequence
tgaaaacccaaatgaggaac

SEQ ID NO: 51917 - DNA, 20 bp, Artificial
  CRISPR gRNA sequence
acccaaatgaggaacgggtg

SEQ ID NO: 51918 - DNA, 20 bp, Artificial
  CRISPR gRNA sequence
caaatgaggaacgggtgcag

SEQ ID NO: 51919 - DNA, 20 bp, Artificial
  CRISPR gRNA sequence
gtggctcctgcctgtaatct

SEQ ID NO: 51920 - DNA, 20 bp, Artificial
  CRISPR gRNA sequence
tgcctgtaatctcagtactt

SEQ ID NO: 51921 - DNA, 20 bp, Artificial
  CRISPR gRNA sequence
gcctgtaatctcagtacttt

SEQ ID NO: 51922 - DNA, 20 bp, Artificial
  CRISPR gRNA sequence
tgtaatctcagtactttggg

SEQ ID NO: 51923 - DNA, 20 bp, Artificial
  CRISPR gRNA sequence
tctcagtactttgggaagcc

SEQ ID NO: 51924 - DNA, 20 bp, Artificial
  CRISPR gRNA sequence
ctcagtactttgggaagccg

SEQ ID NO: 51925 - DNA, 20 bp, Artificial
  CRISPR gRNA sequence
agtactttgggaagccgagg

SEQ ID NO: 51926 - DNA, 20 bp, Artificial
  CRISPR gRNA sequence
gtactttgggaagccgaggc

SEQ ID NO: 51927 - DNA, 20 bp, Artificial
  CRISPR gRNA sequence
ctttgggaagccgaggcggg

SEQ ID NO: 51928 - DNA, 20 bp, Artificial
  CRISPR gRNA sequence
ccgaggcgggcggatcactt

SEQ ID NO: 51929 - DNA, 20 bp, Artificial
  CRISPR gRNA sequence
cgaggcgggcggatcacttg

SEQ ID NO: 51930 - DNA, 20 bp, Artificial
  CRISPR gRNA sequence
gcgggcggatcacttgaggt

SEQ ID NO: 51931 - DNA, 20 bp, Artificial
  CRISPR gRNA sequence
cgggcggatcacttgaggtc

SEQ ID NO: 51932 - DNA, 20 bp, Artificial
  CRISPR gRNA sequence
ggcggatcacttgaggtcgg

SEQ ID NO: 51933 - DNA, 20 bp, Artificial
  CRISPR gRNA sequence
tcacttgaggtcgggagttt

SEQ ID NO: 51934 - DNA, 20 bp, Artificial
  CRISPR gRNA sequence
tgaggtcgggagtttgagac

SEQ ID NO: 51935 - DNA, 20 bp, Artificial
  CRISPR gRNA sequence
tcgggagtttgagaccagca

SEQ ID NO: 51936 - DNA, 20 bp, Artificial
  CRISPR gRNA sequence
tgagaccagcatggtcaaca

SEQ ID NO: 51937 - DNA, 20 bp, Artificial
  CRISPR gRNA sequence
tctactaaaaatacaaaaat

SEQ ID NO: 51938 - DNA, 20 bp, Artificial
  CRISPR gRNA sequence
ctaaaaatacaaaaattagc

SEQ ID NO: 51939 - DNA, 20 bp, Artificial
  CRISPR gRNA sequence
taaaaatacaaaaattagct

SEQ ID NO: 51940 - DNA, 20 bp, Artificial
  CRISPR gRNA sequence
caaaaattagctgggcatga

SEQ ID NO: 51941 - DNA, 20 bp, Artificial
  CRISPR gRNA sequence
atggtgcacgcctgtaatcc

SEQ ID NO: 51942 - DNA, 20 bp, Artificial
  CRISPR gRNA sequence
cgcctgtaatcccagctact

SEQ ID NO: 51943 - DNA, 20 bp, Artificial
  CRISPR gRNA sequence
gcctgtaatcccagctactt

SEQ ID NO: 51944 - DNA, 20 bp, Artificial
  CRISPR gRNA sequence
ctgtaatcccagctacttgg

SEQ ID NO: 51945 - DNA, 20 bp, Artificial
  CRISPR gRNA sequence
tgtaatcccagctacttggg

SEQ ID NO: 51946 - DNA, 20 bp, Artificial
  CRISPR gRNA sequence
tcccagctacttgggaggct

SEQ ID NO: 51947 - DNA, 20 bp, Artificial
  CRISPR gRNA sequence
cccagctacttgggaggctg

SEQ ID NO: 51948 - DNA, 20 bp, Artificial
  CRISPR gRNA sequence
tacttgggaggctgaggcac

SEQ ID NO: 51949 - DNA, 20 bp, Artificial
  CRISPR gRNA sequence
gcacaagaattgcctgaacc

SEQ ID NO: 51950 - DNA, 20 bp, Artificial
  CRISPR gRNA sequence
cacaagaattgcctgaacct

SEQ ID NO: 51951 - DNA, 20 bp, Artificial
  CRISPR gRNA sequence
caagaattgcctgaacctgg

SEQ ID NO: 51952 - DNA, 20 bp, Artificial
  CRISPR gRNA sequence
aagaattgcctgaacctggg

SEQ ID NO: 51953 - DNA, 20 bp, Artificial
  CRISPR gRNA sequence
aattgcctgaacctgggagg

SEQ ID NO: 51954 - DNA, 20 bp, Artificial
  CRISPR gRNA sequence
ttgcctgaacctgggaggcg

SEQ ID NO: 51955 - DNA, 20 bp, Artificial
  CRISPR gRNA sequence
tgcctgaacctgggaggcgg

SEQ ID NO: 51956 - DNA, 20 bp, Artificial
  CRISPR gRNA sequence
aacctgggaggcggaggttg

SEQ ID NO: 51957 - DNA, 20 bp, Artificial
  CRISPR gRNA sequence
tgggaggcggaggttgcagt

SEQ ID NO: 51958 - DNA, 20 bp, Artificial
  CRISPR gRNA sequence
ggcggaggttgcagtgagcc

SEQ ID NO: 51959 - DNA, 20 bp, Artificial
  CRISPR gRNA sequence
gagattgcgccattgcactc

SEQ ID NO: 51960 - DNA, 20 bp, Artificial
  CRISPR gRNA sequence
ttgcactccagcctgtgtga

SEQ ID NO: 51961 - DNA, 20 bp, Artificial
  CRISPR gRNA sequence
gcactccagcctgtgtgaca

SEQ ID NO: 51962 - DNA, 20 bp, Artificial
  CRISPR gRNA sequence
tccagcctgtgtgacagagc

SEQ ID NO: 51963 - DNA, 20 bp, Artificial
  CRISPR gRNA sequence
cgagaccctcccccacaaaa

SEQ ID NO: 51964 - DNA, 20 bp, Artificial
  CRISPR gRNA sequence
accctcccccacaaaaaaga

SEQ ID NO: 51965 - DNA, 20 bp, Artificial
  CRISPR gRNA sequence
tcccccacaaaaaagaaaga

SEQ ID NO: 51966 - DNA, 20 bp, Artificial
  CRISPR gRNA sequence
tcctctccctttcatgttcc

SEQ ID NO: 51967 - DNA, 20 bp, Artificial
  CRISPR gRNA sequence
cctctccctttcatgttccc

SEQ ID NO: 51968 - DNA, 20 bp, Artificial
  CRISPR gRNA sequence
tttcatgttcccaggaacaa

SEQ ID NO: 51969 - DNA, 20 bp, Artificial
  CRISPR gRNA sequence
aaaagtctaaactctcccca

SEQ ID NO: 51970 - DNA, 20 bp, Artificial
  CRISPR gRNA sequence
aaagtctaaactctccccat

SEQ ID NO: 51971 - DNA, 20 bp, Artificial
  CRISPR gRNA sequence
taaactctccccatgggtgc

SEQ ID NO: 51972 - DNA, 20 bp, Artificial
  CRISPR gRNA sequence
aaactctccccatgggtgcc

SEQ ID NO: 51973 - DNA, 20 bp, Artificial
  CRISPR gRNA sequence
ggccccatgcaacccaaccc

SEQ ID NO: 51974 - DNA, 20 bp, Artificial
  CRISPR gRNA sequence
tctctctcttcctcctctcc

SEQ ID NO: 51975 - DNA, 20 bp, Artificial
  CRISPR gRNA sequence
ctctctcttcctcctctcct

SEQ ID NO: 51976 - DNA, 20 bp, Artificial
  CRISPR gRNA sequence
tctcctaggactgtccctgc

SEQ ID NO: 51977 - DNA, 20 bp, Artificial
  CRISPR gRNA sequence
ccctgccagtcactgtgctc

SEQ ID NO: 51978 - DNA, 20 bp, Artificial
  CRISPR gRNA sequence
tcactgtgctctggctgtct

SEQ ID NO: 51979 - DNA, 20 bp, Artificial
  CRISPR gRNA sequence
tctcggttccgcgctgttcc

SEQ ID NO: 51980 - DNA, 20 bp, Artificial
  CRISPR gRNA sequence
tcggttccgcgctgttcctg

SEQ ID NO: 51981 - DNA, 20 bp, Artificial
  CRISPR gRNA sequence
cgctgttcctggagcccacc

SEQ ID NO: 51982 - DNA, 20 bp, Artificial
  CRISPR gRNA sequence
caccaagcttaatcatgcct

SEQ ID NO: 51983 - DNA, 20 bp, Artificial
  CRISPR gRNA sequence
accaagcttaatcatgcctc

SEQ ID NO: 51984 - DNA, 20 bp, Artificial
  CRISPR gRNA sequence
ccaagcttaatcatgcctca

SEQ ID NO: 51985 - DNA, 20 bp, Artificial
  CRISPR gRNA sequence
cacatgccgttccctctgcc

SEQ ID NO: 51986 - DNA, 20 bp, Artificial
  CRISPR gRNA sequence
cgttccctctgcctggaatg

SEQ ID NO: 51987 - DNA, 20 bp, Artificial
  CRISPR gRNA sequence
tgcagttccctgctcttcac

SEQ ID NO: 51988 - DNA, 20 bp, Artificial
  CRISPR gRNA sequence
gcagttccctgctcttcaca

SEQ ID NO: 51989 - DNA, 20 bp, Artificial
  CRISPR gRNA sequence
ttccctgctcttcacaaggc

SEQ ID NO: 51990 - DNA, 20 bp, Artificial
  CRISPR gRNA sequence
gcgagctctctctcttcctt

SEQ ID NO: 51991 - DNA, 20 bp, Artificial
  CRISPR gRNA sequence
cgagctctctctcttccttt

SEQ ID NO: 51992 - DNA, 20 bp, Artificial
  CRISPR gRNA sequence
ctctctcttcctttaggtcc

SEQ ID NO: 51993 - DNA, 20 bp, Artificial
  CRISPR gRNA sequence
tcttcctttaggtcccagct

SEQ ID NO: 51994 - DNA, 20 bp, Artificial
  CRISPR gRNA sequence
cccagctcagcatccctcct

SEQ ID NO: 51995 - DNA, 20 bp, Artificial
  CRISPR gRNA sequence
cagctcagcatccctcctca

SEQ ID NO: 51996 - DNA, 20 bp, Artificial
  CRISPR gRNA sequence
tcctcagagatgttccctga

SEQ ID NO: 51997 - DNA, 20 bp, Artificial
  CRISPR gRNA sequence
ccacatctaaatcacctctc

SEQ ID NO: 51998 - DNA, 20 bp, Artificial
  CRISPR gRNA sequence
gccactcttcaccacatccc

SEQ ID NO: 51999 - DNA, 20 bp, Artificial
  CRISPR gRNA sequence
cgagaaaattctcttatcac

SEQ ID NO: 52000 - DNA, 20 bp, Artificial
  CRISPR gRNA sequence
aaattctcttatcactggct

SEQ ID NO: 52001 - DNA, 20 bp, Artificial
  CRISPR gRNA sequence
attttactttacttattttt

SEQ ID NO: 52002 - DNA, 20 bp, Artificial
  CRISPR gRNA sequence
ttttcagctcccactattgt

SEQ ID NO: 52003 - DNA, 20 bp, Artificial
  CRISPR gRNA sequence
ttcagctcccactattgtaa

SEQ ID NO: 52004 - DNA, 20 bp, Artificial
  CRISPR gRNA sequence
tcagctcccactattgtaag

SEQ ID NO: 52005 - DNA, 20 bp, Artificial
  CRISPR gRNA sequence
agctcccactattgtaagag

SEQ ID NO: 52006 - DNA, 20 bp, Artificial
  CRISPR gRNA sequence
actattgtaagaggagctcc

SEQ ID NO: 52007 - DNA, 20 bp, Artificial
  CRISPR gRNA sequence
attgtaagaggagctccaag

SEQ ID NO: 52008 - DNA, 20 bp, Artificial
  CRISPR gRNA sequence
aagaggagctccaagaagat

SEQ ID NO: 52009 - DNA, 20 bp, Artificial
  CRISPR gRNA sequence
agaggagctccaagaagata

SEQ ID NO: 52010 - DNA, 20 bp, Artificial
  CRISPR gRNA sequence
gctccaagaagataaggaca

SEQ ID NO: 52011 - DNA, 20 bp, Artificial
  CRISPR gRNA sequence
ctgtgtcgtcacacaatgcc

SEQ ID NO: 52012 - DNA, 20 bp, Artificial
  CRISPR gRNA sequence
gtcacacaatgcctggccca

SEQ ID NO: 52013 - DNA, 20 bp, Artificial
  CRISPR gRNA sequence
acacaatgcctggcccacag

SEQ ID NO: 52014 - DNA, 20 bp, Artificial
  CRISPR gRNA sequence
cacaatgcctggcccacagt

SEQ ID NO: 52015 - DNA, 20 bp, Artificial
  CRISPR gRNA sequence
acaatgcctggcccacagta

SEQ ID NO: 52016 - DNA, 20 bp, Artificial
  CRISPR gRNA sequence
ctggcccacagtagggccac

SEQ ID NO: 52017 - DNA, 20 bp, Artificial
  CRISPR gRNA sequence
ggccacaagcactacacgtt

SEQ ID NO: 52018 - DNA, 20 bp, Artificial
  CRISPR gRNA sequence
actacacgttgagtactaca

SEQ ID NO: 52019 - DNA, 20 bp, Artificial
  CRISPR gRNA sequence
gtactacaaagtttaaaccc

SEQ ID NO: 52020 - DNA, 20 bp, Artificial
  CRISPR gRNA sequence
tacaaagtttaaaccctggc

SEQ ID NO: 52021 - DNA, 20 bp, Artificial
  CRISPR gRNA sequence
acaaagtttaaaccctggca

SEQ ID NO: 52022 - DNA, 20 bp, Artificial
  CRISPR gRNA sequence
caaagtttaaaccctggcaa

SEQ ID NO: 52023 - DNA, 20 bp, Artificial
  CRISPR gRNA sequence
aaagtttaaaccctggcaag

SEQ ID NO: 52024 - DNA, 20 bp, Artificial
  CRISPR gRNA sequence
tttaaaccctggcaaggggt

SEQ ID NO: 52025 - DNA, 20 bp, Artificial
  CRISPR gRNA sequence
ttaaaccctggcaaggggtc

SEQ ID NO: 52026 - DNA, 20 bp, Artificial
  CRISPR gRNA sequence
accctggcaaggggtcaggc

SEQ ID NO: 52027 - DNA, 20 bp, Artificial
  CRISPR gRNA sequence
aggctggccacgccactcca

SEQ ID NO: 52028 - DNA, 20 bp, Artificial
  CRISPR gRNA sequence
ggctggccacgccactccaa

SEQ ID NO: 52029 - DNA, 20 bp, Artificial
  CRISPR gRNA sequence
tggccacgccactccaaagg

SEQ ID NO: 52030 - DNA, 20 bp, Artificial
  CRISPR gRNA sequence
acgccactccaaaggcggac

SEQ ID NO: 52031 - DNA, 20 bp, Artificial
  CRISPR gRNA sequence
cgccactccaaaggcggacg

SEQ ID NO: 52032 - DNA, 20 bp, Artificial
  CRISPR gRNA sequence
ccactccaaaggcggacgag

SEQ ID NO: 52033 - DNA, 20 bp, Artificial
  CRISPR gRNA sequence
tccaaaggcggacgaggagt

SEQ ID NO: 52034 - DNA, 20 bp, Artificial
  CRISPR gRNA sequence
ccaaaggcggacgaggagtc

SEQ ID NO: 52035 - DNA, 20 bp, Artificial
  CRISPR gRNA sequence
caaaggcggacgaggagtca

SEQ ID NO: 52036 - DNA, 20 bp, Artificial
  CRISPR gRNA sequence
aaaggcggacgaggagtcag

SEQ ID NO: 52037 - DNA, 20 bp, Artificial
  CRISPR gRNA sequence
cggacgaggagtcaggggtg

SEQ ID NO: 52038 - DNA, 20 bp, Artificial
  CRISPR gRNA sequence
aggggtgaagctgtgtgatt

SEQ ID NO: 52039 - DNA, 20 bp, Artificial
  CRISPR gRNA sequence
ggggtgaagctgtgtgattt

SEQ ID NO: 52040 - DNA, 20 bp, Artificial
  CRISPR gRNA sequence
gaagctgtgtgatttaggca

SEQ ID NO: 52041 - DNA, 20 bp, Artificial
  CRISPR gRNA sequence
agctgtgtgatttaggcaaa

SEQ ID NO: 52042 - DNA, 20 bp, Artificial
  CRISPR gRNA sequence
tgtgtgatttaggcaaagag

SEQ ID NO: 52043 - DNA, 20 bp, Artificial
  CRISPR gRNA sequence
ggcaaagagaagttcctctc

SEQ ID NO: 52044 - DNA, 20 bp, Artificial
  CRISPR gRNA sequence
gagaagttcctctccggtct

SEQ ID NO: 52045 - DNA, 20 bp, Artificial
  CRISPR gRNA sequence
agaagttcctctccggtctg

SEQ ID NO: 52046 - DNA, 20 bp, Artificial
  CRISPR gRNA sequence
cctgccaccttttatgtcca

SEQ ID NO: 52047 - DNA, 20 bp, Artificial
  CRISPR gRNA sequence
ctgccaccttttatgtccaa

SEQ ID NO: 52048 - DNA, 20 bp, Artificial
  CRISPR gRNA sequence
gccaccttttatgtccaaag

SEQ ID NO: 52049 - DNA, 20 bp, Artificial
  CRISPR gRNA sequence
cctttctgactcattatctc

SEQ ID NO: 52050 - DNA, 20 bp, Artificial
  CRISPR gRNA sequence
ctttctgactcattatctcc

SEQ ID NO: 52051 - DNA, 20 bp, Artificial
  CRISPR gRNA sequence
tctgactcattatctccggg

SEQ ID NO: 52052 - DNA, 20 bp, Artificial
  CRISPR gRNA sequence
ctgactcattatctccgggc

SEQ ID NO: 52053 - DNA, 20 bp, Artificial
  CRISPR gRNA sequence
tgactcattatctccgggca

SEQ ID NO: 52054 - DNA, 20 bp, Artificial
  CRISPR gRNA sequence
ctcattatctccgggcaggg

SEQ ID NO: 52055 - DNA, 20 bp, Artificial
  CRISPR gRNA sequence
tcattatctccgggcagggt

SEQ ID NO: 52056 - DNA, 20 bp, Artificial
  CRISPR gRNA sequence
cgggcagggtgggactatta

SEQ ID NO: 52057 - DNA, 20 bp, Artificial
  CRISPR gRNA sequence
gggcagggtgggactattac

SEQ ID NO: 52058 - DNA, 20 bp, Artificial
  CRISPR gRNA sequence
ggcagggtgggactattaca

SEQ ID NO: 52059 - DNA, 20 bp, Artificial
  CRISPR gRNA sequence
gggactattacagggtgcca

SEQ ID NO: 52060 - DNA, 20 bp, Artificial
  CRISPR gRNA sequence
ggactattacagggtgccat

SEQ ID NO: 52061 - DNA, 20 bp, Artificial
  CRISPR gRNA sequence
gactattacagggtgccatg

SEQ ID NO: 52062 - DNA, 20 bp, Artificial
  CRISPR gRNA sequence
agggtgccatggggtgctgt

SEQ ID NO: 52063 - DNA, 20 bp, Artificial
  CRISPR gRNA sequence
tgccatggggtgctgtgagc

SEQ ID NO: 52064 - DNA, 20 bp, Artificial
  CRISPR gRNA sequence
gccatggggtgctgtgagct

SEQ ID NO: 52065 - DNA, 20 bp, Artificial
  CRISPR gRNA sequence
agctgggctgtacttgcccc

SEQ ID NO: 52066 - DNA, 20 bp, Artificial
  CRISPR gRNA sequence
cacgtctcctccctccctcc

SEQ ID NO: 52067 - DNA, 20 bp, Artificial
  CRISPR gRNA sequence
ctccctcccagataaaaccc

SEQ ID NO: 52068 - DNA, 20 bp, Artificial
  CRISPR gRNA sequence
cccagataaaacccaagcat

SEQ ID NO: 52069 - DNA, 20 bp, Artificial
  CRISPR gRNA sequence
gataaaacccaagcataagc

SEQ ID NO: 52070 - DNA, 20 bp, Artificial
  CRISPR gRNA sequence
cccaagcataagcgagatcc

SEQ ID NO: 52071 - DNA, 20 bp, Artificial
  CRISPR gRNA sequence
caagcataagcgagatcctg

SEQ ID NO: 52072 - DNA, 20 bp, Artificial
  CRISPR gRNA sequence
aagcataagcgagatcctgg

SEQ ID NO: 52073 - DNA, 20 bp, Artificial
  CRISPR gRNA sequence
cgagatcctggaggtgatgc

SEQ ID NO: 52074 - DNA, 20 bp, Artificial
  CRISPR gRNA sequence
ggaggtgatgcgagccatct

SEQ ID NO: 52075 - DNA, 20 bp, Artificial
  CRISPR gRNA sequence
gcgagccatcttagacatcc

SEQ ID NO: 52076 - DNA, 20 bp, Artificial
  CRISPR gRNA sequence
gagccatcttagacatccca

SEQ ID NO: 52077 - DNA, 20 bp, Artificial
  CRISPR gRNA sequence
gccatcttagacatcccaga

SEQ ID NO: 52078 - DNA, 20 bp, Artificial
  CRISPR gRNA sequence
ttagacatcccagagagccc

SEQ ID NO: 52079 - DNA, 20 bp, Artificial
  CRISPR gRNA sequence
cctgctgtattttttcatct

SEQ ID NO: 52080 - DNA, 20 bp, Artificial
  CRISPR gRNA sequence
gtattttttcatcttagctg

SEQ ID NO: 52081 - DNA, 20 bp, Artificial
  CRISPR gRNA sequence
cccaccccgcctcccaccac

SEQ ID NO: 52082 - DNA, 20 bp, Artificial
  CRISPR gRNA sequence
accccgcctcccaccactag

SEQ ID NO: 52083 - DNA, 20 bp, Artificial
  CRISPR gRNA sequence
caccactagaagactgttta

SEQ ID NO: 52084 - DNA, 20 bp, Artificial
  CRISPR gRNA sequence
ttttttctttttttttttct

SEQ ID NO: 52085 - DNA, 20 bp, Artificial
  CRISPR gRNA sequence
ttctttttttttttctgaga

SEQ ID NO: 52086 - DNA, 20 bp, Artificial
  CRISPR gRNA sequence
ctttttttttttctgagatg

SEQ ID NO: 52087 - DNA, 20 bp, Artificial
  CRISPR gRNA sequence
gagtttcactcttgtcgccc

SEQ ID NO: 52088 - DNA, 20 bp, Artificial
  CRISPR gRNA sequence
ttcactcttgtcgcccaagc

SEQ ID NO: 52089 - DNA, 20 bp, Artificial
  CRISPR gRNA sequence
cactcttgtcgcccaagctg

SEQ ID NO: 52090 - DNA, 20 bp, Artificial
  CRISPR gRNA sequence
tcgcccaagctggagtgcaa

SEQ ID NO: 52091 - DNA, 20 bp, Artificial
  CRISPR gRNA sequence
ggagtgcaatggcgcgatct

SEQ ID NO: 52092 - DNA, 20 bp, Artificial
  CRISPR gRNA sequence
cactgcaacctccgcctccc

SEQ ID NO: 52093 - DNA, 20 bp, Artificial
  CRISPR gRNA sequence
aacctccgcctcccaagttc

SEQ ID NO: 52094 - DNA, 20 bp, Artificial
  CRISPR gRNA sequence
ttcaagcaattctcctgcct

SEQ ID NO: 52095 - DNA, 20 bp, Artificial
  CRISPR gRNA sequence
ttctcctgcctcagcctccc

SEQ ID NO: 52096 - DNA, 20 bp, Artificial
  CRISPR gRNA sequence
tcctgcctcagcctcccaag

SEQ ID NO: 52097 - DNA, 20 bp, Artificial
  CRISPR gRNA sequence
gcctcagcctcccaagtagc

SEQ ID NO: 52098 - DNA, 20 bp, Artificial
  CRISPR gRNA sequence
ctcccaagtagctggaatta

SEQ ID NO: 52099 - DNA, 20 bp, Artificial
  CRISPR gRNA sequence
tcccaagtagctggaattac

SEQ ID NO: 52100 - DNA, 20 bp, Artificial
  CRISPR gRNA sequence
acaggcacccaccaccacac

SEQ ID NO: 52101 - DNA, 20 bp, Artificial
  CRISPR gRNA sequence
caggcacccaccaccacacc

SEQ ID NO: 52102 - DNA, 20 bp, Artificial
  CRISPR gRNA sequence
cgggctaatttttgtatttt

SEQ ID NO: 52103 - DNA, 20 bp, Artificial
  CRISPR gRNA sequence
gctaatttttgtatttttag

SEQ ID NO: 52104 - DNA, 20 bp, Artificial
  CRISPR gRNA sequence
taatttttgtatttttagta

SEQ ID NO: 52105 - DNA, 20 bp, Artificial
  CRISPR gRNA sequence
ttttgtatttttagtagaga

SEQ ID NO: 52106 - DNA, 20 bp, Artificial
  CRISPR gRNA sequence
tttgtatttttagtagagac

SEQ ID NO: 52107 - DNA, 20 bp, Artificial
  CRISPR gRNA sequence
ttgtatttttagtagagacg

SEQ ID NO: 52108 - DNA, 20 bp, Artificial
  CRISPR gRNA sequence
gagacggggtttcaccacat

SEQ ID NO: 52109 - DNA, 20 bp, Artificial
  CRISPR gRNA sequence
cggggtttcaccacattggc

SEQ ID NO: 52110 - DNA, 20 bp, Artificial
  CRISPR gRNA sequence
ggggtttcaccacattggcc

SEQ ID NO: 52111 - DNA, 20 bp, Artificial
  CRISPR gRNA sequence
tttcaccacattggccaggc

SEQ ID NO: 52112 - DNA, 20 bp, Artificial
  CRISPR gRNA sequence
tggtctcaaactcctgacct

SEQ ID NO: 52113 - DNA, 20 bp, Artificial
  CRISPR gRNA sequence
ggtctcaaactcctgacctc

SEQ ID NO: 52114 - DNA, 20 bp, Artificial
  CRISPR gRNA sequence
ctcaggtgatctgcccgcct

SEQ ID NO: 52115 - DNA, 20 bp, Artificial
  CRISPR gRNA sequence
ctgcccgcctcggcctccca

SEQ ID NO: 52116 - DNA, 20 bp, Artificial
  CRISPR gRNA sequence
gcctcggcctcccaaagtgc

SEQ ID NO: 52117 - DNA, 20 bp, Artificial
  CRISPR gRNA sequence
cctcggcctcccaaagtgcc

SEQ ID NO: 52118 - DNA, 20 bp, Artificial
  CRISPR gRNA sequence
ctcccaaagtgccgggatta

SEQ ID NO: 52119 - DNA, 20 bp, Artificial
  CRISPR gRNA sequence
tcccaaagtgccgggattac

SEQ ID NO: 52120 - DNA, 20 bp, Artificial
  CRISPR gRNA sequence
agtgccgggattacaggcat

SEQ ID NO: 52121 - DNA, 20 bp, Artificial
  CRISPR gRNA sequence
caggcatgagccaccacaca

SEQ ID NO: 52122 - DNA, 20 bp, Artificial
  CRISPR gRNA sequence
aatacttttaaaattctaac

SEQ ID NO: 52123 - DNA, 20 bp, Artificial
  CRISPR gRNA sequence
tttaaaattctaaccagtct

SEQ ID NO: 52124 - DNA, 20 bp, Artificial
  CRISPR gRNA sequence
taaccagtctgagctgaaat

SEQ ID NO: 52125 - DNA, 20 bp, Artificial
  CRISPR gRNA sequence
tctgagctgaaattagaaaa

SEQ ID NO: 52126 - DNA, 20 bp, Artificial
  CRISPR gRNA sequence
agaaaatagttttaatactt

SEQ ID NO: 52127 - DNA, 20 bp, Artificial
  CRISPR gRNA sequence
gaaaatagttttaatacttt

SEQ ID NO: 52128 - DNA, 20 bp, Artificial
  CRISPR gRNA sequence
aaaatagttttaatactttg

SEQ ID NO: 52129 - DNA, 20 bp, Artificial
  CRISPR gRNA sequence
aaatagttttaatactttgg

SEQ ID NO: 52130 - DNA, 20 bp, Artificial
  CRISPR gRNA sequence
tgcttaaattccctttttgc

SEQ ID NO: 52131 - DNA, 20 bp, Artificial
  CRISPR gRNA sequence
ttccctttttgcgagtttga

SEQ ID NO: 52132 - DNA, 20 bp, Artificial
  CRISPR gRNA sequence
gtttgacggtgacctttaaa

SEQ ID NO: 52133 - DNA, 20 bp, Artificial
  CRISPR gRNA sequence
tgacggtgacctttaaaaag

SEQ ID NO: 52134 - DNA, 20 bp, Artificial
  CRISPR gRNA sequence
tttaaaaagcagcatgtgat

SEQ ID NO: 52135 - DNA, 20 bp, Artificial
  CRISPR gRNA sequence
aaagcagcatgtgataagta

SEQ ID NO: 52136 - DNA, 20 bp, Artificial
  CRISPR gRNA sequence
aagcagcatgtgataagtac

SEQ ID NO: 52137 - DNA, 20 bp, Artificial
  CRISPR gRNA sequence
gtacaggacctacatctgta

SEQ ID NO: 52138 - DNA, 20 bp, Artificial
  CRISPR gRNA sequence
tctgtacagcccctttctac

SEQ ID NO: 52139 - DNA, 20 bp, Artificial
  CRISPR gRNA sequence
gtacagcccctttctacgag

SEQ ID NO: 52140 - DNA, 20 bp, Artificial
  CRISPR gRNA sequence
tacagcccctttctacgagt

SEQ ID NO: 52141 - DNA, 20 bp, Artificial
  CRISPR gRNA sequence
tacgagtgggtgaccctccg

SEQ ID NO: 52142 - DNA, 20 bp, Artificial
  CRISPR gRNA sequence
acgagtgggtgaccctccgt

SEQ ID NO: 52143 - DNA, 20 bp, Artificial
  CRISPR gRNA sequence
agtgggtgaccctccgtggg

SEQ ID NO: 52144 - DNA, 20 bp, Artificial
  CRISPR gRNA sequence
gtgggtgaccctccgtgggt

SEQ ID NO: 52145 - DNA, 20 bp, Artificial
  CRISPR gRNA sequence
tgggtgaccctccgtgggtg

SEQ ID NO: 52146 - DNA, 20 bp, Artificial
  CRISPR gRNA sequence
ggtgaccctccgtgggtggg

SEQ ID NO: 52147 - DNA, 20 bp, Artificial
  CRISPR gRNA sequence
gaccctccgtgggtggggag

SEQ ID NO: 52148 - DNA, 20 bp, Artificial
  CRISPR gRNA sequence
ctccgtgggtggggagaagt

SEQ ID NO: 52149 - DNA, 20 bp, Artificial
  CRISPR gRNA sequence
gtgggtggggagaagttgga

SEQ ID NO: 52150 - DNA, 20 bp, Artificial
  CRISPR gRNA sequence
gttggacagctcatttgtca

SEQ ID NO: 52151 - DNA, 20 bp, Artificial
  CRISPR gRNA sequence
tcacagatcttccatttctt

SEQ ID NO: 52152 - DNA, 20 bp, Artificial
  CRISPR gRNA sequence
cacagatcttccatttctta

SEQ ID NO: 52153 - DNA, 20 bp, Artificial
  CRISPR gRNA sequence
tccatttcttaaggtgattt

SEQ ID NO: 52154 - DNA, 20 bp, Artificial
  CRISPR gRNA sequence
gattttagaataacttattt

SEQ ID NO: 52155 - DNA, 20 bp, Artificial
  CRISPR gRNA sequence
acttatttgagtcccaactc

SEQ ID NO: 52156 - DNA, 20 bp, Artificial
  CRISPR gRNA sequence
cttatttgagtcccaactct

SEQ ID NO: 52157 - DNA, 20 bp, Artificial
  CRISPR gRNA sequence
ttatttgagtcccaactctg

SEQ ID NO: 52158 - DNA, 20 bp, Artificial
  CRISPR gRNA sequence
tatttgagtcccaactctgg

SEQ ID NO: 52159 - DNA, 20 bp, Artificial
  CRISPR gRNA sequence
gagtcccaactctgggggaa

SEQ ID NO: 52160 - DNA, 20 bp, Artificial
  CRISPR gRNA sequence
agtcccaactctgggggaat

SEQ ID NO: 52161 - DNA, 20 bp, Artificial
  CRISPR gRNA sequence
cccaactctgggggaatggg

SEQ ID NO: 52162 - DNA, 20 bp, Artificial
  CRISPR gRNA sequence
ccaactctgggggaatgggc

SEQ ID NO: 52163 - DNA, 20 bp, Artificial
  CRISPR gRNA sequence
caactctgggggaatgggcg

SEQ ID NO: 52164 - DNA, 20 bp, Artificial
  CRISPR gRNA sequence
ggaatattaatcccatttgt

SEQ ID NO: 52165 - DNA, 20 bp, Artificial
  CRISPR gRNA sequence
attaatcccatttgtcagat

SEQ ID NO: 52166 - DNA, 20 bp, Artificial
  CRISPR gRNA sequence
ttaatcccatttgtcagatg

SEQ ID NO: 52167 - DNA, 20 bp, Artificial
  CRISPR gRNA sequence
atttgtcagatgaggaaact

SEQ ID NO: 52168 - DNA, 20 bp, Artificial
  CRISPR gRNA sequence
cagatgaggaaactgagacg

SEQ ID NO: 52169 - DNA, 20 bp, Artificial
  CRISPR gRNA sequence
gatgaggaaactgagacgca

SEQ ID NO: 52170 - DNA, 20 bp, Artificial
  CRISPR gRNA sequence
atgaggaaactgagacgcag

SEQ ID NO: 52171 - DNA, 20 bp, Artificial
  CRISPR gRNA sequence
gaggaaactgagacgcagag

SEQ ID NO: 52172 - DNA, 20 bp, Artificial
  CRISPR gRNA sequence
aggaaactgagacgcagagg

SEQ ID NO: 52173 - DNA, 20 bp, Artificial
  CRISPR gRNA sequence
ggaggcaaacgacgccccct

SEQ ID NO: 52174 - DNA, 20 bp, Artificial
  CRISPR gRNA sequence
gaggcaaacgacgccccctg

SEQ ID NO: 52175 - DNA, 20 bp, Artificial
  CRISPR gRNA sequence
gacgccccctgaggttgaca

SEQ ID NO: 52176 - DNA, 20 bp, Artificial
  CRISPR gRNA sequence
ccctgaggttgacaaagtat

SEQ ID NO: 52177 - DNA, 20 bp, Artificial
  CRISPR gRNA sequence
cctgaggttgacaaagtatt

SEQ ID NO: 52178 - DNA, 20 bp, Artificial
  CRISPR gRNA sequence
ctgaggttgacaaagtatta

SEQ ID NO: 52179 - DNA, 20 bp, Artificial
  CRISPR gRNA sequence
aggttgacaaagtattaggg

SEQ ID NO: 52180 - DNA, 20 bp, Artificial
  CRISPR gRNA sequence
gttgacaaagtattagggtg

SEQ ID NO: 52181 - DNA, 20 bp, Artificial
  CRISPR gRNA sequence
acaaagtattagggtggagc

SEQ ID NO: 52182 - DNA, 20 bp, Artificial
  CRISPR gRNA sequence
aagtattagggtggagctgg

SEQ ID NO: 52183 - DNA, 20 bp, Artificial
  CRISPR gRNA sequence
tattagggtggagctggaag

SEQ ID NO: 52184 - DNA, 20 bp, Artificial
  CRISPR gRNA sequence
gggtggagctggaagcagat

SEQ ID NO: 52185 - DNA, 20 bp, Artificial
  CRISPR gRNA sequence
gtggagctggaagcagattg

SEQ ID NO: 52186 - DNA, 20 bp, Artificial
  CRISPR gRNA sequence
tggaagcagattggagtccc

SEQ ID NO: 52187 - DNA, 20 bp, Artificial
  CRISPR gRNA sequence
attggagtccccagttgtgc

SEQ ID NO: 52188 - DNA, 20 bp, Artificial
  CRISPR gRNA sequence
ttggagtccccagttgtgcc

SEQ ID NO: 52189 - DNA, 20 bp, Artificial
  CRISPR gRNA sequence
gtaaaatgataaaacaacct

SEQ ID NO: 52190 - DNA, 20 bp, Artificial
  CRISPR gRNA sequence
taaaatgataaaacaaccta

SEQ ID NO: 52191 - DNA, 20 bp, Artificial
  CRISPR gRNA sequence
atgataaaacaacctaagga

SEQ ID NO: 52192 - DNA, 20 bp, Artificial
  CRISPR gRNA sequence
aaaacaacctaaggaaagaa

SEQ ID NO: 52193 - DNA, 20 bp, Artificial
  CRISPR gRNA sequence
aacaacctaaggaaagaatg

SEQ ID NO: 52194 - DNA, 20 bp, Artificial
  CRISPR gRNA sequence
aacctaaggaaagaatggag

SEQ ID NO: 52195 - DNA, 20 bp, Artificial
  CRISPR gRNA sequence
acctaaggaaagaatggagc

SEQ ID NO: 52196 - DNA, 20 bp, Artificial
  CRISPR gRNA sequence
taaggaaagaatggagcggg

SEQ ID NO: 52197 - DNA, 20 bp, Artificial
  CRISPR gRNA sequence
aggaaagaatggagcgggta

SEQ ID NO: 52198 - DNA, 20 bp, Artificial
  CRISPR gRNA sequence
ggaaagaatggagcgggtag

SEQ ID NO: 52199 - DNA, 20 bp, Artificial
  CRISPR gRNA sequence
gaaagaatggagcgggtaga

SEQ ID NO: 52200 - DNA, 20 bp, Artificial
  CRISPR gRNA sequence
aaagaatggagcgggtagag

SEQ ID NO: 52201 - DNA, 20 bp, Artificial
  CRISPR gRNA sequence
aagaatggagcgggtagagg

SEQ ID NO: 52202 - DNA, 20 bp, Artificial
  CRISPR gRNA sequence
atggagcgggtagagggggt

SEQ ID NO: 52203 - DNA, 20 bp, Artificial
  CRISPR gRNA sequence
ggagcgggtagagggggttg

SEQ ID NO: 52204 - DNA, 20 bp, Artificial
  CRISPR gRNA sequence
gagcgggtagagggggttgg

SEQ ID NO: 52205 - DNA, 20 bp, Artificial
  CRISPR gRNA sequence
agcgggtagagggggttgga

SEQ ID NO: 52206 - DNA, 20 bp, Artificial
  CRISPR gRNA sequence
gcgggtagagggggttggag

SEQ ID NO: 52207 - DNA, 20 bp, Artificial
  CRISPR gRNA sequence
cgggtagagggggttggagg

SEQ ID NO: 52208 - DNA, 20 bp, Artificial
  CRISPR gRNA sequence
agagggggttggagggggta

SEQ ID NO: 52209 - DNA, 20 bp, Artificial
  CRISPR gRNA sequence
gagggggttggagggggtaa

SEQ ID NO: 52210 - DNA, 20 bp, Artificial
  CRISPR gRNA sequence
ggggttggagggggtaaagg

SEQ ID NO: 52211 - DNA, 20 bp, Artificial
  CRISPR gRNA sequence
gggttggagggggtaaaggc

SEQ ID NO: 52212 - DNA, 20 bp, Artificial
  CRISPR gRNA sequence
ggttggagggggtaaaggcg

SEQ ID NO: 52213 - DNA, 20 bp, Artificial
  CRISPR gRNA sequence
gttggagggggtaaaggcgg

SEQ ID NO: 52214 - DNA, 20 bp, Artificial
  CRISPR gRNA sequence
ttggagggggtaaaggcggg

SEQ ID NO: 52215 - DNA, 20 bp, Artificial
  CRISPR gRNA sequence
gggggtaaaggcggggggtt

SEQ ID NO: 52216 - DNA, 20 bp, Artificial
  CRISPR gRNA sequence
ggggtaaaggcggggggttg

SEQ ID NO: 52217 - DNA, 20 bp, Artificial
  CRISPR gRNA sequence
gggtaaaggcggggggttga

SEQ ID NO: 52218 - DNA, 20 bp, Artificial
  CRISPR gRNA sequence
ggtaaaggcggggggttgag

SEQ ID NO: 52219 - DNA, 20 bp, Artificial
  CRISPR gRNA sequence
aaggcggggggttgaggggt

SEQ ID NO: 52220 - DNA, 20 bp, Artificial
  CRISPR gRNA sequence
ggcggggggttgaggggtta

SEQ ID NO: 52221 - DNA, 20 bp, Artificial
  CRISPR gRNA sequence
gcggggggttgaggggttag

SEQ ID NO: 52222 - DNA, 20 bp, Artificial
  CRISPR gRNA sequence
cggggggttgaggggttaga

SEQ ID NO: 52223 - DNA, 20 bp, Artificial
  CRISPR gRNA sequence
ggggttgaggggttagaggg

SEQ ID NO: 52224 - DNA, 20 bp, Artificial
  CRISPR gRNA sequence
gggttgaggggttagagggc

SEQ ID NO: 52225 - DNA, 20 bp, Artificial
  CRISPR gRNA sequence
gaggggttagagggcaggta

SEQ ID NO: 52226 - DNA, 20 bp, Artificial
  CRISPR gRNA sequence
gggcaggtacagctttgcca

SEQ ID NO: 52227 - DNA, 20 bp, Artificial
  CRISPR gRNA sequence
gcaggtacagctttgccatg

SEQ ID NO: 52228 - DNA, 20 bp, Artificial
  CRISPR gRNA sequence
caggtacagctttgccatgg

SEQ ID NO: 52229 - DNA, 20 bp, Artificial
  CRISPR gRNA sequence
ggtacagctttgccatggag

SEQ ID NO: 52230 - DNA, 20 bp, Artificial
  CRISPR gRNA sequence
gctttgccatggaggagcct

SEQ ID NO: 52231 - DNA, 20 bp, Artificial
  CRISPR gRNA sequence
tggaggagccttagaaacac

SEQ ID NO: 52232 - DNA, 20 bp, Artificial
  CRISPR gRNA sequence
agccttagaaacacgagcac

SEQ ID NO: 52233 - DNA, 20 bp, Artificial
  CRISPR gRNA sequence
gccttagaaacacgagcaca

SEQ ID NO: 52234 - DNA, 20 bp, Artificial
  CRISPR gRNA sequence
gaaacacgagcacaaggaac

SEQ ID NO: 52235 - DNA, 20 bp, Artificial
  CRISPR gRNA sequence
aaacacgagcacaaggaacc

SEQ ID NO: 52236 - DNA, 20 bp, Artificial
  CRISPR gRNA sequence
gagcacaaggaaccgggaaa

SEQ ID NO: 52237 - DNA, 20 bp, Artificial
  CRISPR gRNA sequence
agcacaaggaaccgggaaat

SEQ ID NO: 52238 - DNA, 20 bp, Artificial
  CRISPR gRNA sequence
gaaaaactctcgtcttactg

SEQ ID NO: 52239 - DNA, 20 bp, Artificial
  CRISPR gRNA sequence
aaactctcgtcttactgcag

SEQ ID NO: 52240 - DNA, 20 bp, Artificial
  CRISPR gRNA sequence
aactctcgtcttactgcagc

SEQ ID NO: 52241 - DNA, 20 bp, Artificial
  CRISPR gRNA sequence
tcgtcttactgcagcaggct

SEQ ID NO: 52242 - DNA, 20 bp, Artificial
  CRISPR gRNA sequence
ttactgcagcaggctcagct

SEQ ID NO: 52243 - DNA, 20 bp, Artificial
  CRISPR gRNA sequence
tactgcagcaggctcagctg

SEQ ID NO: 52244 - DNA, 20 bp, Artificial
  CRISPR gRNA sequence
actgcagcaggctcagctga

SEQ ID NO: 52245 - DNA, 20 bp, Artificial
  CRISPR gRNA sequence
tgcagcaggctcagctgagg

SEQ ID NO: 52246 - DNA, 20 bp, Artificial
  CRISPR gRNA sequence
caggctcagctgagggagtt

SEQ ID NO: 52247 - DNA, 20 bp, Artificial
  CRISPR gRNA sequence
aggctcagctgagggagttg

SEQ ID NO: 52248 - DNA, 20 bp, Artificial
  CRISPR gRNA sequence
tcagctgagggagttgaggt

SEQ ID NO: 52249 - DNA, 20 bp, Artificial
  CRISPR gRNA sequence
gctgagggagttgaggtaag

SEQ ID NO: 52250 - DNA, 20 bp, Artificial
  CRISPR gRNA sequence
gggagttgaggtaagcagtc

SEQ ID NO: 52251 - DNA, 20 bp, Artificial
  CRISPR gRNA sequence
agttgaggtaagcagtccag

SEQ ID NO: 52252 - DNA, 20 bp, Artificial
  CRISPR gRNA sequence
ttgaggtaagcagtccagta

SEQ ID NO: 52253 - DNA, 20 bp, Artificial
  CRISPR gRNA sequence
aagcagtccagtagagtctc

SEQ ID NO: 52254 - DNA, 20 bp, Artificial
  CRISPR gRNA sequence
agcagtccagtagagtctcc

SEQ ID NO: 52255 - DNA, 20 bp, Artificial
  CRISPR gRNA sequence
ccagtagagtctccaggctc

SEQ ID NO: 52256 - DNA, 20 bp, Artificial
  CRISPR gRNA sequence
gtctccaggctctggtcact

SEQ ID NO: 52257 - DNA, 20 bp, Artificial
  CRISPR gRNA sequence
tctccaggctctggtcactc

SEQ ID NO: 52258 - DNA, 20 bp, Artificial
  CRISPR gRNA sequence
tctggtcactcaggaactca

SEQ ID NO: 52259 - DNA, 20 bp, Artificial
  CRISPR gRNA sequence
ctggtcactcaggaactcac

SEQ ID NO: 52260 - DNA, 20 bp, Artificial
  CRISPR gRNA sequence
acaggacaatctgtgaaaca

SEQ ID NO: 52261 - DNA, 20 bp, Artificial
  CRISPR gRNA sequence
ggacaatctgtgaaacaaag

SEQ ID NO: 52262 - DNA, 20 bp, Artificial
  CRISPR gRNA sequence
gacaatctgtgaaacaaagc

SEQ ID NO: 52263 - DNA, 20 bp, Artificial
  CRISPR gRNA sequence
aatctgtgaaacaaagcagg

SEQ ID NO: 52264 - DNA, 20 bp, Artificial
  CRISPR gRNA sequence
gtgaaacaaagcaggtggat

SEQ ID NO: 52265 - DNA, 20 bp, Artificial
  CRISPR gRNA sequence
tgaaacaaagcaggtggatg

SEQ ID NO: 52266 - DNA, 20 bp, Artificial
  CRISPR gRNA sequence
aacaaagcaggtggatgagg

SEQ ID NO: 52267 - DNA, 20 bp, Artificial
  CRISPR gRNA sequence
acaaagcaggtggatgaggt

SEQ ID NO: 52268 - DNA, 20 bp, Artificial
  CRISPR gRNA sequence
caaagcaggtggatgaggtg

SEQ ID NO: 52269 - DNA, 20 bp, Artificial
  CRISPR gRNA sequence
aaagcaggtggatgaggtgg

SEQ ID NO: 52270 - DNA, 20 bp, Artificial
  CRISPR gRNA sequence
atgaggtgggggaaaccttc

SEQ ID NO: 52271 - DNA, 20 bp, Artificial
  CRISPR gRNA sequence
tgaggtgggggaaaccttcc

SEQ ID NO: 52272 - DNA, 20 bp, Artificial
  CRISPR gRNA sequence
gtgggggaaaccttccagga

SEQ ID NO: 52273 - DNA, 20 bp, Artificial
  CRISPR gRNA sequence
ggggaaaccttccaggaaag

SEQ ID NO: 52274 - DNA, 20 bp, Artificial
  CRISPR gRNA sequence
gggaaaccttccaggaaagc

SEQ ID NO: 52275 - DNA, 20 bp, Artificial
  CRISPR gRNA sequence
ggaaaccttccaggaaagca

SEQ ID NO: 52276 - DNA, 20 bp, Artificial
  CRISPR gRNA sequence
aaaccttccaggaaagcagg

SEQ ID NO: 52277 - DNA, 20 bp, Artificial
  CRISPR gRNA sequence
ttccaggaaagcagggagca

SEQ ID NO: 52278 - DNA, 20 bp, Artificial
  CRISPR gRNA sequence
aagcagggagcacggcctca

SEQ ID NO: 52279 - DNA, 20 bp, Artificial
  CRISPR gRNA sequence
agggagcacggcctcatagc

SEQ ID NO: 52280 - DNA, 20 bp, Artificial
  CRISPR gRNA sequence
ggagcacggcctcatagcca

SEQ ID NO: 52281 - DNA, 20 bp, Artificial
  CRISPR gRNA sequence
gcctcatagccagagccttc

SEQ ID NO: 52282 - DNA, 20 bp, Artificial
  CRISPR gRNA sequence
ctcatagccagagccttctg

SEQ ID NO: 52283 - DNA, 20 bp, Artificial
  CRISPR gRNA sequence
tagccagagccttctggaga

SEQ ID NO: 52284 - DNA, 20 bp, Artificial
  CRISPR gRNA sequence
agccagagccttctggagat

SEQ ID NO: 52285 - DNA, 20 bp, Artificial
  CRISPR gRNA sequence
ttctggagatgggacctaac

SEQ ID NO: 52286 - DNA, 20 bp, Artificial
  CRISPR gRNA sequence
tctggagatgggacctaacc

SEQ ID NO: 52287 - DNA, 20 bp, Artificial
  CRISPR gRNA sequence
ctggagatgggacctaacca

SEQ ID NO: 52288 - DNA, 20 bp, Artificial
  CRISPR gRNA sequence
tcacctgaaacattccctcc

SEQ ID NO: 52289 - DNA, 20 bp, Artificial
  CRISPR gRNA sequence
gaaacattccctcccagcac

SEQ ID NO: 52290 - DNA, 20 bp, Artificial
  CRISPR gRNA sequence
aaacattccctcccagcact

SEQ ID NO: 52291 - DNA, 20 bp, Artificial
  CRISPR gRNA sequence
ccctcccagcactgggtcca

SEQ ID NO: 52292 - DNA, 20 bp, Artificial
  CRISPR gRNA sequence
cctcccagcactgggtccat

SEQ ID NO: 52293 - DNA, 20 bp, Artificial
  CRISPR gRNA sequence
tgggtccatgggttatccgt

SEQ ID NO: 52294 - DNA, 20 bp, Artificial
  CRISPR gRNA sequence
gggtccatgggttatccgtg

SEQ ID NO: 52295 - DNA, 20 bp, Artificial
  CRISPR gRNA sequence
ccatgggttatccgtgaggc

SEQ ID NO: 52296 - DNA, 20 bp, Artificial
  CRISPR gRNA sequence
tgggttatccgtgaggctgg

SEQ ID NO: 52297 - DNA, 20 bp, Artificial
  CRISPR gRNA sequence
gttatccgtgaggctggaag

SEQ ID NO: 52298 - DNA, 20 bp, Artificial
  CRISPR gRNA sequence
tatccgtgaggctggaagaa

SEQ ID NO: 52299 - DNA, 20 bp, Artificial
  CRISPR gRNA sequence
atccgtgaggctggaagaag

SEQ ID NO: 52300 - DNA, 20 bp, Artificial
  CRISPR gRNA sequence
cgtgaggctggaagaagagg

SEQ ID NO: 52301 - DNA, 20 bp, Artificial
  CRISPR gRNA sequence
gtgaggctggaagaagagga

SEQ ID NO: 52302 - DNA, 20 bp, Artificial
  CRISPR gRNA sequence
gaagaagaggaaggtctttt

SEQ ID NO: 52303 - DNA, 20 bp, Artificial
  CRISPR gRNA sequence
agaggaaggtcttttaagtt

SEQ ID NO: 52304 - DNA, 20 bp, Artificial
  CRISPR gRNA sequence
gaggaaggtcttttaagttt

SEQ ID NO: 52305 - DNA, 20 bp, Artificial
  CRISPR gRNA sequence
tcttttaagtttgggaaata

SEQ ID NO: 52306 - DNA, 20 bp, Artificial
  CRISPR gRNA sequence
cttttaagtttgggaaatac

SEQ ID NO: 52307 - DNA, 20 bp, Artificial
  CRISPR gRNA sequence
ttttaagtttgggaaatacg

SEQ ID NO: 52308 - DNA, 20 bp, Artificial
  CRISPR gRNA sequence
agtttgggaaatacggggtt

SEQ ID NO: 52309 - DNA, 20 bp, Artificial
  CRISPR gRNA sequence
cggggttaagccaaattaaa

SEQ ID NO: 52310 - DNA, 20 bp, Artificial
  CRISPR gRNA sequence
ttaaatggttttgtttgctg

SEQ ID NO: 52311 - DNA, 20 bp, Artificial
  CRISPR gRNA sequence
taaatggttttgtttgctgc

SEQ ID NO: 52312 - DNA, 20 bp, Artificial
  CRISPR gRNA sequence
aaatggttttgtttgctgca

SEQ ID NO: 52313 - DNA, 20 bp, Artificial
  CRISPR gRNA sequence
gtttgctgcagggcttctct

SEQ ID NO: 52314 - DNA, 20 bp, Artificial
  CRISPR gRNA sequence
tttgctgcagggcttctctg

SEQ ID NO: 52315 - DNA, 20 bp, Artificial
  CRISPR gRNA sequence
gggcttctctgaggctgcga

SEQ ID NO: 52316 - DNA, 20 bp, Artificial
  CRISPR gRNA sequence
ggcttctctgaggctgcgat

SEQ ID NO: 52317 - DNA, 20 bp, Artificial
  CRISPR gRNA sequence
gctgtgcattatgaatttcc

SEQ ID NO: 52318 - DNA, 20 bp, Artificial
  CRISPR gRNA sequence
ctgtgcattatgaatttcca

SEQ ID NO: 52319 - DNA, 20 bp, Artificial
  CRISPR gRNA sequence
gtgcattatgaatttccaag

SEQ ID NO: 52320 - DNA, 20 bp, Artificial
  CRISPR gRNA sequence
tatgaatttccaaggagcta

SEQ ID NO: 52321 - DNA, 20 bp, Artificial
  CRISPR gRNA sequence
gaatttccaaggagctacag

SEQ ID NO: 52322 - DNA, 20 bp, Artificial
  CRISPR gRNA sequence
agacttttccccaaactaaa

SEQ ID NO: 52323 - DNA, 20 bp, Artificial
  CRISPR gRNA sequence
tttccccaaactaaatggac

SEQ ID NO: 52324 - DNA, 20 bp, Artificial
  CRISPR gRNA sequence
ccccaaactaaatggactag

SEQ ID NO: 52325 - DNA, 20 bp, Artificial
  CRISPR gRNA sequence
gactagcagaattaattttt

SEQ ID NO: 52326 - DNA, 20 bp, Artificial
  CRISPR gRNA sequence
actagcagaattaattttta

SEQ ID NO: 52327 - DNA, 20 bp, Artificial
  CRISPR gRNA sequence
ctagcagaattaatttttaa

SEQ ID NO: 52328 - DNA, 20 bp, Artificial
  CRISPR gRNA sequence
attaatttttaagggccatg

SEQ ID NO: 52329 - DNA, 20 bp, Artificial
  CRISPR gRNA sequence
ttaatttttaagggccatga

SEQ ID NO: 52330 - DNA, 20 bp, Artificial
  CRISPR gRNA sequence
tttttaagggccatgaaggt

SEQ ID NO: 52331 - DNA, 20 bp, Artificial
  CRISPR gRNA sequence
ttccgcaaaacatgtttgtt

SEQ ID NO: 52332 - DNA, 20 bp, Artificial
  CRISPR gRNA sequence
caaaacatgtttgttaagaa

SEQ ID NO: 52333 - DNA, 20 bp, Artificial
  CRISPR gRNA sequence
tgtttgttaagaaaagaatg

SEQ ID NO: 52334 - DNA, 20 bp, Artificial
  CRISPR gRNA sequence
tgttaagaaaagaatgcagc

SEQ ID NO: 52335 - DNA, 20 bp, Artificial
  CRISPR gRNA sequence
gttaagaaaagaatgcagct

SEQ ID NO: 52336 - DNA, 20 bp, Artificial
  CRISPR gRNA sequence
gaaaagaatgcagctgggca

SEQ ID NO: 52337 - DNA, 20 bp, Artificial
  CRISPR gRNA sequence
aagaatgcagctgggcatgg

SEQ ID NO: 52338 - DNA, 20 bp, Artificial
  CRISPR gRNA sequence
gtggctcatgcctgtaatcg

SEQ ID NO: 52339 - DNA, 20 bp, Artificial
  CRISPR gRNA sequence
tgcctgtaatcgcagcactt

SEQ ID NO: 52340 - DNA, 20 bp, Artificial
  CRISPR gRNA sequence
gcctgtaatcgcagcacttt

SEQ ID NO: 52341 - DNA, 20 bp, Artificial
  CRISPR gRNA sequence
ctgtaatcgcagcactttgg

SEQ ID NO: 52342 - DNA, 20 bp, Artificial
  CRISPR gRNA sequence
tgtaatcgcagcactttggg

SEQ ID NO: 52343 - DNA, 20 bp, Artificial
  CRISPR gRNA sequence
tcgcagcactttgggaggct

SEQ ID NO: 52344 - DNA, 20 bp, Artificial
  CRISPR gRNA sequence
cgcagcactttgggaggctg

SEQ ID NO: 52345 - DNA, 20 bp, Artificial
  CRISPR gRNA sequence
agcactttgggaggctgagg

SEQ ID NO: 52346 - DNA, 20 bp, Artificial
  CRISPR gRNA sequence
gcactttgggaggctgaggt

SEQ ID NO: 52347 - DNA, 20 bp, Artificial
  CRISPR gRNA sequence
ctttgggaggctgaggtggg

SEQ ID NO: 52348 - DNA, 20 bp, Artificial
  CRISPR gRNA sequence
ctgaggtgggtggatcatct

SEQ ID NO: 52349 - DNA, 20 bp, Artificial
  CRISPR gRNA sequence
tgaggtgggtggatcatctg

SEQ ID NO: 52350 - DNA, 20 bp, Artificial
  CRISPR gRNA sequence
gtgggtggatcatctgaggt

SEQ ID NO: 52351 - DNA, 20 bp, Artificial
  CRISPR gRNA sequence
tgggtggatcatctgaggtc

SEQ ID NO: 52352 - DNA, 20 bp, Artificial
  CRISPR gRNA sequence
ggtggatcatctgaggtcag

SEQ ID NO: 52353 - DNA, 20 bp, Artificial
  CRISPR gRNA sequence
atcatctgaggtcaggagtc

SEQ ID NO: 52354 - DNA, 20 bp, Artificial
  CRISPR gRNA sequence
tcatctgaggtcaggagtct

SEQ ID NO: 52355 - DNA, 20 bp, Artificial
  CRISPR gRNA sequence
tgaggtcaggagtctgggac

SEQ ID NO: 52356 - DNA, 20 bp, Artificial
  CRISPR gRNA sequence
tcaggagtctgggaccagcc

SEQ ID NO: 52357 - DNA, 20 bp, Artificial
  CRISPR gRNA sequence
caggagtctgggaccagcct

SEQ ID NO: 52358 - DNA, 20 bp, Artificial
  CRISPR gRNA sequence
tgggaccagcctgggcaaca

SEQ ID NO: 52359 - DNA, 20 bp, Artificial
  CRISPR gRNA sequence
acaaaaaacgaaaaaaaaat

SEQ ID NO: 52360 - DNA, 20 bp, Artificial
  CRISPR gRNA sequence
aaaacgaaaaaaaaattagc

SEQ ID NO: 52361 - DNA, 20 bp, Artificial
  CRISPR gRNA sequence
aaacgaaaaaaaaattagcc

SEQ ID NO: 52362 - DNA, 20 bp, Artificial
  CRISPR gRNA sequence
aaaaaaaaattagccaggcg

SEQ ID NO: 52363 - DNA, 20 bp, Artificial
  CRISPR gRNA sequence
aaaaaattagccaggcgtgg

SEQ ID NO: 52364 - DNA, 20 bp, Artificial
  CRISPR gRNA sequence
ggcgtggtggtgcacacctg

SEQ ID NO: 52365 - DNA, 20 bp, Artificial
  CRISPR gRNA sequence
gtggtgcacacctgtagtaa

SEQ ID NO: 52366 - DNA, 20 bp, Artificial
  CRISPR gRNA sequence
cacctgtagtaatagctact

SEQ ID NO: 52367 - DNA, 20 bp, Artificial
  CRISPR gRNA sequence
acctgtagtaatagctactc

SEQ ID NO: 52368 - DNA, 20 bp, Artificial
  CRISPR gRNA sequence
ctgtagtaatagctactcag

SEQ ID NO: 52369 - DNA, 20 bp, Artificial
  CRISPR gRNA sequence
tgtagtaatagctactcagg

SEQ ID NO: 52370 - DNA, 20 bp, Artificial
  CRISPR gRNA sequence
taatagctactcaggaggct

SEQ ID NO: 52371 - DNA, 20 bp, Artificial
  CRISPR gRNA sequence
aatagctactcaggaggctg

SEQ ID NO: 52372 - DNA, 20 bp, Artificial
  CRISPR gRNA sequence
ctactcaggaggctgaggca

SEQ ID NO: 52373 - DNA, 20 bp, Artificial
  CRISPR gRNA sequence
tactcaggaggctgaggcat

SEQ ID NO: 52374 - DNA, 20 bp, Artificial
  CRISPR gRNA sequence
gcatgggaatcacttgaacc

SEQ ID NO: 52375 - DNA, 20 bp, Artificial
  CRISPR gRNA sequence
catgggaatcacttgaacct

SEQ ID NO: 52376 - DNA, 20 bp, Artificial
  CRISPR gRNA sequence
tgggaatcacttgaacctgg

SEQ ID NO: 52377 - DNA, 20 bp, Artificial
  CRISPR gRNA sequence
gggaatcacttgaacctggg

SEQ ID NO: 52378 - DNA, 20 bp, Artificial
  CRISPR gRNA sequence
aatcacttgaacctgggagg

SEQ ID NO: 52379 - DNA, 20 bp, Artificial
  CRISPR gRNA sequence
tcacttgaacctgggaggca

SEQ ID NO: 52380 - DNA, 20 bp, Artificial
  CRISPR gRNA sequence
cacttgaacctgggaggcag

SEQ ID NO: 52381 - DNA, 20 bp, Artificial
  CRISPR gRNA sequence
aacctgggaggcagaggttg

SEQ ID NO: 52382 - DNA, 20 bp, Artificial
  CRISPR gRNA sequence
tgggaggcagaggttgcagt

SEQ ID NO: 52383 - DNA, 20 bp, Artificial
  CRISPR gRNA sequence
ggcagaggttgcagtgagcc

SEQ ID NO: 52384 - DNA, 20 bp, Artificial
  CRISPR gRNA sequence
aagatcgtaccactgcactc

SEQ ID NO: 52385 - DNA, 20 bp, Artificial
  CRISPR gRNA sequence
cgtaccactgcactccagcc

SEQ ID NO: 52386 - DNA, 20 bp, Artificial
  CRISPR gRNA sequence
gtaccactgcactccagcct

SEQ ID NO: 52387 - DNA, 20 bp, Artificial
  CRISPR gRNA sequence
ctgcactccagcctgggtga

SEQ ID NO: 52388 - DNA, 20 bp, Artificial
  CRISPR gRNA sequence
gcactccagcctgggtgaca

SEQ ID NO: 52389 - DNA, 20 bp, Artificial
  CRISPR gRNA sequence
tccagcctgggtgacagagc

SEQ ID NO: 52390 - DNA, 20 bp, Artificial
  CRISPR gRNA sequence
tctatctcaaaaaaataaaa

SEQ ID NO: 52391 - DNA, 20 bp, Artificial
  CRISPR gRNA sequence
ctcaaaaaaataaaaaagaa

SEQ ID NO: 52392 - DNA, 20 bp, Artificial
  CRISPR gRNA sequence
aaaacaatgctgccttaacc

SEQ ID NO: 52393 - DNA, 20 bp, Artificial
  CRISPR gRNA sequence
aacaatgctgccttaaccca

SEQ ID NO: 52394 - DNA, 20 bp, Artificial
  CRISPR gRNA sequence
acaatgctgccttaacccag

SEQ ID NO: 52395 - DNA, 20 bp, Artificial
  CRISPR gRNA sequence
aatgctgccttaacccagag

SEQ ID NO: 52396 - DNA, 20 bp, Artificial
  CRISPR gRNA sequence
gctgccttaacccagaggag

SEQ ID NO: 52397 - DNA, 20 bp, Artificial
  CRISPR gRNA sequence
acccagaggagtggatatga

SEQ ID NO: 52398 - DNA, 20 bp, Artificial
  CRISPR gRNA sequence
cagaggagtggatatgacag

SEQ ID NO: 52399 - DNA, 20 bp, Artificial
  CRISPR gRNA sequence
tggatatgacagtggaaatt

SEQ ID NO: 52400 - DNA, 20 bp, Artificial
  CRISPR gRNA sequence
agtggaaattcagcatacaa

SEQ ID NO: 52401 - DNA, 20 bp, Artificial
  CRISPR gRNA sequence
gtggaaattcagcatacaac

SEQ ID NO: 52402 - DNA, 20 bp, Artificial
  CRISPR gRNA sequence
aaattcagcatacaacaggt

SEQ ID NO: 52403 - DNA, 20 bp, Artificial
  CRISPR gRNA sequence
cagcatacaacaggtcagcg

SEQ ID NO: 52404 - DNA, 20 bp, Artificial
  CRISPR gRNA sequence
agcatacaacaggtcagcga

SEQ ID NO: 52405 - DNA, 20 bp, Artificial
  CRISPR gRNA sequence
catacaacaggtcagcgaag

SEQ ID NO: 52406 - DNA, 20 bp, Artificial
  CRISPR gRNA sequence
caacaggtcagcgaaggaga

SEQ ID NO: 52407 - DNA, 20 bp, Artificial
  CRISPR gRNA sequence
aacaggtcagcgaaggagac

SEQ ID NO: 52408 - DNA, 20 bp, Artificial
  CRISPR gRNA sequence
acaggtcagcgaaggagaca

SEQ ID NO: 52409 - DNA, 20 bp, Artificial
  CRISPR gRNA sequence
tcagcgaaggagacagggac

SEQ ID NO: 52410 - DNA, 20 bp, Artificial
  CRISPR gRNA sequence
gaaggagacagggactggct

SEQ ID NO: 52411 - DNA, 20 bp, Artificial
  CRISPR gRNA sequence
aaggagacagggactggctt

SEQ ID NO: 52412 - DNA, 20 bp, Artificial
  CRISPR gRNA sequence
cagggactggcttgggtctc

SEQ ID NO: 52413 - DNA, 20 bp, Artificial
  CRISPR gRNA sequence
ctctagttgcccattaacac

SEQ ID NO: 52414 - DNA, 20 bp, Artificial
  CRISPR gRNA sequence
cccattaacaccagaccaac

SEQ ID NO: 52415 - DNA, 20 bp, Artificial
  CRISPR gRNA sequence
ccaaccagctcatcattgtt

SEQ ID NO: 52416 - DNA, 20 bp, Artificial
  CRISPR gRNA sequence
tcattgttcagataattcgt

SEQ ID NO: 52417 - DNA, 20 bp, Artificial
  CRISPR gRNA sequence
tcagataattcgtcagaacc

SEQ ID NO: 52418 - DNA, 20 bp, Artificial
  CRISPR gRNA sequence
tcgtcagaacccagtgcatt

SEQ ID NO: 52419 - DNA, 20 bp, Artificial
  CRISPR gRNA sequence
cgtcagaacccagtgcattt

SEQ ID NO: 52420 - DNA, 20 bp, Artificial
  CRISPR gRNA sequence
tcagaacccagtgcatttag

SEQ ID NO: 52421 - DNA, 20 bp, Artificial
  CRISPR gRNA sequence
agtgcatttaggagaaactc

SEQ ID NO: 52422 - DNA, 20 bp, Artificial
  CRISPR gRNA sequence
ctgccttgctgtctctgctc

SEQ ID NO: 52423 - DNA, 20 bp, Artificial
  CRISPR gRNA sequence
cttgctgtctctgctctaga

SEQ ID NO: 52424 - DNA, 20 bp, Artificial
  CRISPR gRNA sequence
tgctgtctctgctctagatg

SEQ ID NO: 52425 - DNA, 20 bp, Artificial
  CRISPR gRNA sequence
gctgtctctgctctagatgg

SEQ ID NO: 52426 - DNA, 20 bp, Artificial
  CRISPR gRNA sequence
ctctgctctagatggaggac

SEQ ID NO: 52427 - DNA, 20 bp, Artificial
  CRISPR gRNA sequence
tctgctctagatggaggacc

SEQ ID NO: 52428 - DNA, 20 bp, Artificial
  CRISPR gRNA sequence
atggaggaccaggacaactc

SEQ ID NO: 52429 - DNA, 20 bp, Artificial
  CRISPR gRNA sequence
ccaggacaactcaagacact

SEQ ID NO: 52430 - DNA, 20 bp, Artificial
  CRISPR gRNA sequence
actcaagacactgagttccc

SEQ ID NO: 52431 - DNA, 20 bp, Artificial
  CRISPR gRNA sequence
ctcaagacactgagttccct

SEQ ID NO: 52432 - DNA, 20 bp, Artificial
  CRISPR gRNA sequence
tcaagacactgagttccctg

SEQ ID NO: 52433 - DNA, 20 bp, Artificial
  CRISPR gRNA sequence
agttccctggggtttaccta

SEQ ID NO: 52434 - DNA, 20 bp, Artificial
  CRISPR gRNA sequence
gtttacctacagccccttcc

SEQ ID NO: 52435 - DNA, 20 bp, Artificial
  CRISPR gRNA sequence
tttacctacagccccttcct

SEQ ID NO: 52436 - DNA, 20 bp, Artificial
  CRISPR gRNA sequence
ttacctacagccccttcctg

SEQ ID NO: 52437 - DNA, 20 bp, Artificial
  CRISPR gRNA sequence
tacctacagccccttcctgg

SEQ ID NO: 52438 - DNA, 20 bp, Artificial
  CRISPR gRNA sequence
acctacagccccttcctggg

SEQ ID NO: 52439 - DNA, 20 bp, Artificial
  CRISPR gRNA sequence
cagccccttcctggggggcc

SEQ ID NO: 52440 - DNA, 20 bp, Artificial
  CRISPR gRNA sequence
gccccttcctggggggcctg

SEQ ID NO: 52441 - DNA, 20 bp, Artificial
  CRISPR gRNA sequence
gagccacttcccaacccccg

SEQ ID NO: 52442 - DNA, 20 bp, Artificial
  CRISPR gRNA sequence
ttctgttccttcatcctctg

SEQ ID NO: 52443 - DNA, 20 bp, Artificial
  CRISPR gRNA sequence
tctgttccttcatcctctgc

SEQ ID NO: 52444 - DNA, 20 bp, Artificial
  CRISPR gRNA sequence
aggctgccctctcccctctc

SEQ ID NO: 52445 - DNA, 20 bp, Artificial
  CRISPR gRNA sequence
ggctgccctctcccctctcc

SEQ ID NO: 52446 - DNA, 20 bp, Artificial
  CRISPR gRNA sequence
gctgccctctcccctctccg

SEQ ID NO: 52447 - DNA, 20 bp, Artificial
  CRISPR gRNA sequence
ctcccctctccggggcctcc

SEQ ID NO: 52448 - DNA, 20 bp, Artificial
  CRISPR gRNA sequence
tcccctctccggggcctcca

SEQ ID NO: 52449 - DNA, 20 bp, Artificial
  CRISPR gRNA sequence
cccctctccggggcctccaa

SEQ ID NO: 52450 - DNA, 20 bp, Artificial
  CRISPR gRNA sequence
ctccggggcctccaagggcc

SEQ ID NO: 52451 - DNA, 20 bp, Artificial
  CRISPR gRNA sequence
atctctgctgctttctcctc

SEQ ID NO: 52452 - DNA, 20 bp, Artificial
  CRISPR gRNA sequence
tgctttctcctctggctgtt

SEQ ID NO: 52453 - DNA, 20 bp, Artificial
  CRISPR gRNA sequence
ctttctcctctggctgtttg

SEQ ID NO: 52454 - DNA, 20 bp, Artificial
  CRISPR gRNA sequence
tttctcctctggctgtttgg

SEQ ID NO: 52455 - DNA, 20 bp, Artificial
  CRISPR gRNA sequence
ttctcctctggctgtttgga

SEQ ID NO: 52456 - DNA, 20 bp, Artificial
  CRISPR gRNA sequence
tctcctctggctgtttggag

SEQ ID NO: 52457 - DNA, 20 bp, Artificial
  CRISPR gRNA sequence
tcctctggctgtttggaggg

SEQ ID NO: 52458 - DNA, 20 bp, Artificial
  CRISPR gRNA sequence
cctctggctgtttggagggg

SEQ ID NO: 52459 - DNA, 20 bp, Artificial
  CRISPR gRNA sequence
ggctgtttggaggggaggca

SEQ ID NO: 52460 - DNA, 20 bp, Artificial
  CRISPR gRNA sequence
ctgtttggaggggaggcatg

SEQ ID NO: 52461 - DNA, 20 bp, Artificial
  CRISPR gRNA sequence
tggaggggaggcatggagta

SEQ ID NO: 52462 - DNA, 20 bp, Artificial
  CRISPR gRNA sequence
ggaggggaggcatggagtac

SEQ ID NO: 52463 - DNA, 20 bp, Artificial
  CRISPR gRNA sequence
gaggggaggcatggagtaca

SEQ ID NO: 52464 - DNA, 20 bp, Artificial
  CRISPR gRNA sequence
aggggaggcatggagtacag

SEQ ID NO: 52465 - DNA, 20 bp, Artificial
  CRISPR gRNA sequence
tacaggggccctacatcaac

SEQ ID NO: 52466 - DNA, 20 bp, Artificial
  CRISPR gRNA sequence
gggccctacatcaactggct

SEQ ID NO: 52467 - DNA, 20 bp, Artificial
  CRISPR gRNA sequence
cctacatcaactggctcagt

SEQ ID NO: 52468 - DNA, 20 bp, Artificial
  CRISPR gRNA sequence
catcaactggctcagtgagc

SEQ ID NO: 52469 - DNA, 20 bp, Artificial
  CRISPR gRNA sequence
atcaactggctcagtgagct

SEQ ID NO: 52470 - DNA, 20 bp, Artificial
  CRISPR gRNA sequence
tcaactggctcagtgagctg

SEQ ID NO: 52471 - DNA, 20 bp, Artificial
  CRISPR gRNA sequence
caactggctcagtgagctgg

SEQ ID NO: 52472 - DNA, 20 bp, Artificial
  CRISPR gRNA sequence
aactggctcagtgagctggg

SEQ ID NO: 52473 - DNA, 20 bp, Artificial
  CRISPR gRNA sequence
tggctcagtgagctgggggg

SEQ ID NO: 52474 - DNA, 20 bp, Artificial
  CRISPR gRNA sequence
ggctcagtgagctggggggc

SEQ ID NO: 52475 - DNA, 20 bp, Artificial
  CRISPR gRNA sequence
gctcagtgagctggggggca

SEQ ID NO: 52476 - DNA, 20 bp, Artificial
  CRISPR gRNA sequence
cagtgagctggggggcaggg

SEQ ID NO: 52477 - DNA, 20 bp, Artificial
  CRISPR gRNA sequence
agtgagctggggggcagggt

SEQ ID NO: 52478 - DNA, 20 bp, Artificial
  CRISPR gRNA sequence
gtgagctggggggcagggta

SEQ ID NO: 52479 - DNA, 20 bp, Artificial
  CRISPR gRNA sequence
agctggggggcagggtaggg

SEQ ID NO: 52480 - DNA, 20 bp, Artificial
  CRISPR gRNA sequence
gctggggggcagggtagggc

SEQ ID NO: 52481 - DNA, 20 bp, Artificial
  CRISPR gRNA sequence
tggggggcagggtagggcgg

SEQ ID NO: 52482 - DNA, 20 bp, Artificial
  CRISPR gRNA sequence
ggggggcagggtagggcggg

SEQ ID NO: 52483 - DNA, 20 bp, Artificial
  CRISPR gRNA sequence
ggggcagggtagggcgggag

SEQ ID NO: 52484 - DNA, 20 bp, Artificial
  CRISPR gRNA sequence
gcagggtagggcgggaggag

SEQ ID NO: 52485 - DNA, 20 bp, Artificial
  CRISPR gRNA sequence
cgggaggagcagcctcatgt

SEQ ID NO: 52486 - DNA, 20 bp, Artificial
  CRISPR gRNA sequence
ggaggagcagcctcatgttg

SEQ ID NO: 52487 - DNA, 20 bp, Artificial
  CRISPR gRNA sequence
cctcatgttggagcctctgc

SEQ ID NO: 52488 - DNA, 20 bp, Artificial
  CRISPR gRNA sequence
ctcatgttggagcctctgcc

SEQ ID NO: 52489 - DNA, 20 bp, Artificial
  CRISPR gRNA sequence
tcatgttggagcctctgcca

SEQ ID NO: 52490 - DNA, 20 bp, Artificial
  CRISPR gRNA sequence
ttggagcctctgccagggcc

SEQ ID NO: 52491 - DNA, 20 bp, Artificial
  CRISPR gRNA sequence
tggagcctctgccagggccc

SEQ ID NO: 52492 - DNA, 20 bp, Artificial
  CRISPR gRNA sequence
gcctctgccagggcccaggc

SEQ ID NO: 52493 - DNA, 20 bp, Artificial
  CRISPR gRNA sequence
ctctgccagggcccaggctg

SEQ ID NO: 52494 - DNA, 20 bp, Artificial
  CRISPR gRNA sequence
tctgccagggcccaggctgg

SEQ ID NO: 52495 - DNA, 20 bp, Artificial
  CRISPR gRNA sequence
caactctaccctttctgccc

SEQ ID NO: 52496 - DNA, 20 bp, Artificial
  CRISPR gRNA sequence
aactctaccctttctgcccc

SEQ ID NO: 52497 - DNA, 20 bp, Artificial
  CRISPR gRNA sequence
actctaccctttctgcccca

SEQ ID NO: 52498 - DNA, 20 bp, Artificial
  CRISPR gRNA sequence
accctttctgccccagggac

SEQ ID NO: 52499 - DNA, 20 bp, Artificial
  CRISPR gRNA sequence
ccctttctgccccagggact

SEQ ID NO: 52500 - DNA, 20 bp, Artificial
  CRISPR gRNA sequence
tctgccccagggactgggca

SEQ ID NO: 52501 - DNA, 20 bp, Artificial
  CRISPR gRNA sequence
ctgccccagggactgggcat

SEQ ID NO: 52502 - DNA, 20 bp, Artificial
  CRISPR gRNA sequence
gggactgggcatgggcccct

SEQ ID NO: 52503 - DNA, 20 bp, Artificial
  CRISPR gRNA sequence
ggactgggcatgggcccctg

SEQ ID NO: 52504 - DNA, 20 bp, Artificial
  CRISPR gRNA sequence
gggcatgggcccctgaggca

SEQ ID NO: 52505 - DNA, 20 bp, Artificial
  CRISPR gRNA sequence
atgggcccctgaggcacagt

SEQ ID NO: 52506 - DNA, 20 bp, Artificial
  CRISPR gRNA sequence
tgggcccctgaggcacagtc

SEQ ID NO: 52507 - DNA, 20 bp, Artificial
  CRISPR gRNA sequence
ccctgaggcacagtcaggac

SEQ ID NO: 52508 - DNA, 20 bp, Artificial
  CRISPR gRNA sequence
cctgaggcacagtcaggact

SEQ ID NO: 52509 - DNA, 20 bp, Artificial
  CRISPR gRNA sequence
ctgaggcacagtcaggactg

SEQ ID NO: 52510 - DNA, 20 bp, Artificial
  CRISPR gRNA sequence
tcaggactggggcctttatt

SEQ ID NO: 52511 - DNA, 20 bp, Artificial
  CRISPR gRNA sequence
caggactggggcctttattg

SEQ ID NO: 52512 - DNA, 20 bp, Artificial
  CRISPR gRNA sequence
aggactggggcctttattga

SEQ ID NO: 52513 - DNA, 20 bp, Artificial
  CRISPR gRNA sequence
actggggcctttattgaggg

SEQ ID NO: 52514 - DNA, 20 bp, Artificial
  CRISPR gRNA sequence
tttattgagggtggtctttc

SEQ ID NO: 52515 - DNA, 20 bp, Artificial
  CRISPR gRNA sequence
ttccagaaacacatcccgta

SEQ ID NO: 52516 - DNA, 20 bp, Artificial
  CRISPR gRNA sequence
catcccgtatggtgtcccac

SEQ ID NO: 52517 - DNA, 20 bp, Artificial
  CRISPR gRNA sequence
ccagacccccaaatacacca

SEQ ID NO: 52518 - DNA, 20 bp, Artificial
  CRISPR gRNA sequence
cagacccccaaatacaccat

SEQ ID NO: 52519 - DNA, 20 bp, Artificial
  CRISPR gRNA sequence
cccaaatacaccatgggctc

SEQ ID NO: 52520 - DNA, 20 bp, Artificial
  CRISPR gRNA sequence
aatacaccatgggctctggt

SEQ ID NO: 52521 - DNA, 20 bp, Artificial
  CRISPR gRNA sequence
accatgggctctggttggca

SEQ ID NO: 52522 - DNA, 20 bp, Artificial
  CRISPR gRNA sequence
ccatgggctctggttggcaa

SEQ ID NO: 52523 - DNA, 20 bp, Artificial
  CRISPR gRNA sequence
atgggctctggttggcaaag

SEQ ID NO: 52524 - DNA, 20 bp, Artificial
  CRISPR gRNA sequence
tgggctctggttggcaaagg

SEQ ID NO: 52525 - DNA, 20 bp, Artificial
  CRISPR gRNA sequence
cctcctttttttttttttta

SEQ ID NO: 52526 - DNA, 20 bp, Artificial
  CRISPR gRNA sequence
tttttttttttttaaagcaa

SEQ ID NO: 52527 - DNA, 20 bp, Artificial
  CRISPR gRNA sequence
actctttaccacatcccaca

SEQ ID NO: 52528 - DNA, 20 bp, Artificial
  CRISPR gRNA sequence
atggtatgcccatgtgtaca

SEQ ID NO: 52529 - DNA, 20 bp, Artificial
  CRISPR gRNA sequence
tggtatgcccatgtgtacac

SEQ ID NO: 52530 - DNA, 20 bp, Artificial
  CRISPR gRNA sequence
tgcccatgtgtacacaggca

SEQ ID NO: 52531 - DNA, 20 bp, Artificial
  CRISPR gRNA sequence
ccatgtgtacacaggcaaag

SEQ ID NO: 52532 - DNA, 20 bp, Artificial
  CRISPR gRNA sequence
acacaggcaaagtagacctg

SEQ ID NO: 52533 - DNA, 20 bp, Artificial
  CRISPR gRNA sequence
agacctgcagtgcttgaatt

SEQ ID NO: 52534 - DNA, 20 bp, Artificial
  CRISPR gRNA sequence
gacctgcagtgcttgaattc

SEQ ID NO: 52535 - DNA, 20 bp, Artificial
  CRISPR gRNA sequence
acctgcagtgcttgaattca

SEQ ID NO: 52536 - DNA, 20 bp, Artificial
  CRISPR gRNA sequence
ctgcagtgcttgaattcagg

SEQ ID NO: 52537 - DNA, 20 bp, Artificial
  CRISPR gRNA sequence
tgcagtgcttgaattcaggg

SEQ ID NO: 52538 - DNA, 20 bp, Artificial
  CRISPR gRNA sequence
gcagtgcttgaattcaggga

SEQ ID NO: 52539 - DNA, 20 bp, Artificial
  CRISPR gRNA sequence
cagtgcttgaattcagggag

SEQ ID NO: 52540 - DNA, 20 bp, Artificial
  CRISPR gRNA sequence
agtgcttgaattcagggagg

SEQ ID NO: 52541 - DNA, 20 bp, Artificial
  CRISPR gRNA sequence
gtgcttgaattcagggaggg

SEQ ID NO: 52542 - DNA, 20 bp, Artificial
  CRISPR gRNA sequence
ttgaattcagggagggggga

SEQ ID NO: 52543 - DNA, 20 bp, Artificial
  CRISPR gRNA sequence
gaattcagggaggggggatg

SEQ ID NO: 52544 - DNA, 20 bp, Artificial
  CRISPR gRNA sequence
gccccacaatctatcttccc

SEQ ID NO: 52545 - DNA, 20 bp, Artificial
  CRISPR gRNA sequence
tctatcttccctggcttccc

SEQ ID NO: 52546 - DNA, 20 bp, Artificial
  CRISPR gRNA sequence
atcttccctggcttccccgg

SEQ ID NO: 52547 - DNA, 20 bp, Artificial
  CRISPR gRNA sequence
tggcttccccggtggaaccc

SEQ ID NO: 52548 - DNA, 20 bp, Artificial
  CRISPR gRNA sequence
ggcttccccggtggaacccc

SEQ ID NO: 52549 - DNA, 20 bp, Artificial
  CRISPR gRNA sequence
gcttccccggtggaaccccg

SEQ ID NO: 52550 - DNA, 20 bp, Artificial
  CRISPR gRNA sequence
gtggaaccccggggaatcac

SEQ ID NO: 52551 - DNA, 20 bp, Artificial
  CRISPR gRNA sequence
cccggggaatcactggactt

SEQ ID NO: 52552 - DNA, 20 bp, Artificial
  CRISPR gRNA sequence
aatcactggacttcagcatt

SEQ ID NO: 52553 - DNA, 20 bp, Artificial
  CRISPR gRNA sequence
agtaccttgatgactattta

SEQ ID NO: 52554 - DNA, 20 bp, Artificial
  CRISPR gRNA sequence
atttatagcaataatcctgc

SEQ ID NO: 52555 - DNA, 20 bp, Artificial
  CRISPR gRNA sequence
aataatcctgcaagtgatca

SEQ ID NO: 52556 - DNA, 20 bp, Artificial
  CRISPR gRNA sequence
caagtgatcacagtactcta

SEQ ID NO: 52557 - DNA, 20 bp, Artificial
  CRISPR gRNA sequence
acagtactctacagttgaca

SEQ ID NO: 52558 - DNA, 20 bp, Artificial
  CRISPR gRNA sequence
tattgcactttccccaacca

SEQ ID NO: 52559 - DNA, 20 bp, Artificial
  CRISPR gRNA sequence
attgcactttccccaaccac

SEQ ID NO: 52560 - DNA, 20 bp, Artificial
  CRISPR gRNA sequence
ctttccccaaccacaggtaa

SEQ ID NO: 52561 - DNA, 20 bp, Artificial
  CRISPR gRNA sequence
ttccccaaccacaggtaatg

SEQ ID NO: 52562 - DNA, 20 bp, Artificial
  CRISPR gRNA sequence
tccccaaccacaggtaatgg

SEQ ID NO: 52563 - DNA, 20 bp, Artificial
  CRISPR gRNA sequence
ccccaaccacaggtaatgga

SEQ ID NO: 52564 - DNA, 20 bp, Artificial
  CRISPR gRNA sequence
cccaaccacaggtaatggag

SEQ ID NO: 52565 - DNA, 20 bp, Artificial
  CRISPR gRNA sequence
ccaaccacaggtaatggagg

SEQ ID NO: 52566 - DNA, 20 bp, Artificial
  CRISPR gRNA sequence
ctgaaactcccacctgtgct

SEQ ID NO: 52567 - DNA, 20 bp, Artificial
  CRISPR gRNA sequence
ccacctgtgctcagaccgcc

SEQ ID NO: 52568 - DNA, 20 bp, Artificial
  CRISPR gRNA sequence
ctcagaccgcccagtgctgc

SEQ ID NO: 52569 - DNA, 20 bp, Artificial
  CRISPR gRNA sequence
agaccgcccagtgctgccag

SEQ ID NO: 52570 - DNA, 20 bp, Artificial
  CRISPR gRNA sequence
gaccgcccagtgctgccagt

SEQ ID NO: 52571 - DNA, 20 bp, Artificial
  CRISPR gRNA sequence
atttatttatttatttattt

SEQ ID NO: 52572 - DNA, 20 bp, Artificial
  CRISPR gRNA sequence
atttatttatttatttgaga

SEQ ID NO: 52573 - DNA, 20 bp, Artificial
  CRISPR gRNA sequence
ttatttatttatttgagaca

SEQ ID NO: 52574 - DNA, 20 bp, Artificial
  CRISPR gRNA sequence
cagagtcttgctctgttgcc

SEQ ID NO: 52575 - DNA, 20 bp, Artificial
  CRISPR gRNA sequence
agagtcttgctctgttgccc

SEQ ID NO: 52576 - DNA, 20 bp, Artificial
  CRISPR gRNA sequence
tcttgctctgttgcccaggc

SEQ ID NO: 52577 - DNA, 20 bp, Artificial
  CRISPR gRNA sequence
ttgctctgttgcccaggctg

SEQ ID NO: 52578 - DNA, 20 bp, Artificial
  CRISPR gRNA sequence
tgctctgttgcccaggctgg

SEQ ID NO: 52579 - DNA, 20 bp, Artificial
  CRISPR gRNA sequence
ctgttgcccaggctggagga

SEQ ID NO: 52580 - DNA, 20 bp, Artificial
  CRISPR gRNA sequence
ttgcccaggctggaggacag

SEQ ID NO: 52581 - DNA, 20 bp, Artificial
  CRISPR gRNA sequence
caggctggaggacagtggcg

SEQ ID NO: 52582 - DNA, 20 bp, Artificial
  CRISPR gRNA sequence
ggaggacagtggcgcagtct

SEQ ID NO: 52583 - DNA, 20 bp, Artificial
  CRISPR gRNA sequence
tcaccacaatctctgcctcc

SEQ ID NO: 52584 - DNA, 20 bp, Artificial
  CRISPR gRNA sequence
caccacaatctctgcctccc

SEQ ID NO: 52585 - DNA, 20 bp, Artificial
  CRISPR gRNA sequence
aatctctgcctcccgggttc

SEQ ID NO: 52586 - DNA, 20 bp, Artificial
  CRISPR gRNA sequence
tctgcctcccgggttcaagc

SEQ ID NO: 52587 - DNA, 20 bp, Artificial
  CRISPR gRNA sequence
gcaagtctcctgcctgcctc

SEQ ID NO: 52588 - DNA, 20 bp, Artificial
  CRISPR gRNA sequence
aagtctcctgcctgcctcca

SEQ ID NO: 52589 - DNA, 20 bp, Artificial
  CRISPR gRNA sequence
tctcctgcctgcctccagag

SEQ ID NO: 52590 - DNA, 20 bp, Artificial
  CRISPR gRNA sequence
ctgcctgcctccagagtagc

SEQ ID NO: 52591 - DNA, 20 bp, Artificial
  CRISPR gRNA sequence
tgcctgcctccagagtagct

SEQ ID NO: 52592 - DNA, 20 bp, Artificial
  CRISPR gRNA sequence
ctccagagtagctgggatta

SEQ ID NO: 52593 - DNA, 20 bp, Artificial
  CRISPR gRNA sequence
tccagagtagctgggattac

SEQ ID NO: 52594 - DNA, 20 bp, Artificial
  CRISPR gRNA sequence
ccagagtagctgggattaca

SEQ ID NO: 52595 - DNA, 20 bp, Artificial
  CRISPR gRNA sequence
cagagtagctgggattacag

SEQ ID NO: 52596 - DNA, 20 bp, Artificial
  CRISPR gRNA sequence
caggggtgcaccaccatgcc

SEQ ID NO: 52597 - DNA, 20 bp, Artificial
  CRISPR gRNA sequence
ctggctaatttttgtatttt

SEQ ID NO: 52598 - DNA, 20 bp, Artificial
  CRISPR gRNA sequence
gctaatttttgtatttttag

SEQ ID NO: 52599 - DNA, 20 bp, Artificial
  CRISPR gRNA sequence
taatttttgtatttttagta

SEQ ID NO: 52600 - DNA, 20 bp, Artificial
  CRISPR gRNA sequence
ttttgtatttttagtagaga

SEQ ID NO: 52601 - DNA, 20 bp, Artificial
  CRISPR gRNA sequence
tttgtatttttagtagagat

SEQ ID NO: 52602 - DNA, 20 bp, Artificial
  CRISPR gRNA sequence
ttgtatttttagtagagatg

SEQ ID NO: 52603 - DNA, 20 bp, Artificial
  CRISPR gRNA sequence
gagatggggtttcactatgt

SEQ ID NO: 52604 - DNA, 20 bp, Artificial
  CRISPR gRNA sequence
tggggtttcactatgttggc

SEQ ID NO: 52605 - DNA, 20 bp, Artificial
  CRISPR gRNA sequence
ggggtttcactatgttggcc

SEQ ID NO: 52606 - DNA, 20 bp, Artificial
  CRISPR gRNA sequence
tttcactatgttggccaggc

SEQ ID NO: 52607 - DNA, 20 bp, Artificial
  CRISPR gRNA sequence
gaactcctgacctcatgatc

SEQ ID NO: 52608 - DNA, 20 bp, Artificial
  CRISPR gRNA sequence
acctcatgatccagccacct

SEQ ID NO: 52609 - DNA, 20 bp, Artificial
  CRISPR gRNA sequence
ccagccacctcggcctccca

SEQ ID NO: 52610 - DNA, 20 bp, Artificial
  CRISPR gRNA sequence
acctcggcctcccaaagtgc

SEQ ID NO: 52611 - DNA, 20 bp, Artificial
  CRISPR gRNA sequence
cctcggcctcccaaagtgct

SEQ ID NO: 52612 - DNA, 20 bp, Artificial
  CRISPR gRNA sequence
ctcccaaagtgctgggatta

SEQ ID NO: 52613 - DNA, 20 bp, Artificial
  CRISPR gRNA sequence
tcccaaagtgctgggattat

SEQ ID NO: 52614 - DNA, 20 bp, Artificial
  CRISPR gRNA sequence
agtgctgggattataggcgt

SEQ ID NO: 52615 - DNA, 20 bp, Artificial
  CRISPR gRNA sequence
ataggcgtgagtcaccgtgc

SEQ ID NO: 52616 - DNA, 20 bp, Artificial
  CRISPR gRNA sequence
taggcgtgagtcaccgtgcc

SEQ ID NO: 52617 - DNA, 20 bp, Artificial
  CRISPR gRNA sequence
gagtcaccgtgccgggccgc

SEQ ID NO: 52618 - DNA, 20 bp, Artificial
  CRISPR gRNA sequence
tcaccgtgccgggccgccag

SEQ ID NO: 52619 - DNA, 20 bp, Artificial
  CRISPR gRNA sequence
caccgtgccgggccgccagt

SEQ ID NO: 52620 - DNA, 20 bp, Artificial
  CRISPR gRNA sequence
gccagtgggctttttatatt

SEQ ID NO: 52621 - DNA, 20 bp, Artificial
  CRISPR gRNA sequence
tttatattaagcttcctctg

SEQ ID NO: 52622 - DNA, 20 bp, Artificial
  CRISPR gRNA sequence
cctctgcagatgatttgcct

SEQ ID NO: 52623 - DNA, 20 bp, Artificial
  CRISPR gRNA sequence
tgcagatgatttgccttggc

SEQ ID NO: 52624 - DNA, 20 bp, Artificial
  CRISPR gRNA sequence
agatgatttgccttggccag

SEQ ID NO: 52625 - DNA, 20 bp, Artificial
  CRISPR gRNA sequence
atgatttgccttggccagca

SEQ ID NO: 52626 - DNA, 20 bp, Artificial
  CRISPR gRNA sequence
ggccagcagagcccgcatcc

SEQ ID NO: 52627 - DNA, 20 bp, Artificial
  CRISPR gRNA sequence
tcccagtctccttgtgttcc

SEQ ID NO: 52628 - DNA, 20 bp, Artificial
  CRISPR gRNA sequence
cccagtctccttgtgttccc

SEQ ID NO: 52629 - DNA, 20 bp, Artificial
  CRISPR gRNA sequence
ctccttgtgttcccaggatc

SEQ ID NO: 52630 - DNA, 20 bp, Artificial
  CRISPR gRNA sequence
tgtgttcccaggatctggcc

SEQ ID NO: 52631 - DNA, 20 bp, Artificial
  CRISPR gRNA sequence
ccaggatctggcccagtgca

SEQ ID NO: 52632 - DNA, 20 bp, Artificial
  CRISPR gRNA sequence
gcccagtgcatggtatacaa

SEQ ID NO: 52633 - DNA, 20 bp, Artificial
  CRISPR gRNA sequence
cccagtgcatggtatacaat

SEQ ID NO: 52634 - DNA, 20 bp, Artificial
  CRISPR gRNA sequence
ggtatacaataggtacttaa

SEQ ID NO: 52635 - DNA, 20 bp, Artificial
  CRISPR gRNA sequence
acttaacagtcaaatcacgt

SEQ ID NO: 52636 - DNA, 20 bp, Artificial
  CRISPR gRNA sequence
ttaacagtcaaatcacgtaa

SEQ ID NO: 52637 - DNA, 20 bp, Artificial
  CRISPR gRNA sequence
tcacgtaagagtgctttttg

SEQ ID NO: 52638 - DNA, 20 bp, Artificial
  CRISPR gRNA sequence
gctttttgtagcactgactg

SEQ ID NO: 52639 - DNA, 20 bp, Artificial
  CRISPR gRNA sequence
acaaaacaaaacacaacacc

SEQ ID NO: 52640 - DNA, 20 bp, Artificial
  CRISPR gRNA sequence
aaacaaaacacaacacctag

SEQ ID NO: 52641 - DNA, 20 bp, Artificial
  CRISPR gRNA sequence
caaaacacaacacctagaag

SEQ ID NO: 52642 - DNA, 20 bp, Artificial
  CRISPR gRNA sequence
cacaacacctagaagcagtt

SEQ ID NO: 52643 - DNA, 20 bp, Artificial
  CRISPR gRNA sequence
aagcagtttggatttcaatc

SEQ ID NO: 52644 - DNA, 20 bp, Artificial
  CRISPR gRNA sequence
tttggatttcaatctagacc

SEQ ID NO: 52645 - DNA, 20 bp, Artificial
  CRISPR gRNA sequence
caatctagaccaagttgtcc

SEQ ID NO: 52646 - DNA, 20 bp, Artificial
  CRISPR gRNA sequence
accaagttgtccaagccaca

SEQ ID NO: 52647 - DNA, 20 bp, Artificial
  CRISPR gRNA sequence
gccacatggcctgctgcatg

SEQ ID NO: 52648 - DNA, 20 bp, Artificial
  CRISPR gRNA sequence
atggcctgctgcatgcagcc

SEQ ID NO: 52649 - DNA, 20 bp, Artificial
  CRISPR gRNA sequence
tggcctgctgcatgcagcct

SEQ ID NO: 52650 - DNA, 20 bp, Artificial
  CRISPR gRNA sequence
ctgctgcatgcagcctagga

SEQ ID NO: 52651 - DNA, 20 bp, Artificial
  CRISPR gRNA sequence
gcctaggatggctttgaata

SEQ ID NO: 52652 - DNA, 20 bp, Artificial
  CRISPR gRNA sequence
aaactttcttaaaacactat

SEQ ID NO: 52653 - DNA, 20 bp, Artificial
  CRISPR gRNA sequence
aacactatgagatttttctt

SEQ ID NO: 52654 - DNA, 20 bp, Artificial
  CRISPR gRNA sequence
cactatgagatttttctttg

SEQ ID NO: 52655 - DNA, 20 bp, Artificial
  CRISPR gRNA sequence
ggagttttgttttttttttt

SEQ ID NO: 52656 - DNA, 20 bp, Artificial
  CRISPR gRNA sequence
gttttttttttttagcacat

SEQ ID NO: 52657 - DNA, 20 bp, Artificial
  CRISPR gRNA sequence
tttagcacatcagctatcgc

SEQ ID NO: 52658 - DNA, 20 bp, Artificial
  CRISPR gRNA sequence
acatcagctatcgctagtgt

SEQ ID NO: 52659 - DNA, 20 bp, Artificial
  CRISPR gRNA sequence
gtgttagtgtattttatgtg

SEQ ID NO: 52660 - DNA, 20 bp, Artificial
  CRISPR gRNA sequence
gtgtattttatgtgtggccc

SEQ ID NO: 52661 - DNA, 20 bp, Artificial
  CRISPR gRNA sequence
ttctttttcttcttccaatg

SEQ ID NO: 52662 - DNA, 20 bp, Artificial
  CRISPR gRNA sequence
tttcttcttccaatgtggcc

SEQ ID NO: 52663 - DNA, 20 bp, Artificial
  CRISPR gRNA sequence
ttcttcttccaatgtggccc

SEQ ID NO: 52664 - DNA, 20 bp, Artificial
  CRISPR gRNA sequence
tcttcttccaatgtggccca

SEQ ID NO: 52665 - DNA, 20 bp, Artificial
  CRISPR gRNA sequence
tcttccaatgtggcccaggg

SEQ ID NO: 52666 - DNA, 20 bp, Artificial
  CRISPR gRNA sequence
atgtggcccagggaagccaa

SEQ ID NO: 52667 - DNA, 20 bp, Artificial
  CRISPR gRNA sequence
gcccagggaagccaaaagat

SEQ ID NO: 52668 - DNA, 20 bp, Artificial
  CRISPR gRNA sequence
aagattggacacccttgatc

SEQ ID NO: 52669 - DNA, 20 bp, Artificial
  CRISPR gRNA sequence
gacacccttgatctagactc

SEQ ID NO: 52670 - DNA, 20 bp, Artificial
  CRISPR gRNA sequence
acccttgatctagactctag

SEQ ID NO: 52671 - DNA, 20 bp, Artificial
  CRISPR gRNA sequence
cccttgatctagactctaga

SEQ ID NO: 52672 - DNA, 20 bp, Artificial
  CRISPR gRNA sequence
ccttgatctagactctagaa

SEQ ID NO: 52673 - DNA, 20 bp, Artificial
  CRISPR gRNA sequence
atctagactctagaagggtg

SEQ ID NO: 52674 - DNA, 20 bp, Artificial
  CRISPR gRNA sequence
tagactctagaagggtgtgg

SEQ ID NO: 52675 - DNA, 20 bp, Artificial
  CRISPR gRNA sequence
gactctagaagggtgtggtg

SEQ ID NO: 52676 - DNA, 20 bp, Artificial
  CRISPR gRNA sequence
gggtgtggtggagtaacttg

SEQ ID NO: 52677 - DNA, 20 bp, Artificial
  CRISPR gRNA sequence
ttgcagctcgtcccgtactg

SEQ ID NO: 52678 - DNA, 20 bp, Artificial
  CRISPR gRNA sequence
cgtcccgtactgtggcaatt

SEQ ID NO: 52679 - DNA, 20 bp, Artificial
  CRISPR gRNA sequence
ctgtggcaatttagtattaa

SEQ ID NO: 52680 - DNA, 20 bp, Artificial
  CRISPR gRNA sequence
tgtggcaatttagtattaaa

SEQ ID NO: 52681 - DNA, 20 bp, Artificial
  CRISPR gRNA sequence
aatttagtattaaaaggcat

SEQ ID NO: 52682 - DNA, 20 bp, Artificial
  CRISPR gRNA sequence
cagtatatactctgtgaaaa

SEQ ID NO: 52683 - DNA, 20 bp, Artificial
  CRISPR gRNA sequence
agtatatactctgtgaaaac

SEQ ID NO: 52684 - DNA, 20 bp, Artificial
  CRISPR gRNA sequence
tatactctgtgaaaacaggt

SEQ ID NO: 52685 - DNA, 20 bp, Artificial
  CRISPR gRNA sequence
tactctgtgaaaacaggtaa

SEQ ID NO: 52686 - DNA, 20 bp, Artificial
  CRISPR gRNA sequence
gaaaacaggtaagagacaat

SEQ ID NO: 52687 - DNA, 20 bp, Artificial
  CRISPR gRNA sequence
aaaacaggtaagagacaatc

SEQ ID NO: 52688 - DNA, 20 bp, Artificial
  CRISPR gRNA sequence
aaacaggtaagagacaatca

SEQ ID NO: 52689 - DNA, 20 bp, Artificial
  CRISPR gRNA sequence
aatcagggaccactgaccat

SEQ ID NO: 52690 - DNA, 20 bp, Artificial
  CRISPR gRNA sequence
actgaccattggttgacttt

SEQ ID NO: 52691 - DNA, 20 bp, Artificial
  CRISPR gRNA sequence
ctgaccattggttgacttta

SEQ ID NO: 52692 - DNA, 20 bp, Artificial
  CRISPR gRNA sequence
ctttaaggaattgccattaa

SEQ ID NO: 52693 - DNA, 20 bp, Artificial
  CRISPR gRNA sequence
tttaaggaattgccattaat

SEQ ID NO: 52694 - DNA, 20 bp, Artificial
  CRISPR gRNA sequence
ttaaggaattgccattaata

SEQ ID NO: 52695 - DNA, 20 bp, Artificial
  CRISPR gRNA sequence
aggaattgccattaataggg

SEQ ID NO: 52696 - DNA, 20 bp, Artificial
  CRISPR gRNA sequence
ggaattgccattaatagggt

SEQ ID NO: 52697 - DNA, 20 bp, Artificial
  CRISPR gRNA sequence
tgccattaatagggtaggtc

SEQ ID NO: 52698 - DNA, 20 bp, Artificial
  CRISPR gRNA sequence
gccattaatagggtaggtct

SEQ ID NO: 52699 - DNA, 20 bp, Artificial
  CRISPR gRNA sequence
ttaatagggtaggtctgggc

SEQ ID NO: 52700 - DNA, 20 bp, Artificial
  CRISPR gRNA sequence
taatagggtaggtctgggcc

SEQ ID NO: 52701 - DNA, 20 bp, Artificial
  CRISPR gRNA sequence
gggtaggtctgggccaggtg

SEQ ID NO: 52702 - DNA, 20 bp, Artificial
  CRISPR gRNA sequence
taggtctgggccaggtgcag

SEQ ID NO: 52703 - DNA, 20 bp, Artificial
  CRISPR gRNA sequence
tgggccaggtgcagtggctc

SEQ ID NO: 52704 - DNA, 20 bp, Artificial
  CRISPR gRNA sequence
agcctgtaatcccaacactt

SEQ ID NO: 52705 - DNA, 20 bp, Artificial
  CRISPR gRNA sequence
gcctgtaatcccaacacttt

SEQ ID NO: 52706 - DNA, 20 bp, Artificial
  CRISPR gRNA sequence
ctgtaatcccaacactttgg

SEQ ID NO: 52707 - DNA, 20 bp, Artificial
  CRISPR gRNA sequence
tgtaatcccaacactttggg

SEQ ID NO: 52708 - DNA, 20 bp, Artificial
  CRISPR gRNA sequence
tcccaacactttgggaggct

SEQ ID NO: 52709 - DNA, 20 bp, Artificial
  CRISPR gRNA sequence
cccaacactttgggaggctg

SEQ ID NO: 52710 - DNA, 20 bp, Artificial
  CRISPR gRNA sequence
aacactttgggaggctgagg

SEQ ID NO: 52711 - DNA, 20 bp, Artificial
  CRISPR gRNA sequence
acactttgggaggctgagga

SEQ ID NO: 52712 - DNA, 20 bp, Artificial
  CRISPR gRNA sequence
ctttgggaggctgaggaagg

SEQ ID NO: 52713 - DNA, 20 bp, Artificial
  CRISPR gRNA sequence
ctgaggaaggtggatcactt

SEQ ID NO: 52714 - DNA, 20 bp, Artificial
  CRISPR gRNA sequence
tgaggaaggtggatcacttg

SEQ ID NO: 52715 - DNA, 20 bp, Artificial
  CRISPR gRNA sequence
gaaggtggatcacttgaggt

SEQ ID NO: 52716 - DNA, 20 bp, Artificial
  CRISPR gRNA sequence
aaggtggatcacttgaggtc

SEQ ID NO: 52717 - DNA, 20 bp, Artificial
  CRISPR gRNA sequence
ggtggatcacttgaggtcag

SEQ ID NO: 52718 - DNA, 20 bp, Artificial
  CRISPR gRNA sequence
tcacttgaggtcaggagttc

SEQ ID NO: 52719 - DNA, 20 bp, Artificial
  CRISPR gRNA sequence
tgaggtcaggagttcgagac

SEQ ID NO: 52720 - DNA, 20 bp, Artificial
  CRISPR gRNA sequence
tcaggagttcgagaccagcc

SEQ ID NO: 52721 - DNA, 20 bp, Artificial
  CRISPR gRNA sequence
cgagaccagcctggccaaca

SEQ ID NO: 52722 - DNA, 20 bp, Artificial
  CRISPR gRNA sequence
tctactaaaaatacaaaaat

SEQ ID NO: 52723 - DNA, 20 bp, Artificial
  CRISPR gRNA sequence
ctaaaaatacaaaaattagc

SEQ ID NO: 52724 - DNA, 20 bp, Artificial
  CRISPR gRNA sequence
taaaaatacaaaaattagcc

SEQ ID NO: 52725 - DNA, 20 bp, Artificial
  CRISPR gRNA sequence
caaaaattagccaggcatga

SEQ ID NO: 52726 - DNA, 20 bp, Artificial
  CRISPR gRNA sequence
aaattagccaggcatgatgg

SEQ ID NO: 52727 - DNA, 20 bp, Artificial
  CRISPR gRNA sequence
aattagccaggcatgatggc

SEQ ID NO: 52728 - DNA, 20 bp, Artificial
  CRISPR gRNA sequence
atggcgggcgcctgtaatcc

SEQ ID NO: 52729 - DNA, 20 bp, Artificial
  CRISPR gRNA sequence
cgcctgtaatcccagctact

SEQ ID NO: 52730 - DNA, 20 bp, Artificial
  CRISPR gRNA sequence
gcctgtaatcccagctactc

SEQ ID NO: 52731 - DNA, 20 bp, Artificial
  CRISPR gRNA sequence
ctgtaatcccagctactcag

SEQ ID NO: 52732 - DNA, 20 bp, Artificial
  CRISPR gRNA sequence
tgtaatcccagctactcagg

SEQ ID NO: 52733 - DNA, 20 bp, Artificial
  CRISPR gRNA sequence
tcccagctactcaggaggct

SEQ ID NO: 52734 - DNA, 20 bp, Artificial
  CRISPR gRNA sequence
cccagctactcaggaggctg

SEQ ID NO: 52735 - DNA, 20 bp, Artificial
  CRISPR gRNA sequence
agctactcaggaggctgagg

SEQ ID NO: 52736 - DNA, 20 bp, Artificial
  CRISPR gRNA sequence
gctactcaggaggctgaggc

SEQ ID NO: 52737 - DNA, 20 bp, Artificial
  CRISPR gRNA sequence
tactcaggaggctgaggcag

SEQ ID NO: 52738 - DNA, 20 bp, Artificial
  CRISPR gRNA sequence
gcaggagaattgcttgaacc

SEQ ID NO: 52739 - DNA, 20 bp, Artificial
  CRISPR gRNA sequence
caggagaattgcttgaaccc

SEQ ID NO: 52740 - DNA, 20 bp, Artificial
  CRISPR gRNA sequence
ggagaattgcttgaacccag

SEQ ID NO: 52741 - DNA, 20 bp, Artificial
  CRISPR gRNA sequence
gagaattgcttgaacccagg

SEQ ID NO: 52742 - DNA, 20 bp, Artificial
  CRISPR gRNA sequence
aattgcttgaacccaggagg

SEQ ID NO: 52743 - DNA, 20 bp, Artificial
  CRISPR gRNA sequence
ttgcttgaacccaggaggca

SEQ ID NO: 52744 - DNA, 20 bp, Artificial
  CRISPR gRNA sequence
tgcttgaacccaggaggcag

SEQ ID NO: 52745 - DNA, 20 bp, Artificial
  CRISPR gRNA sequence
ttgaacccaggaggcagagg

SEQ ID NO: 52746 - DNA, 20 bp, Artificial
  CRISPR gRNA sequence
aacccaggaggcagaggtgg

SEQ ID NO: 52747 - DNA, 20 bp, Artificial
  CRISPR gRNA sequence
caggaggcagaggtggcagc

SEQ ID NO: 52748 - DNA, 20 bp, Artificial
  CRISPR gRNA sequence
ggcagaggtggcagcaagcc

SEQ ID NO: 52749 - DNA, 20 bp, Artificial
  CRISPR gRNA sequence
gagatcacgccattgcactc

SEQ ID NO: 52750 - DNA, 20 bp, Artificial
  CRISPR gRNA sequence
cacgccattgcactccagcc

SEQ ID NO: 52751 - DNA, 20 bp, Artificial
  CRISPR gRNA sequence
acgccattgcactccagcct

SEQ ID NO: 52752 - DNA, 20 bp, Artificial
  CRISPR gRNA sequence
tgcactccagcctgggcaac

SEQ ID NO: 52753 - DNA, 20 bp, Artificial
  CRISPR gRNA sequence
cactccagcctgggcaacaa

SEQ ID NO: 52754 - DNA, 20 bp, Artificial
  CRISPR gRNA sequence
acaagagcaaaactctgtct

SEQ ID NO: 52755 - DNA, 20 bp, Artificial
  CRISPR gRNA sequence
tctgtctcagaaaaaaaaaa

SEQ ID NO: 52756 - DNA, 20 bp, Artificial
  CRISPR gRNA sequence
ctcagaaaaaaaaaatagtg

SEQ ID NO: 52757 - DNA, 20 bp, Artificial
  CRISPR gRNA sequence
tcagaaaaaaaaaatagtgt

SEQ ID NO: 52758 - DNA, 20 bp, Artificial
  CRISPR gRNA sequence
aaatagtgtaggtctgataa

SEQ ID NO: 52759 - DNA, 20 bp, Artificial
  CRISPR gRNA sequence
taggtctgataatggttttg

SEQ ID NO: 52760 - DNA, 20 bp, Artificial
  CRISPR gRNA sequence
tgtggttatatgtttgaacc

SEQ ID NO: 52761 - DNA, 20 bp, Artificial
  CRISPR gRNA sequence
tggttatatgtttgaacctg

SEQ ID NO: 52762 - DNA, 20 bp, Artificial
  CRISPR gRNA sequence
ttatatgtttgaacctggag

SEQ ID NO: 52763 - DNA, 20 bp, Artificial
  CRISPR gRNA sequence
tatatgtttgaacctggaga

SEQ ID NO: 52764 - DNA, 20 bp, Artificial
  CRISPR gRNA sequence
tttgaacctggagaaggaca

SEQ ID NO: 52765 - DNA, 20 bp, Artificial
  CRISPR gRNA sequence
ttgaacctggagaaggacat

SEQ ID NO: 52766 - DNA, 20 bp, Artificial
  CRISPR gRNA sequence
aacctggagaaggacatggg

SEQ ID NO: 52767 - DNA, 20 bp, Artificial
  CRISPR gRNA sequence
acctggagaaggacatggga

SEQ ID NO: 52768 - DNA, 20 bp, Artificial
  CRISPR gRNA sequence
gacatgggaaggccacactc

SEQ ID NO: 52769 - DNA, 20 bp, Artificial
  CRISPR gRNA sequence
acatgggaaggccacactcc

SEQ ID NO: 52770 - DNA, 20 bp, Artificial
  CRISPR gRNA sequence
catgggaaggccacactcca

SEQ ID NO: 52771 - DNA, 20 bp, Artificial
  CRISPR gRNA sequence
atgggaaggccacactccag

SEQ ID NO: 52772 - DNA, 20 bp, Artificial
  CRISPR gRNA sequence
tgggaaggccacactccagg

SEQ ID NO: 52773 - DNA, 20 bp, Artificial
  CRISPR gRNA sequence
cacactccagggggtcaaac

SEQ ID NO: 52774 - DNA, 20 bp, Artificial
  CRISPR gRNA sequence
gggggtcaaaccggattatc

SEQ ID NO: 52775 - DNA, 20 bp, Artificial
  CRISPR gRNA sequence
gtcaaaccggattatctggt

SEQ ID NO: 52776 - DNA, 20 bp, Artificial
  CRISPR gRNA sequence
aaaccggattatctggttgg

SEQ ID NO: 52777 - DNA, 20 bp, Artificial
  CRISPR gRNA sequence
aaccggattatctggttgga

SEQ ID NO: 52778 - DNA, 20 bp, Artificial
  CRISPR gRNA sequence
accggattatctggttggaa

SEQ ID NO: 52779 - DNA, 20 bp, Artificial
  CRISPR gRNA sequence
gattatctggttggaagggc

SEQ ID NO: 52780 - DNA, 20 bp, Artificial
  CRISPR gRNA sequence
tatctggttggaagggctgg

SEQ ID NO: 52781 - DNA, 20 bp, Artificial
  CRISPR gRNA sequence
atctggttggaagggctgga

SEQ ID NO: 52782 - DNA, 20 bp, Artificial
  CRISPR gRNA sequence
tctggttggaagggctggaa

SEQ ID NO: 52783 - DNA, 20 bp, Artificial
  CRISPR gRNA sequence
gaagggctggaagggcattt

SEQ ID NO: 52784 - DNA, 20 bp, Artificial
  CRISPR gRNA sequence
ggctggaagggcatttgaga

SEQ ID NO: 52785 - DNA, 20 bp, Artificial
  CRISPR gRNA sequence
gctggaagggcatttgagat

SEQ ID NO: 52786 - DNA, 20 bp, Artificial
  CRISPR gRNA sequence
ctggaagggcatttgagatg

SEQ ID NO: 52787 - DNA, 20 bp, Artificial
  CRISPR gRNA sequence
tggaagggcatttgagatgg

SEQ ID NO: 52788 - DNA, 20 bp, Artificial
  CRISPR gRNA sequence
agggcatttgagatgggggc

SEQ ID NO: 52789 - DNA, 20 bp, Artificial
  CRISPR gRNA sequence
catttgagatgggggctaga

SEQ ID NO: 52790 - DNA, 20 bp, Artificial
  CRISPR gRNA sequence
tgagatgggggctagaaagc

SEQ ID NO: 52791 - DNA, 20 bp, Artificial
  CRISPR gRNA sequence
ggggctagaaagcaagaaaa

SEQ ID NO: 52792 - DNA, 20 bp, Artificial
  CRISPR gRNA sequence
gaaagcaagaaaaaagactg

SEQ ID NO: 52793 - DNA, 20 bp, Artificial
  CRISPR gRNA sequence
gaaaaaagactgaagcaaaa

SEQ ID NO: 52794 - DNA, 20 bp, Artificial
  CRISPR gRNA sequence
ctgaagcaaaatggaaaaca

SEQ ID NO: 52795 - DNA, 20 bp, Artificial
  CRISPR gRNA sequence
acacagatgctatgaaaaca

SEQ ID NO: 52796 - DNA, 20 bp, Artificial
  CRISPR gRNA sequence
gaaaacacagtgcatgaaac

SEQ ID NO: 52797 - DNA, 20 bp, Artificial
  CRISPR gRNA sequence
aactagtttatgactgcaaa

SEQ ID NO: 52798 - DNA, 20 bp, Artificial
  CRISPR gRNA sequence
actagtttatgactgcaaac

SEQ ID NO: 52799 - DNA, 20 bp, Artificial
  CRISPR gRNA sequence
agtttatgactgcaaacagg

SEQ ID NO: 52800 - DNA, 20 bp, Artificial
  CRISPR gRNA sequence
gtagaaactgaatatgcaaa

SEQ ID NO: 52801 - DNA, 20 bp, Artificial
  CRISPR gRNA sequence
tagaaactgaatatgcaaat

SEQ ID NO: 52802 - DNA, 20 bp, Artificial
  CRISPR gRNA sequence
aactgaatatgcaaataggc

SEQ ID NO: 52803 - DNA, 20 bp, Artificial
  CRISPR gRNA sequence
actgaatatgcaaataggca

SEQ ID NO: 52804 - DNA, 20 bp, Artificial
  CRISPR gRNA sequence
tgaatatgcaaataggcaag

SEQ ID NO: 52805 - DNA, 20 bp, Artificial
  CRISPR gRNA sequence
atatgcaaataggcaaggag

SEQ ID NO: 52806 - DNA, 20 bp, Artificial
  CRISPR gRNA sequence
gcaaataggcaaggagtaga

SEQ ID NO: 52807 - DNA, 20 bp, Artificial
  CRISPR gRNA sequence
gcaaggagtagacagtcctg

SEQ ID NO: 52808 - DNA, 20 bp, Artificial
  CRISPR gRNA sequence
cctgtggacacatgacaaca

SEQ ID NO: 52809 - DNA, 20 bp, Artificial
  CRISPR gRNA sequence
catgacaacatggatttgat

SEQ ID NO: 52810 - DNA, 20 bp, Artificial
  CRISPR gRNA sequence
tgacaacatggatttgatga

SEQ ID NO: 52811 - DNA, 20 bp, Artificial
  CRISPR gRNA sequence
caacatggatttgatgagag

SEQ ID NO: 52812 - DNA, 20 bp, Artificial
  CRISPR gRNA sequence
acatggatttgatgagagaa

SEQ ID NO: 52813 - DNA, 20 bp, Artificial
  CRISPR gRNA sequence
catggatttgatgagagaag

SEQ ID NO: 52814 - DNA, 20 bp, Artificial
  CRISPR gRNA sequence
tgatgagagaagaggttgtt

SEQ ID NO: 52815 - DNA, 20 bp, Artificial
  CRISPR gRNA sequence
gatgagagaagaggttgttt

SEQ ID NO: 52816 - DNA, 20 bp, Artificial
  CRISPR gRNA sequence
agagaagaggttgtttaggt

SEQ ID NO: 52817 - DNA, 20 bp, Artificial
  CRISPR gRNA sequence
gagaagaggttgtttaggtg

SEQ ID NO: 52818 - DNA, 20 bp, Artificial
  CRISPR gRNA sequence
aagaggttgtttaggtgagg

SEQ ID NO: 52819 - DNA, 20 bp, Artificial
  CRISPR gRNA sequence
agaggttgtttaggtgaggc

SEQ ID NO: 52820 - DNA, 20 bp, Artificial
  CRISPR gRNA sequence
aggtgaggcaggttttgtct

SEQ ID NO: 52821 - DNA, 20 bp, Artificial
  CRISPR gRNA sequence
gtcttggatttctttatttt

SEQ ID NO: 52822 - DNA, 20 bp, Artificial
  CRISPR gRNA sequence
tcttggatttctttatttta

SEQ ID NO: 52823 - DNA, 20 bp, Artificial
  CRISPR gRNA sequence
ttttaaggtaattactataa

SEQ ID NO: 52824 - DNA, 20 bp, Artificial
  CRISPR gRNA sequence
aatcaccacaatgacaataa

SEQ ID NO: 52825 - DNA, 20 bp, Artificial
  CRISPR gRNA sequence
atcaccacaatgacaataaa

SEQ ID NO: 52826 - DNA, 20 bp, Artificial
  CRISPR gRNA sequence
ccacaatgacaataaaagga

SEQ ID NO: 52827 - DNA, 20 bp, Artificial
  CRISPR gRNA sequence
cacaatgacaataaaaggaa

SEQ ID NO: 52828 - DNA, 20 bp, Artificial
  CRISPR gRNA sequence
aaggctgaccatccactgtg

SEQ ID NO: 52829 - DNA, 20 bp, Artificial
  CRISPR gRNA sequence
gaccatccactgtgcagatg

SEQ ID NO: 52830 - DNA, 20 bp, Artificial
  CRISPR gRNA sequence
catccactgtgcagatgaag

SEQ ID NO: 52831 - DNA, 20 bp, Artificial
  CRISPR gRNA sequence
actgtgcagatgaagaagct

SEQ ID NO: 52832 - DNA, 20 bp, Artificial
  CRISPR gRNA sequence
ctgtgcagatgaagaagctg

SEQ ID NO: 52833 - DNA, 20 bp, Artificial
  CRISPR gRNA sequence
cagatgaagaagctgaggcc

SEQ ID NO: 52834 - DNA, 20 bp, Artificial
  CRISPR gRNA sequence
agatgaagaagctgaggccc

SEQ ID NO: 52835 - DNA, 20 bp, Artificial
  CRISPR gRNA sequence
gatgaagaagctgaggcccg

SEQ ID NO: 52836 - DNA, 20 bp, Artificial
  CRISPR gRNA sequence
tgaagaagctgaggcccggg

SEQ ID NO: 52837 - DNA, 20 bp, Artificial
  CRISPR gRNA sequence
cggggagttaaatccctttt

SEQ ID NO: 52838 - DNA, 20 bp, Artificial
  CRISPR gRNA sequence
agttaaatcccttttgagcc

SEQ ID NO: 52839 - DNA, 20 bp, Artificial
  CRISPR gRNA sequence
ttaaatcccttttgagccaa

SEQ ID NO: 52840 - DNA, 20 bp, Artificial
  CRISPR gRNA sequence
tgagccaagagtcctgattc

SEQ ID NO: 52841 - DNA, 20 bp, Artificial
  CRISPR gRNA sequence
gagccaagagtcctgattcc

SEQ ID NO: 52842 - DNA, 20 bp, Artificial
  CRISPR gRNA sequence
aagagtcctgattccaggtc

SEQ ID NO: 52843 - DNA, 20 bp, Artificial
  CRISPR gRNA sequence
ctgattccaggtccagtctc

SEQ ID NO: 52844 - DNA, 20 bp, Artificial
  CRISPR gRNA sequence
ccaggtccagtctctggtta

SEQ ID NO: 52845 - DNA, 20 bp, Artificial
  CRISPR gRNA sequence
ccagtctctggttacagacc

SEQ ID NO: 52846 - DNA, 20 bp, Artificial
  CRISPR gRNA sequence
ggttacagacccagatgttc

SEQ ID NO: 52847 - DNA, 20 bp, Artificial
  CRISPR gRNA sequence
gttacagacccagatgttct

SEQ ID NO: 52848 - DNA, 20 bp, Artificial
  CRISPR gRNA sequence
ttacagacccagatgttctg

SEQ ID NO: 52849 - DNA, 20 bp, Artificial
  CRISPR gRNA sequence
agacccagatgttctggggc

SEQ ID NO: 52850 - DNA, 20 bp, Artificial
  CRISPR gRNA sequence
ccagatgttctggggcgagt

SEQ ID NO: 52851 - DNA, 20 bp, Artificial
  CRISPR gRNA sequence
cagatgttctggggcgagtg

SEQ ID NO: 52852 - DNA, 20 bp, Artificial
  CRISPR gRNA sequence
atgttctggggcgagtgagg

SEQ ID NO: 52853 - DNA, 20 bp, Artificial
  CRISPR gRNA sequence
gcgagtgaggtggtaacccc

SEQ ID NO: 52854 - DNA, 20 bp, Artificial
  CRISPR gRNA sequence
cgagtgaggtggtaacccca

SEQ ID NO: 52855 - DNA, 20 bp, Artificial
  CRISPR gRNA sequence
agtgaggtggtaaccccaag

SEQ ID NO: 52856 - DNA, 20 bp, Artificial
  CRISPR gRNA sequence
tgaggtggtaaccccaagga

SEQ ID NO: 52857 - DNA, 20 bp, Artificial
  CRISPR gRNA sequence
ggtggtaaccccaaggagag

SEQ ID NO: 52858 - DNA, 20 bp, Artificial
  CRISPR gRNA sequence
gtggtaaccccaaggagagt

SEQ ID NO: 52859 - DNA, 20 bp, Artificial
  CRISPR gRNA sequence
tggtaaccccaaggagagtg

SEQ ID NO: 52860 - DNA, 20 bp, Artificial
  CRISPR gRNA sequence
ggtaaccccaaggagagtgg

SEQ ID NO: 52861 - DNA, 20 bp, Artificial
  CRISPR gRNA sequence
aaggagagtgggggtgcctt

SEQ ID NO: 52862 - DNA, 20 bp, Artificial
  CRISPR gRNA sequence
aggagagtgggggtgccttg

SEQ ID NO: 52863 - DNA, 20 bp, Artificial
  CRISPR gRNA sequence
agagtgggggtgccttgagg

SEQ ID NO: 52864 - DNA, 20 bp, Artificial
  CRISPR gRNA sequence
gagtgggggtgccttgagga

SEQ ID NO: 52865 - DNA, 20 bp, Artificial
  CRISPR gRNA sequence
agtgggggtgccttgaggaa

SEQ ID NO: 52866 - DNA, 20 bp, Artificial
  CRISPR gRNA sequence
gtgccttgaggaagggcttt

SEQ ID NO: 52867 - DNA, 20 bp, Artificial
  CRISPR gRNA sequence
ccttgaggaagggctttcag

SEQ ID NO: 52868 - DNA, 20 bp, Artificial
  CRISPR gRNA sequence
ctttcagaagtgctacgctc

SEQ ID NO: 52869 - DNA, 20 bp, Artificial
  CRISPR gRNA sequence
agtgctacgctccagccatg

SEQ ID NO: 52870 - DNA, 20 bp, Artificial
  CRISPR gRNA sequence
gtgctacgctccagccatgc

SEQ ID NO: 52871 - DNA, 20 bp, Artificial
  CRISPR gRNA sequence
ctacgctccagccatgcagg

SEQ ID NO: 52872 - DNA, 20 bp, Artificial
  CRISPR gRNA sequence
tacgctccagccatgcaggc

SEQ ID NO: 52873 - DNA, 20 bp, Artificial
  CRISPR gRNA sequence
ccagccatgcaggcaggttc

SEQ ID NO: 52874 - DNA, 20 bp, Artificial
  CRISPR gRNA sequence
gccatgcaggcaggttcaag

SEQ ID NO: 52875 - DNA, 20 bp, Artificial
  CRISPR gRNA sequence
ccatgcaggcaggttcaagt

SEQ ID NO: 52876 - DNA, 20 bp, Artificial
  CRISPR gRNA sequence
gcaggttcaagtgggtgccc

SEQ ID NO: 52877 - DNA, 20 bp, Artificial
  CRISPR gRNA sequence
gttcaagtgggtgccctggt

SEQ ID NO: 52878 - DNA, 20 bp, Artificial
  CRISPR gRNA sequence
ttcaagtgggtgccctggtg

SEQ ID NO: 52879 - DNA, 20 bp, Artificial
  CRISPR gRNA sequence
tgggtgccctggtgaggctc

SEQ ID NO: 52880 - DNA, 20 bp, Artificial
  CRISPR gRNA sequence
gggtgccctggtgaggctcc

SEQ ID NO: 52881 - DNA, 20 bp, Artificial
  CRISPR gRNA sequence
ggtgccctggtgaggctcca

SEQ ID NO: 52882 - DNA, 20 bp, Artificial
  CRISPR gRNA sequence
gtgccctggtgaggctccag

SEQ ID NO: 52883 - DNA, 20 bp, Artificial
  CRISPR gRNA sequence
ccctggtgaggctccagggg

SEQ ID NO: 52884 - DNA, 20 bp, Artificial
  CRISPR gRNA sequence
cctggtgaggctccaggggt

SEQ ID NO: 52885 - DNA, 20 bp, Artificial
  CRISPR gRNA sequence
ctggtgaggctccaggggtg

SEQ ID NO: 52886 - DNA, 20 bp, Artificial
  CRISPR gRNA sequence
tgaggctccaggggtggggt

SEQ ID NO: 52887 - DNA, 20 bp, Artificial
  CRISPR gRNA sequence
aggctccaggggtggggttg

SEQ ID NO: 52888 - DNA, 20 bp, Artificial
  CRISPR gRNA sequence
ggctccaggggtggggttgg

SEQ ID NO: 52889 - DNA, 20 bp, Artificial
  CRISPR gRNA sequence
tccaggggtggggttggagg

SEQ ID NO: 52890 - DNA, 20 bp, Artificial
  CRISPR gRNA sequence
ggggtggggttggaggtgga

SEQ ID NO: 52891 - DNA, 20 bp, Artificial
  CRISPR gRNA sequence
gggtggggttggaggtggac

SEQ ID NO: 52892 - DNA, 20 bp, Artificial
  CRISPR gRNA sequence
ggtggggttggaggtggaca

SEQ ID NO: 52893 - DNA, 20 bp, Artificial
  CRISPR gRNA sequence
ttggaggtggacagggctcc

SEQ ID NO: 52894 - DNA, 20 bp, Artificial
  CRISPR gRNA sequence
tggaggtggacagggctccc

SEQ ID NO: 52895 - DNA, 20 bp, Artificial
  CRISPR gRNA sequence
acagggctcccaggtgccct

SEQ ID NO: 52896 - DNA, 20 bp, Artificial
  CRISPR gRNA sequence
gctcccaggtgccctgagtt

SEQ ID NO: 52897 - DNA, 20 bp, Artificial
  CRISPR gRNA sequence
cccaggtgccctgagttgag

SEQ ID NO: 52898 - DNA, 20 bp, Artificial
  CRISPR gRNA sequence
ggtgccctgagttgagtgga

SEQ ID NO: 52899 - DNA, 20 bp, Artificial
  CRISPR gRNA sequence
cctgagttgagtggatggtg

SEQ ID NO: 52900 - DNA, 20 bp, Artificial
  CRISPR gRNA sequence
ctgagttgagtggatggtgc

SEQ ID NO: 52901 - DNA, 20 bp, Artificial
  CRISPR gRNA sequence
ttgagtggatggtgcaggtg

SEQ ID NO: 52902 - DNA, 20 bp, Artificial
  CRISPR gRNA sequence
tgagtggatggtgcaggtga

SEQ ID NO: 52903 - DNA, 20 bp, Artificial
  CRISPR gRNA sequence
ggtgcaggtgaaggcttccc

SEQ ID NO: 52904 - DNA, 20 bp, Artificial
  CRISPR gRNA sequence
aggtgaaggcttccccagtc

SEQ ID NO: 52905 - DNA, 20 bp, Artificial
  CRISPR gRNA sequence
aaggcttccccagtccagca

SEQ ID NO: 52906 - DNA, 20 bp, Artificial
  CRISPR gRNA sequence
cagtccagcacagcatctcc

SEQ ID NO: 52907 - DNA, 20 bp, Artificial
  CRISPR gRNA sequence
tccagcacagcatctcccag

SEQ ID NO: 52908 - DNA, 20 bp, Artificial
  CRISPR gRNA sequence
ccagcacagcatctcccagt

SEQ ID NO: 52909 - DNA, 20 bp, Artificial
  CRISPR gRNA sequence
agcacagcatctcccagtgg

SEQ ID NO: 52910 - DNA, 20 bp, Artificial
  CRISPR gRNA sequence
gtgggagacatgcgctgcct

SEQ ID NO: 52911 - DNA, 20 bp, Artificial
  CRISPR gRNA sequence
tgggagacatgcgctgccta

SEQ ID NO: 52912 - DNA, 20 bp, Artificial
  CRISPR gRNA sequence
agacatgcgctgcctaaggc

SEQ ID NO: 52913 - DNA, 20 bp, Artificial
  CRISPR gRNA sequence
gacatgcgctgcctaaggct

SEQ ID NO: 52914 - DNA, 20 bp, Artificial
  CRISPR gRNA sequence
acatgcgctgcctaaggctg

SEQ ID NO: 52915 - DNA, 20 bp, Artificial
  CRISPR gRNA sequence
catgcgctgcctaaggctgg

SEQ ID NO: 52916 - DNA, 20 bp, Artificial
  CRISPR gRNA sequence
gcctaaggctgggggctgcc

SEQ ID NO: 52917 - DNA, 20 bp, Artificial
  CRISPR gRNA sequence
ctaaggctgggggctgccga

SEQ ID NO: 52918 - DNA, 20 bp, Artificial
  CRISPR gRNA sequence
ggctgggggctgccgagaga

SEQ ID NO: 52919 - DNA, 20 bp, Artificial
  CRISPR gRNA sequence
ggggctgccgagagacagcc

SEQ ID NO: 52920 - DNA, 20 bp, Artificial
  CRISPR gRNA sequence
agacagccaagtttctacca

SEQ ID NO: 52921 - DNA, 20 bp, Artificial
  CRISPR gRNA sequence
gacagccaagtttctaccaa

SEQ ID NO: 52922 - DNA, 20 bp, Artificial
  CRISPR gRNA sequence
gccaagtttctaccaaaggc

SEQ ID NO: 52923 - DNA, 20 bp, Artificial
  CRISPR gRNA sequence
ccaagtttctaccaaaggcc

SEQ ID NO: 52924 - DNA, 20 bp, Artificial
  CRISPR gRNA sequence
caagtttctaccaaaggcca

SEQ ID NO: 52925 - DNA, 20 bp, Artificial
  CRISPR gRNA sequence
aagtttctaccaaaggccag

SEQ ID NO: 52926 - DNA, 20 bp, Artificial
  CRISPR gRNA sequence
caaaggccaggggactctca

SEQ ID NO: 52927 - DNA, 20 bp, Artificial
  CRISPR gRNA sequence
aaaggccaggggactctcat

SEQ ID NO: 52928 - DNA, 20 bp, Artificial
  CRISPR gRNA sequence
aaggccaggggactctcatg

SEQ ID NO: 52929 - DNA, 20 bp, Artificial
  CRISPR gRNA sequence
gccaggggactctcatgggg

SEQ ID NO: 52930 - DNA, 20 bp, Artificial
  CRISPR gRNA sequence
ccaggggactctcatggggc

SEQ ID NO: 52931 - DNA, 20 bp, Artificial
  CRISPR gRNA sequence
caggggactctcatggggca

SEQ ID NO: 52932 - DNA, 20 bp, Artificial
  CRISPR gRNA sequence
ggactctcatggggcagggc

SEQ ID NO: 52933 - DNA, 20 bp, Artificial
  CRISPR gRNA sequence
ctctcatggggcagggctgg

SEQ ID NO: 52934 - DNA, 20 bp, Artificial
  CRISPR gRNA sequence
tctcatggggcagggctggt

SEQ ID NO: 52935 - DNA, 20 bp, Artificial
  CRISPR gRNA sequence
catggggcagggctggtggg

SEQ ID NO: 52936 - DNA, 20 bp, Artificial
  CRISPR gRNA sequence
agggctggtgggaagaaatc

SEQ ID NO: 52937 - DNA, 20 bp, Artificial
  CRISPR gRNA sequence
ctggtgggaagaaatcgaga

SEQ ID NO: 52938 - DNA, 20 bp, Artificial
  CRISPR gRNA sequence
gactcacctgtcttctaacc

SEQ ID NO: 52939 - DNA, 20 bp, Artificial
  CRISPR gRNA sequence
tcacctgtcttctaaccaag

SEQ ID NO: 52940 - DNA, 20 bp, Artificial
  CRISPR gRNA sequence
ctaaccaagaagccccctcc

SEQ ID NO: 52941 - DNA, 20 bp, Artificial
  CRISPR gRNA sequence
taaccaagaagccccctccc

SEQ ID NO: 52942 - DNA, 20 bp, Artificial
  CRISPR gRNA sequence
gaagccccctcccaggtcac

SEQ ID NO: 52943 - DNA, 20 bp, Artificial
  CRISPR gRNA sequence
aagccccctcccaggtcact

SEQ ID NO: 52944 - DNA, 20 bp, Artificial
  CRISPR gRNA sequence
ccccctcccaggtcactggg

SEQ ID NO: 52945 - DNA, 20 bp, Artificial
  CRISPR gRNA sequence
tcactgggcagatccccaca

SEQ ID NO: 52946 - DNA, 20 bp, Artificial
  CRISPR gRNA sequence
gatccccacatggtgccctc

SEQ ID NO: 52947 - DNA, 20 bp, Artificial
  CRISPR gRNA sequence
atccccacatggtgccctct

SEQ ID NO: 52948 - DNA, 20 bp, Artificial
  CRISPR gRNA sequence
tccccacatggtgccctctg

SEQ ID NO: 52949 - DNA, 20 bp, Artificial
  CRISPR gRNA sequence
tgtgtcctcgttacttactg

SEQ ID NO: 52950 - DNA, 20 bp, Artificial
  CRISPR gRNA sequence
ctcgttacttactgcagttc

SEQ ID NO: 52951 - DNA, 20 bp, Artificial
  CRISPR gRNA sequence
tcgttacttactgcagttcc

SEQ ID NO: 52952 - DNA, 20 bp, Artificial
  CRISPR gRNA sequence
cgttacttactgcagttcca

SEQ ID NO: 52953 - DNA, 20 bp, Artificial
  CRISPR gRNA sequence
gttacttactgcagttccag

SEQ ID NO: 52954 - DNA, 20 bp, Artificial
  CRISPR gRNA sequence
tactgcagttccaggggtcc

SEQ ID NO: 52955 - DNA, 20 bp, Artificial
  CRISPR gRNA sequence
actgcagttccaggggtccc

SEQ ID NO: 52956 - DNA, 20 bp, Artificial
  CRISPR gRNA sequence
gcagttccaggggtcccggg

SEQ ID NO: 52957 - DNA, 20 bp, Artificial
  CRISPR gRNA sequence
aggggtcccgggcagtcctt

SEQ ID NO: 52958 - DNA, 20 bp, Artificial
  CRISPR gRNA sequence
gggtcccgggcagtccttca

SEQ ID NO: 52959 - DNA, 20 bp, Artificial
  CRISPR gRNA sequence
tcccgggcagtccttcagag

SEQ ID NO: 52960 - DNA, 20 bp, Artificial
  CRISPR gRNA sequence
ggcagtccttcagagtggca

SEQ ID NO: 52961 - DNA, 20 bp, Artificial
  CRISPR gRNA sequence
cagtccttcagagtggcaca

SEQ ID NO: 52962 - DNA, 20 bp, Artificial
  CRISPR gRNA sequence
agtccttcagagtggcacag

SEQ ID NO: 52963 - DNA, 20 bp, Artificial
  CRISPR gRNA sequence
ccttcagagtggcacagagg

SEQ ID NO: 52964 - DNA, 20 bp, Artificial
  CRISPR gRNA sequence
cttcagagtggcacagaggc

SEQ ID NO: 52965 - DNA, 20 bp, Artificial
  CRISPR gRNA sequence
agagtggcacagaggcgggt

SEQ ID NO: 52966 - DNA, 20 bp, Artificial
  CRISPR gRNA sequence
gagtggcacagaggcgggtg

SEQ ID NO: 52967 - DNA, 20 bp, Artificial
  CRISPR gRNA sequence
gcacagaggcgggtgaggct

SEQ ID NO: 52968 - DNA, 20 bp, Artificial
  CRISPR gRNA sequence
cacagaggcgggtgaggctt

SEQ ID NO: 52969 - DNA, 20 bp, Artificial
  CRISPR gRNA sequence
acagaggcgggtgaggcttg

SEQ ID NO: 52970 - DNA, 20 bp, Artificial
  CRISPR gRNA sequence
cagaggcgggtgaggcttgg

SEQ ID NO: 52971 - DNA, 20 bp, Artificial
  CRISPR gRNA sequence
cgggtgaggcttgggggctc

SEQ ID NO: 52972 - DNA, 20 bp, Artificial
  CRISPR gRNA sequence
ggtgaggcttgggggctcca

SEQ ID NO: 52973 - DNA, 20 bp, Artificial
  CRISPR gRNA sequence
gtgaggcttgggggctccag

SEQ ID NO: 52974 - DNA, 20 bp, Artificial
  CRISPR gRNA sequence
ggctccagaggacactcact

SEQ ID NO: 52975 - DNA, 20 bp, Artificial
  CRISPR gRNA sequence
gctccagaggacactcactg

SEQ ID NO: 52976 - DNA, 20 bp, Artificial
  CRISPR gRNA sequence
ggacactcactgaggctgca

SEQ ID NO: 52977 - DNA, 20 bp, Artificial
  CRISPR gRNA sequence
gacactcactgaggctgcaa

SEQ ID NO: 52978 - DNA, 20 bp, Artificial
  CRISPR gRNA sequence
acactcactgaggctgcaaa

SEQ ID NO: 52979 - DNA, 20 bp, Artificial
  CRISPR gRNA sequence
cactcactgaggctgcaaag

SEQ ID NO: 52980 - DNA, 20 bp, Artificial
  CRISPR gRNA sequence
ctgaggctgcaaaggggcaa

SEQ ID NO: 52981 - DNA, 20 bp, Artificial
  CRISPR gRNA sequence
tgaggctgcaaaggggcaat

SEQ ID NO: 52982 - DNA, 20 bp, Artificial
  CRISPR gRNA sequence
ggctgcaaaggggcaatggg

SEQ ID NO: 52983 - DNA, 20 bp, Artificial
  CRISPR gRNA sequence
gctgcaaaggggcaatgggc

SEQ ID NO: 52984 - DNA, 20 bp, Artificial
  CRISPR gRNA sequence
ctgcaaaggggcaatgggca

SEQ ID NO: 52985 - DNA, 20 bp, Artificial
  CRISPR gRNA sequence
caaaggggcaatgggcaggg

SEQ ID NO: 52986 - DNA, 20 bp, Artificial
  CRISPR gRNA sequence
aaaggggcaatgggcagggc

SEQ ID NO: 52987 - DNA, 20 bp, Artificial
  CRISPR gRNA sequence
aaggggcaatgggcagggca

SEQ ID NO: 52988 - DNA, 20 bp, Artificial
  CRISPR gRNA sequence
caatgggcagggcagggaat

SEQ ID NO: 52989 - DNA, 20 bp, Artificial
  CRISPR gRNA sequence
atgggcagggcagggaatca

SEQ ID NO: 52990 - DNA, 20 bp, Artificial
  CRISPR gRNA sequence
gcagggcagggaatcagaga

SEQ ID NO: 52991 - DNA, 20 bp, Artificial
  CRISPR gRNA sequence
gcagggaatcagagaaagcc

SEQ ID NO: 52992 - DNA, 20 bp, Artificial
  CRISPR gRNA sequence
cagggaatcagagaaagccc

SEQ ID NO: 52993 - DNA, 20 bp, Artificial
  CRISPR gRNA sequence
agggaatcagagaaagccca

SEQ ID NO: 52994 - DNA, 20 bp, Artificial
  CRISPR gRNA sequence
cagagaaagcccagggtccc

SEQ ID NO: 52995 - DNA, 20 bp, Artificial
  CRISPR gRNA sequence
gaaagcccagggtccctggc

SEQ ID NO: 52996 - DNA, 20 bp, Artificial
  CRISPR gRNA sequence
ccagggtccctggctagccc

SEQ ID NO: 52997 - DNA, 20 bp, Artificial
  CRISPR gRNA sequence
cagggtccctggctagcccc

SEQ ID NO: 52998 - DNA, 20 bp, Artificial
  CRISPR gRNA sequence
agggtccctggctagcccca

SEQ ID NO: 52999 - DNA, 20 bp, Artificial
  CRISPR gRNA sequence
gggtccctggctagccccag

SEQ ID NO: 53000 - DNA, 20 bp, Artificial
  CRISPR gRNA sequence
caggggctctatccttctcc

SEQ ID NO: 53001 - DNA, 20 bp, Artificial
  CRISPR gRNA sequence
ctcccagcatccctcactct

SEQ ID NO: 53002 - DNA, 20 bp, Artificial
  CRISPR gRNA sequence
ccagcatccctcactctaag

SEQ ID NO: 53003 - DNA, 20 bp, Artificial
  CRISPR gRNA sequence
cagcatccctcactctaagt

SEQ ID NO: 53004 - DNA, 20 bp, Artificial
  CRISPR gRNA sequence
gcatccctcactctaagtgg

SEQ ID NO: 53005 - DNA, 20 bp, Artificial
  CRISPR gRNA sequence
catccctcactctaagtggg

SEQ ID NO: 53006 - DNA, 20 bp, Artificial
  CRISPR gRNA sequence
tcactctaagtgggaggcca

SEQ ID NO: 53007 - DNA, 20 bp, Artificial
  CRISPR gRNA sequence
cactctaagtgggaggccac

SEQ ID NO: 53008 - DNA, 20 bp, Artificial
  CRISPR gRNA sequence
gccacaggccccttcccctg

SEQ ID NO: 53009 - DNA, 20 bp, Artificial
  CRISPR gRNA sequence
ccacaggccccttcccctgt

SEQ ID NO: 53010 - DNA, 20 bp, Artificial
  CRISPR gRNA sequence
cacaggccccttcccctgtg

SEQ ID NO: 53011 - DNA, 20 bp, Artificial
  CRISPR gRNA sequence
ggggcactcgcttccctctc

SEQ ID NO: 53012 - DNA, 20 bp, Artificial
  CRISPR gRNA sequence
tccctctcgagtctcccctg

SEQ ID NO: 53013 - DNA, 20 bp, Artificial
  CRISPR gRNA sequence
ccccaatcctcctgccctga

SEQ ID NO: 53014 - DNA, 20 bp, Artificial
  CRISPR gRNA sequence
tcctcctgccctgacagtga

SEQ ID NO: 53015 - DNA, 20 bp, Artificial
  CRISPR gRNA sequence
ctgccctgacagtgacagtg

SEQ ID NO: 53016 - DNA, 20 bp, Artificial
  CRISPR gRNA sequence
tgccctgacagtgacagtgc

SEQ ID NO: 53017 - DNA, 20 bp, Artificial
  CRISPR gRNA sequence
cagtgacagtgcaggaccct

SEQ ID NO: 53018 - DNA, 20 bp, Artificial
  CRISPR gRNA sequence
agtgcaggaccctgagttcc

SEQ ID NO: 53019 - DNA, 20 bp, Artificial
  CRISPR gRNA sequence
gagttcccagctgcccttgt

SEQ ID NO: 53020 - DNA, 20 bp, Artificial
  CRISPR gRNA sequence
gcccttgtcagtgactctcc

SEQ ID NO: 53021 - DNA, 20 bp, Artificial
  CRISPR gRNA sequence
gtcctccccaccgccccctc

SEQ ID NO: 53022 - DNA, 20 bp, Artificial
  CRISPR gRNA sequence
cctccccaccgccccctcca

SEQ ID NO: 53023 - DNA, 20 bp, Artificial
  CRISPR gRNA sequence
ccaccgccccctccagagcc

SEQ ID NO: 53024 - DNA, 20 bp, Artificial
  CRISPR gRNA sequence
caccgccccctccagagccc

SEQ ID NO: 53025 - DNA, 20 bp, Artificial
  CRISPR gRNA sequence
cttgaccatttaacaccctc

SEQ ID NO: 53026 - DNA, 20 bp, Artificial
  CRISPR gRNA sequence
ttgaccatttaacaccctct

SEQ ID NO: 53027 - DNA, 20 bp, Artificial
  CRISPR gRNA sequence
ttaatccctctctgccccac

SEQ ID NO: 53028 - DNA, 20 bp, Artificial
  CRISPR gRNA sequence
tttaacactgcacatctgac

SEQ ID NO: 53029 - DNA, 20 bp, Artificial
  CRISPR gRNA sequence
ttaacactgcacatctgacc

SEQ ID NO: 53030 - DNA, 20 bp, Artificial
  CRISPR gRNA sequence
gcctctccctgttacccccg

SEQ ID NO: 53031 - DNA, 20 bp, Artificial
  CRISPR gRNA sequence
cccgtggctccccattgccc

SEQ ID NO: 53032 - DNA, 20 bp, Artificial
  CRISPR gRNA sequence
ccgtggctccccattgccct

SEQ ID NO: 53033 - DNA, 20 bp, Artificial
  CRISPR gRNA sequence
cgtggctccccattgccctg

SEQ ID NO: 53034 - DNA, 20 bp, Artificial
  CRISPR gRNA sequence
ccccattgccctggggctaa

SEQ ID NO: 53035 - DNA, 20 bp, Artificial
  CRISPR gRNA sequence
tgaaattgaaatgtccttcc

SEQ ID NO: 53036 - DNA, 20 bp, Artificial
  CRISPR gRNA sequence
gaaattgaaatgtccttccc

SEQ ID NO: 53037 - DNA, 20 bp, Artificial
  CRISPR gRNA sequence
aaattgaaatgtccttccca

SEQ ID NO: 53038 - DNA, 20 bp, Artificial
  CRISPR gRNA sequence
ctcacttgcctccacttccc

SEQ ID NO: 53039 - DNA, 20 bp, Artificial
  CRISPR gRNA sequence
cacttgcctccacttccctg

SEQ ID NO: 53040 - DNA, 20 bp, Artificial
  CRISPR gRNA sequence
acttgcctccacttccctgg

SEQ ID NO: 53041 - DNA, 20 bp, Artificial
  CRISPR gRNA sequence
cctccacttccctggaggcc

SEQ ID NO: 53042 - DNA, 20 bp, Artificial
  CRISPR gRNA sequence
tccacttccctggaggccta

SEQ ID NO: 53043 - DNA, 20 bp, Artificial
  CRISPR gRNA sequence
cacttccctggaggcctaga

SEQ ID NO: 53044 - DNA, 20 bp, Artificial
  CRISPR gRNA sequence
cttccctggaggcctagaga

SEQ ID NO: 53045 - DNA, 20 bp, Artificial
  CRISPR gRNA sequence
ttccctggaggcctagagag

SEQ ID NO: 53046 - DNA, 20 bp, Artificial
  CRISPR gRNA sequence
cctggaggcctagagagagg

SEQ ID NO: 53047 - DNA, 20 bp, Artificial
  CRISPR gRNA sequence
ctggaggcctagagagaggt

SEQ ID NO: 53048 - DNA, 20 bp, Artificial
  CRISPR gRNA sequence
tggaggcctagagagaggtg

SEQ ID NO: 53049 - DNA, 20 bp, Artificial
  CRISPR gRNA sequence
gcctagagagaggtggggcc

SEQ ID NO: 53050 - DNA, 20 bp, Artificial
  CRISPR gRNA sequence
agagagaggtggggccaagt

SEQ ID NO: 53051 - DNA, 20 bp, Artificial
  CRISPR gRNA sequence
gagagaggtggggccaagtc

SEQ ID NO: 53052 - DNA, 20 bp, Artificial
  CRISPR gRNA sequence
agagaggtggggccaagtca

SEQ ID NO: 53053 - DNA, 20 bp, Artificial
  CRISPR gRNA sequence
ggggccaagtcagggtctca

SEQ ID NO: 53054 - DNA, 20 bp, Artificial
  CRISPR gRNA sequence
cagggtctcacagcctctca

SEQ ID NO: 53055 - DNA, 20 bp, Artificial
  CRISPR gRNA sequence
ggtctcacagcctctcatgg

SEQ ID NO: 53056 - DNA, 20 bp, Artificial
  CRISPR gRNA sequence
tctcacagcctctcatggca

SEQ ID NO: 53057 - DNA, 20 bp, Artificial
  CRISPR gRNA sequence
gcctctcatggcagagcttg

SEQ ID NO: 53058 - DNA, 20 bp, Artificial
  CRISPR gRNA sequence
ctcatggcagagcttgcaga

SEQ ID NO: 53059 - DNA, 20 bp, Artificial
  CRISPR gRNA sequence
tcatggcagagcttgcagat

SEQ ID NO: 53060 - DNA, 20 bp, Artificial
  CRISPR gRNA sequence
catggcagagcttgcagatg

SEQ ID NO: 53061 - DNA, 20 bp, Artificial
  CRISPR gRNA sequence
tggcagagcttgcagatggg

SEQ ID NO: 53062 - DNA, 20 bp, Artificial
  CRISPR gRNA sequence
cttgcagatggggagtgtat

SEQ ID NO: 53063 - DNA, 20 bp, Artificial
  CRISPR gRNA sequence
gcagatggggagtgtattag

SEQ ID NO: 53064 - DNA, 20 bp, Artificial
  CRISPR gRNA sequence
cagatggggagtgtattagt

SEQ ID NO: 53065 - DNA, 20 bp, Artificial
  CRISPR gRNA sequence
agatggggagtgtattagtg

SEQ ID NO: 53066 - DNA, 20 bp, Artificial
  CRISPR gRNA sequence
atggggagtgtattagtggg

SEQ ID NO: 53067 - DNA, 20 bp, Artificial
  CRISPR gRNA sequence
ggagtgtattagtggggaga

SEQ ID NO: 53068 - DNA, 20 bp, Artificial
  CRISPR gRNA sequence
gagtgtattagtggggagac

SEQ ID NO: 53069 - DNA, 20 bp, Artificial
  CRISPR gRNA sequence
caggccaacccctttctttc

SEQ ID NO: 53070 - DNA, 20 bp, Artificial
  CRISPR gRNA sequence
ccaacccctttctttctgga

SEQ ID NO: 53071 - DNA, 20 bp, Artificial
  CRISPR gRNA sequence
acccctttctttctggaaag

SEQ ID NO: 53072 - DNA, 20 bp, Artificial
  CRISPR gRNA sequence
cccctttctttctggaaagt

SEQ ID NO: 53073 - DNA, 20 bp, Artificial
  CRISPR gRNA sequence
tctggaaagtgggtgtcccc

SEQ ID NO: 53074 - DNA, 20 bp, Artificial
  CRISPR gRNA sequence
tggaaagtgggtgtccccca

SEQ ID NO: 53075 - DNA, 20 bp, Artificial
  CRISPR gRNA sequence
aaagtgggtgtcccccagag

SEQ ID NO: 53076 - DNA, 20 bp, Artificial
  CRISPR gRNA sequence
tgggtgtcccccagagcaga

SEQ ID NO: 53077 - DNA, 20 bp, Artificial
  CRISPR gRNA sequence
ggtgtcccccagagcagatg

SEQ ID NO: 53078 - DNA, 20 bp, Artificial
  CRISPR gRNA sequence
cccagagcagatggagaccc

SEQ ID NO: 53079 - DNA, 20 bp, Artificial
  CRISPR gRNA sequence
ccagagcagatggagacccc

SEQ ID NO: 53080 - DNA, 20 bp, Artificial
  CRISPR gRNA sequence
gagcagatggagaccccagg

SEQ ID NO: 53081 - DNA, 20 bp, Artificial
  CRISPR gRNA sequence
agcagatggagaccccaggc

SEQ ID NO: 53082 - DNA, 20 bp, Artificial
  CRISPR gRNA sequence
gcagatggagaccccaggca

SEQ ID NO: 53083 - DNA, 20 bp, Artificial
  CRISPR gRNA sequence
agatggagaccccaggcagg

SEQ ID NO: 53084 - DNA, 20 bp, Artificial
  CRISPR gRNA sequence
tggagaccccaggcagggag

SEQ ID NO: 53085 - DNA, 20 bp, Artificial
  CRISPR gRNA sequence
accccaggcagggagtggct

SEQ ID NO: 53086 - DNA, 20 bp, Artificial
  CRISPR gRNA sequence
gagctgctctgtttgcttca

SEQ ID NO: 53087 - DNA, 20 bp, Artificial
  CRISPR gRNA sequence
ctgtttgcttcacagaaatg

SEQ ID NO: 53088 - DNA, 20 bp, Artificial
  CRISPR gRNA sequence
aaatgtggaatcttctctcc

SEQ ID NO: 53089 - DNA, 20 bp, Artificial
  CRISPR gRNA sequence
aatgtggaatcttctctcca

SEQ ID NO: 53090 - DNA, 20 bp, Artificial
  CRISPR gRNA sequence
tgtggaatcttctctccaag

SEQ ID NO: 53091 - DNA, 20 bp, Artificial
  CRISPR gRNA sequence
tcttctctccaaggagaatg

SEQ ID NO: 53092 - DNA, 20 bp, Artificial
  CRISPR gRNA sequence
cttctctccaaggagaatgc

SEQ ID NO: 53093 - DNA, 20 bp, Artificial
  CRISPR gRNA sequence
ttctctccaaggagaatgcg

SEQ ID NO: 53094 - DNA, 20 bp, Artificial
  CRISPR gRNA sequence
tccaaggagaatgcggggca

SEQ ID NO: 53095 - DNA, 20 bp, Artificial
  CRISPR gRNA sequence
ccaaggagaatgcggggcat

SEQ ID NO: 53096 - DNA, 20 bp, Artificial
  CRISPR gRNA sequence
ggagaatgcggggcatgggc

SEQ ID NO: 53097 - DNA, 20 bp, Artificial
  CRISPR gRNA sequence
atgcggggcatgggccagct

SEQ ID NO: 53098 - DNA, 20 bp, Artificial
  CRISPR gRNA sequence
gggccagctgagctgcccgt

SEQ ID NO: 53099 - DNA, 20 bp, Artificial
  CRISPR gRNA sequence
ggccagctgagctgcccgtc

SEQ ID NO: 53100 - DNA, 20 bp, Artificial
  CRISPR gRNA sequence
gccagctgagctgcccgtca

SEQ ID NO: 53101 - DNA, 20 bp, Artificial
  CRISPR gRNA sequence
ccagctgagctgcccgtcag

SEQ ID NO: 53102 - DNA, 20 bp, Artificial
  CRISPR gRNA sequence
ctgagctgcccgtcaggggc

SEQ ID NO: 53103 - DNA, 20 bp, Artificial
  CRISPR gRNA sequence
gagctgcccgtcaggggcca

SEQ ID NO: 53104 - DNA, 20 bp, Artificial
  CRISPR gRNA sequence
ggccagagctccccaactcc

SEQ ID NO: 53105 - DNA, 20 bp, Artificial
  CRISPR gRNA sequence
cttccctctatcccaatccc

SEQ ID NO: 53106 - DNA, 20 bp, Artificial
  CRISPR gRNA sequence
tctatcccaatccccagccc

SEQ ID NO: 53107 - DNA, 20 bp, Artificial
  CRISPR gRNA sequence
ccccagccctagccccctgc

SEQ ID NO: 53108 - DNA, 20 bp, Artificial
  CRISPR gRNA sequence
ctgacgcctcatccctatta

SEQ ID NO: 53109 - DNA, 20 bp, Artificial
  CRISPR gRNA sequence
tattatggttacccccaaac

SEQ ID NO: 53110 - DNA, 20 bp, Artificial
  CRISPR gRNA sequence
tatggttacccccaaacaag

SEQ ID NO: 53111 - DNA, 20 bp, Artificial
  CRISPR gRNA sequence
atggttacccccaaacaaga

SEQ ID NO: 53112 - DNA, 20 bp, Artificial
  CRISPR gRNA sequence
tggttacccccaaacaagaa

SEQ ID NO: 53113 - DNA, 20 bp, Artificial
  CRISPR gRNA sequence
tacccccaaacaagaagggc

SEQ ID NO: 53114 - DNA, 20 bp, Artificial
  CRISPR gRNA sequence
acccccaaacaagaagggct

SEQ ID NO: 53115 - DNA, 20 bp, Artificial
  CRISPR gRNA sequence
ccaaacaagaagggctggga

SEQ ID NO: 53116 - DNA, 20 bp, Artificial
  CRISPR gRNA sequence
aagaagggctgggacagtac

SEQ ID NO: 53117 - DNA, 20 bp, Artificial
  CRISPR gRNA sequence
gaagggctgggacagtacca

SEQ ID NO: 53118 - DNA, 20 bp, Artificial
  CRISPR gRNA sequence
aagggctgggacagtaccag

SEQ ID NO: 53119 - DNA, 20 bp, Artificial
  CRISPR gRNA sequence
gggacagtaccagaggctcc

SEQ ID NO: 53120 - DNA, 20 bp, Artificial
  CRISPR gRNA sequence
ggacagtaccagaggctcct

SEQ ID NO: 53121 - DNA, 20 bp, Artificial
  CRISPR gRNA sequence
gacagtaccagaggctcctg

SEQ ID NO: 53122 - DNA, 20 bp, Artificial
  CRISPR gRNA sequence
accagaggctcctggggatg

SEQ ID NO: 53123 - DNA, 20 bp, Artificial
  CRISPR gRNA sequence
tcctggggatgcagcgctga

SEQ ID NO: 53124 - DNA, 20 bp, Artificial
  CRISPR gRNA sequence
tgcagcgctgacggaaccct

SEQ ID NO: 53125 - DNA, 20 bp, Artificial
  CRISPR gRNA sequence
ctgacggaaccctaagaact

SEQ ID NO: 53126 - DNA, 20 bp, Artificial
  CRISPR gRNA sequence
gaaccctaagaacttggctg

SEQ ID NO: 53127 - DNA, 20 bp, Artificial
  CRISPR gRNA sequence
cctaagaacttggctgcagc

SEQ ID NO: 53128 - DNA, 20 bp, Artificial
  CRISPR gRNA sequence
ctaagaacttggctgcagct

SEQ ID NO: 53129 - DNA, 20 bp, Artificial
  CRISPR gRNA sequence
agaacttggctgcagctggg

SEQ ID NO: 53130 - DNA, 20 bp, Artificial
  CRISPR gRNA sequence
ttggctgcagctgggaagtc

SEQ ID NO: 53131 - DNA, 20 bp, Artificial
  CRISPR gRNA sequence
tgcagctgggaagtctggca

SEQ ID NO: 53132 - DNA, 20 bp, Artificial
  CRISPR gRNA sequence
tgggaagtctggcaaagatc

SEQ ID NO: 53133 - DNA, 20 bp, Artificial
  CRISPR gRNA sequence
gaagtctggcaaagatccag

SEQ ID NO: 53134 - DNA, 20 bp, Artificial
  CRISPR gRNA sequence
tccagtggcccacatatccc

SEQ ID NO: 53135 - DNA, 20 bp, Artificial
  CRISPR gRNA sequence
ccagtggcccacatatccct

SEQ ID NO: 53136 - DNA, 20 bp, Artificial
  CRISPR gRNA sequence
agtggcccacatatccctag

SEQ ID NO: 53137 - DNA, 20 bp, Artificial
  CRISPR gRNA sequence
gtggcccacatatccctagg

SEQ ID NO: 53138 - DNA, 20 bp, Artificial
  CRISPR gRNA sequence
tggcccacatatccctagga

SEQ ID NO: 53139 - DNA, 20 bp, Artificial
  CRISPR gRNA sequence
ggcccacatatccctaggag

SEQ ID NO: 53140 - DNA, 20 bp, Artificial
  CRISPR gRNA sequence
gcccacatatccctaggagg

SEQ ID NO: 53141 - DNA, 20 bp, Artificial
  CRISPR gRNA sequence
tccctaggagggggatcatt

SEQ ID NO: 53142 - DNA, 20 bp, Artificial
  CRISPR gRNA sequence
taggagggggatcatttaga

SEQ ID NO: 53143 - DNA, 20 bp, Artificial
  CRISPR gRNA sequence
aggagggggatcatttagaa

SEQ ID NO: 53144 - DNA, 20 bp, Artificial
  CRISPR gRNA sequence
gggggatcatttagaaagga

SEQ ID NO: 53145 - DNA, 20 bp, Artificial
  CRISPR gRNA sequence
atcatttagaaaggaaagtt

SEQ ID NO: 53146 - DNA, 20 bp, Artificial
  CRISPR gRNA sequence
gaaagttcagatcaccccct

SEQ ID NO: 53147 - DNA, 20 bp, Artificial
  CRISPR gRNA sequence
agatcaccccctcggactcc

SEQ ID NO: 53148 - DNA, 20 bp, Artificial
  CRISPR gRNA sequence
accccctcggactcccagcc

SEQ ID NO: 53149 - DNA, 20 bp, Artificial
  CRISPR gRNA sequence
cagcccagcccatatacccc

SEQ ID NO: 53150 - DNA, 20 bp, Artificial
  CRISPR gRNA sequence
agcccagcccatatacccct

SEQ ID NO: 53151 - DNA, 20 bp, Artificial
  CRISPR gRNA sequence
cccagcccatatacccctag

SEQ ID NO: 53152 - DNA, 20 bp, Artificial
  CRISPR gRNA sequence
ccagcccatatacccctagg

SEQ ID NO: 53153 - DNA, 20 bp, Artificial
  CRISPR gRNA sequence
cagcccatatacccctagga

SEQ ID NO: 53154 - DNA, 20 bp, Artificial
  CRISPR gRNA sequence
agcccatatacccctaggag

SEQ ID NO: 53155 - DNA, 20 bp, Artificial
  CRISPR gRNA sequence
gcccatatacccctaggagg

SEQ ID NO: 53156 - DNA, 20 bp, Artificial
  CRISPR gRNA sequence
cccctaggagggggatcgtt

SEQ ID NO: 53157 - DNA, 20 bp, Artificial
  CRISPR gRNA sequence
taggagggggatcgtttaga

SEQ ID NO: 53158 - DNA, 20 bp, Artificial
  CRISPR gRNA sequence
aggagggggatcgtttagaa

SEQ ID NO: 53159 - DNA, 20 bp, Artificial
  CRISPR gRNA sequence
gggggatcgtttagaaagga

SEQ ID NO: 53160 - DNA, 20 bp, Artificial
  CRISPR gRNA sequence
atcgtttagaaaggaaagtt

SEQ ID NO: 53161 - DNA, 20 bp, Artificial
  CRISPR gRNA sequence
aaagttcagatcacccacat

SEQ ID NO: 53162 - DNA, 20 bp, Artificial
  CRISPR gRNA sequence
gatcacccacattggactcc

SEQ ID NO: 53163 - DNA, 20 bp, Artificial
  CRISPR gRNA sequence
ccacattggactcccagact

SEQ ID NO: 53164 - DNA, 20 bp, Artificial
  CRISPR gRNA sequence
attggactcccagacttgga

SEQ ID NO: 53165 - DNA, 20 bp, Artificial
  CRISPR gRNA sequence
gactcccagacttggaaagt

SEQ ID NO: 53166 - DNA, 20 bp, Artificial
  CRISPR gRNA sequence
actcccagacttggaaagtc

SEQ ID NO: 53167 - DNA, 20 bp, Artificial
  CRISPR gRNA sequence
ctcccagacttggaaagtca

SEQ ID NO: 53168 - DNA, 20 bp, Artificial
  CRISPR gRNA sequence
cagacttggaaagtcagggc

SEQ ID NO: 53169 - DNA, 20 bp, Artificial
  CRISPR gRNA sequence
acttggaaagtcagggctgg

SEQ ID NO: 53170 - DNA, 20 bp, Artificial
  CRISPR gRNA sequence
cttggaaagtcagggctgga

SEQ ID NO: 53171 - DNA, 20 bp, Artificial
  CRISPR gRNA sequence
gtcagggctggaaggcatct

SEQ ID NO: 53172 - DNA, 20 bp, Artificial
  CRISPR gRNA sequence
cagggctggaaggcatctca

SEQ ID NO: 53173 - DNA, 20 bp, Artificial
  CRISPR gRNA sequence
aaggcatctcagagacaatg

SEQ ID NO: 53174 - DNA, 20 bp, Artificial
  CRISPR gRNA sequence
ctcagagacaatgcagtcac

SEQ ID NO: 53175 - DNA, 20 bp, Artificial
  CRISPR gRNA sequence
acaatgcagtcactagatcc

SEQ ID NO: 53176 - DNA, 20 bp, Artificial
  CRISPR gRNA sequence
gcagtcactagatcctagct

SEQ ID NO: 53177 - DNA, 20 bp, Artificial
  CRISPR gRNA sequence
tagctcagtccctcattgtt

SEQ ID NO: 53178 - DNA, 20 bp, Artificial
  CRISPR gRNA sequence
tcagtccctcattgttcaga

SEQ ID NO: 53179 - DNA, 20 bp, Artificial
  CRISPR gRNA sequence
cagtccctcattgttcagat

SEQ ID NO: 53180 - DNA, 20 bp, Artificial
  CRISPR gRNA sequence
agtccctcattgttcagatg

SEQ ID NO: 53181 - DNA, 20 bp, Artificial
  CRISPR gRNA sequence
attgttcagatggggaaact

SEQ ID NO: 53182 - DNA, 20 bp, Artificial
  CRISPR gRNA sequence
ttgttcagatggggaaactg

SEQ ID NO: 53183 - DNA, 20 bp, Artificial
  CRISPR gRNA sequence
cagatggggaaactgaggct

SEQ ID NO: 53184 - DNA, 20 bp, Artificial
  CRISPR gRNA sequence
agatggggaaactgaggctc

SEQ ID NO: 53185 - DNA, 20 bp, Artificial
  CRISPR gRNA sequence
gatggggaaactgaggctca

SEQ ID NO: 53186 - DNA, 20 bp, Artificial
  CRISPR gRNA sequence
ggggaaactgaggctcaggg

SEQ ID NO: 53187 - DNA, 20 bp, Artificial
  CRISPR gRNA sequence
gggaaactgaggctcaggga

SEQ ID NO: 53188 - DNA, 20 bp, Artificial
  CRISPR gRNA sequence
ggaaactgaggctcagggaa

SEQ ID NO: 53189 - DNA, 20 bp, Artificial
  CRISPR gRNA sequence
aactgaggctcagggaaggg

SEQ ID NO: 53190 - DNA, 20 bp, Artificial
  CRISPR gRNA sequence
ggctcagggaagggaagcct

SEQ ID NO: 53191 - DNA, 20 bp, Artificial
  CRISPR gRNA sequence
cagggaagggaagcctgagt

SEQ ID NO: 53192 - DNA, 20 bp, Artificial
  CRISPR gRNA sequence
aagggaagcctgagttagaa

SEQ ID NO: 53193 - DNA, 20 bp, Artificial
  CRISPR gRNA sequence
gaagcctgagttagaaaagc

SEQ ID NO: 53194 - DNA, 20 bp, Artificial
  CRISPR gRNA sequence
gcctgagttagaaaagccag

SEQ ID NO: 53195 - DNA, 20 bp, Artificial
  CRISPR gRNA sequence
gccagcagcttgttcctgtc

SEQ ID NO: 53196 - DNA, 20 bp, Artificial
  CRISPR gRNA sequence
ccagcagcttgttcctgtcc

SEQ ID NO: 53197 - DNA, 20 bp, Artificial
  CRISPR gRNA sequence
cagcttgttcctgtccaggt

SEQ ID NO: 53198 - DNA, 20 bp, Artificial
  CRISPR gRNA sequence
cttgttcctgtccaggtgag

SEQ ID NO: 53199 - DNA, 20 bp, Artificial
  CRISPR gRNA sequence
ttgttcctgtccaggtgagc

SEQ ID NO: 53200 - DNA, 20 bp, Artificial
  CRISPR gRNA sequence
ttcctgtccaggtgagcagg

SEQ ID NO: 53201 - DNA, 20 bp, Artificial
  CRISPR gRNA sequence
tcctgtccaggtgagcaggc

SEQ ID NO: 53202 - DNA, 20 bp, Artificial
  CRISPR gRNA sequence
ctgtccaggtgagcaggcag

SEQ ID NO: 53203 - DNA, 20 bp, Artificial
  CRISPR gRNA sequence
tgtccaggtgagcaggcagg

SEQ ID NO: 53204 - DNA, 20 bp, Artificial
  CRISPR gRNA sequence
gtgagcaggcaggaggaccc

SEQ ID NO: 53205 - DNA, 20 bp, Artificial
  CRISPR gRNA sequence
gcaggcaggaggacccaaga

SEQ ID NO: 53206 - DNA, 20 bp, Artificial
  CRISPR gRNA sequence
aggcaggaggacccaagaca

SEQ ID NO: 53207 - DNA, 20 bp, Artificial
  CRISPR gRNA sequence
gagcctctctgaccactgct

SEQ ID NO: 53208 - DNA, 20 bp, Artificial
  CRISPR gRNA sequence
acttctgcctccctgtacgt

SEQ ID NO: 53209 - DNA, 20 bp, Artificial
  CRISPR gRNA sequence
ctccctgtacgtcagttctt

SEQ ID NO: 53210 - DNA, 20 bp, Artificial
  CRISPR gRNA sequence
tccctgtacgtcagttcttt

SEQ ID NO: 53211 - DNA, 20 bp, Artificial
  CRISPR gRNA sequence
acgtcagttctttgggcctc

SEQ ID NO: 53212 - DNA, 20 bp, Artificial
  CRISPR gRNA sequence
ttctttgggcctcaagaacc

SEQ ID NO: 53213 - DNA, 20 bp, Artificial
  CRISPR gRNA sequence
tctttgggcctcaagaaccc

SEQ ID NO: 53214 - DNA, 20 bp, Artificial
  CRISPR gRNA sequence
ctttgggcctcaagaacccg

SEQ ID NO: 53215 - DNA, 20 bp, Artificial
  CRISPR gRNA sequence
tttgggcctcaagaacccgg

SEQ ID NO: 53216 - DNA, 20 bp, Artificial
  CRISPR gRNA sequence
tcaagaacccgggggttccc

SEQ ID NO: 53217 - DNA, 20 bp, Artificial
  CRISPR gRNA sequence
acccgggggttccccagaaa

SEQ ID NO: 53218 - DNA, 20 bp, Artificial
  CRISPR gRNA sequence
ccgggggttccccagaaaca

SEQ ID NO: 53219 - DNA, 20 bp, Artificial
  CRISPR gRNA sequence
cagaaacagagatcctatcc

SEQ ID NO: 53220 - DNA, 20 bp, Artificial
  CRISPR gRNA sequence
agaaacagagatcctatcct

SEQ ID NO: 53221 - DNA, 20 bp, Artificial
  CRISPR gRNA sequence
aacagagatcctatcctggg

SEQ ID NO: 53222 - DNA, 20 bp, Artificial
  CRISPR gRNA sequence
gagatcctatcctgggaagc

SEQ ID NO: 53223 - DNA, 20 bp, Artificial
  CRISPR gRNA sequence
tcctgggaagcaagaccacc

SEQ ID NO: 53224 - DNA, 20 bp, Artificial
  CRISPR gRNA sequence
cctgggaagcaagaccaccc

SEQ ID NO: 53225 - DNA, 20 bp, Artificial
  CRISPR gRNA sequence
aagcaagaccacccaggctt

SEQ ID NO: 53226 - DNA, 20 bp, Artificial
  CRISPR gRNA sequence
gagccacccctgactcctga

SEQ ID NO: 53227 - DNA, 20 bp, Artificial
  CRISPR gRNA sequence
ctcctgacagcccatctgta

SEQ ID NO: 53228 - DNA, 20 bp, Artificial
  CRISPR gRNA sequence
ctgacagcccatctgtacgg

SEQ ID NO: 53229 - DNA, 20 bp, Artificial
  CRISPR gRNA sequence
agtgccttttcttgacacac

SEQ ID NO: 53230 - DNA, 20 bp, Artificial
  CRISPR gRNA sequence
tagctgtgactctctccacc

SEQ ID NO: 53231 - DNA, 20 bp, Artificial
  CRISPR gRNA sequence
tgtgactctctccacccagc

SEQ ID NO: 53232 - DNA, 20 bp, Artificial
  CRISPR gRNA sequence
tccacccagccagctgcaca

SEQ ID NO: 53233 - DNA, 20 bp, Artificial
  CRISPR gRNA sequence
ccacccagccagctgcacat

SEQ ID NO: 53234 - DNA, 20 bp, Artificial
  CRISPR gRNA sequence
tgtccgctgccactgctccc

SEQ ID NO: 53235 - DNA, 20 bp, Artificial
  CRISPR gRNA sequence
cgctgccactgctcccaagt

SEQ ID NO: 53236 - DNA, 20 bp, Artificial
  CRISPR gRNA sequence
gctgccactgctcccaagtg

SEQ ID NO: 53237 - DNA, 20 bp, Artificial
  CRISPR gRNA sequence
cactgctcccaagtgaggcc

SEQ ID NO: 53238 - DNA, 20 bp, Artificial
  CRISPR gRNA sequence
ctgctcccaagtgaggccaa

SEQ ID NO: 53239 - DNA, 20 bp, Artificial
  CRISPR gRNA sequence
tgctcccaagtgaggccaag

SEQ ID NO: 53240 - DNA, 20 bp, Artificial
  CRISPR gRNA sequence
ccaagtgaggccaagaggcc

SEQ ID NO: 53241 - DNA, 20 bp, Artificial
  CRISPR gRNA sequence
gccaagaggcctggtcccac

SEQ ID NO: 53242 - DNA, 20 bp, Artificial
  CRISPR gRNA sequence
caagaggcctggtcccacta

SEQ ID NO: 53243 - DNA, 20 bp, Artificial
  CRISPR gRNA sequence
aagaggcctggtcccactag

SEQ ID NO: 53244 - DNA, 20 bp, Artificial
  CRISPR gRNA sequence
agaggcctggtcccactaga

SEQ ID NO: 53245 - DNA, 20 bp, Artificial
  CRISPR gRNA sequence
ggcctggtcccactagaggg

SEQ ID NO: 53246 - DNA, 20 bp, Artificial
  CRISPR gRNA sequence
tggtcccactagagggcagc

SEQ ID NO: 53247 - DNA, 20 bp, Artificial
  CRISPR gRNA sequence
ggtcccactagagggcagcc

SEQ ID NO: 53248 - DNA, 20 bp, Artificial
  CRISPR gRNA sequence
gggcagccgggaacatcatg

SEQ ID NO: 53249 - DNA, 20 bp, Artificial
  CRISPR gRNA sequence
gcagccgggaacatcatgaa

SEQ ID NO: 53250 - DNA, 20 bp, Artificial
  CRISPR gRNA sequence
aacatcatgaagagctaaac

SEQ ID NO: 53251 - DNA, 20 bp, Artificial
  CRISPR gRNA sequence
atgaagagctaaactagtat

SEQ ID NO: 53252 - DNA, 20 bp, Artificial
  CRISPR gRNA sequence
agtattggttgtttactgcg

SEQ ID NO: 53253 - DNA, 20 bp, Artificial
  CRISPR gRNA sequence
ttggttgtttactgcgaaga

SEQ ID NO: 53254 - DNA, 20 bp, Artificial
  CRISPR gRNA sequence
tggttgtttactgcgaagac

SEQ ID NO: 53255 - DNA, 20 bp, Artificial
  CRISPR gRNA sequence
ggttgtttactgcgaagacg

SEQ ID NO: 53256 - DNA, 20 bp, Artificial
  CRISPR gRNA sequence
agacggggaaaatgtttttt

SEQ ID NO: 53257 - DNA, 20 bp, Artificial
  CRISPR gRNA sequence
acggggaaaatgttttttca

SEQ ID NO: 53258 - DNA, 20 bp, Artificial
  CRISPR gRNA sequence
atgttttttcagagcaccca

SEQ ID NO: 53259 - DNA, 20 bp, Artificial
  CRISPR gRNA sequence
gcacccacggcccctgcctt

SEQ ID NO: 53260 - DNA, 20 bp, Artificial
  CRISPR gRNA sequence
acccacggcccctgccttca

SEQ ID NO: 53261 - DNA, 20 bp, Artificial
  CRISPR gRNA sequence
cccctgccttcagagcgtga

SEQ ID NO: 53262 - DNA, 20 bp, Artificial
  CRISPR gRNA sequence
ccctgccttcagagcgtgaa

SEQ ID NO: 53263 - DNA, 20 bp, Artificial
  CRISPR gRNA sequence
cctgccttcagagcgtgaaa

SEQ ID NO: 53264 - DNA, 20 bp, Artificial
  CRISPR gRNA sequence
gccttcagagcgtgaaaggg

SEQ ID NO: 53265 - DNA, 20 bp, Artificial
  CRISPR gRNA sequence
tgaaagggcagtgacatgta

SEQ ID NO: 53266 - DNA, 20 bp, Artificial
  CRISPR gRNA sequence
aaagggcagtgacatgtatg

SEQ ID NO: 53267 - DNA, 20 bp, Artificial
  CRISPR gRNA sequence
gggcagtgacatgtatggag

SEQ ID NO: 53268 - DNA, 20 bp, Artificial
  CRISPR gRNA sequence
cagtgacatgtatggagcgg

SEQ ID NO: 53269 - DNA, 20 bp, Artificial
  CRISPR gRNA sequence
agtgacatgtatggagcggt

SEQ ID NO: 53270 - DNA, 20 bp, Artificial
  CRISPR gRNA sequence
ctacaaaattccccgaaacg

SEQ ID NO: 53271 - DNA, 20 bp, Artificial
  CRISPR gRNA sequence
caaaattccccgaaacgcag

SEQ ID NO: 53272 - DNA, 20 bp, Artificial
  CRISPR gRNA sequence
ttctcctgtctcctcccaca

SEQ ID NO: 53273 - DNA, 20 bp, Artificial
  CRISPR gRNA sequence
tcctgtctcctcccacacag

SEQ ID NO: 53274 - DNA, 20 bp, Artificial
  CRISPR gRNA sequence
tcccacacagcagcaatctg

SEQ ID NO: 53275 - DNA, 20 bp, Artificial
  CRISPR gRNA sequence
cccacacagcagcaatctgc

SEQ ID NO: 53276 - DNA, 20 bp, Artificial
  CRISPR gRNA sequence
tgcgggcacctgccctgctc

SEQ ID NO: 53277 - DNA, 20 bp, Artificial
  CRISPR gRNA sequence
gcgggcacctgccctgctct

SEQ ID NO: 53278 - DNA, 20 bp, Artificial
  CRISPR gRNA sequence
catctgcattgcctccttcc

SEQ ID NO: 53279 - DNA, 20 bp, Artificial
  CRISPR gRNA sequence
atctgcattgcctccttcca

SEQ ID NO: 53280 - DNA, 20 bp, Artificial
  CRISPR gRNA sequence
tctgcattgcctccttccaa

SEQ ID NO: 53281 - DNA, 20 bp, Artificial
  CRISPR gRNA sequence
ctgcattgcctccttccaag

SEQ ID NO: 53282 - DNA, 20 bp, Artificial
  CRISPR gRNA sequence
gcctccttccaaggggaaaa

SEQ ID NO: 53283 - DNA, 20 bp, Artificial
  CRISPR gRNA sequence
cctccttccaaggggaaaac

SEQ ID NO: 53284 - DNA, 20 bp, Artificial
  CRISPR gRNA sequence
ctccttccaaggggaaaaca

SEQ ID NO: 53285 - DNA, 20 bp, Artificial
  CRISPR gRNA sequence
cttccaaggggaaaacaggg

SEQ ID NO: 53286 - DNA, 20 bp, Artificial
  CRISPR gRNA sequence
agttgattactgacaattta

SEQ ID NO: 53287 - DNA, 20 bp, Artificial
  CRISPR gRNA sequence
gttgattactgacaatttat

SEQ ID NO: 53288 - DNA, 20 bp, Artificial
  CRISPR gRNA sequence
ttgattactgacaatttatg

SEQ ID NO: 53289 - DNA, 20 bp, Artificial
  CRISPR gRNA sequence
tgattactgacaatttatgg

SEQ ID NO: 53290 - DNA, 20 bp, Artificial
  CRISPR gRNA sequence
gattactgacaatttatggg

SEQ ID NO: 53291 - DNA, 20 bp, Artificial
  CRISPR gRNA sequence
attactgacaatttatgggg

SEQ ID NO: 53292 - DNA, 20 bp, Artificial
  CRISPR gRNA sequence
ttactgacaatttatggggg

SEQ ID NO: 53293 - DNA, 20 bp, Artificial
  CRISPR gRNA sequence
ctgacaatttatgggggggg

SEQ ID NO: 53294 - DNA, 20 bp, Artificial
  CRISPR gRNA sequence
acaatttatggggggggcgg

SEQ ID NO: 53295 - DNA, 20 bp, Artificial
  CRISPR gRNA sequence
ggggggggcggtggttactg

SEQ ID NO: 53296 - DNA, 20 bp, Artificial
  CRISPR gRNA sequence
gggggcggtggttactgaag

SEQ ID NO: 53297 - DNA, 20 bp, Artificial
  CRISPR gRNA sequence
actgaagtggtgattaaacc

SEQ ID NO: 53298 - DNA, 20 bp, Artificial
  CRISPR gRNA sequence
ggtgattaaacctagtgtgc

SEQ ID NO: 53299 - DNA, 20 bp, Artificial
  CRISPR gRNA sequence
taaacctagtgtgccggact

SEQ ID NO: 53300 - DNA, 20 bp, Artificial
  CRISPR gRNA sequence
aaacctagtgtgccggactt

SEQ ID NO: 53301 - DNA, 20 bp, Artificial
  CRISPR gRNA sequence
cctagtgtgccggacttggg

SEQ ID NO: 53302 - DNA, 20 bp, Artificial
  CRISPR gRNA sequence
cggacttgggtggtttaact

SEQ ID NO: 53303 - DNA, 20 bp, Artificial
  CRISPR gRNA sequence
gacttgggtggtttaactga

SEQ ID NO: 53304 - DNA, 20 bp, Artificial
  CRISPR gRNA sequence
gggtggtttaactgagagct

SEQ ID NO: 53305 - DNA, 20 bp, Artificial
  CRISPR gRNA sequence
tggtttaactgagagctgag

SEQ ID NO: 53306 - DNA, 20 bp, Artificial
  CRISPR gRNA sequence
ttaactgagagctgagtggt

SEQ ID NO: 53307 - DNA, 20 bp, Artificial
  CRISPR gRNA sequence
tgagagctgagtggtcagca

SEQ ID NO: 53308 - DNA, 20 bp, Artificial
  CRISPR gRNA sequence
gagagctgagtggtcagcat

SEQ ID NO: 53309 - DNA, 20 bp, Artificial
  CRISPR gRNA sequence
ctgagtggtcagcatgggtc

SEQ ID NO: 53310 - DNA, 20 bp, Artificial
  CRISPR gRNA sequence
tgagtggtcagcatgggtct

SEQ ID NO: 53311 - DNA, 20 bp, Artificial
  CRISPR gRNA sequence
gagtggtcagcatgggtctg

SEQ ID NO: 53312 - DNA, 20 bp, Artificial
  CRISPR gRNA sequence
agtggtcagcatgggtctgg

SEQ ID NO: 53313 - DNA, 20 bp, Artificial
  CRISPR gRNA sequence
ggtcagcatgggtctggggg

SEQ ID NO: 53314 - DNA, 20 bp, Artificial
  CRISPR gRNA sequence
gtcagcatgggtctgggggt

SEQ ID NO: 53315 - DNA, 20 bp, Artificial
  CRISPR gRNA sequence
tcagcatgggtctgggggtg

SEQ ID NO: 53316 - DNA, 20 bp, Artificial
  CRISPR gRNA sequence
cagcatgggtctgggggtgg

SEQ ID NO: 53317 - DNA, 20 bp, Artificial
  CRISPR gRNA sequence
agcatgggtctgggggtggg

SEQ ID NO: 53318 - DNA, 20 bp, Artificial
  CRISPR gRNA sequence
gggggtggggggacctccaa

SEQ ID NO: 53319 - DNA, 20 bp, Artificial
  CRISPR gRNA sequence
gtggggggacctccaacaga

SEQ ID NO: 53320 - DNA, 20 bp, Artificial
  CRISPR gRNA sequence
tggggggacctccaacagac

SEQ ID NO: 53321 - DNA, 20 bp, Artificial
  CRISPR gRNA sequence
ggggggacctccaacagacg

SEQ ID NO: 53322 - DNA, 20 bp, Artificial
  CRISPR gRNA sequence
gacctccaacagacggggac

SEQ ID NO: 53323 - DNA, 20 bp, Artificial
  CRISPR gRNA sequence
cctccaacagacggggacca

SEQ ID NO: 53324 - DNA, 20 bp, Artificial
  CRISPR gRNA sequence
ccaacagacggggaccagag

SEQ ID NO: 53325 - DNA, 20 bp, Artificial
  CRISPR gRNA sequence
caacagacggggaccagagc

SEQ ID NO: 53326 - DNA, 20 bp, Artificial
  CRISPR gRNA sequence
acagacggggaccagagcgg

SEQ ID NO: 53327 - DNA, 20 bp, Artificial
  CRISPR gRNA sequence
cagacggggaccagagcggg

SEQ ID NO: 53328 - DNA, 20 bp, Artificial
  CRISPR gRNA sequence
agacggggaccagagcggga

SEQ ID NO: 53329 - DNA, 20 bp, Artificial
  CRISPR gRNA sequence
gacggggaccagagcgggag

SEQ ID NO: 53330 - DNA, 20 bp, Artificial
  CRISPR gRNA sequence
ggaggggactcccccacccc

SEQ ID NO: 53331 - DNA, 20 bp, Artificial
  CRISPR gRNA sequence
ctgcttgtcttgtcccctct

SEQ ID NO: 53332 - DNA, 20 bp, Artificial
  CRISPR gRNA sequence
tgcttgtcttgtcccctctc

SEQ ID NO: 53333 - DNA, 20 bp, Artificial
  CRISPR gRNA sequence
cttgtcttgtcccctctcag

SEQ ID NO: 53334 - DNA, 20 bp, Artificial
  CRISPR gRNA sequence
ttgtcttgtcccctctcagg

SEQ ID NO: 53335 - DNA, 20 bp, Artificial
  CRISPR gRNA sequence
cccctctcaggaggatgtgt

SEQ ID NO: 53336 - DNA, 20 bp, Artificial
  CRISPR gRNA sequence
ggaggatgtgttggctttca

SEQ ID NO: 53337 - DNA, 20 bp, Artificial
  CRISPR gRNA sequence
gatgtgttggctttcaaagc

SEQ ID NO: 53338 - DNA, 20 bp, Artificial
  CRISPR gRNA sequence
gtgttggctttcaaagctgg

SEQ ID NO: 53339 - DNA, 20 bp, Artificial
  CRISPR gRNA sequence
ttggctttcaaagctggaag

SEQ ID NO: 53340 - DNA, 20 bp, Artificial
  CRISPR gRNA sequence
ggctttcaaagctggaagca

SEQ ID NO: 53341 - DNA, 20 bp, Artificial
  CRISPR gRNA sequence
ctttcaaagctggaagcaga

SEQ ID NO: 53342 - DNA, 20 bp, Artificial
  CRISPR gRNA sequence
tttcaaagctggaagcagag

SEQ ID NO: 53343 - DNA, 20 bp, Artificial
  CRISPR gRNA sequence
caaagctggaagcagagagg

SEQ ID NO: 53344 - DNA, 20 bp, Artificial
  CRISPR gRNA sequence
agctggaagcagagaggaag

SEQ ID NO: 53345 - DNA, 20 bp, Artificial
  CRISPR gRNA sequence
tggaagcagagaggaagcag

SEQ ID NO: 53346 - DNA, 20 bp, Artificial
  CRISPR gRNA sequence
aggaagcagcagtttgaaaa

SEQ ID NO: 53347 - DNA, 20 bp, Artificial
  CRISPR gRNA sequence
cagcagtttgaaaatggtca

SEQ ID NO: 53348 - DNA, 20 bp, Artificial
  CRISPR gRNA sequence
tggtcaaagaccaacttccc

SEQ ID NO: 53349 - DNA, 20 bp, Artificial
  CRISPR gRNA sequence
tcaaagaccaacttccctgg

SEQ ID NO: 53350 - DNA, 20 bp, Artificial
  CRISPR gRNA sequence
aagaccaacttccctggcag

SEQ ID NO: 53351 - DNA, 20 bp, Artificial
  CRISPR gRNA sequence
ccaacttccctggcagtggc

SEQ ID NO: 53352 - DNA, 20 bp, Artificial
  CRISPR gRNA sequence
ccctggcagtggcaagaacc

SEQ ID NO: 53353 - DNA, 20 bp, Artificial
  CRISPR gRNA sequence
gcagtggcaagaacccagac

SEQ ID NO: 53354 - DNA, 20 bp, Artificial
  CRISPR gRNA sequence
tggcaagaacccagactggt

SEQ ID NO: 53355 - DNA, 20 bp, Artificial
  CRISPR gRNA sequence
ggcaagaacccagactggtc

SEQ ID NO: 53356 - DNA, 20 bp, Artificial
  CRISPR gRNA sequence
gcaagaacccagactggtca

SEQ ID NO: 53357 - DNA, 20 bp, Artificial
  CRISPR gRNA sequence
gaacccagactggtcagggc

SEQ ID NO: 53358 - DNA, 20 bp, Artificial
  CRISPR gRNA sequence
aacccagactggtcagggca

SEQ ID NO: 53359 - DNA, 20 bp, Artificial
  CRISPR gRNA sequence
cccagactggtcagggcaag

SEQ ID NO: 53360 - DNA, 20 bp, Artificial
  CRISPR gRNA sequence
ccagactggtcagggcaagg

SEQ ID NO: 53361 - DNA, 20 bp, Artificial
  CRISPR gRNA sequence
cagactggtcagggcaagga

SEQ ID NO: 53362 - DNA, 20 bp, Artificial
  CRISPR gRNA sequence
tggtcagggcaaggagggcc

SEQ ID NO: 53363 - DNA, 20 bp, Artificial
  CRISPR gRNA sequence
ggtcagggcaaggagggcct

SEQ ID NO: 53364 - DNA, 20 bp, Artificial
  CRISPR gRNA sequence
gtcagggcaaggagggcctg

SEQ ID NO: 53365 - DNA, 20 bp, Artificial
  CRISPR gRNA sequence
agggcaaggagggcctgggg

SEQ ID NO: 53366 - DNA, 20 bp, Artificial
  CRISPR gRNA sequence
cctggggtggcctgctttct

SEQ ID NO: 53367 - DNA, 20 bp, Artificial
  CRISPR gRNA sequence
ggcctgctttcttagcaaac

SEQ ID NO: 53368 - DNA, 20 bp, Artificial
  CRISPR gRNA sequence
gcctgctttcttagcaaaca

SEQ ID NO: 53369 - DNA, 20 bp, Artificial
  CRISPR gRNA sequence
ctttcttagcaaacaaggaa

SEQ ID NO: 53370 - DNA, 20 bp, Artificial
  CRISPR gRNA sequence
tagcaaacaaggaatagatt

SEQ ID NO: 53371 - DNA, 20 bp, Artificial
  CRISPR gRNA sequence
aagcaacaattacatgtatc

SEQ ID NO: 53372 - DNA, 20 bp, Artificial
  CRISPR gRNA sequence
catgtatcaagtcacatgca

SEQ ID NO: 53373 - DNA, 20 bp, Artificial
  CRISPR gRNA sequence
tgattctcacaataaacaat

SEQ ID NO: 53374 - DNA, 20 bp, Artificial
  CRISPR gRNA sequence
gattctcacaataaacaatg

SEQ ID NO: 53375 - DNA, 20 bp, Artificial
  CRISPR gRNA sequence
ctcacaataaacaatgaggt

SEQ ID NO: 53376 - DNA, 20 bp, Artificial
  CRISPR gRNA sequence
tcttctttgttgttgtttcg

SEQ ID NO: 53377 - DNA, 20 bp, Artificial
  CRISPR gRNA sequence
ctttgttgttgtttcgaaga

SEQ ID NO: 53378 - DNA, 20 bp, Artificial
  CRISPR gRNA sequence
tttgttgttgtttcgaagaa

SEQ ID NO: 53379 - DNA, 20 bp, Artificial
  CRISPR gRNA sequence
ttgttgttgtttcgaagaaa

SEQ ID NO: 53380 - DNA, 20 bp, Artificial
  CRISPR gRNA sequence
aagggtcttgctctgtcgcc

SEQ ID NO: 53381 - DNA, 20 bp, Artificial
  CRISPR gRNA sequence
agggtcttgctctgtcgccc

SEQ ID NO: 53382 - DNA, 20 bp, Artificial
  CRISPR gRNA sequence
tcttgctctgtcgcccaggc

SEQ ID NO: 53383 - DNA, 20 bp, Artificial
  CRISPR gRNA sequence
ctgtcgcccaggctggtgtg

SEQ ID NO: 53384 - DNA, 20 bp, Artificial
  CRISPR gRNA sequence
tcgcccaggctggtgtgcag

SEQ ID NO: 53385 - DNA, 20 bp, Artificial
  CRISPR gRNA sequence
caggctggtgtgcagtggtg

SEQ ID NO: 53386 - DNA, 20 bp, Artificial
  CRISPR gRNA sequence
ggtgtgcagtggtgcagtca

SEQ ID NO: 53387 - DNA, 20 bp, Artificial
  CRISPR gRNA sequence
ggtgcagtcatggctcactg

SEQ ID NO: 53388 - DNA, 20 bp, Artificial
  CRISPR gRNA sequence
actgcagcctcaaccttccc

SEQ ID NO: 53389 - DNA, 20 bp, Artificial
  CRISPR gRNA sequence
ctgcagcctcaaccttcccc

SEQ ID NO: 53390 - DNA, 20 bp, Artificial
  CRISPR gRNA sequence
ctcaactgatcctactgcct

SEQ ID NO: 53391 - DNA, 20 bp, Artificial
  CRISPR gRNA sequence
tcctactgcctcagcctccc

SEQ ID NO: 53392 - DNA, 20 bp, Artificial
  CRISPR gRNA sequence
tactgcctcagcctcccaag

SEQ ID NO: 53393 - DNA, 20 bp, Artificial
  CRISPR gRNA sequence
gcctcagcctcccaagtagc

SEQ ID NO: 53394 - DNA, 20 bp, Artificial
  CRISPR gRNA sequence
cctcagcctcccaagtagct

SEQ ID NO: 53395 - DNA, 20 bp, Artificial
  CRISPR gRNA sequence
ctcccaagtagctgggacta

SEQ ID NO: 53396 - DNA, 20 bp, Artificial
  CRISPR gRNA sequence
tcccaagtagctgggactac

SEQ ID NO: 53397 - DNA, 20 bp, Artificial
  CRISPR gRNA sequence
tctaatttttgtattttttg

SEQ ID NO: 53398 - DNA, 20 bp, Artificial
  CRISPR gRNA sequence
taatttttgtattttttgta

SEQ ID NO: 53399 - DNA, 20 bp, Artificial
  CRISPR gRNA sequence
ttttgtattttttgtagaga

SEQ ID NO: 53400 - DNA, 20 bp, Artificial
  CRISPR gRNA sequence
tttgtattttttgtagagat

SEQ ID NO: 53401 - DNA, 20 bp, Artificial
  CRISPR gRNA sequence
ttgtattttttgtagagatg

SEQ ID NO: 53402 - DNA, 20 bp, Artificial
  CRISPR gRNA sequence
agatggggttttgccatgtt

SEQ ID NO: 53403 - DNA, 20 bp, Artificial
  CRISPR gRNA sequence
tggggttttgccatgttgag

SEQ ID NO: 53404 - DNA, 20 bp, Artificial
  CRISPR gRNA sequence
ggggttttgccatgttgagc

SEQ ID NO: 53405 - DNA, 20 bp, Artificial
  CRISPR gRNA sequence
ttttgccatgttgagcaggc

SEQ ID NO: 53406 - DNA, 20 bp, Artificial
  CRISPR gRNA sequence
caggctggtctcaaactcca

SEQ ID NO: 53407 - DNA, 20 bp, Artificial
  CRISPR gRNA sequence
ctcaaacgatcctcctgcct

SEQ ID NO: 53408 - DNA, 20 bp, Artificial
  CRISPR gRNA sequence
cctcctgccttagcctccca

SEQ ID NO: 53409 - DNA, 20 bp, Artificial
  CRISPR gRNA sequence
gccttagcctcccaaagtgc

SEQ ID NO: 53410 - DNA, 20 bp, Artificial
  CRISPR gRNA sequence
ctcccaaagtgctggaatta

SEQ ID NO: 53411 - DNA, 20 bp, Artificial
  CRISPR gRNA sequence
agtgctggaattacagatgt

SEQ ID NO: 53412 - DNA, 20 bp, Artificial
  CRISPR gRNA sequence
cctgacatttttttttcttt

SEQ ID NO: 53413 - DNA, 20 bp, Artificial
  CRISPR gRNA sequence
acatttttttttctttgaga

SEQ ID NO: 53414 - DNA, 20 bp, Artificial
  CRISPR gRNA sequence
atttttttttctttgagaca

SEQ ID NO: 53415 - DNA, 20 bp, Artificial
  CRISPR gRNA sequence
cagagtcttgctctgttgcc

SEQ ID NO: 53416 - DNA, 20 bp, Artificial
  CRISPR gRNA sequence
agagtcttgctctgttgccc

SEQ ID NO: 53417 - DNA, 20 bp, Artificial
  CRISPR gRNA sequence
tcttgctctgttgcccaggc

SEQ ID NO: 53418 - DNA, 20 bp, Artificial
  CRISPR gRNA sequence
ttgctctgttgcccaggctg

SEQ ID NO: 53419 - DNA, 20 bp, Artificial
  CRISPR gRNA sequence
ttgcccaggctggagtgcaa

SEQ ID NO: 53420 - DNA, 20 bp, Artificial
  CRISPR gRNA sequence
ggtgtgatcacaactcactg

SEQ ID NO: 53421 - DNA, 20 bp, Artificial
  CRISPR gRNA sequence
cactgtagcctcgatctcct

SEQ ID NO: 53422 - DNA, 20 bp, Artificial
  CRISPR gRNA sequence
agcctcgatctcctgagtct

SEQ ID NO: 53423 - DNA, 20 bp, Artificial
  CRISPR gRNA sequence
tctaagcaatcctcccacct

SEQ ID NO: 53424 - DNA, 20 bp, Artificial
  CRISPR gRNA sequence
tcctcccacctcagcctccc

SEQ ID NO: 53425 - DNA, 20 bp, Artificial
  CRISPR gRNA sequence
tcccacctcagcctcccaag

SEQ ID NO: 53426 - DNA, 20 bp, Artificial
  CRISPR gRNA sequence
cccacctcagcctcccaagt

SEQ ID NO: 53427 - DNA, 20 bp, Artificial
  CRISPR gRNA sequence
taggtgcatgccatcacgct

SEQ ID NO: 53428 - DNA, 20 bp, Artificial
  CRISPR gRNA sequence
tcacgcttggctaattttta

SEQ ID NO: 53429 - DNA, 20 bp, Artificial
  CRISPR gRNA sequence
gctaatttttaaagtttctg

SEQ ID NO: 53430 - DNA, 20 bp, Artificial
  CRISPR gRNA sequence
taatttttaaagtttctgta

SEQ ID NO: 53431 - DNA, 20 bp, Artificial
  CRISPR gRNA sequence
ttttaaagtttctgtagaga

SEQ ID NO: 53432 - DNA, 20 bp, Artificial
  CRISPR gRNA sequence
tttaaagtttctgtagagat

SEQ ID NO: 53433 - DNA, 20 bp, Artificial
  CRISPR gRNA sequence
ttaaagtttctgtagagatg

SEQ ID NO: 53434 - DNA, 20 bp, Artificial
  CRISPR gRNA sequence
taaagtttctgtagagatgg

SEQ ID NO: 53435 - DNA, 20 bp, Artificial
  CRISPR gRNA sequence
aaagtttctgtagagatggg

SEQ ID NO: 53436 - DNA, 20 bp, Artificial
  CRISPR gRNA sequence
aagtttctgtagagatgggg

SEQ ID NO: 53437 - DNA, 20 bp, Artificial
  CRISPR gRNA sequence
gggggtctcaccatgttgtc

SEQ ID NO: 53438 - DNA, 20 bp, Artificial
  CRISPR gRNA sequence
ggggtctcaccatgttgtcc

SEQ ID NO: 53439 - DNA, 20 bp, Artificial
  CRISPR gRNA sequence
tctcaccatgttgtccaggc

SEQ ID NO: 53440 - DNA, 20 bp, Artificial
  CRISPR gRNA sequence
ccaggctggtctcaaactcc

SEQ ID NO: 53441 - DNA, 20 bp, Artificial
  CRISPR gRNA sequence
caggctggtctcaaactcct

SEQ ID NO: 53442 - DNA, 20 bp, Artificial
  CRISPR gRNA sequence
tggtctcaaactcctaggct

SEQ ID NO: 53443 - DNA, 20 bp, Artificial
  CRISPR gRNA sequence
ggtctcaaactcctaggctc

SEQ ID NO: 53444 - DNA, 20 bp, Artificial
  CRISPR gRNA sequence
tgatcctcctcctcctgtct

SEQ ID NO: 53445 - DNA, 20 bp, Artificial
  CRISPR gRNA sequence
cctcctgtcttggcctccca

SEQ ID NO: 53446 - DNA, 20 bp, Artificial
  CRISPR gRNA sequence
gtcttggcctcccaaagtgc

SEQ ID NO: 53447 - DNA, 20 bp, Artificial
  CRISPR gRNA sequence
tcttggcctcccaaagtgct

SEQ ID NO: 53448 - DNA, 20 bp, Artificial
  CRISPR gRNA sequence
ctcccaaagtgctgggatta

SEQ ID NO: 53449 - DNA, 20 bp, Artificial
  CRISPR gRNA sequence
tcccaaagtgctgggattac

SEQ ID NO: 53450 - DNA, 20 bp, Artificial
  CRISPR gRNA sequence
agtgctgggattacaggctt

SEQ ID NO: 53451 - DNA, 20 bp, Artificial
  CRISPR gRNA sequence
acaggcttgagccactgtgc

SEQ ID NO: 53452 - DNA, 20 bp, Artificial
  CRISPR gRNA sequence
caggcttgagccactgtgcc

SEQ ID NO: 53453 - DNA, 20 bp, Artificial
  CRISPR gRNA sequence
cttgagccactgtgccaggc

SEQ ID NO: 53454 - DNA, 20 bp, Artificial
  CRISPR gRNA sequence
ttattcttatctccatttta

SEQ ID NO: 53455 - DNA, 20 bp, Artificial
  CRISPR gRNA sequence
cttatctccattttacagat

SEQ ID NO: 53456 - DNA, 20 bp, Artificial
  CRISPR gRNA sequence
ttatctccattttacagatg

SEQ ID NO: 53457 - DNA, 20 bp, Artificial
  CRISPR gRNA sequence
attttacagatgaggaaact

SEQ ID NO: 53458 - DNA, 20 bp, Artificial
  CRISPR gRNA sequence
ttttacagatgaggaaactg

SEQ ID NO: 53459 - DNA, 20 bp, Artificial
  CRISPR gRNA sequence
cagatgaggaaactgaggcc

SEQ ID NO: 53460 - DNA, 20 bp, Artificial
  CRISPR gRNA sequence
gatgaggaaactgaggcctg

SEQ ID NO: 53461 - DNA, 20 bp, Artificial
  CRISPR gRNA sequence
tgaggaaactgaggcctgga

SEQ ID NO: 53462 - DNA, 20 bp, Artificial
  CRISPR gRNA sequence
gaggaaactgaggcctggag

SEQ ID NO: 53463 - DNA, 20 bp, Artificial
  CRISPR gRNA sequence
actgaggcctggagaggctc

SEQ ID NO: 53464 - DNA, 20 bp, Artificial
  CRISPR gRNA sequence
ctgaggcctggagaggctct

SEQ ID NO: 53465 - DNA, 20 bp, Artificial
  CRISPR gRNA sequence
gaggctctgggacctgctct

SEQ ID NO: 53466 - DNA, 20 bp, Artificial
  CRISPR gRNA sequence
tgggacctgctctgagctcg

SEQ ID NO: 53467 - DNA, 20 bp, Artificial
  CRISPR gRNA sequence
gacctgctctgagctcgcag

SEQ ID NO: 53468 - DNA, 20 bp, Artificial
  CRISPR gRNA sequence
gctctgagctcgcagcagtt

SEQ ID NO: 53469 - DNA, 20 bp, Artificial
  CRISPR gRNA sequence
ctcgcagcagttaagtaact

SEQ ID NO: 53470 - DNA, 20 bp, Artificial
  CRISPR gRNA sequence
agcagttaagtaactgagcc

SEQ ID NO: 53471 - DNA, 20 bp, Artificial
  CRISPR gRNA sequence
tgagcctggtccatctgctg

SEQ ID NO: 53472 - DNA, 20 bp, Artificial
  CRISPR gRNA sequence
gctgtggcacctcccattct

SEQ ID NO: 53473 - DNA, 20 bp, Artificial
  CRISPR gRNA sequence
ctgtggcacctcccattctt

SEQ ID NO: 53474 - DNA, 20 bp, Artificial
  CRISPR gRNA sequence
tgtggcacctcccattcttg

SEQ ID NO: 53475 - DNA, 20 bp, Artificial
  CRISPR gRNA sequence
gtggcacctcccattcttgg

SEQ ID NO: 53476 - DNA, 20 bp, Artificial
  CRISPR gRNA sequence
ctcccattcttgggggtcct

SEQ ID NO: 53477 - DNA, 20 bp, Artificial
  CRISPR gRNA sequence
tcccattcttgggggtcctt

SEQ ID NO: 53478 - DNA, 20 bp, Artificial
  CRISPR gRNA sequence
cccattcttgggggtcctta

SEQ ID NO: 53479 - DNA, 20 bp, Artificial
  CRISPR gRNA sequence
attcttgggggtccttaggg

SEQ ID NO: 53480 - DNA, 20 bp, Artificial
  CRISPR gRNA sequence
ttcttgggggtccttaggga

SEQ ID NO: 53481 - DNA, 20 bp, Artificial
  CRISPR gRNA sequence
tcttgggggtccttagggaa

SEQ ID NO: 53482 - DNA, 20 bp, Artificial
  CRISPR gRNA sequence
gggggtccttagggaaggga

SEQ ID NO: 53483 - DNA, 20 bp, Artificial
  CRISPR gRNA sequence
ggggtccttagggaagggaa

SEQ ID NO: 53484 - DNA, 20 bp, Artificial
  CRISPR gRNA sequence
gggtccttagggaagggaaa

SEQ ID NO: 53485 - DNA, 20 bp, Artificial
  CRISPR gRNA sequence
tccttagggaagggaaaggg

SEQ ID NO: 53486 - DNA, 20 bp, Artificial
  CRISPR gRNA sequence
ttagggaagggaaagggaag

SEQ ID NO: 53487 - DNA, 20 bp, Artificial
  CRISPR gRNA sequence
cagacctcccctgaaaatca

SEQ ID NO: 53488 - DNA, 20 bp, Artificial
  CRISPR gRNA sequence
tcccctgaaaatcatggatg

SEQ ID NO: 53489 - DNA, 20 bp, Artificial
  CRISPR gRNA sequence
aatcatggatgcggtgccct

SEQ ID NO: 53490 - DNA, 20 bp, Artificial
  CRISPR gRNA sequence
gatgcggtgccctgagtgcc

SEQ ID NO: 53491 - DNA, 20 bp, Artificial
  CRISPR gRNA sequence
atgcggtgccctgagtgcct

SEQ ID NO: 53492 - DNA, 20 bp, Artificial
  CRISPR gRNA sequence
tgcggtgccctgagtgcctg

SEQ ID NO: 53493 - DNA, 20 bp, Artificial
  CRISPR gRNA sequence
ggtgccctgagtgcctgggg

SEQ ID NO: 53494 - DNA, 20 bp, Artificial
  CRISPR gRNA sequence
cctgagtgcctggggtggct

SEQ ID NO: 53495 - DNA, 20 bp, Artificial
  CRISPR gRNA sequence
agtgcctggggtggcttggc

SEQ ID NO: 53496 - DNA, 20 bp, Artificial
  CRISPR gRNA sequence
cctggggtggcttggctggc

SEQ ID NO: 53497 - DNA, 20 bp, Artificial
  CRISPR gRNA sequence
ctccccttttatattctcat

SEQ ID NO: 53498 - DNA, 20 bp, Artificial
  CRISPR gRNA sequence
tctcatcagctcccacaatt

SEQ ID NO: 53499 - DNA, 20 bp, Artificial
  CRISPR gRNA sequence
atcagctcccacaattaaga

SEQ ID NO: 53500 - DNA, 20 bp, Artificial
  CRISPR gRNA sequence
tcagctcccacaattaagac

SEQ ID NO: 53501 - DNA, 20 bp, Artificial
  CRISPR gRNA sequence
cacaattaagacaggtccct

SEQ ID NO: 53502 - DNA, 20 bp, Artificial
  CRISPR gRNA sequence
aagacaggtccctgagtccc

SEQ ID NO: 53503 - DNA, 20 bp, Artificial
  CRISPR gRNA sequence
acaggtccctgagtccccag

SEQ ID NO: 53504 - DNA, 20 bp, Artificial
  CRISPR gRNA sequence
cctgagtccccagtggcaac

SEQ ID NO: 53505 - DNA, 20 bp, Artificial
  CRISPR gRNA sequence
ctgagtccccagtggcaact

SEQ ID NO: 53506 - DNA, 20 bp, Artificial
  CRISPR gRNA sequence
agtccccagtggcaactagg

SEQ ID NO: 53507 - DNA, 20 bp, Artificial
  CRISPR gRNA sequence
agtggcaactaggaagctcc

SEQ ID NO: 53508 - DNA, 20 bp, Artificial
  CRISPR gRNA sequence
tttcttttcttttttttttt

SEQ ID NO: 53509 - DNA, 20 bp, Artificial
  CRISPR gRNA sequence
ttttctttttttttttgaga

SEQ ID NO: 53510 - DNA, 20 bp, Artificial
  CRISPR gRNA sequence
ttctttttttttttgagatg

SEQ ID NO: 53511 - DNA, 20 bp, Artificial
  CRISPR gRNA sequence
tggagtctcactctgtcgcc

SEQ ID NO: 53512 - DNA, 20 bp, Artificial
  CRISPR gRNA sequence
ggagtctcactctgtcgccc

SEQ ID NO: 53513 - DNA, 20 bp, Artificial
  CRISPR gRNA sequence
tctcactctgtcgcccaggc

SEQ ID NO: 53514 - DNA, 20 bp, Artificial
  CRISPR gRNA sequence
tcactctgtcgcccaggctg

SEQ ID NO: 53515 - DNA, 20 bp, Artificial
  CRISPR gRNA sequence
ctgtcgcccaggctggagtg

SEQ ID NO: 53516 - DNA, 20 bp, Artificial
  CRISPR gRNA sequence
tcgcccaggctggagtgcag

SEQ ID NO: 53517 - DNA, 20 bp, Artificial
  CRISPR gRNA sequence
ggagtgcagtggcacgatct

SEQ ID NO: 53518 - DNA, 20 bp, Artificial
  CRISPR gRNA sequence
tcactgcaaccttcgcctcc

SEQ ID NO: 53519 - DNA, 20 bp, Artificial
  CRISPR gRNA sequence
cactgcaaccttcgcctcct

SEQ ID NO: 53520 - DNA, 20 bp, Artificial
  CRISPR gRNA sequence
aaccttcgcctcctgggttc

SEQ ID NO: 53521 - DNA, 20 bp, Artificial
  CRISPR gRNA sequence
aagtgattctcctgactcct

SEQ ID NO: 53522 - DNA, 20 bp, Artificial
  CRISPR gRNA sequence
tgattctcctgactcctgag

SEQ ID NO: 53523 - DNA, 20 bp, Artificial
  CRISPR gRNA sequence
tctcctgactcctgagcggc

SEQ ID NO: 53524 - DNA, 20 bp, Artificial
  CRISPR gRNA sequence
tcctgagcggctggcactac

SEQ ID NO: 53525 - DNA, 20 bp, Artificial
  CRISPR gRNA sequence
cctgagcggctggcactaca

SEQ ID NO: 53526 - DNA, 20 bp, Artificial
  CRISPR gRNA sequence
ctgagcggctggcactacaa

SEQ ID NO: 53527 - DNA, 20 bp, Artificial
  CRISPR gRNA sequence
caagggctcacaaccacgcc

SEQ ID NO: 53528 - DNA, 20 bp, Artificial
  CRISPR gRNA sequence
gatacttttttttttttttt

SEQ ID NO: 53529 - DNA, 20 bp, Artificial
  CRISPR gRNA sequence
ttttttttttttggtatttt

SEQ ID NO: 53530 - DNA, 20 bp, Artificial
  CRISPR gRNA sequence
tttttttttggtatttttag

SEQ ID NO: 53531 - DNA, 20 bp, Artificial
  CRISPR gRNA sequence
tttttttggtatttttagca

SEQ ID NO: 53532 - DNA, 20 bp, Artificial
  CRISPR gRNA sequence
tttggtatttttagcagaga

SEQ ID NO: 53533 - DNA, 20 bp, Artificial
  CRISPR gRNA sequence
ttggtatttttagcagagac

SEQ ID NO: 53534 - DNA, 20 bp, Artificial
  CRISPR gRNA sequence
tggtatttttagcagagaca

SEQ ID NO: 53535 - DNA, 20 bp, Artificial
  CRISPR gRNA sequence
gagacagggtttcaccctgt

SEQ ID NO: 53536 - DNA, 20 bp, Artificial
  CRISPR gRNA sequence
cagggtttcaccctgttggc

SEQ ID NO: 53537 - DNA, 20 bp, Artificial
  CRISPR gRNA sequence
agggtttcaccctgttggcc

SEQ ID NO: 53538 - DNA, 20 bp, Artificial
  CRISPR gRNA sequence
ctcacgtgatccgcccacct

SEQ ID NO: 53539 - DNA, 20 bp, Artificial
  CRISPR gRNA sequence
accttggcctcccaaaatgc

SEQ ID NO: 53540 - DNA, 20 bp, Artificial
  CRISPR gRNA sequence
ccttggcctcccaaaatgct

SEQ ID NO: 53541 - DNA, 20 bp, Artificial
  CRISPR gRNA sequence
ctcccaaaatgctgggatta

SEQ ID NO: 53542 - DNA, 20 bp, Artificial
  CRISPR gRNA sequence
tcccaaaatgctgggattac

SEQ ID NO: 53543 - DNA, 20 bp, Artificial
  CRISPR gRNA sequence
aatgctgggattacaggcgt

SEQ ID NO: 53544 - DNA, 20 bp, Artificial
  CRISPR gRNA sequence
caggcgtgagccaccgcgcc

SEQ ID NO: 53545 - DNA, 20 bp, Artificial
  CRISPR gRNA sequence
gagccaccgcgcctggcccc

SEQ ID NO: 53546 - DNA, 20 bp, Artificial
  CRISPR gRNA sequence
ctggcccccagttttcttaa

SEQ ID NO: 53547 - DNA, 20 bp, Artificial
  CRISPR gRNA sequence
agttttcttaaaagtctctg

SEQ ID NO: 53548 - DNA, 20 bp, Artificial
  CRISPR gRNA sequence
gtctctgcagcataccaaca

SEQ ID NO: 53549 - DNA, 20 bp, Artificial
  CRISPR gRNA sequence
tatgttgtgcacatgtaccc

SEQ ID NO: 53550 - DNA, 20 bp, Artificial
  CRISPR gRNA sequence
cacatgtaccctagaactta

SEQ ID NO: 53551 - DNA, 20 bp, Artificial
  CRISPR gRNA sequence
tcctaaaaaaaaaaatctct

SEQ ID NO: 53552 - DNA, 20 bp, Artificial
  CRISPR gRNA sequence
cctaaaaaaaaaaatctcta

SEQ ID NO: 53553 - DNA, 20 bp, Artificial
  CRISPR gRNA sequence
aaatctctaaggactatcca

SEQ ID NO: 53554 - DNA, 20 bp, Artificial
  CRISPR gRNA sequence
ctaaggactatccaaagaac

SEQ ID NO: 53555 - DNA, 20 bp, Artificial
  CRISPR gRNA sequence
ggactatccaaagaacgagt

SEQ ID NO: 53556 - DNA, 20 bp, Artificial
  CRISPR gRNA sequence
gactatccaaagaacgagtg

SEQ ID NO: 53557 - DNA, 20 bp, Artificial
  CRISPR gRNA sequence
tatccaaagaacgagtgagg

SEQ ID NO: 53558 - DNA, 20 bp, Artificial
  CRISPR gRNA sequence
tccaaagaacgagtgaggca

SEQ ID NO: 53559 - DNA, 20 bp, Artificial
  CRISPR gRNA sequence
agagtcaatgaactctctaa

SEQ ID NO: 53560 - DNA, 20 bp, Artificial
  CRISPR gRNA sequence
gaactctctaatggtgaatt

SEQ ID NO: 53561 - DNA, 20 bp, Artificial
  CRISPR gRNA sequence
actctctaatggtgaatttg

SEQ ID NO: 53562 - DNA, 20 bp, Artificial
  CRISPR gRNA sequence
tggtgaatttggagaaattt

SEQ ID NO: 53563 - DNA, 20 bp, Artificial
  CRISPR gRNA sequence
ggagaaatttgagcatccgt

SEQ ID NO: 53564 - DNA, 20 bp, Artificial
  CRISPR gRNA sequence
gagaaatttgagcatccgtg

SEQ ID NO: 53565 - DNA, 20 bp, Artificial
  CRISPR gRNA sequence
catttgatcattcattcatt

SEQ ID NO: 53566 - DNA, 20 bp, Artificial
  CRISPR gRNA sequence
ttgatcattcattcattcag

SEQ ID NO: 53567 - DNA, 20 bp, Artificial
  CRISPR gRNA sequence
gacgcccatcacatgctctg

SEQ ID NO: 53568 - DNA, 20 bp, Artificial
  CRISPR gRNA sequence
catcacatgctctgcagatc

SEQ ID NO: 53569 - DNA, 20 bp, Artificial
  CRISPR gRNA sequence
ctgcagatctggtactgccc

SEQ ID NO: 53570 - DNA, 20 bp, Artificial
  CRISPR gRNA sequence
tgcagatctggtactgccca

SEQ ID NO: 53571 - DNA, 20 bp, Artificial
  CRISPR gRNA sequence
ctggtactgcccaaggtgct

SEQ ID NO: 53572 - DNA, 20 bp, Artificial
  CRISPR gRNA sequence
tggtactgcccaaggtgctg

SEQ ID NO: 53573 - DNA, 20 bp, Artificial
  CRISPR gRNA sequence
gcccaaggtgctgaggatga

SEQ ID NO: 53574 - DNA, 20 bp, Artificial
  CRISPR gRNA sequence
cccaaggtgctgaggatgac

SEQ ID NO: 53575 - DNA, 20 bp, Artificial
  CRISPR gRNA sequence
aggtgctgaggatgacaggt

SEQ ID NO: 53576 - DNA, 20 bp, Artificial
  CRISPR gRNA sequence
atgacaggttggcatgaaac

SEQ ID NO: 53577 - DNA, 20 bp, Artificial
  CRISPR gRNA sequence
acaggttggcatgaaactgg

SEQ ID NO: 53578 - DNA, 20 bp, Artificial
  CRISPR gRNA sequence
ttggcatgaaactggtggac

SEQ ID NO: 53579 - DNA, 20 bp, Artificial
  CRISPR gRNA sequence
tggcatgaaactggtggaca

SEQ ID NO: 53580 - DNA, 20 bp, Artificial
  CRISPR gRNA sequence
ggcatgaaactggtggacaa

SEQ ID NO: 53581 - DNA, 20 bp, Artificial
  CRISPR gRNA sequence
gcatgaaactggtggacaag

SEQ ID NO: 53582 - DNA, 20 bp, Artificial
  CRISPR gRNA sequence
tggtggacaaggggcccacg

SEQ ID NO: 53583 - DNA, 20 bp, Artificial
  CRISPR gRNA sequence
ggtggacaaggggcccacgt

SEQ ID NO: 53584 - DNA, 20 bp, Artificial
  CRISPR gRNA sequence
tggacaaggggcccacgtgg

SEQ ID NO: 53585 - DNA, 20 bp, Artificial
  CRISPR gRNA sequence
acaaggggcccacgtgggag

SEQ ID NO: 53586 - DNA, 20 bp, Artificial
  CRISPR gRNA sequence
acgtgggagcagatgacctg

SEQ ID NO: 53587 - DNA, 20 bp, Artificial
  CRISPR gRNA sequence
cgtgggagcagatgacctgt

SEQ ID NO: 53588 - DNA, 20 bp, Artificial
  CRISPR gRNA sequence
ggagcagatgacctgtggga

SEQ ID NO: 53589 - DNA, 20 bp, Artificial
  CRISPR gRNA sequence
gagcagatgacctgtgggat

SEQ ID NO: 53590 - DNA, 20 bp, Artificial
  CRISPR gRNA sequence
agcagatgacctgtgggatg

SEQ ID NO: 53591 - DNA, 20 bp, Artificial
  CRISPR gRNA sequence
gcagatgacctgtgggatgg

SEQ ID NO: 53592 - DNA, 20 bp, Artificial
  CRISPR gRNA sequence
atgacctgtgggatggggga

SEQ ID NO: 53593 - DNA, 20 bp, Artificial
  CRISPR gRNA sequence
tgacctgtgggatgggggac

SEQ ID NO: 53594 - DNA, 20 bp, Artificial
  CRISPR gRNA sequence
gacctgtgggatgggggaca

SEQ ID NO: 53595 - DNA, 20 bp, Artificial
  CRISPR gRNA sequence
acctgtgggatgggggacag

SEQ ID NO: 53596 - DNA, 20 bp, Artificial
  CRISPR gRNA sequence
tgtgggatgggggacagggg

SEQ ID NO: 53597 - DNA, 20 bp, Artificial
  CRISPR gRNA sequence
gtgggatgggggacaggggc

SEQ ID NO: 53598 - DNA, 20 bp, Artificial
  CRISPR gRNA sequence
tgggatgggggacaggggca

SEQ ID NO: 53599 - DNA, 20 bp, Artificial
  CRISPR gRNA sequence
atgggggacaggggcagggc

SEQ ID NO: 53600 - DNA, 20 bp, Artificial
  CRISPR gRNA sequence
tgggggacaggggcagggct

SEQ ID NO: 53601 - DNA, 20 bp, Artificial
  CRISPR gRNA sequence
gggggacaggggcagggctg

SEQ ID NO: 53602 - DNA, 20 bp, Artificial
  CRISPR gRNA sequence
ggggacaggggcagggctgg

SEQ ID NO: 53603 - DNA, 20 bp, Artificial
  CRISPR gRNA sequence
gacaggggcagggctggggg

SEQ ID NO: 53604 - DNA, 20 bp, Artificial
  CRISPR gRNA sequence
caggggcagggctgggggcg

SEQ ID NO: 53605 - DNA, 20 bp, Artificial
  CRISPR gRNA sequence
ggggcagggctgggggcgga

SEQ ID NO: 53606 - DNA, 20 bp, Artificial
  CRISPR gRNA sequence
gggcagggctgggggcggag

SEQ ID NO: 53607 - DNA, 20 bp, Artificial
  CRISPR gRNA sequence
ggcacgctcacctgatgtcc

SEQ ID NO: 53608 - DNA, 20 bp, Artificial
  CRISPR gRNA sequence
acgctcacctgatgtccaag

SEQ ID NO: 53609 - DNA, 20 bp, Artificial
  CRISPR gRNA sequence
ctcacctgatgtccaagcgg

SEQ ID NO: 53610 - DNA, 20 bp, Artificial
  CRISPR gRNA sequence
cacctgatgtccaagcggaa

SEQ ID NO: 53611 - DNA, 20 bp, Artificial
  CRISPR gRNA sequence
tccaagcggaagagccactg

SEQ ID NO: 53612 - DNA, 20 bp, Artificial
  CRISPR gRNA sequence
caagcggaagagccactgca

SEQ ID NO: 53613 - DNA, 20 bp, Artificial
  CRISPR gRNA sequence
gcggaagagccactgcagag

SEQ ID NO: 53614 - DNA, 20 bp, Artificial
  CRISPR gRNA sequence
ggaagagccactgcagagtg

SEQ ID NO: 53615 - DNA, 20 bp, Artificial
  CRISPR gRNA sequence
agagccactgcagagtggag

SEQ ID NO: 53616 - DNA, 20 bp, Artificial
  CRISPR gRNA sequence
gcaccgaaccaaacccaaca

SEQ ID NO: 53617 - DNA, 20 bp, Artificial
  CRISPR gRNA sequence
accaaacccaacacggcatc

SEQ ID NO: 53618 - DNA, 20 bp, Artificial
  CRISPR gRNA sequence
ccaaacccaacacggcatcc

SEQ ID NO: 53619 - DNA, 20 bp, Artificial
  CRISPR gRNA sequence
caaacccaacacggcatcca

SEQ ID NO: 53620 - DNA, 20 bp, Artificial
  CRISPR gRNA sequence
agggacaaaccgttctcact

SEQ ID NO: 53621 - DNA, 20 bp, Artificial
  CRISPR gRNA sequence
gggacaaaccgttctcactg

SEQ ID NO: 53622 - DNA, 20 bp, Artificial
  CRISPR gRNA sequence
caaaccgttctcactgaggc

SEQ ID NO: 53623 - DNA, 20 bp, Artificial
  CRISPR gRNA sequence
aaccgttctcactgaggctg

SEQ ID NO: 53624 - DNA, 20 bp, Artificial
  CRISPR gRNA sequence
ctcactgaggctggagatca

SEQ ID NO: 53625 - DNA, 20 bp, Artificial
  CRISPR gRNA sequence
tcactgaggctggagatcac

SEQ ID NO: 53626 - DNA, 20 bp, Artificial
  CRISPR gRNA sequence
cactgaggctggagatcaca

SEQ ID NO: 53627 - DNA, 20 bp, Artificial
  CRISPR gRNA sequence
actgaggctggagatcacag

SEQ ID NO: 53628 - DNA, 20 bp, Artificial
  CRISPR gRNA sequence
gaggctggagatcacagggg

SEQ ID NO: 53629 - DNA, 20 bp, Artificial
  CRISPR gRNA sequence
agatcacaggggtggcacaa

SEQ ID NO: 53630 - DNA, 20 bp, Artificial
  CRISPR gRNA sequence
atcacaggggtggcacaatg

SEQ ID NO: 53631 - DNA, 20 bp, Artificial
  CRISPR gRNA sequence
tcacaggggtggcacaatgg

SEQ ID NO: 53632 - DNA, 20 bp, Artificial
  CRISPR gRNA sequence
gtggcacaatggaggtcact

SEQ ID NO: 53633 - DNA, 20 bp, Artificial
  CRISPR gRNA sequence
tggcacaatggaggtcactc

SEQ ID NO: 53634 - DNA, 20 bp, Artificial
  CRISPR gRNA sequence
acccaaacacatcctctttg

SEQ ID NO: 53635 - DNA, 20 bp, Artificial
  CRISPR gRNA sequence
aaacacatcctctttgtggt

SEQ ID NO: 53636 - DNA, 20 bp, Artificial
  CRISPR gRNA sequence
aacacatcctctttgtggtc

SEQ ID NO: 53637 - DNA, 20 bp, Artificial
  CRISPR gRNA sequence
acacatcctctttgtggtca

SEQ ID NO: 53638 - DNA, 20 bp, Artificial
  CRISPR gRNA sequence
tcctctttgtggtcagggca

SEQ ID NO: 53639 - DNA, 20 bp, Artificial
  CRISPR gRNA sequence
cctctttgtggtcagggcac

SEQ ID NO: 53640 - DNA, 20 bp, Artificial
  CRISPR gRNA sequence
ctctttgtggtcagggcaca

SEQ ID NO: 53641 - DNA, 20 bp, Artificial
  CRISPR gRNA sequence
tttgtggtcagggcacaggg

SEQ ID NO: 53642 - DNA, 20 bp, Artificial
  CRISPR gRNA sequence
ttgtggtcagggcacagggc

SEQ ID NO: 53643 - DNA, 20 bp, Artificial
  CRISPR gRNA sequence
tgtggtcagggcacagggcg

SEQ ID NO: 53644 - DNA, 20 bp, Artificial
  CRISPR gRNA sequence
gtggtcagggcacagggcgg

SEQ ID NO: 53645 - DNA, 20 bp, Artificial
  CRISPR gRNA sequence
ggtcagggcacagggcgggg

SEQ ID NO: 53646 - DNA, 20 bp, Artificial
  CRISPR gRNA sequence
gtcagggcacagggcggggg

SEQ ID NO: 53647 - DNA, 20 bp, Artificial
  CRISPR gRNA sequence
tcagggcacagggcggggga

SEQ ID NO: 53648 - DNA, 20 bp, Artificial
  CRISPR gRNA sequence
cagggcgggggagggatccc

SEQ ID NO: 53649 - DNA, 20 bp, Artificial
  CRISPR gRNA sequence
gggggagggatccctggttc

SEQ ID NO: 53650 - DNA, 20 bp, Artificial
  CRISPR gRNA sequence
ggatccctggttccagatga

SEQ ID NO: 53651 - DNA, 20 bp, Artificial
  CRISPR gRNA sequence
tgacggaacccactgaaccc

SEQ ID NO: 53652 - DNA, 20 bp, Artificial
  CRISPR gRNA sequence
ggaacccactgaacccaaga

SEQ ID NO: 53653 - DNA, 20 bp, Artificial
  CRISPR gRNA sequence
cccactgaacccaagatggt

SEQ ID NO: 53654 - DNA, 20 bp, Artificial
  CRISPR gRNA sequence
cactgaacccaagatggtca

SEQ ID NO: 53655 - DNA, 20 bp, Artificial
  CRISPR gRNA sequence
ctgaacccaagatggtcaga

SEQ ID NO: 53656 - DNA, 20 bp, Artificial
  CRISPR gRNA sequence
ggtcagagagcaccccttgc

SEQ ID NO: 53657 - DNA, 20 bp, Artificial
  CRISPR gRNA sequence
gcaccccttgcaagtcctca

SEQ ID NO: 53658 - DNA, 20 bp, Artificial
  CRISPR gRNA sequence
ccccttgcaagtcctcatgg

SEQ ID NO: 53659 - DNA, 20 bp, Artificial
  CRISPR gRNA sequence
ccttgcaagtcctcatggtg

SEQ ID NO: 53660 - DNA, 20 bp, Artificial
  CRISPR gRNA sequence
gcaagtcctcatggtggaga

SEQ ID NO: 53661 - DNA, 20 bp, Artificial
  CRISPR gRNA sequence
caagtcctcatggtggagat

SEQ ID NO: 53662 - DNA, 20 bp, Artificial
  CRISPR gRNA sequence
aagtcctcatggtggagatg

SEQ ID NO: 53663 - DNA, 20 bp, Artificial
  CRISPR gRNA sequence
tcatggtggagatggggaaa

SEQ ID NO: 53664 - DNA, 20 bp, Artificial
  CRISPR gRNA sequence
atggtggagatggggaaaca

SEQ ID NO: 53665 - DNA, 20 bp, Artificial
  CRISPR gRNA sequence
gagatggggaaacagagtcc

SEQ ID NO: 53666 - DNA, 20 bp, Artificial
  CRISPR gRNA sequence
gatggggaaacagagtccta

SEQ ID NO: 53667 - DNA, 20 bp, Artificial
  CRISPR gRNA sequence
tggggaaacagagtcctaga

SEQ ID NO: 53668 - DNA, 20 bp, Artificial
  CRISPR gRNA sequence
acagagtcctagagagaatc

SEQ ID NO: 53669 - DNA, 20 bp, Artificial
  CRISPR gRNA sequence
cagagtcctagagagaatca

SEQ ID NO: 53670 - DNA, 20 bp, Artificial
  CRISPR gRNA sequence
tcctagagagaatcaaggtc

SEQ ID NO: 53671 - DNA, 20 bp, Artificial
  CRISPR gRNA sequence
agagaatcaaggtctagccc

SEQ ID NO: 53672 - DNA, 20 bp, Artificial
  CRISPR gRNA sequence
gagaatcaaggtctagccca

SEQ ID NO: 53673 - DNA, 20 bp, Artificial
  CRISPR gRNA sequence
aaggtctagcccaaggttat

SEQ ID NO: 53674 - DNA, 20 bp, Artificial
  CRISPR gRNA sequence
cccaaggttatgagacatgt

SEQ ID NO: 53675 - DNA, 20 bp, Artificial
  CRISPR gRNA sequence
gttatgagacatgttggtga

SEQ ID NO: 53676 - DNA, 20 bp, Artificial
  CRISPR gRNA sequence
tatgagacatgttggtgaca

SEQ ID NO: 53677 - DNA, 20 bp, Artificial
  CRISPR gRNA sequence
gacatgttggtgacagagct

SEQ ID NO: 53678 - DNA, 20 bp, Artificial
  CRISPR gRNA sequence
tgttggtgacagagctgaga

SEQ ID NO: 53679 - DNA, 20 bp, Artificial
  CRISPR gRNA sequence
gttggtgacagagctgagat

SEQ ID NO: 53680 - DNA, 20 bp, Artificial
  CRISPR gRNA sequence
acagagctgagatgggcacc

SEQ ID NO: 53681 - DNA, 20 bp, Artificial
  CRISPR gRNA sequence
gagctgagatgggcacccag

SEQ ID NO: 53682 - DNA, 20 bp, Artificial
  CRISPR gRNA sequence
agctgagatgggcacccagt

SEQ ID NO: 53683 - DNA, 20 bp, Artificial
  CRISPR gRNA sequence
tgggcacccagtgggtccct

SEQ ID NO: 53684 - DNA, 20 bp, Artificial
  CRISPR gRNA sequence
gtgggtccctcggtctgtga

SEQ ID NO: 53685 - DNA, 20 bp, Artificial
  CRISPR gRNA sequence
cctcggtctgtgatggatct

SEQ ID NO: 53686 - DNA, 20 bp, Artificial
  CRISPR gRNA sequence
ctcggtctgtgatggatctg

SEQ ID NO: 53687 - DNA, 20 bp, Artificial
  CRISPR gRNA sequence
cggtctgtgatggatctgag

SEQ ID NO: 53688 - DNA, 20 bp, Artificial
  CRISPR gRNA sequence
tggatctgaggagtgctttc

SEQ ID NO: 53689 - DNA, 20 bp, Artificial
  CRISPR gRNA sequence
tctgaggagtgctttctggc

SEQ ID NO: 53690 - DNA, 20 bp, Artificial
  CRISPR gRNA sequence
tgaggagtgctttctggctg

SEQ ID NO: 53691 - DNA, 20 bp, Artificial
  CRISPR gRNA sequence
gagtgctttctggctggagc

SEQ ID NO: 53692 - DNA, 20 bp, Artificial
  CRISPR gRNA sequence
agtgctttctggctggagct

SEQ ID NO: 53693 - DNA, 20 bp, Artificial
  CRISPR gRNA sequence
cctccttttctccacctgat

SEQ ID NO: 53694 - DNA, 20 bp, Artificial
  CRISPR gRNA sequence
ctccttttctccacctgata

SEQ ID NO: 53695 - DNA, 20 bp, Artificial
  CRISPR gRNA sequence
tccttttctccacctgataa

SEQ ID NO: 53696 - DNA, 20 bp, Artificial
  CRISPR gRNA sequence
cttttctccacctgataagg

SEQ ID NO: 53697 - DNA, 20 bp, Artificial
  CRISPR gRNA sequence
ttttctccacctgataaggg

SEQ ID NO: 53698 - DNA, 20 bp, Artificial
  CRISPR gRNA sequence
tttctccacctgataaggga

SEQ ID NO: 53699 - DNA, 20 bp, Artificial
  CRISPR gRNA sequence
ttctccacctgataagggag

SEQ ID NO: 53700 - DNA, 20 bp, Artificial
  CRISPR gRNA sequence
tccacctgataagggagggg

SEQ ID NO: 53701 - DNA, 20 bp, Artificial
  CRISPR gRNA sequence
gataagggaggggtggtacc

SEQ ID NO: 53702 - DNA, 20 bp, Artificial
  CRISPR gRNA sequence
ataagggaggggtggtaccc

SEQ ID NO: 53703 - DNA, 20 bp, Artificial
  CRISPR gRNA sequence
cccaggacaaaatgaaaatg

SEQ ID NO: 53704 - DNA, 20 bp, Artificial
  CRISPR gRNA sequence
ccaggacaaaatgaaaatgc

SEQ ID NO: 53705 - DNA, 20 bp, Artificial
  CRISPR gRNA sequence
caggacaaaatgaaaatgca

SEQ ID NO: 53706 - DNA, 20 bp, Artificial
  CRISPR gRNA sequence
aaaatgcagggtctcttgtg

SEQ ID NO: 53707 - DNA, 20 bp, Artificial
  CRISPR gRNA sequence
tgcagggtctcttgtgcaga

SEQ ID NO: 53708 - DNA, 20 bp, Artificial
  CRISPR gRNA sequence
agggtctcttgtgcagaaag

SEQ ID NO: 53709 - DNA, 20 bp, Artificial
  CRISPR gRNA sequence
gggtctcttgtgcagaaagc

SEQ ID NO: 53710 - DNA, 20 bp, Artificial
  CRISPR gRNA sequence
ttgtgcagaaagcaggaaca

SEQ ID NO: 53711 - DNA, 20 bp, Artificial
  CRISPR gRNA sequence
acaaagtgtctcctttcttt

SEQ ID NO: 53712 - DNA, 20 bp, Artificial
  CRISPR gRNA sequence
caaagtgtctcctttctttc

SEQ ID NO: 53713 - DNA, 20 bp, Artificial
  CRISPR gRNA sequence
aaagtgtctcctttctttca

SEQ ID NO: 53714 - DNA, 20 bp, Artificial
  CRISPR gRNA sequence
aatgctacactcccctccca

SEQ ID NO: 53715 - DNA, 20 bp, Artificial
  CRISPR gRNA sequence
atgctacactcccctcccac

SEQ ID NO: 53716 - DNA, 20 bp, Artificial
  CRISPR gRNA sequence
tgctacactcccctcccacg

SEQ ID NO: 53717 - DNA, 20 bp, Artificial
  CRISPR gRNA sequence
ctcccctcccacggggacac

SEQ ID NO: 53718 - DNA, 20 bp, Artificial
  CRISPR gRNA sequence
ccctcccacggggacactgg

SEQ ID NO: 53719 - DNA, 20 bp, Artificial
  CRISPR gRNA sequence
cctcccacggggacactggt

SEQ ID NO: 53720 - DNA, 20 bp, Artificial
  CRISPR gRNA sequence
ctcccacggggacactggta

SEQ ID NO: 53721 - DNA, 20 bp, Artificial
  CRISPR gRNA sequence
cacggggacactggtagggc

SEQ ID NO: 53722 - DNA, 20 bp, Artificial
  CRISPR gRNA sequence
ggacactggtagggcgagtg

SEQ ID NO: 53723 - DNA, 20 bp, Artificial
  CRISPR gRNA sequence
agggcgagtgtggaccctca

SEQ ID NO: 53724 - DNA, 20 bp, Artificial
  CRISPR gRNA sequence
agtgtggaccctcacagcac

SEQ ID NO: 53725 - DNA, 20 bp, Artificial
  CRISPR gRNA sequence
gtgtggaccctcacagcacc

SEQ ID NO: 53726 - DNA, 20 bp, Artificial
  CRISPR gRNA sequence
ccctcacagcaccaggtcac

SEQ ID NO: 53727 - DNA, 20 bp, Artificial
  CRISPR gRNA sequence
ggtcacgagtccacactaat

SEQ ID NO: 53728 - DNA, 20 bp, Artificial
  CRISPR gRNA sequence
cacgagtccacactaataag

SEQ ID NO: 53729 - DNA, 20 bp, Artificial
  CRISPR gRNA sequence
acgagtccacactaataaga

SEQ ID NO: 53730 - DNA, 20 bp, Artificial
  CRISPR gRNA sequence
cactaataagaaggtcacat

SEQ ID NO: 53731 - DNA, 20 bp, Artificial
  CRISPR gRNA sequence
actaataagaaggtcacatg

SEQ ID NO: 53732 - DNA, 20 bp, Artificial
  CRISPR gRNA sequence
tgaggacatactaaaacctc

SEQ ID NO: 53733 - DNA, 20 bp, Artificial
  CRISPR gRNA sequence
ttcatgtaatttgcctgcaa

SEQ ID NO: 53734 - DNA, 20 bp, Artificial
  CRISPR gRNA sequence
tgtaatttgcctgcaatggt

SEQ ID NO: 53735 - DNA, 20 bp, Artificial
  CRISPR gRNA sequence
gttagaccttccttccttcc

SEQ ID NO: 53736 - DNA, 20 bp, Artificial
  CRISPR gRNA sequence
ttagaccttccttccttccc

SEQ ID NO: 53737 - DNA, 20 bp, Artificial
  CRISPR gRNA sequence
ccttccttccttcccaggtg

SEQ ID NO: 53738 - DNA, 20 bp, Artificial
  CRISPR gRNA sequence
cttccttccttcccaggtgc

SEQ ID NO: 53739 - DNA, 20 bp, Artificial
  CRISPR gRNA sequence
tcccaggtgcaggccctgaa

SEQ ID NO: 53740 - DNA, 20 bp, Artificial
  CRISPR gRNA sequence
cccaggtgcaggccctgaac

SEQ ID NO: 53741 - DNA, 20 bp, Artificial
  CRISPR gRNA sequence
gcaggccctgaacaggaacc

SEQ ID NO: 53742 - DNA, 20 bp, Artificial
  CRISPR gRNA sequence
caggccctgaacaggaacca

SEQ ID NO: 53743 - DNA, 20 bp, Artificial
  CRISPR gRNA sequence
aaggcaactcccttccttcc

SEQ ID NO: 53744 - DNA, 20 bp, Artificial
  CRISPR gRNA sequence
ttcccagcattgcacaaaaa

SEQ ID NO: 53745 - DNA, 20 bp, Artificial
  CRISPR gRNA sequence
tcccagcattgcacaaaaac

SEQ ID NO: 53746 - DNA, 20 bp, Artificial
  CRISPR gRNA sequence
cccagcattgcacaaaaaca

SEQ ID NO: 53747 - DNA, 20 bp, Artificial
  CRISPR gRNA sequence
attgcacaaaaacagggtgt

SEQ ID NO: 53748 - DNA, 20 bp, Artificial
  CRISPR gRNA sequence
gcacaaaaacagggtgtgag

SEQ ID NO: 53749 - DNA, 20 bp, Artificial
  CRISPR gRNA sequence
cacaaaaacagggtgtgagc

SEQ ID NO: 53750 - DNA, 20 bp, Artificial
  CRISPR gRNA sequence
acaaaaacagggtgtgagca

SEQ ID NO: 53751 - DNA, 20 bp, Artificial
  CRISPR gRNA sequence
caaaaacagggtgtgagcag

SEQ ID NO: 53752 - DNA, 20 bp, Artificial
  CRISPR gRNA sequence
aaaaacagggtgtgagcagg

SEQ ID NO: 53753 - DNA, 20 bp, Artificial
  CRISPR gRNA sequence
gggtgtgagcagggggtcct

SEQ ID NO: 53754 - DNA, 20 bp, Artificial
  CRISPR gRNA sequence
ggtgtgagcagggggtcctt

SEQ ID NO: 53755 - DNA, 20 bp, Artificial
  CRISPR gRNA sequence
agcagggggtccttaggccc

SEQ ID NO: 53756 - DNA, 20 bp, Artificial
  CRISPR gRNA sequence
ttaggccccagcactcattt

SEQ ID NO: 53757 - DNA, 20 bp, Artificial
  CRISPR gRNA sequence
aggccccagcactcatttca

SEQ ID NO: 53758 - DNA, 20 bp, Artificial
  CRISPR gRNA sequence
agcactcatttcagagatcg

SEQ ID NO: 53759 - DNA, 20 bp, Artificial
  CRISPR gRNA sequence
tcagagatcgtagccaccaa

SEQ ID NO: 53760 - DNA, 20 bp, Artificial
  CRISPR gRNA sequence
agagatcgtagccaccaaca

SEQ ID NO: 53761 - DNA, 20 bp, Artificial
  CRISPR gRNA sequence
gagatcgtagccaccaacag

SEQ ID NO: 53762 - DNA, 20 bp, Artificial
  CRISPR gRNA sequence
caatttatgtatttaccgac

SEQ ID NO: 53763 - DNA, 20 bp, Artificial
  CRISPR gRNA sequence
aatttatgtatttaccgact

SEQ ID NO: 53764 - DNA, 20 bp, Artificial
  CRISPR gRNA sequence
tgtatttaccgactgggaac

SEQ ID NO: 53765 - DNA, 20 bp, Artificial
  CRISPR gRNA sequence
gtatttaccgactgggaacc

SEQ ID NO: 53766 - DNA, 20 bp, Artificial
  CRISPR gRNA sequence
tatttaccgactgggaacca

SEQ ID NO: 53767 - DNA, 20 bp, Artificial
  CRISPR gRNA sequence
ccgactgggaaccagggact

SEQ ID NO: 53768 - DNA, 20 bp, Artificial
  CRISPR gRNA sequence
gactgggaaccagggactcg

SEQ ID NO: 53769 - DNA, 20 bp, Artificial
  CRISPR gRNA sequence
ctgggaaccagggactcgga

SEQ ID NO: 53770 - DNA, 20 bp, Artificial
  CRISPR gRNA sequence
tgggaaccagggactcggag

SEQ ID NO: 53771 - DNA, 20 bp, Artificial
  CRISPR gRNA sequence
gggaaccagggactcggaga

SEQ ID NO: 53772 - DNA, 20 bp, Artificial
  CRISPR gRNA sequence
ggaaccagggactcggagag

SEQ ID NO: 53773 - DNA, 20 bp, Artificial
  CRISPR gRNA sequence
gagaggggatgtaacttgcc

SEQ ID NO: 53774 - DNA, 20 bp, Artificial
  CRISPR gRNA sequence
gtaacttgcccagaatcaca

SEQ ID NO: 53775 - DNA, 20 bp, Artificial
  CRISPR gRNA sequence
ttgcccagaatcacacagca

SEQ ID NO: 53776 - DNA, 20 bp, Artificial
  CRISPR gRNA sequence
cacacagcaaagcgtgttca

SEQ ID NO: 53777 - DNA, 20 bp, Artificial
  CRISPR gRNA sequence
cacagcaaagcgtgttcaca

SEQ ID NO: 53778 - DNA, 20 bp, Artificial
  CRISPR gRNA sequence
gcaaagcgtgttcacagaga

SEQ ID NO: 53779 - DNA, 20 bp, Artificial
  CRISPR gRNA sequence
gcgtgttcacagagacagcc

SEQ ID NO: 53780 - DNA, 20 bp, Artificial
  CRISPR gRNA sequence
cacagagacagcctggaata

SEQ ID NO: 53781 - DNA, 20 bp, Artificial
  CRISPR gRNA sequence
acagagacagcctggaatat

SEQ ID NO: 53782 - DNA, 20 bp, Artificial
  CRISPR gRNA sequence
aggacctgtgacctctcccc

SEQ ID NO: 53783 - DNA, 20 bp, Artificial
  CRISPR gRNA sequence
ggacctgtgacctctcccct

SEQ ID NO: 53784 - DNA, 20 bp, Artificial
  CRISPR gRNA sequence
acctctcccctgggctcctc

SEQ ID NO: 53785 - DNA, 20 bp, Artificial
  CRISPR gRNA sequence
cccctgggctcctctggctt

SEQ ID NO: 53786 - DNA, 20 bp, Artificial
  CRISPR gRNA sequence
gggctcctctggctttggcc

SEQ ID NO: 53787 - DNA, 20 bp, Artificial
  CRISPR gRNA sequence
ctcctctggctttggcccag

SEQ ID NO: 53788 - DNA, 20 bp, Artificial
  CRISPR gRNA sequence
ggctttggcccagaagtgcc

SEQ ID NO: 53789 - DNA, 20 bp, Artificial
  CRISPR gRNA sequence
gctttggcccagaagtgcct

SEQ ID NO: 53790 - DNA, 20 bp, Artificial
  CRISPR gRNA sequence
tttggcccagaagtgcctgg

SEQ ID NO: 53791 - DNA, 20 bp, Artificial
  CRISPR gRNA sequence
ttggcccagaagtgcctggg

SEQ ID NO: 53792 - DNA, 20 bp, Artificial
  CRISPR gRNA sequence
ggcccagaagtgcctgggag

SEQ ID NO: 53793 - DNA, 20 bp, Artificial
  CRISPR gRNA sequence
gcccagaagtgcctgggagg

SEQ ID NO: 53794 - DNA, 20 bp, Artificial
  CRISPR gRNA sequence
cccagaagtgcctgggagga

SEQ ID NO: 53795 - DNA, 20 bp, Artificial
  CRISPR gRNA sequence
ccagaagtgcctgggaggag

SEQ ID NO: 53796 - DNA, 20 bp, Artificial
  CRISPR gRNA sequence
cagaagtgcctgggaggagg

SEQ ID NO: 53797 - DNA, 20 bp, Artificial
  CRISPR gRNA sequence
gggaggagggggtgctttgt

SEQ ID NO: 53798 - DNA, 20 bp, Artificial
  CRISPR gRNA sequence
gggggtgctttgtgagccaa

SEQ ID NO: 53799 - DNA, 20 bp, Artificial
  CRISPR gRNA sequence
ctttgtgagccaaaagcacc

SEQ ID NO: 53800 - DNA, 20 bp, Artificial
  CRISPR gRNA sequence
tttgtgagccaaaagcacca

SEQ ID NO: 53801 - DNA, 20 bp, Artificial
  CRISPR gRNA sequence
ttgtgagccaaaagcaccaa

SEQ ID NO: 53802 - DNA, 20 bp, Artificial
  CRISPR gRNA sequence
ccaaaagcaccaagggcatt

SEQ ID NO: 53803 - DNA, 20 bp, Artificial
  CRISPR gRNA sequence
caaaagcaccaagggcattt

SEQ ID NO: 53804 - DNA, 20 bp, Artificial
  CRISPR gRNA sequence
aaaagcaccaagggcattta

SEQ ID NO: 53805 - DNA, 20 bp, Artificial
  CRISPR gRNA sequence
accaagggcatttagggatc

SEQ ID NO: 53806 - DNA, 20 bp, Artificial
  CRISPR gRNA sequence
catttagggatcaagaactc

SEQ ID NO: 53807 - DNA, 20 bp, Artificial
  CRISPR gRNA sequence
tcaagaactctggtccattg

SEQ ID NO: 53808 - DNA, 20 bp, Artificial
  CRISPR gRNA sequence
caagaactctggtccattgc

SEQ ID NO: 53809 - DNA, 20 bp, Artificial
  CRISPR gRNA sequence
ggtccattgcaggcaaactt

SEQ ID NO: 53810 - DNA, 20 bp, Artificial
  CRISPR gRNA sequence
gtccattgcaggcaaacttt

SEQ ID NO: 53811 - DNA, 20 bp, Artificial
  CRISPR gRNA sequence
tccattgcaggcaaactttg

SEQ ID NO: 53812 - DNA, 20 bp, Artificial
  CRISPR gRNA sequence
tcctcctacacactctctgc

SEQ ID NO: 53813 - DNA, 20 bp, Artificial
  CRISPR gRNA sequence
cctcctacacactctctgcc

SEQ ID NO: 53814 - DNA, 20 bp, Artificial
  CRISPR gRNA sequence
cacactctctgccaggtact

SEQ ID NO: 53815 - DNA, 20 bp, Artificial
  CRISPR gRNA sequence
acactctctgccaggtactc

SEQ ID NO: 53816 - DNA, 20 bp, Artificial
  CRISPR gRNA sequence
cactctctgccaggtactca

SEQ ID NO: 53817 - DNA, 20 bp, Artificial
  CRISPR gRNA sequence
gccaggtactcagggatcct

SEQ ID NO: 53818 - DNA, 20 bp, Artificial
  CRISPR gRNA sequence
aggtactcagggatccttgg

SEQ ID NO: 53819 - DNA, 20 bp, Artificial
  CRISPR gRNA sequence
tcagggatccttggcagccc

SEQ ID NO: 53820 - DNA, 20 bp, Artificial
  CRISPR gRNA sequence
cagggatccttggcagccct

SEQ ID NO: 53821 - DNA, 20 bp, Artificial
  CRISPR gRNA sequence
cagccctgggcaccctgctt

SEQ ID NO: 53822 - DNA, 20 bp, Artificial
  CRISPR gRNA sequence
ccctgcttgagtgtcctctc

SEQ ID NO: 53823 - DNA, 20 bp, Artificial
  CRISPR gRNA sequence
tgtctaccctgaccataccc

SEQ ID NO: 53824 - DNA, 20 bp, Artificial
  CRISPR gRNA sequence
cctgaccataccccagctaa

SEQ ID NO: 53825 - DNA, 20 bp, Artificial
  CRISPR gRNA sequence
cataccccagctaacagccc

SEQ ID NO: 53826 - DNA, 20 bp, Artificial
  CRISPR gRNA sequence
ctaacagccccagcccctcc

SEQ ID NO: 53827 - DNA, 20 bp, Artificial
  CRISPR gRNA sequence
cccagcccctcccggcaccc

SEQ ID NO: 53828 - DNA, 20 bp, Artificial
  CRISPR gRNA sequence
ccagcccctcccggcacccc

SEQ ID NO: 53829 - DNA, 20 bp, Artificial
  CRISPR gRNA sequence
cagcccctcccggcacccca

SEQ ID NO: 53830 - DNA, 20 bp, Artificial
  CRISPR gRNA sequence
ccctcccggcaccccagggc

SEQ ID NO: 53831 - DNA, 20 bp, Artificial
  CRISPR gRNA sequence
agggccagaataacaactgc

SEQ ID NO: 53832 - DNA, 20 bp, Artificial
  CRISPR gRNA sequence
gaataacaactgccagccgt

SEQ ID NO: 53833 - DNA, 20 bp, Artificial
  CRISPR gRNA sequence
gcacccacacctgccctccc

SEQ ID NO: 53834 - DNA, 20 bp, Artificial
  CRISPR gRNA sequence
cacccacacctgccctcccc

SEQ ID NO: 53835 - DNA, 20 bp, Artificial
  CRISPR gRNA sequence
acccacacctgccctcccca

SEQ ID NO: 53836 - DNA, 20 bp, Artificial
  CRISPR gRNA sequence
cacacctgccctccccaggg

SEQ ID NO: 53837 - DNA, 20 bp, Artificial
  CRISPR gRNA sequence
tgccctccccagggtggcct

SEQ ID NO: 53838 - DNA, 20 bp, Artificial
  CRISPR gRNA sequence
cctccccagggtggcctcag

SEQ ID NO: 53839 - DNA, 20 bp, Artificial
  CRISPR gRNA sequence
ggtggcctcagaagcctgtt

SEQ ID NO: 53840 - DNA, 20 bp, Artificial
  CRISPR gRNA sequence
tggcctcagaagcctgttca

SEQ ID NO: 53841 - DNA, 20 bp, Artificial
  CRISPR gRNA sequence
cagaagcctgttcagagatg

SEQ ID NO: 53842 - DNA, 20 bp, Artificial
  CRISPR gRNA sequence
gaagcctgttcagagatgcg

SEQ ID NO: 53843 - DNA, 20 bp, Artificial
  CRISPR gRNA sequence
cctgttcagagatgcggaga

SEQ ID NO: 53844 - DNA, 20 bp, Artificial
  CRISPR gRNA sequence
ctgttcagagatgcggagac

SEQ ID NO: 53845 - DNA, 20 bp, Artificial
  CRISPR gRNA sequence
agagatgcggagacaggttc

SEQ ID NO: 53846 - DNA, 20 bp, Artificial
  CRISPR gRNA sequence
gatgcggagacaggttccag

SEQ ID NO: 53847 - DNA, 20 bp, Artificial
  CRISPR gRNA sequence
ccagaagtgaaaccttgaat

SEQ ID NO: 53848 - DNA, 20 bp, Artificial
  CRISPR gRNA sequence
gaagtgaaaccttgaatcag

SEQ ID NO: 53849 - DNA, 20 bp, Artificial
  CRISPR gRNA sequence
gtgaaaccttgaatcagaag

SEQ ID NO: 53850 - DNA, 20 bp, Artificial
  CRISPR gRNA sequence
tgaaaccttgaatcagaagt

SEQ ID NO: 53851 - DNA, 20 bp, Artificial
  CRISPR gRNA sequence
gaatcagaagtgggattatt

SEQ ID NO: 53852 - DNA, 20 bp, Artificial
  CRISPR gRNA sequence
gaagtgggattattgagtca

SEQ ID NO: 53853 - DNA, 20 bp, Artificial
  CRISPR gRNA sequence
tattgagtcacagactctct

SEQ ID NO: 53854 - DNA, 20 bp, Artificial
  CRISPR gRNA sequence
gagtcacagactctctgagt

SEQ ID NO: 53855 - DNA, 20 bp, Artificial
  CRISPR gRNA sequence
tctgagtaagaatcatctat

SEQ ID NO: 53856 - DNA, 20 bp, Artificial
  CRISPR gRNA sequence
agtaagaatcatctattagc

SEQ ID NO: 53857 - DNA, 20 bp, Artificial
  CRISPR gRNA sequence
tctattagctagccttcacc

SEQ ID NO: 53858 - DNA, 20 bp, Artificial
  CRISPR gRNA sequence
accgagaacttacattgtat

SEQ ID NO: 53859 - DNA, 20 bp, Artificial
  CRISPR gRNA sequence
ccgagaacttacattgtatt

SEQ ID NO: 53860 - DNA, 20 bp, Artificial
  CRISPR gRNA sequence
cgagaacttacattgtatta

SEQ ID NO: 53861 - DNA, 20 bp, Artificial
  CRISPR gRNA sequence
gagaacttacattgtattag

SEQ ID NO: 53862 - DNA, 20 bp, Artificial
  CRISPR gRNA sequence
tttaatctttacaataaccc

SEQ ID NO: 53863 - DNA, 20 bp, Artificial
  CRISPR gRNA sequence
ttaatctttacaataacccc

SEQ ID NO: 53864 - DNA, 20 bp, Artificial
  CRISPR gRNA sequence
tctttacaataaccccagga

SEQ ID NO: 53865 - DNA, 20 bp, Artificial
  CRISPR gRNA sequence
tttacaataaccccaggaaa

SEQ ID NO: 53866 - DNA, 20 bp, Artificial
  CRISPR gRNA sequence
ttacaataaccccaggaaag

SEQ ID NO: 53867 - DNA, 20 bp, Artificial
  CRISPR gRNA sequence
tacaataaccccaggaaaga

SEQ ID NO: 53868 - DNA, 20 bp, Artificial
  CRISPR gRNA sequence
acaataaccccaggaaagag

SEQ ID NO: 53869 - DNA, 20 bp, Artificial
  CRISPR gRNA sequence
caataaccccaggaaagagg

SEQ ID NO: 53870 - DNA, 20 bp, Artificial
  CRISPR gRNA sequence
aaccccaggaaagaggggga

SEQ ID NO: 53871 - DNA, 20 bp, Artificial
  CRISPR gRNA sequence
accccaggaaagagggggat

SEQ ID NO: 53872 - DNA, 20 bp, Artificial
  CRISPR gRNA sequence
caggaaagagggggatggga

SEQ ID NO: 53873 - DNA, 20 bp, Artificial
  CRISPR gRNA sequence
ggaaagagggggatgggaca

SEQ ID NO: 53874 - DNA, 20 bp, Artificial
  CRISPR gRNA sequence
agaatgctccccccctgccc

SEQ ID NO: 53875 - DNA, 20 bp, Artificial
  CRISPR gRNA sequence
ctccccccctgccccagcct

SEQ ID NO: 53876 - DNA, 20 bp, Artificial
  CRISPR gRNA sequence
ccccccctgccccagcctca

SEQ ID NO: 53877 - DNA, 20 bp, Artificial
  CRISPR gRNA sequence
cccccctgccccagcctcag

SEQ ID NO: 53878 - DNA, 20 bp, Artificial
  CRISPR gRNA sequence
ccagcctcagaggctctgcc

SEQ ID NO: 53879 - DNA, 20 bp, Artificial
  CRISPR gRNA sequence
gcctcagaggctctgcctag

SEQ ID NO: 53880 - DNA, 20 bp, Artificial
  CRISPR gRNA sequence
cctcagaggctctgcctagc

SEQ ID NO: 53881 - DNA, 20 bp, Artificial
  CRISPR gRNA sequence
cctagcgggctactcacttc

SEQ ID NO: 53882 - DNA, 20 bp, Artificial
  CRISPR gRNA sequence
ctagcgggctactcacttca

SEQ ID NO: 53883 - DNA, 20 bp, Artificial
  CRISPR gRNA sequence
gctactcacttcaaggactg

SEQ ID NO: 53884 - DNA, 20 bp, Artificial
  CRISPR gRNA sequence
tactcacttcaaggactgca

SEQ ID NO: 53885 - DNA, 20 bp, Artificial
  CRISPR gRNA sequence
ttcaaggactgcagagctcc

SEQ ID NO: 53886 - DNA, 20 bp, Artificial
  CRISPR gRNA sequence
gactgcagagctcccagccc

SEQ ID NO: 53887 - DNA, 20 bp, Artificial
  CRISPR gRNA sequence
actgcagagctcccagccct

SEQ ID NO: 53888 - DNA, 20 bp, Artificial
  CRISPR gRNA sequence
tgcagagctcccagccctgg

SEQ ID NO: 53889 - DNA, 20 bp, Artificial
  CRISPR gRNA sequence
agagctcccagccctgggag

SEQ ID NO: 53890 - DNA, 20 bp, Artificial
  CRISPR gRNA sequence
tcccagccctgggagcagct

SEQ ID NO: 53891 - DNA, 20 bp, Artificial
  CRISPR gRNA sequence
agccctgggagcagctgagc

SEQ ID NO: 53892 - DNA, 20 bp, Artificial
  CRISPR gRNA sequence
ctgggagcagctgagccagc

SEQ ID NO: 53893 - DNA, 20 bp, Artificial
  CRISPR gRNA sequence
tgggagcagctgagccagcc

SEQ ID NO: 53894 - DNA, 20 bp, Artificial
  CRISPR gRNA sequence
cgggctgcaccttcatcccc

SEQ ID NO: 53895 - DNA, 20 bp, Artificial
  CRISPR gRNA sequence
ggctgcaccttcatccccca

SEQ ID NO: 53896 - DNA, 20 bp, Artificial
  CRISPR gRNA sequence
catcccccagagcattgcct

SEQ ID NO: 53897 - DNA, 20 bp, Artificial
  CRISPR gRNA sequence
cccccagagcattgcctgag

SEQ ID NO: 53898 - DNA, 20 bp, Artificial
  CRISPR gRNA sequence
cagagcattgcctgagaagc

SEQ ID NO: 53899 - DNA, 20 bp, Artificial
  CRISPR gRNA sequence
agagcattgcctgagaagct

SEQ ID NO: 53900 - DNA, 20 bp, Artificial
  CRISPR gRNA sequence
gagcattgcctgagaagctg

SEQ ID NO: 53901 - DNA, 20 bp, Artificial
  CRISPR gRNA sequence
agcattgcctgagaagctgg

SEQ ID NO: 53902 - DNA, 20 bp, Artificial
  CRISPR gRNA sequence
attgcctgagaagctggggg

SEQ ID NO: 53903 - DNA, 20 bp, Artificial
  CRISPR gRNA sequence
ttgcctgagaagctgggggt

SEQ ID NO: 53904 - DNA, 20 bp, Artificial
  CRISPR gRNA sequence
tgcctgagaagctgggggtg

SEQ ID NO: 53905 - DNA, 20 bp, Artificial
  CRISPR gRNA sequence
cctgagaagctgggggtggg

SEQ ID NO: 53906 - DNA, 20 bp, Artificial
  CRISPR gRNA sequence
gagaagctgggggtggggag

SEQ ID NO: 53907 - DNA, 20 bp, Artificial
  CRISPR gRNA sequence
agaagctgggggtggggaga

SEQ ID NO: 53908 - DNA, 20 bp, Artificial
  CRISPR gRNA sequence
gaagctgggggtggggagaa

SEQ ID NO: 53909 - DNA, 20 bp, Artificial
  CRISPR gRNA sequence
agctgggggtggggagaagg

SEQ ID NO: 53910 - DNA, 20 bp, Artificial
  CRISPR gRNA sequence
gctgggggtggggagaaggg

SEQ ID NO: 53911 - DNA, 20 bp, Artificial
  CRISPR gRNA sequence
ctgggggtggggagaaggga

SEQ ID NO: 53912 - DNA, 20 bp, Artificial
  CRISPR gRNA sequence
tgggggtggggagaagggag

SEQ ID NO: 53913 - DNA, 20 bp, Artificial
  CRISPR gRNA sequence
ggggtggggagaagggaggg

SEQ ID NO: 53914 - DNA, 20 bp, Artificial
  CRISPR gRNA sequence
gagaagggaggggagaacat

SEQ ID NO: 53915 - DNA, 20 bp, Artificial
  CRISPR gRNA sequence
aagggaggggagaacattag

SEQ ID NO: 53916 - DNA, 20 bp, Artificial
  CRISPR gRNA sequence
agggaggggagaacattagc

SEQ ID NO: 53917 - DNA, 20 bp, Artificial
  CRISPR gRNA sequence
gaggggagaacattagcagg

SEQ ID NO: 53918 - DNA, 20 bp, Artificial
  CRISPR gRNA sequence
aggggagaacattagcaggt

SEQ ID NO: 53919 - DNA, 20 bp, Artificial
  CRISPR gRNA sequence
ggggagaacattagcaggtg

SEQ ID NO: 53920 - DNA, 20 bp, Artificial
  CRISPR gRNA sequence
ggagaacattagcaggtggg

SEQ ID NO: 53921 - DNA, 20 bp, Artificial
  CRISPR gRNA sequence
gaacattagcaggtggggag

SEQ ID NO: 53922 - DNA, 20 bp, Artificial
  CRISPR gRNA sequence
aacattagcaggtggggagt

SEQ ID NO: 53923 - DNA, 20 bp, Artificial
  CRISPR gRNA sequence
gcaggtggggagtgggttgc

SEQ ID NO: 53924 - DNA, 20 bp, Artificial
  CRISPR gRNA sequence
ggtggggagtgggttgctgg

SEQ ID NO: 53925 - DNA, 20 bp, Artificial
  CRISPR gRNA sequence
ggagtgggttgctggcagca

SEQ ID NO: 53926 - DNA, 20 bp, Artificial
  CRISPR gRNA sequence
gcagcatggtccctgcattc

SEQ ID NO: 53927 - DNA, 20 bp, Artificial
  CRISPR gRNA sequence
gttactcaacttcctgaaac

SEQ ID NO: 53928 - DNA, 20 bp, Artificial
  CRISPR gRNA sequence
caacttcctgaaactggaca

SEQ ID NO: 53929 - DNA, 20 bp, Artificial
  CRISPR gRNA sequence
cctgaaactggacacagccc

SEQ ID NO: 53930 - DNA, 20 bp, Artificial
  CRISPR gRNA sequence
ctgaaactggacacagccct

SEQ ID NO: 53931 - DNA, 20 bp, Artificial
  CRISPR gRNA sequence
tggacacagccctgggctgc

SEQ ID NO: 53932 - DNA, 20 bp, Artificial
  CRISPR gRNA sequence
ggacacagccctgggctgcc

SEQ ID NO: 53933 - DNA, 20 bp, Artificial
  CRISPR gRNA sequence
acagccctgggctgccaggc

SEQ ID NO: 53934 - DNA, 20 bp, Artificial
  CRISPR gRNA sequence
tgggctgccaggccagatct

SEQ ID NO: 53935 - DNA, 20 bp, Artificial
  CRISPR gRNA sequence
gctgccaggccagatctcag

SEQ ID NO: 53936 - DNA, 20 bp, Artificial
  CRISPR gRNA sequence
aggccagatctcagcagatc

SEQ ID NO: 53937 - DNA, 20 bp, Artificial
  CRISPR gRNA sequence
agatctcagcagatctggca

SEQ ID NO: 53938 - DNA, 20 bp, Artificial
  CRISPR gRNA sequence
gatctcagcagatctggcac

SEQ ID NO: 53939 - DNA, 20 bp, Artificial
  CRISPR gRNA sequence
ctcagcagatctggcacggg

SEQ ID NO: 53940 - DNA, 20 bp, Artificial
  CRISPR gRNA sequence
gcagatctggcacgggcagc

SEQ ID NO: 53941 - DNA, 20 bp, Artificial
  CRISPR gRNA sequence
cagatctggcacgggcagct

SEQ ID NO: 53942 - DNA, 20 bp, Artificial
  CRISPR gRNA sequence
agatctggcacgggcagctg

SEQ ID NO: 53943 - DNA, 20 bp, Artificial
  CRISPR gRNA sequence
cgggcagctggggtctcccc

SEQ ID NO: 53944 - DNA, 20 bp, Artificial
  CRISPR gRNA sequence
gggcagctggggtctccccc

SEQ ID NO: 53945 - DNA, 20 bp, Artificial
  CRISPR gRNA sequence
ctcccccaggttcttattct

SEQ ID NO: 53946 - DNA, 20 bp, Artificial
  CRISPR gRNA sequence
tcccccaggttcttattctg

SEQ ID NO: 53947 - DNA, 20 bp, Artificial
  CRISPR gRNA sequence
ggttcttattctgaggttcg

SEQ ID NO: 53948 - DNA, 20 bp, Artificial
  CRISPR gRNA sequence
tctgaggttcgtggacctct

SEQ ID NO: 53949 - DNA, 20 bp, Artificial
  CRISPR gRNA sequence
ctgaggttcgtggacctctg

SEQ ID NO: 53950 - DNA, 20 bp, Artificial
  CRISPR gRNA sequence
tgaggttcgtggacctctga

SEQ ID NO: 53951 - DNA, 20 bp, Artificial
  CRISPR gRNA sequence
ttcgtggacctctgagggac

SEQ ID NO: 53952 - DNA, 20 bp, Artificial
  CRISPR gRNA sequence
tcgtggacctctgagggacc

SEQ ID NO: 53953 - DNA, 20 bp, Artificial
  CRISPR gRNA sequence
cgtggacctctgagggacca

SEQ ID NO: 53954 - DNA, 20 bp, Artificial
  CRISPR gRNA sequence
gtggacctctgagggaccag

SEQ ID NO: 53955 - DNA, 20 bp, Artificial
  CRISPR gRNA sequence
acctctgagggaccaggggt

SEQ ID NO: 53956 - DNA, 20 bp, Artificial
  CRISPR gRNA sequence
gggaccaggggtgagcctcc

SEQ ID NO: 53957 - DNA, 20 bp, Artificial
  CRISPR gRNA sequence
gggtgagcctccgagcgtgt

SEQ ID NO: 53958 - DNA, 20 bp, Artificial
  CRISPR gRNA sequence
gcctccgagcgtgtcagaca

SEQ ID NO: 53959 - DNA, 20 bp, Artificial
  CRISPR gRNA sequence
cctccgagcgtgtcagacat

SEQ ID NO: 53960 - DNA, 20 bp, Artificial
  CRISPR gRNA sequence
ctccgagcgtgtcagacatg

SEQ ID NO: 53961 - DNA, 20 bp, Artificial
  CRISPR gRNA sequence
tccgagcgtgtcagacatgg

SEQ ID NO: 53962 - DNA, 20 bp, Artificial
  CRISPR gRNA sequence
gacatgggggatctgtatct

SEQ ID NO: 53963 - DNA, 20 bp, Artificial
  CRISPR gRNA sequence
acatgggggatctgtatctt

SEQ ID NO: 53964 - DNA, 20 bp, Artificial
  CRISPR gRNA sequence
atgggggatctgtatcttgg

SEQ ID NO: 53965 - DNA, 20 bp, Artificial
  CRISPR gRNA sequence
tgggggatctgtatcttggg

SEQ ID NO: 53966 - DNA, 20 bp, Artificial
  CRISPR gRNA sequence
gggatctgtatcttgggagg

SEQ ID NO: 53967 - DNA, 20 bp, Artificial
  CRISPR gRNA sequence
gatctgtatcttgggaggaa

SEQ ID NO: 53968 - DNA, 20 bp, Artificial
  CRISPR gRNA sequence
ggaagagtcacaactttcac

SEQ ID NO: 53969 - DNA, 20 bp, Artificial
  CRISPR gRNA sequence
caactttcaccagattctcc

SEQ ID NO: 53970 - DNA, 20 bp, Artificial
  CRISPR gRNA sequence
aactttcaccagattctcca

SEQ ID NO: 53971 - DNA, 20 bp, Artificial
  CRISPR gRNA sequence
actttcaccagattctccaa

SEQ ID NO: 53972 - DNA, 20 bp, Artificial
  CRISPR gRNA sequence
ctttcaccagattctccaag

SEQ ID NO: 53973 - DNA, 20 bp, Artificial
  CRISPR gRNA sequence
ctccaaggggtttctgactt

SEQ ID NO: 53974 - DNA, 20 bp, Artificial
  CRISPR gRNA sequence
caaggggtttctgacttcag

SEQ ID NO: 53975 - DNA, 20 bp, Artificial
  CRISPR gRNA sequence
aaggggtttctgacttcagc

SEQ ID NO: 53976 - DNA, 20 bp, Artificial
  CRISPR gRNA sequence
aggggtttctgacttcagca

SEQ ID NO: 53977 - DNA, 20 bp, Artificial
  CRISPR gRNA sequence
gtttctgacttcagcaggga

SEQ ID NO: 53978 - DNA, 20 bp, Artificial
  CRISPR gRNA sequence
tgacttcagcagggaaagaa

SEQ ID NO: 53979 - DNA, 20 bp, Artificial
  CRISPR gRNA sequence
caacactaactcactgtaat

SEQ ID NO: 53980 - DNA, 20 bp, Artificial
  CRISPR gRNA sequence
aacacacaaaccactcactc

SEQ ID NO: 53981 - DNA, 20 bp, Artificial
  CRISPR gRNA sequence
acacacaaaccactcactcg

SEQ ID NO: 53982 - DNA, 20 bp, Artificial
  CRISPR gRNA sequence
cacaaaccactcactcgagg

SEQ ID NO: 53983 - DNA, 20 bp, Artificial
  CRISPR gRNA sequence
caaaccactcactcgaggtg

SEQ ID NO: 53984 - DNA, 20 bp, Artificial
  CRISPR gRNA sequence
aaaccactcactcgaggtgg

SEQ ID NO: 53985 - DNA, 20 bp, Artificial
  CRISPR gRNA sequence
cactcgaggtggaggtgacc

SEQ ID NO: 53986 - DNA, 20 bp, Artificial
  CRISPR gRNA sequence
actcgaggtggaggtgaccg

SEQ ID NO: 53987 - DNA, 20 bp, Artificial
  CRISPR gRNA sequence
cgaggtggaggtgaccgagg

SEQ ID NO: 53988 - DNA, 20 bp, Artificial
  CRISPR gRNA sequence
ggtggaggtgaccgaggtgg

SEQ ID NO: 53989 - DNA, 20 bp, Artificial
  CRISPR gRNA sequence
ccgaggtggcagcttcctcc

SEQ ID NO: 53990 - DNA, 20 bp, Artificial
  CRISPR gRNA sequence
gaggtggcagcttcctccca

SEQ ID NO: 53991 - DNA, 20 bp, Artificial
  CRISPR gRNA sequence
agcttcctcccagagccttg

SEQ ID NO: 53992 - DNA, 20 bp, Artificial
  CRISPR gRNA sequence
cttcctcccagagccttgca

SEQ ID NO: 53993 - DNA, 20 bp, Artificial
  CRISPR gRNA sequence
agagccttgcagagctgctc

SEQ ID NO: 53994 - DNA, 20 bp, Artificial
  CRISPR gRNA sequence
gagccttgcagagctgctct

SEQ ID NO: 53995 - DNA, 20 bp, Artificial
  CRISPR gRNA sequence
gctgctctaggtgcttttct

SEQ ID NO: 53996 - DNA, 20 bp, Artificial
  CRISPR gRNA sequence
tgctctaggtgcttttcttg

SEQ ID NO: 53997 - DNA, 20 bp, Artificial
  CRISPR gRNA sequence
gctctaggtgcttttcttgg

SEQ ID NO: 53998 - DNA, 20 bp, Artificial
  CRISPR gRNA sequence
tcttggaggccacaatgtgt

SEQ ID NO: 53999 - DNA, 20 bp, Artificial
  CRISPR gRNA sequence
ccacaatgtgtcagcctgcc

SEQ ID NO: 54000 - DNA, 20 bp, Artificial
  CRISPR gRNA sequence
cacaatgtgtcagcctgccc

SEQ ID NO: 54001 - DNA, 20 bp, Artificial
  CRISPR gRNA sequence
acaatgtgtcagcctgccca

SEQ ID NO: 54002 - DNA, 20 bp, Artificial
  CRISPR gRNA sequence
cctgcccagggacaaaaaca

SEQ ID NO: 54003 - DNA, 20 bp, Artificial
  CRISPR gRNA sequence
gtgctgcatgccccactgaa

SEQ ID NO: 54004 - DNA, 20 bp, Artificial
  CRISPR gRNA sequence
gctgcatgccccactgaaca

SEQ ID NO: 54005 - DNA, 20 bp, Artificial
  CRISPR gRNA sequence
ctgcatgccccactgaacag

SEQ ID NO: 54006 - DNA, 20 bp, Artificial
  CRISPR gRNA sequence
catgccccactgaacagagg

SEQ ID NO: 54007 - DNA, 20 bp, Artificial
  CRISPR gRNA sequence
atgccccactgaacagaggc

SEQ ID NO: 54008 - DNA, 20 bp, Artificial
  CRISPR gRNA sequence
ccccactgaacagaggcggg

SEQ ID NO: 54009 - DNA, 20 bp, Artificial
  CRISPR gRNA sequence
cccactgaacagaggcggga

SEQ ID NO: 54010 - DNA, 20 bp, Artificial
  CRISPR gRNA sequence
cactgaacagaggcgggaag

SEQ ID NO: 54011 - DNA, 20 bp, Artificial
  CRISPR gRNA sequence
ggagccgctttcccaccccc

SEQ ID NO: 54012 - DNA, 20 bp, Artificial
  CRISPR gRNA sequence
gctttcccaccccccagaca

SEQ ID NO: 54013 - DNA, 20 bp, Artificial
  CRISPR gRNA sequence
tttcccaccccccagacaca

SEQ ID NO: 54014 - DNA, 20 bp, Artificial
  CRISPR gRNA sequence
ttcccaccccccagacacag

SEQ ID NO: 54015 - DNA, 20 bp, Artificial
  CRISPR gRNA sequence
ccaccccccagacacagagg

SEQ ID NO: 54016 - DNA, 20 bp, Artificial
  CRISPR gRNA sequence
accccccagacacagaggca

SEQ ID NO: 54017 - DNA, 20 bp, Artificial
  CRISPR gRNA sequence
cagacacagaggcagagaat

SEQ ID NO: 54018 - DNA, 20 bp, Artificial
  CRISPR gRNA sequence
agacacagaggcagagaatg

SEQ ID NO: 54019 - DNA, 20 bp, Artificial
  CRISPR gRNA sequence
gaggcagagaatgaggcttg

SEQ ID NO: 54020 - DNA, 20 bp, Artificial
  CRISPR gRNA sequence
aggcagagaatgaggcttgc

SEQ ID NO: 54021 - DNA, 20 bp, Artificial
  CRISPR gRNA sequence
gcagagaatgaggcttgcag

SEQ ID NO: 54022 - DNA, 20 bp, Artificial
  CRISPR gRNA sequence
agagaatgaggcttgcagga

SEQ ID NO: 54023 - DNA, 20 bp, Artificial
  CRISPR gRNA sequence
gagaatgaggcttgcaggag

SEQ ID NO: 54024 - DNA, 20 bp, Artificial
  CRISPR gRNA sequence
gaatgaggcttgcaggagag

SEQ ID NO: 54025 - DNA, 20 bp, Artificial
  CRISPR gRNA sequence
aatgaggcttgcaggagagg

SEQ ID NO: 54026 - DNA, 20 bp, Artificial
  CRISPR gRNA sequence
atgaggcttgcaggagagga

SEQ ID NO: 54027 - DNA, 20 bp, Artificial
  CRISPR gRNA sequence
gcttgcaggagaggagggac

SEQ ID NO: 54028 - DNA, 20 bp, Artificial
  CRISPR gRNA sequence
cttgcaggagaggagggact

SEQ ID NO: 54029 - DNA, 20 bp, Artificial
  CRISPR gRNA sequence
aggagggactgggatgtatc

SEQ ID NO: 54030 - DNA, 20 bp, Artificial
  CRISPR gRNA sequence
actgggatgtatctggcacc

SEQ ID NO: 54031 - DNA, 20 bp, Artificial
  CRISPR gRNA sequence
ggatgtatctggcacctaga

SEQ ID NO: 54032 - DNA, 20 bp, Artificial
  CRISPR gRNA sequence
gtatctggcacctagacaga

SEQ ID NO: 54033 - DNA, 20 bp, Artificial
  CRISPR gRNA sequence
ggcacctagacagacggaca

SEQ ID NO: 54034 - DNA, 20 bp, Artificial
  CRISPR gRNA sequence
cacctagacagacggacaaa

SEQ ID NO: 54035 - DNA, 20 bp, Artificial
  CRISPR gRNA sequence
acctagacagacggacaaag

SEQ ID NO: 54036 - DNA, 20 bp, Artificial
  CRISPR gRNA sequence
cctagacagacggacaaaga

SEQ ID NO: 54037 - DNA, 20 bp, Artificial
  CRISPR gRNA sequence
accaacacacacgacaccca

SEQ ID NO: 54038 - DNA, 20 bp, Artificial
  CRISPR gRNA sequence
ccaacacacacgacacccac

SEQ ID NO: 54039 - DNA, 20 bp, Artificial
  CRISPR gRNA sequence
cacccacaggatgtcacata

SEQ ID NO: 54040 - DNA, 20 bp, Artificial
  CRISPR gRNA sequence
acccacaggatgtcacatat

SEQ ID NO: 54041 - DNA, 20 bp, Artificial
  CRISPR gRNA sequence
cacaggatgtcacatatagg

SEQ ID NO: 54042 - DNA, 20 bp, Artificial
  CRISPR gRNA sequence
caggatgtcacatataggca

SEQ ID NO: 54043 - DNA, 20 bp, Artificial
  CRISPR gRNA sequence
aggatgtcacatataggcag

SEQ ID NO: 54044 - DNA, 20 bp, Artificial
  CRISPR gRNA sequence
ggatgtcacatataggcaga

SEQ ID NO: 54045 - DNA, 20 bp, Artificial
  CRISPR gRNA sequence
tgtcacatataggcagaggg

SEQ ID NO: 54046 - DNA, 20 bp, Artificial
  CRISPR gRNA sequence
gtcacatataggcagagggt

SEQ ID NO: 54047 - DNA, 20 bp, Artificial
  CRISPR gRNA sequence
acatataggcagagggtggg

SEQ ID NO: 54048 - DNA, 20 bp, Artificial
  CRISPR gRNA sequence
atataggcagagggtgggca

SEQ ID NO: 54049 - DNA, 20 bp, Artificial
  CRISPR gRNA sequence
gcagagggtgggcagagaca

SEQ ID NO: 54050 - DNA, 20 bp, Artificial
  CRISPR gRNA sequence
agggtgggcagagacacaga

SEQ ID NO: 54051 - DNA, 20 bp, Artificial
  CRISPR gRNA sequence
gtgggcagagacacagatgg

SEQ ID NO: 54052 - DNA, 20 bp, Artificial
  CRISPR gRNA sequence
tgggcagagacacagatgga

SEQ ID NO: 54053 - DNA, 20 bp, Artificial
  CRISPR gRNA sequence
gacacagatggaaggaaacc

SEQ ID NO: 54054 - DNA, 20 bp, Artificial
  CRISPR gRNA sequence
acacagatggaaggaaacca

SEQ ID NO: 54055 - DNA, 20 bp, Artificial
  CRISPR gRNA sequence
gatggaaggaaaccaaggca

SEQ ID NO: 54056 - DNA, 20 bp, Artificial
  CRISPR gRNA sequence
tggaaggaaaccaaggcaca

SEQ ID NO: 54057 - DNA, 20 bp, Artificial
  CRISPR gRNA sequence
aaaccaaggcacagagacct

SEQ ID NO: 54058 - DNA, 20 bp, Artificial
  CRISPR gRNA sequence
accaaggcacagagacctca

SEQ ID NO: 54059 - DNA, 20 bp, Artificial
  CRISPR gRNA sequence
caaggcacagagacctcaga

SEQ ID NO: 54060 - DNA, 20 bp, Artificial
  CRISPR gRNA sequence
aggcacagagacctcagaga

SEQ ID NO: 54061 - DNA, 20 bp, Artificial
  CRISPR gRNA sequence
gcacagagacctcagagaga

SEQ ID NO: 54062 - DNA, 20 bp, Artificial
  CRISPR gRNA sequence
acagagacctcagagagaga

SEQ ID NO: 54063 - DNA, 20 bp, Artificial
  CRISPR gRNA sequence
gagacctcagagagagagag

SEQ ID NO: 54064 - DNA, 20 bp, Artificial
  CRISPR gRNA sequence
ctcagagagagagagcagat

SEQ ID NO: 54065 - DNA, 20 bp, Artificial
  CRISPR gRNA sequence
cagagagagagagcagatca

SEQ ID NO: 54066 - DNA, 20 bp, Artificial
  CRISPR gRNA sequence
agagagagagagcagatcag

SEQ ID NO: 54067 - DNA, 20 bp, Artificial
  CRISPR gRNA sequence
gagagagagcagatcagagg

SEQ ID NO: 54068 - DNA, 20 bp, Artificial
  CRISPR gRNA sequence
gagagcagatcagaggaaga

SEQ ID NO: 54069 - DNA, 20 bp, Artificial
  CRISPR gRNA sequence
cagatcagaggaagacagat

SEQ ID NO: 54070 - DNA, 20 bp, Artificial
  CRISPR gRNA sequence
gacagataagactgaaataa

SEQ ID NO: 54071 - DNA, 20 bp, Artificial
  CRISPR gRNA sequence
agttaaataaactgataaaa

SEQ ID NO: 54072 - DNA, 20 bp, Artificial
  CRISPR gRNA sequence
ataaaacagaaatacacgat

SEQ ID NO: 54073 - DNA, 20 bp, Artificial
  CRISPR gRNA sequence
aaaacagaaatacacgatga

SEQ ID NO: 54074 - DNA, 20 bp, Artificial
  CRISPR gRNA sequence
aacagaaatacacgatgaga

SEQ ID NO: 54075 - DNA, 20 bp, Artificial
  CRISPR gRNA sequence
acagaaatacacgatgagag

SEQ ID NO: 54076 - DNA, 20 bp, Artificial
  CRISPR gRNA sequence
cagaaatacacgatgagaga

SEQ ID NO: 54077 - DNA, 20 bp, Artificial
  CRISPR gRNA sequence
aaatacacgatgagagaggg

SEQ ID NO: 54078 - DNA, 20 bp, Artificial
  CRISPR gRNA sequence
cgatgagagagggaagaaat

SEQ ID NO: 54079 - DNA, 20 bp, Artificial
  CRISPR gRNA sequence
atgagagagggaagaaatga

SEQ ID NO: 54080 - DNA, 20 bp, Artificial
  CRISPR gRNA sequence
gagggaagaaatgagagaaa

SEQ ID NO: 54081 - DNA, 20 bp, Artificial
  CRISPR gRNA sequence
agggaagaaatgagagaaac

SEQ ID NO: 54082 - DNA, 20 bp, Artificial
  CRISPR gRNA sequence
gaagaaatgagagaaacagg

SEQ ID NO: 54083 - DNA, 20 bp, Artificial
  CRISPR gRNA sequence
agaaatgagagaaacaggca

SEQ ID NO: 54084 - DNA, 20 bp, Artificial
  CRISPR gRNA sequence
gaaatgagagaaacaggcag

SEQ ID NO: 54085 - DNA, 20 bp, Artificial
  CRISPR gRNA sequence
aaatgagagaaacaggcaga

SEQ ID NO: 54086 - DNA, 20 bp, Artificial
  CRISPR gRNA sequence
gagagaaacaggcagaggga

SEQ ID NO: 54087 - DNA, 20 bp, Artificial
  CRISPR gRNA sequence
gagaaacaggcagagggaca

SEQ ID NO: 54088 - DNA, 20 bp, Artificial
  CRISPR gRNA sequence
agaaacaggcagagggacag

SEQ ID NO: 54089 - DNA, 20 bp, Artificial
  CRISPR gRNA sequence
gaaacaggcagagggacaga

SEQ ID NO: 54090 - DNA, 20 bp, Artificial
  CRISPR gRNA sequence
aacaggcagagggacagagg

SEQ ID NO: 54091 - DNA, 20 bp, Artificial
  CRISPR gRNA sequence
gcagagggacagagggagat

SEQ ID NO: 54092 - DNA, 20 bp, Artificial
  CRISPR gRNA sequence
cagagggacagagggagatt

SEQ ID NO: 54093 - DNA, 20 bp, Artificial
  CRISPR gRNA sequence
gggacagagggagattagga

SEQ ID NO: 54094 - DNA, 20 bp, Artificial
  CRISPR gRNA sequence
gagggagattaggacagaca

SEQ ID NO: 54095 - DNA, 20 bp, Artificial
  CRISPR gRNA sequence
gattaggacagacaaagacc

SEQ ID NO: 54096 - DNA, 20 bp, Artificial
  CRISPR gRNA sequence
ttaggacagacaaagaccaa

SEQ ID NO: 54097 - DNA, 20 bp, Artificial
  CRISPR gRNA sequence
aggacagacaaagaccaaga

SEQ ID NO: 54098 - DNA, 20 bp, Artificial
  CRISPR gRNA sequence
acagacaaagaccaagagag

SEQ ID NO: 54099 - DNA, 20 bp, Artificial
  CRISPR gRNA sequence
cagacaaagaccaagagaga

SEQ ID NO: 54100 - DNA, 20 bp, Artificial
  CRISPR gRNA sequence
agacaaagaccaagagagaa

SEQ ID NO: 54101 - DNA, 20 bp, Artificial
  CRISPR gRNA sequence
gacaaagaccaagagagaag

SEQ ID NO: 54102 - DNA, 20 bp, Artificial
  CRISPR gRNA sequence
acaaagaccaagagagaagg

SEQ ID NO: 54103 - DNA, 20 bp, Artificial
  CRISPR gRNA sequence
caaagaccaagagagaaggg

SEQ ID NO: 54104 - DNA, 20 bp, Artificial
  CRISPR gRNA sequence
agaccaagagagaagggggg

SEQ ID NO: 54105 - DNA, 20 bp, Artificial
  CRISPR gRNA sequence
accaagagagaaggggggaa

SEQ ID NO: 54106 - DNA, 20 bp, Artificial
  CRISPR gRNA sequence
gaaggggggaagagtgctga

SEQ ID NO: 54107 - DNA, 20 bp, Artificial
  CRISPR gRNA sequence
aaggggggaagagtgctgat

SEQ ID NO: 54108 - DNA, 20 bp, Artificial
  CRISPR gRNA sequence
ggggggaagagtgctgatgg

SEQ ID NO: 54109 - DNA, 20 bp, Artificial
  CRISPR gRNA sequence
agagtgctgatgggagcccc

SEQ ID NO: 54110 - DNA, 20 bp, Artificial
  CRISPR gRNA sequence
gagtgctgatgggagccccc

SEQ ID NO: 54111 - DNA, 20 bp, Artificial
  CRISPR gRNA sequence
ctgatgggagcccccaggcc

SEQ ID NO: 54112 - DNA, 20 bp, Artificial
  CRISPR gRNA sequence
tgatgggagcccccaggccc

SEQ ID NO: 54113 - DNA, 20 bp, Artificial
  CRISPR gRNA sequence
gagcccccaggcccaggcac

SEQ ID NO: 54114 - DNA, 20 bp, Artificial
  CRISPR gRNA sequence
agcccccaggcccaggcacc

SEQ ID NO: 54115 - DNA, 20 bp, Artificial
  CRISPR gRNA sequence
cccaggcaccaggatcatga

SEQ ID NO: 54116 - DNA, 20 bp, Artificial
  CRISPR gRNA sequence
aggcaccaggatcatgacag

SEQ ID NO: 54117 - DNA, 20 bp, Artificial
  CRISPR gRNA sequence
ggcaccaggatcatgacaga

SEQ ID NO: 54118 - DNA, 20 bp, Artificial
  CRISPR gRNA sequence
caccaggatcatgacagaag

SEQ ID NO: 54119 - DNA, 20 bp, Artificial
  CRISPR gRNA sequence
ggatcatgacagaaggagcc

SEQ ID NO: 54120 - DNA, 20 bp, Artificial
  CRISPR gRNA sequence
tgctccccttcacctctttt

SEQ ID NO: 54121 - DNA, 20 bp, Artificial
  CRISPR gRNA sequence
ctccccttcacctcttttca

SEQ ID NO: 54122 - DNA, 20 bp, Artificial
  CRISPR gRNA sequence
tcagagtctccacaacccct

SEQ ID NO: 54123 - DNA, 20 bp, Artificial
  CRISPR gRNA sequence
ctccacaacccctcagctgc

SEQ ID NO: 54124 - DNA, 20 bp, Artificial
  CRISPR gRNA sequence
tccacaacccctcagctgct

SEQ ID NO: 54125 - DNA, 20 bp, Artificial
  CRISPR gRNA sequence
ccacaacccctcagctgctg

SEQ ID NO: 54126 - DNA, 20 bp, Artificial
  CRISPR gRNA sequence
cacaacccctcagctgctgg

SEQ ID NO: 54127 - DNA, 20 bp, Artificial
  CRISPR gRNA sequence
acccctcagctgctgggggt

SEQ ID NO: 54128 - DNA, 20 bp, Artificial
  CRISPR gRNA sequence
cccctcagctgctgggggtc

SEQ ID NO: 54129 - DNA, 20 bp, Artificial
  CRISPR gRNA sequence
ccctcagctgctgggggtca

SEQ ID NO: 54130 - DNA, 20 bp, Artificial
  CRISPR gRNA sequence
ctcagctgctgggggtcagg

SEQ ID NO: 54131 - DNA, 20 bp, Artificial
  CRISPR gRNA sequence
ctgctgggggtcagggagct

SEQ ID NO: 54132 - DNA, 20 bp, Artificial
  CRISPR gRNA sequence
tgctgggggtcagggagcta

SEQ ID NO: 54133 - DNA, 20 bp, Artificial
  CRISPR gRNA sequence
gctgggggtcagggagctaa

SEQ ID NO: 54134 - DNA, 20 bp, Artificial
  CRISPR gRNA sequence
ctgggggtcagggagctaag

SEQ ID NO: 54135 - DNA, 20 bp, Artificial
  CRISPR gRNA sequence
gggggtcagggagctaaggg

SEQ ID NO: 54136 - DNA, 20 bp, Artificial
  CRISPR gRNA sequence
ggtcagggagctaaggggag

SEQ ID NO: 54137 - DNA, 20 bp, Artificial
  CRISPR gRNA sequence
gtcagggagctaaggggagt

SEQ ID NO: 54138 - DNA, 20 bp, Artificial
  CRISPR gRNA sequence
tcagggagctaaggggagtg

SEQ ID NO: 54139 - DNA, 20 bp, Artificial
  CRISPR gRNA sequence
ctaaggggagtggggtctcc

SEQ ID NO: 54140 - DNA, 20 bp, Artificial
  CRISPR gRNA sequence
taaggggagtggggtctcct

SEQ ID NO: 54141 - DNA, 20 bp, Artificial
  CRISPR gRNA sequence
ggagtggggtctcctgggct

SEQ ID NO: 54142 - DNA, 20 bp, Artificial
  CRISPR gRNA sequence
gagtggggtctcctgggctt

SEQ ID NO: 54143 - DNA, 20 bp, Artificial
  CRISPR gRNA sequence
tggggtctcctgggcttggg

SEQ ID NO: 54144 - DNA, 20 bp, Artificial
  CRISPR gRNA sequence
ggggtctcctgggcttggga

SEQ ID NO: 54145 - DNA, 20 bp, Artificial
  CRISPR gRNA sequence
gtctcctgggcttgggaagg

SEQ ID NO: 54146 - DNA, 20 bp, Artificial
  CRISPR gRNA sequence
gggcttgggaaggtggttga

SEQ ID NO: 54147 - DNA, 20 bp, Artificial
  CRISPR gRNA sequence
ggcttgggaaggtggttgac

SEQ ID NO: 54148 - DNA, 20 bp, Artificial
  CRISPR gRNA sequence
gcttgggaaggtggttgacg

SEQ ID NO: 54149 - DNA, 20 bp, Artificial
  CRISPR gRNA sequence
ggttgacggggctgccttgt

SEQ ID NO: 54150 - DNA, 20 bp, Artificial
  CRISPR gRNA sequence
gctgccttgtgagccctgtc

SEQ ID NO: 54151 - DNA, 20 bp, Artificial
  CRISPR gRNA sequence
ctgccttgtgagccctgtct

SEQ ID NO: 54152 - DNA, 20 bp, Artificial
  CRISPR gRNA sequence
tgccttgtgagccctgtctg

SEQ ID NO: 54153 - DNA, 20 bp, Artificial
  CRISPR gRNA sequence
cttgtgagccctgtctgggg

SEQ ID NO: 54154 - DNA, 20 bp, Artificial
  CRISPR gRNA sequence
ttgtgagccctgtctggggt

SEQ ID NO: 54155 - DNA, 20 bp, Artificial
  CRISPR gRNA sequence
gagccctgtctggggtgggc

SEQ ID NO: 54156 - DNA, 20 bp, Artificial
  CRISPR gRNA sequence
agccctgtctggggtgggct

SEQ ID NO: 54157 - DNA, 20 bp, Artificial
  CRISPR gRNA sequence
cctgtctggggtgggctggg

SEQ ID NO: 54158 - DNA, 20 bp, Artificial
  CRISPR gRNA sequence
ctgtctggggtgggctgggc

SEQ ID NO: 54159 - DNA, 20 bp, Artificial
  CRISPR gRNA sequence
tgtctggggtgggctgggca

SEQ ID NO: 54160 - DNA, 20 bp, Artificial
  CRISPR gRNA sequence
gtctggggtgggctgggcag

SEQ ID NO: 54161 - DNA, 20 bp, Artificial
  CRISPR gRNA sequence
ctggggtgggctgggcaggg

SEQ ID NO: 54162 - DNA, 20 bp, Artificial
  CRISPR gRNA sequence
tggggtgggctgggcagggg

SEQ ID NO: 54163 - DNA, 20 bp, Artificial
  CRISPR gRNA sequence
ggtgggctgggcaggggagg

SEQ ID NO: 54164 - DNA, 20 bp, Artificial
  CRISPR gRNA sequence
gtgggctgggcaggggaggt

SEQ ID NO: 54165 - DNA, 20 bp, Artificial
  CRISPR gRNA sequence
gggctgggcaggggaggtag

SEQ ID NO: 54166 - DNA, 20 bp, Artificial
  CRISPR gRNA sequence
ggctgggcaggggaggtagg

SEQ ID NO: 54167 - DNA, 20 bp, Artificial
  CRISPR gRNA sequence
tgggcaggggaggtaggagg

SEQ ID NO: 54168 - DNA, 20 bp, Artificial
  CRISPR gRNA sequence
gggcaggggaggtaggaggt

SEQ ID NO: 54169 - DNA, 20 bp, Artificial
  CRISPR gRNA sequence
ggcaggggaggtaggaggta

SEQ ID NO: 54170 - DNA, 20 bp, Artificial
  CRISPR gRNA sequence
aggggaggtaggaggtaggg

SEQ ID NO: 54171 - DNA, 20 bp, Artificial
  CRISPR gRNA sequence
gaggtaggaggtagggaagc

SEQ ID NO: 54172 - DNA, 20 bp, Artificial
  CRISPR gRNA sequence
aggtaggaggtagggaagcc

SEQ ID NO: 54173 - DNA, 20 bp, Artificial
  CRISPR gRNA sequence
ggaagccaggccatgacccc

SEQ ID NO: 54174 - DNA, 20 bp, Artificial
  CRISPR gRNA sequence
caggccatgacccctggaca

SEQ ID NO: 54175 - DNA, 20 bp, Artificial
  CRISPR gRNA sequence
gccatgacccctggacacag

SEQ ID NO: 54176 - DNA, 20 bp, Artificial
  CRISPR gRNA sequence
ccatgacccctggacacagc

SEQ ID NO: 54177 - DNA, 20 bp, Artificial
  CRISPR gRNA sequence
gacccctggacacagcaggt

SEQ ID NO: 54178 - DNA, 20 bp, Artificial
  CRISPR gRNA sequence
acccctggacacagcaggtc

SEQ ID NO: 54179 - DNA, 20 bp, Artificial
  CRISPR gRNA sequence
acagcaggtcaggtgtcctt

SEQ ID NO: 54180 - DNA, 20 bp, Artificial
  CRISPR gRNA sequence
cagcaggtcaggtgtccttc

SEQ ID NO: 54181 - DNA, 20 bp, Artificial
  CRISPR gRNA sequence
agcaggtcaggtgtccttca

SEQ ID NO: 54182 - DNA, 20 bp, Artificial
  CRISPR gRNA sequence
caggtcaggtgtccttcagg

SEQ ID NO: 54183 - DNA, 20 bp, Artificial
  CRISPR gRNA sequence
ggtgtccttcagggagcatg

SEQ ID NO: 54184 - DNA, 20 bp, Artificial
  CRISPR gRNA sequence
gtgtccttcagggagcatgt

SEQ ID NO: 54185 - DNA, 20 bp, Artificial
  CRISPR gRNA sequence
tgtccttcagggagcatgtg

SEQ ID NO: 54186 - DNA, 20 bp, Artificial
  CRISPR gRNA sequence
ttcagggagcatgtggggcc

SEQ ID NO: 54187 - DNA, 20 bp, Artificial
  CRISPR gRNA sequence
tcagggagcatgtggggcct

SEQ ID NO: 54188 - DNA, 20 bp, Artificial
  CRISPR gRNA sequence
gagcatgtggggcctgggca

SEQ ID NO: 54189 - DNA, 20 bp, Artificial
  CRISPR gRNA sequence
agcatgtggggcctgggcac

SEQ ID NO: 54190 - DNA, 20 bp, Artificial
  CRISPR gRNA sequence
gtggggcctgggcacaggtt

SEQ ID NO: 54191 - DNA, 20 bp, Artificial
  CRISPR gRNA sequence
tggggcctgggcacaggttt

SEQ ID NO: 54192 - DNA, 20 bp, Artificial
  CRISPR gRNA sequence
gggcctgggcacaggtttgg

SEQ ID NO: 54193 - DNA, 20 bp, Artificial
  CRISPR gRNA sequence
cctgggcacaggtttgggag

SEQ ID NO: 54194 - DNA, 20 bp, Artificial
  CRISPR gRNA sequence
ctgggcacaggtttgggagc

SEQ ID NO: 54195 - DNA, 20 bp, Artificial
  CRISPR gRNA sequence
caggtttgggagcaggctct

SEQ ID NO: 54196 - DNA, 20 bp, Artificial
  CRISPR gRNA sequence
gtttgggagcaggctctgag

SEQ ID NO: 54197 - DNA, 20 bp, Artificial
  CRISPR gRNA sequence
tttgggagcaggctctgagc

SEQ ID NO: 54198 - DNA, 20 bp, Artificial
  CRISPR gRNA sequence
ttgggagcaggctctgagca

SEQ ID NO: 54199 - DNA, 20 bp, Artificial
  CRISPR gRNA sequence
tgggagcaggctctgagcag

SEQ ID NO: 54200 - DNA, 20 bp, Artificial
  CRISPR gRNA sequence
gagcaggctctgagcagggg

SEQ ID NO: 54201 - DNA, 20 bp, Artificial
  CRISPR gRNA sequence
agcaggctctgagcagggga

SEQ ID NO: 54202 - DNA, 20 bp, Artificial
  CRISPR gRNA sequence
gcaggctctgagcaggggaa

SEQ ID NO: 54203 - DNA, 20 bp, Artificial
  CRISPR gRNA sequence
aggctctgagcaggggaagg

SEQ ID NO: 54204 - DNA, 20 bp, Artificial
  CRISPR gRNA sequence
ggctctgagcaggggaaggg

SEQ ID NO: 54205 - DNA, 20 bp, Artificial
  CRISPR gRNA sequence
gctctgagcaggggaaggga

SEQ ID NO: 54206 - DNA, 20 bp, Artificial
  CRISPR gRNA sequence
ctctgagcaggggaagggag

SEQ ID NO: 54207 - DNA, 20 bp, Artificial
  CRISPR gRNA sequence
tctgagcaggggaagggagg

SEQ ID NO: 54208 - DNA, 20 bp, Artificial
  CRISPR gRNA sequence
agcaggggaagggagggggc

SEQ ID NO: 54209 - DNA, 20 bp, Artificial
  CRISPR gRNA sequence
gagggggctggaatcacaca

SEQ ID NO: 54210 - DNA, 20 bp, Artificial
  CRISPR gRNA sequence
agggggctggaatcacacac

SEQ ID NO: 54211 - DNA, 20 bp, Artificial
  CRISPR gRNA sequence
gggggctggaatcacacaca

SEQ ID NO: 54212 - DNA, 20 bp, Artificial
  CRISPR gRNA sequence
gctggaatcacacacagggc

SEQ ID NO: 54213 - DNA, 20 bp, Artificial
  CRISPR gRNA sequence
tggaatcacacacagggctg

SEQ ID NO: 54214 - DNA, 20 bp, Artificial
  CRISPR gRNA sequence
ggaatcacacacagggctgg

SEQ ID NO: 54215 - DNA, 20 bp, Artificial
  CRISPR gRNA sequence
catcactgtacctcatcctt

SEQ ID NO: 54216 - DNA, 20 bp, Artificial
  CRISPR gRNA sequence
atcactgtacctcatccttc

SEQ ID NO: 54217 - DNA, 20 bp, Artificial
  CRISPR gRNA sequence
cactgtacctcatccttcgg

SEQ ID NO: 54218 - DNA, 20 bp, Artificial
  CRISPR gRNA sequence
tacctcatccttcgggagct

SEQ ID NO: 54219 - DNA, 20 bp, Artificial
  CRISPR gRNA sequence
cctcatccttcgggagctca

SEQ ID NO: 54220 - DNA, 20 bp, Artificial
  CRISPR gRNA sequence
ctcatccttcgggagctcag

SEQ ID NO: 54221 - DNA, 20 bp, Artificial
  CRISPR gRNA sequence
atccttcgggagctcagagg

SEQ ID NO: 54222 - DNA, 20 bp, Artificial
  CRISPR gRNA sequence
tcgggagctcagaggcagct

SEQ ID NO: 54223 - DNA, 20 bp, Artificial
  CRISPR gRNA sequence
gggagctcagaggcagctca

SEQ ID NO: 54224 - DNA, 20 bp, Artificial
  CRISPR gRNA sequence
ggagctcagaggcagctcag

SEQ ID NO: 54225 - DNA, 20 bp, Artificial
  CRISPR gRNA sequence
gagctcagaggcagctcaga

SEQ ID NO: 54226 - DNA, 20 bp, Artificial
  CRISPR gRNA sequence
gaggcagctcagagggcatc

SEQ ID NO: 54227 - DNA, 20 bp, Artificial
  CRISPR gRNA sequence
ggcagctcagagggcatctg

SEQ ID NO: 54228 - DNA, 20 bp, Artificial
  CRISPR gRNA sequence
tcagagggcatctggagcat

SEQ ID NO: 54229 - DNA, 20 bp, Artificial
  CRISPR gRNA sequence
cagagggcatctggagcatg

SEQ ID NO: 54230 - DNA, 20 bp, Artificial
  CRISPR gRNA sequence
atctggagcatgaggctgtc

SEQ ID NO: 54231 - DNA, 20 bp, Artificial
  CRISPR gRNA sequence
catgaggctgtcaagaaatg

SEQ ID NO: 54232 - DNA, 20 bp, Artificial
  CRISPR gRNA sequence
gctgtcaagaaatgcagccc

SEQ ID NO: 54233 - DNA, 20 bp, Artificial
  CRISPR gRNA sequence
tgtcaagaaatgcagccctg

SEQ ID NO: 54234 - DNA, 20 bp, Artificial
  CRISPR gRNA sequence
gtcaagaaatgcagccctgg

SEQ ID NO: 54235 - DNA, 20 bp, Artificial
  CRISPR gRNA sequence
tcaagaaatgcagccctgga

SEQ ID NO: 54236 - DNA, 20 bp, Artificial
  CRISPR gRNA sequence
agccctggagggacatcacc

SEQ ID NO: 54237 - DNA, 20 bp, Artificial
  CRISPR gRNA sequence
gccctggagggacatcacca

SEQ ID NO: 54238 - DNA, 20 bp, Artificial
  CRISPR gRNA sequence
tggagggacatcaccaaggc

SEQ ID NO: 54239 - DNA, 20 bp, Artificial
  CRISPR gRNA sequence
ggagggacatcaccaaggcc

SEQ ID NO: 54240 - DNA, 20 bp, Artificial
  CRISPR gRNA sequence
gacatcaccaaggccaggct

SEQ ID NO: 54241 - DNA, 20 bp, Artificial
  CRISPR gRNA sequence
caccaaggccaggctgagca

SEQ ID NO: 54242 - DNA, 20 bp, Artificial
  CRISPR gRNA sequence
accaaggccaggctgagcaa

SEQ ID NO: 54243 - DNA, 20 bp, Artificial
  CRISPR gRNA sequence
aaggccatgtccgccatctc

SEQ ID NO: 54244 - DNA, 20 bp, Artificial
  CRISPR gRNA sequence
ccatctccagaatccatcct

SEQ ID NO: 54245 - DNA, 20 bp, Artificial
  CRISPR gRNA sequence
tccagaatccatcctcagcc

SEQ ID NO: 54246 - DNA, 20 bp, Artificial
  CRISPR gRNA sequence
cagcctggccttccaccatc

SEQ ID NO: 54247 - DNA, 20 bp, Artificial
  CRISPR gRNA sequence
atcgagccctatcctccacc

SEQ ID NO: 54248 - DNA, 20 bp, Artificial
  CRISPR gRNA sequence
cgagccctatcctccaccta

SEQ ID NO: 54249 - DNA, 20 bp, Artificial
  CRISPR gRNA sequence
atcctccacctagagtcaat

SEQ ID NO: 54250 - DNA, 20 bp, Artificial
  CRISPR gRNA sequence
acctagagtcaatcagacct

SEQ ID NO: 54251 - DNA, 20 bp, Artificial
  CRISPR gRNA sequence
atcagaccttggtgccaatt

SEQ ID NO: 54252 - DNA, 20 bp, Artificial
  CRISPR gRNA sequence
aatttggcttctccacttcc

SEQ ID NO: 54253 - DNA, 20 bp, Artificial
  CRISPR gRNA sequence
acttcctggttgtgtgaccc

SEQ ID NO: 54254 - DNA, 20 bp, Artificial
  CRISPR gRNA sequence
gtgtgaccctggacaaatca

SEQ ID NO: 54255 - DNA, 20 bp, Artificial
  CRISPR gRNA sequence
gacaaatcacagcctctcaa

SEQ ID NO: 54256 - DNA, 20 bp, Artificial
  CRISPR gRNA sequence
acaaatcacagcctctcaat

SEQ ID NO: 54257 - DNA, 20 bp, Artificial
  CRISPR gRNA sequence
aaatcacagcctctcaatgg

SEQ ID NO: 54258 - DNA, 20 bp, Artificial
  CRISPR gRNA sequence
agactgtatgtgaactgcct

SEQ ID NO: 54259 - DNA, 20 bp, Artificial
  CRISPR gRNA sequence
gtatgtgaactgccttagtt

SEQ ID NO: 54260 - DNA, 20 bp, Artificial
  CRISPR gRNA sequence
aactgccttagtttggtgct

SEQ ID NO: 54261 - DNA, 20 bp, Artificial
  CRISPR gRNA sequence
tttggtgcttggtgcataca

SEQ ID NO: 54262 - DNA, 20 bp, Artificial
  CRISPR gRNA sequence
gtgcttggtgcatacatggc

SEQ ID NO: 54263 - DNA, 20 bp, Artificial
  CRISPR gRNA sequence
cctcctcctcatctgtgctt

SEQ ID NO: 54264 - DNA, 20 bp, Artificial
  CRISPR gRNA sequence
tcctcctcatctgtgcttca

SEQ ID NO: 54265 - DNA, 20 bp, Artificial
  CRISPR gRNA sequence
catctgtgcttcagagatgt

SEQ ID NO: 54266 - DNA, 20 bp, Artificial
  CRISPR gRNA sequence
tgcttcagagatgtcagccc

SEQ ID NO: 54267 - DNA, 20 bp, Artificial
  CRISPR gRNA sequence
tcagagatgtcagccccagc

SEQ ID NO: 54268 - DNA, 20 bp, Artificial
  CRISPR gRNA sequence
tgtcagccccagctggaatc

SEQ ID NO: 54269 - DNA, 20 bp, Artificial
  CRISPR gRNA sequence
cccagctggaatcgagcctt

SEQ ID NO: 54270 - DNA, 20 bp, Artificial
  CRISPR gRNA sequence
agctggaatcgagccttcag

SEQ ID NO: 54271 - DNA, 20 bp, Artificial
  CRISPR gRNA sequence
gaatcgagccttcagtagtc

SEQ ID NO: 54272 - DNA, 20 bp, Artificial
  CRISPR gRNA sequence
cttcagtagtccagactcta

SEQ ID NO: 54273 - DNA, 20 bp, Artificial
  CRISPR gRNA sequence
cagtagtccagactctacag

SEQ ID NO: 54274 - DNA, 20 bp, Artificial
  CRISPR gRNA sequence
gtagtccagactctacagaa

SEQ ID NO: 54275 - DNA, 20 bp, Artificial
  CRISPR gRNA sequence
agactctacagaagagattg

SEQ ID NO: 54276 - DNA, 20 bp, Artificial
  CRISPR gRNA sequence
gactctacagaagagattgt

SEQ ID NO: 54277 - DNA, 20 bp, Artificial
  CRISPR gRNA sequence
tctacagaagagattgtggg

SEQ ID NO: 54278 - DNA, 20 bp, Artificial
  CRISPR gRNA sequence
ctacagaagagattgtgggt

SEQ ID NO: 54279 - DNA, 20 bp, Artificial
  CRISPR gRNA sequence
aagagattgtgggtgggctc

SEQ ID NO: 54280 - DNA, 20 bp, Artificial
  CRISPR gRNA sequence
agagattgtgggtgggctcc

SEQ ID NO: 54281 - DNA, 20 bp, Artificial
  CRISPR gRNA sequence
agattgtgggtgggctccgg

SEQ ID NO: 54282 - DNA, 20 bp, Artificial
  CRISPR gRNA sequence
gtgggtgggctccgggagca

SEQ ID NO: 54283 - DNA, 20 bp, Artificial
  CRISPR gRNA sequence
gggtgggctccgggagcaaa

SEQ ID NO: 54284 - DNA, 20 bp, Artificial
  CRISPR gRNA sequence
ggctccgggagcaaagagct

SEQ ID NO: 54285 - DNA, 20 bp, Artificial
  CRISPR gRNA sequence
ctgagtctctacccatgcgc

SEQ ID NO: 54286 - DNA, 20 bp, Artificial
  CRISPR gRNA sequence
tgagtctctacccatgcgct

SEQ ID NO: 54287 - DNA, 20 bp, Artificial
  CRISPR gRNA sequence
tctctacccatgcgctaggc

SEQ ID NO: 54288 - DNA, 20 bp, Artificial
  CRISPR gRNA sequence
ctctacccatgcgctaggct

SEQ ID NO: 54289 - DNA, 20 bp, Artificial
  CRISPR gRNA sequence
tctacccatgcgctaggctg

SEQ ID NO: 54290 - DNA, 20 bp, Artificial
  CRISPR gRNA sequence
tgcgctaggctggggcaatc

SEQ ID NO: 54291 - DNA, 20 bp, Artificial
  CRISPR gRNA sequence
gcgctaggctggggcaatcc

SEQ ID NO: 54292 - DNA, 20 bp, Artificial
  CRISPR gRNA sequence
ggggcaatccaggaccctaa

SEQ ID NO: 54293 - DNA, 20 bp, Artificial
  CRISPR gRNA sequence
gggcaatccaggaccctaat

SEQ ID NO: 54294 - DNA, 20 bp, Artificial
  CRISPR gRNA sequence
cctaatgggtccttgtgtga

SEQ ID NO: 54295 - DNA, 20 bp, Artificial
  CRISPR gRNA sequence
ctaatgggtccttgtgtgaa

SEQ ID NO: 54296 - DNA, 20 bp, Artificial
  CRISPR gRNA sequence
taatgggtccttgtgtgaaa

SEQ ID NO: 54297 - DNA, 20 bp, Artificial
  CRISPR gRNA sequence
gtccttgtgtgaaagggata

SEQ ID NO: 54298 - DNA, 20 bp, Artificial
  CRISPR gRNA sequence
cttgtgtgaaagggatacag

SEQ ID NO: 54299 - DNA, 20 bp, Artificial
  CRISPR gRNA sequence
agggatacagaagttccgac

SEQ ID NO: 54300 - DNA, 20 bp, Artificial
  CRISPR gRNA sequence
gggatacagaagttccgacc

SEQ ID NO: 54301 - DNA, 20 bp, Artificial
  CRISPR gRNA sequence
acagaagttccgaccaggac

SEQ ID NO: 54302 - DNA, 20 bp, Artificial
  CRISPR gRNA sequence
agaagttccgaccaggacca

SEQ ID NO: 54303 - DNA, 20 bp, Artificial
  CRISPR gRNA sequence
tccgaccaggaccagagcta

SEQ ID NO: 54304 - DNA, 20 bp, Artificial
  CRISPR gRNA sequence
ccgaccaggaccagagctac

SEQ ID NO: 54305 - DNA, 20 bp, Artificial
  CRISPR gRNA sequence
ccaggaccagagctacaggc

SEQ ID NO: 54306 - DNA, 20 bp, Artificial
  CRISPR gRNA sequence
caggaccagagctacaggcc

SEQ ID NO: 54307 - DNA, 20 bp, Artificial
  CRISPR gRNA sequence
ctacaggccaggcaatcccc

SEQ ID NO: 54308 - DNA, 20 bp, Artificial
  CRISPR gRNA sequence
tacaggccaggcaatcccct

SEQ ID NO: 54309 - DNA, 20 bp, Artificial
  CRISPR gRNA sequence
ccaggcaatcccctgggttt

SEQ ID NO: 54310 - DNA, 20 bp, Artificial
  CRISPR gRNA sequence
gcaatcccctgggtttaagc

SEQ ID NO: 54311 - DNA, 20 bp, Artificial
  CRISPR gRNA sequence
aatcccctgggtttaagctg

SEQ ID NO: 54312 - DNA, 20 bp, Artificial
  CRISPR gRNA sequence
atcccctgggtttaagctgg

SEQ ID NO: 54313 - DNA, 20 bp, Artificial
  CRISPR gRNA sequence
tcccctgggtttaagctgga

SEQ ID NO: 54314 - DNA, 20 bp, Artificial
  CRISPR gRNA sequence
gggtttaagctggagggctc

SEQ ID NO: 54315 - DNA, 20 bp, Artificial
  CRISPR gRNA sequence
gctggagggctctagtctcc

SEQ ID NO: 54316 - DNA, 20 bp, Artificial
  CRISPR gRNA sequence
agtctcccggaatccccctc

SEQ ID NO: 54317 - DNA, 20 bp, Artificial
  CRISPR gRNA sequence
tggctacccaactcctgccc

SEQ ID NO: 54318 - DNA, 20 bp, Artificial
  CRISPR gRNA sequence
gctgtctatatcctacacac

SEQ ID NO: 54319 - DNA, 20 bp, Artificial
  CRISPR gRNA sequence
ctgtctatatcctacacact

SEQ ID NO: 54320 - DNA, 20 bp, Artificial
  CRISPR gRNA sequence
tgtctatatcctacacactg

SEQ ID NO: 54321 - DNA, 20 bp, Artificial
  CRISPR gRNA sequence
ctacacactggggctccttt

SEQ ID NO: 54322 - DNA, 20 bp, Artificial
  CRISPR gRNA sequence
tacacactggggctcctttc

SEQ ID NO: 54323 - DNA, 20 bp, Artificial
  CRISPR gRNA sequence
gggctcctttcaggcaccat

SEQ ID NO: 54324 - DNA, 20 bp, Artificial
  CRISPR gRNA sequence
gctcctttcaggcaccatga

SEQ ID NO: 54325 - DNA, 20 bp, Artificial
  CRISPR gRNA sequence
ctcctttcaggcaccatgag

SEQ ID NO: 54326 - DNA, 20 bp, Artificial
  CRISPR gRNA sequence
ctttcaggcaccatgagagg

SEQ ID NO: 54327 - DNA, 20 bp, Artificial
  CRISPR gRNA sequence
ttcaggcaccatgagaggcg

SEQ ID NO: 54328 - DNA, 20 bp, Artificial
  CRISPR gRNA sequence
tcaggcaccatgagaggcgg

SEQ ID NO: 54329 - DNA, 20 bp, Artificial
  CRISPR gRNA sequence
ggcaccatgagaggcggagg

SEQ ID NO: 54330 - DNA, 20 bp, Artificial
  CRISPR gRNA sequence
catgagaggcggaggtggtc

SEQ ID NO: 54331 - DNA, 20 bp, Artificial
  CRISPR gRNA sequence
aggcggaggtggtctggatt

SEQ ID NO: 54332 - DNA, 20 bp, Artificial
  CRISPR gRNA sequence
ggatttggaccctccccctt

SEQ ID NO: 54333 - DNA, 20 bp, Artificial
  CRISPR gRNA sequence
gatttggaccctcccccttt

SEQ ID NO: 54334 - DNA, 20 bp, Artificial
  CRISPR gRNA sequence
atttggaccctccccctttg

SEQ ID NO: 54335 - DNA, 20 bp, Artificial
  CRISPR gRNA sequence
ttggggctgcatcctttgcc

SEQ ID NO: 54336 - DNA, 20 bp, Artificial
  CRISPR gRNA sequence
cgctcttccgtgaatttgtc

SEQ ID NO: 54337 - DNA, 20 bp, Artificial
  CRISPR gRNA sequence
gctcttccgtgaatttgtcc

SEQ ID NO: 54338 - DNA, 20 bp, Artificial
  CRISPR gRNA sequence
tgaatttgtccaggtcaccc

SEQ ID NO: 54339 - DNA, 20 bp, Artificial
  CRISPR gRNA sequence
atttgtccaggtcaccctgg

SEQ ID NO: 54340 - DNA, 20 bp, Artificial
  CRISPR gRNA sequence
caccctggcagttgactgac

SEQ ID NO: 54341 - DNA, 20 bp, Artificial
  CRISPR gRNA sequence
gttgactgactggcactgcc

SEQ ID NO: 54342 - DNA, 20 bp, Artificial
  CRISPR gRNA sequence
tgactggcactgcccagctg

SEQ ID NO: 54343 - DNA, 20 bp, Artificial
  CRISPR gRNA sequence
actggcactgcccagctgtg

SEQ ID NO: 54344 - DNA, 20 bp, Artificial
  CRISPR gRNA sequence
ctggcactgcccagctgtgg

SEQ ID NO: 54345 - DNA, 20 bp, Artificial
  CRISPR gRNA sequence
tggcactgcccagctgtgga

SEQ ID NO: 54346 - DNA, 20 bp, Artificial
  CRISPR gRNA sequence
cactgcccagctgtggaggg

SEQ ID NO: 54347 - DNA, 20 bp, Artificial
  CRISPR gRNA sequence
ctgcccagctgtggagggta

SEQ ID NO: 54348 - DNA, 20 bp, Artificial
  CRISPR gRNA sequence
gcccagctgtggagggtaga

SEQ ID NO: 54349 - DNA, 20 bp, Artificial
  CRISPR gRNA sequence
cccagctgtggagggtagag

SEQ ID NO: 54350 - DNA, 20 bp, Artificial
  CRISPR gRNA sequence
ccagctgtggagggtagaga

SEQ ID NO: 54351 - DNA, 20 bp, Artificial
  CRISPR gRNA sequence
cagctgtggagggtagagag

SEQ ID NO: 54352 - DNA, 20 bp, Artificial
  CRISPR gRNA sequence
agaggggaatgtccctgact

SEQ ID NO: 54353 - DNA, 20 bp, Artificial
  CRISPR gRNA sequence
ggaatgtccctgactgagca

SEQ ID NO: 54354 - DNA, 20 bp, Artificial
  CRISPR gRNA sequence
aatgtccctgactgagcatg

SEQ ID NO: 54355 - DNA, 20 bp, Artificial
  CRISPR gRNA sequence
tccctgactgagcatggagt

SEQ ID NO: 54356 - DNA, 20 bp, Artificial
  CRISPR gRNA sequence
ccctgactgagcatggagtt

SEQ ID NO: 54357 - DNA, 20 bp, Artificial
  CRISPR gRNA sequence
cctgactgagcatggagttg

SEQ ID NO: 54358 - DNA, 20 bp, Artificial
  CRISPR gRNA sequence
gcatggagttggggtgaaat

SEQ ID NO: 54359 - DNA, 20 bp, Artificial
  CRISPR gRNA sequence
catggagttggggtgaaatc

SEQ ID NO: 54360 - DNA, 20 bp, Artificial
  CRISPR gRNA sequence
aaatcgggccctacctctcc

SEQ ID NO: 54361 - DNA, 20 bp, Artificial
  CRISPR gRNA sequence
aatcgggccctacctctcct

SEQ ID NO: 54362 - DNA, 20 bp, Artificial
  CRISPR gRNA sequence
atcgggccctacctctcctg

SEQ ID NO: 54363 - DNA, 20 bp, Artificial
  CRISPR gRNA sequence
tggggccccttctgctcctc

SEQ ID NO: 54364 - DNA, 20 bp, Artificial
  CRISPR gRNA sequence
ccttctgctcctctggctcc

SEQ ID NO: 54365 - DNA, 20 bp, Artificial
  CRISPR gRNA sequence
cttctgctcctctggctcct

SEQ ID NO: 54366 - DNA, 20 bp, Artificial
  CRISPR gRNA sequence
ctggctcctgggcaaacatg

SEQ ID NO: 54367 - DNA, 20 bp, Artificial
  CRISPR gRNA sequence
ctgggcaaacatgaagatca

SEQ ID NO: 54368 - DNA, 20 bp, Artificial
  CRISPR gRNA sequence
aagatcacagttttgtgctg

SEQ ID NO: 54369 - DNA, 20 bp, Artificial
  CRISPR gRNA sequence
agatcacagttttgtgctgc

SEQ ID NO: 54370 - DNA, 20 bp, Artificial
  CRISPR gRNA sequence
gttttgtgctgcaggctgtg

SEQ ID NO: 54371 - DNA, 20 bp, Artificial
  CRISPR gRNA sequence
gctgcaggctgtgaagacaa

SEQ ID NO: 54372 - DNA, 20 bp, Artificial
  CRISPR gRNA sequence
tgcaggctgtgaagacaaaa

SEQ ID NO: 54373 - DNA, 20 bp, Artificial
  CRISPR gRNA sequence
gcaggctgtgaagacaaaag

SEQ ID NO: 54374 - DNA, 20 bp, Artificial
  CRISPR gRNA sequence
caggctgtgaagacaaaaga

SEQ ID NO: 54375 - DNA, 20 bp, Artificial
  CRISPR gRNA sequence
aggctgtgaagacaaaagag

SEQ ID NO: 54376 - DNA, 20 bp, Artificial
  CRISPR gRNA sequence
tgtgaagacaaaagaggggt

SEQ ID NO: 54377 - DNA, 20 bp, Artificial
  CRISPR gRNA sequence
gtgaagacaaaagaggggtg

SEQ ID NO: 54378 - DNA, 20 bp, Artificial
  CRISPR gRNA sequence
aagacaaaagaggggtgagg

SEQ ID NO: 54379 - DNA, 20 bp, Artificial
  CRISPR gRNA sequence
caaaagaggggtgaggaagc

SEQ ID NO: 54380 - DNA, 20 bp, Artificial
  CRISPR gRNA sequence
aaagaggggtgaggaagcga

SEQ ID NO: 54381 - DNA, 20 bp, Artificial
  CRISPR gRNA sequence
aagaggggtgaggaagcgag

SEQ ID NO: 54382 - DNA, 20 bp, Artificial
  CRISPR gRNA sequence
gtgaggaagcgagaggttat

SEQ ID NO: 54383 - DNA, 20 bp, Artificial
  CRISPR gRNA sequence
ccctgttactatttcttttt

SEQ ID NO: 54384 - DNA, 20 bp, Artificial
  CRISPR gRNA sequence
ctgttactatttctttttga

SEQ ID NO: 54385 - DNA, 20 bp, Artificial
  CRISPR gRNA sequence
ttactatttctttttgagag

SEQ ID NO: 54386 - DNA, 20 bp, Artificial
  CRISPR gRNA sequence
tactatttctttttgagaga

SEQ ID NO: 54387 - DNA, 20 bp, Artificial
  CRISPR gRNA sequence
ttctttttgagagaaggtct

SEQ ID NO: 54388 - DNA, 20 bp, Artificial
  CRISPR gRNA sequence
aaggtctcagtctgttgccc

SEQ ID NO: 54389 - DNA, 20 bp, Artificial
  CRISPR gRNA sequence
tctcagtctgttgcccaagc

SEQ ID NO: 54390 - DNA, 20 bp, Artificial
  CRISPR gRNA sequence
ctgttgcccaagctggtgtg

SEQ ID NO: 54391 - DNA, 20 bp, Artificial
  CRISPR gRNA sequence
ttgcccaagctggtgtgcag

SEQ ID NO: 54392 - DNA, 20 bp, Artificial
  CRISPR gRNA sequence
ggtgtgcagtggtgcaatca

SEQ ID NO: 54393 - DNA, 20 bp, Artificial
  CRISPR gRNA sequence
ggtgcaatcatggctcactg

SEQ ID NO: 54394 - DNA, 20 bp, Artificial
  CRISPR gRNA sequence
tcactgaagcctccacctcc

SEQ ID NO: 54395 - DNA, 20 bp, Artificial
  CRISPR gRNA sequence
cactgaagcctccacctcct

SEQ ID NO: 54396 - DNA, 20 bp, Artificial
  CRISPR gRNA sequence
agcctccacctcctgggctc

SEQ ID NO: 54397 - DNA, 20 bp, Artificial
  CRISPR gRNA sequence
ctcaagcaatcctcccactt

SEQ ID NO: 54398 - DNA, 20 bp, Artificial
  CRISPR gRNA sequence
tcctcccacttcagcctcct

SEQ ID NO: 54399 - DNA, 20 bp, Artificial
  CRISPR gRNA sequence
tcccacttcagcctcctgag

SEQ ID NO: 54400 - DNA, 20 bp, Artificial
  CRISPR gRNA sequence
acttcagcctcctgagtagc

SEQ ID NO: 54401 - DNA, 20 bp, Artificial
  CRISPR gRNA sequence
cttcagcctcctgagtagct

SEQ ID NO: 54402 - DNA, 20 bp, Artificial
  CRISPR gRNA sequence
ctcctgagtagctgggatta

SEQ ID NO: 54403 - DNA, 20 bp, Artificial
  CRISPR gRNA sequence
tcctgagtagctgggattac

SEQ ID NO: 54404 - DNA, 20 bp, Artificial
  CRISPR gRNA sequence
ggattacaggcttgtgccat

SEQ ID NO: 54405 - DNA, 20 bp, Artificial
  CRISPR gRNA sequence
gattacaggcttgtgccatc

SEQ ID NO: 54406 - DNA, 20 bp, Artificial
  CRISPR gRNA sequence
caggcttgtgccatcaggcc

SEQ ID NO: 54407 - DNA, 20 bp, Artificial
  CRISPR gRNA sequence
gcccagctaattaaaaaaaa

SEQ ID NO: 54408 - DNA, 20 bp, Artificial
  CRISPR gRNA sequence
taattaaaaaaaaaagtatg

SEQ ID NO: 54409 - DNA, 20 bp, Artificial
  CRISPR gRNA sequence
attaaaaaaaaaagtatgta

SEQ ID NO: 54410 - DNA, 20 bp, Artificial
  CRISPR gRNA sequence
aaaaaaaaagtatgtagaga

SEQ ID NO: 54411 - DNA, 20 bp, Artificial
  CRISPR gRNA sequence
acagtctatgttgtctactc

SEQ ID NO: 54412 - DNA, 20 bp, Artificial
  CRISPR gRNA sequence
ctactctggtctcgaacttc

SEQ ID NO: 54413 - DNA, 20 bp, Artificial
  CRISPR gRNA sequence
tactctggtctcgaacttct

SEQ ID NO: 54414 - DNA, 20 bp, Artificial
  CRISPR gRNA sequence
tggtctcgaacttctgggct

SEQ ID NO: 54415 - DNA, 20 bp, Artificial
  CRISPR gRNA sequence
ggtctcgaacttctgggctc

SEQ ID NO: 54416 - DNA, 20 bp, Artificial
  CRISPR gRNA sequence
cctcccacctttgcttccca

SEQ ID NO: 54417 - DNA, 20 bp, Artificial
  CRISPR gRNA sequence
acctttgcttcccaaagtgc

SEQ ID NO: 54418 - DNA, 20 bp, Artificial
  CRISPR gRNA sequence
cctttgcttcccaaagtgct

SEQ ID NO: 54419 - DNA, 20 bp, Artificial
  CRISPR gRNA sequence
ttcccaaagtgctgggatga

SEQ ID NO: 54420 - DNA, 20 bp, Artificial
  CRISPR gRNA sequence
tcccaaagtgctgggatgat

SEQ ID NO: 54421 - DNA, 20 bp, Artificial
  CRISPR gRNA sequence
agtgctgggatgataggtgt

SEQ ID NO: 54422 - DNA, 20 bp, Artificial
  CRISPR gRNA sequence
taggtgtgagccaccgtgcc

SEQ ID NO: 54423 - DNA, 20 bp, Artificial
  CRISPR gRNA sequence
ggcctgtcactttttacccc

SEQ ID NO: 54424 - DNA, 20 bp, Artificial
  CRISPR gRNA sequence
gtcactttttacccctggcc

SEQ ID NO: 54425 - DNA, 20 bp, Artificial
  CRISPR gRNA sequence
tcactttttacccctggccc

SEQ ID NO: 54426 - DNA, 20 bp, Artificial
  CRISPR gRNA sequence
actttttacccctggcccgg

SEQ ID NO: 54427 - DNA, 20 bp, Artificial
  CRISPR gRNA sequence
ctttttacccctggcccggg

SEQ ID NO: 54428 - DNA, 20 bp, Artificial
  CRISPR gRNA sequence
ctggcccgggaggacctctc

SEQ ID NO: 54429 - DNA, 20 bp, Artificial
  CRISPR gRNA sequence
aagttccatccccctgcctc

SEQ ID NO: 54430 - DNA, 20 bp, Artificial
  CRISPR gRNA sequence
catccccctgcctccagctg

SEQ ID NO: 54431 - DNA, 20 bp, Artificial
  CRISPR gRNA sequence
actcccctctgacttcctct

SEQ ID NO: 54432 - DNA, 20 bp, Artificial
  CRISPR gRNA sequence
tctgacttcctctgagcttt

SEQ ID NO: 54433 - DNA, 20 bp, Artificial
  CRISPR gRNA sequence
tgacttcctctgagcttttg

SEQ ID NO: 54434 - DNA, 20 bp, Artificial
  CRISPR gRNA sequence
gacttcctctgagcttttgg

SEQ ID NO: 54435 - DNA, 20 bp, Artificial
  CRISPR gRNA sequence
acttcctctgagcttttgga

SEQ ID NO: 54436 - DNA, 20 bp, Artificial
  CRISPR gRNA sequence
gggctgaaatctttctacca

SEQ ID NO: 54437 - DNA, 20 bp, Artificial
  CRISPR gRNA sequence
cacaaatgtatctattgcct

SEQ ID NO: 54438 - DNA, 20 bp, Artificial
  CRISPR gRNA sequence
aatgtatctattgcctaagt

SEQ ID NO: 54439 - DNA, 20 bp, Artificial
  CRISPR gRNA sequence
cctaagtaagccccatttcc

SEQ ID NO: 54440 - DNA, 20 bp, Artificial
  CRISPR gRNA sequence
agtaagccccatttcctggc

SEQ ID NO: 54441 - DNA, 20 bp, Artificial
  CRISPR gRNA sequence
catttcctggcaagtcttaa

SEQ ID NO: 54442 - DNA, 20 bp, Artificial
  CRISPR gRNA sequence
aaattctgtgttctctcttt

SEQ ID NO: 54443 - DNA, 20 bp, Artificial
  CRISPR gRNA sequence
tgtgttctctcttttagccc

SEQ ID NO: 54444 - DNA, 20 bp, Artificial
  CRISPR gRNA sequence
actgaaacccctctctctgc

SEQ ID NO: 54445 - DNA, 20 bp, Artificial
  CRISPR gRNA sequence
aaacccctctctctgctagt

SEQ ID NO: 54446 - DNA, 20 bp, Artificial
  CRISPR gRNA sequence
cagtgttctgtctgtgctca

SEQ ID NO: 54447 - DNA, 20 bp, Artificial
  CRISPR gRNA sequence
gtctgtgctcaaagtatgtg

SEQ ID NO: 54448 - DNA, 20 bp, Artificial
  CRISPR gRNA sequence
aagtatgtgtggattacccc

SEQ ID NO: 54449 - DNA, 20 bp, Artificial
  CRISPR gRNA sequence
ggattacccctggtaacctt

SEQ ID NO: 54450 - DNA, 20 bp, Artificial
  CRISPR gRNA sequence
attacccctggtaacctttg

SEQ ID NO: 54451 - DNA, 20 bp, Artificial
  CRISPR gRNA sequence
cccctggtaacctttggagt

SEQ ID NO: 54452 - DNA, 20 bp, Artificial
  CRISPR gRNA sequence
ccttcaaaccttccattttc

SEQ ID NO: 54453 - DNA, 20 bp, Artificial
  CRISPR gRNA sequence
taatttttgttttacaaaca

SEQ ID NO: 54454 - DNA, 20 bp, Artificial
  CRISPR gRNA sequence
aatttttgttttacaaacat

SEQ ID NO: 54455 - DNA, 20 bp, Artificial
  CRISPR gRNA sequence
acaaacatgggattaaacta

SEQ ID NO: 54456 - DNA, 20 bp, Artificial
  CRISPR gRNA sequence
tagattctctttttaaacat

SEQ ID NO: 54457 - DNA, 20 bp, Artificial
  CRISPR gRNA sequence
tttttaaacattagtttttt

SEQ ID NO: 54458 - DNA, 20 bp, Artificial
  CRISPR gRNA sequence
ttttaaacattagtttttta

SEQ ID NO: 54459 - DNA, 20 bp, Artificial
  CRISPR gRNA sequence
tttaaacattagttttttaa

SEQ ID NO: 54460 - DNA, 20 bp, Artificial
  CRISPR gRNA sequence
aacattagttttttaagggc

SEQ ID NO: 54461 - DNA, 20 bp, Artificial
  CRISPR gRNA sequence
attagttttttaagggctag

SEQ ID NO: 54462 - DNA, 20 bp, Artificial
  CRISPR gRNA sequence
agttttttaagggctagaag

SEQ ID NO: 54463 - DNA, 20 bp, Artificial
  CRISPR gRNA sequence
gttttttaagggctagaagc

SEQ ID NO: 54464 - DNA, 20 bp, Artificial
  CRISPR gRNA sequence
ttttttaagggctagaagca

SEQ ID NO: 54465 - DNA, 20 bp, Artificial
  CRISPR gRNA sequence
taatacttgatcattattga

SEQ ID NO: 54466 - DNA, 20 bp, Artificial
  CRISPR gRNA sequence
aatacttgatcattattgat

SEQ ID NO: 54467 - DNA, 20 bp, Artificial
  CRISPR gRNA sequence
ttgatcattattgatgggaa

SEQ ID NO: 54468 - DNA, 20 bp, Artificial
  CRISPR gRNA sequence
tttttttttttttttaattt

SEQ ID NO: 54469 - DNA, 20 bp, Artificial
  CRISPR gRNA sequence
tttttttttttaatttgaga

SEQ ID NO: 54470 - DNA, 20 bp, Artificial
  CRISPR gRNA sequence
tttttttttaatttgagaca

SEQ ID NO: 54471 - DNA, 20 bp, Artificial
  CRISPR gRNA sequence
cagagtcttgctctgtctcc

SEQ ID NO: 54472 - DNA, 20 bp, Artificial
  CRISPR gRNA sequence
agagtcttgctctgtctccc

SEQ ID NO: 54473 - DNA, 20 bp, Artificial
  CRISPR gRNA sequence
tcttgctctgtctcccaggc

SEQ ID NO: 54474 - DNA, 20 bp, Artificial
  CRISPR gRNA sequence
ttgctctgtctcccaggctg

SEQ ID NO: 54475 - DNA, 20 bp, Artificial
  CRISPR gRNA sequence
ctgtctcccaggctggagtg

SEQ ID NO: 54476 - DNA, 20 bp, Artificial
  CRISPR gRNA sequence
tctcccaggctggagtgcag

SEQ ID NO: 54477 - DNA, 20 bp, Artificial
  CRISPR gRNA sequence
ggagtgcagtggcatgatct

SEQ ID NO: 54478 - DNA, 20 bp, Artificial
  CRISPR gRNA sequence
tcactgcaacctccgcctcc

SEQ ID NO: 54479 - DNA, 20 bp, Artificial
  CRISPR gRNA sequence
cactgcaacctccgcctccc

SEQ ID NO: 54480 - DNA, 20 bp, Artificial
  CRISPR gRNA sequence
aacctccgcctcccaggttc

SEQ ID NO: 54481 - DNA, 20 bp, Artificial
  CRISPR gRNA sequence
ttccagcgattctcctgcct

SEQ ID NO: 54482 - DNA, 20 bp, Artificial
  CRISPR gRNA sequence
ttctcctgcctcagcctcct

SEQ ID NO: 54483 - DNA, 20 bp, Artificial
  CRISPR gRNA sequence
tcctgcctcagcctcctgag

SEQ ID NO: 54484 - DNA, 20 bp, Artificial
  CRISPR gRNA sequence
gcctcagcctcctgagtagc

SEQ ID NO: 54485 - DNA, 20 bp, Artificial
  CRISPR gRNA sequence
ctcctgagtagctggaatta

SEQ ID NO: 54486 - DNA, 20 bp, Artificial
  CRISPR gRNA sequence
tcctgagtagctggaattac

SEQ ID NO: 54487 - DNA, 20 bp, Artificial
  CRISPR gRNA sequence
caggtgcacgccaccatgcc

SEQ ID NO: 54488 - DNA, 20 bp, Artificial
  CRISPR gRNA sequence
tgcacgccaccatgcccagc

SEQ ID NO: 54489 - DNA, 20 bp, Artificial
  CRISPR gRNA sequence
ccagctagtttttgtatttt

SEQ ID NO: 54490 - DNA, 20 bp, Artificial
  CRISPR gRNA sequence
gctagtttttgtatttttag

SEQ ID NO: 54491 - DNA, 20 bp, Artificial
  CRISPR gRNA sequence
tagtttttgtatttttagta

SEQ ID NO: 54492 - DNA, 20 bp, Artificial
  CRISPR gRNA sequence
ttttgtatttttagtagaga

SEQ ID NO: 54493 - DNA, 20 bp, Artificial
  CRISPR gRNA sequence
tttgtatttttagtagagac

SEQ ID NO: 54494 - DNA, 20 bp, Artificial
  CRISPR gRNA sequence
ttgtatttttagtagagacg

SEQ ID NO: 54495 - DNA, 20 bp, Artificial
  CRISPR gRNA sequence
gagacggggtttcatcctat

SEQ ID NO: 54496 - DNA, 20 bp, Artificial
  CRISPR gRNA sequence
cggggtttcatcctattggc

SEQ ID NO: 54497 - DNA, 20 bp, Artificial
  CRISPR gRNA sequence
ggggtttcatcctattggcc

SEQ ID NO: 54498 - DNA, 20 bp, Artificial
  CRISPR gRNA sequence
tttcatcctattggccaggc

SEQ ID NO: 54499 - DNA, 20 bp, Artificial
  CRISPR gRNA sequence
tggtcttgaactcctgacct

SEQ ID NO: 54500 - DNA, 20 bp, Artificial
  CRISPR gRNA sequence
ggtcttgaactcctgacctc

SEQ ID NO: 54501 - DNA, 20 bp, Artificial
  CRISPR gRNA sequence
ctcaggtgatccccctgcct

SEQ ID NO: 54502 - DNA, 20 bp, Artificial
  CRISPR gRNA sequence
ccccctgcctcagcctccca

SEQ ID NO: 54503 - DNA, 20 bp, Artificial
  CRISPR gRNA sequence
gcctcagcctcccaaagtgc

SEQ ID NO: 54504 - DNA, 20 bp, Artificial
  CRISPR gRNA sequence
cctcagcctcccaaagtgct

SEQ ID NO: 54505 - DNA, 20 bp, Artificial
  CRISPR gRNA sequence
ctcccaaagtgctgggttta

SEQ ID NO: 54506 - DNA, 20 bp, Artificial
  CRISPR gRNA sequence
aagtgctgggtttacagcat

SEQ ID NO: 54507 - DNA, 20 bp, Artificial
  CRISPR gRNA sequence
tgggtttacagcatgagcca

SEQ ID NO: 54508 - DNA, 20 bp, Artificial
  CRISPR gRNA sequence
acagcatgagccacagcacc

SEQ ID NO: 54509 - DNA, 20 bp, Artificial
  CRISPR gRNA sequence
atgagccacagcacctggcc

SEQ ID NO: 54510 - DNA, 20 bp, Artificial
  CRISPR gRNA sequence
ctgccattgcatatcttgaa

SEQ ID NO: 54511 - DNA, 20 bp, Artificial
  CRISPR gRNA sequence
ataatcttttataatctttt

SEQ ID NO: 54512 - DNA, 20 bp, Artificial
  CRISPR gRNA sequence
ttataatcttttaagataat

SEQ ID NO: 54513 - DNA, 20 bp, Artificial
  CRISPR gRNA sequence
tgagttaaaatttttatgtt

SEQ ID NO: 54514 - DNA, 20 bp, Artificial
  CRISPR gRNA sequence
taaaatttttatgtttggcc

SEQ ID NO: 54515 - DNA, 20 bp, Artificial
  CRISPR gRNA sequence
tttttatgtttggcctggtg

SEQ ID NO: 54516 - DNA, 20 bp, Artificial
  CRISPR gRNA sequence
ttatgtttggcctggtgcag

SEQ ID NO: 54517 - DNA, 20 bp, Artificial
  CRISPR gRNA sequence
tacctataatccttgctctt

SEQ ID NO: 54518 - DNA, 20 bp, Artificial
  CRISPR gRNA sequence
acctataatccttgctcttt

SEQ ID NO: 54519 - DNA, 20 bp, Artificial
  CRISPR gRNA sequence
ctataatccttgctctttgg

SEQ ID NO: 54520 - DNA, 20 bp, Artificial
  CRISPR gRNA sequence
tataatccttgctctttggg

SEQ ID NO: 54521 - DNA, 20 bp, Artificial
  CRISPR gRNA sequence
atccttgctctttgggaggc

SEQ ID NO: 54522 - DNA, 20 bp, Artificial
  CRISPR gRNA sequence
tccttgctctttgggaggcc

SEQ ID NO: 54523 - DNA, 20 bp, Artificial
  CRISPR gRNA sequence
ccttgctctttgggaggcca

SEQ ID NO: 54524 - DNA, 20 bp, Artificial
  CRISPR gRNA sequence
tgctctttgggaggccaggg

SEQ ID NO: 54525 - DNA, 20 bp, Artificial
  CRISPR gRNA sequence
gctctttgggaggccagggc

SEQ ID NO: 54526 - DNA, 20 bp, Artificial
  CRISPR gRNA sequence
tctttgggaggccagggcag

SEQ ID NO: 54527 - DNA, 20 bp, Artificial
  CRISPR gRNA sequence
ctttgggaggccagggcagg

SEQ ID NO: 54528 - DNA, 20 bp, Artificial
  CRISPR gRNA sequence
ccagggcaggaggatcacat

SEQ ID NO: 54529 - DNA, 20 bp, Artificial
  CRISPR gRNA sequence
gcaggaggatcacatgagct

SEQ ID NO: 54530 - DNA, 20 bp, Artificial
  CRISPR gRNA sequence
caggaggatcacatgagctc

SEQ ID NO: 54531 - DNA, 20 bp, Artificial
  CRISPR gRNA sequence
ggaggatcacatgagctcgg

SEQ ID NO: 54532 - DNA, 20 bp, Artificial
  CRISPR gRNA sequence
tcacatgagctcgggagttt

SEQ ID NO: 54533 - DNA, 20 bp, Artificial
  CRISPR gRNA sequence
tgagctcgggagtttgagaa

SEQ ID NO: 54534 - DNA, 20 bp, Artificial
  CRISPR gRNA sequence
tcgggagtttgagaacagcc

SEQ ID NO: 54535 - DNA, 20 bp, Artificial
  CRISPR gRNA sequence
tgagaacagcctggtcaata

SEQ ID NO: 54536 - DNA, 20 bp, Artificial
  CRISPR gRNA sequence
aacagcctggtcaatatagc

SEQ ID NO: 54537 - DNA, 20 bp, Artificial
  CRISPR gRNA sequence
ctaaaaataaaaaaaattgc

SEQ ID NO: 54538 - DNA, 20 bp, Artificial
  CRISPR gRNA sequence
taaaaataaaaaaaattgcc

SEQ ID NO: 54539 - DNA, 20 bp, Artificial
  CRISPR gRNA sequence
ataaaaaaaattgccaggca

SEQ ID NO: 54540 - DNA, 20 bp, Artificial
  CRISPR gRNA sequence
gtgactcatgactgtaatcc

SEQ ID NO: 54541 - DNA, 20 bp, Artificial
  CRISPR gRNA sequence
tgactgtaatcccagcactt

SEQ ID NO: 54542 - DNA, 20 bp, Artificial
  CRISPR gRNA sequence
gactgtaatcccagcacttt

SEQ ID NO: 54543 - DNA, 20 bp, Artificial
  CRISPR gRNA sequence
ctgtaatcccagcactttgg

SEQ ID NO: 54544 - DNA, 20 bp, Artificial
  CRISPR gRNA sequence
tcccagcactttgggagact

SEQ ID NO: 54545 - DNA, 20 bp, Artificial
  CRISPR gRNA sequence
ccagcactttgggagactaa

SEQ ID NO: 54546 - DNA, 20 bp, Artificial
  CRISPR gRNA sequence
agcactttgggagactaaga

SEQ ID NO: 54547 - DNA, 20 bp, Artificial
  CRISPR gRNA sequence
ctttgggagactaagagaga

SEQ ID NO: 54548 - DNA, 20 bp, Artificial
  CRISPR gRNA sequence
actaagagagatggattgct

SEQ ID NO: 54549 - DNA, 20 bp, Artificial
  CRISPR gRNA sequence
gagagatggattgctgagcc

SEQ ID NO: 54550 - DNA, 20 bp, Artificial
  CRISPR gRNA sequence
agagatggattgctgagccc

SEQ ID NO: 54551 - DNA, 20 bp, Artificial
  CRISPR gRNA sequence
ggattgctgagcccaggatt

SEQ ID NO: 54552 - DNA, 20 bp, Artificial
  CRISPR gRNA sequence
attgctgagcccaggatttg

SEQ ID NO: 54553 - DNA, 20 bp, Artificial
  CRISPR gRNA sequence
ttgctgagcccaggatttgg

SEQ ID NO: 54554 - DNA, 20 bp, Artificial
  CRISPR gRNA sequence
agcccaggatttggaggtta

SEQ ID NO: 54555 - DNA, 20 bp, Artificial
  CRISPR gRNA sequence
caggatttggaggttacagt

SEQ ID NO: 54556 - DNA, 20 bp, Artificial
  CRISPR gRNA sequence
gtgattgtgtcactgtactc

SEQ ID NO: 54557 - DNA, 20 bp, Artificial
  CRISPR gRNA sequence
gtgtcactgtactccagcct

SEQ ID NO: 54558 - DNA, 20 bp, Artificial
  CRISPR gRNA sequence
ctgtactccagccttggtaa

SEQ ID NO: 54559 - DNA, 20 bp, Artificial
  CRISPR gRNA sequence
gtactccagccttggtaaca

SEQ ID NO: 54560 - DNA, 20 bp, Artificial
  CRISPR gRNA sequence
tccagccttggtaacagagc

SEQ ID NO: 54561 - DNA, 20 bp, Artificial
  CRISPR gRNA sequence
agagcaagatcctgtctcta

SEQ ID NO: 54562 - DNA, 20 bp, Artificial
  CRISPR gRNA sequence
tattatcatttttttttcta

SEQ ID NO: 54563 - DNA, 20 bp, Artificial
  CRISPR gRNA sequence
tttttttctatggttccact

SEQ ID NO: 54564 - DNA, 20 bp, Artificial
  CRISPR gRNA sequence
tggttccactgagttctctc

SEQ ID NO: 54565 - DNA, 20 bp, Artificial
  CRISPR gRNA sequence
ttccactgagttctctctgg

SEQ ID NO: 54566 - DNA, 20 bp, Artificial
  CRISPR gRNA sequence
agttctctctggaagtaact

SEQ ID NO: 54567 - DNA, 20 bp, Artificial
  CRISPR gRNA sequence
ttagtctaactaatatccct

SEQ ID NO: 54568 - DNA, 20 bp, Artificial
  CRISPR gRNA sequence
tatccctcggttaaacattc

SEQ ID NO: 54569 - DNA, 20 bp, Artificial
  CRISPR gRNA sequence
ttcctattataaccaatact

SEQ ID NO: 54570 - DNA, 20 bp, Artificial
  CRISPR gRNA sequence
tcctattataaccaatactg

SEQ ID NO: 54571 - DNA, 20 bp, Artificial
  CRISPR gRNA sequence
tactgaggtgaacatcccta

SEQ ID NO: 54572 - DNA, 20 bp, Artificial
  CRISPR gRNA sequence
cacaatcgtgataatttatt

SEQ ID NO: 54573 - DNA, 20 bp, Artificial
  CRISPR gRNA sequence
cgtgataatttatttagtat

SEQ ID NO: 54574 - DNA, 20 bp, Artificial
  CRISPR gRNA sequence
atttatttagtataagttcc

SEQ ID NO: 54575 - DNA, 20 bp, Artificial
  CRISPR gRNA sequence
tatttagtataagttcctgg

SEQ ID NO: 54576 - DNA, 20 bp, Artificial
  CRISPR gRNA sequence
tataagttcctggaagtgaa

SEQ ID NO: 54577 - DNA, 20 bp, Artificial
  CRISPR gRNA sequence
ataagttcctggaagtgaac

SEQ ID NO: 54578 - DNA, 20 bp, Artificial
  CRISPR gRNA sequence
taagttcctggaagtgaaca

SEQ ID NO: 54579 - DNA, 20 bp, Artificial
  CRISPR gRNA sequence
gaagtgaacagggcatcgct

SEQ ID NO: 54580 - DNA, 20 bp, Artificial
  CRISPR gRNA sequence
gggcatcgcttggaatgcac

SEQ ID NO: 54581 - DNA, 20 bp, Artificial
  CRISPR gRNA sequence
ggcatcgcttggaatgcact

SEQ ID NO: 54582 - DNA, 20 bp, Artificial
  CRISPR gRNA sequence
gcatcgcttggaatgcacta

SEQ ID NO: 54583 - DNA, 20 bp, Artificial
  CRISPR gRNA sequence
ctttattgaatcatcatata

SEQ ID NO: 54584 - DNA, 20 bp, Artificial
  CRISPR gRNA sequence
atcatcatatacagtgaacc

SEQ ID NO: 54585 - DNA, 20 bp, Artificial
  CRISPR gRNA sequence
tcatcatatacagtgaacca

SEQ ID NO: 54586 - DNA, 20 bp, Artificial
  CRISPR gRNA sequence
aggtcccctaatctaccttt

SEQ ID NO: 54587 - DNA, 20 bp, Artificial
  CRISPR gRNA sequence
ggtcccctaatctacctttt

SEQ ID NO: 54588 - DNA, 20 bp, Artificial
  CRISPR gRNA sequence
aatctaccttttgggtgaat

SEQ ID NO: 54589 - DNA, 20 bp, Artificial
  CRISPR gRNA sequence
cggtttccctctcctccctt

SEQ ID NO: 54590 - DNA, 20 bp, Artificial
  CRISPR gRNA sequence
ggtttccctctcctcccttg

SEQ ID NO: 54591 - DNA, 20 bp, Artificial
  CRISPR gRNA sequence
gtttccctctcctcccttga

SEQ ID NO: 54592 - DNA, 20 bp, Artificial
  CRISPR gRNA sequence
tttccctctcctcccttgag

SEQ ID NO: 54593 - DNA, 20 bp, Artificial
  CRISPR gRNA sequence
cctcccttgaggggtgttta

SEQ ID NO: 54594 - DNA, 20 bp, Artificial
  CRISPR gRNA sequence
cccttgaggggtgtttaaag

SEQ ID NO: 54595 - DNA, 20 bp, Artificial
  CRISPR gRNA sequence
ccttgaggggtgtttaaagc

SEQ ID NO: 54596 - DNA, 20 bp, Artificial
  CRISPR gRNA sequence
cttgaggggtgtttaaagca

SEQ ID NO: 54597 - DNA, 20 bp, Artificial
  CRISPR gRNA sequence
taaagcagggaccaccctac

SEQ ID NO: 54598 - DNA, 20 bp, Artificial
  CRISPR gRNA sequence
aaagcagggaccaccctact

SEQ ID NO: 54599 - DNA, 20 bp, Artificial
  CRISPR gRNA sequence
agggaccaccctactgggtt

SEQ ID NO: 54600 - DNA, 20 bp, Artificial
  CRISPR gRNA sequence
caccctactgggttgagaat

SEQ ID NO: 54601 - DNA, 20 bp, Artificial
  CRISPR gRNA sequence
accctactgggttgagaatg

SEQ ID NO: 54602 - DNA, 20 bp, Artificial
  CRISPR gRNA sequence
tgagaatgaggctttcctcc

SEQ ID NO: 54603 - DNA, 20 bp, Artificial
  CRISPR gRNA sequence
gaatgaggctttcctccgag

SEQ ID NO: 54604 - DNA, 20 bp, Artificial
  CRISPR gRNA sequence
aatgaggctttcctccgagt

SEQ ID NO: 54605 - DNA, 20 bp, Artificial
  CRISPR gRNA sequence
ctttcctccgagtgggaact

SEQ ID NO: 54606 - DNA, 20 bp, Artificial
  CRISPR gRNA sequence
cctcacctccccatactcaa

SEQ ID NO: 54607 - DNA, 20 bp, Artificial
  CRISPR gRNA sequence
acctccccatactcaacggc

SEQ ID NO: 54608 - DNA, 20 bp, Artificial
  CRISPR gRNA sequence
atactcaacggcgagactta

SEQ ID NO: 54609 - DNA, 20 bp, Artificial
  CRISPR gRNA sequence
aacggcgagacttacagaaa

SEQ ID NO: 54610 - DNA, 20 bp, Artificial
  CRISPR gRNA sequence
acggcgagacttacagaaat

SEQ ID NO: 54611 - DNA, 20 bp, Artificial
  CRISPR gRNA sequence
gagacttacagaaataggat

SEQ ID NO: 54612 - DNA, 20 bp, Artificial
  CRISPR gRNA sequence
agacttacagaaataggatt

SEQ ID NO: 54613 - DNA, 20 bp, Artificial
  CRISPR gRNA sequence
agaaataggattgggttccc

SEQ ID NO: 54614 - DNA, 20 bp, Artificial
  CRISPR gRNA sequence
aataggattgggttccctag

SEQ ID NO: 54615 - DNA, 20 bp, Artificial
  CRISPR gRNA sequence
aggattgggttccctagtgg

SEQ ID NO: 54616 - DNA, 20 bp, Artificial
  CRISPR gRNA sequence
gattgggttccctagtggca

SEQ ID NO: 54617 - DNA, 20 bp, Artificial
  CRISPR gRNA sequence
ggttccctagtggcagagcc

SEQ ID NO: 54618 - DNA, 20 bp, Artificial
  CRISPR gRNA sequence
gttccctagtggcagagcct

SEQ ID NO: 54619 - DNA, 20 bp, Artificial
  CRISPR gRNA sequence
gtggcagagcctgggtctgt

SEQ ID NO: 54620 - DNA, 20 bp, Artificial
  CRISPR gRNA sequence
gcagagcctgggtctgtgag

SEQ ID NO: 54621 - DNA, 20 bp, Artificial
  CRISPR gRNA sequence
cagagcctgggtctgtgagt

SEQ ID NO: 54622 - DNA, 20 bp, Artificial
  CRISPR gRNA sequence
agagcctgggtctgtgagtg

SEQ ID NO: 54623 - DNA, 20 bp, Artificial
  CRISPR gRNA sequence
gcctgggtctgtgagtgggg

SEQ ID NO: 54624 - DNA, 20 bp, Artificial
  CRISPR gRNA sequence
cctgggtctgtgagtggggt

SEQ ID NO: 54625 - DNA, 20 bp, Artificial
  CRISPR gRNA sequence
ctgggtctgtgagtggggta

SEQ ID NO: 54626 - DNA, 20 bp, Artificial
  CRISPR gRNA sequence
tgggtctgtgagtggggtag

SEQ ID NO: 54627 - DNA, 20 bp, Artificial
  CRISPR gRNA sequence
gggtctgtgagtggggtagg

SEQ ID NO: 54628 - DNA, 20 bp, Artificial
  CRISPR gRNA sequence
gggggtcgcatgtcacttgt

SEQ ID NO: 54629 - DNA, 20 bp, Artificial
  CRISPR gRNA sequence
ttgcgcacatcatgaactga

SEQ ID NO: 54630 - DNA, 20 bp, Artificial
  CRISPR gRNA sequence
atgaactgacggtctgctct

SEQ ID NO: 54631 - DNA, 20 bp, Artificial
  CRISPR gRNA sequence
tgaactgacggtctgctctc

SEQ ID NO: 54632 - DNA, 20 bp, Artificial
  CRISPR gRNA sequence
aactgacggtctgctctcag

SEQ ID NO: 54633 - DNA, 20 bp, Artificial
  CRISPR gRNA sequence
cggtctgctctcaggagaaa

SEQ ID NO: 54634 - DNA, 20 bp, Artificial
  CRISPR gRNA sequence
ctgctctcaggagaaacagt

SEQ ID NO: 54635 - DNA, 20 bp, Artificial
  CRISPR gRNA sequence
tgctctcaggagaaacagta

SEQ ID NO: 54636 - DNA, 20 bp, Artificial
  CRISPR gRNA sequence
gctctcaggagaaacagtaa

SEQ ID NO: 54637 - DNA, 20 bp, Artificial
  CRISPR gRNA sequence
aggagaaacagtaagggact

SEQ ID NO: 54638 - DNA, 20 bp, Artificial
  CRISPR gRNA sequence
ggagaaacagtaagggactg

SEQ ID NO: 54639 - DNA, 20 bp, Artificial
  CRISPR gRNA sequence
gagaaacagtaagggactga

SEQ ID NO: 54640 - DNA, 20 bp, Artificial
  CRISPR gRNA sequence
aaacagtaagggactgaggg

SEQ ID NO: 54641 - DNA, 20 bp, Artificial
  CRISPR gRNA sequence
agggactgagggaagccaaa

SEQ ID NO: 54642 - DNA, 20 bp, Artificial
  CRISPR gRNA sequence
ggactgagggaagccaaacg

SEQ ID NO: 54643 - DNA, 20 bp, Artificial
  CRISPR gRNA sequence
tgagggaagccaaacggagc

SEQ ID NO: 54644 - DNA, 20 bp, Artificial
  CRISPR gRNA sequence
agccaaacggagcaagtcct

SEQ ID NO: 54645 - DNA, 20 bp, Artificial
  CRISPR gRNA sequence
aacggagcaagtccttggcc

SEQ ID NO: 54646 - DNA, 20 bp, Artificial
  CRISPR gRNA sequence
aagtccttggcctagtctcc

SEQ ID NO: 54647 - DNA, 20 bp, Artificial
  CRISPR gRNA sequence
agtccttggcctagtctccc

SEQ ID NO: 54648 - DNA, 20 bp, Artificial
  CRISPR gRNA sequence
gtccttggcctagtctccca

SEQ ID NO: 54649 - DNA, 20 bp, Artificial
  CRISPR gRNA sequence
ccttggcctagtctcccagg

SEQ ID NO: 54650 - DNA, 20 bp, Artificial
  CRISPR gRNA sequence
cccagggagctttgtcccac

SEQ ID NO: 54651 - DNA, 20 bp, Artificial
  CRISPR gRNA sequence
cagggagctttgtcccactg

SEQ ID NO: 54652 - DNA, 20 bp, Artificial
  CRISPR gRNA sequence
gggagctttgtcccactgga

SEQ ID NO: 54653 - DNA, 20 bp, Artificial
  CRISPR gRNA sequence
ctttgtcccactggagagtt

SEQ ID NO: 54654 - DNA, 20 bp, Artificial
  CRISPR gRNA sequence
tttgtcccactggagagttt

SEQ ID NO: 54655 - DNA, 20 bp, Artificial
  CRISPR gRNA sequence
tcccactggagagtttgggc

SEQ ID NO: 54656 - DNA, 20 bp, Artificial
  CRISPR gRNA sequence
ccactggagagtttgggctg

SEQ ID NO: 54657 - DNA, 20 bp, Artificial
  CRISPR gRNA sequence
actggagagtttgggctgga

SEQ ID NO: 54658 - DNA, 20 bp, Artificial
  CRISPR gRNA sequence
gtgccctctgcctctgtcat

SEQ ID NO: 54659 - DNA, 20 bp, Artificial
  CRISPR gRNA sequence
gcctctgtcattggccactc

SEQ ID NO: 54660 - DNA, 20 bp, Artificial
  CRISPR gRNA sequence
cctctgtcattggccactct

SEQ ID NO: 54661 - DNA, 20 bp, Artificial
  CRISPR gRNA sequence
tgtcattggccactctaggt

SEQ ID NO: 54662 - DNA, 20 bp, Artificial
  CRISPR gRNA sequence
gtcattggccactctaggtt

SEQ ID NO: 54663 - DNA, 20 bp, Artificial
  CRISPR gRNA sequence
tcattggccactctaggtta

SEQ ID NO: 54664 - DNA, 20 bp, Artificial
  CRISPR gRNA sequence
cattggccactctaggttag

SEQ ID NO: 54665 - DNA, 20 bp, Artificial
  CRISPR gRNA sequence
ggccactctaggttagggga

SEQ ID NO: 54666 - DNA, 20 bp, Artificial
  CRISPR gRNA sequence
cactctaggttaggggaaag

SEQ ID NO: 54667 - DNA, 20 bp, Artificial
  CRISPR gRNA sequence
actctaggttaggggaaagt

SEQ ID NO: 54668 - DNA, 20 bp, Artificial
  CRISPR gRNA sequence
ctctaggttaggggaaagtg

SEQ ID NO: 54669 - DNA, 20 bp, Artificial
  CRISPR gRNA sequence
tctaggttaggggaaagtgg

SEQ ID NO: 54670 - DNA, 20 bp, Artificial
  CRISPR gRNA sequence
aagtgggggttgtaccctgc

SEQ ID NO: 54671 - DNA, 20 bp, Artificial
  CRISPR gRNA sequence
agtgggggttgtaccctgcc

SEQ ID NO: 54672 - DNA, 20 bp, Artificial
  CRISPR gRNA sequence
tgtaccctgccaggcgtctc

SEQ ID NO: 54673 - DNA, 20 bp, Artificial
  CRISPR gRNA sequence
caggcgtctctggttcttat

SEQ ID NO: 54674 - DNA, 20 bp, Artificial
  CRISPR gRNA sequence
gtctctggttcttatcagcc

SEQ ID NO: 54675 - DNA, 20 bp, Artificial
  CRISPR gRNA sequence
tctctggttcttatcagcca

SEQ ID NO: 54676 - DNA, 20 bp, Artificial
  CRISPR gRNA sequence
ctctggttcttatcagccaa

SEQ ID NO: 54677 - DNA, 20 bp, Artificial
  CRISPR gRNA sequence
tggttcttatcagccaaggg

SEQ ID NO: 54678 - DNA, 20 bp, Artificial
  CRISPR gRNA sequence
atcagccaagggtagttctc

SEQ ID NO: 54679 - DNA, 20 bp, Artificial
  CRISPR gRNA sequence
cagccaagggtagttctcca

SEQ ID NO: 54680 - DNA, 20 bp, Artificial
  CRISPR gRNA sequence
agccaagggtagttctccag

SEQ ID NO: 54681 - DNA, 20 bp, Artificial
  CRISPR gRNA sequence
tctccagaggtataaaccat

SEQ ID NO: 54682 - DNA, 20 bp, Artificial
  CRISPR gRNA sequence
ccagaggtataaaccatgag

SEQ ID NO: 54683 - DNA, 20 bp, Artificial
  CRISPR gRNA sequence
ccatgagcagcctatatcca

SEQ ID NO: 54684 - DNA, 20 bp, Artificial
  CRISPR gRNA sequence
tgagcagcctatatccacag

SEQ ID NO: 54685 - DNA, 20 bp, Artificial
  CRISPR gRNA sequence
cagcctatatccacagcagc

SEQ ID NO: 54686 - DNA, 20 bp, Artificial
  CRISPR gRNA sequence
agcctatatccacagcagct

SEQ ID NO: 54687 - DNA, 20 bp, Artificial
  CRISPR gRNA sequence
ctatatccacagcagctagg

SEQ ID NO: 54688 - DNA, 20 bp, Artificial
  CRISPR gRNA sequence
atatccacagcagctaggaa

SEQ ID NO: 54689 - DNA, 20 bp, Artificial
  CRISPR gRNA sequence
tatccacagcagctaggaag

SEQ ID NO: 54690 - DNA, 20 bp, Artificial
  CRISPR gRNA sequence
atccacagcagctaggaaga

SEQ ID NO: 54691 - DNA, 20 bp, Artificial
  CRISPR gRNA sequence
tccacagcagctaggaagag

SEQ ID NO: 54692 - DNA, 20 bp, Artificial
  CRISPR gRNA sequence
gcagctaggaagaggggtgc

SEQ ID NO: 54693 - DNA, 20 bp, Artificial
  CRISPR gRNA sequence
aagaggggtgccggctgtaa

SEQ ID NO: 54694 - DNA, 20 bp, Artificial
  CRISPR gRNA sequence
agaggggtgccggctgtaac

SEQ ID NO: 54695 - DNA, 20 bp, Artificial
  CRISPR gRNA sequence
gaggggtgccggctgtaacg

SEQ ID NO: 54696 - DNA, 20 bp, Artificial
  CRISPR gRNA sequence
gtgccggctgtaacggggtc

SEQ ID NO: 54697 - DNA, 20 bp, Artificial
  CRISPR gRNA sequence
tgccggctgtaacggggtct

SEQ ID NO: 54698 - DNA, 20 bp, Artificial
  CRISPR gRNA sequence
cggctgtaacggggtctggg

SEQ ID NO: 54699 - DNA, 20 bp, Artificial
  CRISPR gRNA sequence
ggctgtaacggggtctgggt

SEQ ID NO: 54700 - DNA, 20 bp, Artificial
  CRISPR gRNA sequence
gtaacggggtctgggtggga

SEQ ID NO: 54701 - DNA, 20 bp, Artificial
  CRISPR gRNA sequence
acggggtctgggtgggacag

SEQ ID NO: 54702 - DNA, 20 bp, Artificial
  CRISPR gRNA sequence
gggtctgggtgggacagcag

SEQ ID NO: 54703 - DNA, 20 bp, Artificial
  CRISPR gRNA sequence
cagcatcttctgcccgtccc

SEQ ID NO: 54704 - DNA, 20 bp, Artificial
  CRISPR gRNA sequence
agcatcttctgcccgtccca

SEQ ID NO: 54705 - DNA, 20 bp, Artificial
  CRISPR gRNA sequence
cttctgcccgtcccaaggcc

SEQ ID NO: 54706 - DNA, 20 bp, Artificial
  CRISPR gRNA sequence
ttctgcccgtcccaaggcct

SEQ ID NO: 54707 - DNA, 20 bp, Artificial
  CRISPR gRNA sequence
cccgtcccaaggcctgggcc

SEQ ID NO: 54708 - DNA, 20 bp, Artificial
  CRISPR gRNA sequence
gtcccaaggcctgggcccag

SEQ ID NO: 54709 - DNA, 20 bp, Artificial
  CRISPR gRNA sequence
tcccaaggcctgggcccaga

SEQ ID NO: 54710 - DNA, 20 bp, Artificial
  CRISPR gRNA sequence
ctgggcccagaaggaattcc

SEQ ID NO: 54711 - DNA, 20 bp, Artificial
  CRISPR gRNA sequence
tgggcccagaaggaattcca

SEQ ID NO: 54712 - DNA, 20 bp, Artificial
  CRISPR gRNA sequence
gggcccagaaggaattccaa

SEQ ID NO: 54713 - DNA, 20 bp, Artificial
  CRISPR gRNA sequence
agaaggaattccaagggctt

SEQ ID NO: 54714 - DNA, 20 bp, Artificial
  CRISPR gRNA sequence
aaggaattccaagggcttca

SEQ ID NO: 54715 - DNA, 20 bp, Artificial
  CRISPR gRNA sequence
ggaattccaagggcttcaga

SEQ ID NO: 54716 - DNA, 20 bp, Artificial
  CRISPR gRNA sequence
aattccaagggcttcagaga

SEQ ID NO: 54717 - DNA, 20 bp, Artificial
  CRISPR gRNA sequence
gggcttcagagagagcatga

SEQ ID NO: 54718 - DNA, 20 bp, Artificial
  CRISPR gRNA sequence
ggcttcagagagagcatgat

SEQ ID NO: 54719 - DNA, 20 bp, Artificial
  CRISPR gRNA sequence
gcttcagagagagcatgatg

SEQ ID NO: 54720 - DNA, 20 bp, Artificial
  CRISPR gRNA sequence
cttcagagagagcatgatgg

SEQ ID NO: 54721 - DNA, 20 bp, Artificial
  CRISPR gRNA sequence
ttcagagagagcatgatggg

SEQ ID NO: 54722 - DNA, 20 bp, Artificial
  CRISPR gRNA sequence
tcagagagagcatgatgggg

SEQ ID NO: 54723 - DNA, 20 bp, Artificial
  CRISPR gRNA sequence
cagagagagcatgatggggg

SEQ ID NO: 54724 - DNA, 20 bp, Artificial
  CRISPR gRNA sequence
agagagagcatgatgggggg

SEQ ID NO: 54725 - DNA, 20 bp, Artificial
  CRISPR gRNA sequence
gagagagcatgatggggggg

SEQ ID NO: 54726 - DNA, 20 bp, Artificial
  CRISPR gRNA sequence
gagcatgatgggggggggga

SEQ ID NO: 54727 - DNA, 20 bp, Artificial
  CRISPR gRNA sequence
agcatgatggggggggggat

SEQ ID NO: 54728 - DNA, 20 bp, Artificial
  CRISPR gRNA sequence
ggggggggggatgggtaccg

SEQ ID NO: 54729 - DNA, 20 bp, Artificial
  CRISPR gRNA sequence
ggggatgggtaccgtggtct

SEQ ID NO: 54730 - DNA, 20 bp, Artificial
  CRISPR gRNA sequence
gggatgggtaccgtggtctg

SEQ ID NO: 54731 - DNA, 20 bp, Artificial
  CRISPR gRNA sequence
ggatgggtaccgtggtctga

SEQ ID NO: 54732 - DNA, 20 bp, Artificial
  CRISPR gRNA sequence
atgggtaccgtggtctgagg

SEQ ID NO: 54733 - DNA, 20 bp, Artificial
  CRISPR gRNA sequence
gggagctcccacctgatgtg

SEQ ID NO: 54734 - DNA, 20 bp, Artificial
  CRISPR gRNA sequence
cacctgatgtgcagctctgc

SEQ ID NO: 54735 - DNA, 20 bp, Artificial
  CRISPR gRNA sequence
acctgatgtgcagctctgcc

SEQ ID NO: 54736 - DNA, 20 bp, Artificial
  CRISPR gRNA sequence
cctgatgtgcagctctgcca

SEQ ID NO: 54737 - DNA, 20 bp, Artificial
  CRISPR gRNA sequence
tgtgcagctctgccagggtc

SEQ ID NO: 54738 - DNA, 20 bp, Artificial
  CRISPR gRNA sequence
cagggtccagcacgcactca

SEQ ID NO: 54739 - DNA, 20 bp, Artificial
  CRISPR gRNA sequence
cagcacgcactcacggccct

SEQ ID NO: 54740 - DNA, 20 bp, Artificial
  CRISPR gRNA sequence
cctcagcacacaatgcaccc

SEQ ID NO: 54741 - DNA, 20 bp, Artificial
  CRISPR gRNA sequence
cacacaatgcaccccggcca

SEQ ID NO: 54742 - DNA, 20 bp, Artificial
  CRISPR gRNA sequence
caatgcaccccggccacaga

SEQ ID NO: 54743 - DNA, 20 bp, Artificial
  CRISPR gRNA sequence
acagaaagcccgttgttact

SEQ ID NO: 54744 - DNA, 20 bp, Artificial
  CRISPR gRNA sequence
cagaaagcccgttgttactg

SEQ ID NO: 54745 - DNA, 20 bp, Artificial
  CRISPR gRNA sequence
gcccgttgttactgaggctg

SEQ ID NO: 54746 - DNA, 20 bp, Artificial
  CRISPR gRNA sequence
ccgttgttactgaggctgtg

SEQ ID NO: 54747 - DNA, 20 bp, Artificial
  CRISPR gRNA sequence
gttgttactgaggctgtgga

SEQ ID NO: 54748 - DNA, 20 bp, Artificial
  CRISPR gRNA sequence
gttactgaggctgtggagag

SEQ ID NO: 54749 - DNA, 20 bp, Artificial
  CRISPR gRNA sequence
ttactgaggctgtggagagc

SEQ ID NO: 54750 - DNA, 20 bp, Artificial
  CRISPR gRNA sequence
actgaggctgtggagagcag

SEQ ID NO: 54751 - DNA, 20 bp, Artificial
  CRISPR gRNA sequence
gaggctgtggagagcaggag

SEQ ID NO: 54752 - DNA, 20 bp, Artificial
  CRISPR gRNA sequence
aggctgtggagagcaggaga

SEQ ID NO: 54753 - DNA, 20 bp, Artificial
  CRISPR gRNA sequence
ctgtggagagcaggagaagg

SEQ ID NO: 54754 - DNA, 20 bp, Artificial
  CRISPR gRNA sequence
gagcaggagaaggcagccgt

SEQ ID NO: 54755 - DNA, 20 bp, Artificial
  CRISPR gRNA sequence
agaaggcagccgttggcatg

SEQ ID NO: 54756 - DNA, 20 bp, Artificial
  CRISPR gRNA sequence
gcagccgttggcatgtggct

SEQ ID NO: 54757 - DNA, 20 bp, Artificial
  CRISPR gRNA sequence
cagccgttggcatgtggctg

SEQ ID NO: 54758 - DNA, 20 bp, Artificial
  CRISPR gRNA sequence
tggcatgtggctgaggtacc

SEQ ID NO: 54759 - DNA, 20 bp, Artificial
  CRISPR gRNA sequence
gtggctgaggtacccagccc

SEQ ID NO: 54760 - DNA, 20 bp, Artificial
  CRISPR gRNA sequence
ctgaggtacccagccccagc

SEQ ID NO: 54761 - DNA, 20 bp, Artificial
  CRISPR gRNA sequence
tacccagccccagccagctc

SEQ ID NO: 54762 - DNA, 20 bp, Artificial
  CRISPR gRNA sequence
ccagctctagcccctccctg

SEQ ID NO: 54763 - DNA, 20 bp, Artificial
  CRISPR gRNA sequence
tctagcccctccctgtggct

SEQ ID NO: 54764 - DNA, 20 bp, Artificial
  CRISPR gRNA sequence
agcccctccctgtggctcag

SEQ ID NO: 54765 - DNA, 20 bp, Artificial
  CRISPR gRNA sequence
cctgtggctcagcagcttgc

SEQ ID NO: 54766 - DNA, 20 bp, Artificial
  CRISPR gRNA sequence
agcttgctggctgtcactcc

SEQ ID NO: 54767 - DNA, 20 bp, Artificial
  CRISPR gRNA sequence
gctgtcactcctggatgtcc

SEQ ID NO: 54768 - DNA, 20 bp, Artificial
  CRISPR gRNA sequence
ctgtcactcctggatgtcct

SEQ ID NO: 54769 - DNA, 20 bp, Artificial
  CRISPR gRNA sequence
ggatgtcctaggtcccttgc

SEQ ID NO: 54770 - DNA, 20 bp, Artificial
  CRISPR gRNA sequence
gatgtcctaggtcccttgcc

SEQ ID NO: 54771 - DNA, 20 bp, Artificial
  CRISPR gRNA sequence
atgtcctaggtcccttgcca

SEQ ID NO: 54772 - DNA, 20 bp, Artificial
  CRISPR gRNA sequence
tgtcctaggtcccttgccag

SEQ ID NO: 54773 - DNA, 20 bp, Artificial
  CRISPR gRNA sequence
tcccttgccaggggatctca

SEQ ID NO: 54774 - DNA, 20 bp, Artificial
  CRISPR gRNA sequence
cccttgccaggggatctcaa

SEQ ID NO: 54775 - DNA, 20 bp, Artificial
  CRISPR gRNA sequence
caggggatctcaaaggattc

SEQ ID NO: 54776 - DNA, 20 bp, Artificial
  CRISPR gRNA sequence
caaaggattctggtgcgtgt

SEQ ID NO: 54777 - DNA, 20 bp, Artificial
  CRISPR gRNA sequence
ggattctggtgcgtgtgagt

SEQ ID NO: 54778 - DNA, 20 bp, Artificial
  CRISPR gRNA sequence
catgacacccccatcccatt

SEQ ID NO: 54779 - DNA, 20 bp, Artificial
  CRISPR gRNA sequence
cccatcccatttggaaaata

SEQ ID NO: 54780 - DNA, 20 bp, Artificial
  CRISPR gRNA sequence
atttggaaaataaagttgtc

SEQ ID NO: 54781 - DNA, 20 bp, Artificial
  CRISPR gRNA sequence
aataaagttgtccagcttga

SEQ ID NO: 54782 - DNA, 20 bp, Artificial
  CRISPR gRNA sequence
aagttgtccagcttgacagc

SEQ ID NO: 54783 - DNA, 20 bp, Artificial
  CRISPR gRNA sequence
ccagcttgacagcaagaact

SEQ ID NO: 54784 - DNA, 20 bp, Artificial
  CRISPR gRNA sequence
gttttcacctctctgacccc

SEQ ID NO: 54785 - DNA, 20 bp, Artificial
  CRISPR gRNA sequence
taaaataaccaccattttct

SEQ ID NO: 54786 - DNA, 20 bp, Artificial
  CRISPR gRNA sequence
tttctgagccctgactatac

SEQ ID NO: 54787 - DNA, 20 bp, Artificial
  CRISPR gRNA sequence
ctataccagactctgtacaa

SEQ ID NO: 54788 - DNA, 20 bp, Artificial
  CRISPR gRNA sequence
tataccagactctgtacaaa

SEQ ID NO: 54789 - DNA, 20 bp, Artificial
  CRISPR gRNA sequence
caaaaggctttgtacatata

SEQ ID NO: 54790 - DNA, 20 bp, Artificial
  CRISPR gRNA sequence
tttcatgtgatcccatttta

SEQ ID NO: 54791 - DNA, 20 bp, Artificial
  CRISPR gRNA sequence
tcatgtgatcccattttaca

SEQ ID NO: 54792 - DNA, 20 bp, Artificial
  CRISPR gRNA sequence
catgtgatcccattttacag

SEQ ID NO: 54793 - DNA, 20 bp, Artificial
  CRISPR gRNA sequence
atgtgatcccattttacaga

SEQ ID NO: 54794 - DNA, 20 bp, Artificial
  CRISPR gRNA sequence
tgtgatcccattttacagag

SEQ ID NO: 54795 - DNA, 20 bp, Artificial
  CRISPR gRNA sequence
cattttacagaggggaaacc

SEQ ID NO: 54796 - DNA, 20 bp, Artificial
  CRISPR gRNA sequence
attttacagaggggaaaccg

SEQ ID NO: 54797 - DNA, 20 bp, Artificial
  CRISPR gRNA sequence
acagaggggaaaccgaggcc

SEQ ID NO: 54798 - DNA, 20 bp, Artificial
  CRISPR gRNA sequence
agaggggaaaccgaggccca

SEQ ID NO: 54799 - DNA, 20 bp, Artificial
  CRISPR gRNA sequence
gagacattcaattactttcc

SEQ ID NO: 54800 - DNA, 20 bp, Artificial
  CRISPR gRNA sequence
agacattcaattactttccc

SEQ ID NO: 54801 - DNA, 20 bp, Artificial
  CRISPR gRNA sequence
cccaggttcacaatgctact

SEQ ID NO: 54802 - DNA, 20 bp, Artificial
  CRISPR gRNA sequence
ttcacaatgctactaagtga

SEQ ID NO: 54803 - DNA, 20 bp, Artificial
  CRISPR gRNA sequence
cacaatgctactaagtgaca

SEQ ID NO: 54804 - DNA, 20 bp, Artificial
  CRISPR gRNA sequence
tgctactaagtgacagagcg

SEQ ID NO: 54805 - DNA, 20 bp, Artificial
  CRISPR gRNA sequence
agagcgaagattgaaatcca

SEQ ID NO: 54806 - DNA, 20 bp, Artificial
  CRISPR gRNA sequence
gaagattgaaatccaaagct

SEQ ID NO: 54807 - DNA, 20 bp, Artificial
  CRISPR gRNA sequence
aagattgaaatccaaagctg

SEQ ID NO: 54808 - DNA, 20 bp, Artificial
  CRISPR gRNA sequence
cccgacccacacttgatcct

SEQ ID NO: 54809 - DNA, 20 bp, Artificial
  CRISPR gRNA sequence
cacttgatcctaagaccccc

SEQ ID NO: 54810 - DNA, 20 bp, Artificial
  CRISPR gRNA sequence
cctcaccccatgcaacacca

SEQ ID NO: 54811 - DNA, 20 bp, Artificial
  CRISPR gRNA sequence
atgcaacaccacagcacacc

SEQ ID NO: 54812 - DNA, 20 bp, Artificial
  CRISPR gRNA sequence
caacaccacagcacacccag

SEQ ID NO: 54813 - DNA, 20 bp, Artificial
  CRISPR gRNA sequence
cagcacacccagcagcctaa

SEQ ID NO: 54814 - DNA, 20 bp, Artificial
  CRISPR gRNA sequence
ctcaccacccctcaccccaa

SEQ ID NO: 54815 - DNA, 20 bp, Artificial
  CRISPR gRNA sequence
accccaacagtgtatcccca

SEQ ID NO: 54816 - DNA, 20 bp, Artificial
  CRISPR gRNA sequence
ccccaacagtgtatccccac

SEQ ID NO: 54817 - DNA, 20 bp, Artificial
  CRISPR gRNA sequence
gaacacaccactccctaccc

SEQ ID NO: 54818 - DNA, 20 bp, Artificial
  CRISPR gRNA sequence
cactccctaccctagcaccc

SEQ ID NO: 54819 - DNA, 20 bp, Artificial
  CRISPR gRNA sequence
accccagcatgacacctcca

SEQ ID NO: 54820 - DNA, 20 bp, Artificial
  CRISPR gRNA sequence
cacccaccctgacacctccc

SEQ ID NO: 54821 - DNA, 20 bp, Artificial
  CRISPR gRNA sequence
caccccaccccaccgtgctc

SEQ ID NO: 54822 - DNA, 20 bp, Artificial
  CRISPR gRNA sequence
accccaccccaccgtgctcc

SEQ ID NO: 54823 - DNA, 20 bp, Artificial
  CRISPR gRNA sequence
ccccaccccaccgtgctcca

SEQ ID NO: 54824 - DNA, 20 bp, Artificial
  CRISPR gRNA sequence
caccccaccgtgctccaggg

SEQ ID NO: 54825 - DNA, 20 bp, Artificial
  CRISPR gRNA sequence
cgtgctccagggcagctaca

SEQ ID NO: 54826 - DNA, 20 bp, Artificial
  CRISPR gRNA sequence
gggcagctacaaagatgaat

SEQ ID NO: 54827 - DNA, 20 bp, Artificial
  CRISPR gRNA sequence
acaaagatgaattggaatgc

SEQ ID NO: 54828 - DNA, 20 bp, Artificial
  CRISPR gRNA sequence
tgaacgcattttacacatgt

SEQ ID NO: 54829 - DNA, 20 bp, Artificial
  CRISPR gRNA sequence
gaacgcattttacacatgta

SEQ ID NO: 54830 - DNA, 20 bp, Artificial
  CRISPR gRNA sequence
aacgcattttacacatgtaa

SEQ ID NO: 54831 - DNA, 20 bp, Artificial
  CRISPR gRNA sequence
ttttacacatgtaagggtgc

SEQ ID NO: 54832 - DNA, 20 bp, Artificial
  CRISPR gRNA sequence
atgtaagggtgctagatgat

SEQ ID NO: 54833 - DNA, 20 bp, Artificial
  CRISPR gRNA sequence
gggtgctagatgattggact

SEQ ID NO: 54834 - DNA, 20 bp, Artificial
  CRISPR gRNA sequence
gctagatgattggactaaga

SEQ ID NO: 54835 - DNA, 20 bp, Artificial
  CRISPR gRNA sequence
agatgattggactaagacag

SEQ ID NO: 54836 - DNA, 20 bp, Artificial
  CRISPR gRNA sequence
actaagacagtggctcatgc

SEQ ID NO: 54837 - DNA, 20 bp, Artificial
  CRISPR gRNA sequence
taagacagtggctcatgccg

SEQ ID NO: 54838 - DNA, 20 bp, Artificial
  CRISPR gRNA sequence
aagacagtggctcatgccgg

SEQ ID NO: 54839 - DNA, 20 bp, Artificial
  CRISPR gRNA sequence
agtggctcatgccggaggtg

SEQ ID NO: 54840 - DNA, 20 bp, Artificial
  CRISPR gRNA sequence
gtggctcatgccggaggtga

SEQ ID NO: 54841 - DNA, 20 bp, Artificial
  CRISPR gRNA sequence
ctcatgccggaggtgaaggc

SEQ ID NO: 54842 - DNA, 20 bp, Artificial
  CRISPR gRNA sequence
tcatgccggaggtgaaggca

SEQ ID NO: 54843 - DNA, 20 bp, Artificial
  CRISPR gRNA sequence
ccggaggtgaaggcaaggca

SEQ ID NO: 54844 - DNA, 20 bp, Artificial
  CRISPR gRNA sequence
tcaaaccatcttgactttgc

SEQ ID NO: 54845 - DNA, 20 bp, Artificial
  CRISPR gRNA sequence
aaaccatcttgactttgctg

SEQ ID NO: 54846 - DNA, 20 bp, Artificial
  CRISPR gRNA sequence
catcttgactttgctggagt

SEQ ID NO: 54847 - DNA, 20 bp, Artificial
  CRISPR gRNA sequence
atcttgactttgctggagtt

SEQ ID NO: 54848 - DNA, 20 bp, Artificial
  CRISPR gRNA sequence
cttgactttgctggagttgg

SEQ ID NO: 54849 - DNA, 20 bp, Artificial
  CRISPR gRNA sequence
ttgactttgctggagttggg

SEQ ID NO: 54850 - DNA, 20 bp, Artificial
  CRISPR gRNA sequence
actttgctggagttgggagg

SEQ ID NO: 54851 - DNA, 20 bp, Artificial
  CRISPR gRNA sequence
ttgctggagttgggaggaag

SEQ ID NO: 54852 - DNA, 20 bp, Artificial
  CRISPR gRNA sequence
tgctggagttgggaggaagc

SEQ ID NO: 54853 - DNA, 20 bp, Artificial
  CRISPR gRNA sequence
gctggagttgggaggaagca

SEQ ID NO: 54854 - DNA, 20 bp, Artificial
  CRISPR gRNA sequence
ctggagttgggaggaagcag

SEQ ID NO: 54855 - DNA, 20 bp, Artificial
  CRISPR gRNA sequence
gagttgggaggaagcagggg

SEQ ID NO: 54856 - DNA, 20 bp, Artificial
  CRISPR gRNA sequence
ttgggaggaagcaggggtgg

SEQ ID NO: 54857 - DNA, 20 bp, Artificial
  CRISPR gRNA sequence
ggaggaagcaggggtggcag

SEQ ID NO: 54858 - DNA, 20 bp, Artificial
  CRISPR gRNA sequence
aagcaggggtggcagtggat

SEQ ID NO: 54859 - DNA, 20 bp, Artificial
  CRISPR gRNA sequence
cttactgctgattacgaaca

SEQ ID NO: 54860 - DNA, 20 bp, Artificial
  CRISPR gRNA sequence
ttactgctgattacgaacac

SEQ ID NO: 54861 - DNA, 20 bp, Artificial
  CRISPR gRNA sequence
tactgctgattacgaacacg

SEQ ID NO: 54862 - DNA, 20 bp, Artificial
  CRISPR gRNA sequence
ttacgaacacggggacctcc

SEQ ID NO: 54863 - DNA, 20 bp, Artificial
  CRISPR gRNA sequence
tacgaacacggggacctcct

SEQ ID NO: 54864 - DNA, 20 bp, Artificial
  CRISPR gRNA sequence
acgaacacggggacctcctg

SEQ ID NO: 54865 - DNA, 20 bp, Artificial
  CRISPR gRNA sequence
ggggacctcctggggctcta

SEQ ID NO: 54866 - DNA, 20 bp, Artificial
  CRISPR gRNA sequence
gggacctcctggggctctac

SEQ ID NO: 54867 - DNA, 20 bp, Artificial
  CRISPR gRNA sequence
ggacctcctggggctctaca

SEQ ID NO: 54868 - DNA, 20 bp, Artificial
  CRISPR gRNA sequence
gggctctacagggccttccc

SEQ ID NO: 54869 - DNA, 20 bp, Artificial
  CRISPR gRNA sequence
acagggccttccctggtacc

SEQ ID NO: 54870 - DNA, 20 bp, Artificial
  CRISPR gRNA sequence
gggccttccctggtacccag

SEQ ID NO: 54871 - DNA, 20 bp, Artificial
  CRISPR gRNA sequence
ccttccctggtacccagcgg

SEQ ID NO: 54872 - DNA, 20 bp, Artificial
  CRISPR gRNA sequence
cttccctggtacccagcggt

SEQ ID NO: 54873 - DNA, 20 bp, Artificial
  CRISPR gRNA sequence
ttccctggtacccagcggtg

SEQ ID NO: 54874 - DNA, 20 bp, Artificial
  CRISPR gRNA sequence
cctggtacccagcggtgggg

SEQ ID NO: 54875 - DNA, 20 bp, Artificial
  CRISPR gRNA sequence
gtggggtggacaactcactc

SEQ ID NO: 54876 - DNA, 20 bp, Artificial
  CRISPR gRNA sequence
gacaactcactccagcttcc

SEQ ID NO: 54877 - DNA, 20 bp, Artificial
  CRISPR gRNA sequence
tccagcttcctggcgatgtg

SEQ ID NO: 54878 - DNA, 20 bp, Artificial
  CRISPR gRNA sequence
gcttcctggcgatgtgcagc

SEQ ID NO: 54879 - DNA, 20 bp, Artificial
  CRISPR gRNA sequence
cttcctggcgatgtgcagct

SEQ ID NO: 54880 - DNA, 20 bp, Artificial
  CRISPR gRNA sequence
ggcgatgtgcagctgggatg

SEQ ID NO: 54881 - DNA, 20 bp, Artificial
  CRISPR gRNA sequence
tgggatgcagcctctgccat

SEQ ID NO: 54882 - DNA, 20 bp, Artificial
  CRISPR gRNA sequence
cagcctctgccatcagccga

SEQ ID NO: 54883 - DNA, 20 bp, Artificial
  CRISPR gRNA sequence
agccgacagccttcatcttc

SEQ ID NO: 54884 - DNA, 20 bp, Artificial
  CRISPR gRNA sequence
gacagccttcatcttccagc

SEQ ID NO: 54885 - DNA, 20 bp, Artificial
  CRISPR gRNA sequence
catcttccagctggttccct

SEQ ID NO: 54886 - DNA, 20 bp, Artificial
  CRISPR gRNA sequence
tcttccagctggttccctga

SEQ ID NO: 54887 - DNA, 20 bp, Artificial
  CRISPR gRNA sequence
cttccagctggttccctgag

SEQ ID NO: 54888 - DNA, 20 bp, Artificial
  CRISPR gRNA sequence
agctggttccctgagaggct

SEQ ID NO: 54889 - DNA, 20 bp, Artificial
  CRISPR gRNA sequence
ggttccctgagaggctgaga

SEQ ID NO: 54890 - DNA, 20 bp, Artificial
  CRISPR gRNA sequence
gttccctgagaggctgagac

SEQ ID NO: 54891 - DNA, 20 bp, Artificial
  CRISPR gRNA sequence
ttccctgagaggctgagacg

SEQ ID NO: 54892 - DNA, 20 bp, Artificial
  CRISPR gRNA sequence
tccctgagaggctgagacgg

SEQ ID NO: 54893 - DNA, 20 bp, Artificial
  CRISPR gRNA sequence
ccctgagaggctgagacggg

SEQ ID NO: 54894 - DNA, 20 bp, Artificial
  CRISPR gRNA sequence
gggcccaatgcactgtattg

SEQ ID NO: 54895 - DNA, 20 bp, Artificial
  CRISPR gRNA sequence
ggcccaatgcactgtattgt

SEQ ID NO: 54896 - DNA, 20 bp, Artificial
  CRISPR gRNA sequence
gcccaatgcactgtattgtg

SEQ ID NO: 54897 - DNA, 20 bp, Artificial
  CRISPR gRNA sequence
aatgcactgtattgtggggc

SEQ ID NO: 54898 - DNA, 20 bp, Artificial
  CRISPR gRNA sequence
tgcactgtattgtggggctg

SEQ ID NO: 54899 - DNA, 20 bp, Artificial
  CRISPR gRNA sequence
tactcctcctttgctaactt

SEQ ID NO: 54900 - DNA, 20 bp, Artificial
  CRISPR gRNA sequence
tcctttgctaactttagtca

SEQ ID NO: 54901 - DNA, 20 bp, Artificial
  CRISPR gRNA sequence
tttagtcaaagtgtcactct

SEQ ID NO: 54902 - DNA, 20 bp, Artificial
  CRISPR gRNA sequence
ttagtcaaagtgtcactctc

SEQ ID NO: 54903 - DNA, 20 bp, Artificial
  CRISPR gRNA sequence
ttgataataactgaaatcga

SEQ ID NO: 54904 - DNA, 20 bp, Artificial
  CRISPR gRNA sequence
cagactccataccacatgcc

SEQ ID NO: 54905 - DNA, 20 bp, Artificial
  CRISPR gRNA sequence
ccacatgcctggcaacatcc

SEQ ID NO: 54906 - DNA, 20 bp, Artificial
  CRISPR gRNA sequence
cacatgcctggcaacatcct

SEQ ID NO: 54907 - DNA, 20 bp, Artificial
  CRISPR gRNA sequence
ctaggttcttctatgactat

SEQ ID NO: 54908 - DNA, 20 bp, Artificial
  CRISPR gRNA sequence
attggcctatttcatcctca

SEQ ID NO: 54909 - DNA, 20 bp, Artificial
  CRISPR gRNA sequence
tcctcatagtgccgatgacg

SEQ ID NO: 54910 - DNA, 20 bp, Artificial
  CRISPR gRNA sequence
cctcatagtgccgatgacgt

SEQ ID NO: 54911 - DNA, 20 bp, Artificial
  CRISPR gRNA sequence
attatcctcaccttactgat

SEQ ID NO: 54912 - DNA, 20 bp, Artificial
  CRISPR gRNA sequence
ccttactgatgagtaaactc

SEQ ID NO: 54913 - DNA, 20 bp, Artificial
  CRISPR gRNA sequence
ctgatgagtaaactcaagtg

SEQ ID NO: 54914 - DNA, 20 bp, Artificial
  CRISPR gRNA sequence
gatgagtaaactcaagtgca

SEQ ID NO: 54915 - DNA, 20 bp, Artificial
  CRISPR gRNA sequence
gagtaaactcaagtgcagag

SEQ ID NO: 54916 - DNA, 20 bp, Artificial
  CRISPR gRNA sequence
aactcaagtgcagagtggtt

SEQ ID NO: 54917 - DNA, 20 bp, Artificial
  CRISPR gRNA sequence
aagtgcagagtggttaagtg

SEQ ID NO: 54918 - DNA, 20 bp, Artificial
  CRISPR gRNA sequence
gtgcagagtggttaagtgca

SEQ ID NO: 54919 - DNA, 20 bp, Artificial
  CRISPR gRNA sequence
gagtggttaagtgcagagta

SEQ ID NO: 54920 - DNA, 20 bp, Artificial
  CRISPR gRNA sequence
gttaagtgcagagtaaagtt

SEQ ID NO: 54921 - DNA, 20 bp, Artificial
  CRISPR gRNA sequence
ttaagtgcagagtaaagtta

SEQ ID NO: 54922 - DNA, 20 bp, Artificial
  CRISPR gRNA sequence
taaagttaaggcacttgctc

SEQ ID NO: 54923 - DNA, 20 bp, Artificial
  CRISPR gRNA sequence
aaagttaaggcacttgctcg

SEQ ID NO: 54924 - DNA, 20 bp, Artificial
  CRISPR gRNA sequence
aagttaaggcacttgctcga

SEQ ID NO: 54925 - DNA, 20 bp, Artificial
  CRISPR gRNA sequence
gttaaggcacttgctcgagg

SEQ ID NO: 54926 - DNA, 20 bp, Artificial
  CRISPR gRNA sequence
cacttgctcgagggagaacc

SEQ ID NO: 54927 - DNA, 20 bp, Artificial
  CRISPR gRNA sequence
ggagaacctggatttgaacc

SEQ ID NO: 54928 - DNA, 20 bp, Artificial
  CRISPR gRNA sequence
gagaacctggatttgaaccc

SEQ ID NO: 54929 - DNA, 20 bp, Artificial
  CRISPR gRNA sequence
aacctggatttgaacccagg

SEQ ID NO: 54930 - DNA, 20 bp, Artificial
  CRISPR gRNA sequence
aacccaggcagcctgccttc

SEQ ID NO: 54931 - DNA, 20 bp, Artificial
  CRISPR gRNA sequence
acccaggcagcctgccttca

SEQ ID NO: 54932 - DNA, 20 bp, Artificial
  CRISPR gRNA sequence
caactcttcctttatgctgc

SEQ ID NO: 54933 - DNA, 20 bp, Artificial
  CRISPR gRNA sequence
tgtgataaacttcatgatta

SEQ ID NO: 54934 - DNA, 20 bp, Artificial
  CRISPR gRNA sequence
gtgataaacttcatgattat

SEQ ID NO: 54935 - DNA, 20 bp, Artificial
  CRISPR gRNA sequence
tgataaacttcatgattatg

SEQ ID NO: 54936 - DNA, 20 bp, Artificial
  CRISPR gRNA sequence
gataaacttcatgattatgg

SEQ ID NO: 54937 - DNA, 20 bp, Artificial
  CRISPR gRNA sequence
gattatgggggcatctgacc

SEQ ID NO: 54938 - DNA, 20 bp, Artificial
  CRISPR gRNA sequence
tgggggcatctgacctagtc

SEQ ID NO: 54939 - DNA, 20 bp, Artificial
  CRISPR gRNA sequence
gggggcatctgacctagtct

SEQ ID NO: 54940 - DNA, 20 bp, Artificial
  CRISPR gRNA sequence
gggcatctgacctagtctgg

SEQ ID NO: 54941 - DNA, 20 bp, Artificial
  CRISPR gRNA sequence
atctgacctagtctgggagt

SEQ ID NO: 54942 - DNA, 20 bp, Artificial
  CRISPR gRNA sequence
tctgacctagtctgggagtc

SEQ ID NO: 54943 - DNA, 20 bp, Artificial
  CRISPR gRNA sequence
ctgacctagtctgggagtcg

SEQ ID NO: 54944 - DNA, 20 bp, Artificial
  CRISPR gRNA sequence
cctagtctgggagtcgggga

SEQ ID NO: 54945 - DNA, 20 bp, Artificial
  CRISPR gRNA sequence
ggatggcttatttgttgctt

SEQ ID NO: 54946 - DNA, 20 bp, Artificial
  CRISPR gRNA sequence
aagctacttgctgaaataac

SEQ ID NO: 54947 - DNA, 20 bp, Artificial
  CRISPR gRNA sequence
agctacttgctgaaataact

SEQ ID NO: 54948 - DNA, 20 bp, Artificial
  CRISPR gRNA sequence
ctacttgctgaaataactgg

SEQ ID NO: 54949 - DNA, 20 bp, Artificial
  CRISPR gRNA sequence
tgctgaaataactgggagtt

SEQ ID NO: 54950 - DNA, 20 bp, Artificial
  CRISPR gRNA sequence
tgaaataactgggagttcag

SEQ ID NO: 54951 - DNA, 20 bp, Artificial
  CRISPR gRNA sequence
gaaataactgggagttcagt

SEQ ID NO: 54952 - DNA, 20 bp, Artificial
  CRISPR gRNA sequence
actgggagttcagtaggtaa

SEQ ID NO: 54953 - DNA, 20 bp, Artificial
  CRISPR gRNA sequence
ctgggagttcagtaggtaaa

SEQ ID NO: 54954 - DNA, 20 bp, Artificial
  CRISPR gRNA sequence
gagttcagtaggtaaaaggt

SEQ ID NO: 54955 - DNA, 20 bp, Artificial
  CRISPR gRNA sequence
agttcagtaggtaaaaggtt

SEQ ID NO: 54956 - DNA, 20 bp, Artificial
  CRISPR gRNA sequence
gttcagtaggtaaaaggttg

SEQ ID NO: 54957 - DNA, 20 bp, Artificial
  CRISPR gRNA sequence
ttcagtaggtaaaaggttgg

SEQ ID NO: 54958 - DNA, 20 bp, Artificial
  CRISPR gRNA sequence
cagtaggtaaaaggttgggg

SEQ ID NO: 54959 - DNA, 20 bp, Artificial
  CRISPR gRNA sequence
gtaggtaaaaggttggggga

SEQ ID NO: 54960 - DNA, 20 bp, Artificial
  CRISPR gRNA sequence
gtaaaaggttgggggagaga

SEQ ID NO: 54961 - DNA, 20 bp, Artificial
  CRISPR gRNA sequence
aaaaggttgggggagagatg

SEQ ID NO: 54962 - DNA, 20 bp, Artificial
  CRISPR gRNA sequence
aaaggttgggggagagatgg

SEQ ID NO: 54963 - DNA, 20 bp, Artificial
  CRISPR gRNA sequence
ggttgggggagagatggagg

SEQ ID NO: 54964 - DNA, 20 bp, Artificial
  CRISPR gRNA sequence
gttgggggagagatggagga

SEQ ID NO: 54965 - DNA, 20 bp, Artificial
  CRISPR gRNA sequence
ttgggggagagatggaggaa

SEQ ID NO: 54966 - DNA, 20 bp, Artificial
  CRISPR gRNA sequence
agatggaggaagggtgttcc

SEQ ID NO: 54967 - DNA, 20 bp, Artificial
  CRISPR gRNA sequence
tggaggaagggtgttcctgg

SEQ ID NO: 54968 - DNA, 20 bp, Artificial
  CRISPR gRNA sequence
aggaagggtgttcctggtgg

SEQ ID NO: 54969 - DNA, 20 bp, Artificial
  CRISPR gRNA sequence
aagggtgttcctggtggtag

SEQ ID NO: 54970 - DNA, 20 bp, Artificial
  CRISPR gRNA sequence
ggtgttcctggtggtagaag

SEQ ID NO: 54971 - DNA, 20 bp, Artificial
  CRISPR gRNA sequence
tggtagaagcagtacattca

SEQ ID NO: 54972 - DNA, 20 bp, Artificial
  CRISPR gRNA sequence
ggtagaagcagtacattcaa

SEQ ID NO: 54973 - DNA, 20 bp, Artificial
  CRISPR gRNA sequence
cagtacattcaaaggccctg

SEQ ID NO: 54974 - DNA, 20 bp, Artificial
  CRISPR gRNA sequence
ccctgtggcataacacatat

SEQ ID NO: 54975 - DNA, 20 bp, Artificial
  CRISPR gRNA sequence
cctgtggcataacacatatg

SEQ ID NO: 54976 - DNA, 20 bp, Artificial
  CRISPR gRNA sequence
taacacatatgaggacctga

SEQ ID NO: 54977 - DNA, 20 bp, Artificial
  CRISPR gRNA sequence
acacatatgaggacctgaaa

SEQ ID NO: 54978 - DNA, 20 bp, Artificial
  CRISPR gRNA sequence
acatatgaggacctgaaaga

SEQ ID NO: 54979 - DNA, 20 bp, Artificial
  CRISPR gRNA sequence
atgaggacctgaaagagagc

SEQ ID NO: 54980 - DNA, 20 bp, Artificial
  CRISPR gRNA sequence
tgaaagagagccagtgtgtc

SEQ ID NO: 54981 - DNA, 20 bp, Artificial
  CRISPR gRNA sequence
gagagccagtgtgtctggat

SEQ ID NO: 54982 - DNA, 20 bp, Artificial
  CRISPR gRNA sequence
gagccagtgtgtctggattg

SEQ ID NO: 54983 - DNA, 20 bp, Artificial
  CRISPR gRNA sequence
gtgtgtctggattggagatt

SEQ ID NO: 54984 - DNA, 20 bp, Artificial
  CRISPR gRNA sequence
tgtctggattggagattgag

SEQ ID NO: 54985 - DNA, 20 bp, Artificial
  CRISPR gRNA sequence
ctggattggagattgagtgg

SEQ ID NO: 54986 - DNA, 20 bp, Artificial
  CRISPR gRNA sequence
tggattggagattgagtgga

SEQ ID NO: 54987 - DNA, 20 bp, Artificial
  CRISPR gRNA sequence
ttggagattgagtggaagga

SEQ ID NO: 54988 - DNA, 20 bp, Artificial
  CRISPR gRNA sequence
tggagattgagtggaaggat

SEQ ID NO: 54989 - DNA, 20 bp, Artificial
  CRISPR gRNA sequence
ggagattgagtggaaggatg

SEQ ID NO: 54990 - DNA, 20 bp, Artificial
  CRISPR gRNA sequence
attgagtggaaggatggggt

SEQ ID NO: 54991 - DNA, 20 bp, Artificial
  CRISPR gRNA sequence
agtggaaggatggggtcaga

SEQ ID NO: 54992 - DNA, 20 bp, Artificial
  CRISPR gRNA sequence
gtggaaggatggggtcagat

SEQ ID NO: 54993 - DNA, 20 bp, Artificial
  CRISPR gRNA sequence
tggaaggatggggtcagatg

SEQ ID NO: 54994 - DNA, 20 bp, Artificial
  CRISPR gRNA sequence
ggatggggtcagatggggtt

SEQ ID NO: 54995 - DNA, 20 bp, Artificial
  CRISPR gRNA sequence
gatggggtcagatggggttt

SEQ ID NO: 54996 - DNA, 20 bp, Artificial
  CRISPR gRNA sequence
tggggtcagatggggtttag

SEQ ID NO: 54997 - DNA, 20 bp, Artificial
  CRISPR gRNA sequence
ggggtcagatggggtttagg

SEQ ID NO: 54998 - DNA, 20 bp, Artificial
  CRISPR gRNA sequence
tcagatggggtttaggaggc

SEQ ID NO: 54999 - DNA, 20 bp, Artificial
  CRISPR gRNA sequence
cagatggggtttaggaggct

SEQ ID NO: 55000 - DNA, 20 bp, Artificial
  CRISPR gRNA sequence
agatggggtttaggaggctg

SEQ ID NO: 55001 - DNA, 20 bp, Artificial
  CRISPR gRNA sequence
gatggggtttaggaggctgg

SEQ ID NO: 55002 - DNA, 20 bp, Artificial
  CRISPR gRNA sequence
ggggtttaggaggctggggg

SEQ ID NO: 55003 - DNA, 20 bp, Artificial
  CRISPR gRNA sequence
gggtttaggaggctgggggc

SEQ ID NO: 55004 - DNA, 20 bp, Artificial
  CRISPR gRNA sequence
ggtttaggaggctgggggca

SEQ ID NO: 55005 - DNA, 20 bp, Artificial
  CRISPR gRNA sequence
ggaggctgggggcagggttc

SEQ ID NO: 55006 - DNA, 20 bp, Artificial
  CRISPR gRNA sequence
gggcagggttctggaccacc

SEQ ID NO: 55007 - DNA, 20 bp, Artificial
  CRISPR gRNA sequence
ggcagggttctggaccacct

SEQ ID NO: 55008 - DNA, 20 bp, Artificial
  CRISPR gRNA sequence
cagggttctggaccacctgg

SEQ ID NO: 55009 - DNA, 20 bp, Artificial
  CRISPR gRNA sequence
ttctggaccacctgggagtt

SEQ ID NO: 55010 - DNA, 20 bp, Artificial
  CRISPR gRNA sequence
ccacctgggagtttagaatg

SEQ ID NO: 55011 - DNA, 20 bp, Artificial
  CRISPR gRNA sequence
cacctgggagtttagaatgt

SEQ ID NO: 55012 - DNA, 20 bp, Artificial
  CRISPR gRNA sequence
tagaatgtgggttttatcct

SEQ ID NO: 55013 - DNA, 20 bp, Artificial
  CRISPR gRNA sequence
aatgtgggttttatcctgag

SEQ ID NO: 55014 - DNA, 20 bp, Artificial
  CRISPR gRNA sequence
gtgggttttatcctgagcag

SEQ ID NO: 55015 - DNA, 20 bp, Artificial
  CRISPR gRNA sequence
tgggttttatcctgagcagt

SEQ ID NO: 55016 - DNA, 20 bp, Artificial
  CRISPR gRNA sequence
gttttatcctgagcagtggg

SEQ ID NO: 55017 - DNA, 20 bp, Artificial
  CRISPR gRNA sequence
ttttatcctgagcagtggga

SEQ ID NO: 55018 - DNA, 20 bp, Artificial
  CRISPR gRNA sequence
ttatcctgagcagtgggaag

SEQ ID NO: 55019 - DNA, 20 bp, Artificial
  CRISPR gRNA sequence
ctgagcagtgggaaggagtg

SEQ ID NO: 55020 - DNA, 20 bp, Artificial
  CRISPR gRNA sequence
tgagcagtgggaaggagtga

SEQ ID NO: 55021 - DNA, 20 bp, Artificial
  CRISPR gRNA sequence
gagcagtgggaaggagtgaa

SEQ ID NO: 55022 - DNA, 20 bp, Artificial
  CRISPR gRNA sequence
agcagtgggaaggagtgaag

SEQ ID NO: 55023 - DNA, 20 bp, Artificial
  CRISPR gRNA sequence
gcagtgggaaggagtgaagg

SEQ ID NO: 55024 - DNA, 20 bp, Artificial
  CRISPR gRNA sequence
gtgggaaggagtgaaggggg

SEQ ID NO: 55025 - DNA, 20 bp, Artificial
  CRISPR gRNA sequence
tgggaaggagtgaagggggc

SEQ ID NO: 55026 - DNA, 20 bp, Artificial
  CRISPR gRNA sequence
ggagtgaagggggcaggcat

SEQ ID NO: 55027 - DNA, 20 bp, Artificial
  CRISPR gRNA sequence
agggggcaggcatcagtgaa

SEQ ID NO: 55028 - DNA, 20 bp, Artificial
  CRISPR gRNA sequence
aaaagtgatctactctctgc

SEQ ID NO: 55029 - DNA, 20 bp, Artificial
  CRISPR gRNA sequence
aaagtgatctactctctgcc

SEQ ID NO: 55030 - DNA, 20 bp, Artificial
  CRISPR gRNA sequence
gtgatctactctctgccagg

SEQ ID NO: 55031 - DNA, 20 bp, Artificial
  CRISPR gRNA sequence
atctactctctgccaggtgg

SEQ ID NO: 55032 - DNA, 20 bp, Artificial
  CRISPR gRNA sequence
tactctctgccaggtggaag

SEQ ID NO: 55033 - DNA, 20 bp, Artificial
  CRISPR gRNA sequence
ctctgccaggtggaagtggc

SEQ ID NO: 55034 - DNA, 20 bp, Artificial
  CRISPR gRNA sequence
tctgccaggtggaagtggcc

SEQ ID NO: 55035 - DNA, 20 bp, Artificial
  CRISPR gRNA sequence
ctgccaggtggaagtggcca

SEQ ID NO: 55036 - DNA, 20 bp, Artificial
  CRISPR gRNA sequence
ggtggaagtggccagggtga

SEQ ID NO: 55037 - DNA, 20 bp, Artificial
  CRISPR gRNA sequence
ggaagtggccagggtgaaag

SEQ ID NO: 55038 - DNA, 20 bp, Artificial
  CRISPR gRNA sequence
gaagtggccagggtgaaagc

SEQ ID NO: 55039 - DNA, 20 bp, Artificial
  CRISPR gRNA sequence
aagtggccagggtgaaagca

SEQ ID NO: 55040 - DNA, 20 bp, Artificial
  CRISPR gRNA sequence
tggccagggtgaaagcaggg

SEQ ID NO: 55041 - DNA, 20 bp, Artificial
  CRISPR gRNA sequence
cagggtgaaagcagggaagc

SEQ ID NO: 55042 - DNA, 20 bp, Artificial
  CRISPR gRNA sequence
gtgaaagcagggaagccagc

SEQ ID NO: 55043 - DNA, 20 bp, Artificial
  CRISPR gRNA sequence
tgaaagcagggaagccagca

SEQ ID NO: 55044 - DNA, 20 bp, Artificial
  CRISPR gRNA sequence
aagcagggaagccagcaagg

SEQ ID NO: 55045 - DNA, 20 bp, Artificial
  CRISPR gRNA sequence
agcagggaagccagcaagga

SEQ ID NO: 55046 - DNA, 20 bp, Artificial
  CRISPR gRNA sequence
gggaagccagcaaggaaggc

SEQ ID NO: 55047 - DNA, 20 bp, Artificial
  CRISPR gRNA sequence
ggaagccagcaaggaaggca

SEQ ID NO: 55048 - DNA, 20 bp, Artificial
  CRISPR gRNA sequence
gccagcaaggaaggcaaggc

SEQ ID NO: 55049 - DNA, 20 bp, Artificial
  CRISPR gRNA sequence
ccagcaaggaaggcaaggcg

SEQ ID NO: 55050 - DNA, 20 bp, Artificial
  CRISPR gRNA sequence
cagcaaggaaggcaaggcga

SEQ ID NO: 55051 - DNA, 20 bp, Artificial
  CRISPR gRNA sequence
agcaaggaaggcaaggcgag

SEQ ID NO: 55052 - DNA, 20 bp, Artificial
  CRISPR gRNA sequence
gcaaggaaggcaaggcgagg

SEQ ID NO: 55053 - DNA, 20 bp, Artificial
  CRISPR gRNA sequence
ggcaaggcgagggggtcatc

SEQ ID NO: 55054 - DNA, 20 bp, Artificial
  CRISPR gRNA sequence
gcaaggcgagggggtcatcc

SEQ ID NO: 55055 - DNA, 20 bp, Artificial
  CRISPR gRNA sequence
ggcgagggggtcatccaggt

SEQ ID NO: 55056 - DNA, 20 bp, Artificial
  CRISPR gRNA sequence
cgagggggtcatccaggtaa

SEQ ID NO: 55057 - DNA, 20 bp, Artificial
  CRISPR gRNA sequence
gggtcatccaggtaagagat

SEQ ID NO: 55058 - DNA, 20 bp, Artificial
  CRISPR gRNA sequence
ggtcatccaggtaagagatg

SEQ ID NO: 55059 - DNA, 20 bp, Artificial
  CRISPR gRNA sequence
gtcatccaggtaagagatga

SEQ ID NO: 55060 - DNA, 20 bp, Artificial
  CRISPR gRNA sequence
atccaggtaagagatgaggg

SEQ ID NO: 55061 - DNA, 20 bp, Artificial
  CRISPR gRNA sequence
tccaggtaagagatgagggt

SEQ ID NO: 55062 - DNA, 20 bp, Artificial
  CRISPR gRNA sequence
ggtaagagatgagggtgggt

SEQ ID NO: 55063 - DNA, 20 bp, Artificial
  CRISPR gRNA sequence
gagatgagggtgggttggac

SEQ ID NO: 55064 - DNA, 20 bp, Artificial
  CRISPR gRNA sequence
tgagggtgggttggactaga

SEQ ID NO: 55065 - DNA, 20 bp, Artificial
  CRISPR gRNA sequence
gagggtgggttggactagaa

SEQ ID NO: 55066 - DNA, 20 bp, Artificial
  CRISPR gRNA sequence
ggtgggttggactagaaagg

SEQ ID NO: 55067 - DNA, 20 bp, Artificial
  CRISPR gRNA sequence
tgggttggactagaaaggtg

SEQ ID NO: 55068 - DNA, 20 bp, Artificial
  CRISPR gRNA sequence
gggttggactagaaaggtgg

SEQ ID NO: 55069 - DNA, 20 bp, Artificial
  CRISPR gRNA sequence
ggactagaaaggtggaggaa

SEQ ID NO: 55070 - DNA, 20 bp, Artificial
  CRISPR gRNA sequence
actagaaaggtggaggaaaa

SEQ ID NO: 55071 - DNA, 20 bp, Artificial
  CRISPR gRNA sequence
ctagaaaggtggaggaaaag

SEQ ID NO: 55072 - DNA, 20 bp, Artificial
  CRISPR gRNA sequence
aaaggtggaggaaaagagga

SEQ ID NO: 55073 - DNA, 20 bp, Artificial
  CRISPR gRNA sequence
gaggaaaagaggatagtttt

SEQ ID NO: 55074 - DNA, 20 bp, Artificial
  CRISPR gRNA sequence
aggatagttttgagcgctac

SEQ ID NO: 55075 - DNA, 20 bp, Artificial
  CRISPR gRNA sequence
atagttttgagcgctaccag

SEQ ID NO: 55076 - DNA, 20 bp, Artificial
  CRISPR gRNA sequence
tagttttgagcgctaccagt

SEQ ID NO: 55077 - DNA, 20 bp, Artificial
  CRISPR gRNA sequence
gcgctaccagtaggtccatc

SEQ ID NO: 55078 - DNA, 20 bp, Artificial
  CRISPR gRNA sequence
gctaccagtaggtccatctg

SEQ ID NO: 55079 - DNA, 20 bp, Artificial
  CRISPR gRNA sequence
ctaccagtaggtccatctgg

SEQ ID NO: 55080 - DNA, 20 bp, Artificial
  CRISPR gRNA sequence
taccagtaggtccatctgga

SEQ ID NO: 55081 - DNA, 20 bp, Artificial
  CRISPR gRNA sequence
ccatctggagggactaaatg

SEQ ID NO: 55082 - DNA, 20 bp, Artificial
  CRISPR gRNA sequence
catctggagggactaaatgt

SEQ ID NO: 55083 - DNA, 20 bp, Artificial
  CRISPR gRNA sequence
tctggagggactaaatgtgg

SEQ ID NO: 55084 - DNA, 20 bp, Artificial
  CRISPR gRNA sequence
ggagggactaaatgtgggag

SEQ ID NO: 55085 - DNA, 20 bp, Artificial
  CRISPR gRNA sequence
gagggactaaatgtgggaga

SEQ ID NO: 55086 - DNA, 20 bp, Artificial
  CRISPR gRNA sequence
agggactaaatgtgggagaa

SEQ ID NO: 55087 - DNA, 20 bp, Artificial
  CRISPR gRNA sequence
actaaatgtgggagaagggc

SEQ ID NO: 55088 - DNA, 20 bp, Artificial
  CRISPR gRNA sequence
ctaaatgtgggagaagggca

SEQ ID NO: 55089 - DNA, 20 bp, Artificial
  CRISPR gRNA sequence
taaatgtgggagaagggcaa

SEQ ID NO: 55090 - DNA, 20 bp, Artificial
  CRISPR gRNA sequence
aaatgtgggagaagggcaag

SEQ ID NO: 55091 - DNA, 20 bp, Artificial
  CRISPR gRNA sequence
aatgtgggagaagggcaagg

SEQ ID NO: 55092 - DNA, 20 bp, Artificial
  CRISPR gRNA sequence
tgggagaagggcaagggggc

SEQ ID NO: 55093 - DNA, 20 bp, Artificial
  CRISPR gRNA sequence
gggagaagggcaagggggct

SEQ ID NO: 55094 - DNA, 20 bp, Artificial
  CRISPR gRNA sequence
gagaagggcaagggggctag

SEQ ID NO: 55095 - DNA, 20 bp, Artificial
  CRISPR gRNA sequence
agaagggcaagggggctagg

SEQ ID NO: 55096 - DNA, 20 bp, Artificial
  CRISPR gRNA sequence
agggcaagggggctaggagg

SEQ ID NO: 55097 - DNA, 20 bp, Artificial
  CRISPR gRNA sequence
ctaggaggtggctgcgtaac

SEQ ID NO: 55098 - DNA, 20 bp, Artificial
  CRISPR gRNA sequence
taggaggtggctgcgtaacc

SEQ ID NO: 55099 - DNA, 20 bp, Artificial
  CRISPR gRNA sequence
gaggtggctgcgtaaccagg

SEQ ID NO: 55100 - DNA, 20 bp, Artificial
  CRISPR gRNA sequence
aggtggctgcgtaaccaggc

SEQ ID NO: 55101 - DNA, 20 bp, Artificial
  CRISPR gRNA sequence
ctgcgtaaccaggcgggtga

SEQ ID NO: 55102 - DNA, 20 bp, Artificial
  CRISPR gRNA sequence
tgcgtaaccaggcgggtgat

SEQ ID NO: 55103 - DNA, 20 bp, Artificial
  CRISPR gRNA sequence
gcgtaaccaggcgggtgatg

SEQ ID NO: 55104 - DNA, 20 bp, Artificial
  CRISPR gRNA sequence
gggtgatggggctgcttctg

SEQ ID NO: 55105 - DNA, 20 bp, Artificial
  CRISPR gRNA sequence
ggtgatggggctgcttctgc

SEQ ID NO: 55106 - DNA, 20 bp, Artificial
  CRISPR gRNA sequence
ggggctgcttctgcaggtga

SEQ ID NO: 55107 - DNA, 20 bp, Artificial
  CRISPR gRNA sequence
cttctgcaggtgatggcact

SEQ ID NO: 55108 - DNA, 20 bp, Artificial
  CRISPR gRNA sequence
ttctgcaggtgatggcactc

SEQ ID NO: 55109 - DNA, 20 bp, Artificial
  CRISPR gRNA sequence
tctgcaggtgatggcactcg

SEQ ID NO: 55110 - DNA, 20 bp, Artificial
  CRISPR gRNA sequence
tgcaggtgatggcactcggg

SEQ ID NO: 55111 - DNA, 20 bp, Artificial
  CRISPR gRNA sequence
gcaggtgatggcactcgggg

SEQ ID NO: 55112 - DNA, 20 bp, Artificial
  CRISPR gRNA sequence
caggtgatggcactcgggga

SEQ ID NO: 55113 - DNA, 20 bp, Artificial
  CRISPR gRNA sequence
aggtgatggcactcggggag

SEQ ID NO: 55114 - DNA, 20 bp, Artificial
  CRISPR gRNA sequence
cactcggggaggggcatgct

SEQ ID NO: 55115 - DNA, 20 bp, Artificial
  CRISPR gRNA sequence
gggaggggcatgctcagtgc

SEQ ID NO: 55116 - DNA, 20 bp, Artificial
  CRISPR gRNA sequence
ggggcatgctcagtgctggt

SEQ ID NO: 55117 - DNA, 20 bp, Artificial
  CRISPR gRNA sequence
gggcatgctcagtgctggtg

SEQ ID NO: 55118 - DNA, 20 bp, Artificial
  CRISPR gRNA sequence
catgctcagtgctggtgagg

SEQ ID NO: 55119 - DNA, 20 bp, Artificial
  CRISPR gRNA sequence
atgctcagtgctggtgaggc

SEQ ID NO: 55120 - DNA, 20 bp, Artificial
  CRISPR gRNA sequence
ctcagtgctggtgaggcagg

SEQ ID NO: 55121 - DNA, 20 bp, Artificial
  CRISPR gRNA sequence
agtgctggtgaggcaggtag

SEQ ID NO: 55122 - DNA, 20 bp, Artificial
  CRISPR gRNA sequence
tgaggcaggtagaagtgtgt

SEQ ID NO: 55123 - DNA, 20 bp, Artificial
  CRISPR gRNA sequence
accaccttctaattctgtcc

SEQ ID NO: 55124 - DNA, 20 bp, Artificial
  CRISPR gRNA sequence
ttctgtcctggttctcccaa

SEQ ID NO: 55125 - DNA, 20 bp, Artificial
  CRISPR gRNA sequence
tctgtcctggttctcccaat

SEQ ID NO: 55126 - DNA, 20 bp, Artificial
  CRISPR gRNA sequence
cctggttctcccaatgggac

SEQ ID NO: 55127 - DNA, 20 bp, Artificial
  CRISPR gRNA sequence
ctggttctcccaatgggacg

SEQ ID NO: 55128 - DNA, 20 bp, Artificial
  CRISPR gRNA sequence
tctcccaatgggacgaggtc

SEQ ID NO: 55129 - DNA, 20 bp, Artificial
  CRISPR gRNA sequence
ctcccaatgggacgaggtcc

SEQ ID NO: 55130 - DNA, 20 bp, Artificial
  CRISPR gRNA sequence
atgggacgaggtccaggatc

SEQ ID NO: 55131 - DNA, 20 bp, Artificial
  CRISPR gRNA sequence
gggacgaggtccaggatcaa

SEQ ID NO: 55132 - DNA, 20 bp, Artificial
  CRISPR gRNA sequence
ggacgaggtccaggatcaag

SEQ ID NO: 55133 - DNA, 20 bp, Artificial
  CRISPR gRNA sequence
acccctatccgtcttaccct

SEQ ID NO: 55134 - DNA, 20 bp, Artificial
  CRISPR gRNA sequence
cccctatccgtcttaccctg

SEQ ID NO: 55135 - DNA, 20 bp, Artificial
  CRISPR gRNA sequence
ctatccgtcttaccctgagg

SEQ ID NO: 55136 - DNA, 20 bp, Artificial
  CRISPR gRNA sequence
tatccgtcttaccctgaggt

SEQ ID NO: 55137 - DNA, 20 bp, Artificial
  CRISPR gRNA sequence
atccgtcttaccctgaggtg

SEQ ID NO: 55138 - DNA, 20 bp, Artificial
  CRISPR gRNA sequence
tgaggtggggccactcgacc

SEQ ID NO: 55139 - DNA, 20 bp, Artificial
  CRISPR gRNA sequence
actcgacccagaacacatcc

SEQ ID NO: 55140 - DNA, 20 bp, Artificial
  CRISPR gRNA sequence
catctgccttcatgttcact

SEQ ID NO: 55141 - DNA, 20 bp, Artificial
  CRISPR gRNA sequence
tctgccttcatgttcacttg

SEQ ID NO: 55142 - DNA, 20 bp, Artificial
  CRISPR gRNA sequence
ctgccttcatgttcacttgg

SEQ ID NO: 55143 - DNA, 20 bp, Artificial
  CRISPR gRNA sequence
atgttcacttggaggtttcc

SEQ ID NO: 55144 - DNA, 20 bp, Artificial
  CRISPR gRNA sequence
gttcacttggaggtttcctg

SEQ ID NO: 55145 - DNA, 20 bp, Artificial
  CRISPR gRNA sequence
ttcacttggaggtttcctgg

SEQ ID NO: 55146 - DNA, 20 bp, Artificial
  CRISPR gRNA sequence
tcacttggaggtttcctgga

SEQ ID NO: 55147 - DNA, 20 bp, Artificial
  CRISPR gRNA sequence
cacttggaggtttcctggag

SEQ ID NO: 55148 - DNA, 20 bp, Artificial
  CRISPR gRNA sequence
tcctggaggggcgcccctcc

SEQ ID NO: 55149 - DNA, 20 bp, Artificial
  CRISPR gRNA sequence
cctggaggggcgcccctcct

SEQ ID NO: 55150 - DNA, 20 bp, Artificial
  CRISPR gRNA sequence
ctggaggggcgcccctccta

SEQ ID NO: 55151 - DNA, 20 bp, Artificial
  CRISPR gRNA sequence
cgcccctcctagggtcgtga

SEQ ID NO: 55152 - DNA, 20 bp, Artificial
  CRISPR gRNA sequence
cccctcctagggtcgtgaca

SEQ ID NO: 55153 - DNA, 20 bp, Artificial
  CRISPR gRNA sequence
cagagcctccgtccatcccc

SEQ ID NO: 55154 - DNA, 20 bp, Artificial
  CRISPR gRNA sequence
tccccaagcactactcttat

SEQ ID NO: 55155 - DNA, 20 bp, Artificial
  CRISPR gRNA sequence
agcactactcttattggctt

SEQ ID NO: 55156 - DNA, 20 bp, Artificial
  CRISPR gRNA sequence
ctactcttattggcttcagc

SEQ ID NO: 55157 - DNA, 20 bp, Artificial
  CRISPR gRNA sequence
tactcttattggcttcagcc

SEQ ID NO: 55158 - DNA, 20 bp, Artificial
  CRISPR gRNA sequence
actcttattggcttcagcca

SEQ ID NO: 55159 - DNA, 20 bp, Artificial
  CRISPR gRNA sequence
ctcttattggcttcagccag

SEQ ID NO: 55160 - DNA, 20 bp, Artificial
  CRISPR gRNA sequence
tattggcttcagccaggggc

SEQ ID NO: 55161 - DNA, 20 bp, Artificial
  CRISPR gRNA sequence
cagccaggggctggacgcca

SEQ ID NO: 55162 - DNA, 20 bp, Artificial
  CRISPR gRNA sequence
agccaggggctggacgccat

SEQ ID NO: 55163 - DNA, 20 bp, Artificial
  CRISPR gRNA sequence
gggaatttctccatcccgaa

SEQ ID NO: 55164 - DNA, 20 bp, Artificial
  CRISPR gRNA sequence
gaatttctccatcccgaaaa

SEQ ID NO: 55165 - DNA, 20 bp, Artificial
  CRISPR gRNA sequence
tttctccatcccgaaaagag

SEQ ID NO: 55166 - DNA, 20 bp, Artificial
  CRISPR gRNA sequence
ttctccatcccgaaaagaga

SEQ ID NO: 55167 - DNA, 20 bp, Artificial
  CRISPR gRNA sequence
aaggttatcccactctactc

SEQ ID NO: 55168 - DNA, 20 bp, Artificial
  CRISPR gRNA sequence
aggttatcccactctactct

SEQ ID NO: 55169 - DNA, 20 bp, Artificial
  CRISPR gRNA sequence
gttatcccactctactctgg

SEQ ID NO: 55170 - DNA, 20 bp, Artificial
  CRISPR gRNA sequence
atcccactctactctgggag

SEQ ID NO: 55171 - DNA, 20 bp, Artificial
  CRISPR gRNA sequence
tcccactctactctgggaga

SEQ ID NO: 55172 - DNA, 20 bp, Artificial
  CRISPR gRNA sequence
tctactctgggagaaggatg

SEQ ID NO: 55173 - DNA, 20 bp, Artificial
  CRISPR gRNA sequence
ctactctgggagaaggatga

SEQ ID NO: 55174 - DNA, 20 bp, Artificial
  CRISPR gRNA sequence
tactctgggagaaggatgaa

SEQ ID NO: 55175 - DNA, 20 bp, Artificial
  CRISPR gRNA sequence
actctgggagaaggatgaag

SEQ ID NO: 55176 - DNA, 20 bp, Artificial
  CRISPR gRNA sequence
ctctgggagaaggatgaagg

SEQ ID NO: 55177 - DNA, 20 bp, Artificial
  CRISPR gRNA sequence
tgggagaaggatgaaggggg

SEQ ID NO: 55178 - DNA, 20 bp, Artificial
  CRISPR gRNA sequence
gggagaaggatgaagggggt

SEQ ID NO: 55179 - DNA, 20 bp, Artificial
  CRISPR gRNA sequence
ggagaaggatgaagggggtg

SEQ ID NO: 55180 - DNA, 20 bp, Artificial
  CRISPR gRNA sequence
gagaaggatgaagggggtgg

SEQ ID NO: 55181 - DNA, 20 bp, Artificial
  CRISPR gRNA sequence
agaaggatgaagggggtggg

SEQ ID NO: 55182 - DNA, 20 bp, Artificial
  CRISPR gRNA sequence
aaggatgaagggggtggggg

SEQ ID NO: 55183 - DNA, 20 bp, Artificial
  CRISPR gRNA sequence
aagggggtggggggagccct

SEQ ID NO: 55184 - DNA, 20 bp, Artificial
  CRISPR gRNA sequence
agggggtggggggagccctg

SEQ ID NO: 55185 - DNA, 20 bp, Artificial
  CRISPR gRNA sequence
gggggtggggggagccctga

SEQ ID NO: 55186 - DNA, 20 bp, Artificial
  CRISPR gRNA sequence
gggggagccctgagggactg

SEQ ID NO: 55187 - DNA, 20 bp, Artificial
  CRISPR gRNA sequence
agccctgagggactgtggtt

SEQ ID NO: 55188 - DNA, 20 bp, Artificial
  CRISPR gRNA sequence
cctgagggactgtggtttgg

SEQ ID NO: 55189 - DNA, 20 bp, Artificial
  CRISPR gRNA sequence
ctgagggactgtggtttgga

SEQ ID NO: 55190 - DNA, 20 bp, Artificial
  CRISPR gRNA sequence
agggactgtggtttggaagg

SEQ ID NO: 55191 - DNA, 20 bp, Artificial
  CRISPR gRNA sequence
tgtggtttggaaggcagacc

SEQ ID NO: 55192 - DNA, 20 bp, Artificial
  CRISPR gRNA sequence
gtggtttggaaggcagaccc

SEQ ID NO: 55193 - DNA, 20 bp, Artificial
  CRISPR gRNA sequence
ttggaaggcagacccaggtg

SEQ ID NO: 55194 - DNA, 20 bp, Artificial
  CRISPR gRNA sequence
gaaggcagacccaggtgtgg

SEQ ID NO: 55195 - DNA, 20 bp, Artificial
  CRISPR gRNA sequence
aaggcagacccaggtgtggt

SEQ ID NO: 55196 - DNA, 20 bp, Artificial
  CRISPR gRNA sequence
aggcagacccaggtgtggtg

SEQ ID NO: 55197 - DNA, 20 bp, Artificial
  CRISPR gRNA sequence
ggtgtggtggggtttctact

SEQ ID NO: 55198 - DNA, 20 bp, Artificial
  CRISPR gRNA sequence
gtggtggggtttctacttgg

SEQ ID NO: 55199 - DNA, 20 bp, Artificial
  CRISPR gRNA sequence
ggtttctacttggcagatct

SEQ ID NO: 55200 - DNA, 20 bp, Artificial
  CRISPR gRNA sequence
tctacttggcagatctcagc

SEQ ID NO: 55201 - DNA, 20 bp, Artificial
  CRISPR gRNA sequence
tacttggcagatctcagcaa

SEQ ID NO: 55202 - DNA, 20 bp, Artificial
  CRISPR gRNA sequence
cttggcagatctcagcaaga

SEQ ID NO: 55203 - DNA, 20 bp, Artificial
  CRISPR gRNA sequence
ttggcagatctcagcaagag

SEQ ID NO: 55204 - DNA, 20 bp, Artificial
  CRISPR gRNA sequence
gcagatctcagcaagagagg

SEQ ID NO: 55205 - DNA, 20 bp, Artificial
  CRISPR gRNA sequence
gatctcagcaagagaggtag

SEQ ID NO: 55206 - DNA, 20 bp, Artificial
  CRISPR gRNA sequence
ctcagcaagagaggtagcag

SEQ ID NO: 55207 - DNA, 20 bp, Artificial
  CRISPR gRNA sequence
agagaggtagcagtggttat

SEQ ID NO: 55208 - DNA, 20 bp, Artificial
  CRISPR gRNA sequence
gagaggtagcagtggttatg

SEQ ID NO: 55209 - DNA, 20 bp, Artificial
  CRISPR gRNA sequence
gtagcagtggttatgaggat

SEQ ID NO: 55210 - DNA, 20 bp, Artificial
  CRISPR gRNA sequence
tagcagtggttatgaggatg

SEQ ID NO: 55211 - DNA, 20 bp, Artificial
  CRISPR gRNA sequence
ggttatgaggatgaggctgc

SEQ ID NO: 55212 - DNA, 20 bp, Artificial
  CRISPR gRNA sequence
atgaggatgaggctgcgagc

SEQ ID NO: 55213 - DNA, 20 bp, Artificial
  CRISPR gRNA sequence
aggctgcgagccagactgtc

SEQ ID NO: 55214 - DNA, 20 bp, Artificial
  CRISPR gRNA sequence
ggctgcgagccagactgtct

SEQ ID NO: 55215 - DNA, 20 bp, Artificial
  CRISPR gRNA sequence
gactgtctgggcttgaaccc

SEQ ID NO: 55216 - DNA, 20 bp, Artificial
  CRISPR gRNA sequence
tctgggcttgaaccctagcc

SEQ ID NO: 55217 - DNA, 20 bp, Artificial
  CRISPR gRNA sequence
ctagactcttcctacctgtg

SEQ ID NO: 55218 - DNA, 20 bp, Artificial
  CRISPR gRNA sequence
cttcctacctgtgtggcctt

SEQ ID NO: 55219 - DNA, 20 bp, Artificial
  CRISPR gRNA sequence
ctacctgtgtggccttgagc

SEQ ID NO: 55220 - DNA, 20 bp, Artificial
  CRISPR gRNA sequence
tgagcaagtttatctttctg

SEQ ID NO: 55221 - DNA, 20 bp, Artificial
  CRISPR gRNA sequence
aacttcctcctctataaaat

SEQ ID NO: 55222 - DNA, 20 bp, Artificial
  CRISPR gRNA sequence
acttcctcctctataaaatg

SEQ ID NO: 55223 - DNA, 20 bp, Artificial
  CRISPR gRNA sequence
cctcctctataaaatgagga

SEQ ID NO: 55224 - DNA, 20 bp, Artificial
  CRISPR gRNA sequence
ctataaaatgaggacagtaa

SEQ ID NO: 55225 - DNA, 20 bp, Artificial
  CRISPR gRNA sequence
cagtaacagtgcttacatca

SEQ ID NO: 55226 - DNA, 20 bp, Artificial
  CRISPR gRNA sequence
gtaacagtgcttacatcaca

SEQ ID NO: 55227 - DNA, 20 bp, Artificial
  CRISPR gRNA sequence
tgcttacatcacagagatgt

SEQ ID NO: 55228 - DNA, 20 bp, Artificial
  CRISPR gRNA sequence
gcttacatcacagagatgtg

SEQ ID NO: 55229 - DNA, 20 bp, Artificial
  CRISPR gRNA sequence
ttacatcacagagatgtgag

SEQ ID NO: 55230 - DNA, 20 bp, Artificial
  CRISPR gRNA sequence
gagatgtgaggagtgaatgc

SEQ ID NO: 55231 - DNA, 20 bp, Artificial
  CRISPR gRNA sequence
agatgtgaggagtgaatgcg

SEQ ID NO: 55232 - DNA, 20 bp, Artificial
  CRISPR gRNA sequence
atgtgaggagtgaatgcgag

SEQ ID NO: 55233 - DNA, 20 bp, Artificial
  CRISPR gRNA sequence
tgtgaggagtgaatgcgagg

SEQ ID NO: 55234 - DNA, 20 bp, Artificial
  CRISPR gRNA sequence
tgaatgcgaggaggcatgta

SEQ ID NO: 55235 - DNA, 20 bp, Artificial
  CRISPR gRNA sequence
gaggaggcatgtacagtccc

SEQ ID NO: 55236 - DNA, 20 bp, Artificial
  CRISPR gRNA sequence
ggcatgtacagtccctagca

SEQ ID NO: 55237 - DNA, 20 bp, Artificial
  CRISPR gRNA sequence
ccctagcacagcacctgacc

SEQ ID NO: 55238 - DNA, 20 bp, Artificial
  CRISPR gRNA sequence
cctagcacagcacctgaccc

SEQ ID NO: 55239 - DNA, 20 bp, Artificial
  CRISPR gRNA sequence
cacagcacctgacccgggac

SEQ ID NO: 55240 - DNA, 20 bp, Artificial
  CRISPR gRNA sequence
gacccgggacaagtgctgaa

SEQ ID NO: 55241 - DNA, 20 bp, Artificial
  CRISPR gRNA sequence
ccgggacaagtgctgaatag

SEQ ID NO: 55242 - DNA, 20 bp, Artificial
  CRISPR gRNA sequence
ggacaagtgctgaatagtag

SEQ ID NO: 55243 - DNA, 20 bp, Artificial
  CRISPR gRNA sequence
gattcccccaaattcttcat

SEQ ID NO: 55244 - DNA, 20 bp, Artificial
  CRISPR gRNA sequence
attcccccaaattcttcatg

SEQ ID NO: 55245 - DNA, 20 bp, Artificial
  CRISPR gRNA sequence
cccccaaattcttcatgagg

SEQ ID NO: 55246 - DNA, 20 bp, Artificial
  CRISPR gRNA sequence
tcccccacaccacccaccca

SEQ ID NO: 55247 - DNA, 20 bp, Artificial
  CRISPR gRNA sequence
cccccacaccacccacccaa

SEQ ID NO: 55248 - DNA, 20 bp, Artificial
  CRISPR gRNA sequence
cacaccacccacccaaaggc

SEQ ID NO: 55249 - DNA, 20 bp, Artificial
  CRISPR gRNA sequence
acaccacccacccaaaggcg

SEQ ID NO: 55250 - DNA, 20 bp, Artificial
  CRISPR gRNA sequence
ccctctccaacctcctttcc

SEQ ID NO: 55251 - DNA, 20 bp, Artificial
  CRISPR gRNA sequence
tcctttcctggctcctacgc

SEQ ID NO: 55252 - DNA, 20 bp, Artificial
  CRISPR gRNA sequence
cctttcctggctcctacgcc

SEQ ID NO: 55253 - DNA, 20 bp, Artificial
  CRISPR gRNA sequence
ctttcctggctcctacgcca

SEQ ID NO: 55254 - DNA, 20 bp, Artificial
  CRISPR gRNA sequence
gatactcactccacttcctc

SEQ ID NO: 55255 - DNA, 20 bp, Artificial
  CRISPR gRNA sequence
atactcactccacttcctcc

SEQ ID NO: 55256 - DNA, 20 bp, Artificial
  CRISPR gRNA sequence
tcactccacttcctccaggt

SEQ ID NO: 55257 - DNA, 20 bp, Artificial
  CRISPR gRNA sequence
cactccacttcctccaggtg

SEQ ID NO: 55258 - DNA, 20 bp, Artificial
  CRISPR gRNA sequence
actccacttcctccaggtga

SEQ ID NO: 55259 - DNA, 20 bp, Artificial
  CRISPR gRNA sequence
cctccaggtgagggccttcc

SEQ ID NO: 55260 - DNA, 20 bp, Artificial
  CRISPR gRNA sequence
tccaggtgagggccttcctg

SEQ ID NO: 55261 - DNA, 20 bp, Artificial
  CRISPR gRNA sequence
aggtgagggccttcctggag

SEQ ID NO: 55262 - DNA, 20 bp, Artificial
  CRISPR gRNA sequence
ggtgagggccttcctggagc

SEQ ID NO: 55263 - DNA, 20 bp, Artificial
  CRISPR gRNA sequence
gtgagggccttcctggagca

SEQ ID NO: 55264 - DNA, 20 bp, Artificial
  CRISPR gRNA sequence
ccttcctggagcagggctat

SEQ ID NO: 55265 - DNA, 20 bp, Artificial
  CRISPR gRNA sequence
cttcctggagcagggctatg

SEQ ID NO: 55266 - DNA, 20 bp, Artificial
  CRISPR gRNA sequence
ttcctggagcagggctatga

SEQ ID NO: 55267 - DNA, 20 bp, Artificial
  CRISPR gRNA sequence
ctatgagggcctccgcatcg

SEQ ID NO: 55268 - DNA, 20 bp, Artificial
  CRISPR gRNA sequence
gggcctccgcatcgtggacc

SEQ ID NO: 55269 - DNA, 20 bp, Artificial
  CRISPR gRNA sequence
gcctccgcatcgtggacctg

SEQ ID NO: 55270 - DNA, 20 bp, Artificial
  CRISPR gRNA sequence
acctggagctgacacttctg

SEQ ID NO: 55271 - DNA, 20 bp, Artificial
  CRISPR gRNA sequence
agctgacacttctgcagcct

SEQ ID NO: 55272 - DNA, 20 bp, Artificial
  CRISPR gRNA sequence
gctgacacttctgcagcctt

SEQ ID NO: 55273 - DNA, 20 bp, Artificial
  CRISPR gRNA sequence
gacacttctgcagccttggg

SEQ ID NO: 55274 - DNA, 20 bp, Artificial
  CRISPR gRNA sequence
acacttctgcagccttgggt

SEQ ID NO: 55275 - DNA, 20 bp, Artificial
  CRISPR gRNA sequence
acttctgcagccttgggtag

SEQ ID NO: 55276 - DNA, 20 bp, Artificial
  CRISPR gRNA sequence
tctgcagccttgggtaggag

SEQ ID NO: 55277 - DNA, 20 bp, Artificial
  CRISPR gRNA sequence
ctgcagccttgggtaggagt

SEQ ID NO: 55278 - DNA, 20 bp, Artificial
  CRISPR gRNA sequence
tgcagccttgggtaggagtg

SEQ ID NO: 55279 - DNA, 20 bp, Artificial
  CRISPR gRNA sequence
gcagccttgggtaggagtgg

SEQ ID NO: 55280 - DNA, 20 bp, Artificial
  CRISPR gRNA sequence
ccttgggtaggagtggggga

SEQ ID NO: 55281 - DNA, 20 bp, Artificial
  CRISPR gRNA sequence
tgggtaggagtgggggacag

SEQ ID NO: 55282 - DNA, 20 bp, Artificial
  CRISPR gRNA sequence
gggtaggagtgggggacaga

SEQ ID NO: 55283 - DNA, 20 bp, Artificial
  CRISPR gRNA sequence
ggtaggagtgggggacagaa

SEQ ID NO: 55284 - DNA, 20 bp, Artificial
  CRISPR gRNA sequence
gagtgggggacagaagggct

SEQ ID NO: 55285 - DNA, 20 bp, Artificial
  CRISPR gRNA sequence
agtgggggacagaagggctc

SEQ ID NO: 55286 - DNA, 20 bp, Artificial
  CRISPR gRNA sequence
gtgggggacagaagggctca

SEQ ID NO: 55287 - DNA, 20 bp, Artificial
  CRISPR gRNA sequence
acagaagggctcagggcaaa

SEQ ID NO: 55288 - DNA, 20 bp, Artificial
  CRISPR gRNA sequence
ggcaaacagcccctactcca

SEQ ID NO: 55289 - DNA, 20 bp, Artificial
  CRISPR gRNA sequence
cccctactccatggcccctc

SEQ ID NO: 55290 - DNA, 20 bp, Artificial
  CRISPR gRNA sequence
gcccctccagcttccaatgc

SEQ ID NO: 55291 - DNA, 20 bp, Artificial
  CRISPR gRNA sequence
cccctccagcttccaatgct

SEQ ID NO: 55292 - DNA, 20 bp, Artificial
  CRISPR gRNA sequence
ccctccagcttccaatgctg

SEQ ID NO: 55293 - DNA, 20 bp, Artificial
  CRISPR gRNA sequence
cctccagcttccaatgctgg

SEQ ID NO: 55294 - DNA, 20 bp, Artificial
  CRISPR gRNA sequence
tccagcttccaatgctgggg

SEQ ID NO: 55295 - DNA, 20 bp, Artificial
  CRISPR gRNA sequence
gcttccaatgctgggggagt

SEQ ID NO: 55296 - DNA, 20 bp, Artificial
  CRISPR gRNA sequence
cttccaatgctgggggagtc

SEQ ID NO: 55297 - DNA, 20 bp, Artificial
  CRISPR gRNA sequence
ttccaatgctgggggagtca

SEQ ID NO: 55298 - DNA, 20 bp, Artificial
  CRISPR gRNA sequence
tccaatgctgggggagtcag

SEQ ID NO: 55299 - DNA, 20 bp, Artificial
  CRISPR gRNA sequence
ccaatgctgggggagtcagg

SEQ ID NO: 55300 - DNA, 20 bp, Artificial
  CRISPR gRNA sequence
tgggggagtcagggggccca

SEQ ID NO: 55301 - DNA, 20 bp, Artificial
  CRISPR gRNA sequence
agtcagggggcccacagacc

SEQ ID NO: 55302 - DNA, 20 bp, Artificial
  CRISPR gRNA sequence
gtcagggggcccacagacct

SEQ ID NO: 55303 - DNA, 20 bp, Artificial
  CRISPR gRNA sequence
cacagacctgggtctaatcc

SEQ ID NO: 55304 - DNA, 20 bp, Artificial
  CRISPR gRNA sequence
ctaatcctagccacacctct

SEQ ID NO: 55305 - DNA, 20 bp, Artificial
  CRISPR gRNA sequence
atcctagccacacctcttag

SEQ ID NO: 55306 - DNA, 20 bp, Artificial
  CRISPR gRNA sequence
tagccacacctcttagtagc

SEQ ID NO: 55307 - DNA, 20 bp, Artificial
  CRISPR gRNA sequence
agccacacctcttagtagct

SEQ ID NO: 55308 - DNA, 20 bp, Artificial
  CRISPR gRNA sequence
cttagtagctgggtgatctt

SEQ ID NO: 55309 - DNA, 20 bp, Artificial
  CRISPR gRNA sequence
gtagctgggtgatcttgagc

SEQ ID NO: 55310 - DNA, 20 bp, Artificial
  CRISPR gRNA sequence
tagctgggtgatcttgagca

SEQ ID NO: 55311 - DNA, 20 bp, Artificial
  CRISPR gRNA sequence
agctgggtgatcttgagcaa

SEQ ID NO: 55312 - DNA, 20 bp, Artificial
  CRISPR gRNA sequence
gcaagggacttaacctgtct

SEQ ID NO: 55313 - DNA, 20 bp, Artificial
  CRISPR gRNA sequence
gacttaacctgtctgagact

SEQ ID NO: 55314 - DNA, 20 bp, Artificial
  CRISPR gRNA sequence
ctcagtttcctcctccctca

SEQ ID NO: 55315 - DNA, 20 bp, Artificial
  CRISPR gRNA sequence
tcagtttcctcctccctcaa

SEQ ID NO: 55316 - DNA, 20 bp, Artificial
  CRISPR gRNA sequence
cagtttcctcctccctcaaa

SEQ ID NO: 55317 - DNA, 20 bp, Artificial
  CRISPR gRNA sequence
agtttcctcctccctcaaag

SEQ ID NO: 55318 - DNA, 20 bp, Artificial
  CRISPR gRNA sequence
gaataataatgtgtacttca

SEQ ID NO: 55319 - DNA, 20 bp, Artificial
  CRISPR gRNA sequence
ataataatgtgtacttcaca

SEQ ID NO: 55320 - DNA, 20 bp, Artificial
  CRISPR gRNA sequence
tgtacttcacagagattcta

SEQ ID NO: 55321 - DNA, 20 bp, Artificial
  CRISPR gRNA sequence
gtacttcacagagattctaa

SEQ ID NO: 55322 - DNA, 20 bp, Artificial
  CRISPR gRNA sequence
cagagattctaaaggaatta

SEQ ID NO: 55323 - DNA, 20 bp, Artificial
  CRISPR gRNA sequence
gattctaaaggaattacagt

SEQ ID NO: 55324 - DNA, 20 bp, Artificial
  CRISPR gRNA sequence
attctaaaggaattacagtg

SEQ ID NO: 55325 - DNA, 20 bp, Artificial
  CRISPR gRNA sequence
aaggaattacagtgaggtaa

SEQ ID NO: 55326 - DNA, 20 bp, Artificial
  CRISPR gRNA sequence
ggtaatggatgtaaaacatc

SEQ ID NO: 55327 - DNA, 20 bp, Artificial
  CRISPR gRNA sequence
aaaacatctagtgcaatgcc

SEQ ID NO: 55328 - DNA, 20 bp, Artificial
  CRISPR gRNA sequence
ctagtgcaatgcccggcata

SEQ ID NO: 55329 - DNA, 20 bp, Artificial
  CRISPR gRNA sequence
tgcaatgcccggcatataga

SEQ ID NO: 55330 - DNA, 20 bp, Artificial
  CRISPR gRNA sequence
atgcccggcatatagatagc

SEQ ID NO: 55331 - DNA, 20 bp, Artificial
  CRISPR gRNA sequence
tatagatagccggttccatt

SEQ ID NO: 55332 - DNA, 20 bp, Artificial
  CRISPR gRNA sequence
tagccggttccattaagttg

SEQ ID NO: 55333 - DNA, 20 bp, Artificial
  CRISPR gRNA sequence
tgcagctattgttattatga

SEQ ID NO: 55334 - DNA, 20 bp, Artificial
  CRISPR gRNA sequence
atgacagatgctccttattc

SEQ ID NO: 55335 - DNA, 20 bp, Artificial
  CRISPR gRNA sequence
cagatgctccttattcaagc

SEQ ID NO: 55336 - DNA, 20 bp, Artificial
  CRISPR gRNA sequence
agatgctccttattcaagcc

SEQ ID NO: 55337 - DNA, 20 bp, Artificial
  CRISPR gRNA sequence
gctccttattcaagccagga

SEQ ID NO: 55338 - DNA, 20 bp, Artificial
  CRISPR gRNA sequence
ctccttattcaagccaggat

SEQ ID NO: 55339 - DNA, 20 bp, Artificial
  CRISPR gRNA sequence
tcaagccaggatgggctatc

SEQ ID NO: 55340 - DNA, 20 bp, Artificial
  CRISPR gRNA sequence
caagccaggatgggctatcc

SEQ ID NO: 55341 - DNA, 20 bp, Artificial
  CRISPR gRNA sequence
ccaggatgggctatccagga

SEQ ID NO: 55342 - DNA, 20 bp, Artificial
  CRISPR gRNA sequence
caggatgggctatccaggat

SEQ ID NO: 55343 - DNA, 20 bp, Artificial
  CRISPR gRNA sequence
tccaggatgggcaccacacc

SEQ ID NO: 55344 - DNA, 20 bp, Artificial
  CRISPR gRNA sequence
gcccctgctctcccttgcct

SEQ ID NO: 55345 - DNA, 20 bp, Artificial
  CRISPR gRNA sequence
ccatatcatatccctctcct

SEQ ID NO: 55346 - DNA, 20 bp, Artificial
  CRISPR gRNA sequence
catatcatatccctctccta

SEQ ID NO: 55347 - DNA, 20 bp, Artificial
  CRISPR gRNA sequence
atatccctctcctaaggcaa

SEQ ID NO: 55348 - DNA, 20 bp, Artificial
  CRISPR gRNA sequence
ctaaggcaatagatccctcc

SEQ ID NO: 55349 - DNA, 20 bp, Artificial
  CRISPR gRNA sequence
taaggcaatagatccctcca

SEQ ID NO: 55350 - DNA, 20 bp, Artificial
  CRISPR gRNA sequence
tagatccctccaaggtacct

SEQ ID NO: 55351 - DNA, 20 bp, Artificial
  CRISPR gRNA sequence
ctccaaggtacctgagcgtc

SEQ ID NO: 55352 - DNA, 20 bp, Artificial
  CRISPR gRNA sequence
gagcgtcaagcttctgctct

SEQ ID NO: 55353 - DNA, 20 bp, Artificial
  CRISPR gRNA sequence
tgctctgagcccctttcctc

SEQ ID NO: 55354 - DNA, 20 bp, Artificial
  CRISPR gRNA sequence
ctctggccgtcactttcctg

SEQ ID NO: 55355 - DNA, 20 bp, Artificial
  CRISPR gRNA sequence
tctggccgtcactttcctgc

SEQ ID NO: 55356 - DNA, 20 bp, Artificial
  CRISPR gRNA sequence
ccgtcactttcctgcaggtc

SEQ ID NO: 55357 - DNA, 20 bp, Artificial
  CRISPR gRNA sequence
gtcactttcctgcaggtctg

SEQ ID NO: 55358 - DNA, 20 bp, Artificial
  CRISPR gRNA sequence
ttcctgcaggtctggagctc

SEQ ID NO: 55359 - DNA, 20 bp, Artificial
  CRISPR gRNA sequence
tgcaggtctggagctctggc

SEQ ID NO: 55360 - DNA, 20 bp, Artificial
  CRISPR gRNA sequence
agctctggcaagaacaaatc

SEQ ID NO: 55361 - DNA, 20 bp, Artificial
  CRISPR gRNA sequence
ggcaagaacaaatcaagcat

SEQ ID NO: 55362 - DNA, 20 bp, Artificial
  CRISPR gRNA sequence
gaacaaatcaagcattggcc

SEQ ID NO: 55363 - DNA, 20 bp, Artificial
  CRISPR gRNA sequence
aacaaatcaagcattggcct

SEQ ID NO: 55364 - DNA, 20 bp, Artificial
  CRISPR gRNA sequence
atcaagcattggcctgggct

SEQ ID NO: 55365 - DNA, 20 bp, Artificial
  CRISPR gRNA sequence
tcaagcattggcctgggctc

SEQ ID NO: 55366 - DNA, 20 bp, Artificial
  CRISPR gRNA sequence
ttggcctgggctcaggcatc

SEQ ID NO: 55367 - DNA, 20 bp, Artificial
  CRISPR gRNA sequence
tggcctgggctcaggcatct

SEQ ID NO: 55368 - DNA, 20 bp, Artificial
  CRISPR gRNA sequence
ggcctgggctcaggcatcta

SEQ ID NO: 55369 - DNA, 20 bp, Artificial
  CRISPR gRNA sequence
gggctcaggcatctagggcc

SEQ ID NO: 55370 - DNA, 20 bp, Artificial
  CRISPR gRNA sequence
ctcaggcatctagggcctgg

SEQ ID NO: 55371 - DNA, 20 bp, Artificial
  CRISPR gRNA sequence
catctagggcctggtggatc

SEQ ID NO: 55372 - DNA, 20 bp, Artificial
  CRISPR gRNA sequence
gtggatcaagcctctttcct

SEQ ID NO: 55373 - DNA, 20 bp, Artificial
  CRISPR gRNA sequence
aagcctctttccttggcttc

SEQ ID NO: 55374 - DNA, 20 bp, Artificial
  CRISPR gRNA sequence
gcctctttccttggcttcta

SEQ ID NO: 55375 - DNA, 20 bp, Artificial
  CRISPR gRNA sequence
cctctttccttggcttctag

SEQ ID NO: 55376 - DNA, 20 bp, Artificial
  CRISPR gRNA sequence
tccttggcttctagaggctg

SEQ ID NO: 55377 - DNA, 20 bp, Artificial
  CRISPR gRNA sequence
tctagaggctgaagaccctg

SEQ ID NO: 55378 - DNA, 20 bp, Artificial
  CRISPR gRNA sequence
agaccctgaagcacaaccca

SEQ ID NO: 55379 - DNA, 20 bp, Artificial
  CRISPR gRNA sequence
cctgaagcacaacccaaagt

SEQ ID NO: 55380 - DNA, 20 bp, Artificial
  CRISPR gRNA sequence
aagcacaacccaaagtgagt

SEQ ID NO: 55381 - DNA, 20 bp, Artificial
  CRISPR gRNA sequence
cccaaagtgagtcggtaaca

SEQ ID NO: 55382 - DNA, 20 bp, Artificial
  CRISPR gRNA sequence
ccaaagtgagtcggtaacaa

SEQ ID NO: 55383 - DNA, 20 bp, Artificial
  CRISPR gRNA sequence
aaagtgagtcggtaacaaag

SEQ ID NO: 55384 - DNA, 20 bp, Artificial
  CRISPR gRNA sequence
gtaacaaaggagactgcttg

SEQ ID NO: 55385 - DNA, 20 bp, Artificial
  CRISPR gRNA sequence
gagactgcttgcagatgctc

SEQ ID NO: 55386 - DNA, 20 bp, Artificial
  CRISPR gRNA sequence
cagatgctcaagatgtgatt

SEQ ID NO: 55387 - DNA, 20 bp, Artificial
  CRISPR gRNA sequence
atgctcaagatgtgattcag

SEQ ID NO: 55388 - DNA, 20 bp, Artificial
  CRISPR gRNA sequence
gctcaagatgtgattcagca

SEQ ID NO: 55389 - DNA, 20 bp, Artificial
  CRISPR gRNA sequence
caagatgtgattcagcagag

SEQ ID NO: 55390 - DNA, 20 bp, Artificial
  CRISPR gRNA sequence
aagatgtgattcagcagagc

SEQ ID NO: 55391 - DNA, 20 bp, Artificial
  CRISPR gRNA sequence
gatgtgattcagcagagcag

SEQ ID NO: 55392 - DNA, 20 bp, Artificial
  CRISPR gRNA sequence
atgtgattcagcagagcagg

SEQ ID NO: 55393 - DNA, 20 bp, Artificial
  CRISPR gRNA sequence
tgtgattcagcagagcagga

SEQ ID NO: 55394 - DNA, 20 bp, Artificial
  CRISPR gRNA sequence
gtgattcagcagagcaggag

SEQ ID NO: 55395 - DNA, 20 bp, Artificial
  CRISPR gRNA sequence
cagcagagcaggaggggcaa

SEQ ID NO: 55396 - DNA, 20 bp, Artificial
  CRISPR gRNA sequence
agcagagcaggaggggcaac

SEQ ID NO: 55397 - DNA, 20 bp, Artificial
  CRISPR gRNA sequence
gcaggaggggcaacaggttt

SEQ ID NO: 55398 - DNA, 20 bp, Artificial
  CRISPR gRNA sequence
caggaggggcaacaggtttg

SEQ ID NO: 55399 - DNA, 20 bp, Artificial
  CRISPR gRNA sequence
gcaacaggtttgaggtcaaa

SEQ ID NO: 55400 - DNA, 20 bp, Artificial
  CRISPR gRNA sequence
tggaacctttattcaaattt

SEQ ID NO: 55401 - DNA, 20 bp, Artificial
  CRISPR gRNA sequence
aattttggctctgccatgta

SEQ ID NO: 55402 - DNA, 20 bp, Artificial
  CRISPR gRNA sequence
ctctgccatgtatagccatg

SEQ ID NO: 55403 - DNA, 20 bp, Artificial
  CRISPR gRNA sequence
catgtatagccatgtggcct

SEQ ID NO: 55404 - DNA, 20 bp, Artificial
  CRISPR gRNA sequence
atgtatagccatgtggcctt

SEQ ID NO: 55405 - DNA, 20 bp, Artificial
  CRISPR gRNA sequence
tggccttgggcaaatcactg

SEQ ID NO: 55406 - DNA, 20 bp, Artificial
  CRISPR gRNA sequence
cttgggcaaatcactgcagt

SEQ ID NO: 55407 - DNA, 20 bp, Artificial
  CRISPR gRNA sequence
cccttttctcttttctaaaa

SEQ ID NO: 55408 - DNA, 20 bp, Artificial
  CRISPR gRNA sequence
ctaaaacggatgacaacatc

SEQ ID NO: 55409 - DNA, 20 bp, Artificial
  CRISPR gRNA sequence
ggatgacaacatctagcaca

SEQ ID NO: 55410 - DNA, 20 bp, Artificial
  CRISPR gRNA sequence
gatgacaacatctagcacat

SEQ ID NO: 55411 - DNA, 20 bp, Artificial
  CRISPR gRNA sequence
atctagcacataggtacctg

SEQ ID NO: 55412 - DNA, 20 bp, Artificial
  CRISPR gRNA sequence
tctagcacataggtacctga

SEQ ID NO: 55413 - DNA, 20 bp, Artificial
  CRISPR gRNA sequence
aggtacctgaaggattgaat

SEQ ID NO: 55414 - DNA, 20 bp, Artificial
  CRISPR gRNA sequence
gaatgagacaatgtatgtcc

SEQ ID NO: 55415 - DNA, 20 bp, Artificial
  CRISPR gRNA sequence
acaatgtatgtccaagtacc

SEQ ID NO: 55416 - DNA, 20 bp, Artificial
  CRISPR gRNA sequence
gtatgtccaagtacccagca

SEQ ID NO: 55417 - DNA, 20 bp, Artificial
  CRISPR gRNA sequence
tatgtccaagtacccagcat

SEQ ID NO: 55418 - DNA, 20 bp, Artificial
  CRISPR gRNA sequence
ccagcataggtgtaaaatcg

SEQ ID NO: 55419 - DNA, 20 bp, Artificial
  CRISPR gRNA sequence
cagcataggtgtaaaatcga

SEQ ID NO: 55420 - DNA, 20 bp, Artificial
  CRISPR gRNA sequence
ataggtgtaaaatcgaaggt

SEQ ID NO: 55421 - DNA, 20 bp, Artificial
  CRISPR gRNA sequence
taaaatcgaaggttagtaaa

SEQ ID NO: 55422 - DNA, 20 bp, Artificial
  CRISPR gRNA sequence
aatcgaaggttagtaaacag

SEQ ID NO: 55423 - DNA, 20 bp, Artificial
  CRISPR gRNA sequence
tgctattgtcgatgatgtga

SEQ ID NO: 55424 - DNA, 20 bp, Artificial
  CRISPR gRNA sequence
gatgtgatggtctccatttg

SEQ ID NO: 55425 - DNA, 20 bp, Artificial
  CRISPR gRNA sequence
atttgtggatgtgctgtctg

SEQ ID NO: 55426 - DNA, 20 bp, Artificial
  CRISPR gRNA sequence
tggatgtgctgtctgtggtt

SEQ ID NO: 55427 - DNA, 20 bp, Artificial
  CRISPR gRNA sequence
atgtgctgtctgtggttcag

SEQ ID NO: 55428 - DNA, 20 bp, Artificial
  CRISPR gRNA sequence
tgtgctgtctgtggttcaga

SEQ ID NO: 55429 - DNA, 20 bp, Artificial
  CRISPR gRNA sequence
ctgtctgtggttcagaaggc

SEQ ID NO: 55430 - DNA, 20 bp, Artificial
  CRISPR gRNA sequence
tgtctgtggttcagaaggcg

SEQ ID NO: 55431 - DNA, 20 bp, Artificial
  CRISPR gRNA sequence
tctgtggttcagaaggcgag

SEQ ID NO: 55432 - DNA, 20 bp, Artificial
  CRISPR gRNA sequence
gttcagaaggcgaggagcat

SEQ ID NO: 55433 - DNA, 20 bp, Artificial
  CRISPR gRNA sequence
cgaggagcatgagctgtatg

SEQ ID NO: 55434 - DNA, 20 bp, Artificial
  CRISPR gRNA sequence
gagcatgagctgtatgcagt

SEQ ID NO: 55435 - DNA, 20 bp, Artificial
  CRISPR gRNA sequence
tgagctgtatgcagtgagtc

SEQ ID NO: 55436 - DNA, 20 bp, Artificial
  CRISPR gRNA sequence
gagctgtatgcagtgagtcc

SEQ ID NO: 55437 - DNA, 20 bp, Artificial
  CRISPR gRNA sequence
tatgcagtgagtccaggcta

SEQ ID NO: 55438 - DNA, 20 bp, Artificial
  CRISPR gRNA sequence
gtccaggctatggtaaacca

SEQ ID NO: 55439 - DNA, 20 bp, Artificial
  CRISPR gRNA sequence
aaccacagactctctcccac

SEQ ID NO: 55440 - DNA, 20 bp, Artificial
  CRISPR gRNA sequence
accacagactctctcccact

SEQ ID NO: 55441 - DNA, 20 bp, Artificial
  CRISPR gRNA sequence
agactctctcccactgggct

SEQ ID NO: 55442 - DNA, 20 bp, Artificial
  CRISPR gRNA sequence
gactctctcccactgggctg

SEQ ID NO: 55443 - DNA, 20 bp, Artificial
  CRISPR gRNA sequence
actctctcccactgggctga

SEQ ID NO: 55444 - DNA, 20 bp, Artificial
  CRISPR gRNA sequence
tctctcccactgggctgagg

SEQ ID NO: 55445 - DNA, 20 bp, Artificial
  CRISPR gRNA sequence
ccactgggctgagggagcgt

SEQ ID NO: 55446 - DNA, 20 bp, Artificial
  CRISPR gRNA sequence
cactgggctgagggagcgtt

SEQ ID NO: 55447 - DNA, 20 bp, Artificial
  CRISPR gRNA sequence
actgggctgagggagcgtta

SEQ ID NO: 55448 - DNA, 20 bp, Artificial
  CRISPR gRNA sequence
ctgggctgagggagcgttag

SEQ ID NO: 55449 - DNA, 20 bp, Artificial
  CRISPR gRNA sequence
tgagggagcgttaggggatg

SEQ ID NO: 55450 - DNA, 20 bp, Artificial
  CRISPR gRNA sequence
gagggagcgttaggggatgc

SEQ ID NO: 55451 - DNA, 20 bp, Artificial
  CRISPR gRNA sequence
agggagcgttaggggatgca

SEQ ID NO: 55452 - DNA, 20 bp, Artificial
  CRISPR gRNA sequence
gagcgttaggggatgcaggg

SEQ ID NO: 55453 - DNA, 20 bp, Artificial
  CRISPR gRNA sequence
gttaggggatgcagggaagc

SEQ ID NO: 55454 - DNA, 20 bp, Artificial
  CRISPR gRNA sequence
ttaggggatgcagggaagct

SEQ ID NO: 55455 - DNA, 20 bp, Artificial
  CRISPR gRNA sequence
cagggaagctaggacatcat

SEQ ID NO: 55456 - DNA, 20 bp, Artificial
  CRISPR gRNA sequence
gaagctaggacatcatgagc

SEQ ID NO: 55457 - DNA, 20 bp, Artificial
  CRISPR gRNA sequence
aagctaggacatcatgagcc

SEQ ID NO: 55458 - DNA, 20 bp, Artificial
  CRISPR gRNA sequence
acatcatgagccaggtttca

SEQ ID NO: 55459 - DNA, 20 bp, Artificial
  CRISPR gRNA sequence
gccaggtttcacagactttt

SEQ ID NO: 55460 - DNA, 20 bp, Artificial
  CRISPR gRNA sequence
gtttcacagactttttggat

SEQ ID NO: 55461 - DNA, 20 bp, Artificial
  CRISPR gRNA sequence
gctaaccatttttttttttt

SEQ ID NO: 55462 - DNA, 20 bp, Artificial
  CRISPR gRNA sequence
taaccattttttttttttta

SEQ ID NO: 55463 - DNA, 20 bp, Artificial
  CRISPR gRNA sequence
catttttttttttttagaga

SEQ ID NO: 55464 - DNA, 20 bp, Artificial
  CRISPR gRNA sequence
atttttttttttttagagac

SEQ ID NO: 55465 - DNA, 20 bp, Artificial
  CRISPR gRNA sequence
tttttttttttttagagaca

SEQ ID NO: 55466 - DNA, 20 bp, Artificial
  CRISPR gRNA sequence
tttagagacagggtcccact

SEQ ID NO: 55467 - DNA, 20 bp, Artificial
  CRISPR gRNA sequence
cagggtcccactcagtcccc

SEQ ID NO: 55468 - DNA, 20 bp, Artificial
  CRISPR gRNA sequence
gtcccactcagtccccaagc

SEQ ID NO: 55469 - DNA, 20 bp, Artificial
  CRISPR gRNA sequence
cccactcagtccccaagctg

SEQ ID NO: 55470 - DNA, 20 bp, Artificial
  CRISPR gRNA sequence
tcagtccccaagctggagtg

SEQ ID NO: 55471 - DNA, 20 bp, Artificial
  CRISPR gRNA sequence
gtccccaagctggagtgcag

SEQ ID NO: 55472 - DNA, 20 bp, Artificial
  CRISPR gRNA sequence
ggagtgcagtggctctatcc

SEQ ID NO: 55473 - DNA, 20 bp, Artificial
  CRISPR gRNA sequence
ggctctatcccagttcactg

SEQ ID NO: 55474 - DNA, 20 bp, Artificial
  CRISPR gRNA sequence
tcactgcagcctcaaactcc

SEQ ID NO: 55475 - DNA, 20 bp, Artificial
  CRISPR gRNA sequence
cactgcagcctcaaactcct

SEQ ID NO: 55476 - DNA, 20 bp, Artificial
  CRISPR gRNA sequence
agcctcaaactcctgggctc

SEQ ID NO: 55477 - DNA, 20 bp, Artificial
  CRISPR gRNA sequence
ctcaagtgatcctcccacct

SEQ ID NO: 55478 - DNA, 20 bp, Artificial
  CRISPR gRNA sequence
tcctcccaccttggcttcct

SEQ ID NO: 55479 - DNA, 20 bp, Artificial
  CRISPR gRNA sequence
accttggcttcctgagtaac

SEQ ID NO: 55480 - DNA, 20 bp, Artificial
  CRISPR gRNA sequence
ttcctgagtaactggtacta

SEQ ID NO: 55481 - DNA, 20 bp, Artificial
  CRISPR gRNA sequence
tcctgagtaactggtactat

SEQ ID NO: 55482 - DNA, 20 bp, Artificial
  CRISPR gRNA sequence
ctgagtaactggtactatag

SEQ ID NO: 55483 - DNA, 20 bp, Artificial
  CRISPR gRNA sequence
taggagtgaatcaccatgcc

SEQ ID NO: 55484 - DNA, 20 bp, Artificial
  CRISPR gRNA sequence
ctattttttttttttttttg

SEQ ID NO: 55485 - DNA, 20 bp, Artificial
  CRISPR gRNA sequence
attttttttttttttttgta

SEQ ID NO: 55486 - DNA, 20 bp, Artificial
  CRISPR gRNA sequence
tttttttttttttgtagaga

SEQ ID NO: 55487 - DNA, 20 bp, Artificial
  CRISPR gRNA sequence
ttttttttttttgtagagat

SEQ ID NO: 55488 - DNA, 20 bp, Artificial
  CRISPR gRNA sequence
tttttttttttgtagagatg

SEQ ID NO: 55489 - DNA, 20 bp, Artificial
  CRISPR gRNA sequence
ttttttttttgtagagatgg

SEQ ID NO: 55490 - DNA, 20 bp, Artificial
  CRISPR gRNA sequence
gggggtctcactttgttgcc

SEQ ID NO: 55491 - DNA, 20 bp, Artificial
  CRISPR gRNA sequence
ggggtctcactttgttgccc

SEQ ID NO: 55492 - DNA, 20 bp, Artificial
  CRISPR gRNA sequence
tctcactttgttgcccaggc

SEQ ID NO: 55493 - DNA, 20 bp, Artificial
  CRISPR gRNA sequence
ccaggctggtcttgaactcc

SEQ ID NO: 55494 - DNA, 20 bp, Artificial
  CRISPR gRNA sequence
ggtcttgaactcctagcttc

SEQ ID NO: 55495 - DNA, 20 bp, Artificial
  CRISPR gRNA sequence
ttcaagcgatcctgccccct

SEQ ID NO: 55496 - DNA, 20 bp, Artificial
  CRISPR gRNA sequence
cctgccccctcagcctctca

SEQ ID NO: 55497 - DNA, 20 bp, Artificial
  CRISPR gRNA sequence
ccctcagcctctcaaagtgc

SEQ ID NO: 55498 - DNA, 20 bp, Artificial
  CRISPR gRNA sequence
cctcagcctctcaaagtgct

SEQ ID NO: 55499 - DNA, 20 bp, Artificial
  CRISPR gRNA sequence
ctcagcctctcaaagtgctg

SEQ ID NO: 55500 - DNA, 20 bp, Artificial
  CRISPR gRNA sequence
ctctcaaagtgctggggtta

SEQ ID NO: 55501 - DNA, 20 bp, Artificial
  CRISPR gRNA sequence
agtgctggggttacagacat

SEQ ID NO: 55502 - DNA, 20 bp, Artificial
  CRISPR gRNA sequence
acagacatgagccaccatgc

SEQ ID NO: 55503 - DNA, 20 bp, Artificial
  CRISPR gRNA sequence
caccatgccagcctgtttaa

SEQ ID NO: 55504 - DNA, 20 bp, Artificial
  CRISPR gRNA sequence
aatagaactttctgcaatga

SEQ ID NO: 55505 - DNA, 20 bp, Artificial
  CRISPR gRNA sequence
ctgcaatgatggaaatgtcc

SEQ ID NO: 55506 - DNA, 20 bp, Artificial
  CRISPR gRNA sequence
ggcatctgtaccacttgcta

SEQ ID NO: 55507 - DNA, 20 bp, Artificial
  CRISPR gRNA sequence
gcatctgtaccacttgctat

SEQ ID NO: 55508 - DNA, 20 bp, Artificial
  CRISPR gRNA sequence
atctgtaccacttgctatgg

SEQ ID NO: 55509 - DNA, 20 bp, Artificial
  CRISPR gRNA sequence
ccacttgctatgggagccac

SEQ ID NO: 55510 - DNA, 20 bp, Artificial
  CRISPR gRNA sequence
tgggagccactagccaccta

SEQ ID NO: 55511 - DNA, 20 bp, Artificial
  CRISPR gRNA sequence
actagccacctatggccact

SEQ ID NO: 55512 - DNA, 20 bp, Artificial
  CRISPR gRNA sequence
agccacctatggccactgag

SEQ ID NO: 55513 - DNA, 20 bp, Artificial
  CRISPR gRNA sequence
gccactgagcagttgaaata

SEQ ID NO: 55514 - DNA, 20 bp, Artificial
  CRISPR gRNA sequence
ttaatttatttaaattaaaa

SEQ ID NO: 55515 - DNA, 20 bp, Artificial
  CRISPR gRNA sequence
ttaatttatttaaattgaaa

SEQ ID NO: 55516 - DNA, 20 bp, Artificial
  CRISPR gRNA sequence
ttaatttatttaaattgaaa

SEQ ID NO: 55517 - DNA, 20 bp, Artificial
  CRISPR gRNA sequence
tttaaattgaaatagccata

SEQ ID NO: 55518 - DNA, 20 bp, Artificial
  CRISPR gRNA sequence
ttaaattgaaatagccatat

SEQ ID NO: 55519 - DNA, 20 bp, Artificial
  CRISPR gRNA sequence
taaattgaaatagccatatg

SEQ ID NO: 55520 - DNA, 20 bp, Artificial
  CRISPR gRNA sequence
ttgaaatagccatatggggc

SEQ ID NO: 55521 - DNA, 20 bp, Artificial
  CRISPR gRNA sequence
aaatagccatatggggctag

SEQ ID NO: 55522 - DNA, 20 bp, Artificial
  CRISPR gRNA sequence
gggctagtggctatcctact

SEQ ID NO: 55523 - DNA, 20 bp, Artificial
  CRISPR gRNA sequence
ggctatcctactgagcatca

SEQ ID NO: 55524 - DNA, 20 bp, Artificial
  CRISPR gRNA sequence
ctactgagcatcacagcttt

SEQ ID NO: 55525 - DNA, 20 bp, Artificial
  CRISPR gRNA sequence
ctgagcatcacagctttaag

SEQ ID NO: 55526 - DNA, 20 bp, Artificial
  CRISPR gRNA sequence
gcatcacagctttaagcagt

SEQ ID NO: 55527 - DNA, 20 bp, Artificial
  CRISPR gRNA sequence
atcacagctttaagcagtta

SEQ ID NO: 55528 - DNA, 20 bp, Artificial
  CRISPR gRNA sequence
tcacagctttaagcagttag

SEQ ID NO: 55529 - DNA, 20 bp, Artificial
  CRISPR gRNA sequence
cacagctttaagcagttaga

SEQ ID NO: 55530 - DNA, 20 bp, Artificial
  CRISPR gRNA sequence
ctttaagcagttagagggaa

SEQ ID NO: 55531 - DNA, 20 bp, Artificial
  CRISPR gRNA sequence
aagcagttagagggaaaaga

SEQ ID NO: 55532 - DNA, 20 bp, Artificial
  CRISPR gRNA sequence
gagggaaaagaaagtgacac

SEQ ID NO: 55533 - DNA, 20 bp, Artificial
  CRISPR gRNA sequence
aaagaaagtgacactggtcc

SEQ ID NO: 55534 - DNA, 20 bp, Artificial
  CRISPR gRNA sequence
gaaagtgacactggtcctag

SEQ ID NO: 55535 - DNA, 20 bp, Artificial
  CRISPR gRNA sequence
aaagtgacactggtcctagt

SEQ ID NO: 55536 - DNA, 20 bp, Artificial
  CRISPR gRNA sequence
gtcctagtgggtcatttttt

SEQ ID NO: 55537 - DNA, 20 bp, Artificial
  CRISPR gRNA sequence
tagtgggtcattttttgaga

SEQ ID NO: 55538 - DNA, 20 bp, Artificial
  CRISPR gRNA sequence
gtgggtcattttttgagaca

SEQ ID NO: 55539 - DNA, 20 bp, Artificial
  CRISPR gRNA sequence
cagagtccctctctgtcacc

SEQ ID NO: 55540 - DNA, 20 bp, Artificial
  CRISPR gRNA sequence
agagtccctctctgtcaccc

SEQ ID NO: 55541 - DNA, 20 bp, Artificial
  CRISPR gRNA sequence
tccctctctgtcacccaggc

SEQ ID NO: 55542 - DNA, 20 bp, Artificial
  CRISPR gRNA sequence
cctctctgtcacccaggctg

SEQ ID NO: 55543 - DNA, 20 bp, Artificial
  CRISPR gRNA sequence
ctgtcacccaggctggagta

SEQ ID NO: 55544 - DNA, 20 bp, Artificial
  CRISPR gRNA sequence
tcacccaggctggagtacag

SEQ ID NO: 55545 - DNA, 20 bp, Artificial
  CRISPR gRNA sequence
ggagtacagtggtgtgatca

SEQ ID NO: 55546 - DNA, 20 bp, Artificial
  CRISPR gRNA sequence
cagtggtgtgatcatggctc

SEQ ID NO: 55547 - DNA, 20 bp, Artificial
  CRISPR gRNA sequence
gtgatcatggctcaagctcc

SEQ ID NO: 55548 - DNA, 20 bp, Artificial
  CRISPR gRNA sequence
tgatcatggctcaagctccc

SEQ ID NO: 55549 - DNA, 20 bp, Artificial
  CRISPR gRNA sequence
tggctcaagctcccaggctc

SEQ ID NO: 55550 - DNA, 20 bp, Artificial
  CRISPR gRNA sequence
tcaagcgatcctcccaacgt

SEQ ID NO: 55551 - DNA, 20 bp, Artificial
  CRISPR gRNA sequence
cctcccaacgtcagcatctt

SEQ ID NO: 55552 - DNA, 20 bp, Artificial
  CRISPR gRNA sequence
cccaacgtcagcatcttgag

SEQ ID NO: 55553 - DNA, 20 bp, Artificial
  CRISPR gRNA sequence
acgtcagcatcttgagtagc

SEQ ID NO: 55554 - DNA, 20 bp, Artificial
  CRISPR gRNA sequence
cgtcagcatcttgagtagct

SEQ ID NO: 55555 - DNA, 20 bp, Artificial
  CRISPR gRNA sequence
atcttgagtagctgggacta

SEQ ID NO: 55556 - DNA, 20 bp, Artificial
  CRISPR gRNA sequence
tcttgagtagctgggactac

SEQ ID NO: 55557 - DNA, 20 bp, Artificial
  CRISPR gRNA sequence
ccacgcctgccttttttttt

SEQ ID NO: 55558 - DNA, 20 bp, Artificial
  CRISPR gRNA sequence
acgcctgcctttttttttta

SEQ ID NO: 55559 - DNA, 20 bp, Artificial
  CRISPR gRNA sequence
ctgccttttttttttagaga

SEQ ID NO: 55560 - DNA, 20 bp, Artificial
  CRISPR gRNA sequence
tgccttttttttttagagat

SEQ ID NO: 55561 - DNA, 20 bp, Artificial
  CRISPR gRNA sequence
gccttttttttttagagatg

SEQ ID NO: 55562 - DNA, 20 bp, Artificial
  CRISPR gRNA sequence
tggggtcttgctatgttgcc

SEQ ID NO: 55563 - DNA, 20 bp, Artificial
  CRISPR gRNA sequence
ggggtcttgctatgttgccc

SEQ ID NO: 55564 - DNA, 20 bp, Artificial
  CRISPR gRNA sequence
tcttgctatgttgcccaggc

SEQ ID NO: 55565 - DNA, 20 bp, Artificial
  CRISPR gRNA sequence
ccaggctggtcttgaacacc

SEQ ID NO: 55566 - DNA, 20 bp, Artificial
  CRISPR gRNA sequence
ggtcttgaacacctggaatc

SEQ ID NO: 55567 - DNA, 20 bp, Artificial
  CRISPR gRNA sequence
tcttgaacacctggaatcaa

SEQ ID NO: 55568 - DNA, 20 bp, Artificial
  CRISPR gRNA sequence
aatcaagagattctcgtgct

SEQ ID NO: 55569 - DNA, 20 bp, Artificial
  CRISPR gRNA sequence
ttctcgtgcttggcgttcca

SEQ ID NO: 55570 - DNA, 20 bp, Artificial
  CRISPR gRNA sequence
tgcttggcgttccaaagtgc

SEQ ID NO: 55571 - DNA, 20 bp, Artificial
  CRISPR gRNA sequence
gcttggcgttccaaagtgct

SEQ ID NO: 55572 - DNA, 20 bp, Artificial
  CRISPR gRNA sequence
gttccaaagtgctaggatta

SEQ ID NO: 55573 - DNA, 20 bp, Artificial
  CRISPR gRNA sequence
ttccaaagtgctaggattac

SEQ ID NO: 55574 - DNA, 20 bp, Artificial
  CRISPR gRNA sequence
agtgctaggattacaggcat

SEQ ID NO: 55575 - DNA, 20 bp, Artificial
  CRISPR gRNA sequence
caggcatgagccaccgcacc

SEQ ID NO: 55576 - DNA, 20 bp, Artificial
  CRISPR gRNA sequence
gccaccgcacccagcaacat

SEQ ID NO: 55577 - DNA, 20 bp, Artificial
  CRISPR gRNA sequence
caacattggtcctacactac

SEQ ID NO: 55578 - DNA, 20 bp, Artificial
  CRISPR gRNA sequence
aacattggtcctacactacc

SEQ ID NO: 55579 - DNA, 20 bp, Artificial
  CRISPR gRNA sequence
acactaccaggtcattatac

SEQ ID NO: 55580 - DNA, 20 bp, Artificial
  CRISPR gRNA sequence
taccaggtcattatacaagc

SEQ ID NO: 55581 - DNA, 20 bp, Artificial
  CRISPR gRNA sequence
accaggtcattatacaagca

SEQ ID NO: 55582 - DNA, 20 bp, Artificial
  CRISPR gRNA sequence
cattatacaagcaaggaatc

SEQ ID NO: 55583 - DNA, 20 bp, Artificial
  CRISPR gRNA sequence
acaagcaaggaatcgagatc

SEQ ID NO: 55584 - DNA, 20 bp, Artificial
  CRISPR gRNA sequence
aagcaaggaatcgagatcca

SEQ ID NO: 55585 - DNA, 20 bp, Artificial
  CRISPR gRNA sequence
caaggaatcgagatccagag

SEQ ID NO: 55586 - DNA, 20 bp, Artificial
  CRISPR gRNA sequence
aaggaatcgagatccagaga

SEQ ID NO: 55587 - DNA, 20 bp, Artificial
  CRISPR gRNA sequence
aggaatcgagatccagagaa

SEQ ID NO: 55588 - DNA, 20 bp, Artificial
  CRISPR gRNA sequence
atcgagatccagagaaggga

SEQ ID NO: 55589 - DNA, 20 bp, Artificial
  CRISPR gRNA sequence
cgagatccagagaagggaaa

SEQ ID NO: 55590 - DNA, 20 bp, Artificial
  CRISPR gRNA sequence
gagaagggaaagagattgct

SEQ ID NO: 55591 - DNA, 20 bp, Artificial
  CRISPR gRNA sequence
agaagggaaagagattgctc

SEQ ID NO: 55592 - DNA, 20 bp, Artificial
  CRISPR gRNA sequence
gaagggaaagagattgctca

SEQ ID NO: 55593 - DNA, 20 bp, Artificial
  CRISPR gRNA sequence
aagggaaagagattgctcag

SEQ ID NO: 55594 - DNA, 20 bp, Artificial
  CRISPR gRNA sequence
gcatacatacatctgtctct

SEQ ID NO: 55595 - DNA, 20 bp, Artificial
  CRISPR gRNA sequence
atacatctgtctctgagtct

SEQ ID NO: 55596 - DNA, 20 bp, Artificial
  CRISPR gRNA sequence
atctgtctctgagtcttagc

SEQ ID NO: 55597 - DNA, 20 bp, Artificial
  CRISPR gRNA sequence
tctgtctctgagtcttagcc

SEQ ID NO: 55598 - DNA, 20 bp, Artificial
  CRISPR gRNA sequence
tgtctctgagtcttagccag

SEQ ID NO: 55599 - DNA, 20 bp, Artificial
  CRISPR gRNA sequence
tctctgagtcttagccagga

SEQ ID NO: 55600 - DNA, 20 bp, Artificial
  CRISPR gRNA sequence
gagtcttagccaggagagca

SEQ ID NO: 55601 - DNA, 20 bp, Artificial
  CRISPR gRNA sequence
ttagccaggagagcaaagtg

SEQ ID NO: 55602 - DNA, 20 bp, Artificial
  CRISPR gRNA sequence
gccaggagagcaaagtgtgg

SEQ ID NO: 55603 - DNA, 20 bp, Artificial
  CRISPR gRNA sequence
caggagagcaaagtgtggta

SEQ ID NO: 55604 - DNA, 20 bp, Artificial
  CRISPR gRNA sequence
gagcaaagtgtggtagagca

SEQ ID NO: 55605 - DNA, 20 bp, Artificial
  CRISPR gRNA sequence
aaagtgtggtagagcacagt

SEQ ID NO: 55606 - DNA, 20 bp, Artificial
  CRISPR gRNA sequence
aagtgtggtagagcacagtt

SEQ ID NO: 55607 - DNA, 20 bp, Artificial
  CRISPR gRNA sequence
gtggtagagcacagttggga

SEQ ID NO: 55608 - DNA, 20 bp, Artificial
  CRISPR gRNA sequence
gcacagttgggatggtcttt

SEQ ID NO: 55609 - DNA, 20 bp, Artificial
  CRISPR gRNA sequence
cacagttgggatggtctttt

SEQ ID NO: 55610 - DNA, 20 bp, Artificial
  CRISPR gRNA sequence
acagttgggatggtctttta

SEQ ID NO: 55611 - DNA, 20 bp, Artificial
  CRISPR gRNA sequence
tgggatggtcttttagggaa

SEQ ID NO: 55612 - DNA, 20 bp, Artificial
  CRISPR gRNA sequence
gatggtcttttagggaaaag

SEQ ID NO: 55613 - DNA, 20 bp, Artificial
  CRISPR gRNA sequence
gaaaagcagctcccttttct

SEQ ID NO: 55614 - DNA, 20 bp, Artificial
  CRISPR gRNA sequence
tcccttttctcagcccatcc

SEQ ID NO: 55615 - DNA, 20 bp, Artificial
  CRISPR gRNA sequence
tttctcagcccatccaagac

SEQ ID NO: 55616 - DNA, 20 bp, Artificial
  CRISPR gRNA sequence
cagcccatccaagactggcc

SEQ ID NO: 55617 - DNA, 20 bp, Artificial
  CRISPR gRNA sequence
ccatccaagactggccaagc

SEQ ID NO: 55618 - DNA, 20 bp, Artificial
  CRISPR gRNA sequence
gccaagctggaatccatgca

SEQ ID NO: 55619 - DNA, 20 bp, Artificial
  CRISPR gRNA sequence
agctggaatccatgcacagc

SEQ ID NO: 55620 - DNA, 20 bp, Artificial
  CRISPR gRNA sequence
gaatccatgcacagctggaa

SEQ ID NO: 55621 - DNA, 20 bp, Artificial
  CRISPR gRNA sequence
ccatgcacagctggaatagc

SEQ ID NO: 55622 - DNA, 20 bp, Artificial
  CRISPR gRNA sequence
gactgcccactgcatgccaa

SEQ ID NO: 55623 - DNA, 20 bp, Artificial
  CRISPR gRNA sequence
aacagtgctctaaactcctt

SEQ ID NO: 55624 - DNA, 20 bp, Artificial
  CRISPR gRNA sequence
tgctctaaactccttaagtg

SEQ ID NO: 55625 - DNA, 20 bp, Artificial
  CRISPR gRNA sequence
gtagtaactcatttaattct

SEQ ID NO: 55626 - DNA, 20 bp, Artificial
  CRISPR gRNA sequence
ttaattctcagaacaaccct

SEQ ID NO: 55627 - DNA, 20 bp, Artificial
  CRISPR gRNA sequence
ctcagaacaaccctaagatg

SEQ ID NO: 55628 - DNA, 20 bp, Artificial
  CRISPR gRNA sequence
tcagaacaaccctaagatgt

SEQ ID NO: 55629 - DNA, 20 bp, Artificial
  CRISPR gRNA sequence
ttgccctccctgtctttttt

SEQ ID NO: 55630 - DNA, 20 bp, Artificial
  CRISPR gRNA sequence
ccctgtcttttttcagttgt

SEQ ID NO: 55631 - DNA, 20 bp, Artificial
  CRISPR gRNA sequence
cctgtcttttttcagttgta

SEQ ID NO: 55632 - DNA, 20 bp, Artificial
  CRISPR gRNA sequence
ctgtcttttttcagttgtaa

SEQ ID NO: 55633 - DNA, 20 bp, Artificial
  CRISPR gRNA sequence
ttcagttgtaagggcttttc

SEQ ID NO: 55634 - DNA, 20 bp, Artificial
  CRISPR gRNA sequence
cagttgtaagggcttttcca

SEQ ID NO: 55635 - DNA, 20 bp, Artificial
  CRISPR gRNA sequence
tttccagagttttcaccatc

SEQ ID NO: 55636 - DNA, 20 bp, Artificial
  CRISPR gRNA sequence
ttttcaccatctagtaatgc

SEQ ID NO: 55637 - DNA, 20 bp, Artificial
  CRISPR gRNA sequence
atctagtaatgccagtctaa

SEQ ID NO: 55638 - DNA, 20 bp, Artificial
  CRISPR gRNA sequence
agtatctttatgttctcccc

SEQ ID NO: 55639 - DNA, 20 bp, Artificial
  CRISPR gRNA sequence
gtatctttatgttctcccca

SEQ ID NO: 55640 - DNA, 20 bp, Artificial
  CRISPR gRNA sequence
tatctttatgttctccccaa

SEQ ID NO: 55641 - DNA, 20 bp, Artificial
  CRISPR gRNA sequence
ccaagggtttgccttcctct

SEQ ID NO: 55642 - DNA, 20 bp, Artificial
  CRISPR gRNA sequence
ttgccttcctctgagtcttc

SEQ ID NO: 55643 - DNA, 20 bp, Artificial
  CRISPR gRNA sequence
tgccttcctctgagtcttct

SEQ ID NO: 55644 - DNA, 20 bp, Artificial
  CRISPR gRNA sequence
gccttcctctgagtcttctg

SEQ ID NO: 55645 - DNA, 20 bp, Artificial
  CRISPR gRNA sequence
tctggggatgcttccttcca

SEQ ID NO: 55646 - DNA, 20 bp, Artificial
  CRISPR gRNA sequence
ctggggatgcttccttccac

SEQ ID NO: 55647 - DNA, 20 bp, Artificial
  CRISPR gRNA sequence
tggggatgcttccttccaca

SEQ ID NO: 55648 - DNA, 20 bp, Artificial
  CRISPR gRNA sequence
atgcttccttccacagggac

SEQ ID NO: 55649 - DNA, 20 bp, Artificial
  CRISPR gRNA sequence
ccttccacagggaccagatg

SEQ ID NO: 55650 - DNA, 20 bp, Artificial
  CRISPR gRNA sequence
cacagggaccagatgtggtc

SEQ ID NO: 55651 - DNA, 20 bp, Artificial
  CRISPR gRNA sequence
cagatgtggtctggacacgc

SEQ ID NO: 55652 - DNA, 20 bp, Artificial
  CRISPR gRNA sequence
gatgtggtctggacacgcta

SEQ ID NO: 55653 - DNA, 20 bp, Artificial
  CRISPR gRNA sequence
atgtggtctggacacgctag

SEQ ID NO: 55654 - DNA, 20 bp, Artificial
  CRISPR gRNA sequence
tggtctggacacgctagagg

SEQ ID NO: 55655 - DNA, 20 bp, Artificial
  CRISPR gRNA sequence
ttaaaatcctttgccaacct

SEQ ID NO: 55656 - DNA, 20 bp, Artificial
  CRISPR gRNA sequence
aaatcctttgccaacctaag

SEQ ID NO: 55657 - DNA, 20 bp, Artificial
  CRISPR gRNA sequence
ctaagcagtaattcattcct

SEQ ID NO: 55658 - DNA, 20 bp, Artificial
  CRISPR gRNA sequence
cagtaattcattcctcagtg

SEQ ID NO: 55659 - DNA, 20 bp, Artificial
  CRISPR gRNA sequence
taattcattcctcagtgcag

SEQ ID NO: 55660 - DNA, 20 bp, Artificial
  CRISPR gRNA sequence
ttcattcctcagtgcagcag

SEQ ID NO: 55661 - DNA, 20 bp, Artificial
  CRISPR gRNA sequence
attcctcagtgcagcagtag

SEQ ID NO: 55662 - DNA, 20 bp, Artificial
  CRISPR gRNA sequence
ttcctcagtgcagcagtagc

SEQ ID NO: 55663 - DNA, 20 bp, Artificial
  CRISPR gRNA sequence
ctcagtgcagcagtagcagg

SEQ ID NO: 55664 - DNA, 20 bp, Artificial
  CRISPR gRNA sequence
caggaagaattcccataccc

SEQ ID NO: 55665 - DNA, 20 bp, Artificial
  CRISPR gRNA sequence
tcccataccccagctcttcc

SEQ ID NO: 55666 - DNA, 20 bp, Artificial
  CRISPR gRNA sequence
cccagctcttcctagtctct

SEQ ID NO: 55667 - DNA, 20 bp, Artificial
  CRISPR gRNA sequence
acctttcccctcaactgcct

SEQ ID NO: 55668 - DNA, 20 bp, Artificial
  CRISPR gRNA sequence
cccctcaactgcctgagccc

SEQ ID NO: 55669 - DNA, 20 bp, Artificial
  CRISPR gRNA sequence
cctgagcccaagttgcttct

SEQ ID NO: 55670 - DNA, 20 bp, Artificial
  CRISPR gRNA sequence
ctgagcccaagttgcttcta

SEQ ID NO: 55671 - DNA, 20 bp, Artificial
  CRISPR gRNA sequence
gcccaagttgcttctaagga

SEQ ID NO: 55672 - DNA, 20 bp, Artificial
  CRISPR gRNA sequence
gttgcttctaaggatggccc

SEQ ID NO: 55673 - DNA, 20 bp, Artificial
  CRISPR gRNA sequence
ttgcttctaaggatggcccc

SEQ ID NO: 55674 - DNA, 20 bp, Artificial
  CRISPR gRNA sequence
gccccaggcccaccgcctct

SEQ ID NO: 55675 - DNA, 20 bp, Artificial
  CRISPR gRNA sequence
ctcttggcttcttacctttg

SEQ ID NO: 55676 - DNA, 20 bp, Artificial
  CRISPR gRNA sequence
ttcttacctttgtagctctg

SEQ ID NO: 55677 - DNA, 20 bp, Artificial
  CRISPR gRNA sequence
tagctctgcagttgtctctg

SEQ ID NO: 55678 - DNA, 20 bp, Artificial
  CRISPR gRNA sequence
agctctgcagttgtctctgt

SEQ ID NO: 55679 - DNA, 20 bp, Artificial
  CRISPR gRNA sequence
tctgcagttgtctctgtggg

SEQ ID NO: 55680 - DNA, 20 bp, Artificial
  CRISPR gRNA sequence
ctgcagttgtctctgtgggc

SEQ ID NO: 55681 - DNA, 20 bp, Artificial
  CRISPR gRNA sequence
tgcagttgtctctgtgggcg

SEQ ID NO: 55682 - DNA, 20 bp, Artificial
  CRISPR gRNA sequence
gttgtctctgtgggcgggga

SEQ ID NO: 55683 - DNA, 20 bp, Artificial
  CRISPR gRNA sequence
gtctctgtgggcggggaaag

SEQ ID NO: 55684 - DNA, 20 bp, Artificial
  CRISPR gRNA sequence
tctctgtgggcggggaaaga

SEQ ID NO: 55685 - DNA, 20 bp, Artificial
  CRISPR gRNA sequence
ctgtgggcggggaaagaagg

SEQ ID NO: 55686 - DNA, 20 bp, Artificial
  CRISPR gRNA sequence
ggcggggaaagaaggaagat

SEQ ID NO: 55687 - DNA, 20 bp, Artificial
  CRISPR gRNA sequence
gcggggaaagaaggaagatg

SEQ ID NO: 55688 - DNA, 20 bp, Artificial
  CRISPR gRNA sequence
agatgaggtccgcctccctg

SEQ ID NO: 55689 - DNA, 20 bp, Artificial
  CRISPR gRNA sequence
gatgaggtccgcctccctgc

SEQ ID NO: 55690 - DNA, 20 bp, Artificial
  CRISPR gRNA sequence
ggtccgcctccctgcaggat

SEQ ID NO: 55691 - DNA, 20 bp, Artificial
  CRISPR gRNA sequence
tccctgcaggatcagatacc

SEQ ID NO: 55692 - DNA, 20 bp, Artificial
  CRISPR gRNA sequence
agataccaagccatgaaacc

SEQ ID NO: 55693 - DNA, 20 bp, Artificial
  CRISPR gRNA sequence
ataccaagccatgaaaccca

SEQ ID NO: 55694 - DNA, 20 bp, Artificial
  CRISPR gRNA sequence
aagccatgaaacccagagac

SEQ ID NO: 55695 - DNA, 20 bp, Artificial
  CRISPR gRNA sequence
gaaacccagagactggaaac

SEQ ID NO: 55696 - DNA, 20 bp, Artificial
  CRISPR gRNA sequence
aaccagcacatcacccacca

SEQ ID NO: 55697 - DNA, 20 bp, Artificial
  CRISPR gRNA sequence
accagcacatcacccaccac

SEQ ID NO: 55698 - DNA, 20 bp, Artificial
  CRISPR gRNA sequence
gccccaaatgttcaaacatc

SEQ ID NO: 55699 - DNA, 20 bp, Artificial
  CRISPR gRNA sequence
aatgttcaaacatccagata

SEQ ID NO: 55700 - DNA, 20 bp, Artificial
  CRISPR gRNA sequence
aaagctgattttgcaattga

SEQ ID NO: 55701 - DNA, 20 bp, Artificial
  CRISPR gRNA sequence
aagctgattttgcaattgac

SEQ ID NO: 55702 - DNA, 20 bp, Artificial
  CRISPR gRNA sequence
agctgattttgcaattgaca

SEQ ID NO: 55703 - DNA, 20 bp, Artificial
  CRISPR gRNA sequence
caattgacagggaaacataa

SEQ ID NO: 55704 - DNA, 20 bp, Artificial
  CRISPR gRNA sequence
acagggaaacataacggaac

SEQ ID NO: 55705 - DNA, 20 bp, Artificial
  CRISPR gRNA sequence
aaacataacggaactagcaa

SEQ ID NO: 55706 - DNA, 20 bp, Artificial
  CRISPR gRNA sequence
ctagcaaaagtgttttaaat

SEQ ID NO: 55707 - DNA, 20 bp, Artificial
  CRISPR gRNA sequence
tagcaaaagtgttttaaatc

SEQ ID NO: 55708 - DNA, 20 bp, Artificial
  CRISPR gRNA sequence
ctttgcttgatgaatcctgc

SEQ ID NO: 55709 - DNA, 20 bp, Artificial
  CRISPR gRNA sequence
ttgcttgatgaatcctgcaa

SEQ ID NO: 55710 - DNA, 20 bp, Artificial
  CRISPR gRNA sequence
tcctgcaagagtgttttaaa

SEQ ID NO: 55711 - DNA, 20 bp, Artificial
  CRISPR gRNA sequence
gcaagagtgttttaaaaagt

SEQ ID NO: 55712 - DNA, 20 bp, Artificial
  CRISPR gRNA sequence
gtcagaaaaacaattttcac

SEQ ID NO: 55713 - DNA, 20 bp, Artificial
  CRISPR gRNA sequence
caagaaatataataaaaatt

SEQ ID NO: 55714 - DNA, 20 bp, Artificial
  CRISPR gRNA sequence
ataaaaattaagaatgttgt

SEQ ID NO: 55715 - DNA, 20 bp, Artificial
  CRISPR gRNA sequence
tttcctttctttttaaattt

SEQ ID NO: 55716 - DNA, 20 bp, Artificial
  CRISPR gRNA sequence
ctttctttttaaatttgaga

SEQ ID NO: 55717 - DNA, 20 bp, Artificial
  CRISPR gRNA sequence
ttctttttaaatttgagatg

SEQ ID NO: 55718 - DNA, 20 bp, Artificial
  CRISPR gRNA sequence
ggagatctcactctgctact

SEQ ID NO: 55719 - DNA, 20 bp, Artificial
  CRISPR gRNA sequence
gagatctcactctgctactc

SEQ ID NO: 55720 - DNA, 20 bp, Artificial
  CRISPR gRNA sequence
tctcactctgctactcaggc

SEQ ID NO: 55721 - DNA, 20 bp, Artificial
  CRISPR gRNA sequence
tcactctgctactcaggctg

SEQ ID NO: 55722 - DNA, 20 bp, Artificial
  CRISPR gRNA sequence
ctgctactcaggctggagtg

SEQ ID NO: 55723 - DNA, 20 bp, Artificial
  CRISPR gRNA sequence
ctactcaggctggagtgcag

SEQ ID NO: 55724 - DNA, 20 bp, Artificial
  CRISPR gRNA sequence
ggtgtgttcacacctcactg

SEQ ID NO: 55725 - DNA, 20 bp, Artificial
  CRISPR gRNA sequence
cactgcagcctcaacctcca

SEQ ID NO: 55726 - DNA, 20 bp, Artificial
  CRISPR gRNA sequence
agcctcaacctccacggctc

SEQ ID NO: 55727 - DNA, 20 bp, Artificial
  CRISPR gRNA sequence
ctcaagcaatcttcccacct

SEQ ID NO: 55728 - DNA, 20 bp, Artificial
  CRISPR gRNA sequence
tcccacctcagcctcccaaa

SEQ ID NO: 55729 - DNA, 20 bp, Artificial
  CRISPR gRNA sequence
acctcagcctcccaaatagc

SEQ ID NO: 55730 - DNA, 20 bp, Artificial
  CRISPR gRNA sequence
ctcccaaatagctggaacca

SEQ ID NO: 55731 - DNA, 20 bp, Artificial
  CRISPR gRNA sequence
tcccaaatagctggaaccac

SEQ ID NO: 55732 - DNA, 20 bp, Artificial
  CRISPR gRNA sequence
ttaattttgttcattttttg

SEQ ID NO: 55733 - DNA, 20 bp, Artificial
  CRISPR gRNA sequence
aattttgttcattttttgta

SEQ ID NO: 55734 - DNA, 20 bp, Artificial
  CRISPR gRNA sequence
tttgtagagactatgttgcc

SEQ ID NO: 55735 - DNA, 20 bp, Artificial
  CRISPR gRNA sequence
ttgtagagactatgttgccc

SEQ ID NO: 55736 - DNA, 20 bp, Artificial
  CRISPR gRNA sequence
agagactatgttgcccaggt

SEQ ID NO: 55737 - DNA, 20 bp, Artificial
  CRISPR gRNA sequence
caggttggtctcgaactcct

SEQ ID NO: 55738 - DNA, 20 bp, Artificial
  CRISPR gRNA sequence
ggtctcgaactcctgagctc

SEQ ID NO: 55739 - DNA, 20 bp, Artificial
  CRISPR gRNA sequence
ctcaagtaatcctcttgcct

SEQ ID NO: 55740 - DNA, 20 bp, Artificial
  CRISPR gRNA sequence
cctcttgccttggccttcca

SEQ ID NO: 55741 - DNA, 20 bp, Artificial
  CRISPR gRNA sequence
gccttggccttccaaagtgt

SEQ ID NO: 55742 - DNA, 20 bp, Artificial
  CRISPR gRNA sequence
cttccaaagtgttggaatta

SEQ ID NO: 55743 - DNA, 20 bp, Artificial
  CRISPR gRNA sequence
ttccaaagtgttggaattac

SEQ ID NO: 55744 - DNA, 20 bp, Artificial
  CRISPR gRNA sequence
agtgttggaattacaggcat

SEQ ID NO: 55745 - DNA, 20 bp, Artificial
  CRISPR gRNA sequence
aattacaggcatgagccact

SEQ ID NO: 55746 - DNA, 20 bp, Artificial
  CRISPR gRNA sequence
caggcatgagccactgagcc

SEQ ID NO: 55747 - DNA, 20 bp, Artificial
  CRISPR gRNA sequence
cccggctgaattttttttaa

SEQ ID NO: 55748 - DNA, 20 bp, Artificial
  CRISPR gRNA sequence
tttttaatagaaatttttat

SEQ ID NO: 55749 - DNA, 20 bp, Artificial
  CRISPR gRNA sequence
taatagaaatttttatgagt

SEQ ID NO: 55750 - DNA, 20 bp, Artificial
  CRISPR gRNA sequence
acctaccccatgatcaaaac

SEQ ID NO: 55751 - DNA, 20 bp, Artificial
  CRISPR gRNA sequence
atgatcaaaactggctatat

SEQ ID NO: 55752 - DNA, 20 bp, Artificial
  CRISPR gRNA sequence
caaaactggctatattggtt

SEQ ID NO: 55753 - DNA, 20 bp, Artificial
  CRISPR gRNA sequence
gctatattggttcagcacca

SEQ ID NO: 55754 - DNA, 20 bp, Artificial
  CRISPR gRNA sequence
tatattggttcagcaccatg

SEQ ID NO: 55755 - DNA, 20 bp, Artificial
  CRISPR gRNA sequence
atattggttcagcaccatgg

SEQ ID NO: 55756 - DNA, 20 bp, Artificial
  CRISPR gRNA sequence
tattggttcagcaccatgga

SEQ ID NO: 55757 - DNA, 20 bp, Artificial
  CRISPR gRNA sequence
gcaccatggagggcaacaca

SEQ ID NO: 55758 - DNA, 20 bp, Artificial
  CRISPR gRNA sequence
cacacagctaattattcctt

SEQ ID NO: 55759 - DNA, 20 bp, Artificial
  CRISPR gRNA sequence
ttggctatgcctgtgcttcg

SEQ ID NO: 55760 - DNA, 20 bp, Artificial
  CRISPR gRNA sequence
cacacacctatccatctttt

SEQ ID NO: 55761 - DNA, 20 bp, Artificial
  CRISPR gRNA sequence
cacctatccatcttttcagc

SEQ ID NO: 55762 - DNA, 20 bp, Artificial
  CRISPR gRNA sequence
catccacccatccatctttt

SEQ ID NO: 55763 - DNA, 20 bp, Artificial
  CRISPR gRNA sequence
catccacccatccatctttt

SEQ ID NO: 55764 - DNA, 20 bp, Artificial
  CRISPR gRNA sequence
catccacccatccatctttt

SEQ ID NO: 55765 - DNA, 20 bp, Artificial
  CRISPR gRNA sequence
ccattaattcaatatatacc

SEQ ID NO: 55766 - DNA, 20 bp, Artificial
  CRISPR gRNA sequence
attcaatatataccaagtac

SEQ ID NO: 55767 - DNA, 20 bp, Artificial
  CRISPR gRNA sequence
ttcaatatataccaagtacc

SEQ ID NO: 55768 - DNA, 20 bp, Artificial
  CRISPR gRNA sequence
tataccaagtaccaggtgcc

SEQ ID NO: 55769 - DNA, 20 bp, Artificial
  CRISPR gRNA sequence
aagtaccaggtgccaagcct

SEQ ID NO: 55770 - DNA, 20 bp, Artificial
  CRISPR gRNA sequence
accaggtgccaagcctgagc

SEQ ID NO: 55771 - DNA, 20 bp, Artificial
  CRISPR gRNA sequence
ccaggtgccaagcctgagct

SEQ ID NO: 55772 - DNA, 20 bp, Artificial
  CRISPR gRNA sequence
caagcctgagctaggttctg

SEQ ID NO: 55773 - DNA, 20 bp, Artificial
  CRISPR gRNA sequence
aagcctgagctaggttctga

SEQ ID NO: 55774 - DNA, 20 bp, Artificial
  CRISPR gRNA sequence
tgagctaggttctgaaggta

SEQ ID NO: 55775 - DNA, 20 bp, Artificial
  CRISPR gRNA sequence
ggttctgaaggtaaagctgt

SEQ ID NO: 55776 - DNA, 20 bp, Artificial
  CRISPR gRNA sequence
aggtaaagctgtgagtaaaa

SEQ ID NO: 55777 - DNA, 20 bp, Artificial
  CRISPR gRNA sequence
taaagctgtgagtaaaacag

SEQ ID NO: 55778 - DNA, 20 bp, Artificial
  CRISPR gRNA sequence
aaagctgtgagtaaaacagt

SEQ ID NO: 55779 - DNA, 20 bp, Artificial
  CRISPR gRNA sequence
aagctgtgagtaaaacagta

SEQ ID NO: 55780 - DNA, 20 bp, Artificial
  CRISPR gRNA sequence
gtaaaacagtagggtatgca

SEQ ID NO: 55781 - DNA, 20 bp, Artificial
  CRISPR gRNA sequence
gtatgcacagatttatcctg

SEQ ID NO: 55782 - DNA, 20 bp, Artificial
  CRISPR gRNA sequence
cacagatttatcctgcagac

SEQ ID NO: 55783 - DNA, 20 bp, Artificial
  CRISPR gRNA sequence
acagatttatcctgcagacg

SEQ ID NO: 55784 - DNA, 20 bp, Artificial
  CRISPR gRNA sequence
cagatttatcctgcagacga

SEQ ID NO: 55785 - DNA, 20 bp, Artificial
  CRISPR gRNA sequence
agatttatcctgcagacgag

SEQ ID NO: 55786 - DNA, 20 bp, Artificial
  CRISPR gRNA sequence
ctttcccctcctcttttctc

SEQ ID NO: 55787 - DNA, 20 bp, Artificial
  CRISPR gRNA sequence
tttcccctcctcttttctca

SEQ ID NO: 55788 - DNA, 20 bp, Artificial
  CRISPR gRNA sequence
cctcttttctcaaggcccat

SEQ ID NO: 55789 - DNA, 20 bp, Artificial
  CRISPR gRNA sequence
ctcttttctcaaggcccata

SEQ ID NO: 55790 - DNA, 20 bp, Artificial
  CRISPR gRNA sequence
ttctcaaggcccataaggcc

SEQ ID NO: 55791 - DNA, 20 bp, Artificial
  CRISPR gRNA sequence
tccctttccttctgctcacc

SEQ ID NO: 55792 - DNA, 20 bp, Artificial
  CRISPR gRNA sequence
ccttctgctcacctggcctg

SEQ ID NO: 55793 - DNA, 20 bp, Artificial
  CRISPR gRNA sequence
cctggcctgaagcatcctga

SEQ ID NO: 55794 - DNA, 20 bp, Artificial
  CRISPR gRNA sequence
ggcctgaagcatcctgacgg

SEQ ID NO: 55795 - DNA, 20 bp, Artificial
  CRISPR gRNA sequence
gcctgaagcatcctgacggt

SEQ ID NO: 55796 - DNA, 20 bp, Artificial
  CRISPR gRNA sequence
acgtgactgccacccttgcc

SEQ ID NO: 55797 - DNA, 20 bp, Artificial
  CRISPR gRNA sequence
tgactgccacccttgccaag

SEQ ID NO: 55798 - DNA, 20 bp, Artificial
  CRISPR gRNA sequence
actgccacccttgccaagca

SEQ ID NO: 55799 - DNA, 20 bp, Artificial
  CRISPR gRNA sequence
gccacccttgccaagcagag

SEQ ID NO: 55800 - DNA, 20 bp, Artificial
  CRISPR gRNA sequence
ccacccttgccaagcagagt

SEQ ID NO: 55801 - DNA, 20 bp, Artificial
  CRISPR gRNA sequence
cacccttgccaagcagagta

SEQ ID NO: 55802 - DNA, 20 bp, Artificial
  CRISPR gRNA sequence
agcagagtagggttgacacg

SEQ ID NO: 55803 - DNA, 20 bp, Artificial
  CRISPR gRNA sequence
acgcagatgctgttgctgct

SEQ ID NO: 55804 - DNA, 20 bp, Artificial
  CRISPR gRNA sequence
cgcagatgctgttgctgctc

SEQ ID NO: 55805 - DNA, 20 bp, Artificial
  CRISPR gRNA sequence
gctgttgctgctcaggctgc

SEQ ID NO: 55806 - DNA, 20 bp, Artificial
  CRISPR gRNA sequence
ctgctcaggctgcaagattg

SEQ ID NO: 55807 - DNA, 20 bp, Artificial
  CRISPR gRNA sequence
caggctgcaagattgtggca

SEQ ID NO: 55808 - DNA, 20 bp, Artificial
  CRISPR gRNA sequence
aggctgcaagattgtggcaa

SEQ ID NO: 55809 - DNA, 20 bp, Artificial
  CRISPR gRNA sequence
caagattgtggcaaaggtgt

SEQ ID NO: 55810 - DNA, 20 bp, Artificial
  CRISPR gRNA sequence
aagattgtggcaaaggtgtc

SEQ ID NO: 55811 - DNA, 20 bp, Artificial
  CRISPR gRNA sequence
gattgtggcaaaggtgtcag

SEQ ID NO: 55812 - DNA, 20 bp, Artificial
  CRISPR gRNA sequence
tgtggcaaaggtgtcaggag

SEQ ID NO: 55813 - DNA, 20 bp, Artificial
  CRISPR gRNA sequence
aggagtggaatcccctaccc

SEQ ID NO: 55814 - DNA, 20 bp, Artificial
  CRISPR gRNA sequence
ggagtggaatcccctacccc

SEQ ID NO: 55815 - DNA, 20 bp, Artificial
  CRISPR gRNA sequence
gagtggaatcccctacccca

SEQ ID NO: 55816 - DNA, 20 bp, Artificial
  CRISPR gRNA sequence
agtggaatcccctaccccag

SEQ ID NO: 55817 - DNA, 20 bp, Artificial
  CRISPR gRNA sequence
atcccctaccccaggggccc

SEQ ID NO: 55818 - DNA, 20 bp, Artificial
  CRISPR gRNA sequence
ccagaccttccttgccttgc

SEQ ID NO: 55819 - DNA, 20 bp, Artificial
  CRISPR gRNA sequence
cagaccttccttgccttgca

SEQ ID NO: 55820 - DNA, 20 bp, Artificial
  CRISPR gRNA sequence
agaccttccttgccttgcaa

SEQ ID NO: 55821 - DNA, 20 bp, Artificial
  CRISPR gRNA sequence
accttccttgccttgcaagg

SEQ ID NO: 55822 - DNA, 20 bp, Artificial
  CRISPR gRNA sequence
ttccttgccttgcaagggag

SEQ ID NO: 55823 - DNA, 20 bp, Artificial
  CRISPR gRNA sequence
tccttgccttgcaagggagt

SEQ ID NO: 55824 - DNA, 20 bp, Artificial
  CRISPR gRNA sequence
ccttgccttgcaagggagtg

SEQ ID NO: 55825 - DNA, 20 bp, Artificial
  CRISPR gRNA sequence
tgcaagggagtggggtgaat

SEQ ID NO: 55826 - DNA, 20 bp, Artificial
  CRISPR gRNA sequence
gcaagggagtggggtgaatc

SEQ ID NO: 55827 - DNA, 20 bp, Artificial
  CRISPR gRNA sequence
ggagtggggtgaatcaggta

SEQ ID NO: 55828 - DNA, 20 bp, Artificial
  CRISPR gRNA sequence
agtggggtgaatcaggtata

SEQ ID NO: 55829 - DNA, 20 bp, Artificial
  CRISPR gRNA sequence
tggggtgaatcaggtataga

SEQ ID NO: 55830 - DNA, 20 bp, Artificial
  CRISPR gRNA sequence
ggggtgaatcaggtatagag

SEQ ID NO: 55831 - DNA, 20 bp, Artificial
  CRISPR gRNA sequence
gggtgaatcaggtatagaga

SEQ ID NO: 55832 - DNA, 20 bp, Artificial
  CRISPR gRNA sequence
aatcaggtatagagagggac

SEQ ID NO: 55833 - DNA, 20 bp, Artificial
  CRISPR gRNA sequence
atcaggtatagagagggact

SEQ ID NO: 55834 - DNA, 20 bp, Artificial
  CRISPR gRNA sequence
tatagagagggactgggctg

SEQ ID NO: 55835 - DNA, 20 bp, Artificial
  CRISPR gRNA sequence
tagagagggactgggctgca

SEQ ID NO: 55836 - DNA, 20 bp, Artificial
  CRISPR gRNA sequence
agagagggactgggctgcag

SEQ ID NO: 55837 - DNA, 20 bp, Artificial
  CRISPR gRNA sequence
gagggactgggctgcagagg

SEQ ID NO: 55838 - DNA, 20 bp, Artificial
  CRISPR gRNA sequence
ggactgggctgcagaggcag

SEQ ID NO: 55839 - DNA, 20 bp, Artificial
  CRISPR gRNA sequence
tgggctgcagaggcagtgga

SEQ ID NO: 55840 - DNA, 20 bp, Artificial
  CRISPR gRNA sequence
agtggaaagatcacttactc

SEQ ID NO: 55841 - DNA, 20 bp, Artificial
  CRISPR gRNA sequence
agatcacttactcaagcttc

SEQ ID NO: 55842 - DNA, 20 bp, Artificial
  CRISPR gRNA sequence
atcacttactcaagcttccg

SEQ ID NO: 55843 - DNA, 20 bp, Artificial
  CRISPR gRNA sequence
tactcaagcttccggagccg

SEQ ID NO: 55844 - DNA, 20 bp, Artificial
  CRISPR gRNA sequence
tcaagcttccggagccgtgg

SEQ ID NO: 55845 - DNA, 20 bp, Artificial
  CRISPR gRNA sequence
caagcttccggagccgtggt

SEQ ID NO: 55846 - DNA, 20 bp, Artificial
  CRISPR gRNA sequence
cttccggagccgtggtaggt

SEQ ID NO: 55847 - DNA, 20 bp, Artificial
  CRISPR gRNA sequence
ttccggagccgtggtaggtg

SEQ ID NO: 55848 - DNA, 20 bp, Artificial
  CRISPR gRNA sequence
tccggagccgtggtaggtga

SEQ ID NO: 55849 - DNA, 20 bp, Artificial
  CRISPR gRNA sequence
cggagccgtggtaggtgagg

SEQ ID NO: 55850 - DNA, 20 bp, Artificial
  CRISPR gRNA sequence
gggagaacctccacaatgtt

SEQ ID NO: 55851 - DNA, 20 bp, Artificial
  CRISPR gRNA sequence
ccacaatgttcagcaccacc

SEQ ID NO: 55852 - DNA, 20 bp, Artificial
  CRISPR gRNA sequence
ttcagcaccacctggtcact

SEQ ID NO: 55853 - DNA, 20 bp, Artificial
  CRISPR gRNA sequence
gcaccacctggtcactgagc

SEQ ID NO: 55854 - DNA, 20 bp, Artificial
  CRISPR gRNA sequence
ctggttgtcccgaaaactgc

SEQ ID NO: 55855 - DNA, 20 bp, Artificial
  CRISPR gRNA sequence
tggttgtcccgaaaactgcg

SEQ ID NO: 55856 - DNA, 20 bp, Artificial
  CRISPR gRNA sequence
gttgtcccgaaaactgcgag

SEQ ID NO: 55857 - DNA, 20 bp, Artificial
  CRISPR gRNA sequence
ccgaaaactgcgaggagacc

SEQ ID NO: 55858 - DNA, 20 bp, Artificial
  CRISPR gRNA sequence
cgaaaactgcgaggagacca

SEQ ID NO: 55859 - DNA, 20 bp, Artificial
  CRISPR gRNA sequence
actgcgaggagaccaaggcc

SEQ ID NO: 55860 - DNA, 20 bp, Artificial
  CRISPR gRNA sequence
aaggcccagtccctttgccc

SEQ ID NO: 55861 - DNA, 20 bp, Artificial
  CRISPR gRNA sequence
aggcccagtccctttgccct

SEQ ID NO: 55862 - DNA, 20 bp, Artificial
  CRISPR gRNA sequence
ggcccagtccctttgccctg

SEQ ID NO: 55863 - DNA, 20 bp, Artificial
  CRISPR gRNA sequence
cagtccctttgccctggggt

SEQ ID NO: 55864 - DNA, 20 bp, Artificial
  CRISPR gRNA sequence
agtccctttgccctggggtt

SEQ ID NO: 55865 - DNA, 20 bp, Artificial
  CRISPR gRNA sequence
gtccctttgccctggggttg

SEQ ID NO: 55866 - DNA, 20 bp, Artificial
  CRISPR gRNA sequence
cctggggttggggcacttgc

SEQ ID NO: 55867 - DNA, 20 bp, Artificial
  CRISPR gRNA sequence
gttggggcacttgcaagccc

SEQ ID NO: 55868 - DNA, 20 bp, Artificial
  CRISPR gRNA sequence
gggcacttgcaagccccagt

SEQ ID NO: 55869 - DNA, 20 bp, Artificial
  CRISPR gRNA sequence
acttgcaagccccagttagc

SEQ ID NO: 55870 - DNA, 20 bp, Artificial
  CRISPR gRNA sequence
aagccccagttagcaagtga

SEQ ID NO: 55871 - DNA, 20 bp, Artificial
  CRISPR gRNA sequence
agccccagttagcaagtgac

SEQ ID NO: 55872 - DNA, 20 bp, Artificial
  CRISPR gRNA sequence
ccagttagcaagtgacagga

SEQ ID NO: 55873 - DNA, 20 bp, Artificial
  CRISPR gRNA sequence
acaggatggccaccctcatg

SEQ ID NO: 55874 - DNA, 20 bp, Artificial
  CRISPR gRNA sequence
caggatggccaccctcatgt

SEQ ID NO: 55875 - DNA, 20 bp, Artificial
  CRISPR gRNA sequence
ggatggccaccctcatgtgg

SEQ ID NO: 55876 - DNA, 20 bp, Artificial
  CRISPR gRNA sequence
caccctcatgtgggagacat

SEQ ID NO: 55877 - DNA, 20 bp, Artificial
  CRISPR gRNA sequence
ctcatgtgggagacataaga

SEQ ID NO: 55878 - DNA, 20 bp, Artificial
  CRISPR gRNA sequence
tcatgtgggagacataagac

SEQ ID NO: 55879 - DNA, 20 bp, Artificial
  CRISPR gRNA sequence
catgtgggagacataagaca

SEQ ID NO: 55880 - DNA, 20 bp, Artificial
  CRISPR gRNA sequence
atgtgggagacataagacag

SEQ ID NO: 55881 - DNA, 20 bp, Artificial
  CRISPR gRNA sequence
ggagacataagacaggggcc

SEQ ID NO: 55882 - DNA, 20 bp, Artificial
  CRISPR gRNA sequence
acataagacaggggcccaga

SEQ ID NO: 55883 - DNA, 20 bp, Artificial
  CRISPR gRNA sequence
ataagacaggggcccagaaa

SEQ ID NO: 55884 - DNA, 20 bp, Artificial
  CRISPR gRNA sequence
aggggcccagaaagagctga

SEQ ID NO: 55885 - DNA, 20 bp, Artificial
  CRISPR gRNA sequence
agagctgatggcctgctcgc

SEQ ID NO: 55886 - DNA, 20 bp, Artificial
  CRISPR gRNA sequence
atggcctgctcgccggattc

SEQ ID NO: 55887 - DNA, 20 bp, Artificial
  CRISPR gRNA sequence
gcctgctcgccggattccag

SEQ ID NO: 55888 - DNA, 20 bp, Artificial
  CRISPR gRNA sequence
cctgctcgccggattccagc

SEQ ID NO: 55889 - DNA, 20 bp, Artificial
  CRISPR gRNA sequence
tcgccggattccagcaggca

SEQ ID NO: 55890 - DNA, 20 bp, Artificial
  CRISPR gRNA sequence
cggattccagcaggcacggc

SEQ ID NO: 55891 - DNA, 20 bp, Artificial
  CRISPR gRNA sequence
ggattccagcaggcacggct

SEQ ID NO: 55892 - DNA, 20 bp, Artificial
  CRISPR gRNA sequence
attccagcaggcacggctag

SEQ ID NO: 55893 - DNA, 20 bp, Artificial
  CRISPR gRNA sequence
ttccagcaggcacggctagg

SEQ ID NO: 55894 - DNA, 20 bp, Artificial
  CRISPR gRNA sequence
agcaggcacggctaggagga

SEQ ID NO: 55895 - DNA, 20 bp, Artificial
  CRISPR gRNA sequence
taggaggaaagaccctctgc

SEQ ID NO: 55896 - DNA, 20 bp, Artificial
  CRISPR gRNA sequence
ccctctgctggcctcaattc

SEQ ID NO: 55897 - DNA, 20 bp, Artificial
  CRISPR gRNA sequence
cctctgctggcctcaattct

SEQ ID NO: 55898 - DNA, 20 bp, Artificial
  CRISPR gRNA sequence
ctgggtctattctgttccta

SEQ ID NO: 55899 - DNA, 20 bp, Artificial
  CRISPR gRNA sequence
tgggtctattctgttcctat

SEQ ID NO: 55900 - DNA, 20 bp, Artificial
  CRISPR gRNA sequence
gggtctattctgttcctatg

SEQ ID NO: 55901 - DNA, 20 bp, Artificial
  CRISPR gRNA sequence
tctattctgttcctatgggg

SEQ ID NO: 55902 - DNA, 20 bp, Artificial
  CRISPR gRNA sequence
cctatggggaagtttttgcc

SEQ ID NO: 55903 - DNA, 20 bp, Artificial
  CRISPR gRNA sequence
atggggaagtttttgcctgg

SEQ ID NO: 55904 - DNA, 20 bp, Artificial
  CRISPR gRNA sequence
aagtttttgcctggcggctc

SEQ ID NO: 55905 - DNA, 20 bp, Artificial
  CRISPR gRNA sequence
agtttttgcctggcggctca

SEQ ID NO: 55906 - DNA, 20 bp, Artificial
  CRISPR gRNA sequence
gtttttgcctggcggctcaa

SEQ ID NO: 55907 - DNA, 20 bp, Artificial
  CRISPR gRNA sequence
gcctggcggctcaagggatc

SEQ ID NO: 55908 - DNA, 20 bp, Artificial
  CRISPR gRNA sequence
tggcggctcaagggatctag

SEQ ID NO: 55909 - DNA, 20 bp, Artificial
  CRISPR gRNA sequence
ggctcaagggatctagaaga

SEQ ID NO: 55910 - DNA, 20 bp, Artificial
  CRISPR gRNA sequence
ggatctagaagacagactga

SEQ ID NO: 55911 - DNA, 20 bp, Artificial
  CRISPR gRNA sequence
cagactgacggcctcttcat

SEQ ID NO: 55912 - DNA, 20 bp, Artificial
  CRISPR gRNA sequence
agactgacggcctcttcatg

SEQ ID NO: 55913 - DNA, 20 bp, Artificial
  CRISPR gRNA sequence
gcctcttcatgaggcacaat

SEQ ID NO: 55914 - DNA, 20 bp, Artificial
  CRISPR gRNA sequence
cctcttcatgaggcacaatg

SEQ ID NO: 55915 - DNA, 20 bp, Artificial
  CRISPR gRNA sequence
tcttcatgaggcacaatgag

SEQ ID NO: 55916 - DNA, 20 bp, Artificial
  CRISPR gRNA sequence
tgaggcacaatgaggagacc

SEQ ID NO: 55917 - DNA, 20 bp, Artificial
  CRISPR gRNA sequence
gagacctagcaccctgctcc

SEQ ID NO: 55918 - DNA, 20 bp, Artificial
  CRISPR gRNA sequence
agacctagcaccctgctccc

SEQ ID NO: 55919 - DNA, 20 bp, Artificial
  CRISPR gRNA sequence
gacctagcaccctgctccca

SEQ ID NO: 55920 - DNA, 20 bp, Artificial
  CRISPR gRNA sequence
ctgctcccagggcttatgcc

SEQ ID NO: 55921 - DNA, 20 bp, Artificial
  CRISPR gRNA sequence
tgctcccagggcttatgcct

SEQ ID NO: 55922 - DNA, 20 bp, Artificial
  CRISPR gRNA sequence
gcttatgcctgggatgtgcc

SEQ ID NO: 55923 - DNA, 20 bp, Artificial
  CRISPR gRNA sequence
cttatgcctgggatgtgcct

SEQ ID NO: 55924 - DNA, 20 bp, Artificial
  CRISPR gRNA sequence
tgcctgggatgtgcctggga

SEQ ID NO: 55925 - DNA, 20 bp, Artificial
  CRISPR gRNA sequence
gcctgggatgtgcctgggat

SEQ ID NO: 55926 - DNA, 20 bp, Artificial
  CRISPR gRNA sequence
tgtgcctgggataggccccc

SEQ ID NO: 55927 - DNA, 20 bp, Artificial
  CRISPR gRNA sequence
gtgcctgggataggcccccc

SEQ ID NO: 55928 - DNA, 20 bp, Artificial
  CRISPR gRNA sequence
ggataggccccccaggcaat

SEQ ID NO: 55929 - DNA, 20 bp, Artificial
  CRISPR gRNA sequence
ggccccccaggcaatgagta

SEQ ID NO: 55930 - DNA, 20 bp, Artificial
  CRISPR gRNA sequence
cccaggcaatgagtaaagtc

SEQ ID NO: 55931 - DNA, 20 bp, Artificial
  CRISPR gRNA sequence
gcaatgagtaaagtctagac

SEQ ID NO: 55932 - DNA, 20 bp, Artificial
  CRISPR gRNA sequence
caatgagtaaagtctagact

SEQ ID NO: 55933 - DNA, 20 bp, Artificial
  CRISPR gRNA sequence
aagtctagactgggacgctg

SEQ ID NO: 55934 - DNA, 20 bp, Artificial
  CRISPR gRNA sequence
gacgctgcagacatcgcttc

SEQ ID NO: 55935 - DNA, 20 bp, Artificial
  CRISPR gRNA sequence
gcagacatcgcttccagcct

SEQ ID NO: 55936 - DNA, 20 bp, Artificial
  CRISPR gRNA sequence
atcgcttccagcctcggctg

SEQ ID NO: 55937 - DNA, 20 bp, Artificial
  CRISPR gRNA sequence
ggctgtggccctgactcacc

SEQ ID NO: 55938 - DNA, 20 bp, Artificial
  CRISPR gRNA sequence
ctgtggccctgactcaccca

SEQ ID NO: 55939 - DNA, 20 bp, Artificial
  CRISPR gRNA sequence
cctgactcacccagagccct

SEQ ID NO: 55940 - DNA, 20 bp, Artificial
  CRISPR gRNA sequence
ctcacccagagccctgagcc

SEQ ID NO: 55941 - DNA, 20 bp, Artificial
  CRISPR gRNA sequence
cactttccccacctgttcac

SEQ ID NO: 55942 - DNA, 20 bp, Artificial
  CRISPR gRNA sequence
ttccccacctgttcacaagc

SEQ ID NO: 55943 - DNA, 20 bp, Artificial
  CRISPR gRNA sequence
gttcacaagccagccttgcc

SEQ ID NO: 55944 - DNA, 20 bp, Artificial
  CRISPR gRNA sequence
ttcacaagccagccttgcct

SEQ ID NO: 55945 - DNA, 20 bp, Artificial
  CRISPR gRNA sequence
gccagccttgcctgggttcc

SEQ ID NO: 55946 - DNA, 20 bp, Artificial
  CRISPR gRNA sequence
gccttgcctgggttcctagc

SEQ ID NO: 55947 - DNA, 20 bp, Artificial
  CRISPR gRNA sequence
ccttgcctgggttcctagct

SEQ ID NO: 55948 - DNA, 20 bp, Artificial
  CRISPR gRNA sequence
cttgcctgggttcctagctg

SEQ ID NO: 55949 - DNA, 20 bp, Artificial
  CRISPR gRNA sequence
tgcctgggttcctagctggg

SEQ ID NO: 55950 - DNA, 20 bp, Artificial
  CRISPR gRNA sequence
tgggttcctagctggggaga

SEQ ID NO: 55951 - DNA, 20 bp, Artificial
  CRISPR gRNA sequence
tcctagctggggagacagat

SEQ ID NO: 55952 - DNA, 20 bp, Artificial
  CRISPR gRNA sequence
gctggggagacagatgagtt

SEQ ID NO: 55953 - DNA, 20 bp, Artificial
  CRISPR gRNA sequence
ctggggagacagatgagttg

SEQ ID NO: 55954 - DNA, 20 bp, Artificial
  CRISPR gRNA sequence
tggggagacagatgagttga

SEQ ID NO: 55955 - DNA, 20 bp, Artificial
  CRISPR gRNA sequence
ggggagacagatgagttgag

SEQ ID NO: 55956 - DNA, 20 bp, Artificial
  CRISPR gRNA sequence
ggagacagatgagttgaggg

SEQ ID NO: 55957 - DNA, 20 bp, Artificial
  CRISPR gRNA sequence
acagatgagttgaggggagt

SEQ ID NO: 55958 - DNA, 20 bp, Artificial
  CRISPR gRNA sequence
cagatgagttgaggggagtg

SEQ ID NO: 55959 - DNA, 20 bp, Artificial
  CRISPR gRNA sequence
agatgagttgaggggagtga

SEQ ID NO: 55960 - DNA, 20 bp, Artificial
  CRISPR gRNA sequence
tgaggggagtgagggtgatt

SEQ ID NO: 55961 - DNA, 20 bp, Artificial
  CRISPR gRNA sequence
gtgagggtgattaagaacaa

SEQ ID NO: 55962 - DNA, 20 bp, Artificial
  CRISPR gRNA sequence
agggtgattaagaacaatgg

SEQ ID NO: 55963 - DNA, 20 bp, Artificial
  CRISPR gRNA sequence
gggtgattaagaacaatggt

SEQ ID NO: 55964 - DNA, 20 bp, Artificial
  CRISPR gRNA sequence
agaacaatggtgggtgatga

SEQ ID NO: 55965 - DNA, 20 bp, Artificial
  CRISPR gRNA sequence
ggtgatgaaagacaaaatta

SEQ ID NO: 55966 - DNA, 20 bp, Artificial
  CRISPR gRNA sequence
aaaattaaagtcactttcaa

SEQ ID NO: 55967 - DNA, 20 bp, Artificial
  CRISPR gRNA sequence
ttaaagtcactttcaatagc

SEQ ID NO: 55968 - DNA, 20 bp, Artificial
  CRISPR gRNA sequence
taaagtcactttcaatagcc

SEQ ID NO: 55969 - DNA, 20 bp, Artificial
  CRISPR gRNA sequence
aaagtcactttcaatagcca

SEQ ID NO: 55970 - DNA, 20 bp, Artificial
  CRISPR gRNA sequence
gtcactttcaatagccaggg

SEQ ID NO: 55971 - DNA, 20 bp, Artificial
  CRISPR gRNA sequence
cagggaagaaaaatgtcaac

SEQ ID NO: 55972 - DNA, 20 bp, Artificial
  CRISPR gRNA sequence
aagaaaaatgtcaacaagtt

SEQ ID NO: 55973 - DNA, 20 bp, Artificial
  CRISPR gRNA sequence
agttcagtacttctgaacct

SEQ ID NO: 55974 - DNA, 20 bp, Artificial
  CRISPR gRNA sequence
tctgaaccttggcttaatca

SEQ ID NO: 55975 - DNA, 20 bp, Artificial
  CRISPR gRNA sequence
cttggcttaatcacggttca

SEQ ID NO: 55976 - DNA, 20 bp, Artificial
  CRISPR gRNA sequence
aatcacggttcacagatgcc

SEQ ID NO: 55977 - DNA, 20 bp, Artificial
  CRISPR gRNA sequence
cggttcacagatgcccagcc

SEQ ID NO: 55978 - DNA, 20 bp, Artificial
  CRISPR gRNA sequence
atgcccagccgagacgacaa

SEQ ID NO: 55979 - DNA, 20 bp, Artificial
  CRISPR gRNA sequence
tgcccagccgagacgacaat

SEQ ID NO: 55980 - DNA, 20 bp, Artificial
  CRISPR gRNA sequence
gcccagccgagacgacaata

SEQ ID NO: 55981 - DNA, 20 bp, Artificial
  CRISPR gRNA sequence
cgagacgacaatagggactg

SEQ ID NO: 55982 - DNA, 20 bp, Artificial
  CRISPR gRNA sequence
acttattattttcactcaac

SEQ ID NO: 55983 - DNA, 20 bp, Artificial
  CRISPR gRNA sequence
actcaacaagtgctgaacct

SEQ ID NO: 55984 - DNA, 20 bp, Artificial
  CRISPR gRNA sequence
caagtgctgaaccttagtga

SEQ ID NO: 55985 - DNA, 20 bp, Artificial
  CRISPR gRNA sequence
aagtgctgaaccttagtgac

SEQ ID NO: 55986 - DNA, 20 bp, Artificial
  CRISPR gRNA sequence
agtgacaggctgcatctgtg

SEQ ID NO: 55987 - DNA, 20 bp, Artificial
  CRISPR gRNA sequence
aggctgcatctgtgtggatg

SEQ ID NO: 55988 - DNA, 20 bp, Artificial
  CRISPR gRNA sequence
ctgcatctgtgtggatgaag

SEQ ID NO: 55989 - DNA, 20 bp, Artificial
  CRISPR gRNA sequence
tgccttctctaaatgtcata

SEQ ID NO: 55990 - DNA, 20 bp, Artificial
  CRISPR gRNA sequence
gccttctctaaatgtcataa

SEQ ID NO: 55991 - DNA, 20 bp, Artificial
  CRISPR gRNA sequence
cataaaggtgccatataaac

SEQ ID NO: 55992 - DNA, 20 bp, Artificial
  CRISPR gRNA sequence
aaaggtgccatataaactag

SEQ ID NO: 55993 - DNA, 20 bp, Artificial
  CRISPR gRNA sequence
ataaactagcagcgttctgc

SEQ ID NO: 55994 - DNA, 20 bp, Artificial
  CRISPR gRNA sequence
taaactagcagcgttctgcc

SEQ ID NO: 55995 - DNA, 20 bp, Artificial
  CRISPR gRNA sequence
aaactagcagcgttctgcca

SEQ ID NO: 55996 - DNA, 20 bp, Artificial
  CRISPR gRNA sequence
actagcagcgttctgccagg

SEQ ID NO: 55997 - DNA, 20 bp, Artificial
  CRISPR gRNA sequence
ctagcagcgttctgccaggg

SEQ ID NO: 55998 - DNA, 20 bp, Artificial
  CRISPR gRNA sequence
agcagcgttctgccagggag

SEQ ID NO: 55999 - DNA, 20 bp, Artificial
  CRISPR gRNA sequence
gcagcgttctgccagggagg

SEQ ID NO: 56000 - DNA, 20 bp, Artificial
  CRISPR gRNA sequence
cagcgttctgccagggagga

SEQ ID NO: 56001 - DNA, 20 bp, Artificial
  CRISPR gRNA sequence
ctgccagggaggagggtcac

SEQ ID NO: 56002 - DNA, 20 bp, Artificial
  CRISPR gRNA sequence
actggtcccactcctcccca

SEQ ID NO: 56003 - DNA, 20 bp, Artificial
  CRISPR gRNA sequence
ccactcctccccatggtact

SEQ ID NO: 56004 - DNA, 20 bp, Artificial
  CRISPR gRNA sequence
ctccccatggtactgagtcc

SEQ ID NO: 56005 - DNA, 20 bp, Artificial
  CRISPR gRNA sequence
atggtactgagtcccagaca

SEQ ID NO: 56006 - DNA, 20 bp, Artificial
  CRISPR gRNA sequence
tggtactgagtcccagacac

SEQ ID NO: 56007 - DNA, 20 bp, Artificial
  CRISPR gRNA sequence
ggtactgagtcccagacaca

SEQ ID NO: 56008 - DNA, 20 bp, Artificial
  CRISPR gRNA sequence
actgagtcccagacacaggg

SEQ ID NO: 56009 - DNA, 20 bp, Artificial
  CRISPR gRNA sequence
ctgagtcccagacacagggc

SEQ ID NO: 56010 - DNA, 20 bp, Artificial
  CRISPR gRNA sequence
gagtcccagacacagggcag

SEQ ID NO: 56011 - DNA, 20 bp, Artificial
  CRISPR gRNA sequence
aggagtatatttgtgcatac

SEQ ID NO: 56012 - DNA, 20 bp, Artificial
  CRISPR gRNA sequence
tatatttgtgcatacaagct

SEQ ID NO: 56013 - DNA, 20 bp, Artificial
  CRISPR gRNA sequence
tttgtgcatacaagcttagt

SEQ ID NO: 56014 - DNA, 20 bp, Artificial
  CRISPR gRNA sequence
tgcatacaagcttagttagt

SEQ ID NO: 56015 - DNA, 20 bp, Artificial
  CRISPR gRNA sequence
catacaagcttagttagtta

SEQ ID NO: 56016 - DNA, 20 bp, Artificial
  CRISPR gRNA sequence
cttagttagttagagtgtgc

SEQ ID NO: 56017 - DNA, 20 bp, Artificial
  CRISPR gRNA sequence
ggcatcaaaatgtgtacatg

SEQ ID NO: 56018 - DNA, 20 bp, Artificial
  CRISPR gRNA sequence
aaaatgtgtacatgtagtta

SEQ ID NO: 56019 - DNA, 20 bp, Artificial
  CRISPR gRNA sequence
aaatgtgtacatgtagttaa

SEQ ID NO: 56020 - DNA, 20 bp, Artificial
  CRISPR gRNA sequence
gcatacatgtgcacacctat

SEQ ID NO: 56021 - DNA, 20 bp, Artificial
  CRISPR gRNA sequence
tacatgtgcacacctatgag

SEQ ID NO: 56022 - DNA, 20 bp, Artificial
  CRISPR gRNA sequence
acatgtgcacacctatgagt

SEQ ID NO: 56023 - DNA, 20 bp, Artificial
  CRISPR gRNA sequence
cacctatgagtgggcatgtg

SEQ ID NO: 56024 - DNA, 20 bp, Artificial
  CRISPR gRNA sequence
acctatgagtgggcatgtgt

SEQ ID NO: 56025 - DNA, 20 bp, Artificial
  CRISPR gRNA sequence
atgcctgtgtacttctgtgc

SEQ ID NO: 56026 - DNA, 20 bp, Artificial
  CRISPR gRNA sequence
tgtgtacttctgtgcaagtg

SEQ ID NO: 56027 - DNA, 20 bp, Artificial
  CRISPR gRNA sequence
gacatgtgtgaacaaatgtg

SEQ ID NO: 56028 - DNA, 20 bp, Artificial
  CRISPR gRNA sequence
acatgtgtgaacaaatgtga

SEQ ID NO: 56029 - DNA, 20 bp, Artificial
  CRISPR gRNA sequence
tgaacaaatgtgaaggtgtg

SEQ ID NO: 56030 - DNA, 20 bp, Artificial
  CRISPR gRNA sequence
aaggtgtgtggtgcttcatg

SEQ ID NO: 56031 - DNA, 20 bp, Artificial
  CRISPR gRNA sequence
catgtagttatgtgtaccca

SEQ ID NO: 56032 - DNA, 20 bp, Artificial
  CRISPR gRNA sequence
cgcactgctatcccttctcc

SEQ ID NO: 56033 - DNA, 20 bp, Artificial
  CRISPR gRNA sequence
gcactgctatcccttctcct

SEQ ID NO: 56034 - DNA, 20 bp, Artificial
  CRISPR gRNA sequence
tatcccttctcctgggattt

SEQ ID NO: 56035 - DNA, 20 bp, Artificial
  CRISPR gRNA sequence
ccttctcctgggatttcaga

SEQ ID NO: 56036 - DNA, 20 bp, Artificial
  CRISPR gRNA sequence
ttctcctgggatttcagaaa

SEQ ID NO: 56037 - DNA, 20 bp, Artificial
  CRISPR gRNA sequence
tctcctgggatttcagaaag

SEQ ID NO: 56038 - DNA, 20 bp, Artificial
  CRISPR gRNA sequence
ctcctgggatttcagaaaga

SEQ ID NO: 56039 - DNA, 20 bp, Artificial
  CRISPR gRNA sequence
cctgggatttcagaaagagg

SEQ ID NO: 56040 - DNA, 20 bp, Artificial
  CRISPR gRNA sequence
ctgggatttcagaaagaggg

SEQ ID NO: 56041 - DNA, 20 bp, Artificial
  CRISPR gRNA sequence
tgggatttcagaaagaggga

SEQ ID NO: 56042 - DNA, 20 bp, Artificial
  CRISPR gRNA sequence
ggatttcagaaagagggagg

SEQ ID NO: 56043 - DNA, 20 bp, Artificial
  CRISPR gRNA sequence
cttaacactcatgctcctcc

SEQ ID NO: 56044 - DNA, 20 bp, Artificial
  CRISPR gRNA sequence
acactcatgctcctccaaga

SEQ ID NO: 56045 - DNA, 20 bp, Artificial
  CRISPR gRNA sequence
tccaagacagtctaaaatat

SEQ ID NO: 56046 - DNA, 20 bp, Artificial
  CRISPR gRNA sequence
acagtctaaaatattagatg

SEQ ID NO: 56047 - DNA, 20 bp, Artificial
  CRISPR gRNA sequence
cagtctaaaatattagatga

SEQ ID NO: 56048 - DNA, 20 bp, Artificial
  CRISPR gRNA sequence
tctaaaatattagatgaagg

SEQ ID NO: 56049 - DNA, 20 bp, Artificial
  CRISPR gRNA sequence
agatgaaggaagccttgctc

SEQ ID NO: 56050 - DNA, 20 bp, Artificial
  CRISPR gRNA sequence
gatgaaggaagccttgctct

SEQ ID NO: 56051 - DNA, 20 bp, Artificial
  CRISPR gRNA sequence
atgaaggaagccttgctctg

SEQ ID NO: 56052 - DNA, 20 bp, Artificial
  CRISPR gRNA sequence
aagccttgctctggggactc

SEQ ID NO: 56053 - DNA, 20 bp, Artificial
  CRISPR gRNA sequence
agccttgctctggggactct

SEQ ID NO: 56054 - DNA, 20 bp, Artificial
  CRISPR gRNA sequence
ccttgctctggggactctgg

SEQ ID NO: 56055 - DNA, 20 bp, Artificial
  CRISPR gRNA sequence
tctggggactctgggagcct

SEQ ID NO: 56056 - DNA, 20 bp, Artificial
  CRISPR gRNA sequence
ctggggactctgggagcctt

SEQ ID NO: 56057 - DNA, 20 bp, Artificial
  CRISPR gRNA sequence
gactctgggagccttgggtt

SEQ ID NO: 56058 - DNA, 20 bp, Artificial
  CRISPR gRNA sequence
gggagccttgggtttggact

SEQ ID NO: 56059 - DNA, 20 bp, Artificial
  CRISPR gRNA sequence
ggtttggactcagccctact

SEQ ID NO: 56060 - DNA, 20 bp, Artificial
  CRISPR gRNA sequence
actcagccctactgagtact

SEQ ID NO: 56061 - DNA, 20 bp, Artificial
  CRISPR gRNA sequence
ggactgatgccttccctctc

SEQ ID NO: 56062 - DNA, 20 bp, Artificial
  CRISPR gRNA sequence
gactgatgccttccctctct

SEQ ID NO: 56063 - DNA, 20 bp, Artificial
  CRISPR gRNA sequence
gggtctcactgaaaaactac

SEQ ID NO: 56064 - DNA, 20 bp, Artificial
  CRISPR gRNA sequence
ctcactgaaaaactactggt

SEQ ID NO: 56065 - DNA, 20 bp, Artificial
  CRISPR gRNA sequence
gaaaaactactggtcagact

SEQ ID NO: 56066 - DNA, 20 bp, Artificial
  CRISPR gRNA sequence
aaaactactggtcagacttg

SEQ ID NO: 56067 - DNA, 20 bp, Artificial
  CRISPR gRNA sequence
aaactactggtcagacttgg

SEQ ID NO: 56068 - DNA, 20 bp, Artificial
  CRISPR gRNA sequence
gtcagacttggaggaacatg

SEQ ID NO: 56069 - DNA, 20 bp, Artificial
  CRISPR gRNA sequence
tcagacttggaggaacatgc

SEQ ID NO: 56070 - DNA, 20 bp, Artificial
  CRISPR gRNA sequence
ttggaggaacatgcaggccc

SEQ ID NO: 56071 - DNA, 20 bp, Artificial
  CRISPR gRNA sequence
tggaggaacatgcaggcccc

SEQ ID NO: 56072 - DNA, 20 bp, Artificial
  CRISPR gRNA sequence
ggaggaacatgcaggcccca

SEQ ID NO: 56073 - DNA, 20 bp, Artificial
  CRISPR gRNA sequence
gaggaacatgcaggccccag

SEQ ID NO: 56074 - DNA, 20 bp, Artificial
  CRISPR gRNA sequence
aggaacatgcaggccccagg

SEQ ID NO: 56075 - DNA, 20 bp, Artificial
  CRISPR gRNA sequence
tgcaggccccagggggactc

SEQ ID NO: 56076 - DNA, 20 bp, Artificial
  CRISPR gRNA sequence
gcaggccccagggggactct

SEQ ID NO: 56077 - DNA, 20 bp, Artificial
  CRISPR gRNA sequence
cccagggggactctgggacc

SEQ ID NO: 56078 - DNA, 20 bp, Artificial
  CRISPR gRNA sequence
ccagggggactctgggacct

SEQ ID NO: 56079 - DNA, 20 bp, Artificial
  CRISPR gRNA sequence
gggggactctgggacctggg

SEQ ID NO: 56080 - DNA, 20 bp, Artificial
  CRISPR gRNA sequence
ggactctgggacctgggcag

SEQ ID NO: 56081 - DNA, 20 bp, Artificial
  CRISPR gRNA sequence
tgggcagtggctcatctccc

SEQ ID NO: 56082 - DNA, 20 bp, Artificial
  CRISPR gRNA sequence
cagtggctcatctccccagt

SEQ ID NO: 56083 - DNA, 20 bp, Artificial
  CRISPR gRNA sequence
ggctcatctccccagtcagt

SEQ ID NO: 56084 - DNA, 20 bp, Artificial
  CRISPR gRNA sequence
ccccagtcagtgagccctcc

SEQ ID NO: 56085 - DNA, 20 bp, Artificial
  CRISPR gRNA sequence
ccagtcagtgagccctcctg

SEQ ID NO: 56086 - DNA, 20 bp, Artificial
  CRISPR gRNA sequence
atcactcacctgacttcttt

SEQ ID NO: 56087 - DNA, 20 bp, Artificial
  CRISPR gRNA sequence
cacctgacttctttcagctg

SEQ ID NO: 56088 - DNA, 20 bp, Artificial
  CRISPR gRNA sequence
tgacttctttcagctgtgga

SEQ ID NO: 56089 - DNA, 20 bp, Artificial
  CRISPR gRNA sequence
acttctttcagctgtggaca

SEQ ID NO: 56090 - DNA, 20 bp, Artificial
  CRISPR gRNA sequence
ttctttcagctgtggacaga

SEQ ID NO: 56091 - DNA, 20 bp, Artificial
  CRISPR gRNA sequence
tctttcagctgtggacagag

SEQ ID NO: 56092 - DNA, 20 bp, Artificial
  CRISPR gRNA sequence
cagctgtggacagagaggca

SEQ ID NO: 56093 - DNA, 20 bp, Artificial
  CRISPR gRNA sequence
cagagaggcaaagctttcac

SEQ ID NO: 56094 - DNA, 20 bp, Artificial
  CRISPR gRNA sequence
agagaggcaaagctttcacc

SEQ ID NO: 56095 - DNA, 20 bp, Artificial
  CRISPR gRNA sequence
gaggcaaagctttcaccagg

SEQ ID NO: 56096 - DNA, 20 bp, Artificial
  CRISPR gRNA sequence
tcaccaggtggctgatgcct

SEQ ID NO: 56097 - DNA, 20 bp, Artificial
  CRISPR gRNA sequence
caccaggtggctgatgcctc

SEQ ID NO: 56098 - DNA, 20 bp, Artificial
  CRISPR gRNA sequence
caggtggctgatgcctcggg

SEQ ID NO: 56099 - DNA, 20 bp, Artificial
  CRISPR gRNA sequence
ttttacttcctgctaaccta

SEQ ID NO: 56100 - DNA, 20 bp, Artificial
  CRISPR gRNA sequence
ttacttcctgctaacctaca

SEQ ID NO: 56101 - DNA, 20 bp, Artificial
  CRISPR gRNA sequence
ttcctgctaacctacagagt

SEQ ID NO: 56102 - DNA, 20 bp, Artificial
  CRISPR gRNA sequence
gctaacctacagagtaagca

SEQ ID NO: 56103 - DNA, 20 bp, Artificial
  CRISPR gRNA sequence
acctacagagtaagcaaaga

SEQ ID NO: 56104 - DNA, 20 bp, Artificial
  CRISPR gRNA sequence
tacagagtaagcaaagatgg

SEQ ID NO: 56105 - DNA, 20 bp, Artificial
  CRISPR gRNA sequence
acagagtaagcaaagatggt

SEQ ID NO: 56106 - DNA, 20 bp, Artificial
  CRISPR gRNA sequence
cagagtaagcaaagatggtg

SEQ ID NO: 56107 - DNA, 20 bp, Artificial
  CRISPR gRNA sequence
gagtaagcaaagatggtggg

SEQ ID NO: 56108 - DNA, 20 bp, Artificial
  CRISPR gRNA sequence
agtaagcaaagatggtgggg

SEQ ID NO: 56109 - DNA, 20 bp, Artificial
  CRISPR gRNA sequence
caaagatggtggggaggaac

SEQ ID NO: 56110 - DNA, 20 bp, Artificial
  CRISPR gRNA sequence
aaagatggtggggaggaacg

SEQ ID NO: 56111 - DNA, 20 bp, Artificial
  CRISPR gRNA sequence
agatggtggggaggaacgag

SEQ ID NO: 56112 - DNA, 20 bp, Artificial
  CRISPR gRNA sequence
gatggtggggaggaacgagg

SEQ ID NO: 56113 - DNA, 20 bp, Artificial
  CRISPR gRNA sequence
atggtggggaggaacgagga

SEQ ID NO: 56114 - DNA, 20 bp, Artificial
  CRISPR gRNA sequence
tggtggggaggaacgaggag

SEQ ID NO: 56115 - DNA, 20 bp, Artificial
  CRISPR gRNA sequence
gggaggaacgaggaggggaa

SEQ ID NO: 56116 - DNA, 20 bp, Artificial
  CRISPR gRNA sequence
ggaggaacgaggaggggaaa

SEQ ID NO: 56117 - DNA, 20 bp, Artificial
  CRISPR gRNA sequence
gaggaacgaggaggggaaaa

SEQ ID NO: 56118 - DNA, 20 bp, Artificial
  CRISPR gRNA sequence
gaacgaggaggggaaaaggg

SEQ ID NO: 56119 - DNA, 20 bp, Artificial
  CRISPR gRNA sequence
aacgaggaggggaaaagggc

SEQ ID NO: 56120 - DNA, 20 bp, Artificial
  CRISPR gRNA sequence
acgaggaggggaaaagggcg

SEQ ID NO: 56121 - DNA, 20 bp, Artificial
  CRISPR gRNA sequence
ggaggggaaaagggcggggc

SEQ ID NO: 56122 - DNA, 20 bp, Artificial
  CRISPR gRNA sequence
gaggggaaaagggcggggcc

SEQ ID NO: 56123 - DNA, 20 bp, Artificial
  CRISPR gRNA sequence
ggccaggaatctgccttgtg

SEQ ID NO: 56124 - DNA, 20 bp, Artificial
  CRISPR gRNA sequence
gccaggaatctgccttgtgt

SEQ ID NO: 56125 - DNA, 20 bp, Artificial
  CRISPR gRNA sequence
aatctgccttgtgtaggatt

SEQ ID NO: 56126 - DNA, 20 bp, Artificial
  CRISPR gRNA sequence
atctgccttgtgtaggatta

SEQ ID NO: 56127 - DNA, 20 bp, Artificial
  CRISPR gRNA sequence
ctgccttgtgtaggattaag

SEQ ID NO: 56128 - DNA, 20 bp, Artificial
  CRISPR gRNA sequence
gccttgtgtaggattaagga

SEQ ID NO: 56129 - DNA, 20 bp, Artificial
  CRISPR gRNA sequence
ccttgtgtaggattaaggag

SEQ ID NO: 56130 - DNA, 20 bp, Artificial
  CRISPR gRNA sequence
cttgtgtaggattaaggaga

SEQ ID NO: 56131 - DNA, 20 bp, Artificial
  CRISPR gRNA sequence
tgtgtaggattaaggagagg

SEQ ID NO: 56132 - DNA, 20 bp, Artificial
  CRISPR gRNA sequence
gtgtaggattaaggagaggg

SEQ ID NO: 56133 - DNA, 20 bp, Artificial
  CRISPR gRNA sequence
gtaggattaaggagagggag

SEQ ID NO: 56134 - DNA, 20 bp, Artificial
  CRISPR gRNA sequence
aggattaaggagagggagga

SEQ ID NO: 56135 - DNA, 20 bp, Artificial
  CRISPR gRNA sequence
aaggagagggaggagagtac

SEQ ID NO: 56136 - DNA, 20 bp, Artificial
  CRISPR gRNA sequence
aggagagggaggagagtacc

SEQ ID NO: 56137 - DNA, 20 bp, Artificial
  CRISPR gRNA sequence
aggagagtaccaggcatccc

SEQ ID NO: 56138 - DNA, 20 bp, Artificial
  CRISPR gRNA sequence
gtaccaggcatccccagctg

SEQ ID NO: 56139 - DNA, 20 bp, Artificial
  CRISPR gRNA sequence
ccccagctgaagacccttct

SEQ ID NO: 56140 - DNA, 20 bp, Artificial
  CRISPR gRNA sequence
tgaagacccttctcagctcc

SEQ ID NO: 56141 - DNA, 20 bp, Artificial
  CRISPR gRNA sequence
gaagacccttctcagctcca

SEQ ID NO: 56142 - DNA, 20 bp, Artificial
  CRISPR gRNA sequence
cccttctcagctccaaggcc

SEQ ID NO: 56143 - DNA, 20 bp, Artificial
  CRISPR gRNA sequence
ctccaaggcctggctcaccc

SEQ ID NO: 56144 - DNA, 20 bp, Artificial
  CRISPR gRNA sequence
ctggctcaccccagcatctg

SEQ ID NO: 56145 - DNA, 20 bp, Artificial
  CRISPR gRNA sequence
atctgcagcctccccattgt

SEQ ID NO: 56146 - DNA, 20 bp, Artificial
  CRISPR gRNA sequence
gcagcctccccattgtcggc

SEQ ID NO: 56147 - DNA, 20 bp, Artificial
  CRISPR gRNA sequence
ccccattgtcggcaagctcc

SEQ ID NO: 56148 - DNA, 20 bp, Artificial
  CRISPR gRNA sequence
ccattgtcggcaagctcctg

SEQ ID NO: 56149 - DNA, 20 bp, Artificial
  CRISPR gRNA sequence
attgtcggcaagctcctgga

SEQ ID NO: 56150 - DNA, 20 bp, Artificial
  CRISPR gRNA sequence
ttgtcggcaagctcctggag

SEQ ID NO: 56151 - DNA, 20 bp, Artificial
  CRISPR gRNA sequence
tgtcggcaagctcctggaga

SEQ ID NO: 56152 - DNA, 20 bp, Artificial
  CRISPR gRNA sequence
tcctggagagggcttctgca

SEQ ID NO: 56153 - DNA, 20 bp, Artificial
  CRISPR gRNA sequence
cctggagagggcttctgcaa

SEQ ID NO: 56154 - DNA, 20 bp, Artificial
  CRISPR gRNA sequence
ccccacacttcctgctctta

SEQ ID NO: 56155 - DNA, 20 bp, Artificial
  CRISPR gRNA sequence
cctgctcttaaagctgccat

SEQ ID NO: 56156 - DNA, 20 bp, Artificial
  CRISPR gRNA sequence
gctcttaaagctgccataag

SEQ ID NO: 56157 - DNA, 20 bp, Artificial
  CRISPR gRNA sequence
cttaaagctgccataagaag

SEQ ID NO: 56158 - DNA, 20 bp, Artificial
  CRISPR gRNA sequence
agctgccataagaagaagcg

SEQ ID NO: 56159 - DNA, 20 bp, Artificial
  CRISPR gRNA sequence
cataagaagaagcgaagtgt

SEQ ID NO: 56160 - DNA, 20 bp, Artificial
  CRISPR gRNA sequence
taagaagaagcgaagtgtca

SEQ ID NO: 56161 - DNA, 20 bp, Artificial
  CRISPR gRNA sequence
aagaagaagcgaagtgtcag

SEQ ID NO: 56162 - DNA, 20 bp, Artificial
  CRISPR gRNA sequence
gaagcgaagtgtcagaggat

SEQ ID NO: 56163 - DNA, 20 bp, Artificial
  CRISPR gRNA sequence
aagtgtcagaggatcagtgc

SEQ ID NO: 56164 - DNA, 20 bp, Artificial
  CRISPR gRNA sequence
agtgtcagaggatcagtgct

SEQ ID NO: 56165 - DNA, 20 bp, Artificial
  CRISPR gRNA sequence
gtcagaggatcagtgctggg

SEQ ID NO: 56166 - DNA, 20 bp, Artificial
  CRISPR gRNA sequence
cagaggatcagtgctgggca

SEQ ID NO: 56167 - DNA, 20 bp, Artificial
  CRISPR gRNA sequence
gatcagtgctgggcagagct

SEQ ID NO: 56168 - DNA, 20 bp, Artificial
  CRISPR gRNA sequence
cagtgctgggcagagctgag

SEQ ID NO: 56169 - DNA, 20 bp, Artificial
  CRISPR gRNA sequence
agaagtcatcgccatcccct

SEQ ID NO: 56170 - DNA, 20 bp, Artificial
  CRISPR gRNA sequence
aagtcatcgccatcccctca

SEQ ID NO: 56171 - DNA, 20 bp, Artificial
  CRISPR gRNA sequence
gtcatcgccatcccctcaga

SEQ ID NO: 56172 - DNA, 20 bp, Artificial
  CRISPR gRNA sequence
tcgccatcccctcagagaga

SEQ ID NO: 56173 - DNA, 20 bp, Artificial
  CRISPR gRNA sequence
cgccatcccctcagagagat

SEQ ID NO: 56174 - DNA, 20 bp, Artificial
  CRISPR gRNA sequence
gccatcccctcagagagatg

SEQ ID NO: 56175 - DNA, 20 bp, Artificial
  CRISPR gRNA sequence
cagagagatggggcttaata

SEQ ID NO: 56176 - DNA, 20 bp, Artificial
  CRISPR gRNA sequence
agagatggggcttaatacag

SEQ ID NO: 56177 - DNA, 20 bp, Artificial
  CRISPR gRNA sequence
gtactaacaaatacatatta

SEQ ID NO: 56178 - DNA, 20 bp, Artificial
  CRISPR gRNA sequence
aacaaatacatattatggcc

SEQ ID NO: 56179 - DNA, 20 bp, Artificial
  CRISPR gRNA sequence
agacttctaatcgtccacca

SEQ ID NO: 56180 - DNA, 20 bp, Artificial
  CRISPR gRNA sequence
cccattctccacttcatcta

SEQ ID NO: 56181 - DNA, 20 bp, Artificial
  CRISPR gRNA sequence
ctccacttcatctacagcaa

SEQ ID NO: 56182 - DNA, 20 bp, Artificial
  CRISPR gRNA sequence
ccacttcatctacagcaata

SEQ ID NO: 56183 - DNA, 20 bp, Artificial
  CRISPR gRNA sequence
tacagcaatagagctatcat

SEQ ID NO: 56184 - DNA, 20 bp, Artificial
  CRISPR gRNA sequence
acagcaatagagctatcatg

SEQ ID NO: 56185 - DNA, 20 bp, Artificial
  CRISPR gRNA sequence
tagagctatcatgaggaaca

SEQ ID NO: 56186 - DNA, 20 bp, Artificial
  CRISPR gRNA sequence
tcatgaggaacatggtttcc

SEQ ID NO: 56187 - DNA, 20 bp, Artificial
  CRISPR gRNA sequence
gaggaacatggtttcccagc

SEQ ID NO: 56188 - DNA, 20 bp, Artificial
  CRISPR gRNA sequence
ggaacatggtttcccagcca

SEQ ID NO: 56189 - DNA, 20 bp, Artificial
  CRISPR gRNA sequence
cagccagagatcacatttcc

SEQ ID NO: 56190 - DNA, 20 bp, Artificial
  CRISPR gRNA sequence
acatttcccagcctcccttg

SEQ ID NO: 56191 - DNA, 20 bp, Artificial
  CRISPR gRNA sequence
tcccagcctcccttgcagct

SEQ ID NO: 56192 - DNA, 20 bp, Artificial
  CRISPR gRNA sequence
gcctcccttgcagctcagtg

SEQ ID NO: 56193 - DNA, 20 bp, Artificial
  CRISPR gRNA sequence
cccttgcagctcagtgtggc

SEQ ID NO: 56194 - DNA, 20 bp, Artificial
  CRISPR gRNA sequence
ccttgcagctcagtgtggcc

SEQ ID NO: 56195 - DNA, 20 bp, Artificial
  CRISPR gRNA sequence
ggtgactatgttctcaccaa

SEQ ID NO: 56196 - DNA, 20 bp, Artificial
  CRISPR gRNA sequence
tgttctcaccaatggaatgt

SEQ ID NO: 56197 - DNA, 20 bp, Artificial
  CRISPR gRNA sequence
tctcaccaatggaatgtgag

SEQ ID NO: 56198 - DNA, 20 bp, Artificial
  CRISPR gRNA sequence
caccaatggaatgtgagtgg

SEQ ID NO: 56199 - DNA, 20 bp, Artificial
  CRISPR gRNA sequence
accaatggaatgtgagtgga

SEQ ID NO: 56200 - DNA, 20 bp, Artificial
  CRISPR gRNA sequence
ccaatggaatgtgagtggaa

SEQ ID NO: 56201 - DNA, 20 bp, Artificial
  CRISPR gRNA sequence
tgagtggaagggatgtatcc

SEQ ID NO: 56202 - DNA, 20 bp, Artificial
  CRISPR gRNA sequence
gaagggatgtatcctagttt

SEQ ID NO: 56203 - DNA, 20 bp, Artificial
  CRISPR gRNA sequence
aagggatgtatcctagtttc

SEQ ID NO: 56204 - DNA, 20 bp, Artificial
  CRISPR gRNA sequence
catgctctttccttgttccc

SEQ ID NO: 56205 - DNA, 20 bp, Artificial
  CRISPR gRNA sequence
ctctttccttgttcccaagc

SEQ ID NO: 56206 - DNA, 20 bp, Artificial
  CRISPR gRNA sequence
ctttccttgttcccaagcca

SEQ ID NO: 56207 - DNA, 20 bp, Artificial
  CRISPR gRNA sequence
cttgttcccaagccagagca

SEQ ID NO: 56208 - DNA, 20 bp, Artificial
  CRISPR gRNA sequence
gcacagatatacccatgacg

SEQ ID NO: 56209 - DNA, 20 bp, Artificial
  CRISPR gRNA sequence
atgacgtagctttgactgtg

SEQ ID NO: 56210 - DNA, 20 bp, Artificial
  CRISPR gRNA sequence
cgtagctttgactgtgcaga

SEQ ID NO: 56211 - DNA, 20 bp, Artificial
  CRISPR gRNA sequence
gtagctttgactgtgcagat

SEQ ID NO: 56212 - DNA, 20 bp, Artificial
  CRISPR gRNA sequence
actgtgcagataggattccc

SEQ ID NO: 56213 - DNA, 20 bp, Artificial
  CRISPR gRNA sequence
ctgtgcagataggattccca

SEQ ID NO: 56214 - DNA, 20 bp, Artificial
  CRISPR gRNA sequence
tgtgcagataggattcccaa

SEQ ID NO: 56215 - DNA, 20 bp, Artificial
  CRISPR gRNA sequence
gtgcagataggattcccaag

SEQ ID NO: 56216 - DNA, 20 bp, Artificial
  CRISPR gRNA sequence
taggattcccaaggggataa

SEQ ID NO: 56217 - DNA, 20 bp, Artificial
  CRISPR gRNA sequence
ggattcccaaggggataatg

SEQ ID NO: 56218 - DNA, 20 bp, Artificial
  CRISPR gRNA sequence
aaggggataatggagcaaaa

SEQ ID NO: 56219 - DNA, 20 bp, Artificial
  CRISPR gRNA sequence
aggggataatggagcaaaat

SEQ ID NO: 56220 - DNA, 20 bp, Artificial
  CRISPR gRNA sequence
gggataatggagcaaaatgg

SEQ ID NO: 56221 - DNA, 20 bp, Artificial
  CRISPR gRNA sequence
ggataatggagcaaaatggg

SEQ ID NO: 56222 - DNA, 20 bp, Artificial
  CRISPR gRNA sequence
gataatggagcaaaatggga

SEQ ID NO: 56223 - DNA, 20 bp, Artificial
  CRISPR gRNA sequence
ggagcaaaatgggagggacc

SEQ ID NO: 56224 - DNA, 20 bp, Artificial
  CRISPR gRNA sequence
gagcaaaatgggagggacct

SEQ ID NO: 56225 - DNA, 20 bp, Artificial
  CRISPR gRNA sequence
tgggtacctgcatgactgcg

SEQ ID NO: 56226 - DNA, 20 bp, Artificial
  CRISPR gRNA sequence
ggtacctgcatgactgcgtg

SEQ ID NO: 56227 - DNA, 20 bp, Artificial
  CRISPR gRNA sequence
ctgcatgactgcgtggagct

SEQ ID NO: 56228 - DNA, 20 bp, Artificial
  CRISPR gRNA sequence
gctgagccattccactgacc

SEQ ID NO: 56229 - DNA, 20 bp, Artificial
  CRISPR gRNA sequence
cctacctctgactcttccat

SEQ ID NO: 56230 - DNA, 20 bp, Artificial
  CRISPR gRNA sequence
tacctctgactcttccatga

SEQ ID NO: 56231 - DNA, 20 bp, Artificial
  CRISPR gRNA sequence
cctctgactcttccatgaga

SEQ ID NO: 56232 - DNA, 20 bp, Artificial
  CRISPR gRNA sequence
attatttaacctactgtatt

SEQ ID NO: 56233 - DNA, 20 bp, Artificial
  CRISPR gRNA sequence
ttatttaacctactgtattt

SEQ ID NO: 56234 - DNA, 20 bp, Artificial
  CRISPR gRNA sequence
tatttaacctactgtatttg

SEQ ID NO: 56235 - DNA, 20 bp, Artificial
  CRISPR gRNA sequence
tttaacctactgtatttggg

SEQ ID NO: 56236 - DNA, 20 bp, Artificial
  CRISPR gRNA sequence
ttaacctactgtatttgggg

SEQ ID NO: 56237 - DNA, 20 bp, Artificial
  CRISPR gRNA sequence
aacctactgtatttggggag

SEQ ID NO: 56238 - DNA, 20 bp, Artificial
  CRISPR gRNA sequence
acctactgtatttggggagg

SEQ ID NO: 56239 - DNA, 20 bp, Artificial
  CRISPR gRNA sequence
aggaggtttctctgttactg

SEQ ID NO: 56240 - DNA, 20 bp, Artificial
  CRISPR gRNA sequence
gtttctctgttactgcagcc

SEQ ID NO: 56241 - DNA, 20 bp, Artificial
  CRISPR gRNA sequence
ctgcagcctagccttttctc

SEQ ID NO: 56242 - DNA, 20 bp, Artificial
  CRISPR gRNA sequence
ctctagctaatatgcacact

SEQ ID NO: 56243 - DNA, 20 bp, Artificial
  CRISPR gRNA sequence
actgagcctttgctctgtgc

SEQ ID NO: 56244 - DNA, 20 bp, Artificial
  CRISPR gRNA sequence
ctgagcctttgctctgtgct

SEQ ID NO: 56245 - DNA, 20 bp, Artificial
  CRISPR gRNA sequence
cattcttgcaatgaccatat

SEQ ID NO: 56246 - DNA, 20 bp, Artificial
  CRISPR gRNA sequence
cttgcaatgaccatatgagt

SEQ ID NO: 56247 - DNA, 20 bp, Artificial
  CRISPR gRNA sequence
atatgagttggctattgtta

SEQ ID NO: 56248 - DNA, 20 bp, Artificial
  CRISPR gRNA sequence
ctattgttacagattcgttt

SEQ ID NO: 56249 - DNA, 20 bp, Artificial
  CRISPR gRNA sequence
tattgttacagattcgtttt

SEQ ID NO: 56250 - DNA, 20 bp, Artificial
  CRISPR gRNA sequence
acagattcgttttaggaacg

SEQ ID NO: 56251 - DNA, 20 bp, Artificial
  CRISPR gRNA sequence
ttttaggaacgaagaaactc

SEQ ID NO: 56252 - DNA, 20 bp, Artificial
  CRISPR gRNA sequence
ggaacgaagaaactctggcc

SEQ ID NO: 56253 - DNA, 20 bp, Artificial
  CRISPR gRNA sequence
cgaagaaactctggcctaga

SEQ ID NO: 56254 - DNA, 20 bp, Artificial
  CRISPR gRNA sequence
gtgctccatatacttgccca

SEQ ID NO: 56255 - DNA, 20 bp, Artificial
  CRISPR gRNA sequence
tatacttgcccaaagtccac

SEQ ID NO: 56256 - DNA, 20 bp, Artificial
  CRISPR gRNA sequence
ccaaagtccaccagcctcta

SEQ ID NO: 56257 - DNA, 20 bp, Artificial
  CRISPR gRNA sequence
agtccaccagcctctataga

SEQ ID NO: 56258 - DNA, 20 bp, Artificial
  CRISPR gRNA sequence
accagcctctatagacagcc

SEQ ID NO: 56259 - DNA, 20 bp, Artificial
  CRISPR gRNA sequence
ctatagacagcctggatctg

SEQ ID NO: 56260 - DNA, 20 bp, Artificial
  CRISPR gRNA sequence
acagcctggatctgtggttt

SEQ ID NO: 56261 - DNA, 20 bp, Artificial
  CRISPR gRNA sequence
tggtttcagcccatgattga

SEQ ID NO: 56262 - DNA, 20 bp, Artificial
  CRISPR gRNA sequence
gtttcagcccatgattgaca

SEQ ID NO: 56263 - DNA, 20 bp, Artificial
  CRISPR gRNA sequence
ttcagcccatgattgacaga

SEQ ID NO: 56264 - DNA, 20 bp, Artificial
  CRISPR gRNA sequence
ccatgattgacagagagact

SEQ ID NO: 56265 - DNA, 20 bp, Artificial
  CRISPR gRNA sequence
atgattgacagagagactga

SEQ ID NO: 56266 - DNA, 20 bp, Artificial
  CRISPR gRNA sequence
tgacagagagactgagagtc

SEQ ID NO: 56267 - DNA, 20 bp, Artificial
  CRISPR gRNA sequence
gactgagagtccagaaacca

SEQ ID NO: 56268 - DNA, 20 bp, Artificial
  CRISPR gRNA sequence
agagtccagaaaccacagac

SEQ ID NO: 56269 - DNA, 20 bp, Artificial
  CRISPR gRNA sequence
agtccagaaaccacagacaa

SEQ ID NO: 56270 - DNA, 20 bp, Artificial
  CRISPR gRNA sequence
gtccagaaaccacagacaag

SEQ ID NO: 56271 - DNA, 20 bp, Artificial
  CRISPR gRNA sequence
ccagaaaccacagacaagag

SEQ ID NO: 56272 - DNA, 20 bp, Artificial
  CRISPR gRNA sequence
cagaaaccacagacaagagg

SEQ ID NO: 56273 - DNA, 20 bp, Artificial
  CRISPR gRNA sequence
agacaagaggaggatccatt

SEQ ID NO: 56274 - DNA, 20 bp, Artificial
  CRISPR gRNA sequence
aggaggatccatttggactc

SEQ ID NO: 56275 - DNA, 20 bp, Artificial
  CRISPR gRNA sequence
gaggatccatttggactcca

SEQ ID NO: 56276 - DNA, 20 bp, Artificial
  CRISPR gRNA sequence
aggatccatttggactccag

SEQ ID NO: 56277 - DNA, 20 bp, Artificial
  CRISPR gRNA sequence
tggactccagaggtcctgtc

SEQ ID NO: 56278 - DNA, 20 bp, Artificial
  CRISPR gRNA sequence
ggactccagaggtcctgtca

SEQ ID NO: 56279 - DNA, 20 bp, Artificial
  CRISPR gRNA sequence
ccagaggtcctgtcaaggta

SEQ ID NO: 56280 - DNA, 20 bp, Artificial
  CRISPR gRNA sequence
agaggtcctgtcaaggtatg

SEQ ID NO: 56281 - DNA, 20 bp, Artificial
  CRISPR gRNA sequence
gagcttcctctcttgcattg

SEQ ID NO: 56282 - DNA, 20 bp, Artificial
  CRISPR gRNA sequence
agcttcctctcttgcattgc

SEQ ID NO: 56283 - DNA, 20 bp, Artificial
  CRISPR gRNA sequence
gccattatgttctgatattc

SEQ ID NO: 56284 - DNA, 20 bp, Artificial
  CRISPR gRNA sequence
tgatattcaagattcttatc

SEQ ID NO: 56285 - DNA, 20 bp, Artificial
  CRISPR gRNA sequence
agattcttatccagtcctct

SEQ ID NO: 56286 - DNA, 20 bp, Artificial
  CRISPR gRNA sequence
ttcttatccagtcctcttgg

SEQ ID NO: 56287 - DNA, 20 bp, Artificial
  CRISPR gRNA sequence
cttatccagtcctcttggca

SEQ ID NO: 56288 - DNA, 20 bp, Artificial
  CRISPR gRNA sequence
ttatccagtcctcttggcag

SEQ ID NO: 56289 - DNA, 20 bp, Artificial
  CRISPR gRNA sequence
tcctcttggcagaggtttgc

SEQ ID NO: 56290 - DNA, 20 bp, Artificial
  CRISPR gRNA sequence
ttggcagaggtttgctagac

SEQ ID NO: 56291 - DNA, 20 bp, Artificial
  CRISPR gRNA sequence
cagaggtttgctagactggt

SEQ ID NO: 56292 - DNA, 20 bp, Artificial
  CRISPR gRNA sequence
gttggcctctgctcccccaa

SEQ ID NO: 56293 - DNA, 20 bp, Artificial
  CRISPR gRNA sequence
caaaagcccaatcccctccc

SEQ ID NO: 56294 - DNA, 20 bp, Artificial
  CRISPR gRNA sequence
tcctccactcttactcacct

SEQ ID NO: 56295 - DNA, 20 bp, Artificial
  CRISPR gRNA sequence
tgagattctctatctgccca

SEQ ID NO: 56296 - DNA, 20 bp, Artificial
  CRISPR gRNA sequence
tctatctgcccacagcctac

SEQ ID NO: 56297 - DNA, 20 bp, Artificial
  CRISPR gRNA sequence
tatctgcccacagcctacca

SEQ ID NO: 56298 - DNA, 20 bp, Artificial
  CRISPR gRNA sequence
cccacagcctaccagagcct

SEQ ID NO: 56299 - DNA, 20 bp, Artificial
  CRISPR gRNA sequence
ccacagcctaccagagcctc

SEQ ID NO: 56300 - DNA, 20 bp, Artificial
  CRISPR gRNA sequence
cacagcctaccagagcctca

SEQ ID NO: 56301 - DNA, 20 bp, Artificial
  CRISPR gRNA sequence
agcctaccagagcctcaggg

SEQ ID NO: 56302 - DNA, 20 bp, Artificial
  CRISPR gRNA sequence
ctaccagagcctcagggcag

SEQ ID NO: 56303 - DNA, 20 bp, Artificial
  CRISPR gRNA sequence
taccagagcctcagggcagt

SEQ ID NO: 56304 - DNA, 20 bp, Artificial
  CRISPR gRNA sequence
accagagcctcagggcagtg

SEQ ID NO: 56305 - DNA, 20 bp, Artificial
  CRISPR gRNA sequence
gcctcagggcagtggggctc

SEQ ID NO: 56306 - DNA, 20 bp, Artificial
  CRISPR gRNA sequence
cctcagggcagtggggctcc

SEQ ID NO: 56307 - DNA, 20 bp, Artificial
  CRISPR gRNA sequence
ctcagggcagtggggctcca

SEQ ID NO: 56308 - DNA, 20 bp, Artificial
  CRISPR gRNA sequence
tcagggcagtggggctccag

SEQ ID NO: 56309 - DNA, 20 bp, Artificial
  CRISPR gRNA sequence
ggcagtggggctccagggga

SEQ ID NO: 56310 - DNA, 20 bp, Artificial
  CRISPR gRNA sequence
aggggacagccatcaaaatc

SEQ ID NO: 56311 - DNA, 20 bp, Artificial
  CRISPR gRNA sequence
ggggacagccatcaaaatcc

SEQ ID NO: 56312 - DNA, 20 bp, Artificial
  CRISPR gRNA sequence
gacagccatcaaaatccagg

SEQ ID NO: 56313 - DNA, 20 bp, Artificial
  CRISPR gRNA sequence
gccatcaaaatccaggtgga

SEQ ID NO: 56314 - DNA, 20 bp, Artificial
  CRISPR gRNA sequence
ccatcaaaatccaggtggat

SEQ ID NO: 56315 - DNA, 20 bp, Artificial
  CRISPR gRNA sequence
catcaaaatccaggtggatg

SEQ ID NO: 56316 - DNA, 20 bp, Artificial
  CRISPR gRNA sequence
atcaaaatccaggtggatgg

SEQ ID NO: 56317 - DNA, 20 bp, Artificial
  CRISPR gRNA sequence
atgggggcctccctgtgctc

SEQ ID NO: 56318 - DNA, 20 bp, Artificial
  CRISPR gRNA sequence
tgggggcctccctgtgctct

SEQ ID NO: 56319 - DNA, 20 bp, Artificial
  CRISPR gRNA sequence
ctccctgtgctctaggatgt

SEQ ID NO: 56320 - DNA, 20 bp, Artificial
  CRISPR gRNA sequence
ctgtgctctaggatgttggt

SEQ ID NO: 56321 - DNA, 20 bp, Artificial
  CRISPR gRNA sequence
tgtgctctaggatgttggtc

SEQ ID NO: 56322 - DNA, 20 bp, Artificial
  CRISPR gRNA sequence
gtgctctaggatgttggtca

SEQ ID NO: 56323 - DNA, 20 bp, Artificial
  CRISPR gRNA sequence
ctctaggatgttggtcaggg

SEQ ID NO: 56324 - DNA, 20 bp, Artificial
  CRISPR gRNA sequence
aggatgttggtcagggtggc

SEQ ID NO: 56325 - DNA, 20 bp, Artificial
  CRISPR gRNA sequence
ggatgttggtcagggtggcc

SEQ ID NO: 56326 - DNA, 20 bp, Artificial
  CRISPR gRNA sequence
gttggtcagggtggccaggt

SEQ ID NO: 56327 - DNA, 20 bp, Artificial
  CRISPR gRNA sequence
tcagggtggccaggtcggtg

SEQ ID NO: 56328 - DNA, 20 bp, Artificial
  CRISPR gRNA sequence
cagggtggccaggtcggtgc

SEQ ID NO: 56329 - DNA, 20 bp, Artificial
  CRISPR gRNA sequence
gtggccaggtcggtgcaggt

SEQ ID NO: 56330 - DNA, 20 bp, Artificial
  CRISPR gRNA sequence
gccaggtcggtgcaggtcag

SEQ ID NO: 56331 - DNA, 20 bp, Artificial
  CRISPR gRNA sequence
ccaggtcggtgcaggtcagt

SEQ ID NO: 56332 - DNA, 20 bp, Artificial
  CRISPR gRNA sequence
tgcaggtcagtgggaaattg

SEQ ID NO: 56333 - DNA, 20 bp, Artificial
  CRISPR gRNA sequence
aggtcagtgggaaattgtgg

SEQ ID NO: 56334 - DNA, 20 bp, Artificial
  CRISPR gRNA sequence
ggtcagtgggaaattgtgga

SEQ ID NO: 56335 - DNA, 20 bp, Artificial
  CRISPR gRNA sequence
gtcagtgggaaattgtggaa

SEQ ID NO: 56336 - DNA, 20 bp, Artificial
  CRISPR gRNA sequence
agtgggaaattgtggaaggg

SEQ ID NO: 56337 - DNA, 20 bp, Artificial
  CRISPR gRNA sequence
aattgtggaagggcagttga

SEQ ID NO: 56338 - DNA, 20 bp, Artificial
  CRISPR gRNA sequence
attgtggaagggcagttgat

SEQ ID NO: 56339 - DNA, 20 bp, Artificial
  CRISPR gRNA sequence
ttgtggaagggcagttgata

SEQ ID NO: 56340 - DNA, 20 bp, Artificial
  CRISPR gRNA sequence
tgtggaagggcagttgatag

SEQ ID NO: 56341 - DNA, 20 bp, Artificial
  CRISPR gRNA sequence
tggaagggcagttgataggg

SEQ ID NO: 56342 - DNA, 20 bp, Artificial
  CRISPR gRNA sequence
ggaagggcagttgatagggg

SEQ ID NO: 56343 - DNA, 20 bp, Artificial
  CRISPR gRNA sequence
ttgataggggaggctttgtg

SEQ ID NO: 56344 - DNA, 20 bp, Artificial
  CRISPR gRNA sequence
taggggaggctttgtgcggt

SEQ ID NO: 56345 - DNA, 20 bp, Artificial
  CRISPR gRNA sequence
gaggctttgtgcggtgagac

SEQ ID NO: 56346 - DNA, 20 bp, Artificial
  CRISPR gRNA sequence
ctttgtgcggtgagactggc

SEQ ID NO: 56347 - DNA, 20 bp, Artificial
  CRISPR gRNA sequence
tgcggtgagactggccagct

SEQ ID NO: 56348 - DNA, 20 bp, Artificial
  CRISPR gRNA sequence
gcggtgagactggccagctc

SEQ ID NO: 56349 - DNA, 20 bp, Artificial
  CRISPR gRNA sequence
gctcctgtgtctcatccaca

SEQ ID NO: 56350 - DNA, 20 bp, Artificial
  CRISPR gRNA sequence
gtctcatccacacagtgaca

SEQ ID NO: 56351 - DNA, 20 bp, Artificial
  CRISPR gRNA sequence
tgacacagctctacaacctt

SEQ ID NO: 56352 - DNA, 20 bp, Artificial
  CRISPR gRNA sequence
tctacaacctttggccctgt

SEQ ID NO: 56353 - DNA, 20 bp, Artificial
  CRISPR gRNA sequence
cctttggccctgtgagcttg

SEQ ID NO: 56354 - DNA, 20 bp, Artificial
  CRISPR gRNA sequence
ctttggccctgtgagcttgc

SEQ ID NO: 56355 - DNA, 20 bp, Artificial
  CRISPR gRNA sequence
tggccctgtgagcttgcggg

SEQ ID NO: 56356 - DNA, 20 bp, Artificial
  CRISPR gRNA sequence
cttcttcaacacctgcacta

SEQ ID NO: 56357 - DNA, 20 bp, Artificial
  CRISPR gRNA sequence
cttcaacacctgcactacag

SEQ ID NO: 56358 - DNA, 20 bp, Artificial
  CRISPR gRNA sequence
ctgcactacagcagcctgct

SEQ ID NO: 56359 - DNA, 20 bp, Artificial
  CRISPR gRNA sequence
cagcctgcttggcacccaca

SEQ ID NO: 56360 - DNA, 20 bp, Artificial
  CRISPR gRNA sequence
cagtcctcattgccctgcgc

SEQ ID NO: 56361 - DNA, 20 bp, Artificial
  CRISPR gRNA sequence
agtcctcattgccctgcgcc

SEQ ID NO: 56362 - DNA, 20 bp, Artificial
  CRISPR gRNA sequence
cctcattgccctgcgccagg

SEQ ID NO: 56363 - DNA, 20 bp, Artificial
  CRISPR gRNA sequence
ttgccctgcgccaggtggct

SEQ ID NO: 56364 - DNA, 20 bp, Artificial
  CRISPR gRNA sequence
tgccctgcgccaggtggcta

SEQ ID NO: 56365 - DNA, 20 bp, Artificial
  CRISPR gRNA sequence
cctgcgccaggtggctaagg

SEQ ID NO: 56366 - DNA, 20 bp, Artificial
  CRISPR gRNA sequence
ctgcgccaggtggctaagga

SEQ ID NO: 56367 - DNA, 20 bp, Artificial
  CRISPR gRNA sequence
tgcgccaggtggctaaggaa

SEQ ID NO: 56368 - DNA, 20 bp, Artificial
  CRISPR gRNA sequence
gcgccaggtggctaaggaag

SEQ ID NO: 56369 - DNA, 20 bp, Artificial
  CRISPR gRNA sequence
ccaggtggctaaggaagggg

SEQ ID NO: 56370 - DNA, 20 bp, Artificial
  CRISPR gRNA sequence
ggtggctaaggaaggggcgg

SEQ ID NO: 56371 - DNA, 20 bp, Artificial
  CRISPR gRNA sequence
gtggctaaggaaggggcggc

SEQ ID NO: 56372 - DNA, 20 bp, Artificial
  CRISPR gRNA sequence
taaggaaggggcggcaggtg

SEQ ID NO: 56373 - DNA, 20 bp, Artificial
  CRISPR gRNA sequence
aaggaaggggcggcaggtgc

SEQ ID NO: 56374 - DNA, 20 bp, Artificial
  CRISPR gRNA sequence
gggcggcaggtgcaggatgc

SEQ ID NO: 56375 - DNA, 20 bp, Artificial
  CRISPR gRNA sequence
ggcggcaggtgcaggatgcc

SEQ ID NO: 56376 - DNA, 20 bp, Artificial
  CRISPR gRNA sequence
gtgcaggatgccaggcccgc

SEQ ID NO: 56377 - DNA, 20 bp, Artificial
  CRISPR gRNA sequence
tgcaggatgccaggcccgcc

SEQ ID NO: 56378 - DNA, 20 bp, Artificial
  CRISPR gRNA sequence
aggatgccaggcccgccagg

SEQ ID NO: 56379 - DNA, 20 bp, Artificial
  CRISPR gRNA sequence
ggatgccaggcccgccagga

SEQ ID NO: 56380 - DNA, 20 bp, Artificial
  CRISPR gRNA sequence
tgccaggcccgccaggaagg

SEQ ID NO: 56381 - DNA, 20 bp, Artificial
  CRISPR gRNA sequence
gccaggcccgccaggaaggt

SEQ ID NO: 56382 - DNA, 20 bp, Artificial
  CRISPR gRNA sequence
ccaggcccgccaggaaggtg

SEQ ID NO: 56383 - DNA, 20 bp, Artificial
  CRISPR gRNA sequence
aggcccgccaggaaggtggg

SEQ ID NO: 56384 - DNA, 20 bp, Artificial
  CRISPR gRNA sequence
ggcccgccaggaaggtgggg

SEQ ID NO: 56385 - DNA, 20 bp, Artificial
  CRISPR gRNA sequence
ccgccaggaaggtggggagg

SEQ ID NO: 56386 - DNA, 20 bp, Artificial
  CRISPR gRNA sequence
ggaaggtggggaggtggtct

SEQ ID NO: 56387 - DNA, 20 bp, Artificial
  CRISPR gRNA sequence
aaggtggggaggtggtctga

SEQ ID NO: 56388 - DNA, 20 bp, Artificial
  CRISPR gRNA sequence
aggtggggaggtggtctgag

SEQ ID NO: 56389 - DNA, 20 bp, Artificial
  CRISPR gRNA sequence
gggaggtggtctgagaggcc

SEQ ID NO: 56390 - DNA, 20 bp, Artificial
  CRISPR gRNA sequence
gtggtctgagaggcccagtc

SEQ ID NO: 56391 - DNA, 20 bp, Artificial
  CRISPR gRNA sequence
tgagaggcccagtctagctt

SEQ ID NO: 56392 - DNA, 20 bp, Artificial
  CRISPR gRNA sequence
tagctttggtccgctgtacc

SEQ ID NO: 56393 - DNA, 20 bp, Artificial
  CRISPR gRNA sequence
ctttggtccgctgtacccag

SEQ ID NO: 56394 - DNA, 20 bp, Artificial
  CRISPR gRNA sequence
tttggtccgctgtacccagc

SEQ ID NO: 56395 - DNA, 20 bp, Artificial
  CRISPR gRNA sequence
tccgctgtacccagcgggaa

SEQ ID NO: 56396 - DNA, 20 bp, Artificial
  CRISPR gRNA sequence
cgctgtacccagcgggaatg

SEQ ID NO: 56397 - DNA, 20 bp, Artificial
  CRISPR gRNA sequence
gctgtacccagcgggaatgg

SEQ ID NO: 56398 - DNA, 20 bp, Artificial
  CRISPR gRNA sequence
ctgtacccagcgggaatgga

SEQ ID NO: 56399 - DNA, 20 bp, Artificial
  CRISPR gRNA sequence
gggaatggagggtaacatac

SEQ ID NO: 56400 - DNA, 20 bp, Artificial
  CRISPR gRNA sequence
ggaatggagggtaacatact

SEQ ID NO: 56401 - DNA, 20 bp, Artificial
  CRISPR gRNA sequence
tggagggtaacatactgggt

SEQ ID NO: 56402 - DNA, 20 bp, Artificial
  CRISPR gRNA sequence
aagtgtgtctttgttcacct

SEQ ID NO: 56403 - DNA, 20 bp, Artificial
  CRISPR gRNA sequence
agtgtgtctttgttcacctt

SEQ ID NO: 56404 - DNA, 20 bp, Artificial
  CRISPR gRNA sequence
gtgtgtctttgttcaccttg

SEQ ID NO: 56405 - DNA, 20 bp, Artificial
  CRISPR gRNA sequence
gtctttgttcaccttggggc

SEQ ID NO: 56406 - DNA, 20 bp, Artificial
  CRISPR gRNA sequence
ttcaccttggggctggccat

SEQ ID NO: 56407 - DNA, 20 bp, Artificial
  CRISPR gRNA sequence
tcaccttggggctggccatc

SEQ ID NO: 56408 - DNA, 20 bp, Artificial
  CRISPR gRNA sequence
ttggggctggccatcaggtg

SEQ ID NO: 56409 - DNA, 20 bp, Artificial
  CRISPR gRNA sequence
tggggctggccatcaggtgc

SEQ ID NO: 56410 - DNA, 20 bp, Artificial
  CRISPR gRNA sequence
ggggctggccatcaggtgca

SEQ ID NO: 56411 - DNA, 20 bp, Artificial
  CRISPR gRNA sequence
gctggccatcaggtgcaggg

SEQ ID NO: 56412 - DNA, 20 bp, Artificial
  CRISPR gRNA sequence
gccatcaggtgcagggcagc

SEQ ID NO: 56413 - DNA, 20 bp, Artificial
  CRISPR gRNA sequence
agggcagcaagaaactcctg

SEQ ID NO: 56414 - DNA, 20 bp, Artificial
  CRISPR gRNA sequence
gggcagcaagaaactcctgc

SEQ ID NO: 56415 - DNA, 20 bp, Artificial
  CRISPR gRNA sequence
gcaagaaactcctgcaggct

SEQ ID NO: 56416 - DNA, 20 bp, Artificial
  CRISPR gRNA sequence
caagaaactcctgcaggctg

SEQ ID NO: 56417 - DNA, 20 bp, Artificial
  CRISPR gRNA sequence
gaaactcctgcaggctgagg

SEQ ID NO: 56418 - DNA, 20 bp, Artificial
  CRISPR gRNA sequence
aaactcctgcaggctgaggt

SEQ ID NO: 56419 - DNA, 20 bp, Artificial
  CRISPR gRNA sequence
ctgcaggctgaggtgggtga

SEQ ID NO: 56420 - DNA, 20 bp, Artificial
  CRISPR gRNA sequence
ggctgaggtgggtgaaagca

SEQ ID NO: 56421 - DNA, 20 bp, Artificial
  CRISPR gRNA sequence
tgaaagcatagcctgtctgc

SEQ ID NO: 56422 - DNA, 20 bp, Artificial
  CRISPR gRNA sequence
atagcctgtctgctggtgcc

SEQ ID NO: 56423 - DNA, 20 bp, Artificial
  CRISPR gRNA sequence
tagcctgtctgctggtgccc

SEQ ID NO: 56424 - DNA, 20 bp, Artificial
  CRISPR gRNA sequence
agcctgtctgctggtgccca

SEQ ID NO: 56425 - DNA, 20 bp, Artificial
  CRISPR gRNA sequence
gctggtgcccagggcctgtg

SEQ ID NO: 56426 - DNA, 20 bp, Artificial
  CRISPR gRNA sequence
gcccagggcctgtgcagacg

SEQ ID NO: 56427 - DNA, 20 bp, Artificial
  CRISPR gRNA sequence
cagggcctgtgcagacgcag

SEQ ID NO: 56428 - DNA, 20 bp, Artificial
  CRISPR gRNA sequence
agggcctgtgcagacgcaga

SEQ ID NO: 56429 - DNA, 20 bp, Artificial
  CRISPR gRNA sequence
gcctgtgcagacgcagaagg

SEQ ID NO: 56430 - DNA, 20 bp, Artificial
  CRISPR gRNA sequence
gtgcagacgcagaaggaagt

SEQ ID NO: 56431 - DNA, 20 bp, Artificial
  CRISPR gRNA sequence
cagacgcagaaggaagtcag

SEQ ID NO: 56432 - DNA, 20 bp, Artificial
  CRISPR gRNA sequence
agacgcagaaggaagtcagc

SEQ ID NO: 56433 - DNA, 20 bp, Artificial
  CRISPR gRNA sequence
gaaggaagtcagcaggctgt

SEQ ID NO: 56434 - DNA, 20 bp, Artificial
  CRISPR gRNA sequence
ggaagtcagcaggctgtgag

SEQ ID NO: 56435 - DNA, 20 bp, Artificial
  CRISPR gRNA sequence
caggctgtgagtggccccaa

SEQ ID NO: 56436 - DNA, 20 bp, Artificial
  CRISPR gRNA sequence
gagtggccccaaaagctatc

SEQ ID NO: 56437 - DNA, 20 bp, Artificial
  CRISPR gRNA sequence
agtggccccaaaagctatca

SEQ ID NO: 56438 - DNA, 20 bp, Artificial
  CRISPR gRNA sequence
gtggccccaaaagctatcaa

SEQ ID NO: 56439 - DNA, 20 bp, Artificial
  CRISPR gRNA sequence
gccccaaaagctatcaaggg

SEQ ID NO: 56440 - DNA, 20 bp, Artificial
  CRISPR gRNA sequence
cccaaaagctatcaagggtg

SEQ ID NO: 56441 - DNA, 20 bp, Artificial
  CRISPR gRNA sequence
gtggagcaatatcttttgca

SEQ ID NO: 56442 - DNA, 20 bp, Artificial
  CRISPR gRNA sequence
gagcaatatcttttgcatag

SEQ ID NO: 56443 - DNA, 20 bp, Artificial
  CRISPR gRNA sequence
aagataaccttccctgtctc

SEQ ID NO: 56444 - DNA, 20 bp, Artificial
  CRISPR gRNA sequence
agataaccttccctgtctcc

SEQ ID NO: 56445 - DNA, 20 bp, Artificial
  CRISPR gRNA sequence
ttccctgtctccaggcccct

SEQ ID NO: 56446 - DNA, 20 bp, Artificial
  CRISPR gRNA sequence
tccctgtctccaggcccctc

SEQ ID NO: 56447 - DNA, 20 bp, Artificial
  CRISPR gRNA sequence
ccctgtctccaggcccctca

SEQ ID NO: 56448 - DNA, 20 bp, Artificial
  CRISPR gRNA sequence
cccctcagggccacctcccc

SEQ ID NO: 56449 - DNA, 20 bp, Artificial
  CRISPR gRNA sequence
ccctcagggccacctccccc

SEQ ID NO: 56450 - DNA, 20 bp, Artificial
  CRISPR gRNA sequence
agggccacctcccccaggtc

SEQ ID NO: 56451 - DNA, 20 bp, Artificial
  CRISPR gRNA sequence
gccacctcccccaggtccag

SEQ ID NO: 56452 - DNA, 20 bp, Artificial
  CRISPR gRNA sequence
ccacctcccccaggtccagt

SEQ ID NO: 56453 - DNA, 20 bp, Artificial
  CRISPR gRNA sequence
cacctcccccaggtccagta

SEQ ID NO: 56454 - DNA, 20 bp, Artificial
  CRISPR gRNA sequence
cccccaggtccagtagggac

SEQ ID NO: 56455 - DNA, 20 bp, Artificial
  CRISPR gRNA sequence
ccccaggtccagtagggacg

SEQ ID NO: 56456 - DNA, 20 bp, Artificial
  CRISPR gRNA sequence
caggtccagtagggacgagg

SEQ ID NO: 56457 - DNA, 20 bp, Artificial
  CRISPR gRNA sequence
aggtccagtagggacgaggt

SEQ ID NO: 56458 - DNA, 20 bp, Artificial
  CRISPR gRNA sequence
ccagtagggacgaggtgggc

SEQ ID NO: 56459 - DNA, 20 bp, Artificial
  CRISPR gRNA sequence
ggacgaggtgggcaagtgcc

SEQ ID NO: 56460 - DNA, 20 bp, Artificial
  CRISPR gRNA sequence
gacgaggtgggcaagtgccc

SEQ ID NO: 56461 - DNA, 20 bp, Artificial
  CRISPR gRNA sequence
acgaggtgggcaagtgccca

SEQ ID NO: 56462 - DNA, 20 bp, Artificial
  CRISPR gRNA sequence
cgaggtgggcaagtgcccag

SEQ ID NO: 56463 - DNA, 20 bp, Artificial
  CRISPR gRNA sequence
gaggtgggcaagtgcccagg

SEQ ID NO: 56464 - DNA, 20 bp, Artificial
  CRISPR gRNA sequence
aggtgggcaagtgcccaggg

SEQ ID NO: 56465 - DNA, 20 bp, Artificial
  CRISPR gRNA sequence
ggcaagtgcccaggggggct

SEQ ID NO: 56466 - DNA, 20 bp, Artificial
  CRISPR gRNA sequence
gcaagtgcccaggggggctg

SEQ ID NO: 56467 - DNA, 20 bp, Artificial
  CRISPR gRNA sequence
caagtgcccaggggggctga

SEQ ID NO: 56468 - DNA, 20 bp, Artificial
  CRISPR gRNA sequence
tgcccaggggggctgagggc

SEQ ID NO: 56469 - DNA, 20 bp, Artificial
  CRISPR gRNA sequence
gggcgagcaccatctgcata

SEQ ID NO: 56470 - DNA, 20 bp, Artificial
  CRISPR gRNA sequence
gcgagcaccatctgcatata

SEQ ID NO: 56471 - DNA, 20 bp, Artificial
  CRISPR gRNA sequence
caccatctgcatatagagct

SEQ ID NO: 56472 - DNA, 20 bp, Artificial
  CRISPR gRNA sequence
catatagagctgagtcatgt

SEQ ID NO: 56473 - DNA, 20 bp, Artificial
  CRISPR gRNA sequence
atatagagctgagtcatgtt

SEQ ID NO: 56474 - DNA, 20 bp, Artificial
  CRISPR gRNA sequence
tagagctgagtcatgttggg

SEQ ID NO: 56475 - DNA, 20 bp, Artificial
  CRISPR gRNA sequence
agagctgagtcatgttgggc

SEQ ID NO: 56476 - DNA, 20 bp, Artificial
  CRISPR gRNA sequence
agctgagtcatgttgggcag

SEQ ID NO: 56477 - DNA, 20 bp, Artificial
  CRISPR gRNA sequence
gctgagtcatgttgggcagg

SEQ ID NO: 56478 - DNA, 20 bp, Artificial
  CRISPR gRNA sequence
ctgagtcatgttgggcagga

SEQ ID NO: 56479 - DNA, 20 bp, Artificial
  CRISPR gRNA sequence
catgttgggcaggagggcca

SEQ ID NO: 56480 - DNA, 20 bp, Artificial
  CRISPR gRNA sequence
tgggcaggagggccacagac

SEQ ID NO: 56481 - DNA, 20 bp, Artificial
  CRISPR gRNA sequence
aggagggccacagactggcc

SEQ ID NO: 56482 - DNA, 20 bp, Artificial
  CRISPR gRNA sequence
ggagggccacagactggcct

SEQ ID NO: 56483 - DNA, 20 bp, Artificial
  CRISPR gRNA sequence
gagggccacagactggcctg

SEQ ID NO: 56484 - DNA, 20 bp, Artificial
  CRISPR gRNA sequence
ccacagactggcctggggcg

SEQ ID NO: 56485 - DNA, 20 bp, Artificial
  CRISPR gRNA sequence
agactggcctggggcgtggt

SEQ ID NO: 56486 - DNA, 20 bp, Artificial
  CRISPR gRNA sequence
gactggcctggggcgtggtc

SEQ ID NO: 56487 - DNA, 20 bp, Artificial
  CRISPR gRNA sequence
tggcctggggcgtggtcagg

SEQ ID NO: 56488 - DNA, 20 bp, Artificial
  CRISPR gRNA sequence
cctggggcgtggtcaggaag

SEQ ID NO: 56489 - DNA, 20 bp, Artificial
  CRISPR gRNA sequence
gggcgtggtcaggaagcaga

SEQ ID NO: 56490 - DNA, 20 bp, Artificial
  CRISPR gRNA sequence
cgtggtcaggaagcagatgg

SEQ ID NO: 56491 - DNA, 20 bp, Artificial
  CRISPR gRNA sequence
tggtcaggaagcagatggtg

SEQ ID NO: 56492 - DNA, 20 bp, Artificial
  CRISPR gRNA sequence
ggtcaggaagcagatggtgg

SEQ ID NO: 56493 - DNA, 20 bp, Artificial
  CRISPR gRNA sequence
caggaagcagatggtggagg

SEQ ID NO: 56494 - DNA, 20 bp, Artificial
  CRISPR gRNA sequence
ggaagcagatggtggaggca

SEQ ID NO: 56495 - DNA, 20 bp, Artificial
  CRISPR gRNA sequence
gcagatggtggaggcagaga

SEQ ID NO: 56496 - DNA, 20 bp, Artificial
  CRISPR gRNA sequence
cagatggtggaggcagagac

SEQ ID NO: 56497 - DNA, 20 bp, Artificial
  CRISPR gRNA sequence
ggaggcagagacaggcgact

SEQ ID NO: 56498 - DNA, 20 bp, Artificial
  CRISPR gRNA sequence
cagagacaggcgacttggca

SEQ ID NO: 56499 - DNA, 20 bp, Artificial
  CRISPR gRNA sequence
acaggcgacttggcacagtg

SEQ ID NO: 56500 - DNA, 20 bp, Artificial
  CRISPR gRNA sequence
caggcgacttggcacagtgc

SEQ ID NO: 56501 - DNA, 20 bp, Artificial
  CRISPR gRNA sequence
cacagtgcgggcaccgcaca

SEQ ID NO: 56502 - DNA, 20 bp, Artificial
  CRISPR gRNA sequence
acagtgcgggcaccgcacac

SEQ ID NO: 56503 - DNA, 20 bp, Artificial
  CRISPR gRNA sequence
cgggcaccgcacacaggctt

SEQ ID NO: 56504 - DNA, 20 bp, Artificial
  CRISPR gRNA sequence
ggcaccgcacacaggcttcg

SEQ ID NO: 56505 - DNA, 20 bp, Artificial
  CRISPR gRNA sequence
ccatttgtctgtaactccac

SEQ ID NO: 56506 - DNA, 20 bp, Artificial
  CRISPR gRNA sequence
catttgtctgtaactccacc

SEQ ID NO: 56507 - DNA, 20 bp, Artificial
  CRISPR gRNA sequence
atttgtctgtaactccacca

SEQ ID NO: 56508 - DNA, 20 bp, Artificial
  CRISPR gRNA sequence
accagggccccctcccgcga

SEQ ID NO: 56509 - DNA, 20 bp, Artificial
  CRISPR gRNA sequence
gggccccctcccgcgatggc

SEQ ID NO: 56510 - DNA, 20 bp, Artificial
  CRISPR gRNA sequence
ggccccctcccgcgatggct

SEQ ID NO: 56511 - DNA, 20 bp, Artificial
  CRISPR gRNA sequence
cccgcgatggctgggcgctg

SEQ ID NO: 56512 - DNA, 20 bp, Artificial
  CRISPR gRNA sequence
gcgatggctgggcgctgaag

SEQ ID NO: 56513 - DNA, 20 bp, Artificial
  CRISPR gRNA sequence
ttcacatattcttccacccg

SEQ ID NO: 56514 - DNA, 20 bp, Artificial
  CRISPR gRNA sequence
cttccacccgtggcccatca

SEQ ID NO: 56515 - DNA, 20 bp, Artificial
  CRISPR gRNA sequence
gcccatcaaagcccaacatg

SEQ ID NO: 56516 - DNA, 20 bp, Artificial
  CRISPR gRNA sequence
aaagcccaacatgtggacca

SEQ ID NO: 56517 - DNA, 20 bp, Artificial
  CRISPR gRNA sequence
gtggaccatggctgcctctg

SEQ ID NO: 56518 - DNA, 20 bp, Artificial
  CRISPR gRNA sequence
tggaccatggctgcctctgc

SEQ ID NO: 56519 - DNA, 20 bp, Artificial
  CRISPR gRNA sequence
accatggctgcctctgcagg

SEQ ID NO: 56520 - DNA, 20 bp, Artificial
  CRISPR gRNA sequence
ccatggctgcctctgcaggc

SEQ ID NO: 56521 - DNA, 20 bp, Artificial
  CRISPR gRNA sequence
tggctgcctctgcaggcagg

SEQ ID NO: 56522 - DNA, 20 bp, Artificial
  CRISPR gRNA sequence
ggctgcctctgcaggcaggc

SEQ ID NO: 56523 - DNA, 20 bp, Artificial
  CRISPR gRNA sequence
tgcctctgcaggcaggcagg

SEQ ID NO: 56524 - DNA, 20 bp, Artificial
  CRISPR gRNA sequence
gcctctgcaggcaggcaggc

SEQ ID NO: 56525 - DNA, 20 bp, Artificial
  CRISPR gRNA sequence
tctgcaggcaggcaggcagg

SEQ ID NO: 56526 - DNA, 20 bp, Artificial
  CRISPR gRNA sequence
aggcaggcaggcagcttccc

SEQ ID NO: 56527 - DNA, 20 bp, Artificial
  CRISPR gRNA sequence
aggcaggcagcttccctgga

SEQ ID NO: 56528 - DNA, 20 bp, Artificial
  CRISPR gRNA sequence
ggcaggcagcttccctggac

SEQ ID NO: 56529 - DNA, 20 bp, Artificial
  CRISPR gRNA sequence
caggcagcttccctggacgg

SEQ ID NO: 56530 - DNA, 20 bp, Artificial
  CRISPR gRNA sequence
aggcagcttccctggacggg

SEQ ID NO: 56531 - DNA, 20 bp, Artificial
  CRISPR gRNA sequence
cagcttccctggacgggagg

SEQ ID NO: 56532 - DNA, 20 bp, Artificial
  CRISPR gRNA sequence
gacgggaggtagccatcacc

SEQ ID NO: 56533 - DNA, 20 bp, Artificial
  CRISPR gRNA sequence
gggaggtagccatcacccgg

SEQ ID NO: 56534 - DNA, 20 bp, Artificial
  CRISPR gRNA sequence
ggtagccatcacccggcagc

SEQ ID NO: 56535 - DNA, 20 bp, Artificial
  CRISPR gRNA sequence
gtagccatcacccggcagcc

SEQ ID NO: 56536 - DNA, 20 bp, Artificial
  CRISPR gRNA sequence
gccatcacccggcagccagg

SEQ ID NO: 56537 - DNA, 20 bp, Artificial
  CRISPR gRNA sequence
ccatcacccggcagccaggc

SEQ ID NO: 56538 - DNA, 20 bp, Artificial
  CRISPR gRNA sequence
atcacccggcagccaggcag

SEQ ID NO: 56539 - DNA, 20 bp, Artificial
  CRISPR gRNA sequence
tcacccggcagccaggcagg

SEQ ID NO: 56540 - DNA, 20 bp, Artificial
  CRISPR gRNA sequence
cacccggcagccaggcagga

SEQ ID NO: 56541 - DNA, 20 bp, Artificial
  CRISPR gRNA sequence
caggcaggagggtcccattg

SEQ ID NO: 56542 - DNA, 20 bp, Artificial
  CRISPR gRNA sequence
ggcaggagggtcccattgca

SEQ ID NO: 56543 - DNA, 20 bp, Artificial
  CRISPR gRNA sequence
ggagggtcccattgcagaga

SEQ ID NO: 56544 - DNA, 20 bp, Artificial
  CRISPR gRNA sequence
gagggtcccattgcagagat

SEQ ID NO: 56545 - DNA, 20 bp, Artificial
  CRISPR gRNA sequence
gggtcccattgcagagatgg

SEQ ID NO: 56546 - DNA, 20 bp, Artificial
  CRISPR gRNA sequence
ccattgcagagatgggagaa

SEQ ID NO: 56547 - DNA, 20 bp, Artificial
  CRISPR gRNA sequence
cattgcagagatgggagaaa

SEQ ID NO: 56548 - DNA, 20 bp, Artificial
  CRISPR gRNA sequence
attgcagagatgggagaaaa

SEQ ID NO: 56549 - DNA, 20 bp, Artificial
  CRISPR gRNA sequence
cagagatgggagaaaagggt

SEQ ID NO: 56550 - DNA, 20 bp, Artificial
  CRISPR gRNA sequence
agagatgggagaaaagggtg

SEQ ID NO: 56551 - DNA, 20 bp, Artificial
  CRISPR gRNA sequence
tgggagaaaagggtgaggac

SEQ ID NO: 56552 - DNA, 20 bp, Artificial
  CRISPR gRNA sequence
gggagaaaagggtgaggact

SEQ ID NO: 56553 - DNA, 20 bp, Artificial
  CRISPR gRNA sequence
aaaagggtgaggactgggcc

SEQ ID NO: 56554 - DNA, 20 bp, Artificial
  CRISPR gRNA sequence
aaagggtgaggactgggcct

SEQ ID NO: 56555 - DNA, 20 bp, Artificial
  CRISPR gRNA sequence
gaggactgggcctgggccat

SEQ ID NO: 56556 - DNA, 20 bp, Artificial
  CRISPR gRNA sequence
aggactgggcctgggccatc

SEQ ID NO: 56557 - DNA, 20 bp, Artificial
  CRISPR gRNA sequence
gcctgggccatcaggaccca

SEQ ID NO: 56558 - DNA, 20 bp, Artificial
  CRISPR gRNA sequence
cctgggccatcaggacccat

SEQ ID NO: 56559 - DNA, 20 bp, Artificial
  CRISPR gRNA sequence
ggccatcaggacccataggc

SEQ ID NO: 56560 - DNA, 20 bp, Artificial
  CRISPR gRNA sequence
ccatcaggacccataggctg

SEQ ID NO: 56561 - DNA, 20 bp, Artificial
  CRISPR gRNA sequence
catcaggacccataggctgg

SEQ ID NO: 56562 - DNA, 20 bp, Artificial
  CRISPR gRNA sequence
atcaggacccataggctgga

SEQ ID NO: 56563 - DNA, 20 bp, Artificial
  CRISPR gRNA sequence
ataggctggagggcctcatc

SEQ ID NO: 56564 - DNA, 20 bp, Artificial
  CRISPR gRNA sequence
gggcctcatctagcccatca

SEQ ID NO: 56565 - DNA, 20 bp, Artificial
  CRISPR gRNA sequence
tcatctagcccatcaaagat

SEQ ID NO: 56566 - DNA, 20 bp, Artificial
  CRISPR gRNA sequence
tctagcccatcaaagatcag

SEQ ID NO: 56567 - DNA, 20 bp, Artificial
  CRISPR gRNA sequence
ctagcccatcaaagatcagc

SEQ ID NO: 56568 - DNA, 20 bp, Artificial
  CRISPR gRNA sequence
catcaaagatcagcaggact

SEQ ID NO: 56569 - DNA, 20 bp, Artificial
  CRISPR gRNA sequence
aaagatcagcaggacttggt

SEQ ID NO: 56570 - DNA, 20 bp, Artificial
  CRISPR gRNA sequence
acttggtcagcgttcttctc

SEQ ID NO: 56571 - DNA, 20 bp, Artificial
  CRISPR gRNA sequence
cttggtcagcgttcttctcc

SEQ ID NO: 56572 - DNA, 20 bp, Artificial
  CRISPR gRNA sequence
cagcgttcttctccaggtac

SEQ ID NO: 56573 - DNA, 20 bp, Artificial
  CRISPR gRNA sequence
cgttcttctccaggtactgg

SEQ ID NO: 56574 - DNA, 20 bp, Artificial
  CRISPR gRNA sequence
cttctccaggtactggaaga

SEQ ID NO: 56575 - DNA, 20 bp, Artificial
  CRISPR gRNA sequence
ggtactggaagacagtgtcg

SEQ ID NO: 56576 - DNA, 20 bp, Artificial
  CRISPR gRNA sequence
gacagtgtcgtggtccgatt

SEQ ID NO: 56577 - DNA, 20 bp, Artificial
  CRISPR gRNA sequence
acagtgtcgtggtccgattc

SEQ ID NO: 56578 - DNA, 20 bp, Artificial
  CRISPR gRNA sequence
cagtgtcgtggtccgattca

SEQ ID NO: 56579 - DNA, 20 bp, Artificial
  CRISPR gRNA sequence
tcgtggtccgattcagggct

SEQ ID NO: 56580 - DNA, 20 bp, Artificial
  CRISPR gRNA sequence
cgtggtccgattcagggctc

SEQ ID NO: 56581 - DNA, 20 bp, Artificial
  CRISPR gRNA sequence
tccgattcagggctcaggta

SEQ ID NO: 56582 - DNA, 20 bp, Artificial
  CRISPR gRNA sequence
gggctcaggtacagatcaaa

SEQ ID NO: 56583 - DNA, 20 bp, Artificial
  CRISPR gRNA sequence
ggctcaggtacagatcaaaa

SEQ ID NO: 56584 - DNA, 20 bp, Artificial
  CRISPR gRNA sequence
ctcaggtacagatcaaaaag

SEQ ID NO: 56585 - DNA, 20 bp, Artificial
  CRISPR gRNA sequence
gtacagatcaaaaaggagct

SEQ ID NO: 56586 - DNA, 20 bp, Artificial
  CRISPR gRNA sequence
agatcaaaaaggagctcgga

SEQ ID NO: 56587 - DNA, 20 bp, Artificial
  CRISPR gRNA sequence
aaaaggagctcggacggtgt

SEQ ID NO: 56588 - DNA, 20 bp, Artificial
  CRISPR gRNA sequence
aaaggagctcggacggtgtc

SEQ ID NO: 56589 - DNA, 20 bp, Artificial
  CRISPR gRNA sequence
gtgtcaggaacctcgtgatc

SEQ ID NO: 56590 - DNA, 20 bp, Artificial
  CRISPR gRNA sequence
aggaacctcgtgatcaagtt

SEQ ID NO: 56591 - DNA, 20 bp, Artificial
  CRISPR gRNA sequence
acctcgtgatcaagttgagc

SEQ ID NO: 56592 - DNA, 20 bp, Artificial
  CRISPR gRNA sequence
tcgtgatcaagttgagctgg

SEQ ID NO: 56593 - DNA, 20 bp, Artificial
  CRISPR gRNA sequence
ttgagctggcggaattcaaa

SEQ ID NO: 56594 - DNA, 20 bp, Artificial
  CRISPR gRNA sequence
tgagctggcggaattcaaaa

SEQ ID NO: 56595 - DNA, 20 bp, Artificial
  CRISPR gRNA sequence
tggcggaattcaaaaaggaa

SEQ ID NO: 56596 - DNA, 20 bp, Artificial
  CRISPR gRNA sequence
ggcggaattcaaaaaggaac

SEQ ID NO: 56597 - DNA, 20 bp, Artificial
  CRISPR gRNA sequence
gcggaattcaaaaaggaaca

SEQ ID NO: 56598 - DNA, 20 bp, Artificial
  CRISPR gRNA sequence
attcaaaaaggaacagggcc

SEQ ID NO: 56599 - DNA, 20 bp, Artificial
  CRISPR gRNA sequence
aaaggaacagggcctggaaa

SEQ ID NO: 56600 - DNA, 20 bp, Artificial
  CRISPR gRNA sequence
aacagggcctggaaacagtt

SEQ ID NO: 56601 - DNA, 20 bp, Artificial
  CRISPR gRNA sequence
gggcctggaaacagttcaga

SEQ ID NO: 56602 - DNA, 20 bp, Artificial
  CRISPR gRNA sequence
gatggccctctgcccacttc

SEQ ID NO: 56603 - DNA, 20 bp, Artificial
  CRISPR gRNA sequence
ggccctctgcccacttctgg

SEQ ID NO: 56604 - DNA, 20 bp, Artificial
  CRISPR gRNA sequence
ccctctgcccacttctggca

SEQ ID NO: 56605 - DNA, 20 bp, Artificial
  CRISPR gRNA sequence
ctgcccacttctggcagagc

SEQ ID NO: 56606 - DNA, 20 bp, Artificial
  CRISPR gRNA sequence
cccacttctggcagagccgg

SEQ ID NO: 56607 - DNA, 20 bp, Artificial
  CRISPR gRNA sequence
ccacttctggcagagccggt

SEQ ID NO: 56608 - DNA, 20 bp, Artificial
  CRISPR gRNA sequence
ttctggcagagccggtgggc

SEQ ID NO: 56609 - DNA, 20 bp, Artificial
  CRISPR gRNA sequence
gcagagccggtgggccagcg

SEQ ID NO: 56610 - DNA, 20 bp, Artificial
  CRISPR gRNA sequence
cagcgtggtcttgcccatgc

SEQ ID NO: 56611 - DNA, 20 bp, Artificial
  CRISPR gRNA sequence
cccatgccagccttccccaa

SEQ ID NO: 56612 - DNA, 20 bp, Artificial
  CRISPR gRNA sequence
gccagccttccccaaaagca

SEQ ID NO: 56613 - DNA, 20 bp, Artificial
  CRISPR gRNA sequence
cccaaaagcacggtcaccct

SEQ ID NO: 56614 - DNA, 20 bp, Artificial
  CRISPR gRNA sequence
ccaaaagcacggtcaccctc

SEQ ID NO: 56615 - DNA, 20 bp, Artificial
  CRISPR gRNA sequence
cctcgggcccttgttaaccc

SEQ ID NO: 56616 - DNA, 20 bp, Artificial
  CRISPR gRNA sequence
ccttgttaaccctggtgttg

SEQ ID NO: 56617 - DNA, 20 bp, Artificial
  CRISPR gRNA sequence
ttgttaaccctggtgttgaa

SEQ ID NO: 56618 - DNA, 20 bp, Artificial
  CRISPR gRNA sequence
tgttaaccctggtgttgaag

SEQ ID NO: 56619 - DNA, 20 bp, Artificial
  CRISPR gRNA sequence
ccctggtgttgaagaggtcc

SEQ ID NO: 56620 - DNA, 20 bp, Artificial
  CRISPR gRNA sequence
gaggtccgagatgctcacgt

SEQ ID NO: 56621 - DNA, 20 bp, Artificial
  CRISPR gRNA sequence
caccttgacgtcccccataa

SEQ ID NO: 56622 - DNA, 20 bp, Artificial
  CRISPR gRNA sequence
tcccccataatggccccctc

SEQ ID NO: 56623 - DNA, 20 bp, Artificial
  CRISPR gRNA sequence
ccccataatggccccctccg

SEQ ID NO: 56624 - DNA, 20 bp, Artificial
  CRISPR gRNA sequence
tggccccctccggagtgtct

SEQ ID NO: 56625 - DNA, 20 bp, Artificial
  CRISPR gRNA sequence
ggccccctccggagtgtcta

SEQ ID NO: 56626 - DNA, 20 bp, Artificial
  CRISPR gRNA sequence
cggagtgtctaaggatgctg

SEQ ID NO: 56627 - DNA, 20 bp, Artificial
  CRISPR gRNA sequence
tgtctaaggatgctgtggcc

SEQ ID NO: 56628 - DNA, 20 bp, Artificial
  CRISPR gRNA sequence
aaggatgctgtggcccggcg

SEQ ID NO: 56629 - DNA, 20 bp, Artificial
  CRISPR gRNA sequence
aggatgctgtggcccggcgc

SEQ ID NO: 56630 - DNA, 20 bp, Artificial
  CRISPR gRNA sequence
gctgtggcccggcgcaggat

SEQ ID NO: 56631 - DNA, 20 bp, Artificial
  CRISPR gRNA sequence
tgtggcccggcgcaggattg

SEQ ID NO: 56632 - DNA, 20 bp, Artificial
  CRISPR gRNA sequence
gtggcccggcgcaggattgg

SEQ ID NO: 56633 - DNA, 20 bp, Artificial
  CRISPR gRNA sequence
tggcccggcgcaggattgga

SEQ ID NO: 56634 - DNA, 20 bp, Artificial
  CRISPR gRNA sequence
ggcgcaggattggagggaca

SEQ ID NO: 56635 - DNA, 20 bp, Artificial
  CRISPR gRNA sequence
ggattggagggacatagacc

SEQ ID NO: 56636 - DNA, 20 bp, Artificial
  CRISPR gRNA sequence
ttggagggacatagacctgg

SEQ ID NO: 56637 - DNA, 20 bp, Artificial
  CRISPR gRNA sequence
gagggacatagacctggtgg

SEQ ID NO: 56638 - DNA, 20 bp, Artificial
  CRISPR gRNA sequence
agggacatagacctggtgga

SEQ ID NO: 56639 - DNA, 20 bp, Artificial
  CRISPR gRNA sequence
catagacctggtggaaggcg

SEQ ID NO: 56640 - DNA, 20 bp, Artificial
  CRISPR gRNA sequence
atagacctggtggaaggcgt

SEQ ID NO: 56641 - DNA, 20 bp, Artificial
  CRISPR gRNA sequence
tagacctggtggaaggcgtg

SEQ ID NO: 56642 - DNA, 20 bp, Artificial
  CRISPR gRNA sequence
ggcgtggggctgccctgacc

SEQ ID NO: 56643 - DNA, 20 bp, Artificial
  CRISPR gRNA sequence
gcgtggggctgccctgaccc

SEQ ID NO: 56644 - DNA, 20 bp, Artificial
  CRISPR gRNA sequence
cgtggggctgccctgaccca

SEQ ID NO: 56645 - DNA, 20 bp, Artificial
  CRISPR gRNA sequence
gctgccctgacccagggatt

SEQ ID NO: 56646 - DNA, 20 bp, Artificial
  CRISPR gRNA sequence
acccagggatttggctcctg

SEQ ID NO: 56647 - DNA, 20 bp, Artificial
  CRISPR gRNA sequence
tttggctcctgtagcgctgc

SEQ ID NO: 56648 - DNA, 20 bp, Artificial
  CRISPR gRNA sequence
ttggctcctgtagcgctgct

SEQ ID NO: 56649 - DNA, 20 bp, Artificial
  CRISPR gRNA sequence
gctcctgtagcgctgctggg

SEQ ID NO: 56650 - DNA, 20 bp, Artificial
  CRISPR gRNA sequence
tcctgtagcgctgctgggca

SEQ ID NO: 56651 - DNA, 20 bp, Artificial
  CRISPR gRNA sequence
cctgtagcgctgctgggcag

SEQ ID NO: 56652 - DNA, 20 bp, Artificial
  CRISPR gRNA sequence
cgctgctgggcagaggtccg

SEQ ID NO: 56653 - DNA, 20 bp, Artificial
  CRISPR gRNA sequence
gctgctgggcagaggtccgc

SEQ ID NO: 56654 - DNA, 20 bp, Artificial
  CRISPR gRNA sequence
tgctgggcagaggtccgcag

SEQ ID NO: 56655 - DNA, 20 bp, Artificial
  CRISPR gRNA sequence
gcagaggtccgcaggagctg

SEQ ID NO: 56656 - DNA, 20 bp, Artificial
  CRISPR gRNA sequence
cagaggtccgcaggagctgc

SEQ ID NO: 56657 - DNA, 20 bp, Artificial
  CRISPR gRNA sequence
caggagctgcaggtacttct

SEQ ID NO: 56658 - DNA, 20 bp, Artificial
  CRISPR gRNA sequence
tacttcttggccaactctgc

SEQ ID NO: 56659 - DNA, 20 bp, Artificial
  CRISPR gRNA sequence
acttcttggccaactctgca

SEQ ID NO: 56660 - DNA, 20 bp, Artificial
  CRISPR gRNA sequence
cttcttggccaactctgcaa

SEQ ID NO: 56661 - DNA, 20 bp, Artificial
  CRISPR gRNA sequence
ttcttggccaactctgcaag

SEQ ID NO: 56662 - DNA, 20 bp, Artificial
  CRISPR gRNA sequence
ttggccaactctgcaagggg

SEQ ID NO: 56663 - DNA, 20 bp, Artificial
  CRISPR gRNA sequence
tggccaactctgcaaggggc

SEQ ID NO: 56664 - DNA, 20 bp, Artificial
  CRISPR gRNA sequence
ggccaactctgcaaggggca

SEQ ID NO: 56665 - DNA, 20 bp, Artificial
  CRISPR gRNA sequence
ctctgcaaggggcagggaca

SEQ ID NO: 56666 - DNA, 20 bp, Artificial
  CRISPR gRNA sequence
aaggggcagggacatggcat

SEQ ID NO: 56667 - DNA, 20 bp, Artificial
  CRISPR gRNA sequence
aggggcagggacatggcatg

SEQ ID NO: 56668 - DNA, 20 bp, Artificial
  CRISPR gRNA sequence
gggcagggacatggcatgag

SEQ ID NO: 56669 - DNA, 20 bp, Artificial
  CRISPR gRNA sequence
gcagggacatggcatgagga

SEQ ID NO: 56670 - DNA, 20 bp, Artificial
  CRISPR gRNA sequence
cagggacatggcatgaggag

SEQ ID NO: 56671 - DNA, 20 bp, Artificial
  CRISPR gRNA sequence
ggcatgaggagaggaccccc

SEQ ID NO: 56672 - DNA, 20 bp, Artificial
  CRISPR gRNA sequence
ctgctcatgtcttcttgccc

SEQ ID NO: 56673 - DNA, 20 bp, Artificial
  CRISPR gRNA sequence
atgtcttcttgccccagtat

SEQ ID NO: 56674 - DNA, 20 bp, Artificial
  CRISPR gRNA sequence
tgtcttcttgccccagtatt

SEQ ID NO: 56675 - DNA, 20 bp, Artificial
  CRISPR gRNA sequence
ttgccccagtattgggctgt

SEQ ID NO: 56676 - DNA, 20 bp, Artificial
  CRISPR gRNA sequence
tgccccagtattgggctgtt

SEQ ID NO: 56677 - DNA, 20 bp, Artificial
  CRISPR gRNA sequence
ccccagtattgggctgttgg

SEQ ID NO: 56678 - DNA, 20 bp, Artificial
  CRISPR gRNA sequence
attgggctgttgggagcctg

SEQ ID NO: 56679 - DNA, 20 bp, Artificial
  CRISPR gRNA sequence
ctgttgggagcctgtagccc

SEQ ID NO: 56680 - DNA, 20 bp, Artificial
  CRISPR gRNA sequence
ccccagatgtgtatgtatga

SEQ ID NO: 56681 - DNA, 20 bp, Artificial
  CRISPR gRNA sequence
cccagatgtgtatgtatgat

SEQ ID NO: 56682 - DNA, 20 bp, Artificial
  CRISPR gRNA sequence
ccagatgtgtatgtatgatg

SEQ ID NO: 56683 - DNA, 20 bp, Artificial
  CRISPR gRNA sequence
atgtgtatgtatgatggggt

SEQ ID NO: 56684 - DNA, 20 bp, Artificial
  CRISPR gRNA sequence
tgtgtatgtatgatggggtg

SEQ ID NO: 56685 - DNA, 20 bp, Artificial
  CRISPR gRNA sequence
gtgtatgtatgatggggtga

SEQ ID NO: 56686 - DNA, 20 bp, Artificial
  CRISPR gRNA sequence
tatgtatgatggggtgaggg

SEQ ID NO: 56687 - DNA, 20 bp, Artificial
  CRISPR gRNA sequence
atgtatgatggggtgagggt

SEQ ID NO: 56688 - DNA, 20 bp, Artificial
  CRISPR gRNA sequence
tgtatgatggggtgagggtg

SEQ ID NO: 56689 - DNA, 20 bp, Artificial
  CRISPR gRNA sequence
gtatgatggggtgagggtgg

SEQ ID NO: 56690 - DNA, 20 bp, Artificial
  CRISPR gRNA sequence
ggggtgagggtgggggtgtc

SEQ ID NO: 56691 - DNA, 20 bp, Artificial
  CRISPR gRNA sequence
ggtgagggtgggggtgtcaa

SEQ ID NO: 56692 - DNA, 20 bp, Artificial
  CRISPR gRNA sequence
tgggggtgtcaagagcacca

SEQ ID NO: 56693 - DNA, 20 bp, Artificial
  CRISPR gRNA sequence
gggggtgtcaagagcaccat

SEQ ID NO: 56694 - DNA, 20 bp, Artificial
  CRISPR gRNA sequence
ggggtgtcaagagcaccata

SEQ ID NO: 56695 - DNA, 20 bp, Artificial
  CRISPR gRNA sequence
gggtgtcaagagcaccatag

SEQ ID NO: 56696 - DNA, 20 bp, Artificial
  CRISPR gRNA sequence
ggtgtcaagagcaccatagg

SEQ ID NO: 56697 - DNA, 20 bp, Artificial
  CRISPR gRNA sequence
atctgtgccaccccaacttc

SEQ ID NO: 56698 - DNA, 20 bp, Artificial
  CRISPR gRNA sequence
tgtgccaccccaacttccag

SEQ ID NO: 56699 - DNA, 20 bp, Artificial
  CRISPR gRNA sequence
gtgccaccccaacttccaga

SEQ ID NO: 56700 - DNA, 20 bp, Artificial
  CRISPR gRNA sequence
ccccaacttccagaaggaat

SEQ ID NO: 56701 - DNA, 20 bp, Artificial
  CRISPR gRNA sequence
ttccagaaggaatcagttct

SEQ ID NO: 56702 - DNA, 20 bp, Artificial
  CRISPR gRNA sequence
tccagaaggaatcagttcta

SEQ ID NO: 56703 - DNA, 20 bp, Artificial
  CRISPR gRNA sequence
ccagaaggaatcagttctaa

SEQ ID NO: 56704 - DNA, 20 bp, Artificial
  CRISPR gRNA sequence
agaaggaatcagttctaagg

SEQ ID NO: 56705 - DNA, 20 bp, Artificial
  CRISPR gRNA sequence
gaatcagttctaagggagca

SEQ ID NO: 56706 - DNA, 20 bp, Artificial
  CRISPR gRNA sequence
aatcagttctaagggagcat

SEQ ID NO: 56707 - DNA, 20 bp, Artificial
  CRISPR gRNA sequence
ctaagggagcataggctctc

SEQ ID NO: 56708 - DNA, 20 bp, Artificial
  CRISPR gRNA sequence
agggagcataggctctccgg

SEQ ID NO: 56709 - DNA, 20 bp, Artificial
  CRISPR gRNA sequence
ctctccggtagctatttaaa

SEQ ID NO: 56710 - DNA, 20 bp, Artificial
  CRISPR gRNA sequence
tctccggtagctatttaaac

SEQ ID NO: 56711 - DNA, 20 bp, Artificial
  CRISPR gRNA sequence
ccggtagctatttaaacagg

SEQ ID NO: 56712 - DNA, 20 bp, Artificial
  CRISPR gRNA sequence
cggtagctatttaaacaggc

SEQ ID NO: 56713 - DNA, 20 bp, Artificial
  CRISPR gRNA sequence
tagctatttaaacaggcagg

SEQ ID NO: 56714 - DNA, 20 bp, Artificial
  CRISPR gRNA sequence
agctatttaaacaggcaggt

SEQ ID NO: 56715 - DNA, 20 bp, Artificial
  CRISPR gRNA sequence
tttaaacaggcaggtgggaa

SEQ ID NO: 56716 - DNA, 20 bp, Artificial
  CRISPR gRNA sequence
ttaaacaggcaggtgggaat

SEQ ID NO: 56717 - DNA, 20 bp, Artificial
  CRISPR gRNA sequence
taaacaggcaggtgggaatg

SEQ ID NO: 56718 - DNA, 20 bp, Artificial
  CRISPR gRNA sequence
acaggcaggtgggaatgggg

SEQ ID NO: 56719 - DNA, 20 bp, Artificial
  CRISPR gRNA sequence
caggtgggaatggggaagtg

SEQ ID NO: 56720 - DNA, 20 bp, Artificial
  CRISPR gRNA sequence
aggtgggaatggggaagtgt

SEQ ID NO: 56721 - DNA, 20 bp, Artificial
  CRISPR gRNA sequence
gaatggggaagtgtgggtca

SEQ ID NO: 56722 - DNA, 20 bp, Artificial
  CRISPR gRNA sequence
cggttctatccattctgcaa

SEQ ID NO: 56723 - DNA, 20 bp, Artificial
  CRISPR gRNA sequence
ccattctgcaatagtacacg

SEQ ID NO: 56724 - DNA, 20 bp, Artificial
  CRISPR gRNA sequence
tgcaatagtacacgtggtgt

SEQ ID NO: 56725 - DNA, 20 bp, Artificial
  CRISPR gRNA sequence
gcaatagtacacgtggtgta

SEQ ID NO: 56726 - DNA, 20 bp, Artificial
  CRISPR gRNA sequence
caatagtacacgtggtgtaa

SEQ ID NO: 56727 - DNA, 20 bp, Artificial
  CRISPR gRNA sequence
gtacacgtggtgtaagggtt

SEQ ID NO: 56728 - DNA, 20 bp, Artificial
  CRISPR gRNA sequence
acgtggtgtaagggttcagt

SEQ ID NO: 56729 - DNA, 20 bp, Artificial
  CRISPR gRNA sequence
ggtgtaagggttcagtaaga

SEQ ID NO: 56730 - DNA, 20 bp, Artificial
  CRISPR gRNA sequence
gtgtaagggttcagtaagat

SEQ ID NO: 56731 - DNA, 20 bp, Artificial
  CRISPR gRNA sequence
tgtaagggttcagtaagatg

SEQ ID NO: 56732 - DNA, 20 bp, Artificial
  CRISPR gRNA sequence
gtaagggttcagtaagatgg

SEQ ID NO: 56733 - DNA, 20 bp, Artificial
  CRISPR gRNA sequence
taagggttcagtaagatggg

SEQ ID NO: 56734 - DNA, 20 bp, Artificial
  CRISPR gRNA sequence
agggttcagtaagatggggg

SEQ ID NO: 56735 - DNA, 20 bp, Artificial
  CRISPR gRNA sequence
gggttcagtaagatgggggg

SEQ ID NO: 56736 - DNA, 20 bp, Artificial
  CRISPR gRNA sequence
ggttcagtaagatgggggga

SEQ ID NO: 56737 - DNA, 20 bp, Artificial
  CRISPR gRNA sequence
gttcagtaagatggggggag

SEQ ID NO: 56738 - DNA, 20 bp, Artificial
  CRISPR gRNA sequence
gtaagatggggggaggggaa

SEQ ID NO: 56739 - DNA, 20 bp, Artificial
  CRISPR gRNA sequence
taagatggggggaggggaat

SEQ ID NO: 56740 - DNA, 20 bp, Artificial
  CRISPR gRNA sequence
aagatggggggaggggaata

SEQ ID NO: 56741 - DNA, 20 bp, Artificial
  CRISPR gRNA sequence
ctcttttttttcttttttcc

SEQ ID NO: 56742 - DNA, 20 bp, Artificial
  CRISPR gRNA sequence
cttttttttcttttttccca

SEQ ID NO: 56743 - DNA, 20 bp, Artificial
  CRISPR gRNA sequence
tttttcttttttcccagaga

SEQ ID NO: 56744 - DNA, 20 bp, Artificial
  CRISPR gRNA sequence
tttcttttttcccagagaca

SEQ ID NO: 56745 - DNA, 20 bp, Artificial
  CRISPR gRNA sequence
ttttcccagagacagagtct

SEQ ID NO: 56746 - DNA, 20 bp, Artificial
  CRISPR gRNA sequence
gacagagtctcagtcttgcc

SEQ ID NO: 56747 - DNA, 20 bp, Artificial
  CRISPR gRNA sequence
acagagtctcagtcttgccc

SEQ ID NO: 56748 - DNA, 20 bp, Artificial
  CRISPR gRNA sequence
tctcagtcttgcccaggctc

SEQ ID NO: 56749 - DNA, 20 bp, Artificial
  CRISPR gRNA sequence
gtcttgcccaggctccagtg

SEQ ID NO: 56750 - DNA, 20 bp, Artificial
  CRISPR gRNA sequence
ttgcccaggctccagtgcag

SEQ ID NO: 56751 - DNA, 20 bp, Artificial
  CRISPR gRNA sequence
ccagtgcagtggcacgatcc

SEQ ID NO: 56752 - DNA, 20 bp, Artificial
  CRISPR gRNA sequence
ggcacgatcctagcttactg

SEQ ID NO: 56753 - DNA, 20 bp, Artificial
  CRISPR gRNA sequence
ttactgtagccgcaaactcc

SEQ ID NO: 56754 - DNA, 20 bp, Artificial
  CRISPR gRNA sequence
agccgcaaactcctggtctc

SEQ ID NO: 56755 - DNA, 20 bp, Artificial
  CRISPR gRNA sequence
ctcaagtgatcctcctgcct

SEQ ID NO: 56756 - DNA, 20 bp, Artificial
  CRISPR gRNA sequence
tcctcctgcctcagcctcct

SEQ ID NO: 56757 - DNA, 20 bp, Artificial
  CRISPR gRNA sequence
tcctgcctcagcctcctgag

SEQ ID NO: 56758 - DNA, 20 bp, Artificial
  CRISPR gRNA sequence
gcctcagcctcctgagtagc

SEQ ID NO: 56759 - DNA, 20 bp, Artificial
  CRISPR gRNA sequence
cctcagcctcctgagtagct

SEQ ID NO: 56760 - DNA, 20 bp, Artificial
  CRISPR gRNA sequence
ctcctgagtagctgggacta

SEQ ID NO: 56761 - DNA, 20 bp, Artificial
  CRISPR gRNA sequence
tcctgagtagctgggactac

SEQ ID NO: 56762 - DNA, 20 bp, Artificial
  CRISPR gRNA sequence
caggtgcacaccaccacacc

SEQ ID NO: 56763 - DNA, 20 bp, Artificial
  CRISPR gRNA sequence
ccagctaatttttgtatttt

SEQ ID NO: 56764 - DNA, 20 bp, Artificial
  CRISPR gRNA sequence
gctaatttttgtatttttag

SEQ ID NO: 56765 - DNA, 20 bp, Artificial
  CRISPR gRNA sequence
taatttttgtatttttagta

SEQ ID NO: 56766 - DNA, 20 bp, Artificial
  CRISPR gRNA sequence
tttgtatttttagtagagac

SEQ ID NO: 56767 - DNA, 20 bp, Artificial
  CRISPR gRNA sequence
ttgtatttttagtagagaca

SEQ ID NO: 56768 - DNA, 20 bp, Artificial
  CRISPR gRNA sequence
gagacaaggttttgtcacgt

SEQ ID NO: 56769 - DNA, 20 bp, Artificial
  CRISPR gRNA sequence
caaggttttgtcacgttggc

SEQ ID NO: 56770 - DNA, 20 bp, Artificial
  CRISPR gRNA sequence
aaggttttgtcacgttggcc

SEQ ID NO: 56771 - DNA, 20 bp, Artificial
  CRISPR gRNA sequence
ttttgtcacgttggccaggc

SEQ ID NO: 56772 - DNA, 20 bp, Artificial
  CRISPR gRNA sequence
ccaggctagtattgaattcc

SEQ ID NO: 56773 - DNA, 20 bp, Artificial
  CRISPR gRNA sequence
caggctagtattgaattcct

SEQ ID NO: 56774 - DNA, 20 bp, Artificial
  CRISPR gRNA sequence
ctcaactgatccacctgcct

SEQ ID NO: 56775 - DNA, 20 bp, Artificial
  CRISPR gRNA sequence
ccacctgcctcagccctcca

SEQ ID NO: 56776 - DNA, 20 bp, Artificial
  CRISPR gRNA sequence
gcctcagccctccaaagtgc

SEQ ID NO: 56777 - DNA, 20 bp, Artificial
  CRISPR gRNA sequence
cctcagccctccaaagtgct

SEQ ID NO: 56778 - DNA, 20 bp, Artificial
  CRISPR gRNA sequence
cctccaaagtgctgggatta

SEQ ID NO: 56779 - DNA, 20 bp, Artificial
  CRISPR gRNA sequence
ctccaaagtgctgggattac

SEQ ID NO: 56780 - DNA, 20 bp, Artificial
  CRISPR gRNA sequence
agtgctgggattacaggtgt

SEQ ID NO: 56781 - DNA, 20 bp, Artificial
  CRISPR gRNA sequence
caggtgtgagccaccgcgcc

SEQ ID NO: 56782 - DNA, 20 bp, Artificial
  CRISPR gRNA sequence
caacctctttctgtaatatc

SEQ ID NO: 56783 - DNA, 20 bp, Artificial
  CRISPR gRNA sequence
ttctgtaatatctggatccc

SEQ ID NO: 56784 - DNA, 20 bp, Artificial
  CRISPR gRNA sequence
agtgcctcttcccaatattt

SEQ ID NO: 56785 - DNA, 20 bp, Artificial
  CRISPR gRNA sequence
tatttcagttctgcaatgcc

SEQ ID NO: 56786 - DNA, 20 bp, Artificial
  CRISPR gRNA sequence
atttcagttctgcaatgccc

SEQ ID NO: 56787 - DNA, 20 bp, Artificial
  CRISPR gRNA sequence
tttcagttctgcaatgccca

SEQ ID NO: 56788 - DNA, 20 bp, Artificial
  CRISPR gRNA sequence
ttcagttctgcaatgcccag

SEQ ID NO: 56789 - DNA, 20 bp, Artificial
  CRISPR gRNA sequence
gttctgcaatgcccaggggt

SEQ ID NO: 56790 - DNA, 20 bp, Artificial
  CRISPR gRNA sequence
gggtgagcactaacaacctg

SEQ ID NO: 56791 - DNA, 20 bp, Artificial
  CRISPR gRNA sequence
ggtgagcactaacaacctgt

SEQ ID NO: 56792 - DNA, 20 bp, Artificial
  CRISPR gRNA sequence
gcactaacaacctgtaggcc

SEQ ID NO: 56793 - DNA, 20 bp, Artificial
  CRISPR gRNA sequence
cactaacaacctgtaggcct

SEQ ID NO: 56794 - DNA, 20 bp, Artificial
  CRISPR gRNA sequence
taggcctaggcattaccgat

SEQ ID NO: 56795 - DNA, 20 bp, Artificial
  CRISPR gRNA sequence
ggcattaccgatcggaactg

SEQ ID NO: 56796 - DNA, 20 bp, Artificial
  CRISPR gRNA sequence
gcattaccgatcggaactgt

SEQ ID NO: 56797 - DNA, 20 bp, Artificial
  CRISPR gRNA sequence
attaccgatcggaactgtgg

SEQ ID NO: 56798 - DNA, 20 bp, Artificial
  CRISPR gRNA sequence
ccgatcggaactgtgggagc

SEQ ID NO: 56799 - DNA, 20 bp, Artificial
  CRISPR gRNA sequence
cgatcggaactgtgggagct

SEQ ID NO: 56800 - DNA, 20 bp, Artificial
  CRISPR gRNA sequence
ctgtgggagctgggccccta

SEQ ID NO: 56801 - DNA, 20 bp, Artificial
  CRISPR gRNA sequence
gagctgggcccctacagtgc

SEQ ID NO: 56802 - DNA, 20 bp, Artificial
  CRISPR gRNA sequence
gatgttaaccttttaattcc

SEQ ID NO: 56803 - DNA, 20 bp, Artificial
  CRISPR gRNA sequence
atgttaaccttttaattcct

SEQ ID NO: 56804 - DNA, 20 bp, Artificial
  CRISPR gRNA sequence
cttttaattcctgggtcatt

SEQ ID NO: 56805 - DNA, 20 bp, Artificial
  CRISPR gRNA sequence
tttaattcctgggtcattga

SEQ ID NO: 56806 - DNA, 20 bp, Artificial
  CRISPR gRNA sequence
ttaattcctgggtcattgag

SEQ ID NO: 56807 - DNA, 20 bp, Artificial
  CRISPR gRNA sequence
cctgggtcattgagaggtct

SEQ ID NO: 56808 - DNA, 20 bp, Artificial
  CRISPR gRNA sequence
ctgggtcattgagaggtctc

SEQ ID NO: 56809 - DNA, 20 bp, Artificial
  CRISPR gRNA sequence
ttgagaggtctcaggtgacc

SEQ ID NO: 56810 - DNA, 20 bp, Artificial
  CRISPR gRNA sequence
tgagaggtctcaggtgaccc

SEQ ID NO: 56811 - DNA, 20 bp, Artificial
  CRISPR gRNA sequence
gagaggtctcaggtgaccca

SEQ ID NO: 56812 - DNA, 20 bp, Artificial
  CRISPR gRNA sequence
ggtctcaggtgacccaggga

SEQ ID NO: 56813 - DNA, 20 bp, Artificial
  CRISPR gRNA sequence
gtctcaggtgacccagggaa

SEQ ID NO: 56814 - DNA, 20 bp, Artificial
  CRISPR gRNA sequence
tctcaggtgacccagggaaa

SEQ ID NO: 56815 - DNA, 20 bp, Artificial
  CRISPR gRNA sequence
aggtgacccagggaaagggc

SEQ ID NO: 56816 - DNA, 20 bp, Artificial
  CRISPR gRNA sequence
ggtgacccagggaaagggct

SEQ ID NO: 56817 - DNA, 20 bp, Artificial
  CRISPR gRNA sequence
gtgacccagggaaagggctg

SEQ ID NO: 56818 - DNA, 20 bp, Artificial
  CRISPR gRNA sequence
gaaagggctggggctgcttt

SEQ ID NO: 56819 - DNA, 20 bp, Artificial
  CRISPR gRNA sequence
aaagggctggggctgctttt

SEQ ID NO: 56820 - DNA, 20 bp, Artificial
  CRISPR gRNA sequence
aagggctggggctgcttttg

SEQ ID NO: 56821 - DNA, 20 bp, Artificial
  CRISPR gRNA sequence
agggctggggctgcttttgg

SEQ ID NO: 56822 - DNA, 20 bp, Artificial
  CRISPR gRNA sequence
ctgcttttgggggaacccta

SEQ ID NO: 56823 - DNA, 20 bp, Artificial
  CRISPR gRNA sequence
tgcttttgggggaaccctat

SEQ ID NO: 56824 - DNA, 20 bp, Artificial
  CRISPR gRNA sequence
gcttttgggggaaccctatg

SEQ ID NO: 56825 - DNA, 20 bp, Artificial
  CRISPR gRNA sequence
ttgggggaaccctatgggga

SEQ ID NO: 56826 - DNA, 20 bp, Artificial
  CRISPR gRNA sequence
tgggggaaccctatggggaa

SEQ ID NO: 56827 - DNA, 20 bp, Artificial
  CRISPR gRNA sequence
gaaccctatggggaaaggcc

SEQ ID NO: 56828 - DNA, 20 bp, Artificial
  CRISPR gRNA sequence
aaccctatggggaaaggcca

SEQ ID NO: 56829 - DNA, 20 bp, Artificial
  CRISPR gRNA sequence
cctatggggaaaggccaagg

SEQ ID NO: 56830 - DNA, 20 bp, Artificial
  CRISPR gRNA sequence
ccaaggtagtgaactatttt

SEQ ID NO: 56831 - DNA, 20 bp, Artificial
  CRISPR gRNA sequence
aggtagtgaactattttgag

SEQ ID NO: 56832 - DNA, 20 bp, Artificial
  CRISPR gRNA sequence
ttgagcggatgtgaatcctc

SEQ ID NO: 56833 - DNA, 20 bp, Artificial
  CRISPR gRNA sequence
ggatgtgaatcctctggtta

SEQ ID NO: 56834 - DNA, 20 bp, Artificial
  CRISPR gRNA sequence
gaatcctctggttatagcca

SEQ ID NO: 56835 - DNA, 20 bp, Artificial
  CRISPR gRNA sequence
cctctggttatagccatggt

SEQ ID NO: 56836 - DNA, 20 bp, Artificial
  CRISPR gRNA sequence
ctggttatagccatggttgg

SEQ ID NO: 56837 - DNA, 20 bp, Artificial
  CRISPR gRNA sequence
gttatagccatggttggcag

SEQ ID NO: 56838 - DNA, 20 bp, Artificial
  CRISPR gRNA sequence
atagccatggttggcagcag

SEQ ID NO: 56839 - DNA, 20 bp, Artificial
  CRISPR gRNA sequence
tagccatggttggcagcagt

SEQ ID NO: 56840 - DNA, 20 bp, Artificial
  CRISPR gRNA sequence
agccatggttggcagcagtg

SEQ ID NO: 56841 - DNA, 20 bp, Artificial
  CRISPR gRNA sequence
gccatggttggcagcagtgg

SEQ ID NO: 56842 - DNA, 20 bp, Artificial
  CRISPR gRNA sequence
atggttggcagcagtggggg

SEQ ID NO: 56843 - DNA, 20 bp, Artificial
  CRISPR gRNA sequence
ggttggcagcagtgggggca

SEQ ID NO: 56844 - DNA, 20 bp, Artificial
  CRISPR gRNA sequence
tggcagcagtgggggcagag

SEQ ID NO: 56845 - DNA, 20 bp, Artificial
  CRISPR gRNA sequence
ggcagcagtgggggcagaga

SEQ ID NO: 56846 - DNA, 20 bp, Artificial
  CRISPR gRNA sequence
agtgggggcagagaaggctc

SEQ ID NO: 56847 - DNA, 20 bp, Artificial
  CRISPR gRNA sequence
ggggcagagaaggctctagt

SEQ ID NO: 56848 - DNA, 20 bp, Artificial
  CRISPR gRNA sequence
gcagagaaggctctagttag

SEQ ID NO: 56849 - DNA, 20 bp, Artificial
  CRISPR gRNA sequence
cagagaaggctctagttagt

SEQ ID NO: 56850 - DNA, 20 bp, Artificial
  CRISPR gRNA sequence
ctagttagtgggacaactcg

SEQ ID NO: 56851 - DNA, 20 bp, Artificial
  CRISPR gRNA sequence
agttagtgggacaactcgtg

SEQ ID NO: 56852 - DNA, 20 bp, Artificial
  CRISPR gRNA sequence
tgggacaactcgtggagaac

SEQ ID NO: 56853 - DNA, 20 bp, Artificial
  CRISPR gRNA sequence
gggacaactcgtggagaacg

SEQ ID NO: 56854 - DNA, 20 bp, Artificial
  CRISPR gRNA sequence
tggagaacgaggaccattct

SEQ ID NO: 56855 - DNA, 20 bp, Artificial
  CRISPR gRNA sequence
acgaggaccattctgagaac

SEQ ID NO: 56856 - DNA, 20 bp, Artificial
  CRISPR gRNA sequence
gaccattctgagaactggtc

SEQ ID NO: 56857 - DNA, 20 bp, Artificial
  CRISPR gRNA sequence
tctgagaactggtcaagaat

SEQ ID NO: 56858 - DNA, 20 bp, Artificial
  CRISPR gRNA sequence
tgagaactggtcaagaatga

SEQ ID NO: 56859 - DNA, 20 bp, Artificial
  CRISPR gRNA sequence
gaactggtcaagaatgagag

SEQ ID NO: 56860 - DNA, 20 bp, Artificial
  CRISPR gRNA sequence
agtcccctttcttctctcac

SEQ ID NO: 56861 - DNA, 20 bp, Artificial
  CRISPR gRNA sequence
cctttcttctctcactggcc

SEQ ID NO: 56862 - DNA, 20 bp, Artificial
  CRISPR gRNA sequence
tcactggcctggcctgccct

SEQ ID NO: 56863 - DNA, 20 bp, Artificial
  CRISPR gRNA sequence
ctggcctggcctgccctaag

SEQ ID NO: 56864 - DNA, 20 bp, Artificial
  CRISPR gRNA sequence
agcagctccatgtctcccca

SEQ ID NO: 56865 - DNA, 20 bp, Artificial
  CRISPR gRNA sequence
gcagctccatgtctccccat

SEQ ID NO: 56866 - DNA, 20 bp, Artificial
  CRISPR gRNA sequence
catgtctccccatgggcccc

SEQ ID NO: 56867 - DNA, 20 bp, Artificial
  CRISPR gRNA sequence
atgtctccccatgggccccc

SEQ ID NO: 56868 - DNA, 20 bp, Artificial
  CRISPR gRNA sequence
tgtctccccatgggccccca

SEQ ID NO: 56869 - DNA, 20 bp, Artificial
  CRISPR gRNA sequence
cccccagggcctctgtcttg

SEQ ID NO: 56870 - DNA, 20 bp, Artificial
  CRISPR gRNA sequence
ccccagggcctctgtcttga

SEQ ID NO: 56871 - DNA, 20 bp, Artificial
  CRISPR gRNA sequence
tctgtcttgaaggtttctcc

SEQ ID NO: 56872 - DNA, 20 bp, Artificial
  CRISPR gRNA sequence
ctgtcttgaaggtttctccc

SEQ ID NO: 56873 - DNA, 20 bp, Artificial
  CRISPR gRNA sequence
atccctgctcacccccaaac

SEQ ID NO: 56874 - DNA, 20 bp, Artificial
  CRISPR gRNA sequence
ccccaaactggtctcctccc

SEQ ID NO: 56875 - DNA, 20 bp, Artificial
  CRISPR gRNA sequence
cccaaactggtctcctccct

SEQ ID NO: 56876 - DNA, 20 bp, Artificial
  CRISPR gRNA sequence
cctgggtctccttcaacact

SEQ ID NO: 56877 - DNA, 20 bp, Artificial
  CRISPR gRNA sequence
ctgggtctccttcaacactg

SEQ ID NO: 56878 - DNA, 20 bp, Artificial
  CRISPR gRNA sequence
ctccttcaacactgaggaca

SEQ ID NO: 56879 - DNA, 20 bp, Artificial
  CRISPR gRNA sequence
tccttcaacactgaggacat

SEQ ID NO: 56880 - DNA, 20 bp, Artificial
  CRISPR gRNA sequence
ccttcaacactgaggacata

SEQ ID NO: 56881 - DNA, 20 bp, Artificial
  CRISPR gRNA sequence
ctgaggacatagggtgtccc

SEQ ID NO: 56882 - DNA, 20 bp, Artificial
  CRISPR gRNA sequence
gacatagggtgtccctggaa

SEQ ID NO: 56883 - DNA, 20 bp, Artificial
  CRISPR gRNA sequence
agggtgtccctggaaaagcc

SEQ ID NO: 56884 - DNA, 20 bp, Artificial
  CRISPR gRNA sequence
tgtccctggaaaagcctgga

SEQ ID NO: 56885 - DNA, 20 bp, Artificial
  CRISPR gRNA sequence
ctggaaaagcctggacagcg

SEQ ID NO: 56886 - DNA, 20 bp, Artificial
  CRISPR gRNA sequence
aaagcctggacagcgaagct

SEQ ID NO: 56887 - DNA, 20 bp, Artificial
  CRISPR gRNA sequence
cagcgaagctgagacctgta

SEQ ID NO: 56888 - DNA, 20 bp, Artificial
  CRISPR gRNA sequence
tgagacctgtatggtgcttc

SEQ ID NO: 56889 - DNA, 20 bp, Artificial
  CRISPR gRNA sequence
tatggtgcttccagctcctt

SEQ ID NO: 56890 - DNA, 20 bp, Artificial
  CRISPR gRNA sequence
ggtgcttccagctccttcag

SEQ ID NO: 56891 - DNA, 20 bp, Artificial
  CRISPR gRNA sequence
tgcttccagctccttcagcg

SEQ ID NO: 56892 - DNA, 20 bp, Artificial
  CRISPR gRNA sequence
tccttcagcggagccctctt

SEQ ID NO: 56893 - DNA, 20 bp, Artificial
  CRISPR gRNA sequence
cttcagcggagccctcttca

SEQ ID NO: 56894 - DNA, 20 bp, Artificial
  CRISPR gRNA sequence
cagcggagccctcttcagag

SEQ ID NO: 56895 - DNA, 20 bp, Artificial
  CRISPR gRNA sequence
tcttcagagaagtccccatg

SEQ ID NO: 56896 - DNA, 20 bp, Artificial
  CRISPR gRNA sequence
cagagaagtccccatgcagc

SEQ ID NO: 56897 - DNA, 20 bp, Artificial
  CRISPR gRNA sequence
gaagtccccatgcagccaga

SEQ ID NO: 56898 - DNA, 20 bp, Artificial
  CRISPR gRNA sequence
aagtccccatgcagccagat

SEQ ID NO: 56899 - DNA, 20 bp, Artificial
  CRISPR gRNA sequence
tccccatgcagccagatggg

SEQ ID NO: 56900 - DNA, 20 bp, Artificial
  CRISPR gRNA sequence
ccccatgcagccagatgggt

SEQ ID NO: 56901 - DNA, 20 bp, Artificial
  CRISPR gRNA sequence
cccatgcagccagatgggtg

SEQ ID NO: 56902 - DNA, 20 bp, Artificial
  CRISPR gRNA sequence
catgcagccagatgggtggg

SEQ ID NO: 56903 - DNA, 20 bp, Artificial
  CRISPR gRNA sequence
gtggggagccccttcgctgc

SEQ ID NO: 56904 - DNA, 20 bp, Artificial
  CRISPR gRNA sequence
gagccccttcgctgccagcc

SEQ ID NO: 56905 - DNA, 20 bp, Artificial
  CRISPR gRNA sequence
agccccttcgctgccagccc

SEQ ID NO: 56906 - DNA, 20 bp, Artificial
  CRISPR gRNA sequence
ggcctctcctctgcctgtgc

SEQ ID NO: 56907 - DNA, 20 bp, Artificial
  CRISPR gRNA sequence
ctctgcctgtgcaagacctc

SEQ ID NO: 56908 - DNA, 20 bp, Artificial
  CRISPR gRNA sequence
gacctccagtccttttctcc

SEQ ID NO: 56909 - DNA, 20 bp, Artificial
  CRISPR gRNA sequence
cttttctcctggaaacttgc

SEQ ID NO: 56910 - DNA, 20 bp, Artificial
  CRISPR gRNA sequence
ctcctggaaacttgcgagac

SEQ ID NO: 56911 - DNA, 20 bp, Artificial
  CRISPR gRNA sequence
cctggaaacttgcgagacaa

SEQ ID NO: 56912 - DNA, 20 bp, Artificial
  CRISPR gRNA sequence
acttgcgagacaagagtcac

SEQ ID NO: 56913 - DNA, 20 bp, Artificial
  CRISPR gRNA sequence
cttgcgagacaagagtcact

SEQ ID NO: 56914 - DNA, 20 bp, Artificial
  CRISPR gRNA sequence
gacaagagtcactgggcctc

SEQ ID NO: 56915 - DNA, 20 bp, Artificial
  CRISPR gRNA sequence
caagagtcactgggcctctg

SEQ ID NO: 56916 - DNA, 20 bp, Artificial
  CRISPR gRNA sequence
aagagtcactgggcctctgg

SEQ ID NO: 56917 - DNA, 20 bp, Artificial
  CRISPR gRNA sequence
ctgggcctctggaggcttat

SEQ ID NO: 56918 - DNA, 20 bp, Artificial
  CRISPR gRNA sequence
ggcctctggaggcttattgg

SEQ ID NO: 56919 - DNA, 20 bp, Artificial
  CRISPR gRNA sequence
gcctctggaggcttattggc

SEQ ID NO: 56920 - DNA, 20 bp, Artificial
  CRISPR gRNA sequence
cctctggaggcttattggca

SEQ ID NO: 56921 - DNA, 20 bp, Artificial
  CRISPR gRNA sequence
ctctggaggcttattggcag

SEQ ID NO: 56922 - DNA, 20 bp, Artificial
  CRISPR gRNA sequence
gaggcttattggcaggggac

SEQ ID NO: 56923 - DNA, 20 bp, Artificial
  CRISPR gRNA sequence
aggcttattggcaggggaca

SEQ ID NO: 56924 - DNA, 20 bp, Artificial
  CRISPR gRNA sequence
tattggcaggggacaaggtc

SEQ ID NO: 56925 - DNA, 20 bp, Artificial
  CRISPR gRNA sequence
attggcaggggacaaggtcc

SEQ ID NO: 56926 - DNA, 20 bp, Artificial
  CRISPR gRNA sequence
ttggcaggggacaaggtcca

SEQ ID NO: 56927 - DNA, 20 bp, Artificial
  CRISPR gRNA sequence
aggggacaaggtccagggtc

SEQ ID NO: 56928 - DNA, 20 bp, Artificial
  CRISPR gRNA sequence
ggggacaaggtccagggtcc

SEQ ID NO: 56929 - DNA, 20 bp, Artificial
  CRISPR gRNA sequence
aaggtccagggtccgggtct

SEQ ID NO: 56930 - DNA, 20 bp, Artificial
  CRISPR gRNA sequence
agggtccgggtcttggcccc

SEQ ID NO: 56931 - DNA, 20 bp, Artificial
  CRISPR gRNA sequence
gggtccgggtcttggccccc

SEQ ID NO: 56932 - DNA, 20 bp, Artificial
  CRISPR gRNA sequence
gtttatgttcctccccacac

SEQ ID NO: 56933 - DNA, 20 bp, Artificial
  CRISPR gRNA sequence
tccccacactggtacccacc

SEQ ID NO: 56934 - DNA, 20 bp, Artificial
  CRISPR gRNA sequence
gctgcttcttgcactgcttc

SEQ ID NO: 56935 - DNA, 20 bp, Artificial
  CRISPR gRNA sequence
gcttcttgcactgcttccgg

SEQ ID NO: 56936 - DNA, 20 bp, Artificial
  CRISPR gRNA sequence
cttcttgcactgcttccggc

SEQ ID NO: 56937 - DNA, 20 bp, Artificial
  CRISPR gRNA sequence
ttcttgcactgcttccggcg

SEQ ID NO: 56938 - DNA, 20 bp, Artificial
  CRISPR gRNA sequence
tgcactgcttccggcggggt

SEQ ID NO: 56939 - DNA, 20 bp, Artificial
  CRISPR gRNA sequence
gcactgcttccggcggggtg

SEQ ID NO: 56940 - DNA, 20 bp, Artificial
  CRISPR gRNA sequence
tccggcggggtgaggaccca

SEQ ID NO: 56941 - DNA, 20 bp, Artificial
  CRISPR gRNA sequence
gaggacccacagctctgatg

SEQ ID NO: 56942 - DNA, 20 bp, Artificial
  CRISPR gRNA sequence
aggacccacagctctgatgt

SEQ ID NO: 56943 - DNA, 20 bp, Artificial
  CRISPR gRNA sequence
cagctctgatgtgggcgctt

SEQ ID NO: 56944 - DNA, 20 bp, Artificial
  CRISPR gRNA sequence
agctctgatgtgggcgcttc

SEQ ID NO: 56945 - DNA, 20 bp, Artificial
  CRISPR gRNA sequence
tgggcgcttcaggcctgaaa

SEQ ID NO: 56946 - DNA, 20 bp, Artificial
  CRISPR gRNA sequence
gcttcaggcctgaaaaagca

SEQ ID NO: 56947 - DNA, 20 bp, Artificial
  CRISPR gRNA sequence
cttcaggcctgaaaaagcaa

SEQ ID NO: 56948 - DNA, 20 bp, Artificial
  CRISPR gRNA sequence
caggcctgaaaaagcaaagg

SEQ ID NO: 56949 - DNA, 20 bp, Artificial
  CRISPR gRNA sequence
aggcctgaaaaagcaaagga

SEQ ID NO: 56950 - DNA, 20 bp, Artificial
  CRISPR gRNA sequence
ggcctgaaaaagcaaaggaa

SEQ ID NO: 56951 - DNA, 20 bp, Artificial
  CRISPR gRNA sequence
gcctgaaaaagcaaaggaag

SEQ ID NO: 56952 - DNA, 20 bp, Artificial
  CRISPR gRNA sequence
tgaaaaagcaaaggaagggg

SEQ ID NO: 56953 - DNA, 20 bp, Artificial
  CRISPR gRNA sequence
aaaaagcaaaggaaggggtg

SEQ ID NO: 56954 - DNA, 20 bp, Artificial
  CRISPR gRNA sequence
aaaagcaaaggaaggggtgg

SEQ ID NO: 56955 - DNA, 20 bp, Artificial
  CRISPR gRNA sequence
aagcaaaggaaggggtggag

SEQ ID NO: 56956 - DNA, 20 bp, Artificial
  CRISPR gRNA sequence
caaaggaaggggtggaggag

SEQ ID NO: 56957 - DNA, 20 bp, Artificial
  CRISPR gRNA sequence
aaaggaaggggtggaggagt

SEQ ID NO: 56958 - DNA, 20 bp, Artificial
  CRISPR gRNA sequence
aaggaaggggtggaggagtg

SEQ ID NO: 56959 - DNA, 20 bp, Artificial
  CRISPR gRNA sequence
aggggtggaggagtggggtc

SEQ ID NO: 56960 - DNA, 20 bp, Artificial
  CRISPR gRNA sequence
ggggtggaggagtggggtct

SEQ ID NO: 56961 - DNA, 20 bp, Artificial
  CRISPR gRNA sequence
gggtggaggagtggggtctg

SEQ ID NO: 56962 - DNA, 20 bp, Artificial
  CRISPR gRNA sequence
aggagtggggtctggggatc

SEQ ID NO: 56963 - DNA, 20 bp, Artificial
  CRISPR gRNA sequence
ggagtggggtctggggatct

SEQ ID NO: 56964 - DNA, 20 bp, Artificial
  CRISPR gRNA sequence
ggggtctggggatctgggct

SEQ ID NO: 56965 - DNA, 20 bp, Artificial
  CRISPR gRNA sequence
gggtctggggatctgggctg

SEQ ID NO: 56966 - DNA, 20 bp, Artificial
  CRISPR gRNA sequence
ggtctggggatctgggctga

SEQ ID NO: 56967 - DNA, 20 bp, Artificial
  CRISPR gRNA sequence
gtctggggatctgggctgag

SEQ ID NO: 56968 - DNA, 20 bp, Artificial
  CRISPR gRNA sequence
atctgggctgaggggttacc

SEQ ID NO: 56969 - DNA, 20 bp, Artificial
  CRISPR gRNA sequence
gaggggttacccagaacctt

SEQ ID NO: 56970 - DNA, 20 bp, Artificial
  CRISPR gRNA sequence
aggggttacccagaaccttt

SEQ ID NO: 56971 - DNA, 20 bp, Artificial
  CRISPR gRNA sequence
ggggttacccagaacctttg

SEQ ID NO: 56972 - DNA, 20 bp, Artificial
  CRISPR gRNA sequence
ccagaacctttggggaactc

SEQ ID NO: 56973 - DNA, 20 bp, Artificial
  CRISPR gRNA sequence
ctttggggaactccagtcca

SEQ ID NO: 56974 - DNA, 20 bp, Artificial
  CRISPR gRNA sequence
ggggaactccagtccacaga

SEQ ID NO: 56975 - DNA, 20 bp, Artificial
  CRISPR gRNA sequence
gggaactccagtccacagac

SEQ ID NO: 56976 - DNA, 20 bp, Artificial
  CRISPR gRNA sequence
aactccagtccacagacagg

SEQ ID NO: 56977 - DNA, 20 bp, Artificial
  CRISPR gRNA sequence
tccagtccacagacaggtgg

SEQ ID NO: 56978 - DNA, 20 bp, Artificial
  CRISPR gRNA sequence
ccagtccacagacaggtggc

SEQ ID NO: 56979 - DNA, 20 bp, Artificial
  CRISPR gRNA sequence
gtccacagacaggtggcagg

SEQ ID NO: 56980 - DNA, 20 bp, Artificial
  CRISPR gRNA sequence
cagacaggtggcaggcagcc

SEQ ID NO: 56981 - DNA, 20 bp, Artificial
  CRISPR gRNA sequence
cagccaagtacacccacatg

SEQ ID NO: 56982 - DNA, 20 bp, Artificial
  CRISPR gRNA sequence
agccaagtacacccacatgc

SEQ ID NO: 56983 - DNA, 20 bp, Artificial
  CRISPR gRNA sequence
gccaagtacacccacatgca

SEQ ID NO: 56984 - DNA, 20 bp, Artificial
  CRISPR gRNA sequence
gtacacccacatgcagggac

SEQ ID NO: 56985 - DNA, 20 bp, Artificial
  CRISPR gRNA sequence
acccacatgcagggactgga

SEQ ID NO: 56986 - DNA, 20 bp, Artificial
  CRISPR gRNA sequence
cccacatgcagggactggaa

SEQ ID NO: 56987 - DNA, 20 bp, Artificial
  CRISPR gRNA sequence
acatgcagggactggaaagg

SEQ ID NO: 56988 - DNA, 20 bp, Artificial
  CRISPR gRNA sequence
catgcagggactggaaaggc

SEQ ID NO: 56989 - DNA, 20 bp, Artificial
  CRISPR gRNA sequence
gcagggactggaaaggcagg

SEQ ID NO: 56990 - DNA, 20 bp, Artificial
  CRISPR gRNA sequence
gggactggaaaggcaggcag

SEQ ID NO: 56991 - DNA, 20 bp, Artificial
  CRISPR gRNA sequence
ggactggaaaggcaggcagc

SEQ ID NO: 56992 - DNA, 20 bp, Artificial
  CRISPR gRNA sequence
ctggaaaggcaggcagcagg

SEQ ID NO: 56993 - DNA, 20 bp, Artificial
  CRISPR gRNA sequence
ggaaaggcaggcagcaggca

SEQ ID NO: 56994 - DNA, 20 bp, Artificial
  CRISPR gRNA sequence
gaaaggcaggcagcaggcag

SEQ ID NO: 56995 - DNA, 20 bp, Artificial
  CRISPR gRNA sequence
ggcaggcagcaggcagaggc

SEQ ID NO: 56996 - DNA, 20 bp, Artificial
  CRISPR gRNA sequence
gcaggcagcaggcagaggct

SEQ ID NO: 56997 - DNA, 20 bp, Artificial
  CRISPR gRNA sequence
ggcagaggctgggtcaacac

SEQ ID NO: 56998 - DNA, 20 bp, Artificial
  CRISPR gRNA sequence
tcaacaccagcttctatttg

SEQ ID NO: 56999 - DNA, 20 bp, Artificial
  CRISPR gRNA sequence
aacaccagcttctatttgca

SEQ ID NO: 57000 - DNA, 20 bp, Artificial
  CRISPR gRNA sequence
accagcttctatttgcagag

SEQ ID NO: 57001 - DNA, 20 bp, Artificial
  CRISPR gRNA sequence
ctatttgcagagtggacttc

SEQ ID NO: 57002 - DNA, 20 bp, Artificial
  CRISPR gRNA sequence
tatttgcagagtggacttct

SEQ ID NO: 57003 - DNA, 20 bp, Artificial
  CRISPR gRNA sequence
ggacttctaggcacccccat

SEQ ID NO: 57004 - DNA, 20 bp, Artificial
  CRISPR gRNA sequence
cttctaggcacccccattgg

SEQ ID NO: 57005 - DNA, 20 bp, Artificial
  CRISPR gRNA sequence
ttctaggcacccccattgga

SEQ ID NO: 57006 - DNA, 20 bp, Artificial
  CRISPR gRNA sequence
taggcacccccattggaagg

SEQ ID NO: 57007 - DNA, 20 bp, Artificial
  CRISPR gRNA sequence
ccattggaaggtggatgttc

SEQ ID NO: 57008 - DNA, 20 bp, Artificial
  CRISPR gRNA sequence
cattggaaggtggatgttct

SEQ ID NO: 57009 - DNA, 20 bp, Artificial
  CRISPR gRNA sequence
gaaggtggatgttctgggcc

SEQ ID NO: 57010 - DNA, 20 bp, Artificial
  CRISPR gRNA sequence
ggtggatgttctgggcctgg

SEQ ID NO: 57011 - DNA, 20 bp, Artificial
  CRISPR gRNA sequence
ttctgggcctggcagtcttg

SEQ ID NO: 57012 - DNA, 20 bp, Artificial
  CRISPR gRNA sequence
ggcctggcagtcttgcagtc

SEQ ID NO: 57013 - DNA, 20 bp, Artificial
  CRISPR gRNA sequence
gcctggcagtcttgcagtcc

SEQ ID NO: 57014 - DNA, 20 bp, Artificial
  CRISPR gRNA sequence
cagtcttgcagtccaggatg

SEQ ID NO: 57015 - DNA, 20 bp, Artificial
  CRISPR gRNA sequence
agtcttgcagtccaggatgc

SEQ ID NO: 57016 - DNA, 20 bp, Artificial
  CRISPR gRNA sequence
cttgcagtccaggatgcagg

SEQ ID NO: 57017 - DNA, 20 bp, Artificial
  CRISPR gRNA sequence
gcagtccaggatgcaggaag

SEQ ID NO: 57018 - DNA, 20 bp, Artificial
  CRISPR gRNA sequence
cagtccaggatgcaggaagc

SEQ ID NO: 57019 - DNA, 20 bp, Artificial
  CRISPR gRNA sequence
agtccaggatgcaggaagca

SEQ ID NO: 57020 - DNA, 20 bp, Artificial
  CRISPR gRNA sequence
gatgcaggaagcagggccaa

SEQ ID NO: 57021 - DNA, 20 bp, Artificial
  CRISPR gRNA sequence
caggaagcagggccaacagc

SEQ ID NO: 57022 - DNA, 20 bp, Artificial
  CRISPR gRNA sequence
gaagcagggccaacagccag

SEQ ID NO: 57023 - DNA, 20 bp, Artificial
  CRISPR gRNA sequence
ggccaacagccagcagcccc

SEQ ID NO: 57024 - DNA, 20 bp, Artificial
  CRISPR gRNA sequence
cagcagcccccagaaacact

SEQ ID NO: 57025 - DNA, 20 bp, Artificial
  CRISPR gRNA sequence
ccccagaaacactcagctcc

SEQ ID NO: 57026 - DNA, 20 bp, Artificial
  CRISPR gRNA sequence
actcagctccaagcactaaa

SEQ ID NO: 57027 - DNA, 20 bp, Artificial
  CRISPR gRNA sequence
ctaaatggccatctgtccat

SEQ ID NO: 57028 - DNA, 20 bp, Artificial
  CRISPR gRNA sequence
taaatggccatctgtccatc

SEQ ID NO: 57029 - DNA, 20 bp, Artificial
  CRISPR gRNA sequence
aaatggccatctgtccatca

SEQ ID NO: 57030 - DNA, 20 bp, Artificial
  CRISPR gRNA sequence
tggccatctgtccatcaggg

SEQ ID NO: 57031 - DNA, 20 bp, Artificial
  CRISPR gRNA sequence
ggccatctgtccatcaggga

SEQ ID NO: 57032 - DNA, 20 bp, Artificial
  CRISPR gRNA sequence
ctgtccatcagggaaggacc

SEQ ID NO: 57033 - DNA, 20 bp, Artificial
  CRISPR gRNA sequence
cagggaaggaccaagctcta

SEQ ID NO: 57034 - DNA, 20 bp, Artificial
  CRISPR gRNA sequence
ggaaggaccaagctctatgg

SEQ ID NO: 57035 - DNA, 20 bp, Artificial
  CRISPR gRNA sequence
ccaagctctatggaagccgc

SEQ ID NO: 57036 - DNA, 20 bp, Artificial
  CRISPR gRNA sequence
agctctatggaagccgccgg

SEQ ID NO: 57037 - DNA, 20 bp, Artificial
  CRISPR gRNA sequence
gaagccgccggtggtcatat

SEQ ID NO: 57038 - DNA, 20 bp, Artificial
  CRISPR gRNA sequence
cgccggtggtcatataagtg

SEQ ID NO: 57039 - DNA, 20 bp, Artificial
  CRISPR gRNA sequence
ggtcatataagtgaagttcc

SEQ ID NO: 57040 - DNA, 20 bp, Artificial
  CRISPR gRNA sequence
atataagtgaagttcccagt

SEQ ID NO: 57041 - DNA, 20 bp, Artificial
  CRISPR gRNA sequence
agtgaagttcccagtgagtt

SEQ ID NO: 57042 - DNA, 20 bp, Artificial
  CRISPR gRNA sequence
aagttcccagtgagtttggc

SEQ ID NO: 57043 - DNA, 20 bp, Artificial
  CRISPR gRNA sequence
agttcccagtgagtttggcc

SEQ ID NO: 57044 - DNA, 20 bp, Artificial
  CRISPR gRNA sequence
ctgcaacctccctcctctgt

SEQ ID NO: 57045 - DNA, 20 bp, Artificial
  CRISPR gRNA sequence
tgcaacctccctcctctgtt

SEQ ID NO: 57046 - DNA, 20 bp, Artificial
  CRISPR gRNA sequence
gcaacctccctcctctgtta

SEQ ID NO: 57047 - DNA, 20 bp, Artificial
  CRISPR gRNA sequence
catttcctcacttcccttaa

SEQ ID NO: 57048 - DNA, 20 bp, Artificial
  CRISPR gRNA sequence
tcacttcccttaatagtttc

SEQ ID NO: 57049 - DNA, 20 bp, Artificial
  CRISPR gRNA sequence
acttcccttaatagtttctg

SEQ ID NO: 57050 - DNA, 20 bp, Artificial
  CRISPR gRNA sequence
tggagtcttgtctcattgta

SEQ ID NO: 57051 - DNA, 20 bp, Artificial
  CRISPR gRNA sequence
caatcactttaatgcctttc

SEQ ID NO: 57052 - DNA, 20 bp, Artificial
  CRISPR gRNA sequence
tcactttaatgcctttctgg

SEQ ID NO: 57053 - DNA, 20 bp, Artificial
  CRISPR gRNA sequence
actttaatgcctttctggaa

SEQ ID NO: 57054 - DNA, 20 bp, Artificial
  CRISPR gRNA sequence
atgcctttctggaagagttt

SEQ ID NO: 57055 - DNA, 20 bp, Artificial
  CRISPR gRNA sequence
ctttctggaagagtttgaga

SEQ ID NO: 57056 - DNA, 20 bp, Artificial
  CRISPR gRNA sequence
tttctggaagagtttgagaa

SEQ ID NO: 57057 - DNA, 20 bp, Artificial
  CRISPR gRNA sequence
ctggaagagtttgagaaagg

SEQ ID NO: 57058 - DNA, 20 bp, Artificial
  CRISPR gRNA sequence
gaagagtttgagaaaggaag

SEQ ID NO: 57059 - DNA, 20 bp, Artificial
  CRISPR gRNA sequence
aagagtttgagaaaggaaga

SEQ ID NO: 57060 - DNA, 20 bp, Artificial
  CRISPR gRNA sequence
gagaaaggaagaaggaaaac

SEQ ID NO: 57061 - DNA, 20 bp, Artificial
  CRISPR gRNA sequence
aaaggaagaaggaaaacaag

SEQ ID NO: 57062 - DNA, 20 bp, Artificial
  CRISPR gRNA sequence
aaggaagaaggaaaacaaga

SEQ ID NO: 57063 - DNA, 20 bp, Artificial
  CRISPR gRNA sequence
gaagaaggaaaacaagaagg

SEQ ID NO: 57064 - DNA, 20 bp, Artificial
  CRISPR gRNA sequence
aagaaggaaaacaagaagga

SEQ ID NO: 57065 - DNA, 20 bp, Artificial
  CRISPR gRNA sequence
agaaggaaaacaagaaggaa

SEQ ID NO: 57066 - DNA, 20 bp, Artificial
  CRISPR gRNA sequence
gaaggaaaacaagaaggaag

SEQ ID NO: 57067 - DNA, 20 bp, Artificial
  CRISPR gRNA sequence
aaacaagaaggaaggggacc

SEQ ID NO: 57068 - DNA, 20 bp, Artificial
  CRISPR gRNA sequence
aagaaggaaggggacccaga

SEQ ID NO: 57069 - DNA, 20 bp, Artificial
  CRISPR gRNA sequence
agaaggaaggggacccagaa

SEQ ID NO: 57070 - DNA, 20 bp, Artificial
  CRISPR gRNA sequence
aggaaggggacccagaaagg

SEQ ID NO: 57071 - DNA, 20 bp, Artificial
  CRISPR gRNA sequence
ggaaggggacccagaaagga

SEQ ID NO: 57072 - DNA, 20 bp, Artificial
  CRISPR gRNA sequence
gaaggggacccagaaaggaa

SEQ ID NO: 57073 - DNA, 20 bp, Artificial
  CRISPR gRNA sequence
aggggacccagaaaggaagg

SEQ ID NO: 57074 - DNA, 20 bp, Artificial
  CRISPR gRNA sequence
ggggacccagaaaggaaggg

SEQ ID NO: 57075 - DNA, 20 bp, Artificial
  CRISPR gRNA sequence
gggacccagaaaggaaggga

SEQ ID NO: 57076 - DNA, 20 bp, Artificial
  CRISPR gRNA sequence
gacccagaaaggaagggagg

SEQ ID NO: 57077 - DNA, 20 bp, Artificial
  CRISPR gRNA sequence
cagaaaggaagggagggaga

SEQ ID NO: 57078 - DNA, 20 bp, Artificial
  CRISPR gRNA sequence
agaaaggaagggagggagaa

SEQ ID NO: 57079 - DNA, 20 bp, Artificial
  CRISPR gRNA sequence
aggaagggagggagaaagga

SEQ ID NO: 57080 - DNA, 20 bp, Artificial
  CRISPR gRNA sequence
gaagggagggagaaaggaaa

SEQ ID NO: 57081 - DNA, 20 bp, Artificial
  CRISPR gRNA sequence
aagggagggagaaaggaaag

SEQ ID NO: 57082 - DNA, 20 bp, Artificial
  CRISPR gRNA sequence
gggagaaaggaaagaggact

SEQ ID NO: 57083 - DNA, 20 bp, Artificial
  CRISPR gRNA sequence
ggagaaaggaaagaggactc

SEQ ID NO: 57084 - DNA, 20 bp, Artificial
  CRISPR gRNA sequence
aaaggaaagaggactcagga

SEQ ID NO: 57085 - DNA, 20 bp, Artificial
  CRISPR gRNA sequence
aggactcaggaaagaatttt

SEQ ID NO: 57086 - DNA, 20 bp, Artificial
  CRISPR gRNA sequence
actcaggaaagaattttaag

SEQ ID NO: 57087 - DNA, 20 bp, Artificial
  CRISPR gRNA sequence
ggaaagaattttaagaagtc

SEQ ID NO: 57088 - DNA, 20 bp, Artificial
  CRISPR gRNA sequence
aagaattttaagaagtcaag

SEQ ID NO: 57089 - DNA, 20 bp, Artificial
  CRISPR gRNA sequence
agaattttaagaagtcaagc

SEQ ID NO: 57090 - DNA, 20 bp, Artificial
  CRISPR gRNA sequence
gaattttaagaagtcaagca

SEQ ID NO: 57091 - DNA, 20 bp, Artificial
  CRISPR gRNA sequence
agtcaagcagggtcctccta

SEQ ID NO: 57092 - DNA, 20 bp, Artificial
  CRISPR gRNA sequence
agcagggtcctcctacagct

SEQ ID NO: 57093 - DNA, 20 bp, Artificial
  CRISPR gRNA sequence
ggtcctcctacagctaagct

SEQ ID NO: 57094 - DNA, 20 bp, Artificial
  CRISPR gRNA sequence
cagctaagctaagtgaccaa

SEQ ID NO: 57095 - DNA, 20 bp, Artificial
  CRISPR gRNA sequence
agctaagctaagtgaccaat

SEQ ID NO: 57096 - DNA, 20 bp, Artificial
  CRISPR gRNA sequence
agctaagtgaccaataggaa

SEQ ID NO: 57097 - DNA, 20 bp, Artificial
  CRISPR gRNA sequence
tgaccaataggaacagcccc

SEQ ID NO: 57098 - DNA, 20 bp, Artificial
  CRISPR gRNA sequence
accaataggaacagcccctg

SEQ ID NO: 57099 - DNA, 20 bp, Artificial
  CRISPR gRNA sequence
aataggaacagcccctggag

SEQ ID NO: 57100 - DNA, 20 bp, Artificial
  CRISPR gRNA sequence
ataggaacagcccctggagc

SEQ ID NO: 57101 - DNA, 20 bp, Artificial
  CRISPR gRNA sequence
taggaacagcccctggagca

SEQ ID NO: 57102 - DNA, 20 bp, Artificial
  CRISPR gRNA sequence
cagcccctggagcagggccc

SEQ ID NO: 57103 - DNA, 20 bp, Artificial
  CRISPR gRNA sequence
agcccctggagcagggccct

SEQ ID NO: 57104 - DNA, 20 bp, Artificial
  CRISPR gRNA sequence
agggccctgggctccttgtc

SEQ ID NO: 57105 - DNA, 20 bp, Artificial
  CRISPR gRNA sequence
ccctgggctccttgtccagc

SEQ ID NO: 57106 - DNA, 20 bp, Artificial
  CRISPR gRNA sequence
cctgggctccttgtccagct

SEQ ID NO: 57107 - DNA, 20 bp, Artificial
  CRISPR gRNA sequence
tgggctccttgtccagctag

SEQ ID NO: 57108 - DNA, 20 bp, Artificial
  CRISPR gRNA sequence
gggctccttgtccagctagg

SEQ ID NO: 57109 - DNA, 20 bp, Artificial
  CRISPR gRNA sequence
tccttgtccagctaggaggc

SEQ ID NO: 57110 - DNA, 20 bp, Artificial
  CRISPR gRNA sequence
tccagctaggaggctggaac

SEQ ID NO: 57111 - DNA, 20 bp, Artificial
  CRISPR gRNA sequence
taggaggctggaaccagttc

SEQ ID NO: 57112 - DNA, 20 bp, Artificial
  CRISPR gRNA sequence
ggaggctggaaccagttcga

SEQ ID NO: 57113 - DNA, 20 bp, Artificial
  CRISPR gRNA sequence
ttaacaaatcctatattaaa

SEQ ID NO: 57114 - DNA, 20 bp, Artificial
  CRISPR gRNA sequence
taacaaatcctatattaaaa

SEQ ID NO: 57115 - DNA, 20 bp, Artificial
  CRISPR gRNA sequence
aacaaatcctatattaaaaa

SEQ ID NO: 57116 - DNA, 20 bp, Artificial
  CRISPR gRNA sequence
tatattaaaaagggactcac

SEQ ID NO: 57117 - DNA, 20 bp, Artificial
  CRISPR gRNA sequence
ctcactggccaaatatcaat

SEQ ID NO: 57118 - DNA, 20 bp, Artificial
  CRISPR gRNA sequence
ggccaaatatcaatcagatc

SEQ ID NO: 57119 - DNA, 20 bp, Artificial
  CRISPR gRNA sequence
atatcaatcagatctggtta

SEQ ID NO: 57120 - DNA, 20 bp, Artificial
  CRISPR gRNA sequence
tcagatctggttacagccat

SEQ ID NO: 57121 - DNA, 20 bp, Artificial
  CRISPR gRNA sequence
cagccatgagataatgatgc

SEQ ID NO: 57122 - DNA, 20 bp, Artificial
  CRISPR gRNA sequence
atgagataatgatgccagct

SEQ ID NO: 57123 - DNA, 20 bp, Artificial
  CRISPR gRNA sequence
atgatgccagctcagtgatg

SEQ ID NO: 57124 - DNA, 20 bp, Artificial
  CRISPR gRNA sequence
tgatgccagctcagtgatgc

SEQ ID NO: 57125 - DNA, 20 bp, Artificial
  CRISPR gRNA sequence
gctcagtgatgcgggcctat

SEQ ID NO: 57126 - DNA, 20 bp, Artificial
  CRISPR gRNA sequence
gtgatgcgggcctattggac

SEQ ID NO: 57127 - DNA, 20 bp, Artificial
  CRISPR gRNA sequence
tgatgcgggcctattggacc

SEQ ID NO: 57128 - DNA, 20 bp, Artificial
  CRISPR gRNA sequence
gatgcgggcctattggacca

SEQ ID NO: 57129 - DNA, 20 bp, Artificial
  CRISPR gRNA sequence
ggcctattggaccagggact

SEQ ID NO: 57130 - DNA, 20 bp, Artificial
  CRISPR gRNA sequence
tattggaccagggacttgga

SEQ ID NO: 57131 - DNA, 20 bp, Artificial
  CRISPR gRNA sequence
cttggacagttttgattcac

SEQ ID NO: 57132 - DNA, 20 bp, Artificial
  CRISPR gRNA sequence
ttggacagttttgattcact

SEQ ID NO: 57133 - DNA, 20 bp, Artificial
  CRISPR gRNA sequence
tggacagttttgattcactg

SEQ ID NO: 57134 - DNA, 20 bp, Artificial
  CRISPR gRNA sequence
gacagttttgattcactggg

SEQ ID NO: 57135 - DNA, 20 bp, Artificial
  CRISPR gRNA sequence
ttttgattcactggggagct

SEQ ID NO: 57136 - DNA, 20 bp, Artificial
  CRISPR gRNA sequence
tttgattcactggggagctg

SEQ ID NO: 57137 - DNA, 20 bp, Artificial
  CRISPR gRNA sequence
tcactggggagctgaggtta

SEQ ID NO: 57138 - DNA, 20 bp, Artificial
  CRISPR gRNA sequence
cactggggagctgaggttat

SEQ ID NO: 57139 - DNA, 20 bp, Artificial
  CRISPR gRNA sequence
actggggagctgaggttata

SEQ ID NO: 57140 - DNA, 20 bp, Artificial
  CRISPR gRNA sequence
ggggagctgaggttataggg

SEQ ID NO: 57141 - DNA, 20 bp, Artificial
  CRISPR gRNA sequence
gggagctgaggttatagggt

SEQ ID NO: 57142 - DNA, 20 bp, Artificial
  CRISPR gRNA sequence
ttatagggtgggttttctgt

SEQ ID NO: 57143 - DNA, 20 bp, Artificial
  CRISPR gRNA sequence
gttggcattactgccatgca

SEQ ID NO: 57144 - DNA, 20 bp, Artificial
  CRISPR gRNA sequence
ttactgccatgcacagcgat

SEQ ID NO: 57145 - DNA, 20 bp, Artificial
  CRISPR gRNA sequence
gccatgcacagcgataagta

SEQ ID NO: 57146 - DNA, 20 bp, Artificial
  CRISPR gRNA sequence
aagtaaagtcaatgcttctg

SEQ ID NO: 57147 - DNA, 20 bp, Artificial
  CRISPR gRNA sequence
tcaatgcttctgtagaaatc

SEQ ID NO: 57148 - DNA, 20 bp, Artificial
  CRISPR gRNA sequence
caatgcttctgtagaaatca

SEQ ID NO: 57149 - DNA, 20 bp, Artificial
  CRISPR gRNA sequence
tctgtagaaatcaaggtgct

SEQ ID NO: 57150 - DNA, 20 bp, Artificial
  CRISPR gRNA sequence
aaatcaaggtgctgagatga

SEQ ID NO: 57151 - DNA, 20 bp, Artificial
  CRISPR gRNA sequence
tgaaagtgtgacccacgaat

SEQ ID NO: 57152 - DNA, 20 bp, Artificial
  CRISPR gRNA sequence
aagtgtgacccacgaatcag

SEQ ID NO: 57153 - DNA, 20 bp, Artificial
  CRISPR gRNA sequence
agtgtgacccacgaatcagt

SEQ ID NO: 57154 - DNA, 20 bp, Artificial
  CRISPR gRNA sequence
gtgacccacgaatcagtagg

SEQ ID NO: 57155 - DNA, 20 bp, Artificial
  CRISPR gRNA sequence
ggtggtcattatttaatcac

SEQ ID NO: 57156 - DNA, 20 bp, Artificial
  CRISPR gRNA sequence
atttaatcactggcccttcc

SEQ ID NO: 57157 - DNA, 20 bp, Artificial
  CRISPR gRNA sequence
ctggcccttccgagctcctt

SEQ ID NO: 57158 - DNA, 20 bp, Artificial
  CRISPR gRNA sequence
tccgagctccttcagaaaat

SEQ ID NO: 57159 - DNA, 20 bp, Artificial
  CRISPR gRNA sequence
ctccttcagaaaatcagcca

SEQ ID NO: 57160 - DNA, 20 bp, Artificial
  CRISPR gRNA sequence
tccttcagaaaatcagccaa

SEQ ID NO: 57161 - DNA, 20 bp, Artificial
  CRISPR gRNA sequence
agccaaaggctcccccgctg

SEQ ID NO: 57162 - DNA, 20 bp, Artificial
  CRISPR gRNA sequence
aaaggctcccccgctgaaga

SEQ ID NO: 57163 - DNA, 20 bp, Artificial
  CRISPR gRNA sequence
ggctcccccgctgaagacag

SEQ ID NO: 57164 - DNA, 20 bp, Artificial
  CRISPR gRNA sequence
cccgctgaagacagcagctg

SEQ ID NO: 57165 - DNA, 20 bp, Artificial
  CRISPR gRNA sequence
ccgctgaagacagcagctgt

SEQ ID NO: 57166 - DNA, 20 bp, Artificial
  CRISPR gRNA sequence
tgaagacagcagctgtgggt

SEQ ID NO: 57167 - DNA, 20 bp, Artificial
  CRISPR gRNA sequence
agcagctgtgggtgagtgtc

SEQ ID NO: 57168 - DNA, 20 bp, Artificial
  CRISPR gRNA sequence
tgtgggtgagtgtcaagtcc

SEQ ID NO: 57169 - DNA, 20 bp, Artificial
  CRISPR gRNA sequence
gtgggtgagtgtcaagtcca

SEQ ID NO: 57170 - DNA, 20 bp, Artificial
  CRISPR gRNA sequence
gtgtcaagtccaaggtgtac

SEQ ID NO: 57171 - DNA, 20 bp, Artificial
  CRISPR gRNA sequence
caagtccaaggtgtacaagt

SEQ ID NO: 57172 - DNA, 20 bp, Artificial
  CRISPR gRNA sequence
aagtccaaggtgtacaagtc

SEQ ID NO: 57173 - DNA, 20 bp, Artificial
  CRISPR gRNA sequence
gtccaaggtgtacaagtcgg

SEQ ID NO: 57174 - DNA, 20 bp, Artificial
  CRISPR gRNA sequence
tccaaggtgtacaagtcggg

SEQ ID NO: 57175 - DNA, 20 bp, Artificial
  CRISPR gRNA sequence
ccaaggtgtacaagtcggga

SEQ ID NO: 57176 - DNA, 20 bp, Artificial
  CRISPR gRNA sequence
caaggtgtacaagtcgggag

SEQ ID NO: 57177 - DNA, 20 bp, Artificial
  CRISPR gRNA sequence
aaggtgtacaagtcgggagg

SEQ ID NO: 57178 - DNA, 20 bp, Artificial
  CRISPR gRNA sequence
gtgtacaagtcgggaggggg

SEQ ID NO: 57179 - DNA, 20 bp, Artificial
  CRISPR gRNA sequence
acaagtcgggagggggtggt

SEQ ID NO: 57180 - DNA, 20 bp, Artificial
  CRISPR gRNA sequence
caagtcgggagggggtggtt

SEQ ID NO: 57181 - DNA, 20 bp, Artificial
  CRISPR gRNA sequence
aagtcgggagggggtggtta

SEQ ID NO: 57182 - DNA, 20 bp, Artificial
  CRISPR gRNA sequence
gtggttagggcttccccatg

SEQ ID NO: 57183 - DNA, 20 bp, Artificial
  CRISPR gRNA sequence
ccccatgaagcctgacactt

SEQ ID NO: 57184 - DNA, 20 bp, Artificial
  CRISPR gRNA sequence
cccatgaagcctgacacttt

SEQ ID NO: 57185 - DNA, 20 bp, Artificial
  CRISPR gRNA sequence
ccatgaagcctgacactttg

SEQ ID NO: 57186 - DNA, 20 bp, Artificial
  CRISPR gRNA sequence
gaagcctgacactttggggc

SEQ ID NO: 57187 - DNA, 20 bp, Artificial
  CRISPR gRNA sequence
aagcctgacactttggggct

SEQ ID NO: 57188 - DNA, 20 bp, Artificial
  CRISPR gRNA sequence
gcctgacactttggggctgg

SEQ ID NO: 57189 - DNA, 20 bp, Artificial
  CRISPR gRNA sequence
acactttggggctgggagat

SEQ ID NO: 57190 - DNA, 20 bp, Artificial
  CRISPR gRNA sequence
cactttggggctgggagatg

SEQ ID NO: 57191 - DNA, 20 bp, Artificial
  CRISPR gRNA sequence
ggctgggagatgaggccctg

SEQ ID NO: 57192 - DNA, 20 bp, Artificial
  CRISPR gRNA sequence
gctgggagatgaggccctgc

SEQ ID NO: 57193 - DNA, 20 bp, Artificial
  CRISPR gRNA sequence
agatgaggccctgcgggttg

SEQ ID NO: 57194 - DNA, 20 bp, Artificial
  CRISPR gRNA sequence
gatgaggccctgcgggttgc

SEQ ID NO: 57195 - DNA, 20 bp, Artificial
  CRISPR gRNA sequence
gaggccctgcgggttgcggg

SEQ ID NO: 57196 - DNA, 20 bp, Artificial
  CRISPR gRNA sequence
aggccctgcgggttgcgggc

SEQ ID NO: 57197 - DNA, 20 bp, Artificial
  CRISPR gRNA sequence
cctgcgggttgcgggcagga

SEQ ID NO: 57198 - DNA, 20 bp, Artificial
  CRISPR gRNA sequence
cgggttgcgggcaggaaagt

SEQ ID NO: 57199 - DNA, 20 bp, Artificial
  CRISPR gRNA sequence
tgcgggcaggaaagtgagaa

SEQ ID NO: 57200 - DNA, 20 bp, Artificial
  CRISPR gRNA sequence
gcgggcaggaaagtgagaac

SEQ ID NO: 57201 - DNA, 20 bp, Artificial
  CRISPR gRNA sequence
aaagtgagaacaggcttcct

SEQ ID NO: 57202 - DNA, 20 bp, Artificial
  CRISPR gRNA sequence
aagtgagaacaggcttcctg

SEQ ID NO: 57203 - DNA, 20 bp, Artificial
  CRISPR gRNA sequence
agtgagaacaggcttcctga

SEQ ID NO: 57204 - DNA, 20 bp, Artificial
  CRISPR gRNA sequence
gtgagaacaggcttcctgag

SEQ ID NO: 57205 - DNA, 20 bp, Artificial
  CRISPR gRNA sequence
acaggcttcctgaggggttc

SEQ ID NO: 57206 - DNA, 20 bp, Artificial
  CRISPR gRNA sequence
caggcttcctgaggggttcc

SEQ ID NO: 57207 - DNA, 20 bp, Artificial
  CRISPR gRNA sequence
cttcctgaggggttccaggt

SEQ ID NO: 57208 - DNA, 20 bp, Artificial
  CRISPR gRNA sequence
gggttccaggttagaccctt

SEQ ID NO: 57209 - DNA, 20 bp, Artificial
  CRISPR gRNA sequence
caggttagaccctttagaat

SEQ ID NO: 57210 - DNA, 20 bp, Artificial
  CRISPR gRNA sequence
agaccctttagaattggtaa

SEQ ID NO: 57211 - DNA, 20 bp, Artificial
  CRISPR gRNA sequence
gaccctttagaattggtaac

SEQ ID NO: 57212 - DNA, 20 bp, Artificial
  CRISPR gRNA sequence
tttagaattggtaacgggac

SEQ ID NO: 57213 - DNA, 20 bp, Artificial
  CRISPR gRNA sequence
attggtaacgggacaagcta

SEQ ID NO: 57214 - DNA, 20 bp, Artificial
  CRISPR gRNA sequence
gggacaagctaaagccttga

SEQ ID NO: 57215 - DNA, 20 bp, Artificial
  CRISPR gRNA sequence
taaagccttgaaagtcactg

SEQ ID NO: 57216 - DNA, 20 bp, Artificial
  CRISPR gRNA sequence
aaagccttgaaagtcactgc

SEQ ID NO: 57217 - DNA, 20 bp, Artificial
  CRISPR gRNA sequence
agccttgaaagtcactgcag

SEQ ID NO: 57218 - DNA, 20 bp, Artificial
  CRISPR gRNA sequence
gccttgaaagtcactgcagg

SEQ ID NO: 57219 - DNA, 20 bp, Artificial
  CRISPR gRNA sequence
cttgaaagtcactgcaggag

SEQ ID NO: 57220 - DNA, 20 bp, Artificial
  CRISPR gRNA sequence
ttgaaagtcactgcaggagg

SEQ ID NO: 57221 - DNA, 20 bp, Artificial
  CRISPR gRNA sequence
aaagtcactgcaggaggagg

SEQ ID NO: 57222 - DNA, 20 bp, Artificial
  CRISPR gRNA sequence
aagtcactgcaggaggaggt

SEQ ID NO: 57223 - DNA, 20 bp, Artificial
  CRISPR gRNA sequence
agtcactgcaggaggaggtg

SEQ ID NO: 57224 - DNA, 20 bp, Artificial
  CRISPR gRNA sequence
actgcaggaggaggtggggc

SEQ ID NO: 57225 - DNA, 20 bp, Artificial
  CRISPR gRNA sequence
ctgcaggaggaggtggggct

SEQ ID NO: 57226 - DNA, 20 bp, Artificial
  CRISPR gRNA sequence
gcaggaggaggtggggctgg

SEQ ID NO: 57227 - DNA, 20 bp, Artificial
  CRISPR gRNA sequence
ggaggtggggctgggagaca

SEQ ID NO: 57228 - DNA, 20 bp, Artificial
  CRISPR gRNA sequence
gtggggctgggagacacagt

SEQ ID NO: 57229 - DNA, 20 bp, Artificial
  CRISPR gRNA sequence
tggggctgggagacacagtt

SEQ ID NO: 57230 - DNA, 20 bp, Artificial
  CRISPR gRNA sequence
ggggctgggagacacagtta

SEQ ID NO: 57231 - DNA, 20 bp, Artificial
  CRISPR gRNA sequence
gggctgggagacacagttag

SEQ ID NO: 57232 - DNA, 20 bp, Artificial
  CRISPR gRNA sequence
gggcttgacacacttgcaaa

SEQ ID NO: 57233 - DNA, 20 bp, Artificial
  CRISPR gRNA sequence
ggcttgacacacttgcaaat

SEQ ID NO: 57234 - DNA, 20 bp, Artificial
  CRISPR gRNA sequence
tgacacacttgcaaatgggt

SEQ ID NO: 57235 - DNA, 20 bp, Artificial
  CRISPR gRNA sequence
gacacacttgcaaatgggtc

SEQ ID NO: 57236 - DNA, 20 bp, Artificial
  CRISPR gRNA sequence
acacacttgcaaatgggtca

SEQ ID NO: 57237 - DNA, 20 bp, Artificial
  CRISPR gRNA sequence
acttgcaaatgggtcaggga

SEQ ID NO: 57238 - DNA, 20 bp, Artificial
  CRISPR gRNA sequence
aaatgggtcagggacagacg

SEQ ID NO: 57239 - DNA, 20 bp, Artificial
  CRISPR gRNA sequence
atgggtcagggacagacgaa

SEQ ID NO: 57240 - DNA, 20 bp, Artificial
  CRISPR gRNA sequence
tcagggacagacgaagagca

SEQ ID NO: 57241 - DNA, 20 bp, Artificial
  CRISPR gRNA sequence
agacgaagagcatggcctat

SEQ ID NO: 57242 - DNA, 20 bp, Artificial
  CRISPR gRNA sequence
agagcatggcctatgagaaa

SEQ ID NO: 57243 - DNA, 20 bp, Artificial
  CRISPR gRNA sequence
ctatgagaaatggctgtgac

SEQ ID NO: 57244 - DNA, 20 bp, Artificial
  CRISPR gRNA sequence
atggctgtgaccagccacca

SEQ ID NO: 57245 - DNA, 20 bp, Artificial
  CRISPR gRNA sequence
accagccaccacagcctcca

SEQ ID NO: 57246 - DNA, 20 bp, Artificial
  CRISPR gRNA sequence
acagcctccacagcctcctc

SEQ ID NO: 57247 - DNA, 20 bp, Artificial
  CRISPR gRNA sequence
ctccacagcctcctccagct

SEQ ID NO: 57248 - DNA, 20 bp, Artificial
  CRISPR gRNA sequence
cacagcctcctccagcttgg

SEQ ID NO: 57249 - DNA, 20 bp, Artificial
  CRISPR gRNA sequence
agcctcctccagcttggaag

SEQ ID NO: 57250 - DNA, 20 bp, Artificial
  CRISPR gRNA sequence
gcctcctccagcttggaagt

SEQ ID NO: 57251 - DNA, 20 bp, Artificial
  CRISPR gRNA sequence
cctcctccagcttggaagtg

SEQ ID NO: 57252 - DNA, 20 bp, Artificial
  CRISPR gRNA sequence
gcttggaagtggggacttca

SEQ ID NO: 57253 - DNA, 20 bp, Artificial
  CRISPR gRNA sequence
cccttcccaccccccaactc

SEQ ID NO: 57254 - DNA, 20 bp, Artificial
  CRISPR gRNA sequence
cccaactccagtcctcacca

SEQ ID NO: 57255 - DNA, 20 bp, Artificial
  CRISPR gRNA sequence
aactccagtcctcaccatgg

SEQ ID NO: 57256 - DNA, 20 bp, Artificial
  CRISPR gRNA sequence
ctccagtcctcaccatggtg

SEQ ID NO: 57257 - DNA, 20 bp, Artificial
  CRISPR gRNA sequence
gtcctcaccatggtggagct

SEQ ID NO: 57258 - DNA, 20 bp, Artificial
  CRISPR gRNA sequence
accatggtggagctgagatt

SEQ ID NO: 57259 - DNA, 20 bp, Artificial
  CRISPR gRNA sequence
ccatggtggagctgagattc

SEQ ID NO: 57260 - DNA, 20 bp, Artificial
  CRISPR gRNA sequence
ggtggagctgagattcaggt

SEQ ID NO: 57261 - DNA, 20 bp, Artificial
  CRISPR gRNA sequence
ttcaggttggcttttcccct

SEQ ID NO: 57262 - DNA, 20 bp, Artificial
  CRISPR gRNA sequence
tggcttttcccctcagctcc

SEQ ID NO: 57263 - DNA, 20 bp, Artificial
  CRISPR gRNA sequence
ttttcccctcagctcccagc

SEQ ID NO: 57264 - DNA, 20 bp, Artificial
  CRISPR gRNA sequence
cccctcagctcccagctggc

SEQ ID NO: 57265 - DNA, 20 bp, Artificial
  CRISPR gRNA sequence
agctggctggtgaaccctgc

SEQ ID NO: 57266 - DNA, 20 bp, Artificial
  CRISPR gRNA sequence
ctggctggtgaaccctgcaa

SEQ ID NO: 57267 - DNA, 20 bp, Artificial
  CRISPR gRNA sequence
ggctggtgaaccctgcaaga

SEQ ID NO: 57268 - DNA, 20 bp, Artificial
  CRISPR gRNA sequence
gctggtgaaccctgcaagag

SEQ ID NO: 57269 - DNA, 20 bp, Artificial
  CRISPR gRNA sequence
ctggtgaaccctgcaagaga

SEQ ID NO: 57270 - DNA, 20 bp, Artificial
  CRISPR gRNA sequence
tggtgaaccctgcaagagag

SEQ ID NO: 57271 - DNA, 20 bp, Artificial
  CRISPR gRNA sequence
gtgaaccctgcaagagaggg

SEQ ID NO: 57272 - DNA, 20 bp, Artificial
  CRISPR gRNA sequence
gaaccctgcaagagagggga

SEQ ID NO: 57273 - DNA, 20 bp, Artificial
  CRISPR gRNA sequence
agagaggggagagtataatg

SEQ ID NO: 57274 - DNA, 20 bp, Artificial
  CRISPR gRNA sequence
ggggagagtataatgtggta

SEQ ID NO: 57275 - DNA, 20 bp, Artificial
  CRISPR gRNA sequence
gggagagtataatgtggtat

SEQ ID NO: 57276 - DNA, 20 bp, Artificial
  CRISPR gRNA sequence
ggagagtataatgtggtatg

SEQ ID NO: 57277 - DNA, 20 bp, Artificial
  CRISPR gRNA sequence
taatgtggtatggggctgtc

SEQ ID NO: 57278 - DNA, 20 bp, Artificial
  CRISPR gRNA sequence
aatgtggtatggggctgtcg

SEQ ID NO: 57279 - DNA, 20 bp, Artificial
  CRISPR gRNA sequence
atgtggtatggggctgtcga

SEQ ID NO: 57280 - DNA, 20 bp, Artificial
  CRISPR gRNA sequence
atggggctgtcgagggatgc

SEQ ID NO: 57281 - DNA, 20 bp, Artificial
  CRISPR gRNA sequence
tggggctgtcgagggatgct

SEQ ID NO: 57282 - DNA, 20 bp, Artificial
  CRISPR gRNA sequence
ggggctgtcgagggatgctg

SEQ ID NO: 57283 - DNA, 20 bp, Artificial
  CRISPR gRNA sequence
tgtcgagggatgctggggac

SEQ ID NO: 57284 - DNA, 20 bp, Artificial
  CRISPR gRNA sequence
gggatgctggggaccagctc

SEQ ID NO: 57285 - DNA, 20 bp, Artificial
  CRISPR gRNA sequence
gctggggaccagctctggcc

SEQ ID NO: 57286 - DNA, 20 bp, Artificial
  CRISPR gRNA sequence
accagctctggcctggcgcc

SEQ ID NO: 57287 - DNA, 20 bp, Artificial
  CRISPR gRNA sequence
ctctggcctggcgcctggct

SEQ ID NO: 57288 - DNA, 20 bp, Artificial
  CRISPR gRNA sequence
tctggcctggcgcctggctc

SEQ ID NO: 57289 - DNA, 20 bp, Artificial
  CRISPR gRNA sequence
ctggcctggcgcctggctca

SEQ ID NO: 57290 - DNA, 20 bp, Artificial
  CRISPR gRNA sequence
ctggctcagggctcatctca

SEQ ID NO: 57291 - DNA, 20 bp, Artificial
  CRISPR gRNA sequence
tggctcagggctcatctcac

SEQ ID NO: 57292 - DNA, 20 bp, Artificial
  CRISPR gRNA sequence
ggctcagggctcatctcaca

SEQ ID NO: 57293 - DNA, 20 bp, Artificial
  CRISPR gRNA sequence
ctcagggctcatctcacagg

SEQ ID NO: 57294 - DNA, 20 bp, Artificial
  CRISPR gRNA sequence
tcatctcacagggagatacc

SEQ ID NO: 57295 - DNA, 20 bp, Artificial
  CRISPR gRNA sequence
ctcacagggagatacccagc

SEQ ID NO: 57296 - DNA, 20 bp, Artificial
  CRISPR gRNA sequence
tcacagggagatacccagca

SEQ ID NO: 57297 - DNA, 20 bp, Artificial
  CRISPR gRNA sequence
cacagggagatacccagcaa

SEQ ID NO: 57298 - DNA, 20 bp, Artificial
  CRISPR gRNA sequence
cagggagatacccagcaagg

SEQ ID NO: 57299 - DNA, 20 bp, Artificial
  CRISPR gRNA sequence
cccagcaagggagaactaaa

SEQ ID NO: 57300 - DNA, 20 bp, Artificial
  CRISPR gRNA sequence
ggagaactaaatggaacact

SEQ ID NO: 57301 - DNA, 20 bp, Artificial
  CRISPR gRNA sequence
gaacactcagttatctgttg

SEQ ID NO: 57302 - DNA, 20 bp, Artificial
  CRISPR gRNA sequence
acactcagttatctgttgtg

SEQ ID NO: 57303 - DNA, 20 bp, Artificial
  CRISPR gRNA sequence
tatctgttgtggagaaaatg

SEQ ID NO: 57304 - DNA, 20 bp, Artificial
  CRISPR gRNA sequence
ctgttgtggagaaaatgtgg

SEQ ID NO: 57305 - DNA, 20 bp, Artificial
  CRISPR gRNA sequence
tgtggagaaaatgtggtggt

SEQ ID NO: 57306 - DNA, 20 bp, Artificial
  CRISPR gRNA sequence
aaatgtggtggtgagctttg

SEQ ID NO: 57307 - DNA, 20 bp, Artificial
  CRISPR gRNA sequence
aatgtggtggtgagctttga

SEQ ID NO: 57308 - DNA, 20 bp, Artificial
  CRISPR gRNA sequence
gtggtggtgagctttgaagg

SEQ ID NO: 57309 - DNA, 20 bp, Artificial
  CRISPR gRNA sequence
gtgagctttgaaggcagtgc

SEQ ID NO: 57310 - DNA, 20 bp, Artificial
  CRISPR gRNA sequence
tgagctttgaaggcagtgct

SEQ ID NO: 57311 - DNA, 20 bp, Artificial
  CRISPR gRNA sequence
gctttgaaggcagtgctggg

SEQ ID NO: 57312 - DNA, 20 bp, Artificial
  CRISPR gRNA sequence
gcagaaatgtgtgtatatgc

SEQ ID NO: 57313 - DNA, 20 bp, Artificial
  CRISPR gRNA sequence
gtgtatatgcaagtgcatgc

SEQ ID NO: 57314 - DNA, 20 bp, Artificial
  CRISPR gRNA sequence
agtttatgtatgtgtgtgca

SEQ ID NO: 57315 - DNA, 20 bp, Artificial
  CRISPR gRNA sequence
gtttatgtatgtgtgtgcac

SEQ ID NO: 57316 - DNA, 20 bp, Artificial
  CRISPR gRNA sequence
gcatgcatgtgttatgcatg

SEQ ID NO: 57317 - DNA, 20 bp, Artificial
  CRISPR gRNA sequence
catgcatgtgttatgcatgt

SEQ ID NO: 57318 - DNA, 20 bp, Artificial
  CRISPR gRNA sequence
cacttgcatgcatgtgtaca

SEQ ID NO: 57319 - DNA, 20 bp, Artificial
  CRISPR gRNA sequence
acttgcatgcatgtgtacat

SEQ ID NO: 57320 - DNA, 20 bp, Artificial
  CRISPR gRNA sequence
aattcccacactctgccttg

SEQ ID NO: 57321 - DNA, 20 bp, Artificial
  CRISPR gRNA sequence
tcccacactctgccttgaag

SEQ ID NO: 57322 - DNA, 20 bp, Artificial
  CRISPR gRNA sequence
cccacactctgccttgaagt

SEQ ID NO: 57323 - DNA, 20 bp, Artificial
  CRISPR gRNA sequence
ccacactctgccttgaagta

SEQ ID NO: 57324 - DNA, 20 bp, Artificial
  CRISPR gRNA sequence
tgccttgaagtagggttctt

SEQ ID NO: 57325 - DNA, 20 bp, Artificial
  CRISPR gRNA sequence
ttgaagtagggttcttaagt

SEQ ID NO: 57326 - DNA, 20 bp, Artificial
  CRISPR gRNA sequence
caatgtcctgtgtttcccct

SEQ ID NO: 57327 - DNA, 20 bp, Artificial
  CRISPR gRNA sequence
tcccctcagtgctgtgcaaa

SEQ ID NO: 57328 - DNA, 20 bp, Artificial
  CRISPR gRNA sequence
cctcagtgctgtgcaaacag

SEQ ID NO: 57329 - DNA, 20 bp, Artificial
  CRISPR gRNA sequence
ctcagtgctgtgcaaacaga

SEQ ID NO: 57330 - DNA, 20 bp, Artificial
  CRISPR gRNA sequence
tgtgcaaacagaaggtgccc

SEQ ID NO: 57331 - DNA, 20 bp, Artificial
  CRISPR gRNA sequence
aggtgcccaagaaatcccca

SEQ ID NO: 57332 - DNA, 20 bp, Artificial
  CRISPR gRNA sequence
cccaagaaatccccacggat

SEQ ID NO: 57333 - DNA, 20 bp, Artificial
  CRISPR gRNA sequence
aagaaatccccacggatcag

SEQ ID NO: 57334 - DNA, 20 bp, Artificial
  CRISPR gRNA sequence
gaaatccccacggatcagta

SEQ ID NO: 57335 - DNA, 20 bp, Artificial
  CRISPR gRNA sequence
aaatccccacggatcagtag

SEQ ID NO: 57336 - DNA, 20 bp, Artificial
  CRISPR gRNA sequence
aatccccacggatcagtaga

SEQ ID NO: 57337 - DNA, 20 bp, Artificial
  CRISPR gRNA sequence
ccccacggatcagtagaggg

SEQ ID NO: 57338 - DNA, 20 bp, Artificial
  CRISPR gRNA sequence
cacggatcagtagagggcag

SEQ ID NO: 57339 - DNA, 20 bp, Artificial
  CRISPR gRNA sequence
acggatcagtagagggcaga

SEQ ID NO: 57340 - DNA, 20 bp, Artificial
  CRISPR gRNA sequence
caaacaaacaaaaacacctc

SEQ ID NO: 57341 - DNA, 20 bp, Artificial
  CRISPR gRNA sequence
caaacaaaaacacctctagc

SEQ ID NO: 57342 - DNA, 20 bp, Artificial
  CRISPR gRNA sequence
aaacaaaaacacctctagcc

SEQ ID NO: 57343 - DNA, 20 bp, Artificial
  CRISPR gRNA sequence
acacctctagccaggtgtga

SEQ ID NO: 57344 - DNA, 20 bp, Artificial
  CRISPR gRNA sequence
atggctcacatctataatcc

SEQ ID NO: 57345 - DNA, 20 bp, Artificial
  CRISPR gRNA sequence
catctataatcccagcactt

SEQ ID NO: 57346 - DNA, 20 bp, Artificial
  CRISPR gRNA sequence
atctataatcccagcacttt

SEQ ID NO: 57347 - DNA, 20 bp, Artificial
  CRISPR gRNA sequence
ctataatcccagcactttgg

SEQ ID NO: 57348 - DNA, 20 bp, Artificial
  CRISPR gRNA sequence
tataatcccagcactttggg

SEQ ID NO: 57349 - DNA, 20 bp, Artificial
  CRISPR gRNA sequence
tcccagcactttgggaggcc

SEQ ID NO: 57350 - DNA, 20 bp, Artificial
  CRISPR gRNA sequence
cccagcactttgggaggcca

SEQ ID NO: 57351 - DNA, 20 bp, Artificial
  CRISPR gRNA sequence
ccagcactttgggaggccaa

SEQ ID NO: 57352 - DNA, 20 bp, Artificial
  CRISPR gRNA sequence
agcactttgggaggccaagg

SEQ ID NO: 57353 - DNA, 20 bp, Artificial
  CRISPR gRNA sequence
gcactttgggaggccaaggg

SEQ ID NO: 57354 - DNA, 20 bp, Artificial
  CRISPR gRNA sequence
actttgggaggccaagggag

SEQ ID NO: 57355 - DNA, 20 bp, Artificial
  CRISPR gRNA sequence
ctttgggaggccaagggagg

SEQ ID NO: 57356 - DNA, 20 bp, Artificial
  CRISPR gRNA sequence
ccaagggaggaggatcactt

SEQ ID NO: 57357 - DNA, 20 bp, Artificial
  CRISPR gRNA sequence
caagggaggaggatcactta

SEQ ID NO: 57358 - DNA, 20 bp, Artificial
  CRISPR gRNA sequence
ggaggaggatcacttaaggc

SEQ ID NO: 57359 - DNA, 20 bp, Artificial
  CRISPR gRNA sequence
gaggaggatcacttaaggcc

SEQ ID NO: 57360 - DNA, 20 bp, Artificial
  CRISPR gRNA sequence
ggaggatcacttaaggccag

SEQ ID NO: 57361 - DNA, 20 bp, Artificial
  CRISPR gRNA sequence
tcacttaaggccaggagttc

SEQ ID NO: 57362 - DNA, 20 bp, Artificial
  CRISPR gRNA sequence
taaggccaggagttcaagac

SEQ ID NO: 57363 - DNA, 20 bp, Artificial
  CRISPR gRNA sequence
ccaggagttcaagaccagcc

SEQ ID NO: 57364 - DNA, 20 bp, Artificial
  CRISPR gRNA sequence
caggagttcaagaccagcct

SEQ ID NO: 57365 - DNA, 20 bp, Artificial
  CRISPR gRNA sequence
caagaccagcctgggcaaca

SEQ ID NO: 57366 - DNA, 20 bp, Artificial
  CRISPR gRNA sequence
gtgatgtcctgtctctacaa

SEQ ID NO: 57367 - DNA, 20 bp, Artificial
  CRISPR gRNA sequence
tctacaaaagaatgaaaaat

SEQ ID NO: 57368 - DNA, 20 bp, Artificial
  CRISPR gRNA sequence
aatgaaaaattagcctaatg

SEQ ID NO: 57369 - DNA, 20 bp, Artificial
  CRISPR gRNA sequence
gaaaaattagcctaatgtgg

SEQ ID NO: 57370 - DNA, 20 bp, Artificial
  CRISPR gRNA sequence
aatgtggtggcatgcaccta

SEQ ID NO: 57371 - DNA, 20 bp, Artificial
  CRISPR gRNA sequence
atgcacctatagttctactg

SEQ ID NO: 57372 - DNA, 20 bp, Artificial
  CRISPR gRNA sequence
ctatagttctactgtagtct

SEQ ID NO: 57373 - DNA, 20 bp, Artificial
  CRISPR gRNA sequence
ctactgtagtctcagctact

SEQ ID NO: 57374 - DNA, 20 bp, Artificial
  CRISPR gRNA sequence
tactgtagtctcagctactt

SEQ ID NO: 57375 - DNA, 20 bp, Artificial
  CRISPR gRNA sequence
ctgtagtctcagctacttgg

SEQ ID NO: 57376 - DNA, 20 bp, Artificial
  CRISPR gRNA sequence
tgtagtctcagctacttggg

SEQ ID NO: 57377 - DNA, 20 bp, Artificial
  CRISPR gRNA sequence
ctcagctacttgggaggctg

SEQ ID NO: 57378 - DNA, 20 bp, Artificial
  CRISPR gRNA sequence
agctacttgggaggctgaag

SEQ ID NO: 57379 - DNA, 20 bp, Artificial
  CRISPR gRNA sequence
gctacttgggaggctgaagt

SEQ ID NO: 57380 - DNA, 20 bp, Artificial
  CRISPR gRNA sequence
acttgggaggctgaagtggg

SEQ ID NO: 57381 - DNA, 20 bp, Artificial
  CRISPR gRNA sequence
cttgggaggctgaagtggga

SEQ ID NO: 57382 - DNA, 20 bp, Artificial
  CRISPR gRNA sequence
tgaagtgggaaggatcacct

SEQ ID NO: 57383 - DNA, 20 bp, Artificial
  CRISPR gRNA sequence
gggaaggatcacctgagtcc

SEQ ID NO: 57384 - DNA, 20 bp, Artificial
  CRISPR gRNA sequence
gaaggatcacctgagtcctg

SEQ ID NO: 57385 - DNA, 20 bp, Artificial
  CRISPR gRNA sequence
gatcacctgagtcctggagt

SEQ ID NO: 57386 - DNA, 20 bp, Artificial
  CRISPR gRNA sequence
agtcctggagttggatgctg

SEQ ID NO: 57387 - DNA, 20 bp, Artificial
  CRISPR gRNA sequence
ctggagttggatgctgtagt

SEQ ID NO: 57388 - DNA, 20 bp, Artificial
  CRISPR gRNA sequence
atgattgtgccactgcactc

SEQ ID NO: 57389 - DNA, 20 bp, Artificial
  CRISPR gRNA sequence
tgtgccactgcactccagcc

SEQ ID NO: 57390 - DNA, 20 bp, Artificial
  CRISPR gRNA sequence
gtgccactgcactccagcct

SEQ ID NO: 57391 - DNA, 20 bp, Artificial
  CRISPR gRNA sequence
ctgcactccagcctaggcaa

SEQ ID NO: 57392 - DNA, 20 bp, Artificial
  CRISPR gRNA sequence
gcactccagcctaggcaaca

SEQ ID NO: 57393 - DNA, 20 bp, Artificial
  CRISPR gRNA sequence
tccagcctaggcaacagagc

SEQ ID NO: 57394 - DNA, 20 bp, Artificial
  CRISPR gRNA sequence
acaaacaaacaaaacccaac

SEQ ID NO: 57395 - DNA, 20 bp, Artificial
  CRISPR gRNA sequence
aaacaaacaaaacccaacaa

SEQ ID NO: 57396 - DNA, 20 bp, Artificial
  CRISPR gRNA sequence
cccccccacccccgccaaaa

SEQ ID NO: 57397 - DNA, 20 bp, Artificial
  CRISPR gRNA sequence
ccccacccccgccaaaaaag

SEQ ID NO: 57398 - DNA, 20 bp, Artificial
  CRISPR gRNA sequence
aaaagaagaaataaatctct

SEQ ID NO: 57399 - DNA, 20 bp, Artificial
  CRISPR gRNA sequence
aaagaagaaataaatctctc

SEQ ID NO: 57400 - DNA, 20 bp, Artificial
  CRISPR gRNA sequence
aataaatctctcgggcatta

SEQ ID NO: 57401 - DNA, 20 bp, Artificial
  CRISPR gRNA sequence
ataaatctctcgggcattat

SEQ ID NO: 57402 - DNA, 20 bp, Artificial
  CRISPR gRNA sequence
ctcgggcattatgggctatg

SEQ ID NO: 57403 - DNA, 20 bp, Artificial
  CRISPR gRNA sequence
tcgggcattatgggctatgt

SEQ ID NO: 57404 - DNA, 20 bp, Artificial
  CRISPR gRNA sequence
atgggctatgtgggattttg

SEQ ID NO: 57405 - DNA, 20 bp, Artificial
  CRISPR gRNA sequence
gctatgtgggattttgtggc

SEQ ID NO: 57406 - DNA, 20 bp, Artificial
  CRISPR gRNA sequence
atgtgggattttgtggctgg

SEQ ID NO: 57407 - DNA, 20 bp, Artificial
  CRISPR gRNA sequence
tgggattttgtggctggaag

SEQ ID NO: 57408 - DNA, 20 bp, Artificial
  CRISPR gRNA sequence
tgtggctggaagcagtcact

SEQ ID NO: 57409 - DNA, 20 bp, Artificial
  CRISPR gRNA sequence
aagcagtcactcagcaattc

SEQ ID NO: 57410 - DNA, 20 bp, Artificial
  CRISPR gRNA sequence
ctcagcaattcgagcaattc

SEQ ID NO: 57411 - DNA, 20 bp, Artificial
  CRISPR gRNA sequence
caattcgagcaattcgagtg

SEQ ID NO: 57412 - DNA, 20 bp, Artificial
  CRISPR gRNA sequence
tcgagcaattcgagtgaagc

SEQ ID NO: 57413 - DNA, 20 bp, Artificial
  CRISPR gRNA sequence
cgagcaattcgagtgaagcc

SEQ ID NO: 57414 - DNA, 20 bp, Artificial
  CRISPR gRNA sequence
gcaattcgagtgaagccagg

SEQ ID NO: 57415 - DNA, 20 bp, Artificial
  CRISPR gRNA sequence
attcgagtgaagccaggtag

SEQ ID NO: 57416 - DNA, 20 bp, Artificial
  CRISPR gRNA sequence
ttcgagtgaagccaggtaga

SEQ ID NO: 57417 - DNA, 20 bp, Artificial
  CRISPR gRNA sequence
cgagtgaagccaggtagaag

SEQ ID NO: 57418 - DNA, 20 bp, Artificial
  CRISPR gRNA sequence
gagtgaagccaggtagaagg

SEQ ID NO: 57419 - DNA, 20 bp, Artificial
  CRISPR gRNA sequence
agtgaagccaggtagaagga

SEQ ID NO: 57420 - DNA, 20 bp, Artificial
  CRISPR gRNA sequence
gtgaagccaggtagaaggag

SEQ ID NO: 57421 - DNA, 20 bp, Artificial
  CRISPR gRNA sequence
aggtagaaggaggggtcctc

SEQ ID NO: 57422 - DNA, 20 bp, Artificial
  CRISPR gRNA sequence
ggtagaaggaggggtcctcc

SEQ ID NO: 57423 - DNA, 20 bp, Artificial
  CRISPR gRNA sequence
aggaggggtcctccaggccc

SEQ ID NO: 57424 - DNA, 20 bp, Artificial
  CRISPR gRNA sequence
aggggtcctccaggccccag

SEQ ID NO: 57425 - DNA, 20 bp, Artificial
  CRISPR gRNA sequence
cctccaggccccagcagatt

SEQ ID NO: 57426 - DNA, 20 bp, Artificial
  CRISPR gRNA sequence
ctccaggccccagcagattt

SEQ ID NO: 57427 - DNA, 20 bp, Artificial
  CRISPR gRNA sequence
cccagcagatttgggcgcat

SEQ ID NO: 57428 - DNA, 20 bp, Artificial
  CRISPR gRNA sequence
ccagcagatttgggcgcatt

SEQ ID NO: 57429 - DNA, 20 bp, Artificial
  CRISPR gRNA sequence
gcgcattaggaaatttgttc

SEQ ID NO: 57430 - DNA, 20 bp, Artificial
  CRISPR gRNA sequence
cgcattaggaaatttgttct

SEQ ID NO: 57431 - DNA, 20 bp, Artificial
  CRISPR gRNA sequence
attaggaaatttgttctggg

SEQ ID NO: 57432 - DNA, 20 bp, Artificial
  CRISPR gRNA sequence
aatttgttctgggaagtgtc

SEQ ID NO: 57433 - DNA, 20 bp, Artificial
  CRISPR gRNA sequence
ctgggaagtgtccagaaata

SEQ ID NO: 57434 - DNA, 20 bp, Artificial
  CRISPR gRNA sequence
gggaagtgtccagaaatata

SEQ ID NO: 57435 - DNA, 20 bp, Artificial
  CRISPR gRNA sequence
gtgtccagaaatatagagtt

SEQ ID NO: 57436 - DNA, 20 bp, Artificial
  CRISPR gRNA sequence
gaaatatagagttgagatcg

SEQ ID NO: 57437 - DNA, 20 bp, Artificial
  CRISPR gRNA sequence
tatagagttgagatcgtggc

SEQ ID NO: 57438 - DNA, 20 bp, Artificial
  CRISPR gRNA sequence
atagagttgagatcgtggct

SEQ ID NO: 57439 - DNA, 20 bp, Artificial
  CRISPR gRNA sequence
gctacaccctctctctgact

SEQ ID NO: 57440 - DNA, 20 bp, Artificial
  CRISPR gRNA sequence
ctacaccctctctctgactt

SEQ ID NO: 57441 - DNA, 20 bp, Artificial
  CRISPR gRNA sequence
caccctctctctgacttagg

SEQ ID NO: 57442 - DNA, 20 bp, Artificial
  CRISPR gRNA sequence
accctctctctgacttaggt

SEQ ID NO: 57443 - DNA, 20 bp, Artificial
  CRISPR gRNA sequence
ctctgacttaggtgggtccc

SEQ ID NO: 57444 - DNA, 20 bp, Artificial
  CRISPR gRNA sequence
tctgacttaggtgggtccct

SEQ ID NO: 57445 - DNA, 20 bp, Artificial
  CRISPR gRNA sequence
gtgggtccctgggctcctcc

SEQ ID NO: 57446 - DNA, 20 bp, Artificial
  CRISPR gRNA sequence
cctcccggctccccatgacg

SEQ ID NO: 57447 - DNA, 20 bp, Artificial
  CRISPR gRNA sequence
ctcccggctccccatgacgc

SEQ ID NO: 57448 - DNA, 20 bp, Artificial
  CRISPR gRNA sequence
gctccccatgacgcaggtac

SEQ ID NO: 57449 - DNA, 20 bp, Artificial
  CRISPR gRNA sequence
ccatgacgcaggtactggcc

SEQ ID NO: 57450 - DNA, 20 bp, Artificial
  CRISPR gRNA sequence
acctgcccttaccatcatca

SEQ ID NO: 57451 - DNA, 20 bp, Artificial
  CRISPR gRNA sequence
cttaccatcatcatagccaa

SEQ ID NO: 57452 - DNA, 20 bp, Artificial
  CRISPR gRNA sequence
tcatcatagccaaaagtact

SEQ ID NO: 57453 - DNA, 20 bp, Artificial
  CRISPR gRNA sequence
tcatagccaaaagtactcag

SEQ ID NO: 57454 - DNA, 20 bp, Artificial
  CRISPR gRNA sequence
tagccaaaagtactcagcag

SEQ ID NO: 57455 - DNA, 20 bp, Artificial
  CRISPR gRNA sequence
gtactcagcagcagcacctc

SEQ ID NO: 57456 - DNA, 20 bp, Artificial
  CRISPR gRNA sequence
tactcagcagcagcacctcc

SEQ ID NO: 57457 - DNA, 20 bp, Artificial
  CRISPR gRNA sequence
agcagcagcacctccaggtc

SEQ ID NO: 57458 - DNA, 20 bp, Artificial
  CRISPR gRNA sequence
cagcagcacctccaggtcca

SEQ ID NO: 57459 - DNA, 20 bp, Artificial
  CRISPR gRNA sequence
agcagcacctccaggtccag

SEQ ID NO: 57460 - DNA, 20 bp, Artificial
  CRISPR gRNA sequence
tccaggtccagaggcacctc

SEQ ID NO: 57461 - DNA, 20 bp, Artificial
  CRISPR gRNA sequence
catgcacacacaatgaatga

SEQ ID NO: 57462 - DNA, 20 bp, Artificial
  CRISPR gRNA sequence
cacaatgaatgaaagactgc

SEQ ID NO: 57463 - DNA, 20 bp, Artificial
  CRISPR gRNA sequence
acaatgaatgaaagactgcc

SEQ ID NO: 57464 - DNA, 20 bp, Artificial
  CRISPR gRNA sequence
actgccaggtgtccgaaccc

SEQ ID NO: 57465 - DNA, 20 bp, Artificial
  CRISPR gRNA sequence
gtgtccgaaccctggacatg

SEQ ID NO: 57466 - DNA, 20 bp, Artificial
  CRISPR gRNA sequence
ccctggacatgcagcttgtt

SEQ ID NO: 57467 - DNA, 20 bp, Artificial
  CRISPR gRNA sequence
acatgcagcttgttgagttg

SEQ ID NO: 57468 - DNA, 20 bp, Artificial
  CRISPR gRNA sequence
catgcagcttgttgagttgc

SEQ ID NO: 57469 - DNA, 20 bp, Artificial
  CRISPR gRNA sequence
ttgcaggatgactctctgtt

SEQ ID NO: 57470 - DNA, 20 bp, Artificial
  CRISPR gRNA sequence
tgcaggatgactctctgttc

SEQ ID NO: 57471 - DNA, 20 bp, Artificial
  CRISPR gRNA sequence
gcaggatgactctctgttca

SEQ ID NO: 57472 - DNA, 20 bp, Artificial
  CRISPR gRNA sequence
tgactctctgttcagggtcc

SEQ ID NO: 57473 - DNA, 20 bp, Artificial
  CRISPR gRNA sequence
gactctctgttcagggtcca

SEQ ID NO: 57474 - DNA, 20 bp, Artificial
  CRISPR gRNA sequence
agggtccaaggtctcgttcc

SEQ ID NO: 57475 - DNA, 20 bp, Artificial
  CRISPR gRNA sequence
aaggtctcgttcctggaatc

SEQ ID NO: 57476 - DNA, 20 bp, Artificial
  CRISPR gRNA sequence
aggtctcgttcctggaatcc

SEQ ID NO: 57477 - DNA, 20 bp, Artificial
  CRISPR gRNA sequence
cctggaatccaggtccgtgt

SEQ ID NO: 57478 - DNA, 20 bp, Artificial
  CRISPR gRNA sequence
ctggaatccaggtccgtgtt

SEQ ID NO: 57479 - DNA, 20 bp, Artificial
  CRISPR gRNA sequence
tggaatccaggtccgtgttg

SEQ ID NO: 57480 - DNA, 20 bp, Artificial
  CRISPR gRNA sequence
gaatccaggtccgtgttggg

SEQ ID NO: 57481 - DNA, 20 bp, Artificial
  CRISPR gRNA sequence
aatccaggtccgtgttgggg

SEQ ID NO: 57482 - DNA, 20 bp, Artificial
  CRISPR gRNA sequence
ccaggtccgtgttggggagg

SEQ ID NO: 57483 - DNA, 20 bp, Artificial
  CRISPR gRNA sequence
ggggaggaagaacttcatct

SEQ ID NO: 57484 - DNA, 20 bp, Artificial
  CRISPR gRNA sequence
aagaacttcatcttggcgtt

SEQ ID NO: 57485 - DNA, 20 bp, Artificial
  CRISPR gRNA sequence
atcttggcgttcagccattc

SEQ ID NO: 57486 - DNA, 20 bp, Artificial
  CRISPR gRNA sequence
tcttggcgttcagccattct

SEQ ID NO: 57487 - DNA, 20 bp, Artificial
  CRISPR gRNA sequence
gttcagccattctgggtctt

SEQ ID NO: 57488 - DNA, 20 bp, Artificial
  CRISPR gRNA sequence
agccattctgggtctttggt

SEQ ID NO: 57489 - DNA, 20 bp, Artificial
  CRISPR gRNA sequence
cattctgggtctttggtgag

SEQ ID NO: 57490 - DNA, 20 bp, Artificial
  CRISPR gRNA sequence
tctttggtgagcagcctcac

SEQ ID NO: 57491 - DNA, 20 bp, Artificial
  CRISPR gRNA sequence
tggtgagcagcctcacaaga

SEQ ID NO: 57492 - DNA, 20 bp, Artificial
  CRISPR gRNA sequence
agcctcacaagacagctcca

SEQ ID NO: 57493 - DNA, 20 bp, Artificial
  CRISPR gRNA sequence
gcctcacaagacagctccac

SEQ ID NO: 57494 - DNA, 20 bp, Artificial
  CRISPR gRNA sequence
ctccacaggttcttgttgcc

SEQ ID NO: 57495 - DNA, 20 bp, Artificial
  CRISPR gRNA sequence
acaggttcttgttgccgagc

SEQ ID NO: 57496 - DNA, 20 bp, Artificial
  CRISPR gRNA sequence
aggttcttgttgccgagctg

SEQ ID NO: 57497 - DNA, 20 bp, Artificial
  CRISPR gRNA sequence
ggttcttgttgccgagctgg

SEQ ID NO: 57498 - DNA, 20 bp, Artificial
  CRISPR gRNA sequence
gttgccgagctggaggccaa

SEQ ID NO: 57499 - DNA, 20 bp, Artificial
  CRISPR gRNA sequence
ttgccgagctggaggccaac

SEQ ID NO: 57500 - DNA, 20 bp, Artificial
  CRISPR gRNA sequence
tgccgagctggaggccaacg

SEQ ID NO: 57501 - DNA, 20 bp, Artificial
  CRISPR gRNA sequence
tggaggccaacggggtccat

SEQ ID NO: 57502 - DNA, 20 bp, Artificial
  CRISPR gRNA sequence
ggaggccaacggggtccatg

SEQ ID NO: 57503 - DNA, 20 bp, Artificial
  CRISPR gRNA sequence
aggccaacggggtccatgag

SEQ ID NO: 57504 - DNA, 20 bp, Artificial
  CRISPR gRNA sequence
caacggggtccatgaggagc

SEQ ID NO: 57505 - DNA, 20 bp, Artificial
  CRISPR gRNA sequence
ggtccatgaggagccagccc

SEQ ID NO: 57506 - DNA, 20 bp, Artificial
  CRISPR gRNA sequence
tccatgaggagccagccctg

SEQ ID NO: 57507 - DNA, 20 bp, Artificial
  CRISPR gRNA sequence
ccatgaggagccagccctgg

SEQ ID NO: 57508 - DNA, 20 bp, Artificial
  CRISPR gRNA sequence
catgaggagccagccctgga

SEQ ID NO: 57509 - DNA, 20 bp, Artificial
  CRISPR gRNA sequence
aggagccagccctggaggga

SEQ ID NO: 57510 - DNA, 20 bp, Artificial
  CRISPR gRNA sequence
ggagccagccctggagggac

SEQ ID NO: 57511 - DNA, 20 bp, Artificial
  CRISPR gRNA sequence
gagccagccctggagggaca

SEQ ID NO: 57512 - DNA, 20 bp, Artificial
  CRISPR gRNA sequence
ccagccctggagggacaggg

SEQ ID NO: 57513 - DNA, 20 bp, Artificial
  CRISPR gRNA sequence
ccctggagggacagggaaga

SEQ ID NO: 57514 - DNA, 20 bp, Artificial
  CRISPR gRNA sequence
cctggagggacagggaagat

SEQ ID NO: 57515 - DNA, 20 bp, Artificial
  CRISPR gRNA sequence
gagggacagggaagataggt

SEQ ID NO: 57516 - DNA, 20 bp, Artificial
  CRISPR gRNA sequence
acagggaagataggtgagtt

SEQ ID NO: 57517 - DNA, 20 bp, Artificial
  CRISPR gRNA sequence
cagggaagataggtgagttg

SEQ ID NO: 57518 - DNA, 20 bp, Artificial
  CRISPR gRNA sequence
agggaagataggtgagttga

SEQ ID NO: 57519 - DNA, 20 bp, Artificial
  CRISPR gRNA sequence
gggaagataggtgagttgag

SEQ ID NO: 57520 - DNA, 20 bp, Artificial
  CRISPR gRNA sequence
ggaagataggtgagttgagg

SEQ ID NO: 57521 - DNA, 20 bp, Artificial
  CRISPR gRNA sequence
gataggtgagttgaggggga

SEQ ID NO: 57522 - DNA, 20 bp, Artificial
  CRISPR gRNA sequence
ataggtgagttgagggggac

SEQ ID NO: 57523 - DNA, 20 bp, Artificial
  CRISPR gRNA sequence
gttgagggggacaggtaaac

SEQ ID NO: 57524 - DNA, 20 bp, Artificial
  CRISPR gRNA sequence
ttgagggggacaggtaaact

SEQ ID NO: 57525 - DNA, 20 bp, Artificial
  CRISPR gRNA sequence
tgagggggacaggtaaactg

SEQ ID NO: 57526 - DNA, 20 bp, Artificial
  CRISPR gRNA sequence
gagggggacaggtaaactgg

SEQ ID NO: 57527 - DNA, 20 bp, Artificial
  CRISPR gRNA sequence
ggggacaggtaaactggggg

SEQ ID NO: 57528 - DNA, 20 bp, Artificial
  CRISPR gRNA sequence
caggtaaactgggggcagat

SEQ ID NO: 57529 - DNA, 20 bp, Artificial
  CRISPR gRNA sequence
aaactgggggcagatgagct

SEQ ID NO: 57530 - DNA, 20 bp, Artificial
  CRISPR gRNA sequence
aactgggggcagatgagctg

SEQ ID NO: 57531 - DNA, 20 bp, Artificial
  CRISPR gRNA sequence
actgggggcagatgagctga

SEQ ID NO: 57532 - DNA, 20 bp, Artificial
  CRISPR gRNA sequence
ggggcagatgagctgaggga

SEQ ID NO: 57533 - DNA, 20 bp, Artificial
  CRISPR gRNA sequence
gggcagatgagctgagggac

SEQ ID NO: 57534 - DNA, 20 bp, Artificial
  CRISPR gRNA sequence
ggcagatgagctgagggaca

SEQ ID NO: 57535 - DNA, 20 bp, Artificial
  CRISPR gRNA sequence
gcagatgagctgagggacag

SEQ ID NO: 57536 - DNA, 20 bp, Artificial
  CRISPR gRNA sequence
agctgagggacaggggaact

SEQ ID NO: 57537 - DNA, 20 bp, Artificial
  CRISPR gRNA sequence
gctgagggacaggggaactt

SEQ ID NO: 57538 - DNA, 20 bp, Artificial
  CRISPR gRNA sequence
ctgagggacaggggaacttg

SEQ ID NO: 57539 - DNA, 20 bp, Artificial
  CRISPR gRNA sequence
tgagggacaggggaacttgg

SEQ ID NO: 57540 - DNA, 20 bp, Artificial
  CRISPR gRNA sequence
gagggacaggggaacttggg

SEQ ID NO: 57541 - DNA, 20 bp, Artificial
  CRISPR gRNA sequence
gggacaggggaacttggggg

SEQ ID NO: 57542 - DNA, 20 bp, Artificial
  CRISPR gRNA sequence
aggggaacttggggggagtt

SEQ ID NO: 57543 - DNA, 20 bp, Artificial
  CRISPR gRNA sequence
gaacttggggggagttgagc

SEQ ID NO: 57544 - DNA, 20 bp, Artificial
  CRISPR gRNA sequence
aacttggggggagttgagct

SEQ ID NO: 57545 - DNA, 20 bp, Artificial
  CRISPR gRNA sequence
acttggggggagttgagctg

SEQ ID NO: 57546 - DNA, 20 bp, Artificial
  CRISPR gRNA sequence
cttggggggagttgagctgg

SEQ ID NO: 57547 - DNA, 20 bp, Artificial
  CRISPR gRNA sequence
gggggagttgagctggggga

SEQ ID NO: 57548 - DNA, 20 bp, Artificial
  CRISPR gRNA sequence
ggggagttgagctgggggac

SEQ ID NO: 57549 - DNA, 20 bp, Artificial
  CRISPR gRNA sequence
gagctgggggacaggcaaac

SEQ ID NO: 57550 - DNA, 20 bp, Artificial
  CRISPR gRNA sequence
agctgggggacaggcaaact

SEQ ID NO: 57551 - DNA, 20 bp, Artificial
  CRISPR gRNA sequence
gctgggggacaggcaaactg

SEQ ID NO: 57552 - DNA, 20 bp, Artificial
  CRISPR gRNA sequence
ctgggggacaggcaaactgg

SEQ ID NO: 57553 - DNA, 20 bp, Artificial
  CRISPR gRNA sequence
tgggggacaggcaaactggg

SEQ ID NO: 57554 - DNA, 20 bp, Artificial
  CRISPR gRNA sequence
ggggacaggcaaactggggg

SEQ ID NO: 57555 - DNA, 20 bp, Artificial
  CRISPR gRNA sequence
gggacaggcaaactgggggg

SEQ ID NO: 57556 - DNA, 20 bp, Artificial
  CRISPR gRNA sequence
caggcaaactggggggaggt

SEQ ID NO: 57557 - DNA, 20 bp, Artificial
  CRISPR gRNA sequence
caaactggggggaggtgagc

SEQ ID NO: 57558 - DNA, 20 bp, Artificial
  CRISPR gRNA sequence
aaactggggggaggtgagct

SEQ ID NO: 57559 - DNA, 20 bp, Artificial
  CRISPR gRNA sequence
aactggggggaggtgagctg

SEQ ID NO: 57560 - DNA, 20 bp, Artificial
  CRISPR gRNA sequence
actggggggaggtgagctgg

SEQ ID NO: 57561 - DNA, 20 bp, Artificial
  CRISPR gRNA sequence
gggggaggtgagctggggga

SEQ ID NO: 57562 - DNA, 20 bp, Artificial
  CRISPR gRNA sequence
ggggaggtgagctgggggac

SEQ ID NO: 57563 - DNA, 20 bp, Artificial
  CRISPR gRNA sequence
gagctgggggacaggtaaac

SEQ ID NO: 57564 - DNA, 20 bp, Artificial
  CRISPR gRNA sequence
agctgggggacaggtaaact

SEQ ID NO: 57565 - DNA, 20 bp, Artificial
  CRISPR gRNA sequence
gctgggggacaggtaaactg

SEQ ID NO: 57566 - DNA, 20 bp, Artificial
  CRISPR gRNA sequence
ctgggggacaggtaaactgg

SEQ ID NO: 57567 - DNA, 20 bp, Artificial
  CRISPR gRNA sequence
tgggggacaggtaaactggg

SEQ ID NO: 57568 - DNA, 20 bp, Artificial
  CRISPR gRNA sequence
gggggacaggtaaactgggg

SEQ ID NO: 57569 - DNA, 20 bp, Artificial
  CRISPR gRNA sequence
gggacaggtaaactgggggg

SEQ ID NO: 57570 - DNA, 20 bp, Artificial
  CRISPR gRNA sequence
ggacaggtaaactggggggg

SEQ ID NO: 57571 - DNA, 20 bp, Artificial
  CRISPR gRNA sequence
aggtaaactgggggggaggt

SEQ ID NO: 57572 - DNA, 20 bp, Artificial
  CRISPR gRNA sequence
aaactgggggggaggtgagc

SEQ ID NO: 57573 - DNA, 20 bp, Artificial
  CRISPR gRNA sequence
aactgggggggaggtgagct

SEQ ID NO: 57574 - DNA, 20 bp, Artificial
  CRISPR gRNA sequence
actgggggggaggtgagcta

SEQ ID NO: 57575 - DNA, 20 bp, Artificial
  CRISPR gRNA sequence
ctgggggggaggtgagctag

SEQ ID NO: 57576 - DNA, 20 bp, Artificial
  CRISPR gRNA sequence
gggggaggtgagctagggga

SEQ ID NO: 57577 - DNA, 20 bp, Artificial
  CRISPR gRNA sequence
ggggaggtgagctaggggac

SEQ ID NO: 57578 - DNA, 20 bp, Artificial
  CRISPR gRNA sequence
gagctaggggacaggtaaac

SEQ ID NO: 57579 - DNA, 20 bp, Artificial
  CRISPR gRNA sequence
agctaggggacaggtaaact

SEQ ID NO: 57580 - DNA, 20 bp, Artificial
  CRISPR gRNA sequence
gctaggggacaggtaaactg

SEQ ID NO: 57581 - DNA, 20 bp, Artificial
  CRISPR gRNA sequence
ctaggggacaggtaaactgg

SEQ ID NO: 57582 - DNA, 20 bp, Artificial
  CRISPR gRNA sequence
ggggacaggtaaactggggg

SEQ ID NO: 57583 - DNA, 20 bp, Artificial
  CRISPR gRNA sequence
caggtaaactgggggcagat

SEQ ID NO: 57584 - DNA, 20 bp, Artificial
  CRISPR gRNA sequence
taaactgggggcagatgagc

SEQ ID NO: 57585 - DNA, 20 bp, Artificial
  CRISPR gRNA sequence
aaactgggggcagatgagct

SEQ ID NO: 57586 - DNA, 20 bp, Artificial
  CRISPR gRNA sequence
aactgggggcagatgagctg

SEQ ID NO: 57587 - DNA, 20 bp, Artificial
  CRISPR gRNA sequence
actgggggcagatgagctgg

SEQ ID NO: 57588 - DNA, 20 bp, Artificial
  CRISPR gRNA sequence
ggggcagatgagctggggga

SEQ ID NO: 57589 - DNA, 20 bp, Artificial
  CRISPR gRNA sequence
gggcagatgagctgggggac

SEQ ID NO: 57590 - DNA, 20 bp, Artificial
  CRISPR gRNA sequence
gcagatgagctgggggacag

SEQ ID NO: 57591 - DNA, 20 bp, Artificial
  CRISPR gRNA sequence
agatgagctgggggacagga

SEQ ID NO: 57592 - DNA, 20 bp, Artificial
  CRISPR gRNA sequence
agctgggggacaggagagct

SEQ ID NO: 57593 - DNA, 20 bp, Artificial
  CRISPR gRNA sequence
gctgggggacaggagagctg

SEQ ID NO: 57594 - DNA, 20 bp, Artificial
  CRISPR gRNA sequence
ctgggggacaggagagctga

SEQ ID NO: 57595 - DNA, 20 bp, Artificial
  CRISPR gRNA sequence
tgggggacaggagagctgag

SEQ ID NO: 57596 - DNA, 20 bp, Artificial
  CRISPR gRNA sequence
gggggacaggagagctgagg

SEQ ID NO: 57597 - DNA, 20 bp, Artificial
  CRISPR gRNA sequence
gggacaggagagctgagggg

SEQ ID NO: 57598 - DNA, 20 bp, Artificial
  CRISPR gRNA sequence
ggacaggagagctgaggggg

SEQ ID NO: 57599 - DNA, 20 bp, Artificial
  CRISPR gRNA sequence
aggagagctgagggggaggt

SEQ ID NO: 57600 - DNA, 20 bp, Artificial
  CRISPR gRNA sequence
gagctgagggggaggtgagc

SEQ ID NO: 57601 - DNA, 20 bp, Artificial
  CRISPR gRNA sequence
agctgagggggaggtgagct

SEQ ID NO: 57602 - DNA, 20 bp, Artificial
  CRISPR gRNA sequence
gctgagggggaggtgagctg

SEQ ID NO: 57603 - DNA, 20 bp, Artificial
  CRISPR gRNA sequence
ctgagggggaggtgagctgg

SEQ ID NO: 57604 - DNA, 20 bp, Artificial
  CRISPR gRNA sequence
gggggaggtgagctggggga

SEQ ID NO: 57605 - DNA, 20 bp, Artificial
  CRISPR gRNA sequence
ggggaggtgagctgggggac

SEQ ID NO: 57606 - DNA, 20 bp, Artificial
  CRISPR gRNA sequence
gggaggtgagctgggggaca

SEQ ID NO: 57607 - DNA, 20 bp, Artificial
  CRISPR gRNA sequence
ggaggtgagctgggggacag

SEQ ID NO: 57608 - DNA, 20 bp, Artificial
  CRISPR gRNA sequence
gagctgggggacaggggaac

SEQ ID NO: 57609 - DNA, 20 bp, Artificial
  CRISPR gRNA sequence
agctgggggacaggggaact

SEQ ID NO: 57610 - DNA, 20 bp, Artificial
  CRISPR gRNA sequence
gctgggggacaggggaactg

SEQ ID NO: 57611 - DNA, 20 bp, Artificial
  CRISPR gRNA sequence
ctgggggacaggggaactgg

SEQ ID NO: 57612 - DNA, 20 bp, Artificial
  CRISPR gRNA sequence
gggacaggggaactggggga

SEQ ID NO: 57613 - DNA, 20 bp, Artificial
  CRISPR gRNA sequence
ggacaggggaactgggggac

SEQ ID NO: 57614 - DNA, 20 bp, Artificial
  CRISPR gRNA sequence
gacaggggaactgggggaca

SEQ ID NO: 57615 - DNA, 20 bp, Artificial
  CRISPR gRNA sequence
acaggggaactgggggacag

SEQ ID NO: 57616 - DNA, 20 bp, Artificial
  CRISPR gRNA sequence
aggggaactgggggacaggg

SEQ ID NO: 57617 - DNA, 20 bp, Artificial
  CRISPR gRNA sequence
gaactgggggacaggggagc

SEQ ID NO: 57618 - DNA, 20 bp, Artificial
  CRISPR gRNA sequence
aactgggggacaggggagct

SEQ ID NO: 57619 - DNA, 20 bp, Artificial
  CRISPR gRNA sequence
actgggggacaggggagctg

SEQ ID NO: 57620 - DNA, 20 bp, Artificial
  CRISPR gRNA sequence
gggacaggggagctggggca

SEQ ID NO: 57621 - DNA, 20 bp, Artificial
  CRISPR gRNA sequence
ggacaggggagctggggcac

SEQ ID NO: 57622 - DNA, 20 bp, Artificial
  CRISPR gRNA sequence
aggggagctggggcacaggt

SEQ ID NO: 57623 - DNA, 20 bp, Artificial
  CRISPR gRNA sequence
gagctggggcacaggtgagc

SEQ ID NO: 57624 - DNA, 20 bp, Artificial
  CRISPR gRNA sequence
agctggggcacaggtgagct

SEQ ID NO: 57625 - DNA, 20 bp, Artificial
  CRISPR gRNA sequence
gctggggcacaggtgagcta

SEQ ID NO: 57626 - DNA, 20 bp, Artificial
  CRISPR gRNA sequence
ctggggcacaggtgagctag

SEQ ID NO: 57627 - DNA, 20 bp, Artificial
  CRISPR gRNA sequence
ggcacaggtgagctagggga

SEQ ID NO: 57628 - DNA, 20 bp, Artificial
  CRISPR gRNA sequence
gcacaggtgagctaggggac

SEQ ID NO: 57629 - DNA, 20 bp, Artificial
  CRISPR gRNA sequence
cacaggtgagctaggggaca

SEQ ID NO: 57630 - DNA, 20 bp, Artificial
  CRISPR gRNA sequence
acaggtgagctaggggacag

SEQ ID NO: 57631 - DNA, 20 bp, Artificial
  CRISPR gRNA sequence
aggtgagctaggggacaggg

SEQ ID NO: 57632 - DNA, 20 bp, Artificial
  CRISPR gRNA sequence
gagctaggggacaggggagc

SEQ ID NO: 57633 - DNA, 20 bp, Artificial
  CRISPR gRNA sequence
agctaggggacaggggagct

SEQ ID NO: 57634 - DNA, 20 bp, Artificial
  CRISPR gRNA sequence
ctaggggacaggggagctag

SEQ ID NO: 57635 - DNA, 20 bp, Artificial
  CRISPR gRNA sequence
taggggacaggggagctagg

SEQ ID NO: 57636 - DNA, 20 bp, Artificial
  CRISPR gRNA sequence
gggacaggggagctaggagg

SEQ ID NO: 57637 - DNA, 20 bp, Artificial
  CRISPR gRNA sequence
gagctaggaggaagatgaac

SEQ ID NO: 57638 - DNA, 20 bp, Artificial
  CRISPR gRNA sequence
agctaggaggaagatgaact

SEQ ID NO: 57639 - DNA, 20 bp, Artificial
  CRISPR gRNA sequence
gctaggaggaagatgaactg

SEQ ID NO: 57640 - DNA, 20 bp, Artificial
  CRISPR gRNA sequence
ctaggaggaagatgaactgg

SEQ ID NO: 57641 - DNA, 20 bp, Artificial
  CRISPR gRNA sequence
gaggaagatgaactggggga

SEQ ID NO: 57642 - DNA, 20 bp, Artificial
  CRISPR gRNA sequence
aggaagatgaactgggggac

SEQ ID NO: 57643 - DNA, 20 bp, Artificial
  CRISPR gRNA sequence
aactgggggacaggtgaact

SEQ ID NO: 57644 - DNA, 20 bp, Artificial
  CRISPR gRNA sequence
actgggggacaggtgaactg

SEQ ID NO: 57645 - DNA, 20 bp, Artificial
  CRISPR gRNA sequence
ctgggggacaggtgaactga

SEQ ID NO: 57646 - DNA, 20 bp, Artificial
  CRISPR gRNA sequence
ggggacaggtgaactgaggg

SEQ ID NO: 57647 - DNA, 20 bp, Artificial
  CRISPR gRNA sequence
gggacaggtgaactgagggc

SEQ ID NO: 57648 - DNA, 20 bp, Artificial
  CRISPR gRNA sequence
acaggtgaactgagggcagg

SEQ ID NO: 57649 - DNA, 20 bp, Artificial
  CRISPR gRNA sequence
caggtgaactgagggcaggc

SEQ ID NO: 57650 - DNA, 20 bp, Artificial
  CRISPR gRNA sequence
tgaactgagggcaggcaggt

SEQ ID NO: 57651 - DNA, 20 bp, Artificial
  CRISPR gRNA sequence
ctgagggcaggcaggtgagc

SEQ ID NO: 57652 - DNA, 20 bp, Artificial
  CRISPR gRNA sequence
tgagggcaggcaggtgagct

SEQ ID NO: 57653 - DNA, 20 bp, Artificial
  CRISPR gRNA sequence
gagggcaggcaggtgagctg

SEQ ID NO: 57654 - DNA, 20 bp, Artificial
  CRISPR gRNA sequence
agggcaggcaggtgagctgg

SEQ ID NO: 57655 - DNA, 20 bp, Artificial
  CRISPR gRNA sequence
caggcaggtgagctggggga

SEQ ID NO: 57656 - DNA, 20 bp, Artificial
  CRISPR gRNA sequence
aggcaggtgagctgggggac

SEQ ID NO: 57657 - DNA, 20 bp, Artificial
  CRISPR gRNA sequence
ggcaggtgagctgggggaca

SEQ ID NO: 57658 - DNA, 20 bp, Artificial
  CRISPR gRNA sequence
gcaggtgagctgggggacag

SEQ ID NO: 57659 - DNA, 20 bp, Artificial
  CRISPR gRNA sequence
gagctgggggacaggggaac

SEQ ID NO: 57660 - DNA, 20 bp, Artificial
  CRISPR gRNA sequence
ctgggggacaggggaactgg

SEQ ID NO: 57661 - DNA, 20 bp, Artificial
  CRISPR gRNA sequence
tgggggacaggggaactgga

SEQ ID NO: 57662 - DNA, 20 bp, Artificial
  CRISPR gRNA sequence
gggacaggggaactggaagg

SEQ ID NO: 57663 - DNA, 20 bp, Artificial
  CRISPR gRNA sequence
aggggaactggaaggaagat

SEQ ID NO: 57664 - DNA, 20 bp, Artificial
  CRISPR gRNA sequence
gaactggaaggaagatgagc

SEQ ID NO: 57665 - DNA, 20 bp, Artificial
  CRISPR gRNA sequence
aactggaaggaagatgagct

SEQ ID NO: 57666 - DNA, 20 bp, Artificial
  CRISPR gRNA sequence
actggaaggaagatgagctg

SEQ ID NO: 57667 - DNA, 20 bp, Artificial
  CRISPR gRNA sequence
aggaagatgagctggggaac

SEQ ID NO: 57668 - DNA, 20 bp, Artificial
  CRISPR gRNA sequence
agatgagctggggaaccggt

SEQ ID NO: 57669 - DNA, 20 bp, Artificial
  CRISPR gRNA sequence
gagctggggaaccggtgagc

SEQ ID NO: 57670 - DNA, 20 bp, Artificial
  CRISPR gRNA sequence
gctggggaaccggtgagctg

SEQ ID NO: 57671 - DNA, 20 bp, Artificial
  CRISPR gRNA sequence
ctggggaaccggtgagctgg

SEQ ID NO: 57672 - DNA, 20 bp, Artificial
  CRISPR gRNA sequence
gaaccggtgagctggaggac

SEQ ID NO: 57673 - DNA, 20 bp, Artificial
  CRISPR gRNA sequence
gagctggaggacaagcaaat

SEQ ID NO: 57674 - DNA, 20 bp, Artificial
  CRISPR gRNA sequence
agctggaggacaagcaaatt

SEQ ID NO: 57675 - DNA, 20 bp, Artificial
  CRISPR gRNA sequence
gctggaggacaagcaaattg

SEQ ID NO: 57676 - DNA, 20 bp, Artificial
  CRISPR gRNA sequence
ctggaggacaagcaaattgg

SEQ ID NO: 57677 - DNA, 20 bp, Artificial
  CRISPR gRNA sequence
gaggacaagcaaattggggg

SEQ ID NO: 57678 - DNA, 20 bp, Artificial
  CRISPR gRNA sequence
aggacaagcaaattgggggc

SEQ ID NO: 57679 - DNA, 20 bp, Artificial
  CRISPR gRNA sequence
caaattgggggcaggtgatt

SEQ ID NO: 57680 - DNA, 20 bp, Artificial
  CRISPR gRNA sequence
aaattgggggcaggtgattt

SEQ ID NO: 57681 - DNA, 20 bp, Artificial
  CRISPR gRNA sequence
aattgggggcaggtgatttg

SEQ ID NO: 57682 - DNA, 20 bp, Artificial
  CRISPR gRNA sequence
attgggggcaggtgatttgg

SEQ ID NO: 57683 - DNA, 20 bp, Artificial
  CRISPR gRNA sequence
ggggcaggtgatttggggga

SEQ ID NO: 57684 - DNA, 20 bp, Artificial
  CRISPR gRNA sequence
gggcaggtgatttgggggac

SEQ ID NO: 57685 - DNA, 20 bp, Artificial
  CRISPR gRNA sequence
ggcaggtgatttgggggaca

SEQ ID NO: 57686 - DNA, 20 bp, Artificial
  CRISPR gRNA sequence
gcaggtgatttgggggacag

SEQ ID NO: 57687 - DNA, 20 bp, Artificial
  CRISPR gRNA sequence
aggtgatttgggggacaggg

SEQ ID NO: 57688 - DNA, 20 bp, Artificial
  CRISPR gRNA sequence
gatttgggggacaggggagc

SEQ ID NO: 57689 - DNA, 20 bp, Artificial
  CRISPR gRNA sequence
atttgggggacaggggagct

SEQ ID NO: 57690 - DNA, 20 bp, Artificial
  CRISPR gRNA sequence
ttgggggacaggggagctgg

SEQ ID NO: 57691 - DNA, 20 bp, Artificial
  CRISPR gRNA sequence
tgggggacaggggagctggg

SEQ ID NO: 57692 - DNA, 20 bp, Artificial
  CRISPR gRNA sequence
gggacaggggagctgggagg

SEQ ID NO: 57693 - DNA, 20 bp, Artificial
  CRISPR gRNA sequence
aggggagctgggaggaagat

SEQ ID NO: 57694 - DNA, 20 bp, Artificial
  CRISPR gRNA sequence
gagctgggaggaagattaga

SEQ ID NO: 57695 - DNA, 20 bp, Artificial
  CRISPR gRNA sequence
gctgggaggaagattagatg

SEQ ID NO: 57696 - DNA, 20 bp, Artificial
  CRISPR gRNA sequence
gaggaagattagatggagaa

SEQ ID NO: 57697 - DNA, 20 bp, Artificial
  CRISPR gRNA sequence
aggaagattagatggagaac

SEQ ID NO: 57698 - DNA, 20 bp, Artificial
  CRISPR gRNA sequence
agattagatggagaacaggt

SEQ ID NO: 57699 - DNA, 20 bp, Artificial
  CRISPR gRNA sequence
gatggagaacaggtgagttg

SEQ ID NO: 57700 - DNA, 20 bp, Artificial
  CRISPR gRNA sequence
atggagaacaggtgagttgt

SEQ ID NO: 57701 - DNA, 20 bp, Artificial
  CRISPR gRNA sequence
tggagaacaggtgagttgtg

SEQ ID NO: 57702 - DNA, 20 bp, Artificial
  CRISPR gRNA sequence
agaacaggtgagttgtgggg

SEQ ID NO: 57703 - DNA, 20 bp, Artificial
  CRISPR gRNA sequence
gaacaggtgagttgtggggc

SEQ ID NO: 57704 - DNA, 20 bp, Artificial
  CRISPR gRNA sequence
agttgtggggcaggtgacct

SEQ ID NO: 57705 - DNA, 20 bp, Artificial
  CRISPR gRNA sequence
gttgtggggcaggtgacctg

SEQ ID NO: 57706 - DNA, 20 bp, Artificial
  CRISPR gRNA sequence
ttgtggggcaggtgacctga

SEQ ID NO: 57707 - DNA, 20 bp, Artificial
  CRISPR gRNA sequence
tggggcaggtgacctgaggg

SEQ ID NO: 57708 - DNA, 20 bp, Artificial
  CRISPR gRNA sequence
ggggcaggtgacctgagggc

SEQ ID NO: 57709 - DNA, 20 bp, Artificial
  CRISPR gRNA sequence
caggtgacctgagggcaggt

SEQ ID NO: 57710 - DNA, 20 bp, Artificial
  CRISPR gRNA sequence
gtgacctgagggcaggtgag

SEQ ID NO: 57711 - DNA, 20 bp, Artificial
  CRISPR gRNA sequence
tgacctgagggcaggtgagt

SEQ ID NO: 57712 - DNA, 20 bp, Artificial
  CRISPR gRNA sequence
gacctgagggcaggtgagtg

SEQ ID NO: 57713 - DNA, 20 bp, Artificial
  CRISPR gRNA sequence
gagggcaggtgagtggggta

SEQ ID NO: 57714 - DNA, 20 bp, Artificial
  CRISPR gRNA sequence
tgagtggggtacagatgaac

SEQ ID NO: 57715 - DNA, 20 bp, Artificial
  CRISPR gRNA sequence
gagtggggtacagatgaact

SEQ ID NO: 57716 - DNA, 20 bp, Artificial
  CRISPR gRNA sequence
agtggggtacagatgaacta

SEQ ID NO: 57717 - DNA, 20 bp, Artificial
  CRISPR gRNA sequence
gtggggtacagatgaactag

SEQ ID NO: 57718 - DNA, 20 bp, Artificial
  CRISPR gRNA sequence
tggggtacagatgaactagg

SEQ ID NO: 57719 - DNA, 20 bp, Artificial
  CRISPR gRNA sequence
ggtacagatgaactaggggg

SEQ ID NO: 57720 - DNA, 20 bp, Artificial
  CRISPR gRNA sequence
gtacagatgaactaggggga

SEQ ID NO: 57721 - DNA, 20 bp, Artificial
  CRISPR gRNA sequence
gaactagggggaaggtgatc

SEQ ID NO: 57722 - DNA, 20 bp, Artificial
  CRISPR gRNA sequence
aactagggggaaggtgatct

SEQ ID NO: 57723 - DNA, 20 bp, Artificial
  CRISPR gRNA sequence
actagggggaaggtgatctg

SEQ ID NO: 57724 - DNA, 20 bp, Artificial
  CRISPR gRNA sequence
agggggaaggtgatctgggg

SEQ ID NO: 57725 - DNA, 20 bp, Artificial
  CRISPR gRNA sequence
gggggaaggtgatctgggga

SEQ ID NO: 57726 - DNA, 20 bp, Artificial
  CRISPR gRNA sequence
gaaggtgatctggggaaggt

SEQ ID NO: 57727 - DNA, 20 bp, Artificial
  CRISPR gRNA sequence
gtgatctggggaaggtgagt

SEQ ID NO: 57728 - DNA, 20 bp, Artificial
  CRISPR gRNA sequence
tgatctggggaaggtgagtt

SEQ ID NO: 57729 - DNA, 20 bp, Artificial
  CRISPR gRNA sequence
gatctggggaaggtgagttg

SEQ ID NO: 57730 - DNA, 20 bp, Artificial
  CRISPR gRNA sequence
atctggggaaggtgagttgg

SEQ ID NO: 57731 - DNA, 20 bp, Artificial
  CRISPR gRNA sequence
gggaaggtgagttgggggat

SEQ ID NO: 57732 - DNA, 20 bp, Artificial
  CRISPR gRNA sequence
ggaaggtgagttgggggata

SEQ ID NO: 57733 - DNA, 20 bp, Artificial
  CRISPR gRNA sequence
gaaggtgagttgggggataa

SEQ ID NO: 57734 - DNA, 20 bp, Artificial
  CRISPR gRNA sequence
aggtgagttgggggataagg

SEQ ID NO: 57735 - DNA, 20 bp, Artificial
  CRISPR gRNA sequence
ttgggggataagggagtttc

SEQ ID NO: 57736 - DNA, 20 bp, Artificial
  CRISPR gRNA sequence
tgggggataagggagtttct

SEQ ID NO: 57737 - DNA, 20 bp, Artificial
  CRISPR gRNA sequence
gggggataagggagtttcta

SEQ ID NO: 57738 - DNA, 20 bp, Artificial
  CRISPR gRNA sequence
ggataagggagtttctaggg

SEQ ID NO: 57739 - DNA, 20 bp, Artificial
  CRISPR gRNA sequence
agggagtttctagggaagtc

SEQ ID NO: 57740 - DNA, 20 bp, Artificial
  CRISPR gRNA sequence
gagtttctagggaagtcaag

SEQ ID NO: 57741 - DNA, 20 bp, Artificial
  CRISPR gRNA sequence
tctagggaagtcaagcagtc

SEQ ID NO: 57742 - DNA, 20 bp, Artificial
  CRISPR gRNA sequence
gaagtcaagcagtcaagaac

SEQ ID NO: 57743 - DNA, 20 bp, Artificial
  CRISPR gRNA sequence
aagaaccagtccctacattt

SEQ ID NO: 57744 - DNA, 20 bp, Artificial
  CRISPR gRNA sequence
tacatttgagcgacataaaa

SEQ ID NO: 57745 - DNA, 20 bp, Artificial
  CRISPR gRNA sequence
acatttgagcgacataaaat

SEQ ID NO: 57746 - DNA, 20 bp, Artificial
  CRISPR gRNA sequence
tttgagcgacataaaatagg

SEQ ID NO: 57747 - DNA, 20 bp, Artificial
  CRISPR gRNA sequence
ttgagcgacataaaataggc

SEQ ID NO: 57748 - DNA, 20 bp, Artificial
  CRISPR gRNA sequence
tgagcgacataaaataggca

SEQ ID NO: 57749 - DNA, 20 bp, Artificial
  CRISPR gRNA sequence
gcgacataaaataggcaggg

SEQ ID NO: 57750 - DNA, 20 bp, Artificial
  CRISPR gRNA sequence
acataaaataggcagggaag

SEQ ID NO: 57751 - DNA, 20 bp, Artificial
  CRISPR gRNA sequence
gcagggaagtggcctctcca

SEQ ID NO: 57752 - DNA, 20 bp, Artificial
  CRISPR gRNA sequence
agggaagtggcctctccatg

SEQ ID NO: 57753 - DNA, 20 bp, Artificial
  CRISPR gRNA sequence
ggagtcttgatgtctctgcc

SEQ ID NO: 57754 - DNA, 20 bp, Artificial
  CRISPR gRNA sequence
gagtcttgatgtctctgccc

SEQ ID NO: 57755 - DNA, 20 bp, Artificial
  CRISPR gRNA sequence
agtcttgatgtctctgccca

SEQ ID NO: 57756 - DNA, 20 bp, Artificial
  CRISPR gRNA sequence
tgatgtctctgcccagggat

SEQ ID NO: 57757 - DNA, 20 bp, Artificial
  CRISPR gRNA sequence
ctctgcccagggatcagctc

SEQ ID NO: 57758 - DNA, 20 bp, Artificial
  CRISPR gRNA sequence
ctgcccagggatcagctcca

SEQ ID NO: 57759 - DNA, 20 bp, Artificial
  CRISPR gRNA sequence
cagggatcagctccagagat

SEQ ID NO: 57760 - DNA, 20 bp, Artificial
  CRISPR gRNA sequence
ctccatttgtgcctgcaccc

SEQ ID NO: 57761 - DNA, 20 bp, Artificial
  CRISPR gRNA sequence
gtgcctgcaccctggctctc

SEQ ID NO: 57762 - DNA, 20 bp, Artificial
  CRISPR gRNA sequence
tgcaccctggctctctggaa

SEQ ID NO: 57763 - DNA, 20 bp, Artificial
  CRISPR gRNA sequence
atggtcttgttcatcccctg

SEQ ID NO: 57764 - DNA, 20 bp, Artificial
  CRISPR gRNA sequence
tcttgttcatcccctgtgga

SEQ ID NO: 57765 - DNA, 20 bp, Artificial
  CRISPR gRNA sequence
tcccctgtggacagtcccgt

SEQ ID NO: 57766 - DNA, 20 bp, Artificial
  CRISPR gRNA sequence
cccctgtggacagtcccgtg

SEQ ID NO: 57767 - DNA, 20 bp, Artificial
  CRISPR gRNA sequence
tgaaccatttatgctgctct

SEQ ID NO: 57768 - DNA, 20 bp, Artificial
  CRISPR gRNA sequence
atttatgctgctctcagtct

SEQ ID NO: 57769 - DNA, 20 bp, Artificial
  CRISPR gRNA sequence
ctcagtctgagctaacctca

SEQ ID NO: 57770 - DNA, 20 bp, Artificial
  CRISPR gRNA sequence
agtctgagctaacctcatgg

SEQ ID NO: 57771 - DNA, 20 bp, Artificial
  CRISPR gRNA sequence
tctgagctaacctcatggca

SEQ ID NO: 57772 - DNA, 20 bp, Artificial
  CRISPR gRNA sequence
aacctcatggcagagacaac

SEQ ID NO: 57773 - DNA, 20 bp, Artificial
  CRISPR gRNA sequence
tctgttcttcccttcttcct

SEQ ID NO: 57774 - DNA, 20 bp, Artificial
  CRISPR gRNA sequence
cttcccttcttcctcagtat

SEQ ID NO: 57775 - DNA, 20 bp, Artificial
  CRISPR gRNA sequence
tagaactactaaatattctc

SEQ ID NO: 57776 - DNA, 20 bp, Artificial
  CRISPR gRNA sequence
ctaaatattctctggtcatc

SEQ ID NO: 57777 - DNA, 20 bp, Artificial
  CRISPR gRNA sequence
tattctctggtcatctagaa

SEQ ID NO: 57778 - DNA, 20 bp, Artificial
  CRISPR gRNA sequence
tagaatagattattatatcc

SEQ ID NO: 57779 - DNA, 20 bp, Artificial
  CRISPR gRNA sequence
ttatatcccagtctcccttg

SEQ ID NO: 57780 - DNA, 20 bp, Artificial
  CRISPR gRNA sequence
gtctcccttgcagttatatg

SEQ ID NO: 57781 - DNA, 20 bp, Artificial
  CRISPR gRNA sequence
ttatatgtagccatgtaatt

SEQ ID NO: 57782 - DNA, 20 bp, Artificial
  CRISPR gRNA sequence
atgtagccatgtaatttggc

SEQ ID NO: 57783 - DNA, 20 bp, Artificial
  CRISPR gRNA sequence
tagccatgtaatttggccag

SEQ ID NO: 57784 - DNA, 20 bp, Artificial
  CRISPR gRNA sequence
taatttggccagtggaatgt

SEQ ID NO: 57785 - DNA, 20 bp, Artificial
  CRISPR gRNA sequence
tttggccagtggaatgtaag

SEQ ID NO: 57786 - DNA, 20 bp, Artificial
  CRISPR gRNA sequence
ctttgctccttcctgttgtc

SEQ ID NO: 57787 - DNA, 20 bp, Artificial
  CRISPR gRNA sequence
cctgttgtctggattgttga

SEQ ID NO: 57788 - DNA, 20 bp, Artificial
  CRISPR gRNA sequence
ctgttgtctggattgttgat

SEQ ID NO: 57789 - DNA, 20 bp, Artificial
  CRISPR gRNA sequence
tgtctggattgttgatggga

SEQ ID NO: 57790 - DNA, 20 bp, Artificial
  CRISPR gRNA sequence
tggattgttgatgggatggc

SEQ ID NO: 57791 - DNA, 20 bp, Artificial
  CRISPR gRNA sequence
ttgatgggatggctggatct

SEQ ID NO: 57792 - DNA, 20 bp, Artificial
  CRISPR gRNA sequence
tgatgggatggctggatctt

SEQ ID NO: 57793 - DNA, 20 bp, Artificial
  CRISPR gRNA sequence
tgggatggctggatcttggg

SEQ ID NO: 57794 - DNA, 20 bp, Artificial
  CRISPR gRNA sequence
gggcagccatattgaatcat

SEQ ID NO: 57795 - DNA, 20 bp, Artificial
  CRISPR gRNA sequence
ggcagccatattgaatcatg

SEQ ID NO: 57796 - DNA, 20 bp, Artificial
  CRISPR gRNA sequence
agccatattgaatcatgagg

SEQ ID NO: 57797 - DNA, 20 bp, Artificial
  CRISPR gRNA sequence
catgaggtggaacccatact

SEQ ID NO: 57798 - DNA, 20 bp, Artificial
  CRISPR gRNA sequence
atgaggtggaacccatactg

SEQ ID NO: 57799 - DNA, 20 bp, Artificial
  CRISPR gRNA sequence
aggtggaacccatactgagg

SEQ ID NO: 57800 - DNA, 20 bp, Artificial
  CRISPR gRNA sequence
ggtggaacccatactgagga

SEQ ID NO: 57801 - DNA, 20 bp, Artificial
  CRISPR gRNA sequence
ggaacccatactgaggaagg

SEQ ID NO: 57802 - DNA, 20 bp, Artificial
  CRISPR gRNA sequence
acccatactgaggaaggtgg

SEQ ID NO: 57803 - DNA, 20 bp, Artificial
  CRISPR gRNA sequence
cccatactgaggaaggtgga

SEQ ID NO: 57804 - DNA, 20 bp, Artificial
  CRISPR gRNA sequence
actgaggaaggtggaaggta

SEQ ID NO: 57805 - DNA, 20 bp, Artificial
  CRISPR gRNA sequence
tgccctgtgctcactgactt

SEQ ID NO: 57806 - DNA, 20 bp, Artificial
  CRISPR gRNA sequence
gactttggacttctgttaca

SEQ ID NO: 57807 - DNA, 20 bp, Artificial
  CRISPR gRNA sequence
tttggacttctgttacatgg

SEQ ID NO: 57808 - DNA, 20 bp, Artificial
  CRISPR gRNA sequence
ttggacttctgttacatggc

SEQ ID NO: 57809 - DNA, 20 bp, Artificial
  CRISPR gRNA sequence
tggacttctgttacatggca

SEQ ID NO: 57810 - DNA, 20 bp, Artificial
  CRISPR gRNA sequence
agggaaatacacttccattc

SEQ ID NO: 57811 - DNA, 20 bp, Artificial
  CRISPR gRNA sequence
aatacacttccattctggtt

SEQ ID NO: 57812 - DNA, 20 bp, Artificial
  CRISPR gRNA sequence
ctggttaagccactgttgtt

SEQ ID NO: 57813 - DNA, 20 bp, Artificial
  CRISPR gRNA sequence
ttagtgctttctgctactca

SEQ ID NO: 57814 - DNA, 20 bp, Artificial
  CRISPR gRNA sequence
ctcacagtgaactctaatcc

SEQ ID NO: 57815 - DNA, 20 bp, Artificial
  CRISPR gRNA sequence
aactctaatcctagctaaca

SEQ ID NO: 57816 - DNA, 20 bp, Artificial
  CRISPR gRNA sequence
agaccatcacctcttttgct

SEQ ID NO: 57817 - DNA, 20 bp, Artificial
  CRISPR gRNA sequence
caaattcttcccttctgaac

SEQ ID NO: 57818 - DNA, 20 bp, Artificial
  CRISPR gRNA sequence
actggaactctttttttttt

SEQ ID NO: 57819 - DNA, 20 bp, Artificial
  CRISPR gRNA sequence
gaactcttttttttttgaga

SEQ ID NO: 57820 - DNA, 20 bp, Artificial
  CRISPR gRNA sequence
actcttttttttttgagaca

SEQ ID NO: 57821 - DNA, 20 bp, Artificial
  CRISPR gRNA sequence
cagagtctcgctctgtcacc

SEQ ID NO: 57822 - DNA, 20 bp, Artificial
  CRISPR gRNA sequence
agagtctcgctctgtcaccc

SEQ ID NO: 57823 - DNA, 20 bp, Artificial
  CRISPR gRNA sequence
tctcgctctgtcacccaggc

SEQ ID NO: 57824 - DNA, 20 bp, Artificial
  CRISPR gRNA sequence
tcgctctgtcacccaggctg

SEQ ID NO: 57825 - DNA, 20 bp, Artificial
  CRISPR gRNA sequence
tcacccaggctggagtgcaa

SEQ ID NO: 57826 - DNA, 20 bp, Artificial
  CRISPR gRNA sequence
ggagtgcaatggtgcaatct

SEQ ID NO: 57827 - DNA, 20 bp, Artificial
  CRISPR gRNA sequence
ggtgcaatctcggctcactg

SEQ ID NO: 57828 - DNA, 20 bp, Artificial
  CRISPR gRNA sequence
tcactgcagcctccgcctcc

SEQ ID NO: 57829 - DNA, 20 bp, Artificial
  CRISPR gRNA sequence
cactgcagcctccgcctccc

SEQ ID NO: 57830 - DNA, 20 bp, Artificial
  CRISPR gRNA sequence
agcctccgcctcccgggttc

SEQ ID NO: 57831 - DNA, 20 bp, Artificial
  CRISPR gRNA sequence
ttcaagcgattcttctgcct

SEQ ID NO: 57832 - DNA, 20 bp, Artificial
  CRISPR gRNA sequence
ttcttctgcctcagcctccc

SEQ ID NO: 57833 - DNA, 20 bp, Artificial
  CRISPR gRNA sequence
ttctgcctcagcctcccgag

SEQ ID NO: 57834 - DNA, 20 bp, Artificial
  CRISPR gRNA sequence
gcctcagcctcccgagtagc

SEQ ID NO: 57835 - DNA, 20 bp, Artificial
  CRISPR gRNA sequence
cctcagcctcccgagtagct

SEQ ID NO: 57836 - DNA, 20 bp, Artificial
  CRISPR gRNA sequence
ctcccgagtagctgggatta

SEQ ID NO: 57837 - DNA, 20 bp, Artificial
  CRISPR gRNA sequence
tcccgagtagctgggattac

SEQ ID NO: 57838 - DNA, 20 bp, Artificial
  CRISPR gRNA sequence
caggtgcacaccacaatgcc

SEQ ID NO: 57839 - DNA, 20 bp, Artificial
  CRISPR gRNA sequence
cagctaatttttgtaatttt

SEQ ID NO: 57840 - DNA, 20 bp, Artificial
  CRISPR gRNA sequence
aatttttgtaatttttagta

SEQ ID NO: 57841 - DNA, 20 bp, Artificial
  CRISPR gRNA sequence
tttgtaatttttagtacaga

SEQ ID NO: 57842 - DNA, 20 bp, Artificial
  CRISPR gRNA sequence
ttgtaatttttagtacagat

SEQ ID NO: 57843 - DNA, 20 bp, Artificial
  CRISPR gRNA sequence
tgtaatttttagtacagatg

SEQ ID NO: 57844 - DNA, 20 bp, Artificial
  CRISPR gRNA sequence
cagatggggtttcaccatgt

SEQ ID NO: 57845 - DNA, 20 bp, Artificial
  CRISPR gRNA sequence
tggggtttcaccatgttggc

SEQ ID NO: 57846 - DNA, 20 bp, Artificial
  CRISPR gRNA sequence
ggggtttcaccatgttggcc

SEQ ID NO: 57847 - DNA, 20 bp, Artificial
  CRISPR gRNA sequence
tttcaccatgttggccaggc

SEQ ID NO: 57848 - DNA, 20 bp, Artificial
  CRISPR gRNA sequence
ttcaccatgttggccaggct

SEQ ID NO: 57849 - DNA, 20 bp, Artificial
  CRISPR gRNA sequence
tgggctcaaactcctgacct

SEQ ID NO: 57850 - DNA, 20 bp, Artificial
  CRISPR gRNA sequence
gggctcaaactcctgacctc

SEQ ID NO: 57851 - DNA, 20 bp, Artificial
  CRISPR gRNA sequence
ggctcaaactcctgacctca

SEQ ID NO: 57852 - DNA, 20 bp, Artificial
  CRISPR gRNA sequence
tcagggtgatctgcccacct

SEQ ID NO: 57853 - DNA, 20 bp, Artificial
  CRISPR gRNA sequence
ctgcccacctcggcctccca

SEQ ID NO: 57854 - DNA, 20 bp, Artificial
  CRISPR gRNA sequence
acctcggcctcccaaagtgc

SEQ ID NO: 57855 - DNA, 20 bp, Artificial
  CRISPR gRNA sequence
cctcggcctcccaaagtgct

SEQ ID NO: 57856 - DNA, 20 bp, Artificial
  CRISPR gRNA sequence
ctcccaaagtgctgggatta

SEQ ID NO: 57857 - DNA, 20 bp, Artificial
  CRISPR gRNA sequence
tcccaaagtgctgggattac

SEQ ID NO: 57858 - DNA, 20 bp, Artificial
  CRISPR gRNA sequence
agtgctgggattacaggtgt

SEQ ID NO: 57859 - DNA, 20 bp, Artificial
  CRISPR gRNA sequence
acaggtgtgagccatcatga

SEQ ID NO: 57860 - DNA, 20 bp, Artificial
  CRISPR gRNA sequence
agccatcatgatggccgaac

SEQ ID NO: 57861 - DNA, 20 bp, Artificial
  CRISPR gRNA sequence
actcttaaaccacctccttc

SEQ ID NO: 57862 - DNA, 20 bp, Artificial
  CRISPR gRNA sequence
cttaaaccacctccttctag

SEQ ID NO: 57863 - DNA, 20 bp, Artificial
  CRISPR gRNA sequence
cctccttctagaagtaccaa

SEQ ID NO: 57864 - DNA, 20 bp, Artificial
  CRISPR gRNA sequence
tccttctagaagtaccaata

SEQ ID NO: 57865 - DNA, 20 bp, Artificial
  CRISPR gRNA sequence
ccttctagaagtaccaatag

SEQ ID NO: 57866 - DNA, 20 bp, Artificial
  CRISPR gRNA sequence
cttctagaagtaccaataga

SEQ ID NO: 57867 - DNA, 20 bp, Artificial
  CRISPR gRNA sequence
agaagtaccaatagagggca

SEQ ID NO: 57868 - DNA, 20 bp, Artificial
  CRISPR gRNA sequence
gaagtaccaatagagggcac

SEQ ID NO: 57869 - DNA, 20 bp, Artificial
  CRISPR gRNA sequence
aagtaccaatagagggcacg

SEQ ID NO: 57870 - DNA, 20 bp, Artificial
  CRISPR gRNA sequence
gagggcacggggcatttaca

SEQ ID NO: 57871 - DNA, 20 bp, Artificial
  CRISPR gRNA sequence
acggggcatttacacagcaa

SEQ ID NO: 57872 - DNA, 20 bp, Artificial
  CRISPR gRNA sequence
gcaaaagcctaaataatgtg

SEQ ID NO: 57873 - DNA, 20 bp, Artificial
  CRISPR gRNA sequence
aatgtgcagttcctttgatt

SEQ ID NO: 57874 - DNA, 20 bp, Artificial
  CRISPR gRNA sequence
tgattcagtaattccatttc

SEQ ID NO: 57875 - DNA, 20 bp, Artificial
  CRISPR gRNA sequence
gattcagtaattccatttct

SEQ ID NO: 57876 - DNA, 20 bp, Artificial
  CRISPR gRNA sequence
catttctaggactctaacct

SEQ ID NO: 57877 - DNA, 20 bp, Artificial
  CRISPR gRNA sequence
atatacaatatttaattgca

SEQ ID NO: 57878 - DNA, 20 bp, Artificial
  CRISPR gRNA sequence
attgcaaagatgctcactgc

SEQ ID NO: 57879 - DNA, 20 bp, Artificial
  CRISPR gRNA sequence
tatttataattattaaaaat

SEQ ID NO: 57880 - DNA, 20 bp, Artificial
  CRISPR gRNA sequence
gaaacaacctaaatgtccaa

SEQ ID NO: 57881 - DNA, 20 bp, Artificial
  CRISPR gRNA sequence
caacctaaatgtccaacagt

SEQ ID NO: 57882 - DNA, 20 bp, Artificial
  CRISPR gRNA sequence
aacctaaatgtccaacagtt

SEQ ID NO: 57883 - DNA, 20 bp, Artificial
  CRISPR gRNA sequence
acctaaatgtccaacagttg

SEQ ID NO: 57884 - DNA, 20 bp, Artificial
  CRISPR gRNA sequence
aatgtccaacagttggggat

SEQ ID NO: 57885 - DNA, 20 bp, Artificial
  CRISPR gRNA sequence
ttggggattggccaactaaa

SEQ ID NO: 57886 - DNA, 20 bp, Artificial
  CRISPR gRNA sequence
gggattggccaactaaatgg

SEQ ID NO: 57887 - DNA, 20 bp, Artificial
  CRISPR gRNA sequence
ctaaatggtggtccatcatc

SEQ ID NO: 57888 - DNA, 20 bp, Artificial
  CRISPR gRNA sequence
aatggtggtccatcatctag

SEQ ID NO: 57889 - DNA, 20 bp, Artificial
  CRISPR gRNA sequence
ggactatgctatcacatttc

SEQ ID NO: 57890 - DNA, 20 bp, Artificial
  CRISPR gRNA sequence
acatttccggatgtactttc

SEQ ID NO: 57891 - DNA, 20 bp, Artificial
  CRISPR gRNA sequence
tggtactatgtccttcctca

SEQ ID NO: 57892 - DNA, 20 bp, Artificial
  CRISPR gRNA sequence
tactatgtccttcctcatag

SEQ ID NO: 57893 - DNA, 20 bp, Artificial
  CRISPR gRNA sequence
tcctcatagcagtacacact

SEQ ID NO: 57894 - DNA, 20 bp, Artificial
  CRISPR gRNA sequence
catagcagtacacacttgga

SEQ ID NO: 57895 - DNA, 20 bp, Artificial
  CRISPR gRNA sequence
ggaaagcactcactgtgtat

SEQ ID NO: 57896 - DNA, 20 bp, Artificial
  CRISPR gRNA sequence
gaaagcactcactgtgtatt

SEQ ID NO: 57897 - DNA, 20 bp, Artificial
  CRISPR gRNA sequence
ctgtgtattaggcactgtct

SEQ ID NO: 57898 - DNA, 20 bp, Artificial
  CRISPR gRNA sequence
ttattttatcctcacaactc

SEQ ID NO: 57899 - DNA, 20 bp, Artificial
  CRISPR gRNA sequence
attttatcctcacaactcca

SEQ ID NO: 57900 - DNA, 20 bp, Artificial
  CRISPR gRNA sequence
tttatcctcacaactccaga

SEQ ID NO: 57901 - DNA, 20 bp, Artificial
  CRISPR gRNA sequence
agtccacctctaactctgaa

SEQ ID NO: 57902 - DNA, 20 bp, Artificial
  CRISPR gRNA sequence
tccacctctaactctgaaaa

SEQ ID NO: 57903 - DNA, 20 bp, Artificial
  CRISPR gRNA sequence
acctctaactctgaaaagag

SEQ ID NO: 57904 - DNA, 20 bp, Artificial
  CRISPR gRNA sequence
cctctaactctgaaaagagt

SEQ ID NO: 57905 - DNA, 20 bp, Artificial
  CRISPR gRNA sequence
tctaactctgaaaagagtag

SEQ ID NO: 57906 - DNA, 20 bp, Artificial
  CRISPR gRNA sequence
ctaactctgaaaagagtagg

SEQ ID NO: 57907 - DNA, 20 bp, Artificial
  CRISPR gRNA sequence
aaaagagtaggaggtccacc

SEQ ID NO: 57908 - DNA, 20 bp, Artificial
  CRISPR gRNA sequence
agagtaggaggtccacccag

SEQ ID NO: 57909 - DNA, 20 bp, Artificial
  CRISPR gRNA sequence
taggaggtccacccagaagc

SEQ ID NO: 57910 - DNA, 20 bp, Artificial
  CRISPR gRNA sequence
aagccagccttcccaattcc

SEQ ID NO: 57911 - DNA, 20 bp, Artificial
  CRISPR gRNA sequence
gccagccttcccaattccca

SEQ ID NO: 57912 - DNA, 20 bp, Artificial
  CRISPR gRNA sequence
ccagccttcccaattcccag

SEQ ID NO: 57913 - DNA, 20 bp, Artificial
  CRISPR gRNA sequence
cttcccaattcccagaggct

SEQ ID NO: 57914 - DNA, 20 bp, Artificial
  CRISPR gRNA sequence
ttcccaattcccagaggctg

SEQ ID NO: 57915 - DNA, 20 bp, Artificial
  CRISPR gRNA sequence
caattcccagaggctgaggc

SEQ ID NO: 57916 - DNA, 20 bp, Artificial
  CRISPR gRNA sequence
gaggccagtactatgcgtcc

SEQ ID NO: 57917 - DNA, 20 bp, Artificial
  CRISPR gRNA sequence
aggccagtactatgcgtcct

SEQ ID NO: 57918 - DNA, 20 bp, Artificial
  CRISPR gRNA sequence
ggccagtactatgcgtcctg

SEQ ID NO: 57919 - DNA, 20 bp, Artificial
  CRISPR gRNA sequence
gtactatgcgtcctggggtt

SEQ ID NO: 57920 - DNA, 20 bp, Artificial
  CRISPR gRNA sequence
actatgcgtcctggggttta

SEQ ID NO: 57921 - DNA, 20 bp, Artificial
  CRISPR gRNA sequence
gcgtcctggggtttagagcc

SEQ ID NO: 57922 - DNA, 20 bp, Artificial
  CRISPR gRNA sequence
tttagagcccagctgctccc

SEQ ID NO: 57923 - DNA, 20 bp, Artificial
  CRISPR gRNA sequence
ttagagcccagctgctccct

SEQ ID NO: 57924 - DNA, 20 bp, Artificial
  CRISPR gRNA sequence
ccagctgctccctgggcatg

SEQ ID NO: 57925 - DNA, 20 bp, Artificial
  CRISPR gRNA sequence
gctgctccctgggcatgcag

SEQ ID NO: 57926 - DNA, 20 bp, Artificial
  CRISPR gRNA sequence
tgctccctgggcatgcagta

SEQ ID NO: 57927 - DNA, 20 bp, Artificial
  CRISPR gRNA sequence
gcatgcagtagagacatact

SEQ ID NO: 57928 - DNA, 20 bp, Artificial
  CRISPR gRNA sequence
gacatacttggatgtactgt

SEQ ID NO: 57929 - DNA, 20 bp, Artificial
  CRISPR gRNA sequence
ggatgtactgtcagccccac

SEQ ID NO: 57930 - DNA, 20 bp, Artificial
  CRISPR gRNA sequence
actggtcatttctcctcaac

SEQ ID NO: 57931 - DNA, 20 bp, Artificial
  CRISPR gRNA sequence
ctggtcatttctcctcaact

SEQ ID NO: 57932 - DNA, 20 bp, Artificial
  CRISPR gRNA sequence
tttctcctcaactgggctaa

SEQ ID NO: 57933 - DNA, 20 bp, Artificial
  CRISPR gRNA sequence
ctcaactgggctaatagcaa

SEQ ID NO: 57934 - DNA, 20 bp, Artificial
  CRISPR gRNA sequence
tcaactgggctaatagcaat

SEQ ID NO: 57935 - DNA, 20 bp, Artificial
  CRISPR gRNA sequence
aatagcaataggtcctcact

SEQ ID NO: 57936 - DNA, 20 bp, Artificial
  CRISPR gRNA sequence
atagcaataggtcctcactc

SEQ ID NO: 57937 - DNA, 20 bp, Artificial
  CRISPR gRNA sequence
gcaataggtcctcactcagg

SEQ ID NO: 57938 - DNA, 20 bp, Artificial
  CRISPR gRNA sequence
aataggtcctcactcaggca

SEQ ID NO: 57939 - DNA, 20 bp, Artificial
  CRISPR gRNA sequence
taggtcctcactcaggcaga

SEQ ID NO: 57940 - DNA, 20 bp, Artificial
  CRISPR gRNA sequence
ctcactcaggcagagagtct

SEQ ID NO: 57941 - DNA, 20 bp, Artificial
  CRISPR gRNA sequence
catgctcacaccatgatcct

SEQ ID NO: 57942 - DNA, 20 bp, Artificial
  CRISPR gRNA sequence
atgctcacaccatgatcctc

SEQ ID NO: 57943 - DNA, 20 bp, Artificial
  CRISPR gRNA sequence
ctcacaccatgatcctcagg

SEQ ID NO: 57944 - DNA, 20 bp, Artificial
  CRISPR gRNA sequence
tcacaccatgatcctcaggc

SEQ ID NO: 57945 - DNA, 20 bp, Artificial
  CRISPR gRNA sequence
cacaccatgatcctcaggca

SEQ ID NO: 57946 - DNA, 20 bp, Artificial
  CRISPR gRNA sequence
cagggatcaccacctccact

SEQ ID NO: 57947 - DNA, 20 bp, Artificial
  CRISPR gRNA sequence
ggatcaccacctccactaag

SEQ ID NO: 57948 - DNA, 20 bp, Artificial
  CRISPR gRNA sequence
caccacctccactaagcaga

SEQ ID NO: 57949 - DNA, 20 bp, Artificial
  CRISPR gRNA sequence
acctccactaagcagacgga

SEQ ID NO: 57950 - DNA, 20 bp, Artificial
  CRISPR gRNA sequence
ctaagcagacggaaagacca

SEQ ID NO: 57951 - DNA, 20 bp, Artificial
  CRISPR gRNA sequence
cagacggaaagaccatggcc

SEQ ID NO: 57952 - DNA, 20 bp, Artificial
  CRISPR gRNA sequence
agacggaaagaccatggcca

SEQ ID NO: 57953 - DNA, 20 bp, Artificial
  CRISPR gRNA sequence
cggaaagaccatggccaagg

SEQ ID NO: 57954 - DNA, 20 bp, Artificial
  CRISPR gRNA sequence
ggaaagaccatggccaagga

SEQ ID NO: 57955 - DNA, 20 bp, Artificial
  CRISPR gRNA sequence
gaaagaccatggccaaggaa

SEQ ID NO: 57956 - DNA, 20 bp, Artificial
  CRISPR gRNA sequence
accatggccaaggaagggca

SEQ ID NO: 57957 - DNA, 20 bp, Artificial
  CRISPR gRNA sequence
ccatggccaaggaagggcaa

SEQ ID NO: 57958 - DNA, 20 bp, Artificial
  CRISPR gRNA sequence
catggccaaggaagggcaaa

SEQ ID NO: 57959 - DNA, 20 bp, Artificial
  CRISPR gRNA sequence
aagggcaaagggtgtgccca

SEQ ID NO: 57960 - DNA, 20 bp, Artificial
  CRISPR gRNA sequence
agggtgtgcccacagtcaca

SEQ ID NO: 57961 - DNA, 20 bp, Artificial
  CRISPR gRNA sequence
tgtgcccacagtcacacagc

SEQ ID NO: 57962 - DNA, 20 bp, Artificial
  CRISPR gRNA sequence
gtcacacagcaagtccatga

SEQ ID NO: 57963 - DNA, 20 bp, Artificial
  CRISPR gRNA sequence
cacacagcaagtccatgaca

SEQ ID NO: 57964 - DNA, 20 bp, Artificial
  CRISPR gRNA sequence
acacagcaagtccatgacag

SEQ ID NO: 57965 - DNA, 20 bp, Artificial
  CRISPR gRNA sequence
cagcaagtccatgacagagg

SEQ ID NO: 57966 - DNA, 20 bp, Artificial
  CRISPR gRNA sequence
agcaagtccatgacagaggc

SEQ ID NO: 57967 - DNA, 20 bp, Artificial
  CRISPR gRNA sequence
caagtccatgacagaggcag

SEQ ID NO: 57968 - DNA, 20 bp, Artificial
  CRISPR gRNA sequence
aagtccatgacagaggcagg

SEQ ID NO: 57969 - DNA, 20 bp, Artificial
  CRISPR gRNA sequence
gtccatgacagaggcaggag

SEQ ID NO: 57970 - DNA, 20 bp, Artificial
  CRISPR gRNA sequence
acagaggcaggaggagaact

SEQ ID NO: 57971 - DNA, 20 bp, Artificial
  CRISPR gRNA sequence
cagaggcaggaggagaactg

SEQ ID NO: 57972 - DNA, 20 bp, Artificial
  CRISPR gRNA sequence
aactgaggtttcttgcctcc

SEQ ID NO: 57973 - DNA, 20 bp, Artificial
  CRISPR gRNA sequence
actgaggtttcttgcctccc

SEQ ID NO: 57974 - DNA, 20 bp, Artificial
  CRISPR gRNA sequence
aggtttcttgcctcccaggc

SEQ ID NO: 57975 - DNA, 20 bp, Artificial
  CRISPR gRNA sequence
tcccaggccagtaaatttcc

SEQ ID NO: 57976 - DNA, 20 bp, Artificial
  CRISPR gRNA sequence
cccaggccagtaaatttcca

SEQ ID NO: 57977 - DNA, 20 bp, Artificial
  CRISPR gRNA sequence
ccagtaaatttccaaggcct

SEQ ID NO: 57978 - DNA, 20 bp, Artificial
  CRISPR gRNA sequence
agtaaatttccaaggccttg

SEQ ID NO: 57979 - DNA, 20 bp, Artificial
  CRISPR gRNA sequence
gtaaatttccaaggccttgg

SEQ ID NO: 57980 - DNA, 20 bp, Artificial
  CRISPR gRNA sequence
tttccaaggccttggaggcc

SEQ ID NO: 57981 - DNA, 20 bp, Artificial
  CRISPR gRNA sequence
caaggccttggaggcctaga

SEQ ID NO: 57982 - DNA, 20 bp, Artificial
  CRISPR gRNA sequence
cttggaggcctagatggcac

SEQ ID NO: 57983 - DNA, 20 bp, Artificial
  CRISPR gRNA sequence
aggcctagatggcaccagac

SEQ ID NO: 57984 - DNA, 20 bp, Artificial
  CRISPR gRNA sequence
ggcctagatggcaccagaca

SEQ ID NO: 57985 - DNA, 20 bp, Artificial
  CRISPR gRNA sequence
agatggcaccagacaaggct

SEQ ID NO: 57986 - DNA, 20 bp, Artificial
  CRISPR gRNA sequence
accagacaaggctaagtccc

SEQ ID NO: 57987 - DNA, 20 bp, Artificial
  CRISPR gRNA sequence
ccctggattttgtgtgatct

SEQ ID NO: 57988 - DNA, 20 bp, Artificial
  CRISPR gRNA sequence
attttgtgtgatctcggcaa

SEQ ID NO: 57989 - DNA, 20 bp, Artificial
  CRISPR gRNA sequence
ttttgtgtgatctcggcaaa

SEQ ID NO: 57990 - DNA, 20 bp, Artificial
  CRISPR gRNA sequence
gtgatctcggcaaaaggatg

SEQ ID NO: 57991 - DNA, 20 bp, Artificial
  CRISPR gRNA sequence
tcggcaaaaggatgtggcca

SEQ ID NO: 57992 - DNA, 20 bp, Artificial
  CRISPR gRNA sequence
aaaaggatgtggccatagcc

SEQ ID NO: 57993 - DNA, 20 bp, Artificial
  CRISPR gRNA sequence
aaaggatgtggccatagcct

SEQ ID NO: 57994 - DNA, 20 bp, Artificial
  CRISPR gRNA sequence
aaggatgtggccatagccta

SEQ ID NO: 57995 - DNA, 20 bp, Artificial
  CRISPR gRNA sequence
ctagggcataacttcttttc

SEQ ID NO: 57996 - DNA, 20 bp, Artificial
  CRISPR gRNA sequence
tagggcataacttcttttcc

SEQ ID NO: 57997 - DNA, 20 bp, Artificial
  CRISPR gRNA sequence
ataacttcttttccaggcta

SEQ ID NO: 57998 - DNA, 20 bp, Artificial
  CRISPR gRNA sequence
cttttccaggctatggtgtc

SEQ ID NO: 57999 - DNA, 20 bp, Artificial
  CRISPR gRNA sequence
cagcatccatgctacccatg

SEQ ID NO: 58000 - DNA, 20 bp, Artificial
  CRISPR gRNA sequence
ccatgctacccatgaagaaa

SEQ ID NO: 58001 - DNA, 20 bp, Artificial
  CRISPR gRNA sequence
ctacccatgaagaaatggtc

SEQ ID NO: 58002 - DNA, 20 bp, Artificial
  CRISPR gRNA sequence
tacccatgaagaaatggtcc

SEQ ID NO: 58003 - DNA, 20 bp, Artificial
  CRISPR gRNA sequence
acccatgaagaaatggtcca

SEQ ID NO: 58004 - DNA, 20 bp, Artificial
  CRISPR gRNA sequence
catgaagaaatggtccaggg

SEQ ID NO: 58005 - DNA, 20 bp, Artificial
  CRISPR gRNA sequence
agaaatggtccagggcagca

SEQ ID NO: 58006 - DNA, 20 bp, Artificial
  CRISPR gRNA sequence
ggtccagggcagcatggcac

SEQ ID NO: 58007 - DNA, 20 bp, Artificial
  CRISPR gRNA sequence
cagggcagcatggcaccaga

SEQ ID NO: 58008 - DNA, 20 bp, Artificial
  CRISPR gRNA sequence
ggcagcatggcaccagatgg

SEQ ID NO: 58009 - DNA, 20 bp, Artificial
  CRISPR gRNA sequence
gcatggcaccagatggaagt

SEQ ID NO: 58010 - DNA, 20 bp, Artificial
  CRISPR gRNA sequence
tggcaccagatggaagtaag

SEQ ID NO: 58011 - DNA, 20 bp, Artificial
  CRISPR gRNA sequence
agatggaagtaagtagtgcc

SEQ ID NO: 58012 - DNA, 20 bp, Artificial
  CRISPR gRNA sequence
ggaagtaagtagtgcctgga

SEQ ID NO: 58013 - DNA, 20 bp, Artificial
  CRISPR gRNA sequence
tgcctggatggtgtgatttc

SEQ ID NO: 58014 - DNA, 20 bp, Artificial
  CRISPR gRNA sequence
tcatcctcaaatttctcctc

SEQ ID NO: 58015 - DNA, 20 bp, Artificial
  CRISPR gRNA sequence
cctcaaatttctcctccagc

SEQ ID NO: 58016 - DNA, 20 bp, Artificial
  CRISPR gRNA sequence
aatacctttgtttccatcat

SEQ ID NO: 58017 - DNA, 20 bp, Artificial
  CRISPR gRNA sequence
tcattagtgttctatcccct

SEQ ID NO: 58018 - DNA, 20 bp, Artificial
  CRISPR gRNA sequence
cattagtgttctatcccctt

SEQ ID NO: 58019 - DNA, 20 bp, Artificial
  CRISPR gRNA sequence
gatatgacacaaatctcttt

SEQ ID NO: 58020 - DNA, 20 bp, Artificial
  CRISPR gRNA sequence
atatgacacaaatctcttta

SEQ ID NO: 58021 - DNA, 20 bp, Artificial
  CRISPR gRNA sequence
tctttaaggctaaccatcct

SEQ ID NO: 58022 - DNA, 20 bp, Artificial
  CRISPR gRNA sequence
ctttaaggctaaccatcctc

SEQ ID NO: 58023 - DNA, 20 bp, Artificial
  CRISPR gRNA sequence
ttaaggctaaccatcctcag

SEQ ID NO: 58024 - DNA, 20 bp, Artificial
  CRISPR gRNA sequence
ctaaccatcctcaggagaaa

SEQ ID NO: 58025 - DNA, 20 bp, Artificial
  CRISPR gRNA sequence
tcctcaggagaaaaagcaca

SEQ ID NO: 58026 - DNA, 20 bp, Artificial
  CRISPR gRNA sequence
aaagcacatggcatcattat

SEQ ID NO: 58027 - DNA, 20 bp, Artificial
  CRISPR gRNA sequence
tggcatcattatcagtcatt

SEQ ID NO: 58028 - DNA, 20 bp, Artificial
  CRISPR gRNA sequence
atcagtcattgagatttcca

SEQ ID NO: 58029 - DNA, 20 bp, Artificial
  CRISPR gRNA sequence
tcagtcattgagatttccat

SEQ ID NO: 58030 - DNA, 20 bp, Artificial
  CRISPR gRNA sequence
cagtcattgagatttccatg

SEQ ID NO: 58031 - DNA, 20 bp, Artificial
  CRISPR gRNA sequence
atttccatggggaataatct

SEQ ID NO: 58032 - DNA, 20 bp, Artificial
  CRISPR gRNA sequence
ttccatggggaataatcttg

SEQ ID NO: 58033 - DNA, 20 bp, Artificial
  CRISPR gRNA sequence
atggggaataatcttggaga

SEQ ID NO: 58034 - DNA, 20 bp, Artificial
  CRISPR gRNA sequence
ggggaataatcttggagaca

SEQ ID NO: 58035 - DNA, 20 bp, Artificial
  CRISPR gRNA sequence
gggaataatcttggagacag

SEQ ID NO: 58036 - DNA, 20 bp, Artificial
  CRISPR gRNA sequence
atcttggagacagaggacga

SEQ ID NO: 58037 - DNA, 20 bp, Artificial
  CRISPR gRNA sequence
agacagaggacgatggttga

SEQ ID NO: 58038 - DNA, 20 bp, Artificial
  CRISPR gRNA sequence
gacgatggttgaaagatcca

SEQ ID NO: 58039 - DNA, 20 bp, Artificial
  CRISPR gRNA sequence
tggttgaaagatccatggcc

SEQ ID NO: 58040 - DNA, 20 bp, Artificial
  CRISPR gRNA sequence
gctctgttactaattctctg

SEQ ID NO: 58041 - DNA, 20 bp, Artificial
  CRISPR gRNA sequence
ctgttactaattctctgtgg

SEQ ID NO: 58042 - DNA, 20 bp, Artificial
  CRISPR gRNA sequence
tgttactaattctctgtggt

SEQ ID NO: 58043 - DNA, 20 bp, Artificial
  CRISPR gRNA sequence
taattctctgtggtaggcat

SEQ ID NO: 58044 - DNA, 20 bp, Artificial
  CRISPR gRNA sequence
aattctctgtggtaggcatt

SEQ ID NO: 58045 - DNA, 20 bp, Artificial
  CRISPR gRNA sequence
attctctgtggtaggcatta

SEQ ID NO: 58046 - DNA, 20 bp, Artificial
  CRISPR gRNA sequence
gtaggcattagggctgttca

SEQ ID NO: 58047 - DNA, 20 bp, Artificial
  CRISPR gRNA sequence
gatactctttctcctctttc

SEQ ID NO: 58048 - DNA, 20 bp, Artificial
  CRISPR gRNA sequence
atactctttctcctctttct

SEQ ID NO: 58049 - DNA, 20 bp, Artificial
  CRISPR gRNA sequence
ttctcctctttctaggcctt

SEQ ID NO: 58050 - DNA, 20 bp, Artificial
  CRISPR gRNA sequence
tcctctttctaggcctttgg

SEQ ID NO: 58051 - DNA, 20 bp, Artificial
  CRISPR gRNA sequence
cctctttctaggcctttggt

SEQ ID NO: 58052 - DNA, 20 bp, Artificial
  CRISPR gRNA sequence
cttctctgcctccttgaaat

SEQ ID NO: 58053 - DNA, 20 bp, Artificial
  CRISPR gRNA sequence
ttctctgcctccttgaaatt

SEQ ID NO: 58054 - DNA, 20 bp, Artificial
  CRISPR gRNA sequence
tgcctccttgaaattgggca

SEQ ID NO: 58055 - DNA, 20 bp, Artificial
  CRISPR gRNA sequence
cacagccatgaaacttgctt

SEQ ID NO: 58056 - DNA, 20 bp, Artificial
  CRISPR gRNA sequence
gtcaatgaaacatgctaaaa

SEQ ID NO: 58057 - DNA, 20 bp, Artificial
  CRISPR gRNA sequence
aaagactcatgtcatgcctg

SEQ ID NO: 58058 - DNA, 20 bp, Artificial
  CRISPR gRNA sequence
gtcatgcctgtagttgtttt

SEQ ID NO: 58059 - DNA, 20 bp, Artificial
  CRISPR gRNA sequence
ctgtagttgttttaagaacc

SEQ ID NO: 58060 - DNA, 20 bp, Artificial
  CRISPR gRNA sequence
tgtagttgttttaagaacca

SEQ ID NO: 58061 - DNA, 20 bp, Artificial
  CRISPR gRNA sequence
aagaaccaaggtgtaattga

SEQ ID NO: 58062 - DNA, 20 bp, Artificial
  CRISPR gRNA sequence
ctttttctttttttctactc

SEQ ID NO: 58063 - DNA, 20 bp, Artificial
  CRISPR gRNA sequence
tttttctttttttctactcc

SEQ ID NO: 58064 - DNA, 20 bp, Artificial
  CRISPR gRNA sequence
ttttctttttttctactcca

SEQ ID NO: 58065 - DNA, 20 bp, Artificial
  CRISPR gRNA sequence
tttttttctactccagggac

SEQ ID NO: 58066 - DNA, 20 bp, Artificial
  CRISPR gRNA sequence
accagaaatattgcaaatca

SEQ ID NO: 58067 - DNA, 20 bp, Artificial
  CRISPR gRNA sequence
gcaaatcatggctaccctgt

SEQ ID NO: 58068 - DNA, 20 bp, Artificial
  CRISPR gRNA sequence
catggctaccctgttagcct

SEQ ID NO: 58069 - DNA, 20 bp, Artificial
  CRISPR gRNA sequence
ctaccctgttagcctgagtg

SEQ ID NO: 58070 - DNA, 20 bp, Artificial
  CRISPR gRNA sequence
taccctgttagcctgagtgt

SEQ ID NO: 58071 - DNA, 20 bp, Artificial
  CRISPR gRNA sequence
ccctgttagcctgagtgtgg

SEQ ID NO: 58072 - DNA, 20 bp, Artificial
  CRISPR gRNA sequence
gttagcctgagtgtgggaga

SEQ ID NO: 58073 - DNA, 20 bp, Artificial
  CRISPR gRNA sequence
ttagcctgagtgtgggagac

SEQ ID NO: 58074 - DNA, 20 bp, Artificial
  CRISPR gRNA sequence
gtgtgggagacaggatgatg

SEQ ID NO: 58075 - DNA, 20 bp, Artificial
  CRISPR gRNA sequence
gtgggagacaggatgatgtg

SEQ ID NO: 58076 - DNA, 20 bp, Artificial
  CRISPR gRNA sequence
tgggagacaggatgatgtgg

SEQ ID NO: 58077 - DNA, 20 bp, Artificial
  CRISPR gRNA sequence
ggagacaggatgatgtggag

SEQ ID NO: 58078 - DNA, 20 bp, Artificial
  CRISPR gRNA sequence
atgatgtggaggagcaatcc

SEQ ID NO: 58079 - DNA, 20 bp, Artificial
  CRISPR gRNA sequence
caatcccagtcaatccacac

SEQ ID NO: 58080 - DNA, 20 bp, Artificial
  CRISPR gRNA sequence
cccagtcaatccacacgaga

SEQ ID NO: 58081 - DNA, 20 bp, Artificial
  CRISPR gRNA sequence
ccagtcaatccacacgagac

SEQ ID NO: 58082 - DNA, 20 bp, Artificial
  CRISPR gRNA sequence
gtcaatccacacgagacagg

SEQ ID NO: 58083 - DNA, 20 bp, Artificial
  CRISPR gRNA sequence
atccacacgagacaggaagc

SEQ ID NO: 58084 - DNA, 20 bp, Artificial
  CRISPR gRNA sequence
ccacacgagacaggaagcaa

SEQ ID NO: 58085 - DNA, 20 bp, Artificial
  CRISPR gRNA sequence
cacgagacaggaagcaagag

SEQ ID NO: 58086 - DNA, 20 bp, Artificial
  CRISPR gRNA sequence
acgagacaggaagcaagagc

SEQ ID NO: 58087 - DNA, 20 bp, Artificial
  CRISPR gRNA sequence
aaataaacttttgttgccat

SEQ ID NO: 58088 - DNA, 20 bp, Artificial
  CRISPR gRNA sequence
cttttgttgccatgagtcac

SEQ ID NO: 58089 - DNA, 20 bp, Artificial
  CRISPR gRNA sequence
ttttgttgccatgagtcact

SEQ ID NO: 58090 - DNA, 20 bp, Artificial
  CRISPR gRNA sequence
gccatgagtcactgggactt

SEQ ID NO: 58091 - DNA, 20 bp, Artificial
  CRISPR gRNA sequence
catgagtcactgggactttg

SEQ ID NO: 58092 - DNA, 20 bp, Artificial
  CRISPR gRNA sequence
atgagtcactgggactttgg

SEQ ID NO: 58093 - DNA, 20 bp, Artificial
  CRISPR gRNA sequence
tgagtcactgggactttgga

SEQ ID NO: 58094 - DNA, 20 bp, Artificial
  CRISPR gRNA sequence
tttggagggtgcatgtacta

SEQ ID NO: 58095 - DNA, 20 bp, Artificial
  CRISPR gRNA sequence
gcatgtactacagtgtaacc

SEQ ID NO: 58096 - DNA, 20 bp, Artificial
  CRISPR gRNA sequence
cagtgtaacctggcctatcc

SEQ ID NO: 58097 - DNA, 20 bp, Artificial
  CRISPR gRNA sequence
tatcctagctgatacactca

SEQ ID NO: 58098 - DNA, 20 bp, Artificial
  CRISPR gRNA sequence
tacactcatagtgtgacctt

SEQ ID NO: 58099 - DNA, 20 bp, Artificial
  CRISPR gRNA sequence
ctcatagtgtgaccttgagc

SEQ ID NO: 58100 - DNA, 20 bp, Artificial
  CRISPR gRNA sequence
agcaagcctttttcctatat

SEQ ID NO: 58101 - DNA, 20 bp, Artificial
  CRISPR gRNA sequence
cctttttcctatataagcct

SEQ ID NO: 58102 - DNA, 20 bp, Artificial
  CRISPR gRNA sequence
cagtcataccatctctaaaa

SEQ ID NO: 58103 - DNA, 20 bp, Artificial
  CRISPR gRNA sequence
agtcataccatctctaaaat

SEQ ID NO: 58104 - DNA, 20 bp, Artificial
  CRISPR gRNA sequence
cataccatctctaaaatggg

SEQ ID NO: 58105 - DNA, 20 bp, Artificial
  CRISPR gRNA sequence
catctctaaaatgggtagat

SEQ ID NO: 58106 - DNA, 20 bp, Artificial
  CRISPR gRNA sequence
tacattctcatgctgaatga

SEQ ID NO: 58107 - DNA, 20 bp, Artificial
  CRISPR gRNA sequence
tctcatgctgaatgatggtc

SEQ ID NO: 58108 - DNA, 20 bp, Artificial
  CRISPR gRNA sequence
ctcatgctgaatgatggtca

SEQ ID NO: 58109 - DNA, 20 bp, Artificial
  CRISPR gRNA sequence
tcatgctgaatgatggtcaa

SEQ ID NO: 58110 - DNA, 20 bp, Artificial
  CRISPR gRNA sequence
tgctgaatgatggtcaaggg

SEQ ID NO: 58111 - DNA, 20 bp, Artificial
  CRISPR gRNA sequence
gctgaatgatggtcaagggc

SEQ ID NO: 58112 - DNA, 20 bp, Artificial
  CRISPR gRNA sequence
caagggcaggtttgttgtgt

SEQ ID NO: 58113 - DNA, 20 bp, Artificial
  CRISPR gRNA sequence
aagggcaggtttgttgtgtt

SEQ ID NO: 58114 - DNA, 20 bp, Artificial
  CRISPR gRNA sequence
agggcaggtttgttgtgttg

SEQ ID NO: 58115 - DNA, 20 bp, Artificial
  CRISPR gRNA sequence
gggcaggtttgttgtgttgg

SEQ ID NO: 58116 - DNA, 20 bp, Artificial
  CRISPR gRNA sequence
caggtttgttgtgttggggg

SEQ ID NO: 58117 - DNA, 20 bp, Artificial
  CRISPR gRNA sequence
ttgttgtgttgggggcagcc

SEQ ID NO: 58118 - DNA, 20 bp, Artificial
  CRISPR gRNA sequence
tgtgttgggggcagcccagt

SEQ ID NO: 58119 - DNA, 20 bp, Artificial
  CRISPR gRNA sequence
gtgttgggggcagcccagta

SEQ ID NO: 58120 - DNA, 20 bp, Artificial
  CRISPR gRNA sequence
ttgggggcagcccagtaagg

SEQ ID NO: 58121 - DNA, 20 bp, Artificial
  CRISPR gRNA sequence
gcagcccagtaaggcagatt

SEQ ID NO: 58122 - DNA, 20 bp, Artificial
  CRISPR gRNA sequence
cagcccagtaaggcagattt

SEQ ID NO: 58123 - DNA, 20 bp, Artificial
  CRISPR gRNA sequence
cccagtaaggcagatttggg

SEQ ID NO: 58124 - DNA, 20 bp, Artificial
  CRISPR gRNA sequence
ccagtaaggcagatttgggt

SEQ ID NO: 58125 - DNA, 20 bp, Artificial
  CRISPR gRNA sequence
cagtaaggcagatttgggta

SEQ ID NO: 58126 - DNA, 20 bp, Artificial
  CRISPR gRNA sequence
aggcagatttgggtagggac

SEQ ID NO: 58127 - DNA, 20 bp, Artificial
  CRISPR gRNA sequence
atttgggtagggaccagtct

SEQ ID NO: 58128 - DNA, 20 bp, Artificial
  CRISPR gRNA sequence
tgggtagggaccagtcttgg

SEQ ID NO: 58129 - DNA, 20 bp, Artificial
  CRISPR gRNA sequence
gtagggaccagtcttggcag

SEQ ID NO: 58130 - DNA, 20 bp, Artificial
  CRISPR gRNA sequence
tagggaccagtcttggcagt

SEQ ID NO: 58131 - DNA, 20 bp, Artificial
  CRISPR gRNA sequence
gggaccagtcttggcagtag

SEQ ID NO: 58132 - DNA, 20 bp, Artificial
  CRISPR gRNA sequence
cagtcttggcagtaggagaa

SEQ ID NO: 58133 - DNA, 20 bp, Artificial
  CRISPR gRNA sequence
gcagtaggagaaaagtgacg

SEQ ID NO: 58134 - DNA, 20 bp, Artificial
  CRISPR gRNA sequence
gtaggagaaaagtgacgaag

SEQ ID NO: 58135 - DNA, 20 bp, Artificial
  CRISPR gRNA sequence
gagaaaagtgacgaagtaga

SEQ ID NO: 58136 - DNA, 20 bp, Artificial
  CRISPR gRNA sequence
agaaaagtgacgaagtagat

SEQ ID NO: 58137 - DNA, 20 bp, Artificial
  CRISPR gRNA sequence
aaaagtgacgaagtagatag

SEQ ID NO: 58138 - DNA, 20 bp, Artificial
  CRISPR gRNA sequence
aaagtgacgaagtagatagg

SEQ ID NO: 58139 - DNA, 20 bp, Artificial
  CRISPR gRNA sequence
aagtgacgaagtagatagga

SEQ ID NO: 58140 - DNA, 20 bp, Artificial
  CRISPR gRNA sequence
agtgacgaagtagataggag

SEQ ID NO: 58141 - DNA, 20 bp, Artificial
  CRISPR gRNA sequence
cgaagtagataggaggggaa

SEQ ID NO: 58142 - DNA, 20 bp, Artificial
  CRISPR gRNA sequence
aagtagataggaggggaaaa

SEQ ID NO: 58143 - DNA, 20 bp, Artificial
  CRISPR gRNA sequence
agtagataggaggggaaaag

SEQ ID NO: 58144 - DNA, 20 bp, Artificial
  CRISPR gRNA sequence
tagataggaggggaaaagag

SEQ ID NO: 58145 - DNA, 20 bp, Artificial
  CRISPR gRNA sequence
agataggaggggaaaagagg

SEQ ID NO: 58146 - DNA, 20 bp, Artificial
  CRISPR gRNA sequence
ggaggggaaaagaggaggtg

SEQ ID NO: 58147 - DNA, 20 bp, Artificial
  CRISPR gRNA sequence
gaggggaaaagaggaggtga

SEQ ID NO: 58148 - DNA, 20 bp, Artificial
  CRISPR gRNA sequence
aggggaaaagaggaggtgaa

SEQ ID NO: 58149 - DNA, 20 bp, Artificial
  CRISPR gRNA sequence
ggggaaaagaggaggtgaag

SEQ ID NO: 58150 - DNA, 20 bp, Artificial
  CRISPR gRNA sequence
ggaaaagaggaggtgaaggg

SEQ ID NO: 58151 - DNA, 20 bp, Artificial
  CRISPR gRNA sequence
aaaagaggaggtgaagggga

SEQ ID NO: 58152 - DNA, 20 bp, Artificial
  CRISPR gRNA sequence
ggagagaaaaatcacctact

SEQ ID NO: 58153 - DNA, 20 bp, Artificial
  CRISPR gRNA sequence
cttggtctcctcgttcatga

SEQ ID NO: 58154 - DNA, 20 bp, Artificial
  CRISPR gRNA sequence
ttggtctcctcgttcatgat

SEQ ID NO: 58155 - DNA, 20 bp, Artificial
  CRISPR gRNA sequence
ctcgttcatgataggtgctc

SEQ ID NO: 58156 - DNA, 20 bp, Artificial
  CRISPR gRNA sequence
tcgttcatgataggtgctct

SEQ ID NO: 58157 - DNA, 20 bp, Artificial
  CRISPR gRNA sequence
cgttcatgataggtgctcta

SEQ ID NO: 58158 - DNA, 20 bp, Artificial
  CRISPR gRNA sequence
taggtgctctagggtcccca

SEQ ID NO: 58159 - DNA, 20 bp, Artificial
  CRISPR gRNA sequence
ggtgctctagggtccccacg

SEQ ID NO: 58160 - DNA, 20 bp, Artificial
  CRISPR gRNA sequence
tgctctagggtccccacgga

SEQ ID NO: 58161 - DNA, 20 bp, Artificial
  CRISPR gRNA sequence
gctctagggtccccacggag

SEQ ID NO: 58162 - DNA, 20 bp, Artificial
  CRISPR gRNA sequence
ctctagggtccccacggaga

SEQ ID NO: 58163 - DNA, 20 bp, Artificial
  CRISPR gRNA sequence
tccccacggagagggtctca

SEQ ID NO: 58164 - DNA, 20 bp, Artificial
  CRISPR gRNA sequence
ccccacggagagggtctcat

SEQ ID NO: 58165 - DNA, 20 bp, Artificial
  CRISPR gRNA sequence
gagagggtctcatgggtgtc

SEQ ID NO: 58166 - DNA, 20 bp, Artificial
  CRISPR gRNA sequence
agagggtctcatgggtgtct

SEQ ID NO: 58167 - DNA, 20 bp, Artificial
  CRISPR gRNA sequence
gtctgggctatgtgtgcctt

SEQ ID NO: 58168 - DNA, 20 bp, Artificial
  CRISPR gRNA sequence
gggctatgtgtgccttgagc

SEQ ID NO: 58169 - DNA, 20 bp, Artificial
  CRISPR gRNA sequence
tgtgccttgagctggattga

SEQ ID NO: 58170 - DNA, 20 bp, Artificial
  CRISPR gRNA sequence
gtgccttgagctggattgac

SEQ ID NO: 58171 - DNA, 20 bp, Artificial
  CRISPR gRNA sequence
ggattgacaggttgtttcca

SEQ ID NO: 58172 - DNA, 20 bp, Artificial
  CRISPR gRNA sequence
gacaggttgtttccatagtg

SEQ ID NO: 58173 - DNA, 20 bp, Artificial
  CRISPR gRNA sequence
tttccatagtgcagactcct

SEQ ID NO: 58174 - DNA, 20 bp, Artificial
  CRISPR gRNA sequence
ttccatagtgcagactccta

SEQ ID NO: 58175 - DNA, 20 bp, Artificial
  CRISPR gRNA sequence
tccatagtgcagactcctaa

SEQ ID NO: 58176 - DNA, 20 bp, Artificial
  CRISPR gRNA sequence
ccatagtgcagactcctaag

SEQ ID NO: 58177 - DNA, 20 bp, Artificial
  CRISPR gRNA sequence
atagtgcagactcctaaggg

SEQ ID NO: 58178 - DNA, 20 bp, Artificial
  CRISPR gRNA sequence
agtgcagactcctaagggga

SEQ ID NO: 58179 - DNA, 20 bp, Artificial
  CRISPR gRNA sequence
gcagactcctaaggggagag

SEQ ID NO: 58180 - DNA, 20 bp, Artificial
  CRISPR gRNA sequence
actcctaaggggagagaaga

SEQ ID NO: 58181 - DNA, 20 bp, Artificial
  CRISPR gRNA sequence
ctcctaaggggagagaagac

SEQ ID NO: 58182 - DNA, 20 bp, Artificial
  CRISPR gRNA sequence
tcctaaggggagagaagaca

SEQ ID NO: 58183 - DNA, 20 bp, Artificial
  CRISPR gRNA sequence
ctaaggggagagaagacagg

SEQ ID NO: 58184 - DNA, 20 bp, Artificial
  CRISPR gRNA sequence
gggagttttccccactattc

SEQ ID NO: 58185 - DNA, 20 bp, Artificial
  CRISPR gRNA sequence
cccactattccagactccaa

SEQ ID NO: 58186 - DNA, 20 bp, Artificial
  CRISPR gRNA sequence
ccactattccagactccaaa

SEQ ID NO: 58187 - DNA, 20 bp, Artificial
  CRISPR gRNA sequence
ccaaaaggaatgctgtaaac

SEQ ID NO: 58188 - DNA, 20 bp, Artificial
  CRISPR gRNA sequence
caaaaggaatgctgtaaacc

SEQ ID NO: 58189 - DNA, 20 bp, Artificial
  CRISPR gRNA sequence
gaatgctgtaaaccaggcac

SEQ ID NO: 58190 - DNA, 20 bp, Artificial
  CRISPR gRNA sequence
cagcccttgcccctgcctgc

SEQ ID NO: 58191 - DNA, 20 bp, Artificial
  CRISPR gRNA sequence
gcccttgcccctgcctgccg

SEQ ID NO: 58192 - DNA, 20 bp, Artificial
  CRISPR gRNA sequence
ctggtttacagcattccttt

SEQ ID NO: 58193 - DNA, 20 bp, Artificial
  CRISPR gRNA sequence
acagcattccttttggagtc

SEQ ID NO: 58194 - DNA, 20 bp, Artificial
  CRISPR gRNA sequence
tccctgtcttctctcccctt

SEQ ID NO: 58195 - DNA, 20 bp, Artificial
  CRISPR gRNA sequence
ccttgaccatcattcagcat

SEQ ID NO: 58196 - DNA, 20 bp, Artificial
  CRISPR gRNA sequence
atcagacacagaaaatcagg

SEQ ID NO: 58197 - DNA, 20 bp, Artificial
  CRISPR gRNA sequence
ggcttgctcaaggtcacact

SEQ ID NO: 58198 - DNA, 20 bp, Artificial
  CRISPR gRNA sequence
cacactatgagtgtatcagc

SEQ ID NO: 58199 - DNA, 20 bp, Artificial
  CRISPR gRNA sequence
gctcttgcttcctgtctcgt

SEQ ID NO: 58200 - DNA, 20 bp, Artificial
  CRISPR gRNA sequence
cctgtctcgtgtggattgac

SEQ ID NO: 58201 - DNA, 20 bp, Artificial
  CRISPR gRNA sequence
gtctcccacactcaggctaa

SEQ ID NO: 58202 - DNA, 20 bp, Artificial
  CRISPR gRNA sequence
tttgcaatatttctggtccc

SEQ ID NO: 58203 - DNA, 20 bp, Artificial
  CRISPR gRNA sequence
aaaacaactacaggcatgac

SEQ ID NO: 58204 - DNA, 20 bp, Artificial
  CRISPR gRNA sequence
aaaggcctagaaagaggaga

SEQ ID NO: 58205 - DNA, 20 bp, Artificial
  CRISPR gRNA sequence
cagccctaatgcctaccaca

SEQ ID NO: 58206 - DNA, 20 bp, Artificial
  CRISPR gRNA sequence
attagtaacagagctgggcc

SEQ ID NO: 58207 - DNA, 20 bp, Artificial
  CRISPR gRNA sequence
tgccatgtgctttttctcct

SEQ ID NO: 58208 - DNA, 20 bp, Artificial
  CRISPR gRNA sequence
agatttgtgtcatatcctaa

SEQ ID NO: 58209 - DNA, 20 bp, Artificial
  CRISPR gRNA sequence
actggctggaggagaaattt

SEQ ID NO: 58210 - DNA, 20 bp, Artificial
  CRISPR gRNA sequence
ctgccctggaccatttcttc

SEQ ID NO: 58211 - DNA, 20 bp, Artificial
  CRISPR gRNA sequence
accatttcttcatgggtagc

SEQ ID NO: 58212 - DNA, 20 bp, Artificial
  CRISPR gRNA sequence
ggaggtggtgatccctgcct

SEQ ID NO: 58213 - DNA, 20 bp, Artificial
  CRISPR gRNA sequence
taaattctaagactctctgc

SEQ ID NO: 58214 - DNA, 20 bp, Artificial
  CRISPR gRNA sequence
tagtactggcctcagcctct

SEQ ID NO: 58215 - DNA, 20 bp, Artificial
  CRISPR gRNA sequence
ggaattgggaaggctggctt

SEQ ID NO: 58216 - DNA, 20 bp, Artificial
  CRISPR gRNA sequence
ggtggacctcctactctttt

SEQ ID NO: 58217 - DNA, 20 bp, Artificial
  CRISPR gRNA sequence
agagttagaggtggactctc

SEQ ID NO: 58218 - DNA, 20 bp, Artificial
  CRISPR gRNA sequence
ggtggactctctggagttgt

SEQ ID NO: 58219 - DNA, 20 bp, Artificial
  CRISPR gRNA sequence
tagacagtgcctaatacaca

SEQ ID NO: 58220 - DNA, 20 bp, Artificial
  CRISPR gRNA sequence
tcatgatcgtttgccaaggt

SEQ ID NO: 58221 - DNA, 20 bp, Artificial
  CRISPR gRNA sequence
caaggttagagtcctagaaa

SEQ ID NO: 58222 - DNA, 20 bp, Artificial
  CRISPR gRNA sequence
gagtcctagaaatggaatta

SEQ ID NO: 58223 - DNA, 20 bp, Artificial
  CRISPR gRNA sequence
cttctagaaggaggtggttt

SEQ ID NO: 58224 - DNA, 20 bp, Artificial
  CRISPR gRNA sequence
gggcagatcaccctgaggtc

SEQ ID NO: 58225 - DNA, 20 bp, Artificial
  CRISPR gRNA sequence
tactcgggaggctgaggcag

SEQ ID NO: 58226 - DNA, 20 bp, Artificial
  CRISPR gRNA sequence
ttgcaccattgcactccagc

SEQ ID NO: 58227 - DNA, 20 bp, Artificial
  CRISPR gRNA sequence
agactctgtctcaaaaaaaa

SEQ ID NO: 58228 - DNA, 20 bp, Artificial
  CRISPR gRNA sequence
agagttccagttcagaaggg

SEQ ID NO: 58229 - DNA, 20 bp, Artificial
  CRISPR gRNA sequence
aggtgatggtctgtgttagc

SEQ ID NO: 58230 - DNA, 20 bp, Artificial
  CRISPR gRNA sequence
tggtctgtgttagctaggat

SEQ ID NO: 58231 - DNA, 20 bp, Artificial
  CRISPR gRNA sequence
agctaggattagagttcact

SEQ ID NO: 58232 - DNA, 20 bp, Artificial
  CRISPR gRNA sequence
ctaaacaacagtggcttaac

SEQ ID NO: 58233 - DNA, 20 bp, Artificial
  CRISPR gRNA sequence
taccttccaccttcctcagt

SEQ ID NO: 58234 - DNA, 20 bp, Artificial
  CRISPR gRNA sequence
gacaacaggaaggagcaaag

SEQ ID NO: 58235 - DNA, 20 bp, Artificial
  CRISPR gRNA sequence
catataactgcaagggagac

SEQ ID NO: 58236 - DNA, 20 bp, Artificial
  CRISPR gRNA sequence
taatctattctagatgacca

SEQ ID NO: 58237 - DNA, 20 bp, Artificial
  CRISPR gRNA sequence
cataaatggttcatggaaat

SEQ ID NO: 58238 - DNA, 20 bp, Artificial
  CRISPR gRNA sequence
aatggttcatggaaataaga

SEQ ID NO: 58239 - DNA, 20 bp, Artificial
  CRISPR gRNA sequence
tcctcacgggactgtccaca

SEQ ID NO: 58240 - DNA, 20 bp, Artificial
  CRISPR gRNA sequence
acaagaccattccagagagc

SEQ ID NO: 58241 - DNA, 20 bp, Artificial
  CRISPR gRNA sequence
agccagggtgcaggcacaaa

SEQ ID NO: 58242 - DNA, 20 bp, Artificial
  CRISPR gRNA sequence
aggcacaaatggagtaggga

SEQ ID NO: 58243 - DNA, 20 bp, Artificial
  CRISPR gRNA sequence
gaggctgctcaccaaagacc

SEQ ID NO: 58244 - DNA, 20 bp, Artificial
  CRISPR gRNA sequence
tcttcctccccaacacggac

SEQ ID NO: 58245 - DNA, 20 bp, Artificial
  CRISPR gRNA sequence
gagaccttggaccctgaaca

SEQ ID NO: 58246 - DNA, 20 bp, Artificial
  CRISPR gRNA sequence
aactcaacaagctgcatgtc

SEQ ID NO: 58247 - DNA, 20 bp, Artificial
  CRISPR gRNA sequence
tggacctggaggtgctgctg

SEQ ID NO: 58248 - DNA, 20 bp, Artificial
  CRISPR gRNA sequence
ggacccacctaagtcagaga

SEQ ID NO: 58249 - DNA, 20 bp, Artificial
  CRISPR gRNA sequence
ctccttctacctggcttcac

SEQ ID NO: 58250 - DNA, 20 bp, Artificial
  CRISPR gRNA sequence
cctggcttcactcgaattgc

SEQ ID NO: 58251 - DNA, 20 bp, Artificial
  CRISPR gRNA sequence
cactcgaattgctcgaattg

SEQ ID NO: 58252 - DNA, 20 bp, Artificial
  CRISPR gRNA sequence
tttatttcttcttttttggc

SEQ ID NO: 58253 - DNA, 20 bp, Artificial
  CRISPR gRNA sequence
ttcttttttggcgggggtgg

SEQ ID NO: 58254 - DNA, 20 bp, Artificial
  CRISPR gRNA sequence
tttgtttgttgttgctcttg

SEQ ID NO: 58255 - DNA, 20 bp, Artificial
  CRISPR gRNA sequence
tcttgctctgttgcctaggc

SEQ ID NO: 58256 - DNA, 20 bp, Artificial
  CRISPR gRNA sequence
cccttggcctcccaaagtgc

SEQ ID NO: 58257 - DNA, 20 bp, Artificial
  CRISPR gRNA sequence
tctgccctctactgatccgt

SEQ ID NO: 58258 - DNA, 20 bp, Artificial
  CRISPR gRNA sequence
ttaagaaccctacttcaagg

SEQ ID NO: 58259 - DNA, 20 bp, Artificial
  CRISPR gRNA sequence
cctacttcaaggcagagtgt

SEQ ID NO: 58260 - DNA, 20 bp, Artificial
  CRISPR gRNA sequence
tacacacagtgcatatacat

SEQ ID NO: 58261 - DNA, 20 bp, Artificial
  CRISPR gRNA sequence
attttctccacaacagataa

SEQ ID NO: 58262 - DNA, 20 bp, Artificial
  CRISPR gRNA sequence
ttccatttagttctcccttg

SEQ ID NO: 58263 - DNA, 20 bp, Artificial
  CRISPR gRNA sequence
ttatactctcccctctcttg

SEQ ID NO: 58264 - DNA, 20 bp, Artificial
  CRISPR gRNA sequence
agctgaggggaaaagccaac

SEQ ID NO: 58265 - DNA, 20 bp, Artificial
  CRISPR gRNA sequence
agctccaccatggtgaggac

SEQ ID NO: 58266 - DNA, 20 bp, Artificial
  CRISPR gRNA sequence
catggtgaggactggagttg

SEQ ID NO: 58267 - DNA, 20 bp, Artificial
  CRISPR gRNA sequence
ctggagttggggggtgggaa

SEQ ID NO: 58268 - DNA, 20 bp, Artificial
  CRISPR gRNA sequence
ttgtcccgttaccaattcta

SEQ ID NO: 58269 - DNA, 20 bp, Artificial
  CRISPR gRNA sequence
taatgaccacctactgattc

SEQ ID NO: 58270 - DNA, 20 bp, Artificial
  CRISPR gRNA sequence
cctataacctcagctcccca

SEQ ID NO: 58271 - DNA, 20 bp, Artificial
  CRISPR gRNA sequence
atctgattgatatttggcca

SEQ ID NO: 58272 - DNA, 20 bp, Artificial
  CRISPR gRNA sequence
cagtgagtccctttttaata

SEQ ID NO: 58273 - DNA, 20 bp, Artificial
  CRISPR gRNA sequence
tgacttcttaaaattctttc

SEQ ID NO: 58274 - DNA, 20 bp, Artificial
  CRISPR gRNA sequence
ctttctccctcccttccttt

SEQ ID NO: 58275 - DNA, 20 bp, Artificial
  CRISPR gRNA sequence
attaagggaagtgaggaaat

SEQ ID NO: 58276 - DNA, 20 bp, Artificial
  CRISPR gRNA sequence
aaatgtgggtgataagaaat

SEQ ID NO: 58277 - DNA, 20 bp, Artificial
  CRISPR gRNA sequence
tggccatttagtgcttggag

SEQ ID NO: 58278 - DNA, 20 bp, Artificial
  CRISPR gRNA sequence
cagaacatccaccttccaat

SEQ ID NO: 58279 - DNA, 20 bp, Artificial
  CRISPR gRNA sequence
tgcctttccagtccctgcat

SEQ ID NO: 58280 - DNA, 20 bp, Artificial
  CRISPR gRNA sequence
cctgccacctgtctgtggac

SEQ ID NO: 58281 - DNA, 20 bp, Artificial
  CRISPR gRNA sequence
actggagttccccaaaggtt

SEQ ID NO: 58282 - DNA, 20 bp, Artificial
  CRISPR gRNA sequence
gaagcgcccacatcagagct

SEQ ID NO: 58283 - DNA, 20 bp, Artificial
  CRISPR gRNA sequence
gtgcaagaagcagcagctag

SEQ ID NO: 58284 - DNA, 20 bp, Artificial
  CRISPR gRNA sequence
gaggaacataaacagagaga

SEQ ID NO: 58285 - DNA, 20 bp, Artificial
  CRISPR gRNA sequence
cccagggaggagaccagttt

SEQ ID NO: 58286 - DNA, 20 bp, Artificial
  CRISPR gRNA sequence
agaccagtttgggggtgagc

SEQ ID NO: 58287 - DNA, 20 bp, Artificial
  CRISPR gRNA sequence
gggggtgagcagggatgggg

SEQ ID NO: 58288 - DNA, 20 bp, Artificial
  CRISPR gRNA sequence
tctcattcttgaccagttct

SEQ ID NO: 58289 - DNA, 20 bp, Artificial
  CRISPR gRNA sequence
cagaatggtcctcgttctcc

SEQ ID NO: 58290 - DNA, 20 bp, Artificial
  CRISPR gRNA sequence
gccaaccatggctataacca

SEQ ID NO: 58291 - DNA, 20 bp, Artificial
  CRISPR gRNA sequence
actaccttggcctttcccca

SEQ ID NO: 58292 - DNA, 20 bp, Artificial
  CRISPR gRNA sequence
aagcagccccagccctttcc

SEQ ID NO: 58293 - DNA, 20 bp, Artificial
  CRISPR gRNA sequence
ctgagacctctcaatgaccc

SEQ ID NO: 58294 - DNA, 20 bp, Artificial
  CRISPR gRNA sequence
aaatattgggaagaggcact

SEQ ID NO: 58295 - DNA, 20 bp, Artificial
  CRISPR gRNA sequence
actttggagggctgaggcag

SEQ ID NO: 58296 - DNA, 20 bp, Artificial
  CRISPR gRNA sequence
caggtggatcagttgagccc

SEQ ID NO: 58297 - DNA, 20 bp, Artificial
  CRISPR gRNA sequence
actaaaaatacaaaaattag

SEQ ID NO: 58298 - DNA, 20 bp, Artificial
  CRISPR gRNA sequence
tactcaggaggctgaggcag

SEQ ID NO: 58299 - DNA, 20 bp, Artificial
  CRISPR gRNA sequence
caggaggatcacttgagacc

SEQ ID NO: 58300 - DNA, 20 bp, Artificial
  CRISPR gRNA sequence
agtttgcggctacagtaagc

SEQ ID NO: 58301 - DNA, 20 bp, Artificial
  CRISPR gRNA sequence
ttacaccacgtgtactattg

SEQ ID NO: 58302 - DNA, 20 bp, Artificial
  CRISPR gRNA sequence
accacgtgtactattgcaga

SEQ ID NO: 58303 - DNA, 20 bp, Artificial
  CRISPR gRNA sequence
aactgattccttctggaagt

SEQ ID NO: 58304 - DNA, 20 bp, Artificial
  CRISPR gRNA sequence
aagacatgagcagagggccg

SEQ ID NO: 58305 - DNA, 20 bp, Artificial
  CRISPR gRNA sequence
tgccatgtccctgccccttg

SEQ ID NO: 58306 - DNA, 20 bp, Artificial
  CRISPR gRNA sequence
gcgctacaggagccaaatcc

SEQ ID NO: 58307 - DNA, 20 bp, Artificial
  CRISPR gRNA sequence
atctcggacctcttcaacac

SEQ ID NO: 58308 - DNA, 20 bp, Artificial
  CRISPR gRNA sequence
accagggttaacaagggccc

SEQ ID NO: 58309 - DNA, 20 bp, Artificial
  CRISPR gRNA sequence
tttccaggccctgttccttt

SEQ ID NO: 58310 - DNA, 20 bp, Artificial
  CRISPR gRNA sequence
ttttgatctgtacctgagcc

SEQ ID NO: 58311 - DNA, 20 bp, Artificial
  CRISPR gRNA sequence
tagatgaggccctccagcct

SEQ ID NO: 58312 - DNA, 20 bp, Artificial
  CRISPR gRNA sequence
gggaccctcctgcctggctg

SEQ ID NO: 58313 - DNA, 20 bp, Artificial
  CRISPR gRNA sequence
atgttgggctttgatgggcc

SEQ ID NO: 58314 - DNA, 20 bp, Artificial
  CRISPR gRNA sequence
ctttgatgggccacgggtgg

SEQ ID NO: 58315 - DNA, 20 bp, Artificial
  CRISPR gRNA sequence
ggccacgggtggaagaatat

SEQ ID NO: 58316 - DNA, 20 bp, Artificial
  CRISPR gRNA sequence
atcgcgggagggggccctgg

SEQ ID NO: 58317 - DNA, 20 bp, Artificial
  CRISPR gRNA sequence
tttcacccacctcagcctgc

SEQ ID NO: 58318 - DNA, 20 bp, Artificial
  CRISPR gRNA sequence
tatgttaccctccattcccg

SEQ ID NO: 58319 - DNA, 20 bp, Artificial
  CRISPR gRNA sequence
cgcagggcaatgaggactgt

SEQ ID NO: 58320 - DNA, 20 bp, Artificial
  CRISPR gRNA sequence
ttgtagagctgtgtcactgt

SEQ ID NO: 58321 - DNA, 20 bp, Artificial
  CRISPR gRNA sequence
acagggaggcccccatccac

SEQ ID NO: 58322 - DNA, 20 bp, Artificial
  CRISPR gRNA sequence
tggtaggctgtgggcagata

SEQ ID NO: 58323 - DNA, 20 bp, Artificial
  CRISPR gRNA sequence
gggcagatagagaatctcag

SEQ ID NO: 58324 - DNA, 20 bp, Artificial
  CRISPR gRNA sequence
atagagaatctcaggtgagt

SEQ ID NO: 58325 - DNA, 20 bp, Artificial
  CRISPR gRNA sequence
gagtggaggaggaccgggga

SEQ ID NO: 58326 - DNA, 20 bp, Artificial
  CRISPR gRNA sequence
gcaaacctctgccaagagga

SEQ ID NO: 58327 - DNA, 20 bp, Artificial
  CRISPR gRNA sequence
ctctgccaagaggactggat

SEQ ID NO: 58328 - DNA, 20 bp, Artificial
  CRISPR gRNA sequence
aagaggactggataagaatc

SEQ ID NO: 58329 - DNA, 20 bp, Artificial
  CRISPR gRNA sequence
ccataccttgacaggacctc

SEQ ID NO: 58330 - DNA, 20 bp, Artificial
  CRISPR gRNA sequence
acaggacctctggagtccaa

SEQ ID NO: 58331 - DNA, 20 bp, Artificial
  CRISPR gRNA sequence
cacatgcacactgtctaggc

SEQ ID NO: 58332 - DNA, 20 bp, Artificial
  CRISPR gRNA sequence
agagtttcttcgttcctaaa

SEQ ID NO: 58333 - DNA, 20 bp, Artificial
  CRISPR gRNA sequence
ccaactcatatggtcattgc

SEQ ID NO: 58334 - DNA, 20 bp, Artificial
  CRISPR gRNA sequence
tggtcattgcaagaatgaga

SEQ ID NO: 58335 - DNA, 20 bp, Artificial
  CRISPR gRNA sequence
atacagtaggttaaataatg

SEQ ID NO: 58336 - DNA, 20 bp, Artificial
  CRISPR gRNA sequence
attttatttctctctcatgg

SEQ ID NO: 58337 - DNA, 20 bp, Artificial
  CRISPR gRNA sequence
aggtaggtggtccaggtcag

SEQ ID NO: 58338 - DNA, 20 bp, Artificial
  CRISPR gRNA sequence
ttttgctccattatcccctt

SEQ ID NO: 58339 - DNA, 20 bp, Artificial
  CRISPR gRNA sequence
tgcacagtcaaagctacgtc

SEQ ID NO: 58340 - DNA, 20 bp, Artificial
  CRISPR gRNA sequence
ttaaagttcagtcctgaaac

SEQ ID NO: 58341 - DNA, 20 bp, Artificial
  CRISPR gRNA sequence
ctattgctgtagatgaagtg

SEQ ID NO: 58342 - DNA, 20 bp, Artificial
  CRISPR gRNA sequence
attaagccccatctctctga

SEQ ID NO: 58343 - DNA, 20 bp, Artificial
  CRISPR gRNA sequence
gctttaagagcaggaagtgt

SEQ ID NO: 58344 - DNA, 20 bp, Artificial
  CRISPR gRNA sequence
aatggggaggctgcagatgc

SEQ ID NO: 58345 - DNA, 20 bp, Artificial
  CRISPR gRNA sequence
agccaggccttggagctgag

SEQ ID NO: 58346 - DNA, 20 bp, Artificial
  CRISPR gRNA sequence
gctgagaagggtcttcagct

SEQ ID NO: 58347 - DNA, 20 bp, Artificial
  CRISPR gRNA sequence
ccacagctgaaagaagtcag

SEQ ID NO: 58348 - DNA, 20 bp, Artificial
  CRISPR gRNA sequence
atgagccactgcccaggtcc

SEQ ID NO: 58349 - DNA, 20 bp, Artificial
  CRISPR gRNA sequence
agtccaagtactcagtaggg

SEQ ID NO: 58350 - DNA, 20 bp, Artificial
  CRISPR gRNA sequence
gagtccaaacccaaggctcc

SEQ ID NO: 58351 - DNA, 20 bp, Artificial
  CRISPR gRNA sequence
ttagactgtcttggaggagc

SEQ ID NO: 58352 - DNA, 20 bp, Artificial
  CRISPR gRNA sequence
ctttctgaaatcccaggaga

SEQ ID NO: 58353 - DNA, 20 bp, Artificial
  CRISPR gRNA sequence
agggatagcagtgcgtaggc

SEQ ID NO: 58354 - DNA, 20 bp, Artificial
  CRISPR gRNA sequence
gtaggcaggaatcaggcact

SEQ ID NO: 58355 - DNA, 20 bp, Artificial
  CRISPR gRNA sequence
agaagtacacaggcatatgc

SEQ ID NO: 58356 - DNA, 20 bp, Artificial
  CRISPR gRNA sequence
tgggactcagtaccatgggg

SEQ ID NO: 58357 - DNA, 20 bp, Artificial
  CRISPR gRNA sequence
tcactaaggttcagcacttg

SEQ ID NO: 58358 - DNA, 20 bp, Artificial
  CRISPR gRNA sequence
tggggaaagtgaggtcagag

SEQ ID NO: 58359 - DNA, 20 bp, Artificial
  CRISPR gRNA sequence
aatgcgcttggctcagggct

SEQ ID NO: 58360 - DNA, 20 bp, Artificial
  CRISPR gRNA sequence
cgcttggctcagggctctgg

SEQ ID NO: 58361 - DNA, 20 bp, Artificial
  CRISPR gRNA sequence
ccaggcataagccctgggag

SEQ ID NO: 58362 - DNA, 20 bp, Artificial
  CRISPR gRNA sequence
caaaaacttccccataggaa

SEQ ID NO: 58363 - DNA, 20 bp, Artificial
  CRISPR gRNA sequence
ccataggaacagaatagacc

SEQ ID NO: 58364 - DNA, 20 bp, Artificial
  CRISPR gRNA sequence
acccagaattgaggccagca

SEQ ID NO: 58365 - DNA, 20 bp, Artificial
  CRISPR gRNA sequence
ttcctcctagccgtgcctgc

SEQ ID NO: 58366 - DNA, 20 bp, Artificial
  CRISPR gRNA sequence
ctgtcttatgtctcccacat

SEQ ID NO: 58367 - DNA, 20 bp, Artificial
  CRISPR gRNA sequence
cctaccacggctccggaagc

SEQ ID NO: 58368 - DNA, 20 bp, Artificial
  CRISPR gRNA sequence
caaggaaggtctggggcccc

SEQ ID NO: 58369 - DNA, 20 bp, Artificial
  CRISPR gRNA sequence
ggtctggggcccctggggta

SEQ ID NO: 58370 - DNA, 20 bp, Artificial
  CRISPR gRNA sequence
tcaaccctactctgcttggc

SEQ ID NO: 58371 - DNA, 20 bp, Artificial
  CRISPR gRNA sequence
gcagtcacgtgtcctaccgt

SEQ ID NO: 58372 - DNA, 20 bp, Artificial
  CRISPR gRNA sequence
ggccaggtgagcagaaggaa

SEQ ID NO: 58373 - DNA, 20 bp, Artificial
  CRISPR gRNA sequence
gagaaaagaggaggggaaag

SEQ ID NO: 58374 - DNA, 20 bp, Artificial
  CRISPR gRNA sequence
tggaggaggcccctcgtctg

SEQ ID NO: 58375 - DNA, 20 bp, Artificial
  CRISPR gRNA sequence
cacctggtacttggtatata

SEQ ID NO: 58376 - DNA, 20 bp, Artificial
  CRISPR gRNA sequence
acttggtatatattgaatta

SEQ ID NO: 58377 - DNA, 20 bp, Artificial
  CRISPR gRNA sequence
ggtatatattgaattaatgg

SEQ ID NO: 58378 - DNA, 20 bp, Artificial
  CRISPR gRNA sequence
attaatggatggatgaaaag

SEQ ID NO: 58379 - DNA, 20 bp, Artificial
  CRISPR gRNA sequence
atggatgaaaagatggatgt

SEQ ID NO: 58380 - DNA, 20 bp, Artificial
  CRISPR gRNA sequence
atgaaaagatggatgtatgg

SEQ ID NO: 58381 - DNA, 20 bp, Artificial
  CRISPR gRNA sequence
atggatggatggctgaaaag

SEQ ID NO: 58382 - DNA, 20 bp, Artificial
  CRISPR gRNA sequence
atggatggctgaaaagatgg

SEQ ID NO: 58383 - DNA, 20 bp, Artificial
  CRISPR gRNA sequence
atggctgaaaagatggatgg

SEQ ID NO: 58384 - DNA, 20 bp, Artificial
  CRISPR gRNA sequence
atggatgggtggatgaaaag

SEQ ID NO: 58385 - DNA, 20 bp, Artificial
  CRISPR gRNA sequence
atgggtggatgaaaagatgg

SEQ ID NO: 58386 - DNA, 20 bp, Artificial
  CRISPR gRNA sequence
gtggatgaaaagatggatgg

SEQ ID NO: 58387 - DNA, 20 bp, Artificial
  CRISPR gRNA sequence
atgaaaagatggatggatga

SEQ ID NO: 58388 - DNA, 20 bp, Artificial
  CRISPR gRNA sequence
atgaatggatggctgaaaag

SEQ ID NO: 58389 - DNA, 20 bp, Artificial
  CRISPR gRNA sequence
atggatggctgaaaagatgg

SEQ ID NO: 58390 - DNA, 20 bp, Artificial
  CRISPR gRNA sequence
atggctgaaaagatggatgg

SEQ ID NO: 58391 - DNA, 20 bp, Artificial
  CRISPR gRNA sequence
atggatgggtggatgaaaag

SEQ ID NO: 58392 - DNA, 20 bp, Artificial
  CRISPR gRNA sequence
atgggtggatgaaaagatgg

SEQ ID NO: 58393 - DNA, 20 bp, Artificial
  CRISPR gRNA sequence
gtggatgaaaagatggatgg

SEQ ID NO: 58394 - DNA, 20 bp, Artificial
  CRISPR gRNA sequence
atgaaaagatggatggatgg

SEQ ID NO: 58395 - DNA, 20 bp, Artificial
  CRISPR gRNA sequence
aaagatggatggatggatgg

SEQ ID NO: 58396 - DNA, 20 bp, Artificial
  CRISPR gRNA sequence
atggatggatggatggatgg

SEQ ID NO: 58397 - DNA, 20 bp, Artificial
  CRISPR gRNA sequence
atggatggatggctgaaaag

SEQ ID NO: 58398 - DNA, 20 bp, Artificial
  CRISPR gRNA sequence
atggatggctgaaaagatgg

SEQ ID NO: 58399 - DNA, 20 bp, Artificial
  CRISPR gRNA sequence
atggctgaaaagatggatgg

SEQ ID NO: 58400 - DNA, 20 bp, Artificial
  CRISPR gRNA sequence
atggatgggtggatgaaaag

SEQ ID NO: 58401 - DNA, 20 bp, Artificial
  CRISPR gRNA sequence
atgggtggatgaaaagatgg

SEQ ID NO: 58402 - DNA, 20 bp, Artificial
  CRISPR gRNA sequence
gtggatgaaaagatggatgg

SEQ ID NO: 58403 - DNA, 20 bp, Artificial
  CRISPR gRNA sequence
atgaaaagatggatggatgg

SEQ ID NO: 58404 - DNA, 20 bp, Artificial
  CRISPR gRNA sequence
aaagatggatggatggatgg

SEQ ID NO: 58405 - DNA, 20 bp, Artificial
  CRISPR gRNA sequence
atggatggatggatggatgg

SEQ ID NO: 58406 - DNA, 20 bp, Artificial
  CRISPR gRNA sequence
atggatggatggatgaaaag

SEQ ID NO: 58407 - DNA, 20 bp, Artificial
  CRISPR gRNA sequence
atggatggatgaaaagatgg

SEQ ID NO: 58408 - DNA, 20 bp, Artificial
  CRISPR gRNA sequence
atggatgaaaagatggatgg

SEQ ID NO: 58409 - DNA, 20 bp, Artificial
  CRISPR gRNA sequence
atggatgggtggatgaaaag

SEQ ID NO: 58410 - DNA, 20 bp, Artificial
  CRISPR gRNA sequence
atgggtggatgaaaagatgg

SEQ ID NO: 58411 - DNA, 20 bp, Artificial
  CRISPR gRNA sequence
gtggatgaaaagatggatgg

SEQ ID NO: 58412 - DNA, 20 bp, Artificial
  CRISPR gRNA sequence
atgaaaagatggatggatgg

SEQ ID NO: 58413 - DNA, 20 bp, Artificial
  CRISPR gRNA sequence
aaagatggatggatggatgg

SEQ ID NO: 58414 - DNA, 20 bp, Artificial
  CRISPR gRNA sequence
atggatggatggaaagattg

SEQ ID NO: 58415 - DNA, 20 bp, Artificial
  CRISPR gRNA sequence
atggatggaaagattgatgg

SEQ ID NO: 58416 - DNA, 20 bp, Artificial
  CRISPR gRNA sequence
attgatgggtggatgaaaag

SEQ ID NO: 58417 - DNA, 20 bp, Artificial
  CRISPR gRNA sequence
atgggtggatgaaaagatga

SEQ ID NO: 58418 - DNA, 20 bp, Artificial
  CRISPR gRNA sequence
gtggatgaaaagatgaatgg

SEQ ID NO: 58419 - DNA, 20 bp, Artificial
  CRISPR gRNA sequence
atgaaaagatgaatggatgg

SEQ ID NO: 58420 - DNA, 20 bp, Artificial
  CRISPR gRNA sequence
atgaatggatggatggatag

SEQ ID NO: 58421 - DNA, 20 bp, Artificial
  CRISPR gRNA sequence
atggatggatggatagatga

SEQ ID NO: 58422 - DNA, 20 bp, Artificial
  CRISPR gRNA sequence
atggatggatagatgaatgg

SEQ ID NO: 58423 - DNA, 20 bp, Artificial
  CRISPR gRNA sequence
atggatagatgaatggatgg

SEQ ID NO: 58424 - DNA, 20 bp, Artificial
  CRISPR gRNA sequence
atagatggctagctgaaaag

SEQ ID NO: 58425 - DNA, 20 bp, Artificial
  CRISPR gRNA sequence
atggataggtgtgtgaaaag

SEQ ID NO: 58426 - DNA, 20 bp, Artificial
  CRISPR gRNA sequence
ataggtgtgtgaaaagatgg

SEQ ID NO: 58427 - DNA, 20 bp, Artificial
  CRISPR gRNA sequence
gtgtgtgaaaagatggatgg

SEQ ID NO: 58428 - DNA, 20 bp, Artificial
  CRISPR gRNA sequence
gtgaaaagatggatggatgg

SEQ ID NO: 58429 - DNA, 20 bp, Artificial
  CRISPR gRNA sequence
aaagatggatggatggatgg

SEQ ID NO: 58430 - DNA, 20 bp, Artificial
  CRISPR gRNA sequence
atggatggatggatggatgg

SEQ ID NO: 58431 - DNA, 20 bp, Artificial
  CRISPR gRNA sequence
atggatggatggatggatgg

SEQ ID NO: 58432 - DNA, 20 bp, Artificial
  CRISPR gRNA sequence
atggatggatggatggatgg

SEQ ID NO: 58433 - DNA, 20 bp, Artificial
  CRISPR gRNA sequence
atggatggatggatggatgg

SEQ ID NO: 58434 - DNA, 20 bp, Artificial
  CRISPR gRNA sequence
atggatggatggatggatgg

SEQ ID NO: 58435 - DNA, 20 bp, Artificial
  CRISPR gRNA sequence
atggatggatggatggatgg

SEQ ID NO: 58436 - DNA, 20 bp, Artificial
  CRISPR gRNA sequence
atggatggatggatggatgg

SEQ ID NO: 58437 - DNA, 20 bp, Artificial
  CRISPR gRNA sequence
atggatggatggatggatga

SEQ ID NO: 58438 - DNA, 20 bp, Artificial
  CRISPR gRNA sequence
atggatggatggatgaagga

SEQ ID NO: 58439 - DNA, 20 bp, Artificial
  CRISPR gRNA sequence
cgaagcacaggcatagccaa

SEQ ID NO: 58440 - DNA, 20 bp, Artificial
  CRISPR gRNA sequence
aatatagccagttttgatca

SEQ ID NO: 58441 - DNA, 20 bp, Artificial
  CRISPR gRNA sequence
actttggaaggccaaggcaa

SEQ ID NO: 58442 - DNA, 20 bp, Artificial
  CRISPR gRNA sequence
caagaggattacttgagctc

SEQ ID NO: 58443 - DNA, 20 bp, Artificial
  CRISPR gRNA sequence
acacaccactgcactccagc

SEQ ID NO: 58444 - DNA, 20 bp, Artificial
  CRISPR gRNA sequence
ctgcactccagcctgagtag

SEQ ID NO: 58445 - DNA, 20 bp, Artificial
  CRISPR gRNA sequence
gactttttaaaacactcttg

SEQ ID NO: 58446 - DNA, 20 bp, Artificial
  CRISPR gRNA sequence
aattgcaaaatcagctttat

SEQ ID NO: 58447 - DNA, 20 bp, Artificial
  CRISPR gRNA sequence
tttgaacatttggggcagaa

SEQ ID NO: 58448 - DNA, 20 bp, Artificial
  CRISPR gRNA sequence
cagaaaagggtgtgcctgtg

SEQ ID NO: 58449 - DNA, 20 bp, Artificial
  CRISPR gRNA sequence
gatgtgctggtttccagtct

SEQ ID NO: 58450 - DNA, 20 bp, Artificial
  CRISPR gRNA sequence
accaagagactaggaagagc

SEQ ID NO: 58451 - DNA, 20 bp, Artificial
  CRISPR gRNA sequence
actaggaagagctggggtat

SEQ ID NO: 58452 - DNA, 20 bp, Artificial
  CRISPR gRNA sequence
ttcctgctactgctgcactg

SEQ ID NO: 58453 - DNA, 20 bp, Artificial
  CRISPR gRNA sequence
tgctactgctgcactgagga

SEQ ID NO: 58454 - DNA, 20 bp, Artificial
  CRISPR gRNA sequence
aattactgcttaggttggca

SEQ ID NO: 58455 - DNA, 20 bp, Artificial
  CRISPR gRNA sequence
caattatggtacctacatct

SEQ ID NO: 58456 - DNA, 20 bp, Artificial
  CRISPR gRNA sequence
ctacatcttagggttgttct

SEQ ID NO: 58457 - DNA, 20 bp, Artificial
  CRISPR gRNA sequence
agggttgttctgagaattaa

SEQ ID NO: 58458 - DNA, 20 bp, Artificial
  CRISPR gRNA sequence
taaatgagttactacactta

SEQ ID NO: 58459 - DNA, 20 bp, Artificial
  CRISPR gRNA sequence
gctggctattccagctgtgc

SEQ ID NO: 58460 - DNA, 20 bp, Artificial
  CRISPR gRNA sequence
ggattccagcttggccagtc

SEQ ID NO: 58461 - DNA, 20 bp, Artificial
  CRISPR gRNA sequence
gagcaatctctttcccttct

SEQ ID NO: 58462 - DNA, 20 bp, Artificial
  CRISPR gRNA sequence
gtagtgtaggaccaatgttg

SEQ ID NO: 58463 - DNA, 20 bp, Artificial
  CRISPR gRNA sequence
cactttggaacgccaagcac

SEQ ID NO: 58464 - DNA, 20 bp, Artificial
  CRISPR gRNA sequence
actcaagatgctgacgttgg

SEQ ID NO: 58465 - DNA, 20 bp, Artificial
  CRISPR gRNA sequence
tcacaccactgtactccagc

SEQ ID NO: 58466 - DNA, 20 bp, Artificial
  CRISPR gRNA sequence
cttaaagctgtgatgctcag

SEQ ID NO: 58467 - DNA, 20 bp, Artificial
  CRISPR gRNA sequence
actttgagaggctgaggggg

SEQ ID NO: 58468 - DNA, 20 bp, Artificial
  CRISPR gRNA sequence
gggcaggatcgcttgaagct

SEQ ID NO: 58469 - DNA, 20 bp, Artificial
  CRISPR gRNA sequence
tactcaggaagccaaggtgg

SEQ ID NO: 58470 - DNA, 20 bp, Artificial
  CRISPR gRNA sequence
tgggaggatcacttgagccc

SEQ ID NO: 58471 - DNA, 20 bp, Artificial
  CRISPR gRNA sequence
agtttgaggctgcagtgaac

SEQ ID NO: 58472 - DNA, 20 bp, Artificial
  CRISPR gRNA sequence
actgcactccagcttgggga

SEQ ID NO: 58473 - DNA, 20 bp, Artificial
  CRISPR gRNA sequence
gctccctcagcccagtggga

SEQ ID NO: 58474 - DNA, 20 bp, Artificial
  CRISPR gRNA sequence
ccttcgattttacacctatg

SEQ ID NO: 58475 - DNA, 20 bp, Artificial
  CRISPR gRNA sequence
atacatggcagagccaaaat

SEQ ID NO: 58476 - DNA, 20 bp, Artificial
  CRISPR gRNA sequence
ctgttgcccctcctgctctg

SEQ ID NO: 58477 - DNA, 20 bp, Artificial
  CRISPR gRNA sequence
tcctttgttaccgactcact

SEQ ID NO: 58478 - DNA, 20 bp, Artificial
  CRISPR gRNA sequence
actcactttgggttgtgctt

SEQ ID NO: 58479 - DNA, 20 bp, Artificial
  CRISPR gRNA sequence
ttgacgctcaggtaccttgg

SEQ ID NO: 58480 - DNA, 20 bp, Artificial
  CRISPR gRNA sequence
gggatctattgccttaggag

SEQ ID NO: 58481 - DNA, 20 bp, Artificial
  CRISPR gRNA sequence
caagggagagcaggggcagg

SEQ ID NO: 58482 - DNA, 20 bp, Artificial
  CRISPR gRNA sequence
aagcagatgagggacaggga

SEQ ID NO: 58483 - DNA, 20 bp, Artificial
  CRISPR gRNA sequence
agggacagggaaaggattag

SEQ ID NO: 58484 - DNA, 20 bp, Artificial
  CRISPR gRNA sequence
agccgggtgtggtgcccatc

SEQ ID NO: 58485 - DNA, 20 bp, Artificial
  CRISPR gRNA sequence
cctggatagcccatcctggc

SEQ ID NO: 58486 - DNA, 20 bp, Artificial
  CRISPR gRNA sequence
ttacctcactgtaattcctt

SEQ ID NO: 58487 - DNA, 20 bp, Artificial
  CRISPR gRNA sequence
ccctttgagggaggaggaaa

SEQ ID NO: 58488 - DNA, 20 bp, Artificial
  CRISPR gRNA sequence
cagctactaagaggtgtggc

SEQ ID NO: 58489 - DNA, 20 bp, Artificial
  CRISPR gRNA sequence
attggaagctggaggggcca

SEQ ID NO: 58490 - DNA, 20 bp, Artificial
  CRISPR gRNA sequence
aggccctcacctggaggaag

SEQ ID NO: 58491 - DNA, 20 bp, Artificial
  CRISPR gRNA sequence
cctcacctggaggaagtgga

SEQ ID NO: 58492 - DNA, 20 bp, Artificial
  CRISPR gRNA sequence
agccaggaaaggaggttgga

SEQ ID NO: 58493 - DNA, 20 bp, Artificial
  CRISPR gRNA sequence
gggtgggcagggcctcgcct

SEQ ID NO: 58494 - DNA, 20 bp, Artificial
  CRISPR gRNA sequence
gggcagggcctcgcctttgg

SEQ ID NO: 58495 - DNA, 20 bp, Artificial
  CRISPR gRNA sequence
gaggggcatgctgcctcatg

SEQ ID NO: 58496 - DNA, 20 bp, Artificial
  CRISPR gRNA sequence
ctgcctcatgaagaatttgg

SEQ ID NO: 58497 - DNA, 20 bp, Artificial
  CRISPR gRNA sequence
gctactattcagcacttgtc

SEQ ID NO: 58498 - DNA, 20 bp, Artificial
  CRISPR gRNA sequence
ctcaaggccacacaggtagg

SEQ ID NO: 58499 - DNA, 20 bp, Artificial
  CRISPR gRNA sequence
caggtaggaagagtctaggc

SEQ ID NO: 58500 - DNA, 20 bp, Artificial
  CRISPR gRNA sequence
aagtagaaaccccaccacac

SEQ ID NO: 58501 - DNA, 20 bp, Artificial
  CRISPR gRNA sequence
cacccccttcatccttctcc

SEQ ID NO: 58502 - DNA, 20 bp, Artificial
  CRISPR gRNA sequence
ccttcatccttctcccagag

SEQ ID NO: 58503 - DNA, 20 bp, Artificial
  CRISPR gRNA sequence
atccttctcccagagtagag

SEQ ID NO: 58504 - DNA, 20 bp, Artificial
  CRISPR gRNA sequence
gtgggataaccttctctttt

SEQ ID NO: 58505 - DNA, 20 bp, Artificial
  CRISPR gRNA sequence
agcccctggctgaagccaat

SEQ ID NO: 58506 - DNA, 20 bp, Artificial
  CRISPR gRNA sequence
agccaataagagtagtgctt

SEQ ID NO: 58507 - DNA, 20 bp, Artificial
  CRISPR gRNA sequence
gaaggcagatgatggaacgc

SEQ ID NO: 58508 - DNA, 20 bp, Artificial
  CRISPR gRNA sequence
atggaacgccaggatgtgtt

SEQ ID NO: 58509 - DNA, 20 bp, Artificial
  CRISPR gRNA sequence
acgccaggatgtgttctggg

SEQ ID NO: 58510 - DNA, 20 bp, Artificial
  CRISPR gRNA sequence
tgggtcgagtggccccacct

SEQ ID NO: 58511 - DNA, 20 bp, Artificial
  CRISPR gRNA sequence
tggccccacctcagggtaag

SEQ ID NO: 58512 - DNA, 20 bp, Artificial
  CRISPR gRNA sequence
cacctcagggtaagacggat

SEQ ID NO: 58513 - DNA, 20 bp, Artificial
  CRISPR gRNA sequence
agggtaagacggataggggt

SEQ ID NO: 58514 - DNA, 20 bp, Artificial
  CRISPR gRNA sequence
tcccattgggagaaccagga

SEQ ID NO: 58515 - DNA, 20 bp, Artificial
  CRISPR gRNA sequence
agcactgagcatgcccctcc

SEQ ID NO: 58516 - DNA, 20 bp, Artificial
  CRISPR gRNA sequence
aacccaccctcatctcttac

SEQ ID NO: 58517 - DNA, 20 bp, Artificial
  CRISPR gRNA sequence
ctggccacttccacctggca

SEQ ID NO: 58518 - DNA, 20 bp, Artificial
  CRISPR gRNA sequence
cttcactccttcccactgct

SEQ ID NO: 58519 - DNA, 20 bp, Artificial
  CRISPR gRNA sequence
tgtgttatgccacagggcct

SEQ ID NO: 58520 - DNA, 20 bp, Artificial
  CRISPR gRNA sequence
tgtaacttgcagcataaagg

SEQ ID NO: 58521 - DNA, 20 bp, Artificial
  CRISPR gRNA sequence
tgcagcataaaggaagagtt

SEQ ID NO: 58522 - DNA, 20 bp, Artificial
  CRISPR gRNA sequence
gggccttgaaggcaggctgc

SEQ ID NO: 58523 - DNA, 20 bp, Artificial
  CRISPR gRNA sequence
tgcacttaaccactctgcac

SEQ ID NO: 58524 - DNA, 20 bp, Artificial
  CRISPR gRNA sequence
agtttactcatcagtaaggt

SEQ ID NO: 58525 - DNA, 20 bp, Artificial
  CRISPR gRNA sequence
gcccacgtcatcggcactat

SEQ ID NO: 58526 - DNA, 20 bp, Artificial
  CRISPR gRNA sequence
ccaatagtcatagaagaacc

SEQ ID NO: 58527 - DNA, 20 bp, Artificial
  CRISPR gRNA sequence
atgttgccaggcatgtggta

SEQ ID NO: 58528 - DNA, 20 bp, Artificial
  CRISPR gRNA sequence
tattatcaaggttcattcct

SEQ ID NO: 58529 - DNA, 20 bp, Artificial
  CRISPR gRNA sequence
ttgactaaagttagcaaagg

SEQ ID NO: 58530 - DNA, 20 bp, Artificial
  CRISPR gRNA sequence
gcaaaggaggagtaagtgat

SEQ ID NO: 58531 - DNA, 20 bp, Artificial
  CRISPR gRNA sequence
gctgcacatcgccaggaagc

SEQ ID NO: 58532 - DNA, 20 bp, Artificial
  CRISPR gRNA sequence
cacatcgccaggaagctgga

SEQ ID NO: 58533 - DNA, 20 bp, Artificial
  CRISPR gRNA sequence
gtgagttgtccaccccaccg

SEQ ID NO: 58534 - DNA, 20 bp, Artificial
  CRISPR gRNA sequence
ccgtgttcgtaatcagcagt

SEQ ID NO: 58535 - DNA, 20 bp, Artificial
  CRISPR gRNA sequence
gtagctgccctggagcacgg

SEQ ID NO: 58536 - DNA, 20 bp, Artificial
  CRISPR gRNA sequence
tgccctggagcacggtgggg

SEQ ID NO: 58537 - DNA, 20 bp, Artificial
  CRISPR gRNA sequence
gtgttgcactggggaggtgt

SEQ ID NO: 58538 - DNA, 20 bp, Artificial
  CRISPR gRNA sequence
tgcactggggaggtgtcagg

SEQ ID NO: 58539 - DNA, 20 bp, Artificial
  CRISPR gRNA sequence
tggggaggtgtcagggtggg

SEQ ID NO: 58540 - DNA, 20 bp, Artificial
  CRISPR gRNA sequence
gcactgtggaggtgtcatgc

SEQ ID NO: 58541 - DNA, 20 bp, Artificial
  CRISPR gRNA sequence
gaggtgtcatgctggggtgc

SEQ ID NO: 58542 - DNA, 20 bp, Artificial
  CRISPR gRNA sequence
catgctggggtgctagggta

SEQ ID NO: 58543 - DNA, 20 bp, Artificial
  CRISPR gRNA sequence
agggagtggtgtgttcctgt

SEQ ID NO: 58544 - DNA, 20 bp, Artificial
  CRISPR gRNA sequence
ttcctgtggggatacactgt

SEQ ID NO: 58545 - DNA, 20 bp, Artificial
  CRISPR gRNA sequence
ggggatacactgttggggtg

SEQ ID NO: 58546 - DNA, 20 bp, Artificial
  CRISPR gRNA sequence
aaaggtaggctattaggctg

SEQ ID NO: 58547 - DNA, 20 bp, Artificial
  CRISPR gRNA sequence
gggtgtgctgtggtgttgca

SEQ ID NO: 58548 - DNA, 20 bp, Artificial
  CRISPR gRNA sequence
gctgtggtgttgcatggggt

SEQ ID NO: 58549 - DNA, 20 bp, Artificial
  CRISPR gRNA sequence
gcatggggtgagggtgatgt

SEQ ID NO: 58550 - DNA, 20 bp, Artificial
  CRISPR gRNA sequence
ggtgagggtgatgtttgggt

SEQ ID NO: 58551 - DNA, 20 bp, Artificial
  CRISPR gRNA sequence
tgtttgggtgggggtgtctt

SEQ ID NO: 58552 - DNA, 20 bp, Artificial
  CRISPR gRNA sequence
tgggggtgtcttgggggtct

SEQ ID NO: 58553 - DNA, 20 bp, Artificial
  CRISPR gRNA sequence
tgggggtcttaggatcaagt

SEQ ID NO: 58554 - DNA, 20 bp, Artificial
  CRISPR gRNA sequence
gtcttaggatcaagtgtggg

SEQ ID NO: 58555 - DNA, 20 bp, Artificial
  CRISPR gRNA sequence
tcaagtgtgggtcgggtttg

SEQ ID NO: 58556 - DNA, 20 bp, Artificial
  CRISPR gRNA sequence
gggtttggggagtgttgaga

SEQ ID NO: 58557 - DNA, 20 bp, Artificial
  CRISPR gRNA sequence
agtggtttggggcctcagct

SEQ ID NO: 58558 - DNA, 20 bp, Artificial
  CRISPR gRNA sequence
ttgtgaacctgggaaagtaa

SEQ ID NO: 58559 - DNA, 20 bp, Artificial
  CRISPR gRNA sequence
tcggtttcccctctgtaaaa

SEQ ID NO: 58560 - DNA, 20 bp, Artificial
  CRISPR gRNA sequence
tatgtacaaagccttttgta

SEQ ID NO: 58561 - DNA, 20 bp, Artificial
  CRISPR gRNA sequence
attttacagatgagaaaact

SEQ ID NO: 58562 - DNA, 20 bp, Artificial
  CRISPR gRNA sequence
gggtcagagaggtgaaaaca

SEQ ID NO: 58563 - DNA, 20 bp, Artificial
  CRISPR gRNA sequence
ggacaactttattttccaaa

SEQ ID NO: 58564 - DNA, 20 bp, Artificial
  CRISPR gRNA sequence
ctttattttccaaatgggat

SEQ ID NO: 58565 - DNA, 20 bp, Artificial
  CRISPR gRNA sequence
tttggcttactcacacgcac

SEQ ID NO: 58566 - DNA, 20 bp, Artificial
  CRISPR gRNA sequence
gcaagggacctaggacatcc

SEQ ID NO: 58567 - DNA, 20 bp, Artificial
  CRISPR gRNA sequence
ggggctagagctggctgggg

SEQ ID NO: 58568 - DNA, 20 bp, Artificial
  CRISPR gRNA sequence
aacaacgggctttctgtggc

SEQ ID NO: 58569 - DNA, 20 bp, Artificial
  CRISPR gRNA sequence
tgcattgtgtgctgagggcc

SEQ ID NO: 58570 - DNA, 20 bp, Artificial
  CRISPR gRNA sequence
catgctctctctgaagccct

SEQ ID NO: 58571 - DNA, 20 bp, Artificial
  CRISPR gRNA sequence
cacccctcttcctagctgct

SEQ ID NO: 58572 - DNA, 20 bp, Artificial
  CRISPR gRNA sequence
taagaaccagagacgcctgg

SEQ ID NO: 58573 - DNA, 20 bp, Artificial
  CRISPR gRNA sequence
acccccactttcccctaacc

SEQ ID NO: 58574 - DNA, 20 bp, Artificial
  CRISPR gRNA sequence
tatttctgtaagtctcgccg

SEQ ID NO: 58575 - DNA, 20 bp, Artificial
  CRISPR gRNA sequence
aagcctcattctcaacccag

SEQ ID NO: 58576 - DNA, 20 bp, Artificial
  CRISPR gRNA sequence
ctgtatatgatgattcaata

SEQ ID NO: 58577 - DNA, 20 bp, Artificial
  CRISPR gRNA sequence
gtgcaaacacatttagctgt

SEQ ID NO: 58578 - DNA, 20 bp, Artificial
  CRISPR gRNA sequence
ggaaaaaaaaagaaaatagc

SEQ ID NO: 58579 - DNA, 20 bp, Artificial
  CRISPR gRNA sequence
atagctggaatgtttaaccg

SEQ ID NO: 58580 - DNA, 20 bp, Artificial
  CRISPR gRNA sequence
taggtgcagtttcaatatgg

SEQ ID NO: 58581 - DNA, 20 bp, Artificial
  CRISPR gRNA sequence
ttcaatatggaggggtgacg

SEQ ID NO: 58582 - DNA, 20 bp, Artificial
  CRISPR gRNA sequence
taaagaaatttctttagaga

SEQ ID NO: 58583 - DNA, 20 bp, Artificial
  CRISPR gRNA sequence
tcttgctctgttaccaaggc

SEQ ID NO: 58584 - DNA, 20 bp, Artificial
  CRISPR gRNA sequence
ctcttagtctcccaaagtgc

SEQ ID NO: 58585 - DNA, 20 bp, Artificial
  CRISPR gRNA sequence
aaagtgctgggattacagtc

SEQ ID NO: 58586 - DNA, 20 bp, Artificial
  CRISPR gRNA sequence
ttttttatttttagtagaga

SEQ ID NO: 58587 - DNA, 20 bp, Artificial
  CRISPR gRNA sequence
gccctggcctcccaaagagc

SEQ ID NO: 58588 - DNA, 20 bp, Artificial
  CRISPR gRNA sequence
tcaagatatgcaatggcaga

SEQ ID NO: 58589 - DNA, 20 bp, Artificial
  CRISPR gRNA sequence
actttgggaggctgaggcag

SEQ ID NO: 58590 - DNA, 20 bp, Artificial
  CRISPR gRNA sequence
cagggggatcacctgaggtc

SEQ ID NO: 58591 - DNA, 20 bp, Artificial
  CRISPR gRNA sequence
ttcaagaccagcctggccaa

SEQ ID NO: 58592 - DNA, 20 bp, Artificial
  CRISPR gRNA sequence
tactcaggaggctgaggcag

SEQ ID NO: 58593 - DNA, 20 bp, Artificial
  CRISPR gRNA sequence
aaaaaactaatgtttaaaaa

SEQ ID NO: 58594 - DNA, 20 bp, Artificial
  CRISPR gRNA sequence
gactcactccaaaggttacc

SEQ ID NO: 58595 - DNA, 20 bp, Artificial
  CRISPR gRNA sequence
gaacactgactagcagagag

SEQ ID NO: 58596 - DNA, 20 bp, Artificial
  CRISPR gRNA sequence
tggggctaaaagagagaaca

SEQ ID NO: 58597 - DNA, 20 bp, Artificial
  CRISPR gRNA sequence
aagctcagaggaagtcagag

SEQ ID NO: 58598 - DNA, 20 bp, Artificial
  CRISPR gRNA sequence
gtggctgcagctggaggcag

SEQ ID NO: 58599 - DNA, 20 bp, Artificial
  CRISPR gRNA sequence
ttgagaggtcctcccgggcc

SEQ ID NO: 58600 - DNA, 20 bp, Artificial
  CRISPR gRNA sequence
actttgggaagcaaaggtgg

SEQ ID NO: 58601 - DNA, 20 bp, Artificial
  CRISPR gRNA sequence
tgagcccagaagttcgagac

SEQ ID NO: 58602 - DNA, 20 bp, Artificial
  CRISPR gRNA sequence
tactcaggaggctgaagtgg

SEQ ID NO: 58603 - DNA, 20 bp, Artificial
  CRISPR gRNA sequence
agtgccagtcagtcaactgc

SEQ ID NO: 58604 - DNA, 20 bp, Artificial
  CRISPR gRNA sequence
ggaagtgagcaggcttggca

SEQ ID NO: 58605 - DNA, 20 bp, Artificial
  CRISPR gRNA sequence
aggatgcagccccaaagggg

SEQ ID NO: 58606 - DNA, 20 bp, Artificial
  CRISPR gRNA sequence
ctgaaaggagccccagtgtg

SEQ ID NO: 58607 - DNA, 20 bp, Artificial
  CRISPR gRNA sequence
tatagacagcaggccagggc

SEQ ID NO: 58608 - DNA, 20 bp, Artificial
  CRISPR gRNA sequence
acagcaggccagggcaggag

SEQ ID NO: 58609 - DNA, 20 bp, Artificial
  CRISPR gRNA sequence
caggagttgggtagccagag

SEQ ID NO: 58610 - DNA, 20 bp, Artificial
  CRISPR gRNA sequence
agccctccagcttaaaccca

SEQ ID NO: 58611 - DNA, 20 bp, Artificial
  CRISPR gRNA sequence
cctttcacacaaggacccat

SEQ ID NO: 58612 - DNA, 20 bp, Artificial
  CRISPR gRNA sequence
cacaaggacccattagggtc

SEQ ID NO: 58613 - DNA, 20 bp, Artificial
  CRISPR gRNA sequence
ggattgccccagcctagcgc

SEQ ID NO: 58614 - DNA, 20 bp, Artificial
  CRISPR gRNA sequence
cccacccacaatctcttctg

SEQ ID NO: 58615 - DNA, 20 bp, Artificial
  CRISPR gRNA sequence
tctgaagcacagatgaggag

SEQ ID NO: 58616 - DNA, 20 bp, Artificial
  CRISPR gRNA sequence
ataatagcagtcaaggtcaa

SEQ ID NO: 58617 - DNA, 20 bp, Artificial
  CRISPR gRNA sequence
ttgagaggctgtgatttgtc

SEQ ID NO: 58618 - DNA, 20 bp, Artificial
  CRISPR gRNA sequence
ggtctgattgactctaggtg

SEQ ID NO: 58619 - DNA, 20 bp, Artificial
  CRISPR gRNA sequence
cgatggtggaaggccaggct

SEQ ID NO: 58620 - DNA, 20 bp, Artificial
  CRISPR gRNA sequence
ggtggaaggccaggctgagg

SEQ ID NO: 58621 - DNA, 20 bp, Artificial
  CRISPR gRNA sequence
gagctgcctctgagctcccg

SEQ ID NO: 58622 - DNA, 20 bp, Artificial
  CRISPR gRNA sequence
acacctgacctgctgtgtcc

SEQ ID NO: 58623 - DNA, 20 bp, Artificial
  CRISPR gRNA sequence
tccctgacccccagcagctg

SEQ ID NO: 58624 - DNA, 20 bp, Artificial
  CRISPR gRNA sequence
ctgcctatatgtgacatcct

SEQ ID NO: 58625 - DNA, 20 bp, Artificial
  CRISPR gRNA sequence
attctctgcctctgtgtctg

SEQ ID NO: 58626 - DNA, 20 bp, Artificial
  CRISPR gRNA sequence
ccacctcggtcacctccacc

SEQ ID NO: 58627 - DNA, 20 bp, Artificial
  CRISPR gRNA sequence
ctcggtcacctccacctcga

SEQ ID NO: 58628 - DNA, 20 bp, Artificial
  CRISPR gRNA sequence
agtggtttgtgtgttggaag

SEQ ID NO: 58629 - DNA, 20 bp, Artificial
  CRISPR gRNA sequence
gtttgtgtgttggaaggtgg

SEQ ID NO: 58630 - DNA, 20 bp, Artificial
  CRISPR gRNA sequence
ggtgggtggggccaattaca

SEQ ID NO: 58631 - DNA, 20 bp, Artificial
  CRISPR gRNA sequence
cagtgagttagtgttggtgt

SEQ ID NO: 58632 - DNA, 20 bp, Artificial
  CRISPR gRNA sequence
ctgaagtcagaaaccccttg

SEQ ID NO: 58633 - DNA, 20 bp, Artificial
  CRISPR gRNA sequence
cctcagaggtccacgaacct

SEQ ID NO: 58634 - DNA, 20 bp, Artificial
  CRISPR gRNA sequence
ctgtgtccagtttcaggaag

SEQ ID NO: 58635 - DNA, 20 bp, Artificial
  CRISPR gRNA sequence
gtttcaggaagttgagtaac

SEQ ID NO: 58636 - DNA, 20 bp, Artificial
  CRISPR gRNA sequence
gcttctcaggcaatgctctg

SEQ ID NO: 58637 - DNA, 20 bp, Artificial
  CRISPR gRNA sequence
ggagctctgcagtccttgaa

SEQ ID NO: 58638 - DNA, 20 bp, Artificial
  CRISPR gRNA sequence
tgtcccatccccctctttcc

SEQ ID NO: 58639 - DNA, 20 bp, Artificial
  CRISPR gRNA sequence
taatagatgattcttactca

SEQ ID NO: 58640 - DNA, 20 bp, Artificial
  CRISPR gRNA sequence
ccaccctggggagggcaggt

SEQ ID NO: 58641 - DNA, 20 bp, Artificial
  CRISPR gRNA sequence
ggcagttgttattctggccc

SEQ ID NO: 58642 - DNA, 20 bp, Artificial
  CRISPR gRNA sequence
gaggggctggggctgttagc

SEQ ID NO: 58643 - DNA, 20 bp, Artificial
  CRISPR gRNA sequence
gctgttagctggggtatggt

SEQ ID NO: 58644 - DNA, 20 bp, Artificial
  CRISPR gRNA sequence
gtatggtcagggtagacagg

SEQ ID NO: 58645 - DNA, 20 bp, Artificial
  CRISPR gRNA sequence
taccagagaggacactcaag

SEQ ID NO: 58646 - DNA, 20 bp, Artificial
  CRISPR gRNA sequence
gcagggtgcccagggctgcc

SEQ ID NO: 58647 - DNA, 20 bp, Artificial
  CRISPR gRNA sequence
cccagggctgccaaggatcc

SEQ ID NO: 58648 - DNA, 20 bp, Artificial
  CRISPR gRNA sequence
ggatccctgagtacctggca

SEQ ID NO: 58649 - DNA, 20 bp, Artificial
  CRISPR gRNA sequence
cctggcagagagtgtgtagg

SEQ ID NO: 58650 - DNA, 20 bp, Artificial
  CRISPR gRNA sequence
aaagtttgcctgcaatggac

SEQ ID NO: 58651 - DNA, 20 bp, Artificial
  CRISPR gRNA sequence
gggcaagttacatcccctct

SEQ ID NO: 58652 - DNA, 20 bp, Artificial
  CRISPR gRNA sequence
tggtggctacgatctctgaa

SEQ ID NO: 58653 - DNA, 20 bp, Artificial
  CRISPR gRNA sequence
tgtgcaatgctgggaaggaa

SEQ ID NO: 58654 - DNA, 20 bp, Artificial
  CRISPR gRNA sequence
gactcgtgacctggtgctgt

SEQ ID NO: 58655 - DNA, 20 bp, Artificial
  CRISPR gRNA sequence
taccagtgtccccgtgggag

SEQ ID NO: 58656 - DNA, 20 bp, Artificial
  CRISPR gRNA sequence
ccctgcattttcattttgtc

SEQ ID NO: 58657 - DNA, 20 bp, Artificial
  CRISPR gRNA sequence
atcacagaccgagggaccca

SEQ ID NO: 58658 - DNA, 20 bp, Artificial
  CRISPR gRNA sequence
ctccaccatgaggacttgca

SEQ ID NO: 58659 - DNA, 20 bp, Artificial
  CRISPR gRNA sequence
aggggtgctctctgaccatc

SEQ ID NO: 58660 - DNA, 20 bp, Artificial
  CRISPR gRNA sequence
ctctgaccatcttgggttca

SEQ ID NO: 58661 - DNA, 20 bp, Artificial
  CRISPR gRNA sequence
gggttccgtcatctggaacc

SEQ ID NO: 58662 - DNA, 20 bp, Artificial
  CRISPR gRNA sequence
ccctgtgccctgaccacaaa

SEQ ID NO: 58663 - DNA, 20 bp, Artificial
  CRISPR gRNA sequence
tgaccacaaagaggatgtgt

SEQ ID NO: 58664 - DNA, 20 bp, Artificial
  CRISPR gRNA sequence
aaagaggatgtgtttgggtc

SEQ ID NO: 58665 - DNA, 20 bp, Artificial
  CRISPR gRNA sequence
tcagtgagaacggtttgtcc

SEQ ID NO: 58666 - DNA, 20 bp, Artificial
  CRISPR gRNA sequence
gtttgtccctggatgccgtg

SEQ ID NO: 58667 - DNA, 20 bp, Artificial
  CRISPR gRNA sequence
gagcatgtgatgggcgtcca

SEQ ID NO: 58668 - DNA, 20 bp, Artificial
  CRISPR gRNA sequence
atgtgatgggcgtccactga

SEQ ID NO: 58669 - DNA, 20 bp, Artificial
  CRISPR gRNA sequence
gatgggcgtccactgaatga

SEQ ID NO: 58670 - DNA, 20 bp, Artificial
  CRISPR gRNA sequence
ctgaatgaatgaatgatcaa

SEQ ID NO: 58671 - DNA, 20 bp, Artificial
  CRISPR gRNA sequence
atgaatgaatgatcaaatga

SEQ ID NO: 58672 - DNA, 20 bp, Artificial
  CRISPR gRNA sequence
gaatgaataagtatggcctc

SEQ ID NO: 58673 - DNA, 20 bp, Artificial
  CRISPR gRNA sequence
tttctccaaattcaccatta

SEQ ID NO: 58674 - DNA, 20 bp, Artificial
  CRISPR gRNA sequence
gactctgcctcactcgttct

SEQ ID NO: 58675 - DNA, 20 bp, Artificial
  CRISPR gRNA sequence
tccttagagatttttttttt

SEQ ID NO: 58676 - DNA, 20 bp, Artificial
  CRISPR gRNA sequence
aattattatactttaagttc

SEQ ID NO: 58677 - DNA, 20 bp, Artificial
  CRISPR gRNA sequence
attttgggaggccaaggtgg

SEQ ID NO: 58678 - DNA, 20 bp, Artificial
  CRISPR gRNA sequence
tgggcggatcacgtgaggtc

SEQ ID NO: 58679 - DNA, 20 bp, Artificial
  CRISPR gRNA sequence
tttgagaacagcctggccaa

SEQ ID NO: 58680 - DNA, 20 bp, Artificial
  CRISPR gRNA sequence
ccttgtagtgccagccgctc

SEQ ID NO: 58681 - DNA, 20 bp, Artificial
  CRISPR gRNA sequence
gccagccgctcaggagtcag

SEQ ID NO: 58682 - DNA, 20 bp, Artificial
  CRISPR gRNA sequence
ctgcactccagcctgggcga

SEQ ID NO: 58683 - DNA, 20 bp, Artificial
  CRISPR gRNA sequence
tcttaattgtgggagctgat

SEQ ID NO: 58684 - DNA, 20 bp, Artificial
  CRISPR gRNA sequence
tcccttccctaaggaccccc

SEQ ID NO: 58685 - DNA, 20 bp, Artificial
  CRISPR gRNA sequence
ctcatctgtaaaatggagat

SEQ ID NO: 58686 - DNA, 20 bp, Artificial
  CRISPR gRNA sequence
ggaggccaagacaggaggag

SEQ ID NO: 58687 - DNA, 20 bp, Artificial
  CRISPR gRNA sequence
gaggaggatcacctgagcct

SEQ ID NO: 58688 - DNA, 20 bp, Artificial
  CRISPR gRNA sequence
tacttgggaggctgaggtgg

SEQ ID NO: 58689 - DNA, 20 bp, Artificial
  CRISPR gRNA sequence
ctcaggagatcgaggctaca

SEQ ID NO: 58690 - DNA, 20 bp, Artificial
  CRISPR gRNA sequence
actttgggaggctaaggcag

SEQ ID NO: 58691 - DNA, 20 bp, Artificial
  CRISPR gRNA sequence
caggaggatcgtttgagcca

SEQ ID NO: 58692 - DNA, 20 bp, Artificial
  CRISPR gRNA sequence
tacttgggaggctgaggcag

SEQ ID NO: 58693 - DNA, 20 bp, Artificial
  CRISPR gRNA sequence
tcttcgaaacaacaacaaag

SEQ ID NO: 58694 - DNA, 20 bp, Artificial
  CRISPR gRNA sequence
cttacctcattgtttattgt

SEQ ID NO: 58695 - DNA, 20 bp, Artificial
  CRISPR gRNA sequence
ccctccttgccctgaccagt

SEQ ID NO: 58696 - DNA, 20 bp, Artificial
  CRISPR gRNA sequence
gcaggtgaggagggaacgct

SEQ ID NO: 58697 - DNA, 20 bp, Artificial
  CRISPR gRNA sequence
ggagggaacgctcggggtgg

SEQ ID NO: 58698 - DNA, 20 bp, Artificial
  CRISPR gRNA sequence
aatgcagatgggaggaaggg

SEQ ID NO: 58699 - DNA, 20 bp, Artificial
  CRISPR gRNA sequence
atttgtgcttctgcgtttcg

SEQ ID NO: 58700 - DNA, 20 bp, Artificial
  CRISPR gRNA sequence
acgctctgaaggcaggggcc

SEQ ID NO: 58701 - DNA, 20 bp, Artificial
  CRISPR gRNA sequence
ttgggagcagtggcagcgga

SEQ ID NO: 58702 - DNA, 20 bp, Artificial
  CRISPR gRNA sequence
gtgggcccatgtgcagctgg

SEQ ID NO: 58703 - DNA, 20 bp, Artificial
  CRISPR gRNA sequence
tgtgcagctggctgggtgga

SEQ ID NO: 58704 - DNA, 20 bp, Artificial
  CRISPR gRNA sequence
tgccgtacagatgggctgtc

SEQ ID NO: 58705 - DNA, 20 bp, Artificial
  CRISPR gRNA sequence
cagatgggctgtcaggagtc

SEQ ID NO: 58706 - DNA, 20 bp, Artificial
  CRISPR gRNA sequence
gagtcaggggtggctcaagc

SEQ ID NO: 58707 - DNA, 20 bp, Artificial
  CRISPR gRNA sequence
gcctgggtggtcttgcttcc

SEQ ID NO: 58708 - DNA, 20 bp, Artificial
  CRISPR gRNA sequence
ggtggtcttgcttcccagga

SEQ ID NO: 58709 - DNA, 20 bp, Artificial
  CRISPR gRNA sequence
tctctgtttctggggaaccc

SEQ ID NO: 58710 - DNA, 20 bp, Artificial
  CRISPR gRNA sequence
gtggtcagagaggctctgtc

SEQ ID NO: 58711 - DNA, 20 bp, Artificial
  CRISPR gRNA sequence
tgaacaatgagggactgagc

SEQ ID NO: 58712 - DNA, 20 bp, Artificial
  CRISPR gRNA sequence
agccctgactttccaagtct

SEQ ID NO: 58713 - DNA, 20 bp, Artificial
  CRISPR gRNA sequence
tccaagtctgggagtccaat

SEQ ID NO: 58714 - DNA, 20 bp, Artificial
  CRISPR gRNA sequence
ttctaaacgatccccctcct

SEQ ID NO: 58715 - DNA, 20 bp, Artificial
  CRISPR gRNA sequence
aggggtatatgggctgggct

SEQ ID NO: 58716 - DNA, 20 bp, Artificial
  CRISPR gRNA sequence
gggctgggctgggagtccga

SEQ ID NO: 58717 - DNA, 20 bp, Artificial
  CRISPR gRNA sequence
ttctaaatgatccccctcct

SEQ ID NO: 58718 - DNA, 20 bp, Artificial
  CRISPR gRNA sequence
tcctagggatatgtgggcca

SEQ ID NO: 58719 - DNA, 20 bp, Artificial
  CRISPR gRNA sequence
cccagctgcagccaagttct

SEQ ID NO: 58720 - DNA, 20 bp, Artificial
  CRISPR gRNA sequence
tgtcccagcccttcttgttt

SEQ ID NO: 58721 - DNA, 20 bp, Artificial
  CRISPR gRNA sequence
tgtttgggggtaaccataat

SEQ ID NO: 58722 - DNA, 20 bp, Artificial
  CRISPR gRNA sequence
gctggcagggggctagggct

SEQ ID NO: 58723 - DNA, 20 bp, Artificial
  CRISPR gRNA sequence
agggggctagggctggggat

SEQ ID NO: 58724 - DNA, 20 bp, Artificial
  CRISPR gRNA sequence
attgggatagagggaagaga

SEQ ID NO: 58725 - DNA, 20 bp, Artificial
  CRISPR gRNA sequence
gaaaaggaaaagaaagaggc

SEQ ID NO: 58726 - DNA, 20 bp, Artificial
  CRISPR gRNA sequence
aagaaagaggcgtgggtgtg

SEQ ID NO: 58727 - DNA, 20 bp, Artificial
  CRISPR gRNA sequence
gcgtgggtgtgaggggtgct

SEQ ID NO: 58728 - DNA, 20 bp, Artificial
  CRISPR gRNA sequence
cagctcagccactccctgcc

SEQ ID NO: 58729 - DNA, 20 bp, Artificial
  CRISPR gRNA sequence
cacccactttccagaaagaa

SEQ ID NO: 58730 - DNA, 20 bp, Artificial
  CRISPR gRNA sequence
ccagggcaatggggagccac

SEQ ID NO: 58731 - DNA, 20 bp, Artificial
  CRISPR gRNA sequence
gagacacttgtggggcagag

SEQ ID NO: 58732 - DNA, 20 bp, Artificial
  CRISPR gRNA sequence
gagagggattaaagggaggc

SEQ ID NO: 58733 - DNA, 20 bp, Artificial
  CRISPR gRNA sequence
gaggcaagagtggaagccca

SEQ ID NO: 58734 - DNA, 20 bp, Artificial
  CRISPR gRNA sequence
gagggtgttaaatggtcaag

SEQ ID NO: 58735 - DNA, 20 bp, Artificial
  CRISPR gRNA sequence
gttaaatggtcaaggtgagt

SEQ ID NO: 58736 - DNA, 20 bp, Artificial
  CRISPR gRNA sequence
ggggcggtggggaggacttg

SEQ ID NO: 58737 - DNA, 20 bp, Artificial
  CRISPR gRNA sequence
gacaagggcagctgggaact

SEQ ID NO: 58738 - DNA, 20 bp, Artificial
  CRISPR gRNA sequence
cactgtcactgtcagggcag

SEQ ID NO: 58739 - DNA, 20 bp, Artificial
  CRISPR gRNA sequence
aggggagactcgagagggaa

SEQ ID NO: 58740 - DNA, 20 bp, Artificial
  CRISPR gRNA sequence
ggggcctgtggcctcccact

SEQ ID NO: 58741 - DNA, 20 bp, Artificial
  CRISPR gRNA sequence
gtggcctcccacttagagtg

SEQ ID NO: 58742 - DNA, 20 bp, Artificial
  CRISPR gRNA sequence
agagtgagggatgctgggag

SEQ ID NO: 58743 - DNA, 20 bp, Artificial
  CRISPR gRNA sequence
attgcccctttgcagcctca

SEQ ID NO: 58744 - DNA, 20 bp, Artificial
  CRISPR gRNA sequence
agccccagagggcaccatgt

SEQ ID NO: 58745 - DNA, 20 bp, Artificial
  CRISPR gRNA sequence
gcttcttggttagaagacag

SEQ ID NO: 58746 - DNA, 20 bp, Artificial
  CRISPR gRNA sequence
tcccaccagccctgccccat

SEQ ID NO: 58747 - DNA, 20 bp, Artificial
  CRISPR gRNA sequence
caaggcacccccactctcct

SEQ ID NO: 58748 - DNA, 20 bp, Artificial
  CRISPR gRNA sequence
cctcactcgccccagaacat

SEQ ID NO: 58749 - DNA, 20 bp, Artificial
  CRISPR gRNA sequence
ctgtaaccagagactggacc

SEQ ID NO: 58750 - DNA, 20 bp, Artificial
  CRISPR gRNA sequence
atcaggactcttggctcaaa

SEQ ID NO: 58751 - DNA, 20 bp, Artificial
  CRISPR gRNA sequence
tcagcttcttcatctgcaca

SEQ ID NO: 58752 - DNA, 20 bp, Artificial
  CRISPR gRNA sequence
gataatccggtttgaccccc

SEQ ID NO: 58753 - DNA, 20 bp, Artificial
  CRISPR gRNA sequence
actattttttttttctgaga

SEQ ID NO: 58754 - DNA, 20 bp, Artificial
  CRISPR gRNA sequence
tttgctcttgttgcccaggc

SEQ ID NO: 58755 - DNA, 20 bp, Artificial
  CRISPR gRNA sequence
cttgctgccacctctgcctc

SEQ ID NO: 58756 - DNA, 20 bp, Artificial
  CRISPR gRNA sequence
aattctcctgcctcagcctc

SEQ ID NO: 58757 - DNA, 20 bp, Artificial
  CRISPR gRNA sequence
gcctcagcctcctgagtagc

SEQ ID NO: 58758 - DNA, 20 bp, Artificial
  CRISPR gRNA sequence
ttttgtatttttagtagagg

SEQ ID NO: 58759 - DNA, 20 bp, Artificial
  CRISPR gRNA sequence
tcctcagcctcccaaagtgt

SEQ ID NO: 58760 - DNA, 20 bp, Artificial
  CRISPR gRNA sequence
ttgtctcttacctgttttca

SEQ ID NO: 58761 - DNA, 20 bp, Artificial
  CRISPR gRNA sequence
gttactccaccacacccttc

SEQ ID NO: 58762 - DNA, 20 bp, Artificial
  CRISPR gRNA sequence
acccttctagagtctagatc

SEQ ID NO: 58763 - DNA, 20 bp, Artificial
  CRISPR gRNA sequence
ggccacattggaagaagaaa

SEQ ID NO: 58764 - DNA, 20 bp, Artificial
  CRISPR gRNA sequence
atagtgttttaagaaagttt

SEQ ID NO: 58765 - DNA, 20 bp, Artificial
  CRISPR gRNA sequence
tcctgggaacacaaggagac

SEQ ID NO: 58766 - DNA, 20 bp, Artificial
  CRISPR gRNA sequence
actttgggaggccgaggtgg

SEQ ID NO: 58767 - DNA, 20 bp, Artificial
  CRISPR gRNA sequence
ggtggctggatcatgaggtc

SEQ ID NO: 58768 - DNA, 20 bp, Artificial
  CRISPR gRNA sequence
tgggcggtctgagcacaggt

SEQ ID NO: 58769 - DNA, 20 bp, Artificial
  CRISPR gRNA sequence
tggttggggaaagtgcaata

SEQ ID NO: 58770 - DNA, 20 bp, Artificial
  CRISPR gRNA sequence
tgaaagcactttgtcaactg

SEQ ID NO: 58771 - DNA, 20 bp, Artificial
  CRISPR gRNA sequence
tagagtactgtgatcacttg

SEQ ID NO: 58772 - DNA, 20 bp, Artificial
  CRISPR gRNA sequence
gctgaagtccagtgattccc

SEQ ID NO: 58773 - DNA, 20 bp, Artificial
  CRISPR gRNA sequence
tggggctccatcccccctcc

SEQ ID NO: 58774 - DNA, 20 bp, Artificial
  CRISPR gRNA sequence
gtacacatgggcataccatg

SEQ ID NO: 58775 - DNA, 20 bp, Artificial
  CRISPR gRNA sequence
ataccatgtgggatgtggta

SEQ ID NO: 58776 - DNA, 20 bp, Artificial
  CRISPR gRNA sequence
gctttaaaaaaaaaaaaaag

SEQ ID NO: 58777 - DNA, 20 bp, Artificial
  CRISPR gRNA sequence
ccagagcccatggtgtattt

SEQ ID NO: 58778 - DNA, 20 bp, Artificial
  CRISPR gRNA sequence
gggtctggtgggacaccata

SEQ ID NO: 58779 - DNA, 20 bp, Artificial
  CRISPR gRNA sequence
tgcccagtccctggggcaga

SEQ ID NO: 58780 - DNA, 20 bp, Artificial
  CRISPR gRNA sequence
agtccctggggcagaaaggg

SEQ ID NO: 58781 - DNA, 20 bp, Artificial
  CRISPR gRNA sequence
aggggagagggcagcctgca

SEQ ID NO: 58782 - DNA, 20 bp, Artificial
  CRISPR gRNA sequence
agaacatagtagaggtctgc

SEQ ID NO: 58783 - DNA, 20 bp, Artificial
  CRISPR gRNA sequence
accccagggaactcagtgtc

SEQ ID NO: 58784 - DNA, 20 bp, Artificial
  CRISPR gRNA sequence
gagacagcaaggcaggtatc

SEQ ID NO: 58785 - DNA, 20 bp, Artificial
  CRISPR gRNA sequence
tggagtttctcctaaatgca

SEQ ID NO: 58786 - DNA, 20 bp, Artificial
  CRISPR gRNA sequence
cctaaatgcactgggttctg

SEQ ID NO: 58787 - DNA, 20 bp, Artificial
  CRISPR gRNA sequence
cttcgctgacctgttgtatg

SEQ ID NO: 58788 - DNA, 20 bp, Artificial
  CRISPR gRNA sequence
ccactgtcatatccactcct

SEQ ID NO: 58789 - DNA, 20 bp, Artificial
  CRISPR gRNA sequence
actcgctctgtcacccaggc

SEQ ID NO: 58790 - DNA, 20 bp, Artificial
  CRISPR gRNA sequence
gattcccatgcctcagcctc

SEQ ID NO: 58791 - DNA, 20 bp, Artificial
  CRISPR gRNA sequence
ttcgttttttgtagtagagg

SEQ ID NO: 58792 - DNA, 20 bp, Artificial
  CRISPR gRNA sequence
cttcctcttcttccagcctc

SEQ ID NO: 58793 - DNA, 20 bp, Artificial
  CRISPR gRNA sequence
ccatggacccagtgctggga

SEQ ID NO: 58794 - DNA, 20 bp, Artificial
  CRISPR gRNA sequence
tttgtttcacagattgtcct

SEQ ID NO: 58795 - DNA, 20 bp, Artificial
  CRISPR gRNA sequence
acagattgtcctgtgagttc

SEQ ID NO: 58796 - DNA, 20 bp, Artificial
  CRISPR gRNA sequence
tgagcctgctgcagtaagac

SEQ ID NO: 58797 - DNA, 20 bp, Artificial
  CRISPR gRNA sequence
cagtttcctcatctgacaaa

SEQ ID NO: 58798 - DNA, 20 bp, Artificial
  CRISPR gRNA sequence
atattccccgcccattcccc

SEQ ID NO: 58799 - DNA, 20 bp, Artificial
  CRISPR gRNA sequence
ccaacttctccccacccacg

SEQ ID NO: 58800 - DNA, 20 bp, Artificial
  CRISPR gRNA sequence
caccgtcaaactcgcaaaaa

SEQ ID NO: 58801 - DNA, 20 bp, Artificial
  CRISPR gRNA sequence
tcgcaaaaagggaatttaag

SEQ ID NO: 58802 - DNA, 20 bp, Artificial
  CRISPR gRNA sequence
taatttcagctcagactggt

SEQ ID NO: 58803 - DNA, 20 bp, Artificial
  CRISPR gRNA sequence
cgggcagatcacctgaggtc

SEQ ID NO: 58804 - DNA, 20 bp, Artificial
  CRISPR gRNA sequence
aaaattagcccggtgtggtg

SEQ ID NO: 58805 - DNA, 20 bp, Artificial
  CRISPR gRNA sequence
tacttgggaggctgaggcag

SEQ ID NO: 58806 - DNA, 20 bp, Artificial
  CRISPR gRNA sequence
tgcactccagcttgggcgac

SEQ ID NO: 58807 - DNA, 20 bp, Artificial
  CRISPR gRNA sequence
aaaagaaaaaaagaaaaaga

SEQ ID NO: 58808 - DNA, 20 bp, Artificial
  CRISPR gRNA sequence
agaaaaagaaagaattttag

SEQ ID NO: 58809 - DNA, 20 bp, Artificial
  CRISPR gRNA sequence
agtcttctagtggtgggagg

SEQ ID NO: 58810 - DNA, 20 bp, Artificial
  CRISPR gRNA sequence
gtgcaaaggctggggctctc

SEQ ID NO: 58811 - DNA, 20 bp, Artificial
  CRISPR gRNA sequence
aagatggctcgcatcacctc

SEQ ID NO: 58812 - DNA, 20 bp, Artificial
  CRISPR gRNA sequence
ctccaggatctcgcttatgc

SEQ ID NO: 58813 - DNA, 20 bp, Artificial
  CRISPR gRNA sequence
tcccaccctgcccggagata

SEQ ID NO: 58814 - DNA, 20 bp, Artificial
  CRISPR gRNA sequence
cctgactcctcgtccgcctt

SEQ ID NO: 58815 - DNA, 20 bp, Artificial
  CRISPR gRNA sequence
tggccagcctgaccccttgc

SEQ ID NO: 58816 - DNA, 20 bp, Artificial
  CRISPR gRNA sequence
atgaacttagccagtgataa

SEQ ID NO: 58817 - DNA, 20 bp, Artificial
  CRISPR gRNA sequence
cagtgataagagaattttct

SEQ ID NO: 58818 - DNA, 20 bp, Artificial
  CRISPR gRNA sequence
aattttctcgggatgtggtg

SEQ ID NO: 58819 - DNA, 20 bp, Artificial
  CRISPR gRNA sequence
atcagggaacatctctgagg

SEQ ID NO: 58820 - DNA, 20 bp, Artificial
  CRISPR gRNA sequence
ggaggaagagagagatgggc

SEQ ID NO: 58821 - DNA, 20 bp, Artificial
  CRISPR gRNA sequence
aagagagagatgggctcggg

SEQ ID NO: 58822 - DNA, 20 bp, Artificial
  CRISPR gRNA sequence
tggggcctggcacccatggg

SEQ ID NO: 58823 - DNA, 20 bp, Artificial
  CRISPR gRNA sequence
cctgggaacatgaaagggag

SEQ ID NO: 58824 - DNA, 20 bp, Artificial
  CRISPR gRNA sequence
atgaaagggagaggaataat

SEQ ID NO: 58825 - DNA, 20 bp, Artificial
  CRISPR gRNA sequence
tttctttcttttttgtgggg

SEQ ID NO: 58826 - DNA, 20 bp, Artificial
  CRISPR gRNA sequence
tctcgctctgtcacacaggc

SEQ ID NO: 58827 - DNA, 20 bp, Artificial
  CRISPR gRNA sequence
gcctcagcctcccaagtagc

SEQ ID NO: 58828 - DNA, 20 bp, Artificial
  CRISPR gRNA sequence
ttttgtatttttagtagaga

SEQ ID NO: 58829 - DNA, 20 bp, Artificial
  CRISPR gRNA sequence
ccactgcacccgttcctcat

SEQ ID NO: 58830 - DNA, 20 bp, Artificial
  CRISPR gRNA sequence
tgggttttcaaaagttcaga

SEQ ID NO: 58831 - DNA, 20 bp, Artificial
  CRISPR gRNA sequence
tcaaaagttcagactgagtg

SEQ ID NO: 58832 - DNA, 20 bp, Artificial
  CRISPR gRNA sequence
ttcagactgagtgctgggta

SEQ ID NO: 58833 - DNA, 20 bp, Artificial
  CRISPR gRNA sequence
gactgagtgctgggtagaga

SEQ ID NO: 58834 - DNA, 20 bp, Artificial
  CRISPR gRNA sequence
tagagaatggattgggagat

SEQ ID NO: 58835 - DNA, 20 bp, Artificial
  CRISPR gRNA sequence
tgggagatacgagtggaaat

SEQ ID NO: 58836 - DNA, 20 bp, Artificial
  CRISPR gRNA sequence
gtgggaagagatgtgtgcag

SEQ ID NO: 58837 - DNA, 20 bp, Artificial
  CRISPR gRNA sequence
gagatgtgtgcagcagggtg

SEQ ID NO: 58838 - DNA, 20 bp, Artificial
  CRISPR gRNA sequence
tgctgggggctgatcactgc

SEQ ID NO: 58839 - DNA, 20 bp, Artificial
  CRISPR gRNA sequence
ggggctgatcactgctgggg

SEQ ID NO: 58840 - DNA, 20 bp, Artificial
  CRISPR gRNA sequence
gggatagaagttggtagact

SEQ ID NO: 58841 - DNA, 20 bp, Artificial
  CRISPR gRNA sequence
tagaagttggtagactcagg

SEQ ID NO: 58842 - DNA, 20 bp, Artificial
  CRISPR gRNA sequence
gtagactcagggtggatctt

SEQ ID NO: 58843 - DNA, 20 bp, Artificial
  CRISPR gRNA sequence
ctcagggtggatcttgagag

SEQ ID NO: 58844 - DNA, 20 bp, Artificial
  CRISPR gRNA sequence
atttacagacaagctgatag

SEQ ID NO: 58845 - DNA, 20 bp, Artificial
  CRISPR gRNA sequence
acaagctgatagggggatta

SEQ ID NO: 58846 - DNA, 20 bp, Artificial
  CRISPR gRNA sequence
gctgaggctgcctctgaggg

SEQ ID NO: 58847 - DNA, 20 bp, Artificial
  CRISPR gRNA sequence
taaggcagtggtttccaact

SEQ ID NO: 58848 - DNA, 20 bp, Artificial
  CRISPR gRNA sequence
tgggggtgattttcaccctt

SEQ ID NO: 58849 - DNA, 20 bp, Artificial
  CRISPR gRNA sequence
tatttttggtggtcatgact

SEQ ID NO: 58850 - DNA, 20 bp, Artificial
  CRISPR gRNA sequence
ggtggtcatgactgcgggtg

SEQ ID NO: 58851 - DNA, 20 bp, Artificial
  CRISPR gRNA sequence
gaggggtgctgctactggca

SEQ ID NO: 58852 - DNA, 20 bp, Artificial
  CRISPR gRNA sequence
ggtgctgctactggcatcga

SEQ ID NO: 58853 - DNA, 20 bp, Artificial
  CRISPR gRNA sequence
gcatcgaatgaatagagatc

SEQ ID NO: 58854 - DNA, 20 bp, Artificial
  CRISPR gRNA sequence
gcacaggagagcccacaaca

SEQ ID NO: 58855 - DNA, 20 bp, Artificial
  CRISPR gRNA sequence
attaaatcctcatatacctc

SEQ ID NO: 58856 - DNA, 20 bp, Artificial
  CRISPR gRNA sequence
tacctcgagagtcatacatg

SEQ ID NO: 58857 - DNA, 20 bp, Artificial
  CRISPR gRNA sequence
ttccttgtccactcatcttg

SEQ ID NO: 58858 - DNA, 20 bp, Artificial
  CRISPR gRNA sequence
aacaccttaagcctgtgtcc

SEQ ID NO: 58859 - DNA, 20 bp, Artificial
  CRISPR gRNA sequence
tgtgtccacgggttaaaaag

SEQ ID NO: 58860 - DNA, 20 bp, Artificial
  CRISPR gRNA sequence
gacagccaggactcgtcctg

SEQ ID NO: 58861 - DNA, 20 bp, Artificial
  CRISPR gRNA sequence
tcgtcctgaagggttgtgcc

SEQ ID NO: 58862 - DNA, 20 bp, Artificial
  CRISPR gRNA sequence
agggttgtgcctggagtctg

SEQ ID NO: 58863 - DNA, 20 bp, Artificial
  CRISPR gRNA sequence
ctggagtctggtgggtatga

SEQ ID NO: 58864 - DNA, 20 bp, Artificial
  CRISPR gRNA sequence
gtctggtgggtatgaggggg

SEQ ID NO: 58865 - DNA, 20 bp, Artificial
  CRISPR gRNA sequence
agaggctgggcttccggagg

SEQ ID NO: 58866 - DNA, 20 bp, Artificial
  CRISPR gRNA sequence
ggaggaggaaggcgtgtgct

SEQ ID NO: 58867 - DNA, 20 bp, Artificial
  CRISPR gRNA sequence
gggaccagtagatctgcctc

SEQ ID NO: 58868 - DNA, 20 bp, Artificial
  CRISPR gRNA sequence
cagcatgaagaaacacaggt

SEQ ID NO: 58869 - DNA, 20 bp, Artificial
  CRISPR gRNA sequence
tgaagaaacacaggtccggg

SEQ ID NO: 58870 - DNA, 20 bp, Artificial
  CRISPR gRNA sequence
gtccgggtgggatctactgt

SEQ ID NO: 58871 - DNA, 20 bp, Artificial
  CRISPR gRNA sequence
ctactgtgggggtgggagca

SEQ ID NO: 58872 - DNA, 20 bp, Artificial
  CRISPR gRNA sequence
gtggattctggacacttcca

SEQ ID NO: 58873 - DNA, 20 bp, Artificial
  CRISPR gRNA sequence
cacttccagagggtccaagc

SEQ ID NO: 58874 - DNA, 20 bp, Artificial
  CRISPR gRNA sequence
cctgggctagccaggccgga

SEQ ID NO: 58875 - DNA, 20 bp, Artificial
  CRISPR gRNA sequence
cagcctcagccaggagcacg

SEQ ID NO: 58876 - DNA, 20 bp, Artificial
  CRISPR gRNA sequence
gtgtaaagacctcagccagg

SEQ ID NO: 58877 - DNA, 20 bp, Artificial
  CRISPR gRNA sequence
catgcctgaggggcactgaa

SEQ ID NO: 58878 - DNA, 20 bp, Artificial
  CRISPR gRNA sequence
aggggcactgaagggggtat

SEQ ID NO: 58879 - DNA, 20 bp, Artificial
  CRISPR gRNA sequence
acctctcaggaccagctgtc

SEQ ID NO: 58880 - DNA, 20 bp, Artificial
  CRISPR gRNA sequence
ggaccagctgtcagggatgc

SEQ ID NO: 58881 - DNA, 20 bp, Artificial
  CRISPR gRNA sequence
gtcacatacccaaagcttcc

SEQ ID NO: 58882 - DNA, 20 bp, Artificial
  CRISPR gRNA sequence
ggcagatgggggctaaaacg

SEQ ID NO: 58883 - DNA, 20 bp, Artificial
  CRISPR gRNA sequence
ccagcaggtggttaaaagta

SEQ ID NO: 58884 - DNA, 20 bp, Artificial
  CRISPR gRNA sequence
aggagggacgcagagccagc

SEQ ID NO: 58885 - DNA, 20 bp, Artificial
  CRISPR gRNA sequence
ggacgcagagccagccaggg

SEQ ID NO: 58886 - DNA, 20 bp, Artificial
  CRISPR gRNA sequence
tggtatctgcgtggcctgtc

SEQ ID NO: 58887 - DNA, 20 bp, Artificial
  CRISPR gRNA sequence
ttcaaatagtcagcccctgc

SEQ ID NO: 58888 - DNA, 20 bp, Artificial
  CRISPR gRNA sequence
atagtcagcccctgcatggg

SEQ ID NO: 58889 - DNA, 20 bp, Artificial
  CRISPR gRNA sequence
tttttatgtttcccatatcc

SEQ ID NO: 58890 - DNA, 20 bp, Artificial
  CRISPR gRNA sequence
gatgagggaactgagacaca

SEQ ID NO: 58891 - DNA, 20 bp, Artificial
  CRISPR gRNA sequence
gtcacacagctagtaaaatg

SEQ ID NO: 58892 - DNA, 20 bp, Artificial
  CRISPR gRNA sequence
agtccctgctcagacgcatt

SEQ ID NO: 58893 - DNA, 20 bp, Artificial
  CRISPR gRNA sequence
aaaatgtgactgataaaatc

SEQ ID NO: 58894 - DNA, 20 bp, Artificial
  CRISPR gRNA sequence
tttcttttttttttaagacc

SEQ ID NO: 58895 - DNA, 20 bp, Artificial
  CRISPR gRNA sequence
tctcactctgttgcccaggc

SEQ ID NO: 58896 - DNA, 20 bp, Artificial
  CRISPR gRNA sequence
gatcctcccacctcagcctc

SEQ ID NO: 58897 - DNA, 20 bp, Artificial
  CRISPR gRNA sequence
caggcatgagccgctgtgct

SEQ ID NO: 58898 - DNA, 20 bp, Artificial
  CRISPR gRNA sequence
ggaatgtattttaaacagat

SEQ ID NO: 58899 - DNA, 20 bp, Artificial
  CRISPR gRNA sequence
tatgaataagaaatatgtct

SEQ ID NO: 58900 - DNA, 20 bp, Artificial
  CRISPR gRNA sequence
tttctttctttttttttaga

SEQ ID NO: 58901 - DNA, 20 bp, Artificial
  CRISPR gRNA sequence
tctttctctgctgcccaggc

SEQ ID NO: 58902 - DNA, 20 bp, Artificial
  CRISPR gRNA sequence
tttggtatttttagtagaga

SEQ ID NO: 58903 - DNA, 20 bp, Artificial
  CRISPR gRNA sequence
gcctcgccctcccaaagtgc

SEQ ID NO: 58904 - DNA, 20 bp, Artificial
  CRISPR gRNA sequence
cagcactttgggaggccaaa

SEQ ID NO: 58905 - DNA, 20 bp, Artificial
  CRISPR gRNA sequence
actttgggaggccaaagcgg

SEQ ID NO: 58906 - DNA, 20 bp, Artificial
  CRISPR gRNA sequence
cgggtggatcacctgaggtc

SEQ ID NO: 58907 - DNA, 20 bp, Artificial
  CRISPR gRNA sequence
tacttgggaggctgaggcag

SEQ ID NO: 58908 - DNA, 20 bp, Artificial
  CRISPR gRNA sequence
taaataaataaataaaacca

SEQ ID NO: 58909 - DNA, 20 bp, Artificial
  CRISPR gRNA sequence
cagattaaaagaagaaatct

SEQ ID NO: 58910 - DNA, 20 bp, Artificial
  CRISPR gRNA sequence
cctgcaaacatttttttttc

SEQ ID NO: 58911 - DNA, 20 bp, Artificial
  CRISPR gRNA sequence
tttcctctcattcaaaaact

SEQ ID NO: 58912 - DNA, 20 bp, Artificial
  CRISPR gRNA sequence
ctgctggaggcacctgagct

SEQ ID NO: 58913 - DNA, 20 bp, Artificial
  CRISPR gRNA sequence
ccgatatggaagaggaccaa

SEQ ID NO: 58914 - DNA, 20 bp, Artificial
  CRISPR gRNA sequence
tatggaagaggaccaagagg

SEQ ID NO: 58915 - DNA, 20 bp, Artificial
  CRISPR gRNA sequence
gtttactgtggtgctgggga

SEQ ID NO: 58916 - DNA, 20 bp, Artificial
  CRISPR gRNA sequence
gggatagtagcagagaacgt

SEQ ID NO: 58917 - DNA, 20 bp, Artificial
  CRISPR gRNA sequence
gtcattctagtggtgatgga

SEQ ID NO: 58918 - DNA, 20 bp, Artificial
  CRISPR gRNA sequence
tggtactgggcttggtggtg

SEQ ID NO: 58919 - DNA, 20 bp, Artificial
  CRISPR gRNA sequence
tggcgctggtgaccctgaca

SEQ ID NO: 58920 - DNA, 20 bp, Artificial
  CRISPR gRNA sequence
ggggtccagtagcagtgaca

SEQ ID NO: 58921 - DNA, 20 bp, Artificial
  CRISPR gRNA sequence
cagcggactcagatgccttc

SEQ ID NO: 58922 - DNA, 20 bp, Artificial
  CRISPR gRNA sequence
ggtgcccatctccggtttgc

SEQ ID NO: 58923 - DNA, 20 bp, Artificial
  CRISPR gRNA sequence
ttgccttcactcccctggcc

SEQ ID NO: 58924 - DNA, 20 bp, Artificial
  CRISPR gRNA sequence
agagaggctgtgattcgtgg

SEQ ID NO: 58925 - DNA, 20 bp, Artificial
  CRISPR gRNA sequence
ccatccccaaccagctgatg

SEQ ID NO: 58926 - DNA, 20 bp, Artificial
  CRISPR gRNA sequence
ccatctctcccgtgacctgc

SEQ ID NO: 58927 - DNA, 20 bp, Artificial
  CRISPR gRNA sequence
ggcaactgagcttcgtgctc

SEQ ID NO: 58928 - DNA, 20 bp, Artificial
  CRISPR gRNA sequence
cagaccacaggggcagcggg

SEQ ID NO: 58929 - DNA, 20 bp, Artificial
  CRISPR gRNA sequence
ccacaggggcagcgggcagg

SEQ ID NO: 58930 - DNA, 20 bp, Artificial
  CRISPR gRNA sequence
gagtgcagcgctcaaggact

SEQ ID NO: 58931 - DNA, 20 bp, Artificial
  CRISPR gRNA sequence
ggtgccagttctgcctgtgt

SEQ ID NO: 58932 - DNA, 20 bp, Artificial
  CRISPR gRNA sequence
ggcctcagtgtgtccatctg

SEQ ID NO: 58933 - DNA, 20 bp, Artificial
  CRISPR gRNA sequence
atctccatttcccttctagt

SEQ ID NO: 58934 - DNA, 20 bp, Artificial
  CRISPR gRNA sequence
gggaggcctcagtgaagtaa

SEQ ID NO: 58935 - DNA, 20 bp, Artificial
  CRISPR gRNA sequence
cacactttgtggccttccat

SEQ ID NO: 58936 - DNA, 20 bp, Artificial
  CRISPR gRNA sequence
ggagcaacctctgcctttct

SEQ ID NO: 58937 - DNA, 20 bp, Artificial
  CRISPR gRNA sequence
ctctgcctttctctgaatct

SEQ ID NO: 58938 - DNA, 20 bp, Artificial
  CRISPR gRNA sequence
atctcagggtttcctgggca

SEQ ID NO: 58939 - DNA, 20 bp, Artificial
  CRISPR gRNA sequence
taatttctatcccctgatgc

SEQ ID NO: 58940 - DNA, 20 bp, Artificial
  CRISPR gRNA sequence
catggggaccatggaggcca

SEQ ID NO: 58941 - DNA, 20 bp, Artificial
  CRISPR gRNA sequence
gccaggtattgccatgctca

SEQ ID NO: 58942 - DNA, 20 bp, Artificial
  CRISPR gRNA sequence
ggtattgccatgctcacaga

SEQ ID NO: 58943 - DNA, 20 bp, Artificial
  CRISPR gRNA sequence
catgctcacagaatgagttt

SEQ ID NO: 58944 - DNA, 20 bp, Artificial
  CRISPR gRNA sequence
ctccatcctcccttgtcctt

SEQ ID NO: 58945 - DNA, 20 bp, Artificial
  CRISPR gRNA sequence
cgcttccctctctgtgccct

SEQ ID NO: 58946 - DNA, 20 bp, Artificial
  CRISPR gRNA sequence
ctgggctctgagcagagctt

SEQ ID NO: 58947 - DNA, 20 bp, Artificial
  CRISPR gRNA sequence
agacactcaggtaatccctg

SEQ ID NO: 58948 - DNA, 20 bp, Artificial
  CRISPR gRNA sequence
agcagcttcaagctcactgc

SEQ ID NO: 58949 - DNA, 20 bp, Artificial
  CRISPR gRNA sequence
gactacaggccttgaggctt

SEQ ID NO: 58950 - DNA, 20 bp, Artificial
  CRISPR gRNA sequence
tggccctggacaagtaaaat

SEQ ID NO: 58951 - DNA, 20 bp, Artificial
  CRISPR gRNA sequence
taataacacaacctacccct

SEQ ID NO: 58952 - DNA, 20 bp, Artificial
  CRISPR gRNA sequence
ctaccccttagggttattgt

SEQ ID NO: 58953 - DNA, 20 bp, Artificial
  CRISPR gRNA sequence
agggttattgtgaggattaa

SEQ ID NO: 58954 - DNA, 20 bp, Artificial
  CRISPR gRNA sequence
caggaaaaggtctggctcat

SEQ ID NO: 58955 - DNA, 20 bp, Artificial
  CRISPR gRNA sequence
attcactccacagcccccag

SEQ ID NO: 58956 - DNA, 20 bp, Artificial
  CRISPR gRNA sequence
cagtggctccccattaaccc

SEQ ID NO: 58957 - DNA, 20 bp, Artificial
  CRISPR gRNA sequence
tcccagcagccctgcctcat

SEQ ID NO: 58958 - DNA, 20 bp, Artificial
  CRISPR gRNA sequence
ctggacagcagagccccacg

SEQ ID NO: 58959 - DNA, 20 bp, Artificial
  CRISPR gRNA sequence
ctcagccagtgctggtccgg

SEQ ID NO: 58960 - DNA, 20 bp, Artificial
  CRISPR gRNA sequence
taaggcagtggttaagagct

SEQ ID NO: 58961 - DNA, 20 bp, Artificial
  CRISPR gRNA sequence
gggtctgcagtcagactgac

SEQ ID NO: 58962 - DNA, 20 bp, Artificial
  CRISPR gRNA sequence
ttcttatctgctgtgtgtcc

SEQ ID NO: 58963 - DNA, 20 bp, Artificial
  CRISPR gRNA sequence
ccacctctaattggtgctat

SEQ ID NO: 58964 - DNA, 20 bp, Artificial
  CRISPR gRNA sequence
tgagaattaaaggagaccct

SEQ ID NO: 58965 - DNA, 20 bp, Artificial
  CRISPR gRNA sequence
ggctggcacagtgcctgacc

SEQ ID NO: 58966 - DNA, 20 bp, Artificial
  CRISPR gRNA sequence
actcctaatactttcttaca

SEQ ID NO: 58967 - DNA, 20 bp, Artificial
  CRISPR gRNA sequence
caggcctttgccctcagagg

SEQ ID NO: 58968 - DNA, 20 bp, Artificial
  CRISPR gRNA sequence
gctttctgccctcaggctaa

SEQ ID NO: 58969 - DNA, 20 bp, Artificial
  CRISPR gRNA sequence
ctgcagctgacggagctcac

SEQ ID NO: 58970 - DNA, 20 bp, Artificial
  CRISPR gRNA sequence
ccagcccgtgaggacagcag

SEQ ID NO: 58971 - DNA, 20 bp, Artificial
  CRISPR gRNA sequence
cctccgggaggggccatggc

SEQ ID NO: 58972 - DNA, 20 bp, Artificial
  CRISPR gRNA sequence
gccatggcatgaatgggagc

SEQ ID NO: 58973 - DNA, 20 bp, Artificial
  CRISPR gRNA sequence
atgggagcaggggtgggcac

SEQ ID NO: 58974 - DNA, 20 bp, Artificial
  CRISPR gRNA sequence
gcactggagtaagaggcccc

SEQ ID NO: 58975 - DNA, 20 bp, Artificial
  CRISPR gRNA sequence
cacactggaggcctgtgctt

SEQ ID NO: 58976 - DNA, 20 bp, Artificial
  CRISPR gRNA sequence
aagaaagaaagaaggtttca

SEQ ID NO: 58977 - DNA, 20 bp, Artificial
  CRISPR gRNA sequence
aaagaagataccgaagtaga

SEQ ID NO: 58978 - DNA, 20 bp, Artificial
  CRISPR gRNA sequence
cagttagcgattccttagtg

SEQ ID NO: 58979 - DNA, 20 bp, Artificial
  CRISPR gRNA sequence
cagataagacagctggcttt

SEQ ID NO: 58980 - DNA, 20 bp, Artificial
  CRISPR gRNA sequence
gacagctggcttttgggatc

SEQ ID NO: 58981 - DNA, 20 bp, Artificial
  CRISPR gRNA sequence
acatctggtctgcatttgca

SEQ ID NO: 58982 - DNA, 20 bp, Artificial
  CRISPR gRNA sequence
catttctaagtgtaccattc

SEQ ID NO: 58983 - DNA, 20 bp, Artificial
  CRISPR gRNA sequence
actcttttcctcttgcaaaa

SEQ ID NO: 58984 - DNA, 20 bp, Artificial
  CRISPR gRNA sequence
ccattctgctttctgtctct

SEQ ID NO: 58985 - DNA, 20 bp, Artificial
  CRISPR gRNA sequence
gactgctctaaatagtttat

SEQ ID NO: 58986 - DNA, 20 bp, Artificial
  CRISPR gRNA sequence
ctctaaatagtttatatgag

SEQ ID NO: 58987 - DNA, 20 bp, Artificial
  CRISPR gRNA sequence
ttttttttttttttttgaga

SEQ ID NO: 58988 - DNA, 20 bp, Artificial
  CRISPR gRNA sequence
ctcactcttgtcacctgggc

SEQ ID NO: 58989 - DNA, 20 bp, Artificial
  CRISPR gRNA sequence
ctcactgcaccctccacctc

SEQ ID NO: 58990 - DNA, 20 bp, Artificial
  CRISPR gRNA sequence
gattctcctgcctcagcctc

SEQ ID NO: 58991 - DNA, 20 bp, Artificial
  CRISPR gRNA sequence
gcctcagcctccggagtagc

SEQ ID NO: 58992 - DNA, 20 bp, Artificial
  CRISPR gRNA sequence
tttttgtatttttgtagaga

SEQ ID NO: 58993 - DNA, 20 bp, Artificial
  CRISPR gRNA sequence
gtttcggccttccaaagtgc

SEQ ID NO: 58994 - DNA, 20 bp, Artificial
  CRISPR gRNA sequence
gctgcataatattccattgt

SEQ ID NO: 58995 - DNA, 20 bp, Artificial
  CRISPR gRNA sequence
acttatccatcaattgacac

SEQ ID NO: 58996 - DNA, 20 bp, Artificial
  CRISPR gRNA sequence
tgaggtctcactgttttgcc

SEQ ID NO: 58997 - DNA, 20 bp, Artificial
  CRISPR gRNA sequence
aattattttggttatatatc

SEQ ID NO: 58998 - DNA, 20 bp, Artificial
  CRISPR gRNA sequence
ataactttttttttttgaga

SEQ ID NO: 58999 - DNA, 20 bp, Artificial
  CRISPR gRNA sequence
tctcgctctgttgcccaggt

SEQ ID NO: 59000 - DNA, 20 bp, Artificial
  CRISPR gRNA sequence
ctcactgcaagctccgcctc

SEQ ID NO: 59001 - DNA, 20 bp, Artificial
  CRISPR gRNA sequence
cattctcctgcctcagcctc

SEQ ID NO: 59002 - DNA, 20 bp, Artificial
  CRISPR gRNA sequence
ttttgtatttttagtagaga

SEQ ID NO: 59003 - DNA, 20 bp, Artificial
  CRISPR gRNA sequence
cggggtttcaccatgttagc

SEQ ID NO: 59004 - DNA, 20 bp, Artificial
  CRISPR gRNA sequence
acctcagcctcccaaagtgc

SEQ ID NO: 59005 - DNA, 20 bp, Artificial
  CRISPR gRNA sequence
ataaaataaaaatcactcat

SEQ ID NO: 59006 - DNA, 20 bp, Artificial
  CRISPR gRNA sequence
ctttttttgaaatgcaaaat

SEQ ID NO: 59007 - DNA, 20 bp, Artificial
  CRISPR gRNA sequence
cctttgtgatgtaacattat

SEQ ID NO: 59008 - DNA, 20 bp, Artificial
  CRISPR gRNA sequence
actttgggaggccgaggcag

SEQ ID NO: 59009 - DNA, 20 bp, Artificial
  CRISPR gRNA sequence
caggtggatcacttgaggtc

SEQ ID NO: 59010 - DNA, 20 bp, Artificial
  CRISPR gRNA sequence
tacttgggaggctgaggcag

SEQ ID NO: 59011 - DNA, 20 bp, Artificial
  CRISPR gRNA sequence
taaaaaataatattttctgt

SEQ ID NO: 59012 - DNA, 20 bp, Artificial
  CRISPR gRNA sequence
attgtcacaacaatagttgt

SEQ ID NO: 59013 - DNA, 20 bp, Artificial
  CRISPR gRNA sequence
acaacaatagttgttggaat

SEQ ID NO: 59014 - DNA, 20 bp, Artificial
  CRISPR gRNA sequence
atctgtgtccccttctgtga

SEQ ID NO: 59015 - DNA, 20 bp, Artificial
  CRISPR gRNA sequence
gagccgtgggcggacagagc

SEQ ID NO: 59016 - DNA, 20 bp, Artificial
  CRISPR gRNA sequence
ggcagtgtcactgaaatcag

SEQ ID NO: 59017 - DNA, 20 bp, Artificial
  CRISPR gRNA sequence
gtccagagaagaggcccctt

SEQ ID NO: 59018 - DNA, 20 bp, Artificial
  CRISPR gRNA sequence
cttgaccttccctcatcctg

SEQ ID NO: 59019 - DNA, 20 bp, Artificial
  CRISPR gRNA sequence
cagctagttttccatgtccc

SEQ ID NO: 59020 - DNA, 20 bp, Artificial
  CRISPR gRNA sequence
gtgtcagaggaagacatccc

SEQ ID NO: 59021 - DNA, 20 bp, Artificial
  CRISPR gRNA sequence
agaatcaaaacaaagggcta

SEQ ID NO: 59022 - DNA, 20 bp, Artificial
  CRISPR gRNA sequence
ggatccaggcagacatggct

SEQ ID NO: 59023 - DNA, 20 bp, Artificial
  CRISPR gRNA sequence
agaaataacacaatgacaca

SEQ ID NO: 59024 - DNA, 20 bp, Artificial
  CRISPR gRNA sequence
cctcaacctcctgctcttaa

SEQ ID NO: 59025 - DNA, 20 bp, Artificial
  CRISPR gRNA sequence
acggccctttgcagggctgg

SEQ ID NO: 59026 - DNA, 20 bp, Artificial
  CRISPR gRNA sequence
gcttcttccttctctcctcc

SEQ ID NO: 59027 - DNA, 20 bp, Artificial
  CRISPR gRNA sequence
tctcctccaggagtgagcaa

SEQ ID NO: 59028 - DNA, 20 bp, Artificial
  CRISPR gRNA sequence
agaaaattctggaactgccc

SEQ ID NO: 59029 - DNA, 20 bp, Artificial
  CRISPR gRNA sequence
actttgggaggccgaggcag

SEQ ID NO: 59030 - DNA, 20 bp, Artificial
  CRISPR gRNA sequence
gcaggaggatcactgaagcc

SEQ ID NO: 59031 - DNA, 20 bp, Artificial
  CRISPR gRNA sequence
attgttgaaaaggcactact

SEQ ID NO: 59032 - DNA, 20 bp, Artificial
  CRISPR gRNA sequence
gaaggggacccaggcaaagt

SEQ ID NO: 59033 - DNA, 20 bp, Artificial
  CRISPR gRNA sequence
acccaggcaaagtgagagtt

SEQ ID NO: 59034 - DNA, 20 bp, Artificial
  CRISPR gRNA sequence
gcagcagctctgtgtccagc

SEQ ID NO: 59035 - DNA, 20 bp, Artificial
  CRISPR gRNA sequence
tggaatttcctcgccaggaa

SEQ ID NO: 59036 - DNA, 20 bp, Artificial
  CRISPR gRNA sequence
ccaccctgcccagagacctt

SEQ ID NO: 59037 - DNA, 20 bp, Artificial
  CRISPR gRNA sequence
cacaggctgtgctctctgcc

SEQ ID NO: 59038 - DNA, 20 bp, Artificial
  CRISPR gRNA sequence
ttatccactcttatagatcc

SEQ ID NO: 59039 - DNA, 20 bp, Artificial
  CRISPR gRNA sequence
gaaattaaaatgtcaccctt

SEQ ID NO: 59040 - DNA, 20 bp, Artificial
  CRISPR gRNA sequence
ttaaaatgtcacccttttga

SEQ ID NO: 59041 - DNA, 20 bp, Artificial
  CRISPR gRNA sequence
ttctgggaaatagagcatgg

SEQ ID NO: 59042 - DNA, 20 bp, Artificial
  CRISPR gRNA sequence
cttcctagcacttctcataa

SEQ ID NO: 59043 - DNA, 20 bp, Artificial
  CRISPR gRNA sequence
aagctccttgcaggcagata

SEQ ID NO: 59044 - DNA, 20 bp, Artificial
  CRISPR gRNA sequence
tggaaactctgtgtggggcc

SEQ ID NO: 59045 - DNA, 20 bp, Artificial
  CRISPR gRNA sequence
gtggaggggagggagagccc

SEQ ID NO: 59046 - DNA, 20 bp, Artificial
  CRISPR gRNA sequence
agggtggctcaggggagctc

SEQ ID NO: 59047 - DNA, 20 bp, Artificial
  CRISPR gRNA sequence
tcctctcttggcaccccctt

SEQ ID NO: 59048 - DNA, 20 bp, Artificial
  CRISPR gRNA sequence
gtgtccagcctgaaatcctc

SEQ ID NO: 59049 - DNA, 20 bp, Artificial
  CRISPR gRNA sequence
tggccctggagatgattttt

SEQ ID NO: 59050 - DNA, 20 bp, Artificial
  CRISPR gRNA sequence
actttgggaggccgaggcag

SEQ ID NO: 59051 - DNA, 20 bp, Artificial
  CRISPR gRNA sequence
caggtggattgcctgagctc

SEQ ID NO: 59052 - DNA, 20 bp, Artificial
  CRISPR gRNA sequence
taattgggaggctgaggcac

SEQ ID NO: 59053 - DNA, 20 bp, Artificial
  CRISPR gRNA sequence
ctttacccgttaacatttca

SEQ ID NO: 59054 - DNA, 20 bp, Artificial
  CRISPR gRNA sequence
attgcatttttttcccagtt

SEQ ID NO: 59055 - DNA, 20 bp, Artificial
  CRISPR gRNA sequence
tcccagttgtggatccaatc

SEQ ID NO: 59056 - DNA, 20 bp, Artificial
  CRISPR gRNA sequence
tttacaggccagttatttta

SEQ ID NO: 59057 - DNA, 20 bp, Artificial
  CRISPR gRNA sequence
tttatagaatgtccttccac

SEQ ID NO: 59058 - DNA, 20 bp, Artificial
  CRISPR gRNA sequence
gtccaatgtttcctcatgtt

SEQ ID NO: 59059 - DNA, 20 bp, Artificial
  CRISPR gRNA sequence
tgtttcctcatgtttagagt

SEQ ID NO: 59060 - DNA, 20 bp, Artificial
  CRISPR gRNA sequence
ttagagtctgccctttgggc

SEQ ID NO: 59061 - DNA, 20 bp, Artificial
  CRISPR gRNA sequence
catcggggcacatgatgtgt

SEQ ID NO: 59062 - DNA, 20 bp, Artificial
  CRISPR gRNA sequence
aataaatcttacttaaatcg

SEQ ID NO: 59063 - DNA, 20 bp, Artificial
  CRISPR gRNA sequence
aggaaaaatcgcttgagccc

SEQ ID NO: 59064 - DNA, 20 bp, Artificial
  CRISPR gRNA sequence
cagtatttgctttaaagatg

SEQ ID NO: 59065 - DNA, 20 bp, Artificial
  CRISPR gRNA sequence
ttaagttgtgaagttgctac

SEQ ID NO: 59066 - DNA, 20 bp, Artificial
  CRISPR gRNA sequence
ccaagctctgtggtggctta

SEQ ID NO: 59067 - DNA, 20 bp, Artificial
  CRISPR gRNA sequence
ctgccaccacttggaggagc

SEQ ID NO: 59068 - DNA, 20 bp, Artificial
  CRISPR gRNA sequence
caccacttggaggagctgga

SEQ ID NO: 59069 - DNA, 20 bp, Artificial
  CRISPR gRNA sequence
ggaggagctggagtgagttg

SEQ ID NO: 59070 - DNA, 20 bp, Artificial
  CRISPR gRNA sequence
tggagtgagttgcagagtgg

SEQ ID NO: 59071 - DNA, 20 bp, Artificial
  CRISPR gRNA sequence
tggggacaagtggcccagct

SEQ ID NO: 59072 - DNA, 20 bp, Artificial
  CRISPR gRNA sequence
aagtggcccagctgagggtg

SEQ ID NO: 59073 - DNA, 20 bp, Artificial
  CRISPR gRNA sequence
cctgatgaagtgcagcagtt

SEQ ID NO: 59074 - DNA, 20 bp, Artificial
  CRISPR gRNA sequence
aagagcaccacagttttggt

SEQ ID NO: 59075 - DNA, 20 bp, Artificial
  CRISPR gRNA sequence
tgctctgctgggctggctgt

SEQ ID NO: 59076 - DNA, 20 bp, Artificial
  CRISPR gRNA sequence
cggagagggctgaagaacaa

SEQ ID NO: 59077 - DNA, 20 bp, Artificial
  CRISPR gRNA sequence
agagcctgagccctggagct

SEQ ID NO: 59078 - DNA, 20 bp, Artificial
  CRISPR gRNA sequence
ccatggggaacctggacagc

SEQ ID NO: 59079 - DNA, 20 bp, Artificial
  CRISPR gRNA sequence
tggcccagggcatgcagatg

SEQ ID NO: 59080 - DNA, 20 bp, Artificial
  CRISPR gRNA sequence
atgagggcccttgaggggaa

SEQ ID NO: 59081 - DNA, 20 bp, Artificial
  CRISPR gRNA sequence
gaaatggatgctaaagaggc

SEQ ID NO: 59082 - DNA, 20 bp, Artificial
  CRISPR gRNA sequence
agtaagtagtgatggtggtt

SEQ ID NO: 59083 - DNA, 20 bp, Artificial
  CRISPR gRNA sequence
agtagtgatggtggttgtgg

SEQ ID NO: 59084 - DNA, 20 bp, Artificial
  CRISPR gRNA sequence
gtgatggtggttgtgggtga

SEQ ID NO: 59085 - DNA, 20 bp, Artificial
  CRISPR gRNA sequence
gttgtgggtgagtgagtggt

SEQ ID NO: 59086 - DNA, 20 bp, Artificial
  CRISPR gRNA sequence
gtgagtggtgggggtggtta

SEQ ID NO: 59087 - DNA, 20 bp, Artificial
  CRISPR gRNA sequence
gtggttaatggatggtggaa

SEQ ID NO: 59088 - DNA, 20 bp, Artificial
  CRISPR gRNA sequence
ttaatggatggtggaagtgg

SEQ ID NO: 59089 - DNA, 20 bp, Artificial
  CRISPR gRNA sequence
tggtggaagtgggtgagtgg

SEQ ID NO: 59090 - DNA, 20 bp, Artificial
  CRISPR gRNA sequence
gtgagtggtggggttggtta

SEQ ID NO: 59091 - DNA, 20 bp, Artificial
  CRISPR gRNA sequence
ttggttaatggatggtggaa

SEQ ID NO: 59092 - DNA, 20 bp, Artificial
  CRISPR gRNA sequence
ttaatggatggtggaagtgg

SEQ ID NO: 59093 - DNA, 20 bp, Artificial
  CRISPR gRNA sequence
tggtggaagtgggtgagtgg

SEQ ID NO: 59094 - DNA, 20 bp, Artificial
  CRISPR gRNA sequence
agtggtggggttggttaatg

SEQ ID NO: 59095 - DNA, 20 bp, Artificial
  CRISPR gRNA sequence
tggggttggttaatggggaa

SEQ ID NO: 59096 - DNA, 20 bp, Artificial
  CRISPR gRNA sequence
gttggttaatggggaatggg

SEQ ID NO: 59097 - DNA, 20 bp, Artificial
  CRISPR gRNA sequence
gttaatggggaatggggtga

SEQ ID NO: 59098 - DNA, 20 bp, Artificial
  CRISPR gRNA sequence
gaatggggtgagtgagtggt

SEQ ID NO: 59099 - DNA, 20 bp, Artificial
  CRISPR gRNA sequence
agtggtgggagtggttaatg

SEQ ID NO: 59100 - DNA, 20 bp, Artificial
  CRISPR gRNA sequence
agtggttaatggggaatggg

SEQ ID NO: 59101 - DNA, 20 bp, Artificial
  CRISPR gRNA sequence
gttaatggggaatgggctga

SEQ ID NO: 59102 - DNA, 20 bp, Artificial
  CRISPR gRNA sequence
gaatgggctgagtgagtggt

SEQ ID NO: 59103 - DNA, 20 bp, Artificial
  CRISPR gRNA sequence
agtggtgggagtggttaatg

SEQ ID NO: 59104 - DNA, 20 bp, Artificial
  CRISPR gRNA sequence
tgggagtggttaatggggaa

SEQ ID NO: 59105 - DNA, 20 bp, Artificial
  CRISPR gRNA sequence
agtggttaatggggaatggg

SEQ ID NO: 59106 - DNA, 20 bp, Artificial
  CRISPR gRNA sequence
gttaatggggaatggggtga

SEQ ID NO: 59107 - DNA, 20 bp, Artificial
  CRISPR gRNA sequence
ggtgatggtggttaatgggg

SEQ ID NO: 59108 - DNA, 20 bp, Artificial
  CRISPR gRNA sequence
tggttaatggggaagggtgt

SEQ ID NO: 59109 - DNA, 20 bp, Artificial
  CRISPR gRNA sequence
tgatggtggttaatggggaa

SEQ ID NO: 59110 - DNA, 20 bp, Artificial
  CRISPR gRNA sequence
ggtggttaatggggaagggg

SEQ ID NO: 59111 - DNA, 20 bp, Artificial
  CRISPR gRNA sequence
gttaatggggaagggggtga

SEQ ID NO: 59112 - DNA, 20 bp, Artificial
  CRISPR gRNA sequence
gtggttaatggggaagtgtt

SEQ ID NO: 59113 - DNA, 20 bp, Artificial
  CRISPR gRNA sequence
ttaatggggaagtgttgtga

SEQ ID NO: 59114 - DNA, 20 bp, Artificial
  CRISPR gRNA sequence
ggtggttaatggggaaggag

SEQ ID NO: 59115 - DNA, 20 bp, Artificial
  CRISPR gRNA sequence
gttaatggggaaggagatga

SEQ ID NO: 59116 - DNA, 20 bp, Artificial
  CRISPR gRNA sequence
ggtgttggtggttaatgggg

SEQ ID NO: 59117 - DNA, 20 bp, Artificial
  CRISPR gRNA sequence
gtggttaatggggaagggtt

SEQ ID NO: 59118 - DNA, 20 bp, Artificial
  CRISPR gRNA sequence
ttaatggggaagggttgtga

SEQ ID NO: 59119 - DNA, 20 bp, Artificial
  CRISPR gRNA sequence
tggcgttggttaatggggaa

SEQ ID NO: 59120 - DNA, 20 bp, Artificial
  CRISPR gRNA sequence
gttggttaatggggaagggg

SEQ ID NO: 59121 - DNA, 20 bp, Artificial
  CRISPR gRNA sequence
gttaatggggaagggggtga

SEQ ID NO: 59122 - DNA, 20 bp, Artificial
  CRISPR gRNA sequence
ggtgatggtggttaatgggg

SEQ ID NO: 59123 - DNA, 20 bp, Artificial
  CRISPR gRNA sequence
gtggttaatggggaagagtt

SEQ ID NO: 59124 - DNA, 20 bp, Artificial
  CRISPR gRNA sequence
ttaatggggaagagttgtga

SEQ ID NO: 59125 - DNA, 20 bp, Artificial
  CRISPR gRNA sequence
tgttggtggttaatggggaa

SEQ ID NO: 59126 - DNA, 20 bp, Artificial
  CRISPR gRNA sequence
ggtggttaatggggaagggg

SEQ ID NO: 59127 - DNA, 20 bp, Artificial
  CRISPR gRNA sequence
gttaatggggaagggggtga

SEQ ID NO: 59128 - DNA, 20 bp, Artificial
  CRISPR gRNA sequence
ggaagggggtgagtgagtgg

SEQ ID NO: 59129 - DNA, 20 bp, Artificial
  CRISPR gRNA sequence
ttggttaatggggaagtgtt

SEQ ID NO: 59130 - DNA, 20 bp, Artificial
  CRISPR gRNA sequence
ttaatggggaagtgttgtga

SEQ ID NO: 59131 - DNA, 20 bp, Artificial
  CRISPR gRNA sequence
ggtgatggtgattaatgggg

SEQ ID NO: 59132 - DNA, 20 bp, Artificial
  CRISPR gRNA sequence
gtgattaatggggaagggtt

SEQ ID NO: 59133 - DNA, 20 bp, Artificial
  CRISPR gRNA sequence
ttaatggggaagggttgtga

SEQ ID NO: 59134 - DNA, 20 bp, Artificial
  CRISPR gRNA sequence
ggtggttaatggggaaggga

SEQ ID NO: 59135 - DNA, 20 bp, Artificial
  CRISPR gRNA sequence
gttaatggggaagggaggga

SEQ ID NO: 59136 - DNA, 20 bp, Artificial
  CRISPR gRNA sequence
gatgatggtggttaatgggg

SEQ ID NO: 59137 - DNA, 20 bp, Artificial
  CRISPR gRNA sequence
gtggttaatggggaagggtt

SEQ ID NO: 59138 - DNA, 20 bp, Artificial
  CRISPR gRNA sequence
ttaatggggaagggttgtga

SEQ ID NO: 59139 - DNA, 20 bp, Artificial
  CRISPR gRNA sequence
gaagggttgtgagtgagttg

SEQ ID NO: 59140 - DNA, 20 bp, Artificial
  CRISPR gRNA sequence
ttggttaatggggaagcgtt

SEQ ID NO: 59141 - DNA, 20 bp, Artificial
  CRISPR gRNA sequence
ttaatggggaagcgttgtga

SEQ ID NO: 59142 - DNA, 20 bp, Artificial
  CRISPR gRNA sequence
gtgatggttggttaatgggg

SEQ ID NO: 59143 - DNA, 20 bp, Artificial
  CRISPR gRNA sequence
ttggttaatggggaagggtt

SEQ ID NO: 59144 - DNA, 20 bp, Artificial
  CRISPR gRNA sequence
ttaatggggaagggttgtga

SEQ ID NO: 59145 - DNA, 20 bp, Artificial
  CRISPR gRNA sequence
tgatggtggttaatggggaa

SEQ ID NO: 59146 - DNA, 20 bp, Artificial
  CRISPR gRNA sequence
ggtggttaatggggaagggg

SEQ ID NO: 59147 - DNA, 20 bp, Artificial
  CRISPR gRNA sequence
gttaatggggaagggggtga

SEQ ID NO: 59148 - DNA, 20 bp, Artificial
  CRISPR gRNA sequence
gtggttaatggggaagtgtt

SEQ ID NO: 59149 - DNA, 20 bp, Artificial
  CRISPR gRNA sequence
ttaatggggaagtgttgtga

SEQ ID NO: 59150 - DNA, 20 bp, Artificial
  CRISPR gRNA sequence
ggtgatggtggttaatgggg

SEQ ID NO: 59151 - DNA, 20 bp, Artificial
  CRISPR gRNA sequence
gtggttaatggggaagggtt

SEQ ID NO: 59152 - DNA, 20 bp, Artificial
  CRISPR gRNA sequence
ttaatggggaagggttgtga

SEQ ID NO: 59153 - DNA, 20 bp, Artificial
  CRISPR gRNA sequence
tgttggtggttaatggggaa

SEQ ID NO: 59154 - DNA, 20 bp, Artificial
  CRISPR gRNA sequence
ggtggttaatggggaagggg

SEQ ID NO: 59155 - DNA, 20 bp, Artificial
  CRISPR gRNA sequence
gatgatggtggttaatgggg

SEQ ID NO: 59156 - DNA, 20 bp, Artificial
  CRISPR gRNA sequence
gtggttaatggggaagggtt

SEQ ID NO: 59157 - DNA, 20 bp, Artificial
  CRISPR gRNA sequence
ttaatggggaagggttgtga

SEQ ID NO: 59158 - DNA, 20 bp, Artificial
  CRISPR gRNA sequence
gaagggttgtgagtgagtgg

SEQ ID NO: 59159 - DNA, 20 bp, Artificial
  CRISPR gRNA sequence
tggggttggttaacggggaa

SEQ ID NO: 59160 - DNA, 20 bp, Artificial
  CRISPR gRNA sequence
gttggttaacggggaagggg

SEQ ID NO: 59161 - DNA, 20 bp, Artificial
  CRISPR gRNA sequence
gttaacggggaagggggtga

SEQ ID NO: 59162 - DNA, 20 bp, Artificial
  CRISPR gRNA sequence
tggtggtggttaatggggaa

SEQ ID NO: 59163 - DNA, 20 bp, Artificial
  CRISPR gRNA sequence
ggtggttaatggggaagggg

SEQ ID NO: 59164 - DNA, 20 bp, Artificial
  CRISPR gRNA sequence
gttaatggggaagggggtga

SEQ ID NO: 59165 - DNA, 20 bp, Artificial
  CRISPR gRNA sequence
tgttggtggttaatggggaa

SEQ ID NO: 59166 - DNA, 20 bp, Artificial
  CRISPR gRNA sequence
ggtggttaatggggaagggg

SEQ ID NO: 59167 - DNA, 20 bp, Artificial
  CRISPR gRNA sequence
gttaatggggaagggggtgg

SEQ ID NO: 59168 - DNA, 20 bp, Artificial
  CRISPR gRNA sequence
gtgatggtggttaatgggaa

SEQ ID NO: 59169 - DNA, 20 bp, Artificial
  CRISPR gRNA sequence
tggtggttaatgggaaggga

SEQ ID NO: 59170 - DNA, 20 bp, Artificial
  CRISPR gRNA sequence
ggtgatggtggttaatgggg

SEQ ID NO: 59171 - DNA, 20 bp, Artificial
  CRISPR gRNA sequence
gtggttaatggggaagggtt

SEQ ID NO: 59172 - DNA, 20 bp, Artificial
  CRISPR gRNA sequence
ttaatggggaagggttgtga

SEQ ID NO: 59173 - DNA, 20 bp, Artificial
  CRISPR gRNA sequence
tgatggtggttaatggggaa

SEQ ID NO: 59174 - DNA, 20 bp, Artificial
  CRISPR gRNA sequence
ggtggttaatggggaagggg

SEQ ID NO: 59175 - DNA, 20 bp, Artificial
  CRISPR gRNA sequence
aatggggaagggggtgagta

SEQ ID NO: 59176 - DNA, 20 bp, Artificial
  CRISPR gRNA sequence
gaagggggtgagtaaggggt

SEQ ID NO: 59177 - DNA, 20 bp, Artificial
  CRISPR gRNA sequence
ggtgggggtggttaataggg

SEQ ID NO: 59178 - DNA, 20 bp, Artificial
  CRISPR gRNA sequence
gtggttaatagggaagagtt

SEQ ID NO: 59179 - DNA, 20 bp, Artificial
  CRISPR gRNA sequence
ttaatagggaagagttgtga

SEQ ID NO: 59180 - DNA, 20 bp, Artificial
  CRISPR gRNA sequence
gaagagttgtgagtgagtgg

SEQ ID NO: 59181 - DNA, 20 bp, Artificial
  CRISPR gRNA sequence
tggggttggttaatggggaa

SEQ ID NO: 59182 - DNA, 20 bp, Artificial
  CRISPR gRNA sequence
gttggttaatggggaagggg

SEQ ID NO: 59183 - DNA, 20 bp, Artificial
  CRISPR gRNA sequence
aatggggaagggggtgagtg

SEQ ID NO: 59184 - DNA, 20 bp, Artificial
  CRISPR gRNA sequence
tgacagtggttaatggggaa

SEQ ID NO: 59185 - DNA, 20 bp, Artificial
  CRISPR gRNA sequence
agtggttaatggggaaagga

SEQ ID NO: 59186 - DNA, 20 bp, Artificial
  CRISPR gRNA sequence
aatggggaaaggagtgagtg

SEQ ID NO: 59187 - DNA, 20 bp, Artificial
  CRISPR gRNA sequence
tgcttagtgctgcatggtca

SEQ ID NO: 59188 - DNA, 20 bp, Artificial
  CRISPR gRNA sequence
gaacacaaaccgccatgttt

SEQ ID NO: 59189 - DNA, 20 bp, Artificial
  CRISPR gRNA sequence
tctggatggacccaggtgag

SEQ ID NO: 59190 - DNA, 20 bp, Artificial
  CRISPR gRNA sequence
atgaccttttactttctatt

SEQ ID NO: 59191 - DNA, 20 bp, Artificial
  CRISPR gRNA sequence
agaaccttggtcataggaaa

SEQ ID NO: 59192 - DNA, 20 bp, Artificial
  CRISPR gRNA sequence
gccaatgacttcaggcacag

SEQ ID NO: 59193 - DNA, 20 bp, Artificial
  CRISPR gRNA sequence
cttcaggcacagctggatcc

SEQ ID NO: 59194 - DNA, 20 bp, Artificial
  CRISPR gRNA sequence
ttctctcagcttagtggaaa

SEQ ID NO: 59195 - DNA, 20 bp, Artificial
  CRISPR gRNA sequence
ttacaacaaaaggtcctaga

SEQ ID NO: 59196 - DNA, 20 bp, Artificial
  CRISPR gRNA sequence
ctgagtctcactggactagc

SEQ ID NO: 59197 - DNA, 20 bp, Artificial
  CRISPR gRNA sequence
accctatcttctggacttag

SEQ ID NO: 59198 - DNA, 20 bp, Artificial
  CRISPR gRNA sequence
gacttagaggggtggtattt

SEQ ID NO: 59199 - DNA, 20 bp, Artificial
  CRISPR gRNA sequence
gaggggtggtatttcaggat

SEQ ID NO: 59200 - DNA, 20 bp, Artificial
  CRISPR gRNA sequence
tatctggacagaaaatttaa

SEQ ID NO: 59201 - DNA, 20 bp, Artificial
  CRISPR gRNA sequence
caaataacatgaaatgcccc

SEQ ID NO: 59202 - DNA, 20 bp, Artificial
  CRISPR gRNA sequence
aaacttctgttgaacggttt

SEQ ID NO: 59203 - DNA, 20 bp, Artificial
  CRISPR gRNA sequence
tttttttttctacatatgtt

SEQ ID NO: 59204 - DNA, 20 bp, Artificial
  CRISPR gRNA sequence
ctctttgcttgtcctgggga

SEQ ID NO: 59205 - DNA, 20 bp, Artificial
  CRISPR gRNA sequence
ggatcaggtaaaaggagaag

SEQ ID NO: 59206 - DNA, 20 bp, Artificial
  CRISPR gRNA sequence
cttctggaagcttttattta

SEQ ID NO: 59207 - DNA, 20 bp, Artificial
  CRISPR gRNA sequence
atcttccctgtccgaaggaa

SEQ ID NO: 59208 - DNA, 20 bp, Artificial
  CRISPR gRNA sequence
tccctgtccgaaggaagggg

SEQ ID NO: 59209 - DNA, 20 bp, Artificial
  CRISPR gRNA sequence
ttccagctgtatacctgtga

SEQ ID NO: 59210 - DNA, 20 bp, Artificial
  CRISPR gRNA sequence
agctgtatacctgtgatgga

SEQ ID NO: 59211 - DNA, 20 bp, Artificial
  CRISPR gRNA sequence
ctagttaggagcctcactgc

SEQ ID NO: 59212 - DNA, 20 bp, Artificial
  CRISPR gRNA sequence
ctcactgcctgggttcaact

SEQ ID NO: 59213 - DNA, 20 bp, Artificial
  CRISPR gRNA sequence
tgcctgggttcaactctggg

SEQ ID NO: 59214 - DNA, 20 bp, Artificial
  CRISPR gRNA sequence
tctctctccgttgcccaggc

SEQ ID NO: 59215 - DNA, 20 bp, Artificial
  CRISPR gRNA sequence
ctcactgcaacctccgcctc

SEQ ID NO: 59216 - DNA, 20 bp, Artificial
  CRISPR gRNA sequence
ttttctatttttagtggaga

SEQ ID NO: 59217 - DNA, 20 bp, Artificial
  CRISPR gRNA sequence
gccttggcctcacaaagtcc

SEQ ID NO: 59218 - DNA, 20 bp, Artificial
  CRISPR gRNA sequence
ggcctcctcatcttaacttt

SEQ ID NO: 59219 - DNA, 20 bp, Artificial
  CRISPR gRNA sequence
tctcccctgctacggttgtt

SEQ ID NO: 59220 - DNA, 20 bp, Artificial
  CRISPR gRNA sequence
gataatatgtgttacagtct

SEQ ID NO: 59221 - DNA, 20 bp, Artificial
  CRISPR gRNA sequence
ttacagtcttagagtctggt

SEQ ID NO: 59222 - DNA, 20 bp, Artificial
  CRISPR gRNA sequence
gcctctagaagtacaatcgc

SEQ ID NO: 59223 - DNA, 20 bp, Artificial
  CRISPR gRNA sequence
gtcacatatggttggggctc

SEQ ID NO: 59224 - DNA, 20 bp, Artificial
  CRISPR gRNA sequence
tatggttggggctcaggaat

SEQ ID NO: 59225 - DNA, 20 bp, Artificial
  CRISPR gRNA sequence
tttccagatggccccaagcc

SEQ ID NO: 59226 - DNA, 20 bp, Artificial
  CRISPR gRNA sequence
aatgtgtgaccgccattatt

SEQ ID NO: 59227 - DNA, 20 bp, Artificial
  CRISPR gRNA sequence
tcccagtacagttcattttg

SEQ ID NO: 59228 - DNA, 20 bp, Artificial
  CRISPR gRNA sequence
ttgtagaatttttacactgt

SEQ ID NO: 59229 - DNA, 20 bp, Artificial
  CRISPR gRNA sequence
acctgcctgcagagcctcag

SEQ ID NO: 59230 - DNA, 20 bp, Artificial
  CRISPR gRNA sequence
gagtgaccgagcggccccat

SEQ ID NO: 59231 - DNA, 20 bp, Artificial
  CRISPR gRNA sequence
gaccgagcggccccatggga

SEQ ID NO: 59232 - DNA, 20 bp, Artificial
  CRISPR gRNA sequence
agcactgaggccacctccca

SEQ ID NO: 59233 - DNA, 20 bp, Artificial
  CRISPR gRNA sequence
cacctcccaggggatccttt

SEQ ID NO: 59234 - DNA, 20 bp, Artificial
  CRISPR gRNA sequence
ccatccctgtgccctcccag

SEQ ID NO: 59235 - DNA, 20 bp, Artificial
  CRISPR gRNA sequence
tcattctgattccccaggtc

SEQ ID NO: 59236 - DNA, 20 bp, Artificial
  CRISPR gRNA sequence
tttttttttttttttttttt

SEQ ID NO: 59237 - DNA, 20 bp, Artificial
  CRISPR gRNA sequence
cctcactgtgtggcccaggc

SEQ ID NO: 59238 - DNA, 20 bp, Artificial
  CRISPR gRNA sequence
ttgtttgtttgtttttgaga

SEQ ID NO: 59239 - DNA, 20 bp, Artificial
  CRISPR gRNA sequence
ttcgctcttgttgcccaggc

SEQ ID NO: 59240 - DNA, 20 bp, Artificial
  CRISPR gRNA sequence
ctcactgcaacctccgcctc

SEQ ID NO: 59241 - DNA, 20 bp, Artificial
  CRISPR gRNA sequence
gattctcctgcctcagcctc

SEQ ID NO: 59242 - DNA, 20 bp, Artificial
  CRISPR gRNA sequence
gcctcagcctcccgagtagc

SEQ ID NO: 59243 - DNA, 20 bp, Artificial
  CRISPR gRNA sequence
acctcggcctcccaaagtgc

SEQ ID NO: 59244 - DNA, 20 bp, Artificial
  CRISPR gRNA sequence
ctgcattttctaacaagctt

SEQ ID NO: 59245 - DNA, 20 bp, Artificial
  CRISPR gRNA sequence
tgggggccacggtcagcact

SEQ ID NO: 59246 - DNA, 20 bp, Artificial
  CRISPR gRNA sequence
cggtcagcactttgagtagt

SEQ ID NO: 59247 - DNA, 20 bp, Artificial
  CRISPR gRNA sequence
agtgtgggtctagactcaga

SEQ ID NO: 59248 - DNA, 20 bp, Artificial
  CRISPR gRNA sequence
gtgatttcactccctgctgc

SEQ ID NO: 59249 - DNA, 20 bp, Artificial
  CRISPR gRNA sequence
accccctacctcgggcagag

SEQ ID NO: 59250 - DNA, 20 bp, Artificial
  CRISPR gRNA sequence
gtaggtaggaaatgaggtta

SEQ ID NO: 59251 - DNA, 20 bp, Artificial
  CRISPR gRNA sequence
tctcactctgtcgcccaggc

SEQ ID NO: 59252 - DNA, 20 bp, Artificial
  CRISPR gRNA sequence
ttcactgcaacctctgcctc

SEQ ID NO: 59253 - DNA, 20 bp, Artificial
  CRISPR gRNA sequence
gcctcagccgcccaagtagc

SEQ ID NO: 59254 - DNA, 20 bp, Artificial
  CRISPR gRNA sequence
ttgtatatttttagtacaaa

SEQ ID NO: 59255 - DNA, 20 bp, Artificial
  CRISPR gRNA sequence
gcctagactccgaaagtgct

SEQ ID NO: 59256 - DNA, 20 bp, Artificial
  CRISPR gRNA sequence
ggctcagtaaagacaatacc

SEQ ID NO: 59257 - DNA, 20 bp, Artificial
  CRISPR gRNA sequence
aggaaaaacctaccatttgc

SEQ ID NO: 59258 - DNA, 20 bp, Artificial
  CRISPR gRNA sequence
gcccctgagaactgatctgc

SEQ ID NO: 59259 - DNA, 20 bp, Artificial
  CRISPR gRNA sequence
gaactgatctgcgtgaatca

SEQ ID NO: 59260 - DNA, 20 bp, Artificial
  CRISPR gRNA sequence
ctcctcctgggccaggggct

SEQ ID NO: 59261 - DNA, 20 bp, Artificial
  CRISPR gRNA sequence
agaagttttgctaccagcat

SEQ ID NO: 59262 - DNA, 20 bp, Artificial
  CRISPR gRNA sequence
gtgtaaggctttgcaaactg

SEQ ID NO: 59263 - DNA, 20 bp, Artificial
  CRISPR gRNA sequence
tgccaccagcctagaggagc

SEQ ID NO: 59264 - DNA, 20 bp, Artificial
  CRISPR gRNA sequence
accagcctagaggagctgga

SEQ ID NO: 59265 - DNA, 20 bp, Artificial
  CRISPR gRNA sequence
aagcttgggggacccaaaga

SEQ ID NO: 59266 - DNA, 20 bp, Artificial
  CRISPR gRNA sequence
gggacccaaagacaggatgt

SEQ ID NO: 59267 - DNA, 20 bp, Artificial
  CRISPR gRNA sequence
agagtgtcaattgtagcaag

SEQ ID NO: 59268 - DNA, 20 bp, Artificial
  CRISPR gRNA sequence
gaacatcctaaacagaagcc

SEQ ID NO: 59269 - DNA, 20 bp, Artificial
  CRISPR gRNA sequence
ttaggagctgtcactcaaca

SEQ ID NO: 59270 - DNA, 20 bp, Artificial
  CRISPR gRNA sequence
ggggtgatggggctctctgt

SEQ ID NO: 59271 - DNA, 20 bp, Artificial
  CRISPR gRNA sequence
cagcctccccttctttttct

SEQ ID NO: 59272 - DNA, 20 bp, Artificial
  CRISPR gRNA sequence
tccccttctttttctgggag

SEQ ID NO: 59273 - DNA, 20 bp, Artificial
  CRISPR gRNA sequence
gctgccagagctcaggaaga

SEQ ID NO: 59274 - DNA, 20 bp, Artificial
  CRISPR gRNA sequence
ccagagctcaggaagataga

SEQ ID NO: 59275 - DNA, 20 bp, Artificial
  CRISPR gRNA sequence
gccctacagaggagggccac

SEQ ID NO: 59276 - DNA, 20 bp, Artificial
  CRISPR gRNA sequence
gggcctttctgcctcattgt

SEQ ID NO: 59277 - DNA, 20 bp, Artificial
  CRISPR gRNA sequence
tgggtaggtgtgtggtgtcg

SEQ ID NO: 59278 - DNA, 20 bp, Artificial
  CRISPR gRNA sequence
tctcttaggccccctgaagc

SEQ ID NO: 59279 - DNA, 20 bp, Artificial
  CRISPR gRNA sequence
ggcagacccagcagatgtgc

SEQ ID NO: 59280 - DNA, 20 bp, Artificial
  CRISPR gRNA sequence
ccccctcccacagcctctca

SEQ ID NO: 59281 - DNA, 20 bp, Artificial
  CRISPR gRNA sequence
aatagcatcagctcagccgg

SEQ ID NO: 59282 - DNA, 20 bp, Artificial
  CRISPR gRNA sequence
agccgggggagtgcagttgg

SEQ ID NO: 59283 - DNA, 20 bp, Artificial
  CRISPR gRNA sequence
cgttctttgcaggcgcctgg

SEQ ID NO: 59284 - DNA, 20 bp, Artificial
  CRISPR gRNA sequence
aggcgcctggaggagttgat

SEQ ID NO: 59285 - DNA, 20 bp, Artificial
  CRISPR gRNA sequence
cagtgggcacagggcagggc

SEQ ID NO: 59286 - DNA, 20 bp, Artificial
  CRISPR gRNA sequence
cacagggcagggcgggggtc

SEQ ID NO: 59287 - DNA, 20 bp, Artificial
  CRISPR gRNA sequence
ggcttggctgcaatgccctg

SEQ ID NO: 59288 - DNA, 20 bp, Artificial
  CRISPR gRNA sequence
caggagctgccccagcacct

SEQ ID NO: 59289 - DNA, 20 bp, Artificial
  CRISPR gRNA sequence
cagcacctgagggtcctaca

SEQ ID NO: 59290 - DNA, 20 bp, Artificial
  CRISPR gRNA sequence
catgcagggctggtggggag

SEQ ID NO: 59291 - DNA, 20 bp, Artificial
  CRISPR gRNA sequence
agggtcctcgggagcagtgg

SEQ ID NO: 59292 - DNA, 20 bp, Artificial
  CRISPR gRNA sequence
cagttcattgtgccctgtga

SEQ ID NO: 59293 - DNA, 20 bp, Artificial
  CRISPR gRNA sequence
ctgtgagcgggtccctgagg

SEQ ID NO: 59294 - DNA, 20 bp, Artificial
  CRISPR gRNA sequence
tgcagccccatggcagcccc

SEQ ID NO: 59295 - DNA, 20 bp, Artificial
  CRISPR gRNA sequence
catggcagcccccagagtcc

SEQ ID NO: 59296 - DNA, 20 bp, Artificial
  CRISPR gRNA sequence
tttttttttttttttttaga

SEQ ID NO: 59297 - DNA, 20 bp, Artificial
  CRISPR gRNA sequence
tctctctctgtcacccaggc

SEQ ID NO: 59298 - DNA, 20 bp, Artificial
  CRISPR gRNA sequence
ctcactgcaacctccacctc

SEQ ID NO: 59299 - DNA, 20 bp, Artificial
  CRISPR gRNA sequence
aattcttgtgcctcagctac

SEQ ID NO: 59300 - DNA, 20 bp, Artificial
  CRISPR gRNA sequence
gcctcagctaccagagtagc

SEQ ID NO: 59301 - DNA, 20 bp, Artificial
  CRISPR gRNA sequence
acctcagcctccaaaagtgc

SEQ ID NO: 59302 - DNA, 20 bp, Artificial
  CRISPR gRNA sequence
gtgctcccttttccaggcaa

SEQ ID NO: 59303 - DNA, 20 bp, Artificial
  CRISPR gRNA sequence
tgaaggccaggagaggtgtg

SEQ ID NO: 59304 - DNA, 20 bp, Artificial
  CRISPR gRNA sequence
atacacgaaggacccaggtg

SEQ ID NO: 59305 - DNA, 20 bp, Artificial
  CRISPR gRNA sequence
aaggacccaggtgttgaatt

SEQ ID NO: 59306 - DNA, 20 bp, Artificial
  CRISPR gRNA sequence
gggatctcagaccccaaagc

SEQ ID NO: 59307 - DNA, 20 bp, Artificial
  CRISPR gRNA sequence
gatacctacccaggtcctgt

SEQ ID NO: 59308 - DNA, 20 bp, Artificial
  CRISPR gRNA sequence
acccaggtcctgtgtggatg

SEQ ID NO: 59309 - DNA, 20 bp, Artificial
  CRISPR gRNA sequence
ctgcagcctgagacaaggct

SEQ ID NO: 59310 - DNA, 20 bp, Artificial
  CRISPR gRNA sequence
ccctgagcctggcccaggcc

SEQ ID NO: 59311 - DNA, 20 bp, Artificial
  CRISPR gRNA sequence
gagcctggcccaggccctgg

SEQ ID NO: 59312 - DNA, 20 bp, Artificial
  CRISPR gRNA sequence
aggcacggggacagtcctgg

SEQ ID NO: 59313 - DNA, 20 bp, Artificial
  CRISPR gRNA sequence
ggacagtcctgggcgggtct

SEQ ID NO: 59314 - DNA, 20 bp, Artificial
  CRISPR gRNA sequence
gcggaaaacaacctggctgg

SEQ ID NO: 59315 - DNA, 20 bp, Artificial
  CRISPR gRNA sequence
gctcccgctgctcagacaga

SEQ ID NO: 59316 - DNA, 20 bp, Artificial
  CRISPR gRNA sequence
tttgaagtgatagaagcccc

SEQ ID NO: 59317 - DNA, 20 bp, Artificial
  CRISPR gRNA sequence
cctgccctggaagtaatctt

SEQ ID NO: 59318 - DNA, 20 bp, Artificial
  CRISPR gRNA sequence
tgggaaaaggaaaagtcggg

SEQ ID NO: 59319 - DNA, 20 bp, Artificial
  CRISPR gRNA sequence
gaaaagtcgggaggggtcgg

SEQ ID NO: 59320 - DNA, 20 bp, Artificial
  CRISPR gRNA sequence
cacttgagctgcaggtaatg

SEQ ID NO: 59321 - DNA, 20 bp, Artificial
  CRISPR gRNA sequence
accttccttttgggaggcaa

SEQ ID NO: 59322 - DNA, 20 bp, Artificial
  CRISPR gRNA sequence
cttggctgtctcttagcaat

SEQ ID NO: 59323 - DNA, 20 bp, Artificial
  CRISPR gRNA sequence
gggctttgcagtgctgcctc

SEQ ID NO: 59324 - DNA, 20 bp, Artificial
  CRISPR gRNA sequence
gtgctgcctcatgagtaaac

SEQ ID NO: 59325 - DNA, 20 bp, Artificial
  CRISPR gRNA sequence
ttcatctttaacacctaaca

SEQ ID NO: 59326 - DNA, 20 bp, Artificial
  CRISPR gRNA sequence
gattctccctttttaaccaa

SEQ ID NO: 59327 - DNA, 20 bp, Artificial
  CRISPR gRNA sequence
ttttgtaactaccttctata

SEQ ID NO: 59328 - DNA, 20 bp, Artificial
  CRISPR gRNA sequence
ttttttttttttttttgaga

SEQ ID NO: 59329 - DNA, 20 bp, Artificial
  CRISPR gRNA sequence
tctccctctgttacccaggc

SEQ ID NO: 59330 - DNA, 20 bp, Artificial
  CRISPR gRNA sequence
ctcactgcaacctccacctg

SEQ ID NO: 59331 - DNA, 20 bp, Artificial
  CRISPR gRNA sequence
gattctcctgcctcagcctc

SEQ ID NO: 59332 - DNA, 20 bp, Artificial
  CRISPR gRNA sequence
gcctcagcctcctgagtagc

SEQ ID NO: 59333 - DNA, 20 bp, Artificial
  CRISPR gRNA sequence
ttttgtatttttagtagaga

SEQ ID NO: 59334 - DNA, 20 bp, Artificial
  CRISPR gRNA sequence
accttggcctcccaaagtgc

SEQ ID NO: 59335 - DNA, 20 bp, Artificial
  CRISPR gRNA sequence
ccctaccctgcaggctgtcc

SEQ ID NO: 59336 - DNA, 20 bp, Artificial
  CRISPR gRNA sequence
ggctgtcctggaatctcctc

SEQ ID NO: 59337 - DNA, 20 bp, Artificial
  CRISPR gRNA sequence
ccgcagatgggccggctgaa

SEQ ID NO: 59338 - DNA, 20 bp, Artificial
  CRISPR gRNA sequence
gatgggccggctgaagagag

SEQ ID NO: 59339 - DNA, 20 bp, Artificial
  CRISPR gRNA sequence
ggagtatgaggggccggggg

SEQ ID NO: 59340 - DNA, 20 bp, Artificial
  CRISPR gRNA sequence
ccgggaacaccaagaggcca

SEQ ID NO: 59341 - DNA, 20 bp, Artificial
  CRISPR gRNA sequence
gcctcccagaaagcccttcc

SEQ ID NO: 59342 - DNA, 20 bp, Artificial
  CRISPR gRNA sequence
cctgccaggcttagttcccc

SEQ ID NO: 59343 - DNA, 20 bp, Artificial
  CRISPR gRNA sequence
caccagtcccctgttgtctt

SEQ ID NO: 59344 - DNA, 20 bp, Artificial
  CRISPR gRNA sequence
gtccactgagaagcctggag

SEQ ID NO: 59345 - DNA, 20 bp, Artificial
  CRISPR gRNA sequence
cctggctgaaggactggccc

SEQ ID NO: 59346 - DNA, 20 bp, Artificial
  CRISPR gRNA sequence
taacagaggcctgcaggggc

SEQ ID NO: 59347 - DNA, 20 bp, Artificial
  CRISPR gRNA sequence
ggcctgcaggggcagggatg

SEQ ID NO: 59348 - DNA, 20 bp, Artificial
  CRISPR gRNA sequence
gaggcggcagggcctgggct

SEQ ID NO: 59349 - DNA, 20 bp, Artificial
  CRISPR gRNA sequence
gagacttggaccactccacc

SEQ ID NO: 59350 - DNA, 20 bp, Artificial
  CRISPR gRNA sequence
gaatttggcagcaagcagac

SEQ ID NO: 59351 - DNA, 20 bp, Artificial
  CRISPR gRNA sequence
aattttctcatctgtgaaat

SEQ ID NO: 59352 - DNA, 20 bp, Artificial
  CRISPR gRNA sequence
tactgatagtatctacctca

SEQ ID NO: 59353 - DNA, 20 bp, Artificial
  CRISPR gRNA sequence
ctgctagatttctagcagat

SEQ ID NO: 59354 - DNA, 20 bp, Artificial
  CRISPR gRNA sequence
agtaaaacatcttgaagaaa

SEQ ID NO: 59355 - DNA, 20 bp, Artificial
  CRISPR gRNA sequence
tatttgcacaaatgtgtcat

SEQ ID NO: 59356 - DNA, 20 bp, Artificial
  CRISPR gRNA sequence
ctatctcccagggaggaagg

SEQ ID NO: 59357 - DNA, 20 bp, Artificial
  CRISPR gRNA sequence
gaggactcaggaggcaggtg

SEQ ID NO: 59358 - DNA, 20 bp, Artificial
  CRISPR gRNA sequence
acgacagatggcaaagatgg

SEQ ID NO: 59359 - DNA, 20 bp, Artificial
  CRISPR gRNA sequence
cagatggcaaagatgggagg

SEQ ID NO: 59360 - DNA, 20 bp, Artificial
  CRISPR gRNA sequence
tggcaaagatgggaggatga

SEQ ID NO: 59361 - DNA, 20 bp, Artificial
  CRISPR gRNA sequence
tatctgtgccccacagcctc

SEQ ID NO: 59362 - DNA, 20 bp, Artificial
  CRISPR gRNA sequence
acaaccagccccaggcccct

SEQ ID NO: 59363 - DNA, 20 bp, Artificial
  CRISPR gRNA sequence
gatggccccctcaagacctt

SEQ ID NO: 59364 - DNA, 20 bp, Artificial
  CRISPR gRNA sequence
atgatccacctttcgcccac

SEQ ID NO: 59365 - DNA, 20 bp, Artificial
  CRISPR gRNA sequence
tctgcactccacccaggagg

SEQ ID NO: 59366 - DNA, 20 bp, Artificial
  CRISPR gRNA sequence
acttttttgggaaccaggag

SEQ ID NO: 59367 - DNA, 20 bp, Artificial
  CRISPR gRNA sequence
caggagctgggtctggacaa

SEQ ID NO: 59368 - DNA, 20 bp, Artificial
  CRISPR gRNA sequence
aaggagtaccctgcattacg

SEQ ID NO: 59369 - DNA, 20 bp, Artificial
  CRISPR gRNA sequence
ggggacatgcgacacacaat

SEQ ID NO: 59370 - DNA, 20 bp, Artificial
  CRISPR gRNA sequence
tgtggcacgtgttctgtggc

SEQ ID NO: 59371 - DNA, 20 bp, Artificial
  CRISPR gRNA sequence
ggtgctggcatcccaagtag

SEQ ID NO: 59372 - DNA, 20 bp, Artificial
  CRISPR gRNA sequence
ttccgcccgagctgggaggg

SEQ ID NO: 59373 - DNA, 20 bp, Artificial
  CRISPR gRNA sequence
ggaggtagggccagcctggc

SEQ ID NO: 59374 - DNA, 20 bp, Artificial
  CRISPR gRNA sequence
caaagccaggtctaatggta

SEQ ID NO: 59375 - DNA, 20 bp, Artificial
  CRISPR gRNA sequence
caagacaataagctaggcta

SEQ ID NO: 59376 - DNA, 20 bp, Artificial
  CRISPR gRNA sequence
gggtccagctactactttgg

SEQ ID NO: 59377 - DNA, 20 bp, Artificial
  CRISPR gRNA sequence
actactttggtgggattcag

SEQ ID NO: 59378 - DNA, 20 bp, Artificial
  CRISPR gRNA sequence
tgttacttccaaggagaacc

SEQ ID NO: 59379 - DNA, 20 bp, Artificial
  CRISPR gRNA sequence
aatggtattccacgtctagc

SEQ ID NO: 59380 - DNA, 20 bp, Artificial
  CRISPR gRNA sequence
gctgtccagtccttacggca

SEQ ID NO: 59381 - DNA, 20 bp, Artificial
  CRISPR gRNA sequence
tgaaccacctctgacttcag

SEQ ID NO: 59382 - DNA, 20 bp, Artificial
  CRISPR gRNA sequence
cagtggggtaagaggaaaca

SEQ ID NO: 59383 - DNA, 20 bp, Artificial
  CRISPR gRNA sequence
cattggattcacgctagacg

SEQ ID NO: 59384 - DNA, 20 bp, Artificial
  CRISPR gRNA sequence
tttattgatcaagcctggct

SEQ ID NO: 59385 - DNA, 20 bp, Artificial
  CRISPR gRNA sequence
ccttggaagtaacaagaaca

SEQ ID NO: 59386 - DNA, 20 bp, Artificial
  CRISPR gRNA sequence
tgaagtgcatggagactcac

SEQ ID NO: 59387 - DNA, 20 bp, Artificial
  CRISPR gRNA sequence
agctagtatgtaagtaaggg

SEQ ID NO: 59388 - DNA, 20 bp, Artificial
  CRISPR gRNA sequence
aggagtcatcaagtttatag

SEQ ID NO: 59389 - DNA, 20 bp, Artificial
  CRISPR gRNA sequence
agtttatagatgggtaggct

SEQ ID NO: 59390 - DNA, 20 bp, Artificial
  CRISPR gRNA sequence
ggcaggaggggacttaatgg

SEQ ID NO: 59391 - DNA, 20 bp, Artificial
  CRISPR gRNA sequence
ctgaggtcatctggccagcc

SEQ ID NO: 59392 - DNA, 20 bp, Artificial
  CRISPR gRNA sequence
caatcatgtatcctgctact

SEQ ID NO: 59393 - DNA, 20 bp, Artificial
  CRISPR gRNA sequence
tcatgtaacgccacatgtca

SEQ ID NO: 59394 - DNA, 20 bp, Artificial
  CRISPR gRNA sequence
cacacatatcccacgtaatg

SEQ ID NO: 59395 - DNA, 20 bp, Artificial
  CRISPR gRNA sequence
ggacacacgtatccttcctc

SEQ ID NO: 59396 - DNA, 20 bp, Artificial
  CRISPR gRNA sequence
cacgtatccttcctcctggg

SEQ ID NO: 59397 - DNA, 20 bp, Artificial
  CRISPR gRNA sequence
cctgccgaggctcttctttc

SEQ ID NO: 59398 - DNA, 20 bp, Artificial
  CRISPR gRNA sequence
attatcccagtgggcgaaag

SEQ ID NO: 59399 - DNA, 20 bp, Artificial
  CRISPR gRNA sequence
gtgggcgaaaggtggatcat

SEQ ID NO: 59400 - DNA, 20 bp, Artificial
  CRISPR gRNA sequence
catttgggtgcatcacttgg

SEQ ID NO: 59401 - DNA, 20 bp, Artificial
  CRISPR gRNA sequence
aggtgctgggccatgtcgca

SEQ ID NO: 59402 - DNA, 20 bp, Artificial
  CRISPR gRNA sequence
ctgggccatgtcgcagggaa

SEQ ID NO: 59403 - DNA, 20 bp, Artificial
  CRISPR gRNA sequence
caaaaaggtagagctgtgcc

SEQ ID NO: 59404 - DNA, 20 bp, Artificial
  CRISPR gRNA sequence
cagcatagctgacctaggga

SEQ ID NO: 59405 - DNA, 20 bp, Artificial
  CRISPR gRNA sequence
gtgtaccccacacctgcctc

SEQ ID NO: 59406 - DNA, 20 bp, Artificial
  CRISPR gRNA sequence
aaatctagcaggttgacaat

SEQ ID NO: 59407 - DNA, 20 bp, Artificial
  CRISPR gRNA sequence
tgcttactatgtgccaggca

SEQ ID NO: 59408 - DNA, 20 bp, Artificial
  CRISPR gRNA sequence
catttcacagatgagaaaat

SEQ ID NO: 59409 - DNA, 20 bp, Artificial
  CRISPR gRNA sequence
aaaattggggttcagagagg

SEQ ID NO: 59410 - DNA, 20 bp, Artificial
  CRISPR gRNA sequence
cagttggcaagtggcagagc

SEQ ID NO: 59411 - DNA, 20 bp, Artificial
  CRISPR gRNA sequence
gcttgctgccaaattcttgg

SEQ ID NO: 59412 - DNA, 20 bp, Artificial
  CRISPR gRNA sequence
aggccctgccgcctcctcca

SEQ ID NO: 59413 - DNA, 20 bp, Artificial
  CRISPR gRNA sequence
cagggagtcccattagatct

SEQ ID NO: 59414 - DNA, 20 bp, Artificial
  CRISPR gRNA sequence
gcccctgcaggcctctgtta

SEQ ID NO: 59415 - DNA, 20 bp, Artificial
  CRISPR gRNA sequence
ggcctctgttaccggatgac

SEQ ID NO: 59416 - DNA, 20 bp, Artificial
  CRISPR gRNA sequence
ggaaagagaaacacggccat

SEQ ID NO: 59417 - DNA, 20 bp, Artificial
  CRISPR gRNA sequence
agagaaacacggccatgaga

SEQ ID NO: 59418 - DNA, 20 bp, Artificial
  CRISPR gRNA sequence
acggccatgagaatgggtgt

SEQ ID NO: 59419 - DNA, 20 bp, Artificial
  CRISPR gRNA sequence
ggcaggggcttggaacaggc

SEQ ID NO: 59420 - DNA, 20 bp, Artificial
  CRISPR gRNA sequence
cagtggcctcttggtgttcc

SEQ ID NO: 59421 - DNA, 20 bp, Artificial
  CRISPR gRNA sequence
ggagattccaggacagcctg

SEQ ID NO: 59422 - DNA, 20 bp, Artificial
  CRISPR gRNA sequence
tccaggacagcctgcagggt

SEQ ID NO: 59423 - DNA, 20 bp, Artificial
  CRISPR gRNA sequence
gcaggagagcaaggaggtcg

SEQ ID NO: 59424 - DNA, 20 bp, Artificial
  CRISPR gRNA sequence
cgaggggtggagacaaggca

SEQ ID NO: 59425 - DNA, 20 bp, Artificial
  CRISPR gRNA sequence
aaggcagtgaatggggaaag

SEQ ID NO: 59426 - DNA, 20 bp, Artificial
  CRISPR gRNA sequence
agggtgccagtcgtgggggc

SEQ ID NO: 59427 - DNA, 20 bp, Artificial
  CRISPR gRNA sequence
tttcaagagaggccacctga

SEQ ID NO: 59428 - DNA, 20 bp, Artificial
  CRISPR gRNA sequence
gtgtcctcccctgaagacgt

SEQ ID NO: 59429 - DNA, 20 bp, Artificial
  CRISPR gRNA sequence
tgctcccctccccgtcaagt

SEQ ID NO: 59430 - DNA, 20 bp, Artificial
  CRISPR gRNA sequence
actaaaaatacaaaaattag

SEQ ID NO: 59431 - DNA, 20 bp, Artificial
  CRISPR gRNA sequence
tactcaggaggctgaggcag

SEQ ID NO: 59432 - DNA, 20 bp, Artificial
  CRISPR gRNA sequence
ttgcaccactgcactccagc

SEQ ID NO: 59433 - DNA, 20 bp, Artificial
  CRISPR gRNA sequence
catatgcccttcctaagatg

SEQ ID NO: 59434 - DNA, 20 bp, Artificial
  CRISPR gRNA sequence
aacccttttggttaaaaagg

SEQ ID NO: 59435 - DNA, 20 bp, Artificial
  CRISPR gRNA sequence
tccagtgttaggtgttaaag

SEQ ID NO: 59436 - DNA, 20 bp, Artificial
  CRISPR gRNA sequence
tttcgctttggtgtaatgag

SEQ ID NO: 59437 - DNA, 20 bp, Artificial
  CRISPR gRNA sequence
atgagaagggttaagacctt

SEQ ID NO: 59438 - DNA, 20 bp, Artificial
  CRISPR gRNA sequence
tttgtcctccataccatggt

SEQ ID NO: 59439 - DNA, 20 bp, Artificial
  CRISPR gRNA sequence
ttagggtcccaggctagtcc

SEQ ID NO: 59440 - DNA, 20 bp, Artificial
  CRISPR gRNA sequence
ctgcaaagccccaaggtctg

SEQ ID NO: 59441 - DNA, 20 bp, Artificial
  CRISPR gRNA sequence
cacggccagccagcaggtct

SEQ ID NO: 59442 - DNA, 20 bp, Artificial
  CRISPR gRNA sequence
aagtgttaaaatgtctttga

SEQ ID NO: 59443 - DNA, 20 bp, Artificial
  CRISPR gRNA sequence
aaatgtctttgagaggatgt

SEQ ID NO: 59444 - DNA, 20 bp, Artificial
  CRISPR gRNA sequence
ctttgagaggatgtctgagt

SEQ ID NO: 59445 - DNA, 20 bp, Artificial
  CRISPR gRNA sequence
aaatgggaggactggccaga

SEQ ID NO: 59446 - DNA, 20 bp, Artificial
  CRISPR gRNA sequence
atcttacaggaaaccaggct

SEQ ID NO: 59447 - DNA, 20 bp, Artificial
  CRISPR gRNA sequence
gctggggatggagaagggca

SEQ ID NO: 59448 - DNA, 20 bp, Artificial
  CRISPR gRNA sequence
ggatggagaagggcatggga

SEQ ID NO: 59449 - DNA, 20 bp, Artificial
  CRISPR gRNA sequence
agaagggcatgggatgggat

SEQ ID NO: 59450 - DNA, 20 bp, Artificial
  CRISPR gRNA sequence
tgggatgggatgggggttgt

SEQ ID NO: 59451 - DNA, 20 bp, Artificial
  CRISPR gRNA sequence
gatgggggttgtttgagtca

SEQ ID NO: 59452 - DNA, 20 bp, Artificial
  CRISPR gRNA sequence
ggtcctgcctccagagccac

SEQ ID NO: 59453 - DNA, 20 bp, Artificial
  CRISPR gRNA sequence
cctccagagccaccagggtc

SEQ ID NO: 59454 - DNA, 20 bp, Artificial
  CRISPR gRNA sequence
ggttgttttccgccaagctg

SEQ ID NO: 59455 - DNA, 20 bp, Artificial
  CRISPR gRNA sequence
acctgatctcttccaaatgg

SEQ ID NO: 59456 - DNA, 20 bp, Artificial
  CRISPR gRNA sequence
ccccacctgggcccagatgg

SEQ ID NO: 59457 - DNA, 20 bp, Artificial
  CRISPR gRNA sequence
ggtaggctggggaaagagga

SEQ ID NO: 59458 - DNA, 20 bp, Artificial
  CRISPR gRNA sequence
attccccatccacacaggac

SEQ ID NO: 59459 - DNA, 20 bp, Artificial
  CRISPR gRNA sequence
ggtatcaaggaccctggctt

SEQ ID NO: 59460 - DNA, 20 bp, Artificial
  CRISPR gRNA sequence
tgagatcccaaattcaacac

SEQ ID NO: 59461 - DNA, 20 bp, Artificial
  CRISPR gRNA sequence
aacacctgggtccttcgtgt

SEQ ID NO: 59462 - DNA, 20 bp, Artificial
  CRISPR gRNA sequence
cagcacttttggaggctgag

SEQ ID NO: 59463 - DNA, 20 bp, Artificial
  CRISPR gRNA sequence
acttttggaggctgaggtgg

SEQ ID NO: 59464 - DNA, 20 bp, Artificial
  CRISPR gRNA sequence
tgggtggatcacttgaggcc

SEQ ID NO: 59465 - DNA, 20 bp, Artificial
  CRISPR gRNA sequence
tactctggtagctgaggcac

SEQ ID NO: 59466 - DNA, 20 bp, Artificial
  CRISPR gRNA sequence
ttgcaccactgcactccagc

SEQ ID NO: 59467 - DNA, 20 bp, Artificial
  CRISPR gRNA sequence
gctcctgcgaagccctctgc

SEQ ID NO: 59468 - DNA, 20 bp, Artificial
  CRISPR gRNA sequence
gctcacagggcacaatgaac

SEQ ID NO: 59469 - DNA, 20 bp, Artificial
  CRISPR gRNA sequence
aactgaggctgagaaggggc

SEQ ID NO: 59470 - DNA, 20 bp, Artificial
  CRISPR gRNA sequence
ggcagggaaggaacaggcag

SEQ ID NO: 59471 - DNA, 20 bp, Artificial
  CRISPR gRNA sequence
gggaaggaacaggcaggaga

SEQ ID NO: 59472 - DNA, 20 bp, Artificial
  CRISPR gRNA sequence
ctgagccagccccagggctg

SEQ ID NO: 59473 - DNA, 20 bp, Artificial
  CRISPR gRNA sequence
agccaagcctggaagaggag

SEQ ID NO: 59474 - DNA, 20 bp, Artificial
  CRISPR gRNA sequence
gaagaggagaggaatgagca

SEQ ID NO: 59475 - DNA, 20 bp, Artificial
  CRISPR gRNA sequence
ccgacaccccagcacatctg

SEQ ID NO: 59476 - DNA, 20 bp, Artificial
  CRISPR gRNA sequence
gcccagagaagagcaggggc

SEQ ID NO: 59477 - DNA, 20 bp, Artificial
  CRISPR gRNA sequence
ctgagctctggcagcccagg

SEQ ID NO: 59478 - DNA, 20 bp, Artificial
  CRISPR gRNA sequence
gagagccccatcaccccatg

SEQ ID NO: 59479 - DNA, 20 bp, Artificial
  CRISPR gRNA sequence
cctaacccttggcttctgtt

SEQ ID NO: 59480 - DNA, 20 bp, Artificial
  CRISPR gRNA sequence
gacactcttacatcctgtct

SEQ ID NO: 59481 - DNA, 20 bp, Artificial
  CRISPR gRNA sequence
gttgtttacacagtgtagaa

SEQ ID NO: 59482 - DNA, 20 bp, Artificial
  CRISPR gRNA sequence
ctttcccggccaaaattgtc

SEQ ID NO: 59483 - DNA, 20 bp, Artificial
  CRISPR gRNA sequence
aattgtcctgggtctggggg

SEQ ID NO: 59484 - DNA, 20 bp, Artificial
  CRISPR gRNA sequence
ctgttcagtctggaaaagca

SEQ ID NO: 59485 - DNA, 20 bp, Artificial
  CRISPR gRNA sequence
ttgcaaagccttacacgccc

SEQ ID NO: 59486 - DNA, 20 bp, Artificial
  CRISPR gRNA sequence
atgctggtagcaaaacttct

SEQ ID NO: 59487 - DNA, 20 bp, Artificial
  CRISPR gRNA sequence
tctgggggtcatggcaggtg

SEQ ID NO: 59488 - DNA, 20 bp, Artificial
  CRISPR gRNA sequence
tggggagtggtgagcaaggt

SEQ ID NO: 59489 - DNA, 20 bp, Artificial
  CRISPR gRNA sequence
gagacttagggacttgcagg

SEQ ID NO: 59490 - DNA, 20 bp, Artificial
  CRISPR gRNA sequence
tccagagcccctggcccagg

SEQ ID NO: 59491 - DNA, 20 bp, Artificial
  CRISPR gRNA sequence
ttcacctcagcctctgtgtc

SEQ ID NO: 59492 - DNA, 20 bp, Artificial
  CRISPR gRNA sequence
ggatctccgggctggcccgg

SEQ ID NO: 59493 - DNA, 20 bp, Artificial
  CRISPR gRNA sequence
ggctgaatgccactttcacg

SEQ ID NO: 59494 - DNA, 20 bp, Artificial
  CRISPR gRNA sequence
ggtaggtttttccttaaacc

SEQ ID NO: 59495 - DNA, 20 bp, Artificial
  CRISPR gRNA sequence
gagccctgaccttgctctgc

SEQ ID NO: 59496 - DNA, 20 bp, Artificial
  CRISPR gRNA sequence
acctgtattcccagcacttt

SEQ ID NO: 59497 - DNA, 20 bp, Artificial
  CRISPR gRNA sequence
cactttcggagtctaggcag

SEQ ID NO: 59498 - DNA, 20 bp, Artificial
  CRISPR gRNA sequence
caggtggatcatttgaggtc

SEQ ID NO: 59499 - DNA, 20 bp, Artificial
  CRISPR gRNA sequence
tacttgggcggctgaggcac

SEQ ID NO: 59500 - DNA, 20 bp, Artificial
  CRISPR gRNA sequence
ctgcactccagcctgggcga

SEQ ID NO: 59501 - DNA, 20 bp, Artificial
  CRISPR gRNA sequence
aaataaataaatacacttta

SEQ ID NO: 59502 - DNA, 20 bp, Artificial
  CRISPR gRNA sequence
cacctttcagtaaattaatt

SEQ ID NO: 59503 - DNA, 20 bp, Artificial
  CRISPR gRNA sequence
actctgctctgcccgaggta

SEQ ID NO: 59504 - DNA, 20 bp, Artificial
  CRISPR gRNA sequence
gtagggggtaggaggtgtac

SEQ ID NO: 59505 - DNA, 20 bp, Artificial
  CRISPR gRNA sequence
gcaatgctttgtgtcactgc

SEQ ID NO: 59506 - DNA, 20 bp, Artificial
  CRISPR gRNA sequence
gtttatttatcctagcagca

SEQ ID NO: 59507 - DNA, 20 bp, Artificial
  CRISPR gRNA sequence
gcagggagtgaaatcacaaa

SEQ ID NO: 59508 - DNA, 20 bp, Artificial
  CRISPR gRNA sequence
gtgtaggaaggccaccccat

SEQ ID NO: 59509 - DNA, 20 bp, Artificial
  CRISPR gRNA sequence
aaagtgctgaccgtggcccc

SEQ ID NO: 59510 - DNA, 20 bp, Artificial
  CRISPR gRNA sequence
cggaagcttgttagaaaatg

SEQ ID NO: 59511 - DNA, 20 bp, Artificial
  CRISPR gRNA sequence
tactcgggaggctgaggcag

SEQ ID NO: 59512 - DNA, 20 bp, Artificial
  CRISPR gRNA sequence
caaaaaaagaaatgctaagt

SEQ ID NO: 59513 - DNA, 20 bp, Artificial
  CRISPR gRNA sequence
ctgtagtcccagctgcttag

SEQ ID NO: 59514 - DNA, 20 bp, Artificial
  CRISPR gRNA sequence
tgcttaggagggtgaggcag

SEQ ID NO: 59515 - DNA, 20 bp, Artificial
  CRISPR gRNA sequence
caggaggatcacgttcgccc

SEQ ID NO: 59516 - DNA, 20 bp, Artificial
  CRISPR gRNA sequence
aaaaaaaagcacagtctagg

SEQ ID NO: 59517 - DNA, 20 bp, Artificial
  CRISPR gRNA sequence
taggcagaattccagacctg

SEQ ID NO: 59518 - DNA, 20 bp, Artificial
  CRISPR gRNA sequence
gaattccagacctggggaat

SEQ ID NO: 59519 - DNA, 20 bp, Artificial
  CRISPR gRNA sequence
tgagcattttaacaagagcc

SEQ ID NO: 59520 - DNA, 20 bp, Artificial
  CRISPR gRNA sequence
gtgaactgtgtgtgtgcctc

SEQ ID NO: 59521 - DNA, 20 bp, Artificial
  CRISPR gRNA sequence
gcacccacctgggagggcac

SEQ ID NO: 59522 - DNA, 20 bp, Artificial
  CRISPR gRNA sequence
ggcacagggatgggcctggg

SEQ ID NO: 59523 - DNA, 20 bp, Artificial
  CRISPR gRNA sequence
gggcctgggagggatccgca

SEQ ID NO: 59524 - DNA, 20 bp, Artificial
  CRISPR gRNA sequence
gaggtggcctcagtgcttcc

SEQ ID NO: 59525 - DNA, 20 bp, Artificial
  CRISPR gRNA sequence
ttccctggatgtggtcccaa

SEQ ID NO: 59526 - DNA, 20 bp, Artificial
  CRISPR gRNA sequence
caggtcatctggcttagtct

SEQ ID NO: 59527 - DNA, 20 bp, Artificial
  CRISPR gRNA sequence
gccaggtgaacttgacatct

SEQ ID NO: 59528 - DNA, 20 bp, Artificial
  CRISPR gRNA sequence
ggtggggcactgtccagtct

SEQ ID NO: 59529 - DNA, 20 bp, Artificial
  CRISPR gRNA sequence
tccaaatgctgtttctctgc

SEQ ID NO: 59530 - DNA, 20 bp, Artificial
  CRISPR gRNA sequence
gcttggggccatctggaaag

SEQ ID NO: 59531 - DNA, 20 bp, Artificial
  CRISPR gRNA sequence
gtgaggaacaccaaggttca

SEQ ID NO: 59532 - DNA, 20 bp, Artificial
  CRISPR gRNA sequence
ccccagcctaggcaggagag

SEQ ID NO: 59533 - DNA, 20 bp, Artificial
  CRISPR gRNA sequence
ataacaatagctagcacttg

SEQ ID NO: 59534 - DNA, 20 bp, Artificial
  CRISPR gRNA sequence
agagaggctgagggactggc

SEQ ID NO: 59535 - DNA, 20 bp, Artificial
  CRISPR gRNA sequence
caggactttgtgaggccaag

SEQ ID NO: 59536 - DNA, 20 bp, Artificial
  CRISPR gRNA sequence
actttgtgaggccaaggcgg

SEQ ID NO: 59537 - DNA, 20 bp, Artificial
  CRISPR gRNA sequence
cgggtgaatcacctgaggtc

SEQ ID NO: 59538 - DNA, 20 bp, Artificial
  CRISPR gRNA sequence
tacttgggaggctgaggcag

SEQ ID NO: 59539 - DNA, 20 bp, Artificial
  CRISPR gRNA sequence
gcctgggcaacggagagaga

SEQ ID NO: 59540 - DNA, 20 bp, Artificial
  CRISPR gRNA sequence
tcttggttggctcagaacag

SEQ ID NO: 59541 - DNA, 20 bp, Artificial
  CRISPR gRNA sequence
tcagaacagaagagtttttc

SEQ ID NO: 59542 - DNA, 20 bp, Artificial
  CRISPR gRNA sequence
tttttcctggatgtgggact

SEQ ID NO: 59543 - DNA, 20 bp, Artificial
  CRISPR gRNA sequence
gaagtgtcagttaccccacc

SEQ ID NO: 59544 - DNA, 20 bp, Artificial
  CRISPR gRNA sequence
caggcagtgaggctcctaac

SEQ ID NO: 59545 - DNA, 20 bp, Artificial
  CRISPR gRNA sequence
atacagctggaagaagctga

SEQ ID NO: 59546 - DNA, 20 bp, Artificial
  CRISPR gRNA sequence
ggaagaagctgactggattt

SEQ ID NO: 59547 - DNA, 20 bp, Artificial
  CRISPR gRNA sequence
tttgagggtaactgcctgtg

SEQ ID NO: 59548 - DNA, 20 bp, Artificial
  CRISPR gRNA sequence
agaaaaaggcccccaggggc

SEQ ID NO: 59549 - DNA, 20 bp, Artificial
  CRISPR gRNA sequence
aaaggcccccaggggcatgg

SEQ ID NO: 59550 - DNA, 20 bp, Artificial
  CRISPR gRNA sequence
cccagctcagtacatatttg

SEQ ID NO: 59551 - DNA, 20 bp, Artificial
  CRISPR gRNA sequence
agtacatatttgtcgaatgc

SEQ ID NO: 59552 - DNA, 20 bp, Artificial
  CRISPR gRNA sequence
tcgaatgcatgaatgagcca

SEQ ID NO: 59553 - DNA, 20 bp, Artificial
  CRISPR gRNA sequence
aagcaaagagggacaagcgg

SEQ ID NO: 59554 - DNA, 20 bp, Artificial
  CRISPR gRNA sequence
gtcaaaaggctactttcaag

SEQ ID NO: 59555 - DNA, 20 bp, Artificial
  CRISPR gRNA sequence
gttcaacagaagttttctca

SEQ ID NO: 59556 - DNA, 20 bp, Artificial
  CRISPR gRNA sequence
tgtccagatactgtctaaac

SEQ ID NO: 59557 - DNA, 20 bp, Artificial
  CRISPR gRNA sequence
aggctgtttctggcatttct

SEQ ID NO: 59558 - DNA, 20 bp, Artificial
  CRISPR gRNA sequence
gatgacttcaaattatgggg

SEQ ID NO: 59559 - DNA, 20 bp, Artificial
  CRISPR gRNA sequence
tctgtagatttttttctgcc

SEQ ID NO: 59560 - DNA, 20 bp, Artificial
  CRISPR gRNA sequence
acccctctaagtccagaaga

SEQ ID NO: 59561 - DNA, 20 bp, Artificial
  CRISPR gRNA sequence
gcccaggtctggccagtgag

SEQ ID NO: 59562 - DNA, 20 bp, Artificial
  CRISPR gRNA sequence
cacagccacagtgattgctt

SEQ ID NO: 59563 - DNA, 20 bp, Artificial
  CRISPR gRNA sequence
ccttttgttgtaaccacaga

SEQ ID NO: 59564 - DNA, 20 bp, Artificial
  CRISPR gRNA sequence
gaaagtaagcctgcaggtgc

SEQ ID NO: 59565 - DNA, 20 bp, Artificial
  CRISPR gRNA sequence
gaagccaaggtggacagaga

SEQ ID NO: 59566 - DNA, 20 bp, Artificial
  CRISPR gRNA sequence
gacagagaaagagtaagggc

SEQ ID NO: 59567 - DNA, 20 bp, Artificial
  CRISPR gRNA sequence
gcctgacaaatatagaaccc

SEQ ID NO: 59568 - DNA, 20 bp, Artificial
  CRISPR gRNA sequence
taagccaatatatttctgtc

SEQ ID NO: 59569 - DNA, 20 bp, Artificial
  CRISPR gRNA sequence
tatttctgtcttggattgct

SEQ ID NO: 59570 - DNA, 20 bp, Artificial
  CRISPR gRNA sequence
ttcttgctggcactgagatc

SEQ ID NO: 59571 - DNA, 20 bp, Artificial
  CRISPR gRNA sequence
tgtaagggcattcagctcac

SEQ ID NO: 59572 - DNA, 20 bp, Artificial
  CRISPR gRNA sequence
gcagaagaccaggcagaggc

SEQ ID NO: 59573 - DNA, 20 bp, Artificial
  CRISPR gRNA sequence
cctcgctgtccaggttcccc

SEQ ID NO: 59574 - DNA, 20 bp, Artificial
  CRISPR gRNA sequence
ctagctccagggctcaggct

SEQ ID NO: 59575 - DNA, 20 bp, Artificial
  CRISPR gRNA sequence
cccagctgagaaactatgcc

SEQ ID NO: 59576 - DNA, 20 bp, Artificial
  CRISPR gRNA sequence
tagataaggcaatcaaagcc

SEQ ID NO: 59577 - DNA, 20 bp, Artificial
  CRISPR gRNA sequence
gccatgcccacagcccctct

SEQ ID NO: 59578 - DNA, 20 bp, Artificial
  CRISPR gRNA sequence
ctgctgcacttcatcagggg

SEQ ID NO: 59579 - DNA, 20 bp, Artificial
  CRISPR gRNA sequence
cagctggaggtcagcctggt

SEQ ID NO: 59580 - DNA, 20 bp, Artificial
  CRISPR gRNA sequence
caggtcaggcaggagccgcc

SEQ ID NO: 59581 - DNA, 20 bp, Artificial
  CRISPR gRNA sequence
cgccctgggtcttgggagct

SEQ ID NO: 59582 - DNA, 20 bp, Artificial
  CRISPR gRNA sequence
gaatgctggtggcagagggc

SEQ ID NO: 59583 - DNA, 20 bp, Artificial
  CRISPR gRNA sequence
ggtggcagagggcaaggatg

SEQ ID NO: 59584 - DNA, 20 bp, Artificial
  CRISPR gRNA sequence
agagggcaaggatgtggggt

SEQ ID NO: 59585 - DNA, 20 bp, Artificial
  CRISPR gRNA sequence
agcaacttcacaacttaagc

SEQ ID NO: 59586 - DNA, 20 bp, Artificial
  CRISPR gRNA sequence
tcaaagatctctctgtccta

SEQ ID NO: 59587 - DNA, 20 bp, Artificial
  CRISPR gRNA sequence
tatttattttttgtagagat

SEQ ID NO: 59588 - DNA, 20 bp, Artificial
  CRISPR gRNA sequence
atttttcctcctcggcctcc

SEQ ID NO: 59589 - DNA, 20 bp, Artificial
  CRISPR gRNA sequence
tcctcggcctcccagagtgc

SEQ ID NO: 59590 - DNA, 20 bp, Artificial
  CRISPR gRNA sequence
tgagccactgttcccagccc

SEQ ID NO: 59591 - DNA, 20 bp, Artificial
  CRISPR gRNA sequence
ggctgctaaaatttgccaat

SEQ ID NO: 59592 - DNA, 20 bp, Artificial
  CRISPR gRNA sequence
actaaatgagacgtgtgatc

SEQ ID NO: 59593 - DNA, 20 bp, Artificial
  CRISPR gRNA sequence
atgagacgtgtgatcctgga

SEQ ID NO: 59594 - DNA, 20 bp, Artificial
  CRISPR gRNA sequence
attgggagaactggtgagat

SEQ ID NO: 59595 - DNA, 20 bp, Artificial
  CRISPR gRNA sequence
gtgtatcaatgtcacatttc

SEQ ID NO: 59596 - DNA, 20 bp, Artificial
  CRISPR gRNA sequence
tcctggattttataatttta

SEQ ID NO: 59597 - DNA, 20 bp, Artificial
  CRISPR gRNA sequence
aattttactggattatggaa

SEQ ID NO: 59598 - DNA, 20 bp, Artificial
  CRISPR gRNA sequence
gcaaattcgctgaaatgtta

SEQ ID NO: 59599 - DNA, 20 bp, Artificial
  CRISPR gRNA sequence
ttcagaaaaggagagaggga

SEQ ID NO: 59600 - DNA, 20 bp, Artificial
  CRISPR gRNA sequence
aatgtggaaaaagattggca

SEQ ID NO: 59601 - DNA, 20 bp, Artificial
  CRISPR gRNA sequence
tggaaaaagattggcaaagg

SEQ ID NO: 59602 - DNA, 20 bp, Artificial
  CRISPR gRNA sequence
cctcgctctgtcacctaggc

SEQ ID NO: 59603 - DNA, 20 bp, Artificial
  CRISPR gRNA sequence
ctcactgtaacctcagcctc

SEQ ID NO: 59604 - DNA, 20 bp, Artificial
  CRISPR gRNA sequence
gcctcagcctcccaattagc

SEQ ID NO: 59605 - DNA, 20 bp, Artificial
  CRISPR gRNA sequence
tttttgtattttagtagaga

SEQ ID NO: 59606 - DNA, 20 bp, Artificial
  CRISPR gRNA sequence
cggggtttcaccgtgttgtc

SEQ ID NO: 59607 - DNA, 20 bp, Artificial
  CRISPR gRNA sequence
ccgtgttgtccagggtggtc

SEQ ID NO: 59608 - DNA, 20 bp, Artificial
  CRISPR gRNA sequence
gcctcggcctcccaaagtgc

SEQ ID NO: 59609 - DNA, 20 bp, Artificial
  CRISPR gRNA sequence
gagccaccacgcccagctct

SEQ ID NO: 59610 - DNA, 20 bp, Artificial
  CRISPR gRNA sequence
caccacgcccagctctaagg

SEQ ID NO: 59611 - DNA, 20 bp, Artificial
  CRISPR gRNA sequence
gcccagctctaagggtgaat

SEQ ID NO: 59612 - DNA, 20 bp, Artificial
  CRISPR gRNA sequence
ttttaaaagaaaaacaatga

SEQ ID NO: 59613 - DNA, 20 bp, Artificial
  CRISPR gRNA sequence
ccacctgtggtttgtgtcca

SEQ ID NO: 59614 - DNA, 20 bp, Artificial
  CRISPR gRNA sequence
tgtgtccacagagtaagaca

SEQ ID NO: 59615 - DNA, 20 bp, Artificial
  CRISPR gRNA sequence
cacagagtaagacacagagt

SEQ ID NO: 59616 - DNA, 20 bp, Artificial
  CRISPR gRNA sequence
agtcctctgagcccagggct

SEQ ID NO: 59617 - DNA, 20 bp, Artificial
  CRISPR gRNA sequence
gggcagagctgcaaagggga

SEQ ID NO: 59618 - DNA, 20 bp, Artificial
  CRISPR gRNA sequence
agagctgcaaaggggactga

SEQ ID NO: 59619 - DNA, 20 bp, Artificial
  CRISPR gRNA sequence
gagacaagctgaaaaggtcc

SEQ ID NO: 59620 - DNA, 20 bp, Artificial
  CRISPR gRNA sequence
aaaggtccaaggatattcta

SEQ ID NO: 59621 - DNA, 20 bp, Artificial
  CRISPR gRNA sequence
agaggtcatcacatccagaa

SEQ ID NO: 59622 - DNA, 20 bp, Artificial
  CRISPR gRNA sequence
tttctcctgcacaaggaagt

SEQ ID NO: 59623 - DNA, 20 bp, Artificial
  CRISPR gRNA sequence
gcacaaggaagtgagaatgc

SEQ ID NO: 59624 - DNA, 20 bp, Artificial
  CRISPR gRNA sequence
tgccagggtcacacatggcc

SEQ ID NO: 59625 - DNA, 20 bp, Artificial
  CRISPR gRNA sequence
acatggcctggagtaggtac

SEQ ID NO: 59626 - DNA, 20 bp, Artificial
  CRISPR gRNA sequence
agagaactcagggccccaca

SEQ ID NO: 59627 - DNA, 20 bp, Artificial
  CRISPR gRNA sequence
ggaacatctagtccagtatg

SEQ ID NO: 59628 - DNA, 20 bp, Artificial
  CRISPR gRNA sequence
ctgcaaggagcttatggtgt

SEQ ID NO: 59629 - DNA, 20 bp, Artificial
  CRISPR gRNA sequence
tatgagaagtgctaggaagc

SEQ ID NO: 59630 - DNA, 20 bp, Artificial
  CRISPR gRNA sequence
tcctaccatgctctatttcc

SEQ ID NO: 59631 - DNA, 20 bp, Artificial
  CRISPR gRNA sequence
gcagggctgcatccactcaa

SEQ ID NO: 59632 - DNA, 20 bp, Artificial
  CRISPR gRNA sequence
aatttcccaaactgtgccat

SEQ ID NO: 59633 - DNA, 20 bp, Artificial
  CRISPR gRNA sequence
catatggatttagaggtgct

SEQ ID NO: 59634 - DNA, 20 bp, Artificial
  CRISPR gRNA sequence
tttagaggtgctgtgaatcc

SEQ ID NO: 59635 - DNA, 20 bp, Artificial
  CRISPR gRNA sequence
ctgtgaatccagggatctat

SEQ ID NO: 59636 - DNA, 20 bp, Artificial
  CRISPR gRNA sequence
gaatccagggatctataaga

SEQ ID NO: 59637 - DNA, 20 bp, Artificial
  CRISPR gRNA sequence
ggaagtgtttgactaagcct

SEQ ID NO: 59638 - DNA, 20 bp, Artificial
  CRISPR gRNA sequence
ggcatttaagctgagacctg

SEQ ID NO: 59639 - DNA, 20 bp, Artificial
  CRISPR gRNA sequence
ctgagacctgagggatgagg

SEQ ID NO: 59640 - DNA, 20 bp, Artificial
  CRISPR gRNA sequence
tcggggaactgaaagttcat

SEQ ID NO: 59641 - DNA, 20 bp, Artificial
  CRISPR gRNA sequence
ctggagctgagactggggcc

SEQ ID NO: 59642 - DNA, 20 bp, Artificial
  CRISPR gRNA sequence
ggggctgaaacgcctcagaa

SEQ ID NO: 59643 - DNA, 20 bp, Artificial
  CRISPR gRNA sequence
gaacccctaaggtctctggg

SEQ ID NO: 59644 - DNA, 20 bp, Artificial
  CRISPR gRNA sequence
taaggtctctgggcagggtg

SEQ ID NO: 59645 - DNA, 20 bp, Artificial
  CRISPR gRNA sequence
cccaacaccagcccctgcct

SEQ ID NO: 59646 - DNA, 20 bp, Artificial
  CRISPR gRNA sequence
ctgccttggggtccctggtg

SEQ ID NO: 59647 - DNA, 20 bp, Artificial
  CRISPR gRNA sequence
tccctggtgctgggtcccac

SEQ ID NO: 59648 - DNA, 20 bp, Artificial
  CRISPR gRNA sequence
ccacctgagtgccacagctt

SEQ ID NO: 59649 - DNA, 20 bp, Artificial
  CRISPR gRNA sequence
agctggacacagagctgctg

SEQ ID NO: 59650 - DNA, 20 bp, Artificial
  CRISPR gRNA sequence
gctgggtctcggagatgctg

SEQ ID NO: 59651 - DNA, 20 bp, Artificial
  CRISPR gRNA sequence
actctgaactctcactttgc

SEQ ID NO: 59652 - DNA, 20 bp, Artificial
  CRISPR gRNA sequence
actggaaagtaggtgcttcc

SEQ ID NO: 59653 - DNA, 20 bp, Artificial
  CRISPR gRNA sequence
tttttttttttttaaagaga

SEQ ID NO: 59654 - DNA, 20 bp, Artificial
  CRISPR gRNA sequence
gcctcggcctcccaaagtgc

SEQ ID NO: 59655 - DNA, 20 bp, Artificial
  CRISPR gRNA sequence
ccatgacagaaagccattag

SEQ ID NO: 59656 - DNA, 20 bp, Artificial
  CRISPR gRNA sequence
gagggatccaagggcagttc

SEQ ID NO: 59657 - DNA, 20 bp, Artificial
  CRISPR gRNA sequence
caaggaccacagtgtggtgg

SEQ ID NO: 59658 - DNA, 20 bp, Artificial
  CRISPR gRNA sequence
accacagtgtggtggaaggg

SEQ ID NO: 59659 - DNA, 20 bp, Artificial
  CRISPR gRNA sequence
tgtggtggaagggtggggta

SEQ ID NO: 59660 - DNA, 20 bp, Artificial
  CRISPR gRNA sequence
ggtggggtaggggatgtgtc

SEQ ID NO: 59661 - DNA, 20 bp, Artificial
  CRISPR gRNA sequence
tctaagctcactgccttcac

SEQ ID NO: 59662 - DNA, 20 bp, Artificial
  CRISPR gRNA sequence
tcacttgaatgttatgttca

SEQ ID NO: 59663 - DNA, 20 bp, Artificial
  CRISPR gRNA sequence
gggctccaaccagtaagtga

SEQ ID NO: 59664 - DNA, 20 bp, Artificial
  CRISPR gRNA sequence
caaccagtaagtgactgagt

SEQ ID NO: 59665 - DNA, 20 bp, Artificial
  CRISPR gRNA sequence
gagttgggatctgaacatag

SEQ ID NO: 59666 - DNA, 20 bp, Artificial
  CRISPR gRNA sequence
gggatctgaacatagctgag

SEQ ID NO: 59667 - DNA, 20 bp, Artificial
  CRISPR gRNA sequence
ggactcccagccatgtctgc

SEQ ID NO: 59668 - DNA, 20 bp, Artificial
  CRISPR gRNA sequence
tagccctttgttttgattct

SEQ ID NO: 59669 - DNA, 20 bp, Artificial
  CRISPR gRNA sequence
gtgacacagctattacccca

SEQ ID NO: 59670 - DNA, 20 bp, Artificial
  CRISPR gRNA sequence
cccaatgcttatgaaagatg

SEQ ID NO: 59671 - DNA, 20 bp, Artificial
  CRISPR gRNA sequence
acacatgacggggccggggg

SEQ ID NO: 59672 - DNA, 20 bp, Artificial
  CRISPR gRNA sequence
gggggggacctagaggcttt

SEQ ID NO: 59673 - DNA, 20 bp, Artificial
  CRISPR gRNA sequence
atcttattttatttttgaga

SEQ ID NO: 59674 - DNA, 20 bp, Artificial
  CRISPR gRNA sequence
tttgctcttgttgcccagac

SEQ ID NO: 59675 - DNA, 20 bp, Artificial
  CRISPR gRNA sequence
atcactgcaacctctgcctc

SEQ ID NO: 59676 - DNA, 20 bp, Artificial
  CRISPR gRNA sequence
gcctcagcctcccaagtagc

SEQ ID NO: 59677 - DNA, 20 bp, Artificial
  CRISPR gRNA sequence
ttttgtatttttagtagaga

SEQ ID NO: 59678 - DNA, 20 bp, Artificial
  CRISPR gRNA sequence
gcctcggcctcccaaagtgc

SEQ ID NO: 59679 - DNA, 20 bp, Artificial
  CRISPR gRNA sequence
atggtggttgtttaagatga

SEQ ID NO: 59680 - DNA, 20 bp, Artificial
  CRISPR gRNA sequence
tttaagatgatagaattctc

SEQ ID NO: 59681 - DNA, 20 bp, Artificial
  CRISPR gRNA sequence
aatttgaaagtaggaaaaaa

SEQ ID NO: 59682 - DNA, 20 bp, Artificial
  CRISPR gRNA sequence
attactgctttaaagttatg

SEQ ID NO: 59683 - DNA, 20 bp, Artificial
  CRISPR gRNA sequence
actattttctttatgtattt

SEQ ID NO: 59684 - DNA, 20 bp, Artificial
  CRISPR gRNA sequence
atttttattttttgtagata

SEQ ID NO: 59685 - DNA, 20 bp, Artificial
  CRISPR gRNA sequence
acctcagcctcccaaagtgt

SEQ ID NO: 59686 - DNA, 20 bp, Artificial
  CRISPR gRNA sequence
atttgaaaatgttattttgg

SEQ ID NO: 59687 - DNA, 20 bp, Artificial
  CRISPR gRNA sequence
actttgggaggctgaggtgg

SEQ ID NO: 59688 - DNA, 20 bp, Artificial
  CRISPR gRNA sequence
tactctggaggctgaggcag

SEQ ID NO: 59689 - DNA, 20 bp, Artificial
  CRISPR gRNA sequence
ctcaaaaaaaaaaagttatt

SEQ ID NO: 59690 - DNA, 20 bp, Artificial
  CRISPR gRNA sequence
ttttgggtgctctagcaatt

SEQ ID NO: 59691 - DNA, 20 bp, Artificial
  CRISPR gRNA sequence
actttgggaggctgaggtgg

SEQ ID NO: 59692 - DNA, 20 bp, Artificial
  CRISPR gRNA sequence
agggactgtcaattgggcac

SEQ ID NO: 59693 - DNA, 20 bp, Artificial
  CRISPR gRNA sequence
gacaacccaagtgtcaattg

SEQ ID NO: 59694 - DNA, 20 bp, Artificial
  CRISPR gRNA sequence
aagtgtcaattgatggataa

SEQ ID NO: 59695 - DNA, 20 bp, Artificial
  CRISPR gRNA sequence
aatgtggtccatccacacaa

SEQ ID NO: 59696 - DNA, 20 bp, Artificial
  CRISPR gRNA sequence
agccttaaaaaaggaaaggg

SEQ ID NO: 59697 - DNA, 20 bp, Artificial
  CRISPR gRNA sequence
cgggcagatcatctgaggtc

SEQ ID NO: 59698 - DNA, 20 bp, Artificial
  CRISPR gRNA sequence
aaaatacaaaaaaaaattag

SEQ ID NO: 59699 - DNA, 20 bp, Artificial
  CRISPR gRNA sequence
tactccggaggctgaggcag

SEQ ID NO: 59700 - DNA, 20 bp, Artificial
  CRISPR gRNA sequence
tcgcttgaacccaagaggtg

SEQ ID NO: 59701 - DNA, 20 bp, Artificial
  CRISPR gRNA sequence
tgcactccagcccaggtgac

SEQ ID NO: 59702 - DNA, 20 bp, Artificial
  CRISPR gRNA sequence
acagtgacacacgctgcaac

SEQ ID NO: 59703 - DNA, 20 bp, Artificial
  CRISPR gRNA sequence
caattcatagagacagaaag

SEQ ID NO: 59704 - DNA, 20 bp, Artificial
  CRISPR gRNA sequence
gaatggtggttgccaggggc

SEQ ID NO: 59705 - DNA, 20 bp, Artificial
  CRISPR gRNA sequence
gggctggggtaggggggaaa

SEQ ID NO: 59706 - DNA, 20 bp, Artificial
  CRISPR gRNA sequence
gaaatggggtgttgtttaat

SEQ ID NO: 59707 - DNA, 20 bp, Artificial
  CRISPR gRNA sequence
attcagttttgcaagaggaa

SEQ ID NO: 59708 - DNA, 20 bp, Artificial
  CRISPR gRNA sequence
gagattggccgtacaaaaaa

SEQ ID NO: 59709 - DNA, 20 bp, Artificial
  CRISPR gRNA sequence
agtggatgtacttaacactc

SEQ ID NO: 59710 - DNA, 20 bp, Artificial
  CRISPR gRNA sequence
ttttgggcacaaacatgaaa

SEQ ID NO: 59711 - DNA, 20 bp, Artificial
  CRISPR gRNA sequence
cgtccagtttccaggaaagt

SEQ ID NO: 59712 - DNA, 20 bp, Artificial
  CRISPR gRNA sequence
tgacatcatgagaaagccac

SEQ ID NO: 59713 - DNA, 20 bp, Artificial
  CRISPR gRNA sequence
gaaacagaaagctgtggtga

SEQ ID NO: 59714 - DNA, 20 bp, Artificial
  CRISPR gRNA sequence
gcagtgatgccgcaggttag

SEQ ID NO: 59715 - DNA, 20 bp, Artificial
  CRISPR gRNA sequence
cagaccagatgtgacagatc

SEQ ID NO: 59716 - DNA, 20 bp, Artificial
  CRISPR gRNA sequence
ctaggtagtacccgacacta

SEQ ID NO: 59717 - DNA, 20 bp, Artificial
  CRISPR gRNA sequence
cgacactaaggaatcgctaa

SEQ ID NO: 59718 - DNA, 20 bp, Artificial
  CRISPR gRNA sequence
agcttcacggtgaaatattt

SEQ ID NO: 59719 - DNA, 20 bp, Artificial
  CRISPR gRNA sequence
cggtgaaatatttaggagtg

SEQ ID NO: 59720 - DNA, 20 bp, Artificial
  CRISPR gRNA sequence
aactgtcaaacctaggttct

SEQ ID NO: 59721 - DNA, 20 bp, Artificial
  CRISPR gRNA sequence
caaacctaggttctgggaat

SEQ ID NO: 59722 - DNA, 20 bp, Artificial
  CRISPR gRNA sequence
tacttcggtatcttcttttt

SEQ ID NO: 59723 - DNA, 20 bp, Artificial
  CRISPR gRNA sequence
cagtttctctgtgtgccttg

SEQ ID NO: 59724 - DNA, 20 bp, Artificial
  CRISPR gRNA sequence
gagtctctgggacagatgga

SEQ ID NO: 59725 - DNA, 20 bp, Artificial
  CRISPR gRNA sequence
acagatggacagggtttgct

SEQ ID NO: 59726 - DNA, 20 bp, Artificial
  CRISPR gRNA sequence
tttgctcagggtccagatgg

SEQ ID NO: 59727 - DNA, 20 bp, Artificial
  CRISPR gRNA sequence
agggtccagatggcagggtt

SEQ ID NO: 59728 - DNA, 20 bp, Artificial
  CRISPR gRNA sequence
acctgaggctgaacagccct

SEQ ID NO: 59729 - DNA, 20 bp, Artificial
  CRISPR gRNA sequence
ggtcgccccaccaagctcag

SEQ ID NO: 59730 - DNA, 20 bp, Artificial
  CRISPR gRNA sequence
tgcttctggcccaggcagca

SEQ ID NO: 59731 - DNA, 20 bp, Artificial
  CRISPR gRNA sequence
agtcactgaggtggctctgg

SEQ ID NO: 59732 - DNA, 20 bp, Artificial
  CRISPR gRNA sequence
ccctctgctgtcctcacggg

SEQ ID NO: 59733 - DNA, 20 bp, Artificial
  CRISPR gRNA sequence
ctgctgtcctcacgggctgg

SEQ ID NO: 59734 - DNA, 20 bp, Artificial
  CRISPR gRNA sequence
gcagaaagccagggcagagc

SEQ ID NO: 59735 - DNA, 20 bp, Artificial
  CRISPR gRNA sequence
accccctgtaagaaagtatt

SEQ ID NO: 59736 - DNA, 20 bp, Artificial
  CRISPR gRNA sequence
gtcaggcactgtgccagcct

SEQ ID NO: 59737 - DNA, 20 bp, Artificial
  CRISPR gRNA sequence
gggacttcctgccttacccg

SEQ ID NO: 59738 - DNA, 20 bp, Artificial
  CRISPR gRNA sequence
cagcagataagaaagaaggg

SEQ ID NO: 59739 - DNA, 20 bp, Artificial
  CRISPR gRNA sequence
cctggggagggaggtgtgcc

SEQ ID NO: 59740 - DNA, 20 bp, Artificial
  CRISPR gRNA sequence
gctgtccaggcatctcagcc

SEQ ID NO: 59741 - DNA, 20 bp, Artificial
  CRISPR gRNA sequence
ctctgatgaggcagggctgc

SEQ ID NO: 59742 - DNA, 20 bp, Artificial
  CRISPR gRNA sequence
aggaggggctgatgtttgag

SEQ ID NO: 59743 - DNA, 20 bp, Artificial
  CRISPR gRNA sequence
gatgtttgagctgggtgtta

SEQ ID NO: 59744 - DNA, 20 bp, Artificial
  CRISPR gRNA sequence
gctgggtgttaaaggattgg

SEQ ID NO: 59745 - DNA, 20 bp, Artificial
  CRISPR gRNA sequence
atctcagaaaaggcaaggaa

SEQ ID NO: 59746 - DNA, 20 bp, Artificial
  CRISPR gRNA sequence
gcaaggaagagaatgttgag

SEQ ID NO: 59747 - DNA, 20 bp, Artificial
  CRISPR gRNA sequence
gtgcggtgtgagcagaggca

SEQ ID NO: 59748 - DNA, 20 bp, Artificial
  CRISPR gRNA sequence
atgtgccaggtatgtatgtg

SEQ ID NO: 59749 - DNA, 20 bp, Artificial
  CRISPR gRNA sequence
atgtggggggtttgtttttg

SEQ ID NO: 59750 - DNA, 20 bp, Artificial
  CRISPR gRNA sequence
ctgcgtgctgtgtggtgtgt

SEQ ID NO: 59751 - DNA, 20 bp, Artificial
  CRISPR gRNA sequence
gcttggtgtatctgtggtat

SEQ ID NO: 59752 - DNA, 20 bp, Artificial
  CRISPR gRNA sequence
aacatggtggaaggtgacag

SEQ ID NO: 59753 - DNA, 20 bp, Artificial
  CRISPR gRNA sequence
agggactttgaacttcaccc

SEQ ID NO: 59754 - DNA, 20 bp, Artificial
  CRISPR gRNA sequence
tggggagccactgaggggca

SEQ ID NO: 59755 - DNA, 20 bp, Artificial
  CRISPR gRNA sequence
gaagatccctctgggggctg

SEQ ID NO: 59756 - DNA, 20 bp, Artificial
  CRISPR gRNA sequence
atccctctgggggctgtgga

SEQ ID NO: 59757 - DNA, 20 bp, Artificial
  CRISPR gRNA sequence
gaggaggcctgataagatgc

SEQ ID NO: 59758 - DNA, 20 bp, Artificial
  CRISPR gRNA sequence
taaaggaactggccgtggca

SEQ ID NO: 59759 - DNA, 20 bp, Artificial
  CRISPR gRNA sequence
ggcagtgagtcagggctacc

SEQ ID NO: 59760 - DNA, 20 bp, Artificial
  CRISPR gRNA sequence
taatcctcacaataacccta

SEQ ID NO: 59761 - DNA, 20 bp, Artificial
  CRISPR gRNA sequence
tagctggtaagtggcagatc

SEQ ID NO: 59762 - DNA, 20 bp, Artificial
  CRISPR gRNA sequence
agtcaggacatggcaaggaa

SEQ ID NO: 59763 - DNA, 20 bp, Artificial
  CRISPR gRNA sequence
gcaaggaagagaatgttggg

SEQ ID NO: 59764 - DNA, 20 bp, Artificial
  CRISPR gRNA sequence
atgttgggctgagttgggct

SEQ ID NO: 59765 - DNA, 20 bp, Artificial
  CRISPR gRNA sequence
gccaaggccctggctgagac

SEQ ID NO: 59766 - DNA, 20 bp, Artificial
  CRISPR gRNA sequence
gggggccatggaggccgcca

SEQ ID NO: 59767 - DNA, 20 bp, Artificial
  CRISPR gRNA sequence
cccctgtcccatcaccctgc

SEQ ID NO: 59768 - DNA, 20 bp, Artificial
  CRISPR gRNA sequence
catcaccctgcagggattac

SEQ ID NO: 59769 - DNA, 20 bp, Artificial
  CRISPR gRNA sequence
gcctggtcctctctggagaa

SEQ ID NO: 59770 - DNA, 20 bp, Artificial
  CRISPR gRNA sequence
ctgcacccacaaggacaagg

SEQ ID NO: 59771 - DNA, 20 bp, Artificial
  CRISPR gRNA sequence
cccatggcacccgggcatca

SEQ ID NO: 59772 - DNA, 20 bp, Artificial
  CRISPR gRNA sequence
cagatggaaggccacaaagt

SEQ ID NO: 59773 - DNA, 20 bp, Artificial
  CRISPR gRNA sequence
actagaagggaaatggagat

SEQ ID NO: 59774 - DNA, 20 bp, Artificial
  CRISPR gRNA sequence
agggaaatggagatgagaat

SEQ ID NO: 59775 - DNA, 20 bp, Artificial
  CRISPR gRNA sequence
atggacacactgaggcccag

SEQ ID NO: 59776 - DNA, 20 bp, Artificial
  CRISPR gRNA sequence
ggcagaactggcaccagacc

SEQ ID NO: 59777 - DNA, 20 bp, Artificial
  CRISPR gRNA sequence
tgcccgctgcccctgtggtc

SEQ ID NO: 59778 - DNA, 20 bp, Artificial
  CRISPR gRNA sequence
gctggcagctctagccccgc

SEQ ID NO: 59779 - DNA, 20 bp, Artificial
  CRISPR gRNA sequence
gggagagatggggcaaccat

SEQ ID NO: 59780 - DNA, 20 bp, Artificial
  CRISPR gRNA sequence
ccacatttatgttccacaga

SEQ ID NO: 59781 - DNA, 20 bp, Artificial
  CRISPR gRNA sequence
tgttccacagattgggtcag

SEQ ID NO: 59782 - DNA, 20 bp, Artificial
  CRISPR gRNA sequence
ggtcagaagaatttcaggga

SEQ ID NO: 59783 - DNA, 20 bp, Artificial
  CRISPR gRNA sequence
caatcccgcatcagctggtt

SEQ ID NO: 59784 - DNA, 20 bp, Artificial
  CRISPR gRNA sequence
ccgcatcagctggttgggga

SEQ ID NO: 59785 - DNA, 20 bp, Artificial
  CRISPR gRNA sequence
ccccaggtcagtttggctgt

SEQ ID NO: 59786 - DNA, 20 bp, Artificial
  CRISPR gRNA sequence
taggggtgtgtcaccctgcc

SEQ ID NO: 59787 - DNA, 20 bp, Artificial
  CRISPR gRNA sequence
gccacgaatcacagcctctc

SEQ ID NO: 59788 - DNA, 20 bp, Artificial
  CRISPR gRNA sequence
cctctcttgggtgtttggtg

SEQ ID NO: 59789 - DNA, 20 bp, Artificial
  CRISPR gRNA sequence
tggtggaggatctgcccatg

SEQ ID NO: 59790 - DNA, 20 bp, Artificial
  CRISPR gRNA sequence
aggaaaggacccaaggccag

SEQ ID NO: 59791 - DNA, 20 bp, Artificial
  CRISPR gRNA sequence
caggggagtgaaggcaaggg

SEQ ID NO: 59792 - DNA, 20 bp, Artificial
  CRISPR gRNA sequence
ccttgtcctctggtgctctg

SEQ ID NO: 59793 - DNA, 20 bp, Artificial
  CRISPR gRNA sequence
gcagacattccagaaggcat

SEQ ID NO: 59794 - DNA, 20 bp, Artificial
  CRISPR gRNA sequence
aggtttgctgagagactgta

SEQ ID NO: 59795 - DNA, 20 bp, Artificial
  CRISPR gRNA sequence
agggggtaaggagcagtggc

SEQ ID NO: 59796 - DNA, 20 bp, Artificial
  CRISPR gRNA sequence
actgctactggaccccatgt

SEQ ID NO: 59797 - DNA, 20 bp, Artificial
  CRISPR gRNA sequence
accatcccttccatcaccac

SEQ ID NO: 59798 - DNA, 20 bp, Artificial
  CRISPR gRNA sequence
cctcttggtcctcttccata

SEQ ID NO: 59799 - DNA, 20 bp, Artificial
  CRISPR gRNA sequence
ggtgcctccagcaggctttc

SEQ ID NO: 59800 - DNA, 20 bp, Artificial
  CRISPR gRNA sequence
cgcccttggccggcatcatt

SEQ ID NO: 59801 - DNA, 20 bp, Artificial
  CRISPR gRNA sequence
tcatttgggatccacagttt

SEQ ID NO: 59802 - DNA, 20 bp, Artificial
  CRISPR gRNA sequence
tcaggaaaaaaaaatgtttg

SEQ ID NO: 59803 - DNA, 20 bp, Artificial
  CRISPR gRNA sequence
tagatttcttcttttaatct

SEQ ID NO: 59804 - DNA, 20 bp, Artificial
  CRISPR gRNA sequence
tttatttatttattttgaga

SEQ ID NO: 59805 - DNA, 20 bp, Artificial
  CRISPR gRNA sequence
tcttgctctgttgcccaggc

SEQ ID NO: 59806 - DNA, 20 bp, Artificial
  CRISPR gRNA sequence
gcctcagcctcccaagtagc

SEQ ID NO: 59807 - DNA, 20 bp, Artificial
  CRISPR gRNA sequence
tttttgtatttttagtagag

SEQ ID NO: 59808 - DNA, 20 bp, Artificial
  CRISPR gRNA sequence
gctttggcctcccaaagtgc

SEQ ID NO: 59809 - DNA, 20 bp, Artificial
  CRISPR gRNA sequence
tttaaaataagaaaaattgg

SEQ ID NO: 59810 - DNA, 20 bp, Artificial
  CRISPR gRNA sequence
actttgggagggcgaggcag

SEQ ID NO: 59811 - DNA, 20 bp, Artificial
  CRISPR gRNA sequence
caggcggatcgcctgaggtc

SEQ ID NO: 59812 - DNA, 20 bp, Artificial
  CRISPR gRNA sequence
tccttgggaggctgaggcag

SEQ ID NO: 59813 - DNA, 20 bp, Artificial
  CRISPR gRNA sequence
tctcagcaacctgggaggct

SEQ ID NO: 59814 - DNA, 20 bp, Artificial
  CRISPR gRNA sequence
tactccagaggctgaggtgg

SEQ ID NO: 59815 - DNA, 20 bp, Artificial
  CRISPR gRNA sequence
tgggaggatcgcttgagccc

SEQ ID NO: 59816 - DNA, 20 bp, Artificial
  CRISPR gRNA sequence
ctgcactccagcctgggcaa

SEQ ID NO: 59817 - DNA, 20 bp, Artificial
  CRISPR gRNA sequence
tatttcccactggtcctagg

SEQ ID NO: 59818 - DNA, 20 bp, Artificial
  CRISPR gRNA sequence
tgagaacaatactagtatcc

SEQ ID NO: 59819 - DNA, 20 bp, Artificial
  CRISPR gRNA sequence
cccatgcaggggctgactat

SEQ ID NO: 59820 - DNA, 20 bp, Artificial
  CRISPR gRNA sequence
gctctgcgtccctcctcagg

SEQ ID NO: 59821 - DNA, 20 bp, Artificial
  CRISPR gRNA sequence
aaccacctgctgggccaaca

SEQ ID NO: 59822 - DNA, 20 bp, Artificial
  CRISPR gRNA sequence
ggaactagctccaccatggc

SEQ ID NO: 59823 - DNA, 20 bp, Artificial
  CRISPR gRNA sequence
aaaattgattcagggaagct

SEQ ID NO: 59824 - DNA, 20 bp, Artificial
  CRISPR gRNA sequence
agaggtgtaggcaggcacac

SEQ ID NO: 59825 - DNA, 20 bp, Artificial
  CRISPR gRNA sequence
tacacttgctcagcaaccag

SEQ ID NO: 59826 - DNA, 20 bp, Artificial
  CRISPR gRNA sequence
ggaggtaaaggggacaagca

SEQ ID NO: 59827 - DNA, 20 bp, Artificial
  CRISPR gRNA sequence
gcacagcctctgggctccag

SEQ ID NO: 59828 - DNA, 20 bp, Artificial
  CRISPR gRNA sequence
ttggaccctctggaagtgtc

SEQ ID NO: 59829 - DNA, 20 bp, Artificial
  CRISPR gRNA sequence
cggacctgtgtttcttcatg

SEQ ID NO: 59830 - DNA, 20 bp, Artificial
  CRISPR gRNA sequence
gggtgaaacaagtccctctg

SEQ ID NO: 59831 - DNA, 20 bp, Artificial
  CRISPR gRNA sequence
cctctgcagggttgttccag

SEQ ID NO: 59832 - DNA, 20 bp, Artificial
  CRISPR gRNA sequence
acacgccttcctcctcctcg

SEQ ID NO: 59833 - DNA, 20 bp, Artificial
  CRISPR gRNA sequence
aagttgcatggtgcagggac

SEQ ID NO: 59834 - DNA, 20 bp, Artificial
  CRISPR gRNA sequence
ggacctggatcagacaggac

SEQ ID NO: 59835 - DNA, 20 bp, Artificial
  CRISPR gRNA sequence
gacagctgtggccacagcct

SEQ ID NO: 59836 - DNA, 20 bp, Artificial
  CRISPR gRNA sequence
tccggaagcccagcctctag

SEQ ID NO: 59837 - DNA, 20 bp, Artificial
  CRISPR gRNA sequence
tccaggcacaacccttcagg

SEQ ID NO: 59838 - DNA, 20 bp, Artificial
  CRISPR gRNA sequence
acgagtcctggctgtcccag

SEQ ID NO: 59839 - DNA, 20 bp, Artificial
  CRISPR gRNA sequence
ggctcagcctgaaaaggaaa

SEQ ID NO: 59840 - DNA, 20 bp, Artificial
  CRISPR gRNA sequence
aagggggtagatccggcaag

SEQ ID NO: 59841 - DNA, 20 bp, Artificial
  CRISPR gRNA sequence
caaggaacctggctagcctg

SEQ ID NO: 59842 - DNA, 20 bp, Artificial
  CRISPR gRNA sequence
gcctggagggtaaggaaagg

SEQ ID NO: 59843 - DNA, 20 bp, Artificial
  CRISPR gRNA sequence
aggcaatagggaagcaggca

SEQ ID NO: 59844 - DNA, 20 bp, Artificial
  CRISPR gRNA sequence
gggctgagggacaggcagat

SEQ ID NO: 59845 - DNA, 20 bp, Artificial
  CRISPR gRNA sequence
agggacaggcagatttggat

SEQ ID NO: 59846 - DNA, 20 bp, Artificial
  CRISPR gRNA sequence
gtatgactctcgaggtatat

SEQ ID NO: 59847 - DNA, 20 bp, Artificial
  CRISPR gRNA sequence
tgcaagcacagatttcacag

SEQ ID NO: 59848 - DNA, 20 bp, Artificial
  CRISPR gRNA sequence
caggcgagtccttgctcaca

SEQ ID NO: 59849 - DNA, 20 bp, Artificial
  CRISPR gRNA sequence
gtgggctctcctgtgcccta

SEQ ID NO: 59850 - DNA, 20 bp, Artificial
  CRISPR gRNA sequence
gatatttccaaatgactccc

SEQ ID NO: 59851 - DNA, 20 bp, Artificial
  CRISPR gRNA sequence
actgccttagagaaagtgag

SEQ ID NO: 59852 - DNA, 20 bp, Artificial
  CRISPR gRNA sequence
ttccactctcaagatccacc

SEQ ID NO: 59853 - DNA, 20 bp, Artificial
  CRISPR gRNA sequence
tttgaaaacccaaatgagga

SEQ ID NO: 59854 - DNA, 20 bp, Artificial
  CRISPR gRNA sequence
actttgggaagccgaggcgg

SEQ ID NO: 59855 - DNA, 20 bp, Artificial
  CRISPR gRNA sequence
cgggcggatcacttgaggtc

SEQ ID NO: 59856 - DNA, 20 bp, Artificial
  CRISPR gRNA sequence
tacttgggaggctgaggcac

SEQ ID NO: 59857 - DNA, 20 bp, Artificial
  CRISPR gRNA sequence
caaaagtctaaactctcccc

SEQ ID NO: 59858 - DNA, 20 bp, Artificial
  CRISPR gRNA sequence
cacatgccgttccctctgcc

SEQ ID NO: 59859 - DNA, 20 bp, Artificial
  CRISPR gRNA sequence
agggccacaagcactacacg

SEQ ID NO: 59860 - DNA, 20 bp, Artificial
  CRISPR gRNA sequence
acaaagtttaaaccctggca

SEQ ID NO: 59861 - DNA, 20 bp, Artificial
  CRISPR gRNA sequence
cgccactccaaaggcggacg

SEQ ID NO: 59862 - DNA, 20 bp, Artificial
  CRISPR gRNA sequence
ccaaaggcggacgaggagtc

SEQ ID NO: 59863 - DNA, 20 bp, Artificial
  CRISPR gRNA sequence
ctgccaccttttatgtccaa

SEQ ID NO: 59864 - DNA, 20 bp, Artificial
  CRISPR gRNA sequence
tctgactcattatctccggg

SEQ ID NO: 59865 - DNA, 20 bp, Artificial
  CRISPR gRNA sequence
cgggcagggtgggactatta

SEQ ID NO: 59866 - DNA, 20 bp, Artificial
  CRISPR gRNA sequence
gggactattacagggtgcca

SEQ ID NO: 59867 - DNA, 20 bp, Artificial
  CRISPR gRNA sequence
agctgggctgtacttgcccc

SEQ ID NO: 59868 - DNA, 20 bp, Artificial
  CRISPR gRNA sequence
ttctttttttttttctgaga

SEQ ID NO: 59869 - DNA, 20 bp, Artificial
  CRISPR gRNA sequence
ttcactcttgtcgcccaagc

SEQ ID NO: 59870 - DNA, 20 bp, Artificial
  CRISPR gRNA sequence
gcctcagcctcccaagtagc

SEQ ID NO: 59871 - DNA, 20 bp, Artificial
  CRISPR gRNA sequence
ttttgtatttttagtagaga

SEQ ID NO: 59872 - DNA, 20 bp, Artificial
  CRISPR gRNA sequence
gcctcggcctcccaaagtgc

SEQ ID NO: 59873 - DNA, 20 bp, Artificial
  CRISPR gRNA sequence
aaatagttttaatactttgg

SEQ ID NO: 59874 - DNA, 20 bp, Artificial
  CRISPR gRNA sequence
tctgcttaaattcccttttt

SEQ ID NO: 59875 - DNA, 20 bp, Artificial
  CRISPR gRNA sequence
catctgtacagcccctttct

SEQ ID NO: 59876 - DNA, 20 bp, Artificial
  CRISPR gRNA sequence
tgtacagcccctttctacga

SEQ ID NO: 59877 - DNA, 20 bp, Artificial
  CRISPR gRNA sequence
ctacgagtgggtgaccctcc

SEQ ID NO: 59878 - DNA, 20 bp, Artificial
  CRISPR gRNA sequence
tccatttcttaaggtgattt

SEQ ID NO: 59879 - DNA, 20 bp, Artificial
  CRISPR gRNA sequence
gtgattttagaataacttat

SEQ ID NO: 59880 - DNA, 20 bp, Artificial
  CRISPR gRNA sequence
tatttgagtcccaactctgg

SEQ ID NO: 59881 - DNA, 20 bp, Artificial
  CRISPR gRNA sequence
caactctgggggaatgggcg

SEQ ID NO: 59882 - DNA, 20 bp, Artificial
  CRISPR gRNA sequence
ccctgaggttgacaaagtat

SEQ ID NO: 59883 - DNA, 20 bp, Artificial
  CRISPR gRNA sequence
gggtggagctggaagcagat

SEQ ID NO: 59884 - DNA, 20 bp, Artificial
  CRISPR gRNA sequence
atgataaaacaacctaagga

SEQ ID NO: 59885 - DNA, 20 bp, Artificial
  CRISPR gRNA sequence
caacctaaggaaagaatgga

SEQ ID NO: 59886 - DNA, 20 bp, Artificial
  CRISPR gRNA sequence
gaaagaatggagcgggtaga

SEQ ID NO: 59887 - DNA, 20 bp, Artificial
  CRISPR gRNA sequence
agcgggtagagggggttgga

SEQ ID NO: 59888 - DNA, 20 bp, Artificial
  CRISPR gRNA sequence
ggttggagggggtaaaggcg

SEQ ID NO: 59889 - DNA, 20 bp, Artificial
  CRISPR gRNA sequence
ggggtaaaggcggggggttg

SEQ ID NO: 59890 - DNA, 20 bp, Artificial
  CRISPR gRNA sequence
actgcagcaggctcagctga

SEQ ID NO: 59891 - DNA, 20 bp, Artificial
  CRISPR gRNA sequence
agttgaggtaagcagtccag

SEQ ID NO: 59892 - DNA, 20 bp, Artificial
  CRISPR gRNA sequence
caatctgtgaaacaaagcag

SEQ ID NO: 59893 - DNA, 20 bp, Artificial
  CRISPR gRNA sequence
ttctggagatgggacctaac

SEQ ID NO: 59894 - DNA, 20 bp, Artificial
  CRISPR gRNA sequence
tgaaacattccctcccagca

SEQ ID NO: 59895 - DNA, 20 bp, Artificial
  CRISPR gRNA sequence
tccctcccagcactgggtcc

SEQ ID NO: 59896 - DNA, 20 bp, Artificial
  CRISPR gRNA sequence
tcttttaagtttgggaaata

SEQ ID NO: 59897 - DNA, 20 bp, Artificial
  CRISPR gRNA sequence
gcgataggctgctgtgcatt

SEQ ID NO: 59898 - DNA, 20 bp, Artificial
  CRISPR gRNA sequence
ccccaaactaaatggactag

SEQ ID NO: 59899 - DNA, 20 bp, Artificial
  CRISPR gRNA sequence
caaaacatgtttgttaagaa

SEQ ID NO: 59900 - DNA, 20 bp, Artificial
  CRISPR gRNA sequence
cagcactttgggaggctgag

SEQ ID NO: 59901 - DNA, 20 bp, Artificial
  CRISPR gRNA sequence
actttgggaggctgaggtgg

SEQ ID NO: 59902 - DNA, 20 bp, Artificial
  CRISPR gRNA sequence
tgggtggatcatctgaggtc

SEQ ID NO: 59903 - DNA, 20 bp, Artificial
  CRISPR gRNA sequence
tactcaggaggctgaggcat

SEQ ID NO: 59904 - DNA, 20 bp, Artificial
  CRISPR gRNA sequence
tcgtaccactgcactccagc

SEQ ID NO: 59905 - DNA, 20 bp, Artificial
  CRISPR gRNA sequence
actccagcctgggtgacaga

SEQ ID NO: 59906 - DNA, 20 bp, Artificial
  CRISPR gRNA sequence
acaatgctgccttaacccag

SEQ ID NO: 59907 - DNA, 20 bp, Artificial
  CRISPR gRNA sequence
tgctgccttaacccagagga

SEQ ID NO: 59908 - DNA, 20 bp, Artificial
  CRISPR gRNA sequence
cgaaggagacagggactggc

SEQ ID NO: 59909 - DNA, 20 bp, Artificial
  CRISPR gRNA sequence
gaccaggacaactcaagaca

SEQ ID NO: 59910 - DNA, 20 bp, Artificial
  CRISPR gRNA sequence
actcaagacactgagttccc

SEQ ID NO: 59911 - DNA, 20 bp, Artificial
  CRISPR gRNA sequence
ggctgtttggaggggaggca

SEQ ID NO: 59912 - DNA, 20 bp, Artificial
  CRISPR gRNA sequence
tggctcagtgagctgggggg

SEQ ID NO: 59913 - DNA, 20 bp, Artificial
  CRISPR gRNA sequence
tcaggactggggcctttatt

SEQ ID NO: 59914 - DNA, 20 bp, Artificial
  CRISPR gRNA sequence
tttttttttttttaaagcaa

SEQ ID NO: 59915 - DNA, 20 bp, Artificial
  CRISPR gRNA sequence
gcaaagtagacctgcagtgc

SEQ ID NO: 59916 - DNA, 20 bp, Artificial
  CRISPR gRNA sequence
agtgcttgaattcagggagg

SEQ ID NO: 59917 - DNA, 20 bp, Artificial
  CRISPR gRNA sequence
gcttccccggtggaaccccg

SEQ ID NO: 59918 - DNA, 20 bp, Artificial
  CRISPR gRNA sequence
ggaatcactggacttcagca

SEQ ID NO: 59919 - DNA, 20 bp, Artificial
  CRISPR gRNA sequence
atttatttatttatttgaga

SEQ ID NO: 59920 - DNA, 20 bp, Artificial
  CRISPR gRNA sequence
ctcaccacaatctctgcctc

SEQ ID NO: 59921 - DNA, 20 bp, Artificial
  CRISPR gRNA sequence
gcaagtctcctgcctgcctc

SEQ ID NO: 59922 - DNA, 20 bp, Artificial
  CRISPR gRNA sequence
ctgcctgcctccagagtagc

SEQ ID NO: 59923 - DNA, 20 bp, Artificial
  CRISPR gRNA sequence
tccagagtagctgggattac

SEQ ID NO: 59924 - DNA, 20 bp, Artificial
  CRISPR gRNA sequence
ttttgtatttttagtagaga

SEQ ID NO: 59925 - DNA, 20 bp, Artificial
  CRISPR gRNA sequence
acctcggcctcccaaagtgc

SEQ ID NO: 59926 - DNA, 20 bp, Artificial
  CRISPR gRNA sequence
aaagtgctgggattataggc

SEQ ID NO: 59927 - DNA, 20 bp, Artificial
  CRISPR gRNA sequence
tcccagtctccttgtgttcc

SEQ ID NO: 59928 - DNA, 20 bp, Artificial
  CRISPR gRNA sequence
acttaacagtcaaatcacgt

SEQ ID NO: 59929 - DNA, 20 bp, Artificial
  CRISPR gRNA sequence
acacaacacctagaagcagt

SEQ ID NO: 59930 - DNA, 20 bp, Artificial
  CRISPR gRNA sequence
atggcctgctgcatgcagcc

SEQ ID NO: 59931 - DNA, 20 bp, Artificial
  CRISPR gRNA sequence
gcatgcagcctaggatggct

SEQ ID NO: 59932 - DNA, 20 bp, Artificial
  CRISPR gRNA sequence
aacactatgagatttttctt

SEQ ID NO: 59933 - DNA, 20 bp, Artificial
  CRISPR gRNA sequence
acccttgatctagactctag

SEQ ID NO: 59934 - DNA, 20 bp, Artificial
  CRISPR gRNA sequence
tagactctagaagggtgtgg

SEQ ID NO: 59935 - DNA, 20 bp, Artificial
  CRISPR gRNA sequence
ctgaccattggttgacttta

SEQ ID NO: 59936 - DNA, 20 bp, Artificial
  CRISPR gRNA sequence
ctttaaggaattgccattaa

SEQ ID NO: 59937 - DNA, 20 bp, Artificial
  CRISPR gRNA sequence
actttgggaggctgaggaag

SEQ ID NO: 59938 - DNA, 20 bp, Artificial
  CRISPR gRNA sequence
aaggtggatcacttgaggtc

SEQ ID NO: 59939 - DNA, 20 bp, Artificial
  CRISPR gRNA sequence
tactcaggaggctgaggcag

SEQ ID NO: 59940 - DNA, 20 bp, Artificial
  CRISPR gRNA sequence
catgggaaggccacactcca

SEQ ID NO: 59941 - DNA, 20 bp, Artificial
  CRISPR gRNA sequence
ccacactccagggggtcaaa

SEQ ID NO: 59942 - DNA, 20 bp, Artificial
  CRISPR gRNA sequence
tgactgcaaacaggtagaaa

SEQ ID NO: 59943 - DNA, 20 bp, Artificial
  CRISPR gRNA sequence
actgaatatgcaaataggca

SEQ ID NO: 59944 - DNA, 20 bp, Artificial
  CRISPR gRNA sequence
tcctgtggacacatgacaac

SEQ ID NO: 59945 - DNA, 20 bp, Artificial
  CRISPR gRNA sequence
taggtgaggcaggttttgtc

SEQ ID NO: 59946 - DNA, 20 bp, Artificial
  CRISPR gRNA sequence
ttttaaggtaattactataa

SEQ ID NO: 59947 - DNA, 20 bp, Artificial
  CRISPR gRNA sequence
gatgaagaagctgaggcccg

SEQ ID NO: 59948 - DNA, 20 bp, Artificial
  CRISPR gRNA sequence
agttaaatcccttttgagcc

SEQ ID NO: 59949 - DNA, 20 bp, Artificial
  CRISPR gRNA sequence
acagacccagatgttctggg

SEQ ID NO: 59950 - DNA, 20 bp, Artificial
  CRISPR gRNA sequence
agtgaggtggtaaccccaag

SEQ ID NO: 59951 - DNA, 20 bp, Artificial
  CRISPR gRNA sequence
gtggtaaccccaaggagagt

SEQ ID NO: 59952 - DNA, 20 bp, Artificial
  CRISPR gRNA sequence
agccatgcaggcaggttcaa

SEQ ID NO: 59953 - DNA, 20 bp, Artificial
  CRISPR gRNA sequence
gggtgccctggtgaggctcc

SEQ ID NO: 59954 - DNA, 20 bp, Artificial
  CRISPR gRNA sequence
ccctggtgaggctccagggg

SEQ ID NO: 59955 - DNA, 20 bp, Artificial
  CRISPR gRNA sequence
ggacagggctcccaggtgcc

SEQ ID NO: 59956 - DNA, 20 bp, Artificial
  CRISPR gRNA sequence
gggctcccaggtgccctgag

SEQ ID NO: 59957 - DNA, 20 bp, Artificial
  CRISPR gRNA sequence
tcccaggtgccctgagttga

SEQ ID NO: 59958 - DNA, 20 bp, Artificial
  CRISPR gRNA sequence
tcgttacttactgcagttcc

SEQ ID NO: 59959 - DNA, 20 bp, Artificial
  CRISPR gRNA sequence
aggggtcccgggcagtcctt

SEQ ID NO: 59960 - DNA, 20 bp, Artificial
  CRISPR gRNA sequence
tccttcagagtggcacagag

SEQ ID NO: 59961 - DNA, 20 bp, Artificial
  CRISPR gRNA sequence
aaggggcaatgggcagggca

SEQ ID NO: 59962 - DNA, 20 bp, Artificial
  CRISPR gRNA sequence
gcagggaatcagagaaagcc

SEQ ID NO: 59963 - DNA, 20 bp, Artificial
  CRISPR gRNA sequence
gtggggcactcgcttccctc

SEQ ID NO: 59964 - DNA, 20 bp, Artificial
  CRISPR gRNA sequence
gacagtgacagtgcaggacc

SEQ ID NO: 59965 - DNA, 20 bp, Artificial
  CRISPR gRNA sequence
agagagaggtggggccaagt

SEQ ID NO: 59966 - DNA, 20 bp, Artificial
  CRISPR gRNA sequence
catggcagagcttgcagatg

SEQ ID NO: 59967 - DNA, 20 bp, Artificial
  CRISPR gRNA sequence
aacccctttctttctggaaa

SEQ ID NO: 59968 - DNA, 20 bp, Artificial
  CRISPR gRNA sequence
gcagatggagaccccaggca

SEQ ID NO: 59969 - DNA, 20 bp, Artificial
  CRISPR gRNA sequence
ctgtttgcttcacagaaatg

SEQ ID NO: 59970 - DNA, 20 bp, Artificial
  CRISPR gRNA sequence
tgtggaatcttctctccaag

SEQ ID NO: 59971 - DNA, 20 bp, Artificial
  CRISPR gRNA sequence
ggacagtaccagaggctcct

SEQ ID NO: 59972 - DNA, 20 bp, Artificial
  CRISPR gRNA sequence
ggcccacatatccctaggag

SEQ ID NO: 59973 - DNA, 20 bp, Artificial
  CRISPR gRNA sequence
agcccatatacccctaggag

SEQ ID NO: 59974 - DNA, 20 bp, Artificial
  CRISPR gRNA sequence
gaggctcagggaagggaagc

SEQ ID NO: 59975 - DNA, 20 bp, Artificial
  CRISPR gRNA sequence
tctttgggcctcaagaaccc

SEQ ID NO: 59976 - DNA, 20 bp, Artificial
  CRISPR gRNA sequence
gcagtgacatgtatggagcg

SEQ ID NO: 59977 - DNA, 20 bp, Artificial
  CRISPR gRNA sequence
ttaaacctagtgtgccggac

SEQ ID NO: 59978 - DNA, 20 bp, Artificial
  CRISPR gRNA sequence
ttgggtggtttaactgagag

SEQ ID NO: 59979 - DNA, 20 bp, Artificial
  CRISPR gRNA sequence
ctgagagctgagtggtcagc

SEQ ID NO: 59980 - DNA, 20 bp, Artificial
  CRISPR gRNA sequence
tgagtggtcagcatgggtct

SEQ ID NO: 59981 - DNA, 20 bp, Artificial
  CRISPR gRNA sequence
cttgtcttgtcccctctcag

SEQ ID NO: 59982 - DNA, 20 bp, Artificial
  CRISPR gRNA sequence
tggtcagggcaaggagggcc

SEQ ID NO: 59983 - DNA, 20 bp, Artificial
  CRISPR gRNA sequence
gcctgctttcttagcaaaca

SEQ ID NO: 59984 - DNA, 20 bp, Artificial
  CRISPR gRNA sequence
ctttgttgttgtttcgaaga

SEQ ID NO: 59985 - DNA, 20 bp, Artificial
  CRISPR gRNA sequence
ttttgtattttttgtagaga

SEQ ID NO: 59986 - DNA, 20 bp, Artificial
  CRISPR gRNA sequence
gccttagcctcccaaagtgc

SEQ ID NO: 59987 - DNA, 20 bp, Artificial
  CRISPR gRNA sequence
acatttttttttctttgaga

SEQ ID NO: 59988 - DNA, 20 bp, Artificial
  CRISPR gRNA sequence
tcttgctctgttgcccaggc

SEQ ID NO: 59989 - DNA, 20 bp, Artificial
  CRISPR gRNA sequence
ctcactgtagcctcgatctc

SEQ ID NO: 59990 - DNA, 20 bp, Artificial
  CRISPR gRNA sequence
taaagtttctgtagagatgg

SEQ ID NO: 59991 - DNA, 20 bp, Artificial
  CRISPR gRNA sequence
gtcttggcctcccaaagtgc

SEQ ID NO: 59992 - DNA, 20 bp, Artificial
  CRISPR gRNA sequence
ctgtggcacctcccattctt

SEQ ID NO: 59993 - DNA, 20 bp, Artificial
  CRISPR gRNA sequence
gcagacctcccctgaaaatc

SEQ ID NO: 59994 - DNA, 20 bp, Artificial
  CRISPR gRNA sequence
aaaatcatggatgcggtgcc

SEQ ID NO: 59995 - DNA, 20 bp, Artificial
  CRISPR gRNA sequence
gatgcggtgccctgagtgcc

SEQ ID NO: 59996 - DNA, 20 bp, Artificial
  CRISPR gRNA sequence
cccacaattaagacaggtcc

SEQ ID NO: 59997 - DNA, 20 bp, Artificial
  CRISPR gRNA sequence
ttttctttttttttttgaga

SEQ ID NO: 59998 - DNA, 20 bp, Artificial
  CRISPR gRNA sequence
tctcactctgtcgcccaggc

SEQ ID NO: 59999 - DNA, 20 bp, Artificial
  CRISPR gRNA sequence
ctcactgcaaccttcgcctc

SEQ ID NO: 60000 - DNA, 20 bp, Artificial
  CRISPR gRNA sequence
tttggtatttttagcagaga

SEQ ID NO: 60001 - DNA, 20 bp, Artificial
  CRISPR gRNA sequence
accttggcctcccaaaatgc

SEQ ID NO: 60002 - DNA, 20 bp, Artificial
  CRISPR gRNA sequence
ctctaaggactatccaaaga

SEQ ID NO: 60003 - DNA, 20 bp, Artificial
  CRISPR gRNA sequence
tatccaaagaacgagtgagg

SEQ ID NO: 60004 - DNA, 20 bp, Artificial
  CRISPR gRNA sequence
agtcaatgaactctctaatg

SEQ ID NO: 60005 - DNA, 20 bp, Artificial
  CRISPR gRNA sequence
ctggtactgcccaaggtgct

SEQ ID NO: 60006 - DNA, 20 bp, Artificial
  CRISPR gRNA sequence
acgtgggagcagatgacctg

SEQ ID NO: 60007 - DNA, 20 bp, Artificial
  CRISPR gRNA sequence
tccaagcggaagagccactg

SEQ ID NO: 60008 - DNA, 20 bp, Artificial
  CRISPR gRNA sequence
tcactgaggctggagatcac

SEQ ID NO: 60009 - DNA, 20 bp, Artificial
  CRISPR gRNA sequence
gtcagggcacagggcggggg

SEQ ID NO: 60010 - DNA, 20 bp, Artificial
  CRISPR gRNA sequence
tcatggtggagatggggaaa

SEQ ID NO: 60011 - DNA, 20 bp, Artificial
  CRISPR gRNA sequence
tggggaaacagagtcctaga

SEQ ID NO: 60012 - DNA, 20 bp, Artificial
  CRISPR gRNA sequence
agagctgagatgggcaccca

SEQ ID NO: 60013 - DNA, 20 bp, Artificial
  CRISPR gRNA sequence
agtgggtccctcggtctgtg

SEQ ID NO: 60014 - DNA, 20 bp, Artificial
  CRISPR gRNA sequence
ctcggtctgtgatggatctg

SEQ ID NO: 60015 - DNA, 20 bp, Artificial
  CRISPR gRNA sequence
ttttctccacctgataaggg

SEQ ID NO: 60016 - DNA, 20 bp, Artificial
  CRISPR gRNA sequence
cccaggacaaaatgaaaatg

SEQ ID NO: 60017 - DNA, 20 bp, Artificial
  CRISPR gRNA sequence
acaaagtgtctcctttcttt

SEQ ID NO: 60018 - DNA, 20 bp, Artificial
  CRISPR gRNA sequence
cccacggggacactggtagg

SEQ ID NO: 60019 - DNA, 20 bp, Artificial
  CRISPR gRNA sequence
gaccctcacagcaccaggtc

SEQ ID NO: 60020 - DNA, 20 bp, Artificial
  CRISPR gRNA sequence
ttcccagcattgcacaaaaa

SEQ ID NO: 60021 - DNA, 20 bp, Artificial
  CRISPR gRNA sequence
acaaaaacagggtgtgagca

SEQ ID NO: 60022 - DNA, 20 bp, Artificial
  CRISPR gRNA sequence
gggaaccagggactcggaga

SEQ ID NO: 60023 - DNA, 20 bp, Artificial
  CRISPR gRNA sequence
gagaggggatgtaacttgcc

SEQ ID NO: 60024 - DNA, 20 bp, Artificial
  CRISPR gRNA sequence
gcgtgttcacagagacagcc

SEQ ID NO: 60025 - DNA, 20 bp, Artificial
  CRISPR gRNA sequence
cccagaagtgcctgggagga

SEQ ID NO: 60026 - DNA, 20 bp, Artificial
  CRISPR gRNA sequence
caaaagcaccaagggcattt

SEQ ID NO: 60027 - DNA, 20 bp, Artificial
  CRISPR gRNA sequence
gtccattgcaggcaaacttt

SEQ ID NO: 60028 - DNA, 20 bp, Artificial
  CRISPR gRNA sequence
acactctctgccaggtactc

SEQ ID NO: 60029 - DNA, 20 bp, Artificial
  CRISPR gRNA sequence
ggcagccctgggcaccctgc

SEQ ID NO: 60030 - DNA, 20 bp, Artificial
  CRISPR gRNA sequence
ccctcccggcaccccagggc

SEQ ID NO: 60031 - DNA, 20 bp, Artificial
  CRISPR gRNA sequence
gcacccacacctgccctccc

SEQ ID NO: 60032 - DNA, 20 bp, Artificial
  CRISPR gRNA sequence
caggttccagaagtgaaacc

SEQ ID NO: 60033 - DNA, 20 bp, Artificial
  CRISPR gRNA sequence
gtgaaaccttgaatcagaag

SEQ ID NO: 60034 - DNA, 20 bp, Artificial
  CRISPR gRNA sequence
ttgaatcagaagtgggatta

SEQ ID NO: 60035 - DNA, 20 bp, Artificial
  CRISPR gRNA sequence
attattgagtcacagactct

SEQ ID NO: 60036 - DNA, 20 bp, Artificial
  CRISPR gRNA sequence
gagtcacagactctctgagt

SEQ ID NO: 60037 - DNA, 20 bp, Artificial
  CRISPR gRNA sequence
acaataaccccaggaaagag

SEQ ID NO: 60038 - DNA, 20 bp, Artificial
  CRISPR gRNA sequence
ggaaagagggggatgggaca

SEQ ID NO: 60039 - DNA, 20 bp, Artificial
  CRISPR gRNA sequence
agagcattgcctgagaagct

SEQ ID NO: 60040 - DNA, 20 bp, Artificial
  CRISPR gRNA sequence
ggggagaacattagcaggtg

SEQ ID NO: 60041 - DNA, 20 bp, Artificial
  CRISPR gRNA sequence
agaacattagcaggtgggga

SEQ ID NO: 60042 - DNA, 20 bp, Artificial
  CRISPR gRNA sequence
gcagatctggcacgggcagc

SEQ ID NO: 60043 - DNA, 20 bp, Artificial
  CRISPR gRNA sequence
tcgtggacctctgagggacc

SEQ ID NO: 60044 - DNA, 20 bp, Artificial
  CRISPR gRNA sequence
ctccgagcgtgtcagacatg

SEQ ID NO: 60045 - DNA, 20 bp, Artificial
  CRISPR gRNA sequence
gggatctgtatcttgggagg

SEQ ID NO: 60046 - DNA, 20 bp, Artificial
  CRISPR gRNA sequence
aactttcaccagattctcca

SEQ ID NO: 60047 - DNA, 20 bp, Artificial
  CRISPR gRNA sequence
accccccagacacagaggca

SEQ ID NO: 60048 - DNA, 20 bp, Artificial
  CRISPR gRNA sequence
gcttgcaggagaggagggac

SEQ ID NO: 60049 - DNA, 20 bp, Artificial
  CRISPR gRNA sequence
accaacacacacgacaccca

SEQ ID NO: 60050 - DNA, 20 bp, Artificial
  CRISPR gRNA sequence
caggatgtcacatataggca

SEQ ID NO: 60051 - DNA, 20 bp, Artificial
  CRISPR gRNA sequence
agaccaagagagaagggggg

SEQ ID NO: 60052 - DNA, 20 bp, Artificial
  CRISPR gRNA sequence
gagcccccaggcccaggcac

SEQ ID NO: 60053 - DNA, 20 bp, Artificial
  CRISPR gRNA sequence
tgctccccttcacctctttt

SEQ ID NO: 60054 - DNA, 20 bp, Artificial
  CRISPR gRNA sequence
tccacaacccctcagctgct

SEQ ID NO: 60055 - DNA, 20 bp, Artificial
  CRISPR gRNA sequence
ctgggggtcagggagctaag

SEQ ID NO: 60056 - DNA, 20 bp, Artificial
  CRISPR gRNA sequence
ggtcagggagctaaggggag

SEQ ID NO: 60057 - DNA, 20 bp, Artificial
  CRISPR gRNA sequence
gctgccttgtgagccctgtc

SEQ ID NO: 60058 - DNA, 20 bp, Artificial
  CRISPR gRNA sequence
agcaggggaagggagggggc

SEQ ID NO: 60059 - DNA, 20 bp, Artificial
  CRISPR gRNA sequence
aaggccatgtccgccatctc

SEQ ID NO: 60060 - DNA, 20 bp, Artificial
  CRISPR gRNA sequence
atcgagccctatcctccacc

SEQ ID NO: 60061 - DNA, 20 bp, Artificial
  CRISPR gRNA sequence
tcagagatgtcagccccagc

SEQ ID NO: 60062 - DNA, 20 bp, Artificial
  CRISPR gRNA sequence
cagactctacagaagagatt

SEQ ID NO: 60063 - DNA, 20 bp, Artificial
  CRISPR gRNA sequence
tgggctccgggagcaaagag

SEQ ID NO: 60064 - DNA, 20 bp, Artificial
  CRISPR gRNA sequence
tggggcaatccaggacccta

SEQ ID NO: 60065 - DNA, 20 bp, Artificial
  CRISPR gRNA sequence
ctaatgggtccttgtgtgaa

SEQ ID NO: 60066 - DNA, 20 bp, Artificial
  CRISPR gRNA sequence
gctacaggccaggcaatccc

SEQ ID NO: 60067 - DNA, 20 bp, Artificial
  CRISPR gRNA sequence
gctggagggctctagtctcc

SEQ ID NO: 60068 - DNA, 20 bp, Artificial
  CRISPR gRNA sequence
ccatgagaggcggaggtggt

SEQ ID NO: 60069 - DNA, 20 bp, Artificial
  CRISPR gRNA sequence
tgctcacttcccgctcttcc

SEQ ID NO: 60070 - DNA, 20 bp, Artificial
  CRISPR gRNA sequence
actggcactgcccagctgtg

SEQ ID NO: 60071 - DNA, 20 bp, Artificial
  CRISPR gRNA sequence
cagctgtggagggtagagag

SEQ ID NO: 60072 - DNA, 20 bp, Artificial
  CRISPR gRNA sequence
ggaatgtccctgactgagca

SEQ ID NO: 60073 - DNA, 20 bp, Artificial
  CRISPR gRNA sequence
tccctgactgagcatggagt

SEQ ID NO: 60074 - DNA, 20 bp, Artificial
  CRISPR gRNA sequence
gcaggctgtgaagacaaaag

SEQ ID NO: 60075 - DNA, 20 bp, Artificial
  CRISPR gRNA sequence
aatcctcccacttcagcctc

SEQ ID NO: 60076 - DNA, 20 bp, Artificial
  CRISPR gRNA sequence
acttcagcctcctgagtagc

SEQ ID NO: 60077 - DNA, 20 bp, Artificial
  CRISPR gRNA sequence
acctttgcttcccaaagtgc

SEQ ID NO: 60078 - DNA, 20 bp, Artificial
  CRISPR gRNA sequence
tgtctgtgctcaaagtatgt

SEQ ID NO: 60079 - DNA, 20 bp, Artificial
  CRISPR gRNA sequence
ggattacccctggtaacctt

SEQ ID NO: 60080 - DNA, 20 bp, Artificial
  CRISPR gRNA sequence
tacccctggtaacctttgga

SEQ ID NO: 60081 - DNA, 20 bp, Artificial
  CRISPR gRNA sequence
taatttttgttttacaaaca

SEQ ID NO: 60082 - DNA, 20 bp, Artificial
  CRISPR gRNA sequence
gttttttaagggctagaagc

SEQ ID NO: 60083 - DNA, 20 bp, Artificial
  CRISPR gRNA sequence
tttttttttttaatttgaga

SEQ ID NO: 60084 - DNA, 20 bp, Artificial
  CRISPR gRNA sequence
tcttgctctgtctcccaggc

SEQ ID NO: 60085 - DNA, 20 bp, Artificial
  CRISPR gRNA sequence
gattctcctgcctcagcctc

SEQ ID NO: 60086 - DNA, 20 bp, Artificial
  CRISPR gRNA sequence
gcctcagcctcctgagtagc

SEQ ID NO: 60087 - DNA, 20 bp, Artificial
  CRISPR gRNA sequence
ttttgtatttttagtagaga

SEQ ID NO: 60088 - DNA, 20 bp, Artificial
  CRISPR gRNA sequence
tgcctcagcctcccaaagtg

SEQ ID NO: 60089 - DNA, 20 bp, Artificial
  CRISPR gRNA sequence
ttttataatcttttaagata

SEQ ID NO: 60090 - DNA, 20 bp, Artificial
  CRISPR gRNA sequence
tctttgggaggccagggcag

SEQ ID NO: 60091 - DNA, 20 bp, Artificial
  CRISPR gRNA sequence
caggaggatcacatgagctc

SEQ ID NO: 60092 - DNA, 20 bp, Artificial
  CRISPR gRNA sequence
actttgggagactaagagag

SEQ ID NO: 60093 - DNA, 20 bp, Artificial
  CRISPR gRNA sequence
gagagatggattgctgagcc

SEQ ID NO: 60094 - DNA, 20 bp, Artificial
  CRISPR gRNA sequence
tttttttttctatggttcca

SEQ ID NO: 60095 - DNA, 20 bp, Artificial
  CRISPR gRNA sequence
gaagtgaacagggcatcgct

SEQ ID NO: 60096 - DNA, 20 bp, Artificial
  CRISPR gRNA sequence
aatgcactagggacccttta

SEQ ID NO: 60097 - DNA, 20 bp, Artificial
  CRISPR gRNA sequence
aaggtcccctaatctacctt

SEQ ID NO: 60098 - DNA, 20 bp, Artificial
  CRISPR gRNA sequence
tcccctaatctaccttttgg

SEQ ID NO: 60099 - DNA, 20 bp, Artificial
  CRISPR gRNA sequence
ggtttccctctcctcccttg

SEQ ID NO: 60100 - DNA, 20 bp, Artificial
  CRISPR gRNA sequence
ttaaagcagggaccacccta

SEQ ID NO: 60101 - DNA, 20 bp, Artificial
  CRISPR gRNA sequence
agggaccaccctactgggtt

SEQ ID NO: 60102 - DNA, 20 bp, Artificial
  CRISPR gRNA sequence
gttgagaatgaggctttcct

SEQ ID NO: 60103 - DNA, 20 bp, Artificial
  CRISPR gRNA sequence
ggctttcctccgagtgggaa

SEQ ID NO: 60104 - DNA, 20 bp, Artificial
  CRISPR gRNA sequence
aacggcgagacttacagaaa

SEQ ID NO: 60105 - DNA, 20 bp, Artificial
  CRISPR gRNA sequence
cgagacttacagaaatagga

SEQ ID NO: 60106 - DNA, 20 bp, Artificial
  CRISPR gRNA sequence
gggttccctagtggcagagc

SEQ ID NO: 60107 - DNA, 20 bp, Artificial
  CRISPR gRNA sequence
tagtggcagagcctgggtct

SEQ ID NO: 60108 - DNA, 20 bp, Artificial
  CRISPR gRNA sequence
gcagagcctgggtctgtgag

SEQ ID NO: 60109 - DNA, 20 bp, Artificial
  CRISPR gRNA sequence
ctgggtctgtgagtggggta

SEQ ID NO: 60110 - DNA, 20 bp, Artificial
  CRISPR gRNA sequence
cagggagctttgtcccactg

SEQ ID NO: 60111 - DNA, 20 bp, Artificial
  CRISPR gRNA sequence
ccactggagagtttgggctg

SEQ ID NO: 60112 - DNA, 20 bp, Artificial
  CRISPR gRNA sequence
actctaggttaggggaaagt

SEQ ID NO: 60113 - DNA, 20 bp, Artificial
  CRISPR gRNA sequence
gtctctggttcttatcagcc

SEQ ID NO: 60114 - DNA, 20 bp, Artificial
  CRISPR gRNA sequence
tatccacagcagctaggaag

SEQ ID NO: 60115 - DNA, 20 bp, Artificial
  CRISPR gRNA sequence
aagaggggtgccggctgtaa

SEQ ID NO: 60116 - DNA, 20 bp, Artificial
  CRISPR gRNA sequence
ggtgccggctgtaacggggt

SEQ ID NO: 60117 - DNA, 20 bp, Artificial
  CRISPR gRNA sequence
tcccaaggcctgggcccaga

SEQ ID NO: 60118 - DNA, 20 bp, Artificial
  CRISPR gRNA sequence
agagagagcatgatgggggg

SEQ ID NO: 60119 - DNA, 20 bp, Artificial
  CRISPR gRNA sequence
agagcatgatgggggggggg

SEQ ID NO: 60120 - DNA, 20 bp, Artificial
  CRISPR gRNA sequence
cacctgatgtgcagctctgc

SEQ ID NO: 60121 - DNA, 20 bp, Artificial
  CRISPR gRNA sequence
cagcttgctggctgtcactc

SEQ ID NO: 60122 - DNA, 20 bp, Artificial
  CRISPR gRNA sequence
atgtcctaggtcccttgcca

SEQ ID NO: 60123 - DNA, 20 bp, Artificial
  CRISPR gRNA sequence
tcccttgccaggggatctca

SEQ ID NO: 60124 - DNA, 20 bp, Artificial
  CRISPR gRNA sequence
ctcaaaggattctggtgcgt

SEQ ID NO: 60125 - DNA, 20 bp, Artificial
  CRISPR gRNA sequence
gctccagggcagctacaaag

SEQ ID NO: 60126 - DNA, 20 bp, Artificial
  CRISPR gRNA sequence
gggcagctacaaagatgaat

SEQ ID NO: 60127 - DNA, 20 bp, Artificial
  CRISPR gRNA sequence
tgaacgcattttacacatgt

SEQ ID NO: 60128 - DNA, 20 bp, Artificial
  CRISPR gRNA sequence
tcaaaccatcttgactttgc

SEQ ID NO: 60129 - DNA, 20 bp, Artificial
  CRISPR gRNA sequence
tgctggagttgggaggaagc

SEQ ID NO: 60130 - DNA, 20 bp, Artificial
  CRISPR gRNA sequence
gggaggaagcaggggtggca

SEQ ID NO: 60131 - DNA, 20 bp, Artificial
  CRISPR gRNA sequence
ccttccctggtacccagcgg

SEQ ID NO: 60132 - DNA, 20 bp, Artificial
  CRISPR gRNA sequence
gcttcctggcgatgtgcagc

SEQ ID NO: 60133 - DNA, 20 bp, Artificial
  CRISPR gRNA sequence
aatgcactgtattgtggggc

SEQ ID NO: 60134 - DNA, 20 bp, Artificial
  CRISPR gRNA sequence
ttagtcaaagtgtcactctc

SEQ ID NO: 60135 - DNA, 20 bp, Artificial
  CRISPR gRNA sequence
taattatcctcaccttactg

SEQ ID NO: 60136 - DNA, 20 bp, Artificial
  CRISPR gRNA sequence
ctgatgagtaaactcaagtg

SEQ ID NO: 60137 - DNA, 20 bp, Artificial
  CRISPR gRNA sequence
aagtgcagagtggttaagtg

SEQ ID NO: 60138 - DNA, 20 bp, Artificial
  CRISPR gRNA sequence
gcacttgctcgagggagaac

SEQ ID NO: 60139 - DNA, 20 bp, Artificial
  CRISPR gRNA sequence
gggggcatctgacctagtct

SEQ ID NO: 60140 - DNA, 20 bp, Artificial
  CRISPR gRNA sequence
tctgacctagtctgggagtc

SEQ ID NO: 60141 - DNA, 20 bp, Artificial
  CRISPR gRNA sequence
agctacttgctgaaataact

SEQ ID NO: 60142 - DNA, 20 bp, Artificial
  CRISPR gRNA sequence
ggttgggggagagatggagg

SEQ ID NO: 60143 - DNA, 20 bp, Artificial
  CRISPR gRNA sequence
ctgaaagagagccagtgtgt

SEQ ID NO: 60144 - DNA, 20 bp, Artificial
  CRISPR gRNA sequence
cagtgtgtctggattggaga

SEQ ID NO: 60145 - DNA, 20 bp, Artificial
  CRISPR gRNA sequence
ctggattggagattgagtgg

SEQ ID NO: 60146 - DNA, 20 bp, Artificial
  CRISPR gRNA sequence
ttggagattgagtggaagga

SEQ ID NO: 60147 - DNA, 20 bp, Artificial
  CRISPR gRNA sequence
agtggaaggatggggtcaga

SEQ ID NO: 60148 - DNA, 20 bp, Artificial
  CRISPR gRNA sequence
ggggtttaggaggctggggg

SEQ ID NO: 60149 - DNA, 20 bp, Artificial
  CRISPR gRNA sequence
ggcagggttctggaccacct

SEQ ID NO: 60150 - DNA, 20 bp, Artificial
  CRISPR gRNA sequence
ttctggaccacctgggagtt

SEQ ID NO: 60151 - DNA, 20 bp, Artificial
  CRISPR gRNA sequence
accacctgggagtttagaat

SEQ ID NO: 60152 - DNA, 20 bp, Artificial
  CRISPR gRNA sequence
ttttatcctgagcagtggga

SEQ ID NO: 60153 - DNA, 20 bp, Artificial
  CRISPR gRNA sequence
ctctgccaggtggaagtggc

SEQ ID NO: 60154 - DNA, 20 bp, Artificial
  CRISPR gRNA sequence
cagcaaggaaggcaaggcga

SEQ ID NO: 60155 - DNA, 20 bp, Artificial
  CRISPR gRNA sequence
gggtcatccaggtaagagat

SEQ ID NO: 60156 - DNA, 20 bp, Artificial
  CRISPR gRNA sequence
catccaggtaagagatgagg

SEQ ID NO: 60157 - DNA, 20 bp, Artificial
  CRISPR gRNA sequence
actagaaaggtggaggaaaa

SEQ ID NO: 60158 - DNA, 20 bp, Artificial
  CRISPR gRNA sequence
ggaggtggctgcgtaaccag

SEQ ID NO: 60159 - DNA, 20 bp, Artificial
  CRISPR gRNA sequence
tctcccaatgggacgaggtc

SEQ ID NO: 60160 - DNA, 20 bp, Artificial
  CRISPR gRNA sequence
tcctggaggggcgcccctcc

SEQ ID NO: 60161 - DNA, 20 bp, Artificial
  CRISPR gRNA sequence
agccaggggctggacgccat

SEQ ID NO: 60162 - DNA, 20 bp, Artificial
  CRISPR gRNA sequence
atcccactctactctgggag

SEQ ID NO: 60163 - DNA, 20 bp, Artificial
  CRISPR gRNA sequence
tactctgggagaaggatgaa

SEQ ID NO: 60164 - DNA, 20 bp, Artificial
  CRISPR gRNA sequence
gaaggcagacccaggtgtgg

SEQ ID NO: 60165 - DNA, 20 bp, Artificial
  CRISPR gRNA sequence
agagaggtagcagtggttat

SEQ ID NO: 60166 - DNA, 20 bp, Artificial
  CRISPR gRNA sequence
gcttacatcacagagatgtg

SEQ ID NO: 60167 - DNA, 20 bp, Artificial
  CRISPR gRNA sequence
acatcacagagatgtgagga

SEQ ID NO: 60168 - DNA, 20 bp, Artificial
  CRISPR gRNA sequence
cacctgacccgggacaagtg

SEQ ID NO: 60169 - DNA, 20 bp, Artificial
  CRISPR gRNA sequence
gagctgacacttctgcagcc

SEQ ID NO: 60170 - DNA, 20 bp, Artificial
  CRISPR gRNA sequence
acacttctgcagccttgggt

SEQ ID NO: 60171 - DNA, 20 bp, Artificial
  CRISPR gRNA sequence
cctccagcttccaatgctgg

SEQ ID NO: 60172 - DNA, 20 bp, Artificial
  CRISPR gRNA sequence
gagtcagggggcccacagac

SEQ ID NO: 60173 - DNA, 20 bp, Artificial
  CRISPR gRNA sequence
ctagccacacctcttagtag

SEQ ID NO: 60174 - DNA, 20 bp, Artificial
  CRISPR gRNA sequence
agtttcctcctccctcaaag

SEQ ID NO: 60175 - DNA, 20 bp, Artificial
  CRISPR gRNA sequence
gtacttcacagagattctaa

SEQ ID NO: 60176 - DNA, 20 bp, Artificial
  CRISPR gRNA sequence
aaaggaattacagtgaggta

SEQ ID NO: 60177 - DNA, 20 bp, Artificial
  CRISPR gRNA sequence
cagatgctccttattcaagc

SEQ ID NO: 60178 - DNA, 20 bp, Artificial
  CRISPR gRNA sequence
tcaagccaggatgggctatc

SEQ ID NO: 60179 - DNA, 20 bp, Artificial
  CRISPR gRNA sequence
gctcaggcatctagggcctg

SEQ ID NO: 60180 - DNA, 20 bp, Artificial
  CRISPR gRNA sequence
accctgaagcacaacccaaa

SEQ ID NO: 60181 - DNA, 20 bp, Artificial
  CRISPR gRNA sequence
tcccttttctcttttctaaa

SEQ ID NO: 60182 - DNA, 20 bp, Artificial
  CRISPR gRNA sequence
atctagcacataggtacctg

SEQ ID NO: 60183 - DNA, 20 bp, Artificial
  CRISPR gRNA sequence
gcacataggtacctgaagga

SEQ ID NO: 60184 - DNA, 20 bp, Artificial
  CRISPR gRNA sequence
tgatgtgatggtctccattt

SEQ ID NO: 60185 - DNA, 20 bp, Artificial
  CRISPR gRNA sequence
aggagcatgagctgtatgca

SEQ ID NO: 60186 - DNA, 20 bp, Artificial
  CRISPR gRNA sequence
actgggctgagggagcgtta

SEQ ID NO: 60187 - DNA, 20 bp, Artificial
  CRISPR gRNA sequence
agccaggtttcacagacttt

SEQ ID NO: 60188 - DNA, 20 bp, Artificial
  CRISPR gRNA sequence
catttttttttttttagaga

SEQ ID NO: 60189 - DNA, 20 bp, Artificial
  CRISPR gRNA sequence
gtcccactcagtccccaagc

SEQ ID NO: 60190 - DNA, 20 bp, Artificial
  CRISPR gRNA sequence
gatcctcccaccttggcttc

SEQ ID NO: 60191 - DNA, 20 bp, Artificial
  CRISPR gRNA sequence
tcctgagtaactggtactat

SEQ ID NO: 60192 - DNA, 20 bp, Artificial
  CRISPR gRNA sequence
gagtaactggtactatagga

SEQ ID NO: 60193 - DNA, 20 bp, Artificial
  CRISPR gRNA sequence
ttttttttttttgtagagat

SEQ ID NO: 60194 - DNA, 20 bp, Artificial
  CRISPR gRNA sequence
ccctcagcctctcaaagtgc

SEQ ID NO: 60195 - DNA, 20 bp, Artificial
  CRISPR gRNA sequence
agaaagtgacactggtccta

SEQ ID NO: 60196 - DNA, 20 bp, Artificial
  CRISPR gRNA sequence
tagtgggtcattttttgaga

SEQ ID NO: 60197 - DNA, 20 bp, Artificial
  CRISPR gRNA sequence
tccctctctgtcacccaggc

SEQ ID NO: 60198 - DNA, 20 bp, Artificial
  CRISPR gRNA sequence
atcctcccaacgtcagcatc

SEQ ID NO: 60199 - DNA, 20 bp, Artificial
  CRISPR gRNA sequence
ctgccttttttttttagaga

SEQ ID NO: 60200 - DNA, 20 bp, Artificial
  CRISPR gRNA sequence
ccaggctggtcttgaacacc

SEQ ID NO: 60201 - DNA, 20 bp, Artificial
  CRISPR gRNA sequence
tgcttggcgttccaaagtgc

SEQ ID NO: 60202 - DNA, 20 bp, Artificial
  CRISPR gRNA sequence
accaggtcattatacaagca

SEQ ID NO: 60203 - DNA, 20 bp, Artificial
  CRISPR gRNA sequence
gggcatacatacatctgtct

SEQ ID NO: 60204 - DNA, 20 bp, Artificial
  CRISPR gRNA sequence
aaagtgtggtagagcacagt

SEQ ID NO: 60205 - DNA, 20 bp, Artificial
  CRISPR gRNA sequence
ccatccaagactggccaagc

SEQ ID NO: 60206 - DNA, 20 bp, Artificial
  CRISPR gRNA sequence
agctggaatccatgcacagc

SEQ ID NO: 60207 - DNA, 20 bp, Artificial
  CRISPR gRNA sequence
ttcagttgtaagggcttttc

SEQ ID NO: 60208 - DNA, 20 bp, Artificial
  CRISPR gRNA sequence
agtatctttatgttctcccc

SEQ ID NO: 60209 - DNA, 20 bp, Artificial
  CRISPR gRNA sequence
ccccaagggtttgccttcct

SEQ ID NO: 60210 - DNA, 20 bp, Artificial
  CRISPR gRNA sequence
tgccttcctctgagtcttct

SEQ ID NO: 60211 - DNA, 20 bp, Artificial
  CRISPR gRNA sequence
ctcagtgcagcagtagcagg

SEQ ID NO: 60212 - DNA, 20 bp, Artificial
  CRISPR gRNA sequence
cctgagcccaagttgcttct

SEQ ID NO: 60213 - DNA, 20 bp, Artificial
  CRISPR gRNA sequence
agatgaggtccgcctccctg

SEQ ID NO: 60214 - DNA, 20 bp, Artificial
  CRISPR gRNA sequence
actgattatgtctttgcttg

SEQ ID NO: 60215 - DNA, 20 bp, Artificial
  CRISPR gRNA sequence
ctttgcttgatgaatcctgc

SEQ ID NO: 60216 - DNA, 20 bp, Artificial
  CRISPR gRNA sequence
caagaaatataataaaaatt

SEQ ID NO: 60217 - DNA, 20 bp, Artificial
  CRISPR gRNA sequence
taataaaaattaagaatgtt

SEQ ID NO: 60218 - DNA, 20 bp, Artificial
  CRISPR gRNA sequence
tctcactctgctactcaggc

SEQ ID NO: 60219 - DNA, 20 bp, Artificial
  CRISPR gRNA sequence
gccttggccttccaaagtgt

SEQ ID NO: 60220 - DNA, 20 bp, Artificial
  CRISPR gRNA sequence
gcatgagccactgagcccgg

SEQ ID NO: 60221 - DNA, 20 bp, Artificial
  CRISPR gRNA sequence
tttttttaatagaaattttt

SEQ ID NO: 60222 - DNA, 20 bp, Artificial
  CRISPR gRNA sequence
taggttctgaaggtaaagct

SEQ ID NO: 60223 - DNA, 20 bp, Artificial
  CRISPR gRNA sequence
taaagctgtgagtaaaacag

SEQ ID NO: 60224 - DNA, 20 bp, Artificial
  CRISPR gRNA sequence
tgactgccacccttgccaag

SEQ ID NO: 60225 - DNA, 20 bp, Artificial
  CRISPR gRNA sequence
gccacccttgccaagcagag

SEQ ID NO: 60226 - DNA, 20 bp, Artificial
  CRISPR gRNA sequence
aagattgtggcaaaggtgtc

SEQ ID NO: 60227 - DNA, 20 bp, Artificial
  CRISPR gRNA sequence
tgtggcaaaggtgtcaggag

SEQ ID NO: 60228 - DNA, 20 bp, Artificial
  CRISPR gRNA sequence
agaccttccttgccttgcaa

SEQ ID NO: 60229 - DNA, 20 bp, Artificial
  CRISPR gRNA sequence
ttccttgccttgcaagggag

SEQ ID NO: 60230 - DNA, 20 bp, Artificial
  CRISPR gRNA sequence
ttgccttgcaagggagtggg

SEQ ID NO: 60231 - DNA, 20 bp, Artificial
  CRISPR gRNA sequence
aaggcccagtccctttgccc

SEQ ID NO: 60232 - DNA, 20 bp, Artificial
  CRISPR gRNA sequence
aagccccagttagcaagtga

SEQ ID NO: 60233 - DNA, 20 bp, Artificial
  CRISPR gRNA sequence
aagagctgatggcctgctcg

SEQ ID NO: 60234 - DNA, 20 bp, Artificial
  CRISPR gRNA sequence
accctctgctggcctcaatt

SEQ ID NO: 60235 - DNA, 20 bp, Artificial
  CRISPR gRNA sequence
agtttttgcctggcggctca

SEQ ID NO: 60236 - DNA, 20 bp, Artificial
  CRISPR gRNA sequence
ctgctcccagggcttatgcc

SEQ ID NO: 60237 - DNA, 20 bp, Artificial
  CRISPR gRNA sequence
gcttatgcctgggatgtgcc

SEQ ID NO: 60238 - DNA, 20 bp, Artificial
  CRISPR gRNA sequence
tgggataggccccccaggca

SEQ ID NO: 60239 - DNA, 20 bp, Artificial
  CRISPR gRNA sequence
tgttcacaagccagccttgc

SEQ ID NO: 60240 - DNA, 20 bp, Artificial
  CRISPR gRNA sequence
gttcctagctggggagacag

SEQ ID NO: 60241 - DNA, 20 bp, Artificial
  CRISPR gRNA sequence
ggggagacagatgagttgag

SEQ ID NO: 60242 - DNA, 20 bp, Artificial
  CRISPR gRNA sequence
acagatgagttgaggggagt

SEQ ID NO: 60243 - DNA, 20 bp, Artificial
  CRISPR gRNA sequence
gagggtgattaagaacaatg

SEQ ID NO: 60244 - DNA, 20 bp, Artificial
  CRISPR gRNA sequence
tagtgacaggctgcatctgt

SEQ ID NO: 60245 - DNA, 20 bp, Artificial
  CRISPR gRNA sequence
agcagcgttctgccagggag

SEQ ID NO: 60246 - DNA, 20 bp, Artificial
  CRISPR gRNA sequence
tcccactcctccccatggta

SEQ ID NO: 60247 - DNA, 20 bp, Artificial
  CRISPR gRNA sequence
ctgagtcccagacacagggc

SEQ ID NO: 60248 - DNA, 20 bp, Artificial
  CRISPR gRNA sequence
tgcatacaagcttagttagt

SEQ ID NO: 60249 - DNA, 20 bp, Artificial
  CRISPR gRNA sequence
ctgcatacatgtgcacacct

SEQ ID NO: 60250 - DNA, 20 bp, Artificial
  CRISPR gRNA sequence
acacctatgagtgggcatgt

SEQ ID NO: 60251 - DNA, 20 bp, Artificial
  CRISPR gRNA sequence
cgcactgctatcccttctcc

SEQ ID NO: 60252 - DNA, 20 bp, Artificial
  CRISPR gRNA sequence
ctctggggactctgggagcc

SEQ ID NO: 60253 - DNA, 20 bp, Artificial
  CRISPR gRNA sequence
tgggtttggactcagcccta

SEQ ID NO: 60254 - DNA, 20 bp, Artificial
  CRISPR gRNA sequence
tggactgatgccttccctct

SEQ ID NO: 60255 - DNA, 20 bp, Artificial
  CRISPR gRNA sequence
ttttacttcctgctaaccta

SEQ ID NO: 60256 - DNA, 20 bp, Artificial
  CRISPR gRNA sequence
gaggggaaaagggcggggcc

SEQ ID NO: 60257 - DNA, 20 bp, Artificial
  CRISPR gRNA sequence
ggccaggaatctgccttgtg

SEQ ID NO: 60258 - DNA, 20 bp, Artificial
  CRISPR gRNA sequence
gtaggattaaggagagggag

SEQ ID NO: 60259 - DNA, 20 bp, Artificial
  CRISPR gRNA sequence
taagaagaagcgaagtgtca

SEQ ID NO: 60260 - DNA, 20 bp, Artificial
  CRISPR gRNA sequence
ggtgactatgttctcaccaa

SEQ ID NO: 60261 - DNA, 20 bp, Artificial
  CRISPR gRNA sequence
tatgttctcaccaatggaat

SEQ ID NO: 60262 - DNA, 20 bp, Artificial
  CRISPR gRNA sequence
accaatggaatgtgagtgga

SEQ ID NO: 60263 - DNA, 20 bp, Artificial
  CRISPR gRNA sequence
cgtagctttgactgtgcaga

SEQ ID NO: 60264 - DNA, 20 bp, Artificial
  CRISPR gRNA sequence
tgtgcagataggattcccaa

SEQ ID NO: 60265 - DNA, 20 bp, Artificial
  CRISPR gRNA sequence
tggagcaaaatgggagggac

SEQ ID NO: 60266 - DNA, 20 bp, Artificial
  CRISPR gRNA sequence
ctcattcttgcaatgaccat

SEQ ID NO: 60267 - DNA, 20 bp, Artificial
  CRISPR gRNA sequence
caccagcctctatagacagc

SEQ ID NO: 60268 - DNA, 20 bp, Artificial
  CRISPR gRNA sequence
ccatgattgacagagagact

SEQ ID NO: 60269 - DNA, 20 bp, Artificial
  CRISPR gRNA sequence
ccagaaaccacagacaagag

SEQ ID NO: 60270 - DNA, 20 bp, Artificial
  CRISPR gRNA sequence
ggacagccatcaaaatccag

SEQ ID NO: 60271 - DNA, 20 bp, Artificial
  CRISPR gRNA sequence
atgggggcctccctgtgctc

SEQ ID NO: 60272 - DNA, 20 bp, Artificial
  CRISPR gRNA sequence
ctgtgctctaggatgttggt

SEQ ID NO: 60273 - DNA, 20 bp, Artificial
  CRISPR gRNA sequence
acctttggccctgtgagctt

SEQ ID NO: 60274 - DNA, 20 bp, Artificial
  CRISPR gRNA sequence
taaggaaggggcggcaggtg

SEQ ID NO: 60275 - DNA, 20 bp, Artificial
  CRISPR gRNA sequence
tttggtccgctgtacccagc

SEQ ID NO: 60276 - DNA, 20 bp, Artificial
  CRISPR gRNA sequence
cgctgtacccagcgggaatg

SEQ ID NO: 60277 - DNA, 20 bp, Artificial
  CRISPR gRNA sequence
cgggaatggagggtaacata

SEQ ID NO: 60278 - DNA, 20 bp, Artificial
  CRISPR gRNA sequence
agaaactcctgcaggctgag

SEQ ID NO: 60279 - DNA, 20 bp, Artificial
  CRISPR gRNA sequence
cagaaggaagtcagcaggct

SEQ ID NO: 60280 - DNA, 20 bp, Artificial
  CRISPR gRNA sequence
gagtggccccaaaagctatc

SEQ ID NO: 60281 - DNA, 20 bp, Artificial
  CRISPR gRNA sequence
agcaccatctgcatatagag

SEQ ID NO: 60282 - DNA, 20 bp, Artificial
  CRISPR gRNA sequence
atcacccggcagccaggcag

SEQ ID NO: 60283 - DNA, 20 bp, Artificial
  CRISPR gRNA sequence
ccattgcagagatgggagaa

SEQ ID NO: 60284 - DNA, 20 bp, Artificial
  CRISPR gRNA sequence
tcgtgatcaagttgagctgg

SEQ ID NO: 60285 - DNA, 20 bp, Artificial
  CRISPR gRNA sequence
tcccccataatggccccctc

SEQ ID NO: 60286 - DNA, 20 bp, Artificial
  CRISPR gRNA sequence
tggccccctccggagtgtct

SEQ ID NO: 60287 - DNA, 20 bp, Artificial
  CRISPR gRNA sequence
aaggatgctgtggcccggcg

SEQ ID NO: 60288 - DNA, 20 bp, Artificial
  CRISPR gRNA sequence
gcgtggggctgccctgaccc

SEQ ID NO: 60289 - DNA, 20 bp, Artificial
  CRISPR gRNA sequence
ccccagatgtgtatgtatga

SEQ ID NO: 60290 - DNA, 20 bp, Artificial
  CRISPR gRNA sequence
atgtgtatgtatgatggggt

SEQ ID NO: 60291 - DNA, 20 bp, Artificial
  CRISPR gRNA sequence
atgtatgatggggtgagggt

SEQ ID NO: 60292 - DNA, 20 bp, Artificial
  CRISPR gRNA sequence
gggtgtcaagagcaccatag

SEQ ID NO: 60293 - DNA, 20 bp, Artificial
  CRISPR gRNA sequence
gtgccaccccaacttccaga

SEQ ID NO: 60294 - DNA, 20 bp, Artificial
  CRISPR gRNA sequence
agctatttaaacaggcaggt

SEQ ID NO: 60295 - DNA, 20 bp, Artificial
  CRISPR gRNA sequence
gcaggtgggaatggggaagt

SEQ ID NO: 60296 - DNA, 20 bp, Artificial
  CRISPR gRNA sequence
tgcaatagtacacgtggtgt

SEQ ID NO: 60297 - DNA, 20 bp, Artificial
  CRISPR gRNA sequence
gttcagtaagatggggggag

SEQ ID NO: 60298 - DNA, 20 bp, Artificial
  CRISPR gRNA sequence
tttttcttttttcccagaga

SEQ ID NO: 60299 - DNA, 20 bp, Artificial
  CRISPR gRNA sequence
gatcctcctgcctcagcctc

SEQ ID NO: 60300 - DNA, 20 bp, Artificial
  CRISPR gRNA sequence
tcacgttggccaggctagta

SEQ ID NO: 60301 - DNA, 20 bp, Artificial
  CRISPR gRNA sequence
gcctcagccctccaaagtgc

SEQ ID NO: 60302 - DNA, 20 bp, Artificial
  CRISPR gRNA sequence
acaacctctttctgtaatat

SEQ ID NO: 60303 - DNA, 20 bp, Artificial
  CRISPR gRNA sequence
atttcagttctgcaatgccc

SEQ ID NO: 60304 - DNA, 20 bp, Artificial
  CRISPR gRNA sequence
agatgttaaccttttaattc

SEQ ID NO: 60305 - DNA, 20 bp, Artificial
  CRISPR gRNA sequence
aaggtagtgaactattttga

SEQ ID NO: 60306 - DNA, 20 bp, Artificial
  CRISPR gRNA sequence
gtgaactattttgagcggat

SEQ ID NO: 60307 - DNA, 20 bp, Artificial
  CRISPR gRNA sequence
gaccattctgagaactggtc

SEQ ID NO: 60308 - DNA, 20 bp, Artificial
  CRISPR gRNA sequence
cccccaaactggtctcctcc

SEQ ID NO: 60309 - DNA, 20 bp, Artificial
  CRISPR gRNA sequence
ctccttcaacactgaggaca

SEQ ID NO: 60310 - DNA, 20 bp, Artificial
  CRISPR gRNA sequence
agaagtccccatgcagccag

SEQ ID NO: 60311 - DNA, 20 bp, Artificial
  CRISPR gRNA sequence
ctcctggaaacttgcgagac

SEQ ID NO: 60312 - DNA, 20 bp, Artificial
  CRISPR gRNA sequence
tattggcaggggacaaggtc

SEQ ID NO: 60313 - DNA, 20 bp, Artificial
  CRISPR gRNA sequence
caggggacaaggtccagggt

SEQ ID NO: 60314 - DNA, 20 bp, Artificial
  CRISPR gRNA sequence
gcttcttgcactgcttccgg

SEQ ID NO: 60315 - DNA, 20 bp, Artificial
  CRISPR gRNA sequence
aggcctgaaaaagcaaagga

SEQ ID NO: 60316 - DNA, 20 bp, Artificial
  CRISPR gRNA sequence
aaaagcaaaggaaggggtgg

SEQ ID NO: 60317 - DNA, 20 bp, Artificial
  CRISPR gRNA sequence
caaaggaaggggtggaggag

SEQ ID NO: 60318 - DNA, 20 bp, Artificial
  CRISPR gRNA sequence
ggggtggaggagtggggtct

SEQ ID NO: 60319 - DNA, 20 bp, Artificial
  CRISPR gRNA sequence
gggtctggggatctgggctg

SEQ ID NO: 60320 - DNA, 20 bp, Artificial
  CRISPR gRNA sequence
aggcaggcagcaggcagagg

SEQ ID NO: 60321 - DNA, 20 bp, Artificial
  CRISPR gRNA sequence
tcaacaccagcttctatttg

SEQ ID NO: 60322 - DNA, 20 bp, Artificial
  CRISPR gRNA sequence
ctaggcacccccattggaag

SEQ ID NO: 60323 - DNA, 20 bp, Artificial
  CRISPR gRNA sequence
ggcctggcagtcttgcagtc

SEQ ID NO: 60324 - DNA, 20 bp, Artificial
  CRISPR gRNA sequence
tcatataagtgaagttccca

SEQ ID NO: 60325 - DNA, 20 bp, Artificial
  CRISPR gRNA sequence
ctgcaacctccctcctctgt

SEQ ID NO: 60326 - DNA, 20 bp, Artificial
  CRISPR gRNA sequence
tcacttcccttaatagtttc

SEQ ID NO: 60327 - DNA, 20 bp, Artificial
  CRISPR gRNA sequence
ctggagtcttgtctcattgt

SEQ ID NO: 60328 - DNA, 20 bp, Artificial
  CRISPR gRNA sequence
tcactttaatgcctttctgg

SEQ ID NO: 60329 - DNA, 20 bp, Artificial
  CRISPR gRNA sequence
aaaggaaagaggactcagga

SEQ ID NO: 60330 - DNA, 20 bp, Artificial
  CRISPR gRNA sequence
aagaattttaagaagtcaag

SEQ ID NO: 60331 - DNA, 20 bp, Artificial
  CRISPR gRNA sequence
tcactggggagctgaggtta

SEQ ID NO: 60332 - DNA, 20 bp, Artificial
  CRISPR gRNA sequence
tggggagctgaggttatagg

SEQ ID NO: 60333 - DNA, 20 bp, Artificial
  CRISPR gRNA sequence
ctgagatgaaagtgtgaccc

SEQ ID NO: 60334 - DNA, 20 bp, Artificial
  CRISPR gRNA sequence
ccccgctgaagacagcagct

SEQ ID NO: 60335 - DNA, 20 bp, Artificial
  CRISPR gRNA sequence
gctgaagacagcagctgtgg

SEQ ID NO: 60336 - DNA, 20 bp, Artificial
  CRISPR gRNA sequence
ccaaggtgtacaagtcggga

SEQ ID NO: 60337 - DNA, 20 bp, Artificial
  CRISPR gRNA sequence
gggctgggagatgaggccct

SEQ ID NO: 60338 - DNA, 20 bp, Artificial
  CRISPR gRNA sequence
aagtgagaacaggcttcctg

SEQ ID NO: 60339 - DNA, 20 bp, Artificial
  CRISPR gRNA sequence
gggttccaggttagaccctt

SEQ ID NO: 60340 - DNA, 20 bp, Artificial
  CRISPR gRNA sequence
ggggcttgacacacttgcaa

SEQ ID NO: 60341 - DNA, 20 bp, Artificial
  CRISPR gRNA sequence
gtgaaccctgcaagagaggg

SEQ ID NO: 60342 - DNA, 20 bp, Artificial
  CRISPR gRNA sequence
aatgtggtatggggctgtcg

SEQ ID NO: 60343 - DNA, 20 bp, Artificial
  CRISPR gRNA sequence
acacttgcatgcatgtgtac

SEQ ID NO: 60344 - DNA, 20 bp, Artificial
  CRISPR gRNA sequence
tcccacactctgccttgaag

SEQ ID NO: 60345 - DNA, 20 bp, Artificial
  CRISPR gRNA sequence
ccttgaagtagggttcttaa

SEQ ID NO: 60346 - DNA, 20 bp, Artificial
  CRISPR gRNA sequence
aaggtgcccaagaaatcccc

SEQ ID NO: 60347 - DNA, 20 bp, Artificial
  CRISPR gRNA sequence
actttgggaggccaagggag

SEQ ID NO: 60348 - DNA, 20 bp, Artificial
  CRISPR gRNA sequence
gaggaggatcacttaaggcc

SEQ ID NO: 60349 - DNA, 20 bp, Artificial
  CRISPR gRNA sequence
gtgatgtcctgtctctacaa

SEQ ID NO: 60350 - DNA, 20 bp, Artificial
  CRISPR gRNA sequence
acttgggaggctgaagtggg

SEQ ID NO: 60351 - DNA, 20 bp, Artificial
  CRISPR gRNA sequence
gctgaagtgggaaggatcac

SEQ ID NO: 60352 - DNA, 20 bp, Artificial
  CRISPR gRNA sequence
gggaaggatcacctgagtcc

SEQ ID NO: 60353 - DNA, 20 bp, Artificial
  CRISPR gRNA sequence
ggatcacctgagtcctggag

SEQ ID NO: 60354 - DNA, 20 bp, Artificial
  CRISPR gRNA sequence
ctcgggcattatgggctatg

SEQ ID NO: 60355 - DNA, 20 bp, Artificial
  CRISPR gRNA sequence
cactcagcaattcgagcaat

SEQ ID NO: 60356 - DNA, 20 bp, Artificial
  CRISPR gRNA sequence
gagtgaagccaggtagaagg

SEQ ID NO: 60357 - DNA, 20 bp, Artificial
  CRISPR gRNA sequence
ctgggaagtgtccagaaata

SEQ ID NO: 60358 - DNA, 20 bp, Artificial
  CRISPR gRNA sequence
acaccctctctctgacttag

SEQ ID NO: 60359 - DNA, 20 bp, Artificial
  CRISPR gRNA sequence
tccagctgcatgcacacaca

SEQ ID NO: 60360 - DNA, 20 bp, Artificial
  CRISPR gRNA sequence
aaccctggacatgcagcttg

SEQ ID NO: 60361 - DNA, 20 bp, Artificial
  CRISPR gRNA sequence
acatgcagcttgttgagttg

SEQ ID NO: 60362 - DNA, 20 bp, Artificial
  CRISPR gRNA sequence
ttgcaggatgactctctgtt

SEQ ID NO: 60363 - DNA, 20 bp, Artificial
  CRISPR gRNA sequence
agggtccaaggtctcgttcc

SEQ ID NO: 60364 - DNA, 20 bp, Artificial
  CRISPR gRNA sequence
catcttggcgttcagccatt

SEQ ID NO: 60365 - DNA, 20 bp, Artificial
  CRISPR gRNA sequence
gttgccgagctggaggccaa

SEQ ID NO: 60366 - DNA, 20 bp, Artificial
  CRISPR gRNA sequence
tggagggacagggaagatag

SEQ ID NO: 60367 - DNA, 20 bp, Artificial
  CRISPR gRNA sequence
gagggacaggggaacttggg

SEQ ID NO: 60368 - DNA, 20 bp, Artificial
  CRISPR gRNA sequence
gaagattagatggagaacag

SEQ ID NO: 60369 - DNA, 20 bp, Artificial
  CRISPR gRNA sequence
ggcaggtgacctgagggcag

SEQ ID NO: 60370 - DNA, 20 bp, Artificial
  CRISPR gRNA sequence
gtgacctgagggcaggtgag

SEQ ID NO: 60371 - DNA, 20 bp, Artificial
  CRISPR gRNA sequence
gggaaggtgatctggggaag

SEQ ID NO: 60372 - DNA, 20 bp, Artificial
  CRISPR gRNA sequence
gatctggggaaggtgagttg

SEQ ID NO: 60373 - DNA, 20 bp, Artificial
  CRISPR gRNA sequence
gaaggtgagttgggggataa

SEQ ID NO: 60374 - DNA, 20 bp, Artificial
  CRISPR gRNA sequence
gcagggaagtggcctctcca

SEQ ID NO: 60375 - DNA, 20 bp, Artificial
  CRISPR gRNA sequence
gagtcttgatgtctctgccc

SEQ ID NO: 60376 - DNA, 20 bp, Artificial
  CRISPR gRNA sequence
gtgcctgcaccctggctctc

SEQ ID NO: 60377 - DNA, 20 bp, Artificial
  CRISPR gRNA sequence
tcccctgtggacagtcccgt

SEQ ID NO: 60378 - DNA, 20 bp, Artificial
  CRISPR gRNA sequence
ctaaatattctctggtcatc

SEQ ID NO: 60379 - DNA, 20 bp, Artificial
  CRISPR gRNA sequence
tagccatgtaatttggccag

SEQ ID NO: 60380 - DNA, 20 bp, Artificial
  CRISPR gRNA sequence
tctttgctccttcctgttgt

SEQ ID NO: 60381 - DNA, 20 bp, Artificial
  CRISPR gRNA sequence
cctgttgtctggattgttga

SEQ ID NO: 60382 - DNA, 20 bp, Artificial
  CRISPR gRNA sequence
ctggattgttgatgggatgg

SEQ ID NO: 60383 - DNA, 20 bp, Artificial
  CRISPR gRNA sequence
ctggatcttgggcagccata

SEQ ID NO: 60384 - DNA, 20 bp, Artificial
  CRISPR gRNA sequence
gaactcttttttttttgaga

SEQ ID NO: 60385 - DNA, 20 bp, Artificial
  CRISPR gRNA sequence
tctcgctctgtcacccaggc

SEQ ID NO: 60386 - DNA, 20 bp, Artificial
  CRISPR gRNA sequence
ctcactgcagcctccgcctc

SEQ ID NO: 60387 - DNA, 20 bp, Artificial
  CRISPR gRNA sequence
gattcttctgcctcagcctc

SEQ ID NO: 60388 - DNA, 20 bp, Artificial
  CRISPR gRNA sequence
gcctcagcctcccgagtagc

SEQ ID NO: 60389 - DNA, 20 bp, Artificial
  CRISPR gRNA sequence
tttgtaatttttagtacaga

SEQ ID NO: 60390 - DNA, 20 bp, Artificial
  CRISPR gRNA sequence
tgggctcaaactcctgacct

SEQ ID NO: 60391 - DNA, 20 bp, Artificial
  CRISPR gRNA sequence
acctcggcctcccaaagtgc

SEQ ID NO: 60392 - DNA, 20 bp, Artificial
  CRISPR gRNA sequence
aacctaaatgtccaacagtt

SEQ ID NO: 60393 - DNA, 20 bp, Artificial
  CRISPR gRNA sequence
tggactatgctatcacattt

SEQ ID NO: 60394 - DNA, 20 bp, Artificial
  CRISPR gRNA sequence
attttatcctcacaactcca

SEQ ID NO: 60395 - DNA, 20 bp, Artificial
  CRISPR gRNA sequence
agtccacctctaactctgaa

SEQ ID NO: 60396 - DNA, 20 bp, Artificial
  CRISPR gRNA sequence
gaggccagtactatgcgtcc

SEQ ID NO: 60397 - DNA, 20 bp, Artificial
  CRISPR gRNA sequence
ggcatgcagtagagacatac

SEQ ID NO: 60398 - DNA, 20 bp, Artificial
  CRISPR gRNA sequence
aataggtcctcactcaggca

SEQ ID NO: 60399 - DNA, 20 bp, Artificial
  CRISPR gRNA sequence
ctcactcaggcagagagtct

SEQ ID NO: 60400 - DNA, 20 bp, Artificial
  CRISPR gRNA sequence
tcacaccatgatcctcaggc

SEQ ID NO: 60401 - DNA, 20 bp, Artificial
  CRISPR gRNA sequence
accatggccaaggaagggca

SEQ ID NO: 60402 - DNA, 20 bp, Artificial
  CRISPR gRNA sequence
caccagacaaggctaagtcc

SEQ ID NO: 60403 - DNA, 20 bp, Artificial
  CRISPR gRNA sequence
attttgtgtgatctcggcaa

SEQ ID NO: 60404 - DNA, 20 bp, Artificial
  CRISPR gRNA sequence
cagatggaagtaagtagtgc

SEQ ID NO: 60405 - DNA, 20 bp, Artificial
  CRISPR gRNA sequence
tcattagtgttctatcccct

SEQ ID NO: 60406 - DNA, 20 bp, Artificial
  CRISPR gRNA sequence
cagtcattgagatttccatg

SEQ ID NO: 60407 - DNA, 20 bp, Artificial
  CRISPR gRNA sequence
tcctctttctaggcctttgg

SEQ ID NO: 60408 - DNA, 20 bp, Artificial
  CRISPR gRNA sequence
atcatggctaccctgttagc

SEQ ID NO: 60409 - DNA, 20 bp, Artificial
  CRISPR gRNA sequence
gttagcctgagtgtgggaga

SEQ ID NO: 60410 - DNA, 20 bp, Artificial
  CRISPR gRNA sequence
ggaaataaacttttgttgcc

SEQ ID NO: 60411 - DNA, 20 bp, Artificial
  CRISPR gRNA sequence
catgagtcactgggactttg

SEQ ID NO: 60412 - DNA, 20 bp, Artificial
  CRISPR gRNA sequence
tcagtcataccatctctaaa

SEQ ID NO: 60413 - DNA, 20 bp, Artificial
  CRISPR gRNA sequence
ctgatcattacattctcatg

SEQ ID NO: 60414 - DNA, 20 bp, Artificial
  CRISPR gRNA sequence
ggcagcccagtaaggcagat

SEQ ID NO: 60415 - DNA, 20 bp, Artificial
  CRISPR gRNA sequence
ctcgttcatgataggtgctc

SEQ ID NO: 60416 - DNA, 20 bp, Artificial
  CRISPR gRNA sequence
tgctctagggtccccacgga

SEQ ID NO: 60417 - DNA, 20 bp, Artificial
  CRISPR gRNA sequence
gtccccacggagagggtctc

SEQ ID NO: 60418 - DNA, 20 bp, Artificial
  CRISPR gRNA sequence
tgggctatgtgtgccttgag

SEQ ID NO: 60419 - DNA, 20 bp, Artificial
  CRISPR gRNA sequence
tcctaaggggagagaagaca

SEQ ID NO: 60420 - DNA, 20 bp, Artificial
  CRISPR gRNA sequence
ccactattccagactccaaa

SEQ ID NO: 60421 - DNA, 20 bp, Artificial
  CRISPR gRNA sequence
ggcaggggcaagggctggtg

SEQ ID NO: 60422 - DNA, 20 bp, Artificial
  CRISPR gRNA sequence
catgaacgaggagaccaagt

SEQ ID NO: 60423 - DNA, 20 bp, Artificial
  CRISPR gRNA sequence
atcagacacagaaaatcagg

SEQ ID NO: 60424 - DNA, 20 bp, Artificial
  CRISPR gRNA sequence
cattttagagatggtatgac

SEQ ID NO: 60425 - DNA, 20 bp, Artificial
  CRISPR gRNA sequence
gactgaggcttatataggaa

SEQ ID NO: 60426 - DNA, 20 bp, Artificial
  CRISPR gRNA sequence
tcccagtgactcatggcaac

SEQ ID NO: 60427 - DNA, 20 bp, Artificial
  CRISPR gRNA sequence
aacaaaagtttatttcctgc

SEQ ID NO: 60428 - DNA, 20 bp, Artificial
  CRISPR gRNA sequence
tgctcttgcttcctgtctcg

SEQ ID NO: 60429 - DNA, 20 bp, Artificial
  CRISPR gRNA sequence
tcctgtctcgtgtggattga

SEQ ID NO: 60430 - DNA, 20 bp, Artificial
  CRISPR gRNA sequence
cactcaggctaacagggtag

SEQ ID NO: 60431 - DNA, 20 bp, Artificial
  CRISPR gRNA sequence
catgacatgagtctttttta

SEQ ID NO: 60432 - DNA, 20 bp, Artificial
  CRISPR gRNA sequence
agcatgtttcattgaccaaa

SEQ ID NO: 60433 - DNA, 20 bp, Artificial
  CRISPR gRNA sequence
tcaaccatcgtcctctgtct

SEQ ID NO: 60434 - DNA, 20 bp, Artificial
  CRISPR gRNA sequence
caatgactgataatgatgcc

SEQ ID NO: 60435 - DNA, 20 bp, Artificial
  CRISPR gRNA sequence
cctgaggatggttagcctta

SEQ ID NO: 60436 - DNA, 20 bp, Artificial
  CRISPR gRNA sequence
tccttggccatggtctttcc

SEQ ID NO: 60437 - DNA, 20 bp, Artificial
  CRISPR gRNA sequence
gcctgaggatcatggtgtga

SEQ ID NO: 60438 - DNA, 20 bp, Artificial
  CRISPR gRNA sequence
agcctctgggaattgggaag

SEQ ID NO: 60439 - DNA, 20 bp, Artificial
  CRISPR gRNA sequence
gacagtgcctaatacacagt

SEQ ID NO: 60440 - DNA, 20 bp, Artificial
  CRISPR gRNA sequence
ccccaactgttggacattta

SEQ ID NO: 60441 - DNA, 20 bp, Artificial
  CRISPR gRNA sequence
aatattgtatatacgttcat

SEQ ID NO: 60442 - DNA, 20 bp, Artificial
  CRISPR gRNA sequence
tcaaaggaactgcacattat

SEQ ID NO: 60443 - DNA, 20 bp, Artificial
  CRISPR gRNA sequence
tattggtacttctagaagga

SEQ ID NO: 60444 - DNA, 20 bp, Artificial
  CRISPR gRNA sequence
gggcagatcaccctgaggtc

SEQ ID NO: 60445 - DNA, 20 bp, Artificial
  CRISPR gRNA sequence
tcgggaggctgaggcagaag

SEQ ID NO: 60446 - DNA, 20 bp, Artificial
  CRISPR gRNA sequence
gaggcggaggctgcagtgag

SEQ ID NO: 60447 - DNA, 20 bp, Artificial
  CRISPR gRNA sequence
ttccagttcagaagggaaga

SEQ ID NO: 60448 - DNA, 20 bp, Artificial
  CRISPR gRNA sequence
gaggtgatggtctgtgttag

SEQ ID NO: 60449 - DNA, 20 bp, Artificial
  CRISPR gRNA sequence
agcagaaagcactaaacaac

SEQ ID NO: 60450 - DNA, 20 bp, Artificial
  CRISPR gRNA sequence
cagtgagcacagggcagatg

SEQ ID NO: 60451 - DNA, 20 bp, Artificial
  CRISPR gRNA sequence
tcctcagtatgggttccacc

SEQ ID NO: 60452 - DNA, 20 bp, Artificial
  CRISPR gRNA sequence
atactgaggaagaagggaag

SEQ ID NO: 60453 - DNA, 20 bp, Artificial
  CRISPR gRNA sequence
aaatgtagggactggttctt

SEQ ID NO: 60454 - DNA, 20 bp, Artificial
  CRISPR gRNA sequence
ccccaaatcacctgccccca

SEQ ID NO: 60455 - DNA, 20 bp, Artificial
  CRISPR gRNA sequence
tgtcccccagctcatctgcc

SEQ ID NO: 60456 - DNA, 20 bp, Artificial
  CRISPR gRNA sequence
gtcccctagctcacctcccc

SEQ ID NO: 60457 - DNA, 20 bp, Artificial
  CRISPR gRNA sequence
tgtcccccagctcacctccc

SEQ ID NO: 60458 - DNA, 20 bp, Artificial
  CRISPR gRNA sequence
tgtccctcagctcatctgcc

SEQ ID NO: 60459 - DNA, 20 bp, Artificial
  CRISPR gRNA sequence
ttcttcctccccaacacgga

SEQ ID NO: 60460 - DNA, 20 bp, Artificial
  CRISPR gRNA sequence
ctggaggacccctccttcta

SEQ ID NO: 60461 - DNA, 20 bp, Artificial
  CRISPR gRNA sequence
aattgctcgaattgctgagt

SEQ ID NO: 60462 - DNA, 20 bp, Artificial
  CRISPR gRNA sequence
ccacatagcccataatgccc

SEQ ID NO: 60463 - DNA, 20 bp, Artificial
  CRISPR gRNA sequence
cttttttggcgggggtgggg

SEQ ID NO: 60464 - DNA, 20 bp, Artificial
  CRISPR gRNA sequence
ggcgggggtgggggggtgtt

SEQ ID NO: 60465 - DNA, 20 bp, Artificial
  CRISPR gRNA sequence
tttgtttgttgttgctcttg

SEQ ID NO: 60466 - DNA, 20 bp, Artificial
  CRISPR gRNA sequence
ttgttgttgctcttgttggg

SEQ ID NO: 60467 - DNA, 20 bp, Artificial
  CRISPR gRNA sequence
tgttgctcttgttgggtttt

SEQ ID NO: 60468 - DNA, 20 bp, Artificial
  CRISPR gRNA sequence
gctcttgttgggttttgttt

SEQ ID NO: 60469 - DNA, 20 bp, Artificial
  CRISPR gRNA sequence
tcccttggcctcccaaagtg

SEQ ID NO: 60470 - DNA, 20 bp, Artificial
  CRISPR gRNA sequence
gagccatcacacctggctag

SEQ ID NO: 60471 - DNA, 20 bp, Artificial
  CRISPR gRNA sequence
tcacacctggctagaggtgt

SEQ ID NO: 60472 - DNA, 20 bp, Artificial
  CRISPR gRNA sequence
acctggctagaggtgttttt

SEQ ID NO: 60473 - DNA, 20 bp, Artificial
  CRISPR gRNA sequence
ggctagaggtgtttttgttt

SEQ ID NO: 60474 - DNA, 20 bp, Artificial
  CRISPR gRNA sequence
agaggtgtttttgtttgttt

SEQ ID NO: 60475 - DNA, 20 bp, Artificial
  CRISPR gRNA sequence
ttctgccctctactgatccg

SEQ ID NO: 60476 - DNA, 20 bp, Artificial
  CRISPR gRNA sequence
gtggggatttcttgggcacc

SEQ ID NO: 60477 - DNA, 20 bp, Artificial
  CRISPR gRNA sequence
cacaggacattgaggggcaa

SEQ ID NO: 60478 - DNA, 20 bp, Artificial
  CRISPR gRNA sequence
cctcctcctgcagtgacttt

SEQ ID NO: 60479 - DNA, 20 bp, Artificial
  CRISPR gRNA sequence
cctgcagtgactttcaaggc

SEQ ID NO: 60480 - DNA, 20 bp, Artificial
  CRISPR gRNA sequence
catctcccagccccaaagtg

SEQ ID NO: 60481 - DNA, 20 bp, Artificial
  CRISPR gRNA sequence
tcttcagcgggggagccttt

SEQ ID NO: 60482 - DNA, 20 bp, Artificial
  CRISPR gRNA sequence
ctgaaggagctcggaagggc

SEQ ID NO: 60483 - DNA, 20 bp, Artificial
  CRISPR gRNA sequence
gtgattaaataatgaccacc

SEQ ID NO: 60484 - DNA, 20 bp, Artificial
  CRISPR gRNA sequence
gtcacactttcatctcagca

SEQ ID NO: 60485 - DNA, 20 bp, Artificial
  CRISPR gRNA sequence
tatctcatggctgtaaccag

SEQ ID NO: 60486 - DNA, 20 bp, Artificial
  CRISPR gRNA sequence
ccagtgagtccctttttaat

SEQ ID NO: 60487 - DNA, 20 bp, Artificial
  CRISPR gRNA sequence
ggggctgttcctattggtca

SEQ ID NO: 60488 - DNA, 20 bp, Artificial
  CRISPR gRNA sequence
ttagcttagctgtaggagga

SEQ ID NO: 60489 - DNA, 20 bp, Artificial
  CRISPR gRNA sequence
cctttctgggtccccttcct

SEQ ID NO: 60490 - DNA, 20 bp, Artificial
  CRISPR gRNA sequence
actcttccagaaaggcatta

SEQ ID NO: 60491 - DNA, 20 bp, Artificial
  CRISPR gRNA sequence
acttcacttatatgaccacc

SEQ ID NO: 60492 - DNA, 20 bp, Artificial
  CRISPR gRNA sequence
atgaccaccggcggcttcca

SEQ ID NO: 60493 - DNA, 20 bp, Artificial
  CRISPR gRNA sequence
ctgatggacagatggccatt

SEQ ID NO: 60494 - DNA, 20 bp, Artificial
  CRISPR gRNA sequence
gccatttagtgcttggagct

SEQ ID NO: 60495 - DNA, 20 bp, Artificial
  CRISPR gRNA sequence
tgggggctgctggctgttgg

SEQ ID NO: 60496 - DNA, 20 bp, Artificial
  CRISPR gRNA sequence
ccccactcctccaccccttc

SEQ ID NO: 60497 - DNA, 20 bp, Artificial
  CRISPR gRNA sequence
ggcccagtgactcttgtctc

SEQ ID NO: 60498 - DNA, 20 bp, Artificial
  CRISPR gRNA sequence
gctggaagcaccatacaggt

SEQ ID NO: 60499 - DNA, 20 bp, Artificial
  CRISPR gRNA sequence
acaggtctcagcttcgctgt

SEQ ID NO: 60500 - DNA, 20 bp, Artificial
  CRISPR gRNA sequence
gaaggagacccagggaggag

SEQ ID NO: 60501 - DNA, 20 bp, Artificial
  CRISPR gRNA sequence
gggcccatggggagacatgg

SEQ ID NO: 60502 - DNA, 20 bp, Artificial
  CRISPR gRNA sequence
tgccaaccatggctataacc

SEQ ID NO: 60503 - DNA, 20 bp, Artificial
  CRISPR gRNA sequence
atccagatattacagaaaga

SEQ ID NO: 60504 - DNA, 20 bp, Artificial
  CRISPR gRNA sequence
caggaggatcacttgagacc

SEQ ID NO: 60505 - DNA, 20 bp, Artificial
  CRISPR gRNA sequence
acacttccccattcccacct

SEQ ID NO: 60506 - DNA, 20 bp, Artificial
  CRISPR gRNA sequence
gagagcctatgctcccttag

SEQ ID NO: 60507 - DNA, 20 bp, Artificial
  CRISPR gRNA sequence
taacaagggcccgagggtga

SEQ ID NO: 60508 - DNA, 20 bp, Artificial
  CRISPR gRNA sequence
agtgggcagagggccatctg

SEQ ID NO: 60509 - DNA, 20 bp, Artificial
  CRISPR gRNA sequence
aggcagccatggtccacatg

SEQ ID NO: 60510 - DNA, 20 bp, Artificial
  CRISPR gRNA sequence
cgcctgtctctgcctccacc

SEQ ID NO: 60511 - DNA, 20 bp, Artificial
  CRISPR gRNA sequence
aaagatattgctccaccctt

SEQ ID NO: 60512 - DNA, 20 bp, Artificial
  CRISPR gRNA sequence
cctgggcaccagcagacagg

SEQ ID NO: 60513 - DNA, 20 bp, Artificial
  CRISPR gRNA sequence
tttcacccacctcagcctgc

SEQ ID NO: 60514 - DNA, 20 bp, Artificial
  CRISPR gRNA sequence
cacagggaggcccccatcca

SEQ ID NO: 60515 - DNA, 20 bp, Artificial
  CRISPR gRNA sequence
agagtggaggaggaccgggg

SEQ ID NO: 60516 - DNA, 20 bp, Artificial
  CRISPR gRNA sequence
gaggaggaccggggagggga

SEQ ID NO: 60517 - DNA, 20 bp, Artificial
  CRISPR gRNA sequence
aaatggatcctcctcttgtc

SEQ ID NO: 60518 - DNA, 20 bp, Artificial
  CRISPR gRNA sequence
cacatgcacactgtctaggc

SEQ ID NO: 60519 - DNA, 20 bp, Artificial
  CRISPR gRNA sequence
cgtcatgggtatatctgtgc

SEQ ID NO: 60520 - DNA, 20 bp, Artificial
  CRISPR gRNA sequence
tgctgtagatgaagtggaga

SEQ ID NO: 60521 - DNA, 20 bp, Artificial
  CRISPR gRNA sequence
agtggagaatgggctttggt

SEQ ID NO: 60522 - DNA, 20 bp, Artificial
  CRISPR gRNA sequence
ccagcactgatcctctgaca

SEQ ID NO: 60523 - DNA, 20 bp, Artificial
  CRISPR gRNA sequence
gacacttcgcttcttcttat

SEQ ID NO: 60524 - DNA, 20 bp, Artificial
  CRISPR gRNA sequence
cctttgcagaagccctctcc

SEQ ID NO: 60525 - DNA, 20 bp, Artificial
  CRISPR gRNA sequence
ctctccttaatcctacacaa

SEQ ID NO: 60526 - DNA, 20 bp, Artificial
  CRISPR gRNA sequence
tcctcgttcctccccaccat

SEQ ID NO: 60527 - DNA, 20 bp, Artificial
  CRISPR gRNA sequence
cgaggcatcagccacctggt

SEQ ID NO: 60528 - DNA, 20 bp, Artificial
  CRISPR gRNA sequence
atgttcctccaagtctgacc

SEQ ID NO: 60529 - DNA, 20 bp, Artificial
  CRISPR gRNA sequence
ggctcccagagtccccagag

SEQ ID NO: 60530 - DNA, 20 bp, Artificial
  CRISPR gRNA sequence
tgccagcacactctaactaa

SEQ ID NO: 60531 - DNA, 20 bp, Artificial
  CRISPR gRNA sequence
ctcctccctggcagaacgct

SEQ ID NO: 60532 - DNA, 20 bp, Artificial
  CRISPR gRNA sequence
ctcggctgggcatctgtgaa

SEQ ID NO: 60533 - DNA, 20 bp, Artificial
  CRISPR gRNA sequence
cagctaggaacccaggcaag

SEQ ID NO: 60534 - DNA, 20 bp, Artificial
  CRISPR gRNA sequence
gaaagtgaggtcagagagga

SEQ ID NO: 60535 - DNA, 20 bp, Artificial
  CRISPR gRNA sequence
ccatcctgtcacttgctaac

SEQ ID NO: 60536 - DNA, 20 bp, Artificial
  CRISPR gRNA sequence
ggactgggccttggtctcct

SEQ ID NO: 60537 - DNA, 20 bp, Artificial
  CRISPR gRNA sequence
ccctcacctaccacggctcc

SEQ ID NO: 60538 - DNA, 20 bp, Artificial
  CRISPR gRNA sequence
gcagcccagtccctctctat

SEQ ID NO: 60539 - DNA, 20 bp, Artificial
  CRISPR gRNA sequence
aggtctggggcccctggggt

SEQ ID NO: 60540 - DNA, 20 bp, Artificial
  CRISPR gRNA sequence
gcatctgcgtgtcaacccta

SEQ ID NO: 60541 - DNA, 20 bp, Artificial
  CRISPR gRNA sequence
agtcacgtgtcctaccgtca

SEQ ID NO: 60542 - DNA, 20 bp, Artificial
  CRISPR gRNA sequence
ggataaatctgtgcataccc

SEQ ID NO: 60543 - DNA, 20 bp, Artificial
  CRISPR gRNA sequence
gcataccctactgttttact

SEQ ID NO: 60544 - DNA, 20 bp, Artificial
  CRISPR gRNA sequence
ctttaccttcagaacctagc

SEQ ID NO: 60545 - DNA, 20 bp, Artificial
  CRISPR gRNA sequence
gatggatggatggatggatg

SEQ ID NO: 60546 - DNA, 20 bp, Artificial
  CRISPR gRNA sequence
catggtgctgaaccaatata

SEQ ID NO: 60547 - DNA, 20 bp, Artificial
  CRISPR gRNA sequence
cactttggaaggccaaggca

SEQ ID NO: 60548 - DNA, 20 bp, Artificial
  CRISPR gRNA sequence
ctatttgggaggctgaggtg

SEQ ID NO: 60549 - DNA, 20 bp, Artificial
  CRISPR gRNA sequence
ttgggaggctgaggtgggaa

SEQ ID NO: 60550 - DNA, 20 bp, Artificial
  CRISPR gRNA sequence
tttattatatttcttgtgaa

SEQ ID NO: 60551 - DNA, 20 bp, Artificial
  CRISPR gRNA sequence
tgactttttaaaacactctt

SEQ ID NO: 60552 - DNA, 20 bp, Artificial
  CRISPR gRNA sequence
acataatcagtatttcacat

SEQ ID NO: 60553 - DNA, 20 bp, Artificial
  CRISPR gRNA sequence
aaacacttttgctagttccg

SEQ ID NO: 60554 - DNA, 20 bp, Artificial
  CRISPR gRNA sequence
gtttccctgtcaattgcaaa

SEQ ID NO: 60555 - DNA, 20 bp, Artificial
  CRISPR gRNA sequence
ttgcaaaatcagctttatct

SEQ ID NO: 60556 - DNA, 20 bp, Artificial
  CRISPR gRNA sequence
gtgcctgtggtgggtgatgt

SEQ ID NO: 60557 - DNA, 20 bp, Artificial
  CRISPR gRNA sequence
gatgtgctggtttccagtct

SEQ ID NO: 60558 - DNA, 20 bp, Artificial
  CRISPR gRNA sequence
ggtttccagtctctgggttt

SEQ ID NO: 60559 - DNA, 20 bp, Artificial
  CRISPR gRNA sequence
tgctgcactgaggaatgaat

SEQ ID NO: 60560 - DNA, 20 bp, Artificial
  CRISPR gRNA sequence
gaattactgcttaggttggc

SEQ ID NO: 60561 - DNA, 20 bp, Artificial
  CRISPR gRNA sequence
taaatgagttactacactta

SEQ ID NO: 60562 - DNA, 20 bp, Artificial
  CRISPR gRNA sequence
tgctggctattccagctgtg

SEQ ID NO: 60563 - DNA, 20 bp, Artificial
  CRISPR gRNA sequence
tattccagctgtgcatggat

SEQ ID NO: 60564 - DNA, 20 bp, Artificial
  CRISPR gRNA sequence
tggatgggctgagaaaaggg

SEQ ID NO: 60565 - DNA, 20 bp, Artificial
  CRISPR gRNA sequence
atctctttcccttctctgga

SEQ ID NO: 60566 - DNA, 20 bp, Artificial
  CRISPR gRNA sequence
cccttctctggatctcgatt

SEQ ID NO: 60567 - DNA, 20 bp, Artificial
  CRISPR gRNA sequence
gaacgccaagcacgagaatc

SEQ ID NO: 60568 - DNA, 20 bp, Artificial
  CRISPR gRNA sequence
caagatgctgacgttgggag

SEQ ID NO: 60569 - DNA, 20 bp, Artificial
  CRISPR gRNA sequence
tgggaggatcgcttgagcct

SEQ ID NO: 60570 - DNA, 20 bp, Artificial
  CRISPR gRNA sequence
tgtcactttcttttccctct

SEQ ID NO: 60571 - DNA, 20 bp, Artificial
  CRISPR gRNA sequence
ttgagaggctgagggggcag

SEQ ID NO: 60572 - DNA, 20 bp, Artificial
  CRISPR gRNA sequence
aaaaaaaaaatagctgggca

SEQ ID NO: 60573 - DNA, 20 bp, Artificial
  CRISPR gRNA sequence
tgggaggatcacttgagccc

SEQ ID NO: 60574 - DNA, 20 bp, Artificial
  CRISPR gRNA sequence
ctgggatagagccactgcac

SEQ ID NO: 60575 - DNA, 20 bp, Artificial
  CRISPR gRNA sequence
tgaaacctggctcatgatgt

SEQ ID NO: 60576 - DNA, 20 bp, Artificial
  CRISPR gRNA sequence
cagcccagtgggagagagtc

SEQ ID NO: 60577 - DNA, 20 bp, Artificial
  CRISPR gRNA sequence
accatcacatcatcgacaat

SEQ ID NO: 60578 - DNA, 20 bp, Artificial
  CRISPR gRNA sequence
acatcatcgacaatagcagc

SEQ ID NO: 60579 - DNA, 20 bp, Artificial
  CRISPR gRNA sequence
agcagcttctgtttactaac

SEQ ID NO: 60580 - DNA, 20 bp, Artificial
  CRISPR gRNA sequence
cctatgtgctagatgttgtc

SEQ ID NO: 60581 - DNA, 20 bp, Artificial
  CRISPR gRNA sequence
agagaaaagggagccgactg

SEQ ID NO: 60582 - DNA, 20 bp, Artificial
  CRISPR gRNA sequence
tgttaccgactcactttggg

SEQ ID NO: 60583 - DNA, 20 bp, Artificial
  CRISPR gRNA sequence
agcctctagaagccaaggaa

SEQ ID NO: 60584 - DNA, 20 bp, Artificial
  CRISPR gRNA sequence
ctagatgcctgagcccaggc

SEQ ID NO: 60585 - DNA, 20 bp, Artificial
  CRISPR gRNA sequence
atgcctgagcccaggccaat

SEQ ID NO: 60586 - DNA, 20 bp, Artificial
  CRISPR gRNA sequence
agaggaaaggggctcagagc

SEQ ID NO: 60587 - DNA, 20 bp, Artificial
  CRISPR gRNA sequence
aaagcagatgagggacaggg

SEQ ID NO: 60588 - DNA, 20 bp, Artificial
  CRISPR gRNA sequence
gcccatcctggatagcccat

SEQ ID NO: 60589 - DNA, 20 bp, Artificial
  CRISPR gRNA sequence
tatatgccgggcattgcact

SEQ ID NO: 60590 - DNA, 20 bp, Artificial
  CRISPR gRNA sequence
ccagctactaagaggtgtgg

SEQ ID NO: 60591 - DNA, 20 bp, Artificial
  CRISPR gRNA sequence
tggaggggccatggagtagg

SEQ ID NO: 60592 - DNA, 20 bp, Artificial
  CRISPR gRNA sequence
ctggctgaagccaataagag

SEQ ID NO: 60593 - DNA, 20 bp, Artificial
  CRISPR gRNA sequence
gaaccaggacagaattagaa

SEQ ID NO: 60594 - DNA, 20 bp, Artificial
  CRISPR gRNA sequence
cccctcgccttgccttcctt

SEQ ID NO: 60595 - DNA, 20 bp, Artificial
  CRISPR gRNA sequence
cttgccttccttgctggctt

SEQ ID NO: 60596 - DNA, 20 bp, Artificial
  CRISPR gRNA sequence
tgccacagggcctttgaatg

SEQ ID NO: 60597 - DNA, 20 bp, Artificial
  CRISPR gRNA sequence
aactcccagttatttcagca

SEQ ID NO: 60598 - DNA, 20 bp, Artificial
  CRISPR gRNA sequence
gtcagatgcccccataatca

SEQ ID NO: 60599 - DNA, 20 bp, Artificial
  CRISPR gRNA sequence
tgcacttaaccactctgcac

SEQ ID NO: 60600 - DNA, 20 bp, Artificial
  CRISPR gRNA sequence
caggcatgtggtatggagtc

SEQ ID NO: 60601 - DNA, 20 bp, Artificial
  CRISPR gRNA sequence
agcaaaggaggagtaagtga

SEQ ID NO: 60602 - DNA, 20 bp, Artificial
  CRISPR gRNA sequence
gggtgctgatccactgccac

SEQ ID NO: 60603 - DNA, 20 bp, Artificial
  CRISPR gRNA sequence
cccaactccagcaaagtcaa

SEQ ID NO: 60604 - DNA, 20 bp, Artificial
  CRISPR gRNA sequence
aaatgcgttcattatacatc

SEQ ID NO: 60605 - DNA, 20 bp, Artificial
  CRISPR gRNA sequence
ggtgttgcatggggtgaggg

SEQ ID NO: 60606 - DNA, 20 bp, Artificial
  CRISPR gRNA sequence
gtcttaggatcaagtgtggg

SEQ ID NO: 60607 - DNA, 20 bp, Artificial
  CRISPR gRNA sequence
tgggtcgggtttggggagtg

SEQ ID NO: 60608 - DNA, 20 bp, Artificial
  CRISPR gRNA sequence
gagtgttgagattgggtagc

SEQ ID NO: 60609 - DNA, 20 bp, Artificial
  CRISPR gRNA sequence
gggtagcagtggtttggggc

SEQ ID NO: 60610 - DNA, 20 bp, Artificial
  CRISPR gRNA sequence
cagtggtttggggcctcagc

SEQ ID NO: 60611 - DNA, 20 bp, Artificial
  CRISPR gRNA sequence
gtaattgaatgtctctgggc

SEQ ID NO: 60612 - DNA, 20 bp, Artificial
  CRISPR gRNA sequence
gatgggggtgtcatgcattt

SEQ ID NO: 60613 - DNA, 20 bp, Artificial
  CRISPR gRNA sequence
tctccacagcctcagtaaca

SEQ ID NO: 60614 - DNA, 20 bp, Artificial
  CRISPR gRNA sequence
tgctgtggatataggctgct

SEQ ID NO: 60615 - DNA, 20 bp, Artificial
  CRISPR gRNA sequence
gagactaggccaaggacttg

SEQ ID NO: 60616 - DNA, 20 bp, Artificial
  CRISPR gRNA sequence
taggccaaggacttgctccg

SEQ ID NO: 60617 - DNA, 20 bp, Artificial
  CRISPR gRNA sequence
tttggcttccctcagtccct

SEQ ID NO: 60618 - DNA, 20 bp, Artificial
  CRISPR gRNA sequence
tatggggaggtgaggacaga

SEQ ID NO: 60619 - DNA, 20 bp, Artificial
  CRISPR gRNA sequence
tctcaacccagtagggtggt

SEQ ID NO: 60620 - DNA, 20 bp, Artificial
  CRISPR gRNA sequence
ccctcaagggaggagaggga

SEQ ID NO: 60621 - DNA, 20 bp, Artificial
  CRISPR gRNA sequence
ggaaaccgattcacccaaaa

SEQ ID NO: 60622 - DNA, 20 bp, Artificial
  CRISPR gRNA sequence
ggaccttggttcactgtata

SEQ ID NO: 60623 - DNA, 20 bp, Artificial
  CRISPR gRNA sequence
aacttatactaaataaatta

SEQ ID NO: 60624 - DNA, 20 bp, Artificial
  CRISPR gRNA sequence
aaaaaaaaagaaaatagctg

SEQ ID NO: 60625 - DNA, 20 bp, Artificial
  CRISPR gRNA sequence
aaaaaaaatgataatatagg

SEQ ID NO: 60626 - DNA, 20 bp, Artificial
  CRISPR gRNA sequence
tctcttagtctcccaaagtg

SEQ ID NO: 60627 - DNA, 20 bp, Artificial
  CRISPR gRNA sequence
tgccctggcctcccaaagag

SEQ ID NO: 60628 - DNA, 20 bp, Artificial
  CRISPR gRNA sequence
aaattttaactcattatctt

SEQ ID NO: 60629 - DNA, 20 bp, Artificial
  CRISPR gRNA sequence
tcattatcttaaaagattat

SEQ ID NO: 60630 - DNA, 20 bp, Artificial
  CRISPR gRNA sequence
aagattataaaagattataa

SEQ ID NO: 60631 - DNA, 20 bp, Artificial
  CRISPR gRNA sequence
tattaataattatttgtcat

SEQ ID NO: 60632 - DNA, 20 bp, Artificial
  CRISPR gRNA sequence
gcttctagcccttaaaaaac

SEQ ID NO: 60633 - DNA, 20 bp, Artificial
  CRISPR gRNA sequence
taatgtttaaaaagagaatc

SEQ ID NO: 60634 - DNA, 20 bp, Artificial
  CRISPR gRNA sequence
agagaatctatagtttaatc

SEQ ID NO: 60635 - DNA, 20 bp, Artificial
  CRISPR gRNA sequence
aattattgcactagaaaatg

SEQ ID NO: 60636 - DNA, 20 bp, Artificial
  CRISPR gRNA sequence
gaacactgactagcagagag

SEQ ID NO: 60637 - DNA, 20 bp, Artificial
  CRISPR gRNA sequence
gctaaaagagagaacacaga

SEQ ID NO: 60638 - DNA, 20 bp, Artificial
  CRISPR gRNA sequence
ttttaagacttgccaggaaa

SEQ ID NO: 60639 - DNA, 20 bp, Artificial
  CRISPR gRNA sequence
tttgtgaaatatctgtggta

SEQ ID NO: 60640 - DNA, 20 bp, Artificial
  CRISPR gRNA sequence
ctactcaggaggctgaagtg

SEQ ID NO: 60641 - DNA, 20 bp, Artificial
  CRISPR gRNA sequence
tcaggaggctgaagtgggag

SEQ ID NO: 60642 - DNA, 20 bp, Artificial
  CRISPR gRNA sequence
attgcttgagcccaggaggt

SEQ ID NO: 60643 - DNA, 20 bp, Artificial
  CRISPR gRNA sequence
gaggtggaggcttcagtgag

SEQ ID NO: 60644 - DNA, 20 bp, Artificial
  CRISPR gRNA sequence
ccatgattgcaccactgcac

SEQ ID NO: 60645 - DNA, 20 bp, Artificial
  CRISPR gRNA sequence
gtaacagggagccaataacc

SEQ ID NO: 60646 - DNA, 20 bp, Artificial
  CRISPR gRNA sequence
gcagcacaaaactgtgatct

SEQ ID NO: 60647 - DNA, 20 bp, Artificial
  CRISPR gRNA sequence
ggggccccaggagaggtagg

SEQ ID NO: 60648 - DNA, 20 bp, Artificial
  CRISPR gRNA sequence
cacggaagagcgggaagtga

SEQ ID NO: 60649 - DNA, 20 bp, Artificial
  CRISPR gRNA sequence
gcaggagttgggtagccaga

SEQ ID NO: 60650 - DNA, 20 bp, Artificial
  CRISPR gRNA sequence
attccgggagactagagccc

SEQ ID NO: 60651 - DNA, 20 bp, Artificial
  CRISPR gRNA sequence
gagccctccagcttaaaccc

SEQ ID NO: 60652 - DNA, 20 bp, Artificial
  CRISPR gRNA sequence
acacaaggacccattagggt

SEQ ID NO: 60653 - DNA, 20 bp, Artificial
  CRISPR gRNA sequence
tagagtctggactactgaag

SEQ ID NO: 60654 - DNA, 20 bp, Artificial
  CRISPR gRNA sequence
aagcacagatgaggaggagg

SEQ ID NO: 60655 - DNA, 20 bp, Artificial
  CRISPR gRNA sequence
tacagtctcccattgagagg

SEQ ID NO: 60656 - DNA, 20 bp, Artificial
  CRISPR gRNA sequence
gaagccaaattggcaccaag

SEQ ID NO: 60657 - DNA, 20 bp, Artificial
  CRISPR gRNA sequence
tggtggaaggccaggctgag

SEQ ID NO: 60658 - DNA, 20 bp, Artificial
  CRISPR gRNA sequence
gtgatggcctccagccctgt

SEQ ID NO: 60659 - DNA, 20 bp, Artificial
  CRISPR gRNA sequence
gctgtgtccaggggtcatgg

SEQ ID NO: 60660 - DNA, 20 bp, Artificial
  CRISPR gRNA sequence
taatctccctctgtccctct

SEQ ID NO: 60661 - DNA, 20 bp, Artificial
  CRISPR gRNA sequence
ttccctctctcatcgtgtat

SEQ ID NO: 60662 - DNA, 20 bp, Artificial
  CRISPR gRNA sequence
tcatcgtgtatttctgtttt

SEQ ID NO: 60663 - DNA, 20 bp, Artificial
  CRISPR gRNA sequence
tctctctgaggtctctgtgc

SEQ ID NO: 60664 - DNA, 20 bp, Artificial
  CRISPR gRNA sequence
gttcagtggggcatgcagca

SEQ ID NO: 60665 - DNA, 20 bp, Artificial
  CRISPR gRNA sequence
ggtcacctccacctcgagtg

SEQ ID NO: 60666 - DNA, 20 bp, Artificial
  CRISPR gRNA sequence
caattacagtgagttagtgt

SEQ ID NO: 60667 - DNA, 20 bp, Artificial
  CRISPR gRNA sequence
cagtgagttagtgttggtgt

SEQ ID NO: 60668 - DNA, 20 bp, Artificial
  CRISPR gRNA sequence
agttagtgttggtgtttggg

SEQ ID NO: 60669 - DNA, 20 bp, Artificial
  CRISPR gRNA sequence
ttggtgtttgggtttggttt

SEQ ID NO: 60670 - DNA, 20 bp, Artificial
  CRISPR gRNA sequence
cctggcagcccagggctgtg

SEQ ID NO: 60671 - DNA, 20 bp, Artificial
  CRISPR gRNA sequence
tcccctcccttctccccacc

SEQ ID NO: 60672 - DNA, 20 bp, Artificial
  CRISPR gRNA sequence
cctctttcctggggttattg

SEQ ID NO: 60673 - DNA, 20 bp, Artificial
  CRISPR gRNA sequence
ctcggtgaaggctagctaat

SEQ ID NO: 60674 - DNA, 20 bp, Artificial
  CRISPR gRNA sequence
ctgtgactcaataatcccac

SEQ ID NO: 60675 - DNA, 20 bp, Artificial
  CRISPR gRNA sequence
caataatcccacttctgatt

SEQ ID NO: 60676 - DNA, 20 bp, Artificial
  CRISPR gRNA sequence
acctgtctccgcatctctga

SEQ ID NO: 60677 - DNA, 20 bp, Artificial
  CRISPR gRNA sequence
gtatggtcagggtagacagg

SEQ ID NO: 60678 - DNA, 20 bp, Artificial
  CRISPR gRNA sequence
gagtgtgtaggaggaatccc

SEQ ID NO: 60679 - DNA, 20 bp, Artificial
  CRISPR gRNA sequence
tcttgatccctaaatgccct

SEQ ID NO: 60680 - DNA, 20 bp, Artificial
  CRISPR gRNA sequence
attccaggctgtctctgtga

SEQ ID NO: 60681 - DNA, 20 bp, Artificial
  CRISPR gRNA sequence
ctctgtgaacacgctttgct

SEQ ID NO: 60682 - DNA, 20 bp, Artificial
  CRISPR gRNA sequence
ctaaggaccccctgctcaca

SEQ ID NO: 60683 - DNA, 20 bp, Artificial
  CRISPR gRNA sequence
aggcaaattacatgaagact

SEQ ID NO: 60684 - DNA, 20 bp, Artificial
  CRISPR gRNA sequence
aaagaaaggagacactttgt

SEQ ID NO: 60685 - DNA, 20 bp, Artificial
  CRISPR gRNA sequence
tctcataaccttgggctaga

SEQ ID NO: 60686 - DNA, 20 bp, Artificial
  CRISPR gRNA sequence
gaccttgattctctctagga

SEQ ID NO: 60687 - DNA, 20 bp, Artificial
  CRISPR gRNA sequence
gtgccctgaccacaaagagg

SEQ ID NO: 60688 - DNA, 20 bp, Artificial
  CRISPR gRNA sequence
tgatctccagcctcagtgag

SEQ ID NO: 60689 - DNA, 20 bp, Artificial
  CRISPR gRNA sequence
gtttgtccctggatgccgtg

SEQ ID NO: 60690 - DNA, 20 bp, Artificial
  CRISPR gRNA sequence
atgccgtgttgggtttggtt

SEQ ID NO: 60691 - DNA, 20 bp, Artificial
  CRISPR gRNA sequence
tctccactctgcagtggctc

SEQ ID NO: 60692 - DNA, 20 bp, Artificial
  CRISPR gRNA sequence
cccacgtgggccccttgtcc

SEQ ID NO: 60693 - DNA, 20 bp, Artificial
  CRISPR gRNA sequence
ctcgttctttggatagtcct

SEQ ID NO: 60694 - DNA, 20 bp, Artificial
  CRISPR gRNA sequence
gtccttagagattttttttt

SEQ ID NO: 60695 - DNA, 20 bp, Artificial
  CRISPR gRNA sequence
agggtacatgtgcacaacat

SEQ ID NO: 60696 - DNA, 20 bp, Artificial
  CRISPR gRNA sequence
tgggcggatcacgtgaggtc

SEQ ID NO: 60697 - DNA, 20 bp, Artificial
  CRISPR gRNA sequence
aaagaaaagaaaagaaaact

SEQ ID NO: 60698 - DNA, 20 bp, Artificial
  CRISPR gRNA sequence
aggcactcagggcaccgcat

SEQ ID NO: 60699 - DNA, 20 bp, Artificial
  CRISPR gRNA sequence
atccatgattttcaggggag

SEQ ID NO: 60700 - DNA, 20 bp, Artificial
  CRISPR gRNA sequence
gtcccagagcctctccaggc

SEQ ID NO: 60701 - DNA, 20 bp, Artificial
  CRISPR gRNA sequence
gaggaggatcacctgagcct

SEQ ID NO: 60702 - DNA, 20 bp, Artificial
  CRISPR gRNA sequence
ctacttgggaggctgaggtg

SEQ ID NO: 60703 - DNA, 20 bp, Artificial
  CRISPR gRNA sequence
ttgggaggctgaggtgggag

SEQ ID NO: 60704 - DNA, 20 bp, Artificial
  CRISPR gRNA sequence
ttgggaggctaaggcaggag

SEQ ID NO: 60705 - DNA, 20 bp, Artificial
  CRISPR gRNA sequence
caggaggatcgtttgagcca

SEQ ID NO: 60706 - DNA, 20 bp, Artificial
  CRISPR gRNA sequence
caaagaagaatttcttacct

SEQ ID NO: 60707 - DNA, 20 bp, Artificial
  CRISPR gRNA sequence
tcaaatgagaaatgtcgatg

SEQ ID NO: 60708 - DNA, 20 bp, Artificial
  CRISPR gRNA sequence
tgtgacttgatacatgtaat

SEQ ID NO: 60709 - DNA, 20 bp, Artificial
  CRISPR gRNA sequence
taattgttgcttaatctatt

SEQ ID NO: 60710 - DNA, 20 bp, Artificial
  CRISPR gRNA sequence
gtctttgaccattttcaaac

SEQ ID NO: 60711 - DNA, 20 bp, Artificial
  CRISPR gRNA sequence
ttttcaaactgctgcttcct

SEQ ID NO: 60712 - DNA, 20 bp, Artificial
  CRISPR gRNA sequence
actgctgcttcctctctgct

SEQ ID NO: 60713 - DNA, 20 bp, Artificial
  CRISPR gRNA sequence
aaccacccaagtccggcaca

SEQ ID NO: 60714 - DNA, 20 bp, Artificial
  CRISPR gRNA sequence
aaattgtcagtaatcaactg

SEQ ID NO: 60715 - DNA, 20 bp, Artificial
  CRISPR gRNA sequence
cccagagcagggcaggtgcc

SEQ ID NO: 60716 - DNA, 20 bp, Artificial
  CRISPR gRNA sequence
gggaggagacaggagaacat

SEQ ID NO: 60717 - DNA, 20 bp, Artificial
  CRISPR gRNA sequence
acaggagaacatttgtgctt

SEQ ID NO: 60718 - DNA, 20 bp, Artificial
  CRISPR gRNA sequence
cttcgcagtaaacaaccaat

SEQ ID NO: 60719 - DNA, 20 bp, Artificial
  CRISPR gRNA sequence
ggtggctcaagcctgggtgg

SEQ ID NO: 60720 - DNA, 20 bp, Artificial
  CRISPR gRNA sequence
cttgcttcccaggataggat

SEQ ID NO: 60721 - DNA, 20 bp, Artificial
  CRISPR gRNA sequence
cacctggacaggaacaagct

SEQ ID NO: 60722 - DNA, 20 bp, Artificial
  CRISPR gRNA sequence
aagctgctggcttttctaac

SEQ ID NO: 60723 - DNA, 20 bp, Artificial
  CRISPR gRNA sequence
caggcttcccttccctgagc

SEQ ID NO: 60724 - DNA, 20 bp, Artificial
  CRISPR gRNA sequence
tctggtactgtcccagccct

SEQ ID NO: 60725 - DNA, 20 bp, Artificial
  CRISPR gRNA sequence
agctggcagggggctagggc

SEQ ID NO: 60726 - DNA, 20 bp, Artificial
  CRISPR gRNA sequence
attgggatagagggaagaga

SEQ ID NO: 60727 - DNA, 20 bp, Artificial
  CRISPR gRNA sequence
gccccgcattctccttggag

SEQ ID NO: 60728 - DNA, 20 bp, Artificial
  CRISPR gRNA sequence
tgagacacttgtggggcaga

SEQ ID NO: 60729 - DNA, 20 bp, Artificial
  CRISPR gRNA sequence
gcactgtcactgtcagggca

SEQ ID NO: 60730 - DNA, 20 bp, Artificial
  CRISPR gRNA sequence
cctggggctagccagggacc

SEQ ID NO: 60731 - DNA, 20 bp, Artificial
  CRISPR gRNA sequence
agccagggaccctgggcttt

SEQ ID NO: 60732 - DNA, 20 bp, Artificial
  CRISPR gRNA sequence
atctgcccagtgacctggga

SEQ ID NO: 60733 - DNA, 20 bp, Artificial
  CRISPR gRNA sequence
ttagaagacaggtgagtctt

SEQ ID NO: 60734 - DNA, 20 bp, Artificial
  CRISPR gRNA sequence
aatcaggactcttggctcaa

SEQ ID NO: 60735 - DNA, 20 bp, Artificial
  CRISPR gRNA sequence
agggatttaactccccgggc

SEQ ID NO: 60736 - DNA, 20 bp, Artificial
  CRISPR gRNA sequence
ctttccttttattgtcattg

SEQ ID NO: 60737 - DNA, 20 bp, Artificial
  CRISPR gRNA sequence
actccttgcctatttgcata

SEQ ID NO: 60738 - DNA, 20 bp, Artificial
  CRISPR gRNA sequence
tatttgcatattcagtttct

SEQ ID NO: 60739 - DNA, 20 bp, Artificial
  CRISPR gRNA sequence
ctacctgtttgcagtcataa

SEQ ID NO: 60740 - DNA, 20 bp, Artificial
  CRISPR gRNA sequence
tcataaactagtttcatgca

SEQ ID NO: 60741 - DNA, 20 bp, Artificial
  CRISPR gRNA sequence
gcactgtgttttcatagcat

SEQ ID NO: 60742 - DNA, 20 bp, Artificial
  CRISPR gRNA sequence
catagcatctgtgttttcca

SEQ ID NO: 60743 - DNA, 20 bp, Artificial
  CRISPR gRNA sequence
cattttgcttcagtcttttt

SEQ ID NO: 60744 - DNA, 20 bp, Artificial
  CRISPR gRNA sequence
cagcccttccaaccagataa

SEQ ID NO: 60745 - DNA, 20 bp, Artificial
  CRISPR gRNA sequence
actattttttttttctgaga

SEQ ID NO: 60746 - DNA, 20 bp, Artificial
  CRISPR gRNA sequence
ctggagtgcaatggcgtgat

SEQ ID NO: 60747 - DNA, 20 bp, Artificial
  CRISPR gRNA sequence
tgcctcagcctcctgagtag

SEQ ID NO: 60748 - DNA, 20 bp, Artificial
  CRISPR gRNA sequence
ttttgtatttttagtagagg

SEQ ID NO: 60749 - DNA, 20 bp, Artificial
  CRISPR gRNA sequence
ttcctcagcctcccaaagtg

SEQ ID NO: 60750 - DNA, 20 bp, Artificial
  CRISPR gRNA sequence
cctcccaaagtgttgggatt

SEQ ID NO: 60751 - DNA, 20 bp, Artificial
  CRISPR gRNA sequence
gtcaaccaatggtcagtggt

SEQ ID NO: 60752 - DNA, 20 bp, Artificial
  CRISPR gRNA sequence
gtggtccctgattgtctctt

SEQ ID NO: 60753 - DNA, 20 bp, Artificial
  CRISPR gRNA sequence
agatcaagggtgtccaatct

SEQ ID NO: 60754 - DNA, 20 bp, Artificial
  CRISPR gRNA sequence
aactccaaagaaaaatctca

SEQ ID NO: 60755 - DNA, 20 bp, Artificial
  CRISPR gRNA sequence
aaaatctcatagtgttttaa

SEQ ID NO: 60756 - DNA, 20 bp, Artificial
  CRISPR gRNA sequence
aggctgcatgcagcaggcca

SEQ ID NO: 60757 - DNA, 20 bp, Artificial
  CRISPR gRNA sequence
atgtggcttggacaacttgg

SEQ ID NO: 60758 - DNA, 20 bp, Artificial
  CRISPR gRNA sequence
ttggtctagattgaaatcca

SEQ ID NO: 60759 - DNA, 20 bp, Artificial
  CRISPR gRNA sequence
atccaaactgcttctaggtg

SEQ ID NO: 60760 - DNA, 20 bp, Artificial
  CRISPR gRNA sequence
aactgcttctaggtgttgtg

SEQ ID NO: 60761 - DNA, 20 bp, Artificial
  CRISPR gRNA sequence
gtgctacaaaaagcactctt

SEQ ID NO: 60762 - DNA, 20 bp, Artificial
  CRISPR gRNA sequence
caaggcaaatcatctgcaga

SEQ ID NO: 60763 - DNA, 20 bp, Artificial
  CRISPR gRNA sequence
actctggaggcaggcaggag

SEQ ID NO: 60764 - DNA, 20 bp, Artificial
  CRISPR gRNA sequence
acttgcttgaacccgggagg

SEQ ID NO: 60765 - DNA, 20 bp, Artificial
  CRISPR gRNA sequence
tgggcggtctgagcacaggt

SEQ ID NO: 60766 - DNA, 20 bp, Artificial
  CRISPR gRNA sequence
gtagagtactgtgatcactt

SEQ ID NO: 60767 - DNA, 20 bp, Artificial
  CRISPR gRNA sequence
aggtactcaatgctgaagtc

SEQ ID NO: 60768 - DNA, 20 bp, Artificial
  CRISPR gRNA sequence
ccaccggggaagccagggaa

SEQ ID NO: 60769 - DNA, 20 bp, Artificial
  CRISPR gRNA sequence
atgtgggatgtggtaaagag

SEQ ID NO: 60770 - DNA, 20 bp, Artificial
  CRISPR gRNA sequence
gtggtaaagagtaaagattc

SEQ ID NO: 60771 - DNA, 20 bp, Artificial
  CRISPR gRNA sequence
ctggtgggacaccatacggg

SEQ ID NO: 60772 - DNA, 20 bp, Artificial
  CRISPR gRNA sequence
gagacagcaaggcaggtatc

SEQ ID NO: 60773 - DNA, 20 bp, Artificial
  CRISPR gRNA sequence
actcctctgggttaaggcag

SEQ ID NO: 60774 - DNA, 20 bp, Artificial
  CRISPR gRNA sequence
aacctctgcctcccaggttc

SEQ ID NO: 60775 - DNA, 20 bp, Artificial
  CRISPR gRNA sequence
ccacgcctggctaatttttt

SEQ ID NO: 60776 - DNA, 20 bp, Artificial
  CRISPR gRNA sequence
cacctcagcctcccaaagtg

SEQ ID NO: 60777 - DNA, 20 bp, Artificial
  CRISPR gRNA sequence
ctgcattcttttcttaacaa

SEQ ID NO: 60778 - DNA, 20 bp, Artificial
  CRISPR gRNA sequence
aaattaattctgctagtcca

SEQ ID NO: 60779 - DNA, 20 bp, Artificial
  CRISPR gRNA sequence
cagcaaacaaaaccatttaa

SEQ ID NO: 60780 - DNA, 20 bp, Artificial
  CRISPR gRNA sequence
atggacccagtgctgggagg

SEQ ID NO: 60781 - DNA, 20 bp, Artificial
  CRISPR gRNA sequence
tctggctatgaggccgtgct

SEQ ID NO: 60782 - DNA, 20 bp, Artificial
  CRISPR gRNA sequence
ccgtgctccctgctttcctg

SEQ ID NO: 60783 - DNA, 20 bp, Artificial
  CRISPR gRNA sequence
aggtttcccccacctcatcc

SEQ ID NO: 60784 - DNA, 20 bp, Artificial
  CRISPR gRNA sequence
tcccccacctcatccacctg

SEQ ID NO: 60785 - DNA, 20 bp, Artificial
  CRISPR gRNA sequence
ctcatccacctgctttgttt

SEQ ID NO: 60786 - DNA, 20 bp, Artificial
  CRISPR gRNA sequence
agagcctggagactctactg

SEQ ID NO: 60787 - DNA, 20 bp, Artificial
  CRISPR gRNA sequence
tgagcctgctgcagtaagac

SEQ ID NO: 60788 - DNA, 20 bp, Artificial
  CRISPR gRNA sequence
tatttcccggttccttgtgc

SEQ ID NO: 60789 - DNA, 20 bp, Artificial
  CRISPR gRNA sequence
cccgctccattctttcctta

SEQ ID NO: 60790 - DNA, 20 bp, Artificial
  CRISPR gRNA sequence
tggcacaactggggactcca

SEQ ID NO: 60791 - DNA, 20 bp, Artificial
  CRISPR gRNA sequence
actttgtcaacctcaggggg

SEQ ID NO: 60792 - DNA, 20 bp, Artificial
  CRISPR gRNA sequence
gtcgtttgcctcctctgcgt

SEQ ID NO: 60793 - DNA, 20 bp, Artificial
  CRISPR gRNA sequence
tcagtttcctcatctgacaa

SEQ ID NO: 60794 - DNA, 20 bp, Artificial
  CRISPR gRNA sequence
taggtcctgtacttatcaca

SEQ ID NO: 60795 - DNA, 20 bp, Artificial
  CRISPR gRNA sequence
cgggcagatcacctgaggtc

SEQ ID NO: 60796 - DNA, 20 bp, Artificial
  CRISPR gRNA sequence
ttgggaggctgaggcaggag

SEQ ID NO: 60797 - DNA, 20 bp, Artificial
  CRISPR gRNA sequence
ccgagatcgcgccattgcac

SEQ ID NO: 60798 - DNA, 20 bp, Artificial
  CRISPR gRNA sequence
aagaaaaagaaagaatttta

SEQ ID NO: 60799 - DNA, 20 bp, Artificial
  CRISPR gRNA sequence
ggctcgcatcacctccagga

SEQ ID NO: 60800 - DNA, 20 bp, Artificial
  CRISPR gRNA sequence
catcacctccaggatctcgc

SEQ ID NO: 60801 - DNA, 20 bp, Artificial
  CRISPR gRNA sequence
ctccaggatctcgcttatgc

SEQ ID NO: 60802 - DNA, 20 bp, Artificial
  CRISPR gRNA sequence
acttctctttgcctaaatca

SEQ ID NO: 60803 - DNA, 20 bp, Artificial
  CRISPR gRNA sequence
tggccagcctgaccccttgc

SEQ ID NO: 60804 - DNA, 20 bp, Artificial
  CRISPR gRNA sequence
actttgtagtactcaacgtg

SEQ ID NO: 60805 - DNA, 20 bp, Artificial
  CRISPR gRNA sequence
gtggtgaagagtggctggag

SEQ ID NO: 60806 - DNA, 20 bp, Artificial
  CRISPR gRNA sequence
ggcatgtgtgaggccctgag

SEQ ID NO: 60807 - DNA, 20 bp, Artificial
  CRISPR gRNA sequence
tgtgaggccctgaggcatga

SEQ ID NO: 60808 - DNA, 20 bp, Artificial
  CRISPR gRNA sequence
tggggcctggcacccatggg

SEQ ID NO: 60809 - DNA, 20 bp, Artificial
  CRISPR gRNA sequence
atgaaagggagaggaataat

SEQ ID NO: 60810 - DNA, 20 bp, Artificial
  CRISPR gRNA sequence
tgcctcagcctcccaagtag

SEQ ID NO: 60811 - DNA, 20 bp, Artificial
  CRISPR gRNA sequence
ttttgtatttttagtagaga

SEQ ID NO: 60812 - DNA, 20 bp, Artificial
  CRISPR gRNA sequence
acctcaagtgatccgcccgc

SEQ ID NO: 60813 - DNA, 20 bp, Artificial
  CRISPR gRNA sequence
cgcctcggcttcccaaagta

SEQ ID NO: 60814 - DNA, 20 bp, Artificial
  CRISPR gRNA sequence
ccactgcacccgttcctcat

SEQ ID NO: 60815 - DNA, 20 bp, Artificial
  CRISPR gRNA sequence
agactgagtgctgggtagag

SEQ ID NO: 60816 - DNA, 20 bp, Artificial
  CRISPR gRNA sequence
aatttacagacaagctgata

SEQ ID NO: 60817 - DNA, 20 bp, Artificial
  CRISPR gRNA sequence
catctcactttctctaaggc

SEQ ID NO: 60818 - DNA, 20 bp, Artificial
  CRISPR gRNA sequence
aggcagtggtttccaactgg

SEQ ID NO: 60819 - DNA, 20 bp, Artificial
  CRISPR gRNA sequence
acctcacatctcaatagtgc

SEQ ID NO: 60820 - DNA, 20 bp, Artificial
  CRISPR gRNA sequence
aaaactgtgtctgaagggcc

SEQ ID NO: 60821 - DNA, 20 bp, Artificial
  CRISPR gRNA sequence
caaggactcgcctgtgaaat

SEQ ID NO: 60822 - DNA, 20 bp, Artificial
  CRISPR gRNA sequence
cgagagtcatacatgacgag

SEQ ID NO: 60823 - DNA, 20 bp, Artificial
  CRISPR gRNA sequence
tttgtgcctcttgatcccct

SEQ ID NO: 60824 - DNA, 20 bp, Artificial
  CRISPR gRNA sequence
cagtaggacccaactagagg

SEQ ID NO: 60825 - DNA, 20 bp, Artificial
  CRISPR gRNA sequence
tggaacaaccctgcagaggg

SEQ ID NO: 60826 - DNA, 20 bp, Artificial
  CRISPR gRNA sequence
tctactgtgggggtgggagc

SEQ ID NO: 60827 - DNA, 20 bp, Artificial
  CRISPR gRNA sequence
tctggacacttccagagggt

SEQ ID NO: 60828 - DNA, 20 bp, Artificial
  CRISPR gRNA sequence
cagtggccaaacgccccatc

SEQ ID NO: 60829 - DNA, 20 bp, Artificial
  CRISPR gRNA sequence
ggatgcctgggtcacatacc

SEQ ID NO: 60830 - DNA, 20 bp, Artificial
  CRISPR gRNA sequence
tggcagatgggggctaaaac

SEQ ID NO: 60831 - DNA, 20 bp, Artificial
  CRISPR gRNA sequence
agcactttctccactgttct

SEQ ID NO: 60832 - DNA, 20 bp, Artificial
  CRISPR gRNA sequence
aagtgcttgacatgttcttt

SEQ ID NO: 60833 - DNA, 20 bp, Artificial
  CRISPR gRNA sequence
aaaaatgtgactgataaaat

SEQ ID NO: 60834 - DNA, 20 bp, Artificial
  CRISPR gRNA sequence
acacaccaacatgcctggct

SEQ ID NO: 60835 - DNA, 20 bp, Artificial
  CRISPR gRNA sequence
ccaacatgcctggctaatag

SEQ ID NO: 60836 - DNA, 20 bp, Artificial
  CRISPR gRNA sequence
atcctcagcctcccaggttg

SEQ ID NO: 60837 - DNA, 20 bp, Artificial
  CRISPR gRNA sequence
gagattacaggcatgagccg

SEQ ID NO: 60838 - DNA, 20 bp, Artificial
  CRISPR gRNA sequence
tatgaataagaaatatgtct

SEQ ID NO: 60839 - DNA, 20 bp, Artificial
  CRISPR gRNA sequence
aagaaatatgtctttgagtt

SEQ ID NO: 60840 - DNA, 20 bp, Artificial
  CRISPR gRNA sequence
tgcctcagcctcccaaggag

SEQ ID NO: 60841 - DNA, 20 bp, Artificial
  CRISPR gRNA sequence
tttggtatttttagtagaga

SEQ ID NO: 60842 - DNA, 20 bp, Artificial
  CRISPR gRNA sequence
tgcctcgccctcccaaagtg

SEQ ID NO: 60843 - DNA, 20 bp, Artificial
  CRISPR gRNA sequence
ttttaaagactattttatta

SEQ ID NO: 60844 - DNA, 20 bp, Artificial
  CRISPR gRNA sequence
aagacagaccaatttttaaa

SEQ ID NO: 60845 - DNA, 20 bp, Artificial
  CRISPR gRNA sequence
cgggtggatcacctgaggtc

SEQ ID NO: 60846 - DNA, 20 bp, Artificial
  CRISPR gRNA sequence
gggaagtaagaaacttcagg

SEQ ID NO: 60847 - DNA, 20 bp, Artificial
  CRISPR gRNA sequence
tccaatattgatattgcatt

SEQ ID NO: 60848 - DNA, 20 bp, Artificial
  CRISPR gRNA sequence
cagattaaaagaagaaatct

SEQ ID NO: 60849 - DNA, 20 bp, Artificial
  CRISPR gRNA sequence
caagggcgtggtgaaggcaa

SEQ ID NO: 60850 - DNA, 20 bp, Artificial
  CRISPR gRNA sequence
tatggaagaggaccaagagg

SEQ ID NO: 60851 - DNA, 20 bp, Artificial
  CRISPR gRNA sequence
aagggatggtgatggtggta

SEQ ID NO: 60852 - DNA, 20 bp, Artificial
  CRISPR gRNA sequence
gtctgccgcaggtgcccatc

SEQ ID NO: 60853 - DNA, 20 bp, Artificial
  CRISPR gRNA sequence
gccgcaggtgcccatctccg

SEQ ID NO: 60854 - DNA, 20 bp, Artificial
  CRISPR gRNA sequence
caccaaacacccaagagagg

SEQ ID NO: 60855 - DNA, 20 bp, Artificial
  CRISPR gRNA sequence
tccatccccaaccagctgat

SEQ ID NO: 60856 - DNA, 20 bp, Artificial
  CRISPR gRNA sequence
caccacttgttgctaggcaa

SEQ ID NO: 60857 - DNA, 20 bp, Artificial
  CRISPR gRNA sequence
agtgtgtccatctggagaat

SEQ ID NO: 60858 - DNA, 20 bp, Artificial
  CRISPR gRNA sequence
gagaatagatgcttagacat

SEQ ID NO: 60859 - DNA, 20 bp, Artificial
  CRISPR gRNA sequence
actttgtggccttccatctg

SEQ ID NO: 60860 - DNA, 20 bp, Artificial
  CRISPR gRNA sequence
ctctgcctttctctgaatct

SEQ ID NO: 60861 - DNA, 20 bp, Artificial
  CRISPR gRNA sequence
ggtattgccatgctcacaga

SEQ ID NO: 60862 - DNA, 20 bp, Artificial
  CRISPR gRNA sequence
ccttgtccttgtgggtgcag

SEQ ID NO: 60863 - DNA, 20 bp, Artificial
  CRISPR gRNA sequence
gaagctggcatgtctgggca

SEQ ID NO: 60864 - DNA, 20 bp, Artificial
  CRISPR gRNA sequence
tctgcagcctgggctctgag

SEQ ID NO: 60865 - DNA, 20 bp, Artificial
  CRISPR gRNA sequence
cctgggctctgagcagagct

SEQ ID NO: 60866 - DNA, 20 bp, Artificial
  CRISPR gRNA sequence
ggccctctcctcctttagag

SEQ ID NO: 60867 - DNA, 20 bp, Artificial
  CRISPR gRNA sequence
catgtcctgactacaggcct

SEQ ID NO: 60868 - DNA, 20 bp, Artificial
  CRISPR gRNA sequence
aggcttctgagtgtcacggt

SEQ ID NO: 60869 - DNA, 20 bp, Artificial
  CRISPR gRNA sequence
cctaccccttagggttattg

SEQ ID NO: 60870 - DNA, 20 bp, Artificial
  CRISPR gRNA sequence
ctcctagatcaagccctgcc

SEQ ID NO: 60871 - DNA, 20 bp, Artificial
  CRISPR gRNA sequence
gggagagtaaggcagtggtt

SEQ ID NO: 60872 - DNA, 20 bp, Artificial
  CRISPR gRNA sequence
tcagactgacctggatggaa

SEQ ID NO: 60873 - DNA, 20 bp, Artificial
  CRISPR gRNA sequence
tgctgtgtgtccttgggtta

SEQ ID NO: 60874 - DNA, 20 bp, Artificial
  CRISPR gRNA sequence
aggcctcacccaggctctgc

SEQ ID NO: 60875 - DNA, 20 bp, Artificial
  CRISPR gRNA sequence
ctgccctcaggctaagtgag

SEQ ID NO: 60876 - DNA, 20 bp, Artificial
  CRISPR gRNA sequence
agcacgtgtccaggctggcc

SEQ ID NO: 60877 - DNA, 20 bp, Artificial
  CRISPR gRNA sequence
agaagcagctggccatcctc

SEQ ID NO: 60878 - DNA, 20 bp, Artificial
  CRISPR gRNA sequence
tccttccccacactggaggc

SEQ ID NO: 60879 - DNA, 20 bp, Artificial
  CRISPR gRNA sequence
ccacactggaggcctgtgct

SEQ ID NO: 60880 - DNA, 20 bp, Artificial
  CRISPR gRNA sequence
aaaagaaagaaagaaagaaa

SEQ ID NO: 60881 - DNA, 20 bp, Artificial
  CRISPR gRNA sequence
aaaactcctattcccagaac

SEQ ID NO: 60882 - DNA, 20 bp, Artificial
  CRISPR gRNA sequence
gttgttcatactttttttat

SEQ ID NO: 60883 - DNA, 20 bp, Artificial
  CRISPR gRNA sequence
tttatttttatttcagctga

SEQ ID NO: 60884 - DNA, 20 bp, Artificial
  CRISPR gRNA sequence
ggacacctaagaaactcagt

SEQ ID NO: 60885 - DNA, 20 bp, Artificial
  CRISPR gRNA sequence
attgtcccccagataagaca

SEQ ID NO: 60886 - DNA, 20 bp, Artificial
  CRISPR gRNA sequence
cactgcccccatcccctcac

SEQ ID NO: 60887 - DNA, 20 bp, Artificial
  CRISPR gRNA sequence
cccatcccctcaccacagct

SEQ ID NO: 60888 - DNA, 20 bp, Artificial
  CRISPR gRNA sequence
actgtcctgctcctgactct

SEQ ID NO: 60889 - DNA, 20 bp, Artificial
  CRISPR gRNA sequence
gatcaaaaggctccatgaca

SEQ ID NO: 60890 - DNA, 20 bp, Artificial
  CRISPR gRNA sequence
aggctccatgacattcagtt

SEQ ID NO: 60891 - DNA, 20 bp, Artificial
  CRISPR gRNA sequence
ccagcccctggcaaccacca

SEQ ID NO: 60892 - DNA, 20 bp, Artificial
  CRISPR gRNA sequence
ctatgaattggactgctcta

SEQ ID NO: 60893 - DNA, 20 bp, Artificial
  CRISPR gRNA sequence
accctccacctcttgggttc

SEQ ID NO: 60894 - DNA, 20 bp, Artificial
  CRISPR gRNA sequence
tgcctcagcctccggagtag

SEQ ID NO: 60895 - DNA, 20 bp, Artificial
  CRISPR gRNA sequence
tttttgtatttttgtagaga

SEQ ID NO: 60896 - DNA, 20 bp, Artificial
  CRISPR gRNA sequence
ctcctgacctcagatgatct

SEQ ID NO: 60897 - DNA, 20 bp, Artificial
  CRISPR gRNA sequence
cgtttcggccttccaaagtg

SEQ ID NO: 60898 - DNA, 20 bp, Artificial
  CRISPR gRNA sequence
tcaagtgcccaattgacagt

SEQ ID NO: 60899 - DNA, 20 bp, Artificial
  CRISPR gRNA sequence
aaacaatagagatgaggtct

SEQ ID NO: 60900 - DNA, 20 bp, Artificial
  CRISPR gRNA sequence
accatgcccagccagaaagt

SEQ ID NO: 60901 - DNA, 20 bp, Artificial
  CRISPR gRNA sequence
tgcccgccaccacgcctgac

SEQ ID NO: 60902 - DNA, 20 bp, Artificial
  CRISPR gRNA sequence
ttttgtatttttagtagaga

SEQ ID NO: 60903 - DNA, 20 bp, Artificial
  CRISPR gRNA sequence
cacctcagcctcccaaagtg

SEQ ID NO: 60904 - DNA, 20 bp, Artificial
  CRISPR gRNA sequence
cactttgggaggctgaggtg

SEQ ID NO: 60905 - DNA, 20 bp, Artificial
  CRISPR gRNA sequence
ttgggaggctgaggtgggca

SEQ ID NO: 60906 - DNA, 20 bp, Artificial
  CRISPR gRNA sequence
ccagaaatacataaagaaaa

SEQ ID NO: 60907 - DNA, 20 bp, Artificial
  CRISPR gRNA sequence
attaatgcacatgcattgta

SEQ ID NO: 60908 - DNA, 20 bp, Artificial
  CRISPR gRNA sequence
tgaacatttaatatattttc

SEQ ID NO: 60909 - DNA, 20 bp, Artificial
  CRISPR gRNA sequence
tgttttccacacatctctct

SEQ ID NO: 60910 - DNA, 20 bp, Artificial
  CRISPR gRNA sequence
tttgaaatgcaaaattggga

SEQ ID NO: 60911 - DNA, 20 bp, Artificial
  CRISPR gRNA sequence
aattgggatcatgttttata

SEQ ID NO: 60912 - DNA, 20 bp, Artificial
  CRISPR gRNA sequence
ggatcatgttttatatacag

SEQ ID NO: 60913 - DNA, 20 bp, Artificial
  CRISPR gRNA sequence
ttgggaggctgaggcaggag

SEQ ID NO: 60914 - DNA, 20 bp, Artificial
  CRISPR gRNA sequence
atcatttaaaaaataatatt

SEQ ID NO: 60915 - DNA, 20 bp, Artificial
  CRISPR gRNA sequence
ttaaaaaataatattttctg

SEQ ID NO: 60916 - DNA, 20 bp, Artificial
  CRISPR gRNA sequence
gggtgatgttaatttccttt

SEQ ID NO: 60917 - DNA, 20 bp, Artificial
  CRISPR gRNA sequence
gatgcctacttgtataattt

SEQ ID NO: 60918 - DNA, 20 bp, Artificial
  CRISPR gRNA sequence
tcccccggccccgtcatgtg

SEQ ID NO: 60919 - DNA, 20 bp, Artificial
  CRISPR gRNA sequence
gggtaatagctgtgtcacca

SEQ ID NO: 60920 - DNA, 20 bp, Artificial
  CRISPR gRNA sequence
catggctgggagtccacgct

SEQ ID NO: 60921 - DNA, 20 bp, Artificial
  CRISPR gRNA sequence
aataacacaatgacacacag

SEQ ID NO: 60922 - DNA, 20 bp, Artificial
  CRISPR gRNA sequence
cacacagagtagcttatagc

SEQ ID NO: 60923 - DNA, 20 bp, Artificial
  CRISPR gRNA sequence
tacggccctttgcagggctg

SEQ ID NO: 60924 - DNA, 20 bp, Artificial
  CRISPR gRNA sequence
gtcaccagccacacagcctg

SEQ ID NO: 60925 - DNA, 20 bp, Artificial
  CRISPR gRNA sequence
ataacattcaagtgaaggca

SEQ ID NO: 60926 - DNA, 20 bp, Artificial
  CRISPR gRNA sequence
aactgcccttggatccctct

SEQ ID NO: 60927 - DNA, 20 bp, Artificial
  CRISPR gRNA sequence
ggctttctgtcatggtctga

SEQ ID NO: 60928 - DNA, 20 bp, Artificial
  CRISPR gRNA sequence
tggtgttggggagggggcag

SEQ ID NO: 60929 - DNA, 20 bp, Artificial
  CRISPR gRNA sequence
gtctgaccaacccacttctg

SEQ ID NO: 60930 - DNA, 20 bp, Artificial
  CRISPR gRNA sequence
tttcagttccccgaacacca

SEQ ID NO: 60931 - DNA, 20 bp, Artificial
  CRISPR gRNA sequence
agaatgttctcttcacgcct

SEQ ID NO: 60932 - DNA, 20 bp, Artificial
  CRISPR gRNA sequence
ctcctcctcatccctcaggt

SEQ ID NO: 60933 - DNA, 20 bp, Artificial
  CRISPR gRNA sequence
cagggaggccccctggaccc

SEQ ID NO: 60934 - DNA, 20 bp, Artificial
  CRISPR gRNA sequence
attatccactcttatagatc

SEQ ID NO: 60935 - DNA, 20 bp, Artificial
  CRISPR gRNA sequence
gcacctctaaatccatatgg

SEQ ID NO: 60936 - DNA, 20 bp, Artificial
  CRISPR gRNA sequence
accagctgccccatctggac

SEQ ID NO: 60937 - DNA, 20 bp, Artificial
  CRISPR gRNA sequence
ctagaatatccttggacctt

SEQ ID NO: 60938 - DNA, 20 bp, Artificial
  CRISPR gRNA sequence
caaaccacaggtggccctgg

SEQ ID NO: 60939 - DNA, 20 bp, Artificial
  CRISPR gRNA sequence
ttccctttttaacactcttt

SEQ ID NO: 60940 - DNA, 20 bp, Artificial
  CRISPR gRNA sequence
aaaataactgcgaactaaca

SEQ ID NO: 60941 - DNA, 20 bp, Artificial
  CRISPR gRNA sequence
cactttgggaggccgaggca

SEQ ID NO: 60942 - DNA, 20 bp, Artificial
  CRISPR gRNA sequence
ttgggaggctgaggcacaag

SEQ ID NO: 60943 - DNA, 20 bp, Artificial
  CRISPR gRNA sequence
gaggctgaggttacagtgag

SEQ ID NO: 60944 - DNA, 20 bp, Artificial
  CRISPR gRNA sequence
gcctaggtgacagagcgagg

SEQ ID NO: 60945 - DNA, 20 bp, Artificial
  CRISPR gRNA sequence
tacactactattatctcaac

SEQ ID NO: 60946 - DNA, 20 bp, Artificial
  CRISPR gRNA sequence
ctcaccagttctcccaataa

SEQ ID NO: 60947 - DNA, 20 bp, Artificial
  CRISPR gRNA sequence
tttatagaatgtccttccac

SEQ ID NO: 60948 - DNA, 20 bp, Artificial
  CRISPR gRNA sequence
tccttccacttgggtttgtc

SEQ ID NO: 60949 - DNA, 20 bp, Artificial
  CRISPR gRNA sequence
tgggtttgtccaatgtttcc

SEQ ID NO: 60950 - DNA, 20 bp, Artificial
  CRISPR gRNA sequence
aactttccctttgtaatcaa

SEQ ID NO: 60951 - DNA, 20 bp, Artificial
  CRISPR gRNA sequence
agattatgtggggagatact

SEQ ID NO: 60952 - DNA, 20 bp, Artificial
  CRISPR gRNA sequence
tcagcatgacagttgcaaaa

SEQ ID NO: 60953 - DNA, 20 bp, Artificial
  CRISPR gRNA sequence
tttacattttatttccatct

SEQ ID NO: 60954 - DNA, 20 bp, Artificial
  CRISPR gRNA sequence
cttgggctgggaacagtggc

SEQ ID NO: 60955 - DNA, 20 bp, Artificial
  CRISPR gRNA sequence
ctgggaggccgaggaggaaa

SEQ ID NO: 60956 - DNA, 20 bp, Artificial
  CRISPR gRNA sequence
aaaaaataaataaataaaat

SEQ ID NO: 60957 - DNA, 20 bp, Artificial
  CRISPR gRNA sequence
atctttgacacttcttcagt

SEQ ID NO: 60958 - DNA, 20 bp, Artificial
  CRISPR gRNA sequence
cagtatttgctttaaagatg

SEQ ID NO: 60959 - DNA, 20 bp, Artificial
  CRISPR gRNA sequence
aaactacagtgatacctaat

SEQ ID NO: 60960 - DNA, 20 bp, Artificial
  CRISPR gRNA sequence
gaagttgctacctgaatgac

SEQ ID NO: 60961 - DNA, 20 bp, Artificial
  CRISPR gRNA sequence
ttaggaaatactgaactagt

SEQ ID NO: 60962 - DNA, 20 bp, Artificial
  CRISPR gRNA sequence
aatactgaactagtccatgc

SEQ ID NO: 60963 - DNA, 20 bp, Artificial
  CRISPR gRNA sequence
cttctgcttccaagctctgt

SEQ ID NO: 60964 - DNA, 20 bp, Artificial
  CRISPR gRNA sequence
gcttaatgagttcatggtgg

SEQ ID NO: 60965 - DNA, 20 bp, Artificial
  CRISPR gRNA sequence
ctggagtgagttgcagagtg

SEQ ID NO: 60966 - DNA, 20 bp, Artificial
  CRISPR gRNA sequence
gaggggtggagaagagagca

SEQ ID NO: 60967 - DNA, 20 bp, Artificial
  CRISPR gRNA sequence
gcctggggaaggaagagcac

SEQ ID NO: 60968 - DNA, 20 bp, Artificial
  CRISPR gRNA sequence
gtgggcatggctgttccact

SEQ ID NO: 60969 - DNA, 20 bp, Artificial
  CRISPR gRNA sequence
catggctgttccactctggg

SEQ ID NO: 60970 - DNA, 20 bp, Artificial
  CRISPR gRNA sequence
tgtgtgtgtgtccctagtcc

SEQ ID NO: 60971 - DNA, 20 bp, Artificial
  CRISPR gRNA sequence
tctgcagccttcatccaggg

SEQ ID NO: 60972 - DNA, 20 bp, Artificial
  CRISPR gRNA sequence
cttgcctctgcctggtcttc

SEQ ID NO: 60973 - DNA, 20 bp, Artificial
  CRISPR gRNA sequence
gtgttgtgagtgagtggtga

SEQ ID NO: 60974 - DNA, 20 bp, Artificial
  CRISPR gRNA sequence
aaggagtgagtgaggggtga

SEQ ID NO: 60975 - DNA, 20 bp, Artificial
  CRISPR gRNA sequence
tagcatgcctaggaaccttt

SEQ ID NO: 60976 - DNA, 20 bp, Artificial
  CRISPR gRNA sequence
tgttttgtgaacacaaaccg

SEQ ID NO: 60977 - DNA, 20 bp, Artificial
  CRISPR gRNA sequence
gcaatccaagacagaaatat

SEQ ID NO: 60978 - DNA, 20 bp, Artificial
  CRISPR gRNA sequence
atccaggggttctatatttg

SEQ ID NO: 60979 - DNA, 20 bp, Artificial
  CRISPR gRNA sequence
cttactctttctctgtccac

SEQ ID NO: 60980 - DNA, 20 bp, Artificial
  CRISPR gRNA sequence
ggcaggccatccctgcacct

SEQ ID NO: 60981 - DNA, 20 bp, Artificial
  CRISPR gRNA sequence
cacctgcaggcttactttct

SEQ ID NO: 60982 - DNA, 20 bp, Artificial
  CRISPR gRNA sequence
cctagactgagtctcactgg

SEQ ID NO: 60983 - DNA, 20 bp, Artificial
  CRISPR gRNA sequence
tgtccactacatttgtctac

SEQ ID NO: 60984 - DNA, 20 bp, Artificial
  CRISPR gRNA sequence
cagttgtttccttggtaact

SEQ ID NO: 60985 - DNA, 20 bp, Artificial
  CRISPR gRNA sequence
aaagacaggtccccgtcctg

SEQ ID NO: 60986 - DNA, 20 bp, Artificial
  CRISPR gRNA sequence
ggtccccgtcctgcacagat

SEQ ID NO: 60987 - DNA, 20 bp, Artificial
  CRISPR gRNA sequence
agaaaatttaacagaatatc

SEQ ID NO: 60988 - DNA, 20 bp, Artificial
  CRISPR gRNA sequence
ccctgagaaaacttctgttg

SEQ ID NO: 60989 - DNA, 20 bp, Artificial
  CRISPR gRNA sequence
gaacggtttgtgaatttttc

SEQ ID NO: 60990 - DNA, 20 bp, Artificial
  CRISPR gRNA sequence
ctccagatttttttttctac

SEQ ID NO: 60991 - DNA, 20 bp, Artificial
  CRISPR gRNA sequence
ttttctacatatgttttgaa

SEQ ID NO: 60992 - DNA, 20 bp, Artificial
  CRISPR gRNA sequence
gccccttaacattgaaattc

SEQ ID NO: 60993 - DNA, 20 bp, Artificial
  CRISPR gRNA sequence
aaattcttccgcttgtccct

SEQ ID NO: 60994 - DNA, 20 bp, Artificial
  CRISPR gRNA sequence
aggatcaggtaaaaggagaa

SEQ ID NO: 60995 - DNA, 20 bp, Artificial
  CRISPR gRNA sequence
gccctcctgtcgtctcactg

SEQ ID NO: 60996 - DNA, 20 bp, Artificial
  CRISPR gRNA sequence
gcatctcggctcagccttct

SEQ ID NO: 60997 - DNA, 20 bp, Artificial
  CRISPR gRNA sequence
ccttctggaagcttttattt

SEQ ID NO: 60998 - DNA, 20 bp, Artificial
  CRISPR gRNA sequence
ggcacctgggccggggacag

SEQ ID NO: 60999 - DNA, 20 bp, Artificial
  CRISPR gRNA sequence
cctgggggcctttttcttcc

SEQ ID NO: 61000 - DNA, 20 bp, Artificial
  CRISPR gRNA sequence
ggcagttaccctcaaatcca

SEQ ID NO: 61001 - DNA, 20 bp, Artificial
  CRISPR gRNA sequence
tgggtggggtaactgacact

SEQ ID NO: 61002 - DNA, 20 bp, Artificial
  CRISPR gRNA sequence
tggggtaactgacacttcca

SEQ ID NO: 61003 - DNA, 20 bp, Artificial
  CRISPR gRNA sequence
actgacacttccagtttgct

SEQ ID NO: 61004 - DNA, 20 bp, Artificial
  CRISPR gRNA sequence
aaccaagacagttgaccatc

SEQ ID NO: 61005 - DNA, 20 bp, Artificial
  CRISPR gRNA sequence
ttttctatttttagtggaga

SEQ ID NO: 61006 - DNA, 20 bp, Artificial
  CRISPR gRNA sequence
ggtctcgaactcctgacctc

SEQ ID NO: 61007 - DNA, 20 bp, Artificial
  CRISPR gRNA sequence
cgccttggcctcacaaagtc

SEQ ID NO: 61008 - DNA, 20 bp, Artificial
  CRISPR gRNA sequence
gagccattgcgcccagccag

SEQ ID NO: 61009 - DNA, 20 bp, Artificial
  CRISPR gRNA sequence
gggctcaggaatgggagttc

SEQ ID NO: 61010 - DNA, 20 bp, Artificial
  CRISPR gRNA sequence
tttccagatggccccaagcc

SEQ ID NO: 61011 - DNA, 20 bp, Artificial
  CRISPR gRNA sequence
agtggctgtcttggaggtcc

SEQ ID NO: 61012 - DNA, 20 bp, Artificial
  CRISPR gRNA sequence
gctgaacagctccaccttgg

SEQ ID NO: 61013 - DNA, 20 bp, Artificial
  CRISPR gRNA sequence
tgctcttgccttctaatgcc

SEQ ID NO: 61014 - DNA, 20 bp, Artificial
  CRISPR gRNA sequence
ctggttacaaaagtggccta

SEQ ID NO: 61015 - DNA, 20 bp, Artificial
  CRISPR gRNA sequence
ggctcttgttaaaatgctca

SEQ ID NO: 61016 - DNA, 20 bp, Artificial
  CRISPR gRNA sequence
ggtctggaattctgcctaga

SEQ ID NO: 61017 - DNA, 20 bp, Artificial
  CRISPR gRNA sequence
cccaaacttagcatttcttt

SEQ ID NO: 61018 - DNA, 20 bp, Artificial
  CRISPR gRNA sequence
aacttagcatttcttttttt

SEQ ID NO: 61019 - DNA, 20 bp, Artificial
  CRISPR gRNA sequence
tagcatttctttttttgttt

SEQ ID NO: 61020 - DNA, 20 bp, Artificial
  CRISPR gRNA sequence
ttgtttgtttgtttttgaga

SEQ ID NO: 61021 - DNA, 20 bp, Artificial
  CRISPR gRNA sequence
aacctccgcctcccgggttc

SEQ ID NO: 61022 - DNA, 20 bp, Artificial
  CRISPR gRNA sequence
tgcctcagcctcccgagtag

SEQ ID NO: 61023 - DNA, 20 bp, Artificial
  CRISPR gRNA sequence
ttttgtatttttggtagaga

SEQ ID NO: 61024 - DNA, 20 bp, Artificial
  CRISPR gRNA sequence
cacctcggcctcccaaagtg

SEQ ID NO: 61025 - DNA, 20 bp, Artificial
  CRISPR gRNA sequence
tacaggcgtgagccaccacg

SEQ ID NO: 61026 - DNA, 20 bp, Artificial
  CRISPR gRNA sequence
ttcagactctgcattttcta

SEQ ID NO: 61027 - DNA, 20 bp, Artificial
  CRISPR gRNA sequence
gtggccttcctacactccct

SEQ ID NO: 61028 - DNA, 20 bp, Artificial
  CRISPR gRNA sequence
aaacatgacacttactttca

SEQ ID NO: 61029 - DNA, 20 bp, Artificial
  CRISPR gRNA sequence
atccaagcagtgacacaaag

SEQ ID NO: 61030 - DNA, 20 bp, Artificial
  CRISPR gRNA sequence
agcagtgacacaaagcattg

SEQ ID NO: 61031 - DNA, 20 bp, Artificial
  CRISPR gRNA sequence
aacctctgcctcctgggttc

SEQ ID NO: 61032 - DNA, 20 bp, Artificial
  CRISPR gRNA sequence
tgcctcagccgcccaagtag

SEQ ID NO: 61033 - DNA, 20 bp, Artificial
  CRISPR gRNA sequence
ttgtatatttttagtacaaa

SEQ ID NO: 61034 - DNA, 20 bp, Artificial
  CRISPR gRNA sequence
gaccatttgcctcagctatt

SEQ ID NO: 61035 - DNA, 20 bp, Artificial
  CRISPR gRNA sequence
ggctcagtaaagacaatacc

SEQ ID NO: 61036 - DNA, 20 bp, Artificial
  CRISPR gRNA sequence
ccctgacacagaggctgagg

SEQ ID NO: 61037 - DNA, 20 bp, Artificial
  CRISPR gRNA sequence
actcctcctgggccaggggc

SEQ ID NO: 61038 - DNA, 20 bp, Artificial
  CRISPR gRNA sequence
tcctgggccaggggctctgg

SEQ ID NO: 61039 - DNA, 20 bp, Artificial
  CRISPR gRNA sequence
tcacagctcactgctggctc

SEQ ID NO: 61040 - DNA, 20 bp, Artificial
  CRISPR gRNA sequence
ccccacctgccatgaccccc

SEQ ID NO: 61041 - DNA, 20 bp, Artificial
  CRISPR gRNA sequence
catatgaattcctgggcgtg

SEQ ID NO: 61042 - DNA, 20 bp, Artificial
  CRISPR gRNA sequence
tgaaagcctcttggtctatt

SEQ ID NO: 61043 - DNA, 20 bp, Artificial
  CRISPR gRNA sequence
aggggctacctgagcacgcc

SEQ ID NO: 61044 - DNA, 20 bp, Artificial
  CRISPR gRNA sequence
gtgtaaacaacctggggcct

SEQ ID NO: 61045 - DNA, 20 bp, Artificial
  CRISPR gRNA sequence
aagagtgtcaattgtagcaa

SEQ ID NO: 61046 - DNA, 20 bp, Artificial
  CRISPR gRNA sequence
agacggcagaaggctgatga

SEQ ID NO: 61047 - DNA, 20 bp, Artificial
  CRISPR gRNA sequence
tgatgaagctgttttctccc

SEQ ID NO: 61048 - DNA, 20 bp, Artificial
  CRISPR gRNA sequence
tcccccaagcttgagccaca

SEQ ID NO: 61049 - DNA, 20 bp, Artificial
  CRISPR gRNA sequence
atgctcattcctctcctctt

SEQ ID NO: 61050 - DNA, 20 bp, Artificial
  CRISPR gRNA sequence
ttgagctgccctgccccaag

SEQ ID NO: 61051 - DNA, 20 bp, Artificial
  CRISPR gRNA sequence
aacccctgccccttctcagc

SEQ ID NO: 61052 - DNA, 20 bp, Artificial
  CRISPR gRNA sequence
gcgaatgagaaatcctggca

SEQ ID NO: 61053 - DNA, 20 bp, Artificial
  CRISPR gRNA sequence
agagtcccagagtgctggga

SEQ ID NO: 61054 - DNA, 20 bp, Artificial
  CRISPR gRNA sequence
tgcctcagctaccagagtag

SEQ ID NO: 61055 - DNA, 20 bp, Artificial
  CRISPR gRNA sequence
cacctcagcctccaaaagtg

SEQ ID NO: 61056 - DNA, 20 bp, Artificial
  CRISPR gRNA sequence
cacaggtatctcccctaccc

SEQ ID NO: 61057 - DNA, 20 bp, Artificial
  CRISPR gRNA sequence
acaacctggctggaggggtc

SEQ ID NO: 61058 - DNA, 20 bp, Artificial
  CRISPR gRNA sequence
aggaagtctttcctaaaacg

SEQ ID NO: 61059 - DNA, 20 bp, Artificial
  CRISPR gRNA sequence
atgcccttctccatccccag

SEQ ID NO: 61060 - DNA, 20 bp, Artificial
  CRISPR gRNA sequence
catccccagcctggtttcct

SEQ ID NO: 61061 - DNA, 20 bp, Artificial
  CRISPR gRNA sequence
agactgccaagctcctcacc

SEQ ID NO: 61062 - DNA, 20 bp, Artificial
  CRISPR gRNA sequence
tgccctggaagtaatcttgt

SEQ ID NO: 61063 - DNA, 20 bp, Artificial
  CRISPR gRNA sequence
ctgcaggtaatgttgggtaa

SEQ ID NO: 61064 - DNA, 20 bp, Artificial
  CRISPR gRNA sequence
cttctgcctttttccccatt

SEQ ID NO: 61065 - DNA, 20 bp, Artificial
  CRISPR gRNA sequence
aggtggaccagatggtcttt

SEQ ID NO: 61066 - DNA, 20 bp, Artificial
  CRISPR gRNA sequence
gcaactggatagaccacctt

SEQ ID NO: 61067 - DNA, 20 bp, Artificial
  CRISPR gRNA sequence
cccccagacctgctggctgg

SEQ ID NO: 61068 - DNA, 20 bp, Artificial
  CRISPR gRNA sequence
aatcagaatcccccagacct

SEQ ID NO: 61069 - DNA, 20 bp, Artificial
  CRISPR gRNA sequence
aaccatggtatggaggacaa

SEQ ID NO: 61070 - DNA, 20 bp, Artificial
  CRISPR gRNA sequence
tttcctaaagaacaggacac

SEQ ID NO: 61071 - DNA, 20 bp, Artificial
  CRISPR gRNA sequence
acaggacacaagtgattacg

SEQ ID NO: 61072 - DNA, 20 bp, Artificial
  CRISPR gRNA sequence
acaagtgattacgagaagat

SEQ ID NO: 61073 - DNA, 20 bp, Artificial
  CRISPR gRNA sequence
attcatctttaacacctaac

SEQ ID NO: 61074 - DNA, 20 bp, Artificial
  CRISPR gRNA sequence
ttccaactagaagttaatac

SEQ ID NO: 61075 - DNA, 20 bp, Artificial
  CRISPR gRNA sequence
ttctatatggagtctgtaac

SEQ ID NO: 61076 - DNA, 20 bp, Artificial
  CRISPR gRNA sequence
tttccattgatagtagcaat

SEQ ID NO: 61077 - DNA, 20 bp, Artificial
  CRISPR gRNA sequence
gtagcaataaaagtttcctt

SEQ ID NO: 61078 - DNA, 20 bp, Artificial
  CRISPR gRNA sequence
aacctccacctgccgggttc

SEQ ID NO: 61079 - DNA, 20 bp, Artificial
  CRISPR gRNA sequence
tgcctcagcctcctgagtag

SEQ ID NO: 61080 - DNA, 20 bp, Artificial
  CRISPR gRNA sequence
tttttgtatttttagtagag

SEQ ID NO: 61081 - DNA, 20 bp, Artificial
  CRISPR gRNA sequence
gaccttggcctcccaaagtg

SEQ ID NO: 61082 - DNA, 20 bp, Artificial
  CRISPR gRNA sequence
gcgtgagcaaccacgcccag

SEQ ID NO: 61083 - DNA, 20 bp, Artificial
  CRISPR gRNA sequence
gcaacatcttgtgaacaacg

SEQ ID NO: 61084 - DNA, 20 bp, Artificial
  CRISPR gRNA sequence
ccttgcccccacgactggca

SEQ ID NO: 61085 - DNA, 20 bp, Artificial
  CRISPR gRNA sequence
tggcctgttccaagcccctg

SEQ ID NO: 61086 - DNA, 20 bp, Artificial
  CRISPR gRNA sequence
tctcacacccattctcatgg

SEQ ID NO: 61087 - DNA, 20 bp, Artificial
  CRISPR gRNA sequence
agcctggagaagaatcagat

SEQ ID NO: 61088 - DNA, 20 bp, Artificial
  CRISPR gRNA sequence
ggaggcggcagggcctgggc

SEQ ID NO: 61089 - DNA, 20 bp, Artificial
  CRISPR gRNA sequence
accattcacattgtcaacct

SEQ ID NO: 61090 - DNA, 20 bp, Artificial
  CRISPR gRNA sequence
ggcatcccaagtagcaggat

SEQ ID NO: 61091 - DNA, 20 bp, Artificial
  CRISPR gRNA sequence
ttttaaagcaaatacatatt

SEQ ID NO: 61092 - DNA, 20 bp, Artificial
  CRISPR gRNA sequence
gactcctcccttacttacat

SEQ ID NO: 61093 - DNA, 20 bp, Artificial
  CRISPR gRNA sequence
tgggtccagctactactttg

SEQ ID NO: 61094 - DNA, 20 bp, Artificial
  CRISPR gRNA sequence
tggctctgtcacactcgaag

SEQ ID NO: 61095 - DNA, 20 bp, Artificial
  CRISPR gRNA sequence
ttccacgtctagcgtgaatc

SEQ ID NO: 61096 - DNA, 20 bp, Artificial
  CRISPR gRNA sequence
tcagtggggtaagaggaaac

SEQ ID NO: 61097 - DNA, 20 bp, Artificial
  CRISPR gRNA sequence
acgctagacgtggaatacca

SEQ ID NO: 61098 - DNA, 20 bp, Artificial
  CRISPR gRNA sequence
cattgtgtttattgatcaag

SEQ ID NO: 61099 - DNA, 20 bp, Artificial
  CRISPR gRNA sequence
gtagtagctggacccagtag

SEQ ID NO: 61100 - DNA, 20 bp, Artificial
  CRISPR gRNA sequence
ccctacccagtaccattaga

SEQ ID NO: 61101 - DNA, 20 bp, Artificial
  CRISPR gRNA sequence
tgtcccttacataggacaga

SEQ ID NO: 61102 - DNA, 20 bp, Artificial
  CRISPR gRNA sequence
tgtaagtaagggaggagtca

SEQ ID NO: 61103 - DNA, 20 bp, Artificial
  CRISPR gRNA sequence
aagtttatagatgggtaggc

SEQ ID NO: 61104 - DNA, 20 bp, Artificial
  CRISPR gRNA sequence
ggggacttaatggctgagtc

SEQ ID NO: 61105 - DNA, 20 bp, Artificial
  CRISPR gRNA sequence
cacacaatctataaatatgt

SEQ ID NO: 61106 - DNA, 20 bp, Artificial
  CRISPR gRNA sequence
tcatttgggtgcatcacttg

SEQ ID NO: 61107 - DNA, 20 bp, Artificial
  CRISPR gRNA sequence
tctttgccatctgtcgtatc

SEQ ID NO: 61108 - DNA, 20 bp, Artificial
  CRISPR gRNA sequence
gaaaagaccctctttcttca

SEQ ID NO: 61109 - DNA, 20 bp, Artificial
  CRISPR gRNA sequence
ctgtctgaaattgtcataat

SEQ ID NO: 61110 - DNA, 20 bp, Artificial
  CRISPR gRNA sequence
gacaatgtgaatggtgcccc

SEQ ID NO: 61111 - DNA, 20 bp, Artificial
  CRISPR gRNA sequence
tatacaactgtatgtgatgg

SEQ ID NO: 61112 - DNA, 20 bp, Artificial
  CRISPR gRNA sequence
ctgattatagctgccatttt

SEQ ID NO: 61113 - DNA, 20 bp, Artificial
  CRISPR gRNA sequence
tatgtgccaggcattgggtt

SEQ ID NO: 61114 - DNA, 20 bp, Artificial
  CRISPR gRNA sequence
cagttggcaagtggcagagc

SEQ ID NO: 61115 - DNA, 20 bp, Artificial
  CRISPR gRNA sequence
agagctggggtttgatccaa

SEQ ID NO: 61116 - DNA, 20 bp, Artificial
  CRISPR gRNA sequence
gccaggcccccaaagctgtg

SEQ ID NO: 61117 - DNA, 20 bp, Artificial
  CRISPR gRNA sequence
agctgtgatctgattcttct

SEQ ID NO: 61118 - DNA, 20 bp, Artificial
  CRISPR gRNA sequence
acggccatgagaatgggtgt

SEQ ID NO: 61119 - DNA, 20 bp, Artificial
  CRISPR gRNA sequence
cagggggaactaagcctggc

SEQ ID NO: 61120 - DNA, 20 bp, Artificial
  CRISPR gRNA sequence
ccagagtgtgcaactcaagg

SEQ ID NO: 61121 - DNA, 20 bp, Artificial
  CRISPR gRNA sequence
cggcagctgcctcatccccg

SEQ ID NO: 61122 - DNA, 20 bp, Artificial
  CRISPR gRNA sequence
agggtgccagtcgtgggggc

SEQ ID NO: 61123 - DNA, 20 bp, Artificial
  CRISPR gRNA sequence
tcaagagaggccacctgata

SEQ ID NO: 61124 - DNA, 20 bp, Artificial
  CRISPR gRNA sequence
cctccctgctcccctccccg

SEQ ID NO: 61125 - DNA, 20 bp, Artificial
  CRISPR gRNA sequence
cactttgggaggccaaggtc

SEQ ID NO: 61126 - DNA, 20 bp, Artificial
  CRISPR gRNA sequence
caggtggaggttgcagtgag

SEQ ID NO: 61127 - DNA, 20 bp, Artificial
  CRISPR gRNA sequence
catatgcccttcctaagatg

SEQ ID NO: 61128 - DNA, 20 bp, Artificial
  CRISPR gRNA sequence
aattaccactgatctgagac

SEQ ID NO: 61129 - DNA, 20 bp, Artificial
  CRISPR gRNA sequence
ttgtgtcctgttctttagga

SEQ ID NO: 61130 - DNA, 20 bp, Artificial
  CRISPR gRNA sequence
tcccaggctagtcctagaat

SEQ ID NO: 61131 - DNA, 20 bp, Artificial
  CRISPR gRNA sequence
actgcaaagccccaaggtct

SEQ ID NO: 61132 - DNA, 20 bp, Artificial
  CRISPR gRNA sequence
aagccccaaggtctggggga

SEQ ID NO: 61133 - DNA, 20 bp, Artificial
  CRISPR gRNA sequence
ggccagccagcaggtctggg

SEQ ID NO: 61134 - DNA, 20 bp, Artificial
  CRISPR gRNA sequence
aggtctgggggtggctttct

SEQ ID NO: 61135 - DNA, 20 bp, Artificial
  CRISPR gRNA sequence
ggctttctcctggctttagc

SEQ ID NO: 61136 - DNA, 20 bp, Artificial
  CRISPR gRNA sequence
accaactgtggttcataaat

SEQ ID NO: 61137 - DNA, 20 bp, Artificial
  CRISPR gRNA sequence
gaaaaaggcagaagaaggta

SEQ ID NO: 61138 - DNA, 20 bp, Artificial
  CRISPR gRNA sequence
cagggctcttccaatcactc

SEQ ID NO: 61139 - DNA, 20 bp, Artificial
  CRISPR gRNA sequence
agctcgtgaagctggaggtg

SEQ ID NO: 61140 - DNA, 20 bp, Artificial
  CRISPR gRNA sequence
agggcatgggatgggatggg

SEQ ID NO: 61141 - DNA, 20 bp, Artificial
  CRISPR gRNA sequence
accagggtctggggtaagct

SEQ ID NO: 61142 - DNA, 20 bp, Artificial
  CRISPR gRNA sequence
agccaggcccccaccatccc

SEQ ID NO: 61143 - DNA, 20 bp, Artificial
  CRISPR gRNA sequence
acgcaggacccctccagcca

SEQ ID NO: 61144 - DNA, 20 bp, Artificial
  CRISPR gRNA sequence
gtgagaggagcctgagggac

SEQ ID NO: 61145 - DNA, 20 bp, Artificial
  CRISPR gRNA sequence
cctgggtaggtatcaaggac

SEQ ID NO: 61146 - DNA, 20 bp, Artificial
  CRISPR gRNA sequence
tctggtagctgaggcacaag

SEQ ID NO: 61147 - DNA, 20 bp, Artificial
  CRISPR gRNA sequence
tttgtgaagtgctgaggcca

SEQ ID NO: 61148 - DNA, 20 bp, Artificial
  CRISPR gRNA sequence
tgctcctgcgaagccctctg

SEQ ID NO: 61149 - DNA, 20 bp, Artificial
  CRISPR gRNA sequence
aactgaggctgagaaggggc

SEQ ID NO: 61150 - DNA, 20 bp, Artificial
  CRISPR gRNA sequence
agccaggactaggctgggcc

SEQ ID NO: 61151 - DNA, 20 bp, Artificial
  CRISPR gRNA sequence
ggcaggagagtgggtatatg

SEQ ID NO: 61152 - DNA, 20 bp, Artificial
  CRISPR gRNA sequence
acatctgctgggtctgccac

SEQ ID NO: 61153 - DNA, 20 bp, Artificial
  CRISPR gRNA sequence
cagagaagagcaggggctgg

SEQ ID NO: 61154 - DNA, 20 bp, Artificial
  CRISPR gRNA sequence
ggacactgaggttggcgcag

SEQ ID NO: 61155 - DNA, 20 bp, Artificial
  CRISPR gRNA sequence
gtctccaatctggttgtggc

SEQ ID NO: 61156 - DNA, 20 bp, Artificial
  CRISPR gRNA sequence
ggctcaagcttgggggagaa

SEQ ID NO: 61157 - DNA, 20 bp, Artificial
  CRISPR gRNA sequence
ttgagtgacagctcctaacc

SEQ ID NO: 61158 - DNA, 20 bp, Artificial
  CRISPR gRNA sequence
gacagctcctaacccttggc

SEQ ID NO: 61159 - DNA, 20 bp, Artificial
  CRISPR gRNA sequence
acatcctgtctttgggtccc

SEQ ID NO: 61160 - DNA, 20 bp, Artificial
  CRISPR gRNA sequence
ccccaagcttctaggcccca

SEQ ID NO: 61161 - DNA, 20 bp, Artificial
  CRISPR gRNA sequence
gaaaagcagggaatagacca

SEQ ID NO: 61162 - DNA, 20 bp, Artificial
  CRISPR gRNA sequence
gaatagaccaagaggctttc

SEQ ID NO: 61163 - DNA, 20 bp, Artificial
  CRISPR gRNA sequence
aggtgctgtgctaagaactc

SEQ ID NO: 61164 - DNA, 20 bp, Artificial
  CRISPR gRNA sequence
ggagtctctacatttctttg

SEQ ID NO: 61165 - DNA, 20 bp, Artificial
  CRISPR gRNA sequence
cggctgaatgccactttcac

SEQ ID NO: 61166 - DNA, 20 bp, Artificial
  CRISPR gRNA sequence
tgccactttcacgtgggatt

SEQ ID NO: 61167 - DNA, 20 bp, Artificial
  CRISPR gRNA sequence
tgttctcatccatgcaaatg

SEQ ID NO: 61168 - DNA, 20 bp, Artificial
  CRISPR gRNA sequence
gtcttagccccttgggaagt

SEQ ID NO: 61169 - DNA, 20 bp, Artificial
  CRISPR gRNA sequence
ttgggaagtatttgtttgca

SEQ ID NO: 61170 - DNA, 20 bp, Artificial
  CRISPR gRNA sequence
ttgggcggctgaggcaccag

SEQ ID NO: 61171 - DNA, 20 bp, Artificial
  CRISPR gRNA sequence
gtacttggatataaacaaag

SEQ ID NO: 61172 - DNA, 20 bp, Artificial
  CRISPR gRNA sequence
aacaaagcaatgctttgtgt

SEQ ID NO: 61173 - DNA, 20 bp, Artificial
  CRISPR gRNA sequence
agcaatgctttgtgtcactg

SEQ ID NO: 61174 - DNA, 20 bp, Artificial
  CRISPR gRNA sequence
tgctttgtgtcactgcttgg

SEQ ID NO: 61175 - DNA, 20 bp, Artificial
  CRISPR gRNA sequence
gcttggatttgtttttagtc

SEQ ID NO: 61176 - DNA, 20 bp, Artificial
  CRISPR gRNA sequence
ttgtttttagtcacaagatt

SEQ ID NO: 61177 - DNA, 20 bp, Artificial
  CRISPR gRNA sequence
aatcacattgaaagtaagtg

SEQ ID NO: 61178 - DNA, 20 bp, Artificial
  CRISPR gRNA sequence
ccccagaattgataccaccc

SEQ ID NO: 61179 - DNA, 20 bp, Artificial
  CRISPR gRNA sequence
tcgggaggctgaggcaggag

SEQ ID NO: 61180 - DNA, 20 bp, Artificial
  CRISPR gRNA sequence
gaggcggaggttgcagtgag

SEQ ID NO: 61181 - DNA, 20 bp, Artificial
  CRISPR gRNA sequence
aacaaacaaaaaaagaaatg

SEQ ID NO: 61182 - DNA, 20 bp, Artificial
  CRISPR gRNA sequence
cgccttaggcctgtagtccc

SEQ ID NO: 61183 - DNA, 20 bp, Artificial
  CRISPR gRNA sequence
caggaggatcacgttcgccc

SEQ ID NO: 61184 - DNA, 20 bp, Artificial
  CRISPR gRNA sequence
gagtttgaggctgcagtgca

SEQ ID NO: 61185 - DNA, 20 bp, Artificial
  CRISPR gRNA sequence
gatcccctgggaggtggcct

SEQ ID NO: 61186 - DNA, 20 bp, Artificial
  CRISPR gRNA sequence
tgtggtcccaactgagtggg

SEQ ID NO: 61187 - DNA, 20 bp, Artificial
  CRISPR gRNA sequence
gaggctctgcaggcaggtca

SEQ ID NO: 61188 - DNA, 20 bp, Artificial
  CRISPR gRNA sequence
agtctgggggtctgaggcct

SEQ ID NO: 61189 - DNA, 20 bp, Artificial
  CRISPR gRNA sequence
actgtactgggaggtccaaa

SEQ ID NO: 61190 - DNA, 20 bp, Artificial
  CRISPR gRNA sequence
cataaaatgtgggccaaact

SEQ ID NO: 61191 - DNA, 20 bp, Artificial
  CRISPR gRNA sequence
gcttggggccatctggaaag

SEQ ID NO: 61192 - DNA, 20 bp, Artificial
  CRISPR gRNA sequence
aaggttcagagagttagaga

SEQ ID NO: 61193 - DNA, 20 bp, Artificial
  CRISPR gRNA sequence
cttaaggtcatacacaaagt

SEQ ID NO: 61194 - DNA, 20 bp, Artificial
  CRISPR gRNA sequence
gccccaaccatatgtgaccc

SEQ ID NO: 61195 - DNA, 20 bp, Artificial
  CRISPR gRNA sequence
actcacaacaaccgtagcag

SEQ ID NO: 61196 - DNA, 20 bp, Artificial
  CRISPR gRNA sequence
ttgggaggctgaggcaggag

SEQ ID NO: 61197 - DNA, 20 bp, Artificial
  CRISPR gRNA sequence
tcttggttggctcagaacag

SEQ ID NO: 61198 - DNA, 20 bp, Artificial
  CRISPR gRNA sequence
tatacagctggaagaagctg

SEQ ID NO: 61199 - DNA, 20 bp, Artificial
  CRISPR gRNA sequence
cggacagggaagatattatg

SEQ ID NO: 61200 - DNA, 20 bp, Artificial
  CRISPR gRNA sequence
gggcctccaatcccctaaat

SEQ ID NO: 61201 - DNA, 20 bp, Artificial
  CRISPR gRNA sequence
aaattcacaaaccgttcaac

SEQ ID NO: 61202 - DNA, 20 bp, Artificial
  CRISPR gRNA sequence
ggacctgtcttttagactga

SEQ ID NO: 61203 - DNA, 20 bp, Artificial
  CRISPR gRNA sequence
agacaaatgtagtggacatc

SEQ ID NO: 61204 - DNA, 20 bp, Artificial
  CRISPR gRNA sequence
tctgtagatttttttctgcc

SEQ ID NO: 61205 - DNA, 20 bp, Artificial
  CRISPR gRNA sequence
atattttgtgctcacagcca

SEQ ID NO: 61206 - DNA, 20 bp, Artificial
  CRISPR gRNA sequence
tttgtgctcacagccacagt

SEQ ID NO: 61207 - DNA, 20 bp, Artificial
  CRISPR gRNA sequence
ataagccaatatatttctgt

SEQ ID NO: 61208 - DNA, 20 bp, Artificial
  CRISPR gRNA sequence
gccaatatatttctgtcttg

SEQ ID NO: 61209 - DNA, 20 bp, Artificial
  CRISPR gRNA sequence
ggattgctttgagttgtgta

SEQ ID NO: 61210 - DNA, 20 bp, Artificial
  CRISPR gRNA sequence
ctgggtccatccagaaacat

SEQ ID NO: 61211 - DNA, 20 bp, Artificial
  CRISPR gRNA sequence
caaccatcaccactcactca

SEQ ID NO: 61212 - DNA, 20 bp, Artificial
  CRISPR gRNA sequence
ccttggtgccctcctcatca

SEQ ID NO: 61213 - DNA, 20 bp, Artificial
  CRISPR gRNA sequence
atgaactcattaagccacca

SEQ ID NO: 61214 - DNA, 20 bp, Artificial
  CRISPR gRNA sequence
tagcaacttcacaacttaag

SEQ ID NO: 61215 - DNA, 20 bp, Artificial
  CRISPR gRNA sequence
aagccaggattaggtatcac

SEQ ID NO: 61216 - DNA, 20 bp, Artificial
  CRISPR gRNA sequence
actgtagtttagctagttac

SEQ ID NO: 61217 - DNA, 20 bp, Artificial
  CRISPR gRNA sequence
tcaaagatctctctgtccta

SEQ ID NO: 61218 - DNA, 20 bp, Artificial
  CRISPR gRNA sequence
ggtgtcgaactcccgggctc

SEQ ID NO: 61219 - DNA, 20 bp, Artificial
  CRISPR gRNA sequence
ctcctcggcctcccagagtg

SEQ ID NO: 61220 - DNA, 20 bp, Artificial
  CRISPR gRNA sequence
cctcccagagtgctgggatt

SEQ ID NO: 61221 - DNA, 20 bp, Artificial
  CRISPR gRNA sequence
tgagccactgttcccagccc

SEQ ID NO: 61222 - DNA, 20 bp, Artificial
  CRISPR gRNA sequence
gctacattttgcaactgtca

SEQ ID NO: 61223 - DNA, 20 bp, Artificial
  CRISPR gRNA sequence
ttgcaactgtcatgctgatt

SEQ ID NO: 61224 - DNA, 20 bp, Artificial
  CRISPR gRNA sequence
atgctgattcatcgatttaa

SEQ ID NO: 61225 - DNA, 20 bp, Artificial
  CRISPR gRNA sequence
ggctgctaaaatttgccaat

SEQ ID NO: 61226 - DNA, 20 bp, Artificial
  CRISPR gRNA sequence
gtatctccccacataatcta

SEQ ID NO: 61227 - DNA, 20 bp, Artificial
  CRISPR gRNA sequence
aagaagggccaaggacgtgt

SEQ ID NO: 61228 - DNA, 20 bp, Artificial
  CRISPR gRNA sequence
cactaaatgagacgtgtgat

SEQ ID NO: 61229 - DNA, 20 bp, Artificial
  CRISPR gRNA sequence
caacattattgggagaactg

SEQ ID NO: 61230 - DNA, 20 bp, Artificial
  CRISPR gRNA sequence
agtgtatcaatgtcacattt

SEQ ID NO: 61231 - DNA, 20 bp, Artificial
  CRISPR gRNA sequence
ttcctggattttataatttt

SEQ ID NO: 61232 - DNA, 20 bp, Artificial
  CRISPR gRNA sequence
aaatgttaacgggtaaaggg

SEQ ID NO: 61233 - DNA, 20 bp, Artificial
  CRISPR gRNA sequence
aagaaatgagcaaatgtgga

SEQ ID NO: 61234 - DNA, 20 bp, Artificial
  CRISPR gRNA sequence
tgcctcagcctcccaattag

SEQ ID NO: 61235 - DNA, 20 bp, Artificial
  CRISPR gRNA sequence
tttttgtattttagtagaga

SEQ ID NO: 61236 - DNA, 20 bp, Artificial
  CRISPR gRNA sequence
tgcctcggcctcccaaagtg

SEQ ID NO: 61237 - DNA, 20 bp, Artificial
  CRISPR gRNA sequence
gtggctcaatgttcctaagg

SEQ ID NO: 61238 - DNA, 20 bp, Artificial
  CRISPR gRNA sequence
aaatcatctccagggccacc

SEQ ID NO: 61239 - DNA, 20 bp, Artificial
  CRISPR gRNA sequence
aaaaggtccaaggatattct

SEQ ID NO: 61240 - DNA, 20 bp, Artificial
  CRISPR gRNA sequence
ccctcccctccactggccaa

SEQ ID NO: 61241 - DNA, 20 bp, Artificial
  CRISPR gRNA sequence
agagaactcagggccccaca

SEQ ID NO: 61242 - DNA, 20 bp, Artificial
  CRISPR gRNA sequence
ctggacacagacagggagac

SEQ ID NO: 61243 - DNA, 20 bp, Artificial
  CRISPR gRNA sequence
tggaacatctagtccagtat

SEQ ID NO: 61244 - DNA, 20 bp, Artificial
  CRISPR gRNA sequence
ggattcagtatctgcctgca

SEQ ID NO: 61245 - DNA, 20 bp, Artificial
  CRISPR gRNA sequence
atgctgatcaaatgaagtcc

SEQ ID NO: 61246 - DNA, 20 bp, Artificial
  CRISPR gRNA sequence
taatttcccaaactgtgcca

SEQ ID NO: 61247 - DNA, 20 bp, Artificial
  CRISPR gRNA sequence
tctataagagtggataatgg

SEQ ID NO: 61248 - DNA, 20 bp, Artificial
  CRISPR gRNA sequence
gctgggtcccacctgagtgc

SEQ ID NO: 61249 - DNA, 20 bp, Artificial
  CRISPR gRNA sequence
cccacctgagtgccacagct

SEQ ID NO: 61250 - DNA, 20 bp, Artificial
  CRISPR gRNA sequence
ccccttctcccctgccaggg

SEQ ID NO: 61251 - DNA, 20 bp, Artificial
  CRISPR gRNA sequence
ccagcttaggactggaaagt

SEQ ID NO: 61252 - DNA, 20 bp, Artificial
  CRISPR gRNA sequence
gctcactgcagccttgaact

SEQ ID NO: 61253 - DNA, 20 bp, Artificial
  CRISPR gRNA sequence
acttgaatgttatgttcatg

SEQ ID NO: 61254 - DNA, 20 bp, Artificial
  CRISPR gRNA sequence
gcttatggggagagggctat

SEQ ID NO: 61255 - DNA, 20 bp, Artificial
  CRISPR gRNA sequence
tctgcctggatccaatagcc

SEQ ID NO: 61256 - DNA, 20 bp, Artificial
  CRISPR gRNA sequence
ctggatccaatagccctttg

SEQ ID NO: 61257 - DNA, 20 bp, Artificial
  CRISPR gRNA sequence
gggatgtcttcctctgacac

SEQ ID NO: 61258 - DNA, 20 bp, Artificial
  CRISPR gRNA sequence
ggaaggtcaaggaaaagtcc

SEQ ID NO: 61259 - DNA, 20 bp, Artificial
  CRISPR gRNA sequence
ggggcctcttctctggactc

SEQ ID NO: 61260 - DNA, 20 bp, Artificial
  CRISPR gRNA sequence
gagtgtcaagggggggacct

SEQ ID NO: 61261 - DNA, 20 bp, Artificial
  CRISPR gRNA sequence
gggggggacctagaggcttt

SEQ ID NO: 61262 - DNA, 20 bp, Artificial
  CRISPR gRNA sequence
atcttattttatttttgaga

SEQ ID NO: 61263 - DNA, 20 bp, Artificial
  CRISPR gRNA sequence
aacctctgcctcctgggttc

SEQ ID NO: 61264 - DNA, 20 bp, Artificial
  CRISPR gRNA sequence
tgcctcagcctcccaagtag

SEQ ID NO: 61265 - DNA, 20 bp, Artificial
  CRISPR gRNA sequence
ttttgtatttttagtagaga

SEQ ID NO: 61266 - DNA, 20 bp, Artificial
  CRISPR gRNA sequence
tgcctcggcctcccaaagtg

SEQ ID NO: 61267 - DNA, 20 bp, Artificial
  CRISPR gRNA sequence
tgcactgggccactgatatt

SEQ ID NO: 61268 - DNA, 20 bp, Artificial
  CRISPR gRNA sequence
ctgatatttttagatttaag

SEQ ID NO: 61269 - DNA, 20 bp, Artificial
  CRISPR gRNA sequence
atatattaaatgttcatggt

SEQ ID NO: 61270 - DNA, 20 bp, Artificial
  CRISPR gRNA sequence
taagatgatagaattctcat

SEQ ID NO: 61271 - DNA, 20 bp, Artificial
  CRISPR gRNA sequence
aagagaattaagtcaaatat

SEQ ID NO: 61272 - DNA, 20 bp, Artificial
  CRISPR gRNA sequence
cactattttctttatgtatt

SEQ ID NO: 61273 - DNA, 20 bp, Artificial
  CRISPR gRNA sequence
ggattttctgcacatttcaa

SEQ ID NO: 61274 - DNA, 20 bp, Artificial
  CRISPR gRNA sequence
atttttattttttgtagata

SEQ ID NO: 61275 - DNA, 20 bp, Artificial
  CRISPR gRNA sequence
cacctcagcctcccaaagtg

SEQ ID NO: 61276 - DNA, 20 bp, Artificial
  CRISPR gRNA sequence
aatattatttttagactaag

SEQ ID NO: 61277 - DNA, 20 bp, Artificial
  CRISPR gRNA sequence
aatggcgtgaacccaggagg

SEQ ID NO: 61278 - DNA, 20 bp, Artificial
  CRISPR gRNA sequence
aaacagtgagacctcatctc

SEQ ID NO: 61279 - DNA, 20 bp, Artificial
  CRISPR gRNA sequence
tccggaggctgaggcaggag

SEQ ID NO: 61280 - DNA, 20 bp, Artificial
  CRISPR gRNA sequence
ggggtaggggggaaatgggg

SEQ ID NO: 61281 - DNA, 20 bp, Artificial
  CRISPR gRNA sequence
ggggtgttgtttaatgggga

SEQ ID NO: 61282 - DNA, 20 bp, Artificial
  CRISPR gRNA sequence
ttgtttaatggggatagaga

SEQ ID NO: 61283 - DNA, 20 bp, Artificial
  CRISPR gRNA sequence
ttgcaagaggaaaagagttc

SEQ ID NO: 61284 - DNA, 20 bp, Artificial
  CRISPR gRNA sequence
ctcctgaatggtacacttag

SEQ ID NO: 61285 - DNA, 20 bp, Artificial
  CRISPR gRNA sequence
tgcacagctctgtcggtgac

SEQ ID NO: 61286 - DNA, 20 bp, Artificial
  CRISPR gRNA sequence
tggagccttttgatctaacg

SEQ ID NO: 61287 - DNA, 20 bp, Artificial
  CRISPR gRNA sequence
cagtctgcagtacacacagt

SEQ ID NO: 61288 - DNA, 20 bp, Artificial
  CRISPR gRNA sequence
ctgggggacaatggggacat

SEQ ID NO: 61289 - DNA, 20 bp, Artificial
  CRISPR gRNA sequence
cgacactaaggaatcgctaa

SEQ ID NO: 61290 - DNA, 20 bp, Artificial
  CRISPR gRNA sequence
tcttaggtgtcctgatggaa

SEQ ID NO: 61291 - DNA, 20 bp, Artificial
  CRISPR gRNA sequence
aaaaaaatgtccttattttt

SEQ ID NO: 61292 - DNA, 20 bp, Artificial
  CRISPR gRNA sequence
acggtgaaatatttaggagt

SEQ ID NO: 61293 - DNA, 20 bp, Artificial
  CRISPR gRNA sequence
gaggtctataacttacttga

SEQ ID NO: 61294 - DNA, 20 bp, Artificial
  CRISPR gRNA sequence
caaacctaggttctgggaat

SEQ ID NO: 61295 - DNA, 20 bp, Artificial
  CRISPR gRNA sequence
cttcggtatcttctttttct

SEQ ID NO: 61296 - DNA, 20 bp, Artificial
  CRISPR gRNA sequence
agtgaacagacagacaagaa

SEQ ID NO: 61297 - DNA, 20 bp, Artificial
  CRISPR gRNA sequence
cagacagacaagaacttcgt

SEQ ID NO: 61298 - DNA, 20 bp, Artificial
  CRISPR gRNA sequence
aggcctccagtgtggggaag

SEQ ID NO: 61299 - DNA, 20 bp, Artificial
  CRISPR gRNA sequence
gagtctctgggacagatgga

SEQ ID NO: 61300 - DNA, 20 bp, Artificial
  CRISPR gRNA sequence
ccaagctcaggaggatggcc

SEQ ID NO: 61301 - DNA, 20 bp, Artificial
  CRISPR gRNA sequence
gaggcctgtgggcactgctg

SEQ ID NO: 61302 - DNA, 20 bp, Artificial
  CRISPR gRNA sequence
aaatatgcagctcctgctct

SEQ ID NO: 61303 - DNA, 20 bp, Artificial
  CRISPR gRNA sequence
gataagaaagaagggcagaa

SEQ ID NO: 61304 - DNA, 20 bp, Artificial
  CRISPR gRNA sequence
ccctggggagggaggtgtgc

SEQ ID NO: 61305 - DNA, 20 bp, Artificial
  CRISPR gRNA sequence
gggatacttccaggaggggc

SEQ ID NO: 61306 - DNA, 20 bp, Artificial
  CRISPR gRNA sequence
tgatgtttgagctgggtgtt

SEQ ID NO: 61307 - DNA, 20 bp, Artificial
  CRISPR gRNA sequence
agaggcagagaatcttcagg

SEQ ID NO: 61308 - DNA, 20 bp, Artificial
  CRISPR gRNA sequence
atgtgccaggtatgtatgtg

SEQ ID NO: 61309 - DNA, 20 bp, Artificial
  CRISPR gRNA sequence
gccaggtatgtatgtggggg

SEQ ID NO: 61310 - DNA, 20 bp, Artificial
  CRISPR gRNA sequence
tggtatgtgtatggtatgtg

SEQ ID NO: 61311 - DNA, 20 bp, Artificial
  CRISPR gRNA sequence
tgtgtgctgcgtgctgtgtg

SEQ ID NO: 61312 - DNA, 20 bp, Artificial
  CRISPR gRNA sequence
gtgctgtgtggtgtgtttgg

SEQ ID NO: 61313 - DNA, 20 bp, Artificial
  CRISPR gRNA sequence
aggcctgataagatgcaggg

SEQ ID NO: 61314 - DNA, 20 bp, Artificial
  CRISPR gRNA sequence
atagctggtaagtggcagat

SEQ ID NO: 61315 - DNA, 20 bp, Artificial
  CRISPR gRNA sequence
agatcagggatttattttca

SEQ ID NO: 61316 - DNA, 20 bp, Artificial
  CRISPR gRNA sequence
gaagagaatgttgggctgag

SEQ ID NO: 61317 - DNA, 20 bp, Artificial
  CRISPR gRNA sequence
tggaggaacagacccaggca

SEQ ID NO: 61318 - DNA, 20 bp, Artificial
  CRISPR gRNA sequence
tcccctgtcccatcaccctg

SEQ ID NO: 61319 - DNA, 20 bp, Artificial
  CRISPR gRNA sequence
gaagcacggtgcccagacat

SEQ ID NO: 61320 - DNA, 20 bp, Artificial
  CRISPR gRNA sequence
gatcccatgcccaggaaacc

SEQ ID NO: 61321 - DNA, 20 bp, Artificial
  CRISPR gRNA sequence
aaggccacaaagtgtgggtg

SEQ ID NO: 61322 - DNA, 20 bp, Artificial
  CRISPR gRNA sequence
gcacctgttggccagcagaa

SEQ ID NO: 61323 - DNA, 20 bp, Artificial
  CRISPR gRNA sequence
acatctccacatttatgttc

SEQ ID NO: 61324 - DNA, 20 bp, Artificial
  CRISPR gRNA sequence
tcagctggttggggatggaa

SEQ ID NO: 61325 - DNA, 20 bp, Artificial
  CRISPR gRNA sequence
tgttgcttccctgtccccag

SEQ ID NO: 61326 - DNA, 20 bp, Artificial
  CRISPR gRNA sequence
cacgaatcacagcctctctt

SEQ ID NO: 61327 - DNA, 20 bp, Artificial
  CRISPR gRNA sequence
gccctcagaaggagccccca

SEQ ID NO: 61328 - DNA, 20 bp, Artificial
  CRISPR gRNA sequence
tccttgctatctgtccttta

SEQ ID NO: 61329 - DNA, 20 bp, Artificial
  CRISPR gRNA sequence
tctgagtccgctgtcgccca

SEQ ID NO: 61330 - DNA, 20 bp, Artificial
  CRISPR gRNA sequence
tcatagctcaggtgcctcca

SEQ ID NO: 61331 - DNA, 20 bp, Artificial
  CRISPR gRNA sequence
ggccggcatcatttgggatc

SEQ ID NO: 61332 - DNA, 20 bp, Artificial
  CRISPR gRNA sequence
agaggaaattcaggaaaaaa

SEQ ID NO: 61333 - DNA, 20 bp, Artificial
  CRISPR gRNA sequence
tttgcaggatgcattaaacc

SEQ ID NO: 61334 - DNA, 20 bp, Artificial
  CRISPR gRNA sequence
tcaatattggaaacctcacc

SEQ ID NO: 61335 - DNA, 20 bp, Artificial
  CRISPR gRNA sequence
ttcccttcattgcagcattc

SEQ ID NO: 61336 - DNA, 20 bp, Artificial
  CRISPR gRNA sequence
gacctctgtctcccaggttc

SEQ ID NO: 61337 - DNA, 20 bp, Artificial
  CRISPR gRNA sequence
tgcctcagcctcccaagtag

SEQ ID NO: 61338 - DNA, 20 bp, Artificial
  CRISPR gRNA sequence
tttttgtatttttagtagag

SEQ ID NO: 61339 - DNA, 20 bp, Artificial
  CRISPR gRNA sequence
ctcctgacctcaggtgatcc

SEQ ID NO: 61340 - DNA, 20 bp, Artificial
  CRISPR gRNA sequence
cgctttggcctcccaaagtg

SEQ ID NO: 61341 - DNA, 20 bp, Artificial
  CRISPR gRNA sequence
ggcgtgagccaccacgccca

SEQ ID NO: 61342 - DNA, 20 bp, Artificial
  CRISPR gRNA sequence
cacgcccagctagttttaac

SEQ ID NO: 61343 - DNA, 20 bp, Artificial
  CRISPR gRNA sequence
taaccagtgtgtcccggaac

SEQ ID NO: 61344 - DNA, 20 bp, Artificial
  CRISPR gRNA sequence
tcctaggtctgtgacatttt

SEQ ID NO: 61345 - DNA, 20 bp, Artificial
  CRISPR gRNA sequence
ttgggaggctgaggcaggag

SEQ ID NO: 61346 - DNA, 20 bp, Artificial
  CRISPR gRNA sequence
aagacatatttcttattcat

SEQ ID NO: 61347 - DNA, 20 bp, Artificial
  CRISPR gRNA sequence
gctgaggatcacctgagctc

SEQ ID NO: 61348 - DNA, 20 bp, Artificial
  CRISPR gRNA sequence
tccagaggctgaggtgggag

SEQ ID NO: 61349 - DNA, 20 bp, Artificial
  CRISPR gRNA sequence
gtcttaaaaaaaaaagaaat

SEQ ID NO: 61350 - DNA, 20 bp, Artificial
  CRISPR gRNA sequence
ctatttcccactggtcctag

SEQ ID NO: 61351 - DNA, 20 bp, Artificial
  CRISPR gRNA sequence
tgctgggccaacaatgaatc

SEQ ID NO: 61352 - DNA, 20 bp, Artificial
  CRISPR gRNA sequence
ttttagcccccatctgccag

SEQ ID NO: 61353 - DNA, 20 bp, Artificial
  CRISPR gRNA sequence
agtgggggcgggagagagaa

SEQ ID NO: 61354 - DNA, 20 bp, Artificial
  CRISPR gRNA sequence
gagagagaaaattgattcag

SEQ ID NO: 61355 - DNA, 20 bp, Artificial
  CRISPR gRNA sequence
aaggggacaagcaggggatg

SEQ ID NO: 61356 - DNA, 20 bp, Artificial
  CRISPR gRNA sequence
ggctccaggtgggtctccac

SEQ ID NO: 61357 - DNA, 20 bp, Artificial
  CRISPR gRNA sequence
acagtagatcccacccggac

SEQ ID NO: 61358 - DNA, 20 bp, Artificial
  CRISPR gRNA sequence
tctgcagggttgttccaggg

SEQ ID NO: 61359 - DNA, 20 bp, Artificial
  CRISPR gRNA sequence
gctgcctaggcatggttcaa

SEQ ID NO: 61360 - DNA, 20 bp, Artificial
  CRISPR gRNA sequence
cacctttttaacccgtggac

SEQ ID NO: 61361 - DNA, 20 bp, Artificial
  CRISPR gRNA sequence
taaggtgttggccagcagga

SEQ ID NO: 61362 - DNA, 20 bp, Artificial
  CRISPR gRNA sequence
acaaatagggctgagggaca

SEQ ID NO: 61363 - DNA, 20 bp, Artificial
  CRISPR gRNA sequence
agggctgagggacaggcaga

SEQ ID NO: 61364 - DNA, 20 bp, Artificial
  CRISPR gRNA sequence
gatttggatttgagtcccag

SEQ ID NO: 61365 - DNA, 20 bp, Artificial
  CRISPR gRNA sequence
ggagaagtgacttcacctct

SEQ ID NO: 61366 - DNA, 20 bp, Artificial
  CRISPR gRNA sequence
gtgacttcacctctctgagc

SEQ ID NO: 61367 - DNA, 20 bp, Artificial
  CRISPR gRNA sequence
tgtatgactctcgaggtata

SEQ ID NO: 61368 - DNA, 20 bp, Artificial
  CRISPR gRNA sequence
tgcactgccgggcatgggac

SEQ ID NO: 61369 - DNA, 20 bp, Artificial
  CRISPR gRNA sequence
gtgcttgctgttattattac

SEQ ID NO: 61370 - DNA, 20 bp, Artificial
  CRISPR gRNA sequence
ctattgtttttacctgcaag

SEQ ID NO: 61371 - DNA, 20 bp, Artificial
  CRISPR gRNA sequence
gtccttgctcacagagagtg

SEQ ID NO: 61372 - DNA, 20 bp, Artificial
  CRISPR gRNA sequence
gaagcttcaggcccttcaga

SEQ ID NO: 61373 - DNA, 20 bp, Artificial
  CRISPR gRNA sequence
cctcatccagtaatccccct

SEQ ID NO: 61374 - DNA, 20 bp, Artificial
  CRISPR gRNA sequence
cgggcggatcacttgaggtc

SEQ ID NO: 61375 - DNA, 20 bp, Artificial
  CRISPR gRNA sequence
gaggcggaggttgcagtgag

SEQ ID NO: 61376 - DNA, 20 bp, Artificial
  CRISPR gRNA sequence
cgcgctgttcctggagccca

SEQ ID NO: 61377 - DNA, 20 bp, Artificial
  CRISPR gRNA sequence
cctcctcagagatgttccct

SEQ ID NO: 61378 - DNA, 20 bp, Artificial
  CRISPR gRNA sequence
tcactggctaagttcatctt

SEQ ID NO: 61379 - DNA, 20 bp, Artificial
  CRISPR gRNA sequence
gcactacacgttgagtacta

SEQ ID NO: 61380 - DNA, 20 bp, Artificial
  CRISPR gRNA sequence
gaggagtcaggggtgaagct

SEQ ID NO: 61381 - DNA, 20 bp, Artificial
  CRISPR gRNA sequence
agagaagttcctctccggtc

SEQ ID NO: 61382 - DNA, 20 bp, Artificial
  CRISPR gRNA sequence
ttgcaccgatgttattaaca

SEQ ID NO: 61383 - DNA, 20 bp, Artificial
  CRISPR gRNA sequence
tattttttcatcttagctgc

SEQ ID NO: 61384 - DNA, 20 bp, Artificial
  CRISPR gRNA sequence
cccgcctcccaccactagaa

SEQ ID NO: 61385 - DNA, 20 bp, Artificial
  CRISPR gRNA sequence
ttctttttttttttctgaga

SEQ ID NO: 61386 - DNA, 20 bp, Artificial
  CRISPR gRNA sequence
ttttgtatttttagtagaga

SEQ ID NO: 61387 - DNA, 20 bp, Artificial
  CRISPR gRNA sequence
cgcctcggcctcccaaagtg

SEQ ID NO: 61388 - DNA, 20 bp, Artificial
  CRISPR gRNA sequence
agtctgagctgaaattagaa

SEQ ID NO: 61389 - DNA, 20 bp, Artificial
  CRISPR gRNA sequence
gttttaatactttgggggaa

SEQ ID NO: 61390 - DNA, 20 bp, Artificial
  CRISPR gRNA sequence
tctgcttaaattcccttttt

SEQ ID NO: 61391 - DNA, 20 bp, Artificial
  CRISPR gRNA sequence
cacagatcttccatttctta

SEQ ID NO: 61392 - DNA, 20 bp, Artificial
  CRISPR gRNA sequence
agtattagggtggagctgga

SEQ ID NO: 61393 - DNA, 20 bp, Artificial
  CRISPR gRNA sequence
ttgaggggttagagggcagg

SEQ ID NO: 61394 - DNA, 20 bp, Artificial
  CRISPR gRNA sequence
tggaagaagaggaaggtctt

SEQ ID NO: 61395 - DNA, 20 bp, Artificial
  CRISPR gRNA sequence
tacggggttaagccaaatta

SEQ ID NO: 61396 - DNA, 20 bp, Artificial
  CRISPR gRNA sequence
ggttaagccaaattaaatgg

SEQ ID NO: 61397 - DNA, 20 bp, Artificial
  CRISPR gRNA sequence
ttaaatggttttgtttgctg

SEQ ID NO: 61398 - DNA, 20 bp, Artificial
  CRISPR gRNA sequence
gaaggttagtgttccgcaaa

SEQ ID NO: 61399 - DNA, 20 bp, Artificial
  CRISPR gRNA sequence
ggtcagcgaaggagacaggg

SEQ ID NO: 61400 - DNA, 20 bp, Artificial
  CRISPR gRNA sequence
actcaagacactgagttccc

SEQ ID NO: 61401 - DNA, 20 bp, Artificial
  CRISPR gRNA sequence
ccaagggcctggcccatctc

SEQ ID NO: 61402 - DNA, 20 bp, Artificial
  CRISPR gRNA sequence
tctctgctgctttctcctct

SEQ ID NO: 61403 - DNA, 20 bp, Artificial
  CRISPR gRNA sequence
tgggctctggttggcaaagg

SEQ ID NO: 61404 - DNA, 20 bp, Artificial
  CRISPR gRNA sequence
acacaggcaaagtagacctg

SEQ ID NO: 61405 - DNA, 20 bp, Artificial
  CRISPR gRNA sequence
gagccccacaatctatcttc

SEQ ID NO: 61406 - DNA, 20 bp, Artificial
  CRISPR gRNA sequence
acagtactctacagttgaca

SEQ ID NO: 61407 - DNA, 20 bp, Artificial
  CRISPR gRNA sequence
cagaccgcccagtgctgcca

SEQ ID NO: 61408 - DNA, 20 bp, Artificial
  CRISPR gRNA sequence
cctgcctgcctccagagtag

SEQ ID NO: 61409 - DNA, 20 bp, Artificial
  CRISPR gRNA sequence
ttttgtatttttagtagaga

SEQ ID NO: 61410 - DNA, 20 bp, Artificial
  CRISPR gRNA sequence
cacctcggcctcccaaagtg

SEQ ID NO: 61411 - DNA, 20 bp, Artificial
  CRISPR gRNA sequence
gtcaccgtgccgggccgcca

SEQ ID NO: 61412 - DNA, 20 bp, Artificial
  CRISPR gRNA sequence
ccgccagtgggctttttata

SEQ ID NO: 61413 - DNA, 20 bp, Artificial
  CRISPR gRNA sequence
ttatattaagcttcctctgc

SEQ ID NO: 61414 - DNA, 20 bp, Artificial
  CRISPR gRNA sequence
ttaacagtcaaatcacgtaa

SEQ ID NO: 61415 - DNA, 20 bp, Artificial
  CRISPR gRNA sequence
aacaaaacacaacacctaga

SEQ ID NO: 61416 - DNA, 20 bp, Artificial
  CRISPR gRNA sequence
aacacaacacctagaagcag

SEQ ID NO: 61417 - DNA, 20 bp, Artificial
  CRISPR gRNA sequence
gcctgctgcatgcagcctag

SEQ ID NO: 61418 - DNA, 20 bp, Artificial
  CRISPR gRNA sequence
gtaaactttcttaaaacact

SEQ ID NO: 61419 - DNA, 20 bp, Artificial
  CRISPR gRNA sequence
aacactatgagatttttctt

SEQ ID NO: 61420 - DNA, 20 bp, Artificial
  CRISPR gRNA sequence
tatgagatttttctttggag

SEQ ID NO: 61421 - DNA, 20 bp, Artificial
  CRISPR gRNA sequence
caatgtggcccagggaagcc

SEQ ID NO: 61422 - DNA, 20 bp, Artificial
  CRISPR gRNA sequence
tcaggaggctgaggcaggag

SEQ ID NO: 61423 - DNA, 20 bp, Artificial
  CRISPR gRNA sequence
aaaaatagtgtaggtctgat

SEQ ID NO: 61424 - DNA, 20 bp, Artificial
  CRISPR gRNA sequence
ctgataatggttttgtggtt

SEQ ID NO: 61425 - DNA, 20 bp, Artificial
  CRISPR gRNA sequence
gccacactccagggggtcaa

SEQ ID NO: 61426 - DNA, 20 bp, Artificial
  CRISPR gRNA sequence
atgaaaacacagtgcatgaa

SEQ ID NO: 61427 - DNA, 20 bp, Artificial
  CRISPR gRNA sequence
gtcctgtggacacatgacaa

SEQ ID NO: 61428 - DNA, 20 bp, Artificial
  CRISPR gRNA sequence
atggatttgatgagagaaga

SEQ ID NO: 61429 - DNA, 20 bp, Artificial
  CRISPR gRNA sequence
gaagaggttgtttaggtgag

SEQ ID NO: 61430 - DNA, 20 bp, Artificial
  CRISPR gRNA sequence
ttaggtgaggcaggttttgt

SEQ ID NO: 61431 - DNA, 20 bp, Artificial
  CRISPR gRNA sequence
aatcccttttgagccaagag

SEQ ID NO: 61432 - DNA, 20 bp, Artificial
  CRISPR gRNA sequence
agagtgggggtgccttgagg

SEQ ID NO: 61433 - DNA, 20 bp, Artificial
  CRISPR gRNA sequence
gttgagtggatggtgcaggt

SEQ ID NO: 61434 - DNA, 20 bp, Artificial
  CRISPR gRNA sequence
tgggggctgccgagagacag

SEQ ID NO: 61435 - DNA, 20 bp, Artificial
  CRISPR gRNA sequence
cagagtggcacagaggcggg

SEQ ID NO: 61436 - DNA, 20 bp, Artificial
  CRISPR gRNA sequence
ggccccttcccctgtggggc

SEQ ID NO: 61437 - DNA, 20 bp, Artificial
  CRISPR gRNA sequence
ccttgaccatttaacaccct

SEQ ID NO: 61438 - DNA, 20 bp, Artificial
  CRISPR gRNA sequence
ggtctcacagcctctcatgg

SEQ ID NO: 61439 - DNA, 20 bp, Artificial
  CRISPR gRNA sequence
ggcagggagtggctgagctg

SEQ ID NO: 61440 - DNA, 20 bp, Artificial
  CRISPR gRNA sequence
gggagtggctgagctgctct

SEQ ID NO: 61441 - DNA, 20 bp, Artificial
  CRISPR gRNA sequence
ccatatacccctaggagggg

SEQ ID NO: 61442 - DNA, 20 bp, Artificial
  CRISPR gRNA sequence
aagcctgagttagaaaagcc

SEQ ID NO: 61443 - DNA, 20 bp, Artificial
  CRISPR gRNA sequence
caagacagagcctctctgac

SEQ ID NO: 61444 - DNA, 20 bp, Artificial
  CRISPR gRNA sequence
atcctgggaagcaagaccac

SEQ ID NO: 61445 - DNA, 20 bp, Artificial
  CRISPR gRNA sequence
tgaagagctaaactagtatt

SEQ ID NO: 61446 - DNA, 20 bp, Artificial
  CRISPR gRNA sequence
gtttactgcgaagacgggga

SEQ ID NO: 61447 - DNA, 20 bp, Artificial
  CRISPR gRNA sequence
ttccaaggggaaaacagggc

SEQ ID NO: 61448 - DNA, 20 bp, Artificial
  CRISPR gRNA sequence
gggggcggtggttactgaag

SEQ ID NO: 61449 - DNA, 20 bp, Artificial
  CRISPR gRNA sequence
aacctagtgtgccggacttg

SEQ ID NO: 61450 - DNA, 20 bp, Artificial
  CRISPR gRNA sequence
accccgagcgttccctcctc

SEQ ID NO: 61451 - DNA, 20 bp, Artificial
  CRISPR gRNA sequence
gtcccctctcaggaggatgt

SEQ ID NO: 61452 - DNA, 20 bp, Artificial
  CRISPR gRNA sequence
gctggaagcagagaggaagc

SEQ ID NO: 61453 - DNA, 20 bp, Artificial
  CRISPR gRNA sequence
ggcaaggagggcctggggtg

SEQ ID NO: 61454 - DNA, 20 bp, Artificial
  CRISPR gRNA sequence
tgctttcttagcaaacaagg

SEQ ID NO: 61455 - DNA, 20 bp, Artificial
  CRISPR gRNA sequence
gcacaccatcgacatttctc

SEQ ID NO: 61456 - DNA, 20 bp, Artificial
  CRISPR gRNA sequence
ggtaagaaattcttctttgt

SEQ ID NO: 61457 - DNA, 20 bp, Artificial
  CRISPR gRNA sequence
ttttgtattttttgtagaga

SEQ ID NO: 61458 - DNA, 20 bp, Artificial
  CRISPR gRNA sequence
tcccaagtaggtgcatgcca

SEQ ID NO: 61459 - DNA, 20 bp, Artificial
  CRISPR gRNA sequence
catcacgcttggctaatttt

SEQ ID NO: 61460 - DNA, 20 bp, Artificial
  CRISPR gRNA sequence
tgtcttggcctcccaaagtg

SEQ ID NO: 61461 - DNA, 20 bp, Artificial
  CRISPR gRNA sequence
cctcccaaagtgctgggatt

SEQ ID NO: 61462 - DNA, 20 bp, Artificial
  CRISPR gRNA sequence
gcggtgccctgagtgcctgg

SEQ ID NO: 61463 - DNA, 20 bp, Artificial
  CRISPR gRNA sequence
ccagtggcaactaggaagct

SEQ ID NO: 61464 - DNA, 20 bp, Artificial
  CRISPR gRNA sequence
aaccttcgcctcctgggttc

SEQ ID NO: 61465 - DNA, 20 bp, Artificial
  CRISPR gRNA sequence
tttggtatttttagcagaga

SEQ ID NO: 61466 - DNA, 20 bp, Artificial
  CRISPR gRNA sequence
caccttggcctcccaaaatg

SEQ ID NO: 61467 - DNA, 20 bp, Artificial
  CRISPR gRNA sequence
gtgagccaccgcgcctggcc

SEQ ID NO: 61468 - DNA, 20 bp, Artificial
  CRISPR gRNA sequence
cggtctgtgatggatctgag

SEQ ID NO: 61469 - DNA, 20 bp, Artificial
  CRISPR gRNA sequence
agggtctcctgtcaacttgt

SEQ ID NO: 61470 - DNA, 20 bp, Artificial
  CRISPR gRNA sequence
tgacctctcccctgggctcc

SEQ ID NO: 61471 - DNA, 20 bp, Artificial
  CRISPR gRNA sequence
cagaagtgcctgggaggagg

SEQ ID NO: 61472 - DNA, 20 bp, Artificial
  CRISPR gRNA sequence
ggtccattgcaggcaaactt

SEQ ID NO: 61473 - DNA, 20 bp, Artificial
  CRISPR gRNA sequence
atccttggcagccctgggca

SEQ ID NO: 61474 - DNA, 20 bp, Artificial
  CRISPR gRNA sequence
agtgaaaccttgaatcagaa

SEQ ID NO: 61475 - DNA, 20 bp, Artificial
  CRISPR gRNA sequence
aggggcaattttcatgcatt

SEQ ID NO: 61476 - DNA, 20 bp, Artificial
  CRISPR gRNA sequence
gaggaagagtcacaactttc

SEQ ID NO: 61477 - DNA, 20 bp, Artificial
  CRISPR gRNA sequence
aactttcaccagattctcca

SEQ ID NO: 61478 - DNA, 20 bp, Artificial
  CRISPR gRNA sequence
gaggtggaggtgaccgaggt

SEQ ID NO: 61479 - DNA, 20 bp, Artificial
  CRISPR gRNA sequence
gagccttgcagagctgctct

SEQ ID NO: 61480 - DNA, 20 bp, Artificial
  CRISPR gRNA sequence
actgaacagaggcgggaagg

SEQ ID NO: 61481 - DNA, 20 bp, Artificial
  CRISPR gRNA sequence
ccagacacagaggcagagaa

SEQ ID NO: 61482 - DNA, 20 bp, Artificial
  CRISPR gRNA sequence
gaaacaggcagagggacaga

SEQ ID NO: 61483 - DNA, 20 bp, Artificial
  CRISPR gRNA sequence
gctaaggggagtggggtctc

SEQ ID NO: 61484 - DNA, 20 bp, Artificial
  CRISPR gRNA sequence
ggagcatgtggggcctgggc

SEQ ID NO: 61485 - DNA, 20 bp, Artificial
  CRISPR gRNA sequence
caatcagaccttggtgccaa

SEQ ID NO: 61486 - DNA, 20 bp, Artificial
  CRISPR gRNA sequence
ggagactgtatgtgaactgc

SEQ ID NO: 61487 - DNA, 20 bp, Artificial
  CRISPR gRNA sequence
gtatgtgaactgccttagtt

SEQ ID NO: 61488 - DNA, 20 bp, Artificial
  CRISPR gRNA sequence
aatctcatcctcctcctcat

SEQ ID NO: 61489 - DNA, 20 bp, Artificial
  CRISPR gRNA sequence
cagtagtccagactctacag

SEQ ID NO: 61490 - DNA, 20 bp, Artificial
  CRISPR gRNA sequence
gctacaggccaggcaatccc

SEQ ID NO: 61491 - DNA, 20 bp, Artificial
  CRISPR gRNA sequence
accatgagaggcggaggtgg

SEQ ID NO: 61492 - DNA, 20 bp, Artificial
  CRISPR gRNA sequence
tcctgggcaaacatgaagat

SEQ ID NO: 61493 - DNA, 20 bp, Artificial
  CRISPR gRNA sequence
cacttcagcctcctgagtag

SEQ ID NO: 61494 - DNA, 20 bp, Artificial
  CRISPR gRNA sequence
cctcctgagtagctgggatt

SEQ ID NO: 61495 - DNA, 20 bp, Artificial
  CRISPR gRNA sequence
ggctcaggtgatcctcccac

SEQ ID NO: 61496 - DNA, 20 bp, Artificial
  CRISPR gRNA sequence
tgactcccctctgacttcct

SEQ ID NO: 61497 - DNA, 20 bp, Artificial
  CRISPR gRNA sequence
ctgtctgtgctcaaagtatg

SEQ ID NO: 61498 - DNA, 20 bp, Artificial
  CRISPR gRNA sequence
ccattttctagtgcaataat

SEQ ID NO: 61499 - DNA, 20 bp, Artificial
  CRISPR gRNA sequence
ataatttttgttttacaaac

SEQ ID NO: 61500 - DNA, 20 bp, Artificial
  CRISPR gRNA sequence
ttacaaacatgggattaaac

SEQ ID NO: 61501 - DNA, 20 bp, Artificial
  CRISPR gRNA sequence
tatagattctctttttaaac

SEQ ID NO: 61502 - DNA, 20 bp, Artificial
  CRISPR gRNA sequence
acttgatcattattgatggg

SEQ ID NO: 61503 - DNA, 20 bp, Artificial
  CRISPR gRNA sequence
aacctccgcctcccaggttc

SEQ ID NO: 61504 - DNA, 20 bp, Artificial
  CRISPR gRNA sequence
ggtgcacgccaccatgccca

SEQ ID NO: 61505 - DNA, 20 bp, Artificial
  CRISPR gRNA sequence
ttttgtatttttagtagaga

SEQ ID NO: 61506 - DNA, 20 bp, Artificial
  CRISPR gRNA sequence
tgcctcagcctcccaaagtg

SEQ ID NO: 61507 - DNA, 20 bp, Artificial
  CRISPR gRNA sequence
gcatgagccacagcacctgg

SEQ ID NO: 61508 - DNA, 20 bp, Artificial
  CRISPR gRNA sequence
ttctgccattgcatatcttg

SEQ ID NO: 61509 - DNA, 20 bp, Artificial
  CRISPR gRNA sequence
aagataatgagttaaaattt

SEQ ID NO: 61510 - DNA, 20 bp, Artificial
  CRISPR gRNA sequence
caggaggatcacatgagctc

SEQ ID NO: 61511 - DNA, 20 bp, Artificial
  CRISPR gRNA sequence
cactttgggagactaagaga

SEQ ID NO: 61512 - DNA, 20 bp, Artificial
  CRISPR gRNA sequence
agagagatggattgctgagc

SEQ ID NO: 61513 - DNA, 20 bp, Artificial
  CRISPR gRNA sequence
gatttggaggttacagtgag

SEQ ID NO: 61514 - DNA, 20 bp, Artificial
  CRISPR gRNA sequence
ctgtctctaaagaaatttct

SEQ ID NO: 61515 - DNA, 20 bp, Artificial
  CRISPR gRNA sequence
gtgaacatccctacagctaa

SEQ ID NO: 61516 - DNA, 20 bp, Artificial
  CRISPR gRNA sequence
gttcctggaagtgaacaggg

SEQ ID NO: 61517 - DNA, 20 bp, Artificial
  CRISPR gRNA sequence
ctaatctaccttttgggtga

SEQ ID NO: 61518 - DNA, 20 bp, Artificial
  CRISPR gRNA sequence
tttccctctcctcccttgag

SEQ ID NO: 61519 - DNA, 20 bp, Artificial
  CRISPR gRNA sequence
ccaccctactgggttgagaa

SEQ ID NO: 61520 - DNA, 20 bp, Artificial
  CRISPR gRNA sequence
caacggcgagacttacagaa

SEQ ID NO: 61521 - DNA, 20 bp, Artificial
  CRISPR gRNA sequence
gtccttggcctagtctccca

SEQ ID NO: 61522 - DNA, 20 bp, Artificial
  CRISPR gRNA sequence
cagggagctttgtcccactg

SEQ ID NO: 61523 - DNA, 20 bp, Artificial
  CRISPR gRNA sequence
ctgggcccagaaggaattcc

SEQ ID NO: 61524 - DNA, 20 bp, Artificial
  CRISPR gRNA sequence
ctagcccctccctgtggctc

SEQ ID NO: 61525 - DNA, 20 bp, Artificial
  CRISPR gRNA sequence
gtcccttgccaggggatctc

SEQ ID NO: 61526 - DNA, 20 bp, Artificial
  CRISPR gRNA sequence
ccatttggaaaataaagttg

SEQ ID NO: 61527 - DNA, 20 bp, Artificial
  CRISPR gRNA sequence
ccagcttgacagcaagaact

SEQ ID NO: 61528 - DNA, 20 bp, Artificial
  CRISPR gRNA sequence
gtgttttcacctctctgacc

SEQ ID NO: 61529 - DNA, 20 bp, Artificial
  CRISPR gRNA sequence
actataccagactctgtaca

SEQ ID NO: 61530 - DNA, 20 bp, Artificial
  CRISPR gRNA sequence
tacaaaaggctttgtacata

SEQ ID NO: 61531 - DNA, 20 bp, Artificial
  CRISPR gRNA sequence
aatgctactaagtgacagag

SEQ ID NO: 61532 - DNA, 20 bp, Artificial
  CRISPR gRNA sequence
tttacacatgtaagggtgct

SEQ ID NO: 61533 - DNA, 20 bp, Artificial
  CRISPR gRNA sequence
cagtggatcagcacccttac

SEQ ID NO: 61534 - DNA, 20 bp, Artificial
  CRISPR gRNA sequence
cggtggggtggacaactcac

SEQ ID NO: 61535 - DNA, 20 bp, Artificial
  CRISPR gRNA sequence
ggcacttgctcgagggagaa

SEQ ID NO: 61536 - DNA, 20 bp, Artificial
  CRISPR gRNA sequence
ctttatgctgcaagttacat

SEQ ID NO: 61537 - DNA, 20 bp, Artificial
  CRISPR gRNA sequence
attgctttttgtgataaact

SEQ ID NO: 61538 - DNA, 20 bp, Artificial
  CRISPR gRNA sequence
gacctagtctgggagtcggg

SEQ ID NO: 61539 - DNA, 20 bp, Artificial
  CRISPR gRNA sequence
ggagtcggggatggcttatt

SEQ ID NO: 61540 - DNA, 20 bp, Artificial
  CRISPR gRNA sequence
cctgaaagagagccagtgtg

SEQ ID NO: 61541 - DNA, 20 bp, Artificial
  CRISPR gRNA sequence
gagagccagtgtgtctggat

SEQ ID NO: 61542 - DNA, 20 bp, Artificial
  CRISPR gRNA sequence
agtggaaggatggggtcaga

SEQ ID NO: 61543 - DNA, 20 bp, Artificial
  CRISPR gRNA sequence
ggcagggttctggaccacct

SEQ ID NO: 61544 - DNA, 20 bp, Artificial
  CRISPR gRNA sequence
accacctgggagtttagaat

SEQ ID NO: 61545 - DNA, 20 bp, Artificial
  CRISPR gRNA sequence
agaaaggtggaggaaaagag

SEQ ID NO: 61546 - DNA, 20 bp, Artificial
  CRISPR gRNA sequence
cgtaaccaggcgggtgatgg

SEQ ID NO: 61547 - DNA, 20 bp, Artificial
  CRISPR gRNA sequence
ggtgaggcaggtagaagtgt

SEQ ID NO: 61548 - DNA, 20 bp, Artificial
  CRISPR gRNA sequence
atctgccttcatgttcactt

SEQ ID NO: 61549 - DNA, 20 bp, Artificial
  CRISPR gRNA sequence
catccccaagcactactctt

SEQ ID NO: 61550 - DNA, 20 bp, Artificial
  CRISPR gRNA sequence
tggggggagccctgagggac

SEQ ID NO: 61551 - DNA, 20 bp, Artificial
  CRISPR gRNA sequence
gaaggcagacccaggtgtgg

SEQ ID NO: 61552 - DNA, 20 bp, Artificial
  CRISPR gRNA sequence
gaggctgcgagccagactgt

SEQ ID NO: 61553 - DNA, 20 bp, Artificial
  CRISPR gRNA sequence
tcctacctgtgtggccttga

SEQ ID NO: 61554 - DNA, 20 bp, Artificial
  CRISPR gRNA sequence
cttgagcaagtttatctttc

SEQ ID NO: 61555 - DNA, 20 bp, Artificial
  CRISPR gRNA sequence
ctataaaatgaggacagtaa

SEQ ID NO: 61556 - DNA, 20 bp, Artificial
  CRISPR gRNA sequence
tagtagcagctgttacaatg

SEQ ID NO: 61557 - DNA, 20 bp, Artificial
  CRISPR gRNA sequence
tcctttcctggctcctacgc

SEQ ID NO: 61558 - DNA, 20 bp, Artificial
  CRISPR gRNA sequence
agcccctactccatggcccc

SEQ ID NO: 61559 - DNA, 20 bp, Artificial
  CRISPR gRNA sequence
gggacttaacctgtctgaga

SEQ ID NO: 61560 - DNA, 20 bp, Artificial
  CRISPR gRNA sequence
gaataataatgtgtacttca

SEQ ID NO: 61561 - DNA, 20 bp, Artificial
  CRISPR gRNA sequence
taatcctttccctgtccctc

SEQ ID NO: 61562 - DNA, 20 bp, Artificial
  CRISPR gRNA sequence
ccctccaaggtacctgagcg

SEQ ID NO: 61563 - DNA, 20 bp, Artificial
  CRISPR gRNA sequence
tggtggatcaagcctctttc

SEQ ID NO: 61564 - DNA, 20 bp, Artificial
  CRISPR gRNA sequence
agtgagtcggtaacaaagga

SEQ ID NO: 61565 - DNA, 20 bp, Artificial
  CRISPR gRNA sequence
actgcttgcagatgctcaag

SEQ ID NO: 61566 - DNA, 20 bp, Artificial
  CRISPR gRNA sequence
tcagcagagcaggaggggca

SEQ ID NO: 61567 - DNA, 20 bp, Artificial
  CRISPR gRNA sequence
catctagcacataggtacct

SEQ ID NO: 61568 - DNA, 20 bp, Artificial
  CRISPR gRNA sequence
ggaagctaggacatcatgag

SEQ ID NO: 61569 - DNA, 20 bp, Artificial
  CRISPR gRNA sequence
gagccaggtttcacagactt

SEQ ID NO: 61570 - DNA, 20 bp, Artificial
  CRISPR gRNA sequence
ggctcaagtgatcctcccac

SEQ ID NO: 61571 - DNA, 20 bp, Artificial
  CRISPR gRNA sequence
gcccaggctggtcttgaact

SEQ ID NO: 61572 - DNA, 20 bp, Artificial
  CRISPR gRNA sequence
agacatgagccaccatgcca

SEQ ID NO: 61573 - DNA, 20 bp, Artificial
  CRISPR gRNA sequence
gtggctatcctactgagcat

SEQ ID NO: 61574 - DNA, 20 bp, Artificial
  CRISPR gRNA sequence
ggtcttgaacacctggaatc

SEQ ID NO: 61575 - DNA, 20 bp, Artificial
  CRISPR gRNA sequence
cacctggaatcaagagattc

SEQ ID NO: 61576 - DNA, 20 bp, Artificial
  CRISPR gRNA sequence
gtgcttggcgttccaaagtg

SEQ ID NO: 61577 - DNA, 20 bp, Artificial
  CRISPR gRNA sequence
atcgagatccagagaaggga

SEQ ID NO: 61578 - DNA, 20 bp, Artificial
  CRISPR gRNA sequence
ccctgtcttttttcagttgt

SEQ ID NO: 61579 - DNA, 20 bp, Artificial
  CRISPR gRNA sequence
ttcagttgtaagggcttttc

SEQ ID NO: 61580 - DNA, 20 bp, Artificial
  CRISPR gRNA sequence
agtatctttatgttctcccc

SEQ ID NO: 61581 - DNA, 20 bp, Artificial
  CRISPR gRNA sequence
ccttcctctgagtcttctgg

SEQ ID NO: 61582 - DNA, 20 bp, Artificial
  CRISPR gRNA sequence
ccctcaactgcctgagccca

SEQ ID NO: 61583 - DNA, 20 bp, Artificial
  CRISPR gRNA sequence
tggccccaggcccaccgcct

SEQ ID NO: 61584 - DNA, 20 bp, Artificial
  CRISPR gRNA sequence
atgttcaaacatccagataa

SEQ ID NO: 61585 - DNA, 20 bp, Artificial
  CRISPR gRNA sequence
aaacataacggaactagcaa

SEQ ID NO: 61586 - DNA, 20 bp, Artificial
  CRISPR gRNA sequence
tttaaatcaggcatgtgaaa

SEQ ID NO: 61587 - DNA, 20 bp, Artificial
  CRISPR gRNA sequence
atgtgaaatactgattatgt

SEQ ID NO: 61588 - DNA, 20 bp, Artificial
  CRISPR gRNA sequence
ttgcttgatgaatcctgcaa

SEQ ID NO: 61589 - DNA, 20 bp, Artificial
  CRISPR gRNA sequence
taataaaaattaagaatgtt

SEQ ID NO: 61590 - DNA, 20 bp, Artificial
  CRISPR gRNA sequence
aattattcctttggctatgc

SEQ ID NO: 61591 - DNA, 20 bp, Artificial
  CRISPR gRNA sequence
gagtaaaacagtagggtatg

SEQ ID NO: 61592 - DNA, 20 bp, Artificial
  CRISPR gRNA sequence
atgctgttgctgctcaggct

SEQ ID NO: 61593 - DNA, 20 bp, Artificial
  CRISPR gRNA sequence
gcagtggaaagatcacttac

SEQ ID NO: 61594 - DNA, 20 bp, Artificial
  CRISPR gRNA sequence
aaagagctgatggcctgctc

SEQ ID NO: 61595 - DNA, 20 bp, Artificial
  CRISPR gRNA sequence
ggtctattctgttcctatgg

SEQ ID NO: 61596 - DNA, 20 bp, Artificial
  CRISPR gRNA sequence
gagacctagcaccctgctcc

SEQ ID NO: 61597 - DNA, 20 bp, Artificial
  CRISPR gRNA sequence
ctagactgggacgctgcaga

SEQ ID NO: 61598 - DNA, 20 bp, Artificial
  CRISPR gRNA sequence
agatgagttgaggggagtga

SEQ ID NO: 61599 - DNA, 20 bp, Artificial
  CRISPR gRNA sequence
caagttcagtacttctgaac

SEQ ID NO: 61600 - DNA, 20 bp, Artificial
  CRISPR gRNA sequence
gcaggagtatatttgtgcat

SEQ ID NO: 61601 - DNA, 20 bp, Artificial
  CRISPR gRNA sequence
tgaacaaatgtgaaggtgtg

SEQ ID NO: 61602 - DNA, 20 bp, Artificial
  CRISPR gRNA sequence
tagttatgtgtacccacagt

SEQ ID NO: 61603 - DNA, 20 bp, Artificial
  CRISPR gRNA sequence
acgcactgctatcccttctc

SEQ ID NO: 61604 - DNA, 20 bp, Artificial
  CRISPR gRNA sequence
ctctggggactctgggagcc

SEQ ID NO: 61605 - DNA, 20 bp, Artificial
  CRISPR gRNA sequence
ttcagctgtggacagagagg

SEQ ID NO: 61606 - DNA, 20 bp, Artificial
  CRISPR gRNA sequence
caggtggctgatgcctcggg

SEQ ID NO: 61607 - DNA, 20 bp, Artificial
  CRISPR gRNA sequence
gggccaggaatctgccttgt

SEQ ID NO: 61608 - DNA, 20 bp, Artificial
  CRISPR gRNA sequence
attgtcggcaagctcctgga

SEQ ID NO: 61609 - DNA, 20 bp, Artificial
  CRISPR gRNA sequence
tcgccatcccctcagagaga

SEQ ID NO: 61610 - DNA, 20 bp, Artificial
  CRISPR gRNA sequence
aatagagctatcatgaggaa

SEQ ID NO: 61611 - DNA, 20 bp, Artificial
  CRISPR gRNA sequence
tgtgagtggaagggatgtat

SEQ ID NO: 61612 - DNA, 20 bp, Artificial
  CRISPR gRNA sequence
gagcacagatatacccatga

SEQ ID NO: 61613 - DNA, 20 bp, Artificial
  CRISPR gRNA sequence
acgtagctttgactgtgcag

SEQ ID NO: 61614 - DNA, 20 bp, Artificial
  CRISPR gRNA sequence
taacctactgtatttgggga

SEQ ID NO: 61615 - DNA, 20 bp, Artificial
  CRISPR gRNA sequence
gtgctaggcactgtgctaca

SEQ ID NO: 61616 - DNA, 20 bp, Artificial
  CRISPR gRNA sequence
ccatatgagttggctattgt

SEQ ID NO: 61617 - DNA, 20 bp, Artificial
  CRISPR gRNA sequence
tgagttggctattgttacag

SEQ ID NO: 61618 - DNA, 20 bp, Artificial
  CRISPR gRNA sequence
ctctatagacagcctggatc

SEQ ID NO: 61619 - DNA, 20 bp, Artificial
  CRISPR gRNA sequence
cctggatctgtggtttcagc

SEQ ID NO: 61620 - DNA, 20 bp, Artificial
  CRISPR gRNA sequence
ccagaggtcctgtcaaggta

SEQ ID NO: 61621 - DNA, 20 bp, Artificial
  CRISPR gRNA sequence
aggccattatgttctgatat

SEQ ID NO: 61622 - DNA, 20 bp, Artificial
  CRISPR gRNA sequence
tcttatccagtcctcttggc

SEQ ID NO: 61623 - DNA, 20 bp, Artificial
  CRISPR gRNA sequence
cctcctccactcttactcac

SEQ ID NO: 61624 - DNA, 20 bp, Artificial
  CRISPR gRNA sequence
gtggaagggcagttgatagg

SEQ ID NO: 61625 - DNA, 20 bp, Artificial
  CRISPR gRNA sequence
gctctacaacctttggccct

SEQ ID NO: 61626 - DNA, 20 bp, Artificial
  CRISPR gRNA sequence
tcaacacctgcactacagca

SEQ ID NO: 61627 - DNA, 20 bp, Artificial
  CRISPR gRNA sequence
aggtggtctgagaggcccag

SEQ ID NO: 61628 - DNA, 20 bp, Artificial
  CRISPR gRNA sequence
gcacagtgcgggcaccgcac

SEQ ID NO: 61629 - DNA, 20 bp, Artificial
  CRISPR gRNA sequence
gcgatggctgggcgctgaag

SEQ ID NO: 61630 - DNA, 20 bp, Artificial
  CRISPR gRNA sequence
cctctgcaggcaggcaggca

SEQ ID NO: 61631 - DNA, 20 bp, Artificial
  CRISPR gRNA sequence
tactggaagacagtgtcgtg

SEQ ID NO: 61632 - DNA, 20 bp, Artificial
  CRISPR gRNA sequence
taaggatgctgtggcccggc

SEQ ID NO: 61633 - DNA, 20 bp, Artificial
  CRISPR gRNA sequence
ggcgtggggctgccctgacc

SEQ ID NO: 61634 - DNA, 20 bp, Artificial
  CRISPR gRNA sequence
ctccagtgcagtggcacgat

SEQ ID NO: 61635 - DNA, 20 bp, Artificial
  CRISPR gRNA sequence
ttttgtatttttagtagaga

SEQ ID NO: 61636 - DNA, 20 bp, Artificial
  CRISPR gRNA sequence
tgcctcagccctccaaagtg

SEQ ID NO: 61637 - DNA, 20 bp, Artificial
  CRISPR gRNA sequence
tgacccagggaaagggctgg

SEQ ID NO: 61638 - DNA, 20 bp, Artificial
  CRISPR gRNA sequence
gcccccagggcctctgtctt

SEQ ID NO: 61639 - DNA, 20 bp, Artificial
  CRISPR gRNA sequence
cagcgaagctgagacctgta

SEQ ID NO: 61640 - DNA, 20 bp, Artificial
  CRISPR gRNA sequence
acaagagtcactgggcctct

SEQ ID NO: 61641 - DNA, 20 bp, Artificial
  CRISPR gRNA sequence
gcccccaggcaaccccatct

SEQ ID NO: 61642 - DNA, 20 bp, Artificial
  CRISPR gRNA sequence
cacactggtacccacctagc

SEQ ID NO: 61643 - DNA, 20 bp, Artificial
  CRISPR gRNA sequence
cacctagctgctgcttcttg

SEQ ID NO: 61644 - DNA, 20 bp, Artificial
  CRISPR gRNA sequence
aggacccacagctctgatgt

SEQ ID NO: 61645 - DNA, 20 bp, Artificial
  CRISPR gRNA sequence
caggcagaggctgggtcaac

SEQ ID NO: 61646 - DNA, 20 bp, Artificial
  CRISPR gRNA sequence
tcatataagtgaagttccca

SEQ ID NO: 61647 - DNA, 20 bp, Artificial
  CRISPR gRNA sequence
ctgcaacctccctcctctgt

SEQ ID NO: 61648 - DNA, 20 bp, Artificial
  CRISPR gRNA sequence
cctctgttagggttttatca

SEQ ID NO: 61649 - DNA, 20 bp, Artificial
  CRISPR gRNA sequence
cacatttcctcacttccctt

SEQ ID NO: 61650 - DNA, 20 bp, Artificial
  CRISPR gRNA sequence
tctggagtcttgtctcattg

SEQ ID NO: 61651 - DNA, 20 bp, Artificial
  CRISPR gRNA sequence
tcactttaatgcctttctgg

SEQ ID NO: 61652 - DNA, 20 bp, Artificial
  CRISPR gRNA sequence
cctattggaccagggacttg

SEQ ID NO: 61653 - DNA, 20 bp, Artificial
  CRISPR gRNA sequence
tggaccagggacttggacag

SEQ ID NO: 61654 - DNA, 20 bp, Artificial
  CRISPR gRNA sequence
tggggagctgaggttatagg

SEQ ID NO: 61655 - DNA, 20 bp, Artificial
  CRISPR gRNA sequence
tgcacagcgataagtaaagt

SEQ ID NO: 61656 - DNA, 20 bp, Artificial
  CRISPR gRNA sequence
acaagtcgggagggggtggt

SEQ ID NO: 61657 - DNA, 20 bp, Artificial
  CRISPR gRNA sequence
ttgcgggcaggaaagtgaga

SEQ ID NO: 61658 - DNA, 20 bp, Artificial
  CRISPR gRNA sequence
tggggctgggagacacagtt

SEQ ID NO: 61659 - DNA, 20 bp, Artificial
  CRISPR gRNA sequence
ccacagcctccacagcctcc

SEQ ID NO: 61660 - DNA, 20 bp, Artificial
  CRISPR gRNA sequence
cagtcctcaccatggtggag

SEQ ID NO: 61661 - DNA, 20 bp, Artificial
  CRISPR gRNA sequence
atggtggagctgagattcag

SEQ ID NO: 61662 - DNA, 20 bp, Artificial
  CRISPR gRNA sequence
gttgtggagaaaatgtggtg

SEQ ID NO: 61663 - DNA, 20 bp, Artificial
  CRISPR gRNA sequence
gtgtgtatatgcaagtgcat

SEQ ID NO: 61664 - DNA, 20 bp, Artificial
  CRISPR gRNA sequence
acacttgcatgcatgtgtac

SEQ ID NO: 61665 - DNA, 20 bp, Artificial
  CRISPR gRNA sequence
cgctgttgcccctcaatgtc

SEQ ID NO: 61666 - DNA, 20 bp, Artificial
  CRISPR gRNA sequence
gggcagaaggcgctccccgt

SEQ ID NO: 61667 - DNA, 20 bp, Artificial
  CRISPR gRNA sequence
gagttggatgctgtagtgag

SEQ ID NO: 61668 - DNA, 20 bp, Artificial
  CRISPR gRNA sequence
tctcgggcattatgggctat

SEQ ID NO: 61669 - DNA, 20 bp, Artificial
  CRISPR gRNA sequence
ggaggggtcctccaggcccc

SEQ ID NO: 61670 - DNA, 20 bp, Artificial
  CRISPR gRNA sequence
catgacgcaggtactggccc

SEQ ID NO: 61671 - DNA, 20 bp, Artificial
  CRISPR gRNA sequence
aggtgtccgaaccctggaca

SEQ ID NO: 61672 - DNA, 20 bp, Artificial
  CRISPR gRNA sequence
aggacaagcaaattgggggc

SEQ ID NO: 61673 - DNA, 20 bp, Artificial
  CRISPR gRNA sequence
gggggacaggggagctggga

SEQ ID NO: 61674 - DNA, 20 bp, Artificial
  CRISPR gRNA sequence
gaaggtgagttgggggataa

SEQ ID NO: 61675 - DNA, 20 bp, Artificial
  CRISPR gRNA sequence
gggatcagctccagagatca

SEQ ID NO: 61676 - DNA, 20 bp, Artificial
  CRISPR gRNA sequence
aatattctctggtcatctag

SEQ ID NO: 61677 - DNA, 20 bp, Artificial
  CRISPR gRNA sequence
ttctttgctccttcctgttg

SEQ ID NO: 61678 - DNA, 20 bp, Artificial
  CRISPR gRNA sequence
ttccattctggttaagccac

SEQ ID NO: 61679 - DNA, 20 bp, Artificial
  CRISPR gRNA sequence
ctggttaagccactgttgtt

SEQ ID NO: 61680 - DNA, 20 bp, Artificial
  CRISPR gRNA sequence
agcctccgcctcccgggttc

SEQ ID NO: 61681 - DNA, 20 bp, Artificial
  CRISPR gRNA sequence
tgcctcagcctcccgagtag

SEQ ID NO: 61682 - DNA, 20 bp, Artificial
  CRISPR gRNA sequence
tttgtaatttttagtacaga

SEQ ID NO: 61683 - DNA, 20 bp, Artificial
  CRISPR gRNA sequence
cacctcggcctcccaaagtg

SEQ ID NO: 61684 - DNA, 20 bp, Artificial
  CRISPR gRNA sequence
gcctaaataatgtgcagttc

SEQ ID NO: 61685 - DNA, 20 bp, Artificial
  CRISPR gRNA sequence
taattgcaaagatgctcact

SEQ ID NO: 61686 - DNA, 20 bp, Artificial
  CRISPR gRNA sequence
caacctaaatgtccaacagt

SEQ ID NO: 61687 - DNA, 20 bp, Artificial
  CRISPR gRNA sequence
ctgtgtattaggcactgtct

SEQ ID NO: 61688 - DNA, 20 bp, Artificial
  CRISPR gRNA sequence
gaggccagtactatgcgtcc

SEQ ID NO: 61689 - DNA, 20 bp, Artificial
  CRISPR gRNA sequence
gacagaggcaggaggagaac

SEQ ID NO: 61690 - DNA, 20 bp, Artificial
  CRISPR gRNA sequence
gcaccagacaaggctaagtc

SEQ ID NO: 61691 - DNA, 20 bp, Artificial
  CRISPR gRNA sequence
aagtaagtagtgcctggatg

SEQ ID NO: 61692 - DNA, 20 bp, Artificial
  CRISPR gRNA sequence
ctggatggtgtgatttctgg

SEQ ID NO: 61693 - DNA, 20 bp, Artificial
  CRISPR gRNA sequence
cagccagtctaacacaatac

SEQ ID NO: 61694 - DNA, 20 bp, Artificial
  CRISPR gRNA sequence
catggcatcattatcagtca

SEQ ID NO: 61695 - DNA, 20 bp, Artificial
  CRISPR gRNA sequence
ctcctctttctaggcctttg

SEQ ID NO: 61696 - DNA, 20 bp, Artificial
  CRISPR gRNA sequence
aaattgggcacagccatgaa

SEQ ID NO: 61697 - DNA, 20 bp, Artificial
  CRISPR gRNA sequence
aagactcatgtcatgcctgt

SEQ ID NO: 61698 - DNA, 20 bp, Artificial
  CRISPR gRNA sequence
gtcataccatctctaaaatg

SEQ ID NO: 61699 - DNA, 20 bp, Artificial
  CRISPR gRNA sequence
agatgctgtctcaaaactct

SEQ ID NO: 61700 - DNA, 20 bp, Artificial
  CRISPR gRNA sequence
atgctgaatgatggtcaagg

SEQ ID NO: 61701 - DNA, 20 bp, Artificial
  CRISPR gRNA sequence
tgttgggggcagcccagtaa

SEQ ID NO: 61702 - DNA, 20 bp, Artificial
  CRISPR gRNA sequence
ctgggctatgtgtgccttga

SEQ ID NO: 61703 - DNA, 20 bp, Artificial
  CRISPR gRNA sequence
tgccttgagctggattgaca

SEQ ID NO: 61704 - DNA, 20 bp, Artificial
  CRISPR gRNA sequence
tcctaaggggagagaagaca

SEQ ID NO: 61705 - DNA, 20 bp, Artificial
  CRISPR gRNA sequence
cccttgaccatcattcagca

SEQ ID NO: 61706 - DNA, 20 bp, Artificial
  CRISPR gRNA sequence
tgagaatgtaatgatcagac

SEQ ID NO: 61707 - DNA, 20 bp, Artificial
  CRISPR gRNA sequence
caatatttctggtccctgga

SEQ ID NO: 61708 - DNA, 20 bp, Artificial
  CRISPR gRNA sequence
ctggtccctggagtagaaaa

SEQ ID NO: 61709 - DNA, 20 bp, Artificial
  CRISPR gRNA sequence
agtgtaatcccaccaaaggc

SEQ ID NO: 61710 - DNA, 20 bp, Artificial
  CRISPR gRNA sequence
ccaccaaaggcctagaaaga

SEQ ID NO: 61711 - DNA, 20 bp, Artificial
  CRISPR gRNA sequence
acagccctaatgcctaccac

SEQ ID NO: 61712 - DNA, 20 bp, Artificial
  CRISPR gRNA sequence
attgtgttagactggctgga

SEQ ID NO: 61713 - DNA, 20 bp, Artificial
  CRISPR gRNA sequence
ctggaggagaaatttgagga

SEQ ID NO: 61714 - DNA, 20 bp, Artificial
  CRISPR gRNA sequence
tttgaggatgagaaacatca

SEQ ID NO: 61715 - DNA, 20 bp, Artificial
  CRISPR gRNA sequence
aaatttactggcctgggagg

SEQ ID NO: 61716 - DNA, 20 bp, Artificial
  CRISPR gRNA sequence
attgctattagcccagttga

SEQ ID NO: 61717 - DNA, 20 bp, Artificial
  CRISPR gRNA sequence
ctatgaggaaggacatagta

SEQ ID NO: 61718 - DNA, 20 bp, Artificial
  CRISPR gRNA sequence
cgtttgccaaggttagagtc

SEQ ID NO: 61719 - DNA, 20 bp, Artificial
  CRISPR gRNA sequence
ctactcgggaggctgaggca

SEQ ID NO: 61720 - DNA, 20 bp, Artificial
  CRISPR gRNA sequence
aagagttccagttcagaagg

SEQ ID NO: 61721 - DNA, 20 bp, Artificial
  CRISPR gRNA sequence
attagagttcactgtgagta

SEQ ID NO: 61722 - DNA, 20 bp, Artificial
  CRISPR gRNA sequence
actaaacaacagtggcttaa

SEQ ID NO: 61723 - DNA, 20 bp, Artificial
  CRISPR gRNA sequence
agacaacaggaaggagcaaa

SEQ ID NO: 61724 - DNA, 20 bp, Artificial
  CRISPR gRNA sequence
ataatctattctagatgacc

SEQ ID NO: 61725 - DNA, 20 bp, Artificial
  CRISPR gRNA sequence
gcataaatggttcatggaaa

SEQ ID NO: 61726 - DNA, 20 bp, Artificial
  CRISPR gRNA sequence
tggagtagggagggggtgca

SEQ ID NO: 61727 - DNA, 20 bp, Artificial
  CRISPR gRNA sequence
ttcttgactgcttgacttcc

SEQ ID NO: 61728 - DNA, 20 bp, Artificial
  CRISPR gRNA sequence
tgaggctgctcaccaaagac

SEQ ID NO: 61729 - DNA, 20 bp, Artificial
  CRISPR gRNA sequence
ttgtttgttttgcaacatgg

SEQ ID NO: 61730 - DNA, 20 bp, Artificial
  CRISPR gRNA sequence
aggggcaacagcgtttttgg

SEQ ID NO: 61731 - DNA, 20 bp, Artificial
  CRISPR gRNA sequence
tgtgcatggcagtaatgcca

SEQ ID NO: 61732 - DNA, 20 bp, Artificial
  CRISPR gRNA sequence
tcttcctttctcaaactctt

SEQ ID NO: 61733 - DNA, 20 bp, Artificial
  CRISPR gRNA sequence
ccatacaatgagacaagact

SEQ ID NO: 61734 - DNA, 20 bp, Artificial
  CRISPR gRNA sequence
aagtgaggaaatgtgggtga

SEQ ID NO: 61735 - DNA, 20 bp, Artificial
  CRISPR gRNA sequence
tcttgtctcgcaagtttcca

SEQ ID NO: 61736 - DNA, 20 bp, Artificial
  CRISPR gRNA sequence
gggaggggtgaggaggcctg

SEQ ID NO: 61737 - DNA, 20 bp, Artificial
  CRISPR gRNA sequence
ggcaggccaggccagtgaga

SEQ ID NO: 61738 - DNA, 20 bp, Artificial
  CRISPR gRNA sequence
ctctcattcttgaccagttc

SEQ ID NO: 61739 - DNA, 20 bp, Artificial
  CRISPR gRNA sequence
gcactggggatccagatatt

SEQ ID NO: 61740 - DNA, 20 bp, Artificial
  CRISPR gRNA sequence
gagactctgtctctgggaaa

SEQ ID NO: 61741 - DNA, 20 bp, Artificial
  CRISPR gRNA sequence
cttacaccacgtgtactatt

SEQ ID NO: 61742 - DNA, 20 bp, Artificial
  CRISPR gRNA sequence
gctttgatgggccacgggtg

SEQ ID NO: 61743 - DNA, 20 bp, Artificial
  CRISPR gRNA sequence
ctggtaggctgtgggcagat

SEQ ID NO: 61744 - DNA, 20 bp, Artificial
  CRISPR gRNA sequence
cctctgccaagaggactgga

SEQ ID NO: 61745 - DNA, 20 bp, Artificial
  CRISPR gRNA sequence
gccaactcatatggtcattg

SEQ ID NO: 61746 - DNA, 20 bp, Artificial
  CRISPR gRNA sequence
gctcagtgtgcatattagct

SEQ ID NO: 61747 - DNA, 20 bp, Artificial
  CRISPR gRNA sequence
aaaggctaggctgcagtaac

SEQ ID NO: 61748 - DNA, 20 bp, Artificial
  CRISPR gRNA sequence
aatacagtaggttaaataat

SEQ ID NO: 61749 - DNA, 20 bp, Artificial
  CRISPR gRNA sequence
tctattgctgtagatgaagt

SEQ ID NO: 61750 - DNA, 20 bp, Artificial
  CRISPR gRNA sequence
cagaagtacacaggcatatg

SEQ ID NO: 61751 - DNA, 20 bp, Artificial
  CRISPR gRNA sequence
gcaaaaacttccccatagga

SEQ ID NO: 61752 - DNA, 20 bp, Artificial
  CRISPR gRNA sequence
cccataggaacagaatagac

SEQ ID NO: 61753 - DNA, 20 bp, Artificial
  CRISPR gRNA sequence
gatcttggccttatgggcct

SEQ ID NO: 61754 - DNA, 20 bp, Artificial
  CRISPR gRNA sequence
gatctccatctcaaatttaa

SEQ ID NO: 61755 - DNA, 20 bp, Artificial
  CRISPR gRNA sequence
tggatgtttgaacatttggg

SEQ ID NO: 61756 - DNA, 20 bp, Artificial
  CRISPR gRNA sequence
cctacatcttagggttgttc

SEQ ID NO: 61757 - DNA, 20 bp, Artificial
  CRISPR gRNA sequence
ttggccagtcttggatgggc

SEQ ID NO: 61758 - DNA, 20 bp, Artificial
  CRISPR gRNA sequence
gcactttggaacgccaagca

SEQ ID NO: 61759 - DNA, 20 bp, Artificial
  CRISPR gRNA sequence
gccaggacatttccatcatt

SEQ ID NO: 61760 - DNA, 20 bp, Artificial
  CRISPR gRNA sequence
gctagatgttgtcatccgtt

SEQ ID NO: 61761 - DNA, 20 bp, Artificial
  CRISPR gRNA sequence
gttgtcatccgttttagaaa

SEQ ID NO: 61762 - DNA, 20 bp, Artificial
  CRISPR gRNA sequence
attacctcactgtaattcct

SEQ ID NO: 61763 - DNA, 20 bp, Artificial
  CRISPR gRNA sequence
ggaggggcatgctgcctcat

SEQ ID NO: 61764 - DNA, 20 bp, Artificial
  CRISPR gRNA sequence
atagaggaggaagttaagct

SEQ ID NO: 61765 - DNA, 20 bp, Artificial
  CRISPR gRNA sequence
ctcttgctgagatctgccaa

SEQ ID NO: 61766 - DNA, 20 bp, Artificial
  CRISPR gRNA sequence
taaccttctcttttcgggat

SEQ ID NO: 61767 - DNA, 20 bp, Artificial
  CRISPR gRNA sequence
gtcccattgggagaaccagg

SEQ ID NO: 61768 - DNA, 20 bp, Artificial
  CRISPR gRNA sequence
gagtctggtatagtcagggc

SEQ ID NO: 61769 - DNA, 20 bp, Artificial
  CRISPR gRNA sequence
aatggtggttattttacaga

SEQ ID NO: 61770 - DNA, 20 bp, Artificial
  CRISPR gRNA sequence
ttttggcttactcacacgca

SEQ ID NO: 61771 - DNA, 20 bp, Artificial
  CRISPR gRNA sequence
ttggttataataggaaaaaa

SEQ ID NO: 61772 - DNA, 20 bp, Artificial
  CRISPR gRNA sequence
agagagaactcagtggaacc

SEQ ID NO: 61773 - DNA, 20 bp, Artificial
  CRISPR gRNA sequence
gggagttattaagtaaacat

SEQ ID NO: 61774 - DNA, 20 bp, Artificial
  CRISPR gRNA sequence
gcttttcaagatatgcaatg

SEQ ID NO: 61775 - DNA, 20 bp, Artificial
  CRISPR gRNA sequence
ttcaagatatgcaatggcag

SEQ ID NO: 61776 - DNA, 20 bp, Artificial
  CRISPR gRNA sequence
ctactcaggaggctgaggca

SEQ ID NO: 61777 - DNA, 20 bp, Artificial
  CRISPR gRNA sequence
taaaaaactaatgtttaaaa

SEQ ID NO: 61778 - DNA, 20 bp, Artificial
  CRISPR gRNA sequence
gtaaaacaaaaattattgca

SEQ ID NO: 61779 - DNA, 20 bp, Artificial
  CRISPR gRNA sequence
ctggggctaaaagagagaac

SEQ ID NO: 61780 - DNA, 20 bp, Artificial
  CRISPR gRNA sequence
acatttgtgaaatatctgtg

SEQ ID NO: 61781 - DNA, 20 bp, Artificial
  CRISPR gRNA sequence
agactgagaccttctctcaa

SEQ ID NO: 61782 - DNA, 20 bp, Artificial
  CRISPR gRNA sequence
ggctgacacattgtggcctc

SEQ ID NO: 61783 - DNA, 20 bp, Artificial
  CRISPR gRNA sequence
ctgttctttccctgctgaag

SEQ ID NO: 61784 - DNA, 20 bp, Artificial
  CRISPR gRNA sequence
gctgaagtcagaaacccctt

SEQ ID NO: 61785 - DNA, 20 bp, Artificial
  CRISPR gRNA sequence
ccctcagaggtccacgaacc

SEQ ID NO: 61786 - DNA, 20 bp, Artificial
  CRISPR gRNA sequence
agtgtagcattaaatagtaa

SEQ ID NO: 61787 - DNA, 20 bp, Artificial
  CRISPR gRNA sequence
caagttgacaggagaccctg

SEQ ID NO: 61788 - DNA, 20 bp, Artificial
  CRISPR gRNA sequence
ccacccctcccttatcaggt

SEQ ID NO: 61789 - DNA, 20 bp, Artificial
  CRISPR gRNA sequence
aaaaggaggcccagctccag

SEQ ID NO: 61790 - DNA, 20 bp, Artificial
  CRISPR gRNA sequence
tggtatgctgcagagacttt

SEQ ID NO: 61791 - DNA, 20 bp, Artificial
  CRISPR gRNA sequence
tgccagccgctcaggagtca

SEQ ID NO: 61792 - DNA, 20 bp, Artificial
  CRISPR gRNA sequence
agactccatctcaaaaaaaa

SEQ ID NO: 61793 - DNA, 20 bp, Artificial
  CRISPR gRNA sequence
ccatctcaaaaaaaaaaaga

SEQ ID NO: 61794 - DNA, 20 bp, Artificial
  CRISPR gRNA sequence
tcaaaaaaaaaaagaaaaga

SEQ ID NO: 61795 - DNA, 20 bp, Artificial
  CRISPR gRNA sequence
gtcttaattgtgggagctga

SEQ ID NO: 61796 - DNA, 20 bp, Artificial
  CRISPR gRNA sequence
ttcccttccctaaggacccc

SEQ ID NO: 61797 - DNA, 20 bp, Artificial
  CRISPR gRNA sequence
cctcatctgtaaaatggaga

SEQ ID NO: 61798 - DNA, 20 bp, Artificial
  CRISPR gRNA sequence
ggtgagacccccccatctct

SEQ ID NO: 61799 - DNA, 20 bp, Artificial
  CRISPR gRNA sequence
acagagcaagactctgtctc

SEQ ID NO: 61800 - DNA, 20 bp, Artificial
  CRISPR gRNA sequence
ttcttcgaaacaacaacaaa

SEQ ID NO: 61801 - DNA, 20 bp, Artificial
  CRISPR gRNA sequence
tcttacctcattgtttattg

SEQ ID NO: 61802 - DNA, 20 bp, Artificial
  CRISPR gRNA sequence
tgtttattgtgagaatcaaa

SEQ ID NO: 61803 - DNA, 20 bp, Artificial
  CRISPR gRNA sequence
ttaatctattccttgtttgc

SEQ ID NO: 61804 - DNA, 20 bp, Artificial
  CRISPR gRNA sequence
gagagtcacagctagtgtgt

SEQ ID NO: 61805 - DNA, 20 bp, Artificial
  CRISPR gRNA sequence
gagggaagagagggagttta

SEQ ID NO: 61806 - DNA, 20 bp, Artificial
  CRISPR gRNA sequence
gggagtttaagagaaaagga

SEQ ID NO: 61807 - DNA, 20 bp, Artificial
  CRISPR gRNA sequence
ctctgggggacacccacttt

SEQ ID NO: 61808 - DNA, 20 bp, Artificial
  CRISPR gRNA sequence
gggggacacccactttccag

SEQ ID NO: 61809 - DNA, 20 bp, Artificial
  CRISPR gRNA sequence
tgagagtcccctggcctttg

SEQ ID NO: 61810 - DNA, 20 bp, Artificial
  CRISPR gRNA sequence
tatagtaattaccttaaaat

SEQ ID NO: 61811 - DNA, 20 bp, Artificial
  CRISPR gRNA sequence
ttccctgggccacattggaa

SEQ ID NO: 61812 - DNA, 20 bp, Artificial
  CRISPR gRNA sequence
gggccacattggaagaagaa

SEQ ID NO: 61813 - DNA, 20 bp, Artificial
  CRISPR gRNA sequence
aaaaaaaaaaacaaaactcc

SEQ ID NO: 61814 - DNA, 20 bp, Artificial
  CRISPR gRNA sequence
agaaaaatctcatagtgttt

SEQ ID NO: 61815 - DNA, 20 bp, Artificial
  CRISPR gRNA sequence
gcccatgcccagtccctggg

SEQ ID NO: 61816 - DNA, 20 bp, Artificial
  CRISPR gRNA sequence
ctcccctccaaacagccaga

SEQ ID NO: 61817 - DNA, 20 bp, Artificial
  CRISPR gRNA sequence
agcctgcagaggatgaagga

SEQ ID NO: 61818 - DNA, 20 bp, Artificial
  CRISPR gRNA sequence
aagttattctaaaatcacct

SEQ ID NO: 61819 - DNA, 20 bp, Artificial
  CRISPR gRNA sequence
ccacggagggtcacccactc

SEQ ID NO: 61820 - DNA, 20 bp, Artificial
  CRISPR gRNA sequence
ctcgcaaaaagggaatttaa

SEQ ID NO: 61821 - DNA, 20 bp, Artificial
  CRISPR gRNA sequence
ctaatttcagctcagactgg

SEQ ID NO: 61822 - DNA, 20 bp, Artificial
  CRISPR gRNA sequence
ctacttgggaggctgaggca

SEQ ID NO: 61823 - DNA, 20 bp, Artificial
  CRISPR gRNA sequence
gacaagagtgaaactccatc

SEQ ID NO: 61824 - DNA, 20 bp, Artificial
  CRISPR gRNA sequence
actccatctcagaaaaaaaa

SEQ ID NO: 61825 - DNA, 20 bp, Artificial
  CRISPR gRNA sequence
tcagaaaaaaaaaaagaaaa

SEQ ID NO: 61826 - DNA, 20 bp, Artificial
  CRISPR gRNA sequence
aaaaaaaaagaaaaaaagaa

SEQ ID NO: 61827 - DNA, 20 bp, Artificial
  CRISPR gRNA sequence
aaaaagaaaaaaagaaaaag

SEQ ID NO: 61828 - DNA, 20 bp, Artificial
  CRISPR gRNA sequence
ccctgcccggagataatgag

SEQ ID NO: 61829 - DNA, 20 bp, Artificial
  CRISPR gRNA sequence
aggcattgtgtgacgacaca

SEQ ID NO: 61830 - DNA, 20 bp, Artificial
  CRISPR gRNA sequence
gatgaacttagccagtgata

SEQ ID NO: 61831 - DNA, 20 bp, Artificial
  CRISPR gRNA sequence
gttcagactgagtgctgggt

SEQ ID NO: 61832 - DNA, 20 bp, Artificial
  CRISPR gRNA sequence
ggcacaggagagcccacaac

SEQ ID NO: 61833 - DNA, 20 bp, Artificial
  CRISPR gRNA sequence
ggacttgtttcacccagcat

SEQ ID NO: 61834 - DNA, 20 bp, Artificial
  CRISPR gRNA sequence
ttctgttgtgatgtggcaga

SEQ ID NO: 61835 - DNA, 20 bp, Artificial
  CRISPR gRNA sequence
gtattttaaacagatatgaa

SEQ ID NO: 61836 - DNA, 20 bp, Artificial
  CRISPR gRNA sequence
ctacttgggaggctgaggca

SEQ ID NO: 61837 - DNA, 20 bp, Artificial
  CRISPR gRNA sequence
ataaataaataaataaaacc

SEQ ID NO: 61838 - DNA, 20 bp, Artificial
  CRISPR gRNA sequence
aatgctgcaatgaagggaag

SEQ ID NO: 61839 - DNA, 20 bp, Artificial
  CRISPR gRNA sequence
attgcattcccagattaaaa

SEQ ID NO: 61840 - DNA, 20 bp, Artificial
  CRISPR gRNA sequence
gtggtactgggcttggtggt

SEQ ID NO: 61841 - DNA, 20 bp, Artificial
  CRISPR gRNA sequence
gggcctcagtgtgtccatct

SEQ ID NO: 61842 - DNA, 20 bp, Artificial
  CRISPR gRNA sequence
ggccaggtattgccatgctc

SEQ ID NO: 61843 - DNA, 20 bp, Artificial
  CRISPR gRNA sequence
cctggacagcagagccccac

SEQ ID NO: 61844 - DNA, 20 bp, Artificial
  CRISPR gRNA sequence
cccacctctaattggtgcta

SEQ ID NO: 61845 - DNA, 20 bp, Artificial
  CRISPR gRNA sequence
agagactccacaaggcacac

SEQ ID NO: 61846 - DNA, 20 bp, Artificial
  CRISPR gRNA sequence
gaggcctgtgctttgggatt

SEQ ID NO: 61847 - DNA, 20 bp, Artificial
  CRISPR gRNA sequence
tgctttgggatttaagaaaa

SEQ ID NO: 61848 - DNA, 20 bp, Artificial
  CRISPR gRNA sequence
ttgggatttaagaaaaaaag

SEQ ID NO: 61849 - DNA, 20 bp, Artificial
  CRISPR gRNA sequence
gatttaagaaaaaaagaaag

SEQ ID NO: 61850 - DNA, 20 bp, Artificial
  CRISPR gRNA sequence
taagaaaaaaagaaagaaag

SEQ ID NO: 61851 - DNA, 20 bp, Artificial
  CRISPR gRNA sequence
ctatgatcattttaaaacac

SEQ ID NO: 61852 - DNA, 20 bp, Artificial
  CRISPR gRNA sequence
cagaaaaagaagataccgaa

SEQ ID NO: 61853 - DNA, 20 bp, Artificial
  CRISPR gRNA sequence
aaaagaagataccgaagtag

SEQ ID NO: 61854 - DNA, 20 bp, Artificial
  CRISPR gRNA sequence
cacagttccatcaggacacc

SEQ ID NO: 61855 - DNA, 20 bp, Artificial
  CRISPR gRNA sequence
gcgtgagccaccatgcccag

SEQ ID NO: 61856 - DNA, 20 bp, Artificial
  CRISPR gRNA sequence
caattattttggttatatat

SEQ ID NO: 61857 - DNA, 20 bp, Artificial
  CRISPR gRNA sequence
tttaatcattgttgaaatgt

SEQ ID NO: 61858 - DNA, 20 bp, Artificial
  CRISPR gRNA sequence
tgttgaaatgtgcagaaaat

SEQ ID NO: 61859 - DNA, 20 bp, Artificial
  CRISPR gRNA sequence
cagaaaatccagaaatacat

SEQ ID NO: 61860 - DNA, 20 bp, Artificial
  CRISPR gRNA sequence
caaattaatgcacatgcatt

SEQ ID NO: 61861 - DNA, 20 bp, Artificial
  CRISPR gRNA sequence
gcacatgcattgtagaaagt

SEQ ID NO: 61862 - DNA, 20 bp, Artificial
  CRISPR gRNA sequence
ttgtagaaagtttagaaaat

SEQ ID NO: 61863 - DNA, 20 bp, Artificial
  CRISPR gRNA sequence
cataaaataaaaatcactca

SEQ ID NO: 61864 - DNA, 20 bp, Artificial
  CRISPR gRNA sequence
ctacttgggaggctgaggca

SEQ ID NO: 61865 - DNA, 20 bp, Artificial
  CRISPR gRNA sequence
agtgtcagaggaagacatcc

SEQ ID NO: 61866 - DNA, 20 bp, Artificial
  CRISPR gRNA sequence
cacacattatggctcttcaa

SEQ ID NO: 61867 - DNA, 20 bp, Artificial
  CRISPR gRNA sequence
gtggtccttgtgcccctccc

SEQ ID NO: 61868 - DNA, 20 bp, Artificial
  CRISPR gRNA sequence
gtctctttaaaaaaaaaaaa

SEQ ID NO: 61869 - DNA, 20 bp, Artificial
  CRISPR gRNA sequence
ttaaaaaaaaaaaaaaagaa

SEQ ID NO: 61870 - DNA, 20 bp, Artificial
  CRISPR gRNA sequence
ctggaatttcctcgccagga

SEQ ID NO: 61871 - DNA, 20 bp, Artificial
  CRISPR gRNA sequence
gcacaggctgtgctctctgc

SEQ ID NO: 61872 - DNA, 20 bp, Artificial
  CRISPR gRNA sequence
cattctcacttccttgtgca

SEQ ID NO: 61873 - DNA, 20 bp, Artificial
  CRISPR gRNA sequence
tgtgtccagcctgaaatcct

SEQ ID NO: 61874 - DNA, 20 bp, Artificial
  CRISPR gRNA sequence
aggaacattgagccacatgg

SEQ ID NO: 61875 - DNA, 20 bp, Artificial
  CRISPR gRNA sequence
ctaattgggaggctgaggca

SEQ ID NO: 61876 - DNA, 20 bp, Artificial
  CRISPR gRNA sequence
ttaacatttcagcgaatttg

SEQ ID NO: 61877 - DNA, 20 bp, Artificial
  CRISPR gRNA sequence
atttacaggccagttatttt

SEQ ID NO: 61878 - DNA, 20 bp, Artificial
  CRISPR gRNA sequence
catctaactgattacaccaa

SEQ ID NO: 61879 - DNA, 20 bp, Artificial
  CRISPR gRNA sequence
taaaataaatgtttaaaaag

SEQ ID NO: 61880 - DNA, 20 bp, Artificial
  CRISPR gRNA sequence
aagaaccttggtcataggaa

SEQ ID NO: 61881 - DNA, 20 bp, Artificial
  CRISPR gRNA sequence
acaactcaaagcaatccaag

SEQ ID NO: 61882 - DNA, 20 bp, Artificial
  CRISPR gRNA sequence
gatgtgagtaacagaagagg

SEQ ID NO: 61883 - DNA, 20 bp, Artificial
  CRISPR gRNA sequence
gaagaggaaagaaactctgg

SEQ ID NO: 61884 - DNA, 20 bp, Artificial
  CRISPR gRNA sequence
aatttgaagtcatcaaattc

SEQ ID NO: 61885 - DNA, 20 bp, Artificial
  CRISPR gRNA sequence
tcatcaaattcttagaaatg

SEQ ID NO: 61886 - DNA, 20 bp, Artificial
  CRISPR gRNA sequence
cctgtttagacagtatctgg

SEQ ID NO: 61887 - DNA, 20 bp, Artificial
  CRISPR gRNA sequence
gtatctggacagaaaattta

SEQ ID NO: 61888 - DNA, 20 bp, Artificial
  CRISPR gRNA sequence
accaaaaaagttccatcttt

SEQ ID NO: 61889 - DNA, 20 bp, Artificial
  CRISPR gRNA sequence
gccccggggatgacaccccc

SEQ ID NO: 61890 - DNA, 20 bp, Artificial
  CRISPR gRNA sequence
ctgacctcagtaattcatgc

SEQ ID NO: 61891 - DNA, 20 bp, Artificial
  CRISPR gRNA sequence
ctcccagtacagttcatttt

SEQ ID NO: 61892 - DNA, 20 bp, Artificial
  CRISPR gRNA sequence
ggccccatgggaatgagtgg

SEQ ID NO: 61893 - DNA, 20 bp, Artificial
  CRISPR gRNA sequence
aaaatttaatttgcaaaata

SEQ ID NO: 61894 - DNA, 20 bp, Artificial
  CRISPR gRNA sequence
agaactgatctgcgtgaatc

SEQ ID NO: 61895 - DNA, 20 bp, Artificial
  CRISPR gRNA sequence
aggctgaggtgaagcttggc

SEQ ID NO: 61896 - DNA, 20 bp, Artificial
  CRISPR gRNA sequence
cctgcctctgatgtctgcag

SEQ ID NO: 61897 - DNA, 20 bp, Artificial
  CRISPR gRNA sequence
agcgggtccctgagggcgaa

SEQ ID NO: 61898 - DNA, 20 bp, Artificial
  CRISPR gRNA sequence
atgaaggccaggagaggtgt

SEQ ID NO: 61899 - DNA, 20 bp, Artificial
  CRISPR gRNA sequence
gggatggtgggggcctggct

SEQ ID NO: 61900 - DNA, 20 bp, Artificial
  CRISPR gRNA sequence
ccatttatgaaccacagttg

SEQ ID NO: 61901 - DNA, 20 bp, Artificial
  CRISPR gRNA sequence
agaaacagtggctaaagcca

SEQ ID NO: 61902 - DNA, 20 bp, Artificial
  CRISPR gRNA sequence
gcttggctgtctcttagcaa

SEQ ID NO: 61903 - DNA, 20 bp, Artificial
  CRISPR gRNA sequence
agtgctgcctcatgagtaaa

SEQ ID NO: 61904 - DNA, 20 bp, Artificial
  CRISPR gRNA sequence
ccaagattaattttttaaag

SEQ ID NO: 61905 - DNA, 20 bp, Artificial
  CRISPR gRNA sequence
aaaaaagagggggccaattt

SEQ ID NO: 61906 - DNA, 20 bp, Artificial
  CRISPR gRNA sequence
ctgggtcagtcccctgcctc

SEQ ID NO: 61907 - DNA, 20 bp, Artificial
  CRISPR gRNA sequence
tgtccactgagaagcctgga

SEQ ID NO: 61908 - DNA, 20 bp, Artificial
  CRISPR gRNA sequence
ggagacttggaccactccac

SEQ ID NO: 61909 - DNA, 20 bp, Artificial
  CRISPR gRNA sequence
agatggaagtaaaacatctt

SEQ ID NO: 61910 - DNA, 20 bp, Artificial
  CRISPR gRNA sequence
ttgttacttccaaggagaac

SEQ ID NO: 61911 - DNA, 20 bp, Artificial
  CRISPR gRNA sequence
aggtactttactctcatctg

SEQ ID NO: 61912 - DNA, 20 bp, Artificial
  CRISPR gRNA sequence
cagtatccccatttcacaga

SEQ ID NO: 61913 - DNA, 20 bp, Artificial
  CRISPR gRNA sequence
ggacagtgaggggaggggaa

SEQ ID NO: 61914 - DNA, 20 bp, Artificial
  CRISPR gRNA sequence
gggaaagagaaacacggcca

SEQ ID NO: 61915 - DNA, 20 bp, Artificial
  CRISPR gRNA sequence
ctactcaggaggctgaggca

SEQ ID NO: 61916 - DNA, 20 bp, Artificial
  CRISPR gRNA sequence
taacccttttggttaaaaag

SEQ ID NO: 61917 - DNA, 20 bp, Artificial
  CRISPR gRNA sequence
gttagggtcccaggctagtc

SEQ ID NO: 61918 - DNA, 20 bp, Artificial
  CRISPR gRNA sequence
ctgagcagcgggagctccat

SEQ ID NO: 61919 - DNA, 20 bp, Artificial
  CRISPR gRNA sequence
ctactctggtagctgaggca

SEQ ID NO: 61920 - DNA, 20 bp, Artificial
  CRISPR gRNA sequence
attgtacttcttttgcatgt

SEQ ID NO: 61921 - DNA, 20 bp, Artificial
  CRISPR gRNA sequence
acacctacccagacaatgag

SEQ ID NO: 61922 - DNA, 20 bp, Artificial
  CRISPR gRNA sequence
ggttgtggctcaagcttggg

SEQ ID NO: 61923 - DNA, 20 bp, Artificial
  CRISPR gRNA sequence
atcttgtccacaccccactc

SEQ ID NO: 61924 - DNA, 20 bp, Artificial
  CRISPR gRNA sequence
aaattgtcctgggtctgggg

SEQ ID NO: 61925 - DNA, 20 bp, Artificial
  CRISPR gRNA sequence
tggtggcagccctgagagcc

SEQ ID NO: 61926 - DNA, 20 bp, Artificial
  CRISPR gRNA sequence
tattgtccccagtgtccagg

SEQ ID NO: 61927 - DNA, 20 bp, Artificial
  CRISPR gRNA sequence
ctacttgggcggctgaggca

SEQ ID NO: 61928 - DNA, 20 bp, Artificial
  CRISPR gRNA sequence
tctcaaaaaataaaaataaa

SEQ ID NO: 61929 - DNA, 20 bp, Artificial
  CRISPR gRNA sequence
caaagtgctgaccgtggccc

SEQ ID NO: 61930 - DNA, 20 bp, Artificial
  CRISPR gRNA sequence
tgataccacccggaagcttg

SEQ ID NO: 61931 - DNA, 20 bp, Artificial
  CRISPR gRNA sequence
aagaccagcctgaccaacat

SEQ ID NO: 61932 - DNA, 20 bp, Artificial
  CRISPR gRNA sequence
ctactcgggaggctgaggca

SEQ ID NO: 61933 - DNA, 20 bp, Artificial
  CRISPR gRNA sequence
tcaaaaacaaacaaacaaaa

SEQ ID NO: 61934 - DNA, 20 bp, Artificial
  CRISPR gRNA sequence
aaaaaaaaagcacagtctag

SEQ ID NO: 61935 - DNA, 20 bp, Artificial
  CRISPR gRNA sequence
agaattccagacctggggaa

SEQ ID NO: 61936 - DNA, 20 bp, Artificial
  CRISPR gRNA sequence
cccccagcctaggcaggaga

SEQ ID NO: 61937 - DNA, 20 bp, Artificial
  CRISPR gRNA sequence
actggcacgagttcacacat

SEQ ID NO: 61938 - DNA, 20 bp, Artificial
  CRISPR gRNA sequence
aaaccccatctccactaaaa

SEQ ID NO: 61939 - DNA, 20 bp, Artificial
  CRISPR gRNA sequence
ggtgcctgggaaatcaggag

SEQ ID NO: 61940 - DNA, 20 bp, Artificial
  CRISPR gRNA sequence
caggtacatggacagtgggc

SEQ ID NO: 61941 - DNA, 20 bp, Artificial
  CRISPR gRNA sequence
caagcaaagagggacaagcg

SEQ ID NO: 61942 - DNA, 20 bp, Artificial
  CRISPR gRNA sequence
aagctgaattcaaaacatat

SEQ ID NO: 61943 - DNA, 20 bp, Artificial
  CRISPR gRNA sequence
atatgtagaaaaaaaaatct

SEQ ID NO: 61944 - DNA, 20 bp, Artificial
  CRISPR gRNA sequence
atgttatttgttacatattt

SEQ ID NO: 61945 - DNA, 20 bp, Artificial
  CRISPR gRNA sequence
agatggaacttttttggtca

SEQ ID NO: 61946 - DNA, 20 bp, Artificial
  CRISPR gRNA sequence
gaggctgtttctggcatttc

SEQ ID NO: 61947 - DNA, 20 bp, Artificial
  CRISPR gRNA sequence
cgcccaggtctggccagtga

SEQ ID NO: 61948 - DNA, 20 bp, Artificial
  CRISPR gRNA sequence
accttttgttgtaaccacag

SEQ ID NO: 61949 - DNA, 20 bp, Artificial
  CRISPR gRNA sequence
actccctttccactaagctg

SEQ ID NO: 61950 - DNA, 20 bp, Artificial
  CRISPR gRNA sequence
agaaggaagccaaggtggac

SEQ ID NO: 61951 - DNA, 20 bp, Artificial
  CRISPR gRNA sequence
gttcttgctggcactgagat

SEQ ID NO: 61952 - DNA, 20 bp, Artificial
  CRISPR gRNA sequence
tgctggcactgagatccaga

SEQ ID NO: 61953 - DNA, 20 bp, Artificial
  CRISPR gRNA sequence
ttcagctcacctgggtccat

SEQ ID NO: 61954 - DNA, 20 bp, Artificial
  CRISPR gRNA sequence
atagtcacagctggcccagc

SEQ ID NO: 61955 - DNA, 20 bp, Artificial
  CRISPR gRNA sequence
taattttactggattatgga

SEQ ID NO: 61956 - DNA, 20 bp, Artificial
  CRISPR gRNA sequence
acaacttacttctaaatggt

SEQ ID NO: 61957 - DNA, 20 bp, Artificial
  CRISPR gRNA sequence
aaggagagagggagagagtg

SEQ ID NO: 61958 - DNA, 20 bp, Artificial
  CRISPR gRNA sequence
gtgggaaagaaggagggagg

SEQ ID NO: 61959 - DNA, 20 bp, Artificial
  CRISPR gRNA sequence
gttagttcgcagttatttta

SEQ ID NO: 61960 - DNA, 20 bp, Artificial
  CRISPR gRNA sequence
ttttctcctgcacaaggaag

SEQ ID NO: 61961 - DNA, 20 bp, Artificial
  CRISPR gRNA sequence
atcctaccatgctctatttc

SEQ ID NO: 61962 - DNA, 20 bp, Artificial
  CRISPR gRNA sequence
ataagccttttcagaccatg

SEQ ID NO: 61963 - DNA, 20 bp, Artificial
  CRISPR gRNA sequence
agagggatccaagggcagtt

SEQ ID NO: 61964 - DNA, 20 bp, Artificial
  CRISPR gRNA sequence
tcccaatgcttatgaaagat

SEQ ID NO: 61965 - DNA, 20 bp, Artificial
  CRISPR gRNA sequence
ctattgttgtgacaatccaa

SEQ ID NO: 61966 - DNA, 20 bp, Artificial
  CRISPR gRNA sequence
gccactgatatttttagatt

SEQ ID NO: 61967 - DNA, 20 bp, Artificial
  CRISPR gRNA sequence
tcaaaaaaaggaaagtattt

SEQ ID NO: 61968 - DNA, 20 bp, Artificial
  CRISPR gRNA sequence
tttggagaaaaaaagtgtgg

SEQ ID NO: 61969 - DNA, 20 bp, Artificial
  CRISPR gRNA sequence
catggtggttgtttaagatg

SEQ ID NO: 61970 - DNA, 20 bp, Artificial
  CRISPR gRNA sequence
taatttgaaagtaggaaaaa

SEQ ID NO: 61971 - DNA, 20 bp, Artificial
  CRISPR gRNA sequence
aaccaatattatttttagac

SEQ ID NO: 61972 - DNA, 20 bp, Artificial
  CRISPR gRNA sequence
ctactctggaggctgaggca

SEQ ID NO: 61973 - DNA, 20 bp, Artificial
  CRISPR gRNA sequence
aaataaaataatatttaaaa

SEQ ID NO: 61974 - DNA, 20 bp, Artificial
  CRISPR gRNA sequence
ctactccggaggctgaggca

SEQ ID NO: 61975 - DNA, 20 bp, Artificial
  CRISPR gRNA sequence
gagcagtccaattcatagag

SEQ ID NO: 61976 - DNA, 20 bp, Artificial
  CRISPR gRNA sequence
ccaattcatagagacagaaa

SEQ ID NO: 61977 - DNA, 20 bp, Artificial
  CRISPR gRNA sequence
aacactcctgaatggtacac

SEQ ID NO: 61978 - DNA, 20 bp, Artificial
  CRISPR gRNA sequence
gaacacgtgccatgacatca

SEQ ID NO: 61979 - DNA, 20 bp, Artificial
  CRISPR gRNA sequence
tcaacagacactgacatgaa

SEQ ID NO: 61980 - DNA, 20 bp, Artificial
  CRISPR gRNA sequence
tgcactcacttagcctgagg

SEQ ID NO: 61981 - DNA, 20 bp, Artificial
  CRISPR gRNA sequence
ggaacctcccacaccccctg

SEQ ID NO: 61982 - DNA, 20 bp, Artificial
  CRISPR gRNA sequence
acccaaggacacacagcaga

SEQ ID NO: 61983 - DNA, 20 bp, Artificial
  CRISPR gRNA sequence
acagcagataagaaagaagg

SEQ ID NO: 61984 - DNA, 20 bp, Artificial
  CRISPR gRNA sequence
agctgggtgttaaaggattg

SEQ ID NO: 61985 - DNA, 20 bp, Artificial
  CRISPR gRNA sequence
aggattgggagaattttatc

SEQ ID NO: 61986 - DNA, 20 bp, Artificial
  CRISPR gRNA sequence
tatctcagaaaaggcaagga

SEQ ID NO: 61987 - DNA, 20 bp, Artificial
  CRISPR gRNA sequence
agtgcggtgtgagcagaggc

SEQ ID NO: 61988 - DNA, 20 bp, Artificial
  CRISPR gRNA sequence
tagtcaggacatggcaagga

SEQ ID NO: 61989 - DNA, 20 bp, Artificial
  CRISPR gRNA sequence
tggcacccgggcatcagggg

SEQ ID NO: 61990 - DNA, 20 bp, Artificial
  CRISPR gRNA sequence
cccaggaaaccctgagattc

SEQ ID NO: 61991 - DNA, 20 bp, Artificial
  CRISPR gRNA sequence
ccaggggcacctgttggcca

SEQ ID NO: 61992 - DNA, 20 bp, Artificial
  CRISPR gRNA sequence
gcaggtacagggcactttcc

SEQ ID NO: 61993 - DNA, 20 bp, Artificial
  CRISPR gRNA sequence
gactagaagggaaatggaga

SEQ ID NO: 61994 - DNA, 20 bp, Artificial
  CRISPR gRNA sequence
atgttccacagattgggtca

SEQ ID NO: 61995 - DNA, 20 bp, Artificial
  CRISPR gRNA sequence
ccaggggagtgaaggcaagg

SEQ ID NO: 61996 - DNA, 20 bp, Artificial
  CRISPR gRNA sequence
caccatcccttccatcacca

SEQ ID NO: 61997 - DNA, 20 bp, Artificial
  CRISPR gRNA sequence
ccagcaggctttcaagggtt

SEQ ID NO: 61998 - DNA, 20 bp, Artificial
  CRISPR gRNA sequence
agctagttttaactacagtt

SEQ ID NO: 61999 - DNA, 20 bp, Artificial
  CRISPR gRNA sequence
ttgttaatttcatcttttcc

SEQ ID NO: 62000 - DNA, 20 bp, Artificial
  CRISPR gRNA sequence
taataaaatagtctttaaaa

SEQ ID NO: 62001 - DNA, 20 bp, Artificial
  CRISPR gRNA sequence
ctccttgggaggctgaggca

SEQ ID NO: 62002 - DNA, 20 bp, Artificial
  CRISPR gRNA sequence
tgcattccagcctgggcagc

SEQ ID NO: 62003 - DNA, 20 bp, Artificial
  CRISPR gRNA sequence
gaaagactccatctaaaaaa

SEQ ID NO: 62004 - DNA, 20 bp, Artificial
  CRISPR gRNA sequence
gactccatctaaaaaaaaag

SEQ ID NO: 62005 - DNA, 20 bp, Artificial
  CRISPR gRNA sequence
ccatctaaaaaaaaagaaag

SEQ ID NO: 62006 - DNA, 20 bp, Artificial
  CRISPR gRNA sequence
taaaaaaaaagaaagaaaga

SEQ ID NO: 62007 - DNA, 20 bp, Artificial
  CRISPR gRNA sequence
gaccccaggtcttaaaaaaa

SEQ ID NO: 62008 - DNA, 20 bp, Artificial
  CRISPR gRNA sequence
ttcttctctgccacatcaca

SEQ ID NO: 62009 - DNA, 20 bp, Artificial
  CRISPR gRNA sequence
tgtcaagcacttagaacagt

SEQ ID NO: 62010 - DNA, 20 bp, Artificial
  CRISPR gRNA sequence
ggcgagagtgggggcgggag

SEQ ID NO: 62011 - DNA, 20 bp, Artificial
  CRISPR gRNA sequence
cttggaccctctggaagtgt

SEQ ID NO: 62012 - DNA, 20 bp, Artificial
  CRISPR gRNA sequence
cagttggaaaccactgcctt

SEQ ID NO: 62013 - DNA, 20 bp, Artificial
  CRISPR gRNA sequence
ctacttgggaggctgaggca

SEQ ID NO: 62014 - DNA, 20 bp, Artificial
  CRISPR gRNA sequence
gcgagaccctcccccacaaa

SEQ ID NO: 62015 - DNA, 20 bp, Artificial
  CRISPR gRNA sequence
gaccctcccccacaaaaaag

SEQ ID NO: 62016 - DNA, 20 bp, Artificial
  CRISPR gRNA sequence
ctcccccacaaaaaagaaag

SEQ ID NO: 62017 - DNA, 20 bp, Artificial
  CRISPR gRNA sequence
agccactcttcaccacatcc

SEQ ID NO: 62018 - DNA, 20 bp, Artificial
  CRISPR gRNA sequence
ctaaccagtctgagctgaaa

SEQ ID NO: 62019 - DNA, 20 bp, Artificial
  CRISPR gRNA sequence
ttccatttcttaaggtgatt

SEQ ID NO: 62020 - DNA, 20 bp, Artificial
  CRISPR gRNA sequence
aatgataaaacaacctaagg

SEQ ID NO: 62021 - DNA, 20 bp, Artificial
  CRISPR gRNA sequence
agctttgccatggaggagcc

SEQ ID NO: 62022 - DNA, 20 bp, Artificial
  CRISPR gRNA sequence
tccccaaactaaatggacta

SEQ ID NO: 62023 - DNA, 20 bp, Artificial
  CRISPR gRNA sequence
gttccgcaaaacatgtttgt

SEQ ID NO: 62024 - DNA, 20 bp, Artificial
  CRISPR gRNA sequence
gcaaaacatgtttgttaaga

SEQ ID NO: 62025 - DNA, 20 bp, Artificial
  CRISPR gRNA sequence
ctctatctcaaaaaaataaa

SEQ ID NO: 62026 - DNA, 20 bp, Artificial
  CRISPR gRNA sequence
tctcaaaaaaataaaaaaga

SEQ ID NO: 62027 - DNA, 20 bp, Artificial
  CRISPR gRNA sequence
gtcagaacccagtgcattta

SEQ ID NO: 62028 - DNA, 20 bp, Artificial
  CRISPR gRNA sequence
ctttattgagggtggtcttt

SEQ ID NO: 62029 - DNA, 20 bp, Artificial
  CRISPR gRNA sequence
ctactcaggaggctgaggca

SEQ ID NO: 62030 - DNA, 20 bp, Artificial
  CRISPR gRNA sequence
aacaagagcaaaactctgtc

SEQ ID NO: 62031 - DNA, 20 bp, Artificial
  CRISPR gRNA sequence
aagggcatttgagatggggg

SEQ ID NO: 62032 - DNA, 20 bp, Artificial
  CRISPR gRNA sequence
ttgagatgggggctagaaag

SEQ ID NO: 62033 - DNA, 20 bp, Artificial
  CRISPR gRNA sequence
tagtttatgactgcaaacag

SEQ ID NO: 62034 - DNA, 20 bp, Artificial
  CRISPR gRNA sequence
attttaaggtaattactata

SEQ ID NO: 62035 - DNA, 20 bp, Artificial
  CRISPR gRNA sequence
tcatggggcagggctggtgg

SEQ ID NO: 62036 - DNA, 20 bp, Artificial
  CRISPR gRNA sequence
cagggctggtgggaagaaat

SEQ ID NO: 62037 - DNA, 20 bp, Artificial
  CRISPR gRNA sequence
aatgggcagggcagggaatc

SEQ ID NO: 62038 - DNA, 20 bp, Artificial
  CRISPR gRNA sequence
tgagctgctctgtttgcttc

SEQ ID NO: 62039 - DNA, 20 bp, Artificial
  CRISPR gRNA sequence
atgtggaatcttctctccaa

SEQ ID NO: 62040 - DNA, 20 bp, Artificial
  CRISPR gRNA sequence
atccctaggagggggatcat

SEQ ID NO: 62041 - DNA, 20 bp, Artificial
  CRISPR gRNA sequence
acccctaggagggggatcgt

SEQ ID NO: 62042 - DNA, 20 bp, Artificial
  CRISPR gRNA sequence
tcagggaagggaagcctgag

SEQ ID NO: 62043 - DNA, 20 bp, Artificial
  CRISPR gRNA sequence
ctcaagaacccgggggttcc

SEQ ID NO: 62044 - DNA, 20 bp, Artificial
  CRISPR gRNA sequence
tctcacaataaacaatgagg

SEQ ID NO: 62045 - DNA, 20 bp, Artificial
  CRISPR gRNA sequence
ttcttctttgttgttgtttc

SEQ ID NO: 62046 - DNA, 20 bp, Artificial
  CRISPR gRNA sequence
aactctctaatggtgaattt

SEQ ID NO: 62047 - DNA, 20 bp, Artificial
  CRISPR gRNA sequence
atggggaaacagagtcctag

SEQ ID NO: 62048 - DNA, 20 bp, Artificial
  CRISPR gRNA sequence
gaaaatgcagggtctcttgt

SEQ ID NO: 62049 - DNA, 20 bp, Artificial
  CRISPR gRNA sequence
ggagaggggatgtaacttgc

SEQ ID NO: 62050 - DNA, 20 bp, Artificial
  CRISPR gRNA sequence
cccctcccggcaccccaggg

SEQ ID NO: 62051 - DNA, 20 bp, Artificial
  CRISPR gRNA sequence
tgagtcacagactctctgag

SEQ ID NO: 62052 - DNA, 20 bp, Artificial
  CRISPR gRNA sequence
aggaaagagggggatgggac

SEQ ID NO: 62053 - DNA, 20 bp, Artificial
  CRISPR gRNA sequence
caccccccagacacagaggc

SEQ ID NO: 62054 - DNA, 20 bp, Artificial
  CRISPR gRNA sequence
cagttaaataaactgataaa

SEQ ID NO: 62055 - DNA, 20 bp, Artificial
  CRISPR gRNA sequence
gaaatacacgatgagagagg

SEQ ID NO: 62056 - DNA, 20 bp, Artificial
  CRISPR gRNA sequence
gatgagagagggaagaaatg

SEQ ID NO: 62057 - DNA, 20 bp, Artificial
  CRISPR gRNA sequence
catctggagcatgaggctgt

SEQ ID NO: 62058 - DNA, 20 bp, Artificial
  CRISPR gRNA sequence
aaaggccatgtccgccatct

SEQ ID NO: 62059 - DNA, 20 bp, Artificial
  CRISPR gRNA sequence
ccatttcctggcaagtctta

SEQ ID NO: 62060 - DNA, 20 bp, Artificial
  CRISPR gRNA sequence
cagagcaagatcctgtctct

SEQ ID NO: 62061 - DNA, 20 bp, Artificial
  CRISPR gRNA sequence
cagggaccaccctactgggt

SEQ ID NO: 62062 - DNA, 20 bp, Artificial
  CRISPR gRNA sequence
catactcaacggcgagactt

SEQ ID NO: 62063 - DNA, 20 bp, Artificial
  CRISPR gRNA sequence
gaactgacggtctgctctca

SEQ ID NO: 62064 - DNA, 20 bp, Artificial
  CRISPR gRNA sequence
gcacacaatgcaccccggcc

SEQ ID NO: 62065 - DNA, 20 bp, Artificial
  CRISPR gRNA sequence
gttctggaccacctgggagt

SEQ ID NO: 62066 - DNA, 20 bp, Artificial
  CRISPR gRNA sequence
agagatgagggtgggttgga

SEQ ID NO: 62067 - DNA, 20 bp, Artificial
  CRISPR gRNA sequence
gctttaagcagttagaggga

SEQ ID NO: 62068 - DNA, 20 bp, Artificial
  CRISPR gRNA sequence
cctcagtgcagcagtagcag

SEQ ID NO: 62069 - DNA, 20 bp, Artificial
  CRISPR gRNA sequence
tgcaagagtgttttaaaaag

SEQ ID NO: 62070 - DNA, 20 bp, Artificial
  CRISPR gRNA sequence
agtcagaaaaacaattttca

SEQ ID NO: 62071 - DNA, 20 bp, Artificial
  CRISPR gRNA sequence
acaagaaatataataaaaat

SEQ ID NO: 62072 - DNA, 20 bp, Artificial
  CRISPR gRNA sequence
gcccggctgaatttttttta

SEQ ID NO: 62073 - DNA, 20 bp, Artificial
  CRISPR gRNA sequence
ttaatagaaatttttatgag

SEQ ID NO: 62074 - DNA, 20 bp, Artificial
  CRISPR gRNA sequence
gggagacataagacaggggc

SEQ ID NO: 62075 - DNA, 20 bp, Artificial
  CRISPR gRNA sequence
agtcactttcaatagccagg

SEQ ID NO: 62076 - DNA, 20 bp, Artificial
  CRISPR gRNA sequence
ctatcccttctcctgggatt

SEQ ID NO: 62077 - DNA, 20 bp, Artificial
  CRISPR gRNA sequence
acctctgactcttccatgag

SEQ ID NO: 62078 - DNA, 20 bp, Artificial
  CRISPR gRNA sequence
tacagattcgttttaggaac

SEQ ID NO: 62079 - DNA, 20 bp, Artificial
  CRISPR gRNA sequence
ttgacagagagactgagagt

SEQ ID NO: 62080 - DNA, 20 bp, Artificial
  CRISPR gRNA sequence
ggccatcaggtgcagggcag

SEQ ID NO: 62081 - DNA, 20 bp, Artificial
  CRISPR gRNA sequence
agggtcccattgcagagatg

SEQ ID NO: 62082 - DNA, 20 bp, Artificial
  CRISPR gRNA sequence
ggaccattctgagaactggt

SEQ ID NO: 62083 - DNA, 20 bp, Artificial
  CRISPR gRNA sequence
gggccaacagccagcagccc

SEQ ID NO: 62084 - DNA, 20 bp, Artificial
  CRISPR gRNA sequence
aatgcctttctggaagagtt

SEQ ID NO: 62085 - DNA, 20 bp, Artificial
  CRISPR gRNA sequence
aaaacaagaaggaaggggac

SEQ ID NO: 62086 - DNA, 20 bp, Artificial
  CRISPR gRNA sequence
ggacccagaaaggaagggag

SEQ ID NO: 62087 - DNA, 20 bp, Artificial
  CRISPR gRNA sequence
gaaaggaaagaggactcagg

SEQ ID NO: 62088 - DNA, 20 bp, Artificial
  CRISPR gRNA sequence
taagtaaagtcaatgcttct

SEQ ID NO: 62089 - DNA, 20 bp, Artificial
  CRISPR gRNA sequence
actggcccttccgagctcct

SEQ ID NO: 62090 - DNA, 20 bp, Artificial
  CRISPR gRNA sequence
ggggttccaggttagaccct

SEQ ID NO: 62091 - DNA, 20 bp, Artificial
  CRISPR gRNA sequence
cagacgaagagcatggccta

SEQ ID NO: 62092 - DNA, 20 bp, Artificial
  CRISPR gRNA sequence
aacactcagttatctgttgt

SEQ ID NO: 62093 - DNA, 20 bp, Artificial
  CRISPR gRNA sequence
agctttgaaggcagtgctgg

SEQ ID NO: 62094 - DNA, 20 bp, Artificial
  CRISPR gRNA sequence
ctgtgcaaacagaaggtgcc

SEQ ID NO: 62095 - DNA, 20 bp, Artificial
  CRISPR gRNA sequence
agtgatgtcctgtctctaca

SEQ ID NO: 62096 - DNA, 20 bp, Artificial
  CRISPR gRNA sequence
cccccacccccgccaaaaaa

SEQ ID NO: 62097 - DNA, 20 bp, Artificial
  CRISPR gRNA sequence
aaatttgttctgggaagtgt

SEQ ID NO: 62098 - DNA, 20 bp, Artificial
  CRISPR gRNA sequence
actaaatattctctggtcat

SEQ ID NO: 62099 - DNA, 20 bp, Artificial
  CRISPR gRNA sequence
atttggccagtggaatgtaa

SEQ ID NO: 62100 - DNA, 20 bp, Artificial
  CRISPR gRNA sequence
cctcactcaggcagagagtc

SEQ ID NO: 62101 - DNA, 20 bp, Artificial
  CRISPR gRNA sequence
ccagcatccatgctacccat

SEQ ID NO: 62102 - DNA, 20 bp, Artificial
  CRISPR gRNA sequence
tttaaggctaaccatcctca

SEQ ID NO: 62103 - DNA, 20 bp, Artificial
  CRISPR gRNA sequence
ctttttttctactccaggga

SEQ ID NO: 62104 - DNA, 20 bp, Artificial
  CRISPR gRNA sequence
agggaccagtcttggcagta

SEQ ID NO: 62105 - DNA, 20 bp, Artificial
  CRISPR gRNA sequence
gaaaagaggaggtgaagggg

SEQ ID NO: 62106 - DNA, 20 bp, Artificial
  CRISPR gRNA sequence
ttggagtctggaatagtggg

SEQ ID NO: 62107 - DNA, 20 bp, Artificial
  CRISPR gRNA sequence
gtcaattacaccttggttct

SEQ ID NO: 62108 - DNA, 20 bp, Artificial
  CRISPR gRNA sequence
gcatggcagtaatgccaaca

SEQ ID NO: 62109 - DNA, 20 bp, Artificial
  CRISPR gRNA sequence
acctcagctccccagtgaat

SEQ ID NO: 62110 - DNA, 20 bp, Artificial
  CRISPR gRNA sequence
gtgataagaaatcgggatga

SEQ ID NO: 62111 - DNA, 20 bp, Artificial
  CRISPR gRNA sequence
tactagcctggccaacgtga

SEQ ID NO: 62112 - DNA, 20 bp, Artificial
  CRISPR gRNA sequence
ggccagagtttcttcgttcc

SEQ ID NO: 62113 - DNA, 20 bp, Artificial
  CRISPR gRNA sequence
atgagatgggatggtgcatg

SEQ ID NO: 62114 - DNA, 20 bp, Artificial
  CRISPR gRNA sequence
gatcccttgagccgccaggc

SEQ ID NO: 62115 - DNA, 20 bp, Artificial
  CRISPR gRNA sequence
tttaaaaagaaaggaaaaaa

SEQ ID NO: 62116 - DNA, 20 bp, Artificial
  CRISPR gRNA sequence
aaattgtttttctgactttt

SEQ ID NO: 62117 - DNA, 20 bp, Artificial
  CRISPR gRNA sequence
agtatttcacatgcctgatt

SEQ ID NO: 62118 - DNA, 20 bp, Artificial
  CRISPR gRNA sequence
gactggcattactagatggt

SEQ ID NO: 62119 - DNA, 20 bp, Artificial
  CRISPR gRNA sequence
atggacctactggtagcgct

SEQ ID NO: 62120 - DNA, 20 bp, Artificial
  CRISPR gRNA sequence
ctccttcccactgctcagga

SEQ ID NO: 62121 - DNA, 20 bp, Artificial
  CRISPR gRNA sequence
ggtggttattttacagatga

SEQ ID NO: 62122 - DNA, 20 bp, Artificial
  CRISPR gRNA sequence
aaactgggggtcagagaggt

SEQ ID NO: 62123 - DNA, 20 bp, Artificial
  CRISPR gRNA sequence
cccgtctctactaaaaatac

SEQ ID NO: 62124 - DNA, 20 bp, Artificial
  CRISPR gRNA sequence
atccctgcttctagccctta

SEQ ID NO: 62125 - DNA, 20 bp, Artificial
  CRISPR gRNA sequence
atagtttaatcccatgtttg

SEQ ID NO: 62126 - DNA, 20 bp, Artificial
  CRISPR gRNA sequence
tgtcttcacagcctgcagca

SEQ ID NO: 62127 - DNA, 20 bp, Artificial
  CRISPR gRNA sequence
gtagcattaaatagtaaata

SEQ ID NO: 62128 - DNA, 20 bp, Artificial
  CRISPR gRNA sequence
tatgctgcagagacttttaa

SEQ ID NO: 62129 - DNA, 20 bp, Artificial
  CRISPR gRNA sequence
aaaaaaaaaagaaaagaaaa

SEQ ID NO: 62130 - DNA, 20 bp, Artificial
  CRISPR gRNA sequence
gaccagcctgctcaacatgg

SEQ ID NO: 62131 - DNA, 20 bp, Artificial
  CRISPR gRNA sequence
aggggccgtgggtgctctga

SEQ ID NO: 62132 - DNA, 20 bp, Artificial
  CRISPR gRNA sequence
taaaataaagaaatccaaga

SEQ ID NO: 62133 - DNA, 20 bp, Artificial
  CRISPR gRNA sequence
caggttcaaacatataacca

SEQ ID NO: 62134 - DNA, 20 bp, Artificial
  CRISPR gRNA sequence
tagctgatgtgctaaaaaaa

SEQ ID NO: 62135 - DNA, 20 bp, Artificial
  CRISPR gRNA sequence
gatgtgctaaaaaaaaaaaa

SEQ ID NO: 62136 - DNA, 20 bp, Artificial
  CRISPR gRNA sequence
cagagaagccctgcagcaaa

SEQ ID NO: 62137 - DNA, 20 bp, Artificial
  CRISPR gRNA sequence
gcagaattcccccaaagtat

SEQ ID NO: 62138 - DNA, 20 bp, Artificial
  CRISPR gRNA sequence
tctcaatagtgctaaggttt

SEQ ID NO: 62139 - DNA, 20 bp, Artificial
  CRISPR gRNA sequence
tgaaatctgtgcttgcaggt

SEQ ID NO: 62140 - DNA, 20 bp, Artificial
  CRISPR gRNA sequence
agtatgcagactgcctacca

SEQ ID NO: 62141 - DNA, 20 bp, Artificial
  CRISPR gRNA sequence
ctctgctggcagatgggggc

SEQ ID NO: 62142 - DNA, 20 bp, Artificial
  CRISPR gRNA sequence
attatttctgaaactgtagt

SEQ ID NO: 62143 - DNA, 20 bp, Artificial
  CRISPR gRNA sequence
accagcctgatcaacatggt

SEQ ID NO: 62144 - DNA, 20 bp, Artificial
  CRISPR gRNA sequence
tctcaaaataaataaataaa

SEQ ID NO: 62145 - DNA, 20 bp, Artificial
  CRISPR gRNA sequence
tcctgaatttcctctcattc

SEQ ID NO: 62146 - DNA, 20 bp, Artificial
  CRISPR gRNA sequence
acacaatacacacaccccac

SEQ ID NO: 62147 - DNA, 20 bp, Artificial
  CRISPR gRNA sequence
tctgttcactatgatcattt

SEQ ID NO: 62148 - DNA, 20 bp, Artificial
  CRISPR gRNA sequence
aagtagaaagaataattttt

SEQ ID NO: 62149 - DNA, 20 bp, Artificial
  CRISPR gRNA sequence
cagtttcatgtttgtgccca

SEQ ID NO: 62150 - DNA, 20 bp, Artificial
  CRISPR gRNA sequence
ccggaactcttttcctcttg

SEQ ID NO: 62151 - DNA, 20 bp, Artificial
  CRISPR gRNA sequence
tttaaatattattttatttc

SEQ ID NO: 62152 - DNA, 20 bp, Artificial
  CRISPR gRNA sequence
gccaaaataacattttcaaa

SEQ ID NO: 62153 - DNA, 20 bp, Artificial
  CRISPR gRNA sequence
gaccagcctggacaacatgg

SEQ ID NO: 62154 - DNA, 20 bp, Artificial
  CRISPR gRNA sequence
tccagtctgggcaacaagag

SEQ ID NO: 62155 - DNA, 20 bp, Artificial
  CRISPR gRNA sequence
atagttttaaaatgagcaaa

SEQ ID NO: 62156 - DNA, 20 bp, Artificial
  CRISPR gRNA sequence
gaggaagacatccccagaat

SEQ ID NO: 62157 - DNA, 20 bp, Artificial
  CRISPR gRNA sequence
acatactggactagatgttc

SEQ ID NO: 62158 - DNA, 20 bp, Artificial
  CRISPR gRNA sequence
ccggggatgacaccccctga

SEQ ID NO: 62159 - DNA, 20 bp, Artificial
  CRISPR gRNA sequence
cccaaagtcccacatccagg

SEQ ID NO: 62160 - DNA, 20 bp, Artificial
  CRISPR gRNA sequence
ttactttcaatgtgattttt

SEQ ID NO: 62161 - DNA, 20 bp, Artificial
  CRISPR gRNA sequence
aaacatgaaatcttgtgact

SEQ ID NO: 62162 - DNA, 20 bp, Artificial
  CRISPR gRNA sequence
tttgcaaaataaaagaaagt

SEQ ID NO: 62163 - DNA, 20 bp, Artificial
  CRISPR gRNA sequence
acaataccctgggtttaagg

SEQ ID NO: 62164 - DNA, 20 bp, Artificial
  CRISPR gRNA sequence
ccctaccctgcagcttggcg

SEQ ID NO: 62165 - DNA, 20 bp, Artificial
  CRISPR gRNA sequence
tcaagaaaggaagtctttcc

SEQ ID NO: 62166 - DNA, 20 bp, Artificial
  CRISPR gRNA sequence
gagctgcaggtaatgttggg

SEQ ID NO: 62167 - DNA, 20 bp, Artificial
  CRISPR gRNA sequence
cctttttaaccaaaagggtt

SEQ ID NO: 62168 - DNA, 20 bp, Artificial
  CRISPR gRNA sequence
cctatcaggtggcctctctt

SEQ ID NO: 62169 - DNA, 20 bp, Artificial
  CRISPR gRNA sequence
caatttcagacagatggaag

SEQ ID NO: 62170 - DNA, 20 bp, Artificial
  CRISPR gRNA sequence
ttttattgctactatcaatg

SEQ ID NO: 62171 - DNA, 20 bp, Artificial
  CRISPR gRNA sequence
cccaaaaggaaggttggacc

SEQ ID NO: 62172 - DNA, 20 bp, Artificial
  CRISPR gRNA sequence
taaaaaaaaaaaaaaaaaaa

SEQ ID NO: 62173 - DNA, 20 bp, Artificial
  CRISPR gRNA sequence
tgtggctcaagcttggggga

SEQ ID NO: 62174 - DNA, 20 bp, Artificial
  CRISPR gRNA sequence
aggaattcatatgctggtag

SEQ ID NO: 62175 - DNA, 20 bp, Artificial
  CRISPR gRNA sequence
tgtccccagtgtccaggtga

SEQ ID NO: 62176 - DNA, 20 bp, Artificial
  CRISPR gRNA sequence
cttgctctgcctgggtagga

SEQ ID NO: 62177 - DNA, 20 bp, Artificial
  CRISPR gRNA sequence
caagagcgaaactctgtctc

SEQ ID NO: 62178 - DNA, 20 bp, Artificial
  CRISPR gRNA sequence
gctgcttcaggaacagaacc

SEQ ID NO: 62179 - DNA, 20 bp, Artificial
  CRISPR gRNA sequence
ggctactttcaagctgaatt

SEQ ID NO: 62180 - DNA, 20 bp, Artificial
  CRISPR gRNA sequence
aacatggcggtttgtgttca

SEQ ID NO: 62181 - DNA, 20 bp, Artificial
  CRISPR gRNA sequence
gtcagtggcgaaattcagac

SEQ ID NO: 62182 - DNA, 20 bp, Artificial
  CRISPR gRNA sequence
gttcgcagttattttaaaag

SEQ ID NO: 62183 - DNA, 20 bp, Artificial
  CRISPR gRNA sequence
aacatagctgagtgggatgc

SEQ ID NO: 62184 - DNA, 20 bp, Artificial
  CRISPR gRNA sequence
cctgctaccctggggacatg

SEQ ID NO: 62185 - DNA, 20 bp, Artificial
  CRISPR gRNA sequence
tgagttttttttgctcattt

SEQ ID NO: 62186 - DNA, 20 bp, Artificial
  CRISPR gRNA sequence
taaggaaaccaaactgtata

SEQ ID NO: 62187 - DNA, 20 bp, Artificial
  CRISPR gRNA sequence
aacagggagagagatgtgtg

SEQ ID NO: 62188 - DNA, 20 bp, Artificial
  CRISPR gRNA sequence
ccccgtctctactaaaaata

SEQ ID NO: 62189 - DNA, 20 bp, Artificial
  CRISPR gRNA sequence
gagatcaagatcatcctggg

SEQ ID NO: 62190 - DNA, 20 bp, Artificial
  CRISPR gRNA sequence
caggctttcaagggttaaag

SEQ ID NO: 62191 - DNA, 20 bp, Artificial
  CRISPR gRNA sequence
aaaaatttccctctataatg

SEQ ID NO: 62192 - DNA, 20 bp, Artificial
  CRISPR gRNA sequence
tccctctataatgaaaaaca

SEQ ID NO: 62193 - DNA, 20 bp, Artificial
  CRISPR gRNA sequence
tggtgagacttcatctctta

SEQ ID NO: 62194 - DNA, 20 bp, Artificial
  CRISPR gRNA sequence
agcactcagtctgaactttt

SEQ ID NO: 62195 - DNA, 20 bp, Artificial
  CRISPR gRNA sequence
ccccacaaaaaagaaagaaa

SEQ ID NO: 62196 - DNA, 20 bp, Artificial
  CRISPR gRNA sequence
tctcctccctccctcccaga

SEQ ID NO: 62197 - DNA, 20 bp, Artificial
  CRISPR gRNA sequence
agttgtgccaggtaaaatga

SEQ ID NO: 62198 - DNA, 20 bp, Artificial
  CRISPR gRNA sequence
acaaggaaccgggaaatagg

SEQ ID NO: 62199 - DNA, 20 bp, Artificial
  CRISPR gRNA sequence
ccatgaaggttagtgttccg

SEQ ID NO: 62200 - DNA, 20 bp, Artificial
  CRISPR gRNA sequence
gaaattccacctctactaca

SEQ ID NO: 62201 - DNA, 20 bp, Artificial
  CRISPR gRNA sequence
caaaaaaataaaaaagaaaa

SEQ ID NO: 62202 - DNA, 20 bp, Artificial
  CRISPR gRNA sequence
gcactgactgcagtgctaca

SEQ ID NO: 62203 - DNA, 20 bp, Artificial
  CRISPR gRNA sequence
gactgcagtgctacacaaaa

SEQ ID NO: 62204 - DNA, 20 bp, Artificial
  CRISPR gRNA sequence
caaaaattcgtaaactttct

SEQ ID NO: 62205 - DNA, 20 bp, Artificial
  CRISPR gRNA sequence
ggcatcagtatatactctgt

SEQ ID NO: 62206 - DNA, 20 bp, Artificial
  CRISPR gRNA sequence
tccagcctgggcaacaagag

SEQ ID NO: 62207 - DNA, 20 bp, Artificial
  CRISPR gRNA sequence
aaaaagactgaagcaaaatg

SEQ ID NO: 62208 - DNA, 20 bp, Artificial
  CRISPR gRNA sequence
atggaaaacacagatgctat

SEQ ID NO: 62209 - DNA, 20 bp, Artificial
  CRISPR gRNA sequence
gcattgcctccttccaaggg

SEQ ID NO: 62210 - DNA, 20 bp, Artificial
  CRISPR gRNA sequence
aaggtcacatgaggacatac

SEQ ID NO: 62211 - DNA, 20 bp, Artificial
  CRISPR gRNA sequence
cttccttcccagcattgcac

SEQ ID NO: 62212 - DNA, 20 bp, Artificial
  CRISPR gRNA sequence
gaacagttgatctaaatctt

SEQ ID NO: 62213 - DNA, 20 bp, Artificial
  CRISPR gRNA sequence
gtgtcagcctgcccagggac

SEQ ID NO: 62214 - DNA, 20 bp, Artificial
  CRISPR gRNA sequence
ataacagttaaataaactga

SEQ ID NO: 62215 - DNA, 20 bp, Artificial
  CRISPR gRNA sequence
tttcctggcaagtcttaaaa

SEQ ID NO: 62216 - DNA, 20 bp, Artificial
  CRISPR gRNA sequence
agaagtgtgtgagcttgtta

SEQ ID NO: 62217 - DNA, 20 bp, Artificial
  CRISPR gRNA sequence
ttacagtgaggtaatggatg

SEQ ID NO: 62218 - DNA, 20 bp, Artificial
  CRISPR gRNA sequence
cggctcccttttctcttttc

SEQ ID NO: 62219 - DNA, 20 bp, Artificial
  CRISPR gRNA sequence
agagtgttttaaaaagtcag

SEQ ID NO: 62220 - DNA, 20 bp, Artificial
  CRISPR gRNA sequence
cacctaacctaccccatgat

SEQ ID NO: 62221 - DNA, 20 bp, Artificial
  CRISPR gRNA sequence
tctgaaggtaaagctgtgag

SEQ ID NO: 62222 - DNA, 20 bp, Artificial
  CRISPR gRNA sequence
gtcactgagctggttgtccc

SEQ ID NO: 62223 - DNA, 20 bp, Artificial
  CRISPR gRNA sequence
tccctctctgggtctcactg

SEQ ID NO: 62224 - DNA, 20 bp, Artificial
  CRISPR gRNA sequence
gagtttgagaaaggaagaag

SEQ ID NO: 62225 - DNA, 20 bp, Artificial
  CRISPR gRNA sequence
tgagttcccattttctctcc

SEQ ID NO: 62226 - DNA, 20 bp, Artificial
  CRISPR gRNA sequence
cactgtttctgaccatgttg

SEQ ID NO: 62227 - DNA, 20 bp, Artificial
  CRISPR gRNA sequence
tgcaaaacaaacaaacaaac

SEQ ID NO: 62228 - DNA, 20 bp, Artificial
  CRISPR gRNA sequence
aagaccttgtctcaaaaata

SEQ ID NO: 62229 - DNA, 20 bp, Artificial
  CRISPR gRNA sequence
aaaaataaaaaacaaacaaa

SEQ ID NO: 62230 - DNA, 20 bp, Artificial
  CRISPR gRNA sequence
aacaagagcaacaacaaaca

SEQ ID NO: 62231 - DNA, 20 bp, Artificial
  CRISPR gRNA sequence
gggtagattagatgctgtct

SEQ ID NO: 62232 - DNA, 20 bp, Artificial
  CRISPR gRNA sequence
cggcaggcaggggcaagggc

SEQ ID NO: 62233 - DNA, 20 bp, Artificial
  CRISPR gRNA sequence
gtgcctggtttacagcattc

SEQ ID NO: 62234 - DNA, 20 bp, Artificial
  CRISPR gRNA sequence
gtttacagcattccttttgg

SEQ ID NO: 62235 - DNA, 20 bp, Artificial
  CRISPR gRNA sequence
acagcattccttttggagtc

SEQ ID NO: 62236 - DNA, 20 bp, Artificial
  CRISPR gRNA sequence
cagcattccttttggagtct

SEQ ID NO: 62237 - DNA, 20 bp, Artificial
  CRISPR gRNA sequence
cttttggagtctggaatagt

SEQ ID NO: 62238 - DNA, 20 bp, Artificial
  CRISPR gRNA sequence
ttggagtctggaatagtggg

SEQ ID NO: 62239 - DNA, 20 bp, Artificial
  CRISPR gRNA sequence
tggagtctggaatagtgggg

SEQ ID NO: 62240 - DNA, 20 bp, Artificial
  CRISPR gRNA sequence
ggagtctggaatagtgggga

SEQ ID NO: 62241 - DNA, 20 bp, Artificial
  CRISPR gRNA sequence
gagtctggaatagtggggaa

SEQ ID NO: 62242 - DNA, 20 bp, Artificial
  CRISPR gRNA sequence
gaatagtggggaaaactccc

SEQ ID NO: 62243 - DNA, 20 bp, Artificial
  CRISPR gRNA sequence
cctgtcttctctccccttag

SEQ ID NO: 62244 - DNA, 20 bp, Artificial
  CRISPR gRNA sequence
tcttctctccccttaggagt

SEQ ID NO: 62245 - DNA, 20 bp, Artificial
  CRISPR gRNA sequence
ctctccccttaggagtctgc

SEQ ID NO: 62246 - DNA, 20 bp, Artificial
  CRISPR gRNA sequence
tctccccttaggagtctgca

SEQ ID NO: 62247 - DNA, 20 bp, Artificial
  CRISPR gRNA sequence
tccccttaggagtctgcact

SEQ ID NO: 62248 - DNA, 20 bp, Artificial
  CRISPR gRNA sequence
cccttaggagtctgcactat

SEQ ID NO: 62249 - DNA, 20 bp, Artificial
  CRISPR gRNA sequence
aggagtctgcactatggaaa

SEQ ID NO: 62250 - DNA, 20 bp, Artificial
  CRISPR gRNA sequence
ggagtctgcactatggaaac

SEQ ID NO: 62251 - DNA, 20 bp, Artificial
  CRISPR gRNA sequence
cactatggaaacaacctgtc

SEQ ID NO: 62252 - DNA, 20 bp, Artificial
  CRISPR gRNA sequence
tggaaacaacctgtcaatcc

SEQ ID NO: 62253 - DNA, 20 bp, Artificial
  CRISPR gRNA sequence
tcaatccagctcaaggcaca

SEQ ID NO: 62254 - DNA, 20 bp, Artificial
  CRISPR gRNA sequence
aaggcacacatagcccagac

SEQ ID NO: 62255 - DNA, 20 bp, Artificial
  CRISPR gRNA sequence
tccgtggggaccctagagca

SEQ ID NO: 62256 - DNA, 20 bp, Artificial
  CRISPR gRNA sequence
cgtggggaccctagagcacc

SEQ ID NO: 62257 - DNA, 20 bp, Artificial
  CRISPR gRNA sequence
gagcacctatcatgaacgag

SEQ ID NO: 62258 - DNA, 20 bp, Artificial
  CRISPR gRNA sequence
tcatgaacgaggagaccaag

SEQ ID NO: 62259 - DNA, 20 bp, Artificial
  CRISPR gRNA sequence
ttctctccccttcacctcct

SEQ ID NO: 62260 - DNA, 20 bp, Artificial
  CRISPR gRNA sequence
tctctccccttcacctcctc

SEQ ID NO: 62261 - DNA, 20 bp, Artificial
  CRISPR gRNA sequence
ctctccccttcacctcctct

SEQ ID NO: 62262 - DNA, 20 bp, Artificial
  CRISPR gRNA sequence
tctccccttcacctcctctt

SEQ ID NO: 62263 - DNA, 20 bp, Artificial
  CRISPR gRNA sequence
tccccttcacctcctctttt

SEQ ID NO: 62264 - DNA, 20 bp, Artificial
  CRISPR gRNA sequence
cccttcacctcctcttttcc

SEQ ID NO: 62265 - DNA, 20 bp, Artificial
  CRISPR gRNA sequence
cacctcctcttttcccctcc

SEQ ID NO: 62266 - DNA, 20 bp, Artificial
  CRISPR gRNA sequence
acctcctcttttcccctcct

SEQ ID NO: 62267 - DNA, 20 bp, Artificial
  CRISPR gRNA sequence
ctcttttcccctcctatcta

SEQ ID NO: 62268 - DNA, 20 bp, Artificial
  CRISPR gRNA sequence
ttttcccctcctatctactt

SEQ ID NO: 62269 - DNA, 20 bp, Artificial
  CRISPR gRNA sequence
ttcccctcctatctacttcg

SEQ ID NO: 62270 - DNA, 20 bp, Artificial
  CRISPR gRNA sequence
tcccctcctatctacttcgt

SEQ ID NO: 62271 - DNA, 20 bp, Artificial
  CRISPR gRNA sequence
cccctcctatctacttcgtc

SEQ ID NO: 62272 - DNA, 20 bp, Artificial
  CRISPR gRNA sequence
ccctcctatctacttcgtca

SEQ ID NO: 62273 - DNA, 20 bp, Artificial
  CRISPR gRNA sequence
ctatctacttcgtcactttt

SEQ ID NO: 62274 - DNA, 20 bp, Artificial
  CRISPR gRNA sequence
tctacttcgtcacttttctc

SEQ ID NO: 62275 - DNA, 20 bp, Artificial
  CRISPR gRNA sequence
cttcgtcacttttctcctac

SEQ ID NO: 62276 - DNA, 20 bp, Artificial
  CRISPR gRNA sequence
cgtcacttttctcctactgc

SEQ ID NO: 62277 - DNA, 20 bp, Artificial
  CRISPR gRNA sequence
gtcacttttctcctactgcc

SEQ ID NO: 62278 - DNA, 20 bp, Artificial
  CRISPR gRNA sequence
ttctcctactgccaagactg

SEQ ID NO: 62279 - DNA, 20 bp, Artificial
  CRISPR gRNA sequence
tctcctactgccaagactgg

SEQ ID NO: 62280 - DNA, 20 bp, Artificial
  CRISPR gRNA sequence
ctcctactgccaagactggt

SEQ ID NO: 62281 - DNA, 20 bp, Artificial
  CRISPR gRNA sequence
tcctactgccaagactggtc

SEQ ID NO: 62282 - DNA, 20 bp, Artificial
  CRISPR gRNA sequence
ctactgccaagactggtccc

SEQ ID NO: 62283 - DNA, 20 bp, Artificial
  CRISPR gRNA sequence
ctgccaagactggtccctac

SEQ ID NO: 62284 - DNA, 20 bp, Artificial
  CRISPR gRNA sequence
ccaagactggtccctaccca

SEQ ID NO: 62285 - DNA, 20 bp, Artificial
  CRISPR gRNA sequence
gtccctacccaaatctgcct

SEQ ID NO: 62286 - DNA, 20 bp, Artificial
  CRISPR gRNA sequence
cccaaatctgccttactggg

SEQ ID NO: 62287 - DNA, 20 bp, Artificial
  CRISPR gRNA sequence
ccttactgggctgcccccaa

SEQ ID NO: 62288 - DNA, 20 bp, Artificial
  CRISPR gRNA sequence
actgggctgcccccaacaca

SEQ ID NO: 62289 - DNA, 20 bp, Artificial
  CRISPR gRNA sequence
ctgggctgcccccaacacaa

SEQ ID NO: 62290 - DNA, 20 bp, Artificial
  CRISPR gRNA sequence
ggctgcccccaacacaacaa

SEQ ID NO: 62291 - DNA, 20 bp, Artificial
  CRISPR gRNA sequence
cccccaacacaacaaacctg

SEQ ID NO: 62292 - DNA, 20 bp, Artificial
  CRISPR gRNA sequence
cccttgaccatcattcagca

SEQ ID NO: 62293 - DNA, 20 bp, Artificial
  CRISPR gRNA sequence
gaccatcattcagcatgaga

SEQ ID NO: 62294 - DNA, 20 bp, Artificial
  CRISPR gRNA sequence
accatcattcagcatgagaa
